United States Patent 11,332,783 (SAMPLE ANALYSIS, PRESENCE DETERMINATION OF A TARGET SEQUENCE) - sequence listing, part 18

SEQ ID NO: 363098 - DNA, 140 bp, Artificial Sequence
  Synthetic
atggccgactcccaagtacgtttttttttttttttttttttttttttttgaaatattaaaaacaaaataacatctcctacgtccctgtgggttcggagaatcgtggaagagttcggtatgggagacccagcatggcgtat

SEQ ID NO: 363099 - DNA, 140 bp, Artificial Sequence; identical to SEQ ID NO: 8487
  Synthetic

SEQ ID NO: 363100 - DNA, 140 bp, Artificial Sequence; identical to SEQ ID NO: 8488
  Synthetic

SEQ ID NO: 363101 - DNA, 140 bp, Artificial Sequence
  Synthetic
aggccctggctgctgatatgtgtgcaactgtctgaagctcttgccatgctgctgtaagcttcctaaaagcagccgaactcactttgagacgtaggcatagtataccgaactcttccactagaccttttgggacagcggtg

SEQ ID NO: 363102 - DNA, 140 bp, Artificial Sequence
  Synthetic
caccgctgtcccaaaaggtctagtggaagagttcggtatactatgcctacgtctcaaagtgagttcggctgcttttaggaagcttacagcagcatggcaagagcttcagacagttgcacacatatcagcagccagggcct

SEQ ID NO: 363103 - DNA, 140 bp, Artificial Sequence
  Synthetic
atacgccatgctgggtctccaagcccttattccgctggcagccctgattgtcctatgtaactgtctgagactcctaccatgctgttgtaaaatgttgacttttttagccgtactgagcgtcgtacttgggagtcggccat

SEQ ID NO: 363104 - DNA, 140 bp, Artificial Sequence
  Synthetic
atggccgactcccaagtacgacgctcagtacggctaaaaaagtcaacattttacaacagcatggtaggagtctcagacagttacataggacaatcagggctgccagcggaataagggcttggagacccagcatggcgtat

SEQ ID NO: 363105 - DNA, 140 bp, Artificial Sequence; identical to SEQ ID NO: 12197
  Synthetic

SEQ ID NO: 363106 - DNA, 140 bp, Artificial Sequence; identical to SEQ ID NO: 12198
  Synthetic

SEQ ID NO: 363107 - DNA, 140 bp, Artificial Sequence
  Synthetic
aggccctggctgctgatatgcggtgcccacactgtgagcgcgtacgaacacgtaacagtgatcccgaacacggtgggagtaccgtataagactctagtcaacagaccgggctacagccccgaccttttgggacagcggtg

SEQ ID NO: 363108 - DNA, 140 bp, Artificial Sequence
  Synthetic
caccgctgtcccaaaaggtcggggctgtagcccggtctgttgactagagtcttatacggtactcccaccgtgttcgggatcactgttacgtgttcgtacgcgctcacagtgtgggcaccgcatatcagcagccagggcct

SEQ ID NO: 363109 - DNA, 140 bp, Artificial Sequence
  Synthetic
aggccctggctgctgatatgattactggaacaatgggacacttcattctggcccgatgtccgaaaggagaaactctgacggtgggattcactgacggtaggaagatcagtcactcatgtagaccttttgggacagcggtg

SEQ ID NO: 363110 - DNA, 140 bp, Artificial Sequence
  Synthetic
caccgctgtcccaaaaggtctacatgagtgactgatcttcctaccgtcagtgaatcccaccgtcagagtttctcctttcggacatcgggccagaatgaagtgtcccattgttccagtaatcatatcagcagccagggcct

SEQ ID NO: 363111 - DNA, 140 bp, Artificial Sequence; identical to SEQ ID NO: 6045
  Synthetic

SEQ ID NO: 363112 - DNA, 140 bp, Artificial Sequence; identical to SEQ ID NO: 6046
  Synthetic

SEQ ID NO: 363113 - DNA, 140 bp, Artificial Sequence
  Synthetic
aggccctggctgctgatatgtaccagcctgcacccattcctcagactttgggggcgtcgccattattaaatatgcagccagcaagaaaggcaagtgtgcggtgcattcgatgactaacgcgaccttttgggacagcggtg

SEQ ID NO: 363114 - DNA, 140 bp, Artificial Sequence
  Synthetic
caccgctgtcccaaaaggtcgcgttagtcatcgaatgcaccgcacacttgcctttcttgctggctgcatatttaataatggcgacgcccccaaagtctgaggaatgggtgcaggctggtacatatcagcagccagggcct

SEQ ID NO: 363115 - DNA, 140 bp, Artificial Sequence
  Synthetic
atacgccatgctgggtctccgagactgctcaaaccgggtggctctctattgatcagagcatatggttacgcagatagaaccagtgaacgagtcatctgcgtattgggacgcaagtttagacgtacttgggagtcggccat

SEQ ID NO: 363116 - DNA, 140 bp, Artificial Sequence
  Synthetic
atggccgactcccaagtacgtctaaacttgcgtcccaatacgcagatgactcgttcactggttctatctgcgtaaccatatgctctgatcaatagagagccacccggtttgagcagtctcggagacccagcatggcgtat

SEQ ID NO: 363117 - DNA, 140 bp, Artificial Sequence
  Synthetic
atacgccatgctgggtctccattttgatgaaggggagattgaaagcttgtcctctgagttactgacctttggggacttctcgccgggcgaagtggatgacctgacagacagcgactggtccgtacttgggagtcggccat

SEQ ID NO: 363118 - DNA, 140 bp, Artificial Sequence
  Synthetic
atggccgactcccaagtacggaccagtcgctgtctgtcaggtcatccacttcgcccggcgagaagtccccaaaggtcagtaactcagaggacaagctttcaatctccccttcatcaaaatggagacccagcatggcgtat

SEQ ID NO: 363119 - DNA, 140 bp, Artificial Sequence; identical to SEQ ID NO: 5053
  Synthetic

SEQ ID NO: 363120 - DNA, 140 bp, Artificial Sequence; identical to SEQ ID NO: 5054
  Synthetic

SEQ ID NO: 363121 - DNA, 140 bp, Artificial Sequence
  Synthetic
aggccctggctgctgatatgatcgtggtgtacaaaggcgacgtctacaacatggactacccgcccttcggcgcaggaagaccaggacaatttggcgacatccaaagtcgcacgcctgagagaccttttgggacagcggtg

SEQ ID NO: 363122 - DNA, 140 bp, Artificial Sequence
  Synthetic
caccgctgtcccaaaaggtctctcaggcgtgcgactttggatgtcgccaaattgtcctggtcttcctgcgccgaagggcgggtagtccatgttgtagacgtcgcctttgtacaccacgatcatatcagcagccagggcct

SEQ ID NO: 363123 - DNA, 140 bp, Artificial Sequence; identical to SEQ ID NO: 6167
  Synthetic

SEQ ID NO: 363124 - DNA, 140 bp, Artificial Sequence; identical to SEQ ID NO: 6168
  Synthetic

SEQ ID NO: 363125 - DNA, 140 bp, Artificial Sequence
  Synthetic
atacgccatgctgggtctccgcgaagacgtctatgctaatacacaactggtactgcagagaccgtccgcgggtacggtgcacgtgccgtactctcaggcaccatctggcttcaagtattgcgtacttgggagtcggccat

SEQ ID NO: 363126 - DNA, 140 bp, Artificial Sequence
  Synthetic
atggccgactcccaagtacgcaatacttgaagccagatggtgcctgagagtacggcacgtgcaccgtacccgcggacggtctctgcagtaccagttgtgtattagcatagacgtcttcgcggagacccagcatggcgtat

SEQ ID NO: 363127 - DNA, 140 bp, Artificial Sequence
  Synthetic
aggccctggctgctgatatgcgacgagagagaagggaacgtacttcccatggctagcgttcggtttttcagagcggatctgcactccatcgtacaggaaacggcagagatacgcgatacggaccttttgggacagcggtg

SEQ ID NO: 363128 - DNA, 140 bp, Artificial Sequence
  Synthetic
caccgctgtcccaaaaggtccgtatcgcgtatctctgccgtttcctgtacgatggagtgcagatccgctctgaaaaaccgaacgctagccatgggaagtacgttcccttctctctcgtcgcatatcagcagccagggcct

SEQ ID NO: 363129 - DNA, 140 bp, Artificial Sequence; identical to SEQ ID NO: 5063
  Synthetic

SEQ ID NO: 363130 - DNA, 140 bp, Artificial Sequence; identical to SEQ ID NO: 5064
  Synthetic

SEQ ID NO: 363131 - DNA, 140 bp, Artificial Sequence; identical to SEQ ID NO: 10523
  Synthetic

SEQ ID NO: 363132 - DNA, 140 bp, Artificial Sequence; identical to SEQ ID NO: 10524
  Synthetic

SEQ ID NO: 363133 - DNA, 140 bp, Artificial Sequence
  Synthetic
atacgccatgctgggtctccagaagacgggcgctggctgatgaagtaatcagatggcaacgaacagggctaatagatgagctggagaaagcggtgtactctaggtacgaagtgcagggtacgtacttgggagtcggccat

SEQ ID NO: 363134 - DNA, 140 bp, Artificial Sequence
  Synthetic
atggccgactcccaagtacgtaccctgcacttcgtacctagagtacaccgctttctccagctcatctattagccctgttcgttgccatctgattacttcatcagccagcgcccgtcttctggagacccagcatggcgtat

SEQ ID NO: 363135 - DNA, 140 bp, Artificial Sequence
  Synthetic
atacgccatgctgggtctccaaagatcacagtcaatggccagacggtgcggtacaagtgtaattgcggtggctcaaatgaaggactaacaactacagacaaagtgattaataactgcaagcgtacttgggagtcggccat

SEQ ID NO: 363136 - DNA, 140 bp, Artificial Sequence
  Synthetic
atggccgactcccaagtacgcttgcagttattaatcactttgtctgtagttgttagtccttcatttgagccaccgcaattacacttgtaccgcaccgtctggccattgactgtgatctttggagacccagcatggcgtat

SEQ ID NO: 363137 - DNA, 140 bp, Artificial Sequence
  Synthetic
atacgccatgctgggtctcccttgctctccccaccgccaaagacgcagtactaaggacaattttaatgtctataaagccacaagaccatatctagctcattgtcctgactgcggagaaggcgtacttgggagtcggccat

SEQ ID NO: 363138 - DNA, 140 bp, Artificial Sequence
  Synthetic
atggccgactcccaagtacgccttctccgcagtcaggacaatgagctagatatggtcttgtggctttatagacattaaaattgtccttagtactgcgtctttggcggtggggagagcaagggagacccagcatggcgtat

SEQ ID NO: 363139 - DNA, 140 bp, Artificial Sequence
  Synthetic
aggccctggctgctgatatgctaggtatgaaggcatacgcgtccctaaagagacacaccacatatagctaagaatcaatagataagtatagtaacaaaatataaaaatcaacaaaaatcagaccttttgggacagcggtg

SEQ ID NO: 363140 - DNA, 140 bp, Artificial Sequence
  Synthetic
caccgctgtcccaaaaggtctgatttttgttgatttttatattttgttactatacttatctattgattcttagctatatgtggtgtgtctctttagggacgcgtatgccttcatacctagcatatcagcagccagggcct

SEQ ID NO: 363141 - DNA, 140 bp, Artificial Sequence
  Synthetic
aggccctggctgctgatatggagacgctgacagtgggatttacggacagcagaaagatcagccacacatgcacacacccgttccatcatgaaccacctgtgataggtagggagaggttccgaccttttgggacagcggtg

SEQ ID NO: 363142 - DNA, 140 bp, Artificial Sequence
  Synthetic
caccgctgtcccaaaaggtcggaacctctccctacctatcacaggtggttcatgatggaacgggtgtgtgcatgtgtggctgatctttctgctgtccgtaaatcccactgtcagcgtctccatatcagcagccagggcct

SEQ ID NO: 363143 - DNA, 140 bp, Artificial Sequence
  Synthetic
aggccctggctgctgatatgcgagagagaagggaacataacacccatggctagcgtccgattctttagggcagagctgcgtccggtcgtacaagaaacagcggagacgcgtgacacagcagaccttttgggacagcggtg

SEQ ID NO: 363144 - DNA, 140 bp, Artificial Sequence
  Synthetic
caccgctgtcccaaaaggtctgctgtgtcacgcgtctccgctgtttcttgtacgaccggacgcagctctgccctaaagaatcggacgctagccatgggtgttatgttcccttctctctcgcatatcagcagccagggcct

SEQ ID NO: 363145 - DNA, 140 bp, Artificial Sequence
  Synthetic
aggccctggctgctgatatgatattacgaggctgcggcatatctatggaacgaacagcagcccctgttctggttgcaggctcttatcccgctggccgccttgatcgtcctgtgcaactgtgaccttttgggacagcggtg

SEQ ID NO: 363146 - DNA, 140 bp, Artificial Sequence
  Synthetic
caccgctgtcccaaaaggtcacagttgcacaggacgatcaaggcggccagcgggataagagcctgcaaccagaacaggggctgctgttcgttccatagatatgccgcagcctcgtaatatcatatcagcagccagggcct

SEQ ID NO: 363147 - DNA, 140 bp, Artificial Sequence
  Synthetic
atacgccatgctgggtctccaacccacagggacgtaggagatgttcaaagtgactataaaaaccctgaacagtaataaaacataaaattaataatgagtaccataattggcaaacggaagcgtacttgggagtcggccat

SEQ ID NO: 363148 - DNA, 140 bp, Artificial Sequence
  Synthetic
atggccgactcccaagtacgcttccgtttgccaattatggtactcattattaattttatgttttattactgttcagggtttttatagtcactttgaacatctcctacgtccctgtgggttggagacccagcatggcgtat

SEQ ID NO: 363149 - DNA, 140 bp, Artificial Sequence; identical to SEQ ID NO: 5097
  Synthetic

SEQ ID NO: 363150 - DNA, 140 bp, Artificial Sequence; identical to SEQ ID NO: 5098
  Synthetic

SEQ ID NO: 363151 - DNA, 140 bp, Artificial Sequence
  Synthetic
aggccctggctgctgatatgacgcaaagtggaaaatatgaaagcaacaatcatccagagactaaagagaggctgtaaactgtatttaatggcagagaccccgaaagtcccgacttatcgggaccttttgggacagcggtg

SEQ ID NO: 363152 - DNA, 140 bp, Artificial Sequence
  Synthetic
caccgctgtcccaaaaggtcccgataagtcgggactttcggggtctctgccattaaatacagtttacagcctctctttagtctctggatgattgttgctttcatattttccactttgcgtcatatcagcagccagggcct

SEQ ID NO: 363153 - DNA, 140 bp, Artificial Sequence
  Synthetic
aggccctggctgctgatatgactgtcccgtgcctctgccgttacgccatgacaccagaacgcgttacccgacttcgcatgaaccatgtcacaagcataattgtgtgttcttcgtttccccgaccttttgggacagcggtg

SEQ ID NO: 363154 - DNA, 140 bp, Artificial Sequence
  Synthetic
caccgctgtcccaaaaggtcggggaaacgaagaacacacaattatgcttgtgacatggttcatgcgaagtcgggtaacgcgttctggtgtcatggcgtaacggcagaggcacgggacagtcatatcagcagccagggcct

SEQ ID NO: 363155 - DNA, 140 bp, Artificial Sequence
  Synthetic
atacgccatgctgggtctccgcaacgagaagagacgtaggtatttaagcttcctaaaagcagccgaactcactttgagacgtaggcatagcataccgaactcttccactattctccgaaccgtacttgggagtcggccat

SEQ ID NO: 363156 - DNA, 140 bp, Artificial Sequence
  Synthetic
atggccgactcccaagtacggttcggagaatagtggaagagttcggtatgctatgcctacgtctcaaagtgagttcggctgcttttaggaagcttaaatacctacgtctcttctcgttgcggagacccagcatggcgtat

SEQ ID NO: 363157 - DNA, 140 bp, Artificial Sequence
  Synthetic
atacgccatgctgggtctcccccacgtcgctatatcaccaggcgattaaaggagtccgagtggcgtactgggtagggttcgacacaaccccgttcatgtacaacgctatggcgggtgcctcgtacttgggagtcggccat

SEQ ID NO: 363158 - DNA, 140 bp, Artificial Sequence
  Synthetic
atggccgactcccaagtacgaggcacccgccatagcgttgtacatgaacggggttgtgtcgaaccctacccagtacgccactcggactcctttaatcgcctggtgatatagcgacgtgggggagacccagcatggcgtat

SEQ ID NO: 363159 - DNA, 140 bp, Artificial Sequence
  Synthetic
aggccctggctgctgatatggagaagtctgaatcatgcaaaacggaatttgcatcagcatacagggcccataccgcatccgcatcagctaagctccgcgtcctttaccaaggaaataatggaccttttgggacagcggtg

SEQ ID NO: 363160 - DNA, 140 bp, Artificial Sequence
  Synthetic
caccgctgtcccaaaaggtccattatttccttggtaaaggacgcggagcttagctgatgcggatgcggtatgggccctgtatgctgatgcaaattccgttttgcatgattcagacttctccatatcagcagccagggcct

SEQ ID NO: 363161 - DNA, 140 bp, Artificial Sequence; identical to SEQ ID NO: 6407
  Synthetic

SEQ ID NO: 363162 - DNA, 140 bp, Artificial Sequence; identical to SEQ ID NO: 6408
  Synthetic

SEQ ID NO: 363163 - DNA, 140 bp, Artificial Sequence; identical to SEQ ID NO: 6035
  Synthetic

SEQ ID NO: 363164 - DNA, 140 bp, Artificial Sequence; identical to SEQ ID NO: 6036
  Synthetic

SEQ ID NO: 363165 - DNA, 140 bp, Artificial Sequence
  Synthetic
aggccctggctgctgatatgccaaactatcaagaagagtgggtgacgcataagaaggagatcaggttaaccgtgccgactgaagggctcgaggtcacgtggggtaacaatgagccgtacagaccttttgggacagcggtg

SEQ ID NO: 363166 - DNA, 140 bp, Artificial Sequence
  Synthetic
caccgctgtcccaaaaggtctgtacggctcattgttaccccacgtgacctcgagcccttcagtcggcacggttaacctgatctccttcttatgcgtcacccactcttcttgatagtttggcatatcagcagccagggcct

SEQ ID NO: 363167 - DNA, 140 bp, Artificial Sequence
  Synthetic
aggccctggctgctgatatgtgtgcaaaacaaccgatacggtagacggcgagagagtgtcattttcggtatgcacgtacgtacccgcaaccatttgtgatcaaatgacaggtattcttgcgaccttttgggacagcggtg

SEQ ID NO: 363168 - DNA, 140 bp, Artificial Sequence
  Synthetic
caccgctgtcccaaaaggtcgcaagaatacctgtcatttgatcacaaatggttgcgggtacgtacgtgcataccgaaaatgacactctctcgccgtctaccgtatcggttgttttgcacacatatcagcagccagggcct

SEQ ID NO: 363169 - DNA, 140 bp, Artificial Sequence; identical to SEQ ID NO: 8507
  Synthetic

SEQ ID NO: 363170 - DNA, 140 bp, Artificial Sequence; identical to SEQ ID NO: 8508
  Synthetic

SEQ ID NO: 363171 - DNA, 140 bp, Artificial Sequence
  Synthetic
atacgccatgctgggtctccgtctacaagaggcctgacactcagtcaattcagaaagtcccagccgaatttgacagctttgtggtaccaagtctgtggtcatctggactgtcgatcccgccgtacttgggagtcggccat

SEQ ID NO: 363172 - DNA, 140 bp, Artificial Sequence
  Synthetic
atggccgactcccaagtacggcgggatcgacagtccagatgaccacagacttggtaccacaaagctgtcaaattcggctgggactttctgaattgactgagtgtcaggcctcttgtagacggagacccagcatggcgtat

SEQ ID NO: 363173 - DNA, 140 bp, Artificial Sequence
  Synthetic
aggccctggctgctgatatgtaaaactaataaaaaccaaacgaataccataattggcaattggaagagatgtaggtacttaagcttcctaaaagcagccgaactcgctttgagatgtagggaccttttgggacagcggtg

SEQ ID NO: 363174 - DNA, 140 bp, Artificial Sequence
  Synthetic
caccgctgtcccaaaaggtccctacatctcaaagcgagttcggctgcttttaggaagcttaagtacctacatctcttccaattgccaattatggtattcgtttggtttttattagttttacatatcagcagccagggcct

SEQ ID NO: 363175 - DNA, 140 bp, Artificial Sequence; identical to SEQ ID NO: 7713
  Synthetic

SEQ ID NO: 363176 - DNA, 140 bp, Artificial Sequence; identical to SEQ ID NO: 7714
  Synthetic

SEQ ID NO: 363177 - DNA, 140 bp, Artificial Sequence; identical to SEQ ID NO: 11031
  Synthetic

SEQ ID NO: 363178 - DNA, 140 bp, Artificial Sequence; identical to SEQ ID NO: 11032
  Synthetic

SEQ ID NO: 363179 - DNA, 140 bp, Artificial Sequence
  Synthetic
aggccctggctgctgatatggtagcctaccagtttcttactgctctactctgcaaagcaagagattaataacccatcatggatcctgtgtacgtggacatagacgctgacagcgccttttgaccttttgggacagcggtg

SEQ ID NO: 363180 - DNA, 140 bp, Artificial Sequence
  Synthetic
caccgctgtcccaaaaggtcaaaaggcgctgtcagcgtctatgtccacgtacacaggatccatgatgggttattaatctcttgctttgcagagtagagcagtaagaaactggtaggctaccatatcagcagccagggcct

SEQ ID NO: 363181 - DNA, 140 bp, Artificial Sequence
  Synthetic
aggccctggctgctgatatgccatttaaagggcaagctcagcttcacatgccgctgtgatacagtggtttcgtgcgaaggctacgtcgttaagagaataacgatgagcccaggcctttacgaccttttgggacagcggtg

SEQ ID NO: 363182 - DNA, 140 bp, Artificial Sequence
  Synthetic
caccgctgtcccaaaaggtcgtaaaggcctgggctcatcgttattctcttaacgacgtagccttcgcacgaaaccactgtatcacagcggcatgtgaagctgagcttgccctttaaatggcatatcagcagccagggcct

SEQ ID NO: 363183 - DNA, 140 bp, Artificial Sequence
  Synthetic
aggccctggctgctgatatggaagaacgatgaagagtgcgtagtcaacgccgccaaccctcgcgggttaccgggtgacggtgtttgcaaggcagtatacaaaaaatggccggagtcctttgaccttttgggacagcggtg

SEQ ID NO: 363184 - DNA, 140 bp, Artificial Sequence
  Synthetic
caccgctgtcccaaaaggtcaaaggactccggccattttttgtatactgccttgcaaacaccgtcacccggtaacccgcgagggttggcggcgttgactacgcactcttcatcgttcttccatatcagcagccagggcct

SEQ ID NO: 363185 - DNA, 140 bp, Artificial Sequence
  Synthetic
aggccctggctgctgatatggacctggatgctgacgccccagccctagaaccagcccttgacgacggggcgatacacacgttgccatctgcaaccggaaaccttgcggccgtgtctgactgaccttttgggacagcggtg

SEQ ID NO: 363186 - DNA, 140 bp, Artificial Sequence
  Synthetic
caccgctgtcccaaaaggtcagtcagacacggccgcaaggtttccggttgcagatggcaacgtgtgtatcgccccgtcgtcaagggctggttctagggctggggcgtcagcatccaggtccatatcagcagccagggcct

SEQ ID NO: 363187 - DNA, 140 bp, Artificial Sequence
  Synthetic
atacgccatgctgggtctccttacgcagttaggcaaaaagttaacgaaaacccactctatgcatcaacatcagagcacgtcaacgtactcctaacgcgtacggaaggtaaactggtatggcgtacttgggagtcggccat

SEQ ID NO: 363188 - DNA, 140 bp, Artificial Sequence
  Synthetic
atggccgactcccaagtacgccataccagtttaccttccgtacgcgttaggagtacgttgacgtgctctgatgttgatgcatagagtgggttttcgttaactttttgcctaactgcgtaaggagacccagcatggcgtat

SEQ ID NO: 363189 - DNA, 140 bp, Artificial Sequence
  Synthetic
atacgccatgctgggtctccctgcccactaagagagtcacctgggtggcgccgctgggcattcggggagctgactacacgtataacctagagttaggcctaccagcaacgctcggtaggtcgtacttgggagtcggccat

SEQ ID NO: 363190 - DNA, 140 bp, Artificial Sequence
  Synthetic
atggccgactcccaagtacgacctaccgagcgttgctggtaggcctaactctaggttatacgtgtagtcagctccccgaatgcccagcggcgccacccaggtgactctcttagtgggcagggagacccagcatggcgtat

SEQ ID NO: 363191 - DNA, 140 bp, Artificial Sequence
  Synthetic
aggccctggctgctgatatgaaagggctataaaacccctgaatagtaacaaaacataaaattaataaaaatcaaatgaataccataattggcaaacggaagagatgtaggtacttaagctgaccttttgggacagcggtg

SEQ ID NO: 363192 - DNA, 140 bp, Artificial Sequence
  Synthetic
caccgctgtcccaaaaggtcagcttaagtacctacatctcttccgtttgccaattatggtattcatttgatttttattaattttatgttttgttactattcaggggttttatagccctttcatatcagcagccagggcct

SEQ ID NO: 363193 - DNA, 140 bp, Artificial Sequence
  Synthetic
aggccctggctgctgatatggatcgcacattgatgtcacaacagtccggcaacgtaaagatcacagttaatggccagacggtgcggtacaagtgtaattgcggtggctcaaatgaaggacgaccttttgggacagcggtg

SEQ ID NO: 363194 - DNA, 140 bp, Artificial Sequence
  Synthetic
caccgctgtcccaaaaggtcgtccttcatttgagccaccgcaattacacttgtaccgcaccgtctggccattaactgtgatctttacgttgccggactgttgtgacatcaatgtgcgatccatatcagcagccagggcct

SEQ ID NO: 363195 - DNA, 140 bp, Artificial Sequence; identical to SEQ ID NO: 6069
  Synthetic

SEQ ID NO: 363196 - DNA, 140 bp, Artificial Sequence; identical to SEQ ID NO: 6070
  Synthetic

SEQ ID NO: 363197 - DNA, 140 bp, Artificial Sequence
  Synthetic
aggccctggctgctgatatggtatatgtgtcccctaagagacacactgtacatagcaaataatctatagatcaaagggctacgcaacccctgaatagtaacaaaatacaaaatcactaaagaccttttgggacagcggtg

SEQ ID NO: 363198 - DNA, 140 bp, Artificial Sequence
  Synthetic
caccgctgtcccaaaaggtctttagtgattttgtattttgttactattcaggggttgcgtagccctttgatctatagattatttgctatgtacagtgtgtctcttaggggacacatataccatatcagcagccagggcct

SEQ ID NO: 363199 - DNA, 140 bp, Artificial Sequence; identical to SEQ ID NO: 10335
  Synthetic

SEQ ID NO: 363200 - DNA, 140 bp, Artificial Sequence; identical to SEQ ID NO: 10336
  Synthetic

SEQ ID NO: 363201 - DNA, 140 bp, Artificial Sequence; identical to SEQ ID NO: 7803
  Synthetic

SEQ ID NO: 363202 - DNA, 140 bp, Artificial Sequence; identical to SEQ ID NO: 7804
  Synthetic

SEQ ID NO: 363203 - DNA, 140 bp, Artificial Sequence
  Synthetic
atacgccatgctgggtctccactgtaactgcctatgcaaacggcgaccatgccgtcacagttaaggacgccaaattcattgtggggccaatgtcttcagcctggacacctttcgacaatacgtacttgggagtcggccat

SEQ ID NO: 363204 - DNA, 140 bp, Artificial Sequence
  Synthetic
atggccgactcccaagtacgtattgtcgaaaggtgtccaggctgaagacattggccccacaatgaatttggcgtccttaactgtgacggcatggtcgccgtttgcataggcagttacagtggagacccagcatggcgtat

SEQ ID NO: 363205 - DNA, 140 bp, Artificial Sequence
  Synthetic
aggccctggctgctgatatgccgtcaaaactcaggagctacccgaaacagcacgcttaccacgcgccctccatcagaagcgctgtaccgtccccattccagaacacactacagaatgtacgaccttttgggacagcggtg

SEQ ID NO: 363206 - DNA, 140 bp, Artificial Sequence
  Synthetic
caccgctgtcccaaaaggtcgtacattctgtagtgtgttctggaatggggacggtacagcgcttctgatggagggcgcgtggtaagcgtgctgtttcgggtagctcctgagttttgacggcatatcagcagccagggcct

SEQ ID NO: 363207 - DNA, 140 bp, Artificial Sequence
  Synthetic
atacgccatgctgggtctccatacatacgaccggaaaccttgcggccgtgtctgactgggtaatgagcaccgtacccgtcgcgccgcctagaagaaggagagggagaaacctgaccgtgacgtacttgggagtcggccat

SEQ ID NO: 363208 - DNA, 140 bp, Artificial Sequence
  Synthetic
atggccgactcccaagtacgtcacggtcaggtttctccctctccttcttctaggcggcgcgacgggtacggtgctcattacccagtcagacacggccgcaaggtttccggtcgtatgtatggagacccagcatggcgtat

SEQ ID NO: 363209 - DNA, 140 bp, Artificial Sequence
  Synthetic
aggccctggctgctgatatgtttcggagacttcctacccggtgaagtggatgatttgacagatagcgactggtccacgtgctcagacacggacgacgagttatgactagacagggcaggtgaccttttgggacagcggtg

SEQ ID NO: 363210 - DNA, 140 bp, Artificial Sequence
  Synthetic
caccgctgtcccaaaaggtcacctgccctgtctagtcataactcgtcgtccgtgtctgagcacgtggaccagtcgctatctgtcaaatcatccacttcaccgggtaggaagtctccgaaacatatcagcagccagggcct

SEQ ID NO: 363211 - DNA, 140 bp, Artificial Sequence; identical to SEQ ID NO: 9643
  Synthetic

SEQ ID NO: 363212 - DNA, 140 bp, Artificial Sequence; identical to SEQ ID NO: 9644
  Synthetic

SEQ ID NO: 363213 - DNA, 140 bp, Artificial Sequence; identical to SEQ ID NO: 7867
  Synthetic

SEQ ID NO: 363214 - DNA, 140 bp, Artificial Sequence; identical to SEQ ID NO: 7868
  Synthetic

SEQ ID NO: 363215 - DNA, 140 bp, Artificial Sequence
  Synthetic
atacgccatgctgggtctcccaccttggaaccaacgctatcgcttgattacatcacgtgcgagtataaaaccgttatcccgtctccgtacgtgaaatgctgcggtacagcagagtgtaagcgtacttgggagtcggccat

SEQ ID NO: 363216 - DNA, 140 bp, Artificial Sequence
  Synthetic
atggccgactcccaagtacgcttacactctgctgtaccgcagcatttcacgtacggagacgggataacggttttatactcgcacgtgatgtaatcaagcgatagcgttggttccaaggtgggagacccagcatggcgtat

SEQ ID NO: 363217 - DNA, 140 bp, Artificial Sequence
  Synthetic
aggccctggctgctgatatggtcaaaacttaggagctacccgaaacaacatgcttatcacgcgccctctatcagaagcgctgtaccttccccattccagaacacactacagaatgtactggaccttttgggacagcggtg

SEQ ID NO: 363218 - DNA, 140 bp, Artificial Sequence
  Synthetic
caccgctgtcccaaaaggtccagtacattctgtagtgtgttctggaatggggaaggtacagcgcttctgatagagggcgcgtgataagcatgttgtttcgggtagctcctaagttttgaccatatcagcagccagggcct

SEQ ID NO: 363219 - DNA, 140 bp, Artificial Sequence
  Synthetic
aggccctggctgctgatatggacgtaggtacttaagcttcctaaaagcagccgaactcactttgagatgtaggcatagcataccgaactcttccacaattctccgtacccatagggacgtgaccttttgggacagcggtg

SEQ ID NO: 363220 - DNA, 140 bp, Artificial Sequence
  Synthetic
caccgctgtcccaaaaggtcacgtccctatgggtacggagaattgtggaagagttcggtatgctatgcctacatctcaaagtgagttcggctgcttttaggaagcttaagtacctacgtccatatcagcagccagggcct

SEQ ID NO: 363221 - DNA, 140 bp, Artificial Sequence
  Synthetic
aggccctggctgctgatatgtctgcctatatgccctgggggaaagtattgaatcgatcaggcagaaatgcccggtggatgatgcagacgcatcatctccccccaaaactgtcccgtgcctgaccttttgggacagcggtg

SEQ ID NO: 363222 - DNA, 140 bp, Artificial Sequence
  Synthetic
caccgctgtcccaaaaggtcaggcacgggacagttttggggggagatgatgcgtctgcatcatccaccgggcatttctgcctgatcgattcaatactttcccccagggcatataggcagacatatcagcagccagggcct

SEQ ID NO: 363223 - DNA, 140 bp, Artificial Sequence; identical to SEQ ID NO: 11941
  Synthetic

SEQ ID NO: 363224 - DNA, 140 bp, Artificial Sequence; identical to SEQ ID NO: 11942
  Synthetic

SEQ ID NO: 363225 - DNA, 140 bp, Artificial Sequence; identical to SEQ ID NO: 11981
  Synthetic

SEQ ID NO: 363226 - DNA, 140 bp, Artificial Sequence; identical to SEQ ID NO: 11982
  Synthetic

SEQ ID NO: 363227 - DNA, 140 bp, Artificial Sequence
  Synthetic
aggccctggctgctgatatgaaagcgagagattaataacccatcatggattctgtgtacgtggatatagacgctgacagcgcctttttgaaggccctgcaacgtgcgtaccccatgtttggaccttttgggacagcggtg

SEQ ID NO: 363228 - DNA, 140 bp, Artificial Sequence
  Synthetic
caccgctgtcccaaaaggtccaaacatggggtacgcacgttgcagggccttcaaaaaggcgctgtcagcgtctatatccacgtacacagaatccatgatgggttattaatctctcgctttcatatcagcagccagggcct

SEQ ID NO: 363229 - DNA, 140 bp, Artificial Sequence
  Synthetic
atacgccatgctgggtctcctcgtctagagcgttgaaaccaccatgtgtcaccagcaacactgagatgtttttcctattcagcaactttgacaatggcagaaggaatttcacaactcatgcgtacttgggagtcggccat

SEQ ID NO: 363230 - DNA, 140 bp, Artificial Sequence
  Synthetic
atggccgactcccaagtacgcatgagttgtgaaattccttctgccattgtcaaagttgctgaataggaaaaacatctcagtgttgctggtgacacatggtggtttcaacgctctagacgaggagacccagcatggcgtat

SEQ ID NO: 363231 - DNA, 140 bp, Artificial Sequence; identical to SEQ ID NO: 4831
  Synthetic

SEQ ID NO: 363232 - DNA, 140 bp, Artificial Sequence; identical to SEQ ID NO: 4832
  Synthetic

SEQ ID NO: 363233 - DNA, 140 bp, Artificial Sequence
  Synthetic
aggccctggctgctgatatgcctaccagtttcttactgctctactctgcaaagcaagagattaataacccatcatggatcctgtgtacgtggacatagacgctgacagcgcctttttgaagaccttttgggacagcggtg

SEQ ID NO: 363234 - DNA, 140 bp, Artificial Sequence
  Synthetic
caccgctgtcccaaaaggtcttcaaaaaggcgctgtcagcgtctatgtccacgtacacaggatccatgatgggttattaatctcttgctttgcagagtagagcagtaagaaactggtaggcatatcagcagccagggcct

SEQ ID NO: 363235 - DNA, 140 bp, Artificial Sequence
  Synthetic
aggccctggctgctgatatggaagggcactcgtgccatagtcccgtagcactagaacgcatcagaaatgaagcgacagacgggacgctgaaaatccaggtctccttgcaaatcggaataagaccttttgggacagcggtg

SEQ ID NO: 363236 - DNA, 140 bp, Artificial Sequence
  Synthetic
caccgctgtcccaaaaggtcttattccgatttgcaaggagacctggattttcagcgtcccgtctgtcgcttcatttctgatgcgttctagtgctacgggactatggcacgagtgcccttccatatcagcagccagggcct

SEQ ID NO: 363237 - DNA, 140 bp, Artificial Sequence; identical to SEQ ID NO: 5321
  Synthetic

SEQ ID NO: 363238 - DNA, 140 bp, Artificial Sequence; identical to SEQ ID NO: 5322
  Synthetic

SEQ ID NO: 363239 - DNA, 140 bp, Artificial Sequence
  Synthetic
aggccctggctgctgatatgcgtacgtgaagtgctgtggtacagcagagtgcaaggacaagagcctaccagactacagttgcaaggtctttactggagtctacccatttatgtggggcgggaccttttgggacagcggtg

SEQ ID NO: 363240 - DNA, 140 bp, Artificial Sequence
  Synthetic
caccgctgtcccaaaaggtcccgccccacataaatgggtagactccagtaaagaccttgcaactgtagtctggtaggctcttgtccttgcactctgctgtaccacagcacttcacgtacgcatatcagcagccagggcct

SEQ ID NO: 363241 - DNA, 140 bp, Artificial Sequence
  Synthetic
aggccctggctgctgatatgctaccagtttcttactgctctactctgcaaagcaagagattaataacccatcatggatcctgtgtacgtggacatagacgctgacagcgcctttttgaaggaccttttgggacagcggtg

SEQ ID NO: 363242 - DNA, 140 bp, Artificial Sequence
  Synthetic
caccgctgtcccaaaaggtccttcaaaaaggcgctgtcagcgtctatgtccacgtacacaggatccatgatgggttattaatctcttgctttgcagagtagagcagtaagaaactggtagcatatcagcagccagggcct

SEQ ID NO: 363243 - DNA, 140 bp, Artificial Sequence
  Synthetic
aggccctggctgctgatatgtagcataccgaactcttccacaattctccgtacccatagggacgtaggagatgttattttgtttttaatatttcaaaaaaaaaaaaaaaaaaaaaaaaaagaccttttgggacagcggtg

SEQ ID NO: 363244 - DNA, 140 bp, Artificial Sequence
  Synthetic
caccgctgtcccaaaaggtcttttttttttttttttttttttttttgaaatattaaaaacaaaataacatctcctacgtccctatgggtacggagaattgtggaagagttcggtatgctacatatcagcagccagggcct

SEQ ID NO: 363245 - DNA, 140 bp, Artificial Sequence
  Synthetic
aggccctggctgctgatatgagcataccgaactcttccacaattctccgtacccatagggacgtaggagatgttattttgtttttaatatttcaaaaaaaaaaaaaaaaaaaaaaaaaaagaccttttgggacagcggtg

SEQ ID NO: 363246 - DNA, 140 bp, Artificial Sequence
  Synthetic
caccgctgtcccaaaaggtctttttttttttttttttttttttttttgaaatattaaaaacaaaataacatctcctacgtccctatgggtacggagaattgtggaagagttcggtatgctcatatcagcagccagggcct

SEQ ID NO: 363247 - DNA, 140 bp, Artificial Sequence
  Synthetic
aggccctggctgctgatatgtagcctaccagtttcttactgctctactctgcaaagcaagagattaagaacccatcatggatcctgtgtacgtggacatagacgctgacagcgcctttttgaccttttgggacagcggtg

SEQ ID NO: 363248 - DNA, 140 bp, Artificial Sequence
  Synthetic
caccgctgtcccaaaaggtcaaaaaggcgctgtcagcgtctatgtccacgtacacaggatccatgatgggttcttaatctcttgctttgcagagtagagcagtaagaaactggtaggctacatatcagcagccagggcct

SEQ ID NO: 363249 - DNA, 140 bp, Artificial Sequence
  Synthetic
atacgccatgctgggtctccgagacgtaggtatttaagcttcctaaaagcagccgaactcactttgagacgtaggcatagcataccgaactcttccactattctccgaacccatagggaccgtacttgggagtcggccat

SEQ ID NO: 363250 - DNA, 140 bp, Artificial Sequence
  Synthetic
atggccgactcccaagtacggtccctatgggttcggagaatagtggaagagttcggtatgctatgcctacgtctcaaagtgagttcggctgcttttaggaagcttaaatacctacgtctcggagacccagcatggcgtat

SEQ ID NO: 363251 - DNA, 140 bp, Artificial Sequence
  Synthetic
atacgccatgctgggtctcccagagcaccgctgcaactgccgaggagatagaggtacatatgcccccagacaccccagatcgcacattaatgtcacaacagtccggcaatgtaaagatcacgtacttgggagtcggccat

SEQ ID NO: 363252 - DNA, 140 bp, Artificial Sequence
  Synthetic
atggccgactcccaagtacgtgatctttacattgccggactgttgtgacattaatgtgcgatctggggtgtctgggggcatatgtacctctatctcctcggcagttgcagcggtgctctgggagacccagcatggcgtat

SEQ ID NO: 363253 - DNA, 140 bp, Artificial Sequence
  Synthetic
atacgccatgctgggtctcccagtcaatagtcagacggtgcggtacaagtgcaattgtggtgactcaagtgaaggattaaccactacagataaagtgattaataactgcaaggttgatcacgtacttgggagtcggccat

SEQ ID NO: 363254 - DNA, 140 bp, Artificial Sequence
  Synthetic
atggccgactcccaagtacgtgatcaaccttgcagttattaatcactttatctgtagtggttaatccttcacttgagtcaccacaattgcacttgtaccgcaccgtctgactattgactgggagacccagcatggcgtat

SEQ ID NO: 363255 - DNA, 140 bp, Artificial Sequence
  Synthetic
atacgccatgctgggtctccgtgcaagactaccgacacggttgacggtgaaagagtgtcattttcggtgtgcacgtacgtgccggcgactatttgtgatcaaatgaccggtatccttgctcgtacttgggagtcggccat

SEQ ID NO: 363256 - DNA, 140 bp, Artificial Sequence
  Synthetic
atggccgactcccaagtacgagcaaggataccggtcatttgatcacaaatagtcgccggcacgtacgtgcacaccgaaaatgacactctttcaccgtcaaccgtgtcggtagtcttgcacggagacccagcatggcgtat

SEQ ID NO: 363257 - DNA, 140 bp, Artificial Sequence
  Synthetic
atacgccatgctgggtctccccggaaagccgtaagctacttaagagctggcacctaccatcggtgttccatctaaagggcaaactcagcttcacatgccgctgtgatacagtggtttcgtcgtacttgggagtcggccat

SEQ ID NO: 363258 - DNA, 140 bp, Artificial Sequence
  Synthetic
atggccgactcccaagtacgacgaaaccactgtatcacagcggcatgtgaagctgagtttgccctttagatggaacaccgatggtaggtgccagctcttaagtagcttacggctttccggggagacccagcatggcgtat

SEQ ID NO: 363259 - DNA, 140 bp, Artificial Sequence
  Synthetic
atacgccatgctgggtctccccatttcctctggcaaatgtgacatgcagggtgcctaaagcaagaaaccccaccgtgacgtacggaaaaaaccaagtcatcatgttgctgtatcctgacccgtacttgggagtcggccat

SEQ ID NO: 363260 - DNA, 140 bp, Artificial Sequence
  Synthetic
atggccgactcccaagtacgggtcaggatacagcaacatgatgacttggttttttccgtacgtcacggtggggtttcttgctttaggcaccctgcatgtcacatttgccagaggaaatggggagacccagcatggcgtat

SEQ ID NO: 363261 - DNA, 140 bp, Artificial Sequence
  Synthetic
aggccctggctgctgatatgtaggaggagctaatgaaggagcccgtacagccctctcagtggtgacctggaataaagacattgtcactaaaatcacccctgagggagccgaagagtggaggaccttttgggacagcggtg

SEQ ID NO: 363262 - DNA, 140 bp, Artificial Sequence
  Synthetic
caccgctgtcccaaaaggtcctccactcttcggctccctcaggggtgattttagtgacaatgtctttattccaggtcaccactgagagggctgtacgggctccttcattagctcctcctacatatcagcagccagggcct

SEQ ID NO: 363263 - DNA, 140 bp, Artificial Sequence; identical to SEQ ID NO: 7465
  Synthetic

SEQ ID NO: 363264 - DNA, 140 bp, Artificial Sequence; identical to SEQ ID NO: 7466
  Synthetic

SEQ ID NO: 363265 - DNA, 140 bp, Artificial Sequence
  Synthetic
aggccctggctgctgatatgcagtagggtcaacgctttacccggaaagccgcatgctacttaagagctggcacctaccatcggtgttccatctaaagggcaagcttagcttcacatgccggaccttttgggacagcggtg

SEQ ID NO: 363266 - DNA, 140 bp, Artificial Sequence
  Synthetic
caccgctgtcccaaaaggtccggcatgtgaagctaagcttgccctttagatggaacaccgatggtaggtgccagctcttaagtagcatgcggctttccgggtaaagcgttgaccctactgcatatcagcagccagggcct

SEQ ID NO: 363267 - DNA, 140 bp, Artificial Sequence; identical to SEQ ID NO: 4505
  Synthetic

SEQ ID NO: 363268 - DNA, 140 bp, Artificial Sequence; identical to SEQ ID NO: 4506
  Synthetic

SEQ ID NO: 363269 - DNA, 140 bp, Artificial Sequence
  Synthetic
atacgccatgctgggtctccggtaatccatgcagtaggacctaatttctcaaattactctgagtccgaaggagaccgggaattggcagctgcttaccgagaagtcgctaaggaggtgactcgtacttgggagtcggccat

SEQ ID NO: 363270 - DNA, 140 bp, Artificial Sequence
  Synthetic
atggccgactcccaagtacgagtcacctccttagcgacttctcggtaagcagctgccaattcccggtctccttcggactcagagtaatttgagaaattaggtcctactgcatggattaccggagacccagcatggcgtat

SEQ ID NO: 363271 - DNA, 140 bp, Artificial Sequence
  Synthetic
aggccctggctgctgatatgtgatagccatgattggaccaagctgcgttacatggacaatcacatgccagcagacgcagagagggccgggctatttgtaagaacatcagcaccatgcacggaccttttgggacagcggtg

SEQ ID NO: 363272 - DNA, 140 bp, Artificial Sequence
  Synthetic
caccgctgtcccaaaaggtccgtgcatggtgctgatgttcttacaaatagcccggccctctctgcgtctgctggcatgtgattgtccatgtaacgcagcttggtccaatcatggctatcacatatcagcagccagggcct

SEQ ID NO: 363273 - DNA, 140 bp, Artificial Sequence
  Synthetic
aggccctggctgctgatatgaagaaaggcaagtgtgcagtgcactcgatgactaacgccgtcactattcgggaagctgaaatagaagtagaagggaactctcagttgcaaatctctttttgaccttttgggacagcggtg

SEQ ID NO: 363274 - DNA, 140 bp, Artificial Sequence
  Synthetic
caccgctgtcccaaaaggtcaaaaagagatttgcaactgagagttcccttctacttctatttcagcttcccgaatagtgacggcgttagtcatcgagtgcactgcacacttgcctttcttcatatcagcagccagggcct

SEQ ID NO: 363275 - DNA, 140 bp, Artificial Sequence
  Synthetic
aggccctggctgctgatatgcgacggccctagccagcgccgaatttcgcgtacaagtctgttctacacaagtacactgtgcagccgagtgccatccaccgaaagaccatatagtcaattagaccttttgggacagcggtg

SEQ ID NO: 363276 - DNA, 140 bp, Artificial Sequence
  Synthetic
caccgctgtcccaaaaggtctaattgactatatggtctttcggtggatggcactcggctgcacagtgtacttgtgtagaacagacttgtacgcgaaattcggcgctggctagggccgtcgcatatcagcagccagggcct

SEQ ID NO: 363277 - DNA, 140 bp, Artificial Sequence
  Synthetic
atacgccatgctgggtctccgctaaagcggccacataccaagaggctgcggtatacctgtggaacgagcagcaacctttgttttggctacaagcccttattccgctggcagccctgattgcgtacttgggagtcggccat

SEQ ID NO: 363278 - DNA, 140 bp, Artificial Sequence
  Synthetic
atggccgactcccaagtacgcaatcagggctgccagcggaataagggcttgtagccaaaacaaaggttgctgctcgttccacaggtataccgcagcctcttggtatgtggccgctttagcggagacccagcatggcgtat

SEQ ID NO: 363279 - DNA, 140 bp, Artificial Sequence
  Synthetic
aggccctggctgctgatatgcctgctgctacgaaaaggaaccggaggaaaccctacgcatgcttgaggacaacgtcatgagacctgggtactatcagctgctacaagcatccttaacatggaccttttgggacagcggtg

SEQ ID NO: 363280 - DNA, 140 bp, Artificial Sequence
  Synthetic
caccgctgtcccaaaaggtccatgttaaggatgcttgtagcagctgatagtacccaggtctcatgacgttgtcctcaagcatgcgtagggtttcctccggttccttttcgtagcagcaggcatatcagcagccagggcct

SEQ ID NO: 363281 - DNA, 140 bp, Artificial Sequence
  Synthetic
atacgccatgctgggtctccttctccccaccgccagcgacgcagcaccaaggacaacttcaatgtctataaagccacaagaccatacttagctcactgtcccgactgtggagaagggcaccgtacttgggagtcggccat

SEQ ID NO: 363282 - DNA, 140 bp, Artificial Sequence
  Synthetic
atggccgactcccaagtacggtgcccttctccacagtcgggacagtgagctaagtatggtcttgtggctttatagacattgaagttgtccttggtgctgcgtcgctggcggtggggagaaggagacccagcatggcgtat

SEQ ID NO: 363283 - DNA, 140 bp, Artificial Sequence
  Synthetic
aggccctggctgctgatatggtggataaagacgctgcagaacccaccgaaaggaaacttcaaagcaactattaaggagtgggaggtggagcatgcatcaataatggcgggcatttgtagtgaccttttgggacagcggtg

SEQ ID NO: 363284 - DNA, 140 bp, Artificial Sequence
  Synthetic
caccgctgtcccaaaaggtcactacaaatgcccgccattattgatgcatgctccacctcccactccttaatagttgctttgaagtttcctttcggtgggttctgcagcgtctttatccaccatatcagcagccagggcct

SEQ ID NO: 363285 - DNA, 140 bp, Artificial Sequence
  Synthetic
atacgccatgctgggtctccggcagtggtcccagataattcaagccttcaaagaagacaaagcatactcacctgaagtagccctgaatgaaatatgcacgcgcatgtatggggtggatctcgtacttgggagtcggccat

SEQ ID NO: 363286 - DNA, 140 bp, Artificial Sequence
  Synthetic
atggccgactcccaagtacgagatccaccccatacatgcgcgtgcatatttcattcagggctacttcaggtgagtatgctttgtcttctttgaaggcttgaattatctgggaccactgccggagacccagcatggcgtat

SEQ ID NO: 363287 - DNA, 140 bp, Artificial Sequence
  Synthetic
aggccctggctgctgatatgaaatataaaactaataaaaatcaaacgaataccataattggcaatcggaagagatgtaggtacttaagcttcttaaaagcagccgaactcgctttgagatgaccttttgggacagcggtg

SEQ ID NO: 363288 - DNA, 140 bp, Artificial Sequence
  Synthetic
caccgctgtcccaaaaggtcatctcaaagcgagttcggctgcttttaagaagcttaagtacctacatctcttccgattgccaattatggtattcgtttgatttttattagttttatatttcatatcagcagccagggcct

SEQ ID NO: 363289 - DNA, 140 bp, Artificial Sequence
  Synthetic
aggccctggctgctgatatgaataaaaatcaaatgaataccataattggcaaacggaagagatgtaggtacttaagcttcctaaaagcagccgaactcactttgagaagtaggcatagcagaccttttgggacagcggtg

SEQ ID NO: 363290 - DNA, 140 bp, Artificial Sequence
  Synthetic
caccgctgtcccaaaaggtctgctatgcctacttctcaaagtgagttcggctgcttttaggaagcttaagtacctacatctcttccgtttgccaattatggtattcatttgatttttattcatatcagcagccagggcct

SEQ ID NO: 363291 - DNA, 140 bp, Artificial Sequence
  Synthetic
aggccctggctgctgatatgggagacttctcgccaggcgaagtggatgacctgacagacagcgattggtccacgtgttcagatacggacgacgaattatgactagatagggcaggtgggtgaccttttgggacagcggtg

SEQ ID NO: 363292 - DNA, 140 bp, Artificial Sequence
  Synthetic
caccgctgtcccaaaaggtcacccacctgccctatctagtcataattcgtcgtccgtatctgaacacgtggaccaatcgctgtctgtcaggtcatccacttcgcctggcgagaagtctcccatatcagcagccagggcct

SEQ ID NO: 363293 - DNA, 140 bp, Artificial Sequence
  Synthetic
aggccctggctgctgatatgtaggcatagcataccgaactcttccacgattctccgaacccacagggacgtaggagatgttattttgtttttaatatttcaaaaaaaaaaaaaaaaaaaagaccttttgggacagcggtg

SEQ ID NO: 363294 - DNA, 140 bp, Artificial Sequence
  Synthetic
caccgctgtcccaaaaggtcttttttttttttttttttttgaaatattaaaaacaaaataacatctcctacgtccctgtgggttcggagaatcgtggaagagttcggtatgctatgcctacatatcagcagccagggcct

SEQ ID NO: 363295 - DNA, 140 bp, Artificial Sequence
  Synthetic
aggccctggctgctgatatgaaattaataatgagtaccataattggcaaatggaagagacgtaggtactaagcttcttaaaagcagccgaactcactttgagatgtaggcatagcataccgaccttttgggacagcggtg

SEQ ID NO: 363296 - DNA, 140 bp, Artificial Sequence
  Synthetic
caccgctgtcccaaaaggtcggtatgctatgcctacatctcaaagtgagttcggctgcttttaagaagcttagtacctacgtctcttccatttgccaattatggtactcattattaatttcatatcagcagccagggcct

SEQ ID NO: 363297 - DNA, 140 bp, Artificial Sequence
  Synthetic
aggccctggctgctgatatggtggatcactccctgttggacctgatagaggctgcttttggagagatttccagctgtcacctgccgacaggtacgcgcttcaagttcggcgctatgatgagaccttttgggacagcggtg

SEQ ID NO: 363298 - DNA, 140 bp, Artificial Sequence
  Synthetic
caccgctgtcccaaaaggtctcatcatagcgccgaacttgaagcgcgtacctgtcggcaggtgacagctggaaatctctccaaaagcagcctctatcaggtccaacagggagtgatccaccatatcagcagccagggcct

SEQ ID NO: 363299 - DNA, 140 bp, Artificial Sequence
  Synthetic
aggccctggctgctgatatgagtttcttactgctctactctgcaaagcaagagattaataacccatcatggatcctgtgtacgtggacatagacgctgacagcgcctttttgaaggccctgaccttttgggacagcggtg

SEQ ID NO: 363300 - DNA, 140 bp, Artificial Sequence
  Synthetic
caccgctgtcccaaaaggtcagggccttcaaaaaggcgctgtcagcgtctatgtccacgtacacaggatccatgatgggttattaatctcttgctttgcagagtagagcagtaagaaactcatatcagcagccagggcct

SEQ ID NO: 363301 - DNA, 140 bp, Artificial Sequence
  Synthetic
atacgccatgctgggtctccagaacttgacgacctatgtcacaaaactaaaaggaccaaaagcagcagcattgtttgccaagacacataacctgctaccactgcaggaggtaccaatggacgtacttgggagtcggccat

SEQ ID NO: 363302 - DNA, 140 bp, Artificial Sequence
  Synthetic
atggccgactcccaagtacgtccattggtacctcctgcagtggtagcaggttatgtgtcttggcaaacaatgctgctgcttttggtccttttagttttgtgacataggtcgtcaagttctggagacccagcatggcgtat

SEQ ID NO: 363303 - DNA, 140 bp, Artificial Sequence; identical to SEQ ID NO: 11867
  Synthetic

SEQ ID NO: 363304 - DNA, 140 bp, Artificial Sequence; identical to SEQ ID NO: 11868
  Synthetic

SEQ ID NO: 363305 - DNA, 140 bp, Artificial Sequence
  Synthetic
aggccctggctgctgatatggcggtaccccaacagaagccacgcaggaatcggaagaataagaagcaaaagcaaaagcaacaggcgccacaaaacaacacaaaccaaaagaaacaaccacgaccttttgggacagcggtg

SEQ ID NO: 363306 - DNA, 140 bp, Artificial Sequence
  Synthetic
caccgctgtcccaaaaggtcgtggttgtttcttttggtttgtgttgttttgtggcgcctgttgcttttgcttttgcttcttattcttccgattcctgcgtggcttctgttggggtaccgccatatcagcagccagggcct

SEQ ID NO: 363307 - DNA, 140 bp, Artificial Sequence
  Synthetic
aggccctggctgctgatatgactttgagaagtaggcatagcataccgaactcttccacgattctccgaacccacagggacgtaggagatgttattttgtttttaatatttcaaaaaaaaagaccttttgggacagcggtg

SEQ ID NO: 363308 - DNA, 140 bp, Artificial Sequence
  Synthetic
caccgctgtcccaaaaggtctttttttttgaaatattaaaaacaaaataacatctcctacgtccctgtgggttcggagaatcgtggaagagttcggtatgctatgcctacttctcaaagtcatatcagcagccagggcct

SEQ ID NO: 363309 - DNA, 140 bp, Artificial Sequence; identical to SEQ ID NO: 4581
  Synthetic

SEQ ID NO: 363310 - DNA, 140 bp, Artificial Sequence; identical to SEQ ID NO: 4582
  Synthetic

SEQ ID NO: 363311 - DNA, 140 bp, Artificial Sequence
  Synthetic
aggccctggctgctgatatgccgagaggagctatcaaagttactgcccaaccaacagaccacgtcgtgggagagtacctggtactctccccgcagaccgtactacgtagccagaagctcagaccttttgggacagcggtg

SEQ ID NO: 363312 - DNA, 140 bp, Artificial Sequence
  Synthetic
caccgctgtcccaaaaggtctgagcttctggctacgtagtacggtctgcggggagagtaccaggtactctcccacgacgtggtctgttggttgggcagtaactttgatagctcctctcggcatatcagcagccagggcct

SEQ ID NO: 363313 - DNA, 140 bp, Artificial Sequence
  Synthetic
aggccctggctgctgatatggggttgtcaatcccgttgaggactagaatcaagtggctgttacgcaaggtgccgaaagcagacctgatcccatacagcggaaatgcccaagaagcccagggaccttttgggacagcggtg

SEQ ID NO: 363314 - DNA, 140 bp, Artificial Sequence
  Synthetic
caccgctgtcccaaaaggtccctgggcttcttgggcatttccgctgtatgggatcaggtctgctttcggcaccttgcgtaacagccacttgattctagtcctcaacgggattgacaaccccatatcagcagccagggcct

SEQ ID NO: 363315 - DNA, 140 bp, Artificial Sequence
  Synthetic
aggccctggctgctgatatgcgtctcttcaggcaccgccgagtaccgccacggaactgaatcatccgccgacctccttcggagcaccaagcgagacgttccccattacatttggggacttgaccttttgggacagcggtg

SEQ ID NO: 363316 - DNA, 140 bp, Artificial Sequence
  Synthetic
caccgctgtcccaaaaggtcaagtccccaaatgtaatggggaacgtctcgcttggtgctccgaaggaggtcggcggatgattcagttccgtggcggtactcggcggtgcctgaagagacgcatatcagcagccagggcct

SEQ ID NO: 363317 - DNA, 140 bp, Artificial Sequence
  Synthetic
aggccctggctgctgatatgcagcgaaggagaaattgaaagcttgtcttctgagctgctaactttcggagacttcctgcccggagaagtggatgacttgacagatagcgactggtccacggaccttttgggacagcggtg

SEQ ID NO: 363318 - DNA, 140 bp, Artificial Sequence
  Synthetic
caccgctgtcccaaaaggtccgtggaccagtcgctatctgtcaagtcatccacttctccgggcaggaagtctccgaaagttagcagctcagaagacaagctttcaatttctccttcgctgcatatcagcagccagggcct

SEQ ID NO: 363319 - DNA, 140 bp, Artificial Sequence
  Synthetic
aggccctggctgctgatatgtcctgaccgcacgctgatgacgcagcagtctggcaacgtgaagatcacagttaatgggcagacggtgcggtacaagtgcaactgcggtggctcaaacgaggaccttttgggacagcggtg

SEQ ID NO: 363320 - DNA, 140 bp, Artificial Sequence
  Synthetic
caccgctgtcccaaaaggtcctcgtttgagccaccgcagttgcacttgtaccgcaccgtctgcccattaactgtgatcttcacgttgccagactgctgcgtcatcagcgtgcggtcaggacatatcagcagccagggcct

SEQ ID NO: 363321 - DNA, 140 bp, Artificial Sequence
  Synthetic
aggccctggctgctgatatgctatacttaatgtcagagaccccaaaagtccctacttaccggaccatatatccggcgcctgtgtactcacctccgatcaacgtccgattgtccaaccccagaccttttgggacagcggtg

SEQ ID NO: 363322 - DNA, 140 bp, Artificial Sequence
  Synthetic
caccgctgtcccaaaaggtctggggttggacaatcggacgttgatcggaggtgagtacacaggcgccggatatatggtccggtaagtagggacttttggggtctctgacattaagtatagcatatcagcagccagggcct

SEQ ID NO: 363323 - DNA, 140 bp, Artificial Sequence; identical to SEQ ID NO: 6399
  Synthetic

SEQ ID NO: 363324 - DNA, 140 bp, Artificial Sequence; identical to SEQ ID NO: 6400
  Synthetic

SEQ ID NO: 363325 - DNA, 140 bp, Artificial Sequence; identical to SEQ ID NO: 11297
  Synthetic

SEQ ID NO: 363326 - DNA, 140 bp, Artificial Sequence; identical to SEQ ID NO: 11298
  Synthetic

SEQ ID NO: 363327 - DNA, 140 bp, Artificial Sequence
  Synthetic
aggccctggctgctgatatgtatcagttgtggtaatgtccatggccacctttgcaagctccagatccaagttcgagaagctcataggacccgtcataagtatgtacggcggtcctaaatagaccttttgggacagcggtg

SEQ ID NO: 363328 - DNA, 140 bp, Artificial Sequence
  Synthetic
caccgctgtcccaaaaggtctatttaggaccgccgtacatacttatgacgggtcctatgagcttctcgaacttggatctggagcttgcaaaggtggccatggacattaccacaactgatacatatcagcagccagggcct

SEQ ID NO: 363329 - DNA, 140 bp, Artificial Sequence; identical to SEQ ID NO: 11299
  Synthetic

SEQ ID NO: 363330 - DNA, 140 bp, Artificial Sequence; identical to SEQ ID NO: 11300
  Synthetic

SEQ ID NO: 363331 - DNA, 140 bp, Artificial Sequence
  Synthetic
aggccctggctgctgatatgtagcctaccagtttcttactgctctactctgcaaagcaagagattaataacccatcatggattctgtgtacgtggatatagacgctgacagcgcctttttgaccttttgggacagcggtg

SEQ ID NO: 363332 - DNA, 140 bp, Artificial Sequence
  Synthetic
caccgctgtcccaaaaggtcaaaaaggcgctgtcagcgtctatatccacgtacacagaatccatgatgggttattaatctcttgctttgcagagtagagcagtaagaaactggtaggctacatatcagcagccagggcct

SEQ ID NO: 363333 - DNA, 140 bp, Artificial Sequence
  Synthetic
aggccctggctgctgatatggacgctgcagaacccaccgaaaggaaacttcaaagcaactattaaggagtgggaggtggagcatgcatcaataatggcgggcatctgcagtcaccaaatggaccttttgggacagcggtg

SEQ ID NO: 363334 - DNA, 140 bp, Artificial Sequence
  Synthetic
caccgctgtcccaaaaggtccatttggtgactgcagatgcccgccattattgatgcatgctccacctcccactccttaatagttgctttgaagtttcctttcggtgggttctgcagcgtccatatcagcagccagggcct

SEQ ID NO: 363335 - DNA, 140 bp, Artificial Sequence; identical to SEQ ID NO: 4653
  Synthetic

SEQ ID NO: 363336 - DNA, 140 bp, Artificial Sequence; identical to SEQ ID NO: 4654
  Synthetic

SEQ ID NO: 363337 - DNA, 140 bp, Artificial Sequence
  Synthetic
aggccctggctgctgatatgaattggcaacgagaagagacgtaggtatttaagcttcctaaaagcagccgaactcactttgagacgtaggcatagcataccgaactcttccactattctcgaccttttgggacagcggtg

SEQ ID NO: 363338 - DNA, 140 bp, Artificial Sequence
  Synthetic
caccgctgtcccaaaaggtcgagaatagtggaagagttcggtatgctatgcctacgtctcaaagtgagttcggctgcttttaggaagcttaaatacctacgtctcttctcgttgccaattcatatcagcagccagggcct

SEQ ID NO: 363339 - DNA, 140 bp, Artificial Sequence
  Synthetic
aggccctggctgctgatatgtctactctgcaaagcaagagattaataacccatcatggatcctgtgtacgtggacatagacgctgacagcgcctttttgaaggccctgcaacgtgcgtacgaccttttgggacagcggtg

SEQ ID NO: 363340 - DNA, 140 bp, Artificial Sequence
  Synthetic
caccgctgtcccaaaaggtcgtacgcacgttgcagggccttcaaaaaggcgctgtcagcgtctatgtccacgtacacaggatccatgatgggttattaatctcttgctttgcagagtagacatatcagcagccagggcct

SEQ ID NO: 363341 - DNA, 140 bp, Artificial Sequence
  Synthetic
atacgccatgctgggtctccgtagcctaccagtttcttactgctctactctgcttagcaagagacttgagaacccatcatggatcccgtgtacgtggacatagacgccgacagcgcctttcgtacttgggagtcggccat

SEQ ID NO: 363342 - DNA, 140 bp, Artificial Sequence
  Synthetic
atggccgactcccaagtacgaaaggcgctgtcggcgtctatgtccacgtacacgggatccatgatgggttctcaagtctcttgctaagcagagtagagcagtaagaaactggtaggctacggagacccagcatggcgtat

SEQ ID NO: 363343 - DNA, 140 bp, Artificial Sequence
  Synthetic
atacgccatgctgggtctccgtagtcaacgccgctaaccctcgcgggttaccgggtgacggtgtttgcaaggcagtatacaaaaaatggccggagtcctttaagaacagtgcaacaccagcgtacttgggagtcggccat

SEQ ID NO: 363344 - DNA, 140 bp, Artificial Sequence
  Synthetic
atggccgactcccaagtacgctggtgttgcactgttcttaaaggactccggccattttttgtatactgccttgcaaacaccgtcacccggtaacccgcgagggttagcggcgttgactacggagacccagcatggcgtat

SEQ ID NO: 363345 - DNA, 140 bp, Artificial Sequence
  Synthetic
atacgccatgctgggtctccgaagaacgagaagcagaactgactcatgaggctctaccacccctacaggcagcacaggaagatgtccaggtcgaaatcgacgtggaacaacttgaggatacgtacttgggagtcggccat

SEQ ID NO: 363346 - DNA, 140 bp, Artificial Sequence
  Synthetic
atggccgactcccaagtacgtatcctcaagttgttccacgtcgatttcgacctggacatcttcctgtgctgcctgtaggggtggtagagcctcatgagtcagttctgcttctcgttcttcggagacccagcatggcgtat

SEQ ID NO: 363347 - DNA, 140 bp, Artificial Sequence
  Synthetic
aggccctggctgctgatatgctcgacaaattgggcagatgagcaggtactgaaggctaagaacataggattatgttcaacagacctgacggaaggtagacgaggcaaattgtctattatggaccttttgggacagcggtg

SEQ ID NO: 363348 - DNA, 140 bp, Artificial Sequence
  Synthetic
caccgctgtcccaaaaggtccataatagacaatttgcctcgtctaccttccgtcaggtctgttgaacataatcctatgttcttagccttcagtacctgctcatctgcccaatttgtcgagcatatcagcagccagggcct

SEQ ID NO: 363349 - DNA, 140 bp, Artificial Sequence
  Synthetic
atacgccatgctgggtctccgagctggtgctggaataatagagactccgagaggcgctattaaagttactgcccaactaacagaccacgtcgtgggggagtacctggtactttccccgcacgtacttgggagtcggccat

SEQ ID NO: 363350 - DNA, 140 bp, Artificial Sequence
  Synthetic
atggccgactcccaagtacgtgcggggaaagtaccaggtactcccccacgacgtggtctgttagttgggcagtaactttaatagcgcctctcggagtctctattattccagcaccagctcggagacccagcatggcgtat

SEQ ID NO: 363351 - DNA, 140 bp, Artificial Sequence
  Synthetic
aggccctggctgctgatatggacaggctgacccagtcactgaaccacctctttacagccatggactcgacggatgcagacgtggtcatctactgccgcgacaaagaatgggagaagaaaagaccttttgggacagcggtg

SEQ ID NO: 363352 - DNA, 140 bp, Artificial Sequence
  Synthetic
caccgctgtcccaaaaggtcttttcttctcccattctttgtcgcggcagtagatgaccacgtctgcatccgtcgagtccatggctgtaaagaggtggttcagtgactgggtcagcctgtccatatcagcagccagggcct

SEQ ID NO: 363353 - DNA, 140 bp, Artificial Sequence
  Synthetic
aggccctggctgctgatatgaggcagaaaaggatacagcaccacggaaggcgcactgtactcatatctagaagggacccgttttcatcagacggctgtggatatggcggagatacatactgaccttttgggacagcggtg

SEQ ID NO: 363354 - DNA, 140 bp, Artificial Sequence
  Synthetic
caccgctgtcccaaaaggtcagtatgtatctccgccatatccacagccgtctgatgaaaacgggtcccttctagatatgagtacagtgcgccttccgtggtgctgtatccttttctgcctcatatcagcagccagggcct

SEQ ID NO: 363355 - DNA, 140 bp, Artificial Sequence
  Synthetic
aggccctggctgctgatatgatgtggccaaagcaaacagaggccaatgagcaagtctgcctatatgccctgggggaaagtattgaatcgatcaggcagaaatgcccggtggatgatgcaggaccttttgggacagcggtg

SEQ ID NO: 363356 - DNA, 140 bp, Artificial Sequence
  Synthetic
caccgctgtcccaaaaggtcctgcatcatccaccgggcatttctgcctgatcgattcaatactttcccccagggcatataggcagacttgctcattggcctctgtttgctttggccacatcatatcagcagccagggcct

SEQ ID NO: 363357 - DNA, 140 bp, Artificial Sequence; identical to SEQ ID NO: 5397
  Synthetic

SEQ ID NO: 363358 - DNA, 140 bp, Artificial Sequence; identical to SEQ ID NO: 5398
  Synthetic

SEQ ID NO: 363359 - DNA, 140 bp, Artificial Sequence
  Synthetic
aggccctggctgctgatatgtgtgtgttcttcgtttcccctcccaaagtacaaaatagaaggagtgcaaaaagtcaaatgctctaaggtaatgctatttgaccacaacgtgccatcgcgcgaccttttgggacagcggtg

SEQ ID NO: 363360 - DNA, 140 bp, Artificial Sequence
  Synthetic
caccgctgtcccaaaaggtcgcgcgatggcacgttgtggtcaaatagcattaccttagagcatttgactttttgcactccttctattttgtactttgggaggggaaacgaagaacacacacatatcagcagccagggcct

SEQ ID NO: 363361 - DNA, 140 bp, Artificial Sequence
  Synthetic
aggccctggctgctgatatgaagtcaaatgctctaaggtaatgctatttgaccacaacgtgccatcgcgcgtaagtccaagggaatatagatcttcccaggagtctgcacaggaggcgaggaccttttgggacagcggtg

SEQ ID NO: 363362 - DNA, 140 bp, Artificial Sequence
  Synthetic
caccgctgtcccaaaaggtcctcgcctcctgtgcagactcctgggaagatctatattcccttggacttacgcgcgatggcacgttgtggtcaaatagcattaccttagagcatttgacttcatatcagcagccagggcct

SEQ ID NO: 363363 - DNA, 140 bp, Artificial Sequence
  Synthetic
aggccctggctgctgatatgccagcactagacgacggggcgacacacacgctgccatccacaaccggaaaccttgcggccgtgtctgactgggtaatgagcaccgtacctgtcgcgccgcgaccttttgggacagcggtg

SEQ ID NO: 363364 - DNA, 140 bp, Artificial Sequence
  Synthetic
caccgctgtcccaaaaggtcgcggcgcgacaggtacggtgctcattacccagtcagacacggccgcaaggtttccggttgtggatggcagcgtgtgtgtcgccccgtcgtctagtgctggcatatcagcagccagggcct

SEQ ID NO: 363365 - DNA, 140 bp, Artificial Sequence
  Synthetic
atacgccatgctgggtctcctctgacggtgggattcactgacggtaggaagattagtcattcatgcacgcacccatttcaccacgatcctcctgtgataggccgggaaaaattccattcccgtacttgggagtcggccat

SEQ ID NO: 363366 - DNA, 140 bp, Artificial Sequence
  Synthetic
atggccgactcccaagtacgggaatggaatttttcccggcctatcacaggaggatcgtggtgaaatgggtgcgtgcatgaatgactaatcttcctaccgtcagtgaatcccaccgtcagaggagacccagcatggcgtat

SEQ ID NO: 363367 - DNA, 140 bp, Artificial Sequence
  Synthetic
aggccctggctgctgatatggtggataaagacgctgcagaacccaccgaaaggaaacttcaaggcaactattaaggagtgggaggtggagcacgcatcgataatggcgggcatctgcagtgaccttttgggacagcggtg

SEQ ID NO: 363368 - DNA, 140 bp, Artificial Sequence
  Synthetic
caccgctgtcccaaaaggtcactgcagatgcccgccattatcgatgcgtgctccacctcccactccttaatagttgccttgaagtttcctttcggtgggttctgcagcgtctttatccaccatatcagcagccagggcct

SEQ ID NO: 363369 - DNA, 140 bp, Artificial Sequence
  Synthetic
atacgccatgctgggtctcccaccaagtgacctttgacacgttccaaaacaaagccaacgtttgctgggctaagagcttggtccctatcctcgaaacagcggggataaaactaaatgatacgtacttgggagtcggccat

SEQ ID NO: 363370 - DNA, 140 bp, Artificial Sequence
  Synthetic
atggccgactcccaagtacgtatcatttagttttatccccgctgtttcgaggatagggaccaagctcttagcccagcaaacgttggctttgttttggaacgtgtcaaaggtcacttggtgggagacccagcatggcgtat

SEQ ID NO: 363371 - DNA, 140 bp, Artificial Sequence; identical to SEQ ID NO: 4725
  Synthetic

SEQ ID NO: 363372 - DNA, 140 bp, Artificial Sequence; identical to SEQ ID NO: 4726
  Synthetic

SEQ ID NO: 363373 - DNA, 140 bp, Artificial Sequence
  Synthetic
aggccctggctgctgatatggaaaaaccataaacagaagtagtttaaagggctataaaacccctgaatagtaacaaaacataaagttaataaaaatcaaatgaataccataattggcaaagaccttttgggacagcggtg

SEQ ID NO: 363374 - DNA, 140 bp, Artificial Sequence
  Synthetic
caccgctgtcccaaaaggtctttgccaattatggtattcatttgatttttattaactttatgttttgttactattcaggggttttatagccctttaaactacttctgtttatggtttttccatatcagcagccagggcct

SEQ ID NO: 363375 - DNA, 140 bp, Artificial Sequence
  Synthetic
aggccctggctgctgatatgaagaggctgcggtgtacctgtggaatgagcagcagcctttgttctggctacaagcccttattccgctggcagccctgattgtcctatgcaactgtctgaggaccttttgggacagcggtg

SEQ ID NO: 363376 - DNA, 140 bp, Artificial Sequence
  Synthetic
caccgctgtcccaaaaggtcctcagacagttgcataggacaatcagggctgccagcggaataagggcttgtagccagaacaaaggctgctgctcattccacaggtacaccgcagcctcttcatatcagcagccagggcct

SEQ ID NO: 363377 - DNA, 140 bp, Artificial Sequence; identical to SEQ ID NO: 4699
  Synthetic

SEQ ID NO: 363378 - DNA, 140 bp, Artificial Sequence; identical to SEQ ID NO: 4700
  Synthetic

SEQ ID NO: 363379 - DNA, 140 bp, Artificial Sequence
  Synthetic
atacgccatgctgggtctccgaggcagcgtccattctagaaagaaagtatccattcacaaaagggaagtggaataccaacaagcagatctgcgtgactaccaggaggatagaagactttacgtacttgggagtcggccat

SEQ ID NO: 363380 - DNA, 140 bp, Artificial Sequence
  Synthetic
atggccgactcccaagtacgtaaagtcttctatcctcctggtagtcacgcagatctgcttgttggtattccacttcccttttgtgaatggatactttctttctagaatggacgctgcctcggagacccagcatggcgtat

SEQ ID NO: 363381 - DNA, 140 bp, Artificial Sequence; identical to SEQ ID NO: 5297
  Synthetic

SEQ ID NO: 363382 - DNA, 140 bp, Artificial Sequence; identical to SEQ ID NO: 5298
  Synthetic

SEQ ID NO: 363383 - DNA, 140 bp, Artificial Sequence
  Synthetic
aggccctggctgctgatatggatgtgcaccatcgtaccgggtaaaacgcatggacatcgcgaagaacgatgaagagtgcgtggtcaacgccgccaaccctcgcgggttaccgggtgacgggaccttttgggacagcggtg

SEQ ID NO: 363384 - DNA, 140 bp, Artificial Sequence
  Synthetic
caccgctgtcccaaaaggtcccgtcacccggtaacccgcgagggttggcggcgttgaccacgcactcttcatcgttcttcgcgatgtccatgcgttttacccggtacgatggtgcacatccatatcagcagccagggcct

SEQ ID NO: 363385 - DNA, 140 bp, Artificial Sequence
  Synthetic
atacgccatgctgggtctcctgtttgcaaggcagtatataaaaaatggccggagtcctttaaaaacagtgcaacaccagtaggaaccgcaaaaacagttatgtgcggtacatatccagtacgtacttgggagtcggccat

SEQ ID NO: 363386 - DNA, 140 bp, Artificial Sequence
  Synthetic
atggccgactcccaagtacgtactggatatgtaccgcacataactgtttttgcggttcctactggtgttgcactgtttttaaaggactccggccattttttatatactgccttgcaaacaggagacccagcatggcgtat

SEQ ID NO: 363387 - DNA, 140 bp, Artificial Sequence
  Synthetic
aggccctggctgctgatatgagtaaagacgtctatgctaatacacaactggtgctgcagagaccggctgtgggtacggtacatgtgccatactctcaggcaccgtctggctttaagtactgaccttttgggacagcggtg

SEQ ID NO: 363388 - DNA, 140 bp, Artificial Sequence
  Synthetic
caccgctgtcccaaaaggtcagtacttaaagccagacggtgcctgagagtatggcacatgtaccgtacccacagccggtctctgcagcaccagttgtgtattagcatagacgtctttactcatatcagcagccagggcct

SEQ ID NO: 363389 - DNA, 140 bp, Artificial Sequence
  Synthetic
atacgccatgctgggtctccggctgaaggaacgaggggcgccgctgcagcacacagcaccatttggctgtcaaatagcaacaaacccggtaagagcggtgaactgcgccgtagggaacatcgtacttgggagtcggccat

SEQ ID NO: 363390 - DNA, 140 bp, Artificial Sequence
  Synthetic
atggccgactcccaagtacgatgttccctacggcgcagttcaccgctcttaccgggtttgttgctatttgacagccaaatggtgctgtgtgctgcagcggcgcccctcgttccttcagccggagacccagcatggcgtat

SEQ ID NO: 363391 - DNA, 140 bp, Artificial Sequence
  Synthetic
atacgccatgctgggtctccgcccatttccattgatataccggatgcagccttcaccagggtcgtcgacgcgccctctctaacggacatgtcgtgcgaagtaccagcctgcacacattcccgtacttgggagtcggccat

SEQ ID NO: 363392 - DNA, 140 bp, Artificial Sequence
  Synthetic
atggccgactcccaagtacgggaatgtgtgcaggctggtacttcgcacgacatgtccgttagagagggcgcgtcgacgaccctggtgaaggctgcatccggtatatcaatggaaatgggcggagacccagcatggcgtat

SEQ ID NO: 363393 - DNA, 140 bp, Artificial Sequence
  Synthetic
atacgccatgctgggtctcctcagacttcgggggcgtcgccattattaaatatgcagccagcaggaaaggcaagtgtgcggtacactcgatgaccaacgccgtcactattcgggaagctgcgtacttgggagtcggccat

SEQ ID NO: 363394 - DNA, 140 bp, Artificial Sequence
  Synthetic
atggccgactcccaagtacgcagcttcccgaatagtgacggcgttggtcatcgagtgtaccgcacacttgcctttcctgctggctgcatatttaataatggcgacgcccccgaagtctgaggagacccagcatggcgtat

SEQ ID NO: 363395 - DNA, 140 bp, Artificial Sequence
  Synthetic
aggccctggctgctgatatgaaaattaataaaaatcaaatgaataccataattggcaaacggaagagatgtaggtacttaagcttcctaaaagcagccgaactcactttgagaagtaggcgaccttttgggacagcggtg

SEQ ID NO: 363396 - DNA, 140 bp, Artificial Sequence
  Synthetic
caccgctgtcccaaaaggtcgcctacttctcaaagtgagttcggctgcttttaggaagcttaagtacctacatctcttccgtttgccaattatggtattcatttgatttttattaattttcatatcagcagccagggcct

SEQ ID NO: 363397 - DNA, 140 bp, Artificial Sequence
  Synthetic
atacgccatgctgggtctcctgggcaacttgcccagctgatctcagcagttaataaactgacaatgcgcgcggtaccccaacagaagccacgcaggaatcggaagaataagaagcaaaagcgtacttgggagtcggccat

SEQ ID NO: 363398 - DNA, 140 bp, Artificial Sequence
  Synthetic
atggccgactcccaagtacgcttttgcttcttattcttccgattcctgcgtggcttctgttggggtaccgcgcgcattgtcagtttattaactgctgagatcagctgggcaagttgcccaggagacccagcatggcgtat

SEQ ID NO: 363399 - DNA, 140 bp, Artificial Sequence
  Synthetic
aggccctggctgctgatatgactaagtatgaaggtatatgtgtcccctaagagacacactgtacataactaataatctatagatcaaagggctacataacccctgaatagtaacaaaatagaccttttgggacagcggtg

SEQ ID NO: 363400 - DNA, 140 bp, Artificial Sequence
  Synthetic
caccgctgtcccaaaaggtctattttgttactattcaggggttatgtagccctttgatctatagattattagttatgtacagtgtgtctcttaggggacacatataccttcatacttagtcatatcagcagccagggcct

SEQ ID NO: 363401 - DNA, 140 bp, Artificial Sequence; identical to SEQ ID NO: 6965
  Synthetic

SEQ ID NO: 363402 - DNA, 140 bp, Artificial Sequence; identical to SEQ ID NO: 6966
  Synthetic

SEQ ID NO: 363403 - DNA, 140 bp, Artificial Sequence
  Synthetic
aggccctggctgctgatatgacttcctacccggtgaagtggatgatttgacagatagcgactggtccacgtgcccagacacggacgacgagttatgactagacagggcaggtgggtatatgaccttttgggacagcggtg

SEQ ID NO: 363404 - DNA, 140 bp, Artificial Sequence
  Synthetic
caccgctgtcccaaaaggtcatatacccacctgccctgtctagtcataactcgtcgtccgtgtctgggcacgtggaccagtcgctatctgtcaaatcatccacttcaccgggtaggaagtcatatcagcagccagggcct

SEQ ID NO: 363405 - DNA, 140 bp, Artificial Sequence
  Synthetic
aggccctggctgctgatatgcactttgagaagtaggcatagcataccgaactcttccacgattctccgaacccacagggacgtaggagatgttattttgtttttaatatttcaaaaaaaagaccttttgggacagcggtg

SEQ ID NO: 363406 - DNA, 140 bp, Artificial Sequence
  Synthetic
caccgctgtcccaaaaggtcttttttttgaaatattaaaaacaaaataacatctcctacgtccctgtgggttcggagaatcgtggaagagttcggtatgctatgcctacttctcaaagtgcatatcagcagccagggcct

SEQ ID NO: 363407 - DNA, 140 bp, Artificial Sequence
  Synthetic
aggccctggctgctgatatgacgactaagcatgaaggtatatgtgtcccctaagagacacaccgtatatagctaataatctgtagatcaaagggctatataacccctgaatagtaacaaagaccttttgggacagcggtg

SEQ ID NO: 363408 - DNA, 140 bp, Artificial Sequence
  Synthetic
caccgctgtcccaaaaggtctttgttactattcaggggttatatagccctttgatctacagattattagctatatacggtgtgtctcttaggggacacatataccttcatgcttagtcgtcatatcagcagccagggcct

SEQ ID NO: 363409 - DNA, 140 bp, Artificial Sequence; identical to SEQ ID NO: 11843
  Synthetic

SEQ ID NO: 363410 - DNA, 140 bp, Artificial Sequence; identical to SEQ ID NO: 11844
  Synthetic

SEQ ID NO: 363411 - DNA, 140 bp, Artificial Sequence
  Synthetic
aggccctggctgctgatatgaaggactaacaactacagacaaagtgattaataactgcaaggttgatcaatgtcatgccgcggtcaccaatcacaaaaagtggcagtataactcccctctgaccttttgggacagcggtg

SEQ ID NO: 363412 - DNA, 140 bp, Artificial Sequence
  Synthetic
caccgctgtcccaaaaggtcagaggggagttatactgccactttttgtgattggtgaccgcggcatgacattgatcaaccttgcagttattaatcactttgtctgtagttgttagtccttcatatcagcagccagggcct

SEQ ID NO: 363413 - DNA, 140 bp, Artificial Sequence; identical to SEQ ID NO: 9945
  Synthetic

SEQ ID NO: 363414 - DNA, 140 bp, Artificial Sequence; identical to SEQ ID NO: 9946
  Synthetic

SEQ ID NO: 363415 - DNA, 140 bp, Artificial Sequence
  Synthetic
aggccctggctgctgatatgtgggcagatgagcaggtactgaaggctaagaacataggattatgttcaacagacctgacggaaggtagacgaggcaaactgtctatcatgagagggaaaagaccttttgggacagcggtg

SEQ ID NO: 363416 - DNA, 140 bp, Artificial Sequence
  Synthetic
caccgctgtcccaaaaggtcttttccctctcatgatagacagtttgcctcgtctaccttccgtcaggtctgttgaacataatcctatgttcttagccttcagtacctgctcatctgcccacatatcagcagccagggcct

SEQ ID NO: 363417 - DNA, 140 bp, Artificial Sequence
  Synthetic
aggccctggctgctgatatgttgcattacgaaggcaaaatgcgcactacgaatgagtacaacatgccgattgtagtggacactacgggctcaacgaaacctgaccctggagacctcgtgtgaccttttgggacagcggtg

SEQ ID NO: 363418 - DNA, 140 bp, Artificial Sequence
  Synthetic
caccgctgtcccaaaaggtcacacgaggtctccagggtcaggtttcgttgagcccgtagtgtccactacaatcggcatgttgtactcattcgtagtgcgcattttgccttcgtaatgcaacatatcagcagccagggcct

SEQ ID NO: 363419 - DNA, 140 bp, Artificial Sequence
  Synthetic
aggccctggctgctgatatgtaacgtgcttcagagggtgggttaaacagctgcaaattgactatcgtggacacgaggtcatgacagcagccgcatcccaagggctaaccagaaaaggagtgaccttttgggacagcggtg

SEQ ID NO: 363420 - DNA, 140 bp, Artificial Sequence
  Synthetic
caccgctgtcccaaaaggtcactccttttctggttagcccttgggatgcggctgctgtcatgacctcgtgtccacgatagtcaatttgcagctgtttaacccaccctctgaagcacgttacatatcagcagccagggcct

SEQ ID NO: 363421 - DNA, 140 bp, Artificial Sequence
  Synthetic
aggccctggctgctgatatgatcacaccgtatgaactgacaccaggagctaccgtccctttcctgcttagcctaatatgctgcatcagaacagctaaagcggccacataccaagaggctggaccttttgggacagcggtg

SEQ ID NO: 363422 - DNA, 140 bp, Artificial Sequence
  Synthetic
caccgctgtcccaaaaggtccagcctcttggtatgtggccgctttagctgttctgatgcagcatattaggctaagcaggaaagggacggtagctcctggtgtcagttcatacggtgtgatcatatcagcagccagggcct

SEQ ID NO: 363423 - DNA, 140 bp, Artificial Sequence; identical to SEQ ID NO: 11171
  Synthetic

SEQ ID NO: 363424 - DNA, 140 bp, Artificial Sequence; identical to SEQ ID NO: 11172
  Synthetic

SEQ ID NO: 363425 - DNA, 140 bp, Artificial Sequence
  Synthetic
aggccctggctgctgatatgcagtagggtcaacgctctacccggaaagccgtaagctacttaagagctggcacctaccatcggtgttccatttaaagggcaagctcagcttcacatgccggaccttttgggacagcggtg

SEQ ID NO: 363426 - DNA, 140 bp, Artificial Sequence
  Synthetic
caccgctgtcccaaaaggtccggcatgtgaagctgagcttgccctttaaatggaacaccgatggtaggtgccagctcttaagtagcttacggctttccgggtagagcgttgaccctactgcatatcagcagccagggcct

SEQ ID NO: 363427 - DNA, 140 bp, Artificial Sequence
  Synthetic
aggccctggctgctgatatgaaattaaatgaataccataattggcaaacggaagagatgtaggtacttaagcttcctaaaagcagccgaactcactttgagaagtaggcgtagcataccggaccttttgggacagcggtg

SEQ ID NO: 363428 - DNA, 140 bp, Artificial Sequence
  Synthetic
caccgctgtcccaaaaggtccggtatgctacgcctacttctcaaagtgagttcggctgcttttaggaagcttaagtacctacatctcttccgtttgccaattatggtattcatttaatttcatatcagcagccagggcct

SEQ ID NO: 363429 - DNA, 140 bp, Artificial Sequence
  Synthetic
aggccctggctgctgatatgtcatgcaaaacagaatttgcatcagcatacagggctcataccgcatctgcatcagctaagctccgcgtcctttaccaaggaaataacatcactgtaactggaccttttgggacagcggtg

SEQ ID NO: 363430 - DNA, 140 bp, Artificial Sequence
  Synthetic
caccgctgtcccaaaaggtccagttacagtgatgttatttccttggtaaaggacgcggagcttagctgatgcagatgcggtatgagccctgtatgctgatgcaaattctgttttgcatgacatatcagcagccagggcct

SEQ ID NO: 363431 - DNA, 140 bp, Artificial Sequence
  Synthetic
atacgccatgctgggtctcctagccacgattggactaagctgcgttacatggacaaccacacgccagcagacgcagagagggcggggctatttgtaagaacatcagcaccgtgcacgattcgtacttgggagtcggccat

SEQ ID NO: 363432 - DNA, 140 bp, Artificial Sequence
  Synthetic
atggccgactcccaagtacgaatcgtgcacggtgctgatgttcttacaaatagccccgccctctctgcgtctgctggcgtgtggttgtccatgtaacgcagcttagtccaatcgtggctaggagacccagcatggcgtat

SEQ ID NO: 363433 - DNA, 140 bp, Artificial Sequence
  Synthetic
aggccctggctgctgatatgtcatagatgcagttgtatccttgaaagccccttacttttgtggagggtttatactgcacgatactgtgacaggaacagcttgcagagtggcagacccgctgaccttttgggacagcggtg

SEQ ID NO: 363434 - DNA, 140 bp, Artificial Sequence
  Synthetic
caccgctgtcccaaaaggtcagcgggtctgccactctgcaagctgttcctgtcacagtatcgtgcagtataaaccctccacaaaagtaaggggctttcaaggatacaactgcatctatgacatatcagcagccagggcct

SEQ ID NO: 363435 - DNA, 140 bp, Artificial Sequence
  Synthetic
aggccctggctgctgatatggacccatcgtaaccctgtacggtggtcctaaataggtacgcactacagctacctatttcgtcagaaaccaatcgcagctacttgcatacctaccagctacgaccttttgggacagcggtg

SEQ ID NO: 363436 - DNA, 140 bp, Artificial Sequence
  Synthetic
caccgctgtcccaaaaggtcgtagctggtaggtatgcaagtagctgcgattggtttctgacgaaataggtagctgtagtgcgtacctatttaggaccaccgtacagggttacgatgggtccatatcagcagccagggcct

SEQ ID NO: 363437 - DNA, 140 bp, Artificial Sequence
  Synthetic
aggccctggctgctgatatgaaatcacccctgagggggccgaagagtggagtcttgccattccagttatgtgcctgctggcaaataccacgttcccctgctcccagcccccttgcacaccgaccttttgggacagcggtg

SEQ ID NO: 363438 - DNA, 140 bp, Artificial Sequence
  Synthetic
caccgctgtcccaaaaggtcggtgtgcaagggggctgggagcaggggaacgtggtatttgccagcaggcacataactggaatggcaagactccactcttcggccccctcaggggtgatttcatatcagcagccagggcct

SEQ ID NO: 363439 - DNA, 140 bp, Artificial Sequence
  Synthetic
aggccctggctgctgatatgaccacatagtcaactacccggcgtcacataccaccctcggggtccaggacatctccgctacggcgatgtcatgggtgcagaagatcacgggaggtgtggggaccttttgggacagcggtg

SEQ ID NO: 363440 - DNA, 140 bp, Artificial Sequence
  Synthetic
caccgctgtcccaaaaggtccccacacctcccgtgatcttctgcacccatgacatcgccgtagcggagatgtcctggaccccgagggtggtatgtgacgccgggtagttgactatgtggtcatatcagcagccagggcct

SEQ ID NO: 363441 - DNA, 140 bp, Artificial Sequence
  Synthetic
aggccctggctgctgatatgcctaaataggtacgcactacagctacctattttgcagaagccgacagcaagtatctaaacactaatcagctacaatggagttcatcccaacccaaactttgaccttttgggacagcggtg

SEQ ID NO: 363442 - DNA, 140 bp, Artificial Sequence
  Synthetic
caccgctgtcccaaaaggtcaaagtttgggttgggatgaactccattgtagctgattagtgtttagatacttgctgtcggcttctgcaaaataggtagctgtagtgcgtacctatttaggcatatcagcagccagggcct

SEQ ID NO: 363443 - DNA, 140 bp, Artificial Sequence
  Synthetic
aggccctggctgctgatatgcagtagtttggcaggtagaaaaggatacagcaccacggaaggcgcactgtattcatatctagaagggacacgttttcaccagacggcagtggatgtggcagaccttttgggacagcggtg

SEQ ID NO: 363444 - DNA, 140 bp, Artificial Sequence
  Synthetic
caccgctgtcccaaaaggtctgccacatccactgccgtctggtgaaaacgtgtcccttctagatatgaatacagtgcgccttccgtggtgctgtatccttttctacctgccaaactactgcatatcagcagccagggcct

SEQ ID NO: 363445 - DNA, 140 bp, Artificial Sequence
  Synthetic
atacgccatgctgggtctccccggaacatgggagaagaaccaaactatcaagaagagtgggtgacgtataagaaggaagtagtgctaaccgtgccgactgaagggctcgaggtcacgtggcgtacttgggagtcggccat

SEQ ID NO: 363446 - DNA, 140 bp, Artificial Sequence
  Synthetic
atggccgactcccaagtacgccacgtgacctcgagcccttcagtcggcacggttagcactacttccttcttatacgtcacccactcttcttgatagtttggttcttctcccatgttccggggagacccagcatggcgtat

SEQ ID NO: 363447 - DNA, 140 bp, Artificial Sequence
  Synthetic
atacgccatgctgggtctcctaaaaattataaaaacagaaaaatacataaataggtatacgtgtcccctaagagacacattgtatgtaggtgataagtatagatcaaagggccgaataaccgtacttgggagtcggccat

SEQ ID NO: 363448 - DNA, 140 bp, Artificial Sequence
  Synthetic
atggccgactcccaagtacggttattcggccctttgatctatacttatcacctacatacaatgtgtctcttaggggacacgtatacctatttatgtatttttctgtttttataatttttaggagacccagcatggcgtat

SEQ ID NO: 363449 - DNA, 140 bp, Artificial Sequence; identical to SEQ ID NO: 4443
  Synthetic

SEQ ID NO: 363450 - DNA, 140 bp, Artificial Sequence; identical to SEQ ID NO: 4444
  Synthetic

SEQ ID NO: 363451 - DNA, 140 bp, Artificial Sequence
  Synthetic
aggccctggctgctgatatggacacattgtatgtaggtgataagtatagatcaaagggccgaataacccctgaatagtaacaaaatatgaaaatcaataaaaatcataaaatagaaaaacgaccttttgggacagcggtg

SEQ ID NO: 363452 - DNA, 140 bp, Artificial Sequence
  Synthetic
caccgctgtcccaaaaggtcgtttttctattttatgatttttattgattttcatattttgttactattcaggggttattcggccctttgatctatacttatcacctacatacaatgtgtccatatcagcagccagggcct

SEQ ID NO: 363453 - DNA, 140 bp, Artificial Sequence; identical to SEQ ID NO: 7035
  Synthetic

SEQ ID NO: 363454 - DNA, 140 bp, Artificial Sequence; identical to SEQ ID NO: 7036
  Synthetic

SEQ ID NO: 363455 - DNA, 140 bp, Artificial Sequence; identical to SEQ ID NO: 4957
  Synthetic

SEQ ID NO: 363456 - DNA, 140 bp, Artificial Sequence; identical to SEQ ID NO: 4958
  Synthetic

SEQ ID NO: 363457 - DNA, 140 bp, Artificial Sequence
  Synthetic
aggccctggctgctgatatggcagaaaacacacacggtctacaagaggcctgatacccagtcaattcagaaggttcaggccgagtttgacagctttgtggtaccgagcctgtggtcgtccgaccttttgggacagcggtg

SEQ ID NO: 363458 - DNA, 140 bp, Artificial Sequence
  Synthetic
caccgctgtcccaaaaggtcggacgaccacaggctcggtaccacaaagctgtcaaactcggcctgaaccttctgaattgactgggtatcaggcctcttgtagaccgtgtgtgttttctgccatatcagcagccagggcct

SEQ ID NO: 363459 - DNA, 140 bp, Artificial Sequence
  Synthetic
aggccctggctgctgatatgcagaacacactacagaatgtactggcagcagccacgaaaaggaactgcaacgtcacacagatgagggaattacccactttggactcagcagtattcaacggaccttttgggacagcggtg

SEQ ID NO: 363460 - DNA, 140 bp, Artificial Sequence
  Synthetic
caccgctgtcccaaaaggtccgttgaatactgctgagtccaaagtgggtaattccctcatctgtgtgacgttgcagttccttttcgtggctgctgccagtacattctgtagtgtgttctgcatatcagcagccagggcct

SEQ ID NO: 363461 - DNA, 140 bp, Artificial Sequence
  Synthetic
aggccctggctgctgatatgatccggcgcctgtgtactcgcctccgatcaacgtccgattgtccaaccccgagtccgcagtggcagcatgcaatgagttcttagctagaaactatccaacgaccttttgggacagcggtg

SEQ ID NO: 363462 - DNA, 140 bp, Artificial Sequence
  Synthetic
caccgctgtcccaaaaggtcgttggatagtttctagctaagaactcattgcatgctgccactgcggactcggggttggacaatcggacgttgatcggaggcgagtacacaggcgccggatcatatcagcagccagggcct

SEQ ID NO: 363463 - DNA, 140 bp, Artificial Sequence
  Synthetic
atacgccatgctgggtctccgcgctatgatgaaatccggtatgttcctaactctgttcgtcaacacattgttaaatatcaccatcgctagccgggtgttggaagatcgtctgacaaaatccgtacttgggagtcggccat

SEQ ID NO: 363464 - DNA, 140 bp, Artificial Sequence
  Synthetic
atggccgactcccaagtacggattttgtcagacgatcttccaacacccggctagcgatggtgatatttaacaatgtgttgacgaacagagttaggaacataccggatttcatcatagcgcggagacccagcatggcgtat

SEQ ID NO: 363465 - DNA, 140 bp, Artificial Sequence
  Synthetic
aggccctggctgctgatatgaagtgcagggtatatcagttgctgtaatgtccatggccacctttgcaagctccagatccaacttcgagaagctcagaggacccgtcataactttgtacgggaccttttgggacagcggtg

SEQ ID NO: 363466 - DNA, 140 bp, Artificial Sequence
  Synthetic
caccgctgtcccaaaaggtcccgtacaaagttatgacgggtcctctgagcttctcgaagttggatctggagcttgcaaaggtggccatggacattacagcaactgatataccctgcacttcatatcagcagccagggcct

SEQ ID NO: 363467 - DNA, 140 bp, Artificial Sequence
  Synthetic
atacgccatgctgggtctccgatcctaatcgtggtgctatgcgtgtcgtttagcaggcactaacttgacaactaggtatgaaggcatatgcgtccctaaagagacacaccacatatagctcgtacttgggagtcggccat

SEQ ID NO: 363468 - DNA, 140 bp, Artificial Sequence
  Synthetic
atggccgactcccaagtacgagctatatgtggtgtgtctctttagggacgcatatgccttcatacctagttgtcaagttagtgcctgctaaacgacacgcatagcaccacgattaggatcggagacccagcatggcgtat

SEQ ID NO: 363469 - DNA, 140 bp, Artificial Sequence
  Synthetic
aggccctggctgctgatatggtttccttgcaaatcggaataaagacggatgatagccatgattggaccaagctgcgttatatggacaatcacatgccagcagacgcagagcgggccgggcgaccttttgggacagcggtg

SEQ ID NO: 363470 - DNA, 140 bp, Artificial Sequence
  Synthetic
caccgctgtcccaaaaggtcgcccggcccgctctgcgtctgctggcatgtgattgtccatataacgcagcttggtccaatcatggctatcatccgtctttattccgatttgcaaggaaaccatatcagcagccagggcct

SEQ ID NO: 363471 - DNA, 140 bp, Artificial Sequence; identical to SEQ ID NO: 11139
  Synthetic

SEQ ID NO: 363472 - DNA, 140 bp, Artificial Sequence; identical to SEQ ID NO: 11140
  Synthetic

SEQ ID NO: 363473 - DNA, 140 bp, Artificial Sequence; identical to SEQ ID NO: 7065
  Synthetic

SEQ ID NO: 363474 - DNA, 140 bp, Artificial Sequence; identical to SEQ ID NO: 7066
  Synthetic

SEQ ID NO: 363475 - DNA, 140 bp, Artificial Sequence
  Synthetic
atacgccatgctgggtctcctccgtacgtgaagtgctgcggtacagcagagtgcaaggacaaaaacctacctgactacagctgtaaggtcttcaccggcgtctacccatttatgtggggccgtacttgggagtcggccat

SEQ ID NO: 363476 - DNA, 140 bp, Artificial Sequence
  Synthetic
atggccgactcccaagtacggccccacataaatgggtagacgccggtgaagaccttacagctgtagtcaggtaggtttttgtccttgcactctgctgtaccgcagcacttcacgtacggaggagacccagcatggcgtat

SEQ ID NO: 363477 - DNA, 140 bp, Artificial Sequence
  Synthetic
aggccctggctgctgatatgtggacgggtcggagagttgcctggatcgagcgacattcaatccgtcaaaacttaggagctacccgaaacagcacgcttaccacgcgccctccatcagaaggaccttttgggacagcggtg

SEQ ID NO: 363478 - DNA, 140 bp, Artificial Sequence
  Synthetic
caccgctgtcccaaaaggtccttctgatggagggcgcgtggtaagcgtgctgtttcgggtagctcctaagttttgacggattgaatgtcgctcgatccaggcaactctccgacccgtccacatatcagcagccagggcct

SEQ ID NO: 363479 - DNA, 140 bp, Artificial Sequence
  Synthetic
aggccctggctgctgatatgaggaatttcacaactcatgtcatgaacaatcaactgaatgcagcctttgtaggacaggccacccgagcaggatgtgcaccgtcgtaccgggtaaaacgcagaccttttgggacagcggtg

SEQ ID NO: 363480 - DNA, 140 bp, Artificial Sequence
  Synthetic
caccgctgtcccaaaaggtctgcgttttacccggtacgacggtgcacatcctgctcgggtggcctgtcctacaaaggctgcattcagttgattgttcatgacatgagttgtgaaattcctcatatcagcagccagggcct

SEQ ID NO: 363481 - DNA, 140 bp, Artificial Sequence
  Synthetic
aggccctggctgctgatatgctactaagagagtcacttgggtagcgccgttaggtgtccgcggagcggactacacatacaacctagagttgggtctgccagcaacgcttggtaggtatgagaccttttgggacagcggtg

SEQ ID NO: 363482 - DNA, 140 bp, Artificial Sequence
  Synthetic
caccgctgtcccaaaaggtctcatacctaccaagcgttgctggcagacccaactctaggttgtatgtgtagtccgctccgcggacacctaacggcgctacccaagtgactctcttagtagcatatcagcagccagggcct

SEQ ID NO: 363483 - DNA, 140 bp, Artificial Sequence; identical to SEQ ID NO: 7763
  Synthetic

SEQ ID NO: 363484 - DNA, 140 bp, Artificial Sequence; identical to SEQ ID NO: 7764
  Synthetic

SEQ ID NO: 363485 - DNA, 140 bp, Artificial Sequence
  Synthetic
atacgccatgctgggtctcctatttgtaagaacgtcagcaccgtgcacgattactggaacaatgggacacttcattctggcccgatgtccgaaaggagaaactctgacggtggggttcaccgtacttgggagtcggccat

SEQ ID NO: 363486 - DNA, 140 bp, Artificial Sequence
  Synthetic
atggccgactcccaagtacggtgaaccccaccgtcagagtttctcctttcggacatcgggccagaatgaagtgtcccattgttccagtaatcgtgcacggtgctgacgttcttacaaataggagacccagcatggcgtat

SEQ ID NO: 363487 - DNA, 140 bp, Artificial Sequence; identical to SEQ ID NO: 10977
  Synthetic

SEQ ID NO: 363488 - DNA, 140 bp, Artificial Sequence; identical to SEQ ID NO: 10978
  Synthetic

SEQ ID NO: 363489 - DNA, 140 bp, Artificial Sequence
  Synthetic
aggccctggctgctgatatgcctatgcaaacggcgaccatgccgtcacagttaaggacgccaaattcattgtggggccaatgtcttcagcctggacacctttcgacaacaaaattgtggtgaccttttgggacagcggtg

SEQ ID NO: 363490 - DNA, 140 bp, Artificial Sequence
  Synthetic
caccgctgtcccaaaaggtcaccacaattttgttgtcgaaaggtgtccaggctgaagacattggccccacaatgaatttggcgtccttaactgtgacggcatggtcgccgtttgcataggcatatcagcagccagggcct

SEQ ID NO: 363491 - DNA, 140 bp, Artificial Sequence; identical to SEQ ID NO: 5291
  Synthetic

SEQ ID NO: 363492 - DNA, 140 bp, Artificial Sequence; identical to SEQ ID NO: 5292
  Synthetic

SEQ ID NO: 363493 - DNA, 140 bp, Artificial Sequence
  Synthetic
  misc_feature (63)..(63): n is a, c, g, or t
atacgccatgctgggtctcccgctggcggcgggagatgaacaagacgacgacagaagacgtgnactggctgacgaagtggtcagatggcaacgaacagggctaattgacgagctagaaaacgtacttgggagtcggccat

SEQ ID NO: 363494 - DNA, 140 bp, Artificial Sequence
  Synthetic
  misc_feature (78)..(78): n is a, c, g, or t
atggccgactcccaagtacgttttctagctcgtcaattagccctgttcgttgccatctgaccacttcgtcagccagtncacgtcttctgtcgtcgtcttgttcatctcccgccgccagcgggagacccagcatggcgtat

SEQ ID NO: 363495 - DNA, 140 bp, Artificial Sequence
  Synthetic
aggccctggctgctgatatgacataggattatgttcaacagacctgacggaaggtagacgaggcaaattgtctatcatgagagggaaaaagctaaaaccgtgcgaccgtgtgctgttctcgaccttttgggacagcggtg

SEQ ID NO: 363496 - DNA, 140 bp, Artificial Sequence
  Synthetic
caccgctgtcccaaaaggtcgagaacagcacacggtcgcacggttttagctttttccctctcatgatagacaatttgcctcgtctaccttccgtcaggtctgttgaacataatcctatgtcatatcagcagccagggcct

SEQ ID NO: 363497 - DNA, 140 bp, Artificial Sequence
  Synthetic
atacgccatgctgggtctcctgaggtggaaccaaggcaggtcacaccgaatgaccatgctaatgctagagcgttctcgcatctagctataaaactaatagagcaggaaattgatcccgaccgtacttgggagtcggccat

SEQ ID NO: 363498 - DNA, 140 bp, Artificial Sequence
  Synthetic
atggccgactcccaagtacggtcgggatcaatttcctgctctattagttttatagctagatgcgagaacgctctagcattagcatggtcattcggtgtgacctgccttggttccacctcaggagacccagcatggcgtat

SEQ ID NO: 363499 - DNA, 140 bp, Artificial Sequence
  Synthetic
aggccctggctgctgatatgaaaaaaacagaaaaatacataaataggtatacgtgtcccctaagagacacattgtatgtaggtgataagtatagatcaaagggccgaataacccctgaatgaccttttgggacagcggtg

SEQ ID NO: 363500 - DNA, 140 bp, Artificial Sequence
  Synthetic
caccgctgtcccaaaaggtcattcaggggttattcggccctttgatctatacttatcacctacatacaatgtgtctcttaggggacacgtatacctatttatgtatttttctgtttttttcatatcagcagccagggcct

SEQ ID NO: 363501 - DNA, 140 bp, Artificial Sequence
  Synthetic
atacgccatgctgggtctccgttaataaaaatcaaatgaataccataattggcaaacggaagagatgtaggtacttaagcttcctaaaagcagccgaactcactttgagaagtaggcatacgtacttgggagtcggccat

SEQ ID NO: 363502 - DNA, 140 bp, Artificial Sequence
  Synthetic
atggccgactcccaagtacgtatgcctacttctcaaagtgagttcggctgcttttaggaagcttaagtacctacatctcttccgtttgccaattatggtattcatttgatttttattaacggagacccagcatggcgtat

SEQ ID NO: 363503 - DNA, 140 bp, Artificial Sequence
  Synthetic
atacgccatgctgggtctcctggtggggctgaaccagagaatagtggttaacggcagaacgcaacggaacacgaacaccatgaagaactatctgcttcccgtggtcgcccaggccttcagcgtacttgggagtcggccat

SEQ ID NO: 363504 - DNA, 140 bp, Artificial Sequence
  Synthetic
atggccgactcccaagtacgctgaaggcctgggcgaccacgggaagcagatagttcttcatggtgttcgtgttccgttgcgttctgccgttaaccactattctctggttcagccccaccaggagacccagcatggcgtat

SEQ ID NO: 363505 - DNA, 140 bp, Artificial Sequence
  Synthetic
aggccctggctgctgatatggaagagatgtaggtacttaagcttcctaaaagcagccgaactcactttgagaagtaggcatagcataccgaactcttccacgattctccgaacccacagggaccttttgggacagcggtg

SEQ ID NO: 363506 - DNA, 140 bp, Artificial Sequence
  Synthetic
caccgctgtcccaaaaggtccctgtgggttcggagaatcgtggaagagttcggtatgctatgcctacttctcaaagtgagttcggctgcttttaggaagcttaagtacctacatctcttccatatcagcagccagggcct

SEQ ID NO: 363507 - DNA, 140 bp, Artificial Sequence; identical to SEQ ID NO: 8753
  Synthetic

SEQ ID NO: 363508 - DNA, 140 bp, Artificial Sequence; identical to SEQ ID NO: 8754
  Synthetic

SEQ ID NO: 363509 - DNA, 140 bp, Artificial Sequence
  Synthetic
aggccctggctgctgatatgatgttactaaactaaaagggccaaaagcagcagcgctattcgcaaaaacccataatctactgccactacaggaagtaccaatggataggttcacagtagagaccttttgggacagcggtg

SEQ ID NO: 363510 - DNA, 140 bp, Artificial Sequence
  Synthetic
caccgctgtcccaaaaggtctctactgtgaacctatccattggtacttcctgtagtggcagtagattatgggtttttgcgaatagcgctgctgcttttggcccttttagtttagtaacatcatatcagcagccagggcct

SEQ ID NO: 363511 - DNA, 140 bp, Artificial Sequence; identical to SEQ ID NO: 7103
  Synthetic

SEQ ID NO: 363512 - DNA, 140 bp, Artificial Sequence; identical to SEQ ID NO: 7104
  Synthetic

SEQ ID NO: 363513 - DNA, 140 bp, Artificial Sequence
  Synthetic
aggccctggctgctgatatgacgccaagtttgtcgtgggaccaatgtcctccgcctggacaccttttgacaacaaaatcgtggtgtacaaaggcgacgtctacaacatggactacccaccgaccttttgggacagcggtg

SEQ ID NO: 363514 - DNA, 140 bp, Artificial Sequence
  Synthetic
caccgctgtcccaaaaggtcggtgggtagtccatgttgtagacgtcgcctttgtacaccacgattttgttgtcaaaaggtgtccaggcggaggacattggtcccacgacaaacttggcgtcatatcagcagccagggcct

SEQ ID NO: 363515 - DNA, 140 bp, Artificial Sequence
  Synthetic
atacgccatgctgggtctcctctacaagaggcctgatacccagtcaatccagaaggttcaggccgaatttgacagctttgtagtaccgggcctgtggtcgtccgggttgtcaatcccgttcgtacttgggagtcggccat

SEQ ID NO: 363516 - DNA, 140 bp, Artificial Sequence
  Synthetic
atggccgactcccaagtacgaacgggattgacaacccggacgaccacaggcccggtactacaaagctgtcaaattcggcctgaaccttctggattgactgggtatcaggcctcttgtagaggagacccagcatggcgtat

SEQ ID NO: 363517 - DNA, 140 bp, Artificial Sequence
  Synthetic
aggccctggctgctgatatgagtccgcagtggcagcatgcaatgagttcttagctagaaactatccaactgtctcatcataccaaattaccgacgagtatgatgcatatctagacatggtgaccttttgggacagcggtg

SEQ ID NO: 363518 - DNA, 140 bp, Artificial Sequence
  Synthetic
caccgctgtcccaaaaggtcaccatgtctagatatgcatcatactcgtcggtaatttggtatgatgagacagttggatagtttctagctaagaactcattgcatgctgccactgcggactcatatcagcagccagggcct

SEQ ID NO: 363519 - DNA, 140 bp, Artificial Sequence
  Synthetic
atacgccatgctgggtctccaaaaaaaacagaaaaatatataaataggtatacgtgtcccctaagagacacattgtatgtaggtgataagtatagatcaaagggccgaacaacccctgaacgtacttgggagtcggccat

SEQ ID NO: 363520 - DNA, 140 bp, Artificial Sequence
  Synthetic
atggccgactcccaagtacgttcaggggttgttcggccctttgatctatacttatcacctacatacaatgtgtctcttaggggacacgtatacctatttatatatttttctgttttttttggagacccagcatggcgtat

SEQ ID NO: 363521 - DNA, 140 bp, Artificial Sequence
  Synthetic
aggccctggctgctgatatgatgcgtgtcgtttagcaggcactaacttgacaactaggtatgaaggcatacgcgtccctaaagagacacaccacatatagctaagaatcaatagataagtgaccttttgggacagcggtg

SEQ ID NO: 363522 - DNA, 140 bp, Artificial Sequence
  Synthetic
caccgctgtcccaaaaggtcacttatctattgattcttagctatatgtggtgtgtctctttagggacgcgtatgccttcatacctagttgtcaagttagtgcctgctaaacgacacgcatcatatcagcagccagggcct

SEQ ID NO: 363523 - DNA, 140 bp, Artificial Sequence
  Synthetic
atacgccatgctgggtctcccccaaagtacaaaatagaaggagtgcaaaaagtcaaatgctctaaggtaatgctatttgaccataacgtgccatcgcgcgtaagtccaagggaatatagacgtacttgggagtcggccat

SEQ ID NO: 363524 - DNA, 140 bp, Artificial Sequence
  Synthetic
atggccgactcccaagtacgtctatattcccttggacttacgcgcgatggcacgttatggtcaaatagcattaccttagagcatttgactttttgcactccttctattttgtactttgggggagacccagcatggcgtat

SEQ ID NO: 363525 - DNA, 140 bp, Artificial Sequence
  Synthetic
atacgccatgctgggtctcccttgctttgatcgccttggtgagaccaagacagaaagttgtactttgtggtgacccgaagcagtgcggcttcttcaatatgatgcagatgaaagtcaactcgtacttgggagtcggccat

SEQ ID NO: 363526 - DNA, 140 bp, Artificial Sequence
  Synthetic
atggccgactcccaagtacgagttgactttcatctgcatcatattgaagaagccgcactgcttcgggtcaccacaaagtacaactttctgtcttggtctcaccaaggcgatcaaagcaagggagacccagcatggcgtat

SEQ ID NO: 363527 - DNA, 140 bp, Artificial Sequence
  Synthetic
aggccctggctgctgatatgtgacccgaagcagtgcggcttcttcaatatgatgcagatgaaagtcaactacaatcataacatctgcacccaagtgtaccacaaaagtatctccaggcgggaccttttgggacagcggtg

SEQ ID NO: 363528 - DNA, 140 bp, Artificial Sequence
  Synthetic
caccgctgtcccaaaaggtcccgcctggagatacttttgtggtacacttgggtgcagatgttatgattgtagttgactttcatctgcatcatattgaagaagccgcactgcttcgggtcacatatcagcagccagggcct

SEQ ID NO: 363529 - DNA, 140 bp, Artificial Sequence
  Synthetic
  misc_feature (103)..(103): n is a, c, g, or t
atacgccatgctgggtctccactccaggagagtgcatccatggccaacagaagcaggtatcagtcgcgcaaagtagaaaacatgaaagcaacaatcatccagngacttgatagaggctgccgtacttgggagtcggccat

SEQ ID NO: 363530 - DNA, 140 bp, Artificial Sequence
  Synthetic
  misc_feature (38)..(38): n is a, c, g, or t
atggccgactcccaagtacggcagcctctatcaagtcnctggatgattgttgctttcatgttttctactttgcgcgactgatacctgcttctgttggccatggatgcactctcctggagtggagacccagcatggcgtat

SEQ ID NO: 363531 - DNA, 140 bp, Artificial Sequence
  Synthetic
aggccctggctgctgatatgccgtccgcgggtacggtgcacgtgccgtactctcaggcaccatctggcttcaagtattggctaaaagaacgaggggcgtcgctgcagcacacagcaccatgaccttttgggacagcggtg

SEQ ID NO: 363532 - DNA, 140 bp, Artificial Sequence
  Synthetic
caccgctgtcccaaaaggtcatggtgctgtgtgctgcagcgacgcccctcgttcttttagccaatacttgaagccagatggtgcctgagagtacggcacgtgcaccgtacccgcggacggcatatcagcagccagggcct

SEQ ID NO: 363533 - DNA, 140 bp, Artificial Sequence
  Synthetic
aggccctggctgctgatatggctcaacgaaacctgaccctggagacctcgtgttaacgtgcttcagagggtgggttaaacaactgcaaattgactatcgtggacacgaggtcatgacagcgaccttttgggacagcggtg

SEQ ID NO: 363534 - DNA, 140 bp, Artificial Sequence
  Synthetic
caccgctgtcccaaaaggtcgctgtcatgacctcgtgtccacgatagtcaatttgcagttgtttaacccaccctctgaagcacgttaacacgaggtctccagggtcaggtttcgttgagccatatcagcagccagggcct

SEQ ID NO: 363535 - DNA, 140 bp, Artificial Sequence
  Synthetic
atacgccatgctgggtctccaggaagtaccactgcgtctgcccgatgcgcagtgcggaagatcccgagagactcgccaattatgcgagaaagctagcatctgccgcaggaaaagtcctggcgtacttgggagtcggccat

SEQ ID NO: 363536 - DNA, 140 bp, Artificial Sequence
  Synthetic
atggccgactcccaagtacgccaggacttttcctgcggcagatgctagctttctcgcataattggcgagtctctcgggatcttccgcactgcgcatcgggcagacgcagtggtacttcctggagacccagcatggcgtat

SEQ ID NO: 363537 - DNA, 140 bp, Artificial Sequence
  Synthetic
atacgccatgctgggtctccctaatccgccctaccacgaattcgcatacgaagggctaaaaattcgccccgcttgtccatacaaaattgcagtcataggagtcttcggggtaccaggatccgtacttgggagtcggccat

SEQ ID NO: 363538 - DNA, 140 bp, Artificial Sequence
  Synthetic
atggccgactcccaagtacggatcctggtaccccgaagactcctatgactgcaattttgtatggacaagcggggcgaatttttagcccttcgtatgcgaattcgtggtagggcggattagggagacccagcatggcgtat

SEQ ID NO: 363539 - DNA, 140 bp, Artificial Sequence
  Synthetic
aggccctggctgctgatatgctctactctgcaaagcaagagattaataacccatcatggatcctgtgtacgtggacatagacgctgacagcgcctttttgaaggccctgcaacgtgcgtagaccttttgggacagcggtg

SEQ ID NO: 363540 - DNA, 140 bp, Artificial Sequence
  Synthetic
caccgctgtcccaaaaggtctacgcacgttgcagggccttcaaaaaggcgctgtcagcgtctatgtccacgtacacaggatccatgatgggttattaatctcttgctttgcagagtagagcatatcagcagccagggcct

SEQ ID NO: 363541 - DNA, 140 bp, Artificial Sequence
  Synthetic
aggccctggctgctgatatgcgaaaatcacccctgagggggccgaagagtggagtcttgccattccagttatgtgcctgctggcaaacaccacgttcccctgctcccagcccccttgcgcgaccttttgggacagcggtg

SEQ ID NO: 363542 - DNA, 140 bp, Artificial Sequence
  Synthetic
caccgctgtcccaaaaggtcgcgcaagggggctgggagcaggggaacgtggtgtttgccagcaggcacataactggaatggcaagactccactcttcggccccctcaggggtgattttcgcatatcagcagccagggcct

SEQ ID NO: 363543 - DNA, 140 bp, Artificial Sequence
  Synthetic
aggccctggctgctgatatgtactcggagtccgaaggggaccgggaattggcggctgcctatcgagaagtcgcaaaggaagtaactagactgggagtaaatagcgtagctatacctctccgaccttttgggacagcggtg

SEQ ID NO: 363544 - DNA, 140 bp, Artificial Sequence
  Synthetic
caccgctgtcccaaaaggtcggagaggtatagctacgctatttactcccagtctagttacttcctttgcgacttctcgataggcagccgccaattcccggtccccttcggactccgagtacatatcagcagccagggcct

SEQ ID NO: 363545 - DNA, 140 bp, Artificial Sequence
  Synthetic
aggccctggctgctgatatgcaatgcgcgcggtaccccaacagaagccacgcaggaatcggaagaataagaagcaaaagcaaaaacaacaggcgccacaaaacaacacaaatcaaaagaagaccttttgggacagcggtg

SEQ ID NO: 363546 - DNA, 140 bp, Artificial Sequence
  Synthetic
caccgctgtcccaaaaggtcttcttttgatttgtgttgttttgtggcgcctgttgtttttgcttttgcttcttattcttccgattcctgcgtggcttctgttggggtaccgcgcgcattgcatatcagcagccagggcct

SEQ ID NO: 363547 - DNA, 140 bp, Artificial Sequence
  Synthetic
aggccctggctgctgatatggctagggggtgactcactgagactgctcaaaccgggtggctctctattgatcagagcatacggttacgcagatagaaccagtgaacgagtaatctgcgtagaccttttgggacagcggtg

SEQ ID NO: 363548 - DNA, 140 bp, Artificial Sequence
  Synthetic
caccgctgtcccaaaaggtctacgcagattactcgttcactggttctatctgcgtaaccgtatgctctgatcaatagagagccacccggtttgagcagtctcagtgagtcaccccctagccatatcagcagccagggcct

SEQ ID NO: 363549 - DNA, 140 bp, Artificial Sequence
  Synthetic
atacgccatgctgggtctccggcgacggccccgtgctgctgcccgacaaccactacctgagcacccagtccgccctgagcaaagaccccaacgagaagcgcgatcacatggtcctgctggcgtacttgggagtcggccat

SEQ ID NO: 363550 - DNA, 140 bp, Artificial Sequence
  Synthetic
atggccgactcccaagtacgccagcaggaccatgtgatcgcgcttctcgttggggtctttgctcagggcggactgggtgctcaggtagtggttgtcgggcagcagcacggggccgtcgccggagacccagcatggcgtat

SEQ ID NO: 363551 - DNA, 140 bp, Artificial Sequence
  Synthetic
aggccctggctgctgatatgataaaaatcaaatgaataccataattggcaaacggaagagatgtaggtacttaagcttcctaaaagcagccgaactcactttgagaagtaggcatagcatgaccttttgggacagcggtg

SEQ ID NO: 363552 - DNA, 140 bp, Artificial Sequence
  Synthetic
caccgctgtcccaaaaggtcatgctatgcctacttctcaaagtgagttcggctgcttttaggaagcttaagtacctacatctcttccgtttgccaattatggtattcatttgatttttatcatatcagcagccagggcct

SEQ ID NO: 363553 - DNA, 140 bp, Artificial Sequence
  Synthetic
aggccctggctgctgatatgggacaggccacccgagcaggatgtgcaccatcgtaccgggtaaaacgcatggacatcgcgaagaacgatgaagagtgcgtggtcaacgccgccaaccctcgaccttttgggacagcggtg

SEQ ID NO: 363554 - DNA, 140 bp, Artificial Sequence
  Synthetic
caccgctgtcccaaaaggtcgagggttggcggcgttgaccacgcactcttcatcgttcttcgcgatgtccatgcgttttacccggtacgatggtgcacatcctgctcgggtggcctgtcccatatcagcagccagggcct

SEQ ID NO: 363555 - DNA, 140 bp, Artificial Sequence
  Synthetic
aggccctggctgctgatatggaaaaagaagccgggccgcagagagaggatgtgcatgaaaatcgaaaatgattgtattttcgaagtcaagcacgaaggtaaggtaacaggttacgcgtgcgaccttttgggacagcggtg

SEQ ID NO: 363556 - DNA, 140 bp, Artificial Sequence
  Synthetic
caccgctgtcccaaaaggtcgcacgcgtaacctgttaccttaccttcgtgcttgacttcgaaaatacaatcattttcgattttcatgcacatcctctctctgcggcccggcttctttttccatatcagcagccagggcct

SEQ ID NO: 363557 - DNA, 140 bp, Artificial Sequence
  Synthetic
atacgccatgctgggtctccagttcgtgaccgccgccgggatcactctcggcatggacgagctgtacaagtaattaattaagggcccaattgcctagggtttaaactccggacctgcaggcgtacttgggagtcggccat

SEQ ID NO: 363558 - DNA, 140 bp, Artificial Sequence
  Synthetic
atggccgactcccaagtacgcctgcaggtccggagtttaaaccctaggcaattgggcccttaattaattacttgtacagctcgtccatgccgagagtgatcccggcggcggtcacgaactggagacccagcatggcgtat

SEQ ID NO: 363559 - DNA, 140 bp, Artificial Sequence
  Synthetic
aggccctggctgctgatatgtgtcatgaacaatcaactgaatgcagcctttgtaggacaggccacccgagcaggatgtgcaccatcgtaccgggtaaaacgcatggacatcgcgaagaacgaccttttgggacagcggtg

SEQ ID NO: 363560 - DNA, 140 bp, Artificial Sequence
  Synthetic
caccgctgtcccaaaaggtcgttcttcgcgatgtccatgcgttttacccggtacgatggtgcacatcctgctcgggtggcctgtcctacaaaggctgcattcagttgattgttcatgacacatatcagcagccagggcct

SEQ ID NO: 363561 - DNA, 140 bp, Artificial Sequence
  Synthetic
atacgccatgctgggtctccgatgaagagtgcgtggttaacgccgccaaccctcgcgggttaccaggtgacggtgtttgcaaggcagtatataaaaaatggccggagtcctttaaaaacacgtacttgggagtcggccat

SEQ ID NO: 363562 - DNA, 140 bp, Artificial Sequence
  Synthetic
atggccgactcccaagtacgtgtttttaaaggactccggccattttttatatactgccttgcaaacaccgtcacctggtaacccgcgagggttggcggcgttaaccacgcactcttcatcggagacccagcatggcgtat

SEQ ID NO: 363563 - DNA, 140 bp, Artificial Sequence
  Synthetic
atacgccatgctgggtctccggacaaccacatgccagcagacgcagagagggcggggctatttgtaagaacatcagcaccgtgtacgattactggaacaatgggacacttcatcctggcccgtacttgggagtcggccat

SEQ ID NO: 363564 - DNA, 140 bp, Artificial Sequence
  Synthetic
atggccgactcccaagtacgggccaggatgaagtgtcccattgttccagtaatcgtacacggtgctgatgttcttacaaatagccccgccctctctgcgtctgctggcatgtggttgtccggagacccagcatggcgtat

SEQ ID NO: 363565 - DNA, 140 bp, Artificial Sequence
  Synthetic
atacgccatgctgggtctccgtaatccacgccgtaggaccaaacttctcaaattattcggagtctgaaggggaccgggaattggcggctgcctatcgagaagtcgcaaaggaagtaactacgtacttgggagtcggccat

SEQ ID NO: 363566 - DNA, 140 bp, Artificial Sequence
  Synthetic
atggccgactcccaagtacgtagttacttcctttgcgacttctcgataggcagccgccaattcccggtccccttcagactccgaataatttgagaagtttggtcctacggcgtggattacggagacccagcatggcgtat

SEQ ID NO: 363567 - DNA, 140 bp, Artificial Sequence
  Synthetic
aggccctggctgctgatatgcactttggagccaacgctatcgcttgattacatcacgtgcgagtataaaaccgtcatcccgtctccgtacgtgaaatgctgcggtacagcagagtgcaaggaccttttgggacagcggtg

SEQ ID NO: 363568 - DNA, 140 bp, Artificial Sequence
  Synthetic
caccgctgtcccaaaaggtccttgcactctgctgtaccgcagcatttcacgtacggagacgggatgacggttttatactcgcacgtgatgtaatcaagcgatagcgttggctccaaagtgcatatcagcagccagggcct

SEQ ID NO: 363569 - DNA, 140 bp, Artificial Sequence
  Synthetic
atacgccatgctgggtctccgggagaagaaaatatctgaggccatacagatgcggacccaagtggagctgctggatgagcacatctccatagactgcgatgtcattcgcgtgcaccctgacgtacttgggagtcggccat

SEQ ID NO: 363570 - DNA, 140 bp, Artificial Sequence
  Synthetic
atggccgactcccaagtacgtcagggtgcacgcgaatgacatcgcagtctatggagatgtgctcatccagcagctccacttgggtccgcatctgtatggcctcagatattttcttctcccggagacccagcatggcgtat

SEQ ID NO: 363571 - DNA, 140 bp, Artificial Sequence; identical to SEQ ID NO: 9087
  Synthetic

SEQ ID NO: 363572 - DNA, 140 bp, Artificial Sequence; identical to SEQ ID NO: 9088
  Synthetic

SEQ ID NO: 363573 - DNA, 140 bp, Artificial Sequence
  Synthetic
atacgccatgctgggtctcccagtagtttggcaggcagaaaaggatacagcaccacggaaggcgcactgtattcatatctagaagggacacgttttcaccagacggcagtggatatggcacgtacttgggagtcggccat

SEQ ID NO: 363574 - DNA, 140 bp, Artificial Sequence
  Synthetic
atggccgactcccaagtacgtgccatatccactgccgtctggtgaaaacgtgtcccttctagatatgaatacagtgcgccttccgtggtgctgtatccttttctgcctgccaaactactgggagacccagcatggcgtat

SEQ ID NO: 363575 - DNA, 140 bp, Artificial Sequence; identical to SEQ ID NO: 7169
  Synthetic

SEQ ID NO: 363576 - DNA, 140 bp, Artificial Sequence; identical to SEQ ID NO: 7170
  Synthetic

SEQ ID NO: 363577 - DNA, 140 bp, Artificial Sequence
  Synthetic
atacgccatgctgggtctccatgccatgccgcggtcaccaatcacaaaaaatggcagtataattcccctctggtcccgcgcaatgctgaattcggggaccggaaaggaaaagttcacattcgtacttgggagtcggccat

SEQ ID NO: 363578 - DNA, 140 bp, Artificial Sequence
  Synthetic
atggccgactcccaagtacgaatgtgaacttttcctttccggtccccgaattcagcattgcgcgggaccagaggggaattatactgccattttttgtgattggtgaccgcggcatggcatggagacccagcatggcgtat

SEQ ID NO: 363579 - DNA, 140 bp, Artificial Sequence; identical to SEQ ID NO: 11997
  Synthetic

SEQ ID NO: 363580 - DNA, 140 bp, Artificial Sequence; identical to SEQ ID NO: 11998
  Synthetic

SEQ ID NO: 363581 - DNA, 140 bp, Artificial Sequence
  Synthetic
aggccctggctgctgatatgtcggaaaccttgcggccgtgtctgactgggtaatgagcaccgtacctgtcgcgccgcctagaagaaggagagggagaaacctgaccgtgatatgtgacgagaccttttgggacagcggtg

SEQ ID NO: 363582 - DNA, 140 bp, Artificial Sequence
  Synthetic
caccgctgtcccaaaaggtctcgtcacatatcacggtcaggtttctccctctccttcttctaggcggcgcgacaggtacggtgctcattacccagtcagacacggccgcaaggtttccgacatatcagcagccagggcct

SEQ ID NO: 363583 - DNA, 140 bp, Artificial Sequence
  Synthetic
atacgccatgctgggtctccaaggagtgcaaaaagtcaaatgctccaaggtaatgttattcgatcacaatgtgccatcgcgcgtaagtccaagggaatacagatcttcccaggagtctgtcgtacttgggagtcggccat

SEQ ID NO: 363584 - DNA, 140 bp, Artificial Sequence
  Synthetic
atggccgactcccaagtacgacagactcctgggaagatctgtattcccttggacttacgcgcgatggcacattgtgatcgaataacattaccttggagcatttgactttttgcactccttggagacccagcatggcgtat

SEQ ID NO: 363585 - DNA, 140 bp, Artificial Sequence
  Synthetic
atacgccatgctgggtctccacaggaagtgagtacgacaacgtcattgacgcatagccagtttgatctaagcgccgatggcgagacactgcctgtcccgtcagacctggatgctgacgcccgtacttgggagtcggccat

SEQ ID NO: 363586 - DNA, 140 bp, Artificial Sequence
  Synthetic
atggccgactcccaagtacgggcgtcagcatccaggtctgacgggacaggcagtgtctcgccatcggcgcttagatcaaactggctatgcgtcaatgacgttgtcgtactcacttcctgtggagacccagcatggcgtat

SEQ ID NO: 363587 - DNA, 140 bp, Artificial Sequence; identical to SEQ ID NO: 7197
  Synthetic

SEQ ID NO: 363588 - DNA, 140 bp, Artificial Sequence; identical to SEQ ID NO: 7198
  Synthetic

SEQ ID NO: 363589 - DNA, 140 bp, Artificial Sequence
  Synthetic
aggccctggctgctgatatgagaagtatacaccatgtggccaaagcagacggaggctaatgaacaagtttgcttgtacgcgttgggggaaagtatagaatcaatcaggcaaaagtgcccagaccttttgggacagcggtg

SEQ ID NO: 363590 - DNA, 140 bp, Artificial Sequence
  Synthetic
caccgctgtcccaaaaggtctgggcacttttgcctgattgattctatactttcccccaacgcgtacaagcaaacttgttcattagcctccgtctgctttggccacatggtgtatacttctcatatcagcagccagggcct

SEQ ID NO: 363591 - DNA, 140 bp, Artificial Sequence; identical to SEQ ID NO: 7187
  Synthetic

SEQ ID NO: 363592 - DNA, 140 bp, Artificial Sequence; identical to SEQ ID NO: 7188
  Synthetic

SEQ ID NO: 363593 - DNA, 140 bp, Artificial Sequence; identical to SEQ ID NO: 7189
  Synthetic

SEQ ID NO: 363594 - DNA, 140 bp, Artificial Sequence; identical to SEQ ID NO: 7190
  Synthetic

SEQ ID NO: 363595 - DNA, 140 bp, Artificial Sequence
  Synthetic
aggccctggctgctgatatgcggcgcctgtgtactcgcctccgatcaacgtccgattgtccaatcccgagtccgcagtggcagcatgtaatgagttcttagctagaaactacccaactgtgaccttttgggacagcggtg

SEQ ID NO: 363596 - DNA, 140 bp, Artificial Sequence
  Synthetic
caccgctgtcccaaaaggtcacagttgggtagtttctagctaagaactcattacatgctgccactgcggactcgggattggacaatcggacgttgatcggaggcgagtacacaggcgccgcatatcagcagccagggcct

SEQ ID NO: 363597 - DNA, 140 bp, Artificial Sequence; identical to SEQ ID NO: 12059
  Synthetic

SEQ ID NO: 363598 - DNA, 140 bp, Artificial Sequence; identical to SEQ ID NO: 12060
  Synthetic

SEQ ID NO: 363599 - DNA, 140 bp, Artificial Sequence
  Synthetic
atacgccatgctgggtctccgcgagtacaatcacgtcactgacgcatagccaattcgacctaagcgttgatggcgagatactgcccgtcccgtcagacctggatgctgacgccccagccccgtacttgggagtcggccat

SEQ ID NO: 363600 - DNA, 140 bp, Artificial Sequence
  Synthetic
atggccgactcccaagtacggggctggggcgtcagcatccaggtctgacgggacgggcagtatctcgccatcaacgcttaggtcgaattggctatgcgtcagtgacgtgattgtactcgcggagacccagcatggcgtat

SEQ ID NO: 363601 - DNA, 140 bp, Artificial Sequence
  Synthetic
aggccctggctgctgatatgatacccggcgcctgtgtactcgcctccgatcaacgtccgattgtccaaccccgagtccgcagtggcagcatgtaatgagttcttagctagaaactacccagaccttttgggacagcggtg

SEQ ID NO: 363602 - DNA, 140 bp, Artificial Sequence
  Synthetic
caccgctgtcccaaaaggtctgggtagtttctagctaagaactcattacatgctgccactgcggactcggggttggacaatcggacgttgatcggaggcgagtacacaggcgccgggtatcatatcagcagccagggcct

SEQ ID NO: 363603 - DNA, 140 bp, Artificial Sequence
  Synthetic
atacgccatgctgggtctcctagaaccagcactagacgacggggcgacacacacgctgccatccacaaccggaaaccttgcggccgtgtctgactgggtaatgagcaccgtacctgtcgccgtacttgggagtcggccat

SEQ ID NO: 363604 - DNA, 140 bp, Artificial Sequence
  Synthetic
atggccgactcccaagtacggcgacaggtacggtgctcattacccagtcagacacggccgcaaggtttccggttgtggatggcagcgtgtgtgtcgccccgtcgtctagtgctggttctaggagacccagcatggcgtat

SEQ ID NO: 363605 - DNA, 140 bp, Artificial Sequence
  Synthetic
aggccctggctgctgatatgggaaaccttgcggccgtgtctgactgggtaatgagcaccgtacctgtcgcgccgcccagaagaaggcgagggagaaacctgactgtgacatgtgacgagagaccttttgggacagcggtg

SEQ ID NO: 363606 - DNA, 140 bp, Artificial Sequence
  Synthetic
caccgctgtcccaaaaggtctctcgtcacatgtcacagtcaggtttctccctcgccttcttctgggcggcgcgacaggtacggtgctcattacccagtcagacacggccgcaaggtttcccatatcagcagccagggcct

SEQ ID NO: 363607 - DNA, 140 bp, Artificial Sequence
  Synthetic
aggccctggctgctgatatgtaacaacctatgtcactaaactaaaggggccaaaagcagcagcgttgtttgcaagaacccataatctgctgccgctgcaggatgtaccaatggataggttgaccttttgggacagcggtg

SEQ ID NO: 363608 - DNA, 140 bp, Artificial Sequence
  Synthetic
caccgctgtcccaaaaggtcaacctatccattggtacatcctgcagcggcagcagattatgggttcttgcaaacaacgctgctgcttttggcccctttagtttagtgacataggttgttacatatcagcagccagggcct

SEQ ID NO: 363609 - DNA, 140 bp, Artificial Sequence
  Synthetic
aggccctggctgctgatatgcgtgccatcacgcgttagtccaagggaatataaatcgcctcaggagaccgcacaagaagtaagttcgaccacgtcactgacgcacagccaattcgaccttgaccttttgggacagcggtg

SEQ ID NO: 363610 - DNA, 140 bp, Artificial Sequence
  Synthetic
caccgctgtcccaaaaggtcaaggtcgaattggctgtgcgtcagtgacgtggtcgaacttacttcttgtgcggtctcctgaggcgatttatattcccttggactaacgcgtgatggcacgcatatcagcagccagggcct

SEQ ID NO: 363611 - DNA, 140 bp, Artificial Sequence
  Synthetic
aggccctggctgctgatatggaatctaacaacctatgtcactaaactaaaggggccaaaagcagcagcgttgtttgcaaaaacccataatctgctgccactgcaggatgtaccaatggatgaccttttgggacagcggtg

SEQ ID NO: 363612 - DNA, 140 bp, Artificial Sequence
  Synthetic
caccgctgtcccaaaaggtcatccattggtacatcctgcagtggcagcagattatgggtttttgcaaacaacgctgctgcttttggcccctttagtttagtgacataggttgttagattccatatcagcagccagggcct

SEQ ID NO: 363613 - DNA, 140 bp, Artificial Sequence
  Synthetic
aggccctggctgctgatatgaggttcacagtagatatgaaaagggatgtgaaggtaactcctggtacaaagcatacagaggaaagacctaaggtgcaggttatacaggcggctgaaccctgaccttttgggacagcggtg

SEQ ID NO: 363614 - DNA, 140 bp, Artificial Sequence
  Synthetic
caccgctgtcccaaaaggtcagggttcagccgcctgtataacctgcaccttaggtctttcctctgtatgctttgtaccaggagttaccttcacatcccttttcatatctactgtgaacctcatatcagcagccagggcct

SEQ ID NO: 363615 - DNA, 140 bp, Artificial Sequence; identical to SEQ ID NO: 6817
  Synthetic

SEQ ID NO: 363616 - DNA, 140 bp, Artificial Sequence; identical to SEQ ID NO: 6818
  Synthetic

SEQ ID NO: 363617 - DNA, 140 bp, Artificial Sequence
  Synthetic
aggccctggctgctgatatgcgcacccatttcaccacgaccctcctgtgataggccgggaaaaattccattcccgaccgcagcacggtaaagagctaccttgcagcacgtacgtgcagaggaccttttgggacagcggtg

SEQ ID NO: 363618 - DNA, 140 bp, Artificial Sequence
  Synthetic
caccgctgtcccaaaaggtcctctgcacgtacgtgctgcaaggtagctctttaccgtgctgcggtcgggaatggaatttttcccggcctatcacaggagggtcgtggtgaaatgggtgcgcatatcagcagccagggcct

SEQ ID NO: 363619 - DNA, 140 bp, Artificial Sequence
  Synthetic
aggccctggctgctgatatgaacgccgtcctcctacccaatgtgcatacactatttgacatgtctgccgaggacttcgatgccattatagccgcacacttcaagccaggagacgctgtttgaccttttgggacagcggtg

SEQ ID NO: 363620 - DNA, 140 bp, Artificial Sequence
  Synthetic
caccgctgtcccaaaaggtcaaacagcgtctcctggcttgaagtgtgcggctataatggcatcgaagtcctcggcagacatgtcaaatagtgtatgcacattgggtaggaggacggcgttcatatcagcagccagggcct

SEQ ID NO: 363621 - DNA, 140 bp, Artificial Sequence
  Synthetic
aggccctggctgctgatatggaataaagacattgtcactaaaatcacccccgagggggccgaagagtggagtcttgccatcccagttatgtgcctgttggcaaataccacgttcccctgcgaccttttgggacagcggtg

SEQ ID NO: 363622 - DNA, 140 bp, Artificial Sequence
  Synthetic
caccgctgtcccaaaaggtcgcaggggaacgtggtatttgccaacaggcacataactgggatggcaagactccactcttcggccccctcgggggtgattttagtgacaatgtctttattccatatcagcagccagggcct

SEQ ID NO: 363623 - DNA, 140 bp, Artificial Sequence
  Synthetic
atacgccatgctgggtctccgccagacacggagacgccaacattttgcttacacacagatgtctcatgtagacagagagcagacgtcgcgatataccaagacgtctatgctgtacacgcacgtacttgggagtcggccat

SEQ ID NO: 363624 - DNA, 140 bp, Artificial Sequence
  Synthetic
atggccgactcccaagtacgtgcgtgtacagcatagacgtcttggtatatcgcgacgtctgctctctgtctacatgagacatctgtgtgtaagcaaaatgttggcgtctccgtgtctggcggagacccagcatggcgtat

SEQ ID NO: 363625 - DNA, 140 bp, Artificial Sequence
  Synthetic
atacgccatgctgggtctccagtctgctgtggcagcgtgcaatgagttcctagcaaggaactatccgacagttgcgtcgtaccaaatcaccgatgagtacgatgcatacctggacatggtcgtacttgggagtcggccat

SEQ ID NO: 363626 - DNA, 140 bp, Artificial Sequence
  Synthetic
atggccgactcccaagtacgaccatgtccaggtatgcatcgtactcatcggtgatttggtacgacgcaactgtcggatagttccttgctaggaactcattgcacgctgccacagcagactggagacccagcatggcgtat

SEQ ID NO: 363627 - DNA, 140 bp, Artificial Sequence
  Synthetic
aggccctggctgctgatatgcttcgcatgaaccatgtcacaaatataattgtgtgttcttcatttccccttccaaagtacaagatagaaggagtgcaaaaagtcaaatgctccaaggtaagaccttttgggacagcggtg

SEQ ID NO: 363628 - DNA, 140 bp, Artificial Sequence
  Synthetic
caccgctgtcccaaaaggtcttaccttggagcatttgactttttgcactccttctatcttgtactttggaaggggaaatgaagaacacacaattatatttgtgacatggttcatgcgaagcatatcagcagccagggcct

SEQ ID NO: 363629 - DNA, 140 bp, Artificial Sequence
  Synthetic
aggccctggctgctgatatgtgaaggccctgcagcgtgcgtaccccatgtttgaggtggaaccaaggcaggtcacaccgaatgaccatgccaatgctagagcattctcgcatctagctatgaccttttgggacagcggtg

SEQ ID NO: 363630 - DNA, 140 bp, Artificial Sequence
  Synthetic
caccgctgtcccaaaaggtcatagctagatgcgagaatgctctagcattggcatggtcattcggtgtgacctgccttggttccacctcaaacatggggtacgcacgctgcagggccttcacatatcagcagccagggcct

SEQ ID NO: 363631 - DNA, 140 bp, Artificial Sequence
  Synthetic
aggccctggctgctgatatgccgttagcggcaggtgacgaacaagatgaagacagaagacgggcgctggctgatgaagtaatcagatggcaacgaacagggctaatagatgagctggagagaccttttgggacagcggtg

SEQ ID NO: 363632 - DNA, 140 bp, Artificial Sequence
  Synthetic
caccgctgtcccaaaaggtctctccagctcatctattagccctgttcgttgccatctgattacttcatcagccagcgcccgtcttctgtcttcatcttgttcgtcacctgccgctaacggcatatcagcagccagggcct

SEQ ID NO: 363633 - DNA, 140 bp, Artificial Sequence
  Synthetic
aggccctggctgctgatatgatataccaagacgtctatgctgtacacgcacccacgtcgctataccaccaggcgattaaaggggtccgagtggcgtactgggttgggttcgacacaacccgaccttttgggacagcggtg

SEQ ID NO: 363634 - DNA, 140 bp, Artificial Sequence
  Synthetic
caccgctgtcccaaaaggtcgggttgtgtcgaacccaacccagtacgccactcggacccctttaatcgcctggtggtatagcgacgtgggtgcgtgtacagcatagacgtcttggtatatcatatcagcagccagggcct

SEQ ID NO: 363635 - DNA, 140 bp, Artificial Sequence; identical to SEQ ID NO: 10721
  Synthetic

SEQ ID NO: 363636 - DNA, 140 bp, Artificial Sequence; identical to SEQ ID NO: 10722
  Synthetic

SEQ ID NO: 363637 - DNA, 140 bp, Artificial Sequence; identical to SEQ ID NO: 11913
  Synthetic

SEQ ID NO: 363638 - DNA, 140 bp, Artificial Sequence; identical to SEQ ID NO: 11914
  Synthetic

SEQ ID NO: 363639 - DNA, 140 bp, Artificial Sequence
  Synthetic
aggccctggctgctgatatgcgattactggaacaatgggacacttcatcctggcccgatgtccaaaaggggaaactctgacggtgggattcactgacagtaggaagattagtcattcatggaccttttgggacagcggtg

SEQ ID NO: 363640 - DNA, 140 bp, Artificial Sequence
  Synthetic
caccgctgtcccaaaaggtccatgaatgactaatcttcctactgtcagtgaatcccaccgtcagagtttccccttttggacatcgggccaggatgaagtgtcccattgttccagtaatcgcatatcagcagccagggcct

SEQ ID NO: 363641 - DNA, 140 bp, Artificial Sequence
  Synthetic
atacgccatgctgggtctcccataattggcaaacggaagagatgtaggtacttgcataccgaactcttccacgattctccgaacccacagggacgtaggagatgttattttgtttttaatcgtacttgggagtcggccat

SEQ ID NO: 363642 - DNA, 140 bp, Artificial Sequence
  Synthetic
atggccgactcccaagtacgattaaaaacaaaataacatctcctacgtccctgtgggttcggagaatcgtggaagagttcggtatgcaagtacctacatctcttccgtttgccaattatgggagacccagcatggcgtat

SEQ ID NO: 363643 - DNA, 140 bp, Artificial Sequence
  Synthetic
aggccctggctgctgatatgcctagtggtcataaacatccacacaccttttcgcatacaccattaccaacagtgcgtcgaccacgcaatgaaactgcaaatgctcgggggtgactcattggaccttttgggacagcggtg

SEQ ID NO: 363644 - DNA, 140 bp, Artificial Sequence
  Synthetic
caccgctgtcccaaaaggtccaatgagtcacccccgagcatttgcagtttcattgcgtggtcgacgcactgttggtaatggtgtatgcgaaaaggtgtgtggatgtttatgaccactaggcatatcagcagccagggcct

SEQ ID NO: 363645 - DNA, 140 bp, Artificial Sequence
  Synthetic
aggccctggctgctgatatgccagtaatactgagatgtttttcctatttagcagttttgacaatggcagaaggaattttacaacgcatgtcatgaacaatcaactgaacgcagcctttgtgaccttttgggacagcggtg

SEQ ID NO: 363646 - DNA, 140 bp, Artificial Sequence
  Synthetic
caccgctgtcccaaaaggtcacaaaggctgcgttcagttgattgttcatgacatgcgttgtaaaattccttctgccattgtcaaaactgctaaataggaaaaacatctcagtattactggcatatcagcagccagggcct

SEQ ID NO: 363647 - DNA, 140 bp, Artificial Sequence; identical to SEQ ID NO: 5505
  Synthetic

SEQ ID NO: 363648 - DNA, 140 bp, Artificial Sequence; identical to SEQ ID NO: 5506
  Synthetic

SEQ ID NO: 363649 - DNA, 140 bp, Artificial Sequence
  Synthetic
aggccctggctgctgatatgacctggatgctgacgccccagccctagaaccggccctagacgacggggcggtacatacattaccaaccataatcggaaaccttgcggccgtgtctgactggaccttttgggacagcggtg

SEQ ID NO: 363650 - DNA, 140 bp, Artificial Sequence
  Synthetic
caccgctgtcccaaaaggtccagtcagacacggccgcaaggtttccgattatggttggtaatgtatgtaccgccccgtcgtctagggccggttctagggctggggcgtcagcatccaggtcatatcagcagccagggcct

SEQ ID NO: 363651 - DNA, 140 bp, Artificial Sequence; identical to SEQ ID NO: 5511
  Synthetic

SEQ ID NO: 363652 - DNA, 140 bp, Artificial Sequence; identical to SEQ ID NO: 5512
  Synthetic

SEQ ID NO: 363653 - DNA, 140 bp, Artificial Sequence
  Synthetic
atacgccatgctgggtctccccccgttcatgtacaatgccatggcgggtgcctacccctcatactcgacaattgggcagatgagcaggtactgaaggctaagaacataggattatgttcacgtacttgggagtcggccat

SEQ ID NO: 363654 - DNA, 140 bp, Artificial Sequence
  Synthetic
atggccgactcccaagtacgtgaacataatcctatgttcttagccttcagtacctgctcatctgcccaattgtcgagtatgaggggtaggcacccgccatggcattgtacatgaacggggggagacccagcatggcgtat

SEQ ID NO: 363655 - DNA, 140 bp, Artificial Sequence
  Synthetic
aggccctggctgctgatatgagcgtccgattctttagagcagagcagtgtccggccgtacaagaaacagcggagacgcgtgacacagctatttcccttcgggcaccgccaagtatcaccggaccttttgggacagcggtg

SEQ ID NO: 363656 - DNA, 140 bp, Artificial Sequence
  Synthetic
caccgctgtcccaaaaggtccggtgatacttggcggtgcccgaagggaaatagctgtgtcacgcgtctccgctgtttcttgtacggccggacactgctctgctctaaagaatcggacgctcatatcagcagccagggcct

SEQ ID NO: 363657 - DNA, 140 bp, Artificial Sequence
  Synthetic
atacgccatgctgggtctccaaggtaaggtaacaggttacgcgtgcctggtgggggacaaagtaatgaaaccagcacacgtaaaggggaccatcgataacgcggacctggccaaactggccgtacttgggagtcggccat

SEQ ID NO: 363658 - DNA, 140 bp, Artificial Sequence
  Synthetic
atggccgactcccaagtacggccagtttggccaggtccgcgttatcgatggtcccctttacgtgtgctggtttcattactttgtcccccaccaggcacgcgtaacctgttaccttaccttggagacccagcatggcgtat

SEQ ID NO: 363659 - DNA, 140 bp, Artificial Sequence
  Synthetic
aggccctggctgctgatatgcgcacccatttcaccacgaccctcctgtgataggccgggaaaaattccattcccgaccgcagcacggtagagaactaccttgcagcacgtacgcgcagaggaccttttgggacagcggtg

SEQ ID NO: 363660 - DNA, 140 bp, Artificial Sequence
  Synthetic
caccgctgtcccaaaaggtcctctgcgcgtacgtgctgcaaggtagttctctaccgtgctgcggtcgggaatggaatttttcccggcctatcacaggagggtcgtggtgaaatgggtgcgcatatcagcagccagggcct

SEQ ID NO: 363661 - DNA, 140 bp, Artificial Sequence; identical to SEQ ID NO: 7159
  Synthetic

SEQ ID NO: 363662 - DNA, 140 bp, Artificial Sequence; identical to SEQ ID NO: 7160
  Synthetic

SEQ ID NO: 363663 - DNA, 140 bp, Artificial Sequence; identical to SEQ ID NO: 8179
  Synthetic

SEQ ID NO: 363664 - DNA, 140 bp, Artificial Sequence; identical to SEQ ID NO: 8180
  Synthetic

SEQ ID NO: 363665 - DNA, 140 bp, Artificial Sequence
  Synthetic
atacgccatgctgggtctcctttacaaaaggaaagtggaacatcaacaagcagatctgcgtgactaccaggaggatagaagacttcaaccctaccaccaacattataccggtcaacaggacgtacttgggagtcggccat

SEQ ID NO: 363666 - DNA, 140 bp, Artificial Sequence
  Synthetic
atggccgactcccaagtacgtcctgttgaccggtataatgttggtggtagggttgaagtcttctatcctcctggtagtcacgcagatctgcttgttgatgttccactttccttttgtaaaggagacccagcatggcgtat

SEQ ID NO: 363667 - DNA, 140 bp, Artificial Sequence
  Synthetic
atacgccatgctgggtctccacgctcctgtcctaccggaatatgggagaagaaccaaactatcaagaagagtgggtgacgcataagaaggagatcaggttaaccgtgccgactgaagggccgtacttgggagtcggccat

SEQ ID NO: 363668 - DNA, 140 bp, Artificial Sequence
  Synthetic
atggccgactcccaagtacggcccttcagtcggcacggttaacctgatctccttcttatgcgtcacccactcttcttgatagtttggttcttctcccatattccggtaggacaggagcgtggagacccagcatggcgtat

SEQ ID NO: 363669 - DNA, 140 bp, Artificial Sequence
  Synthetic
atacgccatgctgggtctcctcgaggtcacgtggggcaacaatgagccgtacaagtattggccgcagttatccacaaacggtacagcccacggccacccgcatgagataattttgtattacgtacttgggagtcggccat

SEQ ID NO: 363670 - DNA, 140 bp, Artificial Sequence
  Synthetic
atggccgactcccaagtacgtaatacaaaattatctcatgcgggtggccgtgggctgtaccgtttgtggataactgcggccaatacttgtacggctcattgttgccccacgtgacctcgaggagacccagcatggcgtat

SEQ ID NO: 363671 - DNA, 140 bp, Artificial Sequence; identical to SEQ ID NO: 6629
  Synthetic

SEQ ID NO: 363672 - DNA, 140 bp, Artificial Sequence; identical to SEQ ID NO: 6630
  Synthetic

SEQ ID NO: 363673 - DNA, 140 bp, Artificial Sequence
  Synthetic
aggccctggctgctgatatgcagggaggtatgcggtcgaagcgtacgacggccgagtcctagtgccctcaggctatgcaatttcgcctgaagacttccagagtctaagcgaaagcgcaacgaccttttgggacagcggtg

SEQ ID NO: 363674 - DNA, 140 bp, Artificial Sequence
  Synthetic
caccgctgtcccaaaaggtcgttgcgctttcgcttagactctggaagtcttcaggcgaaattgcatagcctgagggcactaggactcggccgtcgtacgcttcgaccgcatacctccctgcatatcagcagccagggcct

SEQ ID NO: 363675 - DNA, 140 bp, Artificial Sequence
  Synthetic
aggccctggctgctgatatggagggaattacccactttggactcagcagtattcaacgtggagtgttttaaaaaattcgcatgcaaccgagaatactgggaagaatttgctgccagccctgaccttttgggacagcggtg

SEQ ID NO: 363676 - DNA, 140 bp, Artificial Sequence
  Synthetic
caccgctgtcccaaaaggtcagggctggcagcaaattcttcccagtattctcggttgcatgcgaattttttaaaacactccacgttgaatactgctgagtccaaagtgggtaattccctccatatcagcagccagggcct

SEQ ID NO: 363677 - DNA, 140 bp, Artificial Sequence
  Synthetic
atacgccatgctgggtctccaaaaattcgcatgcaaccgagaatactgggaagaatttgctgccagccctatcaggataacaactgagaatctaacaacctatgtcactaaactaaagggcgtacttgggagtcggccat

SEQ ID NO: 363678 - DNA, 140 bp, Artificial Sequence
  Synthetic
atggccgactcccaagtacgccctttagtttagtgacataggttgttagattctcagttgttatcctgatagggctggcagcaaattcttcccagtattctcggttgcatgcgaatttttggagacccagcatggcgtat

SEQ ID NO: 363679 - DNA, 140 bp, Artificial Sequence; identical to SEQ ID NO: 6807
  Synthetic

SEQ ID NO: 363680 - DNA, 140 bp, Artificial Sequence; identical to SEQ ID NO: 6808
  Synthetic

SEQ ID NO: 363681 - DNA, 140 bp, Artificial Sequence
  Synthetic
aggccctggctgctgatatggcaaacggaagagatgtaggtacttaagcttcctaaaagcagccgaactcactttgagaagtaggcatagcataccgaactcttccacgattctccgaacgaccttttgggacagcggtg

SEQ ID NO: 363682 - DNA, 140 bp, Artificial Sequence
  Synthetic
caccgctgtcccaaaaggtcgttcggagaatcgtggaagagttcggtatgctatgcctacttctcaaagtgagttcggctgcttttaggaagcttaagtacctacatctcttccgtttgccatatcagcagccagggcct

SEQ ID NO: 363683 - DNA, 140 bp, Artificial Sequence; identical to SEQ ID NO: 7309
  Synthetic

SEQ ID NO: 363684 - DNA, 140 bp, Artificial Sequence; identical to SEQ ID NO: 7310
  Synthetic

SEQ ID NO: 363685 - DNA, 140 bp, Artificial Sequence
  Synthetic
atacgccatgctgggtctcctttgacatgtctgccgaggacttcgatgccattatagccgcacactttaagccaggagacgccgttttagaaacggacatagcctcctttgataagagcccgtacttgggagtcggccat

SEQ ID NO: 363686 - DNA, 140 bp, Artificial Sequence
  Synthetic
atggccgactcccaagtacgggctcttatcaaaggaggctatgtccgtttctaaaacggcgtctcctggcttaaagtgtgcggctataatggcatcgaagtcctcggcagacatgtcaaaggagacccagcatggcgtat

SEQ ID NO: 363687 - DNA, 140 bp, Artificial Sequence
  Synthetic
aggccctggctgctgatatgttcacagtagatatgaaaagggacgtaaaggtgactcctggtacaaagcatacagaggaaagacctaaggtgcaggttatacaggcggctgaacccttgggaccttttgggacagcggtg

SEQ ID NO: 363688 - DNA, 140 bp, Artificial Sequence
  Synthetic
caccgctgtcccaaaaggtcccaagggttcagccgcctgtataacctgcaccttaggtctttcctctgtatgctttgtaccaggagtcacctttacgtcccttttcatatctactgtgaacatatcagcagccagggcct

SEQ ID NO: 363689 - DNA, 140 bp, Artificial Sequence
  Synthetic
aggccctggctgctgatatgttacagctgtaaggtcttcaccggcgtctacccattcatgtggggcggcgcctactgcttctgcgacactgaaaatacgcaattgagcgaagcacatgtggaccttttgggacagcggtg

SEQ ID NO: 363690 - DNA, 140 bp, Artificial Sequence
  Synthetic
caccgctgtcccaaaaggtccacatgtgcttcgctcaattgcgtattttcagtgtcgcagaagcagtaggcgccgccccacatgaatgggtagacgccggtgaagaccttacagctgtaacatatcagcagccagggcct

SEQ ID NO: 363691 - DNA, 140 bp, Artificial Sequence
  Synthetic
aggccctggctgctgatatggccaatgagcaagtctgcctatatgccctgggggaaagtattgaatcaatcaggcagaaatgcccggtggatgatgcagacgcatcatctcccccgaaaagaccttttgggacagcggtg

SEQ ID NO: 363692 - DNA, 140 bp, Artificial Sequence
  Synthetic
caccgctgtcccaaaaggtcttttcgggggagatgatgcgtctgcatcatccaccgggcatttctgcctgattgattcaatactttcccccagggcatataggcagacttgctcattggccatatcagcagccagggcct

SEQ ID NO: 363693 - DNA, 140 bp, Artificial Sequence
  Synthetic
aggccctggctgctgatatgtggcagccagatgcgctacttggatgaacatggaagtgaagatcatagatgcagttgtatcccagaaagctccttacttttgtggagggtttatactgcagaccttttgggacagcggtg

SEQ ID NO: 363694 - DNA, 140 bp, Artificial Sequence
  Synthetic
caccgctgtcccaaaaggtctgcagtataaaccctccacaaaagtaaggagctttctgggatacaactgcatctatgatcttcacttccatgttcatccaagtagcgcatctggctgccacatatcagcagccagggcct

SEQ ID NO: 363695 - DNA, 140 bp, Artificial Sequence
  Synthetic
aggccctggctgctgatatgctatctccatcgacataccggacgcggcctttaccagggtcgtcgacgcgccatctttaacggacatgtcgtgtgaggtatcagcctgcacccattcctcgaccttttgggacagcggtg

SEQ ID NO: 363696 - DNA, 140 bp, Artificial Sequence
  Synthetic
caccgctgtcccaaaaggtcgaggaatgggtgcaggctgatacctcacacgacatgtccgttaaagatggcgcgtcgacgaccctggtaaaggccgcgtccggtatgtcgatggagatagcatatcagcagccagggcct

SEQ ID NO: 363697 - DNA, 140 bp, Artificial Sequence
  Synthetic
aggccctggctgctgatatgcgaactcactttgagatgtaggcatagcataccgaactcttccacaattctccgtacccatagggacgtaggagatgttattttgtttttaatatttcttgaccttttgggacagcggtg

SEQ ID NO: 363698 - DNA, 140 bp, Artificial Sequence
  Synthetic
caccgctgtcccaaaaggtcaagaaatattaaaaacaaaataacatctcctacgtccctatgggtacggagaattgtggaagagttcggtatgctatgcctacatctcaaagtgagttcgcatatcagcagccagggcct

SEQ ID NO: 363699 - DNA, 140 bp, Artificial Sequence
  Synthetic
aggccctggctgctgatatgtgtcaaatagcaacaaacccggtaagagcgatgaactgcgccgtagggaacatgcctatctccatcgacataccggacgcggccttcactagggtcgtcggaccttttgggacagcggtg

SEQ ID NO: 363700 - DNA, 140 bp, Artificial Sequence
  Synthetic
caccgctgtcccaaaaggtccgacgaccctagtgaaggccgcgtccggtatgtcgatggagataggcatgttccctacggcgcagttcatcgctcttaccgggtttgttgctatttgacacatatcagcagccagggcct

SEQ ID NO: 363701 - DNA, 140 bp, Artificial Sequence
  Synthetic
aggccctggctgctgatatgttcgagaagctcagaggacccgtcataactttgtacggcggtcctaaataggtacgcactacagctacctattttgcagaagccgacagcaggtacctaagaccttttgggacagcggtg

SEQ ID NO: 363702 - DNA, 140 bp, Artificial Sequence
  Synthetic
caccgctgtcccaaaaggtcttaggtacctgctgtcggcttctgcaaaataggtagctgtagtgcgtacctatttaggaccgccgtacaaagttatgacgggtcctctgagcttctcgaacatatcagcagccagggcct

SEQ ID NO: 363703 - DNA, 140 bp, Artificial Sequence
  Synthetic
atacgccatgctgggtctccacgcgccatctttaacggacatgtcgtgtgaggtatcagcctgcacccattcctcagactttgggggcgtagccatcattaaatatgcagccagcaagaacgtacttgggagtcggccat

SEQ ID NO: 363704 - DNA, 140 bp, Artificial Sequence
  Synthetic
atggccgactcccaagtacgttcttgctggctgcatatttaatgatggctacgcccccaaagtctgaggaatgggtgcaggctgatacctcacacgacatgtccgttaaagatggcgcgtggagacccagcatggcgtat

SEQ ID NO: 363705 - DNA, 140 bp, Artificial Sequence
  Synthetic
atacgccatgctgggtctcctggaactgagccatccaccgatctccttcggagcaccaagcgagacgttccccatcacatttggggacttcgacgaaggagaaatcgaaagcttgtcttccgtacttgggagtcggccat

SEQ ID NO: 363706 - DNA, 140 bp, Artificial Sequence
  Synthetic
atggccgactcccaagtacggaagacaagctttcgatttctccttcgtcgaagtccccaaatgtgatggggaacgtctcgcttggtgctccgaaggagatcggtggatggctcagttccaggagacccagcatggcgtat

SEQ ID NO: 363707 - DNA, 140 bp, Artificial Sequence
  Synthetic
atacgccatgctgggtctccctgcccactaagagagtcacctgggtggcgccgctgggcattcggggagctgactacacatacaacctagagttaggcctaccagcaacgctcggtagatcgtacttgggagtcggccat

SEQ ID NO: 363708 - DNA, 140 bp, Artificial Sequence
  Synthetic
atggccgactcccaagtacgatctaccgagcgttgctggtaggcctaactctaggttgtatgtgtagtcagctccccgaatgcccagcggcgccacccaggtgactctcttagtgggcagggagacccagcatggcgtat

SEQ ID NO: 363709 - DNA, 140 bp, Artificial Sequence
  Synthetic
aggccctggctgctgatatgtaacaaaatataaaaaccaataaaaatcataaaatagaaaaccataaacagaagtagttcaaagggctatgaaacccctgaatagtaacaaaatataaaagaccttttgggacagcggtg

SEQ ID NO: 363710 - DNA, 140 bp, Artificial Sequence
  Synthetic
caccgctgtcccaaaaggtcttttatattttgttactattcaggggtttcatagccctttgaactacttctgtttatggttttctattttatgatttttattggtttttatattttgttacatatcagcagccagggcct

SEQ ID NO: 363711 - DNA, 140 bp, Artificial Sequence
  Synthetic
atacgccatgctgggtctccaaaaccaataaaaatcataaaatagaaaaccataaacagaagtagttcaaagggctatgaaacccctgaatagtaacaaaatataaaactaataaaaatccgtacttgggagtcggccat

SEQ ID NO: 363712 - DNA, 140 bp, Artificial Sequence
  Synthetic
atggccgactcccaagtacggatttttattagttttatattttgttactattcaggggtttcatagccctttgaactacttctgtttatggttttctattttatgatttttattggttttggagacccagcatggcgtat

SEQ ID NO: 363713 - DNA, 140 bp, Artificial Sequence
  Synthetic
aggccctggctgctgatatgacacgtagcctaccagtttcttactgctctactctgcaaagcaagagattaataacccatcatggatcctgtgtacgtggacatagacgctgacagcgccgaccttttgggacagcggtg

SEQ ID NO: 363714 - DNA, 140 bp, Artificial Sequence
  Synthetic
caccgctgtcccaaaaggtcggcgctgtcagcgtctatgtccacgtacacaggatccatgatgggttattaatctcttgctttgcagagtagagcagtaagaaactggtaggctacgtgtcatatcagcagccagggcct

SEQ ID NO: 363715 - DNA, 140 bp, Artificial Sequence; identical to SEQ ID NO: 11987
  Synthetic

SEQ ID NO: 363716 - DNA, 140 bp, Artificial Sequence; identical to SEQ ID NO: 11988
  Synthetic

SEQ ID NO: 363717 - DNA, 140 bp, Artificial Sequence
  Synthetic
aggccctggctgctgatatgaaatataaaaatcaataaaaatcataaaatagaaaaccataaacagaagtagttcaaagggctataaaacccctgaatagtaacaaaacataaaactaatgaccttttgggacagcggtg

SEQ ID NO: 363718 - DNA, 140 bp, Artificial Sequence
  Synthetic
caccgctgtcccaaaaggtcattagttttatgttttgttactattcaggggttttatagccctttgaactacttctgtttatggttttctattttatgatttttattgatttttatatttcatatcagcagccagggcct

SEQ ID NO: 363719 - DNA, 140 bp, Artificial Sequence; identical to SEQ ID NO: 6863
  Synthetic

SEQ ID NO: 363720 - DNA, 140 bp, Artificial Sequence; identical to SEQ ID NO: 6864
  Synthetic

SEQ ID NO: 363721 - DNA, 140 bp, Artificial Sequence
  Synthetic
aggccctggctgctgatatggggagaagaaaatatctgaagccatacagatgcggacccaagtggagctgctggatgagcacatctccatagactgcgatattgttcgcgtgcaccctgagaccttttgggacagcggtg

SEQ ID NO: 363722 - DNA, 140 bp, Artificial Sequence
  Synthetic
caccgctgtcccaaaaggtctcagggtgcacgcgaacaatatcgcagtctatggagatgtgctcatccagcagctccacttgggtccgcatctgtatggcttcagatattttcttctccccatatcagcagccagggcct

SEQ ID NO: 363723 - DNA, 140 bp, Artificial Sequence; identical to SEQ ID NO: 8907
  Synthetic

SEQ ID NO: 363724 - DNA, 140 bp, Artificial Sequence; identical to SEQ ID NO: 8908
  Synthetic

SEQ ID NO: 363725 - DNA, 140 bp, Artificial Sequence; identical to SEQ ID NO: 8247
  Synthetic

SEQ ID NO: 363726 - DNA, 140 bp, Artificial Sequence; identical to SEQ ID NO: 8248
  Synthetic

SEQ ID NO: 363727 - DNA, 140 bp, Artificial Sequence; identical to SEQ ID NO: 4459
  Synthetic

SEQ ID NO: 363728 - DNA, 140 bp, Artificial Sequence; identical to SEQ ID NO: 4460
  Synthetic

SEQ ID NO: 363729 - DNA, 140 bp, Artificial Sequence; identical to SEQ ID NO: 11221
  Synthetic

SEQ ID NO: 363730 - DNA, 140 bp, Artificial Sequence; identical to SEQ ID NO: 11222
  Synthetic

SEQ ID NO: 363731 - DNA, 140 bp, Artificial Sequence; identical to SEQ ID NO: 8945
  Synthetic

SEQ ID NO: 363732 - DNA, 140 bp, Artificial Sequence; identical to SEQ ID NO: 8946
  Synthetic

SEQ ID NO: 363733 - DNA, 140 bp, Artificial Sequence; identical to SEQ ID NO: 5251
  Synthetic

SEQ ID NO: 363734 - DNA, 140 bp, Artificial Sequence; identical to SEQ ID NO: 5252
  Synthetic

SEQ ID NO: 363735 - DNA, 140 bp, Artificial Sequence
  Synthetic
aggccctggctgctgatatggaggaccagaatcaagtggttgttacgcaaggtgccgaaaaccgacctgatcccatacagcgggaatgcccaagaagcccaggatgcagaaaaagaagcagaccttttgggacagcggtg

SEQ ID NO: 363736 - DNA, 140 bp, Artificial Sequence
  Synthetic
caccgctgtcccaaaaggtctgcttctttttctgcatcctgggcttcttgggcattcccgctgtatgggatcaggtcggttttcggcaccttgcgtaacaaccacttgattctggtcctccatatcagcagccagggcct

SEQ ID NO: 363737 - DNA, 140 bp, Artificial Sequence; identical to SEQ ID NO: 5517
  Synthetic

SEQ ID NO: 363738 - DNA, 140 bp, Artificial Sequence; identical to SEQ ID NO: 5518
  Synthetic

SEQ ID NO: 363739 - DNA, 140 bp, Artificial Sequence
  Synthetic
aggccctggctgctgatatgggcagcacaggaagatgtccaggtcgaaatcgacgtggaacagcttgaggacagagctggtgcaggaataatagagactccgagaggcgctatcaaagttgaccttttgggacagcggtg

SEQ ID NO: 363740 - DNA, 140 bp, Artificial Sequence
  Synthetic
caccgctgtcccaaaaggtcaactttgatagcgcctctcggagtctctattattcctgcaccagctctgtcctcaagctgttccacgtcgatttcgacctggacatcttcctgtgctgcccatatcagcagccagggcct

SEQ ID NO: 363741 - DNA, 140 bp, Artificial Sequence; identical to SEQ ID NO: 11293
  Synthetic

SEQ ID NO: 363742 - DNA, 140 bp, Artificial Sequence; identical to SEQ ID NO: 11294
  Synthetic

SEQ ID NO: 363743 - DNA, 140 bp, Artificial Sequence
  Synthetic
atacgccatgctgggtctccccaggagctaccgtccctttcctgcttagcctaatatgctgcattagaacagctaaagcggccacataccaggaggccgcggtatacctgtggaacgagccgtacttgggagtcggccat

SEQ ID NO: 363744 - DNA, 140 bp, Artificial Sequence
  Synthetic
atggccgactcccaagtacggctcgttccacaggtataccgcggcctcctggtatgtggccgctttagctgttctaatgcagcatattaggctaagcaggaaagggacggtagctcctggggagacccagcatggcgtat

SEQ ID NO: 363745 - DNA, 140 bp, Artificial Sequence
  Synthetic
aggccctggctgctgatatgacaactaggtatgaaagtatatgtgtcccctaagagacacaccacatatagctaagaatcaatagataagtatagatcaaagggctgaacaacccctgaagaccttttgggacagcggtg

SEQ ID NO: 363746 - DNA, 140 bp, Artificial Sequence
  Synthetic
caccgctgtcccaaaaggtcttcaggggttgttcagccctttgatctatacttatctattgattcttagctatatgtggtgtgtctcttaggggacacatatactttcatacctagttgtcatatcagcagccagggcct

SEQ ID NO: 363747 - DNA, 140 bp, Artificial Sequence
  Synthetic
aggccctggctgctgatatgatctgcacgtacggttgattcgctgctcttgaatggatgcaacagaccagtcgacgtgttgtacgtagacgaggcgtttgcgtgccactctggaacgttagaccttttgggacagcggtg

SEQ ID NO: 363748 - DNA, 140 bp, Artificial Sequence
  Synthetic
caccgctgtcccaaaaggtctaacgttccagagtggcacgcaaacgcctcgtctacgtacaacacgtcgactggtctgttgcatccattcaagagcagcgaatcaaccgtacgtgcagatcatatcagcagccagggcct

SEQ ID NO: 363749 - DNA, 140 bp, Artificial Sequence
  Synthetic
atacgccatgctgggtctccgacaagagcctacctgattacagctgtaaggtcttcaccggcgtctacccattcatgtggggcggcgcctactgcttctgcgacaccgaaaatacgcaatcgtacttgggagtcggccat

SEQ ID NO: 363750 - DNA, 140 bp, Artificial Sequence
  Synthetic
atggccgactcccaagtacgattgcgtattttcggtgtcgcagaagcagtaggcgccgccccacatgaatgggtagacgccggtgaagaccttacagctgtaatcaggtaggctcttgtcggagacccagcatggcgtat

SEQ ID NO: 363751 - DNA, 140 bp, Artificial Sequence
  Synthetic
atacgccatgctgggtctcctgagcgaagcacatgtggagaagtccgaatcatgcaaaacagaatttgcatcagcatacagggctcataccgcatccgcatcagctaagctccgcgtcctcgtacttgggagtcggccat

SEQ ID NO: 363752 - DNA, 140 bp, Artificial Sequence
  Synthetic
atggccgactcccaagtacgaggacgcggagcttagctgatgcggatgcggtatgagccctgtatgctgatgcaaattctgttttgcatgattcggacttctccacatgtgcttcgctcaggagacccagcatggcgtat

SEQ ID NO: 363753 - DNA, 140 bp, Artificial Sequence
  Synthetic
aggccctggctgctgatatgacgctctacccggaaagccgcaagctacttaagagctggcacctgccatcggtgttccatttaaagggcaaactcagcttcacatgccgctgtgatacaggaccttttgggacagcggtg

SEQ ID NO: 363754 - DNA, 140 bp, Artificial Sequence
  Synthetic
caccgctgtcccaaaaggtcctgtatcacagcggcatgtgaagctgagtttgccctttaaatggaacaccgatggcaggtgccagctcttaagtagcttgcggctttccgggtagagcgtcatatcagcagccagggcct

SEQ ID NO: 363755 - DNA, 140 bp, Artificial Sequence
  Synthetic
aggccctggctgctgatatgtggtttcgtgtgagggctacgtcgttaagagaataacgatgagcccaggcctttatggaaaaaccacagggtatgcggtaacccaccacgcagacggattgaccttttgggacagcggtg

SEQ ID NO: 363756 - DNA, 140 bp, Artificial Sequence
  Synthetic
caccgctgtcccaaaaggtcaatccgtctgcgtggtgggttaccgcataccctgtggtttttccataaaggcctgggctcatcgttattctcttaacgacgtagccctcacacgaaaccacatatcagcagccagggcct

SEQ ID NO: 363757 - DNA, 140 bp, Artificial Sequence
  Synthetic
aggccctggctgctgatatgtcacccgaagtagccctgaatgaaatatgcacgcgcatgtatggggtggatctagacagcgggctattttctaaaccgttggtatctgtgtattacgcgggaccttttgggacagcggtg

SEQ ID NO: 363758 - DNA, 140 bp, Artificial Sequence
  Synthetic
caccgctgtcccaaaaggtcccgcgtaatacacagataccaacggtttagaaaatagcccgctgtctagatccaccccatacatgcgcgtgcatatttcattcagggctacttcgggtgacatatcagcagccagggcct

SEQ ID NO: 363759 - DNA, 140 bp, Artificial Sequence
  Synthetic
aggccctggctgctgatatgcgtggaacagcttgaggacagagcgggtgcaggaataatagagactccgagaggagctatcaaagttactgcccaaccaacagaccacgtcgtgggagaggaccttttgggacagcggtg

SEQ ID NO: 363760 - DNA, 140 bp, Artificial Sequence
  Synthetic
caccgctgtcccaaaaggtcctctcccacgacgtggtctgttggttgggcagtaactttgatagctcctctcggagtctctattattcctgcacccgctctgtcctcaagctgttccacgcatatcagcagccagggcct

SEQ ID NO: 363761 - DNA, 140 bp, Artificial Sequence; identical to SEQ ID NO: 8349
  Synthetic

SEQ ID NO: 363762 - DNA, 140 bp, Artificial Sequence; identical to SEQ ID NO: 8350
  Synthetic

SEQ ID NO: 363763 - DNA, 140 bp, Artificial Sequence; identical to SEQ ID NO: 5345
  Synthetic

SEQ ID NO: 363764 - DNA, 140 bp, Artificial Sequence; identical to SEQ ID NO: 5346
  Synthetic

SEQ ID NO: 363765 - DNA, 140 bp, Artificial Sequence
  Synthetic
aggccctggctgctgatatgtgtatcctgaccacccaacgctcctgtcctaccggaatatgggagaagaaccaaactatcaagaagagtgggtgacgcataagaaggagatcaggttaacgaccttttgggacagcggtg

SEQ ID NO: 363766 - DNA, 140 bp, Artificial Sequence
  Synthetic
caccgctgtcccaaaaggtcgttaacctgatctccttcttatgcgtcacccactcttcttgatagtttggttcttctcccatattccggtaggacaggagcgttgggtggtcaggatacacatatcagcagccagggcct

SEQ ID NO: 363767 - DNA, 140 bp, Artificial Sequence
  Synthetic
atacgccatgctgggtctccgatatctgcacgtacggttgactcgctgctcttgaatggatgcaacagaccagtcgacgtgttgtacgtagacgaggcgtttgcgtgccactctggaacgcgtacttgggagtcggccat

SEQ ID NO: 363768 - DNA, 140 bp, Artificial Sequence
  Synthetic
atggccgactcccaagtacgcgttccagagtggcacgcaaacgcctcgtctacgtacaacacgtcgactggtctgttgcatccattcaagagcagcgagtcaaccgtacgtgcagatatcggagacccagcatggcgtat

SEQ ID NO: 363769 - DNA, 140 bp, Artificial Sequence
  Synthetic
aggccctggctgctgatatgagtattggccgcagttatccacaaacggtacagcccacggccacccgcatgagataattttgtattattatgagctgtaccctactatgactgtggtagtgaccttttgggacagcggtg

SEQ ID NO: 363770 - DNA, 140 bp, Artificial Sequence
  Synthetic
caccgctgtcccaaaaggtcactaccacagtcatagtagggtacagctcataataatacaaaattatctcatgcgggtggccgtgggctgtaccgtttgtggataactgcggccaatactcatatcagcagccagggcct

SEQ ID NO: 363771 - DNA, 140 bp, Artificial Sequence
  Synthetic
aggccctggctgctgatatgtgtgtcagtggcctcgttcgtactcctgtcgatggtgggtgtggcagtggggatgtgcatgtgtgcacgacgcagatgcattacaccgtacgaactgacagaccttttgggacagcggtg

SEQ ID NO: 363772 - DNA, 140 bp, Artificial Sequence
  Synthetic
caccgctgtcccaaaaggtctgtcagttcgtacggtgtaatgcatctgcgtcgtgcacacatgcacatccccactgccacacccaccatcgacaggagtacgaacgaggccactgacacacatatcagcagccagggcct

SEQ ID NO: 363773 - DNA, 140 bp, Artificial Sequence
  Synthetic
aggccctggctgctgatatgccaggagctaccgtccctttcctgcttagcctaatatgctgcattagaacagctaaagcggccacataccaagaggctgcggtatacctgtggaacgagcgaccttttgggacagcggtg

SEQ ID NO: 363774 - DNA, 140 bp, Artificial Sequence
  Synthetic
caccgctgtcccaaaaggtcgctcgttccacaggtataccgcagcctcttggtatgtggccgctttagctgttctaatgcagcatattaggctaagcaggaaagggacggtagctcctggcatatcagcagccagggcct

SEQ ID NO: 363775 - DNA, 140 bp, Artificial Sequence
  Synthetic
aggccctggctgctgatatgacgtaacagtgatcccgaacacggtgggagtaccgtataagactctagtcaacagaccgggctacagccccatggtactggagatggagcttctgtcagtgaccttttgggacagcggtg

SEQ ID NO: 363776 - DNA, 140 bp, Artificial Sequence
  Synthetic
caccgctgtcccaaaaggtcactgacagaagctccatctccagtaccatggggctgtagcccggtctgttgactagagtcttatacggtactcccaccgtgttcgggatcactgttacgtcatatcagcagccagggcct

SEQ ID NO: 363777 - DNA, 140 bp, Artificial Sequence
  Synthetic
atacgccatgctgggtctccgagatatatactatgtggccaaagcaaatagaggccaatgagcaagtctgcctatatgccctgggggaaagtattgaatcaatcaggcagaaatgcccggcgtacttgggagtcggccat

SEQ ID NO: 363778 - DNA, 140 bp, Artificial Sequence
  Synthetic
atggccgactcccaagtacgccgggcatttctgcctgattgattcaatactttcccccagggcatataggcagacttgctcattggcctctatttgctttggccacatagtatatatctcggagacccagcatggcgtat

SEQ ID NO: 363779 - DNA, 140 bp, Artificial Sequence
  Synthetic
aggccctggctgctgatatgtaggacaggccacccgagcaggatgtgcaccgtcgtaccgggtaaaacgcatggacatcgcgaagaacgatgaagagtgcgtagtcaacgccgctaacccgaccttttgggacagcggtg

SEQ ID NO: 363780 - DNA, 140 bp, Artificial Sequence
  Synthetic
caccgctgtcccaaaaggtcgggttagcggcgttgactacgcactcttcatcgttcttcgcgatgtccatgcgttttacccggtacgacggtgcacatcctgctcgggtggcctgtcctacatatcagcagccagggcct

SEQ ID NO: 363781 - DNA, 140 bp, Artificial Sequence; identical to SEQ ID NO: 8537
  Synthetic

SEQ ID NO: 363782 - DNA, 140 bp, Artificial Sequence; identical to SEQ ID NO: 8538
  Synthetic

SEQ ID NO: 363783 - DNA, 140 bp, Artificial Sequence; identical to SEQ ID NO: 5033
  Synthetic

SEQ ID NO: 363784 - DNA, 140 bp, Artificial Sequence; identical to SEQ ID NO: 5034
  Synthetic

SEQ ID NO: 363785 - DNA, 140 bp, Artificial Sequence
  Synthetic
atacgccatgctgggtctccgatgagagagaagggaatataacacccatggctagcgtccgattctttagagcagagctgtgtccagccgtacaagaaacagcggagacgcgtgacacagcgtacttgggagtcggccat

SEQ ID NO: 363786 - DNA, 140 bp, Artificial Sequence
  Synthetic
atggccgactcccaagtacgctgtgtcacgcgtctccgctgtttcttgtacggctggacacagctctgctctaaagaatcggacgctagccatgggtgttatattcccttctctctcatcggagacccagcatggcgtat

SEQ ID NO: 363787 - DNA, 140 bp, Artificial Sequence; identical to SEQ ID NO: 9075
  Synthetic

SEQ ID NO: 363788 - DNA, 140 bp, Artificial Sequence; identical to SEQ ID NO: 9076
  Synthetic

SEQ ID NO: 363789 - DNA, 140 bp, Artificial Sequence
  Synthetic
aggccctggctgctgatatgtactctgcaaagcaagagattaataacccatcatggatcctgtgtacgtggacatagacgctgacagcgcctttttgaaggccctgcaacgtgcgtacccgaccttttgggacagcggtg

SEQ ID NO: 363790 - DNA, 140 bp, Artificial Sequence
  Synthetic
caccgctgtcccaaaaggtcgggtacgcacgttgcagggccttcaaaaaggcgctgtcagcgtctatgtccacgtacacaggatccatgatgggttattaatctcttgctttgcagagtacatatcagcagccagggcct

SEQ ID NO: 363791 - DNA, 140 bp, Artificial Sequence
  Synthetic
atacgccatgctgggtctccatgccgcggtcaccaatcacaaaaagtggcagtataactcccctctggtcccgcgtaatgctgaactcggggaccgaaaaggaaaaattcacatcccgttcgtacttgggagtcggccat

SEQ ID NO: 363792 - DNA, 140 bp, Artificial Sequence
  Synthetic
atggccgactcccaagtacgaacgggatgtgaatttttccttttcggtccccgagttcagcattacgcgggaccagaggggagttatactgccactttttgtgattggtgaccgcggcatggagacccagcatggcgtat

SEQ ID NO: 363793 - DNA, 140 bp, Artificial Sequence
  Synthetic
aggccctggctgctgatatggctaagaatcaatagataagtatagatcaaagggctgaacaacccctgaatagtaacaaaatataaaaatcaacaaaaatcataaaatagaaaactagaagaccttttgggacagcggtg

SEQ ID NO: 363794 - DNA, 140 bp, Artificial Sequence
  Synthetic
caccgctgtcccaaaaggtcttctagttttctattttatgatttttgttgatttttatattttgttactattcaggggttgttcagccctttgatctatacttatctattgattcttagccatatcagcagccagggcct

SEQ ID NO: 363795 - DNA, 140 bp, Artificial Sequence
  Synthetic
aggccctggctgctgatatgtagtaacaaaatataaaaatcaacaaaaatcataaaatagaaaactagaaatagaagtaggtaagaaggtatatgtgtcccctaagagacacaccatatagaccttttgggacagcggtg

SEQ ID NO: 363796 - DNA, 140 bp, Artificial Sequence
  Synthetic
caccgctgtcccaaaaggtctatatggtgtgtctcttaggggacacatataccttcttacctacttctatttctagttttctattttatgatttttgttgatttttatattttgttactacatatcagcagccagggcct

SEQ ID NO: 363797 - DNA, 140 bp, Artificial Sequence
  Synthetic
aggccctggctgctgatatgaataataacaaaatataaaatcaataaaaatcataaaatagaaaaccataaacagaagtagttcaaagggctataaaacccctgaatagtaacaaaacatgaccttttgggacagcggtg

SEQ ID NO: 363798 - DNA, 140 bp, Artificial Sequence
  Synthetic
caccgctgtcccaaaaggtcatgttttgttactattcaggggttttatagccctttgaactacttctgtttatggttttctattttatgatttttattgattttatattttgttattattcatatcagcagccagggcct

SEQ ID NO: 363799 - DNA, 140 bp, Artificial Sequence
  Synthetic
aggccctggctgctgatatgtaggtacttaagcttcctaaaagcagccgaactcgctttgagatgtaggcgtagcacaccgaactcttccataattctccgaacccacagggacgtaggagaccttttgggacagcggtg

SEQ ID NO: 363800 - DNA, 140 bp, Artificial Sequence
  Synthetic
caccgctgtcccaaaaggtctcctacgtccctgtgggttcggagaattatggaagagttcggtgtgctacgcctacatctcaaagcgagttcggctgcttttaggaagcttaagtacctacatatcagcagccagggcct

SEQ ID NO: 363801 - DNA, 140 bp, Artificial Sequence
  Synthetic
atacgccatgctgggtctccgtagcacaccgaactcttccataattctccgaacccacagggacgtaggagatgttcaaagtgactataaaaaaccctgaacagtaataaaacataaaatcgtacttgggagtcggccat

SEQ ID NO: 363802 - DNA, 140 bp, Artificial Sequence
  Synthetic
atggccgactcccaagtacgattttatgttttattactgttcagggttttttatagtcactttgaacatctcctacgtccctgtgggttcggagaattatggaagagttcggtgtgctacggagacccagcatggcgtat

SEQ ID NO: 363803 - DNA, 140 bp, Artificial Sequence
  Synthetic
aggccctggctgctgatatgtgagcccaggcctttacggaaaaaccacagggtatgcggtaacccaccacgcagacggattcctgatgtgcaagaccaccgacacggttgacggcgaaaggaccttttgggacagcggtg

SEQ ID NO: 363804 - DNA, 140 bp, Artificial Sequence
  Synthetic
caccgctgtcccaaaaggtcctttcgccgtcaaccgtgtcggtggtcttgcacatcaggaatccgtctgcgtggtgggttaccgcataccctgtggtttttccgtaaaggcctgggctcacatatcagcagccagggcct

SEQ ID NO: 363805 - DNA, 140 bp, Artificial Sequence
  Synthetic
aggccctggctgctgatatgtacgaacaccatgaaaaactatatgattcccgtggtcgcccaagccttcagtaagtgggcaaaggagtgccggaaagacatggaagatgaaaaactcctggaccttttgggacagcggtg

SEQ ID NO: 363806 - DNA, 140 bp, Artificial Sequence
  Synthetic
caccgctgtcccaaaaggtccaggagtttttcatcttccatgtctttccggcactcctttgcccacttactgaaggcttgggcgaccacgggaatcatatagtttttcatggtgttcgtacatatcagcagccagggcct

SEQ ID NO: 363807 - DNA, 140 bp, Artificial Sequence
  Synthetic
atacgccatgctgggtctccggggtcagagaaagaacactgacctgctgctgtctatgggcatttaagaagcagaaaacacacacggtctacaagaggcctgatacccagtcaattcagacgtacttgggagtcggccat

SEQ ID NO: 363808 - DNA, 140 bp, Artificial Sequence
  Synthetic
atggccgactcccaagtacgtctgaattgactgggtatcaggcctcttgtagaccgtgtgtgttttctgcttcttaaatgcccatagacagcagcaggtcagtgttctttctctgaccccggagacccagcatggcgtat

SEQ ID NO: 363809 - DNA, 140 bp, Artificial Sequence
  Synthetic
atacgccatgctgggtctccaaaatatgaaagcaacaatcatccagagactaaagagaggctgtaaactgtatttaatggcagagaccccgaaagtcccgacttatcggaccgtataccccgtacttgggagtcggccat

SEQ ID NO: 363810 - DNA, 140 bp, Artificial Sequence
  Synthetic
atggccgactcccaagtacggggtatacggtccgataagtcgggactttcggggtctctgccattaaatacagtttacagcctctctttagtctctggatgattgttgctttcatattttggagacccagcatggcgtat

SEQ ID NO: 363811 - DNA, 140 bp, Artificial Sequence
  Synthetic
atacgccatgctgggtctccaggttcaggccgagtttgacagctttgtggtaccgagcctgtggtcgtccgggttgtcaatcccgttgaggactagaatcaaatggttgttaagcaaggtcgtacttgggagtcggccat

SEQ ID NO: 363812 - DNA, 140 bp, Artificial Sequence
  Synthetic
atggccgactcccaagtacgaccttgcttaacaaccatttgattctagtcctcaacgggattgacaacccggacgaccacaggctcggtaccacaaagctgtcaaactcggcctgaacctggagacccagcatggcgtat

SEQ ID NO: 363813 - DNA, 140 bp, Artificial Sequence
  Synthetic
atacgccatgctgggtctccgccaaaaaccgacctgaccccatacagcggggacgcccaagaagcccgggacgcagaaaaagaagcagaggaagaacgagaagcagaactgactcttgaacgtacttgggagtcggccat

SEQ ID NO: 363814 - DNA, 140 bp, Artificial Sequence
  Synthetic
atggccgactcccaagtacgttcaagagtcagttctgcttctcgttcttcctctgcttctttttctgcgtcccgggcttcttgggcgtccccgctgtatggggtcaggtcggtttttggcggagacccagcatggcgtat

SEQ ID NO: 363815 - DNA, 140 bp, Artificial Sequence; identical to SEQ ID NO: 11103
  Synthetic

SEQ ID NO: 363816 - DNA, 140 bp, Artificial Sequence; identical to SEQ ID NO: 11104
  Synthetic

SEQ ID NO: 363817 - DNA, 140 bp, Artificial Sequence
  Synthetic
aggccctggctgctgatatgaggtggaaaatatgaaagcaacaatcatccaaggacttgatagaggctgcaaactgtatttaatggcagagaccccgaaagtcccgacttatcggaccgtgaccttttgggacagcggtg

SEQ ID NO: 363818 - DNA, 140 bp, Artificial Sequence
  Synthetic
caccgctgtcccaaaaggtcacggtccgataagtcgggactttcggggtctctgccattaaatacagtttgcagcctctatcaagtccttggatgattgttgctttcatattttccacctcatatcagcagccagggcct

SEQ ID NO: 363819 - DNA, 140 bp, Artificial Sequence
  Synthetic
aggccctggctgctgatatgagggcagagaggacagaacacgagtacgtctacgacgtggaccagagaagatgctgtaagaaggaagaagctgcaggactggtactggtgggcgacttgagaccttttgggacagcggtg

SEQ ID NO: 363820 - DNA, 140 bp, Artificial Sequence
  Synthetic
caccgctgtcccaaaaggtctcaagtcgcccaccagtaccagtcctgcagcttcttccttcttacagcatcttctctggtccacgtcgtagacgtactcgtgttctgtcctctctgccctcatatcagcagccagggcct

SEQ ID NO: 363821 - DNA, 140 bp, Artificial Sequence
  Synthetic
aggccctggctgctgatatgccttggactccgcgccctactatccaagttatcagacccagaccgcgtccgcaaaggaaagccgggcaacttgcccagctgatctcagcagttaataaacgaccttttgggacagcggtg

SEQ ID NO: 363822 - DNA, 140 bp, Artificial Sequence
  Synthetic
caccgctgtcccaaaaggtcgtttattaactgctgagatcagctgggcaagttgcccggctttcctttgcggacgcggtctgggtctgataacttggatagtagggcgcggagtccaaggcatatcagcagccagggcct

SEQ ID NO: 363823 - DNA, 140 bp, Artificial Sequence
  Synthetic
aggccctggctgctgatatgcagagaggtctagagatatctgcacgtacggttgactcgctgctcttgaatggatgtaacagaccagtcgacgtgttgtacgtagacgaggcgtttgcgtgaccttttgggacagcggtg

SEQ ID NO: 363824 - DNA, 140 bp, Artificial Sequence
  Synthetic
caccgctgtcccaaaaggtcacgcaaacgcctcgtctacgtacaacacgtcgactggtctgttacatccattcaagagcagcgagtcaaccgtacgtgcagatatctctagacctctctgcatatcagcagccagggcct

SEQ ID NO: 363825 - DNA, 140 bp, Artificial Sequence
  Synthetic
atacgccatgctgggtctccgagctgctggatgagcacatctccatagactgcgatattgttcgcgtgcaccctgacagcagcttggcaggcagaaaaggatacagcaccacggaaggcgcgtacttgggagtcggccat

SEQ ID NO: 363826 - DNA, 140 bp, Artificial Sequence
  Synthetic
atggccgactcccaagtacgcgccttccgtggtgctgtatccttttctgcctgccaagctgctgtcagggtgcacgcgaacaatatcgcagtctatggagatgtgctcatccagcagctcggagacccagcatggcgtat

SEQ ID NO: 363827 - DNA, 140 bp, Artificial Sequence
  Synthetic
aggccctggctgctgatatgggacaatcacatgccagcagacgcagagagggccgggctatttgtaagaacgtcagcaccgtgcacgattactggaacaatgggacacttcatcctggccgaccttttgggacagcggtg

SEQ ID NO: 363828 - DNA, 140 bp, Artificial Sequence
  Synthetic
caccgctgtcccaaaaggtcggccaggatgaagtgtcccattgttccagtaatcgtgcacggtgctgacgttcttacaaatagcccggccctctctgcgtctgctggcatgtgattgtcccatatcagcagccagggcct

SEQ ID NO: 363829 - DNA, 140 bp, Artificial Sequence
  Synthetic
aggccctggctgctgatatgaaaaattatctgcttcccgtggtcgcccaagccttcagtaagtgggcaaaggagtgccggaaagacatggaagatgaaaaactcctgggggtcagagaaagaccttttgggacagcggtg

SEQ ID NO: 363830 - DNA, 140 bp, Artificial Sequence
  Synthetic
caccgctgtcccaaaaggtctttctctgacccccaggagtttttcatcttccatgtctttccggcactcctttgcccacttactgaaggcttgggcgaccacgggaagcagataatttttcatatcagcagccagggcct

SEQ ID NO: 363831 - DNA, 140 bp, Artificial Sequence
  Synthetic
atacgccatgctgggtctccgacgggacgctgaaaatccaggtttccttgcaaatcggaataaagacggatgatagccatgattggaccaagctgcgttacatggacaatcacatgccagcgtacttgggagtcggccat

SEQ ID NO: 363832 - DNA, 140 bp, Artificial Sequence
  Synthetic
atggccgactcccaagtacgctggcatgtgattgtccatgtaacgcagcttggtccaatcatggctatcatccgtctttattccgatttgcaaggaaacctggattttcagcgtcccgtcggagacccagcatggcgtat

SEQ ID NO: 363833 - DNA, 140 bp, Artificial Sequence
  Synthetic
aggccctggctgctgatatgtgatagccatgattggaccaagctgcgttacatggacaatcacatgccagcagacgcagagagggctgggctacttgtaagaacgtcagcaccgtgcacggaccttttgggacagcggtg

SEQ ID NO: 363834 - DNA, 140 bp, Artificial Sequence
  Synthetic
caccgctgtcccaaaaggtccgtgcacggtgctgacgttcttacaagtagcccagccctctctgcgtctgctggcatgtgattgtccatgtaacgcagcttggtccaatcatggctatcacatatcagcagccagggcct

SEQ ID NO: 363835 - DNA, 140 bp, Artificial Sequence
  Synthetic
atacgccatgctgggtctccttaccaaggaaataatgttactgtatctgcttatgcaaacggcgaccatgccgtcacagttaaggacgctaaattcattgtggggccaatgtcttcagcccgtacttgggagtcggccat

SEQ ID NO: 363836 - DNA, 140 bp, Artificial Sequence
  Synthetic
atggccgactcccaagtacgggctgaagacattggccccacaatgaatttagcgtccttaactgtgacggcatggtcgccgtttgcataagcagatacagtaacattatttccttggtaaggagacccagcatggcgtat

SEQ ID NO: 363837 - DNA, 140 bp, Artificial Sequence; identical to SEQ ID NO: 9091
  Synthetic

SEQ ID NO: 363838 - DNA, 140 bp, Artificial Sequence; identical to SEQ ID NO: 9092
  Synthetic

SEQ ID NO: 363839 - DNA, 140 bp, Artificial Sequence
  Synthetic
aggccctggctgctgatatggtgggtgacgcataagaaggaggtcaggttaaccgtgccgactgaggggctcgaggtcacgtggggcaacaacgagccgtacaagtattggccgcagttagaccttttgggacagcggtg

SEQ ID NO: 363840 - DNA, 140 bp, Artificial Sequence
  Synthetic
caccgctgtcccaaaaggtctaactgcggccaatacttgtacggctcgttgttgccccacgtgacctcgagcccctcagtcggcacggttaacctgacctccttcttatgcgtcacccaccatatcagcagccagggcct

SEQ ID NO: 363841 - DNA, 140 bp, Artificial Sequence; identical to SEQ ID NO: 10729
  Synthetic

SEQ ID NO: 363842 - DNA, 140 bp, Artificial Sequence; identical to SEQ ID NO: 10730
  Synthetic

SEQ ID NO: 363843 - DNA, 140 bp, Artificial Sequence
  Synthetic
aggccctggctgctgatatgtggggacttcaacgaaggagaaatcgaaagcttgtcttctgagctactaactttcggagacttcttaccaggagaagtggatgacttgacagacagcgacgaccttttgggacagcggtg

SEQ ID NO: 363844 - DNA, 140 bp, Artificial Sequence
  Synthetic
caccgctgtcccaaaaggtcgtcgctgtctgtcaagtcatccacttctcctggtaagaagtctccgaaagttagtagctcagaagacaagctttcgatttctccttcgttgaagtccccacatatcagcagccagggcct

SEQ ID NO: 363845 - DNA, 140 bp, Artificial Sequence; identical to SEQ ID NO: 9313
  Synthetic

SEQ ID NO: 363846 - DNA, 140 bp, Artificial Sequence; identical to SEQ ID NO: 9314
  Synthetic

SEQ ID NO: 363847 - DNA, 140 bp, Artificial Sequence
  Synthetic
atacgccatgctgggtctcctggtccacgtgctcagacacggacgacgagttatgactagacagggcaggtgggtatatattctcgtcggacaccggtccaggtcatttacaacagaagtcgtacttgggagtcggccat

SEQ ID NO: 363848 - DNA, 140 bp, Artificial Sequence
  Synthetic
atggccgactcccaagtacgacttctgttgtaaatgacctggaccggtgtccgacgagaatatatacccacctgccctgtctagtcataactcgtcgtccgtgtctgagcacgtggaccaggagacccagcatggcgtat

SEQ ID NO: 363849 - DNA, 140 bp, Artificial Sequence
  Synthetic
aggccctggctgctgatatgaccaagaggccgcggtatacctgtggaacgagcagcagcctttgttttggctgcaagcccttattccgctggcagccctgattgtcctatgcaactgtctgaccttttgggacagcggtg

SEQ ID NO: 363850 - DNA, 140 bp, Artificial Sequence
  Synthetic
caccgctgtcccaaaaggtcagacagttgcataggacaatcagggctgccagcggaataagggcttgcagccaaaacaaaggctgctgctcgttccacaggtataccgcggcctcttggtcatatcagcagccagggcct

SEQ ID NO: 363851 - DNA, 140 bp, Artificial Sequence
  Synthetic
aggccctggctgctgatatggccaaaaaccgacctgatcccatacagcggagacgcccaagaagcccgggacgcagaaaaagaagcagaggaagaacgagaagcagaactgactcgcgaagaccttttgggacagcggtg

SEQ ID NO: 363852 - DNA, 140 bp, Artificial Sequence
  Synthetic
caccgctgtcccaaaaggtcttcgcgagtcagttctgcttctcgttcttcctctgcttctttttctgcgtcccgggcttcttgggcgtctccgctgtatgggatcaggtcggtttttggccatatcagcagccagggcct

SEQ ID NO: 363853 - DNA, 140 bp, Artificial Sequence; identical to SEQ ID NO: 5895
  Synthetic

SEQ ID NO: 363854 - DNA, 140 bp, Artificial Sequence; identical to SEQ ID NO: 5896
  Synthetic

SEQ ID NO: 363855 - DNA, 140 bp, Artificial Sequence
  Synthetic
atacgccatgctgggtctccgccctaccacctctacaggcagcacaggaagatgttcaggtcgaaatcgacgtggaacagcttgaggacagagcgggtgcaggaataatagagactccgacgtacttgggagtcggccat

SEQ ID NO: 363856 - DNA, 140 bp, Artificial Sequence
  Synthetic
atggccgactcccaagtacgtcggagtctctattattcctgcacccgctctgtcctcaagctgttccacgtcgatttcgacctgaacatcttcctgtgctgcctgtagaggtggtagggcggagacccagcatggcgtat

SEQ ID NO: 363857 - DNA, 140 bp, Artificial Sequence
  Synthetic
aggccctggctgctgatatgagcctaccagtttcttactgctctactctgcaaagcaagagattaataacccatcatggatcctgtgtacgtggacatagacgctgacagcgcctttttggaccttttgggacagcggtg

SEQ ID NO: 363858 - DNA, 140 bp, Artificial Sequence
  Synthetic
caccgctgtcccaaaaggtccaaaaaggcgctgtcagcgtctatgtccacgtacacaggatccatgatgggttattaatctcttgctttgcagagtagagcagtaagaaactggtaggctcatatcagcagccagggcct

SEQ ID NO: 363859 - DNA, 140 bp, Artificial Sequence
  Synthetic
atacgccatgctgggtctccaggcaagtgtgcggtgcattcgatgactaacgccgtcactattcgggaagctgaaatagaagtagaagggaactctcagttgcaaatctctttttcgacgcgtacttgggagtcggccat

SEQ ID NO: 363860 - DNA, 140 bp, Artificial Sequence
  Synthetic
atggccgactcccaagtacgcgtcgaaaaagagatttgcaactgagagttcccttctacttctatttcagcttcccgaatagtgacggcgttagtcatcgaatgcaccgcacacttgcctggagacccagcatggcgtat

SEQ ID NO: 363861 - DNA, 140 bp, Artificial Sequence
  Synthetic
aggccctggctgctgatatgtattcggagtctgaaggggaccgagaattggcggctgcctatcgagaagtcgcaaaggaggtaactagactgggagtaaatagtgtagctatacctctccgaccttttgggacagcggtg

SEQ ID NO: 363862 - DNA, 140 bp, Artificial Sequence
  Synthetic
caccgctgtcccaaaaggtcggagaggtatagctacactatttactcccagtctagttacctcctttgcgacttctcgataggcagccgccaattctcggtccccttcagactccgaatacatatcagcagccagggcct

SEQ ID NO: 363863 - DNA, 140 bp, Artificial Sequence
  Synthetic
atacgccatgctgggtctccaagacactctctggtgacccgtggataaagacgctgcagaacccaccgaaaggaaacttcaaggcaactattaaggagtgggaggtggagcacgcatcgacgtacttgggagtcggccat

SEQ ID NO: 363864 - DNA, 140 bp, Artificial Sequence
  Synthetic
atggccgactcccaagtacgtcgatgcgtgctccacctcccactccttaatagttgccttgaagtttcctttcggtgggttctgcagcgtctttatccacgggtcaccagagagtgtcttggagacccagcatggcgtat

SEQ ID NO: 363865 - DNA, 140 bp, Artificial Sequence
  Synthetic
atacgccatgctgggtctccatggataggttcacagtagatatgaaaagggacgtgaaggtgactcctggtacaaagcatacagaggaaagacctaaggtgcaggttatacaggcggctgcgtacttgggagtcggccat

SEQ ID NO: 363866 - DNA, 140 bp, Artificial Sequence
  Synthetic
atggccgactcccaagtacgcagccgcctgtataacctgcaccttaggtctttcctctgtatgctttgtaccaggagtcaccttcacgtcccttttcatatctactgtgaacctatccatggagacccagcatggcgtat

SEQ ID NO: 363867 - DNA, 140 bp, Artificial Sequence; identical to SEQ ID NO: 11743
  Synthetic

SEQ ID NO: 363868 - DNA, 140 bp, Artificial Sequence; identical to SEQ ID NO: 11744
  Synthetic

SEQ ID NO: 363869 - DNA, 140 bp, Artificial Sequence; identical to SEQ ID NO: 4867
  Synthetic

SEQ ID NO: 363870 - DNA, 140 bp, Artificial Sequence; identical to SEQ ID NO: 4868
  Synthetic

SEQ ID NO: 363871 - DNA, 140 bp, Artificial Sequence; identical to SEQ ID NO: 4701
  Synthetic

SEQ ID NO: 363872 - DNA, 140 bp, Artificial Sequence; identical to SEQ ID NO: 4702
  Synthetic

SEQ ID NO: 363873 - DNA, 140 bp, Artificial Sequence
  Synthetic
aggccctggctgctgatatggcatccgcatcagctaagctccgcgttctttaccaaggaaataatatcactgtagctgcttatgcaaacggcgaccatgccgtcacagttaaggacgctagaccttttgggacagcggtg

SEQ ID NO: 363874 - DNA, 140 bp, Artificial Sequence
  Synthetic
caccgctgtcccaaaaggtctagcgtccttaactgtgacggcatggtcgccgtttgcataagcagctacagtgatattatttccttggtaaagaacgcggagcttagctgatgcggatgccatatcagcagccagggcct

SEQ ID NO: 363875 - DNA, 140 bp, Artificial Sequence
  Synthetic
atacgccatgctgggtctccggagacgcgtgacacagctatgtctcttcaggcaccgccgagtaccgccacggaactgagtcacccgccgatctccttcggtgcaccaagcgagacgttccgtacttgggagtcggccat

SEQ ID NO: 363876 - DNA, 140 bp, Artificial Sequence
  Synthetic
atggccgactcccaagtacggaacgtctcgcttggtgcaccgaaggagatcggcgggtgactcagttccgtggcggtactcggcggtgcctgaagagacatagctgtgtcacgcgtctccggagacccagcatggcgtat

SEQ ID NO: 363877 - DNA, 140 bp, Artificial Sequence
  Synthetic
aggccctggctgctgatatgcccatcacatttggggacttcaacgaaggagaaatcgaaagcttgtcttctgagctactaactttcggagacttcctacccggagaagtggatgatttgagaccttttgggacagcggtg

SEQ ID NO: 363878 - DNA, 140 bp, Artificial Sequence
  Synthetic
caccgctgtcccaaaaggtctcaaatcatccacttctccgggtaggaagtctccgaaagttagtagctcagaagacaagctttcgatttctccttcgttgaagtccccaaatgtgatgggcatatcagcagccagggcct

SEQ ID NO: 363879 - DNA, 140 bp, Artificial Sequence
  Synthetic
atacgccatgctgggtctccagccgaactcacttgagaagtaggcatagcataccgaactcttccacgattctccgaacccacagggacgtaggagatgttattttgtttttaatatttccgtacttgggagtcggccat

SEQ ID NO: 363880 - DNA, 140 bp, Artificial Sequence
  Synthetic
atggccgactcccaagtacggaaatattaaaaacaaaataacatctcctacgtccctgtgggttcggagaatcgtggaagagttcggtatgctatgcctacttctcaagtgagttcggctggagacccagcatggcgtat

SEQ ID NO: 363881 - DNA, 140 bp, Artificial Sequence
  Synthetic
aggccctggctgctgatatgtgagctactaactttcggagacttcttaccaggagaagtggatgacttgacagacagactagacagggcaggtgggtatatattctcgtcggacaccggtgaccttttgggacagcggtg

SEQ ID NO: 363882 - DNA, 140 bp, Artificial Sequence
  Synthetic
caccgctgtcccaaaaggtcaccggtgtccgacgagaatatatacccacctgccctgtctagtctgtctgtcaagtcatccacttctcctggtaagaagtctccgaaagttagtagctcacatatcagcagccagggcct

SEQ ID NO: 363883 - DNA, 140 bp, Artificial Sequence
  Synthetic
atacgccatgctgggtctccgccttaattttaattgtggtgctatgcgtgtcgtttagcaggcactaaaccgatgacaaggcacgaaataactaaatagtaaaagtagaaagtacataaccgtacttgggagtcggccat

SEQ ID NO: 363884 - DNA, 140 bp, Artificial Sequence
  Synthetic
atggccgactcccaagtacggttatgtactttctacttttactatttagttatttcgtgccttgtcatcggtttagtgcctgctaaacgacacgcatagcaccacaattaaaattaaggcggagacccagcatggcgtat

SEQ ID NO: 363885 - DNA, 140 bp, Artificial Sequence
  Synthetic
aggccctggctgctgatatgggctatgcaatctcgcctgaagacttccagagtctaagcgaaagcgcaacgatggtgtataacgaaagagagttcgtaaacagaaagctacaccatattggaccttttgggacagcggtg

SEQ ID NO: 363886 - DNA, 140 bp, Artificial Sequence
  Synthetic
caccgctgtcccaaaaggtccaatatggtgtagctttctgtttacgaactctctttcgttatacaccatcgttgcgctttcgcttagactctggaagtcttcaggcgagattgcatagcccatatcagcagccagggcct

SEQ ID NO: 363887 - DNA, 140 bp, Artificial Sequence
  Synthetic
aggccctggctgctgatatgcgtgacgtacgggaaaaaccaagtcatcatgctactgtatcctgaccacccaacgctcctgtcctaccggaatatgggagaagaaccaaactatcaagaagaccttttgggacagcggtg

SEQ ID NO: 363888 - DNA, 140 bp, Artificial Sequence
  Synthetic
caccgctgtcccaaaaggtcttcttgatagtttggttcttctcccatattccggtaggacaggagcgttgggtggtcaggatacagtagcatgatgacttggtttttcccgtacgtcacgcatatcagcagccagggcct

SEQ ID NO: 363889 - DNA, 140 bp, Artificial Sequence
  Synthetic
aggccctggctgctgatatgtctagacagcgggctattttctaaaccgttggtgtctgtgtattacgcggataaccactgggataataggcctggagggaagatgttcggatttaaccccgaccttttgggacagcggtg

SEQ ID NO: 363890 - DNA, 140 bp, Artificial Sequence
  Synthetic
caccgctgtcccaaaaggtcggggttaaatccgaacatcttccctccaggcctattatcccagtggttatccgcgtaatacacagacaccaacggtttagaaaatagcccgctgtctagacatatcagcagccagggcct

SEQ ID NO: 363891 - DNA, 140 bp, Artificial Sequence
  Synthetic
atacgccatgctgggtctcctgacctagtggtcataaacatccacacaccttttcgcatacaccattaccaacagtgcgtagaccacgcaatgaaactgcaaatgctcgggggtgactcacgtacttgggagtcggccat

SEQ ID NO: 363892 - DNA, 140 bp, Artificial Sequence
  Synthetic
atggccgactcccaagtacgtgagtcacccccgagcatttgcagtttcattgcgtggtctacgcactgttggtaatggtgtatgcgaaaaggtgtgtggatgtttatgaccactaggtcaggagacccagcatggcgtat

SEQ ID NO: 363893 - DNA, 140 bp, Artificial Sequence
  Synthetic
aggccctggctgctgatatggtggatcactccctgttggacttgatagaggctgctttcggagagatttccagctgtcatctaccgacaggtacgcgcttcaagttcggcgccatgatgagaccttttgggacagcggtg

SEQ ID NO: 363894 - DNA, 140 bp, Artificial Sequence
  Synthetic
caccgctgtcccaaaaggtctcatcatggcgccgaacttgaagcgcgtacctgtcggtagatgacagctggaaatctctccgaaagcagcctctatcaagtccaacagggagtgatccaccatatcagcagccagggcct

SEQ ID NO: 363895 - DNA, 140 bp, Artificial Sequence
  Synthetic
atacgccatgctgggtctccaatctggtatgttcctaactctgttcgtcaacacactgctaaatatcaccatcgccagccgagtgctggaagatcgtctgacaaaatccgcgtgcgcagccgtacttgggagtcggccat

SEQ ID NO: 363896 - DNA, 140 bp, Artificial Sequence
  Synthetic
atggccgactcccaagtacggctgcgcacgcggattttgtcagacgatcttccagcactcggctggcgatggtgatatttagcagtgtgttgacgaacagagttaggaacataccagattggagacccagcatggcgtat

SEQ ID NO: 363897 - DNA, 140 bp, Artificial Sequence
  Synthetic
atacgccatgctgggtctcccttcatcggcgacgacaacataatacatggagtcgtctccgatgaattgatggcagccagatgcgccacttggatgaacatggaagtgaagatcatagatcgtacttgggagtcggccat

SEQ ID NO: 363898 - DNA, 140 bp, Artificial Sequence
  Synthetic
atggccgactcccaagtacgatctatgatcttcacttccatgttcatccaagtggcgcatctggctgccatcaattcatcggagacgactccatgtattatgttgtcgtcgccgatgaagggagacccagcatggcgtat

SEQ ID NO: 363899 - DNA, 140 bp, Artificial Sequence
  Synthetic
atacgccatgctgggtctccgcagttgtatcccagaaagccccttacttttgtggagggtttatactgcacgatatcgtgacaggaacagcttgcagagtggcagacccgctaaaaaggccgtacttgggagtcggccat

SEQ ID NO: 363900 - DNA, 140 bp, Artificial Sequence
  Synthetic
atggccgactcccaagtacggcctttttagcgggtctgccactctgcaagctgttcctgtcacgatatcgtgcagtataaaccctccacaaaagtaaggggctttctgggatacaactgcggagacccagcatggcgtat

SEQ ID NO: 363901 - DNA, 140 bp, Artificial Sequence
  Synthetic
aggccctggctgctgatatgtaaacatcaccatcgccagccgagtgctggaagatcgtctgacaaaatccgcgtgcgcggccttcatcggcgacgacaacataatacatggagtcgtctcgaccttttgggacagcggtg

SEQ ID NO: 363902 - DNA, 140 bp, Artificial Sequence
  Synthetic
caccgctgtcccaaaaggtcgagacgactccatgtattatgttgtcgtcgccgatgaaggccgcgcacgcggattttgtcagacgatcttccagcactcggctggcgatggtgatgtttacatatcagcagccagggcct

SEQ ID NO: 363903 - DNA, 140 bp, Artificial Sequence
  Synthetic
atacgccatgctgggtctccagaagacgagcgctggctgacgaagtggtcagatggcaacgaacagggctaattgatgagttggagaaagcggtatactctaggtatgaagtgcagggtacgtacttgggagtcggccat

SEQ ID NO: 363904 - DNA, 140 bp, Artificial Sequence
  Synthetic
atggccgactcccaagtacgtaccctgcacttcatacctagagtataccgctttctccaactcatcaattagccctgttcgttgccatctgaccacttcgtcagccagcgctcgtcttctggagacccagcatggcgtat

SEQ ID NO: 363905 - DNA, 140 bp, Artificial Sequence
  Synthetic
aggccctggctgctgatatgaattgatgagttggagaaagcggtatactctaggtatgaagtgcagggtatatcagttgtggtaatgtccatggccacctttgcaagctccagatccaacgaccttttgggacagcggtg

SEQ ID NO: 363906 - DNA, 140 bp, Artificial Sequence
  Synthetic
caccgctgtcccaaaaggtcgttggatctggagcttgcaaaggtggccatggacattaccacaactgatataccctgcacttcatacctagagtataccgctttctccaactcatcaattcatatcagcagccagggcct

SEQ ID NO: 363907 - DNA, 140 bp, Artificial Sequence
  Synthetic
atacgccatgctgggtctcctacgaacaccatgaaaaattatctgcttcccgtggtcgcccaagccttcagtaagtgggcaaaggagtgccggaaagacatggaagatgaaaaactcctgcgtacttgggagtcggccat

SEQ ID NO: 363908 - DNA, 140 bp, Artificial Sequence
  Synthetic
atggccgactcccaagtacgcaggagtttttcatcttccatgtctttccggcactcctttgcccacttactgaaggcttgggcgaccacgggaagcagataatttttcatggtgttcgtaggagacccagcatggcgtat

SEQ ID NO: 363909 - DNA, 140 bp, Artificial Sequence; identical to SEQ ID NO: 8045
  Synthetic

SEQ ID NO: 363910 - DNA, 140 bp, Artificial Sequence; identical to SEQ ID NO: 8046
  Synthetic

SEQ ID NO: 363911 - DNA, 140 bp, Artificial Sequence
  Synthetic
aggccctggctgctgatatgctaaaatcacccccgagggggccgaagagtggagtcttgccatcccagttatgtgcctgttggcaaacaccacgttcccctgctcccagcccccttgcacgaccttttgggacagcggtg

SEQ ID NO: 363912 - DNA, 140 bp, Artificial Sequence
  Synthetic
caccgctgtcccaaaaggtcgtgcaagggggctgggagcaggggaacgtggtgtttgccaacaggcacataactgggatggcaagactccactcttcggccccctcgggggtgattttagcatatcagcagccagggcct

SEQ ID NO: 363913 - DNA, 140 bp, Artificial Sequence
  Synthetic
atacgccatgctgggtctcccagaagcgctgtaccgtccccattccagaacacactacagaatgtactggcagcagccacgaaaagaaactgcaacgtcacacagatgagggaattaccccgtacttgggagtcggccat

SEQ ID NO: 363914 - DNA, 140 bp, Artificial Sequence
  Synthetic
atggccgactcccaagtacggggtaattccctcatctgtgtgacgttgcagtttcttttcgtggctgctgccagtacattctgtagtgtgttctggaatggggacggtacagcgcttctgggagacccagcatggcgtat

SEQ ID NO: 363915 - DNA, 140 bp, Artificial Sequence
  Synthetic
aggccctggctgctgatatgtaacgcggacctggccaaattggcctttaagcggtcatctaagtacgaccttgaatgcgcgcagatacccgtgcacatgaagtccgacgcttcgaagttcgaccttttgggacagcggtg

SEQ ID NO: 363916 - DNA, 140 bp, Artificial Sequence
  Synthetic
caccgctgtcccaaaaggtcgaacttcgaagcgtcggacttcatgtgcacgggtatctgcgcgcattcaaggtcgtacttagatgaccgcttaaaggccaatttggccaggtccgcgttacatatcagcagccagggcct

SEQ ID NO: 363917 - DNA, 140 bp, Artificial Sequence
  Synthetic
aggccctggctgctgatatgcaggtacgcgcttcaagttcggcgccatgatgaaatccggtatgtttctaactctgttcgtcaacacattgctaaatatcaccatcgctagccgagtgctgaccttttgggacagcggtg

SEQ ID NO: 363918 - DNA, 140 bp, Artificial Sequence
  Synthetic
caccgctgtcccaaaaggtcagcactcggctagcgatggtgatatttagcaatgtgttgacgaacagagttagaaacataccggatttcatcatggcgccgaacttgaagcgcgtacctgcatatcagcagccagggcct

SEQ ID NO: 363919 - DNA, 140 bp, Artificial Sequence
  Synthetic
aggccctggctgctgatatgtgccatcgcgcgtaagtccaagggaatacagaccttcccaggagtctgtacaggaagtgagtacgaccacgtcactgacgcatagccaattcgatctaaggaccttttgggacagcggtg

SEQ ID NO: 363920 - DNA, 140 bp, Artificial Sequence
  Synthetic
caccgctgtcccaaaaggtccttagatcgaattggctatgcgtcagtgacgtggtcgtactcacttcctgtacagactcctgggaaggtctgtattcccttggacttacgcgcgatggcacatatcagcagccagggcct

SEQ ID NO: 363921 - DNA, 140 bp, Artificial Sequence
  Synthetic
aggccctggctgctgatatgatacgtgtcccctaagagacacattgtatgtaggtgataagtatagatcaaagggccgaataacccctgaatagtaacaaaatatgaaaatcaataaaaagaccttttgggacagcggtg

SEQ ID NO: 363922 - DNA, 140 bp, Artificial Sequence
  Synthetic
caccgctgtcccaaaaggtctttttattgattttcatattttgttactattcaggggttattcggccctttgatctatacttatcacctacatacaatgtgtctcttaggggacacgtatcatatcagcagccagggcct

SEQ ID NO: 363923 - DNA, 140 bp, Artificial Sequence
  Synthetic
atacgccatgctgggtctcccgttgacggcgagatactgcccgtcccgtcagacctggatgctgacgccccagccctagaaccagcccttgacgacggggcgatacacacgttgccatctcgtacttgggagtcggccat

SEQ ID NO: 363924 - DNA, 140 bp, Artificial Sequence
  Synthetic
atggccgactcccaagtacgagatggcaacgtgtgtatcgccccgtcgtcaagggctggttctagggctggggcgtcagcatccaggtctgacgggacgggcagtatctcgccgtcaacgggagacccagcatggcgtat

SEQ ID NO: 363925 - DNA, 140 bp, Artificial Sequence
  Synthetic
aggccctggctgctgatatggacaacttcaatgtctataaagccacaagaccatacctagctcactgtcccgactgtggagaagggcactcgtgccatagtcccgtagcactagaacgcagaccttttgggacagcggtg

SEQ ID NO: 363926 - DNA, 140 bp, Artificial Sequence
  Synthetic
caccgctgtcccaaaaggtctgcgttctagtgctacgggactatggcacgagtgcccttctccacagtcgggacagtgagctaggtatggtcttgtggctttatagacattgaagttgtccatatcagcagccagggcct

SEQ ID NO: 363927 - DNA, 140 bp, Artificial Sequence; identical to SEQ ID NO: 8051
  Synthetic

SEQ ID NO: 363928 - DNA, 140 bp, Artificial Sequence; identical to SEQ ID NO: 8052
  Synthetic

SEQ ID NO: 363929 - DNA, 140 bp, Artificial Sequence
  Synthetic
aggccctggctgctgatatgattggaatagggacggatgatagccatgattggaccaagctgcgttacatggacaatcacataccagcagacgcagggagggccgggctatttgtaagaagaccttttgggacagcggtg

SEQ ID NO: 363930 - DNA, 140 bp, Artificial Sequence
  Synthetic
caccgctgtcccaaaaggtcttcttacaaatagcccggccctccctgcgtctgctggtatgtgattgtccatgtaacgcagcttggtccaatcatggctatcatccgtccctattccaatcatatcagcagccagggcct

SEQ ID NO: 363931 - DNA, 140 bp, Artificial Sequence
  Synthetic
aggccctggctgctgatatgcatcagcaccatgcacgattactggaacaatgggacacttcatcctggcccgatgtccgaaaggagaaactctgacggtgggattcactgacagtaggaagaccttttgggacagcggtg

SEQ ID NO: 363932 - DNA, 140 bp, Artificial Sequence
  Synthetic
caccgctgtcccaaaaggtcttcctactgtcagtgaatcccaccgtcagagtttctcctttcggacatcgggccaggatgaagtgtcccattgttccagtaatcgtgcatggtgctgatgcatatcagcagccagggcct

SEQ ID NO: 363933 - DNA, 140 bp, Artificial Sequence
  Synthetic
atacgccatgctgggtctccattggctaaaagaacgaggggcgtcgctgcagcacacagcaccatttggctgccaaatagcaacaaacccggtaagagcggtgaactgcgccgtagggaacgtacttgggagtcggccat

SEQ ID NO: 363934 - DNA, 140 bp, Artificial Sequence
  Synthetic
atggccgactcccaagtacgttccctacggcgcagttcaccgctcttaccgggtttgttgctatttggcagccaaatggtgctgtgtgctgcagcgacgcccctcgttcttttagccaatggagacccagcatggcgtat

SEQ ID NO: 363935 - DNA, 140 bp, Artificial Sequence
  Synthetic
atacgccatgctgggtctccacgtaaagatcacagtcaatagtcagacggtgcggtataagtgtaattgcggtggctcaaatgaaggactaataactacagataaagtgattaataactgcgtacttgggagtcggccat

SEQ ID NO: 363936 - DNA, 140 bp, Artificial Sequence
  Synthetic
atggccgactcccaagtacgcagttattaatcactttatctgtagttattagtccttcatttgagccaccgcaattacacttataccgcaccgtctgactattgactgtgatctttacgtggagacccagcatggcgtat

SEQ ID NO: 363937 - DNA, 140 bp, Artificial Sequence; identical to SEQ ID NO: 5839
  Synthetic

SEQ ID NO: 363938 - DNA, 140 bp, Artificial Sequence; identical to SEQ ID NO: 5840
  Synthetic

SEQ ID NO: 363939 - DNA, 140 bp, Artificial Sequence; identical to SEQ ID NO: 8431
  Synthetic

SEQ ID NO: 363940 - DNA, 140 bp, Artificial Sequence; identical to SEQ ID NO: 8432
  Synthetic

SEQ ID NO: 363941 - DNA, 140 bp, Artificial Sequence; identical to SEQ ID NO: 11611
  Synthetic

SEQ ID NO: 363942 - DNA, 140 bp, Artificial Sequence; identical to SEQ ID NO: 11612
  Synthetic

SEQ ID NO: 363943 - DNA, 140 bp, Artificial Sequence
  Synthetic
aggccctggctgctgatatgagtattggccgcagttatctgcaaacggtacagcccacggccacccgcatgagataatcttgtactattatgagctgtaccctactatgactgtagtagtgaccttttgggacagcggtg

SEQ ID NO: 363944 - DNA, 140 bp, Artificial Sequence
  Synthetic
caccgctgtcccaaaaggtcactactacagtcatagtagggtacagctcataatagtacaagattatctcatgcgggtggccgtgggctgtaccgtttgcagataactgcggccaatactcatatcagcagccagggcct

SEQ ID NO: 363945 - DNA, 140 bp, Artificial Sequence
  Synthetic
aggccctggctgctgatatgatctgccgcaggaaaagtcctggacagaaacatctctggaaagatcggggacttacaagcagtaatggccgtgccagacacggagacgccgacattctgcgaccttttgggacagcggtg

SEQ ID NO: 363946 - DNA, 140 bp, Artificial Sequence
  Synthetic
caccgctgtcccaaaaggtcgcagaatgtcggcgtctccgtgtctggcacggccattactgcttgtaagtccccgatctttccagagatgtttctgtccaggacttttcctgcggcagatcatatcagcagccagggcct

SEQ ID NO: 363947 - DNA, 140 bp, Artificial Sequence
  Synthetic
aggccctggctgctgatatgttacacacagatgtctcatgtagacagagagcagacgtcgcgatataccaagacgtctatgctgtacacgcacccacgtcgctataccaccaggcgattagaccttttgggacagcggtg

SEQ ID NO: 363948 - DNA, 140 bp, Artificial Sequence
  Synthetic
caccgctgtcccaaaaggtctaatcgcctggtggtatagcgacgtgggtgcgtgtacagcatagacgtcttggtatatcgcgacgtctgctctctgtctacatgagacatctgtgtgtaacatatcagcagccagggcct

SEQ ID NO: 363949 - DNA, 140 bp, Artificial Sequence
  Synthetic
  misc_feature (116)..(116): n is a, c, g, or t
aggccctggctgctgatatggccgaactcactttgagaagtaggcatagcataccgaactcttccccgattctccgaacccacagggacgtaggagatgttattttgctttttacncaccgaccttttgggacagcggtg

SEQ ID NO: 363950 - DNA, 140 bp, Artificial Sequence
  Synthetic
  misc_feature (25)..(25): n is a, c, g, or t
caccgctgtcccaaaaggtcggtgngtaaaaagcaaaataacatctcctacgtccctgtgggttcggagaatcggggaagagttcggtatgctatgcctacttctcaaagtgagttcggccatatcagcagccagggcct

SEQ ID NO: 363951 - DNA, 140 bp, Artificial Sequence
  Synthetic
aggccctggctgctgatatggacaaaaacctacctgactacagctgtaaggtcttcaccggcgtctacccatttatgtggggcggcgcctactgcttctgcgacgctgaaaacacgcaatgaccttttgggacagcggtg

SEQ ID NO: 363952 - DNA, 140 bp, Artificial Sequence
  Synthetic
caccgctgtcccaaaaggtcattgcgtgttttcagcgtcgcagaagcagtaggcgccgccccacataaatgggtagacgccggtgaagaccttacagctgtagtcaggtaggtttttgtccatatcagcagccagggcct

SEQ ID NO: 363953 - DNA, 140 bp, Artificial Sequence
  Synthetic
atacgccatgctgggtctccccccctcatcctctcccctctatttaaacaactgctccactactacatccttatctctcacaccccccctctattccgctaagcgatgtctctacccatccgtacttgggagtcggccat

SEQ ID NO: 363954 - DNA, 140 bp, Artificial Sequence
  Synthetic
atggccgactcccaagtacggatgggtagagacatcgcttagcggaatagagggggggtgtgagagataaggatgtagtagtggagcagttgtttaaatagaggggagaggatgagggggggagacccagcatggcgtat

SEQ ID NO: 363955 - DNA, 140 bp, Artificial Sequence; identical to SEQ ID NO: 11387
  Synthetic

SEQ ID NO: 363956 - DNA, 140 bp, Artificial Sequence; identical to SEQ ID NO: 11388
  Synthetic

SEQ ID NO: 363957 - DNA, 140 bp, Artificial Sequence; identical to SEQ ID NO: 8491
  Synthetic

SEQ ID NO: 363958 - DNA, 140 bp, Artificial Sequence; identical to SEQ ID NO: 8492
  Synthetic

SEQ ID NO: 363959 - DNA, 140 bp, Artificial Sequence
  Synthetic
atacgccatgctgggtctcctacctcattaataccccccttaccatattcctctcatcaacatccctcctccacatttcccttcttctatcttcttatcccttatccttacccacattctcgtacttgggagtcggccat

SEQ ID NO: 363960 - DNA, 140 bp, Artificial Sequence
  Synthetic
atggccgactcccaagtacgagaatgtgggtaaggataagggataagaagatagaagaagggaaatgtggaggagggatgttgatgagaggaatatggtaaggggggtattaatgaggtaggagacccagcatggcgtat

SEQ ID NO: 363961 - DNA, 140 bp, Artificial Sequence
  Synthetic
aggccctggctgctgatatgtccaaagtcgcacgcctgagagcaaagacgtctatgctaacacacaactggtactgcagagaccggctgcgggtacggtacacgtgccatactctcaggcgaccttttgggacagcggtg

SEQ ID NO: 363962 - DNA, 140 bp, Artificial Sequence
  Synthetic
caccgctgtcccaaaaggtcgcctgagagtatggcacgtgtaccgtacccgcagccggtctctgcagtaccagttgtgtgttagcatagacgtctttgctctcaggcgtgcgactttggacatatcagcagccagggcct

SEQ ID NO: 363963 - DNA, 140 bp, Artificial Sequence
  Synthetic
atacgccatgctgggtctcccatctatctttcatcatcacatcttatctatctctcttattcttcttccattattctcctcttttcttttcttttctattatctctttcattgttattcacgtacttgggagtcggccat

SEQ ID NO: 363964 - DNA, 140 bp, Artificial Sequence
  Synthetic
atggccgactcccaagtacgtgaataacaatgaaagagataatagaaaagaaaagaaaagaggagaataatggaagaagaataagagagatagataagatgtgatgatgaaagatagatgggagacccagcatggcgtat

SEQ ID NO: 363965 - DNA, 140 bp, Artificial Sequence; identical to SEQ ID NO: 11395
  Synthetic

SEQ ID NO: 363966 - DNA, 140 bp, Artificial Sequence; identical to SEQ ID NO: 11396
  Synthetic

SEQ ID NO: 363967 - DNA, 140 bp, Artificial Sequence; identical to SEQ ID NO: 7969
  Synthetic

SEQ ID NO: 363968 - DNA, 140 bp, Artificial Sequence; identical to SEQ ID NO: 7970
  Synthetic

SEQ ID NO: 363969 - DNA, 140 bp, Artificial Sequence
  Synthetic
  misc_feature (110)..(110): n is a, c, g, or t
atacgccatgctgggtctcccaatctcacactcttaacctcccccatcttccatctacagtctacatccactattccacaactcccctgatcctcaatcctctctgtacnatatatcaagcgtacttgggagtcggccat

SEQ ID NO: 363970 - DNA, 140 bp, Artificial Sequence
  Synthetic
  misc_feature (31)..(31): n is a, c, g, or t
atggccgactcccaagtacgcttgatatatngtacagagaggattgaggatcaggggagttgtggaatagtggatgtagactgtagatggaagatgggggaggttaagagtgtgagattgggagacccagcatggcgtat

SEQ ID NO: 363971 - DNA, 140 bp, Artificial Sequence
  Synthetic
  misc_feature (80)..(80): n is a, c, g, or t
aggccctggctgctgatatgccatctacagtctacatccactattccacaactcccctgatcctcaatcctctctgtacnatatatcaagcacctgacatagcttctctatttttcccacgaccttttgggacagcggtg

SEQ ID NO: 363972 - DNA, 140 bp, Artificial Sequence
  Synthetic
  misc_feature (61)..(61): n is a, c, g, or t
caccgctgtcccaaaaggtcgtgggaaaaatagagaagctatgtcaggtgcttgatatatngtacagagaggattgaggatcaggggagttgtggaatagtggatgtagactgtagatggcatatcagcagccagggcct

SEQ ID NO: 363973 - DNA, 140 bp, Artificial Sequence
  Synthetic
aggccctggctgctgatatgctgcaaagcaagagattaataacccatcatggatcctgtgtacgtggacatagacgctgacagcgcctttttgaaggccctgcaacgtgcgtaccccatggaccttttgggacagcggtg

SEQ ID NO: 363974 - DNA, 140 bp, Artificial Sequence
  Synthetic
caccgctgtcccaaaaggtccatggggtacgcacgttgcagggccttcaaaaaggcgctgtcagcgtctatgtccacgtacacaggatccatgatgggttattaatctcttgctttgcagcatatcagcagccagggcct

SEQ ID NO: 363975 - DNA, 140 bp, Artificial Sequence; identical to SEQ ID NO: 9655
  Synthetic

SEQ ID NO: 363976 - DNA, 140 bp, Artificial Sequence; identical to SEQ ID NO: 9656
  Synthetic

SEQ ID NO: 363977 - DNA, 140 bp, Artificial Sequence
  Synthetic
atacgccatgctgggtctcccagcaggcactaacttgacgactaagcatgaaggtatatgtgtcccctaagagacacaccgtatatagctaataatctgtagatcaaagggctatataaccgtacttgggagtcggccat

SEQ ID NO: 363978 - DNA, 140 bp, Artificial Sequence
  Synthetic
atggccgactcccaagtacggttatatagccctttgatctacagattattagctatatacggtgtgtctcttaggggacacatataccttcatgcttagtcgtcaagttagtgcctgctgggagacccagcatggcgtat

SEQ ID NO: 363979 - DNA, 140 bp, Artificial Sequence
  Synthetic
aggccctggctgctgatatggagacacaccgtatatagctaataatctgtagatcaaagggctatataacccctgaatagtaacaaaatacaaaatcactaaaaattataaaaaaaaaaagaccttttgggacagcggtg

SEQ ID NO: 363980 - DNA, 140 bp, Artificial Sequence
  Synthetic
caccgctgtcccaaaaggtctttttttttttataatttttagtgattttgtattttgttactattcaggggttatatagccctttgatctacagattattagctatatacggtgtgtctccatatcagcagccagggcct

SEQ ID NO: 363981 - DNA, 140 bp, Artificial Sequence
  Synthetic
aggccctggctgctgatatggctttcggagagatttccagctgtcacctaccgacaggtacgcgcttcaagttcggcgccatgatgaaatcaggtatgttcctaactctgttcgtcaacagaccttttgggacagcggtg

SEQ ID NO: 363982 - DNA, 140 bp, Artificial Sequence
  Synthetic
caccgctgtcccaaaaggtctgttgacgaacagagttaggaacatacctgatttcatcatggcgccgaacttgaagcgcgtacctgtcggtaggtgacagctggaaatctctccgaaagccatatcagcagccagggcct

SEQ ID NO: 363983 - DNA, 140 bp, Artificial Sequence
  Synthetic
atacgccatgctgggtctccacgtaggtatttaagcttcctaaaagcagccgaactcactttgagacgtaggcatagcataccgaactcttccactattctccgaacccacaggacgtgacgtacttgggagtcggccat

SEQ ID NO: 363984 - DNA, 140 bp, Artificial Sequence
  Synthetic
atggccgactcccaagtacgtcacgtcctgtgggttcggagaatagtggaagagttcggtatgctatgcctacgtctcaaagtgagttcggctgcttttaggaagcttaaatacctacgtggagacccagcatggcgtat

SEQ ID NO: 363985 - DNA, 140 bp, Artificial Sequence; identical to SEQ ID NO: 9245
  Synthetic

SEQ ID NO: 363986 - DNA, 140 bp, Artificial Sequence; identical to SEQ ID NO: 9246
  Synthetic

SEQ ID NO: 363987 - DNA, 140 bp, Artificial Sequence
  Synthetic
aggccctggctgctgatatgacgtagcctaccagtttcttactgctctactctgcaaagcaagagattaagaacccatcatggatcctgtgtacgtggacatagacgctgacagcgccttgaccttttgggacagcggtg

SEQ ID NO: 363988 - DNA, 140 bp, Artificial Sequence
  Synthetic
caccgctgtcccaaaaggtcaaggcgctgtcagcgtctatgtccacgtacacaggatccatgatgggttcttaatctcttgctttgcagagtagagcagtaagaaactggtaggctacgtcatatcagcagccagggcct

SEQ ID NO: 363989 - DNA, 140 bp, Artificial Sequence
  Synthetic
atacgccatgctgggtctccagtatgaaggtatatgtgtcccctaagagacacactgtacatagcaaataatctatagatcaaagggctacgcaacccctgaatagtaacaaaatacaaacgtacttgggagtcggccat

SEQ ID NO: 363990 - DNA, 140 bp, Artificial Sequence
  Synthetic
atggccgactcccaagtacgtttgtattttgttactattcaggggttgcgtagccctttgatctatagattatttgctatgtacagtgtgtctcttaggggacacatataccttcatactggagacccagcatggcgtat

SEQ ID NO: 363991 - DNA, 140 bp, Artificial Sequence
  Synthetic
atacgccatgctgggtctcctaacaaaatatgaaaatcaataaaaatcataaaatagaaaaaccataaacagaagtagttcaaagggctataaaacccctgaatagtaacaaaacataaacgtacttgggagtcggccat

SEQ ID NO: 363992 - DNA, 140 bp, Artificial Sequence
  Synthetic
atggccgactcccaagtacgtttatgttttgttactattcaggggttttatagccctttgaactacttctgtttatggtttttctattttatgatttttattgattttcatattttgttaggagacccagcatggcgtat

SEQ ID NO: 363993 - DNA, 140 bp, Artificial Sequence
  Synthetic
atacgccatgctgggtctcccgtgccatagtcccgtagcactagaacgcatcagaaatgaagcgacagacgggacgctgaaaatccaggtctccttgcaaatcggaataaagacggatgacgtacttgggagtcggccat

SEQ ID NO: 363994 - DNA, 140 bp, Artificial Sequence
  Synthetic
atggccgactcccaagtacgtcatccgtctttattccgatttgcaaggagacctggattttcagcgtcccgtctgtcgcttcatttctgatgcgttctagtgctacgggactatggcacgggagacccagcatggcgtat

SEQ ID NO: 363995 - DNA, 140 bp, Artificial Sequence
  Synthetic
atacgccatgctgggtctcctctgcccgatgcgcagcgcagaagatcccgagagactcgccaattatgcgagaaagctagcatctgccgcaggaaaagtcctggacagaaacatctctggcgtacttgggagtcggccat

SEQ ID NO: 363996 - DNA, 140 bp, Artificial Sequence
  Synthetic
atggccgactcccaagtacgccagagatgtttctgtccaggacttttcctgcggcagatgctagctttctcgcataattggcgagtctctcgggatcttctgcgctgcgcatcgggcagaggagacccagcatggcgtat

SEQ ID NO: 363997 - DNA, 140 bp, Artificial Sequence; identical to SEQ ID NO: 7779
  Synthetic

SEQ ID NO: 363998 - DNA, 140 bp, Artificial Sequence; identical to SEQ ID NO: 7780
  Synthetic

SEQ ID NO: 363999 - DNA, 140 bp, Artificial Sequence
  Synthetic
aggccctggctgctgatatgcgaacacggtgggagtaccgtataagactctagtcaatagacctggctacagccccatggtattggagatggaactactgtcagtcactttggagccaacgaccttttgggacagcggtg

SEQ ID NO: 364000 - DNA, 140 bp, Artificial Sequence
  Synthetic
caccgctgtcccaaaaggtcgttggctccaaagtgactgacagtagttccatctccaataccatggggctgtagccaggtctattgactagagtcttatacggtactcccaccgtgttcgcatatcagcagccagggcct

SEQ ID NO: 364001 - DNA, 140 bp, Artificial Sequence
  Synthetic
aggccctggctgctgatatggggccgaacaacccctgaatagtaacaaaatatgaaaattaataaaaatcataaaatagaaaaaccataaacagaagtagttcaaagggctataaaaaccgaccttttgggacagcggtg

SEQ ID NO: 364002 - DNA, 140 bp, Artificial Sequence
  Synthetic
caccgctgtcccaaaaggtcggtttttatagccctttgaactacttctgtttatggtttttctattttatgatttttattaattttcatattttgttactattcaggggttgttcggccccatatcagcagccagggcct

SEQ ID NO: 364003 - DNA, 140 bp, Artificial Sequence; identical to SEQ ID NO: 8101
  Synthetic

SEQ ID NO: 364004 - DNA, 140 bp, Artificial Sequence; identical to SEQ ID NO: 8102
  Synthetic

SEQ ID NO: 364005 - DNA, 140 bp, Artificial Sequence
  Synthetic
aggccctggctgctgatatgaagcagccgaactcactttgagaagtaggcatagcataccgaactcttccacgattctccgaacccacagggacgtaggagatgttattttgtttttaatgaccttttgggacagcggtg

SEQ ID NO: 364006 - DNA, 140 bp, Artificial Sequence
  Synthetic
caccgctgtcccaaaaggtcattaaaaacaaaataacatctcctacgtccctgtgggttcggagaatcgtggaagagttcggtatgctatgcctacttctcaaagtgagttcggctgcttcatatcagcagccagggcct

SEQ ID NO: 364007 - DNA, 140 bp, Artificial Sequence
  Synthetic
aggccctggctgctgatatgccagtttcttactgctctactctgcaaagcaagagattaataacccatcatggatcctgtgtacgtggacatagacgctgacagcgcctttttgaaggccgaccttttgggacagcggtg

SEQ ID NO: 364008 - DNA, 140 bp, Artificial Sequence
  Synthetic
caccgctgtcccaaaaggtcggccttcaaaaaggcgctgtcagcgtctatgtccacgtacacaggatccatgatgggttattaatctcttgctttgcagagtagagcagtaagaaactggcatatcagcagccagggcct

SEQ ID NO: 364009 - DNA, 140 bp, Artificial Sequence
  Synthetic
aggccctggctgctgatatgattcacgctttggcggagcaagtgaagacgtgcacgcacaacggacgagcagggaggtatgcggtcgaagcgtacgacggccgagtcctagtgccctcaggaccttttgggacagcggtg

SEQ ID NO: 364010 - DNA, 140 bp, Artificial Sequence
  Synthetic
caccgctgtcccaaaaggtcctgagggcactaggactcggccgtcgtacgcttcgaccgcatacctccctgctcgtccgttgtgcgtgcacgtcttcacttgctccgccaaagcgtgaatcatatcagcagccagggcct

SEQ ID NO: 364011 - DNA, 140 bp, Artificial Sequence
  Synthetic
aggccctggctgctgatatggtgtaagactaccgacacggttgacggcgaaagagtgtcattctcggtgtgtacatacgtgccggcgaccatttgtgatcaaatgaccggcatccttgctgaccttttgggacagcggtg

SEQ ID NO: 364012 - DNA, 140 bp, Artificial Sequence
  Synthetic
caccgctgtcccaaaaggtcagcaaggatgccggtcatttgatcacaaatggtcgccggcacgtatgtacacaccgagaatgacactctttcgccgtcaaccgtgtcggtagtcttacaccatatcagcagccagggcct

SEQ ID NO: 364013 - DNA, 140 bp, Artificial Sequence
  Synthetic
aggccctggctgctgatatggcagaccgtactacgcagccagaagctcagcctgatccacgctttagcggagcaagtgaagacgtgtacgcacagcggacgagcagggaggtatgcggtcgaccttttgggacagcggtg

SEQ ID NO: 364014 - DNA, 140 bp, Artificial Sequence
  Synthetic
caccgctgtcccaaaaggtcgaccgcatacctccctgctcgtccgctgtgcgtacacgtcttcacttgctccgctaaagcgtggatcaggctgagcttctggctgcgtagtacggtctgccatatcagcagccagggcct

SEQ ID NO: 364015 - DNA, 140 bp, Artificial Sequence
  Synthetic
aggccctggctgctgatatgctgaacactgacgaagagtcgtatgagctggtgagggcagagaggacagaacacgagtacgtctacgacgtggaccagagaagatgctgtaagaaggaaggaccttttgggacagcggtg

SEQ ID NO: 364016 - DNA, 140 bp, Artificial Sequence
  Synthetic
caccgctgtcccaaaaggtccttccttcttacagcatcttctctggtccacgtcgtagacgtactcgtgttctgtcctctctgccctcaccagctcatacgactcttcgtcagtgttcagcatatcagcagccagggcct

SEQ ID NO: 364017 - DNA, 140 bp, Artificial Sequence
  Synthetic
atacgccatgctgggtctccaacattataccggccaacaggagactaccacactcattagtggccgaacaccgcccagtaaaaggggaaagaatggaatggctggttaacaagataaacgcgtacttgggagtcggccat

SEQ ID NO: 364018 - DNA, 140 bp, Artificial Sequence
  Synthetic
atggccgactcccaagtacgcgtttatcttgttaaccagccattccattctttccccttttactgggcggtgttcggccactaatgagtgtggtagtctcctgttggccggtataatgttggagacccagcatggcgtat

SEQ ID NO: 364019 - DNA, 140 bp, Artificial Sequence
  Synthetic
aggccctggctgctgatatgctattaaggagtgggaggtggagcacgcatcgataatggcgggcatctgcagtcaccaagtgacctttgacacattccaaaacaaagccaacgtttgctggaccttttgggacagcggtg

SEQ ID NO: 364020 - DNA, 140 bp, Artificial Sequence
  Synthetic
caccgctgtcccaaaaggtccagcaaacgttggctttgttttggaatgtgtcaaaggtcacttggtgactgcagatgcccgccattatcgatgcgtgctccacctcccactccttaatagcatatcagcagccagggcct

SEQ ID NO: 364021 - DNA, 140 bp, Artificial Sequence; identical to SEQ ID NO: 8953
  Synthetic

SEQ ID NO: 364022 - DNA, 140 bp, Artificial Sequence; identical to SEQ ID NO: 8954
  Synthetic

SEQ ID NO: 364023 - DNA, 140 bp, Artificial Sequence; identical to SEQ ID NO: 9749
  Synthetic

SEQ ID NO: 364024 - DNA, 140 bp, Artificial Sequence; identical to SEQ ID NO: 9750
  Synthetic

SEQ ID NO: 364025 - DNA, 140 bp, Artificial Sequence
  Synthetic
atacgccatgctgggtctccttcaacagacctgacggaaggtagacgaggcaaattgtctattatgagagggaaaaagctaaaaccgtgcgaccgtgtgctgttctcagtagggtcaacgcgtacttgggagtcggccat

SEQ ID NO: 364026 - DNA, 140 bp, Artificial Sequence
  Synthetic
atggccgactcccaagtacgcgttgaccctactgagaacagcacacggtcgcacggttttagctttttccctctcataatagacaatttgcctcgtctaccttccgtcaggtctgttgaaggagacccagcatggcgtat

SEQ ID NO: 364027 - DNA, 140 bp, Artificial Sequence
  Synthetic
aggccctggctgctgatatggaggaagaacgagaagcagaactgactcgtgaagccctaccacctctacaggcagcacaggaagatgttcaggtcgaaatcgacgtggaacagcttgagggaccttttgggacagcggtg

SEQ ID NO: 364028 - DNA, 140 bp, Artificial Sequence
  Synthetic
caccgctgtcccaaaaggtccctcaagctgttccacgtcgatttcgacctgaacatcttcctgtgctgcctgtagaggtggtagggcttcacgagtcagttctgcttctcgttcttcctccatatcagcagccagggcct

SEQ ID NO: 364029 - DNA, 140 bp, Artificial Sequence
  Synthetic
atacgccatgctgggtctccatcaactgaatgcagcctttgtaggacaggccacccgagcaggatgtgcaccgtcgtaccgggtaaaacgcatggacatcgcgaagaacgatgaagagtgcgtacttgggagtcggccat

SEQ ID NO: 364030 - DNA, 140 bp, Artificial Sequence
  Synthetic
atggccgactcccaagtacgcactcttcatcgttcttcgcgatgtccatgcgttttacccggtacgacggtgcacatcctgctcgggtggcctgtcctacaaaggctgcattcagttgatggagacccagcatggcgtat

SEQ ID NO: 364031 - DNA, 140 bp, Artificial Sequence
  Synthetic
atacgccatgctgggtctccctgaacaccgacgaagagtcgtatgagctggtgagggcagagaggacagaacacgagtacgtctacgatgtggaccagagaagatgctgtaagaaggaagcgtacttgggagtcggccat

SEQ ID NO: 364032 - DNA, 140 bp, Artificial Sequence
  Synthetic
atggccgactcccaagtacgcttccttcttacagcatcttctctggtccacatcgtagacgtactcgtgttctgtcctctctgccctcaccagctcatacgactcttcgtcggtgttcagggagacccagcatggcgtat

SEQ ID NO: 364033 - DNA, 140 bp, Artificial Sequence; identical to SEQ ID NO: 11715
  Synthetic

SEQ ID NO: 364034 - DNA, 140 bp, Artificial Sequence; identical to SEQ ID NO: 11716
  Synthetic

SEQ ID NO: 364035 - DNA, 140 bp, Artificial Sequence
  Synthetic
aggccctggctgctgatatggagcaggatgtgcaccgtcgtaccgggtaaaacgcatggatatcgcgaagaacgatgaagagtgcgtagtcaacgccgccaaccctcgcggtgacggtgtgaccttttgggacagcggtg

SEQ ID NO: 364036 - DNA, 140 bp, Artificial Sequence
  Synthetic
caccgctgtcccaaaaggtcacaccgtcaccgcgagggttggcggcgttgactacgcactcttcatcgttcttcgcgatatccatgcgttttacccggtacgacggtgcacatcctgctccatatcagcagccagggcct

SEQ ID NO: 364037 - DNA, 140 bp, Artificial Sequence
  Synthetic
aggccctggctgctgatatgatcatctagagcgttgaaaccaccatgtgtcaccagcaacactgagatgttttttttattcagcaactttgacaatggcagaaggaatttcacaacccatgaccttttgggacagcggtg

SEQ ID NO: 364038 - DNA, 140 bp, Artificial Sequence
  Synthetic
caccgctgtcccaaaaggtcatgggttgtgaaattccttctgccattgtcaaagttgctgaataaaaaaaacatctcagtgttgctggtgacacatggtggtttcaacgctctagatgatcatatcagcagccagggcct

SEQ ID NO: 364039 - DNA, 140 bp, Artificial Sequence
  Synthetic
aggccctggctgctgatatgtcgacgtgttgtacgtagacgaggcgtttgcgtgccactctggaacgttacttgctttgatcgccttggttagaccaaggcagaaagttgtactttgtgggaccttttgggacagcggtg

SEQ ID NO: 364040 - DNA, 140 bp, Artificial Sequence
  Synthetic
caccgctgtcccaaaaggtcccacaaagtacaactttctgccttggtctaaccaaggcgatcaaagcaagtaacgttccagagtggcacgcaaacgcctcgtctacgtacaacacgtcgacatatcagcagccagggcct

SEQ ID NO: 364041 - DNA, 140 bp, Artificial Sequence
  Synthetic
aggccctggctgctgatatgtagaaacggacatagcctcctttgataagagccaagatgattcacttgcgcttaccgccttaatgctgttagaagatttgggagtggatcactccctgttgaccttttgggacagcggtg

SEQ ID NO: 364042 - DNA, 140 bp, Artificial Sequence
  Synthetic
caccgctgtcccaaaaggtcaacagggagtgatccactcccaaatcttctaacagcattaaggcggtaagcgcaagtgaatcatcttggctcttatcaaaggaggctatgtccgtttctacatatcagcagccagggcct

SEQ ID NO: 364043 - DNA, 140 bp, Artificial Sequence
  Synthetic
atacgccatgctgggtctccagccacgaaaagaaactgcaacgtcacacagatgagggaattacccactttggactcagcagtgttcaacgtggagtgttttaaaaaatttgcatgcaaccgtacttgggagtcggccat

SEQ ID NO: 364044 - DNA, 140 bp, Artificial Sequence
  Synthetic
atggccgactcccaagtacggttgcatgcaaattttttaaaacactccacgttgaacactgctgagtccaaagtgggtaattccctcatctgtgtgacgttgcagtttcttttcgtggctggagacccagcatggcgtat

SEQ ID NO: 364045 - DNA, 140 bp, Artificial Sequence
  Synthetic
aggccctggctgctgatatgtcctctggcaaatgtgacatgcagggtgcctaaagcaaggaaccccaccgtgacgtacggaaaaaaccaagtcatcatgctgctgtatcctgaccacccagaccttttgggacagcggtg

SEQ ID NO: 364046 - DNA, 140 bp, Artificial Sequence
  Synthetic
caccgctgtcccaaaaggtctgggtggtcaggatacagcagcatgatgacttggttttttccgtacgtcacggtggggttccttgctttaggcaccctgcatgtcacatttgccagaggacatatcagcagccagggcct

SEQ ID NO: 364047 - DNA, 140 bp, Artificial Sequence
  Synthetic
aggccctggctgctgatatgggctaagagcttggtccctatcctcgaaacagcggggataaaactaaatgataggcagtggtcccagataattcaagccttcaaagaagacaaagcatacgaccttttgggacagcggtg

SEQ ID NO: 364048 - DNA, 140 bp, Artificial Sequence
  Synthetic
caccgctgtcccaaaaggtcgtatgctttgtcttctttgaaggcttgaattatctgggaccactgcctatcatttagttttatccccgctgtttcgaggatagggaccaagctcttagcccatatcagcagccagggcct

SEQ ID NO: 364049 - DNA, 140 bp, Artificial Sequence
  Synthetic
atacgccatgctgggtctccgagactcttaccatgctgttgtaaaacgttgacttttttagccgtaatgagcgtcggtgcccacactgtgagcgcgtacgaacacgtaacagtgatcccgcgtacttgggagtcggccat

SEQ ID NO: 364050 - DNA, 140 bp, Artificial Sequence
  Synthetic
atggccgactcccaagtacgcgggatcactgttacgtgttcgtacgcgctcacagtgtgggcaccgacgctcattacggctaaaaaagtcaacgttttacaacagcatggtaagagtctcggagacccagcatggcgtat

SEQ ID NO: 364051 - DNA, 140 bp, Artificial Sequence
  Synthetic
atacgccatgctgggtctcctagtaacaaaatataaaaaatcaataaaaatcataaaatagaaaaccagaaacagaagtaggtaagaaggtatatgtgtcccctaagagacacaccatatcgtacttgggagtcggccat

SEQ ID NO: 364052 - DNA, 140 bp, Artificial Sequence
  Synthetic
atggccgactcccaagtacgatatggtgtgtctcttaggggacacatataccttcttacctacttctgtttctggttttctattttatgatttttattgattttttatattttgttactaggagacccagcatggcgtat

SEQ ID NO: 364053 - DNA, 140 bp, Artificial Sequence; identical to SEQ ID NO: 11131
  Synthetic

SEQ ID NO: 364054 - DNA, 140 bp, Artificial Sequence; identical to SEQ ID NO: 11132
  Synthetic

SEQ ID NO: 364055 - DNA, 140 bp, Artificial Sequence
  Synthetic
atacgccatgctgggtctccgttaccaggcaagacctggtgactagcggaaaaaaagaaaattgtcaggaaatcaccaccgacgtgatgagacagagaggtctagagatatctgcacgtacgtacttgggagtcggccat

SEQ ID NO: 364056 - DNA, 140 bp, Artificial Sequence
  Synthetic
atggccgactcccaagtacgtacgtgcagatatctctagacctctctgtctcatcacgtcggtggtgatttcctgacaattttctttttttccgctagtcaccaggtcttgcctggtaacggagacccagcatggcgtat

SEQ ID NO: 364057 - DNA, 140 bp, Artificial Sequence; identical to SEQ ID NO: 11787
  Synthetic

SEQ ID NO: 364058 - DNA, 140 bp, Artificial Sequence; identical to SEQ ID NO: 11788
  Synthetic

SEQ ID NO: 364059 - DNA, 140 bp, Artificial Sequence
  Synthetic
atacgccatgctgggtctccaacagacctgacggaaggtagacgaggcaaattgtctattatgagaaaaaaaaaaaagctagaaccgtgcgaccgtgtgctgttctcagtagggtcaacgcgtacttgggagtcggccat

SEQ ID NO: 364060 - DNA, 140 bp, Artificial Sequence
  Synthetic
atggccgactcccaagtacgcgttgaccctactgagaacagcacacggtcgcacggttctagcttttttttttttctcataatagacaatttgcctcgtctaccttccgtcaggtctgttggagacccagcatggcgtat

SEQ ID NO: 364061 - DNA, 140 bp, Artificial Sequence
  Synthetic
aggccctggctgctgatatggcaacaccagtgggaaccgcaaaaacagttatgtgcggtacgtatccagtaatccacgccgttggaccaaacttctctaattattcggagtctgaagggggaccttttgggacagcggtg

SEQ ID NO: 364062 - DNA, 140 bp, Artificial Sequence
  Synthetic
caccgctgtcccaaaaggtcccccttcagactccgaataattagagaagtttggtccaacggcgtggattactggatacgtaccgcacataactgtttttgcggttcccactggtgttgccatatcagcagccagggcct

SEQ ID NO: 364063 - DNA, 140 bp, Artificial Sequence; identical to SEQ ID NO: 7481
  Synthetic

SEQ ID NO: 364064 - DNA, 140 bp, Artificial Sequence; identical to SEQ ID NO: 7482
  Synthetic

SEQ ID NO: 364065 - DNA, 140 bp, Artificial Sequence
  Synthetic
  misc_feature (43)..(43): n is a, c, g, or t
atacgccatgctgggtctccatacaaaatcactaaaaattatnaaaaaaaaaaaaaaaaaaaaaaaaaaaaaaaaaaaaaaaaaaaaaaaaaaaacagaaaaatatataaataggtataccgtacttgggagtcggccat

SEQ ID NO: 364066 - DNA, 140 bp, Artificial Sequence
  Synthetic
  misc_feature (98)..(98): n is a, c, g, or t
atggccgactcccaagtacggtatacctatttatatatttttctgttttttttttttttttttttttttttttttttttttttttttttttttttttnataatttttagtgattttgtatggagacccagcatggcgtat

SEQ ID NO: 364067 - DNA, 140 bp, Artificial Sequence
  Synthetic
atacgccatgctgggtctccgagatatatactatgtggccaaagcaaacagaggccaacgagcaagtctgcctatatgccctgggggaaagtattgaatcgatcaggcagaaatgcccggcgtacttgggagtcggccat

SEQ ID NO: 364068 - DNA, 140 bp, Artificial Sequence
  Synthetic
atggccgactcccaagtacgccgggcatttctgcctgatcgattcaatactttcccccagggcatataggcagacttgctcgttggcctctgtttgctttggccacatagtatatatctcggagacccagcatggcgtat

SEQ ID NO: 364069 - DNA, 140 bp, Artificial Sequence
  Synthetic
aggccctggctgctgatatgtagacagggcaggtgggtatatattctcgtcggacaccggtccaggtcatttacaacagaagtcagtacgccagtcagtgctgccggtgaacaccctggagaccttttgggacagcggtg

SEQ ID NO: 364070 - DNA, 140 bp, Artificial Sequence
  Synthetic
caccgctgtcccaaaaggtctccagggtgttcaccggcagcactgactggcgtactgacttctgttgtaaatgacctggaccggtgtccgacgagaatatatacccacctgccctgtctacatatcagcagccagggcct

SEQ ID NO: 364071 - DNA, 140 bp, Artificial Sequence
  Synthetic
atacgccatgctgggtctccgaacaagtgaagacatgcacacacagcggacgagcaggaaggtacgcggtcgaagcatatgacggcagaatccttgtgccctcaggctatgcaatatcaccgtacttgggagtcggccat

SEQ ID NO: 364072 - DNA, 140 bp, Artificial Sequence
  Synthetic
atggccgactcccaagtacggtgatattgcatagcctgagggcacaaggattctgccgtcatatgcttcgaccgcgtaccttcctgctcgtccgctgtgtgtgcatgtcttcacttgttcggagacccagcatggcgtat

SEQ ID NO: 364073 - DNA, 140 bp, Artificial Sequence
  Synthetic
aggccctggctgctgatatggtgccatcgcgcgtaagtccaagggaatatagatcttccccggagtctgcacaggaagcgagtacaaccacgtcactgacgcatagccaattcgacctaagaccttttgggacagcggtg

SEQ ID NO: 364074 - DNA, 140 bp, Artificial Sequence
  Synthetic
caccgctgtcccaaaaggtcttaggtcgaattggctatgcgtcagtgacgtggttgtactcgcttcctgtgcagactccggggaagatctatattcccttggacttacgcgcgatggcaccatatcagcagccagggcct

SEQ ID NO: 364075 - DNA, 140 bp, Artificial Sequence; identical to SEQ ID NO: 6183
  Synthetic

SEQ ID NO: 364076 - DNA, 140 bp, Artificial Sequence; identical to SEQ ID NO: 6184
  Synthetic

SEQ ID NO: 364077 - DNA, 140 bp, Artificial Sequence
  Synthetic
aggccctggctgctgatatgccagccctagaaccagccctagacgacggggcgacacacacgttgccatccacaactggaaaccttgcggccgtgtctgactgggtaatgagcaccgtacgaccttttgggacagcggtg

SEQ ID NO: 364078 - DNA, 140 bp, Artificial Sequence
  Synthetic
caccgctgtcccaaaaggtcgtacggtgctcattacccagtcagacacggccgcaaggtttccagttgtggatggcaacgtgtgtgtcgccccgtcgtctagggctggttctagggctggcatatcagcagccagggcct

SEQ ID NO: 364079 - DNA, 140 bp, Artificial Sequence
  Synthetic
aggccctggctgctgatatgagccccatggtattggagatggagctacaatcagtcaccttggaaccaacattgtcacttgactacatcacgtgcgagtacaaaactgtcatcccctcccgaccttttgggacagcggtg

SEQ ID NO: 364080 - DNA, 140 bp, Artificial Sequence
  Synthetic
caccgctgtcccaaaaggtcgggaggggatgacagttttgtactcgcacgtgatgtagtcaagtgacaatgttggttccaaggtgactgattgtagctccatctccaataccatggggctcatatcagcagccagggcct

SEQ ID NO: 364081 - DNA, 140 bp, Artificial Sequence
  Synthetic
atacgccatgctgggtctcccaacgtctcttcaggcaccgccgagtaccgccacggaactgaatcatccgccgatctccttcggagcaccaagcgagacgttccccattacatttggggacgtacttgggagtcggccat

SEQ ID NO: 364082 - DNA, 140 bp, Artificial Sequence
  Synthetic
atggccgactcccaagtacgtccccaaatgtaatggggaacgtctcgcttggtgctccgaaggagatcggcggatgattcagttccgtggcggtactcggcggtgcctgaagagacgttgggagacccagcatggcgtat

SEQ ID NO: 364083 - DNA, 140 bp, Artificial Sequence
  Synthetic
aggccctggctgctgatatgactgcccaaccaacagaccacgtcgtgggagagtacctggtactttccccgcagaccgtactacgtagccagaagctcagcctgattcacgctttggcgggaccttttgggacagcggtg

SEQ ID NO: 364084 - DNA, 140 bp, Artificial Sequence
  Synthetic
caccgctgtcccaaaaggtcccgccaaagcgtgaatcaggctgagcttctggctacgtagtacggtctgcggggaaagtaccaggtactctcccacgacgtggtctgttggttgggcagtcatatcagcagccagggcct

SEQ ID NO: 364085 - DNA, 140 bp, Artificial Sequence
  Synthetic
aggccctggctgctgatatgcttcaacgaaggagaaatcgaaagcttgtcttctgagctgctaactttcggagacttcctacccggagaagtggatgacttgacagatagcgactggtccgaccttttgggacagcggtg

SEQ ID NO: 364086 - DNA, 140 bp, Artificial Sequence
  Synthetic
caccgctgtcccaaaaggtcggaccagtcgctatctgtcaagtcatccacttctccgggtaggaagtctccgaaagttagcagctcagaagacaagctttcgatttctccttcgttgaagcatatcagcagccagggcct

SEQ ID NO: 364087 - DNA, 140 bp, Artificial Sequence; identical to SEQ ID NO: 5021
  Synthetic

SEQ ID NO: 364088 - DNA, 140 bp, Artificial Sequence; identical to SEQ ID NO: 5022
  Synthetic

SEQ ID NO: 364089 - DNA, 140 bp, Artificial Sequence
  Synthetic
aggccctggctgctgatatgagactatacttaatgtcagagaccccaaaagtccctacttaccggaccacatatccggcgcctgtgtactcgcctccgatcaacgtccgactgtccaaccgaccttttgggacagcggtg

SEQ ID NO: 364090 - DNA, 140 bp, Artificial Sequence
  Synthetic
caccgctgtcccaaaaggtcggttggacagtcggacgttgatcggaggcgagtacacaggcgccggatatgtggtccggtaagtagggacttttggggtctctgacattaagtatagtctcatatcagcagccagggcct

SEQ ID NO: 364091 - DNA, 140 bp, Artificial Sequence
  Synthetic
aggccctggctgctgatatgatatccggcgcctgtgtactcgcctccgatcaacgtccgactgtccaaccccgagtccgcagtggcagcatgcaatgagttcctagctagaaactatccagaccttttgggacagcggtg

SEQ ID NO: 364092 - DNA, 140 bp, Artificial Sequence
  Synthetic
caccgctgtcccaaaaggtctggatagtttctagctaggaactcattgcatgctgccactgcggactcggggttggacagtcggacgttgatcggaggcgagtacacaggcgccggatatcatatcagcagccagggcct

SEQ ID NO: 364093 - DNA, 140 bp, Artificial Sequence
  Synthetic
aggccctggctgctgatatgaggctgtagattatacttaatgtcagagaccccaaaagtccctacctaccggaccacatatccggcgcctgtgtactcgcctccgattaacgtccgactggaccttttgggacagcggtg

SEQ ID NO: 364094 - DNA, 140 bp, Artificial Sequence
  Synthetic
caccgctgtcccaaaaggtccagtcggacgttaatcggaggcgagtacacaggcgccggatatgtggtccggtaggtagggacttttggggtctctgacattaagtataatctacagcctcatatcagcagccagggcct

SEQ ID NO: 364095 - DNA, 140 bp, Artificial Sequence
  Synthetic
aggccctggctgctgatatgagccacgaaaagaaactgcaacgtcacacagatgagggaattacccactttggactcagcagtattcaacgtggagtgtttcaaaaaattcgcatgcaacgaccttttgggacagcggtg

SEQ ID NO: 364096 - DNA, 140 bp, Artificial Sequence
  Synthetic
caccgctgtcccaaaaggtcgttgcatgcgaattttttgaaacactccacgttgaatactgctgagtccaaagtgggtaattccctcatctgtgtgacgttgcagtttcttttcgtggctcatatcagcagccagggcct

SEQ ID NO: 364097 - DNA, 140 bp, Artificial Sequence
  Synthetic
atacgccatgctgggtctcccaagaatactgggaagaatttgctgccagccctattaggataacaactgagaatttaacaacctatgttactaaactaaaagggccaaaagcagcagcgccgtacttgggagtcggccat

SEQ ID NO: 364098 - DNA, 140 bp, Artificial Sequence
  Synthetic
atggccgactcccaagtacggcgctgctgcttttggcccttttagtttagtaacataggttgttaaattctcagttgttatcctaatagggctggcagcaaattcttcccagtattcttgggagacccagcatggcgtat

SEQ ID NO: 364099 - DNA, 140 bp, Artificial Sequence; identical to SEQ ID NO: 4967
  Synthetic

SEQ ID NO: 364100 - DNA, 140 bp, Artificial Sequence; identical to SEQ ID NO: 4968
  Synthetic

SEQ ID NO: 364101 - DNA, 140 bp, Artificial Sequence
  Synthetic
aggccctggctgctgatatggagaggtctagaaatatctgcacgtacggttgattcgctgctcttgaatggatgcaatagaccagtcgacgtgttgtacgtagacgaggcgtttgcgtgcgaccttttgggacagcggtg

SEQ ID NO: 364102 - DNA, 140 bp, Artificial Sequence
  Synthetic
caccgctgtcccaaaaggtcgcacgcaaacgcctcgtctacgtacaacacgtcgactggtctattgcatccattcaagagcagcgaatcaaccgtacgtgcagatatttctagacctctccatatcagcagccagggcct

SEQ ID NO: 364103 - DNA, 140 bp, Artificial Sequence
  Synthetic
aggccctggctgctgatatggatcgtctagagcgttgaaaccaccatgtgtcaccagtaacactgagatgttttttctattcagcaattttgacaatggtagaaggaatttcacaactcagaccttttgggacagcggtg

SEQ ID NO: 364104 - DNA, 140 bp, Artificial Sequence
  Synthetic
caccgctgtcccaaaaggtctgagttgtgaaattccttctaccattgtcaaaattgctgaatagaaaaaacatctcagtgttactggtgacacatggtggtttcaacgctctagacgatccatatcagcagccagggcct

SEQ ID NO: 364105 - DNA, 140 bp, Artificial Sequence
  Synthetic
atacgccatgctgggtctccgtgcaacaccagtgggaaccgcaaaaacgatcatgtgcggtacgtatccagtaatccacgccgttggaccaaacttctccaattattcggagtctgaaggcgtacttgggagtcggccat

SEQ ID NO: 364106 - DNA, 140 bp, Artificial Sequence
  Synthetic
atggccgactcccaagtacgccttcagactccgaataattggagaagtttggtccaacggcgtggattactggatacgtaccgcacatgatcgtttttgcggttcccactggtgttgcacggagacccagcatggcgtat

SEQ ID NO: 364107 - DNA, 140 bp, Artificial Sequence
  Synthetic
atacgccatgctgggtctcccagagaggtctagaaatatctgcacgtacggttgattcgctgctcttgaatggatgcaatagaccagtcgacgtgttgtacgtagacgaggcgtttgcgtcgtacttgggagtcggccat

SEQ ID NO: 364108 - DNA, 140 bp, Artificial Sequence
  Synthetic
atggccgactcccaagtacgacgcaaacgcctcgtctacgtacaacacgtcgactggtctattgcatccattcaagagcagcgaatcaaccgtacgtgcagatatttctagacctctctgggagacccagcatggcgtat

SEQ ID NO: 364109 - DNA, 140 bp, Artificial Sequence
  Synthetic
aggccctggctgctgatatgggcagagctgtgtccggtcgtacaagaaacagcggagacgcgtgacacagcaatgtctcttcaggcaccaccgagtaccgccacggaaccgaatcatccggaccttttgggacagcggtg

SEQ ID NO: 364110 - DNA, 140 bp, Artificial Sequence
  Synthetic
caccgctgtcccaaaaggtccggatgattcggttccgtggcggtactcggtggtgcctgaagagacattgctgtgtcacgcgtctccgctgtttcttgtacgaccggacacagctctgcccatatcagcagccagggcct

SEQ ID NO: 364111 - DNA, 140 bp, Artificial Sequence
  Synthetic
atacgccatgctgggtctcccctattttgcagaagccgacagcaagtacctaaacactaatcaactacaatggagttcatcccaacccaaactttctacaataggaggtatcagcctcgacgtacttgggagtcggccat

SEQ ID NO: 364112 - DNA, 140 bp, Artificial Sequence
  Synthetic
atggccgactcccaagtacgtcgaggctgatacctcctattgtagaaagtttgggttgggatgaactccattgtagttgattagtgtttaggtacttgctgtcggcttctgcaaaataggggagacccagcatggcgtat

SEQ ID NO: 364113 - DNA, 140 bp, Artificial Sequence; identical to SEQ ID NO: 11863
  Synthetic

SEQ ID NO: 364114 - DNA, 140 bp, Artificial Sequence; identical to SEQ ID NO: 11864
  Synthetic

SEQ ID NO: 364115 - DNA, 140 bp, Artificial Sequence; identical to SEQ ID NO: 9359
  Synthetic

SEQ ID NO: 364116 - DNA, 140 bp, Artificial Sequence; identical to SEQ ID NO: 9360
  Synthetic

SEQ ID NO: 364117 - DNA, 140 bp, Artificial Sequence
  Synthetic
atacgccatgctgggtctcctgttctccccaccgtcagcgacgcagtaccaaggacaacttcaatgtctataaagccacaagaccgtacttagctcactgtcccgactgtggagaagggccgtacttgggagtcggccat

SEQ ID NO: 364118 - DNA, 140 bp, Artificial Sequence
  Synthetic
atggccgactcccaagtacggcccttctccacagtcgggacagtgagctaagtacggtcttgtggctttatagacattgaagttgtccttggtactgcgtcgctgacggtggggagaacaggagacccagcatggcgtat

SEQ ID NO: 364119 - DNA, 140 bp, Artificial Sequence
  Synthetic
atacgccatgctgggtctcctatattctcgtcggacactggtccaggccatttacaacagaagtcggtacgccagtcagtgctgccggtaaacaccctggaggaagtccacgaggagaagcgtacttgggagtcggccat

SEQ ID NO: 364120 - DNA, 140 bp, Artificial Sequence
  Synthetic
atggccgactcccaagtacgcttctcctcgtggacttcctccagggtgtttaccggcagcactgactggcgtaccgacttctgttgtaaatggcctggaccagtgtccgacgagaatataggagacccagcatggcgtat

SEQ ID NO: 364121 - DNA, 140 bp, Artificial Sequence
  Synthetic
atacgccatgctgggtctccaggatgtaccaatggataggttcacagtagatatgaaaagggacgtgaaggtaactcctggtacaaagcatacagaggaaaggcctaaggtgcaggttatcgtacttgggagtcggccat

SEQ ID NO: 364122 - DNA, 140 bp, Artificial Sequence
  Synthetic
atggccgactcccaagtacgataacctgcaccttaggcctttcctctgtatgctttgtaccaggagttaccttcacgtcccttttcatatctactgtgaacctatccattggtacatcctggagacccagcatggcgtat

SEQ ID NO: 364123 - DNA, 140 bp, Artificial Sequence; identical to SEQ ID NO: 11901
  Synthetic

SEQ ID NO: 364124 - DNA, 140 bp, Artificial Sequence; identical to SEQ ID NO: 11902
  Synthetic

SEQ ID NO: 364125 - DNA, 140 bp, Artificial Sequence
  Synthetic
aggccctggctgctgatatgtggtgctatgcgtgtcgttcagcaggcactgactcgacaactaagtatgaaggtatacgtgtcccctaagagacacactgtatatagccaataatctatagaccttttgggacagcggtg

SEQ ID NO: 364126 - DNA, 140 bp, Artificial Sequence
  Synthetic
caccgctgtcccaaaaggtctatagattattggctatatacagtgtgtctcttaggggacacgtataccttcatacttagttgtcgagtcagtgcctgctgaacgacacgcatagcaccacatatcagcagccagggcct

SEQ ID NO: 364127 - DNA, 140 bp, Artificial Sequence
  Synthetic
aggccctggctgctgatatgaatggccagacggtgcggtacaagtgtaattgcggtggctcaaatgaaggactaataactacagacaaagtgattaataactgcaaggttgatcaatgtcgaccttttgggacagcggtg

SEQ ID NO: 364128 - DNA, 140 bp, Artificial Sequence
  Synthetic
caccgctgtcccaaaaggtcgacattgatcaaccttgcagttattaatcactttgtctgtagttattagtccttcatttgagccaccgcaattacacttgtaccgcaccgtctggccattcatatcagcagccagggcct

SEQ ID NO: 364129 - DNA, 140 bp, Artificial Sequence
  Synthetic
atacgccatgctgggtctccgagctgtacccaactatgactgtggtagttgtgtcagtggcctcgttcatactcctgtcgatggtgggtgtggcagtggggatgtgcatgtgtgcacgaccgtacttgggagtcggccat

SEQ ID NO: 364130 - DNA, 140 bp, Artificial Sequence
  Synthetic
atggccgactcccaagtacggtcgtgcacacatgcacatccccactgccacacccaccatcgacaggagtatgaacgaggccactgacacaactaccacagtcatagttgggtacagctcggagacccagcatggcgtat

SEQ ID NO: 364131 - DNA, 140 bp, Artificial Sequence
  Synthetic
atacgccatgctgggtctcctgacgaagtgatcagatggcaacgaacagggctaattgatgagctggagaaagcggtatactctaggtatgaagtgcagggtatatcagttgtggtaatgcgtacttgggagtcggccat

SEQ ID NO: 364132 - DNA, 140 bp, Artificial Sequence
  Synthetic
atggccgactcccaagtacgcattaccacaactgatataccctgcacttcatacctagagtataccgctttctccagctcatcaattagccctgttcgttgccatctgatcacttcgtcaggagacccagcatggcgtat

SEQ ID NO: 364133 - DNA, 140 bp, Artificial Sequence
  Synthetic
aggccctggctgctgatatggctgaacaacccctgaatagtaacaaaatataaaaatcaacaaaaatcataaaatagaaaaccagaaacagaagtaggtaagaaggtatatgtgtcccctgaccttttgggacagcggtg

SEQ ID NO: 364134 - DNA, 140 bp, Artificial Sequence
  Synthetic
caccgctgtcccaaaaggtcaggggacacatataccttcttacctacttctgtttctggttttctattttatgatttttgttgatttttatattttgttactattcaggggttgttcagccatatcagcagccagggcct

SEQ ID NO: 364135 - DNA, 140 bp, Artificial Sequence
  Synthetic
aggccctggctgctgatatggcacattgatgtcacaacagtccggcaatgtaaagatcacagtcaatagtcagacggtgcggtacaagtgtaattgcggtgactcaaatgaaggattaacgaccttttgggacagcggtg

SEQ ID NO: 364136 - DNA, 140 bp, Artificial Sequence
  Synthetic
caccgctgtcccaaaaggtcgttaatccttcatttgagtcaccgcaattacacttgtaccgcaccgtctgactattgactgtgatctttacattgccggactgttgtgacatcaatgtgccatatcagcagccagggcct

SEQ ID NO: 364137 - DNA, 140 bp, Artificial Sequence
  Synthetic
atacgccatgctgggtctccacagccccatggtattggagatggaactactgtcagtcactttggagccaacactatcgcttgattacatcacgtgcgagtacaaaaccgtcatcccgtccgtacttgggagtcggccat

SEQ ID NO: 364138 - DNA, 140 bp, Artificial Sequence
  Synthetic
atggccgactcccaagtacggacgggatgacggttttgtactcgcacgtgatgtaatcaagcgatagtgttggctccaaagtgactgacagtagttccatctccaataccatggggctgtggagacccagcatggcgtat

SEQ ID NO: 364139 - DNA, 140 bp, Artificial Sequence
  Synthetic
aggccctggctgctgatatgaatcataaaatagaaaaaccataaacagaagtagttcaaagggctataaaacccctgaatagtaacaaaacataaaattaataaaaatcaaatgaataccgaccttttgggacagcggtg

SEQ ID NO: 364140 - DNA, 140 bp, Artificial Sequence
  Synthetic
caccgctgtcccaaaaggtcggtattcatttgatttttattaattttatgttttgttactattcaggggttttatagccctttgaactacttctgtttatggtttttctattttatgattcatatcagcagccagggcct

SEQ ID NO: 364141 - DNA, 140 bp, Artificial Sequence
  Synthetic
aggccctggctgctgatatggagacacacgtagcctaccagtttcttactgctctactctgcaaagcaagagattaataacccatcatggatcctgtgtacgtggacatagacgctgacagaccttttgggacagcggtg

SEQ ID NO: 364142 - DNA, 140 bp, Artificial Sequence
  Synthetic
caccgctgtcccaaaaggtctgtcagcgtctatgtccacgtacacaggatccatgatgggttattaatctcttgctttgcagagtagagcagtaagaaactggtaggctacgtgtgtctccatatcagcagccagggcct

SEQ ID NO: 364143 - DNA, 140 bp, Artificial Sequence
  Synthetic
aggccctggctgctgatatgcggtgcggtataagtgtaattgcggtggctcaaatgaaggactaacaactacagacaaagtgattaataactgcaaggttgatcaatgtcatgccgcggtgaccttttgggacagcggtg

SEQ ID NO: 364144 - DNA, 140 bp, Artificial Sequence
  Synthetic
caccgctgtcccaaaaggtcaccgcggcatgacattgatcaaccttgcagttattaatcactttgtctgtagttgttagtccttcatttgagccaccgcaattacacttataccgcaccgcatatcagcagccagggcct

SEQ ID NO: 364145 - DNA, 140 bp, Artificial Sequence
  Synthetic
aggccctggctgctgatatgaacacggtgggagtaccgtataagactctagtcaacagaccgggctacagtcccatggtattggagatggaactactgtcagtcactttggagccaacgcgaccttttgggacagcggtg

SEQ ID NO: 364146 - DNA, 140 bp, Artificial Sequence
  Synthetic
caccgctgtcccaaaaggtcgcgttggctccaaagtgactgacagtagttccatctccaataccatgggactgtagcccggtctgttgactagagtcttatacggtactcccaccgtgttcatatcagcagccagggcct

SEQ ID NO: 364147 - DNA, 140 bp, Artificial Sequence; identical to SEQ ID NO: 9417
  Synthetic

SEQ ID NO: 364148 - DNA, 140 bp, Artificial Sequence; identical to SEQ ID NO: 9418
  Synthetic

SEQ ID NO: 364149 - DNA, 140 bp, Artificial Sequence; identical to SEQ ID NO: 10539
  Synthetic

SEQ ID NO: 364150 - DNA, 140 bp, Artificial Sequence; identical to SEQ ID NO: 10540
  Synthetic

SEQ ID NO: 364151 - DNA, 140 bp, Artificial Sequence
  Synthetic
aggccctggctgctgatatgagcataccgaactcttccacgattctccgaacccacagggacgtaggagatgttattttgtttttaatatttcaaaaaaaaaaaaaaaaaaaaaaaaaaagaccttttgggacagcggtg

SEQ ID NO: 364152 - DNA, 140 bp, Artificial Sequence
  Synthetic
caccgctgtcccaaaaggtctttttttttttttttttttttttttttgaaatattaaaaacaaaataacatctcctacgtccctgtgggttcggagaatcgtggaagagttcggtatgctcatatcagcagccagggcct

SEQ ID NO: 364153 - DNA, 140 bp, Artificial Sequence
  Synthetic
aggccctggctgctgatatggtaggcgtagcacaccgaactcttccataattctccgaacccacagggacgtaggagatgttcaaagattataaaaccctgaacagtaataaaatataaagaccttttgggacagcggtg

SEQ ID NO: 364154 - DNA, 140 bp, Artificial Sequence
  Synthetic
caccgctgtcccaaaaggtctttatattttattactgttcagggttttataatctttgaacatctcctacgtccctgtgggttcggagaattatggaagagttcggtgtgctacgcctaccatatcagcagccagggcct

SEQ ID NO: 364155 - DNA, 140 bp, Artificial Sequence
  Synthetic
aggccctggctgctgatatgcaaaattgtggtgtacaaaggtgacgtctataacatggactacccgccctttggcgcaggaagaccaggacaatttggcgatatccaaagtcgcacacctgaccttttgggacagcggtg

SEQ ID NO: 364156 - DNA, 140 bp, Artificial Sequence
  Synthetic
caccgctgtcccaaaaggtcaggtgtgcgactttggatatcgccaaattgtcctggtcttcctgcgccaaagggcgggtagtccatgttatagacgtcacctttgtacaccacaattttgcatatcagcagccagggcct

SEQ ID NO: 364157 - DNA, 140 bp, Artificial Sequence
  Synthetic
aggccctggctgctgatatgccgcgtaatgctgaactcggggaccgaaaaggaaaaattcacatcccgtttccgctggcaaatgtaacatgcagggtgcctaaagcaaggaaccccaccggaccttttgggacagcggtg

SEQ ID NO: 364158 - DNA, 140 bp, Artificial Sequence
  Synthetic
caccgctgtcccaaaaggtccggtggggttccttgctttaggcaccctgcatgttacatttgccagcggaaacgggatgtgaatttttccttttcggtccccgagttcagcattacgcggcatatcagcagccagggcct

SEQ ID NO: 364159 - DNA, 140 bp, Artificial Sequence
  Synthetic
aggccctggctgctgatatggagagtaaagacgtctatgctaatacacaactggtactgcagagaccggctgcgggtacggtacatgtgccatactctcaggcaccatctggctttaagtgaccttttgggacagcggtg

SEQ ID NO: 364160 - DNA, 140 bp, Artificial Sequence
  Synthetic
caccgctgtcccaaaaggtcacttaaagccagatggtgcctgagagtatggcacatgtaccgtacccgcagccggtctctgcagtaccagttgtgtattagcatagacgtctttactctccatatcagcagccagggcct

SEQ ID NO: 364161 - DNA, 140 bp, Artificial Sequence
  Synthetic
atacgccatgctgggtctcctcagaaatgaagcgacagacgggacgctgaaaatccaggtctccttgcaaattggaatagggacggatgatagccatgattggaccaagctgcgttacatcgtacttgggagtcggccat

SEQ ID NO: 364162 - DNA, 140 bp, Artificial Sequence
  Synthetic
atggccgactcccaagtacgatgtaacgcagcttggtccaatcatggctatcatccgtccctattccaatttgcaaggagacctggattttcagcgtcccgtctgtcgcttcatttctgaggagacccagcatggcgtat

SEQ ID NO: 364163 - DNA, 140 bp, Artificial Sequence; identical to SEQ ID NO: 5777
  Synthetic

SEQ ID NO: 364164 - DNA, 140 bp, Artificial Sequence; identical to SEQ ID NO: 5778
  Synthetic

SEQ ID NO: 364165 - DNA, 140 bp, Artificial Sequence
  Synthetic
aggccctggctgctgatatgtccacaaacggtacagcccacggccacccgcatgagataattttgtattactatgagctgtaccctactacgactgtagtagttgtgtcagtggcctcgtgaccttttgggacagcggtg

SEQ ID NO: 364166 - DNA, 140 bp, Artificial Sequence
  Synthetic
caccgctgtcccaaaaggtcacgaggccactgacacaactactacagtcgtagtagggtacagctcatagtaatacaaaattatctcatgcgggtggccgtgggctgtaccgtttgtggacatatcagcagccagggcct

SEQ ID NO: 364167 - DNA, 140 bp, Artificial Sequence; identical to SEQ ID NO: 7085
  Synthetic

SEQ ID NO: 364168 - DNA, 140 bp, Artificial Sequence; identical to SEQ ID NO: 7086
  Synthetic

SEQ ID NO: 364169 - DNA, 140 bp, Artificial Sequence; identical to SEQ ID NO: 9537
  Synthetic

SEQ ID NO: 364170 - DNA, 140 bp, Artificial Sequence; identical to SEQ ID NO: 9538
  Synthetic

SEQ ID NO: 364171 - DNA, 140 bp, Artificial Sequence
  Synthetic
aggccctggctgctgatatggagagtaaagacgtctatgctaatacacaactggtactgcagagaccggctgcgggtacggtacacgtgccatactctcaggcaccatctggctttaagtgaccttttgggacagcggtg

SEQ ID NO: 364172 - DNA, 140 bp, Artificial Sequence
  Synthetic
caccgctgtcccaaaaggtcacttaaagccagatggtgcctgagagtatggcacgtgtaccgtacccgcagccggtctctgcagtaccagttgtgtattagcatagacgtctttactctccatatcagcagccagggcct

SEQ ID NO: 364173 - DNA, 140 bp, Artificial Sequence
  Synthetic
aggccctggctgctgatatgttgacggtgaggtactgcccgctccgtctgacctggaagctgatgctccgattccggagccaacaccagacgacagagcggtacttactttgcctcccacgaccttttgggacagcggtg

SEQ ID NO: 364174 - DNA, 140 bp, Artificial Sequence
  Synthetic
caccgctgtcccaaaaggtcgtgggaggcaaagtaagtaccgctctgtcgtctggtgttggctccggaatcggagcatcagcttccaggtcagacggagcgggcagtacctcaccgtcaacatatcagcagccagggcct

SEQ ID NO: 364175 - DNA, 140 bp, Artificial Sequence
  Synthetic
aggccctggctgctgatatgattggctaaaagaacgcggggcgtcactgcagcacacagcaccatttggctgccaaatagcaacaaacccggtaagagcggtgaactgcgccgtagggaagaccttttgggacagcggtg

SEQ ID NO: 364176 - DNA, 140 bp, Artificial Sequence
  Synthetic
caccgctgtcccaaaaggtcttccctacggcgcagttcaccgctcttaccgggtttgttgctatttggcagccaaatggtgctgtgtgctgcagtgacgccccgcgttcttttagccaatcatatcagcagccagggcct

SEQ ID NO: 364177 - DNA, 140 bp, Artificial Sequence
  Synthetic
atacgccatgctgggtctccacgtgtcccctaagagacacattgtatgtaggtgataagtatagatcaaaggggccgaataacccctgaatagtaacaaaatatgaaaatcaataaaaatcgtacttgggagtcggccat

SEQ ID NO: 364178 - DNA, 140 bp, Artificial Sequence
  Synthetic
atggccgactcccaagtacgatttttattgattttcatattttgttactattcaggggttattcggcccctttgatctatacttatcacctacatacaatgtgtctcttaggggacacgtggagacccagcatggcgtat

SEQ ID NO: 364179 - DNA, 140 bp, Artificial Sequence
  Synthetic
aggccctggctgctgatatgcctgaatagtaacaaaacataaaactaataaaaatcaaatgaataccataattggcaaacggaagagatgtaggtacttaagcttcctaaaagcagccgagaccttttgggacagcggtg

SEQ ID NO: 364180 - DNA, 140 bp, Artificial Sequence
  Synthetic
caccgctgtcccaaaaggtctcggctgcttttaggaagcttaagtacctacatctcttccgtttgccaattatggtattcatttgatttttattagttttatgttttgttactattcaggcatatcagcagccagggcct

SEQ ID NO: 364181 - DNA, 140 bp, Artificial Sequence; identical to SEQ ID NO: 10567
  Synthetic

SEQ ID NO: 364182 - DNA, 140 bp, Artificial Sequence; identical to SEQ ID NO: 10568
  Synthetic

SEQ ID NO: 364183 - DNA, 140 bp, Artificial Sequence; identical to SEQ ID NO: 9253
  Synthetic

SEQ ID NO: 364184 - DNA, 140 bp, Artificial Sequence; identical to SEQ ID NO: 9254
  Synthetic

SEQ ID NO: 364185 - DNA, 140 bp, Artificial Sequence
  Synthetic
aggccctggctgctgatatgctgtcctaccggaatatgggagaagaaccaaactatcaagaagagtgggtgatgcataagaaggaagtcgtgctaaccgtgccgactgaagggctcgagggaccttttgggacagcggtg

SEQ ID NO: 364186 - DNA, 140 bp, Artificial Sequence
  Synthetic
caccgctgtcccaaaaggtccctcgagcccttcagtcggcacggttagcacgacttccttcttatgcatcacccactcttcttgatagtttggttcttctcccatattccggtaggacagcatatcagcagccagggcct

SEQ ID NO: 364187 - DNA, 140 bp, Artificial Sequence; identical to SEQ ID NO: 9043
  Synthetic

SEQ ID NO: 364188 - DNA, 140 bp, Artificial Sequence; identical to SEQ ID NO: 9044
  Synthetic

SEQ ID NO: 364189 - DNA, 140 bp, Artificial Sequence
  Synthetic
aggccctggctgctgatatgatggctgcgtgagacacacgtagcctaccagtttcttactgctctactctgcttagcaagagacttgagaacccatcatggatcccgtgtacgtggacatgaccttttgggacagcggtg

SEQ ID NO: 364190 - DNA, 140 bp, Artificial Sequence
  Synthetic
caccgctgtcccaaaaggtcatgtccacgtacacgggatccatgatgggttctcaagtctcttgctaagcagagtagagcagtaagaaactggtaggctacgtgtgtctcacgcagccatcatatcagcagccagggcct

SEQ ID NO: 364191 - DNA, 140 bp, Artificial Sequence
  Synthetic
aggccctggctgctgatatgagattaataacccatcatggattctgtgtacgtggacatagacgctgacagcgcctttttgaaggccctgcaacgtgcgtaccccatgtttgaggtggaagaccttttgggacagcggtg

SEQ ID NO: 364192 - DNA, 140 bp, Artificial Sequence
  Synthetic
caccgctgtcccaaaaggtcttccacctcaaacatggggtacgcacgttgcagggccttcaaaaaggcgctgtcagcgtctatgtccacgtacacagaatccatgatgggttattaatctcatatcagcagccagggcct

SEQ ID NO: 364193 - DNA, 140 bp, Artificial Sequence
  Synthetic
atacgccatgctgggtctcctgaagacttccagagtctaagcgaaagcgcaacgatggtgtataacgaaagagagttcgtaaacagaaagctacaccacattgcgatgcacggaccagcccgtacttgggagtcggccat

SEQ ID NO: 364194 - DNA, 140 bp, Artificial Sequence
  Synthetic
atggccgactcccaagtacgggctggtccgtgcatcgcaatgtggtgtagctttctgtttacgaactctctttcgttatacaccatcgttgcgctttcgcttagactctggaagtcttcaggagacccagcatggcgtat

SEQ ID NO: 364195 - DNA, 140 bp, Artificial Sequence; identical to SEQ ID NO: 7501
  Synthetic

SEQ ID NO: 364196 - DNA, 140 bp, Artificial Sequence; identical to SEQ ID NO: 7502
  Synthetic

SEQ ID NO: 364197 - DNA, 140 bp, Artificial Sequence; identical to SEQ ID NO: 7215
  Synthetic

SEQ ID NO: 364198 - DNA, 140 bp, Artificial Sequence; identical to SEQ ID NO: 7216
  Synthetic

SEQ ID NO: 364199 - DNA, 140 bp, Artificial Sequence
  Synthetic
atacgccatgctgggtctccgatcgtctagagcattgaaaccaccatgtatcaccagtaatactgagatgttcttcctatttagcaattttgacaatggcagaaggaattttacaacgcacgtacttgggagtcggccat

SEQ ID NO: 364200 - DNA, 140 bp, Artificial Sequence
  Synthetic
atggccgactcccaagtacgtgcgttgtaaaattccttctgccattgtcaaaattgctaaataggaagaacatctcagtattactggtgatacatggtggtttcaatgctctagacgatcggagacccagcatggcgtat

SEQ ID NO: 364201 - DNA, 140 bp, Artificial Sequence
  Synthetic
aggccctggctgctgatatgtctagacagcgggctattttctaaaccgttggtgtctgtgtattacgcggataaccactgggataataggcctggagggaagacgttcggatttaaccccgaccttttgggacagcggtg

SEQ ID NO: 364202 - DNA, 140 bp, Artificial Sequence
  Synthetic
caccgctgtcccaaaaggtcggggttaaatccgaacgtcttccctccaggcctattatcccagtggttatccgcgtaatacacagacaccaacggtttagaaaatagcccgctgtctagacatatcagcagccagggcct

SEQ ID NO: 364203 - DNA, 140 bp, Artificial Sequence
  Synthetic
aggccctggctgctgatatggcagaccgtactacgtagccagaagctcagcctaattcacgctttggcggagcaagtgaagacgtgcacgcacagcggacgagcagggaggtatgcggtcgaccttttgggacagcggtg

SEQ ID NO: 364204 - DNA, 140 bp, Artificial Sequence
  Synthetic
caccgctgtcccaaaaggtcgaccgcatacctccctgctcgtccgctgtgcgtgcacgtcttcacttgctccgccaaagcgtgaattaggctgagcttctggctacgtagtacggtctgccatatcagcagccagggcct

SEQ ID NO: 364205 - DNA, 140 bp, Artificial Sequence
  Synthetic
aggccctggctgctgatatgccggacctgcagggcccgagctccagatccaacttcgagaagctcagaggacccgtcataactttgtacggcggtcctaaataggtacgcactacagctagaccttttgggacagcggtg

SEQ ID NO: 364206 - DNA, 140 bp, Artificial Sequence
  Synthetic
caccgctgtcccaaaaggtctagctgtagtgcgtacctatttaggaccgccgtacaaagttatgacgggtcctctgagcttctcgaagttggatctggagctcgggccctgcaggtccggcatatcagcagccagggcct

SEQ ID NO: 364207 - DNA, 140 bp, Artificial Sequence
  Synthetic
atacgccatgctgggtctccaggactggtactggtgggcgacttgactaatccgccctaccacgaattcgcatatgaagggctaaaaatccgccctgcctgcccatacaaaactgcagtccgtacttgggagtcggccat

SEQ ID NO: 364208 - DNA, 140 bp, Artificial Sequence
  Synthetic
atggccgactcccaagtacggactgcagttttgtatgggcaggcagggcggatttttagcccttcatatgcgaattcgtggtagggcggattagtcaagtcgcccaccagtaccagtcctggagacccagcatggcgtat

SEQ ID NO: 364209 - DNA, 140 bp, Artificial Sequence; identical to SEQ ID NO: 9317
  Synthetic

SEQ ID NO: 364210 - DNA, 140 bp, Artificial Sequence; identical to SEQ ID NO: 9318
  Synthetic

SEQ ID NO: 364211 - DNA, 140 bp, Artificial Sequence
  Synthetic
atacgccatgctgggtctccccataattggcaatcggaagagatgtaggtacttaagcttcctaaaagcagccgaactcgctttgagatgtaggcatagcacaccgaactcttccacgatcgtacttgggagtcggccat

SEQ ID NO: 364212 - DNA, 140 bp, Artificial Sequence
  Synthetic
atggccgactcccaagtacgatcgtggaagagttcggtgtgctatgcctacatctcaaagcgagttcggctgcttttaggaagcttaagtacctacatctcttccgattgccaattatggggagacccagcatggcgtat

SEQ ID NO: 364213 - DNA, 140 bp, Artificial Sequence; identical to SEQ ID NO: 5667
  Synthetic

SEQ ID NO: 364214 - DNA, 140 bp, Artificial Sequence; identical to SEQ ID NO: 5668
  Synthetic

SEQ ID NO: 364215 - DNA, 140 bp, Artificial Sequence
  Synthetic
aggccctggctgctgatatggaagcagccccctaaaaagaaaccggttcaaaagaaaaagaagccgggccgtagagagagaatgtgcatgaaaatcgaaaatgattgcatcttcgaagtcgaccttttgggacagcggtg

SEQ ID NO: 364216 - DNA, 140 bp, Artificial Sequence
  Synthetic
caccgctgtcccaaaaggtcgacttcgaagatgcaatcattttcgattttcatgcacattctctctctacggcccggcttctttttcttttgaaccggtttctttttagggggctgcttccatatcagcagccagggcct

SEQ ID NO: 364217 - DNA, 140 bp, Artificial Sequence
  Synthetic
aggccctggctgctgatatgtcagacctggatgctgacgccccagccctagaaccagcactagacgacggggcgacacacacgctgccatccacaaccggaaaccttgcggccgtgtctggaccttttgggacagcggtg

SEQ ID NO: 364218 - DNA, 140 bp, Artificial Sequence
  Synthetic
caccgctgtcccaaaaggtccagacacggccgcaaggtttccggttgtggatggcagcgtgtgtgtcgccccgtcgtctagtgctggttctagggctggggcgtcagcatccaggtctgacatatcagcagccagggcct

SEQ ID NO: 364219 - DNA, 140 bp, Artificial Sequence
  Synthetic
aggccctggctgctgatatgccgatctccttcggagcaccaagcgagacgttccccattacatttggggacttcaacgaaggagaaatcgaaagcttgtcttctgagctactaactttcggaccttttgggacagcggtg

SEQ ID NO: 364220 - DNA, 140 bp, Artificial Sequence
  Synthetic
caccgctgtcccaaaaggtccgaaagttagtagctcagaagacaagctttcgatttctccttcgttgaagtccccaaatgtaatggggaacgtctcgcttggtgctccgaaggagatcggcatatcagcagccagggcct

SEQ ID NO: 364221 - DNA, 140 bp, Artificial Sequence
  Synthetic
aggccctggctgctgatatgcgaagcggcgtccatactggagaggaaatacccgtttacaaaagggaagtggaataccaacaagcaaatctgtgtgactactaggaggattgaagattttgaccttttgggacagcggtg

SEQ ID NO: 364222 - DNA, 140 bp, Artificial Sequence
  Synthetic
caccgctgtcccaaaaggtcaaaatcttcaatcctcctagtagtcacacagatttgcttgttggtattccacttcccttttgtaaacgggtatttcctctccagtatggacgccgcttcgcatatcagcagccagggcct

SEQ ID NO: 364223 - DNA, 140 bp, Artificial Sequence
  Synthetic
aggccctggctgctgatatgtctcaaagaaacacgtgccgcttacgcccacagtgttctcttgagtgttagcaaaatggaaaacaaaatcgaggtgaataacaaagatgagatgaacaaggaccttttgggacagcggtg

SEQ ID NO: 364224 - DNA, 140 bp, Artificial Sequence
  Synthetic
caccgctgtcccaaaaggtccttgttcatctcatctttgttattcacctcgattttgttttccattttgctaacactcaagagaacactgtgggcgtaagcggcacgtgtttctttgagacatatcagcagccagggcct

SEQ ID NO: 364225 - DNA, 140 bp, Artificial Sequence
  Synthetic
aggccctggctgctgatatgttcatcaagaacttatgtaggcaggtagaaatacctgccggcagcattaagaagatcttaaatgttctcagatacaagttgtgtagcaaaggaggtgtaggaccttttgggacagcggtg

SEQ ID NO: 364226 - DNA, 140 bp, Artificial Sequence
  Synthetic
caccgctgtcccaaaaggtcctacacctcctttgctacacaacttgtatctgagaacatttaagatcttcttaatgctgccggcaggtatttctacctgcctacataagttcttgatgaacatatcagcagccagggcct

SEQ ID NO: 364227 - DNA, 140 bp, Artificial Sequence
  Synthetic
atacgccatgctgggtctccagttgggaaggaaatgacacagtcaagtttttggttacaacctatataagcaaagggcttatggcattaaacagttacaaccatatgggtcaaggtattccgtacttgggagtcggccat

SEQ ID NO: 364228 - DNA, 140 bp, Artificial Sequence
  Synthetic
atggccgactcccaagtacggaataccttgacccatatggttgtaactgtttaatgccataagccctttgcttatataggttgtaaccaaaaacttgactgtgtcatttccttcccaactggagacccagcatggcgtat

SEQ ID NO: 364229 - DNA, 140 bp, Artificial Sequence
  Synthetic
aggccctggctgctgatatgcaaagggcttatggcattaaacagttacaaccatatgggtcaaggtattcatcatgcaacttcttcagtgttaacatctttagctgccgtactctttgaggaccttttgggacagcggtg

SEQ ID NO: 364230 - DNA, 140 bp, Artificial Sequence
  Synthetic
caccgctgtcccaaaaggtcctcaaagagtacggcagctaaagatgttaacactgaagaagttgcatgatgaataccttgacccatatggttgtaactgtttaatgccataagccctttgcatatcagcagccagggcct

SEQ ID NO: 364231 - DNA, 140 bp, Artificial Sequence
  Synthetic
atacgccatgctgggtctcctgttgagcatgccggtagttctgatgattacgcaaagtgcatagtggtaactggcatactgtcaaaagagctttactcccagtatgatgaaacgttttggcgtacttgggagtcggccat

SEQ ID NO: 364232 - DNA, 140 bp, Artificial Sequence
  Synthetic
atggccgactcccaagtacgccaaaacgtttcatcatactgggagtaaagctcttttgacagtatgccagttaccactatgcactttgcgtaatcatcagaactaccggcatgctcaacaggagacccagcatggcgtat

SEQ ID NO: 364233 - DNA, 140 bp, Artificial Sequence
  Synthetic
aggccctggctgctgatatgctggcatactgtcaaaagagctttactcccagtatgatgaaacgttttggaagcatgcttgtagacttaagaacttcacagctgctgtacagagatgttggaccttttgggacagcggtg

SEQ ID NO: 364234 - DNA, 140 bp, Artificial Sequence
  Synthetic
caccgctgtcccaaaaggtccaacatctctgtacagcagctgtgaagttcttaagtctacaagcatgcttccaaaacgtttcatcatactgggagtaaagctcttttgacagtatgccagcatatcagcagccagggcct

SEQ ID NO: 364235 - DNA, 140 bp, Artificial Sequence
  Synthetic
atacgccatgctgggtctcctttatagtgaatttatgatgggctacagagtgaccccagctgtgattaagttcatgttcactggactgataaatagctctgtaacctcacctcagagtttcgtacttgggagtcggccat

SEQ ID NO: 364236 - DNA, 140 bp, Artificial Sequence
  Synthetic
atggccgactcccaagtacgaaactctgaggtgaggttacagagctatttatcagtccagtgaacatgaacttaatcacagctggggtcactctgtagcccatcataaattcactataaaggagacccagcatggcgtat

SEQ ID NO: 364237 - DNA, 140 bp, Artificial Sequence
  Synthetic
aggccctggctgctgatatgcagaggtggtgatgagaatccacgtggccctgtgagccgtgagcatgtggactggtgcagggagtttgtcaaaggcaaatacatcatggccttcaacccagaccttttgggacagcggtg

SEQ ID NO: 364238 - DNA, 140 bp, Artificial Sequence
  Synthetic
caccgctgtcccaaaaggtctgggttgaaggccatgatgtatttgcctttgacaaactccctgcaccagtccacatgctcacggctcacagggccacgtggattctcatcaccacctctgcatatcagcagccagggcct

SEQ ID NO: 364239 - DNA, 140 bp, Artificial Sequence
  Synthetic
atacgccatgctgggtctccaatcacgttgaagactttattagaaggtatggtatattaactcttgggaccttatctccctttggcagactgtttgtaccaacctactcagggttagttacgtacttgggagtcggccat

SEQ ID NO: 364240 - DNA, 140 bp, Artificial Sequence
  Synthetic
atggccgactcccaagtacgtaactaaccctgagtaggttggtacaaacagtctgccaaagggagataaggtcccaagagttaatataccataccttctaataaagtcttcaacgtgattggagacccagcatggcgtat

SEQ ID NO: 364241 - DNA, 140 bp, Artificial Sequence
  Synthetic
aggccctggctgctgatatgcttatctccctttggcagactgtttgtaccaacctactcagggttagttagttcagcagttgctctagaagatgctgaagtcattgctagagcagctcaggaccttttgggacagcggtg

SEQ ID NO: 364242 - DNA, 140 bp, Artificial Sequence
  Synthetic
caccgctgtcccaaaaggtcctgagctgctctagcaatgacttcagcatcttctagagcaactgctgaactaactaaccctgagtaggttggtacaaacagtctgccaaagggagataagcatatcagcagccagggcct

SEQ ID NO: 364243 - DNA, 140 bp, Artificial Sequence
  Synthetic
atacgccatgctgggtctccagacagcttgggtcgcagtaggacaagttccacagttgaagacagcagcagtgtaagcgacaccactgttgcttctcatgattcaggatcttcatcctcacgtacttgggagtcggccat

SEQ ID NO: 364244 - DNA, 140 bp, Artificial Sequence
  Synthetic
atggccgactcccaagtacgtgaggatgaagatcctgaatcatgagaagcaacagtggtgtcgcttacactgctgctgtcttcaactgtggaacttgtcctactgcgacccaagctgtctggagacccagcatggcgtat

SEQ ID NO: 364245 - DNA, 140 bp, Artificial Sequence
  Synthetic
atacgccatgctgggtctccaaagctggcgtgaccccagaaaccttcccgacggtgtcacagttcctctttgagctaggaaagcagccaagaggtactaagaaaatgaagaaggctctgccgtacttgggagtcggccat

SEQ ID NO: 364246 - DNA, 140 bp, Artificial Sequence
  Synthetic
atggccgactcccaagtacggcagagccttcttcattttcttagtacctcttggctgctttcctagctcaaagaggaactgtgacaccgtcgggaaggtttctggggtcacgccagctttggagacccagcatggcgtat

SEQ ID NO: 364247 - DNA, 140 bp, Artificial Sequence
  Synthetic
atacgccatgctgggtctccgattctttccagcagaacaggatctacatgcaccctgccgtgcttacagctggcagaatcagtgaaatgggagtctgctttgggacaatccccgtggccacgtacttgggagtcggccat

SEQ ID NO: 364248 - DNA, 140 bp, Artificial Sequence
  Synthetic
atggccgactcccaagtacgtggccacggggattgtcccaaagcagactcccatttcactgattctgccagctgtaagcacggcagggtgcatgtagatcctgttctgctggaaagaatcggagacccagcatggcgtat

SEQ ID NO: 364249 - DNA, 140 bp, Artificial Sequence
  Synthetic
aggccctggctgctgatatgaggcacaatgttatttacagtagcagaatggcagattcttgtgattggctgagagatggtaagagaagagggaatctagaactggcaaatagaatccagtgaccttttgggacagcggtg

SEQ ID NO: 364250 - DNA, 140 bp, Artificial Sequence
  Synthetic
caccgctgtcccaaaaggtcactggattctatttgccagttctagattccctcttctcttaccatctctcagccaatcacaagaatctgccattctgctactgtaaataacattgtgcctcatatcagcagccagggcct

SEQ ID NO: 364251 - DNA, 140 bp, Artificial Sequence
  Synthetic
aggccctggctgctgatatgagttagaaaggttaggcgtgtctagaatggaggtcgatgagttgatgcctagtatcaacccagatgatactcttgcacagcttgtggcaaaaaagcttatgaccttttgggacagcggtg

SEQ ID NO: 364252 - DNA, 140 bp, Artificial Sequence
  Synthetic
caccgctgtcccaaaaggtcataagcttttttgccacaagctgtgcaagagtatcatctgggttgatactaggcatcaactcatcgacctccattctagacacgcctaacctttctaactcatatcagcagccagggcct

SEQ ID NO: 364253 - DNA, 140 bp, Artificial Sequence
  Synthetic
atacgccatgctgggtctccctccggactaacaccgagaccaacaatccatgtgccaggaccattgtcaagctgtttgaaattcagaaaacagggttcaacattcaggacatggacatagcgtacttgggagtcggccat

SEQ ID NO: 364254 - DNA, 140 bp, Artificial Sequence
  Synthetic
atggccgactcccaagtacgctatgtccatgtcctgaatgttgaaccctgttttctgaatttcaaacagcttgacaatggtcctggcacatggattgttggtctcggtgttagtccggagggagacccagcatggcgtat

SEQ ID NO: 364255 - DNA, 140 bp, Artificial Sequence
  Synthetic
atacgccatgctgggtctccggaactgagaaacaggtaaaagcatcattgaatagagacgacaacaaaatcattgaggatcctatgatacagctaattccagaaaaactgaggagagagtcgtacttgggagtcggccat

SEQ ID NO: 364256 - DNA, 140 bp, Artificial Sequence
  Synthetic
atggccgactcccaagtacgactctctcctcagtttttctggaattagctgtatcataggatcctcaatgattttgttgtcgtctctattcaatgatgcttttacctgtttctcagttccggagacccagcatggcgtat

SEQ ID NO: 364257 - DNA, 140 bp, Artificial Sequence
  Synthetic
atacgccatgctgggtctcctggcctctgagcacttgctacaccagtctcttgttggcaagcaatctccattccagaacgcctacaacgtcaagggcaatgccaccagtgccaacattatcgtacttgggagtcggccat

SEQ ID NO: 364258 - DNA, 140 bp, Artificial Sequence
  Synthetic
atggccgactcccaagtacgataatgttggcactggtggcattgcccttgacgttgtaggcgttctggaatggagattgcttgccaacaagagactggtgtagcaagtgctcagaggccaggagacccagcatggcgtat

SEQ ID NO: 364259 - DNA, 140 bp, Artificial Sequence
  Synthetic
atacgccatgctgggtctcccctcaatgtttcgacagaagaatactcagctgaagtatctaggctcaaacaaacactaacagcccgaaatgttctgcatgggctggctggaggaataaaacgtacttgggagtcggccat

SEQ ID NO: 364260 - DNA, 140 bp, Artificial Sequence
  Synthetic
atggccgactcccaagtacgttttattcctccagccagcccatgcagaacatttcgggctgttagtgtttgtttgagcctagatacttcagctgagtattcttctgtcgaaacattgaggggagacccagcatggcgtat

SEQ ID NO: 364261 - DNA, 140 bp, Artificial Sequence
  Synthetic
aggccctggctgctgatatgaaacactaacagcccgaaatgttctgcatgggctggctggaggaataaaagagctttcgcttccaatatacacgatattcatgaaatcatacttcttcaagaccttttgggacagcggtg

SEQ ID NO: 364262 - DNA, 140 bp, Artificial Sequence
  Synthetic
caccgctgtcccaaaaggtcttgaagaagtatgatttcatgaatatcgtgtatattggaagcgaaagctcttttattcctccagccagcccatgcagaacatttcgggctgttagtgtttcatatcagcagccagggcct

SEQ ID NO: 364263 - DNA, 140 bp, Artificial Sequence
  Synthetic
atacgccatgctgggtctccctcaaagaaatacttgcggcacgtcagtacgtaagtgttaactttgagtgtgtgacctgagcatcttagatgcagcatgcccttcaacatcatgtacacacgtacttgggagtcggccat

SEQ ID NO: 364264 - DNA, 140 bp, Artificial Sequence
  Synthetic
atggccgactcccaagtacgtgtgtacatgatgttgaagggcatgctgcatctaagatgctcaggtcacacactcaaagttaacacttacgtactgacgtgccgcaagtatttctttgagggagacccagcatggcgtat

SEQ ID NO: 364265 - DNA, 140 bp, Artificial Sequence
  Synthetic
atacgccatgctgggtctccccactattgtgtgctattctttgtttgcagctgtggagcttagaaggaatttatggattgtccaacaaaacccaacacaatgacactagtaccataaaggcgtacttgggagtcggccat

SEQ ID NO: 364266 - DNA, 140 bp, Artificial Sequence
  Synthetic
atggccgactcccaagtacgcctttatggtactagtgtcattgtgttgggttttgttggacaatccataaattccttctaagctccacagctgcaaacaaagaatagcacacaatagtggggagacccagcatggcgtat

SEQ ID NO: 364267 - DNA, 140 bp, Artificial Sequence
  Synthetic
aggccctggctgctgatatgaagtatactcattggttggacacttttctcagctgttctgtatccattaacaggcataccactgtcaaagagccttccctgtttaatccaaatatcaggtgaccttttgggacagcggtg

SEQ ID NO: 364268 - DNA, 140 bp, Artificial Sequence
  Synthetic
caccgctgtcccaaaaggtcacctgatatttggattaaacagggaaggctctttgacagtggtatgcctgttaatggatacagaacagctgagaaaagtgtccaaccaatgagtatacttcatatcagcagccagggcct

SEQ ID NO: 364269 - DNA, 140 bp, Artificial Sequence
  Synthetic
atacgccatgctgggtctccatcacgtcagacccctcctccgccacatccacagcattagccagtggaccagaaggctcaggggacacgagcacctctccatcagtcaccacacaaggcccgtacttgggagtcggccat

SEQ ID NO: 364270 - DNA, 140 bp, Artificial Sequence
  Synthetic
atggccgactcccaagtacgggccttgtgtggtgactgatggagaggtgctcgtgtcccctgagccttctggtccactggctaatgctgtggatgtggcggaggaggggtctgacgtgatggagacccagcatggcgtat

SEQ ID NO: 364271 - DNA, 140 bp, Artificial Sequence
  Synthetic
atacgccatgctgggtctcccagagtcacctcaaagtctttgagaatgaatttactaacttaaaccttcagttttctgatccgaacagacagaaacttagaatagttgagtctagacctgcgtacttgggagtcggccat

SEQ ID NO: 364272 - DNA, 140 bp, Artificial Sequence
  Synthetic
atggccgactcccaagtacgcaggtctagactcaactattctaagtttctgtctgttcggatcagaaaactgaaggtttaagttagtaaattcattctcaaagactttgaggtgactctgggagacccagcatggcgtat

SEQ ID NO: 364273 - DNA, 140 bp, Artificial Sequence
  Synthetic
aggccctggctgctgatatggttttctgatccgaacagacagaaacttagaatagttgagtctagacctgcagaatctgagctggaggccaatcgtgcagtgatagtcaagaccaagttagaccttttgggacagcggtg

SEQ ID NO: 364274 - DNA, 140 bp, Artificial Sequence
  Synthetic
caccgctgtcccaaaaggtctaacttggtcttgactatcactgcacgattggcctccagctcagattctgcaggtctagactcaactattctaagtttctgtctgttcggatcagaaaaccatatcagcagccagggcct

SEQ ID NO: 364275 - DNA, 140 bp, Artificial Sequence
  Synthetic
atacgccatgctgggtctccgggctacctattggatgaatcagcaatttctgaagtcaaacctaccaaggttgacttttcgaatctgctcaaagaccgctttaaaataatgcaattcttccgtacttgggagtcggccat

SEQ ID NO: 364276 - DNA, 140 bp, Artificial Sequence
  Synthetic
atggccgactcccaagtacggaagaattgcattattttaaagcggtctttgagcagattcgaaaagtcaaccttggtaggtttgacttcagaaattgctgattcatccaataggtagcccggagacccagcatggcgtat

SEQ ID NO: 364277 - DNA, 140 bp, Artificial Sequence
  Synthetic
aggccctggctgctgatatgttgacttttcgaatctgctcaaagaccgctttaaaataatgcaattcttcccctctgtgtttactttgatcaaaatgctagcagatgaatcaacagattcgaccttttgggacagcggtg

SEQ ID NO: 364278 - DNA, 140 bp, Artificial Sequence
  Synthetic
caccgctgtcccaaaaggtcgaatctgttgattcatctgctagcattttgatcaaagtaaacacagaggggaagaattgcattattttaaagcggtctttgagcagattcgaaaagtcaacatatcagcagccagggcct

SEQ ID NO: 364279 - DNA, 140 bp, Artificial Sequence
  Synthetic
atacgccatgctgggtctccaccatttgactttgcttagcagaatgatacaacaagcaaagccaaccgtaactgttttctacatgctaaagggcaacttgatgaatacagagccgacagtcgtacttgggagtcggccat

SEQ ID NO: 364280 - DNA, 140 bp, Artificial Sequence
  Synthetic
atggccgactcccaagtacgactgtcggctctgtattcatcaagttgccctttagcatgtagaaaacagttacggttggctttgcttgttgtatcattctgctaagcaaagtcaaatggtggagacccagcatggcgtat

SEQ ID NO: 364281 - DNA, 140 bp, Artificial Sequence
  Synthetic
aggccctggctgctgatatgactgttttctacatgctaaagggcaacttgatgaatacagagccgacagttgctgagcttgtcagttacggtataaaggaaggtaggttttataggctttgaccttttgggacagcggtg

SEQ ID NO: 364282 - DNA, 140 bp, Artificial Sequence
  Synthetic
caccgctgtcccaaaaggtcaaagcctataaaacctaccttcctttataccgtaactgacaagctcagcaactgtcggctctgtattcatcaagttgccctttagcatgtagaaaacagtcatatcagcagccagggcct

SEQ ID NO: 364283 - DNA, 140 bp, Artificial Sequence
  Synthetic
atacgccatgctgggtctcctacaccccagcccaacaaacagatctaaaagaaatcttgaaatggaaataattttgactttatctcaaggtttgaagaagtactacggcaaggtactaaacgtacttgggagtcggccat

SEQ ID NO: 364284 - DNA, 140 bp, Artificial Sequence
  Synthetic
atggccgactcccaagtacgtttagtaccttgccgtagtacttcttcaaaccttgagataaagtcaaaattatttccatttcaagatttcttttagatctgtttgttgggctggggtgtaggagacccagcatggcgtat

SEQ ID NO: 364285 - DNA, 140 bp, Artificial Sequence
  Synthetic
atacgccatgctgggtctccacttctggatcttactttagaagaagacactgaaggcctgttagagtggtgtaagagaaaccttggtctgacctgcgatgacaacttctttcagaagagacgtacttgggagtcggccat

SEQ ID NO: 364286 - DNA, 140 bp, Artificial Sequence
  Synthetic
atggccgactcccaagtacgtctcttctgaaagaagttgtcatcgcaggtcagaccaaggtttctcttacaccactctaacaggccttcagtgtcttcttctaaagtaagatccagaagtggagacccagcatggcgtat

SEQ ID NO: 364287 - DNA, 140 bp, Artificial Sequence
  Synthetic
aggccctggctgctgatatggtcttcactgcttatgagtttcctaaattggagggtgaacatggacattagagcttctgactgtccattgtctagccatgaagcaagtatactaagtgaagaccttttgggacagcggtg

SEQ ID NO: 364288 - DNA, 140 bp, Artificial Sequence
  Synthetic
caccgctgtcccaaaaggtcttcacttagtatacttgcttcatggctagacaatggacagtcagaagctctaatgtccatgttcaccctccaatttaggaaactcataagcagtgaagaccatatcagcagccagggcct

SEQ ID NO: 364289 - DNA, 140 bp, Artificial Sequence
  Synthetic
aggccctggctgctgatatgcaccgacagtagaaccctttaaatcttactttgctaaaggcttcctctcaatggactcaggttacttctccgccaagtgttacccaaagtcatccaattcgaccttttgggacagcggtg

SEQ ID NO: 364290 - DNA, 140 bp, Artificial Sequence
  Synthetic
caccgctgtcccaaaaggtcgaattggatgactttgggtaacacttggcggagaagtaacctgagtccattgagaggaagcctttagcaaagtaagatttaaagggttctactgtcggtgcatatcagcagccagggcct

SEQ ID NO: 364291 - DNA, 140 bp, Artificial Sequence
  Synthetic
aggccctggctgctgatatgactctcccacagaactgttgaagaagaagccttacttagggacaacctgcaagttcaacacttggggagactcaaacaggtctgggaagttcacatacaggaccttttgggacagcggtg

SEQ ID NO: 364292 - DNA, 140 bp, Artificial Sequence
  Synthetic
caccgctgtcccaaaaggtcctgtatgtgaacttcccagacctgtttgagtctccccaagtgttgaacttgcaggttgtccctaagtaaggcttcttcttcaacagttctgtgggagagtcatatcagcagccagggcct

SEQ ID NO: 364293 - DNA, 140 bp, Artificial Sequence
  Synthetic
aggccctggctgctgatatgaaggcattagtcttcaaagagcatagggagattgaaatcaatgttctcctccctcaagtcgcggtcaatctctcaaactgccatgtgctgatcaaatctcgaccttttgggacagcggtg

SEQ ID NO: 364294 - DNA, 140 bp, Artificial Sequence
  Synthetic
caccgctgtcccaaaaggtcgagatttgatcagcacatggcagtttgagagattgaccgcgacttgagggaggagaacattgatttcaatctccctatgctctttgaagactaatgccttcatatcagcagccagggcct

SEQ ID NO: 364295 - DNA, 140 bp, Artificial Sequence
  Synthetic
aggccctggctgctgatatggtgctctcttggatgagcaaaaggagaactgaggtaataactaaagaacagcaccagttgttcctaagccaccttccccagtctcatgaatgcttacaaagaccttttgggacagcggtg

SEQ ID NO: 364296 - DNA, 140 bp, Artificial Sequence
  Synthetic
caccgctgtcccaaaaggtctttgtaagcattcatgagactggggaaggtggcttaggaacaactggtgctgttctttagttattacctcagttctccttttgctcatccaagagagcaccatatcagcagccagggcct

SEQ ID NO: 364297 - DNA, 140 bp, Artificial Sequence
  Synthetic
atacgccatgctgggtctcccgactactcaaatttgtgcctctcaagaaaggcctggcagtggttaaaatcaaaaagcaaattttgacagttaagaagcaagttgtgtttgatgcagagacgtacttgggagtcggccat

SEQ ID NO: 364298 - DNA, 140 bp, Artificial Sequence
  Synthetic
atggccgactcccaagtacgtctctgcatcaaacacaacttgcttcttaactgtcaaaatttgctttttgattttaaccactgccaggcctttcttgagaggcacaaatttgagtagtcgggagacccagcatggcgtat

SEQ ID NO: 364299 - DNA, 140 bp, Artificial Sequence
  Synthetic
aggccctggctgctgatatgtaaaaggaagggaaattcgcaaaggccagtcagtgttaaggcaatacagaacagaaattaagattggcaaagcatcttctggttctagaagactattgtcgaccttttgggacagcggtg

SEQ ID NO: 364300 - DNA, 140 bp, Artificial Sequence
  Synthetic
caccgctgtcccaaaaggtcgacaatagtcttctagaaccagaagatgctttgccaatcttaatttctgttctgtattgccttaacactgactggcctttgcgaatttcccttccttttacatatcagcagccagggcct

SEQ ID NO: 364301 - DNA, 140 bp, Artificial Sequence
  Synthetic
atacgccatgctgggtctccgaaactgacactcagactacataccacgagaatctgttaaaggtgaagcagcttgttgactgctctacagacagaaagaagcttttacctcagtcagtgtcgtacttgggagtcggccat

SEQ ID NO: 364302 - DNA, 140 bp, Artificial Sequence
  Synthetic
atggccgactcccaagtacgacactgactgaggtaaaagcttctttctgtctgtagagcagtcaacaagctgcttcacctttaacagattctcgtggtatgtagtctgagtgtcagtttcggagacccagcatggcgtat

SEQ ID NO: 364303 - DNA, 140 bp, Artificial Sequence
  Synthetic
atacgccatgctgggtctccaaaatgcggaaattcacagtgacaactatggtggtccaggtgacaagataactatctgcaacggttcaactattgtagatcagagactgggcagtgaactcgtacttgggagtcggccat

SEQ ID NO: 364304 - DNA, 140 bp, Artificial Sequence
  Synthetic
atggccgactcccaagtacgagttcactgcccagtctctgatctacaatagttgaaccgttgcagatagttatcttgtcacctggaccaccatagttgtcactgtgaatttccgcattttggagacccagcatggcgtat

SEQ ID NO: 364305 - DNA, 140 bp, Artificial Sequence
  Synthetic
atacgccatgctgggtctccctccttaactcattaacactgctccactgtttcctgaaacatgctcctagcgatgctataatggaagtagaaagtaaaagtagcttactacacaagttcccgtacttgggagtcggccat

SEQ ID NO: 364306 - DNA, 140 bp, Artificial Sequence
  Synthetic
atggccgactcccaagtacgggaacttgtgtagtaagctacttttactttctacttccattatagcatcgctaggagcatgtttcaggaaacagtggagcagtgttaatgagttaaggagggagacccagcatggcgtat

SEQ ID NO: 364307 - DNA, 140 bp, Artificial Sequence
  Synthetic
atacgccatgctgggtctccgtgctacaggtaaatcttgtgaaatagatagcaccccagtcagatgtaggcagggtttttgcttgaaaattactcaggagggaaggggccacgtgaagctcgtacttgggagtcggccat

SEQ ID NO: 364308 - DNA, 140 bp, Artificial Sequence
  Synthetic
atggccgactcccaagtacgagcttcacgtggccccttccctcctgagtaattttcaagcaaaaaccctgcctacatctgactggggtgctatctatttcacaagatttacctgtagcacggagacccagcatggcgtat

SEQ ID NO: 364309 - DNA, 140 bp, Artificial Sequence
  Synthetic
atacgccatgctgggtctcctaatgataccaaagggcactggggacatcctagttgactgttcaggtgggcagcaacatttcctaaaagataacctggttgatctaggatgccccaacatcgtacttgggagtcggccat

SEQ ID NO: 364310 - DNA, 140 bp, Artificial Sequence
  Synthetic
atggccgactcccaagtacgatgttggggcatcctagatcaaccaggttatcttttaggaaatgttgctgcccacctgaacagtcaactaggatgtccccagtgccctttggtatcattaggagacccagcatggcgtat

SEQ ID NO: 364311 - DNA, 140 bp, Artificial Sequence
  Synthetic
aggccctggctgctgatatgtgcctctcagctgttggtctgaagttcaaaattatattgaagatataggcttcaacaatgtgcttgtcaacattgacagaaacacagtgaagagtgaactgaccttttgggacagcggtg

SEQ ID NO: 364312 - DNA, 140 bp, Artificial Sequence
  Synthetic
caccgctgtcccaaaaggtcagttcactcttcactgtgtttctgtcaatgttgacaagcacattgttgaagcctatatcttcaatataattttgaacttcagaccaacagctgagaggcacatatcagcagccagggcct

SEQ ID NO: 364313 - DNA, 140 bp, Artificial Sequence
  Synthetic
atacgccatgctgggtctccccaagacaactatgggtttccttttttggtttagctttggttatgtgataacctgtatactttgtaaagtaatcttctatctattaatagttgtagggaccgtacttgggagtcggccat

SEQ ID NO: 364314 - DNA, 140 bp, Artificial Sequence
  Synthetic
atggccgactcccaagtacggtccctacaactattaatagatagaagattactttacaaagtatacaggttatcacataaccaaagctaaaccaaaaaaggaaacccatagttgtcttggggagacccagcatggcgtat

SEQ ID NO: 364315 - DNA, 140 bp, Artificial Sequence
  Synthetic
atacgccatgctgggtctccaagatgtgaggactcttgtatcttatgtcagcactgaaaccatacctaagtttctgcttgcatttctcctttatgaggaggtgttaatgaacttaatcagcgtacttgggagtcggccat

SEQ ID NO: 364316 - DNA, 140 bp, Artificial Sequence
  Synthetic
atggccgactcccaagtacgctgattaagttcattaacacctcctcataaaggagaaatgcaagcagaaacttaggtatggtttcagtgctgacataagatacaagagtcctcacatcttggagacccagcatggcgtat

SEQ ID NO: 364317 - DNA, 140 bp, Artificial Sequence
  Synthetic
aggccctggctgctgatatgtttctgcttgcatttctcctttatgaggaggtgttaatgaacttaatcagccagtgcaaggcagtgaaggaactcatcaacagcacaggactctcagactgaccttttgggacagcggtg

SEQ ID NO: 364318 - DNA, 140 bp, Artificial Sequence
  Synthetic
caccgctgtcccaaaaggtcagtctgagagtcctgtgctgttgatgagttccttcactgccttgcactggctgattaagttcattaacacctcctcataaaggagaaatgcaagcagaaacatatcagcagccagggcct

SEQ ID NO: 364319 - DNA, 140 bp, Artificial Sequence
  Synthetic
atacgccatgctgggtctcctgcagtaagagagatgggcctagatgttccttcgcagcactgttaagcctagttcatgaggattggcaaaagataggaaaaaatatccttgttcgtgcaacgtacttgggagtcggccat

SEQ ID NO: 364320 - DNA, 140 bp, Artificial Sequence
  Synthetic
atggccgactcccaagtacgttgcacgaacaaggatattttttcctatcttttgccaatcctcatgaactaggcttaacagtgctgcgaaggaacatctaggcccatctctcttactgcaggagacccagcatggcgtat

SEQ ID NO: 364321 - DNA, 140 bp, Artificial Sequence
  Synthetic
aggccctggctgctgatatgtagaagaaaccgaattatatttaaacttagaaagaatcccctgggttgttaggaaattactgcaggtgtcagaatccaccggtgtagcactaaagaggaggaccttttgggacagcggtg

SEQ ID NO: 364322 - DNA, 140 bp, Artificial Sequence
  Synthetic
caccgctgtcccaaaaggtcctcctctttagtgctacaccggtggattctgacacctgcagtaatttcctaacaacccaggggattctttctaagtttaaatataattcggtttcttctacatatcagcagccagggcct

SEQ ID NO: 364323 - DNA, 140 bp, Artificial Sequence
  Synthetic
atacgccatgctgggtctccaggaaattactgcaggtgtcagaatccaccggtgtagcactaaagaggagtagttggctggttatactacttgtgctactcacagtttcattgtcaccagcgtacttgggagtcggccat

SEQ ID NO: 364324 - DNA, 140 bp, Artificial Sequence
  Synthetic
atggccgactcccaagtacgctggtgacaatgaaactgtgagtagcacaagtagtataaccagccaactactcctctttagtgctacaccggtggattctgacacctgcagtaatttcctggagacccagcatggcgtat

SEQ ID NO: 364325 - DNA, 140 bp, Artificial Sequence
  Synthetic
atacgccatgctgggtctccgtcactaaatcatgctctgtccttaatgtttttagacgagatgtcattacctgagctaaaatccttatctgtgaattgcaaaatggggagccttgaagggcgtacttgggagtcggccat

SEQ ID NO: 364326 - DNA, 140 bp, Artificial Sequence
  Synthetic
atggccgactcccaagtacgcccttcaaggctccccattttgcaattcacagataaggattttagctcaggtaatgacatctcgtctaaaaacattaaggacagagcatgatttagtgacggagacccagcatggcgtat

SEQ ID NO: 364327 - DNA, 140 bp, Artificial Sequence
  Synthetic
aggccctggctgctgatatgctgagctaaaatccttatctgtgaattgcaaaatggggagccttgaagggcaggagtgttttgagttcaccattctaaaggacagtagcacaagattagagaccttttgggacagcggtg

SEQ ID NO: 364328 - DNA, 140 bp, Artificial Sequence
  Synthetic
caccgctgtcccaaaaggtctctaatcttgtgctactgtcctttagaatggtgaactcaaaacactcctgcccttcaaggctccccattttgcaattcacagataaggattttagctcagcatatcagcagccagggcct

SEQ ID NO: 364329 - DNA, 140 bp, Artificial Sequence
  Synthetic
atacgccatgctgggtctcctttcccctggcttgtccatttgtaagacatgttctattggcagtataaacggctttgaaattgaatctcacaaatgttactgtagtctgttttgctgccccgtacttgggagtcggccat

SEQ ID NO: 364330 - DNA, 140 bp, Artificial Sequence
  Synthetic
atggccgactcccaagtacggggcagcaaaacagactacagtaacatttgtgagattcaatttcaaagccgtttatactgccaatagaacatgtcttacaaatggacaagccaggggaaaggagacccagcatggcgtat

SEQ ID NO: 364331 - DNA, 140 bp, Artificial Sequence
  Synthetic
atacgccatgctgggtctcccagttagagcagtagaagatttgattctgatgttgacgggcaaggcagtcaaacctagtaatgtgacacaaattgcacgcgaagatgagcagtgccaagacgtacttgggagtcggccat

SEQ ID NO: 364332 - DNA, 140 bp, Artificial Sequence
  Synthetic
atggccgactcccaagtacgtcttggcactgctcatcttcgcgtgcaatttgtgtcacattactaggtttgactgccttgcccgtcaacatcagaatcaaatcttctactgctctaactgggagacccagcatggcgtat

SEQ ID NO: 364333 - DNA, 140 bp, Artificial Sequence
  Synthetic
aggccctggctgctgatatgaaacctagtaatgtgacacaaattgcacgcgaagatgagcagtgccaagagcaaataagcttagacgatctaatggcaagtgacacagtgatagacttgcgaccttttgggacagcggtg

SEQ ID NO: 364334 - DNA, 140 bp, Artificial Sequence
  Synthetic
caccgctgtcccaaaaggtcgcaagtctatcactgtgtcacttgccattagatcgtctaagcttatttgctcttggcactgctcatcttcgcgtgcaatttgtgtcacattactaggtttcatatcagcagccagggcct

SEQ ID NO: 364335 - DNA, 140 bp, Artificial Sequence
  Synthetic
atacgccatgctgggtctccgcatctgcaagaaaagaaaaactgggagtaatgtcatgttagccgtctgtaagcgcatgtgctttagggcaactgtggaagtaagcaataaagctttactcgtacttgggagtcggccat

SEQ ID NO: 364336 - DNA, 140 bp, Artificial Sequence
  Synthetic
atggccgactcccaagtacgagtaaagctttattgcttacttccacagttgccctaaagcacatgcgcttacagacggctaacatgacattactcccagtttttcttttcttgcagatgcggagacccagcatggcgtat

SEQ ID NO: 364337 - DNA, 140 bp, Artificial Sequence
  Synthetic
atacgccatgctgggtctccgattcagattgatcatgctctctgtatgagttattaatagctttcaatgtcttgaggacaagtaagactatttgcatcatgccatttgctgacattaaaacgtacttgggagtcggccat

SEQ ID NO: 364338 - DNA, 140 bp, Artificial Sequence
  Synthetic
atggccgactcccaagtacgttttaatgtcagcaaatggcatgatgcaaatagtcttacttgtcctcaagacattgaaagctattaataactcatacagagagcatgatcaatctgaatcggagacccagcatggcgtat

SEQ ID NO: 364339 - DNA, 140 bp, Artificial Sequence
  Synthetic
atacgccatgctgggtctcccagtttgtgttgtcagcacctctgcagtggagatggaaaacctgccagcaggcacttgggaaaaagaggaagacctgacaaatttctgtcatcaggaatgcgtacttgggagtcggccat

SEQ ID NO: 364340 - DNA, 140 bp, Artificial Sequence
  Synthetic
atggccgactcccaagtacgcattcctgatgacagaaatttgtcaggtcttcctctttttcccaagtgcctgctggcaggttttccatctccactgcagaggtgctgacaacacaaactgggagacccagcatggcgtat

SEQ ID NO: 364341 - DNA, 140 bp, Artificial Sequence
  Synthetic
atacgccatgctgggtctcctcaatgcaacctttttaattcttctactattccgccgttcttccctctctatcattcatttcagtttcactatttccagggtgtggggggaacgaatttccgtacttgggagtcggccat

SEQ ID NO: 364342 - DNA, 140 bp, Artificial Sequence
  Synthetic
atggccgactcccaagtacggaaattcgttccccccacaccctggaaatagtgaaactgaaatgaatgatagagagggaagaacggcggaatagtagaagaattaaaaaggttgcattgaggagacccagcatggcgtat

SEQ ID NO: 364343 - DNA, 140 bp, Artificial Sequence
  Synthetic
atacgccatgctgggtctccggaaacccttgtttttggacagtattgttaaaggcaagaagaacttgctaaattcaacaagcctagaaacaagcttatcaattgaggcaccatggggggccgtacttgggagtcggccat

SEQ ID NO: 364344 - DNA, 140 bp, Artificial Sequence
  Synthetic
atggccgactcccaagtacggccccccatggtgcctcaattgataagcttgtttctaggcttgttgaatttagcaagttcttcttgcctttaacaatactgtccaaaaacaagggtttccggagacccagcatggcgtat

SEQ ID NO: 364345 - DNA, 140 bp, Artificial Sequence
  Synthetic
atacgccatgctgggtctcccgcttagttggagctcagtagaacatagaggcaataaaattttggtttcaggcagatcagagtcaatcatgaaattagaggaaaggacaggaattagctgcgtacttgggagtcggccat

SEQ ID NO: 364346 - DNA, 140 bp, Artificial Sequence
  Synthetic
atggccgactcccaagtacgcagctaattcctgtcctttcctctaatttcatgattgactctgatctgcctgaaaccaaaattttattgcctctatgttctactgagctccaactaagcgggagacccagcatggcgtat

SEQ ID NO: 364347 - DNA, 140 bp, Artificial Sequence
  Synthetic
atacgccatgctgggtctcccacgtaactcaatgtcccaaacggaaagagaaggtcgaagaaactgaactatacttaaacttggagagaataccttggttggtaagaaagctcctacaagcgtacttgggagtcggccat

SEQ ID NO: 364348 - DNA, 140 bp, Artificial Sequence
  Synthetic
atggccgactcccaagtacgcttgtaggagctttcttaccaaccaaggtattctctccaagtttaagtatagttcagtttcttcgaccttctctttccgtttgggacattgagttacgtgggagacccagcatggcgtat

SEQ ID NO: 364349 - DNA, 140 bp, Artificial Sequence
  Synthetic
atacgccatgctgggtctccttatggacttgtcacaaatgtattctcctgtctttgagtacctatcaggtgatagacaagtggaggaatggcccaaggcaacctgcacaggagattgccccgtacttgggagtcggccat

SEQ ID NO: 364350 - DNA, 140 bp, Artificial Sequence
  Synthetic
atggccgactcccaagtacggggcaatctcctgtgcaggttgccttgggccattcctccacttgtctatcacctgataggtactcaaagacaggagaatacatttgtgacaagtccataaggagacccagcatggcgtat

SEQ ID NO: 364351 - DNA, 140 bp, Artificial Sequence
  Synthetic
atacgccatgctgggtctccattcaagaaactggagatgcaaccctacttggtgttggggagtcggcactggatgcacctgttgtgggctggatgtgaaagacctctttacagattacatcgtacttgggagtcggccat

SEQ ID NO: 364352 - DNA, 140 bp, Artificial Sequence
  Synthetic
atggccgactcccaagtacgatgtaatctgtaaagaggtctttcacatccagcccacaacaggtgcatccagtgccgactccccaacaccaagtagggttgcatctccagtttcttgaatggagacccagcatggcgtat

SEQ ID NO: 364353 - DNA, 140 bp, Artificial Sequence
  Synthetic
aggccctggctgctgatatgggatgcacctgttgtgggctggatgtgaaagacctctttacagattacatgtttgtcaagtggaaagttgactacattaaaacagaagctatagtgtgtggaccttttgggacagcggtg

SEQ ID NO: 364354 - DNA, 140 bp, Artificial Sequence
  Synthetic
caccgctgtcccaaaaggtccacacactatagcttctgttttaatgtagtcaactttccacttgacaaacatgtaatctgtaaagaggtctttcacatccagcccacaacaggtgcatcccatatcagcagccagggcct

SEQ ID NO: 364355 - DNA, 140 bp, Artificial Sequence
  Synthetic
atacgccatgctgggtctccgtttgtcaagtggaaagttgactacattaaaacagaagctatagtgtgtgttgagcttactagccaggaaagacaatgtagcttaattgaggcaggcacacgtacttgggagtcggccat

SEQ ID NO: 364356 - DNA, 140 bp, Artificial Sequence
  Synthetic
atggccgactcccaagtacgtgtgcctgcctcaattaagctacattgtctttcctggctagtaagctcaacacacactatagcttctgttttaatgtagtcaactttccacttgacaaacggagacccagcatggcgtat

SEQ ID NO: 364357 - DNA, 140 bp, Artificial Sequence
  Synthetic
atacgccatgctgggtctcctcagcaaaagctccctccagaaatagtcacattgcatcctaggattgaagaaggcttctttgacttaatgcatatacaaaaagtgctatcagcaagtacacgtacttgggagtcggccat

SEQ ID NO: 364358 - DNA, 140 bp, Artificial Sequence
  Synthetic
atggccgactcccaagtacgtgtacttgctgatagcactttttgtatatgcattaagtcaaagaagccttcttcaatcctaggatgcaatgtgactatttctggagggagcttttgctgaggagacccagcatggcgtat

SEQ ID NO: 364359 - DNA, 140 bp, Artificial Sequence
  Synthetic
atacgccatgctgggtctccctaccacattggaaacttgttaaaaggagacaaggtgaacgggcacctgattcacaaaattgaaccacacttcaacacttcctggatgtcttgggacggccgtacttgggagtcggccat

SEQ ID NO: 364360 - DNA, 140 bp, Artificial Sequence
  Synthetic
atggccgactcccaagtacggccgtcccaagacatccaggaagtgttgaagtgtggttcaattttgtgaatcaggtgcccgttcaccttgtctccttttaacaagtttccaatgtggtagggagacccagcatggcgtat

SEQ ID NO: 364361 - DNA, 140 bp, Artificial Sequence
  Synthetic
aggccctggctgctgatatgttcacaaaattgaaccacacttcaacacttcctggatgtcttgggacggctgtgacctagactactactgtaatatgggggattggccatcttgctcatagaccttttgggacagcggtg

SEQ ID NO: 364362 - DNA, 140 bp, Artificial Sequence
  Synthetic
caccgctgtcccaaaaggtctatgagcaagatggccaatcccccatattacagtagtagtctaggtcacagccgtcccaagacatccaggaagtgttgaagtgtggttcaattttgtgaacatatcagcagccagggcct

SEQ ID NO: 364363 - DNA, 140 bp, Artificial Sequence
  Synthetic
aggccctggctgctgatatggcacatggagacacaccacaattagatttaaaagctagaccaacttatggtgcaggtgaaatcactgtgctggtagaggttgcagacatggagttgcatagaccttttgggacagcggtg

SEQ ID NO: 364364 - DNA, 140 bp, Artificial Sequence
  Synthetic
caccgctgtcccaaaaggtctatgcaactccatgtctgcaacctctaccagcacagtgatttcacctgcaccataagttggtctagcttttaaatctaattgtggtgtgtctccatgtgccatatcagcagccagggcct

SEQ ID NO: 364365 - DNA, 140 bp, Artificial Sequence
  Synthetic
aggccctggctgctgatatggtgtaagcgacaccactgttgcttctcatgattcaggatcttcatcctcaagcttctcttttgagctcaataggcctctgtctgaaactgaattacaattgaccttttgggacagcggtg

SEQ ID NO: 364366 - DNA, 140 bp, Artificial Sequence
  Synthetic
caccgctgtcccaaaaggtcaattgtaattcagtttcagacagaggcctattgagctcaaaagagaagcttgaggatgaagatcctgaatcatgagaagcaacagtggtgtcgcttacaccatatcagcagccagggcct

SEQ ID NO: 364367 - DNA, 140 bp, Artificial Sequence
  Synthetic
atacgccatgctgggtctccagattcaggttacttctctgccaaatgttatccaagatcatctacttcagggcttcagctgatcaatgttacccaacacccagctagaatagcagaaacacgtacttgggagtcggccat

SEQ ID NO: 364368 - DNA, 140 bp, Artificial Sequence
  Synthetic
atggccgactcccaagtacgtgtttctgctattctagctgggtgttgggtaacattgatcagctgaagccctgaagtagatgatcttggataacatttggcagagaagtaacctgaatctggagacccagcatggcgtat

SEQ ID NO: 364369 - DNA, 140 bp, Artificial Sequence
  Synthetic
atacgccatgctgggtctcctagttgctgctagttcaagtctcatggctaggaagcttgaatttgggacagatagcacatttaaagccttttcagccatgcccaaaacctccttgtgcttcgtacttgggagtcggccat

SEQ ID NO: 364370 - DNA, 140 bp, Artificial Sequence
  Synthetic
atggccgactcccaagtacgaagcacaaggaggttttgggcatggctgaaaaggctttaaatgtgctatctgtcccaaattcaagcttcctagccatgagacttgaactagcagcaactaggagacccagcatggcgtat

SEQ ID NO: 364371 - DNA, 140 bp, Artificial Sequence
  Synthetic
aggccctggctgctgatatggatagcacatttaaagccttttcagccatgcccaaaacctccttgtgcttttacattgtggagagggaatactgcaaaagctgtagtaaagaagacacacgaccttttgggacagcggtg

SEQ ID NO: 364372 - DNA, 140 bp, Artificial Sequence
  Synthetic
caccgctgtcccaaaaggtcgtgtgtcttctttactacagcttttgcagtattccctctccacaatgtaaaagcacaaggaggttttgggcatggctgaaaaggctttaaatgtgctatccatatcagcagccagggcct

SEQ ID NO: 364373 - DNA, 140 bp, Artificial Sequence
  Synthetic
atacgccatgctgggtctccttacattgtggagagggaatactgcaaaagctgtagtaaagaagacacacaaaaatgtgtcaacacaaagcttgaacaaccacaaagcattttaatcgagcgtacttgggagtcggccat

SEQ ID NO: 364374 - DNA, 140 bp, Artificial Sequence
  Synthetic
atggccgactcccaagtacgctcgattaaaatgctttgtggttgttcaagctttgtgttgacacatttttgtgtgtcttctttactacagcttttgcagtattccctctccacaatgtaaggagacccagcatggcgtat

SEQ ID NO: 364375 - DNA, 140 bp, Artificial Sequence
  Synthetic
aggccctggctgctgatatgaaaaatgtgtcaacacaaagcttgaacaaccacaaagcattttaatcgagcacaaagggacgataattgggaagcagaacgacacttgtacaggcaaagcgaccttttgggacagcggtg

SEQ ID NO: 364376 - DNA, 140 bp, Artificial Sequence
  Synthetic
caccgctgtcccaaaaggtcgctttgcctgtacaagtgtcgttctgcttcccaattatcgtccctttgtgctcgattaaaatgctttgtggttgttcaagctttgtgttgacacatttttcatatcagcagccagggcct

SEQ ID NO: 364377 - DNA, 140 bp, Artificial Sequence
  Synthetic
atacgccatgctgggtctccctttgaaattgaatcgcataaatgctactgtagcctattttgctgcccctactgtaggcactgctctgctgacagagaaattcaccagttacacttgagtcgtacttgggagtcggccat

SEQ ID NO: 364378 - DNA, 140 bp, Artificial Sequence
  Synthetic
atggccgactcccaagtacgactcaagtgtaactggtgaatttctctgtcagcagagcagtgcctacagtaggggcagcaaaataggctacagtagcatttatgcgattcaatttcaaagggagacccagcatggcgtat

SEQ ID NO: 364379 - DNA, 140 bp, Artificial Sequence
  Synthetic
atacgccatgctgggtctccacgcatgtgctttagggcaaccatagaagcaagcagaagagccctgctcatccgaagcattataaataccacttttgtaatatgcattttaacattgacacgtacttgggagtcggccat

SEQ ID NO: 364380 - DNA, 140 bp, Artificial Sequence
  Synthetic
atggccgactcccaagtacgtgtcaatgttaaaatgcatattacaaaagtggtatttataatgcttcggatgagcagggctcttctgcttgcttctatggttgccctaaagcacatgcgtggagacccagcatggcgtat

SEQ ID NO: 364381 - DNA, 140 bp, Artificial Sequence
  Synthetic
atacgccatgctgggtctcctaggaagatcgctgagctgttctctacaaaaacacacattggctaaatcagcagaaagggcctcaagaaatgatgacagtatacttactaatactactgccgtacttgggagtcggccat

SEQ ID NO: 364382 - DNA, 140 bp, Artificial Sequence
  Synthetic
atggccgactcccaagtacggcagtagtattagtaagtatactgtcatcatttcttgaggccctttctgctgatttagccaatgtgtgtttttgtagagaacagctcagcgatcttcctaggagacccagcatggcgtat

SEQ ID NO: 364383 - DNA, 140 bp, Artificial Sequence
  Synthetic
atacgccatgctgggtctccagttatatctaacctgtttcatcacattcgcaaacaagctcttctgctctttccactctgacataaaccttgactgcgtgccgccactatatctttgagacgtacttgggagtcggccat

SEQ ID NO: 364384 - DNA, 140 bp, Artificial Sequence
  Synthetic
atggccgactcccaagtacgtctcaaagatatagtggcggcacgcagtcaaggtttatgtcagagtggaaagagcagaagagcttgtttgcgaatgtgatgaaacaggttagatataactggagacccagcatggcgtat

SEQ ID NO: 364385 - DNA, 140 bp, Artificial Sequence
  Synthetic
atacgccatgctgggtctccagaatagaattacaggtctttattgtaatagcaatgaagggcctcttgataggcacaatgttatttacagtagcagaatggcagattcttgtgattggctcgtacttgggagtcggccat

SEQ ID NO: 364386 - DNA, 140 bp, Artificial Sequence
  Synthetic
atggccgactcccaagtacgagccaatcacaagaatctgccattctgctactgtaaataacattgtgcctatcaagaggcccttcattgctattacaataaagacctgtaattctattctggagacccagcatggcgtat

SEQ ID NO: 364387 - DNA, 140 bp, Artificial Sequence
  Synthetic
atacgccatgctgggtctcctggcagaatcagtgaaatgggagtctgctttgggacaatccccgtggccaatcctgatgatgctgcccaaggatctggacatactaagtccattctcaaccgtacttgggagtcggccat

SEQ ID NO: 364388 - DNA, 140 bp, Artificial Sequence
  Synthetic
atggccgactcccaagtacggttgagaatggacttagtatgtccagatccttgggcagcatcatcaggattggccacggggattgtcccaaagcagactcccatttcactgattctgccaggagacccagcatggcgtat

SEQ ID NO: 364389 - DNA, 140 bp, Artificial Sequence
  Synthetic
aggccctggctgctgatatgctaaagaaatgggcattactatcatcatttggactgttgctgccagtgatgaagtagaagcaggtataaagttcggagacggtgatgtgtttacagctgtgaccttttgggacagcggtg

SEQ ID NO: 364390 - DNA, 140 bp, Artificial Sequence
  Synthetic
caccgctgtcccaaaaggtcacagctgtaaacacatcaccgtctccgaactttatacctgcttctacttcatcactggcagcaacagtccaaatgatgatagtaatgcccatttctttagcatatcagcagccagggcct

SEQ ID NO: 364391 - DNA, 140 bp, Artificial Sequence
  Synthetic
aggccctggctgctgatatggaagtagaagcaggtataaagttcggagacggtgatgtgtttacagctgtgaaccttttgcactctggacaaacacactttgatgcgctcagaatactgcgaccttttgggacagcggtg

SEQ ID NO: 364392 - DNA, 140 bp, Artificial Sequence
  Synthetic
caccgctgtcccaaaaggtcgcagtattctgagcgcatcaaagtgtgtttgtccagagtgcaaaaggttcacagctgtaaacacatcaccgtctccgaactttatacctgcttctacttccatatcagcagccagggcct

SEQ ID NO: 364393 - DNA, 140 bp, Artificial Sequence
  Synthetic
atacgccatgctgggtctcccacagtttgaagcagacacgagagagaccctgagcttgatggacagggttatagctgtggatcagttgacatcatcttctagtgatgaactgcaagattacgtacttgggagtcggccat

SEQ ID NO: 364394 - DNA, 140 bp, Artificial Sequence
  Synthetic
atggccgactcccaagtacgtaatcttgcagttcatcactagaagatgatgtcaactgatccacagctataaccctgtccatcaagctcagggtctctctcgtgtctgcttcaaactgtgggagacccagcatggcgtat

SEQ ID NO: 364395 - DNA, 140 bp, Artificial Sequence
  Synthetic
atacgccatgctgggtctccgcacctaatctgcttcgttatatctacaaataagctctatgatgcttgaagctgccttagctctgcttactctgaccttaactttgactgcgtgccgccacgtacttgggagtcggccat

SEQ ID NO: 364396 - DNA, 140 bp, Artificial Sequence
  Synthetic
atggccgactcccaagtacgtggcggcacgcagtcaaagttaaggtcagagtaagcagagctaaggcagcttcaagcatcatagagcttatttgtagatataacgaagcagattaggtgcggagacccagcatggcgtat

SEQ ID NO: 364397 - DNA, 140 bp, Artificial Sequence
  Synthetic
atacgccatgctgggtctccattggtgaaatcatgtcattgcggcagctggggcataagctgctgacacgagacaaacaaattaagcaagagttctctagaatgaaactctacgtcactacgtacttgggagtcggccat

SEQ ID NO: 364398 - DNA, 140 bp, Artificial Sequence
  Synthetic
atggccgactcccaagtacgtagtgacgtagagtttcattctagagaactcttgcttaatttgtttgtctcgtgtcagcagcttatgccccagctgccgcaatgacatgatttcaccaatggagacccagcatggcgtat

SEQ ID NO: 364399 - DNA, 140 bp, Artificial Sequence
  Synthetic
atacgccatgctgggtctccttggactcaggtgattgctggtcaatatgtgaccaaccctaggttcaatatctccgattacttcgagattgtgcggcagcctggtgatgggaactgcttccgtacttgggagtcggccat

SEQ ID NO: 364400 - DNA, 140 bp, Artificial Sequence
  Synthetic
atggccgactcccaagtacggaagcagttcccatcaccaggctgccgcacaatctcgaagtaatcggagatattgaacctagggttggtcacatattgaccagcaatcacctgagtccaaggagacccagcatggcgtat

SEQ ID NO: 364401 - DNA, 140 bp, Artificial Sequence
  Synthetic
aggccctggctgctgatatggcagctgtatggtctggggggaacccatgggtcacacaatggaactgaacacaataagacaaacgctgtgacaacgtctagtgacagccggagctcagaagaccttttgggacagcggtg

SEQ ID NO: 364402 - DNA, 140 bp, Artificial Sequence
  Synthetic
caccgctgtcccaaaaggtcttctgagctccggctgtcactagacgttgtcacagcgtttgtcttattgtgttcagttccattgtgtgacccatgggttccccccagaccatacagctgccatatcagcagccagggcct

SEQ ID NO: 364403 - DNA, 140 bp, Artificial Sequence
  Synthetic
aggccctggctgctgatatgtcacaacatcaaacatctgaccgagttggcagcaaggaagtattaccaagaggagcctgaggctaagcttgttggcctgagtttggaagattaccttaaggaccttttgggacagcggtg

SEQ ID NO: 364404 - DNA, 140 bp, Artificial Sequence
  Synthetic
caccgctgtcccaaaaggtccttaaggtaatcttccaaactcaggccaacaagcttagcctcaggctcctcttggtaatacttccttgctgccaactcggtcagatgtttgatgttgtgacatatcagcagccagggcct

SEQ ID NO: 364405 - DNA, 140 bp, Artificial Sequence
  Synthetic
atacgccatgctgggtctccagcacagccctgtccggaaagaaggtgtacaaagttctcggcaacctaggaaatgaactgttgtacaaggcacctagaaaggccttagcaactgtctgcacgtacttgggagtcggccat

SEQ ID NO: 364406 - DNA, 140 bp, Artificial Sequence
  Synthetic
atggccgactcccaagtacgtgcagacagttgctaaggcctttctaggtgccttgtacaacagttcatttcctaggttgccgagaactttgtacaccttctttccggacagggctgtgctggagacccagcatggcgtat

SEQ ID NO: 364407 - DNA, 140 bp, Artificial Sequence
  Synthetic
aggccctggctgctgatatgaaatgaactgttgtacaaggcacctagaaaggccttagcaactgtctgcagtgccttgtttgggaagcagataaacaagcttcagaattgcttcaggaccgaccttttgggacagcggtg

SEQ ID NO: 364408 - DNA, 140 bp, Artificial Sequence
  Synthetic
caccgctgtcccaaaaggtcggtcctgaagcaattctgaagcttgtttatctgcttcccaaacaaggcactgcagacagttgctaaggcctttctaggtgccttgtacaacagttcatttcatatcagcagccagggcct

SEQ ID NO: 364409 - DNA, 140 bp, Artificial Sequence
  Synthetic
atacgccatgctgggtctccacaataagacaaacgctgtgacaacgtctagtgacagccggagctcagaaccaccagtaagaacgaccctgcctgtcacgccggactcccccaccgtcaccgtacttgggagtcggccat

SEQ ID NO: 364410 - DNA, 140 bp, Artificial Sequence
  Synthetic
atggccgactcccaagtacggtgacggtgggggagtccggcgtgacaggcagggtcgttcttactggtggttctgagctccggctgtcactagacgttgtcacagcgtttgtcttattgtggagacccagcatggcgtat

SEQ ID NO: 364411 - DNA, 140 bp, Artificial Sequence
  Synthetic
aggccctggctgctgatatgcattgaggatcctatgatacagctaattccagaaaaactgaggagagagttggaaaggttgggagtttctagaatggaagttgatgaactgatgccaagcgaccttttgggacagcggtg

SEQ ID NO: 364412 - DNA, 140 bp, Artificial Sequence
  Synthetic
caccgctgtcccaaaaggtcgcttggcatcagttcatcaacttccattctagaaactcccaacctttccaactctctcctcagtttttctggaattagctgtatcataggatcctcaatgcatatcagcagccagggcct

SEQ ID NO: 364413 - DNA, 140 bp, Artificial Sequence
  Synthetic
aggccctggctgctgatatgccgactagagtcggcagggtcttggactgcatgtttaactgcaaactatgtgttgagatatcagctgacactttaattctaagaccagaatccaaagagagaccttttgggacagcggtg

SEQ ID NO: 364414 - DNA, 140 bp, Artificial Sequence
  Synthetic
caccgctgtcccaaaaggtctctctttggattctggtcttagaattaaagtgtcagctgatatctcaacacatagtttgcagttaaacatgcagtccaagaccctgccgactctagtcggcatatcagcagccagggcct

SEQ ID NO: 364415 - DNA, 140 bp, Artificial Sequence
  Synthetic
atacgccatgctgggtctcccacagcacagcctggaagcatgcactccgattaaaagggactgcatacgaaggtctgtttgcaaactgttacggctggcaatacattccagaagacattacgtacttgggagtcggccat

SEQ ID NO: 364416 - DNA, 140 bp, Artificial Sequence
  Synthetic
atggccgactcccaagtacgtaatgtcttctggaatgtattgccagccgtaacagtttgcaaacagaccttcgtatgcagtcccttttaatcggagtgcatgcttccaggctgtgctgtgggagacccagcatggcgtat

SEQ ID NO: 364417 - DNA, 140 bp, Artificial Sequence
  Synthetic
atacgccatgctgggtctccgatttcctggatcgaacccagttgcatccagagttcagggatctaactccagacttttcactcacacaaaaggttcacttcaaaagaaatcagatacctacgtacttgggagtcggccat

SEQ ID NO: 364418 - DNA, 140 bp, Artificial Sequence
  Synthetic
atggccgactcccaagtacgtaggtatctgatttcttttgaagtgaaccttttgtgtgagtgaaaagtctggagttagatccctgaactctggatgcaactgggttcgatccaggaaatcggagacccagcatggcgtat

SEQ ID NO: 364419 - DNA, 140 bp, Artificial Sequence
  Synthetic
atacgccatgctgggtctcccccccccaaacaccaccgaaggcccgtctctgccggagtccacgccagagccccccgcggcaaccagcacaggcatcccaggtgcaagtgatgtcaactccgtacttgggagtcggccat

SEQ ID NO: 364420 - DNA, 140 bp, Artificial Sequence
  Synthetic
atggccgactcccaagtacggagttgacatcacttgcacctgggatgcctgtgctggttgccgcggggggctctggcgtggactccggcagagacgggccttcggtggtgtttgggggggggagacccagcatggcgtat

SEQ ID NO: 364421 - DNA, 140 bp, Artificial Sequence
  Synthetic
atacgccatgctgggtctccgaagcagtgccggtgacagaaagaaagatgttccctctccctgagactccactaagtgaggtgcattcaatagagcgtataatggaaaactttacccgcccgtacttgggagtcggccat

SEQ ID NO: 364422 - DNA, 140 bp, Artificial Sequence
  Synthetic
atggccgactcccaagtacgggcgggtaaagttttccattatacgctctattgaatgcacctcacttagtggagtctcagggagagggaacatctttctttctgtcaccggcactgcttcggagacccagcatggcgtat

SEQ ID NO: 364423 - DNA, 140 bp, Artificial Sequence
  Synthetic
aggccctggctgctgatatgactaagtgaggtgcattcaatagagcgtataatggaaaactttacccgccttatgcacggaggaaaactttcagccaagaaaaaagatggagatccggcagaccttttgggacagcggtg

SEQ ID NO: 364424 - DNA, 140 bp, Artificial Sequence
  Synthetic
caccgctgtcccaaaaggtctgccggatctccatcttttttcttggctgaaagttttcctccgtgcataaggcgggtaaagttttccattatacgctctattgaatgcacctcacttagtcatatcagcagccagggcct

SEQ ID NO: 364425 - DNA, 140 bp, Artificial Sequence
  Synthetic
atacgccatgctgggtctcctgaactcacccacagagctattgaagaaaaaaccctacttaggcaccacctgtaagttcaacacttggggagacacaaacagaactggaaagttcacatacgtacttgggagtcggccat

SEQ ID NO: 364426 - DNA, 140 bp, Artificial Sequence
  Synthetic
atggccgactcccaagtacgtatgtgaactttccagttctgtttgtgtctccccaagtgttgaacttacaggtggtgcctaagtagggttttttcttcaatagctctgtgggtgagttcaggagacccagcatggcgtat

SEQ ID NO: 364427 - DNA, 140 bp, Artificial Sequence
  Synthetic
atacgccatgctgggtctccttatgaaattcatcagcacctcaggaagggcaatgagtgcaggcaagattggtaacgtcctttcctatgcacataacctttacttgagtaagtctagtttcgtacttgggagtcggccat

SEQ ID NO: 364428 - DNA, 140 bp, Artificial Sequence
  Synthetic
atggccgactcccaagtacgaaactagacttactcaagtaaaggttatgtgcataggaaaggacgttaccaatcttgcctgcactcattgcccttcctgaggtgctgatgaatttcataaggagacccagcatggcgtat

SEQ ID NO: 364429 - DNA, 140 bp, Artificial Sequence
  Synthetic
aggccctggctgctgatatggttggttttcaaactgacatcgatgggaaaataaggacagatcacaagaagtggaaagatatattaaagctattagagttgctaggaatcaaatgctcatgaccttttgggacagcggtg

SEQ ID NO: 364430 - DNA, 140 bp, Artificial Sequence
  Synthetic
caccgctgtcccaaaaggtcatgagcatttgattcctagcaactctaatagctttaatatatctttccacttcttgtgatctgtccttattttcccatcgatgtcagtttgaaaaccaaccatatcagcagccagggcct

SEQ ID NO: 364431 - DNA, 140 bp, Artificial Sequence
  Synthetic
atacgccatgctgggtctcctcggaggacagagtgcgagtcttaaaaaattcagtcagcttcttattcaataaactctccagaaactcacctacagaagtaactgacatagttgttggagcgtacttgggagtcggccat

SEQ ID NO: 364432 - DNA, 140 bp, Artificial Sequence
  Synthetic
atggccgactcccaagtacgctccaacaactatgtcagttacttctgtaggtgagtttctggagagtttattgaataagaagctgactgaattttttaagactcgcactctgtcctccgaggagacccagcatggcgtat

SEQ ID NO: 364433 - DNA, 140 bp, Artificial Sequence
  Synthetic
aggccctggctgctgatatggagggtctgtttgcaaactgctacggatggcaatacattccagaagatatcaaaccaagcctgaccatgttgatacagactttgtttcctgacaagtttggaccttttgggacagcggtg

SEQ ID NO: 364434 - DNA, 140 bp, Artificial Sequence
  Synthetic
caccgctgtcccaaaaggtccaaacttgtcaggaaacaaagtctgtatcaacatggtcaggcttggtttgatatcttctggaatgtattgccatccgtagcagtttgcaaacagaccctccatatcagcagccagggcct

SEQ ID NO: 364435 - DNA, 140 bp, Artificial Sequence
  Synthetic
atacgccatgctgggtctccaaaacccccgtgtcgacaaaagacgtcctagaaacttgggaaaagatgaaggagcacatactcaacagaccaacaggactgacactgcccaccagtttggcgtacttgggagtcggccat

SEQ ID NO: 364436 - DNA, 140 bp, Artificial Sequence
  Synthetic
atggccgactcccaagtacgccaaactggtgggcagtgtcagtcctgttggtctgttgagtatgtgctccttcatcttttcccaagtttctaggacgtcttttgtcgacacgggggttttggagacccagcatggcgtat

SEQ ID NO: 364437 - DNA, 140 bp, Artificial Sequence
  Synthetic
atacgccatgctgggtctccaacaggcaatgcgcaaaggactggtcgaaggtgttgtcatctctaaagagggttccgaatcatgcatcaatatgttgaaagaaaatttagaccgaataaccgtacttgggagtcggccat

SEQ ID NO: 364438 - DNA, 140 bp, Artificial Sequence
  Synthetic
atggccgactcccaagtacggttattcggtctaaattttctttcaacatattgatgcatgattcggaaccctctttagagatgacaacaccttcgaccagtcctttgcgcattgcctgttggagacccagcatggcgtat

SEQ ID NO: 364439 - DNA, 140 bp, Artificial Sequence
  Synthetic
aggccctggctgctgatatgtgccaatctatcagaaaagattgagttgctcgcttataatctgcaacttactaatcactgcagcaactgtcaccccaatggtttaaacattagtaacacagaccttttgggacagcggtg

SEQ ID NO: 364440 - DNA, 140 bp, Artificial Sequence
  Synthetic
caccgctgtcccaaaaggtctgtgttactaatgtttaaaccattggggtgacagttgctgcagtgattagtaagttgcagattataagcgagcaactcaatcttttctgatagattggcacatatcagcagccagggcct

SEQ ID NO: 364441 - DNA, 140 bp, Artificial Sequence
  Synthetic
atacgccatgctgggtctcctctaatgtgtgcaaaagatgccccaagattgaagtggtcagccattgtgaaaataaaggctttgaggacagcaatgagtgcttaacagacctagataggccgtacttgggagtcggccat

SEQ ID NO: 364442 - DNA, 140 bp, Artificial Sequence
  Synthetic
atggccgactcccaagtacggcctatctaggtctgttaagcactcattgctgtcctcaaagcctttattttcacaatggctgaccacttcaatcttggggcatcttttgcacacattagaggagacccagcatggcgtat

SEQ ID NO: 364443 - DNA, 140 bp, Artificial Sequence
  Synthetic
aggccctggctgctgatatgaaataaaggctttgaggacagcaatgagtgcttaacagacctagataggcttgttaggcttacactaccagggaaaactgagaaggagagaagagttaaagaccttttgggacagcggtg

SEQ ID NO: 364444 - DNA, 140 bp, Artificial Sequence
  Synthetic
caccgctgtcccaaaaggtctttaactcttctctccttctcagttttccctggtagtgtaagcctaacaagcctatctaggtctgttaagcactcattgctgtcctcaaagcctttatttcatatcagcagccagggcct

SEQ ID NO: 364445 - DNA, 140 bp, Artificial Sequence
  Synthetic
atacgccatgctgggtctccgtgaggaatctactttcagtcacgagccataagcccgaagaaacatcagcaccgtcaggatctggcaaagagagtccagcagccaacagccctcacccagcgtacttgggagtcggccat

SEQ ID NO: 364446 - DNA, 140 bp, Artificial Sequence
  Synthetic
atggccgactcccaagtacgctgggtgagggctgttggctgctggactctctttgccagatcctgacggtgctgatgtttcttcgggcttatggctcgtgactgaaagtagattcctcacggagacccagcatggcgtat

SEQ ID NO: 364447 - DNA, 140 bp, Artificial Sequence
  Synthetic
aggccctggctgctgatatgcgtaatgtggaatatcttataaaactgatgatgagcatgtcaggcattgattgtataaaatatcccacaggacagcttatcacccatggaagagtgagtggaccttttgggacagcggtg

SEQ ID NO: 364448 - DNA, 140 bp, Artificial Sequence
  Synthetic
caccgctgtcccaaaaggtccactcactcttccatgggtgataagctgtcctgtgggatattttatacaatcaatgcctgacatgctcatcatcagttttataagatattccacattacgcatatcagcagccagggcct

SEQ ID NO: 364449 - DNA, 140 bp, Artificial Sequence
  Synthetic
aggccctggctgctgatatgttgtataaaatatcccacaggacagcttatcacccatggaagagtgagtgcaaaacataacgatggaaacttgaaagatagaagtgatgacgaccaaagagaccttttgggacagcggtg

SEQ ID NO: 364450 - DNA, 140 bp, Artificial Sequence
  Synthetic
caccgctgtcccaaaaggtctctttggtcgtcatcacttctatctttcaagtttccatcgttatgttttgcactcactcttccatgggtgataagctgtcctgtgggatattttatacaacatatcagcagccagggcct

SEQ ID NO: 364451 - DNA, 140 bp, Artificial Sequence
  Synthetic
atacgccatgctgggtctcccaaaacataacgatggaaacttgaaagatagaagtgatgacgaccaaagactagctgagaagatagatgctgttaggaaagagctttcagaatctaaactcgtacttgggagtcggccat

SEQ ID NO: 364452 - DNA, 140 bp, Artificial Sequence
  Synthetic
atggccgactcccaagtacgagtttagattctgaaagctctttcctaacagcatctatcttctcagctagtctttggtcgtcatcacttctatctttcaagtttccatcgttatgttttgggagacccagcatggcgtat

SEQ ID NO: 364453 - DNA, 140 bp, Artificial Sequence
  Synthetic
atacgccatgctgggtctcccaaactatcgtgacagttgcggtaaacaactgactggtagaataattaccaagtatactcattggttggacacttttctcagctgttctgtatccattaacgtacttgggagtcggccat

SEQ ID NO: 364454 - DNA, 140 bp, Artificial Sequence
  Synthetic
atggccgactcccaagtacgttaatggatacagaacagctgagaaaagtgtccaaccaatgagtatacttggtaattattctaccagtcagttgtttaccgcaactgtcacgatagtttgggagacccagcatggcgtat

SEQ ID NO: 364455 - DNA, 140 bp, Artificial Sequence
  Synthetic
atacgccatgctgggtctcctataaacattagaaactcactaaaagctagatccgagtttgtcagaaataacgataaactactcataaggtcaaaagaagaattaaaaaaatgtttcgatcgtacttgggagtcggccat

SEQ ID NO: 364456 - DNA, 140 bp, Artificial Sequence
  Synthetic
atggccgactcccaagtacgatcgaaacatttttttaattcttcttttgaccttatgagtagtttatcgttatttctgacaaactcggatctagcttttagtgagtttctaatgtttataggagacccagcatggcgtat

SEQ ID NO: 364457 - DNA, 140 bp, Artificial Sequence
  Synthetic
aggccctggctgctgatatggcagcatcaactattcttgagccttcttcctcaatctcacgagtgtctacagaaacataaggacggtagcgcaatgtcagtcatacctgataacagcaatgaccttttgggacagcggtg

SEQ ID NO: 364458 - DNA, 140 bp, Artificial Sequence
  Synthetic
caccgctgtcccaaaaggtcattgctgttatcaggtatgactgacattgcgctaccgtccttatgtttctgtagacactcgtgagattgaggaagaaggctcaagaatagttgatgctgccatatcagcagccagggcct

SEQ ID NO: 364459 - DNA, 140 bp, Artificial Sequence
  Synthetic
atacgccatgctgggtctcctgactgtatactgttcaaagaagtggcagctgaatgcatgaagaggtacattggcacaccttatgagggaattgtagacaccttagtttctctgattaatcgtacttgggagtcggccat

SEQ ID NO: 364460 - DNA, 140 bp, Artificial Sequence
  Synthetic
atggccgactcccaagtacgattaatcagagaaactaaggtgtctacaattccctcataaggtgtgccaatgtacctcttcatgcattcagctgccacttctttgaacagtatacagtcaggagacccagcatggcgtat

SEQ ID NO: 364461 - DNA, 140 bp, Artificial Sequence
  Synthetic
atacgccatgctgggtctccaactggttaagataaggcactgtgacattaacctatcagtcaaattgccatcaaataaaaaggagaatatgttatgctgtctatatagtagcaacatggacgtacttgggagtcggccat

SEQ ID NO: 364462 - DNA, 140 bp, Artificial Sequence
  Synthetic
atggccgactcccaagtacgtccatgttgctactatatagacagcataacatattctcctttttatttgatggcaatttgactgataggttaatgtcacagtgccttatcttaaccagttggagacccagcatggcgtat

SEQ ID NO: 364463 - DNA, 140 bp, Artificial Sequence
  Synthetic
aggccctggctgctgatatgtcaaataaaaaggagaatatgttatgctgtctatatagtagcaacatggaactcttacaaggacccttctacttgaataggagacaagctgtccttggttgaccttttgggacagcggtg

SEQ ID NO: 364464 - DNA, 140 bp, Artificial Sequence
  Synthetic
caccgctgtcccaaaaggtcaaccaaggacagcttgtctcctattcaagtagaagggtccttgtaagagttccatgttgctactatatagacagcataacatattctcctttttatttgacatatcagcagccagggcct

SEQ ID NO: 364465 - DNA, 140 bp, Artificial Sequence
  Synthetic
atacgccatgctgggtctcctataggtgtctagaagttataaacagtgtgaatgaaaaaacattgcaagacgttgaaaatcattccatgactctactagaggattcattcaaggaaatcacgtacttgggagtcggccat

SEQ ID NO: 364466 - DNA, 140 bp, Artificial Sequence
  Synthetic
atggccgactcccaagtacgtgatttccttgaatgaatcctctagtagagtcatggaatgattttcaacgtcttgcaatgttttttcattcacactgtttataacttctagacacctataggagacccagcatggcgtat

SEQ ID NO: 364467 - DNA, 140 bp, Artificial Sequence
  Synthetic
atacgccatgctgggtctcccttttgctcttgaaggtaggtttgaagagtcttacaaaatacgaacctcaaggtgcagagccagtgggaattttctgaatagaagcagcagagaccacttcgtacttgggagtcggccat

SEQ ID NO: 364468 - DNA, 140 bp, Artificial Sequence
  Synthetic
atggccgactcccaagtacgaagtggtctctgctgcttctattcagaaaattcccactggctctgcaccttgaggttcgtattttgtaagactcttcaaacctaccttcaagagcaaaagggagacccagcatggcgtat

SEQ ID NO: 364469 - DNA, 140 bp, Artificial Sequence
  Synthetic
atacgccatgctgggtctcctataagcgttgtttcaggcttgaacttagtttatggcttcctcataaaagataacttactagccaactctcagcaacagaacaaacagctacagatgcttcgtacttgggagtcggccat

SEQ ID NO: 364470 - DNA, 140 bp, Artificial Sequence
  Synthetic
atggccgactcccaagtacgaagcatctgtagctgtttgttctgttgctgagagttggctagtaagttatcttttatgaggaagccataaactaagttcaagcctgaaacaacgcttataggagacccagcatggcgtat

SEQ ID NO: 364471 - DNA, 140 bp, Artificial Sequence
  Synthetic
atacgccatgctgggtctcccattggcacaccttatgaaggaattatcgacaccttagtttctctgattaatgttctgacaaggttcacctggtttcaagaggtggtgctatatggtaaacgtacttgggagtcggccat

SEQ ID NO: 364472 - DNA, 140 bp, Artificial Sequence
  Synthetic
atggccgactcccaagtacgtttaccatatagcaccacctcttgaaaccaggtgaaccttgtcagaacattaatcagagaaactaaggtgtcgataattccttcataaggtgtgccaatgggagacccagcatggcgtat

SEQ ID NO: 364473 - DNA, 140 bp, Artificial Sequence
  Synthetic
atacgccatgctgggtctccaataaagaaacaaattttgacggtgaagaagcagattgtgtttgatgcagaaagtgaaccaagattgcaatggggacatggctgtctatccattgtttatcgtacttgggagtcggccat

SEQ ID NO: 364474 - DNA, 140 bp, Artificial Sequence
  Synthetic
atggccgactcccaagtacgataaacaatggatagacagccatgtccccattgcaatcttggttcactttctgcatcaaacacaatctgcttcttcaccgtcaaaatttgtttctttattggagacccagcatggcgtat

SEQ ID NO: 364475 - DNA, 140 bp, Artificial Sequence
  Synthetic
aggccctggctgctgatatgatgctttacagtctatggaacctttgtcaacagcgatagacaactgatctttgacatttacaatgtgcacatatataataaagaaatggataactttgatgaccttttgggacagcggtg

SEQ ID NO: 364476 - DNA, 140 bp, Artificial Sequence
  Synthetic
caccgctgtcccaaaaggtcatcaaagttatccatttctttattatatatgtgcacattgtaaatgtcaaagatcagttgtctatcgctgttgacaaaggttccatagactgtaaagcatcatatcagcagccagggcct

SEQ ID NO: 364477 - DNA, 140 bp, Artificial Sequence
  Synthetic
atacgccatgctgggtctccgaaccgcaagactattgctaggctgcccaaatgtgaggaaagcagcaaatagagaagggaagaagctgttgaagttaaacagtgaaacatccacagacaccgtacttgggagtcggccat

SEQ ID NO: 364478 - DNA, 140 bp, Artificial Sequence
  Synthetic
atggccgactcccaagtacggtgtctgtggatgtttcactgtttaacttcaacagcttcttcccttctctatttgctgctttcctcacatttgggcagcctagcaatagtcttgcggttcggagacccagcatggcgtat

SEQ ID NO: 364479 - DNA, 140 bp, Artificial Sequence
  Synthetic
aggccctggctgctgatatgaaagtgaaccaagattgcaatggggacatggctgtctatccattgtttatgatgaaactgacacacagactacctaccatgaaaacctactgaaggttaagaccttttgggacagcggtg

SEQ ID NO: 364480 - DNA, 140 bp, Artificial Sequence
  Synthetic
caccgctgtcccaaaaggtcttaaccttcagtaggttttcatggtaggtagtctgtgtgtcagtttcatcataaacaatggatagacagccatgtccccattgcaatcttggttcactttcatatcagcagccagggcct

SEQ ID NO: 364481 - DNA, 140 bp, Artificial Sequence
  Synthetic
aggccctggctgctgatatgtttgaattaaggtcaggtcttgaggttttcaatgatcctttcaatgattatcagcaagcaataacggacatttgtcaattttctgagtacacaccaaacagaccttttgggacagcggtg

SEQ ID NO: 364482 - DNA, 140 bp, Artificial Sequence
  Synthetic
caccgctgtcccaaaaggtctgtttggtgtgtactcagaaaattgacaaatgtccgttattgcttgctgataatcattgaaaggatcattgaaaacctcaagacctgaccttaattcaaacatatcagcagccagggcct

SEQ ID NO: 364483 - DNA, 140 bp, Artificial Sequence
  Synthetic
aggccctggctgctgatatgaagactttacctacaaacatctatatattgttcagtcagagacgtggaagacaatattaagcactggaagcaaagagatctatgccctgaagtgaccattgaccttttgggacagcggtg

SEQ ID NO: 364484 - DNA, 140 bp, Artificial Sequence
  Synthetic
caccgctgtcccaaaaggtcaatggtcacttcagggcatagatctctttgcttccagtgcttaatattgtcttccacgtctctgactgaacaatatatagatgtttgtaggtaaagtcttcatatcagcagccagggcct

SEQ ID NO: 364485 - DNA, 140 bp, Artificial Sequence
  Synthetic
aggccctggctgctgatatgactgggttagcatctctgaagtgacagaaacaacaagtatagttgcatcacctagaactcatatgatgctcaaggattgttttaaaattatactaggtacgaccttttgggacagcggtg

SEQ ID NO: 364486 - DNA, 140 bp, Artificial Sequence
  Synthetic
caccgctgtcccaaaaggtcgtacctagtataattttaaaacaatccttgagcatcatatgagttctaggtgatgcaactatacttgttgtttctgtcacttcagagatgctaacccagtcatatcagcagccagggcct

SEQ ID NO: 364487 - DNA, 140 bp, Artificial Sequence
  Synthetic
aggccctggctgctgatatgtagaaccgcaagattattactaggttgcccaaatgtgaggaaagctgcaaacaaagaagggaaaaagctattgaagtcaaacagcgacacatccactgatgaccttttgggacagcggtg

SEQ ID NO: 364488 - DNA, 140 bp, Artificial Sequence
  Synthetic
caccgctgtcccaaaaggtcatcagtggatgtgtcgctgtttgacttcaatagctttttcccttctttgtttgcagctttcctcacatttgggcaacctagtaataatcttgcggttctacatatcagcagccagggcct

SEQ ID NO: 364489 - DNA, 140 bp, Artificial Sequence
  Synthetic
atacgccatgctgggtctcctgagaataagaagatagtcaaaatgcttcgagggaagctaaaaaaactcggtgctatctcaacaaacatagagatcgggaaaagggattgcctagatctacgtacttgggagtcggccat

SEQ ID NO: 364490 - DNA, 140 bp, Artificial Sequence
  Synthetic
atggccgactcccaagtacgtagatctaggcaatcccttttcccgatctctatgtttgttgagatagcaccgagtttttttagcttccctcgaagcattttgactatcttcttattctcaggagacccagcatggcgtat

SEQ ID NO: 364491 - DNA, 140 bp, Artificial Sequence
  Synthetic
atacgccatgctgggtctcctgggatatttgaaccctcaaagttgtccttctaccattggaaggaattggtcaggaaaaacattgatgaagttttacttactgaagacgggaatctgatccgtacttgggagtcggccat

SEQ ID NO: 364492 - DNA, 140 bp, Artificial Sequence
  Synthetic
atggccgactcccaagtacggatcagattcccgtcttcagtaagtaaaacttcatcaatgtttttcctgaccaattccttccaatggtagaaggacaactttgagggttcaaatatcccaggagacccagcatggcgtat

SEQ ID NO: 364493 - DNA, 140 bp, Artificial Sequence
  Synthetic
atacgccatgctgggtctcctgttttcagattctaaagttgtgctgtcaaggattaagtttaaaacggaattgcttcttaattccttgacattattacactgctttctgaaacatgctcccgtacttgggagtcggccat

SEQ ID NO: 364494 - DNA, 140 bp, Artificial Sequence
  Synthetic
atggccgactcccaagtacgggagcatgtttcagaaagcagtgtaataatgtcaaggaattaagaagcaattccgttttaaacttaatccttgacagcacaactttagaatctgaaaacaggagacccagcatggcgtat

SEQ ID NO: 364495 - DNA, 140 bp, Artificial Sequence
  Synthetic
atacgccatgctgggtctccatcttcttggatcaagtgcataacagcttgtaaagattttgcaagcatcaatgacaaaattcagaaattcatttaccacctttctgaagagctatatgaccgtacttgggagtcggccat

SEQ ID NO: 364496 - DNA, 140 bp, Artificial Sequence
  Synthetic
atggccgactcccaagtacggtcatatagctcttcagaaaggtggtaaatgaatttctgaattttgtcattgatgcttgcaaaatctttacaagctgttatgcacttgatccaagaagatggagacccagcatggcgtat

SEQ ID NO: 364497 - DNA, 140 bp, Artificial Sequence
  Synthetic
aggccctggctgctgatatgatgacaaaattcagaaattcatttaccacctttctgaagagctatatgacataagactgcagcacctggaactgtcaaagcttaagcaagagcatcctaggaccttttgggacagcggtg

SEQ ID NO: 364498 - DNA, 140 bp, Artificial Sequence
  Synthetic
caccgctgtcccaaaaggtcctaggatgctcttgcttaagctttgacagttccaggtgctgcagtcttatgtcatatagctcttcagaaaggtggtaaatgaatttctgaattttgtcatcatatcagcagccagggcct

SEQ ID NO: 364499 - DNA, 140 bp, Artificial Sequence
  Synthetic
atacgccatgctgggtctcctctcaaagaaatacttgcggcacgtcagtacgtaagtgttaactttgaagaagtgggttgagcatcttaattgcagcatacctgctgacatcatgcatatcgtacttgggagtcggccat

SEQ ID NO: 364500 - DNA, 140 bp, Artificial Sequence
  Synthetic
atggccgactcccaagtacgatatgcatgatgtcagcaggtatgctgcaattaagatgctcaacccacttcttcaaagttaacacttacgtactgacgtgccgcaagtatttctttgagaggagacccagcatggcgtat

SEQ ID NO: 364501 - DNA, 140 bp, Artificial Sequence
  Synthetic
atacgccatgctgggtctcctccttaagcagcataatctagagattatggaaacagtgaatcttatattctttgcagccctttcagctccttggtgcttacactataaagcactagagtccgtacttgggagtcggccat

SEQ ID NO: 364502 - DNA, 140 bp, Artificial Sequence
  Synthetic
atggccgactcccaagtacggactctagtgctttatagtgtaagcaccaaggagctgaaagggctgcaaagaatataagattcactgtttccataatctctagattatgctgcttaaggaggagacccagcatggcgtat

SEQ ID NO: 364503 - DNA, 140 bp, Artificial Sequence
  Synthetic
aggccctggctgctgatatgtttgcagccctttcagctccttggtgcttacactataaagcactagagtcttatttggtgagacatccagaaatacttgactgtggatctaaagaggattgaccttttgggacagcggtg

SEQ ID NO: 364504 - DNA, 140 bp, Artificial Sequence
  Synthetic
caccgctgtcccaaaaggtcaatcctctttagatccacagtcaagtatttctggatgtctcaccaaataagactctagtgctttatagtgtaagcaccaaggagctgaaagggctgcaaacatatcagcagccagggcct

SEQ ID NO: 364505 - DNA, 140 bp, Artificial Sequence
  Synthetic
aggccctggctgctgatatgtcttctgctggctaaagacaatctcttcttcagtcaaaggaagtttaaagaagagactcaagttcatgaatgtaaattccccggaactgatgccagagaagaccttttgggacagcggtg

SEQ ID NO: 364506 - DNA, 140 bp, Artificial Sequence
  Synthetic
caccgctgtcccaaaaggtcttctctggcatcagttccggggaatttacattcatgaacttgagtctcttctttaaacttcctttgactgaagaagagattgtctttagccagcagaagacatatcagcagccagggcct

SEQ ID NO: 364507 - DNA, 140 bp, Artificial Sequence
  Synthetic
atacgccatgctgggtctcctaccaaaaagatgatgaggagttgacaaatagttcaagtctgaaacttgggtttttagtgaaatatgctgttaccttgttcacatccaatggtgaaccttcgtacttgggagtcggccat

SEQ ID NO: 364508 - DNA, 140 bp, Artificial Sequence
  Synthetic
atggccgactcccaagtacgaaggttcaccattggatgtgaacaaggtaacagcatatttcactaaaaacccaagtttcagacttgaactatttgtcaactcctcatcatctttttggtaggagacccagcatggcgtat

SEQ ID NO: 364509 - DNA, 140 bp, Artificial Sequence
  Synthetic
aggccctggctgctgatatgcaatgacaaggttcagaaattcatttaccacctttctgaagagctgtatgacataaggctgcagcacctggaactgtcaaagcttaagcaagaacaccctgaccttttgggacagcggtg

SEQ ID NO: 364510 - DNA, 140 bp, Artificial Sequence
  Synthetic
caccgctgtcccaaaaggtcagggtgttcttgcttaagctttgacagttccaggtgctgcagccttatgtcatacagctcttcagaaaggtggtaaatgaatttctgaaccttgtcattgcatatcagcagccagggcct

SEQ ID NO: 364511 - DNA, 140 bp, Artificial Sequence
  Synthetic
aggccctggctgctgatatgtttcctaaagcagcacaatctggaaattatggagacagtaaaccttatattctttgccgctctttcagctccctggtgcttacactacaaagcactagaggaccttttgggacagcggtg

SEQ ID NO: 364512 - DNA, 140 bp, Artificial Sequence
  Synthetic
caccgctgtcccaaaaggtcctctagtgctttgtagtgtaagcaccagggagctgaaagagcggcaaagaatataaggtttactgtctccataatttccagattgtgctgctttaggaaacatatcagcagccagggcct

SEQ ID NO: 364513 - DNA, 140 bp, Artificial Sequence
  Synthetic
aggccctggctgctgatatgtcttatctagtgagacatccagagatactcgactgtggatctaaagaggactgtaagctcactttgcttgatctgtcagtctctaagctcttagtctgttgaccttttgggacagcggtg

SEQ ID NO: 364514 - DNA, 140 bp, Artificial Sequence
  Synthetic
caccgctgtcccaaaaggtcaacagactaagagcttagagactgacagatcaagcaaagtgagcttacagtcctctttagatccacagtcgagtatctctggatgtctcactagataagacatatcagcagccagggcct

SEQ ID NO: 364515 - DNA, 140 bp, Artificial Sequence
  Synthetic
atacgccatgctgggtctccgggtttttagtaaagtatgctgttaccttattcacatccaatggtgaacctttttcgcttagtctaaatgatgggggtttagatcttgacctgcacaagacgtacttgggagtcggccat

SEQ ID NO: 364516 - DNA, 140 bp, Artificial Sequence
  Synthetic
atggccgactcccaagtacgtcttgtgcaggtcaagatctaaacccccatcatttagactaagcgaaaaaggttcaccattggatgtgaataaggtaacagcatactttactaaaaacccggagacccagcatggcgtat

SEQ ID NO: 364517 - DNA, 140 bp, Artificial Sequence
  Synthetic
atacgccatgctgggtctccgagaagctggacaaagtggtgataaaagacaatctagaacaagggatagaagaagaaattgagttttgcaataatctgacaaagacagtgtcagaaaacccgtacttgggagtcggccat

SEQ ID NO: 364518 - DNA, 140 bp, Artificial Sequence
  Synthetic
atggccgactcccaagtacgggttttctgacactgtctttgtcagattattgcaaaactcaatttcttcttctatcccttgttctagattgtcttttatcaccactttgtccagcttctcggagacccagcatggcgtat

SEQ ID NO: 364519 - DNA, 140 bp, Artificial Sequence
  Synthetic
atacgccatgctgggtctccattcatcaagaacttgtgtagacaggtagaaatacctgctggcagtattaagaagatcttaaatgttcttaggtacaggttgtgcagcaaaggaggtgtacgtacttgggagtcggccat

SEQ ID NO: 364520 - DNA, 140 bp, Artificial Sequence
  Synthetic
atggccgactcccaagtacgtacacctcctttgctgcacaacctgtacctaagaacatttaagatcttcttaatactgccagcaggtatttctacctgtctacacaagttcttgatgaatggagacccagcatggcgtat

SEQ ID NO: 364521 - DNA, 140 bp, Artificial Sequence
  Synthetic
aggccctggctgctgatatgatgcatgcaacaactgaaatgttcagtagaaacctcttaaaaacaacatcagatgatggccttaccaacccgcatcttaaagaaacaatccttaatgtgggaccttttgggacagcggtg

SEQ ID NO: 364522 - DNA, 140 bp, Artificial Sequence
  Synthetic
caccgctgtcccaaaaggtcccacattaaggattgtttctttaagatgcgggttggtaaggccatcatctgatgttgtttttaagaggtttctactgaacatttcagttgttgcatgcatcatatcagcagccagggcct

SEQ ID NO: 364523 - DNA, 140 bp, Artificial Sequence
  Synthetic
atacgccatgctgggtctcccaccatgcaacatcttcggtgttaacttccctagctgccgtgctctttgaggagctagcaattttctaccttaagagaagcttacctcagacaacagtaccgtacttgggagtcggccat

SEQ ID NO: 364524 - DNA, 140 bp, Artificial Sequence
  Synthetic
atggccgactcccaagtacggtactgttgtctgaggtaagcttctcttaaggtagaaaattgctagctcctcaaagagcacggcagctagggaagttaacaccgaagatgttgcatggtgggagacccagcatggcgtat

SEQ ID NO: 364525 - DNA, 140 bp, Artificial Sequence
  Synthetic
atacgccatgctgggtctccgaaacacgcttgtagactcaagaactttacagctgcagtgcaaagatgctgtcaaatgaaagatagtgccaaaaccttagtgagcgactgctttcttgagcgtacttgggagtcggccat

SEQ ID NO: 364526 - DNA, 140 bp, Artificial Sequence
  Synthetic
atggccgactcccaagtacgctcaagaaagcagtcgctcactaaggttttggcactatctttcatttgacagcatctttgcactgcagctgtaaagttcttgagtctacaagcgtgtttcggagacccagcatggcgtat

SEQ ID NO: 364527 - DNA, 140 bp, Artificial Sequence
  Synthetic
atacgccatgctgggtctcctaagaagatcttgaatgtccttagatacaggttgtgcagcaaaggaggtgtagagcaatatagtgaggaggatctaaggaaactgttggcagataatttacgtacttgggagtcggccat

SEQ ID NO: 364528 - DNA, 140 bp, Artificial Sequence
  Synthetic
atggccgactcccaagtacgtaaattatctgccaacagtttccttagatcctcctcactatattgctctacacctcctttgctgcacaacctgtatctaaggacattcaagatcttcttaggagacccagcatggcgtat

SEQ ID NO: 364529 - DNA, 140 bp, Artificial Sequence
  Synthetic
atacgccatgctgggtctccttttacagtgagtttatgatgggctatagagtaacccctgctgtaataaagttcatgtttactggactgataaacagctctgtgacctctcctcagagttcgtacttgggagtcggccat

SEQ ID NO: 364530 - DNA, 140 bp, Artificial Sequence
  Synthetic
atggccgactcccaagtacgaactctgaggagaggtcacagagctgtttatcagtccagtaaacatgaactttattacagcaggggttactctatagcccatcataaactcactgtaaaaggagacccagcatggcgtat

SEQ ID NO: 364531 - DNA, 140 bp, Artificial Sequence
  Synthetic
atacgccatgctgggtctccaacacttcagatgaacagtgtatctatacagtcaagtagcttgaccacattggatagcctaggtcgttgtaggacaagttccacagccgaggatagcagccgtacttgggagtcggccat

SEQ ID NO: 364532 - DNA, 140 bp, Artificial Sequence
  Synthetic
atggccgactcccaagtacggctgctatcctcggctgtggaacttgtcctacaacgacctaggctatccaatgtggtcaagctacttgactgtatagatacactgttcatctgaagtgttggagacccagcatggcgtat

SEQ ID NO: 364533 - DNA, 140 bp, Artificial Sequence
  Synthetic
atacgccatgctgggtctccaaattcatgttcactggacttataaacagctctgtgacctctcctcagagtttgatgcaggcatgccaagtttcgtcccaacaagcaatgtataatagcgcgtacttgggagtcggccat

SEQ ID NO: 364534 - DNA, 140 bp, Artificial Sequence
  Synthetic
atggccgactcccaagtacgcgctattatacattgcttgttgggacgaaacttggcatgcctgcatcaaactctgaggagaggtcacagagctgtttataagtccagtgaacatgaatttggagacccagcatggcgtat

SEQ ID NO: 364535 - DNA, 140 bp, Artificial Sequence
  Synthetic
atacgccatgctgggtctcccttcactgcatttctgccattggatgcctacctttgagtcaggcagacaagtcttcactgcttatgagtttcctaaattggagggtgaacatggacattacgtacttgggagtcggccat

SEQ ID NO: 364536 - DNA, 140 bp, Artificial Sequence
  Synthetic
atggccgactcccaagtacgtaatgtccatgttcaccctccaatttaggaaactcataagcagtgaagacttgtctgcctgactcaaaggtaggcatccaatggcagaaatgcagtgaagggagacccagcatggcgtat

SEQ ID NO: 364537 - DNA, 140 bp, Artificial Sequence
  Synthetic
aggccctggctgctgatatgtctgtactgtgtattctgatagcagggtattacaggtcatttggaggagaaggaaccgagaaacaggtaaaggcatcattgaatagagacgacaataaaagaccttttgggacagcggtg

SEQ ID NO: 364538 - DNA, 140 bp, Artificial Sequence
  Synthetic
caccgctgtcccaaaaggtcttttattgtcgtctctattcaatgatgcctttacctgtttctcggttccttctcctccaaatgacctgtaataccctgctatcagaatacacagtacagacatatcagcagccagggcct

SEQ ID NO: 364539 - DNA, 140 bp, Artificial Sequence
  Synthetic
aggccctggctgctgatatggcagtgtgagcgacaccactgttgcttctcatgattcaggatcgtcatcctccagcttctcttttgagctcaataggcctctgtccgaaactgaactacagaccttttgggacagcggtg

SEQ ID NO: 364540 - DNA, 140 bp, Artificial Sequence
  Synthetic
caccgctgtcccaaaaggtctgtagttcagtttcggacagaggcctattgagctcaaaagagaagctggaggatgacgatcctgaatcatgagaagcaacagtggtgtcgctcacactgccatatcagcagccagggcct

SEQ ID NO: 364541 - DNA, 140 bp, Artificial Sequence
  Synthetic
atacgccatgctgggtctccttagaaaggttaggtgtttctagaatggaagtcgatgaactgatgccaagcattagtcctgatgacaccttagcccagcttgtagcgaaaaaactcatcacgtacttgggagtcggccat

SEQ ID NO: 364542 - DNA, 140 bp, Artificial Sequence
  Synthetic
atggccgactcccaagtacgtgatgagttttttcgctacaagctgggctaaggtgtcatcaggactaatgcttggcatcagttcatcgacttccattctagaaacacctaacctttctaaggagacccagcatggcgtat

SEQ ID NO: 364543 - DNA, 140 bp, Artificial Sequence
  Synthetic
atacgccatgctgggtctccacaaactatcgtgatagttgtggcaaacaattaacaggcagaataattaccaagtatactcactggttggacacttttctgggctgctctgtctccatcacgtacttgggagtcggccat

SEQ ID NO: 364544 - DNA, 140 bp, Artificial Sequence
  Synthetic
atggccgactcccaagtacgtgatggagacagagcagcccagaaaagtgtccaaccagtgagtatacttggtaattattctgcctgttaattgtttgccacaactatcacgatagtttgtggagacccagcatggcgtat

SEQ ID NO: 364545 - DNA, 140 bp, Artificial Sequence
  Synthetic
aggccctggctgctgatatgcaagtatactcactggttggacacttttctgggctgctctgtctccatcaacaggcatactactgttaaagagccctccttattcaatccaaatatcagagaccttttgggacagcggtg

SEQ ID NO: 364546 - DNA, 140 bp, Artificial Sequence
  Synthetic
caccgctgtcccaaaaggtctctgatatttggattgaataaggagggctctttaacagtagtatgcctgttgatggagacagagcagcccagaaaagtgtccaaccagtgagtatacttgcatatcagcagccagggcct

SEQ ID NO: 364547 - DNA, 140 bp, Artificial Sequence
  Synthetic
atacgccatgctgggtctccacaggcatactactgttaaagagccctccttattcaatccaaatatcagatgtgtcaacctgatcacatttgaggacggcctgagagaactatcagtaatcgtacttgggagtcggccat

SEQ ID NO: 364548 - DNA, 140 bp, Artificial Sequence
  Synthetic
atggccgactcccaagtacgattactgatagttctctcaggccgtcctcaaatgtgatcaggttgacacatctgatatttggattgaataaggagggctctttaacagtagtatgcctgtggagacccagcatggcgtat

SEQ ID NO: 364549 - DNA, 140 bp, Artificial Sequence
  Synthetic
aggccctggctgctgatatgagcatcagccctgatgacaccttagcccagcttgtggcaaaaaagcttattagcctcaatgtttcgacggaagagtactcggctgaagtgtctagacttagaccttttgggacagcggtg

SEQ ID NO: 364550 - DNA, 140 bp, Artificial Sequence
  Synthetic
caccgctgtcccaaaaggtctaagtctagacacttcagccgagtactcttccgtcgaaacattgaggctaataagcttttttgccacaagctgggctaaggtgtcatcagggctgatgctcatatcagcagccagggcct

SEQ ID NO: 364551 - DNA, 140 bp, Artificial Sequence
  Synthetic
aggccctggctgctgatatgaacaaacactaacagcccgaaatgttttgcatgggttggctggaggaattaaggagctatcgctcccaatatacacgatattcatgaaatcttacttcttgaccttttgggacagcggtg

SEQ ID NO: 364552 - DNA, 140 bp, Artificial Sequence
  Synthetic
caccgctgtcccaaaaggtcaagaagtaagatttcatgaatatcgtgtatattgggagcgatagctccttaattcctccagccaacccatgcaaaacatttcgggctgttagtgtttgttcatatcagcagccagggcct

SEQ ID NO: 364553 - DNA, 140 bp, Artificial Sequence
  Synthetic
atacgccatgctgggtctccaattctctgacccgaacagacagaaacttagaatagttgagtctagacctgcggaatctgagctagaggcaaaccgtgcagtaattgtcaagaccaaattcgtacttgggagtcggccat

SEQ ID NO: 364554 - DNA, 140 bp, Artificial Sequence
  Synthetic
atggccgactcccaagtacgaatttggtcttgacaattactgcacggtttgcctctagctcagattccgcaggtctagactcaactattctaagtttctgtctgttcgggtcagagaattggagacccagcatggcgtat

SEQ ID NO: 364555 - DNA, 140 bp, Artificial Sequence
  Synthetic
atacgccatgctgggtctcctgggctacttattggatgaatcagcaatttctgaggtcaagcctaccaaggttgacttctcgaatttacttaaagaccgcttcaaaataatgcagtttttcgtacttgggagtcggccat

SEQ ID NO: 364556 - DNA, 140 bp, Artificial Sequence
  Synthetic
atggccgactcccaagtacgaaaaactgcattattttgaagcggtctttaagtaaattcgagaagtcaaccttggtaggcttgacctcagaaattgctgattcatccaataagtagcccaggagacccagcatggcgtat

SEQ ID NO: 364557 - DNA, 140 bp, Artificial Sequence
  Synthetic
aggccctggctgctgatatgggtgtgttaacctaatcacatttgaagacggtctgagagaactatcagtaatacagagtcatctcaaagtctttgaaaatgaatttaccaacttaaacctgaccttttgggacagcggtg

SEQ ID NO: 364558 - DNA, 140 bp, Artificial Sequence
  Synthetic
caccgctgtcccaaaaggtcaggtttaagttggtaaattcattttcaaagactttgagatgactctgtattactgatagttctctcagaccgtcttcaaatgtgattaggttaacacacccatatcagcagccagggcct

SEQ ID NO: 364559 - DNA, 140 bp, Artificial Sequence
  Synthetic
atacgccatgctgggtctccaaaacgagactctgaacgagaaggtctaactgatctccttgattacctgaactctcccacagaactgttgaagaagaagccttacttagggacaacctgccgtacttgggagtcggccat

SEQ ID NO: 364560 - DNA, 140 bp, Artificial Sequence
  Synthetic
atggccgactcccaagtacggcaggttgtccctaagtaaggcttcttcttcaacagttctgtgggagagttcaggtaatcaaggagatcagttagaccttctcgttcagagtctcgttttggagacccagcatggcgtat

SEQ ID NO: 364561 - DNA, 140 bp, Artificial Sequence
  Synthetic
aggccctggctgctgatatgcatgggctatttattggatgaatcagcaatttctgaagtcaaacccaccaaagttgacttctcaaatttacttaaagatcgctttaaaataatgcagtttgaccttttgggacagcggtg

SEQ ID NO: 364562 - DNA, 140 bp, Artificial Sequence
  Synthetic
caccgctgtcccaaaaggtcaaactgcattattttaaagcgatctttaagtaaatttgagaagtcaactttggtgggtttgacttcagaaattgctgattcatccaataaatagcccatgcatatcagcagccagggcct

SEQ ID NO: 364563 - DNA, 140 bp, Artificial Sequence
  Synthetic
atacgccatgctgggtctcctcttcactgcatctctgccattggatgtttacccttgagtcaagcagacaagtcttcactgcttatgagcttcttaaactggagggttaacatggacattcgtacttgggagtcggccat

SEQ ID NO: 364564 - DNA, 140 bp, Artificial Sequence
  Synthetic
atggccgactcccaagtacgaatgtccatgttaaccctccagtttaagaagctcataagcagtgaagacttgtctgcttgactcaagggtaaacatccaatggcagagatgcagtgaagaggagacccagcatggcgtat

SEQ ID NO: 364565 - DNA, 140 bp, Artificial Sequence
  Synthetic
atacgccatgctgggtctccgtcaaagagatgctgtcagacatgattcggagaaggaaccaaattctaaacagaggtggtgatgagaatccacgtggccctgtgagccgtgagcatgtggcgtacttgggagtcggccat

SEQ ID NO: 364566 - DNA, 140 bp, Artificial Sequence
  Synthetic
atggccgactcccaagtacgccacatgctcacggctcacagggccacgtggattctcatcaccacctctgtttagaatttggttccttctccgaatcatgtctgacagcatctctttgacggagacccagcatggcgtat

SEQ ID NO: 364567 - DNA, 140 bp, Artificial Sequence
  Synthetic
aggccctggctgctgatatggagcgcagtaagcgaggaggaccgaggtgttctttcacagcactgctaggcttaatccacgaagactggcaaaagataggaaagaacatccttgttcgtggaccttttgggacagcggtg

SEQ ID NO: 364568 - DNA, 140 bp, Artificial Sequence
  Synthetic
caccgctgtcccaaaaggtccacgaacaaggatgttctttcctatcttttgccagtcttcgtggattaagcctagcagtgctgtgaaagaacacctcggtcctcctcgcttactgcgctccatatcagcagccagggcct

SEQ ID NO: 364569 - DNA, 140 bp, Artificial Sequence
  Synthetic
aggccctggctgctgatatgtgaaacgagattctgaacgcgaaggtctaactgatctccttgattatctaaactcaccaactgaactgttgaagaagaagccttacttagggacaacttggaccttttgggacagcggtg

SEQ ID NO: 364570 - DNA, 140 bp, Artificial Sequence
  Synthetic
caccgctgtcccaaaaggtccaagttgtccctaagtaaggcttcttcttcaacagttcagttggtgagtttagataatcaaggagatcagttagaccttcgcgttcagaatctcgtttcacatatcagcagccagggcct

SEQ ID NO: 364571 - DNA, 140 bp, Artificial Sequence
  Synthetic
aggccctggctgctgatatgtgaactcacccactgaactgttgaagaagaagccctatttagggacaacttgcaagttcaacacctggggtgactcaaatagatctgggaaatttacatagaccttttgggacagcggtg

SEQ ID NO: 364572 - DNA, 140 bp, Artificial Sequence
  Synthetic
caccgctgtcccaaaaggtctatgtaaatttcccagatctatttgagtcaccccaggtgttgaacttgcaagttgtccctaaatagggcttcttcttcaacagttcagtgggtgagttcacatatcagcagccagggcct

SEQ ID NO: 364573 - DNA, 140 bp, Artificial Sequence
  Synthetic
atacgccatgctgggtctccagcgagcccagattacagtgggggcatggctgcttgtccattgtttatgatgaaactgacactcagaccacataccacgaaaatcttttgaaggtgaagccgtacttgggagtcggccat

SEQ ID NO: 364574 - DNA, 140 bp, Artificial Sequence
  Synthetic
atggccgactcccaagtacggcttcaccttcaaaagattttcgtggtatgtggtctgagtgtcagtttcatcataaacaatggacaagcagccatgcccccactgtaatctgggctcgctggagacccagcatggcgtat

SEQ ID NO: 364575 - DNA, 140 bp, Artificial Sequence
  Synthetic
atacgccatgctgggtctccttttctgactccaaagtcgtcctttcaaggatcaagttcaagacagaacttctcctcaactcattgacactgctccactgtttcttgaaacatgctcctacgtacttgggagtcggccat

SEQ ID NO: 364576 - DNA, 140 bp, Artificial Sequence
  Synthetic
atggccgactcccaagtacgtaggagcatgtttcaagaaacagtggagcagtgtcaatgagttgaggagaagttctgtcttgaacttgatccttgaaaggacgactttggagtcagaaaaggagacccagcatggcgtat

SEQ ID NO: 364577 - DNA, 140 bp, Artificial Sequence
  Synthetic
atacgccatgctgggtctcctccatctctcatctgagtccattgctctgctatgtgagactgagaggcaagtgctctcttggatgagcaaaaggagaactgaggtaataactaaagaacacgtacttgggagtcggccat

SEQ ID NO: 364578 - DNA, 140 bp, Artificial Sequence
  Synthetic
atggccgactcccaagtacgtgttctttagttattacctcagttctccttttgctcatccaagagagcacttgcctctcagtctcacatagcagagcaatggactcagatgagagatggaggagacccagcatggcgtat

SEQ ID NO: 364579 - DNA, 140 bp, Artificial Sequence
  Synthetic
aggccctggctgctgatatggcagcttgttgactgctctacagataggaagaagcttttaccccagtcagtgttttctgattccaaagtcgttctctcaaggatcaagttcaagacagaggaccttttgggacagcggtg

SEQ ID NO: 364580 - DNA, 140 bp, Artificial Sequence
  Synthetic
caccgctgtcccaaaaggtcctctgtcttgaacttgatccttgagagaacgactttggaatcagaaaacactgactggggtaaaagcttcttcctatctgtagagcagtcaacaagctgccatatcagcagccagggcct

SEQ ID NO: 364581 - DNA, 140 bp, Artificial Sequence
  Synthetic
aggccctggctgctgatatgaagatcactgaatcatgctttgaccttgatgttcttagaagaggtcacattgcctgagctgaaagccttttccgttaactgtaaaatgggtagcctagaggaccttttgggacagcggtg

SEQ ID NO: 364582 - DNA, 140 bp, Artificial Sequence
  Synthetic
caccgctgtcccaaaaggtcctctaggctacccattttacagttaacggaaaaggctttcagctcaggcaatgtgacctcttctaagaacatcaaggtcaaagcatgattcagtgatcttcatatcagcagccagggcct

SEQ ID NO: 364583 - DNA, 140 bp, Artificial Sequence
  Synthetic
atacgccatgctgggtctccgttcttgcttgcattcttactttatgaggaagtattgatgaacttgatcaaccagtgtaaggcagtaaaagaactcatcaacagtacaggactctcagaccgtacttgggagtcggccat

SEQ ID NO: 364584 - DNA, 140 bp, Artificial Sequence
  Synthetic
atggccgactcccaagtacggtctgagagtcctgtactgttgatgagttcttttactgccttacactggttgatcaagttcatcaatacttcctcataaagtaagaatgcaagcaagaacggagacccagcatggcgtat

SEQ ID NO: 364585 - DNA, 140 bp, Artificial Sequence
  Synthetic
aggccctggctgctgatatgaccagtgtaaggcagtaaaagaactcatcaacagtacaggactctcagactttgaattggaaagcttacttactttatgtgctttctatttccaaaatgagaccttttgggacagcggtg

SEQ ID NO: 364586 - DNA, 140 bp, Artificial Sequence
  Synthetic
caccgctgtcccaaaaggtctcattttggaaatagaaagcacataaagtaagtaagctttccaattcaaagtctgagagtcctgtactgttgatgagttcttttactgccttacactggtcatatcagcagccagggcct

SEQ ID NO: 364587 - DNA, 140 bp, Artificial Sequence
  Synthetic
atacgccatgctgggtctccgtgcagtaagagagatggccctagatgctcttttgcagcactgttaagtttagttcatgaggattggcagaggataggtaaaaacatccttgttcgtgcacgtacttgggagtcggccat

SEQ ID NO: 364588 - DNA, 140 bp, Artificial Sequence
  Synthetic
atggccgactcccaagtacgtgcacgaacaaggatgtttttacctatcctctgccaatcctcatgaactaaacttaacagtgctgcaaaagagcatctagggccatctctcttactgcacggagacccagcatggcgtat

SEQ ID NO: 364589 - DNA, 140 bp, Artificial Sequence
  Synthetic
aggccctggctgctgatatgaagttcttgcttgcattccttctttacgaagaagtattgatgaacttaatcaaccagtgtaaggcagtaaaggaactcatcaacagtacaggactttcaggaccttttgggacagcggtg

SEQ ID NO: 364590 - DNA, 140 bp, Artificial Sequence
  Synthetic
caccgctgtcccaaaaggtcctgaaagtcctgtactgttgatgagttcctttactgccttacactggttgattaagttcatcaatacttcttcgtaaagaaggaatgcaagcaagaacttcatatcagcagccagggcct

SEQ ID NO: 364591 - DNA, 140 bp, Artificial Sequence
  Synthetic
aggccctggctgctgatatggaatgcagtaggagagatggacctagatgttcctttgcagcactattaagcctagttcatgaagattggcaaaagatagggagaaatatccttgttcgtggaccttttgggacagcggtg

SEQ ID NO: 364592 - DNA, 140 bp, Artificial Sequence
  Synthetic
caccgctgtcccaaaaggtccacgaacaaggatatttctccctatcttttgccaatcttcatgaactaggcttaatagtgctgcaaaggaacatctaggtccatctctcctactgcattccatatcagcagccagggcct

SEQ ID NO: 364593 - DNA, 140 bp, Artificial Sequence
  Synthetic
aggccctggctgctgatatgactacaacaagttgattgaccactgtgttgacatggaaaaaaagagggaagcggttagagcagtagaagatttaattttaatgttgacaggtaaagcaatgaccttttgggacagcggtg

SEQ ID NO: 364594 - DNA, 140 bp, Artificial Sequence
  Synthetic
caccgctgtcccaaaaggtcattgctttacctgtcaacattaaaattaaatcttctactgctctaaccgcttccctctttttttccatgtcaacacagtggtcaatcaacttgttgtagtcatatcagcagccagggcct

SEQ ID NO: 364595 - DNA, 140 bp, Artificial Sequence
  Synthetic
atacgccatgctgggtctccggattcagattgaacatgccgcttgtgagccattaatacccatcggtgtctcaaggaaaattgaggcagttttagccgcaccactcattgacatcaaaaccgtacttgggagtcggccat

SEQ ID NO: 364596 - DNA, 140 bp, Artificial Sequence
  Synthetic
atggccgactcccaagtacggttttgatgtcaatgagtggtgcggctaaaactgcctcaattttccttgagacaccgatgggtattaatggctcacaagcggcatgttcaatctgaatccggagacccagcatggcgtat

SEQ ID NO: 364597 - DNA, 140 bp, Artificial Sequence
  Synthetic
aggccctggctgctgatatgtgggattcagattgaacacgccatctgtactagccattaatgtctttcaatgtctcaagagcaaacgagacagtccatgccatatcagttgccaacaacagaccttttgggacagcggtg

SEQ ID NO: 364598 - DNA, 140 bp, Artificial Sequence
  Synthetic
caccgctgtcccaaaaggtctgttgttggcaactgatatggcatggactgtctcgtttgctcttgagacattgaaagacattaatggctagtacagatggcgtgttcaatctgaatcccacatatcagcagccagggcct

SEQ ID NO: 364599 - DNA, 140 bp, Artificial Sequence
  Synthetic
aggccctggctgctgatatgacgctgtcagagcagttgaggacttagtgctaatgttgacggggagagcagtgaggcccagcattgtgactccagcagcgcctgagtttgagcagtgtcagaccttttgggacagcggtg

SEQ ID NO: 364600 - DNA, 140 bp, Artificial Sequence
  Synthetic
caccgctgtcccaaaaggtctgacactgctcaaactcaggcgctgctggagtcacaatgctgggcctcactgctctccccgtcaacattagcactaagtcctcaactgctctgacagcgtcatatcagcagccagggcct

SEQ ID NO: 364601 - DNA, 140 bp, Artificial Sequence
  Synthetic
atacgccatgctgggtctccagatggccagtgccaccgatgatgcacaaaaggattccatctacgcatcagctctggtggaagcaaccaaattttgtgcacccatatacgagtgtgcctgcgtacttgggagtcggccat

SEQ ID NO: 364602 - DNA, 140 bp, Artificial Sequence
  Synthetic
atggccgactcccaagtacgcaggcacactcgtatatgggtgcacaaaatttggttgcttccaccagagctgatgcgtagatggaatccttttgtgcatcatcggtggcactggccatctggagacccagcatggcgtat

SEQ ID NO: 364603 - DNA, 140 bp, Artificial Sequence
  Synthetic
atacgccatgctgggtctcctctcaaagaaacacgtgccgcttacgcccacagtgttcacttgagtgttggcaaaatggagaataaaatcgaggtgaccagcaaggatgagatgaacaggcgtacttgggagtcggccat

SEQ ID NO: 364604 - DNA, 140 bp, Artificial Sequence
  Synthetic
atggccgactcccaagtacgcctgttcatctcatccttgctggtcacctcgattttattctccattttgccaacactcaagtgaacactgtgggcgtaagcggcacgtgtttctttgagaggagacccagcatggcgtat

SEQ ID NO: 364605 - DNA, 140 bp, Artificial Sequence
  Synthetic
aggccctggctgctgatatggcaaaatggagaataaaatcgaggtgaccagcaaggatgagatgaacaggtggtttgaagagttcaagaagagtaatggacttgtggacaccttcacaaagaccttttgggacagcggtg

SEQ ID NO: 364606 - DNA, 140 bp, Artificial Sequence
  Synthetic
caccgctgtcccaaaaggtctttgtgaaggtgtccacaagtccattactcttcttgaactcttcaaaccacctgttcatctcatccttgctggtcacctcgattttattctccattttgccatatcagcagccagggcct

SEQ ID NO: 364607 - DNA, 140 bp, Artificial Sequence
  Synthetic
atacgccatgctgggtctccatgcaggaaccattaaatcttgggatgaaagctacattgagctgaaagttgaggtccctaaaatagaacagcttgccaattaccaacaggctgctctcaacgtacttgggagtcggccat

SEQ ID NO: 364608 - DNA, 140 bp, Artificial Sequence
  Synthetic
atggccgactcccaagtacgttgagagcagcctgttggtaattggcaagctgttctattttagggacctcaactttcagctcaatgtagctttcatcccaagatttaatggttcctgcatggagacccagcatggcgtat

SEQ ID NO: 364609 - DNA, 140 bp, Artificial Sequence
  Synthetic
aggccctggctgctgatatggaggtccctaaaatagaacagcttgccaattaccaacaggctgctctcaagtggaggaaggacataggttttcgtgtcaatgcaaatacggcagccttaagaccttttgggacagcggtg

SEQ ID NO: 364610 - DNA, 140 bp, Artificial Sequence
  Synthetic
caccgctgtcccaaaaggtcttaaggctgccgtatttgcattgacacgaaaacctatgtccttcctccacttgagagcagcctgttggtaattggcaagctgttctattttagggacctccatatcagcagccagggcct

SEQ ID NO: 364611 - DNA, 140 bp, Artificial Sequence
  Synthetic
atacgccatgctgggtctccgctctagtagaggcaaccaagttttgtgcacctatatacgagtgtgcatgggtcagctccaccggcatagtcaagaaaggccttgagtggttcgaaaaaacgtacttgggagtcggccat

SEQ ID NO: 364612 - DNA, 140 bp, Artificial Sequence
  Synthetic
atggccgactcccaagtacgttttttcgaaccactcaaggcctttcttgactatgccggtggagctgacccatgcacactcgtatataggtgcacaaaacttggttgcctctactagagcggagacccagcatggcgtat

SEQ ID NO: 364613 - DNA, 140 bp, Artificial Sequence
  Synthetic
atacgccatgctgggtctccggggtccccaagatagagcagcttgcaaactaccagcaggctgctctgaagtggaggaaggatattggtttccgtgtcaatgctaatacggcagccttgacgtacttgggagtcggccat

SEQ ID NO: 364614 - DNA, 140 bp, Artificial Sequence
  Synthetic
atggccgactcccaagtacgtcaaggctgccgtattagcattgacacggaaaccaatatccttcctccacttcagagcagcctgctggtagtttgcaagctgctctatcttggggaccccggagacccagcatggcgtat

SEQ ID NO: 364615 - DNA, 140 bp, Artificial Sequence
  Synthetic
aggccctggctgctgatatgccctggggggacatcaacaagtcaggccgatcaggaatagcacttgttgcaacaggccttgccaagctcgcagagactgaggggaagggagtgtttgatggaccttttgggacagcggtg

SEQ ID NO: 364616 - DNA, 140 bp, Artificial Sequence
  Synthetic
caccgctgtcccaaaaggtccatcaaacactcccttcccctcagtctctgcgagcttggcaaggcctgttgcaacaagtgctattcctgatcggcctgacttgttgatgtccccccagggcatatcagcagccagggcct

SEQ ID NO: 364617 - DNA, 140 bp, Artificial Sequence
  Synthetic
atacgccatgctgggtctccgacgaagttgacaaagcaagtgccgacaacatgataacaaaccttctcaaacacattgctaaggcacaagagctttacaaaaactcgtctgcacttcgtgcgtacttgggagtcggccat

SEQ ID NO: 364618 - DNA, 140 bp, Artificial Sequence
  Synthetic
atggccgactcccaagtacgcacgaagtgcagacgagtttttgtaaagctcttgtgccttagcaatgtgtttgagaaggtttgttatcatgttgtcggcacttgctttgtcaacttcgtcggagacccagcatggcgtat

SEQ ID NO: 364619 - DNA, 140 bp, Artificial Sequence
  Synthetic
aggccctggctgctgatatgaatggtgcagggaatttgtcaagggcaagtacatcatggctttcaacccaccctggggagatattaacaagtcaggccgctcggggatagctcttgtcgcgaccttttgggacagcggtg

SEQ ID NO: 364620 - DNA, 140 bp, Artificial Sequence
  Synthetic
caccgctgtcccaaaaggtcgcgacaagagctatccccgagcggcctgacttgttaatatctccccagggtgggttgaaagccatgatgtacttgcccttgacaaattccctgcaccattcatatcagcagccagggcct

SEQ ID NO: 364621 - DNA, 140 bp, Artificial Sequence
  Synthetic
atacgccatgctgggtctcccacagggtgcacagattgacactgctttcagctcatactactggctctacaaggccggcgtgactccagaaaccttcccgactgtctcacagttccttttcgtacttgggagtcggccat

SEQ ID NO: 364622 - DNA, 140 bp, Artificial Sequence
  Synthetic
atggccgactcccaagtacgaaaaggaactgtgagacagtcgggaaggtttctggagtcacgccggccttgtagagccagtagtatgagctgaaagcagtgtcaatctgtgcaccctgtgggagacccagcatggcgtat

SEQ ID NO: 364623 - DNA, 140 bp, Artificial Sequence
  Synthetic
atacgccatgctgggtctccaagccaaaaaaactgttgaggaccttaatgggtatttggataagcacaaggatgaggttgacaaggccagtgctgacggcatggtgacaaacctcctcaacgtacttgggagtcggccat

SEQ ID NO: 364624 - DNA, 140 bp, Artificial Sequence
  Synthetic
atggccgactcccaagtacgttgaggaggtttgtcaccatgccgtcagcactggccttgtcaacctcatccttgtgcttatccaaatacccattaaggtcctcaacagtttttttggcttggagacccagcatggcgtat

SEQ ID NO: 364625 - DNA, 140 bp, Artificial Sequence
  Synthetic
atacgccatgctgggtctcctagtgccttgtttgggaagcagataaacaagcttcagaactgcttcagaaccataagccccgtcagcttacttgcattaagaaatctggactttgactgtcgtacttgggagtcggccat

SEQ ID NO: 364626 - DNA, 140 bp, Artificial Sequence
  Synthetic
atggccgactcccaagtacgacagtcaaagtccagatttcttaatgcaagtaagctgacggggcttatggttctgaagcagttctgaagcttgtttatctgcttcccaaacaaggcactaggagacccagcatggcgtat

SEQ ID NO: 364627 - DNA, 140 bp, Artificial Sequence
  Synthetic
atacgccatgctgggtctcctggcagaatcagtgagatgggtgtctgctttggaacaatccctgtggccaatcccgatgatgctgcccagggatctggacacaccaagtccattcttaaccgtacttgggagtcggccat

SEQ ID NO: 364628 - DNA, 140 bp, Artificial Sequence
  Synthetic
atggccgactcccaagtacggttaagaatggacttggtgtgtccagatccctgggcagcatcatcgggattggccacagggattgttccaaagcagacacccatctcactgattctgccaggagacccagcatggcgtat

SEQ ID NO: 364629 - DNA, 140 bp, Artificial Sequence
  Synthetic
aggccctggctgctgatatgatcccgatgatgctgcccagggatctggacacaccaagtccattcttaacctacggacaaacaccgaaaccaacaatccgtgtgccaagacaattgtcaagaccttttgggacagcggtg

SEQ ID NO: 364630 - DNA, 140 bp, Artificial Sequence
  Synthetic
caccgctgtcccaaaaggtcttgacaattgtcttggcacacggattgttggtttcggtgtttgtccgtaggttaagaatggacttggtgtgtccagatccctgggcagcatcatcgggatcatatcagcagccagggcct

SEQ ID NO: 364631 - DNA, 140 bp, Artificial Sequence
  Synthetic
aggccctggctgctgatatggacggcatagagagcaacatgaagcagttatttgctatactacctcctgactgtgcaagagaatgtgaggtcctctttgatgacataagaaactctccaagaccttttgggacagcggtg

SEQ ID NO: 364632 - DNA, 140 bp, Artificial Sequence
  Synthetic
caccgctgtcccaaaaggtcttggagagtttcttatgtcatcaaagaggacctcacattctcttgcacagtcaggaggtagtatagcaaataactgcttcatgttgctctctatgccgtccatatcagcagccagggcct

SEQ ID NO: 364633 - DNA, 140 bp, Artificial Sequence
  Synthetic
atacgccatgctgggtctccaccctgatgacgctgcccagggatcaggacacaccaagtccattctcaaccttcggacaaacacagagactaacaatccatgtgctaagacaattgttaacgtacttgggagtcggccat

SEQ ID NO: 364634 - DNA, 140 bp, Artificial Sequence
  Synthetic
atggccgactcccaagtacgttaacaattgtcttagcacatggattgttagtctctgtgtttgtccgaaggttgagaatggacttggtgtgtcctgatccctgggcagcgtcatcagggtggagacccagcatggcgtat

SEQ ID NO: 364635 - DNA, 140 bp, Artificial Sequence
  Synthetic
atacgccatgctgggtctcctctatgattgtaaccatcaacaatgtttattttaactgcttatataatcctgttttattaacttcttcttgtttctttcgtttaaacacttaaagggctgcgtacttgggagtcggccat

SEQ ID NO: 364636 - DNA, 140 bp, Artificial Sequence
  Synthetic
atggccgactcccaagtacgcagccctttaagtgtttaaacgaaagaaacaagaagaagttaataaaacaggattatataagcagttaaaataaacattgttgatggttacaatcatagaggagacccagcatggcgtat

SEQ ID NO: 364637 - DNA, 140 bp, Artificial Sequence
  Synthetic
atacgccatgctgggtctcctggcctctgaacatctgctgcatcagtctcttgttggaaagcagtctcctttccagaatgcctacaatgtcaaaggcaacgccaccagtgccaacattatcgtacttgggagtcggccat

SEQ ID NO: 364638 - DNA, 140 bp, Artificial Sequence
  Synthetic
atggccgactcccaagtacgataatgttggcactggtggcgttgcctttgacattgtaggcattctggaaaggagactgctttccaacaagagactgatgcagcagatgttcagaggccaggagacccagcatggcgtat

SEQ ID NO: 364639 - DNA, 140 bp, Artificial Sequence
  Synthetic
atacgccatgctgggtctccctcatggactgtccaacaaaacccaacacagtaatacaagcaccacaaaggcgcctgaagtaagccaggaatttggattgcctgtgagcacagtatcgaccgtacttgggagtcggccat

SEQ ID NO: 364640 - DNA, 140 bp, Artificial Sequence
  Synthetic
atggccgactcccaagtacggtcgatactgtgctcacaggcaatccaaattcctggcttacttcaggcgcctttgtggtgcttgtattactgtgttgggttttgttggacagtccatgagggagacccagcatggcgtat

SEQ ID NO: 364641 - DNA, 140 bp, Artificial Sequence
  Synthetic
atacgccatgctgggtctcctcagaaaagaatggccttagtccagatttgcaacaagttgcaagatactcaaaccacttgaccttgctcagtaggatgatacaacaagcaaagccaactgcgtacttgggagtcggccat

SEQ ID NO: 364642 - DNA, 140 bp, Artificial Sequence
  Synthetic
atggccgactcccaagtacgcagttggctttgcttgttgtatcatcctactgagcaaggtcaagtggtttgagtatcttgcaacttgttgcaaatctggactaaggccattcttttctgaggagacccagcatggcgtat

SEQ ID NO: 364643 - DNA, 140 bp, Artificial Sequence
  Synthetic
aggccctggctgctgatatggtagtgctttcttgcctttgttggaccatggaacttttgaaaaaccttaactggactcaggtgattgctggtcaatatgttaccaaccctaggtttaacagaccttttgggacagcggtg

SEQ ID NO: 364644 - DNA, 140 bp, Artificial Sequence
  Synthetic
caccgctgtcccaaaaggtctgttaaacctagggttggtaacatattgaccagcaatcacctgagtccagttaaggtttttcaaaagttccatggtccaacaaaggcaagaaagcactaccatatcagcagccagggcct

SEQ ID NO: 364645 - DNA, 140 bp, Artificial Sequence
  Synthetic
atacgccatgctgggtctcctgcatcaagcactgtcgtcgtcgatgtcagcacacagacggtcaaggacacccccatatcaacaacccacacaagtttgcccagtactcctagcgcgccacgtacttgggagtcggccat

SEQ ID NO: 364646 - DNA, 140 bp, Artificial Sequence
  Synthetic
atggccgactcccaagtacgtggcgcgctaggagtactgggcaaacttgtgtgggttgttgatatgggggtgtccttgaccgtctgtgtgctgacatcgacgacgacagtgcttgatgcaggagacccagcatggcgtat

SEQ ID NO: 364647 - DNA, 140 bp, Artificial Sequence
  Synthetic
atacgccatgctgggtctcccagcacaaagccagaaggagcatcaacacaagcaaatccagaaaaaataagcatggagaccaatagcccgcgcctagccatcagcgagacaccatccttccgtacttgggagtcggccat

SEQ ID NO: 364648 - DNA, 140 bp, Artificial Sequence
  Synthetic
atggccgactcccaagtacggaaggatggtgtctcgctgatggctaggcgcgggctattggtctccatgcttattttttctggatttgcttgtgttgatgctccttctggctttgtgctgggagacccagcatggcgtat

SEQ ID NO: 364649 - DNA, 140 bp, Artificial Sequence
  Synthetic
aggccctggctgctgatatgaagagcctgaagccaagcttattggtttaagtttggatgattatcttaagaggatgctatctgacaacgaatggggatcaactcttgaggcatccatgctgaccttttgggacagcggtg

SEQ ID NO: 364650 - DNA, 140 bp, Artificial Sequence
  Synthetic
caccgctgtcccaaaaggtcagcatggatgcctcaagagttgatccccattcgttgtcagatagcatcctcttaagataatcatccaaacttaaaccaataagcttggcttcaggctcttcatatcagcagccagggcct

SEQ ID NO: 364651 - DNA, 140 bp, Artificial Sequence
  Synthetic
atacgccatgctgggtctccacagctcatactctcagcacaaccagtaaccccaaacccagtgacccctccagtacagccagccctctctcagagtgacacgtccacggccatccaggatcgtacttgggagtcggccat

SEQ ID NO: 364652 - DNA, 140 bp, Artificial Sequence
  Synthetic
atggccgactcccaagtacgatcctggatggccgtggacgtgtcactctgagagagggctggctgtactggaggggtcactgggtttggggttactggttgtgctgagagtatgagctgtggagacccagcatggcgtat

SEQ ID NO: 364653 - DNA, 140 bp, Artificial Sequence
  Synthetic
atacgccatgctgggtctccatgaggtaggagcaggcttgaagtttggcgatggtgatgtgttcacagctgtgaatcttctacattctgggcagacgcactttgatgcacttagaatactcgtacttgggagtcggccat

SEQ ID NO: 364654 - DNA, 140 bp, Artificial Sequence
  Synthetic
atggccgactcccaagtacgagtattctaagtgcatcaaagtgcgtctgcccagaatgtagaagattcacagctgtgaacacatcaccatcgccaaacttcaagcctgctcctacctcatggagacccagcatggcgtat

SEQ ID NO: 364655 - DNA, 140 bp, Artificial Sequence
  Synthetic
aggccctggctgctgatatggtgaatcttctacattctgggcagacgcactttgatgcacttagaatactgccacagtttgaggccgacacaaaagagaccttaagtctggtggacaggggaccttttgggacagcggtg

SEQ ID NO: 364656 - DNA, 140 bp, Artificial Sequence
  Synthetic
caccgctgtcccaaaaggtcccctgtccaccagacttaaggtctcttttgtgtcggcctcaaactgtggcagtattctaagtgcatcaaagtgcgtctgcccagaatgtagaagattcaccatatcagcagccagggcct

SEQ ID NO: 364657 - DNA, 140 bp, Artificial Sequence
  Synthetic
atacgccatgctgggtctccaattttgactttatctcagggtttgaagaagtactacggcaagatactaaaacttctggaccttactttggaagaagacactgaaggcctgctagagtggcgtacttgggagtcggccat

SEQ ID NO: 364658 - DNA, 140 bp, Artificial Sequence
  Synthetic
atggccgactcccaagtacgccactctagcaggccttcagtgtcttcttccaaagtaaggtccagaagttttagtatcttgccgtagtacttcttcaaaccctgagataaagtcaaaattggagacccagcatggcgtat

SEQ ID NO: 364659 - DNA, 140 bp, Artificial Sequence
  Synthetic
atacgccatgctgggtctcctatgaagaccttgccttagcactcacaggttcagaagagccttatagaaagtctagtctagatgaggttactttgtccaaaaagcaggcagaaatacttacgtacttgggagtcggccat

SEQ ID NO: 364660 - DNA, 140 bp, Artificial Sequence
  Synthetic
atggccgactcccaagtacgtaagtatttctgcctgctttttggacaaagtaacctcatctagactagactttctataaggctcttctgaacctgtgagtgctaaggcaaggtcttcataggagacccagcatggcgtat

SEQ ID NO: 364661 - DNA, 140 bp, Artificial Sequence
  Synthetic
atacgccatgctgggtctccaatagaagagttttttttgactggggagggtcacttcaatgaagtcttacagttcaaaacaccaagcacactaagccccacgggaccagcccgaactgggcgtacttgggagtcggccat

SEQ ID NO: 364662 - DNA, 140 bp, Artificial Sequence
  Synthetic
atggccgactcccaagtacgcccagttcgggctggtcccgtggggcttagtgtgcttggtgttttgaactgtaagacttcattgaagtgaccctccccagtcaaaaaaaactcttctattggagacccagcatggcgtat

SEQ ID NO: 364663 - DNA, 140 bp, Artificial Sequence
  Synthetic
aggccctggctgctgatatgagttcaaaacaccaagcacactaagccccacgggaccagcccgaactgggtcaccaacagtggaaccttttaaatcttacttcgctaaagggttcctttcgaccttttgggacagcggtg

SEQ ID NO: 364664 - DNA, 140 bp, Artificial Sequence
  Synthetic
caccgctgtcccaaaaggtcgaaaggaaccctttagcgaagtaagatttaaaaggttccactgttggtgacccagttcgggctggtcccgtggggcttagtgtgcttggtgttttgaactcatatcagcagccagggcct

SEQ ID NO: 364665 - DNA, 140 bp, Artificial Sequence
  Synthetic
atacgccatgctgggtctcctcaccaacagtggaaccttttaaatcttacttcgctaaagggttcctttcaatggactcaggctacttctctgccaagtgttatccaagagcatccaattcgtacttgggagtcggccat

SEQ ID NO: 364666 - DNA, 140 bp, Artificial Sequence
  Synthetic
atggccgactcccaagtacgaattggatgctcttggataacacttggcagagaagtagcctgagtccattgaaaggaaccctttagcgaagtaagatttaaaaggttccactgttggtgaggagacccagcatggcgtat

SEQ ID NO: 364667 - DNA, 140 bp, Artificial Sequence
  Synthetic
atacgccatgctgggtctcctgttgagatttctgccgacaccttgatcttgcggccagaatccaaggaaagaattggggaagttatgtcattgcggcagctaggacataaattgctaacacgtacttgggagtcggccat

SEQ ID NO: 364668 - DNA, 140 bp, Artificial Sequence
  Synthetic
atggccgactcccaagtacgtgttagcaatttatgtcctagctgccgcaatgacataacttccccaattctttccttggattctggccgcaagatcaaggtgtcggcagaaatctcaacaggagacccagcatggcgtat

SEQ ID NO: 364669 - DNA, 140 bp, Artificial Sequence
  Synthetic
atacgccatgctgggtctccggagattgagttctgcaataacctaaccaaaactgtttcagagaacccgctgcctctcagctgttggtctgaagttcaaaattatattgaagatataggccgtacttgggagtcggccat

SEQ ID NO: 364670 - DNA, 140 bp, Artificial Sequence
  Synthetic
atggccgactcccaagtacggcctatatcttcaatataattttgaacttcagaccaacagctgagaggcagcgggttctctgaaacagttttggttaggttattgcagaactcaatctccggagacccagcatggcgtat

SEQ ID NO: 364671 - DNA, 140 bp, Artificial Sequence
  Synthetic
atacgccatgctgggtctccacacctggacccaaggtcactaatctgaagaccatcaattgcataaacttaaaggcatcagtctttaaagagcatagagagattgaaatcaatgttcttccgtacttgggagtcggccat

SEQ ID NO: 364672 - DNA, 140 bp, Artificial Sequence
  Synthetic
atggccgactcccaagtacggaagaacattgatttcaatctctctatgctctttaaagactgatgcctttaagtttatgcaattgatggtcttcagattagtgaccttgggtccaggtgtggagacccagcatggcgtat

SEQ ID NO: 364673 - DNA, 140 bp, Artificial Sequence
  Synthetic
atacgccatgctgggtctccttcctggaacaggaatagagaggcatatgcagttgctacactcagaaatgatactagacatttgcactgtatcacttggtgttatgttgtcaacattcctcgtacttgggagtcggccat

SEQ ID NO: 364674 - DNA, 140 bp, Artificial Sequence
  Synthetic
atggccgactcccaagtacgaggaatgttgacaacataacaccaagtgatacagtgcaaatgtctagtatcatttctgagtgtagcaactgcatatgcctctctattcctgttccaggaaggagacccagcatggcgtat

SEQ ID NO: 364675 - DNA, 140 bp, Artificial Sequence
  Synthetic
aggccctggctgctgatatgatactagacatttgcactgtatcacttggtgttatgttgtcaacattcctttatggctctaataacaagaataaaaagaagtttatcactaactgtctgcgaccttttgggacagcggtg

SEQ ID NO: 364676 - DNA, 140 bp, Artificial Sequence
  Synthetic
caccgctgtcccaaaaggtcgcagacagttagtgataaacttctttttattcttgttattagagccataaaggaatgttgacaacataacaccaagtgatacagtgcaaatgtctagtatcatatcagcagccagggcct

SEQ ID NO: 364677 - DNA, 140 bp, Artificial Sequence
  Synthetic
atacgccatgctgggtctccacaaaaaaaacaaacaaaatgacagatgcactttgatcaccaactgtgtaataaaaggaagggaaattcgtaagggccagtcagtgttaagacaatacagcgtacttgggagtcggccat

SEQ ID NO: 364678 - DNA, 140 bp, Artificial Sequence
  Synthetic
atggccgactcccaagtacgctgtattgtcttaacactgactggcccttacgaatttcccttccttttattacacagttggtgatcaaagtgcatctgtcattttgtttgttttttttgtggagacccagcatggcgtat

SEQ ID NO: 364679 - DNA, 140 bp, Artificial Sequence
  Synthetic
atacgccatgctgggtctccgggaatgagcttttgtacaagtcgcccagaaaggctctggcaaccgtttgcagtgctttgtttgggaagcaggtgaccaagctccagaactgtttcagaacgtacttgggagtcggccat

SEQ ID NO: 364680 - DNA, 140 bp, Artificial Sequence
  Synthetic
atggccgactcccaagtacgttctgaaacagttctggagcttggtcacctgcttcccaaacaaagcactgcaaacggttgccagagcctttctgggcgacttgtacaaaagctcattcccggagacccagcatggcgtat

SEQ ID NO: 364681 - DNA, 140 bp, Artificial Sequence
  Synthetic
atacgccatgctgggtctcccaccggtgtagcattaaaaagaagcagctggctgattgtgctgcttgtgctgtttgcagtttcattatcaccagttcaatcagcacccattggtcatgggcgtacttgggagtcggccat

SEQ ID NO: 364682 - DNA, 140 bp, Artificial Sequence
  Synthetic
atggccgactcccaagtacgcccatgaccaatgggtgctgattgaactggtgataatgaaactgcaaacagcacaagcagcacaatcagccagctgcttctttttaatgctacaccggtgggagacccagcatggcgtat

SEQ ID NO: 364683 - DNA, 140 bp, Artificial Sequence
  Synthetic
atacgccatgctgggtctccgagactgcggaaattcacagtgataactatggtggtccaggtgacaagataaccatctgcaatggttcaactattgtagatcagagattgggcagtgaaccgtacttgggagtcggccat

SEQ ID NO: 364684 - DNA, 140 bp, Artificial Sequence
  Synthetic
atggccgactcccaagtacggttcactgcccaatctctgatctacaatagttgaaccattgcagatggttatcttgtcacctggaccaccatagttatcactgtgaatttccgcagtctcggagacccagcatggcgtat

SEQ ID NO: 364685 - DNA, 140 bp, Artificial Sequence
  Synthetic
atacgccatgctgggtctcccaacactgatgttgagtttaaccacagggagatagccgacctgaatcagttaacttctcgacttagtacgctaagaaaagagaaagacactgatctcctccgtacttgggagtcggccat

SEQ ID NO: 364686 - DNA, 140 bp, Artificial Sequence
  Synthetic
atggccgactcccaagtacggaggagatcagtgtctttctcttttcttagcgtactaagtcgagaagttaactgattcaggtcggctatctccctgtggttaaactcaacatcagtgttgggagacccagcatggcgtat

SEQ ID NO: 364687 - DNA, 140 bp, Artificial Sequence
  Synthetic
aggccctggctgctgatatgtaacttctcgacttagtacgctaagaaaagagaaagacactgatctcctcaagcagtggtttcctgagagtgacatcacccgcagaagcacaagaaacatgaccttttgggacagcggtg

SEQ ID NO: 364688 - DNA, 140 bp, Artificial Sequence
  Synthetic
caccgctgtcccaaaaggtcatgtttcttgtgcttctgcgggtgatgtcactctcaggaaaccactgcttgaggagatcagtgtctttctcttttcttagcgtactaagtcgagaagttacatatcagcagccagggcct

SEQ ID NO: 364689 - DNA, 140 bp, Artificial Sequence
  Synthetic
atacgccatgctgggtctccagtgccacaggtaaatcctgtgaaatagatagcaccccaattaaatgcaggcagggtttttgtttaaaaattactcaggagggaaggggccacgtgaagccgtacttgggagtcggccat

SEQ ID NO: 364690 - DNA, 140 bp, Artificial Sequence
  Synthetic
atggccgactcccaagtacggcttcacgtggccccttccctcctgagtaatttttaaacaaaaaccctgcctgcatttaattggggtgctatctatttcacaggatttacctgtggcactggagacccagcatggcgtat

SEQ ID NO: 364691 - DNA, 140 bp, Artificial Sequence
  Synthetic
atacgccatgctgggtctccttatgaagtttattagtacttcaggaagggcaatgagtgcaggtaaggttggtaatgtcctctcctatgcacacaacctctatctgagtaaatctagtttcgtacttgggagtcggccat

SEQ ID NO: 364692 - DNA, 140 bp, Artificial Sequence
  Synthetic
atggccgactcccaagtacgaaactagatttactcagatagaggttgtgtgcataggagaggacattaccaaccttacctgcactcattgcccttcctgaagtactaataaacttcataaggagacccagcatggcgtat

SEQ ID NO: 364693 - DNA, 140 bp, Artificial Sequence
  Synthetic
atacgccatgctgggtctccataatgataccaaagggcactggagacatcctagttgactgttcaggtggacagcaacatttcttaaaagataacttgattgatctgggatgcccaaacacgtacttgggagtcggccat

SEQ ID NO: 364694 - DNA, 140 bp, Artificial Sequence
  Synthetic
atggccgactcccaagtacgtgtttgggcatcccagatcaatcaagttatcttttaagaaatgttgctgtccacctgaacagtcaactaggatgtctccagtgccctttggtatcattatggagacccagcatggcgtat

SEQ ID NO: 364695 - DNA, 140 bp, Artificial Sequence
  Synthetic
atacgccatgctgggtctcctcccactattaggtaagatggctatctacatttgtagaatgtcaaatcatcctaaaacgactatggcttttcttttttggtttagctttggttatgtgatcgtacttgggagtcggccat

SEQ ID NO: 364696 - DNA, 140 bp, Artificial Sequence
  Synthetic
atggccgactcccaagtacgatcacataaccaaagctaaaccaaaaaagaaaagccatagtcgttttaggatgatttgacattctacaaatgtagatagccatcttacctaatagtgggaggagacccagcatggcgtat

SEQ ID NO: 364697 - DNA, 140 bp, Artificial Sequence
  Synthetic
atacgccatgctgggtctccgatggtatagaaagcaacatgaaacagttatttgccatactacctcctgactgtgcaaaagagtgtgaggtcctctttgacgacataagaaactctccaacgtacttgggagtcggccat

SEQ ID NO: 364698 - DNA, 140 bp, Artificial Sequence
  Synthetic
atggccgactcccaagtacgttggagagtttcttatgtcgtcaaagaggacctcacactcttttgcacagtcaggaggtagtatggcaaataactgtttcatgttgctttctataccatcggagacccagcatggcgtat

SEQ ID NO: 364699 - DNA, 140 bp, Artificial Sequence
  Synthetic
aggccctggctgctgatatgctgtgcaaaagagtgtgaggtcctctttgacgacataagaaactctccaacgcacagcacagcctggaaacatgccctccgattgaaggggactgcatatgaccttttgggacagcggtg

SEQ ID NO: 364700 - DNA, 140 bp, Artificial Sequence
  Synthetic
caccgctgtcccaaaaggtcatatgcagtccccttcaatcggagggcatgtttccaggctgtgctgtgcgttggagagtttcttatgtcgtcaaagaggacctcacactcttttgcacagcatatcagcagccagggcct

SEQ ID NO: 364701 - DNA, 140 bp, Artificial Sequence
  Synthetic
atacgccatgctgggtctcccgttgggaaaaaagttcaaacagtatagagagttgaaacctcagacctgtaccatatgcgaaacaactcctgttaatgcaatagatgctgaaatgcacgacgtacttgggagtcggccat

SEQ ID NO: 364702 - DNA, 140 bp, Artificial Sequence
  Synthetic
atggccgactcccaagtacgtcgtgcatttcagcatctattgcattaacaggagttgtttcgcatatggtacaggtctgaggtttcaactctctatactgtttgaacttttttcccaacgggagacccagcatggcgtat

SEQ ID NO: 364703 - DNA, 140 bp, Artificial Sequence
  Synthetic
aggccctggctgctgatatgaccatatgcgaaacaactcctgttaatgcaatagatgctgaaatgcacgacctcaactgcagttacaatatatgtccttactgtgcatctaggttaacctgaccttttgggacagcggtg

SEQ ID NO: 364704 - DNA, 140 bp, Artificial Sequence
  Synthetic
caccgctgtcccaaaaggtcaggttaacctagatgcacagtaaggacatatattgtaactgcagttgaggtcgtgcatttcagcatctattgcattaacaggagttgtttcgcatatggtcatatcagcagccagggcct

SEQ ID NO: 364705 - DNA, 140 bp, Artificial Sequence
  Synthetic
atacgccatgctgggtctccaaaaccgagtttgaccatgctgatacaaaccttgttccctgacaaattcgaagatttcttggatcgaactcagctacacccagaattcagagacttaacacgtacttgggagtcggccat

SEQ ID NO: 364706 - DNA, 140 bp, Artificial Sequence
  Synthetic
atggccgactcccaagtacgtgttaagtctctgaattctgggtgtagctgagttcgatccaagaaatcttcgaatttgtcagggaacaaggtttgtatcagcatggtcaaactcggttttggagacccagcatggcgtat

SEQ ID NO: 364707 - DNA, 140 bp, Artificial Sequence
  Synthetic
aggccctggctgctgatatgaagatttcttggatcgaactcagctacacccagaattcagagacttaacacctgacttttccctgactcaaaaggttcatttcaagagaaaccagataccgaccttttgggacagcggtg

SEQ ID NO: 364708 - DNA, 140 bp, Artificial Sequence
  Synthetic
caccgctgtcccaaaaggtcggtatctggtttctcttgaaatgaaccttttgagtcagggaaaagtcaggtgttaagtctctgaattctgggtgtagctgagttcgatccaagaaatcttcatatcagcagccagggcct

SEQ ID NO: 364709 - DNA, 140 bp, Artificial Sequence
  Synthetic
atacgccatgctgggtctccgtagaagaaaccgaattatacttaaacttagaaagaatcccctgggttgttaggaaattactgcaggtgtcagaatccaccggtgtggcactaaagaggacgtacttgggagtcggccat

SEQ ID NO: 364710 - DNA, 140 bp, Artificial Sequence
  Synthetic
atggccgactcccaagtacgtcctctttagtgccacaccggtggattctgacacctgcagtaatttcctaacaacccaggggattctttctaagtttaagtataattcggtttcttctacggagacccagcatggcgtat

SEQ ID NO: 364711 - DNA, 140 bp, Artificial Sequence
  Synthetic
atacgccatgctgggtctcctggaagcagtgccggtgacagaaagaaagatgttccctctacctgagactcctctgagcgaagtgcactcaatagagcatatcatggaaaacttcacacgcgtacttgggagtcggccat

SEQ ID NO: 364712 - DNA, 140 bp, Artificial Sequence
  Synthetic
atggccgactcccaagtacgcgtgtgaagttttccatgatatgctctattgagtgcacttcgctcagaggagtctcaggtagagggaacatctttctttctgtcaccggcactgcttccaggagacccagcatggcgtat

SEQ ID NO: 364713 - DNA, 140 bp, Artificial Sequence
  Synthetic
aggccctggctgctgatatgcctctgagcgaagtgcactcaatagagcatatcatggaaaacttcacacgacttatgcatggagggaaaccttcagcaatgaaaagaaatgcagaaccgagaccttttgggacagcggtg

SEQ ID NO: 364714 - DNA, 140 bp, Artificial Sequence
  Synthetic
caccgctgtcccaaaaggtctcggttctgcatttcttttcattgctgaaggtttccctccatgcataagtcgtgtgaagttttccatgatatgctctattgagtgcacttcgctcagaggcatatcagcagccagggcct

SEQ ID NO: 364715 - DNA, 140 bp, Artificial Sequence
  Synthetic
atacgccatgctgggtctccatggctttcaaagattatggagaaaggggcatagttgaggagaatcatatgatatttagcgaagaagatcaactagaaacgaggcagctactgttagtagcgtacttgggagtcggccat

SEQ ID NO: 364716 - DNA, 140 bp, Artificial Sequence
  Synthetic
atggccgactcccaagtacgctactaacagtagctgcctcgtttctagttgatcttcttcgctaaatatcatatgattctcctcaactatgcccctttctccataatctttgaaagccatggagacccagcatggcgtat

SEQ ID NO: 364717 - DNA, 140 bp, Artificial Sequence
  Synthetic
aggccctggctgctgatatggatatttagcgaagaagatcaactagaaacgaggcagctactgttagtagaggttggctttcagactgatattgatgggaaaataaggacagaccacaaagaccttttgggacagcggtg

SEQ ID NO: 364718 - DNA, 140 bp, Artificial Sequence
  Synthetic
caccgctgtcccaaaaggtctttgtggtctgtccttattttcccatcaatatcagtctgaaagccaacctctactaacagtagctgcctcgtttctagttgatcttcttcgctaaatatccatatcagcagccagggcct

SEQ ID NO: 364719 - DNA, 140 bp, Artificial Sequence
  Synthetic
atacgccatgctgggtctccagcatctgcaagaaaaggaagactgggagtaatgtcatgttggccgtctgtaagcgcatgtgctttagggcaactgtggaagtaagcaacaaggctctaccgtacttgggagtcggccat

SEQ ID NO: 364720 - DNA, 140 bp, Artificial Sequence
  Synthetic
atggccgactcccaagtacggtagagccttgttgcttacttccacagttgccctaaagcacatgcgcttacagacggccaacatgacattactcccagtcttccttttcttgcagatgctggagacccagcatggcgtat

SEQ ID NO: 364721 - DNA, 140 bp, Artificial Sequence
  Synthetic
atacgccatgctgggtctccattcattgcttgtgcagactgctcgtccacaccaccggacaggtggtggattacagaagatagggtgcgagtcttaaaaaattcagtcagtttcctcttccgtacttgggagtcggccat

SEQ ID NO: 364722 - DNA, 140 bp, Artificial Sequence
  Synthetic
atggccgactcccaagtacggaagaggaaactgactgaattttttaagactcgcaccctatcttctgtaatccaccacctgtccggtggtgtggacgagcagtctgcacaagcaatgaatggagacccagcatggcgtat

SEQ ID NO: 364723 - DNA, 140 bp, Artificial Sequence
  Synthetic
aggccctggctgctgatatgttacagaagatagggtgcgagtcttaaaaaattcagtcagtttcctcttcaacaaactctccagaaactcaccaacagaggtgactgatatagttgttgggaccttttgggacagcggtg

SEQ ID NO: 364724 - DNA, 140 bp, Artificial Sequence
  Synthetic
caccgctgtcccaaaaggtcccaacaactatatcagtcacctctgttggtgagtttctggagagtttgttgaagaggaaactgactgaattttttaagactcgcaccctatcttctgtaacatatcagcagccagggcct

SEQ ID NO: 364725 - DNA, 140 bp, Artificial Sequence
  Synthetic
atacgccatgctgggtctcctggcacttgggagagagaggaagatctgacaaatttctgtcatcaagaatgccaagtcactgagactgaatgcctctgtccttacgaagctcttgtgctccgtacttgggagtcggccat

SEQ ID NO: 364726 - DNA, 140 bp, Artificial Sequence
  Synthetic
atggccgactcccaagtacggagcacaagagcttcgtaaggacagaggcattcagtctcagtgacttggcattcttgatgacagaaatttgtcagatcttcctctctctcccaagtgccaggagacccagcatggcgtat

SEQ ID NO: 364727 - DNA, 140 bp, Artificial Sequence
  Synthetic
atacgccatgctgggtctcccaaagacccctgtgtcaacaaaggatgttttagaaacctgggaaaagatgaaagaacacatactcaatagacccacagggctaacactgcctgctagtttcgtacttgggagtcggccat

SEQ ID NO: 364728 - DNA, 140 bp, Artificial Sequence
  Synthetic
atggccgactcccaagtacgaaactagcaggcagtgttagccctgtgggtctattgagtatgtgttctttcatcttttcccaggtttctaaaacatcctttgttgacacaggggtctttgggagacccagcatggcgtat

SEQ ID NO: 364729 - DNA, 140 bp, Artificial Sequence
  Synthetic
aggccctggctgctgatatgaaagaacacatactcaatagacccacagggctaacactgcctgctagtttagaacaggcaatgcgcaaaggactagtcgaaggtgtggtaatttcaaaaggaccttttgggacagcggtg

SEQ ID NO: 364730 - DNA, 140 bp, Artificial Sequence
  Synthetic
caccgctgtcccaaaaggtccttttgaaattaccacaccttcgactagtcctttgcgcattgcctgttctaaactagcaggcagtgttagccctgtgggtctattgagtatgtgttctttcatatcagcagccagggcct

SEQ ID NO: 364731 - DNA, 140 bp, Artificial Sequence
  Synthetic
atacgccatgctgggtctccgataattgaagaccccatgattcaactgatacctgagaaattgagaagagagttagaaaggttaggcgtgtctagaatggaggtcgatgagttgatgcctcgtacttgggagtcggccat

SEQ ID NO: 364732 - DNA, 140 bp, Artificial Sequence
  Synthetic
atggccgactcccaagtacgaggcatcaactcatcgacctccattctagacacgcctaacctttctaactctcttctcaatttctcaggtatcagttgaatcatggggtcttcaattatcggagacccagcatggcgtat

SEQ ID NO: 364733 - DNA, 140 bp, Artificial Sequence
  Synthetic
aggccctggctgctgatatgctcctattccttttgtgagagtgttccaaatttggacaagtttgtgttccaaatggccagtgccactgatgatgcacaaaaggattctatctacgcgtctgaccttttgggacagcggtg

SEQ ID NO: 364734 - DNA, 140 bp, Artificial Sequence
  Synthetic
caccgctgtcccaaaaggtcagacgcgtagatagaatccttttgtgcatcatcagtggcactggccatttggaacacaaacttgtccaaatttggaacactctcacaaaaggaataggagcatatcagcagccagggcct

SEQ ID NO: 364735 - DNA, 140 bp, Artificial Sequence
  Synthetic
atacgccatgctgggtctccgctcttagttggagctcagtggaacacaggggtaataagattttggtttcaggtagatcagagtcaattatgaagctagaggaaaggacaggaatcagctcgtacttgggagtcggccat

SEQ ID NO: 364736 - DNA, 140 bp, Artificial Sequence
  Synthetic
atggccgactcccaagtacgagctgattcctgtcctttcctctagcttcataattgactctgatctacctgaaaccaaaatcttattacccctgtgttccactgagctccaactaagagcggagacccagcatggcgtat

SEQ ID NO: 364737 - DNA, 140 bp, Artificial Sequence
  Synthetic
aggccctggctgctgatatgcaccactagtgagaaaatgctattgagttggttgagtgaagacataaagtcaacaagatgtgatgagtgtcttgccaccataaagaagactattgatgaagaccttttgggacagcggtg

SEQ ID NO: 364738 - DNA, 140 bp, Artificial Sequence
  Synthetic
caccgctgtcccaaaaggtcttcatcaatagtcttctttatggtggcaagacactcatcacatcttgttgactttatgtcttcactcaaccaactcaatagcattttctcactagtggtgcatatcagcagccagggcct

SEQ ID NO: 364739 - DNA, 140 bp, Artificial Sequence
  Synthetic
aggccctggctgctgatatgtgatagacaagtggaggaatggcccaaggcaacctgcacaggagattgcccagaaagatgtggctgcacatcatcaacctgcctacacaaagaatggcccgaccttttgggacagcggtg

SEQ ID NO: 364740 - DNA, 140 bp, Artificial Sequence
  Synthetic
caccgctgtcccaaaaggtcgggccattctttgtgtaggcaggttgatgatgtgcagccacatctttctgggcaatctcctgtgcaggttgccttgggccattcctccacttgtctatcacatatcagcagccagggcct

SEQ ID NO: 364741 - DNA, 140 bp, Artificial Sequence
  Synthetic
aggccctggctgctgatatgcatctaatgttggcaagaggtgccctaaattagaggtagtcagtcattgtgaaaacaaaggctttgaagacagcaatgaatgcctaacagatttagataggaccttttgggacagcggtg

SEQ ID NO: 364742 - DNA, 140 bp, Artificial Sequence
  Synthetic
caccgctgtcccaaaaggtcctatctaaatctgttaggcattcattgctgtcttcaaagcctttgttttcacaatgactgactacctctaatttagggcacctcttgccaacattagatgcatatcagcagccagggcct

SEQ ID NO: 364743 - DNA, 140 bp, Artificial Sequence
  Synthetic
atacgccatgctgggtctcctggatgtacctgctgtgggctggatgtaaaagacctttttacagattacatgtttgtcaagtggaaagttgagtacattaaaacagaagctatagtgtgtcgtacttgggagtcggccat

SEQ ID NO: 364744 - DNA, 140 bp, Artificial Sequence
  Synthetic
atggccgactcccaagtacgacacactatagcttctgttttaatgtactcaactttccacttgacaaacatgtaatctgtaaaaaggtcttttacatccagcccacagcaggtacatccaggagacccagcatggcgtat

SEQ ID NO: 364745 - DNA, 140 bp, Artificial Sequence
  Synthetic
atacgccatgctgggtctccagcgcaatgtggagtacctaataaaattgatgatgagcatgtcaggcatcgactgtatcaagtatcccacaggtcagcttatcacccatggaagggtgagcgtacttgggagtcggccat

SEQ ID NO: 364746 - DNA, 140 bp, Artificial Sequence
  Synthetic
atggccgactcccaagtacgctcacccttccatgggtgataagctgacctgtgggatacttgatacagtcgatgcctgacatgctcatcatcaattttattaggtactccacattgcgctggagacccagcatggcgtat

SEQ ID NO: 364747 - DNA, 140 bp, Artificial Sequence
  Synthetic
aggccctggctgctgatatggactgtatcaagtatcccacaggtcagcttatcacccatggaagggtgagtgcaaaacacagcaatgaaagcttgagagatagaagtgatgatgaccagagaccttttgggacagcggtg

SEQ ID NO: 364748 - DNA, 140 bp, Artificial Sequence
  Synthetic
caccgctgtcccaaaaggtctctggtcatcatcacttctatctctcaagctttcattgctgtgttttgcactcacccttccatgggtgataagctgacctgtgggatacttgatacagtccatatcagcagccagggcct

SEQ ID NO: 364749 - DNA, 140 bp, Artificial Sequence
  Synthetic
aggccctggctgctgatatgagttcatgaggattggcaaaagataggaaaaaatatccttgttcgtgcaaacaatgagctaggtgatgtgtcactaaaggttaacattgtcttagtgcctgaccttttgggacagcggtg

SEQ ID NO: 364750 - DNA, 140 bp, Artificial Sequence
  Synthetic
caccgctgtcccaaaaggtcaggcactaagacaatgttaacctttagtgacacatcacctagctcattgtttgcacgaacaaggatattttttcctatcttttgccaatcctcatgaactcatatcagcagccagggcct

SEQ ID NO: 364751 - DNA, 140 bp, Artificial Sequence
  Synthetic
atacgccatgctgggtctccctgaaagactattctacttatgcaagaggtgtgatctcaaattcgcttaagaacctctcgaagcaaggtaaatctaagtgttctgtgccaagatcttggccgtacttgggagtcggccat

SEQ ID NO: 364752 - DNA, 140 bp, Artificial Sequence
  Synthetic
atggccgactcccaagtacggccaagatcttggcacagaacacttagatttaccttgcttcgagaggttcttaagcgaatttgagatcacacctcttgcataagtagaatagtctttcagggagacccagcatggcgtat

SEQ ID NO: 364753 - DNA, 140 bp, Artificial Sequence
  Synthetic
atacgccatgctgggtctccagtatgtaagctacagagttgcacacatggtgtgccaggggacctacaggtctaccacataggaaacttgttaaaaggagacaaggtgaatgggcacctgcgtacttgggagtcggccat

SEQ ID NO: 364754 - DNA, 140 bp, Artificial Sequence
  Synthetic
atggccgactcccaagtacgcaggtgcccattcaccttgtctccttttaacaagtttcctatgtggtagacctgtaggtcccctggcacaccatgtgtgcaactctgtagcttacatactggagacccagcatggcgtat

SEQ ID NO: 364755 - DNA, 140 bp, Artificial Sequence
  Synthetic
atacgccatgctgggtctcctaacgacaaactgctcataaggtccaaagaagaaataaaaaaatactttgatactcaatccctcaagttgatgaaaaacaagcagcctataccctttcagcgtacttgggagtcggccat

SEQ ID NO: 364756 - DNA, 140 bp, Artificial Sequence
  Synthetic
atggccgactcccaagtacgctgaaagggtataggctgcttgtttttcatcaacttgagggattgagtatcaaagtatttttttatttcttctttggaccttatgagcagtttgtcgttaggagacccagcatggcgtat

SEQ ID NO: 364757 - DNA, 140 bp, Artificial Sequence
  Synthetic
aggccctggctgctgatatgatactcaatccctcaagttgatgaaaaacaagcagcctataccctttcaggctgactgcatactatttaaagaagtagcggctgaatgcatgaagaggtagaccttttgggacagcggtg

SEQ ID NO: 364758 - DNA, 140 bp, Artificial Sequence
  Synthetic
caccgctgtcccaaaaggtctacctcttcatgcattcagccgctacttctttaaatagtatgcagtcagcctgaaagggtataggctgcttgtttttcatcaacttgagggattgagtatcatatcagcagccagggcct

SEQ ID NO: 364759 - DNA, 140 bp, Artificial Sequence
  Synthetic
aggccctggctgctgatatgatcgaaactgattatacaaaaatcttccactttcactctaagagagttactgcacatggagacacaccacaattagatttgaaagctagaccaacttatggaccttttgggacagcggtg

SEQ ID NO: 364760 - DNA, 140 bp, Artificial Sequence
  Synthetic
caccgctgtcccaaaaggtccataagttggtctagctttcaaatctaattgtggtgtgtctccatgtgcagtaactctcttagagtgaaagtggaagatttttgtataatcagtttcgatcatatcagcagccagggcct

SEQ ID NO: 364761 - DNA, 140 bp, Artificial Sequence
  Synthetic
atacgccatgctgggtctccacgtattaacaagattcacttggtttcaagatgtcgtactctacggtaaaatatgtgagacgtttcttaggtgctgcacagagttcaatagatcaggagtcgtacttgggagtcggccat

SEQ ID NO: 364762 - DNA, 140 bp, Artificial Sequence
  Synthetic
atggccgactcccaagtacgactcctgatctattgaactctgtgcagcacctaagaaacgtctcacatattttaccgtagagtacgacatcttgaaaccaagtgaatcttgttaatacgtggagacccagcatggcgtat

SEQ ID NO: 364763 - DNA, 140 bp, Artificial Sequence
  Synthetic
aggccctggctgctgatatgatatgtgagacgtttcttaggtgctgcacagagttcaatagatcaggagttaaattagtgaaggtaagacactgtgacatcaacttgtcagttaaactgcgaccttttgggacagcggtg

SEQ ID NO: 364764 - DNA, 140 bp, Artificial Sequence
  Synthetic
caccgctgtcccaaaaggtcgcagtttaactgacaagttgatgtcacagtgtcttaccttcactaatttaactcctgatctattgaactctgtgcagcacctaagaaacgtctcacatatcatatcagcagccagggcct

SEQ ID NO: 364765 - DNA, 140 bp, Artificial Sequence
  Synthetic
aggccctggctgctgatatgtagatgagcctgatgagcttacagtacatgtgaagagtgaagacccagacatagttgctgctagctcaagtctcatggctagaaaacttgaatttgggacgaccttttgggacagcggtg

SEQ ID NO: 364766 - DNA, 140 bp, Artificial Sequence
  Synthetic
caccgctgtcccaaaaggtcgtcccaaattcaagttttctagccatgagacttgagctagcagcaactatgtctgggtcttcactcttcacatgtactgtaagctcatcaggctcatctacatatcagcagccagggcct

SEQ ID NO: 364767 - DNA, 140 bp, Artificial Sequence
  Synthetic
atacgccatgctgggtctccgagctcttgcaagggcctttctacctgaacagaagacaagccgttcttggttcttcatacctttatattgtcatcacactttatatacaagtcctgcagccgtacttgggagtcggccat

SEQ ID NO: 364768 - DNA, 140 bp, Artificial Sequence
  Synthetic
atggccgactcccaagtacggctgcaggacttgtatataaagtgtgatgacaatataaaggtatgaagaaccaagaacggcttgtcttctgttcaggtagaaaggcccttgcaagagctcggagacccagcatggcgtat

SEQ ID NO: 364769 - DNA, 140 bp, Artificial Sequence
  Synthetic
aggccctggctgctgatatgttcttcatacctttatattgtcatcacactttatatacaagtcctgcagcagtacaggtgtctagaagtcataaacagtatgaacgagaagacactgcaggaccttttgggacagcggtg

SEQ ID NO: 364770 - DNA, 140 bp, Artificial Sequence
  Synthetic
caccgctgtcccaaaaggtcctgcagtgtcttctcgttcatactgtttatgacttctagacacctgtactgctgcaggacttgtatataaagtgtgatgacaatataaaggtatgaagaacatatcagcagccagggcct

SEQ ID NO: 364771 - DNA, 140 bp, Artificial Sequence
  Synthetic
atacgccatgctgggtctcctttacattgtggagagagaatattgtaaaagctgcagtaaagaagatacacaaaaatgtgtcaacacaaagcttgagcaaccacagagcattttaattgacgtacttgggagtcggccat

SEQ ID NO: 364772 - DNA, 140 bp, Artificial Sequence
  Synthetic
atggccgactcccaagtacgtcaattaaaatgctctgtggttgctcaagctttgtgttgacacatttttgtgtatcttctttactgcagcttttacaatattctctctccacaatgtaaaggagacccagcatggcgtat

SEQ ID NO: 364773 - DNA, 140 bp, Artificial Sequence
  Synthetic
aggccctggctgctgatatgcaaaaatgtgtcaacacaaagcttgagcaaccacagagcattttaattgagcacaaaggaacgataattggtaagcaaaacgacacctgcacatctaaaggaccttttgggacagcggtg

SEQ ID NO: 364774 - DNA, 140 bp, Artificial Sequence
  Synthetic
caccgctgtcccaaaaggtcctttagatgtgcaggtgtcgttttgcttaccaattatcgttcctttgtgctcaattaaaatgctctgtggttgctcaagctttgtgttgacacatttttgcatatcagcagccagggcct

SEQ ID NO: 364775 - DNA, 140 bp, Artificial Sequence
  Synthetic
atacgccatgctgggtctcccaccactgcccttgaaggcaggtttgaagagtcctataagatacgagcttcaaggtgcaaagccagtgggaactttctaaacagaagcagcagagatcatcgtacttgggagtcggccat

SEQ ID NO: 364776 - DNA, 140 bp, Artificial Sequence
  Synthetic
atggccgactcccaagtacgatgatctctgctgcttctgtttagaaagttcccactggctttgcaccttgaagctcgtatcttataggactcttcaaacctgccttcaagggcagtggtgggagacccagcatggcgtat

SEQ ID NO: 364777 - DNA, 140 bp, Artificial Sequence
  Synthetic
aggccctggctgctgatatgcaaggtgcaaagccagtgggaactttctaaacagaagcagcagagatcattttataagtgttgtatcaggcttgaatctggtctatggtttcctcataaagaccttttgggacagcggtg

SEQ ID NO: 364778 - DNA, 140 bp, Artificial Sequence
  Synthetic
caccgctgtcccaaaaggtctttatgaggaaaccatagaccagattcaagcctgatacaacacttataaaatgatctctgctgcttctgtttagaaagttcccactggctttgcaccttgcatatcagcagccagggcct

SEQ ID NO: 364779 - DNA, 140 bp, Artificial Sequence
  Synthetic
atacgccatgctgggtctccatgcttagtggcatttttggcaatgttttcatagggattttcttattccttgctccttttatccttttaatacttttctttatgtttggatggagaatcccgtacttgggagtcggccat

SEQ ID NO: 364780 - DNA, 140 bp, Artificial Sequence
  Synthetic
atggccgactcccaagtacgggattctccatccaaacataaagaaaagtattaaaaggataaaaggagcaaggaataagaaaatccctatgaaaacattgccaaaaatgccactaagcatggagacccagcatggcgtat

SEQ ID NO: 364781 - DNA, 140 bp, Artificial Sequence
  Synthetic
aggccctggctgctgatatgtgctccttttatccttttaatacttttctttatgtttggatggagaatcctgttctgctttaaatgttgcagaagaactagaggcctatttaagtacagagaccttttgggacagcggtg

SEQ ID NO: 364782 - DNA, 140 bp, Artificial Sequence
  Synthetic
caccgctgtcccaaaaggtctctgtacttaaataggcctctagttcttctgcaacatttaaagcagaacaggattctccatccaaacataaagaaaagtattaaaaggataaaaggagcacatatcagcagccagggcct

SEQ ID NO: 364783 - DNA, 140 bp, Artificial Sequence
  Synthetic
atacgccatgctgggtctccttcggtttggcatgcttgcagggcttagtaggctcgtctgtcctaatgagctggggaaaaagttttccacaagttgtagaagaattgaagacaacatcgccgtacttgggagtcggccat

SEQ ID NO: 364784 - DNA, 140 bp, Artificial Sequence
  Synthetic
atggccgactcccaagtacggcgatgttgtcttcaattcttctacaacttgtggaaaactttttccccagctcattaggacagacgagcctactaagccctgcaagcatgccaaaccgaaggagacccagcatggcgtat

SEQ ID NO: 364785 - DNA, 140 bp, Artificial Sequence
  Synthetic
aggccctggctgctgatatgctggggaaaaagttttccacaagttgtagaagaattgaagacaacatcgcaagactttatctacagacgtcaatatactgctcagttagagacgtggagggaccttttgggacagcggtg

SEQ ID NO: 364786 - DNA, 140 bp, Artificial Sequence
  Synthetic
caccgctgtcccaaaaggtccctccacgtctctaactgagcagtatattgacgtctgtagataaagtcttgcgatgttgtcttcaattcttctacaacttgtggaaaactttttccccagcatatcagcagccagggcct

SEQ ID NO: 364787 - DNA, 140 bp, Artificial Sequence
  Synthetic
aggccctggctgctgatatggaacaacaaaaaagggaaaaacaaactgcttgatggtgaaagattagctgataggaagattgctgagctgttctccacaaagacacacattggctaaatcgaccttttgggacagcggtg

SEQ ID NO: 364788 - DNA, 140 bp, Artificial Sequence
  Synthetic
caccgctgtcccaaaaggtcgatttagccaatgtgtgtctttgtggagaacagctcagcaatcttcctatcagctaatctttcaccatcaagcagtttgtttttcccttttttgttgttccatatcagcagccagggcct

SEQ ID NO: 364789 - DNA, 140 bp, Artificial Sequence
  Synthetic
atacgccatgctgggtctcccgaactggggaagcaaccaaggggtaccaagaaaatgaagaaggcactcttgagcactccaatgaagtgggggaagaagctctatgagctctttgctgatcgtacttgggagtcggccat

SEQ ID NO: 364790 - DNA, 140 bp, Artificial Sequence
  Synthetic
atggccgactcccaagtacgatcagcaaagagctcatagagcttcttcccccacttcattggagtgctcaagagtgccttcttcattttcttggtaccccttggttgcttccccagttcgggagacccagcatggcgtat

SEQ ID NO: 364791 - DNA, 140 bp, Artificial Sequence
  Synthetic
atacgccatgctgggtctccccttgcttcacagtctatggcacctttgttaacagtgacagacaattgatctttgacatttacaatgtgcacatatacaacaaggaaatggacaactttgcgtacttgggagtcggccat

SEQ ID NO: 364792 - DNA, 140 bp, Artificial Sequence
  Synthetic
atggccgactcccaagtacgcaaagttgtccatttccttgttgtatatgtgcacattgtaaatgtcaaagatcaattgtctgtcactgttaacaaaggtgccatagactgtgaagcaaggggagacccagcatggcgtat

SEQ ID NO: 364793 - DNA, 140 bp, Artificial Sequence
  Synthetic
atacgccatgctgggtctcccttgtgctagtttcaccgaccgcacccatatcacactgtcattgcaacaagttacttttaatccgtttcattatatccgcaagcaagctctgcaataccccgtacttgggagtcggccat

SEQ ID NO: 364794 - DNA, 140 bp, Artificial Sequence
  Synthetic
atggccgactcccaagtacggggtattgcagagcttgcttgcggatataatgaaacggattaaaagtaacttgttgcaatgacagtgtgatatgggtgcggtcggtgaaactagcacaagggagacccagcatggcgtat

SEQ ID NO: 364795 - DNA, 140 bp, Artificial Sequence
  Synthetic
aggccctggctgctgatatggttacttttaatccgtttcattatatccgcaagcaagctctgcaatacccaataccgccatcactctatttactctgacctaaaccttgactgcgtgccggaccttttgggacagcggtg

SEQ ID NO: 364796 - DNA, 140 bp, Artificial Sequence
  Synthetic
caccgctgtcccaaaaggtccggcacgcagtcaaggtttaggtcagagtaaatagagtgatggcggtattgggtattgcagagcttgcttgcggatataatgaaacggattaaaagtaaccatatcagcagccagggcct

SEQ ID NO: 364797 - DNA, 140 bp, Artificial Sequence
  Synthetic
atacgccatgctgggtctcctagaaatgcaaggcttctactgggttgcccaaatgtaaggaaagcagcaaacaaagaagggaagaggctactaaagttaaatagtgacacatctactgatcgtacttgggagtcggccat

SEQ ID NO: 364798 - DNA, 140 bp, Artificial Sequence
  Synthetic
atggccgactcccaagtacgatcagtagatgtgtcactatttaactttagtagcctcttcccttctttgtttgctgctttccttacatttgggcaacccagtagaagccttgcatttctaggagacccagcatggcgtat

SEQ ID NO: 364799 - DNA, 140 bp, Artificial Sequence
  Synthetic
aggccctggctgctgatatggtagtggttctttgtccttattaaaccatggacttcttaagaaaccttgactggactcaggtgattgctggtcagcatgtgaccaatcccaggttcaatagaccttttgggacagcggtg

SEQ ID NO: 364800 - DNA, 140 bp, Artificial Sequence
  Synthetic
caccgctgtcccaaaaggtctattgaacctgggattggtcacatgctgaccagcaatcacctgagtccagtcaaggtttcttaagaagtccatggtttaataaggacaaagaaccactaccatatcagcagccagggcct

SEQ ID NO: 364801 - DNA, 140 bp, Artificial Sequence
  Synthetic
atacgccatgctgggtctccctggactcaggtgattgctggtcagcatgtgaccaatcccaggttcaatatctccgattactttgagattgtgcggcagcctggtgatgggaactgctttcgtacttgggagtcggccat

SEQ ID NO: 364802 - DNA, 140 bp, Artificial Sequence
  Synthetic
atggccgactcccaagtacgaaagcagttcccatcaccaggctgccgcacaatctcaaagtaatcggagatattgaacctgggattggtcacatgctgaccagcaatcacctgagtccagggagacccagcatggcgtat

SEQ ID NO: 364803 - DNA, 140 bp, Artificial Sequence
  Synthetic
atacgccatgctgggtctcccatttgaactgaggtcaggccttgaagtctttaacgaccctttcaatgactatcagcaggcaataacagatatatgtcaattttctgagtacacgcccaacgtacttgggagtcggccat

SEQ ID NO: 364804 - DNA, 140 bp, Artificial Sequence
  Synthetic
atggccgactcccaagtacgttgggcgtgtactcagaaaattgacatatatctgttattgcctgctgatagtcattgaaagggtcgttaaagacttcaaggcctgacctcagttcaaatgggagacccagcatggcgtat

SEQ ID NO: 364805 - DNA, 140 bp, Artificial Sequence
  Synthetic
atacgccatgctgggtctccccataacatcaaacacctaactgaggtggcagcacggaagtattaccaagaagaacctgaagctaagcttattggcctgagtctggaagactatcttaagcgtacttgggagtcggccat

SEQ ID NO: 364806 - DNA, 140 bp, Artificial Sequence
  Synthetic
atggccgactcccaagtacgcttaagatagtcttccagactcaggccaataagcttagcttcaggttcttcttggtaatacttccgtgctgccacctcagttaggtgtttgatgttatggggagacccagcatggcgtat

SEQ ID NO: 364807 - DNA, 140 bp, Artificial Sequence
  Synthetic
aggccctggctgctgatatgaagaacctgaagctaagcttattggcctgagtctggaagactatcttaagaggatgttatctgacaacgaatggggatcgactcttgaggcgtccatgttgaccttttgggacagcggtg

SEQ ID NO: 364808 - DNA, 140 bp, Artificial Sequence
  Synthetic
caccgctgtcccaaaaggtcaacatggacgcctcaagagtcgatccccattcgttgtcagataacatcctcttaagatagtcttccagactcaggccaataagcttagcttcaggttcttcatatcagcagccagggcct

SEQ ID NO: 364809 - DNA, 140 bp, Artificial Sequence
  Synthetic
atacgccatgctgggtctccatgagtaaatttcctcctgagaatatagataaggcaagaagagatccaaagaactgggttagcatctctgaggtgacagaaacaacaagtatagttgcatcgtacttgggagtcggccat

SEQ ID NO: 364810 - DNA, 140 bp, Artificial Sequence
  Synthetic
atggccgactcccaagtacgatgcaactatacttgttgtttctgtcacctcagagatgctaacccagttctttggatctcttcttgccttatctatattctcaggaggaaatttactcatggagacccagcatggcgtat

SEQ ID NO: 364811 - DNA, 140 bp, Artificial Sequence
  Synthetic
atacgccatgctgggtctccacgaagtggaagcaggcataaagttcggagatggtgatgtttttacagccgtgaaccttctgcactccggacaaacacactttgatgctctcagaatactcgtacttgggagtcggccat

SEQ ID NO: 364812 - DNA, 140 bp, Artificial Sequence
  Synthetic
atggccgactcccaagtacgagtattctgagagcatcaaagtgtgtttgtccggagtgcagaaggttcacggctgtaaaaacatcaccatctccgaactttatgcctgcttccacttcgtggagacccagcatggcgtat

SEQ ID NO: 364813 - DNA, 140 bp, Artificial Sequence
  Synthetic
atacgccatgctgggtctcctgagctaggaaaacagccaagaggtaccaagaaaatgaagaaggctctgctgagcaccccaatgaagtgggggaagaaactttatgaactctttgccgaccgtacttgggagtcggccat

SEQ ID NO: 364814 - DNA, 140 bp, Artificial Sequence
  Synthetic
atggccgactcccaagtacggtcggcaaagagttcataaagtttcttcccccacttcattggggtgctcagcagagccttcttcattttcttggtacctcttggctgttttcctagctcaggagacccagcatggcgtat

SEQ ID NO: 364815 - DNA, 140 bp, Artificial Sequence
  Synthetic
atacgccatgctgggtctcccggtgccgtctcaacaaatatagaaatcgggaaaagagactgcttggatctgcttagtactgtggatggtctaacagatcagcaaaaggaaaacattgtgcgtacttgggagtcggccat

SEQ ID NO: 364816 - DNA, 140 bp, Artificial Sequence
  Synthetic
atggccgactcccaagtacgcacaatgttttccttttgctgatctgttagaccatccacagtactaagcagatccaagcagtctcttttcccgatttctatatttgttgagacggcaccgggagacccagcatggcgtat

SEQ ID NO: 364817 - DNA, 140 bp, Artificial Sequence
  Synthetic
atacgccatgctgggtctcctatgaagaccttgctttagcacttactagtgcggaagaaccgtatagacggtctagtctggatgaggtcaccctgtccaagaaacaagcagagatactgacgtacttgggagtcggccat

SEQ ID NO: 364818 - DNA, 140 bp, Artificial Sequence
  Synthetic
atggccgactcccaagtacgtcagtatctctgcttgtttcttggacagggtgacctcatccagactagaccgtctatacggttcttccgcactagtaagtgctaaagcaaggtcttcataggagacccagcatggcgtat

SEQ ID NO: 364819 - DNA, 140 bp, Artificial Sequence
  Synthetic
aggccctggctgctgatatggtctagtctggatgaggtcaccctgtccaagaaacaagcagagatactgaggcagaaggcctctcagttgtctaaactggtcaataaaagtcagaacatagaccttttgggacagcggtg

SEQ ID NO: 364820 - DNA, 140 bp, Artificial Sequence
  Synthetic
caccgctgtcccaaaaggtctatgttctgacttttattgaccagtttagacaactgagaggccttctgcctcagtatctctgcttgtttcttggacagggtgacctcatccagactagaccatatcagcagccagggcct

SEQ ID NO: 364821 - DNA, 140 bp, Artificial Sequence
  Synthetic
atacgccatgctgggtctcctcttctgctggttaaaaacaatatcttcctcagttaaaggaagcttaaagaagaaactcagattcatgaacatacattctccagaactgatgccagaaaacgtacttgggagtcggccat

SEQ ID NO: 364822 - DNA, 140 bp, Artificial Sequence
  Synthetic
atggccgactcccaagtacgttttctggcatcagttctggagaatgtatgttcatgaatctgagtttcttctttaagcttcctttaactgaggaagatattgtttttaaccagcagaagaggagacccagcatggcgtat

SEQ ID NO: 364823 - DNA, 140 bp, Artificial Sequence
  Synthetic
atacgccatgctgggtctcctgttgaaatatcagctgacactctaattctgcgaccagaatctaaggaaagaattggtgaagttatgtcgttgcggcagctagggcacaagttgctaacacgtacttgggagtcggccat

SEQ ID NO: 364824 - DNA, 140 bp, Artificial Sequence
  Synthetic
atggccgactcccaagtacgtgttagcaacttgtgccctagctgccgcaacgacataacttcaccaattctttccttagattctggtcgcagaattagagtgtcagctgatatttcaacaggagacccagcatggcgtat

SEQ ID NO: 364825 - DNA, 140 bp, Artificial Sequence
  Synthetic
aggccctggctgctgatatggaattggtgaagttatgtcgttgcggcagctagggcacaagttgctaacacgagataaacaaattaagcaggaattctctagaatgaagctctacgttacgaccttttgggacagcggtg

SEQ ID NO: 364826 - DNA, 140 bp, Artificial Sequence
  Synthetic
caccgctgtcccaaaaggtcgtaacgtagagcttcattctagagaattcctgcttaatttgtttatctcgtgttagcaacttgtgccctagctgccgcaacgacataacttcaccaattccatatcagcagccagggcct

SEQ ID NO: 364827 - DNA, 140 bp, Artificial Sequence
  Synthetic
atacgccatgctgggtctccatatcttcctgggtcaagtgcataacagcatgtaaggattttgcaaacatcaatgaaaaagttcaaaagttcatttaccgcctctctgaagagctatatgcgtacttgggagtcggccat

SEQ ID NO: 364828 - DNA, 140 bp, Artificial Sequence
  Synthetic
atggccgactcccaagtacgcatatagctcttcagagaggcggtaaatgaacttttgaactttttcattgatgtttgcaaaatccttacatgctgttatgcacttgacccaggaagatatggagacccagcatggcgtat

SEQ ID NO: 364829 - DNA, 140 bp, Artificial Sequence
  Synthetic
atacgccatgctgggtctcctccctggaacaggaatagaaagacatatgcagttgctacactctgaaatgatactagacatttgtactgtgtcacttggcgtcatgttatcaacattcttcgtacttgggagtcggccat

SEQ ID NO: 364830 - DNA, 140 bp, Artificial Sequence
  Synthetic
atggccgactcccaagtacgaagaatgttgataacatgacgccaagtgacacagtacaaatgtctagtatcatttcagagtgtagcaactgcatatgtctttctattcctgttccagggaggagacccagcatggcgtat

SEQ ID NO: 364831 - DNA, 140 bp, Artificial Sequence
  Synthetic
atacgccatgctgggtctcccttcctcaagcagcacaatcaggaaattatggaaacagtaaatctcattttctttgctgcactttcagctccctggtgcttacactataaagcactagagcgtacttgggagtcggccat

SEQ ID NO: 364832 - DNA, 140 bp, Artificial Sequence
  Synthetic
atggccgactcccaagtacgctctagtgctttatagtgtaagcaccagggagctgaaagtgcagcaaagaaaatgagatttactgtttccataatttcctgattgtgctgcttgaggaagggagacccagcatggcgtat

SEQ ID NO: 364833 - DNA, 140 bp, Artificial Sequence
  Synthetic
aggccctggctgctgatatgtctttgctgcactttcagctccctggtgcttacactataaagcactagagtcttatctagtgaggcatccagagatacttgactgtggttcaaaagaggagaccttttgggacagcggtg

SEQ ID NO: 364834 - DNA, 140 bp, Artificial Sequence
  Synthetic
caccgctgtcccaaaaggtctcctcttttgaaccacagtcaagtatctctggatgcctcactagataagactctagtgctttatagtgtaagcaccagggagctgaaagtgcagcaaagacatatcagcagccagggcct

SEQ ID NO: 364835 - DNA, 140 bp, Artificial Sequence
  Synthetic
atacgccatgctgggtctcccttagtgtgcaagactacaatggtatgatagaaaatatgtccaaattggataacactgacgttgagtttaaccacagggaaatagccgatctcaaccaatcgtacttgggagtcggccat

SEQ ID NO: 364836 - DNA, 140 bp, Artificial Sequence
  Synthetic
atggccgactcccaagtacgattggttgagatcggctatttccctgtggttaaactcaacgtcagtgttatccaatttggacatattttctatcataccattgtagtcttgcacactaagggagacccagcatggcgtat

SEQ ID NO: 364837 - DNA, 140 bp, Artificial Sequence
  Synthetic
aggccctggctgctgatatgggctttctagtgaagtacgctgtcactctgttcacatccaatggtgagccgttctcactcagcctaaacgatggtggcttggatcttgatctgcataagagaccttttgggacagcggtg

SEQ ID NO: 364838 - DNA, 140 bp, Artificial Sequence
  Synthetic
caccgctgtcccaaaaggtctcttatgcagatcaagatccaagccaccatcgtttaggctgagtgagaacggctcaccattggatgtgaacagagtgacagcgtacttcactagaaagcccatatcagcagccagggcct

SEQ ID NO: 364839 - DNA, 140 bp, Artificial Sequence
  Synthetic
atacgccatgctgggtctccggcctttcagggaatggttatgacttcatctggaccacccagatgattgcaaatagcaactttaatgtctgcaagaggttgactggaaggagtactggggcgtacttgggagtcggccat

SEQ ID NO: 364840 - DNA, 140 bp, Artificial Sequence
  Synthetic
atggccgactcccaagtacgccccagtactccttccagtcaacctcttgcagacattaaagttgctatttgcaatcatctgggtggtccagatgaagtcataaccattccctgaaaggccggagacccagcatggcgtat

SEQ ID NO: 364841 - DNA, 140 bp, Artificial Sequence
  Synthetic
aggccctggctgctgatatgaaatagcaactttaatgtctgcaagaggttgactggaaggagtactggggagaggctcccaagaagtgtcaggagcaaggtcatttatgaaatggtcaaagaccttttgggacagcggtg

SEQ ID NO: 364842 - DNA, 140 bp, Artificial Sequence
  Synthetic
caccgctgtcccaaaaggtctttgaccatttcataaatgaccttgctcctgacacttcttgggagcctctccccagtactccttccagtcaacctcttgcagacattaaagttgctatttcatatcagcagccagggcct

SEQ ID NO: 364843 - DNA, 140 bp, Artificial Sequence
  Synthetic
atacgccatgctgggtctcctatatgctctacaagaagattctgaagtcgagccaatagccataatttgtgacggcatagagagcaacatgaagcagttatttgctatactacctcctgacgtacttgggagtcggccat

SEQ ID NO: 364844 - DNA, 140 bp, Artificial Sequence
  Synthetic
atggccgactcccaagtacgtcaggaggtagtatagcaaataactgcttcatgttgctctctatgccgtcacaaattatggctattggctcgacttcagaatcttcttgtagagcatataggagacccagcatggcgtat

SEQ ID NO: 364845 - DNA, 140 bp, Artificial Sequence
  Synthetic
aggccctggctgctgatatgagttgggaggagcaagagatctgttggtgcaagaaactggtacaaaagttatgcatgcaactactgagatgttcagtagaaatcttttaaaaacaacttcgaccttttgggacagcggtg

SEQ ID NO: 364846 - DNA, 140 bp, Artificial Sequence
  Synthetic
caccgctgtcccaaaaggtcgaagttgtttttaaaagatttctactgaacatctcagtagttgcatgcataacttttgtaccagtttcttgcaccaacagatctcttgctcctcccaactcatatcagcagccagggcct

SEQ ID NO: 364847 - DNA, 140 bp, Artificial Sequence
  Synthetic
atacgccatgctgggtctccgagggtctgtttgccaactgctatggatggcaatatatcccagaagacattaaaccaagtttaaccatgttgatacagacattgttccctgacaaatttgcgtacttgggagtcggccat

SEQ ID NO: 364848 - DNA, 140 bp, Artificial Sequence
  Synthetic
atggccgactcccaagtacgcaaatttgtcagggaacaatgtctgtatcaacatggttaaacttggtttaatgtcttctgggatatattgccatccatagcagttggcaaacagaccctcggagacccagcatggcgtat

SEQ ID NO: 364849 - DNA, 140 bp, Artificial Sequence
  Synthetic
aggccctggctgctgatatggagggcagcagtttagtcaatttttataaggtcatttgcatctcaggtgataacaccaaatgggggccaattcactgctgttcctttttctccggtatgagaccttttgggacagcggtg

SEQ ID NO: 364850 - DNA, 140 bp, Artificial Sequence
  Synthetic
caccgctgtcccaaaaggtctcataccggagaaaaaggaacagcagtgaattggcccccatttggtgttatcacctgagatgcaaatgaccttataaaaattgactaaactgctgccctccatatcagcagccagggcct

SEQ ID NO: 364851 - DNA, 140 bp, Artificial Sequence
  Synthetic
atacgccatgctgggtctccacatttatcaaaaacttatgtagacaagtagaaatacctgctggcagcatcaagaagatcttgaatgttcttagatataaactgtgcagcaaaggaggcgcgtacttgggagtcggccat

SEQ ID NO: 364852 - DNA, 140 bp, Artificial Sequence
  Synthetic
atggccgactcccaagtacgcgcctcctttgctgcacagtttatatctaagaacattcaagatcttcttgatgctgccagcaggtatttctacttgtctacataagtttttgataaatgtggagacccagcatggcgtat

SEQ ID NO: 364853 - DNA, 140 bp, Artificial Sequence
  Synthetic
aggccctggctgctgatatgcaagaagatcttgaatgttcttagatataaactgtgcagcaaaggaggcgtggagcaacatagtgaagaggatttgagaaagttgttggtagacaatttagaccttttgggacagcggtg

SEQ ID NO: 364854 - DNA, 140 bp, Artificial Sequence
  Synthetic
caccgctgtcccaaaaggtctaaattgtctaccaacaactttctcaaatcctcttcactatgttgctccacgcctcctttgctgcacagtttatatctaagaacattcaagatcttcttgcatatcagcagccagggcct

SEQ ID NO: 364855 - DNA, 140 bp, Artificial Sequence
  Synthetic
atacgccatgctgggtctccaagtaaagggctaatggcactaaacagctacaaccatatgggacagggcatccatcatgcaacttcttcagtgttaacctcattggctgctgtactttttcgtacttgggagtcggccat

SEQ ID NO: 364856 - DNA, 140 bp, Artificial Sequence
  Synthetic
atggccgactcccaagtacgaaaaagtacagcagccaatgaggttaacactgaagaagttgcatgatggatgccctgtcccatatggttgtagctgtttagtgccattagccctttacttggagacccagcatggcgtat

SEQ ID NO: 364857 - DNA, 140 bp, Artificial Sequence
  Synthetic
aggccctggctgctgatatgtccatcatgcaacttcttcagtgttaacctcattggctgctgtactttttgaagagctaacgatcttttatctaaagaggagtctacctcagacaacaatgaccttttgggacagcggtg

SEQ ID NO: 364858 - DNA, 140 bp, Artificial Sequence
  Synthetic
caccgctgtcccaaaaggtcattgttgtctgaggtagactcctctttagataaaagatcgttagctcttcaaaaagtacagcagccaatgaggttaacactgaagaagttgcatgatggacatatcagcagccagggcct

SEQ ID NO: 364859 - DNA, 140 bp, Artificial Sequence
  Synthetic
aggccctggctgctgatatgggcaacctgtacaggtgactgcccagagagatgtggctgtacatcatcaacctgtttgcataaagaatggccccattcaagaaactggaggtgtaatccagaccttttgggacagcggtg

SEQ ID NO: 364860 - DNA, 140 bp, Artificial Sequence
  Synthetic
caccgctgtcccaaaaggtctggattacacctccagtttcttgaatggggccattctttatgcaaacaggttgatgatgtacagccacatctctctgggcagtcacctgtacaggttgcccatatcagcagccagggcct

SEQ ID NO: 364861 - DNA, 140 bp, Artificial Sequence
  Synthetic
atacgccatgctgggtctccaaatggaaagatatattgaagctattagaattactgggaatcaaatgctcattcattgcctgtgctgactgctcgtctacaccgccagatagatggtggacgtacttgggagtcggccat

SEQ ID NO: 364862 - DNA, 140 bp, Artificial Sequence
  Synthetic
atggccgactcccaagtacgtccaccatctatctggcggtgtagacgagcagtcagcacaggcaatgaatgagcatttgattcccagtaattctaatagcttcaatatatctttccatttggagacccagcatggcgtat

SEQ ID NO: 364863 - DNA, 140 bp, Artificial Sequence
  Synthetic
aggccctggctgctgatatgtggaaacatgcctgcaagctgaaaaacttcacagctgctgtgcagagatgctgtcagatgaaagacagcgcaaaaaccttggtaagtgactgtttccttggaccttttgggacagcggtg

SEQ ID NO: 364864 - DNA, 140 bp, Artificial Sequence
  Synthetic
caccgctgtcccaaaaggtccaaggaaacagtcacttaccaaggtttttgcgctgtctttcatctgacagcatctctgcacagcagctgtgaagtttttcagcttgcaggcatgtttccacatatcagcagccagggcct

SEQ ID NO: 364865 - DNA, 140 bp, Artificial Sequence
  Synthetic
atacgccatgctgggtctccggccataagtactcaaaaggttaggagttatttaaaggcagggactgctacaaaaacccctgtgtcaacaaaagacgttctagagacttgggaaagaatgcgtacttgggagtcggccat

SEQ ID NO: 364866 - DNA, 140 bp, Artificial Sequence
  Synthetic
atggccgactcccaagtacgcattctttcccaagtctctagaacgtcttttgttgacacaggggtttttgtagcagtccctgcctttaaataactcctaaccttttgagtacttatggccggagacccagcatggcgtat

SEQ ID NO: 364867 - DNA, 140 bp, Artificial Sequence
  Synthetic
aggccctggctgctgatatgtttgatgcaggcatgtcaggtttcatcccagcaagccatgtacaatagtgtccctcttgtaaccaatgctgcctttacactgctcagacagcagattttcgaccttttgggacagcggtg

SEQ ID NO: 364868 - DNA, 140 bp, Artificial Sequence
  Synthetic
caccgctgtcccaaaaggtcgaaaatctgctgtctgagcagtgtaaaggcagcattggttacaagagggacactattgtacatggcttgctgggatgaaacctgacatgcctgcatcaaacatatcagcagccagggcct

SEQ ID NO: 364869 - DNA, 140 bp, Artificial Sequence
  Synthetic
atacgccatgctgggtctccaaagagcatatacttaacaggcctacaggtctgacactgcctgccagtctggagcaggcaatgcgcaaagggttagttgagggtgtggtcatctccaaggcgtacttgggagtcggccat

SEQ ID NO: 364870 - DNA, 140 bp, Artificial Sequence
  Synthetic
atggccgactcccaagtacgccttggagatgaccacaccctcaactaaccctttgcgcattgcctgctccagactggcaggcagtgtcagacctgtaggcctgttaagtatatgctctttggagacccagcatggcgtat

SEQ ID NO: 364871 - DNA, 140 bp, Artificial Sequence
  Synthetic
atacgccatgctgggtctcccactttatctccctttggtaggttgtttgtgccaacttactctggtcttgttagttcagcagtagccctggaggatgctgaagttattgctagagcagctcgtacttgggagtcggccat

SEQ ID NO: 364872 - DNA, 140 bp, Artificial Sequence
  Synthetic
atggccgactcccaagtacgagctgctctagcaataacttcagcatcctccagggctactgctgaactaacaagaccagagtaagttggcacaaacaacctaccaaagggagataaagtgggagacccagcatggcgtat

SEQ ID NO: 364873 - DNA, 140 bp, Artificial Sequence
  Synthetic
atacgccatgctgggtctccactgatgaatttgagcggacaaagtttaaacatgagcttacacagaatgttactactagtgaaaagatgctgttaagttggttaagtgaagacatcaagtcgtacttgggagtcggccat

SEQ ID NO: 364874 - DNA, 140 bp, Artificial Sequence
  Synthetic
atggccgactcccaagtacgacttgatgtcttcacttaaccaacttaacagcatcttttcactagtagtaacattctgtgtaagctcatgtttaaactttgtccgctcaaattcatcagtggagacccagcatggcgtat

SEQ ID NO: 364875 - DNA, 140 bp, Artificial Sequence
  Synthetic
atacgccatgctgggtctccgtagtgtgagcgacactaccatcgcttctcatgactcgggatcttcatcttctagcttctcttttgaactcaataggcctctatctgagaccgaattacacgtacttgggagtcggccat

SEQ ID NO: 364876 - DNA, 140 bp, Artificial Sequence
  Synthetic
atggccgactcccaagtacgtgtaattcggtctcagatagaggcctattgagttcaaaagagaagctagaagatgaagatcccgagtcatgagaagcgatggtagtgtcgctcacactacggagacccagcatggcgtat

SEQ ID NO: 364877 - DNA, 140 bp, Artificial Sequence
  Synthetic
aggccctggctgctgatatgtctagcttctcttttgaactcaataggcctctatctgagaccgaattacagttcattaaagcactaaatagcctcaaatcaacccaggcttgtgaaataagaccttttgggacagcggtg

SEQ ID NO: 364878 - DNA, 140 bp, Artificial Sequence
  Synthetic
caccgctgtcccaaaaggtcttatttcacaagcctgggttgatttgaggctatttagtgctttaatgaactgtaattcggtctcagatagaggcctattgagttcaaaagagaagctagacatatcagcagccagggcct

SEQ ID NO: 364879 - DNA, 140 bp, Artificial Sequence
  Synthetic
atacgccatgctgggtctccgataggcacaatgtgatttatagtagtagaattgcagactcttgtgattggttgagagatgggaaaagaagaggaaatttagagttagcaaacagaattccgtacttgggagtcggccat

SEQ ID NO: 364880 - DNA, 140 bp, Artificial Sequence
  Synthetic
atggccgactcccaagtacggaattctgtttgctaactctaaatttcctcttcttttcccatctctcaaccaatcacaagagtctgcaattctactactataaatcacattgtgcctatcggagacccagcatggcgtat

SEQ ID NO: 364881 - DNA, 140 bp, Artificial Sequence
  Synthetic
aggccctggctgctgatatggttgagagatgggaaaagaagaggaaatttagagttagcaaacagaattcagtctgtgctttgtgttctaatagcaggttactacaggtcatttggtggagaccttttgggacagcggtg

SEQ ID NO: 364882 - DNA, 140 bp, Artificial Sequence
  Synthetic
caccgctgtcccaaaaggtctccaccaaatgacctgtagtaacctgctattagaacacaaagcacagactgaattctgtttgctaactctaaatttcctcttcttttcccatctctcaaccatatcagcagccagggcct

SEQ ID NO: 364883 - DNA, 140 bp, Artificial Sequence
  Synthetic
atacgccatgctgggtctccgactggctgagaaggtagatactgtcagaaaagagctttcggaaactaaactaaaagattattcagcttatgcaagaggagtgatctcaaattcgctaaacgtacttgggagtcggccat

SEQ ID NO: 364884 - DNA, 140 bp, Artificial Sequence
  Synthetic
atggccgactcccaagtacgtttagcgaatttgagatcactcctcttgcataagctgaataatcttttagtttagtttccgaaagctcttttctgacagtatctaccttctcagccagtcggagacccagcatggcgtat

SEQ ID NO: 364885 - DNA, 140 bp, Artificial Sequence
  Synthetic
aggccctggctgctgatatgagctggagaggctaggagtctcaagaatggaagttgatgaattgatgccaagcattaaccctgatgacaccttggctcagcttgtagcaaaaaagctcatgaccttttgggacagcggtg

SEQ ID NO: 364886 - DNA, 140 bp, Artificial Sequence
  Synthetic
caccgctgtcccaaaaggtcatgagcttttttgctacaagctgagccaaggtgtcatcagggttaatgcttggcatcaattcatcaacttccattcttgagactcctagcctctccagctcatatcagcagccagggcct

SEQ ID NO: 364887 - DNA, 140 bp, Artificial Sequence
  Synthetic
atacgccatgctgggtctccttaataaacatcagaaattcactgaaggctagatctgagtttgttaggaacaacgacaaactgctcataagatctaaagaagagcttaaaaaatgtttcgcgtacttgggagtcggccat

SEQ ID NO: 364888 - DNA, 140 bp, Artificial Sequence
  Synthetic
atggccgactcccaagtacgcgaaacattttttaagctcttctttagatcttatgagcagtttgtcgttgttcctaacaaactcagatctagccttcagtgaatttctgatgtttattaaggagacccagcatggcgtat

SEQ ID NO: 364889 - DNA, 140 bp, Artificial Sequence
  Synthetic
aggccctggctgctgatatgaaagagctttcactccctatctacacaatattcatgaaatcttatttttttaaggacaacgtcttcttatcattaacagataggtggtccaccaagcacagaccttttgggacagcggtg

SEQ ID NO: 364890 - DNA, 140 bp, Artificial Sequence
  Synthetic
caccgctgtcccaaaaggtctgtgcttggtggaccacctatctgttaatgataagaagacgttgtccttaaaaaaataagatttcatgaatattgtgtagatagggagtgaaagctctttcatatcagcagccagggcct

SEQ ID NO: 364891 - DNA, 140 bp, Artificial Sequence
  Synthetic
atacgccatgctgggtctccagcaaacacttactgctcgtaatgtcttacatggtctggcaggagggattaaggagctttcccttcctatatatacaatattcatgaagtcttacttcttcgtacttgggagtcggccat

SEQ ID NO: 364892 - DNA, 140 bp, Artificial Sequence
  Synthetic
atggccgactcccaagtacgaagaagtaagacttcatgaatattgtatatataggaagggaaagctccttaatccctcctgccagaccatgtaagacattacgagcagtaagtgtttgctggagacccagcatggcgtat

SEQ ID NO: 364893 - DNA, 140 bp, Artificial Sequence
  Synthetic
atacgccatgctgggtctcctattggcacaccttatgagggaattatagacactttggtttccttaatcaatgtgttaacaaggttcacttggtttcaagaggtggtgctttatggtaagcgtacttgggagtcggccat

SEQ ID NO: 364894 - DNA, 140 bp, Artificial Sequence
  Synthetic
atggccgactcccaagtacgcttaccataaagcaccacctcttgaaaccaagtgaaccttgttaacacattgattaaggaaaccaaagtgtctataattccctcataaggtgtgccaataggagacccagcatggcgtat

SEQ ID NO: 364895 - DNA, 140 bp, Artificial Sequence
  Synthetic
aggccctggctgctgatatgcaacagacacactactgtcaaagagtcttccctatttaactcaaacatcaggtgtgttaacctaatcacttttgaagatggtctgagggagctctcgatagaccttttgggacagcggtg

SEQ ID NO: 364896 - DNA, 140 bp, Artificial Sequence
  Synthetic
caccgctgtcccaaaaggtctatcgagagctccctcagaccatcttcaaaagtgattaggttaacacacctgatgtttgagttaaatagggaagactctttgacagtagtgtgtctgttgcatatcagcagccagggcct

SEQ ID NO: 364897 - DNA, 140 bp, Artificial Sequence
  Synthetic
atacgccatgctgggtctcctcagttctctgatccaaacagacagaaactcaggatagttgaatctagacctgcagagtctgagcttgaagcgaatcgtgcagtgattgtcaagactaaacgtacttgggagtcggccat

SEQ ID NO: 364898 - DNA, 140 bp, Artificial Sequence
  Synthetic
atggccgactcccaagtacgtttagtcttgacaatcactgcacgattcgcttcaagctcagactctgcaggtctagattcaactatcctgagtttctgtctgtttggatcagagaactgaggagacccagcatggcgtat

SEQ ID NO: 364899 - DNA, 140 bp, Artificial Sequence
  Synthetic
aggccctggctgctgatatgctgcagagtctgagcttgaagcgaatcgtgcagtgattgtcaagactaaactgttctcagcaacggaacaagttcgactgtccaacaatcccgcagtcgtgaccttttgggacagcggtg

SEQ ID NO: 364900 - DNA, 140 bp, Artificial Sequence
  Synthetic
caccgctgtcccaaaaggtcacgactgcgggattgttggacagtcgaacttgttccgttgctgagaacagtttagtcttgacaatcactgcacgattcgcttcaagctcagactctgcagcatatcagcagccagggcct

SEQ ID NO: 364901 - DNA, 140 bp, Artificial Sequence
  Synthetic
atacgccatgctgggtctccaggttgacttttcgaacttacttaaagaccgctttaagataatgcagtttttcccttcagtgttcactttaattaagatgctgacagatgagtcatcagacgtacttgggagtcggccat

SEQ ID NO: 364902 - DNA, 140 bp, Artificial Sequence
  Synthetic
atggccgactcccaagtacgtctgatgactcatctgtcagcatcttaattaaagtgaacactgaagggaaaaactgcattatcttaaagcggtctttaagtaagttcgaaaagtcaacctggagacccagcatggcgtat

SEQ ID NO: 364903 - DNA, 140 bp, Artificial Sequence
  Synthetic
aggccctggctgctgatatgttcccttcagtgttcactttaattaagatgctgacagatgagtcatcagactcggagaaaaatggtattagccctgatctgcagcaagttgcaaggtattgaccttttgggacagcggtg

SEQ ID NO: 364904 - DNA, 140 bp, Artificial Sequence
  Synthetic
caccgctgtcccaaaaggtcaataccttgcaacttgctgcagatcagggctaataccatttttctccgagtctgatgactcatctgtcagcatcttaattaaagtgaacactgaagggaacatatcagcagccagggcct

SEQ ID NO: 364905 - DNA, 140 bp, Artificial Sequence
  Synthetic
atacgccatgctgggtctcccaaggtgcaaagctagcgggaatttcttaaacagaagcagcagagaccactttataagtgttgtttcaggattaaacctggtttatggcttcctcataaacgtacttgggagtcggccat

SEQ ID NO: 364906 - DNA, 140 bp, Artificial Sequence
  Synthetic
atggccgactcccaagtacgtttatgaggaagccataaaccaggtttaatcctgaaacaacacttataaagtggtctctgctgcttctgtttaagaaattcccgctagctttgcaccttgggagacccagcatggcgtat

SEQ ID NO: 364907 - DNA, 140 bp, Artificial Sequence
  Synthetic
atacgccatgctgggtctccgtcactgttttctacatgctaaagggcaacttgatgaatacagaaccgacagtggctgaacttgtcagttatggcataaaagaaggtaggttttacaggccgtacttgggagtcggccat

SEQ ID NO: 364908 - DNA, 140 bp, Artificial Sequence
  Synthetic
atggccgactcccaagtacggcctgtaaaacctaccttcttttatgccataactgacaagttcagccactgtcggttctgtattcatcaagttgccctttagcatgtagaaaacagtgacggagacccagcatggcgtat

SEQ ID NO: 364909 - DNA, 140 bp, Artificial Sequence
  Synthetic
aggccctggctgctgatatgagtggctgaacttgtcagttatggcataaaagaaggtaggttttacaggctgtctgacacaggaattgatgcaagcacatactctgtaaagtactggaaggaccttttgggacagcggtg

SEQ ID NO: 364910 - DNA, 140 bp, Artificial Sequence
  Synthetic
caccgctgtcccaaaaggtccttccagtactttacagagtatgtgcttgcatcaattcctgtgtcagacagcctgtaaaacctaccttcttttatgccataactgacaagttcagccactcatatcagcagccagggcct

SEQ ID NO: 364911 - DNA, 140 bp, Artificial Sequence
  Synthetic
aggccctggctgctgatatgttggggaaaaagttttcaacaagttgtagaagaattgaagacaacattgcaagactttacctacaaacatctatatactgctcagttagagatgtggaaggaccttttgggacagcggtg

SEQ ID NO: 364912 - DNA, 140 bp, Artificial Sequence
  Synthetic
caccgctgtcccaaaaggtccttccacatctctaactgagcagtatatagatgtttgtaggtaaagtcttgcaatgttgtcttcaattcttctacaacttgttgaaaactttttccccaacatatcagcagccagggcct

SEQ ID NO: 364913 - DNA, 140 bp, Artificial Sequence
  Synthetic
atacgccatgctgggtctcccaagtcttcactgctcatgagtttcttgaactggagagtgaacatggacattagaactactgactgtccactatctaaccatgaggcaaacattctaagtcgtacttgggagtcggccat

SEQ ID NO: 364914 - DNA, 140 bp, Artificial Sequence
  Synthetic
atggccgactcccaagtacgacttagaatgtttgcctcatggttagatagtggacagtcagtagttctaatgtccatgttcactctccagttcaagaaactcatgagcagtgaagacttgggagacccagcatggcgtat

SEQ ID NO: 364915 - DNA, 140 bp, Artificial Sequence
  Synthetic
atacgccatgctgggtctccccatgttttactgtctatggcacctttgttaacagcgacagacagctaatttttgacatttacaatgtgcatatatacaataaagaaatggacaattttgcgtacttgggagtcggccat

SEQ ID NO: 364916 - DNA, 140 bp, Artificial Sequence
  Synthetic
atggccgactcccaagtacgcaaaattgtccatttctttattgtatatatgcacattgtaaatgtcaaaaattagctgtctgtcgctgttaacaaaggtgccatagacagtaaaacatggggagacccagcatggcgtat

SEQ ID NO: 364917 - DNA, 140 bp, Artificial Sequence
  Synthetic
aggccctggctgctgatatgttttgacatttacaatgtgcatatatacaataaagaaatggacaattttgacgaaggatgtatcagcgtcttggaagaaacagcagaaaggcatatgcttgaccttttgggacagcggtg

SEQ ID NO: 364918 - DNA, 140 bp, Artificial Sequence
  Synthetic
caccgctgtcccaaaaggtcaagcatatgcctttctgctgtttcttccaagacgctgatacatccttcgtcaaaattgtccatttctttattgtatatatgcacattgtaaatgtcaaaacatatcagcagccagggcct

SEQ ID NO: 364919 - DNA, 140 bp, Artificial Sequence
  Synthetic
atacgccatgctgggtctccacgaaggatgtatcagcgtcttggaagaaacagcagaaaggcatatgctttgggagcttgatctgatgaattcactttgttctgacgagaaaagagatgccgtacttgggagtcggccat

SEQ ID NO: 364920 - DNA, 140 bp, Artificial Sequence
  Synthetic
atggccgactcccaagtacggcatctcttttctcgtcagaacaaagtgaattcatcagatcaagctcccaaagcatatgcctttctgctgtttcttccaagacgctgatacatccttcgtggagacccagcatggcgtat

SEQ ID NO: 364921 - DNA, 140 bp, Artificial Sequence
  Synthetic
atacgccatgctgggtctcctaaactcacctactgaactgttaaagaaaaagccctatttaggaacaacctgcaagtttagcacttggggagattcgaacaggtctgggaaatttacatacgtacttgggagtcggccat

SEQ ID NO: 364922 - DNA, 140 bp, Artificial Sequence
  Synthetic
atggccgactcccaagtacgtatgtaaatttcccagacctgttcgaatctccccaagtgctaaacttgcaggttgttcctaaatagggctttttctttaacagttcagtaggtgagtttaggagacccagcatggcgtat

SEQ ID NO: 364923 - DNA, 140 bp, Artificial Sequence
  Synthetic
aggccctggctgctgatatgtgcaagtttagcacttggggagattcgaacaggtctgggaaatttacatacagcagcagatctggggagtcgattggtattttcattgcaggaaagctacgaccttttgggacagcggtg

SEQ ID NO: 364924 - DNA, 140 bp, Artificial Sequence
  Synthetic
caccgctgtcccaaaaggtcgtagctttcctgcaatgaaaataccaatcgactccccagatctgctgctgtatgtaaatttcccagacctgttcgaatctccccaagtgctaaacttgcacatatcagcagccagggcct

SEQ ID NO: 364925 - DNA, 140 bp, Artificial Sequence
  Synthetic
atacgccatgctgggtctccataaagaggggaaaaagctattaaagttaagcagtgatacatctactgacacacaaagcgttgcttctgaagtgtcagacaggaggtcctatagctcaagcgtacttgggagtcggccat

SEQ ID NO: 364926 - DNA, 140 bp, Artificial Sequence
  Synthetic
atggccgactcccaagtacgcttgagctataggacctcctgtctgacacttcagaagcaacgctttgtgtgtcagtagatgtatcactgcttaactttaatagctttttcccctctttatggagacccagcatggcgtat

SEQ ID NO: 364927 - DNA, 140 bp, Artificial Sequence
  Synthetic
aggccctggctgctgatatgacacaaagcgttgcttctgaagtgtcagacaggaggtcctatagctcaagtaagagtagaattcgtagtatttttggaagatacaattctcagaaaaaacgaccttttgggacagcggtg

SEQ ID NO: 364928 - DNA, 140 bp, Artificial Sequence
  Synthetic
caccgctgtcccaaaaggtcgttttttctgagaattgtatcttccaaaaatactacgaattctactcttacttgagctataggacctcctgtctgacacttcagaagcaacgctttgtgtcatatcagcagccagggcct

SEQ ID NO: 364929 - DNA, 140 bp, Artificial Sequence
  Synthetic
atacgccatgctgggtctcccaagtactatcctggatgagcaaaagaagaactgaagtgataactaaggagcagcatcaactattcctaagcctccttcctcagtctcatgagtgcttaccgtacttgggagtcggccat

SEQ ID NO: 364930 - DNA, 140 bp, Artificial Sequence
  Synthetic
atggccgactcccaagtacggtaagcactcatgagactgaggaaggaggcttaggaatagttgatgctgctccttagttatcacttcagttcttcttttgctcatccaggatagtacttgggagacccagcatggcgtat

SEQ ID NO: 364931 - DNA, 140 bp, Artificial Sequence
  Synthetic
aggccctggctgctgatatggcagcatcaactattcctaagcctccttcctcagtctcatgagtgcttacaaaagcacaaggatggcagtgcgctatcagttatacctgacggcaacaacgaccttttgggacagcggtg

SEQ ID NO: 364932 - DNA, 140 bp, Artificial Sequence
  Synthetic
caccgctgtcccaaaaggtcgttgttgccgtcaggtataactgatagcgcactgccatccttgtgcttttgtaagcactcatgagactgaggaaggaggcttaggaatagttgatgctgccatatcagcagccagggcct

SEQ ID NO: 364933 - DNA, 140 bp, Artificial Sequence
  Synthetic
aggccctggctgctgatatgcaaagaaagcattttgaaggactgccttcaaatcatacggaaaaatcccagccacacaatgggctcttttgagttgatccaggcagtctcagagtttggcgaccttttgggacagcggtg

SEQ ID NO: 364934 - DNA, 140 bp, Artificial Sequence
  Synthetic
caccgctgtcccaaaaggtcgccaaactctgagactgcctggatcaactcaaaagagcccattgtgtggctgggatttttccgtatgatttgaaggcagtccttcaaaatgctttctttgcatatcagcagccagggcct

SEQ ID NO: 364935 - DNA, 140 bp, Artificial Sequence
  Synthetic
atacgccatgctgggtctccgccacacaatgggctcttttgagttgatccaggcagtctcagagtttggcatgagtaaatttcctcccgagaatatagacaaggcaaggagggatccaaacgtacttgggagtcggccat

SEQ ID NO: 364936 - DNA, 140 bp, Artificial Sequence
  Synthetic
atggccgactcccaagtacgtttggatccctccttgccttgtctatattctcgggaggaaatttactcatgccaaactctgagactgcctggatcaactcaaaagagcccattgtgtggcggagacccagcatggcgtat

SEQ ID NO: 364937 - DNA, 140 bp, Artificial Sequence
  Synthetic
aggccctggctgctgatatgaaagtgagcctagactacagtggggccacggctgcctgtctattgtttatgatgagactgacactcagaccacataccatgagaaccttttaaaggtgaagaccttttgggacagcggtg

SEQ ID NO: 364938 - DNA, 140 bp, Artificial Sequence
  Synthetic
caccgctgtcccaaaaggtcttcacctttaaaaggttctcatggtatgtggtctgagtgtcagtctcatcataaacaatagacaggcagccgtggccccactgtagtctaggctcactttcatatcagcagccagggcct

SEQ ID NO: 364939 - DNA, 140 bp, Artificial Sequence
  Synthetic
atacgccatgctgggtctcctgttttctgattctaaggttgttttgtcgaggattaaatttaagacagagctgctccttaattctttgacactgcttcattgtttcctgaagcatgcccccgtacttgggagtcggccat

SEQ ID NO: 364940 - DNA, 140 bp, Artificial Sequence
  Synthetic
atggccgactcccaagtacgggggcatgcttcaggaaacaatgaagcagtgtcaaagaattaaggagcagctctgtcttaaatttaatcctcgacaaaacaaccttagaatcagaaaacaggagacccagcatggcgtat

SEQ ID NO: 364941 - DNA, 140 bp, Artificial Sequence
  Synthetic
aggccctggctgctgatatgctgctccttaattctttgacactgcttcattgtttcctgaagcatgcccccagtgatgccattatggaggtggagagtaaaagtagcttgctgcataagtgaccttttgggacagcggtg

SEQ ID NO: 364942 - DNA, 140 bp, Artificial Sequence
  Synthetic
caccgctgtcccaaaaggtcacttatgcagcaagctacttttactctccacctccataatggcatcactgggggcatgcttcaggaaacaatgaagcagtgtcaaagaattaaggagcagcatatcagcagccagggcct

SEQ ID NO: 364943 - DNA, 140 bp, Artificial Sequence
  Synthetic
atacgccatgctgggtctccagtcaaaaaaaacatagatgaggttctgcttactgaggatggaaatctgatcttctgctggcttaaaacaatctcatcctcagttaaaggaagcttgaagcgtacttgggagtcggccat

SEQ ID NO: 364944 - DNA, 140 bp, Artificial Sequence
  Synthetic
atggccgactcccaagtacgcttcaagcttcctttaactgaggatgagattgttttaagccagcagaagatcagatttccatcctcagtaagcagaacctcatctatgttttttttgactggagacccagcatggcgtat

SEQ ID NO: 364945 - DNA, 140 bp, Artificial Sequence
  Synthetic
aggccctggctgctgatatgggaggagattgagttttgcaacaacctgactaagactgtttcagaaaacccgttgccactcagctgctggtctgaagttcaaaattatattgaggacatagaccttttgggacagcggtg

SEQ ID NO: 364946 - DNA, 140 bp, Artificial Sequence
  Synthetic
caccgctgtcccaaaaggtctatgtcctcaatataattttgaacttcagaccagcagctgagtggcaacgggttttctgaaacagtcttagtcaggttgttgcaaaactcaatctcctcccatatcagcagccagggcct

SEQ ID NO: 364947 - DNA, 140 bp, Artificial Sequence
  Synthetic
atacgccatgctgggtctccctgcctcttttctagtgaggagtttaatgaactgattaagttgaaaaaacttctcctcaacgaacaacaagatgaacaggagttgaggcaagaccttttacgtacttgggagtcggccat

SEQ ID NO: 364948 - DNA, 140 bp, Artificial Sequence
  Synthetic
atggccgactcccaagtacgtaaaaggtcttgcctcaactcctgttcatcttgttgttcgttgaggagaagttttttcaacttaatcagttcattaaactcctcactagaaaagaggcagggagacccagcatggcgtat

SEQ ID NO: 364949 - DNA, 140 bp, Artificial Sequence
  Synthetic
atacgccatgctgggtctccacttctatggaagttcacactagataccaacgttagcaccacgagcaccatcaaggacgtgaggacacttgtgtcttatgtcagcaccgaaaccattcctcgtacttgggagtcggccat

SEQ ID NO: 364950 - DNA, 140 bp, Artificial Sequence
  Synthetic
atggccgactcccaagtacgaggaatggtttcggtgctgacataagacacaagtgtcctcacgtccttgatggtgctcgtggtgctaacgttggtatctagtgtgaacttccatagaagtggagacccagcatggcgtat

SEQ ID NO: 364951 - DNA, 140 bp, Artificial Sequence
  Synthetic
aggccctggctgctgatatgtcaaggacgtgaggacacttgtgtcttatgtcagcaccgaaaccattcctaaattcttgcttgcatttcttctttacgaagaagtattaatgaacctaatgaccttttgggacagcggtg

SEQ ID NO: 364952 - DNA, 140 bp, Artificial Sequence
  Synthetic
caccgctgtcccaaaaggtcattaggttcattaatacttcttcgtaaagaagaaatgcaagcaagaatttaggaatggtttcggtgctgacataagacacaagtgtcctcacgtccttgacatatcagcagccagggcct

SEQ ID NO: 364953 - DNA, 140 bp, Artificial Sequence
  Synthetic
atacgccatgctgggtctccactcagaactggagagcctactcactttatgcacttactactttcagaatgagtgcagtaagagagatggacctagatgttccttcgcagcactgttgagcgtacttgggagtcggccat

SEQ ID NO: 364954 - DNA, 140 bp, Artificial Sequence
  Synthetic
atggccgactcccaagtacgctcaacagtgctgcgaaggaacatctaggtccatctctcttactgcactcattctgaaagtagtaagtgcataaagtgagtaggctctccagttctgagtggagacccagcatggcgtat

SEQ ID NO: 364955 - DNA, 140 bp, Artificial Sequence
  Synthetic
aggccctggctgctgatatggagtgcagtaagagagatggacctagatgttccttcgcagcactgttgagtctggttcatgaggactggcaaaagatagggaaaaatatctgtgttcgtggaccttttgggacagcggtg

SEQ ID NO: 364956 - DNA, 140 bp, Artificial Sequence
  Synthetic
caccgctgtcccaaaaggtccacgaacacagatatttttccctatcttttgccagtcctcatgaaccagactcaacagtgctgcgaaggaacatctaggtccatctctcttactgcactccatatcagcagccagggcct

SEQ ID NO: 364957 - DNA, 140 bp, Artificial Sequence
  Synthetic
atacgccatgctgggtctcctcttatctggtaagacatccagagatacttgactgtggatctaaagaggactgtaagctcactctacttgatctgtcagtttctaaactcttagtgtgttcgtacttgggagtcggccat

SEQ ID NO: 364958 - DNA, 140 bp, Artificial Sequence
  Synthetic
atggccgactcccaagtacgaacacactaagagtttagaaactgacagatcaagtagagtgagcttacagtcctctttagatccacagtcaagtatctctggatgtcttaccagataagaggagacccagcatggcgtat

SEQ ID NO: 364959 - DNA, 140 bp, Artificial Sequence
  Synthetic
atacgccatgctgggtctcccctctcaaggacatgtctaagccgaaacctgagagagtgatcatagctaggaggtcattaaatcatgccttgtctttgatattcttggatgagatgtcatcgtacttgggagtcggccat

SEQ ID NO: 364960 - DNA, 140 bp, Artificial Sequence
  Synthetic
atggccgactcccaagtacgatgacatctcatccaagaatatcaaagacaaggcatgatttaatgacctcctagctatgatcactctctcaggtttcggcttagacatgtccttgagaggggagacccagcatggcgtat

SEQ ID NO: 364961 - DNA, 140 bp, Artificial Sequence
  Synthetic
aggccctggctgctgatatggaggtcattaaatcatgccttgtctttgatattcttggatgagatgtcattgcctgaactaaaatccttctctgtaaattgcaagatggggaaccttgaagaccttttgggacagcggtg

SEQ ID NO: 364962 - DNA, 140 bp, Artificial Sequence
  Synthetic
caccgctgtcccaaaaggtcttcaaggttccccatcttgcaatttacagagaaggattttagttcaggcaatgacatctcatccaagaatatcaaagacaaggcatgatttaatgacctccatatcagcagccagggcct

SEQ ID NO: 364963 - DNA, 140 bp, Artificial Sequence
  Synthetic
atacgccatgctgggtctcctttctcgcttagtctgaatgacggaggtttggaccttgatttacacaaaaccactgacgagaagttgctacatcaaacaaagatagtttttgccaaaattcgtacttgggagtcggccat

SEQ ID NO: 364964 - DNA, 140 bp, Artificial Sequence
  Synthetic
atggccgactcccaagtacgaattttggcaaaaactatctttgtttgatgtagcaacttctcgtcagtggttttgtgtaaatcaaggtccaaacctccgtcattcagactaagcgagaaaggagacccagcatggcgtat

SEQ ID NO: 364965 - DNA, 140 bp, Artificial Sequence
  Synthetic
atacgccatgctgggtctccggactataataaattagttgaccactgtgtggatatggagaaaaaaagggacgcagttagagcagtggaggacctagttctaatgttgacaggcaggtctcgtacttgggagtcggccat

SEQ ID NO: 364966 - DNA, 140 bp, Artificial Sequence
  Synthetic
atggccgactcccaagtacgagacctgcctgtcaacattagaactaggtcctccactgctctaactgcgtccctttttttctccatatccacacagtggtcaactaatttattatagtccggagacccagcatggcgtat

SEQ ID NO: 364967 - DNA, 140 bp, Artificial Sequence
  Synthetic
aggccctggctgctgatatgacgcagttagagcagtggaggacctagttctaatgttgacaggcaggtctaccaagcccagcaccataacactattttcacgtgaggaagagcagtgccagaccttttgggacagcggtg

SEQ ID NO: 364968 - DNA, 140 bp, Artificial Sequence
  Synthetic
caccgctgtcccaaaaggtctggcactgctcttcctcacgtgaaaatagtgttatggtgctgggcttggtagacctgcctgtcaacattagaactaggtcctccactgctctaactgcgtcatatcagcagccagggcct

SEQ ID NO: 364969 - DNA, 140 bp, Artificial Sequence
  Synthetic
atacgccatgctgggtctccaaatagcaactttaacgtctgcaaaaggttgaccggaaggagtaccggggaaaggcttccaagaagcgtcaggagcaaggtcatttatgagatggtgaaacgtacttgggagtcggccat

SEQ ID NO: 364970 - DNA, 140 bp, Artificial Sequence
  Synthetic
atggccgactcccaagtacgtttcaccatctcataaatgaccttgctcctgacgcttcttggaagcctttccccggtactccttccggtcaaccttttgcagacgttaaagttgctatttggagacccagcatggcgtat

SEQ ID NO: 364971 - DNA, 140 bp, Artificial Sequence
  Synthetic
atacgccatgctgggtctcctgcctgacaaggaggcagaagccctcaaaacaggtaatctcggcttcaactgggactcagattgatcatactactcatgagaatcaacagcatccttgaacgtacttgggagtcggccat

SEQ ID NO: 364972 - DNA, 140 bp, Artificial Sequence
  Synthetic
atggccgactcccaagtacgttcaaggatgctgttgattctcatgagtagtatgatcaatctgagtcccagttgaagccgagattacctgttttgagggcttctgcctccttgtcaggcaggagacccagcatggcgtat

SEQ ID NO: 364973 - DNA, 140 bp, Artificial Sequence
  Synthetic
atacgccatgctgggtctccggcactaaattatgaacaccgcttttatgcagttttagcacctaaggcacagctaggaggagcaagagatctgttagtacaagaaactggaaccaaagtccgtacttgggagtcggccat

SEQ ID NO: 364974 - DNA, 140 bp, Artificial Sequence
  Synthetic
atggccgactcccaagtacggactttggttccagtttcttgtactaacagatctcttgctcctcctagctgtgccttaggtgctaaaactgcataaaagcggtgttcataatttagtgccggagacccagcatggcgtat

SEQ ID NO: 364975 - DNA, 140 bp, Artificial Sequence
  Synthetic
aggccctggctgctgatatgagctaggaggagcaagagatctgttagtacaagaaactggaaccaaagtcatgcatgcaactactgaaatgttcagtagaaacctcttaaaaacaacatcgaccttttgggacagcggtg

SEQ ID NO: 364976 - DNA, 140 bp, Artificial Sequence
  Synthetic
caccgctgtcccaaaaggtcgatgttgtttttaagaggtttctactgaacatttcagtagttgcatgcatgactttggttccagtttcttgtactaacagatctcttgctcctcctagctcatatcagcagccagggcct

SEQ ID NO: 364977 - DNA, 140 bp, Artificial Sequence
  Synthetic
atacgccatgctgggtctccaagcatgcatacaagtggacaatctaactatacattggttaactttagctgatccaacacttctattctttaagcattgacctcagtttgattatttccacgtacttgggagtcggccat

SEQ ID NO: 364978 - DNA, 140 bp, Artificial Sequence
  Synthetic
atggccgactcccaagtacgtggaaataatcaaactgaggtcaatgcttaaagaatagaagtgttggatcagctaaagttaaccaatgtatagttagattgtccacttgtatgcatgcttggagacccagcatggcgtat

SEQ ID NO: 364979 - DNA, 140 bp, Artificial Sequence
  Synthetic
atacgccatgctgggtctccgattggattgtcttaccaatatgcgaaaccttgatggaaagcccataagtgagggtagcaacttggtcaacttctacaaagtcatttgcatttcaggtgacgtacttgggagtcggccat

SEQ ID NO: 364980 - DNA, 140 bp, Artificial Sequence
  Synthetic
atggccgactcccaagtacgtcacctgaaatgcaaatgactttgtagaagttgaccaagttgctaccctcacttatgggctttccatcaaggtttcgcatattggtaagacaatccaatcggagacccagcatggcgtat

SEQ ID NO: 364981 - DNA, 140 bp, Artificial Sequence
  Synthetic
aggccctggctgctgatatggagggtagcaacttggtcaacttctacaaagtcatttgcatttcaggtgacaataccaaatggggcccgatacactgctgttcattcttttcaggcatgagaccttttgggacagcggtg

SEQ ID NO: 364982 - DNA, 140 bp, Artificial Sequence
  Synthetic
caccgctgtcccaaaaggtctcatgcctgaaaagaatgaacagcagtgtatcgggccccatttggtattgtcacctgaaatgcaaatgactttgtagaagttgaccaagttgctaccctccatatcagcagccagggcct

SEQ ID NO: 364983 - DNA, 140 bp, Artificial Sequence
  Synthetic
atacgccatgctgggtctccacatttataaaaaacttgtgtaggcaagtagaaataccagcaggcagtattaaaaagatcttaaatgttcttagatacaaactatgcagcaaaggaggtgcgtacttgggagtcggccat

SEQ ID NO: 364984 - DNA, 140 bp, Artificial Sequence
  Synthetic
atggccgactcccaagtacgcacctcctttgctgcatagtttgtatctaagaacatttaagatctttttaatactgcctgctggtatttctacttgcctacacaagttttttataaatgtggagacccagcatggcgtat

SEQ ID NO: 364985 - DNA, 140 bp, Artificial Sequence
  Synthetic
aggccctggctgctgatatgtaaaaagatcttaaatgttcttagatacaaactatgcagcaaaggaggtgtggagcagcacagtgaagaggatttaagaaagctgttggtagataatttagaccttttgggacagcggtg

SEQ ID NO: 364986 - DNA, 140 bp, Artificial Sequence
  Synthetic
caccgctgtcccaaaaggtctaaattatctaccaacagctttcttaaatcctcttcactgtgctgctccacacctcctttgctgcatagtttgtatctaagaacatttaagatctttttacatatcagcagccagggcct

SEQ ID NO: 364987 - DNA, 140 bp, Artificial Sequence
  Synthetic
aggccctggctgctgatatgaagcaaggggctcatggcactaaacagctacaaccatatgggtcagggcattcaccatgcaacctcttcagtgttaacttctttagctgctgtactcttcgaccttttgggacagcggtg

SEQ ID NO: 364988 - DNA, 140 bp, Artificial Sequence
  Synthetic
caccgctgtcccaaaaggtcgaagagtacagcagctaaagaagttaacactgaagaggttgcatggtgaatgccctgacccatatggttgtagctgtttagtgccatgagccccttgcttcatatcagcagccagggcct

SEQ ID NO: 364989 - DNA, 140 bp, Artificial Sequence
  Synthetic
aggccctggctgctgatatgttcaccatgcaacctcttcagtgttaacttctttagctgctgtactcttcgaagagttaacaattttttatcttaagaggagcttaccccagacaacagtgaccttttgggacagcggtg

SEQ ID NO: 364990 - DNA, 140 bp, Artificial Sequence
  Synthetic
caccgctgtcccaaaaggtcactgttgtctggggtaagctcctcttaagataaaaaattgttaactcttcgaagagtacagcagctaaagaagttaacactgaagaggttgcatggtgaacatatcagcagccagggcct

SEQ ID NO: 364991 - DNA, 140 bp, Artificial Sequence
  Synthetic
atacgccatgctgggtctcctaactggcatactgtccaaggagctatactcccagtatgacgaaacattttggaagcatgcttgtagacttaagaactttacagctgctgtacaaagatgcgtacttgggagtcggccat

SEQ ID NO: 364992 - DNA, 140 bp, Artificial Sequence
  Synthetic
atggccgactcccaagtacgcatctttgtacagcagctgtaaagttcttaagtctacaagcatgcttccaaaatgtttcgtcatactgggagtatagctccttggacagtatgccagttaggagacccagcatggcgtat

SEQ ID NO: 364993 - DNA, 140 bp, Artificial Sequence
  Synthetic
aggccctggctgctgatatgtggaagcatgcttgtagacttaagaactttacagctgctgtacaaagatgttgtcaaatgaaagatagtgccaaaaccttagtgagcgactgttttcttggaccttttgggacagcggtg

SEQ ID NO: 364994 - DNA, 140 bp, Artificial Sequence
  Synthetic
caccgctgtcccaaaaggtccaagaaaacagtcgctcactaaggttttggcactatctttcatttgacaacatctttgtacagcagctgtaaagttcttaagtctacaagcatgcttccacatatcagcagccagggcct

SEQ ID NO: 364995 - DNA, 140 bp, Artificial Sequence
  Synthetic
aggccctggctgctgatatgtttgatgcaagcatgccaggtttcatcacagcaagccatgtataatagtgttccccttgtcaccaatacctcctttaccttactaaggcaacaaattttcgaccttttgggacagcggtg

SEQ ID NO: 364996 - DNA, 140 bp, Artificial Sequence
  Synthetic
caccgctgtcccaaaaggtcgaaaatttgttgccttagtaaggtaaaggaggtattggtgacaaggggaacactattatacatggcttgctgtgatgaaacctggcatgcttgcatcaaacatatcagcagccagggcct

SEQ ID NO: 364997 - DNA, 140 bp, Artificial Sequence
  Synthetic
atacgccatgctgggtctccaaccttgtctccctttggcagactgtttgtaccaacctactctggattagtcagctcagcagttgctttggaagatgctgaagttattgctagggcagctcgtacttgggagtcggccat

SEQ ID NO: 364998 - DNA, 140 bp, Artificial Sequence
  Synthetic
atggccgactcccaagtacgagctgccctagcaataacttcagcatcttccaaagcaactgctgagctgactaatccagagtaggttggtacaaacagtctgccaaagggagacaaggttggagacccagcatggcgtat

SEQ ID NO: 364999 - DNA, 140 bp, Artificial Sequence
  Synthetic
atacgccatgctgggtctcccaaacactccatatgaacagtgtatcgatccagtcaagtagcttaactacattagacagtttaggccgtagtaggacaagttctacagttgaagatagcacgtacttgggagtcggccat

SEQ ID NO: 365000 - DNA, 140 bp, Artificial Sequence
  Synthetic
atggccgactcccaagtacgtgctatcttcaactgtagaacttgtcctactacggcctaaactgtctaatgtagttaagctacttgactggatcgatacactgttcatatggagtgtttgggagacccagcatggcgtat

SEQ ID NO: 365001 - DNA, 140 bp, Artificial Sequence
  Synthetic
atacgccatgctgggtctcctcaagcttctcttttgagctcaatcggcctctgtctgagactgaactacaatttattaaagcactaaacagcctcaaatcaactcaagcttgtgagataacgtacttgggagtcggccat

SEQ ID NO: 365002 - DNA, 140 bp, Artificial Sequence
  Synthetic
atggccgactcccaagtacgttatctcacaagcttgagttgatttgaggctgtttagtgctttaataaattgtagttcagtctcagacagaggccgattgagctcaaaagagaagcttgaggagacccagcatggcgtat

SEQ ID NO: 365003 - DNA, 140 bp, Artificial Sequence
  Synthetic
aggccctggctgctgatatgatttattaaagcactaaacagcctcaaatcaactcaagcttgtgagataattcagaacaggattacgggcctttattgcaatagcaatgaaggacctcttgaccttttgggacagcggtg

SEQ ID NO: 365004 - DNA, 140 bp, Artificial Sequence
  Synthetic
caccgctgtcccaaaaggtcaagaggtccttcattgctattgcaataaaggcccgtaatcctgttctgaattatctcacaagcttgagttgatttgaggctgtttagtgctttaataaatcatatcagcagccagggcct

SEQ ID NO: 365005 - DNA, 140 bp, Artificial Sequence
  Synthetic
atacgccatgctgggtctccgctaagagatggcaagagaagagggaatctagaactagcaaacagaatccaatctgtactatgtgttctgatagcgggatactacagatcatttggcgggcgtacttgggagtcggccat

SEQ ID NO: 365006 - DNA, 140 bp, Artificial Sequence
  Synthetic
atggccgactcccaagtacgcccgccaaatgatctgtagtatcccgctatcagaacacatagtacagattggattctgtttgctagttctagattccctcttctcttgccatctcttagcggagacccagcatggcgtat

SEQ ID NO: 365007 - DNA, 140 bp, Artificial Sequence
  Synthetic
aggccctggctgctgatatgaatctgtactatgtgttctgatagcgggatactacagatcatttggcggggaagggaccgagaaacaggtaaaggcgtcattgaatagagacgacaacaagaccttttgggacagcggtg

SEQ ID NO: 365008 - DNA, 140 bp, Artificial Sequence
  Synthetic
caccgctgtcccaaaaggtcttgttgtcgtctctattcaatgacgcctttacctgtttctcggtcccttccccgccaaatgatctgtagtatcccgctatcagaacacatagtacagattcatatcagcagccagggcct

SEQ ID NO: 365009 - DNA, 140 bp, Artificial Sequence
  Synthetic
atacgccatgctgggtctccagttagaaaggttaggagtttctagaatggaagtcgatgaactgatgccaagtatcagccctgatgataccttggcccagcttgtggcaaaaaaactaatcgtacttgggagtcggccat

SEQ ID NO: 365010 - DNA, 140 bp, Artificial Sequence
  Synthetic
atggccgactcccaagtacgattagtttttttgccacaagctgggccaaggtatcatcagggctgatacttggcatcagttcatcgacttccattctagaaactcctaacctttctaactggagacccagcatggcgtat

SEQ ID NO: 365011 - DNA, 140 bp, Artificial Sequence
  Synthetic
atacgccatgctgggtctcccagcctcaatgtttcgacggaagaatactcagcagaggtatctaggctcaaacaaacactaacagcccgaaatgttttacatgggttagctggaggaatacgtacttgggagtcggccat

SEQ ID NO: 365012 - DNA, 140 bp, Artificial Sequence
  Synthetic
atggccgactcccaagtacgtattcctccagctaacccatgtaaaacatttcgggctgttagtgtttgtttgagcctagatacctctgctgagtattcttccgtcgaaacattgaggctgggagacccagcatggcgtat

SEQ ID NO: 365013 - DNA, 140 bp, Artificial Sequence
  Synthetic
atacgccatgctgggtctcccaaagacaacgttttcttgtcactgacagacagatggtctaccaagcatagcacaaactaccgtgacagttgcggcaaacaattaactggtaggataatccgtacttgggagtcggccat

SEQ ID NO: 365014 - DNA, 140 bp, Artificial Sequence
  Synthetic
atggccgactcccaagtacggattatcctaccagttaattgtttgccgcaactgtcacggtagtttgtgctatgcttggtagaccatctgtctgtcagtgacaagaaaacgttgtctttgggagacccagcatggcgtat

SEQ ID NO: 365015 - DNA, 140 bp, Artificial Sequence
  Synthetic
atacgccatgctgggtctcctaacaggcatacaactgttaaggagccttcccttttcaaccccaacatcagatgtgtcaacttgatcacatttgaagacggtctgagggaactttcagtgcgtacttgggagtcggccat

SEQ ID NO: 365016 - DNA, 140 bp, Artificial Sequence
  Synthetic
atggccgactcccaagtacgcactgaaagttccctcagaccgtcttcaaatgtgatcaagttgacacatctgatgttggggttgaaaagggaaggctccttaacagttgtatgcctgttaggagacccagcatggcgtat

SEQ ID NO: 365017 - DNA, 140 bp, Artificial Sequence
  Synthetic
aggccctggctgctgatatggatgtgtcaacttgatcacatttgaagacggtctgagggaactttcagtgatacaaagtcatctcaaagtttttgagaatgaattcaccaacttaaacctgaccttttgggacagcggtg

SEQ ID NO: 365018 - DNA, 140 bp, Artificial Sequence
  Synthetic
caccgctgtcccaaaaggtcaggtttaagttggtgaattcattctcaaaaactttgagatgactttgtatcactgaaagttccctcagaccgtcttcaaatgtgatcaagttgacacatccatatcagcagccagggcct

SEQ ID NO: 365019 - DNA, 140 bp, Artificial Sequence
  Synthetic
atacgccatgctgggtctccctgcagaatctgagttagaggcaaatcgtgcagtgattgttaagaccaaactgttttcagcaaccgaacaggttcggctatctaacaaccctgcagttgtcgtacttgggagtcggccat

SEQ ID NO: 365020 - DNA, 140 bp, Artificial Sequence
  Synthetic
atggccgactcccaagtacgacaactgcagggttgttagatagccgaacctgttcggttgctgaaaacagtttggtcttaacaatcactgcacgatttgcctctaactcagattctgcagggagacccagcatggcgtat

SEQ ID NO: 365021 - DNA, 140 bp, Artificial Sequence
  Synthetic
aggccctggctgctgatatgctgttttcagcaaccgaacaggttcggctatctaacaaccctgcagttgtcatgggttatctattagatgaatccgcaatttctgaagttaaacctacaagaccttttgggacagcggtg

SEQ ID NO: 365022 - DNA, 140 bp, Artificial Sequence
  Synthetic
caccgctgtcccaaaaggtcttgtaggtttaacttcagaaattgcggattcatctaatagataacccatgacaactgcagggttgttagatagccgaacctgttcggttgctgaaaacagcatatcagcagccagggcct

SEQ ID NO: 365023 - DNA, 140 bp, Artificial Sequence
  Synthetic
atacgccatgctgggtctccttcccttccgtgttcactttaatcaaaatgctaacagatgagtcgtcagactcagaaaagaatggtcttagtccagatttgcaacaagttgcaagatactcgtacttgggagtcggccat

SEQ ID NO: 365024 - DNA, 140 bp, Artificial Sequence
  Synthetic
atggccgactcccaagtacgagtatcttgcaacttgttgcaaatctggactaagaccattcttttctgagtctgacgactcatctgttagcattttgattaaagtgaacacggaagggaaggagacccagcatggcgtat

SEQ ID NO: 365025 - DNA, 140 bp, Artificial Sequence
  Synthetic
aggccctggctgctgatatgctcagaaaagaatggtcttagtccagatttgcaacaagttgcaagatactccaaccatttaaccttacttagcagaatgatacaacaagcaaagccaaccgaccttttgggacagcggtg

SEQ ID NO: 365026 - DNA, 140 bp, Artificial Sequence
  Synthetic
caccgctgtcccaaaaggtcggttggctttgcttgttgtatcattctgctaagtaaggttaaatggttggagtatcttgcaacttgttgcaaatctggactaagaccattcttttctgagcatatcagcagccagggcct

SEQ ID NO: 365027 - DNA, 140 bp, Artificial Sequence
  Synthetic
atacgccatgctgggtctccagttgctgagcttgtcagttacggtataaaggaaggtaggttctataggctttccgacactggaatcgatgcaagtacatattctgtaaaatattggaagcgtacttgggagtcggccat

SEQ ID NO: 365028 - DNA, 140 bp, Artificial Sequence
  Synthetic
atggccgactcccaagtacgcttccaatattttacagaatatgtacttgcatcgattccagtgtcggaaagcctatagaacctaccttcctttataccgtaactgacaagctcagcaactggagacccagcatggcgtat

SEQ ID NO: 365029 - DNA, 140 bp, Artificial Sequence
  Synthetic
aggccctggctgctgatatgtttccgacactggaatcgatgcaagtacatattctgtaaaatattggaagattctccactgcatttctgctatcggatgcctacctctgagtcaagcagagaccttttgggacagcggtg

SEQ ID NO: 365030 - DNA, 140 bp, Artificial Sequence
  Synthetic
caccgctgtcccaaaaggtctctgcttgactcagaggtaggcatccgatagcagaaatgcagtggagaatcttccaatattttacagaatatgtacttgcatcgattccagtgtcggaaacatatcagcagccagggcct

SEQ ID NO: 365031 - DNA, 140 bp, Artificial Sequence
  Synthetic
atacgccatgctgggtctccttaaagcttctgattgtccattgtctagtcatgaagcaagtatacttagtgaatttgacagtcaagttattgctaacatacttgccagtgaattaagttccgtacttgggagtcggccat

SEQ ID NO: 365032 - DNA, 140 bp, Artificial Sequence
  Synthetic
atggccgactcccaagtacggaacttaattcactggcaagtatgttagcaataacttgactgtcaaattcactaagtatacttgcttcatgactagacaatggacaatcagaagctttaaggagacccagcatggcgtat

SEQ ID NO: 365033 - DNA, 140 bp, Artificial Sequence
  Synthetic
atacgccatgctgggtctccctttaactgatccattttactaccttgctaatcctctctcatcctctctttctttgccactcatttcagtatcatcatcattattattattttggggtgtcgtacttgggagtcggccat

SEQ ID NO: 365034 - DNA, 140 bp, Artificial Sequence
  Synthetic
atggccgactcccaagtacgacaccccaaaataataataatgatgatgatactgaaatgagtggcaaagaaagagaggatgagagaggattagcaaggtagtaaaatggatcagttaaagggagacccagcatggcgtat

SEQ ID NO: 365035 - DNA, 140 bp, Artificial Sequence
  Synthetic
atacgccatgctgggtctcctaaattcacccactgaactgttgaagaagaagccttacttgggaacaacctgcaagttcaacacttggggagactcaaacaggtctggcaagtttacatacgtacttgggagtcggccat

SEQ ID NO: 365036 - DNA, 140 bp, Artificial Sequence
  Synthetic
atggccgactcccaagtacgtatgtaaacttgccagacctgtttgagtctccccaagtgttgaacttgcaggttgttcccaagtaaggcttcttcttcaacagttcagtgggtgaatttaggagacccagcatggcgtat

SEQ ID NO: 365037 - DNA, 140 bp, Artificial Sequence
  Synthetic
aggccctggctgctgatatgtgcaagttcaacacttggggagactcaaacaggtctggcaagtttacatacagtagcagatctggagagtcaattggtattttcattgcagggaaattgcgaccttttgggacagcggtg

SEQ ID NO: 365038 - DNA, 140 bp, Artificial Sequence
  Synthetic
caccgctgtcccaaaaggtcgcaatttccctgcaatgaaaataccaattgactctccagatctgctactgtatgtaaacttgccagacctgtttgagtctccccaagtgttgaacttgcacatatcagcagccagggcct

SEQ ID NO: 365039 - DNA, 140 bp, Artificial Sequence
  Synthetic
aggccctggctgctgatatgacaacatcaattgttcctgagcctccttccacaatcacatgaatgtttacaaaagcacaaggatggcagtgcactgtcagtcatacctgatagcagcaatgaccttttgggacagcggtg

SEQ ID NO: 365040 - DNA, 140 bp, Artificial Sequence
  Synthetic
caccgctgtcccaaaaggtcattgctgctatcaggtatgactgacagtgcactgccatccttgtgcttttgtaaacattcatgtgattgtggaaggaggctcaggaacaattgatgttgtcatatcagcagccagggcct

SEQ ID NO: 365041 - DNA, 140 bp, Artificial Sequence
  Synthetic
atacgccatgctgggtctccaattaaaaaacaaattttgacagtgaagaagcaagtcgtgtttgatgctgaaagtgagcccaggctacagtggggacacggctgcttgtccattgtttatcgtacttgggagtcggccat

SEQ ID NO: 365042 - DNA, 140 bp, Artificial Sequence
  Synthetic
atggccgactcccaagtacgataaacaatggacaagcagccgtgtccccactgtagcctgggctcactttcagcatcaaacacgacttgcttcttcactgtcaaaatttgttttttaattggagacccagcatggcgtat

SEQ ID NO: 365043 - DNA, 140 bp, Artificial Sequence
  Synthetic
aggccctggctgctgatatgaaagtgagcccaggctacagtggggacacggctgcttgtccattgtttatgatgaaaccgacactcagaccacataccacgaaaacctcctgaaggtaaagaccttttgggacagcggtg

SEQ ID NO: 365044 - DNA, 140 bp, Artificial Sequence
  Synthetic
caccgctgtcccaaaaggtctttaccttcaggaggttttcgtggtatgtggtctgagtgtcggtttcatcataaacaatggacaagcagccgtgtccccactgtagcctgggctcactttcatatcagcagccagggcct

SEQ ID NO: 365045 - DNA, 140 bp, Artificial Sequence
  Synthetic
atacgccatgctgggtctcctgttttctgattccaaaatcgtcctctcaaggattaagttcaaaacagagcttcttcttaattcattgacgctgcttcactgtttcttgaaacatgctcccgtacttgggagtcggccat

SEQ ID NO: 365046 - DNA, 140 bp, Artificial Sequence
  Synthetic
atggccgactcccaagtacgggagcatgtttcaagaaacagtgaagcagcgtcaatgaattaagaagaagctctgttttgaacttaatccttgagaggacgattttggaatcagaaaacaggagacccagcatggcgtat

SEQ ID NO: 365047 - DNA, 140 bp, Artificial Sequence
  Synthetic
atacgccatgctgggtctcccagtgatgctataatggaagtagagagtaaaagtagcctactacacaagtatctcaaatcaggaggtgttaggcagcggaacactgaggtgcttttcagacgtacttgggagtcggccat

SEQ ID NO: 365048 - DNA, 140 bp, Artificial Sequence
  Synthetic
atggccgactcccaagtacgtctgaaaagcacctcagtgttccgctgcctaacacctcctgatttgagatacttgtgtagtaggctacttttactctctacttccattatagcatcactgggagacccagcatggcgtat

SEQ ID NO: 365049 - DNA, 140 bp, Artificial Sequence
  Synthetic
atacgccatgctgggtctccagaagagattgagttctgcaacaacctgaccaagactgtttcggagaacccgctaccactcagctgttggtctgaagttcaaaactatattgaagacatacgtacttgggagtcggccat

SEQ ID NO: 365050 - DNA, 140 bp, Artificial Sequence
  Synthetic
atggccgactcccaagtacgtatgtcttcaatatagttttgaacttcagaccaacagctgagtggtagcgggttctccgaaacagtcttggtcaggttgttgcagaactcaatctcttctggagacccagcatggcgtat

SEQ ID NO: 365051 - DNA, 140 bp, Artificial Sequence
  Synthetic
atacgccatgctgggtctccccaggggcctgttcagatataaacatctcgaaaacgatgaagaaactggttacagaagaatcattgaaagactgaacaacaaaaaaggaaaaaacaagctcgtacttgggagtcggccat

SEQ ID NO: 365052 - DNA, 140 bp, Artificial Sequence
  Synthetic
atggccgactcccaagtacgagcttgttttttccttttttgttgttcagtctttcaatgattcttctgtaaccagtttcttcatcgttttcgagatgtttatatctgaacaggcccctggggagacccagcatggcgtat

SEQ ID NO: 365053 - DNA, 140 bp, Artificial Sequence
  Synthetic
atacgccatgctgggtctccggcttcaacaatgtgcttgtaaacattgatagaaacacagtgaaaagtgaacttctgtggaaatttacattagacaccaatgtaagtactacaagtaccacgtacttgggagtcggccat

SEQ ID NO: 365054 - DNA, 140 bp, Artificial Sequence
  Synthetic
atggccgactcccaagtacgtggtacttgtagtacttacattggtgtctaatgtaaatttccacagaagttcacttttcactgtgtttctatcaatgtttacaagcacattgttgaagccggagacccagcatggcgtat

SEQ ID NO: 365055 - DNA, 140 bp, Artificial Sequence
  Synthetic
atacgccatgctgggtctccaagtttctgcttgcatttcttctttatgaagaagtgttgatgaacttaatcaaccagtgcaaggcagtaaaggaactcattaatagcacaggactctcagcgtacttgggagtcggccat

SEQ ID NO: 365056 - DNA, 140 bp, Artificial Sequence
  Synthetic
atggccgactcccaagtacgctgagagtcctgtgctattaatgagttcctttactgccttgcactggttgattaagttcatcaacacttcttcataaagaagaaatgcaagcagaaacttggagacccagcatggcgtat

SEQ ID NO: 365057 - DNA, 140 bp, Artificial Sequence
  Synthetic
aggccctggctgctgatatgcaaccagtgcaaggcagtaaaggaactcattaatagcacaggactctcagatctggaactggagagcttgctcactttgtgtgctttttattttcagaatgaccttttgggacagcggtg

SEQ ID NO: 365058 - DNA, 140 bp, Artificial Sequence
  Synthetic
caccgctgtcccaaaaggtcattctgaaaataaaaagcacacaaagtgagcaagctctccagttccagatctgagagtcctgtgctattaatgagttcctttactgccttgcactggttgcatatcagcagccagggcct

SEQ ID NO: 365059 - DNA, 140 bp, Artificial Sequence
  Synthetic
atacgccatgctgggtctcccttggttcacgaggattggcaaaggataggaaaaaatatccttgttcgtgcaaacaatgagctaggtgatgtgtcactgaaggtcaatattgtcttggtgcgtacttgggagtcggccat

SEQ ID NO: 365060 - DNA, 140 bp, Artificial Sequence
  Synthetic
atggccgactcccaagtacgcaccaagacaatattgaccttcagtgacacatcacctagctcattgtttgcacgaacaaggatattttttcctatcctttgccaatcctcgtgaaccaagggagacccagcatggcgtat

SEQ ID NO: 365061 - DNA, 140 bp, Artificial Sequence
  Synthetic
aggccctggctgctgatatgcaaacaatgagctaggtgatgtgtcactgaaggtcaatattgtcttggtgcctcttaaggacatgtccaagccaaagcctgaaagagtggttatagccaggaccttttgggacagcggtg

SEQ ID NO: 365062 - DNA, 140 bp, Artificial Sequence
  Synthetic
caccgctgtcccaaaaggtcctggctataaccactctttcaggctttggcttggacatgtccttaagaggcaccaagacaatattgaccttcagtgacacatcacctagctcattgtttgcatatcagcagccagggcct

SEQ ID NO: 365063 - DNA, 140 bp, Artificial Sequence
  Synthetic
atacgccatgctgggtctcctacctgagcttaaatccttgtctgtgaattgcagaatgggaaactttgaagggcaagagtgctttgagttcaccattttgaaggacaatagcacaaggctcgtacttgggagtcggccat

SEQ ID NO: 365064 - DNA, 140 bp, Artificial Sequence
  Synthetic
atggccgactcccaagtacgagccttgtgctattgtccttcaaaatggtgaactcaaagcactcttgcccttcaaagtttcccattctgcaattcacagacaaggatttaagctcaggtaggagacccagcatggcgtat

SEQ ID NO: 365065 - DNA, 140 bp, Artificial Sequence
  Synthetic
aggccctggctgctgatatggggcaagagtgctttgagttcaccattttgaaggacaatagcacaaggctagattacaacaaattagttgaccattgtgtggatatggaaaaaaagaggggaccttttgggacagcggtg

SEQ ID NO: 365066 - DNA, 140 bp, Artificial Sequence
  Synthetic
caccgctgtcccaaaaggtcccctctttttttccatatccacacaatggtcaactaatttgttgtaatctagccttgtgctattgtccttcaaaatggtgaactcaaagcactcttgccccatatcagcagccagggcct

SEQ ID NO: 365067 - DNA, 140 bp, Artificial Sequence
  Synthetic
atacgccatgctgggtctccgtcaaacctagcactgtgacaccagctgcacatgaaggcgagcagtgtcaggagcaaataagcctagatgatctaatggcaagtgacacagtgacagacccgtacttgggagtcggccat

SEQ ID NO: 365068 - DNA, 140 bp, Artificial Sequence
  Synthetic
atggccgactcccaagtacgggtctgtcactgtgtcacttgccattagatcatctaggcttatttgctcctgacactgctcgccttcatgtgcagctggtgtcacagtgctaggtttgacggagacccagcatggcgtat

SEQ ID NO: 365069 - DNA, 140 bp, Artificial Sequence
  Synthetic
aggccctggctgctgatatgggagcaaataagcctagatgatctaatggcaagtgacacagtgacagaccagcctgatagggaggcagaggcactcaaaacaggcaatcttggctttaacgaccttttgggacagcggtg

SEQ ID NO: 365070 - DNA, 140 bp, Artificial Sequence
  Synthetic
caccgctgtcccaaaaggtcgttaaagccaagattgcctgttttgagtgcctctgcctccctatcaggctggtctgtcactgtgtcacttgccattagatcatctaggcttatttgctcccatatcagcagccagggcct

SEQ ID NO: 365071 - DNA, 140 bp, Artificial Sequence
  Synthetic
atacgccatgctgggtctcctgtcttaagggcaagtatgacagtttataccatgccatttgccaacctctaaacttccaattaagtcagttgctctgcatctcttatagtcaatcaaatccgtacttgggagtcggccat

SEQ ID NO: 365072 - DNA, 140 bp, Artificial Sequence
  Synthetic
atggccgactcccaagtacggatttgattgactataagagatgcagagcaactgacttaattggaagtttagaggttggcaaatggcatggtataaactgtcatacttgcccttaagacaggagacccagcatggcgtat

SEQ ID NO: 365073 - DNA, 140 bp, Artificial Sequence
  Synthetic
atacgccatgctgggtctccgcttcattacagttctcacaactattggttaacatttaccatcctgctatttcactttctttgctgtttatatcagtttcattatttccagggtgtggggcgtacttgggagtcggccat

SEQ ID NO: 365074 - DNA, 140 bp, Artificial Sequence
  Synthetic
atggccgactcccaagtacgccccacaccctggaaataatgaaactgatataaacagcaaagaaagtgaaatagcaggatggtaaatgttaaccaatagttgtgagaactgtaatgaagcggagacccagcatggcgtat

SEQ ID NO: 365075 - DNA, 140 bp, Artificial Sequence
  Synthetic
atacgccatgctgggtctccgacgaagttgacaaggcgagtgctgacagtatgataacaaaccttctcaagcacattgccaaggcacaggagctctacaagaattcgtctgcactccgtgcgtacttgggagtcggccat

SEQ ID NO: 365076 - DNA, 140 bp, Artificial Sequence
  Synthetic
atggccgactcccaagtacgcacggagtgcagacgaattcttgtagagctcctgtgccttggcaatgtgcttgagaaggtttgttatcatactgtcagcactcgccttgtcaacttcgtcggagacccagcatggcgtat

SEQ ID NO: 365077 - DNA, 140 bp, Artificial Sequence
  Synthetic
aggccctggctgctgatatggcacattgccaaggcacaggagctctacaagaattcgtctgcactccgtgcacaaggtgcccagattgacactgccttcagctcatactactggctttacgaccttttgggacagcggtg

SEQ ID NO: 365078 - DNA, 140 bp, Artificial Sequence
  Synthetic
caccgctgtcccaaaaggtcgtaaagccagtagtatgagctgaaggcagtgtcaatctgggcaccttgtgcacggagtgcagacgaattcttgtagagctcctgtgccttggcaatgtgccatatcagcagccagggcct

SEQ ID NO: 365079 - DNA, 140 bp, Artificial Sequence
  Synthetic
aggccctggctgctgatatgacaggccagctcatcacccatggaagagtaagtgccaaacttaacgatggaaacttaaaagataggagtgatgacgaccaaaggctagccgagaaggtgggaccttttgggacagcggtg

SEQ ID NO: 365080 - DNA, 140 bp, Artificial Sequence
  Synthetic
caccgctgtcccaaaaggtcccaccttctcggctagcctttggtcgtcatcactcctatcttttaagtttccatcgttaagtttggcacttactcttccatgggtgatgagctggcctgtcatatcagcagccagggcct

SEQ ID NO: 365081 - DNA, 140 bp, Artificial Sequence
  Synthetic
atacgccatgctgggtctccccatagctgcaatactcaatcatgcttattttacttgcttatataaccttattttattaacttttctctattttcttttgtcttaaacacttggagggctcgtacttgggagtcggccat

SEQ ID NO: 365082 - DNA, 140 bp, Artificial Sequence
  Synthetic
atggccgactcccaagtacgagccctccaagtgtttaagacaaaagaaaatagagaaaagttaataaaataaggttatataagcaagtaaaataagcatgattgagtattgcagctatggggagacccagcatggcgtat

SEQ ID NO: 365083 - DNA, 140 bp, Artificial Sequence
  Synthetic
atacgccatgctgggtctcctctcaaagaaatacttgcggcacgtcagtacgtaagtatcaactttgagggtgctagtggagtgttcagcagtcaacatgttgtgtcatatcaaacacatcgtacttgggagtcggccat

SEQ ID NO: 365084 - DNA, 140 bp, Artificial Sequence
  Synthetic
atggccgactcccaagtacgatgtgtttgatatgacacaacatgttgactgctgaacactccactagcaccctcaaagttgatacttacgtactgacgtgccgcaagtatttctttgagaggagacccagcatggcgtat

SEQ ID NO: 365085 - DNA, 140 bp, Artificial Sequence
  Synthetic
aggccctggctgctgatatggtgctagtggagtgttcagcagtcaacatgttgtgtcatatcaaacacatattattgttttgcattatcctttatcatcaacaatggaacacaggagcttgaccttttgggacagcggtg

SEQ ID NO: 365086 - DNA, 140 bp, Artificial Sequence
  Synthetic
caccgctgtcccaaaaggtcaagctcctgtgttccattgttgatgataaaggataatgcaaaacaataatatgtgtttgatatgacacaacatgttgactgctgaacactccactagcaccatatcagcagccagggcct

SEQ ID NO: 365087 - DNA, 140 bp, Artificial Sequence
  Synthetic
atacgccatgctgggtctccattattgttttgcattatcctttatcatcaacaatggaacacaggagcttccaatacaactatcagccctacaactaacaaatcccacacagacatatcccgtacttgggagtcggccat

SEQ ID NO: 365088 - DNA, 140 bp, Artificial Sequence
  Synthetic
atggccgactcccaagtacgggatatgtctgtgtgggatttgttagttgtagggctgatagttgtattggaagctcctgtgttccattgttgatgataaaggataatgcaaaacaataatggagacccagcatggcgtat

SEQ ID NO: 365089 - DNA, 140 bp, Artificial Sequence
  Synthetic
aggccctggctgctgatatgtcagccccaagcagctcatcgacagctgagaacaacacgatgtttcaaccagctcaagacaccaccaccagtggtgtttcggaacagtacaacccaacaagaccttttgggacagcggtg

SEQ ID NO: 365090 - DNA, 140 bp, Artificial Sequence
  Synthetic
caccgctgtcccaaaaggtcttgttgggttgtactgttccgaaacaccactggtggtggtgtcttgagctggttgaaacatcgtgttgttctcagctgtcgatgagctgcttggggctgacatatcagcagccagggcct

SEQ ID NO: 365091 - DNA, 140 bp, Artificial Sequence
  Synthetic
atacgccatgctgggtctcccaccgcgccgcccgaaagatcagtcacaccctcacacactccaaccacctcagtctccgaagccggctccggagagccccctgcggcaactcctgcctcacgtacttgggagtcggccat

SEQ ID NO: 365092 - DNA, 140 bp, Artificial Sequence
  Synthetic
atggccgactcccaagtacgtgaggcaggagttgccgcagggggctctccggagccggcttcggagactgaggtggttggagtgtgtgagggtgtgactgatctttcgggcggcgcggtgggagacccagcatggcgtat

SEQ ID NO: 365093 - DNA, 140 bp, Artificial Sequence
  Synthetic
aggccctggctgctgatatgcagtctccgaagccggctccggagagccccctgcggcaactcctgcctcagccaccgcccagagcccagagccagcaagcgcagcccaaccatcaccaacgaccttttgggacagcggtg

SEQ ID NO: 365094 - DNA, 140 bp, Artificial Sequence
  Synthetic
caccgctgtcccaaaaggtcgttggtgatggttgggctgcgcttgctggctctgggctctgggcggtggctgaggcaggagttgccgcagggggctctccggagccggcttcggagactgcatatcagcagccagggcct

SEQ ID NO: 365095 - DNA, 140 bp, Artificial Sequence
  Synthetic
atacgccatgctgggtctccccgccaccagcagaccccaagagccaagcacccatccaagccccaggagcagcccaagcaagcctgtagagactcaaagcacacgccacactgcaagagacgtacttgggagtcggccat

SEQ ID NO: 365096 - DNA, 140 bp, Artificial Sequence
  Synthetic
atggccgactcccaagtacgtctcttgcagtgtggcgtgtgctttgagtctctacaggcttgcttgggctgctcctggggcttggatgggtgcttggctcttggggtctgctggtggcggggagacccagcatggcgtat

SEQ ID NO: 365097 - DNA, 140 bp, Artificial Sequence
  Synthetic
aggccctggctgctgatatgagcccaagcaagcctgtagagactcaaagcacacgccacactgcaagagagctcctctcagtaacaggcacggaggcagaacagctcatcacacagacaagaccttttgggacagcggtg

SEQ ID NO: 365098 - DNA, 140 bp, Artificial Sequence
  Synthetic
caccgctgtcccaaaaggtcttgtctgtgtgatgagctgttctgcctccgtgcctgttactgagaggagctctcttgcagtgtggcgtgtgctttgagtctctacaggcttgcttgggctcatatcagcagccagggcct

SEQ ID NO: 365099 - DNA, 140 bp, Artificial Sequence
  Synthetic
atacgccatgctgggtctccagcaaccccgaccccacactggcaacaaccagccgctccatcaacagcattaaccccaaggggccagagtcaaccagagccacaccccaatccacatccccgtacttgggagtcggccat

SEQ ID NO: 365100 - DNA, 140 bp, Artificial Sequence
  Synthetic
atggccgactcccaagtacggggatgtggattggggtgtggctctggttgactctggccccttggggttaatgctgttgatggagcggctggttgttgccagtgtggggtcggggttgctggagacccagcatggcgtat

SEQ ID NO: 365101 - DNA, 140 bp, Artificial Sequence
  Synthetic
aggccctggctgctgatatgtaaccccaaggggccagagtcaaccagagccacaccccaatccacatccccaacacccgagagttcaacaattcagactcaaattctgccaatcattaccgaccttttgggacagcggtg

SEQ ID NO: 365102 - DNA, 140 bp, Artificial Sequence
  Synthetic
caccgctgtcccaaaaggtcggtaatgattggcagaatttgagtctgaattgttgaactctcgggtgttggggatgtggattggggtgtggctctggttgactctggccccttggggttacatatcagcagccagggcct

SEQ ID NO: 365103 - DNA, 140 bp, Artificial Sequence
  Synthetic
atacgccatgctgggtctccaaaccttggtactgagataatcctgactctcccacaaggtctcaagaaatactacagtaaagtgcttaagctgatgcacctcaccagggaagaagactcccgtacttgggagtcggccat

SEQ ID NO: 365104 - DNA, 140 bp, Artificial Sequence
  Synthetic
atggccgactcccaagtacgggagtcttcttccctggtgaggtgcatcagcttaagcactttactgtagtatttcttgagaccttgtgggagagtcaggattatctcagtaccaaggtttggagacccagcatggcgtat

SEQ ID NO: 365105 - DNA, 140 bp, Artificial Sequence
  Synthetic
aggccctggctgctgatatgactacagtaaagtgcttaagctgatgcacctcaccagggaagaagactccgagggtctgcttgagtggtgtacacggatcttgggacaaacctgtgatgagaccttttgggacagcggtg

SEQ ID NO: 365106 - DNA, 140 bp, Artificial Sequence
  Synthetic
caccgctgtcccaaaaggtctcatcacaggtttgtcccaagatccgtgtacaccactcaagcagaccctcggagtcttcttccctggtgaggtgcatcagcttaagcactttactgtagtcatatcagcagccagggcct

SEQ ID NO: 365107 - DNA, 140 bp, Artificial Sequence
  Synthetic
atacgccatgctgggtctccattttaatgaggttctgctattcaaagaaacgactgatgcacccacattagcaccaactcacaaaggagcaccaccaactgagccttttaagtcttactacgtacttgggagtcggccat

SEQ ID NO: 365108 - DNA, 140 bp, Artificial Sequence
  Synthetic
atggccgactcccaagtacgtagtaagacttaaaaggctcagttggtggtgctcctttgtgagttggtgctaatgtgggtgcatcagtcgtttctttgaatagcagaacctcattaaaatggagacccagcatggcgtat

SEQ ID NO: 365109 - DNA, 140 bp, Artificial Sequence
  Synthetic
aggccctggctgctgatatggcaccaactcacaaaggagcaccaccaactgagccttttaagtcttactatgctaagggattcatcacaatggattcgggctacttttctgctaaatgctgaccttttgggacagcggtg

SEQ ID NO: 365110 - DNA, 140 bp, Artificial Sequence
  Synthetic
caccgctgtcccaaaaggtcagcatttagcagaaaagtagcccgaatccattgtgatgaatcccttagcatagtaagacttaaaaggctcagttggtggtgctcctttgtgagttggtgccatatcagcagccagggcct

SEQ ID NO: 365111 - DNA, 140 bp, Artificial Sequence
  Synthetic
aggccctggctgctgatatgaatagcaactttaacgtctgcaaaagactaacgggaaggagtactggggaaaggctccctagaagcgttagaagtaaggtcatatatgagatggtaaaacgaccttttgggacagcggtg

SEQ ID NO: 365112 - DNA, 140 bp, Artificial Sequence
  Synthetic
caccgctgtcccaaaaggtcgttttaccatctcatatatgaccttacttctaacgcttctagggagcctttccccagtactccttcccgttagtcttttgcagacgttaaagttgctattcatatcagcagccagggcct

SEQ ID NO: 365113 - DNA, 140 bp, Artificial Sequence
  Synthetic
atacgccatgctgggtctcctcatctaagatgcccattactccaggcccaaagtactccaatctcaagaacattaactgtataaacctaaaagtgtcaactgataaagaacacaatgaagcgtacttgggagtcggccat

SEQ ID NO: 365114 - DNA, 140 bp, Artificial Sequence
  Synthetic
atggccgactcccaagtacgcttcattgtgttctttatcagttgacacttttaggtttatacagttaatgttcttgagattggagtactttgggcctggagtaatgggcatcttagatgaggagacccagcatggcgtat

SEQ ID NO: 365115 - DNA, 140 bp, Artificial Sequence
  Synthetic
aggccctggctgctgatatgcattaactgtataaacctaaaagtgtcaactgataaagaacacaatgaagttgagataaatgtgcttcttccccaagttgcagtaaatctctcaagctgtgaccttttgggacagcggtg

SEQ ID NO: 365116 - DNA, 140 bp, Artificial Sequence
  Synthetic
caccgctgtcccaaaaggtcacagcttgagagatttactgcaacttggggaagaagcacatttatctcaacttcattgtgttctttatcagttgacacttttaggtttatacagttaatgcatatcagcagccagggcct

SEQ ID NO: 365117 - DNA, 140 bp, Artificial Sequence
  Synthetic
atacgccatgctgggtctccaatgataaagcttccccagataactcacgagggaacttttatacctggaacttataagatcataatagacaaaaagaacaaacaaaatgacagatgtactcgtacttgggagtcggccat

SEQ ID NO: 365118 - DNA, 140 bp, Artificial Sequence
  Synthetic
atggccgactcccaagtacgagtacatctgtcattttgtttgttctttttgtctattatgatcttataagttccaggtataaaagttccctcgtgagttatctggggaagctttatcattggagacccagcatggcgtat

SEQ ID NO: 365119 - DNA, 140 bp, Artificial Sequence
  Synthetic
aggccctggctgctgatatgcttataagatcataatagacaaaaagaacaaacaaaatgacagatgtactttgatcaccaactgcgtcataaagggaagagaggtcaggaaggggcagtcgaccttttgggacagcggtg

SEQ ID NO: 365120 - DNA, 140 bp, Artificial Sequence
  Synthetic
caccgctgtcccaaaaggtcgactgccccttcctgacctctcttccctttatgacgcagttggtgatcaaagtacatctgtcattttgtttgttctttttgtctattatgatcttataagcatatcagcagccagggcct

SEQ ID NO: 365121 - DNA, 140 bp, Artificial Sequence
  Synthetic
atacgccatgctgggtctcctagcagtctgtgttgttagcacttcagcagtagagatggaaagcctaccagctgggacctgggaaagagaagaagaccttacaaatttctgccatcaggacgtacttgggagtcggccat

SEQ ID NO: 365122 - DNA, 140 bp, Artificial Sequence
  Synthetic
atggccgactcccaagtacgtcctgatggcagaaatttgtaaggtcttcttctctttcccaggtcccagctggtaggctttccatctctactgctgaagtgctaacaacacagactgctaggagacccagcatggcgtat

SEQ ID NO: 365123 - DNA, 140 bp, Artificial Sequence
  Synthetic
atacgccatgctgggtctccgcactagaagattgttatcagaaagcaacaacaatgattgcgtatcaaggactcagctgatcaagacagaaaatgctgaaatacatggtgatgactatggcgtacttgggagtcggccat

SEQ ID NO: 365124 - DNA, 140 bp, Artificial Sequence
  Synthetic
atggccgactcccaagtacgccatagtcatcaccatgtatttcagcattttctgtcttgatcagctgagtccttgatacgcaatcattgttgttgctttctgataacaatcttctagtgcggagacccagcatggcgtat

SEQ ID NO: 365125 - DNA, 140 bp, Artificial Sequence
  Synthetic
aggccctggctgctgatatgactcagctgatcaagacagaaaatgctgaaatacatggtgatgactatggcgggcccggagagaaaataaccatctgcaacggctctactattgtagaacgaccttttgggacagcggtg

SEQ ID NO: 365126 - DNA, 140 bp, Artificial Sequence
  Synthetic
caccgctgtcccaaaaggtcgttctacaatagtagagccgttgcagatggttattttctctccgggcccgccatagtcatcaccatgtatttcagcattttctgtcttgatcagctgagtcatatcagcagccagggcct

SEQ ID NO: 365127 - DNA, 140 bp, Artificial Sequence
  Synthetic
atacgccatgctgggtctccttcaaactatgcgaaaatagtgcttcaggaaagggttgtgaaattgacagtactccagtaaaatgtaagcaaggcttctgtttgaaaataacccaagaagcgtacttgggagtcggccat

SEQ ID NO: 365128 - DNA, 140 bp, Artificial Sequence
  Synthetic
atggccgactcccaagtacgcttcttgggttattttcaaacagaagccttgcttacattttactggagtactgtcaatttcacaaccctttcctgaagcactattttcgcatagtttgaaggagacccagcatggcgtat

SEQ ID NO: 365129 - DNA, 140 bp, Artificial Sequence
  Synthetic
aggccctggctgctgatatgtactccagtaaaatgtaagcaaggcttctgtttgaaaataacccaagaaggaaggggtcatgttaaactttccagaggctcagagataattctagacgttgaccttttgggacagcggtg

SEQ ID NO: 365130 - DNA, 140 bp, Artificial Sequence
  Synthetic
caccgctgtcccaaaaggtcaacgtctagaattatctctgagcctctggaaagtttaacatgaccccttccttcttgggttattttcaaacagaagccttgcttacattttactggagtacatatcagcagccagggcct

SEQ ID NO: 365131 - DNA, 140 bp, Artificial Sequence
  Synthetic
atacgccatgctgggtctccggtagattgctctggaggacagcagcacttcctacaggacaacttggtcgacttaggatgcccaaacgttcccctactgggcaaaatggccatatacatccgtacttgggagtcggccat

SEQ ID NO: 365132 - DNA, 140 bp, Artificial Sequence
  Synthetic
atggccgactcccaagtacggatgtatatggccattttgcccagtaggggaacgtttgggcatcctaagtcgaccaagttgtcctgtaggaagtgctgctgtcctccagagcaatctaccggagacccagcatggcgtat

SEQ ID NO: 365133 - DNA, 140 bp, Artificial Sequence
  Synthetic
aggccctggctgctgatatgacttaggatgcccaaacgttcccctactgggcaaaatggccatatacatctgcagaatgtcaaaccaccccaagacaaccatggccttcctcttttggttgaccttttgggacagcggtg

SEQ ID NO: 365134 - DNA, 140 bp, Artificial Sequence
  Synthetic
caccgctgtcccaaaaggtcaaccaaaagaggaaggccatggttgtcttggggtggtttgacattctgcagatgtatatggccattttgcccagtaggggaacgtttgggcatcctaagtcatatcagcagccagggcct

SEQ ID NO: 365135 - DNA, 140 bp, Artificial Sequence
  Synthetic
atacgccatgctgggtctcctcaattttcggaccccaatagacagaaacttaggatagtagaatcaagaccagcggaatctgaactagaagcaaaccgagctgtgatagtcaagaccaagcgtacttgggagtcggccat

SEQ ID NO: 365136 - DNA, 140 bp, Artificial Sequence
  Synthetic
atggccgactcccaagtacgcttggtcttgactatcacagctcggtttgcttctagttcagattccgctggtcttgattctactatcctaagtttctgtctattggggtccgaaaattgaggagacccagcatggcgtat

SEQ ID NO: 365137 - DNA, 140 bp, Artificial Sequence
  Synthetic
atacgccatgctgggtctcctgctaataataattggaacattaggaaaaaggatcaaacagtacagagagcttaagcctcagacctgcactatatgtgaagcaactcctgttaatgcaatcgtacttgggagtcggccat

SEQ ID NO: 365138 - DNA, 140 bp, Artificial Sequence
  Synthetic
atggccgactcccaagtacgattgcattaacaggagttgcttcacatatagtgcaggtctgaggcttaagctctctgtactgtttgatcctttttcctaatgttccaattattattagcaggagacccagcatggcgtat

SEQ ID NO: 365139 - DNA, 140 bp, Artificial Sequence
  Synthetic
aggccctggctgctgatatgcttaagcctcagacctgcactatatgtgaagcaactcctgttaatgcaatagatgctgaaatgcatgatcttaactgtagctacaacatatgcccttattgaccttttgggacagcggtg

SEQ ID NO: 365140 - DNA, 140 bp, Artificial Sequence
  Synthetic
caccgctgtcccaaaaggtcaataagggcatatgttgtagctacagttaagatcatgcatttcagcatctattgcattaacaggagttgcttcacatatagtgcaggtctgaggcttaagcatatcagcagccagggcct

SEQ ID NO: 365141 - DNA, 140 bp, Artificial Sequence
  Synthetic
atacgccatgctgggtctcccctaagaggaaggaaaagatagaggaaacagagctgtacttaaatttggaaaggataccctggtttgtcagaaagctcttgcaggtatcagaatcaacagcgtacttgggagtcggccat

SEQ ID NO: 365142 - DNA, 140 bp, Artificial Sequence
  Synthetic
atggccgactcccaagtacgctgttgattctgatacctgcaagagctttctgacaaaccagggtatcctttccaaatttaagtacagctctgtttcctctatcttttccttcctcttaggggagacccagcatggcgtat

SEQ ID NO: 365143 - DNA, 140 bp, Artificial Sequence
  Synthetic
aggccctggctgctgatatgaaggataccctggtttgtcagaaagctcttgcaggtatcagaatcaacaggggtagcgctcaagagaagcagctggctggtgacacttcttgtgttgctagaccttttgggacagcggtg

SEQ ID NO: 365144 - DNA, 140 bp, Artificial Sequence
  Synthetic
caccgctgtcccaaaaggtctagcaacacaagaagtgtcaccagccagctgcttctcttgagcgctacccctgttgattctgatacctgcaagagctttctgacaaaccagggtatccttcatatcagcagccagggcct

SEQ ID NO: 365145 - DNA, 140 bp, Artificial Sequence
  Synthetic
atacgccatgctgggtctccggtagtaacgtaccaagtcagagaaagttacacaggcatgtgtcttttcatcctaggtagtgtcctttttgcaatctcctggttgacaaagggactggtacgtacttgggagtcggccat

SEQ ID NO: 365146 - DNA, 140 bp, Artificial Sequence
  Synthetic
atggccgactcccaagtacgtaccagtccctttgtcaaccaggagattgcaaaaaggacactacctaggatgaaaagacacatgcctgtgtaactttctctgacttggtacgttactaccggagacccagcatggcgtat

SEQ ID NO: 365147 - DNA, 140 bp, Artificial Sequence
  Synthetic
aggccctggctgctgatatgtcctaggtagtgtcctttttgcaatctcctggttgacaaagggactggtagacagtgttggtaacattttctttcctggactttcagtttgtaaaacatggaccttttgggacagcggtg

SEQ ID NO: 365148 - DNA, 140 bp, Artificial Sequence
  Synthetic
caccgctgtcccaaaaggtccatgttttacaaactgaaagtccaggaaagaaaatgttaccaacactgtctaccagtccctttgtcaaccaggagattgcaaaaaggacactacctaggacatatcagcagccagggcct

SEQ ID NO: 365149 - DNA, 140 bp, Artificial Sequence
  Synthetic
atacgccatgctgggtctccgtagccttttctgctgcccttactgtagatactgctcggccgacagaggtgctcaccagtctcatttgagtgtttgtaaaaagaggaaaactggaagcaacgtacttgggagtcggccat

SEQ ID NO: 365150 - DNA, 140 bp, Artificial Sequence
  Synthetic
atggccgactcccaagtacgttgcttccagttttcctctttttacaaacactcaaatgagactggtgagcacctctgtcggccgagcagtatctacagtaagggcagcagaaaaggctacggagacccagcatggcgtat

SEQ ID NO: 365151 - DNA, 140 bp, Artificial Sequence
  Synthetic
aggccctggctgctgatatggctcaccagtctcatttgagtgtttgtaaaaagaggaaaactggaagcaatgtcatgttagctgtctgcaagcgcatgtgttttagagctactttaaagggaccttttgggacagcggtg

SEQ ID NO: 365152 - DNA, 140 bp, Artificial Sequence
  Synthetic
caccgctgtcccaaaaggtccctttaaagtagctctaaaacacatgcgcttgcagacagctaacatgacattgcttccagttttcctctttttacaaacactcaaatgagactggtgagccatatcagcagccagggcct

SEQ ID NO: 365153 - DNA, 140 bp, Artificial Sequence
  Synthetic
atacgccatgctgggtctccgtgtgcattctaatattagttgtctgtgttgttagcacctcagccgtagagatggagaacttgccagcaggtacttgggagaaggaagaggacctaacaacgtacttgggagtcggccat

SEQ ID NO: 365154 - DNA, 140 bp, Artificial Sequence
  Synthetic
atggccgactcccaagtacgttgttaggtcctcttccttctcccaagtacctgctggcaagttctccatctctacggctgaggtgctaacaacacagacaactaatattagaatgcacacggagacccagcatggcgtat

SEQ ID NO: 365155 - DNA, 140 bp, Artificial Sequence
  Synthetic
aggccctggctgctgatatggatggagaacttgccagcaggtacttgggagaaggaagaggacctaacaaacttctgtcaccaagaatgtcaggtaacagaaaccgaatgcctctgtccagaccttttgggacagcggtg

SEQ ID NO: 365156 - DNA, 140 bp, Artificial Sequence
  Synthetic
caccgctgtcccaaaaggtctggacagaggcattcggtttctgttacctgacattcttggtgacagaagtttgttaggtcctcttccttctcccaagtacctgctggcaagttctccatccatatcagcagccagggcct

SEQ ID NO: 365157 - DNA, 140 bp, Artificial Sequence
  Synthetic
atacgccatgctgggtctccgagcatgaaaagcctgttaaattcaacaagtttggaaacaagcctgtcaattgaagcaccctggggggcaattaatgtacagtcaactttcaaacccacccgtacttgggagtcggccat

SEQ ID NO: 365158 - DNA, 140 bp, Artificial Sequence
  Synthetic
atggccgactcccaagtacgggtgggtttgaaagttgactgtacattaattgccccccagggtgcttcaattgacaggcttgtttccaaacttgttgaatttaacaggcttttcatgctcggagacccagcatggcgtat

SEQ ID NO: 365159 - DNA, 140 bp, Artificial Sequence
  Synthetic
aggccctggctgctgatatgttgaagcaccctggggggcaattaatgtacagtcaactttcaaacccaccgcttcgactgcaaatatagcgctcagttggagctcagtagaacacagagggaccttttgggacagcggtg

SEQ ID NO: 365160 - DNA, 140 bp, Artificial Sequence
  Synthetic
caccgctgtcccaaaaggtccctctgtgttctactgagctccaactgagcgctatatttgcagtcgaagcggtgggtttgaaagttgactgtacattaattgccccccagggtgcttcaacatatcagcagccagggcct

SEQ ID NO: 365161 - DNA, 140 bp, Artificial Sequence
  Synthetic
atacgccatgctgggtctccaaagaacaggaatcagttggaatctcggtgtggaagatgcttctgaatcaaagacactcactgtatcagtcatggacttatctcagatgtattccactgtcgtacttgggagtcggccat

SEQ ID NO: 365162 - DNA, 140 bp, Artificial Sequence
  Synthetic
atggccgactcccaagtacgacagtggaatacatctgagataagtccatgactgatacagtgagtgtctttgattcagaagcatcttccacaccgagattccaactgattcctgttctttggagacccagcatggcgtat

SEQ ID NO: 365163 - DNA, 140 bp, Artificial Sequence
  Synthetic
aggccctggctgctgatatgaagacactcactgtatcagtcatggacttatctcagatgtattccactgtcttcgagtacttatcaggcgaccggcaagtagaggagtggcctaaagcaagaccttttgggacagcggtg

SEQ ID NO: 365164 - DNA, 140 bp, Artificial Sequence
  Synthetic
caccgctgtcccaaaaggtcttgctttaggccactcctctacttgccggtcgcctgataagtactcgaagacagtggaatacatctgagataagtccatgactgatacagtgagtgtcttcatatcagcagccagggcct

SEQ ID NO: 365165 - DNA, 140 bp, Artificial Sequence
  Synthetic
atacgccatgctgggtctccctccacaaggcgtggccccattcaaggaactggaggtgcaaccccacgtggtgttggggagttggaactggttgcacttgctgtggattggatgtgaaaacgtacttgggagtcggccat

SEQ ID NO: 365166 - DNA, 140 bp, Artificial Sequence
  Synthetic
atggccgactcccaagtacgttttcacatccaatccacagcaagtgcaaccagttccaactccccaacaccacgtggggttgcacctccagttccttgaatggggccacgccttgtggagggagacccagcatggcgtat

SEQ ID NO: 365167 - DNA, 140 bp, Artificial Sequence
  Synthetic
aggccctggctgctgatatggtgttggggagttggaactggttgcacttgctgtggattggatgtgaaaaacctctttactgactatatgcttatcaaatggaaagttgaatttataaaagaccttttgggacagcggtg

SEQ ID NO: 365168 - DNA, 140 bp, Artificial Sequence
  Synthetic
caccgctgtcccaaaaggtcttttataaattcaactttccatttgataagcatatagtcagtaaagaggtttttcacatccaatccacagcaagtgcaaccagttccaactccccaacaccatatcagcagccagggcct

SEQ ID NO: 365169 - DNA, 140 bp, Artificial Sequence
  Synthetic
atacgccatgctgggtctcctcttatagaagcaggcacaagatttaacttgggccctgttaccatcactttatcagaaccaagaaacattcagcagaagctccctcctgaactggttacgcgtacttgggagtcggccat

SEQ ID NO: 365170 - DNA, 140 bp, Artificial Sequence
  Synthetic
atggccgactcccaagtacgcgtaaccagttcaggagggagcttctgctgaatgtttcttggttctgataaagtgatggtaacagggcccaagttaaatcttgtgcctgcttctataagaggagacccagcatggcgtat

SEQ ID NO: 365171 - DNA, 140 bp, Artificial Sequence
  Synthetic
aggccctggctgctgatatgtatcagaaccaagaaacattcagcagaagctccctcctgaactggttacgctgcatccaagagtagaagaaggcttcttcgaccttatgcatgtgcagaagaccttttgggacagcggtg

SEQ ID NO: 365172 - DNA, 140 bp, Artificial Sequence
  Synthetic
caccgctgtcccaaaaggtcttctgcacatgcataaggtcgaagaagccttcttctactcttggatgcagcgtaaccagttcaggagggagcttctgctgaatgtttcttggttctgatacatatcagcagccagggcct

SEQ ID NO: 365173 - DNA, 140 bp, Artificial Sequence
  Synthetic
atacgccatgctgggtctcctaccaggtgacttgcaagtgtatcatgtaggcaacttgctgaaaggggataaaataaatggcaactcatttcacaaaattgagccgaacctaaatacatccgtacttgggagtcggccat

SEQ ID NO: 365174 - DNA, 140 bp, Artificial Sequence
  Synthetic
atggccgactcccaagtacggatgtatttaggttcggctcaattttgtgaaatgagttgccatttattttatcccctttcagcaagttgcctacatgatacacttgcaagtcacctggtaggagacccagcatggcgtat

SEQ ID NO: 365175 - DNA, 140 bp, Artificial Sequence
  Synthetic
aggccctggctgctgatatgaaaataaatggcaactcatttcacaaaattgagccgaacctaaatacatcatggatgtcttgggacggctgtgatcttgattactactgcaacatgggaggaccttttgggacagcggtg

SEQ ID NO: 365176 - DNA, 140 bp, Artificial Sequence
  Synthetic
caccgctgtcccaaaaggtcctcccatgttgcagtagtaatcaagatcacagccgtcccaagacatccatgatgtatttaggttcggctcaattttgtgaaatgagttgccatttattttcatatcagcagccagggcct

SEQ ID NO: 365177 - DNA, 140 bp, Artificial Sequence
  Synthetic
atacgccatgctgggtctccttacagttataactatcaatcacgttcattccaactgcctatgtaatgctgttttgctaattctatcttgctacctttcatttcaaatacttaaagggctcgtacttgggagtcggccat

SEQ ID NO: 365178 - DNA, 140 bp, Artificial Sequence
  Synthetic
atggccgactcccaagtacgagccctttaagtatttgaaatgaaaggtagcaagatagaattagcaaaacagcattacataggcagttggaatgaacgtgattgatagttataactgtaaggagacccagcatggcgtat

SEQ ID NO: 365179 - DNA, 140 bp, Artificial Sequence
  Synthetic
atacgccatgctgggtctcctttgtgaacctgctcaacattgaaactgactatacaaagaacttccactttcactcaaagagagtcacagcacatggagagacgccccagctagaccttacgtacttgggagtcggccat

SEQ ID NO: 365180 - DNA, 140 bp, Artificial Sequence
  Synthetic
atggccgactcccaagtacgtaaggtctagctggggcgtctctccatgtgctgtgactctctttgagtgaaagtggaagttctttgtatagtcagtttcaatgttgagcaggttcacaaaggagacccagcatggcgtat

SEQ ID NO: 365181 - DNA, 140 bp, Artificial Sequence
  Synthetic
atacgccatgctgggtctccgcaaaatggaaaacaaaatcgaggtgaataacaaggatgagatgaacaggtggtttgaagagttcaaaaaagggaacggacttgtggacaccttcacaaacgtacttgggagtcggccat

SEQ ID NO: 365182 - DNA, 140 bp, Artificial Sequence
  Synthetic
atggccgactcccaagtacgtttgtgaaggtgtccacaagtccgttcccttttttgaactcttcaaaccacctgttcatctcatccttgttattcacctcgattttgttttccattttgcggagacccagcatggcgtat

SEQ ID NO: 365183 - DNA, 140 bp, Artificial Sequence
  Synthetic
aggccctggctgctgatatgaaatggccggtgccactgatgatgcacaaaaggactccatctatgcatctgctctggtggaggcaacaaaattttgtgcacctatatacgagtgtgcatggaccttttgggacagcggtg

SEQ ID NO: 365184 - DNA, 140 bp, Artificial Sequence
  Synthetic
caccgctgtcccaaaaggtccatgcacactcgtatataggtgcacaaaattttgttgcctccaccagagcagatgcatagatggagtccttttgtgcatcatcagtggcaccggccatttcatatcagcagccagggcct

SEQ ID NO: 365185 - DNA, 140 bp, Artificial Sequence
  Synthetic
aggccctggctgctgatatggcaaggttaggcttcatgtagatgagccagatgagctcacggtacacgtgaagagtgatgatccggatgtagttgcagccagctcaagcctgatggccaggaccttttgggacagcggtg

SEQ ID NO: 365186 - DNA, 140 bp, Artificial Sequence
  Synthetic
caccgctgtcccaaaaggtcctggccatcaggcttgagctggctgcaactacatccggatcatcactcttcacgtgtaccgtgagctcatctggctcatctacatgaagcctaaccttgccatatcagcagccagggcct

SEQ ID NO: 365187 - DNA, 140 bp, Artificial Sequence
  Synthetic
aggccctggctgctgatatgggttagctccactggcattgtgaagaagggacttgaatggttcgaaaaaaatgcaggcaccattaagtcctgggatgaaagttacactgaactaaaagtcgaccttttgggacagcggtg

SEQ ID NO: 365188 - DNA, 140 bp, Artificial Sequence
  Synthetic
caccgctgtcccaaaaggtcgacttttagttcagtgtaactttcatcccaggacttaatggtgcctgcatttttttcgaaccattcaagtcccttcttcacaatgccagtggagctaacccatatcagcagccagggcct

SEQ ID NO: 365189 - DNA, 140 bp, Artificial Sequence
  Synthetic
aggccctggctgctgatatgattcattgcctgtgctgactgctcgtctacaccgccagatagatggtggatcactgaagacagagtacgagtcttgaagaactcagtcagcttcctcttcgaccttttgggacagcggtg

SEQ ID NO: 365190 - DNA, 140 bp, Artificial Sequence
  Synthetic
caccgctgtcccaaaaggtcgaagaggaagctgactgagttcttcaagactcgtactctgtcttcagtgatccaccatctatctggcggtgtagacgagcagtcagcacaggcaatgaatcatatcagcagccagggcct

SEQ ID NO: 365191 - DNA, 140 bp, Artificial Sequence
  Synthetic
atacgccatgctgggtctccctaaggataaactctgcttttacattgtggaaagagactactgcagcagttgcagcaaagaggacacacaaaagtgtgtaaatgcaaaacttgagcagcccgtacttgggagtcggccat

SEQ ID NO: 365192 - DNA, 140 bp, Artificial Sequence
  Synthetic
atggccgactcccaagtacgggctgctcaagttttgcatttacacacttttgtgtgtcctctttgctgcaactgctgcagtagtctctttccacaatgtaaaagcagagtttatccttagggagacccagcatggcgtat

SEQ ID NO: 365193 - DNA, 140 bp, Artificial Sequence
  Synthetic
aggccctggctgctgatatggtggagaaaagacataggtttccgtgtcaatgcaaacacagcggctttgagcaacaaagtccttgcagagtacaaagttcctggcgagattgtgatgtccgaccttttgggacagcggtg

SEQ ID NO: 365194 - DNA, 140 bp, Artificial Sequence
  Synthetic
caccgctgtcccaaaaggtcggacatcacaatctcgccaggaactttgtactctgcaaggactttgttgctcaaagccgctgtgtttgcattgacacggaaacctatgtcttttctccaccatatcagcagccagggcct

SEQ ID NO: 365195 - DNA, 140 bp, Artificial Sequence
  Synthetic
aggccctggctgctgatatggtcaaagagatgctgtctgacatgattaggagaaggaaccaaattctaaacaggggtggtgatgagaatccacgcggcccagtgagccgtgagcatgtaggaccttttgggacagcggtg

SEQ ID NO: 365196 - DNA, 140 bp, Artificial Sequence
  Synthetic
caccgctgtcccaaaaggtcctacatgctcacggctcactgggccgcgtggattctcatcaccacccctgtttagaatttggttccttctcctaatcatgtcagacagcatctctttgaccatatcagcagccagggcct

SEQ ID NO: 365197 - DNA, 140 bp, Artificial Sequence
  Synthetic
atacgccatgctgggtctccttttatggactaaaaaacatgttgggtggtatcttcggcaacgttatcttgggcatcatcatgttccttgctccttttgccttgttactgctcttcttcccgtacttgggagtcggccat

SEQ ID NO: 365198 - DNA, 140 bp, Artificial Sequence
  Synthetic
atggccgactcccaagtacgggaagaagagcagtaacaaggcaaaaggagcaaggaacatgatgatgcccaagataacgttgccgaagataccacccaacatgttttttagtccataaaaggagacccagcatggcgtat

SEQ ID NO: 365199 - DNA, 140 bp, Artificial Sequence
  Synthetic
aggccctggctgctgatatgactggtgcagggagtttgtcaagggcaaatacatcatggccttcaacccaccatggggggacataaacaagtcgggccgttcaggaatagcacttgtcgcgaccttttgggacagcggtg

SEQ ID NO: 365200 - DNA, 140 bp, Artificial Sequence
  Synthetic
caccgctgtcccaaaaggtcgcgacaagtgctattcctgaacggcccgacttgtttatgtccccccatggtgggttgaaggccatgatgtatttgcccttgacaaactccctgcaccagtcatatcagcagccagggcct

SEQ ID NO: 365201 - DNA, 140 bp, Artificial Sequence
  Synthetic
atacgccatgctgggtctccaaggattattgaaaggttaaataacaagaaaggtaagaacaagttatttgacggcgagagattggcagacaagaaaattgctgaactattctcaacgaagcgtacttgggagtcggccat

SEQ ID NO: 365202 - DNA, 140 bp, Artificial Sequence
  Synthetic
atggccgactcccaagtacgcttcgttgagaatagttcagcaattttcttgtctgccaatctctcgccgtcaaataacttgttcttacctttcttgttatttaacctttcaataatccttggagacccagcatggcgtat

SEQ ID NO: 365203 - DNA, 140 bp, Artificial Sequence
  Synthetic
aggccctggctgctgatatgacggcgagagattggcagacaagaaaattgctgaactattctcaacgaagacacacattggctaatacagactagacttaacagggcgcaacagcagcaagaccttttgggacagcggtg

SEQ ID NO: 365204 - DNA, 140 bp, Artificial Sequence
  Synthetic
caccgctgtcccaaaaggtcttgctgctgttgcgccctgttaagtctagtctgtattagccaatgtgtgtcttcgttgagaatagttcagcaattttcttgtctgccaatctctcgccgtcatatcagcagccagggcct

SEQ ID NO: 365205 - DNA, 140 bp, Artificial Sequence
  Synthetic
aggccctggctgctgatatgcacaaggtgcacagattgacactgccttcagctcatactattggctttacaaggcaggcgtgactccagaaaccttcccgacggtgtcacagttcctcttgaccttttgggacagcggtg

SEQ ID NO: 365206 - DNA, 140 bp, Artificial Sequence
  Synthetic
caccgctgtcccaaaaggtcaagaggaactgtgacaccgtcgggaaggtttctggagtcacgcctgccttgtaaagccaatagtatgagctgaaggcagtgtcaatctgtgcaccttgtgcatatcagcagccagggcct

SEQ ID NO: 365207 - DNA, 140 bp, Artificial Sequence
  Synthetic
atacgccatgctgggtctccgccagggctgccccatgttcacacataatcttgacaacacccgtattaacagtatatatataaccagtgtatagcgtttcacagtatgtgttctcttcctcgtacttgggagtcggccat

SEQ ID NO: 365208 - DNA, 140 bp, Artificial Sequence
  Synthetic
atggccgactcccaagtacgaggaagagaacacatactgtgaaacgctatacactggttatatatatactgttaatacgggtgttgtcaagattatgtgtgaacatggggcagccctggcggagacccagcatggcgtat

SEQ ID NO: 365209 - DNA, 140 bp, Artificial Sequence
  Synthetic
aggccctggctgctgatatgcagtatgtgttctcttcctccacactgcagcgtatgtgacactgtttccatttagatcttgacctaactttgactgcgtgccgccactatatctttgagagaccttttgggacagcggtg

SEQ ID NO: 365210 - DNA, 140 bp, Artificial Sequence
  Synthetic
caccgctgtcccaaaaggtctctcaaagatatagtggcggcacgcagtcaaagttaggtcaagatctaaatggaaacagtgtcacatacgctgcagtgtggaggaagagaacacatactgcatatcagcagccagggcct

SEQ ID NO: 365211 - DNA, 140 bp, Artificial Sequence
  Synthetic
aggccctggctgctgatatggattctttccagcaaaacaggatctacatgcatcctgccgtgcttacagctggcagaatcagtgaaatgggagtctgctttgggacaatccctgtggccagaccttttgggacagcggtg

SEQ ID NO: 365212 - DNA, 140 bp, Artificial Sequence
  Synthetic
caccgctgtcccaaaaggtctggccacagggattgtcccaaagcagactcccatttcactgattctgccagctgtaagcacggcaggatgcatgtagatcctgttttgctggaaagaatccatatcagcagccagggcct

SEQ ID NO: 365213 - DNA, 140 bp, Artificial Sequence
  Synthetic
aggccctggctgctgatatgatcctgatgatgctgcccaaggatctggacacactaagtctattctgaacctccggactaacaccgagaccaacaatccgtgtgccaagaccatcgtcaagaccttttgggacagcggtg

SEQ ID NO: 365214 - DNA, 140 bp, Artificial Sequence
  Synthetic
caccgctgtcccaaaaggtcttgacgatggtcttggcacacggattgttggtctcggtgttagtccggaggttcagaatagacttagtgtgtccagatccttgggcagcatcatcaggatcatatcagcagccagggcct

SEQ ID NO: 365215 - DNA, 140 bp, Artificial Sequence
  Synthetic
atacgccatgctgggtctcctggcctctgagcacctgctgcaccagtctcttgttggcaagcaatctccattccagaacgcctacaacgtcaagggcaatgccaccagtgccaacattatcgtacttgggagtcggccat

SEQ ID NO: 365216 - DNA, 140 bp, Artificial Sequence
  Synthetic
atggccgactcccaagtacgataatgttggcactggtggcattgcccttgacgttgtaggcgttctggaatggagattgcttgccaacaagagactggtgcagcaggtgctcagaggccaggagacccagcatggcgtat

SEQ ID NO: 365217 - DNA, 140 bp, Artificial Sequence
  Synthetic
atacgccatgctgggtctccggagcctgaagctagacttgttggcctgagcctggaagactacctcaagaggatgctgtctgacaacgagtggggatcaactctagaagcatctatgttgcgtacttgggagtcggccat

SEQ ID NO: 365218 - DNA, 140 bp, Artificial Sequence
  Synthetic
atggccgactcccaagtacgcaacatagatgcttctagagttgatccccactcgttgtcagacagcatcctcttgaggtagtcttccaggctcaggccaacaagtctagcttcaggctccggagacccagcatggcgtat

SEQ ID NO: 365219 - DNA, 140 bp, Artificial Sequence
  Synthetic
aggccctggctgctgatatgccataattgcaaggttcaattacacttattttatccgcttatctaacattattttactaacctttctctattttctcttgtcttgaacacttaaagggctgaccttttgggacagcggtg

SEQ ID NO: 365220 - DNA, 140 bp, Artificial Sequence
  Synthetic
caccgctgtcccaaaaggtcagccctttaagtgttcaagacaagagaaaatagagaaaggttagtaaaataatgttagataagcggataaaataagtgtaattgaaccttgcaattatggcatatcagcagccagggcct

SEQ ID NO: 365221 - DNA, 140 bp, Artificial Sequence
  Synthetic
atacgccatgctgggtctccctcaaagaaatacttgcggcacgtcagtacgtaagtgttaactttgagtgagtggcttgagcattttggattcagcatgaccgtcaacactgtgtgcacacgtacttgggagtcggccat

SEQ ID NO: 365222 - DNA, 140 bp, Artificial Sequence
  Synthetic
atggccgactcccaagtacgtgtgcacacagtgttgacggtcatgctgaatccaaaatgctcaagccactcactcaaagttaacacttacgtactgacgtgccgcaagtatttctttgagggagacccagcatggcgtat

SEQ ID NO: 365223 - DNA, 140 bp, Artificial Sequence
  Synthetic
aggccctggctgctgatatgagtggcttgagcattttggattcagcatgaccgtcaacactgtgtgcacaccactagtgtgtgctgttttctgcctacagctgtggaatctaggaggtacgaccttttgggacagcggtg

SEQ ID NO: 365224 - DNA, 140 bp, Artificial Sequence
  Synthetic
caccgctgtcccaaaaggtcgtacctcctagattccacagctgtaggcagaaaacagcacacactagtggtgtgcacacagtgttgacggtcatgctgaatccaaaatgctcaagccactcatatcagcagccagggcct

SEQ ID NO: 365225 - DNA, 140 bp, Artificial Sequence
  Synthetic
atacgccatgctgggtctccccactagtgtgtgctgttttctgcctacagctgtggaatctaggaggtactcttgtgcccactaacaggacccaacacaataaaacaggcaccatggcgacgtacttgggagtcggccat

SEQ ID NO: 365226 - DNA, 140 bp, Artificial Sequence
  Synthetic
atggccgactcccaagtacgtcgccatggtgcctgttttattgtgttgggtcctgttagtgggcacaagagtacctcctagattccacagctgtaggcagaaaacagcacacactagtggggagacccagcatggcgtat

SEQ ID NO: 365227 - DNA, 140 bp, Artificial Sequence
  Synthetic
atacgccatgctgggtctccgcatcaagcacaggggtcgtcaatgtcagcacgcagatgaccaaggacatccctatgtcgacggcctacacgaatccacccagcacccctagcgcaccatcgtacttgggagtcggccat

SEQ ID NO: 365228 - DNA, 140 bp, Artificial Sequence
  Synthetic
atggccgactcccaagtacgatggtgcgctaggggtgctgggtggattcgtgtaggccgtcgacatagggatgtccttggtcatctgcgtgctgacattgacgacccctgtgcttgatgcggagacccagcatggcgtat

SEQ ID NO: 365229 - DNA, 140 bp, Artificial Sequence
  Synthetic
aggccctggctgctgatatgcaaaaagcatctcagttgtctaaattggtcaataaaagtcagaacataccgaccagagtcggtagggtcttggattgcatgttcaactgcaaattatgtggaccttttgggacagcggtg

SEQ ID NO: 365230 - DNA, 140 bp, Artificial Sequence
  Synthetic
caccgctgtcccaaaaggtccacataatttgcagttgaacatgcaatccaagaccctaccgactctggtcggtatgttctgacttttattgaccaatttagacaactgagatgctttttgcatatcagcagccagggcct

SEQ ID NO: 365231 - DNA, 140 bp, Artificial Sequence
  Synthetic
atacgccatgctgggtctccagtacgaagtcagaagaagtatcaatgtcaacaagcccaggaaaaacaagcacagagaccagcagcccacccccagccaccagcgagacaccagccccctcgtacttgggagtcggccat

SEQ ID NO: 365232 - DNA, 140 bp, Artificial Sequence
  Synthetic
atggccgactcccaagtacgagggggctggtgtctcgctggtggctgggggtgggctgctggtctctgtgcttgtttttcctgggcttgttgacattgatacttcttctgacttcgtactggagacccagcatggcgtat

SEQ ID NO: 365233 - DNA, 140 bp, Artificial Sequence
  Synthetic
aggccctggctgctgatatgcacagagaccagcagcccacccccagccaccagcgagacaccagccccctctccaacaactcaggctcccaccggaaacaataaccctaacacctccagagaccttttgggacagcggtg

SEQ ID NO: 365234 - DNA, 140 bp, Artificial Sequence
  Synthetic
caccgctgtcccaaaaggtctctggaggtgttagggttattgtttccggtgggagcctgagttgttggagagggggctggtgtctcgctggtggctgggggtgggctgctggtctctgtgcatatcagcagccagggcct

SEQ ID NO: 365235 - DNA, 140 bp, Artificial Sequence
  Synthetic
atacgccatgctgggtctccgtttctggaccttaccttagaagaggacactgaaggcctgctagaatggtgtaaaagaaatctcggtctaacctgtgatgataacttctttcagaagagacgtacttgggagtcggccat

SEQ ID NO: 365236 - DNA, 140 bp, Artificial Sequence
  Synthetic
atggccgactcccaagtacgtctcttctgaaagaagttatcatcacaggttagaccgagatttcttttacaccattctagcaggccttcagtgtcctcttctaaggtaaggtccagaaacggagacccagcatggcgtat

SEQ ID NO: 365237 - DNA, 140 bp, Artificial Sequence
  Synthetic
atacgccatgctgggtctccaacaatggtttcctgaaagtgacctcacccgcagaagcaccaggaatgctgcaaacgcggaggaatttgtcatatctgagttctttaagaagaaggacatcgtacttgggagtcggccat

SEQ ID NO: 365238 - DNA, 140 bp, Artificial Sequence
  Synthetic
atggccgactcccaagtacgatgtccttcttcttaaagaactcagatatgacaaattcctccgcgtttgcagcattcctggtgcttctgcgggtgaggtcactttcaggaaaccattgttggagacccagcatggcgtat

SEQ ID NO: 365239 - DNA, 140 bp, Artificial Sequence
  Synthetic
atacgccatgctgggtctccatgaactcaggctacttctctgctaaatgttatccaaggacatccaactcgggacttcagttgatcaatgtcaccaaacattcagctaaaatagcagacacgtacttgggagtcggccat

SEQ ID NO: 365240 - DNA, 140 bp, Artificial Sequence
  Synthetic
atggccgactcccaagtacgtgtctgctattttagctgaatgtttggtgacattgatcaactgaagtcccgagttggatgtccttggataacatttagcagagaagtagcctgagttcatggagacccagcatggcgtat

SEQ ID NO: 365241 - DNA, 140 bp, Artificial Sequence
  Synthetic
atacgccatgctgggtctcccacctggacccaagattactaatttgaagaccatcaattgcataaacttaagggcatcagtcttcaaagaacatagagaggttgagatcaatgtacttctcgtacttgggagtcggccat

SEQ ID NO: 365242 - DNA, 140 bp, Artificial Sequence
  Synthetic
atggccgactcccaagtacgagaagtacattgatctcaacctctctatgttctttgaagactgatgcccttaagtttatgcaattgatggtcttcaaattagtaatcttgggtccaggtgggagacccagcatggcgtat

SEQ ID NO: 365243 - DNA, 140 bp, Artificial Sequence
  Synthetic
aggccctggctgctgatatgatggcatagaaagcaacatgaaacagttgtttgctatattgcctcctgactgtgcaagagagtgtgaagtcctcttcgatgacataagaaattctccaacgaccttttgggacagcggtg

SEQ ID NO: 365244 - DNA, 140 bp, Artificial Sequence
  Synthetic
caccgctgtcccaaaaggtcgttggagaatttcttatgtcatcgaagaggacttcacactctcttgcacagtcaggaggcaatatagcaaacaactgtttcatgttgctttctatgccatcatatcagcagccagggcct

SEQ ID NO: 365245 - DNA, 140 bp, Artificial Sequence
  Synthetic
atacgccatgctgggtctccatgtctgtgactattctttagccactgatgggatggtgagattacctcgtatccaccatgaagggactttcataccaggaacttacaaaatagtgatagacgtacttgggagtcggccat

SEQ ID NO: 365246 - DNA, 140 bp, Artificial Sequence
  Synthetic
atggccgactcccaagtacgtctatcactattttgtaagttcctggtatgaaagtcccttcatggtggatacgaggtaatctcaccatcccatcagtggctaaagaatagtcacagacatggagacccagcatggcgtat

SEQ ID NO: 365247 - DNA, 140 bp, Artificial Sequence
  Synthetic
aggccctggctgctgatatgatccaccatgaagggactttcataccaggaacttacaaaatagtgatagacaaaaaaaacaagcaaaacgataggtgtaccttggtcacaaattgtgtgagaccttttgggacagcggtg

SEQ ID NO: 365248 - DNA, 140 bp, Artificial Sequence
  Synthetic
caccgctgtcccaaaaggtctcacacaatttgtgaccaaggtacacctatcgttttgcttgttttttttgtctatcactattttgtaagttcctggtatgaaagtcccttcatggtggatcatatcagcagccagggcct

SEQ ID NO: 365249 - DNA, 140 bp, Artificial Sequence
  Synthetic
atacgccatgctgggtctccacagaaatcaggattggcaaggcatcttctggttccagaagactgctgtccgaggagtctgatggtgactgtatatcaagaactcaactattgaggacagcgtacttgggagtcggccat

SEQ ID NO: 365250 - DNA, 140 bp, Artificial Sequence
  Synthetic
atggccgactcccaagtacgctgtcctcaatagttgagttcttgatatacagtcaccatcagactcctcggacagcagtcttctggaaccagaagatgccttgccaatcctgatttctgtggagacccagcatggcgtat

SEQ ID NO: 365251 - DNA, 140 bp, Artificial Sequence
  Synthetic
aggccctggctgctgatatgccgacttttcgctcacacaaaaggttcactttaaaagaaatcagatacccagtgtcgaaaatgtgcaaatctccattgatgcgacgttgcctgaatctgtgaccttttgggacagcggtg

SEQ ID NO: 365252 - DNA, 140 bp, Artificial Sequence
  Synthetic
caccgctgtcccaaaaggtcacagattcaggcaacgtcgcatcaatggagatttgcacattttcgacactgggtatctgatttcttttaaagtgaaccttttgtgtgagcgaaaagtcggcatatcagcagccagggcct

SEQ ID NO: 365253 - DNA, 140 bp, Artificial Sequence
  Synthetic
atacgccatgctgggtctccggggtgttatactatcaatagggtaaagtcatttaagctttgcgaaaacagtgccacaggaaaatcttgtgaaatagatagcaccccagttaagtgcagacgtacttgggagtcggccat

SEQ ID NO: 365254 - DNA, 140 bp, Artificial Sequence
  Synthetic
atggccgactcccaagtacgtctgcacttaactggggtgctatctatttcacaagattttcctgtggcactgttttcgcaaagcttaaatgactttaccctattgatagtataacaccccggagacccagcatggcgtat

SEQ ID NO: 365255 - DNA, 140 bp, Artificial Sequence
  Synthetic
aggccctggctgctgatatggtgccacaggaaaatcttgtgaaatagatagcaccccagttaagtgcagacaaggtttttgcttgaaaatcactcaagaagggaggggccacgtgaagctgaccttttgggacagcggtg

SEQ ID NO: 365256 - DNA, 140 bp, Artificial Sequence
  Synthetic
caccgctgtcccaaaaggtcagcttcacgtggcccctcccttcttgagtgattttcaagcaaaaaccttgtctgcacttaactggggtgctatctatttcacaagattttcctgtggcaccatatcagcagccagggcct

SEQ ID NO: 365257 - DNA, 140 bp, Artificial Sequence
  Synthetic
atacgccatgctgggtctccctgcctttaaagactacggagagagagggatagtcgaggaaaatcacatgaggtttagtgaagaagatcagctagagacaaggcagctgttgttggtggacgtacttgggagtcggccat

SEQ ID NO: 365258 - DNA, 140 bp, Artificial Sequence
  Synthetic
atggccgactcccaagtacgtccaccaacaacagctgccttgtctctagctgatcttcttcactaaacctcatgtgattttcctcgactatccctctctctccgtagtctttaaaggcagggagacccagcatggcgtat

SEQ ID NO: 365259 - DNA, 140 bp, Artificial Sequence
  Synthetic
atacgccatgctgggtctccatccgcagtatcagtcagtggatcagaaggctcaggagacacgaacacctctccctcggtcaccacacaaggcctgactttgccagaaaccacgctggaacgtacttgggagtcggccat

SEQ ID NO: 365260 - DNA, 140 bp, Artificial Sequence
  Synthetic
atggccgactcccaagtacgttccagcgtggtttctggcaaagtcaggccttgtgtggtgaccgagggagaggtgttcgtgtctcctgagccttctgatccactgactgatactgcggatggagacccagcatggcgtat

SEQ ID NO: 365261 - DNA, 140 bp, Artificial Sequence
  Synthetic
aggccctggctgctgatatgcaacaacatttcttaaaagataatttgattgatcttggatgtcccaatatcccattattaggcagaatggccatctacatttgcagaatgtccaatcatcgaccttttgggacagcggtg

SEQ ID NO: 365262 - DNA, 140 bp, Artificial Sequence
  Synthetic
caccgctgtcccaaaaggtcgatgattggacattctgcaaatgtagatggccattctgcctaataatgggatattgggacatccaagatcaatcaaattatcttttaagaaatgttgttgcatatcagcagccagggcct

SEQ ID NO: 365263 - DNA, 140 bp, Artificial Sequence
  Synthetic
atacgccatgctgggtctccagtggaaagacatattaaagctattagagctactaggaatcaagtgctcatttattgcctgtgcagattgctcatctacaccaccagacagatggtggatcgtacttgggagtcggccat

SEQ ID NO: 365264 - DNA, 140 bp, Artificial Sequence
  Synthetic
atggccgactcccaagtacgatccaccatctgtctggtggtgtagatgagcaatctgcacaggcaataaatgagcacttgattcctagtagctctaatagctttaatatgtctttccactggagacccagcatggcgtat

SEQ ID NO: 365265 - DNA, 140 bp, Artificial Sequence
  Synthetic
atacgccatgctgggtctccacctgtatcctttgtaaggtgatcttttacctattgatagttgcagggacagtagggaaaaagttcaaacagtatagagagttgagacctcagacctgcacgtacttgggagtcggccat

SEQ ID NO: 365266 - DNA, 140 bp, Artificial Sequence
  Synthetic
atggccgactcccaagtacgtgcaggtctgaggtctcaactctctatactgtttgaactttttccctactgtccctgcaactatcaataggtaaaagatcaccttacaaaggatacaggtggagacccagcatggcgtat

SEQ ID NO: 365267 - DNA, 140 bp, Artificial Sequence
  Synthetic
aggccctggctgctgatatgagtagggaaaaagttcaaacagtatagagagttgagacctcagacctgcaccatatgtgaaacaactcctgtcaatgcaatagatgctgaaatgcatgacgaccttttgggacagcggtg

SEQ ID NO: 365268 - DNA, 140 bp, Artificial Sequence
  Synthetic
caccgctgtcccaaaaggtcgtcatgcatttcagcatctattgcattgacaggagttgtttcacatatggtgcaggtctgaggtctcaactctctatactgtttgaactttttccctactcatatcagcagccagggcct

SEQ ID NO: 365269 - DNA, 140 bp, Artificial Sequence
  Synthetic
atacgccatgctgggtctccagatggtcttgccagacatgtaatgcaatgccccaagcggaaggaaaaaatagaggaaactgaattatacttaaacctagaaaggattccctgggttgttcgtacttgggagtcggccat

SEQ ID NO: 365270 - DNA, 140 bp, Artificial Sequence
  Synthetic
atggccgactcccaagtacgaacaacccagggaatcctttctaggtttaagtataattcagtttcctctattttttccttccgcttggggcattgcattacatgtctggcaagaccatctggagacccagcatggcgtat

SEQ ID NO: 365271 - DNA, 140 bp, Artificial Sequence
  Synthetic
aggccctggctgctgatatgtagaggaaactgaattatacttaaacctagaaaggattccctgggttgttaggaaattattgcaagtttcagagtctaccggtgtggcattgaagaggaggaccttttgggacagcggtg

SEQ ID NO: 365272 - DNA, 140 bp, Artificial Sequence
  Synthetic
caccgctgtcccaaaaggtcctcctcttcaatgccacaccggtagactctgaaacttgcaataatttcctaacaacccagggaatcctttctaggtttaagtataattcagtttcctctacatatcagcagccagggcct

SEQ ID NO: 365273 - DNA, 140 bp, Artificial Sequence
  Synthetic
atacgccatgctgggtctcctgcagtcagcacctattggtcatggaaagacaattgaaacatatcaggccagagaggggtatacaagcttctgcctttttatactaggaagcatcttgttcgtacttgggagtcggccat

SEQ ID NO: 365274 - DNA, 140 bp, Artificial Sequence
  Synthetic
atggccgactcccaagtacgaacaagatgcttcctagtataaaaaggcagaagcttgtatacccctctctggcctgatatgtttcaattgtctttccatgaccaataggtgctgactgcaggagacccagcatggcgtat

SEQ ID NO: 365275 - DNA, 140 bp, Artificial Sequence
  Synthetic
aggccctggctgctgatatgagagaggggtatacaagcttctgcctttttatactaggaagcatcttgtttatagtctcttgcctagtaaagggtctgattgacagtgtcggtaacagctgaccttttgggacagcggtg

SEQ ID NO: 365276 - DNA, 140 bp, Artificial Sequence
  Synthetic
caccgctgtcccaaaaggtcagctgttaccgacactgtcaatcagaccctttactaggcaagagactataaacaagatgcttcctagtataaaaaggcagaagcttgtatacccctctctcatatcagcagccagggcct

SEQ ID NO: 365277 - DNA, 140 bp, Artificial Sequence
  Synthetic
aggccctggctgctgatatgactaatcactgcagcaactgtcaccccaatggtgtaaacattagtaacacttctaatgtgtgcaagagatgccccaagattgaagtggttagccattgtggaccttttgggacagcggtg

SEQ ID NO: 365278 - DNA, 140 bp, Artificial Sequence
  Synthetic
caccgctgtcccaaaaggtccacaatggctaaccacttcaatcttggggcatctcttgcacacattagaagtgttactaatgtttacaccattggggtgacagttgctgcagtgattagtcatatcagcagccagggcct

SEQ ID NO: 365279 - DNA, 140 bp, Artificial Sequence
  Synthetic
atacgccatgctgggtctccggttttgagattgaatcccacaaatgttactgtagtctattttgttgcccttattgtagacactgctctgccgatagagaaatccataagttgcacttgacgtacttgggagtcggccat

SEQ ID NO: 365280 - DNA, 140 bp, Artificial Sequence
  Synthetic
atggccgactcccaagtacgtcaagtgcaacttatggatttctctatcggcagagcagtgtctacaataagggcaacaaaatagactacagtaacatttgtgggattcaatctcaaaaccggagacccagcatggcgtat

SEQ ID NO: 365281 - DNA, 140 bp, Artificial Sequence
  Synthetic
atacgccatgctgggtctccgcatctgcaaaaaaagaaaaactgggagcaatgtcatgtcggccgtctgcaagcgcatgtgctttagagcaaccatagaagttagcaatagggctttactcgtacttgggagtcggccat

SEQ ID NO: 365282 - DNA, 140 bp, Artificial Sequence
  Synthetic
atggccgactcccaagtacgagtaaagccctattgctaacttctatggttgctctaaagcacatgcgcttgcagacggccgacatgacattgctcccagtttttctttttttgcagatgcggagacccagcatggcgtat

SEQ ID NO: 365283 - DNA, 140 bp, Artificial Sequence
  Synthetic
atacgccatgctgggtctcccagtttgtgttgtcagcacctctgcagtggagatggaaagtctaccagccggcacctgggagagagaggaagacctaacaaacttctgtcatcaggaatgcgtacttgggagtcggccat

SEQ ID NO: 365284 - DNA, 140 bp, Artificial Sequence
  Synthetic
atggccgactcccaagtacgcattcctgatgacagaagtttgttaggtcttcctctctctcccaggtgccggctggtagactttccatctccactgcagaggtgctgacaacacaaactgggagacccagcatggcgtat

SEQ ID NO: 365285 - DNA, 140 bp, Artificial Sequence
  Synthetic
atacgccatgctgggtctccactagctgagaagatagacactgttaggaaagagctttcagaatctaaactgaaagattattcaacttatgcaaggggagtgatatcaaattcactaaaacgtacttgggagtcggccat

SEQ ID NO: 365286 - DNA, 140 bp, Artificial Sequence
  Synthetic
atggccgactcccaagtacgttttagtgaatttgatatcactccccttgcataagttgaataatctttcagtttagattctgaaagctctttcctaacagtgtctatcttctcagctagtggagacccagcatggcgtat

SEQ ID NO: 365287 - DNA, 140 bp, Artificial Sequence
  Synthetic
aggccctggctgctgatatgtgaaagattattcaacttatgcaaggggagtgatatcaaattcactaaaaaacctctcaaggcaaggtaaatcaaagtgttctgtgccaagatcttggctgaccttttgggacagcggtg

SEQ ID NO: 365288 - DNA, 140 bp, Artificial Sequence
  Synthetic
caccgctgtcccaaaaggtcagccaagatcttggcacagaacactttgatttaccttgccttgagaggttttttagtgaatttgatatcactccccttgcataagttgaataatctttcacatatcagcagccagggcct

SEQ ID NO: 365289 - DNA, 140 bp, Artificial Sequence
  Synthetic
aggccctggctgctgatatgaggatgctgtctgacaacgagtgggggtcaactcttgaggcatccatgctggccaaagaaatgggcattacaataatcatttggactgttgctgccagtggaccttttgggacagcggtg

SEQ ID NO: 365290 - DNA, 140 bp, Artificial Sequence
  Synthetic
caccgctgtcccaaaaggtccactggcagcaacagtccaaatgattattgtaatgcccatttctttggccagcatggatgcctcaagagttgacccccactcgttgtcagacagcatcctcatatcagcagccagggcct

SEQ ID NO: 365291 - DNA, 140 bp, Artificial Sequence
  Synthetic
atacgccatgctgggtctccaactcaacaagcttggaaacaagcttatcaattgaagcaccatggggtgcaataaatgtccaatcaaccttcaaacctactgtgtcagctgcaaacatagcgtacttgggagtcggccat

SEQ ID NO: 365292 - DNA, 140 bp, Artificial Sequence
  Synthetic
atggccgactcccaagtacgctatgtttgcagctgacacagtaggtttgaaggttgattggacatttattgcaccccatggtgcttcaattgataagcttgtttccaagcttgttgagttggagacccagcatggcgtat

SEQ ID NO: 365293 - DNA, 140 bp, Artificial Sequence
  Synthetic
aggccctggctgctgatatgaataaatgtccaatcaaccttcaaacctactgtgtcagctgcaaacatagcacttagctggagctcagtggaacacagaggcaacaagattttggtttcagaccttttgggacagcggtg

SEQ ID NO: 365294 - DNA, 140 bp, Artificial Sequence
  Synthetic
caccgctgtcccaaaaggtctgaaaccaaaatcttgttgcctctgtgttccactgagctccagctaagtgctatgtttgcagctgacacagtaggtttgaaggttgattggacatttattcatatcagcagccagggcct

SEQ ID NO: 365295 - DNA, 140 bp, Artificial Sequence
  Synthetic
atacgccatgctgggtctccggatctgggagtagaagacgcctctgagtccaaattgctcaccgtctctgtcatggacttgtcacagatgtattcccccgtctttgagtacctgtcaggtcgtacttgggagtcggccat

SEQ ID NO: 365296 - DNA, 140 bp, Artificial Sequence
  Synthetic
atggccgactcccaagtacgacctgacaggtactcaaagacgggggaatacatctgtgacaagtccatgacagagacggtgagcaatttggactcagaggcgtcttctactcccagatccggagacccagcatggcgtat

SEQ ID NO: 365297 - DNA, 140 bp, Artificial Sequence
  Synthetic
aggccctggctgctgatatgtcatggacttgtcacagatgtattcccccgtctttgagtacctgtcaggtgatagacaggtagaagagtggcccaaggcgacctgtacaggcgattgcccgaccttttgggacagcggtg

SEQ ID NO: 365298 - DNA, 140 bp, Artificial Sequence
  Synthetic
caccgctgtcccaaaaggtcgggcaatcgcctgtacaggtcgccttgggccactcttctacctgtctatcacctgacaggtactcaaagacgggggaatacatctgtgacaagtccatgacatatcagcagccagggcct

SEQ ID NO: 365299 - DNA, 140 bp, Artificial Sequence
  Synthetic
atacgccatgctgggtctccattcaaggaactggagatgcaaccccacttggtgttggggggtcggcactggatgcacctgttgtggactagatgtaaaagacctctttacagattacatcgtacttgggagtcggccat

SEQ ID NO: 365300 - DNA, 140 bp, Artificial Sequence
  Synthetic
atggccgactcccaagtacgatgtaatctgtaaagaggtcttttacatctagtccacaacaggtgcatccagtgccgaccccccaacaccaagtggggttgcatctccagttccttgaatggagacccagcatggcgtat

SEQ ID NO: 365301 - DNA, 140 bp, Artificial Sequence
  Synthetic
atacgccatgctgggtctccgtttgtcaagtggaaagttgaatacataaaaacagaggccatagtgtgcgtcgaacttactagccaagaaagacaatgtagcttgattgaagcaggcacacgtacttgggagtcggccat

SEQ ID NO: 365302 - DNA, 140 bp, Artificial Sequence
  Synthetic
atggccgactcccaagtacgtgtgcctgcttcaatcaagctacattgtctttcttggctagtaagttcgacgcacactatggcctctgtttttatgtattcaactttccacttgacaaacggagacccagcatggcgtat

SEQ ID NO: 365303 - DNA, 140 bp, Artificial Sequence
  Synthetic
atacgccatgctgggtctcctcttcatacctttacattgtcattacactttatatacaagtgctgcagcagtacaggtgtctagaagttataaacagtgtgagtgaaaaaacattgcaagcgtacttgggagtcggccat

SEQ ID NO: 365304 - DNA, 140 bp, Artificial Sequence
  Synthetic
atggccgactcccaagtacgcttgcaatgttttttcactcacactgtttataacttctagacacctgtactgctgcagcacttgtatataaagtgtaatgacaatgtaaaggtatgaagaggagacccagcatggcgtat

SEQ ID NO: 365305 - DNA, 140 bp, Artificial Sequence
  Synthetic
atacgccatgctgggtctccaaggcttttttgacttaatgcatgtgcaaaaagtgctgtcagcaagcacagtgtgcaagctacagagttgcacacatggtgttccaggagacctacaggtcgtacttgggagtcggccat

SEQ ID NO: 365306 - DNA, 140 bp, Artificial Sequence
  Synthetic
atggccgactcccaagtacgacctgtaggtctcctggaacaccatgtgtgcaactctgtagcttgcacactgtgcttgctgacagcactttttgcacatgcattaagtcaaaaaagccttggagacccagcatggcgtat

SEQ ID NO: 365307 - DNA, 140 bp, Artificial Sequence
  Synthetic
aggccctggctgctgatatggtgtgcaagctacagagttgcacacatggtgttccaggagacctacaggtctaccacatcggaaacttgttaaaaggagacaaggtaaacgggcatctgagaccttttgggacagcggtg

SEQ ID NO: 365308 - DNA, 140 bp, Artificial Sequence
  Synthetic
caccgctgtcccaaaaggtctcagatgcccgtttaccttgtctccttttaacaagtttccgatgtggtagacctgtaggtctcctggaacaccatgtgtgcaactctgtagcttgcacaccatatcagcagccagggcct

SEQ ID NO: 365309 - DNA, 140 bp, Artificial Sequence
  Synthetic
atacgccatgctgggtctcctgtgacctagactactactgcaatatgggggactggccttcttgcacatacactggagtaacccaacataaccatgctgcatttgtaaatttgctcaatacgtacttgggagtcggccat

SEQ ID NO: 365310 - DNA, 140 bp, Artificial Sequence
  Synthetic
atggccgactcccaagtacgtattgagcaaatttacaaatgcagcatggttatgttgggttactccagtgtatgtgcaagaaggccagtcccccatattgcagtagtagtctaggtcacaggagacccagcatggcgtat

SEQ ID NO: 365311 - DNA, 140 bp, Artificial Sequence
  Synthetic
atacgccatgctgggtctcctcgaaaccgattatacaaaaaactttcattttcactccaagagagttactgcacatggagacacaccacagttagacttgaaggccagaccaacttatggcgtacttgggagtcggccat

SEQ ID NO: 365312 - DNA, 140 bp, Artificial Sequence
  Synthetic
atggccgactcccaagtacgccataagttggtctggccttcaagtctaactgtggtgtgtctccatgtgcagtaactctcttggagtgaaaatgaaagttttttgtataatcggtttcgaggagacccagcatggcgtat

SEQ ID NO: 365313 - DNA, 140 bp, Artificial Sequence
  Synthetic
atacgccatgctgggtctcccaatgttaagcactggaaacaaagagatctatgtcctgaagtaaccattccatgctttacagtctatggaacctttgtcaacagcgatagacaactgatccgtacttgggagtcggccat

SEQ ID NO: 365314 - DNA, 140 bp, Artificial Sequence
  Synthetic
atggccgactcccaagtacggatcagttgtctatcgctgttgacaaaggttccatagactgtaaagcatggaatggttacttcaggacatagatctctttgtttccagtgcttaacattgggagacccagcatggcgtat

SEQ ID NO: 365315 - DNA, 140 bp, Artificial Sequence
  Synthetic
atacgccatgctgggtctccggctgctatgcttgtagctctggtatctcctgtaaggtcaggatccatgtagatgaaccagatgagcttacagtacatgtgaagagtgaagacccagacacgtacttgggagtcggccat

SEQ ID NO: 365316 - DNA, 140 bp, Artificial Sequence
  Synthetic
atggccgactcccaagtacgtgtctgggtcttcactcttcacatgtactgtaagctcatctggttcatctacatggatcctgaccttacaggagataccagagctacaagcatagcagccggagacccagcatggcgtat

SEQ ID NO: 365317 - DNA, 140 bp, Artificial Sequence
  Synthetic
atacgccatgctgggtctccgatagtacattcaaagccttttcagccatgcccaaaacctccttgtgcttttacattgtggagagagaatactgtaagagctgcagtagagaagacacaccgtacttgggagtcggccat

SEQ ID NO: 365318 - DNA, 140 bp, Artificial Sequence
  Synthetic
atggccgactcccaagtacggtgtgtcttctctactgcagctcttacagtattctctctccacaatgtaaaagcacaaggaggttttgggcatggctgaaaaggctttgaatgtactatcggagacccagcatggcgtat

SEQ ID NO: 365319 - DNA, 140 bp, Artificial Sequence
  Synthetic
atacgccatgctgggtctccaagagtagaatccgtagtatatttggtagatacaactctcagaagaaaccatttgaattaaggtcaggtcttgaggttttcaatgatcctttcaatgattcgtacttgggagtcggccat

SEQ ID NO: 365320 - DNA, 140 bp, Artificial Sequence
  Synthetic
atggccgactcccaagtacgaatcattgaaaggatcattgaaaacctcaagacctgaccttaattcaaatggtttcttctgagagttgtatctaccaaatatactacggattctactcttggagacccagcatggcgtat

SEQ ID NO: 365321 - DNA, 140 bp, Artificial Sequence
  Synthetic
atacgccatgctgggtctcccataaaggaacgattattggaaagcaaaacgacacttgcacagctaaagcaagctgctggctagagtcagtcaaaagttttttctacggattaaagagtacgtacttgggagtcggccat

SEQ ID NO: 365322 - DNA, 140 bp, Artificial Sequence
  Synthetic
atggccgactcccaagtacgtactctttaatccgtagaaaaaacttttgactgactctagccagcagcttgctttagctgtgcaagtgtcgttttgctttccaataatcgttcctttatgggagacccagcatggcgtat

SEQ ID NO: 365323 - DNA, 140 bp, Artificial Sequence
  Synthetic
atacgccatgctgggtctccgctccttttgtcctgttaatacttttctttatgtttgggtggaggattctgttctgctttaagtgctgcagaagaaccaggggcctatttaagtacagaccgtacttgggagtcggccat

SEQ ID NO: 365324 - DNA, 140 bp, Artificial Sequence
  Synthetic
atggccgactcccaagtacggtctgtacttaaataggcccctggttcttctgcagcacttaaagcagaacagaatcctccacccaaacataaagaaaagtattaacaggacaaaaggagcggagacccagcatggcgtat

SEQ ID NO: 365325 - DNA, 140 bp, Artificial Sequence
  Synthetic
aggccctggctgctgatatgttccccggcctgtctgtctgcaagacatgctccattggcagtataaatggctttgaaattgaatcgcataaatgctactgtagcttattttgctgcccctgaccttttgggacagcggtg

SEQ ID NO: 365326 - DNA, 140 bp, Artificial Sequence
  Synthetic
caccgctgtcccaaaaggtcaggggcagcaaaataagctacagtagcatttatgcgattcaatttcaaagccatttatactgccaatggagcatgtcttgcagacagacaggccggggaacatatcagcagccagggcct

SEQ ID NO: 365327 - DNA, 140 bp, Artificial Sequence
  Synthetic
atacgccatgctgggtctccaataacaaaaagggaaaaaacaaactacttgatggggaaaggctagctgacaggaaaatcgccgagttattctccacaaaatcacatatcggctaacttacgtacttgggagtcggccat

SEQ ID NO: 365328 - DNA, 140 bp, Artificial Sequence
  Synthetic
atggccgactcccaagtacgtaagttagccgatatgtgattttgtggagaataactcggcgattttcctgtcagctagcctttccccatcaagtagtttgttttttccctttttgttattggagacccagcatggcgtat

SEQ ID NO: 365329 - DNA, 140 bp, Artificial Sequence
  Synthetic
atacgccatgctgggtctccttgtgttaacatcattaattgtgcccacaccatgtcgtcatcgcaatgcatcatattcaacctacttcattatattcgtaatgcttgaaattgctattgccgtacttgggagtcggccat

SEQ ID NO: 365330 - DNA, 140 bp, Artificial Sequence
  Synthetic
atggccgactcccaagtacggcaatagcaatttcaagcattacgaatataatgaagtaggttgaatatgatgcattgcgatgacgacatggtgtgggcacaattaatgatgttaacacaaggagacccagcatggcgtat

SEQ ID NO: 365331 - DNA, 140 bp, Artificial Sequence
  Synthetic
atacgccatgctgggtctccatggaatatttgaaccctcaaagttatccttctaccattggaaggaattggtcaaaaaaaacattgatgaagttttacttactgaagatggaaatctgatcgtacttgggagtcggccat

SEQ ID NO: 365332 - DNA, 140 bp, Artificial Sequence
  Synthetic
atggccgactcccaagtacgatcagatttccatcttcagtaagtaaaacttcatcaatgttttttttgaccaattccttccaatggtagaaggataactttgagggttcaaatattccatggagacccagcatggcgtat

SEQ ID NO: 365333 - DNA, 140 bp, Artificial Sequence
  Synthetic
atacgccatgctgggtctccagagactcaaattcatgaatgtacattctccagaattgatgccggaaaactgtctcttttctagtgaggaattcaatgagttaattaagttaaagaaactcgtacttgggagtcggccat

SEQ ID NO: 365334 - DNA, 140 bp, Artificial Sequence
  Synthetic
atggccgactcccaagtacgagtttctttaacttaattaactcattgaattcctcactagaaaagagacagttttccggcatcaattctggagaatgtacattcatgaatttgagtctctggagacccagcatggcgtat

SEQ ID NO: 365335 - DNA, 140 bp, Artificial Sequence
  Synthetic
aggccctggctgctgatatgtgtctcttttctagtgaggaattcaatgagttaattaagttaaagaaactcctcctcaatgaacaacaagatgaacaggagctgaaacaagatcttttgagaccttttgggacagcggtg

SEQ ID NO: 365336 - DNA, 140 bp, Artificial Sequence
  Synthetic
caccgctgtcccaaaaggtctcaaaagatcttgtttcagctcctgttcatcttgttgttcattgaggaggagtttctttaacttaattaactcattgaattcctcactagaaaagagacacatatcagcagccagggcct

SEQ ID NO: 365337 - DNA, 140 bp, Artificial Sequence
  Synthetic
aggccctggctgctgatatgcttatttggtgagacatccagaaatacttgactgtggatctaaagaggactgcaaactcactttgcttgatctgtcagtttctaagctcttggtttgtttgaccttttgggacagcggtg

SEQ ID NO: 365338 - DNA, 140 bp, Artificial Sequence
  Synthetic
caccgctgtcccaaaaggtcaaacaaaccaagagcttagaaactgacagatcaagcaaagtgagtttgcagtcctctttagatccacagtcaagtatttctggatgtctcaccaaataagcatatcagcagccagggcct

SEQ ID NO: 365339 - DNA, 140 bp, Artificial Sequence
  Synthetic
atacgccatgctgggtctcccgaccagagtcggtagggtcttggattgcatgttcaactgcaaattatgtgttgagatatcagctgacactttaattctgaggccagaatcaaaagagaacgtacttgggagtcggccat

SEQ ID NO: 365340 - DNA, 140 bp, Artificial Sequence
  Synthetic
atggccgactcccaagtacgttctcttttgattctggcctcagaattaaagtgtcagctgatatctcaacacataatttgcagttgaacatgcaatccaagaccctaccgactctggtcgggagacccagcatggcgtat

SEQ ID NO: 365341 - DNA, 140 bp, Artificial Sequence
  Synthetic
atacgccatgctgggtctccggtttttagtgaaatatgctgtcaccttgttcacatccaatggtgaacctttttcactcagtctcaatgacgggggtttggatcttgatttacacaagaccgtacttgggagtcggccat

SEQ ID NO: 365342 - DNA, 140 bp, Artificial Sequence
  Synthetic
atggccgactcccaagtacggtcttgtgtaaatcaagatccaaacccccgtcattgagactgagtgaaaaaggttcaccattggatgtgaacaaggtgacagcatatttcactaaaaaccggagacccagcatggcgtat

SEQ ID NO: 365343 - DNA, 140 bp, Artificial Sequence
  Synthetic
atacgccatgctgggtctccaaggctccctagaagcgttagaagcaaggtcatatatgagatggtaaaattagtgggagaaacaggcatggcaatactacaacaattagcttttgcacagcgtacttgggagtcggccat

SEQ ID NO: 365344 - DNA, 140 bp, Artificial Sequence
  Synthetic
atggccgactcccaagtacgctgtgcaaaagctaattgttgtagtattgccatgcctgtttctcccactaattttaccatctcatatatgaccttgcttctaacgcttctagggagccttggagacccagcatggcgtat

SEQ ID NO: 365345 - DNA, 140 bp, Artificial Sequence
  Synthetic
aggccctggctgctgatatgtagtgggagaaacaggcatggcaatactacaacaattagcttttgcacaggcactaaattatgagcaccgcttctatgcagtcttagcacctaaagcgcagaccttttgggacagcggtg

SEQ ID NO: 365346 - DNA, 140 bp, Artificial Sequence
  Synthetic
caccgctgtcccaaaaggtctgcgctttaggtgctaagactgcatagaagcggtgctcataatttagtgcctgtgcaaaagctaattgttgtagtattgccatgcctgtttctcccactacatatcagcagccagggcct

SEQ ID NO: 365347 - DNA, 140 bp, Artificial Sequence
  Synthetic
atacgccatgctgggtctcctgcatgcaaccactgaaatgtttagcagaaatcttttaaaaacaacatcagatgatggcctcacaaacccacatcttaaagaaacaatcctcaatgtgggcgtacttgggagtcggccat

SEQ ID NO: 365348 - DNA, 140 bp, Artificial Sequence
  Synthetic
atggccgactcccaagtacgcccacattgaggattgtttctttaagatgtgggtttgtgaggccatcatctgatgttgtttttaaaagatttctgctaaacatttcagtggttgcatgcaggagacccagcatggcgtat

SEQ ID NO: 365349 - DNA, 140 bp, Artificial Sequence
  Synthetic
atacgccatgctgggtctccaaggcagtaacttggtcaatttctacaaagtcatatgcatctcgggtgataataccaagtggggcccgatacactgctgttctttcttttctggcatgatcgtacttgggagtcggccat

SEQ ID NO: 365350 - DNA, 140 bp, Artificial Sequence
  Synthetic
atggccgactcccaagtacgatcatgccagaaaagaaagaacagcagtgtatcgggccccacttggtattatcacccgagatgcatatgactttgtagaaattgaccaagttactgccttggagacccagcatggcgtat

SEQ ID NO: 365351 - DNA, 140 bp, Artificial Sequence
  Synthetic
atacgccatgctgggtctccagaacagggcagccagcagagtaccactgaacacgagagcaccagcatctctgcctttaaagactacggagagagggggatagtcgaggaaaaccacatgcgtacttgggagtcggccat

SEQ ID NO: 365352 - DNA, 140 bp, Artificial Sequence
  Synthetic
atggccgactcccaagtacgcatgtggttttcctcgactatccccctctctccgtagtctttaaaggcagagatgctggtgctctcgtgttcagtggtactctgctggctgccctgttctggagacccagcatggcgtat

SEQ ID NO: 365353 - DNA, 140 bp, Artificial Sequence
  Synthetic
atacgccatgctgggtctccggaaacacgcttgcagactcaaaaacttcacggccgcagtacaaagatgctgtcaaatgaaagatagtgccaaaaccttggtgagcgactgctttctcgacgtacttgggagtcggccat

SEQ ID NO: 365354 - DNA, 140 bp, Artificial Sequence
  Synthetic
atggccgactcccaagtacgtcgagaaagcagtcgctcaccaaggttttggcactatctttcatttgacagcatctttgtactgcggccgtgaagtttttgagtctgcaagcgtgtttccggagacccagcatggcgtat

SEQ ID NO: 365355 - DNA, 140 bp, Artificial Sequence
  Synthetic
aggccctggctgctgatatgagttcatgtttactggactgataaacagctctgtgacctctcctcagagtttgatgcaagcatgccaagtttcatcccaacaagcaatgtataatagtgtgaccttttgggacagcggtg

SEQ ID NO: 365356 - DNA, 140 bp, Artificial Sequence
  Synthetic
caccgctgtcccaaaaggtcacactattatacattgcttgttgggatgaaacttggcatgcttgcatcaaactctgaggagaggtcacagagctgtttatcagtccagtaaacatgaactcatatcagcagccagggcct

SEQ ID NO: 365357 - DNA, 140 bp, Artificial Sequence
  Synthetic
atacgccatgctgggtctcctcctcttgtcaccaacactgccttcactctattaaggcagcaaattttctttaatcatgttgaagactttatcagaaggtatggtatactgactcttgggcgtacttgggagtcggccat

SEQ ID NO: 365358 - DNA, 140 bp, Artificial Sequence
  Synthetic
atggccgactcccaagtacgcccaagagtcagtataccataccttctgataaagtcttcaacatgattaaagaaaatttgctgccttaatagagtgaaggcagtgttggtgacaagaggaggagacccagcatggcgtat

SEQ ID NO: 365359 - DNA, 140 bp, Artificial Sequence
  Synthetic
aggccctggctgctgatatgcaagcttctcttttgagctcaatagacccctgtctgaaactgaactacagttcattaaagcactaagtagtcttaagtcaacacaagcctgtgaagtgatgaccttttgggacagcggtg

SEQ ID NO: 365360 - DNA, 140 bp, Artificial Sequence
  Synthetic
caccgctgtcccaaaaggtcatcacttcacaggcttgtgttgacttaagactacttagtgctttaatgaactgtagttcagtttcagacaggggtctattgagctcaaaagagaagcttgcatatcagcagccagggcct

SEQ ID NO: 365361 - DNA, 140 bp, Artificial Sequence
  Synthetic
atacgccatgctgggtctccataggcataatgttatttacagcagcagaatggcagactcttgcgattggctaaaggatggcaaaagaagagggaatctagaactagcgaataggatccacgtacttgggagtcggccat

SEQ ID NO: 365362 - DNA, 140 bp, Artificial Sequence
  Synthetic
atggccgactcccaagtacgtggatcctattcgctagttctagattccctcttcttttgccatcctttagccaatcgcaagagtctgccattctgctgctgtaaataacattatgcctatggagacccagcatggcgtat

SEQ ID NO: 365363 - DNA, 140 bp, Artificial Sequence
  Synthetic
atacgccatgctgggtctccttataaacatcagaaactcattaaaagctagatccgagtttgttagaaataacgataaactactcataagatcaaaagaagaattaaaaaaatgtttcgacgtacttgggagtcggccat

SEQ ID NO: 365364 - DNA, 140 bp, Artificial Sequence
  Synthetic
atggccgactcccaagtacgtcgaaacatttttttaattcttcttttgatcttatgagtagtttatcgttatttctaacaaactcggatctagcttttaatgagtttctgatgtttataaggagacccagcatggcgtat

SEQ ID NO: 365365 - DNA, 140 bp, Artificial Sequence
  Synthetic
atacgccatgctgggtctccatgtgtgaatctgatcacatttgaggacggcctgagagaactatcagtgatacagagtcaccttaaagtctttgaaaatgagttcaccaacttaaatcttcgtacttgggagtcggccat

SEQ ID NO: 365366 - DNA, 140 bp, Artificial Sequence
  Synthetic
atggccgactcccaagtacgaagatttaagttggtgaactcattttcaaagactttaaggtgactctgtatcactgatagttctctcaggccgtcctcaaatgtgatcagattcacacatggagacccagcatggcgtat

SEQ ID NO: 365367 - DNA, 140 bp, Artificial Sequence
  Synthetic
atacgccatgctgggtctccgttgctgagcttgtcagctatggtataaaggaaggcagattttttaggctttccgacaccggaatcgatgcaagcacatactctgtaaaatattggaaaacgtacttgggagtcggccat

SEQ ID NO: 365368 - DNA, 140 bp, Artificial Sequence
  Synthetic
atggccgactcccaagtacgttttccaatattttacagagtatgtgcttgcatcgattccggtgtcggaaagcctaaaaaatctgccttcctttataccatagctgacaagctcagcaacggagacccagcatggcgtat

SEQ ID NO: 365369 - DNA, 140 bp, Artificial Sequence
  Synthetic
aggccctggctgctgatatgttccgacaccggaatcgatgcaagcacatactctgtaaaatattggaaaattcttcactgcatctctgccattggatgtttacctttgagtcaagcagacgaccttttgggacagcggtg

SEQ ID NO: 365370 - DNA, 140 bp, Artificial Sequence
  Synthetic
caccgctgtcccaaaaggtcgtctgcttgactcaaaggtaaacatccaatggcagagatgcagtgaagaattttccaatattttacagagtatgtgcttgcatcgattccggtgtcggaacatatcagcagccagggcct

SEQ ID NO: 365371 - DNA, 140 bp, Artificial Sequence
  Synthetic
atacgccatgctgggtctccagtttgatggacaagttatcgctaatatacttgccagtgaattaagttctgtgaaacgagattctgaacgcgagggtctgactgatctccttgattatctcgtacttgggagtcggccat

SEQ ID NO: 365372 - DNA, 140 bp, Artificial Sequence
  Synthetic
atggccgactcccaagtacgagataatcaaggagatcagtcagaccctcgcgttcagaatctcgtttcacagaacttaattcactggcaagtatattagcgataacttgtccatcaaactggagacccagcatggcgtat

SEQ ID NO: 365373 - DNA, 140 bp, Artificial Sequence
  Synthetic
atacgccatgctgggtctccgcaagttcaacacctggggagactcgaatagatctggaaagttcacatacagcagcagatctggagaatccattggaatcttcattgcagggaaattgcacgtacttgggagtcggccat

SEQ ID NO: 365374 - DNA, 140 bp, Artificial Sequence
  Synthetic
atggccgactcccaagtacgtgcaatttccctgcaatgaagattccaatggattctccagatctgctgctgtatgtgaactttccagatctattcgagtctccccaggtgttgaacttgcggagacccagcatggcgtat

SEQ ID NO: 365375 - DNA, 140 bp, Artificial Sequence
  Synthetic
aggccctggctgctgatatgcgttgcagaacttgtcagttatggcatcaaggaaggtagattttacaggctttcagacactggaattgatgcaagcacctactctgtgaaatactggaaggaccttttgggacagcggtg

SEQ ID NO: 365376 - DNA, 140 bp, Artificial Sequence
  Synthetic
caccgctgtcccaaaaggtccttccagtatttcacagagtaggtgcttgcatcaattccagtgtctgaaagcctgtaaaatctaccttccttgatgccataactgacaagttctgcaacgcatatcagcagccagggcct

SEQ ID NO: 365377 - DNA, 140 bp, Artificial Sequence
  Synthetic
atacgccatgctgggtctccgagcgagcctagactgcagtgggggcatggctgcttgtccattgtttatgacgaaactgatactcagaccacataccatgaaaatcttttgaaggtgaagcgtacttgggagtcggccat

SEQ ID NO: 365378 - DNA, 140 bp, Artificial Sequence
  Synthetic
atggccgactcccaagtacgcttcaccttcaaaagattttcatggtatgtggtctgagtatcagtttcgtcataaacaatggacaagcagccatgcccccactgcagtctaggctcgctcggagacccagcatggcgtat

SEQ ID NO: 365379 - DNA, 140 bp, Artificial Sequence
  Synthetic
atacgccatgctgggtctccgttttctgactccaaagttgtcctttcaaggatcaagttcaagacggagcttctcctcaactcattgacgctgctccactgtttcctaaaacatgctcctcgtacttgggagtcggccat

SEQ ID NO: 365380 - DNA, 140 bp, Artificial Sequence
  Synthetic
atggccgactcccaagtacgaggagcatgttttaggaaacagtggagcagcgtcaatgagttgaggagaagctccgtcttgaacttgatccttgaaaggacaactttggagtcagaaaacggagacccagcatggcgtat

SEQ ID NO: 365381 - DNA, 140 bp, Artificial Sequence
  Synthetic
aggccctggctgctgatatgagaagttaaacaaggttgttataaaagacaatcttgagcaaggtgtggaagaggagattgagttttgcaacaacttgactaagactgtttcagagaacccgaccttttgggacagcggtg

SEQ ID NO: 365382 - DNA, 140 bp, Artificial Sequence
  Synthetic
caccgctgtcccaaaaggtcgggttctctgaaacagtcttagtcaagttgttgcaaaactcaatctcctcttccacaccttgctcaagattgtcttttataacaaccttgtttaacttctcatatcagcagccagggcct

SEQ ID NO: 365383 - DNA, 140 bp, Artificial Sequence
  Synthetic
aggccctggctgctgatatgagttcttgcttgcattcttactttatgaggaagtgttaatgaacctgatcaaccagtgtaaggcagtaaaagaactcatcaacagcacaggactctcagagaccttttgggacagcggtg

SEQ ID NO: 365384 - DNA, 140 bp, Artificial Sequence
  Synthetic
caccgctgtcccaaaaggtctctgagagtcctgtgctgttgatgagttcttttactgccttacactggttgatcaggttcattaacacttcctcataaagtaagaatgcaagcaagaactcatatcagcagccagggcct

SEQ ID NO: 365385 - DNA, 140 bp, Artificial Sequence
  Synthetic
atacgccatgctgggtctccagtgcagtaagagagatggtcctagatgctcctttgcagcactattgagtctaatccatgaggattggcagaggataggtaaaaacattcttgttcgtgccgtacttgggagtcggccat

SEQ ID NO: 365386 - DNA, 140 bp, Artificial Sequence
  Synthetic
atggccgactcccaagtacggcacgaacaagaatgtttttacctatcctctgccaatcctcatggattagactcaatagtgctgcaaaggagcatctaggaccatctctcttactgcactggagacccagcatggcgtat

SEQ ID NO: 365387 - DNA, 140 bp, Artificial Sequence
  Synthetic
aggccctggctgctgatatgctctcaaggacatgtctaagccaaagtctgagagagtggtcatggctagaaggtcactaaatcatgctctatccttgatgtttctggacgagatgtcattgaccttttgggacagcggtg

SEQ ID NO: 365388 - DNA, 140 bp, Artificial Sequence
  Synthetic
caccgctgtcccaaaaggtcaatgacatctcgtccagaaacatcaaggatagagcatgatttagtgaccttctagccatgaccactctctcagactttggcttagacatgtccttgagagcatatcagcagccagggcct

SEQ ID NO: 365389 - DNA, 140 bp, Artificial Sequence
  Synthetic
atacgccatgctgggtctccacctgagctaaaatccttatccgtgaactgcaaaatggggaactttgaagggcaggagtgctttgagttcactattctgaaggacaatagcgcaaggctacgtacttgggagtcggccat

SEQ ID NO: 365390 - DNA, 140 bp, Artificial Sequence
  Synthetic
atggccgactcccaagtacgtagccttgcgctattgtccttcagaatagtgaactcaaagcactcctgcccttcaaagttccccattttgcagttcacggataaggattttagctcaggtggagacccagcatggcgtat

SEQ ID NO: 365391 - DNA, 140 bp, Artificial Sequence
  Synthetic
aggccctggctgctgatatgggcaggagtgctttgagttcactattctgaaggacaatagcgcaaggctagattacaacaagttgattgaccactgtgtggacatggaaaaaaagagggagaccttttgggacagcggtg

SEQ ID NO: 365392 - DNA, 140 bp, Artificial Sequence
  Synthetic
caccgctgtcccaaaaggtctccctctttttttccatgtccacacagtggtcaatcaacttgttgtaatctagccttgcgctattgtccttcagaatagtgaactcaaagcactcctgcccatatcagcagccagggcct

SEQ ID NO: 365393 - DNA, 140 bp, Artificial Sequence
  Synthetic
atacgccatgctgggtctccgattacaacaagttgattgaccactgtgtggacatggaaaaaaagagggaagcggttagagcagtagaagatttaattttaatgttgacaggcaaagcagcgtacttgggagtcggccat

SEQ ID NO: 365394 - DNA, 140 bp, Artificial Sequence
  Synthetic
atggccgactcccaagtacgctgctttgcctgtcaacattaaaattaaatcttctactgctctaaccgcttccctctttttttccatgtccacacagtggtcaatcaacttgttgtaatcggagacccagcatggcgtat

SEQ ID NO: 365395 - DNA, 140 bp, Artificial Sequence
  Synthetic
atacgccatgctgggtctcctattttactagcttatcgatcctctctttcttaactatttatttcagcttcatcgtcatcgttattatcttggggtgtggggggaacgatttctttgagacgtacttgggagtcggccat

SEQ ID NO: 365396 - DNA, 140 bp, Artificial Sequence
  Synthetic
atggccgactcccaagtacgtctcaaagaaatcgttccccccacaccccaagataataacgatgacgatgaagctgaaataaatagttaagaaagagaggatcgataagctagtaaaataggagacccagcatggcgtat

SEQ ID NO: 365397 - DNA, 140 bp, Artificial Sequence
  Synthetic
atacgccatgctgggtctccatgcatatatcattaatgtatgcagtcctttgcctacagctgtgtggtctgggagagactcatggatcatacaatgaaactggacacaataaaacagacgcgtacttgggagtcggccat

SEQ ID NO: 365398 - DNA, 140 bp, Artificial Sequence
  Synthetic
atggccgactcccaagtacgcgtctgttttattgtgtccagtttcattgtatgatccatgagtctctcccagaccacacagctgtaggcaaaggactgcatacattaatgatatatgcatggagacccagcatggcgtat

SEQ ID NO: 365399 - DNA, 140 bp, Artificial Sequence
  Synthetic
atacgccatgctgggtctccttatgacaacgcccggtgataacctgagctctgaacagccagtgagtacggccttgtctatcacacctgacccctccactgttacacccacaacaccagccgtacttgggagtcggccat

SEQ ID NO: 365400 - DNA, 140 bp, Artificial Sequence
  Synthetic
atggccgactcccaagtacggctggtgttgtgggtgtaacagtggaggggtcaggtgtgatagacaaggccgtactcactggctgttcagagctcaggttatcaccgggcgttgtcataaggagacccagcatggcgtat

SEQ ID NO: 365401 - DNA, 140 bp, Artificial Sequence
  Synthetic
aggccctggctgctgatatgccgagagcttgtccctgccagaaaccacaccagagctccctgctacagctggtatagacacttcaagtgcaagtgatgtcgactccagtacgcaagcagcgaccttttgggacagcggtg

SEQ ID NO: 365402 - DNA, 140 bp, Artificial Sequence
  Synthetic
caccgctgtcccaaaaggtcgctgcttgcgtactggagtcgacatcacttgcacttgaagtgtctataccagctgtagcagggagctctggtgtggtttctggcagggacaagctctcggcatatcagcagccagggcct

SEQ ID NO: 365403 - DNA, 140 bp, Artificial Sequence
  Synthetic
atacgccatgctgggtctccgcacaccatctacaccacaagaaacacaccatcctgtgaggaatctactttcagtcacgagccttgggccagaagaaacatcaacaccttcgggaccaggcgtacttgggagtcggccat

SEQ ID NO: 365404 - DNA, 140 bp, Artificial Sequence
  Synthetic
atggccgactcccaagtacgcctggtcccgaaggtgttgatgtttcttctggcccaaggctcgtgactgaaagtagattcctcacaggatggtgtgtttcttgtggtgtagatggtgtgcggagacccagcatggcgtat

SEQ ID NO: 365405 - DNA, 140 bp, Artificial Sequence
  Synthetic
aggccctggctgctgatatgtcagtcacgagccttgggccagaagaaacatcaacaccttcgggaccaggcaaagagagctcagcaactagtagcccccatccagtctccaacaaaccacgaccttttgggacagcggtg

SEQ ID NO: 365406 - DNA, 140 bp, Artificial Sequence
  Synthetic
caccgctgtcccaaaaggtcgtggtttgttggagactggatgggggctactagttgctgagctctctttgcctggtcccgaaggtgttgatgtttcttctggcccaaggctcgtgactgacatatcagcagccagggcct

SEQ ID NO: 365407 - DNA, 140 bp, Artificial Sequence
  Synthetic
atacgccatgctgggtctccgccactgaacaccccgagcccctgacacagtcagcaaccccaggcctaatgacctctccaacacaggtagtccacccacaaagtgccacctccataaccgcgtacttgggagtcggccat

SEQ ID NO: 365408 - DNA, 140 bp, Artificial Sequence
  Synthetic
atggccgactcccaagtacgcggttatggaggtggcactttgtgggtggactacctgtgttggagaggtcattaggcctggggttgctgactgtgtcaggggctcggggtgttcagtggcggagacccagcatggcgtat

SEQ ID NO: 365409 - DNA, 140 bp, Artificial Sequence
  Synthetic
aggccctggctgctgatatgtggaatggtgtaagagaaatcttggtcttgattgtgatgacactttctttcaaaagagaattgaggaattcttcataactggtgagggccattttaatgagaccttttgggacagcggtg

SEQ ID NO: 365410 - DNA, 140 bp, Artificial Sequence
  Synthetic
caccgctgtcccaaaaggtctcattaaaatggccctcaccagttatgaagaattcctcaattctcttttgaaagaaagtgtcatcacaatcaagaccaagatttctcttacaccattccacatatcagcagccagggcct

SEQ ID NO: 365411 - DNA, 140 bp, Artificial Sequence
  Synthetic
aggccctggctgctgatatgatctaattcagggcttcaattgattaatattacccgacattcaactagaatagttgacacacctgggcctaagatcaccaacttaaagaccatcaactgcgaccttttgggacagcggtg

SEQ ID NO: 365412 - DNA, 140 bp, Artificial Sequence
  Synthetic
caccgctgtcccaaaaggtcgcagttgatggtctttaagttggtgatcttaggcccaggtgtgtcaactattctagttgaatgtcgggtaatattaatcaattgaagccctgaattagatcatatcagcagccagggcct

SEQ ID NO: 365413 - DNA, 140 bp, Artificial Sequence
  Synthetic
atacgccatgctgggtctcctagttgacacacctgggcctaagatcaccaacttaaagaccatcaactgcataaacttgaaggcatcgatcttcaaagaacatagagaggttgaaatcaacgtacttgggagtcggccat

SEQ ID NO: 365414 - DNA, 140 bp, Artificial Sequence
  Synthetic
atggccgactcccaagtacgttgatttcaacctctctatgttctttgaagatcgatgccttcaagtttatgcagttgatggtctttaagttggtgatcttaggcccaggtgtgtcaactaggagacccagcatggcgtat

SEQ ID NO: 365415 - DNA, 140 bp, Artificial Sequence
  Synthetic
aggccctggctgctgatatgttctcctcaactcattgacactgctccactgtttcttaaaacatgctcctagtgatgccataatggaggtagagagcaaaagtagcttgctacacaagtagaccttttgggacagcggtg

SEQ ID NO: 365416 - DNA, 140 bp, Artificial Sequence
  Synthetic
caccgctgtcccaaaaggtctacttgtgtagcaagctacttttgctctctacctccattatggcatcactaggagcatgttttaagaaacagtggagcagtgtcaatgagttgaggagaacatatcagcagccagggcct

SEQ ID NO: 365417 - DNA, 140 bp, Artificial Sequence
  Synthetic
atacgccatgctgggtctcccaaaccaagcctgaccatgttgatacagactttgtttcctgacaagtttgaagatttcttagatcgaacccagttgcatccagagttcagagatttaactcgtacttgggagtcggccat

SEQ ID NO: 365418 - DNA, 140 bp, Artificial Sequence
  Synthetic
atggccgactcccaagtacgagttaaatctctgaactctggatgcaactgggttcgatctaagaaatcttcaaacttgtcaggaaacaaagtctgtatcaacatggtcaggcttggtttgggagacccagcatggcgtat

SEQ ID NO: 365419 - DNA, 140 bp, Artificial Sequence
  Synthetic
aggccctggctgctgatatgccccaaaattccattattgggcaaaatggctatttacatttgcagaatgtcgaatcaccccaaaacaaccatggctttcctcttctggttcagctttggcgaccttttgggacagcggtg

SEQ ID NO: 365420 - DNA, 140 bp, Artificial Sequence
  Synthetic
caccgctgtcccaaaaggtcgccaaagctgaaccagaagaggaaagccatggttgttttggggtgattcgacattctgcaaatgtaaatagccattttgcccaataatggaattttggggcatatcagcagccagggcct

SEQ ID NO: 365421 - DNA, 140 bp, Artificial Sequence
  Synthetic
atacgccatgctgggtctcccgaatcaccccaaaacaaccatggctttcctcttctggttcagctttggctacgtaataacttgtatactttgcaaggccatcttctacttgttaataatcgtacttgggagtcggccat

SEQ ID NO: 365422 - DNA, 140 bp, Artificial Sequence
  Synthetic
atggccgactcccaagtacgattattaacaagtagaagatggccttgcaaagtatacaagttattacgtagccaaagctgaaccagaagaggaaagccatggttgttttggggtgattcgggagacccagcatggcgtat

SEQ ID NO: 365423 - DNA, 140 bp, Artificial Sequence
  Synthetic
atacgccatgctgggtctcctattgggacactagggaaaaggttcaagcagtatagagagttaaaacctcagacctgcaccatatgtgagacaactcctgtaaatgcaatagatgctgagcgtacttgggagtcggccat

SEQ ID NO: 365424 - DNA, 140 bp, Artificial Sequence
  Synthetic
atggccgactcccaagtacgctcagcatctattgcatttacaggagttgtctcacatatggtgcaggtctgaggttttaactctctatactgcttgaaccttttccctagtgtcccaataggagacccagcatggcgtat

SEQ ID NO: 365425 - DNA, 140 bp, Artificial Sequence
  Synthetic
atacgccatgctgggtctccagacctgcaccatatgtgagacaactcctgtaaatgcaatagatgctgagatgcacgacctcaattgcagttacaacatttgtccctactgtgcatctagcgtacttgggagtcggccat

SEQ ID NO: 365426 - DNA, 140 bp, Artificial Sequence
  Synthetic
atggccgactcccaagtacgctagatgcacagtagggacaaatgttgtaactgcaattgaggtcgtgcatctcagcatctattgcatttacaggagttgtctcacatatggtgcaggtctggagacccagcatggcgtat

SEQ ID NO: 365427 - DNA, 140 bp, Artificial Sequence
  Synthetic
atacgccatgctgggtctccactaacctcagatgggcttgctaggcatgtgacacaatgccctaagcggaaggagaaagtggaagaaactgaactgtacttgaacttagaaagaattcctcgtacttgggagtcggccat

SEQ ID NO: 365428 - DNA, 140 bp, Artificial Sequence
  Synthetic
atggccgactcccaagtacgaggaattctttctaagttcaagtacagttcagtttcttccactttctccttccgcttagggcattgtgtcacatgcctagcaagcccatctgaggttagtggagacccagcatggcgtat

SEQ ID NO: 365429 - DNA, 140 bp, Artificial Sequence
  Synthetic
atacgccatgctgggtctcctgggttgtaagaaagctgttgcaggtatcagagtccactggtgtggcattgaaaagaagcagctggctgattgtgctgcttgtgctgttcacggtttcatcgtacttgggagtcggccat

SEQ ID NO: 365430 - DNA, 140 bp, Artificial Sequence
  Synthetic
atggccgactcccaagtacgatgaaaccgtgaacagcacaagcagcacaatcagccagctgcttcttttcaatgccacaccagtggactctgatacctgcaacagctttcttacaacccaggagacccagcatggcgtat

SEQ ID NO: 365431 - DNA, 140 bp, Artificial Sequence
  Synthetic
atacgccatgctgggtctcctctcaaagaaacacgtgccgcttacgcccacagtgttctcttgagtgctagcaaaatggagaataaaatcgaggtgaataacaaagatgagatgaacaagcgtacttgggagtcggccat

SEQ ID NO: 365432 - DNA, 140 bp, Artificial Sequence
  Synthetic
atggccgactcccaagtacgcttgttcatctcatctttgttattcacctcgattttattctccattttgctagcactcaagagaacactgtgggcgtaagcggcacgtgtttctttgagaggagacccagcatggcgtat

SEQ ID NO: 365433 - DNA, 140 bp, Artificial Sequence
  Synthetic
aggccctggctgctgatatggcaactccttcttccctggactgtccatttgcaagacgtgctccataagcagcattaatggctttgaaattgagtcccataagtgctattgcagcttattgaccttttgggacagcggtg

SEQ ID NO: 365434 - DNA, 140 bp, Artificial Sequence
  Synthetic
caccgctgtcccaaaaggtcaataagctgcaatagcacttatgggactcaatttcaaagccattaatgctgcttatggagcacgtcttgcaaatggacagtccagggaagaaggagttgccatatcagcagccagggcct

SEQ ID NO: 365435 - DNA, 140 bp, Artificial Sequence
  Synthetic
atacgccatgctgggtctccaatttgatggacaagttattgccaacatacttgccagtgaattgagttctgtgaaacgagattctgaacgcgaaggtctaactgatctccttgattatctcgtacttgggagtcggccat

SEQ ID NO: 365436 - DNA, 140 bp, Artificial Sequence
  Synthetic
atggccgactcccaagtacgagataatcaaggagatcagttagaccttcgcgttcagaatctcgtttcacagaactcaattcactggcaagtatgttggcaataacttgtccatcaaattggagacccagcatggcgtat

SEQ ID NO: 365437 - DNA, 140 bp, Artificial Sequence
  Synthetic
atacgccatgctgggtctcctgatactagcagtttgtgttgttagcacgtcagcagtggagatggaaaacctaccagccgggacctgggaaagagaagaagacctaacaaatttctgtcacgtacttgggagtcggccat

SEQ ID NO: 365438 - DNA, 140 bp, Artificial Sequence
  Synthetic
atggccgactcccaagtacgtgacagaaatttgttaggtcttcttctctttcccaggtcccggctggtaggttttccatctccactgctgacgtgctaacaacacaaactgctagtatcaggagacccagcatggcgtat

SEQ ID NO: 365439 - DNA, 140 bp, Artificial Sequence
  Synthetic
aggccctggctgctgatatgctaccagccgggacctgggaaagagaagaagacctaacaaatttctgtcatcaggaatgtcaggttacagagactgaatgcctctgcccttatgaagctcgaccttttgggacagcggtg

SEQ ID NO: 365440 - DNA, 140 bp, Artificial Sequence
  Synthetic
caccgctgtcccaaaaggtcgagcttcataagggcagaggcattcagtctctgtaacctgacattcctgatgacagaaatttgttaggtcttcttctctttcccaggtcccggctggtagcatatcagcagccagggcct

SEQ ID NO: 365441 - DNA, 140 bp, Artificial Sequence
  Synthetic
aggccctggctgctgatatgccttggggggacatcaacaagtcaggccggtcaggaatagcacttgttgcaacaggccttgccaagctcgcagagactgaggggaaaggagtgtttgatggaccttttgggacagcggtg

SEQ ID NO: 365442 - DNA, 140 bp, Artificial Sequence
  Synthetic
caccgctgtcccaaaaggtccatcaaacactcctttcccctcagtctctgcgagcttggcaaggcctgttgcaacaagtgctattcctgaccggcctgacttgttgatgtccccccaaggcatatcagcagccagggcct

SEQ ID NO: 365443 - DNA, 140 bp, Artificial Sequence
  Synthetic
atacgccatgctgggtctccaaggctggtgtgactccagaaaccttcccgactgtctcacagttccttttcgaactggggaaacaaccaaggggtaccaagaaaatgaagaaggcactctcgtacttgggagtcggccat

SEQ ID NO: 365444 - DNA, 140 bp, Artificial Sequence
  Synthetic
atggccgactcccaagtacgagagtgccttcttcattttcttggtaccccttggttgtttccccagttcgaaaaggaactgtgagacagtcgggaaggtttctggagtcacaccagccttggagacccagcatggcgtat

SEQ ID NO: 365445 - DNA, 140 bp, Artificial Sequence
  Synthetic
atacgccatgctgggtctccaatggccccattcaagaaattggagatgcaatcccacttggtgctggggtgtagggactggctgcacctgttgtggattagatgtgaaagacctttttaccgtacttgggagtcggccat

SEQ ID NO: 365446 - DNA, 140 bp, Artificial Sequence
  Synthetic
atggccgactcccaagtacggtaaaaaggtctttcacatctaatccacaacaggtgcagccagtccctacaccccagcaccaagtgggattgcatctccaatttcttgaatggggccattggagacccagcatggcgtat

SEQ ID NO: 365447 - DNA, 140 bp, Artificial Sequence
  Synthetic
atacgccatgctgggtctcctagtgtgtgtagaacttaccagtcaggaaaggcagtgtagcttgattgaagcgggcacaaggttcaatttaggtcctgtgaccatcacactgtcagaacccgtacttgggagtcggccat

SEQ ID NO: 365448 - DNA, 140 bp, Artificial Sequence
  Synthetic
atggccgactcccaagtacgggttctgacagtgtgatggtcacaggacctaaattgaaccttgtgcccgcttcaatcaagctacactgcctttcctgactggtaagttctacacacactaggagacccagcatggcgtat

SEQ ID NO: 365449 - DNA, 140 bp, Artificial Sequence
  Synthetic
aggccctggctgctgatatgggatcgaagaaggtttttttgacttgatgcatgtacagaaagtgttatcggcaagcacagtatgtaagttgcagagttgcacacatggtgtaccaggagagaccttttgggacagcggtg

SEQ ID NO: 365450 - DNA, 140 bp, Artificial Sequence
  Synthetic
caccgctgtcccaaaaggtctctcctggtacaccatgtgtgcaactctgcaacttacatactgtgcttgccgataacactttctgtacatgcatcaagtcaaaaaaaccttcttcgatcccatatcagcagccagggcct

SEQ ID NO: 365451 - DNA, 140 bp, Artificial Sequence
  Synthetic
atacgccatgctgggtctccttccaaaatgcctacaatgtcaagggcaatgccaccagtgccaacattatctgaagctcagaatgctctgcacccagctttcccccttttgcactgctgtcgtacttgggagtcggccat

SEQ ID NO: 365452 - DNA, 140 bp, Artificial Sequence
  Synthetic
atggccgactcccaagtacgacagcagtgcaaaagggggaaagctgggtgcagagcattctgagcttcagataatgttggcactggtggcattgcccttgacattgtaggcattttggaaggagacccagcatggcgtat

SEQ ID NO: 365453 - DNA, 140 bp, Artificial Sequence
  Synthetic
aggccctggctgctgatatggtttattttaactgcttatataatcctgttttattaacttcttcttattttctttcgttttaaacacttaaagggctgtgcggcaacgatatctttgagagaccttttgggacagcggtg

SEQ ID NO: 365454 - DNA, 140 bp, Artificial Sequence
  Synthetic
caccgctgtcccaaaaggtctctcaaagatatcgttgccgcacagccctttaagtgtttaaaacgaaagaaaataagaagaagttaataaaacaggattatataagcagttaaaataaaccatatcagcagccagggcct

SEQ ID NO: 365455 - DNA, 140 bp, Artificial Sequence
  Synthetic
aggccctggctgctgatatgggaaatgaactgttgtataaggcacccagaaaggccttggcaaccgtctgtggtgccctatttgggaaacaaataaacaagcttcagaactgctttaggagaccttttgggacagcggtg

SEQ ID NO: 365456 - DNA, 140 bp, Artificial Sequence
  Synthetic
caccgctgtcccaaaaggtctcctaaagcagttctgaagcttgtttatttgtttcccaaatagggcaccacagacggttgccaaggcctttctgggtgccttatacaacagttcatttcccatatcagcagccagggcct

SEQ ID NO: 365457 - DNA, 140 bp, Artificial Sequence
  Synthetic
aggccctggctgctgatatgagggtcactgcacacggagacacaccacaactagatcttaaggcaagaccaacctatggtgcaggtgagatcactgtactggtagaagttgctgacatgggaccttttgggacagcggtg

SEQ ID NO: 365458 - DNA, 140 bp, Artificial Sequence
  Synthetic
caccgctgtcccaaaaggtcccatgtcagcaacttctaccagtacagtgatctcacctgcaccataggttggtcttgccttaagatctagttgtggtgtgtctccgtgtgcagtgaccctcatatcagcagccagggcct

SEQ ID NO: 365459 - DNA, 140 bp, Artificial Sequence
  Synthetic
aggccctggctgctgatatgacttgcacaggttgttatgcttgtagctctggcatctcatgcaaagttagaattcatgtggatgaaccagatgaacttacagtacatgttaaaagtgatggaccttttgggacagcggtg

SEQ ID NO: 365460 - DNA, 140 bp, Artificial Sequence
  Synthetic
caccgctgtcccaaaaggtccatcacttttaacatgtactgtaagttcatctggttcatccacatgaattctaactttgcatgagatgccagagctacaagcataacaacctgtgcaagtcatatcagcagccagggcct

SEQ ID NO: 365461 - DNA, 140 bp, Artificial Sequence
  Synthetic
atacgccatgctgggtctccaattcatgtggatgaaccagatgaacttacagtacatgttaaaagtgatgatccagatgtagttgcagctagctcaagtctcatggcaagaaagcttgaacgtacttgggagtcggccat

SEQ ID NO: 365462 - DNA, 140 bp, Artificial Sequence
  Synthetic
atggccgactcccaagtacgttcaagctttcttgccatgagacttgagctagctgcaactacatctggatcatcacttttaacatgtactgtaagttcatctggttcatccacatgaattggagacccagcatggcgtat

SEQ ID NO: 365463 - DNA, 140 bp, Artificial Sequence
  Synthetic
atacgccatgctgggtctccatccagatgtagttgcagctagctcaagtctcatggcaagaaagcttgaatttggaacagacagtacatttaaagctttctcagccatgcctaaaacttccgtacttgggagtcggccat

SEQ ID NO: 365464 - DNA, 140 bp, Artificial Sequence
  Synthetic
atggccgactcccaagtacggaagttttaggcatggctgagaaagctttaaatgtactgtctgttccaaattcaagctttcttgccatgagacttgagctagctgcaactacatctggatggagacccagcatggcgtat

SEQ ID NO: 365465 - DNA, 140 bp, Artificial Sequence
  Synthetic
aggccctggctgctgatatggccacaaagtcctcgcagagtacaaagtccctggtgaaattgttatgtctgtcaaagaaatgctgtcagatatgattagaagaaggaacttgattctcaagaccttttgggacagcggtg

SEQ ID NO: 365466 - DNA, 140 bp, Artificial Sequence
  Synthetic
caccgctgtcccaaaaggtcttgagaatcaagttccttcttctaatcatatctgacagcatttctttgacagacataacaatttcaccagggactttgtactctgcgaggactttgtggccatatcagcagccagggcct

SEQ ID NO: 365467 - DNA, 140 bp, Artificial Sequence
  Synthetic
atacgccatgctgggtctccgtcaaagaaatgctgtcagatatgattagaagaaggaacttgattctcaacagaggtggcgatgaaaatccacgaggcccagtgagccgtgaacatgtggcgtacttgggagtcggccat

SEQ ID NO: 365468 - DNA, 140 bp, Artificial Sequence
  Synthetic
atggccgactcccaagtacgccacatgttcacggctcactgggcctcgtggattttcatcgccacctctgttgagaatcaagttccttcttctaatcatatctgacagcatttctttgacggagacccagcatggcgtat

SEQ ID NO: 365469 - DNA, 140 bp, Artificial Sequence
  Synthetic
aggccctggctgctgatatgtaaagaacatgcttagtggtatttttggcaatgtttttataggtattttcttgttccttggccccttcatcttgttaatactattctttatgtttgggtggaccttttgggacagcggtg

SEQ ID NO: 365470 - DNA, 140 bp, Artificial Sequence
  Synthetic
caccgctgtcccaaaaggtccacccaaacataaagaatagtattaacaagatgaaggggccaaggaacaagaaaatacctataaaaacattgccaaaaataccactaagcatgttctttacatatcagcagccagggcct

SEQ ID NO: 365471 - DNA, 140 bp, Artificial Sequence
  Synthetic
aggccctggctgctgatatgagtatagacacctcaaggaagatgaagaaactggttatagaaggattattgaaagactaaacaataaaaaaggaaaaaacaaactgcttgatggtgaaaggaccttttgggacagcggtg

SEQ ID NO: 365472 - DNA, 140 bp, Artificial Sequence
  Synthetic
caccgctgtcccaaaaggtcctttcaccatcaagcagtttgttttttccttttttattgtttagtctttcaataatccttctataaccagtttcttcatcttccttgaggtgtctatactcatatcagcagccagggcct

SEQ ID NO: 365473 - DNA, 140 bp, Artificial Sequence
  Synthetic
aggccctggctgctgatatgactaaacaataaaaaaggaaaaaacaaactgcttgatggtgaaagacttgctgatagaagaattgccgaactgttctctacaaaaacacacattggctaggaccttttgggacagcggtg

SEQ ID NO: 365474 - DNA, 140 bp, Artificial Sequence
  Synthetic
caccgctgtcccaaaaggtcctagccaatgtgtgtttttgtagagaacagttcggcaattcttctatcagcaagtctttcaccatcaagcagtttgttttttccttttttattgtttagtcatatcagcagccagggcct

SEQ ID NO: 365475 - DNA, 140 bp, Artificial Sequence
  Synthetic
atacgccatgctgggtctcctctcaaagaaacacgtgccgcttacgcccacagtgttctcttgagtgtctgcaaaatggaaaacaagatcgaggtgaacagcaaagacgagatgaacaaacgtacttgggagtcggccat

SEQ ID NO: 365476 - DNA, 140 bp, Artificial Sequence
  Synthetic
atggccgactcccaagtacgtttgttcatctcgtctttgctgttcacctcgatcttgttttccattttgcagacactcaagagaacactgtgggcgtaagcggcacgtgtttctttgagaggagacccagcatggcgtat

SEQ ID NO: 365477 - DNA, 140 bp, Artificial Sequence
  Synthetic
aggccctggctgctgatatgtactagtcactgtagtaactgtcaccccaacggtgtgaacattagcaacatatcaaatgtgtgcaaaaggtgtcccaaaatagaagtagttagtcattgtgaccttttgggacagcggtg

SEQ ID NO: 365478 - DNA, 140 bp, Artificial Sequence
  Synthetic
caccgctgtcccaaaaggtcacaatgactaactacttctattttgggacaccttttgcacacatttgatatgttgctaatgttcacaccgttggggtgacagttactacagtgactagtacatatcagcagccagggcct

SEQ ID NO: 365479 - DNA, 140 bp, Artificial Sequence
  Synthetic
atacgccatgctgggtctcctggtttgaggagtttaaaaaaggaaatggacttatggacactttcacaaactcctactccttttgtgagaatgtaccaaatctggataagtttgtgttcccgtacttgggagtcggccat

SEQ ID NO: 365480 - DNA, 140 bp, Artificial Sequence
  Synthetic
atggccgactcccaagtacgggaacacaaacttatccagatttggtacattctcacaaaaggagtaggagtttgtgaaagtgtccataagtccatttccttttttaaactcctcaaaccaggagacccagcatggcgtat

SEQ ID NO: 365481 - DNA, 140 bp, Artificial Sequence
  Synthetic
aggccctggctgctgatatgaggtaaccgagacggaatgcctttgtccatacgaagctcttgtgctcaggaaacctcttttcttagacagtatagtcaaaggtatgaaaaatttgctaaagaccttttgggacagcggtg

SEQ ID NO: 365482 - DNA, 140 bp, Artificial Sequence
  Synthetic
caccgctgtcccaaaaggtctttagcaaatttttcatacctttgactatactgtctaagaaaagaggtttcctgagcacaagagcttcgtatggacaaaggcattccgtctcggttacctcatatcagcagccagggcct

SEQ ID NO: 365483 - DNA, 140 bp, Artificial Sequence
  Synthetic
atacgccatgctgggtctccgatgttcccaaaatagaacaacttgccaattaccaacaggctgctctcaagtggaggaaggacataggtttccgtgtcaatgcaaacacggcagccttaacgtacttgggagtcggccat

SEQ ID NO: 365484 - DNA, 140 bp, Artificial Sequence
  Synthetic
atggccgactcccaagtacgttaaggctgccgtgtttgcattgacacggaaacctatgtccttcctccacttgagagcagcctgttggtaattggcaagttgttctattttgggaacatcggagacccagcatggcgtat

SEQ ID NO: 365485 - DNA, 140 bp, Artificial Sequence
  Synthetic
aggccctggctgctgatatgccacagacaatggctctggtgaacctagcacagatcctccaaccaccaatgagacaaccccccctccctctgccaccactgcccaaacaacagagacaaagaccttttgggacagcggtg

SEQ ID NO: 365486 - DNA, 140 bp, Artificial Sequence
  Synthetic
caccgctgtcccaaaaggtctttgtctctgttgtttgggcagtggtggcagagggagggggggttgtctcattggtggttggaggatctgtgctaggttcaccagagccattgtctgtggcatatcagcagccagggcct

SEQ ID NO: 365487 - DNA, 140 bp, Artificial Sequence
  Synthetic
atacgccatgctgggtctccgcacattgccaaagcacaagagctttataaaaattcatctgctcttcgtgcacaaggtgcacagattgacacccccttcagctcgttttactggctctaccgtacttgggagtcggccat

SEQ ID NO: 365488 - DNA, 140 bp, Artificial Sequence
  Synthetic
atggccgactcccaagtacggtagagccagtaaaacgagctgaagggggtgtcaatctgtgcaccttgtgcacgaagagcagatgaatttttataaagctcttgtgctttggcaatgtgcggagacccagcatggcgtat

SEQ ID NO: 365489 - DNA, 140 bp, Artificial Sequence
  Synthetic
aggccctggctgctgatatgtgaactggggaagcagccaagggggaccaaaaaaatgaaaaaggcactcctgagcactccaatgaagtgggggaagaaactttatgagctctttgctgatgaccttttgggacagcggtg

SEQ ID NO: 365490 - DNA, 140 bp, Artificial Sequence
  Synthetic
caccgctgtcccaaaaggtcatcagcaaagagctcataaagtttcttcccccacttcattggagtgctcaggagtgcctttttcatttttttggtcccccttggctgcttccccagttcacatatcagcagccagggcct

SEQ ID NO: 365491 - DNA, 140 bp, Artificial Sequence
  Synthetic
aggccctggctgctgatatgtgagcactccaatgaagtgggggaagaaactttatgagctctttgctgatgactctttccagcagaacagaatctacatgcaccctgctgtgttgacagcgaccttttgggacagcggtg

SEQ ID NO: 365492 - DNA, 140 bp, Artificial Sequence
  Synthetic
caccgctgtcccaaaaggtcgctgtcaacacagcagggtgcatgtagattctgttctgctggaaagagtcatcagcaaagagctcataaagtttcttcccccacttcattggagtgctcacatatcagcagccagggcct

SEQ ID NO: 365493 - DNA, 140 bp, Artificial Sequence
  Synthetic
aggccctggctgctgatatgcttcggacaagcacagagaccaacaatccatgcgccaagacaattgtaaaattatttgaaatccaaaaaacaggatttaacatacaggacatggacattggaccttttgggacagcggtg

SEQ ID NO: 365494 - DNA, 140 bp, Artificial Sequence
  Synthetic
caccgctgtcccaaaaggtccaatgtccatgtcctgtatgttaaatcctgttttttggatttcaaataattttacaattgtcttggcgcatggattgttggtctctgtgcttgtccgaagcatatcagcagccagggcct

SEQ ID NO: 365495 - DNA, 140 bp, Artificial Sequence
  Synthetic
aggccctggctgctgatatgttccagaatgcctacaacgtcaagggcaatgccaccagtgccaacatcatctaaaactcaaggtgtttcatattcagcttttctcctcctgcatcactacgaccttttgggacagcggtg

SEQ ID NO: 365496 - DNA, 140 bp, Artificial Sequence
  Synthetic
caccgctgtcccaaaaggtcgtagtgatgcaggaggagaaaagctgaatatgaaacaccttgagttttagatgatgttggcactggtggcattgcccttgacgttgtaggcattctggaacatatcagcagccagggcct

SEQ ID NO: 365497 - DNA, 140 bp, Artificial Sequence
  Synthetic
aggccctggctgctgatatgctaaaactcaaggtgtttcatattcagcttttctcctcctgcatcactacttacagttatgactattaatcacatttatttcaattgcttacgtaatgctgaccttttgggacagcggtg

SEQ ID NO: 365498 - DNA, 140 bp, Artificial Sequence
  Synthetic
caccgctgtcccaaaaggtcagcattacgtaagcaattgaaataaatgtgattaatagtcataactgtaagtagtgatgcaggaggagaaaagctgaatatgaaacaccttgagttttagcatatcagcagccagggcct

SEQ ID NO: 365499 - DNA, 140 bp, Artificial Sequence
  Synthetic
aggccctggctgctgatatgttacagttatgactattaatcacatttatttcaattgcttacgtaatgctgttttgctaattttatcttgccatttttcatttcaaacacttaaagggctgaccttttgggacagcggtg

SEQ ID NO: 365500 - DNA, 140 bp, Artificial Sequence
  Synthetic
caccgctgtcccaaaaggtcagccctttaagtgtttgaaatgaaaaatggcaagataaaattagcaaaacagcattacgtaagcaattgaaataaatgtgattaatagtcataactgtaacatatcagcagccagggcct

SEQ ID NO: 365501 - DNA, 140 bp, Artificial Sequence
  Synthetic
atacgccatgctgggtctcctctcaaagaaatacttgcggcacgtcagtacgtaagtgtaaactttgagagagtggattgagcatcccgaatgcaccatgcccaccaacattatgcataccgtacttgggagtcggccat

SEQ ID NO: 365502 - DNA, 140 bp, Artificial Sequence
  Synthetic
atggccgactcccaagtacggtatgcataatgttggtgggcatggtgcattcgggatgctcaatccactctctcaaagtttacacttacgtactgacgtgccgcaagtatttctttgagaggagacccagcatggcgtat

SEQ ID NO: 365503 - DNA, 140 bp, Artificial Sequence
  Synthetic
atacgccatgctgggtctccctcatgggcagttaaacacaactgaacacaatggaacaaacaacaccacagcacctggcgcaagccaaagccccaagccacccatgagcacaaccccacccgtacttgggagtcggccat

SEQ ID NO: 365504 - DNA, 140 bp, Artificial Sequence
  Synthetic
atggccgactcccaagtacgggtggggttgtgctcatgggtggcttggggctttggcttgcgccaggtgctgtggtgttgtttgttccattgtgttcagttgtgtttaactgcccatgagggagacccagcatggcgtat

SEQ ID NO: 365505 - DNA, 140 bp, Artificial Sequence
  Synthetic
aggccctggctgctgatatggcacctggcgcaagccaaagccccaagccacccatgagcacaaccccaccacacgcaccggaatcatccaccatcaaacccaccacaccaataagcgaaggaccttttgggacagcggtg

SEQ ID NO: 365506 - DNA, 140 bp, Artificial Sequence
  Synthetic
caccgctgtcccaaaaggtccttcgcttattggtgtggtgggtttgatggtggatgattccggtgcgtgtggtggggttgtgctcatgggtggcttggggctttggcttgcgccaggtgccatatcagcagccagggcct

SEQ ID NO: 365507 - DNA, 140 bp, Artificial Sequence
  Synthetic
atacgccatgctgggtctccacacgcaccggaatcatccaccatcaaacccaccacaccaataagcgaagcagaaggctcaggggaaacgacttcaaccccaaacaccacccagggcctgcgtacttgggagtcggccat

SEQ ID NO: 365508 - DNA, 140 bp, Artificial Sequence
  Synthetic
atggccgactcccaagtacgcaggccctgggtggtgtttggggttgaagtcgtttcccctgagccttctgcttcgcttattggtgtggtgggtttgatggtggatgattccggtgcgtgtggagacccagcatggcgtat

SEQ ID NO: 365509 - DNA, 140 bp, Artificial Sequence
  Synthetic
aggccctggctgctgatatgccccccgcggcaaccagcacaggcatcccaggtgcaagtgatgtcaactccagcacacaggcagccagagatacctccacaccaacagtccgcaccggtcgaccttttgggacagcggtg

SEQ ID NO: 365510 - DNA, 140 bp, Artificial Sequence
  Synthetic
caccgctgtcccaaaaggtcgaccggtgcggactgttggtgtggaggtatctctggctgcctgtgtgctggagttgacatcacttgcacctgggatgcctgtgctggttgccgcggggggcatatcagcagccagggcct

SEQ ID NO: 365511 - DNA, 140 bp, Artificial Sequence
  Synthetic
atacgccatgctgggtctccgtcaagcacagacagcacgaaccccaccacacagatgaccgacaacacccccacactaacagtcagtacaagcccatccagcagccccagcacgccatcccgtacttgggagtcggccat

SEQ ID NO: 365512 - DNA, 140 bp, Artificial Sequence
  Synthetic
atggccgactcccaagtacgggatggcgtgctggggctgctggatgggcttgtactgactgttagtgtgggggtgttgtcggtcatctgtgtggtggggttcgtgctgtctgtgcttgacggagacccagcatggcgtat

SEQ ID NO: 365513 - DNA, 140 bp, Artificial Sequence
  Synthetic
atacgccatgctgggtctccccctaagacagtaacaacaccaacaccaacgagccctggagagatgagctcggaaaccagcagtcagcactcagccatgagcagaataccaaccccccaccgtacttgggagtcggccat

SEQ ID NO: 365514 - DNA, 140 bp, Artificial Sequence
  Synthetic
atggccgactcccaagtacggtggggggttggtattctgctcatggctgagtgctgactgctggtttccgagctcatctctccagggctcgttggtgttggtgttgttactgtcttagggggagacccagcatggcgtat

SEQ ID NO: 365515 - DNA, 140 bp, Artificial Sequence
  Synthetic
aggccctggctgctgatatgcggaaaccagcagtcagcactcagccatgagcagaataccaaccccccacacagcaacccgggtctccactgagaacaccaaccacagcacacctagacagaccttttgggacagcggtg

SEQ ID NO: 365516 - DNA, 140 bp, Artificial Sequence
  Synthetic
caccgctgtcccaaaaggtctgtctaggtgtgctgtggttggtgttctcagtggagacccgggttgctgtgtggggggttggtattctgctcatggctgagtgctgactgctggtttccgcatatcagcagccagggcct

SEQ ID NO: 365517 - DNA, 140 bp, Artificial Sequence
  Synthetic
atacgccatgctgggtctcccgcaatcgatccttctaatgagtgctgctcctacagctgttcaagacatacatcccagcccaacaaacaggtctaagaggaaccttgagacggaaataatcgtacttgggagtcggccat

SEQ ID NO: 365518 - DNA, 140 bp, Artificial Sequence
  Synthetic
atggccgactcccaagtacgattatttccgtctcaaggttcctcttagacctgtttgttgggctgggatgtatgtcttgaacagctgtaggagcagcactcattagaaggatcgattgcgggagacccagcatggcgtat

SEQ ID NO: 365519 - DNA, 140 bp, Artificial Sequence
  Synthetic
aggccctggctgctgatatgcatcccagcccaacaaacaggtctaagaggaaccttgagacggaaataattttaactctatctcaaggtctaaagaaatactacggtaagatactgaagcgaccttttgggacagcggtg

SEQ ID NO: 365520 - DNA, 140 bp, Artificial Sequence
  Synthetic
caccgctgtcccaaaaggtcgcttcagtatcttaccgtagtatttctttagaccttgagatagagttaaaattatttccgtctcaaggttcctcttagacctgtttgttgggctgggatgcatatcagcagccagggcct

SEQ ID NO: 365521 - DNA, 140 bp, Artificial Sequence
  Synthetic
aggccctggctgctgatatgaagagaaaccttgggtcaaactgtgatgatgacttctttcaaaagagaatagaagaattcttcatgactggtgagggctacttcaatgaagtcttacaatgaccttttgggacagcggtg

SEQ ID NO: 365522 - DNA, 140 bp, Artificial Sequence
  Synthetic
caccgctgtcccaaaaggtcattgtaagacttcattgaagtagccctcaccagtcatgaagaattcttctattctcttttgaaagaagtcatcatcacagtttgacccaaggtttctcttcatatcagcagccagggcct

SEQ ID NO: 365523 - DNA, 140 bp, Artificial Sequence
  Synthetic
aggccctggctgctgatatgagaagaattcttcatgactggtgagggctacttcaatgaagtcttacaatttaaaacactaagcacactaagccccacggagccgtctcatgccaggctagaccttttgggacagcggtg

SEQ ID NO: 365524 - DNA, 140 bp, Artificial Sequence
  Synthetic
caccgctgtcccaaaaggtctagcctggcatgagacggctccgtggggcttagtgtgcttagtgttttaaattgtaagacttcattgaagtagccctcaccagtcatgaagaattcttctcatatcagcagccagggcct

SEQ ID NO: 365525 - DNA, 140 bp, Artificial Sequence
  Synthetic
aggccctggctgctgatatgggcttcagctgatcaatgttacccaacacccagctaggatagcagaaacacctggacccaagacaacgagtctgaaaaccatcaactgtataaacctaaggaccttttgggacagcggtg

SEQ ID NO: 365526 - DNA, 140 bp, Artificial Sequence
  Synthetic
caccgctgtcccaaaaggtccttaggtttatacagttgatggttttcagactcgttgtcttgggtccaggtgtttctgctatcctagctgggtgttgggtaacattgatcagctgaagcccatatcagcagccagggcct

SEQ ID NO: 365527 - DNA, 140 bp, Artificial Sequence
  Synthetic
atacgccatgctgggtctccagcatcagtcttcaaagaacacagagaaattgagatcaatgtgcttcttcctcagattgcagtcaacctctcaaactgccatgttgtgatcaattcacatcgtacttgggagtcggccat

SEQ ID NO: 365528 - DNA, 140 bp, Artificial Sequence
  Synthetic
atggccgactcccaagtacgatgtgaattgatcacaacatggcagtttgagaggttgactgcaatctgaggaagaagcacattgatctcaatttctctgtgttctttgaagactgatgctggagacccagcatggcgtat

SEQ ID NO: 365529 - DNA, 140 bp, Artificial Sequence
  Synthetic
aggccctggctgctgatatgctcagattgcagtcaacctctcaaactgccatgttgtgatcaattcacatgtctgtgattactctttagacactgatgggccagtgaggcttcctcgcatgaccttttgggacagcggtg

SEQ ID NO: 365530 - DNA, 140 bp, Artificial Sequence
  Synthetic
caccgctgtcccaaaaggtcatgcgaggaagcctcactggcccatcagtgtctaaagagtaatcacagacatgtgaattgatcacaacatggcagtttgagaggttgactgcaatctgagcatatcagcagccagggcct

SEQ ID NO: 365531 - DNA, 140 bp, Artificial Sequence
  Synthetic
aggccctggctgctgatatggtctgtgattactctttagacactgatgggccagtgaggcttcctcgcatttatcatgaagggactttcataccaggaacttataaaatagtgatagacagaccttttgggacagcggtg

SEQ ID NO: 365532 - DNA, 140 bp, Artificial Sequence
  Synthetic
caccgctgtcccaaaaggtctgtctatcactattttataagttcctggtatgaaagtcccttcatgataaatgcgaggaagcctcactggcccatcagtgtctaaagagtaatcacagaccatatcagcagccagggcct

SEQ ID NO: 365533 - DNA, 140 bp, Artificial Sequence
  Synthetic
aggccctggctgctgatatgagaaatcaagataggcaaggcatcaacaggctttaggaaactactgtccgaagagccaggtgatgactgcatatcaagaactcagctattgaggacagaagaccttttgggacagcggtg

SEQ ID NO: 365534 - DNA, 140 bp, Artificial Sequence
  Synthetic
caccgctgtcccaaaaggtcttctgtcctcaatagctgagttcttgatatgcagtcatcacctggctcttcggacagtagtttcctaaagcctgttgatgccttgcctatcttgatttctcatatcagcagccagggcct

SEQ ID NO: 365535 - DNA, 140 bp, Artificial Sequence
  Synthetic
aggccctggctgctgatatgaggtttttgtttaaaaatcacccaagagggaaggggccacgtaaaattatctagaggctcagaggttgtcctggatgcttgcgactcaagctgtgaagtagaccttttgggacagcggtg

SEQ ID NO: 365536 - DNA, 140 bp, Artificial Sequence
  Synthetic
caccgctgtcccaaaaggtctacttcacagcttgagtcgcaagcatccaggacaacctctgagcctctagataattttacgtggccccttccctcttgggtgatttttaaacaaaaacctcatatcagcagccagggcct

SEQ ID NO: 365537 - DNA, 140 bp, Artificial Sequence
  Synthetic
atacgccatgctgggtctccgcaacatttcttaaaagacaacttaattgacctagggtgcccccatatcccgctattgggtaagatggctatttacatttgcagaatgtcaaatcatcctcgtacttgggagtcggccat

SEQ ID NO: 365538 - DNA, 140 bp, Artificial Sequence
  Synthetic
atggccgactcccaagtacgaggatgatttgacattctgcaaatgtaaatagccatcttacccaatagcgggatatgggggcaccctaggtcaattaagttgtcttttaagaaatgttgcggagacccagcatggcgtat

SEQ ID NO: 365539 - DNA, 140 bp, Artificial Sequence
  Synthetic
aggccctggctgctgatatgcgctattgggtaagatggctatttacatttgcagaatgtcaaatcatcctagaacaaccatggcttttctcttctggttcagctttggctatgttatcacgaccttttgggacagcggtg

SEQ ID NO: 365540 - DNA, 140 bp, Artificial Sequence
  Synthetic
caccgctgtcccaaaaggtcgtgataacatagccaaagctgaaccagaagagaaaagccatggttgttctaggatgatttgacattctgcaaatgtaaatagccatcttacccaatagcgcatatcagcagccagggcct

SEQ ID NO: 365541 - DNA, 140 bp, Artificial Sequence
  Synthetic
aggccctggctgctgatatgatatgtgagacagctcctgtcaatgcaatagatgctgaaatgcatgacctcaactgtagttacaatatatgcccttattgtgcatcaagattgacctccggaccttttgggacagcggtg

SEQ ID NO: 365542 - DNA, 140 bp, Artificial Sequence
  Synthetic
caccgctgtcccaaaaggtccggaggtcaatcttgatgcacaataagggcatatattgtaactacagttgaggtcatgcatttcagcatctattgcattgacaggagctgtctcacatatcatatcagcagccagggcct

SEQ ID NO: 365543 - DNA, 140 bp, Artificial Sequence
  Synthetic
atacgccatgctgggtctccgaagagactgaactgtacctgaacctggaaagaattccttggattgtcagaaagctattgcaggtgtcagagtccactggtgtggcattaaaacgaagcacgtacttgggagtcggccat

SEQ ID NO: 365544 - DNA, 140 bp, Artificial Sequence
  Synthetic
atggccgactcccaagtacgtgcttcgttttaatgccacaccagtggactctgacacctgcaatagctttctgacaatccaaggaattctttccaggttcaggtacagttcagtctcttcggagacccagcatggcgtat

SEQ ID NO: 365545 - DNA, 140 bp, Artificial Sequence
  Synthetic
atacgccatgctgggtctcccaatcagcacctgttggtcatggaaagacaatcgaaatatatcagaccagggaaggattcgcaagcatctgtctctttatgttaggaagcattctatttacgtacttgggagtcggccat

SEQ ID NO: 365546 - DNA, 140 bp, Artificial Sequence
  Synthetic
atggccgactcccaagtacgtaaatagaatgcttcctaacataaagagacagatgcttgcgaatccttccctggtctgatatatttcgattgtctttccatgaccaacaggtgctgattgggagacccagcatggcgtat

SEQ ID NO: 365547 - DNA, 140 bp, Artificial Sequence
  Synthetic
aggccctggctgctgatatgggaaggattcgcaagcatctgtctctttatgttaggaagcattctatttatagtctcttgcttggtgaaagggctagttgacagtgtcagtgacagcttcgaccttttgggacagcggtg

SEQ ID NO: 365548 - DNA, 140 bp, Artificial Sequence
  Synthetic
caccgctgtcccaaaaggtcgaagctgtcactgacactgtcaactagccctttcaccaagcaagagactataaatagaatgcttcctaacataaagagacagatgcttgcgaatccttcccatatcagcagccagggcct

SEQ ID NO: 365549 - DNA, 140 bp, Artificial Sequence
  Synthetic
atacgccatgctgggtctccaacttgggagagggaggaagatctgacaaatttctgtcatcaggaatgccaggtaactgagacagaatgcctctgtccatacgaagctcttgtgctcagacgtacttgggagtcggccat

SEQ ID NO: 365550 - DNA, 140 bp, Artificial Sequence
  Synthetic
atggccgactcccaagtacgtctgagcacaagagcttcgtatggacagaggcattctgtctcagttacctggcattcctgatgacagaaatttgtcagatcttcctccctctcccaagttggagacccagcatggcgtat

SEQ ID NO: 365551 - DNA, 140 bp, Artificial Sequence
  Synthetic
atacgccatgctgggtctccctcagttggagctcagtggagcacagaggcaacaagatcttagtcacaggcaggtctgaatcaattatgaaactggaggaaaggacaggagtcagctgggcgtacttgggagtcggccat

SEQ ID NO: 365552 - DNA, 140 bp, Artificial Sequence
  Synthetic
atggccgactcccaagtacgcccagctgactcctgtcctttcctccagtttcataattgattcagacctgcctgtgactaagatcttgttgcctctgtgctccactgagctccaactgagggagacccagcatggcgtat

SEQ ID NO: 365553 - DNA, 140 bp, Artificial Sequence
  Synthetic
aggccctggctgctgatatgatggatttgtcacaaatgtattctcctgtttttgagtacttgtcaggagacagacaggttgaagaatggcccaaagcaacttgtacaggtgattgcccgggaccttttgggacagcggtg

SEQ ID NO: 365554 - DNA, 140 bp, Artificial Sequence
  Synthetic
caccgctgtcccaaaaggtcccgggcaatcacctgtacaagttgctttgggccattcttcaacctgtctgtctcctgacaagtactcaaaaacaggagaatacatttgtgacaaatccatcatatcagcagccagggcct

SEQ ID NO: 365555 - DNA, 140 bp, Artificial Sequence
  Synthetic
atacgccatgctgggtctcctcaagaaactggagatgtaatcccacttggtgctggggagtaggaaccggctgcacctgctgcggggtggatgtaaaagatctttttacagatcacatgtcgtacttgggagtcggccat

SEQ ID NO: 365556 - DNA, 140 bp, Artificial Sequence
  Synthetic
atggccgactcccaagtacgacatgtgatctgtaaaaagatcttttacatccaccccgcagcaggtgcagccggttcctactccccagcaccaagtgggattacatctccagtttcttgaggagacccagcatggcgtat

SEQ ID NO: 365557 - DNA, 140 bp, Artificial Sequence
  Synthetic
atacgccatgctgggtctccggcttctttgacttgatgcatgtacaaaaagtgttgtctgcaagtacagtgtgtaaactgcagagttgcacacatggtataccaggagatctacaagtttcgtacttgggagtcggccat

SEQ ID NO: 365558 - DNA, 140 bp, Artificial Sequence
  Synthetic
atggccgactcccaagtacgaaacttgtagatctcctggtataccatgtgtgcaactctgcagtttacacactgtacttgcagacaacactttttgtacatgcatcaagtcaaagaagccggagacccagcatggcgtat

SEQ ID NO: 365559 - DNA, 140 bp, Artificial Sequence
  Synthetic
aggccctggctgctgatatggtgtaaactgcagagttgcacacatggtataccaggagatctacaagtttaccacattggcaacttgttgaaaggggatagagtaaacgggcatctaattgaccttttgggacagcggtg

SEQ ID NO: 365560 - DNA, 140 bp, Artificial Sequence
  Synthetic
caccgctgtcccaaaaggtcaattagatgcccgtttactctatcccctttcaacaagttgccaatgtggtaaacttgtagatctcctggtataccatgtgtgcaactctgcagtttacaccatatcagcagccagggcct

SEQ ID NO: 365561 - DNA, 140 bp, Artificial Sequence
  Synthetic
atacgccatgctgggtctcctgacttagactactactgcaacatgggggattggccatcttgcacatacacaggagtgacccagcataaccatgctgcatttgtaaacttgcttaacattcgtacttgggagtcggccat

SEQ ID NO: 365562 - DNA, 140 bp, Artificial Sequence
  Synthetic
atggccgactcccaagtacgaatgttaagcaagtttacaaatgcagcatggttatgctgggtcactcctgtgtatgtgcaagatggccaatcccccatgttgcagtagtagtctaagtcaggagacccagcatggcgtat

SEQ ID NO: 365563 - DNA, 140 bp, Artificial Sequence
  Synthetic
atacgccatgctgggtctccacatggtgacacaccacaattagacttaaaagcaaggccgacctacggtgcaggtgagatcactgtgctggttgaggttgctgacatggagttgcatacccgtacttgggagtcggccat

SEQ ID NO: 365564 - DNA, 140 bp, Artificial Sequence
  Synthetic
atggccgactcccaagtacgggtatgcaactccatgtcagcaacctcaaccagcacagtgatctcacctgcaccgtaggtcggccttgcttttaagtctaattgtggtgtgtcaccatgtggagacccagcatggcgtat

SEQ ID NO: 365565 - DNA, 140 bp, Artificial Sequence
  Synthetic
aggccctggctgctgatatgcaggtgagatcactgtgctggttgaggttgctgacatggagttgcataccaagaaagttgaaatatcaggcttgaaatttgcaagtctggcttgcacggggaccttttgggacagcggtg

SEQ ID NO: 365566 - DNA, 140 bp, Artificial Sequence
  Synthetic
caccgctgtcccaaaaggtccccgtgcaagccagacttgcaaatttcaagcctgatatttcaactttcttggtatgcaactccatgtcagcaacctcaaccagcacagtgatctcacctgcatatcagcagccagggcct

SEQ ID NO: 365567 - DNA, 140 bp, Artificial Sequence
  Synthetic
atacgccatgctgggtctccatgaaccagatgagctcacagtacatgtaaagagcagtgatccagatgtggttgcagctagcacaagtctcatggcgaggaagcttgaatttgggacagacgtacttgggagtcggccat

SEQ ID NO: 365568 - DNA, 140 bp, Artificial Sequence
  Synthetic
atggccgactcccaagtacgtctgtcccaaattcaagcttcctcgccatgagacttgtgctagctgcaaccacatctggatcactgctctttacatgtactgtgagctcatctggttcatggagacccagcatggcgtat

SEQ ID NO: 365569 - DNA, 140 bp, Artificial Sequence
  Synthetic
aggccctggctgctgatatggttgcagctagcacaagtctcatggcgaggaagcttgaatttgggacagacagcacattcaaggccttttcagctatgcccaaaacctctttatgtttttgaccttttgggacagcggtg

SEQ ID NO: 365570 - DNA, 140 bp, Artificial Sequence
  Synthetic
caccgctgtcccaaaaggtcaaaaacataaagaggttttgggcatagctgaaaaggccttgaatgtgctgtctgtcccaaattcaagcttcctcgccatgagacttgtgctagctgcaaccatatcagcagccagggcct

SEQ ID NO: 365571 - DNA, 140 bp, Artificial Sequence
  Synthetic
atacgccatgctgggtctcccagcacattcaaggccttttcagctatgcccaaaacctctttatgtttttacattgtggagagagaatactgcaagagctgcagtgaagatgatacacaacgtacttgggagtcggccat

SEQ ID NO: 365572 - DNA, 140 bp, Artificial Sequence
  Synthetic
atggccgactcccaagtacgttgtgtatcatcttcactgcagctcttgcagtattctctctccacaatgtaaaaacataaagaggttttgggcatagctgaaaaggccttgaatgtgctgggagacccagcatggcgtat

SEQ ID NO: 365573 - DNA, 140 bp, Artificial Sequence
  Synthetic
atacgccatgctgggtctccaaaacacaacgatgggaacttaaaggacaggagtgatgacgaccaaaaactagcagagaagatagacattgttaggaaagagctttcagaagccaagctacgtacttgggagtcggccat

SEQ ID NO: 365574 - DNA, 140 bp, Artificial Sequence
  Synthetic
atggccgactcccaagtacgtagcttggcttctgaaagctctttcctaacaatgtctatcttctctgctagtttttggtcgtcatcactcctgtcctttaagttcccatcgttgtgttttggagacccagcatggcgtat

SEQ ID NO: 365575 - DNA, 140 bp, Artificial Sequence
  Synthetic
aggccctggctgctgatatgtttgctttaaatgttgcaggaggaccagaggcttatttaagtatagacacctcaaagacgatgaggaaacaggctacagaaggattattgaaagactgaagaccttttgggacagcggtg

SEQ ID NO: 365576 - DNA, 140 bp, Artificial Sequence
  Synthetic
caccgctgtcccaaaaggtcttcagtctttcaataatccttctgtagcctgtttcctcatcgtctttgaggtgtctatacttaaataagcctctggtcctcctgcaacatttaaagcaaacatatcagcagccagggcct

SEQ ID NO: 365577 - DNA, 140 bp, Artificial Sequence
  Synthetic
atacgccatgctgggtctccctcaaagacgatgaggaaacaggctacagaaggattattgaaagactgaacagcaaaaaagggaaaaacaggctgcttgatggtgatagactggctgatacgtacttgggagtcggccat

SEQ ID NO: 365578 - DNA, 140 bp, Artificial Sequence
  Synthetic
atggccgactcccaagtacgtatcagccagtctatcaccatcaagcagcctgtttttcccttttttgctgttcagtctttcaataatccttctgtagcctgtttcctcatcgtctttgagggagacccagcatggcgtat

SEQ ID NO: 365579 - DNA, 140 bp, Artificial Sequence
  Synthetic
atacgccatgctgggtctccagaaagaacctcgaaggttgacagcagtatgctgtctagtgtccttgcttgtgctagcttcgttaatcgcatccataatttacagacactgcaacacactcgtacttgggagtcggccat

SEQ ID NO: 365580 - DNA, 140 bp, Artificial Sequence
  Synthetic
atggccgactcccaagtacgagtgtgttgcagtgtctgtaaattatggatgcgattaacgaagctagcacaagcaaggacactagacagcatactgctgtcaaccttcgaggttctttctggagacccagcatggcgtat

SEQ ID NO: 365581 - DNA, 140 bp, Artificial Sequence
  Synthetic
aggccctggctgctgatatgttagttcagcagtagccctggaggatgctgaagttattgctagagcagctcaaacacttcacatgaatagtgtatcaattcaatcaagcagtctgaccacgaccttttgggacagcggtg

SEQ ID NO: 365582 - DNA, 140 bp, Artificial Sequence
  Synthetic
caccgctgtcccaaaaggtcgtggtcagactgcttgattgaattgatacactattcatgtgaagtgtttgagctgctctagcaataacttcagcatcctccagggctactgctgaactaacatatcagcagccagggcct

SEQ ID NO: 365583 - DNA, 140 bp, Artificial Sequence
  Synthetic
atacgccatgctgggtctcctcacctaatctgcctcattatatccacaaataagctctgtgatgcttgaaactgccctagctctgcttgctctaaccttaactttgactgcgtgccgccacgtacttgggagtcggccat

SEQ ID NO: 365584 - DNA, 140 bp, Artificial Sequence
  Synthetic
atggccgactcccaagtacgtggcggcacgcagtcaaagttaaggttagagcaagcagagctagggcagtttcaagcatcacagagcttatttgtggatataatgaggcagattaggtgaggagacccagcatggcgtat

SEQ ID NO: 365585 - DNA, 140 bp, Artificial Sequence
  Synthetic
aggccctggctgctgatatgtctcaaagatatcaatcccccctttacccacgttgacacagtcagctccagtggtggctttttgtctctgtggcaccatggacttcttgaggaaccttgagaccttttgggacagcggtg

SEQ ID NO: 365586 - DNA, 140 bp, Artificial Sequence
  Synthetic
caccgctgtcccaaaaggtctcaaggttcctcaagaagtccatggtgccacagagacaaaaagccaccactggagctgactgtgtcaacgtgggtaaaggggggattgatatctttgagacatatcagcagccagggcct

SEQ ID NO: 365587 - DNA, 140 bp, Artificial Sequence
  Synthetic
aggccctggctgctgatatgtcataacatcaagcatctgaccgagttggcagcacggaagtattaccaagaggagcctgaggctaagcttgttggcttaagtttggaagattaccttaaggaccttttgggacagcggtg

SEQ ID NO: 365588 - DNA, 140 bp, Artificial Sequence
  Synthetic
caccgctgtcccaaaaggtccttaaggtaatcttccaaacttaagccaacaagcttagcctcaggctcctcttggtaatacttccgtgctgccaactcggtcagatgcttgatgttatgacatatcagcagccagggcct

SEQ ID NO: 365589 - DNA, 140 bp, Artificial Sequence
  Synthetic
atacgccatgctgggtctccaggagcctgaggctaagcttgttggcttaagtttggaagattaccttaagaggatgctgtctgacaacgagtggggatcaactcttgaggcatccatgctcgtacttgggagtcggccat

SEQ ID NO: 365590 - DNA, 140 bp, Artificial Sequence
  Synthetic
atggccgactcccaagtacgagcatggatgcctcaagagttgatccccactcgttgtcagacagcatcctcttaaggtaatcttccaaacttaagccaacaagcttagcctcaggctcctggagacccagcatggcgtat

SEQ ID NO: 365591 - DNA, 140 bp, Artificial Sequence
  Synthetic
atacgccatgctgggtctcctgacatttacaatgtgcatatatataataaagaaatggacaattttgatgaaggatgtatcagcgtcttggaagaaacagcagaaaggcatatgctctggcgtacttgggagtcggccat

SEQ ID NO: 365592 - DNA, 140 bp, Artificial Sequence
  Synthetic
atggccgactcccaagtacgccagagcatatgcctttctgctgtttcttccaagacgctgatacatccttcatcaaaattgtccatttctttattatatatatgcacattgtaaatgtcaggagacccagcatggcgtat

SEQ ID NO: 365593 - DNA, 140 bp, Artificial Sequence
  Synthetic
atacgccatgctgggtctcctatgaagatcttgctttagcactcacaagtgcggaagaaccgtataggcggtcaagcttggatgaagtcactctgtccaggaaacaagcagaaatattgacgtacttgggagtcggccat

SEQ ID NO: 365594 - DNA, 140 bp, Artificial Sequence
  Synthetic
atggccgactcccaagtacgtcaatatttctgcttgtttcctggacagagtgacttcatccaagcttgaccgcctatacggttcttccgcacttgtgagtgctaaagcaagatcttcataggagacccagcatggcgtat

SEQ ID NO: 365595 - DNA, 140 bp, Artificial Sequence
  Synthetic
aggccctggctgctgatatgccgactagagttggcagggtcttagactgcatgtttaactgcaaactatgtgttgagatatcagctgacaccttaattctaaggccagaatccaaagagagaccttttgggacagcggtg

SEQ ID NO: 365596 - DNA, 140 bp, Artificial Sequence
  Synthetic
caccgctgtcccaaaaggtctctctttggattctggccttagaattaaggtgtcagctgatatctcaacacatagtttgcagttaaacatgcagtctaagaccctgccaactctagtcggcatatcagcagccagggcct

SEQ ID NO: 365597 - DNA, 140 bp, Artificial Sequence
  Synthetic
aggccctggctgctgatatggaattggtgaagtcatgtcattgcgacagctagggcacaaactgctgacacgagataaacaaattaagcaagaattctctagaatgaaactttatgtcacgaccttttgggacagcggtg

SEQ ID NO: 365598 - DNA, 140 bp, Artificial Sequence
  Synthetic
caccgctgtcccaaaaggtcgtgacataaagtttcattctagagaattcttgcttaatttgtttatctcgtgtcagcagtttgtgccctagctgtcgcaatgacatgacttcaccaattccatatcagcagccagggcct

SEQ ID NO: 365599 - DNA, 140 bp, Artificial Sequence
  Synthetic
atacgccatgctgggtctcctagtgccttatttgggaagcagataaacaagcttcagaattgctttagaaccataagccctgttagcttacttgcattaagaaatctggactttgactgtcgtacttgggagtcggccat

SEQ ID NO: 365600 - DNA, 140 bp, Artificial Sequence
  Synthetic
atggccgactcccaagtacgacagtcaaagtccagatttcttaatgcaagtaagctaacagggcttatggttctaaagcaattctgaagcttgtttatctgcttcccaaataaggcactaggagacccagcatggcgtat

SEQ ID NO: 365601 - DNA, 140 bp, Artificial Sequence
  Synthetic
aggccctggctgctgatatgtaacactgatgttgaattcaaccacagggaaatagctgacctcaatcaattaacatctcggctcattacattaaggaaagagaaagacactgacctcctcgaccttttgggacagcggtg

SEQ ID NO: 365602 - DNA, 140 bp, Artificial Sequence
  Synthetic
caccgctgtcccaaaaggtcgaggaggtcagtgtctttctctttccttaatgtaatgagccgagatgttaattgattgaggtcagctatttccctgtggttgaattcaacatcagtgttacatatcagcagccagggcct

SEQ ID NO: 365603 - DNA, 140 bp, Artificial Sequence
  Synthetic
atacgccatgctgggtctccttatgaaattcatcagcacctcaggaagggcaatgagtgcaggcaagattggtaatgtcctttcctatgcacataacctttacttgagtaaatctagtttcgtacttgggagtcggccat

SEQ ID NO: 365604 - DNA, 140 bp, Artificial Sequence
  Synthetic
atggccgactcccaagtacgaaactagatttactcaagtaaaggttatgtgcataggaaaggacattaccaatcttgcctgcactcattgcccttcctgaggtgctgatgaatttcataaggagacccagcatggcgtat

SEQ ID NO: 365605 - DNA, 140 bp, Artificial Sequence
  Synthetic
atacgccatgctgggtctccgatggcatagaaagcaatatgaaacaactttttgctatactgcctcctgactgtgcaagagaatgtgaagtcctctttgatgacataagaaactctccaacgtacttgggagtcggccat

SEQ ID NO: 365606 - DNA, 140 bp, Artificial Sequence
  Synthetic
atggccgactcccaagtacgttggagagtttcttatgtcatcaaagaggacttcacattctcttgcacagtcaggaggcagtatagcaaaaagttgtttcatattgctttctatgccatcggagacccagcatggcgtat

SEQ ID NO: 365607 - DNA, 140 bp, Artificial Sequence
  Synthetic
aggccctggctgctgatatgcagtgttgaaaatgtgcaaatctcaattgatgtaacactgcctgaatctgtggaggcggtaccggtgacagaaagaaaaatgttccctctgcctgaaactgaccttttgggacagcggtg

SEQ ID NO: 365608 - DNA, 140 bp, Artificial Sequence
  Synthetic
caccgctgtcccaaaaggtcagtttcaggcagagggaacatttttctttctgtcaccggtaccgcctccacagattcaggcagtgttacatcaattgagatttgcacattttcaacactgcatatcagcagccagggcct

SEQ ID NO: 365609 - DNA, 140 bp, Artificial Sequence
  Synthetic
aggccctggctgctgatatgccttatgcatggaggaaaactttcaaccaaggaaaaggaaggagatcttgtggaacaaggcaaccagcagagcgccgttgaacacgagagcccaagcatcgaccttttgggacagcggtg

SEQ ID NO: 365610 - DNA, 140 bp, Artificial Sequence
  Synthetic
caccgctgtcccaaaaggtcgatgcttgggctctcgtgttcaacggcgctctgctggttgccttgttccacaagatctccttccttttccttggttgaaagttttcctccatgcataaggcatatcagcagccagggcct

SEQ ID NO: 365611 - DNA, 140 bp, Artificial Sequence
  Synthetic
atacgccatgctgggtctcctggaacaaggcaaccagcagagcgccgttgaacacgagagcccaagcatctcggccttcaaggactatggagagagaggaatagttgaggagaaccacatcgtacttgggagtcggccat

SEQ ID NO: 365612 - DNA, 140 bp, Artificial Sequence
  Synthetic
atggccgactcccaagtacgatgtggttctcctcaactattcctctctctccatagtccttgaaggccgagatgcttgggctctcgtgttcaacggcgctctgctggttgccttgttccaggagacccagcatggcgtat

SEQ ID NO: 365613 - DNA, 140 bp, Artificial Sequence
  Synthetic
atacgccatgctgggtctccgggactcagattgaatatgccgcttataagccattaatacctttcggcgtcccaaggacaaatgaggcagttttagctgcaccgttcattgacattaaagcgtacttgggagtcggccat

SEQ ID NO: 365614 - DNA, 140 bp, Artificial Sequence
  Synthetic
atggccgactcccaagtacgctttaatgtcaatgaacggtgcagctaaaactgcctcatttgtccttgggacgccgaaaggtattaatggcttataagcggcatattcaatctgagtcccggagacccagcatggcgtat

SEQ ID NO: 365615 - DNA, 140 bp, Artificial Sequence
  Synthetic
aggccctggctgctgatatgaaagagcacatactcaataggccaacaggattaacactgcctgccagtttggaacaggctatgcgcaaaggactggttgaaggtgtggtcatctctaagggaccttttgggacagcggtg

SEQ ID NO: 365616 - DNA, 140 bp, Artificial Sequence
  Synthetic
caccgctgtcccaaaaggtcccttagagatgaccacaccttcaaccagtcctttgcgcatagcctgttccaaactggcaggcagtgttaatcctgttggcctattgagtatgtgctctttcatatcagcagccagggcct

SEQ ID NO: 365617 - DNA, 140 bp, Artificial Sequence
  Synthetic
atacgccatgctgggtctccggaacaggctatgcgcaaaggactggttgaaggtgtggtcatctctaaggaaggttctgaatcatgcattaacatgttgaaagaaaatttggaccgaatacgtacttgggagtcggccat

SEQ ID NO: 365618 - DNA, 140 bp, Artificial Sequence
  Synthetic
atggccgactcccaagtacgtattcggtccaaattttctttcaacatgttaatgcatgattcagaaccttccttagagatgaccacaccttcaaccagtcctttgcgcatagcctgttccggagacccagcatggcgtat

SEQ ID NO: 365619 - DNA, 140 bp, Artificial Sequence
  Synthetic
aggccctggctgctgatatgtaccactggtgaaaagatgctgctgagctggttgagtgaagatatcaaatcatcgagatgtactgagtgcctcaccaacataaagaaaaccgttgacgaggaccttttgggacagcggtg

SEQ ID NO: 365620 - DNA, 140 bp, Artificial Sequence
  Synthetic
caccgctgtcccaaaaggtcctcgtcaacggttttctttatgttggtgaggcactcagtacatctcgatgatttgatatcttcactcaaccagctcagcagcatcttttcaccagtggtacatatcagcagccagggcct

SEQ ID NO: 365621 - DNA, 140 bp, Artificial Sequence
  Synthetic
aggccctggctgctgatatgactgccaacctatctgagaagattgagctacttgcatacaaccttcaactcgttagtcactgcagcaactgtcaccccaatggtgtgaacattagcaatagaccttttgggacagcggtg

SEQ ID NO: 365622 - DNA, 140 bp, Artificial Sequence
  Synthetic
caccgctgtcccaaaaggtctattgctaatgttcacaccattggggtgacagttgctgcagtgactaacgagttgaaggttgtatgcaagtagctcaatcttctcagataggttggcagtcatatcagcagccagggcct

SEQ ID NO: 365623 - DNA, 140 bp, Artificial Sequence
  Synthetic
aggccctggctgctgatatgaacgcaatgtggaataccttataaaactgatgatgagcatgtcaggcattgattgcataaaatatcccacaggacagctcatcacccatggaagagtgaggaccttttgggacagcggtg

SEQ ID NO: 365624 - DNA, 140 bp, Artificial Sequence
  Synthetic
caccgctgtcccaaaaggtcctcactcttccatgggtgatgagctgtcctgtgggatattttatgcaatcaatgcctgacatgctcatcatcagttttataaggtattccacattgcgttcatatcagcagccagggcct

SEQ ID NO: 365625 - DNA, 140 bp, Artificial Sequence
  Synthetic
aggccctggctgctgatatgtgcaaaacataacgagggaactttgaaagataggagtgatgacgatcaaagactagccgagaagatagacactgtcaggaaagagctttcagaatccaaagaccttttgggacagcggtg

SEQ ID NO: 365626 - DNA, 140 bp, Artificial Sequence
  Synthetic
caccgctgtcccaaaaggtctttggattctgaaagctctttcctgacagtgtctatcttctcggctagtctttgatcgtcatcactcctatctttcaaagttccctcgttatgttttgcacatatcagcagccagggcct

SEQ ID NO: 365627 - DNA, 140 bp, Artificial Sequence
  Synthetic
aggccctggctgctgatatggttgactgtatactgtttaaagaagtggcagctgagtgcatgaagaggtacattggcacaccttatgaaggaattatcgacaccttagtttctctgattagaccttttgggacagcggtg

SEQ ID NO: 365628 - DNA, 140 bp, Artificial Sequence
  Synthetic
caccgctgtcccaaaaggtctaatcagagaaactaaggtgtcgataattccttcataaggtgtgccaatgtacctcttcatgcactcagctgccacttctttaaacagtatacagtcaaccatatcagcagccagggcct

SEQ ID NO: 365629 - DNA, 140 bp, Artificial Sequence
  Synthetic
aggccctggctgctgatatgtaaactagttaagataaggcactgtgacattaacctatcagtcaaactaccatcgaacaaaaaagagaatatgttgtgttgtatatacagtggcaacatggaccttttgggacagcggtg

SEQ ID NO: 365630 - DNA, 140 bp, Artificial Sequence
  Synthetic
caccgctgtcccaaaaggtccatgttgccactgtatatacaacacaacatattctcttttttgttcgatggtagtttgactgataggttaatgtcacagtgccttatcttaactagtttacatatcagcagccagggcct

SEQ ID NO: 365631 - DNA, 140 bp, Artificial Sequence
  Synthetic
atacgccatgctgggtctcccatcgaacaaaaaagagaatatgttgtgttgtatatacagtggcaacatggagctcttacaaggacctttctatttgaacaggagacaggctgtccttggcgtacttgggagtcggccat

SEQ ID NO: 365632 - DNA, 140 bp, Artificial Sequence
  Synthetic
atggccgactcccaagtacgccaaggacagcctgtctcctgttcaaatagaaaggtccttgtaagagctccatgttgccactgtatatacaacacaacatattctcttttttgttcgatgggagacccagcatggcgtat

SEQ ID NO: 365633 - DNA, 140 bp, Artificial Sequence
  Synthetic
aggccctggctgctgatatgagtacaggtgtctagaagttataaacagtgtaaatgaaaagacactgcaagacattgaaaatcactccatgactttgctagaagatgcgttcaaggaactgaccttttgggacagcggtg

SEQ ID NO: 365634 - DNA, 140 bp, Artificial Sequence
  Synthetic
caccgctgtcccaaaaggtcagttccttgaacgcatcttctagcaaagtcatggagtgattttcaatgtcttgcagtgtcttttcatttacactgtttataacttctagacacctgtactcatatcagcagccagggcct

SEQ ID NO: 365635 - DNA, 140 bp, Artificial Sequence
  Synthetic
aggccctggctgctgatatgataccggagttacccaacacaatcatgcttcatttgtaaacctgctcaacattgaaactgactatacaaaaagcttccactttcactctaaaagggttacgaccttttgggacagcggtg

SEQ ID NO: 365636 - DNA, 140 bp, Artificial Sequence
  Synthetic
caccgctgtcccaaaaggtcgtaacccttttagagtgaaagtggaagctttttgtatagtcagtttcaatgttgagcaggtttacaaatgaagcatgattgtgttgggtaactccggtatcatatcagcagccagggcct

SEQ ID NO: 365637 - DNA, 140 bp, Artificial Sequence
  Synthetic
aggccctggctgctgatatgcaaggtgtaaagctagtgggaacttcttaaacagaagcagtagagaccactttataagcattgtctcaggcttaaacctggtttatggcttcctcataaagaccttttgggacagcggtg

SEQ ID NO: 365638 - DNA, 140 bp, Artificial Sequence
  Synthetic
caccgctgtcccaaaaggtctttatgaggaagccataaaccaggtttaagcctgagacaatgcttataaagtggtctctactgcttctgtttaagaagttcccactagctttacaccttgcatatcagcagccagggcct

SEQ ID NO: 365639 - DNA, 140 bp, Artificial Sequence
  Synthetic
atacgccatgctgggtctccaaaacttgaacatccacaaagcatacttattgaacacaaaggaacgattattggcaagcaaaatgacacctgtccaactaaaacaagctgctggttggaacgtacttgggagtcggccat

SEQ ID NO: 365640 - DNA, 140 bp, Artificial Sequence
  Synthetic
atggccgactcccaagtacgttccaaccagcagcttgttttagttggacaggtgtcattttgcttgccaataatcgttcctttgtgttcaataagtatgctttgtggatgttcaagttttggagacccagcatggcgtat

SEQ ID NO: 365641 - DNA, 140 bp, Artificial Sequence
  Synthetic
aggccctggctgctgatatgcagtgtgagcgacactactgctgcttcccatgactcaggatcgtcatcctcaagcttctcttttgagctcaataggcctctgtctgaaactgaactacaggaccttttgggacagcggtg

SEQ ID NO: 365642 - DNA, 140 bp, Artificial Sequence
  Synthetic
caccgctgtcccaaaaggtcctgtagttcagtttcagacagaggcctattgagctcaaaagagaagcttgaggatgacgatcctgagtcatgggaagcagcagtagtgtcgctcacactgcatatcagcagccagggcct

SEQ ID NO: 365643 - DNA, 140 bp, Artificial Sequence
  Synthetic
aggccctggctgctgatatgctttgacatttacaatgtgcatatatacaataaagaaatggataattttgacgaaggatgtatcagcgtcttagaagaaacagcagaaagacatatgcttgaccttttgggacagcggtg

SEQ ID NO: 365644 - DNA, 140 bp, Artificial Sequence
  Synthetic
caccgctgtcccaaaaggtcaagcatatgtctttctgctgtttcttctaagacgctgatacatccttcgtcaaaattatccatttctttattgtatatatgcacattgtaaatgtcaaagcatatcagcagccagggcct

SEQ ID NO: 365645 - DNA, 140 bp, Artificial Sequence
  Synthetic
aggccctggctgctgatatgcagaaccgcaaggttattactaggttgcccaaatgtgagaaaagctgcaaacaaagaagggaaaaagctattaaagtcaaacagcgatacatcaactgacgaccttttgggacagcggtg

SEQ ID NO: 365646 - DNA, 140 bp, Artificial Sequence
  Synthetic
caccgctgtcccaaaaggtcgtcagttgatgtatcgctgtttgactttaatagctttttcccttctttgtttgcagcttttctcacatttgggcaacctagtaataaccttgcggttctgcatatcagcagccagggcct

SEQ ID NO: 365647 - DNA, 140 bp, Artificial Sequence
  Synthetic
atacgccatgctgggtctccacaaagaagggaaaaagctattaaagtcaaacagcgatacatcaactgacacacaaagcatcacttccgaggtgtcagacagaaggtcctatagctcaagcgtacttgggagtcggccat

SEQ ID NO: 365648 - DNA, 140 bp, Artificial Sequence
  Synthetic
atggccgactcccaagtacgcttgagctataggaccttctgtctgacacctcggaagtgatgctttgtgtgtcagttgatgtatcgctgtttgactttaatagctttttcccttctttgtggagacccagcatggcgtat

SEQ ID NO: 365649 - DNA, 140 bp, Artificial Sequence
  Synthetic
aggccctggctgctgatatgcaagagtagaatccgtagtatttttggtagatacaactcccagaaaaaaccgtttgaattaaggtcaggccttgaagtcttcaatgaccctttcaatgatgaccttttgggacagcggtg

SEQ ID NO: 365650 - DNA, 140 bp, Artificial Sequence
  Synthetic
caccgctgtcccaaaaggtcatcattgaaagggtcattgaagacttcaaggcctgaccttaattcaaacggttttttctgggagttgtatctaccaaaaatactacggattctactcttgcatatcagcagccagggcct

SEQ ID NO: 365651 - DNA, 140 bp, Artificial Sequence
  Synthetic
atacgccatgctgggtctccccaatgcaacctctttaattcttctactattccgccgttcttccttctctatcattcatttcagtttcactatttctagggtgtggggggaacgatttctcgtacttgggagtcggccat

SEQ ID NO: 365652 - DNA, 140 bp, Artificial Sequence
  Synthetic
atggccgactcccaagtacgagaaatcgttccccccacaccctagaaatagtgaaactgaaatgaatgatagagaaggaagaacggcggaatagtagaagaattaaagaggttgcattggggagacccagcatggcgtat

SEQ ID NO: 365653 - DNA, 140 bp, Artificial Sequence
  Synthetic
aggccctggctgctgatatgcaaagagagcattttgaaggactgtcttcaaatcatacggaagaaccctagccacacaatgggttcttttgagctgatccaggcaatctcagagtttggtgaccttttgggacagcggtg

SEQ ID NO: 365654 - DNA, 140 bp, Artificial Sequence
  Synthetic
caccgctgtcccaaaaggtcaccaaactctgagattgcctggatcagctcaaaagaacccattgtgtggctagggttcttccgtatgatttgaagacagtccttcaaaatgctctctttgcatatcagcagccagggcct

SEQ ID NO: 365655 - DNA, 140 bp, Artificial Sequence
  Synthetic
atacgccatgctgggtctccgccacacaatgggttcttttgagctgatccaggcaatctcagagtttggtatgagcaaatttcctcccgagaatatagacaaggcaaggagagacccgaacgtacttgggagtcggccat

SEQ ID NO: 365656 - DNA, 140 bp, Artificial Sequence
  Synthetic
atggccgactcccaagtacgttcgggtctctccttgccttgtctatattctcgggaggaaatttgctcataccaaactctgagattgcctggatcagctcaaaagaacccattgtgtggcggagacccagcatggcgtat

SEQ ID NO: 365657 - DNA, 140 bp, Artificial Sequence
  Synthetic
aggccctggctgctgatatgcacctaaaactcatatgatgctcaaagactgctttaaaattatactaggtactgagaataagaagatagttaagatgcttagagggaagctaaaaaaactgaccttttgggacagcggtg

SEQ ID NO: 365658 - DNA, 140 bp, Artificial Sequence
  Synthetic
caccgctgtcccaaaaggtcagtttttttagcttccctctaagcatcttaactatcttcttattctcagtacctagtataattttaaagcagtctttgagcatcatatgagttttaggtgcatatcagcagccagggcct

SEQ ID NO: 365659 - DNA, 140 bp, Artificial Sequence
  Synthetic
aggccctggctgctgatatgcctagaactcatatgatgctcaaggattgttttaaaattatactaggtactgagaataagaagatagtcaaaatgcttcgagggaagctaaaaaaactcggaccttttgggacagcggtg

SEQ ID NO: 365660 - DNA, 140 bp, Artificial Sequence
  Synthetic
caccgctgtcccaaaaggtccgagtttttttagcttccctcgaagcattttgactatcttcttattctcagtacctagtataattttaaaacaatccttgagcatcatatgagttctaggcatatcagcagccagggcct

SEQ ID NO: 365661 - DNA, 140 bp, Artificial Sequence
  Synthetic
atacgccatgctgggtctccgttaaagaaatgctgtcagacatgattagaaggaggaatctaattctcaacaggggcggtgatgaaaatccacgcggcccagtgagccgtgaacatgtggcgtacttgggagtcggccat

SEQ ID NO: 365662 - DNA, 140 bp, Artificial Sequence
  Synthetic
atggccgactcccaagtacgccacatgttcacggctcactgggccgcgtggattttcatcaccgcccctgttgagaattagattcctccttctaatcatgtctgacagcatttctttaacggagacccagcatggcgtat

SEQ ID NO: 365663 - DNA, 140 bp, Artificial Sequence
  Synthetic
aggccctggctgctgatatgtacttagcacggtagatggtctgacagaccaacagaaagaaaacattgtgaacgggatatttgagccctcaaagctgtccttctatcactggaaagaattgaccttttgggacagcggtg

SEQ ID NO: 365664 - DNA, 140 bp, Artificial Sequence
  Synthetic
caccgctgtcccaaaaggtcaattctttccagtgatagaaggacagctttgagggctcaaatatcccgttcacaatgttttctttctgttggtctgtcagaccatctaccgtgctaagtacatatcagcagccagggcct

SEQ ID NO: 365665 - DNA, 140 bp, Artificial Sequence
  Synthetic
aggccctggctgctgatatgtcttctgctggctaaaaacaatctcttcttcagtcaaaggaagcttaaagaagaaactcaagttcatgaatgtacattccccggaactgatgccagagaagaccttttgggacagcggtg

SEQ ID NO: 365666 - DNA, 140 bp, Artificial Sequence
  Synthetic
caccgctgtcccaaaaggtcttctctggcatcagttccggggaatgtacattcatgaacttgagtttcttctttaagcttcctttgactgaagaagagattgtttttagccagcagaagacatatcagcagccagggcct

SEQ ID NO: 365667 - DNA, 140 bp, Artificial Sequence
  Synthetic
aggccctggctgctgatatgactgatagggaagcagaagccctcagaacagggaatctcggctttaactgggattcagattgaacatgccacttatgagccattaatacccatcggtgtcgaccttttgggacagcggtg

SEQ ID NO: 365668 - DNA, 140 bp, Artificial Sequence
  Synthetic
caccgctgtcccaaaaggtcgacaccgatgggtattaatggctcataagtggcatgttcaatctgaatcccagttaaagccgagattccctgttctgagggcttctgcttccctatcagtcatatcagcagccagggcct

SEQ ID NO: 365669 - DNA, 140 bp, Artificial Sequence
  Synthetic
atacgccatgctgggtctccttctactcaacgagcaacaagatgaacaggagctgaaacaggaccttttgatatcttcttggattaagtgcataacagcctgcaaagattttgcaagcatcgtacttgggagtcggccat

SEQ ID NO: 365670 - DNA, 140 bp, Artificial Sequence
  Synthetic
atggccgactcccaagtacgatgcttgcaaaatctttgcaggctgttatgcacttaatccaagaagatatcaaaaggtcctgtttcagctcctgttcatcttgttgctcgttgagtagaaggagacccagcatggcgtat

SEQ ID NO: 365671 - DNA, 140 bp, Artificial Sequence
  Synthetic
aggccctggctgctgatatgacataaggctgcagcacctggaactgtcaaagcttaaacaagagcaccctagtgttagcttcactaaggaagaggtcttaataaagcggctagaaaaaaagaccttttgggacagcggtg

SEQ ID NO: 365672 - DNA, 140 bp, Artificial Sequence
  Synthetic
caccgctgtcccaaaaggtctttttttctagccgctttattaagacctcttccttagtgaagctaacactagggtgctcttgtttaagctttgacagttccaggtgctgcagccttatgtcatatcagcagccagggcct

SEQ ID NO: 365673 - DNA, 140 bp, Artificial Sequence
  Synthetic
atacgccatgctgggtctccagtgttagcttcactaaggaagaggtcttaataaagcggctagaaaaaaacttcctaaagcagcacaatctggaaattatggagacagtaaaccttatatcgtacttgggagtcggccat

SEQ ID NO: 365674 - DNA, 140 bp, Artificial Sequence
  Synthetic
atggccgactcccaagtacgatataaggtttactgtctccataatttccagattgtgctgctttaggaagtttttttctagccgctttattaagacctcttccttagtgaagctaacactggagacccagcatggcgtat

SEQ ID NO: 365675 - DNA, 140 bp, Artificial Sequence
  Synthetic
aggccctggctgctgatatggtcagaaagaacattgatgaagtactacttactgaggatgggaatctgatcttctgctggctgaaaacaatctcctcttcggtcaaaggaagcttaaagagaccttttgggacagcggtg

SEQ ID NO: 365676 - DNA, 140 bp, Artificial Sequence
  Synthetic
caccgctgtcccaaaaggtctctttaagcttcctttgaccgaagaggagattgttttcagccagcagaagatcagattcccatcctcagtaagtagtacttcatcaatgttctttctgaccatatcagcagccagggcct

SEQ ID NO: 365677 - DNA, 140 bp, Artificial Sequence
  Synthetic
aggccctggctgctgatatgtcttatctagtgagacatccagagatacttgactgtggatctaaagaggactgtaggcttactttgcttgatctgtcagtttctaagctcttagtttgttgaccttttgggacagcggtg

SEQ ID NO: 365678 - DNA, 140 bp, Artificial Sequence
  Synthetic
caccgctgtcccaaaaggtcaacaaactaagagcttagaaactgacagatcaagcaaagtaagcctacagtcctctttagatccacagtcaagtatctctggatgtctcactagataagacatatcagcagccagggcct

SEQ ID NO: 365679 - DNA, 140 bp, Artificial Sequence
  Synthetic
aggccctggctgctgatatggggtttttagtaaagtatgctgttaccttattcacatccaatggtgaacctttttcgcttagtctaaatgatgggggtttagatctcgacctgcataagagaccttttgggacagcggtg

SEQ ID NO: 365680 - DNA, 140 bp, Artificial Sequence
  Synthetic
caccgctgtcccaaaaggtctcttatgcaggtcgagatctaaacccccatcatttagactaagcgaaaaaggttcaccattggatgtgaataaggtaacagcatactttactaaaaaccccatatcagcagccagggcct

SEQ ID NO: 365681 - DNA, 140 bp, Artificial Sequence
  Synthetic
aggccctggctgctgatatgctactgacgaaaagctactacatcagacaaagatagtttttgctaaaattggtctgtctgggaatagttatgacttcatctggactactcaaatgatagcgaccttttgggacagcggtg

SEQ ID NO: 365682 - DNA, 140 bp, Artificial Sequence
  Synthetic
caccgctgtcccaaaaggtcgctatcatttgagtagtccagatgaagtcataactattcccagacagaccaattttagcaaaaactatctttgtctgatgtagtagcttttcgtcagtagcatatcagcagccagggcct

SEQ ID NO: 365683 - DNA, 140 bp, Artificial Sequence
  Synthetic
atacgccatgctgggtctcccatccatcatggaggaaccttcattccaggaacttacaagatagtgatagacaaaaaaaacaagctgaatgacagatgtaccctatacaccaactgtgtgcgtacttgggagtcggccat

SEQ ID NO: 365684 - DNA, 140 bp, Artificial Sequence
  Synthetic
atggccgactcccaagtacgcacacagttggtgtatagggtacatctgtcattcagcttgttttttttgtctatcactatcttgtaagttcctggaatgaaggttcctccatgatggatgggagacccagcatggcgtat

SEQ ID NO: 365685 - DNA, 140 bp, Artificial Sequence
  Synthetic
aggccctggctgctgatatggaaggtagcaacctggtcaatttctacaaagtcatatgtatctcgggtgataacactaaatggggcccgatacattgctgttccttcttttccggcatgagaccttttgggacagcggtg

SEQ ID NO: 365686 - DNA, 140 bp, Artificial Sequence
  Synthetic
caccgctgtcccaaaaggtctcatgccggaaaagaaggaacagcaatgtatcgggccccatttagtgttatcacccgagatacatatgactttgtagaaattgaccaggttgctaccttccatatcagcagccagggcct

SEQ ID NO: 365687 - DNA, 140 bp, Artificial Sequence
  Synthetic
atacgccatgctgggtctcctaacactaaatggggcccgatacattgctgttccttcttttccggcatgatgcagcaagtactgaaaaatgttccagattggtgttcattttataaattacgtacttgggagtcggccat

SEQ ID NO: 365688 - DNA, 140 bp, Artificial Sequence
  Synthetic
atggccgactcccaagtacgtaatttataaaatgaacaccaatctggaacatttttcagtacttgctgcatcatgccggaaaagaaggaacagcaatgtatcgggccccatttagtgttaggagacccagcatggcgtat

SEQ ID NO: 365689 - DNA, 140 bp, Artificial Sequence
  Synthetic
atacgccatgctgggtctccttacagttatgactattaatcacatttatttcaattgcttacgtaatgctgttttgctaattttatcttgctatctttcatttcaaatacttaaagggctcgtacttgggagtcggccat

SEQ ID NO: 365690 - DNA, 140 bp, Artificial Sequence
  Synthetic
atggccgactcccaagtacgagccctttaagtatttgaaatgaaagatagcaagataaaattagcaaaacagcattacgtaagcaattgaaataaatgtgattaatagtcataactgtaaggagacccagcatggcgtat

SEQ ID NO: 365691 - DNA, 140 bp, Artificial Sequence
  Synthetic
atacgccatgctgggtctccaagcaaaggactcatggcgttaaacagttacaaccatatgggtcagggtattcaccatgcaacatcttcagtattaacttctctagctgctgtgctctttcgtacttgggagtcggccat

SEQ ID NO: 365692 - DNA, 140 bp, Artificial Sequence
  Synthetic
atggccgactcccaagtacgaaagagcacagcagctagagaagttaatactgaagatgttgcatggtgaataccctgacccatatggttgtaactgtttaacgccatgagtcctttgcttggagacccagcatggcgtat

SEQ ID NO: 365693 - DNA, 140 bp, Artificial Sequence
  Synthetic
aggccctggctgctgatatgacatgttgaacatgccggcagttcagatgattacgcaaagtgtatagtggtaactggtatactatccaaagagctctactcccagtatgatgaaacattcgaccttttgggacagcggtg

SEQ ID NO: 365694 - DNA, 140 bp, Artificial Sequence
  Synthetic
caccgctgtcccaaaaggtcgaatgtttcatcatactgggagtagagctctttggatagtataccagttaccactatacactttgcgtaatcatctgaactgccggcatgttcaacatgtcatatcagcagccagggcct

SEQ ID NO: 365695 - DNA, 140 bp, Artificial Sequence
  Synthetic
aggccctggctgctgatatgtggaaacatgcctgtagacttaagaatttcacagctgcggtacaaagatgttgtcaaatgaaagatagtgccaaaactttagtgagcgactgtttccttggaccttttgggacagcggtg

SEQ ID NO: 365696 - DNA, 140 bp, Artificial Sequence
  Synthetic
caccgctgtcccaaaaggtccaaggaaacagtcgctcactaaagttttggcactatctttcatttgacaacatctttgtaccgcagctgtgaaattcttaagtctacaggcatgtttccacatatcagcagccagggcct

SEQ ID NO: 365697 - DNA, 140 bp, Artificial Sequence
  Synthetic
atacgccatgctgggtctcctttgatgcaggcatgccaagtctcgtcccaacaagcaatgtataatagcgttcctcttgtcaccaacactgccttcacactattgaggcaacaaattttccgtacttgggagtcggccat

SEQ ID NO: 365698 - DNA, 140 bp, Artificial Sequence
  Synthetic
atggccgactcccaagtacggaaaatttgttgcctcaatagtgtgaaggcagtgttggtgacaagaggaacgctattatacattgcttgttgggacgagacttggcatgcctgcatcaaaggagacccagcatggcgtat

SEQ ID NO: 365699 - DNA, 140 bp, Artificial Sequence
  Synthetic
aggccctggctgctgatatggactttgtctccctttggtaggctgtttgtaccaacctactctgggttagttagctcagcggttgccttggaagatgctgaagtcattgctagagcagctgaccttttgggacagcggtg

SEQ ID NO: 365700 - DNA, 140 bp, Artificial Sequence
  Synthetic
caccgctgtcccaaaaggtcagctgctctagcaatgacttcagcatcttccaaggcaaccgctgagctaactaacccagagtaggttggtacaaacagcctaccaaagggagacaaagtccatatcagcagccagggcct

SEQ ID NO: 365701 - DNA, 140 bp, Artificial Sequence
  Synthetic
atacgccatgctgggtctccttagctcagcggttgccttggaagatgctgaagtcattgctagagcagctcaaacacttcacatgaacagtgtatcgatacagtcaagcagcttgaccaccgtacttgggagtcggccat

SEQ ID NO: 365702 - DNA, 140 bp, Artificial Sequence
  Synthetic
atggccgactcccaagtacggtggtcaagctgcttgactgtatcgatacactgttcatgtgaagtgtttgagctgctctagcaatgacttcagcatcttccaaggcaaccgctgagctaaggagacccagcatggcgtat

SEQ ID NO: 365703 - DNA, 140 bp, Artificial Sequence
  Synthetic
aggccctggctgctgatatgcaaacacttcacatgaacagtgtatcgatacagtcaagcagcttgaccacattagacagcttaggttgcagcaggacaagttccacagttgaagatagcagaccttttgggacagcggtg

SEQ ID NO: 365704 - DNA, 140 bp, Artificial Sequence
  Synthetic
caccgctgtcccaaaaggtctgctatcttcaactgtggaacttgtcctgctgcaacctaagctgtctaatgtggtcaagctgcttgactgtatcgatacactgttcatgtgaagtgtttgcatatcagcagccagggcct

SEQ ID NO: 365705 - DNA, 140 bp, Artificial Sequence
  Synthetic
aggccctggctgctgatatgtccagcttctcatttgagctcaataggcctctgtctgaaaccgaactacaattcattaaagcattaagtagcctcaaatccacacaagcctgtgaagttagaccttttgggacagcggtg

SEQ ID NO: 365706 - DNA, 140 bp, Artificial Sequence
  Synthetic
caccgctgtcccaaaaggtctaacttcacaggcttgtgtggatttgaggctacttaatgctttaatgaattgtagttcggtttcagacagaggcctattgagctcaaatgagaagctggacatatcagcagccagggcct

SEQ ID NO: 365707 - DNA, 140 bp, Artificial Sequence
  Synthetic
aggccctggctgctgatatggataggcacaatgttatttatagcagcagaatggcagattcttgtgattggctgagagatggtaagagaagagggaatctggaactagcaaataggattcgaccttttgggacagcggtg

SEQ ID NO: 365708 - DNA, 140 bp, Artificial Sequence
  Synthetic
caccgctgtcccaaaaggtcgaatcctatttgctagttccagattccctcttctcttaccatctctcagccaatcacaagaatctgccattctgctgctataaataacattgtgcctatccatatcagcagccagggcct

SEQ ID NO: 365709 - DNA, 140 bp, Artificial Sequence
  Synthetic
aggccctggctgctgatatggctgagagatggtaagagaagagggaatctggaactagcaaataggattcagtctgtgctgtgtgttctgatagcagggtactacagatcatttggaggtgaccttttgggacagcggtg

SEQ ID NO: 365710 - DNA, 140 bp, Artificial Sequence
  Synthetic
caccgctgtcccaaaaggtcacctccaaatgatctgtagtaccctgctatcagaacacacagcacagactgaatcctatttgctagttccagattccctcttctcttaccatctctcagccatatcagcagccagggcct

SEQ ID NO: 365711 - DNA, 140 bp, Artificial Sequence
  Synthetic
aggccctggctgctgatatggaaggaaccgagaaacaggtaaaggcatcattgaatagagatgacaacaaaatcattgaggatcccatgatacaattaattccagagaagctgaggagaggaccttttgggacagcggtg

SEQ ID NO: 365712 - DNA, 140 bp, Artificial Sequence
  Synthetic
caccgctgtcccaaaaggtcctctcctcagcttctctggaattaattgtatcatgggatcctcaatgattttgttgtcatctctattcaatgatgcctttacctgtttctcggttccttccatatcagcagccagggcct

SEQ ID NO: 365713 - DNA, 140 bp, Artificial Sequence
  Synthetic
aggccctggctgctgatatgcaaagacaacgtcttcttatcactaacagacagatggtctaccaagcacagcacaaactatcgtgatagttgcggcaaacaattaaccggtagaataattgaccttttgggacagcggtg

SEQ ID NO: 365714 - DNA, 140 bp, Artificial Sequence
  Synthetic
caccgctgtcccaaaaggtcaattattctaccggttaattgtttgccgcaactatcacgatagtttgtgctgtgcttggtagaccatctgtctgttagtgataagaagacgttgtctttgcatatcagcagccagggcct

SEQ ID NO: 365715 - DNA, 140 bp, Artificial Sequence
  Synthetic
atacgccatgctgggtctccatacagagtcatctcaaagtctttgaaaatgaatttaccaacttaaaccttcagttctccgatccaaacagacagaaacttagaatagttgagtctagaccgtacttgggagtcggccat

SEQ ID NO: 365716 - DNA, 140 bp, Artificial Sequence
  Synthetic
atggccgactcccaagtacggtctagactcaactattctaagtttctgtctgtttggatcggagaactgaaggtttaagttggtaaattcattttcaaagactttgagatgactctgtatggagacccagcatggcgtat

SEQ ID NO: 365717 - DNA, 140 bp, Artificial Sequence
  Synthetic
aggccctggctgctgatatgtcaaggacatcagaactctcgtctcctacatcagcaccgagaccatccctaagtttttactctcatttcttctctatgaggaagtactgatgaacttgatgaccttttgggacagcggtg

SEQ ID NO: 365718 - DNA, 140 bp, Artificial Sequence
  Synthetic
caccgctgtcccaaaaggtcatcaagttcatcagtacttcctcatagagaagaaatgagagtaaaaacttagggatggtctcggtgctgatgtaggagacgagagttctgatgtccttgacatatcagcagccagggcct

SEQ ID NO: 365719 - DNA, 140 bp, Artificial Sequence
  Synthetic
aggccctggctgctgatatgtatgggctatttattagatgaatcagcaatttctgaagtcaaacctaccaaagttgacttctcaaatttgcttaaagatcgctttaaaataatgcagtttgaccttttgggacagcggtg

SEQ ID NO: 365720 - DNA, 140 bp, Artificial Sequence
  Synthetic
caccgctgtcccaaaaggtcaaactgcattattttaaagcgatctttaagcaaatttgagaagtcaactttggtaggtttgacttcagaaattgctgattcatctaataaatagcccatacatatcagcagccagggcct

SEQ ID NO: 365721 - DNA, 140 bp, Artificial Sequence
  Synthetic
atacgccatgctgggtctcccaaaccatttaaccctgctcagcaggatgatacaacaagcaaagccaaccgtgacggttttctacatgctgaaaggtaacttgatgaacacagagccgaccgtacttgggagtcggccat

SEQ ID NO: 365722 - DNA, 140 bp, Artificial Sequence
  Synthetic
atggccgactcccaagtacggtcggctctgtgttcatcaagttacctttcagcatgtagaaaaccgtcacggttggctttgcttgttgtatcatcctgctgagcagggttaaatggtttgggagacccagcatggcgtat

SEQ ID NO: 365723 - DNA, 140 bp, Artificial Sequence
  Synthetic
aggccctggctgctgatatggtgacggttttctacatgctgaaaggtaacttgatgaacacagagccgacagttgctgagcttgtcagctatggtataaaggaaggtaggttttataggcgaccttttgggacagcggtg

SEQ ID NO: 365724 - DNA, 140 bp, Artificial Sequence
  Synthetic
caccgctgtcccaaaaggtcgcctataaaacctaccttcctttataccatagctgacaagctcagcaactgtcggctctgtgttcatcaagttacctttcagcatgtagaaaaccgtcaccatatcagcagccagggcct

SEQ ID NO: 365725 - DNA, 140 bp, Artificial Sequence
  Synthetic
aggccctggctgctgatatgattcttcactgtatttctgccattggaagtttgcctttgagtcaggcagacaagtcttcactacttatgagtttcttaaactggagagttaacatggacagaccttttgggacagcggtg

SEQ ID NO: 365726 - DNA, 140 bp, Artificial Sequence
  Synthetic
caccgctgtcccaaaaggtctgtccatgttaactctccagtttaagaaactcataagtagtgaagacttgtctgcctgactcaaaggcaaacttccaatggcagaaatacagtgaagaatcatatcagcagccagggcct

SEQ ID NO: 365727 - DNA, 140 bp, Artificial Sequence
  Synthetic
aggccctggctgctgatatgcaaaggaacgataattggaaagcagaatgatacttgcacagccaaggcaagctgttggctagagtcagtcaagagttttttttatggattgaagaatatggaccttttgggacagcggtg

SEQ ID NO: 365728 - DNA, 140 bp, Artificial Sequence
  Synthetic
caccgctgtcccaaaaggtccatattcttcaatccataaaaaaaactcttgactgactctagccaacagcttgccttggctgtgcaagtatcattctgctttccaattatcgttcctttgcatatcagcagccagggcct

SEQ ID NO: 365729 - DNA, 140 bp, Artificial Sequence
  Synthetic
aggccctggctgctgatatgacaaagaagatcgaaataacaggccttaaatttgcaagcctgacttgcacaggttgttatgcttgtagttcaggcatctcctgcaaagttaggattcacggaccttttgggacagcggtg

SEQ ID NO: 365730 - DNA, 140 bp, Artificial Sequence
  Synthetic
caccgctgtcccaaaaggtccgtgaatcctaactttgcaggagatgcctgaactacaagcataacaacctgtgcaagtcaggcttgcaaatttaaggcctgttatttcgatcttctttgtcatatcagcagccagggcct

SEQ ID NO: 365731 - DNA, 140 bp, Artificial Sequence
  Synthetic
aggccctggctgctgatatgagaggagattgagttttgcaacaacctgaccaagactgtatcagagaacccgctaccactcagctgttggtctgaagttcaaaactacattgaagatatagaccttttgggacagcggtg

SEQ ID NO: 365732 - DNA, 140 bp, Artificial Sequence
  Synthetic
caccgctgtcccaaaaggtctatatcttcaatgtagttttgaacttcagaccaacagctgagtggtagcgggttctctgatacagtcttggtcaggttgttgcaaaactcaatctcctctcatatcagcagccagggcct

SEQ ID NO: 365733 - DNA, 140 bp, Artificial Sequence
  Synthetic
atacgccatgctgggtctccatactggacatctgtactgtatcacttggcatcatgttgtcaacattcttatatggctctaacaataagaacaagaagaagttcattaccaactgtctgccgtacttgggagtcggccat

SEQ ID NO: 365734 - DNA, 140 bp, Artificial Sequence
  Synthetic
atggccgactcccaagtacggcagacagttggtaatgaacttcttcttgttcttattgttagagccatataagaatgttgacaacatgatgccaagtgatacagtacagatgtccagtatggagacccagcatggcgtat

SEQ ID NO: 365735 - DNA, 140 bp, Artificial Sequence
  Synthetic
aggccctggctgctgatatgcaacgacaaactgctcataagatctaaagaagagcttaaaaaatgtttcgatgtgcaatcttttaaattgataaaaaacaagcaacctgtgccttttcaggaccttttgggacagcggtg

SEQ ID NO: 365736 - DNA, 140 bp, Artificial Sequence
  Synthetic
caccgctgtcccaaaaggtcctgaaaaggcacaggttgcttgttttttatcaatttaaaagattgcacatcgaaacattttttaagctcttctttagatcttatgagcagtttgtcgttgcatatcagcagccagggcct

SEQ ID NO: 365737 - DNA, 140 bp, Artificial Sequence
  Synthetic
aggccctggctgctgatatgttaaagatgtaaggacactggtatcctacgtcagtactgaaaccatccccaagttcttgcttgcattccttctctacgaagaagtattgatgaacttaatgaccttttgggacagcggtg

SEQ ID NO: 365738 - DNA, 140 bp, Artificial Sequence
  Synthetic
caccgctgtcccaaaaggtcattaagttcatcaatacttcttcgtagagaaggaatgcaagcaagaacttggggatggtttcagtactgacgtaggataccagtgtccttacatctttaacatatcagcagccagggcct

SEQ ID NO: 365739 - DNA, 140 bp, Artificial Sequence
  Synthetic
atacgccatgctgggtctccaagttcttgcttgcattccttctctacgaagaagtattgatgaacttaatcaaccagtgtaaggcagtaaaagaactcatcaacagcacaggactttcagcgtacttgggagtcggccat

SEQ ID NO: 365740 - DNA, 140 bp, Artificial Sequence
  Synthetic
atggccgactcccaagtacgctgaaagtcctgtgctgttgatgagttcttttactgccttacactggttgattaagttcatcaatacttcttcgtagagaaggaatgcaagcaagaacttggagacccagcatggcgtat

SEQ ID NO: 365741 - DNA, 140 bp, Artificial Sequence
  Synthetic
aggccctggctgctgatatggaatgcagtaagagagatggacctagatgttcctctgcagcactactgagcctagttcatgaggattggcaaaagataggaaaaaatatcctagttcgtggaccttttgggacagcggtg

SEQ ID NO: 365742 - DNA, 140 bp, Artificial Sequence
  Synthetic
caccgctgtcccaaaaggtccacgaactaggatattttttcctatcttttgccaatcctcatgaactaggctcagtagtgctgcagaggaacatctaggtccatctctcttactgcattccatatcagcagccagggcct

SEQ ID NO: 365743 - DNA, 140 bp, Artificial Sequence
  Synthetic
aggccctggctgctgatatgcaaacaatgagctaggtgatgtgtcactgaaggttaatattgtcctggtacccctcaaggacatgtccaaaccaaagcctgaaagagtggtcatagctaggaccttttgggacagcggtg

SEQ ID NO: 365744 - DNA, 140 bp, Artificial Sequence
  Synthetic
caccgctgtcccaaaaggtcctagctatgaccactctttcaggctttggtttggacatgtccttgaggggtaccaggacaatattaaccttcagtgacacatcacctagctcattgtttgcatatcagcagccagggcct

SEQ ID NO: 365745 - DNA, 140 bp, Artificial Sequence
  Synthetic
aggccctggctgctgatatgagattacaataagttgattgaccattgtgttgacatggaaaaaaagagggaagcagttagagcagtagaagatttaattctgatgttgacaggcaaggcagaccttttgggacagcggtg

SEQ ID NO: 365746 - DNA, 140 bp, Artificial Sequence
  Synthetic
caccgctgtcccaaaaggtctgccttgcctgtcaacatcagaattaaatcttctactgctctaactgcttccctctttttttccatgtcaacacaatggtcaatcaacttattgtaatctcatatcagcagccagggcct

SEQ ID NO: 365747 - DNA, 140 bp, Artificial Sequence
  Synthetic
aggccctggctgctgatatggctgagagacgggaaaagaagaggaaactttgaattggcaaatagaatacagtcagtactctgtgtactgatagctggctattacagatcgttcggaggagaccttttgggacagcggtg

SEQ ID NO: 365748 - DNA, 140 bp, Artificial Sequence
  Synthetic
caccgctgtcccaaaaggtctcctccgaacgatctgtaatagccagctatcagtacacagagtactgactgtattctatttgccaattcaaagtttcctcttcttttcccgtctctcagccatatcagcagccagggcct

SEQ ID NO: 365749 - DNA, 140 bp, Artificial Sequence
  Synthetic
atacgccatgctgggtctccaccatatgtgagacaactcctgcaaatgcaatagatgctgaaatgcatgaccttaactgcagttacaacatatgtccctattgtgcatctagactaacctcgtacttgggagtcggccat

SEQ ID NO: 365750 - DNA, 140 bp, Artificial Sequence
  Synthetic
atggccgactcccaagtacgaggttagtctagatgcacaatagggacatatgttgtaactgcagttaaggtcatgcatttcagcatctattgcatttgcaggagttgtctcacatatggtggagacccagcatggcgtat

SEQ ID NO: 365751 - DNA, 140 bp, Artificial Sequence
  Synthetic
aggccctggctgctgatatggtctcaagggcaaatgaggcagtccataccatttcagttgctatcatcagagctctcaaacgagctaactgctctacatttctcacagtcaattcagctggaccttttgggacagcggtg

SEQ ID NO: 365752 - DNA, 140 bp, Artificial Sequence
  Synthetic
caccgctgtcccaaaaggtccagctgaattgactgtgagaaatgtagagcagttagctcgtttgagagctctgatgatagcaactgaaatggtatggactgcctcatttgcccttgagaccatatcagcagccagggcct

SEQ ID NO: 365753 - DNA, 140 bp, Artificial Sequence
  Synthetic
atacgccatgctgggtctccgcctctattgatccattttatcattctgtcattcttctttctctactattcattccagtttcattatttgaagggtgtggggggaacgatttctttgagacgtacttgggagtcggccat

SEQ ID NO: 365754 - DNA, 140 bp, Artificial Sequence
  Synthetic
atggccgactcccaagtacgtctcaaagaaatcgttccccccacacccttcaaataatgaaactggaatgaatagtagagaaagaagaatgacagaatgataaaatggatcaatagaggcggagacccagcatggcgtat

SEQ ID NO: 365755 - DNA, 140 bp, Artificial Sequence
  Synthetic
atacgccatgctgggtctcctctcaaagaaacacgtgccgcttacgcccacagtgttctcttgagtgttggcagaatggaaaacaaaatcgaggtgaacaacaaagatgagatgaacaaacgtacttgggagtcggccat

SEQ ID NO: 365756 - DNA, 140 bp, Artificial Sequence
  Synthetic
atggccgactcccaagtacgtttgttcatctcatctttgttgttcacctcgattttgttttccattctgccaacactcaagagaacactgtgggcgtaagcggcacgtgtttctttgagaggagacccagcatggcgtat

SEQ ID NO: 365757 - DNA, 140 bp, Artificial Sequence
  Synthetic
aggccctggctgctgatatggcagaatggaaaacaaaatcgaggtgaacaacaaagatgagatgaacaaatggtttgaggagttcaagaaaggaaatggacttgtggacactttcacaaagaccttttgggacagcggtg

SEQ ID NO: 365758 - DNA, 140 bp, Artificial Sequence
  Synthetic
caccgctgtcccaaaaggtctttgtgaaagtgtccacaagtccatttcctttcttgaactcctcaaaccatttgttcatctcatctttgttgttcacctcgattttgttttccattctgccatatcagcagccagggcct

SEQ ID NO: 365759 - DNA, 140 bp, Artificial Sequence
  Synthetic
atacgccatgctgggtctccagatggctagtgccactgatgatgcacaaaaggactccatctacgcatctgctctagtggaggcaaccaagttttgtgcacctatatacgagtgtgcttgcgtacttgggagtcggccat

SEQ ID NO: 365760 - DNA, 140 bp, Artificial Sequence
  Synthetic
atggccgactcccaagtacgcaagcacactcgtatataggtgcacaaaacttggttgcctccactagagcagatgcgtagatggagtccttttgtgcatcatcagtggcactagccatctggagacccagcatggcgtat

SEQ ID NO: 365761 - DNA, 140 bp, Artificial Sequence
  Synthetic
atacgccatgctgggtctccatgcaggaaccattaaatcttgggatgagagttatactgagctgaaagttgaagttcccaaaatagaacaactttccaactaccagcaggctgctctcaacgtacttgggagtcggccat

SEQ ID NO: 365762 - DNA, 140 bp, Artificial Sequence
  Synthetic
atggccgactcccaagtacgttgagagcagcctgctggtagttggaaagttgttctattttgggaacttcaactttcagctcagtataactctcatcccaagatttaatggttcctgcatggagacccagcatggcgtat

SEQ ID NO: 365763 - DNA, 140 bp, Artificial Sequence
  Synthetic
aggccctggctgctgatatggaagttcccaaaatagaacaactttccaactaccagcaggctgctctcaagtggaggaaagacataggtttccgtgtcaatgcaaacacggcagctttgagaccttttgggacagcggtg

SEQ ID NO: 365764 - DNA, 140 bp, Artificial Sequence
  Synthetic
caccgctgtcccaaaaggtctcaaagctgccgtgtttgcattgacacggaaacctatgtctttcctccacttgagagcagcctgctggtagttggaaagttgttctattttgggaacttccatatcagcagccagggcct

SEQ ID NO: 365765 - DNA, 140 bp, Artificial Sequence
  Synthetic
aggccctggctgctgatatgccttggggggacatcaacaagtcaggccgttcaggaatagcacttgttgcaacaggccttgccaagcttgcagaaactgaggggaagggggtttttgatggaccttttgggacagcggtg

SEQ ID NO: 365766 - DNA, 140 bp, Artificial Sequence
  Synthetic
caccgctgtcccaaaaggtccatcaaaaacccccttcccctcagtttctgcaagcttggcaaggcctgttgcaacaagtgctattcctgaacggcctgacttgttgatgtccccccaaggcatatcagcagccagggcct

SEQ ID NO: 365767 - DNA, 140 bp, Artificial Sequence
  Synthetic
atacgccatgctgggtctccgacgaagttgacaaagcaagtgctgacagcatgataacaaacctccttaagcatattgctaaggcacaagagctttacaaaaactcgtctgctcttcgtgcgtacttgggagtcggccat

SEQ ID NO: 365768 - DNA, 140 bp, Artificial Sequence
  Synthetic
atggccgactcccaagtacgcacgaagagcagacgagtttttgtaaagctcttgtgccttagcaatatgcttaaggaggtttgttatcatgctgtcagcacttgctttgtcaacttcgtcggagacccagcatggcgtat

SEQ ID NO: 365769 - DNA, 140 bp, Artificial Sequence
  Synthetic
atacgccatgctgggtctccctcagggtgcacagattgacaccgtcttcagctcttactactggctctacaaggccggtgtgactccagagaccttcccgactgtctcacagttccttttcgtacttgggagtcggccat

SEQ ID NO: 365770 - DNA, 140 bp, Artificial Sequence
  Synthetic
atggccgactcccaagtacgaaaaggaactgtgagacagtcgggaaggtctctggagtcacaccggccttgtagagccagtagtaagagctgaagacggtgtcaatctgtgcaccctgagggagacccagcatggcgtat

SEQ ID NO: 365771 - DNA, 140 bp, Artificial Sequence
  Synthetic
aggccctggctgctgatatgtgagcaccccaatgaagtgggggaagaagctttatgagctttttgccgatgattctttccagcagaacaggatctacatgcaccccgctgtgctgacagcgaccttttgggacagcggtg

SEQ ID NO: 365772 - DNA, 140 bp, Artificial Sequence
  Synthetic
caccgctgtcccaaaaggtcgctgtcagcacagcggggtgcatgtagatcctgttctgctggaaagaatcatcggcaaaaagctcataaagcttcttcccccacttcattggggtgctcacatatcagcagccagggcct

SEQ ID NO: 365773 - DNA, 140 bp, Artificial Sequence
  Synthetic
atacgccatgctgggtctcccggcagaatcagtgaaatgggtgtctgctttggaacaatccctgtggccaatcctgatgatgctgctttaggatctggacacactaagtccattctcaaccgtacttgggagtcggccat

SEQ ID NO: 365774 - DNA, 140 bp, Artificial Sequence
  Synthetic
atggccgactcccaagtacggttgagaatggacttagtgtgtccagatcctaaagcagcatcatcaggattggccacagggattgttccaaagcagacacccatttcactgattctgccgggagacccagcatggcgtat

SEQ ID NO: 365775 - DNA, 140 bp, Artificial Sequence
  Synthetic
aggccctggctgctgatatgatcctgatgatgctgctttaggatctggacacactaagtccattctcaaccttcggacaaacactgaaaccaataatccgtgtgccaagacaattgttaagaccttttgggacagcggtg

SEQ ID NO: 365776 - DNA, 140 bp, Artificial Sequence
  Synthetic
caccgctgtcccaaaaggtcttaacaattgtcttggcacacggattattggtttcagtgtttgtccgaaggttgagaatggacttagtgtgtccagatcctaaagcagcatcatcaggatcatatcagcagccagggcct

SEQ ID NO: 365777 - DNA, 140 bp, Artificial Sequence
  Synthetic
aggccctggctgctgatatgagcctcctcccccagtcacatgaatgtttacaaaagcacaaggatggcagcgcactatcggtcatacctgacagcagcaacccccgactacttaaatttggaccttttgggacagcggtg

SEQ ID NO: 365778 - DNA, 140 bp, Artificial Sequence
  Synthetic
caccgctgtcccaaaaggtccaaatttaagtagtcgggggttgctgctgtcaggtatgaccgatagtgcgctgccatccttgtgcttttgtaaacattcatgtgactgggggaggaggctcatatcagcagccagggcct

SEQ ID NO: 365779 - DNA, 140 bp, Artificial Sequence
  Synthetic
atacgccatgctgggtctcctcacaactgcaactatcagttatgtttactttaactgcttgtataatcctgttttattaacattctcttactttcttctgttttaaacatttaaagggctcgtacttgggagtcggccat

SEQ ID NO: 365780 - DNA, 140 bp, Artificial Sequence
  Synthetic
atggccgactcccaagtacgagccctttaaatgtttaaaacagaagaaagtaagagaatgttaataaaacaggattatacaagcagttaaagtaaacataactgatagttgcagttgtgaggagacccagcatggcgtat

SEQ ID NO: 365781 - DNA, 140 bp, Artificial Sequence
  Synthetic
atacgccatgctgggtctcctctcaaagatatcaatcccccctttacccacgttgacacagacagcttcagtagtggttttcctgtccttgtttaaccatggactttttgaggaaccttgcgtacttgggagtcggccat

SEQ ID NO: 365782 - DNA, 140 bp, Artificial Sequence
  Synthetic
atggccgactcccaagtacgcaaggttcctcaaaaagtccatggttaaacaaggacaggaaaaccactactgaagctgtctgtgtcaacgtgggtaaaggggggattgatatctttgagaggagacccagcatggcgtat

SEQ ID NO: 365783 - DNA, 140 bp, Artificial Sequence
  Synthetic
aggccctggctgctgatatggtagtggttttcctgtccttgtttaaccatggactttttgaggaaccttgactggactcaggtaattgctggccaatatgtgaccaatcctaggttcaacgaccttttgggacagcggtg

SEQ ID NO: 365784 - DNA, 140 bp, Artificial Sequence
  Synthetic
caccgctgtcccaaaaggtcgttgaacctaggattggtcacatattggccagcaattacctgagtccagtcaaggttcctcaaaaagtccatggttaaacaaggacaggaaaaccactaccatatcagcagccagggcct

SEQ ID NO: 365785 - DNA, 140 bp, Artificial Sequence
  Synthetic
atacgccatgctgggtctccactggactcaggtaattgctggccaatatgtgaccaatcctaggttcaacatctccgactacttcgagattgttcggcaacctggtgatgggaactgcttcgtacttgggagtcggccat

SEQ ID NO: 365786 - DNA, 140 bp, Artificial Sequence
  Synthetic
atggccgactcccaagtacgaagcagttcccatcaccaggttgccgaacaatctcgaagtagtcggagatgttgaacctaggattggtcacatattggccagcaattacctgagtccagtggagacccagcatggcgtat

SEQ ID NO: 365787 - DNA, 140 bp, Artificial Sequence
  Synthetic
atacgccatgctgggtctccaccacaacatcaaacacctaacagaagtggcagcacggaagtattacaaggaggaacccgaagccaagcttattggcctgagtctggaagactatattaacgtacttgggagtcggccat

SEQ ID NO: 365788 - DNA, 140 bp, Artificial Sequence
  Synthetic
atggccgactcccaagtacgttaatatagtcttccagactcaggccaataagcttggcttcgggttcctccttgtaatacttccgtgctgccacttctgttaggtgtttgatgttgtggtggagacccagcatggcgtat

SEQ ID NO: 365789 - DNA, 140 bp, Artificial Sequence
  Synthetic
atacgccatgctgggtctccaaggatgctgtctgacaacgagtggggatcgactcttgaggcatcaatgctggctaaagaaatgggtgttactatcatcatttggaccgttgctgctagtcgtacttgggagtcggccat

SEQ ID NO: 365790 - DNA, 140 bp, Artificial Sequence
  Synthetic
atggccgactcccaagtacgactagcagcaacggtccaaatgatgatagtaacacccatttctttagccagcattgatgcctcaagagtcgatccccactcgttgtcagacagcatccttggagacccagcatggcgtat

SEQ ID NO: 365791 - DNA, 140 bp, Artificial Sequence
  Synthetic
atacgccatgctgggtctcctgtaaacctattgcactctggacaaacgcattttgacgctcttagaatactgccacagtttgaagctgacacgagagagaccttaagtttggtagataaacgtacttgggagtcggccat

SEQ ID NO: 365792 - DNA, 140 bp, Artificial Sequence
  Synthetic
atggccgactcccaagtacgtttatctaccaaacttaaggtctctctcgtgtcagcttcaaactgtggcagtattctaagagcgtcaaaatgcgtttgtccagagtgcaataggtttacaggagacccagcatggcgtat

SEQ ID NO: 365793 - DNA, 140 bp, Artificial Sequence
  Synthetic
aggccctggctgctgatatgtgccacagtttgaagctgacacgagagagaccttaagtttggtagataaagtcatagctgtggatcagttgacctcgtcctcaggtgatgaactgcaagagaccttttgggacagcggtg

SEQ ID NO: 365794 - DNA, 140 bp, Artificial Sequence
  Synthetic
caccgctgtcccaaaaggtctcttgcagttcatcacctgaggacgaggtcaactgatccacagctatgactttatctaccaaacttaaggtctctctcgtgtcagcttcaaactgtggcacatatcagcagccagggcct

SEQ ID NO: 365795 - DNA, 140 bp, Artificial Sequence
  Synthetic
atacgccatgctgggtctccggtcgagcctagatgaggtcactctgtctaagaaacaagcagagatattgaggcagaaggcatcgcagttatctaaactggttaataaaagtcagaacatcgtacttgggagtcggccat

SEQ ID NO: 365796 - DNA, 140 bp, Artificial Sequence
  Synthetic
atggccgactcccaagtacgatgttctgacttttattaaccagtttagataactgcgatgccttctgcctcaatatctctgcttgtttcttagacagagtgacctcatctaggctcgaccggagacccagcatggcgtat

SEQ ID NO: 365797 - DNA, 140 bp, Artificial Sequence
  Synthetic
atacgccatgctgggtctccgtgttgagatatcagcagataccctgattctacgaccagaatccaaagagagaattggtgaagttatgtcgttgcggcagctagggcataaattactaaccgtacttgggagtcggccat

SEQ ID NO: 365798 - DNA, 140 bp, Artificial Sequence
  Synthetic
atggccgactcccaagtacggttagtaatttatgccctagctgccgcaacgacataacttcaccaattctctctttggattctggtcgtagaatcagggtatctgctgatatctcaacacggagacccagcatggcgtat

SEQ ID NO: 365799 - DNA, 140 bp, Artificial Sequence
  Synthetic
atacgccatgctgggtctccactaaatatacccactggctggacacattcttaagctgctctgtctccatcaatagacataccaccgtcaaggagccatcattattcaatcccaatatcacgtacttgggagtcggccat

SEQ ID NO: 365800 - DNA, 140 bp, Artificial Sequence
  Synthetic
atggccgactcccaagtacgtgatattgggattgaataatgatggctccttgacggtggtatgtctattgatggagacagagcagcttaagaatgtgtccagccagtgggtatatttagtggagacccagcatggcgtat

SEQ ID NO: 365801 - DNA, 140 bp, Artificial Sequence
  Synthetic
atacgccatgctgggtctcctttcctggaacagggatagaaagacacatgcagttgctgcactccgagatgatactagacatttgtactgtgtcacttggcatcatgttgtcaacatttccgtacttgggagtcggccat

SEQ ID NO: 365802 - DNA, 140 bp, Artificial Sequence
  Synthetic
atggccgactcccaagtacggaaatgttgacaacatgatgccaagtgacacagtacaaatgtctagtatcatctcggagtgcagcaactgcatgtgtctttctatccctgttccaggaaaggagacccagcatggcgtat

SEQ ID NO: 365803 - DNA, 140 bp, Artificial Sequence
  Synthetic
aggccctggctgctgatatggatactagacatttgtactgtgtcacttggcatcatgttgtcaacatttctgtatggctccaataacaagaacaagaagaaattcatcactaactgtctggaccttttgggacagcggtg

SEQ ID NO: 365804 - DNA, 140 bp, Artificial Sequence
  Synthetic
caccgctgtcccaaaaggtccagacagttagtgatgaatttcttcttgttcttgttattggagccatacagaaatgttgacaacatgatgccaagtgacacagtacaaatgtctagtatccatatcagcagccagggcct

SEQ ID NO: 365805 - DNA, 140 bp, Artificial Sequence
  Synthetic
atacgccatgctgggtctccaggaaatgaactgctgtataaggcacctagaaaggccttagcaaccgtttgtagtgccttattcgggaagcaggtaaacaagcttcagaattgctttaggcgtacttgggagtcggccat

SEQ ID NO: 365806 - DNA, 140 bp, Artificial Sequence
  Synthetic
atggccgactcccaagtacgcctaaagcaattctgaagcttgtttacctgcttcccgaataaggcactacaaacggttgctaaggcctttctaggtgccttatacagcagttcatttcctggagacccagcatggcgtat

SEQ ID NO: 365807 - DNA, 140 bp, Artificial Sequence
  Synthetic
atacgccatgctgggtctccagagcaaataagcttggatgacctaatggcaagtgatacagcgatagatttgcctgacagggaagcagaagccctcaaaacaggaaaccttggctttaaccgtacttgggagtcggccat

SEQ ID NO: 365808 - DNA, 140 bp, Artificial Sequence
  Synthetic
atggccgactcccaagtacggttaaagccaaggtttcctgttttgagggcttctgcttccctgtcaggcaaatctatcgctgtatcacttgccattaggtcatccaagcttatttgctctggagacccagcatggcgtat

SEQ ID NO: 365809 - DNA, 140 bp, Artificial Sequence
  Synthetic
atacgccatgctgggtctccacaacactgatgttgaatttaaccacagggaaatagctgatctcaaccaactaacttctcggcttattacgttaaggaaggaaagagacactgacctcctcgtacttgggagtcggccat

SEQ ID NO: 365810 - DNA, 140 bp, Artificial Sequence
  Synthetic
atggccgactcccaagtacgaggaggtcagtgtctctttccttccttaacgtaataagccgagaagttagttggttgagatcagctatttccctgtggttaaattcaacatcagtgttgtggagacccagcatggcgtat

SEQ ID NO: 365811 - DNA, 140 bp, Artificial Sequence
  Synthetic
atacgccatgctgggtctcctctcaaagaaacacgtgccgcttacgcccacagtgttctcttgagtgttggcaaaatggaaaacaaaatcgaggtgaataacaaagatgagatgaacaagcgtacttgggagtcggccat

SEQ ID NO: 365812 - DNA, 140 bp, Artificial Sequence
  Synthetic
atggccgactcccaagtacgcttgttcatctcatctttgttattcacctcgattttgttttccattttgccaacactcaagagaacactgtgggcgtaagcggcacgtgtttctttgagaggagacccagcatggcgtat

SEQ ID NO: 365813 - DNA, 140 bp, Artificial Sequence
  Synthetic
atacgccatgctgggtctcctaaatatgacttctgaggacatctcacagctcttaatcgagatcaagagactgtatgctctacaagaagattctgaagtagagccaatagctataatttgcgtacttgggagtcggccat

SEQ ID NO: 365814 - DNA, 140 bp, Artificial Sequence
  Synthetic
atggccgactcccaagtacgcaaattatagctattggctctacttcagaatcttcttgtagagcatacagtctcttgatctcgattaagagctgtgagatgtcctcagaagtcatatttaggagacccagcatggcgtat

SEQ ID NO: 365815 - DNA, 140 bp, Artificial Sequence
  Synthetic
aggccctggctgctgatatgctgtatgctctacaagaagattctgaagtagagccaatagctataatttgcgatggcatagaaagcaatatgaaacagttatttgctatactgcctcctggaccttttgggacagcggtg

SEQ ID NO: 365816 - DNA, 140 bp, Artificial Sequence
  Synthetic
caccgctgtcccaaaaggtccaggaggcagtatagcaaataactgtttcatattgctttctatgccatcgcaaattatagctattggctctacttcagaatcttcttgtagagcatacagcatatcagcagccagggcct

SEQ ID NO: 365817 - DNA, 140 bp, Artificial Sequence
  Synthetic
atacgccatgctgggtctccattgtgcaaaggaatgtgaggttctttttgatgacattagaaactctccaacgcacagtacagcttggaagcatgctctccggctaaaagggactgcatacgtacttgggagtcggccat

SEQ ID NO: 365818 - DNA, 140 bp, Artificial Sequence
  Synthetic
atggccgactcccaagtacgtatgcagtcccttttagccggagagcatgcttccaagctgtactgtgcgttggagagtttctaatgtcatcaaaaagaacctcacattcctttgcacaatggagacccagcatggcgtat

SEQ ID NO: 365819 - DNA, 140 bp, Artificial Sequence
  Synthetic
atacgccatgctgggtctcctcaaacctagcctgaccatgttgattcagactttattccctgacaagtttgaggatttcttggatcgaacccaactgcatccagagttcagagatctaaccgtacttgggagtcggccat

SEQ ID NO: 365820 - DNA, 140 bp, Artificial Sequence
  Synthetic
atggccgactcccaagtacggttagatctctgaactctggatgcagttgggttcgatccaagaaatcctcaaacttgtcagggaataaagtctgaatcaacatggtcaggctaggtttgaggagacccagcatggcgtat

SEQ ID NO: 365821 - DNA, 140 bp, Artificial Sequence
  Synthetic
atacgccatgctgggtctccccagtgttgagaatgtgcagatctccattgatgcaacattgcctgaatctgtggaggcagtaccagtgacagaaagaaagatgttccctctacctgagaccgtacttgggagtcggccat

SEQ ID NO: 365822 - DNA, 140 bp, Artificial Sequence
  Synthetic
atggccgactcccaagtacggtctcaggtagagggaacatctttctttctgtcactggtactgcctccacagattcaggcaatgttgcatcaatggagatctgcacattctcaacactggggagacccagcatggcgtat

SEQ ID NO: 365823 - DNA, 140 bp, Artificial Sequence
  Synthetic
aggccctggctgctgatatggtggaggcagtaccagtgacagaaagaaagatgttccctctacctgagactccactaagtgaggtacattcaatagagcgtatcatggaaaacttcactcgaccttttgggacagcggtg

SEQ ID NO: 365824 - DNA, 140 bp, Artificial Sequence
  Synthetic
caccgctgtcccaaaaggtcgagtgaagttttccatgatacgctctattgaatgtacctcacttagtggagtctcaggtagagggaacatctttctttctgtcactggtactgcctccaccatatcagcagccagggcct

SEQ ID NO: 365825 - DNA, 140 bp, Artificial Sequence
  Synthetic
aggccctggctgctgatatgttgcttcttaattccttgacattattacactgctttctgaaacatgctcctagtgacgccataatggaagtggaaagcaagagtagcctattacacaaatgaccttttgggacagcggtg

SEQ ID NO: 365826 - DNA, 140 bp, Artificial Sequence
  Synthetic
caccgctgtcccaaaaggtcatttgtgtaataggctactcttgctttccacttccattatggcgtcactaggagcatgtttcagaaagcagtgtaataatgtcaaggaattaagaagcaacatatcagcagccagggcct

SEQ ID NO: 365827 - DNA, 140 bp, Artificial Sequence
  Synthetic
atacgccatgctgggtctccgtggaacaggacaatcatcagaatgccattgaacatgagagctcaagcatcctggccttcaaggactatggagaaagaggaatagttgaagaaaatcatacgtacttgggagtcggccat

SEQ ID NO: 365828 - DNA, 140 bp, Artificial Sequence
  Synthetic
atggccgactcccaagtacgtatgattttcttcaactattcctctttctccatagtccttgaaggccaggatgcttgagctctcatgttcaatggcattctgatgattgtcctgttccacggagacccagcatggcgtat

SEQ ID NO: 365829 - DNA, 140 bp, Artificial Sequence
  Synthetic
atacgccatgctgggtctccgaagttggttttcagactgacatcgatgggaaaataaggacagaccacaaaaaatggaaagatatattaaagctgttggagttacttggaattaaatgttcgtacttgggagtcggccat

SEQ ID NO: 365830 - DNA, 140 bp, Artificial Sequence
  Synthetic
atggccgactcccaagtacgaacatttaattccaagtaactccaacagctttaatatatctttccattttttgtggtctgtccttattttcccatcgatgtcagtctgaaaaccaacttcggagacccagcatggcgtat

SEQ ID NO: 365831 - DNA, 140 bp, Artificial Sequence
  Synthetic
aggccctggctgctgatatgattactgaagacagagtgcgagttttaaagaactcagtcagctttctcttcaacaagctctctaggaactcaccgacagaagtaaccgatatagttgttggaccttttgggacagcggtg

SEQ ID NO: 365832 - DNA, 140 bp, Artificial Sequence
  Synthetic
caccgctgtcccaaaaggtccaacaactatatcggttacttctgtcggtgagttcctagagagcttgttgaagagaaagctgactgagttctttaaaactcgcactctgtcttcagtaatcatatcagcagccagggcct

SEQ ID NO: 365833 - DNA, 140 bp, Artificial Sequence
  Synthetic
aggccctggctgctgatatgccccaacaacccaagctcccaccgaaatcaacaaccccaacacatccagacagcccatgccctcaacacaaccagcagctcccaactcagtgacccctccgaccttttgggacagcggtg

SEQ ID NO: 365834 - DNA, 140 bp, Artificial Sequence
  Synthetic
caccgctgtcccaaaaggtcggaggggtcactgagttgggagctgctggttgtgttgagggcatgggctgtctggatgtgttggggttgttgatttcggtgggagcttgggttgttggggcatatcagcagccagggcct

SEQ ID NO: 365835 - DNA, 140 bp, Artificial Sequence
  Synthetic
atacgccatgctgggtctccacaaaaacccctgtgtcaacaaaagacgttctagagacctgggaaaggatgaaagagcacatacttaacaggccaacaggattgacattgcctgcaagtccgtacttgggagtcggccat

SEQ ID NO: 365836 - DNA, 140 bp, Artificial Sequence
  Synthetic
atggccgactcccaagtacggacttgcaggcaatgtcaatcctgttggcctgttaagtatgtgctctttcatcctttcccaggtctctagaacgtcttttgttgacacaggggtttttgtggagacccagcatggcgtat

SEQ ID NO: 365837 - DNA, 140 bp, Artificial Sequence
  Synthetic
aggccctggctgctgatatggaaagagcacatacttaacaggccaacaggattgacattgcctgcaagtctggaacaggcaatgcgtaaaggactggtcgaaggtgtagtcatctccaaggaccttttgggacagcggtg

SEQ ID NO: 365838 - DNA, 140 bp, Artificial Sequence
  Synthetic
caccgctgtcccaaaaggtccttggagatgactacaccttcgaccagtcctttacgcattgcctgttccagacttgcaggcaatgtcaatcctgttggcctgttaagtatgtgctctttccatatcagcagccagggcct

SEQ ID NO: 365839 - DNA, 140 bp, Artificial Sequence
  Synthetic
atacgccatgctgggtctccaactgatgagtttgaacggacaaagttcaagcatgagcttacacagaatgttacaactagtgaaaagatgttgttgagttggctaagtgaggatattaagcgtacttgggagtcggccat

SEQ ID NO: 365840 - DNA, 140 bp, Artificial Sequence
  Synthetic
atggccgactcccaagtacgcttaatatcctcacttagccaactcaacaacatcttttcactagttgtaacattctgtgtaagctcatgcttgaactttgtccgttcaaactcatcagttggagacccagcatggcgtat

SEQ ID NO: 365841 - DNA, 140 bp, Artificial Sequence
  Synthetic
atacgccatgctgggtctcctcatcgagatgtagtgagtgcctctctagcataaagaaaactgttgatgaaactgccaacttatcagaaaagattgaaatgcttgcttacaatctgcaaccgtacttgggagtcggccat

SEQ ID NO: 365842 - DNA, 140 bp, Artificial Sequence
  Synthetic
atggccgactcccaagtacggttgcagattgtaagcaagcatttcaatcttttctgataagttggcagtttcatcaacagttttctttatgctagagaggcactcactacatctcgatgaggagacccagcatggcgtat

SEQ ID NO: 365843 - DNA, 140 bp, Artificial Sequence
  Synthetic
atacgccatgctgggtctccgtatcaaatgtgtgtaagaggtgtcccaagatagaggtagttagtcattgtgaaaacaaaggctttgaggatagcaatgaatgcttaacggatttggatacgtacttgggagtcggccat

SEQ ID NO: 365844 - DNA, 140 bp, Artificial Sequence
  Synthetic
atggccgactcccaagtacgtatccaaatccgttaagcattcattgctatcctcaaagcctttgttttcacaatgactaactacctctatcttgggacacctcttacacacatttgatacggagacccagcatggcgtat

SEQ ID NO: 365845 - DNA, 140 bp, Artificial Sequence
  Synthetic
aggccctggctgctgatatgcgactgcataaaatatcccacaggtcagctcatcacccatggaagagtgagtgccaaacttaacgatggaaacttaaaagataggagtgatgacgaccaagaccttttgggacagcggtg

SEQ ID NO: 365846 - DNA, 140 bp, Artificial Sequence
  Synthetic
caccgctgtcccaaaaggtcttggtcgtcatcactcctatcttttaagtttccatcgttaagtttggcactcactcttccatgggtgatgagctgacctgtgggatattttatgcagtcgcatatcagcagccagggcct

SEQ ID NO: 365847 - DNA, 140 bp, Artificial Sequence
  Synthetic
aggccctggctgctgatatggtgccaaacttaacgatggaaacttaaaagataggagtgatgacgaccaaaggctagccgagaagatagacactgttaggaaggagctttcggaaactaagaccttttgggacagcggtg

SEQ ID NO: 365848 - DNA, 140 bp, Artificial Sequence
  Synthetic
caccgctgtcccaaaaggtcttagtttccgaaagctccttcctaacagtgtctatcttctcggctagcctttggtcgtcatcactcctatcttttaagtttccatcgttaagtttggcaccatatcagcagccagggcct

SEQ ID NO: 365849 - DNA, 140 bp, Artificial Sequence
  Synthetic
atacgccatgctgggtctccagaacctttcaaaacaaggtaaatcgaagtgctccgtaccaaggtcttggcttgaaaagatattgtttgatctaaaggtgcccactaaagatgaagaagtcgtacttgggagtcggccat

SEQ ID NO: 365850 - DNA, 140 bp, Artificial Sequence
  Synthetic
atggccgactcccaagtacgacttcttcatctttagtgggcacctttagatcaaacaatatcttttcaagccaagaccttggtacggagcacttcgatttaccttgttttgaaaggttctggagacccagcatggcgtat

SEQ ID NO: 365851 - DNA, 140 bp, Artificial Sequence
  Synthetic
atacgccatgctgggtctccacaatgacaaactactcataagatcaaaggaggagttgaaaaaatgtttcgatgtgcaatcctttaaattgatgaaaaataagcagcccgtgccttttcacgtacttgggagtcggccat

SEQ ID NO: 365852 - DNA, 140 bp, Artificial Sequence
  Synthetic
atggccgactcccaagtacgtgaaaaggcacgggctgcttatttttcatcaatttaaaggattgcacatcgaaacattttttcaactcctcctttgatcttatgagtagtttgtcattgtggagacccagcatggcgtat

SEQ ID NO: 365853 - DNA, 140 bp, Artificial Sequence
  Synthetic
atacgccatgctgggtctccactgctctatatatttcccacaatcaattcatctattttagtgcaattctttctaccattagtttgcttttactgtcttaccattcttcttcctttgccacgtacttgggagtcggccat

SEQ ID NO: 365854 - DNA, 140 bp, Artificial Sequence
  Synthetic
atggccgactcccaagtacgtggcaaaggaagaagaatggtaagacagtaaaagcaaactaatggtagaaagaattgcactaaaatagatgaattgattgtgggaaatatatagagcagtggagacccagcatggcgtat

SEQ ID NO: 365855 - DNA, 140 bp, Artificial Sequence
  Synthetic
atacgccatgctgggtctccatattggtacaccttatgaaggaattatagacactttggtttccttaattaatgtattaacaaggttcacttggtttcaagaggtaatactatacgggaacgtacttgggagtcggccat

SEQ ID NO: 365856 - DNA, 140 bp, Artificial Sequence
  Synthetic
atggccgactcccaagtacgttcccgtatagtattacctcttgaaaccaagtgaaccttgttaatacattaattaaggaaaccaaagtgtctataattccttcataaggtgtaccaatatggagacccagcatggcgtat

SEQ ID NO: 365857 - DNA, 140 bp, Artificial Sequence
  Synthetic
atacgccatgctgggtctccttaaactagtcaaggtaaggcactgtgacattaacctatcggtcaagctgccatcaaacaaaaaagagaatatgttatgttgtatttacagtagtaacatcgtacttgggagtcggccat

SEQ ID NO: 365858 - DNA, 140 bp, Artificial Sequence
  Synthetic
atggccgactcccaagtacgatgttactactgtaaatacaacataacatattctcttttttgtttgatggcagcttgaccgataggttaatgtcacagtgccttaccttgactagtttaaggagacccagcatggcgtat

SEQ ID NO: 365859 - DNA, 140 bp, Artificial Sequence
  Synthetic
atacgccatgctgggtctccggagctcctacaagggcctttctatttgaatagaaggcaagctgtccttggctcatcatacctttacattgttataacactttacatacaagttctacagcgtacttgggagtcggccat

SEQ ID NO: 365860 - DNA, 140 bp, Artificial Sequence
  Synthetic
atggccgactcccaagtacgctgtagaacttgtatgtaaagtgttataacaatgtaaaggtatgatgagccaaggacagcttgccttctattcaaatagaaaggcccttgtaggagctccggagacccagcatggcgtat

SEQ ID NO: 365861 - DNA, 140 bp, Artificial Sequence
  Synthetic
atacgccatgctgggtctccagacattgaaaatcactccatgactctgctggaagatgcattcaaagaacttacttctgctcttgaaggtagattcgaagaatcttacaaaatacggactcgtacttgggagtcggccat

SEQ ID NO: 365862 - DNA, 140 bp, Artificial Sequence
  Synthetic
atggccgactcccaagtacgagtccgtattttgtaagattcttcgaatctaccttcaagagcagaagtaagttctttgaatgcatcttccagcagagtcatggagtgattttcaatgtctggagacccagcatggcgtat

SEQ ID NO: 365863 - DNA, 140 bp, Artificial Sequence
  Synthetic
atacgccatgctgggtctccctttataagcattatttcaggcttaaacttggtctatggcttcctcataaaagacaacttattagctaactcacagcaacagaacaaacaactccagatgcgtacttgggagtcggccat

SEQ ID NO: 365864 - DNA, 140 bp, Artificial Sequence
  Synthetic
atggccgactcccaagtacgcatctggagttgtttgttctgttgctgtgagttagctaataagttgtcttttatgaggaagccatagaccaagtttaagcctgaaataatgcttataaagggagacccagcatggcgtat

SEQ ID NO: 365865 - DNA, 140 bp, Artificial Sequence
  Synthetic
aggccctggctgctgatatgaagacaacttattagctaactcacagcaacagaacaaacaactccagatgcttcgttttggtatgcttgcagggctcagtaggctcgtctgtcctaatgagaccttttgggacagcggtg

SEQ ID NO: 365866 - DNA, 140 bp, Artificial Sequence
  Synthetic
caccgctgtcccaaaaggtctcattaggacagacgagcctactgagccctgcaagcataccaaaacgaagcatctggagttgtttgttctgttgctgtgagttagctaataagttgtcttcatatcagcagccagggcct

SEQ ID NO: 365867 - DNA, 140 bp, Artificial Sequence
  Synthetic
aggccctggctgctgatatggacaacattaagcactggaagcaaagagatttatgccctgaagtgaccatcccatgttttacagtttatggcacctttgtgaacagcgacagacagctgagaccttttgggacagcggtg

SEQ ID NO: 365868 - DNA, 140 bp, Artificial Sequence
  Synthetic
caccgctgtcccaaaaggtctcagctgtctgtcgctgttcacaaaggtgccataaactgtaaaacatgggatggtcacttcagggcataaatctctttgcttccagtgcttaatgttgtccatatcagcagccagggcct

SEQ ID NO: 365869 - DNA, 140 bp, Artificial Sequence
  Synthetic
atacgccatgctgggtctcccccatgttttacagtttatggcacctttgtgaacagcgacagacagctgatctttgacatttacaatgtgcatatatacaataaagagatggacaattttcgtacttgggagtcggccat

SEQ ID NO: 365870 - DNA, 140 bp, Artificial Sequence
  Synthetic
atggccgactcccaagtacgaaaattgtccatctctttattgtatatatgcacattgtaaatgtcaaagatcagctgtctgtcgctgttcacaaaggtgccataaactgtaaaacatgggggagacccagcatggcgtat

SEQ ID NO: 365871 - DNA, 140 bp, Artificial Sequence
  Synthetic
atacgccatgctgggtctcctggcctccgagcacctgctgcaccaatctcttgttggcaagcagtctccatttcaaaatgcctacaacgtcaaggggaatgccaccagtgccaacatcatcgtacttgggagtcggccat

SEQ ID NO: 365872 - DNA, 140 bp, Artificial Sequence
  Synthetic
atggccgactcccaagtacgatgatgttggcactggtggcattccccttgacgttgtaggcattttgaaatggagactgcttgccaacaagagattggtgcagcaggtgctcggaggccaggagacccagcatggcgtat

SEQ ID NO: 365873 - DNA, 140 bp, Artificial Sequence
  Synthetic
atacgccatgctgggtctccaataaagaagggaaaaaacttttaaagttaagcagcgacacttccactgacacacaaagcgttgcttctgaagtgtcagacaggaggtcttatagctcaacgtacttgggagtcggccat

SEQ ID NO: 365874 - DNA, 140 bp, Artificial Sequence
  Synthetic
atggccgactcccaagtacgttgagctataagacctcctgtctgacacttcagaagcaacgctttgtgtgtcagtggaagtgtcgctgcttaactttaaaagttttttcccttctttattggagacccagcatggcgtat

SEQ ID NO: 365875 - DNA, 140 bp, Artificial Sequence
  Synthetic
aggccctggctgctgatatgcacacaaagcgttgcttctgaagtgtcagacaggaggtcttatagctcaagcaagagtagaatccgtagcatttttgggagatacaactctcagaaaaaagaccttttgggacagcggtg

SEQ ID NO: 365876 - DNA, 140 bp, Artificial Sequence
  Synthetic
caccgctgtcccaaaaggtcttttttctgagagttgtatctcccaaaaatgctacggattctactcttgcttgagctataagacctcctgtctgacacttcagaagcaacgctttgtgtgcatatcagcagccagggcct

SEQ ID NO: 365877 - DNA, 140 bp, Artificial Sequence
  Synthetic
atacgccatgctgggtctccttatcagcaagcaataacagacgtttgtcaattttctgagtatacaccgaacaaagaaagtattttgaaggactgtcttcaaattatacgaaagaatcctcgtacttgggagtcggccat

SEQ ID NO: 365878 - DNA, 140 bp, Artificial Sequence
  Synthetic
atggccgactcccaagtacgaggattctttcgtataatttgaagacagtccttcaaaatactttctttgttcggtgtatactcagaaaattgacaaacgtctgttattgcttgctgataaggagacccagcatggcgtat

SEQ ID NO: 365879 - DNA, 140 bp, Artificial Sequence
  Synthetic
aggccctggctgctgatatgacaaagaaagtattttgaaggactgtcttcaaattatacgaaagaatcctagccacacaatgggttcttttgagctaattcaagcaatctcagagttcgggaccttttgggacagcggtg

SEQ ID NO: 365880 - DNA, 140 bp, Artificial Sequence
  Synthetic
caccgctgtcccaaaaggtcccgaactctgagattgcttgaattagctcaaaagaacccattgtgtggctaggattctttcgtataatttgaagacagtccttcaaaatactttctttgtcatatcagcagccagggcct

SEQ ID NO: 365881 - DNA, 140 bp, Artificial Sequence
  Synthetic
atacgccatgctgggtctccaaaattgggttagcatctcagaagttactgaaacaacaagtatagttgcgtcacctaaaactcatatgatgctcaaagactgctttaaaatcatactgggcgtacttgggagtcggccat

SEQ ID NO: 365882 - DNA, 140 bp, Artificial Sequence
  Synthetic
atggccgactcccaagtacgcccagtatgattttaaagcagtctttgagcatcatatgagttttaggtgacgcaactatacttgttgtttcagtaacttctgagatgctaacccaattttggagacccagcatggcgtat

SEQ ID NO: 365883 - DNA, 140 bp, Artificial Sequence
  Synthetic
aggccctggctgctgatatgtcacctaaaactcatatgatgctcaaagactgctttaaaatcatactgggtactgagaacaaaaagatagtcaaaatgcttcgagggaagctcaagaaacgaccttttgggacagcggtg

SEQ ID NO: 365884 - DNA, 140 bp, Artificial Sequence
  Synthetic
caccgctgtcccaaaaggtcgtttcttgagcttccctcgaagcattttgactatctttttgttctcagtacccagtatgattttaaagcagtctttgagcatcatatgagttttaggtgacatatcagcagccagggcct

SEQ ID NO: 365885 - DNA, 140 bp, Artificial Sequence
  Synthetic
atacgccatgctgggtctccttactcagcacggtagatggtctaacagatcaacagaaagagaatatcgtgaacgggatatttgaaccctcaaagttgtctttttaccactggaaagaatcgtacttgggagtcggccat

SEQ ID NO: 365886 - DNA, 140 bp, Artificial Sequence
  Synthetic
atggccgactcccaagtacgattctttccagtggtaaaaagacaactttgagggttcaaatatcccgttcacgatattctctttctgttgatctgttagaccatctaccgtgctgagtaaggagacccagcatggcgtat

SEQ ID NO: 365887 - DNA, 140 bp, Artificial Sequence
  Synthetic
atacgccatgctgggtctccatattctgctggctaaaaacgatctcctcctcagttaagggaagcttgaagaagagacttaagttcatgaatatacattcccctgaactgatgccagaaacgtacttgggagtcggccat

SEQ ID NO: 365888 - DNA, 140 bp, Artificial Sequence
  Synthetic
atggccgactcccaagtacgtttctggcatcagttcaggggaatgtatattcatgaacttaagtctcttcttcaagcttcccttaactgaggaggagatcgtttttagccagcagaatatggagacccagcatggcgtat

SEQ ID NO: 365889 - DNA, 140 bp, Artificial Sequence
  Synthetic
aggccctggctgctgatatggaagagacttaagttcatgaatatacattcccctgaactgatgccagaaaactgtctcttttctagtgaggaatttaatgagttgatcaagttaaagaaagaccttttgggacagcggtg

SEQ ID NO: 365890 - DNA, 140 bp, Artificial Sequence
  Synthetic
caccgctgtcccaaaaggtctttctttaacttgatcaactcattaaattcctcactagaaaagagacagttttctggcatcagttcaggggaatgtatattcatgaacttaagtctcttccatatcagcagccagggcct

SEQ ID NO: 365891 - DNA, 140 bp, Artificial Sequence
  Synthetic
atacgccatgctgggtctccgatatcttcttggattaaatgcataacagcctgtaaagattttgcaaacatcaatgataaggtccagaaattcatttatcacctttctgaagagctatatcgtacttgggagtcggccat

SEQ ID NO: 365892 - DNA, 140 bp, Artificial Sequence
  Synthetic
atggccgactcccaagtacgatatagctcttcagaaaggtgataaatgaatttctggaccttatcattgatgtttgcaaaatctttacaggctgttatgcatttaatccaagaagatatcggagacccagcatggcgtat

SEQ ID NO: 365893 - DNA, 140 bp, Artificial Sequence
  Synthetic
aggccctggctgctgatatgtcaatgataaggtccagaaattcatttatcacctttctgaagagctatatgacataaggctgcagcacctggaattgtcaaagcttaaacaagagcatccgaccttttgggacagcggtg

SEQ ID NO: 365894 - DNA, 140 bp, Artificial Sequence
  Synthetic
caccgctgtcccaaaaggtcggatgctcttgtttaagctttgacaattccaggtgctgcagccttatgtcatatagctcttcagaaaggtgataaatgaatttctggaccttatcattgacatatcagcagccagggcct

SEQ ID NO: 365895 - DNA, 140 bp, Artificial Sequence
  Synthetic
atacgccatgctgggtctccatttccttaagcagcacaatttagaaattatggaaacagtgaatcttatattctttgctgctctttcagccccttggtgcttacactacaaagcactagacgtacttgggagtcggccat

SEQ ID NO: 365896 - DNA, 140 bp, Artificial Sequence
  Synthetic
atggccgactcccaagtacgtctagtgctttgtagtgtaagcaccaaggggctgaaagagcagcaaagaatataagattcactgtttccataatttctaaattgtgctgcttaaggaaatggagacccagcatggcgtat

SEQ ID NO: 365897 - DNA, 140 bp, Artificial Sequence
  Synthetic
aggccctggctgctgatatgttctttgctgctctttcagccccttggtgcttacactacaaagcactagagtcttatctggtgaggcatccggaaatacttgactgcgggtctaaggagggaccttttgggacagcggtg

SEQ ID NO: 365898 - DNA, 140 bp, Artificial Sequence
  Synthetic
caccgctgtcccaaaaggtccctccttagacccgcagtcaagtatttccggatgcctcaccagataagactctagtgctttgtagtgtaagcaccaaggggctgaaagagcagcaaagaacatatcagcagccagggcct

SEQ ID NO: 365899 - DNA, 140 bp, Artificial Sequence
  Synthetic
atacgccatgctgggtctccttgtataaaaaagatgatgaagaactagcaagtggcttaggcttaaaacttgggtttttagtaaagtatgctgtcaccttattcacatccaatggcgagccgtacttgggagtcggccat

SEQ ID NO: 365900 - DNA, 140 bp, Artificial Sequence
  Synthetic
atggccgactcccaagtacggctcgccattggatgtgaataaggtgacagcatactttactaaaaacccaagttttaagcctaagccacttgctagttcttcatcatcttttttatacaaggagacccagcatggcgtat

SEQ ID NO: 365901 - DNA, 140 bp, Artificial Sequence
  Synthetic
aggccctggctgctgatatggaatagatccaagagggagtctaaagtgcaaataattttaacctttcctcaaggtctgaagaagtactacagcaaaatattgaaactcctacacttaactgaccttttgggacagcggtg

SEQ ID NO: 365902 - DNA, 140 bp, Artificial Sequence
  Synthetic
caccgctgtcccaaaaggtcagttaagtgtaggagtttcaatattttgctgtagtacttcttcagaccttgaggaaaggttaaaattatttgcactttagactccctcttggatctattccatatcagcagccagggcct

SEQ ID NO: 365903 - DNA, 140 bp, Artificial Sequence
  Synthetic
atacgccatgctgggtctccactactgatgaaaagttgctacatcaaacaaagatagtttttgctaaaatcggtctgtccgggaatagctatgactttatctggaccactcaaatgatagcgtacttgggagtcggccat

SEQ ID NO: 365904 - DNA, 140 bp, Artificial Sequence
  Synthetic
atggccgactcccaagtacgctatcatttgagtggtccagataaagtcatagctattcccggacagaccgattttagcaaaaactatctttgtttgatgtagcaacttttcatcagtagtggagacccagcatggcgtat

SEQ ID NO: 365905 - DNA, 140 bp, Artificial Sequence
  Synthetic
aggccctggctgctgatatgcggtctgtccgggaatagctatgactttatctggaccactcaaatgatagcaaatagcaacttcaatgtctgtaaaaggttgactggaaggagcactggggaccttttgggacagcggtg

SEQ ID NO: 365906 - DNA, 140 bp, Artificial Sequence
  Synthetic
caccgctgtcccaaaaggtccccagtgctccttccagtcaaccttttacagacattgaagttgctatttgctatcatttgagtggtccagataaagtcatagctattcccggacagaccgcatatcagcagccagggcct

SEQ ID NO: 365907 - DNA, 140 bp, Artificial Sequence
  Synthetic
atacgccatgctgggtctccattggtaggagagacaggcatggcaatattgcaacaattagcttttgcacaggcactaaattatgaacaccgtttttatgcagttttggcacctaaagcacgtacttgggagtcggccat

SEQ ID NO: 365908 - DNA, 140 bp, Artificial Sequence
  Synthetic
atggccgactcccaagtacgtgctttaggtgccaaaactgcataaaaacggtgttcataatttagtgcctgtgcaaaagctaattgttgcaatattgccatgcctgtctctcctaccaatggagacccagcatggcgtat

SEQ ID NO: 365909 - DNA, 140 bp, Artificial Sequence
  Synthetic
aggccctggctgctgatatgaggcactaaattatgaacaccgtttttatgcagttttggcacctaaagcacagctaggaggagcaagggatctgttagtgcaagaaactgggaccaaagtgaccttttgggacagcggtg

SEQ ID NO: 365910 - DNA, 140 bp, Artificial Sequence
  Synthetic
caccgctgtcccaaaaggtcactttggtcccagtttcttgcactaacagatcccttgctcctcctagctgtgctttaggtgccaaaactgcataaaaacggtgttcataatttagtgcctcatatcagcagccagggcct

SEQ ID NO: 365911 - DNA, 140 bp, Artificial Sequence
  Synthetic
atacgccatgctgggtctcccagatgacggcctcacaaacccacatcttaaagagacaattcttaatgtggggttagactgtcttaccaacatgcgaaaccttgacggaaagcccataagcgtacttgggagtcggccat

SEQ ID NO: 365912 - DNA, 140 bp, Artificial Sequence
  Synthetic
atggccgactcccaagtacgcttatgggctttccgtcaaggtttcgcatgttggtaagacagtctaaccccacattaagaattgtctctttaagatgtgggtttgtgaggccgtcatctgggagacccagcatggcgtat

SEQ ID NO: 365913 - DNA, 140 bp, Artificial Sequence
  Synthetic
aggccctggctgctgatatggggttagactgtcttaccaacatgcgaaaccttgacggaaagcccataagtgagggtagcaacttagtcaacttctacaaagttatctgcatttcgggtggaccttttgggacagcggtg

SEQ ID NO: 365914 - DNA, 140 bp, Artificial Sequence
  Synthetic
caccgctgtcccaaaaggtccacccgaaatgcagataactttgtagaagttgactaagttgctaccctcacttatgggctttccgtcaaggtttcgcatgttggtaagacagtctaaccccatatcagcagccagggcct

SEQ ID NO: 365915 - DNA, 140 bp, Artificial Sequence
  Synthetic
atacgccatgctgggtctccatgcagcaggttctaaaaaatgtccctgactggtgttcattctataagttaacattcatcaaaaacttatgtaggcaggtggaaatacctgcaggcagcacgtacttgggagtcggccat

SEQ ID NO: 365916 - DNA, 140 bp, Artificial Sequence
  Synthetic
atggccgactcccaagtacgtgctgcctgcaggtatttccacctgcctacataagtttttgatgaatgttaacttatagaatgaacaccagtcagggacattttttagaacctgctgcatggagacccagcatggcgtat

SEQ ID NO: 365917 - DNA, 140 bp, Artificial Sequence
  Synthetic
aggccctggctgctgatatgaacattcatcaaaaacttatgtaggcaggtggaaatacctgcaggcagcattaagaagatcttaaatgttcttagatacaagctatgcagcaaaggaggtgaccttttgggacagcggtg

SEQ ID NO: 365918 - DNA, 140 bp, Artificial Sequence
  Synthetic
caccgctgtcccaaaaggtcacctcctttgctgcatagcttgtatctaagaacatttaagatcttcttaatgctgcctgcaggtatttccacctgcctacataagtttttgatgaatgttcatatcagcagccagggcct

SEQ ID NO: 365919 - DNA, 140 bp, Artificial Sequence
  Synthetic
aggccctggctgctgatatgcagagcgacgtccccacggctgctcaagatatacaccccaatccaataaacagatctaaaagaaatcttgaaatggaaataattctgactttgtctcaaggaccttttgggacagcggtg

SEQ ID NO: 365920 - DNA, 140 bp, Artificial Sequence
  Synthetic
caccgctgtcccaaaaggtccttgagacaaagtcagaattatttccatttcaagatttcttttagatctgtttattggattggggtgtatatcttgagcagccgtggggacgtcgctctgcatatcagcagccagggcct

SEQ ID NO: 365921 - DNA, 140 bp, Artificial Sequence
  Synthetic
atacgccatgctgggtctccattcaccatgcaacctcttcagtgttaacttccctagctgctgtactctttgaggagctagcaattttttatctcaaaaggagcctaccacagacaacggcgtacttgggagtcggccat

SEQ ID NO: 365922 - DNA, 140 bp, Artificial Sequence
  Synthetic
atggccgactcccaagtacgccgttgtctgtggtaggctccttttgagataaaaaattgctagctcctcaaagagtacagcagctagggaagttaacactgaagaggttgcatggtgaatggagacccagcatggcgtat

SEQ ID NO: 365923 - DNA, 140 bp, Artificial Sequence
  Synthetic
atacgccatgctgggtctccgtaactggtatactttctaaagagctttattcccagtatgatgaaacgttttggaagcatgcctgtagacttaaaaacttcacagctgctgtacaaagatcgtacttgggagtcggccat

SEQ ID NO: 365924 - DNA, 140 bp, Artificial Sequence
  Synthetic
atggccgactcccaagtacgatctttgtacagcagctgtgaagtttttaagtctacaggcatgcttccaaaacgtttcatcatactgggaataaagctctttagaaagtataccagttacggagacccagcatggcgtat

SEQ ID NO: 365925 - DNA, 140 bp, Artificial Sequence
  Synthetic
aggccctggctgctgatatgtaactgggaaaggttacttcaatgatgtacttcagttcaagttgcatgacactcctaccaccactgttccggccctggccgcctcatctacagccatgccgaccttttgggacagcggtg

SEQ ID NO: 365926 - DNA, 140 bp, Artificial Sequence
  Synthetic
caccgctgtcccaaaaggtcggcatggctgtagatgaggcggccagggccggaacagtggtggtaggagtgtcatgcaacttgaactgaagtacatcattgaagtaacctttcccagttacatatcagcagccagggcct

SEQ ID NO: 365927 - DNA, 140 bp, Artificial Sequence
  Synthetic
aggccctggctgctgatatggtctgatgcaagcatgccaggtttcatctcaacaagcaatgtataatagtgttccccttgtcaccaatactgctttcaccctattaaggcaacaaattttgaccttttgggacagcggtg

SEQ ID NO: 365928 - DNA, 140 bp, Artificial Sequence
  Synthetic
caccgctgtcccaaaaggtcaaaatttgttgccttaatagggtgaaagcagtattggtgacaaggggaacactattatacattgcttgttgagatgaaacctggcatgcttgcatcagaccatatcagcagccagggcct

SEQ ID NO: 365929 - DNA, 140 bp, Artificial Sequence
  Synthetic
atacgccatgctgggtctccgttagctcggcggttgccttggaagatgctgaagtcattgctagagcagctcaaacacttcacatgaacagtgtgtcgatacagtcaagcagcttgaccacgtacttgggagtcggccat

SEQ ID NO: 365930 - DNA, 140 bp, Artificial Sequence
  Synthetic
atggccgactcccaagtacgtggtcaagctgcttgactgtatcgacacactgttcatgtgaagtgtttgagctgctctagcaatgacttcagcatcttccaaggcaaccgccgagctaacggagacccagcatggcgtat

SEQ ID NO: 365931 - DNA, 140 bp, Artificial Sequence
  Synthetic
atacgccatgctgggtctccgaaccttgtctccctttggtaggctatttgtaccgacctactcggggttggttagctcagcggttgccttggaagatgctgaagtcattgccagggcagccgtacttgggagtcggccat

SEQ ID NO: 365932 - DNA, 140 bp, Artificial Sequence
  Synthetic
atggccgactcccaagtacggctgccctggcaatgacttcagcatcttccaaggcaaccgctgagctaaccaaccccgagtaggtcggtacaaatagcctaccaaagggagacaaggttcggagacccagcatggcgtat

SEQ ID NO: 365933 - DNA, 140 bp, Artificial Sequence
  Synthetic
aggccctggctgctgatatggttagctcagcggttgccttggaagatgctgaagtcattgccagggcagctcaaacacttcacatgaatagtgtatcaatccagtcaagtagcttgactagaccttttgggacagcggtg

SEQ ID NO: 365934 - DNA, 140 bp, Artificial Sequence
  Synthetic
caccgctgtcccaaaaggtctagtcaagctacttgactggattgatacactattcatgtgaagtgtttgagctgccctggcaatgacttcagcatcttccaaggcaaccgctgagctaaccatatcagcagccagggcct

SEQ ID NO: 365935 - DNA, 140 bp, Artificial Sequence
  Synthetic
atacgccatgctgggtctccagcagtgtgagtgacacaaccgttgcctcccatgattcagggtcgtcatcatcgagcttctcttttgagctcaataggcctctgtctgaaactgaactaccgtacttgggagtcggccat

SEQ ID NO: 365936 - DNA, 140 bp, Artificial Sequence
  Synthetic
atggccgactcccaagtacggtagttcagtttcagacagaggcctattgagctcaaaagagaagctcgatgatgacgaccctgaatcatgggaggcaacggttgtgtcactcacactgctggagacccagcatggcgtat

SEQ ID NO: 365937 - DNA, 140 bp, Artificial Sequence
  Synthetic
aggccctggctgctgatatgggctgagagatggtaagagaagagggaatctggaactagcaaacagaatccaatctgtactgtgtgttttgatagcagggtattacaggtcattcggtgggaccttttgggacagcggtg

SEQ ID NO: 365938 - DNA, 140 bp, Artificial Sequence
  Synthetic
caccgctgtcccaaaaggtcccaccgaatgacctgtaataccctgctatcaaaacacacagtacagattggattctgtttgctagttccagattccctcttctcttaccatctctcagcccatatcagcagccagggcct

SEQ ID NO: 365939 - DNA, 140 bp, Artificial Sequence
  Synthetic
atacgccatgctgggtctccagaagggaccgagaaacaagtgaaggcatcattgaatagagacgacaacaaaataattgaagaccctatgatacaactgattccagagaaactgaggagacgtacttgggagtcggccat

SEQ ID NO: 365940 - DNA, 140 bp, Artificial Sequence
  Synthetic
atggccgactcccaagtacgtctcctcagtttctctggaatcagttgtatcatagggtcttcaattattttgttgtcgtctctattcaatgatgccttcacttgtttctcggtcccttctggagacccagcatggcgtat

SEQ ID NO: 365941 - DNA, 140 bp, Artificial Sequence
  Synthetic
aggccctggctgctgatatgtctctgctaaatgttacccaagagcatcaaactcaggaatgcagctaatcaatgtcacacaacacccaatgaagatagccaacactccgggccctaaaacgaccttttgggacagcggtg

SEQ ID NO: 365942 - DNA, 140 bp, Artificial Sequence
  Synthetic
caccgctgtcccaaaaggtcgttttagggcccggagtgttggctatcttcattgggtgttgtgtgacattgattagctgcattcctgagtttgatgctcttgggtaacatttagcagagacatatcagcagccagggcct

SEQ ID NO: 365943 - DNA, 140 bp, Artificial Sequence
  Synthetic
atacgccatgctgggtctccaagcattagccctgatgatactttagctcagcttgtggcaaaaaagctcatcagtctcaatgtttctacggaagaatactctgctgaagtgtctaggctccgtacttgggagtcggccat

SEQ ID NO: 365944 - DNA, 140 bp, Artificial Sequence
  Synthetic
atggccgactcccaagtacggagcctagacacttcagcagagtattcttccgtagaaacattgagactgatgagcttttttgccacaagctgagctaaagtatcatcagggctaatgcttggagacccagcatggcgtat

SEQ ID NO: 365945 - DNA, 140 bp, Artificial Sequence
  Synthetic
aggccctggctgctgatatgtcagtctcaatgtttctacggaagaatactctgctgaagtgtctaggctcaaacaaacacttacagcccgaaatgttttgcacgggttagctggaggaatgaccttttgggacagcggtg

SEQ ID NO: 365946 - DNA, 140 bp, Artificial Sequence
  Synthetic
caccgctgtcccaaaaggtcattcctccagctaacccgtgcaaaacatttcgggctgtaagtgtttgtttgagcctagacacttcagcagagtattcttccgtagaaacattgagactgacatatcagcagccagggcct

SEQ ID NO: 365947 - DNA, 140 bp, Artificial Sequence
  Synthetic
atacgccatgctgggtctcctcaaagacaacgttttcttgtcactaacagacaggtggtctaccaagcacagcacaaactaccgtgacagctgcggcaaacaactgactggtagaataatcgtacttgggagtcggccat

SEQ ID NO: 365948 - DNA, 140 bp, Artificial Sequence
  Synthetic
atggccgactcccaagtacgattattctaccagtcagttgtttgccgcagctgtcacggtagtttgtgctgtgcttggtagaccacctgtctgttagtgacaagaaaacgttgtctttgaggagacccagcatggcgtat

SEQ ID NO: 365949 - DNA, 140 bp, Artificial Sequence
  Synthetic
aggccctggctgctgatatgagcacaaactaccgtgacagctgcggcaaacaactgactggtagaataatcaccaagtatactcactggctagacacttttctgagctgctctgtctccagaccttttgggacagcggtg

SEQ ID NO: 365950 - DNA, 140 bp, Artificial Sequence
  Synthetic
caccgctgtcccaaaaggtctggagacagagcagctcagaaaagtgtctagccagtgagtatacttggtgattattctaccagtcagttgtttgccgcagctgtcacggtagtttgtgctcatatcagcagccagggcct

SEQ ID NO: 365951 - DNA, 140 bp, Artificial Sequence
  Synthetic
atacgccatgctgggtctccagatgtgttaatctaatcacatttgaagacggcctgagggaactctcagtgatacaaagtcatctcaaagtcttcgagagtgaattcaccaacttaaatccgtacttgggagtcggccat

SEQ ID NO: 365952 - DNA, 140 bp, Artificial Sequence
  Synthetic
atggccgactcccaagtacggatttaagttggtgaattcactctcgaagactttgagatgactttgtatcactgagagttccctcaggccgtcttcaaatgtgattagattaacacatctggagacccagcatggcgtat

SEQ ID NO: 365953 - DNA, 140 bp, Artificial Sequence
  Synthetic
aggccctggctgctgatatggatacaaagtcatctcaaagtcttcgagagtgaattcaccaacttaaatcttcagttctctgatccaaacagacagaagctcagaatagttgagtccagagaccttttgggacagcggtg

SEQ ID NO: 365954 - DNA, 140 bp, Artificial Sequence
  Synthetic
caccgctgtcccaaaaggtctctggactcaactattctgagcttctgtctgtttggatcagagaactgaagatttaagttggtgaattcactctcgaagactttgagatgactttgtatccatatcagcagccagggcct

SEQ ID NO: 365955 - DNA, 140 bp, Artificial Sequence
  Synthetic
atacgccatgctgggtctccactgttttcagcaactgaacaggttcgactatctaacaaccctgcagttgtcatgggctacttattagatgaatcagcaatttctgaagtcaagcctacgcgtacttgggagtcggccat

SEQ ID NO: 365956 - DNA, 140 bp, Artificial Sequence
  Synthetic
atggccgactcccaagtacgcgtaggcttgacttcagaaattgctgattcatctaataagtagcccatgacaactgcagggttgttagatagtcgaacctgttcagttgctgaaaacagtggagacccagcatggcgtat

SEQ ID NO: 365957 - DNA, 140 bp, Artificial Sequence
  Synthetic
aggccctggctgctgatatgtcatgggctacttattagatgaatcagcaatttctgaagtcaagcctacgaaggttgacttttcaaacctacttaaagaccgctttaaattaatgcaattgaccttttgggacagcggtg

SEQ ID NO: 365958 - DNA, 140 bp, Artificial Sequence
  Synthetic
caccgctgtcccaaaaggtcaattgcattaatttaaagcggtctttaagtaggtttgaaaagtcaaccttcgtaggcttgacttcagaaattgctgattcatctaataagtagcccatgacatatcagcagccagggcct

SEQ ID NO: 365959 - DNA, 140 bp, Artificial Sequence
  Synthetic
atacgccatgctgggtctccactcagagaagaatggtcttagtccagatttgcaacaggttgcaaggtactcaaaccatttgactttgcttagtaggatgatacaacaagcaaagccaaccgtacttgggagtcggccat

SEQ ID NO: 365960 - DNA, 140 bp, Artificial Sequence
  Synthetic
atggccgactcccaagtacggttggctttgcttgttgtatcatcctactaagcaaagtcaaatggtttgagtaccttgcaacctgttgcaaatctggactaagaccattcttctctgagtggagacccagcatggcgtat

SEQ ID NO: 365961 - DNA, 140 bp, Artificial Sequence
  Synthetic
aggccctggctgctgatatgtcaaaccatttgactttgcttagtaggatgatacaacaagcaaagccaactgtaaccgttttctacatgctaaagggtaacctgatgaacacggaaccgagaccttttgggacagcggtg

SEQ ID NO: 365962 - DNA, 140 bp, Artificial Sequence
  Synthetic
caccgctgtcccaaaaggtctcggttccgtgttcatcaggttaccctttagcatgtagaaaacggttacagttggctttgcttgttgtatcatcctactaagcaaagtcaaatggtttgacatatcagcagccagggcct

SEQ ID NO: 365963 - DNA, 140 bp, Artificial Sequence
  Synthetic
atacgccatgctgggtctccctctctgatactggaattgacgcaagtacatattctgtgaaatactggaagattcttcactgcatttctgccatcggatgtctacctctaagtcaagcagcgtacttgggagtcggccat

SEQ ID NO: 365964 - DNA, 140 bp, Artificial Sequence
  Synthetic
atggccgactcccaagtacgctgcttgacttagaggtagacatccgatggcagaaatgcagtgaagaatcttccagtatttcacagaatatgtacttgcgtcaattccagtatcagagagggagacccagcatggcgtat

SEQ ID NO: 365965 - DNA, 140 bp, Artificial Sequence
  Synthetic
aggccctggctgctgatatggattcttcactgcatttctgccatcggatgtctacctctaagtcaagcagataagtcttcgctgcttatgagtttcctaaactggagggtaaatatggacgaccttttgggacagcggtg

SEQ ID NO: 365966 - DNA, 140 bp, Artificial Sequence
  Synthetic
caccgctgtcccaaaaggtcgtccatatttaccctccagtttaggaaactcataagcagcgaagacttatctgcttgacttagaggtagacatccgatggcagaaatgcagtgaagaatccatatcagcagccagggcct

SEQ ID NO: 365967 - DNA, 140 bp, Artificial Sequence
  Synthetic
atacgccatgctgggtctcctgaattcgatggacaagtcattgctaatatacttgccagtgaactgagttctgtgaagcgagactctgaacgcgaaggtctaactgatctccttgactaccgtacttgggagtcggccat

SEQ ID NO: 365968 - DNA, 140 bp, Artificial Sequence
  Synthetic
atggccgactcccaagtacggtagtcaaggagatcagttagaccttcgcgttcagagtctcgcttcacagaactcagttcactggcaagtatattagcaatgacttgtccatcgaattcaggagacccagcatggcgtat

SEQ ID NO: 365969 - DNA, 140 bp, Artificial Sequence
  Synthetic
aggccctggctgctgatatgctgtgaagcgagactctgaacgcgaaggtctaactgatctccttgactacctaaactcacccactgaactgttgaagaagaagccgtatttaggaacaacgaccttttgggacagcggtg

SEQ ID NO: 365970 - DNA, 140 bp, Artificial Sequence
  Synthetic
caccgctgtcccaaaaggtcgttgttcctaaatacggcttcttcttcaacagttcagtgggtgagtttaggtagtcaaggagatcagttagaccttcgcgttcagagtctcgcttcacagcatatcagcagccagggcct

SEQ ID NO: 365971 - DNA, 140 bp, Artificial Sequence
  Synthetic
atacgccatgctgggtctccatagtagcagatctggagaatcaattggcattttcattgctggaaagttgcacgttcatctctcttctgagtccattgccttgttgtgtgagactgagagcgtacttgggagtcggccat

SEQ ID NO: 365972 - DNA, 140 bp, Artificial Sequence
  Synthetic
atggccgactcccaagtacgctctcagtctcacacaacaaggcaatggactcagaagagagatgaacgtgcaactttccagcaatgaaaatgccaattgattctccagatctgctactatggagacccagcatggcgtat

SEQ ID NO: 365973 - DNA, 140 bp, Artificial Sequence
  Synthetic
aggccctggctgctgatatgcacgttcatctctcttctgagtccattgccttgttgtgtgagactgagaggcaagtgctctcttggatgagcaagaggaggactgaagtaataactaaaggaccttttgggacagcggtg

SEQ ID NO: 365974 - DNA, 140 bp, Artificial Sequence
  Synthetic
caccgctgtcccaaaaggtcctttagttattacttcagtcctcctcttgctcatccaagagagcacttgcctctcagtctcacacaacaaggcaatggactcagaagagagatgaacgtgcatatcagcagccagggcct

SEQ ID NO: 365975 - DNA, 140 bp, Artificial Sequence
  Synthetic
atacgccatgctgggtctcccaaaagcacaaagatggtagtgcactatcagtcatacctgataacagcaatcctcgacttcttaaatttgtgcccctcaagaagggtctggcagtggtgacgtacttgggagtcggccat

SEQ ID NO: 365976 - DNA, 140 bp, Artificial Sequence
  Synthetic
atggccgactcccaagtacgtcaccactgccagacccttcttgaggggcacaaatttaagaagtcgaggattgctgttatcaggtatgactgatagtgcactaccatctttgtgcttttgggagacccagcatggcgtat

SEQ ID NO: 365977 - DNA, 140 bp, Artificial Sequence
  Synthetic
aggccctggctgctgatatgtcctcgacttcttaaatttgtgcccctcaagaagggtctggcagtggtgaaaatcaaaaaacaaattttgacagtgaagaaacaagttgtacttgatgctgaccttttgggacagcggtg

SEQ ID NO: 365978 - DNA, 140 bp, Artificial Sequence
  Synthetic
caccgctgtcccaaaaggtcagcatcaagtacaacttgtttcttcactgtcaaaatttgttttttgattttcaccactgccagacccttcttgaggggcacaaatttaagaagtcgaggacatatcagcagccagggcct

SEQ ID NO: 365979 - DNA, 140 bp, Artificial Sequence
  Synthetic
atacgccatgctgggtctcctgatgagacagacactcagaccacataccacgagaaccttctgaaggtgaagcagcttgttgactgctccacagacaggaagaagcttttaccacagtcgcgtacttgggagtcggccat

SEQ ID NO: 365980 - DNA, 140 bp, Artificial Sequence
  Synthetic
atggccgactcccaagtacgcgactgtggtaaaagcttcttcctgtctgtggagcagtcaacaagctgcttcaccttcagaaggttctcgtggtatgtggtctgagtgtctgtctcatcaggagacccagcatggcgtat

SEQ ID NO: 365981 - DNA, 140 bp, Artificial Sequence
  Synthetic
aggccctggctgctgatatgagcagcttgttgactgctccacagacaggaagaagcttttaccacagtcggtgttttctgactccaaagttgtcctctcaaggattaagttcaaaacggagaccttttgggacagcggtg

SEQ ID NO: 365982 - DNA, 140 bp, Artificial Sequence
  Synthetic
caccgctgtcccaaaaggtctccgttttgaacttaatccttgagaggacaactttggagtcagaaaacaccgactgtggtaaaagcttcttcctgtctgtggagcagtcaacaagctgctcatatcagcagccagggcct

SEQ ID NO: 365983 - DNA, 140 bp, Artificial Sequence
  Synthetic
atacgccatgctgggtctccccagtgatgctatcatggaagtggagagcaaaagtggcttgttacacaagtacctcaaatcgggaggtgtcaggcagcgaaacactgaagtgcttttcagcgtacttgggagtcggccat

SEQ ID NO: 365984 - DNA, 140 bp, Artificial Sequence
  Synthetic
atggccgactcccaagtacgctgaaaagcacttcagtgtttcgctgcctgacacctcccgatttgaggtacttgtgtaacaagccacttttgctctccacttccatgatagcatcactggggagacccagcatggcgtat

SEQ ID NO: 365985 - DNA, 140 bp, Artificial Sequence
  Synthetic
aggccctggctgctgatatgtacctcaaatcgggaggtgtcaggcagcgaaacactgaagtgcttttcagagagaagttaaacaagattgttataaaggacaacctcgagcaaggtgcaggaccttttgggacagcggtg

SEQ ID NO: 365986 - DNA, 140 bp, Artificial Sequence
  Synthetic
caccgctgtcccaaaaggtcctgcaccttgctcgaggttgtcctttataacaatcttgtttaacttctctctgaaaagcacttcagtgtttcgctgcctgacacctcccgatttgaggtacatatcagcagccagggcct

SEQ ID NO: 365987 - DNA, 140 bp, Artificial Sequence
  Synthetic
atacgccatgctgggtctccactgacgaaaagctactacatcaaacaaagatagtttttgctaaaattggtttatctgggaacagttatgactttatctggactactcagatgatagcaacgtacttgggagtcggccat

SEQ ID NO: 365988 - DNA, 140 bp, Artificial Sequence
  Synthetic
atggccgactcccaagtacgttgctatcatctgagtagtccagataaagtcataactgttcccagataaaccaattttagcaaaaactatctttgtttgatgtagtagcttttcgtcagtggagacccagcatggcgtat

SEQ ID NO: 365989 - DNA, 140 bp, Artificial Sequence
  Synthetic
atacgccatgctgggtctccccactgccactcagctgctggtcagaggttcagaactacattgaagacataggcttcaacaatgtgcttgtcaacattgatagaaacacggttaaaagtgcgtacttgggagtcggccat

SEQ ID NO: 365990 - DNA, 140 bp, Artificial Sequence
  Synthetic
atggccgactcccaagtacgcacttttaaccgtgtttctatcaatgttgacaagcacattgttgaagcctatgtcttcaatgtagttctgaacctctgaccagcagctgagtggcagtggggagacccagcatggcgtat

SEQ ID NO: 365991 - DNA, 140 bp, Artificial Sequence
  Synthetic
aggccctggctgctgatatgaggcttcaacaatgtgcttgtcaacattgatagaaacacggttaaaagtgagcttctgtggaaatttacgctggacaccaatgtgagtactacaagtaccgaccttttgggacagcggtg

SEQ ID NO: 365992 - DNA, 140 bp, Artificial Sequence
  Synthetic
caccgctgtcccaaaaggtcggtacttgtagtactcacattggtgtccagcgtaaatttccacagaagctcacttttaaccgtgtttctatcaatgttgacaagcacattgttgaagcctcatatcagcagccagggcct

SEQ ID NO: 365993 - DNA, 140 bp, Artificial Sequence
  Synthetic
aggccctggctgctgatatgcaacaggttctaaaaaatgtaccagattggtgttcattttataaattaacattcattaagaacttatgtagacaggtagaaatacctgctggcagtattagaccttttgggacagcggtg

SEQ ID NO: 365994 - DNA, 140 bp, Artificial Sequence
  Synthetic
caccgctgtcccaaaaggtctaatactgccagcaggtatttctacctgtctacataagttcttaatgaatgttaatttataaaatgaacaccaatctggtacattttttagaacctgttgcatatcagcagccagggcct

SEQ ID NO: 365995 - DNA, 140 bp, Artificial Sequence
  Synthetic
atacgccatgctgggtctccgacctagaactagaaagcttgctcaccttgtgtgctttctacttccagaatgagtgcagtaagagagacgggcctaggtgttccttcgcagcacttttaacgtacttgggagtcggccat

SEQ ID NO: 365996 - DNA, 140 bp, Artificial Sequence
  Synthetic
atggccgactcccaagtacgttaaaagtgctgcgaaggaacacctaggcccgtctctcttactgcactcattctggaagtagaaagcacacaaggtgagcaagctttctagttctaggtcggagacccagcatggcgtat

SEQ ID NO: 365997 - DNA, 140 bp, Artificial Sequence
  Synthetic
aggccctggctgctgatatgtgagtgcagtaagagagacgggcctaggtgttccttcgcagcacttttaagtctagttcatgaggattggcaaaagatagggaagaatatccttgttcgtgaccttttgggacagcggtg

SEQ ID NO: 365998 - DNA, 140 bp, Artificial Sequence
  Synthetic
caccgctgtcccaaaaggtcacgaacaaggatattcttccctatcttttgccaatcctcatgaactagacttaaaagtgctgcgaaggaacacctaggcccgtctctcttactgcactcacatatcagcagccagggcct

SEQ ID NO: 365999 - DNA, 140 bp, Artificial Sequence
  Synthetic
aggccctggctgctgatatggcctctcaaagacatgtctaagtcaaagcctgagagagtagtcatagctagaaggtcactaaatcatgccctgtctttgatatttttggatgagatgtcagaccttttgggacagcggtg

SEQ ID NO: 366000 - DNA, 140 bp, Artificial Sequence
  Synthetic
caccgctgtcccaaaaggtctgacatctcatccaaaaatatcaaagacagggcatgatttagtgaccttctagctatgactactctctcaggctttgacttagacatgtctttgagaggccatatcagcagccagggcct

SEQ ID NO: 366001 - DNA, 140 bp, Artificial Sequence
  Synthetic
atacgccatgctgggtctccagggcaagagtgctttgagttcaccgttttgaaagacaatagtacaaggctagattacaataagttgattgatcactgtgtggacatggagaagaaaaggcgtacttgggagtcggccat

SEQ ID NO: 366002 - DNA, 140 bp, Artificial Sequence
  Synthetic
atggccgactcccaagtacgccttttcttctccatgtccacacagtgatcaatcaacttattgtaatctagccttgtactattgtctttcaaaacggtgaactcaaagcactcttgccctggagacccagcatggcgtat

SEQ ID NO: 366003 - DNA, 140 bp, Artificial Sequence
  Synthetic
aggccctggctgctgatatgtagattacaataagttgattgatcactgtgtggacatggagaagaaaagggatgcagtcagagcagtggaagatttggttttaatgttaacaggtagggcgaccttttgggacagcggtg

SEQ ID NO: 366004 - DNA, 140 bp, Artificial Sequence
  Synthetic
caccgctgtcccaaaaggtcgccctacctgttaacattaaaaccaaatcttccactgctctgactgcatcccttttcttctccatgtccacacagtgatcaatcaacttattgtaatctacatatcagcagccagggcct

SEQ ID NO: 366005 - DNA, 140 bp, Artificial Sequence
  Synthetic
atacgccatgctgggtctccaagagcaaataagcctggatgatctaatggcaagtgacacagtggcagacccacctgatgaggaagcagaagccctcagaacaggcaatcttggcttcaacgtacttgggagtcggccat

SEQ ID NO: 366006 - DNA, 140 bp, Artificial Sequence
  Synthetic
atggccgactcccaagtacgttgaagccaagattgcctgttctgagggcttctgcttcctcatcaggtgggtctgccactgtgtcacttgccattagatcatccaggcttatttgctcttggagacccagcatggcgtat

SEQ ID NO: 366007 - DNA, 140 bp, Artificial Sequence
  Synthetic
aggccctggctgctgatatgagaattggtgaagttatgtcgttgcggcagctagggcataaattactaacacgagacaaacaaatcaagcaagaattctctagaatgaagctttatgttagaccttttgggacagcggtg

SEQ ID NO: 366008 - DNA, 140 bp, Artificial Sequence
  Synthetic
caccgctgtcccaaaaggtctaacataaagcttcattctagagaattcttgcttgatttgtttgtctcgtgttagtaatttatgccctagctgccgcaacgacataacttcaccaattctcatatcagcagccagggcct

SEQ ID NO: 366009 - DNA, 140 bp, Artificial Sequence
  Synthetic
atacgccatgctgggtctccaaactttcaaacaagtcaaatactctatatttcccacagtcaattcatctattttagtgctattctttcaaccattagtttgcctttaccatcctgccttcgtacttgggagtcggccat

SEQ ID NO: 366010 - DNA, 140 bp, Artificial Sequence
  Synthetic
atggccgactcccaagtacgaaggcaggatggtaaaggcaaactaatggttgaaagaatagcactaaaatagatgaattgactgtgggaaatatagagtatttgacttgtttgaaagtttggagacccagcatggcgtat

SEQ ID NO: 366011 - DNA, 140 bp, Artificial Sequence
  Synthetic
aggccctggctgctgatatgattttagtgctattctttcaaccattagtttgcctttaccatcctgcctttcttctcctttcaccgttcatttcagtttgattatttctagggtgtgggggaccttttgggacagcggtg

SEQ ID NO: 366012 - DNA, 140 bp, Artificial Sequence
  Synthetic
caccgctgtcccaaaaggtcccccacaccctagaaataatcaaactgaaatgaacggtgaaaggagaagaaaggcaggatggtaaaggcaaactaatggttgaaagaatagcactaaaatcatatcagcagccagggcct

SEQ ID NO: 366013 - DNA, 140 bp, Artificial Sequence
  Synthetic
atacgccatgctgggtctcctctcaaagaaacacgtgccgcttacgcccatagtgttctcttgagtgttagcaaaatggaaaacaaaatcgaggtgaataacaaggatgaaatgaacaagcgtacttgggagtcggccat

SEQ ID NO: 366014 - DNA, 140 bp, Artificial Sequence
  Synthetic
atggccgactcccaagtacgcttgttcatttcatccttgttattcacctcgattttgttttccattttgctaacactcaagagaacactatgggcgtaagcggcacgtgtttctttgagaggagacccagcatggcgtat

SEQ ID NO: 366015 - DNA, 140 bp, Artificial Sequence
  Synthetic
aggccctggctgctgatatgccacaatcgtggaccaaaggcttggtagcgaactaggttgctacacaattaaccgcgtgaagacttataagctttgtgagaacagtgccacagaaaaggggaccttttgggacagcggtg

SEQ ID NO: 366016 - DNA, 140 bp, Artificial Sequence
  Synthetic
caccgctgtcccaaaaggtccccttttctgtggcactgttctcacaaagcttataagtcttcacgcggttaattgtgtagcaacctagttcgctaccaagcctttggtccacgattgtggcatatcagcagccagggcct

SEQ ID NO: 366017 - DNA, 140 bp, Artificial Sequence
  Synthetic
atacgccatgctgggtctccgctctggtggaggcaacaaaattttgtgcacctatatatgagtgtgcatgggttagctccactggcattgtgaagaggggacttgaatggttcgaaaaaacgtacttgggagtcggccat

SEQ ID NO: 366018 - DNA, 140 bp, Artificial Sequence
  Synthetic
atggccgactcccaagtacgttttttcgaaccattcaagtcccctcttcacaatgccagtggagctaacccatgcacactcatatataggtgcacaaaattttgttgcctccaccagagcggagacccagcatggcgtat

SEQ ID NO: 366019 - DNA, 140 bp, Artificial Sequence
  Synthetic
aggccctggctgctgatatgctcatagacagtcaaacgcaactgaacacaacggaacaaacaccaccacagcacccagcacaagtcaaagccccaagcctcttgtgagcacagccccaccgaccttttgggacagcggtg

SEQ ID NO: 366020 - DNA, 140 bp, Artificial Sequence
  Synthetic
caccgctgtcccaaaaggtcggtggggctgtgctcacaagaggcttggggctttgacttgtgctgggtgctgtggtggtgtttgttccgttgtgttcagttgcgtttgactgtctatgagcatatcagcagccagggcct

SEQ ID NO: 366021 - DNA, 140 bp, Artificial Sequence
  Synthetic
atacgccatgctgggtctccgtcaaagagatgctgtcagacatgattaggagaaggaaccagattctaaacaggggtggtgatgagaatccacgtggccctgtgagccgtgagcatgtggcgtacttgggagtcggccat

SEQ ID NO: 366022 - DNA, 140 bp, Artificial Sequence
  Synthetic
atggccgactcccaagtacgccacatgctcacggctcacagggccacgtggattctcatcaccacccctgtttagaatctggttccttctcctaatcatgtctgacagcatctctttgacggagacccagcatggcgtat

SEQ ID NO: 366023 - DNA, 140 bp, Artificial Sequence
  Synthetic
aggccctggctgctgatatgccatggggggacatcaacaagtcaggccgttcaggaatagcacttgttgcaacaggccttgccaagcttgcagagactgaaggaaagggagtttttgacggaccttttgggacagcggtg

SEQ ID NO: 366024 - DNA, 140 bp, Artificial Sequence
  Synthetic
caccgctgtcccaaaaggtccgtcaaaaactccctttccttcagtctctgcaagcttggcaaggcctgttgcaacaagtgctattcctgaacggcctgacttgttgatgtccccccatggcatatcagcagccagggcct

SEQ ID NO: 366025 - DNA, 140 bp, Artificial Sequence
  Synthetic
atacgccatgctgggtctccaagtaacccaagagggcaggggccatgtgaaactatctagaggaacggaaattgtcctggatgtgtgtgacaccagttgtgagttgatgatacctaaaggcgtacttgggagtcggccat

SEQ ID NO: 366026 - DNA, 140 bp, Artificial Sequence
  Synthetic
atggccgactcccaagtacgcctttaggtatcatcaactcacaactggtgtcacacacatccaggacaatttccgttcctctagatagtttcacatggcccctgccctcttgggttacttggagacccagcatggcgtat

SEQ ID NO: 366027 - DNA, 140 bp, Artificial Sequence
  Synthetic
aggccctggctgctgatatgaggcagaatcagtgaaatgggagtctgctttgggacaatccccgtggccaaccctgatgatgctgcccaaggatctggacataccaagtccattctcaacgaccttttgggacagcggtg

SEQ ID NO: 366028 - DNA, 140 bp, Artificial Sequence
  Synthetic
caccgctgtcccaaaaggtcgttgagaatggacttggtatgtccagatccttgggcagcatcatcagggttggccacggggattgtcccaaagcagactcccatttcactgattctgcctcatatcagcagccagggcct

SEQ ID NO: 366029 - DNA, 140 bp, Artificial Sequence
  Synthetic
aggccctggctgctgatatgatgcttagtggcatttttggcaatgtttttgtaggcattttcttatttcttgccccctttatcttgttaatacttttcttcatgtttggatggaggatccgaccttttgggacagcggtg

SEQ ID NO: 366030 - DNA, 140 bp, Artificial Sequence
  Synthetic
caccgctgtcccaaaaggtcggatcctccatccaaacatgaagaaaagtattaacaagataaagggggcaagaaataagaaaatgcctacaaaaacattgccaaaaatgccactaagcatcatatcagcagccagggcct

SEQ ID NO: 366031 - DNA, 140 bp, Artificial Sequence
  Synthetic
aggccctggctgctgatatgtggcctctgagcacttgctgcaccagtctcttgttggcaagcaatctccattccagaacgcctacaatgtcaagggcaatgccactagtgctaacatcatgaccttttgggacagcggtg

SEQ ID NO: 366032 - DNA, 140 bp, Artificial Sequence
  Synthetic
caccgctgtcccaaaaggtcatgatgttagcactagtggcattgcccttgacattgtaggcgttctggaatggagattgcttgccaacaagagactggtgcagcaagtgctcagaggccacatatcagcagccagggcct

SEQ ID NO: 366033 - DNA, 140 bp, Artificial Sequence
  Synthetic
aggccctggctgctgatatggtagtgccttattcgggaagcaggtaaacaagcttcagaattgctttaggaccataagccctgtcagcctgcttgctttaagaaacctggactttgactggaccttttgggacagcggtg

SEQ ID NO: 366034 - DNA, 140 bp, Artificial Sequence
  Synthetic
caccgctgtcccaaaaggtccagtcaaagtccaggtttcttaaagcaagcaggctgacagggcttatggtcctaaagcaattctgaagcttgtttacctgcttcccgaataaggcactaccatatcagcagccagggcct

SEQ ID NO: 366035 - DNA, 140 bp, Artificial Sequence
  Synthetic
atacgccatgctgggtctcccatctcaaagacgatgaagaaactggttacagaaggatcattgaaagactgaacaacaagaaggggaaaaacaagctgcttgacggtgaaagacttgccgcgtacttgggagtcggccat

SEQ ID NO: 366036 - DNA, 140 bp, Artificial Sequence
  Synthetic
atggccgactcccaagtacgcggcaagtctttcaccgtcaagcagcttgtttttccccttcttgttgttcagtctttcaatgatccttctgtaaccagtttcttcatcgtctttgagatgggagacccagcatggcgtat

SEQ ID NO: 366037 - DNA, 140 bp, Artificial Sequence
  Synthetic
atacgccatgctgggtctccccttggggggacatcaacaaatcaggccgttcgggaatagcacttgttgcaacaggccttgccaagcttgcagagaccgaggggaaaggagtttttgacgcgtacttgggagtcggccat

SEQ ID NO: 366038 - DNA, 140 bp, Artificial Sequence
  Synthetic
atggccgactcccaagtacgcgtcaaaaactcctttcccctcggtctctgcaagcttggcaaggcctgttgcaacaagtgctattcccgaacggcctgatttgttgatgtccccccaaggggagacccagcatggcgtat

SEQ ID NO: 366039 - DNA, 140 bp, Artificial Sequence
  Synthetic
aggccctggctgctgatatgaacaggccttgccaagcttgcagagaccgaggggaaaggagtttttgacgaagccaagaagaccgtggaggctctcaatgggtatttggacaagcacagggaccttttgggacagcggtg

SEQ ID NO: 366040 - DNA, 140 bp, Artificial Sequence
  Synthetic
caccgctgtcccaaaaggtccctgtgcttgtccaaatacccattgagagcctccacggtcttcttggcttcgtcaaaaactcctttcccctcggtctctgcaagcttggcaaggcctgttcatatcagcagccagggcct

SEQ ID NO: 366041 - DNA, 140 bp, Artificial Sequence
  Synthetic
atacgccatgctgggtctcccttcaaacaagccaactgctctgcattcctctcagtcagctcaattgctttaactggtccactttgcaaacctaccagtcctctatttctcaaccatttacgtacttgggagtcggccat

SEQ ID NO: 366042 - DNA, 140 bp, Artificial Sequence
  Synthetic
atggccgactcccaagtacgtaaatggttgagaaatagaggactggtaggtttgcaaagtggaccagttaaagcaattgagctgactgagaggaatgcagagcagttggcttgtttgaagggagacccagcatggcgtat

SEQ ID NO: 366043 - DNA, 140 bp, Artificial Sequence
  Synthetic
aggccctggctgctgatatgtaactggtccactttgcaaacctaccagtcctctatttctcaaccatttatttcggtttcatcattgttattcttttggggtgtggggggaacgatttctgaccttttgggacagcggtg

SEQ ID NO: 366044 - DNA, 140 bp, Artificial Sequence
  Synthetic
caccgctgtcccaaaaggtcagaaatcgttccccccacaccccaaaagaataacaatgatgaaaccgaaataaatggttgagaaatagaggactggtaggtttgcaaagtggaccagttacatatcagcagccagggcct

SEQ ID NO: 366045 - DNA, 140 bp, Artificial Sequence
  Synthetic
aggccctggctgctgatatggaacaacaagaaggggaaaaacaagctgcttgacggtgaaagacttgccgatagaaggattgccgaactattctccacaaaaacacacattggctagatcgaccttttgggacagcggtg

SEQ ID NO: 366046 - DNA, 140 bp, Artificial Sequence
  Synthetic
caccgctgtcccaaaaggtcgatctagccaatgtgtgtttttgtggagaatagttcggcaatccttctatcggcaagtctttcaccgtcaagcagcttgtttttccccttcttgttgttccatatcagcagccagggcct

SEQ ID NO: 366047 - DNA, 140 bp, Artificial Sequence
  Synthetic
aggccctggctgctgatatgaagtgggttgagcatcttaattgcagcatacctgctgacatcatgcatatatcattaatatatgcaatcctttgcctacagctgtgtggtctgggagagagaccttttgggacagcggtg

SEQ ID NO: 366048 - DNA, 140 bp, Artificial Sequence
  Synthetic
caccgctgtcccaaaaggtctctctcccagaccacacagctgtaggcaaaggattgcatatattaatgatatatgcatgatgtcagcaggtatgctgcaattaagatgctcaacccacttcatatcagcagccagggcct

SEQ ID NO: 366049 - DNA, 140 bp, Artificial Sequence
  Synthetic
atacgccatgctgggtctccatcattaatatatgcaatcctttgcctacagctgtgtggtctgggagagactcatggatcacacaatgaaactagacacaataaaacagacaccataacacgtacttgggagtcggccat

SEQ ID NO: 366050 - DNA, 140 bp, Artificial Sequence
  Synthetic
atggccgactcccaagtacgtgttatggtgtctgttttattgtgtctagtttcattgtgtgatccatgagtctctcccagaccacacagctgtaggcaaaggattgcatatattaatgatggagacccagcatggcgtat

SEQ ID NO: 366051 - DNA, 140 bp, Artificial Sequence
  Synthetic
atacgccatgctgggtctccatcctgatgacgctgctcagggatctggacataccaagtccattctcaaccttcggacaagcacagagaccaacaatccatgcgccaagacaattgtcaacgtacttgggagtcggccat

SEQ ID NO: 366052 - DNA, 140 bp, Artificial Sequence
  Synthetic
atggccgactcccaagtacgttgacaattgtcttggcgcatggattgttggtctctgtgcttgtccgaaggttgagaatggacttggtatgtccagatccctgagcagcgtcatcaggatggagacccagcatggcgtat

SEQ ID NO: 366053 - DNA, 140 bp, Artificial Sequence
  Synthetic
aggccctggctgctgatatgtagaaggctcaggggaagtttacacatcccctccgatcaccaccgggagcttgcccctgccggggacaacaccggagctccctgctacaaccggcacagagaccttttgggacagcggtg

SEQ ID NO: 366054 - DNA, 140 bp, Artificial Sequence
  Synthetic
caccgctgtcccaaaaggtctctgtgccggttgtagcagggagctccggtgttgtccccggcaggggcaagctcccggtggtgatcggaggggatgtgtaaacttcccctgagccttctacatatcagcagccagggcct

SEQ ID NO: 366055 - DNA, 140 bp, Artificial Sequence
  Synthetic
atacgccatgctgggtctccccttcacactaacagtccgcacaagtctacccagaagccctagcacaccatctacaccacaagacacacaccatcctgtgagaaatctactttcagtcaccgtacttgggagtcggccat

SEQ ID NO: 366056 - DNA, 140 bp, Artificial Sequence
  Synthetic
atggccgactcccaagtacggtgactgaaagtagatttctcacaggatggtgtgtgtcttgtggtgtagatggtgtgctagggcttctgggtagacttgtgcggactgttagtgtgaaggggagacccagcatggcgtat

SEQ ID NO: 366057 - DNA, 140 bp, Artificial Sequence
  Synthetic
aggccctggctgctgatatgtctacaccacaagacacacaccatcctgtgagaaatctactttcagtcacgagtcctgggccagatgaaacatcaacaccttcgggaacaggcaaagagagaccttttgggacagcggtg

SEQ ID NO: 366058 - DNA, 140 bp, Artificial Sequence
  Synthetic
caccgctgtcccaaaaggtctctctttgcctgttcccgaaggtgttgatgtttcatctggcccaggactcgtgactgaaagtagatttctcacaggatggtgtgtgtcttgtggtgtagacatatcagcagccagggcct

SEQ ID NO: 366059 - DNA, 140 bp, Artificial Sequence
  Synthetic
atacgccatgctgggtctccttacagttataactattaaccacatttatcttaattgcttatgtaatgttgttttgctaattttatcttgctatctttcatttcaaatacttaaagggctcgtacttgggagtcggccat

SEQ ID NO: 366060 - DNA, 140 bp, Artificial Sequence
  Synthetic
atggccgactcccaagtacgagccctttaagtatttgaaatgaaagatagcaagataaaattagcaaaacaacattacataagcaattaagataaatgtggttaatagttataactgtaaggagacccagcatggcgtat

SEQ ID NO: 366061 - DNA, 140 bp, Artificial Sequence
  Synthetic
atacgccatgctgggtctcccccgcaacagcccagggacctactgaaaatgacagtcacaatgccactgaacaccctgagtccctgacacagtcagcaaccacaggcccaatgacctctccgtacttgggagtcggccat

SEQ ID NO: 366062 - DNA, 140 bp, Artificial Sequence
  Synthetic
atggccgactcccaagtacggagaggtcattgggcctgtggttgctgactgtgtcagggactcagggtgttcagtggcattgtgactgtcattttcagtaggtccctgggctgttgcgggggagacccagcatggcgtat

SEQ ID NO: 366063 - DNA, 140 bp, Artificial Sequence
  Synthetic
atacgccatgctgggtctccactattagtgtgcttcattctttacctacagctgttgggtctaggaggagctcatagacagtcaaacgcaactgaacacaacggaacaaacaccaccacacgtacttgggagtcggccat

SEQ ID NO: 366064 - DNA, 140 bp, Artificial Sequence
  Synthetic
atggccgactcccaagtacgtgtggtggtgtttgttccgttgtgttcagttgcgtttgactgtctatgagctcctcctagacccaacagctgtaggtaaagaatgaagcacactaatagtggagacccagcatggcgtat

SEQ ID NO: 366065 - DNA, 140 bp, Artificial Sequence
  Synthetic
atacgccatgctgggtctccacacatcctagcccaacgaacaggtctaaaagaaaccttgagatggaaataatcttgactttgtctcagggtttaaaaaagtactatgggaagatattaacgtacttgggagtcggccat

SEQ ID NO: 366066 - DNA, 140 bp, Artificial Sequence
  Synthetic
atggccgactcccaagtacgttaatatcttcccatagtacttttttaaaccctgagacaaagtcaagattatttccatctcaaggtttcttttagacctgttcgttgggctaggatgtgtggagacccagcatggcgtat

SEQ ID NO: 366067 - DNA, 140 bp, Artificial Sequence
  Synthetic
atacgccatgctgggtctccttcatgctggcttctttagttgcatccccattgcactattatcacaatatgctacatctaatctgcttcattgtacccacaaacagactgaaactgccttcgtacttgggagtcggccat

SEQ ID NO: 366068 - DNA, 140 bp, Artificial Sequence
  Synthetic
atggccgactcccaagtacgaaggcagtttcagtctgtttgtgggtacaatgaagcagattagatgtagcatattgtgataatagtgcaatggggatgcaactaaagaagccagcatgaaggagacccagcatggcgtat

SEQ ID NO: 366069 - DNA, 140 bp, Artificial Sequence
  Synthetic
atacgccatgctgggtctcccagaaggctcaggggaaacgaccccacccccaaacaccacccagggcccgtctccaccagaggccacaccagaacgccccacaacaactgccacaagtaccgtacttgggagtcggccat

SEQ ID NO: 366070 - DNA, 140 bp, Artificial Sequence
  Synthetic
atggccgactcccaagtacggtacttgtggcagttgttgtggggcgttctggtgtggcctctggtggagacgggccctgggtggtgtttgggggtggggtcgtttcccctgagccttctgggagacccagcatggcgtat

SEQ ID NO: 366071 - DNA, 140 bp, Artificial Sequence
  Synthetic
aggccctggctgctgatatgtctccaccagaggccacaccagaacgccccacaacaactgccacaagtacgccaagcacagacaacacgaattccaccacacatgtgaccgacaacaaccgaccttttgggacagcggtg

SEQ ID NO: 366072 - DNA, 140 bp, Artificial Sequence
  Synthetic
caccgctgtcccaaaaggtcggttgttgtcggtcacatgtgtggtggaattcgtgttgtctgtgcttggcgtacttgtggcagttgttgtggggcgttctggtgtggcctctggtggagacatatcagcagccagggcct

SEQ ID NO: 366073 - DNA, 140 bp, Artificial Sequence
  Synthetic
atacgccatgctgggtctccacaccacaaggcatacatcatcctgcaaggaatctattgtcagtctcgagccctaagacagcaacaacaccaacaccaacgagccctggggagataagctcgtacttgggagtcggccat

SEQ ID NO: 366074 - DNA, 140 bp, Artificial Sequence
  Synthetic
atggccgactcccaagtacgagcttatctccccagggctcgttggtgttggtgttgttgctgtcttagggctcgagactgacaatagattccttgcaggatgatgtatgccttgtggtgtggagacccagcatggcgtat

SEQ ID NO: 366075 - DNA, 140 bp, Artificial Sequence
  Synthetic
aggccctggctgctgatatggctacatctaatctgcttcattgtacccacaaacagactgaaactgcctttgctctatttactctgacctaaaccttaactgcgtgccgccactatatctgaccttttgggacagcggtg

SEQ ID NO: 366076 - DNA, 140 bp, Artificial Sequence
  Synthetic
caccgctgtcccaaaaggtcagatatagtggcggcacgcagttaaggtttaggtcagagtaaatagagcaaaggcagtttcagtctgtttgtgggtacaatgaagcagattagatgtagccatatcagcagccagggcct

SEQ ID NO: 366077 - DNA, 140 bp, Artificial Sequence
  Synthetic
atacgccatgctgggtctcccagaaaccagcagtctgcactcagccatgagcagaacatcaaccctctacacagcaacccaggtctccactgaaaatgccaaccacagcgcacctagacacgtacttgggagtcggccat

SEQ ID NO: 366078 - DNA, 140 bp, Artificial Sequence
  Synthetic
atggccgactcccaagtacgtgtctaggtgcgctgtggttggcattttcagtggagacctgggttgctgtgtagagggttgatgttctgctcatggctgagtgcagactgctggtttctgggagacccagcatggcgtat

SEQ ID NO: 366079 - DNA, 140 bp, Artificial Sequence
  Synthetic
atacgccatgctgggtctcccacaatcaatccttgtaatgagtgctgctcctacagctattcagaacatacatcccagcccaacgaataggtctaagaggaaccttgagatggaaataatcgtacttgggagtcggccat

SEQ ID NO: 366080 - DNA, 140 bp, Artificial Sequence
  Synthetic
atggccgactcccaagtacgattatttccatctcaaggttcctcttagacctattcgttgggctgggatgtatgttctgaatagctgtaggagcagcactcattacaaggattgattgtgggagacccagcatggcgtat

SEQ ID NO: 366081 - DNA, 140 bp, Artificial Sequence
  Synthetic
aggccctggctgctgatatgaaccatttgaccttgctcagcaggatgattcagcaagcaaagccaactgtgactgttttctacatgctgaaaggtaacctgatgaacacagagccaacaggaccttttgggacagcggtg

SEQ ID NO: 366082 - DNA, 140 bp, Artificial Sequence
  Synthetic
caccgctgtcccaaaaggtcctgttggctctgtgttcatcaggttacctttcagcatgtagaaaacagtcacagttggctttgcttgctgaatcatcctgctgagcaaggtcaaatggttcatatcagcagccagggcct

SEQ ID NO: 366083 - DNA, 140 bp, Artificial Sequence
  Synthetic
atacgccatgctgggtctccttctgcacctcaccttggaagaggacactgaaggcctgttagaatggtgtaagagaaaccttgggtcaaactgtgatgatgacttctttcagaagagaatcgtacttgggagtcggccat

SEQ ID NO: 366084 - DNA, 140 bp, Artificial Sequence
  Synthetic
atggccgactcccaagtacgattctcttctgaaagaagtcatcatcacagtttgacccaaggtttctcttacaccattctaacaggccttcagtgtcctcttccaaggtgaggtgcagaaggagacccagcatggcgtat

SEQ ID NO: 366085 - DNA, 140 bp, Artificial Sequence
  Synthetic
atacgccatgctgggtctccgacggaagtcaggattggcaaagcatcaaccggctccagaagattgctttctgaagaacccagtgatgactgtatatcaagaactcaactactgaggacacgtacttgggagtcggccat

SEQ ID NO: 366086 - DNA, 140 bp, Artificial Sequence
  Synthetic
atggccgactcccaagtacgtgtcctcagtagttgagttcttgatatacagtcatcactgggttcttcagaaagcaatcttctggagccggttgatgctttgccaatcctgacttccgtcggagacccagcatggcgtat

SEQ ID NO: 366087 - DNA, 140 bp, Artificial Sequence
  Synthetic
aggccctggctgctgatatgagaagaattcttcatgaccggtgagggctacttcaatgaagtcttacaatttaaaacactaagcacactaagccccacggagccgtctcatgccaggccagaccttttgggacagcggtg

SEQ ID NO: 366088 - DNA, 140 bp, Artificial Sequence
  Synthetic
caccgctgtcccaaaaggtctggcctggcatgagacggctccgtggggcttagtgtgcttagtgttttaaattgtaagacttcattgaagtagccctcaccggtcatgaagaattcttctcatatcagcagccagggcct

SEQ ID NO: 366089 - DNA, 140 bp, Artificial Sequence
  Synthetic
atacgccatgctgggtctccaaccatctgcaatggctcaactattgtagaccaaagactgggcagtgaactagggtgttacaccatcaatagagtaaagtcattcaagctatgcgaaaaccgtacttgggagtcggccat

SEQ ID NO: 366090 - DNA, 140 bp, Artificial Sequence
  Synthetic
atggccgactcccaagtacggttttcgcatagcttgaatgactttactctattgatggtgtaacaccctagttcactgcccagtctttggtctacaatagttgagccattgcagatggttggagacccagcatggcgtat

SEQ ID NO: 366091 - DNA, 140 bp, Artificial Sequence
  Synthetic
atacgccatgctgggtctccttaccatgaagggactttcataccaggaacttataaaatagtgatagacaaaaaaaataagctaaatgaccgatgtacactggtcaccaactgtgtgatacgtacttgggagtcggccat

SEQ ID NO: 366092 - DNA, 140 bp, Artificial Sequence
  Synthetic
atggccgactcccaagtacgtatcacacagttggtgaccagtgtacatcggtcatttagcttattttttttgtctatcactattttataagttcctggtatgaaagtcccttcatggtaaggagacccagcatggcgtat

SEQ ID NO: 366093 - DNA, 140 bp, Artificial Sequence
  Synthetic
atacgccatgctgggtctccaaaggaagagaggttcgtaagggccaatcagtgctgaggcagtacaaaacagaaatcaagataggcaaggcatcaacaggctctaggaaactactgtccgcgtacttgggagtcggccat

SEQ ID NO: 366094 - DNA, 140 bp, Artificial Sequence
  Synthetic
atggccgactcccaagtacgcggacagtagtttcctagagcctgttgatgccttgcctatcttgatttctgttttgtactgcctcagcactgattggcccttacgaacctctcttcctttggagacccagcatggcgtat

SEQ ID NO: 366095 - DNA, 140 bp, Artificial Sequence
  Synthetic
atacgccatgctgggtctcctatctgcaatggttcaaccattgtagatcagagactgggcagtgaactagggtgttataccatcaacagggtgaagtcattcaagctatgcgaaaacagccgtacttgggagtcggccat

SEQ ID NO: 366096 - DNA, 140 bp, Artificial Sequence
  Synthetic
atggccgactcccaagtacggctgttttcgcatagcttgaatgacttcaccctgttgatggtataacaccctagttcactgcccagtctctgatctacaatggttgaaccattgcagataggagacccagcatggcgtat

SEQ ID NO: 366097 - DNA, 140 bp, Artificial Sequence
  Synthetic
atacgccatgctgggtctccgccacagggaaaacctgtgagatagacagcactccggttaagtgcaggcaaggtttttgtttaaaaatcacccaagagggaaggggccacgtaaaattatcgtacttgggagtcggccat

SEQ ID NO: 366098 - DNA, 140 bp, Artificial Sequence
  Synthetic
atggccgactcccaagtacgataattttacgtggccccttccctcttgggtgatttttaaacaaaaaccttgcctgcacttaaccggagtgctgtctatctcacaggttttccctgtggcggagacccagcatggcgtat

SEQ ID NO: 366099 - DNA, 140 bp, Artificial Sequence
  Synthetic
aggccctggctgctgatatgaggtttttgtttaaaaatcacccaagagggaaggggccacgtaaaattatctagaggctcagaggttgttttggatgcttgcgactcaagctgcgaagtagaccttttgggacagcggtg

SEQ ID NO: 366100 - DNA, 140 bp, Artificial Sequence
  Synthetic
caccgctgtcccaaaaggtctacttcgcagcttgagtcgcaagcatccaaaacaacctctgagcctctagataattttacgtggccccttccctcttgggtgatttttaaacaaaaacctcatatcagcagccagggcct

SEQ ID NO: 366101 - DNA, 140 bp, Artificial Sequence
  Synthetic
atacgccatgctgggtctccgcagttggctgattgtgctgcttgtgctattcactgtttcattgtcaccagttcaatcagcacccattggtcaagggaagacaattgaagcataccgggccgtacttgggagtcggccat

SEQ ID NO: 366102 - DNA, 140 bp, Artificial Sequence
  Synthetic
atggccgactcccaagtacggcccggtatgcttcaattgtcttcccttgaccaatgggtgctgattgaactggtgacaatgaaacagtgaatagcacaagcagcacaatcagccaactgcggagacccagcatggcgtat

SEQ ID NO: 366103 - DNA, 140 bp, Artificial Sequence
  Synthetic
atacgccatgctgggtctccgcaacatttcttaaaagacaacttaattgacctagggtgcccccatatcccgctattgggtaaaatggccatttacatctgcagaatgtcaaatcatcctcgtacttgggagtcggccat

SEQ ID NO: 366104 - DNA, 140 bp, Artificial Sequence
  Synthetic
atggccgactcccaagtacgaggatgatttgacattctgcagatgtaaatggccattttacccaatagcgggatatgggggcaccctaggtcaattaagttgtcttttaagaaatgttgcggagacccagcatggcgtat

SEQ ID NO: 366105 - DNA, 140 bp, Artificial Sequence
  Synthetic
aggccctggctgctgatatgcgctattgggtaaaatggccatttacatctgcagaatgtcaaatcatcctagaacaactatggcttttctcttctggttcagctttggctatgtgatcacgaccttttgggacagcggtg

SEQ ID NO: 366106 - DNA, 140 bp, Artificial Sequence
  Synthetic
caccgctgtcccaaaaggtcgtgatcacatagccaaagctgaaccagaagagaaaagccatagttgttctaggatgatttgacattctgcagatgtaaatggccattttacccaatagcgcatatcagcagccagggcct

SEQ ID NO: 366107 - DNA, 140 bp, Artificial Sequence
  Synthetic
atacgccatgctgggtctcctagggaaaaagatcaagcaatatagggaattgaaacctcaaacttgtaccatatgtgagacagcccctgtcaatgcaatagacgctgaaatgcatgacctcgtacttgggagtcggccat

SEQ ID NO: 366108 - DNA, 140 bp, Artificial Sequence
  Synthetic
atggccgactcccaagtacgaggtcatgcatttcagcgtctattgcattgacaggggctgtctcacatatggtacaagtttgaggtttcaattccctatattgcttgatctttttccctaggagacccagcatggcgtat

SEQ ID NO: 366109 - DNA, 140 bp, Artificial Sequence
  Synthetic
atacgccatgctgggtctcctaactgcagttacaatatatgcccttattgtgcatcaagattgacctccgatgggctagctaggcatgtgccacaatgccccaagcggaaggaaaaagttcgtacttgggagtcggccat

SEQ ID NO: 366110 - DNA, 140 bp, Artificial Sequence
  Synthetic
atggccgactcccaagtacgaactttttccttccgcttggggcattgtggcacatgcctagctagcccatcggaggtcaatcttgatgcacaataagggcatatattgtaactgcagttaggagacccagcatggcgtat

SEQ ID NO: 366111 - DNA, 140 bp, Artificial Sequence
  Synthetic
aggccctggctgctgatatgttatccgtagcatcatcaacaccacttttgttttgtgcatactgatactagcagtttgtgttgttagtacctcagcagtggagatggaaaacctaccagcgaccttttgggacagcggtg

SEQ ID NO: 366112 - DNA, 140 bp, Artificial Sequence
  Synthetic
caccgctgtcccaaaaggtcgctggtaggttttccatctccactgctgaggtactaacaacacaaactgctagtatcagtatgcacaaaacaaaagtggtgttgatgatgctacggataacatatcagcagccagggcct

SEQ ID NO: 366113 - DNA, 140 bp, Artificial Sequence
  Synthetic
aggccctggctgctgatatggctacatttaatccgtttcattatatccgcaagcaagctctgcaatgcccaacaccgccattactctatttactctgacctaaaccttgactgcgtgccggaccttttgggacagcggtg

SEQ ID NO: 366114 - DNA, 140 bp, Artificial Sequence
  Synthetic
caccgctgtcccaaaaggtccggcacgcagtcaaggtttaggtcagagtaaatagagtaatggcggtgttgggcattgcagagcttgcttgcggatataatgaaacggattaaatgtagccatatcagcagccagggcct

SEQ ID NO: 366115 - DNA, 140 bp, Artificial Sequence
  Synthetic
atacgccatgctgggtctccagaaggattcacaagtatctgtctctttatgttaggaagcatcctgtttttagtctcttgcttggtgaaggggctggttgacagtgtcagtgacagcttccgtacttgggagtcggccat

SEQ ID NO: 366116 - DNA, 140 bp, Artificial Sequence
  Synthetic
atggccgactcccaagtacggaagctgtcactgacactgtcaaccagccccttcaccaagcaagagactaaaaacaggatgcttcctaacataaagagacagatacttgtgaatccttctggagacccagcatggcgtat

SEQ ID NO: 366117 - DNA, 140 bp, Artificial Sequence
  Synthetic
atacgccatgctgggtctccttccccggcctgtctgtctgtaagacatgctctattggcagtataaatggctttgaaattgaatcgcataaatgctactgtagcctattttgctgcccctcgtacttgggagtcggccat

SEQ ID NO: 366118 - DNA, 140 bp, Artificial Sequence
  Synthetic
atggccgactcccaagtacgaggggcagcaaaataggctacagtagcatttatgcgattcaatttcaaagccatttatactgccaatagagcatgtcttacagacagacaggccggggaaggagacccagcatggcgtat

SEQ ID NO: 366119 - DNA, 140 bp, Artificial Sequence
  Synthetic
atacgccatgctgggtctcccactcaagaaattggagatgcaatcccacctggtgctggggtgtagggactggctgcacctgttgtggattagatgtgaaggacctttttacagattacacgtacttgggagtcggccat

SEQ ID NO: 366120 - DNA, 140 bp, Artificial Sequence
  Synthetic
atggccgactcccaagtacgtgtaatctgtaaaaaggtccttcacatctaatccacaacaggtgcagccagtccctacaccccagcaccaggtgggattgcatctccaatttcttgagtgggagacccagcatggcgtat

SEQ ID NO: 366121 - DNA, 140 bp, Artificial Sequence
  Synthetic
atacgccatgctgggtctcccacttgggagagagaggaagacctgacaaatttctgtcatcaggaatgccaggtaaccgagacggagtgcctctgtccatacgaagctcttgtgctcagacgtacttgggagtcggccat

SEQ ID NO: 366122 - DNA, 140 bp, Artificial Sequence
  Synthetic
atggccgactcccaagtacgtctgagcacaagagcttcgtatggacagaggcactccgtctcggttacctggcattcctgatgacagaaatttgtcaggtcttcctctctctcccaagtgggagacccagcatggcgtat

SEQ ID NO: 366123 - DNA, 140 bp, Artificial Sequence
  Synthetic
atacgccatgctgggtctccatctaggcgtagaagatgcctctgaatccaaattacttaccgtctctatcatggatttgtcacaaatgtattcccctgtttttgagtacttgtcaggagacgtacttgggagtcggccat

SEQ ID NO: 366124 - DNA, 140 bp, Artificial Sequence
  Synthetic
atggccgactcccaagtacgtctcctgacaagtactcaaaaacaggggaatacatttgtgacaaatccatgatagagacggtaagtaatttggattcagaggcatcttctacgcctagatggagacccagcatggcgtat

SEQ ID NO: 366125 - DNA, 140 bp, Artificial Sequence
  Synthetic
atacgccatgctgggtctcccagacaggttgaagaatggcccaaagcaacttgcacaggtgactgcccagaaaggtgtggttgcacatcatcaacctgcttgcataaagaatggcctcaccgtacttgggagtcggccat

SEQ ID NO: 366126 - DNA, 140 bp, Artificial Sequence
  Synthetic
atggccgactcccaagtacggtgaggccattctttatgcaagcaggttgatgatgtgcaaccacacctttctgggcagtcacctgtgcaagttgctttgggccattcttcaacctgtctgggagacccagcatggcgtat

SEQ ID NO: 366127 - DNA, 140 bp, Artificial Sequence
  Synthetic
aggccctggctgctgatatgtcaagaaactggagatgtaatcccacttggtgctggggagtaggaactggctgcacctgctgcggggtggatgtaaaagacctttttacagatcacatgtgaccttttgggacagcggtg

SEQ ID NO: 366128 - DNA, 140 bp, Artificial Sequence
  Synthetic
caccgctgtcccaaaaggtcacatgtgatctgtaaaaaggtcttttacatccaccccgcagcaggtgcagccagttcctactccccagcaccaagtgggattacatctccagtttcttgacatatcagcagccagggcct

SEQ ID NO: 366129 - DNA, 140 bp, Artificial Sequence
  Synthetic
aggccctggctgctgatatggtgtaaactgcagagttgcacacatggtataccaggagatctacaagtttaccatattggcaacttgctgaaaggggatagggtaaacgggcatctaattgaccttttgggacagcggtg

SEQ ID NO: 366130 - DNA, 140 bp, Artificial Sequence
  Synthetic
caccgctgtcccaaaaggtcaattagatgcccgtttaccctatcccctttcagcaagttgccaatatggtaaacttgtagatctcctggtataccatgtgtgcaactctgcagtttacaccatatcagcagccagggcct

SEQ ID NO: 366131 - DNA, 140 bp, Artificial Sequence
  Synthetic
atacgccatgctgggtctccacacaagggaaccataatcggaaagcagaacagcacttgcacggctagggcgagttgctggttggagtcagtcaagagtttcttttatggcctaaagaaccgtacttgggagtcggccat

SEQ ID NO: 366132 - DNA, 140 bp, Artificial Sequence
  Synthetic
atggccgactcccaagtacggttctttaggccataaaagaaactcttgactgactccaaccagcaactcgccctagccgtgcaagtgctgttctgctttccgattatggttcccttgtgtggagacccagcatggcgtat

SEQ ID NO: 366133 - DNA, 140 bp, Artificial Sequence
  Synthetic
atacgccatgctgggtctccatgcttagtggcatttttggcaatgtctttatgggcatcttcttattccttgcccccttcatcctgttaatactattctttatgtttgggtggaggatcccgtacttgggagtcggccat

SEQ ID NO: 366134 - DNA, 140 bp, Artificial Sequence
  Synthetic
atggccgactcccaagtacgggatcctccacccaaacataaagaatagtattaacaggatgaagggggcaaggaataagaagatgcccataaagacattgccaaaaatgccactaagcatggagacccagcatggcgtat

SEQ ID NO: 366135 - DNA, 140 bp, Artificial Sequence
  Synthetic
atacgccatgctgggtctccaaatgtgttgacacaaaacttgagcagccacagagcatactaattgagcacaaaggaacgataattggaaagcagaatgatacttgcacagccaaggcaacgtacttgggagtcggccat

SEQ ID NO: 366136 - DNA, 140 bp, Artificial Sequence
  Synthetic
atggccgactcccaagtacgttgccttggctgtgcaagtatcattctgctttccaattatcgttcctttgtgctcaattagtatgctctgtggctgctcaagttttgtgtcaacacatttggagacccagcatggcgtat

SEQ ID NO: 366137 - DNA, 140 bp, Artificial Sequence
  Synthetic
aggccctggctgctgatatgctacatctaatctgctacattgtatccatggacagactctataatgcctgaaactgcctttgttctatttactctgacctaaatcttgactgcgtgccgcgaccttttgggacagcggtg

SEQ ID NO: 366138 - DNA, 140 bp, Artificial Sequence
  Synthetic
caccgctgtcccaaaaggtcgcggcacgcagtcaagatttaggtcagagtaaatagaacaaaggcagtttcaggcattatagagtctgtccatggatacaatgtagcagattagatgtagcatatcagcagccagggcct

SEQ ID NO: 366139 - DNA, 140 bp, Artificial Sequence
  Synthetic
atacgccatgctgggtctcccccttttgtcctgttggtgcttttctttatgtttggatggaaaatcttgttttgcttcaaatgttgcaggaggaccagaggcttacttaagtatagactccgtacttgggagtcggccat

SEQ ID NO: 366140 - DNA, 140 bp, Artificial Sequence
  Synthetic
atggccgactcccaagtacggagtctatacttaagtaagcctctggtcctcctgcaacatttgaagcaaaacaagattttccatccaaacataaagaaaagcaccaacaggacaaaagggggagacccagcatggcgtat

SEQ ID NO: 366141 - DNA, 140 bp, Artificial Sequence
  Synthetic
atacgccatgctgggtctccctcaaagacgatgaggaaacaggctacagaaggattattgaaagactgaacaacaaaaagggaaaaaacagactgcttgatggtgaaaggttggctgatacgtacttgggagtcggccat

SEQ ID NO: 366142 - DNA, 140 bp, Artificial Sequence
  Synthetic
atggccgactcccaagtacgtatcagccaacctttcaccatcaagcagtctgttttttccctttttgttgttcagtctttcaataatccttctgtagcctgtttcctcatcgtctttgagggagacccagcatggcgtat

SEQ ID NO: 366143 - DNA, 140 bp, Artificial Sequence
  Synthetic
atacgccatgctgggtctccagaaataacctcgaaggttgacagcagtgtgctgtctagtgtccttgcttatgctagcttcgttcatcgcatccgtactttacagacgctgcaacacactcgtacttgggagtcggccat

SEQ ID NO: 366144 - DNA, 140 bp, Artificial Sequence
  Synthetic
atggccgactcccaagtacgagtgtgttgcagcgtctgtaaagtacggatgcgatgaacgaagctagcataagcaaggacactagacagcacactgctgtcaaccttcgaggttatttctggagacccagcatggcgtat

SEQ ID NO: 366145 - DNA, 140 bp, Artificial Sequence
  Synthetic
aggccctggctgctgatatgaagaagaccttacaaacttctgccatcaagaatgccaagtgacagagactgagtgtctttgcccgtatgaagccttaattctcagaaagccccttttcctgaccttttgggacagcggtg

SEQ ID NO: 366146 - DNA, 140 bp, Artificial Sequence
  Synthetic
caccgctgtcccaaaaggtcaggaaaaggggctttctgagaattaaggcttcatacgggcaaagacactcagtctctgtcacttggcattcttgatggcagaagtttgtaaggtcttcttcatatcagcagccagggcct

SEQ ID NO: 366147 - DNA, 140 bp, Artificial Sequence
  Synthetic
atacgccatgctgggtctcccacaaggtgcacagattgacactgctttcagctcatactattggctttacaaggctggcgtgaccccagagaccttcccgacggtgtcgcagttcctcttcgtacttgggagtcggccat

SEQ ID NO: 366148 - DNA, 140 bp, Artificial Sequence
  Synthetic
atggccgactcccaagtacgaagaggaactgcgacaccgtcgggaaggtctctggggtcacgccagccttgtaaagccaatagtatgagctgaaagcagtgtcaatctgtgcaccttgtgggagacccagcatggcgtat

SEQ ID NO: 366149 - DNA, 140 bp, Artificial Sequence
  Synthetic
aggccctggctgctgatatgtgagcaccccaatgaagtgggggaagaaactttatgaactctttgccgacgattctttccagcagaacaggatctacatgcaccctgccgtgcttacagcgaccttttgggacagcggtg

SEQ ID NO: 366150 - DNA, 140 bp, Artificial Sequence
  Synthetic
caccgctgtcccaaaaggtcgctgtaagcacggcagggtgcatgtagatcctgttctgctggaaagaatcgtcggcaaagagttcataaagtttcttcccccacttcattggggtgctcacatatcagcagccagggcct

SEQ ID NO: 366151 - DNA, 140 bp, Artificial Sequence
  Synthetic
aggccctggctgctgatatgaagccatggaggtggatggctctggtgagtccaccacactccccgctgtgacccctactccagctgaaacaactacacatgccaatcagaagtcagcttcgaccttttgggacagcggtg

SEQ ID NO: 366152 - DNA, 140 bp, Artificial Sequence
  Synthetic
caccgctgtcccaaaaggtcgaagctgacttctgattggcatgtgtagttgtttcagctggagtaggggtcacagcggggagtgtggtggactcaccagagccatccacctccatggcttcatatcagcagccagggcct

SEQ ID NO: 366153 - DNA, 140 bp, Artificial Sequence
  Synthetic
aggccctggctgctgatatgagatggctagtgccactgatgatgcacaaaaggattccatctacgcatctgctctagtggaggcaaccaaattctgtgcacctatatacgagtgtgcttggaccttttgggacagcggtg

SEQ ID NO: 366154 - DNA, 140 bp, Artificial Sequence
  Synthetic
caccgctgtcccaaaaggtccaagcacactcgtatataggtgcacagaatttggttgcctccactagagcagatgcgtagatggaatccttttgtgcatcatcagtggcactagccatctcatatcagcagccagggcct

SEQ ID NO: 366155 - DNA, 140 bp, Artificial Sequence
  Synthetic
atacgccatgctgggtctccaccacgtcagaccccccctccgccacatccacagcatcagccagtggaccagaaggctcaggggacacgagcacctctccctcagtcaccacacaaggcccgtacttgggagtcggccat

SEQ ID NO: 366156 - DNA, 140 bp, Artificial Sequence
  Synthetic
atggccgactcccaagtacgggccttgtgtggtgactgagggagaggtgctcgtgtcccctgagccttctggtccactggctgatgctgtggatgtggcggagggggggtctgacgtggtggagacccagcatggcgtat

SEQ ID NO: 366157 - DNA, 140 bp, Artificial Sequence
  Synthetic
atacgccatgctgggtctccgtaacaaggtccttgcagaatacaaagttcctggcgaaattgtgatgtctgtcaaagagatgttgtcagatatgattagaaggaggaacctgattctcaacgtacttgggagtcggccat

SEQ ID NO: 366158 - DNA, 140 bp, Artificial Sequence
  Synthetic
atggccgactcccaagtacgttgagaatcaggttcctccttctaatcatatctgacaacatctctttgacagacatcacaatttcgccaggaactttgtattctgcaaggaccttgttacggagacccagcatggcgtat

SEQ ID NO: 366159 - DNA, 140 bp, Artificial Sequence
  Synthetic
aggccctggctgctgatatgagtggattgagcatcttaattgcagcacacctgccaacatcatgcatatatcgttaatgtatgcagtcctttgcctacagctgtgtggtctgggagagacgaccttttgggacagcggtg

SEQ ID NO: 366160 - DNA, 140 bp, Artificial Sequence
  Synthetic
caccgctgtcccaaaaggtcgtctctcccagaccacacagctgtaggcaaaggactgcatacattaacgatatatgcatgatgttggcaggtgtgctgcaattaagatgctcaatccactcatatcagcagccagggcct

SEQ ID NO: 366161 - DNA, 140 bp, Artificial Sequence
  Synthetic
atacgccatgctgggtctcctcgttaatgtatgcagtcctttgcctacagctgtgtggtctgggagagactcatagatcacacaatgaaactggacacaataaaacagacgttgcgacaacgtacttgggagtcggccat

SEQ ID NO: 366162 - DNA, 140 bp, Artificial Sequence
  Synthetic
atggccgactcccaagtacgttgtcgcaacgtctgttttattgtgtccagtttcattgtgtgatctatgagtctctcccagaccacacagctgtaggcaaaggactgcatacattaacgaggagacccagcatggcgtat

SEQ ID NO: 366163 - DNA, 140 bp, Artificial Sequence
  Synthetic
aggccctggctgctgatatgaacaggccttgccaagcttgcagagactgaagggaagggagttttcgacgaagccaagaagactgttgaggctctcaacgggtatctggacaagcacaaggaccttttgggacagcggtg

SEQ ID NO: 366164 - DNA, 140 bp, Artificial Sequence
  Synthetic
caccgctgtcccaaaaggtccttgtgcttgtccagatacccgttgagagcctcaacagtcttcttggcttcgtcgaaaactcccttcccttcagtctctgcaagcttggcaaggcctgttcatatcagcagccagggcct

SEQ ID NO: 366165 - DNA, 140 bp, Artificial Sequence
  Synthetic
aggccctggctgctgatatgagaaggctcgggggaagtttacacatcctctctgatcaccaccgagagcttgtccttgctggaaaccacaccgaagctccctactacaactggtatagacgaccttttgggacagcggtg

SEQ ID NO: 366166 - DNA, 140 bp, Artificial Sequence
  Synthetic
caccgctgtcccaaaaggtcgtctataccagttgtagtagggagcttcggtgtggtttccagcaaggacaagctctcggtggtgatcagagaggatgtgtaaacttcccccgagccttctcatatcagcagccagggcct

SEQ ID NO: 366167 - DNA, 140 bp, Artificial Sequence
  Synthetic
atacgccatgctgggtctccctccgcactaacagtccgcacaagtccacccagcaaccccagcacaccatctacaccacaagacacgcaccatcccatgagaaatctactttcagtcacgcgtacttgggagtcggccat

SEQ ID NO: 366168 - DNA, 140 bp, Artificial Sequence
  Synthetic
atggccgactcccaagtacgcgtgactgaaagtagatttctcatgggatggtgcgtgtcttgtggtgtagatggtgtgctggggttgctgggtggacttgtgcggactgttagtgcggagggagacccagcatggcgtat

SEQ ID NO: 366169 - DNA, 140 bp, Artificial Sequence
  Synthetic
aggccctggctgctgatatgctacaccacaagacacgcaccatcccatgagaaatctactttcagtcacgagccctgggccagaagaaacatctacaccctcaggatcaggcaaagagaggaccttttgggacagcggtg

SEQ ID NO: 366170 - DNA, 140 bp, Artificial Sequence
  Synthetic
caccgctgtcccaaaaggtcctctctttgcctgatcctgagggtgtagatgtttcttctggcccagggctcgtgactgaaagtagatttctcatgggatggtgcgtgtcttgtggtgtagcatatcagcagccagggcct

SEQ ID NO: 366171 - DNA, 140 bp, Artificial Sequence
  Synthetic
atacgccatgctgggtctccaacacagatagtccacccacaaagtgccacctccataaccgttcaagacacataccccagtccaacgaacaggtccaaaagaaaccttgagatggaaatacgtacttgggagtcggccat

SEQ ID NO: 366172 - DNA, 140 bp, Artificial Sequence
  Synthetic
atggccgactcccaagtacgtatttccatctcaaggtttcttttggacctgttcgttggactggggtatgtgtcttgaacggttatggaggtggcactttgtgggtggactatctgtgttggagacccagcatggcgtat

SEQ ID NO: 366173 - DNA, 140 bp, Artificial Sequence
  Synthetic
atacgccatgctgggtctccatcttgactttgtctcagggtttaaaaaagtactatggcaaaatattaaggcttctgcgtctcaccttagaggaggacactgaaggtctactggaatggtcgtacttgggagtcggccat

SEQ ID NO: 366174 - DNA, 140 bp, Artificial Sequence
  Synthetic
atggccgactcccaagtacgaccattccagtagaccttcagtgtcctcctctaaggtgagacgcagaagccttaatattttgccatagtacttttttaaaccctgagacaaagtcaagatggagacccagcatggcgtat

SEQ ID NO: 366175 - DNA, 140 bp, Artificial Sequence
  Synthetic
atacgccatgctgggtctcctagcctctgagcacctgctgcaccagtctcttgttggtaagcagtctccatttcaaaatgcctacaacgtcaaggggaacgccaccagtgccaacatcatcgtacttgggagtcggccat

SEQ ID NO: 366176 - DNA, 140 bp, Artificial Sequence
  Synthetic
atggccgactcccaagtacgatgatgttggcactggtggcgttccccttgacgttgtaggcattttgaaatggagactgcttaccaacaagagactggtgcagcaggtgctcagaggctaggagacccagcatggcgtat

SEQ ID NO: 366177 - DNA, 140 bp, Artificial Sequence
  Synthetic
atacgccatgctgggtctccttacgatttcaatcatcaactatgcttcttttaactgtttatgtaatcctgttctattaacattttgttactttcttctgttttaaatacttaaagggctcgtacttgggagtcggccat

SEQ ID NO: 366178 - DNA, 140 bp, Artificial Sequence
  Synthetic
atggccgactcccaagtacgagccctttaagtatttaaaacagaagaaagtaacaaaatgttaatagaacaggattacataaacagttaaaagaagcatagttgatgattgaaatcgtaaggagacccagcatggcgtat

SEQ ID NO: 366179 - DNA, 140 bp, Artificial Sequence
  Synthetic
atacgccatgctgggtctccagggcttcaattgattaatattacccgacattcaactaaaatagctgacacacctgggcctaagatcactaacttaaagaccatcaactgcataaacctgcgtacttgggagtcggccat

SEQ ID NO: 366180 - DNA, 140 bp, Artificial Sequence
  Synthetic
atggccgactcccaagtacgcaggtttatgcagttgatggtctttaagttagtgatcttaggcccaggtgtgtcagctattttagttgaatgtcgggtaatattaatcaattgaagccctggagacccagcatggcgtat

SEQ ID NO: 366181 - DNA, 140 bp, Artificial Sequence
  Synthetic
aggccctggctgctgatatggagtgacttgagcattttagacgcatcatgcccgtcaacactatgcacacactgctagtgtatgctgtcttttgcttgcagctatggagtccaggaggaagaccttttgggacagcggtg

SEQ ID NO: 366182 - DNA, 140 bp, Artificial Sequence
  Synthetic
caccgctgtcccaaaaggtcttcctcctggactccatagctgcaagcaaaagacagcatacactagcagtgtgtgcatagtgttgacgggcatgatgcgtctaaaatgctcaagtcactccatatcagcagccagggcct

SEQ ID NO: 366183 - DNA, 140 bp, Artificial Sequence
  Synthetic
atacgccatgctgggtctccactgctagtgtatgctgtcttttgcttgcagctatggagtccaggaggaactcgtggactgtcaaatgaaactcaacacaatgaaacaggtatcacaagacgtacttgggagtcggccat

SEQ ID NO: 366184 - DNA, 140 bp, Artificial Sequence
  Synthetic
atggccgactcccaagtacgtcttgtgatacctgtttcattgtgttgagtttcatttgacagtccacgagttcctcctggactccatagctgcaagcaaaagacagcatacactagcagtggagacccagcatggcgtat

SEQ ID NO: 366185 - DNA, 140 bp, Artificial Sequence
  Synthetic
atacgccatgctgggtctcccatcatgtcagacccctccatcaccacaccctcagcgtcgaccagtggactagaaggctcaggggacacgactcccccagccatcacacaaggcccgacccgtacttgggagtcggccat

SEQ ID NO: 366186 - DNA, 140 bp, Artificial Sequence
  Synthetic
atggccgactcccaagtacgggtcgggccttgtgtgatggctgggggagtcgtgtcccctgagccttctagtccactggtcgacgctgagggtgtggtgatggaggggtctgacatgatgggagacccagcatggcgtat

SEQ ID NO: 366187 - DNA, 140 bp, Artificial Sequence
  Synthetic
aggccctggctgctgatatgtagaaggctcaggggacacgactcccccagccatcacacaaggcccgaccccaccagagaccacgccggaaccctccacaacaaccggcacaaacgcattgaccttttgggacagcggtg

SEQ ID NO: 366188 - DNA, 140 bp, Artificial Sequence
  Synthetic
caccgctgtcccaaaaggtcaatgcgtttgtgccggttgttgtggagggttccggcgtggtctctggtggggtcgggccttgtgtgatggctgggggagtcgtgtcccctgagccttctacatatcagcagccagggcct

SEQ ID NO: 366189 - DNA, 140 bp, Artificial Sequence
  Synthetic
atacgccatgctgggtctcccaccgacagtccaaacaagtccacctagcactcccgacgcatctaccataccacagggcacacatcacaccgcaaggggtctgctgtcagtcaccgtcaccgtacttgggagtcggccat

SEQ ID NO: 366190 - DNA, 140 bp, Artificial Sequence
  Synthetic
atggccgactcccaagtacggtgacggtgactgacagcagaccccttgcggtgtgatgtgtgccctgtggtatggtagatgcgtcgggagtgctaggtggacttgtttggactgtcggtgggagacccagcatggcgtat

SEQ ID NO: 366191 - DNA, 140 bp, Artificial Sequence
  Synthetic
aggccctggctgctgatatgccacagggcacacatcacaccgcaaggggtctgctgtcagtcaccgtcacaaagccagaagaagtaccaacaccaacaggcccagaacaagcaagcataggaccttttgggacagcggtg

SEQ ID NO: 366192 - DNA, 140 bp, Artificial Sequence
  Synthetic
caccgctgtcccaaaaggtcctatgcttgcttgttctgggcctgttggtgttggtacttcttctggctttgtgacggtgactgacagcagaccccttgcggtgtgatgtgtgccctgtggcatatcagcagccagggcct

SEQ ID NO: 366193 - DNA, 140 bp, Artificial Sequence
  Synthetic
atacgccatgctgggtctccacagctcaggttaccactgaaaacagcaaccctaatacctccagacagctcgtgctctcaacacaaccagcaacctcaagcccagtgacctctccagcaccgtacttgggagtcggccat

SEQ ID NO: 366194 - DNA, 140 bp, Artificial Sequence
  Synthetic
atggccgactcccaagtacggtgctggagaggtcactgggcttgaggttgctggttgtgttgagagcacgagctgtctggaggtattagggttgctgttttcagtggtaacctgagctgtggagacccagcatggcgtat

SEQ ID NO: 366195 - DNA, 140 bp, Artificial Sequence
  Synthetic
aggccctggctgctgatatgcgtgctctcaacacaaccagcaacctcaagcccagtgacctctccagcacagctgatcttcgtgcagagtgctactaccgtagccgttcaagatgcacacgaccttttgggacagcggtg

SEQ ID NO: 366196 - DNA, 140 bp, Artificial Sequence
  Synthetic
caccgctgtcccaaaaggtcgtgtgcatcttgaacggctacggtagtagcactctgcacgaagatcagctgtgctggagaggtcactgggcttgaggttgctggttgtgttgagagcacgcatatcagcagccagggcct

SEQ ID NO: 366197 - DNA, 140 bp, Artificial Sequence
  Synthetic
atacgccatgctgggtctccgactttatctcaaggtttaagaaagtactacggcagaatactgaaacttctggaccttaccttagaagaagacaccgaaggactgctggagtggtgtaagcgtacttgggagtcggccat

SEQ ID NO: 366198 - DNA, 140 bp, Artificial Sequence
  Synthetic
atggccgactcccaagtacgcttacaccactccagcagtccttcggtgtcttcttctaaggtaaggtccagaagtttcagtattctgccgtagtactttcttaaaccttgagataaagtcggagacccagcatggcgtat

SEQ ID NO: 366199 - DNA, 140 bp, Artificial Sequence
  Synthetic
aggccctggctgctgatatgtggaccttaccttagaagaagacaccgaaggactgctggagtggtgtaagagaaatcttggtctaacctgtgacgataacttctttcagaagaggatagagaccttttgggacagcggtg

SEQ ID NO: 366200 - DNA, 140 bp, Artificial Sequence
  Synthetic
caccgctgtcccaaaaggtctctatcctcttctgaaagaagttatcgtcacaggttagaccaagatttctcttacaccactccagcagtccttcggtgtcttcttctaaggtaaggtccacatatcagcagccagggcct

SEQ ID NO: 366201 - DNA, 140 bp, Artificial Sequence
  Synthetic
atacgccatgctgggtctccaaaccccaagcacactgagctctacagaatctgctagtgtagggttaccaacagttgagcccttcaaatcttactttgctaaaggctttctttcaatagacgtacttgggagtcggccat

SEQ ID NO: 366202 - DNA, 140 bp, Artificial Sequence
  Synthetic
atggccgactcccaagtacgtctattgaaagaaagcctttagcaaagtaagatttgaagggctcaactgttggtaaccctacactagcagattctgtagagctcagtgtgcttggggtttggagacccagcatggcgtat

SEQ ID NO: 366203 - DNA, 140 bp, Artificial Sequence
  Synthetic
aggccctggctgctgatatgacagttgagcccttcaaatcttactttgctaaaggctttctttcaatagactcaggttacttctctgccaagtgttatccaagggcgtctaactcagggcgaccttttgggacagcggtg

SEQ ID NO: 366204 - DNA, 140 bp, Artificial Sequence
  Synthetic
caccgctgtcccaaaaggtcgccctgagttagacgcccttggataacacttggcagagaagtaacctgagtctattgaaagaaagcctttagcaaagtaagatttgaagggctcaactgtcatatcagcagccagggcct

SEQ ID NO: 366205 - DNA, 140 bp, Artificial Sequence
  Synthetic
atacgccatgctgggtctccggacctaagatcacaaatctgaaaaccatcaattgcataaacctaaaggcattggtctttaaagagcatagagagattgaaatcaatgttcttctccctccgtacttgggagtcggccat

SEQ ID NO: 366206 - DNA, 140 bp, Artificial Sequence
  Synthetic
atggccgactcccaagtacggagggagaagaacattgatttcaatctctctatgctctttaaagaccaatgcctttaggtttatgcaattgatggttttcagatttgtgatcttaggtccggagacccagcatggcgtat

SEQ ID NO: 366207 - DNA, 140 bp, Artificial Sequence
  Synthetic
aggccctggctgctgatatgattggtctttaaagagcatagagagattgaaatcaatgttcttctccctcaagtcgcagtcaatctctcaaactgccatgtccacatcaaatcgcatgtcgaccttttgggacagcggtg

SEQ ID NO: 366208 - DNA, 140 bp, Artificial Sequence
  Synthetic
caccgctgtcccaaaaggtcgacatgcgatttgatgtggacatggcagtttgagagattgactgcgacttgagggagaagaacattgatttcaatctctctatgctctttaaagaccaatcatatcagcagccagggcct

SEQ ID NO: 366209 - DNA, 140 bp, Artificial Sequence
  Synthetic
atacgccatgctgggtctccccatgaaggaactttcataccaggaacttacaaaatagtgatagacaaaaaaaacaaacaaaacgatagatgcaacttggttaccaattgtgtaataaaacgtacttgggagtcggccat

SEQ ID NO: 366210 - DNA, 140 bp, Artificial Sequence
  Synthetic
atggccgactcccaagtacgttttattacacaattggtaaccaagttgcatctatcgttttgtttgttttttttgtctatcactattttgtaagttcctggtatgaaagttccttcatggggagacccagcatggcgtat

SEQ ID NO: 366211 - DNA, 140 bp, Artificial Sequence
  Synthetic
aggccctggctgctgatatgaaaacaaacaaaacgatagatgcaacttggttaccaattgtgtaataaaaggaagggaagtgcgtaaaggccagtcagtgttaagacagtacagaacagagaccttttgggacagcggtg

SEQ ID NO: 366212 - DNA, 140 bp, Artificial Sequence
  Synthetic
caccgctgtcccaaaaggtctctgttctgtactgtcttaacactgactggcctttacgcacttcccttccttttattacacaattggtaaccaagttgcatctatcgttttgtttgttttcatatcagcagccagggcct

SEQ ID NO: 366213 - DNA, 140 bp, Artificial Sequence
  Synthetic
atacgccatgctgggtctccagtctggtgaagactgtatatcaaggactcagctattgaggacagaaactgcagaaatccatggtgataactatggtggtccaggtgacaaaataaccatcgtacttgggagtcggccat

SEQ ID NO: 366214 - DNA, 140 bp, Artificial Sequence
  Synthetic
atggccgactcccaagtacgatggttattttgtcacctggaccaccatagttatcaccatggatttctgcagtttctgtcctcaatagctgagtccttgatatacagtcttcaccagactggagacccagcatggcgtat

SEQ ID NO: 366215 - DNA, 140 bp, Artificial Sequence
  Synthetic
aggccctggctgctgatatggcagaaatccatggtgataactatggtggtccaggtgacaaaataaccatctgcaatggttcaaccattgtagatcaaaggctgggtagtgaactggggtgaccttttgggacagcggtg

SEQ ID NO: 366216 - DNA, 140 bp, Artificial Sequence
  Synthetic
caccgctgtcccaaaaggtcaccccagttcactacccagcctttgatctacaatggttgaaccattgcagatggttattttgtcacctggaccaccatagttatcaccatggatttctgccatatcagcagccagggcct

SEQ ID NO: 366217 - DNA, 140 bp, Artificial Sequence
  Synthetic
atacgccatgctgggtctccacaggtaagtcctgtgaaatagataacactccagtaaaatgcaagcaaggtttttgcttgaaaataacccaagaaggaaggggccacgtgaagctttcaacgtacttgggagtcggccat

SEQ ID NO: 366218 - DNA, 140 bp, Artificial Sequence
  Synthetic
atggccgactcccaagtacgttgaaagcttcacgtggccccttccttcttgggttattttcaagcaaaaaccttgcttgcattttactggagtgttatctatttcacaggacttacctgtggagacccagcatggcgtat

SEQ ID NO: 366219 - DNA, 140 bp, Artificial Sequence
  Synthetic
aggccctggctgctgatatggggacttgggaaagagaagaagacctaacaaatttctgtcatcaggaatgccaggttacagagactgaatgcctctgcccttatgaagctctagtactcagaccttttgggacagcggtg

SEQ ID NO: 366220 - DNA, 140 bp, Artificial Sequence
  Synthetic
caccgctgtcccaaaaggtctgagtactagagcttcataagggcagaggcattcagtctctgtaacctggcattcctgatgacagaaatttgttaggtcttcttctctttcccaagtccccatatcagcagccagggcct

SEQ ID NO: 366221 - DNA, 140 bp, Artificial Sequence
  Synthetic
atacgccatgctgggtctccgcacttcttaaaagacaacctgattgatctgggatgccccaacatcccattattaggcaaaatggcaatctacatttgtagaatgtcaaatcatcctaaacgtacttgggagtcggccat

SEQ ID NO: 366222 - DNA, 140 bp, Artificial Sequence
  Synthetic
atggccgactcccaagtacgtttaggatgatttgacattctacaaatgtagattgccattttgcctaataatgggatgttggggcatcccagatcaatcaggttgtcttttaagaagtgcggagacccagcatggcgtat

SEQ ID NO: 366223 - DNA, 140 bp, Artificial Sequence
  Synthetic
aggccctggctgctgatatgtattaggcaaaatggcaatctacatttgtagaatgtcaaatcatcctaaaacaactatggcttttcttttttggtttagctttggttatgtgataacctggaccttttgggacagcggtg

SEQ ID NO: 366224 - DNA, 140 bp, Artificial Sequence
  Synthetic
caccgctgtcccaaaaggtccaggttatcacataaccaaagctaaaccaaaaaagaaaagccatagttgttttaggatgatttgacattctacaaatgtagattgccattttgcctaatacatatcagcagccagggcct

SEQ ID NO: 366225 - DNA, 140 bp, Artificial Sequence
  Synthetic
atacgccatgctgggtctccggaaaaagtttaaacagtatagagagttaaaacctcagacctgcacaatatgtgaaacaactcctgtcaatgcaatagatgctgagatgcacgatctcaacgtacttgggagtcggccat

SEQ ID NO: 366226 - DNA, 140 bp, Artificial Sequence
  Synthetic
atggccgactcccaagtacgttgagatcgtgcatctcagcatctattgcattgacaggagttgtttcacatattgtgcaggtctgaggttttaactctctatactgtttaaactttttccggagacccagcatggcgtat

SEQ ID NO: 366227 - DNA, 140 bp, Artificial Sequence
  Synthetic
atacgccatgctgggtctcctcatggacttgtctcagatgtactctcctgtcttcgagtacttatcaggagacagacaggtggaagagtggcccaaagcaacttgtacaggtgactgccccgtacttgggagtcggccat

SEQ ID NO: 366228 - DNA, 140 bp, Artificial Sequence
  Synthetic
atggccgactcccaagtacggggcagtcacctgtacaagttgctttgggccactcttccacctgtctgtctcctgataagtactcgaagacaggagagtacatctgagacaagtccatgaggagacccagcatggcgtat

SEQ ID NO: 366229 - DNA, 140 bp, Artificial Sequence
  Synthetic
atacgccatgctgggtctccgaaaccgaattatacctgaacttagaaagaatcccttgggttgtcagaaaactactgcaggtgtcagaatccactggtgtagcactaaagaggagcagttcgtacttgggagtcggccat

SEQ ID NO: 366230 - DNA, 140 bp, Artificial Sequence
  Synthetic
atggccgactcccaagtacgaactgctcctctttagtgctacaccagtggattctgacacctgcagtagttttctgacaacccaagggattctttctaagttcaggtataattcggtttcggagacccagcatggcgtat

SEQ ID NO: 366231 - DNA, 140 bp, Artificial Sequence
  Synthetic
aggccctggctgctgatatgactactgcaggtgtcagaatccactggtgtagcactaaagaggagcagttggctgattgtgctacttgtgcttctcacagtttcattgtcaccagtacaagaccttttgggacagcggtg

SEQ ID NO: 366232 - DNA, 140 bp, Artificial Sequence
  Synthetic
caccgctgtcccaaaaggtcttgtactggtgacaatgaaactgtgagaagcacaagtagcacaatcagccaactgctcctctttagtgctacaccagtggattctgacacctgcagtagtcatatcagcagccagggcct

SEQ ID NO: 366233 - DNA, 140 bp, Artificial Sequence
  Synthetic
atacgccatgctgggtctccagggtacacaagtatttgtctttttgtgctaggaagcattttgtttatagtttctcacctaatgaaggggctggttgacagtgttggtaacagtttttttcgtacttgggagtcggccat

SEQ ID NO: 366234 - DNA, 140 bp, Artificial Sequence
  Synthetic
atggccgactcccaagtacgaaaaaaactgttaccaacactgtcaaccagccccttcattaggtgagaaactataaacaaaatgcttcctagcacaaaaagacaaatacttgtgtaccctggagacccagcatggcgtat

SEQ ID NO: 366235 - DNA, 140 bp, Artificial Sequence
  Synthetic
aggccctggctgctgatatgtttctcacctaatgaaggggctggttgacagtgttggtaacagtttttttcctgggttatctatctgcaagacatgctctattggcagtataaatggcttgaccttttgggacagcggtg

SEQ ID NO: 366236 - DNA, 140 bp, Artificial Sequence
  Synthetic
caccgctgtcccaaaaggtcaagccatttatactgccaatagagcatgtcttgcagatagataacccaggaaaaaaactgttaccaacactgtcaaccagccccttcattaggtgagaaacatatcagcagccagggcct

SEQ ID NO: 366237 - DNA, 140 bp, Artificial Sequence
  Synthetic
atacgccatgctgggtctccgtagacactgctctgccgataaagaaatccataagttgcatttgagcatctgcaaaaaaagaaaagctgggagtaatgtcatgttggccgtctgtaagcgcgtacttgggagtcggccat

SEQ ID NO: 366238 - DNA, 140 bp, Artificial Sequence
  Synthetic
atggccgactcccaagtacgcgcttacagacggccaacatgacattactcccagcttttctttttttgcagatgctcaaatgcaacttatggatttctttatcggcagagcagtgtctacggagacccagcatggcgtat

SEQ ID NO: 366239 - DNA, 140 bp, Artificial Sequence
  Synthetic
aggccctggctgctgatatgtgcaaaaaaagaaaagctgggagtaatgtcatgttggccgtctgtaagcgcatgtgttttagggcaactatggaagtgagcaacaaggctctactcatccgaccttttgggacagcggtg

SEQ ID NO: 366240 - DNA, 140 bp, Artificial Sequence
  Synthetic
caccgctgtcccaaaaggtcggatgagtagagccttgttgctcacttccatagttgccctaaaacacatgcgcttacagacggccaacatgacattactcccagcttttctttttttgcacatatcagcagccagggcct

SEQ ID NO: 366241 - DNA, 140 bp, Artificial Sequence
  Synthetic
atacgccatgctgggtctcctctcaaagaaatacttgcggcacgtcagtacgtaagtgttaaatttgaggaagtggattgagcatctcagttgcagttcacctgtcgacatcatgcatatcgtacttgggagtcggccat

SEQ ID NO: 366242 - DNA, 140 bp, Artificial Sequence
  Synthetic
atggccgactcccaagtacgatatgcatgatgtcgacaggtgaactgcaactgagatgctcaatccacttcctcaaatttaacacttacgtactgacgtgccgcaagtatttctttgagaggagacccagcatggcgtat

SEQ ID NO: 366243 - DNA, 140 bp, Artificial Sequence
  Synthetic
atacgccatgctgggtctcctgtgttgttagcacctctgcagtagagatggaaagcctgccagctggcacttgggagagagaggaagacctaacaaacttctgccatcaagaatgccaggcgtacttgggagtcggccat

SEQ ID NO: 366244 - DNA, 140 bp, Artificial Sequence
  Synthetic
atggccgactcccaagtacgcctggcattcttgatggcagaagtttgttaggtcttcctctctctcccaagtgccagctggcaggctttccatctctactgcagaggtgctaacaacacaggagacccagcatggcgtat

SEQ ID NO: 366245 - DNA, 140 bp, Artificial Sequence
  Synthetic
aggccctggctgctgatatgttgggagagagaggaagacctaacaaacttctgccatcaagaatgccaggtcactgaaactgaatgtctctgtccctatgaagctcttgtactcagaaaggaccttttgggacagcggtg

SEQ ID NO: 366246 - DNA, 140 bp, Artificial Sequence
  Synthetic
caccgctgtcccaaaaggtcctttctgagtacaagagcttcatagggacagagacattcagtttcagtgacctggcattcttgatggcagaagtttgttaggtcttcctctctctcccaacatatcagcagccagggcct

SEQ ID NO: 366247 - DNA, 140 bp, Artificial Sequence
  Synthetic
atacgccatgctgggtctcccaaagaagattgaaatatcaggcttaaaatttgcaagcttgacttgcacaggttgttatgcttgtagctctggcatctcatgcaaagttagaattcatgtcgtacttgggagtcggccat

SEQ ID NO: 366248 - DNA, 140 bp, Artificial Sequence
  Synthetic
atggccgactcccaagtacgacatgaattctaactttgcatgagatgccagagctacaagcataacaacctgtgcaagtcaagcttgcaaattttaagcctgatatttcaatcttctttgggagacccagcatggcgtat

SEQ ID NO: 366249 - DNA, 140 bp, Artificial Sequence
  Synthetic
atacgccatgctgggtctccaacaagcttagaaacaagcttatcaattgaggcaccatggggagcaataaacgttcaatctactttcaaacctactgtgtcaactgcaaacatagcacttcgtacttgggagtcggccat

SEQ ID NO: 366250 - DNA, 140 bp, Artificial Sequence
  Synthetic
atggccgactcccaagtacgaagtgctatgtttgcagttgacacagtaggtttgaaagtagattgaacgtttattgctccccatggtgcctcaattgataagcttgtttctaagcttgttggagacccagcatggcgtat

SEQ ID NO: 366251 - DNA, 140 bp, Artificial Sequence
  Synthetic
aggccctggctgctgatatgacgttcaatctactttcaaacctactgtgtcaactgcaaacatagcacttagttggagctcagtggaacacagaggtaataagatcttggtttcaggcaggaccttttgggacagcggtg

SEQ ID NO: 366252 - DNA, 140 bp, Artificial Sequence
  Synthetic
caccgctgtcccaaaaggtcctgcctgaaaccaagatcttattacctctgtgttccactgagctccaactaagtgctatgtttgcagttgacacagtaggtttgaaagtagattgaacgtcatatcagcagccagggcct

SEQ ID NO: 366253 - DNA, 140 bp, Artificial Sequence
  Synthetic
atacgccatgctgggtctcctgggagtagaagatgcctctgagtccaaattacttactgtttccgtcatggacttatcacagatgtactctcctgtctttgagtacctatcaggtgacagcgtacttgggagtcggccat

SEQ ID NO: 366254 - DNA, 140 bp, Artificial Sequence
  Synthetic
atggccgactcccaagtacgctgtcacctgataggtactcaaagacaggagagtacatctgtgataagtccatgacggaaacagtaagtaatttggactcagaggcatcttctactcccaggagacccagcatggcgtat

SEQ ID NO: 366255 - DNA, 140 bp, Artificial Sequence
  Synthetic
aggccctggctgctgatatggacttatcacagatgtactctcctgtctttgagtacctatcaggtgacagacaagtagaggaatggccaaaggcaacctgtacaggcgattgcccggaaagaccttttgggacagcggtg

SEQ ID NO: 366256 - DNA, 140 bp, Artificial Sequence
  Synthetic
caccgctgtcccaaaaggtctttccgggcaatcgcctgtacaggttgcctttggccattcctctacttgtctgtcacctgataggtactcaaagacaggagagtacatctgtgataagtccatatcagcagccagggcct

SEQ ID NO: 366257 - DNA, 140 bp, Artificial Sequence
  Synthetic
atacgccatgctgggtctccagaaactggagatgcaaccccacttggtgttggggagtcggcaccggatgcacctgttgtggactagatgtaaaggacctttttacagattacatgtttgcgtacttgggagtcggccat

SEQ ID NO: 366258 - DNA, 140 bp, Artificial Sequence
  Synthetic
atggccgactcccaagtacgcaaacatgtaatctgtaaaaaggtcctttacatctagtccacaacaggtgcatccggtgccgactccccaacaccaagtggggttgcatctccagtttctggagacccagcatggcgtat

SEQ ID NO: 366259 - DNA, 140 bp, Artificial Sequence
  Synthetic
aggccctggctgctgatatgcacctgttgtggactagatgtaaaggacctttttacagattacatgtttgttaaatggaaggtcgaatatataaaaacagaggctatagtgtgtgttgaggaccttttgggacagcggtg

SEQ ID NO: 366260 - DNA, 140 bp, Artificial Sequence
  Synthetic
caccgctgtcccaaaaggtcctcaacacacactatagcctctgtttttatatattcgaccttccatttaacaaacatgtaatctgtaaaaaggtcctttacatctagtccacaacaggtgcatatcagcagccagggcct

SEQ ID NO: 366261 - DNA, 140 bp, Artificial Sequence
  Synthetic
aggccctggctgctgatatgaacaataaaaaaggaaaaaacaaattgcttgatggtgaaagacttgctgatagaagaattgctgaactgttctccacaaaaacacacattggctagaccagaccttttgggacagcggtg

SEQ ID NO: 366262 - DNA, 140 bp, Artificial Sequence
  Synthetic
caccgctgtcccaaaaggtctggtctagccaatgtgtgtttttgtggagaacagttcagcaattcttctatcagcaagtctttcaccatcaagcaatttgttttttccttttttattgttcatatcagcagccagggcct

SEQ ID NO: 366263 - DNA, 140 bp, Artificial Sequence
  Synthetic
atacgccatgctgggtctcccaacttaggtcctgtgactatcacattatcagagccaagaaacattcagcaaaagctccctccagaaattgtcacattacatcctagaattgaagaaggtcgtacttgggagtcggccat

SEQ ID NO: 366264 - DNA, 140 bp, Artificial Sequence
  Synthetic
atggccgactcccaagtacgaccttcttcaattctaggatgtaatgtgacaatttctggagggagcttttgctgaatgtttcttggctctgataatgtgatagtcacaggacctaagttgggagacccagcatggcgtat

SEQ ID NO: 366265 - DNA, 140 bp, Artificial Sequence
  Synthetic
aggccctggctgctgatatgaaaagctccctccagaaattgtcacattacatcctagaattgaagaaggtttttttgacttaatgcatgtacagaaggtactatcagcaagcacagtgtggaccttttgggacagcggtg

SEQ ID NO: 366266 - DNA, 140 bp, Artificial Sequence
  Synthetic
caccgctgtcccaaaaggtccacactgtgcttgctgatagtaccttctgtacatgcattaagtcaaaaaaaccttcttcaattctaggatgtaatgtgacaatttctggagggagcttttcatatcagcagccagggcct

SEQ ID NO: 366267 - DNA, 140 bp, Artificial Sequence
  Synthetic
atacgccatgctgggtctccatgctaacatctttagttgcaaccctactgcattatcatagcaatatactgcatctaatctgcttcattgtatctatgaacagactctataatgcttgaacgtacttgggagtcggccat

SEQ ID NO: 366268 - DNA, 140 bp, Artificial Sequence
  Synthetic
atggccgactcccaagtacgttcaagcattatagagtctgttcatagatacaatgaagcagattagatgcagtatattgctatgataatgcagtagggttgcaactaaagatgttagcatggagacccagcatggcgtat

SEQ ID NO: 366269 - DNA, 140 bp, Artificial Sequence
  Synthetic
aggccctggctgctgatatggcatctaatctgcttcattgtatctatgaacagactctataatgcttgaaactgcctttactctatttactctgacctaaatctcgactgcgtgccgccagaccttttgggacagcggtg

SEQ ID NO: 366270 - DNA, 140 bp, Artificial Sequence
  Synthetic
caccgctgtcccaaaaggtctggcggcacgcagtcgagatttaggtcagagtaaatagagtaaaggcagtttcaagcattatagagtctgttcatagatacaatgaagcagattagatgccatatcagcagccagggcct

SEQ ID NO: 366271 - DNA, 140 bp, Artificial Sequence
  Synthetic
atacgccatgctgggtctccacatcggaaacttactaaaaggagacaaagtgaacgggcatctgatacataaagttgaaccacatttcaacacctcctggatgtcttgggacggctgtgacgtacttgggagtcggccat

SEQ ID NO: 366272 - DNA, 140 bp, Artificial Sequence
  Synthetic
atggccgactcccaagtacgtcacagccgtcccaagacatccaggaggtgttgaaatgtggttcaactttatgtatcagatgcccgttcactttgtctccttttagtaagtttccgatgtggagacccagcatggcgtat

SEQ ID NO: 366273 - DNA, 140 bp, Artificial Sequence
  Synthetic
aggccctggctgctgatatgaaagttgaaccacatttcaacacctcctggatgtcttgggacggctgtgacctagattactactgcaatatgggggattggccctcttgcacgtatactggaccttttgggacagcggtg

SEQ ID NO: 366274 - DNA, 140 bp, Artificial Sequence
  Synthetic
caccgctgtcccaaaaggtccagtatacgtgcaagagggccaatcccccatattgcagtagtaatctaggtcacagccgtcccaagacatccaggaggtgttgaaatgtggttcaactttcatatcagcagccagggcct

SEQ ID NO: 366275 - DNA, 140 bp, Artificial Sequence
  Synthetic
atacgccatgctgggtctccactgattacacaaagaacttccactttcactctaagagagtcactgcacatggggacactccacaattagatttaaaagccagaccaaattatggtgcagcgtacttgggagtcggccat

SEQ ID NO: 366276 - DNA, 140 bp, Artificial Sequence
  Synthetic
atggccgactcccaagtacgctgcaccataatttggtctggcttttaaatctaattgtggagtgtccccatgtgcagtgactctcttagagtgaaagtggaagttctttgtgtaatcagtggagacccagcatggcgtat

SEQ ID NO: 366277 - DNA, 140 bp, Artificial Sequence
  Synthetic
aggccctggctgctgatatgtggggacactccacaattagatttaaaagccagaccaaattatggtgcaggtgaggtcactgtgctggtggaagttgctgacatggagttacacacaaaggaccttttgggacagcggtg

SEQ ID NO: 366278 - DNA, 140 bp, Artificial Sequence
  Synthetic
caccgctgtcccaaaaggtcctttgtgtgtaactccatgtcagcaacttccaccagcacagtgacctcacctgcaccataatttggtctggcttttaaatctaattgtggagtgtccccacatatcagcagccagggcct

SEQ ID NO: 366279 - DNA, 140 bp, Artificial Sequence
  Synthetic
aggccctggctgctgatatgagtggattgagcatcttaattgcagcatacctgtcaacatcatgcatatatcattaatgtatgcagtcctttgcctacagctgtgtagtctgggagaaacgaccttttgggacagcggtg

SEQ ID NO: 366280 - DNA, 140 bp, Artificial Sequence
  Synthetic
caccgctgtcccaaaaggtcgtttctcccagactacacagctgtaggcaaaggactgcatacattaatgatatatgcatgatgttgacaggtatgctgcaattaagatgctcaatccactcatatcagcagccagggcct

SEQ ID NO: 366281 - DNA, 140 bp, Artificial Sequence
  Synthetic
atacgccatgctgggtctccttatgcttgtagctctggcatctcatgtaaggttaggatccatgtagatgaaccagatgagcttacagtacatgtgaagagtgaagacccagacatagttcgtacttgggagtcggccat

SEQ ID NO: 366282 - DNA, 140 bp, Artificial Sequence
  Synthetic
atggccgactcccaagtacgaactatgtctgggtcttcactcttcacatgtactgtaagctcatctggttcatctacatggatcctaaccttacatgagatgccagagctacaagcataaggagacccagcatggcgtat

SEQ ID NO: 366283 - DNA, 140 bp, Artificial Sequence
  Synthetic
aggccctggctgctgatatgaaccagatgagcttacagtacatgtgaagagtgaagacccagacatagttgctgctagctcaagtctcatggcaagaaagcttgaattcgggacggataggaccttttgggacagcggtg

SEQ ID NO: 366284 - DNA, 140 bp, Artificial Sequence
  Synthetic
caccgctgtcccaaaaggtcctatccgtcccgaattcaagctttcttgccatgagacttgagctagcagcaactatgtctgggtcttcactcttcacatgtactgtaagctcatctggttcatatcagcagccagggcct

SEQ ID NO: 366285 - DNA, 140 bp, Artificial Sequence
  Synthetic
atacgccatgctgggtctccttgttgagagagaatactgtaaaagctgcagtaaagaagacacacaaaagtgtgttaacgcaaagcttgagcgaccacagagcattttaattgagcacaacgtacttgggagtcggccat

SEQ ID NO: 366286 - DNA, 140 bp, Artificial Sequence
  Synthetic
atggccgactcccaagtacgttgtgctcaattaaaatgctctgtggtcgctcaagctttgcgttaacacacttttgtgtgtcttctttactgcagcttttacagtattctctctcaacaaggagacccagcatggcgtat

SEQ ID NO: 366287 - DNA, 140 bp, Artificial Sequence
  Synthetic
aggccctggctgctgatatgtgtgttaacgcaaagcttgagcgaccacagagcattttaattgagcacaaaggaacgataattggaaagcagaacgacacttgcacagctaaagcaagctgaccttttgggacagcggtg

SEQ ID NO: 366288 - DNA, 140 bp, Artificial Sequence
  Synthetic
caccgctgtcccaaaaggtcagcttgctttagctgtgcaagtgtcgttctgctttccaattatcgttcctttgtgctcaattaaaatgctctgtggtcgctcaagctttgcgttaacacacatatcagcagccagggcct

SEQ ID NO: 366289 - DNA, 140 bp, Artificial Sequence
  Synthetic
aggccctggctgctgatatgttttatcctgttaatacttttctttatgtttgggtggagaatcctattctgctttaagtgctgcaggagaactagaggcctatttaagtacagacacctcgaccttttgggacagcggtg

SEQ ID NO: 366290 - DNA, 140 bp, Artificial Sequence
  Synthetic
caccgctgtcccaaaaggtcgaggtgtctgtacttaaataggcctctagttctcctgcagcacttaaagcagaataggattctccacccaaacataaagaaaagtattaacaggataaaacatatcagcagccagggcct

SEQ ID NO: 366291 - DNA, 140 bp, Artificial Sequence
  Synthetic
atacgccatgctgggtctcccaaaaaaggtaaaaacaagctgcttgacggtgaaagattagctgatagaaagatcgctgagctgttctctacaaaaacacacattggctgaaacaacagacgtacttgggagtcggccat

SEQ ID NO: 366292 - DNA, 140 bp, Artificial Sequence
  Synthetic
atggccgactcccaagtacgtctgttgtttcagccaatgtgtgtttttgtagagaacagctcagcgatctttctatcagctaatctttcaccgtcaagcagcttgtttttaccttttttgggagacccagcatggcgtat

SEQ ID NO: 366293 - DNA, 140 bp, Artificial Sequence
  Synthetic
atacgccatgctgggtctccccagcatcaccggttgtacccatgccacactatcattgcaacatgttacatttaacctgtctcatcgtactcacaagtaagctctgcaacacctgaaatccgtacttgggagtcggccat

SEQ ID NO: 366294 - DNA, 140 bp, Artificial Sequence
  Synthetic
atggccgactcccaagtacggatttcaggtgttgcagagcttacttgtgagtacgatgagacaggttaaatgtaacatgttgcaatgatagtgtggcatgggtacaaccggtgatgctggggagacccagcatggcgtat

SEQ ID NO: 366295 - DNA, 140 bp, Artificial Sequence
  Synthetic
aggccctggctgctgatatgtttaacctgtctcatcgtactcacaagtaagctctgcaacacctgaaatcaccactgctctattcactctgacctaaaccttgactgcgtgccgccactagaccttttgggacagcggtg

SEQ ID NO: 366296 - DNA, 140 bp, Artificial Sequence
  Synthetic
caccgctgtcccaaaaggtctagtggcggcacgcagtcaaggtttaggtcagagtgaatagagcagtggtgatttcaggtgttgcagagcttacttgtgagtacgatgagacaggttaaacatatcagcagccagggcct

SEQ ID NO: 366297 - DNA, 140 bp, Artificial Sequence
  Synthetic
atacgccatgctgggtctcctctcaaagatatcaatcccccctttacccacattgtcgcagacggctccagtagtggttctttgtccttgtcaaactatggatttcctgagaagcctcgacgtacttgggagtcggccat

SEQ ID NO: 366298 - DNA, 140 bp, Artificial Sequence
  Synthetic
atggccgactcccaagtacgtcgaggcttctcaggaaatccatagtttgacaaggacaaagaaccactactggagccgtctgcgacaatgtgggtaaaggggggattgatatctttgagaggagacccagcatggcgtat

SEQ ID NO: 366299 - DNA, 140 bp, Artificial Sequence
  Synthetic
aggccctggctgctgatatggtagtggttctttgtccttgtcaaactatggatttcctgagaagcctcgactggactcaggtgattgctggtcagtacgtgaccaatccaaggttcaatagaccttttgggacagcggtg

SEQ ID NO: 366300 - DNA, 140 bp, Artificial Sequence
  Synthetic
caccgctgtcccaaaaggtctattgaaccttggattggtcacgtactgaccagcaatcacctgagtccagtcgaggcttctcaggaaatccatagtttgacaaggacaaagaaccactaccatatcagcagccagggcct

SEQ ID NO: 366301 - DNA, 140 bp, Artificial Sequence
  Synthetic
atacgccatgctgggtctccctggactcaggtgattgctggtcagtacgtgaccaatccaaggttcaatatctctgattactttgagattgtacgacaacctggtgatgggaactgcttccgtacttgggagtcggccat

SEQ ID NO: 366302 - DNA, 140 bp, Artificial Sequence
  Synthetic
atggccgactcccaagtacggaagcagttcccatcaccaggttgtcgtacaatctcaaagtaatcagagatattgaaccttggattggtcacgtactgaccagcaatcacctgagtccagggagacccagcatggcgtat

SEQ ID NO: 366303 - DNA, 140 bp, Artificial Sequence
  Synthetic
atacgccatgctgggtctccccataacatcaagcacctaactgaggtggcagcacggaagtattaccaggaggagcctgaagctaagcttattggcctgagtttggaggattatcttaagcgtacttgggagtcggccat

SEQ ID NO: 366304 - DNA, 140 bp, Artificial Sequence
  Synthetic
atggccgactcccaagtacgcttaagataatcctccaaactcaggccaataagcttagcttcaggctcctcctggtaatacttccgtgctgccacctcagttaggtgcttgatgttatggggagacccagcatggcgtat

SEQ ID NO: 366305 - DNA, 140 bp, Artificial Sequence
  Synthetic
aggccctggctgctgatatgggatttcctggatagaacccagttgcatccagagttcagagatctaactcctgacttttcgctcacacaaaaggttcacttcaaaagaaatcagatacccgaccttttgggacagcggtg

SEQ ID NO: 366306 - DNA, 140 bp, Artificial Sequence
  Synthetic
caccgctgtcccaaaaggtcgggtatctgatttcttttgaagtgaaccttttgtgtgagcgaaaagtcaggagttagatctctgaactctggatgcaactgggttctatccaggaaatcccatatcagcagccagggcct

SEQ ID NO: 366307 - DNA, 140 bp, Artificial Sequence
  Synthetic
aggccctggctgctgatatggttctagtggaggttgcagatctggagctacacactaagaaaatagaagtgtcagggttgaagtttgcaagtctgacctgctccggttgttatgcctgcagaccttttgggacagcggtg

SEQ ID NO: 366308 - DNA, 140 bp, Artificial Sequence
  Synthetic
caccgctgtcccaaaaggtctgcaggcataacaaccggagcaggtcagacttgcaaacttcaaccctgacacttctattttcttagtgtgtagctccagatctgcaacctccactagaaccatatcagcagccagggcct

SEQ ID NO: 366309 - DNA, 140 bp, Artificial Sequence
  Synthetic
atacgccatgctgggtctccatgaagtagaagcaggcataaagtttggagatggtgatgtgtttacagccgtgaacctcctgcactccggacagacacactttgacgctctcagaatgctcgtacttgggagtcggccat

SEQ ID NO: 366310 - DNA, 140 bp, Artificial Sequence
  Synthetic
atggccgactcccaagtacgagcattctgagagcgtcaaagtgtgtctgtccggagtgcaggaggttcacggctgtaaacacatcaccatctccaaactttatgcctgcttctacttcatggagacccagcatggcgtat

SEQ ID NO: 366311 - DNA, 140 bp, Artificial Sequence
  Synthetic
aggccctggctgctgatatggtgaacctcctgcactccggacagacacactttgacgctctcagaatgctgccacagtttgaagctgatacaagagagaccttaagtttggtagacaagggaccttttgggacagcggtg

SEQ ID NO: 366312 - DNA, 140 bp, Artificial Sequence
  Synthetic
caccgctgtcccaaaaggtcccttgtctaccaaacttaaggtctctcttgtatcagcttcaaactgtggcagcattctgagagcgtcaaagtgtgtctgtccggagtgcaggaggttcaccatatcagcagccagggcct

SEQ ID NO: 366313 - DNA, 140 bp, Artificial Sequence
  Synthetic
atacgccatgctgggtctccctcatgcatggagaaaaactttctgccaagaaaaaagacggagatcgggcggaacagggcaacaagcagagcaccactgaacacgagagctccagcatctcgtacttgggagtcggccat

SEQ ID NO: 366314 - DNA, 140 bp, Artificial Sequence
  Synthetic
atggccgactcccaagtacgagatgctggagctctcgtgttcagtggtgctctgcttgttgccctgttccgcccgatctccgtcttttttcttggcagaaagtttttctccatgcatgagggagacccagcatggcgtat

SEQ ID NO: 366315 - DNA, 140 bp, Artificial Sequence
  Synthetic
atacgccatgctgggtctcctatgaagaccttgccttagcacttactagtgcggaagaaccatgtagacgatctagtctggatgaggttaccctgtccaagaaacaagcagagatgttgacgtacttgggagtcggccat

SEQ ID NO: 366316 - DNA, 140 bp, Artificial Sequence
  Synthetic
atggccgactcccaagtacgtcaacatctctgcttgtttcttggacagggtaacctcatccagactagatcgtctacatggttcttccgcactagtaagtgctaaggcaaggtcttcataggagacccagcatggcgtat

SEQ ID NO: 366317 - DNA, 140 bp, Artificial Sequence
  Synthetic
aggccctggctgctgatatgatctagtctggatgaggttaccctgtccaagaaacaagcagagatgttgaggcagaaggcatatcagctgtctaaactggtcaataaaagtcagaatatagaccttttgggacagcggtg

SEQ ID NO: 366318 - DNA, 140 bp, Artificial Sequence
  Synthetic
caccgctgtcccaaaaggtctatattctgacttttattgaccagtttagacagctgatatgccttctgcctcaacatctctgcttgtttcttggacagggtaacctcatccagactagatcatatcagcagccagggcct

SEQ ID NO: 366319 - DNA, 140 bp, Artificial Sequence
  Synthetic
atacgccatgctgggtctcctgttgaaatatcagctgacactctgattctgcgaccagagtccaaggaaagaataggtgaagttatgtcgttgcggcagctagggcacaagttgctaacacgtacttgggagtcggccat

SEQ ID NO: 366320 - DNA, 140 bp, Artificial Sequence
  Synthetic
atggccgactcccaagtacgtgttagcaacttgtgccctagctgccgcaacgacataacttcacctattctttccttggactctggtcgcagaatcagagtgtcagctgatatttcaacaggagacccagcatggcgtat

SEQ ID NO: 366321 - DNA, 140 bp, Artificial Sequence
  Synthetic
aggccctggctgctgatatggaataggtgaagttatgtcgttgcggcagctagggcacaagttgctaacacgggacaaacaaataaagcaagaattctctagaatgaagctctacgttacgaccttttgggacagcggtg

SEQ ID NO: 366322 - DNA, 140 bp, Artificial Sequence
  Synthetic
caccgctgtcccaaaaggtcgtaacgtagagcttcattctagagaattcttgctttatttgtttgtcccgtgttagcaacttgtgccctagctgccgcaacgacataacttcacctattccatatcagcagccagggcct

SEQ ID NO: 366323 - DNA, 140 bp, Artificial Sequence
  Synthetic
atacgccatgctgggtctcctccctggaacagggatagaaagacacatgcagttactacactctgaaatgatactagacatttgtactgtatcacttggcgtcatgttatcaacatttttcgtacttgggagtcggccat

SEQ ID NO: 366324 - DNA, 140 bp, Artificial Sequence
  Synthetic
atggccgactcccaagtacgaaaaatgttgataacatgacgccaagtgatacagtacaaatgtctagtatcatttcagagtgtagtaactgcatgtgtctttctatccctgttccagggaggagacccagcatggcgtat

SEQ ID NO: 366325 - DNA, 140 bp, Artificial Sequence
  Synthetic
atacgccatgctgggtctccttagcacagccttgtctgggaagaaggtgtataaggttctcggtaacttagggaatgaactgttgtataaggcacccagaaaggccttagcaactgtctgcgtacttgggagtcggccat

SEQ ID NO: 366326 - DNA, 140 bp, Artificial Sequence
  Synthetic
atggccgactcccaagtacgcagacagttgctaaggcctttctgggtgccttatacaacagttcattccctaagttaccgagaaccttatacaccttcttcccagacaaggctgtgctaaggagacccagcatggcgtat

SEQ ID NO: 366327 - DNA, 140 bp, Artificial Sequence
  Synthetic
aggccctggctgctgatatggggaatgaactgttgtataaggcacccagaaaggccttagcaactgtctgtagtgccctgtttgggaaacagataaacaagcttcagaactgcttcaggagaccttttgggacagcggtg

SEQ ID NO: 366328 - DNA, 140 bp, Artificial Sequence
  Synthetic
caccgctgtcccaaaaggtctcctgaagcagttctgaagcttgtttatctgtttcccaaacagggcactacagacagttgctaaggcctttctgggtgccttatacaacagttcattccccatatcagcagccagggcct

SEQ ID NO: 366329 - DNA, 140 bp, Artificial Sequence
  Synthetic
aggccctggctgctgatatgtaacactgacgttgagttcaaccacagggaaatagccgatctcaaccaattgacttctcggcttattacgttgagaaaagaaaaggacactgacctccttgaccttttgggacagcggtg

SEQ ID NO: 366330 - DNA, 140 bp, Artificial Sequence
  Synthetic
caccgctgtcccaaaaggtcaaggaggtcagtgtccttttcttttctcaacgtaataagccgagaagtcaattggttgagatcggctatttccctgtggttgaactcaacgtcagtgttacatatcagcagccagggcct

SEQ ID NO: 366331 - DNA, 140 bp, Artificial Sequence
  Synthetic
aggccctggctgctgatatgaagtctgatggcaaggaaaatagagtttggggctgacagcacctttaaagccttttcatcaatgcctaaaaactctttgtgcttttatatagtggaaagagaccttttgggacagcggtg

SEQ ID NO: 366332 - DNA, 140 bp, Artificial Sequence
  Synthetic
caccgctgtcccaaaaggtctctttccactatataaaagcacaaagagtttttaggcattgatgaaaaggctttaaaggtgctgtcagccccaaactctattttccttgccatcagacttcatatcagcagccagggcct

SEQ ID NO: 366333 - DNA, 140 bp, Artificial Sequence
  Synthetic
atacgccatgctgggtctcctgcaaatgcagaagaatttgtcatatctgagttcttcaagaagaaggacattatgaagttcatcagcacctcaggcagagcaatgagtgcaggcaaaattcgtacttgggagtcggccat

SEQ ID NO: 366334 - DNA, 140 bp, Artificial Sequence
  Synthetic
atggccgactcccaagtacgaattttgcctgcactcattgctctgcctgaggtgctgatgaacttcataatgtccttcttcttgaagaactcagatatgacaaattcttctgcatttgcaggagacccagcatggcgtat

SEQ ID NO: 366335 - DNA, 140 bp, Artificial Sequence
  Synthetic
aggccctggctgctgatatgttatgaagttcatcagcacctcaggcagagcaatgagtgcaggcaaaattggtaatgtcctttcttatgcacataacctttatttgagcaaatccagcctgaccttttgggacagcggtg

SEQ ID NO: 366336 - DNA, 140 bp, Artificial Sequence
  Synthetic
caccgctgtcccaaaaggtcaggctggatttgctcaaataaaggttatgtgcataagaaaggacattaccaattttgcctgcactcattgctctgcctgaggtgctgatgaacttcataacatatcagcagccagggcct

SEQ ID NO: 366337 - DNA, 140 bp, Artificial Sequence
  Synthetic
atacgccatgctgggtctcctatatgctctacaggaagattctgaagtagagccaatagccataatttgtgacggcatagagagcaacatgaagcagttatttgctatattacctcctgacgtacttgggagtcggccat

SEQ ID NO: 366338 - DNA, 140 bp, Artificial Sequence
  Synthetic
atggccgactcccaagtacgtcaggaggtaatatagcaaataactgcttcatgttgctctctatgccgtcacaaattatggctattggctctacttcagaatcttcctgtagagcatataggagacccagcatggcgtat

SEQ ID NO: 366339 - DNA, 140 bp, Artificial Sequence
  Synthetic
aggccctggctgctgatatgttataaacatcagaaactcattgaaagctagatccgagtttgtcagaaataacgataaactactcataaggtcaaaagaagaactgaaaaaatgtttcgagaccttttgggacagcggtg

SEQ ID NO: 366340 - DNA, 140 bp, Artificial Sequence
  Synthetic
caccgctgtcccaaaaggtctcgaaacattttttcagttcttcttttgaccttatgagtagtttatcgttatttctgacaaactcggatctagctttcaatgagtttctgatgtttataacatatcagcagccagggcct

SEQ ID NO: 366341 - DNA, 140 bp, Artificial Sequence
  Synthetic
aggccctggctgctgatatgtgtgcaatcttttaaattgaaaaaaaacaagcaacctgtgccctttcaagttgactgtatactgttcaaagaagtggcagctgaatgcatgaagaggtacgaccttttgggacagcggtg

SEQ ID NO: 366342 - DNA, 140 bp, Artificial Sequence
  Synthetic
caccgctgtcccaaaaggtcgtacctcttcatgcattcagctgccacttctttgaacagtatacagtcaacttgaaagggcacaggttgcttgttttttttcaatttaaaagattgcacacatatcagcagccagggcct

SEQ ID NO: 366343 - DNA, 140 bp, Artificial Sequence
  Synthetic
atacgccatgctgggtctccgagggtttatttgccaactgctatggatggcaatacatcccggaagacatcaaaccaagtctgaccatgctgatacagacgttgttccctgacaaattcgcgtacttgggagtcggccat

SEQ ID NO: 366344 - DNA, 140 bp, Artificial Sequence
  Synthetic
atggccgactcccaagtacgcgaatttgtcagggaacaacgtctgtatcagcatggtcagacttggtttgatgtcttccgggatgtattgccatccatagcagttggcaaataaaccctcggagacccagcatggcgtat

SEQ ID NO: 366345 - DNA, 140 bp, Artificial Sequence
  Synthetic
aggccctggctgctgatatgcaaaccaagtctgaccatgctgatacagacgttgttccctgacaaattcgaggatttcctggaccgaactcaactacatccagagttcagagatttaactgaccttttgggacagcggtg

SEQ ID NO: 366346 - DNA, 140 bp, Artificial Sequence
  Synthetic
caccgctgtcccaaaaggtcagttaaatctctgaactctggatgtagttgagttcggtccaggaaatcctcgaatttgtcagggaacaacgtctgtatcagcatggtcagacttggtttgcatatcagcagccagggcct

SEQ ID NO: 366347 - DNA, 140 bp, Artificial Sequence
  Synthetic
atacgccatgctgggtctcccagtgttgaaaacgtgcaaatctctatagacgcaacattgcctgagtctgtggaagcagtgccagtgacagaaagaaagatgttccctctacctgagactcgtacttgggagtcggccat

SEQ ID NO: 366348 - DNA, 140 bp, Artificial Sequence
  Synthetic
atggccgactcccaagtacgagtctcaggtagagggaacatctttctttctgtcactggcactgcttccacagactcaggcaatgttgcgtctatagagatttgcacgttttcaacactgggagacccagcatggcgtat

SEQ ID NO: 366349 - DNA, 140 bp, Artificial Sequence
  Synthetic
aggccctggctgctgatatgtggaagcagtgccagtgacagaaagaaagatgttccctctacctgagactcctttaagtgaggtacattcaatagagcgcatcatggaaaatttcactcggaccttttgggacagcggtg

SEQ ID NO: 366350 - DNA, 140 bp, Artificial Sequence
  Synthetic
caccgctgtcccaaaaggtccgagtgaaattttccatgatgcgctctattgaatgtacctcacttaaaggagtctcaggtagagggaacatctttctttctgtcactggcactgcttccacatatcagcagccagggcct

SEQ ID NO: 366351 - DNA, 140 bp, Artificial Sequence
  Synthetic
atacgccatgctgggtctcccaggacaggacagtcagcaaaatgctgctgagcatgagagttcaagcattttggctttcaaggactatggagagaggggaatagttgaggagaatcacatcgtacttgggagtcggccat

SEQ ID NO: 366352 - DNA, 140 bp, Artificial Sequence
  Synthetic
atggccgactcccaagtacgatgtgattctcctcaactattcccctctctccatagtccttgaaagccaaaatgcttgaactctcatgctcagcagcattttgctgactgtcctgtcctgggagacccagcatggcgtat

SEQ ID NO: 366353 - DNA, 140 bp, Artificial Sequence
  Synthetic
aggccctggctgctgatatgttggctttcaaggactatggagagaggggaatagttgaggagaatcacatgaggtttagtgaagaggatcagctggagacaaggcagctgttgttggtgggaccttttgggacagcggtg

SEQ ID NO: 366354 - DNA, 140 bp, Artificial Sequence
  Synthetic
caccgctgtcccaaaaggtcccaccaacaacagctgccttgtctccagctgatcctcttcactaaacctcatgtgattctcctcaactattcccctctctccatagtccttgaaagccaacatatcagcagccagggcct

SEQ ID NO: 366355 - DNA, 140 bp, Artificial Sequence
  Synthetic
atacgccatgctgggtctccaaatggaaagacatactaaagctgttagagttactgggaatcaaatgctcattcattgcttgtgccgactgctcgtccacaccgccagacaggtggtggacgtacttgggagtcggccat

SEQ ID NO: 366356 - DNA, 140 bp, Artificial Sequence
  Synthetic
atggccgactcccaagtacgtccaccacctgtctggcggtgtggacgagcagtcggcacaagcaatgaatgagcatttgattcccagtaactctaacagctttagtatgtctttccatttggagacccagcatggcgtat

SEQ ID NO: 366357 - DNA, 140 bp, Artificial Sequence
  Synthetic
aggccctggctgctgatatgattcattgcttgtgccgactgctcgtccacaccgccagacaggtggtggattactgaagacagagtacgagtcttgaagaactcagtcagcttcctcttcgaccttttgggacagcggtg

SEQ ID NO: 366358 - DNA, 140 bp, Artificial Sequence
  Synthetic
caccgctgtcccaaaaggtcgaagaggaagctgactgagttcttcaagactcgtactctgtcttcagtaatccaccacctgtctggcggtgtggacgagcagtcggcacaagcaatgaatcatatcagcagccagggcct

SEQ ID NO: 366359 - DNA, 140 bp, Artificial Sequence
  Synthetic
aggccctggctgctgatatgttggtaagcaaaatgacacctgtccgaccaaaacaagctgctggctagaatcagtcaagagttttttttatggactgaaaaacatgctgggtggcatcttgaccttttgggacagcggtg

SEQ ID NO: 366360 - DNA, 140 bp, Artificial Sequence
  Synthetic
caccgctgtcccaaaaggtcaagatgccacccagcatgtttttcagtccataaaaaaaactcttgactgattctagccagcagcttgttttggtcggacaggtgtcattttgcttaccaacatatcagcagccagggcct

SEQ ID NO: 366361 - DNA, 140 bp, Artificial Sequence
  Synthetic
atacgccatgctgggtctccggccataagtactcaaaaggttaggagttacttaaaggcagggactgctacaaaaactcctgtatcaacaaaagatgtcctagagacttgggaaaggatgcgtacttgggagtcggccat

SEQ ID NO: 366362 - DNA, 140 bp, Artificial Sequence
  Synthetic
atggccgactcccaagtacgcatcctttcccaagtctctaggacatcttttgttgatacaggagtttttgtagcagtccctgcctttaagtaactcctaaccttttgagtacttatggccggagacccagcatggcgtat

SEQ ID NO: 366363 - DNA, 140 bp, Artificial Sequence
  Synthetic
aggccctggctgctgatatgcaaaaactcctgtatcaacaaaagatgtcctagagacttgggaaaggatgaaagagcacatactcaacaggcctacaggtttgacactgcctgccagtttgaccttttgggacagcggtg

SEQ ID NO: 366364 - DNA, 140 bp, Artificial Sequence
  Synthetic
caccgctgtcccaaaaggtcaaactggcaggcagtgtcaaacctgtaggcctgttgagtatgtgctctttcatcctttcccaagtctctaggacatcttttgttgatacaggagtttttgcatatcagcagccagggcct

SEQ ID NO: 366365 - DNA, 140 bp, Artificial Sequence
  Synthetic
atacgccatgctgggtctccagggttctgaatcatgcatcaacatgttaaaggagaatttggaccggataactgatgagtttgagcggacaaaatttaaacatgagctaacacagaatgtcgtacttgggagtcggccat

SEQ ID NO: 366366 - DNA, 140 bp, Artificial Sequence
  Synthetic
atggccgactcccaagtacgacattctgtgttagctcatgtttaaattttgtccgctcaaactcatcagttatccggtccaaattctcctttaacatgttgatgcatgattcagaaccctggagacccagcatggcgtat

SEQ ID NO: 366367 - DNA, 140 bp, Artificial Sequence
  Synthetic
aggccctggctgctgatatgactgatgagtttgagcggacaaaatttaaacatgagctaacacagaatgttaccactagtgaaaagatgctgttaagttggctgagtgaagacatcaaatgaccttttgggacagcggtg

SEQ ID NO: 366368 - DNA, 140 bp, Artificial Sequence
  Synthetic
caccgctgtcccaaaaggtcatttgatgtcttcactcagccaacttaacagcatcttttcactagtggtaacattctgtgttagctcatgtttaaattttgtccgctcaaactcatcagtcatatcagcagccagggcct

SEQ ID NO: 366369 - DNA, 140 bp, Artificial Sequence
  Synthetic
atacgccatgctgggtctccctgagaataagaagatagtcaaaatgcttcgagggaagctaaagaaactcggtgctatctcaacaaatatagagatcgggaaaagggattgcctagatctcgtacttgggagtcggccat

SEQ ID NO: 366370 - DNA, 140 bp, Artificial Sequence
  Synthetic
atggccgactcccaagtacgagatctaggcaatcccttttcccgatctctatatttgttgagatagcaccgagtttctttagcttccctcgaagcattttgactatcttcttattctcagggagacccagcatggcgtat

SEQ ID NO: 366371 - DNA, 140 bp, Artificial Sequence
  Synthetic
aggccctggctgctgatatgtactagtcactgtagtaactgtcaccccaacggtgtgaacattagcaacatatcaaatgtgtgcaagaggtgtcccagaatagaagtagtcagccattgtgaccttttgggacagcggtg

SEQ ID NO: 366372 - DNA, 140 bp, Artificial Sequence
  Synthetic
caccgctgtcccaaaaggtcacaatggctgactacttctattctgggacacctcttgcacacatttgatatgttgctaatgttcacaccgttggggtgacagttactacagtgactagtacatatcagcagccagggcct

SEQ ID NO: 366373 - DNA, 140 bp, Artificial Sequence
  Synthetic
atacgccatgctgggtctccgcttgttaggctcacattaccggggaaaactgagaaggaaagaagagtaaaacggaatgtggaatgtctgattaaattgatgatgagcatgtcaggcatccgtacttgggagtcggccat

SEQ ID NO: 366374 - DNA, 140 bp, Artificial Sequence
  Synthetic
atggccgactcccaagtacggatgcctgacatgctcatcatcaatttaatcagacattccacattccgttttactcttctttccttctcagttttccccggtaatgtgagcctaacaagcggagacccagcatggcgtat

SEQ ID NO: 366375 - DNA, 140 bp, Artificial Sequence
  Synthetic
aggccctggctgctgatatgaacggaatgtggaatgtctgattaaattgatgatgagcatgtcaggcatcgactgtataaaatatcctacaggccagctcattactcatggaagagtaaggaccttttgggacagcggtg

SEQ ID NO: 366376 - DNA, 140 bp, Artificial Sequence
  Synthetic
caccgctgtcccaaaaggtccttactcttccatgagtaatgagctggcctgtaggatattttatacagtcgatgcctgacatgctcatcatcaatttaatcagacattccacattccgttcatatcagcagccagggcct

SEQ ID NO: 366377 - DNA, 140 bp, Artificial Sequence
  Synthetic
atacgccatgctgggtctccgactggctgagaagatagatattgttaggaaagaactttcggaaaccaaactaaaagattattcaacttatgcaaggggagtaatctcaaattcgcttaacgtacttgggagtcggccat

SEQ ID NO: 366378 - DNA, 140 bp, Artificial Sequence
  Synthetic
atggccgactcccaagtacgttaagcgaatttgagattactccccttgcataagttgaataatcttttagtttggtttccgaaagttctttcctaacaatatctatcttctcagccagtcggagacccagcatggcgtat

SEQ ID NO: 366379 - DNA, 140 bp, Artificial Sequence
  Synthetic
atacgccatgctgggtctccttgagaagatattgttcgatttaaaggtgcctactaaagatgaggaagtgctgataaatatcagaaattcactgaaggctagatcagaatttattagaaacgtacttgggagtcggccat

SEQ ID NO: 366380 - DNA, 140 bp, Artificial Sequence
  Synthetic
atggccgactcccaagtacgtttctaataaattctgatctagccttcagtgaatttctgatatttatcagcacttcctcatctttagtaggcacctttaaatcgaacaatatcttctcaaggagacccagcatggcgtat

SEQ ID NO: 366381 - DNA, 140 bp, Artificial Sequence
  Synthetic
aggccctggctgctgatatgctgataaatatcagaaattcactgaaggctagatcagaatttattagaaacaatgacaaactactcataaggtccaaagaagagctaaaaaaatgtttcggaccttttgggacagcggtg

SEQ ID NO: 366382 - DNA, 140 bp, Artificial Sequence
  Synthetic
caccgctgtcccaaaaggtccgaaacatttttttagctcttctttggaccttatgagtagtttgtcattgtttctaataaattctgatctagccttcagtgaatttctgatatttatcagcatatcagcagccagggcct

SEQ ID NO: 366383 - DNA, 140 bp, Artificial Sequence
  Synthetic
aggccctggctgctgatatgtattggcacaccttatgaaggaattatagacactttagtttccttaatcaatgtgttaacaaggttcacttggtttcaggaggtagtgctgtatggtaaggaccttttgggacagcggtg

SEQ ID NO: 366384 - DNA, 140 bp, Artificial Sequence
  Synthetic
caccgctgtcccaaaaggtccttaccatacagcactacctcctgaaaccaagtgaaccttgttaacacattgattaaggaaactaaagtgtctataattccttcataaggtgtgccaatacatatcagcagccagggcct

SEQ ID NO: 366385 - DNA, 140 bp, Artificial Sequence
  Synthetic
atacgccatgctgggtctcctaagctagtcaaggtgagacactgtgacattaacctatcagttaagctgccatcaaataaaaaggagaacatgttatgttgtatatacagtggtaacatgcgtacttgggagtcggccat

SEQ ID NO: 366386 - DNA, 140 bp, Artificial Sequence
  Synthetic
atggccgactcccaagtacgcatgttaccactgtatatacaacataacatgttctcctttttatttgatggcagcttaactgataggttaatgtcacagtgtctcaccttgactagcttaggagacccagcatggcgtat

SEQ ID NO: 366387 - DNA, 140 bp, Artificial Sequence
  Synthetic
atacgccatgctgggtctccgagctcttacaaggacctttctatttgaataggaggcaagctgtccttggttcatcatacctttatattgttattacactttacatacaagtgttgcagccgtacttgggagtcggccat

SEQ ID NO: 366388 - DNA, 140 bp, Artificial Sequence
  Synthetic
atggccgactcccaagtacggctgcaacacttgtatgtaaagtgtaataacaatataaaggtatgatgaaccaaggacagcttgcctcctattcaaatagaaaggtccttgtaagagctcggagacccagcatggcgtat

SEQ ID NO: 366389 - DNA, 140 bp, Artificial Sequence
  Synthetic
atacgccatgctgggtctccgacattgaaaatcactctatgactctgctagaagatgcattcaaagaactcacttctgcacttgagggtagatttgaagagtcttacaaaatacgaacttcgtacttgggagtcggccat

SEQ ID NO: 366390 - DNA, 140 bp, Artificial Sequence
  Synthetic
atggccgactcccaagtacgaagttcgtattttgtaagactcttcaaatctaccctcaagtgcagaagtgagttctttgaatgcatcttctagcagagtcatagagtgattttcaatgtcggagacccagcatggcgtat

SEQ ID NO: 366391 - DNA, 140 bp, Artificial Sequence
  Synthetic
atacgccatgctgggtctcctttataagtattgtttcaggactaaacctggtttatggcttcctcataaaagataacttattagctaactctcaacaacaaaacaaacaacttcaaatgccgtacttgggagtcggccat

SEQ ID NO: 366392 - DNA, 140 bp, Artificial Sequence
  Synthetic
atggccgactcccaagtacggcatttgaagttgtttgttttgttgttgagagttagctaataagttatcttttatgaggaagccataaaccaggtttagtcctgaaacaatacttataaaggagacccagcatggcgtat

SEQ ID NO: 366393 - DNA, 140 bp, Artificial Sequence
  Synthetic
aggccctggctgctgatatggggcatcatcatgttccttgctccttttgccttgttactgctcttcttccttttcggatggagaattctgttctgccttagatgctgcagaaggactagggaccttttgggacagcggtg

SEQ ID NO: 366394 - DNA, 140 bp, Artificial Sequence
  Synthetic
caccgctgtcccaaaaggtccctagtccttctgcagcatctaaggcagaacagaattctccatccgaaaaggaagaagagcagtaacaaggcaaaaggagcaaggaacatgatgatgccccatatcagcagccagggcct

SEQ ID NO: 366395 - DNA, 140 bp, Artificial Sequence
  Synthetic
aggccctggctgctgatatgaagactttacctacaaacatctatatactgctcagttagagatgtggaagacaacattaagcactggaaacaaagggatttgtgtcctgaagtaactatcgaccttttgggacagcggtg

SEQ ID NO: 366396 - DNA, 140 bp, Artificial Sequence
  Synthetic
caccgctgtcccaaaaggtcgatagttacttcaggacacaaatccctttgtttccagtgcttaatgttgtcttccacatctctaactgagcagtatatagatgtttgtaggtaaagtcttcatatcagcagccagggcct

SEQ ID NO: 366397 - DNA, 140 bp, Artificial Sequence
  Synthetic
atacgccatgctgggtctccttttgacatttataatgtgcatatatacaataaagaaatggacaactttgacgaaggatgtatcagcgtcttggaagaaacagcagaaaggcacatgcttcgtacttgggagtcggccat

SEQ ID NO: 366398 - DNA, 140 bp, Artificial Sequence
  Synthetic
atggccgactcccaagtacgaagcatgtgcctttctgctgtttcttccaagacgctgatacatccttcgtcaaagttgtccatttctttattgtatatatgcacattataaatgtcaaaaggagacccagcatggcgtat

SEQ ID NO: 366399 - DNA, 140 bp, Artificial Sequence
  Synthetic
atacgccatgctgggtctcctagaaccgcaagactgctattgggctgtccaaatgtgaggaaagctgcaaataaagaagggaaaaaactattgaagttaaacagcgatgcatccactgaccgtacttgggagtcggccat

SEQ ID NO: 366400 - DNA, 140 bp, Artificial Sequence
  Synthetic
atggccgactcccaagtacggtcagtggatgcatcgctgtttaacttcaatagttttttcccttctttatttgcagctttcctcacatttggacagcccaatagcagtcttgcggttctaggagacccagcatggcgtat

SEQ ID NO: 366401 - DNA, 140 bp, Artificial Sequence
  Synthetic
atacgccatgctgggtctcccaagagtagaattcgtagcatttttggaagatacaattctcagaaaaaaccatttgaactaaggtcaggcctcgaagtctttaatgaccctttcaacgatcgtacttgggagtcggccat

SEQ ID NO: 366402 - DNA, 140 bp, Artificial Sequence
  Synthetic
atggccgactcccaagtacgatcgttgaaagggtcattaaagacttcgaggcctgaccttagttcaaatggttttttctgagaattgtatcttccaaaaatgctacgaattctactcttgggagacccagcatggcgtat

SEQ ID NO: 366403 - DNA, 140 bp, Artificial Sequence
  Synthetic
aggccctggctgctgatatgcatttgaactaaggtcaggcctcgaagtctttaatgaccctttcaacgattatcagcaagcaataacagacatttgtcaattttctgaatatacaccaaagaccttttgggacagcggtg

SEQ ID NO: 366404 - DNA, 140 bp, Artificial Sequence
  Synthetic
caccgctgtcccaaaaggtctttggtgtatattcagaaaattgacaaatgtctgttattgcttgctgataatcgttgaaagggtcattaaagacttcgaggcctgaccttagttcaaatgcatatcagcagccagggcct

SEQ ID NO: 366405 - DNA, 140 bp, Artificial Sequence
  Synthetic
aggccctggctgctgatatgatgagtaaatttcctcccgagaatatagacaaggcaaggagagatccaaagaactgggtcagcatctctgaagtaacagagacaacaagtatagttgcatgaccttttgggacagcggtg

SEQ ID NO: 366406 - DNA, 140 bp, Artificial Sequence
  Synthetic
caccgctgtcccaaaaggtcatgcaactatacttgttgtctctgttacttcagagatgctgacccagttctttggatctctccttgccttgtctatattctcgggaggaaatttactcatcatatcagcagccagggcct

SEQ ID NO: 366407 - DNA, 140 bp, Artificial Sequence
  Synthetic
atacgccatgctgggtctccactgagaacaaaaagatagtcaaaatgctccgagggaagctaaaaaaactcggtgccatctctaccaacatagagatcggtaaaagagactgcttggatccgtacttgggagtcggccat

SEQ ID NO: 366408 - DNA, 140 bp, Artificial Sequence
  Synthetic
atggccgactcccaagtacggatccaagcagtctcttttaccgatctctatgttggtagagatggcaccgagtttttttagcttccctcggagcattttgactatctttttgttctcagtggagacccagcatggcgtat

SEQ ID NO: 366409 - DNA, 140 bp, Artificial Sequence
  Synthetic
aggccctggctgctgatatgcggtgccatctctaccaacatagagatcggtaaaagagactgcttggatctactcagcacggtcgatggtctgacagaccagcaaaaagaaaacatcgtggaccttttgggacagcggtg

SEQ ID NO: 366410 - DNA, 140 bp, Artificial Sequence
  Synthetic
caccgctgtcccaaaaggtccacgatgttttctttttgctggtctgtcagaccatcgaccgtgctgagtagatccaagcagtctcttttaccgatctctatgttggtagagatggcaccgcatatcagcagccagggcct

SEQ ID NO: 366411 - DNA, 140 bp, Artificial Sequence
  Synthetic
atacgccatgctgggtctccagtcaaaaaaaacatagatgaggttttgcttactgaggatggaaatctaatcttttgctggctaaaaacaatctcatcatcagttaaagggagcttgaagcgtacttgggagtcggccat

SEQ ID NO: 366412 - DNA, 140 bp, Artificial Sequence
  Synthetic
atggccgactcccaagtacgcttcaagctccctttaactgatgatgagattgtttttagccagcaaaagattagatttccatcctcagtaagcaaaacctcatctatgttttttttgactggagacccagcatggcgtat

SEQ ID NO: 366413 - DNA, 140 bp, Artificial Sequence
  Synthetic
aggccctggctgctgatatgtcttttgctggctaaaaacaatctcatcatcagttaaagggagcttgaagaagaggctcaagtttatgaatatacattctccagaactaatgccagaaaagaccttttgggacagcggtg

SEQ ID NO: 366414 - DNA, 140 bp, Artificial Sequence
  Synthetic
caccgctgtcccaaaaggtcttttctggcattagttctggagaatgtatattcataaacttgagcctcttcttcaagctccctttaactgatgatgagattgtttttagccagcaaaagacatatcagcagccagggcct

SEQ ID NO: 366415 - DNA, 140 bp, Artificial Sequence
  Synthetic
atacgccatgctgggtctccttctcctcaacgaacaacaggatgaacaggagttgaagcaggaccttttaatttcttcttgggtcaagtgtataacagcttgtaaagactttgcaaatatcgtacttgggagtcggccat

SEQ ID NO: 366416 - DNA, 140 bp, Artificial Sequence
  Synthetic
atggccgactcccaagtacgatatttgcaaagtctttacaagctgttatacacttgacccaagaagaaattaaaaggtcctgcttcaactcctgttcatcctgttgttcgttgaggagaaggagacccagcatggcgtat

SEQ ID NO: 366417 - DNA, 140 bp, Artificial Sequence
  Synthetic
aggccctggctgctgatatgatttcttcttgggtcaagtgtataacagcttgtaaagactttgcaaatataaatgacaaggttcagaaatttatttatcatctgtctgaagagctatatagaccttttgggacagcggtg

SEQ ID NO: 366418 - DNA, 140 bp, Artificial Sequence
  Synthetic
caccgctgtcccaaaaggtctatatagctcttcagacagatgataaataaatttctgaaccttgtcatttatatttgcaaagtctttacaagctgttatacacttgacccaagaagaaatcatatcagcagccagggcct

SEQ ID NO: 366419 - DNA, 140 bp, Artificial Sequence
  Synthetic
aggccctggctgctgatatgagtgttagcttcaccaaggaggaagtcttaataaagcggctggagaaaaatttccttaagcaacacaatctagaaatcatggaaacagtgaacctcatatgaccttttgggacagcggtg

SEQ ID NO: 366420 - DNA, 140 bp, Artificial Sequence
  Synthetic
caccgctgtcccaaaaggtcatatgaggttcactgtttccatgatttctagattgtgttgcttaaggaaatttttctccagccgctttattaagacttcctccttggtgaagctaacactcatatcagcagccagggcct

SEQ ID NO: 366421 - DNA, 140 bp, Artificial Sequence
  Synthetic
aggccctggctgctgatatgaataggcatactactgtcaaagagccctctttattcaatccaaatatcagatgtgttaacctgatcacattcgaggatggcctgagggaactttcagtgagaccttttgggacagcggtg

SEQ ID NO: 366422 - DNA, 140 bp, Artificial Sequence
  Synthetic
caccgctgtcccaaaaggtctcactgaaagttccctcaggccatcctcgaatgtgatcaggttaacacatctgatatttggattgaataaagagggctctttgacagtagtatgcctattcatatcagcagccagggcct

SEQ ID NO: 366423 - DNA, 140 bp, Artificial Sequence
  Synthetic
atacgccatgctgggtctccttgcagactcactctacttgatctgtcagtttctaaactcttagtttgtttatatcgaagagatgacgaagaactaacgaacagctcgagcttaaaactccgtacttgggagtcggccat

SEQ ID NO: 366424 - DNA, 140 bp, Artificial Sequence
  Synthetic
atggccgactcccaagtacggagttttaagctcgagctgttcgttagttcttcgtcatctcttcgatataaacaaactaagagtttagaaactgacagatcaagtagagtgagtctgcaaggagacccagcatggcgtat

SEQ ID NO: 366425 - DNA, 140 bp, Artificial Sequence
  Synthetic
aggccctggctgctgatatgtatatcgaagagatgacgaagaactaacgaacagctcgagcttaaaactcgggttcttagtaaagtatgctgtcaccctatttacatccaatggtgaaccgaccttttgggacagcggtg

SEQ ID NO: 366426 - DNA, 140 bp, Artificial Sequence
  Synthetic
caccgctgtcccaaaaggtcggttcaccattggatgtaaatagggtgacagcatactttactaagaacccgagttttaagctcgagctgttcgttagttcttcgtcatctcttcgatatacatatcagcagccagggcct

SEQ ID NO: 366427 - DNA, 140 bp, Artificial Sequence
  Synthetic
atacgccatgctgggtctccccactgacgagaagctgctacatcagacaaaaatagtttttgcgaagattggtttgtccgggaacggttatgacttcatttggaccactcaaatgatagccgtacttgggagtcggccat

SEQ ID NO: 366428 - DNA, 140 bp, Artificial Sequence
  Synthetic
atggccgactcccaagtacggctatcatttgagtggtccaaatgaagtcataaccgttcccggacaaaccaatcttcgcaaaaactatttttgtctgatgtagcagcttctcgtcagtggggagacccagcatggcgtat

SEQ ID NO: 366429 - DNA, 140 bp, Artificial Sequence
  Synthetic
atacgccatgctgggtctccgaatagcaactttaatgtctgcaagagattaaccggaaggagtactggagaaagacttccaagaagcgtcaggagcaaggtcatttatgagatggtaaaacgtacttgggagtcggccat

SEQ ID NO: 366430 - DNA, 140 bp, Artificial Sequence
  Synthetic
atggccgactcccaagtacgttttaccatctcataaatgaccttgctcctgacgcttcttggaagtctttctccagtactccttccggttaatctcttgcagacattaaagttgctattcggagacccagcatggcgtat

SEQ ID NO: 366431 - DNA, 140 bp, Artificial Sequence
  Synthetic
aggccctggctgctgatatgagctagggggagcaagagatctgttagtgcaagaaactggaaccaaagtcatgcatgcaactactgaaatgtttagtagaaacctcttaaaaacaacatcgaccttttgggacagcggtg

SEQ ID NO: 366432 - DNA, 140 bp, Artificial Sequence
  Synthetic
caccgctgtcccaaaaggtcgatgttgtttttaagaggtttctactaaacatttcagtagttgcatgcatgactttggttccagtttcttgcactaacagatctcttgctccccctagctcatatcagcagccagggcct

SEQ ID NO: 366433 - DNA, 140 bp, Artificial Sequence
  Synthetic
atacgccatgctgggtctccgattagactgccttaccaacatgcgaaaccttgatgggaaacccataagtgagggtagcaacttggtcaatttctacaaagtcatttgcatttcaggtgacgtacttgggagtcggccat

SEQ ID NO: 366434 - DNA, 140 bp, Artificial Sequence
  Synthetic
atggccgactcccaagtacgtcacctgaaatgcaaatgactttgtagaaattgaccaagttgctaccctcacttatgggtttcccatcaaggtttcgcatgttggtaaggcagtctaatcggagacccagcatggcgtat

SEQ ID NO: 366435 - DNA, 140 bp, Artificial Sequence
  Synthetic
aggccctggctgctgatatggagggtagcaacttggtcaatttctacaaagtcatttgcatttcaggtgacaatactaagtggggcccgatacactgctgttccttcttttcaggcatgagaccttttgggacagcggtg

SEQ ID NO: 366436 - DNA, 140 bp, Artificial Sequence
  Synthetic
caccgctgtcccaaaaggtctcatgcctgaaaagaaggaacagcagtgtatcgggccccacttagtattgtcacctgaaatgcaaatgactttgtagaaattgaccaagttgctaccctccatatcagcagccagggcct

SEQ ID NO: 366437 - DNA, 140 bp, Artificial Sequence
  Synthetic
atacgccatgctgggtctccacatttatcaaaaacttatgtaggcaagtagaaataccagcaggcagtattaaaaagattttaaatgttcttagatacaaactgtgcagtaaaggaggtgcgtacttgggagtcggccat

SEQ ID NO: 366438 - DNA, 140 bp, Artificial Sequence
  Synthetic
atggccgactcccaagtacgcacctcctttactgcacagtttgtatctaagaacatttaaaatctttttaatactgcctgctggtatttctacttgcctacataagtttttgataaatgtggagacccagcatggcgtat

SEQ ID NO: 366439 - DNA, 140 bp, Artificial Sequence
  Synthetic
aggccctggctgctgatatgtaaaaagattttaaatgttcttagatacaaactgtgcagtaaaggaggtgtggagcagcacagtgaagaggatttaagaaagctgttagtagacaatttagaccttttgggacagcggtg

SEQ ID NO: 366440 - DNA, 140 bp, Artificial Sequence
  Synthetic
caccgctgtcccaaaaggtctaaattgtctactaacagctttcttaaatcctcttcactgtgctgctccacacctcctttactgcacagtttgtatctaagaacatttaaaatctttttacatatcagcagccagggcct

SEQ ID NO: 366441 - DNA, 140 bp, Artificial Sequence
  Synthetic
atacgccatgctgggtctccaagcaaagggctcatggcactaaacagttacaaccatatgggtcaaggtattcaccatgcaacctcttcagtgttaacttccttggctgctgtgctcttccgtacttgggagtcggccat

SEQ ID NO: 366442 - DNA, 140 bp, Artificial Sequence
  Synthetic
atggccgactcccaagtacggaagagcacagcagccaaggaagttaacactgaagaggttgcatggtgaataccttgacccatatggttgtaactgtttagtgccatgagccctttgcttggagacccagcatggcgtat

SEQ ID NO: 366443 - DNA, 140 bp, Artificial Sequence
  Synthetic
aggccctggctgctgatatgcgatgctataatggaagtagaaagtaaaagtagcttactacacaagttcctcaaatcaggaggtgtcaggcagcggaacactgaagtgctttttagagaagaccttttgggacagcggtg

SEQ ID NO: 366444 - DNA, 140 bp, Artificial Sequence
  Synthetic
caccgctgtcccaaaaggtcttctctaaaaagcacttcagtgttccgctgcctgacacctcctgatttgaggaacttgtgtagtaagctacttttactttctacttccattatagcatcgcatatcagcagccagggcct

SEQ ID NO: 366445 - DNA, 140 bp, Artificial Sequence
  Synthetic
atacgccatgctgggtctcctaactggcatactatccaaagagctatactcccagtatgacgaaacattttggaagcacgcctgtagacttaagaatttcacagctgctgtacaaagatgcgtacttgggagtcggccat

SEQ ID NO: 366446 - DNA, 140 bp, Artificial Sequence
  Synthetic
atggccgactcccaagtacgcatctttgtacagcagctgtgaaattcttaagtctacaggcgtgcttccaaaatgtttcgtcatactgggagtatagctctttggatagtatgccagttaggagacccagcatggcgtat

SEQ ID NO: 366447 - DNA, 140 bp, Artificial Sequence
  Synthetic
aggccctggctgctgatatgtggaagcacgcctgtagacttaagaatttcacagctgctgtacaaagatgttgtcaaatgaaagatagtgccaaaaccttagtgagtgactgctttttaggaccttttgggacagcggtg

SEQ ID NO: 366448 - DNA, 140 bp, Artificial Sequence
  Synthetic
caccgctgtcccaaaaggtcctaaaaagcagtcactcactaaggttttggcactatctttcatttgacaacatctttgtacagcagctgtgaaattcttaagtctacaggcgtgcttccacatatcagcagccagggcct

SEQ ID NO: 366449 - DNA, 140 bp, Artificial Sequence
  Synthetic
atacgccatgctgggtctccaaattcatgttcactggactgataaacagctctgtaacctctccccagagtttgatgcaagcatgccaggtttcttcacaacaagccatgtataacagtgcgtacttgggagtcggccat

SEQ ID NO: 366450 - DNA, 140 bp, Artificial Sequence
  Synthetic
atggccgactcccaagtacgcactgttatacatggcttgttgtgaagaaacctggcatgcttgcatcaaactctggggagaggttacagagctgtttatcagtccagtgaacatgaatttggagacccagcatggcgtat

SEQ ID NO: 366451 - DNA, 140 bp, Artificial Sequence
  Synthetic
aggccctggctgctgatatgtttgatgcaagcatgccaggtttcttcacaacaagccatgtataacagtgtacctcttgtcactaatactacctttaccttactaagacaacaaattttcgaccttttgggacagcggtg

SEQ ID NO: 366452 - DNA, 140 bp, Artificial Sequence
  Synthetic
caccgctgtcccaaaaggtcgaaaatttgttgtcttagtaaggtaaaggtagtattagtgacaagaggtacactgttatacatggcttgttgtgaagaaacctggcatgcttgcatcaaacatatcagcagccagggcct

SEQ ID NO: 366453 - DNA, 140 bp, Artificial Sequence
  Synthetic
atacgccatgctgggtctccaaccctgtctccctttggcaggctgtttgtaccgacctactctggattagtcagctcagcagttgctttggaagatgctgaagttattgctagggcagctcgtacttgggagtcggccat

SEQ ID NO: 366454 - DNA, 140 bp, Artificial Sequence
  Synthetic
atggccgactcccaagtacgagctgccctagcaataacttcagcatcttccaaagcaactgctgagctgactaatccagagtaggtcggtacaaacagcctgccaaagggagacagggttggagacccagcatggcgtat

SEQ ID NO: 366455 - DNA, 140 bp, Artificial Sequence
  Synthetic
aggccctggctgctgatatgtcagctcagcagttgctttggaagatgctgaagttattgctagggcagctcaaacactccacatgaacagtgtgtcgatccagtcaagtagcttgactacgaccttttgggacagcggtg

SEQ ID NO: 366456 - DNA, 140 bp, Artificial Sequence
  Synthetic
caccgctgtcccaaaaggtcgtagtcaagctacttgactggatcgacacactgttcatgtggagtgtttgagctgccctagcaataacttcagcatcttccaaagcaactgctgagctgacatatcagcagccagggcct

SEQ ID NO: 366457 - DNA, 140 bp, Artificial Sequence
  Synthetic
aggccctggctgctgatatggtggaggaaggatattggtttccgtgtcaatgctaatacggcagccttgagcaacaaagtccttgcagagtataaagtccctggtgagattgtaatgtctgaccttttgggacagcggtg

SEQ ID NO: 366458 - DNA, 140 bp, Artificial Sequence
  Synthetic
caccgctgtcccaaaaggtcagacattacaatctcaccagggactttatactctgcaaggactttgttgctcaaggctgccgtattagcattgacacggaaaccaatatccttcctccaccatatcagcagccagggcct

SEQ ID NO: 366459 - DNA, 140 bp, Artificial Sequence
  Synthetic
atacgccatgctgggtctccgcagtgtgagtgacaccactgctgcttctcatgattcgggatcatcatcatcaagtttctcttttgagcttaataggcctctgtctgagactgaactacacgtacttgggagtcggccat

SEQ ID NO: 366460 - DNA, 140 bp, Artificial Sequence
  Synthetic
atggccgactcccaagtacgtgtagttcagtctcagacagaggcctattaagctcaaaagagaaacttgatgatgatgatcccgaatcatgagaagcagcagtggtgtcactcacactgcggagacccagcatggcgtat

SEQ ID NO: 366461 - DNA, 140 bp, Artificial Sequence
  Synthetic
aggccctggctgctgatatgtcaagtttctcttttgagcttaataggcctctgtctgagactgaactacaatttatcaaggcactaaacagcctcaaatcaactcaagcctgtgagataagaccttttgggacagcggtg

SEQ ID NO: 366462 - DNA, 140 bp, Artificial Sequence
  Synthetic
caccgctgtcccaaaaggtcttatctcacaggcttgagttgatttgaggctgtttagtgccttgataaattgtagttcagtctcagacagaggcctattaagctcaaaagagaaacttgacatatcagcagccagggcct

SEQ ID NO: 366463 - DNA, 140 bp, Artificial Sequence
  Synthetic
atacgccatgctgggtctccgatagacacaatgttatttacagcagtagaatggcagactcttgtgattggcttaaagatggtaagaggagagggaatctagaactagcaaatagaatcccgtacttgggagtcggccat

SEQ ID NO: 366464 - DNA, 140 bp, Artificial Sequence
  Synthetic
atggccgactcccaagtacgggattctatttgctagttctagattccctctcctcttaccatctttaagccaatcacaagagtctgccattctactgctgtaaataacattgtgtctatcggagacccagcatggcgtat

SEQ ID NO: 366465 - DNA, 140 bp, Artificial Sequence
  Synthetic
aggccctggctgctgatatggcttaaagatggtaagaggagagggaatctagaactagcaaatagaatccaatctgtgctatgtgttctgatagcaggttactacagatcatttggaggggaccttttgggacagcggtg

SEQ ID NO: 366466 - DNA, 140 bp, Artificial Sequence
  Synthetic
caccgctgtcccaaaaggtcccctccaaatgatctgtagtaacctgctatcagaacacatagcacagattggattctatttgctagttctagattccctctcctcttaccatctttaagccatatcagcagccagggcct

SEQ ID NO: 366467 - DNA, 140 bp, Artificial Sequence
  Synthetic
atacgccatgctgggtctccaattatcgaagatcctatgatacaactgattccagagaaactaaggagggagttggaaagactaggagtctctagaatggaagtcgatgaactgatgccacgtacttgggagtcggccat

SEQ ID NO: 366468 - DNA, 140 bp, Artificial Sequence
  Synthetic
atggccgactcccaagtacgtggcatcagttcatcgacttccattctagagactcctagtctttccaactccctccttagtttctctggaatcagttgtatcataggatcttcgataattggagacccagcatggcgtat

SEQ ID NO: 366469 - DNA, 140 bp, Artificial Sequence
  Synthetic
aggccctggctgctgatatgagttggaaagactaggagtctctagaatggaagtcgatgaactgatgccaagtgttagccctgacgataccttggcccagcttgtggccaaaaaattaatgaccttttgggacagcggtg

SEQ ID NO: 366470 - DNA, 140 bp, Artificial Sequence
  Synthetic
caccgctgtcccaaaaggtcattaattttttggccacaagctgggccaaggtatcgtcagggctaacacttggcatcagttcatcgacttccattctagagactcctagtctttccaactcatatcagcagccagggcct

SEQ ID NO: 366471 - DNA, 140 bp, Artificial Sequence
  Synthetic
atacgccatgctgggtctccaacaaacactaactgctcgaaatgttttgcacgggttagctggaggaataaaagaactttcgcttcccatatatacaatattcatgaagtcatacttcttcgtacttgggagtcggccat

SEQ ID NO: 366472 - DNA, 140 bp, Artificial Sequence
  Synthetic
atggccgactcccaagtacgaagaagtatgacttcatgaatattgtatatatgggaagcgaaagttcttttattcctccagctaacccgtgcaaaacatttcgagcagttagtgtttgttggagacccagcatggcgtat

SEQ ID NO: 366473 - DNA, 140 bp, Artificial Sequence
  Synthetic
aggccctggctgctgatatgaagttcaacacctggggagactcaaatagatctggaaaattcacatacagcagcagatctggagaatccattggaatcttcattgcagggaaattgcacagaccttttgggacagcggtg

SEQ ID NO: 366474 - DNA, 140 bp, Artificial Sequence
  Synthetic
caccgctgtcccaaaaggtctgtgcaatttccctgcaatgaagattccaatggattctccagatctgctgctgtatgtgaattttccagatctatttgagtctccccaggtgttgaacttcatatcagcagccagggcct

SEQ ID NO: 366475 - DNA, 140 bp, Artificial Sequence
  Synthetic
atacgccatgctgggtctcccagaggtggcgatgagaacccacgcggcccggtgagccgtgagcatgtggaatggtgcagggaatttgtcaagggcaagtacatcatggctttcaacccacgtacttgggagtcggccat

SEQ ID NO: 366476 - DNA, 140 bp, Artificial Sequence
  Synthetic
atggccgactcccaagtacgtgggttgaaagccatgatgtacttgcccttgacaaattccctgcaccattccacatgctcacggctcaccgggccgcgtgggttctcatcgccacctctgggagacccagcatggcgtat

SEQ ID NO: 366477 - DNA, 140 bp, Artificial Sequence
  Synthetic
aggccctggctgctgatatggatgtgtcaacttgatcacatttgaagacggcctgagggaactttcagtgatacaaagtcatcttaaagtttttgagaatgaattcaccaacctaaacctgaccttttgggacagcggtg

SEQ ID NO: 366478 - DNA, 140 bp, Artificial Sequence
  Synthetic
caccgctgtcccaaaaggtcaggtttaggttggtgaattcattctcaaaaactttaagatgactttgtatcactgaaagttccctcaggccgtcttcaaatgtgatcaagttgacacatccatatcagcagccagggcct

SEQ ID NO: 366479 - DNA, 140 bp, Artificial Sequence
  Synthetic
atacgccatgctgggtctccctgcagaatctgaattagaggcaaatcgcgcagtgattgtcaagaccaaactgttttcagcaaccgaacaggttcggctatctaacaaccctgcagttgtcgtacttgggagtcggccat

SEQ ID NO: 366480 - DNA, 140 bp, Artificial Sequence
  Synthetic
atggccgactcccaagtacgacaactgcagggttgttagatagccgaacctgttcggttgctgaaaacagtttggtcttgacaatcactgcgcgatttgcctctaattcagattctgcagggagacccagcatggcgtat

SEQ ID NO: 366481 - DNA, 140 bp, Artificial Sequence
  Synthetic
aggccctggctgctgatatgctgttttcagcaaccgaacaggttcggctatctaacaaccctgcagttgtcatgggttatcttttagatgaatcagcaatttctgaagttaaacccaccagaccttttgggacagcggtg

SEQ ID NO: 366482 - DNA, 140 bp, Artificial Sequence
  Synthetic
caccgctgtcccaaaaggtctggtgggtttaacttcagaaattgctgattcatctaaaagataacccatgacaactgcagggttgttagatagccgaacctgttcggttgctgaaaacagcatatcagcagccagggcct

SEQ ID NO: 366483 - DNA, 140 bp, Artificial Sequence
  Synthetic
atacgccatgctgggtctccttcccctctgtgttcactttaatcaaaatgttaacagatgagtcatcagactcagaaaaaaacggtcttagtccagatttgcaacaagtcgcaagatactcgtacttgggagtcggccat

SEQ ID NO: 366484 - DNA, 140 bp, Artificial Sequence
  Synthetic
atggccgactcccaagtacgagtatcttgcgacttgttgcaaatctggactaagaccgtttttttctgagtctgatgactcatctgttaacattttgattaaagtgaacacagaggggaaggagacccagcatggcgtat

SEQ ID NO: 366485 - DNA, 140 bp, Artificial Sequence
  Synthetic
aggccctggctgctgatatgctcagaaaaaaacggtcttagtccagatttgcaacaagtcgcaagatactccaatcatttaaccttacttagcagaatgatacaacaagcaaagccaactgaccttttgggacagcggtg

SEQ ID NO: 366486 - DNA, 140 bp, Artificial Sequence
  Synthetic
caccgctgtcccaaaaggtcagttggctttgcttgttgtatcattctgctaagtaaggttaaatgattggagtatcttgcgacttgttgcaaatctggactaagaccgtttttttctgagcatatcagcagccagggcct

SEQ ID NO: 366487 - DNA, 140 bp, Artificial Sequence
  Synthetic
atacgccatgctgggtctccagtagctgagcttgtcagttacggcataaaggaaggtaggttctataggctttctgatactggaatcgatgcaagtacatattctgtaaaatactggaagcgtacttgggagtcggccat

SEQ ID NO: 366488 - DNA, 140 bp, Artificial Sequence
  Synthetic
atggccgactcccaagtacgcttccagtattttacagaatatgtacttgcatcgattccagtatcagaaagcctatagaacctaccttcctttatgccgtaactgacaagctcagctactggagacccagcatggcgtat

SEQ ID NO: 366489 - DNA, 140 bp, Artificial Sequence
  Synthetic
aggccctggctgctgatatgtttctgatactggaatcgatgcaagtacatattctgtaaaatactggaagattcttcactgcatttctgctattggatgcctacctctgagtcaagcagagaccttttgggacagcggtg

SEQ ID NO: 366490 - DNA, 140 bp, Artificial Sequence
  Synthetic
caccgctgtcccaaaaggtctctgcttgactcagaggtaggcatccaatagcagaaatgcagtgaagaatcttccagtattttacagaatatgtacttgcatcgattccagtatcagaaacatatcagcagccagggcct

SEQ ID NO: 366491 - DNA, 140 bp, Artificial Sequence
  Synthetic
atacgccatgctgggtctccgttgttgactaacttcttcttttgtcaactcctatggggtggcggcggggttgccagtggaggcaggaccaataccagctcaacacaaaccaccctaatacgtacttgggagtcggccat

SEQ ID NO: 366492 - DNA, 140 bp, Artificial Sequence
  Synthetic
atggccgactcccaagtacgtattagggtggtttgtgttgagctggtattggtcctgcctccactggcaaccccgccgccaccccataggagttgacaaaagaagaagttagtcaacaacggagacccagcatggcgtat

SEQ ID NO: 366493 - DNA, 140 bp, Artificial Sequence
  Synthetic
atacgccatgctgggtctccttagagtttctgactgtccattgtctagccatgaagcaagtatacttagtgagtttgacggacaagtcattgctaatatacttgccagtgaattgagttccgtacttgggagtcggccat

SEQ ID NO: 366494 - DNA, 140 bp, Artificial Sequence
  Synthetic
atggccgactcccaagtacggaactcaattcactggcaagtatattagcaatgacttgtccgtcaaactcactaagtatacttgcttcatggctagacaatggacagtcagaaactctaaggagacccagcatggcgtat

SEQ ID NO: 366495 - DNA, 140 bp, Artificial Sequence
  Synthetic
aggccctggctgctgatatggagtttgacggacaagtcattgctaatatacttgccagtgaattgagttctgtgaaacgagactctgaacgcgaaggtttaactgatctccttgattactgaccttttgggacagcggtg

SEQ ID NO: 366496 - DNA, 140 bp, Artificial Sequence
  Synthetic
caccgctgtcccaaaaggtcagtaatcaaggagatcagttaaaccttcgcgttcagagtctcgtttcacagaactcaattcactggcaagtatattagcaatgacttgtccgtcaaactccatatcagcagccagggcct

SEQ ID NO: 366497 - DNA, 140 bp, Artificial Sequence
  Synthetic
atacgccatgctgggtctccaactgccacagaaacagtgccgagcacgaccaccaacacaccggacacacaggtcaccacagacagtggttctggtgaatccagcacagacccccagacccgtacttgggagtcggccat

SEQ ID NO: 366498 - DNA, 140 bp, Artificial Sequence
  Synthetic
atggccgactcccaagtacgggtctgggggtctgtgctggattcaccagaaccactgtctgtggtgacctgtgtgtccggtgtgttggtggtcgtgctcggcactgtttctgtggcagttggagacccagcatggcgtat

SEQ ID NO: 366499 - DNA, 140 bp, Artificial Sequence
  Synthetic
aggccctggctgctgatatgaggtcaccacagacagtggttctggtgaatccagcacagacccccagaccaccagcaaagaagtaccttccacttctgtcgctaccatcaaaacacaagagaccttttgggacagcggtg

SEQ ID NO: 366500 - DNA, 140 bp, Artificial Sequence
  Synthetic
caccgctgtcccaaaaggtctcttgtgttttgatggtagcgacagaagtggaaggtacttctttgctggtggtctgggggtctgtgctggattcaccagaaccactgtctgtggtgacctcatatcagcagccagggcct

SEQ ID NO: 366501 - DNA, 140 bp, Artificial Sequence
  Synthetic
atacgccatgctgggtctcctgcaagttcaacacttggggagactcaaacaggtctggtaagtttacatacagtagcaggtctggggagtcaattggtatcttcattgcagggaaattgccgtacttgggagtcggccat

SEQ ID NO: 366502 - DNA, 140 bp, Artificial Sequence
  Synthetic
atggccgactcccaagtacggcaatttccctgcaatgaagataccaattgactccccagacctgctactgtatgtaaacttaccagacctgtttgagtctccccaagtgttgaacttgcaggagacccagcatggcgtat

SEQ ID NO: 366503 - DNA, 140 bp, Artificial Sequence
  Synthetic
aggccctggctgctgatatgcagtagcaggtctggggagtcaattggtatcttcattgcagggaaattgcacatccatctctcctctgagtccattgctctgctgtgtgagactgaaagggaccttttgggacagcggtg

SEQ ID NO: 366504 - DNA, 140 bp, Artificial Sequence
  Synthetic
caccgctgtcccaaaaggtccctttcagtctcacacagcagagcaatggactcagaggagagatggatgtgcaatttccctgcaatgaagataccaattgactccccagacctgctactgcatatcagcagccagggcct

SEQ ID NO: 366505 - DNA, 140 bp, Artificial Sequence
  Synthetic
atacgccatgctgggtctcccatccactccaagcaacaccacatcaaacaaaccagatgtcaactcactcacatcaccaatcttggaggcaaagtcatcacccagccctagtaaaacatccgtacttgggagtcggccat

SEQ ID NO: 366506 - DNA, 140 bp, Artificial Sequence
  Synthetic
atggccgactcccaagtacggatgttttactagggctgggtgatgactttgcctccaagattggtgatgtgagtgagttgacatctggtttgtttgatgtggtgttgcttggagtggatgggagacccagcatggcgtat

SEQ ID NO: 366507 - DNA, 140 bp, Artificial Sequence
  Synthetic
atacgccatgctgggtctcctgagctagggaaacaaccaaggggtaccaagaaaatgaagaaggcactcttgagcaccccaatgaagtggggtaagaagctttatgagctctttgctgatcgtacttgggagtcggccat

SEQ ID NO: 366508 - DNA, 140 bp, Artificial Sequence
  Synthetic
atggccgactcccaagtacgatcagcaaagagctcataaagcttcttaccccacttcattggggtgctcaagagtgccttcttcattttcttggtaccccttggttgtttccctagctcaggagacccagcatggcgtat

SEQ ID NO: 366509 - DNA, 140 bp, Artificial Sequence
  Synthetic
atacgccatgctgggtctccacaacatcaactgttcctgagtctcctcccacaatcacatgaatgcttacaaaagcacaaagacggcagtgcactgtcagtcatacctgataacagcaatcgtacttgggagtcggccat

SEQ ID NO: 366510 - DNA, 140 bp, Artificial Sequence
  Synthetic
atggccgactcccaagtacgattgctgttatcaggtatgactgacagtgcactgccgtctttgtgcttttgtaagcattcatgtgattgtgggaggagactcaggaacagttgatgttgtggagacccagcatggcgtat

SEQ ID NO: 366511 - DNA, 140 bp, Artificial Sequence
  Synthetic
aggccctggctgctgatatgaaaagcacaaagacggcagtgcactgtcagtcatacctgataacagcaatcctcgattacttaaatttgtgcctctaaaaaaaggactggcagtggtgaagaccttttgggacagcggtg

SEQ ID NO: 366512 - DNA, 140 bp, Artificial Sequence
  Synthetic
caccgctgtcccaaaaggtcttcaccactgccagtcctttttttagaggcacaaatttaagtaatcgaggattgctgttatcaggtatgactgacagtgcactgccgtctttgtgcttttcatatcagcagccagggcct

SEQ ID NO: 366513 - DNA, 140 bp, Artificial Sequence
  Synthetic
atacgccatgctgggtctccacaaccatgagcagtccaacaacagtcaaaaacagtgtaacagccataccaacccaaggcatcaccaccagcaacacttcgaaacagactgacactataacgtacttgggagtcggccat

SEQ ID NO: 366514 - DNA, 140 bp, Artificial Sequence
  Synthetic
atggccgactcccaagtacgttatagtgtcagtctgtttcgaagtgttgctggtggtgatgccttgggttggtatggctgttacactgtttttgactgttgttggactgctcatggttgtggagacccagcatggcgtat

SEQ ID NO: 366515 - DNA, 140 bp, Artificial Sequence
  Synthetic
atacgccatgctgggtctccaaagtgagcccaggctacagtggggacatggctgcttgtccatcgtttatgatgaaaccgacactcagaccacataccacgaaaacctcctcaaggtgaacgtacttgggagtcggccat

SEQ ID NO: 366516 - DNA, 140 bp, Artificial Sequence
  Synthetic
atggccgactcccaagtacgttcaccttgaggaggttttcgtggtatgtggtctgagtgtcggtttcatcataaacgatggacaagcagccatgtccccactgtagcctgggctcactttggagacccagcatggcgtat

SEQ ID NO: 366517 - DNA, 140 bp, Artificial Sequence
  Synthetic
aggccctggctgctgatatggatgaaaccgacactcagaccacataccacgaaaacctcctcaaggtgaagcagcttgttgactgctctacagatagaaagaagctcttacctcagtcaggaccttttgggacagcggtg

SEQ ID NO: 366518 - DNA, 140 bp, Artificial Sequence
  Synthetic
caccgctgtcccaaaaggtcctgactgaggtaagagcttctttctatctgtagagcagtcaacaagctgcttcaccttgaggaggttttcgtggtatgtggtctgagtgtcggtttcatccatatcagcagccagggcct

SEQ ID NO: 366519 - DNA, 140 bp, Artificial Sequence
  Synthetic
atacgccatgctgggtctcccttctcctcaactcactgacgttgctccactgtttcttgaaacatgctcccagtgatgccataatggaagtggagagtaaaagtagcctactacacaaatcgtacttgggagtcggccat

SEQ ID NO: 366520 - DNA, 140 bp, Artificial Sequence
  Synthetic
atggccgactcccaagtacgatttgtgtagtaggctacttttactctccacttccattatggcatcactgggagcatgtttcaagaaacagtggagcaacgtcagtgagttgaggagaagggagacccagcatggcgtat

SEQ ID NO: 366521 - DNA, 140 bp, Artificial Sequence
  Synthetic
atacgccatgctgggtctccacaggcatgcaatgacgactacttcaatgaaagaatagaagaatttttcataaccggaaaaggctacttcaatgatgttttgcagtttaggctgtatgaccgtacttgggagtcggccat

SEQ ID NO: 366522 - DNA, 140 bp, Artificial Sequence
  Synthetic
atggccgactcccaagtacggtcatacagcctaaactgcaaaacatcattgaagtagccttttccggttatgaaaaattcttctattctttcattgaagtagtcgtcattgcatgcctgtggagacccagcatggcgtat

SEQ ID NO: 366523 - DNA, 140 bp, Artificial Sequence
  Synthetic
atacgccatgctgggtctccagaagaaattgagttctgcaacaacctgaccaagactgtttcggaaaacccactaccactcagctgttggtctgaagttcaaaactatattgaggacatacgtacttgggagtcggccat

SEQ ID NO: 366524 - DNA, 140 bp, Artificial Sequence
  Synthetic
atggccgactcccaagtacgtatgtcctcaatatagttttgaacttcagaccaacagctgagtggtagtgggttttccgaaacagtcttggtcaggttgttgcagaactcaatttcttctggagacccagcatggcgtat

SEQ ID NO: 366525 - DNA, 140 bp, Artificial Sequence
  Synthetic
aggccctggctgctgatatgcactaccactcagctgttggtctgaagttcaaaactatattgaggacataggcttcaacaatgtgcttgtaaacattgatagaaatacagtaaaaagtgagaccttttgggacagcggtg

SEQ ID NO: 366526 - DNA, 140 bp, Artificial Sequence
  Synthetic
caccgctgtcccaaaaggtctcactttttactgtatttctatcaatgtttacaagcacattgttgaagcctatgtcctcaatatagttttgaacttcagaccaacagctgagtggtagtgcatatcagcagccagggcct

SEQ ID NO: 366527 - DNA, 140 bp, Artificial Sequence
  Synthetic
atacgccatgctgggtctcctcaaggacataaggacactagtatcttacgtcagcactgaaacaatccctaagtttctacttgcatttcttctttatgaagaagtgttgatgaacttaatcgtacttgggagtcggccat

SEQ ID NO: 366528 - DNA, 140 bp, Artificial Sequence
  Synthetic
atggccgactcccaagtacgattaagttcatcaacacttcttcataaagaagaaatgcaagtagaaacttagggattgtttcagtgctgacgtaagatactagtgtccttatgtccttgaggagacccagcatggcgtat

SEQ ID NO: 366529 - DNA, 140 bp, Artificial Sequence
  Synthetic
atacgccatgctgggtctcccacaaggcgcacagattgacactcctttcagctcattttactggctttacaaggctggcgtatctccagaaaccttcccaactgtttcacagtttctcttcgtacttgggagtcggccat

SEQ ID NO: 366530 - DNA, 140 bp, Artificial Sequence
  Synthetic
atggccgactcccaagtacgaagagaaactgtgaaacagttgggaaggtttctggagatacgccagccttgtaaagccagtaaaatgagctgaaaggagtgtcaatctgtgcgccttgtgggagacccagcatggcgtat

SEQ ID NO: 366531 - DNA, 140 bp, Artificial Sequence
  Synthetic
atacgccatgctgggtctccgagtgcagtaagagagatgggcctagatgctcattcgcagcactgttgagcttagttcatgaggattggcaaaggatagggaaaaatatccttattcgtgcgtacttgggagtcggccat

SEQ ID NO: 366532 - DNA, 140 bp, Artificial Sequence
  Synthetic
atggccgactcccaagtacgcacgaataaggatatttttccctatcctttgccaatcctcatgaactaagctcaacagtgctgcgaatgagcatctaggcccatctctcttactgcactcggagacccagcatggcgtat

SEQ ID NO: 366533 - DNA, 140 bp, Artificial Sequence
  Synthetic
aggccctggctgctgatatgcttagttcatgaggattggcaaaggatagggaaaaatatccttattcgtgcaaacaatgagctgggtgatgtatcactgaaggtcaatattgtcttggtggaccttttgggacagcggtg

SEQ ID NO: 366534 - DNA, 140 bp, Artificial Sequence
  Synthetic
caccgctgtcccaaaaggtccaccaagacaatattgaccttcagtgatacatcacccagctcattgtttgcacgaataaggatatttttccctatcctttgccaatcctcatgaactaagcatatcagcagccagggcct

SEQ ID NO: 366535 - DNA, 140 bp, Artificial Sequence
  Synthetic
atacgccatgctgggtctccaaggtcactaaatcatgctctgtccttaatttttttggatgaaatgtcattacctgagcttaaatctttgtctgtaaattgcagaatggggaactttgaacgtacttgggagtcggccat

SEQ ID NO: 366536 - DNA, 140 bp, Artificial Sequence
  Synthetic
atggccgactcccaagtacgttcaaagttccccattctgcaatttacagacaaagatttaagctcaggtaatgacatttcatccaaaaaaattaaggacagagcatgatttagtgaccttggagacccagcatggcgtat

SEQ ID NO: 366537 - DNA, 140 bp, Artificial Sequence
  Synthetic
aggccctggctgctgatatgtacctgagcttaaatctttgtctgtaaattgcagaatggggaactttgaagggcaagagtgctttgaattcaccattttgaaggataacagcacaaggctgaccttttgggacagcggtg

SEQ ID NO: 366538 - DNA, 140 bp, Artificial Sequence
  Synthetic
caccgctgtcccaaaaggtcagccttgtgctgttatccttcaaaatggtgaattcaaagcactcttgcccttcaaagttccccattctgcaatttacagacaaagatttaagctcaggtacatatcagcagccagggcct

SEQ ID NO: 366539 - DNA, 140 bp, Artificial Sequence
  Synthetic
atacgccatgctgggtctccatgcagttagagcagtggaagacttagttctaatgctgacaggcagggcagtcagacctagcactgtgacaccagctacacatgaagacaagcaatgtcacgtacttgggagtcggccat

SEQ ID NO: 366540 - DNA, 140 bp, Artificial Sequence
  Synthetic
atggccgactcccaagtacgtgacattgcttgtcttcatgtgtagctggtgtcacagtgctaggtctgactgccctgcctgtcagcattagaactaagtcttccactgctctaactgcatggagacccagcatggcgtat

SEQ ID NO: 366541 - DNA, 140 bp, Artificial Sequence
  Synthetic
aggccctggctgctgatatggtcagacctagcactgtgacaccagctacacatgaagacaagcaatgtcaagagcaaataagcctggatgatctaatggcaagtgacacagtgacagaccgaccttttgggacagcggtg

SEQ ID NO: 366542 - DNA, 140 bp, Artificial Sequence
  Synthetic
caccgctgtcccaaaaggtcggtctgtcactgtgtcacttgccattagatcatccaggcttatttgctcttgacattgcttgtcttcatgtgtagctggtgtcacagtgctaggtctgaccatatcagcagccagggcct

SEQ ID NO: 366543 - DNA, 140 bp, Artificial Sequence
  Synthetic
atacgccatgctgggtctcccacgtaactcaatgtcccaaacggaaagagaaggtcgaagaaactgaactatacttaaacctggagagaataccttggttggtgagaaaactcctacaagcgtacttgggagtcggccat

SEQ ID NO: 366544 - DNA, 140 bp, Artificial Sequence
  Synthetic
atggccgactcccaagtacgcttgtaggagttttctcaccaaccaaggtattctctccaggtttaagtatagttcagtttcttcgaccttctctttccgtttgggacattgagttacgtgggagacccagcatggcgtat

SEQ ID NO: 366545 - DNA, 140 bp, Artificial Sequence
  Synthetic
atacgccatgctgggtctcctgggattcagattgaacacgctgtccatatgaatcaccaatacctttcaatgtcttaaaggcaagtgagacagtttataccatgccacctgccaacctcccgtacttgggagtcggccat

SEQ ID NO: 366546 - DNA, 140 bp, Artificial Sequence
  Synthetic
atggccgactcccaagtacgggaggttggcaggtggcatggtataaactgtctcacttgcctttaagacattgaaaggtattggtgattcatatggacagcgtgttcaatctgaatcccaggagacccagcatggcgtat

SEQ ID NO: 366547 - DNA, 140 bp, Artificial Sequence
  Synthetic
atacgccatgctgggtctccgcttcaccacaattccctcaagtgctggccaatctttgctatactgctattacactttctttattgttctcatcagttttattatttaattgtttccaggcgtacttgggagtcggccat

SEQ ID NO: 366548 - DNA, 140 bp, Artificial Sequence
  Synthetic
atggccgactcccaagtacgcctggaaacaattaaataataaaactgatgagaacaataaagaaagtgtaatagcagtatagcaaagattggccagcacttgagggaattgtggtgaagcggagacccagcatggcgtat

SEQ ID NO: 366549 - DNA, 140 bp, Artificial Sequence
  Synthetic
atacgccatgctgggtctcctctcaaagacatcaatccccccgttacccacgttaacacagagagctctagtagtggtctttccttttgtgaaaccatggacttcttgagaagccttgaccgtacttgggagtcggccat

SEQ ID NO: 366550 - DNA, 140 bp, Artificial Sequence
  Synthetic
atggccgactcccaagtacggtcaaggcttctcaagaagtccatggtttcacaaaaggaaagaccactactagagctctctgtgttaacgtgggtaacggggggattgatgtctttgagaggagacccagcatggcgtat

SEQ ID NO: 366551 - DNA, 140 bp, Artificial Sequence
  Synthetic
atacgccatgctgggtctccgcaatagatgctgaaatgcatgatcttaactgcagttacaacatatgtccctattgtgcatctagactaacctcagatgggcttgctaggcatgtaactccgtacttgggagtcggccat

SEQ ID NO: 366552 - DNA, 140 bp, Artificial Sequence
  Synthetic
atggccgactcccaagtacggagttacatgcctagcaagcccatctgaggttagtctagatgcacaatagggacatatgttgtaactgcagttaagatcatgcatttcagcatctattgcggagacccagcatggcgtat

SEQ ID NO: 366553 - DNA, 140 bp, Artificial Sequence
  Synthetic
aggccctggctgctgatatgaaaaatgtgtcaacacaaagcttgaacaaccacaaagcattttaatcgagcacaaagggacgataattggaaaacagaacgacacttgtacagccagagcgaccttttgggacagcggtg

SEQ ID NO: 366554 - DNA, 140 bp, Artificial Sequence
  Synthetic
caccgctgtcccaaaaggtcgctctggctgtacaagtgtcgttctgttttccaattatcgtccctttgtgctcgattaaaatgctttgtggttgttcaagctttgtgttgacacatttttcatatcagcagccagggcct

SEQ ID NO: 366555 - DNA, 140 bp, Artificial Sequence
  Synthetic
aggccctggctgctgatatgcagagaagggtacacaagcttctgcctttttatactaggaagcatcttgtttgtagtctcttgcctagtaaagggtctaattgacagtgtcggtaacagcgaccttttgggacagcggtg

SEQ ID NO: 366556 - DNA, 140 bp, Artificial Sequence
  Synthetic
caccgctgtcccaaaaggtcgctgttaccgacactgtcaattagaccctttactaggcaagagactacaaacaagatgcttcctagtataaaaaggcagaagcttgtgtacccttctctgcatatcagcagccagggcct

SEQ ID NO: 366557 - DNA, 140 bp, Artificial Sequence
  Synthetic
aggccctggctgctgatatgaaaaacctttcactttcattcaaaaagggtcacagcacacggagacacccctcagttggacctaaaagcgagaccagcatatggtgcaggcgaaatcactgaccttttgggacagcggtg

SEQ ID NO: 366558 - DNA, 140 bp, Artificial Sequence
  Synthetic
caccgctgtcccaaaaggtcagtgatttcgcctgcaccatatgctggtctcgcttttaggtccaactgaggggtgtctccgtgtgctgtgaccctttttgaatgaaagtgaaaggtttttcatatcagcagccagggcct

SEQ ID NO: 366559 - DNA, 140 bp, Artificial Sequence
  Synthetic
atacgccatgctgggtctcccgctaagtgaggtgcattcaatagagcgtataatggaaaactttactcgcctcatgcatggaggaagactttcgaccaagaaaagagatggagatccggccgtacttgggagtcggccat

SEQ ID NO: 366560 - DNA, 140 bp, Artificial Sequence
  Synthetic
atggccgactcccaagtacggccggatctccatctcttttcttggtcgaaagtcttcctccatgcatgaggcgagtaaagttttccattatacgctctattgaatgcacctcacttagcgggagacccagcatggcgtat

SEQ ID NO: 366561 - DNA, 140 bp, Artificial Sequence
  Synthetic
atacgccatgctgggtctcctaaacttgaacatccacagagcatactcattgaacacaaaggaacgattattggcaagcagaatgacacctgtccaactaaaacaagctgctggttggaacgtacttgggagtcggccat

SEQ ID NO: 366562 - DNA, 140 bp, Artificial Sequence
  Synthetic
atggccgactcccaagtacgttccaaccagcagcttgttttagttggacaggtgtcattctgcttgccaataatcgttcctttgtgttcaatgagtatgctctgtggatgttcaagtttaggagacccagcatggcgtat

SEQ ID NO: 366563 - DNA, 140 bp, Artificial Sequence
  Synthetic
atacgccatgctgggtctcctctcaaagaaatacttgcggcacgtcagcacgtaagtgttaactttgagtgagtgacttgagcatcctagatgcagcatgtctttcagcattatgtacaccgtacttgggagtcggccat

SEQ ID NO: 366564 - DNA, 140 bp, Artificial Sequence
  Synthetic
atggccgactcccaagtacggtgtacataatgctgaaagacatgctgcatctaggatgctcaagtcactcactcaaagttaacacttacgtgctgacgtgccgcaagtatttctttgagaggagacccagcatggcgtat

SEQ ID NO: 366565 - DNA, 140 bp, Artificial Sequence
  Synthetic
aggccctggctgctgatatgaaagtcgattgtttgatggagaaaggcttgcagacagaaagattgccgaactcttttcaactaaaactcatataggttgacgaatcagacaagttgttttgaccttttgggacagcggtg

SEQ ID NO: 366566 - DNA, 140 bp, Artificial Sequence
  Synthetic
caccgctgtcccaaaaggtcaaaacaacttgtctgattcgtcaacctatatgagttttagttgaaaagagttcggcaatctttctgtctgcaagcctttctccatcaaacaatcgactttcatatcagcagccagggcct

SEQ ID NO: 366567 - DNA, 140 bp, Artificial Sequence
  Synthetic
atacgccatgctgggtctccatgctccaactattgcaccttcagctaccttttatcgctttgaacttgtaacaatcaactatgctgctcttcaccatcctggcttgacttcacttagacccgtacttgggagtcggccat

SEQ ID NO: 366568 - DNA, 140 bp, Artificial Sequence
  Synthetic
atggccgactcccaagtacgggtctaagtgaagtcaagccaggatggtgaagagcagcatagttgattgttacaagttcaaagcgataaaaggtagctgaaggtgcaatagttggagcatggagacccagcatggcgtat

SEQ ID NO: 366569 - DNA, 140 bp, Artificial Sequence
  Synthetic
atacgccatgctgggtctccctgacgaattcgagcgaacaaaatttaaacatgaacttactcagaatattaccacaagtgagaagatgctattgagttggttgagtgaagacatcaaatccgtacttgggagtcggccat

SEQ ID NO: 366570 - DNA, 140 bp, Artificial Sequence
  Synthetic
atggccgactcccaagtacggatttgatgtcttcactcaaccaactcaatagcatcttctcacttgtggtaatattctgagtaagttcatgtttaaattttgttcgctcgaattcgtcagggagacccagcatggcgtat

SEQ ID NO: 366571 - DNA, 140 bp, Artificial Sequence
  Synthetic
atacgccatgctgggtctccattgcttttatcaatcgtttatttaatccagcttcactaactttgcttttttctttaatttaaacacttaaagggctgtgcggcaacgatatctttgagacgtacttgggagtcggccat

SEQ ID NO: 366572 - DNA, 140 bp, Artificial Sequence
  Synthetic
atggccgactcccaagtacgtctcaaagatatcgttgccgcacagccctttaagtgtttaaattaaagaaaaaagcaaagttagtgaagctggattaaataaacgattgataaaagcaatggagacccagcatggcgtat

SEQ ID NO: 366573 - DNA, 140 bp, Artificial Sequence
  Synthetic
aggccctggctgctgatatgttataaacatcagaaactcattgaaagctagatccgagtttgttagaaataacgataaactactcataaggtcaaaagaagaactaaaaaaatgtttcgagaccttttgggacagcggtg

SEQ ID NO: 366574 - DNA, 140 bp, Artificial Sequence
  Synthetic
caccgctgtcccaaaaggtctcgaaacatttttttagttcttcttttgaccttatgagtagtttatcgttatttctaacaaactcggatctagctttcaatgagtttctgatgtttataacatatcagcagccagggcct

SEQ ID NO: 366575 - DNA, 140 bp, Artificial Sequence
  Synthetic
atacgccatgctgggtctccacattgaaaatcattccatgactctactagaagattcattcagggaaatcacttttgctcttgaaggtaggtttgaagaatcttataaaatacgaacctccgtacttgggagtcggccat

SEQ ID NO: 366576 - DNA, 140 bp, Artificial Sequence
  Synthetic
atggccgactcccaagtacggaggttcgtattttataagattcttcaaacctaccttcaagagcaaaagtgatttccctgaatgaatcttctagtagagtcatggaatgattttcaatgtggagacccagcatggcgtat

SEQ ID NO: 366577 - DNA, 140 bp, Artificial Sequence
  Synthetic
aggccctggctgctgatatggataacttactagccaactctcagcaacagaacaaacaactacagatgcttcgttttggcatgcttgcagggcttagtaggcttgtttgtcctaatgagcgaccttttgggacagcggtg

SEQ ID NO: 366578 - DNA, 140 bp, Artificial Sequence
  Synthetic
caccgctgtcccaaaaggtcgctcattaggacaaacaagcctactaagccctgcaagcatgccaaaacgaagcatctgtagttgtttgttctgttgctgagagttggctagtaagttatccatatcagcagccagggcct

SEQ ID NO: 366579 - DNA, 140 bp, Artificial Sequence
  Synthetic
atacgccatgctgggtctcctctcaaagatatcaatcccccctttacccacgttgacacagatagctttagtagtgctttcttgcctttgttggaccatggaacttttgaaaaaccttaacgtacttgggagtcggccat

SEQ ID NO: 366580 - DNA, 140 bp, Artificial Sequence
  Synthetic
atggccgactcccaagtacgttaaggtttttcaaaagttccatggtccaacaaaggcaagaaagcactactaaagctatctgtgtcaacgtgggtaaaggggggattgatatctttgagaggagacccagcatggcgtat

SEQ ID NO: 366581 - DNA, 140 bp, Artificial Sequence
  Synthetic
aggccctggctgctgatatgtgaaggatgtatcagcgtcttggaagaaacagcagaaaggcacatgctttgggaactcgatctgatgaattcactttgttctgacgaaaaaaaagatactgaccttttgggacagcggtg

SEQ ID NO: 366582 - DNA, 140 bp, Artificial Sequence
  Synthetic
caccgctgtcccaaaaggtcagtatcttttttttcgtcagaacaaagtgaattcatcagatcgagttcccaaagcatgtgcctttctgctgtttcttccaagacgctgatacatccttcacatatcagcagccagggcct

SEQ ID NO: 366583 - DNA, 140 bp, Artificial Sequence
  Synthetic
aggccctggctgctgatatgcagagaagggaagaagctgttgaagttaaacagtgacacatccacagacacacagagcattgcttctgaagtgtcggacagaaggtcttatagttcaagtgaccttttgggacagcggtg

SEQ ID NO: 366584 - DNA, 140 bp, Artificial Sequence
  Synthetic
caccgctgtcccaaaaggtcacttgaactataagaccttctgtccgacacttcagaagcaatgctctgtgtgtctgtggatgtgtcactgtttaacttcaacagcttcttcccttctctgcatatcagcagccagggcct

SEQ ID NO: 366585 - DNA, 140 bp, Artificial Sequence
  Synthetic
aggccctggctgctgatatgccacacaatgggttcttttgagctgatccaggcaatctcagagttcggcatgagcaagtttcctcccgaaaatatagacaaagcaagaagggatccgaaggaccttttgggacagcggtg

SEQ ID NO: 366586 - DNA, 140 bp, Artificial Sequence
  Synthetic
caccgctgtcccaaaaggtccttcggatcccttcttgctttgtctatattttcgggaggaaacttgctcatgccgaactctgagattgcctggatcagctcaaaagaacccattgtgtggcatatcagcagccagggcct

SEQ ID NO: 366587 - DNA, 140 bp, Artificial Sequence
  Synthetic
atacgccatgctgggtctccaactgggttagcatctctgaagtaaccgaaacaacaagtatagttgcatcacctagaactcatatgatgctcaaggattgttttaaaattatactaggtacgtacttgggagtcggccat

SEQ ID NO: 366588 - DNA, 140 bp, Artificial Sequence
  Synthetic
atggccgactcccaagtacgtacctagtataattttaaaacaatccttgagcatcatatgagttctaggtgatgcaactatacttgttgtttcggttacttcagagatgctaacccagttggagacccagcatggcgtat

SEQ ID NO: 366589 - DNA, 140 bp, Artificial Sequence
  Synthetic
atacgccatgctgggtctccctgccaatctatcagaaaagattgagctgctcgcttataatctgcaactcactaatcactgcagcaactgtcaccccaatggtgtaaacattagtaacaccgtacttgggagtcggccat

SEQ ID NO: 366590 - DNA, 140 bp, Artificial Sequence
  Synthetic
atggccgactcccaagtacggtgttactaatgtttacaccattggggtgacagttgctgcagtgattagtgagttgcagattataagcgagcagctcaatcttttctgatagattggcagggagacccagcatggcgtat

SEQ ID NO: 366591 - DNA, 140 bp, Artificial Sequence
  Synthetic
aggccctggctgctgatatgagctcttacaaggacctttttatctgaacaggagacaagctgtccttggttcttcatacctttacattgtcattacactttatatacaagtgctgcagcagaccttttgggacagcggtg

SEQ ID NO: 366592 - DNA, 140 bp, Artificial Sequence
  Synthetic
caccgctgtcccaaaaggtctgctgcagcacttgtatataaagtgtaatgacaatgtaaaggtatgaagaaccaaggacagcttgtctcctgttcagataaaaaggtccttgtaagagctcatatcagcagccagggcct

SEQ ID NO: 366593 - DNA, 140 bp, Artificial Sequence
  Synthetic
atacgccatgctgggtctccctggactcaggtgattgctggtcaatatgttaccaaccctaggtttaacatctccgactactttgagattgtgcgtcaacctggtgatggtaattgttttcgtacttgggagtcggccat

SEQ ID NO: 366594 - DNA, 140 bp, Artificial Sequence
  Synthetic
atggccgactcccaagtacgaaaacaattaccatcaccaggttgacgcacaatctcaaagtagtcggagatgttaaacctagggttggtaacatattgaccagcaatcacctgagtccagggagacccagcatggcgtat

SEQ ID NO: 366595 - DNA, 140 bp, Artificial Sequence
  Synthetic
aggccctggctgctgatatggtcaaaaaaaacattgatgaagttttacttactgaagatggaaatctgatcttctgctggctgaaaacaatctcctcttcagtcaaaggaagcctaaagagaccttttgggacagcggtg

SEQ ID NO: 366596 - DNA, 140 bp, Artificial Sequence
  Synthetic
caccgctgtcccaaaaggtctctttaggcttcctttgactgaagaggagattgttttcagccagcagaagatcagatttccatcttcagtaagtaaaacttcatcaatgttttttttgaccatatcagcagccagggcct

SEQ ID NO: 366597 - DNA, 140 bp, Artificial Sequence
  Synthetic
atacgccatgctgggtctccaatgagttataacctgtttcatcacattcgcaaacaagctcttctgctcttttcactctgacataaaccttgactgcgtgccgccactatatctttgagacgtacttgggagtcggccat

SEQ ID NO: 366598 - DNA, 140 bp, Artificial Sequence
  Synthetic
atggccgactcccaagtacgtctcaaagatatagtggcggcacgcagtcaaggtttatgtcagagtgaaaagagcagaagagcttgtttgcgaatgtgatgaaacaggttataactcattggagacccagcatggcgtat

SEQ ID NO: 366599 - DNA, 140 bp, Artificial Sequence
  Synthetic
aggccctggctgctgatatggtgtcagcttcacaaaagaagaagtcttaataaagcggctggagaaaaatttccttaagcagcataatttagagattatggaaactgtgaatcttgtattgaccttttgggacagcggtg

SEQ ID NO: 366600 - DNA, 140 bp, Artificial Sequence
  Synthetic
caccgctgtcccaaaaggtcaatacaagattcacagtttccataatctctaaattatgctgcttaaggaaatttttctccagccgctttattaagacttcttcttttgtgaagctgacaccatatcagcagccagggcct

SEQ ID NO: 366601 - DNA, 140 bp, Artificial Sequence
  Synthetic
atacgccatgctgggtctccagaaccgcaagactattactaggctgcccaaatgtgaggaaagcagcaaacagagaagggaagaagctgttgaagttaaacagcgacacatccacagacacgtacttgggagtcggccat

SEQ ID NO: 366602 - DNA, 140 bp, Artificial Sequence
  Synthetic
atggccgactcccaagtacgtgtctgtggatgtgtcgctgtttaacttcaacagcttcttcccttctctgtttgctgctttcctcacatttgggcagcctagtaatagtcttgcggttctggagacccagcatggcgtat

SEQ ID NO: 366603 - DNA, 140 bp, Artificial Sequence
  Synthetic
atacgccatgctgggtctccccacaacatcaagcgtctaactgaagcagcagcacggaaatattaccaagaagagcctgaagccaagcttattggtttaagtttggatgattatcttaagcgtacttgggagtcggccat

SEQ ID NO: 366604 - DNA, 140 bp, Artificial Sequence
  Synthetic
atggccgactcccaagtacgcttaagataatcatccaaacttaaaccaataagcttggcttcaggctcttcttggtaatatttccgtgctgctgcttcagttagacgcttgatgttgtggggagacccagcatggcgtat

SEQ ID NO: 366605 - DNA, 140 bp, Artificial Sequence
  Synthetic
atacgccatgctgggtctccgcactaaattatgagcaccgcttctatgcggtcttagcacctaaagcgcaactaggaggagcaagagatttgttagtgcaagagactgggactaaagtcacgtacttgggagtcggccat

SEQ ID NO: 366606 - DNA, 140 bp, Artificial Sequence
  Synthetic
atggccgactcccaagtacgtgactttagtcccagtctcttgcactaacaaatctcttgctcctcctagttgcgctttaggtgctaagaccgcatagaagcggtgctcataatttagtgcggagacccagcatggcgtat

SEQ ID NO: 366607 - DNA, 140 bp, Artificial Sequence
  Synthetic
aggccctggctgctgatatggatgatggcctcacaaacccacatcttaaagaaacaatccttaatgtgggattagactgtcttgctaacatgcgaaatcttgacggtaagcccataagtggaccttttgggacagcggtg

SEQ ID NO: 366608 - DNA, 140 bp, Artificial Sequence
  Synthetic
caccgctgtcccaaaaggtccacttatgggcttaccgtcaagatttcgcatgttagcaagacagtctaatcccacattaaggattgtttctttaagatgtgggtttgtgaggccatcatccatatcagcagccagggcct

SEQ ID NO: 366609 - DNA, 140 bp, Artificial Sequence
  Synthetic
atacgccatgctgggtctccaggagctggcaattttttatcttaagagaagcttaccccagacaacagtacatgttgaacatgccggtagttcagatgattacgcaaagtgtatagtggtcgtacttgggagtcggccat

SEQ ID NO: 366610 - DNA, 140 bp, Artificial Sequence
  Synthetic
atggccgactcccaagtacgaccactatacactttgcgtaatcatctgaactaccggcatgttcaacatgtactgttgtctggggtaagcttctcttaagataaaaaattgccagctcctggagacccagcatggcgtat

SEQ ID NO: 366611 - DNA, 140 bp, Artificial Sequence
  Synthetic
atacgccatgctgggtctccataggcataatgtcatttacagcagcagaatggcagactcttgcgattggctaaaggatggtaaaaggagagggaatctagaactagcgaataggatccacgtacttgggagtcggccat

SEQ ID NO: 366612 - DNA, 140 bp, Artificial Sequence
  Synthetic
atggccgactcccaagtacgtggatcctattcgctagttctagattccctctccttttaccatcctttagccaatcgcaagagtctgccattctgctgctgtaaatgacattatgcctatggagacccagcatggcgtat

SEQ ID NO: 366613 - DNA, 140 bp, Artificial Sequence
  Synthetic
atacgccatgctgggtctccatctgtactgtgtattctgatagcaggatattacaggtcatttggaggggaaggaaccgagaaacaggtaaaggcatcattgaatagagacgacaataaacgtacttgggagtcggccat

SEQ ID NO: 366614 - DNA, 140 bp, Artificial Sequence
  Synthetic
atggccgactcccaagtacgtttattgtcgtctctattcaatgatgcctttacctgtttctcggttccttcccctccaaatgacctgtaatatcctgctatcagaatacacagtacagatggagacccagcatggcgtat

SEQ ID NO: 366615 - DNA, 140 bp, Artificial Sequence
  Synthetic
aggccctggctgctgatatgcagctcagcggttgctttagaagatgctgaagtcattgctagagcagcccaaacacttcaaatgaacagtgtatcaatacagtcaagtagcttgaccacagaccttttgggacagcggtg

SEQ ID NO: 366616 - DNA, 140 bp, Artificial Sequence
  Synthetic
caccgctgtcccaaaaggtctgtggtcaagctacttgactgtattgatacactgttcatttgaagtgtttgggctgctctagcaatgacttcagcatcttctaaagcaaccgctgagctgcatatcagcagccagggcct

SEQ ID NO: 366617 - DNA, 140 bp, Artificial Sequence
  Synthetic
atacgccatgctgggtctccacaaacactgacagcccgaaatgttttgcacgggttagctggaggaattaaggagctttcgcttccaatatatacaatattcatgaaatcttacttctttcgtacttgggagtcggccat

SEQ ID NO: 366618 - DNA, 140 bp, Artificial Sequence
  Synthetic
atggccgactcccaagtacgaaagaagtaagatttcatgaatattgtatatattggaagcgaaagctccttaattcctccagctaacccgtgcaaaacatttcgggctgtcagtgtttgtggagacccagcatggcgtat

SEQ ID NO: 366619 - DNA, 140 bp, Artificial Sequence
  Synthetic
aggccctggctgctgatatgtacagagtcaccttaaagtctttgaaaatgagttcaccaacttaaatcttcaattctctgatccgaacagacagaaacttagaatagttgagtctagaccgaccttttgggacagcggtg

SEQ ID NO: 366620 - DNA, 140 bp, Artificial Sequence
  Synthetic
caccgctgtcccaaaaggtcggtctagactcaactattctaagtttctgtctgttcggatcagagaattgaagatttaagttggtgaactcattttcaaagactttaaggtgactctgtacatatcagcagccagggcct

SEQ ID NO: 366621 - DNA, 140 bp, Artificial Sequence
  Synthetic
aggccctggctgctgatatggcattagtcctgatgacaccttagcccagcttgtagcgaaaaaactcatcagcctcaatgtttcgacagaagaatactcagctgaggtgtccagactcaagaccttttgggacagcggtg

SEQ ID NO: 366622 - DNA, 140 bp, Artificial Sequence
  Synthetic
caccgctgtcccaaaaggtcttgagtctggacacctcagctgagtattcttctgtcgaaacattgaggctgatgagttttttcgctacaagctgggctaaggtgtcatcaggactaatgccatatcagcagccagggcct

SEQ ID NO: 366623 - DNA, 140 bp, Artificial Sequence
  Synthetic
aggccctggctgctgatatgtcagaaaagagtggccttagtccagatttgcaacaagttgcaagatactcaaaccatttgaccttgctcagcagaatgattcaacaagcaaagccaaccggaccttttgggacagcggtg

SEQ ID NO: 366624 - DNA, 140 bp, Artificial Sequence
  Synthetic
caccgctgtcccaaaaggtccggttggctttgcttgttgaatcattctgctgagcaaggtcaaatggtttgagtatcttgcaacttgttgcaaatctggactaaggccactcttttctgacatatcagcagccagggcct

SEQ ID NO: 366625 - DNA, 140 bp, Artificial Sequence
  Synthetic
aggccctggctgctgatatgtgttttcagcaactgaacaagttcgactatccaacaaccctgcagttgtcatgggctacctattggatgaatcagcaatttctgaagtcaagcctaccaagaccttttgggacagcggtg

SEQ ID NO: 366626 - DNA, 140 bp, Artificial Sequence
  Synthetic
caccgctgtcccaaaaggtcttggtaggcttgacttcagaaattgctgattcatccaataggtagcccatgacaactgcagggttgttggatagtcgaacttgttcagttgctgaaaacacatatcagcagccagggcct

SEQ ID NO: 366627 - DNA, 140 bp, Artificial Sequence
  Synthetic
aggccctggctgctgatatggtctagtctagatgaggttactttgtccaaaaagcaggcagaaatacttagacagaaagcatctcagttgtctaaactggtcaacaaaagtcagaatatagaccttttgggacagcggtg

SEQ ID NO: 366628 - DNA, 140 bp, Artificial Sequence
  Synthetic
caccgctgtcccaaaaggtctatattctgacttttgttgaccagtttagacaactgagatgctttctgtctaagtatttctgcctgctttttggacaaagtaacctcatctagactagaccatatcagcagccagggcct

SEQ ID NO: 366629 - DNA, 140 bp, Artificial Sequence
  Synthetic
atacgccatgctgggtctccgacgaaggatgtatcagcgtcttggaagaaacagcagaaaggcatatgctctgggagctcgacctgatgaacacactctgctctgacgaaaaaaaagatgcgtacttgggagtcggccat

SEQ ID NO: 366630 - DNA, 140 bp, Artificial Sequence
  Synthetic
atggccgactcccaagtacgcatcttttttttcgtcagagcagagtgtgttcatcaggtcgagctcccagagcatatgcctttctgctgtttcttccaagacgctgatacatccttcgtcggagacccagcatggcgtat

SEQ ID NO: 366631 - DNA, 140 bp, Artificial Sequence
  Synthetic
aggccctggctgctgatatgaatttgatggacaagttatcgccaacatacttgccagtgaattgagttctgtgaaacgagattctgaacgcgagggtctaactgatctccttgattatctgaccttttgggacagcggtg

SEQ ID NO: 366632 - DNA, 140 bp, Artificial Sequence
  Synthetic
caccgctgtcccaaaaggtcagataatcaaggagatcagttagaccctcgcgttcagaatctcgtttcacagaactcaattcactggcaagtatgttggcgataacttgtccatcaaattcatatcagcagccagggcct

SEQ ID NO: 366633 - DNA, 140 bp, Artificial Sequence
  Synthetic
atacgccatgctgggtctcccccgattacttaagtttgtgcccctcaaaaaaggtctagcagtggtgaaaatcaaaaaacaaattttaacagtgaagaagcaggttgtgtttgatgcagacgtacttgggagtcggccat

SEQ ID NO: 366634 - DNA, 140 bp, Artificial Sequence
  Synthetic
atggccgactcccaagtacgtctgcatcaaacacaacctgcttcttcactgttaaaatttgttttttgattttcaccactgctagaccttttttgaggggcacaaacttaagtaatcgggggagacccagcatggcgtat

SEQ ID NO: 366635 - DNA, 140 bp, Artificial Sequence
  Synthetic
atacgccatgctgggtctccgactggtatactgtccaaggagctctactctcaatatgatgaaacattttggaagcatgcttgtagacttaagaacttcacagctgcagtacaaagatgtcgtacttgggagtcggccat

SEQ ID NO: 366636 - DNA, 140 bp, Artificial Sequence
  Synthetic
atggccgactcccaagtacgacatctttgtactgcagctgtgaagttcttaagtctacaagcatgcttccaaaatgtttcatcatattgagagtagagctccttggacagtataccagtcggagacccagcatggcgtat

SEQ ID NO: 366637 - DNA, 140 bp, Artificial Sequence
  Synthetic
atacgccatgctgggtctccgctttaacaatgtacttgttaacattgacagaaacacggtgaaaagtgaacttttatggaaatttacgttagacaccaatgtaagcaccacaagtactatcgtacttgggagtcggccat

SEQ ID NO: 366638 - DNA, 140 bp, Artificial Sequence
  Synthetic
atggccgactcccaagtacgatagtacttgtggtgcttacattggtgtctaacgtaaatttccataaaagttcacttttcaccgtgtttctgtcaatgttaacaagtacattgttaaagcggagacccagcatggcgtat

SEQ ID NO: 366639 - DNA, 140 bp, Artificial Sequence
  Synthetic
atacgccatgctgggtctccaactgatccactctgcaaacctgccagtcctctccttctcaaccatttatttcagtttcatcattgttattattttggggtgtggggggaacgatttcttcgtacttgggagtcggccat

SEQ ID NO: 366640 - DNA, 140 bp, Artificial Sequence
  Synthetic
atggccgactcccaagtacgaagaaatcgttccccccacaccccaaaataataacaatgatgaaactgaaataaatggttgagaaggagaggactggcaggtttgcagagtggatcagttggagacccagcatggcgtat

SEQ ID NO: 366641 - DNA, 140 bp, Artificial Sequence
  Synthetic
atacgccatgctgggtctccagttcttgcttgcattcttactttatgaagaagtgttaatgaacttaatcaaccagtgtaaggcagtaaaagaactcatcaacagcacaggactctcagacgtacttgggagtcggccat

SEQ ID NO: 366642 - DNA, 140 bp, Artificial Sequence
  Synthetic
atggccgactcccaagtacgtctgagagtcctgtgctgttgatgagttcttttactgccttacactggttgattaagttcattaacacttcttcataaagtaagaatgcaagcaagaactggagacccagcatggcgtat

SEQ ID NO: 366643 - DNA, 140 bp, Artificial Sequence
  Synthetic
aggccctggctgctgatatggaattggggaagttatgtcattgcggcagctaggacataaattgctaacacgggacaagcagatcaagcaggaattttccagaatgaagctttacgtcacgaccttttgggacagcggtg

SEQ ID NO: 366644 - DNA, 140 bp, Artificial Sequence
  Synthetic
caccgctgtcccaaaaggtcgtgacgtaaagcttcattctggaaaattcctgcttgatctgcttgtcccgtgttagcaatttatgtcctagctgccgcaatgacataacttccccaattccatatcagcagccagggcct

SEQ ID NO: 366645 - DNA, 140 bp, Artificial Sequence
  Synthetic
atacgccatgctgggtctccgagcaaataagcttagatgatctgatggcaaacgacacggtaacagactttcctgatagggaagcagaagccctcaaaacaggaaatcttggctttaactcgtacttgggagtcggccat

SEQ ID NO: 366646 - DNA, 140 bp, Artificial Sequence
  Synthetic
atggccgactcccaagtacgagttaaagccaagatttcctgttttgagggcttctgcttccctatcaggaaagtctgttaccgtgtcgtttgccatcagatcatctaagcttatttgctcggagacccagcatggcgtat

SEQ ID NO: 366647 - DNA, 140 bp, Artificial Sequence
  Synthetic
aggccctggctgctgatatgtcctgatagggaagcagaagccctcaaaacaggaaatcttggctttaactgggactcagattgaacatgccgcttataagccattaatacctttcggcgtgaccttttgggacagcggtg

SEQ ID NO: 366648 - DNA, 140 bp, Artificial Sequence
  Synthetic
caccgctgtcccaaaaggtcacgccgaaaggtattaatggcttataagcggcatgttcaatctgagtcccagttaaagccaagatttcctgttttgagggcttctgcttccctatcaggacatatcagcagccagggcct

SEQ ID NO: 366649 - DNA, 140 bp, Artificial Sequence
  Synthetic
atacgccatgctgggtctccccttcaaacaagctaactactctgcattctcctcaatcaactcaattgcttcaactgatctattttactagctcatcgatcctctctttcttagctattccgtacttgggagtcggccat

SEQ ID NO: 366650 - DNA, 140 bp, Artificial Sequence
  Synthetic
atggccgactcccaagtacggaatagctaagaaagagaggatcgatgagctagtaaaatagatcagttgaagcaattgagttgattgaggagaatgcagagtagttagcttgtttgaaggggagacccagcatggcgtat

SEQ ID NO: 366651 - DNA, 140 bp, Artificial Sequence
  Synthetic
aggccctggctgctgatatgtcaactgatctattttactagctcatcgatcctctctttcttagctattcatttcagcttcatcatcatcgttattatcttggggtgtggggggaacgatgaccttttgggacagcggtg

SEQ ID NO: 366652 - DNA, 140 bp, Artificial Sequence
  Synthetic
caccgctgtcccaaaaggtcatcgttccccccacaccccaagataataacgatgatgatgaagctgaaatgaatagctaagaaagagaggatcgatgagctagtaaaatagatcagttgacatatcagcagccagggcct

SEQ ID NO: 366653 - DNA, 140 bp, Artificial Sequence
  Synthetic
atacgccatgctgggtctcctctcaaagaaacacgtgccgcttacgcccacagtgttaccttgagtgttagcaaaatggagaacaaaatcgaagtgaacaacaaagatgagctgaacaaacgtacttgggagtcggccat

SEQ ID NO: 366654 - DNA, 140 bp, Artificial Sequence
  Synthetic
atggccgactcccaagtacgtttgttcagctcatctttgttgttcacttcgattttgttctccattttgctaacactcaaggtaacactgtgggcgtaagcggcacgtgtttctttgagaggagacccagcatggcgtat

SEQ ID NO: 366655 - DNA, 140 bp, Artificial Sequence
  Synthetic
aggccctggctgctgatatggcaaaatggagaacaaaatcgaagtgaacaacaaagatgagctgaacaaatggtttgaggagttcaagaaaggaaacgggcttgtggatactttcacaaagaccttttgggacagcggtg

SEQ ID NO: 366656 - DNA, 140 bp, Artificial Sequence
  Synthetic
caccgctgtcccaaaaggtctttgtgaaagtatccacaagcccgtttcctttcttgaactcctcaaaccatttgttcagctcatctttgttgttcacttcgattttgttctccattttgccatatcagcagccagggcct

SEQ ID NO: 366657 - DNA, 140 bp, Artificial Sequence
  Synthetic
atacgccatgctgggtctcccaccaagtcggaccgcccctctgtcggacccgcagcaccgtccagtggactagagggctcaggggaaccgaatacttccccctcaatcaccacaaaaggccgtacttgggagtcggccat

SEQ ID NO: 366658 - DNA, 140 bp, Artificial Sequence
  Synthetic
atggccgactcccaagtacggccttttgtggtgattgagggggaagtattcggttcccctgagccctctagtccactggacggtgctgcgggtccgacagaggggcggtccgacttggtgggagacccagcatggcgtat

SEQ ID NO: 366659 - DNA, 140 bp, Artificial Sequence
  Synthetic
atacgccatgctgggtctccgccctggttgaggccaccaagtactgtgctcccatatatgaatgtgcctgggttagctccacaggtatagtgaagagaggccttgagtggtttgaaaaaacgtacttgggagtcggccat

SEQ ID NO: 366660 - DNA, 140 bp, Artificial Sequence
  Synthetic
atggccgactcccaagtacgttttttcaaaccactcaaggcctctcttcactatacctgtggagctaacccaggcacattcatatatgggagcacagtacttggtggcctcaaccagggcggagacccagcatggcgtat

SEQ ID NO: 366661 - DNA, 140 bp, Artificial Sequence
  Synthetic
atacgccatgctgggtctccgatgtgcccaaaattgaacagcttgccaactatcagcaggccgccctcaagtggaggaaggacataggcttccgcgttaatgcaaacacagcggccctaacgtacttgggagtcggccat

SEQ ID NO: 366662 - DNA, 140 bp, Artificial Sequence
  Synthetic
atggccgactcccaagtacgttagggccgctgtgtttgcattaacgcggaagcctatgtccttcctccacttgagggcggcctgctgatagttggcaagctgttcaattttgggcacatcggagacccagcatggcgtat

SEQ ID NO: 366663 - DNA, 140 bp, Artificial Sequence
  Synthetic
aggccctggctgctgatatggtggaggaaggacataggcttccgcgttaatgcaaacacagcggccctaagcaacaaagtcctctctgagtacaaggttcctggtgagattgtgatgtctgaccttttgggacagcggtg

SEQ ID NO: 366664 - DNA, 140 bp, Artificial Sequence
  Synthetic
caccgctgtcccaaaaggtcagacatcacaatctcaccaggaaccttgtactcagagaggactttgttgcttagggccgctgtgtttgcattaacgcggaagcctatgtccttcctccaccatatcagcagccagggcct

SEQ ID NO: 366665 - DNA, 140 bp, Artificial Sequence
  Synthetic
atacgccatgctgggtctccgcaacaaagtcctctctgagtacaaggttcctggtgagattgtgatgtctgtcaaagagatgctttcagacatgattagaaggaggaacctgatccttaacgtacttgggagtcggccat

SEQ ID NO: 366666 - DNA, 140 bp, Artificial Sequence
  Synthetic
atggccgactcccaagtacgttaaggatcaggttcctccttctaatcatgtctgaaagcatctctttgacagacatcacaatctcaccaggaaccttgtactcagagaggactttgttgcggagacccagcatggcgtat

SEQ ID NO: 366667 - DNA, 140 bp, Artificial Sequence
  Synthetic
atacgccatgctgggtctcccagcacagccaaaccttttacagaatgccccccccactgctgatcaaggcgtacaccccggcccaacaaacagatccaagaggaaccttgaaatggaaatcgtacttgggagtcggccat

SEQ ID NO: 366668 - DNA, 140 bp, Artificial Sequence
  Synthetic
atggccgactcccaagtacgatttccatttcaaggttcctcttggatctgtttgttgggccggggtgtacgccttgatcagcagtggggggggcattctgtaaaaggtttggctgtgctgggagacccagcatggcgtat

SEQ ID NO: 366669 - DNA, 140 bp, Artificial Sequence
  Synthetic
atacgccatgctgggtctccaatggtgcagggagtttgtcaagggcaaatatataatggccttcaatccaccctggggtgatgtcaacaagtccggccgctcaggaatagctctagttgccgtacttgggagtcggccat

SEQ ID NO: 366670 - DNA, 140 bp, Artificial Sequence
  Synthetic
atggccgactcccaagtacggcaactagagctattcctgagcggccggacttgttgacatcaccccagggtggattgaaggccattatatatttgcccttgacaaactccctgcaccattggagacccagcatggcgtat

SEQ ID NO: 366671 - DNA, 140 bp, Artificial Sequence
  Synthetic
aggccctggctgctgatatgccctggggtgatgtcaacaagtccggccgctcaggaatagctctagttgctacaggtcttgccaaacttgcagaaacagaaggaaagggagtttttgagggaccttttgggacagcggtg

SEQ ID NO: 366672 - DNA, 140 bp, Artificial Sequence
  Synthetic
caccgctgtcccaaaaggtccctcaaaaactccctttccttctgtttctgcaagtttggcaagacctgtagcaactagagctattcctgagcggccggacttgttgacatcaccccagggcatatcagcagccagggcct

SEQ ID NO: 366673 - DNA, 140 bp, Artificial Sequence
  Synthetic
aggccctggctgctgatatgaatagaagagttttttttgactggtgagggttacttcaatgaagtcttacagttcaaggtaccaagcacactgagctccacagagccgacccataccggggaccttttgggacagcggtg

SEQ ID NO: 366674 - DNA, 140 bp, Artificial Sequence
  Synthetic
caccgctgtcccaaaaggtccccggtatgggtcggctctgtggagctcagtgtgcttggtaccttgaactgtaagacttcattgaagtaaccctcaccagtcaaaaaaaactcttctattcatatcagcagccagggcct

SEQ ID NO: 366675 - DNA, 140 bp, Artificial Sequence
  Synthetic
aggccctggctgctgatatggcacatcactaaggcccaggaactctacaaaaactcatcagcactgagagcacagggtgcacagattgacacccctttcagctccttctactggctctatgaccttttgggacagcggtg

SEQ ID NO: 366676 - DNA, 140 bp, Artificial Sequence
  Synthetic
caccgctgtcccaaaaggtcatagagccagtagaaggagctgaaaggggtgtcaatctgtgcaccctgtgctctcagtgctgatgagtttttgtagagttcctgggccttagtgatgtgccatatcagcagccagggcct

SEQ ID NO: 366677 - DNA, 140 bp, Artificial Sequence
  Synthetic
atacgccatgctgggtctcctgagctgggaaagcagccaagaggcactaaaaaaatgaagaaggcacttctgagcaccccaatgaaatggggaaagaagctttatgagctcttcgctgatcgtacttgggagtcggccat

SEQ ID NO: 366678 - DNA, 140 bp, Artificial Sequence
  Synthetic
atggccgactcccaagtacgatcagcgaagagctcataaagcttctttccccatttcattggggtgctcagaagtgccttcttcatttttttagtgcctcttggctgctttcccagctcaggagacccagcatggcgtat

SEQ ID NO: 366679 - DNA, 140 bp, Artificial Sequence
  Synthetic
aggccctggctgctgatatgtgagcaccccaatgaaatggggaaagaagctttatgagctcttcgctgatgactctttccagcaaaacaggatctacatgcaccctgctgtgctgacagcgaccttttgggacagcggtg

SEQ ID NO: 366680 - DNA, 140 bp, Artificial Sequence
  Synthetic
caccgctgtcccaaaaggtcgctgtcagcacagcagggtgcatgtagatcctgttttgctggaaagagtcatcagcgaagagctcataaagcttctttccccatttcattggggtgctcacatatcagcagccagggcct

SEQ ID NO: 366681 - DNA, 140 bp, Artificial Sequence
  Synthetic
atacgccatgctgggtctccatagctgagttaaccatgcccaacaaaacagattactcataccacaacatcaaacatctaactgaggtggcagcacggaagtattaccaggaagagcctgcgtacttgggagtcggccat

SEQ ID NO: 366682 - DNA, 140 bp, Artificial Sequence
  Synthetic
atggccgactcccaagtacgcaggctcttcctggtaatacttccgtgctgccacctcagttagatgtttgatgttgtggtatgagtaatctgttttgttgggcatggttaactcagctatggagacccagcatggcgtat

SEQ ID NO: 366683 - DNA, 140 bp, Artificial Sequence
  Synthetic
atacgccatgctgggtctccatccagacgatgcagcccagggctcaggtcacaccaagtcaattctgaacctccgaacaaatagtgaaactaacaatccttgtgctaaaacgattgtcaacgtacttgggagtcggccat

SEQ ID NO: 366684 - DNA, 140 bp, Artificial Sequence
  Synthetic
atggccgactcccaagtacgttgacaatcgttttagcacaaggattgttagtttcactatttgttcggaggttcagaattgacttggtgtgacctgagccctgggctgcatcgtctggatggagacccagcatggcgtat

SEQ ID NO: 366685 - DNA, 140 bp, Artificial Sequence
  Synthetic
aggccctggctgctgatatgctccgaacaaatagtgaaactaacaatccttgtgctaaaacgattgtcaaacttttcgaagttcaaaaaacaggattcaacatacaggacatggatattggaccttttgggacagcggtg

SEQ ID NO: 366686 - DNA, 140 bp, Artificial Sequence
  Synthetic
caccgctgtcccaaaaggtccaatatccatgtcctgtatgttgaatcctgttttttgaacttcgaaaagtttgacaatcgttttagcacaaggattgttagtttcactatttgttcggagcatatcagcagccagggcct

SEQ ID NO: 366687 - DNA, 140 bp, Artificial Sequence
  Synthetic
aggccctggctgctgatatgataaaaggaagggaaattcgtaagggccagtcagtgttaagacaatacaggacagaaatcaagattggcaaggcatcttctggttccagaagactattgtgaccttttgggacagcggtg

SEQ ID NO: 366688 - DNA, 140 bp, Artificial Sequence
  Synthetic
caccgctgtcccaaaaggtcacaatagtcttctggaaccagaagatgccttgccaatcttgatttctgtcctgtattgtcttaacactgactggcccttacgaatttcccttccttttatcatatcagcagccagggcct

SEQ ID NO: 366689 - DNA, 140 bp, Artificial Sequence
  Synthetic
atacgccatgctgggtctccttccaaaatgcttacaacgtcaaaggcaatgccaccagtgccaacattatctaaatctccagagtttttttctatttgttcctgtttgtgcttctgcttccgtacttgggagtcggccat

SEQ ID NO: 366690 - DNA, 140 bp, Artificial Sequence
  Synthetic
atggccgactcccaagtacggaagcagaagcacaaacaggaacaaatagaaaaaaactctggagatttagataatgttggcactggtggcattgcctttgacgttgtaagcattttggaaggagacccagcatggcgtat

SEQ ID NO: 366691 - DNA, 140 bp, Artificial Sequence
  Synthetic
atacgccatgctgggtctcctaccaaaacctattttatcttgctttattctattttgcttcatactattatattcttcttttacatattaaagggctgtgcggcaacgatatctttgagacgtacttgggagtcggccat

SEQ ID NO: 366692 - DNA, 140 bp, Artificial Sequence
  Synthetic
atggccgactcccaagtacgtctcaaagatatcgttgccgcacagccctttaatatgtaaaagaagaatataatagtatgaagcaaaatagaataaagcaagataaaataggttttggtaggagacccagcatggcgtat

SEQ ID NO: 366693 - DNA, 140 bp, Artificial Sequence
  Synthetic
atacgccatgctgggtctcctctcaaagaaatacttgcggcacgtcagtacgtaagtgttaactttgagtgtgtgtgaaaagcgatttgtgaggaacatgtttctccacttcaaatttgtcgtacttgggagtcggccat

SEQ ID NO: 366694 - DNA, 140 bp, Artificial Sequence
  Synthetic
atggccgactcccaagtacgacaaatttgaagtggagaaacatgttcctcacaaatcgcttttcacacacactcaaagttaacacttacgtactgacgtgccgcaagtatttctttgagaggagacccagcatggcgtat

SEQ ID NO: 366695 - DNA, 140 bp, Artificial Sequence
  Synthetic
aggccctggctgctgatatggtgtgtgaaaagcgatttgtgaggaacatgtttctccacttcaaatttgtgttgttgactaacttcttcttttgtcaactcctatggggtggcggcgggggaccttttgggacagcggtg

SEQ ID NO: 366696 - DNA, 140 bp, Artificial Sequence
  Synthetic
caccgctgtcccaaaaggtcccccgccgccaccccataggagttgacaaaagaagaagttagtcaacaacacaaatttgaagtggagaaacatgttcctcacaaatcgcttttcacacaccatatcagcagccagggcct

SEQ ID NO: 366697 - DNA, 140 bp, Artificial Sequence
  Synthetic
atacgccatgctgggtctccgttgttgactaacttcttcttttgtcaactcctatggggtggcggcggggttaccagtggaggtgggaccaatactagctcaacacaagccatcctaatacgtacttgggagtcggccat

SEQ ID NO: 366698 - DNA, 140 bp, Artificial Sequence
  Synthetic
atggccgactcccaagtacgtattaggatggcttgtgttgagctagtattggtcccacctccactggtaaccccgccgccaccccataggagttgacaaaagaagaagttagtcaacaacggagacccagcatggcgtat

SEQ ID NO: 366699 - DNA, 140 bp, Artificial Sequence
  Synthetic
atacgccatgctgggtctccaaccgccgcagaaacagtgccgagcacgaccatcaatacaccggacacacaggtcaccacagacagtggttctggtgaatccagcacagacccccagacccgtacttgggagtcggccat

SEQ ID NO: 366700 - DNA, 140 bp, Artificial Sequence
  Synthetic
atggccgactcccaagtacgggtctgggggtctgtgctggattcaccagaaccactgtctgtggtgacctgtgtgtccggtgtattgatggtcgtgctcggcactgtttctgcggcggttggagacccagcatggcgtat

SEQ ID NO: 366701 - DNA, 140 bp, Artificial Sequence
  Synthetic
aggccctggctgctgatatgaggtcaccacagacagtggttctggtgaatccagcacagacccccagaccaccaacggagaagtaccttccacttctatcgccaccatcaaaacacaagagaccttttgggacagcggtg

SEQ ID NO: 366702 - DNA, 140 bp, Artificial Sequence
  Synthetic
caccgctgtcccaaaaggtctcttgtgttttgatggtggcgatagaagtggaaggtacttctccgttggtggtctgggggtctgtgctggattcaccagaaccactgtctgtggtgacctcatatcagcagccagggcct

SEQ ID NO: 366703 - DNA, 140 bp, Artificial Sequence
  Synthetic
atacgccatgctgggtctcccatccactccaggcaacaccacatcaaacaaaccagatgtcaacttactcacatcaccaatctcggaggcaaaatcatcacccagccctagcaaaacatccgtacttgggagtcggccat

SEQ ID NO: 366704 - DNA, 140 bp, Artificial Sequence
  Synthetic
atggccgactcccaagtacggatgttttgctagggctgggtgatgattttgcctccgagattggtgatgtgagtaagttgacatctggtttgtttgatgtggtgttgcctggagtggatgggagacccagcatggcgtat

SEQ ID NO: 366705 - DNA, 140 bp, Artificial Sequence
  Synthetic
aggccctggctgctgatatgacatcaccaatctcggaggcaaaatcatcacccagccctagcaaaacatcgacaccgcaaactgcacatcatctctccagaagtcttctctcagcagcaagaccttttgggacagcggtg

SEQ ID NO: 366706 - DNA, 140 bp, Artificial Sequence
  Synthetic
caccgctgtcccaaaaggtcttgctgctgagagaagacttctggagagatgatgtgcagtttgcggtgtcgatgttttgctagggctgggtgatgattttgcctccgagattggtgatgtcatatcagcagccagggcct

SEQ ID NO: 366707 - DNA, 140 bp, Artificial Sequence
  Synthetic
atacgccatgctgggtctccacaaccatgagcagtccaacaacagtcaaaaacagtgcaacagccacaccaacccaaggcatcaccaccagcaacacttcgaaacagactgacactacaacgtacttgggagtcggccat

SEQ ID NO: 366708 - DNA, 140 bp, Artificial Sequence
  Synthetic
atggccgactcccaagtacgttgtagtgtcagtctgtttcgaagtgttgctggtggtgatgccttgggttggtgtggctgttgcactgtttttgactgttgttggactgctcatggttgtggagacccagcatggcgtat

SEQ ID NO: 366709 - DNA, 140 bp, Artificial Sequence
  Synthetic
atacgccatgctgggtctccccctggagatcccccctaagattcaaacaacacagagccaacagactgcaacaccagcaataacacctgccaccactgctattgcattcataagccctaccgtacttgggagtcggccat

SEQ ID NO: 366710 - DNA, 140 bp, Artificial Sequence
  Synthetic
atggccgactcccaagtacggtagggcttatgaatgcaatagcagtggtggcaggtgttattgctggtgttgcagtctgttggctctgtgttgtttgaatcttaggggggatctccagggggagacccagcatggcgtat

SEQ ID NO: 366711 - DNA, 140 bp, Artificial Sequence
  Synthetic
atacgccatgctgggtctccaaggcctcaagaaatattatagcaagatactgaaactcctacacctgacgcaagaagaagattctgaaggtctacttgaatggtgtacgcgggtacttgacgtacttgggagtcggccat

SEQ ID NO: 366712 - DNA, 140 bp, Artificial Sequence
  Synthetic
atggccgactcccaagtacgtcaagtacccgcgtacaccattcaagtagaccttcagaatcttcttcttgcgtcaggtgtaggagtttcagtatcttgctataatatttcttgaggccttggagacccagcatggcgtat

SEQ ID NO: 366713 - DNA, 140 bp, Artificial Sequence
  Synthetic
atacgccatgctgggtctccacaggcatgtgatgatgactacttcaatgaaaggatagaagaatttttcataaccggaaaaggctacttcaatgatgttttgcagttcaggctgtatgaccgtacttgggagtcggccat

SEQ ID NO: 366714 - DNA, 140 bp, Artificial Sequence
  Synthetic
atggccgactcccaagtacggtcatacagcctgaactgcaaaacatcattgaagtagccttttccggttatgaaaaattcttctatcctttcattgaagtagtcatcatcacatgcctgtggagacccagcatggcgtat

SEQ ID NO: 366715 - DNA, 140 bp, Artificial Sequence
  Synthetic
atacgccatgctgggtctcctttcaggtcatactatgccaaagggtctctaacctttgactcaggctatttctctgctaaatgttatccaagggcatcgaactcaggattgcagctaattcgtacttgggagtcggccat

SEQ ID NO: 366716 - DNA, 140 bp, Artificial Sequence
  Synthetic
atggccgactcccaagtacgaattagctgcaatcctgagttcgatgcccttggataacatttagcagagaaatagcctgagtcaaaggttagagaccctttggcatagtatgacctgaaaggagacccagcatggcgtat

SEQ ID NO: 366717 - DNA, 140 bp, Artificial Sequence
  Synthetic
aggccctggctgctgatatgtctctgctaaatgttatccaagggcatcgaactcaggattgcagctaattaatgtcacacaacattcagtgaaaatagctaacacaccaggccccaaaatgaccttttgggacagcggtg

SEQ ID NO: 366718 - DNA, 140 bp, Artificial Sequence
  Synthetic
caccgctgtcccaaaaggtcattttggggcctggtgtgttagctattttcactgaatgttgtgtgacattaattagctgcaatcctgagttcgatgcccttggataacatttagcagagacatatcagcagccagggcct

SEQ ID NO: 366719 - DNA, 140 bp, Artificial Sequence
  Synthetic
atacgccatgctgggtctccaggatcatagcaagcttgagatcaacgtgcttctaccacaagttgctgttaatctttcaaactgccatgttttaattgaatcacatgtctgtgattactccgtacttgggagtcggccat

SEQ ID NO: 366720 - DNA, 140 bp, Artificial Sequence
  Synthetic
atggccgactcccaagtacggagtaatcacagacatgtgattcaattaaaacatggcagtttgaaagattaacagcaacttgtggtagaagcacgttgatctcaagcttgctatgatcctggagacccagcatggcgtat

SEQ ID NO: 366721 - DNA, 140 bp, Artificial Sequence
  Synthetic
aggccctggctgctgatatgaatctttcaaactgccatgttttaattgaatcacatgtctgtgattactctttgaacactgatgggacaataaagctcccgaaaattgcacataatgggggaccttttgggacagcggtg

SEQ ID NO: 366722 - DNA, 140 bp, Artificial Sequence
  Synthetic
caccgctgtcccaaaaggtcccccattatgtgcaattttcgggagctttattgtcccatcagtgttcaaagagtaatcacagacatgtgattcaattaaaacatggcagtttgaaagattcatatcagcagccagggcct

SEQ ID NO: 366723 - DNA, 140 bp, Artificial Sequence
  Synthetic
atacgccatgctgggtctccaatgataggtgtgcactattcaccaactgcgttatcaaaggaagagaggtccgaagagggcagtcagctctgaggcagtacagaacagaaataagaatcgcgtacttgggagtcggccat

SEQ ID NO: 366724 - DNA, 140 bp, Artificial Sequence
  Synthetic
atggccgactcccaagtacgcgattcttatttctgttctgtactgcctcagagctgactgccctcttcggacctctcttcctttgataacgcagttggtgaatagtgcacacctatcattggagacccagcatggcgtat

SEQ ID NO: 366725 - DNA, 140 bp, Artificial Sequence
  Synthetic
aggccctggctgctgatatgccgaagagggcagtcagctctgaggcagtacagaacagaaataagaatcgggcaaacatttacaggctcgagaagattgcttgcagagggggggagcaatgaccttttgggacagcggtg

SEQ ID NO: 366726 - DNA, 140 bp, Artificial Sequence
  Synthetic
caccgctgtcccaaaaggtcattgctccccccctctgcaagcaatcttctcgagcctgtaaatgtttgcccgattcttatttctgttctgtactgcctcagagctgactgccctcttcggcatatcagcagccagggcct

SEQ ID NO: 366727 - DNA, 140 bp, Artificial Sequence
  Synthetic
atacgccatgctgggtctcctgaagacagttacggtggtcctggcgaaaaaatcacaatttgcaacggctccacaatagtggatcaaaggcttggcagcgaattaggttgctatacaatacgtacttgggagtcggccat

SEQ ID NO: 366728 - DNA, 140 bp, Artificial Sequence
  Synthetic
atggccgactcccaagtacgtattgtatagcaacctaattcgctgccaagcctttgatccactattgtggagccgttgcaaattgtgattttttcgccaggaccaccgtaactgtcttcaggagacccagcatggcgtat

SEQ ID NO: 366729 - DNA, 140 bp, Artificial Sequence
  Synthetic
aggccctggctgctgatatgccacaatagtggatcaaaggcttggcagcgaattaggttgctatacaataaacagagtgagaacctataagctctgtgagaacagtgccacagaaaagaggaccttttgggacagcggtg

SEQ ID NO: 366730 - DNA, 140 bp, Artificial Sequence
  Synthetic
caccgctgtcccaaaaggtcctcttttctgtggcactgttctcacagagcttataggttctcactctgtttattgtatagcaacctaattcgctgccaagcctttgatccactattgtggcatatcagcagccagggcct

SEQ ID NO: 366731 - DNA, 140 bp, Artificial Sequence
  Synthetic
atacgccatgctgggtctccaaataactcaggaaggtaggggtcatgtgaaattgtctagagggacagaaatcgttctggatgtctgtgatactagctgtgaactgatgatacccaaaggcgtacttgggagtcggccat

SEQ ID NO: 366732 - DNA, 140 bp, Artificial Sequence
  Synthetic
atggccgactcccaagtacgcctttgggtatcatcagttcacagctagtatcacagacatccagaacgatttctgtccctctagacaatttcacatgacccctaccttcctgagttatttggagacccagcatggcgtat

SEQ ID NO: 366733 - DNA, 140 bp, Artificial Sequence
  Synthetic
aggccctggctgctgatatgatcgttctggatgtctgtgatactagctgtgaactgatgatacccaaaggcactggggatatattggtggactgctcaggagggcagcaacactttttacgaccttttgggacagcggtg

SEQ ID NO: 366734 - DNA, 140 bp, Artificial Sequence
  Synthetic
caccgctgtcccaaaaggtcgtaaaaagtgttgctgccctcctgagcagtccaccaatatatccccagtgcctttgggtatcatcagttcacagctagtatcacagacatccagaacgatcatatcagcagccagggcct

SEQ ID NO: 366735 - DNA, 140 bp, Artificial Sequence
  Synthetic
atacgccatgctgggtctccacggctatatatgtctgtagaatgtcaaaccatcccaagacaaccatggcttttctgttttggttcagttttggctatgtcatcacatgtgtagtgtgcacgtacttgggagtcggccat

SEQ ID NO: 366736 - DNA, 140 bp, Artificial Sequence
  Synthetic
atggccgactcccaagtacgtgcacactacacatgtgatgacatagccaaaactgaaccaaaacagaaaagccatggttgtcttgggatggtttgacattctacagacatatatagccgtggagacccagcatggcgtat

SEQ ID NO: 366737 - DNA, 140 bp, Artificial Sequence
  Synthetic
aggccctggctgctgatatgttttctgttttggttcagttttggctatgtcatcacatgtgtagtgtgcaaggtgctcttctatttgctaattgtcatcgggacactaggaaaaaggctggaccttttgggacagcggtg

SEQ ID NO: 366738 - DNA, 140 bp, Artificial Sequence
  Synthetic
caccgctgtcccaaaaggtccagcctttttcctagtgtcccgatgacaattagcaaatagaagagcaccttgcacactacacatgtgatgacatagccaaaactgaaccaaaacagaaaacatatcagcagccagggcct

SEQ ID NO: 366739 - DNA, 140 bp, Artificial Sequence
  Synthetic
atacgccatgctgggtctccccctgtcaatgcaatagatgctgaaatgcatgatcttaactgcaactacaacatatgcccttactgtgcatccagactgacctcagatggcctcgtcaggcgtacttgggagtcggccat

SEQ ID NO: 366740 - DNA, 140 bp, Artificial Sequence
  Synthetic
atggccgactcccaagtacgcctgacgaggccatctgaggtcagtctggatgcacagtaagggcatatgttgtagttgcagttaagatcatgcatttcagcatctattgcattgacagggggagacccagcatggcgtat

SEQ ID NO: 366741 - DNA, 140 bp, Artificial Sequence
  Synthetic
aggccctggctgctgatatgacatatgcccttactgtgcatccagactgacctcagatggcctcgtcaggcacgtaactcaatgtcccaaacggaaagagaaggtcgaagaaactgaactgaccttttgggacagcggtg

SEQ ID NO: 366742 - DNA, 140 bp, Artificial Sequence
  Synthetic
caccgctgtcccaaaaggtcagttcagtttcttcgaccttctctttccgtttgggacattgagttacgtgcctgacgaggccatctgaggtcagtctggatgcacagtaagggcatatgtcatatcagcagccagggcct

SEQ ID NO: 366743 - DNA, 140 bp, Artificial Sequence
  Synthetic
aggccctggctgctgatatgggtaatgtcctctcctatgcacacaacctctatctgagtaaatctagtttaaacatgacttctgaggatgtctcacagctcttaatagagatcaagaggcgaccttttgggacagcggtg

SEQ ID NO: 366744 - DNA, 140 bp, Artificial Sequence
  Synthetic
caccgctgtcccaaaaggtcgcctcttgatctctattaagagctgtgagacatcctcagaagtcatgtttaaactagatttactcagatagaggttgtgtgcataggagaggacattacccatatcagcagccagggcct

SEQ ID NO: 366745 - DNA, 140 bp, Artificial Sequence
  Synthetic
atacgccatgctgggtctccctccttattctgctgactgtttcaatgtcaccagttcagtccgcaccggtaggccacaaaagggcagttgaagtctatcaaataagagaaagctatacagcgtacttgggagtcggccat

SEQ ID NO: 366746 - DNA, 140 bp, Artificial Sequence
  Synthetic
atggccgactcccaagtacgctgtatagctttctcttatttgatagacttcaactgcccttttgtggcctaccggtgcggactgaactggtgacattgaaacagtcagcagaataaggagggagacccagcatggcgtat

SEQ ID NO: 366747 - DNA, 140 bp, Artificial Sequence
  Synthetic
aggccctggctgctgatatgtgcctccgttaatctattttgccatcctgccatccttctttctctaatattcataccagtttcattatttgaagggtgtggggggaacgatttctttgaggaccttttgggacagcggtg

SEQ ID NO: 366748 - DNA, 140 bp, Artificial Sequence
  Synthetic
caccgctgtcccaaaaggtcctcaaagaaatcgttccccccacacccttcaaataatgaaactggtatgaatattagagaaagaaggatggcaggatggcaaaatagattaacggaggcacatatcagcagccagggcct

SEQ ID NO: 366749 - DNA, 140 bp, Artificial Sequence
  Synthetic
atacgccatgctgggtctccgtatttgcctcttcgtgttaggaggtgttctcttcgcagtctcttggctggtgaaggccctgattgatagcatcggcaatagtttcttccctgggctttccgtacttgggagtcggccat

SEQ ID NO: 366750 - DNA, 140 bp, Artificial Sequence
  Synthetic
atggccgactcccaagtacggaaagcccagggaagaaactattgccgatgctatcaatcagggccttcaccagccaagagactgcgaagagaacacctcctaacacgaagaggcaaatacggagacccagcatggcgtat

SEQ ID NO: 366751 - DNA, 140 bp, Artificial Sequence
  Synthetic
atacgccatgctgggtctcccacacaaatgctactgcagtctactctgctgtccttactgtagggcctgctcatcggacaaaatcactcaccgaatgcatttgaatgtgtgcaaaaagagcgtacttgggagtcggccat

SEQ ID NO: 366752 - DNA, 140 bp, Artificial Sequence
  Synthetic
atggccgactcccaagtacgctctttttgcacacattcaaatgcattcggtgagtgattttgtccgatgagcaggccctacagtaaggacagcagagtagactgcagtagcatttgtgtgggagacccagcatggcgtat

SEQ ID NO: 366753 - DNA, 140 bp, Artificial Sequence
  Synthetic
aggccctggctgctgatatgtcatcggacaaaatcactcaccgaatgcatttgaatgtgtgcaaaaagagaaaggtgggtagtaatgttatgctagccgtttgcaaacgcatgtgttttagaccttttgggacagcggtg

SEQ ID NO: 366754 - DNA, 140 bp, Artificial Sequence
  Synthetic
caccgctgtcccaaaaggtctaaaacacatgcgtttgcaaacggctagcataacattactacccacctttctctttttgcacacattcaaatgcattcggtgagtgattttgtccgatgacatatcagcagccagggcct

SEQ ID NO: 366755 - DNA, 140 bp, Artificial Sequence
  Synthetic
atacgccatgctgggtctccaactccacttttgtcatatgcatactaatcctggtgatctgtgtagttagtacctctgctgtcgacatggaaaatttaccggcaggcatctgggaaaaagcgtacttgggagtcggccat

SEQ ID NO: 366756 - DNA, 140 bp, Artificial Sequence
  Synthetic
atggccgactcccaagtacgctttttcccagatgcctgccggtaaattttccatgtcgacagcagaggtactaactacacagatcaccaggattagtatgcatatgacaaaagtggagttggagacccagcatggcgtat

SEQ ID NO: 366757 - DNA, 140 bp, Artificial Sequence
  Synthetic
aggccctggctgctgatatgtacctctgctgtcgacatggaaaatttaccggcaggcatctgggaaaaagaggaagacctaacaaacttctgtcatcaggagtgtcaagtaacagaaactgaccttttgggacagcggtg

SEQ ID NO: 366758 - DNA, 140 bp, Artificial Sequence
  Synthetic
caccgctgtcccaaaaggtcagtttctgttacttgacactcctgatgacagaagtttgttaggtcttcctctttttcccagatgcctgccggtaaattttccatgtcgacagcagaggtacatatcagcagccagggcct

SEQ ID NO: 366759 - DNA, 140 bp, Artificial Sequence
  Synthetic
atacgccatgctgggtctccagatagtatagccaagggaatgaaaagcttgttgaactccacaagtttagaaacgagcttgtcaattgaagctccatggggggcaatcaatgttcaatcacgtacttgggagtcggccat

SEQ ID NO: 366760 - DNA, 140 bp, Artificial Sequence
  Synthetic
atggccgactcccaagtacgtgattgaacattgattgccccccatggagcttcaattgacaagctcgtttctaaacttgtggagttcaacaagcttttcattcccttggctatactatctggagacccagcatggcgtat

SEQ ID NO: 366761 - DNA, 140 bp, Artificial Sequence
  Synthetic
aggccctggctgctgatatgattcaacttgggccctgtgactattaccctatccgagccaagaaacattcagcagaagcttccccctgagattatcacgttgcaccccaaaattgaagaagaccttttgggacagcggtg

SEQ ID NO: 366762 - DNA, 140 bp, Artificial Sequence
  Synthetic
caccgctgtcccaaaaggtcttcttcaattttggggtgcaacgtgataatctcagggggaagcttctgctgaatgtttcttggctcggatagggtaatagtcacagggcccaagttgaatcatatcagcagccagggcct

SEQ ID NO: 366763 - DNA, 140 bp, Artificial Sequence
  Synthetic
atacgccatgctgggtctccagttgaacacaagggcaacaagatcttagtttcaggcagatcagagtcaattatgaaattagaagaaagaactggaatcagctggtgtctaggtgtggaacgtacttgggagtcggccat

SEQ ID NO: 366764 - DNA, 140 bp, Artificial Sequence
  Synthetic
atggccgactcccaagtacgttccacacctagacaccagctgattccagttctttcttctaatttcataattgactctgatctgcctgaaactaagatcttgttgcccttgtgttcaactggagacccagcatggcgtat

SEQ ID NO: 366765 - DNA, 140 bp, Artificial Sequence
  Synthetic
atacgccatgctgggtctccaatgtattctcctgttttcgagtacctgtcaggtgaccgacaggtggaggagtggccaaaagcaacctgcacaggtgactgtccagaaagatgtggctgccgtacttgggagtcggccat

SEQ ID NO: 366766 - DNA, 140 bp, Artificial Sequence
  Synthetic
atggccgactcccaagtacggcagccacatctttctggacagtcacctgtgcaggttgcttttggccactcctccacctgtcggtcacctgacaggtactcgaaaacaggagaatacattggagacccagcatggcgtat

SEQ ID NO: 366767 - DNA, 140 bp, Artificial Sequence
  Synthetic
aggccctggctgctgatatgagtggccaaaagcaacctgcacaggtgactgtccagaaagatgtggctgcacttcatcaacctgcctacataaggagtggccgcactcgaggaactggcggaccttttgggacagcggtg

SEQ ID NO: 366768 - DNA, 140 bp, Artificial Sequence
  Synthetic
caccgctgtcccaaaaggtccgccagttcctcgagtgcggccactccttatgtaggcaggttgatgaagtgcagccacatctttctggacagtcacctgtgcaggttgcttttggccactcatatcagcagccagggcct

SEQ ID NO: 366769 - DNA, 140 bp, Artificial Sequence
  Synthetic
atacgccatgctgggtctccatgcctattagcatcatgcacatatcattgatgtgtgcagttctttgcctgcagctgtatggtctggggggaacccatgggtcacacaatggaactgaaccgtacttgggagtcggccat

SEQ ID NO: 366770 - DNA, 140 bp, Artificial Sequence
  Synthetic
atggccgactcccaagtacggttcagttccattgtgtgacccatgggttccccccagaccatacagctgcaggcaaagaactgcacacatcaatgatatgtgcatgatgctaataggcatggagacccagcatggcgtat

SEQ ID NO: 366771 - DNA, 140 bp, Artificial Sequence
  Synthetic
atacgccatgctgggtctccggctagatgtaaaggatctcttcacagactacatgttggttaaatggaaagtggaatatataaaaacagaagccataatatgtgttgagcttactagtcacgtacttgggagtcggccat

SEQ ID NO: 366772 - DNA, 140 bp, Artificial Sequence
  Synthetic
atggccgactcccaagtacgtgactagtaagctcaacacatattatggcttctgtttttatatattccactttccatttaaccaacatgtagtctgtgaagagatcctttacatctagccggagacccagcatggcgtat

SEQ ID NO: 366773 - DNA, 140 bp, Artificial Sequence
  Synthetic
aggccctggctgctgatatggtggaatatataaaaacagaagccataatatgtgttgagcttactagtcaagagaggcagtgtagtttaattgaagcaggcacaaggtttaacctaggccgaccttttgggacagcggtg

SEQ ID NO: 366774 - DNA, 140 bp, Artificial Sequence
  Synthetic
caccgctgtcccaaaaggtcggcctaggttaaaccttgtgcctgcttcaattaaactacactgcctctcttgactagtaagctcaacacatattatggcttctgtttttatatattccaccatatcagcagccagggcct

SEQ ID NO: 366775 - DNA, 140 bp, Artificial Sequence
  Synthetic
atacgccatgctgggtctcccccgagatcattacactgcaccctaaaatagaagaagggttttttgatttgatgcatgtgcagaaggtaatgtctgcaagcacggtttgtaagctgcaaacgtacttgggagtcggccat

SEQ ID NO: 366776 - DNA, 140 bp, Artificial Sequence
  Synthetic
atggccgactcccaagtacgtttgcagcttacaaaccgtgcttgcagacattaccttctgcacatgcatcaaatcaaaaaacccttcttctattttagggtgcagtgtaatgatctcgggggagacccagcatggcgtat

SEQ ID NO: 366777 - DNA, 140 bp, Artificial Sequence
  Synthetic
aggccctggctgctgatatggatgcatgtgcagaaggtaatgtctgcaagcacggtttgtaagctgcaaagctgtactcacggtgtgcctggagacttacaagtctaccatgttggcaacgaccttttgggacagcggtg

SEQ ID NO: 366778 - DNA, 140 bp, Artificial Sequence
  Synthetic
caccgctgtcccaaaaggtcgttgccaacatggtagacttgtaagtctccaggcacaccgtgagtacagctttgcagcttacaaaccgtgcttgcagacattaccttctgcacatgcatccatatcagcagccagggcct

SEQ ID NO: 366779 - DNA, 140 bp, Artificial Sequence
  Synthetic
atacgccatgctgggtctccgcacctcaacacctcatggatgtcatgggatgggtgtgatttagattatttttgcaacatgggggactggccctcatgcacatacacaggggtgacacaacgtacttgggagtcggccat

SEQ ID NO: 366780 - DNA, 140 bp, Artificial Sequence
  Synthetic
atggccgactcccaagtacgttgtgtcacccctgtgtatgtgcatgagggccagtcccccatgttgcaaaaataatctaaatcacacccatcccatgacatccatgaggtgttgaggtgcggagacccagcatggcgtat

SEQ ID NO: 366781 - DNA, 140 bp, Artificial Sequence
  Synthetic
aggccctggctgctgatatgaccgtcaggatctggcaaagagagtccagcagccaacagccctcacccagtcgccagcagaccaccaaccccctccacaacagcccaaggacctactgaagaccttttgggacagcggtg

SEQ ID NO: 366782 - DNA, 140 bp, Artificial Sequence
  Synthetic
caccgctgtcccaaaaggtcttcagtaggtccttgggctgttgtggagggggttggtggtctgctggcgactgggtgagggctgttggctgctggactctctttgccagatcctgacggtcatatcagcagccagggcct

SEQ ID NO: 366783 - DNA, 140 bp, Artificial Sequence
  Synthetic
atacgccatgctgggtctcccacaaccgtgctgcattcatcaacatgcttaacattgagactgattacacaaaaacttttcactttcattcaaaaagggtcacagcacacggagacaccccgtacttgggagtcggccat

SEQ ID NO: 366784 - DNA, 140 bp, Artificial Sequence
  Synthetic
atggccgactcccaagtacggggtgtctccgtgtgctgtgaccctttttgaatgaaagtgaaaagtttttgtgtaatcagtctcaatgttaagcatgttgatgaatgcagcacggttgtgggagacccagcatggcgtat

SEQ ID NO: 366785 - DNA, 140 bp, Artificial Sequence
  Synthetic
aggccctggctgctgatatgaaaaacttttcactttcattcaaaaagggtcacagcacacggagacacccctcagttggacctaaaagcgaggccaacatatggtgcaggcgaaatcactgaccttttgggacagcggtg

SEQ ID NO: 366786 - DNA, 140 bp, Artificial Sequence
  Synthetic
caccgctgtcccaaaaggtcagtgatttcgcctgcaccatatgttggcctcgcttttaggtccaactgaggggtgtctccgtgtgctgtgaccctttttgaatgaaagtgaaaagtttttcatatcagcagccagggcct

SEQ ID NO: 366787 - DNA, 140 bp, Artificial Sequence
  Synthetic
atacgccatgctgggtctccagccctaggcccaatgacctctctaacacagacagacctcccacagagtgtcacctccatagctgttcaagactcacaccctagcccaacgaacaggtcccgtacttgggagtcggccat

SEQ ID NO: 366788 - DNA, 140 bp, Artificial Sequence
  Synthetic
atggccgactcccaagtacgggacctgttcgttgggctagggtgtgagtcttgaacagctatggaggtgacactctgtgggaggtctgtctgtgttagagaggtcattgggcctagggctggagacccagcatggcgtat

SEQ ID NO: 366789 - DNA, 140 bp, Artificial Sequence
  Synthetic
aggccctggctgctgatatgtcacctccatagctgttcaagactcacaccctagcccaacgaacaggtccaaaagaaaccttgaaatggaaataatcttaactttacctcagggtttaaagaccttttgggacagcggtg

SEQ ID NO: 366790 - DNA, 140 bp, Artificial Sequence
  Synthetic
caccgctgtcccaaaaggtctttaaaccctgaggtaaagttaagattatttccatttcaaggtttcttttggacctgttcgttgggctagggtgtgagtcttgaacagctatggaggtgacatatcagcagccagggcct

SEQ ID NO: 366791 - DNA, 140 bp, Artificial Sequence
  Synthetic
atacgccatgctgggtctccgtcgggtctgaaattcgcaagtttgacatgctctggatgttatgcttgcagctctggcatctcctgcaaagttaggattcatgtaaatgaaccggatgaacgtacttgggagtcggccat

SEQ ID NO: 366792 - DNA, 140 bp, Artificial Sequence
  Synthetic
atggccgactcccaagtacgttcatccggttcatttacatgaatcctaactttgcaggagatgccagagctgcaagcataacatccagagcatgtcaaacttgcgaatttcagacccgacggagacccagcatggcgtat

SEQ ID NO: 366793 - DNA, 140 bp, Artificial Sequence
  Synthetic
aggccctggctgctgatatggctctggcatctcctgcaaagttaggattcatgtaaatgaaccggatgaattcacagtacatgtaaaaagcaatgacccagatgttgtagcagcaggatcgaccttttgggacagcggtg

SEQ ID NO: 366794 - DNA, 140 bp, Artificial Sequence
  Synthetic
caccgctgtcccaaaaggtcgatcctgctgctacaacatctgggtcattgctttttacatgtactgtgaattcatccggttcatttacatgaatcctaactttgcaggagatgccagagccatatcagcagccagggcct

SEQ ID NO: 366795 - DNA, 140 bp, Artificial Sequence
  Synthetic
atacgccatgctgggtctccacactgaaggcctgctagaatggtgtaggagaaatcttggtcttgattgtgatgacactttctttcgaaagagaattgaagaattcttcataactggtgacgtacttgggagtcggccat

SEQ ID NO: 366796 - DNA, 140 bp, Artificial Sequence
  Synthetic
atggccgactcccaagtacgtcaccagttatgaagaattcttcaattctctttcgaaagaaagtgtcatcacaatcaagaccaagatttctcctacaccattctagcaggccttcagtgtggagacccagcatggcgtat

SEQ ID NO: 366797 - DNA, 140 bp, Artificial Sequence
  Synthetic
aggccctggctgctgatatggatgacactttctttcgaaagagaattgaagaattcttcataactggtgagggtcatttcaatgaagttttacaatttagaacaccaggcacattgagcagaccttttgggacagcggtg

SEQ ID NO: 366798 - DNA, 140 bp, Artificial Sequence
  Synthetic
caccgctgtcccaaaaggtctgctcaatgtgcctggtgttctaaattgtaaaacttcattgaaatgaccctcaccagttatgaagaattcttcaattctctttcgaaagaaagtgtcatccatatcagcagccagggcct

SEQ ID NO: 366799 - DNA, 140 bp, Artificial Sequence
  Synthetic
atacgccatgctgggtctccctttttcatcaatgccaaaaaactctctatgtttttacatagtagaaagagattattgtagcagctgtacagatgatgacactcaaaaatgcgttgacatcgtacttgggagtcggccat

SEQ ID NO: 366800 - DNA, 140 bp, Artificial Sequence
  Synthetic
atggccgactcccaagtacgatgtcaacgcatttttgagtgtcatcatctgtacagctgctacaataatctctttctactatgtaaaaacatagagagttttttggcattgatgaaaaagggagacccagcatggcgtat

SEQ ID NO: 366801 - DNA, 140 bp, Artificial Sequence
  Synthetic
atacgccatgctgggtctcctatttcgctaaaggcttcctttcaatagattcaggttacttctcagccaaatgttactcaagaacatctaattcagggcttcagctgatcaatgtcactccgtacttgggagtcggccat

SEQ ID NO: 366802 - DNA, 140 bp, Artificial Sequence
  Synthetic
atggccgactcccaagtacggagtgacattgatcagctgaagccctgaattagatgttcttgagtaacatttggctgagaagtaacctgaatctattgaaaggaagcctttagcgaaataggagacccagcatggcgtat

SEQ ID NO: 366803 - DNA, 140 bp, Artificial Sequence
  Synthetic
aggccctggctgctgatatgatgttactcaagaacatctaattcagggcttcagctgatcaatgtcactcgacattcaactagaatagccgacacacccgggcctaagatcaccaacctagaccttttgggacagcggtg

SEQ ID NO: 366804 - DNA, 140 bp, Artificial Sequence
  Synthetic
caccgctgtcccaaaaggtctaggttggtgatcttaggcccgggtgtgtcggctattctagttgaatgtcgagtgacattgatcagctgaagccctgaattagatgttcttgagtaacatcatatcagcagccagggcct

SEQ ID NO: 366805 - DNA, 140 bp, Artificial Sequence
  Synthetic
atacgccatgctgggtctcccggtaatattttcttaggcatgctcctgtttcttgctccttttgtattgctaatattgtttttcttcttcgggtggagacttctcttttgccttaagtgccgtacttgggagtcggccat

SEQ ID NO: 366806 - DNA, 140 bp, Artificial Sequence
  Synthetic
atggccgactcccaagtacggcacttaaggcaaaagagaagtctccacccgaagaagaaaaacaatattagcaatacaaaaggagcaagaaacaggagcatgcctaagaaaatattaccgggagacccagcatggcgtat

SEQ ID NO: 366807 - DNA, 140 bp, Artificial Sequence
  Synthetic
atacgccatgctgggtctccagaggttgaaatcaatgtgcttctccctcaagttgcagttaacctctcaaactgtcacgttacaatcaaatcacatgtctgtgactattctttagacattcgtacttgggagtcggccat

SEQ ID NO: 366808 - DNA, 140 bp, Artificial Sequence
  Synthetic
atggccgactcccaagtacgaatgtctaaagaatagtcacagacatgtgatttgattgtaacgtgacagtttgagaggttaactgcaacttgagggagaagcacattgatttcaacctctggagacccagcatggcgtat

SEQ ID NO: 366809 - DNA, 140 bp, Artificial Sequence
  Synthetic
aggccctggctgctgatatgactgtcacgttacaatcaaatcacatgtctgtgactattctttagacattgacggaacagtgaggcttcctcacattcatcatgacggaacctttatcccgaccttttgggacagcggtg

SEQ ID NO: 366810 - DNA, 140 bp, Artificial Sequence
  Synthetic
caccgctgtcccaaaaggtcgggataaaggttccgtcatgatgaatgtgaggaagcctcactgttccgtcaatgtctaaagaatagtcacagacatgtgatttgattgtaacgtgacagtcatatcagcagccagggcct

SEQ ID NO: 366811 - DNA, 140 bp, Artificial Sequence
  Synthetic
atacgccatgctgggtctccagagagtggttacaaaaaaatcattgaaaggctaaatgacaagaagggcaaaagtcgattgtttgatggagaaaggcttgcagacagaaagattgccgaacgtacttgggagtcggccat

SEQ ID NO: 366812 - DNA, 140 bp, Artificial Sequence
  Synthetic
atggccgactcccaagtacgttcggcaatctttctgtctgcaagcctttctccatcaaacaatcgacttttgcccttcttgtcatttagcctttcaatgatttttttgtaaccactctctggagacccagcatggcgtat

SEQ ID NO: 366813 - DNA, 140 bp, Artificial Sequence
  Synthetic
aggccctggctgctgatatgaaagtcgattgtttgatggagaaaggcttgcagacagaaagattgccgaactcttttcaactaaaactcatgtaggttgacgaatcggacaggctgttttgaccttttgggacagcggtg

SEQ ID NO: 366814 - DNA, 140 bp, Artificial Sequence
  Synthetic
caccgctgtcccaaaaggtcaaaacagcctgtccgattcgtcaacctacatgagttttagttgaaaagagttcggcaatctttctgtctgcaagcctttctccatcaaacaatcgactttcatatcagcagccagggcct

SEQ ID NO: 366815 - DNA, 140 bp, Artificial Sequence
  Synthetic
atacgccatgctgggtctccgtaccttattcaccaactgtgtgataaaaggaagagaggttcgtaaaggccaatcagttttgaggcagtataagacagagattaggattggcaaggcatccgtacttgggagtcggccat

SEQ ID NO: 366816 - DNA, 140 bp, Artificial Sequence
  Synthetic
atggccgactcccaagtacggatgccttgccaatcctaatctctgtcttatactgcctcaaaactgattggcctttacgaacctctcttccttttatcacacagttggtgaataaggtacggagacccagcatggcgtat

SEQ ID NO: 366817 - DNA, 140 bp, Artificial Sequence
  Synthetic
aggccctggctgctgatatgcaatcagttttgaggcagtataagacagagattaggattggcaaggcatcaactggttctaggagattgctttctgatgagtctggtgatgactgcatatgaccttttgggacagcggtg

SEQ ID NO: 366818 - DNA, 140 bp, Artificial Sequence
  Synthetic
caccgctgtcccaaaaggtcatatgcagtcatcaccagactcatcagaaagcaatctcctagaaccagttgatgccttgccaatcctaatctctgtcttatactgcctcaaaactgattgcatatcagcagccagggcct

SEQ ID NO: 366819 - DNA, 140 bp, Artificial Sequence
  Synthetic
atacgccatgctgggtctccatgctccaactattgcaccttcaactaccttttatcgctttaaacttgtaacaatcaaccatgctgctcatcaccatcctggcttaacttctcttagacccgtacttgggagtcggccat

SEQ ID NO: 366820 - DNA, 140 bp, Artificial Sequence
  Synthetic
atggccgactcccaagtacgggtctaagagaagttaagccaggatggtgatgagcagcatggttgattgttacaagtttaaagcgataaaaggtagttgaaggtgcaatagttggagcatggagacccagcatggcgtat

SEQ ID NO: 366821 - DNA, 140 bp, Artificial Sequence
  Synthetic
aggccctggctgctgatatggctttaaacttgtaacaatcaaccatgctgctcatcaccatcctggcttaacttctcttagacctaaccttgactgcgtgccgccactatatctttgagagaccttttgggacagcggtg

SEQ ID NO: 366822 - DNA, 140 bp, Artificial Sequence
  Synthetic
caccgctgtcccaaaaggtctctcaaagatatagtggcggcacgcagtcaaggttaggtctaagagaagttaagccaggatggtgatgagcagcatggttgattgttacaagtttaaagccatatcagcagccagggcct

SEQ ID NO: 366823 - DNA, 140 bp, Artificial Sequence
  Synthetic
atacgccatgctgggtctcctatggtggtccgggtgacaagattaccatttgcaatggttcaactattgtagaccaaagactgggcagtgaactggggtgttacactatcaatagagtgacgtacttgggagtcggccat

SEQ ID NO: 366824 - DNA, 140 bp, Artificial Sequence
  Synthetic
atggccgactcccaagtacgtcactctattgatagtgtaacaccccagttcactgcccagtctttggtctacaatagttgaaccattgcaaatggtaatcttgtcacccggaccaccataggagacccagcatggcgtat

SEQ ID NO: 366825 - DNA, 140 bp, Artificial Sequence
  Synthetic
aggccctggctgctgatatgagaccaaagactgggcagtgaactggggtgttacactatcaatagagtgaagtcattcaagctgtgcgaaaacagtgccacagggaagagctgtgaagtagaccttttgggacagcggtg

SEQ ID NO: 366826 - DNA, 140 bp, Artificial Sequence
  Synthetic
caccgctgtcccaaaaggtctacttcacagctcttccctgtggcactgttttcgcacagcttgaatgacttcactctattgatagtgtaacaccccagttcactgcccagtctttggtctcatatcagcagccagggcct

SEQ ID NO: 366827 - DNA, 140 bp, Artificial Sequence
  Synthetic
atacgccatgctgggtctccggaaggaaggggccatgtgaaattatccaggggctcagaggttgtcttggatgcatgcgactcaagctgtgaagtaatgatacctaagggcacaggtgaccgtacttgggagtcggccat

SEQ ID NO: 366828 - DNA, 140 bp, Artificial Sequence
  Synthetic
atggccgactcccaagtacggtcacctgtgcccttaggtatcattacttcacagcttgagtcgcatgcatccaagacaacctctgagcccctggataatttcacatggccccttccttccggagacccagcatggcgtat

SEQ ID NO: 366829 - DNA, 140 bp, Artificial Sequence
  Synthetic
aggccctggctgctgatatgatgcatgcgactcaagctgtgaagtaatgatacctaagggcacaggtgacatcctagtggactgttcaggtgggcagcaacatttcttgaacgacaacttgaccttttgggacagcggtg

SEQ ID NO: 366830 - DNA, 140 bp, Artificial Sequence
  Synthetic
caccgctgtcccaaaaggtcaagttgtcgttcaagaaatgttgctgcccacctgaacagtccactaggatgtcacctgtgcccttaggtatcattacttcacagcttgagtcgcatgcatcatatcagcagccagggcct

SEQ ID NO: 366831 - DNA, 140 bp, Artificial Sequence
  Synthetic
atacgccatgctgggtctccatatttgcagaatgtcgaatcaccccaaaacgaccatggctttcctcttttggttcagttttggctatgtgataacttgtatagtctgcaaggccatcttcgtacttgggagtcggccat

SEQ ID NO: 366832 - DNA, 140 bp, Artificial Sequence
  Synthetic
atggccgactcccaagtacgaagatggccttgcagactatacaagttatcacatagccaaaactgaaccaaaagaggaaagccatggtcgttttggggtgattcgacattctgcaaatatggagacccagcatggcgtat

SEQ ID NO: 366833 - DNA, 140 bp, Artificial Sequence
  Synthetic
aggccctggctgctgatatgtggttcagttttggctatgtgataacttgtatagtctgcaaggccatcttttacttcttaataattgttggaacactagggaagaggtttaagcagtatagaccttttgggacagcggtg

SEQ ID NO: 366834 - DNA, 140 bp, Artificial Sequence
  Synthetic
caccgctgtcccaaaaggtctatactgcttaaacctcttccctagtgttccaacaattattaagaagtaaaagatggccttgcagactatacaagttatcacatagccaaaactgaaccacatatcagcagccagggcct

SEQ ID NO: 366835 - DNA, 140 bp, Artificial Sequence
  Synthetic
atacgccatgctgggtctccccacagtttgaaacagacacaagagaggccttgagcttgatggacagggttatagctgtggatcagttaacatcatcttctagtgatgaactgcaagactcgtacttgggagtcggccat

SEQ ID NO: 366836 - DNA, 140 bp, Artificial Sequence
  Synthetic
atggccgactcccaagtacgagtcttgcagttcatcactagaagatgatgttaactgatccacagctataaccctgtccatcaagctcaaggcctctcttgtgtctgtttcaaactgtggggagacccagcatggcgtat

SEQ ID NO: 366837 - DNA, 140 bp, Artificial Sequence
  Synthetic
atacgccatgctgggtctcctcaagcttggatgaggtcacattgtccaagaagcaagcagagatactaaggcaaaaagcatctcagttgtctaaattggtcaataaaagtcagaacataccgtacttgggagtcggccat

SEQ ID NO: 366838 - DNA, 140 bp, Artificial Sequence
  Synthetic
atggccgactcccaagtacggtatgttctgacttttattgaccaatttagacaactgagatgctttttgccttagtatctctgcttgcttcttggacaatgtgacctcatccaagcttgaggagacccagcatggcgtat

SEQ ID NO: 366839 - DNA, 140 bp, Artificial Sequence
  Synthetic
  misc_feature (97)..(97): n is a, c, g, or t
aggccctggctgctgatatgctattgtgcatctagactaacctcagatgggcttgctaggcatgtaactcattgccctaagcggaaggagaaagtanaagaaactgaattgtacttgaacgaccttttgggacagcggtg

SEQ ID NO: 366840 - DNA, 140 bp, Artificial Sequence
  Synthetic
  misc_feature (44)..(44): n is a, c, g, or t
caccgctgtcccaaaaggtcgttcaagtacaattcagtttcttntactttctccttccgcttagggcaatgagttacatgcctagcaagcccatctgaggttagtctagatgcacaatagcatatcagcagccagggcct

SEQ ID NO: 366841 - DNA, 140 bp, Artificial Sequence
  Synthetic
aggccctggctgctgatatggtacaatcagcacctatcggccatggaaagacagttgaaacatatcaaaccagagaagggtacacaagcatttgcctttttgtactaggaagcatcttatgaccttttgggacagcggtg

SEQ ID NO: 366842 - DNA, 140 bp, Artificial Sequence
  Synthetic
caccgctgtcccaaaaggtcataagatgcttcctagtacaaaaaggcaaatgcttgtgtacccttctctggtttgatatgtttcaactgtctttccatggccgataggtgctgattgtaccatatcagcagccagggcct

SEQ ID NO: 366843 - DNA, 140 bp, Artificial Sequence
  Synthetic
atacgccatgctgggtctccaattggtgaaatcatgtcattgcggcagttggggcataaactgctgacacgagacaaacaaattaagcaagagttctccagaatgaaactctacgtcactcgtacttgggagtcggccat

SEQ ID NO: 366844 - DNA, 140 bp, Artificial Sequence
  Synthetic
atggccgactcccaagtacgagtgacgtagagtttcattctggagaactcttgcttaatttgtttgtctcgtgtcagcagtttatgccccaactgccgcaatgacatgatttcaccaattggagacccagcatggcgtat

SEQ ID NO: 366845 - DNA, 140 bp, Artificial Sequence
  Synthetic
aggccctggctgctgatatgtgtttgcagtttcattatcaccagttcaatcagcacccattggtcatgggaagacaattgaaacataccaggtcagggaggaatacacaagtatttgcctgaccttttgggacagcggtg

SEQ ID NO: 366846 - DNA, 140 bp, Artificial Sequence
  Synthetic
caccgctgtcccaaaaggtcaggcaaatacttgtgtattcctccctgacctggtatgtttcaattgtcttcccatgaccaatgggtgctgattgaactggtgataatgaaactgcaaacacatatcagcagccagggcct

SEQ ID NO: 366847 - DNA, 140 bp, Artificial Sequence
  Synthetic
atacgccatgctgggtctccccctggaacaggaatagaaaggcatatgcagctgctacactccgagatgatactggacatctgcactgtatcacttggtgtcatgctgtcaacattcttacgtacttgggagtcggccat

SEQ ID NO: 366848 - DNA, 140 bp, Artificial Sequence
  Synthetic
atggccgactcccaagtacgtaagaatgttgacagcatgacaccaagtgatacagtgcagatgtccagtatcatctcggagtgtagcagctgcatatgcctttctattcctgttccagggggagacccagcatggcgtat

SEQ ID NO: 366849 - DNA, 140 bp, Artificial Sequence
  Synthetic
atacgccatgctgggtctcctggttaacagtgttggcaacatcttcttccctgggctgtccatttgcaagacatgttctataggtagtattaatggctttgaaattgagtctcataagtgcgtacttgggagtcggccat

SEQ ID NO: 366850 - DNA, 140 bp, Artificial Sequence
  Synthetic
atggccgactcccaagtacgcacttatgagactcaatttcaaagccattaatactacctatagaacatgtcttgcaaatggacagcccagggaagaagatgttgccaacactgttaaccaggagacccagcatggcgtat

SEQ ID NO: 366851 - DNA, 140 bp, Artificial Sequence
  Synthetic
atacgccatgctgggtctccgggaaattcatcaattgcacttgagcatctgcaaaaaaagaaaaacaggaagtaatgtcatgcttgctgtttgcaagcgcatgtgtttcagagcaactatcgtacttgggagtcggccat

SEQ ID NO: 366852 - DNA, 140 bp, Artificial Sequence
  Synthetic
atggccgactcccaagtacgatagttgctctgaaacacatgcgcttgcaaacagcaagcatgacattacttcctgtttttctttttttgcagatgctcaagtgcaattgatgaatttcccggagacccagcatggcgtat

SEQ ID NO: 366853 - DNA, 140 bp, Artificial Sequence
  Synthetic
aggccctggctgctgatatggatgcatgtgcaaaaagtactattctgcaagtacagtttgcaagctacaagctgcacacacggcgtcccaggcgatttgcaggtctaccatgttggcaacgaccttttgggacagcggtg

SEQ ID NO: 366854 - DNA, 140 bp, Artificial Sequence
  Synthetic
caccgctgtcccaaaaggtcgttgccaacatggtagacctgcaaatcgcctgggacgccgtgtgtgcagcttgtagcttgcaaactgtacttgcagaatagtactttttgcacatgcatccatatcagcagccagggcct

SEQ ID NO: 366855 - DNA, 140 bp, Artificial Sequence
  Synthetic
atacgccatgctgggtctcctcagtgtgcaagactataacggtatgatagaaaacatgtctaaattagacaacactgatgttgaattcaaccacagggagatagctgatctcaatcaattcgtacttgggagtcggccat

SEQ ID NO: 366856 - DNA, 140 bp, Artificial Sequence
  Synthetic
atggccgactcccaagtacgaattgattgagatcagctatctccctgtggttgaattcaacatcagtgttgtctaatttagacatgttttctatcataccgttatagtcttgcacactgaggagacccagcatggcgtat

SEQ ID NO: 366857 - DNA, 140 bp, Artificial Sequence
  Synthetic
aggccctggctgctgatatggtagagatggaaagcctaccagctgggacctgggaaagagaagaagacctaacaaatttctgtcatcaggaatgccaggtcacggagactgagtgcctctgaccttttgggacagcggtg

SEQ ID NO: 366858 - DNA, 140 bp, Artificial Sequence
  Synthetic
caccgctgtcccaaaaggtcagaggcactcagtctccgtgacctggcattcctgatgacagaaatttgttaggtcttcttctctttcccaggtcccagctggtaggctttccatctctaccatatcagcagccagggcct

SEQ ID NO: 366859 - DNA, 140 bp, Artificial Sequence
  Synthetic
atacgccatgctgggtctccgcccttatgaagctctagtactcagaaggcccctgtttcaggacagtatagtcaaaggcatgaaaaacctgctaaactcaacaagtttagaaacaagcttcgtacttgggagtcggccat

SEQ ID NO: 366860 - DNA, 140 bp, Artificial Sequence
  Synthetic
atggccgactcccaagtacgaagcttgtttctaaacttgttgagtttagcaggtttttcatgcctttgactatactgtcctgaaacaggggccttctgagtactagagcttcataagggcggagacccagcatggcgtat

SEQ ID NO: 366861 - DNA, 140 bp, Artificial Sequence
  Synthetic
aggccctggctgctgatatgagtaatgtcatgcttgctgtttgcaagcgcatgtgtttcagagcaactatggaagtgagcaacaaggccctatttatccatagcatcatcaacaccacttgaccttttgggacagcggtg

SEQ ID NO: 366862 - DNA, 140 bp, Artificial Sequence
  Synthetic
caccgctgtcccaaaaggtcaagtggtgttgatgatgctatggataaatagggccttgttgctcacttccatagttgctctgaaacacatgcgcttgcaaacagcaagcatgacattactcatatcagcagccagggcct

SEQ ID NO: 366863 - DNA, 140 bp, Artificial Sequence
  Synthetic
atacgccatgctgggtctcccaactgtgtcagctgcaaacatagcacttagttggagttcagttgaacacagaggtaataagattttggtttcaggcagatcagaatcaattatgaagctcgtacttgggagtcggccat

SEQ ID NO: 366864 - DNA, 140 bp, Artificial Sequence
  Synthetic
atggccgactcccaagtacgagcttcataattgattctgatctgcctgaaaccaaaatcttattacctctgtgttcaactgaactccaactaagtgctatgtttgcagctgacacagttgggagacccagcatggcgtat

SEQ ID NO: 366865 - DNA, 140 bp, Artificial Sequence
  Synthetic
aggccctggctgctgatatgagaggtaataagattttggtttcaggcagatcagaatcaattatgaagctggaagaaaggacaggaatcagctgggatcttggcgtagaagatgcctctggaccttttgggacagcggtg

SEQ ID NO: 366866 - DNA, 140 bp, Artificial Sequence
  Synthetic
caccgctgtcccaaaaggtccagaggcatcttctacgccaagatcccagctgattcctgtcctttcttccagcttcataattgattctgatctgcctgaaaccaaaatcttattacctctcatatcagcagccagggcct

SEQ ID NO: 366867 - DNA, 140 bp, Artificial Sequence
  Synthetic
atacgccatgctgggtctcccctgtcttcgagtacttgtcaggtgacagacaagtagaagagtggcccaaggcaacctgtacaggtgactgcccagagagatgtggctgtacatcatcaacgtacttgggagtcggccat

SEQ ID NO: 366868 - DNA, 140 bp, Artificial Sequence
  Synthetic
atggccgactcccaagtacgttgatgatgtacagccacatctctctgggcagtcacctgtacaggttgccttgggccactcttctacttgtctgtcacctgacaagtactcgaagacaggggagacccagcatggcgtat

SEQ ID NO: 366869 - DNA, 140 bp, Artificial Sequence
  Synthetic
atacgccatgctgggtctcccgctaagtgaggtgcattcaatagagcgtataatggaaaacttcacccgcctcatgcatggaggaaaactttcggccaagataagggatggagattcggccgtacttgggagtcggccat

SEQ ID NO: 366870 - DNA, 140 bp, Artificial Sequence
  Synthetic
atggccgactcccaagtacggccgaatctccatcccttatcttggccgaaagttttcctccatgcatgaggcgggtgaagttttccattatacgctctattgaatgcacctcacttagcgggagacccagcatggcgtat

SEQ ID NO: 366871 - DNA, 140 bp, Artificial Sequence
  Synthetic
atacgccatgctgggtctccgaaagacctttttacagactatatgttcgtcaagtggaaagtcgaatacattaagacagaggccatagtgtgtgtagaacttaccagtcaggaaaggcagcgtacttgggagtcggccat

SEQ ID NO: 366872 - DNA, 140 bp, Artificial Sequence
  Synthetic
atggccgactcccaagtacgctgcctttcctgactggtaagttctacacacactatggcctctgtcttaatgtattcgactttccacttgacgaacatatagtctgtaaaaaggtctttcggagacccagcatggcgtat

SEQ ID NO: 366873 - DNA, 140 bp, Artificial Sequence
  Synthetic
aggccctggctgctgatatgttaagacagaggccatagtgtgtgtagaacttaccagtcaggaaaggcagtgtagcttaattgaggcgggtacaaggttcaatttaggtcctgtgactatgaccttttgggacagcggtg

SEQ ID NO: 366874 - DNA, 140 bp, Artificial Sequence
  Synthetic
caccgctgtcccaaaaggtcatagtcacaggacctaaattgaaccttgtacccgcctcaattaagctacactgcctttcctgactggtaagttctacacacactatggcctctgtcttaacatatcagcagccagggcct

SEQ ID NO: 366875 - DNA, 140 bp, Artificial Sequence
  Synthetic
atacgccatgctgggtctcctcacactgcatcctaggattgaagaaggtttttttgacctgatgcatgtacagaaggtgctatcagcaagcacagtgtgtaagttgcagagttgcacacacgtacttgggagtcggccat

SEQ ID NO: 366876 - DNA, 140 bp, Artificial Sequence
  Synthetic
atggccgactcccaagtacgtgtgtgcaactctgcaacttacacactgtgcttgctgatagcaccttctgtacatgcatcaggtcaaaaaaaccttcttcaatcctaggatgcagtgtgaggagacccagcatggcgtat

SEQ ID NO: 366877 - DNA, 140 bp, Artificial Sequence
  Synthetic
aggccctggctgctgatatggtgcattaagggcaacttgtaggcaacacgatgttctgccttaagctcgtgctgctaatcaatcttgccctttgtcagcttcttgaaggcaatgatagaggaccttttgggacagcggtg

SEQ ID NO: 366878 - DNA, 140 bp, Artificial Sequence
  Synthetic
caccgctgtcccaaaaggtcctctatcattgccttcaagaagctgacaaagggcaagattgattagcagcacgagcttaaggcagaacatcgtgttgcctacaagttgcccttaatgcaccatatcagcagccagggcct

SEQ ID NO: 366879 - DNA, 140 bp, Artificial Sequence
  Synthetic
atacgccatgctgggtctcctggtgtgccaggagatctacaggtctaccacatcggaaatttactaaaaggagataaagttaacggacacctgattcataaaattgagccacacttcaaccgtacttgggagtcggccat

SEQ ID NO: 366880 - DNA, 140 bp, Artificial Sequence
  Synthetic
atggccgactcccaagtacggttgaagtgtggctcaattttatgaatcaggtgtccgttaactttatctccttttagtaaatttccgatgtggtagacctgtagatctcctggcacaccaggagacccagcatggcgtat

SEQ ID NO: 366881 - DNA, 140 bp, Artificial Sequence
  Synthetic
atacgccatgctgggtctccgggagactggccttcttgcacatataccggggttacccagcacaatcatgcttcatttgtaaacctgctcaacattgaaactgactatacaaaaagcttccgtacttgggagtcggccat

SEQ ID NO: 366882 - DNA, 140 bp, Artificial Sequence
  Synthetic
atggccgactcccaagtacggaagctttttgtatagtcagtttcaatgttgagcaggtttacaaatgaagcatgattgtgctgggtaaccccggtatatgtgcaagaaggccagtctcccggagacccagcatggcgtat

SEQ ID NO: 366883 - DNA, 140 bp, Artificial Sequence
  Synthetic
aggccctggctgctgatatgcttcatttgtaaacctgctcaacattgaaactgactatacaaaaagcttccattttcactctaaaagggtaactgcacatggagacacaccacaattagagaccttttgggacagcggtg

SEQ ID NO: 366884 - DNA, 140 bp, Artificial Sequence
  Synthetic
caccgctgtcccaaaaggtctctaattgtggtgtgtctccatgtgcagttacccttttagagtgaaaatggaagctttttgtatagtcagtttcaatgttgagcaggtttacaaatgaagcatatcagcagccagggcct

SEQ ID NO: 366885 - DNA, 140 bp, Artificial Sequence
  Synthetic
atacgccatgctgggtctccaggttgctgatatggagttacacacaaagaagattgaaatatcaggcctaaagtttgcaagcttgacttgtacaggttgttatgcttgtagttccggtatcgtacttgggagtcggccat

SEQ ID NO: 366886 - DNA, 140 bp, Artificial Sequence
  Synthetic
atggccgactcccaagtacgataccggaactacaagcataacaacctgtacaagtcaagcttgcaaactttaggcctgatatttcaatcttctttgtgtgtaactccatatcagcaacctggagacccagcatggcgtat

SEQ ID NO: 366887 - DNA, 140 bp, Artificial Sequence
  Synthetic
aggccctggctgctgatatgaagtttgcaagcttgacttgtacaggttgttatgcttgtagttccggtatctcctgtaaagttaggattcatgtggatgaaccagatgagttcacagtacgaccttttgggacagcggtg

SEQ ID NO: 366888 - DNA, 140 bp, Artificial Sequence
  Synthetic
caccgctgtcccaaaaggtcgtactgtgaactcatctggttcatccacatgaatcctaactttacaggagataccggaactacaagcataacaacctgtacaagtcaagcttgcaaacttcatatcagcagccagggcct

SEQ ID NO: 366889 - DNA, 140 bp, Artificial Sequence
  Synthetic
aggccctggctgctgatatgtaagcgcatgtgctttagggcaactgtggaagtaagcaacaaggctctacttatccgaaacatcatcaataccacttttgttgtgtgcatactgatattagaccttttgggacagcggtg

SEQ ID NO: 366890 - DNA, 140 bp, Artificial Sequence
  Synthetic
caccgctgtcccaaaaggtctaatatcagtatgcacacaacaaaagtggtattgatgatgtttcggataagtagagccttgttgcttacttccacagttgccctaaagcacatgcgcttacatatcagcagccagggcct

SEQ ID NO: 366891 - DNA, 140 bp, Artificial Sequence
  Synthetic
atacgccatgctgggtctccgcaaggaagcttgaatttggaacagacagtacatttaaggctttctcagccatgcccaaaacctccttatgtttctatattgtcgaaagggaatactgcacgtacttgggagtcggccat

SEQ ID NO: 366892 - DNA, 140 bp, Artificial Sequence
  Synthetic
atggccgactcccaagtacgtgcagtattccctttcgacaatatagaaacataaggaggttttgggcatggctgagaaagccttaaatgtactgtctgttccaaattcaagcttccttgcggagacccagcatggcgtat

SEQ ID NO: 366893 - DNA, 140 bp, Artificial Sequence
  Synthetic
atacgccatgctgggtctccagagctgcagtgaagaagacacacaaaaatgtgttaacacaaagcttgagcagccacagagcattttgatcgaacataagggaactataatcggaaagcacgtacttgggagtcggccat

SEQ ID NO: 366894 - DNA, 140 bp, Artificial Sequence
  Synthetic
atggccgactcccaagtacgtgctttccgattatagttcccttatgttcgatcaaaatgctctgtggctgctcaagctttgtgttaacacatttttgtgtgtcttcttcactgcagctctggagacccagcatggcgtat

SEQ ID NO: 366895 - DNA, 140 bp, Artificial Sequence
  Synthetic
aggccctggctgctgatatggtttcttttatggtttaaagaacatgcttagtggcatttttggcaatgtttttgtgggcattttcttatttcttgcccccttcatcttgctaatacttttgaccttttgggacagcggtg

SEQ ID NO: 366896 - DNA, 140 bp, Artificial Sequence
  Synthetic
caccgctgtcccaaaaggtcaaaagtattagcaagatgaagggggcaagaaataagaaaatgcccacaaaaacattgccaaaaatgccactaagcatgttctttaaaccataaaagaaaccatatcagcagccagggcct

SEQ ID NO: 366897 - DNA, 140 bp, Artificial Sequence
  Synthetic
aggccctggctgctgatatgaaactggttaagataaggcactgtgacattaacctatcagtcaaattgccatcaaataagaaagagaatatgttatgttgtctatatagtggcaacatgggaccttttgggacagcggtg

SEQ ID NO: 366898 - DNA, 140 bp, Artificial Sequence
  Synthetic
caccgctgtcccaaaaggtcccatgttgccactatatagacaacataacatattctctttcttatttgatggcaatttgactgataggttaatgtcacagtgccttatcttaaccagtttcatatcagcagccagggcct

SEQ ID NO: 366899 - DNA, 140 bp, Artificial Sequence
  Synthetic
aggccctggctgctgatatgtacagaagaatcattgaaagactgaacaacaaaaaaggaaaaaacaagctgcttgatggtgaaagacttgctgatagaagaattgccgaactattctccagaccttttgggacagcggtg

SEQ ID NO: 366900 - DNA, 140 bp, Artificial Sequence
  Synthetic
caccgctgtcccaaaaggtctggagaatagttcggcaattcttctatcagcaagtctttcaccatcaagcagcttgttttttccttttttgttgttcagtctttcaatgattcttctgtacatatcagcagccagggcct

SEQ ID NO: 366901 - DNA, 140 bp, Artificial Sequence
  Synthetic
atacgccatgctgggtctcctaggaaagaaattttcaacgagctgtagaagaattgaagacaacattgcaaggctttacctgcagacatccatatactgttcagttagggatgtggaggacgtacttgggagtcggccat

SEQ ID NO: 366902 - DNA, 140 bp, Artificial Sequence
  Synthetic
atggccgactcccaagtacgtcctccacatccctaactgaacagtatatggatgtctgcaggtaaagccttgcaatgttgtcttcaattcttctacagctcgttgaaaatttctttcctaggagacccagcatggcgtat

SEQ ID NO: 366903 - DNA, 140 bp, Artificial Sequence
  Synthetic
atacgccatgctgggtctccccacagtttgaaacagacatgagagaagccttgagtttgatggatagggttatagctgtggatcagttgacatcatcttccagtgatgaactgcaagattcgtacttgggagtcggccat

SEQ ID NO: 366904 - DNA, 140 bp, Artificial Sequence
  Synthetic
atggccgactcccaagtacgaatcttgcagttcatcactggaagatgatgtcaactgatccacagctataaccctatccatcaaactcaaggcttctctcatgtctgtttcaaactgtggggagacccagcatggcgtat

SEQ ID NO: 366905 - DNA, 140 bp, Artificial Sequence
  Synthetic
atacgccatgctgggtctccactttaattctaagaccagaatccaaagagagaattggcgaagtcatgtcattgcggcagctagggcacaaattgctgacacgagacaaacaaattaagccgtacttgggagtcggccat

SEQ ID NO: 366906 - DNA, 140 bp, Artificial Sequence
  Synthetic
atggccgactcccaagtacggcttaatttgtttgtctcgtgtcagcaatttgtgccctagctgccgcaatgacatgacttcgccaattctctctttggattctggtcttagaattaaagtggagacccagcatggcgtat

SEQ ID NO: 366907 - DNA, 140 bp, Artificial Sequence
  Synthetic
aggccctggctgctgatatgaaagaaggtgtacaaggttctcggcaacctaggaaatgaactgttgtataaggcacccagaaaggccttagcaactgtctgtagtgccttatttgggaaggaccttttgggacagcggtg

SEQ ID NO: 366908 - DNA, 140 bp, Artificial Sequence
  Synthetic
caccgctgtcccaaaaggtccttcccaaataaggcactacagacagttgctaaggcctttctgggtgccttatacaacagttcatttcctaggttgccgagaaccttgtacaccttctttcatatcagcagccagggcct

SEQ ID NO: 366909 - DNA, 140 bp, Artificial Sequence
  Synthetic
aggccctggctgctgatatgggtgctatctcaacaaacatagagatcgggaaaagggattgcctagatctactcagcacagtagatgggctaacagaccagcaaaaagaaaatattgtaagaccttttgggacagcggtg

SEQ ID NO: 366910 - DNA, 140 bp, Artificial Sequence
  Synthetic
caccgctgtcccaaaaggtcttacaatattttctttttgctggtctgttagcccatctactgtgctgagtagatctaggcaatcccttttcccgatctctatgtttgttgagatagcacccatatcagcagccagggcct

SEQ ID NO: 366911 - DNA, 140 bp, Artificial Sequence
  Synthetic
aggccctggctgctgatatggtcaaaaaaaacattgatgaagttttacttactgaagatggaaatctgatattctgctggttgaaaacaatctcctcttcagtcaaaggaagcttaaagagaccttttgggacagcggtg

SEQ ID NO: 366912 - DNA, 140 bp, Artificial Sequence
  Synthetic
caccgctgtcccaaaaggtctctttaagcttcctttgactgaagaggagattgttttcaaccagcagaatatcagatttccatcttcagtaagtaaaacttcatcaatgttttttttgaccatatcagcagccagggcct

SEQ ID NO: 366913 - DNA, 140 bp, Artificial Sequence
  Synthetic
atacgccatgctgggtctccactgacgagtttgaacggacaaagttcaaacatgagctcacacaaaatgtcaccactagtgagaaaatgctattgagttggttgagtgaagacataaagtcgtacttgggagtcggccat

SEQ ID NO: 366914 - DNA, 140 bp, Artificial Sequence
  Synthetic
atggccgactcccaagtacgactttatgtcttcactcaaccaactcaatagcattttctcactagtggtgacattttgtgtgagctcatgtttgaactttgtccgttcaaactcgtcagtggagacccagcatggcgtat

SEQ ID NO: 366915 - DNA, 140 bp, Artificial Sequence
  Synthetic
aggccctggctgctgatatgttgaagcaccatggggggccatcaatgcccaatcaacttacaaaccaactgcatcaagtgctaatattgctctaacatggagctcagtggaacacagggggaccttttgggacagcggtg

SEQ ID NO: 366916 - DNA, 140 bp, Artificial Sequence
  Synthetic
caccgctgtcccaaaaggtccccctgtgttccactgagctccatgttagagcaatattagcacttgatgcagttggtttgtaagttgattgggcattgatggccccccatggtgcttcaacatatcagcagccagggcct

SEQ ID NO: 366917 - DNA, 140 bp, Artificial Sequence
  Synthetic
aggccctggctgctgatatgcagtgctttgtttgggaagcaggtgaccaagctccagaactgtttcagaaccataaaccctgtcagcttacttgcattgaggaatctagactttgactgtgaccttttgggacagcggtg

SEQ ID NO: 366918 - DNA, 140 bp, Artificial Sequence
  Synthetic
caccgctgtcccaaaaggtcacagtcaaagtctagattcctcaatgcaagtaagctgacagggtttatggttctgaaacagttctggagcttggtcacctgcttcccaaacaaagcactgcatatcagcagccagggcct

SEQ ID NO: 366919 - DNA, 140 bp, Artificial Sequence
  Synthetic
aggccctggctgctgatatgttctcctcaacgaacaacaagatgaacaggagttgaggcaagaccttttaatatcttcttggattaagtgcataacagcttgtaaagactttgcaagcatgaccttttgggacagcggtg

SEQ ID NO: 366920 - DNA, 140 bp, Artificial Sequence
  Synthetic
caccgctgtcccaaaaggtcatgcttgcaaagtctttacaagctgttatgcacttaatccaagaagatattaaaaggtcttgcctcaactcctgttcatcttgttgttcgttgaggagaacatatcagcagccagggcct

SEQ ID NO: 366921 - DNA, 140 bp, Artificial Sequence
  Synthetic
aggccctggctgctgatatggatgttgtacagaatttaataggtcaggggttaaactagtcaaggtaaggcactgtgacattaacctatcagtcaaactgccatcgaacaaaaaagagaagaccttttgggacagcggtg

SEQ ID NO: 366922 - DNA, 140 bp, Artificial Sequence
  Synthetic
caccgctgtcccaaaaggtcttctcttttttgttcgatggcagtttgactgataggttaatgtcacagtgccttaccttgactagtttaacccctgacctattaaattctgtacaacatccatatcagcagccagggcct

SEQ ID NO: 366923 - DNA, 140 bp, Artificial Sequence
  Synthetic
aggccctggctgctgatatgcagtgtgagcgacactactgctgcttcccatgactcaggatcgtcatcctcaagcttctcttttgagctcaatagacccctgtctgaaactgaactacaggaccttttgggacagcggtg

SEQ ID NO: 366924 - DNA, 140 bp, Artificial Sequence
  Synthetic
caccgctgtcccaaaaggtcctgtagttcagtttcagacaggggtctattgagctcaaaagagaagcttgaggatgacgatcctgagtcatgggaagcagcagtagtgtcgctcacactgcatatcagcagccagggcct

SEQ ID NO: 366925 - DNA, 140 bp, Artificial Sequence
  Synthetic
aggccctggctgctgatatgtctatttgaacaggagacaagctgtcctcggttcttcatacctttatattgtcattacactttacatacaagtattgcagcagtataggtgtctagaagtgaccttttgggacagcggtg

SEQ ID NO: 366926 - DNA, 140 bp, Artificial Sequence
  Synthetic
caccgctgtcccaaaaggtcacttctagacacctatactgctgcaatacttgtatgtaaagtgtaatgacaatataaaggtatgaagaaccgaggacagcttgtctcctgttcaaatagacatatcagcagccagggcct

SEQ ID NO: 366927 - DNA, 140 bp, Artificial Sequence
  Synthetic
atacgccatgctgggtctcctaccagccattgcgaaaactgtcatcctaacggtattagcattagcaacacatctaatgttggcaagaggtgccctaaattagaggtagtcagtcattgtcgtacttgggagtcggccat

SEQ ID NO: 366928 - DNA, 140 bp, Artificial Sequence
  Synthetic
atggccgactcccaagtacgacaatgactgactacctctaatttagggcacctcttgccaacattagatgtgttgctaatgctaataccgttaggatgacagttttcgcaatggctggtaggagacccagcatggcgtat

SEQ ID NO: 366929 - DNA, 140 bp, Artificial Sequence
  Synthetic
aggccctggctgctgatatgtttgcaacatgggtgactggccttcatgtacatatactggagtgacacagcacaatcgtgcggcattcgtcaacatgctcaatattgagactgattatacgaccttttgggacagcggtg

SEQ ID NO: 366930 - DNA, 140 bp, Artificial Sequence
  Synthetic
caccgctgtcccaaaaggtcgtataatcagtctcaatattgagcatgttgacgaatgccgcacgattgtgctgtgtcactccagtatatgtacatgaaggccagtcacccatgttgcaaacatatcagcagccagggcct

SEQ ID NO: 366931 - DNA, 140 bp, Artificial Sequence
  Synthetic
atacgccatgctgggtctccaatctcttcttcagtcaaaggaagtttaaagaagagactcaagttcatgaatgtaaattccccggaactgatgccagagaactgtctcttttctagtgaacgtacttgggagtcggccat

SEQ ID NO: 366932 - DNA, 140 bp, Artificial Sequence
  Synthetic
atggccgactcccaagtacgttcactagaaaagagacagttctctggcatcagttccggggaatttacattcatgaacttgagtctcttctttaaacttcctttgactgaagaagagattggagacccagcatggcgtat

SEQ ID NO: 366933 - DNA, 140 bp, Artificial Sequence
  Synthetic
aggccctggctgctgatatgtgtttgtcaagtggaaagttgagtacattaaaacagaagctatagtgtgtgttgagcttactagccaagagagacaatgtagcttgattgaggcaggcacgaccttttgggacagcggtg

SEQ ID NO: 366934 - DNA, 140 bp, Artificial Sequence
  Synthetic
caccgctgtcccaaaaggtcgtgcctgcctcaatcaagctacattgtctctcttggctagtaagctcaacacacactatagcttctgttttaatgtactcaactttccacttgacaaacacatatcagcagccagggcct

SEQ ID NO: 366935 - DNA, 140 bp, Artificial Sequence
  Synthetic
aggccctggctgctgatatggtgaaacgagattctgagcgcgagggtctaactgacctccttgattatctaaactcaccagctgaattgttgaagaagaagccttacttggggacaacttgaccttttgggacagcggtg

SEQ ID NO: 366936 - DNA, 140 bp, Artificial Sequence
  Synthetic
caccgctgtcccaaaaggtcaagttgtccccaagtaaggcttcttcttcaacaattcagctggtgagtttagataatcaaggaggtcagttagaccctcgcgctcagaatctcgtttcaccatatcagcagccagggcct

SEQ ID NO: 366937 - DNA, 140 bp, Artificial Sequence
  Synthetic
aggccctggctgctgatatgcaggagtgacccagcacaatcatgctgcatttgtaaacttgcttaacattgaaactgattacacgaaaactttccacttccactctaaaagagttacagcgaccttttgggacagcggtg

SEQ ID NO: 366938 - DNA, 140 bp, Artificial Sequence
  Synthetic
caccgctgtcccaaaaggtcgctgtaactcttttagagtggaagtggaaagttttcgtgtaatcagtttcaatgttaagcaagtttacaaatgcagcatgattgtgctgggtcactcctgcatatcagcagccagggcct

SEQ ID NO: 366939 - DNA, 140 bp, Artificial Sequence
  Synthetic
aggccctggctgctgatatgaaacaatgaactaggtgatgtgtcactgaaggttaacattgtcttggtgcctctcaaggacatgtctaagccaaagtctgagagagtggtcatggctagagaccttttgggacagcggtg

SEQ ID NO: 366940 - DNA, 140 bp, Artificial Sequence
  Synthetic
caccgctgtcccaaaaggtctctagccatgaccactctctcagactttggcttagacatgtccttgagaggcaccaagacaatgttaaccttcagtgacacatcacctagttcattgtttcatatcagcagccagggcct

SEQ ID NO: 366941 - DNA, 140 bp, Artificial Sequence
  Synthetic
aggccctggctgctgatatggtttcgtcccaacaagcaatgtataatagcgttcctcttgtcaccaataccaccttcacactattaaggcaacaaattttctttaaccatgttgaggattgaccttttgggacagcggtg

SEQ ID NO: 366942 - DNA, 140 bp, Artificial Sequence
  Synthetic
caccgctgtcccaaaaggtcaatcctcaacatggttaaagaaaatttgttgccttaatagtgtgaaggtggtattggtgacaagaggaacgctattatacattgcttgttgggacgaaaccatatcagcagccagggcct

SEQ ID NO: 366943 - DNA, 140 bp, Artificial Sequence
  Synthetic
aggccctggctgctgatatggaacctctcgaagcaaggtaaatctaagtgttctgtgccaagatcttggcttgaaaagattctatttgatctgaaagtgcctactaaggatgaggaagtagaccttttgggacagcggtg

SEQ ID NO: 366944 - DNA, 140 bp, Artificial Sequence
  Synthetic
caccgctgtcccaaaaggtctacttcctcatccttagtaggcactttcagatcaaatagaatcttttcaagccaagatcttggcacagaacacttagatttaccttgcttcgagaggttccatatcagcagccagggcct

SEQ ID NO: 366945 - DNA, 140 bp, Artificial Sequence
  Synthetic
atacgccatgctgggtctcctcacagtgttctcttgagttttggcaaaatggagaataaaatcgaagtgactagcaaggatgaaatgaacaggtggtttgaggagttcaagaagagtaatcgtacttgggagtcggccat

SEQ ID NO: 366946 - DNA, 140 bp, Artificial Sequence
  Synthetic
atggccgactcccaagtacgattactcttcttgaactcctcaaaccacctgttcatttcatccttgctagtcacttcgattttattctccattttgccaaaactcaagagaacactgtgaggagacccagcatggcgtat

SEQ ID NO: 366947 - DNA, 140 bp, Artificial Sequence
  Synthetic
atacgccatgctgggtctcctctttattgcaatagcaatgaggggcctcttgataggcacaatgttgtttacagcagcagaatggcagattcttgcgattggctaagagatggtaagagacgtacttgggagtcggccat

SEQ ID NO: 366948 - DNA, 140 bp, Artificial Sequence
  Synthetic
atggccgactcccaagtacgtctcttaccatctcttagccaatcgcaagaatctgccattctgctgctgtaaacaacattgtgcctatcaagaggcccctcattgctattgcaataaagaggagacccagcatggcgtat

SEQ ID NO: 366949 - DNA, 140 bp, Artificial Sequence
  Synthetic
atacgccatgctgggtctccaaaaggactccatctatgcttctgctctagtggaggcaaccaagttttgtgcacctatatacgagtgtgcatgggtcagctctaccggcatagtcaaaaacgtacttgggagtcggccat

SEQ ID NO: 366950 - DNA, 140 bp, Artificial Sequence
  Synthetic
atggccgactcccaagtacgtttttgactatgccggtagagctgacccatgcacactcgtatataggtgcacaaaacttggttgcctccactagagcagaagcatagatggagtccttttggagacccagcatggcgtat

SEQ ID NO: 366951 - DNA, 140 bp, Artificial Sequence
  Synthetic
aggccctggctgctgatatggcacctatatacgagtgtgcatgggtcagctctaccggcatagtcaaaaaaggccttgagtggttcgaaaaaaatgcaggaactatcaagtcttgggatggaccttttgggacagcggtg

SEQ ID NO: 366952 - DNA, 140 bp, Artificial Sequence
  Synthetic
caccgctgtcccaaaaggtccatcccaagacttgatagttcctgcatttttttcgaaccactcaaggccttttttgactatgccggtagagctgacccatgcacactcgtatataggtgccatatcagcagccagggcct

SEQ ID NO: 366953 - DNA, 140 bp, Artificial Sequence
  Synthetic
aggccctggctgctgatatgaactaccagcaggctgctctgaagtggaggaaggatattggtttccgtgtcaatgctaatacggcagccttgagcaacaaagtccttgcagaatataaaggaccttttgggacagcggtg

SEQ ID NO: 366954 - DNA, 140 bp, Artificial Sequence
  Synthetic
caccgctgtcccaaaaggtcctttatattctgcaaggactttgttgctcaaggctgccgtattagcattgacacggaaaccaatatccttcctccacttcagagcagcctgctggtagttcatatcagcagccagggcct

SEQ ID NO: 366955 - DNA, 140 bp, Artificial Sequence
  Synthetic
atacgccatgctgggtctccttgcggcaaacaattaaccggtagaataattaccaagtacactcactggttggacacctttctaggctgctcggtctccattaacaggcatactactgttcgtacttgggagtcggccat

SEQ ID NO: 366956 - DNA, 140 bp, Artificial Sequence
  Synthetic
atggccgactcccaagtacgaacagtagtatgcctgttaatggagaccgagcagcctagaaaggtgtccaaccagtgagtgtacttggtaattattctaccggttaattgtttgccgcaaggagacccagcatggcgtat

SEQ ID NO: 366957 - DNA, 140 bp, Artificial Sequence
  Synthetic
aggccctggctgctgatatgcccggtgagccgtgagcatgtggaatggtgcagggaatttgtcaagggcaagtacatcatggctttcaacccaccctggggagacattaacaagtcaggcgaccttttgggacagcggtg

SEQ ID NO: 366958 - DNA, 140 bp, Artificial Sequence
  Synthetic
caccgctgtcccaaaaggtcgcctgacttgttaatgtctccccagggtgggttgaaagccatgatgtacttgcccttgacaaattccctgcaccattccacatgctcacggctcaccgggcatatcagcagccagggcct

SEQ ID NO: 366959 - DNA, 140 bp, Artificial Sequence
  Synthetic
aggccctggctgctgatatgagtacatcatggctttcaacccaccctggggagacattaacaagtcaggccgctcagggatagcgcttgtcgcaacgggtcttgccaagcttgcagaaacgaccttttgggacagcggtg

SEQ ID NO: 366960 - DNA, 140 bp, Artificial Sequence
  Synthetic
caccgctgtcccaaaaggtcgtttctgcaagcttggcaagacccgttgcgacaagcgctatccctgagcggcctgacttgttaatgtctccccagggtgggttgaaagccatgatgtactcatatcagcagccagggcct

SEQ ID NO: 366961 - DNA, 140 bp, Artificial Sequence
  Synthetic
atacgccatgctgggtctccatggctatttggataagcataaggatgaggtagacaaggctagtgctgacggcatggtgacaaacctcctcaagcacattgcaaaagcacaagagctctacgtacttgggagtcggccat

SEQ ID NO: 366962 - DNA, 140 bp, Artificial Sequence
  Synthetic
atggccgactcccaagtacgtagagctcttgtgcttttgcaatgtgcttgaggaggtttgtcaccatgccgtcagcactagccttgtctacctcatccttatgcttatccaaatagccatggagacccagcatggcgtat

SEQ ID NO: 366963 - DNA, 140 bp, Artificial Sequence
  Synthetic
atacgccatgctgggtctcccaaaaattcatctgcacttcgtgcacaaggtgcacagattgatactccttttagctcattttactggctttacaaggctggcgtatctccagaaaccttccgtacttgggagtcggccat

SEQ ID NO: 366964 - DNA, 140 bp, Artificial Sequence
  Synthetic
atggccgactcccaagtacggaaggtttctggagatacgccagccttgtaaagccagtaaaatgagctaaaaggagtatcaatctgtgcaccttgtgcacgaagtgcagatgaatttttgggagacccagcatggcgtat

SEQ ID NO: 366965 - DNA, 140 bp, Artificial Sequence
  Synthetic
atacgccatgctgggtctcccaagaaaatgaagaaggcactcctgagcactccaatgaagtggggaaagaaactctatgaactctttgctgatgattctttccaggagaacagaatctatcgtacttgggagtcggccat

SEQ ID NO: 366966 - DNA, 140 bp, Artificial Sequence
  Synthetic
atggccgactcccaagtacgatagattctgttctcctggaaagaatcatcagcaaagagttcatagagtttctttccccacttcattggagtgctcaggagtgccttcttcattttcttgggagacccagcatggcgtat

SEQ ID NO: 366967 - DNA, 140 bp, Artificial Sequence
  Synthetic
atacgccatgctgggtctcccttcggaaccatccctgtagctaaccctgatgacgctgcccaaggatcagggcacaccaagtccattctcaacctaaggacaaacacagagactaacaatcgtacttgggagtcggccat

SEQ ID NO: 366968 - DNA, 140 bp, Artificial Sequence
  Synthetic
atggccgactcccaagtacgattgttagtctctgtgtttgtccttaggttgagaatggacttggtgtgccctgatccttgggcagcgtcatcagggttagctacagggatggttccgaagggagacccagcatggcgtat

SEQ ID NO: 366969 - DNA, 140 bp, Artificial Sequence
  Synthetic
aggccctggctgctgatatgggcacaccaagtccattctcaacctaaggacaaacacagagactaacaatccatgtgctaagacaattgttaaactgtttgaaatccaaaagacaggattgaccttttgggacagcggtg

SEQ ID NO: 366970 - DNA, 140 bp, Artificial Sequence
  Synthetic
caccgctgtcccaaaaggtcaatcctgtcttttggatttcaaacagtttaacaattgtcttagcacatggattgttagtctctgtgtttgtccttaggttgagaatggacttggtgtgcccatatcagcagccagggcct

SEQ ID NO: 366971 - DNA, 140 bp, Artificial Sequence
  Synthetic
atacgccatgctgggtctcctgcgtcactctgcactcagattttttcctctaattgcttcaatcaatcgctttttttatccagctttgcttactttgcttttctttcttaattaaacactcgtacttgggagtcggccat

SEQ ID NO: 366972 - DNA, 140 bp, Artificial Sequence
  Synthetic
atggccgactcccaagtacgagtgtttaattaagaaagaaaagcaaagtaagcaaagctggataaaaaaagcgattgattgaagcaattagaggaaaaaatctgagtgcagagtgacgcaggagacccagcatggcgtat

SEQ ID NO: 366973 - DNA, 140 bp, Artificial Sequence
  Synthetic
atacgccatgctgggtctcccaaagatatcaatccccccgttacccacgttaacacggagagctctagtagtggtctttccctttgcgaaaccatggacttcttgagaaaccttgactggcgtacttgggagtcggccat

SEQ ID NO: 366974 - DNA, 140 bp, Artificial Sequence
  Synthetic
atggccgactcccaagtacgccagtcaaggtttctcaagaagtccatggtttcgcaaagggaaagaccactactagagctctccgtgttaacgtgggtaacggggggattgatatctttgggagacccagcatggcgtat

SEQ ID NO: 366975 - DNA, 140 bp, Artificial Sequence
  Synthetic
aggccctggctgctgatatgacagtgaagaaacaggtcgtgtttgatgctgagagcgagcctagactgcagtggggacatggttgcttgtccattgtttacgatgaaactgacactcaaagaccttttgggacagcggtg

SEQ ID NO: 366976 - DNA, 140 bp, Artificial Sequence
  Synthetic
caccgctgtcccaaaaggtctttgagtgtcagtttcatcgtaaacaatggacaagcaaccatgtccccactgcagtctaggctcgctctcagcatcaaacacgacctgtttcttcactgtcatatcagcagccagggcct

SEQ ID NO: 366977 - DNA, 140 bp, Artificial Sequence
  Synthetic
atacgccatgctgggtctcctgattattttgagattgtgcggcagcctggtgatgggaactgcttctatcacagcatagctgagttaaccatgcctaacaaaacagatcattcatatcatcgtacttgggagtcggccat

SEQ ID NO: 366978 - DNA, 140 bp, Artificial Sequence
  Synthetic
atggccgactcccaagtacgatgatatgaatgatctgttttgttaggcatggttaactcagctatgctgtgatagaagcagttcccatcaccaggctgccgcacaatctcaaaataatcaggagacccagcatggcgtat

SEQ ID NO: 366979 - DNA, 140 bp, Artificial Sequence
  Synthetic
aggccctggctgctgatatgcacagggtgcacagattgacaccgtcttcagctcatactactggctctacaaggccggtgtgactccagacaccttcccgactgtctcacagtttcttttgaccttttgggacagcggtg

SEQ ID NO: 366980 - DNA, 140 bp, Artificial Sequence
  Synthetic
caccgctgtcccaaaaggtcaaaagaaactgtgagacagtcgggaaggtgtctggagtcacaccggccttgtagagccagtagtatgagctgaagacggtgtcaatctgtgcaccctgtgcatatcagcagccagggcct

SEQ ID NO: 366981 - DNA, 140 bp, Artificial Sequence
  Synthetic
aggccctggctgctgatatgcactgctccactgttttttaaaacatgctcctagtgatgccataatggaggtagagagtaaaagcagcttgctgcacaagtacctcaaatcaggaggtgtgaccttttgggacagcggtg

SEQ ID NO: 366982 - DNA, 140 bp, Artificial Sequence
  Synthetic
caccgctgtcccaaaaggtcacacctcctgatttgaggtacttgtgcagcaagctgcttttactctctacctccattatggcatcactaggagcatgttttaaaaaacagtggagcagtgcatatcagcagccagggcct

SEQ ID NO: 366983 - DNA, 140 bp, Artificial Sequence
  Synthetic
aggccctggctgctgatatgttataaaagacaatctcgaacaaggtgtagaagaggaaattgagttttgcaacaacctgaccaagaccgtttcagagaacccgctaccactcagctgttggaccttttgggacagcggtg

SEQ ID NO: 366984 - DNA, 140 bp, Artificial Sequence
  Synthetic
caccgctgtcccaaaaggtccaacagctgagtggtagcgggttctctgaaacggtcttggtcaggttgttgcaaaactcaatttcctcttctacaccttgttcgagattgtcttttataacatatcagcagccagggcct

SEQ ID NO: 366985 - DNA, 140 bp, Artificial Sequence
  Synthetic
aggccctggctgctgatatgctatccttaatgtttctggacgagatgtcattgcctgagctgaagtctttgtctgtgaactgcaaaatggggaactttgaggggcaggagtgctttgagtgaccttttgggacagcggtg

SEQ ID NO: 366986 - DNA, 140 bp, Artificial Sequence
  Synthetic
caccgctgtcccaaaaggtcactcaaagcactcctgcccctcaaagttccccattttgcagttcacagacaaagacttcagctcaggcaatgacatctcgtccagaaacattaaggatagcatatcagcagccagggcct

SEQ ID NO: 366987 - DNA, 140 bp, Artificial Sequence
  Synthetic
aggccctggctgctgatatgtgtgcaagagagtgtgaagtcctcttcgatgacataagaaactctccaacgcacagtacagcttggaagcatgcacttcggttaaaagggactgcatacggaccttttgggacagcggtg

SEQ ID NO: 366988 - DNA, 140 bp, Artificial Sequence
  Synthetic
caccgctgtcccaaaaggtccgtatgcagtcccttttaaccgaagtgcatgcttccaagctgtactgtgcgttggagagtttcttatgtcatcgaagaggacttcacactctcttgcacacatatcagcagccagggcct

SEQ ID NO: 366989 - DNA, 140 bp, Artificial Sequence
  Synthetic
aggccctggctgctgatatgctgctctgtacttctcactgtcaattcagctgcctccgttaatctatttgccatcctgccattcttctttctctaatattcatactagtttcattatttggaccttttgggacagcggtg

SEQ ID NO: 366990 - DNA, 140 bp, Artificial Sequence
  Synthetic
caccgctgtcccaaaaggtccaaataatgaaactagtatgaatattagagaaagaagaatggcaggatggcaaatagattaacggaggcagctgaattgacagtgagaagtacagagcagcatatcagcagccagggcct

SEQ ID NO: 366991 - DNA, 140 bp, Artificial Sequence
  Synthetic
atacgccatgctgggtctcctctcaaagaaacacgtgccgcttacgcccccagtgttctcttgagtgttagcaaatggaaaacaaaattgaggtgaataacaaacatgagatgaacaagtcgtacttgggagtcggccat

SEQ ID NO: 366992 - DNA, 140 bp, Artificial Sequence
  Synthetic
atggccgactcccaagtacgacttgttcatctcatgtttgttattcacctcaattttgttttccatttgctaacactcaagagaacactgggggcgtaagcggcacgtgtttctttgagaggagacccagcatggcgtat

SEQ ID NO: 366993 - DNA, 140 bp, Artificial Sequence
  Synthetic
atacgccatgctgggtctcctaagtgaggtgcattcaatagagcgtataatggaaaactttacccgcctcatgcatggaggaagactttcggccaagaaaagggatggagatccggcggacgtacttgggagtcggccat

SEQ ID NO: 366994 - DNA, 140 bp, Artificial Sequence
  Synthetic
atggccgactcccaagtacgtccgccggatctccatcccttttcttggccgaaagtcttcctccatgcatgaggcgggtaaagttttccattatacgctctattgaatgcacctcacttaggagacccagcatggcgtat

SEQ ID NO: 366995 - DNA, 140 bp, Artificial Sequence
  Synthetic
aggccctggctgctgatatgggaattcttggatcgaactcagttgcatccagagttcagagatctaacccccgacttttcgctcacacaaaaggttcacttcaaaagaaaccagatacccgaccttttgggacagcggtg

SEQ ID NO: 366996 - DNA, 140 bp, Artificial Sequence
  Synthetic
caccgctgtcccaaaaggtcgggtatctggtttcttttgaagtgaaccttttgtgtgagcgaaaagtcgggggttagatctctgaactctggatgcaactgagttcgatccaagaattcccatatcagcagccagggcct

SEQ ID NO: 366997 - DNA, 140 bp, Artificial Sequence
  Synthetic
aggccctggctgctgatatgcacattgccaaggcacaggagctttataagaattcgtctgcactccgtgcacaaggtgcacagattgacactgctttcagctcatactattggctttacagaccttttgggacagcggtg

SEQ ID NO: 366998 - DNA, 140 bp, Artificial Sequence
  Synthetic
caccgctgtcccaaaaggtctgtaaagccaatagtatgagctgaaagcagtgtcaatctgtgcaccttgtgcacggagtgcagacgaattcttataaagctcctgtgccttggcaatgtgcatatcagcagccagggcct

SEQ ID NO: 366999 - DNA, 140 bp, Artificial Sequence
  Synthetic
atacgccatgctgggtctccagcacatactcaacaggccaacaggactgacactgcccaccagtttggaacaggcaatgcgcaaaggactggtcgaaggtgtggtcatctctaaggaaggcgtacttgggagtcggccat

SEQ ID NO: 367000 - DNA, 140 bp, Artificial Sequence
  Synthetic
atggccgactcccaagtacgccttccttagagatgaccacaccttcgaccagtcctttgcgcattgcctgttccaaactggtgggcagtgtcagtcctgttggcctgttgagtatgtgctggagacccagcatggcgtat

SEQ ID NO: 367001 - DNA, 140 bp, Artificial Sequence
  Synthetic
atacgccatgctgggtctcccataactgcaatgctcagtcatgcttattttacttacttatataaccttattttattaacctttctctattttctcttgtttaaacacttaaagggctgtcgtacttgggagtcggccat

SEQ ID NO: 367002 - DNA, 140 bp, Artificial Sequence
  Synthetic
atggccgactcccaagtacgacagccctttaagtgtttaaacaagagaaaatagagaaaggttaataaaataaggttatataagtaagtaaaataagcatgactgagcattgcagttatgggagacccagcatggcgtat

SEQ ID NO: 367003 - DNA, 140 bp, Artificial Sequence
  Synthetic
atacgccatgctgggtctccggaggcagtgccggtgacagaaagaaagatgtttcctcttcctgagactccgctaagtgaggtgcattcaatagagcgtataatggacaattttacccgccgtacttgggagtcggccat

SEQ ID NO: 367004 - DNA, 140 bp, Artificial Sequence
  Synthetic
atggccgactcccaagtacggcgggtaaaattgtccattatacgctctattgaatgcacctcacttagcggagtctcaggaagaggaaacatctttctttctgtcaccggcactgcctccggagacccagcatggcgtat

SEQ ID NO: 367005 - DNA, 140 bp, Artificial Sequence
  Synthetic
atacgccatgctgggtctccgtgagaccttcctaagatgctgcacagaatttaataggtcaggggtcaagctggttaagataaggcactgtgacattaacctatcagtcaaattgccatccgtacttgggagtcggccat

SEQ ID NO: 367006 - DNA, 140 bp, Artificial Sequence
  Synthetic
atggccgactcccaagtacggatggcaatttgactgataggttaatgtcacagtgccttatcttaaccagcttgacccctgacctattaaattctgtgcagcatcttaggaaggtctcacggagacccagcatggcgtat

SEQ ID NO: 367007 - DNA, 140 bp, Artificial Sequence
  Synthetic
aggccctggctgctgatatggctgtttgaaattcagaaaacagggttcaacattcaggacatggacatagtggcctctgagcacttgctgcaccagtctcttgttggcaagcaatctccagaccttttgggacagcggtg

SEQ ID NO: 367008 - DNA, 140 bp, Artificial Sequence
  Synthetic
caccgctgtcccaaaaggtctggagattgcttgccaacaagagactggtgcagcaagtgctcagaggccactatgtccatgtcctgaatgttgaaccctgttttctgaatttcaaacagccatatcagcagccagggcct

SEQ ID NO: 367009 - DNA, 140 bp, Artificial Sequence
  Synthetic
aggccctggctgctgatatggagtggcttgagcattttggattcagcatgcccgtcaacattatgtacacaccactagtgtgtgctgttatctgcctacagctgtggaatctaggaggtagaccttttgggacagcggtg

SEQ ID NO: 367010 - DNA, 140 bp, Artificial Sequence
  Synthetic
caccgctgtcccaaaaggtctacctcctagattccacagctgtaggcagataacagcacacactagtggtgtgtacataatgttgacgggcatgctgaatccaaaatgctcaagccactccatatcagcagccagggcct

SEQ ID NO: 367011 - DNA, 140 bp, Artificial Sequence
  Synthetic
aggccctggctgctgatatgaccactagtgtgtgctgttatctgcctacagctgtggaatctaggaggtactcttgtgttcatcaacaggacccaacacaatgaaacaggcaccgtggcagaccttttgggacagcggtg

SEQ ID NO: 367012 - DNA, 140 bp, Artificial Sequence
  Synthetic
caccgctgtcccaaaaggtctgccacggtgcctgtttcattgtgttgggtcctgttgatgaacacaagagtacctcctagattccacagctgtaggcagataacagcacacactagtggtcatatcagcagccagggcct

SEQ ID NO: 367013 - DNA, 140 bp, Artificial Sequence
  Synthetic
atacgccatgctgggtctcccaccaagtcggaccgcccttctgtcggacccgcagcatcgtccagtggactagagggctcaggggaaccgaatacctccccctcaatcaccacaaaaggccgtacttgggagtcggccat

SEQ ID NO: 367014 - DNA, 140 bp, Artificial Sequence
  Synthetic
atggccgactcccaagtacggccttttgtggtgattgagggggaggtattcggttcccctgagccctctagtccactggacgatgctgcgggtccgacagaagggcggtccgacttggtgggagacccagcatggcgtat

SEQ ID NO: 367015 - DNA, 140 bp, Artificial Sequence
  Synthetic
aggccctggctgctgatatggcacagagaccagcagcccacccccagccaccagcgagacaccaaccccctctccaacaactcaggtccccaccggaaacaataaccctaacacctccaggaccttttgggacagcggtg

SEQ ID NO: 367016 - DNA, 140 bp, Artificial Sequence
  Synthetic
caccgctgtcccaaaaggtcctggaggtgttagggttattgtttccggtggggacctgagttgttggagagggggttggtgtctcgctggtggctgggggtgggctgctggtctctgtgccatatcagcagccagggcct

SEQ ID NO: 367017 - DNA, 140 bp, Artificial Sequence
  Synthetic
atacgccatgctgggtctcccagcacagccaaacctttcacagagtgccccccccactgctgatcaaggcgtacaccccagcccaacaaacagatccaagaggaaccttgaaatagaaatcgtacttgggagtcggccat

SEQ ID NO: 367018 - DNA, 140 bp, Artificial Sequence
  Synthetic
atggccgactcccaagtacgatttctatttcaaggttcctcttggatctgtttgttgggctggggtgtacgccttgatcagcagtggggggggcactctgtgaaaggtttggctgtgctgggagacccagcatggcgtat

SEQ ID NO: 367019 - DNA, 140 bp, Artificial Sequence
  Synthetic
aggccctggctgctgatatgctttgacatttacaatgtgcacatatacaacaaggaaatggacaactttgacgaagggtgtattagcgtcttagaagaaacagcagaaagacatatgcttgaccttttgggacagcggtg

SEQ ID NO: 367020 - DNA, 140 bp, Artificial Sequence
  Synthetic
caccgctgtcccaaaaggtcaagcatatgtctttctgctgtttcttctaagacgctaatacacccttcgtcaaagttgtccatttccttgttgtatatgtgcacattgtaaatgtcaaagcatatcagcagccagggcct

SEQ ID NO: 367021 - DNA, 140 bp, Artificial Sequence
  Synthetic
aggccctggctgctgatatgttcatgttcactggactgataaatagctctgtaacctcacctcagagtttgatgcaagcatgccaagtttcatcccaacaagctatgtataatagtgttcgaccttttgggacagcggtg

SEQ ID NO: 367022 - DNA, 140 bp, Artificial Sequence
  Synthetic
caccgctgtcccaaaaggtcgaacactattatacatagcttgttgggatgaaacttggcatgcttgcatcaaactctgaggtgaggttacagagctatttatcagtccagtgaacatgaacatatcagcagccagggcct

SEQ ID NO: 367023 - DNA, 140 bp, Artificial Sequence
  Synthetic
atacgccatgctgggtctccgacaagattcagaagttcatttaccacctgtctgaagagctatatgacataaggctgcagcacctggaactgtcaaagcttaagcaagagcaccctagtgcgtacttgggagtcggccat

SEQ ID NO: 367024 - DNA, 140 bp, Artificial Sequence
  Synthetic
atggccgactcccaagtacgcactagggtgctcttgcttaagctttgacagttccaggtgctgcagccttatgtcatatagctcttcagacaggtggtaaatgaacttctgaatcttgtcggagacccagcatggcgtat

SEQ ID NO: 367025 - DNA, 140 bp, Artificial Sequence
  Synthetic
atacgccatgctgggtctcctctcaaagatatcaatcccccctttacccacgttgacacagacagctccagtagtggttctttgtccttattaaaccatggacttcttaagaaaccttgacgtacttgggagtcggccat

SEQ ID NO: 367026 - DNA, 140 bp, Artificial Sequence
  Synthetic
atggccgactcccaagtacgtcaaggtttcttaagaagtccatggtttaataaggacaaagaaccactactggagctgtctgtgtcaacgtgggtaaaggggggattgatatctttgagaggagacccagcatggcgtat

SEQ ID NO: 367027 - DNA, 140 bp, Artificial Sequence
  Synthetic
aggccctggctgctgatatgtgacgaaaagctactacatcaaacaaagatagtttttgctaaaattggtttatctgggaacagttatgactttatctggactactcaaatgatagcaaacgaccttttgggacagcggtg

SEQ ID NO: 367028 - DNA, 140 bp, Artificial Sequence
  Synthetic
caccgctgtcccaaaaggtcgtttgctatcatttgagtagtccagataaagtcataactgttcccagataaaccaattttagcaaaaactatctttgtttgatgtagtagcttttcgtcacatatcagcagccagggcct

SEQ ID NO: 367029 - DNA, 140 bp, Artificial Sequence
  Synthetic
aggccctggctgctgatatgtatctgggaacagttatgactttatctggactactcaaatgatagcaaacagcaattttaacgtctgcaagagattaacgggaaggagtactggagaaaggaccttttgggacagcggtg

SEQ ID NO: 367030 - DNA, 140 bp, Artificial Sequence
  Synthetic
caccgctgtcccaaaaggtcctttctccagtactccttcccgttaatctcttgcagacgttaaaattgctgtttgctatcatttgagtagtccagataaagtcataactgttcccagatacatatcagcagccagggcct

SEQ ID NO: 367031 - DNA, 140 bp, Artificial Sequence
  Synthetic
aggccctggctgctgatatgctaaattatgagcaccgcttctatgcagtcttagcacctaaagcacaactaggaggagcaagagatttgttagtgcaagagactgggactaaagtcatgcgaccttttgggacagcggtg

SEQ ID NO: 367032 - DNA, 140 bp, Artificial Sequence
  Synthetic
caccgctgtcccaaaaggtcgcatgactttagtcccagtctcttgcactaacaaatctcttgctcctcctagttgtgctttaggtgctaagactgcatagaagcggtgctcataatttagcatatcagcagccagggcct

SEQ ID NO: 367033 - DNA, 140 bp, Artificial Sequence
  Synthetic
atacgccatgctgggtctccacaacatagtgaagaggatctgagaagactgttgacagataatttagacagttgggacggaaacgacacagttaagttcttagttacaacttatataagccgtacttgggagtcggccat

SEQ ID NO: 367034 - DNA, 140 bp, Artificial Sequence
  Synthetic
atggccgactcccaagtacggcttatataagttgtaactaagaacttaactgtgtcgtttccgtcccaactgtctaaattatctgtcaacagtcttctcagatcctcttcactatgttgtggagacccagcatggcgtat

SEQ ID NO: 367035 - DNA, 140 bp, Artificial Sequence
  Synthetic
aggccctggctgctgatatggttgggacggaaacgacacagttaagttcttagttacaacttatataagcaaaggacttatggcgttaaacagttacaatcatatgggtcagggtattcagaccttttgggacagcggtg

SEQ ID NO: 367036 - DNA, 140 bp, Artificial Sequence
  Synthetic
caccgctgtcccaaaaggtctgaataccctgacccatatgattgtaactgtttaacgccataagtcctttgcttatataagttgtaactaagaacttaactgtgtcgtttccgtcccaaccatatcagcagccagggcct

SEQ ID NO: 367037 - DNA, 140 bp, Artificial Sequence
  Synthetic
atacgccatgctgggtctccgaacaggcaatgcgcaaaggactggtcgaaggagtagtcatctctaaggaaggttccgaatcatgcatcaacatgctgaaagaaaacttggaccgaataacgtacttgggagtcggccat

SEQ ID NO: 367038 - DNA, 140 bp, Artificial Sequence
  Synthetic
atggccgactcccaagtacgttattcggtccaagttttctttcagcatgttgatgcatgattcggaaccttccttagagatgactactccttcgaccagtcctttgcgcattgcctgttcggagacccagcatggcgtat

SEQ ID NO: 367039 - DNA, 140 bp, Artificial Sequence
  Synthetic
aggccctggctgctgatatggttgaacatgccggtagttcagatgattacgcaaagtgtatagtggtgactggtatactatccaaagagctctactcccagtatgatgaaacattttggagaccttttgggacagcggtg

SEQ ID NO: 367040 - DNA, 140 bp, Artificial Sequence
  Synthetic
caccgctgtcccaaaaggtctccaaaatgtttcatcatactgggagtagagctctttggatagtataccagtcaccactatacactttgcgtaatcatctgaactaccggcatgttcaaccatatcagcagccagggcct

SEQ ID NO: 367041 - DNA, 140 bp, Artificial Sequence
  Synthetic
aggccctggctgctgatatggtcgaacttactagccaagaaaggcaatgtagcttgattgaagcaggcacaagattcaatttaggtcctgtgactatcacattatcggagccaagaaacagaccttttgggacagcggtg

SEQ ID NO: 367042 - DNA, 140 bp, Artificial Sequence
  Synthetic
caccgctgtcccaaaaggtctgtttcttggctccgataatgtgatagtcacaggacctaaattgaatcttgtgcctgcttcaatcaagctacattgcctttcttggctagtaagttcgaccatatcagcagccagggcct

SEQ ID NO: 367043 - DNA, 140 bp, Artificial Sequence
  Synthetic
aggccctggctgctgatatgtatcagcaggcaataacagatatatgtcaattttctgagtacacgcccaacaaagatagtgttttaaaagactgccttcaaattatacggaaaaaccctagaccttttgggacagcggtg

SEQ ID NO: 367044 - DNA, 140 bp, Artificial Sequence
  Synthetic
caccgctgtcccaaaaggtctagggtttttccgtataatttgaaggcagtcttttaaaacactatctttgttgggcgtgtactcagaaaattgacatatatctgttattgcctgctgatacatatcagcagccagggcct

SEQ ID NO: 367045 - DNA, 140 bp, Artificial Sequence
  Synthetic
atacgccatgctgggtctcccagaaggctcaggggaaacgaccccacccacaaacaccacccaggactcgcccccgctagagaccacaccagaacgctctgcaacaaccgccacaagcaccgtacttgggagtcggccat

SEQ ID NO: 367046 - DNA, 140 bp, Artificial Sequence
  Synthetic
atggccgactcccaagtacggtgcttgtggcggttgttgcagagcgttctggtgtggtctctagcgggggcgagtcctgggtggtgtttgtgggtggggtcgtttcccctgagccttctgggagacccagcatggcgtat

SEQ ID NO: 367047 - DNA, 140 bp, Artificial Sequence
  Synthetic
aggccctggctgctgatatgtgcacatggagacacaccacaattagacttgaaggccagaccaacttatggtgcaggggaggttactgtactagtggaggttgctgacatggagctgcacgaccttttgggacagcggtg

SEQ ID NO: 367048 - DNA, 140 bp, Artificial Sequence
  Synthetic
caccgctgtcccaaaaggtcgtgcagctccatgtcagcaacctccactagtacagtaacctcccctgcaccataagttggtctggccttcaagtctaattgtggtgtgtctccatgtgcacatatcagcagccagggcct

SEQ ID NO: 367049 - DNA, 140 bp, Artificial Sequence
  Synthetic
aggccctggctgctgatatgcccccgctagagaccacaccagaacgctctgcaacaaccgccacaagcacgtcaggcacagacaacatgaattccaccacacagatgaccgataacacccgaccttttgggacagcggtg

SEQ ID NO: 367050 - DNA, 140 bp, Artificial Sequence
  Synthetic
caccgctgtcccaaaaggtcgggtgttatcggtcatctgtgtggtggaattcatgttgtctgtgcctgacgtgcttgtggcggttgttgcagagcgttctggtgtggtctctagcgggggcatatcagcagccagggcct

SEQ ID NO: 367051 - DNA, 140 bp, Artificial Sequence
  Synthetic
atacgccatgctgggtctccacataaaggaacgattattggaaagcaaaacaacacatgcacagctaaagcaagctgctggctagagtcagtcaaaagttttttctacggattgaagaatcgtacttgggagtcggccat

SEQ ID NO: 367052 - DNA, 140 bp, Artificial Sequence
  Synthetic
atggccgactcccaagtacgattcttcaatccgtagaaaaaacttttgactgactctagccagcagcttgctttagctgtgcatgtgttgttttgctttccaataatcgttcctttatgtggagacccagcatggcgtat

SEQ ID NO: 367053 - DNA, 140 bp, Artificial Sequence
  Synthetic
aggccctggctgctgatatggaactgggttagcatctctgaggtgacagaaacaacaagtatagttgcatcacctaaaacacatatgatgttgaaggattgcttcaaaactatattgggtgaccttttgggacagcggtg

SEQ ID NO: 367054 - DNA, 140 bp, Artificial Sequence
  Synthetic
caccgctgtcccaaaaggtcacccaatatagttttgaagcaatccttcaacatcatatgtgttttaggtgatgcaactatacttgttgtttctgtcacctcagagatgctaacccagttccatatcagcagccagggcct

SEQ ID NO: 367055 - DNA, 140 bp, Artificial Sequence
  Synthetic
aggccctggctgctgatatgtcatcgtaatgtgtcatattctacctacttcattatattcgtaatgcttgaaactgctattgcttcattcactctgtcctaaaccttgactgcgtgccgcgaccttttgggacagcggtg

SEQ ID NO: 367056 - DNA, 140 bp, Artificial Sequence
  Synthetic
caccgctgtcccaaaaggtcgcggcacgcagtcaaggtttaggacagagtgaatgaagcaatagcagtttcaagcattacgaatataatgaagtaggtagaatatgacacattacgatgacatatcagcagccagggcct

SEQ ID NO: 367057 - DNA, 140 bp, Artificial Sequence
  Synthetic
aggccctggctgctgatatggtgaaccttctgcactccggacaaacacactttgatgctctcagaatactgccacagtttgaggttgacacaagaggaaccttaagtctggtagacaagggaccttttgggacagcggtg

SEQ ID NO: 367058 - DNA, 140 bp, Artificial Sequence
  Synthetic
caccgctgtcccaaaaggtcccttgtctaccagacttaaggttcctcttgtgtcaacctcaaactgtggcagtattctgagagcatcaaagtgtgtttgtccggagtgcagaaggttcaccatatcagcagccagggcct

SEQ ID NO: 367059 - DNA, 140 bp, Artificial Sequence
  Synthetic
atacgccatgctgggtctcccttcagtgttcactttgattaagatgctgacagatgaatcgtcagattcagaaaagagtggccttagtccagatttgcaacaagttgcaagatactcaaacgtacttgggagtcggccat

SEQ ID NO: 367060 - DNA, 140 bp, Artificial Sequence
  Synthetic
atggccgactcccaagtacgtttgagtatcttgcaacttgttgcaaatctggactaaggccactcttttctgaatctgacgattcatctgtcagcatcttaatcaaagtgaacactgaagggagacccagcatggcgtat

SEQ ID NO: 367061 - DNA, 140 bp, Artificial Sequence
  Synthetic
atacgccatgctgggtctccttcactgcatctctgccattggatgtttacctttgagtcaagcagacaagtcttcactacttatgagcttcttaaactggagggtcaacatggacattagcgtacttgggagtcggccat

SEQ ID NO: 367062 - DNA, 140 bp, Artificial Sequence
  Synthetic
atggccgactcccaagtacgctaatgtccatgttgaccctccagtttaagaagctcataagtagtgaagacttgtctgcttgactcaaaggtaaacatccaatggcagagatgcagtgaaggagacccagcatggcgtat

SEQ ID NO: 367063 - DNA, 140 bp, Artificial Sequence
  Synthetic
aggccctggctgctgatatgtgcttagtactgtggatggtctaacagatcagcaaaaggaaaacattgtgaacggaatatttgagccttcaaagttgtccttttaccactggaaagaattgaccttttgggacagcggtg

SEQ ID NO: 367064 - DNA, 140 bp, Artificial Sequence
  Synthetic
caccgctgtcccaaaaggtcaattctttccagtggtaaaaggacaactttgaaggctcaaatattccgttcacaatgttttccttttgctgatctgttagaccatccacagtactaagcacatatcagcagccagggcct

SEQ ID NO: 367065 - DNA, 140 bp, Artificial Sequence
  Synthetic
atacgccatgctgggtctcctgctttcttggatgagcaagaggaggactgaggtaataactaaagaacagcaccaactgtttctaagtcttctcccacagtctcatgagtgtttacaaaacgtacttgggagtcggccat

SEQ ID NO: 367066 - DNA, 140 bp, Artificial Sequence
  Synthetic
atggccgactcccaagtacgttttgtaaacactcatgagactgtgggagaagacttagaaacagttggtgctgttctttagttattacctcagtcctcctcttgctcatccaagaaagcaggagacccagcatggcgtat

SEQ ID NO: 367067 - DNA, 140 bp, Artificial Sequence
  Synthetic
aggccctggctgctgatatgccacctgatgaggaagcagaagccctcagaacaggcaatcttggcttcaactgggattcagactgaatgtgctgtctatgtgtgtcatcaacaccttttggaccttttgggacagcggtg

SEQ ID NO: 367068 - DNA, 140 bp, Artificial Sequence
  Synthetic
caccgctgtcccaaaaggtccaaaaggtgttgatgacacacatagacagcacattcagtctgaatcccagttgaagccaagattgcctgttctgagggcttctgcttcctcatcaggtggcatatcagcagccagggcct

SEQ ID NO: 367069 - DNA, 140 bp, Artificial Sequence
  Synthetic
atacgccatgctgggtctcccaaatcgggaggtgtcaggcaacggaacactgaagtgctcttcagagagaagttaaacaaggttgttataagagacaatcttgagcaaggtgtggaagagcgtacttgggagtcggccat

SEQ ID NO: 367070 - DNA, 140 bp, Artificial Sequence
  Synthetic
atggccgactcccaagtacgctcttccacaccttgctcaagattgtctcttataacaaccttgtttaacttctctctgaagagcacttcagtgttccgttgcctgacacctcccgatttgggagacccagcatggcgtat

SEQ ID NO: 367071 - DNA, 140 bp, Artificial Sequence
  Synthetic
aggccctggctgctgatatgaagaaactcagattcatgaacatacattctccagaactgatgccagaaaactgtctcttttctaatgaggagtttaacgagctgatcaagttaaaaaagcgaccttttgggacagcggtg

SEQ ID NO: 367072 - DNA, 140 bp, Artificial Sequence
  Synthetic
caccgctgtcccaaaaggtcgcttttttaacttgatcagctcgttaaactcctcattagaaaagagacagttttctggcatcagttctggagaatgtatgttcatgaatctgagtttcttcatatcagcagccagggcct

SEQ ID NO: 367073 - DNA, 140 bp, Artificial Sequence
  Synthetic
atacgccatgctgggtctccagagactcaaattcatgaatgtacactctccagaattgatgccggaaaattgtctcttttctagtgaggaattcaacgagttgattaagctgaagaaactcgtacttgggagtcggccat

SEQ ID NO: 367074 - DNA, 140 bp, Artificial Sequence
  Synthetic
atggccgactcccaagtacgagtttcttcagcttaatcaactcgttgaattcctcactagaaaagagacaattttccggcatcaattctggagagtgtacattcatgaatttgagtctctggagacccagcatggcgtat

SEQ ID NO: 367075 - DNA, 140 bp, Artificial Sequence
  Synthetic
aggccctggctgctgatatggcctcaatgtttcgacagaagaatactcggctgaggtgtctagactcaaacaaacactaacagcccgaaatgttctgcatggattggctggcggaattaagaccttttgggacagcggtg

SEQ ID NO: 367076 - DNA, 140 bp, Artificial Sequence
  Synthetic
caccgctgtcccaaaaggtcttaattccgccagccaatccatgcagaacatttcgggctgttagtgtttgtttgagtctagacacctcagccgagtattcttctgtcgaaacattgaggccatatcagcagccagggcct

SEQ ID NO: 367077 - DNA, 140 bp, Artificial Sequence
  Synthetic
atacgccatgctgggtctccaaggacaaatgaggcagttttagctgcaccattcattgacattaaagccttcaaacaagctaaccactctgcatacttctcagtcaactcaattgcttcacgtacttgggagtcggccat

SEQ ID NO: 367078 - DNA, 140 bp, Artificial Sequence
  Synthetic
atggccgactcccaagtacgtgaagcaattgagttgactgagaagtatgcagagtggttagcttgtttgaaggctttaatgtcaatgaatggtgcagctaaaactgcctcatttgtccttggagacccagcatggcgtat

SEQ ID NO: 367079 - DNA, 140 bp, Artificial Sequence
  Synthetic
atacgccatgctgggtctccactgatctattttactagcttatcgaacctctctttcttaaccattcatttcagcttcattgtcatcgttattatcttggggtgtggggggaacgatttccgtacttgggagtcggccat

SEQ ID NO: 367080 - DNA, 140 bp, Artificial Sequence
  Synthetic
atggccgactcccaagtacggaaatcgttccccccacaccccaagataataacgatgacaatgaagctgaaatgaatggttaagaaagagaggttcgataagctagtaaaatagatcagtggagacccagcatggcgtat

SEQ ID NO: 367081 - DNA, 140 bp, Artificial Sequence
  Synthetic
atacgccatgctgggtctccccttaactgcaatgctcaatcatgcttattttacttgcttatataactttattttattaacctttctctattttcttttgttctaaacacttaaagggctcgtacttgggagtcggccat

SEQ ID NO: 367082 - DNA, 140 bp, Artificial Sequence
  Synthetic
atggccgactcccaagtacgagccctttaagtgtttagaacaaaagaaaatagagaaaggttaataaaataaagttatataagcaagtaaaataagcatgattgagcattgcagttaaggggagacccagcatggcgtat

SEQ ID NO: 367083 - DNA, 140 bp, Artificial Sequence
  Synthetic
atacgccatgctgggtctcctctcaaagaaatacttgcggcacgtcagtacgtaagtgtcaactttgagagagtggattgtgcatcccgaatgcaccatgcccatcaacattatgcataccgtacttgggagtcggccat

SEQ ID NO: 367084 - DNA, 140 bp, Artificial Sequence
  Synthetic
atggccgactcccaagtacggtatgcataatgttgatgggcatggtgcattcgggatgcacaatccactctctcaaagttgacacttacgtactgacgtgccgcaagtatttctttgagaggagacccagcatggcgtat

SEQ ID NO: 367085 - DNA, 140 bp, Artificial Sequence
  Synthetic
aggccctggctgctgatatgctcatggacagtcaaacgcaactgaacacaatggaacaaacaccaccacagcacccggcacaagtcaaagccccaagccacccgcgagcacaaccccatcgaccttttgggacagcggtg

SEQ ID NO: 367086 - DNA, 140 bp, Artificial Sequence
  Synthetic
caccgctgtcccaaaaggtcgatggggttgtgctcgcgggtggcttggggctttgacttgtgccgggtgctgtggtggtgtttgttccattgtgttcagttgcgtttgactgtccatgagcatatcagcagccagggcct

SEQ ID NO: 367087 - DNA, 140 bp, Artificial Sequence
  Synthetic
aggccctggctgctgatatgacagttgggacgggaacgacacagttaagtttttggttacaacttatataagcaaaggactcatggcgttaaacagttacaaccatatgggtcagggtatgaccttttgggacagcggtg

SEQ ID NO: 367088 - DNA, 140 bp, Artificial Sequence
  Synthetic
caccgctgtcccaaaaggtcataccctgacccatatggttgtaactgtttaacgccatgagtcctttgcttatataagttgtaaccaaaaacttaactgtgtcgttcccgtcccaactgtcatatcagcagccagggcct

SEQ ID NO: 367089 - DNA, 140 bp, Artificial Sequence
  Synthetic
aggccctggctgctgatatgcaatgaaaaagttcaaaagttcatttaccgcctctctgaagagctatatgacataaggcttcaacacttggaactgtcaaagctcaaacaagaacaccccgaccttttgggacagcggtg

SEQ ID NO: 367090 - DNA, 140 bp, Artificial Sequence
  Synthetic
caccgctgtcccaaaaggtcggggtgttcttgtttgagctttgacagttccaagtgttgaagccttatgtcatatagctcttcagagaggcggtaaatgaacttttgaactttttcattgcatatcagcagccagggcct

SEQ ID NO: 367091 - DNA, 140 bp, Artificial Sequence
  Synthetic
atacgccatgctgggtctccacatcacaaggcatgcaccatcccgtaaggagtctattgtcagtctcgagccccaagacagcaacaacaccaacaccaatgagccctggagagatgagctcgtacttgggagtcggccat

SEQ ID NO: 367092 - DNA, 140 bp, Artificial Sequence
  Synthetic
atggccgactcccaagtacgagctcatctctccagggctcattggtgttggtgttgttgctgtcttggggctcgagactgacaatagactccttacgggatggtgcatgccttgtgatgtggagacccagcatggcgtat

SEQ ID NO: 367093 - DNA, 140 bp, Artificial Sequence
  Synthetic
aggccctggctgctgatatgccccaagacagcaacaacaccaacaccaatgagccctggagagatgagctcggaaaccagcagtcagcactcagccatgagcagaacaccaaccccccacgaccttttgggacagcggtg

SEQ ID NO: 367094 - DNA, 140 bp, Artificial Sequence
  Synthetic
caccgctgtcccaaaaggtcgtggggggttggtgttctgctcatggctgagtgctgactgctggtttccgagctcatctctccagggctcattggtgttggtgttgttgctgtcttggggcatatcagcagccagggcct

SEQ ID NO: 367095 - DNA, 140 bp, Artificial Sequence
  Synthetic
atacgccatgctgggtctccgtctgagtcctcagcacagccggcaacccaaagcccagtgacttccccagcgcaatcaatccttctgatgagtgctactcccacaaccattcagaacatacgtacttgggagtcggccat

SEQ ID NO: 367096 - DNA, 140 bp, Artificial Sequence
  Synthetic
atggccgactcccaagtacgtatgttctgaatggttgtgggagtagcactcatcagaaggattgattgcgctggggaagtcactgggctttgggttgccggctgtgctgaggactcagacggagacccagcatggcgtat

SEQ ID NO: 367097 - DNA, 140 bp, Artificial Sequence
  Synthetic
aggccctggctgctgatatgcgcaatcaatccttctgatgagtgctactcccacaaccattcagaacatacatcccagcccaacaaacaggtctaagaggaaccttgagatggaaataatgaccttttgggacagcggtg

SEQ ID NO: 367098 - DNA, 140 bp, Artificial Sequence
  Synthetic
caccgctgtcccaaaaggtcattatttccatctcaaggttcctcttagacctgtttgttgggctgggatgtatgttctgaatggttgtgggagtagcactcatcagaaggattgattgcgcatatcagcagccagggcct

SEQ ID NO: 367099 - DNA, 140 bp, Artificial Sequence
  Synthetic
atacgccatgctgggtctccttctgcaccttaccttggaagaggacactgaaggcttgttggaatggtgtaagagaaaccttgggtcgaactgtgatgatgacttctttcaaaagaggatcgtacttgggagtcggccat

SEQ ID NO: 367100 - DNA, 140 bp, Artificial Sequence
  Synthetic
atggccgactcccaagtacgatcctcttttgaaagaagtcatcatcacagttcgacccaaggtttctcttacaccattccaacaagccttcagtgtcctcttccaaggtaaggtgcagaaggagacccagcatggcgtat

SEQ ID NO: 367101 - DNA, 140 bp, Artificial Sequence
  Synthetic
atacgccatgctgggtctccagaagaattcttcataactggtgagggctacttcaacgaagttctacagtttaaaacactaagcacaccaagctccacggagccgtctcatgccaggctacgtacttgggagtcggccat

SEQ ID NO: 367102 - DNA, 140 bp, Artificial Sequence
  Synthetic
atggccgactcccaagtacgtagcctggcatgagacggctccgtggagcttggtgtgcttagtgttttaaactgtagaacttcgttgaagtagccctcaccagttatgaagaattcttctggagacccagcatggcgtat

SEQ ID NO: 367103 - DNA, 140 bp, Artificial Sequence
  Synthetic
atacgccatgctgggtctccagattcgggttacttctctgccaaatgttatccaagatcatccacttcagggcttcagctgatcaatgtcacccaacacccagctaggatagcagagacacgtacttgggagtcggccat

SEQ ID NO: 367104 - DNA, 140 bp, Artificial Sequence
  Synthetic
atggccgactcccaagtacgtgtctctgctatcctagctgggtgttgggtgacattgatcagctgaagccctgaagtggatgatcttggataacatttggcagagaagtaacccgaatctggagacccagcatggcgtat

SEQ ID NO: 367105 - DNA, 140 bp, Artificial Sequence
  Synthetic
aggccctggctgctgatatgggcttcagctgatcaatgtcacccaacacccagctaggatagcagagacacctggacccaaaacaacgagtctgaaaaccatcaactgcatcaatctaaggaccttttgggacagcggtg

SEQ ID NO: 367106 - DNA, 140 bp, Artificial Sequence
  Synthetic
caccgctgtcccaaaaggtccttagattgatgcagttgatggttttcagactcgttgttttgggtccaggtgtctctgctatcctagctgggtgttgggtgacattgatcagctgaagcccatatcagcagccagggcct

SEQ ID NO: 367107 - DNA, 140 bp, Artificial Sequence
  Synthetic
atacgccatgctgggtctccttagcacagccttgtctggaaagaaggtgcacaaggttcttggtaacttaggaaatgaactgttgtataaggcacccagaaaggccttggcaaccgtctgcgtacttgggagtcggccat

SEQ ID NO: 367108 - DNA, 140 bp, Artificial Sequence
  Synthetic
atggccgactcccaagtacgcagacggttgccaaggcctttctgggtgccttatacaacagttcatttcctaagttaccaagaaccttgtgcaccttctttccagacaaggctgtgctaaggagacccagcatggcgtat

SEQ ID NO: 367109 - DNA, 140 bp, Artificial Sequence
  Synthetic
atacgccatgctgggtctccaaaggaagagaagttcgtaagggccaatcagtgctgaggcagtacaaaacagaaattaagataggcaaggcaccaacaggctctaggaaactactgtccgcgtacttgggagtcggccat

SEQ ID NO: 367110 - DNA, 140 bp, Artificial Sequence
  Synthetic
atggccgactcccaagtacgcggacagtagtttcctagagcctgttggtgccttgcctatcttaatttctgttttgtactgcctcagcactgattggcccttacgaacttctcttcctttggagacccagcatggcgtat

SEQ ID NO: 367111 - DNA, 140 bp, Artificial Sequence
  Synthetic
atacgccatgctgggtctccacagcagagatccatgacgataactatggtggtccaggtgacaaaataactatctgcaatggttcaaccattgtagatcagagactgggcagtgaactagcgtacttgggagtcggccat

SEQ ID NO: 367112 - DNA, 140 bp, Artificial Sequence
  Synthetic
atggccgactcccaagtacgctagttcactgcccagtctctgatctacaatggttgaaccattgcagatagttattttgtcacctggaccaccatagttatcgtcatggatctctgctgtggagacccagcatggcgtat

SEQ ID NO: 367113 - DNA, 140 bp, Artificial Sequence
  Synthetic
aggccctggctgctgatatgcttggcagtgtttttggtaattttttcataggcattttgttattccttgccccctttgtcctgttagtacttttctttatgtttggatggaaaatcttgtgaccttttgggacagcggtg

SEQ ID NO: 367114 - DNA, 140 bp, Artificial Sequence
  Synthetic
caccgctgtcccaaaaggtcacaagattttccatccaaacataaagaaaagtactaacaggacaaagggggcaaggaataacaaaatgcctatgaaaaaattaccaaaaacactgccaagcatatcagcagccagggcct

SEQ ID NO: 367115 - DNA, 140 bp, Artificial Sequence
  Synthetic
atacgccatgctgggtctccctagaggctcagaggttgtcttggacgcttgcgactcaaactgtgaagtaatgatacctaaaggcactggagatatcctagtggactgttcaggtggacacgtacttgggagtcggccat

SEQ ID NO: 367116 - DNA, 140 bp, Artificial Sequence
  Synthetic
atggccgactcccaagtacgtgtccacctgaacagtccactaggatatctccagtgcctttaggtatcattacttcacagtttgagtcgcaagcgtccaagacaacctctgagcctctagggagacccagcatggcgtat

SEQ ID NO: 367117 - DNA, 140 bp, Artificial Sequence
  Synthetic
aggccctggctgctgatatgatgatacctaaaggcactggagatatcctagtggactgttcaggtggacagcagcatttcttaaaagacaacttgattgacctggggtgccctcatatccgaccttttgggacagcggtg

SEQ ID NO: 367118 - DNA, 140 bp, Artificial Sequence
  Synthetic
caccgctgtcccaaaaggtcggatatgagggcaccccaggtcaatcaagttgtcttttaagaaatgctgctgtccacctgaacagtccactaggatatctccagtgcctttaggtatcatcatatcagcagccagggcct

SEQ ID NO: 367119 - DNA, 140 bp, Artificial Sequence
  Synthetic
aggccctggctgctgatatgagaagttaaacaaggttgttataaaagacaatcttgagcaaggtgtggaagaggagattgagttttgcaacaacctaactaagactgtttcagagaacccgaccttttgggacagcggtg

SEQ ID NO: 367120 - DNA, 140 bp, Artificial Sequence
  Synthetic
caccgctgtcccaaaaggtcgggttctctgaaacagtcttagttaggttgttgcaaaactcaatctcctcttccacaccttgctcaagattgtcttttataacaaccttgtttaacttctcatatcagcagccagggcct

SEQ ID NO: 367121 - DNA, 140 bp, Artificial Sequence
  Synthetic
atacgccatgctgggtctcccaactgtagttacaatatatgcccttattgtgcatcaagattgacctccgatgggctagctaggcatgtaaagcaatgccctaagcgaaaggagaaagtccgtacttgggagtcggccat

SEQ ID NO: 367122 - DNA, 140 bp, Artificial Sequence
  Synthetic
atggccgactcccaagtacggactttctcctttcgcttagggcattgctttacatgcctagctagcccatcggaggtcaatcttgatgcacaataagggcatatattgtaactacagttgggagacccagcatggcgtat

SEQ ID NO: 367123 - DNA, 140 bp, Artificial Sequence
  Synthetic
atacgccatgctgggtctcctatatcaaaaagatgacgaagaaccggcaaacaacacaagtttgaagcttggctttctagtgaagtacgctgtcactctgttcacatccaatggtgagcccgtacttgggagtcggccat

SEQ ID NO: 367124 - DNA, 140 bp, Artificial Sequence
  Synthetic
atggccgactcccaagtacgggctcaccattggatgtgaacagagtgacagcgtacttcactagaaagccaagcttcaaacttgtgttgtttgccggttcttcgtcatctttttgatataggagacccagcatggcgtat

SEQ ID NO: 367125 - DNA, 140 bp, Artificial Sequence
  Synthetic
atacgccatgctgggtctccaaagctattgcaagtgtcagagtccactggtgtggcattgaaacgaagcagttggctgattgtgctgcttgtgttactcacagtttcattgtcaccggttcgtacttgggagtcggccat

SEQ ID NO: 367126 - DNA, 140 bp, Artificial Sequence
  Synthetic
atggccgactcccaagtacgaaccggtgacaatgaaactgtgagtaacacaagcagcacaatcagccaactgcttcgtttcaatgccacaccagtggactctgacacttgcaatagctttggagacccagcatggcgtat

SEQ ID NO: 367127 - DNA, 140 bp, Artificial Sequence
  Synthetic
aggccctggctgctgatatggttggctgattgtgctgcttgtgttactcacagtttcattgtcaccggttcaatcagcacctgttggtcatggtaagacgatcgaaacatatcagaccaggaccttttgggacagcggtg

SEQ ID NO: 367128 - DNA, 140 bp, Artificial Sequence
  Synthetic
caccgctgtcccaaaaggtcctggtctgatatgtttcgatcgtcttaccatgaccaacaggtgctgattgaaccggtgacaatgaaactgtgagtaacacaagcagcacaatcagccaaccatatcagcagccagggcct

SEQ ID NO: 367129 - DNA, 140 bp, Artificial Sequence
  Synthetic
atacgccatgctgggtctcctagtctcttgcttggtgaaagggctggttgacagtgtcagtgacagcttcttccccggcctgtctgtctgcaagacatgctccattggcagtataaatggcgtacttgggagtcggccat

SEQ ID NO: 367130 - DNA, 140 bp, Artificial Sequence
  Synthetic
atggccgactcccaagtacgccatttatactgccaatggagcatgtcttgcagacagacaggccggggaagaagctgtcactgacactgtcaaccagccctttcaccaagcaagagactaggagacccagcatggcgtat

SEQ ID NO: 367131 - DNA, 140 bp, Artificial Sequence
  Synthetic
aggccctggctgctgatatgtaacactgacgttgagtttaaccacagggaaatagccgatctcaaccaattgacttctcggcttattacgttgagaaaagaaaaggacactgaccttctcgaccttttgggacagcggtg

SEQ ID NO: 367132 - DNA, 140 bp, Artificial Sequence
  Synthetic
caccgctgtcccaaaaggtcgagaaggtcagtgtccttttcttttctcaacgtaataagccgagaagtcaattggttgagatcggctatttccctgtggttaaactcaacgtcagtgttacatatcagcagccagggcct

SEQ ID NO: 367133 - DNA, 140 bp, Artificial Sequence
  Synthetic
atacgccatgctgggtctccccctttacccacgttaacacagacagctttagtagtgtttttcctgtccttgtttaaccatggactttttgagaaaccttgactggactcaggtaattgccgtacttgggagtcggccat

SEQ ID NO: 367134 - DNA, 140 bp, Artificial Sequence
  Synthetic
atggccgactcccaagtacggcaattacctgagtccagtcaaggtttctcaaaaagtccatggttaaacaaggacaggaaaaacactactaaagctgtctgtgttaacgtgggtaaagggggagacccagcatggcgtat

SEQ ID NO: 367135 - DNA, 140 bp, Artificial Sequence
  Synthetic
atacgccatgctgggtctccatctgcaaaaaaagaaaaacggggagcaatgtcatgctagctgtctgcaagcgcatgtgctttagggcaaccatagaagcaagcagaagagccctgctcacgtacttgggagtcggccat

SEQ ID NO: 367136 - DNA, 140 bp, Artificial Sequence
  Synthetic
atggccgactcccaagtacgtgagcagggctcttctgcttgcttctatggttgccctaaagcacatgcgcttgcagacagctagcatgacattgctccccgtttttctttttttgcagatggagacccagcatggcgtat

SEQ ID NO: 367137 - DNA, 140 bp, Artificial Sequence
  Synthetic
aggccctggctgctgatatggcgcatgtgctttagggcaaccatagaagcaagcagaagagccctgctcatccgaagtattatcaataccacttttgtaatatgcattctaacattaacagaccttttgggacagcggtg

SEQ ID NO: 367138 - DNA, 140 bp, Artificial Sequence
  Synthetic
caccgctgtcccaaaaggtctgttaatgttagaatgcatattacaaaagtggtattgataatacttcggatgagcagggctcttctgcttgcttctatggttgccctaaagcacatgcgccatatcagcagccagggcct

SEQ ID NO: 367139 - DNA, 140 bp, Artificial Sequence
  Synthetic
atacgccatgctgggtctcccacctgggagagagaggaagacctgacaaatttttgtcatcaggaatgccaggtaaccgagacggaatgcctttgtccatacgaagctcttgtgctcaggcgtacttgggagtcggccat

SEQ ID NO: 367140 - DNA, 140 bp, Artificial Sequence
  Synthetic
atggccgactcccaagtacgcctgagcacaagagcttcgtatggacaaaggcattccgtctcggttacctggcattcctgatgacaaaaatttgtcaggtcttcctctctctcccaggtgggagacccagcatggcgtat

SEQ ID NO: 367141 - DNA, 140 bp, Artificial Sequence
  Synthetic
aggccctggctgctgatatggcaaaatggagaataaaatcgaggtgaataacaaagatgaaatgaacaagtggtttgaagagttcaagaaaggaaatggacttgtggatactttcacaaagaccttttgggacagcggtg

SEQ ID NO: 367142 - DNA, 140 bp, Artificial Sequence
  Synthetic
caccgctgtcccaaaaggtctttgtgaaagtatccacaagtccatttcctttcttgaactcttcaaaccacttgttcatttcatctttgttattcacctcgattttattctccattttgccatatcagcagccagggcct

SEQ ID NO: 367143 - DNA, 140 bp, Artificial Sequence
  Synthetic
atacgccatgctgggtctccgagtggggatcgactcttgaggcatcaatgctggctaaagaaatgggcgtcactatcatcatttggactgttactgccagtgatgaagtggaagcaggcacgtacttgggagtcggccat

SEQ ID NO: 367144 - DNA, 140 bp, Artificial Sequence
  Synthetic
atggccgactcccaagtacgtgcctgcttccacttcatcactggcagtaacagtccaaatgatgatagtgacgcccatttctttagccagcattgatgcctcaagagtcgatccccactcggagacccagcatggcgtat

SEQ ID NO: 367145 - DNA, 140 bp, Artificial Sequence
  Synthetic
atacgccatgctgggtctcctaaatgtccagtcaaccttcaaaccaacagtgtcgactgcgaacatagcactcagttggagctcagtggaacacagaggcaacaagatcttagtcacaggcgtacttgggagtcggccat

SEQ ID NO: 367146 - DNA, 140 bp, Artificial Sequence
  Synthetic
atggccgactcccaagtacgcctgtgactaagatcttgttgcctctgtgttccactgagctccaactgagtgctatgttcgcagtcgacactgttggtttgaaggttgactggacatttaggagacccagcatggcgtat

SEQ ID NO: 367147 - DNA, 140 bp, Artificial Sequence
  Synthetic
aggccctggctgctgatatgctcagttggagctcagtggaacacagaggcaacaagatcttagtcacaggcaggtctgagtcaattatgaaactagaggaaaggacaggaatcagctggggaccttttgggacagcggtg

SEQ ID NO: 367148 - DNA, 140 bp, Artificial Sequence
  Synthetic
caccgctgtcccaaaaggtccccagctgattcctgtcctttcctctagtttcataattgactcagacctgcctgtgactaagatcttgttgcctctgtgttccactgagctccaactgagcatatcagcagccagggcct

SEQ ID NO: 367149 - DNA, 140 bp, Artificial Sequence
  Synthetic
atacgccatgctgggtctccatggatttgtcacagatgtattccccagtttttgagtacttgtcaggggacagacaggttgaagaatggcccaaagcaacttgcacaggtgactgcccaccgtacttgggagtcggccat

SEQ ID NO: 367150 - DNA, 140 bp, Artificial Sequence
  Synthetic
atggccgactcccaagtacggtgggcagtcacctgtgcaagttgctttgggccattcttcaacctgtctgtcccctgacaagtactcaaaaactggggaatacatctgtgacaaatccatggagacccagcatggcgtat

SEQ ID NO: 367151 - DNA, 140 bp, Artificial Sequence
  Synthetic
aggccctggctgctgatatgcactctatctaagaaacaagcagagatattgaggcaaaaggcatctcagttgtctaaactggttaataaaagtcagaacataccgacgagagtcggcagggaccttttgggacagcggtg

SEQ ID NO: 367152 - DNA, 140 bp, Artificial Sequence
  Synthetic
caccgctgtcccaaaaggtccctgccgactctcgtcggtatgttctgacttttattaaccagtttagacaactgagatgccttttgcctcaatatctctgcttgtttcttagatagagtgcatatcagcagccagggcct

SEQ ID NO: 367153 - DNA, 140 bp, Artificial Sequence
  Synthetic
atacgccatgctgggtctcctgcaaatgcagaagagttcgtcatatctgagttttttaagaagaaggacattatgaaattcattagtacctcaggcagggcaatgagtgcaggcaaaattcgtacttgggagtcggccat

SEQ ID NO: 367154 - DNA, 140 bp, Artificial Sequence
  Synthetic
atggccgactcccaagtacgaattttgcctgcactcattgccctgcctgaggtactaatgaatttcataatgtccttcttcttaaaaaactcagatatgacgaactcttctgcatttgcaggagacccagcatggcgtat

SEQ ID NO: 367155 - DNA, 140 bp, Artificial Sequence
  Synthetic
atacgccatgctgggtctcccaccctgatcctgcgaccagaatccaaagagagaattggtgaagttatgtcgttgcggcagctagggcataagttactaacacgagacaaacaaattaagcgtacttgggagtcggccat

SEQ ID NO: 367156 - DNA, 140 bp, Artificial Sequence
  Synthetic
atggccgactcccaagtacgcttaatttgtttgtctcgtgttagtaacttatgccctagctgccgcaacgacataacttcaccaattctctctttggattctggtcgcaggatcagggtgggagacccagcatggcgtat

SEQ ID NO: 367157 - DNA, 140 bp, Artificial Sequence
  Synthetic
aggccctggctgctgatatgcgttgcggcagctagggcataagttactaacacgagacaaacaaattaagcaagaattctctagaatgaagctttatgtcaccaaggatttgcttgaccagaccttttgggacagcggtg

SEQ ID NO: 367158 - DNA, 140 bp, Artificial Sequence
  Synthetic
caccgctgtcccaaaaggtctggtcaagcaaatccttggtgacataaagcttcattctagagaattcttgcttaatttgtttgtctcgtgttagtaacttatgccctagctgccgcaacgcatatcagcagccagggcct

SEQ ID NO: 367159 - DNA, 140 bp, Artificial Sequence
  Synthetic
atacgccatgctgggtctccgagctcaccagccaagaaagacagtgcagtctgattgaggcaggtactagattcaacttgggccctgtgactattaccctgtctgagccaagaaacattccgtacttgggagtcggccat

SEQ ID NO: 367160 - DNA, 140 bp, Artificial Sequence
  Synthetic
atggccgactcccaagtacggaatgtttcttggctcagacagggtaatagtcacagggcccaagttgaatctagtacctgcctcaatcagactgcactgtctttcttggctggtgagctcggagacccagcatggcgtat

SEQ ID NO: 367161 - DNA, 140 bp, Artificial Sequence
  Synthetic
aggccctggctgctgatatgaaagacacatgcagttgctgcactccgagatgatactagacatttgtactgtatcacttggcatcatgttgtcaacatttctatacggctctaacaacaagaccttttgggacagcggtg

SEQ ID NO: 367162 - DNA, 140 bp, Artificial Sequence
  Synthetic
caccgctgtcccaaaaggtcttgttgttagagccgtatagaaatgttgacaacatgatgccaagtgatacagtacaaatgtctagtatcatctcggagtgcagcaactgcatgtgtctttcatatcagcagccagggcct

SEQ ID NO: 367163 - DNA, 140 bp, Artificial Sequence
  Synthetic
aggccctggctgctgatatgttatgaaattcattagtacctcaggcagggcaatgagtgcaggcaaaattggtaatgtcctttcctatgcacataacctttatttgagcaagtccagcctgaccttttgggacagcggtg

SEQ ID NO: 367164 - DNA, 140 bp, Artificial Sequence
  Synthetic
caccgctgtcccaaaaggtcaggctggacttgctcaaataaaggttatgtgcataggaaaggacattaccaattttgcctgcactcattgccctgcctgaggtactaatgaatttcataacatatcagcagccagggcct

SEQ ID NO: 367165 - DNA, 140 bp, Artificial Sequence
  Synthetic
atacgccatgctgggtctccgaaagaaggtgtacaaagttcttggcaacttaggaaatgaactgttgtataaggcacctagaaaagccctagcaaccgtttgtagtgccttgttcgggaacgtacttgggagtcggccat

SEQ ID NO: 367166 - DNA, 140 bp, Artificial Sequence
  Synthetic
atggccgactcccaagtacgttcccgaacaaggcactacaaacggttgctagggcttttctaggtgccttatacaacagttcatttcctaagttgccaagaactttgtacaccttctttcggagacccagcatggcgtat

SEQ ID NO: 367167 - DNA, 140 bp, Artificial Sequence
  Synthetic
aggccctggctgctgatatgaaggcacctagaaaagccctagcaaccgtttgtagtgccttgttcgggaagcagataaacaagcttcagaactgcttcaggaccataagccctgtcagccgaccttttgggacagcggtg

SEQ ID NO: 367168 - DNA, 140 bp, Artificial Sequence
  Synthetic
caccgctgtcccaaaaggtcggctgacagggcttatggtcctgaagcagttctgaagcttgtttatctgcttcccgaacaaggcactacaaacggttgctagggcttttctaggtgccttcatatcagcagccagggcct

SEQ ID NO: 367169 - DNA, 140 bp, Artificial Sequence
  Synthetic
atacgccatgctgggtctcctgacttagactactactgcaacatgggggactggccttcttgtacatacacaggagtgacccagcataatcatgctgcatttgtaaacttgctcaacattcgtacttgggagtcggccat

SEQ ID NO: 367170 - DNA, 140 bp, Artificial Sequence
  Synthetic
atggccgactcccaagtacgaatgttgagcaagtttacaaatgcagcatgattatgctgggtcactcctgtgtatgtacaagaaggccagtcccccatgttgcagtagtagtctaagtcaggagacccagcatggcgtat

SEQ ID NO: 367171 - DNA, 140 bp, Artificial Sequence
  Synthetic
atacgccatgctgggtctccaatggtatgatagaaaatatgtctaaattagacaacactgatgttgagtttaaccatagagagatagctgatcttaaccagctaacttctcggcttattacgtacttgggagtcggccat

SEQ ID NO: 367172 - DNA, 140 bp, Artificial Sequence
  Synthetic
atggccgactcccaagtacgtaataagccgagaagttagctggttaagatcagctatctctctatggttaaactcaacatcagtgttgtctaatttagacatattttctatcataccattggagacccagcatggcgtat

SEQ ID NO: 367173 - DNA, 140 bp, Artificial Sequence
  Synthetic
aggccctggctgctgatatgtaaccatagagagatagctgatcttaaccagctaacttctcggcttattacgttaagaaaggaaaaggacgctgacctcctcaagcaatggtttcctgaagaccttttgggacagcggtg

SEQ ID NO: 367174 - DNA, 140 bp, Artificial Sequence
  Synthetic
caccgctgtcccaaaaggtcttcaggaaaccattgcttgaggaggtcagcgtccttttcctttcttaacgtaataagccgagaagttagctggttaagatcagctatctctctatggttacatatcagcagccagggcct

SEQ ID NO: 367175 - DNA, 140 bp, Artificial Sequence
  Synthetic
aggccctggctgctgatatgcaggagagatcactgtgctggttgaggttgctgacatggagttgcataccaagaaagttgagatatcgggcttgaaatttgcaagtctggcttgcacagggaccttttgggacagcggtg

SEQ ID NO: 367176 - DNA, 140 bp, Artificial Sequence
  Synthetic
caccgctgtcccaaaaggtccctgtgcaagccagacttgcaaatttcaagcccgatatctcaactttcttggtatgcaactccatgtcagcaacctcaaccagcacagtgatctctcctgcatatcagcagccagggcct

SEQ ID NO: 367177 - DNA, 140 bp, Artificial Sequence
  Synthetic
atacgccatgctgggtctcctatcatatctgagttctttaagaagaaggacatcatgaaattcattagcacctcaggcagagcaatgagtgcaggcaaaattggtaacgtcctctcttatcgtacttgggagtcggccat

SEQ ID NO: 367178 - DNA, 140 bp, Artificial Sequence
  Synthetic
atggccgactcccaagtacgataagagaggacgttaccaattttgcctgcactcattgctctgcctgaggtgctaatgaatttcatgatgtccttcttcttaaagaactcagatatgataggagacccagcatggcgtat

SEQ ID NO: 367179 - DNA, 140 bp, Artificial Sequence
  Synthetic
atacgccatgctgggtctccatgaaccagatgagctcacagtgcatgtaaagagcagtgatccagatgtggttgcagctggcacaagcctcatggcaaggaagcttgaatttgggacagacgtacttgggagtcggccat

SEQ ID NO: 367180 - DNA, 140 bp, Artificial Sequence
  Synthetic
atggccgactcccaagtacgtctgtcccaaattcaagcttccttgccatgaggcttgtgccagctgcaaccacatctggatcactgctctttacatgcactgtgagctcatctggttcatggagacccagcatggcgtat

SEQ ID NO: 367181 - DNA, 140 bp, Artificial Sequence
  Synthetic
aggccctggctgctgatatgacattgtggagaaagaatactgcaagagctgcagtgaagatgatacaaaaaaatgtgttgacacaaaacttgagcagccacagagcatactaattgagcagaccttttgggacagcggtg

SEQ ID NO: 367182 - DNA, 140 bp, Artificial Sequence
  Synthetic
caccgctgtcccaaaaggtctgctcaattagtatgctctgtggctgctcaagttttgtgtcaacacatttttttgtatcatcttcactgcagctcttgcagtattctttctccacaatgtcatatcagcagccagggcct

SEQ ID NO: 367183 - DNA, 140 bp, Artificial Sequence
  Synthetic
atacgccatgctgggtctccggttctctttgacgacatcagaaactctccaacacacagtacagcttggaagcatgcccttcgactaaaagggaccgcgtatgagggcctgtttgcaaaccgtacttgggagtcggccat

SEQ ID NO: 367184 - DNA, 140 bp, Artificial Sequence
  Synthetic
atggccgactcccaagtacggtttgcaaacaggccctcatacgcggtcccttttagtcgaagggcatgcttccaagctgtactgtgtgttggagagtttctgatgtcgtcaaagagaaccggagacccagcatggcgtat

SEQ ID NO: 367185 - DNA, 140 bp, Artificial Sequence
  Synthetic
atacgccatgctgggtctccggcattaaattatgaacatcgcttctatgcagtattagcacctaaggcacagttgggaggagcaagagatctgttggtgcaagaaactggtacaaaagttcgtacttgggagtcggccat

SEQ ID NO: 367186 - DNA, 140 bp, Artificial Sequence
  Synthetic
atggccgactcccaagtacgaacttttgtaccagtttcttgcaccaacagatctcttgctcctcccaactgtgccttaggtgctaatactgcatagaagcgatgttcataatttaatgccggagacccagcatggcgtat

SEQ ID NO: 367187 - DNA, 140 bp, Artificial Sequence
  Synthetic
atacgccatgctgggtctcccccttttgtcctgttggtgcttttctttatgtttggatggaaaatcttgttttgctttaaatgttgcaggaggaccagaggcttgtttaagtatagacaccgtacttgggagtcggccat

SEQ ID NO: 367188 - DNA, 140 bp, Artificial Sequence
  Synthetic
atggccgactcccaagtacggtgtctatacttaaacaagcctctggtcctcctgcaacatttaaagcaaaacaagattttccatccaaacataaagaaaagcaccaacaggacaaaagggggagacccagcatggcgtat

SEQ ID NO: 367189 - DNA, 140 bp, Artificial Sequence
  Synthetic
atacgccatgctgggtctccctcaaagacgatgaggaaacaggctacagaaggattattgaaaggctgaacaacaaaaaagggaaaaatagactgcttgatggtgaaaggttggctgatacgtacttgggagtcggccat

SEQ ID NO: 367190 - DNA, 140 bp, Artificial Sequence
  Synthetic
atggccgactcccaagtacgtatcagccaacctttcaccatcaagcagtctatttttcccttttttgttgttcagcctttcaataatccttctgtagcctgtttcctcatcgtctttgagggagacccagcatggcgtat

SEQ ID NO: 367191 - DNA, 140 bp, Artificial Sequence
  Synthetic
aggccctggctgctgatatgcagaaagaaagatgttccctctacctgagactccactaagtgaggtacattcaatagagcgtatcatggaaaacttcactcgcctcatgcatggaggaaagaccttttgggacagcggtg

SEQ ID NO: 367192 - DNA, 140 bp, Artificial Sequence
  Synthetic
caccgctgtcccaaaaggtctttcctccatgcatgaggcgagtgaagttttccatgatacgctctattgaatgtacctcacttagtggagtctcaggtagagggaacatctttctttctgcatatcagcagccagggcct

SEQ ID NO: 367193 - DNA, 140 bp, Artificial Sequence
  Synthetic
atacgccatgctgggtctccagaaagaacctcgaaggttgacagcagtatgccgtctagtgcccttgcttattctagtttcgttcatcgcatccatactttacagacactgcaacacactcgtacttgggagtcggccat

SEQ ID NO: 367194 - DNA, 140 bp, Artificial Sequence
  Synthetic
atggccgactcccaagtacgagtgtgttgcagtgtctgtaaagtatggatgcgatgaacgaaactagaataagcaagggcactagacggcatactgctgtcaaccttcgaggttctttctggagacccagcatggcgtat

SEQ ID NO: 367195 - DNA, 140 bp, Artificial Sequence
  Synthetic
atacgccatgctgggtctccaaaatgccatcgaacatgagagttcaagcatcatggccttcaaggactacggagaaagaggaatagttgaggagaaccacatgaggcttagtgaagaagacgtacttgggagtcggccat

SEQ ID NO: 367196 - DNA, 140 bp, Artificial Sequence
  Synthetic
atggccgactcccaagtacgtcttcttcactaagcctcatgtggttctcctcaactattcctctttctccgtagtccttgaaggccatgatgcttgaactctcatgttcgatggcattttggagacccagcatggcgtat

SEQ ID NO: 367197 - DNA, 140 bp, Artificial Sequence
  Synthetic
atacgccatgctgggtctccctgctcgtctacaccaccagacagatggtggattactgaagacagagtacgagttttaaagaactcagtcagctttctcttcaacaagctctctaggaaccgtacttgggagtcggccat

SEQ ID NO: 367198 - DNA, 140 bp, Artificial Sequence
  Synthetic
atggccgactcccaagtacggttcctagagagcttgttgaagagaaagctgactgagttctttaaaactcgtactctgtcttcagtaatccaccatctgtctggtggtgtagacgagcagggagacccagcatggcgtat

SEQ ID NO: 367199 - DNA, 140 bp, Artificial Sequence
  Synthetic
aggccctggctgctgatatggagttttaaagaactcagtcagctttctcttcaacaagctctctaggaactcaccgacagaggtaactgatatagttgttggagccataagcactcaaaagaccttttgggacagcggtg

SEQ ID NO: 367200 - DNA, 140 bp, Artificial Sequence
  Synthetic
caccgctgtcccaaaaggtcttttgagtgcttatggctccaacaactatatcagttacctctgtcggtgagttcctagagagcttgttgaagagaaagctgactgagttctttaaaactccatatcagcagccagggcct

SEQ ID NO: 367201 - DNA, 140 bp, Artificial Sequence
  Synthetic
aggccctggctgctgatatgtcacaacatcaaacatctgaccgagttggcagcaaggaagtattaccaagaggagcctgaagctaagcttgttggcctgagcctggaagattaccttaaggaccttttgggacagcggtg

SEQ ID NO: 367202 - DNA, 140 bp, Artificial Sequence
  Synthetic
caccgctgtcccaaaaggtccttaaggtaatcttccaggctcaggccaacaagcttagcttcaggctcctcttggtaatacttccttgctgccaactcggtcagatgtttgatgttgtgacatatcagcagccagggcct

SEQ ID NO: 367203 - DNA, 140 bp, Artificial Sequence
  Synthetic
atacgccatgctgggtctcccaaaagacgttctagagacttgggaaagaatgaaagagcacatagtcaacaggccaacaggattgacactacctgcaagtctagaacaggcaatgcgtaacgtacttgggagtcggccat

SEQ ID NO: 367204 - DNA, 140 bp, Artificial Sequence
  Synthetic
atggccgactcccaagtacgttacgcattgcctgttctagacttgcaggtagtgtcaatcctgttggcctgttgactatgtgctctttcattctttcccaagtctctagaacgtcttttgggagacccagcatggcgtat

SEQ ID NO: 367205 - DNA, 140 bp, Artificial Sequence
  Synthetic
aggccctggctgctgatatgaggccaacaggattgacactacctgcaagtctagaacaggcaatgcgtaaaggattggtcgaaggtgtggtcatctccaaggagggctctgattcatgcagaccttttgggacagcggtg

SEQ ID NO: 367206 - DNA, 140 bp, Artificial Sequence
  Synthetic
caccgctgtcccaaaaggtctgcatgaatcagagccctccttggagatgaccacaccttcgaccaatcctttacgcattgcctgttctagacttgcaggtagtgtcaatcctgttggcctcatatcagcagccagggcct

SEQ ID NO: 367207 - DNA, 140 bp, Artificial Sequence
  Synthetic
atacgccatgctgggtctccacaaaatttaagcatgagctcacacagaatattgcaactagtgaaaagatgctattgagttggctaagtgaagatattaagtcatcgagatgtactgagtcgtacttgggagtcggccat

SEQ ID NO: 367208 - DNA, 140 bp, Artificial Sequence
  Synthetic
atggccgactcccaagtacgactcagtacatctcgatgacttaatatcttcacttagccaactcaatagcatcttttcactagttgcaatattctgtgtgagctcatgcttaaattttgtggagacccagcatggcgtat

SEQ ID NO: 367209 - DNA, 140 bp, Artificial Sequence
  Synthetic
aggccctggctgctgatatgaagcacaaggacggtagcgcgctatctgtcatccctgatagcagcaatccccgactgctcaagtttgtgcctctcaaaaaaggtctagcagtggtgaaaagaccttttgggacagcggtg

SEQ ID NO: 367210 - DNA, 140 bp, Artificial Sequence
  Synthetic
caccgctgtcccaaaaggtcttttcaccactgctagaccttttttgagaggcacaaacttgagcagtcggggattgctgctatcagggatgacagatagcgcgctaccgtccttgtgcttcatatcagcagccagggcct

SEQ ID NO: 367211 - DNA, 140 bp, Artificial Sequence
  Synthetic
atacgccatgctgggtctccgcctctccagcataaagagaactgttgatgaaactaccaatttatcagagaagattgaactgctcgcttataatctgcaacttactagtcactgcagtaacgtacttgggagtcggccat

SEQ ID NO: 367212 - DNA, 140 bp, Artificial Sequence
  Synthetic
atggccgactcccaagtacgttactgcagtgactagtaagttgcagattataagcgagcagttcaatcttctctgataaattggtagtttcatcaacagttctctttatgctggagaggcggagacccagcatggcgtat

SEQ ID NO: 367213 - DNA, 140 bp, Artificial Sequence
  Synthetic
atacgccatgctgggtctccgattagactgtcttactaacatgcgaaacctcgacggaaagcctataagtgagggcagcagtttagtcaatttttataaggtcatttgcatctcaggtgacgtacttgggagtcggccat

SEQ ID NO: 367214 - DNA, 140 bp, Artificial Sequence
  Synthetic
atggccgactcccaagtacgtcacctgagatgcaaatgaccttataaaaattgactaaactgctgccctcacttataggctttccgtcgaggtttcgcatgttagtaagacagtctaatcggagacccagcatggcgtat

SEQ ID NO: 367215 - DNA, 140 bp, Artificial Sequence
  Synthetic
aggccctggctgctgatatgggtgtcccaagatagaggtagttagtcattgtgaaaacaaaggctttgaggatagcaatgaatgcttaacggatttagataggcttgttaggctcacattgaccttttgggacagcggtg

SEQ ID NO: 367216 - DNA, 140 bp, Artificial Sequence
  Synthetic
caccgctgtcccaaaaggtcaatgtgagcctaacaagcctatctaaatccgttaagcattcattgctatcctcaaagcctttgttttcacaatgactaactacctctatcttgggacacccatatcagcagccagggcct

SEQ ID NO: 367217 - DNA, 140 bp, Artificial Sequence
  Synthetic
aggccctggctgctgatatgcgagacaaacaaattaagcaagaattctctaggatgaaactttacgtcaccaaagatttgctagaccatctagatgttggtgggctgttgagggctgcttgaccttttgggacagcggtg

SEQ ID NO: 367218 - DNA, 140 bp, Artificial Sequence
  Synthetic
caccgctgtcccaaaaggtcaagcagccctcaacagcccaccaacatctagatggtctagcaaatctttggtgacgtaaagtttcatcctagagaattcttgcttaatttgtttgtctcgcatatcagcagccagggcct

SEQ ID NO: 367219 - DNA, 140 bp, Artificial Sequence
  Synthetic
aggccctggctgctgatatgtaaaccaagtttaaccatgttgatacagacattgttccctgacaaatttgaggatttcttagaccgaactcagttacatccagagttcagagatttgactgaccttttgggacagcggtg

SEQ ID NO: 367220 - DNA, 140 bp, Artificial Sequence
  Synthetic
caccgctgtcccaaaaggtcagtcaaatctctgaactctggatgtaactgagttcggtctaagaaatcctcaaatttgtcagggaacaatgtctgtatcaacatggttaaacttggtttacatatcagcagccagggcct

SEQ ID NO: 367221 - DNA, 140 bp, Artificial Sequence
  Synthetic
atacgccatgctgggtctcccactattgggtaagatggccatttacatttgcagaatgtcaaatcatcctaaaacaaccatggcttttctcttctggttcagctttggttatgtgatcaccgtacttgggagtcggccat

SEQ ID NO: 367222 - DNA, 140 bp, Artificial Sequence
  Synthetic
atggccgactcccaagtacggtgatcacataaccaaagctgaaccagaagagaaaagccatggttgttttaggatgatttgacattctgcaaatgtaaatggccatcttacccaatagtgggagacccagcatggcgtat

SEQ ID NO: 367223 - DNA, 140 bp, Artificial Sequence
  Synthetic
atacgccatgctgggtctcctatgcaagaggagtaatctctaactcactaaagaacctttcaaagcaaggtaaatcaaagtgctctgtaccaaggtcttggcttgaaaagatattgtttgcgtacttgggagtcggccat

SEQ ID NO: 367224 - DNA, 140 bp, Artificial Sequence
  Synthetic
atggccgactcccaagtacgcaaacaatatcttttcaagccaagaccttggtacagagcactttgatttaccttgctttgaaaggttctttagtgagttagagattactcctcttgcataggagacccagcatggcgtat

SEQ ID NO: 367225 - DNA, 140 bp, Artificial Sequence
  Synthetic
aggccctggctgctgatatgggaaatgaactgttgtacaaggcacccagaaaggccttagcaactgtctgtagtgccttgtttgggaagcagataaacaagcttcagaactgcttcagaagaccttttgggacagcggtg

SEQ ID NO: 367226 - DNA, 140 bp, Artificial Sequence
  Synthetic
caccgctgtcccaaaaggtcttctgaagcagttctgaagcttgtttatctgcttcccaaacaaggcactacagacagttgctaaggcctttctgggtgccttgtacaacagttcatttcccatatcagcagccagggcct

SEQ ID NO: 367227 - DNA, 140 bp, Artificial Sequence
  Synthetic
atacgccatgctgggtctcctcactgaaggctagatctgagtttgttagaaacaacgataaactacttataagatcaaaggaggagttaaaaaaatgtttcgatgtgcagtcctttaaaccgtacttgggagtcggccat

SEQ ID NO: 367228 - DNA, 140 bp, Artificial Sequence
  Synthetic
atggccgactcccaagtacggtttaaaggactgcacatcgaaacatttttttaactcctcctttgatcttataagtagtttatcgttgtttctaacaaactcagatctagccttcagtgaggagacccagcatggcgtat

SEQ ID NO: 367229 - DNA, 140 bp, Artificial Sequence
  Synthetic
aggccctggctgctgatatgaagatcaaaggaggagttaaaaaaatgtttcgatgtgcagtcctttaaactgatgaaaaacaagcaacctatgccttttcaggttgactgcattctattcgaccttttgggacagcggtg

SEQ ID NO: 367230 - DNA, 140 bp, Artificial Sequence
  Synthetic
caccgctgtcccaaaaggtcgaatagaatgcagtcaacctgaaaaggcataggttgcttgtttttcatcagtttaaaggactgcacatcgaaacatttttttaactcctcctttgatcttcatatcagcagccagggcct

SEQ ID NO: 367231 - DNA, 140 bp, Artificial Sequence
  Synthetic
atacgccatgctgggtctcctaacttctcggctcattacattgagaaaagagaaagacactgacctcctcaaacaatggtttcctggaagtgacctcacccgcagaagtaccaggaatatcgtacttgggagtcggccat

SEQ ID NO: 367232 - DNA, 140 bp, Artificial Sequence
  Synthetic
atggccgactcccaagtacgatattcctggtacttctgcgggtgaggtcacttccaggaaaccattgtttgaggaggtcagtgtctttctcttttctcaatgtaatgagccgagaagttaggagacccagcatggcgtat

SEQ ID NO: 367233 - DNA, 140 bp, Artificial Sequence
  Synthetic
aggccctggctgctgatatggcactgtgacattaacctatcggtcaagctgccatcaaacaaaaaagagaatatgttatgttgtatttacagtagtaacatggaactcctacaaggacctgaccttttgggacagcggtg

SEQ ID NO: 367234 - DNA, 140 bp, Artificial Sequence
  Synthetic
caccgctgtcccaaaaggtcaggtccttgtaggagttccatgttactactgtaaatacaacataacatattctcttttttgtttgatggcagcttgaccgataggttaatgtcacagtgccatatcagcagccagggcct

SEQ ID NO: 367235 - DNA, 140 bp, Artificial Sequence
  Synthetic
atacgccatgctgggtctccttctatttgaatagaagacaagctgtccttggctcatcatacctttacattgttataacactttacatacaagttttacagcagcataggtgtctagaggcgtacttgggagtcggccat

SEQ ID NO: 367236 - DNA, 140 bp, Artificial Sequence
  Synthetic
atggccgactcccaagtacgcctctagacacctatgctgctgtaaaacttgtatgtaaagtgttataacaatgtaaaggtatgatgagccaaggacagcttgtcttctattcaaatagaaggagacccagcatggcgtat

SEQ ID NO: 367237 - DNA, 140 bp, Artificial Sequence
  Synthetic
atacgccatgctgggtctcctgtatgctcttcaagaagattctgaagtagagccgatagccataatttgtgatggcatagaaagcaatatgaaacagttgtttgctatactgcctcctgacgtacttgggagtcggccat

SEQ ID NO: 367238 - DNA, 140 bp, Artificial Sequence
  Synthetic
atggccgactcccaagtacgtcaggaggcagtatagcaaacaactgtttcatattgctttctatgccatcacaaattatggctatcggctctacttcagaatcttcttgaagagcatacaggagacccagcatggcgtat

SEQ ID NO: 367239 - DNA, 140 bp, Artificial Sequence
  Synthetic
atacgccatgctgggtctccgatggcatagaaagcaatatgaaacagttgtttgctatactgcctcctgactgtgcaagagagtgtgaggtcctctttgatgacataagaaactctccaacgtacttgggagtcggccat

SEQ ID NO: 367240 - DNA, 140 bp, Artificial Sequence
  Synthetic
atggccgactcccaagtacgttggagagtttcttatgtcatcaaagaggacctcacactctcttgcacagtcaggaggcagtatagcaaacaactgtttcatattgctttctatgccatcggagacccagcatggcgtat

SEQ ID NO: 367241 - DNA, 140 bp, Artificial Sequence
  Synthetic
atacgccatgctgggtctcccagtgttgaaaacgtgcagatctccatagatgcaacattgcctgaatctgtggaagcagtgccagtgacagaaagaaagatgttccctctgcctgagactcgtacttgggagtcggccat

SEQ ID NO: 367242 - DNA, 140 bp, Artificial Sequence
  Synthetic
atggccgactcccaagtacgagtctcaggcagagggaacatctttctttctgtcactggcactgcttccacagattcaggcaatgttgcatctatggagatctgcacgttttcaacactgggagacccagcatggcgtat

SEQ ID NO: 367243 - DNA, 140 bp, Artificial Sequence
  Synthetic
atacgccatgctgggtctccggcttaaacttggtatatggcttcctcataaaagacaacttgttggctaactcacagcaacaaaataaacaactccagatgcttcgtttcggcatgcttgcgtacttgggagtcggccat

SEQ ID NO: 367244 - DNA, 140 bp, Artificial Sequence
  Synthetic
atggccgactcccaagtacgcaagcatgccgaaacgaagcatctggagttgtttattttgttgctgtgagttagccaacaagttgtcttttatgaggaagccatataccaagtttaagccggagacccagcatggcgtat

SEQ ID NO: 367245 - DNA, 140 bp, Artificial Sequence
  Synthetic
aggccctggctgctgatatgcagtgttgaaaatgtgcaaatctccattgatgtaacactgcctgagtctgtggaggcagtgccggtgacagaaagaaaaatgttccctctgcctgaaactgaccttttgggacagcggtg

SEQ ID NO: 367246 - DNA, 140 bp, Artificial Sequence
  Synthetic
caccgctgtcccaaaaggtcagtttcaggcagagggaacatttttctttctgtcaccggcactgcctccacagactcaggcagtgttacatcaatggagatttgcacattttcaacactgcatatcagcagccagggcct

SEQ ID NO: 367247 - DNA, 140 bp, Artificial Sequence
  Synthetic
atacgccatgctgggtctccacaagttgcagaagaattgaagacaacattgcaagactttacctacaaacatctatatactgctctgttagggatgtagaagacaacattaagcactggacgtacttgggagtcggccat

SEQ ID NO: 367248 - DNA, 140 bp, Artificial Sequence
  Synthetic
atggccgactcccaagtacgtccagtgcttaatgttgtcttctacatccctaacagagcagtatatagatgtttgtaggtaaagtcttgcaatgttgtcttcaattcttctgcaacttgtggagacccagcatggcgtat

SEQ ID NO: 367249 - DNA, 140 bp, Artificial Sequence
  Synthetic
aggccctggctgctgatatgccgctgagtgaggtgcattcaatagagcgcattatggaaaatttttcccgccttatgcatggaggaagactttcagccaaggaaaaagatggagaccttggaccttttgggacagcggtg

SEQ ID NO: 367250 - DNA, 140 bp, Artificial Sequence
  Synthetic
caccgctgtcccaaaaggtccaaggtctccatctttttccttggctgaaagtcttcctccatgcataaggcgggaaaaattttccataatgcgctctattgaatgcacctcactcagcggcatatcagcagccagggcct

SEQ ID NO: 367251 - DNA, 140 bp, Artificial Sequence
  Synthetic
atacgccatgctgggtctcctcttagaagaaacagcagaaaggcatatgctctgggagcttgacctgatgaactcactctgttctgacgaaaaaaaggatgctagaaccgcaagactgctcgtacttgggagtcggccat

SEQ ID NO: 367252 - DNA, 140 bp, Artificial Sequence
  Synthetic
atggccgactcccaagtacgagcagtcttgcggttctagcatcctttttttcgtcagaacagagtgagttcatcaggtcaagctcccagagcatatgcctttctgctgtttcttctaagaggagacccagcatggcgtat

SEQ ID NO: 367253 - DNA, 140 bp, Artificial Sequence
  Synthetic
aggccctggctgctgatatgagctataagtactcaaaaggttaggagttacctaaaggcaggaactgcaacaaaaacccctgtgtcgacaaaagacgttctggagacttgggaaaaaatggaccttttgggacagcggtg

SEQ ID NO: 367254 - DNA, 140 bp, Artificial Sequence
  Synthetic
caccgctgtcccaaaaggtccattttttcccaagtctccagaacgtcttttgtcgacacaggggtttttgttgcagttcctgcctttaggtaactcctaaccttttgagtacttatagctcatatcagcagccagggcct

SEQ ID NO: 367255 - DNA, 140 bp, Artificial Sequence
  Synthetic
aggccctggctgctgatatggacatttgtcaattttctgaatacacaccgaacaaagaaagcgttttgaaggactgtctccagatcatacggaagaatcctagccacacaatgggctcttgaccttttgggacagcggtg

SEQ ID NO: 367256 - DNA, 140 bp, Artificial Sequence
  Synthetic
caccgctgtcccaaaaggtcaagagcccattgtgtggctaggattcttccgtatgatctggagacagtccttcaaaacgctttctttgttcggtgtgtattcagaaaattgacaaatgtccatatcagcagccagggcct

SEQ ID NO: 367257 - DNA, 140 bp, Artificial Sequence
  Synthetic
atacgccatgctgggtctccgagaatatagacaaggcaaggagagatccaaaaaattgggttagcatctcagaagttacagaaacaacaagtatagttgcatcacctaaaactcatatgacgtacttgggagtcggccat

SEQ ID NO: 367258 - DNA, 140 bp, Artificial Sequence
  Synthetic
atggccgactcccaagtacgtcatatgagttttaggtgatgcaactatacttgttgtttctgtaacttctgagatgctaacccaattttttggatctctccttgccttgtctatattctcggagacccagcatggcgtat

SEQ ID NO: 367259 - DNA, 140 bp, Artificial Sequence
  Synthetic
aggccctggctgctgatatgagaagttacagaaacaacaagtatagttgcatcacctaaaactcatatgatgcttaaagactgctttaagattatactaggtactgagaacaaaaaaatagaccttttgggacagcggtg

SEQ ID NO: 367260 - DNA, 140 bp, Artificial Sequence
  Synthetic
caccgctgtcccaaaaggtctatttttttgttctcagtacctagtataatcttaaagcagtctttaagcatcatatgagttttaggtgatgcaactatacttgttgtttctgtaacttctcatatcagcagccagggcct

SEQ ID NO: 367261 - DNA, 140 bp, Artificial Sequence
  Synthetic
atacgccatgctgggtctcccaggacaggacagtcagcaaaatgctgctgaacatgaaggttcaagcatcttggctttcaaggactatggagagaggggaatagttgaggaaaatcacatcgtacttgggagtcggccat

SEQ ID NO: 367262 - DNA, 140 bp, Artificial Sequence
  Synthetic
atggccgactcccaagtacgatgtgattttcctcaactattcccctctctccatagtccttgaaagccaagatgcttgaaccttcatgttcagcagcattttgctgactgtcctgtcctgggagacccagcatggcgtat

SEQ ID NO: 367263 - DNA, 140 bp, Artificial Sequence
  Synthetic
atacgccatgctgggtctcccatagagatcggaaaaagggattgcctggatttactcagcacggtagatggtctaacagatcaacaaaaagagaacatcgtgaacgggatatttgagccccgtacttgggagtcggccat

SEQ ID NO: 367264 - DNA, 140 bp, Artificial Sequence
  Synthetic
atggccgactcccaagtacggggctcaaatatcccgttcacgatgttctctttttgttgatctgttagaccatctaccgtgctgagtaaatccaggcaatccctttttccgatctctatgggagacccagcatggcgtat

SEQ ID NO: 367265 - DNA, 140 bp, Artificial Sequence
  Synthetic
aggccctggctgctgatatggtctaacagatcaacaaaaagagaacatcgtgaacgggatatttgagccctcaaagttgtccttttaccactggaaagaattagttaagaaaaacattgagaccttttgggacagcggtg

SEQ ID NO: 367266 - DNA, 140 bp, Artificial Sequence
  Synthetic
caccgctgtcccaaaaggtctcaatgtttttcttaactaattctttccagtggtaaaaggacaactttgagggctcaaatatcccgttcacgatgttctctttttgttgatctgttagaccatatcagcagccagggcct

SEQ ID NO: 367267 - DNA, 140 bp, Artificial Sequence
  Synthetic
aggccctggctgctgatatgcatctaatgtatgcaagaggtgccctaaaatagaagtggttaatcattgtgaaaataaaggctttgaggacagcaatgaatgcttaacagatctagacaggaccttttgggacagcggtg

SEQ ID NO: 367268 - DNA, 140 bp, Artificial Sequence
  Synthetic
caccgctgtcccaaaaggtcctgtctagatctgttaagcattcattgctgtcctcaaagcctttattttcacaatgattaaccacttctattttagggcacctcttgcatacattagatgcatatcagcagccagggcct

SEQ ID NO: 367269 - DNA, 140 bp, Artificial Sequence
  Synthetic
atacgccatgctgggtctcccgatctcctcttcagtcaagggaagcttgaagaagagacttaagttcatgaacatacattcccccgaactgatgccagaaaactgtctcttttctagtgacgtacttgggagtcggccat

SEQ ID NO: 367270 - DNA, 140 bp, Artificial Sequence
  Synthetic
atggccgactcccaagtacgtcactagaaaagagacagttttctggcatcagttcgggggaatgtatgttcatgaacttaagtctcttcttcaagcttcccttgactgaagaggagatcgggagacccagcatggcgtat

SEQ ID NO: 367271 - DNA, 140 bp, Artificial Sequence
  Synthetic
aggccctggctgctgatatgttggctttcaaggactatggagagaggggaatagttgaggaaaatcacatgaggtttagtgaagaggatcagctggaaacaaggcagctgttgttgataggaccttttgggacagcggtg

SEQ ID NO: 367272 - DNA, 140 bp, Artificial Sequence
  Synthetic
caccgctgtcccaaaaggtcctatcaacaacagctgccttgtttccagctgatcctcttcactaaacctcatgtgattttcctcaactattcccctctctccatagtccttgaaagccaacatatcagcagccagggcct

SEQ ID NO: 367273 - DNA, 140 bp, Artificial Sequence
  Synthetic
atacgccatgctgggtctccgagcaaataagcttagacgatctaatggcaaacgacacggtaacagacttgcctgatagggaagcagaagccctcagaacagggaatctcggctttaactcgtacttgggagtcggccat

SEQ ID NO: 367274 - DNA, 140 bp, Artificial Sequence
  Synthetic
atggccgactcccaagtacgagttaaagccgagattccctgttctgagggcttctgcttccctatcaggcaagtctgttaccgtgtcgtttgccattagatcgtctaagcttatttgctcggagacccagcatggcgtat

SEQ ID NO: 367275 - DNA, 140 bp, Artificial Sequence
  Synthetic
aggccctggctgctgatatggactagccgagaagatagacactgttagaaaagagctttctgaatccaaactaaaagattattcaacttatgcaagaggggtgatttcaaattcactgaagaccttttgggacagcggtg

SEQ ID NO: 367276 - DNA, 140 bp, Artificial Sequence
  Synthetic
caccgctgtcccaaaaggtcttcagtgaatttgaaatcacccctcttgcataagttgaataatcttttagtttggattcagaaagctcttttctaacagtgtctatcttctcggctagtccatatcagcagccagggcct

SEQ ID NO: 367277 - DNA, 140 bp, Artificial Sequence
  Synthetic
aggccctggctgctgatatgaaacctctcaaagcaaggcaagtcaaagtgttctgtgccgagatcttggcttgaaaagatattgtttgacttaaaagtgcccactaaagatgaagaagtggaccttttgggacagcggtg

SEQ ID NO: 367278 - DNA, 140 bp, Artificial Sequence
  Synthetic
caccgctgtcccaaaaggtccacttcttcatctttagtgggcacttttaagtcaaacaatatcttttcaagccaagatctcggcacagaacactttgacttgccttgctttgagaggtttcatatcagcagccagggcct

SEQ ID NO: 367279 - DNA, 140 bp, Artificial Sequence
  Synthetic
atacgccatgctgggtctccgaagaggtcttaataaagagactggagaaaaatttccttaagcagcacaatttagaaatcatggaaacggtgaatcttatattctttgctgctctttcagcgtacttgggagtcggccat

SEQ ID NO: 367280 - DNA, 140 bp, Artificial Sequence
  Synthetic
atggccgactcccaagtacgctgaaagagcagcaaagaatataagattcaccgtttccatgatttctaaattgtgctgcttaaggaaatttttctccagtctctttattaagacctcttcggagacccagcatggcgtat

SEQ ID NO: 367281 - DNA, 140 bp, Artificial Sequence
  Synthetic
aggccctggctgctgatatgtttagaaatcatggaaacggtgaatcttatattctttgctgctctttcagctccctggtgcttgcactacaaagcattagaatcttatctggtgaggcatgaccttttgggacagcggtg

SEQ ID NO: 367282 - DNA, 140 bp, Artificial Sequence
  Synthetic
caccgctgtcccaaaaggtcatgcctcaccagataagattctaatgctttgtagtgcaagcaccagggagctgaaagagcagcaaagaatataagattcaccgtttccatgatttctaaacatatcagcagccagggcct

SEQ ID NO: 367283 - DNA, 140 bp, Artificial Sequence
  Synthetic
atacgccatgctgggtctcccgatctgtcagtttccaaactcttagtttgtttgtatcaaaaagatgatgaagaactagcaagtggcttgggtttaaaacttgggtttttagtaaagtatcgtacttgggagtcggccat

SEQ ID NO: 367284 - DNA, 140 bp, Artificial Sequence
  Synthetic
atggccgactcccaagtacgatactttactaaaaacccaagttttaaacccaagccacttgctagttcttcatcatctttttgatacaaacaaactaagagtttggaaactgacagatcgggagacccagcatggcgtat

SEQ ID NO: 367285 - DNA, 140 bp, Artificial Sequence
  Synthetic
aggccctggctgctgatatgaagaactagcaagtggcttgggtttaaaacttgggtttttagtaaagtatgctgtcaccttattcacatccaatggcgagcctttttctcttagtctgaagaccttttgggacagcggtg

SEQ ID NO: 367286 - DNA, 140 bp, Artificial Sequence
  Synthetic
caccgctgtcccaaaaggtcttcagactaagagaaaaaggctcgccattggatgtgaataaggtgacagcatactttactaaaaacccaagttttaaacccaagccacttgctagttcttcatatcagcagccagggcct

SEQ ID NO: 367287 - DNA, 140 bp, Artificial Sequence
  Synthetic
atacgccatgctgggtctcctacatcaaacaaagatagtttttgctaaaatcggtctgtccgggaatggctacgactttatctggactactcaaatgatagcaaatagcaacttcaatgtcgtacttgggagtcggccat

SEQ ID NO: 367288 - DNA, 140 bp, Artificial Sequence
  Synthetic
atggccgactcccaagtacgacattgaagttgctatttgctatcatttgagtagtccagataaagtcgtagccattcccggacagaccgattttagcaaaaactatctttgtttgatgtaggagacccagcatggcgtat

SEQ ID NO: 367289 - DNA, 140 bp, Artificial Sequence
  Synthetic
aggccctggctgctgatatgtacgactttatctggactactcaaatgatagcaaatagcaacttcaatgtttgtaaaaggttgactggaaggagtactggggaaaggcttccaagaagcggaccttttgggacagcggtg

SEQ ID NO: 367290 - DNA, 140 bp, Artificial Sequence
  Synthetic
caccgctgtcccaaaaggtccgcttcttggaagcctttccccagtactccttccagtcaaccttttacaaacattgaagttgctatttgctatcatttgagtagtccagataaagtcgtacatatcagcagccagggcct

SEQ ID NO: 367291 - DNA, 140 bp, Artificial Sequence
  Synthetic
atacgccatgctgggtctccagtataggtgtctagaagttataaacagtgtaaatgaaaagacattgcaagacattgaaaatcactccatgactttgctagaagatgcattcaaggaactcgtacttgggagtcggccat

SEQ ID NO: 367292 - DNA, 140 bp, Artificial Sequence
  Synthetic
atggccgactcccaagtacgagttccttgaatgcatcttctagcaaagtcatggagtgattttcaatgtcttgcaatgtcttttcatttacactgtttataacttctagacacctatactggagacccagcatggcgtat

SEQ ID NO: 367293 - DNA, 140 bp, Artificial Sequence
  Synthetic
atacgccatgctgggtctccatgttcagtaggaacctcctaaagacaacatcagatgacggccttacaaacccacatctcaaagagacgatccttaatgtggggttagactgtcttaccacgtacttgggagtcggccat

SEQ ID NO: 367294 - DNA, 140 bp, Artificial Sequence
  Synthetic
atggccgactcccaagtacgtggtaagacagtctaaccccacattaaggatcgtctctttgagatgtgggtttgtaaggccgtcatctgatgttgtctttaggaggttcctactgaacatggagacccagcatggcgtat

SEQ ID NO: 367295 - DNA, 140 bp, Artificial Sequence
  Synthetic
aggccctggctgctgatatgcccacatctcaaagagacgatccttaatgtggggttagactgtcttaccaacatgcgaaaccttgacggaaggcccataaatgagggtagcaacttagtcgaccttttgggacagcggtg

SEQ ID NO: 367296 - DNA, 140 bp, Artificial Sequence
  Synthetic
caccgctgtcccaaaaggtcgactaagttgctaccctcatttatgggccttccgtcaaggtttcgcatgttggtaagacagtctaaccccacattaaggatcgtctctttgagatgtgggcatatcagcagccagggcct

SEQ ID NO: 367297 - DNA, 140 bp, Artificial Sequence
  Synthetic
atacgccatgctgggtctccttcgttttggcatgcttgcagggcttagtaggcttgtttgccctaatgagctagggaaaaagttttcaacaagttgtagaaggattgaagacaacattgccgtacttgggagtcggccat

SEQ ID NO: 367298 - DNA, 140 bp, Artificial Sequence
  Synthetic
atggccgactcccaagtacggcaatgttgtcttcaatccttctacaacttgttgaaaactttttccctagctcattagggcaaacaagcctactaagccctgcaagcatgccaaaacgaaggagacccagcatggcgtat

SEQ ID NO: 367299 - DNA, 140 bp, Artificial Sequence
  Synthetic
atacgccatgctgggtctccgatacactgttgttctttcttttccggtatgatgcagcaggttctaaaaaatgtcccagattggtgttcattctataagttaacattcgtaaaaaacttacgtacttgggagtcggccat

SEQ ID NO: 367300 - DNA, 140 bp, Artificial Sequence
  Synthetic
atggccgactcccaagtacgtaagttttttacgaatgttaacttatagaatgaacaccaatctgggacattttttagaacctgctgcatcataccggaaaagaaagaacaacagtgtatcggagacccagcatggcgtat

SEQ ID NO: 367301 - DNA, 140 bp, Artificial Sequence
  Synthetic
aggccctggctgctgatatgatgtcccagattggtgttcattctataagttaacattcgtaaaaaacttatgtagacaggtggaaatacctgcgggcagcattaagaagatcctaaatgtgaccttttgggacagcggtg

SEQ ID NO: 367302 - DNA, 140 bp, Artificial Sequence
  Synthetic
caccgctgtcccaaaaggtcacatttaggatcttcttaatgctgcccgcaggtatttccacctgtctacataagttttttacgaatgttaacttatagaatgaacaccaatctgggacatcatatcagcagccagggcct

SEQ ID NO: 367303 - DNA, 140 bp, Artificial Sequence
  Synthetic
atacgccatgctgggtctccaggatttgaggaagctattggtagataatttagatagttgggatggaaatgacacagtcaagtttttagttacaacttatataagcaaagggcttatggccgtacttgggagtcggccat

SEQ ID NO: 367304 - DNA, 140 bp, Artificial Sequence
  Synthetic
atggccgactcccaagtacggccataagccctttgcttatataagttgtaactaaaaacttgactgtgtcatttccatcccaactatctaaattatctaccaatagcttcctcaaatcctggagacccagcatggcgtat

SEQ ID NO: 367305 - DNA, 140 bp, Artificial Sequence
  Synthetic
atacgccatgctgggtctcccagtgttaacttccttagctgctgtactctttgaggagttggcaattttttatctcaagaagagcctgcctcagacaacagtacatgttgagcatgctggcgtacttgggagtcggccat

SEQ ID NO: 367306 - DNA, 140 bp, Artificial Sequence
  Synthetic
atggccgactcccaagtacgccagcatgctcaacatgtactgttgtctgaggcaggctcttcttgagataaaaaattgccaactcctcaaagagtacagcagctaaggaagttaacactgggagacccagcatggcgtat

SEQ ID NO: 367307 - DNA, 140 bp, Artificial Sequence
  Synthetic
aggccctggctgctgatatgcaagagtagaatccgtagtatttttggcaggtacaactctcagaaaaaaccatttgaattaaggtcaggccttgaagtctttaatgaccctttcaatgatgaccttttgggacagcggtg

SEQ ID NO: 367308 - DNA, 140 bp, Artificial Sequence
  Synthetic
caccgctgtcccaaaaggtcatcattgaaagggtcattaaagacttcaaggcctgaccttaattcaaatggttttttctgagagttgtacctgccaaaaatactacggattctactcttgcatatcagcagccagggcct

SEQ ID NO: 367309 - DNA, 140 bp, Artificial Sequence
  Synthetic
aggccctggctgctgatatgcttaaaaacttcacagctgctgtacaaagatgctgtcaaatgaaagatagtgctaaaactttggtgagcgactgcttccttgaattttacagcgagttcagaccttttgggacagcggtg

SEQ ID NO: 367310 - DNA, 140 bp, Artificial Sequence
  Synthetic
caccgctgtcccaaaaggtctgaactcgctgtaaaattcaaggaagcagtcgctcaccaaagttttagcactatctttcatttgacagcatctttgtacagcagctgtgaagtttttaagcatatcagcagccagggcct

SEQ ID NO: 367311 - DNA, 140 bp, Artificial Sequence
  Synthetic
atacgccatgctgggtctccctgataaacagctctgtaacctcccctcagagtctgatgcaagcatgccaggtttcatctcaacaagccatgtataatagtgttccccttgtcaccaatacgtacttgggagtcggccat

SEQ ID NO: 367312 - DNA, 140 bp, Artificial Sequence
  Synthetic
atggccgactcccaagtacgtattggtgacaaggggaacactattatacatggcttgttgagatgaaacctggcatgcttgcatcagactctgaggggaggttacagagctgtttatcagggagacccagcatggcgtat

SEQ ID NO: 367313 - DNA, 140 bp, Artificial Sequence
  Synthetic
aggccctggctgctgatatgggtttcatctcaacaagccatgtataatagtgttccccttgtcaccaatactgcttttaccctattgaggcaacaaattttctttaatcatgttgaggacgaccttttgggacagcggtg

SEQ ID NO: 367314 - DNA, 140 bp, Artificial Sequence
  Synthetic
caccgctgtcccaaaaggtcgtcctcaacatgattaaagaaaatttgttgcctcaatagggtaaaagcagtattggtgacaaggggaacactattatacatggcttgttgagatgaaacccatatcagcagccagggcct

SEQ ID NO: 367315 - DNA, 140 bp, Artificial Sequence
  Synthetic
aggccctggctgctgatatggaactgggtcagcatctctgaagttactgaaacgacaagtatagttgcatcacccaaaactcacatgatgctcaaagattgctttaaaattatactaggtgaccttttgggacagcggtg

SEQ ID NO: 367316 - DNA, 140 bp, Artificial Sequence
  Synthetic
caccgctgtcccaaaaggtcacctagtataattttaaagcaatctttgagcatcatgtgagttttgggtgatgcaactatacttgtcgtttcagtaacttcagagatgctgacccagttccatatcagcagccagggcct

SEQ ID NO: 367317 - DNA, 140 bp, Artificial Sequence
  Synthetic
atacgccatgctgggtctccaagttcatgttcactggactaataaacagttctgtgacctctccccagagtttgatgcaggcatgtcaggtttcatcccagcaagccatgtacaatagtgcgtacttgggagtcggccat

SEQ ID NO: 367318 - DNA, 140 bp, Artificial Sequence
  Synthetic
atggccgactcccaagtacgcactattgtacatggcttgctgggatgaaacctgacatgcctgcatcaaactctggggagaggtcacagaactgtttattagtccagtgaacatgaacttggagacccagcatggcgtat

SEQ ID NO: 367319 - DNA, 140 bp, Artificial Sequence
  Synthetic
atacgccatgctgggtctcccaggctgtttgtaccgacctactctgggttagttagctcagcggttgccctagaagatgctgaagtcattgctagggcagctcagacactgcatatgaaccgtacttgggagtcggccat

SEQ ID NO: 367320 - DNA, 140 bp, Artificial Sequence
  Synthetic
atggccgactcccaagtacggttcatatgcagtgtctgagctgccctagcaatgacttcagcatcttctagggcaaccgctgagctaactaacccagagtaggtcggtacaaacagcctgggagacccagcatggcgtat

SEQ ID NO: 367321 - DNA, 140 bp, Artificial Sequence
  Synthetic
aggccctggctgctgatatgtagaagatgctgaagtcattgctagggcagctcagacactgcatatgaacagtgtatcaatccagtctagtagcttgactacattagacagtttaggtcggaccttttgggacagcggtg

SEQ ID NO: 367322 - DNA, 140 bp, Artificial Sequence
  Synthetic
caccgctgtcccaaaaggtccgacctaaactgtctaatgtagtcaagctactagactggattgatacactgttcatatgcagtgtctgagctgccctagcaatgacttcagcatcttctacatatcagcagccagggcct

SEQ ID NO: 367323 - DNA, 140 bp, Artificial Sequence
  Synthetic
atacgccatgctgggtctcctactcagcacggtagatggtctgacagaccaacagaaagaaaacattgtaaacgggatatttgagccttcaaagctgtccttctatcactggaaagagttcgtacttgggagtcggccat

SEQ ID NO: 367324 - DNA, 140 bp, Artificial Sequence
  Synthetic
atggccgactcccaagtacgaactctttccagtgatagaaggacagctttgaaggctcaaatatcccgtttacaatgttttctttctgttggtctgtcagaccatctaccgtgctgagtaggagacccagcatggcgtat

SEQ ID NO: 367325 - DNA, 140 bp, Artificial Sequence
  Synthetic
atacgccatgctgggtctccccgttgcttcccatgattcagggttgtcatcgtcgagcttctcttttgagctcaataggcctctgtcggaaactgaactacaattcattaaggcactaaacgtacttgggagtcggccat

SEQ ID NO: 367326 - DNA, 140 bp, Artificial Sequence
  Synthetic
atggccgactcccaagtacgtttagtgccttaatgaattgtagttcagtttccgacagaggcctattgagctcaaaagagaagctcgacgatgacaaccctgaatcatgggaagcaacggggagacccagcatggcgtat

SEQ ID NO: 367327 - DNA, 140 bp, Artificial Sequence
  Synthetic
atacgccatgctgggtctcctagccttaagtcaactcaagcctgtgaggtaatccagaatagaattacaggtctttattgtaatagcaatgaagggcctcttgacaggcacaatgtcatccgtacttgggagtcggccat

SEQ ID NO: 367328 - DNA, 140 bp, Artificial Sequence
  Synthetic
atggccgactcccaagtacggatgacattgtgcctgtcaagaggcccttcattgctattacaataaagacctgtaattctattctggattacctcacaggcttgagttgacttaaggctaggagacccagcatggcgtat

SEQ ID NO: 367329 - DNA, 140 bp, Artificial Sequence
  Synthetic
aggccctggctgctgatatgtgtttaaccatggactttttgagaaaccttgactggactcaggtaattgctggccaatatgttaccaatcctaggttcaacatctctgactacttcgagagaccttttgggacagcggtg

SEQ ID NO: 367330 - DNA, 140 bp, Artificial Sequence
  Synthetic
caccgctgtcccaaaaggtctctcgaagtagtcagagatgttgaacctaggattggtaacatattggccagcaattacctgagtccagtcaaggtttctcaaaaagtccatggttaaacacatatcagcagccagggcct

SEQ ID NO: 367331 - DNA, 140 bp, Artificial Sequence
  Synthetic
aggccctggctgctgatatgatatcctcttggattaagtgcataacagcctgtaaagattttgcaagcatcaatgacagggttcagaaattcattcaccacctttctgaagagctgtatggaccttttgggacagcggtg

SEQ ID NO: 367332 - DNA, 140 bp, Artificial Sequence
  Synthetic
caccgctgtcccaaaaggtccatacagctcttcagaaaggtggtgaatgaatttctgaaccctgtcattgatgcttgcaaaatctttacaggctgttatgcacttaatccaagaggatatcatatcagcagccagggcct

SEQ ID NO: 367333 - DNA, 140 bp, Artificial Sequence
  Synthetic
atacgccatgctgggtctcccaatgacagggttcagaaattcattcaccacctttctgaagagctgtatgacataaggctgcagcacctggaactgtcaaagcttaaacaagagcacccccgtacttgggagtcggccat

SEQ ID NO: 367334 - DNA, 140 bp, Artificial Sequence
  Synthetic
atggccgactcccaagtacgggggtgctcttgtttaagctttgacagttccaggtgctgcagccttatgtcatacagctcttcagaaaggtggtgaatgaatttctgaaccctgtcattgggagacccagcatggcgtat

SEQ ID NO: 367335 - DNA, 140 bp, Artificial Sequence
  Synthetic
atacgccatgctgggtctccgtgaaggcatcattgaatagagatgacaacaaaattattgaggatcctatgatacaactgattccagagaaactgaggagagagctagaaaggttaggagcgtacttgggagtcggccat

SEQ ID NO: 367336 - DNA, 140 bp, Artificial Sequence
  Synthetic
atggccgactcccaagtacgctcctaacctttctagctctctcctcagtttctctggaatcagttgtatcataggatcctcaataattttgttgtcatctctattcaatgatgccttcacggagacccagcatggcgtat

SEQ ID NO: 367337 - DNA, 140 bp, Artificial Sequence
  Synthetic
atacgccatgctgggtctcctggccaatatgttaccaatcctaggttcaacatctctgactacttcgagattgttcggcagcctggtgatgggaactgcttctaccatagtatagctgagcgtacttgggagtcggccat

SEQ ID NO: 367338 - DNA, 140 bp, Artificial Sequence
  Synthetic
atggccgactcccaagtacgctcagctatactatggtagaagcagttcccatcaccaggctgccgaacaatctcgaagtagtcagagatgttgaacctaggattggtaacatattggccaggagacccagcatggcgtat

SEQ ID NO: 367339 - DNA, 140 bp, Artificial Sequence
  Synthetic
aggccctggctgctgatatgactttagctcagcttgtggcaaaaaaactcatcagtctcaatgtttctacggaagaatactctgcagaagtgtctaggctcaaacaaacactaacagctcgaccttttgggacagcggtg

SEQ ID NO: 367340 - DNA, 140 bp, Artificial Sequence
  Synthetic
caccgctgtcccaaaaggtcgagctgttagtgtttgtttgagcctagacacttctgcagagtattcttccgtagaaacattgagactgatgagtttttttgccacaagctgagctaaagtcatatcagcagccagggcct

SEQ ID NO: 367341 - DNA, 140 bp, Artificial Sequence
  Synthetic
aggccctggctgctgatatgctgtaagctcactttgcttgatctgtcagtttccaagctcttagtctgtttgtatcgaaaagaagataatgaactaacaaatagctcaagtttgaaacttgaccttttgggacagcggtg

SEQ ID NO: 367342 - DNA, 140 bp, Artificial Sequence
  Synthetic
caccgctgtcccaaaaggtcaagtttcaaacttgagctatttgttagttcattatcttcttttcgatacaaacagactaagagcttggaaactgacagatcaagcaaagtgagcttacagcatatcagcagccagggcct

SEQ ID NO: 367343 - DNA, 140 bp, Artificial Sequence
  Synthetic
atacgccatgctgggtctccatatatacgatattcatgaagtcatacttcttcaaagacaacgttttcctgtcgctaacagacaggtggtccaccaagcatagcacaaactaccgtgacacgtacttgggagtcggccat

SEQ ID NO: 367344 - DNA, 140 bp, Artificial Sequence
  Synthetic
atggccgactcccaagtacgtgtcacggtagtttgtgctatgcttggtggaccacctgtctgttagcgacaggaaaacgttgtctttgaagaagtatgacttcatgaatatcgtatatatggagacccagcatggcgtat

SEQ ID NO: 367345 - DNA, 140 bp, Artificial Sequence
  Synthetic
aggccctggctgctgatatggtcgctaacagacaggtggtccaccaagcatagcacaaactaccgtgacagctgcggcaaacaattgactggtaggataatcaccaagtatactcactgggaccttttgggacagcggtg

SEQ ID NO: 367346 - DNA, 140 bp, Artificial Sequence
  Synthetic
caccgctgtcccaaaaggtcccagtgagtatacttggtgattatcctaccagtcaattgtttgccgcagctgtcacggtagtttgtgctatgcttggtggaccacctgtctgttagcgaccatatcagcagccagggcct

SEQ ID NO: 367347 - DNA, 140 bp, Artificial Sequence
  Synthetic
atacgccatgctgggtctcccaaggaaccttccctgtttaatccaaatattagatgtgtcaatctaatcacatttgaggacggcctaagggaactttcagtgatacaaagtcatctcaaacgtacttgggagtcggccat

SEQ ID NO: 367348 - DNA, 140 bp, Artificial Sequence
  Synthetic
atggccgactcccaagtacgtttgagatgactttgtatcactgaaagttcccttaggccgtcctcaaatgtgattagattgacacatctaatatttggattaaacagggaaggttccttgggagacccagcatggcgtat

SEQ ID NO: 367349 - DNA, 140 bp, Artificial Sequence
  Synthetic
aggccctggctgctgatatgcatttgaggacggcctaagggaactttcagtgatacaaagtcatctcaaagttttcgagagtgaattcaccaacttaaatcttcagttctctgatccaaagaccttttgggacagcggtg

SEQ ID NO: 367350 - DNA, 140 bp, Artificial Sequence
  Synthetic
caccgctgtcccaaaaggtctttggatcagagaactgaagatttaagttggtgaattcactctcgaaaactttgagatgactttgtatcactgaaagttcccttaggccgtcctcaaatgcatatcagcagccagggcct

SEQ ID NO: 367351 - DNA, 140 bp, Artificial Sequence
  Synthetic
atacgccatgctgggtctccaagcaaatcgtgcagtgattgttaagaccaaattgttttcagcaactgaacaggttcgactatccaacaaccctgcagttgtcatgggttacctattggacgtacttgggagtcggccat

SEQ ID NO: 367352 - DNA, 140 bp, Artificial Sequence
  Synthetic
atggccgactcccaagtacgtccaataggtaacccatgacaactgcagggttgttggatagtcgaacctgttcagttgctgaaaacaatttggtcttaacaatcactgcacgatttgcttggagacccagcatggcgtat

SEQ ID NO: 367353 - DNA, 140 bp, Artificial Sequence
  Synthetic
aggccctggctgctgatatgcaggttcgactatccaacaaccctgcagttgtcatgggttacctattggatgaatcagcaatttctgaagtcaagcctacgaaggtggacttttcaaactgaccttttgggacagcggtg

SEQ ID NO: 367354 - DNA, 140 bp, Artificial Sequence
  Synthetic
caccgctgtcccaaaaggtcagtttgaaaagtccaccttcgtaggcttgacttcagaaattgctgattcatccaataggtaacccatgacaactgcagggttgttggatagtcgaacctgcatatcagcagccagggcct

SEQ ID NO: 367355 - DNA, 140 bp, Artificial Sequence
  Synthetic
atacgccatgctgggtctccctgatcaaaatgctgacagatgagtcatcagactcagagaagaatggtcttagtccggatttgcaacaggttgcaagatactcaaaccatttaactttgccgtacttgggagtcggccat

SEQ ID NO: 367356 - DNA, 140 bp, Artificial Sequence
  Synthetic
atggccgactcccaagtacggcaaagttaaatggtttgagtatcttgcaacctgttgcaaatccggactaagaccattcttctctgagtctgatgactcatctgtcagcattttgatcagggagacccagcatggcgtat

SEQ ID NO: 367357 - DNA, 140 bp, Artificial Sequence
  Synthetic
aggccctggctgctgatatgtagtccggatttgcaacaggttgcaagatactcaaaccatttaactttgcttagtaggatgatacaacaagcaaagccaactgtaactgttttctacatggaccttttgggacagcggtg

SEQ ID NO: 367358 - DNA, 140 bp, Artificial Sequence
  Synthetic
caccgctgtcccaaaaggtccatgtagaaaacagttacagttggctttgcttgttgtatcatcctactaagcaaagttaaatggtttgagtatcttgcaacctgttgcaaatccggactacatatcagcagccagggcct

SEQ ID NO: 367359 - DNA, 140 bp, Artificial Sequence
  Synthetic
atacgccatgctgggtctccaacagaggtggcagcacggaagtattaccaggaagaacctgaagccaagcttattggcctgagtttagaagattatattaaaaggatgctatctgacaaccgtacttgggagtcggccat

SEQ ID NO: 367360 - DNA, 140 bp, Artificial Sequence
  Synthetic
atggccgactcccaagtacggttgtcagatagcatccttttaatataatcttctaaactcaggccaataagcttggcttcaggttcttcctggtaatacttccgtgctgccacctctgttggagacccagcatggcgtat

SEQ ID NO: 367361 - DNA, 140 bp, Artificial Sequence
  Synthetic
atacgccatgctgggtctccttatggtataaaggaaggcaggttttataggctctctgatactggaatcgacgcaagcacatattctgtgaaatactggaagattcttcactgcatttctcgtacttgggagtcggccat

SEQ ID NO: 367362 - DNA, 140 bp, Artificial Sequence
  Synthetic
atggccgactcccaagtacgagaaatgcagtgaagaatcttccagtatttcacagaatatgtgcttgcgtcgattccagtatcagagagcctataaaacctgccttcctttataccataaggagacccagcatggcgtat

SEQ ID NO: 367363 - DNA, 140 bp, Artificial Sequence
  Synthetic
aggccctggctgctgatatgtaagaagatcttaaatgtccttagatacaggttgtgcagcaaaggaggtgtagagcaatatagtgaagaggatctaaggaaactgttggcagataatttagaccttttgggacagcggtg

SEQ ID NO: 367364 - DNA, 140 bp, Artificial Sequence
  Synthetic
caccgctgtcccaaaaggtctaaattatctgccaacagtttccttagatcctcttcactatattgctctacacctcctttgctgcacaacctgtatctaaggacatttaagatcttcttacatatcagcagccagggcct

SEQ ID NO: 367365 - DNA, 140 bp, Artificial Sequence
  Synthetic
atacgccatgctgggtctcccactttctaaccatgaagcaagcatactaagtgaatttgatggacaagtcattgctaatatacttgccagtgaactaagttctgtgaagcgagactctgacgtacttgggagtcggccat

SEQ ID NO: 367366 - DNA, 140 bp, Artificial Sequence
  Synthetic
atggccgactcccaagtacgtcagagtctcgcttcacagaacttagttcactggcaagtatattagcaatgacttgtccatcaaattcacttagtatgcttgcttcatggttagaaagtgggagacccagcatggcgtat

SEQ ID NO: 367367 - DNA, 140 bp, Artificial Sequence
  Synthetic
atacgccatgctgggtctccttcaccatgcaacatcttcagtattaacttctctagctgctgtgctctttgaggagctggcaattttttatcttaagaaaagcttaccccagacaacagtcgtacttgggagtcggccat

SEQ ID NO: 367368 - DNA, 140 bp, Artificial Sequence
  Synthetic
atggccgactcccaagtacgactgttgtctggggtaagcttttcttaagataaaaaattgccagctcctcaaagagcacagcagctagagaagttaatactgaagatgttgcatggtgaaggagacccagcatggcgtat

SEQ ID NO: 367369 - DNA, 140 bp, Artificial Sequence
  Synthetic
atacgccatgctgggtctccggggactcaaatagatctgggaagtttacatacagtagcagatctggagaatcaattggtattttcattgcaggaaagttacacattcatctctcctctgcgtacttgggagtcggccat

SEQ ID NO: 367370 - DNA, 140 bp, Artificial Sequence
  Synthetic
atggccgactcccaagtacgcagaggagagatgaatgtgtaactttcctgcaatgaaaataccaattgattctccagatctgctactgtatgtaaacttcccagatctatttgagtccccggagacccagcatggcgtat

SEQ ID NO: 367371 - DNA, 140 bp, Artificial Sequence
  Synthetic
aggccctggctgctgatatgatcaattggtattttcattgcaggaaagttacacattcatctctcctctgagtccattgccttgttgtgtgaaactgaaaggcaagtgctatcttggatggaccttttgggacagcggtg

SEQ ID NO: 367372 - DNA, 140 bp, Artificial Sequence
  Synthetic
caccgctgtcccaaaaggtccatccaagatagcacttgcctttcagtttcacacaacaaggcaatggactcagaggagagatgaatgtgtaactttcctgcaatgaaaataccaattgatcatatcagcagccagggcct

SEQ ID NO: 367373 - DNA, 140 bp, Artificial Sequence
  Synthetic
atacgccatgctgggtctccaagtctccttccccaatcacacgaatgtttgcaaaagcacaaagatggtagtgcactatcagtcatccctgatagtagcaatcctcgacttcttaaatttcgtacttgggagtcggccat

SEQ ID NO: 367374 - DNA, 140 bp, Artificial Sequence
  Synthetic
atggccgactcccaagtacgaaatttaagaagtcgaggattgctactatcagggatgactgatagtgcactaccatctttgtgcttttgcaaacattcgtgtgattggggaaggagacttggagacccagcatggcgtat

SEQ ID NO: 367375 - DNA, 140 bp, Artificial Sequence
  Synthetic
aggccctggctgctgatatggtgcactatcagtcatccctgatagtagcaatcctcgacttcttaaatttgtgcccctcaaaaagggtctggcagtggtgaaaatcaagaaacaaattttgaccttttgggacagcggtg

SEQ ID NO: 367376 - DNA, 140 bp, Artificial Sequence
  Synthetic
caccgctgtcccaaaaggtcaaaatttgtttcttgattttcaccactgccagaccctttttgaggggcacaaatttaagaagtcgaggattgctactatcagggatgactgatagtgcaccatatcagcagccagggcct

SEQ ID NO: 367377 - DNA, 140 bp, Artificial Sequence
  Synthetic
atacgccatgctgggtctccactgccaacctatcagaaaagattgaattgcttgcttataatttgcagcttactagtcactgtagtaactgtcaccccaacggtgtgaacattagcaacacgtacttgggagtcggccat

SEQ ID NO: 367378 - DNA, 140 bp, Artificial Sequence
  Synthetic
atggccgactcccaagtacgtgttgctaatgttcacaccgttggggtgacagttactacagtgactagtaagctgcaaattataagcaagcaattcaatcttttctgataggttggcagtggagacccagcatggcgtat

SEQ ID NO: 367379 - DNA, 140 bp, Artificial Sequence
  Synthetic
atacgccatgctgggtctccagtggggacatggctgcttgtcaattgtttatgatgagactgacactcagaccacataccacgagaaccttctgaaggtaaagcagcttgttgactgctccgtacttgggagtcggccat

SEQ ID NO: 367380 - DNA, 140 bp, Artificial Sequence
  Synthetic
atggccgactcccaagtacggagcagtcaacaagctgctttaccttcagaaggttctcgtggtatgtggtctgagtgtcagtctcatcataaacaattgacaagcagccatgtccccactggagacccagcatggcgtat

SEQ ID NO: 367381 - DNA, 140 bp, Artificial Sequence
  Synthetic
aggccctggctgctgatatgaccacataccacgagaaccttctgaaggtaaagcagcttgttgactgctccacagacagaaagaagcttttaccacagtcagtgttttctgactccaaaggaccttttgggacagcggtg

SEQ ID NO: 367382 - DNA, 140 bp, Artificial Sequence
  Synthetic
caccgctgtcccaaaaggtcctttggagtcagaaaacactgactgtggtaaaagcttctttctgtctgtggagcagtcaacaagctgctttaccttcagaaggttctcgtggtatgtggtcatatcagcagccagggcct

SEQ ID NO: 367383 - DNA, 140 bp, Artificial Sequence
  Synthetic
atacgccatgctgggtctccacattgctccattgtttcctgaaacatgctcccagtgatgctatcatggaagtagagagcaaaagtagcttgttacacaagtacctcaaatcaggaggtgcgtacttgggagtcggccat

SEQ ID NO: 367384 - DNA, 140 bp, Artificial Sequence
  Synthetic
atggccgactcccaagtacgcacctcctgatttgaggtacttgtgtaacaagctacttttgctctctacttccatgatagcatcactgggagcatgtttcaggaaacaatggagcaatgtggagacccagcatggcgtat

SEQ ID NO: 367385 - DNA, 140 bp, Artificial Sequence
  Synthetic
aggccctggctgctgatatgagtagagagcaaaagtagcttgttacacaagtacctcaaatcaggaggtgtcaggcagcgaaacactgaagtactttttagagagaagttaaacaggattgaccttttgggacagcggtg

SEQ ID NO: 367386 - DNA, 140 bp, Artificial Sequence
  Synthetic
caccgctgtcccaaaaggtcaatcctgtttaacttctctctaaaaagtacttcagtgtttcgctgcctgacacctcctgatttgaggtacttgtgtaacaagctacttttgctctctactcatatcagcagccagggcct

SEQ ID NO: 367387 - DNA, 140 bp, Artificial Sequence
  Synthetic
atacgccatgctgggtctcccaacaatctgactaagactgtttcggaaaacccactaccactcagctgttggtcagaagtccagaactacattgaagacataggcttcaacaatgtgcttcgtacttgggagtcggccat

SEQ ID NO: 367388 - DNA, 140 bp, Artificial Sequence
  Synthetic
atggccgactcccaagtacgaagcacattgttgaagcctatgtcttcaatgtagttctggacttctgaccaacagctgagtggtagtgggttttccgaaacagtcttagtcagattgttgggagacccagcatggcgtat

SEQ ID NO: 367389 - DNA, 140 bp, Artificial Sequence
  Synthetic
aggccctggctgctgatatgggtcagaagtccagaactacattgaagacataggcttcaacaatgtgcttgtcaacattgacagaaacacggtgaaaagtgagcttctgtggaagtttacgaccttttgggacagcggtg

SEQ ID NO: 367390 - DNA, 140 bp, Artificial Sequence
  Synthetic
caccgctgtcccaaaaggtcgtaaacttccacagaagctcacttttcaccgtgtttctgtcaatgttgacaagcacattgttgaagcctatgtcttcaatgtagttctggacttctgacccatatcagcagccagggcct

SEQ ID NO: 367391 - DNA, 140 bp, Artificial Sequence
  Synthetic
atacgccatgctgggtctcctatcttcttggatcaagtgcatgacagcttgtaaggattttgcaaacatcaatgacagggttcagaaattcatttaccatctttctgaagagctatatgacgtacttgggagtcggccat

SEQ ID NO: 367392 - DNA, 140 bp, Artificial Sequence
  Synthetic
atggccgactcccaagtacgtcatatagctcttcagaaagatggtaaatgaatttctgaaccctgtcattgatgtttgcaaaatccttacaagctgtcatgcacttgatccaagaagataggagacccagcatggcgtat

SEQ ID NO: 367393 - DNA, 140 bp, Artificial Sequence
  Synthetic
atacgccatgctgggtctcctggtatcttatgtcagtactgaaactatccctaagtttctgcttgcatttcttctttatgaagaagttttaatgaacttgatcaaccagtgtaaagcagtcgtacttgggagtcggccat

SEQ ID NO: 367394 - DNA, 140 bp, Artificial Sequence
  Synthetic
atggccgactcccaagtacgactgctttacactggttgatcaagttcattaaaacttcttcataaagaagaaatgcaagcagaaacttagggatagtttcagtactgacataagataccaggagacccagcatggcgtat

SEQ ID NO: 367395 - DNA, 140 bp, Artificial Sequence
  Synthetic
atacgccatgctgggtctcctagcctcaatgtttcaacggaagagtactcggctgaagtgtctagacttaaacaaacattaacagccagaaatgttctgcatgggttggctggaggaattcgtacttgggagtcggccat

SEQ ID NO: 367396 - DNA, 140 bp, Artificial Sequence
  Synthetic
atggccgactcccaagtacgaattcctccagccaacccatgcagaacatttctggctgttaatgtttgtttaagtctagacacttcagccgagtactcttccgttgaaacattgaggctaggagacccagcatggcgtat

SEQ ID NO: 367397 - DNA, 140 bp, Artificial Sequence
  Synthetic
atacgccatgctgggtctccatgtgtcactgaaggttaacattatcttagtgcctctcaaagacatgtctaagtcaaagcctgagagagtagtcatagctagaaggtcactaaatcatgccgtacttgggagtcggccat

SEQ ID NO: 367398 - DNA, 140 bp, Artificial Sequence
  Synthetic
atggccgactcccaagtacggcatgatttagtgaccttctagctatgactactctctcaggctttgacttagacatgtctttgagaggcactaagataatgttaaccttcagtgacacatggagacccagcatggcgtat

SEQ ID NO: 367399 - DNA, 140 bp, Artificial Sequence
  Synthetic
aggccctggctgctgatatgaagtcaaagcctgagagagtagtcatagctagaaggtcactaaatcatgccctgtctttgatgtttctggacgaaatgtcattacctgagctgaaatcctgaccttttgggacagcggtg

SEQ ID NO: 367400 - DNA, 140 bp, Artificial Sequence
  Synthetic
caccgctgtcccaaaaggtcaggatttcagctcaggtaatgacatttcgtccagaaacatcaaagacagggcatgatttagtgaccttctagctatgactactctctcaggctttgacttcatatcagcagccagggcct

SEQ ID NO: 367401 - DNA, 140 bp, Artificial Sequence
  Synthetic
atacgccatgctgggtctccttcaccattttgaaggacaatagcacaaggctagattacaataagttgattgatcactgtgtggatatggagaagaaaagggacgcagtcagagcagtggcgtacttgggagtcggccat

SEQ ID NO: 367402 - DNA, 140 bp, Artificial Sequence
  Synthetic
atggccgactcccaagtacgccactgctctgactgcgtcccttttcttctccatatccacacagtgatcaatcaacttattgtaatctagccttgtgctattgtccttcaaaatggtgaaggagacccagcatggcgtat

SEQ ID NO: 367403 - DNA, 140 bp, Artificial Sequence
  Synthetic
aggccctggctgctgatatgtgatcactgtgtggatatggagaagaaaagggacgcagtcagagcagtggaagatttggttttaatgttaacaggcagggcagtcaaacctagtactgtggaccttttgggacagcggtg

SEQ ID NO: 367404 - DNA, 140 bp, Artificial Sequence
  Synthetic
caccgctgtcccaaaaggtccacagtactaggtttgactgccctgcctgttaacattaaaaccaaatcttccactgctctgactgcgtcccttttcttctccatatccacacagtgatcacatatcagcagccagggcct

SEQ ID NO: 367405 - DNA, 140 bp, Artificial Sequence
  Synthetic
atacgccatgctgggtctcctgatctaatggcaagtgacacaacagcagacctgcctgataaggaagcggaagccctcagaacaggcaatcttggcttcaactgggattcagattgaacacgtacttgggagtcggccat

SEQ ID NO: 367406 - DNA, 140 bp, Artificial Sequence
  Synthetic
atggccgactcccaagtacgtgttcaatctgaatcccagttgaagccaagattgcctgttctgagggcttccgcttccttatcaggcaggtctgctgttgtgtcacttgccattagatcaggagacccagcatggcgtat

SEQ ID NO: 367407 - DNA, 140 bp, Artificial Sequence
  Synthetic
aggccctggctgctgatatgaagccctcagaacaggcaatcttggcttcaactgggattcagattgaacatgccgtctgtgtatatcatcaacaccttttaatgtcttgaggacaaataagaccttttgggacagcggtg

SEQ ID NO: 367408 - DNA, 140 bp, Artificial Sequence
  Synthetic
caccgctgtcccaaaaggtcttatttgtcctcaagacattaaaaggtgttgatgatatacacagacggcatgttcaatctgaatcccagttgaagccaagattgcctgttctgagggcttcatatcagcagccagggcct

SEQ ID NO: 367409 - DNA, 140 bp, Artificial Sequence
  Synthetic
aggccctggctgctgatatgaacgtaatgtggaatatctgataaaactgatgatgagcatgtcaggcattgactgtataaaatatcctacaggccagcttattactcatggaagagtaaggaccttttgggacagcggtg

SEQ ID NO: 367410 - DNA, 140 bp, Artificial Sequence
  Synthetic
caccgctgtcccaaaaggtccttactcttccatgagtaataagctggcctgtaggatattttatacagtcaatgcctgacatgctcatcatcagttttatcagatattccacattacgttcatatcagcagccagggcct

SEQ ID NO: 367411 - DNA, 140 bp, Artificial Sequence
  Synthetic
atacgccatgctgggtctccgcacttacaagtgtagaggaaccgtatagacggtctagcctagatgaggtcactctatctaagaaacaagcagagatattgaggcaaaaggcatctcagtcgtacttgggagtcggccat

SEQ ID NO: 367412 - DNA, 140 bp, Artificial Sequence
  Synthetic
atggccgactcccaagtacgactgagatgccttttgcctcaatatctctgcttgtttcttagatagagtgacctcatctaggctagaccgtctatacggttcctctacacttgtaagtgcggagacccagcatggcgtat

SEQ ID NO: 367413 - DNA, 140 bp, Artificial Sequence
  Synthetic
aggccctggctgctgatatgtattttagtgcaattctttctaccattagtttgcttttactgtcttaccattcttcttcctttgccattcatttcagtttgattatttctagggtgtggggaccttttgggacagcggtg

SEQ ID NO: 367414 - DNA, 140 bp, Artificial Sequence
  Synthetic
caccgctgtcccaaaaggtccccacaccctagaaataatcaaactgaaatgaatggcaaaggaagaagaatggtaagacagtaaaagcaaactaatggtagaaagaattgcactaaaatacatatcagcagccagggcct

SEQ ID NO: 367415 - DNA, 140 bp, Artificial Sequence
  Synthetic
aggccctggctgctgatatgtctcagacactggaatcgatgcaagcacatattctgtgaaatactggaaaattcttcactgtatttctgccattggatgtttgcctttgagtcaagcagagaccttttgggacagcggtg

SEQ ID NO: 367416 - DNA, 140 bp, Artificial Sequence
  Synthetic
caccgctgtcccaaaaggtctctgcttgactcaaaggcaaacatccaatggcagaaatacagtgaagaattttccagtatttcacagaatatgtgcttgcatcgattccagtgtctgagacatatcagcagccagggcct

SEQ ID NO: 367417 - DNA, 140 bp, Artificial Sequence
  Synthetic
aggccctggctgctgatatgttcgttttggcatgcttgcagggcttagtaggcttgtttgccctaatgagctaggaaaaaagttttcaacaagttgtagaaggattgaagacaacattgcgaccttttgggacagcggtg

SEQ ID NO: 367418 - DNA, 140 bp, Artificial Sequence
  Synthetic
caccgctgtcccaaaaggtcgcaatgttgtcttcaatccttctacaacttgttgaaaacttttttcctagctcattagggcaaacaagcctactaagccctgcaagcatgccaaaacgaacatatcagcagccagggcct

SEQ ID NO: 367419 - DNA, 140 bp, Artificial Sequence
  Synthetic
aggccctggctgctgatatgttcctaaagcagcacaatctggaaattatggaaacagtgaatcttatattctttgcagccctctcagctccctggtgcttacactacaaggcactagagtgaccttttgggacagcggtg

SEQ ID NO: 367420 - DNA, 140 bp, Artificial Sequence
  Synthetic
caccgctgtcccaaaaggtcactctagtgccttgtagtgtaagcaccagggagctgagagggctgcaaagaatataagattcactgtttccataatttccagattgtgctgctttaggaacatatcagcagccagggcct

SEQ ID NO: 367421 - DNA, 140 bp, Artificial Sequence
  Synthetic
aggccctggctgctgatatggagtggattgagcatcccgaatgcaccatgcccaccaacactatgcatacactattagtgtgcttcattctttacctacaactgttgggtctaggaggaggaccttttgggacagcggtg

SEQ ID NO: 367422 - DNA, 140 bp, Artificial Sequence
  Synthetic
caccgctgtcccaaaaggtcctcctcctagacccaacagttgtaggtaaagaatgaagcacactaatagtgtatgcatagtgttggtgggcatggtgcattcgggatgctcaatccactccatatcagcagccagggcct

SEQ ID NO: 367423 - DNA, 140 bp, Artificial Sequence
  Synthetic
aggccctggctgctgatatggagtttgatggacaagttatcgctaacatacttgcaagtgaattgagctctgtaaaacgagattctgagcgtgaagggttaactgatctccttgattatcgaccttttgggacagcggtg

SEQ ID NO: 367424 - DNA, 140 bp, Artificial Sequence
  Synthetic
caccgctgtcccaaaaggtcgataatcaaggagatcagttaacccttcacgctcagaatctcgttttacagagctcaattcacttgcaagtatgttagcgataacttgtccatcaaactccatatcagcagccagggcct

SEQ ID NO: 367425 - DNA, 140 bp, Artificial Sequence
  Synthetic
atacgccatgctgggtctccgcacccggcacaagccatagcctcaagccacttgtgagcacaaccccaccacaagcaccggaatcatccaccattaaacccactacaccaacaagcgaaacgtacttgggagtcggccat

SEQ ID NO: 367426 - DNA, 140 bp, Artificial Sequence
  Synthetic
atggccgactcccaagtacgtttcgcttgttggtgtagtgggtttaatggtggatgattccggtgcttgtggtggggttgtgctcacaagtggcttgaggctatggcttgtgccgggtgcggagacccagcatggcgtat

SEQ ID NO: 367427 - DNA, 140 bp, Artificial Sequence
  Synthetic
aggccctggctgctgatatgacaagcaccggaatcatccaccattaaacccactacaccaacaagcgaaacagaaggctcaggggaagcgaccccactttcaaacaccatccaggccccggaccttttgggacagcggtg

SEQ ID NO: 367428 - DNA, 140 bp, Artificial Sequence
  Synthetic
caccgctgtcccaaaaggtccggggcctggatggtgtttgaaagtggggtcgcttcccctgagccttctgtttcgcttgttggtgtagtgggtttaatggtggatgattccggtgcttgtcatatcagcagccagggcct

SEQ ID NO: 367429 - DNA, 140 bp, Artificial Sequence
  Synthetic
atacgccatgctgggtctccgtcaggcacagacagcacgaactccaccacacagacgaccgataataaccccacaacaacagtcggcacaagtccatccagcagccccagtacgccatcccgtacttgggagtcggccat

SEQ ID NO: 367430 - DNA, 140 bp, Artificial Sequence
  Synthetic
atggccgactcccaagtacgggatggcgtactggggctgctggatggacttgtgccgactgttgttgtggggttattatcggtcgtctgtgtggtggagttcgtgctgtctgtgcctgacggagacccagcatggcgtat

SEQ ID NO: 367431 - DNA, 140 bp, Artificial Sequence
  Synthetic
aggccctggctgctgatatgacagcatcaattgttcctgagcctcctccctcagtcacatgaatgtctacaaaagcacaaggacggcagcgcactttcagtcatacctgacagcagcaacgaccttttgggacagcggtg

SEQ ID NO: 367432 - DNA, 140 bp, Artificial Sequence
  Synthetic
caccgctgtcccaaaaggtcgttgctgctgtcaggtatgactgaaagtgcgctgccgtccttgtgcttttgtagacattcatgtgactgagggaggaggctcaggaacaattgatgctgtcatatcagcagccagggcct

SEQ ID NO: 367433 - DNA, 140 bp, Artificial Sequence
  Synthetic
atacgccatgctgggtctccaaaagcacaaggacggcagcgcactttcagtcatacctgacagcagcaacccccgactactcaaatttgtacctcttaaaaaaggtttagcagtggtgaacgtacttgggagtcggccat

SEQ ID NO: 367434 - DNA, 140 bp, Artificial Sequence
  Synthetic
atggccgactcccaagtacgttcaccactgctaaaccttttttaagaggtacaaatttgagtagtcgggggttgctgctgtcaggtatgactgaaagtgcgctgccgtccttgtgcttttggagacccagcatggcgtat

SEQ ID NO: 367435 - DNA, 140 bp, Artificial Sequence
  Synthetic
atacgccatgctgggtctccgatcattgaagacccaatgatacaactaattccagagaagttaaggagagagctggagaggctaggagtctcaagaatggaagttgatgaattgatgccacgtacttgggagtcggccat

SEQ ID NO: 367436 - DNA, 140 bp, Artificial Sequence
  Synthetic
atggccgactcccaagtacgtggcatcaattcatcaacttccattcttgagactcctagcctctccagctctctccttaacttctctggaattagttgtatcattgggtcttcaatgatcggagacccagcatggcgtat

SEQ ID NO: 367437 - DNA, 140 bp, Artificial Sequence
  Synthetic
atacgccatgctgggtctcccgcaatcaacccttctaatgagtgctgctcctacagctgtccagagcatacatcccagcccaacgaacaggtctaagaggaaccttgagacggaaataatcgtacttgggagtcggccat

SEQ ID NO: 367438 - DNA, 140 bp, Artificial Sequence
  Synthetic
atggccgactcccaagtacgattatttccgtctcaaggttcctcttagacctgttcgttgggctgggatgtatgctctggacagctgtaggagcagcactcattagaagggttgattgcgggagacccagcatggcgtat

SEQ ID NO: 367439 - DNA, 140 bp, Artificial Sequence
  Synthetic
atacgccatgctgggtctcctagtgatgccataatggaggtagagagtaagagcagcttgctgcacaagtacctcaaatcaggaggtgtcagacagcgaaacactgaagtactcttcagacgtacttgggagtcggccat

SEQ ID NO: 367440 - DNA, 140 bp, Artificial Sequence
  Synthetic
atggccgactcccaagtacgtctgaagagtacttcagtgtttcgctgtctgacacctcctgatttgaggtacttgtgcagcaagctgctcttactctctacctccattatggcatcactaggagacccagcatggcgtat

SEQ ID NO: 367441 - DNA, 140 bp, Artificial Sequence
  Synthetic
atacgccatgctgggtctccttaaaacaccaagcacagtaagccccacggagccatctcatgccagactaccaacagcagaacccttcaaatcttacttcgctaagggtttcctttcaatcgtacttgggagtcggccat

SEQ ID NO: 367442 - DNA, 140 bp, Artificial Sequence
  Synthetic
atggccgactcccaagtacgattgaaaggaaacccttagcgaagtaagatttgaagggttctgctgttggtagtctggcatgagatggctccgtggggcttactgtgcttggtgttttaaggagacccagcatggcgtat

SEQ ID NO: 367443 - DNA, 140 bp, Artificial Sequence
  Synthetic
atacgccatgctgggtctcccgctaccactcagctgttggtctgaagttcaaaactacattgaagatataggcttcaacaatgtgcttgttaacattgacagaaacacagtgaaaagtgacgtacttgggagtcggccat

SEQ ID NO: 367444 - DNA, 140 bp, Artificial Sequence
  Synthetic
atggccgactcccaagtacgtcacttttcactgtgtttctgtcaatgttaacaagcacattgttgaagcctatatcttcaatgtagttttgaacttcagaccaacagctgagtggtagcgggagacccagcatggcgtat

SEQ ID NO: 367445 - DNA, 140 bp, Artificial Sequence
  Synthetic
aggccctggctgctgatatgggcttcaacaatgtgcttgttaacattgacagaaacacagtgaaaagtgaacttttgtggaaatttacgttagacactaatgtaagcaccacaagcaccagaccttttgggacagcggtg

SEQ ID NO: 367446 - DNA, 140 bp, Artificial Sequence
  Synthetic
caccgctgtcccaaaaggtctggtgcttgtggtgcttacattagtgtctaacgtaaatttccacaaaagttcacttttcactgtgtttctgtcaatgttaacaagcacattgttgaagcccatatcagcagccagggcct

SEQ ID NO: 367447 - DNA, 140 bp, Artificial Sequence
  Synthetic
aggccctggctgctgatatggtatcaaaaagacgatgaagaattaacaaatagctcaagtttaaaacttgggtttttagtgaaatatgctgtcaccttgttcacatccaatggtgaacccgaccttttgggacagcggtg

SEQ ID NO: 367448 - DNA, 140 bp, Artificial Sequence
  Synthetic
caccgctgtcccaaaaggtcgggttcaccattggatgtgaacaaggtgacagcatatttcactaaaaacccaagttttaaacttgagctatttgttaattcttcatcgtctttttgataccatatcagcagccagggcct

SEQ ID NO: 367449 - DNA, 140 bp, Artificial Sequence
  Synthetic
atacgccatgctgggtctcctattacacctgacccctccactgtcacacccacaacaccagccagtggattagaaggctcaggggaagtttacacatcccctccgatcaccaccgggagccgtacttgggagtcggccat

SEQ ID NO: 367450 - DNA, 140 bp, Artificial Sequence
  Synthetic
atggccgactcccaagtacggctcccggtggtgatcggaggggatgtgtaaacttcccctgagccttctaatccactggctggtgttgtgggtgtgacagtggaggggtcaggtgtaataggagacccagcatggcgtat

SEQ ID NO: 367451 - DNA, 140 bp, Artificial Sequence
  Synthetic
atacgccatgctgggtctccagaaattaagataggcaaggcatcaacaggctctaggaaactactgtccaaagagccaggtgatgactgtatatcaagaactcagctaatgaggacagaacgtacttgggagtcggccat

SEQ ID NO: 367452 - DNA, 140 bp, Artificial Sequence
  Synthetic
atggccgactcccaagtacgttctgtcctcattagctgagttcttgatatacagtcatcacctggctctttggacagtagtttcctagagcctgttgatgccttgcctatcttaatttctggagacccagcatggcgtat

SEQ ID NO: 367453 - DNA, 140 bp, Artificial Sequence
  Synthetic
aggccctggctgctgatatgggtgttataccatcaacagggtgaagtcattcaagctatgtgaaaacagcgccacagggaaagcctgtgaagtggacagcactccggttaagtgcaggcagaccttttgggacagcggtg

SEQ ID NO: 367454 - DNA, 140 bp, Artificial Sequence
  Synthetic
caccgctgtcccaaaaggtctgcctgcacttaaccggagtgctgtccacttcacaggctttccctgtggcgctgttttcacatagcttgaatgacttcaccctgttgatggtataacacccatatcagcagccagggcct

SEQ ID NO: 367455 - DNA, 140 bp, Artificial Sequence
  Synthetic
atacgccatgctgggtctccagcaaacactaacagctcgaaatgtcctgcatggactagctggagggataaaagagctttcactccctatctacacaatattcatgaaatcttattttttcgtacttgggagtcggccat

SEQ ID NO: 367456 - DNA, 140 bp, Artificial Sequence
  Synthetic
atggccgactcccaagtacgaaaaaataagatttcatgaatattgtgtagatagggagtgaaagctcttttatccctccagctagtccatgcaggacatttcgagctgttagtgtttgctggagacccagcatggcgtat

SEQ ID NO: 367457 - DNA, 140 bp, Artificial Sequence
  Synthetic
atacgccatgctgggtctcccgctattaggtaagttggccatttacatttgcagaatgtcaaatcatcctagaacaactatggcttttctcttctggttcggctttggctatgtgatcaccgtacttgggagtcggccat

SEQ ID NO: 367458 - DNA, 140 bp, Artificial Sequence
  Synthetic
atggccgactcccaagtacggtgatcacatagccaaagccgaaccagaagagaaaagccatagttgttctaggatgatttgacattctgcaaatgtaaatggccaacttacctaatagcgggagacccagcatggcgtat

SEQ ID NO: 367459 - DNA, 140 bp, Artificial Sequence
  Synthetic
aggccctggctgctgatatgtgtcccaggggcaaacgagacagtctataccataacaattgccaacatcaaagctctcaaacgagctagctgctctgcatttctcacagtcaactcagctgaccttttgggacagcggtg

SEQ ID NO: 367460 - DNA, 140 bp, Artificial Sequence
  Synthetic
caccgctgtcccaaaaggtcagctgagttgactgtgagaaatgcagagcagctagctcgtttgagagctttgatgttggcaattgttatggtatagactgtctcgtttgcccctgggacacatatcagcagccagggcct

SEQ ID NO: 367461 - DNA, 140 bp, Artificial Sequence
  Synthetic
atacgccatgctgggtctcctagggaaaaagatcaagcaatatagggaactgaaacctcaaacttgcaccatatgtgagacagctcctgtcaatgcaatagatgctgaaatgcatgacctcgtacttgggagtcggccat

SEQ ID NO: 367462 - DNA, 140 bp, Artificial Sequence
  Synthetic
atggccgactcccaagtacgaggtcatgcatttcagcatctattgcattgacaggagctgtctcacatatggtgcaagtttgaggtttcagttccctatattgcttgatctttttccctaggagacccagcatggcgtat

SEQ ID NO: 367463 - DNA, 140 bp, Artificial Sequence
  Synthetic
atacgccatgctgggtctccgcaaaatggaaaacaaaatcgaggtgaataataaagatgagatgaacaggtggtttgaagagttcaagaaagagaatgggcttgtagacactttcacaaacgtacttgggagtcggccat

SEQ ID NO: 367464 - DNA, 140 bp, Artificial Sequence
  Synthetic
atggccgactcccaagtacgtttgtgaaagtgtctacaagcccattctctttcttgaactcttcaaaccacctgttcatctcatctttattattcacctcgattttgttttccattttgcggagacccagcatggcgtat

SEQ ID NO: 367465 - DNA, 140 bp, Artificial Sequence
  Synthetic
aggccctggctgctgatatgagatggctagtgccaccgatgatgcacaaaaggattccatctatgcagctgcactggtggaagcaaccaaattctgtgcacctatatacgagtgtgcttggaccttttgggacagcggtg

SEQ ID NO: 367466 - DNA, 140 bp, Artificial Sequence
  Synthetic
caccgctgtcccaaaaggtccaagcacactcgtatataggtgcacagaatttggttgcttccaccagtgcagctgcatagatggaatccttttgtgcatcatcggtggcactagccatctcatatcagcagccagggcct

SEQ ID NO: 367467 - DNA, 140 bp, Artificial Sequence
  Synthetic
atacgccatgctgggtctccgcactggtggaagcaaccaaattctgtgcacctatatacgagtgtgcttgggttagctccactggcatcgtcaagaaggggctagaatggtttgaaaaaacgtacttgggagtcggccat

SEQ ID NO: 367468 - DNA, 140 bp, Artificial Sequence
  Synthetic
atggccgactcccaagtacgttttttcaaaccattctagccccttcttgacgatgccagtggagctaacccaagcacactcgtatataggtgcacagaatttggttgcttccaccagtgcggagacccagcatggcgtat

SEQ ID NO: 367469 - DNA, 140 bp, Artificial Sequence
  Synthetic
atacgccatgctgggtctccagaaggattcacaagcatctgtctctttatgttaggaagcatcctatttatagtctcttgcatagtgaaggggctggttgacagtgtcagtgacagcttccgtacttgggagtcggccat

SEQ ID NO: 367470 - DNA, 140 bp, Artificial Sequence
  Synthetic
atggccgactcccaagtacggaagctgtcactgacactgtcaaccagccccttcactatgcaagagactataaataggatgcttcctaacataaagagacagatgcttgtgaatccttctggagacccagcatggcgtat

SEQ ID NO: 367471 - DNA, 140 bp, Artificial Sequence
  Synthetic
aggccctggctgctgatatggaagttcccaaaatagaacagctatctaattaccagcaggctgctctcaagtggaggaaggacataggcttccgtgtcaatgcaaatacggcaaccctgagaccttttgggacagcggtg

SEQ ID NO: 367472 - DNA, 140 bp, Artificial Sequence
  Synthetic
caccgctgtcccaaaaggtctcagggttgccgtatttgcattgacacggaagcctatgtccttcctccacttgagagcagcctgctggtaattagatagctgttctattttgggaacttccatatcagcagccagggcct

SEQ ID NO: 367473 - DNA, 140 bp, Artificial Sequence
  Synthetic
atacgccatgctgggtctccgtggaggaaggacataggcttccgtgtcaatgcaaatacggcaaccctgagccataaagtccttgcagagtataaagtacctggtgagattgtgatgtctcgtacttgggagtcggccat

SEQ ID NO: 367474 - DNA, 140 bp, Artificial Sequence
  Synthetic
atggccgactcccaagtacgagacatcacaatctcaccaggtactttatactctgcaaggactttatggctcagggttgccgtatttgcattgacacggaagcctatgtccttcctccacggagacccagcatggcgtat

SEQ ID NO: 367475 - DNA, 140 bp, Artificial Sequence
  Synthetic
aggccctggctgctgatatgcagaggtggtgatgagaacccacgtggcccagtgagccgtgaacatgtggagtggtgcagggaatttgttaaaggcaagtacataatggcctttaaccctgaccttttgggacagcggtg

SEQ ID NO: 367476 - DNA, 140 bp, Artificial Sequence
  Synthetic
caccgctgtcccaaaaggtcagggttaaaggccattatgtacttgcctttaacaaattccctgcaccactccacatgttcacggctcactgggccacgtgggttctcatcaccacctctgcatatcagcagccagggcct

SEQ ID NO: 367477 - DNA, 140 bp, Artificial Sequence
  Synthetic
atacgccatgctgggtctccacgcatgtgctttagggcaaccatagaagtaagcagaagagccctgctcatccgaagcatcatcaataccacttttgtaatatgtattctaacattaacacgtacttgggagtcggccat

SEQ ID NO: 367478 - DNA, 140 bp, Artificial Sequence
  Synthetic
atggccgactcccaagtacgtgttaatgttagaatacatattacaaaagtggtattgatgatgcttcggatgagcagggctcttctgcttacttctatggttgccctaaagcacatgcgtggagacccagcatggcgtat

SEQ ID NO: 367479 - DNA, 140 bp, Artificial Sequence
  Synthetic
atacgccatgctgggtctccactaagtatactcactggttggacacctttctaagctgttctgtttccatcaacagacacactactgtcaaagagtcttccctatttaactcaaacatcacgtacttgggagtcggccat

SEQ ID NO: 367480 - DNA, 140 bp, Artificial Sequence
  Synthetic
atggccgactcccaagtacgtgatgtttgagttaaatagggaagactctttgacagtagtgtgtctgttgatggaaacagaacagcttagaaaggtgtccaaccagtgagtatacttagtggagacccagcatggcgtat

SEQ ID NO: 367481 - DNA, 140 bp, Artificial Sequence
  Synthetic
aggccctggctgctgatatgaagctaagaagactgtagaggctcttaacggatatctagacaaacataaggacgaagttgacaaatcaagtgctgacagcatgataacaaaccttctcaagaccttttgggacagcggtg

SEQ ID NO: 367482 - DNA, 140 bp, Artificial Sequence
  Synthetic
caccgctgtcccaaaaggtcttgagaaggtttgttatcatgctgtcagcacttgatttgtcaacttcgtccttatgtttgtctagatatccgttaagagcctctacagtcttcttagcttcatatcagcagccagggcct

SEQ ID NO: 367483 - DNA, 140 bp, Artificial Sequence
  Synthetic
atacgccatgctgggtctccgacgaagttgacaaatcaagtgctgacagcatgataacaaaccttctcaagcacattgcgaaagcgcaagagctctataggaattcttctgcacttcgtgcgtacttgggagtcggccat

SEQ ID NO: 367484 - DNA, 140 bp, Artificial Sequence
  Synthetic
atggccgactcccaagtacgcacgaagtgcagaagaattcctatagagctcttgcgctttcgcaatgtgcttgagaaggtttgttatcatgctgtcagcacttgatttgtcaacttcgtcggagacccagcatggcgtat

SEQ ID NO: 367485 - DNA, 140 bp, Artificial Sequence
  Synthetic
atacgccatgctgggtctccctcaacaagtttggaaacaagcttatcaattgaagcaccatggggagcaataaatatccagtcaacctttaaaccaacagtatcggctgcaaacatagcacgtacttgggagtcggccat

SEQ ID NO: 367486 - DNA, 140 bp, Artificial Sequence
  Synthetic
atggccgactcccaagtacgtgctatgtttgcagccgatactgttggtttaaaggttgactggatatttattgctccccatggtgcttcaattgataagcttgtttccaaacttgttgagggagacccagcatggcgtat

SEQ ID NO: 367487 - DNA, 140 bp, Artificial Sequence
  Synthetic
aggccctggctgctgatatgaaggcaggtgtgactccagaaaccttcccaactgtctcacagttccttttcgagctggggaagcaaccaaggggcactaagaaaatgaagaaggcactccgaccttttgggacagcggtg

SEQ ID NO: 367488 - DNA, 140 bp, Artificial Sequence
  Synthetic
caccgctgtcccaaaaggtcggagtgccttcttcattttcttagtgccccttggttgcttccccagctcgaaaaggaactgtgagacagttgggaaggtttctggagtcacacctgccttcatatcagcagccagggcct

SEQ ID NO: 367489 - DNA, 140 bp, Artificial Sequence
  Synthetic
aggccctggctgctgatatgatgtgttaacaaggttcacttggtttcaagaggtggtgctttatggtaagatatgtgagaccttcttaaggtgttgcacagaattcaatagatcaggggtgaccttttgggacagcggtg

SEQ ID NO: 367490 - DNA, 140 bp, Artificial Sequence
  Synthetic
caccgctgtcccaaaaggtcacccctgatctattgaattctgtgcaacaccttaagaaggtctcacatatcttaccataaagcaccacctcttgaaaccaagtgaaccttgttaacacatcatatcagcagccagggcct

SEQ ID NO: 367491 - DNA, 140 bp, Artificial Sequence
  Synthetic
aggccctggctgctgatatgtggcagaatcagtgagatgggtgtctgctttgggacaatccctgtggccaatccagatgatgctgccctagggtctggacacaccaagtctattcttaatgaccttttgggacagcggtg

SEQ ID NO: 367492 - DNA, 140 bp, Artificial Sequence
  Synthetic
caccgctgtcccaaaaggtcattaagaatagacttggtgtgtccagaccctagggcagcatcatctggattggccacagggattgtcccaaagcagacacccatctcactgattctgccacatatcagcagccagggcct

SEQ ID NO: 367493 - DNA, 140 bp, Artificial Sequence
  Synthetic
atacgccatgctgggtctccatccagatgatgctgccctagggtctggacacaccaagtctattcttaatcttcgaacaagcaccgaggcaaacaatccatgtgcaaagacaattgtcaacgtacttgggagtcggccat

SEQ ID NO: 367494 - DNA, 140 bp, Artificial Sequence
  Synthetic
atggccgactcccaagtacgttgacaattgtctttgcacatggattgtttgcctcggtgcttgttcgaagattaagaatagacttggtgtgtccagaccctagggcagcatcatctggatggagacccagcatggcgtat

SEQ ID NO: 367495 - DNA, 140 bp, Artificial Sequence
  Synthetic
atacgccatgctgggtctcctcaagaaactggagatgcaatcctacttggtgctggggggtaggaaccggctgcacctgctgcggagtggatgtaaaagacctttttatagatcacatgtcgtacttgggagtcggccat

SEQ ID NO: 367496 - DNA, 140 bp, Artificial Sequence
  Synthetic
atggccgactcccaagtacgacatgtgatctataaaaaggtcttttacatccactccgcagcaggtgcagccggttcctaccccccagcaccaagtaggattgcatctccagtttcttgaggagacccagcatggcgtat

SEQ ID NO: 367497 - DNA, 140 bp, Artificial Sequence
  Synthetic
aggccctggctgctgatatgtggcctctgagcatctgctacaccaatcccttgttggtaagcagtctccattccagaatgcttacaatgtcaagggtaacgccaccagtgctaacatcatgaccttttgggacagcggtg

SEQ ID NO: 367498 - DNA, 140 bp, Artificial Sequence
  Synthetic
caccgctgtcccaaaaggtcatgatgttagcactggtggcgttacccttgacattgtaagcattctggaatggagactgcttaccaacaagggattggtgtagcagatgctcagaggccacatatcagcagccagggcct

SEQ ID NO: 367499 - DNA, 140 bp, Artificial Sequence
  Synthetic
aggccctggctgctgatatgctacaactgcaaccattaaccatgcttattcttactgctcatataattctgtcttgtctactcttctttatcttcttttgttttaaacacttaaagggctgaccttttgggacagcggtg

SEQ ID NO: 367500 - DNA, 140 bp, Artificial Sequence
  Synthetic
caccgctgtcccaaaaggtcagccctttaagtgtttaaaacaaaagaagataaagaagagtagacaagacagaattatatgagcagtaagaataagcatggttaatggttgcagttgtagcatatcagcagccagggcct

SEQ ID NO: 367501 - DNA, 140 bp, Artificial Sequence
  Synthetic
atacgccatgctgggtctccaatcaatcccccccttacccacgttgacacagatagctccagtagtggttcgttgtcctcatcaaactatggactttttaagaaaccttgactggactcacgtacttgggagtcggccat

SEQ ID NO: 367502 - DNA, 140 bp, Artificial Sequence
  Synthetic
atggccgactcccaagtacgtgagtccagtcaaggtttcttaaaaagtccatagtttgatgaggacaacgaaccactactggagctatctgtgtcaacgtgggtaagggggggattgattggagacccagcatggcgtat

SEQ ID NO: 367503 - DNA, 140 bp, Artificial Sequence
  Synthetic
atacgccatgctgggtctccgtgtaaactgcaaagttgcacacatggtataccaggagatctgcaagtctaccacattggcaacctattgaaaggggatagagtaaacgggcatctaattcgtacttgggagtcggccat

SEQ ID NO: 367504 - DNA, 140 bp, Artificial Sequence
  Synthetic
atggccgactcccaagtacgaattagatgcccgtttactctatcccctttcaataggttgccaatgtggtagacttgcagatctcctggtataccatgtgtgcaactttgcagtttacacggagacccagcatggcgtat

SEQ ID NO: 367505 - DNA, 140 bp, Artificial Sequence
  Synthetic
atacgccatgctgggtctcctgacctagactactactgcaacatgggggattggccttcttgcacatacacaggagtgacccagcacaatcatgctgcatttgtaaacttgcttaacattcgtacttgggagtcggccat

SEQ ID NO: 367506 - DNA, 140 bp, Artificial Sequence
  Synthetic
atggccgactcccaagtacgaatgttaagcaagtttacaaatgcagcatgattgtgctgggtcactcctgtgtatgtgcaagaaggccaatcccccatgttgcagtagtagtctaggtcaggagacccagcatggcgtat

SEQ ID NO: 367507 - DNA, 140 bp, Artificial Sequence
  Synthetic
aggccctggctgctgatatgcaaacatctaactgaggtggcagcacggaagtattaccaggaagagcctgaggctaagcttattggcctgagtttggaagactatcttacgaggatgctagaccttttgggacagcggtg

SEQ ID NO: 367508 - DNA, 140 bp, Artificial Sequence
  Synthetic
caccgctgtcccaaaaggtctagcatcctcgtaagatagtcttccaaactcaggccaataagcttagcctcaggctcttcctggtaatacttccgtgctgccacctcagttagatgtttgcatatcagcagccagggcct

SEQ ID NO: 367509 - DNA, 140 bp, Artificial Sequence
  Synthetic
atacgccatgctgggtctcccatcaaacaaaaaagagaatatgttatgttgtatatacagtagtaatatggagctcttacaaggacctttccatttgaacaggaggcaagctgtccttggcgtacttgggagtcggccat

SEQ ID NO: 367510 - DNA, 140 bp, Artificial Sequence
  Synthetic
atggccgactcccaagtacgccaaggacagcttgcctcctgttcaaatggaaaggtccttgtaagagctccatattactactgtatatacaacataacatattctcttttttgtttgatgggagacccagcatggcgtat

SEQ ID NO: 367511 - DNA, 140 bp, Artificial Sequence
  Synthetic
atacgccatgctgggtctccttgctatgcttgtagctctggcatctcctgtaaagtcaggattcatgtagatgaaccagatgagctcacagtacatgtgaagagcaatgatccagatgtgcgtacttgggagtcggccat

SEQ ID NO: 367512 - DNA, 140 bp, Artificial Sequence
  Synthetic
atggccgactcccaagtacgcacatctggatcattgctcttcacatgtactgtgagctcatctggttcatctacatgaatcctgactttacaggagatgccagagctacaagcatagcaaggagacccagcatggcgtat

SEQ ID NO: 367513 - DNA, 140 bp, Artificial Sequence
  Synthetic
aggccctggctgctgatatggagctcttacaaggacctttccatttgaacaggaggcaagctgtccttggctcatcatatctttatattgtcattacactttacatacaagtattgcagcgaccttttgggacagcggtg

SEQ ID NO: 367514 - DNA, 140 bp, Artificial Sequence
  Synthetic
caccgctgtcccaaaaggtcgctgcaatacttgtatgtaaagtgtaatgacaatataaagatatgatgagccaaggacagcttgcctcctgttcaaatggaaaggtccttgtaagagctccatatcagcagccagggcct

SEQ ID NO: 367515 - DNA, 140 bp, Artificial Sequence
  Synthetic
atacgccatgctgggtctcccttgctttagcacttactagcgcggaggaaccatatagacggtctagcttggatgaggttaccctgtctaagaaacaagcagaggtattgaggcagaaggcgtacttgggagtcggccat

SEQ ID NO: 367516 - DNA, 140 bp, Artificial Sequence
  Synthetic
atggccgactcccaagtacgccttctgcctcaatacctctgcttgtttcttagacagggtaacctcatccaagctagaccgtctatatggttcctccgcgctagtaagtgctaaagcaagggagacccagcatggcgtat

SEQ ID NO: 367517 - DNA, 140 bp, Artificial Sequence
  Synthetic
atacgccatgctgggtctccgctgttggctggaatcagtcaagagttttttttatggattgaagaacatgcttggcagtgtttttggtaattttttcataggcattttgttattccttgccgtacttgggagtcggccat

SEQ ID NO: 367518 - DNA, 140 bp, Artificial Sequence
  Synthetic
atggccgactcccaagtacggcaaggaataacaaaatgcctatgaaaaaattaccaaaaacactgccaagcatgttcttcaatccataaaaaaaactcttgactgattccagccaacagcggagacccagcatggcgtat

SEQ ID NO: 367519 - DNA, 140 bp, Artificial Sequence
  Synthetic
atacgccatgctgggtctccgtcggcagggttctggactgcatgtttaactgcaaactatgtgttgagatatcagctgacactctaattctgagaccagaatctaaggaaagaattggtgcgtacttgggagtcggccat

SEQ ID NO: 367520 - DNA, 140 bp, Artificial Sequence
  Synthetic
atggccgactcccaagtacgcaccaattctttccttagattctggtctcagaattagagtgtcagctgatatctcaacacatagtttgcagttaaacatgcagtccagaaccctgccgacggagacccagcatggcgtat

SEQ ID NO: 367521 - DNA, 140 bp, Artificial Sequence
  Synthetic
atacgccatgctgggtctcccaaatcaagcaggaattctcaaaaatgaagctctacgttaccaaagatctgcttgatcatctagatgtcggtgggctgttgagagcagccttccctggaacgtacttgggagtcggccat

SEQ ID NO: 367522 - DNA, 140 bp, Artificial Sequence
  Synthetic
atggccgactcccaagtacgttccagggaaggctgctctcaacagcccaccgacatctagatgatcaagcagatctttggtaacgtagagcttcatttttgagaattcctgcttgatttgggagacccagcatggcgtat

SEQ ID NO: 367523 - DNA, 140 bp, Artificial Sequence
  Synthetic
aggccctggctgctgatatgcagcaaaaaagggaaaaacagactgcttgatggtgaaaggttggctgataggaaaattgctgagctgttctctacaaaaacacacattggctaactcaacgaccttttgggacagcggtg

SEQ ID NO: 367524 - DNA, 140 bp, Artificial Sequence
  Synthetic
caccgctgtcccaaaaggtcgttgagttagccaatgtgtgtttttgtagagaacagctcagcaattttcctatcagccaacctttcaccatcaagcagtctgtttttcccttttttgctgcatatcagcagccagggcct

SEQ ID NO: 367525 - DNA, 140 bp, Artificial Sequence
  Synthetic
atacgccatgctgggtctcctaacaataaaaacaagaaaaaattcatcaccaactgcctgcttagcacagccctgtctggaaagaaggtgtacaaggttcttggtaacttaggaaatgaacgtacttgggagtcggccat

SEQ ID NO: 367526 - DNA, 140 bp, Artificial Sequence
  Synthetic
atggccgactcccaagtacgttcatttcctaagttaccaagaaccttgtacaccttctttccagacagggctgtgctaagcaggcagttggtgatgaattttttcttgtttttattgttaggagacccagcatggcgtat

SEQ ID NO: 367527 - DNA, 140 bp, Artificial Sequence
  Synthetic
aggccctggctgctgatatggcacctgatctgcttcactatatcaaagcaatgtttaaaactgccttagctctgcttgctctgaccttaactttgactgcgtgccgccactatatctttggaccttttgggacagcggtg

SEQ ID NO: 367528 - DNA, 140 bp, Artificial Sequence
  Synthetic
caccgctgtcccaaaaggtccaaagatatagtggcggcacgcagtcaaagttaaggtcagagcaagcagagctaaggcagttttaaacattgctttgatatagtgaagcagatcaggtgccatatcagcagccagggcct

SEQ ID NO: 367529 - DNA, 140 bp, Artificial Sequence
  Synthetic
atacgccatgctgggtctccctgttagtctgcttgcattaagaaatctggactttgactgtcttagtgtgcaggactacaatggtatgatagaaaatatgtccaaattggacaacactgacgtacttgggagtcggccat

SEQ ID NO: 367530 - DNA, 140 bp, Artificial Sequence
  Synthetic
atggccgactcccaagtacgtcagtgttgtccaatttggacatattttctatcataccattgtagtcctgcacactaagacagtcaaagtccagatttcttaatgcaagcagactaacagggagacccagcatggcgtat

SEQ ID NO: 367531 - DNA, 140 bp, Artificial Sequence
  Synthetic
atacgccatgctgggtctcctgttgagttcaaccacagggagatagccgatctcaaccagttaacttctcggcttattacgttaagaaaagaaaaggacactgacctccttaagcaatggcgtacttgggagtcggccat

SEQ ID NO: 367532 - DNA, 140 bp, Artificial Sequence
  Synthetic
atggccgactcccaagtacgccattgcttaaggaggtcagtgtccttttcttttcttaacgtaataagccgagaagttaactggttgagatcggctatctccctgtggttgaactcaacaggagacccagcatggcgtat

SEQ ID NO: 367533 - DNA, 140 bp, Artificial Sequence
  Synthetic
atacgccatgctgggtctcccaaagaaatacttgcggcacgtcagtacgtaagtgttaactttgaggaagtggattgagcatcttaattgcagcatacttgtcaacatcatgcatatatccgtacttgggagtcggccat

SEQ ID NO: 367534 - DNA, 140 bp, Artificial Sequence
  Synthetic
atggccgactcccaagtacggatatatgcatgatgttgacaagtatgctgcaattaagatgctcaatccacttcctcaaagttaacacttacgtactgacgtgccgcaagtatttctttgggagacccagcatggcgtat

SEQ ID NO: 367535 - DNA, 140 bp, Artificial Sequence
  Synthetic
atacgccatgctgggtctcccagcctggaagcatgcccttcgactaaagggaactgcatatgagggtttgtttgccaactgctatggatggcaatacatcccagaagacatcaaaccaagcgtacttgggagtcggccat

SEQ ID NO: 367536 - DNA, 140 bp, Artificial Sequence
  Synthetic
atggccgactcccaagtacgcttggtttgatgtcttctgggatgtattgccatccatagcagttggcaaacaaaccctcatatgcagttccctttagtcgaagggcatgcttccaggctgggagacccagcatggcgtat

SEQ ID NO: 367537 - DNA, 140 bp, Artificial Sequence
  Synthetic
atacgccatgctgggtctcctcgcttacacaaaagattcacttcaaaaagaatcagattcccagtgttgagaatgtgcagatctccatagatgcaacattgcctgaatctgtagaggcagcgtacttgggagtcggccat

SEQ ID NO: 367538 - DNA, 140 bp, Artificial Sequence
  Synthetic
atggccgactcccaagtacgctgcctctacagattcaggcaatgttgcatctatggagatctgcacattctcaacactgggaatctgattctttttgaagtgaatcttttgtgtaagcgaggagacccagcatggcgtat

SEQ ID NO: 367539 - DNA, 140 bp, Artificial Sequence
  Synthetic
atacgccatgctgggtctccgaggtgcattcaatagagcgcatcatggaaaacttcactcgcctcatgcatgaaggaaagtcttcaaccaagaaaaaagatgaagatccaacaggacaggcgtacttgggagtcggccat

SEQ ID NO: 367540 - DNA, 140 bp, Artificial Sequence
  Synthetic
atggccgactcccaagtacgcctgtcctgttggatcttcatcttttttcttggttgaagactttccttcatgcatgaggcgagtgaagttttccatgatgcgctctattgaatgcacctcggagacccagcatggcgtat

SEQ ID NO: 367541 - DNA, 140 bp, Artificial Sequence
  Synthetic
atacgccatgctgggtctccaaggattatggcgaaaggggaatagttgaggagaatcacatgaggtttagtgaagaggatcagctggaaacgaggcagctgttgttagtagaagttggttcgtacttgggagtcggccat

SEQ ID NO: 367542 - DNA, 140 bp, Artificial Sequence
  Synthetic
atggccgactcccaagtacgaaccaacttctactaacaacagctgcctcgtttccagctgatcctcttcactaaacctcatgtgattctcctcaactattcccctttcgccataatccttggagacccagcatggcgtat

SEQ ID NO: 367543 - DNA, 140 bp, Artificial Sequence
  Synthetic
atacgccatgctgggtctccttcaaactgatattgatgggaaaataagaacagaccacaaaaaatggaaagatatattaaagctgttggagttactaggaatcaagtgctccttcattgccgtacttgggagtcggccat

SEQ ID NO: 367544 - DNA, 140 bp, Artificial Sequence
  Synthetic
atggccgactcccaagtacggcaatgaaggagcacttgattcctagtaactccaacagctttaatatatctttccattttttgtggtctgttcttattttcccatcaatatcagtttgaaggagacccagcatggcgtat

SEQ ID NO: 367545 - DNA, 140 bp, Artificial Sequence
  Synthetic
atacgccatgctgggtctccccaacagttgaacccttcaaatcctactttgctaaaggtttcctttcaatagattcaggttatttctctgccaaatgttattcaagaacatccaattcagcgtacttgggagtcggccat

SEQ ID NO: 367546 - DNA, 140 bp, Artificial Sequence
  Synthetic
atggccgactcccaagtacgctgaattggatgttcttgaataacatttggcagagaaataacctgaatctattgaaaggaaacctttagcaaagtaggatttgaagggttcaactgttggggagacccagcatggcgtat

SEQ ID NO: 367547 - DNA, 140 bp, Artificial Sequence
  Synthetic
atacgccatgctgggtctccatagagtgcgagtcttgaagaactcagtcagcttcctctttaacaaactctctagaaattcacctacagaggttactgatatagttgttggggctataagcgtacttgggagtcggccat

SEQ ID NO: 367548 - DNA, 140 bp, Artificial Sequence
  Synthetic
atggccgactcccaagtacgcttatagccccaacaactatatcagtaacctctgtaggtgaatttctagagagtttgttaaagaggaagctgactgagttcttcaagactcgcactctatggagacccagcatggcgtat

SEQ ID NO: 367549 - DNA, 140 bp, Artificial Sequence
  Synthetic
aggccctggctgctgatatgtctagaaattcacctacagaggttactgatatagttgttggggctataagcactcaaaaggttagaagttacttaaaagcagggactgctacaaaaacccgaccttttgggacagcggtg

SEQ ID NO: 367550 - DNA, 140 bp, Artificial Sequence
  Synthetic
caccgctgtcccaaaaggtcgggtttttgtagcagtccctgcttttaagtaacttctaaccttttgagtgcttatagccccaacaactatatcagtaacctctgtaggtgaatttctagacatatcagcagccagggcct

SEQ ID NO: 367551 - DNA, 140 bp, Artificial Sequence
  Synthetic
atacgccatgctgggtctccatacttaacaggcccacaggtttgacactgcctaccagtttggagcaggcaatgcgcaaaggactagtcgagggtgtggtcatctccaaggagggctctgcgtacttgggagtcggccat

SEQ ID NO: 367552 - DNA, 140 bp, Artificial Sequence
  Synthetic
atggccgactcccaagtacgcagagccctccttggagatgaccacaccctcgactagtcctttgcgcattgcctgctccaaactggtaggcagtgtcaaacctgtgggcctgttaagtatggagacccagcatggcgtat

SEQ ID NO: 367553 - DNA, 140 bp, Artificial Sequence
  Synthetic
aggccctggctgctgatatgaatgcgcaaaggactagtcgagggtgtggtcatctccaaggagggctctgaatcatgcatcaacatgttgaaggaaaatttggaccgaataactgatgaagaccttttgggacagcggtg

SEQ ID NO: 367554 - DNA, 140 bp, Artificial Sequence
  Synthetic
caccgctgtcccaaaaggtcttcatcagttattcggtccaaattttccttcaacatgttgatgcatgattcagagccctccttggagatgaccacaccctcgactagtcctttgcgcattcatatcagcagccagggcct

SEQ ID NO: 367555 - DNA, 140 bp, Artificial Sequence
  Synthetic
atacgccatgctgggtctccaaaaaagtaagctgaatgacaggtgtaccctattcaccaactgtgtgataaaaggaagagaagttcgtaaaggccagtcagtcctaaggcaatataagaccgtacttgggagtcggccat

SEQ ID NO: 367556 - DNA, 140 bp, Artificial Sequence
  Synthetic
atggccgactcccaagtacggtcttatattgccttaggactgactggcctttacgaacttctcttccttttatcacacagttggtgaatagggtacacctgtcattcagcttacttttttggagacccagcatggcgtat

SEQ ID NO: 367557 - DNA, 140 bp, Artificial Sequence
  Synthetic
atacgccatgctgggtctcctgaaaagatgctgttaagttggttaagtgaggacattaaatcatcaaggtgtagcgagtgccttgctaacataaagaaaactgttgatgaaactgccaaccgtacttgggagtcggccat

SEQ ID NO: 367558 - DNA, 140 bp, Artificial Sequence
  Synthetic
atggccgactcccaagtacggttggcagtttcatcaacagttttctttatgttagcaaggcactcgctacaccttgatgatttaatgtcctcacttaaccaacttaacagcatcttttcaggagacccagcatggcgtat

SEQ ID NO: 367559 - DNA, 140 bp, Artificial Sequence
  Synthetic
atacgccatgctgggtctccaagaatctggtgatgactgcatatcaagaactcagctattgaggacagagactgcagaggtccatggcgataactatggtggtccaggtgataagataaccgtacttgggagtcggccat

SEQ ID NO: 367560 - DNA, 140 bp, Artificial Sequence
  Synthetic
atggccgactcccaagtacggttatcttatcacctggaccaccatagttatcgccatggacctctgcagtctctgtcctcaatagctgagttcttgatatgcagtcatcaccagattcttggagacccagcatggcgtat

SEQ ID NO: 367561 - DNA, 140 bp, Artificial Sequence
  Synthetic
atacgccatgctgggtctccctgtagtaactgtcaccccaatggtgtgaatattagcaacatatcaaatgtacacaagaggtgtccaaaaatagaagtggtcagccattgtgaaaataaacgtacttgggagtcggccat

SEQ ID NO: 367562 - DNA, 140 bp, Artificial Sequence
  Synthetic
atggccgactcccaagtacgtttattttcacaatggctgaccacttctatttttggacacctcttgtgtacatttgatatgttgctaatattcacaccattggggtgacagttactacagggagacccagcatggcgtat

SEQ ID NO: 367563 - DNA, 140 bp, Artificial Sequence
  Synthetic
atacgccatgctgggtctccgctcacattaccaggaaagactgagaaggagagaagagtcaaacgtaatgtggaatatctgataaaattgatgatgagcatgtctggcattgactgtatacgtacttgggagtcggccat

SEQ ID NO: 367564 - DNA, 140 bp, Artificial Sequence
  Synthetic
atggccgactcccaagtacgtatacagtcaatgccagacatgctcatcatcaattttatcagatattccacattacgtttgactcttctctccttctcagtctttcctggtaatgtgagcggagacccagcatggcgtat

SEQ ID NO: 367565 - DNA, 140 bp, Artificial Sequence
  Synthetic
atacgccatgctgggtctccacacctgggcctaaaattactaacttaaagaccatcaactgcataaacttgaaggcatcgatctttaaagaacatagagaggttgaaatcaatgtgcttccgtacttgggagtcggccat

SEQ ID NO: 367566 - DNA, 140 bp, Artificial Sequence
  Synthetic
atggccgactcccaagtacggaagcacattgatttcaacctctctatgttctttaaagatcgatgccttcaagtttatgcagttgatggtctttaagttagtaattttaggcccaggtgtggagacccagcatggcgtat

SEQ ID NO: 367567 - DNA, 140 bp, Artificial Sequence
  Synthetic
atacgccatgctgggtctcccaatgacggaaacttgaaagataggagtgatgacgaccaaagactagttgagaagatagatactgtaagaaaagagctttcggaaactaaactaaaagaccgtacttgggagtcggccat

SEQ ID NO: 367568 - DNA, 140 bp, Artificial Sequence
  Synthetic
atggccgactcccaagtacggtcttttagtttagtttccgaaagctcttttcttacagtatctatcttctcaactagtctttggtcgtcatcactcctatctttcaagtttccgtcattgggagacccagcatggcgtat

SEQ ID NO: 367569 - DNA, 140 bp, Artificial Sequence
  Synthetic
aggccctggctgctgatatgagaagatagatactgtaagaaaagagctttcggaaactaaactaaaagactattcagcttatgcaagaggagtaatctcgaattcgctaaaaaacctctcgaccttttgggacagcggtg

SEQ ID NO: 367570 - DNA, 140 bp, Artificial Sequence
  Synthetic
caccgctgtcccaaaaggtcgagaggttttttagcgaattcgagattactcctcttgcataagctgaatagtcttttagtttagtttccgaaagctcttttcttacagtatctatcttctcatatcagcagccagggcct

SEQ ID NO: 367571 - DNA, 140 bp, Artificial Sequence
  Synthetic
atacgccatgctgggtctcctactatttgacttaaaggtgcccactaaagatgaagaagtactgataaacatcagaaattcactgaaggctagatctgagtttgtcagaaacaatgacaacgtacttgggagtcggccat

SEQ ID NO: 367572 - DNA, 140 bp, Artificial Sequence
  Synthetic
atggccgactcccaagtacgttgtcattgtttctgacaaactcagatctagccttcagtgaatttctgatgtttatcagtacttcttcatctttagtgggcacctttaagtcaaatagtaggagacccagcatggcgtat

SEQ ID NO: 367573 - DNA, 140 bp, Artificial Sequence
  Synthetic
atacgccatgctgggtctcccttttaaattgatgaagaacaagcaacctgtgccttttcaggttgattgtatactgtttaaggaagtggcagcagaatgcatgaagagatatattggcaccgtacttgggagtcggccat

SEQ ID NO: 367574 - DNA, 140 bp, Artificial Sequence
  Synthetic
atggccgactcccaagtacggtgccaatatatctcttcatgcattctgctgccacttccttaaacagtatacaatcaacctgaaaaggcacaggttgcttgttcttcatcaatttaaaagggagacccagcatggcgtat

SEQ ID NO: 367575 - DNA, 140 bp, Artificial Sequence
  Synthetic
atacgccatgctgggtctccaccttcttaaggtgttgcacagaattcaatagatcaggggttaagctagttaaggtaagacactgtgacattaacctatcagtcaagctgccatcaaacacgtacttgggagtcggccat

SEQ ID NO: 367576 - DNA, 140 bp, Artificial Sequence
  Synthetic
atggccgactcccaagtacgtgtttgatggcagcttgactgataggttaatgtcacagtgtcttaccttaactagcttaacccctgatctattgaattctgtgcaacaccttaagaaggtggagacccagcatggcgtat

SEQ ID NO: 367577 - DNA, 140 bp, Artificial Sequence
  Synthetic
aggccctggctgctgatatgttagaactactgactgtccactatctaaccatgaggcaaacattctaagtgagtttgatggacaggtcattgctaacatccttgccagtgaactgagttcgaccttttgggacagcggtg

SEQ ID NO: 367578 - DNA, 140 bp, Artificial Sequence
  Synthetic
caccgctgtcccaaaaggtcgaactcagttcactggcaaggatgttagcaatgacctgtccatcaaactcacttagaatgtttgcctcatggttagatagtggacagtcagtagttctaacatatcagcagccagggcct

SEQ ID NO: 367579 - DNA, 140 bp, Artificial Sequence
  Synthetic
atacgccatgctgggtctccgtctagaagtcataaacagtgtgaatgagaaaatattgcaagacattgaaaatcactctatgactctgctcgaagatgcattcaaagaactcacttctgccgtacttgggagtcggccat

SEQ ID NO: 367580 - DNA, 140 bp, Artificial Sequence
  Synthetic
atggccgactcccaagtacggcagaagtgagttctttgaatgcatcttcgagcagagtcatagagtgattttcaatgtcttgcaatattttctcattcacactgtttatgacttctagacggagacccagcatggcgtat

SEQ ID NO: 367581 - DNA, 140 bp, Artificial Sequence
  Synthetic
atacgccatgctgggtctccacgcatgtgtttcagggcaactatggaagtaagcaacaaggccctatttatccgtagcattatcaacaccacttttgttgtgtgcatactgatactagcgcgtacttgggagtcggccat

SEQ ID NO: 367582 - DNA, 140 bp, Artificial Sequence
  Synthetic
atggccgactcccaagtacgcgctagtatcagtatgcacacaacaaaagtggtgttgataatgctacggataaatagggccttgttgcttacttccatagttgccctgaaacacatgcgtggagacccagcatggcgtat

SEQ ID NO: 367583 - DNA, 140 bp, Artificial Sequence
  Synthetic
atacgccatgctgggtctccaagctagtgggaattttttaaacagaagcagcagagaccacttcataagtattgtttcaggcttaaacctggtttatggctttctcatgaaagataatttcgtacttgggagtcggccat

SEQ ID NO: 367584 - DNA, 140 bp, Artificial Sequence
  Synthetic
atggccgactcccaagtacgaaattatctttcatgagaaagccataaaccaggtttaagcctgaaacaatacttatgaagtggtctctgctgcttctgtttaaaaaattcccactagcttggagacccagcatggcgtat

SEQ ID NO: 367585 - DNA, 140 bp, Artificial Sequence
  Synthetic
atacgccatgctgggtctccagcactggaagcaaagagatttgtgccctgaagtgactattccatgtttcacagtctatggcacctttgttaatagcgacagacagctgatttttgatatcgtacttgggagtcggccat

SEQ ID NO: 367586 - DNA, 140 bp, Artificial Sequence
  Synthetic
atggccgactcccaagtacgatatcaaaaatcagctgtctgtcgctattaacaaaggtgccatagactgtgaaacatggaatagtcacttcagggcacaaatctctttgcttccagtgctggagacccagcatggcgtat

SEQ ID NO: 367587 - DNA, 140 bp, Artificial Sequence
  Synthetic
atacgccatgctgggtctccgtatcagcgtcttggaagaaacagcagaaaggcatatgctttgggagcttgatctgatgaactcactctgttctgacgagaaaagggatgctagaactgccgtacttgggagtcggccat

SEQ ID NO: 367588 - DNA, 140 bp, Artificial Sequence
  Synthetic
atggccgactcccaagtacggcagttctagcatcccttttctcgtcagaacagagtgagttcatcagatcaagctcccaaagcatatgcctttctgctgtttcttccaagacgctgatacggagacccagcatggcgtat

SEQ ID NO: 367589 - DNA, 140 bp, Artificial Sequence
  Synthetic
atacgccatgctgggtctccaagactgctattaggctgcccaaatgtaaggaaagctgcaaataaagaagggaaaaagctattaaagttaaacagcgatgcatccactgacacacaaagtcgtacttgggagtcggccat

SEQ ID NO: 367590 - DNA, 140 bp, Artificial Sequence
  Synthetic
atggccgactcccaagtacgactttgtgtgtcagtggatgcatcgctgtttaactttaatagctttttcccttctttatttgcagctttccttacatttgggcagcctaatagcagtcttggagacccagcatggcgtat

SEQ ID NO: 367591 - DNA, 140 bp, Artificial Sequence
  Synthetic
atacgccatgctgggtctcctgggctcttttgagttgatccaagcagtctcagagttcggcatgagtaagtttcctcccgaaaatatagacaaggcaagaagggatccaaagaactgggtcgtacttgggagtcggccat

SEQ ID NO: 367592 - DNA, 140 bp, Artificial Sequence
  Synthetic
atggccgactcccaagtacgacccagttctttggatcccttcttgccttgtctatattttcgggaggaaacttactcatgccgaactctgagactgcttggatcaactcaaaagagcccaggagacccagcatggcgtat

SEQ ID NO: 367593 - DNA, 140 bp, Artificial Sequence
  Synthetic
atacgccatgctgggtctcccagcatctctgaagtaacagagacaacaagtatagtcgcatcaccgaaaactcacatgatgctaaaggactgctttaaaattatactgggcactgaaaatcgtacttgggagtcggccat

SEQ ID NO: 367594 - DNA, 140 bp, Artificial Sequence
  Synthetic
atggccgactcccaagtacgattttcagtgcccagtataattttaaagcagtcctttagcatcatgtgagttttcggtgatgcgactatacttgttgtctctgttacttcagagatgctgggagacccagcatggcgtat

SEQ ID NO: 367595 - DNA, 140 bp, Artificial Sequence
  Synthetic
atacgccatgctgggtctccaaaaagatagttaaaatgcttcgagggaagctaaaaaaactcggtgccatctctacaaacatagagatcgggaaaagggactgcttagatctactcagcacgtacttgggagtcggccat

SEQ ID NO: 367596 - DNA, 140 bp, Artificial Sequence
  Synthetic
atggccgactcccaagtacgtgctgagtagatctaagcagtcccttttcccgatctctatgtttgtagagatggcaccgagtttttttagcttccctcgaagcattttaactatctttttggagacccagcatggcgtat

SEQ ID NO: 367597 - DNA, 140 bp, Artificial Sequence
  Synthetic
aggccctggctgctgatatgccacatcaacagtcagcataggtctatccagcagccccagcatgccatccacatcacaaggcatacattatcccgtaaggagtctattgtcagtctcgaggaccttttgggacagcggtg

SEQ ID NO: 367598 - DNA, 140 bp, Artificial Sequence
  Synthetic
caccgctgtcccaaaaggtcctcgagactgacaatagactccttacgggataatgtatgccttgtgatgtggatggcatgctggggctgctggatagacctatgctgactgttgatgtggcatatcagcagccagggcct

SEQ ID NO: 367599 - DNA, 140 bp, Artificial Sequence
  Synthetic
atacgccatgctgggtctcctttgagccttcaaagttgtccttttaccactggaaagaactggtcaaaaaaaacatagacgaggttttgcttactgaggatggaaatctgatcttctgctcgtacttgggagtcggccat

SEQ ID NO: 367600 - DNA, 140 bp, Artificial Sequence
  Synthetic
atggccgactcccaagtacgagcagaagatcagatttccatcctcagtaagcaaaacctcgtctatgttttttttgaccagttctttccagtggtaaaaggacaactttgaaggctcaaaggagacccagcatggcgtat

SEQ ID NO: 367601 - DNA, 140 bp, Artificial Sequence
  Synthetic
aggccctggctgctgatatgaaacatagacgaggttttgcttactgaggatggaaatctgatcttctgctggctaaagacaatctcatcttcagttaagggaagcctgaagaagaggctcgaccttttgggacagcggtg

SEQ ID NO: 367602 - DNA, 140 bp, Artificial Sequence
  Synthetic
caccgctgtcccaaaaggtcgagcctcttcttcaggcttcccttaactgaagatgagattgtctttagccagcagaagatcagatttccatcctcagtaagcaaaacctcgtctatgtttcatatcagcagccagggcct

SEQ ID NO: 367603 - DNA, 140 bp, Artificial Sequence
  Synthetic
atacgccatgctgggtctccttctagtgaggagttcaatgagttgattaagctaaagaaacttctcctcaacgaacaacaggatgaacaggagctgaagcaagaccttttaatatcctctcgtacttgggagtcggccat

SEQ ID NO: 367604 - DNA, 140 bp, Artificial Sequence
  Synthetic
atggccgactcccaagtacgagaggatattaaaaggtcttgcttcagctcctgttcatcctgttgttcgttgaggagaagtttctttagcttaatcaactcattgaactcctcactagaaggagacccagcatggcgtat

SEQ ID NO: 367605 - DNA, 140 bp, Artificial Sequence
  Synthetic
aggccctggctgctgatatgacgaacaacaggatgaacaggagctgaagcaagaccttttaatatcctcttggatcaagtgtataacagcttgtaaagactttgcaagcatcaatgacaagaccttttgggacagcggtg

SEQ ID NO: 367606 - DNA, 140 bp, Artificial Sequence
  Synthetic
caccgctgtcccaaaaggtcttgtcattgatgcttgcaaagtctttacaagctgttatacacttgatccaagaggatattaaaaggtcttgcttcagctcctgttcatcctgttgttcgtcatatcagcagccagggcct

SEQ ID NO: 367607 - DNA, 140 bp, Artificial Sequence
  Synthetic
atacgccatgctgggtctcctggtttgaagagttcaagaagagtaatggacttgtggacaccttcacaaactcttactccttttgtgagagtgtccctaaccttgacaggtttgtgtttccgtacttgggagtcggccat

SEQ ID NO: 367608 - DNA, 140 bp, Artificial Sequence
  Synthetic
atggccgactcccaagtacggaaacacaaacctgtcaaggttagggacactctcacaaaaggagtaagagtttgtgaaggtgtccacaagtccattactcttcttgaactcttcaaaccaggagacccagcatggcgtat

SEQ ID NO: 367609 - DNA, 140 bp, Artificial Sequence
  Synthetic
atacgccatgctgggtctccctctttcagccccatggtgcttacactacaaagcactagagtcttatctggtaagacacccagagatacttgactgtggatctaaggaggattgtaggctcgtacttgggagtcggccat

SEQ ID NO: 367610 - DNA, 140 bp, Artificial Sequence
  Synthetic
atggccgactcccaagtacgagcctacaatcctccttagatccacagtcaagtatctctgggtgtcttaccagataagactctagtgctttgtagtgtaagcaccatggggctgaaagagggagacccagcatggcgtat

SEQ ID NO: 367611 - DNA, 140 bp, Artificial Sequence
  Synthetic
atacgccatgctgggtctccgcatctagcctgcctcattatatccacaaataggctctgtaatgcttgaaactgccctagctctgcttgctctgaccttacctttgactgcgtgccgccacgtacttgggagtcggccat

SEQ ID NO: 367612 - DNA, 140 bp, Artificial Sequence
  Synthetic
atggccgactcccaagtacgtggcggcacgcagtcaaaggtaaggtcagagcaagcagagctagggcagtttcaagcattacagagcctatttgtggatataatgaggcaggctagatgcggagacccagcatggcgtat

SEQ ID NO: 367613 - DNA, 140 bp, Artificial Sequence
  Synthetic
atacgccatgctgggtctccgaaatgacgaagaactaacaaacagctcaagtttaaaacttgggttcttagtgaagtatgctgtcaccctatttacatccaatggtgagcctttttcgctcgtacttgggagtcggccat

SEQ ID NO: 367614 - DNA, 140 bp, Artificial Sequence
  Synthetic
atggccgactcccaagtacgagcgaaaaaggctcaccattggatgtaaatagggtgacagcatacttcactaagaacccaagttttaaacttgagctgtttgttagttcttcgtcatttcggagacccagcatggcgtat

SEQ ID NO: 367615 - DNA, 140 bp, Artificial Sequence
  Synthetic
atacgccatgctgggtctccagaagttgctacatcaaactaagatagtttttgccaaaattggtctgtccgggaacggttatgacttcatctggaccactcaaatgatagcaaatagcaacgtacttgggagtcggccat

SEQ ID NO: 367616 - DNA, 140 bp, Artificial Sequence
  Synthetic
atggccgactcccaagtacgttgctatttgctatcatttgagtggtccagatgaagtcataaccgttcccggacagaccaattttggcaaaaactatcttagtttgatgtagcaacttctggagacccagcatggcgtat

SEQ ID NO: 367617 - DNA, 140 bp, Artificial Sequence
  Synthetic
aggccctggctgctgatatggggaacggttatgacttcatctggaccactcaaatgatagcaaatagcaacttcaacgtctgcaaaagattgactggaaggagtactggggaaaggcttcgaccttttgggacagcggtg

SEQ ID NO: 367618 - DNA, 140 bp, Artificial Sequence
  Synthetic
caccgctgtcccaaaaggtcgaagcctttccccagtactccttccagtcaatcttttgcagacgttgaagttgctatttgctatcatttgagtggtccagatgaagtcataaccgttccccatatcagcagccagggcct

SEQ ID NO: 367619 - DNA, 140 bp, Artificial Sequence
  Synthetic
atacgccatgctgggtctccgaaacaggaatggcaatattgcaacagttagcttttgcacaggcactaaattatgaacaccgtttttatgcagttttagcacctaaagcacagctaggagcgtacttgggagtcggccat

SEQ ID NO: 367620 - DNA, 140 bp, Artificial Sequence
  Synthetic
atggccgactcccaagtacgctcctagctgtgctttaggtgctaaaactgcataaaaacggtgttcataatttagtgcctgtgcaaaagctaactgttgcaatattgccattcctgtttcggagacccagcatggcgtat

SEQ ID NO: 367621 - DNA, 140 bp, Artificial Sequence
  Synthetic
atacgccatgctgggtctccgtgcaagagacctgttagtgcaagaaactggcaccaaagtcatgcatgcaactactgaaatgttcagtagaaacctcttaaaaacaacatcagatgatggcgtacttgggagtcggccat

SEQ ID NO: 367622 - DNA, 140 bp, Artificial Sequence
  Synthetic
atggccgactcccaagtacgccatcatctgatgttgtttttaagaggtttctactgaacatttcagtagttgcatgcatgactttggtgccagtttcttgcactaacaggtctcttgcacggagacccagcatggcgtat

SEQ ID NO: 367623 - DNA, 140 bp, Artificial Sequence
  Synthetic
aggccctggctgctgatatggccttaccaacatgcgaaaccttgacggaaagcccataagtgaaggtagcaacttggtcaacttctacaaagtcatttgcatttcgggtgacaataccaagaccttttgggacagcggtg

SEQ ID NO: 367624 - DNA, 140 bp, Artificial Sequence
  Synthetic
caccgctgtcccaaaaggtcttggtattgtcacccgaaatgcaaatgactttgtagaagttgaccaagttgctaccttcacttatgggctttccgtcaaggtttcgcatgttggtaaggccatatcagcagccagggcct

SEQ ID NO: 367625 - DNA, 140 bp, Artificial Sequence
  Synthetic
atacgccatgctgggtctccgtgggggccgatacactgctgttccttcttctcaggcatgatgcaacaggttcttaaaaatgttccagattggtgttcattctataaattaacatttattcgtacttgggagtcggccat

SEQ ID NO: 367626 - DNA, 140 bp, Artificial Sequence
  Synthetic
atggccgactcccaagtacgaataaatgttaatttatagaatgaacaccaatctggaacatttttaagaacctgttgcatcatgcctgagaagaaggaacagcagtgtatcggcccccacggagacccagcatggcgtat

SEQ ID NO: 367627 - DNA, 140 bp, Artificial Sequence
  Synthetic
atacgccatgctgggtctccaaaaacttatgtaggcaagttgagataccagcaggtagtattaaaaaaatcttaaatgttcttagatacaaactgtgcagcaaaggaggtgtagagcagccgtacttgggagtcggccat

SEQ ID NO: 367628 - DNA, 140 bp, Artificial Sequence
  Synthetic
atggccgactcccaagtacggctgctctacacctcctttgctgcacagtttgtatctaagaacatttaagatttttttaatactacctgctggtatctcaacttgcctacataagtttttggagacccagcatggcgtat

SEQ ID NO: 367629 - DNA, 140 bp, Artificial Sequence
  Synthetic
atacgccatgctgggtctccgatcaaaaaacagattttgacagtaaagaaacaaattgtgtttgatgccgaaagtgagcctagactacagtggggccacggctgcctgtctattgtttatcgtacttgggagtcggccat

SEQ ID NO: 367630 - DNA, 140 bp, Artificial Sequence
  Synthetic
atggccgactcccaagtacgataaacaatagacaggcagccgtggccccactgtagtctaggctcactttcggcatcaaacacaatttgtttctttactgtcaaaatctgttttttgatcggagacccagcatggcgtat

SEQ ID NO: 367631 - DNA, 140 bp, Artificial Sequence
  Synthetic
atacgccatgctgggtctcctactatccagggagttgtattcccagtatgatgaaacattttggaagcatgcctgtagacttaagaacttcacagctgctgtacaaaggtgttgtcaaatcgtacttgggagtcggccat

SEQ ID NO: 367632 - DNA, 140 bp, Artificial Sequence
  Synthetic
atggccgactcccaagtacgatttgacaacacctttgtacagcagctgtgaagttcttaagtctacaggcatgcttccaaaatgtttcatcatactgggaatacaactccctggatagtaggagacccagcatggcgtat

SEQ ID NO: 367633 - DNA, 140 bp, Artificial Sequence
  Synthetic
atacgccatgctgggtctcctctcaaagaaacacgtgccgctcacgcccacagtgttatcttgagtgtaagcaaaatggagaacaaaatcgaggtgaacagcaaagacgatctgaacaagcgtacttgggagtcggccat

SEQ ID NO: 367634 - DNA, 140 bp, Artificial Sequence
  Synthetic
atggccgactcccaagtacgcttgttcagatcgtctttgctgttcacctcgattttgttctccattttgcttacactcaagataacactgtgggcgtgagcggcacgtgtttctttgagaggagacccagcatggcgtat

SEQ ID NO: 367635 - DNA, 140 bp, Artificial Sequence
  Synthetic
aggccctggctgctgatatggcaaaatggagaacaaaatcgaggtgaacagcaaagacgatctgaacaagtggtttgaggagttcaagaaaggaaatgggcttgtggacaccttcacaaagaccttttgggacagcggtg

SEQ ID NO: 367636 - DNA, 140 bp, Artificial Sequence
  Synthetic
caccgctgtcccaaaaggtctttgtgaaggtgtccacaagcccatttcctttcttgaactcctcaaaccacttgttcagatcgtctttgctgttcacctcgattttgttctccattttgccatatcagcagccagggcct

SEQ ID NO: 367637 - DNA, 140 bp, Artificial Sequence
  Synthetic
aggccctggctgctgatatgatgagtaaatttcctcccgagaatatagacaaggcaaggagggatccaaagaactgggtcagcatctctgaagtaacggagacaacaagtatagtcgcaagaccttttgggacagcggtg

SEQ ID NO: 367638 - DNA, 140 bp, Artificial Sequence
  Synthetic
caccgctgtcccaaaaggtcttgcgactatacttgttgtctccgttacttcagagatgctgacccagttctttggatccctccttgccttgtctatattctcgggaggaaatttactcatcatatcagcagccagggcct

SEQ ID NO: 367639 - DNA, 140 bp, Artificial Sequence
  Synthetic
aggccctggctgctgatatgttcactggactgataaacagctctctaacctctcctcagagtttgatgcaggcatgccaggtttcatcccaacaggccatgtataatagtgtgccccttggaccttttgggacagcggtg

SEQ ID NO: 367640 - DNA, 140 bp, Artificial Sequence
  Synthetic
caccgctgtcccaaaaggtccaaggggcacactattatacatggcctgttgggatgaaacctggcatgcctgcatcaaactctgaggagaggttagagagctgtttatcagtccagtgaacatatcagcagccagggcct

SEQ ID NO: 367641 - DNA, 140 bp, Artificial Sequence
  Synthetic
atacgccatgctgggtctccgctcttgttgaagcaaccaagtactgtgcaccaatatatgagtgtgcctgggtcagctctacaggcattgtaaagaaaggtttggagtggtttgaaaagacgtacttgggagtcggccat

SEQ ID NO: 367642 - DNA, 140 bp, Artificial Sequence
  Synthetic
atggccgactcccaagtacgtcttttcaaaccactccaaacctttctttacaatgcctgtagagctgacccaggcacactcatatattggtgcacagtacttggttgcttcaacaagagcggagacccagcatggcgtat

SEQ ID NO: 367643 - DNA, 140 bp, Artificial Sequence
  Synthetic
atacgccatgctgggtctccgttgaagactttatcagaaggtatggcatattaactctcggaaccttatctccctttggcaggctgtttgtaccgacctactctggactggtcagctcagcgtacttgggagtcggccat

SEQ ID NO: 367644 - DNA, 140 bp, Artificial Sequence
  Synthetic
atggccgactcccaagtacgctgagctgaccagtccagagtaggtcggtacaaacagcctgccaaagggagataaggttccgagagttaatatgccataccttctgataaagtcttcaacggagacccagcatggcgtat

SEQ ID NO: 367645 - DNA, 140 bp, Artificial Sequence
  Synthetic
atacgccatgctgggtctccgtggagaaaggacataggtttccgcatcaatgctaacacaacagcgctgagcaacaaagtgcttgcagagtacaaggttccaggagagatcttggtgcctcgtacttgggagtcggccat

SEQ ID NO: 367646 - DNA, 140 bp, Artificial Sequence
  Synthetic
atggccgactcccaagtacgaggcaccaagatctctcctggaaccttgtactctgcaagcactttgttgctcagcgctgttgtgttagcattgatgcggaaacctatgtcctttctccacggagacccagcatggcgtat

SEQ ID NO: 367647 - DNA, 140 bp, Artificial Sequence
  Synthetic
atacgccatgctgggtctcccttaggacgtagtaggacaagttctacaattgaagacagcagcagtgtgagcgacaccactgttgcttcacatgattcaggatcatcatcatcaagcttccgtacttgggagtcggccat

SEQ ID NO: 367648 - DNA, 140 bp, Artificial Sequence
  Synthetic
atggccgactcccaagtacggaagcttgatgatgatgatcctgaatcatgtgaagcaacagtggtgtcgctcacactgctgctgtcttcaattgtagaacttgtcctactacgtcctaagggagacccagcatggcgtat

SEQ ID NO: 367649 - DNA, 140 bp, Artificial Sequence
  Synthetic
aggccctggctgctgatatggcgacaccactgttgcttcacatgattcaggatcatcatcatcaagcttctcttttgagctcaataggcctctgtctgagactgaactacaatttatcaagaccttttgggacagcggtg

SEQ ID NO: 367650 - DNA, 140 bp, Artificial Sequence
  Synthetic
caccgctgtcccaaaaggtcttgataaattgtagttcagtctcagacagaggcctattgagctcaaaagagaagcttgatgatgatgatcctgaatcatgtgaagcaacagtggtgtcgccatatcagcagccagggcct

SEQ ID NO: 367651 - DNA, 140 bp, Artificial Sequence
  Synthetic
atacgccatgctgggtctccagtggtgcagggagttcatcaagggaaagtacattatggccttcaatccaccttggggtgacatcaacaaatcaggtcgctccgggattgcacttgtcgccgtacttgggagtcggccat

SEQ ID NO: 367652 - DNA, 140 bp, Artificial Sequence
  Synthetic
atggccgactcccaagtacggcgacaagtgcaatcccggagcgacctgatttgttgatgtcaccccaaggtggattgaaggccataatgtactttcccttgatgaactccctgcaccactggagacccagcatggcgtat

SEQ ID NO: 367653 - DNA, 140 bp, Artificial Sequence
  Synthetic
atacgccatgctgggtctccggattacaggcctttattgtaatagcaatgaaggacctcttgataggcacaatgttatttacagcagtagaatggcagactcttgtgattggctaagagacgtacttgggagtcggccat

SEQ ID NO: 367654 - DNA, 140 bp, Artificial Sequence
  Synthetic
atggccgactcccaagtacgtctcttagccaatcacaagagtctgccattctactgctgtaaataacattgtgcctatcaagaggtccttcattgctattacaataaaggcctgtaatccggagacccagcatggcgtat

SEQ ID NO: 367655 - DNA, 140 bp, Artificial Sequence
  Synthetic
atacgccatgctgggtctcctatgtgttctaatagctggttactacagatcatttggaggggaagggactgaaaaacaagtgaaggcatcattgaatagggacgacaacaaaatcatcgacgtacttgggagtcggccat

SEQ ID NO: 367656 - DNA, 140 bp, Artificial Sequence
  Synthetic
atggccgactcccaagtacgtcgatgattttgttgtcgtccctattcaatgatgccttcacttgtttttcagtcccttcccctccaaatgatctgtagtaaccagctattagaacacataggagacccagcatggcgtat

SEQ ID NO: 367657 - DNA, 140 bp, Artificial Sequence
  Synthetic
aggccctggctgctgatatgacatattgccaaggctcaggaactctacaagaactcatctgcacttcgtgctcagggtgcacaaattgacactcctttcagctcgttctactggctctacgaccttttgggacagcggtg

SEQ ID NO: 367658 - DNA, 140 bp, Artificial Sequence
  Synthetic
caccgctgtcccaaaaggtcgtagagccagtagaacgagctgaaaggagtgtcaatttgtgcaccctgagcacgaagtgcagatgagttcttgtagagttcctgagccttggcaatatgtcatatcagcagccagggcct

SEQ ID NO: 367659 - DNA, 140 bp, Artificial Sequence
  Synthetic
atacgccatgctgggtctccactgagaacaaaaagatagtcaaaatgcttagagggaagctaaaaaaactcggtgctatctctacaaacatagagatcgggaaaagggattgcttggatccgtacttgggagtcggccat

SEQ ID NO: 367660 - DNA, 140 bp, Artificial Sequence
  Synthetic
atggccgactcccaagtacggatccaagcaatcccttttcccgatctctatgtttgtagagatagcaccgagtttttttagcttccctctaagcattttgactatctttttgttctcagtggagacccagcatggcgtat

SEQ ID NO: 367661 - DNA, 140 bp, Artificial Sequence
  Synthetic
aggccctggctgctgatatgcctgatgacaccttggcccagcttgtggcaaaaaaactaatcagcctcaatgtttcgacagaagaatactcggcagaggtatctaggctcaagcaaacacgaccttttgggacagcggtg

SEQ ID NO: 367662 - DNA, 140 bp, Artificial Sequence
  Synthetic
caccgctgtcccaaaaggtcgtgtttgcttgagcctagatacctctgccgagtattcttctgtcgaaacattgaggctgattagtttttttgccacaagctgggccaaggtgtcatcaggcatatcagcagccagggcct

SEQ ID NO: 367663 - DNA, 140 bp, Artificial Sequence
  Synthetic
aggccctggctgctgatatgtcagcactcccatgaagtggggaaagaagctctatgagctctttgcagatgactctttccagcagaacaggatctacatgcaccctgctgtgctgacagcgaccttttgggacagcggtg

SEQ ID NO: 367664 - DNA, 140 bp, Artificial Sequence
  Synthetic
caccgctgtcccaaaaggtcgctgtcagcacagcagggtgcatgtagatcctgttctgctggaaagagtcatctgcaaagagctcatagagcttctttccccacttcatgggagtgctgacatatcagcagccagggcct

SEQ ID NO: 367665 - DNA, 140 bp, Artificial Sequence
  Synthetic
atacgccatgctgggtctcctcgcttcctatatatacaatattcatgaagtcatacttcttcaaagacaatgttttcctgtcactgacagacagatggtccaccaagcatagcacgaactcgtacttgggagtcggccat

SEQ ID NO: 367666 - DNA, 140 bp, Artificial Sequence
  Synthetic
atggccgactcccaagtacgagttcgtgctatgcttggtggaccatctgtctgtcagtgacaggaaaacattgtctttgaagaagtatgacttcatgaatattgtatatataggaagcgaggagacccagcatggcgtat

SEQ ID NO: 367667 - DNA, 140 bp, Artificial Sequence
  Synthetic
aggccctggctgctgatatgtgttttcctgtcactgacagacagatggtccaccaagcatagcacgaactaccgtgacagttgtggcaaacaattaactggtaggataatcactaagtacgaccttttgggacagcggtg

SEQ ID NO: 367668 - DNA, 140 bp, Artificial Sequence
  Synthetic
caccgctgtcccaaaaggtcgtacttagtgattatcctaccagttaattgtttgccacaactgtcacggtagttcgtgctatgcttggtggaccatctgtctgtcagtgacaggaaaacacatatcagcagccagggcct

SEQ ID NO: 367669 - DNA, 140 bp, Artificial Sequence
  Synthetic
aggccctggctgctgatatgcggtgctatctctacaaacatagagatcgggaaaagggattgcttggatctactcagcacggttgatggtctaacagatcaacaaaaggaaaacatcgtagaccttttgggacagcggtg

SEQ ID NO: 367670 - DNA, 140 bp, Artificial Sequence
  Synthetic
caccgctgtcccaaaaggtctacgatgttttccttttgttgatctgttagaccatcaaccgtgctgagtagatccaagcaatcccttttcccgatctctatgtttgtagagatagcaccgcatatcagcagccagggcct

SEQ ID NO: 367671 - DNA, 140 bp, Artificial Sequence
  Synthetic
atacgccatgctgggtctcccacaactgtcaaggagccttccctttttaacccgaacatcagatgtgtcaacttgatcacatttgaagatggtctgagggaactttcagtgatacaaagtcgtacttgggagtcggccat

SEQ ID NO: 367672 - DNA, 140 bp, Artificial Sequence
  Synthetic
atggccgactcccaagtacgactttgtatcactgaaagttccctcagaccatcttcaaatgtgatcaagttgacacatctgatgttcgggttaaaaagggaaggctccttgacagttgtgggagacccagcatggcgtat

SEQ ID NO: 367673 - DNA, 140 bp, Artificial Sequence
  Synthetic
atacgccatgctgggtctccttccagaatgcctacaatgtcaagggcaatgccaccagtgccaacatcatctagctgcccaggtgctctgcatcccacccacccaactccaagtcagtgccgtacttgggagtcggccat

SEQ ID NO: 367674 - DNA, 140 bp, Artificial Sequence
  Synthetic
atggccgactcccaagtacggcactgacttggagttgggtgggtgggatgcagagcacctgggcagctagatgatgttggcactggtggcattgcccttgacattgtaggcattctggaaggagacccagcatggcgtat

SEQ ID NO: 367675 - DNA, 140 bp, Artificial Sequence
  Synthetic
atacgccatgctgggtctcctttcggctgcaactagtaatcatgcttgcttcaaatactgcttcactcaacttttattctttctttgtttttacacataaagggctgtgcggcaacgatacgtacttgggagtcggccat

SEQ ID NO: 367676 - DNA, 140 bp, Artificial Sequence
  Synthetic
atggccgactcccaagtacgtatcgttgccgcacagccctttatgtgtaaaaacaaagaaagaataaaagttgagtgaagcagtatttgaagcaagcatgattactagttgcagccgaaaggagacccagcatggcgtat

SEQ ID NO: 367677 - DNA, 140 bp, Artificial Sequence
  Synthetic
aggccctggctgctgatatgctgagttagaggcaaatcgtgcagtgattgttaagactaaactgttctcagcaactgaacaggtccggttatctaataaccctgcagtcgtcatgggttagaccttttgggacagcggtg

SEQ ID NO: 367678 - DNA, 140 bp, Artificial Sequence
  Synthetic
caccgctgtcccaaaaggtctaacccatgacgactgcagggttattagataaccggacctgttcagttgctgagaacagtttagtcttaacaatcactgcacgatttgcctctaactcagcatatcagcagccagggcct

SEQ ID NO: 367679 - DNA, 140 bp, Artificial Sequence
  Synthetic
atacgccatgctgggtctcctctcaaagaaatacttgcggcacgtcagttcgtaagtatcagtcttgagagtgtgcgtgaaacgtcctgcatgcaatatgccggatcacttcatacttctcgtacttgggagtcggccat

SEQ ID NO: 367680 - DNA, 140 bp, Artificial Sequence
  Synthetic
atggccgactcccaagtacgagaagtatgaagtgatccggcatattgcatgcaggacgtttcacgcacactctcaagactgatacttacgaactgacgtgccgcaagtatttctttgagaggagacccagcatggcgtat

SEQ ID NO: 367681 - DNA, 140 bp, Artificial Sequence
  Synthetic
atacgccatgctgggtctcctctattagatgaatcagcaatttctgaagttaaacccaccaaggttgatttttcgaacttacttaaagaccgcttcaaaataatgcagttcttcccttctcgtacttgggagtcggccat

SEQ ID NO: 367682 - DNA, 140 bp, Artificial Sequence
  Synthetic
atggccgactcccaagtacgagaagggaagaactgcattattttgaagcggtctttaagtaagttcgaaaaatcaaccttggtgggtttaacttcagaaattgctgattcatctaatagaggagacccagcatggcgtat

SEQ ID NO: 367683 - DNA, 140 bp, Artificial Sequence
  Synthetic
aggccctggctgctgatatgtttcgaacttacttaaagaccgcttcaaaataatgcagttcttcccttctgttttcactttaatcaaaatgctaacagatgagtcatcagactcagaaaagaccttttgggacagcggtg

SEQ ID NO: 367684 - DNA, 140 bp, Artificial Sequence
  Synthetic
caccgctgtcccaaaaggtcttttctgagtctgatgactcatctgttagcattttgattaaagtgaaaacagaagggaagaactgcattattttgaagcggtctttaagtaagttcgaaacatatcagcagccagggcct

SEQ ID NO: 367685 - DNA, 140 bp, Artificial Sequence
  Synthetic
atacgccatgctgggtctccgttttcactttaatcaaaatgctaacagatgagtcatcagactcagaaaagaccggtcttagtccagatttgcaacaggttgcaagatactccaaccattcgtacttgggagtcggccat

SEQ ID NO: 367686 - DNA, 140 bp, Artificial Sequence
  Synthetic
atggccgactcccaagtacgaatggttggagtatcttgcaacctgttgcaaatctggactaagaccggtcttttctgagtctgatgactcatctgttagcattttgattaaagtgaaaacggagacccagcatggcgtat

SEQ ID NO: 367687 - DNA, 140 bp, Artificial Sequence
  Synthetic
atacgccatgctgggtctcccacaacaactatggctcggccaagcacagtgactcagatcactacagcacaagccatggaggtggatggctctggtgagtccaccacactccccgctgtgcgtacttgggagtcggccat

SEQ ID NO: 367688 - DNA, 140 bp, Artificial Sequence
  Synthetic
atggccgactcccaagtacgcacagcggggagtgtggtggactcaccagagccatccacctccatggcttgtgctgtagtgatctgagtcactgtgcttggccgagccatagttgttgtgggagacccagcatggcgtat

SEQ ID NO: 367689 - DNA, 140 bp, Artificial Sequence
  Synthetic
atacgccatgctgggtctccttctacatgctaaagggtaacttgatgaacacggaaccaacagttgctgagcttgtcagttatggcataaaggaaggtaggttctataggctttccgacacgtacttgggagtcggccat

SEQ ID NO: 367690 - DNA, 140 bp, Artificial Sequence
  Synthetic
atggccgactcccaagtacgtgtcggaaagcctatagaacctaccttcctttatgccataactgacaagctcagcaactgttggttccgtgttcatcaagttaccctttagcatgtagaaggagacccagcatggcgtat

SEQ ID NO: 367691 - DNA, 140 bp, Artificial Sequence
  Synthetic
aggccctggctgctgatatggcttgtcagttatggcataaaggaaggtaggttctataggctttccgacaccggaatcgatgcaagtacatattctgtaaaatactggaagattctccacgaccttttgggacagcggtg

SEQ ID NO: 367692 - DNA, 140 bp, Artificial Sequence
  Synthetic
caccgctgtcccaaaaggtcgtggagaatcttccagtattttacagaatatgtacttgcatcgattccggtgtcggaaagcctatagaacctaccttcctttatgccataactgacaagccatatcagcagccagggcct

SEQ ID NO: 367693 - DNA, 140 bp, Artificial Sequence
  Synthetic
atacgccatgctgggtctcctgaccggcagaagtatcctaacatcacaatcccaaacaggttcatttgacagaaccagtaagccccaaacaccacgaagcacaaaccaacccctgagaaacgtacttgggagtcggccat

SEQ ID NO: 367694 - DNA, 140 bp, Artificial Sequence
  Synthetic
atggccgactcccaagtacgtttctcaggggttggtttgtgcttcgtggtgtttggggcttactggttctgtcaaatgaacctgtttgggattgtgatgttaggatacttctgccggtcaggagacccagcatggcgtat

SEQ ID NO: 367695 - DNA, 140 bp, Artificial Sequence
  Synthetic
atacgccatgctgggtctccactgctcatgagtttcttaaactggagagtgaatatggacattagagcttctgactgcccattgtctagtcatgaagcaagtatacttagtgaatttgaccgtacttgggagtcggccat

SEQ ID NO: 367696 - DNA, 140 bp, Artificial Sequence
  Synthetic
atggccgactcccaagtacggtcaaattcactaagtatacttgcttcatgactagacaatgggcagtcagaagctctaatgtccatattcactctccagtttaagaaactcatgagcagtggagacccagcatggcgtat

SEQ ID NO: 367697 - DNA, 140 bp, Artificial Sequence
  Synthetic
atacgccatgctgggtctccgagaaattgaataaggttgtcataaaggacaatcttgagcaaggcatggaggaggagattgagttttgcaacaacctgactaagactgtttcagaaaacccgtacttgggagtcggccat

SEQ ID NO: 367698 - DNA, 140 bp, Artificial Sequence
  Synthetic
atggccgactcccaagtacgggttttctgaaacagtcttagtcaggttgttgcaaaactcaatctcctcctccatgccttgctcaagattgtcctttatgacaaccttattcaatttctcggagacccagcatggcgtat

SEQ ID NO: 367699 - DNA, 140 bp, Artificial Sequence
  Synthetic
atacgccatgctgggtctccggacaagttattgctaatatacttgctagcgaattaagttctgtgaaacgagactctgaacgcgaaggtctaactgatctccttgattacctaaactcaccgtacttgggagtcggccat

SEQ ID NO: 367700 - DNA, 140 bp, Artificial Sequence
  Synthetic
atggccgactcccaagtacggtgagtttaggtaatcaaggagatcagttagaccttcgcgttcagagtctcgtttcacagaacttaattcgctagcaagtatattagcaataacttgtccggagacccagcatggcgtat

SEQ ID NO: 367701 - DNA, 140 bp, Artificial Sequence
  Synthetic
atacgccatgctgggtctccgacacctccccatccactccaacccaggtcacgtcctcagctggcagcagttcgagtaacacatcaaaccactccaagacaacaccccagctaacatcctcgtacttgggagtcggccat

SEQ ID NO: 367702 - DNA, 140 bp, Artificial Sequence
  Synthetic
atggccgactcccaagtacgaggatgttagctggggtgttgtcttggagtggtttgatgtgttactcgaactgctgccagctgaggacgtgacctgggttggagtggatggggaggtgtcggagacccagcatggcgtat

SEQ ID NO: 367703 - DNA, 140 bp, Artificial Sequence
  Synthetic
aggccctggctgctgatatgttcgagtaacacatcaaaccactccaagacaacaccccagctaacatcctcaggctcagaggctcaacaaacccagcccaccaccatgccaaacaccacagaccttttgggacagcggtg

SEQ ID NO: 367704 - DNA, 140 bp, Artificial Sequence
  Synthetic
caccgctgtcccaaaaggtctgtggtgtttggcatggtggtgggctgggtttgttgagcctctgagcctgaggatgttagctggggtgttgtcttggagtggtttgatgtgttactcgaacatatcagcagccagggcct

SEQ ID NO: 367705 - DNA, 140 bp, Artificial Sequence
  Synthetic
atacgccatgctgggtctccgaactctgaagtggaaataatcctcacactccctcaaggccttaagaaatattacagtaaaatattgaagctgctgcacctcactttagaagaggattctcgtacttgggagtcggccat

SEQ ID NO: 367706 - DNA, 140 bp, Artificial Sequence
  Synthetic
atggccgactcccaagtacgagaatcctcttctaaagtgaggtgcagcagcttcaatattttactgtaatatttcttaaggccttgagggagtgtgaggattatttccacttcagagttcggagacccagcatggcgtat

SEQ ID NO: 367707 - DNA, 140 bp, Artificial Sequence
  Synthetic
aggccctggctgctgatatgattacagtaaaatattgaagctgctgcacctcactttagaagaggattctgaaggcttactggagtggtgcactagaacactgaaacaggcatgtgatgagaccttttgggacagcggtg

SEQ ID NO: 367708 - DNA, 140 bp, Artificial Sequence
  Synthetic
caccgctgtcccaaaaggtctcatcacatgcctgtttcagtgttctagtgcaccactccagtaagccttcagaatcctcttctaaagtgaggtgcagcagcttcaatattttactgtaatcatatcagcagccagggcct

SEQ ID NO: 367709 - DNA, 140 bp, Artificial Sequence
  Synthetic
atacgccatgctgggtctccctaaaatttgtgcctctcaagaaggggctagcagtggtgaagattaaaaagcaaattttgacagtgaagaagcaagtcgtgtttgatgctgaaagcgagccgtacttgggagtcggccat

SEQ ID NO: 367710 - DNA, 140 bp, Artificial Sequence
  Synthetic
atggccgactcccaagtacggctcgctttcagcatcaaacacgacttgcttcttcactgtcaaaatttgctttttaatcttcaccactgctagccccttcttgagaggcacaaattttagggagacccagcatggcgtat

SEQ ID NO: 367711 - DNA, 140 bp, Artificial Sequence
  Synthetic
aggccctggctgctgatatggcaaattttgacagtgaagaagcaagtcgtgtttgatgctgaaagcgagcccagattacagtggggacatgggtgcttgtctattgtttatgatgaaaccgaccttttgggacagcggtg

SEQ ID NO: 367712 - DNA, 140 bp, Artificial Sequence
  Synthetic
caccgctgtcccaaaaggtcggtttcatcataaacaatagacaagcacccatgtccccactgtaatctgggctcgctttcagcatcaaacacgacttgcttcttcactgtcaaaatttgccatatcagcagccagggcct

SEQ ID NO: 367713 - DNA, 140 bp, Artificial Sequence
  Synthetic
atacgccatgctgggtctcctgactgctctacagacaggaaaaagcttctaccccagtctgtgttttctgattccaaagttgtcctttcaaggattaaattcaaaacggagctcctccttcgtacttgggagtcggccat

SEQ ID NO: 367714 - DNA, 140 bp, Artificial Sequence
  Synthetic
atggccgactcccaagtacgaaggaggagctccgttttgaatttaatccttgaaaggacaactttggaatcagaaaacacagactggggtagaagctttttcctgtctgtagagcagtcaggagacccagcatggcgtat

SEQ ID NO: 367715 - DNA, 140 bp, Artificial Sequence
  Synthetic
aggccctggctgctgatatgtgttaactgtataaatttgaaggtgtcaactgacaaggatcacagtgaacttgaagtaaatgtgcttcttcctcaggttgcagttaacatttcaaactgtgaccttttgggacagcggtg

SEQ ID NO: 367716 - DNA, 140 bp, Artificial Sequence
  Synthetic
caccgctgtcccaaaaggtcacagtttgaaatgttaactgcaacctgaggaagaagcacatttacttcaagttcactgtgatccttgtcagttgacaccttcaaatttatacagttaacacatatcagcagccagggcct

SEQ ID NO: 367717 - DNA, 140 bp, Artificial Sequence
  Synthetic
atacgccatgctgggtctcctataatggaagtggagagtaaaagcagcctactacataagtacctcaagtcaggaggtgttaggcagcggaatactgaggtgctctttagggaaaagttgcgtacttgggagtcggccat

SEQ ID NO: 367718 - DNA, 140 bp, Artificial Sequence
  Synthetic
atggccgactcccaagtacgcaacttttccctaaagagcacctcagtattccgctgcctaacacctcctgacttgaggtacttatgtagtaggctgcttttactctccacttccattataggagacccagcatggcgtat

SEQ ID NO: 367719 - DNA, 140 bp, Artificial Sequence
  Synthetic
atacgccatgctgggtctccaatgataaggctaccacaagtcacccatgaaggcacctttataccgggaacctataagatagtgatagataagaagaataaactaaatgacaggtgtacccgtacttgggagtcggccat

SEQ ID NO: 367720 - DNA, 140 bp, Artificial Sequence
  Synthetic
atggccgactcccaagtacgggtacacctgtcatttagtttattcttcttatctatcactatcttataggttcccggtataaaggtgccttcatgggtgacttgtggtagccttatcattggagacccagcatggcgtat

SEQ ID NO: 367721 - DNA, 140 bp, Artificial Sequence
  Synthetic
aggccctggctgctgatatgcctataagatagtgatagataagaagaataaactaaatgacaggtgtaccatgaccaccaactgtgtgatcaaaggaaaagaagttcggaagggacagtcgaccttttgggacagcggtg

SEQ ID NO: 367722 - DNA, 140 bp, Artificial Sequence
  Synthetic
caccgctgtcccaaaaggtcgactgtcccttccgaacttcttttcctttgatcacacagttggtggtcatggtacacctgtcatttagtttattcttcttatctatcactatcttataggcatatcagcagccagggcct

SEQ ID NO: 367723 - DNA, 140 bp, Artificial Sequence
  Synthetic
atacgccatgctgggtctccgaacaagaagattgctttcagaagggggtgatggaggctgcatctcaagaactcaactgataaaaacagaaactgcggaggtgcacggagacgattacggcgtacttgggagtcggccat

SEQ ID NO: 367724 - DNA, 140 bp, Artificial Sequence
  Synthetic
atggccgactcccaagtacgccgtaatcgtctccgtgcacctccgcagtttctgtttttatcagttgagttcttgagatgcagcctccatcacccccttctgaaagcaatcttcttgttcggagacccagcatggcgtat

SEQ ID NO: 367725 - DNA, 140 bp, Artificial Sequence
  Synthetic
aggccctggctgctgatatgactcaactgataaaaacagaaactgcggaggtgcacggagacgattacggtggacctggcgagaaaattaccatctgcaatggttcaaccatcgttgatcgaccttttgggacagcggtg

SEQ ID NO: 367726 - DNA, 140 bp, Artificial Sequence
  Synthetic
caccgctgtcccaaaaggtcgatcaacgatggttgaaccattgcagatggtaattttctcgccaggtccaccgtaatcgtctccgtgcacctccgcagtttctgtttttatcagttgagtcatatcagcagccagggcct

SEQ ID NO: 367727 - DNA, 140 bp, Artificial Sequence
  Synthetic
atacgccatgctgggtctcctaaggacactggtgtcctacgtcagcactgaaacgattcctaagtttctacttgcatttcttctttatgaagaagtgttgatgaacttaatcagccagtgcgtacttgggagtcggccat

SEQ ID NO: 367728 - DNA, 140 bp, Artificial Sequence
  Synthetic
atggccgactcccaagtacgcactggctgattaagttcatcaacacttcttcataaagaagaaatgcaagtagaaacttaggaatcgtttcagtgctgacgtaggacaccagtgtccttaggagacccagcatggcgtat

SEQ ID NO: 367729 - DNA, 140 bp, Artificial Sequence
  Synthetic
aggccctggctgctgatatgcttgcatttcttctttatgaagaagtgttgatgaacttaatcagccagtgcaaggcagtgaaagaacttattaacagcacaggtctctcagatctggaacgaccttttgggacagcggtg

SEQ ID NO: 367730 - DNA, 140 bp, Artificial Sequence
  Synthetic
caccgctgtcccaaaaggtcgttccagatctgagagacctgtgctgttaataagttctttcactgccttgcactggctgattaagttcatcaacacttcttcataaagaagaaatgcaagcatatcagcagccagggcct

SEQ ID NO: 367731 - DNA, 140 bp, Artificial Sequence
  Synthetic
atacgccatgctgggtctccttcaaactatgcgagaatagtgcccagggcaagaactgtgagatagacagtgcaccagtacaatgcaggcaaggttattgcttgaaaattagtcaagaggcgtacttgggagtcggccat

SEQ ID NO: 367732 - DNA, 140 bp, Artificial Sequence
  Synthetic
atggccgactcccaagtacgcctcttgactaattttcaagcaataaccttgcctgcattgtactggtgcactgtctatctcacagttcttgccctgggcactattctcgcatagtttgaaggagacccagcatggcgtat

SEQ ID NO: 367733 - DNA, 140 bp, Artificial Sequence
  Synthetic
aggccctggctgctgatatgtgcaccagtacaatgcaggcaaggttattgcttgaaaattagtcaagagggaagaggacatgtgaaactttccaggggttcagaaattgttctagatgttgaccttttgggacagcggtg

SEQ ID NO: 367734 - DNA, 140 bp, Artificial Sequence
  Synthetic
caccgctgtcccaaaaggtcaacatctagaacaatttctgaacccctggaaagtttcacatgtcctcttccctcttgactaattttcaagcaataaccttgcctgcattgtactggtgcacatatcagcagccagggcct

SEQ ID NO: 367735 - DNA, 140 bp, Artificial Sequence
  Synthetic
aggccctggctgctgatatgaagagagatggacctaggtgttcattcgcagcactgttaagcttagttcatgaagattggcaaaaggtagggaaaaacatccttgttcgtgcaaacaatggaccttttgggacagcggtg

SEQ ID NO: 367736 - DNA, 140 bp, Artificial Sequence
  Synthetic
caccgctgtcccaaaaggtccattgtttgcacgaacaaggatgtttttccctaccttttgccaatcttcatgaactaagcttaacagtgctgcgaatgaacacctaggtccatctctcttcatatcagcagccagggcct

SEQ ID NO: 367737 - DNA, 140 bp, Artificial Sequence
  Synthetic
atacgccatgctgggtctcctgaagattggcaaaaggtagggaaaaacatccttgttcgtgcaaacaatgagctgggtgatgtgtcgctgaaggttaacattgtcctggtgcctctcaaacgtacttgggagtcggccat

SEQ ID NO: 367738 - DNA, 140 bp, Artificial Sequence
  Synthetic
atggccgactcccaagtacgtttgagaggcaccaggacaatgttaaccttcagcgacacatcacccagctcattgtttgcacgaacaaggatgtttttccctaccttttgccaatcttcaggagacccagcatggcgtat

SEQ ID NO: 367739 - DNA, 140 bp, Artificial Sequence
  Synthetic
atacgccatgctgggtctccagtagactgctcaggagggcagcagcattttctacagagcaacttagttgacctgggttgtccgaacattccgctgctgggcaagatggctatttatattcgtacttgggagtcggccat

SEQ ID NO: 367740 - DNA, 140 bp, Artificial Sequence
  Synthetic
atggccgactcccaagtacgaatataaatagccatcttgcccagcagcggaatgttcggacaacccaggtcaactaagttgctctgtagaaaatgctgctgccctcctgagcagtctactggagacccagcatggcgtat

SEQ ID NO: 367741 - DNA, 140 bp, Artificial Sequence
  Synthetic
aggccctggctgctgatatgacctgggttgtccgaacattccgctgctgggcaagatggctatttatatttgcagaatgtcaaatcaccctaaaacaaccatggctttccttttttggttgaccttttgggacagcggtg

SEQ ID NO: 367742 - DNA, 140 bp, Artificial Sequence
  Synthetic
caccgctgtcccaaaaggtcaaccaaaaaaggaaagccatggttgttttagggtgatttgacattctgcaaatataaatagccatcttgcccagcagcggaatgttcggacaacccaggtcatatcagcagccagggcct

SEQ ID NO: 367743 - DNA, 140 bp, Artificial Sequence
  Synthetic
atacgccatgctgggtctccgaatcatgctctgtccttaatgtttttggatgaaatgtcattacctgagcttaaatccttatctgtgaactgcagaatgggaaactttgaagggcaggagcgtacttgggagtcggccat

SEQ ID NO: 367744 - DNA, 140 bp, Artificial Sequence
  Synthetic
atggccgactcccaagtacgctcctgcccttcaaagtttcccattctgcagttcacagataaggatttaagctcaggtaatgacatttcatccaaaaacattaaggacagagcatgattcggagacccagcatggcgtat

SEQ ID NO: 367745 - DNA, 140 bp, Artificial Sequence
  Synthetic
atacgccatgctgggtctcctacttataattattgggacattagggaaaaaattaaagcagtacagagagctgaaaccccaaacatgtaccatatgtgaatcagtaccggttaatgcaatcgtacttgggagtcggccat

SEQ ID NO: 367746 - DNA, 140 bp, Artificial Sequence
  Synthetic
atggccgactcccaagtacgattgcattaaccggtactgattcacatatggtacatgtttggggtttcagctctctgtactgctttaattttttccctaatgtcccaataattataagtaggagacccagcatggcgtat

SEQ ID NO: 367747 - DNA, 140 bp, Artificial Sequence
  Synthetic
atacgccatgctgggtctcccaaattagttgaccactgtgtggacatggaaaaaaagagggatgcagttagagcagtggaagatttagttctgatgttgacaggtagggcagtcaaacctcgtacttgggagtcggccat

SEQ ID NO: 367748 - DNA, 140 bp, Artificial Sequence
  Synthetic
atggccgactcccaagtacgaggtttgactgccctacctgtcaacatcagaactaaatcttccactgctctaactgcatccctctttttttccatgtccacacagtggtcaactaatttgggagacccagcatggcgtat

SEQ ID NO: 367749 - DNA, 140 bp, Artificial Sequence
  Synthetic
atacgccatgctgggtctccaagcctagatgatctaatggcaagtgacacagtgacagacctgcccgatagggaagcagaggccctcaaaacaggcaatcttggctttaactgggattcacgtacttgggagtcggccat

SEQ ID NO: 367750 - DNA, 140 bp, Artificial Sequence
  Synthetic
atggccgactcccaagtacgtgaatcccagttaaagccaagattgcctgttttgagggcctctgcttccctatcgggcaggtctgtcactgtgtcacttgccattagatcatctaggcttggagacccagcatggcgtat

SEQ ID NO: 367751 - DNA, 140 bp, Artificial Sequence
  Synthetic
aggccctggctgctgatatggggaagcagaggccctcaaaacaggcaatcttggctttaactgggattcagattgaacacattatctgcatgaatcattaatacctctcagtatcttaaggaccttttgggacagcggtg

SEQ ID NO: 367752 - DNA, 140 bp, Artificial Sequence
  Synthetic
caccgctgtcccaaaaggtccttaagatactgagaggtattaatgattcatgcagataatgtgttcaatctgaatcccagttaaagccaagattgcctgttttgagggcctctgcttccccatatcagcagccagggcct

SEQ ID NO: 367753 - DNA, 140 bp, Artificial Sequence
  Synthetic
atacgccatgctgggtctccagttgccctctatcaatccagagaagattatatgggcatttgccttgtcataatggggagtgttcttctggcagtctccttgctggttagggggctgattcgtacttgggagtcggccat

SEQ ID NO: 367754 - DNA, 140 bp, Artificial Sequence
  Synthetic
atggccgactcccaagtacgaatcagccccctaaccagcaaggagactgccagaagaacactccccattatgacaaggcaaatgcccatataatcttctctggattgatagagggcaactggagacccagcatggcgtat

SEQ ID NO: 367755 - DNA, 140 bp, Artificial Sequence
  Synthetic
aggccctggctgctgatatgtaatggggagtgttcttctggcagtctccttgctggttagggggctgattgacagcattagcagtaccttttttcctggattatctgtttgcaggacatggaccttttgggacagcggtg

SEQ ID NO: 367756 - DNA, 140 bp, Artificial Sequence
  Synthetic
caccgctgtcccaaaaggtccatgtcctgcaaacagataatccaggaaaaaaggtactgctaatgctgtcaatcagccccctaaccagcaaggagactgccagaagaacactccccattacatatcagcagccagggcct

SEQ ID NO: 367757 - DNA, 140 bp, Artificial Sequence
  Synthetic
atacgccatgctgggtctccatgcatatatcattaatgtatgcagttctttgcctacagctgtgtggtctgggggagactcatggatcacataatggaactagatacaataatacagacgcgtacttgggagtcggccat

SEQ ID NO: 367758 - DNA, 140 bp, Artificial Sequence
  Synthetic
atggccgactcccaagtacgcgtctgtattattgtatctagttccattatgtgatccatgagtctcccccagaccacacagctgtaggcaaagaactgcatacattaatgatatatgcatggagacccagcatggcgtat

SEQ ID NO: 367759 - DNA, 140 bp, Artificial Sequence
  Synthetic
aggccctggctgctgatatggggggagactcatggatcacataatggaactagatacaataatacagacgctacgacaacgcccggtgatagccagagccctgaaccgccagtgagcacggaccttttgggacagcggtg

SEQ ID NO: 367760 - DNA, 140 bp, Artificial Sequence
  Synthetic
caccgctgtcccaaaaggtccgtgctcactggcggttcagggctctggctatcaccgggcgttgtcgtagcgtctgtattattgtatctagttccattatgtgatccatgagtctccccccatatcagcagccagggcct

SEQ ID NO: 367761 - DNA, 140 bp, Artificial Sequence
  Synthetic
atacgccatgctgggtctccctacgacaacgcccggtgatagccagagccctgaaccgccagtgagcacggcctcgtccatcacacacaacccctccactgtcacatccacaacaccaaccgtacttgggagtcggccat

SEQ ID NO: 367762 - DNA, 140 bp, Artificial Sequence
  Synthetic
atggccgactcccaagtacggttggtgttgtggatgtgacagtggaggggttgtgtgtgatggacgaggccgtgctcactggcggttcagggctctggctatcaccgggcgttgtcgtagggagacccagcatggcgtat

SEQ ID NO: 367763 - DNA, 140 bp, Artificial Sequence
  Synthetic
aggccctggctgctgatatgagtgttagcttcaccaaggaggaggtcttaataaagcggttggagaaaaatttccttaagcaacacaatctggaaatcatggaaacagtgaacctcatatgaccttttgggacagcggtg

SEQ ID NO: 367764 - DNA, 140 bp, Artificial Sequence
  Synthetic
caccgctgtcccaaaaggtcatatgaggttcactgtttccatgatttccagattgtgttgcttaaggaaatttttctccaaccgctttattaagacctcctccttggtgaagctaacactcatatcagcagccagggcct

SEQ ID NO: 367765 - DNA, 140 bp, Artificial Sequence
  Synthetic
atacgccatgctgggtctccccgagggcctatctccaccggggaccactccagagctcccagccacaaccggtatagacacttcaggtgcaagtgatgccaaccccagcacacaggcagccgtacttgggagtcggccat

SEQ ID NO: 367766 - DNA, 140 bp, Artificial Sequence
  Synthetic
atggccgactcccaagtacggctgcctgtgtgctggggttggcatcacttgcacctgaagtgtctataccggttgtggctgggagctctggagtggtccccggtggagataggccctcggggagacccagcatggcgtat

SEQ ID NO: 367767 - DNA, 140 bp, Artificial Sequence
  Synthetic
aggccctggctgctgatatgggtatagacacttcaggtgcaagtgatgccaaccccagcacacaggcagccagaggcacctctgcactaacagtccacacaagtttgcccagcagccctagaccttttgggacagcggtg

SEQ ID NO: 367768 - DNA, 140 bp, Artificial Sequence
  Synthetic
caccgctgtcccaaaaggtctagggctgctgggcaaacttgtgtggactgttagtgcagaggtgcctctggctgcctgtgtgctggggttggcatcacttgcacctgaagtgtctatacccatatcagcagccagggcct

SEQ ID NO: 367769 - DNA, 140 bp, Artificial Sequence
  Synthetic
atacgccatgctgggtctcctcagttacgagccctatgccagaagagacaacagcaccttcgggttcaggcaaggagagctcagcaaccagcagcccccatccagcttccgacagaccaccgtacttgggagtcggccat

SEQ ID NO: 367770 - DNA, 140 bp, Artificial Sequence
  Synthetic
atggccgactcccaagtacggtggtctgtcggaagctggatgggggctgctggttgctgagctctccttgcctgaacccgaaggtgctgttgtctcttctggcatagggctcgtaactgaggagacccagcatggcgtat

SEQ ID NO: 367771 - DNA, 140 bp, Artificial Sequence
  Synthetic
aggccctggctgctgatatgcaaggagagctcagcaaccagcagcccccatccagcttccgacagaccaccaacccctcccgcaacagcccaggggctcactgaaagtaacagtcacaacgaccttttgggacagcggtg

SEQ ID NO: 367772 - DNA, 140 bp, Artificial Sequence
  Synthetic
caccgctgtcccaaaaggtcgttgtgactgttactttcagtgagcccctgggctgttgcgggaggggttggtggtctgtcggaagctggatgggggctgctggttgctgagctctccttgcatatcagcagccagggcct

SEQ ID NO: 367773 - DNA, 140 bp, Artificial Sequence
  Synthetic
atacgccatgctgggtctcctgataaaattgatgatgagtatgtcaggcatcgactgcataaaatatcccacaggccagctcatcacccatggaagagtaagtgccaaacttaacgatggcgtacttgggagtcggccat

SEQ ID NO: 367774 - DNA, 140 bp, Artificial Sequence
  Synthetic
atggccgactcccaagtacgccatcgttaagtttggcacttactcttccatgggtgatgagctggcctgtgggatattttatgcagtcgatgcctgacatactcatcatcaattttatcaggagacccagcatggcgtat

SEQ ID NO: 367775 - DNA, 140 bp, Artificial Sequence
  Synthetic
atacgccatgctgggtctccaacctctccagcacagacagtccacccacatagcgcaacctccatagccgctccagacacacaccccaacccaacaaacagatctaaaagaaaccttgaacgtacttgggagtcggccat

SEQ ID NO: 367776 - DNA, 140 bp, Artificial Sequence
  Synthetic
atggccgactcccaagtacgttcaaggtttcttttagatctgtttgttgggttggggtgtgtgtctggagcggctatggaggttgcgctatgtgggtggactgtctgtgctggagaggttggagacccagcatggcgtat

SEQ ID NO: 367777 - DNA, 140 bp, Artificial Sequence
  Synthetic
aggccctggctgctgatatgagaacactcaccatctccgtcatggatctatcacagatgtattcccctgtctttgagtacctgtcaggagatcgtcaggtggaggaatggccaaaggcaagaccttttgggacagcggtg

SEQ ID NO: 367778 - DNA, 140 bp, Artificial Sequence
  Synthetic
caccgctgtcccaaaaggtcttgcctttggccattcctccacctgacgatctcctgacaggtactcaaagacaggggaatacatctgtgatagatccatgacggagatggtgagtgttctcatatcagcagccagggcct

SEQ ID NO: 367779 - DNA, 140 bp, Artificial Sequence
  Synthetic
atacgccatgctgggtctccaatactcagacttctgcatcttaccttggaagaagacactgaaggtctactggaatggtgtaagaggaatcttggtcttgattgtgatgacaccttctttcgtacttgggagtcggccat

SEQ ID NO: 367780 - DNA, 140 bp, Artificial Sequence
  Synthetic
atggccgactcccaagtacgaaagaaggtgtcatcacaatcaagaccaagattcctcttacaccattccagtagaccttcagtgtcttcttccaaggtaagatgcagaagtctgagtattggagacccagcatggcgtat

SEQ ID NO: 367781 - DNA, 140 bp, Artificial Sequence
  Synthetic
atacgccatgctgggtctccctttacaaggagtggccacattcgagaaactggagatgcaaccccacctggtgttggggggttgggactggctgcacatgctgtggactagatgtcaaagcgtacttgggagtcggccat

SEQ ID NO: 367782 - DNA, 140 bp, Artificial Sequence
  Synthetic
atggccgactcccaagtacgctttgacatctagtccacagcatgtgcagccagtcccaaccccccaacaccaggtggggttgcatctccagtttctcgaatgtggccactccttgtaaagggagacccagcatggcgtat

SEQ ID NO: 367783 - DNA, 140 bp, Artificial Sequence
  Synthetic
aggccctggctgctgatatggtgttggggggttgggactggctgcacatgctgtggactagatgtcaaagaactgttcacggatcacatgctagtaaaatggaaagttgagtacatcaaggaccttttgggacagcggtg

SEQ ID NO: 367784 - DNA, 140 bp, Artificial Sequence
  Synthetic
caccgctgtcccaaaaggtccttgatgtactcaactttccattttactagcatgtgatccgtgaacagttctttgacatctagtccacagcatgtgcagccagtcccaaccccccaacaccatatcagcagccagggcct

SEQ ID NO: 367785 - DNA, 140 bp, Artificial Sequence
  Synthetic
atacgccatgctgggtctccagttttacaatttagaacgccaggcacagtgagcactacagagtcaacacatgctggaccgccaacagctgaaccctttaagtcctatttcgctaaaggccgtacttgggagtcggccat

SEQ ID NO: 367786 - DNA, 140 bp, Artificial Sequence
  Synthetic
atggccgactcccaagtacggcctttagcgaaataggacttaaagggttcagctgttggcggtccagcatgtgttgactctgtagtgctcactgtgcctggcgttctaaattgtaaaactggagacccagcatggcgtat

SEQ ID NO: 367787 - DNA, 140 bp, Artificial Sequence
  Synthetic
aggccctggctgctgatatgatgctggaccgccaacagctgaaccctttaagtcctatttcgctaaaggctccctttcaatagattcaggttactattcagccaaatgttactcaggaacgaccttttgggacagcggtg

SEQ ID NO: 367788 - DNA, 140 bp, Artificial Sequence
  Synthetic
caccgctgtcccaaaaggtcgttcctgagtaacatttggctgaatagtaacctgaatctattgaaagggagcctttagcgaaataggacttaaagggttcagctgttggcggtccagcatcatatcagcagccagggcct

SEQ ID NO: 367789 - DNA, 140 bp, Artificial Sequence
  Synthetic
atacgccatgctgggtctcctttgattgaagcaggtacgagatttagcttaggaccagtaacaatcaccttgtctgagccaaggaacattcagcagaagcttcctcctgaattaattacacgtacttgggagtcggccat

SEQ ID NO: 367790 - DNA, 140 bp, Artificial Sequence
  Synthetic
atggccgactcccaagtacgtgtaattaattcaggaggaagcttctgctgaatgttccttggctcagacaaggtgattgttactggtcctaagctaaatctcgtacctgcttcaatcaaaggagacccagcatggcgtat

SEQ ID NO: 367791 - DNA, 140 bp, Artificial Sequence
  Synthetic
aggccctggctgctgatatgtgtctgagccaaggaacattcagcagaagcttcctcctgaattaattacattacacccaaagatagaagacggctactttgacttaatgcatgttcaaaagaccttttgggacagcggtg

SEQ ID NO: 367792 - DNA, 140 bp, Artificial Sequence
  Synthetic
caccgctgtcccaaaaggtcttttgaacatgcattaagtcaaagtagccgtcttctatctttgggtgtaatgtaattaattcaggaggaagcttctgctgaatgttccttggctcagacacatatcagcagccagggcct

SEQ ID NO: 367793 - DNA, 140 bp, Artificial Sequence
  Synthetic
atacgccatgctgggtctcctagctgacacacctgggcctaagatcactaacttgaagaccatcaactgcataaacttaaaggcattgaccttcaaagaacacagagaggttgaaatcaacgtacttgggagtcggccat

SEQ ID NO: 367794 - DNA, 140 bp, Artificial Sequence
  Synthetic
atggccgactcccaagtacgttgatttcaacctctctgtgttctttgaaggtcaatgcctttaagtttatgcagttgatggtcttcaagttagtgatcttaggcccaggtgtgtcagctaggagacccagcatggcgtat

SEQ ID NO: 367795 - DNA, 140 bp, Artificial Sequence
  Synthetic
atacgccatgctgggtctcctgcccggggacttgcaaatttatcatgttggcaatctgttgaagggggacagagtgaatgggcacctgatccacaaggttgagccacacctgaacacatccgtacttgggagtcggccat

SEQ ID NO: 367796 - DNA, 140 bp, Artificial Sequence
  Synthetic
atggccgactcccaagtacggatgtgttcaggtgtggctcaaccttgtggatcaggtgcccattcactctgtcccccttcaacagattgccaacatgataaatttgcaagtccccgggcaggagacccagcatggcgtat

SEQ ID NO: 367797 - DNA, 140 bp, Artificial Sequence
  Synthetic
atacgccatgctgggtctcctcaaatcacatgtctgtgactactctttggacattgacgggacggtgaggctccctcacattcatcatgaaggtattttcattccaggaacttataaaatcgtacttgggagtcggccat

SEQ ID NO: 367798 - DNA, 140 bp, Artificial Sequence
  Synthetic
atggccgactcccaagtacgattttataagttcctggaatgaaaataccttcatgatgaatgtgagggagcctcaccgtcccgtcaatgtccaaagagtagtcacagacatgtgatttgaggagacccagcatggcgtat

SEQ ID NO: 367799 - DNA, 140 bp, Artificial Sequence
  Synthetic
aggccctggctgctgatatgctgtaagctcactctacttgatctgtcagtttctaaactcttagtgtgtttatttcgaaaagatgacgaagaactaacaaacagctcaagtttaaaactcgaccttttgggacagcggtg

SEQ ID NO: 367800 - DNA, 140 bp, Artificial Sequence
  Synthetic
caccgctgtcccaaaaggtcgagttttaaacttgagctgtttgttagttcttcgtcatcttttcgaaataaacacactaagagtttagaaactgacagatcaagtagagtgagcttacagcatatcagcagccagggcct

SEQ ID NO: 367801 - DNA, 140 bp, Artificial Sequence
  Synthetic
atacgccatgctgggtctccactgtgtgataaaagggagggaggttcgtaaaggccagtcagttttgaagcagtacaagacagaaatcaggattggcaaggcatcaaccggctctagaagcgtacttgggagtcggccat

SEQ ID NO: 367802 - DNA, 140 bp, Artificial Sequence
  Synthetic
atggccgactcccaagtacgcttctagagccggttgatgccttgccaatcctgatttctgtcttgtactgcttcaaaactgactggcctttacgaacctccctcccttttatcacacagtggagacccagcatggcgtat

SEQ ID NO: 367803 - DNA, 140 bp, Artificial Sequence
  Synthetic
aggccctggctgctgatatgcagtacaagacagaaatcaggattggcaaggcatcaaccggctctagaagattgctctccgaggagtctagcgacgactgcatatcaagaactcaactatgaccttttgggacagcggtg

SEQ ID NO: 367804 - DNA, 140 bp, Artificial Sequence
  Synthetic
caccgctgtcccaaaaggtcatagttgagttcttgatatgcagtcgtcgctagactcctcggagagcaatcttctagagccggttgatgccttgccaatcctgatttctgtcttgtactgcatatcagcagccagggcct

SEQ ID NO: 367805 - DNA, 140 bp, Artificial Sequence
  Synthetic
atacgccatgctgggtctccgacaagataaccatctgcaatggctcaactgttgtagaccagagactgggtagtgagctggggtgttacactatcaatagagtaaagacattcaaactatcgtacttgggagtcggccat

SEQ ID NO: 367806 - DNA, 140 bp, Artificial Sequence
  Synthetic
atggccgactcccaagtacgatagtttgaatgtctttactctattgatagtgtaacaccccagctcactacccagtctctggtctacaacagttgagccattgcagatggttatcttgtcggagacccagcatggcgtat

SEQ ID NO: 367807 - DNA, 140 bp, Artificial Sequence
  Synthetic
aggccctggctgctgatatgtagtgagctggggtgttacactatcaatagagtaaagacattcaaactatgcgaaaacagtgctacagggaagagttgtgagatagatagtgtcccagttgaccttttgggacagcggtg

SEQ ID NO: 367808 - DNA, 140 bp, Artificial Sequence
  Synthetic
caccgctgtcccaaaaggtcaactgggacactatctatctcacaactcttccctgtagcactgttttcgcatagtttgaatgtctttactctattgatagtgtaacaccccagctcactacatatcagcagccagggcct

SEQ ID NO: 367809 - DNA, 140 bp, Artificial Sequence
  Synthetic
atacgccatgctgggtctcctgtaaaattatctagaggctcagaggttgtcttggatgcatgtgatacaagctgtgaagtaatgatacccaaaggcactggtgacatcctagttgactgtcgtacttgggagtcggccat

SEQ ID NO: 367810 - DNA, 140 bp, Artificial Sequence
  Synthetic
atggccgactcccaagtacgacagtcaactaggatgtcaccagtgcctttgggtatcattacttcacagcttgtatcacatgcatccaagacaacctctgagcctctagataattttacaggagacccagcatggcgtat

SEQ ID NO: 367811 - DNA, 140 bp, Artificial Sequence
  Synthetic
aggccctggctgctgatatgtgcaaaaatgaggaaacacagaggtgtgtgaacgcaaagcttgaacagccacagagcatcctcatcgaacatacaggtacaatcattggcaagcagaacggaccttttgggacagcggtg

SEQ ID NO: 367812 - DNA, 140 bp, Artificial Sequence
  Synthetic
caccgctgtcccaaaaggtccgttctgcttgccaatgattgtacctgtatgttcgatgaggatgctctgtggctgttcaagctttgcgttcacacacctctgtgtttcctcatttttgcacatatcagcagccagggcct

SEQ ID NO: 367813 - DNA, 140 bp, Artificial Sequence
  Synthetic
atacgccatgctgggtctccccccaaaattccattactgggtaaaatggctatttacatttgcagaatgtcgaatcaccccaaaacaactatggctttcctcttctggttcagctttggccgtacttgggagtcggccat

SEQ ID NO: 367814 - DNA, 140 bp, Artificial Sequence
  Synthetic
atggccgactcccaagtacggccaaagctgaaccagaagaggaaagccatagttgttttggggtgattcgacattctgcaaatgtaaatagccattttacccagtaatggaattttggggggagacccagcatggcgtat

SEQ ID NO: 367815 - DNA, 140 bp, Artificial Sequence
  Synthetic
atacgccatgctgggtctccttttatggactaaagagcatgttgagcggcatttttggtaatgtctttctaggcatcttcttgtttcttgccccctttgctctgctgctgtttttcttttcgtacttgggagtcggccat

SEQ ID NO: 367816 - DNA, 140 bp, Artificial Sequence
  Synthetic
atggccgactcccaagtacgaaaagaaaaacagcagcagagcaaagggggcaagaaacaagaagatgcctagaaagacattaccaaaaatgccgctcaacatgctctttagtccataaaaggagacccagcatggcgtat

SEQ ID NO: 367817 - DNA, 140 bp, Artificial Sequence
  Synthetic
aggccctggctgctgatatgaggcatcttcttgtttcttgccccctttgctctgctgctgtttttctttttctttggatggagaatcctgttttgctttaagtgctgtagaagaaccagagaccttttgggacagcggtg

SEQ ID NO: 367818 - DNA, 140 bp, Artificial Sequence
  Synthetic
caccgctgtcccaaaaggtctctggttcttctacagcacttaaagcaaaacaggattctccatccaaagaaaaagaaaaacagcagcagagcaaagggggcaagaaacaagaagatgcctcatatcagcagccagggcct

SEQ ID NO: 367819 - DNA, 140 bp, Artificial Sequence
  Synthetic
atacgccatgctgggtctcctgttggaacactaggaaaaaggttcaagcagtacagagagttaaaacctcagacctgcaccatatgtgagacaactcctgtgaatgcaatagatgctgagcgtacttgggagtcggccat

SEQ ID NO: 367820 - DNA, 140 bp, Artificial Sequence
  Synthetic
atggccgactcccaagtacgctcagcatctattgcattcacaggagttgtctcacatatggtgcaggtctgaggttttaactctctgtactgcttgaacctttttcctagtgttccaacaggagacccagcatggcgtat

SEQ ID NO: 367821 - DNA, 140 bp, Artificial Sequence
  Synthetic
atacgccatgctgggtctccaaaaatcatcgaaagactgaacaataaaaaaggcaaacacagacttcttgacggcgagagacttgcagataggaagatcgctgaacttttctcaactaagcgtacttgggagtcggccat

SEQ ID NO: 367822 - DNA, 140 bp, Artificial Sequence
  Synthetic
atggccgactcccaagtacgcttagttgagaaaagttcagcgatcttcctatctgcaagtctctcgccgtcaagaagtctgtgtttgccttttttattgttcagtctttcgatgatttttggagacccagcatggcgtat

SEQ ID NO: 367823 - DNA, 140 bp, Artificial Sequence
  Synthetic
aggccctggctgctgatatgacggcgagagacttgcagataggaagatcgctgaacttttctcaactaagacacacattggataatggagttggtggagcctcaccatccatataaaacagaccttttgggacagcggtg

SEQ ID NO: 367824 - DNA, 140 bp, Artificial Sequence
  Synthetic
caccgctgtcccaaaaggtctgttttatatggatggtgaggctccaccaactccattatccaatgtgtgtcttagttgagaaaagttcagcgatcttcctatctgcaagtctctcgccgtcatatcagcagccagggcct

SEQ ID NO: 367825 - DNA, 140 bp, Artificial Sequence
  Synthetic
atacgccatgctgggtctccgtcacaaaggtacacggtaaacagacagccaatgtgcaacgctgccaaatagcatcatctccctctgacacactaacttaacaaaataccgcactgcacgcgtacttgggagtcggccat

SEQ ID NO: 367826 - DNA, 140 bp, Artificial Sequence
  Synthetic
atggccgactcccaagtacgcgtgcagtgcggtattttgttaagttagtgtgtcagagggagatgatgctatttggcagcgttgcacattggctgtctgtttaccgtgtacctttgtgacggagacccagcatggcgtat

SEQ ID NO: 367827 - DNA, 140 bp, Artificial Sequence
  Synthetic
aggccctggctgctgatatgagcatcatctccctctgacacactaacttaacaaaataccgcactgcacgatgctgcctcagcttccacttactcgtagataacttcaactgcgtgccgcgaccttttgggacagcggtg

SEQ ID NO: 367828 - DNA, 140 bp, Artificial Sequence
  Synthetic
caccgctgtcccaaaaggtcgcggcacgcagttgaagttatctacgagtaagtggaagctgaggcagcatcgtgcagtgcggtattttgttaagttagtgtgtcagagggagatgatgctcatatcagcagccagggcct

SEQ ID NO: 367829 - DNA, 140 bp, Artificial Sequence
  Synthetic
atacgccatgctgggtctcctgtcctgtttttagtctcctgtctaatgaaaggactggttgacagtgtcggcaacaccttcttccctggactgtccatttgcaaaacgtgctctataagccgtacttgggagtcggccat

SEQ ID NO: 367830 - DNA, 140 bp, Artificial Sequence
  Synthetic
atggccgactcccaagtacggcttatagagcacgttttgcaaatggacagtccagggaagaaggtgttgccgacactgtcaaccagtcctttcattagacaggagactaaaaacaggacaggagacccagcatggcgtat

SEQ ID NO: 367831 - DNA, 140 bp, Artificial Sequence
  Synthetic
aggccctggctgctgatatgatagcaggccttgacctttgtcaaacaatggagttcttgaggagccttgactggacccaagtgctggctggtcagtatgtgacaaatcccagattcagcagaccttttgggacagcggtg

SEQ ID NO: 367832 - DNA, 140 bp, Artificial Sequence
  Synthetic
caccgctgtcccaaaaggtctgctgaatctgggatttgtcacatactgaccagccagcacttgggtccagtcaaggctcctcaagaactccattgtttgacaaaggtcaaggcctgctatcatatcagcagccagggcct

SEQ ID NO: 367833 - DNA, 140 bp, Artificial Sequence
  Synthetic
atacgccatgctgggtctccctggacccaagtgctggctggtcagtatgtgacaaatcccagattcagcatatctgactactttgaaattgttcgacagcctggtgacggaaactgtttccgtacttgggagtcggccat

SEQ ID NO: 367834 - DNA, 140 bp, Artificial Sequence
  Synthetic
atggccgactcccaagtacggaaacagtttccgtcaccaggctgtcgaacaatttcaaagtagtcagatatgctgaatctgggatttgtcacatactgaccagccagcacttgggtccagggagacccagcatggcgtat

SEQ ID NO: 367835 - DNA, 140 bp, Artificial Sequence
  Synthetic
atacgccatgctgggtctcctgcacttgagcatctgcaaaaaaaggaaagcaggaagtaatgtcatgctggctgtctgcaagcgcatgtgctttagggccaccatggaagtaagcaacagcgtacttgggagtcggccat

SEQ ID NO: 367836 - DNA, 140 bp, Artificial Sequence
  Synthetic
atggccgactcccaagtacgctgttgcttacttccatggtggccctaaagcacatgcgcttgcagacagccagcatgacattacttcctgctttcctttttttgcagatgctcaagtgcaggagacccagcatggcgtat

SEQ ID NO: 367837 - DNA, 140 bp, Artificial Sequence
  Synthetic
atacgccatgctgggtctcctcacaacatcaagcacataactaaaacagcagcacagaaatactatttggatgagcctgaggctaagcttgtcggtcttagtctagaggactacctccagcgtacttgggagtcggccat

SEQ ID NO: 367838 - DNA, 140 bp, Artificial Sequence
  Synthetic
atggccgactcccaagtacgctggaggtagtcctctagactaagaccgacaagcttagcctcaggctcatccaaatagtatttctgtgctgctgttttagttatgtgcttgatgttgtgaggagacccagcatggcgtat

SEQ ID NO: 367839 - DNA, 140 bp, Artificial Sequence
  Synthetic
aggccctggctgctgatatgatgagcctgaggctaagcttgtcggtcttagtctagaggactacctccagaggatgtcatctgacaatgagtggggctccactcttgaagcatccatgctgaccttttgggacagcggtg

SEQ ID NO: 367840 - DNA, 140 bp, Artificial Sequence
  Synthetic
caccgctgtcccaaaaggtcagcatggatgcttcaagagtggagccccactcattgtcagatgacatcctctggaggtagtcctctagactaagaccgacaagcttagcctcaggctcatcatatcagcagccagggcct

SEQ ID NO: 367841 - DNA, 140 bp, Artificial Sequence
  Synthetic
atacgccatgctgggtctcctgatactagcagcctgtgttgtcagcacctcagcagtggagatggaaagcctaccagccgggacctgggagagagaagaagacctaacaaacttctgtcacgtacttgggagtcggccat

SEQ ID NO: 367842 - DNA, 140 bp, Artificial Sequence
  Synthetic
atggccgactcccaagtacgtgacagaagtttgttaggtcttcttctctctcccaggtcccggctggtaggctttccatctccactgctgaggtgctgacaacacaggctgctagtatcaggagacccagcatggcgtat

SEQ ID NO: 367843 - DNA, 140 bp, Artificial Sequence
  Synthetic
aggccctggctgctgatatgctaccagccgggacctgggagagagaagaagacctaacaaacttctgtcatcaggaatgccaagttgcggatactgaatgcctctgcccttatgaagctcgaccttttgggacagcggtg

SEQ ID NO: 367844 - DNA, 140 bp, Artificial Sequence
  Synthetic
caccgctgtcccaaaaggtcgagcttcataagggcagaggcattcagtatccgcaacttggcattcctgatgacagaagtttgttaggtcttcttctctctcccaggtcccggctggtagcatatcagcagccagggcct

SEQ ID NO: 367845 - DNA, 140 bp, Artificial Sequence
  Synthetic
atacgccatgctgggtctccatgaagtggaagctggcatcaaattcggggagggtgatgtgttcacagctgtgaacctcctgcactcagggcagacacactttgatgcactcagagtgctcgtacttgggagtcggccat

SEQ ID NO: 367846 - DNA, 140 bp, Artificial Sequence
  Synthetic
atggccgactcccaagtacgagcactctgagtgcatcaaagtgtgtctgccctgagtgcaggaggttcacagctgtgaacacatcaccctccccgaatttgatgccagcttccacttcatggagacccagcatggcgtat

SEQ ID NO: 367847 - DNA, 140 bp, Artificial Sequence
  Synthetic
aggccctggctgctgatatggtgaacctcctgcactcagggcagacacactttgatgcactcagagtgctgccacagcttgagactgatgctagaggaacactaagtctagtagacaagggaccttttgggacagcggtg

SEQ ID NO: 367848 - DNA, 140 bp, Artificial Sequence
  Synthetic
caccgctgtcccaaaaggtcccttgtctactagacttagtgttcctctagcatcagtctcaagctgtggcagcactctgagtgcatcaaagtgtgtctgccctgagtgcaggaggttcaccatatcagcagccagggcct

SEQ ID NO: 367849 - DNA, 140 bp, Artificial Sequence
  Synthetic
atacgccatgctgggtctccaatttgctaaactcaacaagtttagagacaagtttatcaattgaggcaccatggggagcaataaatgttcagtcaacctacaaaccaactgtatcaactgcgtacttgggagtcggccat

SEQ ID NO: 367850 - DNA, 140 bp, Artificial Sequence
  Synthetic
atggccgactcccaagtacgcagttgatacagttggtttgtaggttgactgaacatttattgctccccatggtgcctcaattgataaacttgtctctaaacttgttgagtttagcaaattggagacccagcatggcgtat

SEQ ID NO: 367851 - DNA, 140 bp, Artificial Sequence
  Synthetic
aggccctggctgctgatatgatggggagcaataaatgttcagtcaacctacaaaccaactgtatcaactgcaaacatagcgcttagttggagctcagtggaacacagaggcaataagatagaccttttgggacagcggtg

SEQ ID NO: 367852 - DNA, 140 bp, Artificial Sequence
  Synthetic
caccgctgtcccaaaaggtctatcttattgcctctgtgttccactgagctccaactaagcgctatgtttgcagttgatacagttggtttgtaggttgactgaacatttattgctccccatcatatcagcagccagggcct

SEQ ID NO: 367853 - DNA, 140 bp, Artificial Sequence
  Synthetic
atacgccatgctgggtctcctacgaagatcttgccctagcgcttgcggatacagaggaaccacgcaggcgaacgagcctggacgaggttactttgtctagaagacaggcagaagtgcttacgtacttgggagtcggccat

SEQ ID NO: 367854 - DNA, 140 bp, Artificial Sequence
  Synthetic
atggccgactcccaagtacgtaagcacttctgcctgtcttctagacaaagtaacctcgtccaggctcgttcgcctgcgtggttcctctgtatccgcaagcgctagggcaagatcttcgtaggagacccagcatggcgtat

SEQ ID NO: 367855 - DNA, 140 bp, Artificial Sequence
  Synthetic
aggccctggctgctgatatgaacgagcctggacgaggttactttgtctagaagacaggcagaagtgcttagacagaaagcatctcaactttccaagctagtcaacaagagccaaaacatagaccttttgggacagcggtg

SEQ ID NO: 367856 - DNA, 140 bp, Artificial Sequence
  Synthetic
caccgctgtcccaaaaggtctatgttttggctcttgttgactagcttggaaagttgagatgctttctgtctaagcacttctgcctgtcttctagacaaagtaacctcgtccaggctcgttcatatcagcagccagggcct

SEQ ID NO: 367857 - DNA, 140 bp, Artificial Sequence
  Synthetic
atacgccatgctgggtctccaataagctgggatctcggtgtggaagacgcctctgagtctaaactgcttacagtctctgtcatggacttgtctcagatgtactcacctgtcttcgagtaccgtacttgggagtcggccat

SEQ ID NO: 367858 - DNA, 140 bp, Artificial Sequence
  Synthetic
atggccgactcccaagtacggtactcgaagacaggtgagtacatctgagacaagtccatgacagagactgtaagcagtttagactcagaggcgtcttccacaccgagatcccagcttattggagacccagcatggcgtat

SEQ ID NO: 367859 - DNA, 140 bp, Artificial Sequence
  Synthetic
atacgccatgctgggtctcctgttgagataacctctgagactctcatgctgaggccagaatcaaaagaaaggattggggaagtcatgtcactgcgacagctaggacataaactgctgacacgtacttgggagtcggccat

SEQ ID NO: 367860 - DNA, 140 bp, Artificial Sequence
  Synthetic
atggccgactcccaagtacgtgtcagcagtttatgtcctagctgtcgcagtgacatgacttccccaatcctttcttttgattctggcctcagcatgagagtctcagaggttatctcaacaggagacccagcatggcgtat

SEQ ID NO: 367861 - DNA, 140 bp, Artificial Sequence
  Synthetic
atacgccatgctgggtctcctgactgcccagaaagatgtggctgcacatcatcaacctgcttgcacaaagaatggccccactcaagaaattggagatgtaatcccacttggtgctggggtcgtacttgggagtcggccat

SEQ ID NO: 367862 - DNA, 140 bp, Artificial Sequence
  Synthetic
atggccgactcccaagtacgaccccagcaccaagtgggattacatctccaatttcttgagtggggccattctttgtgcaagcaggttgatgatgtgcagccacatctttctgggcagtcaggagacccagcatggcgtat

SEQ ID NO: 367863 - DNA, 140 bp, Artificial Sequence
  Synthetic
atacgccatgctgggtctccagattatatgtttgtcaagtggaaagttgaatacattaagacagaagcaatagtgtgtgtagaacttactagtcaggaaagacagtgtagcttgattgaacgtacttgggagtcggccat

SEQ ID NO: 367864 - DNA, 140 bp, Artificial Sequence
  Synthetic
atggccgactcccaagtacgttcaatcaagctacactgtctttcctgactagtaagttctacacacactattgcttctgtcttaatgtattcaactttccacttgacaaacatataatctggagacccagcatggcgtat

SEQ ID NO: 367865 - DNA, 140 bp, Artificial Sequence
  Synthetic
aggccctggctgctgatatgatactggacatctgcactgtgtctcttggagtgatgttatccacttttctgtatggctctaacaataaaaacaagaagaagtttataacaaattgcctgcgaccttttgggacagcggtg

SEQ ID NO: 367866 - DNA, 140 bp, Artificial Sequence
  Synthetic
caccgctgtcccaaaaggtcgcaggcaatttgttataaacttcttcttgtttttattgttagagccatacagaaaagtggataacatcactccaagagacacagtgcagatgtccagtatcatatcagcagccagggcct

SEQ ID NO: 367867 - DNA, 140 bp, Artificial Sequence
  Synthetic
atacgccatgctgggtctccaagaaacatccagcaaaagctcccacctgaaataatcacactgcatcccaggattgaggagggtttttttgacctgatgcatgtacaaaaagtgttgtcgcgtacttgggagtcggccat

SEQ ID NO: 367868 - DNA, 140 bp, Artificial Sequence
  Synthetic
atggccgactcccaagtacgcgacaacactttttgtacatgcatcaggtcaaaaaaaccctcctcaatcctgggatgcagtgtgattatttcaggtgggagcttttgctggatgtttcttggagacccagcatggcgtat

SEQ ID NO: 367869 - DNA, 140 bp, Artificial Sequence
  Synthetic
atacgccatgctgggtctccagcaacgaactactgtacaaagcacctagaaaagctcttacaattgtctgcagcgccctatttggaaagcaaataaacaagctacagaattgcttcaggacgtacttgggagtcggccat

SEQ ID NO: 367870 - DNA, 140 bp, Artificial Sequence
  Synthetic
atggccgactcccaagtacgtcctgaagcaattctgtagcttgtttatttgctttccaaatagggcgctgcagacaattgtaagagcttttctaggtgctttgtacagtagttcgttgctggagacccagcatggcgtat

SEQ ID NO: 367871 - DNA, 140 bp, Artificial Sequence
  Synthetic
atacgccatgctgggtctccgcaagcacagtgtgtaagttgcagagttgcacacatggtgtgccaggagatctacaggtctaccacatcggaaatttactaaaaggggataaggtaaatgcgtacttgggagtcggccat

SEQ ID NO: 367872 - DNA, 140 bp, Artificial Sequence
  Synthetic
atggccgactcccaagtacgcatttaccttatccccttttagtaaatttccgatgtggtagacctgtagatctcctggcacaccatgtgtgcaactctgcaacttacacactgtgcttgcggagacccagcatggcgtat

SEQ ID NO: 367873 - DNA, 140 bp, Artificial Sequence
  Synthetic
atacgccatgctgggtctccgcactcagttggagctcagtggaacacagaggcaataagatcttggtttcaggcagatcagaatcaattatgaagctggaagaaaggacaggaatcagctcgtacttgggagtcggccat

SEQ ID NO: 367874 - DNA, 140 bp, Artificial Sequence
  Synthetic
atggccgactcccaagtacgagctgattcctgtcctttcttccagcttcataattgattctgatctgcctgaaaccaagatcttattgcctctgtgttccactgagctccaactgagtgcggagacccagcatggcgtat

SEQ ID NO: 367875 - DNA, 140 bp, Artificial Sequence
  Synthetic
atacgccatgctgggtctccggcacctagttcataaaattgagccacacttcaatacttcttggatgtcctgggatggttgtgatctagactattattgcaacatgggagattggccttccgtacttgggagtcggccat

SEQ ID NO: 367876 - DNA, 140 bp, Artificial Sequence
  Synthetic
atggccgactcccaagtacggaaggccaatctcccatgttgcaataatagtctagatcacaaccatcccaggacatccaagaagtattgaagtgtggctcaattttatgaactaggtgccggagacccagcatggcgtat

SEQ ID NO: 367877 - DNA, 140 bp, Artificial Sequence
  Synthetic
atacgccatgctgggtctcccaacactgatgttgagttcaatcacagagagatagctgacctcaaccaactcacatctcggcttatcacattgagaaaagaaaaggacactgatctactccgtacttgggagtcggccat

SEQ ID NO: 367878 - DNA, 140 bp, Artificial Sequence
  Synthetic
atggccgactcccaagtacggagtagatcagtgtccttttcttttctcaatgtgataagccgagatgtgagttggttgaggtcagctatctctctgtgattgaactcaacatcagtgttgggagacccagcatggcgtat

SEQ ID NO: 367879 - DNA, 140 bp, Artificial Sequence
  Synthetic
aggccctggctgctgatatgtcacatctcggcttatcacattgagaaaagaaaaggacactgatctactcaaacaatggttcccagaagacagcctaactcatagatgtacgagaagtgtgaccttttgggacagcggtg

SEQ ID NO: 367880 - DNA, 140 bp, Artificial Sequence
  Synthetic
caccgctgtcccaaaaggtcacacttctcgtacatctatgagttaggctgtcttctgggaaccattgtttgagtagatcagtgtccttttcttttctcaatgtgataagccgagatgtgacatatcagcagccagggcct

SEQ ID NO: 367881 - DNA, 140 bp, Artificial Sequence
  Synthetic
atacgccatgctgggtctcctcatgaagttcatcagcacttctggcagagcaatgagtgctggcaagattggcaatgtgttgtcctatgcgcacaatttgtacctgagcaaaaccagtctcgtacttgggagtcggccat

SEQ ID NO: 367882 - DNA, 140 bp, Artificial Sequence
  Synthetic
atggccgactcccaagtacgagactggttttgctcaggtacaaattgtgcgcataggacaacacattgccaatcttgccagcactcattgctctgccagaagtgctgatgaacttcatgaggagacccagcatggcgtat

SEQ ID NO: 367883 - DNA, 140 bp, Artificial Sequence
  Synthetic
atacgccatgctgggtctccagttacacacaaagaagattgaaatatcaggcttaaaatttactagcttgacttgtacaggttgttatgcttgtagttctggcatctcatgcaaagttagcgtacttgggagtcggccat

SEQ ID NO: 367884 - DNA, 140 bp, Artificial Sequence
  Synthetic
atggccgactcccaagtacgctaactttgcatgagatgccagaactacaagcataacaacctgtacaagtcaagctagtaaattttaagcctgatatttcaatcttctttgtgtgtaactggagacccagcatggcgtat

SEQ ID NO: 367885 - DNA, 140 bp, Artificial Sequence
  Synthetic
atacgccatgctgggtctccgatagtatagaaagcaacatgaggcagcttttcgcaatactaccacctgactgtgcaagagaatgcgaggtcctctttgatgatatcagaaactcacctacgtacttgggagtcggccat

SEQ ID NO: 367886 - DNA, 140 bp, Artificial Sequence
  Synthetic
atggccgactcccaagtacgtaggtgagtttctgatatcatcaaagaggacctcgcattctcttgcacagtcaggtggtagtattgcgaaaagctgcctcatgttgctttctatactatcggagacccagcatggcgtat

SEQ ID NO: 367887 - DNA, 140 bp, Artificial Sequence
  Synthetic
aggccctggctgctgatatgctgtgcaagagaatgcgaggtcctctttgatgatatcagaaactcacctacccacagtactgcatggaaacatgcccttcgcctgaaagggactgcatatgaccttttgggacagcggtg

SEQ ID NO: 367888 - DNA, 140 bp, Artificial Sequence
  Synthetic
caccgctgtcccaaaaggtcatatgcagtccctttcaggcgaagggcatgtttccatgcagtactgtgggtaggtgagtttctgatatcatcaaagaggacctcgcattctcttgcacagcatatcagcagccagggcct

SEQ ID NO: 367889 - DNA, 140 bp, Artificial Sequence
  Synthetic
atacgccatgctgggtctcctctatgtttctacattgtggaaagagaatactgtaagagctgcagtgaagaagacacacaaaaatgtgttaacacaaaacttgagcagccacagagcattcgtacttgggagtcggccat

SEQ ID NO: 367890 - DNA, 140 bp, Artificial Sequence
  Synthetic
atggccgactcccaagtacgaatgctctgtggctgctcaagttttgtgttaacacatttttgtgtgtcttcttcactgcagctcttacagtattctctttccacaatgtagaaacatagaggagacccagcatggcgtat

SEQ ID NO: 367891 - DNA, 140 bp, Artificial Sequence
  Synthetic
atacgccatgctgggtctcccaaaccgagtctaacaatgttgatacagaccttgttccctgataagtttgaagagttcttagacaggacccaattgcacccagagttcagggacctgacacgtacttgggagtcggccat

SEQ ID NO: 367892 - DNA, 140 bp, Artificial Sequence
  Synthetic
atggccgactcccaagtacgtgtcaggtccctgaactctgggtgcaattgggtcctgtctaagaactcttcaaacttatcagggaacaaggtctgtatcaacattgttagactcggtttgggagacccagcatggcgtat

SEQ ID NO: 367893 - DNA, 140 bp, Artificial Sequence
  Synthetic
atacgccatgctgggtctccggctaaggcgggttgctggttagagtcagttaagagttttttttacggcctaaagaacatgctcagtggcatttttggcaatgtatttataggcattttccgtacttgggagtcggccat

SEQ ID NO: 367894 - DNA, 140 bp, Artificial Sequence
  Synthetic
atggccgactcccaagtacggaaaatgcctataaatacattgccaaaaatgccactgagcatgttctttaggccgtaaaaaaaactcttaactgactctaaccagcaacccgccttagccggagacccagcatggcgtat

SEQ ID NO: 367895 - DNA, 140 bp, Artificial Sequence
  Synthetic
aggccctggctgctgatatgtaaagaacatgctcagtggcatttttggcaatgtatttataggcattttcttattccttgcccccttcatcctgttaatactattctttatgtttgggtggaccttttgggacagcggtg

SEQ ID NO: 367896 - DNA, 140 bp, Artificial Sequence
  Synthetic
caccgctgtcccaaaaggtccacccaaacataaagaatagtattaacaggatgaagggggcaaggaataagaaaatgcctataaatacattgccaaaaatgccactgagcatgttctttacatatcagcagccagggcct

SEQ ID NO: 367897 - DNA, 140 bp, Artificial Sequence
  Synthetic
atacgccatgctgggtctccttgaagcagtccctgttacagaaagaaagatgtttcctctgccagaaaccccgcttagtgaggtccactctatagagagaattatggagaacttcacccgcgtacttgggagtcggccat

SEQ ID NO: 367898 - DNA, 140 bp, Artificial Sequence
  Synthetic
atggccgactcccaagtacgcgggtgaagttctccataattctctctatagagtggacctcactaagcggggtttctggcagaggaaacatctttctttctgtaacagggactgcttcaaggagacccagcatggcgtat

SEQ ID NO: 367899 - DNA, 140 bp, Artificial Sequence
  Synthetic
atacgccatgctgggtctccagtacagacacctgaaagacgatgaagaaactggttatagaaagatcattgaaagactaaacaacaaaaaagggaaaaataaactgcttgatggtgaaagcgtacttgggagtcggccat

SEQ ID NO: 367900 - DNA, 140 bp, Artificial Sequence
  Synthetic
atggccgactcccaagtacgctttcaccatcaagcagtttatttttcccttttttgttgtttagtctttcaatgatctttctataaccagtttcttcatcgtctttcaggtgtctgtactggagacccagcatggcgtat

SEQ ID NO: 367901 - DNA, 140 bp, Artificial Sequence
  Synthetic
aggccctggctgctgatatggaaagactaaacaacaaaaaagggaaaaataaactgcttgatggtgaaagacttgctgatagaagaattgccgaactgttctctacaaaaacacacattggaccttttgggacagcggtg

SEQ ID NO: 367902 - DNA, 140 bp, Artificial Sequence
  Synthetic
caccgctgtcccaaaaggtccaatgtgtgtttttgtagagaacagttcggcaattcttctatcagcaagtctttcaccatcaagcagtttatttttcccttttttgttgtttagtctttccatatcagcagccagggcct

SEQ ID NO: 367903 - DNA, 140 bp, Artificial Sequence
  Synthetic
aggccctggctgctgatatgttgactctgctggaagatgcattcaaagaacttacttctgctcttgaaggtagattcgaagaatcttacaaaatacggactacaaggtgtaagactagcggaccttttgggacagcggtg

SEQ ID NO: 367904 - DNA, 140 bp, Artificial Sequence
  Synthetic
caccgctgtcccaaaaggtccgctagtcttacaccttgtagtccgtattttgtaagattcttcgaatctaccttcaagagcagaagtaagttctttgaatgcatcttccagcagagtcaacatatcagcagccagggcct

SEQ ID NO: 367905 - DNA, 140 bp, Artificial Sequence
  Synthetic
atacgccatgctgggtctccctctctttcaaagactacagagaaagaggtatagttgaagaaaaccacatgagattcagcgaagaggaccaacttgaaaaaagacagctgctgcttgtagcgtacttgggagtcggccat

SEQ ID NO: 367906 - DNA, 140 bp, Artificial Sequence
  Synthetic
atggccgactcccaagtacgctacaagcagcagctgtcttttttcaagttggtcctcttcgctgaatctcatgtggttttcttcaactatacctctttctctgtagtctttgaaagagagggagacccagcatggcgtat

SEQ ID NO: 367907 - DNA, 140 bp, Artificial Sequence
  Synthetic
atacgccatgctgggtctccgtagcagtcttagtctttgcgaagccatggacttcttgagaaaccttgactggactcaagtgattgctggccaatatgtgtccaaccctaggttcaacatcgtacttgggagtcggccat

SEQ ID NO: 367908 - DNA, 140 bp, Artificial Sequence
  Synthetic
atggccgactcccaagtacgatgttgaacctagggttggacacatattggccagcaatcacttgagtccagtcaaggtttctcaagaagtccatggcttcgcaaagactaagactgctacggagacccagcatggcgtat

SEQ ID NO: 367909 - DNA, 140 bp, Artificial Sequence
  Synthetic
aggccctggctgctgatatgaccacagcatagctgagttgaccatgcccaacaaaacagatcactcatatcataacatcaaacgcctgaccgagtcggcagcacggaagtattatcaagagaccttttgggacagcggtg

SEQ ID NO: 367910 - DNA, 140 bp, Artificial Sequence
  Synthetic
caccgctgtcccaaaaggtctcttgataatacttccgtgctgccgactcggtcaggcgtttgatgttatgatatgagtgatctgttttgttgggcatggtcaactcagctatgctgtggtcatatcagcagccagggcct

SEQ ID NO: 367911 - DNA, 140 bp, Artificial Sequence
  Synthetic
atacgccatgctgggtctcccataacatcaaacgcctgaccgagtcggcagcacggaagtattatcaagaggagcctgaagcaagactagttggcctgagtttagaagactatcttaagacgtacttgggagtcggccat

SEQ ID NO: 367912 - DNA, 140 bp, Artificial Sequence
  Synthetic
atggccgactcccaagtacgtcttaagatagtcttctaaactcaggccaactagtcttgcttcaggctcctcttgataatacttccgtgctgccgactcggtcaggcgtttgatgttatgggagacccagcatggcgtat

SEQ ID NO: 367913 - DNA, 140 bp, Artificial Sequence
  Synthetic
atacgccatgctgggtctcccaaagacacctgtttcaactaaggatgtttctgaaacttgggagaagatgaaagggcacatactcagtaggccaacaggcttgatgttgccaaacaacctcgtacttgggagtcggccat

SEQ ID NO: 367914 - DNA, 140 bp, Artificial Sequence
  Synthetic
atggccgactcccaagtacgaggttgtttggcaacatcaagcctgttggcctactgagtatgtgccctttcatcttctcccaagtttcagaaacatccttagttgaaacaggtgtctttgggagacccagcatggcgtat

SEQ ID NO: 367915 - DNA, 140 bp, Artificial Sequence
  Synthetic
atacgccatgctgggtctcctgaagtggaagcaggtataaagttcggagacggtgatgtgtttacagctgtgaatcttttgcattctggacagacacactttgatgcactcagaatactgcgtacttgggagtcggccat

SEQ ID NO: 367916 - DNA, 140 bp, Artificial Sequence
  Synthetic
atggccgactcccaagtacgcagtattctgagtgcatcaaagtgtgtctgtccagaatgcaaaagattcacagctgtaaacacatcaccgtctccgaactttatacctgcttccacttcaggagacccagcatggcgtat

SEQ ID NO: 367917 - DNA, 140 bp, Artificial Sequence
  Synthetic
aggccctggctgctgatatgtatagctgtggaccagttgacatcatcttctagtgatgaactgcaagattatgaagaccttgccttggcactcacaagcacagaagagtcgcacagacgggaccttttgggacagcggtg

SEQ ID NO: 367918 - DNA, 140 bp, Artificial Sequence
  Synthetic
caccgctgtcccaaaaggtcccgtctgtgcgactcttctgtgcttgtgagtgccaaggcaaggtcttcataatcttgcagttcatcactagaagatgatgtcaactggtccacagctatacatatcagcagccagggcct

SEQ ID NO: 367919 - DNA, 140 bp, Artificial Sequence
  Synthetic
atacgccatgctgggtctccatgaagaccttgccttggcactcacaagcacagaagagtcgcacagacggtcaagcttggatgaggtcacattgtctaagaaacaagcagagatactgagcgtacttgggagtcggccat

SEQ ID NO: 367920 - DNA, 140 bp, Artificial Sequence
  Synthetic
atggccgactcccaagtacgctcagtatctctgcttgtttcttagacaatgtgacctcatccaagcttgaccgtctgtgcgactcttctgtgcttgtgagtgccaaggcaaggtcttcatggagacccagcatggcgtat

SEQ ID NO: 367921 - DNA, 140 bp, Artificial Sequence
  Synthetic
atacgccatgctgggtctcccaccagtcattgtggaaactgtcatcctagtggcgttagcatcaacaacacttctaacgtggacaagaggtgtccttgtgttgaagttgtcaaccactgtcgtacttgggagtcggccat

SEQ ID NO: 367922 - DNA, 140 bp, Artificial Sequence
  Synthetic
atggccgactcccaagtacgacagtggttgacaacttcaacacaaggacacctcttgtccacgttagaagtgttgttgatgctaacgccactaggatgacagtttccacaatgactggtgggagacccagcatggcgtat

SEQ ID NO: 367923 - DNA, 140 bp, Artificial Sequence
  Synthetic
aggccctggctgctgatatgcttctaacgtggacaagaggtgtccttgtgttgaagttgtcaaccactgtgaaaacaggggctttgaggatagtaacgaatgcctaactgacttagacaggaccttttgggacagcggtg

SEQ ID NO: 367924 - DNA, 140 bp, Artificial Sequence
  Synthetic
caccgctgtcccaaaaggtcctgtctaagtcagttaggcattcgttactatcctcaaagcccctgttttcacagtggttgacaacttcaacacaaggacacctcttgtccacgttagaagcatatcagcagccagggcct

SEQ ID NO: 367925 - DNA, 140 bp, Artificial Sequence
  Synthetic
aggccctggctgctgatatgaattggtgaaatcatgtcattgcggcagctggggcataagctgctaacacgagataaacaaatcaagcaagaattctctagaatgaaactctacgtcactgaccttttgggacagcggtg

SEQ ID NO: 367926 - DNA, 140 bp, Artificial Sequence
  Synthetic
caccgctgtcccaaaaggtcagtgacgtagagtttcattctagagaattcttgcttgatttgtttatctcgtgttagcagcttatgccccagctgccgcaatgacatgatttcaccaattcatatcagcagccagggcct

SEQ ID NO: 367927 - DNA, 140 bp, Artificial Sequence
  Synthetic
atacgccatgctgggtctccagcgcaatgtagagtaccttataaaactgatgatgagtatgtcgggtatcgattgtataaaatacccaacaggacaacttatcacacacgggaaagttgccgtacttgggagtcggccat

SEQ ID NO: 367928 - DNA, 140 bp, Artificial Sequence
  Synthetic
atggccgactcccaagtacggcaactttcccgtgtgtgataagttgtcctgttgggtattttatacaatcgatacccgacatactcatcatcagttttataaggtactctacattgcgctggagacccagcatggcgtat

SEQ ID NO: 367929 - DNA, 140 bp, Artificial Sequence
  Synthetic
aggccctggctgctgatatggattgtataaaatacccaacaggacaacttatcacacacgggaaagttgctgcaaagctcaaagaaggaagcctaagagataagagtgaagagaatcagagaccttttgggacagcggtg

SEQ ID NO: 367930 - DNA, 140 bp, Artificial Sequence
  Synthetic
caccgctgtcccaaaaggtctctgattctcttcactcttatctcttaggcttccttctttgagctttgcagcaactttcccgtgtgtgataagttgtcctgttgggtattttatacaatccatatcagcagccagggcct

SEQ ID NO: 367931 - DNA, 140 bp, Artificial Sequence
  Synthetic
atacgccatgctgggtctcctactagacatctgcactgtatcacttggtgtcatgctgtcaacattcttgtatggctccaacaataaaaacaagaagaaattcatcaccaactgtctactcgtacttgggagtcggccat

SEQ ID NO: 367932 - DNA, 140 bp, Artificial Sequence
  Synthetic
atggccgactcccaagtacgagtagacagttggtgatgaatttcttcttgtttttattgttggagccatacaagaatgttgacagcatgacaccaagtgatacagtgcagatgtctagtaggagacccagcatggcgtat

SEQ ID NO: 367933 - DNA, 140 bp, Artificial Sequence
  Synthetic
atacgccatgctgggtctcccagtacagctctgtctggaaagaaggtgtacaaggttctcggtaacctaggaaatgaactgttgtataaggcacccagaaaggccttagcaactgtttgtcgtacttgggagtcggccat

SEQ ID NO: 367934 - DNA, 140 bp, Artificial Sequence
  Synthetic
atggccgactcccaagtacgacaaacagttgctaaggcctttctgggtgccttatacaacagttcatttcctaggttaccgagaaccttgtacaccttctttccagacagagctgtactgggagacccagcatggcgtat

SEQ ID NO: 367935 - DNA, 140 bp, Artificial Sequence
  Synthetic
aggccctggctgctgatatgaaacatttcgaagcagagcagatcaaagtgttctgtgccaaaatcctggctcgaaaagatactctttgacttaaaagtgcctaccaaagatgaggaagtcgaccttttgggacagcggtg

SEQ ID NO: 367936 - DNA, 140 bp, Artificial Sequence
  Synthetic
caccgctgtcccaaaaggtcgacttcctcatctttggtaggcacttttaagtcaaagagtatcttttcgagccaggattttggcacagaacactttgatctgctctgcttcgaaatgtttcatatcagcagccagggcct

SEQ ID NO: 367937 - DNA, 140 bp, Artificial Sequence
  Synthetic
aggccctggctgctgatatgcataagccctgttagcttacttgcattaagaaatctagactttgactgtctcagtgtgcaagactacaacggtatgatagagaatatgtctaagttagacgaccttttgggacagcggtg

SEQ ID NO: 367938 - DNA, 140 bp, Artificial Sequence
  Synthetic
caccgctgtcccaaaaggtcgtctaacttagacatattctctatcataccgttgtagtcttgcacactgagacagtcaaagtctagatttcttaatgcaagtaagctaacagggcttatgcatatcagcagccagggcct

SEQ ID NO: 367939 - DNA, 140 bp, Artificial Sequence
  Synthetic
atacgccatgctgggtctcctcagtgtgcaagactacaacggtatgatagagaatatgtctaagttagacaatactgatgttgagttcaaccacagggagatagctgatctcaatcaattcgtacttgggagtcggccat

SEQ ID NO: 367940 - DNA, 140 bp, Artificial Sequence
  Synthetic
atggccgactcccaagtacgaattgattgagatcagctatctccctgtggttgaactcaacatcagtattgtctaacttagacatattctctatcataccgttgtagtcttgcacactgaggagacccagcatggcgtat

SEQ ID NO: 367941 - DNA, 140 bp, Artificial Sequence
  Synthetic
aggccctggctgctgatatgatgcccacactgctaagctgaagaagaacagacagccaacacctttccaagtcgattgcatactattcaaggaagttgcagcagaatgtatgaaaaggcagaccttttgggacagcggtg

SEQ ID NO: 367942 - DNA, 140 bp, Artificial Sequence
  Synthetic
caccgctgtcccaaaaggtctgccttttcatacattctgctgcaacttccttgaatagtatgcaatcgacttggaaaggtgttggctgtctgttcttcttcagcttagcagtgtgggcatcatatcagcagccagggcct

SEQ ID NO: 367943 - DNA, 140 bp, Artificial Sequence
  Synthetic
aggccctggctgctgatatgaacagtggtttcctgaaagtgacctcacccgcaggagcactaggaatgctgcaaatgcggaggaatttgtcatatctgaatttttcaagaagaaggacatgaccttttgggacagcggtg

SEQ ID NO: 367944 - DNA, 140 bp, Artificial Sequence
  Synthetic
caccgctgtcccaaaaggtcatgtccttcttcttgaaaaattcagatatgacaaattcctccgcatttgcagcattcctagtgctcctgcgggtgaggtcactttcaggaaaccactgttcatatcagcagccagggcct

SEQ ID NO: 367945 - DNA, 140 bp, Artificial Sequence
  Synthetic
atacgccatgctgggtctccgcaaatgcggaggaatttgtcatatctgaatttttcaagaagaaggacataatgaaattcatcagcacttcaggcagagcaatgagtgcaggtaagattgcgtacttgggagtcggccat

SEQ ID NO: 367946 - DNA, 140 bp, Artificial Sequence
  Synthetic
atggccgactcccaagtacgcaatcttacctgcactcattgctctgcctgaagtgctgatgaatttcattatgtccttcttcttgaaaaattcagatatgacaaattcctccgcatttgcggagacccagcatggcgtat

SEQ ID NO: 367947 - DNA, 140 bp, Artificial Sequence
  Synthetic
aggccctggctgctgatatgatttgtgaaaccttcttgaggtgctgcacggagttcaacaggtcaggcattaagttggttaaggtaaggcattgtgacataaacctttctgttaaattgcgaccttttgggacagcggtg

SEQ ID NO: 367948 - DNA, 140 bp, Artificial Sequence
  Synthetic
caccgctgtcccaaaaggtcgcaatttaacagaaaggtttatgtcacaatgccttaccttaaccaacttaatgcctgacctgttgaactccgtgcagcacctcaagaaggtttcacaaatcatatcagcagccagggcct

SEQ ID NO: 367949 - DNA, 140 bp, Artificial Sequence
  Synthetic
aggccctggctgctgatatgaatatgacctctgaagacatctcacagctcttaatcgagattaaacgattgtatgccctacaagaagattctgaagtggagccaatagccataatttgtggaccttttgggacagcggtg

SEQ ID NO: 367950 - DNA, 140 bp, Artificial Sequence
  Synthetic
caccgctgtcccaaaaggtccacaaattatggctattggctccacttcagaatcttcttgtagggcatacaatcgtttaatctcgattaagagctgtgagatgtcttcagaggtcatattcatatcagcagccagggcct

SEQ ID NO: 367951 - DNA, 140 bp, Artificial Sequence
  Synthetic
atacgccatgctgggtctccgtatgccctacaagaagattctgaagtggagccaatagccataatttgtgatggcatagaaagcaacatgaagcagttatttgctatactgcctcccgaccgtacttgggagtcggccat

SEQ ID NO: 367952 - DNA, 140 bp, Artificial Sequence
  Synthetic
atggccgactcccaagtacggtcgggaggcagtatagcaaataactgcttcatgttgctttctatgccatcacaaattatggctattggctccacttcagaatcttcttgtagggcatacggagacccagcatggcgtat

SEQ ID NO: 367953 - DNA, 140 bp, Artificial Sequence
  Synthetic
aggccctggctgctgatatgttcatcatacctctacattgtggttacactatacattcaggtgctacagcaatatagatgtttggaagtaattaacagcgtgagtgacaaaatgctacaggaccttttgggacagcggtg

SEQ ID NO: 367954 - DNA, 140 bp, Artificial Sequence
  Synthetic
caccgctgtcccaaaaggtcctgtagcattttgtcactcacgctgttaattacttccaaacatctatattgctgtagcacctgaatgtatagtgtaaccacaatgtagaggtatgatgaacatatcagcagccagggcct

SEQ ID NO: 367955 - DNA, 140 bp, Artificial Sequence
  Synthetic
aggccctggctgctgatatgccacagcacagcttggaagcatgcactgcggctaaaaggaactgcgtacgaaggtctgtttgcaaactgttatggctggcaatacattccagaggacattgaccttttgggacagcggtg

SEQ ID NO: 367956 - DNA, 140 bp, Artificial Sequence
  Synthetic
caccgctgtcccaaaaggtcaatgtcctctggaatgtattgccagccataacagtttgcaaacagaccttcgtacgcagttccttttagccgcagtgcatgcttccaagctgtgctgtggcatatcagcagccagggcct

SEQ ID NO: 367957 - DNA, 140 bp, Artificial Sequence
  Synthetic
atacgccatgctgggtctcctactgccaccttagagggtagatttgaagcatcatacaagatacgctctgcaaggtgtaaagcaagtggaaacttcctaaataggagcagtagggaccaccgtacttgggagtcggccat

SEQ ID NO: 367958 - DNA, 140 bp, Artificial Sequence
  Synthetic
atggccgactcccaagtacggtggtccctactgctcctatttaggaagtttccacttgctttacaccttgcagagcgtatcttgtatgatgcttcaaatctaccctctaaggtggcagtaggagacccagcatggcgtat

SEQ ID NO: 367959 - DNA, 140 bp, Artificial Sequence
  Synthetic
aggccctggctgctgatatgcaaggtgtaaagcaagtggaaacttcctaaataggagcagtagggaccacttcattagtgtcttttctgggctgaacctagtttacggcttcctcatgaagaccttttgggacagcggtg

SEQ ID NO: 367960 - DNA, 140 bp, Artificial Sequence
  Synthetic
caccgctgtcccaaaaggtcttcatgaggaagccgtaaactaggttcagcccagaaaagacactaatgaagtggtccctactgctcctatttaggaagtttccacttgctttacaccttgcatatcagcagccagggcct

SEQ ID NO: 367961 - DNA, 140 bp, Artificial Sequence
  Synthetic
aggccctggctgctgatatgggatttcctggacagaacccagttgcatccagagttcagagatctaactcctgacttttcactcacacaaaaggttcacttcaagagaaatcagatacccgaccttttgggacagcggtg

SEQ ID NO: 367962 - DNA, 140 bp, Artificial Sequence
  Synthetic
caccgctgtcccaaaaggtcgggtatctgatttctcttgaagtgaaccttttgtgtgagtgaaaagtcaggagttagatctctgaactctggatgcaactgggttctgtccaggaaatcccatatcagcagccagggcct

SEQ ID NO: 367963 - DNA, 140 bp, Artificial Sequence
  Synthetic
atacgccatgctgggtctccctgacttttcactcacacaaaaggttcacttcaagagaaatcagatacccagtgtcgaaaatgtacaaatctctattgatgcaacactgcctgaatctgtcgtacttgggagtcggccat

SEQ ID NO: 367964 - DNA, 140 bp, Artificial Sequence
  Synthetic
atggccgactcccaagtacgacagattcaggcagtgttgcatcaatagagatttgtacattttcgacactgggtatctgatttctcttgaagtgaaccttttgtgtgagtgaaaagtcagggagacccagcatggcgtat

SEQ ID NO: 367965 - DNA, 140 bp, Artificial Sequence
  Synthetic
atacgccatgctgggtctccttagattcggtatgctcgcagggctcagcagacttgtttgtccaggtgagcttggaaagaagttctcaacaagttgcagaagaatcgaggacaacattgccgtacttgggagtcggccat

SEQ ID NO: 367966 - DNA, 140 bp, Artificial Sequence
  Synthetic
atggccgactcccaagtacggcaatgttgtcctcgattcttctgcaacttgttgagaacttctttccaagctcacctggacaaacaagtctgctgagccctgcgagcataccgaatctaaggagacccagcatggcgtat

SEQ ID NO: 367967 - DNA, 140 bp, Artificial Sequence
  Synthetic
aggccctggctgctgatatgcttggaaagaagttctcaacaagttgcagaagaatcgaggacaacattgctaggctatacttacaaacaactgtctactgttcggttagggatgtggagggaccttttgggacagcggtg

SEQ ID NO: 367968 - DNA, 140 bp, Artificial Sequence
  Synthetic
caccgctgtcccaaaaggtccctccacatccctaaccgaacagtagacagttgtttgtaagtatagcctagcaatgttgtcctcgattcttctgcaacttgttgagaacttctttccaagcatatcagcagccagggcct

SEQ ID NO: 367969 - DNA, 140 bp, Artificial Sequence
  Synthetic
aggccctggctgctgatatgcgctaagtgaggtgcattcaatagagcgtataatggagaattttacccgcctcatgcatggagaaaaactttctgccaagaaaaaagatggagatctggcgaccttttgggacagcggtg

SEQ ID NO: 367970 - DNA, 140 bp, Artificial Sequence
  Synthetic
caccgctgtcccaaaaggtcgccagatctccatcttttttcttggcagaaagtttttctccatgcatgaggcgggtaaaattctccattatacgctctattgaatgcacctcacttagcgcatatcagcagccagggcct

SEQ ID NO: 367971 - DNA, 140 bp, Artificial Sequence
  Synthetic
atacgccatgctgggtctccctcatgcatggagaaaaactttctgccaagaaaaaagatggagatctggcggaacaaggcagcaagcagagcaccactgaacacgagagctctagcatctcgtacttgggagtcggccat

SEQ ID NO: 367972 - DNA, 140 bp, Artificial Sequence
  Synthetic
atggccgactcccaagtacgagatgctagagctctcgtgttcagtggtgctctgcttgctgccttgttccgccagatctccatcttttttcttggcagaaagtttttctccatgcatgagggagacccagcatggcgtat

SEQ ID NO: 367973 - DNA, 140 bp, Artificial Sequence
  Synthetic
atacgccatgctgggtctccccctgctttactgtttatggcactttcgtcaacagtgacaggcagctaatatttgacatctacaatgtgcatatttacaacaaggaaatggacaacttcgcgtacttgggagtcggccat

SEQ ID NO: 367974 - DNA, 140 bp, Artificial Sequence
  Synthetic
atggccgactcccaagtacgcgaagttgtccatttccttgttgtaaatatgcacattgtagatgtcaaatattagctgcctgtcactgttgacgaaagtgccataaacagtaaagcagggggagacccagcatggcgtat

SEQ ID NO: 367975 - DNA, 140 bp, Artificial Sequence
  Synthetic
aggccctggctgctgatatgatttgacatctacaatgtgcatatttacaacaaggaaatggacaacttcgatgagggatgtatcagtgtcctagaagaaactgctgaaagacacatgctcgaccttttgggacagcggtg

SEQ ID NO: 367976 - DNA, 140 bp, Artificial Sequence
  Synthetic
caccgctgtcccaaaaggtcgagcatgtgtctttcagcagtttcttctaggacactgatacatccctcatcgaagttgtccatttccttgttgtaaatatgcacattgtagatgtcaaatcatatcagcagccagggcct

SEQ ID NO: 367977 - DNA, 140 bp, Artificial Sequence
  Synthetic
aggccctggctgctgatatgaggtttagtgaagaggaccagttagaaacaaggcagctgttgctggtggaagttggttttcaaactgacattgatgggaaaataaggacagaccataagagaccttttgggacagcggtg

SEQ ID NO: 367978 - DNA, 140 bp, Artificial Sequence
  Synthetic
caccgctgtcccaaaaggtctcttatggtctgtccttattttcccatcaatgtcagtttgaaaaccaacttccaccagcaacagctgccttgtttctaactggtcctcttcactaaacctcatatcagcagccagggcct

SEQ ID NO: 367979 - DNA, 140 bp, Artificial Sequence
  Synthetic
atacgccatgctgggtctccagttggttttcaaactgacattgatgggaaaataaggacagaccataagaagtggaaagatatattaaagctgttggagttactgggaatcaagtgctcacgtacttgggagtcggccat

SEQ ID NO: 367980 - DNA, 140 bp, Artificial Sequence
  Synthetic
atggccgactcccaagtacgtgagcacttgattcccagtaactccaacagctttaatatatctttccacttcttatggtctgtccttattttcccatcaatgtcagtttgaaaaccaactggagacccagcatggcgtat

SEQ ID NO: 367981 - DNA, 140 bp, Artificial Sequence
  Synthetic
atacgccatgctgggtctccgagaactgcaaggttgctgttaggttgccctaatgttagaaaggctgcaaacaaggaagggaaaaggttgatgaagttgagtgatgacgcgtccactgaccgtacttgggagtcggccat

SEQ ID NO: 367982 - DNA, 140 bp, Artificial Sequence
  Synthetic
atggccgactcccaagtacggtcagtggacgcgtcatcactcaacttcatcaaccttttcccttccttgtttgcagcctttctaacattagggcaacctaacagcaaccttgcagttctcggagacccagcatggcgtat

SEQ ID NO: 367983 - DNA, 140 bp, Artificial Sequence
  Synthetic
aggccctggctgctgatatgacaaggaagggaaaaggttgatgaagttgagtgatgacgcgtccactgacacaaacagcgttgcttcagaggtgtcagataggaggtcttatagctcaaggaccttttgggacagcggtg

SEQ ID NO: 367984 - DNA, 140 bp, Artificial Sequence
  Synthetic
caccgctgtcccaaaaggtccttgagctataagacctcctatctgacacctctgaagcaacgctgtttgtgtcagtggacgcgtcatcactcaacttcatcaaccttttcccttccttgtcatatcagcagccagggcct

SEQ ID NO: 367985 - DNA, 140 bp, Artificial Sequence
  Synthetic
atacgccatgctgggtctcccctttgaactaagatcaggtctcgaggtgttcaacgacccgtttaatgactatcaacaagcaataactgacgtgtgtcagttctctgagtacactcccagcgtacttgggagtcggccat

SEQ ID NO: 367986 - DNA, 140 bp, Artificial Sequence
  Synthetic
atggccgactcccaagtacgctgggagtgtactcagagaactgacacacgtcagttattgcttgttgatagtcattaaacgggtcgttgaacacctcgagacctgatcttagttcaaaggggagacccagcatggcgtat

SEQ ID NO: 367987 - DNA, 140 bp, Artificial Sequence
  Synthetic
aggccctggctgctgatatgtatcaacaagcaataactgacgtgtgtcagttctctgagtacactcccagcaaagacagtgttttaaaagattgcctccaaatcatacgaaagaatcctagaccttttgggacagcggtg

SEQ ID NO: 367988 - DNA, 140 bp, Artificial Sequence
  Synthetic
caccgctgtcccaaaaggtctaggattctttcgtatgatttggaggcaatcttttaaaacactgtctttgctgggagtgtactcagagaactgacacacgtcagttattgcttgttgatacatatcagcagccagggcct

SEQ ID NO: 367989 - DNA, 140 bp, Artificial Sequence
  Synthetic
atacgccatgctgggtctccaagtgctctcttggatgagcaagaggaggactgaggtattaaccaaagaacagcaccaattatttctgagtcttcttccacagtcacatgaatgtttacacgtacttgggagtcggccat

SEQ ID NO: 367990 - DNA, 140 bp, Artificial Sequence
  Synthetic
atggccgactcccaagtacgtgtaaacattcatgtgactgtggaagaagactcagaaataattggtgctgttctttggttaatacctcagtcctcctcttgctcatccaagagagcacttggagacccagcatggcgtat

SEQ ID NO: 367991 - DNA, 140 bp, Artificial Sequence
  Synthetic
aggccctggctgctgatatggaacaggcaatgcgcaaaggactagtcgaaggtgtggtcatctctaaggaaggttccgaatcatgcattaacatgttgaaagagaacttggaccgaataagaccttttgggacagcggtg

SEQ ID NO: 367992 - DNA, 140 bp, Artificial Sequence
  Synthetic
caccgctgtcccaaaaggtcttattcggtccaagttctctttcaacatgttaatgcatgattcggaaccttccttagagatgaccacaccttcgactagtcctttgcgcattgcctgttccatatcagcagccagggcct

SEQ ID NO: 367993 - DNA, 140 bp, Artificial Sequence
  Synthetic
atacgccatgctgggtctcctggaggcagtgccggtgacagaaagaaaaatgttccctctgcctgaaactccgctgagtgaggtgcattcaatagagcgcattatggaaaatttttcccgcgtacttgggagtcggccat

SEQ ID NO: 367994 - DNA, 140 bp, Artificial Sequence
  Synthetic
atggccgactcccaagtacgcgggaaaaattttccataatgcgctctattgaatgcacctcactcagcggagtttcaggcagagggaacatttttctttctgtcaccggcactgcctccaggagacccagcatggcgtat

SEQ ID NO: 367995 - DNA, 140 bp, Artificial Sequence
  Synthetic
aggccctggctgctgatatgaaattgggttagcatatctgaagtcacagagacaacaagcatagttgcttcaccaaaaacacacatgatgttgaaagattgctttaaaattatccttggagaccttttgggacagcggtg

SEQ ID NO: 367996 - DNA, 140 bp, Artificial Sequence
  Synthetic
caccgctgtcccaaaaggtctccaaggataattttaaagcaatctttcaacatcatgtgtgtttttggtgaagcaactatgcttgttgtctctgtgacttcagatatgctaacccaatttcatatcagcagccagggcct

SEQ ID NO: 367997 - DNA, 140 bp, Artificial Sequence
  Synthetic
aggccctggctgctgatatgatcgagatgtgttgagtgcctcacaaatataaagaaaaccgttgatgaaactaccaacctgtcagaaaagattgagctgcttgcttataatctccaactcgaccttttgggacagcggtg

SEQ ID NO: 367998 - DNA, 140 bp, Artificial Sequence
  Synthetic
caccgctgtcccaaaaggtcgagttggagattataagcaagcagctcaatcttttctgacaggttggtagtttcatcaacggttttctttatatttgtgaggcactcaacacatctcgatcatatcagcagccagggcct

SEQ ID NO: 367999 - DNA, 140 bp, Artificial Sequence
  Synthetic
atacgccatgctgggtctccaggtgccatctctacaaacgttgaaattgggaaaagggactgtctagaccttcttagcactgtagatggtttgacggatcagcagaaggagaacattgtgcgtacttgggagtcggccat

SEQ ID NO: 368000 - DNA, 140 bp, Artificial Sequence
  Synthetic
atggccgactcccaagtacgcacaatgttctccttctgctgatccgtcaaaccatctacagtgctaagaaggtctagacagtcccttttcccaatttcaacgtttgtagagatggcacctggagacccagcatggcgtat

SEQ ID NO: 368001 - DNA, 140 bp, Artificial Sequence
  Synthetic
aggccctggctgctgatatgttcttagcactgtagatggtttgacggatcagcagaaggagaacattgtgaacggcatttttgagccttctaagctatccttttaccactggaaagaattgaccttttgggacagcggtg

SEQ ID NO: 368002 - DNA, 140 bp, Artificial Sequence
  Synthetic
caccgctgtcccaaaaggtcaattctttccagtggtaaaaggatagcttagaaggctcaaaaatgccgttcacaatgttctccttctgctgatccgtcaaaccatctacagtgctaagaacatatcagcagccagggcct

SEQ ID NO: 368003 - DNA, 140 bp, Artificial Sequence
  Synthetic
aggccctggctgctgatatgatcaaatgtgtgcaagagatgccccaagatagaaatggtcagccactgtgaaaataaaggctttgaggacagcaatgaatgcttaacagacctagatagggaccttttgggacagcggtg

SEQ ID NO: 368004 - DNA, 140 bp, Artificial Sequence
  Synthetic
caccgctgtcccaaaaggtccctatctaggtctgttaagcattcattgctgtcctcaaagcctttattttcacagtggctgaccatttctatcttggggcatctcttgcacacatttgatcatatcagcagccagggcct

SEQ ID NO: 368005 - DNA, 140 bp, Artificial Sequence
  Synthetic
atacgccatgctgggtctcctcttctgttggctaaagacagtgtcatcatcagtcaaaggcagcctgaagaagaaactaaaattcatgaacatacattcccctgagctcatgcccgacaacgtacttgggagtcggccat

SEQ ID NO: 368006 - DNA, 140 bp, Artificial Sequence
  Synthetic
atggccgactcccaagtacgttgtcgggcatgagctcaggggaatgtatgttcatgaattttagtttcttcttcaggctgcctttgactgatgatgacactgtctttagccaacagaagaggagacccagcatggcgtat

SEQ ID NO: 368007 - DNA, 140 bp, Artificial Sequence
  Synthetic
aggccctggctgctgatatgacgtaatgtggaatatcttataaaactaatgatgagcatgtcaggcattgattgtataaaatatcccacaggacagcttatcacccatggaagagtgagtgaccttttgggacagcggtg

SEQ ID NO: 368008 - DNA, 140 bp, Artificial Sequence
  Synthetic
caccgctgtcccaaaaggtcactcactcttccatgggtgataagctgtcctgtgggatattttatacaatcaatgcctgacatgctcatcattagttttataagatattccacattacgtcatatcagcagccagggcct

SEQ ID NO: 368009 - DNA, 140 bp, Artificial Sequence
  Synthetic
atacgccatgctgggtctccatttctgcctggaccaagagcataacaacttgcaaggactttgcaaacataaatgacagggtgcaaaaattcatacaccaactttctgaggaactctacgcgtacttgggagtcggccat

SEQ ID NO: 368010 - DNA, 140 bp, Artificial Sequence
  Synthetic
atggccgactcccaagtacgcgtagagttcctcagaaagttggtgtatgaatttttgcaccctgtcatttatgtttgcaaagtccttgcaagttgttatgctcttggtccaggcagaaatggagacccagcatggcgtat

SEQ ID NO: 368011 - DNA, 140 bp, Artificial Sequence
  Synthetic
aggccctggctgctgatatgtgaaagattattcaacttatgcaagaggagtgatctcaaattcattaaaaaacctctcaaggcaaggtaaatcaaagtgttctgtgccaagatcttggctgaccttttgggacagcggtg

SEQ ID NO: 368012 - DNA, 140 bp, Artificial Sequence
  Synthetic
caccgctgtcccaaaaggtcagccaagatcttggcacagaacactttgatttaccttgccttgagaggttttttaatgaatttgagatcactcctcttgcataagttgaataatctttcacatatcagcagccagggcct

SEQ ID NO: 368013 - DNA, 140 bp, Artificial Sequence
  Synthetic
aggccctggctgctgatatgttgtgacctagactactactgcaacatgggagattggccttcctgcacatacacaggggtcacccaacacaatcatgcttcatttgtaaacttactcaacgaccttttgggacagcggtg

SEQ ID NO: 368014 - DNA, 140 bp, Artificial Sequence
  Synthetic
caccgctgtcccaaaaggtcgttgagtaagtttacaaatgaagcatgattgtgttgggtgacccctgtgtatgtgcaggaaggccaatctcccatgttgcagtagtagtctaggtcacaacatatcagcagccagggcct

SEQ ID NO: 368015 - DNA, 140 bp, Artificial Sequence
  Synthetic
atacgccatgctgggtctcctttccttaagcaacataatcttgaagtaatggagacagtcaacctcattttttttgcagcattgtcagccccttggtgtcttcactataaggcactagaacgtacttgggagtcggccat

SEQ ID NO: 368016 - DNA, 140 bp, Artificial Sequence
  Synthetic
atggccgactcccaagtacgttctagtgccttatagtgaagacaccaaggggctgacaatgctgcaaaaaaaatgaggttgactgtctccattacttcaagattatgttgcttaaggaaaggagacccagcatggcgtat

SEQ ID NO: 368017 - DNA, 140 bp, Artificial Sequence
  Synthetic
aggccctggctgctgatatgtttttgcagcattgtcagccccttggtgtcttcactataaggcactagaatcttacctggtcagacatccagaaatacttgactgtgggctgaaagaagagaccttttgggacagcggtg

SEQ ID NO: 368018 - DNA, 140 bp, Artificial Sequence
  Synthetic
caccgctgtcccaaaaggtctcttctttcagcccacagtcaagtatttctggatgtctgaccaggtaagattctagtgccttatagtgaagacaccaaggggctgacaatgctgcaaaaacatatcagcagccagggcct

SEQ ID NO: 368019 - DNA, 140 bp, Artificial Sequence
  Synthetic
atacgccatgctgggtctcctgtaccgaagagatggtgaagaattagtgcaaaactccggtttaaagattgggtttctggtgaagtatgctgtcacattgttcacatcaaacggcgagcccgtacttgggagtcggccat

SEQ ID NO: 368020 - DNA, 140 bp, Artificial Sequence
  Synthetic
atggccgactcccaagtacgggctcgccgtttgatgtgaacaatgtgacagcatacttcaccagaaacccaatctttaaaccggagttttgcactaattcttcaccatctcttcggtacaggagacccagcatggcgtat

SEQ ID NO: 368021 - DNA, 140 bp, Artificial Sequence
  Synthetic
aggccctggctgctgatatgtgtgttaacaaggtttacctggtttcaggaggtggtactatatggcaaaatatgtgagaccttcctgagatgctgtacagaatttaatagatcaggggtcgaccttttgggacagcggtg

SEQ ID NO: 368022 - DNA, 140 bp, Artificial Sequence
  Synthetic
caccgctgtcccaaaaggtcgacccctgatctattaaattctgtacagcatctcaggaaggtctcacatattttgccatatagtaccacctcctgaaaccaggtaaaccttgttaacacacatatcagcagccagggcct

SEQ ID NO: 368023 - DNA, 140 bp, Artificial Sequence
  Synthetic
aggccctggctgctgatatggcaagttgctggttagagtcagttaagagttttttttatggtctgaagaatatgcttagtggcatttttggcaatgtttttttaggcattttctcatttcgaccttttgggacagcggtg

SEQ ID NO: 368024 - DNA, 140 bp, Artificial Sequence
  Synthetic
caccgctgtcccaaaaggtcgaaatgagaaaatgcctaaaaaaacattgccaaaaatgccactaagcatattcttcagaccataaaaaaaactcttaactgactctaaccagcaacttgccatatcagcagccagggcct

SEQ ID NO: 368025 - DNA, 140 bp, Artificial Sequence
  Synthetic
atacgccatgctgggtctccggcttatcaggaaatggatatgatttcatctggacaactcaaatgattgcaaatagcaatttcaacgtttgtaagaggttgacaggcaggagtaccggagcgtacttgggagtcggccat

SEQ ID NO: 368026 - DNA, 140 bp, Artificial Sequence
  Synthetic
atggccgactcccaagtacgctccggtactcctgcctgtcaacctcttacaaacgttgaaattgctatttgcaatcatttgagttgtccagatgaaatcatatccatttcctgataagccggagacccagcatggcgtat

SEQ ID NO: 368027 - DNA, 140 bp, Artificial Sequence
  Synthetic
aggccctggctgctgatatgaaatagcaatttcaacgtttgtaagaggttgacaggcaggagtaccggagaaagactcccaagaagtgttaggagcaaagtcatttacgaaatggtaaaggaccttttgggacagcggtg

SEQ ID NO: 368028 - DNA, 140 bp, Artificial Sequence
  Synthetic
caccgctgtcccaaaaggtcctttaccatttcgtaaatgactttgctcctaacacttcttgggagtctttctccggtactcctgcctgtcaacctcttacaaacgttgaaattgctatttcatatcagcagccagggcct

SEQ ID NO: 368029 - DNA, 140 bp, Artificial Sequence
  Synthetic
aggccctggctgctgatatgtcttcatacctttacattgtcattacactttatatacaagtgctgcaacagtatagatgtctggaagtcataaacagtgtaaatgaaaaaacattgcaaggaccttttgggacagcggtg

SEQ ID NO: 368030 - DNA, 140 bp, Artificial Sequence
  Synthetic
caccgctgtcccaaaaggtccttgcaatgttttttcatttacactgtttatgacttccagacatctatactgttgcagcacttgtatataaagtgtaatgacaatgtaaaggtatgaagacatatcagcagccagggcct

SEQ ID NO: 368031 - DNA, 140 bp, Artificial Sequence
  Synthetic
atacgccatgctgggtctccagcgcttaattacgaacatcgcttttatgcagtgctggcaccaaaagcacagttgggtggtgcaagagacttgttggtgcaggagactggtacaaaagtccgtacttgggagtcggccat

SEQ ID NO: 368032 - DNA, 140 bp, Artificial Sequence
  Synthetic
atggccgactcccaagtacggacttttgtaccagtctcctgcaccaacaagtctcttgcaccacccaactgtgcttttggtgccagcactgcataaaagcgatgttcgtaattaagcgctggagacccagcatggcgtat

SEQ ID NO: 368033 - DNA, 140 bp, Artificial Sequence
  Synthetic
aggccctggctgctgatatgacttttgctcttgaaggtaggtttgaagagtcttataaaatacgaacctcaaggtgcagaaccagcgggaattttctgaatagaagcagtagagaccactgaccttttgggacagcggtg

SEQ ID NO: 368034 - DNA, 140 bp, Artificial Sequence
  Synthetic
caccgctgtcccaaaaggtcagtggtctctactgcttctattcagaaaattcccgctggttctgcaccttgaggttcgtattttataagactcttcaaacctaccttcaagagcaaaagtcatatcagcagccagggcct

SEQ ID NO: 368035 - DNA, 140 bp, Artificial Sequence
  Synthetic
aggccctggctgctgatatggaggcttagtgaagaagatcaactagaaacaaggcagctgctgttggtggaagttggttttcaaactgatatcgatgggaaaataaggacagaccacaaggaccttttgggacagcggtg

SEQ ID NO: 368036 - DNA, 140 bp, Artificial Sequence
  Synthetic
caccgctgtcccaaaaggtccttgtggtctgtccttattttcccatcgatatcagtttgaaaaccaacttccaccaacagcagctgccttgtttctagttgatcttcttcactaagcctccatatcagcagccagggcct

SEQ ID NO: 368037 - DNA, 140 bp, Artificial Sequence
  Synthetic
aggccctggctgctgatatggacaacttactagctaactctcagcaacagaacaaacaactacagatgcttcgctttggcatgcttgcagggcttagtaggctcgtttgtcctaatgagcgaccttttgggacagcggtg

SEQ ID NO: 368038 - DNA, 140 bp, Artificial Sequence
  Synthetic
caccgctgtcccaaaaggtcgctcattaggacaaacgagcctactaagccctgcaagcatgccaaagcgaagcatctgtagttgtttgttctgttgctgagagttagctagtaagttgtccatatcagcagccagggcct

SEQ ID NO: 368039 - DNA, 140 bp, Artificial Sequence
  Synthetic
aggccctggctgctgatatggaaggtagcaatctagttaatttctacaaagttatttgcatctccggagataacaccaagtggggcccaatacactgctgttccttcttttctggtatgagaccttttgggacagcggtg

SEQ ID NO: 368040 - DNA, 140 bp, Artificial Sequence
  Synthetic
caccgctgtcccaaaaggtctcataccagaaaagaaggaacagcagtgtattgggccccacttggtgttatctccggagatgcaaataactttgtagaaattaactagattgctaccttccatatcagcagccagggcct

SEQ ID NO: 368041 - DNA, 140 bp, Artificial Sequence
  Synthetic
aggccctggctgctgatatgaggctttatctacaaacatccatatattgttcagttagggatgtggaagacaatgttaaacactggaaacaaagagacctatgtcctgaagtgaccattcgaccttttgggacagcggtg

SEQ ID NO: 368042 - DNA, 140 bp, Artificial Sequence
  Synthetic
caccgctgtcccaaaaggtcgaatggtcacttcaggacataggtctctttgtttccagtgtttaacattgtcttccacatccctaactgaacaatatatggatgtttgtagataaagcctcatatcagcagccagggcct

SEQ ID NO: 368043 - DNA, 140 bp, Artificial Sequence
  Synthetic
atacgccatgctgggtctccgtttttataaagaatttatgcagacaggtagaaatacctgctggtagcatcaagaagattttaaacgtgcttagatacaagttgtgttctaagggaggcgcgtacttgggagtcggccat

SEQ ID NO: 368044 - DNA, 140 bp, Artificial Sequence
  Synthetic
atggccgactcccaagtacgcgcctcccttagaacacaacttgtatctaagcacgtttaaaatcttcttgatgctaccagcaggtatttctacctgtctgcataaattctttataaaaacggagacccagcatggcgtat

SEQ ID NO: 368045 - DNA, 140 bp, Artificial Sequence
  Synthetic
aggccctggctgctgatatgcaagaagattttaaacgtgcttagatacaagttgtgttctaagggaggcgtagagcagcatagtgaagaagacctgaggaagctgctgacagacaatctggaccttttgggacagcggtg

SEQ ID NO: 368046 - DNA, 140 bp, Artificial Sequence
  Synthetic
caccgctgtcccaaaaggtccagattgtctgtcagcagcttcctcaggtcttcttcactatgctgctctacgcctcccttagaacacaacttgtatctaagcacgtttaaaatcttcttgcatatcagcagccagggcct

SEQ ID NO: 368047 - DNA, 140 bp, Artificial Sequence
  Synthetic
atacgccatgctgggtctcctgaaggatgtatcagcgtcttggaagaaacagcagaaaggcacatgctttgggaacttgatttgatgaattcactttgttctgacgaaaaaagggatactcgtacttgggagtcggccat

SEQ ID NO: 368048 - DNA, 140 bp, Artificial Sequence
  Synthetic
atggccgactcccaagtacgagtatcccttttttcgtcagaacaaagtgaattcatcaaatcaagttcccaaagcatgtgcctttctgctgtttcttccaagacgctgatacatccttcaggagacccagcatggcgtat

SEQ ID NO: 368049 - DNA, 140 bp, Artificial Sequence
  Synthetic
atacgccatgctgggtctccaagcaagggactcatggcgcttaatagctacaatcacatgggacaaggaatccatcatgcaacatcatcagtgttgacttctttagcagcagtactattccgtacttgggagtcggccat

SEQ ID NO: 368050 - DNA, 140 bp, Artificial Sequence
  Synthetic
atggccgactcccaagtacggaatagtactgctgctaaagaagtcaacactgatgatgttgcatgatggattccttgtcccatgtgattgtagctattaagcgccatgagtcccttgcttggagacccagcatggcgtat

SEQ ID NO: 368051 - DNA, 140 bp, Artificial Sequence
  Synthetic
aggccctggctgctgatatgtccatcatgcaacatcatcagtgttgacttctttagcagcagtactattcgaagagttaaccatctactaccttaagagaagcatgcctcaaacaaccatgaccttttgggacagcggtg

SEQ ID NO: 368052 - DNA, 140 bp, Artificial Sequence
  Synthetic
caccgctgtcccaaaaggtcatggttgtttgaggcatgcttctcttaaggtagtagatggttaactcttcgaatagtactgctgctaaagaagtcaacactgatgatgttgcatgatggacatatcagcagccagggcct

SEQ ID NO: 368053 - DNA, 140 bp, Artificial Sequence
  Synthetic
aggccctggctgctgatatgcaaagaagggaagaagctgttgaagttaaatagcgacacatccacagatacacagagcattgcttctgaggtgtcagatagaagatcctacagctcaagtgaccttttgggacagcggtg

SEQ ID NO: 368054 - DNA, 140 bp, Artificial Sequence
  Synthetic
caccgctgtcccaaaaggtcacttgagctgtaggatcttctatctgacacctcagaagcaatgctctgtgtatctgtggatgtgtcgctatttaacttcaacagcttcttcccttctttgcatatcagcagccagggcct

SEQ ID NO: 368055 - DNA, 140 bp, Artificial Sequence
  Synthetic
atacgccatgctgggtctcccacagagcattgcttctgaggtgtcagatagaagatcctacagctcaagtaagagcagaatccgtagtatctttggaagatataactctcagaagaaacccgtacttgggagtcggccat

SEQ ID NO: 368056 - DNA, 140 bp, Artificial Sequence
  Synthetic
atggccgactcccaagtacgggtttcttctgagagttatatcttccaaagatactacggattctgctcttacttgagctgtaggatcttctatctgacacctcagaagcaatgctctgtgggagacccagcatggcgtat

SEQ ID NO: 368057 - DNA, 140 bp, Artificial Sequence
  Synthetic
atacgccatgctgggtctcctgacaggtattctgtcaaaagacctttatgcgcaatatgatgaaacgttctggaaacatgcatgcaggttgaagaatttcacagcggcagtacaaaggtgcgtacttgggagtcggccat

SEQ ID NO: 368058 - DNA, 140 bp, Artificial Sequence
  Synthetic
atggccgactcccaagtacgcacctttgtactgccgctgtgaaattcttcaacctgcatgcatgtttccagaacgtttcatcatattgcgcataaaggtcttttgacagaatacctgtcaggagacccagcatggcgtat

SEQ ID NO: 368059 - DNA, 140 bp, Artificial Sequence
  Synthetic
aggccctggctgctgatatgtggaaacatgcatgcaggttgaagaatttcacagcggcagtacaaaggtgctgccaaatgaaagacagtgccaaaaccttagtaagtgactgctttcttggaccttttgggacagcggtg

SEQ ID NO: 368060 - DNA, 140 bp, Artificial Sequence
  Synthetic
caccgctgtcccaaaaggtccaagaaagcagtcacttactaaggttttggcactgtctttcatttggcagcacctttgtactgccgctgtgaaattcttcaacctgcatgcatgtttccacatatcagcagccagggcct

SEQ ID NO: 368061 - DNA, 140 bp, Artificial Sequence
  Synthetic
aggccctggctgctgatatgatcagcaggcaataacagacatctgtcaattttctgaatacacaccaaacaaagaaagcatcttgaaagactgtcttcaaatcatccggaaaaaccctaggaccttttgggacagcggtg

SEQ ID NO: 368062 - DNA, 140 bp, Artificial Sequence
  Synthetic
caccgctgtcccaaaaggtcctagggtttttccggatgatttgaagacagtctttcaagatgctttctttgtttggtgtgtattcagaaaattgacagatgtctgttattgcctgctgatcatatcagcagccagggcct

SEQ ID NO: 368063 - DNA, 140 bp, Artificial Sequence
  Synthetic
atacgccatgctgggtctccaaagaaagcatcttgaaagactgtcttcaaatcatccggaaaaaccctagccacacaatgggttcttttgagctaatccaagcaatctcagagttcggcacgtacttgggagtcggccat

SEQ ID NO: 368064 - DNA, 140 bp, Artificial Sequence
  Synthetic
atggccgactcccaagtacgtgccgaactctgagattgcttggattagctcaaaagaacccattgtgtggctagggtttttccggatgatttgaagacagtctttcaagatgctttctttggagacccagcatggcgtat

SEQ ID NO: 368065 - DNA, 140 bp, Artificial Sequence
  Synthetic
atacgccatgctgggtctccaaattcatattcacgggacttataaatagctcagtaacttctccacaaagtctaatgcaagcatgtcatgtttcctctcagcaggcaatgtacaacagtgcgtacttgggagtcggccat

SEQ ID NO: 368066 - DNA, 140 bp, Artificial Sequence
  Synthetic
atggccgactcccaagtacgcactgttgtacattgcctgctgagaggaaacatgacatgcttgcattagactttgtggagaagttactgagctatttataagtcccgtgaatatgaatttggagacccagcatggcgtat

SEQ ID NO: 368067 - DNA, 140 bp, Artificial Sequence
  Synthetic
aggccctggctgctgatatgtctaatgcaagcatgtcatgtttcctctcagcaggcaatgtacaacagtgttcctcttataacaaacactgcctttacactacttaggcaacagattttcgaccttttgggacagcggtg

SEQ ID NO: 368068 - DNA, 140 bp, Artificial Sequence
  Synthetic
caccgctgtcccaaaaggtcgaaaatctgttgcctaagtagtgtaaaggcagtgtttgttataagaggaacactgttgtacattgcctgctgagaggaaacatgacatgcttgcattagacatatcagcagccagggcct

SEQ ID NO: 368069 - DNA, 140 bp, Artificial Sequence
  Synthetic
atacgccatgctgggtctccgacactatcccctttcggtagactgttcgtcccaacatactcaggtctggttagctcagctgttgctcttgaggatgctgaggtcattgccagagcagcacgtacttgggagtcggccat

SEQ ID NO: 368070 - DNA, 140 bp, Artificial Sequence
  Synthetic
atggccgactcccaagtacgtgctgctctggcaatgacctcagcatcctcaagagcaacagctgagctaaccagacctgagtatgttgggacgaacagtctaccgaaaggggatagtgtcggagacccagcatggcgtat

SEQ ID NO: 368071 - DNA, 140 bp, Artificial Sequence
  Synthetic
aggccctggctgctgatatgttagctcagctgttgctcttgaggatgctgaggtcattgccagagcagcacaaactctcagcatgaacagtgtatcgatccagtcaagtagtttgaccacgaccttttgggacagcggtg

SEQ ID NO: 368072 - DNA, 140 bp, Artificial Sequence
  Synthetic
caccgctgtcccaaaaggtcgtggtcaaactacttgactggatcgatacactgttcatgctgagagtttgtgctgctctggcaatgacctcagcatcctcaagagcaacagctgagctaacatatcagcagccagggcct

SEQ ID NO: 368073 - DNA, 140 bp, Artificial Sequence
  Synthetic
aggccctggctgctgatatgacggaatatttgaaccctcgaagttgtccttctaccattggaaggaactggttaaaaaaaacattgatgaagttttacttactgaagatgggaatctgatgaccttttgggacagcggtg

SEQ ID NO: 368074 - DNA, 140 bp, Artificial Sequence
  Synthetic
caccgctgtcccaaaaggtcatcagattcccatcttcagtaagtaaaacttcatcaatgttttttttaaccagttccttccaatggtagaaggacaacttcgagggttcaaatattccgtcatatcagcagccagggcct

SEQ ID NO: 368075 - DNA, 140 bp, Artificial Sequence
  Synthetic
atacgccatgctgggtctccgttaaaaaaaacattgatgaagttttacttactgaagatgggaatctgatcttctgctggctgaaaacaatttcctcttcggtcaaaggaagtctgaagacgtacttgggagtcggccat

SEQ ID NO: 368076 - DNA, 140 bp, Artificial Sequence
  Synthetic
atggccgactcccaagtacgtcttcagacttcctttgaccgaagaggaaattgttttcagccagcagaagatcagattcccatcttcagtaagtaaaacttcatcaatgttttttttaacggagacccagcatggcgtat

SEQ ID NO: 368077 - DNA, 140 bp, Artificial Sequence
  Synthetic
aggccctggctgctgatatgtcaagtttctctttcgagctgaaccggcccctgtctgaaacagagatacagtttataaaggcacttagcagtctgaggtcaatccaggcgtgtgagataggaccttttgggacagcggtg

SEQ ID NO: 368078 - DNA, 140 bp, Artificial Sequence
  Synthetic
caccgctgtcccaaaaggtcctatctcacacgcctggattgacctcagactgctaagtgcctttataaactgtatctctgtttcagacaggggccggttcagctcgaaagagaaacttgacatatcagcagccagggcct

SEQ ID NO: 368079 - DNA, 140 bp, Artificial Sequence
  Synthetic
aggccctggctgctgatatgtgcctcttttccagtgaggaattcaacgagctgattaagttgaagaaactcctcctcaacgaacagcaagatgaacaggagctgaaacaggaccttttgagaccttttgggacagcggtg

SEQ ID NO: 368080 - DNA, 140 bp, Artificial Sequence
  Synthetic
caccgctgtcccaaaaggtctcaaaaggtcctgtttcagctcctgttcatcttgctgttcgttgaggaggagtttcttcaacttaatcagctcgttgaattcctcactggaaaagaggcacatatcagcagccagggcct

SEQ ID NO: 368081 - DNA, 140 bp, Artificial Sequence
  Synthetic
atacgccatgctgggtctccgacaggcacaatgtcatatatagcagtagaatggcagactcatgtgattggctgagagacgggaaaagaagaggaaactttgaattggcaaatagaataccgtacttgggagtcggccat

SEQ ID NO: 368082 - DNA, 140 bp, Artificial Sequence
  Synthetic
atggccgactcccaagtacggtattctatttgccaattcaaagtttcctcttcttttcccgtctctcagccaatcacatgagtctgccattctactgctatatatgacattgtgcctgtcggagacccagcatggcgtat

SEQ ID NO: 368083 - DNA, 140 bp, Artificial Sequence
  Synthetic
aggccctggctgctgatatgtatcttcctggatcaagtgtataacggcttgtaaagattttacaagcatcaatgataagattcagaaattcatttaccacctttctgaagagctatatgagaccttttgggacagcggtg

SEQ ID NO: 368084 - DNA, 140 bp, Artificial Sequence
  Synthetic
caccgctgtcccaaaaggtctcatatagctcttcagaaaggtggtaaatgaatttctgaatcttatcattgatgcttgtaaaatctttacaagccgttatacacttgatccaggaagatacatatcagcagccagggcct

SEQ ID NO: 368085 - DNA, 140 bp, Artificial Sequence
  Synthetic
aggccctggctgctgatatggtgtcagctttacaaaagaagaagtcttaattaagcggttggagaaaaatttcctaaagcagcataatctggaaatcatggaaacagtgaatcttatattgaccttttgggacagcggtg

SEQ ID NO: 368086 - DNA, 140 bp, Artificial Sequence
  Synthetic
caccgctgtcccaaaaggtcaatataagattcactgtttccatgatttccagattatgctgctttaggaaatttttctccaaccgcttaattaagacttcttcttttgtaaagctgacaccatatcagcagccagggcct

SEQ ID NO: 368087 - DNA, 140 bp, Artificial Sequence
  Synthetic
atacgccatgctgggtctccttcctaaagcagcataatctggaaatcatggaaacagtgaatcttatattctttgcagccctctcagctccttggtgtttacactataaagcactggaatcgtacttgggagtcggccat

SEQ ID NO: 368088 - DNA, 140 bp, Artificial Sequence
  Synthetic
atggccgactcccaagtacgattccagtgctttatagtgtaaacaccaaggagctgagagggctgcaaagaatataagattcactgtttccatgatttccagattatgctgctttaggaaggagacccagcatggcgtat

SEQ ID NO: 368089 - DNA, 140 bp, Artificial Sequence
  Synthetic
atacgccatgctgggtctccgccttgaagtttttaatgatccattcaatgattatcagcaagcaataacagacatttgtcaattttctgaatacacaccgaacaaagaaagcgttttgaacgtacttgggagtcggccat

SEQ ID NO: 368090 - DNA, 140 bp, Artificial Sequence
  Synthetic
atggccgactcccaagtacgttcaaaacgctttctttgttcggtgtgtattcagaaaattgacaaatgtctgttattgcttgctgataatcattgaatggatcattaaaaacttcaaggcggagacccagcatggcgtat

SEQ ID NO: 368091 - DNA, 140 bp, Artificial Sequence
  Synthetic
aggccctggctgctgatatgtgcaagctcactttgcttgatttgtcagtttctaagcttttgatttgtttgtatcaaaaagatgatgaagaattggcaaatagctcaagtttaaaacttggaccttttgggacagcggtg

SEQ ID NO: 368092 - DNA, 140 bp, Artificial Sequence
  Synthetic
caccgctgtcccaaaaggtccaagttttaaacttgagctatttgccaattcttcatcatctttttgatacaaacaaatcaaaagcttagaaactgacaaatcaagcaaagtgagcttgcacatatcagcagccagggcct

SEQ ID NO: 368093 - DNA, 140 bp, Artificial Sequence
  Synthetic
aggccctggctgctgatatgaaggagctttcccttcctatatatacaatattcatgaagtcttacttctttaaagataatgttttcctgtctcttacagacaggtggtcaactaaacacagaccttttgggacagcggtg

SEQ ID NO: 368094 - DNA, 140 bp, Artificial Sequence
  Synthetic
caccgctgtcccaaaaggtctgtgtttagttgaccacctgtctgtaagagacaggaaaacattatctttaaagaagtaagacttcatgaatattgtatatataggaagggaaagctccttcatatcagcagccagggcct

SEQ ID NO: 368095 - DNA, 140 bp, Artificial Sequence
  Synthetic
aggccctggctgctgatatgttttcactcagtcttaatgatggtggtttggatcttgacttacacaagaccactgacgaaaagctgctacatcaaacaaagatagtttttgctaaaattggaccttttgggacagcggtg

SEQ ID NO: 368096 - DNA, 140 bp, Artificial Sequence
  Synthetic
caccgctgtcccaaaaggtccaattttagcaaaaactatctttgtttgatgtagcagcttttcgtcagtggtcttgtgtaagtcaagatccaaaccaccatcattaagactgagtgaaaacatatcagcagccagggcct

SEQ ID NO: 368097 - DNA, 140 bp, Artificial Sequence
  Synthetic
atacgccatgctgggtctcccactgacgaaaagctgctacatcaaacaaagatagtttttgctaaaattggtttatctgggaacagctatgatttcatctggactactcaaatgatagcacgtacttgggagtcggccat

SEQ ID NO: 368098 - DNA, 140 bp, Artificial Sequence
  Synthetic
atggccgactcccaagtacgtgctatcatttgagtagtccagatgaaatcatagctgttcccagataaaccaattttagcaaaaactatctttgtttgatgtagcagcttttcgtcagtgggagacccagcatggcgtat

SEQ ID NO: 368099 - DNA, 140 bp, Artificial Sequence
  Synthetic
aggccctggctgctgatatggtttatctgggaacagctatgatttcatctggactactcaaatgatagcaaacagcaattttaacgtctgcaaaagattaacagggaggagtactggggagaccttttgggacagcggtg

SEQ ID NO: 368100 - DNA, 140 bp, Artificial Sequence
  Synthetic
caccgctgtcccaaaaggtctccccagtactcctccctgttaatcttttgcagacgttaaaattgctgtttgctatcatttgagtagtccagatgaaatcatagctgttcccagataaaccatatcagcagccagggcct

SEQ ID NO: 368101 - DNA, 140 bp, Artificial Sequence
  Synthetic
aggccctggctgctgatatgtagtgggagaaacaggcatggcaatactacaacagttagcattcgcacaggcactaaactatgagcaccgcttctatgcagttttggcacctaaagcacagaccttttgggacagcggtg

SEQ ID NO: 368102 - DNA, 140 bp, Artificial Sequence
  Synthetic
caccgctgtcccaaaaggtctgtgctttaggtgccaaaactgcatagaagcggtgctcatagtttagtgcctgtgcgaatgctaactgttgtagtattgccatgcctgtttctcccactacatatcagcagccagggcct

SEQ ID NO: 368103 - DNA, 140 bp, Artificial Sequence
  Synthetic
atacgccatgctgggtctccgcactaaactatgagcaccgcttctatgcagttttggcacctaaagcacaactaggaggagcaagagatttgttagtgcaggagactgggactaaagtcacgtacttgggagtcggccat

SEQ ID NO: 368104 - DNA, 140 bp, Artificial Sequence
  Synthetic
atggccgactcccaagtacgtgactttagtcccagtctcctgcactaacaaatctcttgctcctcctagttgtgctttaggtgccaaaactgcatagaagcggtgctcatagtttagtgcggagacccagcatggcgtat

SEQ ID NO: 368105 - DNA, 140 bp, Artificial Sequence
  Synthetic
atacgccatgctgggtctccaggttgatttctcaaacttgctcaaagatcgttttaagatcatgcagttcttcccttcagtattcaccctaattagaatgcttacggatgagtcaacagacgtacttgggagtcggccat

SEQ ID NO: 368106 - DNA, 140 bp, Artificial Sequence
  Synthetic
atggccgactcccaagtacgtctgttgactcatccgtaagcattctaattagggtgaatactgaagggaagaactgcatgatcttaaaacgatctttgagcaagtttgagaaatcaacctggagacccagcatggcgtat

SEQ ID NO: 368107 - DNA, 140 bp, Artificial Sequence
  Synthetic
atacgccatgctgggtctcccccaaaacaaccatggctttcctcttctggttcagctttggctatttaataacctgcatactttgcaaggccattttttacttgttgataattattggaacgtacttgggagtcggccat

SEQ ID NO: 368108 - DNA, 140 bp, Artificial Sequence
  Synthetic
atggccgactcccaagtacgttccaataattatcaacaagtaaaaaatggccttgcaaagtatgcaggttattaaatagccaaagctgaaccagaagaggaaagccatggttgttttgggggagacccagcatggcgtat

SEQ ID NO: 368109 - DNA, 140 bp, Artificial Sequence
  Synthetic
aggccctggctgctgatatgaaggtagtaacttggtcaatttctataaagtcatatgcatctcaggtgataataccaaatggggcccgattcattgctgctctttcttttctggcatgatgaccttttgggacagcggtg

SEQ ID NO: 368110 - DNA, 140 bp, Artificial Sequence
  Synthetic
caccgctgtcccaaaaggtcatcatgccagaaaagaaagagcagcaatgaatcgggccccatttggtattatcacctgagatgcatatgactttatagaaattgaccaagttactaccttcatatcagcagccagggcct

SEQ ID NO: 368111 - DNA, 140 bp, Artificial Sequence
  Synthetic
atacgccatgctgggtctccgttactgttttctacatgttgaaaggcaacctgatgaatacagagccgaccgttgcagaacttgtcagttatggcatcaaggaaggtagattttacaggccgtacttgggagtcggccat

SEQ ID NO: 368112 - DNA, 140 bp, Artificial Sequence
  Synthetic
atggccgactcccaagtacggcctgtaaaatctaccttccttgatgccataactgacaagttctgcaacggtcggctctgtattcatcaggttgcctttcaacatgtagaaaacagtaacggagacccagcatggcgtat

SEQ ID NO: 368113 - DNA, 140 bp, Artificial Sequence
  Synthetic
aggccctggctgctgatatgcttttattaagaacttgtgtaggcaggtagaaatacctgctggtagcattaagaagatcttaaatgttcttagatacagattgtgcagcaaaggaggtgtgaccttttgggacagcggtg

SEQ ID NO: 368114 - DNA, 140 bp, Artificial Sequence
  Synthetic
caccgctgtcccaaaaggtcacacctcctttgctgcacaatctgtatctaagaacatttaagatcttcttaatgctaccagcaggtatttctacctgcctacacaagttcttaataaaagcatatcagcagccagggcct

SEQ ID NO: 368115 - DNA, 140 bp, Artificial Sequence
  Synthetic
atacgccatgctgggtctccaagaagatcttaaatgttcttagatacagattgtgcagcaaaggaggtgtagagcagcatagtgaggaggatctaagaaggttgttaacagaaaatttagcgtacttgggagtcggccat

SEQ ID NO: 368116 - DNA, 140 bp, Artificial Sequence
  Synthetic
atggccgactcccaagtacgctaaattttctgttaacaaccttcttagatcctcctcactatgctgctctacacctcctttgctgcacaatctgtatctaagaacatttaagatcttcttggagacccagcatggcgtat

SEQ ID NO: 368117 - DNA, 140 bp, Artificial Sequence
  Synthetic
atacgccatgctgggtctcccaaatcctcattgctcatgagttttttgaactggagagtgaacatggacatcaggactcctgactgtccactgtcaagtcatgaggcaggcatattaagtcgtacttgggagtcggccat

SEQ ID NO: 368118 - DNA, 140 bp, Artificial Sequence
  Synthetic
atggccgactcccaagtacgacttaatatgcctgcctcatgacttgacagtggacagtcaggagtcctgatgtccatgttcactctccagttcaaaaaactcatgagcaatgaggatttgggagacccagcatggcgtat

SEQ ID NO: 368119 - DNA, 140 bp, Artificial Sequence
  Synthetic
aggccctggctgctgatatgtcaggactcctgactgtccactgtcaagtcatgaggcaggcatattaagtgaatttgatgggcaggttattgcaaacatacttgctagcgagttaagctcgaccttttgggacagcggtg

SEQ ID NO: 368120 - DNA, 140 bp, Artificial Sequence
  Synthetic
caccgctgtcccaaaaggtcgagcttaactcgctagcaagtatgtttgcaataacctgcccatcaaattcacttaatatgcctgcctcatgacttgacagtggacagtcaggagtcctgacatatcagcagccagggcct

SEQ ID NO: 368121 - DNA, 140 bp, Artificial Sequence
  Synthetic
aggccctggctgctgatatgcatgttgaacatgcaggtagttcagatgattacgcaaaatgtatagtggtgacaggcatactgtctaaagagctctactcccagtatgatgaggcattttgaccttttgggacagcggtg

SEQ ID NO: 368122 - DNA, 140 bp, Artificial Sequence
  Synthetic
caccgctgtcccaaaaggtcaaaatgcctcatcatactgggagtagagctctttagacagtatgcctgtcaccactatacattttgcgtaatcatctgaactacctgcatgttcaacatgcatatcagcagccagggcct

SEQ ID NO: 368123 - DNA, 140 bp, Artificial Sequence
  Synthetic
aggccctggctgctgatatgtgtaagttcaacacttggggagacacaaacagaactggaaagttcacatacagtagtaggtcaggggagtcaattggaatattcattgctggaaaattgcgaccttttgggacagcggtg

SEQ ID NO: 368124 - DNA, 140 bp, Artificial Sequence
  Synthetic
caccgctgtcccaaaaggtcgcaattttccagcaatgaatattccaattgactcccctgacctactactgtatgtgaactttccagttctgtttgtgtctccccaagtgttgaacttacacatatcagcagccagggcct

SEQ ID NO: 368125 - DNA, 140 bp, Artificial Sequence
  Synthetic
atacgccatgctgggtctcccaggtgctgtcttggatgagtaaaaggaggacggaagtggtaaccaaagagcagcatcaactattcttgagccttcttcctcaatctcacgagtgtctaccgtacttgggagtcggccat

SEQ ID NO: 368126 - DNA, 140 bp, Artificial Sequence
  Synthetic
atggccgactcccaagtacggtagacactcgtgagattgaggaagaaggctcaagaatagttgatgctgctctttggttaccacttccgtcctccttttactcatccaagacagcacctgggagacccagcatggcgtat

SEQ ID NO: 368127 - DNA, 140 bp, Artificial Sequence
  Synthetic
atacgccatgctgggtctccagtttatgttcactgggctgataaatagctctgtgacctctcctcaaagtttaatgcaagcatgtcaagtttcatctcaacaagcaatgtataatagtgtcgtacttgggagtcggccat

SEQ ID NO: 368128 - DNA, 140 bp, Artificial Sequence
  Synthetic
atggccgactcccaagtacgacactattatacattgcttgttgagatgaaacttgacatgcttgcattaaactttgaggagaggtcacagagctatttatcagcccagtgaacataaactggagacccagcatggcgtat

SEQ ID NO: 368129 - DNA, 140 bp, Artificial Sequence
  Synthetic
aggccctggctgctgatatgttaaccatgttgaggattttatcagaagatatggtatattaacacttgggactttatcaccttttggtaggctgtttgtaccaacctactctggattagtgaccttttgggacagcggtg

SEQ ID NO: 368130 - DNA, 140 bp, Artificial Sequence
  Synthetic
caccgctgtcccaaaaggtcactaatccagagtaggttggtacaaacagcctaccaaaaggtgataaagtcccaagtgttaatataccatatcttctgataaaatcctcaacatggttaacatatcagcagccagggcct

SEQ ID NO: 368131 - DNA, 140 bp, Artificial Sequence
  Synthetic
atacgccatgctgggtctccactttatcaccttttggtaggctgtttgtaccaacctactctggattagtcagttcagcagttgctttagaagatgctgaagtcattgctagagcagctccgtacttgggagtcggccat

SEQ ID NO: 368132 - DNA, 140 bp, Artificial Sequence
  Synthetic
atggccgactcccaagtacggagctgctctagcaatgacttcagcatcttctaaagcaactgctgaactgactaatccagagtaggttggtacaaacagcctaccaaaaggtgataaagtggagacccagcatggcgtat

SEQ ID NO: 368133 - DNA, 140 bp, Artificial Sequence
  Synthetic
aggccctggctgctgatatgttagacagcctaggtcgtagtagggcaagttctacagctgaagatagcagcagtgtgagtgacactactgctgcttctcatgactcaggatcatcatcctgaccttttgggacagcggtg

SEQ ID NO: 368134 - DNA, 140 bp, Artificial Sequence
  Synthetic
caccgctgtcccaaaaggtcaggatgatgatcctgagtcatgagaagcagcagtagtgtcactcacactgctgctatcttcagctgtagaacttgccctactacgacctaggctgtctaacatatcagcagccagggcct

SEQ ID NO: 368135 - DNA, 140 bp, Artificial Sequence
  Synthetic
atacgccatgctgggtctcccagtgtgagtgacactactgctgcttctcatgactcaggatcatcatcctcaagcttctcttttgagctcaacaggcccctgtctgaaactgaactacagcgtacttgggagtcggccat

SEQ ID NO: 368136 - DNA, 140 bp, Artificial Sequence
  Synthetic
atggccgactcccaagtacgctgtagttcagtttcagacaggggcctgttgagctcaaaagagaagcttgaggatgatgatcctgagtcatgagaagcagcagtagtgtcactcacactgggagacccagcatggcgtat

SEQ ID NO: 368137 - DNA, 140 bp, Artificial Sequence
  Synthetic
aggccctggctgctgatatgtcaaaatagaattacaggtctttactgcaatagcaatgaaggacctcttgacaggcataatgttatttacagtagcagaatggcagactcttgcgattgggaccttttgggacagcggtg

SEQ ID NO: 368138 - DNA, 140 bp, Artificial Sequence
  Synthetic
caccgctgtcccaaaaggtcccaatcgcaagagtctgccattctgctactgtaaataacattatgcctgtcaagaggtccttcattgctattgcagtaaagacctgtaattctattttgacatatcagcagccagggcct

SEQ ID NO: 368139 - DNA, 140 bp, Artificial Sequence
  Synthetic
aggccctggctgctgatatgagaagaaattgagttttgcaataatctgacaaagacagtgtcagaaaacccgctaccactcagttgctggtcagaagtgcagaattatatagaagacatagaccttttgggacagcggtg

SEQ ID NO: 368140 - DNA, 140 bp, Artificial Sequence
  Synthetic
caccgctgtcccaaaaggtctatgtcttctatataattctgcacttctgaccagcaactgagtggtagcgggttttctgacactgtctttgtcagattattgcaaaactcaatttcttctcatatcagcagccagggcct

SEQ ID NO: 368141 - DNA, 140 bp, Artificial Sequence
  Synthetic
aggccctggctgctgatatgctaagggatggtaaaagaagagggaatctagaacttgcaaatagaatccagtccgtactgtgtattctgatagcagggtattacaggtcatttggaggtggaccttttgggacagcggtg

SEQ ID NO: 368142 - DNA, 140 bp, Artificial Sequence
  Synthetic
caccgctgtcccaaaaggtccacctccaaatgacctgtaataccctgctatcagaatacacagtacggactggattctatttgcaagttctagattccctcttcttttaccatcccttagcatatcagcagccagggcct

SEQ ID NO: 368143 - DNA, 140 bp, Artificial Sequence
  Synthetic
atacgccatgctgggtctccacttttgtggaagttcacgctagacactaatgtaagtactacaagcaccatcaaggacatcagaactctcgtctcctacatcagcaccgagaccatccctcgtacttgggagtcggccat

SEQ ID NO: 368144 - DNA, 140 bp, Artificial Sequence
  Synthetic
atggccgactcccaagtacgagggatggtctcggtgctgatgtaggagacgagagttctgatgtccttgatggtgcttgtagtacttacattagtgtctagcgtgaacttccacaaaagtggagacccagcatggcgtat

SEQ ID NO: 368145 - DNA, 140 bp, Artificial Sequence
  Synthetic
aggccctggctgctgatatgatcattgaggatcctatgatacaactaattccagagaagctgagaagagagttagaaaggctgggtgtttcgagaatggaagtcgatgaactaatgccaagaccttttgggacagcggtg

SEQ ID NO: 368146 - DNA, 140 bp, Artificial Sequence
  Synthetic
caccgctgtcccaaaaggtcttggcattagttcatcgacttccattctcgaaacacccagcctttctaactctcttctcagcttctctggaattagttgtatcataggatcctcaatgatcatatcagcagccagggcct

SEQ ID NO: 368147 - DNA, 140 bp, Artificial Sequence
  Synthetic
atacgccatgctgggtctccgttagaaaggctgggtgtttcgagaatggaagtcgatgaactaatgccaagcattagtcctgatgacaccttagcccagcttgtagcaaaaaaactcatccgtacttgggagtcggccat

SEQ ID NO: 368148 - DNA, 140 bp, Artificial Sequence
  Synthetic
atggccgactcccaagtacggatgagtttttttgctacaagctgggctaaggtgtcatcaggactaatgcttggcattagttcatcgacttccattctcgaaacacccagcctttctaacggagacccagcatggcgtat

SEQ ID NO: 368149 - DNA, 140 bp, Artificial Sequence
  Synthetic
atacgccatgctgggtctccaccttgaattagagagtctgctcactctatgtgtattctgctttcaaactgagcgcagtaagcgaggaggaccgaggtgttctttcacagcactgctaggcgtacttgggagtcggccat

SEQ ID NO: 368150 - DNA, 140 bp, Artificial Sequence
  Synthetic
atggccgactcccaagtacgcctagcagtgctgtgaaagaacacctcggtcctcctcgcttactgcgctcagtttgaaagcagaatacacatagagtgagcagactctctaattcaaggtggagacccagcatggcgtat

SEQ ID NO: 368151 - DNA, 140 bp, Artificial Sequence
  Synthetic
aggccctggctgctgatatgacaaacactgacagcccgaaatgttctgcacgggctggctggaggaattaaggagctatcgctcccaatatacacgatattcatgaaatcctacttctttgaccttttgggacagcggtg

SEQ ID NO: 368152 - DNA, 140 bp, Artificial Sequence
  Synthetic
caccgctgtcccaaaaggtcaaagaagtaggatttcatgaatatcgtgtatattgggagcgatagctccttaattcctccagccagcccgtgcagaacatttcgggctgtcagtgtttgtcatatcagcagccagggcct

SEQ ID NO: 368153 - DNA, 140 bp, Artificial Sequence
  Synthetic
aggccctggctgctgatatgaaagacaacgtcttcttgtcactaacagacagatggtccaccaagcatagtacaaactatcgtgatagttgtggcaaacaattaacaggtagaataatcagaccttttgggacagcggtg

SEQ ID NO: 368154 - DNA, 140 bp, Artificial Sequence
  Synthetic
caccgctgtcccaaaaggtctgattattctacctgttaattgtttgccacaactatcacgatagtttgtactatgcttggtggaccatctgtctgttagtgacaagaagacgttgtctttcatatcagcagccagggcct

SEQ ID NO: 368155 - DNA, 140 bp, Artificial Sequence
  Synthetic
atacgccatgctgggtctccccacacaaagatatgtccaggcctaaatcggaaaggatcgtcactgccagaagatcactgaatcatgctttgaccttgatgttcttagaagaggtcacatcgtacttgggagtcggccat

SEQ ID NO: 368156 - DNA, 140 bp, Artificial Sequence
  Synthetic
atggccgactcccaagtacgatgtgacctcttctaagaacatcaaggtcaaagcatgattcagtgatcttctggcagtgacgatcctttccgatttaggcctggacatatctttgtgtggggagacccagcatggcgtat

SEQ ID NO: 368157 - DNA, 140 bp, Artificial Sequence
  Synthetic
aggccctggctgctgatatgccaagtatactcactggttggatacttttctaggctgttctgtctccatcaataggcatactactgtcaaagagccctccttattcaatcctaatatcaggaccttttgggacagcggtg

SEQ ID NO: 368158 - DNA, 140 bp, Artificial Sequence
  Synthetic
caccgctgtcccaaaaggtcctgatattaggattgaataaggagggctctttgacagtagtatgcctattgatggagacagaacagcctagaaaagtatccaaccagtgagtatacttggcatatcagcagccagggcct

SEQ ID NO: 368159 - DNA, 140 bp, Artificial Sequence
  Synthetic
aggccctggctgctgatatgatgtgttaacctgatcacgttcgaggatggcctgagggaactatcagtgatacagagtcaccttaaagtctttgaaaatgaattcaccaacttaaatcttgaccttttgggacagcggtg

SEQ ID NO: 368160 - DNA, 140 bp, Artificial Sequence
  Synthetic
caccgctgtcccaaaaggtcaagatttaagttggtgaattcattttcaaagactttaaggtgactctgtatcactgatagttccctcaggccatcctcgaacgtgatcaggttaacacatcatatcagcagccagggcct

SEQ ID NO: 368161 - DNA, 140 bp, Artificial Sequence
  Synthetic
atacgccatgctgggtctccggactacaacaaactgattgaccactgtgtagacatggaaaagaagaaagacgctgtcagagcagttgaggacttagtgctaatgttgacggggagagcacgtacttgggagtcggccat

SEQ ID NO: 368162 - DNA, 140 bp, Artificial Sequence
  Synthetic
atggccgactcccaagtacgtgctctccccgtcaacattagcactaagtcctcaactgctctgacagcgtctttcttcttttccatgtctacacagtggtcaatcagtttgttgtagtccggagacccagcatggcgtat

SEQ ID NO: 368163 - DNA, 140 bp, Artificial Sequence
  Synthetic
aggccctggctgctgatatgcaattctctgatccgaacagacagaagcttagaatagttgagtctagacctgcggagtctgagctggaggcaaaccgtgcagtaattgtcaagaccaaatgaccttttgggacagcggtg

SEQ ID NO: 368164 - DNA, 140 bp, Artificial Sequence
  Synthetic
caccgctgtcccaaaaggtcatttggtcttgacaattactgcacggtttgcctccagctcagactccgcaggtctagactcaactattctaagcttctgtctgttcggatcagagaattgcatatcagcagccagggcct

SEQ ID NO: 368165 - DNA, 140 bp, Artificial Sequence
  Synthetic
atacgccatgctgggtctcctgcggagtctgagctggaggcaaaccgtgcagtaattgtcaagaccaaattgttttcggcaactgaacaagttcgactatctaacaaccctgcagttgttcgtacttgggagtcggccat

SEQ ID NO: 368166 - DNA, 140 bp, Artificial Sequence
  Synthetic
atggccgactcccaagtacgaacaactgcagggttgttagatagtcgaacttgttcagttgccgaaaacaatttggtcttgacaattactgcacggtttgcctccagctcagactccgcaggagacccagcatggcgtat

SEQ ID NO: 368167 - DNA, 140 bp, Artificial Sequence
  Synthetic
atacgccatgctgggtctccaaccagacagagaggcggaggcactcaagactggcaatcttagctttaactgggattcagactgagcatggttttgagtttacaaaagggctgtctacttcgtacttgggagtcggccat

SEQ ID NO: 368168 - DNA, 140 bp, Artificial Sequence
  Synthetic
atggccgactcccaagtacgaagtagacagcccttttgtaaactcaaaaccatgctcagtctgaatcccagttaaagctaagattgccagtcttgagtgcctccgcctctctgtctggttggagacccagcatggcgtat

SEQ ID NO: 368169 - DNA, 140 bp, Artificial Sequence
  Synthetic
atacgccatgctgggtctccacataaaactgtgcaaaggagtttgcgtcgtggtctactctagctagcattattcccaaacactttgaccatctaacttactctgtctcacatccatttgcgtacttgggagtcggccat

SEQ ID NO: 368170 - DNA, 140 bp, Artificial Sequence
  Synthetic
atggccgactcccaagtacgcaaatggatgtgagacagagtaagttagatggtcaaagtgtttgggaataatgctagctagagtagaccacgacgcaaactcctttgcacagttttatgtggagacccagcatggcgtat

SEQ ID NO: 368171 - DNA, 140 bp, Artificial Sequence
  Synthetic
aggccctggctgctgatatgtattcccaaacactttgaccatctaacttactctgtctcacatccatttgtttcttttacctccaccctagtattatgcctgttatttgcaaggatgtgggaccttttgggacagcggtg

SEQ ID NO: 368172 - DNA, 140 bp, Artificial Sequence
  Synthetic
caccgctgtcccaaaaggtcccacatccttgcaaataacaggcataatactagggtggaggtaaaagaaacaaatggatgtgagacagagtaagttagatggtcaaagtgtttgggaatacatatcagcagccagggcct

SEQ ID NO: 368173 - DNA, 140 bp, Artificial Sequence
  Synthetic
atacgccatgctgggtctccgttgctgagcttgtcagctatggtataaaggaaggtaggttttataggctttccgacaccggaatcgatgcaagcacatattccgtaaagtattggaaaacgtacttgggagtcggccat

SEQ ID NO: 368174 - DNA, 140 bp, Artificial Sequence
  Synthetic
atggccgactcccaagtacgttttccaatactttacggaatatgtgcttgcatcgattccggtgtcggaaagcctataaaacctaccttcctttataccatagctgacaagctcagcaacggagacccagcatggcgtat

SEQ ID NO: 368175 - DNA, 140 bp, Artificial Sequence
  Synthetic
aggccctggctgctgatatgaagtcttcattacttatgagtttcttaaactggagggtcaatatggacattagagcatccgactgtccactatctagtcatgaggcaagtatattgagtggaccttttgggacagcggtg

SEQ ID NO: 368176 - DNA, 140 bp, Artificial Sequence
  Synthetic
caccgctgtcccaaaaggtccactcaatatacttgcctcatgactagatagtggacagtcggatgctctaatgtccatattgaccctccagtttaagaaactcataagtaatgaagacttcatatcagcagccagggcct

SEQ ID NO: 368177 - DNA, 140 bp, Artificial Sequence
  Synthetic
atacgccatgctgggtctcctagagcatccgactgtccactatctagtcatgaggcaagtatattgagtgagtttgatggacaagttattgctaatatacttgccagtgagttgagttctcgtacttgggagtcggccat

SEQ ID NO: 368178 - DNA, 140 bp, Artificial Sequence
  Synthetic
atggccgactcccaagtacgagaactcaactcactggcaagtatattagcaataacttgtccatcaaactcactcaatatacttgcctcatgactagatagtggacagtcggatgctctaggagacccagcatggcgtat

SEQ ID NO: 368179 - DNA, 140 bp, Artificial Sequence
  Synthetic
atacgccatgctgggtctccccgtgccgacatctccagccgcaaccccactacattatcatcacaatatactacatctaatctgctacattgtatccatggacagactctataatgcctgcgtacttgggagtcggccat

SEQ ID NO: 368180 - DNA, 140 bp, Artificial Sequence
  Synthetic
atggccgactcccaagtacgcaggcattatagagtctgtccatggatacaatgtagcagattagatgtagtatattgtgatgataatgtagtggggttgcggctggagatgtcggcacggggagacccagcatggcgtat

SEQ ID NO: 368181 - DNA, 140 bp, Artificial Sequence
  Synthetic
aggccctggctgctgatatgaaattcaccaactgaactgttgaaaaagaagccttacttagggacaacttgtaagttcaacacctggggagactcaaatagatctggaaagttcacatacgaccttttgggacagcggtg

SEQ ID NO: 368182 - DNA, 140 bp, Artificial Sequence
  Synthetic
caccgctgtcccaaaaggtcgtatgtgaactttccagatctatttgagtctccccaggtgttgaacttacaagttgtccctaagtaaggcttctttttcaacagttcagttggtgaatttcatatcagcagccagggcct

SEQ ID NO: 368183 - DNA, 140 bp, Artificial Sequence
  Synthetic
aggccctggctgctgatatgagcagcagatccggggagtccattgggatcttcattgcagggaaactacacatccacctctcatctgaatccgttgccttgttgtgtgaaactgaaagacgaccttttgggacagcggtg

SEQ ID NO: 368184 - DNA, 140 bp, Artificial Sequence
  Synthetic
caccgctgtcccaaaaggtcgtctttcagtttcacacaacaaggcaacggattcagatgagaggtggatgtgtagtttccctgcaatgaagatcccaatggactccccggatctgctgctcatatcagcagccagggcct

SEQ ID NO: 368185 - DNA, 140 bp, Artificial Sequence
  Synthetic
aggccctggctgctgatatgaacatacattcccccgaactgatgccagaaaactgtctcttttctagtgaggaatttaatgagttgatcaggttaaagaaactcctccttaacgaacagcgaccttttgggacagcggtg

SEQ ID NO: 368186 - DNA, 140 bp, Artificial Sequence
  Synthetic
caccgctgtcccaaaaggtcgctgttcgttaaggaggagtttctttaacctgatcaactcattaaattcctcactagaaaagagacagttttctggcatcagttcgggggaatgtatgttcatatcagcagccagggcct

SEQ ID NO: 368187 - DNA, 140 bp, Artificial Sequence
  Synthetic
aggccctggctgctgatatgcagcaccaattgtttctgagtcttctcccacagtcacatgaatgtctgcaaaagcacaaggacggcagcgcgctgtcagtcatacctgatagcagcaatcgaccttttgggacagcggtg

SEQ ID NO: 368188 - DNA, 140 bp, Artificial Sequence
  Synthetic
caccgctgtcccaaaaggtcgattgctgctatcaggtatgactgacagcgcgctgccgtccttgtgcttttgcagacattcatgtgactgtgggagaagactcagaaacaattggtgctgcatatcagcagccagggcct

SEQ ID NO: 368189 - DNA, 140 bp, Artificial Sequence
  Synthetic
atacgccatgctgggtctccaaagcacaaggacggcagcgcgctgtcagtcatacctgatagcagcaatccccgactacttaagtttgtgcctctcaagaaaggtctagcggtggtgaaacgtacttgggagtcggccat

SEQ ID NO: 368190 - DNA, 140 bp, Artificial Sequence
  Synthetic
atggccgactcccaagtacgtttcaccaccgctagacctttcttgagaggcacaaacttaagtagtcggggattgctgctatcaggtatgactgacagcgcgctgccgtccttgtgctttggagacccagcatggcgtat

SEQ ID NO: 368191 - DNA, 140 bp, Artificial Sequence
  Synthetic
atacgccatgctgggtctcctgagcactccaatgaagtgggggaagaagctctatgagctctttgctgatgattctttccagcagaacaggatctacatgcatcctgctgtgttgacagccgtacttgggagtcggccat

SEQ ID NO: 368192 - DNA, 140 bp, Artificial Sequence
  Synthetic
atggccgactcccaagtacggctgtcaacacagcaggatgcatgtagatcctgttctgctggaaagaatcatcagcaaagagctcatagagcttcttcccccacttcattggagtgctcaggagacccagcatggcgtat

SEQ ID NO: 368193 - DNA, 140 bp, Artificial Sequence
  Synthetic
aggccctggctgctgatatggagcgaacctagattacagtgggggcatggctgcttgtccattgtttatgacgaaactgacactcagactacataccatgagaatcttttgaaggtgaaggaccttttgggacagcggtg

SEQ ID NO: 368194 - DNA, 140 bp, Artificial Sequence
  Synthetic
caccgctgtcccaaaaggtccttcaccttcaaaagattctcatggtatgtagtctgagtgtcagtttcgtcataaacaatggacaagcagccatgcccccactgtaatctaggttcgctccatatcagcagccagggcct

SEQ ID NO: 368195 - DNA, 140 bp, Artificial Sequence
  Synthetic
aggccctggctgctgatatgcatcttgttgactgctctacagatagaaagaaacttttgcctcagtcagtgttctctgattccaaagttgtcctgtcaagaatcaagttcaagacagagcgaccttttgggacagcggtg

SEQ ID NO: 368196 - DNA, 140 bp, Artificial Sequence
  Synthetic
caccgctgtcccaaaaggtcgctctgtcttgaacttgattcttgacaggacaactttggaatcagagaacactgactgaggcaaaagtttctttctatctgtagagcagtcaacaagatgcatatcagcagccagggcct

SEQ ID NO: 368197 - DNA, 140 bp, Artificial Sequence
  Synthetic
atacgccatgctgggtctccctacaattgtaaccatcaaccatgtttatattaactgcttgtataatcctgttttatcaaattcttcttattttctttcgttttaaacacttaaagggctcgtacttgggagtcggccat

SEQ ID NO: 368198 - DNA, 140 bp, Artificial Sequence
  Synthetic
atggccgactcccaagtacgagccctttaagtgtttaaaacgaaagaaaataagaagaatttgataaaacaggattatacaagcagttaatataaacatggttgatggttacaattgtagggagacccagcatggcgtat

SEQ ID NO: 368199 - DNA, 140 bp, Artificial Sequence
  Synthetic
aggccctggctgctgatatggcttcaacaatgtacttgttaacattgacagaaacacagtgaaaagtgaacttctatggaaattcacgttagacaccaatgtaagcactacaagtaccatgaccttttgggacagcggtg

SEQ ID NO: 368200 - DNA, 140 bp, Artificial Sequence
  Synthetic
caccgctgtcccaaaaggtcatggtacttgtagtgcttacattggtgtctaacgtgaatttccatagaagttcacttttcactgtgtttctgtcaatgttaacaagtacattgttgaagccatatcagcagccagggcct

SEQ ID NO: 368201 - DNA, 140 bp, Artificial Sequence
  Synthetic
atacgccatgctgggtctcccttctatggaaattcacgttagacaccaatgtaagcactacaagtaccataaaagacatgaggacactggtgtcctacgttagcactgagactatccctacgtacttgggagtcggccat

SEQ ID NO: 368202 - DNA, 140 bp, Artificial Sequence
  Synthetic
atggccgactcccaagtacgtagggatagtctcagtgctaacgtaggacaccagtgtcctcatgtcttttatggtacttgtagtgcttacattggtgtctaacgtgaatttccatagaagggagacccagcatggcgtat

SEQ ID NO: 368203 - DNA, 140 bp, Artificial Sequence
  Synthetic
atacgccatgctgggtctccaaccagtgtaaggcagtaaaagaactcatcaacagcacaggactctcagatttggaactagagagcttgcttactttatgtgctttctatttccaaaatgcgtacttgggagtcggccat

SEQ ID NO: 368204 - DNA, 140 bp, Artificial Sequence
  Synthetic
atggccgactcccaagtacgcattttggaaatagaaagcacataaagtaagcaagctctctagttccaaatctgagagtcctgtgctgttgatgagttcttttactgccttacactggttggagacccagcatggcgtat

SEQ ID NO: 368205 - DNA, 140 bp, Artificial Sequence
  Synthetic
aggccctggctgctgatatgctagttcatgaggattggcagaggataggtaagaatattcttgttcgtgcaaacaatgagctaagtgatgtgtcattgaaggttaacattatcttggtgcgaccttttgggacagcggtg

SEQ ID NO: 368206 - DNA, 140 bp, Artificial Sequence
  Synthetic
caccgctgtcccaaaaggtcgcaccaagataatgttaaccttcaatgacacatcacttagctcattgtttgcacgaacaagaatattcttacctatcctctgccaatcctcatgaactagcatatcagcagccagggcct

SEQ ID NO: 368207 - DNA, 140 bp, Artificial Sequence
  Synthetic
aggccctggctgctgatatgctctcaaggacatgtctaagccaaagcctgagagagtggtcatggccagaaggtctctaaatcatgctctatccttaatgtttctggatgagatgtcattgaccttttgggacagcggtg

SEQ ID NO: 368208 - DNA, 140 bp, Artificial Sequence
  Synthetic
caccgctgtcccaaaaggtcaatgacatctcatccagaaacattaaggatagagcatgatttagagaccttctggccatgaccactctctcaggctttggcttagacatgtccttgagagcatatcagcagccagggcct

SEQ ID NO: 368209 - DNA, 140 bp, Artificial Sequence
  Synthetic
atacgccatgctgggtctccgattacaacaagttgattgaccactgtgtagacatggaaaaaaagagggaagcggttagagcagtggaagatttgattctgatgttgacaggcagagcaacgtacttgggagtcggccat

SEQ ID NO: 368210 - DNA, 140 bp, Artificial Sequence
  Synthetic
atggccgactcccaagtacgttgctctgcctgtcaacatcagaatcaaatcttccactgctctaaccgcttccctctttttttccatgtctacacagtggtcaatcaacttgttgtaatcggagacccagcatggcgtat

SEQ ID NO: 368211 - DNA, 140 bp, Artificial Sequence
  Synthetic
aggccctggctgctgatatggagcaaataagcttagatgatctaatggcaagcgatacggtaacagacttgcctgacagggaagcagaagctctcagaacaggaaatcttggctttaactgaccttttgggacagcggtg

SEQ ID NO: 368212 - DNA, 140 bp, Artificial Sequence
  Synthetic
caccgctgtcccaaaaggtcagttaaagccaagatttcctgttctgagagcttctgcttccctgtcaggcaagtctgttaccgtatcgcttgccattagatcatctaagcttatttgctccatatcagcagccagggcct

SEQ ID NO: 368213 - DNA, 140 bp, Artificial Sequence
  Synthetic
atacgccatgctgggtctccgcctgacagggaagcagaagctctcagaacaggaaatcttggctttaactgggattcagattgaacatgccgcttgcatgcgccattaatgcccttcagtcgtacttgggagtcggccat

SEQ ID NO: 368214 - DNA, 140 bp, Artificial Sequence
  Synthetic
atggccgactcccaagtacgactgaagggcattaatggcgcatgcaagcggcatgttcaatctgaatcccagttaaagccaagatttcctgttctgagagcttctgcttccctgtcaggcggagacccagcatggcgtat

SEQ ID NO: 368215 - DNA, 140 bp, Artificial Sequence
  Synthetic
aggccctggctgctgatatgagccttcaaacaagccagctgctctgcactccccactgtcaatttaattgctttaactgatccattttactaccttgctaatcctctctcatcctctcttgaccttttgggacagcggtg

SEQ ID NO: 368216 - DNA, 140 bp, Artificial Sequence
  Synthetic
caccgctgtcccaaaaggtcaagagaggatgagagaggattagcaaggtagtaaaatggatcagttaaagcaattaaattgacagtggggagtgcagagcagctggcttgtttgaaggctcatatcagcagccagggcct

SEQ ID NO: 368217 - DNA, 140 bp, Artificial Sequence
  Synthetic
atacgccatgctgggtctccaacccttgactcaggctacttctctgctaaatgttatccaagagcatcaaactcaggaatgcagctaatcaatgtcacacaacacccaatgaagatagcccgtacttgggagtcggccat

SEQ ID NO: 368218 - DNA, 140 bp, Artificial Sequence
  Synthetic
atggccgactcccaagtacgggctatcttcattgggtgttgtgtgacattgattagctgcattcctgagtttgatgctcttggataacatttagcagagaagtagcctgagtcaagggttggagacccagcatggcgtat

SEQ ID NO: 368219 - DNA, 140 bp, Artificial Sequence
  Synthetic
atacgccatgctgggtctcctggtttgaagagttcaagaaaggaaatggacttgtggacactttcacaaactcctactccttttgtgagagtgttccaaatctggacagatttgtatttccgtacttgggagtcggccat

SEQ ID NO: 368220 - DNA, 140 bp, Artificial Sequence
  Synthetic
atggccgactcccaagtacggaaatacaaatctgtccagatttggaacactctcacaaaaggagtaggagtttgtgaaagtgtccacaagtccatttcctttcttgaactcttcaaaccaggagacccagcatggcgtat

SEQ ID NO: 368221 - DNA, 140 bp, Artificial Sequence
  Synthetic
atacgccatgctgggtctccagatggccagtgctactgatgatgcacaaaaggattctatctacgcatctgctctagtggaggcaaccaaattttgcgcacccatatacgagtgtgcttgcgtacttgggagtcggccat

SEQ ID NO: 368222 - DNA, 140 bp, Artificial Sequence
  Synthetic
atggccgactcccaagtacgcaagcacactcgtatatgggtgcgcaaaatttggttgcctccactagagcagatgcgtagatagaatccttttgtgcatcatcagtagcactggccatctggagacccagcatggcgtat

SEQ ID NO: 368223 - DNA, 140 bp, Artificial Sequence
  Synthetic
atacgccatgctgggtctccatgcaggaaccattaaatcttgggatgaaagctacactgagctgaaagttgaggtccctaaaatagagcagcttgccaattaccaacaggctgctctaaacgtacttgggagtcggccat

SEQ ID NO: 368224 - DNA, 140 bp, Artificial Sequence
  Synthetic
atggccgactcccaagtacgtttagagcagcctgttggtaattggcaagctgctctattttagggacctcaactttcagctcagtgtagctttcatcccaagatttaatggttcctgcatggagacccagcatggcgtat

SEQ ID NO: 368225 - DNA, 140 bp, Artificial Sequence
  Synthetic
atacgccatgctgggtctccgtcaaagaaatgttgtcagatatgattagaaggaggaacttaattctcaacagaggtggcgatgaaaatccacgaggcccggtgagccgtgaacatgtggcgtacttgggagtcggccat

SEQ ID NO: 368226 - DNA, 140 bp, Artificial Sequence
  Synthetic
atggccgactcccaagtacgccacatgttcacggctcaccgggcctcgtggattttcatcgccacctctgttgagaattaagttcctccttctaatcatatctgacaacatttctttgacggagacccagcatggcgtat

SEQ ID NO: 368227 - DNA, 140 bp, Artificial Sequence
  Synthetic
atacgccatgctgggtctccccttggggtgatatcaacaagtcaggtcggtcaggaatagcacttgttgcaacaggccttgccaagcttgcagagactgaagggaaaggagtgtttgatgcgtacttgggagtcggccat

SEQ ID NO: 368228 - DNA, 140 bp, Artificial Sequence
  Synthetic
atggccgactcccaagtacgcatcaaacactcctttcccttcagtctctgcaagcttggcaaggcctgttgcaacaagtgctattcctgaccgacctgacttgttgatatcaccccaaggggagacccagcatggcgtat

SEQ ID NO: 368229 - DNA, 140 bp, Artificial Sequence
  Synthetic
aggccctggctgctgatatgacacatcgccaaggcacaggagctttacaaaaactcgtctgcacttcgtgcacagggtgcacagattgacactgctttcagctcatactactggctctacgaccttttgggacagcggtg

SEQ ID NO: 368230 - DNA, 140 bp, Artificial Sequence
  Synthetic
caccgctgtcccaaaaggtcgtagagccagtagtatgagctgaaagcagtgtcaatctgtgcaccctgtgcacgaagtgcagacgagtttttgtaaagctcctgtgccttggcgatgtgtcatatcagcagccagggcct

SEQ ID NO: 368231 - DNA, 140 bp, Artificial Sequence
  Synthetic
atacgccatgctgggtctccgcacctaatctgcttcgttatatcttcaaataagctctatgattcttgaagctgccttagctctgcttactctgaccttaactttgactgcgtgccgcaacgtacttgggagtcggccat

SEQ ID NO: 368232 - DNA, 140 bp, Artificial Sequence
  Synthetic
atggccgactcccaagtacgttgcggcacgcagtcaaagttaaggtcagagtaagcagagctaaggcagcttcaagaatcatagagcttatttgaagatataacgaagcagattaggtgcggagacccagcatggcgtat

SEQ ID NO: 368233 - DNA, 140 bp, Artificial Sequence
  Synthetic
atacgccatgctgggtctcccggcagaatcagtgagatgggtgtctgctttggaacaatccctgtggccaatcctgatgatgccgcccagggatccggacacaccaagtccattcttaatcgtacttgggagtcggccat

SEQ ID NO: 368234 - DNA, 140 bp, Artificial Sequence
  Synthetic
atggccgactcccaagtacgattaagaatggacttggtgtgtccggatccctgggcggcatcatcaggattggccacagggattgttccaaagcagacacccatctcactgattctgccgggagacccagcatggcgtat

SEQ ID NO: 368235 - DNA, 140 bp, Artificial Sequence
  Synthetic
atacgccatgctgggtctcccttcgaacaaacaccgagaccaacaatccgtgtgccaagacaattgtcaagttgtttgaaattcaaaaaacagggtttaacatacaggacatggacattgcgtacttgggagtcggccat

SEQ ID NO: 368236 - DNA, 140 bp, Artificial Sequence
  Synthetic
atggccgactcccaagtacgcaatgtccatgtcctgtatgttaaaccctgttttttgaatttcaaacaacttgacaattgtcttggcacacggattgttggtctcggtgtttgttcgaagggagacccagcatggcgtat

SEQ ID NO: 368237 - DNA, 140 bp, Artificial Sequence
  Synthetic
atacgccatgctgggtctcccattggcacaccttatgaaggaattatcgacaccttagtttctctgatcaatgttctgacaaggttcacctggtttcaagaggtggtactatatggtaagcgtacttgggagtcggccat

SEQ ID NO: 368238 - DNA, 140 bp, Artificial Sequence
  Synthetic
atggccgactcccaagtacgcttaccatatagtaccacctcttgaaaccaggtgaaccttgtcagaacattgatcagagaaactaaggtgtcgataattccttcataaggtgtgccaatgggagacccagcatggcgtat

SEQ ID NO: 368239 - DNA, 140 bp, Artificial Sequence
  Synthetic
atacgccatgctgggtctcctagcctctgagcacctgctgcaccagtctcttgtcggcaagcagtctccattccaaaatgcctacaatgtcaagggcaacgctacaagtgccaacatcatcgtacttgggagtcggccat

SEQ ID NO: 368240 - DNA, 140 bp, Artificial Sequence
  Synthetic
atggccgactcccaagtacgatgatgttggcacttgtagcgttgcccttgacattgtaggcattttggaatggagactgcttgccgacaagagactggtgcagcaggtgctcagaggctaggagacccagcatggcgtat

SEQ ID NO: 368241 - DNA, 140 bp, Artificial Sequence
  Synthetic
aggccctggctgctgatatgttccaaaatgcctacaatgtcaagggcaacgctacaagtgccaacatcatctgaagcgcaaaatgctttgcatccagattccctcctcttgcactgctatgaccttttgggacagcggtg

SEQ ID NO: 368242 - DNA, 140 bp, Artificial Sequence
  Synthetic
caccgctgtcccaaaaggtcatagcagtgcaagaggagggaatctggatgcaaagcattttgcgcttcagatgatgttggcacttgtagcgttgcccttgacattgtaggcattttggaacatatcagcagccagggcct

SEQ ID NO: 368243 - DNA, 140 bp, Artificial Sequence
  Synthetic
atacgccatgctgggtctccatacaattgtaaccatcaatcatgtttatattaaccgcttgtataatcttgttttattaactttttcttattttctttcgttttaaacacttaaagggctcgtacttgggagtcggccat

SEQ ID NO: 368244 - DNA, 140 bp, Artificial Sequence
  Synthetic
atggccgactcccaagtacgagccctttaagtgtttaaaacgaaagaaaataagaaaaagttaataaaacaagattatacaagcggttaatataaacatgattgatggttacaattgtatggagacccagcatggcgtat

SEQ ID NO: 368245 - DNA, 140 bp, Artificial Sequence
  Synthetic
aggccctggctgctgatatgatgtctttcagcattatgtacacaccacttttgtgtgctgttctttgcttacagctgtggagtttagaagggtctcatggactgtccaacaaaacccaacgaccttttgggacagcggtg

SEQ ID NO: 368246 - DNA, 140 bp, Artificial Sequence
  Synthetic
caccgctgtcccaaaaggtcgttgggttttgttggacagtccatgagacccttctaaactccacagctgtaagcaaagaacagcacacaaaagtggtgtgtacataatgctgaaagacatcatatcagcagccagggcct

SEQ ID NO: 368247 - DNA, 140 bp, Artificial Sequence
  Synthetic
atacgccatgctgggtctccagcaggaatctgggagagagaagaagaccttacaaacttttgccaccaagaatgtcaagtaacagaaactgagtgtctttgcccgtatgaagccttaattcgtacttgggagtcggccat

SEQ ID NO: 368248 - DNA, 140 bp, Artificial Sequence
  Synthetic
atggccgactcccaagtacgaattaaggcttcatacgggcaaagacactcagtttctgttacttgacattcttggtggcaaaagtttgtaaggtcttcttctctctcccagattcctgctggagacccagcatggcgtat

SEQ ID NO: 368249 - DNA, 140 bp, Artificial Sequence
  Synthetic
aggccctggctgctgatatggcaaaatggaaaacaaaatcgaggtgaataataaagatgagatgaacaagtggttcgaggagttcaagaaaggaaatggacttgtggacaccttcacaaagaccttttgggacagcggtg

SEQ ID NO: 368250 - DNA, 140 bp, Artificial Sequence
  Synthetic
caccgctgtcccaaaaggtctttgtgaaggtgtccacaagtccatttcctttcttgaactcctcgaaccacttgttcatctcatctttattattcacctcgattttgttttccattttgccatatcagcagccagggcct

SEQ ID NO: 368251 - DNA, 140 bp, Artificial Sequence
  Synthetic
atacgccatgctgggtctccgctgccacgtgttgatcaaatcgcatgtctgtgactactctttggacattgatgggccagtaaggctaccccgcatccaccatgaaggaactttcatacccgtacttgggagtcggccat

SEQ ID NO: 368252 - DNA, 140 bp, Artificial Sequence
  Synthetic
atggccgactcccaagtacgggtatgaaagttccttcatggtggatgcggggtagccttactggcccatcaatgtccaaagagtagtcacagacatgcgatttgatcaacacgtggcagcggagacccagcatggcgtat

SEQ ID NO: 368253 - DNA, 140 bp, Artificial Sequence
  Synthetic
atacgccatgctgggtctcctacttacagtttcattgtcaccagtacaatcagcacctatcggccatggaaagacagttgaaacatatcaaaccagagaagggtacacaagcatttgcctcgtacttgggagtcggccat

SEQ ID NO: 368254 - DNA, 140 bp, Artificial Sequence
  Synthetic
atggccgactcccaagtacgaggcaaatgcttgtgtacccttctctggtttgatatgtttcaactgtctttccatggccgataggtgctgattgtactggtgacaatgaaactgtaagtaggagacccagcatggcgtat

SEQ ID NO: 368255 - DNA, 140 bp, Artificial Sequence
  Synthetic
aggccctggctgctgatatgctaggtgtaaagccagcgggaacttcttaaacaggagtagtagagaccactttataagcattgtctcaggcttaaatctggtttatggcttcctcataaagaccttttgggacagcggtg

SEQ ID NO: 368256 - DNA, 140 bp, Artificial Sequence
  Synthetic
caccgctgtcccaaaaggtctttatgaggaagccataaaccagatttaagcctgagacaatgcttataaagtggtctctactactcctgtttaagaagttcccgctggctttacacctagcatatcagcagccagggcct

SEQ ID NO: 368257 - DNA, 140 bp, Artificial Sequence
  Synthetic
atacgccatgctgggtctccctcaaagaaatacttgcggcacgtcagtacgtaagtgttagctttgaggaagtggattgagcatcttaattgcagcacacctgccaacatcatgcatatacgtacttgggagtcggccat

SEQ ID NO: 368258 - DNA, 140 bp, Artificial Sequence
  Synthetic
atggccgactcccaagtacgtatatgcatgatgttggcaggtgtgctgcaattaagatgctcaatccacttcctcaaagctaacacttacgtactgacgtgccgcaagtatttctttgagggagacccagcatggcgtat

SEQ ID NO: 368259 - DNA, 140 bp, Artificial Sequence
  Synthetic
atacgccatgctgggtctccgtcaaaggcatgaagaacttgctaaattcaacaagcttagaaacaagcttatcaattgaggcaccatggggagctataaatgtccaatcaaccttcaaaccgtacttgggagtcggccat

SEQ ID NO: 368260 - DNA, 140 bp, Artificial Sequence
  Synthetic
atggccgactcccaagtacggtttgaaggttgattggacatttatagctccccatggtgcctcaattgataagcttgtttctaagcttgttgaatttagcaagttcttcatgcctttgacggagacccagcatggcgtat

SEQ ID NO: 368261 - DNA, 140 bp, Artificial Sequence
  Synthetic
atacgccatgctgggtctccctacaattgtaaccatcaaccatgtttatattagctgcttgtataatcctgttttattaacttcttcttatttcctttcgttttaaacacttaaagggctcgtacttgggagtcggccat

SEQ ID NO: 368262 - DNA, 140 bp, Artificial Sequence
  Synthetic
atggccgactcccaagtacgagccctttaagtgtttaaaacgaaaggaaataagaagaagttaataaaacaggattatacaagcagctaatataaacatggttgatggttacaattgtagggagacccagcatggcgtat

SEQ ID NO: 368263 - DNA, 140 bp, Artificial Sequence
  Synthetic
  misc_feature (58)..(58): n is a, c, g, or t
atacgccatgctgggtctcctctcaaagaaatacttgcggcacgtcagtacgtaagtnttaactttgaggaagtggattgagcatcttaaatgcaacatgcctgttagcattatgcatatcgtacttgggagtcggccat

SEQ ID NO: 368264 - DNA, 140 bp, Artificial Sequence
  Synthetic
  misc_feature (83)..(83): n is a, c, g, or t
atggccgactcccaagtacgatatgcataatgctaacaggcatgttgcatttaagatgctcaatccacttcctcaaagttaanacttacgtactgacgtgccgcaagtatttctttgagaggagacccagcatggcgtat

SEQ ID NO: 368265 - DNA, 140 bp, Artificial Sequence
  Synthetic
aggccctggctgctgatatgaagtggattgagcatcttaaatgcaacatgcctgttagcattatgcatatattattgatgtgtgcagtactttgcctgcagcagtatggtctgggggagagaccttttgggacagcggtg

SEQ ID NO: 368266 - DNA, 140 bp, Artificial Sequence
  Synthetic
caccgctgtcccaaaaggtctctcccccagaccatactgctgcaggcaaagtactgcacacatcaataatatatgcataatgctaacaggcatgttgcatttaagatgctcaatccacttcatatcagcagccagggcct

SEQ ID NO: 368267 - DNA, 140 bp, Artificial Sequence
  Synthetic
atacgccatgctgggtctccattattgatgtgtgcagtactttgcctgcagcagtatggtctgggggagactcatagaccaaacaacggaaccgaacacaacaaaacaaacgttttgacacgtacttgggagtcggccat

SEQ ID NO: 368268 - DNA, 140 bp, Artificial Sequence
  Synthetic
atggccgactcccaagtacgtgtcaaaacgtttgttttgttgtgttcggttccgttgtttggtctatgagtctcccccagaccatactgctgcaggcaaagtactgcacacatcaataatggagacccagcatggcgtat

SEQ ID NO: 368269 - DNA, 140 bp, Artificial Sequence
  Synthetic
atacgccatgctgggtctcctgttacgccagactcctccactgtcacacccacaacaccagtcagtggactggaaggctcgggggacgtgtacacatcccccccagtcaccaccaagggccgtacttgggagtcggccat

SEQ ID NO: 368270 - DNA, 140 bp, Artificial Sequence
  Synthetic
atggccgactcccaagtacggcccttggtggtgactgggggggatgtgtacacgtcccccgagccttccagtccactgactggtgttgtgggtgtgacagtggaggagtctggcgtaacaggagacccagcatggcgtat

SEQ ID NO: 368271 - DNA, 140 bp, Artificial Sequence
  Synthetic
atacgccatgctgggtctcccacattgtcagagccaagaaacattcagcaaaagctccctccagagatagttacattgcatcccagaattgaagaaggtttctttgatttaatgcatgtacgtacttgggagtcggccat

SEQ ID NO: 368272 - DNA, 140 bp, Artificial Sequence
  Synthetic
atggccgactcccaagtacgtacatgcattaaatcaaagaaaccttcttcaattctgggatgcaatgtaactatctctggagggagcttttgctgaatgtttcttggctctgacaatgtgggagacccagcatggcgtat

SEQ ID NO: 368273 - DNA, 140 bp, Artificial Sequence
  Synthetic
atacgccatgctgggtctcccctcaacactaacagtccgcacaagtccacctagcagccctagcacaccacctacatcacaagatacataccatcttgtgaggaatctactttcagtcaccgtacttgggagtcggccat

SEQ ID NO: 368274 - DNA, 140 bp, Artificial Sequence
  Synthetic
atggccgactcccaagtacggtgactgaaagtagattcctcacaagatggtatgtatcttgtgatgtaggtggtgtgctagggctgctaggtggacttgtgcggactgttagtgttgaggggagacccagcatggcgtat

SEQ ID NO: 368275 - DNA, 140 bp, Artificial Sequence
  Synthetic
aggccctggctgctgatatgcctacatcacaagatacataccatcttgtgaggaatctactttcagtcacgagcccctggccagaagaaacaacagcaccgtcaaaatcaggcaaagagagaccttttgggacagcggtg

SEQ ID NO: 368276 - DNA, 140 bp, Artificial Sequence
  Synthetic
caccgctgtcccaaaaggtctctctttgcctgattttgacggtgctgttgtttcttctggccaggggctcgtgactgaaagtagattcctcacaagatggtatgtatcttgtgatgtaggcatatcagcagccagggcct

SEQ ID NO: 368277 - DNA, 140 bp, Artificial Sequence
  Synthetic
atacgccatgctgggtctcccccataacagtccaaggacccactgaaaacagcagccacaacaccaccggacagcttgagtccatggcacaatcaacaaccctagtcccaatggcctctccgtacttgggagtcggccat

SEQ ID NO: 368278 - DNA, 140 bp, Artificial Sequence
  Synthetic
atggccgactcccaagtacggagaggccattgggactagggttgttgattgtgccatggactcaagctgtccggtggtgttgtggctgctgttttcagtgggtccttggactgttatgggggagacccagcatggcgtat

SEQ ID NO: 368279 - DNA, 140 bp, Artificial Sequence
  Synthetic
aggccctggctgctgatatgacagcttgagtccatggcacaatcaacaaccctagtcccaatggcctctccaacacagacagtcctctcacagagtgtcacctccttagccgttcaagacgaccttttgggacagcggtg

SEQ ID NO: 368280 - DNA, 140 bp, Artificial Sequence
  Synthetic
caccgctgtcccaaaaggtcgtcttgaacggctaaggaggtgacactctgtgagaggactgtctgtgttggagaggccattgggactagggttgttgattgtgccatggactcaagctgtcatatcagcagccagggcct

SEQ ID NO: 368281 - DNA, 140 bp, Artificial Sequence
  Synthetic
atacgccatgctgggtctccaatcttaactttacctcagggtttaaaaaaatactatggtaaggtgctcaggcttttgcaactcaccttagaggaggacactgaaggcctgctagaatggcgtacttgggagtcggccat

SEQ ID NO: 368282 - DNA, 140 bp, Artificial Sequence
  Synthetic
atggccgactcccaagtacgccattctagcaggccttcagtgtcctcctctaaggtgagttgcaaaagcctgagcaccttaccatagtatttttttaaaccctgaggtaaagttaagattggagacccagcatggcgtat

SEQ ID NO: 368283 - DNA, 140 bp, Artificial Sequence
  Synthetic
aggccctggctgctgatatgggcttttgcaactcaccttagaggaggacactgaaggcctgctagaatggtgtaagagaaatcttggtcttgattgtgatgatactttctttcaaaagaggaccttttgggacagcggtg

SEQ ID NO: 368284 - DNA, 140 bp, Artificial Sequence
  Synthetic
caccgctgtcccaaaaggtcctcttttgaaagaaagtatcatcacaatcaagaccaagatttctcttacaccattctagcaggccttcagtgtcctcctctaaggtgagttgcaaaagcccatatcagcagccagggcct

SEQ ID NO: 368285 - DNA, 140 bp, Artificial Sequence
  Synthetic
atacgccatgctgggtctccaatttaaaacaccaagcacattgagcaccacagagtcaacacatgctgtgtcaccaacagctgaaccctttaaatcctatttcgccaaaggcttcctttccgtacttgggagtcggccat

SEQ ID NO: 368286 - DNA, 140 bp, Artificial Sequence
  Synthetic
atggccgactcccaagtacggaaaggaagcctttggcgaaataggatttaaagggttcagctgttggtgacacagcatgtgttgactctgtggtgctcaatgtgcttggtgttttaaattggagacccagcatggcgtat

SEQ ID NO: 368287 - DNA, 140 bp, Artificial Sequence
  Synthetic
aggccctggctgctgatatgtcaccaacagctgaaccctttaaatcctatttcgccaaaggcttcctttcaatagattcaggttacttctcagccaaatgttattcaaaaacatctaattgaccttttgggacagcggtg

SEQ ID NO: 368288 - DNA, 140 bp, Artificial Sequence
  Synthetic
caccgctgtcccaaaaggtcaattagatgtttttgaataacatttggctgagaagtaacctgaatctattgaaaggaagcctttggcgaaataggatttaaagggttcagctgttggtgacatatcagcagccagggcct

SEQ ID NO: 368289 - DNA, 140 bp, Artificial Sequence
  Synthetic
atacgccatgctgggtctccacacctgggcccaagatcaccaacctaaaaaccatcagctgcataaatttgaaggcatcagtcttcaaagaacatagagaggttgaaatcaatgtgcttccgtacttgggagtcggccat

SEQ ID NO: 368290 - DNA, 140 bp, Artificial Sequence
  Synthetic
atggccgactcccaagtacggaagcacattgatttcaacctctctatgttctttgaagactgatgccttcaaatttatgcagctgatggtttttaggttggtgatcttgggcccaggtgtggagacccagcatggcgtat

SEQ ID NO: 368291 - DNA, 140 bp, Artificial Sequence
  Synthetic
aggccctggctgctgatatggaaggcatcagtcttcaaagaacatagagaggttgaaatcaatgtgcttctccctcaagttgcagtcaacctctcaaactgtcacgttactatcaaatcagaccttttgggacagcggtg

SEQ ID NO: 368292 - DNA, 140 bp, Artificial Sequence
  Synthetic
caccgctgtcccaaaaggtctgatttgatagtaacgtgacagtttgagaggttgactgcaacttgagggagaagcacattgatttcaacctctctatgttctttgaagactgatgccttccatatcagcagccagggcct

SEQ ID NO: 368293 - DNA, 140 bp, Artificial Sequence
  Synthetic
atacgccatgctgggtctcctacaggaaaatcattgagaggctgaacaacaaaaaagggaaaaacaaactgcttgatggtgaaagattagctgataggaagattgctgagctgttctccacgtacttgggagtcggccat

SEQ ID NO: 368294 - DNA, 140 bp, Artificial Sequence
  Synthetic
atggccgactcccaagtacgtggagaacagctcagcaatcttcctatcagctaatctttcaccatcaagcagtttgtttttcccttttttgttgttcagcctctcaatgattttcctgtaggagacccagcatggcgtat

SEQ ID NO: 368295 - DNA, 140 bp, Artificial Sequence
  Synthetic
aggccctggctgctgatatgacaaaaaaaacaagctgaatgacagatgtaccctatacaccaactgtgtgataaaagggagagaagttcgtaaaggccaatcaattttgaggcagtataagaccttttgggacagcggtg

SEQ ID NO: 368296 - DNA, 140 bp, Artificial Sequence
  Synthetic
caccgctgtcccaaaaggtcttatactgcctcaaaattgattggcctttacgaacttctctcccttttatcacacagttggtgtatagggtacatctgtcattcagcttgttttttttgtcatatcagcagccagggcct

SEQ ID NO: 368297 - DNA, 140 bp, Artificial Sequence
  Synthetic
aggccctggctgctgatatgtgagcactccaatgaagtggggaaagaaactctatgaactctttgcagatgattctttccaggagaacaggatctatatgcatcctgctgtgttgacagcgaccttttgggacagcggtg

SEQ ID NO: 368298 - DNA, 140 bp, Artificial Sequence
  Synthetic
caccgctgtcccaaaaggtcgctgtcaacacagcaggatgcatatagatcctgttctcctggaaagaatcatctgcaaagagttcatagagtttctttccccacttcattggagtgctcacatatcagcagccagggcct

SEQ ID NO: 368299 - DNA, 140 bp, Artificial Sequence
  Synthetic
atacgccatgctgggtctccctgaagaatctggtgacgactgcatatcaagaactcagctactgaggacagagactgcagagatccatggtgatgattatggtggtccgggcgacaagatcgtacttgggagtcggccat

SEQ ID NO: 368300 - DNA, 140 bp, Artificial Sequence
  Synthetic
atggccgactcccaagtacgatcttgtcgcccggaccaccataatcatcaccatggatctctgcagtctctgtcctcagtagctgagttcttgatatgcagtcgtcaccagattcttcagggagacccagcatggcgtat

SEQ ID NO: 368301 - DNA, 140 bp, Artificial Sequence
  Synthetic
atacgccatgctgggtctcctggggtgttacactatcaatagagtgaagtcattcaagctgtgcaaaaacagtgcaacagggaagagctgtgaaatagacagcaccccagttaaatgcagcgtacttgggagtcggccat

SEQ ID NO: 368302 - DNA, 140 bp, Artificial Sequence
  Synthetic
atggccgactcccaagtacgctgcatttaactggggtgctgtctatttcacagctcttccctgttgcactgtttttgcacagcttgaatgacttcactctattgatagtgtaacaccccaggagacccagcatggcgtat

SEQ ID NO: 368303 - DNA, 140 bp, Artificial Sequence
  Synthetic
aggccctggctgctgatatgcaggggcagtgatgaaaatccacgcggcccagtgagccatgaacatgtggaatggtgcagagaatttgtcaaaggcaagtatatcatggccttcaatccagaccttttgggacagcggtg

SEQ ID NO: 368304 - DNA, 140 bp, Artificial Sequence
  Synthetic
caccgctgtcccaaaaggtctggattgaaggccatgatatacttgcctttgacaaattctctgcaccattccacatgttcatggctcactgggccgcgtggattttcatcactgcccctgcatatcagcagccagggcct

SEQ ID NO: 368305 - DNA, 140 bp, Artificial Sequence
  Synthetic
aggccctggctgctgatatgtatccaggggctcggaggttgtcttggatgcatgcgattcaagctgtgaagtaatgatacctaagggcacaggtgacatcctagtagactgttcaggtgggaccttttgggacagcggtg

SEQ ID NO: 368306 - DNA, 140 bp, Artificial Sequence
  Synthetic
caccgctgtcccaaaaggtcccacctgaacagtctactaggatgtcacctgtgcccttaggtatcattacttcacagcttgaatcgcatgcatccaagacaacctccgagcccctggatacatatcagcagccagggcct

SEQ ID NO: 368307 - DNA, 140 bp, Artificial Sequence
  Synthetic
atacgccatgctgggtctccttccattattaggtaaaatggctatttatatttgcagaatgtcgaatcaccctaagacaaccatggctttcctcttttggttcagttttggctatgtgatcgtacttgggagtcggccat

SEQ ID NO: 368308 - DNA, 140 bp, Artificial Sequence
  Synthetic
atggccgactcccaagtacgatcacatagccaaaactgaaccaaaagaggaaagccatggttgtcttagggtgattcgacattctgcaaatataaatagccattttacctaataatggaaggagacccagcatggcgtat

SEQ ID NO: 368309 - DNA, 140 bp, Artificial Sequence
  Synthetic
aggccctggctgctgatatgcctaagacaaccatggctttcctcttttggttcagttttggctatgtgataacctgtatactctgcaaggccattttctacttattaataattgttggaagaccttttgggacagcggtg

SEQ ID NO: 368310 - DNA, 140 bp, Artificial Sequence
  Synthetic
caccgctgtcccaaaaggtcttccaacaattattaataagtagaaaatggccttgcagagtatacaggttatcacatagccaaaactgaaccaaaagaggaaagccatggttgtcttaggcatatcagcagccagggcct

SEQ ID NO: 368311 - DNA, 140 bp, Artificial Sequence
  Synthetic
atacgccatgctgggtctcccgaactggggaagcagccaagggggaccaaaaaaatgaaaaaggcactcctgagcactccaatgaagtgggggaagaaactttatgagctctttgctgatcgtacttgggagtcggccat

SEQ ID NO: 368312 - DNA, 140 bp, Artificial Sequence
  Synthetic
atggccgactcccaagtacgatcagcaaagagctcataaagtttcttcccccacttcattggagtgctcaggagtgcctttttcatttttttggtcccccttggctgcttccccagttcgggagacccagcatggcgtat

SEQ ID NO: 368313 - DNA, 140 bp, Artificial Sequence
  Synthetic
aggccctggctgctgatatgccttaactgcagttacaacatatgtccctattgtgcatctagactaacctcagatgggcttgctaggcatgtgacacaatgccctaagcggaaggagaaggaccttttgggacagcggtg

SEQ ID NO: 368314 - DNA, 140 bp, Artificial Sequence
  Synthetic
caccgctgtcccaaaaggtccttctccttccgcttagggcattgtgtcacatgcctagcaagcccatctgaggttagtctagatgcacaatagggacatatgttgtaactgcagttaaggcatatcagcagccagggcct

SEQ ID NO: 368315 - DNA, 140 bp, Artificial Sequence
  Synthetic
atacgccatgctgggtctccaagaaagctgttgcaggtgtcggagtccactggtgttgcattaaaaagaagcagctggctgattgtgctgcttgtgctgttcgcagtttcattatcacctcgtacttgggagtcggccat

SEQ ID NO: 368316 - DNA, 140 bp, Artificial Sequence
  Synthetic
atggccgactcccaagtacgaggtgataatgaaactgcgaacagcacaagcagcacaatcagccagctgcttctttttaatgcaacaccagtggactccgacacctgcaacagctttcttggagacccagcatggcgtat

SEQ ID NO: 368317 - DNA, 140 bp, Artificial Sequence
  Synthetic
aggccctggctgctgatatggcagctggctgattgtgctgcttgtgctgttcgcagtttcattatcacctgttcaatcagcacccattggtcatgggaagacaattgaaacataccaggcgaccttttgggacagcggtg

SEQ ID NO: 368318 - DNA, 140 bp, Artificial Sequence
  Synthetic
caccgctgtcccaaaaggtcgcctggtatgtttcaattgtcttcccatgaccaatgggtgctgattgaacaggtgataatgaaactgcgaacagcacaagcagcacaatcagccagctgccatatcagcagccagggcct

SEQ ID NO: 368319 - DNA, 140 bp, Artificial Sequence
  Synthetic
atacgccatgctgggtctccttatagtctcttgtctgatgaaagggctggttgacagtattggcaacatcttcttccctgggctgaccatctgcaagacatgctctataggtagtatcaacgtacttgggagtcggccat

SEQ ID NO: 368320 - DNA, 140 bp, Artificial Sequence
  Synthetic
atggccgactcccaagtacgttgatactacctatagagcatgtcttgcagatggtcagcccagggaagaagatgttgccaatactgtcaaccagccctttcatcagacaagagactataaggagacccagcatggcgtat

SEQ ID NO: 368321 - DNA, 140 bp, Artificial Sequence
  Synthetic
aggccctggctgctgatatgttcttccctgggctgaccatctgcaagacatgctctataggtagtatcaatggctttgaaattgagtctcacaagtgctattgtagcttactttgttgccgaccttttgggacagcggtg

SEQ ID NO: 368322 - DNA, 140 bp, Artificial Sequence
  Synthetic
caccgctgtcccaaaaggtcggcaacaaagtaagctacaatagcacttgtgagactcaatttcaaagccattgatactacctatagagcatgtcttgcagatggtcagcccagggaagaacatatcagcagccagggcct

SEQ ID NO: 368323 - DNA, 140 bp, Artificial Sequence
  Synthetic
aggccctggctgctgatatggtttattttaactgcttatgtaatgctgttttgctaattttatcttgctatctttcatttcaaatacttaaagggctgtgcggcaacgatatctttgagagaccttttgggacagcggtg

SEQ ID NO: 368324 - DNA, 140 bp, Artificial Sequence
  Synthetic
caccgctgtcccaaaaggtctctcaaagatatcgttgccgcacagccctttaagtatttgaaatgaaagatagcaagataaaattagcaaaacagcattacataagcagttaaaataaaccatatcagcagccagggcct

SEQ ID NO: 368325 - DNA, 140 bp, Artificial Sequence
  Synthetic
atacgccatgctgggtctcctctcaaagaaatacttgcggcacgtcagtacgtaagtgttaactttgagtgtgcattaagggcaacttgtaggcaacacgatgttctgccttaagctcgtcgtacttgggagtcggccat

SEQ ID NO: 368326 - DNA, 140 bp, Artificial Sequence
  Synthetic
atggccgactcccaagtacgacgagcttaaggcagaacatcgtgttgcctacaagttgcccttaatgcacactcaaagttaacacttacgtactgacgtgccgcaagtatttctttgagaggagacccagcatggcgtat

SEQ ID NO: 368327 - DNA, 140 bp, Artificial Sequence
  Synthetic
atacgccatgctgggtctccagcatctgcaaaaaaaggaaaacaggaagtaatgtcatgctcgcagtctgcaagcgcatgtgcttcagagcaactatggaagtgagcaataaggccctaccgtacttgggagtcggccat

SEQ ID NO: 368328 - DNA, 140 bp, Artificial Sequence
  Synthetic
atggccgactcccaagtacggtagggccttattgctcacttccatagttgctctgaagcacatgcgcttgcagactgcgagcatgacattacttcctgttttcctttttttgcagatgctggagacccagcatggcgtat

SEQ ID NO: 368329 - DNA, 140 bp, Artificial Sequence
  Synthetic
aggccctggctgctgatatgcaagcgcatgtgcttcagagcaactatggaagtgagcaataaggccctacttatccgtagcatcatcaacaccacttttgttgtgtgcatattgatattagaccttttgggacagcggtg

SEQ ID NO: 368330 - DNA, 140 bp, Artificial Sequence
  Synthetic
caccgctgtcccaaaaggtctaatatcaatatgcacacaacaaaagtggtgttgatgatgctacggataagtagggccttattgctcacttccatagttgctctgaagcacatgcgcttgcatatcagcagccagggcct

SEQ ID NO: 368331 - DNA, 140 bp, Artificial Sequence
  Synthetic
atacgccatgctgggtctccatttcaactattctgaatagtacaactcctgcaccaggaccatcaacagatactaccatggagacagttccaagcacggccgacagcatgctggaaacaccgtacttgggagtcggccat

SEQ ID NO: 368332 - DNA, 140 bp, Artificial Sequence
  Synthetic
atggccgactcccaagtacggtgtttccagcatgctgtcggccgtgcttggaactgtctccatggtagtatctgttgatggtcctggtgcaggagttgtactattcagaatagttgaaatggagacccagcatggcgtat

SEQ ID NO: 368333 - DNA, 140 bp, Artificial Sequence
  Synthetic
aggccctggctgctgatatgtactaccatggagacagttccaagcacggccgacagcatgctggaaacacaggttaccacggacagtggctctggtgagcccagcacagagcctacaaccgaccttttgggacagcggtg

SEQ ID NO: 368334 - DNA, 140 bp, Artificial Sequence
  Synthetic
caccgctgtcccaaaaggtcggttgtaggctctgtgctgggctcaccagagccactgtccgtggtaacctgtgtttccagcatgctgtcggccgtgcttggaactgtctccatggtagtacatatcagcagccagggcct

SEQ ID NO: 368335 - DNA, 140 bp, Artificial Sequence
  Synthetic
atacgccatgctgggtctccagaaggcccctgttcctggatagtatagttaaaggcacgaaaaatctgttaaactccacaagtttagaaacaagcttgtcgattgaggcaccatggggggcgtacttgggagtcggccat

SEQ ID NO: 368336 - DNA, 140 bp, Artificial Sequence
  Synthetic
atggccgactcccaagtacgccccccatggtgcctcaatcgacaagcttgtttctaaacttgtggagtttaacagatttttcgtgcctttaactatactatccaggaacaggggccttctggagacccagcatggcgtat

SEQ ID NO: 368337 - DNA, 140 bp, Artificial Sequence
  Synthetic
atacgccatgctgggtctccaacaaaaacacacatgactcagaacacaagatccacagcagacccagacaccaccacccccaacaccaccacatcggttgaaccaaccactatcccaccacgtacttgggagtcggccat

SEQ ID NO: 368338 - DNA, 140 bp, Artificial Sequence
  Synthetic
atggccgactcccaagtacgtggtgggatagtggttggttcaaccgatgtggtggtgttgggggtggtggtgtctgggtctgctgtggatcttgtgttctgagtcatgtgtgtttttgttggagacccagcatggcgtat

SEQ ID NO: 368339 - DNA, 140 bp, Artificial Sequence
  Synthetic
aggccctggctgctgatatgccaccacccccaacaccaccacatcggttgaaccaaccactatcccaccaacgtcaccgatcctacaagcaactccaacacccggccacggcaaggcaccgaccttttgggacagcggtg

SEQ ID NO: 368340 - DNA, 140 bp, Artificial Sequence
  Synthetic
caccgctgtcccaaaaggtcggtgccttgccgtggccgggtgttggagttgcttgtaggatcggtgacgttggtgggatagtggttggttcaaccgatgtggtggtgttgggggtggtggcatatcagcagccagggcct

SEQ ID NO: 368341 - DNA, 140 bp, Artificial Sequence
  Synthetic
atacgccatgctgggtctccgcactgaagcaggtcagacaacaccagcaacatccacaactgaggcggcttcagccccaagcagctcatcgacagctgagaacaacacgatgtttcaacccgtacttgggagtcggccat

SEQ ID NO: 368342 - DNA, 140 bp, Artificial Sequence
  Synthetic
atggccgactcccaagtacgggttgaaacatcgtgttgttctcagctgtcgatgagctgcttggggctgaagccgcctcagttgtggatgttgctggtgttgtctgacctgcttcagtgcggagacccagcatggcgtat

SEQ ID NO: 368343 - DNA, 140 bp, Artificial Sequence
  Synthetic
atacgccatgctgggtctccgtcatggacttgtctcagatgtactcccctgtcttcgagtacttatcgggtgacagacaagtagaagagtggcccaaagcaacctgcacaggtgactgcccgtacttgggagtcggccat

SEQ ID NO: 368344 - DNA, 140 bp, Artificial Sequence
  Synthetic
atggccgactcccaagtacgggcagtcacctgtgcaggttgctttgggccactcttctacttgtctgtcacccgataagtactcgaagacaggggagtacatctgagacaagtccatgacggagacccagcatggcgtat

SEQ ID NO: 368345 - DNA, 140 bp, Artificial Sequence
  Synthetic
aggccctggctgctgatatgtgacagacaagtagaagagtggcccaaagcaacctgcacaggtgactgcccagaaagatgtggctgcacatcatcaacctgcttacataaagaatggcccgaccttttgggacagcggtg

SEQ ID NO: 368346 - DNA, 140 bp, Artificial Sequence
  Synthetic
caccgctgtcccaaaaggtcgggccattctttatgtaagcaggttgatgatgtgcagccacatctttctgggcagtcacctgtgcaggttgctttgggccactcttctacttgtctgtcacatatcagcagccagggcct

SEQ ID NO: 368347 - DNA, 140 bp, Artificial Sequence
  Synthetic
atacgccatgctgggtctccgtaccagtgactacacctgtcaccacaacctttacacctataaacccaacgaatagatccaagagggagtctaaagtgcaaataattttaacctttcctccgtacttgggagtcggccat

SEQ ID NO: 368348 - DNA, 140 bp, Artificial Sequence
  Synthetic
atggccgactcccaagtacggaggaaaggttaaaattatttgcactttagactccctcttggatctattcgttgggtttataggtgtaaaggttgtggtgacaggtgtagtcactggtacggagacccagcatggcgtat

SEQ ID NO: 368349 - DNA, 140 bp, Artificial Sequence
  Synthetic
atacgccatgctgggtctcctggctgcacctgttgtggattagatgtgaaagacctatttacagattatatgttcgtcaagtggaaagttgattacattaaaacagaggccatagtgtgtcgtacttgggagtcggccat

SEQ ID NO: 368350 - DNA, 140 bp, Artificial Sequence
  Synthetic
atggccgactcccaagtacgacacactatggcctctgttttaatgtaatcaactttccacttgacgaacatataatctgtaaataggtctttcacatctaatccacaacaggtgcagccaggagacccagcatggcgtat

SEQ ID NO: 368351 - DNA, 140 bp, Artificial Sequence
  Synthetic
aggccctggctgctgatatgtgttcgtcaagtggaaagttgattacattaaaacagaggccatagtgtgtgtagaactcaccagtcaggaaaggcagtgtagcttggttgaggcgggcacgaccttttgggacagcggtg

SEQ ID NO: 368352 - DNA, 140 bp, Artificial Sequence
  Synthetic
caccgctgtcccaaaaggtcgtgcccgcctcaaccaagctacactgcctttcctgactggtgagttctacacacactatggcctctgttttaatgtaatcaactttccacttgacgaacacatatcagcagccagggcct

SEQ ID NO: 368353 - DNA, 140 bp, Artificial Sequence
  Synthetic
atacgccatgctgggtctccacaggtatgtgatgatacctatttcaatgagaggatagaagaattttttataactgggaaaggttacttcaatgatgtacttcagttcaagttgcatgaccgtacttgggagtcggccat

SEQ ID NO: 368354 - DNA, 140 bp, Artificial Sequence
  Synthetic
atggccgactcccaagtacggtcatgcaacttgaactgaagtacatcattgaagtaacctttcccagttataaaaaattcttctatcctctcattgaaataggtatcatcacatacctgtggagacccagcatggcgtat

SEQ ID NO: 368355 - DNA, 140 bp, Artificial Sequence
  Synthetic
atacgccatgctgggtctcctacaacaaaagctccctcctgaaataatcacattgcatcctaggattgaagaaggtttttttgacctgatgcatgtacaaaaagtgctgtcagcaagcaccgtacttgggagtcggccat

SEQ ID NO: 368356 - DNA, 140 bp, Artificial Sequence
  Synthetic
atggccgactcccaagtacggtgcttgctgacagcactttttgtacatgcatcaggtcaaaaaaaccttcttcaatcctaggatgcaatgtgattatttcaggagggagcttttgttgtaggagacccagcatggcgtat

SEQ ID NO: 368357 - DNA, 140 bp, Artificial Sequence
  Synthetic
atacgccatgctgggtctcctctaccacatcggaaatttattaaaaggggataaagtgaacggacacctaattcataaaattgagccgcacttcaatacttcctggatgtcctgggatggcgtacttgggagtcggccat

SEQ ID NO: 368358 - DNA, 140 bp, Artificial Sequence
  Synthetic
atggccgactcccaagtacgccatcccaggacatccaggaagtattgaagtgcggctcaattttatgaattaggtgtccgttcactttatccccttttaataaatttccgatgtggtagaggagacccagcatggcgtat

SEQ ID NO: 368359 - DNA, 140 bp, Artificial Sequence
  Synthetic
aggccctggctgctgatatgatcctgatgatgctgctttaggatctggacacaccaagtccattctcaaccttcggacaaacactgagaccaacaatccgtgtgccaagacaattgttaagaccttttgggacagcggtg

SEQ ID NO: 368360 - DNA, 140 bp, Artificial Sequence
  Synthetic
caccgctgtcccaaaaggtcttaacaattgtcttggcacacggattgttggtctcagtgtttgtccgaaggttgagaatggacttggtgtgtccagatcctaaagcagcatcatcaggatcatatcagcagccagggcct

SEQ ID NO: 368361 - DNA, 140 bp, Artificial Sequence
  Synthetic
atacgccatgctgggtctccaggaacatagcgagcttgagatcaatgtgctcatacctcaggttgctgttaacctttcaaactgtcttgtttcaatcaagtcacatgtctgtgactactccgtacttgggagtcggccat

SEQ ID NO: 368362 - DNA, 140 bp, Artificial Sequence
  Synthetic
atggccgactcccaagtacggagtagtcacagacatgtgacttgattgaaacaagacagtttgaaaggttaacagcaacctgaggtatgagcacattgatctcaagctcgctatgttcctggagacccagcatggcgtat

SEQ ID NO: 368363 - DNA, 140 bp, Artificial Sequence
  Synthetic
aggccctggctgctgatatgaacctttcaaactgtcttgtttcaatcaagtcacatgtctgtgactactccctagacactgacggagcaatacgcctcccgaaagtcgcatacaacgggggaccttttgggacagcggtg

SEQ ID NO: 368364 - DNA, 140 bp, Artificial Sequence
  Synthetic
caccgctgtcccaaaaggtcccccgttgtatgcgactttcgggaggcgtattgctccgtcagtgtctagggagtagtcacagacatgtgacttgattgaaacaagacagtttgaaaggttcatatcagcagccagggcct

SEQ ID NO: 368365 - DNA, 140 bp, Artificial Sequence
  Synthetic
atacgccatgctgggtctccgcgcaggagaaatcactgtactggtagaagttgctgatatggagttacacacaaagaagatcgaaataacaggccttaaatttgcaagcctgacttgcaccgtacttgggagtcggccat

SEQ ID NO: 368366 - DNA, 140 bp, Artificial Sequence
  Synthetic
atggccgactcccaagtacggtgcaagtcaggcttgcaaatttaaggcctgttatttcgatcttctttgtgtgtaactccatatcagcaacttctaccagtacagtgatttctcctgcgcggagacccagcatggcgtat

SEQ ID NO: 368367 - DNA, 140 bp, Artificial Sequence
  Synthetic
atacgccatgctgggtctccaatgataggtgtgcactaatcacaaactgtgtcattaaaggaagagaagttcgaaaggggcagtcaactttgagacagtacaaaacagaaataagaattgcgtacttgggagtcggccat

SEQ ID NO: 368368 - DNA, 140 bp, Artificial Sequence
  Synthetic
atggccgactcccaagtacgcaattcttatttctgttttgtactgtctcaaagttgactgcccctttcgaacttctcttcctttaatgacacagtttgtgattagtgcacacctatcattggagacccagcatggcgtat

SEQ ID NO: 368369 - DNA, 140 bp, Artificial Sequence
  Synthetic
aggccctggctgctgatatgtcgaaaggggcagtcaactttgagacagtacaaaacagaaataagaattgggcaaacactcatgggctcaagaagattgcttgcagaaggagtgagcaatgaccttttgggacagcggtg

SEQ ID NO: 368370 - DNA, 140 bp, Artificial Sequence
  Synthetic
caccgctgtcccaaaaggtcattgctcactccttctgcaagcaatcttcttgagcccatgagtgtttgcccaattcttatttctgttttgtactgtctcaaagttgactgcccctttcgacatatcagcagccagggcct

SEQ ID NO: 368371 - DNA, 140 bp, Artificial Sequence
  Synthetic
atacgccatgctgggtctccgtagttgcagccagctcaagtctcatggcaaggaaacttgagtttggaacagacagtacattcaaagctttctcagccatgcctaaaacttccttatgctcgtacttgggagtcggccat

SEQ ID NO: 368372 - DNA, 140 bp, Artificial Sequence
  Synthetic
atggccgactcccaagtacgagcataaggaagttttaggcatggctgagaaagctttgaatgtactgtctgttccaaactcaagtttccttgccatgagacttgagctggctgcaactacggagacccagcatggcgtat

SEQ ID NO: 368373 - DNA, 140 bp, Artificial Sequence
  Synthetic
atacgccatgctgggtctcctgaagatagctacggtgggcctggagaaaaaataacaatctgcaacggctccacaatcgtggaccaaaggcttggtagcgaactaggttgctacacaattcgtacttgggagtcggccat

SEQ ID NO: 368374 - DNA, 140 bp, Artificial Sequence
  Synthetic
atggccgactcccaagtacgaattgtgtagcaacctagttcgctaccaagcctttggtccacgattgtggagccgttgcagattgttattttttctccaggcccaccgtagctatcttcaggagacccagcatggcgtat

SEQ ID NO: 368375 - DNA, 140 bp, Artificial Sequence
  Synthetic
atacgccatgctgggtctcctctacattgtcgaaagggagtactgtaagagctgcagtaaagaagacacacagaaatgtgttaacacaaaacttgagcaaccacagagcattttgatcgacgtacttgggagtcggccat

SEQ ID NO: 368376 - DNA, 140 bp, Artificial Sequence
  Synthetic
atggccgactcccaagtacgtcgatcaaaatgctctgtggttgctcaagttttgtgttaacacatttctgtgtgtcttctttactgcagctcttacagtactccctttcgacaatgtagaggagacccagcatggcgtat

SEQ ID NO: 368377 - DNA, 140 bp, Artificial Sequence
  Synthetic
atacgccatgctgggtctcccaagttgctggttagagtcagttaaaagtttcttttatggtctaaagaacatgcttagtggcatttttggcaatgtttttgtaggcattttcttatttctcgtacttgggagtcggccat

SEQ ID NO: 368378 - DNA, 140 bp, Artificial Sequence
  Synthetic
atggccgactcccaagtacgagaaataagaaaatgcctacaaaaacattgccaaaaatgccactaagcatgttctttagaccataaaagaaacttttaactgactctaaccagcaacttgggagacccagcatggcgtat

SEQ ID NO: 368379 - DNA, 140 bp, Artificial Sequence
  Synthetic
aggccctggctgctgatatgattgtcctggatgtgtgtgacaccagttgtgagttgatgatacctaaaggcactggagacatattggtggactgctcaggaggacagcagcacttcttgcgaccttttgggacagcggtg

SEQ ID NO: 368380 - DNA, 140 bp, Artificial Sequence
  Synthetic
caccgctgtcccaaaaggtcgcaagaagtgctgctgtcctcctgagcagtccaccaatatgtctccagtgcctttaggtatcatcaactcacaactggtgtcacacacatccaggacaatcatatcagcagccagggcct

SEQ ID NO: 368381 - DNA, 140 bp, Artificial Sequence
  Synthetic
atacgccatgctgggtctccatggcaatatatatctgcaggatgtcgaaccatccaaagaccaccatggcttttttgttctggttcagttttggctatgtcatcacatgcgtagtatgcacgtacttgggagtcggccat

SEQ ID NO: 368382 - DNA, 140 bp, Artificial Sequence
  Synthetic
atggccgactcccaagtacgtgcatactacgcatgtgatgacatagccaaaactgaaccagaacaaaaaagccatggtggtctttggatggttcgacatcctgcagatatatattgccatggagacccagcatggcgtat

SEQ ID NO: 368383 - DNA, 140 bp, Artificial Sequence
  Synthetic
aggccctggctgctgatatgttttttgttctggttcagttttggctatgtcatcacatgcgtagtatgcaaagtgctcttctatctgctaattgtcatcgggacactaggaaagaaacttgaccttttgggacagcggtg

SEQ ID NO: 368384 - DNA, 140 bp, Artificial Sequence
  Synthetic
caccgctgtcccaaaaggtcaagtttctttcctagtgtcccgatgacaattagcagatagaagagcactttgcatactacgcatgtgatgacatagccaaaactgaaccagaacaaaaaacatatcagcagccagggcct

SEQ ID NO: 368385 - DNA, 140 bp, Artificial Sequence
  Synthetic
atacgccatgctgggtctccccctgtcaatgcaatagatgctgaaatgcacgagctcaattgcaattacaatatatgcccatactgtgcgtccagactgacttcagatggactagttagacgtacttgggagtcggccat

SEQ ID NO: 368386 - DNA, 140 bp, Artificial Sequence
  Synthetic
atggccgactcccaagtacgtctaactagtccatctgaagtcagtctggacgcacagtatgggcatatattgtaattgcaattgagctcgtgcatttcagcatctattgcattgacagggggagacccagcatggcgtat

SEQ ID NO: 368387 - DNA, 140 bp, Artificial Sequence
  Synthetic
aggccctggctgctgatatgatatatgcccatactgtgcgtccagactgacttcagatggactagttagacatgtgactcaatgtcccaaaaggaaggaaaaggtcgaggagactgagctgaccttttgggacagcggtg

SEQ ID NO: 368388 - DNA, 140 bp, Artificial Sequence
  Synthetic
caccgctgtcccaaaaggtcagctcagtctcctcgaccttttccttccttttgggacattgagtcacatgtctaactagtccatctgaagtcagtctggacgcacagtatgggcatatatcatatcagcagccagggcct

SEQ ID NO: 368389 - DNA, 140 bp, Artificial Sequence
  Synthetic
atacgccatgctgggtctcctgtcagagtcaacagggatggctctaaagagaagttgctggatgaccacactcctcattctgctagtagtttcattgtctccagttcaatctgctccagtcgtacttgggagtcggccat

SEQ ID NO: 368390 - DNA, 140 bp, Artificial Sequence
  Synthetic
atggccgactcccaagtacgactggagcagattgaactggagacaatgaaactactagcagaatgaggagtgtggtcatccagcaacttctctttagagccatccctgttgactctgacaggagacccagcatggcgtat

SEQ ID NO: 368391 - DNA, 140 bp, Artificial Sequence
  Synthetic
aggccctggctgctgatatgctcctcattctgctagtagtttcattgtctccagttcaatctgctccagtaggtcaggagaaagcaatcgaagtctaccaggtgagagaaagttacacaagaccttttgggacagcggtg

SEQ ID NO: 368392 - DNA, 140 bp, Artificial Sequence
  Synthetic
caccgctgtcccaaaaggtcttgtgtaactttctctcacctggtagacttcgattgctttctcctgacctactggagcagattgaactggagacaatgaaactactagcagaatgaggagcatatcagcagccagggcct

SEQ ID NO: 368393 - DNA, 140 bp, Artificial Sequence
  Synthetic
atacgccatgctgggtctccgtaaagggtttgattgacggtatcggcaacagttttttccctgggctttctgtctgcaaaacatgctctattggcagcataaatggatttgaaatagagtcgtacttgggagtcggccat

SEQ ID NO: 368394 - DNA, 140 bp, Artificial Sequence
  Synthetic
atggccgactcccaagtacgactctatttcaaatccatttatgctgccaatagagcatgttttgcagacagaaagcccagggaaaaaactgttgccgataccgtcaatcaaaccctttacggagacccagcatggcgtat

SEQ ID NO: 368395 - DNA, 140 bp, Artificial Sequence
  Synthetic
aggccctggctgctgatatgtgtctgcaaaacatgctctattggcagcataaatggatttgaaatagagtcccacaaatgctattgtagtctgttctgttgtccttactgcagagcttgcgaccttttgggacagcggtg

SEQ ID NO: 368396 - DNA, 140 bp, Artificial Sequence
  Synthetic
caccgctgtcccaaaaggtcgcaagctctgcagtaaggacaacagaacagactacaatagcatttgtgggactctatttcaaatccatttatgctgccaatagagcatgttttgcagacacatatcagcagccagggcct

SEQ ID NO: 368397 - DNA, 140 bp, Artificial Sequence
  Synthetic
atacgccatgctgggtctccgaaagtgggtagcaatgttatgctggctgtctgtaagcgtatgtgctttaaggcgactgttgaagcaagcaactcagccctgctcatcagaagcatcatacgtacttgggagtcggccat

SEQ ID NO: 368398 - DNA, 140 bp, Artificial Sequence
  Synthetic
atggccgactcccaagtacgtatgatgcttctgatgagcagggctgagttgcttgcttcaacagtcgccttaaagcacatacgcttacagacagccagcataacattgctacccactttcggagacccagcatggcgtat

SEQ ID NO: 368399 - DNA, 140 bp, Artificial Sequence
  Synthetic
aggccctggctgctgatatgcatcgagatgtactgagtgcctcaccaacataaaaaaaactgttgacgagactgccaacctgtctgagaagattgagctgcttgcatataatcttcaactgaccttttgggacagcggtg

SEQ ID NO: 368400 - DNA, 140 bp, Artificial Sequence
  Synthetic
caccgctgtcccaaaaggtcagttgaagattatatgcaagcagctcaatcttctcagacaggttggcagtctcgtcaacagttttttttatgttggtgaggcactcagtacatctcgatgcatatcagcagccagggcct

SEQ ID NO: 368401 - DNA, 140 bp, Artificial Sequence
  Synthetic
atacgccatgctgggtctcccacatctgctgtcgacatggagaatctaccagcaggcatctgggagagagaagaagaccttacaaacttctgccatcaagaatgccaagtgacagagactcgtacttgggagtcggccat

SEQ ID NO: 368402 - DNA, 140 bp, Artificial Sequence
  Synthetic
atggccgactcccaagtacgagtctctgtcacttggcattcttgatggcagaagtttgtaaggtcttcttctctctcccagatgcctgctggtagattctccatgtcgacagcagatgtgggagacccagcatggcgtat

SEQ ID NO: 368403 - DNA, 140 bp, Artificial Sequence
  Synthetic
aggccctggctgctgatatgaacaggccttgccaagcttgcagagactgagggaaagggagtttttgatgaagccaaaaagactgtggaggccctcaatgggtatctggacaagcacaaggaccttttgggacagcggtg

SEQ ID NO: 368404 - DNA, 140 bp, Artificial Sequence
  Synthetic
caccgctgtcccaaaaggtccttgtgcttgtccagatacccattgagggcctccacagtctttttggcttcatcaaaaactccctttccctcagtctctgcaagcttggcaaggcctgttcatatcagcagccagggcct

SEQ ID NO: 368405 - DNA, 140 bp, Artificial Sequence
  Synthetic
atacgccatgctgggtctccagacaagcctgtcgattgaggccccatggggagcaatcaatgttcagtcaacttttaaaccaacagtttcagctgccaacatagcacttagctggagttccgtacttgggagtcggccat

SEQ ID NO: 368406 - DNA, 140 bp, Artificial Sequence
  Synthetic
atggccgactcccaagtacggaactccagctaagtgctatgttggcagctgaaactgttggtttaaaagttgactgaacattgattgctccccatggggcctcaatcgacaggcttgtctggagacccagcatggcgtat

SEQ ID NO: 368407 - DNA, 140 bp, Artificial Sequence
  Synthetic
aggccctggctgctgatatgacttttaaaccaacagtttcagctgccaacatagcacttagctggagttcagttgaacacaggggcaacaaaatcctagtttcgggcaggtcagagtcaagaccttttgggacagcggtg

SEQ ID NO: 368408 - DNA, 140 bp, Artificial Sequence
  Synthetic
caccgctgtcccaaaaggtcttgactctgacctgcccgaaactaggattttgttgcccctgtgttcaactgaactccagctaagtgctatgttggcagctgaaactgttggtttaaaagtcatatcagcagccagggcct

SEQ ID NO: 368409 - DNA, 140 bp, Artificial Sequence
  Synthetic
atacgccatgctgggtctccagttgaacacaggggcaacaaaatcctagtttcgggcaggtcagagtcaattatgaaactggaagaacggaccggcatcagctggagcctaggtgtagagcgtacttgggagtcggccat

SEQ ID NO: 368410 - DNA, 140 bp, Artificial Sequence
  Synthetic
atggccgactcccaagtacgctctacacctaggctccagctgatgccggtccgttcttccagtttcataattgactctgacctgcccgaaactaggattttgttgcccctgtgttcaactggagacccagcatggcgtat

SEQ ID NO: 368411 - DNA, 140 bp, Artificial Sequence
  Synthetic
atacgccatgctgggtctccaatgtattctcctgtctttgagtatctgtcaggtgatagacaagtagaagagtggccaaaggccacttgcacaggcgactgcccggagagatgtggctgccgtacttgggagtcggccat

SEQ ID NO: 368412 - DNA, 140 bp, Artificial Sequence
  Synthetic
atggccgactcccaagtacggcagccacatctctccgggcagtcgcctgtgcaagtggcctttggccactcttctacttgtctatcacctgacagatactcaaagacaggagaatacattggagacccagcatggcgtat

SEQ ID NO: 368413 - DNA, 140 bp, Artificial Sequence
  Synthetic
aggccctggctgctgatatgagtggccaaaggccacttgcacaggcgactgcccggagagatgtggctgcacctcctcaacctgcttgcataaagaatggccgcactcgagaaactggcggaccttttgggacagcggtg

SEQ ID NO: 368414 - DNA, 140 bp, Artificial Sequence
  Synthetic
caccgctgtcccaaaaggtccgccagtttctcgagtgcggccattctttatgcaagcaggttgaggaggtgcagccacatctctccgggcagtcgcctgtgcaagtggcctttggccactcatatcagcagccagggcct

SEQ ID NO: 368415 - DNA, 140 bp, Artificial Sequence
  Synthetic
atacgccatgctgggtctcctctcaaagaaatacttgcggcacgtcagtacgtaagtgttaactttgagtgagtgacttgagcattttagacgcatcatgcccgtcaacactatgcacaccgtacttgggagtcggccat

SEQ ID NO: 368416 - DNA, 140 bp, Artificial Sequence
  Synthetic
atggccgactcccaagtacggtgtgcatagtgttgacgggcatgatgcgtctaaaatgctcaagtcactcactcaaagttaacacttacgtactgacgtgccgcaagtatttctttgagaggagacccagcatggcgtat

SEQ ID NO: 368417 - DNA, 140 bp, Artificial Sequence
  Synthetic
aggccctggctgctgatatgagacagtacatttaaagctttctcggccatgcctaaaacttctttatgtttctacattgttgaaagggaacactgtaagagctgcaatgaagaagacacagaccttttgggacagcggtg

SEQ ID NO: 368418 - DNA, 140 bp, Artificial Sequence
  Synthetic
caccgctgtcccaaaaggtctgtgtcttcttcattgcagctcttacagtgttccctttcaacaatgtagaaacataaagaagttttaggcatggccgagaaagctttaaatgtactgtctcatatcagcagccagggcct

SEQ ID NO: 368419 - DNA, 140 bp, Artificial Sequence
  Synthetic
atacgccatgctgggtctccgactggatgttagagaccttttcacggactacatgatggtcaagtggaaagtggaatatgtaaaaacagaagctataatgtgtgttgagctaactagtcacgtacttgggagtcggccat

SEQ ID NO: 368420 - DNA, 140 bp, Artificial Sequence
  Synthetic
atggccgactcccaagtacgtgactagttagctcaacacacattatagcttctgtttttacatattccactttccacttgaccatcatgtagtccgtgaaaaggtctctaacatccagtcggagacccagcatggcgtat

SEQ ID NO: 368421 - DNA, 140 bp, Artificial Sequence
  Synthetic
aggccctggctgctgatatggtggaatatgtaaaaacagaagctataatgtgtgttgagctaactagtcaggaaaggcagtgtagtttaattgaggcaggtacaaggtttaacctaggccgaccttttgggacagcggtg

SEQ ID NO: 368422 - DNA, 140 bp, Artificial Sequence
  Synthetic
caccgctgtcccaaaaggtcggcctaggttaaaccttgtacctgcctcaattaaactacactgcctttcctgactagttagctcaacacacattatagcttctgtttttacatattccaccatatcagcagccagggcct

SEQ ID NO: 368423 - DNA, 140 bp, Artificial Sequence
  Synthetic
aggccctggctgctgatatgccatgattgcaagattcaattatacttattttacttgcttatctaacattattttactaacctttctctattttctcctgtcttaaacacttaaagggctgaccttttgggacagcggtg

SEQ ID NO: 368424 - DNA, 140 bp, Artificial Sequence
  Synthetic
caccgctgtcccaaaaggtcagccctttaagtgtttaagacaggagaaaatagagaaaggttagtaaaataatgttagataagcaagtaaaataagtataattgaatcttgcaatcatggcatatcagcagccagggcct

SEQ ID NO: 368425 - DNA, 140 bp, Artificial Sequence
  Synthetic
atacgccatgctgggtctcctccgaaatcgttacactgcaccctaagatagaggaaggattctttgatttgatgcatgtgcaaaaagtactattctgcaagtacagtttgcaagctacaacgtacttgggagtcggccat

SEQ ID NO: 368426 - DNA, 140 bp, Artificial Sequence
  Synthetic
atggccgactcccaagtacgttgtagcttgcaaactgtacttgcagaatagtactttttgcacatgcatcaaatcaaagaatccttcctctatcttagggtgcagtgtaacgatttcggaggagacccagcatggcgtat

SEQ ID NO: 368427 - DNA, 140 bp, Artificial Sequence
  Synthetic
aggccctggctgctgatatgaagtggattgagcatctcagttgcagttcacctgtcgacatcatgcatatatcattaatgtatgcagttctttgcctacagctgtgtggtctggggggaggaccttttgggacagcggtg

SEQ ID NO: 368428 - DNA, 140 bp, Artificial Sequence
  Synthetic
caccgctgtcccaaaaggtcctccccccagaccacacagctgtaggcaaagaactgcatacattaatgatatatgcatgatgtcgacaggtgaactgcaactgagatgctcaatccacttcatatcagcagccagggcct

SEQ ID NO: 368429 - DNA, 140 bp, Artificial Sequence
  Synthetic
atacgccatgctgggtctccatcattaatgtatgcagttctttgcctacagctgtgtggtctggggggagctcatggatcacataatggaactagatacaataatacaggcgctttgacacgtacttgggagtcggccat

SEQ ID NO: 368430 - DNA, 140 bp, Artificial Sequence
  Synthetic
atggccgactcccaagtacgtgtcaaagcgcctgtattattgtatctagttccattatgtgatccatgagctccccccagaccacacagctgtaggcaaagaactgcatacattaatgatggagacccagcatggcgtat

SEQ ID NO: 368431 - DNA, 140 bp, Artificial Sequence
  Synthetic
atacgccatgctgggtctcctcatttcaacacctcatggatgtcatgggatggatgtgacctagactacttttgcaacatgggtgactggccttcatgtacatatactggagtgacacagcgtacttgggagtcggccat

SEQ ID NO: 368432 - DNA, 140 bp, Artificial Sequence
  Synthetic
atggccgactcccaagtacgctgtgtcactccagtatatgtacatgaaggccagtcacccatgttgcaaaagtagtctaggtcacatccatcccatgacatccatgaggtgttgaaatgaggagacccagcatggcgtat

SEQ ID NO: 368433 - DNA, 140 bp, Artificial Sequence
  Synthetic
atacgccatgctgggtctcccaccacacacaacccctccactgtcacatccacaacaccagctagcgggtctgaaggctcaggggaagtttacacagcctctccagtcaccaccgagggccgtacttgggagtcggccat

SEQ ID NO: 368434 - DNA, 140 bp, Artificial Sequence
  Synthetic
atggccgactcccaagtacggccctcggtggtgactggagaggctgtgtaaacttcccctgagccttcagacccgctagctggtgttgtggatgtgacagtggaggggttgtgtgtggtgggagacccagcatggcgtat

SEQ ID NO: 368435 - DNA, 140 bp, Artificial Sequence
  Synthetic
aggccctggctgctgatatgctgaaggctcaggggaagtttacacagcctctccagtcaccaccgagggcctgtctccaccggggaccactccagagctccccgccacaaccggtatagagaccttttgggacagcggtg

SEQ ID NO: 368436 - DNA, 140 bp, Artificial Sequence
  Synthetic
caccgctgtcccaaaaggtctctataccggttgtggcggggagctctggagtggtccccggtggagacaggccctcggtggtgactggagaggctgtgtaaacttcccctgagccttcagcatatcagcagccagggcct

SEQ ID NO: 368437 - DNA, 140 bp, Artificial Sequence
  Synthetic
atacgccatgctgggtctccctcaactggatctgaaggcaagaccaacatatggtgcaggcgaggtcactgttctagtggaggttgcagatctggagctacacactaagaaaatagaagtcgtacttgggagtcggccat

SEQ ID NO: 368438 - DNA, 140 bp, Artificial Sequence
  Synthetic
atggccgactcccaagtacgacttctattttcttagtgtgtagctccagatctgcaacctccactagaacagtgacctcgcctgcaccatatgttggtcttgccttcagatccagttgagggagacccagcatggcgtat

SEQ ID NO: 368439 - DNA, 140 bp, Artificial Sequence
  Synthetic
atacgccatgctgggtctcccctctgcactaacagtccgcacaagtttgcccagcagccctagcacactgcctacatcacaagacacacaccatcctgtgaggaacctactttcagttaccgtacttgggagtcggccat

SEQ ID NO: 368440 - DNA, 140 bp, Artificial Sequence
  Synthetic
atggccgactcccaagtacggtaactgaaagtaggttcctcacaggatggtgtgtgtcttgtgatgtaggcagtgtgctagggctgctgggcaaacttgtgcggactgttagtgcagaggggagacccagcatggcgtat

SEQ ID NO: 368441 - DNA, 140 bp, Artificial Sequence
  Synthetic
aggccctggctgctgatatgcctacatcacaagacacacaccatcctgtgaggaacctactttcagttacgagccctaggccagaagagacaacagcaccttcaggttcaggcatagagagaccttttgggacagcggtg

SEQ ID NO: 368442 - DNA, 140 bp, Artificial Sequence
  Synthetic
caccgctgtcccaaaaggtctctctatgcctgaacctgaaggtgctgttgtctcttctggcctagggctcgtaactgaaagtaggttcctcacaggatggtgtgtgtcttgtgatgtaggcatatcagcagccagggcct

SEQ ID NO: 368443 - DNA, 140 bp, Artificial Sequence
  Synthetic
atacgccatgctgggtctccttcacagtacacgtgaaaagcaatgatccagacgttgtggcagcaggatcaagtctgatggcaaggaaaatagagtttggggctgacagcacctttaaagcgtacttgggagtcggccat

SEQ ID NO: 368444 - DNA, 140 bp, Artificial Sequence
  Synthetic
atggccgactcccaagtacgctttaaaggtgctgtcagccccaaactctattttccttgccatcagacttgatcctgctgccacaacgtctggatcattgcttttcacgtgtactgtgaaggagacccagcatggcgtat

SEQ ID NO: 368445 - DNA, 140 bp, Artificial Sequence
  Synthetic
atacgccatgctgggtctcccccgcagcagcccagggacccactgaaagtaacagtcacaacgccaccgaacatcttgagtccctgacacagtcagcaaccccagatctagtaacctctccgtacttgggagtcggccat

SEQ ID NO: 368446 - DNA, 140 bp, Artificial Sequence
  Synthetic
atggccgactcccaagtacggagaggttactagatctggggttgctgactgtgtcagggactcaagatgttcggtggcgttgtgactgttactttcagtgggtccctgggctgctgcgggggagacccagcatggcgtat

SEQ ID NO: 368447 - DNA, 140 bp, Artificial Sequence
  Synthetic
aggccctggctgctgatatgacatcttgagtccctgacacagtcagcaaccccagatctagtaacctctccagcacagacagtccacccacagagcgccacctccatagccgctccagacgaccttttgggacagcggtg

SEQ ID NO: 368448 - DNA, 140 bp, Artificial Sequence
  Synthetic
caccgctgtcccaaaaggtcgtctggagcggctatggaggtggcgctctgtgggtggactgtctgtgctggagaggttactagatctggggttgctgactgtgtcagggactcaagatgtcatatcagcagccagggcct

SEQ ID NO: 368449 - DNA, 140 bp, Artificial Sequence
  Synthetic
atacgccatgctgggtctccaaagctcgaacatccacaaagcatattaattgagcataagggaacaataattggtaagcaaaatgacacctgtccgaccaaaacaagctgctggctagaacgtacttgggagtcggccat

SEQ ID NO: 368450 - DNA, 140 bp, Artificial Sequence
  Synthetic
atggccgactcccaagtacgttctagccagcagcttgttttggtcggacaggtgtcattttgcttaccaattattgttcccttatgctcaattaatatgctttgtggatgttcgagctttggagacccagcatggcgtat

SEQ ID NO: 368451 - DNA, 140 bp, Artificial Sequence
  Synthetic
atacgccatgctgggtctccaatcttgaccttgtctcagggtttaaaaaaatactacggcaaaatacttaggcttctgcatcttaccttggaggaggacactgaaggtctactggaatggcgtacttgggagtcggccat

SEQ ID NO: 368452 - DNA, 140 bp, Artificial Sequence
  Synthetic
atggccgactcccaagtacgccattccagtagaccttcagtgtcctcctccaaggtaagatgcagaagcctaagtattttgccgtagtatttttttaaaccctgagacaaggtcaagattggagacccagcatggcgtat

SEQ ID NO: 368453 - DNA, 140 bp, Artificial Sequence
  Synthetic
aggccctggctgctgatatgggcttctgcatcttaccttggaggaggacactgaaggtctactggaatggtgtaagagaaatcttggccttgattgtgatgacactttctttcaaaaaaggaccttttgggacagcggtg

SEQ ID NO: 368454 - DNA, 140 bp, Artificial Sequence
  Synthetic
caccgctgtcccaaaaggtccttttttgaaagaaagtgtcatcacaatcaaggccaagatttctcttacaccattccagtagaccttcagtgtcctcctccaaggtaagatgcagaagcccatatcagcagccagggcct

SEQ ID NO: 368455 - DNA, 140 bp, Artificial Sequence
  Synthetic
atacgccatgctgggtctcctgatactcttcttcttctttggatggaggcttctgttctgtctgaagtgttgcagaaggaccaggggtctgctaaagtataaacaacttaaggatgaagacgtacttgggagtcggccat

SEQ ID NO: 368456 - DNA, 140 bp, Artificial Sequence
  Synthetic
atggccgactcccaagtacgtcttcatccttaagttgtttatactttagcagacccctggtccttctgcaacacttcagacagaacagaagcctccatccaaagaagaagaagagtatcaggagacccagcatggcgtat

SEQ ID NO: 368457 - DNA, 140 bp, Artificial Sequence
  Synthetic
aggccctggctgctgatatgtgcagaaggaccaggggtctgctaaagtataaacaacttaaggatgaagaagaagccgggtacaagaaaatcatcgagaggctgaatgacaaaaagggcagaccttttgggacagcggtg

SEQ ID NO: 368458 - DNA, 140 bp, Artificial Sequence
  Synthetic
caccgctgtcccaaaaggtctgccctttttgtcattcagcctctcgatgattttcttgtacccggcttcttcttcatccttaagttgtttatactttagcagacccctggtccttctgcacatatcagcagccagggcct

SEQ ID NO: 368459 - DNA, 140 bp, Artificial Sequence
  Synthetic
atacgccatgctgggtctccgtatgcatacttgtgatggtggcctgcatagccagttcggccgctgtagagatggaaaacctaccggcaggaacctgggaacgagaagaagagctcacaacgtacttgggagtcggccat

SEQ ID NO: 368460 - DNA, 140 bp, Artificial Sequence
  Synthetic
atggccgactcccaagtacgttgtgagctcttcttctcgttcccaggttcctgccggtaggttttccatctctacagcggccgaactggctatgcaggccaccatcacaagtatgcatacggagacccagcatggcgtat

SEQ ID NO: 368461 - DNA, 140 bp, Artificial Sequence
  Synthetic
atacgccatgctgggtctccctcttctcaaccaagactcatatagggtgacaaatcagaccagctgccacctgtagtgtcacccgtttttttatgccactgtgtcctttttacaacaaatcgtacttgggagtcggccat

SEQ ID NO: 368462 - DNA, 140 bp, Artificial Sequence
  Synthetic
atggccgactcccaagtacgatttgttgtaaaaaggacacagtggcataaaaaaacgggtgacactacaggtggcagctggtctgatttgtcaccctatatgagtcttggttgagaagagggagacccagcatggcgtat

SEQ ID NO: 368463 - DNA, 140 bp, Artificial Sequence
  Synthetic
atacgccatgctgggtctccacctctagctcatgatagtcgatcgtcctgctcaacaccactccagcttgatttcatctagacttaactttgactgcgtgccgccactatatctttgagacgtacttgggagtcggccat

SEQ ID NO: 368464 - DNA, 140 bp, Artificial Sequence
  Synthetic
atggccgactcccaagtacgtctcaaagatatagtggcggcacgcagtcaaagttaagtctagatgaaatcaagctggagtggtgttgagcaggacgatcgactatcatgagctagaggtggagacccagcatggcgtat

SEQ ID NO: 368465 - DNA, 140 bp, Artificial Sequence
  Synthetic
atacgccatgctgggtctcccatgtctgtgactactctctagacatcgacgggacggtgaggctccctcacattcatcatgaaggaattttcatcccaggaacttataaaatagtgatagcgtacttgggagtcggccat

SEQ ID NO: 368466 - DNA, 140 bp, Artificial Sequence
  Synthetic
atggccgactcccaagtacgctatcactattttataagttcctgggatgaaaattccttcatgatgaatgtgagggagcctcaccgtcccgtcgatgtctagagagtagtcacagacatgggagacccagcatggcgtat

SEQ ID NO: 368467 - DNA, 140 bp, Artificial Sequence
  Synthetic
aggccctggctgctgatatgtcatcatgcaacatcttcggtgttaacttccctagctgccgtgctctttgaggagctggcaattttttatcttaaaagaagcttaccccaaacaacagtagaccttttgggacagcggtg

SEQ ID NO: 368468 - DNA, 140 bp, Artificial Sequence
  Synthetic
caccgctgtcccaaaaggtctactgttgtttggggtaagcttcttttaagataaaaaattgccagctcctcaaagagcacggcagctagggaagttaacaccgaagatgttgcatgatgacatatcagcagccagggcct

SEQ ID NO: 368469 - DNA, 140 bp, Artificial Sequence
  Synthetic
atacgccatgctgggtctccttcaatcagcacccattggtcacgggaagacaattgaggcataccgggccagggagggatacacaagtatatgtctctttgtactaggaagtatcctattcgtacttgggagtcggccat

SEQ ID NO: 368470 - DNA, 140 bp, Artificial Sequence
  Synthetic
atggccgactcccaagtacgaataggatacttcctagtacaaagagacatatacttgtgtatccctccctggcccggtatgcctcaattgtcttcccgtgaccaatgggtgctgattgaaggagacccagcatggcgtat

SEQ ID NO: 368471 - DNA, 140 bp, Artificial Sequence
  Synthetic
atacgccatgctgggtctcccagacgggcttgctaggcatgtgacacagtgccctaagcggaaggaaaaagtggaggaaactgaattgtacttgaacttggaaagaattccttgggttgtcgtacttgggagtcggccat

SEQ ID NO: 368472 - DNA, 140 bp, Artificial Sequence
  Synthetic
atggccgactcccaagtacgacaacccaaggaattctttccaagttcaagtacaattcagtttcctccactttttccttccgcttagggcactgtgtcacatgcctagcaagcccgtctgggagacccagcatggcgtat

SEQ ID NO: 368473 - DNA, 140 bp, Artificial Sequence
  Synthetic
atacgccatgctgggtctccgcagctggctgattgtgctactggtgctgttcacggtttcattgtcaccggttcagtcagcgcccattagtcatgggaagacagttgaggcataccaggccgtacttgggagtcggccat

SEQ ID NO: 368474 - DNA, 140 bp, Artificial Sequence
  Synthetic
atggccgactcccaagtacggcctggtatgcctcaactgtcttcccatgactaatgggcgctgactgaaccggtgacaatgaaaccgtgaacagcaccagtagcacaatcagccagctgcggagacccagcatggcgtat

SEQ ID NO: 368475 - DNA, 140 bp, Artificial Sequence
  Synthetic
aggccctggctgctgatatgatgcacaaaaggattccatctacgcatctgctctggtggaggcaaccaaattttgtgcacctatatacgaatgtgcctgggctagctccactggcattgtgaccttttgggacagcggtg

SEQ ID NO: 368476 - DNA, 140 bp, Artificial Sequence
  Synthetic
caccgctgtcccaaaaggtcacaatgccagtggagctagcccaggcacattcgtatataggtgcacaaaatttggttgcctccaccagagcagatgcgtagatggaatccttttgtgcatcatatcagcagccagggcct

SEQ ID NO: 368477 - DNA, 140 bp, Artificial Sequence
  Synthetic
aggccctggctgctgatatggggatgaaagttacactgagctgaaagttgaggttcccaaaatagaacagctttccaactaccagcaggctgctctcaagtggaggaaagacataggcttgaccttttgggacagcggtg

SEQ ID NO: 368478 - DNA, 140 bp, Artificial Sequence
  Synthetic
caccgctgtcccaaaaggtcaagcctatgtctttcctccacttgagagcagcctgctggtagttggaaagctgttctattttgggaacctcaactttcagctcagtgtaactttcatccccatatcagcagccagggcct

SEQ ID NO: 368479 - DNA, 140 bp, Artificial Sequence
  Synthetic
atacgccatgctgggtctccacaaggttcctggcgaaattgtaatgtctgtcaaagagatgttgtcagatatgattaggagaaggaacctgattctcaacagaggtggtgatgaaaaccccgtacttgggagtcggccat

SEQ ID NO: 368480 - DNA, 140 bp, Artificial Sequence
  Synthetic
atggccgactcccaagtacggggttttcatcaccacctctgttgagaatcaggttccttctcctaatcatatctgacaacatctctttgacagacattacaatttcgccaggaaccttgtggagacccagcatggcgtat

SEQ ID NO: 368481 - DNA, 140 bp, Artificial Sequence
  Synthetic
atacgccatgctgggtctccgcagtttgtgttgttagcacctcagcagtggagatggaaagcctaccagccggaacctgggagagagaagaagacctaacaaatttctgtcatcaggaatcgtacttgggagtcggccat

SEQ ID NO: 368482 - DNA, 140 bp, Artificial Sequence
  Synthetic
atggccgactcccaagtacgattcctgatgacagaaatttgttaggtcttcttctctctcccaggttccggctggtaggctttccatctccactgctgaggtgctaacaacacaaactgcggagacccagcatggcgtat

SEQ ID NO: 368483 - DNA, 140 bp, Artificial Sequence
  Synthetic
atacgccatgctgggtctccaaggcaagtacataatggctttcaacccaccttggggggacatcaacaagtcaggccgttcaggaatagcacttgttgcaacaggccttgccaagcttgccgtacttgggagtcggccat

SEQ ID NO: 368484 - DNA, 140 bp, Artificial Sequence
  Synthetic
atggccgactcccaagtacggcaagcttggcaaggcctgttgcaacaagtgctattcctgaacggcctgacttgttgatgtccccccaaggtgggttgaaagccattatgtacttgccttggagacccagcatggcgtat

SEQ ID NO: 368485 - DNA, 140 bp, Artificial Sequence
  Synthetic
aggccctggctgctgatatgtcaggccgttcaggaatagcacttgttgcaacaggccttgccaagcttgcagagactgaagggaagggagtttttgacgaagccaagaaaactgtagagggaccttttgggacagcggtg

SEQ ID NO: 368486 - DNA, 140 bp, Artificial Sequence
  Synthetic
caccgctgtcccaaaaggtccctctacagttttcttggcttcgtcaaaaactcccttcccttcagtctctgcaagcttggcaaggcctgttgcaacaagtgctattcctgaacggcctgacatatcagcagccagggcct

SEQ ID NO: 368487 - DNA, 140 bp, Artificial Sequence
  Synthetic
atacgccatgctgggtctccgctgacagcatgataacaaaccttctcaagcatattgctaaagcacaggagctttacaaaaactcgtctgctctccgtgcacagggtgcacagattgatacgtacttgggagtcggccat

SEQ ID NO: 368488 - DNA, 140 bp, Artificial Sequence
  Synthetic
atggccgactcccaagtacgtatcaatctgtgcaccctgtgcacggagagcagacgagtttttgtaaagctcctgtgctttagcaatatgcttgagaaggtttgttatcatgctgtcagcggagacccagcatggcgtat

SEQ ID NO: 368489 - DNA, 140 bp, Artificial Sequence
  Synthetic
atacgccatgctgggtctccactttcccgactgtctcacagttcctttttgagttagggaagcagccaaggggtaccaagaaaatgaagaaggcactcttgagcaccccaatgaagtgggcgtacttgggagtcggccat

SEQ ID NO: 368490 - DNA, 140 bp, Artificial Sequence
  Synthetic
atggccgactcccaagtacgcccacttcattggggtgctcaagagtgccttcttcattttcttggtaccccttggctgcttccctaactcaaaaaggaactgtgagacagtcgggaaagtggagacccagcatggcgtat

SEQ ID NO: 368491 - DNA, 140 bp, Artificial Sequence
  Synthetic
atacgccatgctgggtctcccagaaagatgtggctgcacatcatcaacctgcttacataaagaatggccccattcaaggaattggagatgtaaccccacttggtgctggggtgtagggaccgtacttgggagtcggccat

SEQ ID NO: 368492 - DNA, 140 bp, Artificial Sequence
  Synthetic
atggccgactcccaagtacggtccctacaccccagcaccaagtggggttacatctccaattccttgaatggggccattctttatgtaagcaggttgatgatgtgcagccacatctttctgggagacccagcatggcgtat

SEQ ID NO: 368493 - DNA, 140 bp, Artificial Sequence
  Synthetic
aggccctggctgctgatatggatctgggcacaccaagtccattctcaaccttcggacaaacactgagaccaacaatccatgtgccaggacaattgttaagttgtttgaaattcaaaaaacgaccttttgggacagcggtg

SEQ ID NO: 368494 - DNA, 140 bp, Artificial Sequence
  Synthetic
caccgctgtcccaaaaggtcgttttttgaatttcaaacaacttaacaattgtcctggcacatggattgttggtctcagtgtttgtccgaaggttgagaatggacttggtgtgcccagatccatatcagcagccagggcct

SEQ ID NO: 368495 - DNA, 140 bp, Artificial Sequence
  Synthetic
aggccctggctgctgatatgaccgcaatcatcaactatgtttatttaaactgcttatgtaatcctgctttattaacattttatcattttcttctgttttaaacacttaaagggctgtgcggaccttttgggacagcggtg

SEQ ID NO: 368496 - DNA, 140 bp, Artificial Sequence
  Synthetic
caccgctgtcccaaaaggtccgcacagccctttaagtgtttaaaacagaagaaaatgataaaatgttaataaagcaggattacataagcagtttaaataaacatagttgatgattgcggtcatatcagcagccagggcct

SEQ ID NO: 368497 - DNA, 140 bp, Artificial Sequence
  Synthetic
aggccctggctgctgatatgatcatgcatatatcattgatgtatgcagttttctgcttgcagctgtgcggtctagggaagactaacggaccacacaatgggactgaacacaataatacacgaccttttgggacagcggtg

SEQ ID NO: 368498 - DNA, 140 bp, Artificial Sequence
  Synthetic
caccgctgtcccaaaaggtcgtgtattattgtgttcagtcccattgtgtggtccgttagtcttccctagaccgcacagctgcaagcagaaaactgcatacatcaatgatatatgcatgatcatatcagcagccagggcct

SEQ ID NO: 368499 - DNA, 140 bp, Artificial Sequence
  Synthetic
atacgccatgctgggtctccacgttatgacaacgcctgatgacagtcagagccctgaaccgccagtgagcacagccttacctgtcacaccggacccttcaactgtcacaccttcaacacccgtacttgggagtcggccat

SEQ ID NO: 368500 - DNA, 140 bp, Artificial Sequence
  Synthetic
atggccgactcccaagtacgggtgttgaaggtgtgacagttgaagggtccggtgtgacaggtaaggctgtgctcactggcggttcagggctctgactgtcatcaggcgttgtcataacgtggagacccagcatggcgtat

SEQ ID NO: 368501 - DNA, 140 bp, Artificial Sequence
  Synthetic
atacgccatgctgggtctccagccagcggattagaaggctcaggagaggtttacacatcctctccaatcaccaccaagggtttgtctctgccggaggccacatctgagccccctgcgactcgtacttgggagtcggccat

SEQ ID NO: 368502 - DNA, 140 bp, Artificial Sequence
  Synthetic
atggccgactcccaagtacgagtcgcagggggctcagatgtggcctccggcagagacaaacccttggtggtgattggagaggatgtgtaaacctctcctgagccttctaatccgctggctggagacccagcatggcgtat

SEQ ID NO: 368503 - DNA, 140 bp, Artificial Sequence
  Synthetic
aggccctggctgctgatatggtgcaggtgagatcactgtattggtggaagttgctgacatggagttacacacaaagaagattgaaatatcaggcttaaaatttacaagcctgacttgtacgaccttttgggacagcggtg

SEQ ID NO: 368504 - DNA, 140 bp, Artificial Sequence
  Synthetic
caccgctgtcccaaaaggtcgtacaagtcaggcttgtaaattttaagcctgatatttcaatcttctttgtgtgtaactccatgtcagcaacttccaccaatacagtgatctcacctgcaccatatcagcagccagggcct

SEQ ID NO: 368505 - DNA, 140 bp, Artificial Sequence
  Synthetic
atacgccatgctgggtctccagccggagacacccccacaccaacagtccgcacgagtctgcccagcagccctagcacaccatccacatcacaaggcacacactatcccgtgaggagtctgcgtacttgggagtcggccat

SEQ ID NO: 368506 - DNA, 140 bp, Artificial Sequence
  Synthetic
atggccgactcccaagtacgcagactcctcacgggatagtgtgtgccttgtgatgtggatggtgtgctagggctgctgggcagactcgtgcggactgttggtgtgggggtgtctccggctggagacccagcatggcgtat

SEQ ID NO: 368507 - DNA, 140 bp, Artificial Sequence
  Synthetic
aggccctggctgctgatatgctagcacaccatccacatcacaaggcacacactatcccgtgaggagtctgctttcagtcacgagccctaagccagaagaaacaccaacaccgtcaaaatcgaccttttgggacagcggtg

SEQ ID NO: 368508 - DNA, 140 bp, Artificial Sequence
  Synthetic
caccgctgtcccaaaaggtcgattttgacggtgttggtgtttcttctggcttagggctcgtgactgaaagcagactcctcacgggatagtgtgtgccttgtgatgtggatggtgtgctagcatatcagcagccagggcct

SEQ ID NO: 368509 - DNA, 140 bp, Artificial Sequence
  Synthetic
atacgccatgctgggtctccaatgatctctccaacacagacagtcctcccacagagtgttacctctatagccattcaagacattcataacagcccaacaaataggtctaaaagaaaccttcgtacttgggagtcggccat

SEQ ID NO: 368510 - DNA, 140 bp, Artificial Sequence
  Synthetic
atggccgactcccaagtacgaaggtttcttttagacctatttgttgggctgttatgaatgtcttgaatggctatagaggtaacactctgtgggaggactgtctgtgttggagagatcattggagacccagcatggcgtat

SEQ ID NO: 368511 - DNA, 140 bp, Artificial Sequence
  Synthetic
atacgccatgctgggtctcccaaaatacttaagctcctgcatctcaccttagaagaagacactgaaggcttgttagagtggtgcaagagaaatctcggtcttgactgtgatgacaccttccgtacttgggagtcggccat

SEQ ID NO: 368512 - DNA, 140 bp, Artificial Sequence
  Synthetic
atggccgactcccaagtacggaaggtgtcatcacagtcaagaccgagatttctcttgcaccactctaacaagccttcagtgtcttcttctaaggtgagatgcaggagcttaagtattttgggagacccagcatggcgtat

SEQ ID NO: 368513 - DNA, 140 bp, Artificial Sequence
  Synthetic
aggccctggctgctgatatgtgttagagtggtgcaagagaaatctcggtcttgactgtgatgacaccttcttccaaaaaagaatcgaagaattcttcataactggtgagggtcatttcaagaccttttgggacagcggtg

SEQ ID NO: 368514 - DNA, 140 bp, Artificial Sequence
  Synthetic
caccgctgtcccaaaaggtcttgaaatgaccctcaccagttatgaagaattcttcgattcttttttggaagaaggtgtcatcacagtcaagaccgagatttctcttgcaccactctaacacatatcagcagccagggcct

SEQ ID NO: 368515 - DNA, 140 bp, Artificial Sequence
  Synthetic
atacgccatgctgggtctccttccaaaaaagaatcgaagaattcttcataactggtgagggtcatttcaatgaagttttacaatttagaacactaggcacattgagtaccacagagtcaacgtacttgggagtcggccat

SEQ ID NO: 368516 - DNA, 140 bp, Artificial Sequence
  Synthetic
atggccgactcccaagtacgttgactctgtggtactcaatgtgcctagtgttctaaattgtaaaacttcattgaaatgaccctcaccagttatgaagaattcttcgattcttttttggaaggagacccagcatggcgtat

SEQ ID NO: 368517 - DNA, 140 bp, Artificial Sequence
  Synthetic
aggccctggctgctgatatgaacatccaattcagggctccaattgattaatgttacccgacattcaactaggatagctgacacgcctgggcccaagatcactaacctgaagaccatcaatgaccttttgggacagcggtg

SEQ ID NO: 368518 - DNA, 140 bp, Artificial Sequence
  Synthetic
caccgctgtcccaaaaggtcattgatggtcttcaggttagtgatcttgggcccaggcgtgtcagctatcctagttgaatgtcgggtaacattaatcaattggagccctgaattggatgttcatatcagcagccagggcct

SEQ ID NO: 368519 - DNA, 140 bp, Artificial Sequence
  Synthetic
aggccctggctgctgatatggcatctaaactgcttcattgtatctgcaaacagactctatgatgcttgaaactacctctgctctatttaccctgacttaaatcttgactgcgtgccgccagaccttttgggacagcggtg

SEQ ID NO: 368520 - DNA, 140 bp, Artificial Sequence
  Synthetic
caccgctgtcccaaaaggtctggcggcacgcagtcaagatttaagtcagggtaaatagagcagaggtagtttcaagcatcatagagtctgtttgcagatacaatgaagcagtttagatgccatatcagcagccagggcct

SEQ ID NO: 368521 - DNA, 140 bp, Artificial Sequence
  Synthetic
atacgccatgctgggtctcccaatgtgcttctccctcaagtagcagtcaacctctcaaactgtcatgttgcaatcaaatcacatatctgtgactattctttagacaccgacggggcaattcgtacttgggagtcggccat

SEQ ID NO: 368522 - DNA, 140 bp, Artificial Sequence
  Synthetic
atggccgactcccaagtacgaattgccccgtcggtgtctaaagaatagtcacagatatgtgatttgattgcaacatgacagtttgagaggttgactgctacttgagggagaagcacattgggagacccagcatggcgtat

SEQ ID NO: 368523 - DNA, 140 bp, Artificial Sequence
  Synthetic
aggccctggctgctgatatggtagtagtccttgtctttgcaagaccatggatttcttgaggaaccttgactggactcaagtgattgctggtcaatatgtgaccaaccctaagttcaatatgaccttttgggacagcggtg

SEQ ID NO: 368524 - DNA, 140 bp, Artificial Sequence
  Synthetic
caccgctgtcccaaaaggtcatattgaacttagggttggtcacatattgaccagcaatcacttgagtccagtcaaggttcctcaagaaatccatggtcttgcaaagacaaggactactaccatatcagcagccagggcct

SEQ ID NO: 368525 - DNA, 140 bp, Artificial Sequence
  Synthetic
atacgccatgctgggtctccatcacagcatagctgagctaaccatgcccaacaaaacagatcactcatatcacaacattaaacgtctgaccgagtcggcagcacggaagtattaccaagacgtacttgggagtcggccat

SEQ ID NO: 368526 - DNA, 140 bp, Artificial Sequence
  Synthetic
atggccgactcccaagtacgtcttggtaatacttccgtgctgccgactcggtcagacgtttaatgttgtgatatgagtgatctgttttgttgggcatggttagctcagctatgctgtgatggagacccagcatggcgtat

SEQ ID NO: 368527 - DNA, 140 bp, Artificial Sequence
  Synthetic
aggccctggctgctgatatgtattgaggacagagactgcagaggtccatggcgataactatggtggtccaggtgataagataaccatctgtaatggttcaactgttgtagatcaaagactgaccttttgggacagcggtg

SEQ ID NO: 368528 - DNA, 140 bp, Artificial Sequence
  Synthetic
caccgctgtcccaaaaggtcagtctttgatctacaacagttgaaccattacagatggttatcttatcacctggaccaccatagttatcgccatggacctctgcagtctctgtcctcaatacatatcagcagccagggcct

SEQ ID NO: 368529 - DNA, 140 bp, Artificial Sequence
  Synthetic
aggccctggctgctgatatggctaaagaaatgggcatcactatcatcatttggactgttgctgccagtgatgaagtggaagcaggaataaaattcggagacggtgatgtgtttacagctggaccttttgggacagcggtg

SEQ ID NO: 368530 - DNA, 140 bp, Artificial Sequence
  Synthetic
caccgctgtcccaaaaggtccagctgtaaacacatcaccgtctccgaattttattcctgcttccacttcatcactggcagcaacagtccaaatgatgatagtgatgcccatttctttagccatatcagcagccagggcct

SEQ ID NO: 368531 - DNA, 140 bp, Artificial Sequence
  Synthetic
atacgccatgctgggtctcctatgcgaaaacagtgccacagggaagagctgtgaaatagacagtatcccagtcaagtgtaagcagggttattgcctaaaaatcactcaggaaggaaggggcgtacttgggagtcggccat

SEQ ID NO: 368532 - DNA, 140 bp, Artificial Sequence
  Synthetic
atggccgactcccaagtacgccccttccttcctgagtgatttttaggcaataaccctgcttacacttgactgggatactgtctatttcacagctcttccctgtggcactgttttcgcataggagacccagcatggcgtat

SEQ ID NO: 368533 - DNA, 140 bp, Artificial Sequence
  Synthetic
aggccctggctgctgatatggtcaagtgtaagcagggttattgcctaaaaatcactcaggaaggaaggggccatgtgaagttatctagaggctcagaagttgtcttggatgtatgtgattgaccttttgggacagcggtg

SEQ ID NO: 368534 - DNA, 140 bp, Artificial Sequence
  Synthetic
caccgctgtcccaaaaggtcaatcacatacatccaagacaacttctgagcctctagataacttcacatggccccttccttcctgagtgatttttaggcaataaccctgcttacacttgaccatatcagcagccagggcct

SEQ ID NO: 368535 - DNA, 140 bp, Artificial Sequence
  Synthetic
aggccctggctgctgatatgtatagctgtggatcagttgacatcatcttccagtgatgaactgcaagattatgaagaccttgccttggcactcacaagtgcagaagaatcgtatagacgggaccttttgggacagcggtg

SEQ ID NO: 368536 - DNA, 140 bp, Artificial Sequence
  Synthetic
caccgctgtcccaaaaggtcccgtctatacgattcttctgcacttgtgagtgccaaggcaaggtcttcataatcttgcagttcatcactggaagatgatgtcaactgatccacagctatacatatcagcagccagggcct

SEQ ID NO: 368537 - DNA, 140 bp, Artificial Sequence
  Synthetic
atacgccatgctgggtctcctgttcaggtgggcagcaacattttttaaaagacaacctggttgacctagggtgtcccaaaattccgttactgggcaaaatggctatttatatctgcaggacgtacttgggagtcggccat

SEQ ID NO: 368538 - DNA, 140 bp, Artificial Sequence
  Synthetic
atggccgactcccaagtacgtcctgcagatataaatagccattttgcccagtaacggaattttgggacaccctaggtcaaccaggttgtcttttaaaaaatgttgctgcccacctgaacaggagacccagcatggcgtat

SEQ ID NO: 368539 - DNA, 140 bp, Artificial Sequence
  Synthetic
aggccctggctgctgatatggtgtcccaaaattccgttactgggcaaaatggctatttatatctgcaggatgtcgaatcaccccaagacaaccatggccttcctcttttggttcagctttgaccttttgggacagcggtg

SEQ ID NO: 368540 - DNA, 140 bp, Artificial Sequence
  Synthetic
caccgctgtcccaaaaggtcaaagctgaaccaaaagaggaaggccatggttgtcttggggtgattcgacatcctgcagatataaatagccattttgcccagtaacggaattttgggacaccatatcagcagccagggcct

SEQ ID NO: 368541 - DNA, 140 bp, Artificial Sequence
  Synthetic
aggccctggctgctgatatgcgaccagagtcggcagggtcttggattgcatgtttaattgtaagttatgtgttgagatatcagctgatgctttaattctaaggccagaatcaaaagagaagaccttttgggacagcggtg

SEQ ID NO: 368542 - DNA, 140 bp, Artificial Sequence
  Synthetic
caccgctgtcccaaaaggtcttctcttttgattctggccttagaattaaagcatcagctgatatctcaacacataacttacaattaaacatgcaatccaagaccctgccgactctggtcgcatatcagcagccagggcct

SEQ ID NO: 368543 - DNA, 140 bp, Artificial Sequence
  Synthetic
atacgccatgctgggtctccaatttttggaacactagggaaaaggttcaagcagtacagagagttgaaaccccagacctgcaccatatgtgagacaacacctgtaaatgcaatagatgctcgtacttgggagtcggccat

SEQ ID NO: 368544 - DNA, 140 bp, Artificial Sequence
  Synthetic
atggccgactcccaagtacgagcatctattgcatttacaggtgttgtctcacatatggtgcaggtctggggtttcaactctctgtactgcttgaaccttttccctagtgttccaaaaattggagacccagcatggcgtat

SEQ ID NO: 368545 - DNA, 140 bp, Artificial Sequence
  Synthetic
aggccctggctgctgatatgcccagacctgcaccatatgtgagacaacacctgtaaatgcaatagatgctgaaatgcatgatctcaactgcagttacaatatatgtccctattgtgcgtcgaccttttgggacagcggtg

SEQ ID NO: 368546 - DNA, 140 bp, Artificial Sequence
  Synthetic
caccgctgtcccaaaaggtcgacgcacaatagggacatatattgtaactgcagttgagatcatgcatttcagcatctattgcatttacaggtgttgtctcacatatggtgcaggtctgggcatatcagcagccagggcct

SEQ ID NO: 368547 - DNA, 140 bp, Artificial Sequence
  Synthetic
atacgccatgctgggtctccggaaggagaaagtggaggaaaccgaattatacctgaatttagagagaattccctgggttgtaagaaagctattgcaggtgtcagagtccactggtacagtcgtacttgggagtcggccat

SEQ ID NO: 368548 - DNA, 140 bp, Artificial Sequence
  Synthetic
atggccgactcccaagtacgactgtaccagtggactctgacacctgcaatagctttcttacaacccagggaattctctctaaattcaggtataattcggtttcctccactttctccttccggagacccagcatggcgtat

SEQ ID NO: 368549 - DNA, 140 bp, Artificial Sequence
  Synthetic
aggccctggctgctgatatgccctgggttgtaagaaagctattgcaggtgtcagagtccactggtacagtattaaaaaggagcagctggctaattgtattacttgtgctgttcacagtttgaccttttgggacagcggtg

SEQ ID NO: 368550 - DNA, 140 bp, Artificial Sequence
  Synthetic
caccgctgtcccaaaaggtcaaactgtgaacagcacaagtaatacaattagccagctgctcctttttaatactgtaccagtggactctgacacctgcaatagctttcttacaacccagggcatatcagcagccagggcct

SEQ ID NO: 368551 - DNA, 140 bp, Artificial Sequence
  Synthetic
aggccctggctgctgatatggaaatgaactgttgtacaaggcacccagaaaggccttagcaactgtctgtagtgccttattcgggaagcagataaacaaacttcagaattgcttcaggacgaccttttgggacagcggtg

SEQ ID NO: 368552 - DNA, 140 bp, Artificial Sequence
  Synthetic
caccgctgtcccaaaaggtcgtcctgaagcaattctgaagtttgtttatctgcttcccgaataaggcactacagacagttgctaaggcctttctgggtgccttgtacaacagttcatttccatatcagcagccagggcct

SEQ ID NO: 368553 - DNA, 140 bp, Artificial Sequence
  Synthetic
atacgccatgctgggtctccacataccgggttagggaagaatacacaagtatttgcctctttgtactaggaagtatcctgtttatagtctcttttctaatgaaaggactggttgacggtgcgtacttgggagtcggccat

SEQ ID NO: 368554 - DNA, 140 bp, Artificial Sequence
  Synthetic
atggccgactcccaagtacgcaccgtcaaccagtcctttcattagaaaagagactataaacaggatacttcctagtacaaagaggcaaatacttgtgtattcttccctaacccggtatgtggagacccagcatggcgtat

SEQ ID NO: 368555 - DNA, 140 bp, Artificial Sequence
  Synthetic
aggccctggctgctgatatgaagtatcctgtttatagtctcttttctaatgaaaggactggttgacggtgttggcaacatcttctttcctgggctgtccgtctgtaagacatgctctatagaccttttgggacagcggtg

SEQ ID NO: 368556 - DNA, 140 bp, Artificial Sequence
  Synthetic
caccgctgtcccaaaaggtctatagagcatgtcttacagacggacagcccaggaaagaagatgttgccaacaccgtcaaccagtcctttcattagaaaagagactataaacaggatacttcatatcagcagccagggcct

SEQ ID NO: 368557 - DNA, 140 bp, Artificial Sequence
  Synthetic
aggccctggctgctgatatgaacactgatgttgaattcaaccacagggagatagctgatctcaatcaattaacttctcggcttgttacattaagaaaggagaaagacactgacctcctcagaccttttgggacagcggtg

SEQ ID NO: 368558 - DNA, 140 bp, Artificial Sequence
  Synthetic
caccgctgtcccaaaaggtctgaggaggtcagtgtctttctcctttcttaatgtaacaagccgagaagttaattgattgagatcagctatctccctgtggttgaattcaacatcagtgttcatatcagcagccagggcct

SEQ ID NO: 368559 - DNA, 140 bp, Artificial Sequence
  Synthetic
atacgccatgctgggtctccgcaaacgcagaagaatttatcatatccgagttctttaagaagaaggacattatgaagttcatcagcacatcaggcagagcaatgagtgcaggcaagattgcgtacttgggagtcggccat

SEQ ID NO: 368560 - DNA, 140 bp, Artificial Sequence
  Synthetic
atggccgactcccaagtacgcaatcttgcctgcactcattgctctgcctgatgtgctgatgaacttcataatgtccttcttcttaaagaactcggatatgataaattcttctgcgtttgcggagacccagcatggcgtat

SEQ ID NO: 368561 - DNA, 140 bp, Artificial Sequence
  Synthetic
aggccctggctgctgatatgagcctaccagctgggacctgggaaagagaagaagacctaacaaatttctgccatcaggaatgccaggtcacagagactgagtgcctctgcccttatgaaggaccttttgggacagcggtg

SEQ ID NO: 368562 - DNA, 140 bp, Artificial Sequence
  Synthetic
caccgctgtcccaaaaggtccttcataagggcagaggcactcagtctctgtgacctggcattcctgatggcagaaatttgttaggtcttcttctctttcccaggtcccagctggtaggctcatatcagcagccagggcct

SEQ ID NO: 368563 - DNA, 140 bp, Artificial Sequence
  Synthetic
aggccctggctgctgatatgccatcaggaatgccaggtcacagagactgagtgcctctgcccttatgaagctctagtgctcagaaggcccctatttctagatagtatagtcaaaggtatggaccttttgggacagcggtg

SEQ ID NO: 368564 - DNA, 140 bp, Artificial Sequence
  Synthetic
caccgctgtcccaaaaggtccatacctttgactatactatctagaaataggggccttctgagcactagagcttcataagggcagaggcactcagtctctgtgacctggcattcctgatggcatatcagcagccagggcct

SEQ ID NO: 368565 - DNA, 140 bp, Artificial Sequence
  Synthetic
atacgccatgctgggtctccaaaaatctgctaaactcaacaagtctagaaacaagcttatcaattgaggcaccatggggagcaattaatgttcagtcaacctacaaaccaactgtatcaacgtacttgggagtcggccat

SEQ ID NO: 368566 - DNA, 140 bp, Artificial Sequence
  Synthetic
atggccgactcccaagtacgttgatacagttggtttgtaggttgactgaacattaattgctccccatggtgcctcaattgataagcttgtttctagacttgttgagtttagcagatttttggagacccagcatggcgtat

SEQ ID NO: 368567 - DNA, 140 bp, Artificial Sequence
  Synthetic
aggccctggctgctgatatgaccatggggagcaattaatgttcagtcaacctacaaaccaactgtatcaactgcaaacatagcacttagttggagctcagtggaacacagaggcaataaggaccttttgggacagcggtg

SEQ ID NO: 368568 - DNA, 140 bp, Artificial Sequence
  Synthetic
caccgctgtcccaaaaggtccttattgcctctgtgttccactgagctccaactaagtgctatgtttgcagttgatacagttggtttgtaggttgactgaacattaattgctccccatggtcatatcagcagccagggcct

SEQ ID NO: 368569 - DNA, 140 bp, Artificial Sequence
  Synthetic
atacgccatgctgggtctccaaaccaagcctgaccatgttaatacagactttgtttcctgacaagtttgaggaattcttggatcgaactcagttgcatccagagttcagagatctaaccccgtacttgggagtcggccat

SEQ ID NO: 368570 - DNA, 140 bp, Artificial Sequence
  Synthetic
atggccgactcccaagtacggggttagatctctgaactctggatgcaactgagttcgatccaagaattcctcaaacttgtcaggaaacaaagtctgtattaacatggtcaggcttggtttggagacccagcatggcgtat

SEQ ID NO: 368571 - DNA, 140 bp, Artificial Sequence
  Synthetic
aggccctggctgctgatatgaggaatcagctgggatcttggcgtggaagatgcctctgagtctaagctacttacagtttcagtcatggacttgtctcagatgtactctcctgtcttcgaggaccttttgggacagcggtg

SEQ ID NO: 368572 - DNA, 140 bp, Artificial Sequence
  Synthetic
caccgctgtcccaaaaggtcctcgaagacaggagagtacatctgagacaagtccatgactgaaactgtaagtagcttagactcagaggcatcttccacgccaagatcccagctgattcctcatatcagcagccagggcct

SEQ ID NO: 368573 - DNA, 140 bp, Artificial Sequence
  Synthetic
atacgccatgctgggtctccaggtgactgcccagaaagatgtggctgcacatcatcaacctgcttacacaaagagtggccccactcaaggaattggagatgtaatcctacttggtgctggcgtacttgggagtcggccat

SEQ ID NO: 368574 - DNA, 140 bp, Artificial Sequence
  Synthetic
atggccgactcccaagtacgccagcaccaagtaggattacatctccaattccttgagtggggccactctttgtgtaagcaggttgatgatgtgcagccacatctttctgggcagtcacctggagacccagcatggcgtat

SEQ ID NO: 368575 - DNA, 140 bp, Artificial Sequence
  Synthetic
atacgccatgctgggtctccctcatgcatggaggaaacccttcagccaagaaaaaggatggagatctggcagaacagggcagccagcagagcaccactgaacacgagagctccagcatctcgtacttgggagtcggccat

SEQ ID NO: 368576 - DNA, 140 bp, Artificial Sequence
  Synthetic
atggccgactcccaagtacgagatgctggagctctcgtgttcagtggtgctctgctggctgccctgttctgccagatctccatcctttttcttggctgaagggtttcctccatgcatgagggagacccagcatggcgtat

SEQ ID NO: 368577 - DNA, 140 bp, Artificial Sequence
  Synthetic
atacgccatgctgggtctcccacagattacatgttcgtcaagtggaaagttgagtacattaagacagaggccatagtatgtgtagaactaaccagtcaggaaagacagtgtagcttgattcgtacttgggagtcggccat

SEQ ID NO: 368578 - DNA, 140 bp, Artificial Sequence
  Synthetic
atggccgactcccaagtacgaatcaagctacactgtctttcctgactggttagttctacacatactatggcctctgtcttaatgtactcaactttccacttgacgaacatgtaatctgtgggagacccagcatggcgtat

SEQ ID NO: 368579 - DNA, 140 bp, Artificial Sequence
  Synthetic
aggccctggctgctgatatgccatagtatgtgtagaactaaccagtcaggaaagacagtgtagcttgattgaggcgggcacaagattcaatttaggttctgtgactattacattgtcagagaccttttgggacagcggtg

SEQ ID NO: 368580 - DNA, 140 bp, Artificial Sequence
  Synthetic
caccgctgtcccaaaaggtctctgacaatgtaatagtcacagaacctaaattgaatcttgtgcccgcctcaatcaagctacactgtctttcctgactggttagttctacacatactatggcatatcagcagccagggcct

SEQ ID NO: 368581 - DNA, 140 bp, Artificial Sequence
  Synthetic
atacgccatgctgggtctccgaggcgggcacaagattcaatttaggttctgtgactattacattgtcagaaccaaggaacattcaacaaaagctccctcctgaaataatcacactgcacccgtacttgggagtcggccat

SEQ ID NO: 368582 - DNA, 140 bp, Artificial Sequence
  Synthetic
atggccgactcccaagtacgggtgcagtgtgattatttcaggagggagcttttgttgaatgttccttggttctgacaatgtaatagtcacagaacctaaattgaatcttgtgcccgcctcggagacccagcatggcgtat

SEQ ID NO: 368583 - DNA, 140 bp, Artificial Sequence
  Synthetic
aggccctggctgctgatatgagtggaaagatatattaaagttgttggagctactgggaatcaaatgctcattcatcgcctgtgcagactgctcatctacaccaccagacaggtggtggatgaccttttgggacagcggtg

SEQ ID NO: 368584 - DNA, 140 bp, Artificial Sequence
  Synthetic
caccgctgtcccaaaaggtcatccaccacctgtctggtggtgtagatgagcagtctgcacaggcgatgaatgagcatttgattcccagtagctccaacaactttaatatatctttccactcatatcagcagccagggcct

SEQ ID NO: 368585 - DNA, 140 bp, Artificial Sequence
  Synthetic
atacgccatgctgggtctcctcggcaagcacagtgtgtaagttgcagagttgcacacatggtgtgccaggagatctgcaggtctaccacatcggaaacctattaaaaggggacagagtaacgtacttgggagtcggccat

SEQ ID NO: 368586 - DNA, 140 bp, Artificial Sequence
  Synthetic
atggccgactcccaagtacgttactctgtccccttttaataggtttccgatgtggtagacctgcagatctcctggcacaccatgtgtgcaactctgcaacttacacactgtgcttgccgaggagacccagcatggcgtat

SEQ ID NO: 368587 - DNA, 140 bp, Artificial Sequence
  Synthetic
atacgccatgctgggtctccacggacacctgattcataaaattgagcaacacttcaacacatcctggatgtcttgggatggttgtgacctagactactactgtaacatgggagactggcccgtacttgggagtcggccat

SEQ ID NO: 368588 - DNA, 140 bp, Artificial Sequence
  Synthetic
atggccgactcccaagtacgggccagtctcccatgttacagtagtagtctaggtcacaaccatcccaagacatccaggatgtgttgaagtgttgctcaattttatgaatcaggtgtccgtggagacccagcatggcgtat

SEQ ID NO: 368589 - DNA, 140 bp, Artificial Sequence
  Synthetic
atacgccatgctgggtctccacctgctcaacattgaaactgattatacaaaaacctttcactttcactctaaaagggttactgcacatggagacacaccacagctagatctgaaggcaagcgtacttgggagtcggccat

SEQ ID NO: 368590 - DNA, 140 bp, Artificial Sequence
  Synthetic
atggccgactcccaagtacgcttgccttcagatctagctgtggtgtgtctccatgtgcagtaacccttttagagtgaaagtgaaaggtttttgtataatcagtttcaatgttgagcaggtggagacccagcatggcgtat

SEQ ID NO: 368591 - DNA, 140 bp, Artificial Sequence
  Synthetic
aggccctggctgctgatatgaaaagggttactgcacatggagacacaccacagctagatctgaaggcaaggccaacctatggtgcaggtgagatcaccgtgctggtggaagttgctgacagaccttttgggacagcggtg

SEQ ID NO: 368592 - DNA, 140 bp, Artificial Sequence
  Synthetic
caccgctgtcccaaaaggtctgtcagcaacttccaccagcacggtgatctcacctgcaccataggttggccttgccttcagatctagctgtggtgtgtctccatgtgcagtaacccttttcatatcagcagccagggcct

SEQ ID NO: 368593 - DNA, 140 bp, Artificial Sequence
  Synthetic
atacgccatgctgggtctccctgatgaattcgagcgaacaaaatttaaacatgagcttacacagaacatcactacaagtgaaaagatgctattgagttggttaagtgaggacatcaaatccgtacttgggagtcggccat

SEQ ID NO: 368594 - DNA, 140 bp, Artificial Sequence
  Synthetic
atggccgactcccaagtacggatttgatgtcctcacttaaccaactcaatagcatcttttcacttgtagtgatgttctgtgtaagctcatgtttaaattttgttcgctcgaattcatcagggagacccagcatggcgtat

SEQ ID NO: 368595 - DNA, 140 bp, Artificial Sequence
  Synthetic
atacgccatgctgggtctccctaacttgcacaggttgttatgcttgtagttctggcatctcttgtaaagttagaattcatgtagaggaaccagatgaacttacagtacatgttaaaagtgcgtacttgggagtcggccat

SEQ ID NO: 368596 - DNA, 140 bp, Artificial Sequence
  Synthetic
atggccgactcccaagtacgcacttttaacatgtactgtaagttcatctggttcctctacatgaattctaactttacaagagatgccagaactacaagcataacaacctgtgcaagttagggagacccagcatggcgtat

SEQ ID NO: 368597 - DNA, 140 bp, Artificial Sequence
  Synthetic
aggccctggctgctgatatgtagaattcatgtagaggaaccagatgaacttacagtacatgttaaaagtgatgacccagatgtagttgcagctagctcaagtctcatggcgaggaagcttgaccttttgggacagcggtg

SEQ ID NO: 368598 - DNA, 140 bp, Artificial Sequence
  Synthetic
caccgctgtcccaaaaggtcaagcttcctcgccatgagacttgagctagctgcaactacatctgggtcatcacttttaacatgtactgtaagttcatctggttcctctacatgaattctacatatcagcagccagggcct

SEQ ID NO: 368599 - DNA, 140 bp, Artificial Sequence
  Synthetic
aggccctggctgctgatatgactaatcactgcagcaactgtcaccccaatggtgtaaacattagtaacacatctaatgtgttcaagagatgccccaagatagaagtggtcagtcattgtggaccttttgggacagcggtg

SEQ ID NO: 368600 - DNA, 140 bp, Artificial Sequence
  Synthetic
caccgctgtcccaaaaggtccacaatgactgaccacttctatcttggggcatctcttgaacacattagatgtgttactaatgtttacaccattggggtgacagttgctgcagtgattagtcatatcagcagccagggcct

SEQ ID NO: 368601 - DNA, 140 bp, Artificial Sequence
  Synthetic
atacgccatgctgggtctccctccctatgtttctacattgtggaaagagaatactgtaagagctgcagtaaagaagatacacaaaaatgtgttaacacgaaactcgaacaaccacagagccgtacttgggagtcggccat

SEQ ID NO: 368602 - DNA, 140 bp, Artificial Sequence
  Synthetic
atggccgactcccaagtacggctctgtggttgttcgagtttcgtgttaacacatttttgtgtatcttctttactgcagctcttacagtattctctttccacaatgtagaaacatagggagggagacccagcatggcgtat

SEQ ID NO: 368603 - DNA, 140 bp, Artificial Sequence
  Synthetic
atacgccatgctgggtctccattgttaggctcacattaccgggaaaaactgagaaggagagaagaatcaaacgcaatgtggaatatcttataaagctgatgatgagcatgtcaggcattgcgtacttgggagtcggccat

SEQ ID NO: 368604 - DNA, 140 bp, Artificial Sequence
  Synthetic
atggccgactcccaagtacgcaatgcctgacatgctcatcatcagctttataagatattccacattgcgtttgattcttctctccttctcagtttttcccggtaatgtgagcctaacaatggagacccagcatggcgtat

SEQ ID NO: 368605 - DNA, 140 bp, Artificial Sequence
  Synthetic
atacgccatgctgggtctcccacggctaaagcgagttgctggttagagtcagttaagagttttttttatggtctgaagaatatgctcggtggcatatttggcaatgtttttataggcattcgtacttgggagtcggccat

SEQ ID NO: 368606 - DNA, 140 bp, Artificial Sequence
  Synthetic
atggccgactcccaagtacgaatgcctataaaaacattgccaaatatgccaccgagcatattcttcagaccataaaaaaaactcttaactgactctaaccagcaactcgctttagccgtgggagacccagcatggcgtat

SEQ ID NO: 368607 - DNA, 140 bp, Artificial Sequence
  Synthetic
aggccctggctgctgatatgattgtataaaatatcccacaggacagcttattacccatggaagagtaagtgcaaaacataacgatggaaacttgaaagatagaagtgatgacgaccaaaggaccttttgggacagcggtg

SEQ ID NO: 368608 - DNA, 140 bp, Artificial Sequence
  Synthetic
caccgctgtcccaaaaggtcctttggtcgtcatcacttctatctttcaagtttccatcgttatgttttgcacttactcttccatgggtaataagctgtcctgtgggatattttatacaatcatatcagcagccagggcct

SEQ ID NO: 368609 - DNA, 140 bp, Artificial Sequence
  Synthetic
atacgccatgctgggtctccgtggaggatcctgttttgcttcaagtgttgcagaagaaccagaggcctattcaagtacagacacctcaaagacgatgaagaaactggttacagaaagatccgtacttgggagtcggccat

SEQ ID NO: 368610 - DNA, 140 bp, Artificial Sequence
  Synthetic
atggccgactcccaagtacggatctttctgtaaccagtttcttcatcgtctttgaggtgtctgtacttgaataggcctctggttcttctgcaacacttgaagcaaaacaggatcctccacggagacccagcatggcgtat

SEQ ID NO: 368611 - DNA, 140 bp, Artificial Sequence
  Synthetic
aggccctggctgctgatatgtcaagtacagacacctcaaagacgatgaagaaactggttacagaaagatcattgaaagactgaacaacaaaaagggaaaaaacaggctgcttgatggtgagaccttttgggacagcggtg

SEQ ID NO: 368612 - DNA, 140 bp, Artificial Sequence
  Synthetic
caccgctgtcccaaaaggtctcaccatcaagcagcctgttttttccctttttgttgttcagtctttcaatgatctttctgtaaccagtttcttcatcgtctttgaggtgtctgtacttgacatatcagcagccagggcct

SEQ ID NO: 368613 - DNA, 140 bp, Artificial Sequence
  Synthetic
atacgccatgctgggtctccttggctagatcaaccggaggggcctgggaggtgacggccctgcgccggctggtgctgctgctcatgctaattcctttaattgcatccccaccatattacccgtacttgggagtcggccat

SEQ ID NO: 368614 - DNA, 140 bp, Artificial Sequence
  Synthetic
atggccgactcccaagtacgggtaatatggtggggatgcaattaaaggaattagcatgagcagcagcaccagccggcgcagggccgtcacctcccaggcccctccggttgatctagccaaggagacccagcatggcgtat

SEQ ID NO: 368615 - DNA, 140 bp, Artificial Sequence
  Synthetic
atacgccatgctgggtctccatcacaatatgccacatctaagctgcttcattgtatctacaaacagactctgtaatgcttgaaactgccttcgctctgtttgctttgacctaaatcttgacgtacttgggagtcggccat

SEQ ID NO: 368616 - DNA, 140 bp, Artificial Sequence
  Synthetic
atggccgactcccaagtacgtcaagatttaggtcaaagcaaacagagcgaaggcagtttcaagcattacagagtctgtttgtagatacaatgaagcagcttagatgtggcatattgtgatggagacccagcatggcgtat

SEQ ID NO: 368617 - DNA, 140 bp, Artificial Sequence
  Synthetic
aggccctggctgctgatatgttgactgtatactgttcaaagaagtggcagctgagtgcatgaagaggtacattggtacaccttatgaaggaattgtagacaccttagtttccttgattaagaccttttgggacagcggtg

SEQ ID NO: 368618 - DNA, 140 bp, Artificial Sequence
  Synthetic
caccgctgtcccaaaaggtcttaatcaaggaaactaaggtgtctacaattccttcataaggtgtaccaatgtacctcttcatgcactcagctgccacttctttgaacagtatacagtcaacatatcagcagccagggcct

SEQ ID NO: 368619 - DNA, 140 bp, Artificial Sequence
  Synthetic
atacgccatgctgggtctcctctcaaaaggaaacacgtgccgctaacgcccacagtgttctcttgagtgctagcaaaatggagaataaaatcgaggtgaacaacaaagatgagatgaacacgtacttgggagtcggccat

SEQ ID NO: 368620 - DNA, 140 bp, Artificial Sequence
  Synthetic
atggccgactcccaagtacgtgttcatctcatctttgttgttcacctcgattttattctccattttgctagcactcaagagaacactgtgggcgttagcggcacgtgtttccttttgagaggagacccagcatggcgtat

SEQ ID NO: 368621 - DNA, 140 bp, Artificial Sequence
  Synthetic
aggccctggctgctgatatgtagcaaaatggagaataaaatcgaggtgaacaacaaagatgagatgaacaagtggtttgaagagttcaagaaaggaaatggacttgtggacactttcacagaccttttgggacagcggtg

SEQ ID NO: 368622 - DNA, 140 bp, Artificial Sequence
  Synthetic
caccgctgtcccaaaaggtctgtgaaagtgtccacaagtccatttcctttcttgaactcttcaaaccacttgttcatctcatctttgttgttcacctcgattttattctccattttgctacatatcagcagccagggcct

SEQ ID NO: 368623 - DNA, 140 bp, Artificial Sequence
  Synthetic
atacgccatgctgggtctcctttgtgagaccttcctgagatgctgcacagaatttaataggtcaggggtcaaactagttaagataaggcactgtgacattaacctatcagtcaaactgcccgtacttgggagtcggccat

SEQ ID NO: 368624 - DNA, 140 bp, Artificial Sequence
  Synthetic
atggccgactcccaagtacgggcagtttgactgataggttaatgtcacagtgccttatcttaactagtttgacccctgacctattaaattctgtgcagcatctcaggaaggtctcacaaaggagacccagcatggcgtat

SEQ ID NO: 368625 - DNA, 140 bp, Artificial Sequence
  Synthetic
aggccctggctgctgatatgaaactagttaagataaggcactgtgacattaacctatcagtcaaactgccatcgaataaaaaagagaatatgttatgttgtatatacagcagtaacatgggaccttttgggacagcggtg

SEQ ID NO: 368626 - DNA, 140 bp, Artificial Sequence
  Synthetic
caccgctgtcccaaaaggtcccatgttactgctgtatatacaacataacatattctcttttttattcgatggcagtttgactgataggttaatgtcacagtgccttatcttaactagtttcatatcagcagccagggcct

SEQ ID NO: 368627 - DNA, 140 bp, Artificial Sequence
  Synthetic
atacgccatgctgggtctcctcttcatacctttacattgtcattacactttatatacaagtgctacagcagtataggtgcctggaagtcataaacagtatgaacgaaaagacattacaagcgtacttgggagtcggccat

SEQ ID NO: 368628 - DNA, 140 bp, Artificial Sequence
  Synthetic
atggccgactcccaagtacgcttgtaatgtcttttcgttcatactgtttatgacttccaggcacctatactgctgtagcacttgtatataaagtgtaatgacaatgtaaaggtatgaagaggagacccagcatggcgtat

SEQ ID NO: 368629 - DNA, 140 bp, Artificial Sequence
  Synthetic
aggccctggctgctgatatgttgaggtccctaaaatagagcagcttgccaattaccaacaggctgctctaaagtggagaaaggacataggtttccgtgttaatgcaaatacggcagccttgaccttttgggacagcggtg

SEQ ID NO: 368630 - DNA, 140 bp, Artificial Sequence
  Synthetic
caccgctgtcccaaaaggtcaaggctgccgtatttgcattaacacggaaacctatgtcctttctccactttagagcagcctgttggtaattggcaagctgctctattttagggacctcaacatatcagcagccagggcct

SEQ ID NO: 368631 - DNA, 140 bp, Artificial Sequence
  Synthetic
atacgccatgctgggtctccacttctgcacttgaaggtaggtttgaagaatcttataagatacgaacctcaaggtgcagagctagtgggaattttttgaatagaagcagcagagaccactcgtacttgggagtcggccat

SEQ ID NO: 368632 - DNA, 140 bp, Artificial Sequence
  Synthetic
atggccgactcccaagtacgagtggtctctgctgcttctattcaaaaaattcccactagctctgcaccttgaggttcgtatcttataagattcttcaaacctaccttcaagtgcagaagtggagacccagcatggcgtat

SEQ ID NO: 368633 - DNA, 140 bp, Artificial Sequence
  Synthetic
atacgccatgctgggtctcccaatattaagtgctggaagcaaagagatctatgtcctgaagtgaccattccatgctttacggtctatggaacttttatcaacagcgacagacaactgatccgtacttgggagtcggccat

SEQ ID NO: 368634 - DNA, 140 bp, Artificial Sequence
  Synthetic
atggccgactcccaagtacggatcagttgtctgtcgctgttgataaaagttccatagaccgtaaagcatggaatggtcacttcaggacatagatctctttgcttccagcacttaatattgggagacccagcatggcgtat

SEQ ID NO: 368635 - DNA, 140 bp, Artificial Sequence
  Synthetic
atacgccatgctgggtctccaggacgaggttgacaaagcaagtgccgacaacatgataacaaaccttcttaaacacatcgccaaggcacaggagctttacaaaaactcgtctgcacttcgcgtacttgggagtcggccat

SEQ ID NO: 368636 - DNA, 140 bp, Artificial Sequence
  Synthetic
atggccgactcccaagtacgcgaagtgcagacgagtttttgtaaagctcctgtgccttggcgatgtgtttaagaaggtttgttatcatgttgtcggcacttgctttgtcaacctcgtcctggagacccagcatggcgtat

SEQ ID NO: 368637 - DNA, 140 bp, Artificial Sequence
  Synthetic
atacgccatgctgggtctccgggaactcgatctgatgaactcactttgttctgacgaaaagagagatactagaaccgcaagactattactaggttgcccaaatgtgaggaaagcagcaaacgtacttgggagtcggccat

SEQ ID NO: 368638 - DNA, 140 bp, Artificial Sequence
  Synthetic
atggccgactcccaagtacgtttgctgctttcctcacatttgggcaacctagtaatagtcttgcggttctagtatctctcttttcgtcagaacaaagtgagttcatcagatcgagttcccggagacccagcatggcgtat

SEQ ID NO: 368639 - DNA, 140 bp, Artificial Sequence
  Synthetic
aggccctggctgctgatatgagaaccgcaagactattactaggttgcccaaatgtgaggaaagcagcaaacaaagaggggaagaagctgttgaagttaaacagcgacacatccactgacagaccttttgggacagcggtg

SEQ ID NO: 368640 - DNA, 140 bp, Artificial Sequence
  Synthetic
caccgctgtcccaaaaggtctgtcagtggatgtgtcgctgtttaacttcaacagcttcttcccctctttgtttgctgctttcctcacatttgggcaacctagtaatagtcttgcggttctcatatcagcagccagggcct

SEQ ID NO: 368641 - DNA, 140 bp, Artificial Sequence
  Synthetic
aggccctggctgctgatatgattgctaatatacttgccagtgaactaagttctgtgaagcgagactctgaacgcgaaggtctaactgatctccttgattacctaaattcacccaccgaacgaccttttgggacagcggtg

SEQ ID NO: 368642 - DNA, 140 bp, Artificial Sequence
  Synthetic
caccgctgtcccaaaaggtcgttcggtgggtgaatttaggtaatcaaggagatcagttagaccttcgcgttcagagtctcgcttcacagaacttagttcactggcaagtatattagcaatcatatcagcagccagggcct

SEQ ID NO: 368643 - DNA, 140 bp, Artificial Sequence
  Synthetic
atacgccatgctgggtctccaagagtagaattcgtagtatctttggaaggtacaactctcagaaaaaaccatttgagttaagatcgggtcttgaggttttcaatgatcctttcaatgattcgtacttgggagtcggccat

SEQ ID NO: 368644 - DNA, 140 bp, Artificial Sequence
  Synthetic
atggccgactcccaagtacgaatcattgaaaggatcattgaaaacctcaagacccgatcttaactcaaatggttttttctgagagttgtaccttccaaagatactacgaattctactcttggagacccagcatggcgtat

SEQ ID NO: 368645 - DNA, 140 bp, Artificial Sequence
  Synthetic
atacgccatgctgggtctccaaagaaagtattctgaaagactgtcttcaaatcatacgaaaaaaccccagccacacaatgggttcttttgagctgatccaagcagtctcagagttcggcacgtacttgggagtcggccat

SEQ ID NO: 368646 - DNA, 140 bp, Artificial Sequence
  Synthetic
atggccgactcccaagtacgtgccgaactctgagactgcttggatcagctcaaaagaacccattgtgtggctggggttttttcgtatgatttgaagacagtctttcagaatactttctttggagacccagcatggcgtat

SEQ ID NO: 368647 - DNA, 140 bp, Artificial Sequence
  Synthetic
atacgccatgctgggtctccctgagaataagaagatagtcaaaatgcttcgtgggaagctaaagaaactcggtgctatctcaacaaacatagagatcgggaaaagggattgcttagatctcgtacttgggagtcggccat

SEQ ID NO: 368648 - DNA, 140 bp, Artificial Sequence
  Synthetic
atggccgactcccaagtacgagatctaagcaatcccttttcccgatctctatgtttgttgagatagcaccgagtttctttagcttcccacgaagcattttgactatcttcttattctcagggagacccagcatggcgtat

SEQ ID NO: 368649 - DNA, 140 bp, Artificial Sequence
  Synthetic
atacgccatgctgggtctccacgggatatttgaaccctcaaagttgtctttctatcactggaaggaactggtcagaaagaacattgatgaagtactacttactgaggatgggaatctgatcgtacttgggagtcggccat

SEQ ID NO: 368650 - DNA, 140 bp, Artificial Sequence
  Synthetic
atggccgactcccaagtacgatcagattcccatcctcagtaagtagtacttcatcaatgttctttctgaccagttccttccagtgatagaaagacaactttgagggttcaaatatcccgtggagacccagcatggcgtat

SEQ ID NO: 368651 - DNA, 140 bp, Artificial Sequence
  Synthetic
aggccctggctgctgatatgtttttgcttgaaaataacccaagaaggaaggggccacgtgaagctttcaagagactcagaagttgtcctggacgcctgcgattcaagctgtgaaataatggaccttttgggacagcggtg

SEQ ID NO: 368652 - DNA, 140 bp, Artificial Sequence
  Synthetic
caccgctgtcccaaaaggtccattatttcacagcttgaatcgcaggcgtccaggacaacttctgagtctcttgaaagcttcacgtggccccttccttcttgggttattttcaagcaaaaacatatcagcagccagggcct

SEQ ID NO: 368653 - DNA, 140 bp, Artificial Sequence
  Synthetic
atacgccatgctgggtctccaacgcccggtgataaccagagccctgaaccgctagtgagcacggccctgcctgtcacaccggacccttccactatcacacctacagcaccagccagcggacgtacttgggagtcggccat

SEQ ID NO: 368654 - DNA, 140 bp, Artificial Sequence
  Synthetic
atggccgactcccaagtacgtccgctggctggtgctgtaggtgtgatagtggaagggtccggtgtgacaggcagggccgtgctcactagcggttcagggctctggttatcaccgggcgttggagacccagcatggcgtat

SEQ ID NO: 368655 - DNA, 140 bp, Artificial Sequence
  Synthetic
aggccctggctgctgatatgctgtcacaccggacccttccactatcacacctacagcaccagccagcggattagaaggctcaggggaagtttatacatcttcctcaatcaccaccaaggggaccttttgggacagcggtg

SEQ ID NO: 368656 - DNA, 140 bp, Artificial Sequence
  Synthetic
caccgctgtcccaaaaggtccccttggtggtgattgaggaagatgtataaacttcccctgagccttctaatccgctggctggtgctgtaggtgtgatagtggaagggtccggtgtgacagcatatcagcagccagggcct

SEQ ID NO: 368657 - DNA, 140 bp, Artificial Sequence
  Synthetic
atacgccatgctgggtctcctgcctcttttctagtgaggagttcaacgaattaattaagctaaagaaactcctcctcaacgaacaacaagatgaacaggatctgaaacaagatttgttgacgtacttgggagtcggccat

SEQ ID NO: 368658 - DNA, 140 bp, Artificial Sequence
  Synthetic
atggccgactcccaagtacgtcaacaaatcttgtttcagatcctgttcatcttgttgttcgttgaggaggagtttctttagcttaattaattcgttgaactcctcactagaaaagaggcaggagacccagcatggcgtat

SEQ ID NO: 368659 - DNA, 140 bp, Artificial Sequence
  Synthetic
atacgccatgctgggtctcctcacttcaagtgcaagcgatatcgatcctagcacacaggcagccggagacacccccacaccaacagtccgcacaagtctgcccaacagccccagcacacccgtacttgggagtcggccat

SEQ ID NO: 368660 - DNA, 140 bp, Artificial Sequence
  Synthetic
atggccgactcccaagtacgggtgtgctggggctgttgggcagacttgtgcggactgttggtgtgggggtgtctccggctgcctgtgtgctaggatcgatatcgcttgcacttgaagtgaggagacccagcatggcgtat

SEQ ID NO: 368661 - DNA, 140 bp, Artificial Sequence
  Synthetic
aggccctggctgctgatatgacccccacaccaacagtccgcacaagtctgcccaacagccccagcacaccatctacatcgcaagacacacaccatcctgtaaggaatctactttcagtcagaccttttgggacagcggtg

SEQ ID NO: 368662 - DNA, 140 bp, Artificial Sequence
  Synthetic
caccgctgtcccaaaaggtctgactgaaagtagattccttacaggatggtgtgtgtcttgcgatgtagatggtgtgctggggctgttgggcagacttgtgcggactgttggtgtgggggtcatatcagcagccagggcct

SEQ ID NO: 368663 - DNA, 140 bp, Artificial Sequence
  Synthetic
atacgccatgctgggtctccagctcagcaaccaacagccctcacccagccgccagcagactatcaaccccccccacaacagaccagggacccactgaaaacaacaaccacaactccaccgcgtacttgggagtcggccat

SEQ ID NO: 368664 - DNA, 140 bp, Artificial Sequence
  Synthetic
atggccgactcccaagtacgcggtggagttgtggttgttgttttcagtgggtccctggtctgttgtggggggggttgatagtctgctggcggctgggtgagggctgttggttgctgagctggagacccagcatggcgtat

SEQ ID NO: 368665 - DNA, 140 bp, Artificial Sequence
  Synthetic
aggccctggctgctgatatgccccacaacagaccagggacccactgaaaacaacaaccacaactccaccgaacagcttgagtccttaacacgatcagcaacttcaagctcaatggtctctgaccttttgggacagcggtg

SEQ ID NO: 368666 - DNA, 140 bp, Artificial Sequence
  Synthetic
caccgctgtcccaaaaggtcagagaccattgagcttgaagttgctgatcgtgttaaggactcaagctgttcggtggagttgtggttgttgttttcagtgggtccctggtctgttgtggggcatatcagcagccagggcct

SEQ ID NO: 368667 - DNA, 140 bp, Artificial Sequence
  Synthetic
atacgccatgctgggtctcctgcaagctcactttgcttgatctgtcagtttccaagctcctggtttgtttgtatcaaaaagacgatgaagaattaacaaatagctcaagtttaaaacttgcgtacttgggagtcggccat

SEQ ID NO: 368668 - DNA, 140 bp, Artificial Sequence
  Synthetic
atggccgactcccaagtacgcaagttttaaacttgagctatttgttaattcttcatcgtctttttgatacaaacaaaccaggagcttggaaactgacagatcaagcaaagtgagcttgcaggagacccagcatggcgtat

SEQ ID NO: 368669 - DNA, 140 bp, Artificial Sequence
  Synthetic
atacgccatgctgggtctcccacacatcccagcccaacgaacaggtctaaaagaaaccttgaaatggaaataatcttgacattgcctcaaggtttaaaaaaatattatggcaaaatacttcgtacttgggagtcggccat

SEQ ID NO: 368670 - DNA, 140 bp, Artificial Sequence
  Synthetic
atggccgactcccaagtacgaagtattttgccataatatttttttaaaccttgaggcaatgtcaagattatttccatttcaaggtttcttttagacctgttcgttgggctgggatgtgtgggagacccagcatggcgtat

SEQ ID NO: 368671 - DNA, 140 bp, Artificial Sequence
  Synthetic
atacgccatgctgggtctccgtgtaaaaggaatctcggtcttgactgtgatgacaccttctttcaaaaaagaattgaagaattctttataactggtgaaggtcatttcaatgaagttttacgtacttgggagtcggccat

SEQ ID NO: 368672 - DNA, 140 bp, Artificial Sequence
  Synthetic
atggccgactcccaagtacgtaaaacttcattgaaatgaccttcaccagttataaagaattcttcaattcttttttgaaagaaggtgtcatcacagtcaagaccgagattccttttacacggagacccagcatggcgtat

SEQ ID NO: 368673 - DNA, 140 bp, Artificial Sequence
  Synthetic
aggccctggctgctgatatgcaatagattcaggttatttctctgccaaatgttattcaagaacatccaattcagggcttcagttgattaatgttacccgacactcaactaggatagctgagaccttttgggacagcggtg

SEQ ID NO: 368674 - DNA, 140 bp, Artificial Sequence
  Synthetic
caccgctgtcccaaaaggtctcagctatcctagttgagtgtcgggtaacattaatcaactgaagccctgaattggatgttcttgaataacatttggcagagaaataacctgaatctattgcatatcagcagccagggcct

SEQ ID NO: 368675 - DNA, 140 bp, Artificial Sequence
  Synthetic
atacgccatgctgggtctccactaggaggagcaagagacttgttagtgcaagagactgggactaaggtcatgcatgcaaccactgaaatgttcagcagaaatctcttaaagacaacatcacgtacttgggagtcggccat

SEQ ID NO: 368676 - DNA, 140 bp, Artificial Sequence
  Synthetic
atggccgactcccaagtacgtgatgttgtctttaagagatttctgctgaacatttcagtggttgcatgcatgaccttagtcccagtctcttgcactaacaagtctcttgctcctcctagtggagacccagcatggcgtat

SEQ ID NO: 368677 - DNA, 140 bp, Artificial Sequence
  Synthetic
atacgccatgctgggtctcctaaaagcatccgtatttaaagaacatagagaggttgaaattaatgtgcttctccctcaagttgcagttaacctttcaaattgtcacgttgcaatcaaatccgtacttgggagtcggccat

SEQ ID NO: 368678 - DNA, 140 bp, Artificial Sequence
  Synthetic
atggccgactcccaagtacggatttgattgcaacgtgacaatttgaaaggttaactgcaacttgagggagaagcacattaatttcaacctctctatgttctttaaatacggatgcttttaggagacccagcatggcgtat

SEQ ID NO: 368679 - DNA, 140 bp, Artificial Sequence
  Synthetic
atacgccatgctgggtctccacatgtctgcgattattctttggacactgacggggcgattaggctacctcatattcattatgaaggaacttttattccaggaacttacaagatagtgatacgtacttgggagtcggccat

SEQ ID NO: 368680 - DNA, 140 bp, Artificial Sequence
  Synthetic
atggccgactcccaagtacgtatcactatcttgtaagttcctggaataaaagttccttcataatgaatatgaggtagcctaatcgccccgtcagtgtccaaagaataatcgcagacatgtggagacccagcatggcgtat

SEQ ID NO: 368681 - DNA, 140 bp, Artificial Sequence
  Synthetic
aggccctggctgctgatatgaaggtagcaacttggtcaatttctacaaagtcatatgtatctcgggtgataataccaagtggggcccgatacactgttgttctttcttttctggtatgatgaccttttgggacagcggtg

SEQ ID NO: 368682 - DNA, 140 bp, Artificial Sequence
  Synthetic
caccgctgtcccaaaaggtcatcataccagaaaagaaagaacaacagtgtatcgggccccacttggtattatcacccgagatacatatgactttgtagaaattgaccaagttgctaccttcatatcagcagccagggcct

SEQ ID NO: 368683 - DNA, 140 bp, Artificial Sequence
  Synthetic
atacgccatgctgggtctccgataaaaggaagagaagttcgtaaaggccagtcagtcctaaggcaatataagacagaaattagaattggtagagcatcaactggttctaggagactgcttcgtacttgggagtcggccat

SEQ ID NO: 368684 - DNA, 140 bp, Artificial Sequence
  Synthetic
atggccgactcccaagtacgaagcagtctcctagaaccagttgatgctctaccaattctaatttctgtcttatattgccttaggactgactggcctttacgaacttctcttccttttatcggagacccagcatggcgtat

SEQ ID NO: 368685 - DNA, 140 bp, Artificial Sequence
  Synthetic
atacgccatgctgggtctcccatttattaagaacctgtgtaggcaggtagaaatacctgctggcagcattaagaagatcttaaatgttcttagatacagactgtgcagcaaaggaggtgtcgtacttgggagtcggccat

SEQ ID NO: 368686 - DNA, 140 bp, Artificial Sequence
  Synthetic
atggccgactcccaagtacgacacctcctttgctgcacagtctgtatctaagaacatttaagatcttcttaatgctgccagcaggtatttctacctgcctacacaggttcttaataaatgggagacccagcatggcgtat

SEQ ID NO: 368687 - DNA, 140 bp, Artificial Sequence
  Synthetic
aggccctggctgctgatatgagcaaaggactcatggcgttaaacagttacaatcatatgggtcagggtattcatcatgcaacatcttcggtgttaacttccctagctgccgtgctctttggaccttttgggacagcggtg

SEQ ID NO: 368688 - DNA, 140 bp, Artificial Sequence
  Synthetic
caccgctgtcccaaaaggtccaaagagcacggcagctagggaagttaacaccgaagatgttgcatgatgaataccctgacccatatgattgtaactgtttaacgccatgagtcctttgctcatatcagcagccagggcct

SEQ ID NO: 368689 - DNA, 140 bp, Artificial Sequence
  Synthetic
aggccctggctgctgatatgcagtgccacagggaagagctgtgaaatagacagtatcccagttaagtgtaggcagggttattgcctaaaaattactcaggaaggaaggggccatgttaaagaccttttgggacagcggtg

SEQ ID NO: 368690 - DNA, 140 bp, Artificial Sequence
  Synthetic
caccgctgtcccaaaaggtctttaacatggccccttccttcctgagtaatttttaggcaataaccctgcctacacttaactgggatactgtctatttcacagctcttccctgtggcactgcatatcagcagccagggcct

SEQ ID NO: 368691 - DNA, 140 bp, Artificial Sequence
  Synthetic
atacgccatgctgggtctccagtgatgatacctaagggcactggtgacattctagtagattgttcaggtgggcagcaacattttttaaaggacaacctgattgatctaggatgtcctaaacgtacttgggagtcggccat

SEQ ID NO: 368692 - DNA, 140 bp, Artificial Sequence
  Synthetic
atggccgactcccaagtacgtttaggacatcctagatcaatcaggttgtcctttaaaaaatgttgctgcccacctgaacaatctactagaatgtcaccagtgcccttaggtatcatcactggagacccagcatggcgtat

SEQ ID NO: 368693 - DNA, 140 bp, Artificial Sequence
  Synthetic
aggccctggctgctgatatgggaagcatgcttgtagacttaagaacttcacagctgcagtacaaagatgttgccaaatgaaagatagtgccaaaaccttagtgagcgactgttttcttgagaccttttgggacagcggtg

SEQ ID NO: 368694 - DNA, 140 bp, Artificial Sequence
  Synthetic
caccgctgtcccaaaaggtctcaagaaaacagtcgctcactaaggttttggcactatctttcatttggcaacatctttgtactgcagctgtgaagttcttaagtctacaagcatgcttcccatatcagcagccagggcct

SEQ ID NO: 368695 - DNA, 140 bp, Artificial Sequence
  Synthetic
atacgccatgctgggtctccatcccattattgggcaaaatggctatttatatctgcagaatgtcgaatcaccccaaaacaaccatggcctttctcttttggttcagcttcggctatgtgacgtacttgggagtcggccat

SEQ ID NO: 368696 - DNA, 140 bp, Artificial Sequence
  Synthetic
atggccgactcccaagtacgtcacatagccgaagctgaaccaaaagagaaaggccatggttgttttggggtgattcgacattctgcagatataaatagccattttgcccaataatgggatggagacccagcatggcgtat

SEQ ID NO: 368697 - DNA, 140 bp, Artificial Sequence
  Synthetic
atacgccatgctgggtctccagtttatgttcactggactgataaatagttctgtgacctctcctcagagtttaatgcaagcatgccaagtttcatctcaacaagcaatgtataatagtgtcgtacttgggagtcggccat

SEQ ID NO: 368698 - DNA, 140 bp, Artificial Sequence
  Synthetic
atggccgactcccaagtacgacactattatacattgcttgttgagatgaaacttggcatgcttgcattaaactctgaggagaggtcacagaactatttatcagtccagtgaacataaactggagacccagcatggcgtat

SEQ ID NO: 368699 - DNA, 140 bp, Artificial Sequence
  Synthetic
atacgccatgctgggtctcccccacttgtcaccaacactgcctttactctattaaggcagcaaatattcttcaatcatgttgaagattttatcagaaggtatggtatattaactcttgggcgtacttgggagtcggccat

SEQ ID NO: 368700 - DNA, 140 bp, Artificial Sequence
  Synthetic
atggccgactcccaagtacgcccaagagttaatataccataccttctgataaaatcttcaacatgattgaagaatatttgctgccttaatagagtaaaggcagtgttggtgacaagtgggggagacccagcatggcgtat

SEQ ID NO: 368701 - DNA, 140 bp, Artificial Sequence
  Synthetic
atacgccatgctgggtctcctcagatgggctcgctaggcatgtaacacaatgccctaagcggaaggagaaggtggaagagaccgaattgtacttgaacttagagagaattccttgggttgcgtacttgggagtcggccat

SEQ ID NO: 368702 - DNA, 140 bp, Artificial Sequence
  Synthetic
atggccgactcccaagtacgcaacccaaggaattctctctaagttcaagtacaattcggtctcttccaccttctccttccgcttagggcattgtgttacatgcctagcgagcccatctgaggagacccagcatggcgtat

SEQ ID NO: 368703 - DNA, 140 bp, Artificial Sequence
  Synthetic
aggccctggctgctgatatgggtggaagagaccgaattgtacttgaacttagagagaattccttgggttgtaagaaagctattgcaggtgtcagagtccactggcatagcattaaaaagggaccttttgggacagcggtg

SEQ ID NO: 368704 - DNA, 140 bp, Artificial Sequence
  Synthetic
caccgctgtcccaaaaggtccctttttaatgctatgccagtggactctgacacctgcaatagctttcttacaacccaaggaattctctctaagttcaagtacaattcggtctcttccacccatatcagcagccagggcct

SEQ ID NO: 368705 - DNA, 140 bp, Artificial Sequence
  Synthetic
aggccctggctgctgatatgaaacacttcatatgaacagtgtatcgatacagtcaagtagcttaaccacattggacagcctaggtcgtagtaggacaagttctacagctgaggatagcaggaccttttgggacagcggtg

SEQ ID NO: 368706 - DNA, 140 bp, Artificial Sequence
  Synthetic
caccgctgtcccaaaaggtcctgctatcctcagctgtagaacttgtcctactacgacctaggctgtccaatgtggttaagctacttgactgtatcgatacactgttcatatgaagtgtttcatatcagcagccagggcct

SEQ ID NO: 368707 - DNA, 140 bp, Artificial Sequence
  Synthetic
aggccctggctgctgatatgtgtgaaacaactcctgtcaatgcaatagatgctgagatgcacgatctcaattgtagttacaatatatgtccttattgtgcatctaggttaacttcagatggaccttttgggacagcggtg

SEQ ID NO: 368708 - DNA, 140 bp, Artificial Sequence
  Synthetic
caccgctgtcccaaaaggtccatctgaagttaacctagatgcacaataaggacatatattgtaactacaattgagatcgtgcatctcagcatctattgcattgacaggagttgtttcacacatatcagcagccagggcct

SEQ ID NO: 368709 - DNA, 140 bp, Artificial Sequence
  Synthetic
atacgccatgctgggtctccggttcaatcagcgcccattggtcacgggaagacaattgaagcgtaccgggctagggaggaatacacaagcatttgtctctttgtgctgggaagtgtcttgcgtacttgggagtcggccat

SEQ ID NO: 368710 - DNA, 140 bp, Artificial Sequence
  Synthetic
atggccgactcccaagtacgcaagacacttcccagcacaaagagacaaatgcttgtgtattcctccctagcccggtacgcttcaattgtcttcccgtgaccaatgggcgctgattgaaccggagacccagcatggcgtat

SEQ ID NO: 368711 - DNA, 140 bp, Artificial Sequence
  Synthetic
atacgccatgctgggtctcccttctttcctgggctgttcatttgtaagacatgttctataggtagcattaatggctttgaaattgagtctcataagtgctattgtagcttgttttgttgccgtacttgggagtcggccat

SEQ ID NO: 368712 - DNA, 140 bp, Artificial Sequence
  Synthetic
atggccgactcccaagtacggcaacaaaacaagctacaatagcacttatgagactcaatttcaaagccattaatgctacctatagaacatgtcttacaaatgaacagcccaggaaagaagggagacccagcatggcgtat

SEQ ID NO: 368713 - DNA, 140 bp, Artificial Sequence
  Synthetic
atacgccatgctgggtctccgagcatctgcaaaaaaaggaagacaggaagtaatgtcatgctggctgtttgcaaacgcatgtgtttcagagcaactatggaagtaagcaacaaagccctacgtacttgggagtcggccat

SEQ ID NO: 368714 - DNA, 140 bp, Artificial Sequence
  Synthetic
atggccgactcccaagtacgtagggctttgttgcttacttccatagttgctctgaaacacatgcgtttgcaaacagccagcatgacattacttcctgtcttcctttttttgcagatgctcggagacccagcatggcgtat

SEQ ID NO: 368715 - DNA, 140 bp, Artificial Sequence
  Synthetic
aggccctggctgctgatatgaaggaaccgaaaaacaagtaaaggcatcattgaatagagacgacaacaaaatcattgaggatcctatgatacagctaattccagagaagctgaggagagagaccttttgggacagcggtg

SEQ ID NO: 368716 - DNA, 140 bp, Artificial Sequence
  Synthetic
caccgctgtcccaaaaggtctctctcctcagcttctctggaattagctgtatcataggatcctcaatgattttgttgtcgtctctattcaatgatgcctttacttgtttttcggttccttcatatcagcagccagggcct

SEQ ID NO: 368717 - DNA, 140 bp, Artificial Sequence
  Synthetic
atacgccatgctgggtctccgtatcagtcctgatgacaccttagcccagcttgtggcaaaaaaactcatcagcctaaatgtatcgacagaagaatactcggctgaggtgtctaggctcaacgtacttgggagtcggccat

SEQ ID NO: 368718 - DNA, 140 bp, Artificial Sequence
  Synthetic
atggccgactcccaagtacgttgagcctagacacctcagccgagtattcttctgtcgatacatttaggctgatgagtttttttgccacaagctgggctaaggtgtcatcaggactgatacggagacccagcatggcgtat

SEQ ID NO: 368719 - DNA, 140 bp, Artificial Sequence
  Synthetic
aggccctggctgctgatatgagcctaaatgtatcgacagaagaatactcggctgaggtgtctaggctcaagcaaacactaacagcccggaatgttttgcatgggttggctggaggaattagaccttttgggacagcggtg

SEQ ID NO: 368720 - DNA, 140 bp, Artificial Sequence
  Synthetic
caccgctgtcccaaaaggtctaattcctccagccaacccatgcaaaacattccgggctgttagtgtttgcttgagcctagacacctcagccgagtattcttctgtcgatacatttaggctcatatcagcagccagggcct

SEQ ID NO: 368721 - DNA, 140 bp, Artificial Sequence
  Synthetic
atacgccatgctgggtctccaaagacaatgtcttcttgtcactaacagatagatggtccaccaagcacagcacaaactatcgtgatagttgtggcaaacaattaacaggtagaataataacgtacttgggagtcggccat

SEQ ID NO: 368722 - DNA, 140 bp, Artificial Sequence
  Synthetic
atggccgactcccaagtacgttattattctacctgttaattgtttgccacaactatcacgatagtttgtgctgtgcttggtggaccatctatctgttagtgacaagaagacattgtctttggagacccagcatggcgtat

SEQ ID NO: 368723 - DNA, 140 bp, Artificial Sequence
  Synthetic
aggccctggctgctgatatgcacaaactatcgtgatagttgtggcaaacaattaacaggtagaataataaccaagtatactcactggttggacacttttctaggctgctctgtctccatcgaccttttgggacagcggtg

SEQ ID NO: 368724 - DNA, 140 bp, Artificial Sequence
  Synthetic
caccgctgtcccaaaaggtcgatggagacagagcagcctagaaaagtgtccaaccagtgagtatacttggttattattctacctgttaattgtttgccacaactatcacgatagtttgtgcatatcagcagccagggcct

SEQ ID NO: 368725 - DNA, 140 bp, Artificial Sequence
  Synthetic
aggccctggctgctgatatgtgggatctcggcgtagaagatgcctctgagtctaagctacttacagtctcagtcatggacttgtctcagatgtactctcctgtcttcgagtatttatcaggaccttttgggacagcggtg

SEQ ID NO: 368726 - DNA, 140 bp, Artificial Sequence
  Synthetic
caccgctgtcccaaaaggtcctgataaatactcgaagacaggagagtacatctgagacaagtccatgactgagactgtaagtagcttagactcagaggcatcttctacgccgagatcccacatatcagcagccagggcct

SEQ ID NO: 368727 - DNA, 140 bp, Artificial Sequence
  Synthetic
atacgccatgctgggtctccatgtgttaacctgatcacatttgaggatggtctgagagaactatcggtgatacagagtcacctcaaagtcttcgaaaatgagttcaccaacttaaaccttcgtacttgggagtcggccat

SEQ ID NO: 368728 - DNA, 140 bp, Artificial Sequence
  Synthetic
atggccgactcccaagtacgaaggtttaagttggtgaactcattttcgaagactttgaggtgactctgtatcaccgatagttctctcagaccatcctcaaatgtgatcaggttaacacatggagacccagcatggcgtat

SEQ ID NO: 368729 - DNA, 140 bp, Artificial Sequence
  Synthetic
aggccctggctgctgatatgtacagagtcacctcaaagtcttcgaaaatgagttcaccaacttaaaccttcaattctctgatccaaatagacagaaacttagaatagttgagtctagaccgaccttttgggacagcggtg

SEQ ID NO: 368730 - DNA, 140 bp, Artificial Sequence
  Synthetic
caccgctgtcccaaaaggtcggtctagactcaactattctaagtttctgtctatttggatcagagaattgaaggtttaagttggtgaactcattttcgaagactttgaggtgactctgtacatatcagcagccagggcct

SEQ ID NO: 368731 - DNA, 140 bp, Artificial Sequence
  Synthetic
aggccctggctgctgatatgatgggctacctattggatgaatcagcaatttctgaagtcaagcctaccaaggttgacttctcgaatctacttaaagaccgctttaaaataatgcaattttgaccttttgggacagcggtg

SEQ ID NO: 368732 - DNA, 140 bp, Artificial Sequence
  Synthetic
caccgctgtcccaaaaggtcaaaattgcattattttaaagcggtctttaagtagattcgagaagtcaaccttggtaggcttgacttcagaaattgctgattcatccaataggtagcccatcatatcagcagccagggcct

SEQ ID NO: 368733 - DNA, 140 bp, Artificial Sequence
  Synthetic
atacgccatgctgggtctcctcggaaaagaatggccttagtccagacctgcaacaagttgcaagatactcaaaccatttgaccttactcagtaggatgatacaacaagcaaagccaaccgcgtacttgggagtcggccat

SEQ ID NO: 368734 - DNA, 140 bp, Artificial Sequence
  Synthetic
atggccgactcccaagtacgcggttggctttgcttgttgtatcatcctactgagtaaggtcaaatggtttgagtatcttgcaacttgttgcaggtctggactaaggccattcttttccgaggagacccagcatggcgtat

SEQ ID NO: 368735 - DNA, 140 bp, Artificial Sequence
  Synthetic
atacgccatgctgggtctccggaaggtttttttgacctaatgcatgtgcaaaaagtgctatcagcaagcacagtgtgtaagttacaaagctgcacacatggtgtgccaggagatctacagcgtacttgggagtcggccat

SEQ ID NO: 368736 - DNA, 140 bp, Artificial Sequence
  Synthetic
atggccgactcccaagtacgctgtagatctcctggcacaccatgtgtgcagctttgtaacttacacactgtgcttgctgatagcactttttgcacatgcattaggtcaaaaaaaccttccggagacccagcatggcgtat

SEQ ID NO: 368737 - DNA, 140 bp, Artificial Sequence
  Synthetic
atacgccatgctgggtctccgttgctgagcttgtcagctatggtataaaggaaggtaggttttataggctttctgacaccggaatcgatgcaagcacatattctgtgaaatattggaaaacgtacttgggagtcggccat

SEQ ID NO: 368738 - DNA, 140 bp, Artificial Sequence
  Synthetic
atggccgactcccaagtacgttttccaatatttcacagaatatgtgcttgcatcgattccggtgtcagaaagcctataaaacctaccttcctttataccatagctgacaagctcagcaacggagacccagcatggcgtat

SEQ ID NO: 368739 - DNA, 140 bp, Artificial Sequence
  Synthetic
atacgccatgctgggtctccaattcacaaaattgaacaacacctcaacacttcttggatgtcctgggatggttgtgatctagactactactgcaatatgggagactggccttcttgcacacgtacttgggagtcggccat

SEQ ID NO: 368740 - DNA, 140 bp, Artificial Sequence
  Synthetic
atggccgactcccaagtacgtgtgcaagaaggccagtctcccatattgcagtagtagtctagatcacaaccatcccaggacatccaagaagtgttgaggtgttgttcaattttgtgaattggagacccagcatggcgtat

SEQ ID NO: 368741 - DNA, 140 bp, Artificial Sequence
  Synthetic
atacgccatgctgggtctcctccagcttctcttttgagctcaataggcctctgtctgaaactgaactacaattcattaaagcattaagtagcttcaaatccacacaagcctgtgaagtaacgtacttgggagtcggccat

SEQ ID NO: 368742 - DNA, 140 bp, Artificial Sequence
  Synthetic
atggccgactcccaagtacgttacttcacaggcttgtgtggatttgaagctacttaatgctttaatgaattgtagttcagtttcagacagaggcctattgagctcaaaagagaagctggaggagacccagcatggcgtat

SEQ ID NO: 368743 - DNA, 140 bp, Artificial Sequence
  Synthetic
atacgccatgctgggtctccggtgcaggtgagatcactgtactggtggaagttgccgatatggagttacacacaaagaagattgaaatatcaggcttgaagtttgcaagcctatcctgcacgtacttgggagtcggccat

SEQ ID NO: 368744 - DNA, 140 bp, Artificial Sequence
  Synthetic
atggccgactcccaagtacgtgcaggataggcttgcaaacttcaagcctgatatttcaatcttctttgtgtgtaactccatatcggcaacttccaccagtacagtgatctcacctgcaccggagacccagcatggcgtat

SEQ ID NO: 368745 - DNA, 140 bp, Artificial Sequence
  Synthetic
aggccctggctgctgatatggcaagttcaacacctggggagactcaaacagatctggaaagttcacatacagcagcaggtctggagaatccattgggatcttcattgcagggaaattgcagaccttttgggacagcggtg

SEQ ID NO: 368746 - DNA, 140 bp, Artificial Sequence
  Synthetic
caccgctgtcccaaaaggtctgcaatttccctgcaatgaagatcccaatggattctccagacctgctgctgtatgtgaactttccagatctgtttgagtctccccaggtgttgaacttgccatatcagcagccagggcct

SEQ ID NO: 368747 - DNA, 140 bp, Artificial Sequence
  Synthetic
atacgccatgctgggtctcccagacagtacatttaaagctttttcagccatgcctaaaacttccttgtgcttctacattgtagagagagaatactgtaagggctgcagtaaagaagacaccgtacttgggagtcggccat

SEQ ID NO: 368748 - DNA, 140 bp, Artificial Sequence
  Synthetic
atggccgactcccaagtacggtgtcttctttactgcagcccttacagtattctctctctacaatgtagaagcacaaggaagttttaggcatggctgaaaaagctttaaatgtactgtctgggagacccagcatggcgtat

SEQ ID NO: 368749 - DNA, 140 bp, Artificial Sequence
  Synthetic
aggccctggctgctgatatgcagcaccaattatttctgagtcttcttccacagtcacatgaatgtttacaaaagcacaaggacggtagcgcgctatcagtcatacctgatagcagcaatcgaccttttgggacagcggtg

SEQ ID NO: 368750 - DNA, 140 bp, Artificial Sequence
  Synthetic
caccgctgtcccaaaaggtcgattgctgctatcaggtatgactgatagcgcgctaccgtccttgtgcttttgtaaacattcatgtgactgtggaagaagactcagaaataattggtgctgcatatcagcagccagggcct

SEQ ID NO: 368751 - DNA, 140 bp, Artificial Sequence
  Synthetic
atacgccatgctgggtctccaacacaagggaactataattggaaagcaaaataatacttgcacagctaaggcaagttgctggttagagtcagttaagagttttttttatggtctgaagaacgtacttgggagtcggccat

SEQ ID NO: 368752 - DNA, 140 bp, Artificial Sequence
  Synthetic
atggccgactcccaagtacgttcttcagaccataaaaaaaactcttaactgactctaaccagcaacttgccttagctgtgcaagtattattttgctttccaattatagttcccttgtgttggagacccagcatggcgtat

SEQ ID NO: 368753 - DNA, 140 bp, Artificial Sequence
  Synthetic
atacgccatgctgggtctccatcaagaaacaaattttgacagtgaagaagcagatcgtgtttgatgctgagagtgagcctagattacagtgggggcatggctgcttgtccattgtttatgcgtacttgggagtcggccat

SEQ ID NO: 368754 - DNA, 140 bp, Artificial Sequence
  Synthetic
atggccgactcccaagtacgcataaacaatggacaagcagccatgcccccactgtaatctaggctcactctcagcatcaaacacgatctgcttcttcactgtcaaaatttgtttcttgatggagacccagcatggcgtat

SEQ ID NO: 368755 - DNA, 140 bp, Artificial Sequence
  Synthetic
aggccctggctgctgatatggagtgagcctagattacagtgggggcatggctgcttgtccattgtttatgatgaaactgacacccagaccacataccacgagaatcttttaaaggtgaaggaccttttgggacagcggtg

SEQ ID NO: 368756 - DNA, 140 bp, Artificial Sequence
  Synthetic
caccgctgtcccaaaaggtccttcacctttaaaagattctcgtggtatgtggtctgggtgtcagtttcatcataaacaatggacaagcagccatgcccccactgtaatctaggctcactccatatcagcagccagggcct

SEQ ID NO: 368757 - DNA, 140 bp, Artificial Sequence
  Synthetic
atacgccatgctgggtctccgttttctgattccaaagtcgtcctttcaaggatcaagttcaagacagagcttctcctcaactcattgacactgctccactgtttcctaaaacatgctccccgtacttgggagtcggccat

SEQ ID NO: 368758 - DNA, 140 bp, Artificial Sequence
  Synthetic
atggccgactcccaagtacggggagcatgttttaggaaacagtggagcagtgtcaatgagttgaggagaagctctgtcttgaacttgatccttgaaaggacgactttggaatcagaaaacggagacccagcatggcgtat

SEQ ID NO: 368759 - DNA, 140 bp, Artificial Sequence
  Synthetic
aggccctggctgctgatatgttctcctcaactcattgacactgctccactgtttcctaaaacatgctcccagtgatgccataatggaggtggagagtaaaagcagcttgctacataagtagaccttttgggacagcggtg

SEQ ID NO: 368760 - DNA, 140 bp, Artificial Sequence
  Synthetic
caccgctgtcccaaaaggtctacttatgtagcaagctgcttttactctccacctccattatggcatcactgggagcatgttttaggaaacagtggagcagtgtcaatgagttgaggagaacatatcagcagccagggcct

SEQ ID NO: 368761 - DNA, 140 bp, Artificial Sequence
  Synthetic
atacgccatgctgggtctccgacagaaaaattgccgaactgttctccacaaaaacacacattggctagatcaactgaagaggcctgggggggtgatggctttgcactgactggtgttgctcgtacttgggagtcggccat

SEQ ID NO: 368762 - DNA, 140 bp, Artificial Sequence
  Synthetic
atggccgactcccaagtacgagcaacaccagtcagtgcaaagccatcacccccccaggcctcttcagttgatctagccaatgtgtgtttttgtggagaacagttcggcaatttttctgtcggagacccagcatggcgtat

SEQ ID NO: 368763 - DNA, 140 bp, Artificial Sequence
  Synthetic
atacgccatgctgggtctccagaagttaaacaagattgttataaaagacaatcttgaacaaggtgtggaagaggagattgagttctgcaacaacttaactaagactgtttcagagaaccccgtacttgggagtcggccat

SEQ ID NO: 368764 - DNA, 140 bp, Artificial Sequence
  Synthetic
atggccgactcccaagtacggggttctctgaaacagtcttagttaagttgttgcagaactcaatctcctcttccacaccttgttcaagattgtcttttataacaatcttgtttaacttctggagacccagcatggcgtat

SEQ ID NO: 368765 - DNA, 140 bp, Artificial Sequence
  Synthetic
atacgccatgctgggtctcctgccacatctaagctgcttcgttgtatccacaaacagactctgtaatgctcaaaactgccttcgctctgtttgctttgacctaaatcttgactgcgtgcccgtacttgggagtcggccat

SEQ ID NO: 368766 - DNA, 140 bp, Artificial Sequence
  Synthetic
atggccgactcccaagtacgggcacgcagtcaagatttaggtcaaagcaaacagagcgaaggcagttttgagcattacagagtctgtttgtggatacaacgaagcagcttagatgtggcaggagacccagcatggcgtat

SEQ ID NO: 368767 - DNA, 140 bp, Artificial Sequence
  Synthetic
atacgccatgctgggtctcctctcaaagatatcaatcccccctttacccacgttgacacagatagccccagtagtggttctttgtcctcatcaaactatggattttttaagaaaccttgacgtacttgggagtcggccat

SEQ ID NO: 368768 - DNA, 140 bp, Artificial Sequence
  Synthetic
atggccgactcccaagtacgtcaaggtttcttaaaaaatccatagtttgatgaggacaaagaaccactactggggctatctgtgtcaacgtgggtaaaggggggattgatatctttgagaggagacccagcatggcgtat

SEQ ID NO: 368769 - DNA, 140 bp, Artificial Sequence
  Synthetic
aggccctggctgctgatatgctcttatggaaatttacgttagacaccagtgtaagcaccacaagcaccataaaagacatgaggacattggtgtcttacgttagcacagagaccatccctagaccttttgggacagcggtg

SEQ ID NO: 368770 - DNA, 140 bp, Artificial Sequence
  Synthetic
caccgctgtcccaaaaggtctagggatggtctctgtgctaacgtaagacaccaatgtcctcatgtcttttatggtgcttgtggtgcttacactggtgtctaacgtaaatttccataagagcatatcagcagccagggcct

SEQ ID NO: 368771 - DNA, 140 bp, Artificial Sequence
  Synthetic
atacgccatgctgggtctccaatcagtgtaaggcagtaaaagaactcatcaacagcacaggactctcagacttggagctagaaagtttgcttacattatgtgctttctatttccagaatgcgtacttgggagtcggccat

SEQ ID NO: 368772 - DNA, 140 bp, Artificial Sequence
  Synthetic
atggccgactcccaagtacgcattctggaaatagaaagcacataatgtaagcaaactttctagctccaagtctgagagtcctgtgctgttgatgagttcttttactgccttacactgattggagacccagcatggcgtat

SEQ ID NO: 368773 - DNA, 140 bp, Artificial Sequence
  Synthetic
aggccctggctgctgatatgcttggagctagaaagtttgcttacattatgtgctttctatttccagaatgagtgcagcaagagagatggccctaggtgttcctttgcagcactattaagcgaccttttgggacagcggtg

SEQ ID NO: 368774 - DNA, 140 bp, Artificial Sequence
  Synthetic
caccgctgtcccaaaaggtcgcttaatagtgctgcaaaggaacacctagggccatctctcttgctgcactcattctggaaatagaaagcacataatgtaagcaaactttctagctccaagcatatcagcagccagggcct

SEQ ID NO: 368775 - DNA, 140 bp, Artificial Sequence
  Synthetic
atacgccatgctgggtctccaaacaatgagctgggtgatgtgtcactgaaggttaacattgtcttggtgcatctcaaagacatgtctaagccaaagcctgagagagtggtcatagccagacgtacttgggagtcggccat

SEQ ID NO: 368776 - DNA, 140 bp, Artificial Sequence
  Synthetic
atggccgactcccaagtacgtctggctatgaccactctctcaggctttggcttagacatgtctttgagatgcaccaagacaatgttaaccttcagtgacacatcacccagctcattgtttggagacccagcatggcgtat

SEQ ID NO: 368777 - DNA, 140 bp, Artificial Sequence
  Synthetic
aggccctggctgctgatatgatctcaaagacatgtctaagccaaagcctgagagagtggtcatagccagaaggtcactgaatcatgctctatccttaatgtttttggacgagatgtcactgaccttttgggacagcggtg

SEQ ID NO: 368778 - DNA, 140 bp, Artificial Sequence
  Synthetic
caccgctgtcccaaaaggtcagtgacatctcgtccaaaaacattaaggatagagcatgattcagtgaccttctggctatgaccactctctcaggctttggcttagacatgtctttgagatcatatcagcagccagggcct

SEQ ID NO: 368779 - DNA, 140 bp, Artificial Sequence
  Synthetic
aggccctggctgctgatatggattacaacaagttgattgaccactgtgtagacatggaaaaaaagagggatgcagttagagcagtggaagatttaattctaatgttgacaggcagagcaagaccttttgggacagcggtg

SEQ ID NO: 368780 - DNA, 140 bp, Artificial Sequence
  Synthetic
caccgctgtcccaaaaggtcttgctctgcctgtcaacattagaattaaatcttccactgctctaactgcatccctctttttttccatgtctacacagtggtcaatcaacttgttgtaatccatatcagcagccagggcct

SEQ ID NO: 368781 - DNA, 140 bp, Artificial Sequence
  Synthetic
atacgccatgctgggtctccgaccaaataagcttagatgatctgatggcaaatgacacggtgacagacttgcctgacagggaagcggaggccctcaaaacaggaaatcttggctttaactcgtacttgggagtcggccat

SEQ ID NO: 368782 - DNA, 140 bp, Artificial Sequence
  Synthetic
atggccgactcccaagtacgagttaaagccaagatttcctgttttgagggcctccgcttccctgtcaggcaagtctgtcaccgtgtcatttgccatcagatcatctaagcttatttggtcggagacccagcatggcgtat

SEQ ID NO: 368783 - DNA, 140 bp, Artificial Sequence
  Synthetic
aggccctggctgctgatatggcctgacagggaagcggaggccctcaaaacaggaaatcttggctttaactgggattcagattgaacttgctgtctgtatgagccattaacgcccttcaatgaccttttgggacagcggtg

SEQ ID NO: 368784 - DNA, 140 bp, Artificial Sequence
  Synthetic
caccgctgtcccaaaaggtcattgaagggcgttaatggctcatacagacagcaagttcaatctgaatcccagttaaagccaagatttcctgttttgagggcctccgcttccctgtcaggccatatcagcagccagggcct

SEQ ID NO: 368785 - DNA, 140 bp, Artificial Sequence
  Synthetic
atacgccatgctgggtctccagctctccaacaagccgactgctctgcatccttcacagtcaattcaactgcattaattaatctcttttactatcccaccaatcctctctttctctactgtcgtacttgggagtcggccat

SEQ ID NO: 368786 - DNA, 140 bp, Artificial Sequence
  Synthetic
atggccgactcccaagtacgacagtagagaaagagaggattggtgggatagtaaaagagattaattaatgcagttgaattgactgtgaaggatgcagagcagtcggcttgttggagagctggagacccagcatggcgtat

SEQ ID NO: 368787 - DNA, 140 bp, Artificial Sequence
  Synthetic
aggccctggctgctgatatgtccctggaacagggatagagagacatatgcagctgctacactctgaaatgatactagacatttgtactgtgtcacttggtgtcatgttatcaacattcttgaccttttgggacagcggtg

SEQ ID NO: 368788 - DNA, 140 bp, Artificial Sequence
  Synthetic
caccgctgtcccaaaaggtcaagaatgttgataacatgacaccaagtgacacagtacaaatgtctagtatcatttcagagtgtagcagctgcatatgtctctctatccctgttccagggacatatcagcagccagggcct

SEQ ID NO: 368789 - DNA, 140 bp, Artificial Sequence
  Synthetic
atacgccatgctgggtctcctgcaaatgcagaagaatttgttatatctgagttctttaagaagaaggacattatgaaattcattagtacctcaggcagagcaatgagtgcaggcaagattcgtacttgggagtcggccat

SEQ ID NO: 368790 - DNA, 140 bp, Artificial Sequence
  Synthetic
atggccgactcccaagtacgaatcttgcctgcactcattgctctgcctgaggtactaatgaatttcataatgtccttcttcttaaagaactcagatataacaaattcttctgcatttgcaggagacccagcatggcgtat

SEQ ID NO: 368791 - DNA, 140 bp, Artificial Sequence
  Synthetic
aggccctggctgctgatatgttatgaaattcattagtacctcaggcagagcaatgagtgcaggcaagattggtaatgtcctttcctatgcacacaacctctatttaagcaagtccagcctgaccttttgggacagcggtg

SEQ ID NO: 368792 - DNA, 140 bp, Artificial Sequence
  Synthetic
caccgctgtcccaaaaggtcaggctggacttgcttaaatagaggttgtgtgcataggaaaggacattaccaatcttgcctgcactcattgctctgcctgaggtactaatgaatttcataacatatcagcagccagggcct

SEQ ID NO: 368793 - DNA, 140 bp, Artificial Sequence
  Synthetic
aggccctggctgctgatatggagggtttgtttgccaactgctatggatggcaatacatcccagaagacatcaaaccaagtctgaccatgttgatacagacattgtttcctgacaaatttggaccttttgggacagcggtg

SEQ ID NO: 368794 - DNA, 140 bp, Artificial Sequence
  Synthetic
caccgctgtcccaaaaggtccaaatttgtcaggaaacaatgtctgtatcaacatggtcagacttggtttgatgtcttctgggatgtattgccatccatagcagttggcaaacaaaccctccatatcagcagccagggcct

SEQ ID NO: 368795 - DNA, 140 bp, Artificial Sequence
  Synthetic
aggccctggctgctgatatgtgtaacctgagcatcttagatgcagcatgcccttcaacatcatgtacacaccactattgtgtgctattctttgtctgcaggtgtggggcttagaaggaacgaccttttgggacagcggtg

SEQ ID NO: 368796 - DNA, 140 bp, Artificial Sequence
  Synthetic
caccgctgtcccaaaaggtcgttccttctaagccccacacctgcagacaaagaatagcacacaatagtggtgtgtacatgatgttgaagggcatgctgcatctaagatgctcaggttacacatatcagcagccagggcct

SEQ ID NO: 368797 - DNA, 140 bp, Artificial Sequence
  Synthetic
atacgccatgctgggtctcccgcccggagagagtcagaaaactagtctgcctgcgaacacagtatcgcccaccacgtcagaccccccctccgtcacattcacagcatcagccagtgaacccgtacttgggagtcggccat

SEQ ID NO: 368798 - DNA, 140 bp, Artificial Sequence
  Synthetic
atggccgactcccaagtacgggttcactggctgatgctgtgaatgtgacggagggggggtctgacgtggtgggcgatactgtgttcgcaggcagactagttttctgactctctccgggcgggagacccagcatggcgtat

SEQ ID NO: 368799 - DNA, 140 bp, Artificial Sequence
  Synthetic
aggccctggctgctgatatgaccacgtcagaccccccctccgtcacattcacagcatcagccagtgaaccagaaggctcagggggtacgagcacctctccctcagtcaccacacaaagccgaccttttgggacagcggtg

SEQ ID NO: 368800 - DNA, 140 bp, Artificial Sequence
  Synthetic
caccgctgtcccaaaaggtcggctttgtgtggtgactgagggagaggtgctcgtaccccctgagccttctggttcactggctgatgctgtgaatgtgacggagggggggtctgacgtggtcatatcagcagccagggcct

SEQ ID NO: 368801 - DNA, 140 bp, Artificial Sequence
  Synthetic
atacgccatgctgggtctccgaatcaagcacagccatcgccgacaccagcacacaaacagtcagggacatcctcacaccaacaacctacaccagtttgcccagcactcccagcgcgccaacgtacttgggagtcggccat

SEQ ID NO: 368802 - DNA, 140 bp, Artificial Sequence
  Synthetic
atggccgactcccaagtacgttggcgcgctgggagtgctgggcaaactggtgtaggttgttggtgtgaggatgtccctgactgtttgtgtgctggtgtcggcgatggctgtgcttgattcggagacccagcatggcgtat

SEQ ID NO: 368803 - DNA, 140 bp, Artificial Sequence
  Synthetic
aggccctggctgctgatatgcctcacaccaacaacctacaccagtttgcccagcactcccagcgcgccaaccaagccacaggaaacacgtcacactgcaaggggcctactgtcagtcaccgaccttttgggacagcggtg

SEQ ID NO: 368804 - DNA, 140 bp, Artificial Sequence
  Synthetic
caccgctgtcccaaaaggtcggtgactgacagtaggccccttgcagtgtgacgtgtttcctgtggcttggttggcgcgctgggagtgctgggcaaactggtgtaggttgttggtgtgaggcatatcagcagccagggcct

SEQ ID NO: 368805 - DNA, 140 bp, Artificial Sequence
  Synthetic
atacgccatgctgggtctcccacagaggccagcagcccacacccaaccatcagcgagacaccatccccccccccaacagcccaggctcccaccggaatcaacaaccccaacacatccaaacgtacttgggagtcggccat

SEQ ID NO: 368806 - DNA, 140 bp, Artificial Sequence
  Synthetic
atggccgactcccaagtacgtttggatgtgttggggttgttgattccggtgggagcctgggctgttggggggggggatggtgtctcgctgatggttgggtgtgggctgctggcctctgtgggagacccagcatggcgtat

SEQ ID NO: 368807 - DNA, 140 bp, Artificial Sequence
  Synthetic
atacgccatgctgggtctccagtacagccaaccctctctcagagtgaagtttccacggctgttcaaggtatacaccccagcccaacaaacagatctaagagaaaccttgaaatggagatacgtacttgggagtcggccat

SEQ ID NO: 368808 - DNA, 140 bp, Artificial Sequence
  Synthetic
atggccgactcccaagtacgtatctccatttcaaggtttctcttagatctgtttgttgggctggggtgtataccttgaacagccgtggaaacttcactctgagagagggttggctgtactggagacccagcatggcgtat

SEQ ID NO: 368809 - DNA, 140 bp, Artificial Sequence
  Synthetic
atacgccatgctgggtctccatagaagagttttttttaactggtgagggtcacttcaatgaagtgttgcagttcaaaacaccaagcacaccaagccctacgaaaccagctcatgtcgagtcgtacttgggagtcggccat

SEQ ID NO: 368810 - DNA, 140 bp, Artificial Sequence
  Synthetic
atggccgactcccaagtacgactcgacatgagctggtttcgtagggcttggtgtgcttggtgttttgaactgcaacacttcattgaagtgaccctcaccagttaaaaaaaactcttctatggagacccagcatggcgtat

SEQ ID NO: 368811 - DNA, 140 bp, Artificial Sequence
  Synthetic
atacgccatgctgggtctccatggactcaggttacttctctgccaagtgttatccaaagtcatcaaattcaggacttcagctgatcaatatcacccaacattcaattagaataacagacacgtacttgggagtcggccat

SEQ ID NO: 368812 - DNA, 140 bp, Artificial Sequence
  Synthetic
atggccgactcccaagtacgtgtctgttattctaattgaatgttgggtgatattgatcagctgaagtcctgaatttgatgactttggataacacttggcagagaagtaacctgagtccatggagacccagcatggcgtat

SEQ ID NO: 368813 - DNA, 140 bp, Artificial Sequence
  Synthetic
atacgccatgctgggtctccgagctcttacaaggacctttctatttgaacaggaggcaagctgtccttggctcatcatacctttacatcgttattacactctacatacaagtattgcaaccgtacttgggagtcggccat

SEQ ID NO: 368814 - DNA, 140 bp, Artificial Sequence
  Synthetic
atggccgactcccaagtacggttgcaatacttgtatgtagagtgtaataacgatgtaaaggtatgatgagccaaggacagcttgcctcctgttcaaatagaaaggtccttgtaagagctcggagacccagcatggcgtat

SEQ ID NO: 368815 - DNA, 140 bp, Artificial Sequence
  Synthetic
atacgccatgctgggtctcctacaatcagcacctatcggccatggaaagacagtcgaagtgtatcaaaccagagaggggtacacaagtatttgcctttttgtactaggaagcatcctgttcgtacttgggagtcggccat

SEQ ID NO: 368816 - DNA, 140 bp, Artificial Sequence
  Synthetic
atggccgactcccaagtacgaacaggatgcttcctagtacaaaaaggcaaatacttgtgtacccctctctggtttgatacacttcgactgtctttccatggccgataggtgctgattgtaggagacccagcatggcgtat

SEQ ID NO: 368817 - DNA, 140 bp, Artificial Sequence
  Synthetic
aggccctggctgctgatatgttttgatatttacaatgtgcacatatacaataaagaaatggacaattttgacgaaggttgtatcagcgtcttggaagaaacagcagaaaggcatatgcttgaccttttgggacagcggtg

SEQ ID NO: 368818 - DNA, 140 bp, Artificial Sequence
  Synthetic
caccgctgtcccaaaaggtcaagcatatgcctttctgctgtttcttccaagacgctgatacaaccttcgtcaaaattgtccatttctttattgtatatgtgcacattgtaaatatcaaaacatatcagcagccagggcct

SEQ ID NO: 368819 - DNA, 140 bp, Artificial Sequence
  Synthetic
  misc_feature (59)..(59): n is a, c, g, or t
atacgccatgctgggtctccaagcgcatgtgctttagggcaactatggaagtaagcagnaaggctttacttatccgaaacatcatcaacactacttttgttgtgtgcatactgatattagcgtacttgggagtcggccat

SEQ ID NO: 368820 - DNA, 140 bp, Artificial Sequence
  Synthetic
  misc_feature (82)..(82): n is a, c, g, or t
atggccgactcccaagtacgctaatatcagtatgcacacaacaaaagtagtgttgatgatgtttcggataagtaaagccttnctgcttacttccatagttgccctaaagcacatgcgcttggagacccagcatggcgtat

SEQ ID NO: 368821 - DNA, 140 bp, Artificial Sequence
  Synthetic
atacgccatgctgggtctcccacttagttggagctcagtagaacatagaggtaacaagattttggtttcaggcaggtcagagtcaatcatgaaattagaggaaaggacaggaattagctgcgtacttgggagtcggccat

SEQ ID NO: 368822 - DNA, 140 bp, Artificial Sequence
  Synthetic
atggccgactcccaagtacgcagctaattcctgtcctttcctctaatttcatgattgactctgacctgcctgaaaccaaaatcttgttacctctatgttctactgagctccaactaagtgggagacccagcatggcgtat

SEQ ID NO: 368823 - DNA, 140 bp, Artificial Sequence
  Synthetic
aggccctggctgctgatatgcggaacctgggagagagaagaagacctaacaaatttctgtcatcaggaatgccaagttacggatactgaatgcctctgcccttatgaggctctagtgctcgaccttttgggacagcggtg

SEQ ID NO: 368824 - DNA, 140 bp, Artificial Sequence
  Synthetic
caccgctgtcccaaaaggtcgagcactagagcctcataagggcagaggcattcagtatccgtaacttggcattcctgatgacagaaatttgttaggtcttcttctctctcccaggttccgcatatcagcagccagggcct

SEQ ID NO: 368825 - DNA, 140 bp, Artificial Sequence
  Synthetic
aggccctggctgctgatatgaaggcttctttgacttaatgcatgtacaaaatgtgctatcagcaagtacagtgtgcaagctacaaagttgtacacatggtgtgccaggagacctacagatgaccttttgggacagcggtg

SEQ ID NO: 368826 - DNA, 140 bp, Artificial Sequence
  Synthetic
caccgctgtcccaaaaggtcatctgtaggtctcctggcacaccatgtgtacaactttgtagcttgcacactgtacttgctgatagcacattttgtacatgcattaagtcaaagaagccttcatatcagcagccagggcct

SEQ ID NO: 368827 - DNA, 140 bp, Artificial Sequence
  Synthetic
atacgccatgctgggtctcccaaagaaaattgagatatcaggtttgaagtttgcaagcttaacttgcacaggctgttatgcttgtagttctggtatctcctgtaaggttagaatccatgtcgtacttgggagtcggccat

SEQ ID NO: 368828 - DNA, 140 bp, Artificial Sequence
  Synthetic
atggccgactcccaagtacgacatggattctaaccttacaggagataccagaactacaagcataacagcctgtgcaagttaagcttgcaaacttcaaacctgatatctcaattttctttgggagacccagcatggcgtat

SEQ ID NO: 368829 - DNA, 140 bp, Artificial Sequence
  Synthetic
atacgccatgctgggtctccgcagaaagggcctcaaggaatgatgacagtatacttgctaatactactgcttatgctagcaccactgattgtgcctatatcacactgtcattgcaatgagcgtacttgggagtcggccat

SEQ ID NO: 368830 - DNA, 140 bp, Artificial Sequence
  Synthetic
atggccgactcccaagtacgctcattgcaatgacagtgtgatataggcacaatcagtggtgctagcataagcagtagtattagcaagtatactgtcatcattccttgaggccctttctgcggagacccagcatggcgtat

SEQ ID NO: 368831 - DNA, 140 bp, Artificial Sequence
  Synthetic
aggccctggctgctgatatgagttatatcaaaactgtttcatcacattcgcaaacaagctcttctactcttttcactctgacctaaaccttgactgcgtgccgccactatatctttgagagaccttttgggacagcggtg

SEQ ID NO: 368832 - DNA, 140 bp, Artificial Sequence
  Synthetic
caccgctgtcccaaaaggtctctcaaagatatagtggcggcacgcagtcaaggtttaggtcagagtgaaaagagtagaagagcttgtttgcgaatgtgatgaaacagttttgatataactcatatcagcagccagggcct

SEQ ID NO: 368833 - DNA, 140 bp, Artificial Sequence
  Synthetic
atacgccatgctgggtctccattcttcactgtatttctgccattggatgtttgcctttgagtcaagcagacaagtcttcactacttatgagtttcttaaattggagggtaaacatggacacgtacttgggagtcggccat

SEQ ID NO: 368834 - DNA, 140 bp, Artificial Sequence
  Synthetic
atggccgactcccaagtacgtgtccatgtttaccctccaatttaagaaactcataagtagtgaagacttgtctgcttgactcaaaggcaaacatccaatggcagaaatacagtgaagaatggagacccagcatggcgtat

SEQ ID NO: 368835 - DNA, 140 bp, Artificial Sequence
  Synthetic
atacgccatgctgggtctccgacagctgggatgggaacgacacagtcaagtttttagtcacaacctatataagcaaggggctcatggcactaaacagttacaaccatatgggtcagggcacgtacttgggagtcggccat

SEQ ID NO: 368836 - DNA, 140 bp, Artificial Sequence
  Synthetic
atggccgactcccaagtacgtgccctgacccatatggttgtaactgtttagtgccatgagccccttgcttatataggttgtgactaaaaacttgactgtgtcgttcccatcccagctgtcggagacccagcatggcgtat

SEQ ID NO: 368837 - DNA, 140 bp, Artificial Sequence
  Synthetic
aggccctggctgctgatatgaaccttatctccctttggcaggctgtttgtaccgacctactctggattggtcagctcagcagttgctctggaagatgctgaggtcattgctagagcagctgaccttttgggacagcggtg

SEQ ID NO: 368838 - DNA, 140 bp, Artificial Sequence
  Synthetic
caccgctgtcccaaaaggtcagctgctctagcaatgacctcagcatcttccagagcaactgctgagctgaccaatccagagtaggtcggtacaaacagcctgccaaagggagataaggttcatatcagcagccagggcct

SEQ ID NO: 368839 - DNA, 140 bp, Artificial Sequence
  Synthetic
atacgccatgctgggtctccatggctccaacaataaaaacaagaagaaattcatcaccaactgtttgctcagtacagctctatctggaaagaaagtgtacaaggttcttggtaacctaggcgtacttgggagtcggccat

SEQ ID NO: 368840 - DNA, 140 bp, Artificial Sequence
  Synthetic
atggccgactcccaagtacgcctaggttaccaagaaccttgtacactttctttccagatagagctgtactgagcaaacagttggtgatgaatttcttcttgtttttattgttggagccatggagacccagcatggcgtat

SEQ ID NO: 368841 - DNA, 140 bp, Artificial Sequence
  Synthetic
aggccctggctgctgatatgttcccttcagtattcaccctaattagaatgcttacggatgagtcaacagactctgagaaaagtggccttagccctgacttgcatcaggttgctaagtattgaccttttgggacagcggtg

SEQ ID NO: 368842 - DNA, 140 bp, Artificial Sequence
  Synthetic
caccgctgtcccaaaaggtcaatacttagcaacctgatgcaagtcagggctaaggccacttttctcagagtctgttgactcatccgtaagcattctaattagggtgaatactgaagggaacatatcagcagccagggcct

SEQ ID NO: 368843 - DNA, 140 bp, Artificial Sequence
  Synthetic
atacgccatgctgggtctcctcagttctctgacccaaacaggcagaaacttagaatagttgaatccagacctgcagaatctgagttagaggcaaatcgtgcagtgattgttaagactaaacgtacttgggagtcggccat

SEQ ID NO: 368844 - DNA, 140 bp, Artificial Sequence
  Synthetic
atggccgactcccaagtacgtttagtcttaacaatcactgcacgatttgcctctaactcagattctgcaggtctggattcaactattctaagtttctgcctgtttgggtcagagaactgaggagacccagcatggcgtat

SEQ ID NO: 368845 - DNA, 140 bp, Artificial Sequence
  Synthetic
atacgccatgctgggtctccgatttagtgaagaggaccagctagaaacaaggcagctgttgttggtggaagttggttttcaaactgacatcgatgggaaaataaggacggaccacaagaacgtacttgggagtcggccat

SEQ ID NO: 368846 - DNA, 140 bp, Artificial Sequence
  Synthetic
atggccgactcccaagtacgttcttgtggtccgtccttattttcccatcgatgtcagtttgaaaaccaacttccaccaacaacagctgccttgtttctagctggtcctcttcactaaatcggagacccagcatggcgtat

SEQ ID NO: 368847 - DNA, 140 bp, Artificial Sequence
  Synthetic
aggccctggctgctgatatgaaggccggcgtgactccagaaaccttcccgactgtctcacagttcctttttgaactagggaagcaaccaaggggtaccaagaaaatgaagaaggcactctgaccttttgggacagcggtg

SEQ ID NO: 368848 - DNA, 140 bp, Artificial Sequence
  Synthetic
caccgctgtcccaaaaggtcagagtgccttcttcattttcttggtaccccttggttgcttccctagttcaaaaaggaactgtgagacagtcgggaaggtttctggagtcacgccggccttcatatcagcagccagggcct

SEQ ID NO: 368849 - DNA, 140 bp, Artificial Sequence
  Synthetic
atacgccatgctgggtctccggttctgaatcatgcatcaatatgttgaaagagaatttggatcgaataactgatgaattcgagcgaacaaagtttaaacatgaactcacacagaatatcacgtacttgggagtcggccat

SEQ ID NO: 368850 - DNA, 140 bp, Artificial Sequence
  Synthetic
atggccgactcccaagtacgtgatattctgtgtgagttcatgtttaaactttgttcgctcgaattcatcagttattcgatccaaattctctttcaacatattgatgcatgattcagaaccggagacccagcatggcgtat

SEQ ID NO: 368851 - DNA, 140 bp, Artificial Sequence
  Synthetic
atacgccatgctgggtctcccaagtgctctcttggatgagcaaaaggaggactgaggtaataactaaagaacaacatcaattattcctgagcctccttccacaatcacatgaatgtttaccgtacttgggagtcggccat

SEQ ID NO: 368852 - DNA, 140 bp, Artificial Sequence
  Synthetic
atggccgactcccaagtacggtaaacattcatgtgattgtggaaggaggctcaggaataattgatgttgttctttagttattacctcagtcctccttttgctcatccaagagagcacttgggagacccagcatggcgtat

SEQ ID NO: 368853 - DNA, 140 bp, Artificial Sequence
  Synthetic
aggccctggctgctgatatgccacaacaacagtcggcacaagtccatccagcagccccagtacgccatccacaccacaaggcatacaccatcatgcaaggagtctattgtcagtcacgaggaccttttgggacagcggtg

SEQ ID NO: 368854 - DNA, 140 bp, Artificial Sequence
  Synthetic
caccgctgtcccaaaaggtcctcgtgactgacaatagactccttgcatgatggtgtatgccttgtggtgtggatggcgtactggggctgctggatggacttgtgccgactgttgttgtggcatatcagcagccagggcct

SEQ ID NO: 368855 - DNA, 140 bp, Artificial Sequence
  Synthetic
atacgccatgctgggtctcctataagtgttgtttcaggtttgaacctggtttatggcttcctcataaaagataacttactagctaactctcagcaacagaacaagcaactacagatgcttcgtacttgggagtcggccat

SEQ ID NO: 368856 - DNA, 140 bp, Artificial Sequence
  Synthetic
atggccgactcccaagtacgaagcatctgtagttgcttgttctgttgctgagagttagctagtaagttatcttttatgaggaagccataaaccaggttcaaacctgaaacaacacttataggagacccagcatggcgtat

SEQ ID NO: 368857 - DNA, 140 bp, Artificial Sequence
  Synthetic
atacgccatgctgggtctcccggaaaccagcaatcaacactcagccatgagcaggacaccaacccaccacacagtaacccaggtctccactgagaacaccagccacagcacacccagacacgtacttgggagtcggccat

SEQ ID NO: 368858 - DNA, 140 bp, Artificial Sequence
  Synthetic
atggccgactcccaagtacgtgtctgggtgtgctgtggctggtgttctcagtggagacctgggttactgtgtggtgggttggtgtcctgctcatggctgagtgttgattgctggtttccgggagacccagcatggcgtat

SEQ ID NO: 368859 - DNA, 140 bp, Artificial Sequence
  Synthetic
atacgccatgctgggtctccgaaggatgtatcagcgtcttggaggaaacagcagaaaggcatatgctttgggaactcgatctgatgaactcactttgttctgacgaaaaaagagatactacgtacttgggagtcggccat

SEQ ID NO: 368860 - DNA, 140 bp, Artificial Sequence
  Synthetic
atggccgactcccaagtacgtagtatctcttttttcgtcagaacaaagtgagttcatcagatcgagttcccaaagcatatgcctttctgctgtttcctccaagacgctgatacatccttcggagacccagcatggcgtat

SEQ ID NO: 368861 - DNA, 140 bp, Artificial Sequence
  Synthetic
aggccctggctgctgatatgtgggattcagattgaacacattatctgtatgaatcattaatacctctcagtatcttaagggtaagtaagacaatttataccatgccatttgctgacatctgaccttttgggacagcggtg

SEQ ID NO: 368862 - DNA, 140 bp, Artificial Sequence
  Synthetic
caccgctgtcccaaaaggtcagatgtcagcaaatggcatggtataaattgtcttacttacccttaagatactgagaggtattaatgattcatacagataatgtgttcaatctgaatcccacatatcagcagccagggcct

SEQ ID NO: 368863 - DNA, 140 bp, Artificial Sequence
  Synthetic
aggccctggctgctgatatggcagcttgttgactgctctacagataggaagaagcttttgccccaatcagtgttttctgattccaaagtcgttctctcaaggatcaaattcaagacagaggaccttttgggacagcggtg

SEQ ID NO: 368864 - DNA, 140 bp, Artificial Sequence
  Synthetic
caccgctgtcccaaaaggtcctctgtcttgaatttgatccttgagagaacgactttggaatcagaaaacactgattggggcaaaagcttcttcctatctgtagagcagtcaacaagctgccatatcagcagccagggcct

SEQ ID NO: 368865 - DNA, 140 bp, Artificial Sequence
  Synthetic
aggccctggctgctgatatgggcacctgggagagagaggaagacctaacaaacttctgtcatcaggaatgccaagtcactgagactgaatgcctctgtccttacgaagcccttgtactcagaccttttgggacagcggtg

SEQ ID NO: 368866 - DNA, 140 bp, Artificial Sequence
  Synthetic
caccgctgtcccaaaaggtctgagtacaagggcttcgtaaggacagaggcattcagtctcagtgacttggcattcctgatgacagaagtttgttaggtcttcctctctctcccaggtgcccatatcagcagccagggcct

SEQ ID NO: 368867 - DNA, 140 bp, Artificial Sequence
  Synthetic
atacgccatgctgggtctccatgcaggaaccattaaatcatgggatgaaagttatactgagctgaaagttgaggttcccaaaatagaacagctttccaactaccagcaggctgctctcaacgtacttgggagtcggccat

SEQ ID NO: 368868 - DNA, 140 bp, Artificial Sequence
  Synthetic
atggccgactcccaagtacgttgagagcagcctgctggtagttggaaagctgttctattttgggaacctcaactttcagctcagtataactttcatcccatgatttaatggttcctgcatggagacccagcatggcgtat

SEQ ID NO: 368869 - DNA, 140 bp, Artificial Sequence
  Synthetic
atacgccatgctgggtctccttacaactgcaaccatcaactatgtttatttaaactgcttatgtaatcttgctttgttaacattttatcattctcttctgttttaaatacttaaagggctcgtacttgggagtcggccat

SEQ ID NO: 368870 - DNA, 140 bp, Artificial Sequence
  Synthetic
atggccgactcccaagtacgagccctttaagtatttaaaacagaagagaatgataaaatgttaacaaagcaagattacataagcagtttaaataaacatagttgatggttgcagttgtaaggagacccagcatggcgtat

SEQ ID NO: 368871 - DNA, 140 bp, Artificial Sequence
  Synthetic
aggccctggctgctgatatgtaaccatgttgaagatttcatcagaaggtatggtatactaacccttgggactttgtcacccttcggtagactgtttgtaccgacctactctggactagtcgaccttttgggacagcggtg

SEQ ID NO: 368872 - DNA, 140 bp, Artificial Sequence
  Synthetic
caccgctgtcccaaaaggtcgactagtccagagtaggtcggtacaaacagtctaccgaagggtgacaaagtcccaagggttagtataccataccttctgatgaaatcttcaacatggttacatatcagcagccagggcct

SEQ ID NO: 368873 - DNA, 140 bp, Artificial Sequence
  Synthetic
atacgccatgctgggtctccgacacttcatatgaacagtgtatcaatacagtcaagtagcttgaccacattagacagtctagatcgtagtaggacaagttccacagctgaagatagcagccgtacttgggagtcggccat

SEQ ID NO: 368874 - DNA, 140 bp, Artificial Sequence
  Synthetic
atggccgactcccaagtacggctgctatcttcagctgtggaacttgtcctactacgatctagactgtctaatgtggtcaagctacttgactgtattgatacactgttcatatgaagtgtcggagacccagcatggcgtat

SEQ ID NO: 368875 - DNA, 140 bp, Artificial Sequence
  Synthetic
atacgccatgctgggtctccacttagcaaccaacagcccccacccagccaccagcagaccaacaacccctcccacaacagcccagaaacccactgaaaacaacagccacaacaccaccgacgtacttgggagtcggccat

SEQ ID NO: 368876 - DNA, 140 bp, Artificial Sequence
  Synthetic
atggccgactcccaagtacgtcggtggtgttgtggctgttgttttcagtgggtttctgggctgttgtgggaggggttgttggtctgctggtggctgggtgggggctgttggttgctaagtggagacccagcatggcgtat

SEQ ID NO: 368877 - DNA, 140 bp, Artificial Sequence
  Synthetic
aggccctggctgctgatatggttgacttctcgaatttacttaaagaccgcttcaaaataatgcaattttttccttcagtgttcactctgatcaagatgctgacagatgaatcgtcagattgaccttttgggacagcggtg

SEQ ID NO: 368878 - DNA, 140 bp, Artificial Sequence
  Synthetic
caccgctgtcccaaaaggtcaatctgacgattcatctgtcagcatcttgatcagagtgaacactgaaggaaaaaattgcattattttgaagcggtctttaagtaaattcgagaagtcaaccatatcagcagccagggcct

SEQ ID NO: 368879 - DNA, 140 bp, Artificial Sequence
  Synthetic
aggccctggctgctgatatgaactcaccaactgaactgttgaagaagaagccttacttaggaacaacttgcaagttcaacacctggggagactcaaacagatctggaaagttcacatacagaccttttgggacagcggtg

SEQ ID NO: 368880 - DNA, 140 bp, Artificial Sequence
  Synthetic
caccgctgtcccaaaaggtctgtatgtgaactttccagatctgtttgagtctccccaggtgttgaacttgcaagttgttcctaagtaaggcttcttcttcaacagttcagttggtgagttcatatcagcagccagggcct

SEQ ID NO: 368881 - DNA, 140 bp, Artificial Sequence
  Synthetic
atacgccatgctgggtctccaggagattgagttttgcaacaacctgactaagactgtttcagagaacccattgccactcagctgttggtctgaagttcaaaactacattgaagacataggcgtacttgggagtcggccat

SEQ ID NO: 368882 - DNA, 140 bp, Artificial Sequence
  Synthetic
atggccgactcccaagtacgcctatgtcttcaatgtagttttgaacttcagaccaacagctgagtggcaatgggttctctgaaacagtcttagtcaggttgttgcaaaactcaatctcctggagacccagcatggcgtat

SEQ ID NO: 368883 - DNA, 140 bp, Artificial Sequence
  Synthetic
atacgccatgctgggtctccaggcagatcagaatcaattatgaagctggaagaaaggacaggaatcagctgggatcttggcgtggaagatgcctctgagtctaagctacttacagtttcacgtacttgggagtcggccat

SEQ ID NO: 368884 - DNA, 140 bp, Artificial Sequence
  Synthetic
atggccgactcccaagtacgtgaaactgtaagtagcttagactcagaggcatcttccacgccaagatcccagctgattcctgtcctttcttccagcttcataattgattctgatctgcctggagacccagcatggcgtat

SEQ ID NO: 368885 - DNA, 140 bp, Artificial Sequence
  Synthetic
aggccctggctgctgatatgaggagcctgaagctaagcttattggcctgagtttggaggattatcttaagaggatgctatctgacaacgaatggggatcgactcttgaggcatctatgttgaccttttgggacagcggtg

SEQ ID NO: 368886 - DNA, 140 bp, Artificial Sequence
  Synthetic
caccgctgtcccaaaaggtcaacatagatgcctcaagagtcgatccccattcgttgtcagatagcatcctcttaagataatcctccaaactcaggccaataagcttagcttcaggctcctcatatcagcagccagggcct

SEQ ID NO: 368887 - DNA, 140 bp, Artificial Sequence
  Synthetic
aggccctggctgctgatatggccttcaagcaagccaactgctccgcatccttcacagtcaatccaactgctttaattgatctatttactatcctaccaatcctcttcctctctaccattcgaccttttgggacagcggtg

SEQ ID NO: 368888 - DNA, 140 bp, Artificial Sequence
  Synthetic
caccgctgtcccaaaaggtcgaatggtagagaggaagaggattggtaggatagtaaatagatcaattaaagcagttggattgactgtgaaggatgcggagcagttggcttgcttgaaggccatatcagcagccagggcct

SEQ ID NO: 368889 - DNA, 140 bp, Artificial Sequence
  Synthetic
atacgccatgctgggtctccctgacttttcgctcacacaaaaggttcacttcaaaagaaatcagatacccagtgtcgaaaatgtgcaaatctccattgatgcaacactgcctgaatctgtcgtacttgggagtcggccat

SEQ ID NO: 368890 - DNA, 140 bp, Artificial Sequence
  Synthetic
atggccgactcccaagtacgacagattcaggcagtgttgcatcaatggagatttgcacattttcgacactgggtatctgatttcttttgaagtgaaccttttgtgtgagcgaaaagtcagggagacccagcatggcgtat

SEQ ID NO: 368891 - DNA, 140 bp, Artificial Sequence
  Synthetic
aggccctggctgctgatatgagactacaataagttgattgaccattgtgtggacatggagaaaaaaagggaagcagttagagcagtagaagatttaattctgatgttaacaggcaaggcagaccttttgggacagcggtg

SEQ ID NO: 368892 - DNA, 140 bp, Artificial Sequence
  Synthetic
caccgctgtcccaaaaggtctgccttgcctgttaacatcagaattaaatcttctactgctctaactgcttccctttttttctccatgtccacacaatggtcaatcaacttattgtagtctcatatcagcagccagggcct

SEQ ID NO: 368893 - DNA, 140 bp, Artificial Sequence
  Synthetic
atacgccatgctgggtctcctctcaaagaaacacgtgccgcttacgcccagtgttctcttgagtgtctgcaaaatggaaaacaagatcgaggtgaacagcaaagatgagatgaataaatgcgtacttgggagtcggccat

SEQ ID NO: 368894 - DNA, 140 bp, Artificial Sequence
  Synthetic
atggccgactcccaagtacgcatttattcatctcatctttgctgttcacctcgatcttgttttccattttgcagacactcaagagaacactgggcgtaagcggcacgtgtttctttgagaggagacccagcatggcgtat

SEQ ID NO: 368895 - DNA, 140 bp, Artificial Sequence
  Synthetic
atacgccatgctgggtctcctctcaaagatatcaatcccccctttacccacgttgacacagatagctccagtagtggttctttgtccttatcaaaccatggactttttaagaaaccttgacgtacttgggagtcggccat

SEQ ID NO: 368896 - DNA, 140 bp, Artificial Sequence
  Synthetic
atggccgactcccaagtacgtcaaggtttcttaaaaagtccatggtttgataaggacaaagaaccactactggagctatctgtgtcaacgtgggtaaaggggggattgatatctttgagaggagacccagcatggcgtat

SEQ ID NO: 368897 - DNA, 140 bp, Artificial Sequence
  Synthetic
aggccctggctgctgatatggtagtggttctttgtccttatcaaaccatggactttttaagaaaccttgactggactcaggtgattgatggtcagtatgtgaccaaccccaggttcaacagaccttttgggacagcggtg

SEQ ID NO: 368898 - DNA, 140 bp, Artificial Sequence
  Synthetic
caccgctgtcccaaaaggtctgttgaacctggggttggtcacatactgaccatcaatcacctgagtccagtcaaggtttcttaaaaagtccatggtttgataaggacaaagaaccactaccatatcagcagccagggcct

SEQ ID NO: 368899 - DNA, 140 bp, Artificial Sequence
  Synthetic
atacgccatgctgggtctccggctaaagaaatgggtgttaccatcatcatttggactgttgcagctagtgatgaagtggaagcaggcataaagtttggagatggtgatgtgtttacagcccgtacttgggagtcggccat

SEQ ID NO: 368900 - DNA, 140 bp, Artificial Sequence
  Synthetic
atggccgactcccaagtacgggctgtaaacacatcaccatctccaaactttatgcctgcttccacttcatcactagctgcaacagtccaaatgatgatggtaacacccatttctttagccggagacccagcatggcgtat

SEQ ID NO: 368901 - DNA, 140 bp, Artificial Sequence
  Synthetic
aggccctggctgctgatatggagtggattgtgcctcccgaatgcaccatgcccatcaacattatgcatgcactattagtgtgcttcattctttacctacagctatcgggtttaggaggaggaccttttgggacagcggtg

SEQ ID NO: 368902 - DNA, 140 bp, Artificial Sequence
  Synthetic
caccgctgtcccaaaaggtcctcctcctaaacccgatagctgtaggtaaagaatgaagcacactaatagtgcatgcataatgttgatgggcatggtgcattcgggaggcacaatccactccatatcagcagccagggcct

SEQ ID NO: 368903 - DNA, 140 bp, Artificial Sequence
  Synthetic
atacgccatgctgggtctccgcacccggcacaagtcaaagccctaagccacccgtgagcaccactctaccacacacaccagaagcctccaccatcaaactcaccacaccaacaagcgaaacgtacttgggagtcggccat

SEQ ID NO: 368904 - DNA, 140 bp, Artificial Sequence
  Synthetic
atggccgactcccaagtacgtttcgcttgttggtgtggtgagtttgatggtggaggcttctggtgtgtgtggtagagtggtgctcacgggtggcttagggctttgacttgtgccgggtgcggagacccagcatggcgtat

SEQ ID NO: 368905 - DNA, 140 bp, Artificial Sequence
  Synthetic
aggccctggctgctgatatgacacacaccagaagcctccaccatcaaactcaccacaccaacaagcgaaacagaaggctcaggggaaacgaccccacccccaaacaccacccagggcctggaccttttgggacagcggtg

SEQ ID NO: 368906 - DNA, 140 bp, Artificial Sequence
  Synthetic
caccgctgtcccaaaaggtccaggccctgggtggtgtttgggggtggggtcgtttcccctgagccttctgtttcgcttgttggtgtggtgagtttgatggtggaggcttctggtgtgtgtcatatcagcagccagggcct

SEQ ID NO: 368907 - DNA, 140 bp, Artificial Sequence
  Synthetic
atacgccatgctgggtctcctatatgcgctacaggaagattctgaagtagagccaatagccataatttgtgatggcatagaaagcaacatgaagcagttatttgctatattacctcccgacgtacttgggagtcggccat

SEQ ID NO: 368908 - DNA, 140 bp, Artificial Sequence
  Synthetic
atggccgactcccaagtacgtcgggaggtaatatagcaaataactgcttcatgttgctttctatgccatcacaaattatggctattggctctacttcagaatcttcctgtagcgcatataggagacccagcatggcgtat

SEQ ID NO: 368909 - DNA, 140 bp, Artificial Sequence
  Synthetic
atacgccatgctgggtctccgtcaagcacagacgacatgaattccaccacacagatgaccgacaacacccccacatcaacagtcagcataggtctatccagcagccccagcatgccatcccgtacttgggagtcggccat

SEQ ID NO: 368910 - DNA, 140 bp, Artificial Sequence
  Synthetic
atggccgactcccaagtacgggatggcatgctggggctgctggatagacctatgctgactgttgatgtgggggtgttgtcggtcatctgtgtggtggaattcatgtcgtctgtgcttgacggagacccagcatggcgtat

SEQ ID NO: 368911 - DNA, 140 bp, Artificial Sequence
  Synthetic
aggccctggctgctgatatggcccctattgatctattttgccatcctaccgttcttctttctctactattcataccagtttcattatttaaagggtgtggggggaacgatttctttgagagaccttttgggacagcggtg

SEQ ID NO: 368912 - DNA, 140 bp, Artificial Sequence
  Synthetic
caccgctgtcccaaaaggtctctcaaagaaatcgttccccccacaccctttaaataatgaaactggtatgaatagtagagaaagaagaacggtaggatggcaaaatagatcaataggggccatatcagcagccagggcct

SEQ ID NO: 368913 - DNA, 140 bp, Artificial Sequence
  Synthetic
atacgccatgctgggtctccgctataagtactcaaaaggttagaagttatctgaaggcagggactgcaacaaaaacccccgtgtcgacaaaagacgttctggagacttgggaaaaaatgacgtacttgggagtcggccat

SEQ ID NO: 368914 - DNA, 140 bp, Artificial Sequence
  Synthetic
atggccgactcccaagtacgtcattttttcccaagtctccagaacgtcttttgtcgacacgggggtttttgttgcagtccctgccttcagataacttctaaccttttgagtacttatagcggagacccagcatggcgtat

SEQ ID NO: 368915 - DNA, 140 bp, Artificial Sequence
  Synthetic
atacgccatgctgggtctcccggaaaccagcagtcagcactcagccatgagcagaataccaaccctctacacagcaacccaggtctccactgagaacaccaaccgcagcatacctagacacgtacttgggagtcggccat

SEQ ID NO: 368916 - DNA, 140 bp, Artificial Sequence
  Synthetic
atggccgactcccaagtacgtgtctaggtatgctgcggttggtgttctcagtggagacctgggttgctgtgtagagggttggtattctgctcatggctgagtgctgactgctggtttccgggagacccagcatggcgtat

SEQ ID NO: 368917 - DNA, 140 bp, Artificial Sequence
  Synthetic
aggccctggctgctgatatgacagcaacccaggtctccactgagaacaccaaccgcagcatacctagacaatctgagtcctcagtgcagccggcaacccaaagcccaataacttccccaggaccttttgggacagcggtg

SEQ ID NO: 368918 - DNA, 140 bp, Artificial Sequence
  Synthetic
caccgctgtcccaaaaggtcctggggaagttattgggctttgggttgccggctgcactgaggactcagattgtctaggtatgctgcggttggtgttctcagtggagacctgggttgctgtcatatcagcagccagggcct

SEQ ID NO: 368919 - DNA, 140 bp, Artificial Sequence
  Synthetic
atacgccatgctgggtctccccattaagtgaggtgcattcaatagagcgcatcatggaaaatttcactcgcctcatgcatgaaggaaagtcttcaaccaagggaaaagatgaagatccaacgtacttgggagtcggccat

SEQ ID NO: 368920 - DNA, 140 bp, Artificial Sequence
  Synthetic
atggccgactcccaagtacgttggatcttcatcttttcccttggttgaagactttccttcatgcatgaggcgagtgaaattttccatgatgcgctctattgaatgcacctcacttaatggggagacccagcatggcgtat

SEQ ID NO: 368921 - DNA, 140 bp, Artificial Sequence
  Synthetic
atacgccatgctgggtctcccatcccagcccaaaaaacaggtccaagaggaaccttgaggtggaaataattttaactctgtctcaaggtctaaagaaatattacggcaaaatactgaagccgtacttgggagtcggccat

SEQ ID NO: 368922 - DNA, 140 bp, Artificial Sequence
  Synthetic
atggccgactcccaagtacggcttcagtattttgccgtaatatttctttagaccttgagacagagttaaaattatttccacctcaaggttcctcttggacctgttttttgggctgggatgggagacccagcatggcgtat

SEQ ID NO: 368923 - DNA, 140 bp, Artificial Sequence
  Synthetic
atacgccatgctgggtctccaagagaaaccttgggtcgaattgtgatgatgacttctttcaaaagagaatagaagaattcttcataactggtgagggctacttcaatgaagtcctacaatcgtacttgggagtcggccat

SEQ ID NO: 368924 - DNA, 140 bp, Artificial Sequence
  Synthetic
atggccgactcccaagtacgattgtaggacttcattgaagtagccctcaccagttatgaagaattcttctattctcttttgaaagaagtcatcatcacaattcgacccaaggtttctcttggagacccagcatggcgtat

SEQ ID NO: 368925 - DNA, 140 bp, Artificial Sequence
  Synthetic
aggccctggctgctgatatgaagttggttttcaaactgatattgatgggaaaataagaacagaccacagaaaatggaaagatatattaaagctgttggagttactgggaatcaaatgctcgaccttttgggacagcggtg

SEQ ID NO: 368926 - DNA, 140 bp, Artificial Sequence
  Synthetic
caccgctgtcccaaaaggtcgagcatttgattcccagtaactccaacagctttaatatatctttccattttctgtggtctgttcttattttcccatcaatatcagtttgaaaaccaacttcatatcagcagccagggcct

SEQ ID NO: 368927 - DNA, 140 bp, Artificial Sequence
  Synthetic
atacgccatgctgggtctcctaactgtagttacaatatatgcccttattgtgcatcaagattgacctccgatgggctagctaggcatgtaacgcaatgccccaagcgaaaagagaaagttcgtacttgggagtcggccat

SEQ ID NO: 368928 - DNA, 140 bp, Artificial Sequence
  Synthetic
atggccgactcccaagtacgaactttctcttttcgcttggggcattgcgttacatgcctagctagcccatcggaggtcaatcttgatgcacaataagggcatatattgtaactacagttaggagacccagcatggcgtat

SEQ ID NO: 368929 - DNA, 140 bp, Artificial Sequence
  Synthetic
atacgccatgctgggtctccgtctgtgattactctttagacactgacgggccagtgaggcttcctcgcattcaccatgaaggtgctttcataccaggaacttataaaatagtgatagacacgtacttgggagtcggccat

SEQ ID NO: 368930 - DNA, 140 bp, Artificial Sequence
  Synthetic
atggccgactcccaagtacgtgtctatcactattttataagttcctggtatgaaagcaccttcatggtgaatgcgaggaagcctcactggcccgtcagtgtctaaagagtaatcacagacggagacccagcatggcgtat

SEQ ID NO: 368931 - DNA, 140 bp, Artificial Sequence
  Synthetic
aggccctggctgctgatatgtctcaaagaaacacgtgccgcttatgcccacagtgttctcttgagtgttagcaaaatggaaaacaaaatcgaggtgaataacaaggatgagatgaacagggaccttttgggacagcggtg

SEQ ID NO: 368932 - DNA, 140 bp, Artificial Sequence
  Synthetic
caccgctgtcccaaaaggtccctgttcatctcatccttgttattcacctcgattttgttttccattttgctaacactcaagagaacactgtgggcataagcggcacgtgtttctttgagacatatcagcagccagggcct

SEQ ID NO: 368933 - DNA, 140 bp, Artificial Sequence
  Synthetic
atacgccatgctgggtctccgaagctcctgcaagtgtcggagtccactggcgtggtattgaaacgaagcagttggctgattgtgctgcttgtgttactcacagtttcattgtcaccagttcgtacttgggagtcggccat

SEQ ID NO: 368934 - DNA, 140 bp, Artificial Sequence
  Synthetic
atggccgactcccaagtacgaactggtgacaatgaaactgtgagtaacacaagcagcacaatcagccaactgcttcgtttcaataccacgccagtggactccgacacttgcaggagcttcggagacccagcatggcgtat

SEQ ID NO: 368935 - DNA, 140 bp, Artificial Sequence
  Synthetic
atacgccatgctgggtctcccgctattgggtaagatggccatttacatttgcagaatgtcaaatcatcccaggacaaccatggctttcctcttctggttcagttttggctatgtaatcaccgtacttgggagtcggccat

SEQ ID NO: 368936 - DNA, 140 bp, Artificial Sequence
  Synthetic
atggccgactcccaagtacggtgattacatagccaaaactgaaccagaagaggaaagccatggttgtcctgggatgatttgacattctgcaaatgtaaatggccatcttacccaatagcgggagacccagcatggcgtat

SEQ ID NO: 368937 - DNA, 140 bp, Artificial Sequence
  Synthetic
aggccctggctgctgatatggttgattgtatactgtttaaggaagtagcagcagaatgcatgaagagatatattggcacaccttatgaaggaattatagacactttagtttccttaatcagaccttttgggacagcggtg

SEQ ID NO: 368938 - DNA, 140 bp, Artificial Sequence
  Synthetic
caccgctgtcccaaaaggtctgattaaggaaactaaagtgtctataattccttcataaggtgtgccaatatatctcttcatgcattctgctgctacttccttaaacagtatacaatcaaccatatcagcagccagggcct

SEQ ID NO: 368939 - DNA, 140 bp, Artificial Sequence
  Synthetic
atacgccatgctgggtctcccaatcagcacctgttggtcatggtaagacaattgaaacatatcagaccagagaaggattcacaagtatctgtctctttatgttaggaagcatcctattcacgtacttgggagtcggccat

SEQ ID NO: 368940 - DNA, 140 bp, Artificial Sequence
  Synthetic
atggccgactcccaagtacgtgaataggatgcttcctaacataaagagacagatacttgtgaatccttctctggtctgatatgtttcaattgtcttaccatgaccaacaggtgctgattgggagacccagcatggcgtat

SEQ ID NO: 368941 - DNA, 140 bp, Artificial Sequence
  Synthetic
aggccctggctgctgatatgctttgaaattgaatcgcataaatgctactgtagtttattttgctgcccctactgtaggcactactctgctgacagagaaattcaccagttgcacttgagtgaccttttgggacagcggtg

SEQ ID NO: 368942 - DNA, 140 bp, Artificial Sequence
  Synthetic
caccgctgtcccaaaaggtcactcaagtgcaactggtgaatttctctgtcagcagagtagtgcctacagtaggggcagcaaaataaactacagtagcatttatgcgattcaatttcaaagcatatcagcagccagggcct

SEQ ID NO: 368943 - DNA, 140 bp, Artificial Sequence
  Synthetic
atacgccatgctgggtctccacgcatgtgctttaaggcaactatagaagcaagcagaagagccctgctcatccgaagtattatcaacaccacttttgtaatatgtattctaatattagcacgtacttgggagtcggccat

SEQ ID NO: 368944 - DNA, 140 bp, Artificial Sequence
  Synthetic
atggccgactcccaagtacgtgctaatattagaatacatattacaaaagtggtgttgataatacttcggatgagcagggctcttctgcttgcttctatagttgccttaaagcacatgcgtggagacccagcatggcgtat

SEQ ID NO: 368945 - DNA, 140 bp, Artificial Sequence
  Synthetic
atacgccatgctgggtctcccacttgggagagagaggaagacctgacaaatttctgccaccaggaatgccaggtgaccgagacggaatgcctctgtccatacgaagctcttgtgctcaggcgtacttgggagtcggccat

SEQ ID NO: 368946 - DNA, 140 bp, Artificial Sequence
  Synthetic
atggccgactcccaagtacgcctgagcacaagagcttcgtatggacagaggcattccgtctcggtcacctggcattcctggtggcagaaatttgtcaggtcttcctctctctcccaagtgggagacccagcatggcgtat

SEQ ID NO: 368947 - DNA, 140 bp, Artificial Sequence
  Synthetic
atacgccatgctgggtctccctcaacaagcttggaaacaagcttatcaattgaggcaccatggggagcaataaatgtccagtcaacctttaaaccaacagtatcgactgcaaacatagcacgtacttgggagtcggccat

SEQ ID NO: 368948 - DNA, 140 bp, Artificial Sequence
  Synthetic
atggccgactcccaagtacgtgctatgtttgcagtcgatactgttggtttaaaggttgactggacatttattgctccccatggtgcctcaattgataagcttgtttccaagcttgttgagggagacccagcatggcgtat

SEQ ID NO: 368949 - DNA, 140 bp, Artificial Sequence
  Synthetic
atacgccatgctgggtctcctatcagcaggcaataacagacatttgtcaattttctgagtacacaccaaacaaagaaagcattttgaaagactgccttcaaatcatacggaaaaatcccacgtacttgggagtcggccat

SEQ ID NO: 368950 - DNA, 140 bp, Artificial Sequence
  Synthetic
atggccgactcccaagtacgtgggatttttccgtatgatttgaaggcagtctttcaaaatgctttctttgtttggtgtgtactcagaaaattgacaaatgtctgttattgcctgctgataggagacccagcatggcgtat

SEQ ID NO: 368951 - DNA, 140 bp, Artificial Sequence
  Synthetic
atacgccatgctgggtctccaaaggtgtggctgcacatcatcaacctgcttgcataaagaatggcctcactcaagaaactggagatgtaaccccacttggtgctggggagtaggaaccggcgtacttgggagtcggccat

SEQ ID NO: 368952 - DNA, 140 bp, Artificial Sequence
  Synthetic
atggccgactcccaagtacgccggttcctactccccagcaccaagtggggttacatctccagtttcttgagtgaggccattctttatgcaagcaggttgatgatgtgcagccacacctttggagacccagcatggcgtat

SEQ ID NO: 368953 - DNA, 140 bp, Artificial Sequence
  Synthetic
aggccctggctgctgatatgtcaagaaactggagatgtaaccccacttggtgctggggagtaggaaccggctgcacatgctgcggagtggatgtaaaagacctttttacagatcacatgtgaccttttgggacagcggtg

SEQ ID NO: 368954 - DNA, 140 bp, Artificial Sequence
  Synthetic
caccgctgtcccaaaaggtcacatgtgatctgtaaaaaggtcttttacatccactccgcagcatgtgcagccggttcctactccccagcaccaagtggggttacatctccagtttcttgacatatcagcagccagggcct

SEQ ID NO: 368955 - DNA, 140 bp, Artificial Sequence
  Synthetic
atacgccatgctgggtctccacataaggctacaacatctggaattatcaaagcttaagcaggagcaccccagtgttagcttcaccaaggaggaggtcttaataaagcggctggagaaaaacgtacttgggagtcggccat

SEQ ID NO: 368956 - DNA, 140 bp, Artificial Sequence
  Synthetic
atggccgactcccaagtacgtttttctccagccgctttattaagacctcctccttggtgaagctaacactggggtgctcctgcttaagctttgataattccagatgttgtagccttatgtggagacccagcatggcgtat

SEQ ID NO: 368957 - DNA, 140 bp, Artificial Sequence
  Synthetic
aggccctggctgctgatatgcattaattaatctcttttactatcccaccaatcctctctttctctactgttcatttcagtttcatcatcattattatctggggtgtggggggaacgatttgaccttttgggacagcggtg

SEQ ID NO: 368958 - DNA, 140 bp, Artificial Sequence
  Synthetic
caccgctgtcccaaaaggtcaaatcgttccccccacaccccagataataatgatgatgaaactgaaatgaacagtagagaaagagaggattggtgggatagtaaaagagattaattaatgcatatcagcagccagggcct

SEQ ID NO: 368959 - DNA, 140 bp, Artificial Sequence
  Synthetic
atacgccatgctgggtctcctgacctagactactattgcaacatggggaattggccttcttgcacatacacaggagtgacccaacataatcatgctgcatttgtaaatttgcttaacattcgtacttgggagtcggccat

SEQ ID NO: 368960 - DNA, 140 bp, Artificial Sequence
  Synthetic
atggccgactcccaagtacgaatgttaagcaaatttacaaatgcagcatgattatgttgggtcactcctgtgtatgtgcaagaaggccaattccccatgttgcaatagtagtctaggtcaggagacccagcatggcgtat

SEQ ID NO: 368961 - DNA, 140 bp, Artificial Sequence
  Synthetic
atacgccatgctgggtctccgattagactgccttaccaacatgcgaaaccttgacggaaagcccataagtgaaggtagcaacttggtcaacttctacaaagtcatttgcatttcaggtgacgtacttgggagtcggccat

SEQ ID NO: 368962 - DNA, 140 bp, Artificial Sequence
  Synthetic
atggccgactcccaagtacgtcacctgaaatgcaaatgactttgtagaagttgaccaagttgctaccttcacttatgggctttccgtcaaggtttcgcatgttggtaaggcagtctaatcggagacccagcatggcgtat

SEQ ID NO: 368963 - DNA, 140 bp, Artificial Sequence
  Synthetic
aggccctggctgctgatatggtcaaagagatgttgtcagatatgattagaaggaggaacctgattctcaacagaggtggtgatgaaaacccacgcggcccagtcagccgtgagcatgtgggaccttttgggacagcggtg

SEQ ID NO: 368964 - DNA, 140 bp, Artificial Sequence
  Synthetic
caccgctgtcccaaaaggtcccacatgctcacggctgactgggccgcgtgggttttcatcaccacctctgttgagaatcaggttcctccttctaatcatatctgacaacatctctttgaccatatcagcagccagggcct

SEQ ID NO: 368965 - DNA, 140 bp, Artificial Sequence
  Synthetic
atacgccatgctgggtctccagtggtgcagggaatttgttaaaggcaagtacataatggcctttaaccctccctggggggacatcaacaagtcaggacgttcaggaatagcactagttgccgtacttgggagtcggccat

SEQ ID NO: 368966 - DNA, 140 bp, Artificial Sequence
  Synthetic
atggccgactcccaagtacggcaactagtgctattcctgaacgtcctgacttgttgatgtccccccagggagggttaaaggccattatgtacttgcctttaacaaattccctgcaccactggagacccagcatggcgtat

SEQ ID NO: 368967 - DNA, 140 bp, Artificial Sequence
  Synthetic
atacgccatgctgggtctccattgtataaaatatcccacaggacagctaatcacccatggaagagtgagtgcaaaacataacgatggaaacttgaaagatagaagtgatgatgatcaaagcgtacttgggagtcggccat

SEQ ID NO: 368968 - DNA, 140 bp, Artificial Sequence
  Synthetic
atggccgactcccaagtacgctttgatcatcatcacttctatctttcaagtttccatcgttatgttttgcactcactcttccatgggtgattagctgtcctgtgggatattttatacaatggagacccagcatggcgtat

SEQ ID NO: 368969 - DNA, 140 bp, Artificial Sequence
  Synthetic
aggccctggctgctgatatgaaattcatgttcactggactgataaatagctctgtaacctctcctcagagtttgatgcaagcatgccaggtttcatcccaacaagccatgtataatagtggaccttttgggacagcggtg

SEQ ID NO: 368970 - DNA, 140 bp, Artificial Sequence
  Synthetic
caccgctgtcccaaaaggtccactattatacatggcttgttgggatgaaacctggcatgcttgcatcaaactctgaggagaggttacagagctatttatcagtccagtgaacatgaatttcatatcagcagccagggcct

SEQ ID NO: 368971 - DNA, 140 bp, Artificial Sequence
  Synthetic
atacgccatgctgggtctccagaaagaacctcgaaggttgacagcagcatgccgtccagtgtccttgcttattctggcttcgttcatcgcatccatactttacagacactgcaacacactcgtacttgggagtcggccat

SEQ ID NO: 368972 - DNA, 140 bp, Artificial Sequence
  Synthetic
atggccgactcccaagtacgagtgtgttgcagtgtctgtaaagtatggatgcgatgaacgaagccagaataagcaaggacactggacggcatgctgctgtcaaccttcgaggttctttctggagacccagcatggcgtat

SEQ ID NO: 368973 - DNA, 140 bp, Artificial Sequence
  Synthetic
atacgccatgctgggtctccgcatctaacccgcttcattatatccacaaataagctctgtgatgcccgaaactgtctctgctctgcttgctctgaccttaactttgactgcgtgccgccacgtacttgggagtcggccat

SEQ ID NO: 368974 - DNA, 140 bp, Artificial Sequence
  Synthetic
atggccgactcccaagtacgtggcggcacgcagtcaaagttaaggtcagagcaagcagagcagagacagtttcgggcatcacagagcttatttgtggatataatgaagcgggttagatgcggagacccagcatggcgtat

SEQ ID NO: 368975 - DNA, 140 bp, Artificial Sequence
  Synthetic
aggccctggctgctgatatgtcactcaaagagagtcacagcacatggagagacgccccagctagaccttaaagccagaccaaagtatggagcaggtgaggtcacagtcctggtggaagttgaccttttgggacagcggtg

SEQ ID NO: 368976 - DNA, 140 bp, Artificial Sequence
  Synthetic
caccgctgtcccaaaaggtcaacttccaccaggactgtgacctcacctgctccatactttggtctggctttaaggtctagctggggcgtctctccatgtgctgtgactctctttgagtgacatatcagcagccagggcct

SEQ ID NO: 368977 - DNA, 140 bp, Artificial Sequence
  Synthetic
atacgccatgctgggtctccagtctgtactatgtgttctaatagctggttactacagatcatttggaggggaggggactgaaaaacaggtaaaggcatcattgaatagggacgacaacaacgtacttgggagtcggccat

SEQ ID NO: 368978 - DNA, 140 bp, Artificial Sequence
  Synthetic
atggccgactcccaagtacgttgttgtcgtccctattcaatgatgcctttacctgtttttcagtcccctcccctccaaatgatctgtagtaaccagctattagaacacatagtacagactggagacccagcatggcgtat

SEQ ID NO: 368979 - DNA, 140 bp, Artificial Sequence
  Synthetic
aggccctggctgctgatatggacggcatagagagcaacatgaagcagttatttgctatattacctcctgactgtgcaagagaatgtgaagttctctttgatgacattagaaactctccaagaccttttgggacagcggtg

SEQ ID NO: 368980 - DNA, 140 bp, Artificial Sequence
  Synthetic
caccgctgtcccaaaaggtcttggagagtttctaatgtcatcaaagagaacttcacattctcttgcacagtcaggaggtaatatagcaaataactgcttcatgttgctctctatgccgtccatatcagcagccagggcct

SEQ ID NO: 368981 - DNA, 140 bp, Artificial Sequence
  Synthetic
atacgccatgctgggtctcctgctagcctgacctgcacgggctgctatgcttgtagctcaggtatctcctgcaaggttaggcttcatgtagatgagccagatgagctcacggtacacgtgcgtacttgggagtcggccat

SEQ ID NO: 368982 - DNA, 140 bp, Artificial Sequence
  Synthetic
atggccgactcccaagtacgcacgtgtaccgtgagctcatctggctcatctacatgaagcctaaccttgcaggagatacctgagctacaagcatagcagcccgtgcaggtcaggctagcaggagacccagcatggcgtat

SEQ ID NO: 368983 - DNA, 140 bp, Artificial Sequence
  Synthetic
atacgccatgctgggtctcctgcaagttcaacacttggggagactcaaacaggtctggtaagtttacatacagtagtaggtctggagagtcaattggcatcttcattgcaggaaaactgccgtacttgggagtcggccat

SEQ ID NO: 368984 - DNA, 140 bp, Artificial Sequence
  Synthetic
atggccgactcccaagtacggcagttttcctgcaatgaagatgccaattgactctccagacctactactgtatgtaaacttaccagacctgtttgagtctccccaagtgttgaacttgcaggagacccagcatggcgtat

SEQ ID NO: 368985 - DNA, 140 bp, Artificial Sequence
  Synthetic
aggccctggctgctgatatgtaaatatccagtcaacctttaaaccaacagtatcggctgcaaacatagcactcagttggagctcagtggagcacagaggcaacaagatcttagtctcagggaccttttgggacagcggtg

SEQ ID NO: 368986 - DNA, 140 bp, Artificial Sequence
  Synthetic
caccgctgtcccaaaaggtccctgagactaagatcttgttgcctctgtgctccactgagctccaactgagtgctatgtttgcagccgatactgttggtttaaaggttgactggatatttacatatcagcagccagggcct

SEQ ID NO: 368987 - DNA, 140 bp, Artificial Sequence
  Synthetic
aggccctggctgctgatatgataacactgatgttgaattcaaccacagggagatagctgatctcaatcagttaacttctcggctcattacattaagaaaagagaaagacactgacctcctgaccttttgggacagcggtg

SEQ ID NO: 368988 - DNA, 140 bp, Artificial Sequence
  Synthetic
caccgctgtcccaaaaggtcaggaggtcagtgtctttctcttttcttaatgtaatgagccgagaagttaactgattgagatcagctatctccctgtggttgaattcaacatcagtgttatcatatcagcagccagggcct

SEQ ID NO: 368989 - DNA, 140 bp, Artificial Sequence
  Synthetic
atacgccatgctgggtctcccgagctggggaagcaaccaaggggcactaagaaaatgaagaaggcactcctgagcacaccaatgaagtgggggaagaagctttatgagctctttgctgatcgtacttgggagtcggccat

SEQ ID NO: 368990 - DNA, 140 bp, Artificial Sequence
  Synthetic
atggccgactcccaagtacgatcagcaaagagctcataaagcttcttcccccacttcattggtgtgctcaggagtgccttcttcattttcttagtgccccttggttgcttccccagctcgggagacccagcatggcgtat

SEQ ID NO: 368991 - DNA, 140 bp, Artificial Sequence
  Synthetic
aggccctggctgctgatatgtgtaacaggtgaaaaaatgctgttgagctggctgactgaggatatcaaatcagcaaggtgcagtgaatgcctaaatgcaattaagaaggccattgaagaagaccttttgggacagcggtg

SEQ ID NO: 368992 - DNA, 140 bp, Artificial Sequence
  Synthetic
caccgctgtcccaaaaggtcttcttcaatggccttcttaattgcatttaggcattcactgcaccttgctgatttgatatcctcagtcagccagctcaacagcattttttcacctgttacacatatcagcagccagggcct

SEQ ID NO: 368993 - DNA, 140 bp, Artificial Sequence
  Synthetic
atacgccatgctgggtctccatctggaactggagagcttgctcactttgtgtgctttctatttccaaaatgagtgtagtaagagagatggacctaggtgttcattcgcagcactgttaagcgtacttgggagtcggccat

SEQ ID NO: 368994 - DNA, 140 bp, Artificial Sequence
  Synthetic
atggccgactcccaagtacgcttaacagtgctgcgaatgaacacctaggtccatctctcttactacactcattttggaaatagaaagcacacaaagtgagcaagctctccagttccagatggagacccagcatggcgtat

SEQ ID NO: 368995 - DNA, 140 bp, Artificial Sequence
  Synthetic
aggccctggctgctgatatgtgcagcaaagaggacacacaaaagtgtgtaaatgcaaaacttgagcagcctcagagtatacttattgaacataaaggcaccataattgggaagcaaaatggaccttttgggacagcggtg

SEQ ID NO: 368996 - DNA, 140 bp, Artificial Sequence
  Synthetic
caccgctgtcccaaaaggtccattttgcttcccaattatggtgcctttatgttcaataagtatactctgaggctgctcaagttttgcatttacacacttttgtgtgtcctctttgctgcacatatcagcagccagggcct

SEQ ID NO: 368997 - DNA, 140 bp, Artificial Sequence
  Synthetic
aggccctggctgctgatatgcttttatcgcctgtgccgactgctcgtctacaccgccagatagatggtggattacggaggacagagtacgagtcttaaagaattcagtcagtttcctcttgaccttttgggacagcggtg

SEQ ID NO: 368998 - DNA, 140 bp, Artificial Sequence
  Synthetic
caccgctgtcccaaaaggtcaagaggaaactgactgaattctttaagactcgtactctgtcctccgtaatccaccatctatctggcggtgtagacgagcagtcggcacaggcgataaaagcatatcagcagccagggcct

SEQ ID NO: 368999 - DNA, 140 bp, Artificial Sequence
  Synthetic
atacgccatgctgggtctccgtttcactacaatttctcagctattggttaacctttactatcctactattccactttctttgctgttcatgtccgttttattatttctggggtgtgggggcgtacttgggagtcggccat

SEQ ID NO: 369000 - DNA, 140 bp, Artificial Sequence
  Synthetic
atggccgactcccaagtacgcccccacaccccagaaataataaaacggacatgaacagcaaagaaagtggaatagtaggatagtaaaggttaaccaatagctgagaaattgtagtgaaacggagacccagcatggcgtat

SEQ ID NO: 369001 - DNA, 140 bp, Artificial Sequence
  Synthetic
aggccctggctgctgatatggcaaaatggaaaacaaaatcgaggtgaataacaaagatgagatgaacaagtggtttgaagagttcaaaaagggaaatggacttgtggacaccttcacaaagaccttttgggacagcggtg

SEQ ID NO: 369002 - DNA, 140 bp, Artificial Sequence
  Synthetic
caccgctgtcccaaaaggtctttgtgaaggtgtccacaagtccatttccctttttgaactcttcaaaccacttgttcatctcatctttgttattcacctcgattttgttttccattttgccatatcagcagccagggcct

SEQ ID NO: 369003 - DNA, 140 bp, Artificial Sequence
  Synthetic
atacgccatgctgggtctccgaaggttctgaatcatgcatcaacatgttgaaagaaaatttggatcgaataactgatgaattcgagcgaacaaaatttaaacatgaactaactcagaatgcgtacttgggagtcggccat

SEQ ID NO: 369004 - DNA, 140 bp, Artificial Sequence
  Synthetic
atggccgactcccaagtacgcattctgagttagttcatgtttaaattttgttcgctcgaattcatcagttattcgatccaaattttctttcaacatgttgatgcatgattcagaaccttcggagacccagcatggcgtat

SEQ ID NO: 369005 - DNA, 140 bp, Artificial Sequence
  Synthetic
aggccctggctgctgatatgtcatcgagatgcactgagtgcctcaccaacataaagaaaaccgttgacgagactgccaacttgtctgagaagattgagctgcttgcatataatcttcaacgaccttttgggacagcggtg

SEQ ID NO: 369006 - DNA, 140 bp, Artificial Sequence
  Synthetic
caccgctgtcccaaaaggtcgttgaagattatatgcaagcagctcaatcttctcagacaagttggcagtctcgtcaacggttttctttatgttggtgaggcactcagtgcatctcgatgacatatcagcagccagggcct

SEQ ID NO: 369007 - DNA, 140 bp, Artificial Sequence
  Synthetic
atacgccatgctgggtctccggcttgttaggctcacattaccagggaaaactgagaaggagagaagagtcaaacgcaatgtggaataccttataaaactgatgatgagcatgtcaggcatcgtacttgggagtcggccat

SEQ ID NO: 369008 - DNA, 140 bp, Artificial Sequence
  Synthetic
atggccgactcccaagtacgatgcctgacatgctcatcatcagttttataaggtattccacattgcgtttgactcttctctccttctcagttttccctggtaatgtgagcctaacaagccggagacccagcatggcgtat

SEQ ID NO: 369009 - DNA, 140 bp, Artificial Sequence
  Synthetic
aggccctggctgctgatatgaaaacctctcaaagcagggtaagtcaaagtgttctgtgccgaggtcttggcttgaaaagatattgtttgacttaaaggtgcccactaaagacgaggaagtgaccttttgggacagcggtg

SEQ ID NO: 369010 - DNA, 140 bp, Artificial Sequence
  Synthetic
caccgctgtcccaaaaggtcacttcctcgtctttagtgggcacctttaagtcaaacaatatcttttcaagccaagacctcggcacagaacactttgacttaccctgctttgagaggttttcatatcagcagccagggcct

SEQ ID NO: 369011 - DNA, 140 bp, Artificial Sequence
  Synthetic
atacgccatgctgggtctcccttgaaaagatattgtttgacttaaaggtgcccactaaagacgaggaagtgcttataaacattagaaactcattgaaagctagatctgagtttgttagaacgtacttgggagtcggccat

SEQ ID NO: 369012 - DNA, 140 bp, Artificial Sequence
  Synthetic
atggccgactcccaagtacgttctaacaaactcagatctagctttcaatgagtttctaatgtttataagcacttcctcgtctttagtgggcacctttaagtcaaacaatatcttttcaagggagacccagcatggcgtat

SEQ ID NO: 369013 - DNA, 140 bp, Artificial Sequence
  Synthetic
aggccctggctgctgatatgttatggattgtccaacaatacccaacacaatgacactagtaccataaaagtgcccgaggagagtcaaaaaaccagtctgcccgcgaacacagcatcacccgaccttttgggacagcggtg

SEQ ID NO: 369014 - DNA, 140 bp, Artificial Sequence
  Synthetic
caccgctgtcccaaaaggtcgggtgatgctgtgttcgcgggcagactggttttttgactctcctcgggcacttttatggtactagtgtcattgtgttgggtattgttggacaatccataacatatcagcagccagggcct

SEQ ID NO: 369015 - DNA, 140 bp, Artificial Sequence
  Synthetic
atacgccatgctgggtctccaaatcaagcacagccatcgctgacatcagcacacagacagtcaagaacatccccacaccaacagcccacaccagtttgcccagcactctcagcgcgccaacgtacttgggagtcggccat

SEQ ID NO: 369016 - DNA, 140 bp, Artificial Sequence
  Synthetic
atggccgactcccaagtacgttggcgcgctgagagtgctgggcaaactggtgtgggctgttggtgtggggatgttcttgactgtctgtgtgctgatgtcagcgatggctgtgcttgatttggagacccagcatggcgtat

SEQ ID NO: 369017 - DNA, 140 bp, Artificial Sequence
  Synthetic
aggccctggctgctgatatgtctaggtgtaaagctagcgggaacttcttaaacagaagcagtagagaccactttataagcattgtctcaggcttgaacctggtttatggcttcctcataagaccttttgggacagcggtg

SEQ ID NO: 369018 - DNA, 140 bp, Artificial Sequence
  Synthetic
caccgctgtcccaaaaggtcttatgaggaagccataaaccaggttcaagcctgagacaatgcttataaagtggtctctactgcttctgtttaagaagttcccgctagctttacacctagacatatcagcagccagggcct

SEQ ID NO: 369019 - DNA, 140 bp, Artificial Sequence
  Synthetic
atacgccatgctgggtctccagcacaaaaccaggagaagcatcaacaccaacaagcccaggggaagcaagcacagaggccagcagcccacaaccaaccatcagagagacaccatcccccccgtacttgggagtcggccat

SEQ ID NO: 369020 - DNA, 140 bp, Artificial Sequence
  Synthetic
atggccgactcccaagtacgggggggatggtgtctctctgatggttggttgtgggctgctggcctctgtgcttgcttcccctgggcttgttggtgttgatgcttctcctggttttgtgctggagacccagcatggcgtat

SEQ ID NO: 369021 - DNA, 140 bp, Artificial Sequence
  Synthetic
atacgccatgctgggtctccaagccaaaaagactgtggaggcccttaatgggtatctggacaagcacaaggacgaagttgatagggcgagtgctgacagcatgataacaaaccttctcaacgtacttgggagtcggccat

SEQ ID NO: 369022 - DNA, 140 bp, Artificial Sequence
  Synthetic
atggccgactcccaagtacgttgagaaggtttgttatcatgctgtcagcactcgccctatcaacttcgtccttgtgcttgtccagatacccattaagggcctccacagtctttttggcttggagacccagcatggcgtat

SEQ ID NO: 369023 - DNA, 140 bp, Artificial Sequence
  Synthetic
atacgccatgctgggtctcccagcccatgccctcaacacaaccagcagctcccagctcagtgacccatccagcacagccaaccccctctcagagcgacgtccccacggctgctcaagatacgtacttgggagtcggccat

SEQ ID NO: 369024 - DNA, 140 bp, Artificial Sequence
  Synthetic
atggccgactcccaagtacgtatcttgagcagccgtggggacgtcgctctgagagggggttggctgtgctggatgggtcactgagctgggagctgctggttgtgttgagggcatgggctgggagacccagcatggcgtat

SEQ ID NO: 369025 - DNA, 140 bp, Artificial Sequence
  Synthetic
aggccctggctgctgatatgatgtttgtgactactctatagacatcgacgggccggtaagactgccccgtatccaccatgaaggaacttttataccaggaacttacaaaatagttatagagaccttttgggacagcggtg

SEQ ID NO: 369026 - DNA, 140 bp, Artificial Sequence
  Synthetic
caccgctgtcccaaaaggtctctataactattttgtaagttcctggtataaaagttccttcatggtggatacggggcagtcttaccggcccgtcgatgtctatagagtagtcacaaacatcatatcagcagccagggcct

SEQ ID NO: 369027 - DNA, 140 bp, Artificial Sequence
  Synthetic
aggccctggctgctgatatgcaatcaaatcacatatctgtgactattctttagacaccgacggggcaattaggcttcctcaaattcatcatgaaggcacttttatcccaggtacttacaagaccttttgggacagcggtg

SEQ ID NO: 369028 - DNA, 140 bp, Artificial Sequence
  Synthetic
caccgctgtcccaaaaggtcttgtaagtacctgggataaaagtgccttcatgatgaatttgaggaagcctaattgccccgtcggtgtctaaagaatagtcacagatatgtgatttgattgcatatcagcagccagggcct

SEQ ID NO: 369029 - DNA, 140 bp, Artificial Sequence
  Synthetic
aggccctggctgctgatatgtcggcgctatctcaacaaacatagagattgggaaaagggattgcttggatctactcagcacggtagatggtctgacagaccaacagaaagaaaacattgtgaccttttgggacagcggtg

SEQ ID NO: 369030 - DNA, 140 bp, Artificial Sequence
  Synthetic
caccgctgtcccaaaaggtcacaatgttttctttctgttggtctgtcagaccatctaccgtgctgagtagatccaagcaatcccttttcccaatctctatgtttgttgagatagcgccgacatatcagcagccagggcct

SEQ ID NO: 369031 - DNA, 140 bp, Artificial Sequence
  Synthetic
atacgccatgctgggtctccaaggcaggcgtgactccagaaaccttcccgacggtgtcacagttcctcttcgagctagggaaacagccaagaggtaccaagaaaatgaagaaggctctgccgtacttgggagtcggccat

SEQ ID NO: 369032 - DNA, 140 bp, Artificial Sequence
  Synthetic
atggccgactcccaagtacggcagagccttcttcattttcttggtacctcttggctgtttccctagctcgaagaggaactgtgacaccgtcgggaaggtttctggagtcacgcctgccttggagacccagcatggcgtat

SEQ ID NO: 369033 - DNA, 140 bp, Artificial Sequence
  Synthetic
atacgccatgctgggtctccagatggtcttgccagacatgtaatgcaatgccccaaacggaaggaaaaaatagaagaaaccgaattatatttaaacttagaaagaatcccttgggttgttcgtacttgggagtcggccat

SEQ ID NO: 369034 - DNA, 140 bp, Artificial Sequence
  Synthetic
atggccgactcccaagtacgaacaacccaagggattctttctaagtttaaatataattcggtttcttctattttttccttccgtttggggcattgcattacatgtctggcaagaccatctggagacccagcatggcgtat

SEQ ID NO: 369035 - DNA, 140 bp, Artificial Sequence
  Synthetic
atacgccatgctgggtctccttttccctggcttgtccatttgtaagacatgttctattggcagtataaacggctttgaaattgaatctcacaaatgttactgtagcctattttgctgccccgtacttgggagtcggccat

SEQ ID NO: 369036 - DNA, 140 bp, Artificial Sequence
  Synthetic
atggccgactcccaagtacggggcagcaaaataggctacagtaacatttgtgagattcaatttcaaagccgtttatactgccaatagaacatgtcttacaaatggacaagccagggaaaaggagacccagcatggcgtat

SEQ ID NO: 369037 - DNA, 140 bp, Artificial Sequence
  Synthetic
atacgccatgctgggtctccctttttcgcttagtctaaatgatgggggtttagatcttgacctgcacaagactactgacgaaaagctactacatcagacaaagatagtttttgctaaaatcgtacttgggagtcggccat

SEQ ID NO: 369038 - DNA, 140 bp, Artificial Sequence
  Synthetic
atggccgactcccaagtacgattttagcaaaaactatctttgtctgatgtagtagcttttcgtcagtagtcttgtgcaggtcaagatctaaacccccatcatttagactaagcgaaaaagggagacccagcatggcgtat

SEQ ID NO: 369039 - DNA, 140 bp, Artificial Sequence
  Synthetic
atacgccatgctgggtctcccaaatagcaactttaatgtttgcaagagattgactggaaggagtaccggagagaggcttccaagaagtgtcagaagcaaggtcatttatgagatggtaaacgtacttgggagtcggccat

SEQ ID NO: 369040 - DNA, 140 bp, Artificial Sequence
  Synthetic
atggccgactcccaagtacgtttaccatctcataaatgaccttgcttctgacacttcttggaagcctctctccggtactccttccagtcaatctcttgcaaacattaaagttgctatttgggagacccagcatggcgtat

SEQ ID NO: 369041 - DNA, 140 bp, Artificial Sequence
  Synthetic
aggccctggctgctgatatgcagcggaatctgaactagaagcaaaccgagctgtgatagtcaagaccaagctgttctcagcaactgagcaggtccgcctctccaacaatcccgcagttgtgaccttttgggacagcggtg

SEQ ID NO: 369042 - DNA, 140 bp, Artificial Sequence
  Synthetic
caccgctgtcccaaaaggtcacaactgcgggattgttggagaggcggacctgctcagttgctgagaacagcttggtcttgactatcacagctcggtttgcttctagttcagattccgctgcatatcagcagccagggcct

SEQ ID NO: 369043 - DNA, 140 bp, Artificial Sequence
  Synthetic
aggccctggctgctgatatgactagtaggtgagacaggcatggcaatactacaacaattagcttttgcacaggcactaaattacgaacaccgtttctatgcagtcttagcacctaaggcagaccttttgggacagcggtg

SEQ ID NO: 369044 - DNA, 140 bp, Artificial Sequence
  Synthetic
caccgctgtcccaaaaggtctgccttaggtgctaagactgcatagaaacggtgttcgtaatttagtgcctgtgcaaaagctaattgttgtagtattgccatgcctgtctcacctactagtcatatcagcagccagggcct

SEQ ID NO: 369045 - DNA, 140 bp, Artificial Sequence
  Synthetic
aggccctggctgctgatatgggcacttgggaaaaagaggaagacctgacaaatttctgtcatcaggaatgccaagtcactgagactgaatgcctctgtccttatgaagctcttgtgctcagaccttttgggacagcggtg

SEQ ID NO: 369046 - DNA, 140 bp, Artificial Sequence
  Synthetic
caccgctgtcccaaaaggtctgagcacaagagcttcataaggacagaggcattcagtctcagtgacttggcattcctgatgacagaaatttgtcaggtcttcctctttttcccaagtgcccatatcagcagccagggcct

SEQ ID NO: 369047 - DNA, 140 bp, Artificial Sequence
  Synthetic
atacgccatgctgggtctcccagatgatggccttaccaacccgcatcttaaagaaacaatccttaatgtgggattagactgccttaccaacatgcgaaatcttgatggaaagcccataagcgtacttgggagtcggccat

SEQ ID NO: 369048 - DNA, 140 bp, Artificial Sequence
  Synthetic
atggccgactcccaagtacgcttatgggctttccatcaagatttcgcatgttggtaaggcagtctaatcccacattaaggattgtttctttaagatgcgggttggtaaggccatcatctgggagacccagcatggcgtat

SEQ ID NO: 369049 - DNA, 140 bp, Artificial Sequence
  Synthetic
aggccctggctgctgatatggtaactggtatactatccaaagagctctactctcaatacgatgaaacattctggaaacatgcctgtagacttaagaacttcacagctgcagtacaaagatgaccttttgggacagcggtg

SEQ ID NO: 369050 - DNA, 140 bp, Artificial Sequence
  Synthetic
caccgctgtcccaaaaggtcatctttgtactgcagctgtgaagttcttaagtctacaggcatgtttccagaatgtttcatcgtattgagagtagagctctttggatagtataccagttaccatatcagcagccagggcct

SEQ ID NO: 369051 - DNA, 140 bp, Artificial Sequence
  Synthetic
aggccctggctgctgatatgaaaaatgtgtcaacacaaagcttgaacaaccacaaagcattttaatcgagcacaaagggacgataatcggaaagcagaacgacacttgtacagccaaagcgaccttttgggacagcggtg

SEQ ID NO: 369052 - DNA, 140 bp, Artificial Sequence
  Synthetic
caccgctgtcccaaaaggtcgctttggctgtacaagtgtcgttctgctttccgattatcgtccctttgtgctcgattaaaatgctttgtggttgttcaagctttgtgttgacacatttttcatatcagcagccagggcct

SEQ ID NO: 369053 - DNA, 140 bp, Artificial Sequence
  Synthetic
atacgccatgctgggtctcctgcttagtggcatttttggcaatgttttcatagggattttcttattcctcgctccttttatcatgctaatacttttcttcatgtttggatggaggatcctcgtacttgggagtcggccat

SEQ ID NO: 369054 - DNA, 140 bp, Artificial Sequence
  Synthetic
atggccgactcccaagtacgaggatcctccatccaaacatgaagaaaagtattagcatgataaaaggagcgaggaataagaaaatccctatgaaaacattgccaaaaatgccactaagcaggagacccagcatggcgtat

SEQ ID NO: 369055 - DNA, 140 bp, Artificial Sequence
  Synthetic
aggccctggctgctgatatgacctcaaagacgatgaagaaatcggttacaggaaaatcattgagaggctaaacaacaaaaaagggaaaaacaaactacttgacggtgaaagactagctgagaccttttgggacagcggtg

SEQ ID NO: 369056 - DNA, 140 bp, Artificial Sequence
  Synthetic
caccgctgtcccaaaaggtctcagctagtctttcaccgtcaagtagtttgtttttcccttttttgttgtttagcctctcaatgattttcctgtaaccgatttcttcatcgtctttgaggtcatatcagcagccagggcct

SEQ ID NO: 369057 - DNA, 140 bp, Artificial Sequence
  Synthetic
aggccctggctgctgatatgttcaccatgcaacctcttcagtgttaacttccttggctgctgtgctcttcgaagagttagctattttttatcttaagaggagcttgcctcagacaacagtgaccttttgggacagcggtg

SEQ ID NO: 369058 - DNA, 140 bp, Artificial Sequence
  Synthetic
caccgctgtcccaaaaggtcactgttgtctgaggcaagctcctcttaagataaaaaatagctaactcttcgaagagcacagcagccaaggaagttaacactgaagaggttgcatggtgaacatatcagcagccagggcct

SEQ ID NO: 369059 - DNA, 140 bp, Artificial Sequence
  Synthetic
aggccctggctgctgatatgattcagaatagaattacaggtctttattgcaatagcaatgaggggcctcttgataggcacaatgttgtttacagcagcagaatggcagattcttgcgattgaccttttgggacagcggtg

SEQ ID NO: 369060 - DNA, 140 bp, Artificial Sequence
  Synthetic
caccgctgtcccaaaaggtcaatcgcaagaatctgccattctgctgctgtaaacaacattgtgcctatcaagaggcccctcattgctattgcaataaagacctgtaattctattctgaatcatatcagcagccagggcct

SEQ ID NO: 369061 - DNA, 140 bp, Artificial Sequence
  Synthetic
aggccctggctgctgatatgacattgtggagagagaatactgcaagagctgcagtgaagatgatacacagaaatgtgttgaaacaaaacttgaacagccacaaagcatactaattgaacagaccttttgggacagcggtg

SEQ ID NO: 369062 - DNA, 140 bp, Artificial Sequence
  Synthetic
caccgctgtcccaaaaggtctgttcaattagtatgctttgtggctgttcaagttttgtttcaacacatttctgtgtatcatcttcactgcagctcttgcagtattctctctccacaatgtcatatcagcagccagggcct

SEQ ID NO: 369063 - DNA, 140 bp, Artificial Sequence
  Synthetic
atacgccatgctgggtctccttcagttctccgatccaaacagacagaaacttagaatagttgagtctagacctgcggaatctgagctagaggcgaaccgtgcagtaattgttaaaaccaacgtacttgggagtcggccat

SEQ ID NO: 369064 - DNA, 140 bp, Artificial Sequence
  Synthetic
atggccgactcccaagtacgttggttttaacaattactgcacggttcgcctctagctcagattccgcaggtctagactcaactattctaagtttctgtctgtttggatcggagaactgaaggagacccagcatggcgtat

SEQ ID NO: 369065 - DNA, 140 bp, Artificial Sequence
  Synthetic
atacgccatgctgggtctccccctgggacaggaatagaaaggcatatgcagctgctacactctgagatgatattggacatctgcactgtatcacttggtgtcatgctgtcaacattcttacgtacttgggagtcggccat

SEQ ID NO: 369066 - DNA, 140 bp, Artificial Sequence
  Synthetic
atggccgactcccaagtacgtaagaatgttgacagcatgacaccaagtgatacagtgcagatgtccaatatcatctcagagtgtagcagctgcatatgcctttctattcctgtcccagggggagacccagcatggcgtat

SEQ ID NO: 369067 - DNA, 140 bp, Artificial Sequence
  Synthetic
aggccctggctgctgatatgattcagaaaggaatggccttagtccagacttgcaacaagttgcaaggtactcaaaccatttaaccctgctcagcaggatgatacaacaagcaaagccaacgaccttttgggacagcggtg

SEQ ID NO: 369068 - DNA, 140 bp, Artificial Sequence
  Synthetic
caccgctgtcccaaaaggtcgttggctttgcttgttgtatcatcctgctgagcagggttaaatggtttgagtaccttgcaacttgttgcaagtctggactaaggccattcctttctgaatcatatcagcagccagggcct

SEQ ID NO: 369069 - DNA, 140 bp, Artificial Sequence
  Synthetic
aggccctggctgctgatatgtcagtgtgcaagactataacggtatgatagaaaacatgtctaagttagacaacaccgatgttgaattcaaccacagggagatagctgatctcaatcaattgaccttttgggacagcggtg

SEQ ID NO: 369070 - DNA, 140 bp, Artificial Sequence
  Synthetic
caccgctgtcccaaaaggtcaattgattgagatcagctatctccctgtggttgaattcaacatcggtgttgtctaacttagacatgttttctatcataccgttatagtcttgcacactgacatatcagcagccagggcct

SEQ ID NO: 369071 - DNA, 140 bp, Artificial Sequence
  Synthetic
atacgccatgctgggtctcctgagtttgatggacaagttatcgctaatatacttgcaagtgaattgagctctgtaaaacgagattctgaacgtgaaggattaactgatctccttgattatcgtacttgggagtcggccat

SEQ ID NO: 369072 - DNA, 140 bp, Artificial Sequence
  Synthetic
atggccgactcccaagtacgataatcaaggagatcagttaatccttcacgttcagaatctcgttttacagagctcaattcacttgcaagtatattagcgataacttgtccatcaaactcaggagacccagcatggcgtat

SEQ ID NO: 369073 - DNA, 140 bp, Artificial Sequence
  Synthetic
aggccctggctgctgatatggcaaacgcggaggaatttgtcatatctgagttctttaagaagaaggacattatgaaattcatcagcacttcaggcagagcaatgagcgcaggcaagattggaccttttgggacagcggtg

SEQ ID NO: 369074 - DNA, 140 bp, Artificial Sequence
  Synthetic
caccgctgtcccaaaaggtccaatcttgcctgcgctcattgctctgcctgaagtgctgatgaatttcataatgtccttcttcttaaagaactcagatatgacaaattcctccgcgtttgccatatcagcagccagggcct

SEQ ID NO: 369075 - DNA, 140 bp, Artificial Sequence
  Synthetic
atacgccatgctgggtctccgtaatgtcctatcctatgcacataatctttatttgagtaagtcaagcttaaatatgacctctgaagacatctcacagcttttgatcgagattaagcgattcgtacttgggagtcggccat

SEQ ID NO: 369076 - DNA, 140 bp, Artificial Sequence
  Synthetic
atggccgactcccaagtacgaatcgcttaatctcgatcaaaagctgtgagatgtcttcagaggtcatatttaagcttgacttactcaaataaagattatgtgcataggataggacattacggagacccagcatggcgtat

SEQ ID NO: 369077 - DNA, 140 bp, Artificial Sequence
  Synthetic
aggccctggctgctgatatgaatatgacctctgaagacatctcacagcttttgatcgagattaagcgattgtatgctctacaagaagattctgaagtagagccgatagccataatttgtggaccttttgggacagcggtg

SEQ ID NO: 369078 - DNA, 140 bp, Artificial Sequence
  Synthetic
caccgctgtcccaaaaggtccacaaattatggctatcggctctacttcagaatcttcttgtagagcatacaatcgcttaatctcgatcaaaagctgtgagatgtcttcagaggtcatattcatatcagcagccagggcct

SEQ ID NO: 369079 - DNA, 140 bp, Artificial Sequence
  Synthetic
atacgccatgctgggtctccgtatgctctacaagaagattctgaagtagagccgatagccataatttgtgatggcatagaaagcaacatgaaacagttgtttgctatattgcctcctgaccgtacttgggagtcggccat

SEQ ID NO: 369080 - DNA, 140 bp, Artificial Sequence
  Synthetic
atggccgactcccaagtacggtcaggaggcaatatagcaaacaactgtttcatgttgctttctatgccatcacaaattatggctatcggctctacttcagaatcttcttgtagagcatacggagacccagcatggcgtat

SEQ ID NO: 369081 - DNA, 140 bp, Artificial Sequence
  Synthetic
atacgccatgctgggtctccctcaaagaagatgaggaaacaggctacagaaggattattgagagactgaacagcaaaaaagggaaaaacagactgcttgatggtgaaaggttggctgatacgtacttgggagtcggccat

SEQ ID NO: 369082 - DNA, 140 bp, Artificial Sequence
  Synthetic
atggccgactcccaagtacgtatcagccaacctttcaccatcaagcagtctgtttttcccttttttgctgttcagtctctcaataatccttctgtagcctgtttcctcatcttctttgagggagacccagcatggcgtat

SEQ ID NO: 369083 - DNA, 140 bp, Artificial Sequence
  Synthetic
atacgccatgctgggtctccaacctctcaaggcaaggtaaatcaaagtgttctgtgccaagatcttggctcgagaagatactgtttgacctaaaggtgcccactagagacgaagaagtaccgtacttgggagtcggccat

SEQ ID NO: 369084 - DNA, 140 bp, Artificial Sequence
  Synthetic
atggccgactcccaagtacggtacttcttcgtctctagtgggcacctttaggtcaaacagtatcttctcgagccaagatcttggcacagaacactttgatttaccttgccttgagaggttggagacccagcatggcgtat

SEQ ID NO: 369085 - DNA, 140 bp, Artificial Sequence
  Synthetic
atacgccatgctgggtctccatgctagcttcgctcaaagcatccatactttacagacactgtaacaaactgcacctgatctgcttcactatatcaaagcaatgtttaaaactgccttagccgtacttgggagtcggccat

SEQ ID NO: 369086 - DNA, 140 bp, Artificial Sequence
  Synthetic
atggccgactcccaagtacggctaaggcagttttaaacattgctttgatatagtgaagcagatcaggtgcagtttgttacagtgtctgtaaagtatggatgctttgagcgaagctagcatggagacccagcatggcgtat

SEQ ID NO: 369087 - DNA, 140 bp, Artificial Sequence
  Synthetic
atacgccatgctgggtctccccatagctgcaatactcaaccatgcttattttacttgcttatgtgaccttattttattaacctttctctattttctcttgtcttaaacacttaaagggctcgtacttgggagtcggccat

SEQ ID NO: 369088 - DNA, 140 bp, Artificial Sequence
  Synthetic
atggccgactcccaagtacgagccctttaagtgtttaagacaagagaaaatagagaaaggttaataaaataaggtcacataagcaagtaaaataagcatggttgagtattgcagctatggggagacccagcatggcgtat

SEQ ID NO: 369089 - DNA, 140 bp, Artificial Sequence
  Synthetic
aggccctggctgctgatatgatgcagcatgcccttcaacatcatgtacacaccactattgtgtgctattctttgtttgcagctgtggagcttagaaggaatttatggattgtccaacagagaccttttgggacagcggtg

SEQ ID NO: 369090 - DNA, 140 bp, Artificial Sequence
  Synthetic
caccgctgtcccaaaaggtctctgttggacaatccataaattccttctaagctccacagctgcaaacaaagaatagcacacaatagtggtgtgtacatgatgttgaagggcatgctgcatcatatcagcagccagggcct

SEQ ID NO: 369091 - DNA, 140 bp, Artificial Sequence
  Synthetic
aggccctggctgctgatatgacccaacacaatgacactagtaccataaaggtgcccgaagagagtcaaaaaaccagtctgcccgcgaacacagcatcgcccatcacgtcagaccccccctgaccttttgggacagcggtg

SEQ ID NO: 369092 - DNA, 140 bp, Artificial Sequence
  Synthetic
caccgctgtcccaaaaggtcagggggggtctgacgtgatgggcgatgctgtgttcgcgggcagactggttttttgactctcttcgggcacctttatggtactagtgtcattgtgttgggtcatatcagcagccagggcct

SEQ ID NO: 369093 - DNA, 140 bp, Artificial Sequence
  Synthetic
atacgccatgctgggtctcctggggaaaaagttctcaacgagttgtagaaggattgaggacaacattgcaaggctttacctacaaacatccatatactgttcagttagggatgtggaagacgtacttgggagtcggccat

SEQ ID NO: 369094 - DNA, 140 bp, Artificial Sequence
  Synthetic
atggccgactcccaagtacgtcttccacatccctaactgaacagtatatggatgtttgtaggtaaagccttgcaatgttgtcctcaatccttctacaactcgttgagaactttttccccaggagacccagcatggcgtat

SEQ ID NO: 369095 - DNA, 140 bp, Artificial Sequence
  Synthetic
aggccctggctgctgatatggccagagccccacacaacaattgacatcgataaatcaagcacagccatcgctgacatcagcacacagacagtcaaggacatccccacaccaacaacccacgaccttttgggacagcggtg

SEQ ID NO: 369096 - DNA, 140 bp, Artificial Sequence
  Synthetic
caccgctgtcccaaaaggtcgtgggttgttggtgtggggatgtccttgactgtctgtgtgctgatgtcagcgatggctgtgcttgatttatcgatgtcaattgttgtgtggggctctggccatatcagcagccagggcct

SEQ ID NO: 369097 - DNA, 140 bp, Artificial Sequence
  Synthetic
aggccctggctgctgatatgtactggacatctgcactgtatcacttggtgtcatgctgtcaacattcttatatggttctaataataaaaacaagaagaaattcattaccaactgtctgctgaccttttgggacagcggtg

SEQ ID NO: 369098 - DNA, 140 bp, Artificial Sequence
  Synthetic
caccgctgtcccaaaaggtcagcagacagttggtaatgaatttcttcttgtttttattattagaaccatataagaatgttgacagcatgacaccaagtgatacagtgcagatgtccagtacatatcagcagccagggcct

SEQ ID NO: 369099 - DNA, 140 bp, Artificial Sequence
  Synthetic
aggccctggctgctgatatgaagagtagaatccgtagtatctttggaagatacaactctcagaagaaaccatttgaattaaggtcaggtcttgaggttttcaatgatcctttcaatgattgaccttttgggacagcggtg

SEQ ID NO: 369100 - DNA, 140 bp, Artificial Sequence
  Synthetic
caccgctgtcccaaaaggtcaatcattgaaaggatcattgaaaacctcaagacctgaccttaattcaaatggtttcttctgagagttgtatcttccaaagatactacggattctactcttcatatcagcagccagggcct

SEQ ID NO: 369101 - DNA, 140 bp, Artificial Sequence
  Synthetic
aggccctggctgctgatatggacctgcgatgacaacttctttcagaagagaatagaagagttttttttaactggtgaaggtcacttcaatgaagtgctgcagttcaaaacaccaagcacagaccttttgggacagcggtg

SEQ ID NO: 369102 - DNA, 140 bp, Artificial Sequence
  Synthetic
caccgctgtcccaaaaggtctgtgcttggtgttttgaactgcagcacttcattgaagtgaccttcaccagttaaaaaaaactcttctattctcttctgaaagaagttgtcatcgcaggtccatatcagcagccagggcct

SEQ ID NO: 369103 - DNA, 140 bp, Artificial Sequence
  Synthetic
atacgccatgctgggtctccctaagccctacggaacctgctcgtgttgagtcaccgacagtagaaccctttaaatcttactttgctaaaggcttcctctcaatggactcaggttatttctcgtacttgggagtcggccat

SEQ ID NO: 369104 - DNA, 140 bp, Artificial Sequence
  Synthetic
atggccgactcccaagtacgagaaataacctgagtccattgagaggaagcctttagcaaagtaagatttaaagggttctactgtcggtgactcaacacgagcaggttccgtagggcttagggagacccagcatggcgtat

SEQ ID NO: 369105 - DNA, 140 bp, Artificial Sequence
  Synthetic
atacgccatgctgggtctccgtcacccaacatttaattagaataacagacacacctgggcctaagatcactaatctgaaaaccatcaattgcataaacttgaaggcattagtcttcaaagcgtacttgggagtcggccat

SEQ ID NO: 369106 - DNA, 140 bp, Artificial Sequence
  Synthetic
atggccgactcccaagtacgctttgaagactaatgccttcaagtttatgcaattgatggttttcagattagtgatcttaggcccaggtgtgtctgttattctaattaaatgttgggtgacggagacccagcatggcgtat

SEQ ID NO: 369107 - DNA, 140 bp, Artificial Sequence
  Synthetic
atacgccatgctgggtctccctctcaaactgccatgtgctgatcaaatctcatgtttgtgactactctttagacatcgacgggccggtaagactgccccgtatccaccatgaaggaacttcgtacttgggagtcggccat

SEQ ID NO: 369108 - DNA, 140 bp, Artificial Sequence
  Synthetic
atggccgactcccaagtacgaagttccttcatggtggatacggggcagtcttaccggcccgtcgatgtctaaagagtagtcacaaacatgagatttgatcagcacatggcagtttgagagggagacccagcatggcgtat

SEQ ID NO: 369109 - DNA, 140 bp, Artificial Sequence
  Synthetic
atacgccatgctgggtctccgacagatgcactttggtcactaactgtgtgataaaaggaagggaaattcgcaaaggccagtcagtgttaaggcaatacagaacagaaattaagattggcacgtacttgggagtcggccat

SEQ ID NO: 369110 - DNA, 140 bp, Artificial Sequence
  Synthetic
atggccgactcccaagtacgtgccaatcttaatttctgttctgtattgccttaacactgactggcctttgcgaatttcccttccttttatcacacagttagtgaccaaagtgcatctgtcggagacccagcatggcgtat

SEQ ID NO: 369111 - DNA, 140 bp, Artificial Sequence
  Synthetic
atacgccatgctgggtctcctaactggcgtgctatctaaggagctatattcccagtatgatgagacattctggaaacatgcctgcaagctgaaaaacttcacagctgctgtgcagagatgcgtacttgggagtcggccat

SEQ ID NO: 369112 - DNA, 140 bp, Artificial Sequence
  Synthetic
atggccgactcccaagtacgcatctctgcacagcagctgtgaagtttttcagcttgcaggcatgtttccagaatgtctcatcatactgggaatatagctccttagatagcacgccagttaggagacccagcatggcgtat

SEQ ID NO: 369113 - DNA, 140 bp, Artificial Sequence
  Synthetic
atacgccatgctgggtctcccagtacagagagttaaaacctcagacctgtaccatatgtgaaacgaatcctgttaatgcaatagatgctgagatgcacgacctcaactgcagttacaatacgtacttgggagtcggccat

SEQ ID NO: 369114 - DNA, 140 bp, Artificial Sequence
  Synthetic
atggccgactcccaagtacgtattgtaactgcagttgaggtcgtgcatctcagcatctattgcattaacaggattcgtttcacatatggtacaggtctgaggttttaactctctgtactgggagacccagcatggcgtat

SEQ ID NO: 369115 - DNA, 140 bp, Artificial Sequence
  Synthetic
atacgccatgctgggtctccccatggagagacagtcgaagtatatcaaaccagagaagggtacacaagtatttgcctttttgtactaggaagcatcctgtttttggtatcctgcctgatgcgtacttgggagtcggccat

SEQ ID NO: 369116 - DNA, 140 bp, Artificial Sequence
  Synthetic
atggccgactcccaagtacgcatcaggcaggataccaaaaacaggatgcttcctagtacaaaaaggcaaatacttgtgtacccttctctggtttgatatacttcgactgtctctccatggggagacccagcatggcgtat

SEQ ID NO: 369117 - DNA, 140 bp, Artificial Sequence
  Synthetic
atacgccatgctgggtctccaataccaaatggggcccgatacactgctgttctttcttttctggcatgatgcaacaggttctaaaaaatgtaccagattggtgttcattttataaattaacgtacttgggagtcggccat

SEQ ID NO: 369118 - DNA, 140 bp, Artificial Sequence
  Synthetic
atggccgactcccaagtacgttaatttataaaatgaacaccaatctggtacattttttagaacctgttgcatcatgccagaaaagaaagaacagcagtgtatcgggccccatttggtattggagacccagcatggcgtat

SEQ ID NO: 369119 - DNA, 140 bp, Artificial Sequence
  Synthetic
atacgccatgctgggtctcctatgaaattcatcagcacttcaggcagagcaatgagtgcaggcaagattggtaatgtcctatcctatgcacataatctttacttgagtaagtcaagcctacgtacttgggagtcggccat

SEQ ID NO: 369120 - DNA, 140 bp, Artificial Sequence
  Synthetic
atggccgactcccaagtacgtaggcttgacttactcaagtaaagattatgtgcataggataggacattaccaatcttgcctgcactcattgctctgcctgaagtgctgatgaatttcataggagacccagcatggcgtat

SEQ ID NO: 369121 - DNA, 140 bp, Artificial Sequence
  Synthetic
atacgccatgctgggtctcccaagcttctcttttgagctcaataggcctctgtctgaaactgaactacagttcattaaagcactaagtagtctcaagtcaacacaagcctgtgaagtgatcgtacttgggagtcggccat

SEQ ID NO: 369122 - DNA, 140 bp, Artificial Sequence
  Synthetic
atggccgactcccaagtacgatcacttcacaggcttgtgttgacttgagactacttagtgctttaatgaactgtagttcagtttcagacagaggcctattgagctcaaaagagaagcttgggagacccagcatggcgtat

SEQ ID NO: 369123 - DNA, 140 bp, Artificial Sequence
  Synthetic
atacgccatgctgggtctccaatcatgctgcatttgtaaacatgctcaacatcgaaactgattatacaaaaaacttccactttcactctaagagagttacagcacatggagacacaccaccgtacttgggagtcggccat

SEQ ID NO: 369124 - DNA, 140 bp, Artificial Sequence
  Synthetic
atggccgactcccaagtacggtggtgtgtctccatgtgctgtaactctcttagagtgaaagtggaagttttttgtataatcagtttcgatgttgagcatgtttacaaatgcagcatgattggagacccagcatggcgtat

SEQ ID NO: 369125 - DNA, 140 bp, Artificial Sequence
  Synthetic
aggccctggctgctgatatgaaacttccactttcactctaagagagttacagcacatggagacacaccacaattagatttaaaagctagaccaacttatggtgcaggtgaaatcactgtggaccttttgggacagcggtg

SEQ ID NO: 369126 - DNA, 140 bp, Artificial Sequence
  Synthetic
caccgctgtcccaaaaggtccacagtgatttcacctgcaccataagttggtctagcttttaaatctaattgtggtgtgtctccatgtgctgtaactctcttagagtgaaagtggaagtttcatatcagcagccagggcct

SEQ ID NO: 369127 - DNA, 140 bp, Artificial Sequence
  Synthetic
atacgccatgctgggtctccacaaacactgacagcccgaaatgttttacatgggttggctggaggaatcaaggagctttcgcttccaatatatacgatattcatgaaatcttacttctttcgtacttgggagtcggccat

SEQ ID NO: 369128 - DNA, 140 bp, Artificial Sequence
  Synthetic
atggccgactcccaagtacgaaagaagtaagatttcatgaatatcgtatatattggaagcgaaagctccttgattcctccagccaacccatgtaaaacatttcgggctgtcagtgtttgtggagacccagcatggcgtat

SEQ ID NO: 369129 - DNA, 140 bp, Artificial Sequence
  Synthetic
atacgccatgctgggtctccagaagaactagaggcttatttaagtatagacacctcaaagacgatgaagaaatcggttacaggaaaatcattgagaggctaaacaacaaaaaagggaaaacgtacttgggagtcggccat

SEQ ID NO: 369130 - DNA, 140 bp, Artificial Sequence
  Synthetic
atggccgactcccaagtacgttttcccttttttgttgtttagcctctcaatgattttcctgtaaccgatttcttcatcgtctttgaggtgtctatacttaaataagcctctagttcttctggagacccagcatggcgtat

SEQ ID NO: 369131 - DNA, 140 bp, Artificial Sequence
  Synthetic
atacgccatgctgggtctcccacagcatagccgagttaaccatgcccaacaaaacagatcactcatatcacaacatcaaacgcttaaccgagtcggcagcacggaagtattaccaagaggcgtacttgggagtcggccat

SEQ ID NO: 369132 - DNA, 140 bp, Artificial Sequence
  Synthetic
atggccgactcccaagtacgcctcttggtaatacttccgtgctgccgactcggttaagcgtttgatgttgtgatatgagtgatctgttttgttgggcatggttaactcggctatgctgtgggagacccagcatggcgtat

SEQ ID NO: 369133 - DNA, 140 bp, Artificial Sequence
  Synthetic
aggccctggctgctgatatgatgctgtctgacaacgagtggggatctactctagaggcatctatgttggctaaagaaatgggcattactatcatcatttggactgttgctgccagtgatggaccttttgggacagcggtg

SEQ ID NO: 369134 - DNA, 140 bp, Artificial Sequence
  Synthetic
caccgctgtcccaaaaggtccatcactggcagcaacagtccaaatgatgatagtaatgcccatttctttagccaacatagatgcctctagagtagatccccactcgttgtcagacagcatcatatcagcagccagggcct

SEQ ID NO: 369135 - DNA, 140 bp, Artificial Sequence
  Synthetic
atacgccatgctgggtctcccccgattgctcaagtttgtgcctctcaaaaaaggtctagcagtggtgaagattaaaaaacaaattttgacggtgaagaagcaggttgtatttgatgcagacgtacttgggagtcggccat

SEQ ID NO: 369136 - DNA, 140 bp, Artificial Sequence
  Synthetic
atggccgactcccaagtacgtctgcatcaaatacaacctgcttcttcaccgtcaaaatttgttttttaatcttcaccactgctagaccttttttgagaggcacaaacttgagcaatcgggggagacccagcatggcgtat

SEQ ID NO: 369137 - DNA, 140 bp, Artificial Sequence
  Synthetic
aggccctggctgctgatatgcatgttgaacatgctggtagttcagatgattacgcaaagtgtatagtggtgactggcatactgtctaaagagctctactcccagtatgatgagacattttgaccttttgggacagcggtg

SEQ ID NO: 369138 - DNA, 140 bp, Artificial Sequence
  Synthetic
caccgctgtcccaaaaggtcaaaatgtctcatcatactgggagtagagctctttagacagtatgccagtcaccactatacactttgcgtaatcatctgaactaccagcatgttcaacatgcatatcagcagccagggcct

SEQ ID NO: 369139 - DNA, 140 bp, Artificial Sequence
  Synthetic
atacgccatgctgggtctccagatttcctggatcgaacccagttgcatccggagttcagagacctgactcccgacttttcgctcacacaaaaggttcactttaaaagaaatcagataccccgtacttgggagtcggccat

SEQ ID NO: 369140 - DNA, 140 bp, Artificial Sequence
  Synthetic
atggccgactcccaagtacggggtatctgatttcttttaaagtgaaccttttgtgtgagcgaaaagtcgggagtcaggtctctgaactccggatgcaactgggttcgatccaggaaatctggagacccagcatggcgtat

SEQ ID NO: 369141 - DNA, 140 bp, Artificial Sequence
  Synthetic
aggccctggctgctgatatgcgaggagtctgatggtgactgtatatcaagaactcaactattgaggacagagactgcagaaatccacagtgacaactatggtggcccaggtgacaaaatagaccttttgggacagcggtg

SEQ ID NO: 369142 - DNA, 140 bp, Artificial Sequence
  Synthetic
caccgctgtcccaaaaggtctattttgtcacctgggccaccatagttgtcactgtggatttctgcagtctctgtcctcaatagttgagttcttgatatacagtcaccatcagactcctcgcatatcagcagccagggcct

SEQ ID NO: 369143 - DNA, 140 bp, Artificial Sequence
  Synthetic
atacgccatgctgggtctccctctcaaggatatgtccaagccaaagcctgagagagtggtcatggctagaaggtcactaaaccatgctctatccttaatgtttctggacgagatgtcattcgtacttgggagtcggccat

SEQ ID NO: 369144 - DNA, 140 bp, Artificial Sequence
  Synthetic
atggccgactcccaagtacgaatgacatctcgtccagaaacattaaggatagagcatggtttagtgaccttctagccatgaccactctctcaggctttggcttggacatatccttgagagggagacccagcatggcgtat

SEQ ID NO: 369145 - DNA, 140 bp, Artificial Sequence
  Synthetic
atacgccatgctgggtctccggcaggagtgctttgagttcactattctaaaggacaatagcgcaaggctagactacaacaagttgattgaccactgtgtagacatggaaaaaaagagggacgtacttgggagtcggccat

SEQ ID NO: 369146 - DNA, 140 bp, Artificial Sequence
  Synthetic
atggccgactcccaagtacgtccctctttttttccatgtctacacagtggtcaatcaacttgttgtagtctagccttgcgctattgtcctttagaatagtgaactcaaagcactcctgccggagacccagcatggcgtat

SEQ ID NO: 369147 - DNA, 140 bp, Artificial Sequence
  Synthetic
atacgccatgctgggtctccagcggttagagcagtagaagatttaattttaatgttgacaggcaaagcaatcaaacccagtgctgtaacacagtttgtacacgaggacgagcagtgtcaacgtacttgggagtcggccat

SEQ ID NO: 369148 - DNA, 140 bp, Artificial Sequence
  Synthetic
atggccgactcccaagtacgttgacactgctcgtcctcgtgtacaaactgtgttacagcactgggtttgattgctttgcctgtcaacattaaaattaaatcttctactgctctaaccgctggagacccagcatggcgtat

SEQ ID NO: 369149 - DNA, 140 bp, Artificial Sequence
  Synthetic
atacgccatgctgggtctccttaactgatctactttgcaaacctaccagtcctctctttctcaaccatttatttcagtttcatcatcattgttattattttggggtgtggggggaacgatcgtacttgggagtcggccat

SEQ ID NO: 369150 - DNA, 140 bp, Artificial Sequence
  Synthetic
atggccgactcccaagtacgatcgttccccccacaccccaaaataataacaatgatgatgaaactgaaataaatggttgagaaagagaggactggtaggtttgcaaagtagatcagttaaggagacccagcatggcgtat

SEQ ID NO: 369151 - DNA, 140 bp, Artificial Sequence
  Synthetic
atacgccatgctgggtctcctctcaaagaaatacttgcggcacgtcagtacgtaagtgttaactttgagtgagtgacttgagcatcttagatgcagcatgtctttcagcgtcatgtacaccgtacttgggagtcggccat

SEQ ID NO: 369152 - DNA, 140 bp, Artificial Sequence
  Synthetic
atggccgactcccaagtacggtgtacatgacgctgaaagacatgctgcatctaagatgctcaagtcactcactcaaagttaacacttacgtactgacgtgccgcaagtatttctttgagaggagacccagcatggcgtat

SEQ ID NO: 369153 - DNA, 140 bp, Artificial Sequence
  Synthetic
aggccctggctgctgatatggtttagtgaagaagatcagctagagacaaggcaactgttgttggtggaagttggttttcaaactgacatcgatgggaaaataaggacagatcacaagaaggaccttttgggacagcggtg

SEQ ID NO: 369154 - DNA, 140 bp, Artificial Sequence
  Synthetic
caccgctgtcccaaaaggtccttcttgtgatctgtccttattttcccatcgatgtcagtttgaaaaccaacttccaccaacaacagttgccttgtctctagctgatcttcttcactaaaccatatcagcagccagggcct

SEQ ID NO: 369155 - DNA, 140 bp, Artificial Sequence
  Synthetic
atacgccatgctgggtctcctgcatcaagcactgtcgtcgtcgatgtcagcacacagacggtcaaggacacccctatatcaacaacctacacaagtttgcccagtactcccagcgagccacgtacttgggagtcggccat

SEQ ID NO: 369156 - DNA, 140 bp, Artificial Sequence
  Synthetic
atggccgactcccaagtacgtggctcgctgggagtactgggcaaacttgtgtaggttgttgatataggggtgtccttgaccgtctgtgtgctgacatcgacgacgacagtgcttgatgcaggagacccagcatggcgtat

SEQ ID NO: 369157 - DNA, 140 bp, Artificial Sequence
  Synthetic
atacgccatgctgggtctccaaactctccagaaactcacctacagaagtaactgacatagttgttggagctataagtactcaaaaggttagaagttatctaaaggcaggaactgcaacaacgtacttgggagtcggccat

SEQ ID NO: 369158 - DNA, 140 bp, Artificial Sequence
  Synthetic
atggccgactcccaagtacgttgttgcagttcctgcctttagataacttctaaccttttgagtacttatagctccaacaactatgtcagttacttctgtaggtgagtttctggagagtttggagacccagcatggcgtat

SEQ ID NO: 369159 - DNA, 140 bp, Artificial Sequence
  Synthetic
atacgccatgctgggtctccacagcttatgctctcagcacaaccagtaaccccaaacccaatgacctctccagtacagccagctctctctcagagtgacacgtccacggccatccaagatcgtacttgggagtcggccat

SEQ ID NO: 369160 - DNA, 140 bp, Artificial Sequence
  Synthetic
atggccgactcccaagtacgatcttggatggccgtggacgtgtcactctgagagagagctggctgtactggagaggtcattgggtttggggttactggttgtgctgagagcataagctgtggagacccagcatggcgtat

SEQ ID NO: 369161 - DNA, 140 bp, Artificial Sequence
  Synthetic
atacgccatgctgggtctcccacaagtgagaagatgctattgagttggctgagtgaggacatcaaaacatcgagatgtggtgagtgcctctcaagtataaagaaaaccgttgatgaaactcgtacttgggagtcggccat

SEQ ID NO: 369162 - DNA, 140 bp, Artificial Sequence
  Synthetic
atggccgactcccaagtacgagtttcatcaacggttttctttatacttgagaggcactcaccacatctcgatgttttgatgtcctcactcagccaactcaatagcatcttctcacttgtgggagacccagcatggcgtat

SEQ ID NO: 369163 - DNA, 140 bp, Artificial Sequence
  Synthetic
atacgccatgctgggtctcctaatgataccaaagggcaccggagacatcttagttgactgttcaggtggacaacaacatttcttaaaagataatttgattgatcttggatgtcccaatatcgtacttgggagtcggccat

SEQ ID NO: 369164 - DNA, 140 bp, Artificial Sequence
  Synthetic
atggccgactcccaagtacgatattgggacatccaagatcaatcaaattatcttttaagaaatgttgttgtccacctgaacagtcaactaagatgtctccggtgccctttggtatcattaggagacccagcatggcgtat

SEQ ID NO: 369165 - DNA, 140 bp, Artificial Sequence
  Synthetic
atacgccatgctgggtctccagtgccacaggcaaatcctgtgaaatagatagcaccccagtcaaatgcaggcagggtttctgtttgaaaattactcaggagggaaggggccacgtgaagccgtacttgggagtcggccat

SEQ ID NO: 369166 - DNA, 140 bp, Artificial Sequence
  Synthetic
atggccgactcccaagtacggcttcacgtggccccttccctcctgagtaattttcaaacagaaaccctgcctgcatttgactggggtgctatctatttcacaggatttgcctgtggcactggagacccagcatggcgtat

SEQ ID NO: 369167 - DNA, 140 bp, Artificial Sequence
  Synthetic
atacgccatgctgggtctcctcccactattaggcaagatggctatctacatttgtagaatgtcaaatcatcctaaaacgactatgggttttcttttttggtttagctttggttatgtggtcgtacttgggagtcggccat

SEQ ID NO: 369168 - DNA, 140 bp, Artificial Sequence
  Synthetic
atggccgactcccaagtacgaccacataaccaaagctaaaccaaaaaagaaaacccatagtcgttttaggatgatttgacattctacaaatgtagatagccatcttgcctaatagtgggaggagacccagcatggcgtat

SEQ ID NO: 369169 - DNA, 140 bp, Artificial Sequence
  Synthetic
atacgccatgctgggtctcctttgcaaatctgcttaacattgaaaccgactatacaaagactttccatttccactccaaaagagtgacggcccatggagacacaccacagctggacttgacgtacttgggagtcggccat

SEQ ID NO: 369170 - DNA, 140 bp, Artificial Sequence
  Synthetic
atggccgactcccaagtacgtcaagtccagctgtggtgtgtctccatgggccgtcactcttttggagtggaaatggaaagtctttgtatagtcggtttcaatgttaagcagatttgcaaaggagacccagcatggcgtat

SEQ ID NO: 369171 - DNA, 140 bp, Artificial Sequence
  Synthetic
aggccctggctgctgatatggtacaatcagcacctatcggccatggaaagacagttgaaacatatcaaaccagagaaggatacacaagtatttgcctctttgtactaggaagcatcttatgaccttttgggacagcggtg

SEQ ID NO: 369172 - DNA, 140 bp, Artificial Sequence
  Synthetic
caccgctgtcccaaaaggtcataagatgcttcctagtacaaagaggcaaatacttgtgtatccttctctggtttgatatgtttcaactgtctttccatggccgataggtgctgattgtaccatatcagcagccagggcct

SEQ ID NO: 369173 - DNA, 140 bp, Artificial Sequence
  Synthetic
atacgccatgctgggtctccttttttcctggtttgtccatttgtaagacatgttctattggcagtgtaaatggctttgagattgaatctcacaaatgttactgtagcctattttgttgtccgtacttgggagtcggccat

SEQ ID NO: 369174 - DNA, 140 bp, Artificial Sequence
  Synthetic
atggccgactcccaagtacggacaacaaaataggctacagtaacatttgtgagattcaatctcaaagccatttacactgccaatagaacatgtcttacaaatggacaaaccaggaaaaaaggagacccagcatggcgtat

SEQ ID NO: 369175 - DNA, 140 bp, Artificial Sequence
  Synthetic
atacgccatgctgggtctcctgacatttacaatgtgcacatatataataaagaaatggataactttgatgaaggatgtatcagcgtcttggaagaaacagcagaaaggcacatgctttggcgtacttgggagtcggccat

SEQ ID NO: 369176 - DNA, 140 bp, Artificial Sequence
  Synthetic
atggccgactcccaagtacgccaaagcatgtgcctttctgctgtttcttccaagacgctgatacatccttcatcaaagttatccatttctttattatatatgtgcacattgtaaatgtcaggagacccagcatggcgtat

SEQ ID NO: 369177 - DNA, 140 bp, Artificial Sequence
  Synthetic
aggccctggctgctgatatgaggtagatcagagtcaatcatgaagctagaggaaaggacaggaatcagctggaatctaggggtagaagatgcttctgagtctaaattgcttactgtctctgaccttttgggacagcggtg

SEQ ID NO: 369178 - DNA, 140 bp, Artificial Sequence
  Synthetic
caccgctgtcccaaaaggtcagagacagtaagcaatttagactcagaagcatcttctacccctagattccagctgattcctgtcctttcctctagcttcatgattgactctgatctacctcatatcagcagccagggcct

SEQ ID NO: 369179 - DNA, 140 bp, Artificial Sequence
  Synthetic
atacgccatgctgggtctccagaaagcattttgaaagactgtcttcaaatcatacggaaaaaccctagccacacaatgggttcttttgagctgatccaggcaatatcagagttcggcatgcgtacttgggagtcggccat

SEQ ID NO: 369180 - DNA, 140 bp, Artificial Sequence
  Synthetic
atggccgactcccaagtacgcatgccgaactctgatattgcctggatcagctcaaaagaacccattgtgtggctagggtttttccgtatgatttgaagacagtctttcaaaatgctttctggagacccagcatggcgtat

SEQ ID NO: 369181 - DNA, 140 bp, Artificial Sequence
  Synthetic
atacgccatgctgggtctccgcacaaaggaacgataattggtaagcagaacaacacatgcacagctaaagcaagctgttggctagagtcagtcaagagcttcttttatgggctaaagaaccgtacttgggagtcggccat

SEQ ID NO: 369182 - DNA, 140 bp, Artificial Sequence
  Synthetic
atggccgactcccaagtacggttctttagcccataaaagaagctcttgactgactctagccaacagcttgctttagctgtgcatgtgttgttctgcttaccaattatcgttcctttgtgcggagacccagcatggcgtat

SEQ ID NO: 369183 - DNA, 140 bp, Artificial Sequence
  Synthetic
atacgccatgctgggtctcccttgtgctagtatcaccgaccgcacccatatcacactgtcattgcaacaagctacatttaatccgtttcattatatccgcaagcaagctctgcaatgccccgtacttgggagtcggccat

SEQ ID NO: 369184 - DNA, 140 bp, Artificial Sequence
  Synthetic
atggccgactcccaagtacggggcattgcagagcttgcttgcggatataatgaaacggattaaatgtagcttgttgcaatgacagtgtgatatgggtgcggtcggtgatactagcacaagggagacccagcatggcgtat

SEQ ID NO: 369185 - DNA, 140 bp, Artificial Sequence
  Synthetic
atacgccatgctgggtctcctgacggcctcacaaacccacatcttaaagaaacaattcttaatgtgggattggactgtcttgctaacatgcgaaatcttgacggtaagcccataagtgaacgtacttgggagtcggccat

SEQ ID NO: 369186 - DNA, 140 bp, Artificial Sequence
  Synthetic
atggccgactcccaagtacgttcacttatgggcttaccgtcaagatttcgcatgttagcaagacagtccaatcccacattaagaattgtttctttaagatgtgggtttgtgaggccgtcaggagacccagcatggcgtat

SEQ ID NO: 369187 - DNA, 140 bp, Artificial Sequence
  Synthetic
atacgccatgctgggtctcctggtttgaagagttcaaaaaaggaaatggacttgtggacaccttcacaaactcctattccttttgtgagagtgttccaaatttggacaagtttgtgttcccgtacttgggagtcggccat

SEQ ID NO: 369188 - DNA, 140 bp, Artificial Sequence
  Synthetic
atggccgactcccaagtacgggaacacaaacttgtccaaatttggaacactctcacaaaaggaataggagtttgtgaaggtgtccacaagtccatttccttttttgaactcttcaaaccaggagacccagcatggcgtat

SEQ ID NO: 369189 - DNA, 140 bp, Artificial Sequence
  Synthetic
aggccctggctgctgatatgaccacaagtgagaagatgcttttgagttggttgagtgaagacatcaaatcatcgagatgtggtgagtgcctctcaaatataaagaaaaccgttgatgaaagaccttttgggacagcggtg

SEQ ID NO: 369190 - DNA, 140 bp, Artificial Sequence
  Synthetic
caccgctgtcccaaaaggtctttcatcaacggttttctttatatttgagaggcactcaccacatctcgatgatttgatgtcttcactcaaccaactcaaaagcatcttctcacttgtggtcatatcagcagccagggcct

SEQ ID NO: 369191 - DNA, 140 bp, Artificial Sequence
  Synthetic
atacgccatgctgggtctccagcaacatagtgaagaggatctaagaagattgttaacagataatttagacagttgggacgggaacgacacagttaagtttttggttacaacttatataagcgtacttgggagtcggccat

SEQ ID NO: 369192 - DNA, 140 bp, Artificial Sequence
  Synthetic
atggccgactcccaagtacgcttatataagttgtaaccaaaaacttaactgtgtcgttcccgtcccaactgtctaaattatctgttaacaatcttcttagatcctcttcactatgttgctggagacccagcatggcgtat

SEQ ID NO: 369193 - DNA, 140 bp, Artificial Sequence
  Synthetic
atacgccatgctgggtctccgacgtcccgaaaatagaacagcttgccaattaccaacaggctgccttgaaatggaggaaagacataggtttccgtgtcaatgcaaacacagcggctctgacgtacttgggagtcggccat

SEQ ID NO: 369194 - DNA, 140 bp, Artificial Sequence
  Synthetic
atggccgactcccaagtacgtcagagccgctgtgtttgcattgacacggaaacctatgtctttcctccatttcaaggcagcctgttggtaattggcaagctgttctattttcgggacgtcggagacccagcatggcgtat

SEQ ID NO: 369195 - DNA, 140 bp, Artificial Sequence
  Synthetic
atacgccatgctgggtctccccatggggggacatcaacaagtcaggccgttcaggaatagcacttgtcgcaacaggccttgccaagcttgcagagactgaaggaaagggagtatttgacgcgtacttgggagtcggccat

SEQ ID NO: 369196 - DNA, 140 bp, Artificial Sequence
  Synthetic
atggccgactcccaagtacgcgtcaaatactccctttccttcagtctctgcaagcttggcaaggcctgttgcgacaagtgctattcctgaacggcctgacttgttgatgtccccccatggggagacccagcatggcgtat

SEQ ID NO: 369197 - DNA, 140 bp, Artificial Sequence
  Synthetic
aggccctggctgctgatatggagctagcaattttctaccttaagagaagcttacctcagacaacagtacatgttgaacatgctggtagttcagatgattacgcaaagtgtatagtggtgagaccttttgggacagcggtg

SEQ ID NO: 369198 - DNA, 140 bp, Artificial Sequence
  Synthetic
caccgctgtcccaaaaggtctcaccactatacactttgcgtaatcatctgaactaccagcatgttcaacatgtactgttgtctgaggtaagcttctcttaaggtagaaaattgctagctccatatcagcagccagggcct

SEQ ID NO: 369199 - DNA, 140 bp, Artificial Sequence
  Synthetic
atacgccatgctgggtctccaatgctcagtcatgcttattttgcttgcttatataaccttattttattaacctttctctattttctcttgttttaaacacttaaagggctgtgcggcaaccgtacttgggagtcggccat

SEQ ID NO: 369200 - DNA, 140 bp, Artificial Sequence
  Synthetic
atggccgactcccaagtacggttgccgcacagccctttaagtgtttaaaacaagagaaaatagagaaaggttaataaaataaggttatataagcaagcaaaataagcatgactgagcattggagacccagcatggcgtat

SEQ ID NO: 369201 - DNA, 140 bp, Artificial Sequence
  Synthetic
aggccctggctgctgatatgaggcataatgttatttacagcagcagaatggcagactcttgcgattggctaaaggatggtaaaagaagagggaatctagaactagcgaataggatccaatgaccttttgggacagcggtg

SEQ ID NO: 369202 - DNA, 140 bp, Artificial Sequence
  Synthetic
caccgctgtcccaaaaggtcattggatcctattcgctagttctagattccctcttcttttaccatcctttagccaatcgcaagagtctgccattctgctgctgtaaataacattatgcctcatatcagcagccagggcct

SEQ ID NO: 369203 - DNA, 140 bp, Artificial Sequence
  Synthetic
atacgccatgctgggtctccagaaggctcaggggaagtttacacatcctctccgatcaccaccgagagcttgtccctgccagaaaccacaccggagctccctgctacaactggtatagaccgtacttgggagtcggccat

SEQ ID NO: 369204 - DNA, 140 bp, Artificial Sequence
  Synthetic
atggccgactcccaagtacggtctataccagttgtagcagggagctccggtgtggtttctggcagggacaagctctcggtggtgatcggagaggatgtgtaaacttcccctgagccttctggagacccagcatggcgtat

SEQ ID NO: 369205 - DNA, 140 bp, Artificial Sequence
  Synthetic
aggccctggctgctgatatgtgtccctgccagaaaccacaccggagctccctgctacaactggtatagactcttcaagtgcaagtggtgtcgattctagtacgcaagcagccggaggcacgaccttttgggacagcggtg

SEQ ID NO: 369206 - DNA, 140 bp, Artificial Sequence
  Synthetic
caccgctgtcccaaaaggtcgtgcctccggctgcttgcgtactagaatcgacaccacttgcacttgaagagtctataccagttgtagcagggagctccggtgtggtttctggcagggacacatatcagcagccagggcct

SEQ ID NO: 369207 - DNA, 140 bp, Artificial Sequence
  Synthetic
atacgccatgctgggtctccctacaccacaagacacataccatcctgtgagaattctactttcagtcacgggccctgggccagaagaaacatcaacaccttcgggatcaggcaaagagagcgtacttgggagtcggccat

SEQ ID NO: 369208 - DNA, 140 bp, Artificial Sequence
  Synthetic
atggccgactcccaagtacgctctctttgcctgatcccgaaggtgttgatgtttcttctggcccagggcccgtgactgaaagtagaattctcacaggatggtatgtgtcttgtggtgtagggagacccagcatggcgtat

SEQ ID NO: 369209 - DNA, 140 bp, Artificial Sequence
  Synthetic
aggccctggctgctgatatgggccctgggccagaagaaacatcaacaccttcgggatcaggcaaagagagctcagcaactagtagccttcatccaatctccgacagactaccaacccctcgaccttttgggacagcggtg

SEQ ID NO: 369210 - DNA, 140 bp, Artificial Sequence
  Synthetic
caccgctgtcccaaaaggtcgaggggttggtagtctgtcggagattggatgaaggctactagttgctgagctctctttgcctgatcccgaaggtgttgatgtttcttctggcccagggcccatatcagcagccagggcct

SEQ ID NO: 369211 - DNA, 140 bp, Artificial Sequence
  Synthetic
aggccctggctgctgatatgcttgttaggctcacattaccagggaaaactgagaaggagagaagagtcaaacgtaatgtggaatatcttataaaactgatgatgagcatgtcaggcattggaccttttgggacagcggtg

SEQ ID NO: 369212 - DNA, 140 bp, Artificial Sequence
  Synthetic
caccgctgtcccaaaaggtccaatgcctgacatgctcatcatcagttttataagatattccacattacgtttgactcttctctccttctcagttttccctggtaatgtgagcctaacaagcatatcagcagccagggcct

SEQ ID NO: 369213 - DNA, 140 bp, Artificial Sequence
  Synthetic
aggccctggctgctgatatgtttccttaagcaacacaatctagaaatcatggaaacagtgaacctcatattctttgctgctctttcagctccttggtgcttacactacaaagcactagaggaccttttgggacagcggtg

SEQ ID NO: 369214 - DNA, 140 bp, Artificial Sequence
  Synthetic
caccgctgtcccaaaaggtcctctagtgctttgtagtgtaagcaccaaggagctgaaagagcagcaaagaatatgaggttcactgtttccatgatttctagattgtgttgcttaaggaaacatatcagcagccagggcct

SEQ ID NO: 369215 - DNA, 140 bp, Artificial Sequence
  Synthetic
atacgccatgctgggtctcctgccaacagctgaaccttttaagtcctacttcgccaaaggcttcctttcaatagattcaggttactattcagccaaatgttactcaggaacatctaattccgtacttgggagtcggccat

SEQ ID NO: 369216 - DNA, 140 bp, Artificial Sequence
  Synthetic
atggccgactcccaagtacggaattagatgttcctgagtaacatttggctgaatagtaacctgaatctattgaaaggaagcctttggcgaagtaggacttaaaaggttcagctgttggcaggagacccagcatggcgtat

SEQ ID NO: 369217 - DNA, 140 bp, Artificial Sequence
  Synthetic
atacgccatgctgggtctccggaaaagaacggccttagtccagatctgcaacaagttgcaagatactcaaaccatttgaccttgctcagcaggatgattcagcaagcaaagccaactgtgcgtacttgggagtcggccat

SEQ ID NO: 369218 - DNA, 140 bp, Artificial Sequence
  Synthetic
atggccgactcccaagtacgcacagttggctttgcttgctgaatcatcctgctgagcaaggtcaaatggtttgagtatcttgcaacttgttgcagatctggactaaggccgttcttttccggagacccagcatggcgtat

SEQ ID NO: 369219 - DNA, 140 bp, Artificial Sequence
  Synthetic
atacgccatgctgggtctccagggcttcaattgattaatattacccgacattcaactagaatagttgacacacctgggcctaagatcactaatttaaagaccatcaactgcataaacttacgtacttgggagtcggccat

SEQ ID NO: 369220 - DNA, 140 bp, Artificial Sequence
  Synthetic
atggccgactcccaagtacgtaagtttatgcagttgatggtctttaaattagtgatcttaggcccaggtgtgtcaactattctagttgaatgtcgggtaatattaatcaattgaagccctggagacccagcatggcgtat

SEQ ID NO: 369221 - DNA, 140 bp, Artificial Sequence
  Synthetic
aggccctggctgctgatatgatgtctgtgactattctttagacattgacggtacggtgaggcttcctcacatttaccatgaaggagttttcattccaggaacttacaaaatagtgatagagaccttttgggacagcggtg

SEQ ID NO: 369222 - DNA, 140 bp, Artificial Sequence
  Synthetic
caccgctgtcccaaaaggtctctatcactattttgtaagttcctggaatgaaaactccttcatggtaaatgtgaggaagcctcaccgtaccgtcaatgtctaaagaatagtcacagacatcatatcagcagccagggcct

SEQ ID NO: 369223 - DNA, 140 bp, Artificial Sequence
  Synthetic
aggccctggctgctgatatgatttaccatgaaggagttttcattccaggaacttacaaaatagtgatagataaaaaaaataagttgaatgacagatgcaccttatttaccaactgtgtgagaccttttgggacagcggtg

SEQ ID NO: 369224 - DNA, 140 bp, Artificial Sequence
  Synthetic
caccgctgtcccaaaaggtctcacacagttggtaaataaggtgcatctgtcattcaacttattttttttatctatcactattttgtaagttcctggaatgaaaactccttcatggtaaatcatatcagcagccagggcct

SEQ ID NO: 369225 - DNA, 140 bp, Artificial Sequence
  Synthetic
atacgccatgctgggtctcctaaaaggaagggaggttcgtaagggtcagtcagttttgaggcagtacaagacggaaatcaggattggcaaagcatcaaccggctctagaagactgctttccgtacttgggagtcggccat

SEQ ID NO: 369226 - DNA, 140 bp, Artificial Sequence
  Synthetic
atggccgactcccaagtacggaaagcagtcttctagagccggttgatgctttgccaatcctgatttccgtcttgtactgcctcaaaactgactgacccttacgaacctcccttccttttaggagacccagcatggcgtat

SEQ ID NO: 369227 - DNA, 140 bp, Artificial Sequence
  Synthetic
atacgccatgctgggtctccagactgcagagatccacggcgacaactatggtggcccgggtgacaaaataaccatctgcaacggctcaactattgtagaccaaagactgggcagtgagctcgtacttgggagtcggccat

SEQ ID NO: 369228 - DNA, 140 bp, Artificial Sequence
  Synthetic
atggccgactcccaagtacgagctcactgcccagtctttggtctacaatagttgagccgttgcagatggttattttgtcacccgggccaccatagttgtcgccgtggatctctgcagtctggagacccagcatggcgtat

SEQ ID NO: 369229 - DNA, 140 bp, Artificial Sequence
  Synthetic
atacgccatgctgggtctccagggtgttacactatcaatagagtgaagtcattcaagctatgcgaaaatagtgccacagggaagagctgtgaaatagacagtgtcccagttaaatgcaggcgtacttgggagtcggccat

SEQ ID NO: 369230 - DNA, 140 bp, Artificial Sequence
  Synthetic
atggccgactcccaagtacgcctgcatttaactgggacactgtctatttcacagctcttccctgtggcactattttcgcatagcttgaatgacttcactctattgatagtgtaacaccctggagacccagcatggcgtat

SEQ ID NO: 369231 - DNA, 140 bp, Artificial Sequence
  Synthetic
atacgccatgctgggtctccgtgctctcttggatgagcaagaggaggactgaggtaataactaaagaacagcaccaactgtttctaagtcttctcccacaatcacatgagtgtttacaaacgtacttgggagtcggccat

SEQ ID NO: 369232 - DNA, 140 bp, Artificial Sequence
  Synthetic
atggccgactcccaagtacgtttgtaaacactcatgtgattgtgggagaagacttagaaacagttggtgctgttctttagttattacctcagtcctcctcttgctcatccaagagagcacggagacccagcatggcgtat

SEQ ID NO: 369233 - DNA, 140 bp, Artificial Sequence
  Synthetic
atacgccatgctgggtctcccagggttattgcctaagaatcactcaggaagggaggggccatgtaaaattatctaggggctcagaggttgtcttagatgcatgcgatacaagctgtgaaacgtacttgggagtcggccat

SEQ ID NO: 369234 - DNA, 140 bp, Artificial Sequence
  Synthetic
atggccgactcccaagtacgtttcacagcttgtatcgcatgcatctaagacaacctctgagcccctagataattttacatggcccctcccttcctgagtgattcttaggcaataaccctgggagacccagcatggcgtat

SEQ ID NO: 369235 - DNA, 140 bp, Artificial Sequence
  Synthetic
aggccctggctgctgatatgatctaggggctcagaggttgtcttagatgcatgcgatacaagctgtgaaataatgatacctaagggcactggtgacatcctagttgactgttcaggtggggaccttttgggacagcggtg

SEQ ID NO: 369236 - DNA, 140 bp, Artificial Sequence
  Synthetic
caccgctgtcccaaaaggtccccacctgaacagtcaactaggatgtcaccagtgcccttaggtatcattatttcacagcttgtatcgcatgcatctaagacaacctctgagcccctagatcatatcagcagccagggcct

SEQ ID NO: 369237 - DNA, 140 bp, Artificial Sequence
  Synthetic
atacgccatgctgggtctcctaatgatacctaagggcactggtgacatcctagttgactgttcaggtgggcagcaacattttctaaaggacaatttgatagatctaggatgccccaaaatcgtacttgggagtcggccat

SEQ ID NO: 369238 - DNA, 140 bp, Artificial Sequence
  Synthetic
atggccgactcccaagtacgattttggggcatcctagatctatcaaattgtcctttagaaaatgttgctgcccacctgaacagtcaactaggatgtcaccagtgcccttaggtatcattaggagacccagcatggcgtat

SEQ ID NO: 369239 - DNA, 140 bp, Artificial Sequence
  Synthetic
aggccctggctgctgatatgttcaacaatgtacttgttaacattgacagaaacacggtgaaaagtgaactcttatggaaatttacgttagacaccaatgtaagcaccacaagtactataagaccttttgggacagcggtg

SEQ ID NO: 369240 - DNA, 140 bp, Artificial Sequence
  Synthetic
caccgctgtcccaaaaggtcttatagtacttgtggtgcttacattggtgtctaacgtaaatttccataagagttcacttttcaccgtgtttctgtcaatgttaacaagtacattgttgaacatatcagcagccagggcct

SEQ ID NO: 369241 - DNA, 140 bp, Artificial Sequence
  Synthetic
atacgccatgctgggtctcccgaaaagatactgtttgacctgaaggtacccactaaagacgaagaagtgcttataaacatcagaaactcattgaaagctagatccgagtttgttagaaatcgtacttgggagtcggccat

SEQ ID NO: 369242 - DNA, 140 bp, Artificial Sequence
  Synthetic
atggccgactcccaagtacgatttctaacaaactcggatctagctttcaatgagtttctgatgtttataagcacttcttcgtctttagtgggtaccttcaggtcaaacagtatcttttcgggagacccagcatggcgtat

SEQ ID NO: 369243 - DNA, 140 bp, Artificial Sequence
  Synthetic
atacgccatgctgggtctccgcatctgcaaaaaaagaaaaacaggaagtaatgtcatgttggctgtctgcaagcgcatgtgtttcagggccaccatggaagtaagtaacagagccctgttcgtacttgggagtcggccat

SEQ ID NO: 369244 - DNA, 140 bp, Artificial Sequence
  Synthetic
atggccgactcccaagtacgaacagggctctgttacttacttccatggtggccctgaaacacatgcgcttgcagacagccaacatgacattacttcctgtttttctttttttgcagatgcggagacccagcatggcgtat

SEQ ID NO: 369245 - DNA, 140 bp, Artificial Sequence
  Synthetic
atacgccatgctgggtctccaattcaacaagtttagaaacaagtttatcaattgaggcaccatggggggcaataaatgttcagtcaacctacaaaccaactgtgtcaactgcaaacatagcgtacttgggagtcggccat

SEQ ID NO: 369246 - DNA, 140 bp, Artificial Sequence
  Synthetic
atggccgactcccaagtacgctatgtttgcagttgacacagttggtttgtaggttgactgaacatttattgccccccatggtgcctcaattgataaacttgtttctaaacttgttgaattggagacccagcatggcgtat

SEQ ID NO: 369247 - DNA, 140 bp, Artificial Sequence
  Synthetic
atacgccatgctgggtctccactcaagaaattggaggtgcaatcccacttggtgctggggtgtagggactggctgcacctgttgtggattagatgtgaaggacctttttacagattatatcgtacttgggagtcggccat

SEQ ID NO: 369248 - DNA, 140 bp, Artificial Sequence
  Synthetic
atggccgactcccaagtacgatataatctgtaaaaaggtccttcacatctaatccacaacaggtgcagccagtccctacaccccagcaccaagtgggattgcacctccaatttcttgagtggagacccagcatggcgtat

SEQ ID NO: 369249 - DNA, 140 bp, Artificial Sequence
  Synthetic
aggccctggctgctgatatgccactccaaaagagtgacggcccatggagacacaccacagctggacttgaaggcaaggcctaggtatggtgcaggtgaaatcactgttctggttgaagtagaccttttgggacagcggtg

SEQ ID NO: 369250 - DNA, 140 bp, Artificial Sequence
  Synthetic
caccgctgtcccaaaaggtctacttcaaccagaacagtgatttcacctgcaccatacctaggccttgccttcaagtccagctgtggtgtgtctccatgggccgtcactcttttggagtggcatatcagcagccagggcct

SEQ ID NO: 369251 - DNA, 140 bp, Artificial Sequence
  Synthetic
atacgccatgctgggtctccctcaaagaaatacttgcggcacgtcagtacgtaagtgttaactttgagtgagtggcttgagcattttggattcagcatgcccgtcaacattatgtacacacgtacttgggagtcggccat

SEQ ID NO: 369252 - DNA, 140 bp, Artificial Sequence
  Synthetic
atggccgactcccaagtacgtgtgtacataatgttgacgggcatgctgaatccaaaatgctcaagccactcactcaaagttaacacttacgtactgacgtgccgcaagtatttctttgagggagacccagcatggcgtat

SEQ ID NO: 369253 - DNA, 140 bp, Artificial Sequence
  Synthetic
atacgccatgctgggtctccccaacagaagctccctcctgaaataatcacactgcatcccaggatcgaagaaggtttttttgacctgatgcatgtacagaaagtgttatcggcaagcacacgtacttgggagtcggccat

SEQ ID NO: 369254 - DNA, 140 bp, Artificial Sequence
  Synthetic
atggccgactcccaagtacgtgtgcttgccgataacactttctgtacatgcatcaggtcaaaaaaaccttcttcgatcctgggatgcagtgtgattatttcaggagggagcttctgttggggagacccagcatggcgtat

SEQ ID NO: 369255 - DNA, 140 bp, Artificial Sequence
  Synthetic
aggccctggctgctgatatgaaggtttttttgacctgatgcatgtacagaaagtgttatcggcaagcacagtgtgtaagttgcagagttgcacacatggtgtgccaggagacctacaggtgaccttttgggacagcggtg

SEQ ID NO: 369256 - DNA, 140 bp, Artificial Sequence
  Synthetic
caccgctgtcccaaaaggtcacctgtaggtctcctggcacaccatgtgtgcaactctgcaacttacacactgtgcttgccgataacactttctgtacatgcatcaggtcaaaaaaaccttcatatcagcagccagggcct

SEQ ID NO: 369257 - DNA, 140 bp, Artificial Sequence
  Synthetic
atacgccatgctgggtctccttgaaactgattacacaaaaaacttccactttcactctaaaagggtcactgcacacggagacacaccacaactagatcttaaggcaagaccaacctatggcgtacttgggagtcggccat

SEQ ID NO: 369258 - DNA, 140 bp, Artificial Sequence
  Synthetic
atggccgactcccaagtacgccataggttggtcttgccttaagatctagttgtggtgtgtctccgtgtgcagtgacccttttagagtgaaagtggaagttttttgtgtaatcagtttcaaggagacccagcatggcgtat

SEQ ID NO: 369259 - DNA, 140 bp, Artificial Sequence
  Synthetic
atacgccatgctgggtctccgagttgctggttagagtcagtcaaaagttttttttatggtctaaagaacatgcttagtggcatttttggaaatgtttttataggtattttcttgttccttcgtacttgggagtcggccat

SEQ ID NO: 369260 - DNA, 140 bp, Artificial Sequence
  Synthetic
atggccgactcccaagtacgaaggaacaagaaaatacctataaaaacatttccaaaaatgccactaagcatgttctttagaccataaaaaaaacttttgactgactctaaccagcaactcggagacccagcatggcgtat

SEQ ID NO: 369261 - DNA, 140 bp, Artificial Sequence
  Synthetic
atacgccatgctgggtctccgcccccttcatcctgttaatactgttctttatgtttgggtggaggatcctattttgctttaaatgttgcagaagaactagaggcctgttcaagtatagaccgtacttgggagtcggccat

SEQ ID NO: 369262 - DNA, 140 bp, Artificial Sequence
  Synthetic
atggccgactcccaagtacggtctatacttgaacaggcctctagttcttctgcaacatttaaagcaaaataggatcctccacccaaacataaagaacagtattaacaggatgaagggggcggagacccagcatggcgtat

SEQ ID NO: 369263 - DNA, 140 bp, Artificial Sequence
  Synthetic
atacgccatgctgggtctcctttttccctggtttgtccatttgtaagacatgttctattggcagcataaatggctttgagactgaatctcacaaatgttactgtagcctattttgttgcccgtacttgggagtcggccat

SEQ ID NO: 369264 - DNA, 140 bp, Artificial Sequence
  Synthetic
atggccgactcccaagtacgggcaacaaaataggctacagtaacatttgtgagattcagtctcaaagccatttatgctgccaatagaacatgtcttacaaatggacaaaccagggaaaaaggagacccagcatggcgtat

SEQ ID NO: 369265 - DNA, 140 bp, Artificial Sequence
  Synthetic
aggccctggctgctgatatgaagctggttaagataaggcactgtgacattaacctatcagtcaaactgccatcaaataaaaaagagaatatgttatgttgtctatatagtggcaacatgggaccttttgggacagcggtg

SEQ ID NO: 369266 - DNA, 140 bp, Artificial Sequence
  Synthetic
caccgctgtcccaaaaggtcccatgttgccactatatagacaacataacatattctcttttttatttgatggcagtttgactgataggttaatgtcacagtgccttatcttaaccagcttcatatcagcagccagggcct

SEQ ID NO: 369267 - DNA, 140 bp, Artificial Sequence
  Synthetic
atacgccatgctgggtctccatgctgacatctttagttgcatcactactacattatcatcacaatatactgcatttaatctgcttcattgtatctatgaacagactctataatgcttgatcgtacttgggagtcggccat

SEQ ID NO: 369268 - DNA, 140 bp, Artificial Sequence
  Synthetic
atggccgactcccaagtacgatcaagcattatagagtctgttcatagatacaatgaagcagattaaatgcagtatattgtgatgataatgtagtagtgatgcaactaaagatgtcagcatggagacccagcatggcgtat

SEQ ID NO: 369269 - DNA, 140 bp, Artificial Sequence
  Synthetic
aggccctggctgctgatatggcatttaatctgcttcattgtatctatgaacagactctataatgcttgatactgcctttgctctatttactctgacctaaatcttgactgcgtgccgccagaccttttgggacagcggtg

SEQ ID NO: 369270 - DNA, 140 bp, Artificial Sequence
  Synthetic
caccgctgtcccaaaaggtctggcggcacgcagtcaagatttaggtcagagtaaatagagcaaaggcagtatcaagcattatagagtctgttcatagatacaatgaagcagattaaatgccatatcagcagccagggcct

SEQ ID NO: 369271 - DNA, 140 bp, Artificial Sequence
  Synthetic
atacgccatgctgggtctccctcaaagatatcaatccccccgttacccacattaatacagagagctccagtagcagtctttgtctgtgcgaagccatggacttcttgagaaaccttgattcgtacttgggagtcggccat

SEQ ID NO: 369272 - DNA, 140 bp, Artificial Sequence
  Synthetic
atggccgactcccaagtacgaatcaaggtttctcaagaagtccatggcttcgcacagacaaagactgctactggagctctctgtattaatgtgggtaacggggggattgatatctttgagggagacccagcatggcgtat

SEQ ID NO: 369273 - DNA, 140 bp, Artificial Sequence
  Synthetic
aggccctggctgctgatatgggactcaagtgattgccggtcaatatgtgtccaaccctaggttcaacatttctgactacttcgagattgtgcggcagcctggtgatgggaactgcttctagaccttttgggacagcggtg

SEQ ID NO: 369274 - DNA, 140 bp, Artificial Sequence
  Synthetic
caccgctgtcccaaaaggtctagaagcagttcccatcaccaggctgccgcacaatctcgaagtagtcagaaatgttgaacctagggttggacacatattgaccggcaatcacttgagtcccatatcagcagccagggcct

SEQ ID NO: 369275 - DNA, 140 bp, Artificial Sequence
  Synthetic
atacgccatgctgggtctcctcacagcatagctgagttaaccatgcccaacaaaacagatcactcatatcataacatcaaacgcctaaccgagtcggcagcgcggaagtattaccaagagcgtacttgggagtcggccat

SEQ ID NO: 369276 - DNA, 140 bp, Artificial Sequence
  Synthetic
atggccgactcccaagtacgctcttggtaatacttccgcgctgccgactcggttaggcgtttgatgttatgatatgagtgatctgttttgttgggcatggttaactcagctatgctgtgaggagacccagcatggcgtat

SEQ ID NO: 369277 - DNA, 140 bp, Artificial Sequence
  Synthetic
atacgccatgctgggtctccgatgctgtctgacaacgagtggggatcaactctagaggcatctatgttggctaaagaaatgggcattaccatcatcatttggactgttgctgccagtgatcgtacttgggagtcggccat

SEQ ID NO: 369278 - DNA, 140 bp, Artificial Sequence
  Synthetic
atggccgactcccaagtacgatcactggcagcaacagtccaaatgatgatggtaatgcccatttctttagccaacatagatgcctctagagttgatccccactcgttgtcagacagcatcggagacccagcatggcgtat

SEQ ID NO: 369279 - DNA, 140 bp, Artificial Sequence
  Synthetic
atacgccatgctgggtctccctaaagaaatgggcattaccatcatcatttggactgttgctgccagtgatgaagtggaggcaggtataaagttcggagacggtgatgtgtttacagccgtcgtacttgggagtcggccat

SEQ ID NO: 369280 - DNA, 140 bp, Artificial Sequence
  Synthetic
atggccgactcccaagtacgacggctgtaaacacatcaccgtctccgaactttatacctgcctccacttcatcactggcagcaacagtccaaatgatgatggtaatgcccatttctttagggagacccagcatggcgtat

SEQ ID NO: 369281 - DNA, 140 bp, Artificial Sequence
  Synthetic
atacgccatgctgggtctcccacagtttgaaacagacaagagagaggccttgagtttgatggacagggttatagctgtagatcagttgacatcatcttccagtgatgagctgcaagattacgtacttgggagtcggccat

SEQ ID NO: 369282 - DNA, 140 bp, Artificial Sequence
  Synthetic
atggccgactcccaagtacgtaatcttgcagctcatcactggaagatgatgtcaactgatctacagctataaccctgtccatcaaactcaaggcctctctcttgtctgtttcaaactgtgggagacccagcatggcgtat

SEQ ID NO: 369283 - DNA, 140 bp, Artificial Sequence
  Synthetic
atacgccatgctgggtctcctgaagaccttgccttggcactcacaagcacagaagaatcgtatagacggtcgagcttggatgaggttacattgtccaaaaaacaagcagagatattaaggcgtacttgggagtcggccat

SEQ ID NO: 369284 - DNA, 140 bp, Artificial Sequence
  Synthetic
atggccgactcccaagtacgccttaatatctctgcttgttttttggacaatgtaacctcatccaagctcgaccgtctatacgattcttctgtgcttgtgagtgccaaggcaaggtcttcaggagacccagcatggcgtat

SEQ ID NO: 369285 - DNA, 140 bp, Artificial Sequence
  Synthetic
aggccctggctgctgatatgtcgaacttactagccaagaaagacaatgtagcttgattgaagcaggcacaagattcaatttaggtcctgtgactatcacattgtcagagccaagaaacatgaccttttgggacagcggtg

SEQ ID NO: 369286 - DNA, 140 bp, Artificial Sequence
  Synthetic
caccgctgtcccaaaaggtcatgtttcttggctctgacaatgtgatagtcacaggacctaaattgaatcttgtgcctgcttcaatcaagctacattgtctttcttggctagtaagttcgacatatcagcagccagggcct

SEQ ID NO: 369287 - DNA, 140 bp, Artificial Sequence
  Synthetic
atacgccatgctgggtctccgaccagagtcggaagggtcttggactgcatgttcaactgtaaattatgtgttgagatatcagctgacactttaattctaaggccagaatcaaaagagaaacgtacttgggagtcggccat

SEQ ID NO: 369288 - DNA, 140 bp, Artificial Sequence
  Synthetic
atggccgactcccaagtacgtttctcttttgattctggccttagaattaaagtgtcagctgatatctcaacacataatttacagttgaacatgcagtccaagacccttccgactctggtcggagacccagcatggcgtat

SEQ ID NO: 369289 - DNA, 140 bp, Artificial Sequence
  Synthetic
aggccctggctgctgatatgttgagatatcagctgacactttaattctaaggccagaatcaaaagagaaaattggtgaaatcatgtcactgcggcagctagggcacaagctgctgacacggaccttttgggacagcggtg

SEQ ID NO: 369290 - DNA, 140 bp, Artificial Sequence
  Synthetic
caccgctgtcccaaaaggtccgtgtcagcagcttgtgccctagctgccgcagtgacatgatttcaccaattttctcttttgattctggccttagaattaaagtgtcagctgatatctcaacatatcagcagccagggcct

SEQ ID NO: 369291 - DNA, 140 bp, Artificial Sequence
  Synthetic
atacgccatgctgggtctccaagatttgctagaccatctggatgttggtggacttttgagagctgctttccctggaacaggaatagaaaggcatatgcagctgctacactctgagatgatcgtacttgggagtcggccat

SEQ ID NO: 369292 - DNA, 140 bp, Artificial Sequence
  Synthetic
atggccgactcccaagtacgatcatctcagagtgtagcagctgcatatgcctttctattcctgttccagggaaagcagctctcaaaagtccaccaacatccagatggtctagcaaatcttggagacccagcatggcgtat

SEQ ID NO: 369293 - DNA, 140 bp, Artificial Sequence
  Synthetic
aggccctggctgctgatatgatggctccaacaataaaaacaagaagaaattcatcaccaactgtctgctcagtacagctctgtctggaaagaaggtgtacaaggttcttggtaacctagggaccttttgggacagcggtg

SEQ ID NO: 369294 - DNA, 140 bp, Artificial Sequence
  Synthetic
caccgctgtcccaaaaggtccctaggttaccaagaaccttgtacaccttctttccagacagagctgtactgagcagacagttggtgatgaatttcttcttgtttttattgttggagccatcatatcagcagccagggcct

SEQ ID NO: 369295 - DNA, 140 bp, Artificial Sequence
  Synthetic
aggccctggctgctgatatgagtacagctctgtctggaaagaaggtgtacaaggttcttggtaacctaggaaatgaactgttatacaaggcacccagaaaggccttagcaactgtctgtagaccttttgggacagcggtg

SEQ ID NO: 369296 - DNA, 140 bp, Artificial Sequence
  Synthetic
caccgctgtcccaaaaggtctacagacagttgctaaggcctttctgggtgccttgtataacagttcatttcctaggttaccaagaaccttgtacaccttctttccagacagagctgtactcatatcagcagccagggcct

SEQ ID NO: 369297 - DNA, 140 bp, Artificial Sequence
  Synthetic
atacgccatgctgggtctccaaatgaactgttatacaaggcacccagaaaggccttagcaactgtctgtagtgccttgtttggaaagcagataaacaaacttcagaactgcttcaggacccgtacttgggagtcggccat

SEQ ID NO: 369298 - DNA, 140 bp, Artificial Sequence
  Synthetic
atggccgactcccaagtacgggtcctgaagcagttctgaagtttgtttatctgctttccaaacaaggcactacagacagttgctaaggcctttctgggtgccttgtataacagttcatttggagacccagcatggcgtat

SEQ ID NO: 369299 - DNA, 140 bp, Artificial Sequence
  Synthetic
atacgccatgctgggtctccataagccctgttagcttacttgctttaagaaatctagattttgactgtctcagtgtacaggactataacggtatgatagaaaatatgtctaaattagacacgtacttgggagtcggccat

SEQ ID NO: 369300 - DNA, 140 bp, Artificial Sequence
  Synthetic
atggccgactcccaagtacgtgtctaatttagacatattttctatcataccgttatagtcctgtacactgagacagtcaaaatctagatttcttaaagcaagtaagctaacagggcttatggagacccagcatggcgtat

SEQ ID NO: 369301 - DNA, 140 bp, Artificial Sequence
  Synthetic
atacgccatgctgggtctccacttctcggctcattacattaagaaaggagaaagacactgaccttctcagacaatggtatcctgaaagtgacctcacccgcagaagtactaggaatgctgcgtacttgggagtcggccat

SEQ ID NO: 369302 - DNA, 140 bp, Artificial Sequence
  Synthetic
atggccgactcccaagtacgcagcattcctagtacttctgcgggtgaggtcactttcaggataccattgtctgagaaggtcagtgtctttctcctttcttaatgtaatgagccgagaagtggagacccagcatggcgtat

SEQ ID NO: 369303 - DNA, 140 bp, Artificial Sequence
  Synthetic
aggccctggctgctgatatgacaatggtatcctgaaagtgacctcacccgcagaagtactaggaatgctgcaaacgcggaggaatttgtcatatccgagttcttcaagaagaaggatattgaccttttgggacagcggtg

SEQ ID NO: 369304 - DNA, 140 bp, Artificial Sequence
  Synthetic
caccgctgtcccaaaaggtcaatatccttcttcttgaagaactcggatatgacaaattcctccgcgtttgcagcattcctagtacttctgcgggtgaggtcactttcaggataccattgtcatatcagcagccagggcct

SEQ ID NO: 369305 - DNA, 140 bp, Artificial Sequence
  Synthetic
aggccctggctgctgatatgacttttgctcttgaaggtaggtttgaagaatcatataaaatacgaacctcaaggtgcagagccagtgggaattttctgaacaggagcagtagagaccactgaccttttgggacagcggtg

SEQ ID NO: 369306 - DNA, 140 bp, Artificial Sequence
  Synthetic
caccgctgtcccaaaaggtcagtggtctctactgctcctgttcagaaaattcccactggctctgcaccttgaggttcgtattttatatgattcttcaaacctaccttcaagagcaaaagtcatatcagcagccagggcct

SEQ ID NO: 369307 - DNA, 140 bp, Artificial Sequence
  Synthetic
atacgccatgctgggtctcctaatgtcctttcctatgcccataatctttatctgagtaagtcaagcctgaatatgacctctgaagacatctcacagcttctgatcgagatcaagcggttgcgtacttgggagtcggccat

SEQ ID NO: 369308 - DNA, 140 bp, Artificial Sequence
  Synthetic
atggccgactcccaagtacgcaaccgcttgatctcgatcagaagctgtgagatgtcttcagaggtcatattcaggcttgacttactcagataaagattatgggcataggaaaggacattaggagacccagcatggcgtat

SEQ ID NO: 369309 - DNA, 140 bp, Artificial Sequence
  Synthetic
atacgccatgctgggtctcctggcatagaaagcaacatgaaacagctgtttgctatactgcctcccgactgcgcaagagagtgtgaggtcctctttgatgacataagaaactctccaacgcgtacttgggagtcggccat

SEQ ID NO: 369310 - DNA, 140 bp, Artificial Sequence
  Synthetic
atggccgactcccaagtacgcgttggagagtttcttatgtcatcaaagaggacctcacactctcttgcgcagtcgggaggcagtatagcaaacagctgtttcatgttgctttctatgccaggagacccagcatggcgtat

SEQ ID NO: 369311 - DNA, 140 bp, Artificial Sequence
  Synthetic
aggccctggctgctgatatggcgcaagagagtgtgaggtcctctttgatgacataagaaactctccaacgcacagcacagcttggaagcatgcactccggttgaaagggactgcatacgagaccttttgggacagcggtg

SEQ ID NO: 369312 - DNA, 140 bp, Artificial Sequence
  Synthetic
caccgctgtcccaaaaggtctcgtatgcagtccctttcaaccggagtgcatgcttccaagctgtgctgtgcgttggagagtttcttatgtcatcaaagaggacctcacactctcttgcgccatatcagcagccagggcct

SEQ ID NO: 369313 - DNA, 140 bp, Artificial Sequence
  Synthetic
atacgccatgctgggtctccaaccaagcctgaccatgctgatacagactttgtttcctgacaagtttgaagacttcctggatcgaactcagttgcatccagagttcagggacctaactcccgtacttgggagtcggccat

SEQ ID NO: 369314 - DNA, 140 bp, Artificial Sequence
  Synthetic
atggccgactcccaagtacgggagttaggtccctgaactctggatgcaactgagttcgatccaggaagtcttcaaacttgtcaggaaacaaagtctgtatcagcatggtcaggcttggttggagacccagcatggcgtat

SEQ ID NO: 369315 - DNA, 140 bp, Artificial Sequence
  Synthetic
aggccctggctgctgatatggacttcctggatcgaactcagttgcatccagagttcagggacctaactcccgacttctcgctcacacaaaaagttcacttcaagagaaatcaaatacctagaccttttgggacagcggtg

SEQ ID NO: 369316 - DNA, 140 bp, Artificial Sequence
  Synthetic
caccgctgtcccaaaaggtctaggtatttgatttctcttgaagtgaactttttgtgtgagcgagaagtcgggagttaggtccctgaactctggatgcaactgagttcgatccaggaagtccatatcagcagccagggcct

SEQ ID NO: 369317 - DNA, 140 bp, Artificial Sequence
  Synthetic
atacgccatgctgggtctccgaggcagtgccggtgacagaaagaaagatgttccctcttcctgagactccgctaagcgaagtgcattcaatagagcgtataatggaaaattttacccgcccgtacttgggagtcggccat

SEQ ID NO: 369318 - DNA, 140 bp, Artificial Sequence
  Synthetic
atggccgactcccaagtacgggcgggtaaaattttccattatacgctctattgaatgcacttcgcttagcggagtctcaggaagagggaacatctttctttctgtcaccggcactgcctcggagacccagcatggcgtat

SEQ ID NO: 369319 - DNA, 140 bp, Artificial Sequence
  Synthetic
atacgccatgctgggtctccgaacaaggcagccagcaaagcaccactgaatacaagggctccagcatctctgccttcaaggactacggagagagaggaatagtcgaagaaaaccacatgacgtacttgggagtcggccat

SEQ ID NO: 369320 - DNA, 140 bp, Artificial Sequence
  Synthetic
atggccgactcccaagtacgtcatgtggttttcttcgactattcctctctctccgtagtccttgaaggcagagatgctggagcccttgtattcagtggtgctttgctggctgccttgttcggagacccagcatggcgtat

SEQ ID NO: 369321 - DNA, 140 bp, Artificial Sequence
  Synthetic
atacgccatgctgggtctccgtggaaagatatattgaagctgttagagctattaggaataaaatgctcattcatcgcctgtgcagactgctcatctacaccaccagacagatggtggattcgtacttgggagtcggccat

SEQ ID NO: 369322 - DNA, 140 bp, Artificial Sequence
  Synthetic
atggccgactcccaagtacgaatccaccatctgtctggtggtgtagatgagcagtctgcacaggcgatgaatgagcattttattcctaatagctctaacagcttcaatatatctttccacggagacccagcatggcgtat

SEQ ID NO: 369323 - DNA, 140 bp, Artificial Sequence
  Synthetic
aggccctggctgctgatatgctataagtactcaaaaggttagaagttatctaaaggcaggaactgcaacaaaaactcccgtgtcgacaaaagacgttctggagacttgggaaaagatgaagaccttttgggacagcggtg

SEQ ID NO: 369324 - DNA, 140 bp, Artificial Sequence
  Synthetic
caccgctgtcccaaaaggtcttcatcttttcccaagtctccagaacgtcttttgtcgacacgggagtttttgttgcagttcctgcctttagataacttctaaccttttgagtacttatagcatatcagcagccagggcct

SEQ ID NO: 369325 - DNA, 140 bp, Artificial Sequence
  Synthetic
atacgccatgctgggtctccggagtatatactcaacagaccaacaggattgacactgcccaccggtttggaacaggcaatgcgcaaaggattggtcgaaggtgtggtcatctctaaggaacgtacttgggagtcggccat

SEQ ID NO: 369326 - DNA, 140 bp, Artificial Sequence
  Synthetic
atggccgactcccaagtacgttccttagagatgaccacaccttcgaccaatcctttgcgcattgcctgttccaaaccggtgggcagtgtcaatcctgttggtctgttgagtatatactccggagacccagcatggcgtat

SEQ ID NO: 369327 - DNA, 140 bp, Artificial Sequence
  Synthetic
atacgccatgctgggtctccttgtgttaacatcattaattgtgcccacaccatgtcgtcatcgtaatgtgtcatattctacctacttcattatattcgtaatgcttgaaactgctattgccgtacttgggagtcggccat

SEQ ID NO: 369328 - DNA, 140 bp, Artificial Sequence
  Synthetic
atggccgactcccaagtacggcaatagcagtttcaagcattacgaatataatgaagtaggtagaatatgacacattacgatgacgacatggtgtgggcacaattaatgatgttaacacaaggagacccagcatggcgtat

SEQ ID NO: 369329 - DNA, 140 bp, Artificial Sequence
  Synthetic
atacgccatgctgggtctccggttccgaatcatgcatcaatatgttgaaagagaatttggaccgaataactgatgaattcgagcgaacaaagtttaaacatgaactcacacagaatattacgtacttgggagtcggccat

SEQ ID NO: 369330 - DNA, 140 bp, Artificial Sequence
  Synthetic
atggccgactcccaagtacgtaatattctgtgtgagttcatgtttaaactttgttcgctcgaattcatcagttattcggtccaaattctctttcaacatattgatgcatgattcggaaccggagacccagcatggcgtat

SEQ ID NO: 369331 - DNA, 140 bp, Artificial Sequence
  Synthetic
aggccctggctgctgatatgtcaaagatatcaatccccccgttacccacgtttacacagagagctccagtagtggtctttgcctttgcgaaaccatgaacttcttgagaaatcttgactggaccttttgggacagcggtg

SEQ ID NO: 369332 - DNA, 140 bp, Artificial Sequence
  Synthetic
caccgctgtcccaaaaggtccagtcaagatttctcaagaagttcatggtttcgcaaaggcaaagaccactactggagctctctgtgtaaacgtgggtaacggggggattgatatctttgacatatcagcagccagggcct

SEQ ID NO: 369333 - DNA, 140 bp, Artificial Sequence
  Synthetic
atacgccatgctgggtctcctcgagatgtggtgaatgcctcacaaacataaagaaaaccgttgatgaaactgctaacctatcagaaaagattgagctgcttgcttataatctgcagctcacgtacttgggagtcggccat

SEQ ID NO: 369334 - DNA, 140 bp, Artificial Sequence
  Synthetic
atggccgactcccaagtacgtgagctgcagattataagcaagcagctcaatcttttctgataggttagcagtttcatcaacggttttctttatgtttgtgaggcattcaccacatctcgaggagacccagcatggcgtat

SEQ ID NO: 369335 - DNA, 140 bp, Artificial Sequence
  Synthetic
atacgccatgctgggtctccctaatcactgcaacaactgtcaccccaatggtgtaaatattagtaacacatctaatgtgtgcaaaagatgtcccaagatagaagtggtcagccactgtgacgtacttgggagtcggccat

SEQ ID NO: 369336 - DNA, 140 bp, Artificial Sequence
  Synthetic
atggccgactcccaagtacgtcacagtggctgaccacttctatcttgggacatcttttgcacacattagatgtgttactaatatttacaccattggggtgacagttgttgcagtgattagggagacccagcatggcgtat

SEQ ID NO: 369337 - DNA, 140 bp, Artificial Sequence
  Synthetic
atacgccatgctgggtctccttgttaggcttacattaccaggaaaaactgagaaggagaggagagtcaaacgtaatgtggaatatcttataaaactgatgatgagcatgtcaggcattgacgtacttgggagtcggccat

SEQ ID NO: 369338 - DNA, 140 bp, Artificial Sequence
  Synthetic
atggccgactcccaagtacgtcaatgcctgacatgctcatcatcagttttataagatattccacattacgtttgactctcctctccttctcagtttttcctggtaatgtaagcctaacaaggagacccagcatggcgtat

SEQ ID NO: 369339 - DNA, 140 bp, Artificial Sequence
  Synthetic
aggccctggctgctgatatggcacatggagacacaccacagttagacttgaaggccagaccaacttatggtgcaggggaggtcactgtactagtggaggttgctgacatggagttgcacagaccttttgggacagcggtg

SEQ ID NO: 369340 - DNA, 140 bp, Artificial Sequence
  Synthetic
caccgctgtcccaaaaggtctgtgcaactccatgtcagcaacctccactagtacagtgacctcccctgcaccataagttggtctggccttcaagtctaactgtggtgtgtctccatgtgccatatcagcagccagggcct

SEQ ID NO: 369341 - DNA, 140 bp, Artificial Sequence
  Synthetic
atacgccatgctgggtctccgaaaagatactgtttgacttaaaggtgcctactaaagacgaagaagtacttataaacattagaaactcactgaaagctagatccgagtttgttagaaatacgtacttgggagtcggccat

SEQ ID NO: 369342 - DNA, 140 bp, Artificial Sequence
  Synthetic
atggccgactcccaagtacgtatttctaacaaactcggatctagctttcagtgagtttctaatgtttataagtacttcttcgtctttagtaggcacctttaagtcaaacagtatcttttcggagacccagcatggcgtat

SEQ ID NO: 369343 - DNA, 140 bp, Artificial Sequence
  Synthetic
atacgccatgctgggtctccgtgcagtcttttaaattgaaaaaaaacaagcaacctgtgccttttcaagttgactgtatactgttcaaagaagtggcagctgaatgcatgaaaaggtacacgtacttgggagtcggccat

SEQ ID NO: 369344 - DNA, 140 bp, Artificial Sequence
  Synthetic
atggccgactcccaagtacgtgtaccttttcatgcattcagctgccacttctttgaacagtatacagtcaacttgaaaaggcacaggttgcttgttttttttcaatttaaaagactgcacggagacccagcatggcgtat

SEQ ID NO: 369345 - DNA, 140 bp, Artificial Sequence
  Synthetic
atacgccatgctgggtctccgtgttaacaaggttcacttggtttcaggaggtggtgttatatggtaaaatatgtgagaccttcctaagatgctgcacagaatttaataggtcaggggttacgtacttgggagtcggccat

SEQ ID NO: 369346 - DNA, 140 bp, Artificial Sequence
  Synthetic
atggccgactcccaagtacgtaacccctgacctattaaattctgtgcagcatcttaggaaggtctcacatattttaccatataacaccacctcctgaaaccaagtgaaccttgttaacacggagacccagcatggcgtat

SEQ ID NO: 369347 - DNA, 140 bp, Artificial Sequence
  Synthetic
aggccctggctgctgatatgatgtgagaccttcctaagatgctgcacagaatttaataggtcaggggttaaactggttaagataaggcactgtgacatcaacctatcggtcaaactgccagaccttttgggacagcggtg

SEQ ID NO: 369348 - DNA, 140 bp, Artificial Sequence
  Synthetic
caccgctgtcccaaaaggtctggcagtttgaccgataggttgatgtcacagtgccttatcttaaccagtttaacccctgacctattaaattctgtgcagcatcttaggaaggtctcacatcatatcagcagccagggcct

SEQ ID NO: 369349 - DNA, 140 bp, Artificial Sequence
  Synthetic
atacgccatgctgggtctccaactggttaagataaggcactgtgacatcaacctatcggtcaaactgccatcaaataagaaggagaatatgttatgttgcatatacagtagcaacatggacgtacttgggagtcggccat

SEQ ID NO: 369350 - DNA, 140 bp, Artificial Sequence
  Synthetic
atggccgactcccaagtacgtccatgttgctactgtatatgcaacataacatattctccttcttatttgatggcagtttgaccgataggttgatgtcacagtgccttatcttaaccagttggagacccagcatggcgtat

SEQ ID NO: 369351 - DNA, 140 bp, Artificial Sequence
  Synthetic
atacgccatgctgggtctcccttcatacctttatattgtcattacactatatatacaagtgttgcagcaatataggtgtctggaagttataaatagtgtgaatgagaaaacattgcaagacgtacttgggagtcggccat

SEQ ID NO: 369352 - DNA, 140 bp, Artificial Sequence
  Synthetic
atggccgactcccaagtacgtcttgcaatgttttctcattcacactatttataacttccagacacctatattgctgcaacacttgtatatatagtgtaatgacaatataaaggtatgaagggagacccagcatggcgtat

SEQ ID NO: 369353 - DNA, 140 bp, Artificial Sequence
  Synthetic
atacgccatgctgggtctcccttttgctcttgaaggaaggtttgaagagtcctataaaatacgaacctcaaggtgcagagctagcgggagttttttaaatagaagcagtagagaccatttcgtacttgggagtcggccat

SEQ ID NO: 369354 - DNA, 140 bp, Artificial Sequence
  Synthetic
atggccgactcccaagtacgaaatggtctctactgcttctatttaaaaaactcccgctagctctgcaccttgaggttcgtattttataggactcttcaaaccttccttcaagagcaaaagggagacccagcatggcgtat

SEQ ID NO: 369355 - DNA, 140 bp, Artificial Sequence
  Synthetic
aggccctggctgctgatatgaggtgcagagctagcgggagttttttaaatagaagcagtagagaccattttgtaagtgttgtttcaggcttgaacctggtttatggcttcctcataaaaggaccttttgggacagcggtg

SEQ ID NO: 369356 - DNA, 140 bp, Artificial Sequence
  Synthetic
caccgctgtcccaaaaggtccttttatgaggaagccataaaccaggttcaagcctgaaacaacacttacaaaatggtctctactgcttctatttaaaaaactcccgctagctctgcacctcatatcagcagccagggcct

SEQ ID NO: 369357 - DNA, 140 bp, Artificial Sequence
  Synthetic
aggccctggctgctgatatgagggaaaaagttttcaacaagttgtagaaggattgaggacaacattgcaaggctttacctgcaaacatctatatactgttcagttagggatgtggaagacgaccttttgggacagcggtg

SEQ ID NO: 369358 - DNA, 140 bp, Artificial Sequence
  Synthetic
caccgctgtcccaaaaggtcgtcttccacatccctaactgaacagtatatagatgtttgcaggtaaagccttgcaatgttgtcctcaatccttctacaacttgttgaaaactttttccctcatatcagcagccagggcct

SEQ ID NO: 369359 - DNA, 140 bp, Artificial Sequence
  Synthetic
atacgccatgctgggtctccatgctttacagtctatggaacctttgtcaacagcgacagacaactgatctttgacatttacaatgtgcatatatacaataaagaaatggataactttgatcgtacttgggagtcggccat

SEQ ID NO: 369360 - DNA, 140 bp, Artificial Sequence
  Synthetic
atggccgactcccaagtacgatcaaagttatccatttctttattgtatatatgcacattgtaaatgtcaaagatcagttgtctgtcgctgttgacaaaggttccatagactgtaaagcatggagacccagcatggcgtat

SEQ ID NO: 369361 - DNA, 140 bp, Artificial Sequence
  Synthetic
atacgccatgctgggtctccagagaagggaagaagctgttgaagttaaacagcgacacatctacagatacacagagtattgcttctgaggtgtcagacagaagatcctatagctcaagtacgtacttgggagtcggccat

SEQ ID NO: 369362 - DNA, 140 bp, Artificial Sequence
  Synthetic
atggccgactcccaagtacgtacttgagctataggatcttctgtctgacacctcagaagcaatactctgtgtatctgtagatgtgtcgctgtttaacttcaacagcttcttcccttctctggagacccagcatggcgtat

SEQ ID NO: 369363 - DNA, 140 bp, Artificial Sequence
  Synthetic
aggccctggctgctgatatgacagagtattgcttctgaggtgtcagacagaagatcctatagctcaagtaagagtagaatccgtagcatttttggaagatacaactctcagaaaaaaccagaccttttgggacagcggtg

SEQ ID NO: 369364 - DNA, 140 bp, Artificial Sequence
  Synthetic
caccgctgtcccaaaaggtctggttttttctgagagttgtatcttccaaaaatgctacggattctactcttacttgagctataggatcttctgtctgacacctcagaagcaatactctgtcatatcagcagccagggcct

SEQ ID NO: 369365 - DNA, 140 bp, Artificial Sequence
  Synthetic
atacgccatgctgggtctcctcagcaagcaataacggacatttgccagttttctgagtatacaccaaacaaagaaagcattttgaaagactgtcttcaaatcatacgaaaaaaccctagccgtacttgggagtcggccat

SEQ ID NO: 369366 - DNA, 140 bp, Artificial Sequence
  Synthetic
atggccgactcccaagtacggctagggttttttcgtatgatttgaagacagtctttcaaaatgctttctttgtttggtgtatactcagaaaactggcaaatgtccgttattgcttgctgaggagacccagcatggcgtat

SEQ ID NO: 369367 - DNA, 140 bp, Artificial Sequence
  Synthetic
aggccctggctgctgatatgaagaaagcattttgaaagactgtcttcaaatcatacgaaaaaaccctagccacacaatgggttcttttgagctgatacaggcaatctcagagttcggtatgaccttttgggacagcggtg

SEQ ID NO: 369368 - DNA, 140 bp, Artificial Sequence
  Synthetic
caccgctgtcccaaaaggtcataccgaactctgagattgcctgtatcagctcaaaagaacccattgtgtggctagggttttttcgtatgatttgaagacagtctttcaaaatgctttcttcatatcagcagccagggcct

SEQ ID NO: 369369 - DNA, 140 bp, Artificial Sequence
  Synthetic
atacgccatgctgggtctccactgggttagcatctctgaagtaaccgaaacaacaagcatagttgcatcacctagaactcatatgatgctcaaagactgttttaaaatcatactaggtaccgtacttgggagtcggccat

SEQ ID NO: 369370 - DNA, 140 bp, Artificial Sequence
  Synthetic
atggccgactcccaagtacggtacctagtatgattttaaaacagtctttgagcatcatatgagttctaggtgatgcaactatgcttgttgtttcggttacttcagagatgctaacccagtggagacccagcatggcgtat

SEQ ID NO: 369371 - DNA, 140 bp, Artificial Sequence
  Synthetic
atacgccatgctgggtctccgtgctatctcaacaaatatagagattgggaaaagggactgtctagatctactcagcacagtagatggtctaacggaccaacaaaaagaaaatattgtaaacgtacttgggagtcggccat

SEQ ID NO: 369372 - DNA, 140 bp, Artificial Sequence
  Synthetic
atggccgactcccaagtacgtttacaatattttctttttgttggtccgttagaccatctactgtgctgagtagatctagacagtcccttttcccaatctctatatttgttgagatagcacggagacccagcatggcgtat

SEQ ID NO: 369373 - DNA, 140 bp, Artificial Sequence
  Synthetic
atacgccatgctgggtctcctcagaaagaacattgatgaagttttacttactgaagatgggaatctgatcttctgctggctaaaaacaatctcctcttcagtcaaaggaagccttaagaacgtacttgggagtcggccat

SEQ ID NO: 369374 - DNA, 140 bp, Artificial Sequence
  Synthetic
atggccgactcccaagtacgttcttaaggcttcctttgactgaagaggagattgtttttagccagcagaagatcagattcccatcttcagtaagtaaaacttcatcaatgttctttctgaggagacccagcatggcgtat

SEQ ID NO: 369375 - DNA, 140 bp, Artificial Sequence
  Synthetic
aggccctggctgctgatatgttctgctggctaaaaacaatctcctcttcagtcaaaggaagccttaagaagaggctcaagtttatgaacgtgcattccccagagctgatgccagaaaactgaccttttgggacagcggtg

SEQ ID NO: 369376 - DNA, 140 bp, Artificial Sequence
  Synthetic
caccgctgtcccaaaaggtcagttttctggcatcagctctggggaatgcacgttcataaacttgagcctcttcttaaggcttcctttgactgaagaggagattgtttttagccagcagaacatatcagcagccagggcct

SEQ ID NO: 369377 - DNA, 140 bp, Artificial Sequence
  Synthetic
atacgccatgctgggtctccctcctcaacgaacaacaagatgaacaggagctgaaacaggatcttttgatatcctcttggatcaagtgtataacagcttgtaaggattttgcaagcatcacgtacttgggagtcggccat

SEQ ID NO: 369378 - DNA, 140 bp, Artificial Sequence
  Synthetic
atggccgactcccaagtacgtgatgcttgcaaaatccttacaagctgttatacacttgatccaagaggatatcaaaagatcctgtttcagctcctgttcatcttgttgttcgttgaggagggagacccagcatggcgtat

SEQ ID NO: 369379 - DNA, 140 bp, Artificial Sequence
  Synthetic
atacgccatgctgggtctccataaggctgcaacacctggaactgtcaaaacttaagcaagagcacccaagtgtcagctttacaaaagaagaggtcttaataaagcggctagagaaaaattcgtacttgggagtcggccat

SEQ ID NO: 369380 - DNA, 140 bp, Artificial Sequence
  Synthetic
atggccgactcccaagtacgaatttttctctagccgctttattaagacctcttcttttgtaaagctgacacttgggtgctcttgcttaagttttgacagttccaggtgttgcagccttatggagacccagcatggcgtat

SEQ ID NO: 369381 - DNA, 140 bp, Artificial Sequence
  Synthetic
aggccctggctgctgatatgtgtcagctttacaaaagaagaggtcttaataaagcggctagagaaaaatttcctaaagcagcataatctggaaatcatggaaacagtgaatcttatattcgaccttttgggacagcggtg

SEQ ID NO: 369382 - DNA, 140 bp, Artificial Sequence
  Synthetic
caccgctgtcccaaaaggtcgaatataagattcactgtttccatgatttccagattatgctgctttaggaaatttttctctagccgctttattaagacctcttcttttgtaaagctgacacatatcagcagccagggcct

SEQ ID NO: 369383 - DNA, 140 bp, Artificial Sequence
  Synthetic
atacgccatgctgggtctccttatctggtgagacatccggaaatacttgactgtggatccaaagaggattgcaggctcactttgcttgatctatcagtttccaagctcttggtatgtttgcgtacttgggagtcggccat

SEQ ID NO: 369384 - DNA, 140 bp, Artificial Sequence
  Synthetic
atggccgactcccaagtacgcaaacataccaagagcttggaaactgatagatcaagcaaagtgagcctgcaatcctctttggatccacagtcaagtatttccggatgtctcaccagataaggagacccagcatggcgtat

SEQ ID NO: 369385 - DNA, 140 bp, Artificial Sequence
  Synthetic
atacgccatgctgggtctcctatcaaaaagatgatgaagaattgacaaatagctcaagtttaaaacttgggtttttagtgaaatatgctgtcaccctattcacgtccaatggtgagccatcgtacttgggagtcggccat

SEQ ID NO: 369386 - DNA, 140 bp, Artificial Sequence
  Synthetic
atggccgactcccaagtacgatggctcaccattggacgtgaatagggtgacagcatatttcactaaaaacccaagttttaaacttgagctatttgtcaattcttcatcatctttttgataggagacccagcatggcgtat

SEQ ID NO: 369387 - DNA, 140 bp, Artificial Sequence
  Synthetic
atacgccatgctgggtctccactgacgaaaagctgctacatcaaacaaagatagtttttgctaaaattggtttatctgggaacagttatgacttcatctggactactcaaatgatagccacgtacttgggagtcggccat

SEQ ID NO: 369388 - DNA, 140 bp, Artificial Sequence
  Synthetic
atggccgactcccaagtacgtggctatcatttgagtagtccagatgaagtcataactgttcccagataaaccaattttagcaaaaactatctttgtttgatgtagcagcttttcgtcagtggagacccagcatggcgtat

SEQ ID NO: 369389 - DNA, 140 bp, Artificial Sequence
  Synthetic
atacgccatgctgggtctccaggctcccaagaagcgtcagaagcaaggttatttatgagatggtaaaactagtgggagaaacgggcatggcaatactacaacaattagcttttgcacaagcgtacttgggagtcggccat

SEQ ID NO: 369390 - DNA, 140 bp, Artificial Sequence
  Synthetic
atggccgactcccaagtacgcttgtgcaaaagctaattgttgtagtattgccatgcccgtttctcccactagttttaccatctcataaataaccttgcttctgacgcttcttgggagcctggagacccagcatggcgtat

SEQ ID NO: 369391 - DNA, 140 bp, Artificial Sequence
  Synthetic
aggccctggctgctgatatgctaggaggagcaagagatttgttagtgcaagagactgggactaaagtcatgcatgcaaccactgaaatgtttagtagaaaccttttaaagacaacatcaggaccttttgggacagcggtg

SEQ ID NO: 369392 - DNA, 140 bp, Artificial Sequence
  Synthetic
caccgctgtcccaaaaggtcctgatgttgtctttaaaaggtttctactaaacatttcagtggttgcatgcatgactttagtcccagtctcttgcactaacaaatctcttgctcctcctagcatatcagcagccagggcct

SEQ ID NO: 369393 - DNA, 140 bp, Artificial Sequence
  Synthetic
atacgccatgctgggtctccttagactgtcttgctaacatgcgaaaccttgacggtaagcccataagtgaaggtagcaacttggtcaatttctacaaagtcatatgtatctcgggtgatacgtacttgggagtcggccat

SEQ ID NO: 369394 - DNA, 140 bp, Artificial Sequence
  Synthetic
atggccgactcccaagtacgtatcacccgagatacatatgactttgtagaaattgaccaagttgctaccttcacttatgggcttaccgtcaaggtttcgcatgttagcaagacagtctaaggagacccagcatggcgtat

SEQ ID NO: 369395 - DNA, 140 bp, Artificial Sequence
  Synthetic
aggccctggctgctgatatgaggtagcaacttggtcaatttctacaaagtcatatgtatctcgggtgataataccaagtggggcccgatacactgctgttctttcttctccggcatgatggaccttttgggacagcggtg

SEQ ID NO: 369396 - DNA, 140 bp, Artificial Sequence
  Synthetic
caccgctgtcccaaaaggtccatcatgccggagaagaaagaacagcagtgtatcgggccccacttggtattatcacccgagatacatatgactttgtagaaattgaccaagttgctacctcatatcagcagccagggcct

SEQ ID NO: 369397 - DNA, 140 bp, Artificial Sequence
  Synthetic
atacgccatgctgggtctccattcattaagaacttgtgtaggcaagtagaaatacctgctggcagcataaagaagatcttaaatgttcttagatacagattgtgtagcaaaggaggtgtgcgtacttgggagtcggccat

SEQ ID NO: 369398 - DNA, 140 bp, Artificial Sequence
  Synthetic
atggccgactcccaagtacgcacacctcctttgctacacaatctgtatctaagaacatttaagatcttctttatgctgccagcaggtatttctacttgcctacacaagttcttaatgaatggagacccagcatggcgtat

SEQ ID NO: 369399 - DNA, 140 bp, Artificial Sequence
  Synthetic
aggccctggctgctgatatgagaagatcttaaatgttcttagatacagattgtgtagcaaaggaggtgtggagcaacatagtgaagaggatctaaggagattgttgacagataatttagagaccttttgggacagcggtg

SEQ ID NO: 369400 - DNA, 140 bp, Artificial Sequence
  Synthetic
caccgctgtcccaaaaggtctctaaattatctgtcaacaatctccttagatcctcttcactatgttgctccacacctcctttgctacacaatctgtatctaagaacatttaagatcttctcatatcagcagccagggcct

SEQ ID NO: 369401 - DNA, 140 bp, Artificial Sequence
  Synthetic
atacgccatgctgggtctccgcaaaggactcatggcattaaacagttacaatcatatgggtcagggtattcaccatgcaacttcttcggtgttaacttccctagctgccgtgctctttgacgtacttgggagtcggccat

SEQ ID NO: 369402 - DNA, 140 bp, Artificial Sequence
  Synthetic
atggccgactcccaagtacgtcaaagagcacggcagctagggaagttaacaccgaagaagttgcatggtgaataccctgacccatatgattgtaactgtttaatgccatgagtcctttgcggagacccagcatggcgtat

SEQ ID NO: 369403 - DNA, 140 bp, Artificial Sequence
  Synthetic
aggccctggctgctgatatgatgttgaacatgccggtagttcagatgattacgcaaaatgtatagtggtgactggtatactgtccaaagagctctactcccagtatgatgaaacattttggaccttttgggacagcggtg

SEQ ID NO: 369404 - DNA, 140 bp, Artificial Sequence
  Synthetic
caccgctgtcccaaaaggtccaaaatgtttcatcatactgggagtagagctctttggacagtataccagtcaccactatacattttgcgtaatcatctgaactaccggcatgttcaacatcatatcagcagccagggcct

SEQ ID NO: 369405 - DNA, 140 bp, Artificial Sequence
  Synthetic
aggccctggctgctgatatgactggtatactgtccaaagagctctactcccagtatgatgaaacattttggaaacacgcttgtagacttaaaaacttcacagccgcagtacaaagatgttgaccttttgggacagcggtg

SEQ ID NO: 369406 - DNA, 140 bp, Artificial Sequence
  Synthetic
caccgctgtcccaaaaggtcaacatctttgtactgcggctgtgaagtttttaagtctacaagcgtgtttccaaaatgtttcatcatactgggagtagagctctttggacagtataccagtcatatcagcagccagggcct

SEQ ID NO: 369407 - DNA, 140 bp, Artificial Sequence
  Synthetic
aggccctggctgctgatatggtcaaatgaaagatagtgccaaaaccttagtgagcgactgctttcttgagttttacagtgagtttatgatgggctacagagtaacccctgctgtgattaagaccttttgggacagcggtg

SEQ ID NO: 369408 - DNA, 140 bp, Artificial Sequence
  Synthetic
caccgctgtcccaaaaggtcttaatcacagcaggggttactctgtagcccatcataaactcactgtaaaactcaagaaagcagtcgctcactaaggttttggcactatctttcatttgaccatatcagcagccagggcct

SEQ ID NO: 369409 - DNA, 140 bp, Artificial Sequence
  Synthetic
aggccctggctgctgatatgttttacagtgagtttatgatgggctacagagtaacccctgctgtgattaaattcatgttcactggactgataaacagctctgtaacctctcctcagagttgaccttttgggacagcggtg

SEQ ID NO: 369410 - DNA, 140 bp, Artificial Sequence
  Synthetic
caccgctgtcccaaaaggtcaactctgaggagaggttacagagctgtttatcagtccagtgaacatgaatttaatcacagcaggggttactctgtagcccatcataaactcactgtaaaacatatcagcagccagggcct

SEQ ID NO: 369411 - DNA, 140 bp, Artificial Sequence
  Synthetic
atacgccatgctgggtctccaagagactcaagttcatgaatgtaaattccccggaactgatgccagagaactgtctcttttccagtgaagaattcaatgagttgatcaaactgaagaagccgtacttgggagtcggccat

SEQ ID NO: 369412 - DNA, 140 bp, Artificial Sequence
  Synthetic
atggccgactcccaagtacggcttcttcagtttgatcaactcattgaattcttcactggaaaagagacagttctctggcatcagttccggggaatttacattcatgaacttgagtctcttggagacccagcatggcgtat

SEQ ID NO: 369413 - DNA, 140 bp, Artificial Sequence
  Synthetic
atacgccatgctgggtctcccctcttgtcaccaacactaccttcaccctattaaggcagcaaatattctttaaccatgttgaagattttatcagaaggtatggtatactaacccttgggacgtacttgggagtcggccat

SEQ ID NO: 369414 - DNA, 140 bp, Artificial Sequence
  Synthetic
atggccgactcccaagtacgtcccaagggttagtataccataccttctgataaaatcttcaacatggttaaagaatatttgctgccttaatagggtgaaggtagtgttggtgacaagaggggagacccagcatggcgtat

SEQ ID NO: 369415 - DNA, 140 bp, Artificial Sequence
  Synthetic
atacgccatgctgggtctccagctcagcagttgctttggaagatgctgaagtcattgctagagcagctcaaacacttcatatgaacagtgtatcaatacagtcaagtagcttaaccacatcgtacttgggagtcggccat

SEQ ID NO: 369416 - DNA, 140 bp, Artificial Sequence
  Synthetic
atggccgactcccaagtacgatgtggttaagctacttgactgtattgatacactgttcatatgaagtgtttgagctgctctagcaatgacttcagcatcttccaaagcaactgctgagctggagacccagcatggcgtat

SEQ ID NO: 369417 - DNA, 140 bp, Artificial Sequence
  Synthetic
atacgccatgctgggtctccaagcttctcttttgagctcaataggcctctgtctgaaactgaactacagttcattaaagcactaagtagcctcaagtcaacacaagcctgtgaagtaattcgtacttgggagtcggccat

SEQ ID NO: 369418 - DNA, 140 bp, Artificial Sequence
  Synthetic
atggccgactcccaagtacgaattacttcacaggcttgtgttgacttgaggctacttagtgctttaatgaactgtagttcagtttcagacagaggcctattgagctcaaaagagaagcttggagacccagcatggcgtat

SEQ ID NO: 369419 - DNA, 140 bp, Artificial Sequence
  Synthetic
aggccctggctgctgatatgtcattaaagcactaagtagcctcaagtcaacacaagcctgtgaagtaattcaaaatagaattacaggactttattgcaatagcaatgaagggcctcttgagaccttttgggacagcggtg

SEQ ID NO: 369420 - DNA, 140 bp, Artificial Sequence
  Synthetic
caccgctgtcccaaaaggtctcaagaggcccttcattgctattgcaataaagtcctgtaattctattttgaattacttcacaggcttgtgttgacttgaggctacttagtgctttaatgacatatcagcagccagggcct

SEQ ID NO: 369421 - DNA, 140 bp, Artificial Sequence
  Synthetic
atacgccatgctgggtctcctaaaggatggtaaaagaagagggaatctagaactggccaataggatccagtctgtactgtgtattctgatagcagggtattacaggtcatttggaggggacgtacttgggagtcggccat

SEQ ID NO: 369422 - DNA, 140 bp, Artificial Sequence
  Synthetic
atggccgactcccaagtacgtcccctccaaatgacctgtaataccctgctatcagaatacacagtacagactggatcctattggccagttctagattccctcttcttttaccatcctttaggagacccagcatggcgtat

SEQ ID NO: 369423 - DNA, 140 bp, Artificial Sequence
  Synthetic
atacgccatgctgggtctccaggaaccgaaaaacaggtaaaggcatcattgaatagagacgacaataaaatcattgaggatcctatgatacagctaattccagagaagctgaggagagaacgtacttgggagtcggccat

SEQ ID NO: 369424 - DNA, 140 bp, Artificial Sequence
  Synthetic
atggccgactcccaagtacgttctctcctcagcttctctggaattagctgtatcataggatcctcaatgattttattgtcgtctctattcaatgatgcctttacctgtttttcggttcctggagacccagcatggcgtat

SEQ ID NO: 369425 - DNA, 140 bp, Artificial Sequence
  Synthetic
aggccctggctgctgatatgccttcaaacaagccagctgctctgcactccccactgtcaatttaactgctttaattgattcatttcactacattaccaatcctctctttctctctctttcgaccttttgggacagcggtg

SEQ ID NO: 369426 - DNA, 140 bp, Artificial Sequence
  Synthetic
caccgctgtcccaaaaggtcgaaagagagagaaagagaggattggtaatgtagtgaaatgaatcaattaaagcagttaaattgacagtggggagtgcagagcagctggcttgtttgaaggcatatcagcagccagggcct

SEQ ID NO: 369427 - DNA, 140 bp, Artificial Sequence
  Synthetic
atacgccatgctgggtctcctggctttgaaattgagtctcataagtgctactgtagcttgttttgttgcccttactgtaggcactgctctgctgatggagaaatccatcagctgcacttgcgtacttgggagtcggccat

SEQ ID NO: 369428 - DNA, 140 bp, Artificial Sequence
  Synthetic
atggccgactcccaagtacgcaagtgcagctgatggatttctccatcagcagagcagtgcctacagtaagggcaacaaaacaagctacagtagcacttatgagactcaatttcaaagccaggagacccagcatggcgtat

SEQ ID NO: 369429 - DNA, 140 bp, Artificial Sequence
  Synthetic
atacgccatgctgggtctccaagacaacgttttcttgtcattaacagatagatggtccaccaagcacagtacaaactatcgtgatagttgtggcaagcaactaacaggtagaataattaccgtacttgggagtcggccat

SEQ ID NO: 369430 - DNA, 140 bp, Artificial Sequence
  Synthetic
atggccgactcccaagtacggtaattattctacctgttagttgcttgccacaactatcacgatagtttgtactgtgcttggtggaccatctatctgttaatgacaagaaaacgttgtcttggagacccagcatggcgtat

SEQ ID NO: 369431 - DNA, 140 bp, Artificial Sequence
  Synthetic
aggccctggctgctgatatgacaaactatcgtgatagttgtggcaagcaactaacaggtagaataattaccaagtatactcactggttggacactttcctaggctgctctgtgtccatcagaccttttgggacagcggtg

SEQ ID NO: 369432 - DNA, 140 bp, Artificial Sequence
  Synthetic
caccgctgtcccaaaaggtctgatggacacagagcagcctaggaaagtgtccaaccagtgagtatacttggtaattattctacctgttagttgcttgccacaactatcacgatagtttgtcatatcagcagccagggcct

SEQ ID NO: 369433 - DNA, 140 bp, Artificial Sequence
  Synthetic
atacgccatgctgggtctcctgtgtcaacctgatcacatttgaggacggcttgagagagctatcagtgatacagagtcaccttaaagtctttgaaaatgagtttaccaacttaaatcttccgtacttgggagtcggccat

SEQ ID NO: 369434 - DNA, 140 bp, Artificial Sequence
  Synthetic
atggccgactcccaagtacggaagatttaagttggtaaactcattttcaaagactttaaggtgactctgtatcactgatagctctctcaagccgtcctcaaatgtgatcaggttgacacaggagacccagcatggcgtat

SEQ ID NO: 369435 - DNA, 140 bp, Artificial Sequence
  Synthetic
atacgccatgctgggtctccgcggaatctgagctggaggcaaaccgtgcagtaattgtcaaaaccaaattgttttcagcaactgaacaagttcgactatccaacaaccctgcagttgtcacgtacttgggagtcggccat

SEQ ID NO: 369436 - DNA, 140 bp, Artificial Sequence
  Synthetic
atggccgactcccaagtacgtgacaactgcagggttgttggatagtcgaacttgttcagttgctgaaaacaatttggttttgacaattactgcacggtttgcctccagctcagattccgcggagacccagcatggcgtat

SEQ ID NO: 369437 - DNA, 140 bp, Artificial Sequence
  Synthetic
aggccctggctgctgatatgtcatattcaacctacttcattatattcgtaatgcttgaaattgctattgcttcattcactctgtcctaaaccttaactgcgtgccgccactatatctttggaccttttgggacagcggtg

SEQ ID NO: 369438 - DNA, 140 bp, Artificial Sequence
  Synthetic
caccgctgtcccaaaaggtccaaagatatagtggcggcacgcagttaaggtttaggacagagtgaatgaagcaatagcaatttcaagcattacgaatataatgaagtaggttgaatatgacatatcagcagccagggcct

SEQ ID NO: 369439 - DNA, 140 bp, Artificial Sequence
  Synthetic
atacgccatgctgggtctcccggaaaagaatggtcttagtccggatttgcaacaagttgcaagatactcaaaccatttgaccttgctcagcaggatgatacaacaagcaaagccaaccgtcgtacttgggagtcggccat

SEQ ID NO: 369440 - DNA, 140 bp, Artificial Sequence
  Synthetic
atggccgactcccaagtacgacggttggctttgcttgttgtatcatcctgctgagcaaggtcaaatggtttgagtatcttgcaacttgttgcaaatccggactaagaccattcttttccgggagacccagcatggcgtat

SEQ ID NO: 369441 - DNA, 140 bp, Artificial Sequence
  Synthetic
atacgccatgctgggtctccttgctgagcttgtcagctatggtataaaggaaggtaggttttataggctttccgacacaggaatcgatgcaagcacatactctgtaaagtattggaaaatcgtacttgggagtcggccat

SEQ ID NO: 369442 - DNA, 140 bp, Artificial Sequence
  Synthetic
atggccgactcccaagtacgattttccaatactttacagagtatgtgcttgcatcgattcctgtgtcggaaagcctataaaacctaccttcctttataccatagctgacaagctcagcaaggagacccagcatggcgtat

SEQ ID NO: 369443 - DNA, 140 bp, Artificial Sequence
  Synthetic
atacgccatgctgggtctccagtcttcactacttatgagttttttaaactggagggttaacatggacattagagcatctgactgtccactgtctagtcatgaggcaagtatattgagtgacgtacttgggagtcggccat

SEQ ID NO: 369444 - DNA, 140 bp, Artificial Sequence
  Synthetic
atggccgactcccaagtacgtcactcaatatacttgcctcatgactagacagtggacagtcagatgctctaatgtccatgttaaccctccagtttaaaaaactcataagtagtgaagactggagacccagcatggcgtat

SEQ ID NO: 369445 - DNA, 140 bp, Artificial Sequence
  Synthetic
aggccctggctgctgatatgagagcatctgactgtccactgtctagtcatgaggcaagtatattgagtgaatttgatggacaggtcatcgccaacatacttgccagtgaattgagttctggaccttttgggacagcggtg

SEQ ID NO: 369446 - DNA, 140 bp, Artificial Sequence
  Synthetic
caccgctgtcccaaaaggtccagaactcaattcactggcaagtatgttggcgatgacctgtccatcaaattcactcaatatacttgcctcatgactagacagtggacagtcagatgctctcatatcagcagccagggcct

SEQ ID NO: 369447 - DNA, 140 bp, Artificial Sequence
  Synthetic
atacgccatgctgggtctccatgctggcatctttagctgcaactccactacattatcatcacaatatactgcatctaaactgcttcattgtatctgcaaacagactctatgatgcttgaacgtacttgggagtcggccat

SEQ ID NO: 369448 - DNA, 140 bp, Artificial Sequence
  Synthetic
atggccgactcccaagtacgttcaagcatcatagagtctgtttgcagatacaatgaagcagtttagatgcagtatattgtgatgataatgtagtggagttgcagctaaagatgccagcatggagacccagcatggcgtat

SEQ ID NO: 369449 - DNA, 140 bp, Artificial Sequence
  Synthetic
atacgccatgctgggtctccatccatctctcgtctgaatccgttgccctgctgtgtgaaactgaaagacaagtgctctcttggatgagcaagaggaggaccgaggtaataactaaagaaccgtacttgggagtcggccat

SEQ ID NO: 369450 - DNA, 140 bp, Artificial Sequence
  Synthetic
atggccgactcccaagtacggttctttagttattacctcggtcctcctcttgctcatccaagagagcacttgtctttcagtttcacacagcagggcaacggattcagacgagagatggatggagacccagcatggcgtat

SEQ ID NO: 369451 - DNA, 140 bp, Artificial Sequence
  Synthetic
aggccctggctgctgatatgagtgctctcttggatgagcaagaggaggaccgaggtaataactaaagaacagcaccaattgtttctgagtcttcttccacaatcacatgaatgtttacaagaccttttgggacagcggtg

SEQ ID NO: 369452 - DNA, 140 bp, Artificial Sequence
  Synthetic
caccgctgtcccaaaaggtcttgtaaacattcatgtgattgtggaagaagactcagaaacaattggtgctgttctttagttattacctcggtcctcctcttgctcatccaagagagcactcatatcagcagccagggcct

SEQ ID NO: 369453 - DNA, 140 bp, Artificial Sequence
  Synthetic
atacgccatgctgggtctccagcaccaattgtttctgagtcttcttccacaatcacatgaatgtttacaaaagcacaaagacggtagtgcgctatcagtcatacctgatagcagcaatcccgtacttgggagtcggccat

SEQ ID NO: 369454 - DNA, 140 bp, Artificial Sequence
  Synthetic
atggccgactcccaagtacgggattgctgctatcaggtatgactgatagcgcactaccgtctttgtgcttttgtaaacattcatgtgattgtggaagaagactcagaaacaattggtgctggagacccagcatggcgtat

SEQ ID NO: 369455 - DNA, 140 bp, Artificial Sequence
  Synthetic
atacgccatgctgggtctcctcaaaaaacaaattttgacagtgaagaagcaagtcgtgtttgatgctgagagcgagcctagattacagtgggggcatggctgcttgtccattgtttatgacgtacttgggagtcggccat

SEQ ID NO: 369456 - DNA, 140 bp, Artificial Sequence
  Synthetic
atggccgactcccaagtacgtcataaacaatggacaagcagccatgcccccactgtaatctaggctcgctctcagcatcaaacacgacttgcttcttcactgtcaaaatttgttttttgaggagacccagcatggcgtat

SEQ ID NO: 369457 - DNA, 140 bp, Artificial Sequence
  Synthetic
atacgccatgctgggtctccaacttgttgactgctctacagataggaagaagcttttgcctcagtctgtgttttctgattccaaagtcgtcctttcaaggatcaagttcaagacagaactcgtacttgggagtcggccat

SEQ ID NO: 369458 - DNA, 140 bp, Artificial Sequence
  Synthetic
atggccgactcccaagtacgagttctgtcttgaacttgatccttgaaaggacgactttggaatcagaaaacacagactgaggcaaaagcttcttcctatctgtagagcagtcaacaagttggagacccagcatggcgtat

SEQ ID NO: 369459 - DNA, 140 bp, Artificial Sequence
  Synthetic
atacgccatgctgggtctccgtgatgcaataatggaggtagaaagtaaaagtagcttgctgcataaatacctcaaatcaggaggtgtcagacagcggaacactgaagtgctcttcagagacgtacttgggagtcggccat

SEQ ID NO: 369460 - DNA, 140 bp, Artificial Sequence
  Synthetic
atggccgactcccaagtacgtctctgaagagcacttcagtgttccgctgtctgacacctcctgatttgaggtatttatgcagcaagctacttttactttctacctccattattgcatcacggagacccagcatggcgtat

SEQ ID NO: 369461 - DNA, 140 bp, Artificial Sequence
  Synthetic
aggccctggctgctgatatgttaccactcagctgttggtctgaagttcaaaactacattgaagacataggtttcaacaatgtacttgttaatattgacagaaacacggtgaaaagtgaacgaccttttgggacagcggtg

SEQ ID NO: 369462 - DNA, 140 bp, Artificial Sequence
  Synthetic
caccgctgtcccaaaaggtcgttcacttttcaccgtgtttctgtcaatattaacaagtacattgttgaaacctatgtcttcaatgtagttttgaacttcagaccaacagctgagtggtaacatatcagcagccagggcct

SEQ ID NO: 369463 - DNA, 140 bp, Artificial Sequence
  Synthetic
atacgccatgctgggtctccaaagacgtgaggacactagtgtcctacgttagcactgagaccatccctaaattcttacttgcttttttactttatgaggaagtgttgatgaacttaatcacgtacttgggagtcggccat

SEQ ID NO: 369464 - DNA, 140 bp, Artificial Sequence
  Synthetic
atggccgactcccaagtacgtgattaagttcatcaacacttcctcataaagtaaaaaagcaagtaagaatttagggatggtctcagtgctaacgtaggacactagtgtcctcacgtctttggagacccagcatggcgtat

SEQ ID NO: 369465 - DNA, 140 bp, Artificial Sequence
  Synthetic
atacgccatgctgggtctccaccagtgtaaggcagtaaaagaactcattaacagcacaggactctcagacttagaactagagagcttacttactttatgtgccttctacttccaaaatgacgtacttgggagtcggccat

SEQ ID NO: 369466 - DNA, 140 bp, Artificial Sequence
  Synthetic
atggccgactcccaagtacgtcattttggaagtagaaggcacataaagtaagtaagctctctagttctaagtctgagagtcctgtgctgttaatgagttcttttactgccttacactggtggagacccagcatggcgtat

SEQ ID NO: 369467 - DNA, 140 bp, Artificial Sequence
  Synthetic
atacgccatgctgggtctccgtgcagtaagagagatggccccagatgctcctttgcagcactgttaagcctagttcatgaggattggcagaggataggtaaaaacattcttgttcgtgcacgtacttgggagtcggccat

SEQ ID NO: 369468 - DNA, 140 bp, Artificial Sequence
  Synthetic
atggccgactcccaagtacgtgcacgaacaagaatgtttttacctatcctctgccaatcctcatgaactaggcttaacagtgctgcaaaggagcatctggggccatctctcttactgcacggagacccagcatggcgtat

SEQ ID NO: 369469 - DNA, 140 bp, Artificial Sequence
  Synthetic
atacgccatgctgggtctcctctcaaggacatgtctaagccaaagcctgagagagtagtcctggctagaaggtcactaaatcatgctctatccttaatgtttctagacgagatgacattacgtacttgggagtcggccat

SEQ ID NO: 369470 - DNA, 140 bp, Artificial Sequence
  Synthetic
atggccgactcccaagtacgtaatgtcatctcgtctagaaacattaaggatagagcatgatttagtgaccttctagccaggactactctctcaggctttggcttagacatgtccttgagaggagacccagcatggcgtat

SEQ ID NO: 369471 - DNA, 140 bp, Artificial Sequence
  Synthetic
aggccctggctgctgatatgcctgagctaaaatctttatccgtgaactgcaaaatggggaactttgaagggcaagagtgctttgagttcactattctgaaggacaatagcgcaaggctaggaccttttgggacagcggtg

SEQ ID NO: 369472 - DNA, 140 bp, Artificial Sequence
  Synthetic
caccgctgtcccaaaaggtcctagccttgcgctattgtccttcagaatagtgaactcaaagcactcttgcccttcaaagttccccattttgcagttcacggataaagattttagctcaggcatatcagcagccagggcct

SEQ ID NO: 369473 - DNA, 140 bp, Artificial Sequence
  Synthetic
atacgccatgctgggtctccgcagttagagcagtggaagatttaattctaatgttaacaggcaaagcaatcaagcccagtgctgtaacccaatttgcatatgaggatgaacagtgtcaagcgtacttgggagtcggccat

SEQ ID NO: 369474 - DNA, 140 bp, Artificial Sequence
  Synthetic
atggccgactcccaagtacgcttgacactgttcatcctcatatgcaaattgggttacagcactgggcttgattgctttgcctgttaacattagaattaaatcttccactgctctaactgcggagacccagcatggcgtat

SEQ ID NO: 369475 - DNA, 140 bp, Artificial Sequence
  Synthetic
atacgccatgctgggtctcccctgatagagaagcagaagccctcaaaacaggaaatctaggctttgactgggactcagattgaacatgccgcttgtatgagccattgatgccttacagtgcgtacttgggagtcggccat

SEQ ID NO: 369476 - DNA, 140 bp, Artificial Sequence
  Synthetic
atggccgactcccaagtacgcactgtaaggcatcaatggctcatacaagcggcatgttcaatctgagtcccagtcaaagcctagatttcctgttttgagggcttctgcttctctatcaggggagacccagcatggcgtat

SEQ ID NO: 369477 - DNA, 140 bp, Artificial Sequence
  Synthetic
atacgccatgctgggtctcctctcaaggacaaatgaggcagttttaaccgcaccattcattgacatcaaagccttcaagcaagccaactgctccgcatccttcacagtcaatccaactgccgtacttgggagtcggccat

SEQ ID NO: 369478 - DNA, 140 bp, Artificial Sequence
  Synthetic
atggccgactcccaagtacggcagttggattgactgtgaaggatgcggagcagttggcttgcttgaaggctttgatgtcaatgaatggtgcggttaaaactgcctcatttgtccttgagaggagacccagcatggcgtat

SEQ ID NO: 369479 - DNA, 140 bp, Artificial Sequence
  Synthetic
atacgccatgctgggtctcctttaatcgatccatttactattctaccaatcttctctttctctaccattcatttcagtttcatcatcattattattattctagggtgtggggggaacgatcgtacttgggagtcggccat

SEQ ID NO: 369480 - DNA, 140 bp, Artificial Sequence
  Synthetic
atggccgactcccaagtacgatcgttccccccacaccctagaataataataatgatgatgaaactgaaatgaatggtagagaaagagaagattggtagaatagtaaatggatcgattaaaggagacccagcatggcgtat

SEQ ID NO: 369481 - DNA, 140 bp, Artificial Sequence
  Synthetic
aggccctggctgctgatatgattttgtgcacctatatatgagtgtgcgtgggttagctccactggcattgtgaaaaggggacttgaatggttcgaaaaaaatgcgggcaccattaagtctgaccttttgggacagcggtg

SEQ ID NO: 369482 - DNA, 140 bp, Artificial Sequence
  Synthetic
caccgctgtcccaaaaggtcagacttaatggtgcccgcatttttttcgaaccattcaagtccccttttcacaatgccagtggagctaacccacgcacactcatatataggtgcacaaaatcatatcagcagccagggcct

SEQ ID NO: 369483 - DNA, 140 bp, Artificial Sequence
  Synthetic
atacgccatgctgggtctccacttgccaattaccaacaagctgccttgaaatggagaaaggacataggtttccgtgtcaatgcaaacacagcggctctgagcaacaaagtcctcgcagagcgtacttgggagtcggccat

SEQ ID NO: 369484 - DNA, 140 bp, Artificial Sequence
  Synthetic
atggccgactcccaagtacgctctgcgaggactttgttgctcagagccgctgtgtttgcattgacacggaaacctatgtcctttctccatttcaaggcagcttgttggtaattggcaagtggagacccagcatggcgtat

SEQ ID NO: 369485 - DNA, 140 bp, Artificial Sequence
  Synthetic
aggccctggctgctgatatgcatcagtctcttgttggcaagcaatctccattccagaacgcctacaacgtcaagggcaatgccaccagtgctaacattatctaaaatgcaaactgctctggaccttttgggacagcggtg

SEQ ID NO: 369486 - DNA, 140 bp, Artificial Sequence
  Synthetic
caccgctgtcccaaaaggtccagagcagtttgcattttagataatgttagcactggtggcattgcccttgacgttgtaggcgttctggaatggagattgcttgccaacaagagactgatgcatatcagcagccagggcct

SEQ ID NO: 369487 - DNA, 140 bp, Artificial Sequence
  Synthetic
atacgccatgctgggtctcccatgcttattttactagcttacataaccttattttattaacctttctctactttctcttgtcttaaacacttgaagggctgtgcggcaacgatatctttgcgtacttgggagtcggccat

SEQ ID NO: 369488 - DNA, 140 bp, Artificial Sequence
  Synthetic
atggccgactcccaagtacgcaaagatatcgttgccgcacagcccttcaagtgtttaagacaagagaaagtagagaaaggttaataaaataaggttatgtaagctagtaaaataagcatgggagacccagcatggcgtat

SEQ ID NO: 369489 - DNA, 140 bp, Artificial Sequence
  Synthetic
aggccctggctgctgatatgccctttacccacgttgacacagtcagctccagtggtgactttttgtctctgtggtacaatggacttcttgagaaaccttgattggactcaggtgattgctgaccttttgggacagcggtg

SEQ ID NO: 369490 - DNA, 140 bp, Artificial Sequence
  Synthetic
caccgctgtcccaaaaggtcagcaatcacctgagtccaatcaaggtttctcaagaagtccattgtaccacagagacaaaaagtcaccactggagctgactgtgtcaacgtgggtaaagggcatatcagcagccagggcct

SEQ ID NO: 369491 - DNA, 140 bp, Artificial Sequence
  Synthetic
atacgccatgctgggtctccacaataatcatttggactgttgctgccagtgatgaagtggaggcaggcataaaattcggagacggtgatgtgtttacagctgtgaaccttctgcactctgcgtacttgggagtcggccat

SEQ ID NO: 369492 - DNA, 140 bp, Artificial Sequence
  Synthetic
atggccgactcccaagtacgcagagtgcagaaggttcacagctgtaaacacatcaccgtctccgaattttatgcctgcctccacttcatcactggcagcaacagtccaaatgattattgtggagacccagcatggcgtat

SEQ ID NO: 369493 - DNA, 140 bp, Artificial Sequence
  Synthetic
aggccctggctgctgatatgaaaattcggagacggtgatgtgtttacagctgtgaaccttctgcactctgggcaaacacattttgatgctctcagaatactgccacagtttgaaacagacgaccttttgggacagcggtg

SEQ ID NO: 369494 - DNA, 140 bp, Artificial Sequence
  Synthetic
caccgctgtcccaaaaggtcgtctgtttcaaactgtggcagtattctgagagcatcaaaatgtgtttgcccagagtgcagaaggttcacagctgtaaacacatcaccgtctccgaattttcatatcagcagccagggcct

SEQ ID NO: 369495 - DNA, 140 bp, Artificial Sequence
  Synthetic
aggccctggctgctgatatggacatcatcctctagtgatgagctgcaagactatgaagatcttgctttagcactcacaagtgtggaagaaccgtataggcggtcaagcttggatgaagtcgaccttttgggacagcggtg

SEQ ID NO: 369496 - DNA, 140 bp, Artificial Sequence
  Synthetic
caccgctgtcccaaaaggtcgacttcatccaagcttgaccgcctatacggttcttccacacttgtgagtgctaaagcaagatcttcatagtcttgcagctcatcactagaggatgatgtccatatcagcagccagggcct

SEQ ID NO: 369497 - DNA, 140 bp, Artificial Sequence
  Synthetic
atacgccatgctgggtctcccactcacaagtgtggaagaaccgtataggcggtcaagcttggatgaagtcactctgtccaggaaacaagcagagctattgaggcagaaggcatctcagttcgtacttgggagtcggccat

SEQ ID NO: 369498 - DNA, 140 bp, Artificial Sequence
  Synthetic
atggccgactcccaagtacgaactgagatgccttctgcctcaatagctctgcttgtttcctggacagagtgacttcatccaagcttgaccgcctatacggttcttccacacttgtgagtgggagacccagcatggcgtat

SEQ ID NO: 369499 - DNA, 140 bp, Artificial Sequence
  Synthetic
aggccctggctgctgatatgctagatgttggtgggctgttgagggctgccttccctggaacaggaatagaaaggcatatgcagctgctacactctgagatgatactggacatctgtactggaccttttgggacagcggtg

SEQ ID NO: 369500 - DNA, 140 bp, Artificial Sequence
  Synthetic
caccgctgtcccaaaaggtccagtacagatgtccagtatcatctcagagtgtagcagctgcatatgcctttctattcctgttccagggaaggcagccctcaacagcccaccaacatctagcatatcagcagccagggcct

SEQ ID NO: 369501 - DNA, 140 bp, Artificial Sequence
  Synthetic
atacgccatgctgggtctccaaggcatatgcagctgctacactctgagatgatactggacatctgtactgtgtcacttggcatcatgttgtcaacattcttatacggctctaacaataagcgtacttgggagtcggccat

SEQ ID NO: 369502 - DNA, 140 bp, Artificial Sequence
  Synthetic
atggccgactcccaagtacgcttattgttagagccgtataagaatgttgacaacatgatgccaagtgacacagtacagatgtccagtatcatctcagagtgtagcagctgcatatgccttggagacccagcatggcgtat

SEQ ID NO: 369503 - DNA, 140 bp, Artificial Sequence
  Synthetic
aggccctggctgctgatatggtgacctcacccgcagaagcaccaggaatatcgcaaacgcagaggaatttatcatatctgagttcttcaaaaagaaggatattatgaaattcatcagcacgaccttttgggacagcggtg

SEQ ID NO: 369504 - DNA, 140 bp, Artificial Sequence
  Synthetic
caccgctgtcccaaaaggtcgtgctgatgaatttcataatatccttctttttgaagaactcagatatgataaattcctctgcgtttgcgatattcctggtgcttctgcgggtgaggtcaccatatcagcagccagggcct

SEQ ID NO: 369505 - DNA, 140 bp, Artificial Sequence
  Synthetic
aggccctggctgctgatatgatatcacagcttctgatcgagatcaagagattgtatgctcttcaagaagattctgaagtagagccgatagctataatttgtgatggcatagaaagcaatagaccttttgggacagcggtg

SEQ ID NO: 369506 - DNA, 140 bp, Artificial Sequence
  Synthetic
caccgctgtcccaaaaggtctattgctttctatgccatcacaaattatagctatcggctctacttcagaatcttcttgaagagcatacaatctcttgatctcgatcagaagctgtgatatcatatcagcagccagggcct

SEQ ID NO: 369507 - DNA, 140 bp, Artificial Sequence
  Synthetic
atacgccatgctgggtctccaagcgccgttgaacacgagagtccaagcatctcggccttcagggactatggagagagaggaatagttgaggagaatcacatgaggcttagtgaagaagatcgtacttgggagtcggccat

SEQ ID NO: 369508 - DNA, 140 bp, Artificial Sequence
  Synthetic
atggccgactcccaagtacgatcttcttcactaagcctcatgtgattctcctcaactattcctctctctccatagtccctgaaggccgagatgcttggactctcgtgttcaacggcgcttggagacccagcatggcgtat

SEQ ID NO: 369509 - DNA, 140 bp, Artificial Sequence
  Synthetic
aggccctggctgctgatatgcagctggaaacaaggcagctgctgttggtggaagttggttttcaaactgacatcgatgggaaaataaggacagaccacaagaaatggaaggatattttaagaccttttgggacagcggtg

SEQ ID NO: 369510 - DNA, 140 bp, Artificial Sequence
  Synthetic
caccgctgtcccaaaaggtcttaaaatatccttccatttcttgtggtctgtccttattttcccatcgatgtcagtttgaaaaccaacttccaccaacagcagctgccttgtttccagctgcatatcagcagccagggcct

SEQ ID NO: 369511 - DNA, 140 bp, Artificial Sequence
  Synthetic
atacgccatgctgggtctccgtgccctaaaatagaagtggttagtcattgcgaaaataaaggctttgaggacagcaatgaatgcttaacagatctagacaggcttgttaggctcacattacgtacttgggagtcggccat

SEQ ID NO: 369512 - DNA, 140 bp, Artificial Sequence
  Synthetic
atggccgactcccaagtacgtaatgtgagcctaacaagcctgtctagatctgttaagcattcattgctgtcctcaaagcctttattttcgcaatgactaaccacttctattttagggcacggagacccagcatggcgtat

SEQ ID NO: 369513 - DNA, 140 bp, Artificial Sequence
  Synthetic
aggccctggctgctgatatgaatttgaaagacaggagtgaggacgatcaaaggctagccgagaagatagacactgttaggaaagagctctcagaatccaaactaaaagattattcaacttgaccttttgggacagcggtg

SEQ ID NO: 369514 - DNA, 140 bp, Artificial Sequence
  Synthetic
caccgctgtcccaaaaggtcaagttgaataatcttttagtttggattctgagagctctttcctaacagtgtctatcttctcggctagcctttgatcgtcctcactcctgtctttcaaattcatatcagcagccagggcct

SEQ ID NO: 369515 - DNA, 140 bp, Artificial Sequence
  Synthetic
atacgccatgctgggtctcccactgttaggaaagagctctcagaatccaaactaaaagattattcaacttatgcaagaggggtgataacaaattcactaaaaaacctctcaaagcagggtcgtacttgggagtcggccat

SEQ ID NO: 369516 - DNA, 140 bp, Artificial Sequence
  Synthetic
atggccgactcccaagtacgaccctgctttgagaggttttttagtgaatttgttatcacccctcttgcataagttgaataatcttttagtttggattctgagagctctttcctaacagtgggagacccagcatggcgtat

SEQ ID NO: 369517 - DNA, 140 bp, Artificial Sequence
  Synthetic
aggccctggctgctgatatgcattgaaagctagatctgagtttgttagaaacaacgataaactactcataaggtcaaaagaagaattaaaaaaatgttttgatgtgcaatcatttaaactgaccttttgggacagcggtg

SEQ ID NO: 369518 - DNA, 140 bp, Artificial Sequence
  Synthetic
caccgctgtcccaaaaggtcagtttaaatgattgcacatcaaaacatttttttaattcttcttttgaccttatgagtagtttatcgttgtttctaacaaactcagatctagctttcaatgcatatcagcagccagggcct

SEQ ID NO: 369519 - DNA, 140 bp, Artificial Sequence
  Synthetic
atacgccatgctgggtctcccaacctcctcagtgttaacttctttagctgccgtacttttcgaagagctagcaatattttatcttaagagaagcttacctcagacaacagtacatgttgacgtacttgggagtcggccat

SEQ ID NO: 369520 - DNA, 140 bp, Artificial Sequence
  Synthetic
atggccgactcccaagtacgtcaacatgtactgttgtctgaggtaagcttctcttaagataaaatattgctagctcttcgaaaagtacggcagctaaagaagttaacactgaggaggttgggagacccagcatggcgtat

SEQ ID NO: 369521 - DNA, 140 bp, Artificial Sequence
  Synthetic
aggccctggctgctgatatgaggtgtcagacagaaggtcctacagctcaagcaagagtagaatccgtagtatttttggtaggtacaactctcagaaaaaaccatttgaattaaggtcagggaccttttgggacagcggtg

SEQ ID NO: 369522 - DNA, 140 bp, Artificial Sequence
  Synthetic
caccgctgtcccaaaaggtccctgaccttaattcaaatggttttttctgagagttgtacctaccaaaaatactacggattctactcttgcttgagctgtaggaccttctgtctgacacctcatatcagcagccagggcct

SEQ ID NO: 369523 - DNA, 140 bp, Artificial Sequence
  Synthetic
aggccctggctgctgatatgacatttgtcaattttctgagtatacaccaaacaaggagagcattttgaaggactgtcttcaaatcatacggaaaaaccctagccacacaatgggttctttgaccttttgggacagcggtg

SEQ ID NO: 369524 - DNA, 140 bp, Artificial Sequence
  Synthetic
caccgctgtcccaaaaggtcaaagaacccattgtgtggctagggtttttccgtatgatttgaagacagtccttcaaaatgctctccttgtttggtgtatactcagaaaattgacaaatgtcatatcagcagccagggcct

SEQ ID NO: 369525 - DNA, 140 bp, Artificial Sequence
  Synthetic
atacgccatgctgggtctccgactgtcttcaaatcatacggaaaaaccctagccacacaatgggttcttttgagctgatccaggcaatttcagagttcggtatgagtaaatttcctccagcgtacttgggagtcggccat

SEQ ID NO: 369526 - DNA, 140 bp, Artificial Sequence
  Synthetic
atggccgactcccaagtacgctggaggaaatttactcataccgaactctgaaattgcctggatcagctcaaaagaacccattgtgtggctagggtttttccgtatgatttgaagacagtcggagacccagcatggcgtat

SEQ ID NO: 369527 - DNA, 140 bp, Artificial Sequence
  Synthetic
aggccctggctgctgatatggaagttactgaaacaacaagtatagtagcatcacccaaaactcatatgatgctcaaagattgttttaaaattatactaggtactgagaataagaagataggaccttttgggacagcggtg

SEQ ID NO: 369528 - DNA, 140 bp, Artificial Sequence
  Synthetic
caccgctgtcccaaaaggtcctatcttcttattctcagtacctagtataattttaaaacaatctttgagcatcatatgagttttgggtgatgctactatacttgttgtttcagtaacttccatatcagcagccagggcct

SEQ ID NO: 369529 - DNA, 140 bp, Artificial Sequence
  Synthetic
atacgccatgctgggtctccttaattgattcatttcactacattaccaatcctctctttctctctctttctttgccactcatttcagtttcattaccattgttattattttggggtgtggcgtacttgggagtcggccat

SEQ ID NO: 369530 - DNA, 140 bp, Artificial Sequence
  Synthetic
atggccgactcccaagtacgccacaccccaaaataataacaatggtaatgaaactgaaatgagtggcaaagaaagagagagaaagagaggattggtaatgtagtgaaatgaatcaattaaggagacccagcatggcgtat

SEQ ID NO: 369531 - DNA, 140 bp, Artificial Sequence
  Synthetic
aggccctggctgctgatatgacatcaccaatcttggaggcaaagtcatcacccagccctagtaaaacatcgatgccgcaaactgcacatcatctctccagaagtcttctctcagcagcaagaccttttgggacagcggtg

SEQ ID NO: 369532 - DNA, 140 bp, Artificial Sequence
  Synthetic
caccgctgtcccaaaaggtcttgctgctgagagaagacttctggagagatgatgtgcagtttgcggcatcgatgttttactagggctgggtgatgactttgcctccaagattggtgatgtcatatcagcagccagggcct

SEQ ID NO: 369533 - DNA, 140 bp, Artificial Sequence
  Synthetic
aggccctggctgctgatatggagttcaatgagttgatcaaactgaagaagcttctcctcaacgagcaacaagatgaacaggagctgaaacaggaccttttgatatcttcttggattaagtgaccttttgggacagcggtg

SEQ ID NO: 369534 - DNA, 140 bp, Artificial Sequence
  Synthetic
caccgctgtcccaaaaggtcacttaatccaagaagatatcaaaaggtcctgtttcagctcctgttcatcttgttgctcgttgaggagaagcttcttcagtttgatcaactcattgaactccatatcagcagccagggcct

SEQ ID NO: 369535 - DNA, 140 bp, Artificial Sequence
  Synthetic
aggccctggctgctgatatgttcatttaccacctttctgaagagctgtatgacataaggctacagcatctggaactgtcgaagcttaagcaagaacaccctagtgtcagcttcactaagggaccttttgggacagcggtg

SEQ ID NO: 369536 - DNA, 140 bp, Artificial Sequence
  Synthetic
caccgctgtcccaaaaggtcccttagtgaagctgacactagggtgttcttgcttaagcttcgacagttccagatgctgtagccttatgtcatacagctcttcagaaaggtggtaaatgaacatatcagcagccagggcct

SEQ ID NO: 369537 - DNA, 140 bp, Artificial Sequence
  Synthetic
atacgccatgctgggtctcccaaagacaacgttttcttgtcactgacagataggtggtctaccaagcacagcacaaactaccgtgatagttgtggcaaacaattaactggtaagataatacgtacttgggagtcggccat

SEQ ID NO: 369538 - DNA, 140 bp, Artificial Sequence
  Synthetic
atggccgactcccaagtacgtattatcttaccagttaattgtttgccacaactatcacggtagtttgtgctgtgcttggtagaccacctatctgtcagtgacaagaaaacgttgtctttgggagacccagcatggcgtat

SEQ ID NO: 369539 - DNA, 140 bp, Artificial Sequence
  Synthetic
atacgccatgctgggtctcctggtttgaggagttcaagaaaggaaatgggcttgtggacaccttcacaaactcatattctttttgtgaaaatgtgccgaacttggacagatttgtgtatccgtacttgggagtcggccat

SEQ ID NO: 369540 - DNA, 140 bp, Artificial Sequence
  Synthetic
atggccgactcccaagtacggatacacaaatctgtccaagttcggcacattttcacaaaaagaatatgagtttgtgaaggtgtccacaagcccatttcctttcttgaactcctcaaaccaggagacccagcatggcgtat

SEQ ID NO: 369541 - DNA, 140 bp, Artificial Sequence
  Synthetic
aggccctggctgctgatatgatttctacaaagtcatatgtatctcaggtgataataccaaatggggcccaatacactgctgttccttcttttccggcatgatgcagcaggtcctgaaaaagaccttttgggacagcggtg

SEQ ID NO: 369542 - DNA, 140 bp, Artificial Sequence
  Synthetic
caccgctgtcccaaaaggtctttttcaggacctgctgcatcatgccggaaaagaaggaacagcagtgtattgggccccatttggtattatcacctgagatacatatgactttgtagaaatcatatcagcagccagggcct

SEQ ID NO: 369543 - DNA, 140 bp, Artificial Sequence
  Synthetic
atacgccatgctgggtctccatacactgctgttccttcttttccggcatgatgcagcaggtcctgaaaaatgttccagattggtgttcattttataaattaacatttattaagaacttgtcgtacttgggagtcggccat

SEQ ID NO: 369544 - DNA, 140 bp, Artificial Sequence
  Synthetic
atggccgactcccaagtacgacaagttcttaataaatgttaatttataaaatgaacaccaatctggaacatttttcaggacctgctgcatcatgccggaaaagaaggaacagcagtgtatggagacccagcatggcgtat

SEQ ID NO: 369545 - DNA, 140 bp, Artificial Sequence
  Synthetic
atacgccatgctgggtctccccctggagatctcccctaagattcaaacaacacagagtcaacagactgcaacaccagcaatcgcacctgccaccactgctattgcattcataagccctaccgtacttgggagtcggccat

SEQ ID NO: 369546 - DNA, 140 bp, Artificial Sequence
  Synthetic
atggccgactcccaagtacggtagggcttatgaatgcaatagcagtggtggcaggtgcgattgctggtgttgcagtctgttgactctgtgttgtttgaatcttaggggagatctccagggggagacccagcatggcgtat

SEQ ID NO: 369547 - DNA, 140 bp, Artificial Sequence
  Synthetic
aggccctggctgctgatatgacacagttaagtttttagttacaacctatataagcaaaggactcatggcgttaaacagttacaaccatatgggtcagggtattcaccatgcaacatcttcgaccttttgggacagcggtg

SEQ ID NO: 369548 - DNA, 140 bp, Artificial Sequence
  Synthetic
caccgctgtcccaaaaggtcgaagatgttgcatggtgaataccctgacccatatggttgtaactgtttaacgccatgagtcctttgcttatataggttgtaactaaaaacttaactgtgtcatatcagcagccagggcct

SEQ ID NO: 369549 - DNA, 140 bp, Artificial Sequence
  Synthetic
aggccctggctgctgatatgcagaacaaggcaaccagcaaagcgccgttgaacacgagagtccaagcatctcggccttcagggactatggagagagaggaatagttgaggagaatcacatgaccttttgggacagcggtg

SEQ ID NO: 369550 - DNA, 140 bp, Artificial Sequence
  Synthetic
caccgctgtcccaaaaggtcatgtgattctcctcaactattcctctctctccatagtccctgaaggccgagatgcttggactctcgtgttcaacggcgctttgctggttgccttgttctgcatatcagcagccagggcct

SEQ ID NO: 369551 - DNA, 140 bp, Artificial Sequence
  Synthetic
aggccctggctgctgatatgggtcagctctacaggcattgtaaagaaaggtttggagtggtttgaaaagaacacgagcactatcaaatcctgggacgagagctacactgagctgaaggttgaccttttgggacagcggtg

SEQ ID NO: 369552 - DNA, 140 bp, Artificial Sequence
  Synthetic
caccgctgtcccaaaaggtcaaccttcagctcagtgtagctctcgtcccaggatttgatagtgctcgtgttcttttcaaaccactccaaacctttctttacaatgcctgtagagctgacccatatcagcagccagggcct

SEQ ID NO: 369553 - DNA, 140 bp, Artificial Sequence
  Synthetic
aggccctggctgctgatatggccaagactttagtgagcgactgtttccttgaattttacagcgagtttatgatgggctatagagtaacccctgctgtgatcaaattcatgttcactggacgaccttttgggacagcggtg

SEQ ID NO: 369554 - DNA, 140 bp, Artificial Sequence
  Synthetic
caccgctgtcccaaaaggtcgtccagtgaacatgaatttgatcacagcaggggttactctatagcccatcataaactcgctgtaaaattcaaggaaacagtcgctcactaaagtcttggccatatcagcagccagggcct

SEQ ID NO: 369555 - DNA, 140 bp, Artificial Sequence
  Synthetic
atacgccatgctgggtctcccaccttcacactattaaggcaacaaattttctttaaccatgttgaggattttatcagaaggtacggcatattaactcttgggactttgtctccctttggtcgtacttgggagtcggccat

SEQ ID NO: 369556 - DNA, 140 bp, Artificial Sequence
  Synthetic
atggccgactcccaagtacgaccaaagggagacaaagtcccaagagttaatatgccgtaccttctgataaaatcctcaacatggttaaagaaaatttgttgccttaatagtgtgaaggtgggagacccagcatggcgtat

SEQ ID NO: 369557 - DNA, 140 bp, Artificial Sequence
  Synthetic
aggccctggctgctgatatgtaaaggcatcactgaatagagatgacaacaaaatcatcgaagaccccatgatacaattaattccagagaagctgaggagagagctggagaggttaggtgtgaccttttgggacagcggtg

SEQ ID NO: 369558 - DNA, 140 bp, Artificial Sequence
  Synthetic
caccgctgtcccaaaaggtcacacctaacctctccagctctctcctcagcttctctggaattaattgtatcatggggtcttcgatgattttgttgtcatctctattcagtgatgcctttacatatcagcagccagggcct

SEQ ID NO: 369559 - DNA, 140 bp, Artificial Sequence
  Synthetic
aggccctggctgctgatatgcagtgatgccataatggaagtggagagtaaaagtagcctactacacaaatacctcaaatcaggaggtgttaggcaacggaataccgaggtgattttcagagaccttttgggacagcggtg

SEQ ID NO: 369560 - DNA, 140 bp, Artificial Sequence
  Synthetic
caccgctgtcccaaaaggtctctgaaaatcacctcggtattccgttgcctaacacctcctgatttgaggtatttgtgtagtaggctacttttactctccacttccattatggcatcactgcatatcagcagccagggcct

SEQ ID NO: 369561 - DNA, 140 bp, Artificial Sequence
  Synthetic
atacgccatgctgggtctccaaatgttttgcatgggttggctggaggaattaaggagctatcgctcccaatatacacgatattcatgaaatcttacttcttcaaagacaacgttttcttacgtacttgggagtcggccat

SEQ ID NO: 369562 - DNA, 140 bp, Artificial Sequence
  Synthetic
atggccgactcccaagtacgtaagaaaacgttgtctttgaagaagtaagatttcatgaatatcgtgtatattgggagcgatagctccttaattcctccagccaacccatgcaaaacatttggagacccagcatggcgtat

SEQ ID NO: 369563 - DNA, 140 bp, Artificial Sequence
  Synthetic
aggccctggctgctgatatggcaacaaagtgcttgcagagtacaaggttccaggagagatcttggtgcctgtcaaagagatgctgtcagacatgataaggagaaggaacattatccttaagaccttttgggacagcggtg

SEQ ID NO: 369564 - DNA, 140 bp, Artificial Sequence
  Synthetic
caccgctgtcccaaaaggtcttaaggataatgttccttctccttatcatgtctgacagcatctctttgacaggcaccaagatctctcctggaaccttgtactctgcaagcactttgttgccatatcagcagccagggcct

SEQ ID NO: 369565 - DNA, 140 bp, Artificial Sequence
  Synthetic
aggccctggctgctgatatgagacagaaacttagaatagttgagtctagacctgcggaatctgagctagaggcaaaccgtgcagtaattgttaagaccaaattgttctcagcaacagaacgaccttttgggacagcggtg

SEQ ID NO: 369566 - DNA, 140 bp, Artificial Sequence
  Synthetic
caccgctgtcccaaaaggtcgttctgttgctgagaacaatttggtcttaacaattactgcacggtttgcctctagctcagattccgcaggtctagactcaactattctaagtttctgtctcatatcagcagccagggcct

SEQ ID NO: 369567 - DNA, 140 bp, Artificial Sequence
  Synthetic
aggccctggctgctgatatgagtttcttgaactggagggtgaacatggacattagaacttctgactgtccactatctagtcatgaggcaagtatactgagtgagtttgatggacaagtaagaccttttgggacagcggtg

SEQ ID NO: 369568 - DNA, 140 bp, Artificial Sequence
  Synthetic
caccgctgtcccaaaaggtcttacttgtccatcaaactcactcagtatacttgcctcatgactagatagtggacagtcagaagttctaatgtccatgttcaccctccagttcaagaaactcatatcagcagccagggcct

SEQ ID NO: 369569 - DNA, 140 bp, Artificial Sequence
  Synthetic
aggccctggctgctgatatgccttggggtgacatcaacaaatcaggtcgctccgggattgcacttgtcgcaaccggtcttgccaagctggcagagactgaaggtaaaggagtcttcgaaggaccttttgggacagcggtg

SEQ ID NO: 369570 - DNA, 140 bp, Artificial Sequence
  Synthetic
caccgctgtcccaaaaggtccttcgaagactcctttaccttcagtctctgccagcttggcaagaccggttgcgacaagtgcaatcccggagcgacctgatttgttgatgtcaccccaaggcatatcagcagccagggcct

SEQ ID NO: 369571 - DNA, 140 bp, Artificial Sequence
  Synthetic
aggccctggctgctgatatgtccattggaatcttcattgcaggaaaattgcacatccatctctcatctgagtccattgccttattgtgtgaaactgaaagacaagtgctatcttggatgagaccttttgggacagcggtg

SEQ ID NO: 369572 - DNA, 140 bp, Artificial Sequence
  Synthetic
caccgctgtcccaaaaggtctcatccaagatagcacttgtctttcagtttcacacaataaggcaatggactcagatgagagatggatgtgcaattttcctgcaatgaagattccaatggacatatcagcagccagggcct

SEQ ID NO: 369573 - DNA, 140 bp, Artificial Sequence
  Synthetic
atacgccatgctgggtctccgatgaagtcgacaagacaagtgctgacaacatggtgacaagccttttgaaacatattgccaaggctcaggaactctacaagaactcatctgcacttcgtgcgtacttgggagtcggccat

SEQ ID NO: 369574 - DNA, 140 bp, Artificial Sequence
  Synthetic
atggccgactcccaagtacgcacgaagtgcagatgagttcttgtagagttcctgagccttggcaatatgtttcaaaaggcttgtcaccatgttgtcagcacttgtcttgtcgacttcatcggagacccagcatggcgtat

SEQ ID NO: 369575 - DNA, 140 bp, Artificial Sequence
  Synthetic
aggccctggctgctgatatgaagtttctacttgcatttcttctttatgaagaagtgttgatgaacttaatcaaccagtgtaaggcagtaaaggaactcattaacagcacaggactctcaggaccttttgggacagcggtg

SEQ ID NO: 369576 - DNA, 140 bp, Artificial Sequence
  Synthetic
caccgctgtcccaaaaggtcctgagagtcctgtgctgttaatgagttcctttactgccttacactggttgattaagttcatcaacacttcttcataaagaagaaatgcaagtagaaacttcatatcagcagccagggcct

SEQ ID NO: 369577 - DNA, 140 bp, Artificial Sequence
  Synthetic
atacgccatgctgggtctccgacctagatgttcctttgcagcactattaagcctagttcatgaagattggcaaaagatagggagaaatatccttgttcgtgcaaacaatgagctaggcgacgtacttgggagtcggccat

SEQ ID NO: 369578 - DNA, 140 bp, Artificial Sequence
  Synthetic
atggccgactcccaagtacgtcgcctagctcattgtttgcacgaacaaggatatttctccctatcttttgccaatcttcatgaactaggcttaatagtgctgcaaaggaacatctaggtcggagacccagcatggcgtat

SEQ ID NO: 369579 - DNA, 140 bp, Artificial Sequence
  Synthetic
atacgccatgctgggtctcccaaaagatagggagaaatatccttgttcgtgcaaacaatgagctaggcgatgtgtcactgaaggttaatattgtcttggtacccctcaaggacatgtccacgtacttgggagtcggccat

SEQ ID NO: 369580 - DNA, 140 bp, Artificial Sequence
  Synthetic
atggccgactcccaagtacgtggacatgtccttgaggggtaccaagacaatattaaccttcagtgacacatcgcctagctcattgtttgcacgaacaaggatatttctccctatcttttgggagacccagcatggcgtat

SEQ ID NO: 369581 - DNA, 140 bp, Artificial Sequence
  Synthetic
aggccctggctgctgatatgttactattctaaaggacaacagcacaaggctagattacaataagttgattgaccattgtgtggatatggaaaaaaagagggaagcagttagagcagtagagaccttttgggacagcggtg

SEQ ID NO: 369582 - DNA, 140 bp, Artificial Sequence
  Synthetic
caccgctgtcccaaaaggtctctactgctctaactgcttccctctttttttccatatccacacaatggtcaatcaacttattgtaatctagccttgtgctgttgtcctttagaatagtaacatatcagcagccagggcct

SEQ ID NO: 369583 - DNA, 140 bp, Artificial Sequence
  Synthetic
aggccctggctgctgatatgcacaaattgaacacaaggatgagcagtgtcaagagcaaataagcttggatgacctaatggcaagtgatacagcgatagacttgcctgacagggaagcagagaccttttgggacagcggtg

SEQ ID NO: 369584 - DNA, 140 bp, Artificial Sequence
  Synthetic
caccgctgtcccaaaaggtctctgcttccctgtcaggcaagtctatcgctgtatcacttgccattaggtcatccaagcttatttgctcttgacactgctcatccttgtgttcaatttgtgcatatcagcagccagggcct

SEQ ID NO: 369585 - DNA, 140 bp, Artificial Sequence
  Synthetic
atacgccatgctgggtctccggttaggggtttctagaatggaagtcgatgaactaatgccaagtattagccctgatgacaccttggcccagcttgtggcaaaaaaactaatcagcctcaacgtacttgggagtcggccat

SEQ ID NO: 369586 - DNA, 140 bp, Artificial Sequence
  Synthetic
atggccgactcccaagtacgttgaggctgattagtttttttgccacaagctgggccaaggtgtcatcagggctaatacttggcattagttcatcgacttccattctagaaacccctaaccggagacccagcatggcgtat

SEQ ID NO: 369587 - DNA, 140 bp, Artificial Sequence
  Synthetic
aggccctggctgctgatatgctgctctgtacttcttgctgtcaattcagctgcctccgttaatctattttgccatcctgccattcttctttctctaacattcataccagtttcattatttgaccttttgggacagcggtg

SEQ ID NO: 369588 - DNA, 140 bp, Artificial Sequence
  Synthetic
caccgctgtcccaaaaggtcaaataatgaaactggtatgaatgttagagaaagaagaatggcaggatggcaaaatagattaacggaggcagctgaattgacagcaagaagtacagagcagcatatcagcagccagggcct

SEQ ID NO: 369589 - DNA, 140 bp, Artificial Sequence
  Synthetic
atacgccatgctgggtctcctgagcttggaaagcagccaaggggcaccaagaaaatgaagaaagctctgctcagcactcccatgaagtggggaaagaagctctatgagctctttgcagatcgtacttgggagtcggccat

SEQ ID NO: 369590 - DNA, 140 bp, Artificial Sequence
  Synthetic
atggccgactcccaagtacgatctgcaaagagctcatagagcttctttccccacttcatgggagtgctgagcagagctttcttcattttcttggtgccccttggctgctttccaagctcaggagacccagcatggcgtat

SEQ ID NO: 369591 - DNA, 140 bp, Artificial Sequence
  Synthetic
aggccctggctgctgatatgaagaagaccttacaaacttttgccaccaagaatgtcaagtaacagaaactgagtgtctttgcccgtatgaagccttaattctcagaaagcctctttacctgaccttttgggacagcggtg

SEQ ID NO: 369592 - DNA, 140 bp, Artificial Sequence
  Synthetic
caccgctgtcccaaaaggtcaggtaaagaggctttctgagaattaaggcttcatacgggcaaagacactcagtttctgttacttgacattcttggtggcaaaagtttgtaaggtcttcttcatatcagcagccagggcct

SEQ ID NO: 369593 - DNA, 140 bp, Artificial Sequence
  Synthetic
atacgccatgctgggtctccgacgaagttgacagagcgagtgctgacagcatgataacaaaccttctcaagcacattgccaaggcacaggagctttataagaattcgtctgcactccgtgcgtacttgggagtcggccat

SEQ ID NO: 369594 - DNA, 140 bp, Artificial Sequence
  Synthetic
atggccgactcccaagtacgcacggagtgcagacgaattcttataaagctcctgtgccttggcaatgtgcttgagaaggtttgttatcatgctgtcagcactcgctctgtcaacttcgtcggagacccagcatggcgtat

SEQ ID NO: 369595 - DNA, 140 bp, Artificial Sequence
  Synthetic
atacgccatgctgggtctcctggcctctgagcacttgctgcaccagtctcttgttggcaaacaatctccattccagaacgcctacaacgtcaagggcaatgccaccagtgctaacattatcgtacttgggagtcggccat

SEQ ID NO: 369596 - DNA, 140 bp, Artificial Sequence
  Synthetic
atggccgactcccaagtacgataatgttagcactggtggcattgcccttgacgttgtaggcgttctggaatggagattgtttgccaacaagagactggtgcagcaagtgctcagaggccaggagacccagcatggcgtat

SEQ ID NO: 369597 - DNA, 140 bp, Artificial Sequence
  Synthetic
atacgccatgctgggtctccctaaaactcaaggtgtttcacattcagcttttctcctcctgcatcactacttacagttatgactattaatcacgtttattttaattgcttatataatgctcgtacttgggagtcggccat

SEQ ID NO: 369598 - DNA, 140 bp, Artificial Sequence
  Synthetic
atggccgactcccaagtacgagcattatataagcaattaaaataaacgtgattaatagtcataactgtaagtagtgatgcaggaggagaaaagctgaatgtgaaacaccttgagttttagggagacccagcatggcgtat

SEQ ID NO: 369599 - DNA, 140 bp, Artificial Sequence
  Synthetic
atacgccatgctgggtctccgctgctaatcaatcttgccctttgtcagctccttgagggcaatgatggagttaccagtgcagatgaaatcaattccaacacaacacagaccagcctgggacgtacttgggagtcggccat

SEQ ID NO: 369600 - DNA, 140 bp, Artificial Sequence
  Synthetic
atggccgactcccaagtacgtcccaggctggtctgtgttgtgttggaattgatttcatctgcactggtaactccatcattgccctcaaggagctgacaaagggcaagattgattagcagcggagacccagcatggcgtat

SEQ ID NO: 369601 - DNA, 140 bp, Artificial Sequence
  Synthetic
aggccctggctgctgatatgttaccagtgcagatgaaatcaattccaacacaacacagaccagcctgggacttccaaccattctgaatagtacaactcctgcaccaggaccatcaatagagaccttttgggacagcggtg

SEQ ID NO: 369602 - DNA, 140 bp, Artificial Sequence
  Synthetic
caccgctgtcccaaaaggtctctattgatggtcctggtgcaggagttgtactattcagaatggttggaagtcccaggctggtctgtgttgtgttggaattgatttcatctgcactggtaacatatcagcagccagggcct

SEQ ID NO: 369603 - DNA, 140 bp, Artificial Sequence
  Synthetic
atacgccatgctgggtctcccttccaaccattctgaatagtacaactcctgcaccaggaccatcaatagatgctaccatggaggcagtaccaggcacgaccaacagtgtgctggaaacaccgtacttgggagtcggccat

SEQ ID NO: 369604 - DNA, 140 bp, Artificial Sequence
  Synthetic
atggccgactcccaagtacggtgtttccagcacactgttggtcgtgcctggtactgcctccatggtagcatctattgatggtcctggtgcaggagttgtactattcagaatggttggaagggagacccagcatggcgtat

SEQ ID NO: 369605 - DNA, 140 bp, Artificial Sequence
  Synthetic
atacgccatgctgggtctccactagggaagcaacaacccccatcactgctgccactgtcagtgcgcaggaaacaaaaacacacatgactcagaacccaggaaccacagtagatccagacacgtacttgggagtcggccat

SEQ ID NO: 369606 - DNA, 140 bp, Artificial Sequence
  Synthetic
atggccgactcccaagtacgtgtctggatctactgtggttcctgggttctgagtcatgtgtgtttttgtttcctgcgcactgacagtggcagcagtgatgggggttgttgcttccctagtggagacccagcatggcgtat

SEQ ID NO: 369607 - DNA, 140 bp, Artificial Sequence
  Synthetic
aggccctggctgctgatatgaacaaaaacacacatgactcagaacccaggaaccacagtagatccagacaccactacctccaataccaccacatcgattgaaccaatcaccactccaccagaccttttgggacagcggtg

SEQ ID NO: 369608 - DNA, 140 bp, Artificial Sequence
  Synthetic
caccgctgtcccaaaaggtctggtggagtggtgattggttcaatcgatgtggtggtattggaggtagtggtgtctggatctactgtggttcctgggttctgagtcatgtgtgtttttgttcatatcagcagccagggcct

SEQ ID NO: 369609 - DNA, 140 bp, Artificial Sequence
  Synthetic
aggccctggctgctgatatgctaaggacaaacactgagtccaacaatccgtgtgccaggaccattgtcaagcttttcgaaattcagaagacgggctttgacataaaggacatggacatcggaccttttgggacagcggtg

SEQ ID NO: 369610 - DNA, 140 bp, Artificial Sequence
  Synthetic
caccgctgtcccaaaaggtccgatgtccatgtcctttatgtcaaagcccgtcttctgaatttcgaaaagcttgacaatggtcctggcacacggattgttggactcagtgtttgtccttagcatatcagcagccagggcct

SEQ ID NO: 369611 - DNA, 140 bp, Artificial Sequence
  Synthetic
atacgccatgctgggtctcctacactgccgaacacacatcatctctccagaagtcttctttcagctgtgggcactgaagcaggtcagacggcaccagcaacgcccacggctgaagtggcccgtacttgggagtcggccat

SEQ ID NO: 369612 - DNA, 140 bp, Artificial Sequence
  Synthetic
atggccgactcccaagtacgggccacttcagccgtgggcgttgctggtgccgtctgacctgcttcagtgcccacagctgaaagaagacttctggagagatgatgtgtgttcggcagtgtaggagacccagcatggcgtat

SEQ ID NO: 369613 - DNA, 140 bp, Artificial Sequence
  Synthetic
aggccctggctgctgatatggcactgaagcaggtcagacggcaccagcaacgcccacggctgaagtggccttggccccaggcggctcatctacagctgagagcaacacaatatccataccgaccttttgggacagcggtg

SEQ ID NO: 369614 - DNA, 140 bp, Artificial Sequence
  Synthetic
caccgctgtcccaaaaggtcggtatggatattgtgttgctctcagctgtagatgagccgcctggggccaaggccacttcagccgtgggcgttgctggtgccgtctgacctgcttcagtgccatatcagcagccagggcct

SEQ ID NO: 369615 - DNA, 140 bp, Artificial Sequence
  Synthetic
atacgccatgctgggtctccccacaggaatctccccagaggcccagacaatgcagagccaacaggccgttgcaccagtgaccacacctgccaccgccatctctgcacccacaagcccaaccgtacttgggagtcggccat

SEQ ID NO: 369616 - DNA, 140 bp, Artificial Sequence
  Synthetic
atggccgactcccaagtacggttgggcttgtgggtgcagagatggcggtggcaggtgtggtcactggtgcaacggcctgttggctctgcattgtctgggcctctggggagattcctgtggggagacccagcatggcgtat

SEQ ID NO: 369617 - DNA, 140 bp, Artificial Sequence
  Synthetic
aggccctggctgctgatatggcaccagtgaccacacctgccaccgccatctctgcacccacaagcccaacgaacagatccaaaagggagtctaaagtgcaaataattctgacctttcctcgaccttttgggacagcggtg

SEQ ID NO: 369618 - DNA, 140 bp, Artificial Sequence
  Synthetic
caccgctgtcccaaaaggtcgaggaaaggtcagaattatttgcactttagactcccttttggatctgttcgttgggcttgtgggtgcagagatggcggtggcaggtgtggtcactggtgccatatcagcagccagggcct

SEQ ID NO: 369619 - DNA, 140 bp, Artificial Sequence
  Synthetic
atacgccatgctgggtctcccaagaagaggactctgaaggcctacttgaatggtgcacacgagtgcttcaacaggtatgtgatgatacctacttcaatgagaggataaaagaattttttacgtacttgggagtcggccat

SEQ ID NO: 369620 - DNA, 140 bp, Artificial Sequence
  Synthetic
atggccgactcccaagtacgtaaaaaattcttttatcctctcattgaagtaggtatcatcacatacctgttgaagcactcgtgtgcaccattcaagtaggccttcagagtcctcttcttgggagacccagcatggcgtat

SEQ ID NO: 369621 - DNA, 140 bp, Artificial Sequence
  Synthetic
atacgccatgctgggtctcctaactgggaaaggttacttcaatgatgtacttcagtttaagttgcacgacactcccgctaccaccgttccagccctggccgcctcatctacagccatgcccgtacttgggagtcggccat

SEQ ID NO: 369622 - DNA, 140 bp, Artificial Sequence
  Synthetic
atggccgactcccaagtacgggcatggctgtagatgaggcggccagggctggaacggtggtagcgggagtgtcgtgcaacttaaactgaagtacatcattgaagtaacctttcccagttaggagacccagcatggcgtat

SEQ ID NO: 369623 - DNA, 140 bp, Artificial Sequence
  Synthetic
aggccctggctgctgatatgtctctgctaaatgttatccaagagcatcaaactcaggaatgcagctaatcaatgtcacacaacacccaatgaagatagccaacactccaggcccaaagatgaccttttgggacagcggtg

SEQ ID NO: 369624 - DNA, 140 bp, Artificial Sequence
  Synthetic
caccgctgtcccaaaaggtcatctttgggcctggagtgttggctatcttcattgggtgttgtgtgacattgattagctgcattcctgagtttgatgctcttggataacatttagcagagacatatcagcagccagggcct

SEQ ID NO: 369625 - DNA, 140 bp, Artificial Sequence
  Synthetic
atacgccatgctgggtctccaggaacatagtgagcttgagatcaatgtgcttatacctcaggttgctgtcaacctttcaaactgttttgtttcaatcaagtcacatgtctgtgactactccgtacttgggagtcggccat

SEQ ID NO: 369626 - DNA, 140 bp, Artificial Sequence
  Synthetic
atggccgactcccaagtacggagtagtcacagacatgtgacttgattgaaacaaaacagtttgaaaggttgacagcaacctgaggtataagcacattgatctcaagctcactatgttcctggagacccagcatggcgtat

SEQ ID NO: 369627 - DNA, 140 bp, Artificial Sequence
  Synthetic
aggccctggctgctgatatgaacctttcaaactgttttgtttcaatcaagtcacatgtctgtgactactccctggacactgatggagcaatacgtctcccgaaagtcgcacacaacgggggaccttttgggacagcggtg

SEQ ID NO: 369628 - DNA, 140 bp, Artificial Sequence
  Synthetic
caccgctgtcccaaaaggtcccccgttgtgtgcgactttcgggagacgtattgctccatcagtgtccagggagtagtcacagacatgtgacttgattgaaacaaaacagtttgaaaggttcatatcagcagccagggcct

SEQ ID NO: 369629 - DNA, 140 bp, Artificial Sequence
  Synthetic
atacgccatgctgggtctccaatgatagatgcgcgctaatcaccaactgtgtcatcaaaggaagagaagttcgaaaggggcagtcaactttgagacagtataaaacagaaataagaattgcgtacttgggagtcggccat

SEQ ID NO: 369630 - DNA, 140 bp, Artificial Sequence
  Synthetic
atggccgactcccaagtacgcaattcttatttctgttttatactgtctcaaagttgactgcccctttcgaacttctcttcctttgatgacacagttggtgattagcgcgcatctatcattggagacccagcatggcgtat

SEQ ID NO: 369631 - DNA, 140 bp, Artificial Sequence
  Synthetic
aggccctggctgctgatatgtcgaaaggggcagtcaactttgagacagtataaaacagaaataagaattgggcaaacaattgcaggctcaagaagattgcttgcagaaggagtgagcaatgaccttttgggacagcggtg

SEQ ID NO: 369632 - DNA, 140 bp, Artificial Sequence
  Synthetic
caccgctgtcccaaaaggtcattgctcactccttctgcaagcaatcttcttgagcctgcaattgtttgcccaattcttatttctgttttatactgtctcaaagttgactgcccctttcgacatatcagcagccagggcct

SEQ ID NO: 369633 - DNA, 140 bp, Artificial Sequence
  Synthetic
atacgccatgctgggtctcctgaagatagttatggtgggcctggagaaaaaataacaatctgcaacggctccacaatcgtggaccaaagactcggtagcgaactaggctgctacacaatccgtacttgggagtcggccat

SEQ ID NO: 369634 - DNA, 140 bp, Artificial Sequence
  Synthetic
atggccgactcccaagtacggattgtgtagcagcctagttcgctaccgagtctttggtccacgattgtggagccgttgcagattgttattttttctccaggcccaccataactatcttcaggagacccagcatggcgtat

SEQ ID NO: 369635 - DNA, 140 bp, Artificial Sequence
  Synthetic
aggccctggctgctgatatgccacaatcgtggaccaaagactcggtagcgaactaggctgctacacaatcaaccgtgtgaagacttataagctttgtgagaatagtgctacagagaaggggaccttttgggacagcggtg

SEQ ID NO: 369636 - DNA, 140 bp, Artificial Sequence
  Synthetic
caccgctgtcccaaaaggtccccttctctgtagcactattctcacaaagcttataagtcttcacacggttgattgtgtagcagcctagttcgctaccgagtctttggtccacgattgtggcatatcagcagccagggcct

SEQ ID NO: 369637 - DNA, 140 bp, Artificial Sequence
  Synthetic
atacgccatgctgggtctccaagtaacccaagagggcaggggccatgtaaaactgtccagaggaacggaaattgtcctagatgtatgtgacaccagttgtgagttgatgatacccaaaggcgtacttgggagtcggccat

SEQ ID NO: 369638 - DNA, 140 bp, Artificial Sequence
  Synthetic
atggccgactcccaagtacgcctttgggtatcatcaactcacaactggtgtcacatacatctaggacaatttccgttcctctggacagttttacatggcccctgccctcttgggttacttggagacccagcatggcgtat

SEQ ID NO: 369639 - DNA, 140 bp, Artificial Sequence
  Synthetic
aggccctggctgctgatatgattgtcctagatgtatgtgacaccagttgtgagttgatgatacccaaaggcactggggacatattggtggactgctcaggaggacagcagcactttttgcgaccttttgggacagcggtg

SEQ ID NO: 369640 - DNA, 140 bp, Artificial Sequence
  Synthetic
caccgctgtcccaaaaggtcgcaaaaagtgctgctgtcctcctgagcagtccaccaatatgtccccagtgcctttgggtatcatcaactcacaactggtgtcacatacatctaggacaatcatatcagcagccagggcct

SEQ ID NO: 369641 - DNA, 140 bp, Artificial Sequence
  Synthetic
atacgccatgctgggtctccatggcaatatatatctgcaggatgtcaaatcatcctaaaactaccatggcttttttgttctggtttagctttggctatgtcatcacatgcatagtatgtacgtacttgggagtcggccat

SEQ ID NO: 369642 - DNA, 140 bp, Artificial Sequence
  Synthetic
atggccgactcccaagtacgtacatactatgcatgtgatgacatagccaaagctaaaccagaacaaaaaagccatggtagttttaggatgatttgacatcctgcagatatatattgccatggagacccagcatggcgtat

SEQ ID NO: 369643 - DNA, 140 bp, Artificial Sequence
  Synthetic
aggccctggctgctgatatgttttttgttctggtttagctttggctatgtcatcacatgcatagtatgtaaagtgcttttctatctgctaattgtcatcgggacactaagtaagaaacttgaccttttgggacagcggtg

SEQ ID NO: 369644 - DNA, 140 bp, Artificial Sequence
  Synthetic
caccgctgtcccaaaaggtcaagtttcttacttagtgtcccgatgacaattagcagatagaaaagcactttacatactatgcatgtgatgacatagccaaagctaaaccagaacaaaaaacatatcagcagccagggcct

SEQ ID NO: 369645 - DNA, 140 bp, Artificial Sequence
  Synthetic
atacgccatgctgggtctccccctgttaatgcaatagatgctgaaatgcacgagctcaattgtaattacaacatatgcccatactgcgcgtccagactaacttcagatggactagtcagacgtacttgggagtcggccat

SEQ ID NO: 369646 - DNA, 140 bp, Artificial Sequence
  Synthetic
atggccgactcccaagtacgtctgactagtccatctgaagttagtctggacgcgcagtatgggcatatgttgtaattacaattgagctcgtgcatttcagcatctattgcattaacagggggagacccagcatggcgtat

SEQ ID NO: 369647 - DNA, 140 bp, Artificial Sequence
  Synthetic
aggccctggctgctgatatgacatatgcccatactgcgcgtccagactaacttcagatggactagtcagacatgtgaatcaatgtcccaaaaggaaagaaaaggtcgaggagactgaactgaccttttgggacagcggtg

SEQ ID NO: 369648 - DNA, 140 bp, Artificial Sequence
  Synthetic
caccgctgtcccaaaaggtcagttcagtctcctcgaccttttctttccttttgggacattgattcacatgtctgactagtccatctgaagttagtctggacgcgcagtatgggcatatgtcatatcagcagccagggcct

SEQ ID NO: 369649 - DNA, 140 bp, Artificial Sequence
  Synthetic
atacgccatgctgggtctcctgtcagagtcaacggggatggctctaaagagaagttgctggatgaccacactcctcattctgctagtagtttcattatcgccagttcaatctgctccagtcgtacttgggagtcggccat

SEQ ID NO: 369650 - DNA, 140 bp, Artificial Sequence
  Synthetic
atggccgactcccaagtacgactggagcagattgaactggcgataatgaaactactagcagaatgaggagtgtggtcatccagcaacttctctttagagccatccccgttgactctgacaggagacccagcatggcgtat

SEQ ID NO: 369651 - DNA, 140 bp, Artificial Sequence
  Synthetic
aggccctggctgctgatatgctcctcattctgctagtagtttcattatcgccagttcaatctgctccagttggtcaggggaaagcagtcgaagtctaccgggtgagagaaagctacacaagaccttttgggacagcggtg

SEQ ID NO: 369652 - DNA, 140 bp, Artificial Sequence
  Synthetic
caccgctgtcccaaaaggtcttgtgtagctttctctcacccggtagacttcgactgctttcccctgaccaactggagcagattgaactggcgataatgaaactactagcagaatgaggagcatatcagcagccagggcct

SEQ ID NO: 369653 - DNA, 140 bp, Artificial Sequence
  Synthetic
atacgccatgctgggtctccataaagggtttgattgacggtatcggcaacagttttttccctgggctttctgtctgcaaaacatgctctattggcagcataaatgggttcgagatagagtcgtacttgggagtcggccat

SEQ ID NO: 369654 - DNA, 140 bp, Artificial Sequence
  Synthetic
atggccgactcccaagtacgactctatctcgaacccatttatgctgccaatagagcatgttttgcagacagaaagcccagggaaaaaactgttgccgataccgtcaatcaaaccctttatggagacccagcatggcgtat

SEQ ID NO: 369655 - DNA, 140 bp, Artificial Sequence
  Synthetic
aggccctggctgctgatatgtgtctgcaaaacatgctctattggcagcataaatgggttcgagatagagtctcacaaatgctattgtagtctgttttgttgtccttattgcagagcttgcgaccttttgggacagcggtg

SEQ ID NO: 369656 - DNA, 140 bp, Artificial Sequence
  Synthetic
caccgctgtcccaaaaggtcgcaagctctgcaataaggacaacaaaacagactacaatagcatttgtgagactctatctcgaacccatttatgctgccaatagagcatgttttgcagacacatatcagcagccagggcct

SEQ ID NO: 369657 - DNA, 140 bp, Artificial Sequence
  Synthetic
aggccctggctgctgatatggtgtgcgtgaaacgtcctgcatgcaatatgccggatcacttcatacttctgttgcttatgtacactgttttccatcaacacccacaggatgtcagtgcaagaccttttgggacagcggtg

SEQ ID NO: 369658 - DNA, 140 bp, Artificial Sequence
  Synthetic
caccgctgtcccaaaaggtcttgcactgacatcctgtgggtgttgatggaaaacagtgtacataagcaacagaagtatgaagtgatccggcatattgcatgcaggacgtttcacgcacaccatatcagcagccagggcct

SEQ ID NO: 369659 - DNA, 140 bp, Artificial Sequence
  Synthetic
atacgccatgctgggtctccgaaagcgggtagcaatgttatgctggctgtctgtaagcgtatgtgctttaaggcaactgttgaagcaagcaacacagccttgctcatcaggggtatcatacgtacttgggagtcggccat

SEQ ID NO: 369660 - DNA, 140 bp, Artificial Sequence
  Synthetic
atggccgactcccaagtacgtatgatacccctgatgagcaaggctgtgttgcttgcttcaacagttgccttaaagcacatacgcttacagacagccagcataacattgctacccgctttcggagacccagcatggcgtat

SEQ ID NO: 369661 - DNA, 140 bp, Artificial Sequence
  Synthetic
aggccctggctgctgatatgaggcaactgttgaagcaagcaacacagccttgctcatcaggggtatcataaattccacttttgtgatatgcgtactgatcctggttatctgtgtggtaaggaccttttgggacagcggtg

SEQ ID NO: 369662 - DNA, 140 bp, Artificial Sequence
  Synthetic
caccgctgtcccaaaaggtccttaccacacagataaccaggatcagtacgcatatcacaaaagtggaatttatgatacccctgatgagcaaggctgtgttgcttgcttcaacagttgcctcatatcagcagccagggcct

SEQ ID NO: 369663 - DNA, 140 bp, Artificial Sequence
  Synthetic
atacgccatgctgggtctccgttgcttatgtacactgttttccatcaacacccacaggatgtcagtgcaaacgtccacctagtcaacccatccaacagcacaacaggtgctagcacagcccgtacttgggagtcggccat

SEQ ID NO: 369664 - DNA, 140 bp, Artificial Sequence
  Synthetic
atggccgactcccaagtacgggctgtgctagcacctgttgtgctgttggatgggttgactaggtggacgtttgcactgacatcctgtgggtgttgatggaaaacagtgtacataagcaacggagacccagcatggcgtat

SEQ ID NO: 369665 - DNA, 140 bp, Artificial Sequence
  Synthetic
atacgccatgctgggtctccgatgcttctgagtcaaagacgctgactgtttctgtcatggacctatcccaaatgtattctcccgtctttgagtatctgtcaggtgatagacaggtagaagcgtacttgggagtcggccat

SEQ ID NO: 369666 - DNA, 140 bp, Artificial Sequence
  Synthetic
atggccgactcccaagtacgcttctacctgtctatcacctgacagatactcaaagacgggagaatacatttgggataggtccatgacagaaacagtcagcgtctttgactcagaagcatcggagacccagcatggcgtat

SEQ ID NO: 369667 - DNA, 140 bp, Artificial Sequence
  Synthetic
aggccctggctgctgatatgaatgtattctcccgtctttgagtatctgtcaggtgatagacaggtagaagagtggccaaaagccacctgcacaggcgactgccaagagagatgtggctgcgaccttttgggacagcggtg

SEQ ID NO: 369668 - DNA, 140 bp, Artificial Sequence
  Synthetic
caccgctgtcccaaaaggtcgcagccacatctctcttggcagtcgcctgtgcaggtggcttttggccactcttctacctgtctatcacctgacagatactcaaagacgggagaatacattcatatcagcagccagggcct

SEQ ID NO: 369669 - DNA, 140 bp, Artificial Sequence
  Synthetic
atacgccatgctgggtctcctctcaaagatatcaatccccccgttacccaccttgacacagagagctccagtagtagtccttgtctttgcaagaccatggatttcttgaggaaccttgaccgtacttgggagtcggccat

SEQ ID NO: 369670 - DNA, 140 bp, Artificial Sequence
  Synthetic
atggccgactcccaagtacggtcaaggttcctcaagaaatccatggtcttgcaaagacaaggactactactggagctctctgtgtcaaggtgggtaacggggggattgatatctttgagaggagacccagcatggcgtat

SEQ ID NO: 369671 - DNA, 140 bp, Artificial Sequence
  Synthetic
atacgccatgctgggtctccatgcaaccccacttggtgttggggagtggggactggctgcacctgctgtggattggatgtgagagaccttttcacggactacatgatggttaagtggaaacgtacttgggagtcggccat

SEQ ID NO: 369672 - DNA, 140 bp, Artificial Sequence
  Synthetic
atggccgactcccaagtacgtttccacttaaccatcatgtagtccgtgaaaaggtctctcacatccaatccacagcaggtgcagccagtccccactccccaacaccaagtggggttgcatggagacccagcatggcgtat

SEQ ID NO: 369673 - DNA, 140 bp, Artificial Sequence
  Synthetic
aggccctggctgctgatatggattggatgtgagagaccttttcacggactacatgatggttaagtggaaagtggaatatgtaaaaacagaagctataatgtgtgttgagctaaccagtcagaccttttgggacagcggtg

SEQ ID NO: 369674 - DNA, 140 bp, Artificial Sequence
  Synthetic
caccgctgtcccaaaaggtctgactggttagctcaacacacattatagcttctgtttttacatattccactttccacttaaccatcatgtagtccgtgaaaaggtctctcacatccaatccatatcagcagccagggcct

SEQ ID NO: 369675 - DNA, 140 bp, Artificial Sequence
  Synthetic
atacgccatgctgggtctccctgtgacaataaccctgtcagagccaagaaacatccagcaaaggctcccttccgaaatcgttacactgcaccctaagatagaagaagggttctttgacttcgtacttgggagtcggccat

SEQ ID NO: 369676 - DNA, 140 bp, Artificial Sequence
  Synthetic
atggccgactcccaagtacgaagtcaaagaacccttcttctatcttagggtgcagtgtaacgatttcggaagggagcctttgctggatgtttcttggctctgacagggttattgtcacagggagacccagcatggcgtat

SEQ ID NO: 369677 - DNA, 140 bp, Artificial Sequence
  Synthetic
aggccctggctgctgatatgtccgaaatcgttacactgcaccctaagatagaagaagggttctttgacttgatgcatgtgcaaaaggtactatctgcaagtacagtctgcaaactacagagaccttttgggacagcggtg

SEQ ID NO: 369678 - DNA, 140 bp, Artificial Sequence
  Synthetic
caccgctgtcccaaaaggtctctgtagtttgcagactgtacttgcagatagtaccttttgcacatgcatcaagtcaaagaacccttcttctatcttagggtgcagtgtaacgatttcggacatatcagcagccagggcct

SEQ ID NO: 369679 - DNA, 140 bp, Artificial Sequence
  Synthetic
atacgccatgctgggtctccctactgaaaggagataaggtcaatgggcactcaatccacaagatagagtcccatttcaacacttcatggatgtcatgggatggatgtgatctagactactcgtacttgggagtcggccat

SEQ ID NO: 369680 - DNA, 140 bp, Artificial Sequence
  Synthetic
atggccgactcccaagtacgagtagtctagatcacatccatcccatgacatccatgaagtgttgaaatgggactctatcttgtggattgagtgcccattgaccttatctcctttcagtagggagacccagcatggcgtat

SEQ ID NO: 369681 - DNA, 140 bp, Artificial Sequence
  Synthetic
aggccctggctgctgatatgccatttcaacacttcatggatgtcatgggatggatgtgatctagactacttctgcaacatgggtgactggccctcatgtacatacactggagtgacacaggaccttttgggacagcggtg

SEQ ID NO: 369682 - DNA, 140 bp, Artificial Sequence
  Synthetic
caccgctgtcccaaaaggtcctgtgtcactccagtgtatgtacatgagggccagtcacccatgttgcagaagtagtctagatcacatccatcccatgacatccatgaagtgttgaaatggcatatcagcagccagggcct

SEQ ID NO: 369683 - DNA, 140 bp, Artificial Sequence
  Synthetic
atacgccatgctgggtctccaaagactttccacttccattccaagagagtaacggcacatggtgacacccctcaactggatctgaaggcaaggcctacatatggtgcaggcgaagtcactcgtacttgggagtcggccat

SEQ ID NO: 369684 - DNA, 140 bp, Artificial Sequence
  Synthetic
atggccgactcccaagtacgagtgacttcgcctgcaccatatgtaggccttgccttcagatccagttgaggggtgtcaccatgtgccgttactctcttggaatggaagtggaaagtctttggagacccagcatggcgtat

SEQ ID NO: 369685 - DNA, 140 bp, Artificial Sequence
  Synthetic
aggccctggctgctgatatgctcaactggatctgaaggcaaggcctacatatggtgcaggcgaagtcactgttctagtagaggttgcagatctggagctacacaccaagaaaattgaagtgaccttttgggacagcggtg

SEQ ID NO: 369686 - DNA, 140 bp, Artificial Sequence
  Synthetic
caccgctgtcccaaaaggtcacttcaattttcttggtgtgtagctccagatctgcaacctctactagaacagtgacttcgcctgcaccatatgtaggccttgccttcagatccagttgagcatatcagcagccagggcct

SEQ ID NO: 369687 - DNA, 140 bp, Artificial Sequence
  Synthetic
atacgccatgctgggtctccgctccggtatctcctgcaaagttagaattcatgtgaatgaaccagatgaatttactgtacatgtgaaaagcagtgatccagatgttgtggcagcaggatccgtacttgggagtcggccat

SEQ ID NO: 369688 - DNA, 140 bp, Artificial Sequence
  Synthetic
atggccgactcccaagtacggatcctgctgccacaacatctggatcactgcttttcacatgtacagtaaattcatctggttcattcacatgaattctaactttgcaggagataccggagcggagacccagcatggcgtat

SEQ ID NO: 369689 - DNA, 140 bp, Artificial Sequence
  Synthetic
aggccctggctgctgatatgtttactgtacatgtgaaaagcagtgatccagatgttgtggcagcaggatcaagtttgatggcaaggaaaatagagtttggggctgacagcaccttcaaaggaccttttgggacagcggtg

SEQ ID NO: 369690 - DNA, 140 bp, Artificial Sequence
  Synthetic
caccgctgtcccaaaaggtcctttgaaggtgctgtcagccccaaactctattttccttgccatcaaacttgatcctgctgccacaacatctggatcactgcttttcacatgtacagtaaacatatcagcagccagggcct

SEQ ID NO: 369691 - DNA, 140 bp, Artificial Sequence
  Synthetic
atacgccatgctgggtctccgactactgcagcagctgcaccaatgatgacactcagaagtgtgttgacacaaagctcgaacatccacaaagcatattaattgagcataagggaacaataacgtacttgggagtcggccat

SEQ ID NO: 369692 - DNA, 140 bp, Artificial Sequence
  Synthetic
atggccgactcccaagtacgttattgttcccttatgctcaattaatatgctttgtggatgttcgagctttgtgtcaacacacttctgagtgtcatcattggtgcagctgctgcagtagtcggagacccagcatggcgtat

SEQ ID NO: 369693 - DNA, 140 bp, Artificial Sequence
  Synthetic
aggccctggctgctgatatgaaagctcgaacatccacaaagcatattaattgagcataagggaacaataattggcaaacaaaacgacacctgttcgaccaaaacaagctgttggctagaagaccttttgggacagcggtg

SEQ ID NO: 369694 - DNA, 140 bp, Artificial Sequence
  Synthetic
caccgctgtcccaaaaggtcttctagccaacagcttgttttggtcgaacaggtgtcgttttgtttgccaattattgttcccttatgctcaattaatatgctttgtggatgttcgagctttcatatcagcagccagggcct

SEQ ID NO: 369695 - DNA, 140 bp, Artificial Sequence
  Synthetic
atacgccatgctgggtctcccggtaatgtcttcttaggcatcttcctgttccttgctccttttgcactgctaatattcttcttcttcttcgggtggaggcttctgttctgtctgaagtgtcgtacttgggagtcggccat

SEQ ID NO: 369696 - DNA, 140 bp, Artificial Sequence
  Synthetic
atggccgactcccaagtacgacacttcagacagaacagaagcctccacccgaagaagaagaagaatattagcagtgcaaaaggagcaaggaacaggaagatgcctaagaagacattaccgggagacccagcatggcgtat

SEQ ID NO: 369697 - DNA, 140 bp, Artificial Sequence
  Synthetic
atacgccatgctgggtctccagaagccgggtacaagaaaatcatcgagaggctaaatgacaaaaaaggcaaaagtcgactgtttgacggagagaggcttgcagataggaagattgcagaacgtacttgggagtcggccat

SEQ ID NO: 369698 - DNA, 140 bp, Artificial Sequence
  Synthetic
atggccgactcccaagtacgttctgcaatcttcctatctgcaagcctctctccgtcaaacagtcgacttttgccttttttgtcatttagcctctcgatgattttcttgtacccggcttctggagacccagcatggcgtat

SEQ ID NO: 369699 - DNA, 140 bp, Artificial Sequence
  Synthetic
aggccctggctgctgatatgaaagtcgactgtttgacggagagaggcttgcagataggaagattgcagaactcttttcaaccaaaactcatatagggtaacaaatcagaccagctgccacgaccttttgggacagcggtg

SEQ ID NO: 369700 - DNA, 140 bp, Artificial Sequence
  Synthetic
caccgctgtcccaaaaggtcgtggcagctggtctgatttgttaccctatatgagttttggttgaaaagagttctgcaatcttcctatctgcaagcctctctccgtcaaacagtcgactttcatatcagcagccagggcct

SEQ ID NO: 369701 - DNA, 140 bp, Artificial Sequence
  Synthetic
atacgccatgctgggtctcctcatgcactgatcgtcacttcttcgtctgcccttcgtcacctctagcttatgatagttgatcatcctgcttaacaccactccagcttgatttcatctagacgtacttgggagtcggccat

SEQ ID NO: 369702 - DNA, 140 bp, Artificial Sequence
  Synthetic
atggccgactcccaagtacgtctagatgaaatcaagctggagtggtgttaagcaggatgatcaactatcataagctagaggtgacgaagggcagacgaagaagtgacgatcagtgcatgaggagacccagcatggcgtat

SEQ ID NO: 369703 - DNA, 140 bp, Artificial Sequence
  Synthetic
aggccctggctgctgatatgacctctagcttatgatagttgatcatcctgcttaacaccactccagcttgatttcatctagacttaaccttgactgcgtgccgccactatatctttgagagaccttttgggacagcggtg

SEQ ID NO: 369704 - DNA, 140 bp, Artificial Sequence
  Synthetic
caccgctgtcccaaaaggtctctcaaagatatagtggcggcacgcagtcaaggttaagtctagatgaaatcaagctggagtggtgttaagcaggatgatcaactatcataagctagaggtcatatcagcagccagggcct

SEQ ID NO: 369705 - DNA, 140 bp, Artificial Sequence
  Synthetic
aggccctggctgctgatatgagaaccagtaagccccaaacaccacgaagcacaaaccaacccctgagaaagctcctctccgcagtaagcaccgaagcagcaccccaaacctcaccaacaggaccttttgggacagcggtg

SEQ ID NO: 369706 - DNA, 140 bp, Artificial Sequence
  Synthetic
caccgctgtcccaaaaggtcctgttggtgaggtttggggtgctgcttcggtgcttactgcggagaggagctttctcaggggttggtttgtgcttcgtggtgtttggggcttactggttctcatatcagcagccagggcct

SEQ ID NO: 369707 - DNA, 140 bp, Artificial Sequence
  Synthetic
aggccctggctgctgatatgagtggattgagcatcttaattgcagcatacctgtcaacatcatgcatacatctttgatatatgtagttctctgcttgcagctgtgtagtctagggaaaacgaccttttgggacagcggtg

SEQ ID NO: 369708 - DNA, 140 bp, Artificial Sequence
  Synthetic
caccgctgtcccaaaaggtcgttttccctagactacacagctgcaagcagagaactacatatatcaaagatgtatgcatgatgttgacaggtatgctgcaattaagatgctcaatccactcatatcagcagccagggcct

SEQ ID NO: 369709 - DNA, 140 bp, Artificial Sequence
  Synthetic
atacgccatgctgggtctccagactgcagaggtccatggcgacaactatggtggtccgggtgataagataaccatctgcaatggttcaactgttgtagatcaaagactgggtagtgaactcgtacttgggagtcggccat

SEQ ID NO: 369710 - DNA, 140 bp, Artificial Sequence
  Synthetic
atggccgactcccaagtacgagttcactacccagtctttgatctacaacagttgaaccattgcagatggttatcttatcacccggaccaccatagttgtcgccatggacctctgcagtctggagacccagcatggcgtat

SEQ ID NO: 369711 - DNA, 140 bp, Artificial Sequence
  Synthetic
atacgccatgctgggtctccattttaacgaagtgctactattcaggtcaccaagtcaactgggcaccaccgggtcacctctcgcaagcccccccacagctgagcccttcaagtctttttacgtacttgggagtcggccat

SEQ ID NO: 369712 - DNA, 140 bp, Artificial Sequence
  Synthetic
atggccgactcccaagtacgtaaaaagacttgaagggctcagctgtgggggggcttgcgagaggtgacccggtggtgcccagttgacttggtgacctgaatagtagcacttcgttaaaatggagacccagcatggcgtat

SEQ ID NO: 369713 - DNA, 140 bp, Artificial Sequence
  Synthetic
aggccctggctgctgatatggggtcacctctcgcaagcccccccacagctgagcccttcaagtctttttatgctaaagggttcttgataatggattcaggttacttctctgctaaatgctgaccttttgggacagcggtg

SEQ ID NO: 369714 - DNA, 140 bp, Artificial Sequence
  Synthetic
caccgctgtcccaaaaggtcagcatttagcagagaagtaacctgaatccattatcaagaaccctttagcataaaaagacttgaagggctcagctgtgggggggcttgcgagaggtgaccccatatcagcagccagggcct

SEQ ID NO: 369715 - DNA, 140 bp, Artificial Sequence
  Synthetic
atacgccatgctgggtctccgcaaaaggcatctcagttgtctaaactggtcaacaaaagccagaacataccgaccagagtcggcagggtcttggattgcatgtttaattgtaagttatgtcgtacttgggagtcggccat

SEQ ID NO: 369716 - DNA, 140 bp, Artificial Sequence
  Synthetic
atggccgactcccaagtacgacataacttacaattaaacatgcaatccaagaccctgccgactctggtcggtatgttctggcttttgttgaccagtttagacaactgagatgccttttgcggagacccagcatggcgtat

SEQ ID NO: 369717 - DNA, 140 bp, Artificial Sequence
  Synthetic
atacgccatgctgggtctcctcaattaaagtagttaacaccccaggaccaaagtattccaacttaaagactgttaactgtataaatttgaaggtgtcaactgacaaggatcacagtgaaccgtacttgggagtcggccat

SEQ ID NO: 369718 - DNA, 140 bp, Artificial Sequence
  Synthetic
atggccgactcccaagtacggttcactgtgatccttgtcagttgacaccttcaaatttatacagttaacagtctttaagttggaatactttggtcctggggtgttaactactttaattgaggagacccagcatggcgtat

SEQ ID NO: 369719 - DNA, 140 bp, Artificial Sequence
  Synthetic
aggccctggctgctgatatgagaagaattcttcataactggtgagggctacttcaatgaagtcctacaatttaaaacaccaagcacactaagccccacggagccgtctcatgtcaggctagaccttttgggacagcggtg

SEQ ID NO: 369720 - DNA, 140 bp, Artificial Sequence
  Synthetic
caccgctgtcccaaaaggtctagcctgacatgagacggctccgtggggcttagtgtgcttggtgttttaaattgtaggacttcattgaagtagccctcaccagttatgaagaattcttctcatatcagcagccagggcct

SEQ ID NO: 369721 - DNA, 140 bp, Artificial Sequence
  Synthetic
aggccctggctgctgatatgcaggaggtgttaggcagcggaatactgaggtgctctttagggaaaagttgaacaaggtagttataaaggataaccttgagcaaggtgtagaagaagagatgaccttttgggacagcggtg

SEQ ID NO: 369722 - DNA, 140 bp, Artificial Sequence
  Synthetic
caccgctgtcccaaaaggtcatctcttcttctacaccttgctcaaggttatcctttataactaccttgttcaacttttccctaaagagcacctcagtattccgctgcctaacacctcctgcatatcagcagccagggcct

SEQ ID NO: 369723 - DNA, 140 bp, Artificial Sequence
  Synthetic
aggccctggctgctgatatgttttgatatttacaatgtgcacatatacaataaagaaatggacaattttgacgaaggatgtatcagcgtcttggaagaaacagcagaaaggcatatgcttgaccttttgggacagcggtg

SEQ ID NO: 369724 - DNA, 140 bp, Artificial Sequence
  Synthetic
caccgctgtcccaaaaggtcaagcatatgcctttctgctgtttcttccaagacgctgatacatccttcgtcaaaattgtccatttctttattgtatatgtgcacattgtaaatatcaaaacatatcagcagccagggcct

SEQ ID NO: 369725 - DNA, 140 bp, Artificial Sequence
  Synthetic
atacgccatgctgggtctccagttttacagcgagttcatgatgggctacagagtaactcctgctgtgatcaaattcatgttcactggactgataaatagctctgtaacctctcctcagagcgtacttgggagtcggccat

SEQ ID NO: 369726 - DNA, 140 bp, Artificial Sequence
  Synthetic
atggccgactcccaagtacgctctgaggagaggttacagagctatttatcagtccagtgaacatgaatttgatcacagcaggagttactctgtagcccatcatgaactcgctgtaaaactggagacccagcatggcgtat

SEQ ID NO: 369727 - DNA, 140 bp, Artificial Sequence
  Synthetic
atacgccatgctgggtctccatgagcaaatatcctccagaaaacatagacaaggctagaagggatccaaaaaattgggttagcatatctgaagtcacagagacaacaagcatagttgcttcgtacttgggagtcggccat

SEQ ID NO: 369728 - DNA, 140 bp, Artificial Sequence
  Synthetic
atggccgactcccaagtacgaagcaactatgcttgttgtctctgtgacttcagatatgctaacccaattttttggatcccttctagccttgtctatgttttctggaggatatttgctcatggagacccagcatggcgtat

SEQ ID NO: 369729 - DNA, 140 bp, Artificial Sequence
  Synthetic
aggccctggctgctgatatgaaatacttgcggcacgtcagtacgtaagtgttaactttgaggaagtggattgagcaccttaattgcagcatacttgccaacatcatgcatatatcattaagaccttttgggacagcggtg

SEQ ID NO: 369730 - DNA, 140 bp, Artificial Sequence
  Synthetic
caccgctgtcccaaaaggtcttaatgatatatgcatgatgttggcaagtatgctgcaattaaggtgctcaatccacttcctcaaagttaacacttacgtactgacgtgccgcaagtatttcatatcagcagccagggcct

SEQ ID NO: 369731 - DNA, 140 bp, Artificial Sequence
  Synthetic
aggccctggctgctgatatggattagactgccttaccaacatgcgaaatcttgatggtaaacccataagtgaaggtagcaacttggtcaatttctacaaggtcatatgcatctcgggtgagaccttttgggacagcggtg

SEQ ID NO: 369732 - DNA, 140 bp, Artificial Sequence
  Synthetic
caccgctgtcccaaaaggtctcacccgagatgcatatgaccttgtagaaattgaccaagttgctaccttcacttatgggtttaccatcaagatttcgcatgttggtaaggcagtctaatccatatcagcagccagggcct

SEQ ID NO: 369733 - DNA, 140 bp, Artificial Sequence
  Synthetic
aggccctggctgctgatatgtcgggggaagtttacacatcctctccgatcaccaccgagagcttgtcccagccggaaaccacaccgaagctccctgccacaactggtatagacacctcaagaccttttgggacagcggtg

SEQ ID NO: 369734 - DNA, 140 bp, Artificial Sequence
  Synthetic
caccgctgtcccaaaaggtcttgaggtgtctataccagttgtggcagggagcttcggtgtggtttccggctgggacaagctctcggtggtgatcggagaggatgtgtaaacttcccccgacatatcagcagccagggcct

SEQ ID NO: 369735 - DNA, 140 bp, Artificial Sequence
  Synthetic
atacgccatgctgggtctccctaacagtccgcacaagtccacccaacagccctagcacaccatccacaccacaagacacacaccatcctatgagaaatctactttcagtcacgagccctgcgtacttgggagtcggccat

SEQ ID NO: 369736 - DNA, 140 bp, Artificial Sequence
  Synthetic
atggccgactcccaagtacgcagggctcgtgactgaaagtagatttctcataggatggtgtgtgtcttgtggtgtggatggtgtgctagggctgttgggtggacttgtgcggactgttagggagacccagcatggcgtat

SEQ ID NO: 369737 - DNA, 140 bp, Artificial Sequence
  Synthetic
aggccctggctgctgatatgacaagacacacaccatcctatgagaaatctactttcagtcacgagccctgggccagaagaaacatctacaccttccggatcaggcaaagagagctcagcagaccttttgggacagcggtg

SEQ ID NO: 369738 - DNA, 140 bp, Artificial Sequence
  Synthetic
caccgctgtcccaaaaggtctgctgagctctctttgcctgatccggaaggtgtagatgtttcttctggcccagggctcgtgactgaaagtagatttctcataggatggtgtgtgtcttgtcatatcagcagccagggcct

SEQ ID NO: 369739 - DNA, 140 bp, Artificial Sequence
  Synthetic
atacgccatgctgggtctccgagataaacaaatcaagcaggagttctctagaatgaaactctacgtcactaaagatttgctagaccatctggatgttggtgggctcttgagggctgccttcgtacttgggagtcggccat

SEQ ID NO: 369740 - DNA, 140 bp, Artificial Sequence
  Synthetic
atggccgactcccaagtacgaaggcagccctcaagagcccaccaacatccagatggtctagcaaatctttagtgacgtagagtttcattctagagaactcctgcttgatttgtttatctcggagacccagcatggcgtat

SEQ ID NO: 369741 - DNA, 140 bp, Artificial Sequence
  Synthetic
aggccctggctgctgatatgcaatagacataccaccgtcaaggagccatcattattcaatcccaatatcagatgtgttaacctaatcaccttcgaagacggtcttagggaactctcagtggaccttttgggacagcggtg

SEQ ID NO: 369742 - DNA, 140 bp, Artificial Sequence
  Synthetic
caccgctgtcccaaaaggtccactgagagttccctaagaccgtcttcgaaggtgattaggttaacacatctgatattgggattgaataatgatggctccttgacggtggtatgtctattgcatatcagcagccagggcct

SEQ ID NO: 369743 - DNA, 140 bp, Artificial Sequence
  Synthetic
aggccctggctgctgatatgctgaaaccccaaacatgtaccatatgtgaatcagtaccggttaatgcaatagatgctgaaatgcatgacctcaactgcagctacaacatatgcccttattgaccttttgggacagcggtg

SEQ ID NO: 369744 - DNA, 140 bp, Artificial Sequence
  Synthetic
caccgctgtcccaaaaggtcaataagggcatatgttgtagctgcagttgaggtcatgcatttcagcatctattgcattaaccggtactgattcacatatggtacatgtttggggtttcagcatatcagcagccagggcct

SEQ ID NO: 369745 - DNA, 140 bp, Artificial Sequence
  Synthetic
atacgccatgctgggtctcccaattgattaatattaccagacattcaactagaatagttgacacacctgggcctaagatcaccaacttaaagaccatcaactgcattaacctgaaggcatcgtacttgggagtcggccat

SEQ ID NO: 369746 - DNA, 140 bp, Artificial Sequence
  Synthetic
atggccgactcccaagtacgatgccttcaggttaatgcagttgatggtctttaagttggtgatcttaggcccaggtgtgtcaactattctagttgaatgtctggtaatattaatcaattgggagacccagcatggcgtat

SEQ ID NO: 369747 - DNA, 140 bp, Artificial Sequence
  Synthetic
atacgccatgctgggtctccgttgcagttaatctctcaaactgtcacgttgtaatcaaatcacatgtctgtgactatcctttagacattgacggtacggtgaggcttcctcacatttacccgtacttgggagtcggccat

SEQ ID NO: 369748 - DNA, 140 bp, Artificial Sequence
  Synthetic
atggccgactcccaagtacgggtaaatgtgaggaagcctcaccgtaccgtcaatgtctaaaggatagtcacagacatgtgatttgattacaacgtgacagtttgagagattaactgcaacggagacccagcatggcgtat

SEQ ID NO: 369749 - DNA, 140 bp, Artificial Sequence
  Synthetic
atacgccatgctgggtctccaagggaggttcgtaaaggtcagtcagttttgaggcagtacaagacggaaatcaggattggcaaggcatcaaccggctctagaagattgctttccgaagaacgtacttgggagtcggccat

SEQ ID NO: 369750 - DNA, 140 bp, Artificial Sequence
  Synthetic
atggccgactcccaagtacgttcttcggaaagcaatcttctagagccggttgatgccttgccaatcctgatttccgtcttgtactgcctcaaaactgactgacctttacgaacctcccttggagacccagcatggcgtat

SEQ ID NO: 369751 - DNA, 140 bp, Artificial Sequence
  Synthetic
aggccctggctgctgatatggctttgaacttgtaacaatcaactatgctgctcttcaccatcctggcttgacttcacttagacctaaccttgactgcgtgccgccactatatctttgagagaccttttgggacagcggtg

SEQ ID NO: 369752 - DNA, 140 bp, Artificial Sequence
  Synthetic
caccgctgtcccaaaaggtctctcaaagatatagtggcggcacgcagtcaaggttaggtctaagtgaagtcaagccaggatggtgaagagcagcatagttgattgttacaagttcaaagccatatcagcagccagggcct

SEQ ID NO: 369753 - DNA, 140 bp, Artificial Sequence
  Synthetic
atacgccatgctgggtctcctgggaagagctgtgtgatagacagtgtcccagttaaatgcaggcagggttattgcctaaggattactcaagaaggaaggggccatgtaaaattatctaggcgtacttgggagtcggccat

SEQ ID NO: 369754 - DNA, 140 bp, Artificial Sequence
  Synthetic
atggccgactcccaagtacgcctagataattttacatggccccttccttcttgagtaatccttaggcaataaccctgcctgcatttaactgggacactgtctatcacacagctcttcccaggagacccagcatggcgtat

SEQ ID NO: 369755 - DNA, 140 bp, Artificial Sequence
  Synthetic
atacgccatgctgggtctcccccaaaaggaaagagaaggtagaagagacagagttatacctgaacctggaaaggatcccctggattgttaggaagctcctacaggtatctgagtcaacagcgtacttgggagtcggccat

SEQ ID NO: 369756 - DNA, 140 bp, Artificial Sequence
  Synthetic
atggccgactcccaagtacgctgttgactcagatacctgtaggagcttcctaacaatccaggggatcctttccaggttcaggtataactctgtctcttctaccttctctttccttttgggggagacccagcatggcgtat

SEQ ID NO: 369757 - DNA, 140 bp, Artificial Sequence
  Synthetic
aggccctggctgctgatatgaaggatcccctggattgttaggaagctcctacaggtatctgagtcaacaggtgtggccttaaaaagaagcagctggatgatcgtgctcctcatattactggaccttttgggacagcggtg

SEQ ID NO: 369758 - DNA, 140 bp, Artificial Sequence
  Synthetic
caccgctgtcccaaaaggtccagtaatatgaggagcacgatcatccagctgcttctttttaaggccacacctgttgactcagatacctgtaggagcttcctaacaatccaggggatccttcatatcagcagccagggcct

SEQ ID NO: 369759 - DNA, 140 bp, Artificial Sequence
  Synthetic
atacgccatgctgggtctcctcttgcctaatgaaagggttggttgacagtgttggcaactccttcttccctggactgtccatttgcaaaacgtgctccataagcagcattaatggctttgcgtacttgggagtcggccat

SEQ ID NO: 369760 - DNA, 140 bp, Artificial Sequence
  Synthetic
atggccgactcccaagtacgcaaagccattaatgctgcttatggagcacgttttgcaaatggacagtccagggaagaaggagttgccaacactgtcaaccaaccctttcattaggcaagaggagacccagcatggcgtat

SEQ ID NO: 369761 - DNA, 140 bp, Artificial Sequence
  Synthetic
atacgccatgctgggtctcctctattcctagacagtatagttaaaggcatgaaaaatctgctaaactcaacaagtttagaaacaagtctgtcaattgaggcaccatggggggcaataaatcgtacttgggagtcggccat

SEQ ID NO: 369762 - DNA, 140 bp, Artificial Sequence
  Synthetic
atggccgactcccaagtacgatttattgccccccatggtgcctcaattgacagacttgtttctaaacttgttgagtttagcagatttttcatgcctttaactatactgtctaggaatagaggagacccagcatggcgtat

SEQ ID NO: 369763 - DNA, 140 bp, Artificial Sequence
  Synthetic
atacgccatgctgggtctcccaaatgtagttacaatatatgcccttattgtgcatcaagattgacctctgatgggctagctaggcatgtgacacaatgccctaagcgaaaggagaaagttcgtacttgggagtcggccat

SEQ ID NO: 369764 - DNA, 140 bp, Artificial Sequence
  Synthetic
atggccgactcccaagtacgaactttctcctttcgcttagggcattgtgtcacatgcctagctagcccatcagaggtcaatcttgatgcacaataagggcatatattgtaactacatttgggagacccagcatggcgtat

SEQ ID NO: 369765 - DNA, 140 bp, Artificial Sequence
  Synthetic
atacgccatgctgggtctcctttgtctcagatgtactctcctgtcttcgagtacttatcaggagacagacaggtggaggagtggcccaaagcaacttgcacaggtgactgcccagaaagacgtacttgggagtcggccat

SEQ ID NO: 369766 - DNA, 140 bp, Artificial Sequence
  Synthetic
atggccgactcccaagtacgtctttctgggcagtcacctgtgcaagttgctttgggccactcctccacctgtctgtctcctgataagtactcgaagacaggagagtacatctgagacaaaggagacccagcatggcgtat

SEQ ID NO: 369767 - DNA, 140 bp, Artificial Sequence
  Synthetic
atacgccatgctgggtctccgtggcctactgtgctgtccttactgtagggcttgctcaactgaccaggatgcccaccagttccatctaagtgtctgtaagaagagaaaggcaggaagcaacgtacttgggagtcggccat

SEQ ID NO: 369768 - DNA, 140 bp, Artificial Sequence
  Synthetic
atggccgactcccaagtacgttgcttcctgcctttctcttcttacagacacttagatggaactggtgggcatcctggtcagttgagcaagccctacagtaaggacagcacagtaggccacggagacccagcatggcgtat

SEQ ID NO: 369769 - DNA, 140 bp, Artificial Sequence
  Synthetic
aggccctggctgctgatatggcccaccagttccatctaagtgtctgtaagaagagaaaggcaggaagcaacgtcatgttggctgtctgtaagcgtatgtgtttcaaggcaattatcgaaggaccttttgggacagcggtg

SEQ ID NO: 369770 - DNA, 140 bp, Artificial Sequence
  Synthetic
caccgctgtcccaaaaggtccttcgataattgccttgaaacacatacgcttacagacagccaacatgacgttgcttcctgcctttctcttcttacagacacttagatggaactggtgggccatatcagcagccagggcct

SEQ ID NO: 369771 - DNA, 140 bp, Artificial Sequence
  Synthetic
atacgccatgctgggtctcctggttagagtcagccaagagttttttttatggtctaaaggacatgcttagtggcatttttggcaatgtctttataggtattttcttattccttgccccctcgtacttgggagtcggccat

SEQ ID NO: 369772 - DNA, 140 bp, Artificial Sequence
  Synthetic
atggccgactcccaagtacgagggggcaaggaataagaaaatacctataaagacattgccaaaaatgccactaagcatgtcctttagaccataaaaaaaactcttggctgactctaaccaggagacccagcatggcgtat

SEQ ID NO: 369773 - DNA, 140 bp, Artificial Sequence
  Synthetic
atacgccatgctgggtctcctttagatgttgtagaagaactagaggcctgttcaagtatagacacctcaaggacgatgaagaaactggttatagaaggattattgaaagactaaacaatacgtacttgggagtcggccat

SEQ ID NO: 369774 - DNA, 140 bp, Artificial Sequence
  Synthetic
atggccgactcccaagtacgtattgtttagtctttcaataatccttctataaccagtttcttcatcgtccttgaggtgtctatacttgaacaggcctctagttcttctacaacatctaaaggagacccagcatggcgtat

SEQ ID NO: 369775 - DNA, 140 bp, Artificial Sequence
  Synthetic
aggccctggctgctgatatgggacgatgaagaaactggttatagaaggattattgaaagactaaacaataaaaagggaaaaaacaaactgcttgatggtgaaagacttgctgatagaaaagaccttttgggacagcggtg

SEQ ID NO: 369776 - DNA, 140 bp, Artificial Sequence
  Synthetic
caccgctgtcccaaaaggtcttttctatcagcaagtctttcaccatcaagcagtttgttttttccctttttattgtttagtctttcaataatccttctataaccagtttcttcatcgtcccatatcagcagccagggcct

SEQ ID NO: 369777 - DNA, 140 bp, Artificial Sequence
  Synthetic
atacgccatgctgggtctccgggcctcaaaatgatggaatcacaccaaccaatgccgttactcatgctgacatctttagttgcaaccctactgcattatcatcacaatatattgcatctacgtacttgggagtcggccat

SEQ ID NO: 369778 - DNA, 140 bp, Artificial Sequence
  Synthetic
atggccgactcccaagtacgtagatgcaatatattgtgatgataatgcagtagggttgcaactaaagatgtcagcatgagtaacggcattggttggtgtgattccatcattttgaggcccggagacccagcatggcgtat

SEQ ID NO: 369779 - DNA, 140 bp, Artificial Sequence
  Synthetic
atacgccatgctgggtctcctctcaaagacatcaatcccccctttacccacgttgacacagacagctccagtggtggttccttgtccttatcaagccatggacttcttaagaaaccttgacgtacttgggagtcggccat

SEQ ID NO: 369780 - DNA, 140 bp, Artificial Sequence
  Synthetic
atggccgactcccaagtacgtcaaggtttcttaagaagtccatggcttgataaggacaaggaaccaccactggagctgtctgtgtcaacgtgggtaaaggggggattgatgtctttgagaggagacccagcatggcgtat

SEQ ID NO: 369781 - DNA, 140 bp, Artificial Sequence
  Synthetic
aggccctggctgctgatatggtggtggttccttgtccttatcaagccatggacttcttaagaaaccttgactggactcaggtgatggctggtcagtatgtgaccaaccccagattcagtagaccttttgggacagcggtg

SEQ ID NO: 369782 - DNA, 140 bp, Artificial Sequence
  Synthetic
caccgctgtcccaaaaggtctactgaatctggggttggtcacatactgaccagccatcacctgagtccagtcaaggtttcttaagaagtccatggcttgataaggacaaggaaccaccaccatatcagcagccagggcct

SEQ ID NO: 369783 - DNA, 140 bp, Artificial Sequence
  Synthetic
atacgccatgctgggtctccctggactcaggtgatggctggtcagtatgtgaccaaccccagattcagtatctctgattactttgagattgtgcggcagcctggtgatgggaactgcttccgtacttgggagtcggccat

SEQ ID NO: 369784 - DNA, 140 bp, Artificial Sequence
  Synthetic
atggccgactcccaagtacggaagcagttcccatcaccaggctgccgcacaatctcaaagtaatcagagatactgaatctggggttggtcacatactgaccagccatcacctgagtccagggagacccagcatggcgtat

SEQ ID NO: 369785 - DNA, 140 bp, Artificial Sequence
  Synthetic
atacgccatgctgggtctccccacaacatcaaacatctaactgagatggcagcacggaagtattaccaggaagaacctgaagccaagcttattggcctgagtttggaagactatcttaagcgtacttgggagtcggccat

SEQ ID NO: 369786 - DNA, 140 bp, Artificial Sequence
  Synthetic
atggccgactcccaagtacgcttaagatagtcttccaaactcaggccaataagcttggcttcaggttcttcctggtaatacttccgtgctgccatctcagttagatgtttgatgttgtggggagacccagcatggcgtat

SEQ ID NO: 369787 - DNA, 140 bp, Artificial Sequence
  Synthetic
aggccctggctgctgatatgaagaacctgaagccaagcttattggcctgagtttggaagactatcttaagaggatgctatctgacaacgaatggggatcgactcttgaggcatccatgctgaccttttgggacagcggtg

SEQ ID NO: 369788 - DNA, 140 bp, Artificial Sequence
  Synthetic
caccgctgtcccaaaaggtcagcatggatgcctcaagagtcgatccccattcgttgtcagatagcatcctcttaagatagtcttccaaactcaggccaataagcttggcttcaggttcttcatatcagcagccagggcct

SEQ ID NO: 369789 - DNA, 140 bp, Artificial Sequence
  Synthetic
atacgccatgctgggtctccacgaagtagaagcaggcataaagtttggagacggtgatgtgtttacagccgtgaatcttctgcactccggacagacacattttgatgctctcagaatactcgtacttgggagtcggccat

SEQ ID NO: 369790 - DNA, 140 bp, Artificial Sequence
  Synthetic
atggccgactcccaagtacgagtattctgagagcatcaaaatgtgtctgtccggagtgcagaagattcacggctgtaaacacatcaccgtctccaaactttatgcctgcttctacttcgtggagacccagcatggcgtat

SEQ ID NO: 369791 - DNA, 140 bp, Artificial Sequence
  Synthetic
aggccctggctgctgatatggtgaatcttctgcactccggacagacacattttgatgctctcagaatactgccacagtttgaagctgacacaagagagaccttaagtttagtggacaagggaccttttgggacagcggtg

SEQ ID NO: 369792 - DNA, 140 bp, Artificial Sequence
  Synthetic
caccgctgtcccaaaaggtcccttgtccactaaacttaaggtctctcttgtgtcagcttcaaactgtggcagtattctgagagcatcaaaatgtgtctgtccggagtgcagaagattcaccatatcagcagccagggcct

SEQ ID NO: 369793 - DNA, 140 bp, Artificial Sequence
  Synthetic
aggccctggctgctgatatggatggaaaacctaccggcaggaacctgggaacgagaagaagagctcacaaacttctgtcatcaagagtgtcaagtgacagaaactgaatgcctctgtcctgaccttttgggacagcggtg

SEQ ID NO: 369794 - DNA, 140 bp, Artificial Sequence
  Synthetic
caccgctgtcccaaaaggtcaggacagaggcattcagtttctgtcacttgacactcttgatgacagaagtttgtgagctcttcttctcgttcccaggttcctgccggtaggttttccatccatatcagcagccagggcct

SEQ ID NO: 369795 - DNA, 140 bp, Artificial Sequence
  Synthetic
atacgccatgctgggtctcctatgaagaccttgctttggcacttacaagtgcggaagaaccgtatagacggtctagcctggatgaggttaccctgtccaagaaacaagcagagatattaacgtacttgggagtcggccat

SEQ ID NO: 369796 - DNA, 140 bp, Artificial Sequence
  Synthetic
atggccgactcccaagtacgttaatatctctgcttgtttcttggacagggtaacctcatccaggctagaccgtctatacggttcttccgcacttgtaagtgccaaagcaaggtcttcataggagacccagcatggcgtat

SEQ ID NO: 369797 - DNA, 140 bp, Artificial Sequence
  Synthetic
aggccctggctgctgatatggtctagcctggatgaggttaccctgtccaagaaacaagcagagatattaaggcagaaggcatctcaactgtctaaactggttaataaaagccagaacatagaccttttgggacagcggtg

SEQ ID NO: 369798 - DNA, 140 bp, Artificial Sequence
  Synthetic
caccgctgtcccaaaaggtctatgttctggcttttattaaccagtttagacagttgagatgccttctgccttaatatctctgcttgtttcttggacagggtaacctcatccaggctagaccatatcagcagccagggcct

SEQ ID NO: 369799 - DNA, 140 bp, Artificial Sequence
  Synthetic
atacgccatgctgggtctcctgttgagatatcagctgatactctaattctgcgtccagaatctaaggagagaattggtgaagttatgtcattgcggcagctggggcacaagttgctaacacgtacttgggagtcggccat

SEQ ID NO: 369800 - DNA, 140 bp, Artificial Sequence
  Synthetic
atggccgactcccaagtacgtgttagcaacttgtgccccagctgccgcaatgacataacttcaccaattctctccttagattctggacgcagaattagagtatcagctgatatctcaacaggagacccagcatggcgtat

SEQ ID NO: 369801 - DNA, 140 bp, Artificial Sequence
  Synthetic
atacgccatgctgggtctcccaaagatctgcttgaccatctagatgtcggtggtctattaagagcaaccttccctggaacggggatagaaagacatatgcaattgctacactctgaaatgcgtacttgggagtcggccat

SEQ ID NO: 369802 - DNA, 140 bp, Artificial Sequence
  Synthetic
atggccgactcccaagtacgcatttcagagtgtagcaattgcatatgtctttctatccccgttccagggaaggttgctcttaatagaccaccgacatctagatggtcaagcagatctttgggagacccagcatggcgtat

SEQ ID NO: 369803 - DNA, 140 bp, Artificial Sequence
  Synthetic
aggccctggctgctgatatgttagcacagccctgtctggaaagaaggtgtacaaggttcttggcaacttaggaaatgaactgttgtataaggcacccagaagggccttgacaaccgtctggaccttttgggacagcggtg

SEQ ID NO: 369804 - DNA, 140 bp, Artificial Sequence
  Synthetic
caccgctgtcccaaaaggtccagacggttgtcaaggcccttctgggtgccttatacaacagttcatttcctaagttgccaagaaccttgtacaccttctttccagacagggctgtgctaacatatcagcagccagggcct

SEQ ID NO: 369805 - DNA, 140 bp, Artificial Sequence
  Synthetic
atacgccatgctgggtctccccataagtcctgttagcttacttgcactgagaaatctggactttgactgtcttagtgtgcaagactacaatggtatgatagaaaatatgtccaagttagacgtacttgggagtcggccat

SEQ ID NO: 369806 - DNA, 140 bp, Artificial Sequence
  Synthetic
atggccgactcccaagtacgtctaacttggacatattttctatcataccattgtagtcttgcacactaagacagtcaaagtccagatttctcagtgcaagtaagctaacaggacttatggggagacccagcatggcgtat

SEQ ID NO: 369807 - DNA, 140 bp, Artificial Sequence
  Synthetic
aggccctggctgctgatatgcttagtgtgcaagactacaatggtatgatagaaaatatgtccaagttagataacactgacgttgagttcaaccacagggaaatagccgatctcaaccaacgaccttttgggacagcggtg

SEQ ID NO: 369808 - DNA, 140 bp, Artificial Sequence
  Synthetic
caccgctgtcccaaaaggtcgttggttgagatcggctatttccctgtggttgaactcaacgtcagtgttatctaacttggacatattttctatcataccattgtagtcttgcacactaagcatatcagcagccagggcct

SEQ ID NO: 369809 - DNA, 140 bp, Artificial Sequence
  Synthetic
atacgccatgctgggtctccaggtgttaagaacctcttgaactcaacaagcctggaaactagcttgtcaattgaagcaccatggggggccatcaatgcccaatcaacttacaaaccaactcgtacttgggagtcggccat

SEQ ID NO: 369810 - DNA, 140 bp, Artificial Sequence
  Synthetic
atggccgactcccaagtacgagttggtttgtaagttgattgggcattgatggccccccatggtgcttcaattgacaagctagtttccaggcttgttgagttcaagaggttcttaacacctggagacccagcatggcgtat

SEQ ID NO: 369811 - DNA, 140 bp, Artificial Sequence
  Synthetic
atacgccatgctgggtctccaggcaatggttccctgagggtgacctcactcgtagaagcaccaggaacgttgcaaatgcagaagaatttgtcatatctgaattctttaagaagaaggacacgtacttgggagtcggccat

SEQ ID NO: 369812 - DNA, 140 bp, Artificial Sequence
  Synthetic
atggccgactcccaagtacgtgtccttcttcttaaagaattcagatatgacaaattcttctgcatttgcaacgttcctggtgcttctacgagtgaggtcaccctcagggaaccattgcctggagacccagcatggcgtat

SEQ ID NO: 369813 - DNA, 140 bp, Artificial Sequence
  Synthetic
aggccctggctgctgatatgtgcaaatgcagaagaatttgtcatatctgaattctttaagaagaaggacattatgaagttcattagtacctcaggcagagcaatgagtgcaggcaaaattgaccttttgggacagcggtg

SEQ ID NO: 369814 - DNA, 140 bp, Artificial Sequence
  Synthetic
caccgctgtcccaaaaggtcaattttgcctgcactcattgctctgcctgaggtactaatgaacttcataatgtccttcttcttaaagaattcagatatgacaaattcttctgcatttgcacatatcagcagccagggcct

SEQ ID NO: 369815 - DNA, 140 bp, Artificial Sequence
  Synthetic
atacgccatgctgggtctccaaacatgacttctgaagacatttcacagcttctgatcgagatcaagaggctatatgctttacaagaagactctgaagtagagccaatagccatcatctgtcgtacttgggagtcggccat

SEQ ID NO: 369816 - DNA, 140 bp, Artificial Sequence
  Synthetic
atggccgactcccaagtacgacagatgatggctattggctctacttcagagtcttcttgtaaagcatatagcctcttgatctcgatcagaagctgtgaaatgtcttcagaagtcatgtttggagacccagcatggcgtat

SEQ ID NO: 369817 - DNA, 140 bp, Artificial Sequence
  Synthetic
aggccctggctgctgatatgtatatgctttacaagaagactctgaagtagagccaatagccatcatctgtgacggcatagagagcaatatgaagcagttatttgctatattgcctcctgagaccttttgggacagcggtg

SEQ ID NO: 369818 - DNA, 140 bp, Artificial Sequence
  Synthetic
caccgctgtcccaaaaggtctcaggaggcaatatagcaaataactgcttcatattgctctctatgccgtcacagatgatggctattggctctacttcagagtcttcttgtaaagcatatacatatcagcagccagggcct

SEQ ID NO: 369819 - DNA, 140 bp, Artificial Sequence
  Synthetic
atacgccatgctgggtctcccgcacagtacagcttggaagcatgcccttcgattaaaggggactgcatatgagggtctgtttgccaactgctatggatggcaatatatcccggaagacatcgtacttgggagtcggccat

SEQ ID NO: 369820 - DNA, 140 bp, Artificial Sequence
  Synthetic
atggccgactcccaagtacgatgtcttccgggatatattgccatccatagcagttggcaaacagaccctcatatgcagtcccctttaatcgaagggcatgcttccaagctgtactgtgcgggagacccagcatggcgtat

SEQ ID NO: 369821 - DNA, 140 bp, Artificial Sequence
  Synthetic
aggccctggctgctgatatggagggtctgtttgccaactgctatggatggcaatatatcccggaagacatcaaaccaagtctgaccatgttgatacagacactgttccctgataaatttggaccttttgggacagcggtg

SEQ ID NO: 369822 - DNA, 140 bp, Artificial Sequence
  Synthetic
caccgctgtcccaaaaggtccaaatttatcagggaacagtgtctgtatcaacatggtcagacttggtttgatgtcttccgggatatattgccatccatagcagttggcaaacagaccctccatatcagcagccagggcct

SEQ ID NO: 369823 - DNA, 140 bp, Artificial Sequence
  Synthetic
atacgccatgctgggtctcccctgacttttcacttacgcaaaaggtccatttcaagaggaatcagatacccagcgttgaaaacgtgcagatctccatagatgcaacattgcctgagtctgcgtacttgggagtcggccat

SEQ ID NO: 369824 - DNA, 140 bp, Artificial Sequence
  Synthetic
atggccgactcccaagtacgcagactcaggcaatgttgcatctatggagatctgcacgttttcaacgctgggtatctgattcctcttgaaatggaccttttgcgtaagtgaaaagtcaggggagacccagcatggcgtat

SEQ ID NO: 369825 - DNA, 140 bp, Artificial Sequence
  Synthetic
aggccctggctgctgatatgcagcgttgaaaacgtgcagatctccatagatgcaacattgcctgagtctgtggaagcagtgccagtgacagaaagaaagatgttccctctacctgagactgaccttttgggacagcggtg

SEQ ID NO: 369826 - DNA, 140 bp, Artificial Sequence
  Synthetic
caccgctgtcccaaaaggtcagtctcaggtagagggaacatctttctttctgtcactggcactgcttccacagactcaggcaatgttgcatctatggagatctgcacgttttcaacgctgcatatcagcagccagggcct

SEQ ID NO: 369827 - DNA, 140 bp, Artificial Sequence
  Synthetic
atacgccatgctgggtctcccctcatgcatgaaggaaaatcttcaaccaagaaaaaagatgaagaaccaacggaacaggacagtcaacaaaatgctgctgaacatgagagctcaagcatccgtacttgggagtcggccat

SEQ ID NO: 369828 - DNA, 140 bp, Artificial Sequence
  Synthetic
atggccgactcccaagtacggatgcttgagctctcatgttcagcagcattttgttgactgtcctgttccgttggttcttcatcttttttcttggttgaagattttccttcatgcatgaggggagacccagcatggcgtat

SEQ ID NO: 369829 - DNA, 140 bp, Artificial Sequence
  Synthetic
aggccctggctgctgatatgcggaacaggacagtcaacaaaatgctgctgaacatgagagctcaagcatcttggctttcaaggactatggagagaggggaatagttgaagagaatcacatgaccttttgggacagcggtg

SEQ ID NO: 369830 - DNA, 140 bp, Artificial Sequence
  Synthetic
caccgctgtcccaaaaggtcatgtgattctcttcaactattcccctctctccatagtccttgaaagccaagatgcttgagctctcatgttcagcagcattttgttgactgtcctgttccgcatatcagcagccagggcct

SEQ ID NO: 369831 - DNA, 140 bp, Artificial Sequence
  Synthetic
atacgccatgctgggtctccaagttggttttcaaactgatattgatgggaaaataaggacagaccataaaaaatggaaggacattttaaagctgttggagttactgggaatcaaatgctccgtacttgggagtcggccat

SEQ ID NO: 369832 - DNA, 140 bp, Artificial Sequence
  Synthetic
atggccgactcccaagtacggagcatttgattcccagtaactccaacagctttaaaatgtccttccattttttatggtctgtccttattttcccatcaatatcagtttgaaaaccaacttggagacccagcatggcgtat

SEQ ID NO: 369833 - DNA, 140 bp, Artificial Sequence
  Synthetic
aggccctggctgctgatatgaaatggaaggacattttaaagctgttggagttactgggaatcaaatgctcattcattgcctgtgctgactgctcgtctacaccgccagacagatggtggagaccttttgggacagcggtg

SEQ ID NO: 369834 - DNA, 140 bp, Artificial Sequence
  Synthetic
caccgctgtcccaaaaggtctccaccatctgtctggcggtgtagacgagcagtcagcacaggcaatgaatgagcatttgattcccagtaactccaacagctttaaaatgtccttccatttcatatcagcagccagggcct

SEQ ID NO: 369835 - DNA, 140 bp, Artificial Sequence
  Synthetic
atacgccatgctgggtctccagaggaccggaataagctggaacttgggcgttgaagatgcttctgagtcaagaacactcaccatctccgtcatggatctatcacagatgtattcccctgtcgtacttgggagtcggccat

SEQ ID NO: 369836 - DNA, 140 bp, Artificial Sequence
  Synthetic
atggccgactcccaagtacgacaggggaatacatctgtgatagatccatgacggagatggtgagtgttcttgactcagaagcatcttcaacgcccaagttccagcttattccggtcctctggagacccagcatggcgtat

SEQ ID NO: 369837 - DNA, 140 bp, Artificial Sequence
  Synthetic
atacgccatgctgggtctccaacagactctctagaaactcacccacagaggttactgacatagttgttggggccataagtactcaaaaggtcagaagttacttaaaggcagggactgccacgtacttgggagtcggccat

SEQ ID NO: 369838 - DNA, 140 bp, Artificial Sequence
  Synthetic
atggccgactcccaagtacgtggcagtccctgcctttaagtaacttctgaccttttgagtacttatggccccaacaactatgtcagtaacctctgtgggtgagtttctagagagtctgttggagacccagcatggcgtat

SEQ ID NO: 369839 - DNA, 140 bp, Artificial Sequence
  Synthetic
atacgccatgctgggtctccaaagagcatatacttaacaggcctacaggtctgacactgcctgccagtttggagcaagcaatgcgaaaaggactagtcgagggtgtggtcatctccaaggcgtacttgggagtcggccat

SEQ ID NO: 369840 - DNA, 140 bp, Artificial Sequence
  Synthetic
atggccgactcccaagtacgccttggagatgaccacaccctcgactagtccttttcgcattgcttgctccaaactggcaggcagtgtcagacctgtaggcctgttaagtatatgctctttggagacccagcatggcgtat

SEQ ID NO: 369841 - DNA, 140 bp, Artificial Sequence
  Synthetic
aggccctggctgctgatatgtactactagtgaaaagatgctgttaagttggttaagtgaagacataaagtcatcgaggtgcaatgagtgtcttactaacataaagaaaactgttgatgaagaccttttgggacagcggtg

SEQ ID NO: 369842 - DNA, 140 bp, Artificial Sequence
  Synthetic
caccgctgtcccaaaaggtcttcatcaacagttttctttatgttagtaagacactcattgcacctcgatgactttatgtcttcacttaaccaacttaacagcatcttttcactagtagtacatatcagcagccagggcct

SEQ ID NO: 369843 - DNA, 140 bp, Artificial Sequence
  Synthetic
atacgccatgctgggtctcccactagtcactgtagcaattgtcaccccaatggtgtaaacattagcaacatatctaatgtgtgcaagaggtgtcccaaaatagaggtggttagtcattgtcgtacttgggagtcggccat

SEQ ID NO: 369844 - DNA, 140 bp, Artificial Sequence
  Synthetic
atggccgactcccaagtacgacaatgactaaccacctctattttgggacacctcttgcacacattagatatgttgctaatgtttacaccattggggtgacaattgctacagtgactagtgggagacccagcatggcgtat

SEQ ID NO: 369845 - DNA, 140 bp, Artificial Sequence
  Synthetic
aggccctggctgctgatatgtatctaatgtgtgcaagaggtgtcccaaaatagaggtggttagtcattgtgaaaacaaaggctttgaggatagtaatgaatgcttaacggatttggataggaccttttgggacagcggtg

SEQ ID NO: 369846 - DNA, 140 bp, Artificial Sequence
  Synthetic
caccgctgtcccaaaaggtcctatccaaatccgttaagcattcattactatcctcaaagcctttgttttcacaatgactaaccacctctattttgggacacctcttgcacacattagatacatatcagcagccagggcct

SEQ ID NO: 369847 - DNA, 140 bp, Artificial Sequence
  Synthetic
atacgccatgctgggtctccaacgtaatgtggaatatctgataaaattgatgatgagcatgtcaggcatcgactgcataaaatatcctacaggccagcttatcactcatggaagagtaagcgtacttgggagtcggccat

SEQ ID NO: 369848 - DNA, 140 bp, Artificial Sequence
  Synthetic
atggccgactcccaagtacgcttactcttccatgagtgataagctggcctgtaggatattttatgcagtcgatgcctgacatgctcatcatcaattttatcagatattccacattacgttggagacccagcatggcgtat

SEQ ID NO: 369849 - DNA, 140 bp, Artificial Sequence
  Synthetic
aggccctggctgctgatatggactgcataaaatatcctacaggccagcttatcactcatggaagagtaagtgcaaaacataatgatgggaacttgaaagatagaagtgatgacgatcaaagaccttttgggacagcggtg

SEQ ID NO: 369850 - DNA, 140 bp, Artificial Sequence
  Synthetic
caccgctgtcccaaaaggtctttgatcgtcatcacttctatctttcaagttcccatcattatgttttgcacttactcttccatgagtgataagctggcctgtaggatattttatgcagtccatatcagcagccagggcct

SEQ ID NO: 369851 - DNA, 140 bp, Artificial Sequence
  Synthetic
atacgccatgctgggtctccctgaaggattattcaacttatgcaagaggagtaatctcaaattccctaaaaaacctctcaaagcagggcaaatcaaaatgttctgtgccaaagtcttggccgtacttgggagtcggccat

SEQ ID NO: 369852 - DNA, 140 bp, Artificial Sequence
  Synthetic
atggccgactcccaagtacggccaagactttggcacagaacattttgatttgccctgctttgagaggttttttagggaatttgagattactcctcttgcataagttgaataatccttcagggagacccagcatggcgtat

SEQ ID NO: 369853 - DNA, 140 bp, Artificial Sequence
  Synthetic
aggccctggctgctgatatgaaacctctcaaagcagggcaaatcaaaatgttctgtgccaaagtcttggcttgagaaaatactgtttgatttaaaggtgcccactaaagacgaagaagtggaccttttgggacagcggtg

SEQ ID NO: 369854 - DNA, 140 bp, Artificial Sequence
  Synthetic
caccgctgtcccaaaaggtccacttcttcgtctttagtgggcacctttaaatcaaacagtattttctcaagccaagactttggcacagaacattttgatttgccctgctttgagaggtttcatatcagcagccagggcct

SEQ ID NO: 369855 - DNA, 140 bp, Artificial Sequence
  Synthetic
atacgccatgctgggtctcccaacgacaaactactcataagatccaaggaagaactaaaaaaatgtttcgatgtgcaatcttttaaattgatgaaaaataagcaacctgtaccttttcaacgtacttgggagtcggccat

SEQ ID NO: 369856 - DNA, 140 bp, Artificial Sequence
  Synthetic
atggccgactcccaagtacgttgaaaaggtacaggttgcttatttttcatcaatttaaaagattgcacatcgaaacatttttttagttcttccttggatcttatgagtagtttgtcgttgggagacccagcatggcgtat

SEQ ID NO: 369857 - DNA, 140 bp, Artificial Sequence
  Synthetic
aggccctggctgctgatatgatgtgcaatcttttaaattgatgaaaaataagcaacctgtaccttttcaagttgactgtatactgtttaaggaagtggcagcagaatgtatgaagagatagaccttttgggacagcggtg

SEQ ID NO: 369858 - DNA, 140 bp, Artificial Sequence
  Synthetic
caccgctgtcccaaaaggtctatctcttcatacattctgctgccacttccttaaacagtatacagtcaacttgaaaaggtacaggttgcttatttttcatcaatttaaaagattgcacatcatatcagcagccagggcct

SEQ ID NO: 369859 - DNA, 140 bp, Artificial Sequence
  Synthetic
atacgccatgctgggtctccatgtgttaacaaggttcatttggtttcaggaggtagtgctatacggtaagatatgtgagaccttcctaaggtgctgtacagaattcaataggtcaggggtcgtacttgggagtcggccat

SEQ ID NO: 369860 - DNA, 140 bp, Artificial Sequence
  Synthetic
atggccgactcccaagtacgacccctgacctattgaattctgtacagcaccttaggaaggtctcacatatcttaccgtatagcactacctcctgaaaccaaatgaaccttgttaacacatggagacccagcatggcgtat

SEQ ID NO: 369861 - DNA, 140 bp, Artificial Sequence
  Synthetic
atacgccatgctgggtctcccttcaaataaaaaagagaatatgctgtgttgtgtatacagtagtagcatggagctcttacaaggacctttctatttgaacaggagacaagctgtccttggcgtacttgggagtcggccat

SEQ ID NO: 369862 - DNA, 140 bp, Artificial Sequence
  Synthetic
atggccgactcccaagtacgccaaggacagcttgtctcctgttcaaatagaaaggtccttgtaagagctccatgctactactgtatacacaacacagcatattctcttttttatttgaagggagacccagcatggcgtat

SEQ ID NO: 369863 - DNA, 140 bp, Artificial Sequence
  Synthetic
atacgccatgctgggtctcccaaggtgcaaagccagcgggaattttttaaacagaagcagtagagaccactttataagtactgtttcaggcttaaacctagtttatggcttcctcataaacgtacttgggagtcggccat

SEQ ID NO: 369864 - DNA, 140 bp, Artificial Sequence
  Synthetic
atggccgactcccaagtacgtttatgaggaagccataaactaggtttaagcctgaaacagtacttataaagtggtctctactgcttctgtttaaaaaattcccgctggctttgcaccttgggagacccagcatggcgtat

SEQ ID NO: 369865 - DNA, 140 bp, Artificial Sequence
  Synthetic
aggccctggctgctgatatgttagggaaaaagttttcaacaagttgtagaagaattgaagacaacattgcaaggctttacctacaaacatctatatactgctcggttagagatgtggaaggaccttttgggacagcggtg

SEQ ID NO: 369866 - DNA, 140 bp, Artificial Sequence
  Synthetic
caccgctgtcccaaaaggtccttccacatctctaaccgagcagtatatagatgtttgtaggtaaagccttgcaatgttgtcttcaattcttctacaacttgttgaaaactttttccctaacatatcagcagccagggcct

SEQ ID NO: 369867 - DNA, 140 bp, Artificial Sequence
  Synthetic
atacgccatgctgggtctcctagaaccgcaagactgctactaggctgcccaaatgtgaggaaagctgcaaataaagaagggaaaaagctgtcaaaattaaacagcgatacatccactgaccgtacttgggagtcggccat

SEQ ID NO: 369868 - DNA, 140 bp, Artificial Sequence
  Synthetic
atggccgactcccaagtacggtcagtggatgtatcgctgtttaattttgacagctttttcccttctttatttgcagctttcctcacatttgggcagcctagtagcagtcttgcggttctaggagacccagcatggcgtat

SEQ ID NO: 369869 - DNA, 140 bp, Artificial Sequence
  Synthetic
atacgccatgctgggtctccacacaaagcgttgcttctgaagtgtcagacaggaggtcctatagctcaagcaggagtaaaattcgtagtatctttggaagatacaactcccagaaaaaaccgtacttgggagtcggccat

SEQ ID NO: 369870 - DNA, 140 bp, Artificial Sequence
  Synthetic
atggccgactcccaagtacggttttttctgggagttgtatcttccaaagatactacgaattttactcctgcttgagctataggacctcctgtctgacacttcagaagcaacgctttgtgtggagacccagcatggcgtat

SEQ ID NO: 369871 - DNA, 140 bp, Artificial Sequence
  Synthetic
atacgccatgctgggtctccgaactgggttagcatctctgaagtgacagagacaacaagcatagtcgcatcacctaaaactcacatgatgctaaaggactgctttaaaattatactgggtcgtacttgggagtcggccat

SEQ ID NO: 369872 - DNA, 140 bp, Artificial Sequence
  Synthetic
atggccgactcccaagtacgacccagtataattttaaagcagtcctttagcatcatgtgagttttaggtgatgcgactatgcttgttgtctctgtcacttcagagatgctaacccagttcggagacccagcatggcgtat

SEQ ID NO: 369873 - DNA, 140 bp, Artificial Sequence
  Synthetic
aggccctggctgctgatatgcacctaaaactcacatgatgctaaaggactgctttaaaattatactgggtactgagaataaaaagatagttaaaatgcttcgagggaagctaaagaaactgaccttttgggacagcggtg

SEQ ID NO: 369874 - DNA, 140 bp, Artificial Sequence
  Synthetic
caccgctgtcccaaaaggtcagtttctttagcttccctcgaagcattttaactatctttttattctcagtacccagtataattttaaagcagtcctttagcatcatgtgagttttaggtgcatatcagcagccagggcct

SEQ ID NO: 369875 - DNA, 140 bp, Artificial Sequence
  Synthetic
atacgccatgctgggtctcctactcagcacggttgatggtctaacagatcaacagaaagaaaacattgtgaatgggatatttgagccttcaaagttgtccttctaccactggaaagaattcgtacttgggagtcggccat

SEQ ID NO: 369876 - DNA, 140 bp, Artificial Sequence
  Synthetic
atggccgactcccaagtacgaattctttccagtggtagaaggacaactttgaaggctcaaatatcccattcacaatgttttctttctgttgatctgttagaccatcaaccgtgctgagtaggagacccagcatggcgtat

SEQ ID NO: 369877 - DNA, 140 bp, Artificial Sequence
  Synthetic
aggccctggctgctgatatgaatgggatatttgagccttcaaagttgtccttctaccactggaaagaattagtcaagaaaaacatagatgaggttttgcttactgaggatggaaatctaagaccttttgggacagcggtg

SEQ ID NO: 369878 - DNA, 140 bp, Artificial Sequence
  Synthetic
caccgctgtcccaaaaggtcttagatttccatcctcagtaagcaaaacctcatctatgtttttcttgactaattctttccagtggtagaaggacaactttgaaggctcaaatatcccattcatatcagcagccagggcct

SEQ ID NO: 369879 - DNA, 140 bp, Artificial Sequence
  Synthetic
atacgccatgctgggtctccaagaagcttaagtttatgaacatacattccccggaactgataccagagaactgcctcttttctagtgaagagtttaatgaattgattaagttgaagaagccgtacttgggagtcggccat

SEQ ID NO: 369880 - DNA, 140 bp, Artificial Sequence
  Synthetic
atggccgactcccaagtacggcttcttcaacttaatcaattcattaaactcttcactagaaaagaggcagttctctggtatcagttccggggaatgtatgttcataaacttaagcttcttggagacccagcatggcgtat

SEQ ID NO: 369881 - DNA, 140 bp, Artificial Sequence
  Synthetic
aggccctggctgctgatatgctgcctcttttctagtgaagagtttaatgaattgattaagttgaagaagcttctcctcaacgaacaacaagatgaacaggagttgaagcaagatcttttagaccttttgggacagcggtg

SEQ ID NO: 369882 - DNA, 140 bp, Artificial Sequence
  Synthetic
caccgctgtcccaaaaggtctaaaagatcttgcttcaactcctgttcatcttgttgttcgttgaggagaagcttcttcaacttaatcaattcattaaactcttcactagaaaagaggcagcatatcagcagccagggcct

SEQ ID NO: 369883 - DNA, 140 bp, Artificial Sequence
  Synthetic
atacgccatgctgggtctcccaatgacaaggttcagaaattcatttaccatctgtctgaggagctatataacataaggctgcagcatctggaattatcaaagcttaagcaggagcaccctcgtacttgggagtcggccat

SEQ ID NO: 369884 - DNA, 140 bp, Artificial Sequence
  Synthetic
atggccgactcccaagtacgagggtgctcctgcttaagctttgataattccagatgctgcagccttatgttatatagctcctcagacagatggtaaatgaatttctgaaccttgtcattgggagacccagcatggcgtat

SEQ ID NO: 369885 - DNA, 140 bp, Artificial Sequence
  Synthetic
aggccctggctgctgatatgacataaggctgcagcatctggaattatcaaagcttaagcaggagcaccctagtgttagcttcactaaggaagaggttctgataaagcggctagagaagaagaccttttgggacagcggtg

SEQ ID NO: 369886 - DNA, 140 bp, Artificial Sequence
  Synthetic
caccgctgtcccaaaaggtcttcttctctagccgctttatcagaacctcttccttagtgaagctaacactagggtgctcctgcttaagctttgataattccagatgctgcagccttatgtcatatcagcagccagggcct

SEQ ID NO: 369887 - DNA, 140 bp, Artificial Sequence
  Synthetic
atacgccatgctgggtctcctcttcgctgctctttcagctccttggtgcctacactacaaagcactagagtcttatctggtaagacatccagagatacttgactgtggatctaaggaggacgtacttgggagtcggccat

SEQ ID NO: 369888 - DNA, 140 bp, Artificial Sequence
  Synthetic
atggccgactcccaagtacgtcctccttagatccacagtcaagtatctctggatgtcttaccagataagactctagtgctttgtagtgtaggcaccaaggagctgaaagagcagcgaagaggagacccagcatggcgtat

SEQ ID NO: 369889 - DNA, 140 bp, Artificial Sequence
  Synthetic
atacgccatgctgggtctcctgtatcgaagagatgacgatgagctaacaaacagtacaagcttaaaactcgggtttttggtgaagtatgctgtcaccctgtttacatccaatggcgagcccgtacttgggagtcggccat

SEQ ID NO: 369890 - DNA, 140 bp, Artificial Sequence
  Synthetic
atggccgactcccaagtacgggctcgccattggatgtaaacagggtgacagcatacttcaccaaaaacccgagttttaagcttgtactgtttgttagctcatcgtcatctcttcgatacaggagacccagcatggcgtat

SEQ ID NO: 369891 - DNA, 140 bp, Artificial Sequence
  Synthetic
aggccctggctgctgatatgagagtgaatgggcacctgatccacaaggttgagccacacctgaacacatcctggatgtcgtgggatggttgtgacttagactatttctgcaatatggggggaccttttgggacagcggtg

SEQ ID NO: 369892 - DNA, 140 bp, Artificial Sequence
  Synthetic
caccgctgtcccaaaaggtccccccatattgcagaaatagtctaagtcacaaccatcccacgacatccaggatgtgttcaggtgtggctcaaccttgtggatcaggtgcccattcactctcatatcagcagccagggcct

SEQ ID NO: 369893 - DNA, 140 bp, Artificial Sequence
  Synthetic
aggccctggctgctgatatgggtctgtccgggaacagttatgacttcatctggaccactcaaatgatagcaaatagcaattttaacgtctgcaaaagactgaccggaaggagtactgggggaccttttgggacagcggtg

SEQ ID NO: 369894 - DNA, 140 bp, Artificial Sequence
  Synthetic
caccgctgtcccaaaaggtcccccagtactccttccggtcagtcttttgcagacgttaaaattgctatttgctatcatttgagtggtccagatgaagtcataactgttcccggacagacccatatcagcagccagggcct

SEQ ID NO: 369895 - DNA, 140 bp, Artificial Sequence
  Synthetic
atacgccatgctgggtctccttggtaggagaaacaggcatggcaatattacaacagctggcttttgcacaagcactaaattatgagcaccgcttttatgcagtcttagcacctaaagcaccgtacttgggagtcggccat

SEQ ID NO: 369896 - DNA, 140 bp, Artificial Sequence
  Synthetic
atggccgactcccaagtacggtgctttaggtgctaagactgcataaaagcggtgctcataatttagtgcttgtgcaaaagccagctgttgtaatattgccatgcctgtttctcctaccaaggagacccagcatggcgtat

SEQ ID NO: 369897 - DNA, 140 bp, Artificial Sequence
  Synthetic
atacgccatgctgggtctccagctagggggagcaagagatctattggtgcaagaaaccggcactaaagtcatgcatgcgaccactgaaatgttcagtagaaaccttctaaaaacaacatccgtacttgggagtcggccat

SEQ ID NO: 369898 - DNA, 140 bp, Artificial Sequence
  Synthetic
atggccgactcccaagtacggatgttgtttttagaaggtttctactgaacatttcagtggtcgcatgcatgactttagtgccggtttcttgcaccaatagatctcttgctccccctagctggagacccagcatggcgtat

SEQ ID NO: 369899 - DNA, 140 bp, Artificial Sequence
  Synthetic
aggccctggctgctgatatggaaggtagcaacttggtcaacttctacaaagtcatttgcatttcaggtgacaataccaaatggggcccaatacactgctgttccttcttttcaggcatgagaccttttgggacagcggtg

SEQ ID NO: 369900 - DNA, 140 bp, Artificial Sequence
  Synthetic
caccgctgtcccaaaaggtctcatgcctgaaaagaaggaacagcagtgtattgggccccatttggtattgtcacctgaaatgcaaatgactttgtagaagttgaccaagttgctaccttccatatcagcagccagggcct

SEQ ID NO: 369901 - DNA, 140 bp, Artificial Sequence
  Synthetic
atacgccatgctgggtctccacatttattaaaaacttgtgtaggcaagtagagataccagcaggcagtattaaaaaaatcttaaatgttctcagatacaaactatgcagcaaaggaggtgcgtacttgggagtcggccat

SEQ ID NO: 369902 - DNA, 140 bp, Artificial Sequence
  Synthetic
atggccgactcccaagtacgcacctcctttgctgcatagtttgtatctgagaacatttaagatttttttaatactgcctgctggtatctctacttgcctacacaagtttttaataaatgtggagacccagcatggcgtat

SEQ ID NO: 369903 - DNA, 140 bp, Artificial Sequence
  Synthetic
aggccctggctgctgatatgtaaaaaaatcttaaatgttctcagatacaaactatgcagcaaaggaggtgtagagcagcacagtgaagaggatttaaggaagttgttggtagacaatttagaccttttgggacagcggtg

SEQ ID NO: 369904 - DNA, 140 bp, Artificial Sequence
  Synthetic
caccgctgtcccaaaaggtctaaattgtctaccaacaacttccttaaatcctcttcactgtgctgctctacacctcctttgctgcatagtttgtatctgagaacatttaagatttttttacatatcagcagccagggcct

SEQ ID NO: 369905 - DNA, 140 bp, Artificial Sequence
  Synthetic
atacgccatgctgggtctccaagcaaagggctcatggcactaaacagttacaaccatatgggtcagggtattcatcatgcaacctcttcagtgctaacttctttagctgctgtactcttccgtacttgggagtcggccat

SEQ ID NO: 369906 - DNA, 140 bp, Artificial Sequence
  Synthetic
atggccgactcccaagtacggaagagtacagcagctaaagaagttagcactgaagaggttgcatgatgaataccctgacccatatggttgtaactgtttagtgccatgagccctttgcttggagacccagcatggcgtat

SEQ ID NO: 369907 - DNA, 140 bp, Artificial Sequence
  Synthetic
aggccctggctgctgatatgttcatcatgcaacctcttcagtgctaacttctttagctgctgtactcttcgaggagctagcaattttttatcttaaaaggagtttaccccaaacaacagtgaccttttgggacagcggtg

SEQ ID NO: 369908 - DNA, 140 bp, Artificial Sequence
  Synthetic
caccgctgtcccaaaaggtcactgttgtttggggtaaactccttttaagataaaaaattgctagctcctcgaagagtacagcagctaaagaagttagcactgaagaggttgcatgatgaacatatcagcagccagggcct

SEQ ID NO: 369909 - DNA, 140 bp, Artificial Sequence
  Synthetic
atacgccatgctgggtctcctcactggcatactatccaaagagctctactcccagtatgatgagacattttggaagcatgcctgtagacttaagaacttcacagctgctgtacaaagatgcgtacttgggagtcggccat

SEQ ID NO: 369910 - DNA, 140 bp, Artificial Sequence
  Synthetic
atggccgactcccaagtacgcatctttgtacagcagctgtgaagttcttaagtctacaggcatgcttccaaaatgtctcatcatactgggagtagagctctttggatagtatgccagtgaggagacccagcatggcgtat

SEQ ID NO: 369911 - DNA, 140 bp, Artificial Sequence
  Synthetic
aggccctggctgctgatatgtggaagcatgcctgtagacttaagaacttcacagctgctgtacaaagatgttgtcaaatgaaagatagtgccaaaaccttagtgagcgactgctttcttggaccttttgggacagcggtg

SEQ ID NO: 369912 - DNA, 140 bp, Artificial Sequence
  Synthetic
caccgctgtcccaaaaggtccaagaaagcagtcgctcactaaggttttggcactatctttcatttgacaacatctttgtacagcagctgtgaagttcttaagtctacaggcatgcttccacatatcagcagccagggcct

SEQ ID NO: 369913 - DNA, 140 bp, Artificial Sequence
  Synthetic
atacgccatgctgggtctcctaccaagacctattttattttgctttattttattttgcttcatactattatattcttcttttacatgttgaagggctgtgcggcaacgatatctttgagacgtacttgggagtcggccat

SEQ ID NO: 369914 - DNA, 140 bp, Artificial Sequence
  Synthetic
atggccgactcccaagtacgtctcaaagatatcgttgccgcacagcccttcaacatgtaaaagaagaatataatagtatgaagcaaaataaaataaagcaaaataaaataggtcttggtaggagacccagcatggcgtat

SEQ ID NO: 369915 - DNA, 140 bp, Artificial Sequence
  Synthetic
atacgccatgctgggtctccaaattcatgttcactggattgataaatagctctgtaacctcgcctcaaagtttgatgcaagcatgtcaggtttcatcccaacaagctatgtataatagtgcgtacttgggagtcggccat

SEQ ID NO: 369916 - DNA, 140 bp, Artificial Sequence
  Synthetic
atggccgactcccaagtacgcactattatacatagcttgttgggatgaaacctgacatgcttgcatcaaactttgaggcgaggttacagagctatttatcaatccagtgaacatgaatttggagacccagcatggcgtat

SEQ ID NO: 369917 - DNA, 140 bp, Artificial Sequence
  Synthetic
aggccctggctgctgatatgtttgatgcaagcatgtcaggtttcatcccaacaagctatgtataatagtgtcccccttgtcaccaataccaccttcaccttactaaggcaacagattttcgaccttttgggacagcggtg

SEQ ID NO: 369918 - DNA, 140 bp, Artificial Sequence
  Synthetic
caccgctgtcccaaaaggtcgaaaatctgttgccttagtaaggtgaaggtggtattggtgacaagggggacactattatacatagcttgttgggatgaaacctgacatgcttgcatcaaacatatcagcagccagggcct

SEQ ID NO: 369919 - DNA, 140 bp, Artificial Sequence
  Synthetic
atacgccatgctgggtctcctaccttgtctccctttggcaggctgtttgtaccgacctactccggattagttagctcagcggttgctttagaagatgctgaagtcattgctggggcagctcgtacttgggagtcggccat

SEQ ID NO: 369920 - DNA, 140 bp, Artificial Sequence
  Synthetic
atggccgactcccaagtacgagctgccccagcaatgacttcagcatcttctaaagcaaccgctgagctaactaatccggagtaggtcggtacaaacagcctgccaaagggagacaaggtaggagacccagcatggcgtat

SEQ ID NO: 369921 - DNA, 140 bp, Artificial Sequence
  Synthetic
atacgccatgctgggtctcccaaacacttcacatgaacagtgtatcgattcagtcaagcagcttgactacatttgacagtttaggtcgtagtagggcaaattctacagttgaagatagcacgtacttgggagtcggccat

SEQ ID NO: 369922 - DNA, 140 bp, Artificial Sequence
  Synthetic
atggccgactcccaagtacgtgctatcttcaactgtagaatttgccctactacgacctaaactgtcaaatgtagtcaagctgcttgactgaatcgatacactgttcatgtgaagtgtttgggagacccagcatggcgtat

SEQ ID NO: 369923 - DNA, 140 bp, Artificial Sequence
  Synthetic
aggccctggctgctgatatgatttattaaggcactaaacagcctcaaatcaactcaagcttgtgagataattcagaataggatcacaggtctttattgtaatagcaatgaaggacctcttgaccttttgggacagcggtg

SEQ ID NO: 369924 - DNA, 140 bp, Artificial Sequence
  Synthetic
caccgctgtcccaaaaggtcaagaggtccttcattgctattacaataaagacctgtgatcctattctgaattatctcacaagcttgagttgatttgaggctgtttagtgccttaataaatcatatcagcagccagggcct

SEQ ID NO: 369925 - DNA, 140 bp, Artificial Sequence
  Synthetic
atacgccatgctgggtctccgcttagagatggtaaaagaagagggaatttagaactagcaaatagaatccagtctgtgctgtgcgttctgatagcaggatattataggtcatttggagggcgtacttgggagtcggccat

SEQ ID NO: 369926 - DNA, 140 bp, Artificial Sequence
  Synthetic
atggccgactcccaagtacgccctccaaatgacctataatatcctgctatcagaacgcacagcacagactggattctatttgctagttctaaattccctcttcttttaccatctctaagcggagacccagcatggcgtat

SEQ ID NO: 369927 - DNA, 140 bp, Artificial Sequence
  Synthetic
aggccctggctgctgatatgagtctgtgctgtgcgttctgatagcaggatattataggtcatttggaggggaagggactgagaaacaggtaaaagcatcattgaatagggacgacaataagaccttttgggacagcggtg

SEQ ID NO: 369928 - DNA, 140 bp, Artificial Sequence
  Synthetic
caccgctgtcccaaaaggtcttattgtcgtccctattcaatgatgcttttacctgtttctcagtcccttcccctccaaatgacctataatatcctgctatcagaacgcacagcacagactcatatcagcagccagggcct

SEQ ID NO: 369929 - DNA, 140 bp, Artificial Sequence
  Synthetic
atacgccatgctgggtctcctgcaagcctaacttgttcaggatgctatgcctgtagttcaggtatctcctgcaaggttagaatacatgtggacgagccagatgagctcacagtgcatgtgcgtacttgggagtcggccat

SEQ ID NO: 369930 - DNA, 140 bp, Artificial Sequence
  Synthetic
atggccgactcccaagtacgcacatgcactgtgagctcatctggctcgtccacatgtattctaaccttgcaggagatacctgaactacaggcatagcatcctgaacaagttaggcttgcaggagacccagcatggcgtat

SEQ ID NO: 369931 - DNA, 140 bp, Artificial Sequence
  Synthetic
atacgccatgctgggtctccagttggaaagattgggagtttctaggatggaagttgatgaactgatgccaagtattagctctgatgataccttagcccagcttgtggcaaaaaagctaatcgtacttgggagtcggccat

SEQ ID NO: 369932 - DNA, 140 bp, Artificial Sequence
  Synthetic
atggccgactcccaagtacgattagcttttttgccacaagctgggctaaggtatcatcagagctaatacttggcatcagttcatcaacttccatcctagaaactcccaatctttccaactggagacccagcatggcgtat

SEQ ID NO: 369933 - DNA, 140 bp, Artificial Sequence
  Synthetic
atacgccatgctgggtctcccagcctcaatgtttcaacagaagaatactcagcagaggtatctaggctcaagcaaacactaacggcccgaaatgttctgcatgggttagctggaggaatacgtacttgggagtcggccat

SEQ ID NO: 369934 - DNA, 140 bp, Artificial Sequence
  Synthetic
atggccgactcccaagtacgtattcctccagctaacccatgcagaacatttcgggccgttagtgtttgcttgagcctagatacctctgctgagtattcttctgttgaaacattgaggctgggagacccagcatggcgtat

SEQ ID NO: 369935 - DNA, 140 bp, Artificial Sequence
  Synthetic
atacgccatgctgggtctccactgtgtgataaaaggaagggaggttcgtaaaggtcaatcagttttgaggcagtacaagacggaaattaggattggcaaagcatcaatcggctctagaagcgtacttgggagtcggccat

SEQ ID NO: 369936 - DNA, 140 bp, Artificial Sequence
  Synthetic
atggccgactcccaagtacgcttctagagccgattgatgctttgccaatcctaatttccgtcttgtactgcctcaaaactgattgacctttacgaacctcccttccttttatcacacagtggagacccagcatggcgtat

SEQ ID NO: 369937 - DNA, 140 bp, Artificial Sequence
  Synthetic
aggccctggctgctgatatggcaaggttagaatacatgtggacgagccagatgagctcacagtgcatgtgaaaagcagcgacccagacattgtggcagccagctcaagtctcatggcaaggaccttttgggacagcggtg

SEQ ID NO: 369938 - DNA, 140 bp, Artificial Sequence
  Synthetic
caccgctgtcccaaaaggtccttgccatgagacttgagctggctgccacaatgtctgggtcgctgcttttcacatgcactgtgagctcatctggctcgtccacatgtattctaaccttgccatatcagcagccagggcct

SEQ ID NO: 369939 - DNA, 140 bp, Artificial Sequence
  Synthetic
aggccctggctgctgatatggcacaaactaccgtgacagttgcggcaaacaattaactggtaggataatcaccaagtacactcactggttagacacttttctaagctgttctgtctccatgaccttttgggacagcggtg

SEQ ID NO: 369940 - DNA, 140 bp, Artificial Sequence
  Synthetic
caccgctgtcccaaaaggtcatggagacagaacagcttagaaaagtgtctaaccagtgagtgtacttggtgattatcctaccagttaattgtttgccgcaactgtcacggtagtttgtgccatatcagcagccagggcct

SEQ ID NO: 369941 - DNA, 140 bp, Artificial Sequence
  Synthetic
atacgccatgctgggtctccgatgtgttaacctgatcacatttgaagatggtctaagggagctttcagtaatacaaagtcatctaaaagtttttgagaatgagttcaccaacttaaatctcgtacttgggagtcggccat

SEQ ID NO: 369942 - DNA, 140 bp, Artificial Sequence
  Synthetic
atggccgactcccaagtacgagatttaagttggtgaactcattctcaaaaacttttagatgactttgtattactgaaagctcccttagaccatcttcaaatgtgatcaggttaacacatcggagacccagcatggcgtat

SEQ ID NO: 369943 - DNA, 140 bp, Artificial Sequence
  Synthetic
aggccctggctgctgatatgatacaaagtcatctaaaagtttttgagaatgagttcaccaacttaaatcttcagttctctgacccaaacagacaaaaacttagaatagtcgaatccagacgaccttttgggacagcggtg

SEQ ID NO: 369944 - DNA, 140 bp, Artificial Sequence
  Synthetic
caccgctgtcccaaaaggtcgtctggattcgactattctaagtttttgtctgtttgggtcagagaactgaagatttaagttggtgaactcattctcaaaaacttttagatgactttgtatcatatcagcagccagggcct

SEQ ID NO: 369945 - DNA, 140 bp, Artificial Sequence
  Synthetic
atacgccatgctgggtctccctgttttcagcaaccgaacaggttcggctgtctaataaccctgcagttgtcatgggttatctattagatgaatcggcaatttctgaagttaaacctactacgtacttgggagtcggccat

SEQ ID NO: 369946 - DNA, 140 bp, Artificial Sequence
  Synthetic
atggccgactcccaagtacgtagtaggtttaacttcagaaattgccgattcatctaatagataacccatgacaactgcagggttattagacagccgaacctgttcggttgctgaaaacagggagacccagcatggcgtat

SEQ ID NO: 369947 - DNA, 140 bp, Artificial Sequence
  Synthetic
aggccctggctgctgatatgcatgggttatctattagatgaatcggcaatttctgaagttaaacctactaaggttgatttttcgaatttgcttaaagaccgctttaaaataatgcaattggaccttttgggacagcggtg

SEQ ID NO: 369948 - DNA, 140 bp, Artificial Sequence
  Synthetic
caccgctgtcccaaaaggtccaattgcattattttaaagcggtctttaagcaaattcgaaaaatcaaccttagtaggtttaacttcagaaattgccgattcatctaatagataacccatgcatatcagcagccagggcct

SEQ ID NO: 369949 - DNA, 140 bp, Artificial Sequence
  Synthetic
atacgccatgctgggtctccctcagaaaagaatggtcttagtccagatttgcaacaagttgcgagatactctaaccatttaaccttgctcagtaggatgatacaacaagcaaaaccaacccgtacttgggagtcggccat

SEQ ID NO: 369950 - DNA, 140 bp, Artificial Sequence
  Synthetic
atggccgactcccaagtacgggttggttttgcttgttgtatcatcctactgagcaaggttaaatggttagagtatctcgcaacttgttgcaaatctggactaagaccattcttttctgagggagacccagcatggcgtat

SEQ ID NO: 369951 - DNA, 140 bp, Artificial Sequence
  Synthetic
aggccctggctgctgatatgctaaccatttaaccttgctcagtaggatgatacaacaagcaaaaccaaccgtaactgttttctacatgcttaagggtaacttaatgaacacggaaccaacgaccttttgggacagcggtg

SEQ ID NO: 369952 - DNA, 140 bp, Artificial Sequence
  Synthetic
caccgctgtcccaaaaggtcgttggttccgtgttcattaagttacccttaagcatgtagaaaacagttacggttggttttgcttgttgtatcatcctactgagcaaggttaaatggttagcatatcagcagccagggcct

SEQ ID NO: 369953 - DNA, 140 bp, Artificial Sequence
  Synthetic
atacgccatgctgggtctcctttccgacaccggaattgatgcaagtacatattctgtaaaatactggaagattctccactgcatttctgctatcggatgcctgcctctgagtcaagcagacgtacttgggagtcggccat

SEQ ID NO: 369954 - DNA, 140 bp, Artificial Sequence
  Synthetic
atggccgactcccaagtacgtctgcttgactcagaggcaggcatccgatagcagaaatgcagtggagaatcttccagtattttacagaatatgtacttgcatcaattccggtgtcggaaaggagacccagcatggcgtat

SEQ ID NO: 369955 - DNA, 140 bp, Artificial Sequence
  Synthetic
aggccctggctgctgatatgattctccactgcatttctgctatcggatgcctgcctctgagtcaagcagacaagtcttcactactcatgagtttcctaaactggagggtgaacatggacagaccttttgggacagcggtg

SEQ ID NO: 369956 - DNA, 140 bp, Artificial Sequence
  Synthetic
caccgctgtcccaaaaggtctgtccatgttcaccctccagtttaggaaactcatgagtagtgaagacttgtctgcttgactcagaggcaggcatccgatagcagaaatgcagtggagaatcatatcagcagccagggcct

SEQ ID NO: 369957 - DNA, 140 bp, Artificial Sequence
  Synthetic
atacgccatgctgggtctccctaaagattctctgtgcttttatattgtcgaaagagactattgcaacagctgcaaaaatgaggaaacacagaggtgtgtgaacgcaaagcttgaacagcccgtacttgggagtcggccat

SEQ ID NO: 369958 - DNA, 140 bp, Artificial Sequence
  Synthetic
atggccgactcccaagtacgggctgttcaagctttgcgttcacacacctctgtgtttcctcatttttgcagctgttgcaatagtctctttcgacaatataaaagcacagagaatctttagggagacccagcatggcgtat

SEQ ID NO: 369959 - DNA, 140 bp, Artificial Sequence
  Synthetic
atacgccatgctgggtctccgaatttgacgggcaagttattgctaatatacttgccagtgaattaagttccgtgaagcgagactctgaacgtgaaggtctaactgatctccttgattacccgtacttgggagtcggccat

SEQ ID NO: 369960 - DNA, 140 bp, Artificial Sequence
  Synthetic
atggccgactcccaagtacgggtaatcaaggagatcagttagaccttcacgttcagagtctcgcttcacggaacttaattcactggcaagtatattagcaataacttgcccgtcaaattcggagacccagcatggcgtat

SEQ ID NO: 369961 - DNA, 140 bp, Artificial Sequence
  Synthetic
aggccctggctgctgatatgcgtgaagcgagactctgaacgtgaaggtctaactgatctccttgattacctaaactcacccactgaactgttgaagaagaagccctacttaggaacaaccgaccttttgggacagcggtg

SEQ ID NO: 369962 - DNA, 140 bp, Artificial Sequence
  Synthetic
caccgctgtcccaaaaggtcggttgttcctaagtagggcttcttcttcaacagttcagtgggtgagtttaggtaatcaaggagatcagttagaccttcacgttcagagtctcgcttcacgcatatcagcagccagggcct

SEQ ID NO: 369963 - DNA, 140 bp, Artificial Sequence
  Synthetic
atacgccatgctgggtctcccagtagcagatctggagagtctattggtatcttcattgcagggaaattgcacatccacctttcatctgagtccattgccctgctgtgtgaaactgaaaggcgtacttgggagtcggccat

SEQ ID NO: 369964 - DNA, 140 bp, Artificial Sequence
  Synthetic
atggccgactcccaagtacgcctttcagtttcacacagcagggcaatggactcagatgaaaggtggatgtgcaatttccctgcaatgaagataccaatagactctccagatctgctactgggagacccagcatggcgtat

SEQ ID NO: 369965 - DNA, 140 bp, Artificial Sequence
  Synthetic
aggccctggctgctgatatgacatccacctttcatctgagtccattgccctgctgtgtgaaactgaaaggcaggtgctctcttggatgagcaaaaggaggactgaagtaataactaaagagaccttttgggacagcggtg

SEQ ID NO: 369966 - DNA, 140 bp, Artificial Sequence
  Synthetic
caccgctgtcccaaaaggtctctttagttattacttcagtcctccttttgctcatccaagagagcacctgcctttcagtttcacacagcagggcaatggactcagatgaaaggtggatgtcatatcagcagccagggcct

SEQ ID NO: 369967 - DNA, 140 bp, Artificial Sequence
  Synthetic
atacgccatgctgggtctccaaaagcacaaggatggcagcgcactgtcagtcatacctgatggcagcaatcctcgactactaaaatttgtgcctcttaagaagggactggcagtggtgaacgtacttgggagtcggccat

SEQ ID NO: 369968 - DNA, 140 bp, Artificial Sequence
  Synthetic
atggccgactcccaagtacgttcaccactgccagtcccttcttaagaggcacaaattttagtagtcgaggattgctgccatcaggtatgactgacagtgcgctgccatccttgtgcttttggagacccagcatggcgtat

SEQ ID NO: 369969 - DNA, 140 bp, Artificial Sequence
  Synthetic
aggccctggctgctgatatgcctcgactactaaaatttgtgcctcttaagaagggactggcagtggtgaagattaaaaaacaaattttgacggtgaagaaacaggtcgtgtatgatgctggaccttttgggacagcggtg

SEQ ID NO: 369970 - DNA, 140 bp, Artificial Sequence
  Synthetic
caccgctgtcccaaaaggtccagcatcatacacgacctgtttcttcaccgtcaaaatttgttttttaatcttcaccactgccagtcccttcttaagaggcacaaattttagtagtcgaggcatatcagcagccagggcct

SEQ ID NO: 369971 - DNA, 140 bp, Artificial Sequence
  Synthetic
atacgccatgctgggtctccgatgaaaccgacactcagaccacataccacgaaaaccttttgaaggtaaagcagcttgtggactgctctacggacagtaagaagcttttacctcagtcagcgtacttgggagtcggccat

SEQ ID NO: 369972 - DNA, 140 bp, Artificial Sequence
  Synthetic
atggccgactcccaagtacgctgactgaggtaaaagcttcttactgtccgtagagcagtccacaagctgctttaccttcaaaaggttttcgtggtatgtggtctgagtgtcggtttcatcggagacccagcatggcgtat

SEQ ID NO: 369973 - DNA, 140 bp, Artificial Sequence
  Synthetic
atacgccatgctgggtctcccttctccttaactcattgacgttgctccactgtttcttaaaacatgctcgcccttatataggaagcgagagcaaaagtagcctactgcacaagtacctcacgtacttgggagtcggccat

SEQ ID NO: 369974 - DNA, 140 bp, Artificial Sequence
  Synthetic
atggccgactcccaagtacgtgaggtacttgtgcagtaggctacttttgctctcgcttcctatataagggcgagcatgttttaagaaacagtggagcaacgtcaatgagttaaggagaagggagacccagcatggcgtat

SEQ ID NO: 369975 - DNA, 140 bp, Artificial Sequence
  Synthetic
aggccctggctgctgatatgcccttatataggaagcgagagcaaaagtagcctactgcacaagtacctcaaatcagggggtgtcaggcagcggaacactgaggtgctttttagagaaaaggaccttttgggacagcggtg

SEQ ID NO: 369976 - DNA, 140 bp, Artificial Sequence
  Synthetic
caccgctgtcccaaaaggtccttttctctaaaaagcacctcagtgttccgctgcctgacaccccctgatttgaggtacttgtgcagtaggctacttttgctctcgcttcctatataagggcatatcagcagccagggcct

SEQ ID NO: 369977 - DNA, 140 bp, Artificial Sequence
  Synthetic
aggccctggctgctgatatgcactcagctgttggtctgaagttcaaaactatatcgaagacataggcttcaacaatgtgcttgtaaacattgacagaaacacggtgaagagtgaacttttgaccttttgggacagcggtg

SEQ ID NO: 369978 - DNA, 140 bp, Artificial Sequence
  Synthetic
caccgctgtcccaaaaggtcaaaagttcactcttcaccgtgtttctgtcaatgtttacaagcacattgttgaagcctatgtcttcgatatagttttgaacttcagaccaacagctgagtgcatatcagcagccagggcct

SEQ ID NO: 369979 - DNA, 140 bp, Artificial Sequence
  Synthetic
atacgccatgctgggtctccatgtgaggacactggtatcctacgtcagcactgaaacgatccctaagttcctgcttgcatttcttctttatgaagaagtgttaatgaacttaattaaccacgtacttgggagtcggccat

SEQ ID NO: 369980 - DNA, 140 bp, Artificial Sequence
  Synthetic
atggccgactcccaagtacgtggttaattaagttcattaacacttcttcataaagaagaaatgcaagcaggaacttagggatcgtttcagtgctgacgtaggataccagtgtcctcacatggagacccagcatggcgtat

SEQ ID NO: 369981 - DNA, 140 bp, Artificial Sequence
  Synthetic
aggccctggctgctgatatgctgcttgcatttcttctttatgaagaagtgttaatgaacttaattaaccagtgcaaggcagtaaaggaactcattaacagcacgggactctcagacctaggaccttttgggacagcggtg

SEQ ID NO: 369982 - DNA, 140 bp, Artificial Sequence
  Synthetic
caccgctgtcccaaaaggtcctaggtctgagagtcccgtgctgttaatgagttcctttactgccttgcactggttaattaagttcattaacacttcttcataaagaagaaatgcaagcagcatatcagcagccagggcct

SEQ ID NO: 369983 - DNA, 140 bp, Artificial Sequence
  Synthetic
atacgccatgctgggtctccagcaggagagatgggcctagatgttccttcgcagcactgttaagcttagttcatgaggattggcaaaggataggaaaaaatatccttgttcgcgcaaacacgtacttgggagtcggccat

SEQ ID NO: 369984 - DNA, 140 bp, Artificial Sequence
  Synthetic
atggccgactcccaagtacgtgtttgcgcgaacaaggatattttttcctatcctttgccaatcctcatgaactaagcttaacagtgctgcgaaggaacatctaggcccatctctcctgctggagacccagcatggcgtat

SEQ ID NO: 369985 - DNA, 140 bp, Artificial Sequence
  Synthetic
atacgccatgctgggtctccatgagctgggtgatgtgtcactgaaggtcaatattgtcttggtgcctctcaaagacatgtccaagccaaagcctgagagagtggttatagctagaagatccgtacttgggagtcggccat

SEQ ID NO: 369986 - DNA, 140 bp, Artificial Sequence
  Synthetic
atggccgactcccaagtacggatcttctagctataaccactctctcaggctttggcttggacatgtctttgagaggcaccaagacaatattgaccttcagtgacacatcacccagctcatggagacccagcatggcgtat

SEQ ID NO: 369987 - DNA, 140 bp, Artificial Sequence
  Synthetic
aggccctggctgctgatatggagtgctttgagttcaccattttgaaggacaatagcacaaggctagattacaacaaattaattgaccactgtgtggacatggaaaaaaagagggatgcaggaccttttgggacagcggtg

SEQ ID NO: 369988 - DNA, 140 bp, Artificial Sequence
  Synthetic
caccgctgtcccaaaaggtcctgcatccctctttttttccatgtccacacagtggtcaattaatttgttgtaatctagccttgtgctattgtccttcaaaatggtgaactcaaagcactccatatcagcagccagggcct

SEQ ID NO: 369989 - DNA, 140 bp, Artificial Sequence
  Synthetic
atacgccatgctgggtctcccctagcactgtgacaccagctgtacacgaagacgagcagtgtcaggagcaaataagcctagatgatctaatggcaagtgacacagtgacagacctgcctgcgtacttgggagtcggccat

SEQ ID NO: 369990 - DNA, 140 bp, Artificial Sequence
  Synthetic
atggccgactcccaagtacgcaggcaggtctgtcactgtgtcacttgccattagatcatctaggcttatttgctcctgacactgctcgtcttcgtgtacagctggtgtcacagtgctaggggagacccagcatggcgtat

SEQ ID NO: 369991 - DNA, 140 bp, Artificial Sequence
  Synthetic
aggccctggctgctgatatgaataagcctagatgatctaatggcaagtgacacagtgacagacctgcctgatagggaagcagaagctcttaaaacaggcaaccttggcttcgactgggatgaccttttgggacagcggtg

SEQ ID NO: 369992 - DNA, 140 bp, Artificial Sequence
  Synthetic
caccgctgtcccaaaaggtcatcccagtcgaagccaaggttgcctgttttaagagcttctgcttccctatcaggcaggtctgtcactgtgtcacttgccattagatcatctaggcttattcatatcagcagccagggcct

SEQ ID NO: 369993 - DNA, 140 bp, Artificial Sequence
  Synthetic
atacgccatgctgggtctccaaggtcaagtaagacggtttataccgtgccatttgctgatatctggacctttaaccaagtcggctgctctgcacttcttataaccaattcaattgttttacgtacttgggagtcggccat

SEQ ID NO: 369994 - DNA, 140 bp, Artificial Sequence
  Synthetic
atggccgactcccaagtacgtaaaacaattgaattggttataagaagtgcagagcagccgacttggttaaaggtccagatatcagcaaatggcacggtataaaccgtcttacttgaccttggagacccagcatggcgtat

SEQ ID NO: 369995 - DNA, 140 bp, Artificial Sequence
  Synthetic
atacgccatgctgggtctccctgcaattctctcaattattcattagcctttaccattctgctattctactttctttgctgttcatgtcagtttcattacttccagggtgtggggggaacgcgtacttgggagtcggccat

SEQ ID NO: 369996 - DNA, 140 bp, Artificial Sequence
  Synthetic
atggccgactcccaagtacgcgttccccccacaccctggaagtaatgaaactgacatgaacagcaaagaaagtagaatagcagaatggtaaaggctaatgaataattgagagaattgcagggagacccagcatggcgtat

SEQ ID NO: 369997 - DNA, 140 bp, Artificial Sequence
  Synthetic
aggccctggctgctgatatgtttatggattgtccaacaaaacccaacacaatgacaatagtaccacaaaggcgcccgaagagagtcacaaaaccagtctgcccgcgaacacagcatcgccgaccttttgggacagcggtg

SEQ ID NO: 369998 - DNA, 140 bp, Artificial Sequence
  Synthetic
caccgctgtcccaaaaggtcggcgatgctgtgttcgcgggcagactggttttgtgactctcttcgggcgcctttgtggtactattgtcattgtgttgggttttgttggacaatccataaacatatcagcagccagggcct

SEQ ID NO: 369999 - DNA, 140 bp, Artificial Sequence
  Synthetic
atacgccatgctgggtctcccagaaggctcaggggacacgagcacctctcccccagtcaccacacaaggcccggcctcaccagaaaccacgccagagccccacacaacaattgacatcgacgtacttgggagtcggccat

SEQ ID NO: 370000 - DNA, 140 bp, Artificial Sequence
  Synthetic
atggccgactcccaagtacgtcgatgtcaattgttgtgtggggctctggcgtggtttctggtgaggccgggccttgtgtggtgactgggggagaggtgctcgtgtcccctgagccttctgggagacccagcatggcgtat

SEQ ID NO: 370001 - DNA, 140 bp, Artificial Sequence
  Synthetic
atacgccatgctgggtctccgaaaaggagcagctggctggttgtgctgctggtgctgttgacggtttcattgtcaccggttcagtcagcgcccattagtcatgggaagacagttgaggcacgtacttgggagtcggccat

SEQ ID NO: 370002 - DNA, 140 bp, Artificial Sequence
  Synthetic
atggccgactcccaagtacgtgcctcaactgtcttcccatgactaatgggcgctgactgaaccggtgacaatgaaaccgtcaacagcaccagcagcacaaccagccagctgctccttttcggagacccagcatggcgtat

SEQ ID NO: 370003 - DNA, 140 bp, Artificial Sequence
  Synthetic
aggccctggctgctgatatgtccccacaccaacaacccacaccagtttgcccagcactctcagcgcgccaactataccgcaagaagcacatcacactgcaaggggcctactgtcagtcacgaccttttgggacagcggtg

SEQ ID NO: 370004 - DNA, 140 bp, Artificial Sequence
  Synthetic
caccgctgtcccaaaaggtcgtgactgacagtaggccccttgcagtgtgatgtgcttcttgcggtatagttggcgcgctgagagtgctgggcaaactggtgtgggttgttggtgtggggacatatcagcagccagggcct

SEQ ID NO: 370005 - DNA, 140 bp, Artificial Sequence
  Synthetic
atacgccatgctgggtctccgcacagaggccagcagctcacaaccaaccatcagcgagacaccatccccccccccaacaacccaagctcccaccgaaatcaacaaccccaacacatccagcgtacttgggagtcggccat

SEQ ID NO: 370006 - DNA, 140 bp, Artificial Sequence
  Synthetic
atggccgactcccaagtacgctggatgtgttggggttgttgatttcggtgggagcttgggttgttggggggggggatggtgtctcgctgatggttggttgtgagctgctggcctctgtgcggagacccagcatggcgtat

SEQ ID NO: 370007 - DNA, 140 bp, Artificial Sequence
  Synthetic
atacgccatgctgggtctccctcaaagacgatgaggaaacaggctacagaaggattattgaaagactgaatagtaaaaaaggaaaaaacagactgcttgatggtgagaggttggctgatacgtacttgggagtcggccat

SEQ ID NO: 370008 - DNA, 140 bp, Artificial Sequence
  Synthetic
atggccgactcccaagtacgtatcagccaacctctcaccatcaagcagtctgttttttccttttttactattcagtctttcaataatccttctgtagcctgtttcctcatcgtctttgagggagacccagcatggcgtat

SEQ ID NO: 370009 - DNA, 140 bp, Artificial Sequence
  Synthetic
atacgccatgctgggtctcctctcaaagatatcaatcccccctctatccacattgtcactggtggcatagatagcaggccttgacctttgtcaaacaatggagttcttgaggagccttgacgtacttgggagtcggccat

SEQ ID NO: 370010 - DNA, 140 bp, Artificial Sequence
  Synthetic
atggccgactcccaagtacgtcaaggctcctcaagaactccattgtttgacaaaggtcaaggcctgctatctatgccaccagtgacaatgtggatagaggggggattgatatctttgagaggagacccagcatggcgtat

SEQ ID NO: 370011 - DNA, 140 bp, Artificial Sequence
  Synthetic
atacgccatgctgggtctccttgactgatccgctttgcaggcctaccggtcctctctttctcggccatttatttcagtttcatcattgttattattttggggtgtggggggaacgatttccgtacttgggagtcggccat

SEQ ID NO: 370012 - DNA, 140 bp, Artificial Sequence
  Synthetic
atggccgactcccaagtacggaaatcgttccccccacaccccaaaataataacaatgatgaaactgaaataaatggccgagaaagagaggaccggtaggcctgcaaagcggatcagtcaaggagacccagcatggcgtat

SEQ ID NO: 370013 - DNA, 140 bp, Artificial Sequence
  Synthetic
aggccctggctgctgatatggcaacaccttcttccctggactgtccatttgcaaaacgtgctctataagcagcattaatggctttgaaattgagtctcataggtgctattgcagcttgttgaccttttgggacagcggtg

SEQ ID NO: 370014 - DNA, 140 bp, Artificial Sequence
  Synthetic
caccgctgtcccaaaaggtcaacaagctgcaatagcacctatgagactcaatttcaaagccattaatgctgcttatagagcacgttttgcaaatggacagtccagggaagaaggtgttgccatatcagcagccagggcct

SEQ ID NO: 370015 - DNA, 140 bp, Artificial Sequence
  Synthetic
aggccctggctgctgatatgacgcaagcacatattctgtgaaatactggaagattcttcactgcatttctgccatcggatgcctacctttaagtcaagcagataagtcttcgctgcttatgaccttttgggacagcggtg

SEQ ID NO: 370016 - DNA, 140 bp, Artificial Sequence
  Synthetic
caccgctgtcccaaaaggtcataagcagcgaagacttatctgcttgacttaaaggtaggcatccgatggcagaaatgcagtgaagaatcttccagtatttcacagaatatgtgcttgcgtcatatcagcagccagggcct

SEQ ID NO: 370017 - DNA, 140 bp, Artificial Sequence
  Synthetic
atacgccatgctgggtctcccccaagacaaccatggctttccttttttggtttagctttggttatgtgataacctgcatactttgtaaagtaatcttctatctattaatagttgtagggacgtacttgggagtcggccat

SEQ ID NO: 370018 - DNA, 140 bp, Artificial Sequence
  Synthetic
atggccgactcccaagtacgtccctacaactattaatagatagaagattactttacaaagtatgcaggttatcacataaccaaagctaaaccaaaaaaggaaagccatggttgtcttgggggagacccagcatggcgtat

SEQ ID NO: 370019 - DNA, 140 bp, Artificial Sequence
  Synthetic
aggccctggctgctgatatgaggctgttatgcttgtagttctggtatctcctgtaaggtcaggatccatgtagatgaaccagatgagcttacagtacatgtgaagagcgaggatccagacgaccttttgggacagcggtg

SEQ ID NO: 370020 - DNA, 140 bp, Artificial Sequence
  Synthetic
caccgctgtcccaaaaggtcgtctggatcctcgctcttcacatgtactgtaagctcatctggttcatctacatggatcctgaccttacaggagataccagaactacaagcataacagcctcatatcagcagccagggcct

SEQ ID NO: 370021 - DNA, 140 bp, Artificial Sequence
  Synthetic
atacgccatgctgggtctccctcaaagatatcaatccccccgttacccacgtttacacagagagctccagtagtggtctttgcctttgcgaaaccatgaacttcttgagaaaccttgactcgtacttgggagtcggccat

SEQ ID NO: 370022 - DNA, 140 bp, Artificial Sequence
  Synthetic
atggccgactcccaagtacgagtcaaggtttctcaagaagttcatggtttcgcaaaggcaaagaccactactggagctctctgtgtaaacgtgggtaacggggggattgatatctttgagggagacccagcatggcgtat

SEQ ID NO: 370023 - DNA, 140 bp, Artificial Sequence
  Synthetic
atacgccatgctgggtctccggactcaagtgattgccggtcaatatgtgtccaaccctaggttcaacatttctgattatttcgagattgtgcggcagcctggtgatgggaactgcttctacgtacttgggagtcggccat

SEQ ID NO: 370024 - DNA, 140 bp, Artificial Sequence
  Synthetic
atggccgactcccaagtacgtagaagcagttcccatcaccaggctgccgcacaatctcgaaataatcagaaatgttgaacctagggttggacacatattgaccggcaatcacttgagtccggagacccagcatggcgtat

SEQ ID NO: 370025 - DNA, 140 bp, Artificial Sequence
  Synthetic
aggccctggctgctgatatgcatgctttacggtctatggaacttttatcaacagcgacagacaactgatctttgacatttacaatgtgcatatatataacaaagaaatggataactttgagaccttttgggacagcggtg

SEQ ID NO: 370026 - DNA, 140 bp, Artificial Sequence
  Synthetic
caccgctgtcccaaaaggtctcaaagttatccatttctttgttatatatatgcacattgtaaatgtcaaagatcagttgtctgtcgctgttgataaaagttccatagaccgtaaagcatgcatatcagcagccagggcct

SEQ ID NO: 370027 - DNA, 140 bp, Artificial Sequence
  Synthetic
aggccctggctgctgatatgattggacatctgcactgtatcacttggtgttatgctgtcaacattcttatatggctctaacaataaaaacaagaagaaattcatcaccaactgtctgctcgaccttttgggacagcggtg

SEQ ID NO: 370028 - DNA, 140 bp, Artificial Sequence
  Synthetic
caccgctgtcccaaaaggtcgagcagacagttggtgatgaatttcttcttgtttttattgttagagccatataagaatgttgacagcataacaccaagtgatacagtgcagatgtccaatcatatcagcagccagggcct

SEQ ID NO: 370029 - DNA, 140 bp, Artificial Sequence
  Synthetic
aggccctggctgctgatatgggattggggaagtcatgtcactgcgacagctaggacataaactgctgacaagagacaaacagatcaagcaagaattttccagaatgaaactacatgtcacgaccttttgggacagcggtg

SEQ ID NO: 370030 - DNA, 140 bp, Artificial Sequence
  Synthetic
caccgctgtcccaaaaggtcgtgacatgtagtttcattctggaaaattcttgcttgatctgtttgtctcttgtcagcagtttatgtcctagctgtcgcagtgacatgacttccccaatcccatatcagcagccagggcct

SEQ ID NO: 370031 - DNA, 140 bp, Artificial Sequence
  Synthetic
atacgccatgctgggtctccttccaggaacagggattgaaagacacatgcagctgcttcactctgaaatgatactggacatctgcactgtgtctcttggagtgatgttatccacttttctcgtacttgggagtcggccat

SEQ ID NO: 370032 - DNA, 140 bp, Artificial Sequence
  Synthetic
atggccgactcccaagtacgagaaaagtggataacatcactccaagagacacagtgcagatgtccagtatcatttcagagtgaagcagctgcatgtgtctttcaatccctgttcctggaaggagacccagcatggcgtat

SEQ ID NO: 370033 - DNA, 140 bp, Artificial Sequence
  Synthetic
aggccctggctgctgatatgcgaactggggaaacaaccaaggggtaccaagaaaatgaagaaggcactcttaagcaccccaatgaagtgggggaagaagctttatgagctttttgctgatgaccttttgggacagcggtg

SEQ ID NO: 370034 - DNA, 140 bp, Artificial Sequence
  Synthetic
caccgctgtcccaaaaggtcatcagcaaaaagctcataaagcttcttcccccacttcattggggtgcttaagagtgccttcttcattttcttggtaccccttggttgtttccccagttcgcatatcagcagccagggcct

SEQ ID NO: 370035 - DNA, 140 bp, Artificial Sequence
  Synthetic
aggccctggctgctgatatgttggcacaccttatgagggaattgtagacaccttagtttctctgattaatgtgttaacaaggtttacctggttccaggaggtggtgctatatggtaaaatgaccttttgggacagcggtg

SEQ ID NO: 370036 - DNA, 140 bp, Artificial Sequence
  Synthetic
caccgctgtcccaaaaggtcattttaccatatagcaccacctcctggaaccaggtaaaccttgttaacacattaatcagagaaactaaggtgtctacaattccctcataaggtgtgccaacatatcagcagccagggcct

SEQ ID NO: 370037 - DNA, 140 bp, Artificial Sequence
  Synthetic
aggccctggctgctgatatgtggaaggctcgggggacgtgtacacatcccccccagtcaccaccaagggcctgtctccgtcgaaggccacgtcagagctccccgcgtcttcaggcatagagaccttttgggacagcggtg

SEQ ID NO: 370038 - DNA, 140 bp, Artificial Sequence
  Synthetic
caccgctgtcccaaaaggtctctatgcctgaagacgcggggagctctgacgtggccttcgacggagacaggcccttggtggtgactgggggggatgtgtacacgtcccccgagccttccacatatcagcagccagggcct

SEQ ID NO: 370039 - DNA, 140 bp, Artificial Sequence
  Synthetic
aggccctggctgctgatatgcagcgccctatttggaaagcaaataaacaagctacagaattgcttcaggaccatcagccctgtcagtctgcttgcacttagaaacttggattttgattgtgaccttttgggacagcggtg

SEQ ID NO: 370040 - DNA, 140 bp, Artificial Sequence
  Synthetic
caccgctgtcccaaaaggtcacaatcaaaatccaagtttctaagtgcaagcagactgacagggctgatggtcctgaagcaattctgtagcttgtttatttgctttccaaatagggcgctgcatatcagcagccagggcct

SEQ ID NO: 370041 - DNA, 140 bp, Artificial Sequence
  Synthetic
aggccctggctgctgatatgggctttgaaattgaatctcacaaatgttactgtagcctattttgctgcccctactgtagacactgctctgccgacatagaaatacataagttgcacttgagaccttttgggacagcggtg

SEQ ID NO: 370042 - DNA, 140 bp, Artificial Sequence
  Synthetic
caccgctgtcccaaaaggtctcaagtgcaacttatgtatttctatgtcggcagagcagtgtctacagtaggggcagcaaaataggctacagtaacatttgtgagattcaatttcaaagcccatatcagcagccagggcct

SEQ ID NO: 370043 - DNA, 140 bp, Artificial Sequence
  Synthetic
atacgccatgctgggtctcctaaccatgttgaggattttatcagaaggtatggtatactgactcttgggactttgtcaccctttggtaggttgttcgtaccaacctactctggattagtccgtacttgggagtcggccat

SEQ ID NO: 370044 - DNA, 140 bp, Artificial Sequence
  Synthetic
atggccgactcccaagtacggactaatccagagtaggttggtacgaacaacctaccaaagggtgacaaagtcccaagagtcagtataccataccttctgataaaatcctcaacatggttaggagacccagcatggcgtat

SEQ ID NO: 370045 - DNA, 140 bp, Artificial Sequence
  Synthetic
aggccctggctgctgatatgggcaatgtgttgtcctatgcgcacaatttgtacctgagcaaaaccagtctgaacatgtcctcggaagacatctcacaactcttgatagaaatcaaaaggcgaccttttgggacagcggtg

SEQ ID NO: 370046 - DNA, 140 bp, Artificial Sequence
  Synthetic
caccgctgtcccaaaaggtcgccttttgatttctatcaagagttgtgagatgtcttccgaggacatgttcagactggttttgctcaggtacaaattgtgcgcataggacaacacattgcccatatcagcagccagggcct

SEQ ID NO: 370047 - DNA, 140 bp, Artificial Sequence
  Synthetic
aggccctggctgctgatatggggtttctggtgaagtatgctgtcacattgttcacatcaaacggcgagccattctcactcagcctgaatgatggtgggctggaccttgatctccataaaagaccttttgggacagcggtg

SEQ ID NO: 370048 - DNA, 140 bp, Artificial Sequence
  Synthetic
caccgctgtcccaaaaggtcttttatggagatcaaggtccagcccaccatcattcaggctgagtgagaatggctcgccgtttgatgtgaacaatgtgacagcatacttcaccagaaaccccatatcagcagccagggcct

SEQ ID NO: 370049 - DNA, 140 bp, Artificial Sequence
  Synthetic
aggccctggctgctgatatgcttcaacaatgtacttgttaacattgacagaaacacggtgaaaagtgaactcttatggaaatttacgttagacaccaatgtaagcaccacaagcaccatagaccttttgggacagcggtg

SEQ ID NO: 370050 - DNA, 140 bp, Artificial Sequence
  Synthetic
caccgctgtcccaaaaggtctatggtgcttgtggtgcttacattggtgtctaacgtaaatttccataagagttcacttttcaccgtgtttctgtcaatgttaacaagtacattgttgaagcatatcagcagccagggcct

SEQ ID NO: 370051 - DNA, 140 bp, Artificial Sequence
  Synthetic
atacgccatgctgggtctccctctcagtcaactcaattgctttaactgatccactttgcaaacctaccagtcctctctttctcaaccatttattacagtttcatcattgttattattttgcgtacttgggagtcggccat

SEQ ID NO: 370052 - DNA, 140 bp, Artificial Sequence
  Synthetic
atggccgactcccaagtacgcaaaataataacaatgatgaaactgtaataaatggttgagaaagagaggactggtaggtttgcaaagtggatcagttaaagcaattgagttgactgagagggagacccagcatggcgtat

SEQ ID NO: 370053 - DNA, 140 bp, Artificial Sequence
  Synthetic
atacgccatgctgggtctccacgcccacagtgttcccttgagtgttggcaaaatggaaaacaaaatcgaggtgaacagcaaagatgagatgaacaagtggtttgaggagttcaagaaaggcgtacttgggagtcggccat

SEQ ID NO: 370054 - DNA, 140 bp, Artificial Sequence
  Synthetic
atggccgactcccaagtacgcctttcttgaactcctcaaaccacttgttcatctcatctttgctgttcacctcgattttgttttccattttgccaacactcaagggaacactgtgggcgtggagacccagcatggcgtat

SEQ ID NO: 370055 - DNA, 140 bp, Artificial Sequence
  Synthetic
atacgccatgctgggtctccttccaaatctggacagatttgtattccagatggctagtgccactgatgatgcacaaaaggattccatctacgcatctgctctggtggaggcaaccaaattcgtacttgggagtcggccat

SEQ ID NO: 370056 - DNA, 140 bp, Artificial Sequence
  Synthetic
atggccgactcccaagtacgaatttggttgcctccaccagagcagatgcgtagatggaatccttttgtgcatcatcagtggcactagccatctggaatacaaatctgtccagatttggaaggagacccagcatggcgtat

SEQ ID NO: 370057 - DNA, 140 bp, Artificial Sequence
  Synthetic
aggccctggctgctgatatgaagagttcttagacaggacccaattgcacccagagttcagggacctgacacctgacttctcattgacacagaaagtgcattttaaaagaaatcagataccgaccttttgggacagcggtg

SEQ ID NO: 370058 - DNA, 140 bp, Artificial Sequence
  Synthetic
caccgctgtcccaaaaggtcggtatctgatttcttttaaaatgcactttctgtgtcaatgagaagtcaggtgtcaggtccctgaactctgggtgcaattgggtcctgtctaagaactcttcatatcagcagccagggcct

SEQ ID NO: 370059 - DNA, 140 bp, Artificial Sequence
  Synthetic
atacgccatgctgggtctccgttagaaaggttaggtgtttctagaatggaagtcgatgagctaatgccaagcattagtcctgatgacaccttagcccagcttgtagcgaaaaaactcatccgtacttgggagtcggccat

SEQ ID NO: 370060 - DNA, 140 bp, Artificial Sequence
  Synthetic
atggccgactcccaagtacggatgagttttttcgctacaagctgggctaaggtgtcatcaggactaatgcttggcattagctcatcgacttccattctagaaacacctaacctttctaacggagacccagcatggcgtat

SEQ ID NO: 370061 - DNA, 140 bp, Artificial Sequence
  Synthetic
aggccctggctgctgatatgtggaagcagtgccagtgacagaaagaaagatgttccctctgcctgagactccattaagcgaggtgcattcaatagagcgcatcatggaaaatttcactcggaccttttgggacagcggtg

SEQ ID NO: 370062 - DNA, 140 bp, Artificial Sequence
  Synthetic
caccgctgtcccaaaaggtccgagtgaaattttccatgatgcgctctattgaatgcacctcgcttaatggagtctcaggcagagggaacatctttctttctgtcactggcactgcttccacatatcagcagccagggcct

SEQ ID NO: 370063 - DNA, 140 bp, Artificial Sequence
  Synthetic
atacgccatgctgggtctcctctgctttggaacaatccctgtggccaatcctgatgatgctgccttaggatctgggcacaccaagtccattctcaaccttcggacaaacactgagaccaacgtacttgggagtcggccat

SEQ ID NO: 370064 - DNA, 140 bp, Artificial Sequence
  Synthetic
atggccgactcccaagtacgttggtctcagtgtttgtccgaaggttgagaatggacttggtgtgcccagatcctaaggcagcatcatcaggattggccacagggattgttccaaagcagaggagacccagcatggcgtat

SEQ ID NO: 370065 - DNA, 140 bp, Artificial Sequence
  Synthetic
atacgccatgctgggtctcccaatcccttgttggcaagcagtctccatttcaaaatgcctacaacgtcaaggggaacgccaccagtgccaatatcatctaaagcctaaaatgttctgcaacgtacttgggagtcggccat

SEQ ID NO: 370066 - DNA, 140 bp, Artificial Sequence
  Synthetic
atggccgactcccaagtacgttgcagaacattttaggctttagatgatattggcactggtggcgttccccttgacgttgtaggcattttgaaatggagactgcttgccaacaagggattgggagacccagcatggcgtat

SEQ ID NO: 370067 - DNA, 140 bp, Artificial Sequence
  Synthetic
aggccctggctgctgatatgccgcttagtgaggtccactctatagagagaattatggagaacttcacccgacttatgtgtgacgcaagaccttctggaggaaaagagggcacagagcagggaccttttgggacagcggtg

SEQ ID NO: 370068 - DNA, 140 bp, Artificial Sequence
  Synthetic
caccgctgtcccaaaaggtccctgctctgtgccctcttttcctccagaaggtcttgcgtcacacataagtcgggtgaagttctccataattctctctatagagtggacctcactaagcggcatatcagcagccagggcct

SEQ ID NO: 370069 - DNA, 140 bp, Artificial Sequence
  Synthetic
atacgccatgctgggtctcctcagctttcccattactactctgccatttacaaccgcaaccatcaactatgtttatttaaactgcttatgtaatcctgctttattaacattttatcatttcgtacttgggagtcggccat

SEQ ID NO: 370070 - DNA, 140 bp, Artificial Sequence
  Synthetic
atggccgactcccaagtacgaaatgataaaatgttaataaagcaggattacataagcagtttaaataaacatagttgatggttgcggttgtaaatggcagagtagtaatgggaaagctgaggagacccagcatggcgtat

SEQ ID NO: 370071 - DNA, 140 bp, Artificial Sequence
  Synthetic
aggccctggctgctgatatgctaaaagattattcagcttatgcaagaggagtgatctcaaattcgctaaaaaacctctcaaagcaaggcaaatcaaagtgttctgtgccaaggtcttggcgaccttttgggacagcggtg

SEQ ID NO: 370072 - DNA, 140 bp, Artificial Sequence
  Synthetic
caccgctgtcccaaaaggtcgccaagaccttggcacagaacactttgatttgccttgctttgagaggttttttagcgaatttgagatcactcctcttgcataagctgaataatcttttagcatatcagcagccagggcct

SEQ ID NO: 370073 - DNA, 140 bp, Artificial Sequence
  Synthetic
aggccctggctgctgatatgttacaaccgcaaccatcaactatgtttatttaaactgattatgtaatcctgctttattaacattgtatcattttcttctgttttaaatacttaaagggctgaccttttgggacagcggtg

SEQ ID NO: 370074 - DNA, 140 bp, Artificial Sequence
  Synthetic
caccgctgtcccaaaaggtcagccctttaagtatttaaaacagaagaaaatgatacaatgttaataaagcaggattacataatcagtttaaataaacatagttgatggttgcggttgtaacatatcagcagccagggcct

SEQ ID NO: 370075 - DNA, 140 bp, Artificial Sequence
  Synthetic
aggccctggctgctgatatgtctcaaagatatcaatccccccattacccacgttgactcagagagctccggtagcagtcttagtctttgcgaagccatggacttcttgagaaaccttgacgaccttttgggacagcggtg

SEQ ID NO: 370076 - DNA, 140 bp, Artificial Sequence
  Synthetic
caccgctgtcccaaaaggtcgtcaaggtttctcaagaagtccatggcttcgcaaagactaagactgctaccggagctctctgagtcaacgtgggtaatggggggattgatatctttgagacatatcagcagccagggcct

SEQ ID NO: 370077 - DNA, 140 bp, Artificial Sequence
  Synthetic
aggccctggctgctgatatggagattcagcgaagaggaccaacttgaaaaaagacagctgctgcttgtagaggtcgggtttcaaactgacattgatgggaaaataagaacagaccacaaagaccttttgggacagcggtg

SEQ ID NO: 370078 - DNA, 140 bp, Artificial Sequence
  Synthetic
caccgctgtcccaaaaggtctttgtggtctgttcttattttcccatcaatgtcagtttgaaacccgacctctacaagcagcagctgtcttttttcaagttggtcctcttcgctgaatctccatatcagcagccagggcct

SEQ ID NO: 370079 - DNA, 140 bp, Artificial Sequence
  Synthetic
aggccctggctgctgatatgctagcaaggatgaaatgaacaggtggtttgaggagttcaagaagagtaatggacttgtggacacctttacaaattcttactccttttgtgagagtgtcccgaccttttgggacagcggtg

SEQ ID NO: 370080 - DNA, 140 bp, Artificial Sequence
  Synthetic
caccgctgtcccaaaaggtcgggacactctcacaaaaggagtaagaatttgtaaaggtgtccacaagtccattactcttcttgaactcctcaaaccacctgttcatttcatccttgctagcatatcagcagccagggcct

SEQ ID NO: 370081 - DNA, 140 bp, Artificial Sequence
  Synthetic
atacgccatgctgggtctccatttattgcgtgtgcagattgctcatccaccccacctgacaggtggtggataaaagaggacaaagtgcgcatcttgaaaaactcggtcagcttccttttccgtacttgggagtcggccat

SEQ ID NO: 370082 - DNA, 140 bp, Artificial Sequence
  Synthetic
atggccgactcccaagtacggaaaaggaagctgaccgagtttttcaagatgcgcactttgtcctcttttatccaccacctgtcaggtggggtggatgagcaatctgcacacgcaataaatggagacccagcatggcgtat

SEQ ID NO: 370083 - DNA, 140 bp, Artificial Sequence
  Synthetic
aggccctggctgctgatatgtaaaagaggacaaagtgcgcatcttgaaaaactcggtcagcttccttttcaacaagctttctagaaattcacccactgaagttacagacatagttgtcgggaccttttgggacagcggtg

SEQ ID NO: 370084 - DNA, 140 bp, Artificial Sequence
  Synthetic
caccgctgtcccaaaaggtcccgacaactatgtctgtaacttcagtgggtgaatttctagaaagcttgttgaaaaggaagctgaccgagtttttcaagatgcgcactttgtcctcttttacatatcagcagccagggcct

SEQ ID NO: 370085 - DNA, 140 bp, Artificial Sequence
  Synthetic
aggccctggctgctgatatgaaagggcacatactcagtaggccaacaggcttgatgttgccaaacaaccttgagcaggcaatgcgtaaaggcctggtggaaggtgttgttatttccaaaggaccttttgggacagcggtg

SEQ ID NO: 370086 - DNA, 140 bp, Artificial Sequence
  Synthetic
caccgctgtcccaaaaggtcctttggaaataacaacaccttccaccaggcctttacgcattgcctgctcaaggttgtttggcaacatcaagcctgttggcctactgagtatgtgccctttcatatcagcagccagggcct

SEQ ID NO: 370087 - DNA, 140 bp, Artificial Sequence
  Synthetic
atacgccatgctgggtctcctctcaaagacatcaatcccccctttacccacgttgacacagatagctccagtagtggtttctttgtcctcatcaaaccatggactttttaagaaaccttgcgtacttgggagtcggccat

SEQ ID NO: 370088 - DNA, 140 bp, Artificial Sequence
  Synthetic
atggccgactcccaagtacgcaaggtttcttaaaaagtccatggtttgatgaggacaaagaaaccactactggagctatctgtgtcaacgtgggtaaaggggggattgatgtctttgagaggagacccagcatggcgtat

SEQ ID NO: 370089 - DNA, 140 bp, Artificial Sequence
  Synthetic
aggccctggctgctgatatgactggactcaggtgattgatggtcagtatgtgaccaaccccaggttcaatatctccgattactttgagattgtgcggcagcctggtgatgggaactgcttgaccttttgggacagcggtg

SEQ ID NO: 370090 - DNA, 140 bp, Artificial Sequence
  Synthetic
caccgctgtcccaaaaggtcaagcagttcccatcaccaggctgccgcacaatctcaaagtaatcggagatattgaacctggggttggtcacatactgaccatcaatcacctgagtccagtcatatcagcagccagggcct

SEQ ID NO: 370091 - DNA, 140 bp, Artificial Sequence
  Synthetic
atacgccatgctgggtctccactgacgaatttgaacagacaaagtacaagcatgagctcacacagaacattgtaacaggtgaaaaaatgctgttgagctggctgactgaggatatcaaatcgtacttgggagtcggccat

SEQ ID NO: 370092 - DNA, 140 bp, Artificial Sequence
  Synthetic
atggccgactcccaagtacgatttgatatcctcagtcagccagctcaacagcattttttcacctgttacaatgttctgtgtgagctcatgcttgtactttgtctgttcaaattcgtcagtggagacccagcatggcgtat

SEQ ID NO: 370093 - DNA, 140 bp, Artificial Sequence
  Synthetic
aggccctggctgctgatatgttccaaaatgcctacaatgtcaaaggcaacgccaccagtgccaacatcatctgaagttcaaaacactctgtattcaacttctctcctattgcactgttgtgaccttttgggacagcggtg

SEQ ID NO: 370094 - DNA, 140 bp, Artificial Sequence
  Synthetic
caccgctgtcccaaaaggtcacaacagtgcaataggagagaagttgaatacagagtgttttgaacttcagatgatgttggcactggtggcgttgcctttgacattgtaggcattttggaacatatcagcagccagggcct

SEQ ID NO: 370095 - DNA, 140 bp, Artificial Sequence
  Synthetic
atacgccatgctgggtctcctgccacaatttgaagctgacacaagagagaccttgagtctggtagacaaggttatagctgtggaccaattgacctcatcttcaagtgatgaactgcaggacgtacttgggagtcggccat

SEQ ID NO: 370096 - DNA, 140 bp, Artificial Sequence
  Synthetic
atggccgactcccaagtacgtcctgcagttcatcacttgaagatgaggtcaattggtccacagctataaccttgtctaccagactcaaggtctctcttgtgtcagcttcaaattgtggcaggagacccagcatggcgtat

SEQ ID NO: 370097 - DNA, 140 bp, Artificial Sequence
  Synthetic
atacgccatgctgggtctccaccgactagagttggcagggttctggactgcatgtttaactgcaaactatgtgttgaaatatcagctgacactctaattctgaggccagaatctaaagaacgtacttgggagtcggccat

SEQ ID NO: 370098 - DNA, 140 bp, Artificial Sequence
  Synthetic
atggccgactcccaagtacgttctttagattctggcctcagaattagagtgtcagctgatatttcaacacatagtttgcagttaaacatgcagtccagaaccctgccaactctagtcggtggagacccagcatggcgtat

SEQ ID NO: 370099 - DNA, 140 bp, Artificial Sequence
  Synthetic
aggccctggctgctgatatgcttagcacagccttgtctggaaagaaggtgtataaggttcttggtaacttaggaaatgaactgttatataaggcgcccagaaaggccttggcaaccgtctgaccttttgggacagcggtg

SEQ ID NO: 370100 - DNA, 140 bp, Artificial Sequence
  Synthetic
caccgctgtcccaaaaggtcagacggttgccaaggcctttctgggcgccttatataacagttcatttcctaagttaccaagaaccttatacaccttctttccagacaaggctgtgctaagcatatcagcagccagggcct

SEQ ID NO: 370101 - DNA, 140 bp, Artificial Sequence
  Synthetic
atacgccatgctgggtctccttgccagccactgtagtaactgtcaccccaatggtgtgaatgttagcaacatatcaaatgtttacaagaggtgtccaaagatagaagtggttagtcattgcgtacttgggagtcggccat

SEQ ID NO: 370102 - DNA, 140 bp, Artificial Sequence
  Synthetic
atggccgactcccaagtacgcaatgactaaccacttctatctttggacacctcttgtaaacatttgatatgttgctaacattcacaccattggggtgacagttactacagtggctggcaaggagacccagcatggcgtat

SEQ ID NO: 370103 - DNA, 140 bp, Artificial Sequence
  Synthetic
atacgccatgctgggtctccctgaaggaatactccacttatgcgaaaggagtaatttctaactctcttaaaaacatttcgaagcagagcagatcaaagtgttctgtgccaaaatcctggccgtacttgggagtcggccat

SEQ ID NO: 370104 - DNA, 140 bp, Artificial Sequence
  Synthetic
atggccgactcccaagtacggccaggattttggcacagaacactttgatctgctctgcttcgaaatgtttttaagagagttagaaattactcctttcgcataagtggagtattccttcagggagacccagcatggcgtat

SEQ ID NO: 370105 - DNA, 140 bp, Artificial Sequence
  Synthetic
aggccctggctgctgatatgagttgggtggtgcaagagacttgttggtgcaggagactggtacaaaagtcatgcatgctaccactgaaatgtttagcaggaatcttttgaaaacaacctcgaccttttgggacagcggtg

SEQ ID NO: 370106 - DNA, 140 bp, Artificial Sequence
  Synthetic
caccgctgtcccaaaaggtcgaggttgttttcaaaagattcctgctaaacatttcagtggtagcatgcatgacttttgtaccagtctcctgcaccaacaagtctcttgcaccacccaactcatatcagcagccagggcct

SEQ ID NO: 370107 - DNA, 140 bp, Artificial Sequence
  Synthetic
atacgccatgctgggtctcccttcgttttggtatgcttgcagggcttagtaggcttgtctgtcctaatgagttggggaaaaagttttcaacaagttgtagaagaattgaggacaacattgcgtacttgggagtcggccat

SEQ ID NO: 370108 - DNA, 140 bp, Artificial Sequence
  Synthetic
atggccgactcccaagtacgcaatgttgtcctcaattcttctacaacttgttgaaaactttttccccaactcattaggacagacaagcctactaagccctgcaagcataccaaaacgaagggagacccagcatggcgtat

SEQ ID NO: 370109 - DNA, 140 bp, Artificial Sequence
  Synthetic
atacgccatgctgggtctcctaacgataaattacttataaggtcgaaggaggagctaaaaaaatactttgatgcccacactgctaagctgaagaagaacagacagccaacacctttccaacgtacttgggagtcggccat

SEQ ID NO: 370110 - DNA, 140 bp, Artificial Sequence
  Synthetic
atggccgactcccaagtacgttggaaaggtgttggctgtctgttcttcttcagcttagcagtgtgggcatcaaagtatttttttagctcctccttcgaccttataagtaatttatcgttaggagacccagcatggcgtat

SEQ ID NO: 370111 - DNA, 140 bp, Artificial Sequence
  Synthetic
atacgccatgctgggtctccgtctgtactctgtgttctgatagcagggtattacaggtcatttggaggggaaggaaccgaaaaacaagtaaaggcatcattgaatagagacgacaacaaacgtacttgggagtcggccat

SEQ ID NO: 370112 - DNA, 140 bp, Artificial Sequence
  Synthetic
atggccgactcccaagtacgtttgttgtcgtctctattcaatgatgcctttacttgtttttcggttccttcccctccaaatgacctgtaataccctgctatcagaacacagagtacagacggagacccagcatggcgtat

SEQ ID NO: 370113 - DNA, 140 bp, Artificial Sequence
  Synthetic
atacgccatgctgggtctccatgtcctaacaagattcgtctggtttcaagaagttgtgttatatggcaagatttgtgaaaccttcttgaggtgctgcacggagttcaacaggtcaggcatcgtacttgggagtcggccat

SEQ ID NO: 370114 - DNA, 140 bp, Artificial Sequence
  Synthetic
atggccgactcccaagtacgatgcctgacctgttgaactccgtgcagcacctcaagaaggtttcacaaatcttgccatataacacaacttcttgaaaccagacgaatcttgttaggacatggagacccagcatggcgtat

SEQ ID NO: 370115 - DNA, 140 bp, Artificial Sequence
  Synthetic
atacgccatgctgggtctccccttcaaacaagctaactactctgcattcttctcagtcaactcaattgcttcaactgatctattttactagcctatcgatcctctctttctcaaccattccgtacttgggagtcggccat

SEQ ID NO: 370116 - DNA, 140 bp, Artificial Sequence
  Synthetic
atggccgactcccaagtacggaatggttgagaaagagaggatcgataggctagtaaaatagatcagttgaagcaattgagttgactgagaagaatgcagagtagttagcttgtttgaaggggagacccagcatggcgtat

SEQ ID NO: 370117 - DNA, 140 bp, Artificial Sequence
  Synthetic
atacgccatgctgggtctccttgtatcgaagagatgatgaagaactaacaaacggctcaaatttaaaacttgggttcttagtgaagtatgctgtcaccctattcacatccaatggtgagccgtacttgggagtcggccat

SEQ ID NO: 370118 - DNA, 140 bp, Artificial Sequence
  Synthetic
atggccgactcccaagtacggctcaccattggatgtgaatagggtgacagcatacttcactaagaacccaagttttaaatttgagccgtttgttagttcttcatcatctcttcgatacaaggagacccagcatggcgtat

SEQ ID NO: 370119 - DNA, 140 bp, Artificial Sequence
  Synthetic
aggccctggctgctgatatgtcaactgatctattttactagcctatcgatcctctctttctcaaccattcatttcagcttcatcatcatcgttattatcttggggtgtggggggaacgatgaccttttgggacagcggtg

SEQ ID NO: 370120 - DNA, 140 bp, Artificial Sequence
  Synthetic
caccgctgtcccaaaaggtcatcgttccccccacaccccaagataataacgatgatgatgaagctgaaatgaatggttgagaaagagaggatcgataggctagtaaaatagatcagttgacatatcagcagccagggcct

SEQ ID NO: 370121 - DNA, 140 bp, Artificial Sequence
  Synthetic
atacgccatgctgggtctccgaacttttaaaaggccctttttacctaaatagaagacaggctgtcctaggttcatcatacctctacattgtggttacactatacattcaggtgctacagccgtacttgggagtcggccat

SEQ ID NO: 370122 - DNA, 140 bp, Artificial Sequence
  Synthetic
atggccgactcccaagtacggctgtagcacctgaatgtatagtgtaaccacaatgtagaggtatgatgaacctaggacagcctgtcttctatttaggtaaaaagggccttttaaaagttcggagacccagcatggcgtat

SEQ ID NO: 370123 - DNA, 140 bp, Artificial Sequence
  Synthetic
atacgccatgctgggtctccgtaactggcatattatccaaggagttgtattcccagtatgacgaaacattttggaagcacgcctgtagacttaagaacttcacagctgctgtacaaagatcgtacttgggagtcggccat

SEQ ID NO: 370124 - DNA, 140 bp, Artificial Sequence
  Synthetic
atggccgactcccaagtacgatctttgtacagcagctgtgaagttcttaagtctacaggcgtgcttccaaaatgtttcgtcatactgggaatacaactccttggataatatgccagttacggagacccagcatggcgtat

SEQ ID NO: 370125 - DNA, 140 bp, Artificial Sequence
  Synthetic
atacgccatgctgggtctcccaatcggtactatgtgttctaatagctggttactacagatcatttggaggagaagggactgagaaacaggtaaaggcatcactgaatagggacgacaacacgtacttgggagtcggccat

SEQ ID NO: 370126 - DNA, 140 bp, Artificial Sequence
  Synthetic
atggccgactcccaagtacgtgttgtcgtccctattcagtgatgcctttacctgtttctcagtcccttctcctccaaatgatctgtagtaaccagctattagaacacatagtaccgattgggagacccagcatggcgtat

SEQ ID NO: 370127 - DNA, 140 bp, Artificial Sequence
  Synthetic
atacgccatgctgggtctcctggtttgaggagttcaagaaaggaaacgggcttgtggatactttcacaaactcctattctttctgtgagaacgtgccgaaccttgacaggtttgtattcccgtacttgggagtcggccat

SEQ ID NO: 370128 - DNA, 140 bp, Artificial Sequence
  Synthetic
atggccgactcccaagtacgggaatacaaacctgtcaaggttcggcacgttctcacagaaagaataggagtttgtgaaagtatccacaagcccgtttcctttcttgaactcctcaaaccaggagacccagcatggcgtat

SEQ ID NO: 370129 - DNA, 140 bp, Artificial Sequence
  Synthetic
aggccctggctgctgatatgagattaaaaaacaaattttgacagtgaagaagcaagtcgtgtttgatgctgaaagcgagcccaggttacagtggggacatggatgcttgtccattgtttagaccttttgggacagcggtg

SEQ ID NO: 370130 - DNA, 140 bp, Artificial Sequence
  Synthetic
caccgctgtcccaaaaggtctaaacaatggacaagcatccatgtccccactgtaacctgggctcgctttcagcatcaaacacgacttgcttcttcactgtcaaaatttgttttttaatctcatatcagcagccagggcct

SEQ ID NO: 370131 - DNA, 140 bp, Artificial Sequence
  Synthetic
atacgccatgctgggtctccccgctaccactcagctgttggtctgaagttcaaaactatattgaagacataggcttcaacaatgtgcttgtaaacattgacagaaacacagtgaaaagtgcgtacttgggagtcggccat

SEQ ID NO: 370132 - DNA, 140 bp, Artificial Sequence
  Synthetic
atggccgactcccaagtacgcacttttcactgtgtttctgtcaatgtttacaagcacattgttgaagcctatgtcttcaatatagttttgaacttcagaccaacagctgagtggtagcggggagacccagcatggcgtat

SEQ ID NO: 370133 - DNA, 140 bp, Artificial Sequence
  Synthetic
aggccctggctgctgatatgatcaaggatgtgaggacactggtatcctacgtcagcactgaaacgattcctaagtttctgctcgcatttcttctttatgaagaagtgttgatgaacttaagaccttttgggacagcggtg

SEQ ID NO: 370134 - DNA, 140 bp, Artificial Sequence
  Synthetic
caccgctgtcccaaaaggtcttaagttcatcaacacttcttcataaagaagaaatgcgagcagaaacttaggaatcgtttcagtgctgacgtaggataccagtgtcctcacatccttgatcatatcagcagccagggcct

SEQ ID NO: 370135 - DNA, 140 bp, Artificial Sequence
  Synthetic
aggccctggctgctgatatgtgaatgtagtaagagagatgggcctaggtgttcattcgcagcactgttaagtttagttcatgaagattggcaaaagataggaaaaaacatccttgttcgtgaccttttgggacagcggtg

SEQ ID NO: 370136 - DNA, 140 bp, Artificial Sequence
  Synthetic
caccgctgtcccaaaaggtcacgaacaaggatgttttttcctatcttttgccaatcttcatgaactaaacttaacagtgctgcgaatgaacacctaggcccatctctcttactacattcacatatcagcagccagggcct

SEQ ID NO: 370137 - DNA, 140 bp, Artificial Sequence
  Synthetic
aggccctggctgctgatatggcctctcaaagacatgtccaagccaaagcctgagagagtggttatagccagaaggtcactgaatcatgctctgtccttaatgtttttggatgaaatgtcagaccttttgggacagcggtg

SEQ ID NO: 370138 - DNA, 140 bp, Artificial Sequence
  Synthetic
caccgctgtcccaaaaggtctgacatttcatccaaaaacattaaggacagagcatgattcagtgaccttctggctataaccactctctcaggctttggcttggacatgtctttgagaggccatatcagcagccagggcct

SEQ ID NO: 370139 - DNA, 140 bp, Artificial Sequence
  Synthetic
aggccctggctgctgatatggatgcagttagagcagtggaagatttagttctgatgttgacaggtagggcagtcaagcctagcactgtgacaccagctgcacatgagaacgaacagtgtcgaccttttgggacagcggtg

SEQ ID NO: 370140 - DNA, 140 bp, Artificial Sequence
  Synthetic
caccgctgtcccaaaaggtcgacactgttcgttctcatgtgcagctggtgtcacagtgctaggcttgactgccctacctgtcaacatcagaactaaatcttccactgctctaactgcatccatatcagcagccagggcct

SEQ ID NO: 370141 - DNA, 140 bp, Artificial Sequence
  Synthetic
atacgccatgctgggtctccctgcccgatagggaagcagaggccctcaaaacaggcaaccttggctttaactgggattcagattgaacacattatctgtatgaatctttaatgcctctcacgtacttgggagtcggccat

SEQ ID NO: 370142 - DNA, 140 bp, Artificial Sequence
  Synthetic
atggccgactcccaagtacgtgagaggcattaaagattcatacagataatgtgttcaatctgaatcccagttaaagccaaggttgcctgttttgagggcctctgcttccctatcgggcagggagacccagcatggcgtat

SEQ ID NO: 370143 - DNA, 140 bp, Artificial Sequence
  Synthetic
aggccctggctgctgatatgctgggattcagattgaacacattatctgtatgaatctttaatgcctctcagtgtcttaagggaaagtaagacaatttataccatgccatttgctgacaccgaccttttgggacagcggtg

SEQ ID NO: 370144 - DNA, 140 bp, Artificial Sequence
  Synthetic
caccgctgtcccaaaaggtcggtgtcagcaaatggcatggtataaattgtcttactttcccttaagacactgagaggcattaaagattcatacagataatgtgttcaatctgaatcccagcatatcagcagccagggcct

SEQ ID NO: 370145 - DNA, 140 bp, Artificial Sequence
  Synthetic
atacgccatgctgggtctcctgtttcactacaattttctcagttattggttaacctttactatcctactattccactttctttgctgttcatgtccattttattatttctggggtgtgggcgtacttgggagtcggccat

SEQ ID NO: 370146 - DNA, 140 bp, Artificial Sequence
  Synthetic
atggccgactcccaagtacgcccacaccccagaaataataaaatggacatgaacagcaaagaaagtggaatagtaggatagtaaaggttaaccaataactgagaaaattgtagtgaaacaggagacccagcatggcgtat

SEQ ID NO: 370147 - DNA, 140 bp, Artificial Sequence
  Synthetic
aggccctggctgctgatatgacaaagaagggaagaggctactaaagttaaatagtgacacatctactgatacgcaaagtattgcttctgaagtgtcagacaggagatcttacagttcaaggaccttttgggacagcggtg

SEQ ID NO: 370148 - DNA, 140 bp, Artificial Sequence
  Synthetic
caccgctgtcccaaaaggtccttgaactgtaagatctcctgtctgacacttcagaagcaatactttgcgtatcagtagatgtgtcactatttaactttagtagcctcttcccttctttgtcatatcagcagccagggcct

SEQ ID NO: 370149 - DNA, 140 bp, Artificial Sequence
  Synthetic
aggccctggctgctgatatgatcattaatgtatgcagtcctttgcctacagctgtgtggtctaggagagactcatagatcacacaatgaaactgtacacaataaaacagacattgtgacagaccttttgggacagcggtg

SEQ ID NO: 370150 - DNA, 140 bp, Artificial Sequence
  Synthetic
caccgctgtcccaaaaggtctgtcacaatgtctgttttattgtgtacagtttcattgtgtgatctatgagtctctcctagaccacacagctgtaggcaaaggactgcatacattaatgatcatatcagcagccagggcct

SEQ ID NO: 370151 - DNA, 140 bp, Artificial Sequence
  Synthetic
atacgccatgctgggtctccaattacacctgacccctccactgttacgcccacaacatcagccagtggattagaaggctcgggggaagtttacacatcctctccgatcaccaccgagagccgtacttgggagtcggccat

SEQ ID NO: 370152 - DNA, 140 bp, Artificial Sequence
  Synthetic
atggccgactcccaagtacggctctcggtggtgatcggagaggatgtgtaaacttcccccgagccttctaatccactggctgatgttgtgggcgtaacagtggaggggtcaggtgtaattggagacccagcatggcgtat

SEQ ID NO: 370153 - DNA, 140 bp, Artificial Sequence
  Synthetic
atacgccatgctgggtctcccccgcaacggcccaaggacctactgaagataacagtcacaacgccactgaacaccccgagcacctgacacagtcagcaacctcaggcccaatgacctctccgtacttgggagtcggccat

SEQ ID NO: 370154 - DNA, 140 bp, Artificial Sequence
  Synthetic
atggccgactcccaagtacggagaggtcattgggcctgaggttgctgactgtgtcaggtgctcggggtgttcagtggcgttgtgactgttatcttcagtaggtccttgggccgttgcgggggagacccagcatggcgtat

SEQ ID NO: 370155 - DNA, 140 bp, Artificial Sequence
  Synthetic
atacgccatgctgggtctccgctataagtactcaaaaagttagaagttatctaaaggcagggactgcaacaaaaacccccgtgtcgacaaaagacgttctggaaacttgggaaaaaatgacgtacttgggagtcggccat

SEQ ID NO: 370156 - DNA, 140 bp, Artificial Sequence
  Synthetic
atggccgactcccaagtacgtcattttttcccaagtttccagaacgtcttttgtcgacacgggggtttttgttgcagtccctgcctttagataacttctaactttttgagtacttatagcggagacccagcatggcgtat

SEQ ID NO: 370157 - DNA, 140 bp, Artificial Sequence
  Synthetic
atacgccatgctgggtctccgatgaggtggacaaggctagtgctgacagcatggtaacaaacctcctcaagcacatcactaaggcccaggaactctacaaaaactcatcagcactgagagcgtacttgggagtcggccat

SEQ ID NO: 370158 - DNA, 140 bp, Artificial Sequence
  Synthetic
atggccgactcccaagtacgctctcagtgctgatgagtttttgtagagttcctgggccttagtgatgtgcttgaggaggtttgttaccatgctgtcagcactagccttgtccacctcatcggagacccagcatggcgtat

SEQ ID NO: 370159 - DNA, 140 bp, Artificial Sequence
  Synthetic
atacgccatgctgggtctccaggttccgaatcatgcattaacatgttgaaagagaacttggaccgaataactgatgaattcgagcgaacaaaatttaaacatgaattaacacagaatattcgtacttgggagtcggccat

SEQ ID NO: 370160 - DNA, 140 bp, Artificial Sequence
  Synthetic
atggccgactcccaagtacgaatattctgtgttaattcatgtttaaattttgttcgctcgaattcatcagttattcggtccaagttctctttcaacatgttaatgcatgattcggaacctggagacccagcatggcgtat

SEQ ID NO: 370161 - DNA, 140 bp, Artificial Sequence
  Synthetic
atacgccatgctgggtctccctataccgcaagaagcacatcacactgcaagaggcctactgtcagtcaccagcacaaaaccaggagaaacatcaacaccaacaagcccaggggaagcaagcgtacttgggagtcggccat

SEQ ID NO: 370162 - DNA, 140 bp, Artificial Sequence
  Synthetic
atggccgactcccaagtacgcttgcttcccctgggcttgttggtgttgatgtttctcctggttttgtgctggtgactgacagtaggcctcttgcagtgtgatgtgcttcttgcggtatagggagacccagcatggcgtat

SEQ ID NO: 370163 - DNA, 140 bp, Artificial Sequence
  Synthetic
atacgccatgctgggtctccgaaggtttttttgacctgatgcacgttcagaaagtgttatcagcaagcacagtgtgtaagttgcagagttgcacacatggtgtaccaggagacctacaggcgtacttgggagtcggccat

SEQ ID NO: 370164 - DNA, 140 bp, Artificial Sequence
  Synthetic
atggccgactcccaagtacgcctgtaggtctcctggtacaccatgtgtgcaactctgcaacttacacactgtgcttgctgataacactttctgaacgtgcatcaggtcaaaaaaaccttcggagacccagcatggcgtat

SEQ ID NO: 370165 - DNA, 140 bp, Artificial Sequence
  Synthetic
atacgccatgctgggtctccattcataaaattgagccacacttcaacacttcctggatgtcctgggatggttgtgacctagactactactgcaacatgggagattggccttcttgcacatcgtacttgggagtcggccat

SEQ ID NO: 370166 - DNA, 140 bp, Artificial Sequence
  Synthetic
atggccgactcccaagtacgatgtgcaagaaggccaatctcccatgttgcagtagtagtctaggtcacaaccatcccaggacatccaggaagtgttgaagtgtggctcaattttatgaatggagacccagcatggcgtat

SEQ ID NO: 370167 - DNA, 140 bp, Artificial Sequence
  Synthetic
atacgccatgctgggtctccaaaaaatgtgttaacacaaaacttgagcaaccacagagcattttgatcgaacacaagggaactataatcggaaagcaaaacagcacttgcacagccaaggcgtacttgggagtcggccat

SEQ ID NO: 370168 - DNA, 140 bp, Artificial Sequence
  Synthetic
atggccgactcccaagtacgccttggctgtgcaagtgctgttttgctttccgattatagttcccttgtgttcgatcaaaatgctctgtggttgctcaagttttgtgttaacacattttttggagacccagcatggcgtat

SEQ ID NO: 370169 - DNA, 140 bp, Artificial Sequence
  Synthetic
aggccctggctgctgatatgaagaaactaaaattcatgaacatacattcccctgagctcatgcccgacaactgtatcttttcagaagctgagttccaagaactaataaagcttaagaagcgaccttttgggacagcggtg

SEQ ID NO: 370170 - DNA, 140 bp, Artificial Sequence
  Synthetic
caccgctgtcccaaaaggtcgcttcttaagctttattagttcttggaactcagcttctgaaaagatacagttgtcgggcatgagctcaggggaatgtatgttcatgaattttagtttcttcatatcagcagccagggcct

SEQ ID NO: 370171 - DNA, 140 bp, Artificial Sequence
  Synthetic
aggccctggctgctgatatgtgcatctaatctgcttcattgtatctatgagcagactctatactgcttgaaactgcctttactctatttactttgacctaaatctcgactgcgtgccgccgaccttttgggacagcggtg

SEQ ID NO: 370172 - DNA, 140 bp, Artificial Sequence
  Synthetic
caccgctgtcccaaaaggtcggcggcacgcagtcgagatttaggtcaaagtaaatagagtaaaggcagtttcaagcagtatagagtctgctcatagatacaatgaagcagattagatgcacatatcagcagccagggcct

SEQ ID NO: 370173 - DNA, 140 bp, Artificial Sequence
  Synthetic
atacgccatgctgggtctccgctctggtggaagcaaccaagttctgtgcacccatatatgaatgtgcttgggtcagctctactggcattgtgaagaaggggcttgagtggttcgagaagacgtacttgggagtcggccat

SEQ ID NO: 370174 - DNA, 140 bp, Artificial Sequence
  Synthetic
atggccgactcccaagtacgtcttctcgaaccactcaagccccttcttcacaatgccagtagagctgacccaagcacattcatatatgggtgcacagaacttggttgcttccaccagagcggagacccagcatggcgtat

SEQ ID NO: 370175 - DNA, 140 bp, Artificial Sequence
  Synthetic
atacgccatgctgggtctcctagcctctgagcacctgctgcaccaatcccttgttggcaagcagtctccattccaaaatgcctacaacgtcaagggcaatgccaccagtgccaacatcatcgtacttgggagtcggccat

SEQ ID NO: 370176 - DNA, 140 bp, Artificial Sequence
  Synthetic
atggccgactcccaagtacgatgatgttggcactggtggcattgcccttgacgttgtaggcattttggaatggagactgcttgccaacaagggattggtgcagcaggtgctcagaggctaggagacccagcatggcgtat

SEQ ID NO: 370177 - DNA, 140 bp, Artificial Sequence
  Synthetic
aggccctggctgctgatatgaaatgacagggtgcaaaaattcatacaccaactttctgaggaactctacgaaataagactacagcatctagagttatcaaagctgaagcaggaacaccctgaccttttgggacagcggtg

SEQ ID NO: 370178 - DNA, 140 bp, Artificial Sequence
  Synthetic
caccgctgtcccaaaaggtcagggtgttcctgcttcagctttgataactctagatgctgtagtcttatttcgtagagttcctcagaaagttggtgtatgaatttttgcaccctgtcatttcatatcagcagccagggcct

SEQ ID NO: 370179 - DNA, 140 bp, Artificial Sequence
  Synthetic
aggccctggctgctgatatgtctcaaagaaacacgtgccgcttacgcccacagtgttatcttgagtgctgacaaaatggagaacaaaatcgaggtgaataacaaagatgagatgaataaggaccttttgggacagcggtg

SEQ ID NO: 370180 - DNA, 140 bp, Artificial Sequence
  Synthetic
caccgctgtcccaaaaggtccttattcatctcatctttgttattcacctcgattttgttctccattttgtcagcactcaagataacactgtgggcgtaagcggcacgtgtttctttgagacatatcagcagccagggcct

SEQ ID NO: 370181 - DNA, 140 bp, Artificial Sequence
  Synthetic
aggccctggctgctgatatgagatggccagtgccactgatgatgcacaaaaggattccatctacgcatcagctctggtggaagcaactaagttttgcgcacccatatacgagtgtgcctggaccttttgggacagcggtg

SEQ ID NO: 370182 - DNA, 140 bp, Artificial Sequence
  Synthetic
caccgctgtcccaaaaggtccaggcacactcgtatatgggtgcgcaaaacttagttgcttccaccagagctgatgcgtagatggaatccttttgtgcatcatcagtggcactggccatctcatatcagcagccagggcct

SEQ ID NO: 370183 - DNA, 140 bp, Artificial Sequence
  Synthetic
aggccctggctgctgatatgatgcaggaaccattaaatcttgggatgaaagctacactgaactgaaggttgaggttcccaaaatagaacagcttgccgattaccaacaggctgctctcaagaccttttgggacagcggtg

SEQ ID NO: 370184 - DNA, 140 bp, Artificial Sequence
  Synthetic
caccgctgtcccaaaaggtcttgagagcagcctgttggtaatcggcaagctgttctattttgggaacctcaaccttcagttcagtgtagctttcatcccaagatttaatggttcctgcatcatatcagcagccagggcct

SEQ ID NO: 370185 - DNA, 140 bp, Artificial Sequence
  Synthetic
aggccctggctgctgatatgagtggtgcagggaatttgtcaaaggcaagtacatcatggctttcaacccgccttggggggacatcaacaagtcaggccggtcaggaatagcacttgttgcgaccttttgggacagcggtg

SEQ ID NO: 370186 - DNA, 140 bp, Artificial Sequence
  Synthetic
caccgctgtcccaaaaggtcgcaacaagtgctattcctgaccggcctgacttgttgatgtccccccaaggcgggttgaaagccatgatgtacttgcctttgacaaattccctgcaccactcatatcagcagccagggcct

SEQ ID NO: 370187 - DNA, 140 bp, Artificial Sequence
  Synthetic
aggccctggctgctgatatgaacaggccttgctaagcttgcagagactgaggggaagggagtgtttgatgaagcaaaaaagactgtggaggctctcaacgggtacttgaacaaacataaggaccttttgggacagcggtg

SEQ ID NO: 370188 - DNA, 140 bp, Artificial Sequence
  Synthetic
caccgctgtcccaaaaggtccttatgtttgttcaagtacccgttgagagcctccacagtcttttttgcttcatcaaacactcccttcccctcagtctctgcaagcttagcaaggcctgttcatatcagcagccagggcct

SEQ ID NO: 370189 - DNA, 140 bp, Artificial Sequence
  Synthetic
aggccctggctgctgatatggattccttccagcagaacaggatctacatgcaccctgctgtgctgacagctggcagaattagtgagatgggtgtctgctttgggacaatccctgtggccagaccttttgggacagcggtg

SEQ ID NO: 370190 - DNA, 140 bp, Artificial Sequence
  Synthetic
caccgctgtcccaaaaggtctggccacagggattgtcccaaagcagacacccatctcactaattctgccagctgtcagcacagcagggtgcatgtagatcctgttctgctggaaggaatccatatcagcagccagggcct

SEQ ID NO: 370191 - DNA, 140 bp, Artificial Sequence
  Synthetic
atacgccatgctgggtctcctggcagaattagtgagatgggtgtctgctttgggacaatccctgtggccaaccctgatgatgctgcccagggatctggacacaccaagtccattcttaaccgtacttgggagtcggccat

SEQ ID NO: 370192 - DNA, 140 bp, Artificial Sequence
  Synthetic
atggccgactcccaagtacggttaagaatggacttggtgtgtccagatccctgggcagcatcatcagggttggccacagggattgtcccaaagcagacacccatctcactaattctgccaggagacccagcatggcgtat

SEQ ID NO: 370193 - DNA, 140 bp, Artificial Sequence
  Synthetic
aggccctggctgctgatatggttgtttgaaattcaaaaaacagggttcaacatacaagacatggacattgtggcttctgagcacctgctacaccaatcccttgtcggcaaacagtctccagaccttttgggacagcggtg

SEQ ID NO: 370194 - DNA, 140 bp, Artificial Sequence
  Synthetic
caccgctgtcccaaaaggtctggagactgtttgccgacaagggattggtgtagcaggtgctcagaagccacaatgtccatgtcttgtatgttgaaccctgttttttgaatttcaaacaaccatatcagcagccagggcct

SEQ ID NO: 370195 - DNA, 140 bp, Artificial Sequence
  Synthetic
atacgccatgctgggtctcctggcttctgagcacctgctacaccaatcccttgtcggcaaacagtctccattccaaaatgcctacaatgtcaagggcaacgccaccagtgccaacatcatcgtacttgggagtcggccat

SEQ ID NO: 370196 - DNA, 140 bp, Artificial Sequence
  Synthetic
atggccgactcccaagtacgatgatgttggcactggtggcgttgcccttgacattgtaggcattttggaatggagactgtttgccgacaagggattggtgtagcaggtgctcagaagccaggagacccagcatggcgtat

SEQ ID NO: 370197 - DNA, 140 bp, Artificial Sequence
  Synthetic
aggccctggctgctgatatgctacgatcgtgaccattaaccatgtttattttaactgcttatataaacctgtcttattaacttcttcttactttctttcgttttaaacacttaaagggctgaccttttgggacagcggtg

SEQ ID NO: 370198 - DNA, 140 bp, Artificial Sequence
  Synthetic
caccgctgtcccaaaaggtcagccctttaagtgtttaaaacgaaagaaagtaagaagaagttaataagacaggtttatataagcagttaaaataaacatggttaatggtcacgatcgtagcatatcagcagccagggcct

SEQ ID NO: 370199 - DNA, 140 bp, Artificial Sequence
  Synthetic
atacgccatgctgggtctcctctcaaagaaatacttgcggcacgtcagtacgtaagtgttaactttgagtgtgtgtaaagagcagcttgtgatcaacatgttattccactttaaatttatcgtacttgggagtcggccat

SEQ ID NO: 370200 - DNA, 140 bp, Artificial Sequence
  Synthetic
atggccgactcccaagtacgataaatttaaagtggaataacatgttgatcacaagctgctctttacacacactcaaagttaacacttacgtactgacgtgccgcaagtatttctttgagaggagacccagcatggcgtat

SEQ ID NO: 370201 - DNA, 140 bp, Artificial Sequence
  Synthetic
aggccctggctgctgatatggtgtgtaaagagcagcttgtgatcaacatgttattccactttaaatttatgttgctgattaattttattctttgtcatctcctttgggggggtggtggaggaccttttgggacagcggtg

SEQ ID NO: 370202 - DNA, 140 bp, Artificial Sequence
  Synthetic
caccgctgtcccaaaaggtcctccaccacccccccaaaggagatgacaaagaataaaattaatcagcaacataaatttaaagtggaataacatgttgatcacaagctgctctttacacaccatatcagcagccagggcct

SEQ ID NO: 370203 - DNA, 140 bp, Artificial Sequence
  Synthetic
atacgccatgctgggtctccgttgctgattaattttattctttgtcatctcctttgggggggtggtggagtcaccggtggggtcgaaacaaactccagctcaacacaagccatccagacgcgtacttgggagtcggccat

SEQ ID NO: 370204 - DNA, 140 bp, Artificial Sequence
  Synthetic
atggccgactcccaagtacgcgtctggatggcttgtgttgagctggagtttgtttcgaccccaccggtgactccaccacccccccaaaggagatgacaaagaataaaattaatcagcaacggagacccagcatggcgtat

SEQ ID NO: 370205 - DNA, 140 bp, Artificial Sequence
  Synthetic
atacgccatgctgggtctcccacggagacagcgtcaagcatgaccactagcacgccggacacacaagtaaccacagacaatggctctggtgagcctagcacagatcctctaaccaccaatcgtacttgggagtcggccat

SEQ ID NO: 370206 - DNA, 140 bp, Artificial Sequence
  Synthetic
atggccgactcccaagtacgattggtggttagaggatctgtgctaggctcaccagagccattgtctgtggttacttgtgtgtccggcgtgctagtggtcatgcttgacgctgtctccgtgggagacccagcatggcgtat

SEQ ID NO: 370207 - DNA, 140 bp, Artificial Sequence
  Synthetic
aggccctggctgctgatatgccacagacaatggctctggtgagcctagcacagatcctctaaccaccaatgaggcaaccccccctctctctgtcaccactgcccaaacgacagagacgaagaccttttgggacagcggtg

SEQ ID NO: 370208 - DNA, 140 bp, Artificial Sequence
  Synthetic
caccgctgtcccaaaaggtcttcgtctctgtcgtttgggcagtggtgacagagagagggggggttgcctcattggtggttagaggatctgtgctaggctcaccagagccattgtctgtggcatatcagcagccagggcct

SEQ ID NO: 370209 - DNA, 140 bp, Artificial Sequence
  Synthetic
atacgccatgctgggtctccccccgagtatcaccatattgagtgcatcaaatactagcttgcccatatcatcagtgcatgcaagcccatcacccagctccagtgaagaaccaacaccacacgtacttgggagtcggccat

SEQ ID NO: 370210 - DNA, 140 bp, Artificial Sequence
  Synthetic
atggccgactcccaagtacgtgtggtgttggttcttcactggagctgggtgatgggcttgcatgcactgatgatatgggcaagctagtatttgatgcactcaatatggtgatactcggggggagacccagcatggcgtat

SEQ ID NO: 370211 - DNA, 140 bp, Artificial Sequence
  Synthetic
aggccctggctgctgatatgtcagtgcatgcaagcccatcacccagctccagtgaagaaccaacaccacaaaatgcacaccatctctccagaagtcttctctcagcagtaagtacagagagaccttttgggacagcggtg

SEQ ID NO: 370212 - DNA, 140 bp, Artificial Sequence
  Synthetic
caccgctgtcccaaaaggtctctctgtacttactgctgagagaagacttctggagagatggtgtgcattttgtggtgttggttcttcactggagctgggtgatgggcttgcatgcactgacatatcagcagccagggcct

SEQ ID NO: 370213 - DNA, 140 bp, Artificial Sequence
  Synthetic
atacgccatgctgggtctccaatagcccgccaacagccggaaatgacacaatggtcacatcagctccaaacggcaatatacgcaacactccagaacaggccaaccccacagccccagaggcgtacttgggagtcggccat

SEQ ID NO: 370214 - DNA, 140 bp, Artificial Sequence
  Synthetic
atggccgactcccaagtacgcctctggggctgtggggttggcctgttctggagtgttgcgtatattgccgtttggagctgatgtgaccattgtgtcatttccggctgttggcgggctattggagacccagcatggcgtat

SEQ ID NO: 370215 - DNA, 140 bp, Artificial Sequence
  Synthetic
atacgccatgctgggtctcccttcccccaagattcaaacaacacaaaaccaacagaccgttacaccagaggctacacctatcaccacaatcactgcactcacagacctaacaaacaggtccgtacttgggagtcggccat

SEQ ID NO: 370216 - DNA, 140 bp, Artificial Sequence
  Synthetic
atggccgactcccaagtacggacctgtttgttaggtctgtgagtgcagtgattgtggtgataggtgtagcctctggtgtaacggtctgttggttttgtgttgtttgaatcttgggggaagggagacccagcatggcgtat

SEQ ID NO: 370217 - DNA, 140 bp, Artificial Sequence
  Synthetic
atacgccatgctgggtctcccaaaagggactccaaggtacagaaaattctgaccttttctcaaggcctcaagaagtactatagcaagatattgaaactcttgcaattaacacaagaagaacgtacttgggagtcggccat

SEQ ID NO: 370218 - DNA, 140 bp, Artificial Sequence
  Synthetic
atggccgactcccaagtacgttcttcttgtgttaattgcaagagtttcaatatcttgctatagtacttcttgaggccttgagaaaaggtcagaattttctgtaccttggagtcccttttgggagacccagcatggcgtat

SEQ ID NO: 370219 - DNA, 140 bp, Artificial Sequence
  Synthetic
aggccctggctgctgatatgagaagtactatagcaagatattgaaactcttgcaattaacacaagaagaagattctgaaggtctgcttgagtggtgcacacgggtgctggaacaagcatggaccttttgggacagcggtg

SEQ ID NO: 370220 - DNA, 140 bp, Artificial Sequence
  Synthetic
caccgctgtcccaaaaggtccatgcttgttccagcacccgtgtgcaccactcaagcagaccttcagaatcttcttcttgtgttaattgcaagagtttcaatatcttgctatagtacttctcatatcagcagccagggcct

SEQ ID NO: 370221 - DNA, 140 bp, Artificial Sequence
  Synthetic
atacgccatgctgggtctccagggctacttcaatgatgttctacagttcaggttacatgacgcacttagcaacaccgagcctgcccagaccacttcacctacagctgtacccttcaaatccgtacttgggagtcggccat

SEQ ID NO: 370222 - DNA, 140 bp, Artificial Sequence
  Synthetic
atggccgactcccaagtacggatttgaagggtacagctgtaggtgaagtggtctgggcaggctcggtgttgctaagtgcgtcatgtaacctgaactgtagaacatcattgaagtagccctggagacccagcatggcgtat

SEQ ID NO: 370223 - DNA, 140 bp, Artificial Sequence
  Synthetic
aggccctggctgctgatatgaacaccgagcctgcccagaccacttcacctacagctgtacccttcaaatcttactatgccaaagggtctctaacctttgattcaggctacttttctgctagaccttttgggacagcggtg

SEQ ID NO: 370224 - DNA, 140 bp, Artificial Sequence
  Synthetic
caccgctgtcccaaaaggtctagcagaaaagtagcctgaatcaaaggttagagaccctttggcatagtaagatttgaagggtacagctgtaggtgaagtggtctgggcaggctcggtgttcatatcagcagccagggcct

SEQ ID NO: 370225 - DNA, 140 bp, Artificial Sequence
  Synthetic
atacgccatgctgggtctcccaacaccctgtaaaaatagctaacactccaggtccaaaattatctaatctcaagaccattaactgcataaacctgaaagtgtcaactgacaaagaacatacgtacttgggagtcggccat

SEQ ID NO: 370226 - DNA, 140 bp, Artificial Sequence
  Synthetic
atggccgactcccaagtacgtatgttctttgtcagttgacactttcaggtttatgcagttaatggtcttgagattagataattttggacctggagtgttagctatttttacagggtgttgggagacccagcatggcgtat

SEQ ID NO: 370227 - DNA, 140 bp, Artificial Sequence
  Synthetic
aggccctggctgctgatatgcaagaccattaactgcataaacctgaaagtgtcaactgacaaagaacatagtgagcttgaggtcaacgtgcttctacctcaggttgccgttaatctctcagaccttttgggacagcggtg

SEQ ID NO: 370228 - DNA, 140 bp, Artificial Sequence
  Synthetic
caccgctgtcccaaaaggtctgagagattaacggcaacctgaggtagaagcacgttgacctcaagctcactatgttctttgtcagttgacactttcaggtttatgcagttaatggtcttgcatatcagcagccagggcct

SEQ ID NO: 370229 - DNA, 140 bp, Artificial Sequence
  Synthetic
atacgccatgctgggtctcccgatggagcaataaaactccctagagttgcacacaatggggtttttataccaggtacatacaagattgtgatagacaaaaaaaacaacctaaatgataggcgtacttgggagtcggccat

SEQ ID NO: 370230 - DNA, 140 bp, Artificial Sequence
  Synthetic
atggccgactcccaagtacgcctatcatttaggttgttttttttgtctatcacaatcttgtatgtacctggtataaaaaccccattgtgtgcaactctagggagttttattgctccatcgggagacccagcatggcgtat

SEQ ID NO: 370231 - DNA, 140 bp, Artificial Sequence
  Synthetic
aggccctggctgctgatatgcaggtacatacaagattgtgatagacaaaaaaaacaacctaaatgataggtgtacattaatcaccaattgtgtcataaagggaagagaagtccgaaaagggaccttttgggacagcggtg

SEQ ID NO: 370232 - DNA, 140 bp, Artificial Sequence
  Synthetic
caccgctgtcccaaaaggtcccttttcggacttctcttccctttatgacacaattggtgattaatgtacacctatcatttaggttgttttttttgtctatcacaatcttgtatgtacctgcatatcagcagccagggcct

SEQ ID NO: 370233 - DNA, 140 bp, Artificial Sequence
  Synthetic
atacgccatgctgggtctcctcacaggctcgagaagattacttgcagaaggaggaagcagtgactgcatttcaagaactcagctagttaaaacggaggttgcagaaattcatgaggacagcgtacttgggagtcggccat

SEQ ID NO: 370234 - DNA, 140 bp, Artificial Sequence
  Synthetic
atggccgactcccaagtacgctgtcctcatgaatttctgcaacctccgttttaactagctgagttcttgaaatgcagtcactgcttcctccttctgcaagtaatcttctcgagcctgtgaggagacccagcatggcgtat

SEQ ID NO: 370235 - DNA, 140 bp, Artificial Sequence
  Synthetic
aggccctggctgctgatatgtcaagaactcagctagttaaaacggaggttgcagaaattcatgaggacagttacggtgggcctggtgagaaaataacaatctgcaatggttccacaattggaccttttgggacagcggtg

SEQ ID NO: 370236 - DNA, 140 bp, Artificial Sequence
  Synthetic
caccgctgtcccaaaaggtccaattgtggaaccattgcagattgttattttctcaccaggcccaccgtaactgtcctcatgaatttctgcaacctccgttttaactagctgagttcttgacatatcagcagccagggcct

SEQ ID NO: 370237 - DNA, 140 bp, Artificial Sequence
  Synthetic
atacgccatgctgggtctccagatcctacaagctatgcgagaacagtgcctcagggaaaagctgtgaaatagatagcatcccagtcaaatgcaaacaagggttttgcctcaaaataaccccgtacttgggagtcggccat

SEQ ID NO: 370238 - DNA, 140 bp, Artificial Sequence
  Synthetic
atggccgactcccaagtacggggttattttgaggcaaaacccttgtttgcatttgactgggatgctatctatttcacagcttttccctgaggcactgttctcgcatagcttgtaggatctggagacccagcatggcgtat

SEQ ID NO: 370239 - DNA, 140 bp, Artificial Sequence
  Synthetic
aggccctggctgctgatatgagatagcatcccagtcaaatgcaaacaagggttttgcctcaaaataacccaagaaggaagaggtcatgtaaaactgtccagagggacagaaattgttctagaccttttgggacagcggtg

SEQ ID NO: 370240 - DNA, 140 bp, Artificial Sequence
  Synthetic
caccgctgtcccaaaaggtctagaacaatttctgtccctctggacagttttacatgacctcttccttcttgggttattttgaggcaaaacccttgtttgcatttgactgggatgctatctcatatcagcagccagggcct

SEQ ID NO: 370241 - DNA, 140 bp, Artificial Sequence
  Synthetic
atacgccatgctgggtctcccattttagtggattgctcaggagggcaacagcattttttacaaaacaatctgattgacttgggatgccccaatgtcccattactgggtaaaatggccatacgtacttgggagtcggccat

SEQ ID NO: 370242 - DNA, 140 bp, Artificial Sequence
  Synthetic
atggccgactcccaagtacgtatggccattttacccagtaatgggacattggggcatcccaagtcaatcagattgttttgtaaaaaatgctgttgccctcctgagcaatccactaaaatgggagacccagcatggcgtat

SEQ ID NO: 370243 - DNA, 140 bp, Artificial Sequence
  Synthetic
aggccctggctgctgatatgtgattgacttgggatgccccaatgtcccattactgggtaaaatggccatatatgtctgcagaatgtcaaaccacccaaaaactaccatggcatttctgttgaccttttgggacagcggtg

SEQ ID NO: 370244 - DNA, 140 bp, Artificial Sequence
  Synthetic
caccgctgtcccaaaaggtcaacagaaatgccatggtagtttttgggtggtttgacattctgcagacatatatggccattttacccagtaatgggacattggggcatcccaagtcaatcacatatcagcagccagggcct

SEQ ID NO: 370245 - DNA, 140 bp, Artificial Sequence
  Synthetic
atacgccatgctgggtctcctctacttgctgattgccatcggaacagtagggaaaaagctaaaacagtatagagagctgaaaccacaaacatgcattgtctgtgaatctgtccctgttaacgtacttgggagtcggccat

SEQ ID NO: 370246 - DNA, 140 bp, Artificial Sequence
  Synthetic
atggccgactcccaagtacgttaacagggacagattcacagacaatgcatgtttgtggtttcagctctctatactgttttagctttttccctactgttccgatggcaatcagcaagtagaggagacccagcatggcgtat

SEQ ID NO: 370247 - DNA, 140 bp, Artificial Sequence
  Synthetic
aggccctggctgctgatatgagagagctgaaaccacaaacatgcattgtctgtgaatctgtccctgttaatgcaatagatgctgaaatgcatgagcttaattgcagttacaatatatgccgaccttttgggacagcggtg

SEQ ID NO: 370248 - DNA, 140 bp, Artificial Sequence
  Synthetic
caccgctgtcccaaaaggtcggcatatattgtaactgcaattaagctcatgcatttcagcatctattgcattaacagggacagattcacagacaatgcatgtttgtggtttcagctctctcatatcagcagccagggcct

SEQ ID NO: 370249 - DNA, 140 bp, Artificial Sequence
  Synthetic
atacgccatgctgggtctcccagtgtcccaaacggagggagaaggtggaagagactgagctattcttgaacttggaaagaataccttggctggtgagaaagctccttcaagtatcagagtcgtacttgggagtcggccat

SEQ ID NO: 370250 - DNA, 140 bp, Artificial Sequence
  Synthetic
atggccgactcccaagtacgactctgatacttgaaggagctttctcaccagccaaggtattctttccaagttcaagaatagctcagtctcttccaccttctccctccgtttgggacactgggagacccagcatggcgtat

SEQ ID NO: 370251 - DNA, 140 bp, Artificial Sequence
  Synthetic
aggccctggctgctgatatgcttggaaagaataccttggctggtgagaaagctccttcaagtatcagagtcaacaggaatggctctaaagagaagctgttggatgatcacactcctcattgaccttttgggacagcggtg

SEQ ID NO: 370252 - DNA, 140 bp, Artificial Sequence
  Synthetic
caccgctgtcccaaaaggtcaatgaggagtgtgatcatccaacagcttctctttagagccattcctgttgactctgatacttgaaggagctttctcaccagccaaggtattctttccaagcatatcagcagccagggcct

SEQ ID NO: 370253 - DNA, 140 bp, Artificial Sequence
  Synthetic
atacgccatgctgggtctccgagggcaatcgagacctatcaagcaagagaaacctacacaggcatatgcctctttgtgttaggaagtgttctctttgcggtatcctggctgacaaaggcccgtacttgggagtcggccat

SEQ ID NO: 370254 - DNA, 140 bp, Artificial Sequence
  Synthetic
atggccgactcccaagtacgggcctttgtcagccaggataccgcaaagagaacacttcctaacacaaagaggcatatgcctgtgtaggtttctcttgcttgataggtctcgattgccctcggagacccagcatggcgtat

SEQ ID NO: 370255 - DNA, 140 bp, Artificial Sequence
  Synthetic
atacgccatgctgggtctccgacatgctccattggtagtataaatggatttgaaatagagtctcataaatgctattgcagtctattctgttgtccttactgtagagcttgctcatccgaccgtacttgggagtcggccat

SEQ ID NO: 370256 - DNA, 140 bp, Artificial Sequence
  Synthetic
atggccgactcccaagtacggtcggatgagcaagctctacagtaaggacaacagaatagactgcaatagcatttatgagactctatttcaaatccatttatactaccaatggagcatgtcggagacccagcatggcgtat

SEQ ID NO: 370257 - DNA, 140 bp, Artificial Sequence
  Synthetic
aggccctggctgctgatatggctattgcagtctattctgttgtccttactgtagagcttgctcatccgacaaaaacactcaccggatgcacttaaatgtttgcaaaaaaaggaagatggggaccttttgggacagcggtg

SEQ ID NO: 370258 - DNA, 140 bp, Artificial Sequence
  Synthetic
caccgctgtcccaaaaggtccccatcttcctttttttgcaaacatttaagtgcatccggtgagtgtttttgtcggatgagcaagctctacagtaaggacaacagaatagactgcaatagccatatcagcagccagggcct

SEQ ID NO: 370259 - DNA, 140 bp, Artificial Sequence
  Synthetic
atacgccatgctgggtctccaaaaacactcaccggatgcacttaaatgtttgcaaaaaaaggaagatgggtagcaatgtcatgctggctgtctgtaaacgtatgtgctttagagcaaccacgtacttgggagtcggccat

SEQ ID NO: 370260 - DNA, 140 bp, Artificial Sequence
  Synthetic
atggccgactcccaagtacgtggttgctctaaagcacatacgtttacagacagccagcatgacattgctacccatcttcctttttttgcaaacatttaagtgcatccggtgagtgtttttggagacccagcatggcgtat

SEQ ID NO: 370261 - DNA, 140 bp, Artificial Sequence
  Synthetic
atacgccatgctgggtctcctttgtgatttgcatattaatcctaacaatctgtgtggtaagcacctccgcagttgatatggaaaatttgcctgcaggcatctgggagaaagaagaagatccgtacttgggagtcggccat

SEQ ID NO: 370262 - DNA, 140 bp, Artificial Sequence
  Synthetic
atggccgactcccaagtacggatcttcttctttctcccagatgcctgcaggcaaattttccatatcaactgcggaggtgcttaccacacagattgttaggattaatatgcaaatcacaaaggagacccagcatggcgtat

SEQ ID NO: 370263 - DNA, 140 bp, Artificial Sequence
  Synthetic
atacgccatgctgggtctccttacaaacttctgtcaccaggagtgtcaagtgacagaaactgaatgcctctgcccgtatgaggccatggtactcaggaagccactcttcctggatagcaccgtacttgggagtcggccat

SEQ ID NO: 370264 - DNA, 140 bp, Artificial Sequence
  Synthetic
atggccgactcccaagtacggtgctatccaggaagagtggcttcctgagtaccatggcctcatacgggcagaggcattcagtttctgtcacttgacactcctggtgacagaagtttgtaaggagacccagcatggcgtat

SEQ ID NO: 370265 - DNA, 140 bp, Artificial Sequence
  Synthetic
atacgccatgctgggtctcctgtcaattgaagctccgtggggagcaatcaatgtccagtcaactttcaaaccaacagtttcagctgctaacatagcacttagctggagttcagttgaacacgtacttgggagtcggccat

SEQ ID NO: 370266 - DNA, 140 bp, Artificial Sequence
  Synthetic
atggccgactcccaagtacgtgttcaactgaactccagctaagtgctatgttagcagctgaaactgttggtttgaaagttgactggacattgattgctccccacggagcttcaattgacaggagacccagcatggcgtat

SEQ ID NO: 370267 - DNA, 140 bp, Artificial Sequence
  Synthetic
aggccctggctgctgatatgccaacagtttcagctgctaacatagcacttagctggagttcagttgaacacaggggcaacaaaattttagtttcaggtagatcagagtcaatcatgaaatgaccttttgggacagcggtg

SEQ ID NO: 370268 - DNA, 140 bp, Artificial Sequence
  Synthetic
caccgctgtcccaaaaggtcatttcatgattgactctgatctacctgaaactaaaattttgttgcccctgtgttcaactgaactccagctaagtgctatgttagcagctgaaactgttggcatatcagcagccagggcct

SEQ ID NO: 370269 - DNA, 140 bp, Artificial Sequence
  Synthetic
atacgccatgctgggtctccgagtcaaagacgcttactgtttccgtcatggacctgtcacaaatgtactctcctgtttttgagtacttgtcaggtgacagacaagtggaggaatggccaacgtacttgggagtcggccat

SEQ ID NO: 370270 - DNA, 140 bp, Artificial Sequence
  Synthetic
atggccgactcccaagtacgttggccattcctccacttgtctgtcacctgacaagtactcaaaaacaggagagtacatttgtgacaggtccatgacggaaacagtaagcgtctttgactcggagacccagcatggcgtat

SEQ ID NO: 370271 - DNA, 140 bp, Artificial Sequence
  Synthetic
aggccctggctgctgatatgtcctgtttttgagtacttgtcaggtgacagacaagtggaggaatggccaaaggcaacttgcacaggtgactgtccagagagatgcggctgcacttcgtcagaccttttgggacagcggtg

SEQ ID NO: 370272 - DNA, 140 bp, Artificial Sequence
  Synthetic
caccgctgtcccaaaaggtctgacgaagtgcagccgcatctctctggacagtcacctgtgcaagttgcctttggccattcctccacttgtctgtcacctgacaagtactcaaaaacaggacatatcagcagccagggcct

SEQ ID NO: 370273 - DNA, 140 bp, Artificial Sequence
  Synthetic
atacgccatgctgggtctcctacctggtgttggggggtggggactggctgcacttgctgtgggctggatgtaaaggatttttttactgactacatgctggtaaaatggaaagtggaatatcgtacttgggagtcggccat

SEQ ID NO: 370274 - DNA, 140 bp, Artificial Sequence
  Synthetic
atggccgactcccaagtacgatattccactttccattttaccagcatgtagtcagtaaaaaaatcctttacatccagcccacagcaagtgcagccagtccccaccccccaacaccaggtaggagacccagcatggcgtat

SEQ ID NO: 370275 - DNA, 140 bp, Artificial Sequence
  Synthetic
aggccctggctgctgatatgtaaaggatttttttactgactacatgctggtaaaatggaaagtggaatatataaagacagaagctatagtgtgtgtcgagctgactagtcaagagaggcagaccttttgggacagcggtg

SEQ ID NO: 370276 - DNA, 140 bp, Artificial Sequence
  Synthetic
caccgctgtcccaaaaggtctgcctctcttgactagtcagctcgacacacactatagcttctgtctttatatattccactttccattttaccagcatgtagtcagtaaaaaaatcctttacatatcagcagccagggcct

SEQ ID NO: 370277 - DNA, 140 bp, Artificial Sequence
  Synthetic
atacgccatgctgggtctcctaaccctatcagagccaagaaatgtccagcagaggcttcctcccgaaattgtaacactgcatcctaaaatagaggaaggtttttttgatttgatgcatgtcgtacttgggagtcggccat

SEQ ID NO: 370278 - DNA, 140 bp, Artificial Sequence
  Synthetic
atggccgactcccaagtacgacatgcatcaaatcaaaaaaaccttcctctattttaggatgcagtgttacaatttcgggaggaagcctctgctggacatttcttggctctgatagggttaggagacccagcatggcgtat

SEQ ID NO: 370279 - DNA, 140 bp, Artificial Sequence
  Synthetic
atacgccatgctgggtctccggctagattgcctcaccaacatgagaaaccttgatggaaaacccattagtgaaggtagcaatctagttaatttctacaaagttatttgcatctccggagacgtacttgggagtcggccat

SEQ ID NO: 370280 - DNA, 140 bp, Artificial Sequence
  Synthetic
atggccgactcccaagtacgtctccggagatgcaaataactttgtagaaattaactagattgctaccttcactaatgggttttccatcaaggtttctcatgttggtgaggcaatctagccggagacccagcatggcgtat

SEQ ID NO: 370281 - DNA, 140 bp, Artificial Sequence
  Synthetic
atacgccatgctgggtctccggagacaaggttaatggacactcaattcacaagatagaaccacattttaatacttcatggatgtcatgggatggttgcgatctggactatttctgcaatacgtacttgggagtcggccat

SEQ ID NO: 370282 - DNA, 140 bp, Artificial Sequence
  Synthetic
atggccgactcccaagtacgtattgcagaaatagtccagatcgcaaccatcccatgacatccatgaagtattaaaatgtggttctatcttgtgaattgagtgtccattaaccttgtctccggagacccagcatggcgtat

SEQ ID NO: 370283 - DNA, 140 bp, Artificial Sequence
  Synthetic
aggccctggctgctgatatgtacttcatggatgtcatgggatggttgcgatctggactatttctgcaatatgggggactggccttcatgcacatacactggagtgacacagcataaccgtgaccttttgggacagcggtg

SEQ ID NO: 370284 - DNA, 140 bp, Artificial Sequence
  Synthetic
caccgctgtcccaaaaggtcacggttatgctgtgtcactccagtgtatgtgcatgaaggccagtcccccatattgcagaaatagtccagatcgcaaccatcccatgacatccatgaagtacatatcagcagccagggcct

SEQ ID NO: 370285 - DNA, 140 bp, Artificial Sequence
  Synthetic
atacgccatgctgggtctccccactttcattcgaagagggtcacggcacatggagatactccccagctagacctaaaagcgagaccggcatatggtgctggcgaggtcactgttctagtgcgtacttgggagtcggccat

SEQ ID NO: 370286 - DNA, 140 bp, Artificial Sequence
  Synthetic
atggccgactcccaagtacgcactagaacagtgacctcgccagcaccatatgccggtctcgcttttaggtctagctggggagtatctccatgtgccgtgaccctcttcgaatgaaagtggggagacccagcatggcgtat

SEQ ID NO: 370287 - DNA, 140 bp, Artificial Sequence
  Synthetic
aggccctggctgctgatatgacctaaaagcgagaccggcatatggtgctggcgaggtcactgttctagtggaggttgcagacttggagttgcacacaaagaaacttgaagtgtcaggtttgaccttttgggacagcggtg

SEQ ID NO: 370288 - DNA, 140 bp, Artificial Sequence
  Synthetic
caccgctgtcccaaaaggtcaaacctgacacttcaagtttctttgtgtgcaactccaagtctgcaacctccactagaacagtgacctcgccagcaccatatgccggtctcgcttttaggtcatatcagcagccagggcct

SEQ ID NO: 370289 - DNA, 140 bp, Artificial Sequence
  Synthetic
atacgccatgctgggtctcctctcctgcaaagttagaatccatgtaaatgaaccagatgaatttacagtacatgtaagaagtagcgacccagatgttgtagcagcaggatcaagtcttatcgtacttgggagtcggccat

SEQ ID NO: 370290 - DNA, 140 bp, Artificial Sequence
  Synthetic
atggccgactcccaagtacgataagacttgatcctgctgctacaacatctgggtcgctacttcttacatgtactgtaaattcatctggttcatttacatggattctaactttgcaggagaggagacccagcatggcgtat

SEQ ID NO: 370291 - DNA, 140 bp, Artificial Sequence
  Synthetic
aggccctggctgctgatatgcatgtaagaagtagcgacccagatgttgtagcagcaggatcaagtcttatggcaaggaaaatagagtttggggctgacagtacattcaaggccttttcatgaccttttgggacagcggtg

SEQ ID NO: 370292 - DNA, 140 bp, Artificial Sequence
  Synthetic
caccgctgtcccaaaaggtcatgaaaaggccttgaatgtactgtcagccccaaactctattttccttgccataagacttgatcctgctgctacaacatctgggtcgctacttcttacatgcatatcagcagccagggcct

SEQ ID NO: 370293 - DNA, 140 bp, Artificial Sequence
  Synthetic
atacgccatgctgggtctccagcagctgcaccgacgatgacacacaaaagtgtgtcaacacgaagcttgaccatccacagagcatactcattgagcacaaaggaacaataattggcaagccgtacttgggagtcggccat

SEQ ID NO: 370294 - DNA, 140 bp, Artificial Sequence
  Synthetic
atggccgactcccaagtacggcttgccaattattgttcctttgtgctcaatgagtatgctctgtggatggtcaagcttcgtgttgacacacttttgtgtgtcatcgtcggtgcagctgctggagacccagcatggcgtat

SEQ ID NO: 370295 - DNA, 140 bp, Artificial Sequence
  Synthetic
aggccctggctgctgatatgccatccacagagcatactcattgagcacaaaggaacaataattggcaagcaaaatgacacttgttcgaccaagacaagctgctggctagaatcagttaaggaccttttgggacagcggtg

SEQ ID NO: 370296 - DNA, 140 bp, Artificial Sequence
  Synthetic
caccgctgtcccaaaaggtccttaactgattctagccagcagcttgtcttggtcgaacaagtgtcattttgcttgccaattattgttcctttgtgctcaatgagtatgctctgtggatggcatatcagcagccagggcct

SEQ ID NO: 370297 - DNA, 140 bp, Artificial Sequence
  Synthetic
atacgccatgctgggtctccttttttaggcatcttcttattccttgctccttttgtgctactgatattttttttcttttttgggtggaggcttctgttttgtctcaaatgttgcagaagacgtacttgggagtcggccat

SEQ ID NO: 370298 - DNA, 140 bp, Artificial Sequence
  Synthetic
atggccgactcccaagtacgtcttctgcaacatttgagacaaaacagaagcctccacccaaaaaagaaaaaaaatatcagtagcacaaaaggagcaaggaataagaagatgcctaaaaaaggagacccagcatggcgtat

SEQ ID NO: 370299 - DNA, 140 bp, Artificial Sequence
  Synthetic
aggccctggctgctgatatgttttcttttttgggtggaggcttctgttttgtctcaaatgttgcagaagaactagaggactgttgaaatacaagcaccttaaggatgaagaggaggctgggaccttttgggacagcggtg

SEQ ID NO: 370300 - DNA, 140 bp, Artificial Sequence
  Synthetic
caccgctgtcccaaaaggtcccagcctcctcttcatccttaaggtgcttgtatttcaacagtcctctagttcttctgcaacatttgagacaaaacagaagcctccacccaaaaaagaaaacatatcagcagccagggcct

SEQ ID NO: 370301 - DNA, 140 bp, Artificial Sequence
  Synthetic
atacgccatgctgggtctcctgtttgatggtgaaaggcttgcagacaggaagattgctgagcttttttctactaaaattcacataggttaacaaaccaggcaaagctctagctgcagcagcgtacttgggagtcggccat

SEQ ID NO: 370302 - DNA, 140 bp, Artificial Sequence
  Synthetic
atggccgactcccaagtacgctgctgcagctagagctttgcctggtttgttaacctatgtgaattttagtagaaaaaagctcagcaatcttcctgtctgcaagcctttcaccatcaaacaggagacccagcatggcgtat

SEQ ID NO: 370303 - DNA, 140 bp, Artificial Sequence
  Synthetic
atacgccatgctgggtctccaatcatcacttcttttattgccttcctctctttttttacttctagttgattatgctgcctgacactactcctgccaaacttcatttagacttaaccttgacgtacttgggagtcggccat

SEQ ID NO: 370304 - DNA, 140 bp, Artificial Sequence
  Synthetic
atggccgactcccaagtacgtcaaggttaagtctaaatgaagtttggcaggagtagtgtcaggcagcataatcaactagaagtaaaaaaagagaggaaggcaataaaagaagtgatgattggagacccagcatggcgtat

SEQ ID NO: 370305 - DNA, 140 bp, Artificial Sequence
  Synthetic
atacgccatgctgggtctcctctcaaagatatcaatcccccctttacccacattgacacaggcagctccagtagtggttttcccttgtcaaaccatggacttcttgagaaaccttgactgcgtacttgggagtcggccat

SEQ ID NO: 370306 - DNA, 140 bp, Artificial Sequence
  Synthetic
atggccgactcccaagtacgcagtcaaggtttctcaagaagtccatggtttgacaagggaaaaccactactggagctgcctgtgtcaatgtgggtaaaggggggattgatatctttgagaggagacccagcatggcgtat

SEQ ID NO: 370307 - DNA, 140 bp, Artificial Sequence
  Synthetic
aggccctggctgctgatatggtagtggttttcccttgtcaaaccatggacttcttgagaaaccttgactggactcaggtgattgctggtcaatatgtgaccaaccccaggttcaatatctgaccttttgggacagcggtg

SEQ ID NO: 370308 - DNA, 140 bp, Artificial Sequence
  Synthetic
caccgctgtcccaaaaggtcagatattgaacctggggttggtcacatattgaccagcaatcacctgagtccagtcaaggtttctcaagaagtccatggtttgacaagggaaaaccactaccatatcagcagccagggcct

SEQ ID NO: 370309 - DNA, 140 bp, Artificial Sequence
  Synthetic
atacgccatgctgggtctccgactcaggtgattgctggtcaatatgtgaccaaccccaggttcaatatctctgattacttcgagattgtgcggcagcctggtgatgggaattgtttttatcgtacttgggagtcggccat

SEQ ID NO: 370310 - DNA, 140 bp, Artificial Sequence
  Synthetic
atggccgactcccaagtacgataaaaacaattcccatcaccaggctgccgcacaatctcgaagtaatcagagatattgaacctggggttggtcacatattgaccagcaatcacctgagtcggagacccagcatggcgtat

SEQ ID NO: 370311 - DNA, 140 bp, Artificial Sequence
  Synthetic
atacgccatgctgggtctcctaacattaaacatctaacagagttggcagcacgaaagtactaccaagaggagcctgaggctaagcttattggcctgagtttggaggattatcttaagaggcgtacttgggagtcggccat

SEQ ID NO: 370312 - DNA, 140 bp, Artificial Sequence
  Synthetic
atggccgactcccaagtacgcctcttaagataatcctccaaactcaggccaataagcttagcctcaggctcctcttggtagtactttcgtgctgccaactctgttagatgtttaatgttaggagacccagcatggcgtat

SEQ ID NO: 370313 - DNA, 140 bp, Artificial Sequence
  Synthetic
aggccctggctgctgatatgagcctgaggctaagcttattggcctgagtttggaggattatcttaagaggatgctatctgacaatgagtgggggtcaaccctcgaggcatccatgttggcgaccttttgggacagcggtg

SEQ ID NO: 370314 - DNA, 140 bp, Artificial Sequence
  Synthetic
caccgctgtcccaaaaggtcgccaacatggatgcctcgagggttgacccccactcattgtcagatagcatcctcttaagataatcctccaaactcaggccaataagcttagcctcaggctcatatcagcagccagggcct

SEQ ID NO: 370315 - DNA, 140 bp, Artificial Sequence
  Synthetic
atacgccatgctgggtctccaagtggaagcaggcataaagtttggagatggtgatgtatttacagctgtaaatcttctgcactctggacaaacacattttgatgctcttagaatactgcccgtacttgggagtcggccat

SEQ ID NO: 370316 - DNA, 140 bp, Artificial Sequence
  Synthetic
atggccgactcccaagtacgggcagtattctaagagcatcaaaatgtgtttgtccagagtgcagaagatttacagctgtaaatacatcaccatctccaaactttatgcctgcttccacttggagacccagcatggcgtat

SEQ ID NO: 370317 - DNA, 140 bp, Artificial Sequence
  Synthetic
aggccctggctgctgatatgaatcttctgcactctggacaaacacattttgatgctcttagaatactgccacagtttgaagcagacacaagggagaccttaagtttggtggataaggttagaccttttgggacagcggtg

SEQ ID NO: 370318 - DNA, 140 bp, Artificial Sequence
  Synthetic
caccgctgtcccaaaaggtctaaccttatccaccaaacttaaggtctcccttgtgtctgcttcaaactgtggcagtattctaagagcatcaaaatgtgtttgtccagagtgcagaagattcatatcagcagccagggcct

SEQ ID NO: 370319 - DNA, 140 bp, Artificial Sequence
  Synthetic
atacgccatgctgggtctccgaagaccttgcattagcactcacaagtgcagaagaaccatatagacgatcgagcctagatgaagtcactttgtctaagaaacaagcagagatgttgaggccgtacttgggagtcggccat

SEQ ID NO: 370320 - DNA, 140 bp, Artificial Sequence
  Synthetic
atggccgactcccaagtacggcctcaacatctctgcttgtttcttagacaaagtgacttcatctaggctcgatcgtctatatggttcttctgcacttgtgagtgctaatgcaaggtcttcggagacccagcatggcgtat

SEQ ID NO: 370321 - DNA, 140 bp, Artificial Sequence
  Synthetic
aggccctggctgctgatatggagcctagatgaagtcactttgtctaagaaacaagcagagatgttgaggcaaaaggcatctcagttgtctaaactggtcaacaaaagtcagaatataccagaccttttgggacagcggtg

SEQ ID NO: 370322 - DNA, 140 bp, Artificial Sequence
  Synthetic
caccgctgtcccaaaaggtctggtatattctgacttttgttgaccagtttagacaactgagatgccttttgcctcaacatctctgcttgtttcttagacaaagtgacttcatctaggctccatatcagcagccagggcct

SEQ ID NO: 370323 - DNA, 140 bp, Artificial Sequence
  Synthetic
atacgccatgctgggtctcctgagatatcagctgacactttaattctgcggcctgaatccaaagagagaatcggtgaagttatgtcgttgcggcagctagggcataagttgttgacacgacgtacttgggagtcggccat

SEQ ID NO: 370324 - DNA, 140 bp, Artificial Sequence
  Synthetic
atggccgactcccaagtacgtcgtgtcaacaacttatgccctagctgccgcaacgacataacttcaccgattctctctttggattcaggccgcagaattaaagtgtcagctgatatctcaggagacccagcatggcgtat

SEQ ID NO: 370325 - DNA, 140 bp, Artificial Sequence
  Synthetic
aggccctggctgctgatatgtcggtgaagttatgtcgttgcggcagctagggcataagttgttgacacgagacaaacagattaagcaggaattctctagaatgaaactctacgtcactaagaccttttgggacagcggtg

SEQ ID NO: 370326 - DNA, 140 bp, Artificial Sequence
  Synthetic
caccgctgtcccaaaaggtcttagtgacgtagagtttcattctagagaattcctgcttaatctgtttgtctcgtgtcaacaacttatgccctagctgccgcaacgacataacttcaccgacatatcagcagccagggcct

SEQ ID NO: 370327 - DNA, 140 bp, Artificial Sequence
  Synthetic
atacgccatgctgggtctccctggtacaggaatagaaaggcatatgcagctactacactccgagatgatactggacatctgtacggtgtcacttggtgtcatgctgtcaacattcttatacgtacttgggagtcggccat

SEQ ID NO: 370328 - DNA, 140 bp, Artificial Sequence
  Synthetic
atggccgactcccaagtacgtataagaatgttgacagcatgacaccaagtgacaccgtacagatgtccagtatcatctcggagtgtagtagctgcatatgcctttctattcctgtaccagggagacccagcatggcgtat

SEQ ID NO: 370329 - DNA, 140 bp, Artificial Sequence
  Synthetic
aggccctggctgctgatatgctggacatctgtacggtgtcacttggtgtcatgctgtcaacattcttatatggctccaacaataaaaacaagaagaagttcatcacaaattgtctgctcagaccttttgggacagcggtg

SEQ ID NO: 370330 - DNA, 140 bp, Artificial Sequence
  Synthetic
caccgctgtcccaaaaggtctgagcagacaatttgtgatgaacttcttcttgtttttattgttggagccatataagaatgttgacagcatgacaccaagtgacaccgtacagatgtccagcatatcagcagccagggcct

SEQ ID NO: 370331 - DNA, 140 bp, Artificial Sequence
  Synthetic
atacgccatgctgggtctccaatgagctgctgtacaaggcacccaggaaggccttagcaaccgtctgtagtgccttatttgggaagcagataaacaagctgcagaactgcttcagaaccacgtacttgggagtcggccat

SEQ ID NO: 370332 - DNA, 140 bp, Artificial Sequence
  Synthetic
atggccgactcccaagtacgtggttctgaagcagttctgcagcttgtttatctgcttcccaaataaggcactacagacggttgctaaggccttcctgggtgccttgtacagcagctcattggagacccagcatggcgtat

SEQ ID NO: 370333 - DNA, 140 bp, Artificial Sequence
  Synthetic
aggccctggctgctgatatgtgccttatttgggaagcagataaacaagctgcagaactgcttcagaaccataagccctgttagcttgcttgcattaaggaatttggacttcgattgtctcgaccttttgggacagcggtg

SEQ ID NO: 370334 - DNA, 140 bp, Artificial Sequence
  Synthetic
caccgctgtcccaaaaggtcgagacaatcgaagtccaaattccttaatgcaagcaagctaacagggcttatggttctgaagcagttctgcagcttgtttatctgcttcccaaataaggcacatatcagcagccagggcct

SEQ ID NO: 370335 - DNA, 140 bp, Artificial Sequence
  Synthetic
atacgccatgctgggtctcccactgatgttgaattcaaccacagggagatagctgatctcaatcaattaacttctcggcttattacattgaggaaagaaaaagacactgaccttctcaagcgtacttgggagtcggccat

SEQ ID NO: 370336 - DNA, 140 bp, Artificial Sequence
  Synthetic
atggccgactcccaagtacgcttgagaaggtcagtgtctttttctttcctcaatgtaataagccgagaagttaattgattgagatcagctatctccctgtggttgaattcaacatcagtgggagacccagcatggcgtat

SEQ ID NO: 370337 - DNA, 140 bp, Artificial Sequence
  Synthetic
aggccctggctgctgatatgcttctcggcttattacattgaggaaagaaaaagacactgaccttctcaagcaatggttttctgaaggtgatcttacccgcagaagtaccagaaacgttgcgaccttttgggacagcggtg

SEQ ID NO: 370338 - DNA, 140 bp, Artificial Sequence
  Synthetic
caccgctgtcccaaaaggtcgcaacgtttctggtacttctgcgggtaagatcaccttcagaaaaccattgcttgagaaggtcagtgtctttttctttcctcaatgtaataagccgagaagcatatcagcagccagggcct

SEQ ID NO: 370339 - DNA, 140 bp, Artificial Sequence
  Synthetic
atacgccatgctgggtctcctgaaattcattagcacctccggcagagcaatgagtgcaggcaagattggtaatgtcctttcctatgcacataatctttatctgagcaagtctagtctaaacgtacttgggagtcggccat

SEQ ID NO: 370340 - DNA, 140 bp, Artificial Sequence
  Synthetic
atggccgactcccaagtacgtttagactagacttgctcagataaagattatgtgcataggaaaggacattaccaatcttgcctgcactcattgctctgccggaggtgctaatgaatttcaggagacccagcatggcgtat

SEQ ID NO: 370341 - DNA, 140 bp, Artificial Sequence
  Synthetic
aggccctggctgctgatatgaatgtcctttcctatgcacataatctttatctgagcaagtctagtctaaatatgacttctgaagacatctcacagctcttgattgagatcaagagattgtgaccttttgggacagcggtg

SEQ ID NO: 370342 - DNA, 140 bp, Artificial Sequence
  Synthetic
caccgctgtcccaaaaggtcacaatctcttgatctcaatcaagagctgtgagatgtcttcagaagtcatatttagactagacttgctcagataaagattatgtgcataggaaaggacattcatatcagcagccagggcct

SEQ ID NO: 370343 - DNA, 140 bp, Artificial Sequence
  Synthetic
atacgccatgctgggtctccggcatagagggcaacatgaaacagttgttttctatattgcctccagattgtgcaagagagtgtgaggtcctctttgatgacataagaaattctccaacgccgtacttgggagtcggccat

SEQ ID NO: 370344 - DNA, 140 bp, Artificial Sequence
  Synthetic
atggccgactcccaagtacggcgttggagaatttcttatgtcatcaaagaggacctcacactctcttgcacaatctggaggcaatatagaaaacaactgtttcatgttgccctctatgccggagacccagcatggcgtat

SEQ ID NO: 370345 - DNA, 140 bp, Artificial Sequence
  Synthetic
aggccctggctgctgatatgtgcaagagagtgtgaggtcctctttgatgacataagaaattctccaacgcacagcacagcttggaagcatgctcttcgactgaaggggaccgcatacgaagaccttttgggacagcggtg

SEQ ID NO: 370346 - DNA, 140 bp, Artificial Sequence
  Synthetic
caccgctgtcccaaaaggtcttcgtatgcggtccccttcagtcgaagagcatgcttccaagctgtgctgtgcgttggagaatttcttatgtcatcaaagaggacctcacactctcttgcacatatcagcagccagggcct

SEQ ID NO: 370347 - DNA, 140 bp, Artificial Sequence
  Synthetic
atacgccatgctgggtctccaccaagtctgaccatgttgatacagactctgtttcctgacaagtttgaggacttcttggaccgaacccagttgcacccagagttcagagatctaactcctcgtacttgggagtcggccat

SEQ ID NO: 370348 - DNA, 140 bp, Artificial Sequence
  Synthetic
atggccgactcccaagtacgaggagttagatctctgaactctgggtgcaactgggttcggtccaagaagtcctcaaacttgtcaggaaacagagtctgtatcaacatggtcagacttggtggagacccagcatggcgtat

SEQ ID NO: 370349 - DNA, 140 bp, Artificial Sequence
  Synthetic
aggccctggctgctgatatgacttcttggaccgaacccagttgcacccagagttcagagatctaactcctgacttctcgcttacacaaaaggttcacttcaaaagaaaccagatacccaggaccttttgggacagcggtg

SEQ ID NO: 370350 - DNA, 140 bp, Artificial Sequence
  Synthetic
caccgctgtcccaaaaggtcctgggtatctggtttcttttgaagtgaaccttttgtgtaagcgagaagtcaggagttagatctctgaactctgggtgcaactgggttcggtccaagaagtcatatcagcagccagggcct

SEQ ID NO: 370351 - DNA, 140 bp, Artificial Sequence
  Synthetic
atacgccatgctgggtctccaggcagtgccagtgacagaaagaaagatgtttcctctacctgagactccactgaatgaagtgcattcaatagagcgtattatggaaaatttcacccgcctcgtacttgggagtcggccat

SEQ ID NO: 370352 - DNA, 140 bp, Artificial Sequence
  Synthetic
atggccgactcccaagtacgaggcgggtgaaattttccataatacgctctattgaatgcacttcattcagtggagtctcaggtagaggaaacatctttctttctgtcactggcactgcctggagacccagcatggcgtat

SEQ ID NO: 370353 - DNA, 140 bp, Artificial Sequence
  Synthetic
aggccctggctgctgatatgctgaatgaagtgcattcaatagagcgtattatggaaaatttcacccgcctcatgcatggaggaaagccctcagccacaaaaaaggatgaagatctgacaggaccttttgggacagcggtg

SEQ ID NO: 370354 - DNA, 140 bp, Artificial Sequence
  Synthetic
caccgctgtcccaaaaggtcctgtcagatcttcatccttttttgtggctgagggctttcctccatgcatgaggcgggtgaaattttccataatacgctctattgaatgcacttcattcagcatatcagcagccagggcct

SEQ ID NO: 370355 - DNA, 140 bp, Artificial Sequence
  Synthetic
atacgccatgctgggtctccgccttcaaggattatggagagagaggaatagttgaggggaatcacatgaggttcagtgaggaggatcaactggaaacaaggcagctgttgttggtggaagcgtacttgggagtcggccat

SEQ ID NO: 370356 - DNA, 140 bp, Artificial Sequence
  Synthetic
atggccgactcccaagtacgcttccaccaacaacagctgccttgtttccagttgatcctcctcactgaacctcatgtgattcccctcaactattcctctctctccataatccttgaaggcggagacccagcatggcgtat

SEQ ID NO: 370357 - DNA, 140 bp, Artificial Sequence
  Synthetic
aggccctggctgctgatatggttcagtgaggaggatcaactggaaacaaggcagctgttgttggtggaagttggttttcaaacagatatcgacgggaaaataaggacagatcacaaaaaagaccttttgggacagcggtg

SEQ ID NO: 370358 - DNA, 140 bp, Artificial Sequence
  Synthetic
caccgctgtcccaaaaggtcttttttgtgatctgtccttattttcccgtcgatatctgtttgaaaaccaacttccaccaacaacagctgccttgtttccagttgatcctcctcactgaaccatatcagcagccagggcct

SEQ ID NO: 370359 - DNA, 140 bp, Artificial Sequence
  Synthetic
atacgccatgctgggtctcctgtcgcctgtgcagactgctcatctacaccgccagacagatggtggataacggaggacagagtgcgagtcttaaagaactcagtcagcttcctcttcaaccgtacttgggagtcggccat

SEQ ID NO: 370360 - DNA, 140 bp, Artificial Sequence
  Synthetic
atggccgactcccaagtacggttgaagaggaagctgactgagttctttaagactcgcactctgtcctccgttatccaccatctgtctggcggtgtagatgagcagtctgcacaggcgacaggagacccagcatggcgtat

SEQ ID NO: 370361 - DNA, 140 bp, Artificial Sequence
  Synthetic
aggccctggctgctgatatgcggaggacagagtgcgagtcttaaagaactcagtcagcttcctcttcaacaaactctctagaaactcacctacagaggtgactgatattgttgttggagcgaccttttgggacagcggtg

SEQ ID NO: 370362 - DNA, 140 bp, Artificial Sequence
  Synthetic
caccgctgtcccaaaaggtcgctccaacaacaatatcagtcacctctgtaggtgagtttctagagagtttgttgaagaggaagctgactgagttctttaagactcgcactctgtcctccgcatatcagcagccagggcct

SEQ ID NO: 370363 - DNA, 140 bp, Artificial Sequence
  Synthetic
atacgccatgctgggtctccagacccctgtctcaactaaagatgttctagagacttgggaaaagatgaaagagcatatacttaacaggccaaccggattgacgctacccgctagtttggacgtacttgggagtcggccat

SEQ ID NO: 370364 - DNA, 140 bp, Artificial Sequence
  Synthetic
atggccgactcccaagtacgtccaaactagcgggtagcgtcaatccggttggcctgttaagtatatgctctttcatcttttcccaagtctctagaacatctttagttgagacaggggtctggagacccagcatggcgtat

SEQ ID NO: 370365 - DNA, 140 bp, Artificial Sequence
  Synthetic
aggccctggctgctgatatggagcatatacttaacaggccaaccggattgacgctacccgctagtttggaacaggcaatgcgcaaaggactagtcgaaggtgtagtcatctctaaggagggaccttttgggacagcggtg

SEQ ID NO: 370366 - DNA, 140 bp, Artificial Sequence
  Synthetic
caccgctgtcccaaaaggtccctccttagagatgactacaccttcgactagtcctttgcgcattgcctgttccaaactagcgggtagcgtcaatccggttggcctgttaagtatatgctccatatcagcagccagggcct

SEQ ID NO: 370367 - DNA, 140 bp, Artificial Sequence
  Synthetic
aggccctggctgctgatatggtaacactgcatcctaaaatagaggaaggtttttttgatttgatgcatgtacaaaaaatactgtctgcaagcacagtttgcaagctacagagctgcacacgaccttttgggacagcggtg

SEQ ID NO: 370368 - DNA, 140 bp, Artificial Sequence
  Synthetic
caccgctgtcccaaaaggtcgtgtgcagctctgtagcttgcaaactgtgcttgcagacagtattttttgtacatgcatcaaatcaaaaaaaccttcctctattttaggatgcagtgttaccatatcagcagccagggcct

SEQ ID NO: 370369 - DNA, 140 bp, Artificial Sequence
  Synthetic
atacgccatgctgggtctccgacgagttcgagcggacaaaatttaaacatgagcttacacagaatgttaccactagtgaaaagatgctgttgagctggttaagtgaagatattaagtcatcgtacttgggagtcggccat

SEQ ID NO: 370370 - DNA, 140 bp, Artificial Sequence
  Synthetic
atggccgactcccaagtacgatgacttaatatcttcacttaaccagctcaacagcatcttttcactagtggtaacattctgtgtaagctcatgtttaaattttgtccgctcgaactcgtcggagacccagcatggcgtat

SEQ ID NO: 370371 - DNA, 140 bp, Artificial Sequence
  Synthetic
aggccctggctgctgatatgcactagtgaaaagatgctgttgagctggttaagtgaagatattaagtcatcaaggtgtagtgaatgcctcgtcaacataaagaaaactgttgatgaaactgaccttttgggacagcggtg

SEQ ID NO: 370372 - DNA, 140 bp, Artificial Sequence
  Synthetic
caccgctgtcccaaaaggtcagtttcatcaacagttttctttatgttgacgaggcattcactacaccttgatgacttaatatcttcacttaaccagctcaacagcatcttttcactagtgcatatcagcagccagggcct

SEQ ID NO: 370373 - DNA, 140 bp, Artificial Sequence
  Synthetic
atacgccatgctgggtctccaagtcactgtggtaactgtcaccccaatggtgtaaacattagcaatacatccaatgtgtgcaagaggtgtcccaagatagaggtagttagtcattgtgaacgtacttgggagtcggccat

SEQ ID NO: 370374 - DNA, 140 bp, Artificial Sequence
  Synthetic
atggccgactcccaagtacgttcacaatgactaactacctctatcttgggacacctcttgcacacattggatgtattgctaatgtttacaccattggggtgacagttaccacagtgacttggagacccagcatggcgtat

SEQ ID NO: 370375 - DNA, 140 bp, Artificial Sequence
  Synthetic
aggccctggctgctgatatgccaatgtgtgcaagaggtgtcccaagatagaggtagttagtcattgtgaaaacaagggctttgaggacagcaatgaatgcttgaccgacctagacaggctgaccttttgggacagcggtg

SEQ ID NO: 370376 - DNA, 140 bp, Artificial Sequence
  Synthetic
caccgctgtcccaaaaggtcagcctgtctaggtcggtcaagcattcattgctgtcctcaaagcccttgttttcacaatgactaactacctctatcttgggacacctcttgcacacattggcatatcagcagccagggcct

SEQ ID NO: 370377 - DNA, 140 bp, Artificial Sequence
  Synthetic
atacgccatgctgggtctccgtaatgtggaatatctgataaaattgatgatgaacttgtcaggcatcgactgtataaagtatcccacaggccagcttatcacccatggaagagtgagtgccgtacttgggagtcggccat

SEQ ID NO: 370378 - DNA, 140 bp, Artificial Sequence
  Synthetic
atggccgactcccaagtacggcactcactcttccatgggtgataagctggcctgtgggatactttatacagtcgatgcctgacaagttcatcatcaattttatcagatattccacattacggagacccagcatggcgtat

SEQ ID NO: 370379 - DNA, 140 bp, Artificial Sequence
  Synthetic
aggccctggctgctgatatgtgtataaagtatcccacaggccagcttatcacccatggaagagtgagtgcaaaacataacgatgggaacttgaaggacaggagtgatgacgaccaaaaacgaccttttgggacagcggtg

SEQ ID NO: 370380 - DNA, 140 bp, Artificial Sequence
  Synthetic
caccgctgtcccaaaaggtcgtttttggtcgtcatcactcctgtccttcaagttcccatcgttatgttttgcactcactcttccatgggtgataagctggcctgtgggatactttatacacatatcagcagccagggcct

SEQ ID NO: 370381 - DNA, 140 bp, Artificial Sequence
  Synthetic
atacgccatgctgggtctccaaaacataacgatgggaacttgaaggacaggagtgatgacgaccaaaaactagcagagaagatagacattgttagaaaagagctttcagagaccaagctacgtacttgggagtcggccat

SEQ ID NO: 370382 - DNA, 140 bp, Artificial Sequence
  Synthetic
atggccgactcccaagtacgtagcttggtctctgaaagctcttttctaacaatgtctatcttctctgctagtttttggtcgtcatcactcctgtccttcaagttcccatcgttatgttttggagacccagcatggcgtat

SEQ ID NO: 370383 - DNA, 140 bp, Artificial Sequence
  Synthetic
atacgccatgctgggtctcctctctctaaacaggggaaatcgaagtgttctgtgccaaggtcttggctggaaaagatactgtttgacttaaaagtgcctactaaagatgaagaagtgctacgtacttgggagtcggccat

SEQ ID NO: 370384 - DNA, 140 bp, Artificial Sequence
  Synthetic
atggccgactcccaagtacgtagcacttcttcatctttagtaggcacttttaagtcaaacagtatcttttccagccaagaccttggcacagaacacttcgatttcccctgtttagagagaggagacccagcatggcgtat

SEQ ID NO: 370385 - DNA, 140 bp, Artificial Sequence
  Synthetic
aggccctggctgctgatatgaaaagatactgtttgacttaaaagtgcctactaaagatgaagaagtgctaataaacatcagaaattcattaaaggctaaatctgagtttgttagaaacaagaccttttgggacagcggtg

SEQ ID NO: 370386 - DNA, 140 bp, Artificial Sequence
  Synthetic
caccgctgtcccaaaaggtcttgtttctaacaaactcagatttagcctttaatgaatttctgatgtttattagcacttcttcatctttagtaggcacttttaagtcaaacagtatcttttcatatcagcagccagggcct

SEQ ID NO: 370387 - DNA, 140 bp, Artificial Sequence
  Synthetic
atacgccatgctgggtctcctgcagtcattcaaattgatgaaaaacaagcagcctgtgccttttcaagttgactgtatactatttaaagaagtagcagctgaatgcatgaaaaggtacatcgtacttgggagtcggccat

SEQ ID NO: 370388 - DNA, 140 bp, Artificial Sequence
  Synthetic
atggccgactcccaagtacgatgtaccttttcatgcattcagctgctacttctttaaatagtatacagtcaacttgaaaaggcacaggctgcttgtttttcatcaatttgaatgactgcaggagacccagcatggcgtat

SEQ ID NO: 370389 - DNA, 140 bp, Artificial Sequence
  Synthetic
atacgccatgctgggtctcctattaacaaggttcacttggtttcaagaggtagtgctttatggtaaaatatgtgaaacctttctgagatgctgtacagaatttaatagatcaggagttaacgtacttgggagtcggccat

SEQ ID NO: 370390 - DNA, 140 bp, Artificial Sequence
  Synthetic
atggccgactcccaagtacgttaactcctgatctattaaattctgtacagcatctcagaaaggtttcacatattttaccataaagcactacctcttgaaaccaagtgaaccttgttaataggagacccagcatggcgtat

SEQ ID NO: 370391 - DNA, 140 bp, Artificial Sequence
  Synthetic
atacgccatgctgggtctcccaaacaaaaaggaaaacatgttgtgttgtgtatacagtagcaacatggagctcttacaaggacctttctttttgaacagaaggcaagctgtccttggctccgtacttgggagtcggccat

SEQ ID NO: 370392 - DNA, 140 bp, Artificial Sequence
  Synthetic
atggccgactcccaagtacggagccaaggacagcttgccttctgttcaaaaagaaaggtccttgtaagagctccatgttgctactgtatacacaacacaacatgttttcctttttgtttgggagacccagcatggcgtat

SEQ ID NO: 370393 - DNA, 140 bp, Artificial Sequence
  Synthetic
aggccctggctgctgatatgctcttacaaggacctttctttttgaacagaaggcaagctgtccttggctcatcatacctttacattgtcattacactttacatacaagttttgcagcagtgaccttttgggacagcggtg

SEQ ID NO: 370394 - DNA, 140 bp, Artificial Sequence
  Synthetic
caccgctgtcccaaaaggtcactgctgcaaaacttgtatgtaaagtgtaatgacaatgtaaaggtatgatgagccaaggacagcttgccttctgttcaaaaagaaaggtccttgtaagagcatatcagcagccagggcct

SEQ ID NO: 370395 - DNA, 140 bp, Artificial Sequence
  Synthetic
atacgccatgctgggtctccattgagaaccactctatgactctgctagaagatgcattcaaagaacttacatttgctctcgaaggtagatttgaagaatcttacaaaatacggacctcaacgtacttgggagtcggccat

SEQ ID NO: 370396 - DNA, 140 bp, Artificial Sequence
  Synthetic
atggccgactcccaagtacgttgaggtccgtattttgtaagattcttcaaatctaccttcgagagcaaatgtaagttctttgaatgcatcttctagcagagtcatagagtggttctcaatggagacccagcatggcgtat

SEQ ID NO: 370397 - DNA, 140 bp, Artificial Sequence
  Synthetic
aggccctggctgctgatatgatttgctctcgaaggtagatttgaagaatcttacaaaatacggacctcaaggtgcaaggctagcggaaactttctaaacagaagcagcagagatcactttgaccttttgggacagcggtg

SEQ ID NO: 370398 - DNA, 140 bp, Artificial Sequence
  Synthetic
caccgctgtcccaaaaggtcaaagtgatctctgctgcttctgtttagaaagtttccgctagccttgcaccttgaggtccgtattttgtaagattcttcaaatctaccttcgagagcaaatcatatcagcagccagggcct

SEQ ID NO: 370399 - DNA, 140 bp, Artificial Sequence
  Synthetic
atacgccatgctgggtctcctaatttattggccaactcccaacaacagaataaacaactccaaatgctccgctttggcatgcttgcaggactcagtaggcttgtttgtcctaatgagctgcgtacttgggagtcggccat

SEQ ID NO: 370400 - DNA, 140 bp, Artificial Sequence
  Synthetic
atggccgactcccaagtacgcagctcattaggacaaacaagcctactgagtcctgcaagcatgccaaagcggagcatttggagttgtttattctgttgttgggagttggccaataaattaggagacccagcatggcgtat

SEQ ID NO: 370401 - DNA, 140 bp, Artificial Sequence
  Synthetic
atacgccatgctgggtctccactttacctacaggcttctatatactgctcagttagagatgtggaagataatattaagcactggaagcaaagagatctatgccctgaggtgaccattccacgtacttgggagtcggccat

SEQ ID NO: 370402 - DNA, 140 bp, Artificial Sequence
  Synthetic
atggccgactcccaagtacgtggaatggtcacctcagggcatagatctctttgcttccagtgcttaatattatcttccacatctctaactgagcagtatatagaagcctgtaggtaaagtggagacccagcatggcgtat

SEQ ID NO: 370403 - DNA, 140 bp, Artificial Sequence
  Synthetic
aggccctggctgctgatatgaaggatgtatcagcgtcttggaagaaacagcagaaaggcatatgctctgggaactcgatctgatgaactcactttgttctgacgagaggaaagatgctaggaccttttgggacagcggtg

SEQ ID NO: 370404 - DNA, 140 bp, Artificial Sequence
  Synthetic
caccgctgtcccaaaaggtcctagcatctttcctctcgtcagaacaaagtgagttcatcagatcgagttcccagagcatatgcctttctgctgtttcttccaagacgctgatacatccttcatatcagcagccagggcct

SEQ ID NO: 370405 - DNA, 140 bp, Artificial Sequence
  Synthetic
atacgccatgctgggtctccaagaagggaaaaagctattgaagctgaacagcgatacatccactgatacacagagcattgcttctgaagtatcagacaggaggtcctacagctcaagcaacgtacttgggagtcggccat

SEQ ID NO: 370406 - DNA, 140 bp, Artificial Sequence
  Synthetic
atggccgactcccaagtacgttgcttgagctgtaggacctcctgtctgatacttcagaagcaatgctctgtgtatcagtggatgtatcgctgttcagcttcaatagctttttcccttcttggagacccagcatggcgtat

SEQ ID NO: 370407 - DNA, 140 bp, Artificial Sequence
  Synthetic
aggccctggctgctgatatgcagagcattgcttctgaagtatcagacaggaggtcctacagctcaagcaaaagtaggatccgaagtattttcggaaggtacaattctcagaaaaagccatgaccttttgggacagcggtg

SEQ ID NO: 370408 - DNA, 140 bp, Artificial Sequence
  Synthetic
caccgctgtcccaaaaggtcatggctttttctgagaattgtaccttccgaaaatacttcggatcctacttttgcttgagctgtaggacctcctgtctgatacttcagaagcaatgctctgcatatcagcagccagggcct

SEQ ID NO: 370409 - DNA, 140 bp, Artificial Sequence
  Synthetic
atacgccatgctgggtctcccagcaggcaataacagacatctgccagttttctgagtatacaccaaacaaagaaagcattttgaaagactgccttcaaatcataagaaagaaccctagcccgtacttgggagtcggccat

SEQ ID NO: 370410 - DNA, 140 bp, Artificial Sequence
  Synthetic
atggccgactcccaagtacgggctagggttctttcttatgatttgaaggcagtctttcaaaatgctttctttgtttggtgtatactcagaaaactggcagatgtctgttattgcctgctgggagacccagcatggcgtat

SEQ ID NO: 370411 - DNA, 140 bp, Artificial Sequence
  Synthetic
aggccctggctgctgatatgagaaagcattttgaaagactgccttcaaatcataagaaagaaccctagccacacaatgggatcttttgagctgatccaggcaatttcagaattcggcatggaccttttgggacagcggtg

SEQ ID NO: 370412 - DNA, 140 bp, Artificial Sequence
  Synthetic
caccgctgtcccaaaaggtccatgccgaattctgaaattgcctggatcagctcaaaagatcccattgtgtggctagggttctttcttatgatttgaaggcagtctttcaaaatgctttctcatatcagcagccagggcct

SEQ ID NO: 370413 - DNA, 140 bp, Artificial Sequence
  Synthetic
atacgccatgctgggtctccctgggttagcatatctgaagtgacagaaacaacaagtatagttgcatcgcccaaaactcatatgatgctcaaggactgcttcaaaatcatactaggcactcgtacttgggagtcggccat

SEQ ID NO: 370414 - DNA, 140 bp, Artificial Sequence
  Synthetic
atggccgactcccaagtacgagtgcctagtatgattttgaagcagtccttgagcatcatatgagttttgggcgatgcaactatacttgttgtttctgtcacttcagatatgctaacccagggagacccagcatggcgtat

SEQ ID NO: 370415 - DNA, 140 bp, Artificial Sequence
  Synthetic
aggccctggctgctgatatgccaaaactcatatgatgctcaaggactgcttcaaaatcatactaggcactgagaataagaagatagtcaaaatgcttcgagggaagctaaaaaaactcgggaccttttgggacagcggtg

SEQ ID NO: 370416 - DNA, 140 bp, Artificial Sequence
  Synthetic
caccgctgtcccaaaaggtcccgagtttttttagcttccctcgaagcattttgactatcttcttattctcagtgcctagtatgattttgaagcagtccttgagcatcatatgagttttggcatatcagcagccagggcct

SEQ ID NO: 370417 - DNA, 140 bp, Artificial Sequence
  Synthetic
atacgccatgctgggtctccttagcactgtggatggtttaacagatcaacagaaagaaaacattgtaaacgggatatttgagccctcaaagttgtccttctaccattggaaagaattgatcgtacttgggagtcggccat

SEQ ID NO: 370418 - DNA, 140 bp, Artificial Sequence
  Synthetic
atggccgactcccaagtacgatcaattctttccaatggtagaaggacaactttgagggctcaaatatcccgtttacaatgttttctttctgttgatctgttaaaccatccacagtgctaaggagacccagcatggcgtat

SEQ ID NO: 370419 - DNA, 140 bp, Artificial Sequence
  Synthetic
aggccctggctgctgatatggggatatttgagccctcaaagttgtccttctaccattggaaagaattgatcaaaaaaaacattgacgaggtactacttactgaggatggaaatctgatctgaccttttgggacagcggtg

SEQ ID NO: 370420 - DNA, 140 bp, Artificial Sequence
  Synthetic
caccgctgtcccaaaaggtcagatcagatttccatcctcagtaagtagtacctcgtcaatgttttttttgatcaattctttccaatggtagaaggacaactttgagggctcaaatatccccatatcagcagccagggcct

SEQ ID NO: 370421 - DNA, 140 bp, Artificial Sequence
  Synthetic
atacgccatgctgggtctccgcagcataagtgacacaacagtgacttctcaagactcagggtcttctgcatcaagtttctctttcgagctgaaccggcccctgtctgaaacagagatacacgtacttgggagtcggccat

SEQ ID NO: 370422 - DNA, 140 bp, Artificial Sequence
  Synthetic
atggccgactcccaagtacgtgtatctctgtttcagacaggggccggttcagctcgaaagagaaacttgatgcagaagaccctgagtcttgagaagtcactgttgtgtcacttatgctgcggagacccagcatggcgtat

SEQ ID NO: 370423 - DNA, 140 bp, Artificial Sequence
  Synthetic
atacgccatgctgggtctccaggctcaagttcatgaatgtgcattctccagagctgatgccagaaaactgtctcttctctagtgaagaatttaatgagttgatcaagctaaaaaagcttccgtacttgggagtcggccat

SEQ ID NO: 370424 - DNA, 140 bp, Artificial Sequence
  Synthetic
atggccgactcccaagtacggaagcttttttagcttgatcaactcattaaattcttcactagagaagagacagttttctggcatcagctctggagaatgcacattcatgaacttgagcctggagacccagcatggcgtat

SEQ ID NO: 370425 - DNA, 140 bp, Artificial Sequence
  Synthetic
aggccctggctgctgatatgtctcttctctagtgaagaatttaatgagttgatcaagctaaaaaagcttctcctcaatgagcaacaggatgaacaggagctgaagcaagaccttttaatagaccttttgggacagcggtg

SEQ ID NO: 370426 - DNA, 140 bp, Artificial Sequence
  Synthetic
caccgctgtcccaaaaggtctattaaaaggtcttgcttcagctcctgttcatcctgttgctcattgaggagaagcttttttagcttgatcaactcattaaattcttcactagagaagagacatatcagcagccagggcct

SEQ ID NO: 370427 - DNA, 140 bp, Artificial Sequence
  Synthetic
atacgccatgctgggtctcctgataagatccagaaattcattcaccacctttctgaagaactgtatgacataaggctgcagcacctggaactgtcaaagcttaagcaagagcaccccagtcgtacttgggagtcggccat

SEQ ID NO: 370428 - DNA, 140 bp, Artificial Sequence
  Synthetic
atggccgactcccaagtacgactggggtgctcttgcttaagctttgacagttccaggtgctgcagccttatgtcatacagttcttcagaaaggtggtgaatgaatttctggatcttatcaggagacccagcatggcgtat

SEQ ID NO: 370429 - DNA, 140 bp, Artificial Sequence
  Synthetic
atacgccatgctgggtctcctcttaagcagcacaatccggaaattatggaaacagtaaatctcatattctttgctgctctttcagctccttggtgcttgcactacaaagcactagagtctcgtacttgggagtcggccat

SEQ ID NO: 370430 - DNA, 140 bp, Artificial Sequence
  Synthetic
atggccgactcccaagtacgagactctagtgctttgtagtgcaagcaccaaggagctgaaagagcagcaaagaatatgagatttactgtttccataatttccggattgtgctgcttaagaggagacccagcatggcgtat

SEQ ID NO: 370431 - DNA, 140 bp, Artificial Sequence
  Synthetic
atacgccatgctgggtctcctaagctcaccttgcttgatctgtcagtttctaaactcttagtctgtttgtatcgaaataacgatgaagagctaacaaatagctcaagtttgaaacttggtcgtacttgggagtcggccat

SEQ ID NO: 370432 - DNA, 140 bp, Artificial Sequence
  Synthetic
atggccgactcccaagtacgaccaagtttcaaacttgagctatttgttagctcttcatcgttatttcgatacaaacagactaagagtttagaaactgacagatcaagcaaggtgagcttaggagacccagcatggcgtat

SEQ ID NO: 370433 - DNA, 140 bp, Artificial Sequence
  Synthetic
aggccctggctgctgatatgatcgaaataacgatgaagagctaacaaatagctcaagtttgaaacttggttttttggtaaagtatgctgtcaccttattcacatccaatggtgagcctttgaccttttgggacagcggtg

SEQ ID NO: 370434 - DNA, 140 bp, Artificial Sequence
  Synthetic
caccgctgtcccaaaaggtcaaaggctcaccattggatgtgaataaggtgacagcatactttaccaaaaaaccaagtttcaaacttgagctatttgttagctcttcatcgttatttcgatcatatcagcagccagggcct

SEQ ID NO: 370435 - DNA, 140 bp, Artificial Sequence
  Synthetic
atacgccatgctgggtctccctgatgaaaagctgctacatcaaacaaagatagtatttgctaaaattggtctatccggaaatagttatgacttcatctggaccacccaaatgatagcaaacgtacttgggagtcggccat

SEQ ID NO: 370436 - DNA, 140 bp, Artificial Sequence
  Synthetic
atggccgactcccaagtacgtttgctatcatttgggtggtccagatgaagtcataactatttccggatagaccaattttagcaaatactatctttgtttgatgtagcagcttttcatcagggagacccagcatggcgtat

SEQ ID NO: 370437 - DNA, 140 bp, Artificial Sequence
  Synthetic
aggccctggctgctgatatgctatccggaaatagttatgacttcatctggaccacccaaatgatagcaaatagcaacttcaacgtctgcaaaaggttgactggaaggagcaccggagaaagaccttttgggacagcggtg

SEQ ID NO: 370438 - DNA, 140 bp, Artificial Sequence
  Synthetic
caccgctgtcccaaaaggtctttctccggtgctccttccagtcaaccttttgcagacgttgaagttgctatttgctatcatttgggtggtccagatgaagtcataactatttccggatagcatatcagcagccagggcct

SEQ ID NO: 370439 - DNA, 140 bp, Artificial Sequence
  Synthetic
atacgccatgctgggtctccgtaggagaaacaggcatggcaatactgcaacaattagcctttgcacaggcgctaaattatgaacaccgcttctatgcagttttagcacctaaagcacagccgtacttgggagtcggccat

SEQ ID NO: 370440 - DNA, 140 bp, Artificial Sequence
  Synthetic
atggccgactcccaagtacggctgtgctttaggtgctaaaactgcatagaagcggtgttcataatttagcgcctgtgcaaaggctaattgttgcagtattgccatgcctgtttctcctacggagacccagcatggcgtat

SEQ ID NO: 370441 - DNA, 140 bp, Artificial Sequence
  Synthetic
aggccctggctgctgatatggctaaattatgaacaccgcttctatgcagttttagcacctaaagcacagcttggaggagcaagagatctgttggtgcaagagactgggaccaaagtcatggaccttttgggacagcggtg

SEQ ID NO: 370442 - DNA, 140 bp, Artificial Sequence
  Synthetic
caccgctgtcccaaaaggtccatgactttggtcccagtctcttgcaccaacagatctcttgctcctccaagctgtgctttaggtgctaaaactgcatagaagcggtgttcataatttagccatatcagcagccagggcct

SEQ ID NO: 370443 - DNA, 140 bp, Artificial Sequence
  Synthetic
atacgccatgctgggtctccacccagatgatgcagcccagggatctggacacaccaagtccattctaaatctaaggacaaacactgagtccaacaatccgtgtgccaggaccattgtcaacgtacttgggagtcggccat

SEQ ID NO: 370444 - DNA, 140 bp, Artificial Sequence
  Synthetic
atggccgactcccaagtacgttgacaatggtcctggcacacggattgttggactcagtgtttgtccttagatttagaatggacttggtgtgtccagatccctgggctgcatcatctgggtggagacccagcatggcgtat

SEQ ID NO: 370445 - DNA, 140 bp, Artificial Sequence
  Synthetic
atacgccatgctgggtctcctgatggcctaacaaacccgcatcttaaggagacaatccttaacgtaggtttggactgtctcactaacatgcgaaacctcgatggaaaacccataagtgagcgtacttgggagtcggccat

SEQ ID NO: 370446 - DNA, 140 bp, Artificial Sequence
  Synthetic
atggccgactcccaagtacgctcacttatgggttttccatcgaggtttcgcatgttagtgagacagtccaaacctacgttaaggattgtctccttaagatgcgggtttgttaggccatcaggagacccagcatggcgtat

SEQ ID NO: 370447 - DNA, 140 bp, Artificial Sequence
  Synthetic
aggccctggctgctgatatgtggactgtctcactaacatgcgaaacctcgatggaaaacccataagtgagggtagcaacttggtcaatttctacaaagttatttgcatctcgggtgataagaccttttgggacagcggtg

SEQ ID NO: 370448 - DNA, 140 bp, Artificial Sequence
  Synthetic
caccgctgtcccaaaaggtcttatcacccgagatgcaaataactttgtagaaattgaccaagttgctaccctcacttatgggttttccatcgaggtttcgcatgttagtgagacagtccacatatcagcagccagggcct

SEQ ID NO: 370449 - DNA, 140 bp, Artificial Sequence
  Synthetic
atacgccatgctgggtctccagcaggttctaaaaagtgttccagactggtgtgcattctacaaattaacattcatcaagaacttatgtaggcaggtagaaatacctgccggcagcattaacgtacttgggagtcggccat

SEQ ID NO: 370450 - DNA, 140 bp, Artificial Sequence
  Synthetic
atggccgactcccaagtacgttaatgctgccggcaggtatttctacctgcctacataagttcttgatgaatgttaatttgtagaatgcacaccagtctggaacactttttagaacctgctggagacccagcatggcgtat

SEQ ID NO: 370451 - DNA, 140 bp, Artificial Sequence
  Synthetic
atacgccatgctgggtctccatgaataaccaacggaaaaaggcgagaaacacgcctttcaatatgctgaaacgcgagagaaaccgcgtgtcaacaatacaacagttgacgaagagattctcgtacttgggagtcggccat

SEQ ID NO: 370452 - DNA, 140 bp, Artificial Sequence
  Synthetic
atggccgactcccaagtacgagaatctcttcgtcaactgttgtattgttgacacgcggtttctctcgcgtttcagcatattgaaaggcgtgtttctcgcctttttccgttggttattcatggagacccagcatggcgtat

SEQ ID NO: 370453 - DNA, 140 bp, Artificial Sequence
  Synthetic
aggccctggctgctgatatgacgcgagagaaaccgcgtgtcaacaatacaacagttgacgaagagattctcacttggaatgctgcaagggagagggccattaaaactatttatggccctagaccttttgggacagcggtg

SEQ ID NO: 370454 - DNA, 140 bp, Artificial Sequence
  Synthetic
caccgctgtcccaaaaggtctagggccataaatagttttaatggccctctcccttgcagcattccaagtgagaatctcttcgtcaactgttgtattgttgacacgcggtttctctcgcgtcatatcagcagccagggcct

SEQ ID NO: 370455 - DNA, 140 bp, Artificial Sequence
  Synthetic
atacgccatgctgggtctcccacttggaatgctgcaagggagagggccattaaaactatttatggccctagtggcgttccttcgtttcctaaccatcccaccaacagcagggatactggacgtacttgggagtcggccat

SEQ ID NO: 370456 - DNA, 140 bp, Artificial Sequence
  Synthetic
atggccgactcccaagtacgtccagtatccctgctgttggtgggatggttaggaaacgaaggaacgccactagggccataaatagttttaatggccctctcccttgcagcattccaagtgggagacccagcatggcgtat

SEQ ID NO: 370457 - DNA, 140 bp, Artificial Sequence
  Synthetic
atacgccatgctgggtctccaagatggggaacgatcaaaaaatcaaaggctatcagtgtactgagaggatttagaaaggaaattgggaggatgctgaacattttgaataggagacgcagacgtacttgggagtcggccat

SEQ ID NO: 370458 - DNA, 140 bp, Artificial Sequence
  Synthetic
atggccgactcccaagtacgtctgcgtctcctattcaaaatgttcagcatcctcccaatttcctttctaaatcctctcagtacactgatagcctttgattttttgatcgttccccatcttggagacccagcatggcgtat

SEQ ID NO: 370459 - DNA, 140 bp, Artificial Sequence
  Synthetic
aggccctggctgctgatatgttagaaaggaaattgggaggatgctgaacattttgaataggagacgcagaacagcgggcttccttatcatggtcattccaacagtgatggctttccatttgaccttttgggacagcggtg

SEQ ID NO: 370460 - DNA, 140 bp, Artificial Sequence
  Synthetic
caccgctgtcccaaaaggtcaaatggaaagccatcactgttggaatgaccatgataaggaagcccgctgttctgcgtctcctattcaaaatgttcagcatcctcccaatttcctttctaacatatcagcagccagggcct

SEQ ID NO: 370461 - DNA, 140 bp, Artificial Sequence
  Synthetic
atacgccatgctgggtctcccaacaacgttacaactgccagaggacattgaacaaatggcaaatggaatcgctctggggctcatggctcttaaactgataacacaatttgaaacataccacgtacttgggagtcggccat

SEQ ID NO: 370462 - DNA, 140 bp, Artificial Sequence
  Synthetic
atggccgactcccaagtacgtggtatgtttcaaattgtgttatcagtttaagagccatgagccccagagcgattccatttgccatttgttcaatgtcctctggcagttgtaacgttgttgggagacccagcatggcgtat

SEQ ID NO: 370463 - DNA, 140 bp, Artificial Sequence
  Synthetic
atacgccatgctgggtctccgaccacacgcaacggggagccacacatgattgtcagcaagaatgagaaaggaaagggcctcctttttaaaacagagaatggaataaacatgtgcacccttcgtacttgggagtcggccat

SEQ ID NO: 370464 - DNA, 140 bp, Artificial Sequence
  Synthetic
atggccgactcccaagtacgaagggtgcacatgtttattccattctctgttttaaaaaggaggccctttcctttctcattcttgctgacaatcatgtgtggctccccgttgcgtgtggtcggagacccagcatggcgtat

SEQ ID NO: 370465 - DNA, 140 bp, Artificial Sequence
  Synthetic
aggccctggctgctgatatggaaagggcctcctttttaaaacagagaatggaataaacatgtgcacccttatggccatggacttaggcgagttgtgtgaggacaccgtcacatacaagtggaccttttgggacagcggtg

SEQ ID NO: 370466 - DNA, 140 bp, Artificial Sequence
  Synthetic
caccgctgtcccaaaaggtccacttgtatgtgacggtgtcctcacacaactcgcctaagtccatggccataagggtgcacatgtttattccattctctgttttaaaaaggaggccctttccatatcagcagccagggcct

SEQ ID NO: 370467 - DNA, 140 bp, Artificial Sequence
  Synthetic
atacgccatgctgggtctccccccttcctcaagcaaaacgagccggaggatatagactgctggtgcaattccacatcaacctgggtgacgtacgggacgtgcagctcgacaggagagcatcgtacttgggagtcggccat

SEQ ID NO: 370468 - DNA, 140 bp, Artificial Sequence
  Synthetic
atggccgactcccaagtacgatgctctcctgtcgagctgcacgtcccgtacgtcacccaggttgatgtggaattgcaccagcagtctatatcctccggctcgttttgcttgaggaaggggggagacccagcatggcgtat

SEQ ID NO: 370469 - DNA, 140 bp, Artificial Sequence
  Synthetic
atacgccatgctgggtctccagaggactgttgggtaggtcccaggtaggagtgggagtttttcaagacggcgtgttccatacaatgtggcatgtcaccaggggggccgtcctcatgtacccgtacttgggagtcggccat

SEQ ID NO: 370470 - DNA, 140 bp, Artificial Sequence
  Synthetic
atggccgactcccaagtacgggtacatgaggacggcccccctggtgacatgccacattgtatggaacacgccgtcttgaaaaactcccactcctacctgggacctacccaacagtcctctggagacccagcatggcgtat

SEQ ID NO: 370471 - DNA, 140 bp, Artificial Sequence
  Synthetic
atacgccatgctgggtctccggaaacgagaactgaaacatggatgtcatcagaaggagcatggaaacaagcccagcggattgagacatggattctgaggcacccaggcttcactcttatgcgtacttgggagtcggccat

SEQ ID NO: 370472 - DNA, 140 bp, Artificial Sequence
  Synthetic
atggccgactcccaagtacgcataagagtgaagcctgggtgcctcagaatccatgtctcaatccgctgggcttgtttccatgctccttctgatgacatccatgtttcagttctcgtttccggagacccagcatggcgtat

SEQ ID NO: 370473 - DNA, 140 bp, Artificial Sequence
  Synthetic
aggccctggctgctgatatgcccagcggattgagacatggattctgaggcacccaggcttcactcttatggcagctgtcttggcgtacacaatagggacaacacatttccaaagagccctgaccttttgggacagcggtg

SEQ ID NO: 370474 - DNA, 140 bp, Artificial Sequence
  Synthetic
caccgctgtcccaaaaggtcagggctctttggaaatgtgttgtccctattgtgtacgccaagacagctgccataagagtgaagcctgggtgcctcagaatccatgtctcaatccgctgggcatatcagcagccagggcct

SEQ ID NO: 370475 - DNA, 140 bp, Artificial Sequence
  Synthetic
atacgccatgctgggtctcctcataactggcacgtcagcagacctcaccgtagaaaaagcagcagatataacatgggaggaagaggctgagcaaacaggagtgtcccacaacttaatgatcgtacttgggagtcggccat

SEQ ID NO: 370476 - DNA, 140 bp, Artificial Sequence
  Synthetic
atggccgactcccaagtacgatcattaagttgtgggacactcctgtttgctcagcctcttcctcccatgttatatctgctgctttttctacggtgaggtctgctgacgtgccagttatgaggagacccagcatggcgtat

SEQ ID NO: 370477 - DNA, 140 bp, Artificial Sequence
  Synthetic
atacgccatgctgggtctccaatctttatccttttaacagctgttgctccctcgatgacaatgcgatgtataggcatatcaaatcgagacttcgtggagggagtttcaggaggaagctggcgtacttgggagtcggccat

SEQ ID NO: 370478 - DNA, 140 bp, Artificial Sequence
  Synthetic
atggccgactcccaagtacgccagcttcctcctgaaactccctccacgaagtctcgatttgatatgcctatacatcgcattgtcatcgagggagcaacagctgttaaaaggataaagattggagacccagcatggcgtat

SEQ ID NO: 370479 - DNA, 140 bp, Artificial Sequence
  Synthetic
aggccctggctgctgatatgtaggcatatcaaatcgagacttcgtggagggagtttcaggaggaagctgggttgatatcgtcttagaacacggaagctgcgtcacaacaatggccaagaagaccttttgggacagcggtg

SEQ ID NO: 370480 - DNA, 140 bp, Artificial Sequence
  Synthetic
caccgctgtcccaaaaggtcttcttggccattgttgtgacgcagcttccgtgttctaagacgatatcaacccagcttcctcctgaaactccctccacgaagtctcgatttgatatgcctacatatcagcagccagggcct

SEQ ID NO: 370481 - DNA, 140 bp, Artificial Sequence
  Synthetic
atacgccatgctgggtctcccaaaccaacattagactttgaactaataaaaacagaggccaagcaaccagcaacattgagaaaattctgcatagaagccaaattgaccaacacaacaacacgtacttgggagtcggccat

SEQ ID NO: 370482 - DNA, 140 bp, Artificial Sequence
  Synthetic
atggccgactcccaagtacgtgttgttgtgttggtcaatttggcttctatgcagaattttctcaatgttgctggttgcttggcctctgtttttattagttcaaagtctaatgttggtttgggagacccagcatggcgtat

SEQ ID NO: 370483 - DNA, 140 bp, Artificial Sequence
  Synthetic
aggccctggctgctgatatgcaacattgagaaaattctgcatagaagccaaattgaccaacacaacaacagaatctcgctgcccaacccaaggtgaacccagcctagtagaggagcaggagaccttttgggacagcggtg

SEQ ID NO: 370484 - DNA, 140 bp, Artificial Sequence
  Synthetic
caccgctgtcccaaaaggtctcctgctcctctactaggctgggttcaccttgggttgggcagcgagattctgttgttgtgttggtcaatttggcttctatgcagaattttctcaatgttgcatatcagcagccagggcct

SEQ ID NO: 370485 - DNA, 140 bp, Artificial Sequence
  Synthetic
atacgccatgctgggtctccgaaccagggaaaaatcccaaacatgtccaaacgaaacctggccttttcaagaccctaactggagaaattggagcagtaacattagatttcaaacccggaacgtacttgggagtcggccat

SEQ ID NO: 370486 - DNA, 140 bp, Artificial Sequence
  Synthetic
atggccgactcccaagtacgttccgggtttgaaatctaatgttactgctccaatttctccagttagggtcttgaaaaggccaggtttcgtttggacatgtttgggatttttccctggttcggagacccagcatggcgtat

SEQ ID NO: 370487 - DNA, 140 bp, Artificial Sequence
  Synthetic
aggccctggctgctgatatggatgtggtctgtttgggaaaggaggtattgtgacctgtgcgatgttcacatgcttgaagaaaatggagggaaaagttgtgcagccagaaaacctagagtagaccttttgggacagcggtg

SEQ ID NO: 370488 - DNA, 140 bp, Artificial Sequence
  Synthetic
caccgctgtcccaaaaggtctactctaggttttctggctgcacaacttttccctccattttcttcaagcatgtgaacatcgcacaggtcacaatacctcctttcccaaacagaccacatccatatcagcagccagggcct

SEQ ID NO: 370489 - DNA, 140 bp, Artificial Sequence
  Synthetic
atacgccatgctgggtctcccaccatagtcataacaccccattcaggagaggaacatgctgtggggaatgatacagggaagcacggtaaggaggttaagataacacctcaaagctctattcgtacttgggagtcggccat

SEQ ID NO: 370490 - DNA, 140 bp, Artificial Sequence
  Synthetic
atggccgactcccaagtacgaatagagctttgaggtgttatcttaacctccttaccgtgcttccctgtatcattccccacagcatgttcctctcctgaatggggtgttatgactatggtgggagacccagcatggcgtat

SEQ ID NO: 370491 - DNA, 140 bp, Artificial Sequence
  Synthetic
aggccctggctgctgatatgatacagggaagcacggtaaggaggttaagataacacctcaaagctctatttctgaaactgaactgacagattatggcacgatcacgatggaatgctccccgaccttttgggacagcggtg

SEQ ID NO: 370492 - DNA, 140 bp, Artificial Sequence
  Synthetic
caccgctgtcccaaaaggtcggggagcattccatcgtgatcgtgccataatctgtcagttcagtttcagaaatagagctttgaggtgttatcttaacctccttaccgtgcttccctgtatcatatcagcagccagggcct

SEQ ID NO: 370493 - DNA, 140 bp, Artificial Sequence
  Synthetic
atacgccatgctgggtctccaactttgattttggctcccacgagagtagtggcggccgagatggaagaggccctacgtggactgccaatccgttaccaaaccccagctgtgaaatcagaacgtacttgggagtcggccat

SEQ ID NO: 370494 - DNA, 140 bp, Artificial Sequence
  Synthetic
atggccgactcccaagtacgttctgatttcacagctggggtttggtaacggattggcagtccacgtagggcctcttccatctcggccgccactactctcgtgggagccaaaatcaaagttggagacccagcatggcgtat

SEQ ID NO: 370495 - DNA, 140 bp, Artificial Sequence
  Synthetic
aggccctggctgctgatatgaagcttggctagtccatagacagtggtttctggacttacctctaccatggcttcctggagcagacacacaagggtccaattggatccagaaagagatgctgaccttttgggacagcggtg

SEQ ID NO: 370496 - DNA, 140 bp, Artificial Sequence
  Synthetic
caccgctgtcccaaaaggtcagcatctctttctggatccaattggacccttgtgtgtctgctccaggaagccatggtagaggtaagtccagaaaccactgtctatggactagccaagcttcatatcagcagccagggcct

SEQ ID NO: 370497 - DNA, 140 bp, Artificial Sequence
  Synthetic
aggccctggctgctgatatggaagaagagatgttcaaaaagcgaaatctaaccataatggatcttcatcctgggtcaggaaagacacggaaataccttccagctattgttagagaggcaagaccttttgggacagcggtg

SEQ ID NO: 370498 - DNA, 140 bp, Artificial Sequence
  Synthetic
caccgctgtcccaaaaggtcttgcctctctaacaatagctggaaggtatttccgtgtctttcctgacccaggatgaagatccattatggttagatttcgctttttgaacatctcttcttccatatcagcagccagggcct

SEQ ID NO: 370499 - DNA, 140 bp, Artificial Sequence
  Synthetic
atacgccatgctgggtctccagtaacattcaaaaatccccatgcgaaaagacaggacgttgtcgtcttaggatcacaagagggcgctatgcacacagcactcacaggagcaacagaaattcgtacttgggagtcggccat

SEQ ID NO: 370500 - DNA, 140 bp, Artificial Sequence
  Synthetic
atggccgactcccaagtacgaatttctgttgctcctgtgagtgctgtgtgcatagcgccctcttgtgatcctaagacgacaacgtcctgtcttttcgcatggggatttttgaatgttactggagacccagcatggcgtat

SEQ ID NO: 370501 - DNA, 140 bp, Artificial Sequence
  Synthetic
aggccctggctgctgatatggatcacaagagggcgctatgcacacagcactcacaggagcaacagaaattcaaatgtcattaggaaatatactattcatggggcatttgaagtgtagactgaccttttgggacagcggtg

SEQ ID NO: 370502 - DNA, 140 bp, Artificial Sequence
  Synthetic
caccgctgtcccaaaaggtcagtctacacttcaaatgccccatgaatagtatatttcctaatgacatttgaatttctgttgctcctgtgagtgctgtgtgcatagcgccctcttgtgatccatatcagcagccagggcct

SEQ ID NO: 370503 - DNA, 140 bp, Artificial Sequence
  Synthetic
atacgccatgctgggtctccgaggatggacaagctgcaactcaaagggatgtcatactccatgtgtacaggaaagtttaaagttgtcaaagagatagcggaaacacaacatggaacgatacgtacttgggagtcggccat

SEQ ID NO: 370504 - DNA, 140 bp, Artificial Sequence
  Synthetic
atggccgactcccaagtacgtatcgttccatgttgtgtttccgctatctctttgacaactttaaactttcctgtacacatggagtatgacatccctttgagttgcagcttgtccatcctcggagacccagcatggcgtat

SEQ ID NO: 370505 - DNA, 140 bp, Artificial Sequence
  Synthetic
aggccctggctgctgatatggaaagtttaaagttgtcaaagagatagcggaaacacaacatggaacgatagtcatcagagtgcagtatgaaggagatgactcaccatgtaagattcccttgaccttttgggacagcggtg

SEQ ID NO: 370506 - DNA, 140 bp, Artificial Sequence
  Synthetic
caccgctgtcccaaaaggtcaagggaatcttacatggtgagtcatctccttcatactgcactctgatgactatcgttccatgttgtgtttccgctatctctttgacaactttaaactttccatatcagcagccagggcct

SEQ ID NO: 370507 - DNA, 140 bp, Artificial Sequence
  Synthetic
atacgccatgctgggtctccaacttgataataatggatgaagcccatttcacagacccagccagtatagcggctagagggtacatatcgactcgtgttggaatgggagaggcagccgcaacgtacttgggagtcggccat

SEQ ID NO: 370508 - DNA, 140 bp, Artificial Sequence
  Synthetic
atggccgactcccaagtacgttgcggctgcctctcccattccaacacgagtcgatatgtaccctctagccgctatactggctgggtctgtgaaatgggcttcatccattattatcaagttggagacccagcatggcgtat

SEQ ID NO: 370509 - DNA, 140 bp, Artificial Sequence
  Synthetic
atacgccatgctgggtctcctgagatcatggacttggaaaagaaacatgttttagggcgactgatcacggtcaacccaatagtgacagagaaagacagtccaatcaacatagaagcagaacgtacttgggagtcggccat

SEQ ID NO: 370510 - DNA, 140 bp, Artificial Sequence
  Synthetic
atggccgactcccaagtacgttctgcttctatgttgattggactgtctttctctgtcactattgggttgaccgtgatcagtcgccctaaaacatgtttcttttccaagtccatgatctcaggagacccagcatggcgtat

SEQ ID NO: 370511 - DNA, 140 bp, Artificial Sequence
  Synthetic
aggccctggctgctgatatgtcaacccaatagtgacagagaaagacagtccaatcaacatagaagcagaacctccattcggtgatagctacattgtcataggagtggagccaggacagctgaccttttgggacagcggtg

SEQ ID NO: 370512 - DNA, 140 bp, Artificial Sequence
  Synthetic
caccgctgtcccaaaaggtcagctgtcctggctccactcctatgacaatgtagctatcaccgaatggaggttctgcttctatgttgattggactgtctttctctgtcactattgggttgacatatcagcagccagggcct

SEQ ID NO: 370513 - DNA, 140 bp, Artificial Sequence
  Synthetic
atacgccatgctgggtctccgaaattaaactggtttaaaaagggaagctctataggacaaatgtttgaaacaacaatgagaggagctaaaagaatggccatcttgggagacacagcttggcgtacttgggagtcggccat

SEQ ID NO: 370514 - DNA, 140 bp, Artificial Sequence
  Synthetic
atggccgactcccaagtacgccaagctgtgtctcccaagatggccattcttttagctcctctcattgttgtttcaaacatttgtcctatagagcttccctttttaaaccagtttaatttcggagacccagcatggcgtat

SEQ ID NO: 370515 - DNA, 140 bp, Artificial Sequence
  Synthetic
aggccctggctgctgatatgcaacaatgagaggagctaaaagaatggccatcttgggagacacagcttgggattttggatccatagggggagtgttcacatcagtaggaaaagcactacagaccttttgggacagcggtg

SEQ ID NO: 370516 - DNA, 140 bp, Artificial Sequence
  Synthetic
caccgctgtcccaaaaggtctgtagtgcttttcctactgatgtgaacactccccctatggatccaaaatcccaagctgtgtctcccaagatggccattcttttagctcctctcattgttgcatatcagcagccagggcct

SEQ ID NO: 370517 - DNA, 140 bp, Artificial Sequence
  Synthetic
atacgccatgctgggtctccagtttggctatcttacaaagttgcctcagaaggcttccagtactccgacagaagatggtgctttgacggggaaaggaacaaccaggtgttggaggagaaccgtacttgggagtcggccat

SEQ ID NO: 370518 - DNA, 140 bp, Artificial Sequence
  Synthetic
atggccgactcccaagtacggttctcctccaacacctggttgttcctttccccgtcaaagcaccatcttctgtcggagtactggaagccttctgaggcaactttgtaagatagccaaactggagacccagcatggcgtat

SEQ ID NO: 370519 - DNA, 140 bp, Artificial Sequence
  Synthetic
aggccctggctgctgatatgatcatgcccactggacagaagcaaagatgctgcttgacaatatctacaccccagaagggatcattccaacattgtttggtccggaaagggaaaaaacccagaccttttgggacagcggtg

SEQ ID NO: 370520 - DNA, 140 bp, Artificial Sequence
  Synthetic
caccgctgtcccaaaaggtctgggttttttccctttccggaccaaacaatgttggaatgatcccttctggggtgtagatattgtcaagcagcatctttgcttctgtccagtgggcatgatcatatcagcagccagggcct

SEQ ID NO: 370521 - DNA, 140 bp, Artificial Sequence
  Synthetic
aggccctggctgctgatatgccatgaagatcctcataggggtggttataacatggataggaatgaactcccgcagcacttccttgtcagtgaccctggtgttagtaggaatcgtgacactgaccttttgggacagcggtg

SEQ ID NO: 370522 - DNA, 140 bp, Artificial Sequence
  Synthetic
caccgctgtcccaaaaggtcagtgtcacgattcctactaacaccagggtcactgacaaggaagtgctgcgggagttcattcctatccatgttataaccacccctatgaggatcttcatggcatatcagcagccagggcct

SEQ ID NO: 370523 - DNA, 140 bp, Artificial Sequence
  Synthetic
atacgccatgctgggtctccatacctgggagtgatggtgcaagcggacagtggttgcgttgtaagctggaagaacaaagaactgaaatgtggaagtggaatctttgtgactgacaatgtgcgtacttgggagtcggccat

SEQ ID NO: 370524 - DNA, 140 bp, Artificial Sequence
  Synthetic
atggccgactcccaagtacgcacattgtcagtcacaaagattccacttccacatttcagttctttgttcttccagcttacaacgcaaccactgtccgcttgcaccatcactcccaggtatggagacccagcatggcgtat

SEQ ID NO: 370525 - DNA, 140 bp, Artificial Sequence
  Synthetic
atacgccatgctgggtctccgaagagtataactctcgacatcctaacagagatcgccagtttgccaacctacctttcctctagggccaagctcgcccttgacaacatagtcatgctccaccgtacttgggagtcggccat

SEQ ID NO: 370526 - DNA, 140 bp, Artificial Sequence
  Synthetic
atggccgactcccaagtacggtggagcatgactatgttgtcaagggcgagcttggccctagaggaaaggtaggttggcaaactggcgatctctgttaggatgtcgagagttatactcttcggagacccagcatggcgtat

SEQ ID NO: 370527 - DNA, 140 bp, Artificial Sequence
  Synthetic
atacgccatgctgggtctccggcttctgcaattcaaaaagcccatgaggaaggaatctgtggaatccgttcagttacaaggttggaaaatctaatgtggaagcagataacaccagaattgcgtacttgggagtcggccat

SEQ ID NO: 370528 - DNA, 140 bp, Artificial Sequence
  Synthetic
atggccgactcccaagtacgcaattctggtgttatctgcttccacattagattttccaaccttgtaactgaacggattccacagattccttcctcatgggctttttgaattgcagaagccggagacccagcatggcgtat

SEQ ID NO: 370529 - DNA, 140 bp, Artificial Sequence
  Synthetic
aggccctggctgctgatatgcagttacaaggttggaaaatctaatgtggaagcagataacaccagaattgaaccacatcctatctgaaaatgaagtcaaactgaccatcatgacaggagagaccttttgggacagcggtg

SEQ ID NO: 370530 - DNA, 140 bp, Artificial Sequence
  Synthetic
caccgctgtcccaaaaggtctctcctgtcatgatggtcagtttgacttcattttcagataggatgtggttcaattctggtgttatctgcttccacattagattttccaaccttgtaactgcatatcagcagccagggcct

SEQ ID NO: 370531 - DNA, 140 bp, Artificial Sequence
  Synthetic
aggccctggctgctgatatgtccaggaagactttcgtggaactcatgaggaggggtgaccttccagtctggttagcccataaagtagcatcagaagggatcaaatatacagatagaaaatgaccttttgggacagcggtg

SEQ ID NO: 370532 - DNA, 140 bp, Artificial Sequence
  Synthetic
caccgctgtcccaaaaggtcattttctatctgtatatttgatcccttctgatgctactttatgggctaaccagactggaaggtcacccctcctcatgagttccacgaaagtcttcctggacatatcagcagccagggcct

SEQ ID NO: 370533 - DNA, 140 bp, Artificial Sequence
  Synthetic
atacgccatgctgggtctccgattaaggggattatgcaagcagggagaagatctttgaaaccccaacccactgagctgagatactcatggaaaacttggggaaaagcgaaggtactatcacgtacttgggagtcggccat

SEQ ID NO: 370534 - DNA, 140 bp, Artificial Sequence
  Synthetic
atggccgactcccaagtacgtgatagtaccttcgcttttccccaagttttccatgagtatctcagctcagtgggttggggtttcaaagatcttctccctgcttgcataatccccttaatcggagacccagcatggcgtat

SEQ ID NO: 370535 - DNA, 140 bp, Artificial Sequence
  Synthetic
atacgccatgctgggtctccatcatactagagttttttctgatggtgctgctcattccagagccagacagacagcgtactccacaggacaatcaactagcatatgtggtgataggtttgtcgtacttgggagtcggccat

SEQ ID NO: 370536 - DNA, 140 bp, Artificial Sequence
  Synthetic
atggccgactcccaagtacgacaaacctatcaccacatatgctagttgattgtcctgtggagtacgctgtctgtctggctctggaatgagcagcaccatcagaaaaaactctagtatgatggagacccagcatggcgtat

SEQ ID NO: 370537 - DNA, 140 bp, Artificial Sequence
  Synthetic
aggccctggctgctgatatggtggaaatctggacaaaggaaggagaaaagaaaaaattgagacctaggtggcttgatgcccgcacctattcagatcccttagcactcaaggaattcaagggaccttttgggacagcggtg

SEQ ID NO: 370538 - DNA, 140 bp, Artificial Sequence
  Synthetic
caccgctgtcccaaaaggtcccttgaattccttgagtgctaagggatctgaataggtgcgggcatcaagccacctaggtctcaattttttcttttctccttcctttgtccagatttccaccatatcagcagccagggcct

SEQ ID NO: 370539 - DNA, 140 bp, Artificial Sequence
  Synthetic
atacgccatgctgggtctccatgccctaacagcaatagagcctggaactctttggaagttgaggattatggctttgggatttttaccaccaatatatggctaaagttgagagagaaacaacgtacttgggagtcggccat

SEQ ID NO: 370540 - DNA, 140 bp, Artificial Sequence
  Synthetic
atggccgactcccaagtacgttgtttctctctcaactttagccatatattggtggtaaaaatcccaaagccataatcctcaacttccaaagagttccaggctctattgctgttagggcatggagacccagcatggcgtat

SEQ ID NO: 370541 - DNA, 140 bp, Artificial Sequence
  Synthetic
aggccctggctgctgatatggctttgggatttttaccaccaatatatggctaaagttgagagagaaacaagacatgatttgtgattcaaagttgatgtcagcagctgtcaaggacgacaggaccttttgggacagcggtg

SEQ ID NO: 370542 - DNA, 140 bp, Artificial Sequence
  Synthetic
caccgctgtcccaaaaggtcctgtcgtccttgacagctgctgacatcaactttgaatcacaaatcatgtcttgtttctctctcaactttagccatatattggtggtaaaaatcccaaagccatatcagcagccagggcct

SEQ ID NO: 370543 - DNA, 140 bp, Artificial Sequence
  Synthetic
atacgccatgctgggtctccagcagttcatgctgatatgggctattggatagagagcagactgaatgacacatggaagatggaaaaagcatcatttattgaggttaaaagctgctactggcgtacttgggagtcggccat

SEQ ID NO: 370544 - DNA, 140 bp, Artificial Sequence
  Synthetic
atggccgactcccaagtacgccagtagcagcttttaacctcaataaatgatgctttttccatcttccatgtgtcattcagtctgctctctatccaatagcccatatcagcatgaactgctggagacccagcatggcgtat

SEQ ID NO: 370545 - DNA, 140 bp, Artificial Sequence
  Synthetic
aggccctggctgctgatatgcatggaagatggaaaaagcatcatttattgaggttaaaagctgctactggccaagatcacacaccctttggagcaatggagtgctggagagtgaaatgatgaccttttgggacagcggtg

SEQ ID NO: 370546 - DNA, 140 bp, Artificial Sequence
  Synthetic
caccgctgtcccaaaaggtcatcatttcactctccagcactccattgctccaaagggtgtgtgatcttggccagtagcagcttttaacctcaataaatgatgctttttccatcttccatgcatatcagcagccagggcct

SEQ ID NO: 370547 - DNA, 140 bp, Artificial Sequence
  Synthetic
atacgccatgctgggtctccaattccaaagaatctggctggaccagtgtcgcagcacaactacagaccaggctattacacacaaacagccggaccatggcatttgggcaaactcgagatgcgtacttgggagtcggccat

SEQ ID NO: 370548 - DNA, 140 bp, Artificial Sequence
  Synthetic
atggccgactcccaagtacgcatctcgagtttgcccaaatgccatggtccggctgtttgtgtgtaatagcctggtctgtagttgtgctgcgacactggtccagccagattctttggaattggagacccagcatggcgtat

SEQ ID NO: 370549 - DNA, 140 bp, Artificial Sequence
  Synthetic
aggccctggctgctgatatggctattacacacaaacagccggaccatggcatttgggcaaactcgagatggatttcgagttttgtgaaggaaccacggtagtggtgaccgaggattgcgggaccttttgggacagcggtg

SEQ ID NO: 370550 - DNA, 140 bp, Artificial Sequence
  Synthetic
caccgctgtcccaaaaggtcccgcaatcctcggtcaccactaccgtggttccttcacaaaactcgaaatccatctcgagtttgcccaaatgccatggtccggctgtttgtgtgtaatagccatatcagcagccagggcct

SEQ ID NO: 370551 - DNA, 140 bp, Artificial Sequence
  Synthetic
atacgccatgctgggtctccaaacagaggaccatccctgagaacaaccactgcctcaggaaaactcataactgagtggtgctgcagatcatgcacattaccaccactaagatacagaggacgtacttgggagtcggccat

SEQ ID NO: 370552 - DNA, 140 bp, Artificial Sequence
  Synthetic
atggccgactcccaagtacgtcctctgtatcttagtggtggtaatgtgcatgatctgcagcaccactcagttatgagttttcctgaggcagtggttgttctcagggatggtcctctgtttggagacccagcatggcgtat

SEQ ID NO: 370553 - DNA, 140 bp, Artificial Sequence
  Synthetic
aggccctggctgctgatatgtggctgcaataatagcagctaacgaaatgggattgttggaaactacaaaaagagatttaggaatgtctaaggagccaggcgttgtttctccaaccagctagaccttttgggacagcggtg

SEQ ID NO: 370554 - DNA, 140 bp, Artificial Sequence
  Synthetic
caccgctgtcccaaaaggtctagctggttggagaaacaacgcctggctccttagacattcctaaatctctttttgtagtttccaacaatcccatttcgttagctgctattattgcagccacatatcagcagccagggcct

SEQ ID NO: 370555 - DNA, 140 bp, Artificial Sequence
  Synthetic
atacgccatgctgggtctcctttagatgtggacttgcacccagcatcagcctggacattgtacgccgtggccactacagtaataacaccaatgttaagacataccatagagaattctacacgtacttgggagtcggccat

SEQ ID NO: 370556 - DNA, 140 bp, Artificial Sequence
  Synthetic
atggccgactcccaagtacgtgtagaattctctatggtatgtcttaacattggtgttattactgtagtggccacggcgtacaatgtccaggctgatgctgggtgcaagtccacatctaaaggagacccagcatggcgtat

SEQ ID NO: 370557 - DNA, 140 bp, Artificial Sequence
  Synthetic
aggccctggctgctgatatgatttctcactagggattttgggaatggcattgctcttggaagagatgcttagaaccagagtaggaacaaagcacgccttgctgctagtggcgatctccttgaccttttgggacagcggtg

SEQ ID NO: 370558 - DNA, 140 bp, Artificial Sequence
  Synthetic
caccgctgtcccaaaaggtcaaggagatcgccactagcagcaaggcgtgctttgttcctactctggttctaagcatctcttccaagagcaatgccattcccaaaatccctagtgagaaatcatatcagcagccagggcct

SEQ ID NO: 370559 - DNA, 140 bp, Artificial Sequence
  Synthetic
atacgccatgctgggtctcccgtgacactgattacagggaacatgtccttcaaggatctaggaagagtgataattatggtgggagcagccatgacggacgagatgggtatgggcgtgacacgtacttgggagtcggccat

SEQ ID NO: 370560 - DNA, 140 bp, Artificial Sequence
  Synthetic
atggccgactcccaagtacgtgtcacgcccatacccatctcgtccgtcatggctgctcccaccataattatcactcttcctagatccttgaaggacatgttccctgtaatcagtgtcacgggagacccagcatggcgtat

SEQ ID NO: 370561 - DNA, 140 bp, Artificial Sequence
  Synthetic
aggccctggctgctgatatgtaattatggtgggagcagccatgacggacgagatgggtatgggcgtgacatacttggcattactagctgctttcagagtcagacccacctttgcagtggggaccttttgggacagcggtg

SEQ ID NO: 370562 - DNA, 140 bp, Artificial Sequence
  Synthetic
caccgctgtcccaaaaggtccccactgcaaaggtgggtctgactctgaaagcagctagtaatgccaagtatgtcacgcccatacccatctcgtccgtcatggctgctcccaccataattacatatcagcagccagggcct

SEQ ID NO: 370563 - DNA, 140 bp, Artificial Sequence
  Synthetic
atacgccatgctgggtctccgttgcttttaagaaaactcacttcaaaggaattgttgatggcaaccatcggagtcgttctcctctctcagagcaacataccaggaacagttttggaattgcgtacttgggagtcggccat

SEQ ID NO: 370564 - DNA, 140 bp, Artificial Sequence
  Synthetic
atggccgactcccaagtacgcaattccaaaactgttcctggtatgttgctctgagagaggagaacgactccgatggttgccatcaacaattcctttgaagtgagttttcttaaaagcaacggagacccagcatggcgtat

SEQ ID NO: 370565 - DNA, 140 bp, Artificial Sequence
  Synthetic
aggccctggctgctgatatggagtcgttctcctctctcagagcaacataccaggaacagttttggaattgaccgatgcaatagcattgggaataatggttcttaaaataatgaggagcatgaccttttgggacagcggtg

SEQ ID NO: 370566 - DNA, 140 bp, Artificial Sequence
  Synthetic
caccgctgtcccaaaaggtcatgctcctcattattttaagaaccattattcccaatgctattgcatcggtcaattccaaaactgttcctggtatgttgctctgagagaggagaacgactccatatcagcagccagggcct

SEQ ID NO: 370567 - DNA, 140 bp, Artificial Sequence
  Synthetic
atacgccatgctgggtctccgattcaaaatttgaaaagcaactgggacaggttatgctcctggttttgtgtgcagttcaacttttgttaatgagaacatcatgggccttgtgtgaagcttcgtacttgggagtcggccat

SEQ ID NO: 370568 - DNA, 140 bp, Artificial Sequence
  Synthetic
atggccgactcccaagtacgaagcttcacacaaggcccatgatgttctcattaacaaaagttgaactgcacacaaaaccaggagcataacctgtcccagttgcttttcaaattttgaatcggagacccagcatggcgtat

SEQ ID NO: 370569 - DNA, 140 bp, Artificial Sequence
  Synthetic
atacgccatgctgggtctccggaaaaataccagctagcagtgaccgtcatggctatgctatgtattccaaatgtcatgatactccagcatgcatggaaagtaggttgcaccatattggcacgtacttgggagtcggccat

SEQ ID NO: 370570 - DNA, 140 bp, Artificial Sequence
  Synthetic
atggccgactcccaagtacgtgccaatatggtgcaacctactttccatgcatgctggagtatcatgacatttggaatacatagcatagccatgacggtcactgctagctggtatttttccggagacccagcatggcgtat

SEQ ID NO: 370571 - DNA, 140 bp, Artificial Sequence
  Synthetic
aggccctggctgctgatatgatgtcatgatactccagcatgcatggaaagtaggttgcaccatattggcagcagtctctgtatcaccactcctcctgacttcctcacaacaaaaaacggagaccttttgggacagcggtg

SEQ ID NO: 370572 - DNA, 140 bp, Artificial Sequence
  Synthetic
caccgctgtcccaaaaggtctccgttttttgttgtgaggaagtcaggaggagtggtgatacagagactgctgccaatatggtgcaacctactttccatgcatgctggagtatcatgacatcatatcagcagccagggcct

SEQ ID NO: 370573 - DNA, 140 bp, Artificial Sequence
  Synthetic
atacgccatgctgggtctccttttgtgtgatattggtgagtcctctccgaatccaactatagaagaaggaagaacgttacgtgttctaaagatggtggaaccatggctcagaggaaaccacgtacttgggagtcggccat

SEQ ID NO: 370574 - DNA, 140 bp, Artificial Sequence
  Synthetic
atggccgactcccaagtacgtggtttcctctgagccatggttccaccatctttagaacacgtaacgttcttccttcttctatagttggattcggagaggactcaccaatatcacacaaaaggagacccagcatggcgtat

SEQ ID NO: 370575 - DNA, 140 bp, Artificial Sequence
  Synthetic
atacgccatgctgggtctccctggataccgttagccctcacaataaaaggtctcaatccaactgctattttcttaacaactctgtctagacccagtaaaataagaagttggcctcttaatcgtacttgggagtcggccat

SEQ ID NO: 370576 - DNA, 140 bp, Artificial Sequence
  Synthetic
atggccgactcccaagtacgattaagaggccaacttcttattttactgggtctagacagagttgttaagaaaatagcagttggattgagaccttttattgtgagggctaacggtatccagggagacccagcatggcgtat

SEQ ID NO: 370577 - DNA, 140 bp, Artificial Sequence
  Synthetic
aggccctggctgctgatatggaacaggaaaaagaggaacaggctcacaaggtgaaactttaggagaaaaatggaaaaagaaattaaatcaattatcccggaaagagtttgacctttacaagaccttttgggacagcggtg

SEQ ID NO: 370578 - DNA, 140 bp, Artificial Sequence
  Synthetic
caccgctgtcccaaaaggtcttgtaaaggtcaaactctttccgggataattgatttaatttctttttccatttttctcctaaagtttcaccttgtgagcctgttcctctttttcctgttccatatcagcagccagggcct

SEQ ID NO: 370579 - DNA, 140 bp, Artificial Sequence
  Synthetic
atacgccatgctgggtctccgaaaaatgacattccaatgacgggaccactggtggcaggaggacttctcacagtgtgctatgtgcttactggcagatcggcagacttggagctagaaaaacgtacttgggagtcggccat

SEQ ID NO: 370580 - DNA, 140 bp, Artificial Sequence
  Synthetic
atggccgactcccaagtacgtttttctagctccaagtctgccgatctgccagtaagcacatagcacactgtgagaagtcctcctgccaccagtggtcccgtcattggaatgtcatttttcggagacccagcatggcgtat

SEQ ID NO: 370581 - DNA, 140 bp, Artificial Sequence
  Synthetic
aggccctggctgctgatatgcagtgtgctatgtgcttactggcagatcggcagacttggagctagaaaaagcggcagaggtgaaatgggaagatcaagctgagatatccgggagtagcccgaccttttgggacagcggtg

SEQ ID NO: 370582 - DNA, 140 bp, Artificial Sequence
  Synthetic
caccgctgtcccaaaaggtcgggctactcccggatatctcagcttgatcttcccatttcacctctgccgctttttctagctccaagtctgccgatctgccagtaagcacatagcacactgcatatcagcagccagggcct

SEQ ID NO: 370583 - DNA, 140 bp, Artificial Sequence
  Synthetic
atacgccatgctgggtctcccaatggttcgtggagagaaacatggtcattcccgaaggaagagtcatagacttgggctgtggaagaggaggctggtcatattactgtgcaggactgaaaacgtacttgggagtcggccat

SEQ ID NO: 370584 - DNA, 140 bp, Artificial Sequence
  Synthetic
atggccgactcccaagtacgttttcagtcctgcacagtaatatgaccagcctcctcttccacagcccaagtctatgactcttccttcgggaatgaccatgtttctctccacgaaccattgggagacccagcatggcgtat

SEQ ID NO: 370585 - DNA, 140 bp, Artificial Sequence
  Synthetic
atacgccatgctgggtctccaatcctatcaatcactatatcagaagatggtagtatgtcaataaagaatgaggaagaagagcagactctaaccatactgataaggacaggactgttagtacgtacttgggagtcggccat

SEQ ID NO: 370586 - DNA, 140 bp, Artificial Sequence
  Synthetic
atggccgactcccaagtacgtactaacagtcctgtccttatcagtatggttagagtctgctcttcttcctcattctttattgacatactaccatcttctgatatagtgattgataggattggagacccagcatggcgtat

SEQ ID NO: 370587 - DNA, 140 bp, Artificial Sequence
  Synthetic
atacgccatgctgggtctcctggccagaggatagagaacataaaaaatgaacataagtcaacatggcattatgatgaggacaatccatacaaaacatgggcctatcatggatcatatgagcgtacttgggagtcggccat

SEQ ID NO: 370588 - DNA, 140 bp, Artificial Sequence
  Synthetic
atggccgactcccaagtacgctcatatgatccatgataggcccatgttttgtatggattgtcctcatcataatgccatgttgacttatgttcattttttatgttctctatcctctggccaggagacccagcatggcgtat

SEQ ID NO: 370589 - DNA, 140 bp, Artificial Sequence
  Synthetic
atacgccatgctgggtctcccctatgggagacaaaaaagcagagggccggagtgctgtgggacgttccttcacctccaccaatgggaaaagctgagctagaagatggcgcttacaggatccgtacttgggagtcggccat

SEQ ID NO: 370590 - DNA, 140 bp, Artificial Sequence
  Synthetic
atggccgactcccaagtacggatcctgtaagcgccatcttctagctcagcttttcccattggtggaggtgaaggaacgtcccacagcactccggccctctgcttttttgtctcccataggggagacccagcatggcgtat

SEQ ID NO: 370591 - DNA, 140 bp, Artificial Sequence
  Synthetic
aggccctggctgctgatatgcacctccaccaatgggaaaagctgagctagaagatggcgcttacaggatcaaacagagagggattttcggatactctcaaattggggccggagtgtataagaccttttgggacagcggtg

SEQ ID NO: 370592 - DNA, 140 bp, Artificial Sequence
  Synthetic
caccgctgtcccaaaaggtcttatacactccggccccaatttgagagtatccgaaaatccctctctgtttgatcctgtaagcgccatcttctagctcagcttttcccattggtggaggtgcatatcagcagccagggcct

SEQ ID NO: 370593 - DNA, 140 bp, Artificial Sequence
  Synthetic
atacgccatgctgggtctccctgataccacacccttcggacaacagagggttttcaaagagaaagttgacacacgcacaccaagaccaaaacgaggcacagcacaaattatggaggtgaccgtacttgggagtcggccat

SEQ ID NO: 370594 - DNA, 140 bp, Artificial Sequence
  Synthetic
atggccgactcccaagtacggtcacctccataatttgtgctgtgcctcgttttggtcttggtgtgcgtgtgtcaactttctctttgaaaaccctctgttgtccgaagggtgtggtatcagggagacccagcatggcgtat

SEQ ID NO: 370595 - DNA, 140 bp, Artificial Sequence
  Synthetic
atacgccatgctgggtctccagaaggtacatttcacacgatgtggcacgtcacacgtggagccgtcctagtgcacaaagggaaaagacttgagccatcatgggcagacgtgaagaaagaccgtacttgggagtcggccat

SEQ ID NO: 370596 - DNA, 140 bp, Artificial Sequence
  Synthetic
atggccgactcccaagtacggtctttcttcacgtctgcccatgatggctcaagtcttttccctttgtgcactaggacggctccacgtgtgacgtgccacatcgtgtgaaatgtaccttctggagacccagcatggcgtat

SEQ ID NO: 370597 - DNA, 140 bp, Artificial Sequence
  Synthetic
aggccctggctgctgatatgtacaaaggaaacatggaggaatgcttgtgagaaatccactttcacgaaactccacgcacgaaatgtactggatatctaatggcacaggtaacattgtcgcgaccttttgggacagcggtg

SEQ ID NO: 370598 - DNA, 140 bp, Artificial Sequence
  Synthetic
caccgctgtcccaaaaggtcgcgacaatgttacctgtgccattagatatccagtacatttcgtgcgtggagtttcgtgaaagtggatttctcacaagcattcctccatgtttcctttgtacatatcagcagccagggcct

SEQ ID NO: 370599 - DNA, 140 bp, Artificial Sequence
  Synthetic
atacgccatgctgggtctcccgaagaggttcaggttttagcgctggaacccggaaaaaacccgagagcagtgcaaacaaaacccggcctcttcaaaaccaacacaggaacaataggagcccgtacttgggagtcggccat

SEQ ID NO: 370600 - DNA, 140 bp, Artificial Sequence
  Synthetic
atggccgactcccaagtacgggctcctattgttcctgtgttggttttgaagaggccgggttttgtttgcactgctctcgggttttttccgggttccagcgctaaaacctgaacctcttcgggagacccagcatggcgtat

SEQ ID NO: 370601 - DNA, 140 bp, Artificial Sequence
  Synthetic
aggccctggctgctgatatgtgcaaacaaaacccggcctcttcaaaaccaacacaggaacaataggagccgtttccttagacttttccccaggaacatcaggatccccaatcattgacaggaccttttgggacagcggtg

SEQ ID NO: 370602 - DNA, 140 bp, Artificial Sequence
  Synthetic
caccgctgtcccaaaaggtcctgtcaatgattggggatcctgatgttcctggggaaaagtctaaggaaacggctcctattgttcctgtgttggttttgaagaggccgggttttgtttgcacatatcagcagccagggcct

SEQ ID NO: 370603 - DNA, 140 bp, Artificial Sequence
  Synthetic
atacgccatgctgggtctccgaaaggaaaagtcgtgggtctctacggaaatggtgtcgtgacaagaagcggaacctatgtgagctccatagcccaaacagagaaaagtgtagaggacaatcgtacttgggagtcggccat

SEQ ID NO: 370604 - DNA, 140 bp, Artificial Sequence
  Synthetic
atggccgactcccaagtacgattgtcctctacacttttctctgtttgggctatggagctcacataggttccgcttcttgtcacgacaccatttccgtagagacccacgacttttcctttcggagacccagcatggcgtat

SEQ ID NO: 370605 - DNA, 140 bp, Artificial Sequence
  Synthetic
aggccctggctgctgatatgacaggctcagcctcctccatgataaatggagtcgtgaaactcctcactaaaccatgggatgtggtgcccatggtgacacagatggcaatgacagatacaagaccttttgggacagcggtg

SEQ ID NO: 370606 - DNA, 140 bp, Artificial Sequence
  Synthetic
caccgctgtcccaaaaggtcttgtatctgtcattgccatctgtgtcaccatgggcaccacatcccatggtttagtgaggagtttcacgactccatttatcatggaggaggctgagcctgtcatatcagcagccagggcct

SEQ ID NO: 370607 - DNA, 140 bp, Artificial Sequence
  Synthetic
aggccctggctgctgatatggtgaggaaagacattccgcagtgggaaccatctaagggatggaaaaactggcaagaggttcctttttgctcccaccactttcacaagatctttatgaagggaccttttgggacagcggtg

SEQ ID NO: 370608 - DNA, 140 bp, Artificial Sequence
  Synthetic
caccgctgtcccaaaaggtcccttcataaagatcttgtgaaagtggtgggagcaaaaaggaacctcttgccagtttttccatcccttagatggttcccactgcggaatgtctttcctcaccatatcagcagccagggcct

SEQ ID NO: 370609 - DNA, 140 bp, Artificial Sequence
  Synthetic
aggccctggctgctgatatggagaagcaataagaagaggcctgagaacactgattctagcccccactagagtagtggctgcagaaatggaggaagccctacgggggctcccaatccgttagaccttttgggacagcggtg

SEQ ID NO: 370610 - DNA, 140 bp, Artificial Sequence
  Synthetic
caccgctgtcccaaaaggtctaacggattgggagcccccgtagggcttcctccatttctgcagccactactctagtgggggctagaatcagtgttctcaggcctcttcttattgcttctccatatcagcagccagggcct

SEQ ID NO: 370611 - DNA, 140 bp, Artificial Sequence
  Synthetic
atacgccatgctgggtctccccagactccggccattaaggcagagcacactgggcgcgaaatcgtagacctaatgtgtcatgccacattcactatgaggttattgtcaccaattagggtacgtacttgggagtcggccat

SEQ ID NO: 370612 - DNA, 140 bp, Artificial Sequence
  Synthetic
atggccgactcccaagtacgtaccctaattggtgacaataacctcatagtgaatgtggcatgacacattaggtctacgatttcgcgcccagtgtgctctgccttaatggccggagtctggggagacccagcatggcgtat

SEQ ID NO: 370613 - DNA, 140 bp, Artificial Sequence
  Synthetic
aggccctggctgctgatatgtaatgtgtcatgccacattcactatgaggttattgtcaccaattagggtaccaaactacaacctaatcataatggatgaagcccatttcacagacccagcgaccttttgggacagcggtg

SEQ ID NO: 370614 - DNA, 140 bp, Artificial Sequence
  Synthetic
caccgctgtcccaaaaggtcgctgggtctgtgaaatgggcttcatccattatgattaggttgtagtttggtaccctaattggtgacaataacctcatagtgaatgtggcatgacacattacatatcagcagccagggcct

SEQ ID NO: 370615 - DNA, 140 bp, Artificial Sequence
  Synthetic
atacgccatgctgggtctcctagcatagcagcccgaggatacatctccacccgtgtagaaatgggagaagctgctggaatatttatgacagccactcctccaggcagtagggacccttttcgtacttgggagtcggccat

SEQ ID NO: 370616 - DNA, 140 bp, Artificial Sequence
  Synthetic
atggccgactcccaagtacgaaaagggtccctactgcctggaggagtggctgtcataaatattccagcagcttctcccatttctacacgggtggagatgtatcctcgggctgctatgctaggagacccagcatggcgtat

SEQ ID NO: 370617 - DNA, 140 bp, Artificial Sequence
  Synthetic
aggccctggctgctgatatgctgctggaatatttatgacagccactcctccaggcagtagggacccttttccacagagcaacgccccaataatggacgaggaaagagagatccctgaacggaccttttgggacagcggtg

SEQ ID NO: 370618 - DNA, 140 bp, Artificial Sequence
  Synthetic
caccgctgtcccaaaaggtccgttcagggatctctctttcctcgtccattattggggcgttgctctgtggaaaagggtccctactgcctggaggagtggctgtcataaatattccagcagcatatcagcagccagggcct

SEQ ID NO: 370619 - DNA, 140 bp, Artificial Sequence
  Synthetic
atacgccatgctgggtctcctcgactggttggaaaaacatggcgtcgaaaggttgaaaagaatggcaatcagcggagatgactgtgtggtgaaaccaactgatgacaggtttgcaacagccgtacttgggagtcggccat

SEQ ID NO: 370620 - DNA, 140 bp, Artificial Sequence
  Synthetic
atggccgactcccaagtacggctgttgcaaacctgtcatcagttggtttcaccacacagtcatctccgctgattgccattcttttcaacctttcgacgccatgtttttccaaccagtcgaggagacccagcatggcgtat

SEQ ID NO: 370621 - DNA, 140 bp, Artificial Sequence
  Synthetic
atacgccatgctgggtctccctcatggaattccggacatgaatggataacaaacttcaaaggtaaaacagtatggtttgtcccaagcataagagctggaaacgacatagcagcctgcttacgtacttgggagtcggccat

SEQ ID NO: 370622 - DNA, 140 bp, Artificial Sequence
  Synthetic
atggccgactcccaagtacgtaagcaggctgctatgtcgtttccagctcttatgcttgggacaaaccatactgttttacctttgaagtttgttatccattcatgtccggaattccatgagggagacccagcatggcgtat

SEQ ID NO: 370623 - DNA, 140 bp, Artificial Sequence
  Synthetic
aggccctggctgctgatatgatgattggcaacaggttcctttctgctcccaccactttcatgaattgatcatgaaagatggaagaaagttggtggttccctgcagaccccaggacgaactgaccttttgggacagcggtg

SEQ ID NO: 370624 - DNA, 140 bp, Artificial Sequence
  Synthetic
caccgctgtcccaaaaggtcagttcgtcctggggtctgcagggaaccaccaactttcttccatctttcatgatcaattcatgaaagtggtgggagcagaaaggaacctgttgccaatcatcatatcagcagccagggcct

SEQ ID NO: 370625 - DNA, 140 bp, Artificial Sequence
  Synthetic
atacgccatgctgggtctccagaatacaccaaaacaagaacaaacgactgggacttcgtagtcacgactgacatctcggaaatgggggcaaacttcaaagctgaaagagtgatagatccacgtacttgggagtcggccat

SEQ ID NO: 370626 - DNA, 140 bp, Artificial Sequence
  Synthetic
atggccgactcccaagtacgtggatctatcactctttcagctttgaagtttgcccccatttccgagatgtcagtcgtgactacgaagtcccagtcgtttgttcttgttttggtgtattctggagacccagcatggcgtat

SEQ ID NO: 370627 - DNA, 140 bp, Artificial Sequence
  Synthetic
aggccctggctgctgatatgacatctcggaaatgggggcaaacttcaaagctgaaagagtgatagatccaaggagatgcatgaagccagttatattgacagatggtgaagagcgcgtggtgaccttttgggacagcggtg

SEQ ID NO: 370628 - DNA, 140 bp, Artificial Sequence
  Synthetic
caccgctgtcccaaaaggtcaccacgcgctcttcaccatctgtcaatataactggcttcatgcatctccttggatctatcactctttcagctttgaagtttgcccccatttccgagatgtcatatcagcagccagggcct

SEQ ID NO: 370629 - DNA, 140 bp, Artificial Sequence
  Synthetic
atacgccatgctgggtctcctctggcaggacctatgccagttactcactcaagtgcagcacagagaagagggagaataggaaggaatccaaaaaatgagaacgaccaatatatttacatgcgtacttgggagtcggccat

SEQ ID NO: 370630 - DNA, 140 bp, Artificial Sequence
  Synthetic
atggccgactcccaagtacgcatgtaaatatattggtcgttctcattttttggattccttcctattctccctcttctctgtgctgcacttgagtgagtaactggcataggtcctgccagaggagacccagcatggcgtat

SEQ ID NO: 370631 - DNA, 140 bp, Artificial Sequence
  Synthetic
atacgccatgctgggtctcctgctatctgttcagccgttccagttgattgggtcccaaccagccgcaccacttggtcgatccatgcccaccatcaatggatgacaacagaagacatgttgcgtacttgggagtcggccat

SEQ ID NO: 370632 - DNA, 140 bp, Artificial Sequence
  Synthetic
atggccgactcccaagtacgcaacatgtcttctgttgtcatccattgatggtgggcatggatcgaccaagtggtgcggctggttgggacccaatcaactggaacggctgaacagatagcaggagacccagcatggcgtat

SEQ ID NO: 370633 - DNA, 140 bp, Artificial Sequence
  Synthetic
atacgccatgctgggtctccgatgctccttgataacatcaacacacctgaaggtatcatccccagcatgttcgagccagaacgtgagaaagttgatgccatagacggtgaataccggttacgtacttgggagtcggccat

SEQ ID NO: 370634 - DNA, 140 bp, Artificial Sequence
  Synthetic
atggccgactcccaagtacgtaaccggtattcaccgtctatggcatcaactttctcacgttctggctcgaacatgctggggatgataccttcaggtgtgttgatgttatcaaggagcatcggagacccagcatggcgtat

SEQ ID NO: 370635 - DNA, 140 bp, Artificial Sequence
  Synthetic
atacgccatgctgggtctcccgctctgaacgatatgggaaaggttcggaaagacatacctcaatggcagccatcaaagggatggcatgactggcaacaggttcctttctgctcccaccaccgtacttgggagtcggccat

SEQ ID NO: 370636 - DNA, 140 bp, Artificial Sequence
  Synthetic
atggccgactcccaagtacggtggtgggagcagaaaggaacctgttgccagtcatgccatccctttgatggctgccattgaggtatgtctttccgaacctttcccatatcgttcagagcgggagacccagcatggcgtat

SEQ ID NO: 370637 - DNA, 140 bp, Artificial Sequence
  Synthetic
atacgccatgctgggtctccaccagtttggctggcttacaaggtagcttcggaaggcataaactatgcagacaggaagtggtgctttgatggaatcagaaacaatcagatcctagaggagcgtacttgggagtcggccat

SEQ ID NO: 370638 - DNA, 140 bp, Artificial Sequence
  Synthetic
atggccgactcccaagtacgctcctctaggatctgattgtttctgattccatcaaagcaccacttcctgtctgcatagtttatgccttccgaagctaccttgtaagccagccaaactggtggagacccagcatggcgtat

SEQ ID NO: 370639 - DNA, 140 bp, Artificial Sequence
  Synthetic
aggccctggctgctgatatgacaggaagtggtgctttgatggaatcagaaacaatcagatcctagaggagaacattgaagtggaagtttggacgaaagaaggtgagaggaaaaaactaaagaccttttgggacagcggtg

SEQ ID NO: 370640 - DNA, 140 bp, Artificial Sequence
  Synthetic
caccgctgtcccaaaaggtctttagttttttcctctcaccttctttcgtccaaacttccacttcaatgttctcctctaggatctgattgtttctgattccatcaaagcaccacttcctgtcatatcagcagccagggcct

SEQ ID NO: 370641 - DNA, 140 bp, Artificial Sequence
  Synthetic
atacgccatgctgggtctccacccagatggctggacgcaagaacttattcagatccgctagcactcaaagagttcaaggaatttgcggccggaaggaagtctctaaccttgagtttgatccgtacttgggagtcggccat

SEQ ID NO: 370642 - DNA, 140 bp, Artificial Sequence
  Synthetic
atggccgactcccaagtacggatcaaactcaaggttagagacttccttccggccgcaaattccttgaactctttgagtgctagcggatctgaataagttcttgcgtccagccatctgggtggagacccagcatggcgtat

SEQ ID NO: 370643 - DNA, 140 bp, Artificial Sequence
  Synthetic
aggccctggctgctgatatgagttcaaggaatttgcggccggaaggaagtctctaaccttgagtttgatcacagaaatgggccggctcccaaccttcatgacccaaaagacaagagatgcgaccttttgggacagcggtg

SEQ ID NO: 370644 - DNA, 140 bp, Artificial Sequence
  Synthetic
caccgctgtcccaaaaggtcgcatctcttgtcttttgggtcatgaaggttgggagccggcccatttctgtgatcaaactcaaggttagagacttccttccggccgcaaattccttgaactcatatcagcagccagggcct

SEQ ID NO: 370645 - DNA, 140 bp, Artificial Sequence
  Synthetic
atacgccatgctgggtctcccctggacaacttggctgtgttgcactccgcagaaatgggtggaagagcctataaccatgctctcagtgaactgccagaaactctagaaacattactcttgcgtacttgggagtcggccat

SEQ ID NO: 370646 - DNA, 140 bp, Artificial Sequence
  Synthetic
atggccgactcccaagtacgcaagagtaatgtttctagagtttctggcagttcactgagagcatggttataggctcttccacccatttctgcggagtgcaacacagccaagttgtccaggggagacccagcatggcgtat

SEQ ID NO: 370647 - DNA, 140 bp, Artificial Sequence
  Synthetic
aggccctggctgctgatatgataaccatgctctcagtgaactgccagaaactctagaaacattactcttgctaggtcttctggccacagtcacagggggaatctttttgttcttgatgaggaccttttgggacagcggtg

SEQ ID NO: 370648 - DNA, 140 bp, Artificial Sequence
  Synthetic
caccgctgtcccaaaaggtcctcatcaagaacaaaaagattccccctgtgactgtggccagaagacctagcaagagtaatgtttctagagtttctggcagttcactgagagcatggttatcatatcagcagccagggcct

SEQ ID NO: 370649 - DNA, 140 bp, Artificial Sequence
  Synthetic
atacgccatgctgggtctccggactagaggttagaggagaccccccgcacaacaataaacagcatattgacgctgggagagaccagagatcctgctgtctctacagcatcattccaggcacgtacttgggagtcggccat

SEQ ID NO: 370650 - DNA, 140 bp, Artificial Sequence
  Synthetic
atggccgactcccaagtacgtgcctggaatgatgctgtagagacagcaggatctctggtctctcccagcgtcaatatgctgtttattgttgtgcggggggtctcctctaacctctagtccggagacccagcatggcgtat

SEQ ID NO: 370651 - DNA, 140 bp, Artificial Sequence
  Synthetic
aggccctggctgctgatatgccagcggccttctgtggtatgcacagatacagccccattggattgcagcttcaataatattggagttctttctcatagtactgctaatccctgaaccagagaccttttgggacagcggtg

SEQ ID NO: 370652 - DNA, 140 bp, Artificial Sequence
  Synthetic
caccgctgtcccaaaaggtctctggttcagggattagcagtactatgagaaagaactccaatattattgaagctgcaatccaatggggctgtatctgtgcataccacagaaggccgctggcatatcagcagccagggcct

SEQ ID NO: 370653 - DNA, 140 bp, Artificial Sequence
  Synthetic
atacgccatgctgggtctccttcctaagatttctagccatacccccaacagcaggaattttggctagatggagctcattcaagaagaatggagcgatcaaagtgttacggggtttcaaaacgtacttgggagtcggccat

SEQ ID NO: 370654 - DNA, 140 bp, Artificial Sequence
  Synthetic
atggccgactcccaagtacgttttgaaaccccgtaacactttgatcgctccattcttcttgaatgagctccatctagccaaaattcctgctgttgggggtatggctagaaatcttaggaaggagacccagcatggcgtat

SEQ ID NO: 370655 - DNA, 140 bp, Artificial Sequence
  Synthetic
aggccctggctgctgatatgtcttgacactagtggcagccaccatggcaaacgaaatgggttttctagaaaagacaaagaaagaccttgggttgggaggcttcacaatgcaacaaccagagaccttttgggacagcggtg

SEQ ID NO: 370656 - DNA, 140 bp, Artificial Sequence
  Synthetic
caccgctgtcccaaaaggtctctggttgttgcattgtgaagcctcccaacccaaggtctttctttgtcttttctagaaaacccatttcgtttgccatggtggctgccactagtgtcaagacatatcagcagccagggcct

SEQ ID NO: 370657 - DNA, 140 bp, Artificial Sequence
  Synthetic
aggccctggctgctgatatggacaagaacagtttcgactcggaagcttgcttaacgtagtgctaacagttttttattagagagcagatctctgatgaacaaccaacggaagaagacgggagaccttttgggacagcggtg

SEQ ID NO: 370658 - DNA, 140 bp, Artificial Sequence
  Synthetic
caccgctgtcccaaaaggtctcccgtcttcttccgttggttgttcatcagagatctgctctctaataaaaaactgttagcactacgttaagcaagcttccgagtcgaaactgttcttgtccatatcagcagccagggcct

SEQ ID NO: 370659 - DNA, 140 bp, Artificial Sequence
  Synthetic
aggccctggctgctgatatgatgcagtggccactacgtttgtcacgccaatgctgaggcacagcatagaaaactcctcagtgaatgtgtcactaacagctatagcaaatcaggccacggtgaccttttgggacagcggtg

SEQ ID NO: 370660 - DNA, 140 bp, Artificial Sequence
  Synthetic
caccgctgtcccaaaaggtcaccgtggcctgatttgctatagctgttagtgacacattcactgaggagttttctatgctgtgcctcagcattggcgtgacaaacgtagtggccactgcatcatatcagcagccagggcct

SEQ ID NO: 370661 - DNA, 140 bp, Artificial Sequence
  Synthetic
atacgccatgctgggtctccgcttatgggcttgggaaaaggttggccactatcaaaaatggacataggagttcctcttcttgccattgggtgctactcgcaggtgaatcccataaccctccgtacttgggagtcggccat

SEQ ID NO: 370662 - DNA, 140 bp, Artificial Sequence
  Synthetic
atggccgactcccaagtacggagggttatgggattcacctgcgagtagcacccaatggcaagaagaggaactcctatgtccatttttgatagtggccaaccttttcccaagcccataagcggagacccagcatggcgtat

SEQ ID NO: 370663 - DNA, 140 bp, Artificial Sequence
  Synthetic
aggccctggctgctgatatgttcctcttcttgccattgggtgctactcgcaggtgaatcccataaccctcacagcagcactactgctattggtggcacactacgccatcataggtcctgggaccttttgggacagcggtg

SEQ ID NO: 370664 - DNA, 140 bp, Artificial Sequence
  Synthetic
caccgctgtcccaaaaggtcccaggacctatgatggcgtagtgtgccaccaatagcagtagtgctgctgtgagggttatgggattcacctgcgagtagcacccaatggcaagaagaggaacatatcagcagccagggcct

SEQ ID NO: 370665 - DNA, 140 bp, Artificial Sequence
  Synthetic
atacgccatgctgggtctccactccaagcaaaggctaccagagaggcgcagaaaagagcagcagccggcatcatgaagaatccaacagtagatgggatcacagtgattgacctagaaccacgtacttgggagtcggccat

SEQ ID NO: 370666 - DNA, 140 bp, Artificial Sequence
  Synthetic
atggccgactcccaagtacgtggttctaggtcaatcactgtgatcccatctactgttggattcttcatgatgccggctgctgctcttttctgcgcctctctggtagcctttgcttggagtggagacccagcatggcgtat

SEQ ID NO: 370667 - DNA, 140 bp, Artificial Sequence
  Synthetic
aggccctggctgctgatatgtcatgaagaatccaacagtagatgggatcacagtgattgacctagaaccaataccctatgatccgaagtttgagaagcagctagggcaagtgatgcttttgaccttttgggacagcggtg

SEQ ID NO: 370668 - DNA, 140 bp, Artificial Sequence
  Synthetic
caccgctgtcccaaaaggtcaaaagcatcacttgccctagctgcttctcaaacttcggatcatagggtattggttctaggtcaatcactgtgatcccatctactgttggattcttcatgacatatcagcagccagggcct

SEQ ID NO: 370669 - DNA, 140 bp, Artificial Sequence
  Synthetic
atacgccatgctgggtctccagtcctttgtgtgacacaggtgttgatgatgagaaccacgtgggctctatgcgaagccctaaccctagcaacagggcccatatcaacactgtgggaaggacgtacttgggagtcggccat

SEQ ID NO: 370670 - DNA, 140 bp, Artificial Sequence
  Synthetic
atggccgactcccaagtacgtccttcccacagtgttgatatgggccctgttgctagggttagggcttcgcatagagcccacgtggttctcatcatcaacacctgtgtcacacaaaggactggagacccagcatggcgtat

SEQ ID NO: 370671 - DNA, 140 bp, Artificial Sequence
  Synthetic
atacgccatgctgggtctccagtgttgtggattggcacgaactcaaggaacacttcaatggccatgacgtgcatagctgttggaggaatcactctgtttttgggcttcacggttcaagcgcgtacttgggagtcggccat

SEQ ID NO: 370672 - DNA, 140 bp, Artificial Sequence
  Synthetic
atggccgactcccaagtacgcgcttgaaccgtgaagcccaaaaacagagtgattcctccaacagctatgcacgtcatggccattgaagtgttccttgagttcgtgccaatccacaacactggagacccagcatggcgtat

SEQ ID NO: 370673 - DNA, 140 bp, Artificial Sequence
  Synthetic
atacgccatgctgggtctccaagagagcactcacacccccagcgagtgatctgaaatattcatggaagacatgggggaaagcaaaaatcttcacccctgaagcaagaaacagcacattttcgtacttgggagtcggccat

SEQ ID NO: 370674 - DNA, 140 bp, Artificial Sequence
  Synthetic
atggccgactcccaagtacgaaaatgtgctgtttcttgcttcaggggtgaagatttttgctttcccccatgtcttccatgaatatttcagatcactcgctgggggtgtgagtgctctcttggagacccagcatggcgtat

SEQ ID NO: 370675 - DNA, 140 bp, Artificial Sequence
  Synthetic
aggccctggctgctgatatgggaacacaaccagcgcacgaagaggaaccggcactataggtgaaactttaggagaaaaatggaagagtcggctaaatgcactgggaagaagtgaattccagaccttttgggacagcggtg

SEQ ID NO: 370676 - DNA, 140 bp, Artificial Sequence
  Synthetic
caccgctgtcccaaaaggtctggaattcacttcttcccagtgcatttagccgactcttccatttttctcctaaagtttcacctatagtgccggttcctcttcgtgcgctggttgtgttcccatatcagcagccagggcct

SEQ ID NO: 370677 - DNA, 140 bp, Artificial Sequence
  Synthetic
atacgccatgctgggtctccaatatacaagaaaagtgggattcaggaagtagacagaaccctggcgaaggaaggcataaaaagaggagaaacagaccaccatgccgtttcacggggctctcgtacttgggagtcggccat

SEQ ID NO: 370678 - DNA, 140 bp, Artificial Sequence
  Synthetic
atggccgactcccaagtacgagagccccgtgaaacggcatggtggtctgtttctcctctttttatgccttccttcgccagggttctgtctacttcctgaatcccacttttcttgtatattggagacccagcatggcgtat

SEQ ID NO: 370679 - DNA, 140 bp, Artificial Sequence
  Synthetic
aggccctggctgctgatatgaaggcataaaaagaggagaaacagaccaccatgccgtttcacggggctctgcaaagctgagatggtttgttgaaagaaacatggttgccccggagggaaagaccttttgggacagcggtg

SEQ ID NO: 370680 - DNA, 140 bp, Artificial Sequence
  Synthetic
caccgctgtcccaaaaggtctttccctccggggcaaccatgtttctttcaacaaaccatctcagctttgcagagccccgtgaaacggcatggtggtctgtttctcctctttttatgccttcatatcagcagccagggcct

SEQ ID NO: 370681 - DNA, 140 bp, Artificial Sequence
  Synthetic
atacgccatgctgggtctcccccatccatgacaatgagatgtgtgggagtaggaaacagagattttgtggaaggtctatcaggagctacgtgggttgacgtggtgctcgagcacggggggcgtacttgggagtcggccat

SEQ ID NO: 370682 - DNA, 140 bp, Artificial Sequence
  Synthetic
atggccgactcccaagtacgccccccgtgctcgagcaccacgtcaacccacgtagctcctgatagaccttccacaaaatctctgtttcctactcccacacatctcattgtcatggatgggggagacccagcatggcgtat

SEQ ID NO: 370683 - DNA, 140 bp, Artificial Sequence
  Synthetic
atacgccatgctgggtctccggtagtagaccttggttgtggcagaggaggatggtcatattactgtggtggactaaaaaatgtgagagaagtcaaaggcctgactaaaggaggaccaggacgtacttgggagtcggccat

SEQ ID NO: 370684 - DNA, 140 bp, Artificial Sequence
  Synthetic
atggccgactcccaagtacgtcctggtcctcctttagtcaggcctttgacttctctcacattttttagtccaccacagtaatatgaccatcctcctctgccacaaccaaggtctactaccggagacccagcatggcgtat

SEQ ID NO: 370685 - DNA, 140 bp, Artificial Sequence
  Synthetic
aggccctggctgctgatatggactaaaaaatgtgagagaagtcaaaggcctgactaaaggaggaccaggacatgaggagcctatacctatgtcaacatacgggtggaatctagtgcgactgaccttttgggacagcggtg

SEQ ID NO: 370686 - DNA, 140 bp, Artificial Sequence
  Synthetic
caccgctgtcccaaaaggtcagtcgcactagattccacccgtatgttgacataggtataggctcctcatgtcctggtcctcctttagtcaggcctttgacttctctcacattttttagtccatatcagcagccagggcct

SEQ ID NO: 370687 - DNA, 140 bp, Artificial Sequence
  Synthetic
atacgccatgctgggtctccgcagagtggagtggatgtattctttactccaccagagagatgcgacacactgctatgcgacataggagaatcatcaccaaaccccacagtggaggccggacgtacttgggagtcggccat

SEQ ID NO: 370688 - DNA, 140 bp, Artificial Sequence
  Synthetic
atggccgactcccaagtacgtccggcctccactgtggggtttggtgatgattctcctatgtcgcatagcagtgtgtcgcatctctctggtggagtaaagaatacatccactccactctgcggagacccagcatggcgtat

SEQ ID NO: 370689 - DNA, 140 bp, Artificial Sequence
  Synthetic
aggccctggctgctgatatgtgctatgcgacataggagaatcatcaccaaaccccacagtggaggccggacgaacactgagagttctcaatctagtagaaaattggttgggaagcaacacgaccttttgggacagcggtg

SEQ ID NO: 370690 - DNA, 140 bp, Artificial Sequence
  Synthetic
caccgctgtcccaaaaggtcgtgttgcttcccaaccaattttctactagattgagaactctcagtgttcgtccggcctccactgtggggtttggtgatgattctcctatgtcgcatagcacatatcagcagccagggcct

SEQ ID NO: 370691 - DNA, 140 bp, Artificial Sequence
  Synthetic
atacgccatgctgggtctccacagttttgcataaaagtccttaacccttacatgccatcagtcatagagagaatggaaacattacagagaaagtttggaggcgctctagtccgcaatccacgtacttgggagtcggccat

SEQ ID NO: 370692 - DNA, 140 bp, Artificial Sequence
  Synthetic
atggccgactcccaagtacgtggattgcggactagagcgcctccaaactttctctgtaatgtttccattctctctatgactgatggcatgtaagggttaaggacttttatgcaaaactgtggagacccagcatggcgtat

SEQ ID NO: 370693 - DNA, 140 bp, Artificial Sequence
  Synthetic
aggccctggctgctgatatgataacagactaccaagggaaaactgtgtggtttgttcccagcataaaagctggaaatgacattgcaaattgtttgagaaagtcgggaaagaaagttatccgaccttttgggacagcggtg

SEQ ID NO: 370694 - DNA, 140 bp, Artificial Sequence
  Synthetic
caccgctgtcccaaaaggtcggataactttctttcccgactttctcaaacaatttgcaatgtcatttccagcttttatgctgggaacaaaccacacagttttcccttggtagtctgttatcatatcagcagccagggcct

SEQ ID NO: 370695 - DNA, 140 bp, Artificial Sequence
  Synthetic
atacgccatgctgggtctccaaacattgtatcttctgtgaacatgatttcaaggatgttgataaatagattcacaatgaggcacaagaaagccacctacgagcctgacgttgatcttggacgtacttgggagtcggccat

SEQ ID NO: 370696 - DNA, 140 bp, Artificial Sequence
  Synthetic
atggccgactcccaagtacgtccaagatcaacgtcaggctcgtaggtggctttcttgtgcctcattgtgaatctatttatcaacatccttgaaatcatgttcacagaagatacaatgtttggagacccagcatggcgtat

SEQ ID NO: 370697 - DNA, 140 bp, Artificial Sequence
  Synthetic
aggccctggctgctgatatgtcacaatgaggcacaagaaagccacctacgagcctgacgttgatcttggaagtggaacacgcaacatcggaattgagtgtgaaacgccaaacatggacatgaccttttgggacagcggtg

SEQ ID NO: 370698 - DNA, 140 bp, Artificial Sequence
  Synthetic
caccgctgtcccaaaaggtcatgtccatgtttggcgtttcacactcaattccgatgttgcgtgttccacttccaagatcaacgtcaggctcgtaggtggctttcttgtgcctcattgtgacatatcagcagccagggcct

SEQ ID NO: 370699 - DNA, 140 bp, Artificial Sequence
  Synthetic
atacgccatgctgggtctccggctgaagaaggtcacagaagtgaagggatacacaaaaggaggacccggtcatgaggaacctatcccaatggcgacttatggatggaacatagtgaagctcgtacttgggagtcggccat

SEQ ID NO: 370700 - DNA, 140 bp, Artificial Sequence
  Synthetic
atggccgactcccaagtacgagcttcactatgttccatccataagtcgccattgggataggttcctcatgaccgggtcctccttttgtgtatcccttcacttctgtgaccttcttcagccggagacccagcatggcgtat

SEQ ID NO: 370701 - DNA, 140 bp, Artificial Sequence
  Synthetic
atacgccatgctgggtctccaattggaaaacggattgagaaaataaaacaagaacatgaagcgtcatggcactatgaccaagatcatccatacaaaacatgggcataccacggcagttatcgtacttgggagtcggccat

SEQ ID NO: 370702 - DNA, 140 bp, Artificial Sequence
  Synthetic
atggccgactcccaagtacgataactgccgtggtatgcccatgttttgtatggatgatcttggtcatagtgccatgacgcttcatgttcttgttttattttctcaatccgttttccaattggagacccagcatggcgtat

SEQ ID NO: 370703 - DNA, 140 bp, Artificial Sequence
  Synthetic
aggccctggctgctgatatgactatgaccaagatcatccatacaaaacatgggcataccacggcagttatgagacgaaacaaacaggatcagcatcatcaatggtaaacggagtggttaggaccttttgggacagcggtg

SEQ ID NO: 370704 - DNA, 140 bp, Artificial Sequence
  Synthetic
caccgctgtcccaaaaggtcctaaccactccgtttaccattgatgatgctgatcctgtttgtttcgtctcataactgccgtggtatgcccatgttttgtatggatgatcttggtcatagtcatatcagcagccagggcct

SEQ ID NO: 370705 - DNA, 140 bp, Artificial Sequence
  Synthetic
atacgccatgctgggtctccagaagtagttgtccttggatcgcaagagggagcaatgcataccgcattgacaggagccacagaaatccaaaactcaggaggcacaagtatttttgcggggcgtacttgggagtcggccat

SEQ ID NO: 370706 - DNA, 140 bp, Artificial Sequence
  Synthetic
atggccgactcccaagtacgccccgcaaaaatacttgtgcctcctgagttttggatttctgtggctcctgtcaatgcggtatgcattgctccctcttgcgatccaaggacaactacttctggagacccagcatggcgtat

SEQ ID NO: 370707 - DNA, 140 bp, Artificial Sequence
  Synthetic
atacgccatgctgggtctccgctattgacaaaaccctgggatgtcattcccatggtgacgcaaatggcaatgacagacacaaccccctttggacagcagcgtgttttcaaggaaaaagtacgtacttgggagtcggccat

SEQ ID NO: 370708 - DNA, 140 bp, Artificial Sequence
  Synthetic
atggccgactcccaagtacgtactttttccttgaaaacacgctgctgtccaaagggggttgtgtctgtcattgccatttgcgtcaccatgggaatgacatcccagggttttgtcaatagcggagacccagcatggcgtat

SEQ ID NO: 370709 - DNA, 140 bp, Artificial Sequence
  Synthetic
aggccctggctgctgatatgtgacagacacaaccccctttggacagcagcgtgttttcaaggaaaaagtagatacaagaacccaggaaccaaaagagggcacgaaaaaattgatgagaatgaccttttgggacagcggtg

SEQ ID NO: 370710 - DNA, 140 bp, Artificial Sequence
  Synthetic
caccgctgtcccaaaaggtcattctcatcaattttttcgtgccctcttttggttcctgggttcttgtatctactttttccttgaaaacacgctgctgtccaaagggggttgtgtctgtcacatatcagcagccagggcct

SEQ ID NO: 370711 - DNA, 140 bp, Artificial Sequence
  Synthetic
atacgccatgctgggtctcccacagcagagtggctttggggtgagttaggaaggagaaagaagcctagaatctgcacaagagcagagttctgtaataaagtgagaagcaacgcagctctgcgtacttgggagtcggccat

SEQ ID NO: 370712 - DNA, 140 bp, Artificial Sequence
  Synthetic
atggccgactcccaagtacgcagagctgcgttgcttctcactttattacagaactctgctcttgtgcagattctaggcttctttctccttcctaactcaccccaaagccactctgctgtgggagacccagcatggcgtat

SEQ ID NO: 370713 - DNA, 140 bp, Artificial Sequence
  Synthetic
aggccctggctgctgatatgtctgcacaagagcagagttctgtaataaagtgagaagcaacgcagctctgggggccgtgttcactgatgagaacaagtggaagtcagcacgcgaagcggtgaccttttgggacagcggtg

SEQ ID NO: 370714 - DNA, 140 bp, Artificial Sequence
  Synthetic
caccgctgtcccaaaaggtcaccgcttcgcgtgctgacttccacttgttctcatcagtgaacacggcccccagagctgcgttgcttctcactttattacagaactctgctcttgtgcagacatatcagcagccagggcct

SEQ ID NO: 370715 - DNA, 140 bp, Artificial Sequence
  Synthetic
atacgccatgctgggtctcccgaagatgaaagattttgggagctggtggaaaaagagagaaaccttcacctcgacggaaagtgtgaaacatgtgtgtacaacatgatgggaaaaagagagcgtacttgggagtcggccat

SEQ ID NO: 370716 - DNA, 140 bp, Artificial Sequence
  Synthetic
atggccgactcccaagtacgctctctttttcccatcatgttgtacacacatgtttcacactttccgtcgaggtgaaggtttctctctttttccaccagctcccaaaatctttcatcttcgggagacccagcatggcgtat

SEQ ID NO: 370717 - DNA, 140 bp, Artificial Sequence
  Synthetic
aggccctggctgctgatatgattggagacaacgccttgaaaatcaactggtataagaagggaagctctattgggaagatgttcgaggccactgccagaggtgcaaggcgcatggccatctgaccttttgggacagcggtg

SEQ ID NO: 370718 - DNA, 140 bp, Artificial Sequence
  Synthetic
caccgctgtcccaaaaggtcagatggccatgcgccttgcacctctggcagtggcctcgaacatcttcccaatagagcttcccttcttataccagttgattttcaaggcgttgtctccaatcatatcagcagccagggcct

SEQ ID NO: 370719 - DNA, 140 bp, Artificial Sequence
  Synthetic
atacgccatgctgggtctcctatgtggctaggtgcccgctttctagagtttgaggccctaggttttttgaacgaagaccattggttctctagagaaaattctctaagtggagtggaaggacgtacttgggagtcggccat

SEQ ID NO: 370720 - DNA, 140 bp, Artificial Sequence
  Synthetic
atggccgactcccaagtacgtccttccactccacttagagaattttctctagagaaccaatggtcttcgttcaaaaaacctagggcctcaaactctagaaagcgggcacctagccacataggagacccagcatggcgtat

SEQ ID NO: 370721 - DNA, 140 bp, Artificial Sequence
  Synthetic
aggccctggctgctgatatgacgaagaccattggttctctagagaaaattctctaagtggagtggaaggagaaggactgcacaagctgggctacatcctaagagacatcagcaggaaagcgaccttttgggacagcggtg

SEQ ID NO: 370722 - DNA, 140 bp, Artificial Sequence
  Synthetic
caccgctgtcccaaaaggtcgctttcctgctgatgtctcttaggatgtagcccagcttgtgcagtccttctccttccactccacttagagaattttctctagagaaccaatggtcttcgtcatatcagcagccagggcct

SEQ ID NO: 370723 - DNA, 140 bp, Artificial Sequence
  Synthetic
atacgccatgctgggtctccaggaggagcaatgtatgcagatgacactgctggttgggacacaaggatcacatctgaggatctgaagaatgaagaaatgataacagaccaaatggaagggcgtacttgggagtcggccat

SEQ ID NO: 370724 - DNA, 140 bp, Artificial Sequence
  Synthetic
atggccgactcccaagtacgcccttccatttggtctgttatcatttcttcattcttcagatcctcagatgtgatccttgtgtcccaaccagcagtgtcatctgcatacattgctcctcctggagacccagcatggcgtat

SEQ ID NO: 370725 - DNA, 140 bp, Artificial Sequence
  Synthetic
aggccctggctgctgatatgcatctgaggatctgaagaatgaagaaatgataacagaccaaatggaagggagacataagaagctggcagaggccatattcagactaacatatcagaataagaccttttgggacagcggtg

SEQ ID NO: 370726 - DNA, 140 bp, Artificial Sequence
  Synthetic
caccgctgtcccaaaaggtcttattctgatatgttagtctgaatatggcctctgccagcttcttatgtctcccttccatttggtctgttatcatttcttcattcttcagatcctcagatgcatatcagcagccagggcct

SEQ ID NO: 370727 - DNA, 140 bp, Artificial Sequence
  Synthetic
atacgccatgctgggtctccggtagttcgcgtccaaagaccaaccccaagaggcacggtgatggacatcatttcaaggagagaccaaagaggcagtgggcaggtggggacgtacggtctccgtacttgggagtcggccat

SEQ ID NO: 370728 - DNA, 140 bp, Artificial Sequence
  Synthetic
atggccgactcccaagtacggagaccgtacgtccccacctgcccactgcctctttggtctctccttgaaatgatgtccatcaccgtgcctcttggggttggtctttggacgcgaactaccggagacccagcatggcgtat

SEQ ID NO: 370729 - DNA, 140 bp, Artificial Sequence
  Synthetic
aggccctggctgctgatatgtttcaaggagagaccaaagaggcagtgggcaggtggggacgtacggtctcaacaccttcaccaatatggaagcacaactgataaggcagatggaaggggagaccttttgggacagcggtg

SEQ ID NO: 370730 - DNA, 140 bp, Artificial Sequence
  Synthetic
caccgctgtcccaaaaggtctccccttccatctgccttatcagttgtgcttccatattggtgaaggtgttgagaccgtacgtccccacctgcccactgcctctttggtctctccttgaaacatatcagcagccagggcct

SEQ ID NO: 370731 - DNA, 140 bp, Artificial Sequence
  Synthetic
atacgccatgctgggtctccaggactctttaagagcatactgcacttaacaccccaagaggaaactgctgtccacgcttggctagttagagagggacgcgaacgcctcgcaagaatggcacgtacttgggagtcggccat

SEQ ID NO: 370732 - DNA, 140 bp, Artificial Sequence
  Synthetic
atggccgactcccaagtacgtgccattcttgcgaggcgttcgcgtccctctctaactagccaagcgtggacagcagtttcctcttggggtgttaagtgcagtatgctcttaaagagtcctggagacccagcatggcgtat

SEQ ID NO: 370733 - DNA, 140 bp, Artificial Sequence
  Synthetic
aggccctggctgctgatatgtccacgcttggctagttagagagggacgcgaacgcctcgcaagaatggcaatcagtggagatgactgcgtcgtgaaaccactagatgacagattcgccaggaccttttgggacagcggtg

SEQ ID NO: 370734 - DNA, 140 bp, Artificial Sequence
  Synthetic
caccgctgtcccaaaaggtcctggcgaatctgtcatctagtggtttcacgacgcagtcatctccactgattgccattcttgcgaggcgttcgcgtccctctctaactagccaagcgtggacatatcagcagccagggcct

SEQ ID NO: 370735 - DNA, 140 bp, Artificial Sequence
  Synthetic
atacgccatgctgggtctccagctctaacagcattgaatgacatgggaaaagtgaggaaagacatacaacagtgggaaccctcaaaaggatggagtgattggacccaagtgcccttttgccgtacttgggagtcggccat

SEQ ID NO: 370736 - DNA, 140 bp, Artificial Sequence
  Synthetic
atggccgactcccaagtacggcaaaagggcacttgggtccaatcactccatccttttgagggttcccactgttgtatgtctttcctcacttttcccatgtcattcaatgctgttagagctggagacccagcatggcgtat

SEQ ID NO: 370737 - DNA, 140 bp, Artificial Sequence
  Synthetic
aggccctggctgctgatatgagtgggaaccctcaaaaggatggagtgattggacccaagtgcccttttgctctcaccactttcatgaactaataatgaaagatggtcgcaagcttgtagtgaccttttgggacagcggtg

SEQ ID NO: 370738 - DNA, 140 bp, Artificial Sequence
  Synthetic
caccgctgtcccaaaaggtcactacaagcttgcgaccatctttcattattagttcatgaaagtggtgagagcaaaagggcacttgggtccaatcactccatccttttgagggttcccactcatatcagcagccagggcct

SEQ ID NO: 370739 - DNA, 140 bp, Artificial Sequence
  Synthetic
atacgccatgctgggtctcccccatgcagaaaccaggatgaactgataggcagagcgcgcatctcccagggggcaggatggtccttgagagagacagcctgtttggggaagtcatatgcccgtacttgggagtcggccat

SEQ ID NO: 370740 - DNA, 140 bp, Artificial Sequence
  Synthetic
atggccgactcccaagtacgggcatatgacttccccaaacaggctgtctctctcaaggaccatcctgccccctgggagatgcgcgctctgcctatcagttcatcctggtttctgcatgggggagacccagcatggcgtat

SEQ ID NO: 370741 - DNA, 140 bp, Artificial Sequence
  Synthetic
aggccctggctgctgatatggggcaggatggtccttgagagagacagcctgtttggggaagtcatatgcccagatgtggagcctgatgtacttccacaggcgtgatctcaggttggctgcgaccttttgggacagcggtg

SEQ ID NO: 370742 - DNA, 140 bp, Artificial Sequence
  Synthetic
caccgctgtcccaaaaggtcgcagccaacctgagatcacgcctgtggaagtacatcaggctccacatctgggcatatgacttccccaaacaggctgtctctctcaaggaccatcctgccccatatcagcagccagggcct

SEQ ID NO: 370743 - DNA, 140 bp, Artificial Sequence
  Synthetic
atacgccatgctgggtctccaaatgccatatgttcagcagttccatcacattgggttccaactagcaggacgacttggtccatacatgctagtcatgaatggatgacgacggaagacatgcgtacttgggagtcggccat

SEQ ID NO: 370744 - DNA, 140 bp, Artificial Sequence
  Synthetic
atggccgactcccaagtacgcatgtcttccgtcgtcatccattcatgactagcatgtatggaccaagtcgtcctgctagttggaacccaatgtgatggaactgctgaacatatggcatttggagacccagcatggcgtat

SEQ ID NO: 370745 - DNA, 140 bp, Artificial Sequence
  Synthetic
aggccctggctgctgatatgggagacacccatgcagtaggaaatgacacatccaatcatggagttacagccacgataactcccaggtcaccatcggtagaagtcgaactgccggactatggaccttttgggacagcggtg

SEQ ID NO: 370746 - DNA, 140 bp, Artificial Sequence
  Synthetic
caccgctgtcccaaaaggtccatagtccggcagttcgacttctaccgatggtgacctgggagttatcgtggctgtaactccatgattggatgtgtcatttcctactgcatgggtgtctcccatatcagcagccagggcct

SEQ ID NO: 370747 - DNA, 140 bp, Artificial Sequence
  Synthetic
atacgccatgctgggtctcccaagacccccgtggaatcatgggaagacataccatatctagggaaaagggaggatcagtggtgtggttccctgattggattaacaagcagggccacttggcgtacttgggagtcggccat

SEQ ID NO: 370748 - DNA, 140 bp, Artificial Sequence
  Synthetic
atggccgactcccaagtacgccaagtggccctgcttgttaatccaatcagggaaccacaccactgatcctcccttttccctagatatggtatgtcttcccatgattccacgggggtcttgggagacccagcatggcgtat

SEQ ID NO: 370749 - DNA, 140 bp, Artificial Sequence
  Synthetic
atacgccatgctgggtctccgtttttagatctgcctcttccatgggcagcaggagcagacacatcagaggttcactggaattacaaagagagaatggtgacattcaaggttcctcatgcccgtacttgggagtcggccat

SEQ ID NO: 370750 - DNA, 140 bp, Artificial Sequence
  Synthetic
atggccgactcccaagtacgggcatgaggaaccttgaatgtcaccattctctctttgtaattccagtgaacctctgatgtgtctgctcctgctgcccatggaagaggcagatctaaaaacggagacccagcatggcgtat

SEQ ID NO: 370751 - DNA, 140 bp, Artificial Sequence
  Synthetic
atacgccatgctgggtctccccaggtcagagctctcattggtgaggaggaatacatggactacatgccctcaatgaaaaggttcagaagtgaagaggaggaatcaggagtcctgtggtaacgtacttgggagtcggccat

SEQ ID NO: 370752 - DNA, 140 bp, Artificial Sequence
  Synthetic
atggccgactcccaagtacgttaccacaggactcctgattcctcctcttcacttctgaaccttttcattgagggcatgtagtccatgtattcctcctcaccaatgagagctctgacctggggagacccagcatggcgtat

SEQ ID NO: 370753 - DNA, 140 bp, Artificial Sequence
  Synthetic
aggccctggctgctgatatgtgggaatgggcgttacctacctagctttaattgcaacatttaaaattcagccattcttggctttgggatttttcctaagaaaactgacatccagagaaaagaccttttgggacagcggtg

SEQ ID NO: 370754 - DNA, 140 bp, Artificial Sequence
  Synthetic
caccgctgtcccaaaaggtcttttctctggatgtcagttttcttaggaaaaatcccaaagccaagaatggctgaattttaaatgttgcaattaaagctaggtaggtaacgcccattcccacatatcagcagccagggcct

SEQ ID NO: 370755 - DNA, 140 bp, Artificial Sequence
  Synthetic
atacgccatgctgggtctccatggacttgggagagttatgtgaggacacaatgacctacaaatgcccccggatcactgaggcggaaccagatgacgttgactgctggtgcaatgccacagcgtacttgggagtcggccat

SEQ ID NO: 370756 - DNA, 140 bp, Artificial Sequence
  Synthetic
atggccgactcccaagtacgctgtggcattgcaccagcagtcaacgtcatctggttccgcctcagtgatccgggggcatttgtaggtcattgtgtcctcacataactctcccaagtccatggagacccagcatggcgtat

SEQ ID NO: 370757 - DNA, 140 bp, Artificial Sequence
  Synthetic
aggccctggctgctgatatgtacaaagaaggaacattccatacaatgtggcacgtcacacgtggtgctgttctgatgcatagagggaagaggattgaaccatcatgggcagatgtcaagagaccttttgggacagcggtg

SEQ ID NO: 370758 - DNA, 140 bp, Artificial Sequence
  Synthetic
caccgctgtcccaaaaggtctcttgacatctgcccatgatggttcaatcctcttccctctatgcatcagaacagcaccacgtgtgacgtgccacattgtatggaatgttccttctttgtacatatcagcagccagggcct

SEQ ID NO: 370759 - DNA, 140 bp, Artificial Sequence
  Synthetic
aggccctggctgctgatatgaagaaccgaaacatggatgtcctctgaaggcgcctggagacaaatacaaagagtggaaacttgggctttgagacacccaggattcacggtgatagcctttgaccttttgggacagcggtg

SEQ ID NO: 370760 - DNA, 140 bp, Artificial Sequence
  Synthetic
caccgctgtcccaaaaggtcaaaggctatcaccgtgaatcctgggtgtctcaaagcccaagtttccactctttgtatttgtctccaggcgccttcagaggacatccatgtttcggttcttcatatcagcagccagggcct

SEQ ID NO: 370761 - DNA, 140 bp, Artificial Sequence
  Synthetic
aggccctggctgctgatatgtgcgcaaactgtgcattgaagctaaaatatcaaacaccaccaccgattcaagatgtccaacacaaggagaggctacactggtggaagaacaagacgcgaagaccttttgggacagcggtg

SEQ ID NO: 370762 - DNA, 140 bp, Artificial Sequence
  Synthetic
caccgctgtcccaaaaggtcttcgcgtcttgttcttccaccagtgtagcctctccttgtgttggacatcttgaatcggtggtggtgtttgatattttagcttcaatgcacagtttgcgcacatatcagcagccagggcct

SEQ ID NO: 370763 - DNA, 140 bp, Artificial Sequence
  Synthetic
aggccctggctgctgatatgttttcacagcacaattaccgccagggctatgccacgcaaaccgtgggcccatggcacttaggcaaactagagatagactttggagaatgccccggaacaagaccttttgggacagcggtg

SEQ ID NO: 370764 - DNA, 140 bp, Artificial Sequence
  Synthetic
caccgctgtcccaaaaggtcttgttccggggcattctccaaagtctatctctagtttgcctaagtgccatgggcccacggtttgcgtggcatagccctggcggtaattgtgctgtgaaaacatatcagcagccagggcct

SEQ ID NO: 370765 - DNA, 140 bp, Artificial Sequence
  Synthetic
atacgccatgctgggtctccatacagctgactgactacggagccctcacattggactgctcacctagaacagggctggactttaatgagatggtgctattgacaatgaaagaaaaatcatcgtacttgggagtcggccat

SEQ ID NO: 370766 - DNA, 140 bp, Artificial Sequence
  Synthetic
atggccgactcccaagtacgatgatttttctttcattgtcaatagcaccatctcattaaagtccagccctgttctaggtgagcagtccaatgtgagggctccgtagtcagtcagctgtatggagacccagcatggcgtat

SEQ ID NO: 370767 - DNA, 140 bp, Artificial Sequence
  Synthetic
atacgccatgctgggtctccaccactgcatctggaaaactagtcacgcaatggtgttgccgctcctgcacgatgccccccttaaggttcttgggagaagatggatgctggtatgggatggcgtacttgggagtcggccat

SEQ ID NO: 370768 - DNA, 140 bp, Artificial Sequence
  Synthetic
atggccgactcccaagtacgccatcccataccagcatccatcttctcccaagaaccttaaggggggcatcgtgcaggagcggcaacaccattgcgtgactagttttccagatgcagtggtggagacccagcatggcgtat

SEQ ID NO: 370769 - DNA, 140 bp, Artificial Sequence
  Synthetic
atacgccatgctgggtctccagattaggcccttgagtgaaaaagaagagaacatggtcaagtcacaggtggcggccggacagggcacatcagaaactttttctatgggtctgttgtgcctcgtacttgggagtcggccat

SEQ ID NO: 370770 - DNA, 140 bp, Artificial Sequence
  Synthetic
atggccgactcccaagtacgaggcacaacagacccatagaaaaagtttctgatgtgccctgtccggccgccacctgtgacttgaccatgttctcttctttttcactcaagggcctaatctggagacccagcatggcgtat

SEQ ID NO: 370771 - DNA, 140 bp, Artificial Sequence
  Synthetic
aggccctggctgctgatatgtcaggaacgacaacaatcttcgcaggacacctgaaatgcagactaaaaatggataaactgaccttaaaggggatgtcatatgtgatgtgcacaggctcatgaccttttgggacagcggtg

SEQ ID NO: 370772 - DNA, 140 bp, Artificial Sequence
  Synthetic
caccgctgtcccaaaaggtcatgagcctgtgcacatcacatatgacatcccctttaaggtcagtttatccatttttagtctgcatttcaggtgtcctgcgaagattgttgtcgttcctgacatatcagcagccagggcct

SEQ ID NO: 370773 - DNA, 140 bp, Artificial Sequence
  Synthetic
atacgccatgctgggtctcctggtagaataggaggacagacccacctagccatcatggcagtgttcaagatgtcaccaggatacgtgctgggtgtgtttttaaggaaactcacttcaagacgtacttgggagtcggccat

SEQ ID NO: 370774 - DNA, 140 bp, Artificial Sequence
  Synthetic
atggccgactcccaagtacgtcttgaagtgagtttccttaaaaacacacccagcacgtatcctggtgacatcttgaacactgccatgatggctaggtgggtctgtcctcctattctaccaggagacccagcatggcgtat

SEQ ID NO: 370775 - DNA, 140 bp, Artificial Sequence
  Synthetic
aggccctggctgctgatatggggaaatatgtatgcagacgacacagctggatgggacacaagaataacagaggatgatcttcagaatgaggctaaaatcaccgacatcatggagcctgaagaccttttgggacagcggtg

SEQ ID NO: 370776 - DNA, 140 bp, Artificial Sequence
  Synthetic
caccgctgtcccaaaaggtcttcaggctccatgatgtcggtgattttagcctcattctgaagatcatcctctgttattcttgtgtcccatccagctgtgtcgtctgcatacatatttccccatatcagcagccagggcct

SEQ ID NO: 370777 - DNA, 140 bp, Artificial Sequence
  Synthetic
atacgccatgctgggtctccccaagatgagaaaggagtgacccagaatgggagattgataacagccaatcccatagttactgacaaagaaaaaccagtcaacattgagacagaaccacctcgtacttgggagtcggccat

SEQ ID NO: 370778 - DNA, 140 bp, Artificial Sequence
  Synthetic
atggccgactcccaagtacgaggtggttctgtctcaatgttgactggtttttctttgtcagtaactatgggattggctgttatcaatctcccattctgggtcactcctttctcatcttggggagacccagcatggcgtat

SEQ ID NO: 370779 - DNA, 140 bp, Artificial Sequence
  Synthetic
atacgccatgctgggtctccagatggggacagttaaagaaaaataaggccatcaaaatactgactggattcagaaaggagataggccgtatgctgaacatcttgaatggaaggaaaaggtcgtacttgggagtcggccat

SEQ ID NO: 370780 - DNA, 140 bp, Artificial Sequence
  Synthetic
atggccgactcccaagtacgaccttttccttccattcaagatgttcagcatacggcctatctcctttctgaatccagtcagtattttgatggccttatttttctttaactgtccccatctggagacccagcatggcgtat

SEQ ID NO: 370781 - DNA, 140 bp, Artificial Sequence
  Synthetic
aggccctggctgctgatatgaaataggaatagggattctgctgacatggttgggattaaattcaaggagcacgtcactttcgatgacgtgcattgcagttggcatggtcacactgtacctgaccttttgggacagcggtg

SEQ ID NO: 370782 - DNA, 140 bp, Artificial Sequence
  Synthetic
caccgctgtcccaaaaggtcaggtacagtgtgaccatgccaactgcaatgcacgtcatcgaaagtgacgtgctccttgaatttaatcccaaccatgtcagcagaatccctattcctatttcatatcagcagccagggcct

SEQ ID NO: 370783 - DNA, 140 bp, Artificial Sequence
  Synthetic
atacgccatgctgggtctccagggatcataccagctctctttgagccagaaagggagaagtcagccgccatagacggtgagtatcgcctaaaaggtgagtccaggaagactttcgtggaacgtacttgggagtcggccat

SEQ ID NO: 370784 - DNA, 140 bp, Artificial Sequence
  Synthetic
atggccgactcccaagtacgttccacgaaagtcttcctggactcaccttttaggcgatactcaccgtctatggcggctgacttctccctttctggctcaaagagagctggtatgatccctggagacccagcatggcgtat

SEQ ID NO: 370785 - DNA, 140 bp, Artificial Sequence
  Synthetic
atacgccatgctgggtctcctcaagtttttggcgcaatctatggcgccgcctttagcggggtttcatggaccatgaagatcctcataggggtggttataacatggataggaatgaactcccgtacttgggagtcggccat

SEQ ID NO: 370786 - DNA, 140 bp, Artificial Sequence
  Synthetic
atggccgactcccaagtacgggagttcattcctatccatgttataaccacccctatgaggatcttcatggtccatgaaaccccgctaaaggcggcgccatagattgcgccaaaaacttgaggagacccagcatggcgtat

SEQ ID NO: 370787 - DNA, 140 bp, Artificial Sequence
  Synthetic
atacgccatgctgggtctcccgatggccaaagagcatggaacatttgggaagttgaggactatgggtttggagttttcacgacaaacatatggctgaaattgcgtgactcctacacccaacgtacttgggagtcggccat

SEQ ID NO: 370788 - DNA, 140 bp, Artificial Sequence
  Synthetic
atggccgactcccaagtacgttgggtgtaggagtcacgcaatttcagccatatgtttgtcgtgaaaactccaaacccatagtcctcaacttcccaaatgttccatgctctttggccatcgggagacccagcatggcgtat

SEQ ID NO: 370789 - DNA, 140 bp, Artificial Sequence
  Synthetic
atacgccatgctgggtctcccaatggaaacactcctactcttgggactcatgatcttgttgacaggtggagcaatgcttttcttaatatcaggtaaagggattggaaagacttcaataggcgtacttgggagtcggccat

SEQ ID NO: 370790 - DNA, 140 bp, Artificial Sequence
  Synthetic
atggccgactcccaagtacgcctattgaagtctttccaatccctttacctgatattaagaaaagcattgctccacctgtcaacaagatcatgagtcccaagagtaggagtgtttccattgggagacccagcatggcgtat

SEQ ID NO: 370791 - DNA, 140 bp, Artificial Sequence
  Synthetic
aggccctggctgctgatatgagccgaaagaattggagagccagattatgaagtggatgaggatatttttcgaaagaaaagattaactataatggacttacaccccggagctggaaagacagaccttttgggacagcggtg

SEQ ID NO: 370792 - DNA, 140 bp, Artificial Sequence
  Synthetic
caccgctgtcccaaaaggtctgtctttccagctccggggtgtaagtccattatagttaatcttttctttcgaaaaatatcctcatccacttcataatctggctctccaattctttcggctcatatcagcagccagggcct

SEQ ID NO: 370793 - DNA, 140 bp, Artificial Sequence
  Synthetic
aggccctggctgctgatatgcacacaggaagagagattgtagaccttatgtgtcatgcaaccttcacaacaagacttttgtcatcaaccagggttccaaattacaaccttatagtgatgggaccttttgggacagcggtg

SEQ ID NO: 370794 - DNA, 140 bp, Artificial Sequence
  Synthetic
caccgctgtcccaaaaggtcccatcactataaggttgtaatttggaaccctggttgatgacaaaagtcttgttgtgaaggttgcatgacacataaggtctacaatctctcttcctgtgtgcatatcagcagccagggcct

SEQ ID NO: 370795 - DNA, 140 bp, Artificial Sequence
  Synthetic
atacgccatgctgggtctccatagccaaccaggcagtggtcctgatgggtttggacaaaggatggccaatatcaaaaatggacttaggagtacccctactggcattgggttgctattcaccgtacttgggagtcggccat

SEQ ID NO: 370796 - DNA, 140 bp, Artificial Sequence
  Synthetic
atggccgactcccaagtacggtgaatagcaacccaatgccagtaggggtactcctaagtccatttttgatattggccatcctttgtccaaacccatcaggaccactgcctggttggctatggagacccagcatggcgtat

SEQ ID NO: 370797 - DNA, 140 bp, Artificial Sequence
  Synthetic
aggccctggctgctgatatgagatggagtagaaagatgctgatgactggaacactggctgttttcctccttcttataatgggacaactgacatggaatgatctgattaggttatgcatcagaccttttgggacagcggtg

SEQ ID NO: 370798 - DNA, 140 bp, Artificial Sequence
  Synthetic
caccgctgtcccaaaaggtctgatgcataacctaatcagatcattccatgtcagttgtcccattataagaaggaggaaaacagccagtgttccagtcatcagcatctttctactccatctcatatcagcagccagggcct

SEQ ID NO: 370799 - DNA, 140 bp, Artificial Sequence
  Synthetic
atacgccatgctgggtctcctatgctattataggtccaggattgcaggcaaaagccactcgtgaagctcagaaaaggacagctgctggaataatgaagaatccaacggtggatgggataacgtacttgggagtcggccat

SEQ ID NO: 370800 - DNA, 140 bp, Artificial Sequence
  Synthetic
atggccgactcccaagtacgttatcccatccaccgttggattcttcattattccagcagctgtccttttctgagcttcacgagtggcttttgcctgcaatcctggacctataatagcataggagacccagcatggcgtat

SEQ ID NO: 370801 - DNA, 140 bp, Artificial Sequence
  Synthetic
atacgccatgctgggtctcctaacagaatggtgctgccgatcctgcacactaccacctctaagatacagaggtgaggatggatgctggtacgggatggaaattagaccattgaaagagaacgtacttgggagtcggccat

SEQ ID NO: 370802 - DNA, 140 bp, Artificial Sequence
  Synthetic
atggccgactcccaagtacgttctctttcaatggtctaatttccatcccgtaccagcatccatcctcacctctgtatcttagaggtggtagtgtgcaggatcggcagcaccattctgttaggagacccagcatggcgtat

SEQ ID NO: 370803 - DNA, 140 bp, Artificial Sequence
  Synthetic
atacgccatgctgggtctcctaacaacactctgggaaggatcacctgggaagttttggaacaccacgatagctgtttccatggcgaacatttttagagggagctatttagcaggagctggcgtacttgggagtcggccat

SEQ ID NO: 370804 - DNA, 140 bp, Artificial Sequence
  Synthetic
atggccgactcccaagtacgccagctcctgctaaatagctccctctaaaaatgttcgccatggaaacagctatcgtggtgttccaaaacttcccaggtgatccttcccagagtgttgttaggagacccagcatggcgtat

SEQ ID NO: 370805 - DNA, 140 bp, Artificial Sequence
  Synthetic
aggccctggctgctgatatggctgtttccatggcgaacatttttagagggagctatttagcaggagctgggcttgctttttccattatgaaatcagtaggaacaggaaaaagaggaacaggaccttttgggacagcggtg

SEQ ID NO: 370806 - DNA, 140 bp, Artificial Sequence
  Synthetic
caccgctgtcccaaaaggtcctgttcctctttttcctgttcctactgatttcataatggaaaaagcaagcccagctcctgctaaatagctccctctaaaaatgttcgccatggaaacagccatatcagcagccagggcct

SEQ ID NO: 370807 - DNA, 140 bp, Artificial Sequence
  Synthetic
atacgccatgctgggtctccgcttgctttttccattatgaaatcagtaggaacaggaaaaagaggaacaggctcacaaggtgaaactttaggagaaaaatggaaaaagaagttaaatcaacgtacttgggagtcggccat

SEQ ID NO: 370808 - DNA, 140 bp, Artificial Sequence
  Synthetic
atggccgactcccaagtacgttgatttaacttctttttccatttttctcctaaagtttcaccttgtgagcctgttcctctttttcctgttcctactgatttcataatggaaaaagcaagcggagacccagcatggcgtat

SEQ ID NO: 370809 - DNA, 140 bp, Artificial Sequence
  Synthetic
aggccctggctgctgatatgagaacaaagaactgaaatgtggaagtggaatctttgtgactgacaatgtgcacacttggacggaacaatacaaatttcaaccagactccccttcaaagttgaccttttgggacagcggtg

SEQ ID NO: 370810 - DNA, 140 bp, Artificial Sequence
  Synthetic
caccgctgtcccaaaaggtcaactttgaaggggagtctggttgaaatttgtattgttccgtccaagtgtgcacattgtcagtcacaaagattccacttccacatttcagttctttgttctcatatcagcagccagggcct

SEQ ID NO: 370811 - DNA, 140 bp, Artificial Sequence
  Synthetic
atacgccatgctgggtctccttatcccggaaagactttgacctttacaagaaatctggaatcactgaagtggatagaacagaagccaaagaagggttgaaaagaggagaaataacacatccgtacttgggagtcggccat

SEQ ID NO: 370812 - DNA, 140 bp, Artificial Sequence
  Synthetic
atggccgactcccaagtacggatgtgttatttctcctcttttcaacccttctttggcttctgttctatccacttcagtgattccagatttcttgtaaaggtcaaagtctttccgggataaggagacccagcatggcgtat

SEQ ID NO: 370813 - DNA, 140 bp, Artificial Sequence
  Synthetic
atacgccatgctgggtctcctgatgtgccgttggccgggccactaatagctggaggcatgctaatagcatgttatgtcatatccggaagctcagccgatttatcattggagaaagcggctcgtacttgggagtcggccat

SEQ ID NO: 370814 - DNA, 140 bp, Artificial Sequence
  Synthetic
atggccgactcccaagtacgagccgctttctccaatgataaatcggctgagcttccggatatgacataacatgctattagcatgcctccagctattagtggcccggccaacggcacatcaggagacccagcatggcgtat

SEQ ID NO: 370815 - DNA, 140 bp, Artificial Sequence
  Synthetic
atacgccatgctgggtctccattagtagaggtccaagatgatggaactatgaaaataaaagatgaagagagggatgacacactcactatactccttaaagcaactttgctggcagtctcacgtacttgggagtcggccat

SEQ ID NO: 370816 - DNA, 140 bp, Artificial Sequence
  Synthetic
atggccgactcccaagtacgtgagactgccagcaaagttgctttaaggagtatagtgagtgtgtcatccctctcttcatcttttattttcatagttccatcatcttggacctctactaatggagacccagcatggcgtat

SEQ ID NO: 370817 - DNA, 140 bp, Artificial Sequence
  Synthetic
atacgccatgctgggtctcctggaactctggacatgagtgggttacagattttaaagggaagactgtttggtttgttccgagtataaaagcaggaaatgatatagcagcttgcctgagaacgtacttgggagtcggccat

SEQ ID NO: 370818 - DNA, 140 bp, Artificial Sequence
  Synthetic
atggccgactcccaagtacgttctcaggcaagctgctatatcatttcctgcttttatactcggaacaaaccaaacagtcttccctttaaaatctgtaacccactcatgtccagagttccaggagacccagcatggcgtat

SEQ ID NO: 370819 - DNA, 140 bp, Artificial Sequence
  Synthetic
atacgccatgctgggtctccggagtgtacccaatgtcaataccagcaactctttttgtgtggtacttttggcagaaaaagaaacagagatcaggagtgttatgggacacacccagccctccgtacttgggagtcggccat

SEQ ID NO: 370820 - DNA, 140 bp, Artificial Sequence
  Synthetic
atggccgactcccaagtacggagggctgggtgtgtcccataacactcctgatctctgtttctttttctgccaaaagtaccacacaaaaagagttgctggtattgacattgggtacactccggagacccagcatggcgtat

SEQ ID NO: 370821 - DNA, 140 bp, Artificial Sequence
  Synthetic
atacgccatgctgggtctccgatgaaaaaggagtaacccagaatgggagattgataacagctaaccccatagttactgacaaagaaaaaccagtcaacattgaggcagaaccgccttttgcgtacttgggagtcggccat

SEQ ID NO: 370822 - DNA, 140 bp, Artificial Sequence
  Synthetic
atggccgactcccaagtacgcaaaaggcggttctgcctcaatgttgactggtttttctttgtcagtaactatggggttagctgttatcaatctcccattctgggttactcctttttcatcggagacccagcatggcgtat

SEQ ID NO: 370823 - DNA, 140 bp, Artificial Sequence
  Synthetic
aggccctggctgctgatatgtcggttccataggaggagtgttcacatctgtgggaaaactggtacaccaggttttcggaaccgcatatggggttttgttcagcggtgtctcttggaccatgaccttttgggacagcggtg

SEQ ID NO: 370824 - DNA, 140 bp, Artificial Sequence
  Synthetic
caccgctgtcccaaaaggtcatggtccaagagacaccgctgaacaaaaccccatatgcggttccgaaaacctggtgtaccagttttcccacagatgtgaacactcctcctatggaaccgacatatcagcagccagggcct

SEQ ID NO: 370825 - DNA, 140 bp, Artificial Sequence
  Synthetic
atacgccatgctgggtctccgctttttcactcataaagaatgcacaaacccctaggaggggaactgggaccacaggagagacactgggagagaagtggaagagacagctaaactcattagcgtacttgggagtcggccat

SEQ ID NO: 370826 - DNA, 140 bp, Artificial Sequence
  Synthetic
atggccgactcccaagtacgctaatgagtttagctgtctcttccacttctctcccagtgtctctcctgtggtcccagttcccctcctaggggtttgtgcattctttatgagtgaaaaagcggagacccagcatggcgtat

SEQ ID NO: 370827 - DNA, 140 bp, Artificial Sequence
  Synthetic
atacgccatgctgggtctccaggccataaaaaggaaactgcgtacgttaatcttggctcccacaagagttgtcgcctctgaaatggcagaggcactcaagggaatgccaataagatatcacgtacttgggagtcggccat

SEQ ID NO: 370828 - DNA, 140 bp, Artificial Sequence
  Synthetic
atggccgactcccaagtacgtgatatcttattggcattcccttgagtgcctctgccatttcagaggcgacaactcttgtgggagccaagattaacgtacgcagtttcctttttatggcctggagacccagcatggcgtat

SEQ ID NO: 370829 - DNA, 140 bp, Artificial Sequence
  Synthetic
aggccctggctgctgatatgggactaacgcagccatgggcgccgttttcacagaggagaaccaatgggacagcgcgaaagctgctgttgaggatgaggatttttggaaacttgtggacaggaccttttgggacagcggtg

SEQ ID NO: 370830 - DNA, 140 bp, Artificial Sequence
  Synthetic
caccgctgtcccaaaaggtcctgtccacaagtttccaaaaatcctcatcctcaacagcagctttcgcgctgtcccattggttctcctctgtgaaaacggcgcccatggctgcgttagtcccatatcagcagccagggcct

SEQ ID NO: 370831 - DNA, 140 bp, Artificial Sequence
  Synthetic
aggccctggctgctgatatgcacggtaatggacatcatatctaggaaagaccaaagaggcagtggacaggtaggaacttatggtctgaatacattcaccaacatggaagcccagttaatcgaccttttgggacagcggtg

SEQ ID NO: 370832 - DNA, 140 bp, Artificial Sequence
  Synthetic
caccgctgtcccaaaaggtcgattaactgggcttccatgttggtgaatgtattcagaccataagttcctacctgtccactgcctctttggtctttcctagatatgatgtccattaccgtgcatatcagcagccagggcct

SEQ ID NO: 370833 - DNA, 140 bp, Artificial Sequence
  Synthetic
aggccctggctgctgatatgctgagctgagatactcatggaaaacttggggaaaagcgaaggtactatcaacagaacttcaaaatcagactttcctcatagacggtcctgaaacaactgagaccttttgggacagcggtg

SEQ ID NO: 370834 - DNA, 140 bp, Artificial Sequence
  Synthetic
caccgctgtcccaaaaggtctcagttgtttcaggaccgtctatgaggaaagtctgattttgaagttctgttgatagtaccttcgcttttccccaagttttccatgagtatctcagctcagcatatcagcagccagggcct

SEQ ID NO: 370835 - DNA, 140 bp, Artificial Sequence
  Synthetic
aggccctggctgctgatatgggcaacaggttcctttctgctcccaccactttcatgaattgatcatgaaagatggaagaaagttggtggttccctgcagaccccaggacgaactaatagggaccttttgggacagcggtg

SEQ ID NO: 370836 - DNA, 140 bp, Artificial Sequence
  Synthetic
caccgctgtcccaaaaggtccctattagttcgtcctggggtctgcagggaaccaccaactttcttccatctttcatgatcaattcatgaaagtggtgggagcagaaaggaacctgttgcccatatcagcagccagggcct

SEQ ID NO: 370837 - DNA, 140 bp, Artificial Sequence
  Synthetic
atacgccatgctgggtctccagccagagagagaaaagagtgcagcaatagacggggagtacagactgcggggagaagcaaggaaaacgttcgtggagctcatgagaagaggagatctacccgtacttgggagtcggccat

SEQ ID NO: 370838 - DNA, 140 bp, Artificial Sequence
  Synthetic
atggccgactcccaagtacgggtagatctcctcttctcatgagctccacgaacgttttccttgcttctccccgcagtctgtactccccgtctattgctgcactcttttctctctctggctggagacccagcatggcgtat

SEQ ID NO: 370839 - DNA, 140 bp, Artificial Sequence
  Synthetic
aggccctggctgctgatatggtctggggaaagcctacgcccaaatgtggagtctcatgtattttcatagaagagacctcagactagcatccaacgccatatgttcagcagtaccagtccagaccttttgggacagcggtg

SEQ ID NO: 370840 - DNA, 140 bp, Artificial Sequence
  Synthetic
caccgctgtcccaaaaggtctggactggtactgctgaacatatggcgttggatgctagtctgaggtctcttctatgaaaatacatgagactccacatttgggcgtaggctttccccagaccatatcagcagccagggcct

SEQ ID NO: 370841 - DNA, 140 bp, Artificial Sequence
  Synthetic
aggccctggctgctgatatgatggacgtggagatctggacaaaggaaggagaaagaaagaaattgcgacctcgctggttggacgccagaacatactctgatccattggccctgcgcgagtgaccttttgggacagcggtg

SEQ ID NO: 370842 - DNA, 140 bp, Artificial Sequence
  Synthetic
caccgctgtcccaaaaggtcactcgcgcagggccaatggatcagagtatgttctggcgtccaaccagcgaggtcgcaatttctttctttctccttcctttgtccagatctccacgtccatcatatcagcagccagggcct

SEQ ID NO: 370843 - DNA, 140 bp, Artificial Sequence
  Synthetic
aggccctggctgctgatatggccaaatggaagctgaaggagtcatcacacaagatgacatgcagaacccaaaagggttgaaagaaagagttgagaaatggctgagagagtgtggtgtcgagaccttttgggacagcggtg

SEQ ID NO: 370844 - DNA, 140 bp, Artificial Sequence
  Synthetic
caccgctgtcccaaaaggtctcgacaccacactctctcagccatttctcaactctttctttcaacccttttgggttctgcatgtcatcttgtgtgatgactccttcagcttccatttggccatatcagcagccagggcct

SEQ ID NO: 370845 - DNA, 140 bp, Artificial Sequence
  Synthetic
aggccctggctgctgatatggctttgatagctgtgttgactggtggagtgacgctgttcttcctatcaggaaaaggtctagggaaaacatccattggcttgctctgtgtgacggcctcaagaccttttgggacagcggtg

SEQ ID NO: 370846 - DNA, 140 bp, Artificial Sequence
  Synthetic
caccgctgtcccaaaaggtcttgaggccgtcacacagagcaagccaatggatgttttccctagaccttttcctgataggaagaacagcgtcactccaccagtcaacacagctatcaaagccatatcagcagccagggcct

SEQ ID NO: 370847 - DNA, 140 bp, Artificial Sequence
  Synthetic
aggccctggctgctgatatgccacatcaacctgggtgacgtacgggacgtgcagctcgacaggagagcataggagggagaaaaggtcagtcgcacttgtcccacatgtaggaatggggctgaccttttgggacagcggtg

SEQ ID NO: 370848 - DNA, 140 bp, Artificial Sequence
  Synthetic
caccgctgtcccaaaaggtcagccccattcctacatgtgggacaagtgcgactgaccttttctccctcctatgctctcctgtcgagctgcacgtcccgtacgtcacccaggttgatgtggcatatcagcagccagggcct

SEQ ID NO: 370849 - DNA, 140 bp, Artificial Sequence
  Synthetic
atacgccatgctgggtctcctggtttccaacaagcagaacaacatggtcaatccatgctcatcaccaatggatgaccactgaagacatgctcaaagtgtggaacagagtgtggatagaagcgtacttgggagtcggccat

SEQ ID NO: 370850 - DNA, 140 bp, Artificial Sequence
  Synthetic
atggccgactcccaagtacgcttctatccacactctgttccacactttgagcatgtcttcagtggtcatccattggtgatgagcatggattgaccatgttgttctgcttgttggaaaccaggagacccagcatggcgtat

SEQ ID NO: 370851 - DNA, 140 bp, Artificial Sequence
  Synthetic
aggccctggctgctgatatgattgatgggacttgacaagggatggccaatatcgaagatggacataggagttccacttctcgccttagggtgctattcccaggtgaacccattgacactggaccttttgggacagcggtg

SEQ ID NO: 370852 - DNA, 140 bp, Artificial Sequence
  Synthetic
caccgctgtcccaaaaggtccagtgtcaatgggttcacctgggaatagcaccctaaggcgagaagtggaactcctatgtccatcttcgatattggccatcccttgtcaagtcccatcaatcatatcagcagccagggcct

SEQ ID NO: 370853 - DNA, 140 bp, Artificial Sequence
  Synthetic
aggccctggctgctgatatggcgcatgattgtggggaagaatgaaagagggaaatccctactttttaagacggcctctggaatcaacatgtgcacactcatagccatggacttgggagaggaccttttgggacagcggtg

SEQ ID NO: 370854 - DNA, 140 bp, Artificial Sequence
  Synthetic
caccgctgtcccaaaaggtcctctcccaagtccatggctatgagtgtgcacatgttgattccagaggccgtcttaaaaagtagggatttccctctttcattcttccccacaatcatgcgccatatcagcagccagggcct

SEQ ID NO: 370855 - DNA, 140 bp, Artificial Sequence
  Synthetic
aggccctggctgctgatatgcacctacaaaaggagtgggattatggaggtggacagatccgaagccaaagagggactgaaaagaggagaaacaaccaaacatgcagtgtcgagaggaacagaccttttgggacagcggtg

SEQ ID NO: 370856 - DNA, 140 bp, Artificial Sequence
  Synthetic
caccgctgtcccaaaaggtctgttcctctcgacactgcatgtttggttgtttctcctcttttcagtccctctttggcttcggatctgtccacctccataatcccactccttttgtaggtgcatatcagcagccagggcct

SEQ ID NO: 370857 - DNA, 140 bp, Artificial Sequence
  Synthetic
aggccctggctgctgatatgagggactgaaaagaggagaaacaaccaaacatgcagtgtcgagaggaacagccaaactgaggtggtttgtggagaggaacctcgtgaaaccagaagggaagaccttttgggacagcggtg

SEQ ID NO: 370858 - DNA, 140 bp, Artificial Sequence
  Synthetic
caccgctgtcccaaaaggtcttcccttctggtttcacgaggttcctctccacaaaccacctcagtttggctgttcctctcgacactgcatgtttggttgtttctcctcttttcagtccctcatatcagcagccagggcct

SEQ ID NO: 370859 - DNA, 140 bp, Artificial Sequence
  Synthetic
aggccctggctgctgatatggagaactaacactcgattgtgaacccaggtctggaattgactttaatgaaatgatcttaatgaaaatgaaaaagaaaacatggctcgtgcataagcaatggaccttttgggacagcggtg

SEQ ID NO: 370860 - DNA, 140 bp, Artificial Sequence
  Synthetic
caccgctgtcccaaaaggtccattgcttatgcacgagccatgttttctttttcattttcattaagatcatttcattaaagtcaattccagacctgggttcacaatcgagtgttagttctccatatcagcagccagggcct

SEQ ID NO: 370861 - DNA, 140 bp, Artificial Sequence
  Synthetic
aggccctggctgctgatatgcatgaggaacctatcccaatggcgacctatggatggaacctagtaaagctacactctggaaaggatgtattttttatgccacctgagaaatgtgacacccgaccttttgggacagcggtg

SEQ ID NO: 370862 - DNA, 140 bp, Artificial Sequence
  Synthetic
caccgctgtcccaaaaggtcgggtgtcacatttctcaggtggcataaaaaatacatcctttccagagtgtagctttactaggttccatccataggtcgccattgggataggttcctcatgcatatcagcagccagggcct

SEQ ID NO: 370863 - DNA, 140 bp, Artificial Sequence
  Synthetic
atacgccatgctgggtctccttctgtgtgatattggtgagtcctctccgaatccaactatagaagaaggaagaacgttacgtgttctaaaaatggtggaaccatggctcagaggaaaccacgtacttgggagtcggccat

SEQ ID NO: 370864 - DNA, 140 bp, Artificial Sequence
  Synthetic
atggccgactcccaagtacgtggtttcctctgagccatggttccaccatttttagaacacgtaacgttcttccttcttctatagttggattcggagaggactcaccaatatcacacagaaggagacccagcatggcgtat

SEQ ID NO: 370865 - DNA, 140 bp, Artificial Sequence
  Synthetic
aggccctggctgctgatatgcaatggctcacaggaagccaacatatgaaagagacgtggacttaggcgctggaacaagacatgtggcagtggaaccagaggtagccaacctagatatcatgaccttttgggacagcggtg

SEQ ID NO: 370866 - DNA, 140 bp, Artificial Sequence
  Synthetic
caccgctgtcccaaaaggtcatgatatctaggttggctacctctggttccactgccacatgtcttgttccagcgcctaagtccacgtctctttcatatgttggcttcctgtgagccattgcatatcagcagccagggcct

SEQ ID NO: 370867 - DNA, 140 bp, Artificial Sequence
  Synthetic
atacgccatgctgggtctccgcacaagagaggagttcacaagaaaggttaggtcaaacgcagcaataggagcagtgttcgttgatgaaaaccaatggaactcagcaaaagaagcagtggacgtacttgggagtcggccat

SEQ ID NO: 370868 - DNA, 140 bp, Artificial Sequence
  Synthetic
atggccgactcccaagtacgtccactgcttcttttgctgagttccattggttttcatcaacgaacactgctcctattgctgcgtttgacctaacctttcttgtgaactcctctcttgtgcggagacccagcatggcgtat

SEQ ID NO: 370869 - DNA, 140 bp, Artificial Sequence
  Synthetic
atacgccatgctgggtctccaggacagctgctggaatcatgaaaaatcccacagtggacgggataacagtaatagatctagaaccaatatcctatgacccaaaatttgaaaagcaattagcgtacttgggagtcggccat

SEQ ID NO: 370870 - DNA, 140 bp, Artificial Sequence
  Synthetic
atggccgactcccaagtacgctaattgcttttcaaattttgggtcataggatattggttctagatctattactgttatcccgtccactgtgggatttttcatgattccagcagctgtcctggagacccagcatggcgtat

SEQ ID NO: 370871 - DNA, 140 bp, Artificial Sequence
  Synthetic
atacgccatgctgggtctccagggaaaatgtgccacgtgtgtctacaacatgatggggaagagagagaaaaaattaggagagtttggaaaggcaaaaggaagtcgtgcaatatggtacatcgtacttgggagtcggccat

SEQ ID NO: 370872 - DNA, 140 bp, Artificial Sequence
  Synthetic
atggccgactcccaagtacgatgtaccatattgcacgacttccttttgcctttccaaactctcctaattttttctctctcttccccatcatgttgtagacacacgtggcacattttccctggagacccagcatggcgtat

SEQ ID NO: 370873 - DNA, 140 bp, Artificial Sequence
  Synthetic
atacgccatgctgggtctccgtggctgggagcacgctttctggagttcgaagcccttggtttcatgaatgaagatcactggtttagtagagagaattcactcagtggagtggaaggagaacgtacttgggagtcggccat

SEQ ID NO: 370874 - DNA, 140 bp, Artificial Sequence
  Synthetic
atggccgactcccaagtacgttctccttccactccactgagtgaattctctctactaaaccagtgatcttcattcatgaaaccaagggcttcgaactccagaaagcgtgctcccagccacggagacccagcatggcgtat

SEQ ID NO: 370875 - DNA, 140 bp, Artificial Sequence
  Synthetic
atacgccatgctgggtctccagagccagaatctcgcagggggctggatggagcttaagagaaacagcctgcctgggcaaagcttacgcccagatgtggtcgcttatgtacttccacagaacgtacttgggagtcggccat

SEQ ID NO: 370876 - DNA, 140 bp, Artificial Sequence
  Synthetic
atggccgactcccaagtacgttctgtggaagtacataagcgaccacatctgggcgtaagctttgcccaggcaggctgtttctcttaagctccatccagccccctgcgagattctggctctggagacccagcatggcgtat

SEQ ID NO: 370877 - DNA, 140 bp, Artificial Sequence
  Synthetic
atacgccatgctgggtctcccatgctctattggctacgtcaatttttaagctgacttatcaaaacaaggtggtgagggtgcaaagaccagcaaaaaatggaaccgtgatggatgttatatcgtacttgggagtcggccat

SEQ ID NO: 370878 - DNA, 140 bp, Artificial Sequence
  Synthetic
atggccgactcccaagtacgatataacatccatcacggttccattttttgctggtctttgcaccctcaccaccttgttttgataagtcagcttaaaaattgacgtagccaatagagcatgggagacccagcatggcgtat

SEQ ID NO: 370879 - DNA, 140 bp, Artificial Sequence
  Synthetic
atacgccatgctgggtctccaaacttcaatggttcgtggagaggaacatggtcattcccgaaggaagagtcatagacttaggctgtggaagaggaggctggtcatattattgcgcaggaccgtacttgggagtcggccat

SEQ ID NO: 370880 - DNA, 140 bp, Artificial Sequence
  Synthetic
atggccgactcccaagtacggtcctgcgcaataatatgaccagcctcctcttccacagcctaagtctatgactcttccttcgggaatgaccatgttcctctccacgaaccattgaagtttggagacccagcatggcgtat

SEQ ID NO: 370881 - DNA, 140 bp, Artificial Sequence
  Synthetic
atacgccatgctgggtctccccagacgtgatcagagaggaagtggacaggtcggaacttatggcttaaacactttcaccaatatggaggtccaactaataagacaaatggaatctgaaggcgtacttgggagtcggccat

SEQ ID NO: 370882 - DNA, 140 bp, Artificial Sequence
  Synthetic
atggccgactcccaagtacgccttcagattccatttgtcttattagttggacctccatattggtgaaagtgtttaagccataagttccgacctgtccacttcctctctgatcacgtctggggagacccagcatggcgtat

SEQ ID NO: 370883 - DNA, 140 bp, Artificial Sequence
  Synthetic
aggccctggctgctgatatgctgagtggtgctgcagatcatgcacattaccaccactaagatacagaggagaggatggatgctggtacggaatggaaattagaccactgaaagaaagagagaccttttgggacagcggtg

SEQ ID NO: 370884 - DNA, 140 bp, Artificial Sequence
  Synthetic
caccgctgtcccaaaaggtctctctttctttcagtggtctaatttccattccgtaccagcatccatcctctcctctgtatcttagtggtggtaatgtgcatgatctgcagcaccactcagcatatcagcagccagggcct

SEQ ID NO: 370885 - DNA, 140 bp, Artificial Sequence
  Synthetic
aggccctggctgctgatatgagcggagatgattgcgtggtgaaaccaattgacgacaggttcgcaacagccttaacagctctgaatgacatgggaaaagtaagaaaagacataccgcagtgaccttttgggacagcggtg

SEQ ID NO: 370886 - DNA, 140 bp, Artificial Sequence
  Synthetic
caccgctgtcccaaaaggtcactgcggtatgtcttttcttacttttcccatgtcattcagagctgttaaggctgttgcgaacctgtcgtcaattggtttcaccacgcaatcatctccgctcatatcagcagccagggcct

SEQ ID NO: 370887 - DNA, 140 bp, Artificial Sequence
  Synthetic
aggccctggctgctgatatgatgccgcaaccaagatgaacttgtgggcagggctagagtatcacaaggcgccggatggagcctgagagaaactgcttgcctaggcaagtcatatgcacaagaccttttgggacagcggtg

SEQ ID NO: 370888 - DNA, 140 bp, Artificial Sequence
  Synthetic
caccgctgtcccaaaaggtcttgtgcatatgacttgcctaggcaagcagtttctctcaggctccatccggcgccttgtgatactctagccctgcccacaagttcatcttggttgcggcatcatatcagcagccagggcct

SEQ ID NO: 370889 - DNA, 140 bp, Artificial Sequence
  Synthetic
atacgccatgctgggtctccccggatggagcctgagagaaactgcttgcctaggcaagtcatatgcacaaatgtggcagctgatgtacttccacaggagagacctgagactagcggctaacgtacttgggagtcggccat

SEQ ID NO: 370890 - DNA, 140 bp, Artificial Sequence
  Synthetic
atggccgactcccaagtacgttagccgctagtctcaggtctctcctgtggaagtacatcagctgccacatttgtgcatatgacttgcctaggcaagcagtttctctcaggctccatccggggagacccagcatggcgtat

SEQ ID NO: 370891 - DNA, 140 bp, Artificial Sequence
  Synthetic
atacgccatgctgggtctccatccatcacactggccactggacctctgaccacgctttgggagggatctccaggaaaattttggaacaccacgatagcggtttccatggcaaacattttccgtacttgggagtcggccat

SEQ ID NO: 370892 - DNA, 140 bp, Artificial Sequence
  Synthetic
atggccgactcccaagtacggaaaatgtttgccatggaaaccgctatcgtggtgttccaaaattttcctggagatccctcccaaagcgtggtcagaggtccagtggccagtgtgatggatggagacccagcatggcgtat

SEQ ID NO: 370893 - DNA, 140 bp, Artificial Sequence
  Synthetic
atacgccatgctgggtctccagagaacctggtgaactcattggttacagccggacatggccaaattgacaatttctcactagggattttgggaatggcattgctcttggaagagatgcttcgtacttgggagtcggccat

SEQ ID NO: 370894 - DNA, 140 bp, Artificial Sequence
  Synthetic
atggccgactcccaagtacgaagcatctcttccaagagcaatgccattcccaaaatccctagtgagaaattgtcaatttggccatgtccggctgtaaccaatgagttcaccaggttctctggagacccagcatggcgtat

SEQ ID NO: 370895 - DNA, 140 bp, Artificial Sequence
  Synthetic
aggccctggctgctgatatgatagaagatcaaacaaagtgagaagtcaggccagattaagccatagtacggaaagagctatgctgcctgtgagccccgtccaaggacgtaaaatgaagtcgaccttttgggacagcggtg

SEQ ID NO: 370896 - DNA, 140 bp, Artificial Sequence
  Synthetic
caccgctgtcccaaaaggtcgacttcattttacgtccttggacggggctcacaggcagcatagctctttccgtactatggcttaatctggcctgacttctcactttgtttgatcttctatcatatcagcagccagggcct

SEQ ID NO: 370897 - DNA, 140 bp, Artificial Sequence
  Synthetic
atacgccatgctgggtctccctttgtgtgtcgccgaacgtttgtggacagaggctggggtaatggctgtggactattcggaaagggaagtctattgacgtgtgccaagttcaagtgtgtgcgtacttgggagtcggccat

SEQ ID NO: 370898 - DNA, 140 bp, Artificial Sequence
  Synthetic
atggccgactcccaagtacgcacacacttgaacttggcacacgtcaatagacttccctttccgaatagtccacagccattaccccagcctctgtccacaaacgttcggcgacacacaaagggagacccagcatggcgtat

SEQ ID NO: 370899 - DNA, 140 bp, Artificial Sequence
  Synthetic
aggccctggctgctgatatgtttggacaaaggatggccaatatcaaaaatggacttaggagtacccctactggcattgggttgctattcacaagtgaacccactgactctaacagcggcagaccttttgggacagcggtg

SEQ ID NO: 370900 - DNA, 140 bp, Artificial Sequence
  Synthetic
caccgctgtcccaaaaggtctgccgctgttagagtcagtgggttcacttgtgaatagcaacccaatgccagtaggggtactcctaagtccatttttgatattggccatcctttgtccaaacatatcagcagccagggcct

SEQ ID NO: 370901 - DNA, 140 bp, Artificial Sequence
  Synthetic
aggccctggctgctgatatgacaaatactcatggaaaagctggggaaaagctaaaatcataggagcagacatacaaaataccaccttcatcatcgacggcccagacaccccagaatgtccgaccttttgggacagcggtg

SEQ ID NO: 370902 - DNA, 140 bp, Artificial Sequence
  Synthetic
caccgctgtcccaaaaggtcggacattctggggtgtctgggccgtcgatgatgaaggtggtattttgtatgtctgctcctatgattttagcttttccccagcttttccatgagtatttgtcatatcagcagccagggcct

SEQ ID NO: 370903 - DNA, 140 bp, Artificial Sequence
  Synthetic
atacgccatgctgggtctccttgggagcacgctttctagagttcgaagctcttggtttcatgaacgaagatcactggttcagcagagagaattcactcagcggagtggaaggagaaggaccgtacttgggagtcggccat

SEQ ID NO: 370904 - DNA, 140 bp, Artificial Sequence
  Synthetic
atggccgactcccaagtacggtccttctccttccactccgctgagtgaattctctctgctgaaccagtgatcttcgttcatgaaaccaagagcttcgaactctagaaagcgtgctcccaaggagacccagcatggcgtat

SEQ ID NO: 370905 - DNA, 140 bp, Artificial Sequence
  Synthetic
aggccctggctgctgatatgagccggaccgatgccagtgactgtggccagtgctgcccagaggagaggaagaattggaaggaaccaaaacaaggaaggtgatcagtatatttacatgggagaccttttgggacagcggtg

SEQ ID NO: 370906 - DNA, 140 bp, Artificial Sequence
  Synthetic
caccgctgtcccaaaaggtctcccatgtaaatatactgatcaccttccttgttttggttccttccaattcttcctctcctctgggcagcactggccacagtcactggcatcggtccggctcatatcagcagccagggcct

SEQ ID NO: 370907 - DNA, 140 bp, Artificial Sequence
  Synthetic
aggccctggctgctgatatggagatgattgcgtggtgaaaccaattgatgataggtttgcaacagccttaacagctctgaatgatatgggaaaagtaagaaaagatataccacaatgggagaccttttgggacagcggtg

SEQ ID NO: 370908 - DNA, 140 bp, Artificial Sequence
  Synthetic
caccgctgtcccaaaaggtctcccattgtggtatatcttttcttacttttcccatatcattcagagctgttaaggctgttgcaaacctatcatcaattggtttcaccacgcaatcatctccatatcagcagccagggcct

SEQ ID NO: 370909 - DNA, 140 bp, Artificial Sequence
  Synthetic
aggccctggctgctgatatggattgctttcaggccaaggacccatgaaattggtgatggctttcatagcatttctaagatttctagccatacccccaacagcaggaattttggctagatggaccttttgggacagcggtg

SEQ ID NO: 370910 - DNA, 140 bp, Artificial Sequence
  Synthetic
caccgctgtcccaaaaggtccatctagccaaaattcctgctgttgggggtatggctagaaatcttagaaatgctatgaaagccatcaccaatttcatgggtccttggcctgaaagcaatccatatcagcagccagggcct

SEQ ID NO: 370911 - DNA, 140 bp, Artificial Sequence
  Synthetic
aggccctggctgctgatatgaccatgctcctcatgctgctgcccacagccctggccttccatttgactacacgagggggagagccacacatgatagtcagcaagcaggaaagaggaaagtgaccttttgggacagcggtg

SEQ ID NO: 370912 - DNA, 140 bp, Artificial Sequence
  Synthetic
caccgctgtcccaaaaggtcactttcctctttcctgcttgctgactatcatgtgtggctctccccctcgtgtagtcaaatggaaggccagggctgtgggcagcagcatgaggagcatggtcatatcagcagccagggcct

SEQ ID NO: 370913 - DNA, 140 bp, Artificial Sequence
  Synthetic
atacgccatgctgggtctccactaagacaacagccaaggaagtggctctgttaagaacctattgtattgaagcctcaatatcaaacataactacggcaacaagatgtccaacgcaaggagcgtacttgggagtcggccat

SEQ ID NO: 370914 - DNA, 140 bp, Artificial Sequence
  Synthetic
atggccgactcccaagtacgctccttgcgttggacatcttgttgccgtagttatgtttgatattgaggcttcaatacaataggttcttaacagagccacttccttggctgttgtcttagtggagacccagcatggcgtat

SEQ ID NO: 370915 - DNA, 140 bp, Artificial Sequence
  Synthetic
aggccctggctgctgatatgtaggcaatagagacttcgttgaaggactgtcaggagcaacgtgggtggatgtggtactggagcatggaagctgcgtcaccaccatggcaaaaaacaaaccgaccttttgggacagcggtg

SEQ ID NO: 370916 - DNA, 140 bp, Artificial Sequence
  Synthetic
caccgctgtcccaaaaggtcggtttgttttttgccatggtggtgacgcagcttccatgctccagtaccacatccacccacgttgctcctgacagtccttcaacgaagtctctattgcctacatatcagcagccagggcct

SEQ ID NO: 370917 - DNA, 140 bp, Artificial Sequence
  Synthetic
aggccctggctgctgatatgtgcgcaaactgtgcattgaagctaaaatatcaaacaccaccaccgattcaagatgtccaacacaaggagaagccacactggtggaagaacaagacgcgaagaccttttgggacagcggtg

SEQ ID NO: 370918 - DNA, 140 bp, Artificial Sequence
  Synthetic
caccgctgtcccaaaaggtcttcgcgtcttgttcttccaccagtgtggcttctccttgtgttggacatcttgaatcggtggtggtgtttgatattttagcttcaatgcacagtttgcgcacatatcagcagccagggcct

SEQ ID NO: 370919 - DNA, 140 bp, Artificial Sequence
  Synthetic
atacgccatgctgggtctccagatgtccaacacaaggagaagccacactggtggaagaacaagacgcgaactttgtgtgtcgacgaacgttcgtggacagaggctggggtaatggctgcgcgtacttgggagtcggccat

SEQ ID NO: 370920 - DNA, 140 bp, Artificial Sequence
  Synthetic
atggccgactcccaagtacgcgcagccattaccccagcctctgtccacgaacgttcgtcgacacacaaagttcgcgtcttgttcttccaccagtgtggcttctccttgtgttggacatctggagacccagcatggcgtat

SEQ ID NO: 370921 - DNA, 140 bp, Artificial Sequence
  Synthetic
aggccctggctgctgatatgctttgtgtgtcgacgaacgttcgtggacagaggctggggtaatggctgcggactatttggaaaaggaagtctactgacgtgtgctaagttcaagtgtgtggaccttttgggacagcggtg

SEQ ID NO: 370922 - DNA, 140 bp, Artificial Sequence
  Synthetic
caccgctgtcccaaaaggtccacacacttgaacttagcacacgtcagtagacttccttttccaaatagtccgcagccattaccccagcctctgtccacgaacgttcgtcgacacacaaagcatatcagcagccagggcct

SEQ ID NO: 370923 - DNA, 140 bp, Artificial Sequence
  Synthetic
aggccctggctgctgatatgtcttaacaactctgtctagacccagtaaaataagaagttggcctcttaatgaagccatcatggcagttggaatggtgagcatattagctagttccctcttgaccttttgggacagcggtg

SEQ ID NO: 370924 - DNA, 140 bp, Artificial Sequence
  Synthetic
caccgctgtcccaaaaggtcaagagggaactagctaatatgctcaccattccaactgccatgatggcttcattaagaggccaacttcttattttactgggtctagacagagttgttaagacatatcagcagccagggcct

SEQ ID NO: 370925 - DNA, 140 bp, Artificial Sequence
  Synthetic
aggccctggctgctgatatgttaagctagagaaggaagtggctgagacccagcatggaactgttttagtgcaggttaaatacgaaggaacagatgcaccatgcaagatcccttttttgacgaccttttgggacagcggtg

SEQ ID NO: 370926 - DNA, 140 bp, Artificial Sequence
  Synthetic
caccgctgtcccaaaaggtcgtcaaaaaagggatcttgcatggtgcatctgttccttcgtatttaacctgcactaaaacagttccatgctgggtctcagccacttccttctctagcttaacatatcagcagccagggcct

SEQ ID NO: 370927 - DNA, 140 bp, Artificial Sequence
  Synthetic
aggccctggctgctgatatgcccgaggagcacgaaggatggccatcctgggagacactgcatgggacttcggctctataggaggattgttcacgtccgtgggaaaattgatacaccaggtgaccttttgggacagcggtg

SEQ ID NO: 370928 - DNA, 140 bp, Artificial Sequence
  Synthetic
caccgctgtcccaaaaggtcacctggtgtatcaattttcccacggacgtgaacaatcctcctatagagccgaagtcccatgcagtgtctcccaggatggccatccttcgtgctcctcgggcatatcagcagccagggcct

SEQ ID NO: 370929 - DNA, 140 bp, Artificial Sequence
  Synthetic
atacgccatgctgggtctccacgtcactttcaatgacgtgcattgcagttggcatggtcacactgtacctaggagtcatggttcaagcggactcgggatgtgtgatcaactggaagggcacgtacttgggagtcggccat

SEQ ID NO: 370930 - DNA, 140 bp, Artificial Sequence
  Synthetic
atggccgactcccaagtacgtgcccttccagttgatcacacatcccgagtccgcttgaaccatgactcctaggtacagtgtgaccatgccaactgcaatgcacgtcattgaaagtgacgtggagacccagcatggcgtat

SEQ ID NO: 370931 - DNA, 140 bp, Artificial Sequence
  Synthetic
aggccctggctgctgatatgtcttccacctgaaaagtgtgacaccctgttgtgtgacattggagaatcttcaccaagcccaacagtggaagaaagcagaactataagagttttgaagatggaccttttgggacagcggtg

SEQ ID NO: 370932 - DNA, 140 bp, Artificial Sequence
  Synthetic
caccgctgtcccaaaaggtccatcttcaaaactcttatagttctgctttcttccactgttgggcttggtgaagattctccaatgtcacacaacagggtgtcacacttttcaggtggaagacatatcagcagccagggcct

SEQ ID NO: 370933 - DNA, 140 bp, Artificial Sequence
  Synthetic
aggccctggctgctgatatgtggacagagcaatacaaattccaggctgactccccaaaaagactgtcagcagccattggaaaggcatgggaggaaggcgtgtgtggaattcgatcagccagaccttttgggacagcggtg

SEQ ID NO: 370934 - DNA, 140 bp, Artificial Sequence
  Synthetic
caccgctgtcccaaaaggtctggctgatcgaattccacacacgccttcctcccatgcctttccaatggctgctgacagtctttttggggagtcagcctggaatttgtattgctctgtccacatatcagcagccagggcct

SEQ ID NO: 370935 - DNA, 140 bp, Artificial Sequence
  Synthetic
aggccctggctgctgatatgatcctacttgaaaatgacatgaaattcacagtggttgtaggagacgtcaatggaattttggcccaagggaaaaaaatgattagaccacaacccatggaacgaccttttgggacagcggtg

SEQ ID NO: 370936 - DNA, 140 bp, Artificial Sequence
  Synthetic
caccgctgtcccaaaaggtcgttccatgggttgtggtctaatcatttttttcccttgggccaaaattccattgacgtctcctacaaccactgtgaatttcatgtcattttcaagtaggatcatatcagcagccagggcct

SEQ ID NO: 370937 - DNA, 140 bp, Artificial Sequence
  Synthetic
atacgccatgctgggtctccacaaatactcatggaaaagttggggaaaagccaagatcataggagcagacatacagaacaccacctttatcattgacggcccagatactccagaatgccccgtacttgggagtcggccat

SEQ ID NO: 370938 - DNA, 140 bp, Artificial Sequence
  Synthetic
atggccgactcccaagtacggggcattctggagtatctgggccgtcaatgataaaggtggtgttctgtatgtctgctcctatgatcttggcttttccccaacttttccatgagtatttgtggagacccagcatggcgtat

SEQ ID NO: 370939 - DNA, 140 bp, Artificial Sequence
  Synthetic
aggccctggctgctgatatgatacagaacaccacctttatcattgacggcccagatactccagaatgccccgatgaccaaagagcatggaacatttgggaagttgaggactacgggttcggaccttttgggacagcggtg

SEQ ID NO: 370940 - DNA, 140 bp, Artificial Sequence
  Synthetic
caccgctgtcccaaaaggtccgaacccgtagtcctcaacttcccaaatgttccatgctctttggtcatcggggcattctggagtatctgggccgtcaatgataaaggtggtgttctgtatcatatcagcagccagggcct

SEQ ID NO: 370941 - DNA, 140 bp, Artificial Sequence
  Synthetic
aggccctggctgctgatatgccatgctgatatggggtactggatagaaagtgaaaagaacgagacctggaagctagcgagagcctcctttatagaagtcaagacatgcatctggccgaaagaccttttgggacagcggtg

SEQ ID NO: 370942 - DNA, 140 bp, Artificial Sequence
  Synthetic
caccgctgtcccaaaaggtctttcggccagatgcatgtcttgacttctataaaggaggctctcgctagcttccaggtctcgttcttttcactttctatccagtaccccatatcagcatggcatatcagcagccagggcct

SEQ ID NO: 370943 - DNA, 140 bp, Artificial Sequence
  Synthetic
atacgccatgctgggtctccaggtcaggactaacgcagccatgggcgccgttttcacagaggagaaccaatgggacagcgcgaaagctgctgttgaggatgaggatttttggaaacttgtcgtacttgggagtcggccat

SEQ ID NO: 370944 - DNA, 140 bp, Artificial Sequence
  Synthetic
atggccgactcccaagtacgacaagtttccaaaaatcctcatcctcaacagcagctttcgcgctgtcccattggttctcctctgtgaaaacggcgcccatggctgcgttagtcctgacctggagacccagcatggcgtat

SEQ ID NO: 370945 - DNA, 140 bp, Artificial Sequence
  Synthetic
aggccctggctgctgatatgaggaagaagagcagactctaaccatactgataaggacaggactgttagtaatatcaggactattcccagtatcaatcccaatcacagccgcggcctggtagaccttttgggacagcggtg

SEQ ID NO: 370946 - DNA, 140 bp, Artificial Sequence
  Synthetic
caccgctgtcccaaaaggtctaccaggccgcggctgtgattgggattgatactgggaatagtcctgatattactaacagtcctgtccttatcagtatggttagagtctgctcttcttcctcatatcagcagccagggcct

SEQ ID NO: 370947 - DNA, 140 bp, Artificial Sequence
  Synthetic
atacgccatgctgggtctccatggagtgctggaaagccagatgcttattccaaaatcatatgcgggccctttttcacagcacaattaccgccagggctatgctacgcaaaccgtgggccccgtacttgggagtcggccat

SEQ ID NO: 370948 - DNA, 140 bp, Artificial Sequence
  Synthetic
atggccgactcccaagtacggggcccacggtttgcgtagcatagccctggcggtaattgtgctgtgaaaaagggcccgcatatgattttggaataagcatctggctttccagcactccatggagacccagcatggcgtat

SEQ ID NO: 370949 - DNA, 140 bp, Artificial Sequence
  Synthetic
atacgccatgctgggtctccttaagggacatttccaagatacccggaggagccatgtatgctgatgacacagctggttgggacacaagaataacagaagatgacttgcacaatgaggaaacgtacttgggagtcggccat

SEQ ID NO: 370950 - DNA, 140 bp, Artificial Sequence
  Synthetic
atggccgactcccaagtacgtttcctcattgtgcaagtcatcttctgttattcttgtgtcccaaccagctgtgtcatcagcatacatggctcctccgggtatcttggaaatgtcccttaaggagacccagcatggcgtat

SEQ ID NO: 370951 - DNA, 140 bp, Artificial Sequence
  Synthetic
atacgccatgctgggtctccgccttgatggccactttcaaaatgagaccaatgttcgctgttgggctattatttcgcagactaacatccagagaagttcttcttctcacggttggattaacgtacttgggagtcggccat

SEQ ID NO: 370952 - DNA, 140 bp, Artificial Sequence
  Synthetic
atggccgactcccaagtacgttaatccaaccgtgagaagaagaacttctctggatgttagtctgcgaaataatagcccaacagcgaacattggtctcattttgaaagtggccatcaaggcggagacccagcatggcgtat

SEQ ID NO: 370953 - DNA, 140 bp, Artificial Sequence
  Synthetic
atacgccatgctgggtctccgaccattatggctgtgttgtttgtggtcacactcattcctttgtgcaggacaagctgtcttcaaaaacagtctcattgggtagaaataacagcacttatccgtacttgggagtcggccat

SEQ ID NO: 370954 - DNA, 140 bp, Artificial Sequence
  Synthetic
atggccgactcccaagtacggataagtgctgttatttctacccaatgagactgtttttgaagacagcttgtcctgcacaaaggaatgagtgtgaccacaaacaacacagccataatggtcggagacccagcatggcgtat

SEQ ID NO: 370955 - DNA, 140 bp, Artificial Sequence
  Synthetic
aggccctggctgctgatatgtaacagaaaacaaaatctggggaaggaaaagctggcccatcaatgaaggaattatggctgttggaatagtcagcattctactaagttcactcctcaaaaagaccttttgggacagcggtg

SEQ ID NO: 370956 - DNA, 140 bp, Artificial Sequence
  Synthetic
caccgctgtcccaaaaggtctttttgaggagtgaacttagtagaatgctgactattccaacagccataattccttcattgatgggccagcttttccttccccagattttgttttctgttacatatcagcagccagggcct

SEQ ID NO: 370957 - DNA, 140 bp, Artificial Sequence
  Synthetic
atacgccatgctgggtctcctgatgtgccgctagccggcccactaatagctggaggcatgctaatagcatgttatgtcatatctggaagctcagctgatttatcattggaaaaagcggctcgtacttgggagtcggccat

SEQ ID NO: 370958 - DNA, 140 bp, Artificial Sequence
  Synthetic
atggccgactcccaagtacgagccgctttttccaatgataaatcagctgagcttccagatatgacataacatgctattagcatgcctccagctattagtgggccggctagcggcacatcaggagacccagcatggcgtat

SEQ ID NO: 370959 - DNA, 140 bp, Artificial Sequence
  Synthetic
atacgccatgctgggtctccgaggtatcctgggaagaagaagcagaacactccggcacctcacacaacatattagtggaggtccaagatgatggaactatgaaaataaaagatgaagagacgtacttgggagtcggccat

SEQ ID NO: 370960 - DNA, 140 bp, Artificial Sequence
  Synthetic
atggccgactcccaagtacgtctcttcatcttttattttcatagttccatcatcttggacctccactaatatgttgtgtgaggtgccggagtgttctgcttcttcttcccaggatacctcggagacccagcatggcgtat

SEQ ID NO: 370961 - DNA, 140 bp, Artificial Sequence
  Synthetic
aggccctggctgctgatatgattagtggaggtccaagatgatggaactatgaaaataaaagatgaagagagggatgatacactcaccatactcctcaaagcaactctgctggcagtctcagaccttttgggacagcggtg

SEQ ID NO: 370962 - DNA, 140 bp, Artificial Sequence
  Synthetic
caccgctgtcccaaaaggtctgagactgccagcagagttgctttgaggagtatggtgagtgtatcatccctctcttcatcttttattttcatagttccatcatcttggacctccactaatcatatcagcagccagggcct

SEQ ID NO: 370963 - DNA, 140 bp, Artificial Sequence
  Synthetic
aggccctggctgctgatatgatcagtggatgaccacagaagacatgcttactgtctggaacagggtgtggatcgaggacaatccatggatggaagacaaaactccagtcacaacctgggagaccttttgggacagcggtg

SEQ ID NO: 370964 - DNA, 140 bp, Artificial Sequence
  Synthetic
caccgctgtcccaaaaggtctcccaggttgtgactggagttttgtcttccatccatggattgtcctcgatccacaccctgttccagacagtaagcatgtcttctgtggtcatccactgatcatatcagcagccagggcct

SEQ ID NO: 370965 - DNA, 140 bp, Artificial Sequence
  Synthetic
atacgccatgctgggtctccatatggaagcccaactaatcagacagatggagggagaaggagtcttcaaaagcattcagcacctgacagtcacagaagaaatcgccgtgcaaaactggttcgtacttgggagtcggccat

SEQ ID NO: 370966 - DNA, 140 bp, Artificial Sequence
  Synthetic
atggccgactcccaagtacgaaccagttttgcacggcgatttcttctgtgactgtcaggtgctgaatgcttttgaagactccttctccctccatctgtctgattagttgggcttccatatggagacccagcatggcgtat

SEQ ID NO: 370967 - DNA, 140 bp, Artificial Sequence
  Synthetic
aggccctggctgctgatatgcgtgttccacacaatgtggcacgtcaccaggggagctgtccttatgtaccaagggaagaggctggaaccaagctgggccagtgtcaaaaaagacttgatcgaccttttgggacagcggtg

SEQ ID NO: 370968 - DNA, 140 bp, Artificial Sequence
  Synthetic
caccgctgtcccaaaaggtcgatcaagtcttttttgacactggcccagcttggttccagcctcttcccttggtacataaggacagctcccctggtgacgtgccacattgtgtggaacacgcatatcagcagccagggcct

SEQ ID NO: 370969 - DNA, 140 bp, Artificial Sequence
  Synthetic
atacgccatgctgggtctcctgtcccaatgaacgaagagcatggaattttcttgaggtagaagactatggatttggcatgttcacgaccaacatatggatgaaatttcgagaaggaagttcgtacttgggagtcggccat

SEQ ID NO: 370970 - DNA, 140 bp, Artificial Sequence
  Synthetic
atggccgactcccaagtacgaacttccttctcgaaatttcatccatatgttggtcgtgaacatgccaaatccatagtcttctacctcaagaaaattccatgctcttcgttcattgggacaggagacccagcatggcgtat

SEQ ID NO: 370971 - DNA, 140 bp, Artificial Sequence
  Synthetic
atacgccatgctgggtctccgagattgaggacgaggtgtttaagaaaagaaacttaacaataatggacctgcatccaggatcagggaaaacaagaagatatcttccagccatagtccgtgcgtacttgggagtcggccat

SEQ ID NO: 370972 - DNA, 140 bp, Artificial Sequence
  Synthetic
atggccgactcccaagtacgcacggactatggctggaagatatcttcttgttttccctgatcctggatgcaggtccattattgttaagtttcttttcttaaacacctcgtcctcaatctcggagacccagcatggcgtat

SEQ ID NO: 370973 - DNA, 140 bp, Artificial Sequence
  Synthetic
atacgccatgctgggtctccagccaagtggttgtggggattcctctctagaaataaaaaacccagaatttgcacaagagaggagttcacaagaaaagttaggtcaaacgcagcaattggacgtacttgggagtcggccat

SEQ ID NO: 370974 - DNA, 140 bp, Artificial Sequence
  Synthetic
atggccgactcccaagtacgtccaattgctgcgtttgacctaacttttcttgtgaactcctctcttgtgcaaattctgggttttttatttctagagaggaatccccacaaccacttggctggagacccagcatggcgtat

SEQ ID NO: 370975 - DNA, 140 bp, Artificial Sequence
  Synthetic
aggccctggctgctgatatgaattacaacatgattatcatggatgaagcacactttaccgatccagccagcatagcagccagagggtacatctcaacccgagtgggtatgggtgaagcaggaccttttgggacagcggtg

SEQ ID NO: 370976 - DNA, 140 bp, Artificial Sequence
  Synthetic
caccgctgtcccaaaaggtcctgcttcacccatacccactcgggttgagatgtaccctctggctgctatgctggctggatcggtaaagtgtgcttcatccatgataatcatgttgtaattcatatcagcagccagggcct

SEQ ID NO: 370977 - DNA, 140 bp, Artificial Sequence
  Synthetic
atacgccatgctgggtctccggtttgttccaagcatcaaatcaggaaatgacattgctaactgtttaagaaagaacggaaaacgggtgattcaactgagcaggaaaacctttgacactgacgtacttgggagtcggccat

SEQ ID NO: 370978 - DNA, 140 bp, Artificial Sequence
  Synthetic
atggccgactcccaagtacgtcagtgtcaaaggttttcctgctcagttgaatcacccgttttccgttctttcttaaacagttagcaatgtcatttcctgatttgatgcttggaacaaaccggagacccagcatggcgtat

SEQ ID NO: 370979 - DNA, 140 bp, Artificial Sequence
  Synthetic
aggccctggctgctgatatgacaacatgggctttctgtgaagtcttgactttggccacaggaccaatcttgaccttgtgggagggcaacccgggaaggttttggaacacgaccatagccggaccttttgggacagcggtg

SEQ ID NO: 370980 - DNA, 140 bp, Artificial Sequence
  Synthetic
caccgctgtcccaaaaggtccggctatggtcgtgttccaaaaccttcccgggttgccctcccacaaggtcaagattggtcctgtggccaaagtcaagacttcacagaaagcccatgttgtcatatcagcagccagggcct

SEQ ID NO: 370981 - DNA, 140 bp, Artificial Sequence
  Synthetic
aggccctggctgctgatatggtaccagaaaacaaaaaacaatgactgggactatgttgtcacaacagacatttccgaaatgggagcaaatttccgggccgacagggtaatagatccaagggaccttttgggacagcggtg

SEQ ID NO: 370982 - DNA, 140 bp, Artificial Sequence
  Synthetic
caccgctgtcccaaaaggtcccttggatctattaccctgtcggcccggaaatttgctcccatttcggaaatgtctgttgtgacaacatagtcccagtcattgttttttgttttctggtaccatatcagcagccagggcct

SEQ ID NO: 370983 - DNA, 140 bp, Artificial Sequence
  Synthetic
aggccctggctgctgatatgtttccgaaatgggagcaaatttccgggccgacagggtaatagatccaaggcggtgcttgaaaccggtaatactaaaggaaggtccagagcgcgttattctgaccttttgggacagcggtg

SEQ ID NO: 370984 - DNA, 140 bp, Artificial Sequence
  Synthetic
caccgctgtcccaaaaggtcagaataacgcgctctggaccttcctttagtattaccggtttcaagcaccgccttggatctattaccctgtcggcccggaaatttgctcccatttcggaaacatatcagcagccagggcct

SEQ ID NO: 370985 - DNA, 140 bp, Artificial Sequence
  Synthetic
atacgccatgctgggtctcccagcctttaaataatgatgaggatcacgctcattggacagaagcaaaaatgctccttgacaatataaacacaccagaagggatcatcccagccctctttgcgtacttgggagtcggccat

SEQ ID NO: 370986 - DNA, 140 bp, Artificial Sequence
  Synthetic
atggccgactcccaagtacgcaaagagggctgggatgatcccttctggtgtgtttatattgtcaaggagcatttttgcttctgtccaatgagcgtgatcctcatcattatttaaaggctgggagacccagcatggcgtat

SEQ ID NO: 370987 - DNA, 140 bp, Artificial Sequence
  Synthetic
aggccctggctgctgatatgtattcatgatactgacagtggcagctaatgagatgggattgttggaaaccacaaagaaagacctggggattggccatgtagccgtcgaaaaccaccaccagaccttttgggacagcggtg

SEQ ID NO: 370988 - DNA, 140 bp, Artificial Sequence
  Synthetic
caccgctgtcccaaaaggtctggtggtggttttcgacggctacatggccaatccccaggtctttctttgtggtttccaacaatcccatctcattagctgccactgtcagtatcatgaatacatatcagcagccagggcct

SEQ ID NO: 370989 - DNA, 140 bp, Artificial Sequence
  Synthetic
aggccctggctgctgatatgatgcagtagccacaacagttatcacccccatgatgagacacacaattgaaaatacaacggcaaatatttctctgacagccatcgcaaaccaggctgctatgaccttttgggacagcggtg

SEQ ID NO: 370990 - DNA, 140 bp, Artificial Sequence
  Synthetic
caccgctgtcccaaaaggtcatagcagcctggtttgcgatggctgtcagagaaatatttgccgttgtattttcaattgtgtgtctcatcatgggggtgataactgttgtggctactgcatcatatcagcagccagggcct

SEQ ID NO: 370991 - DNA, 140 bp, Artificial Sequence
  Synthetic
atacgccatgctgggtctcctgatgtacttccacagacgtgacctcaggctggcggctaatgctatttgctcggcagtcccatcacattgggttccaacaagtagaacaacctggtccatcgtacttgggagtcggccat

SEQ ID NO: 370992 - DNA, 140 bp, Artificial Sequence
  Synthetic
atggccgactcccaagtacgatggaccaggttgttctacttgttggaacccaatgtgatgggactgccgagcaaatagcattagccgccagcctgaggtcacgtctgtggaagtacatcaggagacccagcatggcgtat

SEQ ID NO: 370993 - DNA, 140 bp, Artificial Sequence
  Synthetic
aggccctggctgctgatatggtggtttatgatgcaaaatttgaaaaacagctaggccaaataatgttactgatactttgtacatcacagattctcttgatgcggaccacatgggccttgtgaccttttgggacagcggtg

SEQ ID NO: 370994 - DNA, 140 bp, Artificial Sequence
  Synthetic
caccgctgtcccaaaaggtcacaaggcccatgtggtccgcatcaagagaatctgtgatgtacaaagtatcagtaacattatttggcctagctgtttttcaaattttgcatcataaaccaccatatcagcagccagggcct

SEQ ID NO: 370995 - DNA, 140 bp, Artificial Sequence
  Synthetic
atacgccatgctgggtctccgatactttgtacatcacagattctcttgatgcggaccacatgggccttgtgtgaatccatcacactggctactggacccttgaccactctttgggagggacgtacttgggagtcggccat

SEQ ID NO: 370996 - DNA, 140 bp, Artificial Sequence
  Synthetic
atggccgactcccaagtacgtccctcccaaagagtggtcaagggtccagtagccagtgtgatggattcacacaaggcccatgtggtccgcatcaagagaatctgtgatgtacaaagtatcggagacccagcatggcgtat

SEQ ID NO: 370997 - DNA, 140 bp, Artificial Sequence
  Synthetic
aggccctggctgctgatatggtgaatccatcacactggctactggacccttgaccactctttgggagggatctccaggaaaattctggaacaccacgatagcagtgtccatggcaaacatgaccttttgggacagcggtg

SEQ ID NO: 370998 - DNA, 140 bp, Artificial Sequence
  Synthetic
caccgctgtcccaaaaggtcatgtttgccatggacactgctatcgtggtgttccagaattttcctggagatccctcccaaagagtggtcaagggtccagtagccagtgtgatggattcaccatatcagcagccagggcct

SEQ ID NO: 370999 - DNA, 140 bp, Artificial Sequence
  Synthetic
atacgccatgctgggtctcccttacatccaggagcggggaaaacaaaacgatatctcccagccatagttagagaagcaataagaagaggcctgagaacactgattctagcccccactagacgtacttgggagtcggccat

SEQ ID NO: 371000 - DNA, 140 bp, Artificial Sequence
  Synthetic
atggccgactcccaagtacgtctagtgggggctagaatcagtgttctcaggcctcttcttattgcttctctaactatggctgggagatatcgttttgttttccccgctcctggatgtaagggagacccagcatggcgtat

SEQ ID NO: 371001 - DNA, 140 bp, Artificial Sequence
  Synthetic
atacgccatgctgggtctccgaacagccaccctgattttggccggagtttcgcttttaccagtgtgccagtcttcgagcatgaggaaaacagactggcttccaatggcagtggcagctatcgtacttgggagtcggccat

SEQ ID NO: 371002 - DNA, 140 bp, Artificial Sequence
  Synthetic
atggccgactcccaagtacgatagctgccactgccattggaagccagtctgttttcctcatgctcgaagactggcacactggtaaaagcgaaactccggccaaaatcagggtggctgttcggagacccagcatggcgtat

SEQ ID NO: 371003 - DNA, 140 bp, Artificial Sequence
  Synthetic
aggccctggctgctgatatgacactctgggaaagatgtattcttcacaccacctgagaaatgtgacacccttttgtgtgacattggtgagtcctctccaaatccaactatagaagaaggagaccttttgggacagcggtg

SEQ ID NO: 371004 - DNA, 140 bp, Artificial Sequence
  Synthetic
caccgctgtcccaaaaggtctccttcttctatagttggatttggagaggactcaccaatgtcacacaaaagggtgtcacatttctcaggtggtgtgaagaatacatctttcccagagtgtcatatcagcagccagggcct

SEQ ID NO: 371005 - DNA, 140 bp, Artificial Sequence
  Synthetic
aggccctggctgctgatatggcagaaaaagaaacagagatcaggagtgttatgggacacacccagccctccggaagtggaaagagcagttcttgatgatggcatctatagaatcttgcaagaccttttgggacagcggtg

SEQ ID NO: 371006 - DNA, 140 bp, Artificial Sequence
  Synthetic
caccgctgtcccaaaaggtcttgcaagattctatagatgccatcatcaagaactgctctttccacttccggagggctgggtgtgtcccataacactcctgatctctgtttctttttctgccatatcagcagccagggcct

SEQ ID NO: 371007 - DNA, 140 bp, Artificial Sequence
  Synthetic
atacgccatgctgggtctccagggaaaatgtgccacgtgtgtttacaatatgatggggaagagagaaaaaaaattaggagagttcggaaaagcaaaaggaagtcgtgcaatatggtacatcgtacttgggagtcggccat

SEQ ID NO: 371008 - DNA, 140 bp, Artificial Sequence
  Synthetic
atggccgactcccaagtacgatgtaccatattgcacgacttccttttgcttttccgaactctcctaattttttttctctcttccccatcatattgtaaacacacgtggcacattttccctggagacccagcatggcgtat

SEQ ID NO: 371009 - DNA, 140 bp, Artificial Sequence
  Synthetic
atacgccatgctgggtctccccggaaatgacatagcaaactgcttgcgaaaaaacgggaaaaaggtcattcaacttagtaggaagacttttgacacagaatatcagaagactaaactgaacgtacttgggagtcggccat

SEQ ID NO: 371010 - DNA, 140 bp, Artificial Sequence
  Synthetic
atggccgactcccaagtacgttcagtttagtcttctgatattctgtgtcaaaagtcttcctactaagttgaatgacctttttcccgttttttcgcaagcagtttgctatgtcatttccggggagacccagcatggcgtat

SEQ ID NO: 371011 - DNA, 140 bp, Artificial Sequence
  Synthetic
aggccctggctgctgatatgcaacttagtaggaagacttttgacacagaatatcagaagactaaactgaatgattgggacttcgtggtgacaactgacatttcagaaatgggggccaattgaccttttgggacagcggtg

SEQ ID NO: 371012 - DNA, 140 bp, Artificial Sequence
  Synthetic
caccgctgtcccaaaaggtcaattggcccccatttctgaaatgtcagttgtcaccacgaagtcccaatcattcagtttagtcttctgatattctgtgtcaaaagtcttcctactaagttgcatatcagcagccagggcct

SEQ ID NO: 371013 - DNA, 140 bp, Artificial Sequence
  Synthetic
atacgccatgctgggtctccttgactggctggaaaaacatggcgctgaaaggctgaaaagaatggcaattagcggagatgattgtgtggtgaaaccaattgatgacaggttcgcaacagccgtacttgggagtcggccat

SEQ ID NO: 371014 - DNA, 140 bp, Artificial Sequence
  Synthetic
atggccgactcccaagtacggctgttgcgaacctgtcatcaattggtttcaccacacaatcatctccgctaattgccattcttttcagcctttcagcgccatgtttttccagccagtcaaggagacccagcatggcgtat

SEQ ID NO: 371015 - DNA, 140 bp, Artificial Sequence
  Synthetic
aggccctggctgctgatatgcgcacagtgtagcagactagcggttagaggagacccctcccatgacacaacgcagcagcggggcccgagcactgagggaagctgtacctccctgcaaaaggaccttttgggacagcggtg

SEQ ID NO: 371016 - DNA, 140 bp, Artificial Sequence
  Synthetic
caccgctgtcccaaaaggtccttttgcagggaggtacagcttccctcagtgctcgggccccgctgctgcgttgtgtcatgggaggggtctcctctaaccgctagtctgctacactgtgcgcatatcagcagccagggcct

SEQ ID NO: 371017 - DNA, 140 bp, Artificial Sequence
  Synthetic
atacgccatgctgggtctccgggaaccttcaaaaggatggaatgactggcagcaagtccctttctgttcacaccacttccatcagctgatcatgaaagatggaagagaaatagtggtgcccgtacttgggagtcggccat

SEQ ID NO: 371018 - DNA, 140 bp, Artificial Sequence
  Synthetic
atggccgactcccaagtacgggcaccactatttctcttccatctttcatgatcagctgatggaagtggtgtgaacagaaagggacttgctgccagtcattccatccttttgaaggttcccggagacccagcatggcgtat

SEQ ID NO: 371019 - DNA, 140 bp, Artificial Sequence
  Synthetic
aggccctggctgctgatatgactaacatacaagtagccataaaccaagtgagaaggctcatcgggaatgagaattatctagattatatgacatcaatgaagagattcaagaatgagagtggaccttttgggacagcggtg

SEQ ID NO: 371020 - DNA, 140 bp, Artificial Sequence
  Synthetic
caccgctgtcccaaaaggtccactctcattcttgaatctcttcattgatgtcatataatctagataattctcattcccgatgagccttctcacttggtttatggctacttgtatgttagtcatatcagcagccagggcct

SEQ ID NO: 371021 - DNA, 140 bp, Artificial Sequence
  Synthetic
aggccctggctgctgatatggaattatctagattatatgacatcaatgaagagattcaagaatgagagtgatcccgaaggggcactctggtaagtcaacacactcatgaaataaaggaaagaccttttgggacagcggtg

SEQ ID NO: 371022 - DNA, 140 bp, Artificial Sequence
  Synthetic
caccgctgtcccaaaaggtctttcctttatttcatgagtgtgttgacttaccagagtgccccttcgggatcactctcattcttgaatctcttcattgatgtcatataatctagataattccatatcagcagccagggcct

SEQ ID NO: 371023 - DNA, 140 bp, Artificial Sequence
  Synthetic
atacgccatgctgggtctccaggccgaaagccacggcttgagcaaaccgtgctgcctgtggctccatcgtggggatgtaaaaacccgggaggctgcaacccatggaagctgtacgcatggcgtacttgggagtcggccat

SEQ ID NO: 371024 - DNA, 140 bp, Artificial Sequence
  Synthetic
atggccgactcccaagtacgccatgcgtacagcttccatgggttgcagcctcccgggtttttacatccccacgatggagccacaggcagcacggtttgctcaagccgtggctttcggcctggagacccagcatggcgtat

SEQ ID NO: 371025 - DNA, 140 bp, Artificial Sequence
  Synthetic
aggccctggctgctgatatgtatggtttgtcccaagcataagagctggaaacgacatagcagcctgcttaagaaaaaatgggaaaagagtgattcagctaagtaggaaaacctttgacacgaccttttgggacagcggtg

SEQ ID NO: 371026 - DNA, 140 bp, Artificial Sequence
  Synthetic
caccgctgtcccaaaaggtcgtgtcaaaggttttcctacttagctgaatcactcttttcccattttttcttaagcaggctgctatgtcgtttccagctcttatgcttgggacaaaccatacatatcagcagccagggcct

SEQ ID NO: 371027 - DNA, 140 bp, Artificial Sequence
  Synthetic
atacgccatgctgggtctcccaaaagattcgtctgcaggcattcaatggtggatagaggctggggtaatggatgtggtctgtttgggaaaggaggtattgtgacctgtgcgatgttcacacgtacttgggagtcggccat

SEQ ID NO: 371028 - DNA, 140 bp, Artificial Sequence
  Synthetic
atggccgactcccaagtacgtgtgaacatcgcacaggtcacaatacctcctttcccaaacagaccacatccattaccccagcctctatccaccattgaatgcctgcagacgaatcttttgggagacccagcatggcgtat

SEQ ID NO: 371029 - DNA, 140 bp, Artificial Sequence
  Synthetic
atacgccatgctgggtctccgagaactcaaatgtggaagtggcatctttgtcactaatgaagtccacacttggacagagcaatataaattccaggctgactccccaaaaagactgtcagccgtacttgggagtcggccat

SEQ ID NO: 371030 - DNA, 140 bp, Artificial Sequence
  Synthetic
atggccgactcccaagtacggctgacagtctttttggggagtcagcctggaatttatattgctctgtccaagtgtggacttcattagtgacaaagatgccacttccacatttgagttctcggagacccagcatggcgtat

SEQ ID NO: 371031 - DNA, 140 bp, Artificial Sequence
  Synthetic
aggccctggctgctgatatgacaggtgagaagccttataggcgatgaagaatttctggactacatgccttcgatgaagagattcaggaaggaggaggagtcagagggagccatttggtaagaccttttgggacagcggtg

SEQ ID NO: 371032 - DNA, 140 bp, Artificial Sequence
  Synthetic
caccgctgtcccaaaaggtcttaccaaatggctccctctgactcctcctccttcctgaatctcttcatcgaaggcatgtagtccagaaattcttcatcgcctataaggcttctcacctgtcatatcagcagccagggcct

SEQ ID NO: 371033 - DNA, 140 bp, Artificial Sequence
  Synthetic
atacgccatgctgggtctcctggggaacgatcaagaaatcaaaagctatcaatgttttgagagggttcaggaaagagattggaaggatgctgaacatcttgaacaggagacgtaggacagcgtacttgggagtcggccat

SEQ ID NO: 371034 - DNA, 140 bp, Artificial Sequence
  Synthetic
atggccgactcccaagtacgctgtcctacgtctcctgttcaagatgttcagcatccttccaatctctttcctgaaccctctcaaaacattgatagcttttgatttcttgatcgttccccaggagacccagcatggcgtat

SEQ ID NO: 371035 - DNA, 140 bp, Artificial Sequence
  Synthetic
atacgccatgctgggtctcccaggcgtgattgttatgttgattccaacagcaatggcgttccatttaaccacacgtaatggagaaccacacatgatcgttggtaggcaagagaaagggaacgtacttgggagtcggccat

SEQ ID NO: 371036 - DNA, 140 bp, Artificial Sequence
  Synthetic
atggccgactcccaagtacgttccctttctcttgcctaccaacgatcatgtgtggttctccattacgtgtggttaaatggaacgccattgctgttggaatcaacataacaatcacgcctgggagacccagcatggcgtat

SEQ ID NO: 371037 - DNA, 140 bp, Artificial Sequence
  Synthetic
aggccctggctgctgatatgcaacatgggtgacttatggaacgtgcaatcaagctggggagcatagacgcgacaagagatcagtggcgttagctccccatgtcggcatgggactggacacgaccttttgggacagcggtg

SEQ ID NO: 371038 - DNA, 140 bp, Artificial Sequence
  Synthetic
caccgctgtcccaaaaggtcgtgtccagtcccatgccgacatggggagctaacgccactgatctcttgtcgcgtctatgctccccagcttgattgcacgttccataagtcacccatgttgcatatcagcagccagggcct

SEQ ID NO: 371039 - DNA, 140 bp, Artificial Sequence
  Synthetic
aggccctggctgctgatatggtacgcacagtgtagcagactagcggttagaggagacccctccatgacacaacgcagcagcggggcccagcactgagggaagctgtacctccctgcaaaggaccttttgggacagcggtg

SEQ ID NO: 371040 - DNA, 140 bp, Artificial Sequence
  Synthetic
caccgctgtcccaaaaggtcctttgcagggaggtacagcttccctcagtgctgggccccgctgctgcgttgtgtcatggaggggtctcctctaaccgctagtctgctacactgtgcgtaccatatcagcagccagggcct

SEQ ID NO: 371041 - DNA, 140 bp, Artificial Sequence
  Synthetic
atacgccatgctgggtctccttcttctagagccacctgggcgaagaacattcacacggccataactcaggtcaggaatctgatcggaaaagaggaatacgtggattacatgccagtaatgcgtacttgggagtcggccat

SEQ ID NO: 371042 - DNA, 140 bp, Artificial Sequence
  Synthetic
atggccgactcccaagtacgcattactggcatgtaatccacgtattcctcttttccgatcagattcctgacctgagttatggccgtgtgaatgttcttcgcccaggtggctctagaagaaggagacccagcatggcgtat

SEQ ID NO: 371043 - DNA, 140 bp, Artificial Sequence
  Synthetic
aggccctggctgctgatatgttcatcttactgacagctgtcgctccttcaatgacaatgcgctgcataggaatatcaaatagagacttcgtagaaggggtttcaggaggaagctgggttggaccttttgggacagcggtg

SEQ ID NO: 371044 - DNA, 140 bp, Artificial Sequence
  Synthetic
caccgctgtcccaaaaggtccaacccagcttcctcctgaaaccccttctacgaagtctctatttgatattcctatgcagcgcattgtcattgaaggagcgacagctgtcagtaagatgaacatatcagcagccagggcct

SEQ ID NO: 371045 - DNA, 140 bp, Artificial Sequence
  Synthetic
aggccctggctgctgatatgggagaataggaaggaatccaaaaaatgagaacgaccaatatatttacatgggagaacctttagagaatgatgaagactgtgctcactggaaggaggcaaagaccttttgggacagcggtg

SEQ ID NO: 371046 - DNA, 140 bp, Artificial Sequence
  Synthetic
caccgctgtcccaaaaggtctttgcctccttccagtgagcacagtcttcatcattctctaaaggttctcccatgtaaatatattggtcgttctcattttttggattccttcctattctcccatatcagcagccagggcct

SEQ ID NO: 371047 - DNA, 140 bp, Artificial Sequence
  Synthetic
aggccctggctgctgatatgccaacattggattttgaactgataaaaacagaagccaaacaacctgccactctaaggaagtactgtatagaagcaaagctgaccaacacaacaacagaatgaccttttgggacagcggtg

SEQ ID NO: 371048 - DNA, 140 bp, Artificial Sequence
  Synthetic
caccgctgtcccaaaaggtcattctgttgttgtgttggtcagctttgcttctatacagtacttccttagagtggcaggttgtttggcttctgtttttatcagttcaaaatccaatgttggcatatcagcagccagggcct

SEQ ID NO: 371049 - DNA, 140 bp, Artificial Sequence
  Synthetic
atacgccatgctgggtctccggacaacttggtcatgttgcacaattccgaacaaggaggaaaagcctacagacatgccatggaagaactaccagacaccatagaaacattgatgctcctacgtacttgggagtcggccat

SEQ ID NO: 371050 - DNA, 140 bp, Artificial Sequence
  Synthetic
atggccgactcccaagtacgtaggagcatcaatgtttctatggtgtctggtagttcttccatggcatgtctgtaggcttttcctccttgttcggaattgtgcaacatgaccaagttgtccggagacccagcatggcgtat

SEQ ID NO: 371051 - DNA, 140 bp, Artificial Sequence
  Synthetic
aggccctggctgctgatatgactttcaaaaatccccacgccaagaaacaggatgtcgttgtcttagggtctcaagaaggggccatgcacacggcactcacaggggctacagaaatccagagaccttttgggacagcggtg

SEQ ID NO: 371052 - DNA, 140 bp, Artificial Sequence
  Synthetic
caccgctgtcccaaaaggtctctggatttctgtagcccctgtgagtgccgtgtgcatggccccttcttgagaccctaagacaacgacatcctgtttcttggcgtggggatttttgaaagtcatatcagcagccagggcct

SEQ ID NO: 371053 - DNA, 140 bp, Artificial Sequence
  Synthetic
aggccctggctgctgatatgtcgagccagaacgtgagaaagttgatgccatagacggtgaataccggttaaggggggaagcaagaaaaacctttgtagacctgatgaaaagaggagacctgaccttttgggacagcggtg

SEQ ID NO: 371054 - DNA, 140 bp, Artificial Sequence
  Synthetic
caccgctgtcccaaaaggtcaggtctcctcttttcatcaggtctacaaaggtttttcttgcttccccccttaaccggtattcaccgtctatggcatcaactttctcacgttctggctcgacatatcagcagccagggcct

SEQ ID NO: 371055 - DNA, 140 bp, Artificial Sequence
  Synthetic
atacgccatgctgggtctcctttttgacctacctctaccatggacatcaggagctacaacggaaacaccaacttggaacagaaaggagcttcttgtgacattcaaaaacgcacatgcgaacgtacttgggagtcggccat

SEQ ID NO: 371056 - DNA, 140 bp, Artificial Sequence
  Synthetic
atggccgactcccaagtacgttcgcatgtgcgtttttgaatgtcacaagaagctcctttctgttccaagttggtgtttccgttgtagctcctgatgtccatggtagaggtaggtcaaaaaggagacccagcatggcgtat

SEQ ID NO: 371057 - DNA, 140 bp, Artificial Sequence
  Synthetic
aggccctggctgctgatatgcccaatcgtaacagaaaaagatagcccagtcaacatagaagcagaacccccattcggagacagctacatcatcgtaggagtagagccgggacaactgaaagaccttttgggacagcggtg

SEQ ID NO: 371058 - DNA, 140 bp, Artificial Sequence
  Synthetic
caccgctgtcccaaaaggtctttcagttgtcccggctctactcctacgatgatgtagctgtctccgaatgggggttctgcttctatgttgactgggctatctttttctgttacgattgggcatatcagcagccagggcct

SEQ ID NO: 371059 - DNA, 140 bp, Artificial Sequence
  Synthetic
atacgccatgctgggtctccactttcaccaatatggaggtccaattaataagacaaatggagtctgaaggaattttctcacccagcgaattggaaacccccaatctagctaagaaagttccgtacttgggagtcggccat

SEQ ID NO: 371060 - DNA, 140 bp, Artificial Sequence
  Synthetic
atggccgactcccaagtacggaactttcttagctagattgggggtttccaattcgctgggtgagaaaattccttcagactccatttgtcttattaattggacctccatattggtgaaagtggagacccagcatggcgtat

SEQ ID NO: 371061 - DNA, 140 bp, Artificial Sequence
  Synthetic
atacgccatgctgggtctccctgggagctatggtgcaggctgatagtggttgcattgtgagctggaaaaataaagaactgaaatgtggcagcgggatcttcattacagataacgtacacacgtacttgggagtcggccat

SEQ ID NO: 371062 - DNA, 140 bp, Artificial Sequence
  Synthetic
atggccgactcccaagtacgtgtgtacgttatctgtaatgaagatcccgctgccacatttcagttctttatttttccagctcacaatgcaaccactatcagcctgcaccatagctcccagggagacccagcatggcgtat

SEQ ID NO: 371063 - DNA, 140 bp, Artificial Sequence
  Synthetic
atacgccatgctgggtctccttccaatcacaatgaccttatggtacatgtggcaagtgaaaacacaaagatcaggagccctgtgggacgtcccttcacccgctgccactcaaaaagccgccgtacttgggagtcggccat

SEQ ID NO: 371064 - DNA, 140 bp, Artificial Sequence
  Synthetic
atggccgactcccaagtacggcggctttttgagtggcagcgggtgaagggacgtcccacagggctcctgatctttgtgttttcacttgccacatgtaccataaggtcattgtgattggaaggagacccagcatggcgtat

SEQ ID NO: 371065 - DNA, 140 bp, Artificial Sequence
  Synthetic
atacgccatgctgggtctccgagagggagaaaagaaaaaactcaggccaaaatggttagatgcacgtgtatacgctgaccccatggctttgaaggatttcaaggagtttgccagtggaagcgtacttgggagtcggccat

SEQ ID NO: 371066 - DNA, 140 bp, Artificial Sequence
  Synthetic
atggccgactcccaagtacgcttccactggcaaactccttgaaatccttcaaagccatggggtcagcgtatacacgtgcatctaaccattttggcctgagttttttcttttctccctctcggagacccagcatggcgtat

SEQ ID NO: 371067 - DNA, 140 bp, Artificial Sequence
  Synthetic
aggccctggctgctgatatggaagtcaggccggtttaagccatagtacggtaagagctatgctgcctgtgagccccgtccaaggacgtaaaatgaagtcaggccgaaagccacggcttgagaccttttgggacagcggtg

SEQ ID NO: 371068 - DNA, 140 bp, Artificial Sequence
  Synthetic
caccgctgtcccaaaaggtctcaagccgtggctttcggcctgacttcattttacgtccttggacggggctcacaggcagcatagctcttaccgtactatggcttaaaccggcctgacttccatatcagcagccagggcct

SEQ ID NO: 371069 - DNA, 140 bp, Artificial Sequence
  Synthetic
atacgccatgctgggtctccacattgataactgggaacatgtcttttagagacctgggaagagtgatggtcatggtgggcgctaccatgacggatgacataggtatgggagtgacttatccgtacttgggagtcggccat

SEQ ID NO: 371070 - DNA, 140 bp, Artificial Sequence
  Synthetic
atggccgactcccaagtacggataagtcactcccatacctatgtcatccgtcatggtagcgcccaccatgaccatcactcttcccaggtctctaaaagacatgttcccagttatcaatgtggagacccagcatggcgtat

SEQ ID NO: 371071 - DNA, 140 bp, Artificial Sequence
  Synthetic
atacgccatgctgggtctccttgccctactagcagctttcaaagttagaccaacttttgcagctggactactcttgagaaaactgacctccaaggaattgatgatggccaccataggaatcgtacttgggagtcggccat

SEQ ID NO: 371072 - DNA, 140 bp, Artificial Sequence
  Synthetic
atggccgactcccaagtacgattcctatggtggccatcatcaattccttggaggtcagttttctcaagagtagtccagctgcaaaagttggtctaactttgaaagctgctagtagggcaaggagacccagcatggcgtat

SEQ ID NO: 371073 - DNA, 140 bp, Artificial Sequence
  Synthetic
atacgccatgctgggtctccaacaactctttcgagaaccagcaagaaaaggagctggccgctaaatgaagctatcatggcagtcgggatggtgagcattttagccagttctctcctaaagcgtacttgggagtcggccat

SEQ ID NO: 371074 - DNA, 140 bp, Artificial Sequence
  Synthetic
atggccgactcccaagtacgctttaggagagaactggctaaaatgctcaccatcccgactgccatgatagcttcatttagcggccagctccttttcttgctggttctcgaaagagttgttggagacccagcatggcgtat

SEQ ID NO: 371075 - DNA, 140 bp, Artificial Sequence
  Synthetic
aggccctggctgctgatatgcttcaggggaagttatctagcaggagcaggtctggccttctcattaatgaaatctttaggaggaggtaggagaggtacgggagctcaaggggaaacattggaccttttgggacagcggtg

SEQ ID NO: 371076 - DNA, 140 bp, Artificial Sequence
  Synthetic
caccgctgtcccaaaaggtccaatgtttccccttgagctcccgtacctctcctacctcctcctaaagatttcattaatgagaaggccagacctgctcctgctagataacttcccctgaagcatatcagcagccagggcct

SEQ ID NO: 371077 - DNA, 140 bp, Artificial Sequence
  Synthetic
atacgccatgctgggtctccaacgaaacctggaattttcaaaaccaacaccggaaccataggcgctgtatctctggacttttcccctggaacgtcaggatctccaattgtcgacagaaaacgtacttgggagtcggccat

SEQ ID NO: 371078 - DNA, 140 bp, Artificial Sequence
  Synthetic
atggccgactcccaagtacgttttctgtcgacaattggagatcctgacgttccaggggaaaagtccagagatacagcgcctatggttccggtgttggttttgaaaattccaggtttcgttggagacccagcatggcgtat

SEQ ID NO: 371079 - DNA, 140 bp, Artificial Sequence
  Synthetic
aggccctggctgctgatatgagcggagatgattgcgtggtgaaaccaattgatgacaggttcgcaacagccttaacagctttgaatgatatgggaaaagtaagaaaagacataccgcagtgaccttttgggacagcggtg

SEQ ID NO: 371080 - DNA, 140 bp, Artificial Sequence
  Synthetic
caccgctgtcccaaaaggtcactgcggtatgtcttttcttacttttcccatatcattcaaagctgttaaggctgttgcgaacctgtcatcaattggtttcaccacgcaatcatctccgctcatatcagcagccagggcct

SEQ ID NO: 371081 - DNA, 140 bp, Artificial Sequence
  Synthetic
atacgccatgctgggtctccagatcgaagatgacattttccgaaagaaaagattgaccatcatggacctccatccaggggcaggaaagacaaaaagataccttccagccatagttagagacgtacttgggagtcggccat

SEQ ID NO: 371082 - DNA, 140 bp, Artificial Sequence
  Synthetic
atggccgactcccaagtacgtctctaactatggctggaaggtatctttttgtctttcctgcccctggatggaggtccatgatggtcaatcttttctttcggaaaatgtcatcttcgatctggagacccagcatggcgtat

SEQ ID NO: 371083 - DNA, 140 bp, Artificial Sequence
  Synthetic
atacgccatgctgggtctcctggaagaggtgtagggaaaatgactctcggaatgtgttgcataatcacggccagcggccttctgtggtatgcacagatacagccccattggattgcagctcgtacttgggagtcggccat

SEQ ID NO: 371084 - DNA, 140 bp, Artificial Sequence
  Synthetic
atggccgactcccaagtacgagctgcaatccaatggggctgtatctgtgcataccacagaaggccgctggccgtgattatgcaacacattccgagagtcattttccctacacctcttccaggagacccagcatggcgtat

SEQ ID NO: 371085 - DNA, 140 bp, Artificial Sequence
  Synthetic
atacgccatgctgggtctcctggcagctgaaatggaggaagctcttagaggacttccaataagataccaaaccccagccatcagagccgagcacaccgggcgagagatcgtggacctaatcgtacttgggagtcggccat

SEQ ID NO: 371086 - DNA, 140 bp, Artificial Sequence
  Synthetic
atggccgactcccaagtacgattaggtccacgatctctcgcccggtgtgctcggctctgatggctggggtttggtatcttattggaagtcctctaagagcttcctccatttcagctgccaggagacccagcatggcgtat

SEQ ID NO: 371087 - DNA, 140 bp, Artificial Sequence
  Synthetic
aggccctggctgctgatatgtgcttaacgtagttctaacagttttttattagagagcagatctctgatgaacaaccaacgaaaaaagacgggtcgaccgtctttcaatatgctgaaacgcgaccttttgggacagcggtg

SEQ ID NO: 371088 - DNA, 140 bp, Artificial Sequence
  Synthetic
caccgctgtcccaaaaggtcgcgtttcagcatattgaaagacggtcgacccgtcttttttcgttggttgttcatcagagatctgctctctaataaaaaactgttagaactacgttaagcacatatcagcagccagggcct

SEQ ID NO: 371089 - DNA, 140 bp, Artificial Sequence
  Synthetic
atacgccatgctgggtctcccgggattttcatgacagccactcctccggggagcagagacccatttcctcagagcaatgcaccaatcatggatgaggaaagagaaatccctgagcgttcacgtacttgggagtcggccat

SEQ ID NO: 371090 - DNA, 140 bp, Artificial Sequence
  Synthetic
atggccgactcccaagtacgtgaacgctcagggatttctctttcctcatccatgattggtgcattgctctgaggaaatgggtctctgctccccggaggagtggctgtcatgaaaatcccgggagacccagcatggcgtat

SEQ ID NO: 371091 - DNA, 140 bp, Artificial Sequence
  Synthetic
atacgccatgctgggtctcctggaattcaggacatgaatgggtcacggattttaaagggaagactgtttggtttgttccaagtataaaagcaggaaatgacatagcagcttgtcttaggacgtacttgggagtcggccat

SEQ ID NO: 371092 - DNA, 140 bp, Artificial Sequence
  Synthetic
atggccgactcccaagtacgtcctaagacaagctgctatgtcatttcctgcttttatacttggaacaaaccaaacagtcttccctttaaaatccgtgacccattcatgtcctgaattccaggagacccagcatggcgtat

SEQ ID NO: 371093 - DNA, 140 bp, Artificial Sequence
  Synthetic
aggccctggctgctgatatggtttgttccaagtataaaagcaggaaatgacatagcagcttgtcttaggaaaaatggaaagaaagtgatacaactcagtaggaagacttttgactctgaggaccttttgggacagcggtg

SEQ ID NO: 371094 - DNA, 140 bp, Artificial Sequence
  Synthetic
caccgctgtcccaaaaggtcctcagagtcaaaagtcttcctactgagttgtatcactttctttccatttttcctaagacaagctgctatgtcatttcctgcttttatacttggaacaaaccatatcagcagccagggcct

SEQ ID NO: 371095 - DNA, 140 bp, Artificial Sequence
  Synthetic
aggccctggctgctgatatggggaaaagctaaaattataggagcagacatacaaaataccaccttcatcatcgacggcccagataccccagaatgccccgataaccaaagagcgtggaacgaccttttgggacagcggtg

SEQ ID NO: 371096 - DNA, 140 bp, Artificial Sequence
  Synthetic
caccgctgtcccaaaaggtcgttccacgctctttggttatcggggcattctggggtatctgggccgtcgatgatgaaggtggtattttgtatgtctgctcctataattttagcttttccccatatcagcagccagggcct

SEQ ID NO: 371097 - DNA, 140 bp, Artificial Sequence
  Synthetic
aggccctggctgctgatatgtgaccatgctccttatgctgatgcctacagccttggctttccatttgactacacgagggggagagccgcacatgatagtcagcaagcaggaaaggggaaagaccttttgggacagcggtg

SEQ ID NO: 371098 - DNA, 140 bp, Artificial Sequence
  Synthetic
caccgctgtcccaaaaggtctttcccctttcctgcttgctgactatcatgtgcggctctccccctcgtgtagtcaaatggaaagccaaggctgtaggcatcagcataaggagcatggtcacatatcagcagccagggcct

SEQ ID NO: 371099 - DNA, 140 bp, Artificial Sequence
  Synthetic
atacgccatgctgggtctccagacacatgggtgacctatggaacatgttcccaaactggcgagcaccgacgagacaaacgttccgtcgcactggccccacacgtgggacttggtttggaacgtacttgggagtcggccat

SEQ ID NO: 371100 - DNA, 140 bp, Artificial Sequence
  Synthetic
atggccgactcccaagtacgttccaaaccaagtcccacgtgtggggccagtgcgacggaacgtttgtctcgtcggtgctcgccagtttgggaacatgttccataggtcacccatgtgtctggagacccagcatggcgtat

SEQ ID NO: 371101 - DNA, 140 bp, Artificial Sequence
  Synthetic
atacgccatgctgggtctccaaagcaaagaacaccacaggacaaccagttgacctatgtggtcatagccatcttgacactagtggcagccaccatggcaaacgaaatgggttttctagaacgtacttgggagtcggccat

SEQ ID NO: 371102 - DNA, 140 bp, Artificial Sequence
  Synthetic
atggccgactcccaagtacgttctagaaaacccatttcgtttgccatggtggctgccactagtgtcaagatggctatgaccacataggtcaactggttgtcctgtggtgttctttgctttggagacccagcatggcgtat

SEQ ID NO: 371103 - DNA, 140 bp, Artificial Sequence
  Synthetic
atacgccatgctgggtctccgagaagcaaggaaaacctttgtggacctaatgagaagaggggacttaccagtctggttggcctacaaagtggcagctgaaggcatcaactacgcagacagcgtacttgggagtcggccat

SEQ ID NO: 371104 - DNA, 140 bp, Artificial Sequence
  Synthetic
atggccgactcccaagtacgctgtctgcgtagttgatgccttcagctgccactttgtaggccaaccagactggtaagtcccctcttctcattaggtccacaaaggttttccttgcttctcggagacccagcatggcgtat

SEQ ID NO: 371105 - DNA, 140 bp, Artificial Sequence
  Synthetic
aggccctggctgctgatatgttcattttgttaatgctggtaacaccatccatggccatgcgatgcgtgggaataggcagcagggacttcgtggaaggactgtcaggagcaacttgggtaggaccttttgggacagcggtg

SEQ ID NO: 371106 - DNA, 140 bp, Artificial Sequence
  Synthetic
caccgctgtcccaaaaggtcctacccaagttgctcctgacagtccttccacgaagtccctgctgcctattcccacgcatcgcatggccatggatggtgttaccagcattaacaaaatgaacatatcagcagccagggcct

SEQ ID NO: 371107 - DNA, 140 bp, Artificial Sequence
  Synthetic
aggccctggctgctgatatgtggaagtggaaatctggacaaaagaaggggaaaggaaaaaattaaaacccagatggttggatgctaggatctattctgacccactggcactaaaagaattgaccttttgggacagcggtg

SEQ ID NO: 371108 - DNA, 140 bp, Artificial Sequence
  Synthetic
caccgctgtcccaaaaggtcaattcttttagtgccagtgggtcagaatagatcctagcatccaaccatctgggttttaattttttcctttccccttcttttgtccagatttccacttccacatatcagcagccagggcct

SEQ ID NO: 371109 - DNA, 140 bp, Artificial Sequence
  Synthetic
atacgccatgctgggtctccatgtggtactggaacatggaagttgcgtcaccaccatggctaaagacaaaccaacactggacattgaactcttgaagacggaagtcacaaaccctgccgtcgtacttgggagtcggccat

SEQ ID NO: 371110 - DNA, 140 bp, Artificial Sequence
  Synthetic
atggccgactcccaagtacgacggcagggtttgtgacttccgtcttcaagagttcaatgtccagtgttggtttgtctttagccatggtggtgacgcaacttccatgttccagtaccacatggagacccagcatggcgtat

SEQ ID NO: 371111 - DNA, 140 bp, Artificial Sequence
  Synthetic
atacgccatgctgggtctcctcatgctctcagtgaactgccggagactctggagacactgcttctactgacactcctggcagcagtcacaggaggaatcttcttattcttaatgagcggacgtacttgggagtcggccat

SEQ ID NO: 371112 - DNA, 140 bp, Artificial Sequence
  Synthetic
atggccgactcccaagtacgtccgctcattaagaataagaagattcctcctgtgactgctgccaggagtgtcagtagaagcagtgtctccagagtctccggcagttcactgagagcatgaggagacccagcatggcgtat

SEQ ID NO: 371113 - DNA, 140 bp, Artificial Sequence
  Synthetic
aggccctggctgctgatatgtgacaaaactggaaggaaagatagttcaatatgaaaacttgaaatattcagtgatagtcaccgtccacactgaggaccagcatcaggtgggaaatgaaacgaccttttgggacagcggtg

SEQ ID NO: 371114 - DNA, 140 bp, Artificial Sequence
  Synthetic
caccgctgtcccaaaaggtcgtttcatttcccacctgatgctggtcctcagtgtggacggtgactatcactgaatatttcaagttttcatattgaactatctttccttccagttttgtcacatatcagcagccagggcct

SEQ ID NO: 371115 - DNA, 140 bp, Artificial Sequence
  Synthetic
aggccctggctgctgatatgcagagaacaccccaagacaaccaattgacctacgttgtcatagccatcctcacagtggtggccgcaaccatggcaaacgaaatgggtttcctggaaaaaagaccttttgggacagcggtg

SEQ ID NO: 371116 - DNA, 140 bp, Artificial Sequence
  Synthetic
caccgctgtcccaaaaggtcttttttccaggaaacccatttcgtttgccatggttgcggccaccactgtgaggatggctatgacaacgtaggtcaattggttgtcttggggtgttctctgcatatcagcagccagggcct

SEQ ID NO: 371117 - DNA, 140 bp, Artificial Sequence
  Synthetic
atacgccatgctgggtctccatggctagttcacaaacaatggtttctagacttaccactgccttggacctcgggagcttcaacatctcaggagacttggaacagacaagatttgttggttcgtacttgggagtcggccat

SEQ ID NO: 371118 - DNA, 140 bp, Artificial Sequence
  Synthetic
atggccgactcccaagtacgaaccaacaaatcttgtctgttccaagtctcctgagatgttgaagctcccgaggtccaaggcagtggtaagtctagaaaccattgtttgtgaactagccatggagacccagcatggcgtat

SEQ ID NO: 371119 - DNA, 140 bp, Artificial Sequence
  Synthetic
atacgccatgctgggtctccaataaacattttggacatagacctccgacctgcatcagcgtggacgctatatgcagtggccactacgtttgtcacgccaatgctgaggcacagcatagaacgtacttgggagtcggccat

SEQ ID NO: 371120 - DNA, 140 bp, Artificial Sequence
  Synthetic
atggccgactcccaagtacgttctatgctgtgcctcagcattggcgtgacaaacgtagtggccactgcatatagcgtccacgctgatgcaggtcggaggtctatgtccaaaatgtttattggagacccagcatggcgtat

SEQ ID NO: 371121 - DNA, 140 bp, Artificial Sequence
  Synthetic
atacgccatgctgggtctccatggataaactaactttaaaagggatgtcatatgtgatgtgcacaggctcatttaagttagagaaggaagtggctgagacccagcatggaaccgttttagcgtacttgggagtcggccat

SEQ ID NO: 371122 - DNA, 140 bp, Artificial Sequence
  Synthetic
atggccgactcccaagtacgctaaaacggttccatgctgggtctcagccacttccttctctaacttaaatgagcctgtgcacatcacatatgacatcccttttaaagttagtttatccatggagacccagcatggcgtat

SEQ ID NO: 371123 - DNA, 140 bp, Artificial Sequence
  Synthetic
aggccctggctgctgatatgatttaagttagagaaggaagtggctgagacccagcatggaaccgttttagtgcaggttaaatacgaaggaacagatgcaccatgcaagatccccttctcggaccttttgggacagcggtg

SEQ ID NO: 371124 - DNA, 140 bp, Artificial Sequence
  Synthetic
caccgctgtcccaaaaggtccgagaaggggatcttgcatggtgcatctgttccttcgtatttaacctgcactaaaacggttccatgctgggtctcagccacttccttctctaacttaaatcatatcagcagccagggcct

SEQ ID NO: 371125 - DNA, 140 bp, Artificial Sequence
  Synthetic
aggccctggctgctgatatgcaagcaaaagcaaccagagaagctcagaaaagagcagcagcaggcatcatgaaaaacccaacagtcgatggaataacagtgattgacctagaaccaatacgaccttttgggacagcggtg

SEQ ID NO: 371126 - DNA, 140 bp, Artificial Sequence
  Synthetic
caccgctgtcccaaaaggtcgtattggttctaggtcaatcactgttattccatcgactgttgggtttttcatgatgcctgctgctgctcttttctgagcttctctggttgcttttgcttgcatatcagcagccagggcct

SEQ ID NO: 371127 - DNA, 140 bp, Artificial Sequence
  Synthetic
aggccctggctgctgatatgcttttggtgagagctacatcgtggtgggggcaggcgaaaaaactctgaaactaagctggttcaaaaaaggaagcagcataggaaaaatgttcgaagcaacgaccttttgggacagcggtg

SEQ ID NO: 371128 - DNA, 140 bp, Artificial Sequence
  Synthetic
caccgctgtcccaaaaggtcgttgcttcgaacatttttcctatgctgcttccttttttgaaccagcttagtttcagagttttttcgcctgcccccaccacgatgtagctctcaccaaaagcatatcagcagccagggcct

SEQ ID NO: 371129 - DNA, 140 bp, Artificial Sequence
  Synthetic
atacgccatgctgggtctcccgcccgaggagcacgaaggatggctattctaggagacaccgcatgggacttcggttccataggaggagtgttcacatctgtgggaaaactggtacaccagcgtacttgggagtcggccat

SEQ ID NO: 371130 - DNA, 140 bp, Artificial Sequence
  Synthetic
atggccgactcccaagtacgctggtgtaccagttttcccacagatgtgaacactcctcctatggaaccgaagtcccatgcggtgtctcctagaatagccatccttcgtgctcctcgggcgggagacccagcatggcgtat

SEQ ID NO: 371131 - DNA, 140 bp, Artificial Sequence
  Synthetic
aggccctggctgctgatatgagggggagctacttggccggagctggacttctcttttccatcatgaagaacacaacaaacacaagaagaggaactggcaacgtaggagagacacttggaggaccttttgggacagcggtg

SEQ ID NO: 371132 - DNA, 140 bp, Artificial Sequence
  Synthetic
caccgctgtcccaaaaggtcctccaagtgtctctcctacgttgccagttcctcttcttgtgtttgttgtgttcttcatgatggaaaagagaagtccagctccggccaagtagctccccctcatatcagcagccagggcct

SEQ ID NO: 371133 - DNA, 140 bp, Artificial Sequence
  Synthetic
atacgccatgctgggtctccgaaaataggaatagggatcctgctgacatggctaggattaaattcaaggagcacgtcactttcaatgacttgcattgcagttggcatggtcacactgtaccgtacttgggagtcggccat

SEQ ID NO: 371134 - DNA, 140 bp, Artificial Sequence
  Synthetic
atggccgactcccaagtacggtacagtgtgaccatgccaactgcaatgcaagtcattgaaagtgacgtgctccttgaatttaatcctagccatgtcagcaggatccctattcctattttcggagacccagcatggcgtat

SEQ ID NO: 371135 - DNA, 140 bp, Artificial Sequence
  Synthetic
atacgccatgctgggtctcccaaggacagttccaaatcggaagcttgcttaacacagttctaacagtttgtttagatagagagcagatctctggaaaaatgaaccaacgaaaaaaggtggcgtacttgggagtcggccat

SEQ ID NO: 371136 - DNA, 140 bp, Artificial Sequence
  Synthetic
atggccgactcccaagtacgccaccttttttcgttggttcatttttccagagatctgctctctatctaaacaaactgttagaactgtgttaagcaagcttccgatttggaactgtccttgggagacccagcatggcgtat

SEQ ID NO: 371137 - DNA, 140 bp, Artificial Sequence
  Synthetic
atacgccatgctgggtctcccacacgtctggagaacgtcatgtggaagcaaatatcaaatgaattgaaccatattctacttgaaaacgacatgaaattcacagtggttgtgggagatgttcgtacttgggagtcggccat

SEQ ID NO: 371138 - DNA, 140 bp, Artificial Sequence
  Synthetic
atggccgactcccaagtacgaacatctcccacaaccactgtgaatttcatgtcgttttcaagtagaatatggttcaattcatttgatatttgcttccacatgacgttctccagacgtgtgggagacccagcatggcgtat

SEQ ID NO: 371139 - DNA, 140 bp, Artificial Sequence
  Synthetic
aggccctggctgctgatatgatattctacttgaaaacgacatgaaattcacagtggttgtgggagatgttaatggaatcttggcccaggggaagaaaatggttaggccacaacccatggagaccttttgggacagcggtg

SEQ ID NO: 371140 - DNA, 140 bp, Artificial Sequence
  Synthetic
caccgctgtcccaaaaggtctccatgggttgtggcctaaccattttcttcccctgggccaagattccattaacatctcccacaaccactgtgaatttcatgtcgttttcaagtagaatatcatatcagcagccagggcct

SEQ ID NO: 371141 - DNA, 140 bp, Artificial Sequence
  Synthetic
aggccctggctgctgatatgacccttacggatggtgttggcattcattacgtttttgcgagttctttccatcccaccaacagcagggattctgaaaagatggggacagttaaagaaaaacgaccttttgggacagcggtg

SEQ ID NO: 371142 - DNA, 140 bp, Artificial Sequence
  Synthetic
caccgctgtcccaaaaggtcgtttttctttaactgtccccatcttttcagaatccctgctgttggtgggatggaaagaactcgcaaaaacgtaatgaatgccaacaccatccgtaagggtcatatcagcagccagggcct

SEQ ID NO: 371143 - DNA, 140 bp, Artificial Sequence
  Synthetic
atacgccatgctgggtctccacacaaatactcatggaaaagttggggaaaagccaaaatcataggagcagatatacagaataccaccttcatcatcgacggtccagacactccagaatgccgtacttgggagtcggccat

SEQ ID NO: 371144 - DNA, 140 bp, Artificial Sequence
  Synthetic
atggccgactcccaagtacggcattctggagtgtctggaccgtcgatgatgaaggtggtattctgtatatctgctcctatgattttggcttttccccaacttttccatgagtatttgtgtggagacccagcatggcgtat

SEQ ID NO: 371145 - DNA, 140 bp, Artificial Sequence
  Synthetic
atacgccatgctgggtctccaaggccataaagatactcactggattcaggaaggagataggccgcatgctgaacatcttgaatggaaggaaaaggtcaacaataacattgctgtgcttgacgtacttgggagtcggccat

SEQ ID NO: 371146 - DNA, 140 bp, Artificial Sequence
  Synthetic
atggccgactcccaagtacgtcaagcacagcaatgttattgttgaccttttccttccattcaagatgttcagcatgcggcctatctccttcctgaatccagtgagtatctttatggccttggagacccagcatggcgtat

SEQ ID NO: 371147 - DNA, 140 bp, Artificial Sequence
  Synthetic
aggccctggctgctgatatggaacatcttgaatggaaggaaaaggtcaacaataacattgctgtgcttgattcctactgtaatggcgtttcatttgtcaacgagagatggtgaacccctcgaccttttgggacagcggtg

SEQ ID NO: 371148 - DNA, 140 bp, Artificial Sequence
  Synthetic
caccgctgtcccaaaaggtcgaggggttcaccatctctcgttgacaaatgaaacgccattacagtaggaatcaagcacagcaatgttattgttgaccttttccttccattcaagatgttccatatcagcagccagggcct

SEQ ID NO: 371149 - DNA, 140 bp, Artificial Sequence
  Synthetic
aggccctggctgctgatatgcacgaaactccacgcatgaaatgtactgggtatctaatgctaccgggaacatagtgtcatcagtgaacatgatttcaaggatgttgattaacagattcacgaccttttgggacagcggtg

SEQ ID NO: 371150 - DNA, 140 bp, Artificial Sequence
  Synthetic
caccgctgtcccaaaaggtcgtgaatctgttaatcaacatccttgaaatcatgttcactgatgacactatgttcccggtagcattagatacccagtacatttcatgcgtggagtttcgtgcatatcagcagccagggcct

SEQ ID NO: 371151 - DNA, 140 bp, Artificial Sequence
  Synthetic
atacgccatgctgggtctccatgatagtggcgaaacacgaaagggggagacctctcttgtttaagacaacagaaggaatcaataagtgcactcttattgccatggacctgggtgagatgtcgtacttgggagtcggccat

SEQ ID NO: 371152 - DNA, 140 bp, Artificial Sequence
  Synthetic
atggccgactcccaagtacgacatctcacccaggtccatggcaataagagtgcacttattgattccttctgttgtcttaaacaagagaggtctccccctttcgtgtttcgccactatcatggagacccagcatggcgtat

SEQ ID NO: 371153 - DNA, 140 bp, Artificial Sequence
  Synthetic
aggccctggctgctgatatggtccatgctgacatggggtactggatagaaagtgaaaagaacgagacctggaagctagcgagagcctcattcatagaagtcaagacatgcatctggccaagaccttttgggacagcggtg

SEQ ID NO: 371154 - DNA, 140 bp, Artificial Sequence
  Synthetic
caccgctgtcccaaaaggtcttggccagatgcatgtcttgacttctatgaatgaggctctcgctagcttccaggtctcgttcttttcactttctatccagtaccccatgtcagcatggaccatatcagcagccagggcct

SEQ ID NO: 371155 - DNA, 140 bp, Artificial Sequence
  Synthetic
atacgccatgctgggtctccgcgaggacaccgtcacgtataaatgccccttactggtcaataccgaacccgaagacattgattgctggtgcaatctcacgtctgcctgggtaatgtatggcgtacttgggagtcggccat

SEQ ID NO: 371156 - DNA, 140 bp, Artificial Sequence
  Synthetic
atggccgactcccaagtacgccatacattacccaggcagacgtgagattgcaccagcaatcaatgtcttcgggttcggtattgaccagtaaggggcatttatacgtgacggtgtcctcgcggagacccagcatggcgtat

SEQ ID NO: 371157 - DNA, 140 bp, Artificial Sequence
  Synthetic
atacgccatgctgggtctccacgaacaggtctcgattttaatgagatggtcctgctgcagatggagagcaaagcttggctagtccatagacagtggtttctggacttacctctaccatggcgtacttgggagtcggccat

SEQ ID NO: 371158 - DNA, 140 bp, Artificial Sequence
  Synthetic
atggccgactcccaagtacgccatggtagaggtaagtccagaaaccactgtctatggactagccaagctttgctctccatctgcagcaggaccatctcattaaaatcgagacctgttcgtggagacccagcatggcgtat

SEQ ID NO: 371159 - DNA, 140 bp, Artificial Sequence
  Synthetic
aggccctggctgctgatatgccaaagatatatggaggaccaacatctcagcacaactacagaccagggtatttcacacaaacagcaggaccatggcacctaggcaagttggaactagattgaccttttgggacagcggtg

SEQ ID NO: 371160 - DNA, 140 bp, Artificial Sequence
  Synthetic
caccgctgtcccaaaaggtcaatctagttccaacttgcctaggtgccatggtcctgctgtttgtgtgaaataccctggtctgtagttgtgctgagatgttggtcctccatatatctttggcatatcagcagccagggcct

SEQ ID NO: 371161 - DNA, 140 bp, Artificial Sequence
  Synthetic
aggccctggctgctgatatgcaaaacaaactgggtcagcatcatctatggtgaacggagtggtcagactgctgacaaaaccttgggacgtcgtccctatggtgacacagatggcaatgacgaccttttgggacagcggtg

SEQ ID NO: 371162 - DNA, 140 bp, Artificial Sequence
  Synthetic
caccgctgtcccaaaaggtcgtcattgccatctgtgtcaccatagggacgacgtcccaaggttttgtcagcagtctgaccactccgttcaccatagatgatgctgacccagtttgttttgcatatcagcagccagggcct

SEQ ID NO: 371163 - DNA, 140 bp, Artificial Sequence
  Synthetic
atacgccatgctgggtctccctgacaaaaccttgggacgtcgtccctatggtgacacagatggcaatgacagacacgactccatttggacaacagcgcgttttcaaagagaaagtggacacgtacttgggagtcggccat

SEQ ID NO: 371164 - DNA, 140 bp, Artificial Sequence
  Synthetic
atggccgactcccaagtacgtgtccactttctctttgaaaacgcgctgttgtccaaatggagtcgtgtctgtcattgccatctgtgtcaccatagggacgacgtcccaaggttttgtcagggagacccagcatggcgtat

SEQ ID NO: 371165 - DNA, 140 bp, Artificial Sequence
  Synthetic
atacgccatgctgggtctcccagaaacccaggatttgcgctcttggcagggtttatggcctacatgatcgggcaaacaggaatccagcgaacagtcttcttcattctaatgatgctggtccgtacttgggagtcggccat

SEQ ID NO: 371166 - DNA, 140 bp, Artificial Sequence
  Synthetic
atggccgactcccaagtacggaccagcatcattagaatgaagaagactgttcgctggattcctgtttgcccgatcatgtaggccataaaccctgccaagagcgcaaatcctgggtttctgggagacccagcatggcgtat

SEQ ID NO: 371167 - DNA, 140 bp, Artificial Sequence
  Synthetic
aggccctggctgctgatatggcagagtggctttggaaagaactaggaaaggaaaagacacctagaatgtgtaccagagaagaattcacaagaaaagtgagaagcaatgcagccttggggggaccttttgggacagcggtg

SEQ ID NO: 371168 - DNA, 140 bp, Artificial Sequence
  Synthetic
caccgctgtcccaaaaggtccccccaaggctgcattgcttctcacttttcttgtgaattcttctctggtacacattctaggtgtcttttcctttcctagttctttccaaagccactctgccatatcagcagccagggcct

SEQ ID NO: 371169 - DNA, 140 bp, Artificial Sequence
  Synthetic
aggccctggctgctgatatgtaccagagaagaattcacaagaaaagtgagaagcaatgcagccttgggggccgtattcactgatgagaacaaatggaaatcggcacgtgaggctgttgaagaccttttgggacagcggtg

SEQ ID NO: 371170 - DNA, 140 bp, Artificial Sequence
  Synthetic
caccgctgtcccaaaaggtcttcaacagcctcacgtgccgatttccatttgttctcatcagtgaatacggcccccaaggctgcattgcttctcacttttcttgtgaattcttctctggtacatatcagcagccagggcct

SEQ ID NO: 371171 - DNA, 140 bp, Artificial Sequence
  Synthetic
aggccctggctgctgatatgagccttacctcaaagaggaacaagatcaacagtacatctgccggagagatgtggtagatagagggtggggcaacggctgcggcttgtttgggaaaggagggaccttttgggacagcggtg

SEQ ID NO: 371172 - DNA, 140 bp, Artificial Sequence
  Synthetic
caccgctgtcccaaaaggtccctcctttcccaaacaagccgcagccgttgccccaccctctatctaccacatctctccggcagatgtactgttgatcttgttcctctttgaggtaaggctcatatcagcagccagggcct

SEQ ID NO: 371173 - DNA, 140 bp, Artificial Sequence
  Synthetic
atacgccatgctgggtctccagttgtgacatgtgcgaagttttcatgctcaggaaaaataacgggcaacttagtccaaattgagaatcttgaatacacagtggttgtgacagtccataatcgtacttgggagtcggccat

SEQ ID NO: 371174 - DNA, 140 bp, Artificial Sequence
  Synthetic
atggccgactcccaagtacgattatggactgtcacaaccactgtgtattcaagattctcaatttggactaagttgcccgttatttttcctgagcatgaaaacttcgcacatgtcacaactggagacccagcatggcgtat

SEQ ID NO: 371175 - DNA, 140 bp, Artificial Sequence
  Synthetic
aggccctggctgctgatatgaagcctggtggcatccgtggagctaccaaactctctagaggagctaggagatggacttgcaatgggcatcatgatgttaaaattactgaccgattttcaggaccttttgggacagcggtg

SEQ ID NO: 371176 - DNA, 140 bp, Artificial Sequence
  Synthetic
caccgctgtcccaaaaggtcctgaaaatcggtcagtaattttaacatcatgatgcccattgcaagtccatctcctagctcctctagagagtttggtagctccacggatgccaccaggcttcatatcagcagccagggcct

SEQ ID NO: 371177 - DNA, 140 bp, Artificial Sequence
  Synthetic
atacgccatgctgggtctcctcacaccagctatggaccaccttactgtccctgacatttgtcaaaacaactctttcattggattatgcatggaagacaatggccatggtgttgtcaatagcgtacttgggagtcggccat

SEQ ID NO: 371178 - DNA, 140 bp, Artificial Sequence
  Synthetic
atggccgactcccaagtacgctattgacaacaccatggccattgtcttccatgcataatccaatgaaagagttgttttgacaaatgtcagggacagtaaggtggtccatagctggtgtgaggagacccagcatggcgtat

SEQ ID NO: 371179 - DNA, 140 bp, Artificial Sequence
  Synthetic
atacgccatgctgggtctccacaagaaactagccgaggccatattcaaattaacgtaccaaaacaaggtggtgcgtgtgcaaagaccaacaccaagaggcacagtaatggatatcatatccgtacttgggagtcggccat

SEQ ID NO: 371180 - DNA, 140 bp, Artificial Sequence
  Synthetic
atggccgactcccaagtacggatatgatatccattactgtgcctcttggtgttggtctttgcacacgcaccaccttgttttggtacgttaatttgaatatggcctcggctagtttcttgtggagacccagcatggcgtat

SEQ ID NO: 371181 - DNA, 140 bp, Artificial Sequence
  Synthetic
atacgccatgctgggtctcctttcttggatctacctctaccatggacagccggagcggacacgtcagaagttcactggaatcacaaagagagaatggtgacattcaaggttcctcatgcccgtacttgggagtcggccat

SEQ ID NO: 371182 - DNA, 140 bp, Artificial Sequence
  Synthetic
atggccgactcccaagtacgggcatgaggaaccttgaatgtcaccattctctctttgtgattccagtgaacttctgacgtgtccgctccggctgtccatggtagaggtagatccaagaaaggagacccagcatggcgtat

SEQ ID NO: 371183 - DNA, 140 bp, Artificial Sequence
  Synthetic
aggccctggctgctgatatgcataacagaaaataaaatctggggaaggaagagttggcccctcaacgaaggaattatggctgttggaatagctagcattctattaagttcacttctaaaagaccttttgggacagcggtg

SEQ ID NO: 371184 - DNA, 140 bp, Artificial Sequence
  Synthetic
caccgctgtcccaaaaggtcttttagaagtgaacttaatagaatgctagctattccaacagccataattccttcgttgaggggccaactcttccttccccagattttattttctgttatgcatatcagcagccagggcct

SEQ ID NO: 371185 - DNA, 140 bp, Artificial Sequence
  Synthetic
atacgccatgctgggtctccaatgatgtgccgctagctggcccactaatagccggaggcatgctaatagcatgttatgtcatatccgggagctcagccgatttatctctggagaaagcggcgtacttgggagtcggccat

SEQ ID NO: 371186 - DNA, 140 bp, Artificial Sequence
  Synthetic
atggccgactcccaagtacgccgctttctccagagataaatcggctgagctcccggatatgacataacatgctattagcatgcctccggctattagtgggccagctagcggcacatcattggagacccagcatggcgtat

SEQ ID NO: 371187 - DNA, 140 bp, Artificial Sequence
  Synthetic
aggccctggctgctgatatgatgttatgtcatatccgggagctcagccgatttatctctggagaaagcggctgaggtctcctgggaagaagaagcagaacactctggcgcctcacacaacgaccttttgggacagcggtg

SEQ ID NO: 371188 - DNA, 140 bp, Artificial Sequence
  Synthetic
caccgctgtcccaaaaggtcgttgtgtgaggcgccagagtgttctgcttcttcttcccaggagacctcagccgctttctccagagataaatcggctgagctcccggatatgacataacatcatatcagcagccagggcct

SEQ ID NO: 371189 - DNA, 140 bp, Artificial Sequence
  Synthetic
  misc_feature (80)..(80): n is a, c, g, or t
atacgccatgctgggtctccggaatgtcatacacgatgtgctcaggaaagttctcaattgataaagagatggcagaaacncagcatggaacaacagtggtaaagatcaagtatgagggtacgtacttgggagtcggccat

SEQ ID NO: 371190 - DNA, 140 bp, Artificial Sequence
  Synthetic
  misc_feature (61)..(61): n is a, c, g, or t
atggccgactcccaagtacgtaccctcatacttgatctttaccactgttgttccatgctgngtttctgccatctctttatcaattgagaactttcctgagcacatcgtgtatgacattccggagacccagcatggcgtat

SEQ ID NO: 371191 - DNA, 140 bp, Artificial Sequence
  Synthetic
atacgccatgctgggtctccatcttagtggaggtccaagacgatggaactatgaaaataaaagatgaagagagagatgacacactcaccatactccttaaagcaactctgctggcagtttcgtacttgggagtcggccat

SEQ ID NO: 371192 - DNA, 140 bp, Artificial Sequence
  Synthetic
atggccgactcccaagtacgaaactgccagcagagttgctttaaggagtatggtgagtgtgtcatctctctcttcatcttttattttcatagttccatcgtcttggacctccactaagatggagacccagcatggcgtat

SEQ ID NO: 371193 - DNA, 140 bp, Artificial Sequence
  Synthetic
aggccctggctgctgatatgcaggggtgtacccaatgtcaataccagcaaccctttttgtgtggtatttttggcagaaaaagaaacagagatcaggagtgttatgggacacacccagcccgaccttttgggacagcggtg

SEQ ID NO: 371194 - DNA, 140 bp, Artificial Sequence
  Synthetic
caccgctgtcccaaaaggtcgggctgggtgtgtcccataacactcctgatctctgtttctttttctgccaaaaataccacacaaaaagggttgctggtattgacattgggtacacccctgcatatcagcagccagggcct

SEQ ID NO: 371195 - DNA, 140 bp, Artificial Sequence
  Synthetic
aggccctggctgctgatatgcagtgtgaccaatatagaattggaacctccttttggggatagctacatagtgataggtgtgggagacagtgcattaacactccattggttcagaaaaggggaccttttgggacagcggtg

SEQ ID NO: 371196 - DNA, 140 bp, Artificial Sequence
  Synthetic
caccgctgtcccaaaaggtccccttttctgaaccaatggagtgttaatgcactgtctcccacacctatcactatgtagctatccccaaaaggaggttccaattctatattggtcacactgcatatcagcagccagggcct

SEQ ID NO: 371197 - DNA, 140 bp, Artificial Sequence
  Synthetic
aggccctggctgctgatatgaaagaggactgttgggcaggtcccaggtaggagtgggagtcttccaagatggcgtgttccacacaatgtggcacgtcaccaggggagctgtcctcatgtagaccttttgggacagcggtg

SEQ ID NO: 371198 - DNA, 140 bp, Artificial Sequence
  Synthetic
caccgctgtcccaaaaggtctacatgaggacagctcccctggtgacgtgccacattgtgtggaacacgccatcttggaagactcccactcctacctgggacctgcccaacagtcctctttcatatcagcagccagggcct

SEQ ID NO: 371199 - DNA, 140 bp, Artificial Sequence
  Synthetic
aggccctggctgctgatatggcgaagccctaaccctagcaacagggcccatatcaacactgtgggaaggaaatccaggaaaattttggaacacaacaatagcagtttctatggctaatatgaccttttgggacagcggtg

SEQ ID NO: 371200 - DNA, 140 bp, Artificial Sequence
  Synthetic
caccgctgtcccaaaaggtcatattagccatagaaactgctattgttgtgttccaaaattttcctggatttccttcccacagtgttgatatgggccctgttgctagggttagggcttcgccatatcagcagccagggcct

SEQ ID NO: 371201 - DNA, 140 bp, Artificial Sequence
  Synthetic
aggccctggctgctgatatgtcacgtcattgggaaaggctgtacaccaggtctttggcagtgtgtatacaactatgtttggaggagtctcgtggatggtcagaatcctaatcgggctcttgaccttttgggacagcggtg

SEQ ID NO: 371202 - DNA, 140 bp, Artificial Sequence
  Synthetic
caccgctgtcccaaaaggtcaagagcccgattaggattctgaccatccacgagactcctccaaacatagttgtatacacactgccaaagacctggtgtacagcctttcccaatgacgtgacatatcagcagccagggcct

SEQ ID NO: 371203 - DNA, 140 bp, Artificial Sequence
  Synthetic
atacgccatgctgggtctccagtgttgtggattggcacgaattcaagaaacacttcaatggctatgtcgtgcatagctgttggaggaatcaccctgtttctgggcttcacagttcatgcacgtacttgggagtcggccat

SEQ ID NO: 371204 - DNA, 140 bp, Artificial Sequence
  Synthetic
atggccgactcccaagtacgtgcatgaactgtgaagcccagaaacagggtgattcctccaacagctatgcacgacatagccattgaagtgtttcttgaattcgtgccaatccacaacactggagacccagcatggcgtat

SEQ ID NO: 371205 - DNA, 140 bp, Artificial Sequence
  Synthetic
atacgccatgctgggtctccgacatgggttgtgcggtgtcatggagtgggaaagagttgaaatgtggaagcggaatttttgtaattgacaacgtgcacacttggacagaacagtacaaatcgtacttgggagtcggccat

SEQ ID NO: 371206 - DNA, 140 bp, Artificial Sequence
  Synthetic
atggccgactcccaagtacgatttgtactgttctgtccaagtgtgcacgttgtcaattacaaaaattccgcttccacatttcaactctttcccactccatgacaccgcacaacccatgtcggagacccagcatggcgtat

SEQ ID NO: 371207 - DNA, 140 bp, Artificial Sequence
  Synthetic
aggccctggctgctgatatgagccccgtccaaggacgtaaaaagaagtcaggccatcacaaatgccacagcttgagtaaactgtgcagcctgtagctccacctgaggaggtgtaaaaaacgaccttttgggacagcggtg

SEQ ID NO: 371208 - DNA, 140 bp, Artificial Sequence
  Synthetic
caccgctgtcccaaaaggtcgttttttacacctcctcaggtggagctacaggctgcacagtttactcaagctgtggcatttgtgatggcctgacttctttttacgtccttggacggggctcatatcagcagccagggcct

SEQ ID NO: 371209 - DNA, 140 bp, Artificial Sequence
  Synthetic
aggccctggctgctgatatggtggaagcaaataaccaatgaattaaactatgttctctgggaaggaggacatgacctcactgtagtggccggggatgtgaaaggggtcttgtccaaaggcgaccttttgggacagcggtg

SEQ ID NO: 371210 - DNA, 140 bp, Artificial Sequence
  Synthetic
caccgctgtcccaaaaggtcgcctttggacaagacccctttcacatccccggccactacagtgaggtcatgtcctccttcccagagaacatagtttaattcattggttatttgcttccaccatatcagcagccagggcct

SEQ ID NO: 371211 - DNA, 140 bp, Artificial Sequence
  Synthetic
aggccctggctgctgatatgtgaggccataaaaaggaaactgcgtacgctaatcttagctcccacaagagtcgtcgcctctgaaatggcagaggcgcttaaaggaatgccaataagatatgaccttttgggacagcggtg

SEQ ID NO: 371212 - DNA, 140 bp, Artificial Sequence
  Synthetic
caccgctgtcccaaaaggtcatatcttattggcattcctttaagcgcctctgccatttcagaggcgacgactcttgtgggagctaagattagcgtacgcagtttcctttttatggcctcacatatcagcagccagggcct

SEQ ID NO: 371213 - DNA, 140 bp, Artificial Sequence
  Synthetic
atacgccatgctgggtctccaagagagcactcgcacctccagtgaatgacctgaaatattcatggaagacatggggaaaagcaaagatctttactccagaaacaagaaacagcacattttcgtacttgggagtcggccat

SEQ ID NO: 371214 - DNA, 140 bp, Artificial Sequence
  Synthetic
atggccgactcccaagtacgaaaatgtgctgtttcttgtttctggagtaaagatctttgcttttccccatgtcttccatgaatatttcaggtcattcactggaggtgcgagtgctctcttggagacccagcatggcgtat

SEQ ID NO: 371215 - DNA, 140 bp, Artificial Sequence
  Synthetic
atacgccatgctgggtctcccttcagagggagttatttggctggagctggactccttttctccatcatgaggaacacaaccagcgcacgaagaggaaccggcactataggtgaaactttacgtacttgggagtcggccat

SEQ ID NO: 371216 - DNA, 140 bp, Artificial Sequence
  Synthetic
atggccgactcccaagtacgtaaagtttcacctatagtgccggttcctcttcgtgcgctggttgtgttcctcatgatggagaaaaggagtccagctccagccaaataactccctctgaagggagacccagcatggcgtat

SEQ ID NO: 371217 - DNA, 140 bp, Artificial Sequence
  Synthetic
atacgccatgctgggtctcccatgtgccacgccactttcaccatgcgtctcttatctccggtgagagttcccaattacaacatgattattatggacgaggcacatttcactgatccagcccgtacttgggagtcggccat

SEQ ID NO: 371218 - DNA, 140 bp, Artificial Sequence
  Synthetic
atggccgactcccaagtacgggctggatcagtgaaatgtgcctcgtccataataatcatgttgtaattgggaactctcaccggagataagagacgcatggtgaaagtggcgtggcacatgggagacccagcatggcgtat

SEQ ID NO: 371219 - DNA, 140 bp, Artificial Sequence
  Synthetic
aggccctggctgctgatatgccaattacaacatgattattatggacgaggcacatttcactgatccagccagcatagcagccagagggtatatctcaacccgagtgggcatgggtgaagcgaccttttgggacagcggtg

SEQ ID NO: 371220 - DNA, 140 bp, Artificial Sequence
  Synthetic
caccgctgtcccaaaaggtcgcttcacccatgcccactcgggttgagatataccctctggctgctatgctggctggatcagtgaaatgtgcctcgtccataataatcatgttgtaattggcatatcagcagccagggcct

SEQ ID NO: 371221 - DNA, 140 bp, Artificial Sequence
  Synthetic
atacgccatgctgggtctcctgtcggcggcaatcaaagaccagaaagctgtgcatgctgatatgggctattggatagagagctcaaaaaaccagacctggcagatagagaaggcatccctcgtacttgggagtcggccat

SEQ ID NO: 371222 - DNA, 140 bp, Artificial Sequence
  Synthetic
atggccgactcccaagtacgagggatgccttctctatctgccaggtctggttttttgagctctctatccaatagcccatatcagcatgcacagctttctggtctttgattgccgccgacaggagacccagcatggcgtat

SEQ ID NO: 371223 - DNA, 140 bp, Artificial Sequence
  Synthetic
aggccctggctgctgatatgcacagagcaatgcagttatccaagatgaggaaagagatattcctgagagatcatggaactcaggttatgattggatcaccgacttcccaggtaaaacagtgaccttttgggacagcggtg

SEQ ID NO: 371224 - DNA, 140 bp, Artificial Sequence
  Synthetic
caccgctgtcccaaaaggtcactgttttacctgggaagtcggtgatccaatcataacctgagttccatgatctctcaggaatatctctttcctcatcttggataactgcattgctctgtgcatatcagcagccagggcct

SEQ ID NO: 371225 - DNA, 140 bp, Artificial Sequence
  Synthetic
atacgccatgctgggtctccatggagtgctcgaaagccagatgctcatcccaaaagcatatgcaggccctatttcacagcacaactatcgccagggctatgccacgcagaccgtgggccccgtacttgggagtcggccat

SEQ ID NO: 371226 - DNA, 140 bp, Artificial Sequence
  Synthetic
atggccgactcccaagtacggggcccacggtctgcgtggcatagccctggcgatagttgtgctgtgaaatagggcctgcatatgcttttgggatgagcatctggctttcgagcactccatggagacccagcatggcgtat

SEQ ID NO: 371227 - DNA, 140 bp, Artificial Sequence
  Synthetic
atacgccatgctgggtctccatggcacttgggcaaattggagatagactttggtgaatgccccggaacaacagtcactatacaagaggattgtgaccatagagggccatctttgaggacccgtacttgggagtcggccat

SEQ ID NO: 371228 - DNA, 140 bp, Artificial Sequence
  Synthetic
atggccgactcccaagtacgggtcctcaaagatggccctctatggtcacaatcctcttgtatagtgactgttgttccggggcattcaccaaagtctatctccaatttgcccaagtgccatggagacccagcatggcgtat

SEQ ID NO: 371229 - DNA, 140 bp, Artificial Sequence
  Synthetic
aggccctggctgctgatatgcagtcactatacaagaggattgtgaccatagagggccatctttgaggaccaccactgcatctggaaaattggtcacgcagtggtgctgtcgctcctgcacgaccttttgggacagcggtg

SEQ ID NO: 371230 - DNA, 140 bp, Artificial Sequence
  Synthetic
caccgctgtcccaaaaggtcgtgcaggagcgacagcaccactgcgtgaccaattttccagatgcagtggtggtcctcaaagatggccctctatggtcacaatcctcttgtatagtgactgcatatcagcagccagggcct

SEQ ID NO: 371231 - DNA, 140 bp, Artificial Sequence
  Synthetic
atacgccatgctgggtctccgatgcctcccttaagatttttaggagaggatggatgctggtatgggatggaaatcaggcccttgaatgaaaaagaagagaacatggtcaaatcacaggtacgtacttgggagtcggccat

SEQ ID NO: 371232 - DNA, 140 bp, Artificial Sequence
  Synthetic
atggccgactcccaagtacgtacctgtgatttgaccatgttctcttctttttcattcaagggcctgatttccatcccataccagcatccatcctctcctaaaaatcttaagggaggcatcggagacccagcatggcgtat

SEQ ID NO: 371233 - DNA, 140 bp, Artificial Sequence
  Synthetic
aggccctggctgctgatatgaagtctcttgtttaaaacagaggatggtgtgaacatgtgtaccctcatggccatggaccttggtgaactgtgtgaagacacagtcacttataactgtcctgaccttttgggacagcggtg

SEQ ID NO: 371234 - DNA, 140 bp, Artificial Sequence
  Synthetic
caccgctgtcccaaaaggtcaggacagttataagtgactgtgtcttcacacagttcaccaaggtccatggccatgagggtacacatgttcacaccatcctctgttttaaacaagagacttcatatcagcagccagggcct

SEQ ID NO: 371235 - DNA, 140 bp, Artificial Sequence
  Synthetic
aggccctggctgctgatatggacagcctttaaacaacgatgaggaccatgctcattggacagaagcgaaaatgctccttgacaatataaacacaccagaagggattattccagctctcttgaccttttgggacagcggtg

SEQ ID NO: 371236 - DNA, 140 bp, Artificial Sequence
  Synthetic
caccgctgtcccaaaaggtcaagagagctggaataatcccttctggtgtgtttatattgtcaaggagcattttcgcttctgtccaatgagcatggtcctcatcgttgtttaaaggctgtccatatcagcagccagggcct

SEQ ID NO: 371237 - DNA, 140 bp, Artificial Sequence
  Synthetic
atacgccatgctgggtctccgactttgtttgtggaagaatgcttgaggagaagagtcaccaggaaacacatgatattagttgtggtgaccaccctttgtgccatcattttaggaggtcttcgtacttgggagtcggccat

SEQ ID NO: 371238 - DNA, 140 bp, Artificial Sequence
  Synthetic
atggccgactcccaagtacgaagacctcctaaaatgatggcacaaagggtggtcaccacaactaatatcatgtgtttcctggtgactcttctcctcaagcattcttccacaaacaaagtcggagacccagcatggcgtat

SEQ ID NO: 371239 - DNA, 140 bp, Artificial Sequence
  Synthetic
atacgccatgctgggtctccgtccacatgggtaacttatgggacatgcactgccacaggagaacacagaagggaaaaaagatcagtggcactcgtcccacatgtgggaatgggattggagcgtacttgggagtcggccat

SEQ ID NO: 371240 - DNA, 140 bp, Artificial Sequence
  Synthetic
atggccgactcccaagtacgctccaatcccattcccacatgtgggacgagtgccactgatcttttttcccttctgtgttctcctgtggcagtgcatgtcccataagttacccatgtggacggagacccagcatggcgtat

SEQ ID NO: 371241 - DNA, 140 bp, Artificial Sequence
  Synthetic
atacgccatgctgggtctcctggtagaatggggggacagattcatctagccatcatggcagtcttcaagatgtcaccaggatacgtgttgggtatatttctgaggaaactcacctcaagacgtacttgggagtcggccat

SEQ ID NO: 371242 - DNA, 140 bp, Artificial Sequence
  Synthetic
atggccgactcccaagtacgtcttgaggtgagtttcctcagaaatatacccaacacgtatcctggtgacatcttgaagactgccatgatggctagatgaatctgtccccccattctaccaggagacccagcatggcgtat

SEQ ID NO: 371243 - DNA, 140 bp, Artificial Sequence
  Synthetic
atacgccatgctgggtctccgagacagcactaatggtaataggaatggctatgacaacggtgctttcaattccacatgaccttatggaatttattgatggaatatcattagggttaatctcgtacttgggagtcggccat

SEQ ID NO: 371244 - DNA, 140 bp, Artificial Sequence
  Synthetic
atggccgactcccaagtacgagattaaccctaatgatattccatcaataaattccataaggtcatgtggaattgaaagcaccgttgtcatagccattcctattaccattagtgctgtctcggagacccagcatggcgtat

SEQ ID NO: 371245 - DNA, 140 bp, Artificial Sequence
  Synthetic
aggccctggctgctgatatgctttccttgaccttcataaaatcaacaatgccattggtcatggcttggaggaccataatggctgtgttgtttgtggtcacactcattcctctctgtaggagaccttttgggacagcggtg

SEQ ID NO: 371246 - DNA, 140 bp, Artificial Sequence
  Synthetic
caccgctgtcccaaaaggtctcctacagagaggaatgagtgtgaccacaaacaacacagccattatggtcctccaagccatgaccaatggcattgttgattttatgaaggtcaaggaaagcatatcagcagccagggcct

SEQ ID NO: 371247 - DNA, 140 bp, Artificial Sequence
  Synthetic
aggccctggctgctgatatggaccataatggctgtgttgtttgtggtcacactcattcctctctgtaggacaagctgtcttcaaaagcagtcccattgggtggaaataacagcacttatcgaccttttgggacagcggtg

SEQ ID NO: 371248 - DNA, 140 bp, Artificial Sequence
  Synthetic
caccgctgtcccaaaaggtcgataagtgctgttatttccacccaatgggactgcttttgaagacagcttgtcctacagagaggaatgagtgtgaccacaaacaacacagccattatggtccatatcagcagccagggcct

SEQ ID NO: 371249 - DNA, 140 bp, Artificial Sequence
  Synthetic
atacgccatgctgggtctccctgggagcccaggctctaccagtatacctaatgactctcatgaaaggcgcctcaaaaagatcttggccccttaacgagggtataatggctgtgggcttggcgtacttgggagtcggccat

SEQ ID NO: 371250 - DNA, 140 bp, Artificial Sequence
  Synthetic
atggccgactcccaagtacgccaagcccacagccattataccctcgttaaggggccaagatctttttgaggcgcctttcatgagagtcattaggtatactggtagagcctgggctcccagggagacccagcatggcgtat

SEQ ID NO: 371251 - DNA, 140 bp, Artificial Sequence
  Synthetic
aggccctggctgctgatatgctcaaaaagatcttggccccttaacgagggtataatggctgtgggcttggtgagtctcttaggaagcgcccttctaaagaatgatgtccctttagctggcgaccttttgggacagcggtg

SEQ ID NO: 371252 - DNA, 140 bp, Artificial Sequence
  Synthetic
caccgctgtcccaaaaggtcgccagctaaagggacatcattctttagaagggcgcttcctaagagactcaccaagcccacagccattataccctcgttaaggggccaagatctttttgagcatatcagcagccagggcct

SEQ ID NO: 371253 - DNA, 140 bp, Artificial Sequence
  Synthetic
atacgccatgctgggtctccaaaaaaacatggaagggaaaatcgtgcaaccagaaaacctggaatacaccattgtgataacacctcactcaggggaagagaatgcagttggaaatgacaccgtacttgggagtcggccat

SEQ ID NO: 371254 - DNA, 140 bp, Artificial Sequence
  Synthetic
atggccgactcccaagtacggtgtcatttccaactgcattctcttcccctgagtgaggtgttatcacaatggtgtattccaggttttctggttgcacgattttcccttccatgtttttttggagacccagcatggcgtat

SEQ ID NO: 371255 - DNA, 140 bp, Artificial Sequence
  Synthetic
atacgccatgctgggtctccgaccttgtttgtggaagaatgcttgaggagaagagtcaccaggaaacacatgatattagctgtggtaatcactctttgtgctatcatcctggggggcctccgtacttgggagtcggccat

SEQ ID NO: 371256 - DNA, 140 bp, Artificial Sequence
  Synthetic
atggccgactcccaagtacggaggccccccaggatgatagcacaaagagtgattaccacagctaatatcatgtgtttcctggtgactcttctcctcaagcattcttccacaaacaaggtcggagacccagcatggcgtat

SEQ ID NO: 371257 - DNA, 140 bp, Artificial Sequence
  Synthetic
aggccctggctgctgatatgaagcagaactgacaggctatggcaccgtcacgatggagtgctctccgagaacgggccttgacttcaatgagatggtgttgctgcaaatggaaaacaaagcgaccttttgggacagcggtg

SEQ ID NO: 371258 - DNA, 140 bp, Artificial Sequence
  Synthetic
caccgctgtcccaaaaggtcgctttgttttccatttgcagcaacaccatctcattgaagtcaaggcccgttctcggagagcactccatcgtgacggtgccatagcctgtcagttctgcttcatatcagcagccagggcct

SEQ ID NO: 371259 - DNA, 140 bp, Artificial Sequence
  Synthetic
aggccctggctgctgatatgcatgctacaatgctggacgtagatctacgtccagcttcagcctggaccctctatgcagtggccacaacaatcatcactcctatgatgagacacacaattggaccttttgggacagcggtg

SEQ ID NO: 371260 - DNA, 140 bp, Artificial Sequence
  Synthetic
caccgctgtcccaaaaggtccaattgtgtgtctcatcataggagtgatgattgttgtggccactgcatagagggtccaggctgaagctggacgtagatctacgtccagcattgtagcatgcatatcagcagccagggcct

SEQ ID NO: 371261 - DNA, 140 bp, Artificial Sequence
  Synthetic
atacgccatgctgggtctccttccagtcacaatgaccctatggtacatgtggcaagtgaaaacacaaagatcaggagccctgtgggacgtcccctcacctgctgccgctcagaaagccaccgtacttgggagtcggccat

SEQ ID NO: 371262 - DNA, 140 bp, Artificial Sequence
  Synthetic
atggccgactcccaagtacggtggctttctgagcggcagcaggtgaggggacgtcccacagggctcctgatctttgtgttttcacttgccacatgtaccatagggtcattgtgactggaaggagacccagcatggcgtat

SEQ ID NO: 371263 - DNA, 140 bp, Artificial Sequence
  Synthetic
atacgccatgctgggtctccaaaacacaacggcaaacatttccctgacagctattgcaaaccaggcagccatattgatgggactagacaagggatggccgatatcgaagatggatataggcgtacttgggagtcggccat

SEQ ID NO: 371264 - DNA, 140 bp, Artificial Sequence
  Synthetic
atggccgactcccaagtacgcctatatccatcttcgatatcggccatcccttgtctagtcccatcaatatggctgcctggtttgcaatagctgtcagggaaatgtttgccgttgtgttttggagacccagcatggcgtat

SEQ ID NO: 371265 - DNA, 140 bp, Artificial Sequence
  Synthetic
aggccctggctgctgatatgatattgatgggactagacaagggatggccgatatcgaagatggatataggggttccacttctcgctttaggatgctattctcaggtgaacccattaacacgaccttttgggacagcggtg

SEQ ID NO: 371266 - DNA, 140 bp, Artificial Sequence
  Synthetic
caccgctgtcccaaaaggtcgtgttaatgggttcacctgagaatagcatcctaaagcgagaagtggaacccctatatccatcttcgatatcggccatcccttgtctagtcccatcaatatcatatcagcagccagggcct

SEQ ID NO: 371267 - DNA, 140 bp, Artificial Sequence
  Synthetic
aggccctggctgctgatatgtcaagaaggggctatgcatacagcacttacaggggccacggaaatccagatgtcatcaggaaacctactgttcacaggacatctcaagtgcaggctgagagaccttttgggacagcggtg

SEQ ID NO: 371268 - DNA, 140 bp, Artificial Sequence
  Synthetic
caccgctgtcccaaaaggtctctcagcctgcacttgagatgtcctgtgaacagtaggtttcctgatgacatctggatttccgtggcccctgtaagtgctgtatgcatagccccttcttgacatatcagcagccagggcct

SEQ ID NO: 371269 - DNA, 140 bp, Artificial Sequence
  Synthetic
atacgccatgctgggtctcctgacagcagcggtgttgatgctagtggctcattatgctataattggacctggattgcaagcaaaagccactagagaagctcagaaaaggacagcggctggcgtacttgggagtcggccat

SEQ ID NO: 371270 - DNA, 140 bp, Artificial Sequence
  Synthetic
atggccgactcccaagtacgccagccgctgtccttttctgagcttctctagtggcttttgcttgcaatccaggtccaattatagcataatgagccactagcatcaacaccgctgctgtcaggagacccagcatggcgtat

SEQ ID NO: 371271 - DNA, 140 bp, Artificial Sequence
  Synthetic
atacgccatgctgggtctccaataatgaaaaatccaaccgtagacgggattgtcgcaatagatctggatcctgtggtttacgatacaaagtttgaaaaacagctgggtcaaataatgttacgtacttgggagtcggccat

SEQ ID NO: 371272 - DNA, 140 bp, Artificial Sequence
  Synthetic
atggccgactcccaagtacgtaacattatttgacccagctgtttttcaaactttgtatcgtaaaccacaggatccagatctattgcgacaatcccgtctacggttggatttttcattattggagacccagcatggcgtat

SEQ ID NO: 371273 - DNA, 140 bp, Artificial Sequence
  Synthetic
atacgccatgctgggtctcctcagagtacaatatgaaggggatggttctccatgtaaaatcccttttgagataatggacctggaaaaaagacatgtcttaggtcgcctgattacagtcaacgtacttgggagtcggccat

SEQ ID NO: 371274 - DNA, 140 bp, Artificial Sequence
  Synthetic
atggccgactcccaagtacgttgactgtaatcaggcgacctaagacatgtcttttttccaggtccattatctcaaaagggattttacatggagaaccatccccttcatattgtactctgaggagacccagcatggcgtat

SEQ ID NO: 371275 - DNA, 140 bp, Artificial Sequence
  Synthetic
atacgccatgctgggtctccaacccttactggagaaattggagcagttacattggacttcaagcccggaacatccggttctcccatcattaacaggaaaggaaaagtcatcggactctaccgtacttgggagtcggccat

SEQ ID NO: 371276 - DNA, 140 bp, Artificial Sequence
  Synthetic
atggccgactcccaagtacggtagagtccgatgacttttcctttcctgttaatgatgggagaaccggatgttccgggcttgaagtccaatgtaactgctccaatttctccagtaagggttggagacccagcatggcgtat

SEQ ID NO: 371277 - DNA, 140 bp, Artificial Sequence
  Synthetic
atacgccatgctgggtctcccccaattgtcacagaaaaagacagcccagtcaacatagaagcagaacctccattcggagacagctacatcattataggagtagaaccgggacaactgaagcgtacttgggagtcggccat

SEQ ID NO: 371278 - DNA, 140 bp, Artificial Sequence
  Synthetic
atggccgactcccaagtacgcttcagttgtcccggttctactcctataatgatgtagctgtctccgaatggaggttctgcttctatgttgactgggctgtctttttctgtgacaattgggggagacccagcatggcgtat

SEQ ID NO: 371279 - DNA, 140 bp, Artificial Sequence
  Synthetic
aggccctggctgctgatatgttgggagtcatggtgcaggctgatagtggttgtgttgtgagttggaagaacaaagaactgaaatgtggcagtgggatttttatcacagacaatgtacacagaccttttgggacagcggtg

SEQ ID NO: 371280 - DNA, 140 bp, Artificial Sequence
  Synthetic
caccgctgtcccaaaaggtctgtgtacattgtctgtgataaaaatcccactgccacatttcagttctttgttcttccaactcacaacacaaccactatcagcctgcaccatgactcccaacatatcagcagccagggcct

SEQ ID NO: 371281 - DNA, 140 bp, Artificial Sequence
  Synthetic
atacgccatgctgggtctccagctgaaagaattggtgagccagattatgaagtcgatgaggacattttccgaaagaaaagattaactataatggatttacatcccggagccggaaagacacgtacttgggagtcggccat

SEQ ID NO: 371282 - DNA, 140 bp, Artificial Sequence
  Synthetic
atggccgactcccaagtacgtgtctttccggctccgggatgtaaatccattatagttaatcttttctttcggaaaatgtcctcatcgacttcataatctggctcaccaattctttcagctggagacccagcatggcgtat

SEQ ID NO: 371283 - DNA, 140 bp, Artificial Sequence
  Synthetic
aggccctggctgctgatatggaaatctttaggaggaggtaggagaggcacgggggctcaaggggaaacgctgggagaaaaatggaaaagacagctgaaccaactgagtaagtcagaattcgaccttttgggacagcggtg

SEQ ID NO: 371284 - DNA, 140 bp, Artificial Sequence
  Synthetic
caccgctgtcccaaaaggtcgaattctgacttactcagttggttcagctgtcttttccatttttctcccagcgtttccccttgagcccccgtgcctctcctacctcctcctaaagatttccatatcagcagccagggcct

SEQ ID NO: 371285 - DNA, 140 bp, Artificial Sequence
  Synthetic
atacgccatgctgggtctccaaaagaattctcccatcaatagttagagaagccttaaaaaggaggctgcgaaccttgattctggctcccacgagagtggtggcggccgaaatggaagaagcgtacttgggagtcggccat

SEQ ID NO: 371286 - DNA, 140 bp, Artificial Sequence
  Synthetic
atggccgactcccaagtacgcttcttccatttcggccgccaccactctcgtgggagccagaatcaaggttcgcagcctcctttttaaggcttctctaactattgatgggagaattcttttggagacccagcatggcgtat

SEQ ID NO: 371287 - DNA, 140 bp, Artificial Sequence
  Synthetic
atacgccatgctgggtctccaacacttacaagaggagcgggattactgaggtggacagatctgaagccaaagagggactgaagagaggagaaacaaccaaacatgcagtgtcgagaggagcgtacttgggagtcggccat

SEQ ID NO: 371288 - DNA, 140 bp, Artificial Sequence
  Synthetic
atggccgactcccaagtacgctcctctcgacactgcatgtttggttgtttctcctctcttcagtccctctttggcttcagatctgtccacctcagtaatcccgctcctcttgtaagtgttggagacccagcatggcgtat

SEQ ID NO: 371289 - DNA, 140 bp, Artificial Sequence
  Synthetic
aggccctggctgctgatatggaaaatcctcataggagttgtcatcacatggataggaatgaattcacgcagcacctcactgtccgtgtcgttagtattagtgggagtcgtgacattgtatgaccttttgggacagcggtg

SEQ ID NO: 371290 - DNA, 140 bp, Artificial Sequence
  Synthetic
caccgctgtcccaaaaggtcatacaatgtcacgactcccactaatactaacgacacggacagtgaggtgctgcgtgaattcattcctatccatgtgatgacaactcctatgaggattttccatatcagcagccagggcct

SEQ ID NO: 371291 - DNA, 140 bp, Artificial Sequence
  Synthetic
atacgccatgctgggtctccaaagtcatagaccttggttgtggaagaggtggctggtcatattactgcgctgggttgaagaaagtcacagaagtgaagggatacacaaaagggggacctgcgtacttgggagtcggccat

SEQ ID NO: 371292 - DNA, 140 bp, Artificial Sequence
  Synthetic
atggccgactcccaagtacgcaggtcccccttttgtgtatcccttcacttctgtgactttcttcaacccagcgcagtaatatgaccagccacctcttccacaaccaaggtctatgactttggagacccagcatggcgtat

SEQ ID NO: 371293 - DNA, 140 bp, Artificial Sequence
  Synthetic
atacgccatgctgggtctccgacatgaggaacccatcccaatggcgacctatggatggaacctagttaagctacactccggaaaagacgtattcttcataccacctgagaaatgtgataccgtacttgggagtcggccat

SEQ ID NO: 371294 - DNA, 140 bp, Artificial Sequence
  Synthetic
atggccgactcccaagtacggtatcacatttctcaggtggtatgaagaatacgtcttttccggagtgtagcttaactaggttccatccataggtcgccattgggatgggttcctcatgtcggagacccagcatggcgtat

SEQ ID NO: 371295 - DNA, 140 bp, Artificial Sequence
  Synthetic
aggccctggctgctgatatggaagaacgttacgtgttctaaagatggtggaaccatggctcagaggaaatcaattttgcataaaaattctaaatccttacatgccaagtgtggtagaaacgaccttttgggacagcggtg

SEQ ID NO: 371296 - DNA, 140 bp, Artificial Sequence
  Synthetic
caccgctgtcccaaaaggtcgtttctaccacacttggcatgtaaggatttagaatttttatgcaaaattgatttcctctgagccatggttccaccatctttagaacacgtaacgttcttccatatcagcagccagggcct

SEQ ID NO: 371297 - DNA, 140 bp, Artificial Sequence
  Synthetic
aggccctggctgctgatatggctgaagtattcatggaaaacatggggcaaagcgaaaatgctctccacagagcctcataaccagacctttctcattgatggccccgaaacagcagaatgtgaccttttgggacagcggtg

SEQ ID NO: 371298 - DNA, 140 bp, Artificial Sequence
  Synthetic
caccgctgtcccaaaaggtcacattctgctgtttcggggccatcaatgagaaaggtctggttatgaggctctgtggagagcattttcgctttgccccatgttttccatgaatacttcagccatatcagcagccagggcct

SEQ ID NO: 371299 - DNA, 140 bp, Artificial Sequence
  Synthetic
aggccctggctgctgatatggactgggattttgtggttaccacagacatatctgaaatgggggccaattttagagctgggagagtgatagaccccaggagatgccttaagccagttatctgaccttttgggacagcggtg

SEQ ID NO: 371300 - DNA, 140 bp, Artificial Sequence
  Synthetic
caccgctgtcccaaaaggtcagataactggcttaaggcatctcctggggtctatcactctcccagctctaaaattggcccccatttcagatatgtctgtggtaaccacaaaatcccagtccatatcagcagccagggcct

SEQ ID NO: 371301 - DNA, 140 bp, Artificial Sequence
  Synthetic
atacgccatgctgggtctcccccaacacaaacagagcttggaactcactagaagttgaagactatggctttggggtattcaccaccaacatatggctgaagttgaaagaaaggcaggatgcgtacttgggagtcggccat

SEQ ID NO: 371302 - DNA, 140 bp, Artificial Sequence
  Synthetic
atggccgactcccaagtacgcatcctgcctttctttcaacttcagccatatgttggtggtgaataccccaaagccatagtcttcaacttctagtgagttccaagctctgtttgtgttgggggagacccagcatggcgtat

SEQ ID NO: 371303 - DNA, 140 bp, Artificial Sequence
  Synthetic
aggccctggctgctgatatgatcatgcccactggactgaagcaaagatgcttcttgataatatctacaccccagaagggattattccaacactgtttggtccagaaagggaaaaaacccagaccttttgggacagcggtg

SEQ ID NO: 371304 - DNA, 140 bp, Artificial Sequence
  Synthetic
caccgctgtcccaaaaggtctgggttttttccctttctggaccaaacagtgttggaataatcccttctggggtgtagatattatcaagaagcatctttgcttcagtccagtgggcatgatcatatcagcagccagggcct

SEQ ID NO: 371305 - DNA, 140 bp, Artificial Sequence
  Synthetic
aggccctggctgctgatatgccaaagaattttgctggaccagtatcacaacacaattacagaccaggctatcacacacaaacggcaggaccctggcatctaggcaagcttgagatggactgaccttttgggacagcggtg

SEQ ID NO: 371306 - DNA, 140 bp, Artificial Sequence
  Synthetic
caccgctgtcccaaaaggtcagtccatctcaagcttgcctagatgccagggtcctgccgtttgtgtgtgatagcctggtctgtaattgtgttgtgatactggtccagcaaaattctttggcatatcagcagccagggcct

SEQ ID NO: 371307 - DNA, 140 bp, Artificial Sequence
  Synthetic
aggccctggctgctgatatgcttcaatgaagagatttaggaaggaggaggagtcggagggagccatttggtgaacgtaggaagctctgagacacgcaacaggggataggcaaggacacacgaccttttgggacagcggtg

SEQ ID NO: 371308 - DNA, 140 bp, Artificial Sequence
  Synthetic
caccgctgtcccaaaaggtcgtgtgtccttgcctatcccctgttgcgtgtctcagagcttcctacgttcaccaaatggctccctccgactcctcctccttcctaaatctcttcattgaagcatatcagcagccagggcct

SEQ ID NO: 371309 - DNA, 140 bp, Artificial Sequence
  Synthetic
atacgccatgctgggtctcccctatcccctgtgtgccttgcctatcccctgttgcgtgtctcagtggaccgacaagaacagtttcgactcggaagcttgcttaacgtagtgctaacagttcgtacttgggagtcggccat

SEQ ID NO: 371310 - DNA, 140 bp, Artificial Sequence
  Synthetic
atggccgactcccaagtacgaactgttagcactacgttaagcaagcttccgagtcgaaactgttcttgtcggtccactgagacacgcaacaggggataggcaaggcacacaggggataggggagacccagcatggcgtat

SEQ ID NO: 371311 - DNA, 140 bp, Artificial Sequence
  Synthetic
atacgccatgctgggtctcccaggtatcttcctattctttatgcaaggaaaaggaataggaaaattgtcaatgggtttgatagccattgcggtagctagtggcttactctgggtggcagacgtacttgggagtcggccat

SEQ ID NO: 371312 - DNA, 140 bp, Artificial Sequence
  Synthetic
atggccgactcccaagtacgtctgccacccagagtaagccactagctaccgcaatggctatcaaacccattgacaattttcctattccttttccttgcataaagaataggaagatacctgggagacccagcatggcgtat

SEQ ID NO: 371313 - DNA, 140 bp, Artificial Sequence
  Synthetic
aggccctggctgctgatatgttgccttattagcagccttcaaagttagaccaacttttgcagctggactacttttaagaaagctgacctccaaggaattgatgatgaccaccataggaatgaccttttgggacagcggtg

SEQ ID NO: 371314 - DNA, 140 bp, Artificial Sequence
  Synthetic
caccgctgtcccaaaaggtcattcctatggtggtcatcatcaattccttggaggtcagctttcttaaaagtagtccagctgcaaaagttggtctaactttgaaggctgctaataaggcaacatatcagcagccagggcct

SEQ ID NO: 371315 - DNA, 140 bp, Artificial Sequence
  Synthetic
aggccctggctgctgatatggaatggaaacattacagagaaagtttggaggcgctctagtccgcaatccactttcaaggaattccacgcacgagatgtactgggtgtccaacgcttctgggaccttttgggacagcggtg

SEQ ID NO: 371316 - DNA, 140 bp, Artificial Sequence
  Synthetic
caccgctgtcccaaaaggtcccagaagcgttggacacccagtacatctcgtgcgtggaattccttgaaagtggattgcggactagagcgcctccaaactttctctgtaatgtttccattccatatcagcagccagggcct

SEQ ID NO: 371317 - DNA, 140 bp, Artificial Sequence
  Synthetic
atacgccatgctgggtctcctgtacttctctcccagagcaccataccagagactatacttgaactgactgatgcgttggccttgggcatgatgattctcaaaatagtgagaaatatggagcgtacttgggagtcggccat

SEQ ID NO: 371318 - DNA, 140 bp, Artificial Sequence
  Synthetic
atggccgactcccaagtacgctccatatttctcactattttgagaatcatcatgcccaaggccaacgcatcagtcagttcaagtatagtctctggtatggtgctctgggagagaagtacaggagacccagcatggcgtat

SEQ ID NO: 371319 - DNA, 140 bp, Artificial Sequence
  Synthetic
aggccctggctgctgatatggtggttagggtgcaaagaccagcaaaaagtggaaccgtgatggatgttatatccagacgtgaccagagaggaagtggacaggtcggaacttatggcttaagaccttttgggacagcggtg

SEQ ID NO: 371320 - DNA, 140 bp, Artificial Sequence
  Synthetic
caccgctgtcccaaaaggtcttaagccataagttccgacctgtccacttcctctctggtcacgtctggatataacatccatcacggttccactttttgctggtctttgcaccctaaccaccatatcagcagccagggcct

SEQ ID NO: 371321 - DNA, 140 bp, Artificial Sequence
  Synthetic
aggccctggctgctgatatgagtgatactacaaaatgcatggaaagtgagctgcacaatactggcagtggtgtccgtttccccactgctcttaacatcctcacggcagaaagcggactgggaccttttgggacagcggtg

SEQ ID NO: 371322 - DNA, 140 bp, Artificial Sequence
  Synthetic
caccgctgtcccaaaaggtcccagtccgctttctgccgtgaggatgttaagagcagtggggaaacggacaccactgccagtattgtgcagctcactttccatgcattttgtagtatcactcatatcagcagccagggcct

SEQ ID NO: 371323 - DNA, 140 bp, Artificial Sequence
  Synthetic
aggccctggctgctgatatgataccattggcattgacgatcaagggtctcaatccaacagccattttcctaacaaccctttcaagaaccaacaagaaaaggagttggccactaaatgagggaccttttgggacagcggtg

SEQ ID NO: 371324 - DNA, 140 bp, Artificial Sequence
  Synthetic
caccgctgtcccaaaaggtccctcatttagtggccaactccttttcttgttggttcttgaaagggttgttaggaaaatggctgttggattgagacccttgatcgtcaatgccaatggtatcatatcagcagccagggcct

SEQ ID NO: 371325 - DNA, 140 bp, Artificial Sequence
  Synthetic
aggccctggctgctgatatggaacccaacgactttaacagcatccttagttatgcttctggtccattatgcaataataggtccaggattgcaggccaaagcgacaagagaggctcaaaaagaccttttgggacagcggtg

SEQ ID NO: 371326 - DNA, 140 bp, Artificial Sequence
  Synthetic
caccgctgtcccaaaaggtctttttgagcctctcttgtcgctttggcctgcaatcctggacctattattgcataatggaccagaagcataactaaggatgctgttaaagtcgttgggttccatatcagcagccagggcct

SEQ ID NO: 371327 - DNA, 140 bp, Artificial Sequence
  Synthetic
atacgccatgctgggtctccaggacagctgctgggatcatgaagaatcccacggtggacgggataacagttatagatctagaaccaatatcctatgacccaaaatttgaaaagcagctggcgtacttgggagtcggccat

SEQ ID NO: 371328 - DNA, 140 bp, Artificial Sequence
  Synthetic
atggccgactcccaagtacgccagctgcttttcaaattttgggtcataggatattggttctagatctataactgttatcccgtccaccgtgggattcttcatgatcccagcagctgtcctggagacccagcatggcgtat

SEQ ID NO: 371329 - DNA, 140 bp, Artificial Sequence
  Synthetic
aggccctggctgctgatatgctgtcaataacaatatcggaagatggcagcatgtcaataaaaaatgaagaggaagaacaaacactgaccatactcattagaacaggattgctggtgatatgaccttttgggacagcggtg

SEQ ID NO: 371330 - DNA, 140 bp, Artificial Sequence
  Synthetic
caccgctgtcccaaaaggtcatatcaccagcaatcctgttctaatgagtatggtcagtgtttgttcttcctcttcattttttattgacatgctgccatcttccgatattgttattgacagcatatcagcagccagggcct

SEQ ID NO: 371331 - DNA, 140 bp, Artificial Sequence
  Synthetic
aggccctggctgctgatatgcgccggatggagcttgagagaaactgcttgcctaggcaagtcatatgcacaaatgtggcagctgatgtatttccacaggagagacctaagactggcggccgaccttttgggacagcggtg

SEQ ID NO: 371332 - DNA, 140 bp, Artificial Sequence
  Synthetic
caccgctgtcccaaaaggtcggccgccagtcttaggtctctcctgtggaaatacatcagctgccacatttgtgcatatgacttgcctaggcaagcagtttctctcaagctccatccggcgcatatcagcagccagggcct

SEQ ID NO: 371333 - DNA, 140 bp, Artificial Sequence
  Synthetic
aggccctggctgctgatatgaaatgtggcagctgatgtatttccacaggagagacctaagactggcggccaatgctatctgttcagccgttccagttgattgggtcccaaccagccgtacgaccttttgggacagcggtg

SEQ ID NO: 371334 - DNA, 140 bp, Artificial Sequence
  Synthetic
caccgctgtcccaaaaggtcgtacggctggttgggacccaatcaactggaacggctgaacagatagcattggccgccagtcttaggtctctcctgtggaaatacatcagctgccacatttcatatcagcagccagggcct

SEQ ID NO: 371335 - DNA, 140 bp, Artificial Sequence
  Synthetic
aggccctggctgctgatatgtgggaagtgaagaaacaacgggccggagtgttgtgggatgttccttcacccccacccgtgggaaaggccgaattggaagatggagcctatagaatcaagcgaccttttgggacagcggtg

SEQ ID NO: 371336 - DNA, 140 bp, Artificial Sequence
  Synthetic
caccgctgtcccaaaaggtcgcttgattctataggctccatcttccaattcggcctttcccacgggtgggggtgaaggaacatcccacaacactccggcccgttgtttcttcacttcccacatatcagcagccagggcct

SEQ ID NO: 371337 - DNA, 140 bp, Artificial Sequence
  Synthetic
atacgccatgctgggtctccgccttttcgctcataaagaatgcacaaacccccaggaggggaactgggaccacaggagagacactgggagaaaaatggaagagacagctaaactcgcttgcgtacttgggagtcggccat

SEQ ID NO: 371338 - DNA, 140 bp, Artificial Sequence
  Synthetic
atggccgactcccaagtacgcaagcgagtttagctgtctcttccatttttctcccagtgtctctcctgtggtcccagttcccctcctgggggtttgtgcattctttatgagcgaaaaggcggagacccagcatggcgtat

SEQ ID NO: 371339 - DNA, 140 bp, Artificial Sequence
  Synthetic
atacgccatgctgggtctccggaacattccacacaatgtggcacgtcacacgtggtgctgttctaatgcataaagggaagaggattgaaccatcatgggcggatgtcaggaaagacctaacgtacttgggagtcggccat

SEQ ID NO: 371340 - DNA, 140 bp, Artificial Sequence
  Synthetic
atggccgactcccaagtacgttaggtctttcctgacatccgcccatgatggttcaatcctcttccctttatgcattagaacagcaccacgtgtgacgtgccacattgtgtggaatgttccggagacccagcatggcgtat

SEQ ID NO: 371341 - DNA, 140 bp, Artificial Sequence
  Synthetic
aggccctggctgctgatatggagaattatctagattacatgacatcaatgaagagattcaagaatgaaagtgatcccgaaggggcactctggtaagtcaacacattcatgcaataaaggagaccttttgggacagcggtg

SEQ ID NO: 371342 - DNA, 140 bp, Artificial Sequence
  Synthetic
caccgctgtcccaaaaggtctcctttattgcatgaatgtgttgacttaccagagtgccccttcgggatcactttcattcttgaatctcttcattgatgtcatgtaatctagataattctccatatcagcagccagggcct

SEQ ID NO: 371343 - DNA, 140 bp, Artificial Sequence
  Synthetic
atacgccatgctgggtctcctcgtactatatggcgacactcaagaacgtgaccgaggtgaaagggtatacaaaaggtggtccaggacatgaggaaccgattcccatggctacctatggctcgtacttgggagtcggccat

SEQ ID NO: 371344 - DNA, 140 bp, Artificial Sequence
  Synthetic
atggccgactcccaagtacgagccataggtagccatgggaatcggttcctcatgtcctggaccaccttttgtataccctttcacctcggtcacgttcttgagtgtcgccatatagtacgaggagacccagcatggcgtat

SEQ ID NO: 371345 - DNA, 140 bp, Artificial Sequence
  Synthetic
aggccctggctgctgatatgcggtaagagctatgctgcctgtgagccccgtccaaggacgtaaaatgaagtcaggccgaaagccacggcttgagcaaaccgtgctgcctgtggctccatcgaccttttgggacagcggtg

SEQ ID NO: 371346 - DNA, 140 bp, Artificial Sequence
  Synthetic
caccgctgtcccaaaaggtcgatggagccacaggcagcacggtttgctcaagccgtggctttcggcctgacttcattttacgtccttggacggggctcacaggcagcatagctcttaccgcatatcagcagccagggcct

SEQ ID NO: 371347 - DNA, 140 bp, Artificial Sequence
  Synthetic
aggccctggctgctgatatgctggccagttctctccttagaaatgatgtacccatggctggaccattagtggccgggggcttgctgatagcgtgctacgtcataactggcacgtcagcaggaccttttgggacagcggtg

SEQ ID NO: 371348 - DNA, 140 bp, Artificial Sequence
  Synthetic
caccgctgtcccaaaaggtcctgctgacgtgccagttatgacgtagcacgctatcagcaagcccccggccactaatggtccagccatgggtacatcatttctaaggagagaactggccagcatatcagcagccagggcct

SEQ ID NO: 371349 - DNA, 140 bp, Artificial Sequence
  Synthetic
aggccctggctgctgatatggagcaagtggacaccctgctctgtgatattggggagtcatcttctaatccgacgatagaggaaggaagaacattacgagttttaaagatggtggagccatgaccttttgggacagcggtg

SEQ ID NO: 371350 - DNA, 140 bp, Artificial Sequence
  Synthetic
caccgctgtcccaaaaggtcatggctccaccatctttaaaactcgtaatgttcttccttcctctatcgtcggattagaagatgactccccaatatcacagagcagggtgtccacttgctccatatcagcagccagggcct

SEQ ID NO: 371351 - DNA, 140 bp, Artificial Sequence
  Synthetic
atacgccatgctgggtctccggctctcttcaaaacctgaattctgcatcaaagttctcaatccctacatgccaacagtcatagaggagctggagaaactgcagagaaaacatggtggaagcgtacttgggagtcggccat

SEQ ID NO: 371352 - DNA, 140 bp, Artificial Sequence
  Synthetic
atggccgactcccaagtacgcttccaccatgttttctctgcagtttctccagctcctctatgactgttggcatgtagggattgagaactttgatgcagaattcaggttttgaagagagccggagacccagcatggcgtat

SEQ ID NO: 371353 - DNA, 140 bp, Artificial Sequence
  Synthetic
aggccctggctgctgatatgcagtttcgaatcggaagcttgcttaacgtagttctaacagttttttattagagagcagatctctgatgaacaaccaacggaaaaagacggctcgaccgtcgaccttttgggacagcggtg

SEQ ID NO: 371354 - DNA, 140 bp, Artificial Sequence
  Synthetic
caccgctgtcccaaaaggtcgacggtcgagccgtctttttccgttggttgttcatcagagatctgctctctaataaaaaactgttagaactacgttaagcaagcttccgattcgaaactgcatatcagcagccagggcct

SEQ ID NO: 371355 - DNA, 140 bp, Artificial Sequence
  Synthetic
atacgccatgctgggtctcctttcaatatgctgaaacgcgcgagaaaccgcgtgtcaactgtttcacagttggcgaagagattctcaaaaggattgctctcaggccaaggacccatgaaacgtacttgggagtcggccat

SEQ ID NO: 371356 - DNA, 140 bp, Artificial Sequence
  Synthetic
atggccgactcccaagtacgtttcatgggtccttggcctgagagcaatccttttgagaatctcttcgccaactgtgaaacagttgacacgcggtttctcgcgcgtttcagcatattgaaaggagacccagcatggcgtat

SEQ ID NO: 371357 - DNA, 140 bp, Artificial Sequence
  Synthetic
aggccctggctgctgatatggtttgttccgagtataaaagcaggaaatgatatagcagcttgcctgaggaaaaatggaaagaaagtgatacaactcagtaggaagacctttgattctgaagaccttttgggacagcggtg

SEQ ID NO: 371358 - DNA, 140 bp, Artificial Sequence
  Synthetic
caccgctgtcccaaaaggtcttcagaatcaaaggtcttcctactgagttgtatcactttctttccatttttcctcaggcaagctgctatatcatttcctgcttttatactcggaacaaaccatatcagcagccagggcct

SEQ ID NO: 371359 - DNA, 140 bp, Artificial Sequence
  Synthetic
atacgccatgctgggtctcctacatcaagactaggaccaatgattgggactttgtggtcacgactgacatttcagaaatgggtgctaacttcaaggctgaaagggttatagaccccaggccgtacttgggagtcggccat

SEQ ID NO: 371360 - DNA, 140 bp, Artificial Sequence
  Synthetic
atggccgactcccaagtacggcctggggtctataaccctttcagccttgaagttagcacccatttctgaaatgtcagtcgtgaccacaaagtcccaatcattggtcctagtcttgatgtaggagacccagcatggcgtat

SEQ ID NO: 371361 - DNA, 140 bp, Artificial Sequence
  Synthetic
aggccctggctgctgatatgaacatgtgcacccttatagcgatggatttgggagagttatgtgaggacacaatgacttacaaatgccctcgaatcactgaggcggaaccagatgatgttggaccttttgggacagcggtg

SEQ ID NO: 371362 - DNA, 140 bp, Artificial Sequence
  Synthetic
caccgctgtcccaaaaggtccaacatcatctggttccgcctcagtgattcgagggcatttgtaagtcattgtgtcctcacataactctcccaaatccatcgctataagggtgcacatgttcatatcagcagccagggcct

SEQ ID NO: 371363 - DNA, 140 bp, Artificial Sequence
  Synthetic
atacgccatgctgggtctccgctgcatgaaaccagtcatactaacagacggtgaagagcgggtgatcttggcaggacccatgccagtgacccactctagtgcagcacaaagaagagggagcgtacttgggagtcggccat

SEQ ID NO: 371364 - DNA, 140 bp, Artificial Sequence
  Synthetic
atggccgactcccaagtacgctccctcttctttgtgctgcactagagtgggtcactggcatgggtcctgccaagatcacccgctcttcaccgtctgttagtatgactggtttcatgcagcggagacccagcatggcgtat

SEQ ID NO: 371365 - DNA, 140 bp, Artificial Sequence
  Synthetic
atacgccatgctgggtctccgcccaacagtggaagaaagcagaactataagagttttgaagatggttgaaccatggctaaagaacaaccaattttgcattaaagtattgaacccttacatcgtacttgggagtcggccat

SEQ ID NO: 371366 - DNA, 140 bp, Artificial Sequence
  Synthetic
atggccgactcccaagtacgatgtaagggttcaatactttaatgcaaaattggttgttctttagccatggttcaaccatcttcaaaactcttatagttctgctttcttccactgttgggcggagacccagcatggcgtat

SEQ ID NO: 371367 - DNA, 140 bp, Artificial Sequence
  Synthetic
atacgccatgctgggtctccaacctctggaaaatgatgaagactgtgcacactggaaagaagctaagatgcttctagacaacatcaacacgcctgaaggaatcattcccagcatgtttgacgtacttgggagtcggccat

SEQ ID NO: 371368 - DNA, 140 bp, Artificial Sequence
  Synthetic
atggccgactcccaagtacgtcaaacatgctgggaatgattccttcaggcgtgttgatgttgtctagaagcatcttagcttctttccagtgtgcacagtcttcatcattttccagaggttggagacccagcatggcgtat

SEQ ID NO: 371369 - DNA, 140 bp, Artificial Sequence
  Synthetic
atacgccatgctgggtctcccacccagaaagggattatcttcattttgttaatgctggttacaccatccatggccatgcgatgcgtgggaataggcagcagggacttcgtggaaggactgcgtacttgggagtcggccat

SEQ ID NO: 371370 - DNA, 140 bp, Artificial Sequence
  Synthetic
atggccgactcccaagtacgcagtccttccacgaagtccctgctgcctattcccacgcatcgcatggccatggatggtgtaaccagcattaacaaaatgaagataatccctttctgggtgggagacccagcatggcgtat

SEQ ID NO: 371371 - DNA, 140 bp, Artificial Sequence
  Synthetic
aggccctggctgctgatatgcacaggagagacactgggagagaagtggaagagacagctaaactcattagacagaaaagagtttgaagagtataaaagaagtggaatactagaagtggacgaccttttgggacagcggtg

SEQ ID NO: 371372 - DNA, 140 bp, Artificial Sequence
  Synthetic
caccgctgtcccaaaaggtcgtccacttctagtattccacttcttttatactcttcaaactcttttctgtctaatgagtttagctgtctcttccacttctctcccagtgtctctcctgtgcatatcagcagccagggcct

SEQ ID NO: 371373 - DNA, 140 bp, Artificial Sequence
  Synthetic
atacgccatgctgggtctccacatagataagaaggatggagatctgatatatgctgatgacacagcaggctgggacacaagaatcactgaagatgaccttctgaatgaagagctgatcaccgtacttgggagtcggccat

SEQ ID NO: 371374 - DNA, 140 bp, Artificial Sequence
  Synthetic
atggccgactcccaagtacggtgatcagctcttcattcagaaggtcatcttcagtgattcttgtgtcccagcctgctgtgtcatcagcatatatcagatctccatccttcttatctatgtggagacccagcatggcgtat

SEQ ID NO: 371375 - DNA, 140 bp, Artificial Sequence
  Synthetic
aggccctggctgctgatatgtggaagtggaaatctggacaaaagaaggagaaaggaagaaattgaaacccaggtggttggatgctaggatctattctgacccgctggcgctcaaagaattgaccttttgggacagcggtg

SEQ ID NO: 371376 - DNA, 140 bp, Artificial Sequence
  Synthetic
caccgctgtcccaaaaggtcaattctttgagcgccagcgggtcagaatagatcctagcatccaaccacctgggtttcaatttcttcctttctccttcttttgtccagatttccacttccacatatcagcagccagggcct

SEQ ID NO: 371377 - DNA, 140 bp, Artificial Sequence
  Synthetic
atacgccatgctgggtctcccaaagagtttgcagccggaagaaaatccctgaccctgaatctaatcacagaaatgggtaggcttccaacttttatgacccagaaagcaaggaatgcactgcgtacttgggagtcggccat

SEQ ID NO: 371378 - DNA, 140 bp, Artificial Sequence
  Synthetic
atggccgactcccaagtacgcagtgcattccttgctttctgggtcataaaagttggaagcctacccatttctgtgattagattcagggtcagggattttcttccggctgcaaactctttgggagacccagcatggcgtat

SEQ ID NO: 371379 - DNA, 140 bp, Artificial Sequence
  Synthetic
aggccctggctgctgatatgaaatgggtaggcttccaacttttatgacccagaaagcaaggaatgcactggataacttagcagtcctgcacacagctgaagcaggcggaagagcgtacaagaccttttgggacagcggtg

SEQ ID NO: 371380 - DNA, 140 bp, Artificial Sequence
  Synthetic
caccgctgtcccaaaaggtcttgtacgctcttccgcctgcttcagctgtgtgcaggactgctaagttatccagtgcattccttgctttctgggtcataaaagttggaagcctacccatttcatatcagcagccagggcct

SEQ ID NO: 371381 - DNA, 140 bp, Artificial Sequence
  Synthetic
atacgccatgctgggtctcctcatgctctcagtgaactgccggagaccctggagacattgcttttgctgacgcttttggctacagtcacgggcggaatctttttatttttgatgagcggacgtacttgggagtcggccat

SEQ ID NO: 371382 - DNA, 140 bp, Artificial Sequence
  Synthetic
atggccgactcccaagtacgtccgctcatcaaaaataaaaagattccgcccgtgactgtagccaaaagcgtcagcaaaagcaatgtctccagggtctccggcagttcactgagagcatgaggagacccagcatggcgtat

SEQ ID NO: 371383 - DNA, 140 bp, Artificial Sequence
  Synthetic
aggccctggctgctgatatgcgtcacaagaggggcagtgttgacacacaatgggaaaagactggaaccaaactgggctagcgtgaaaaaagatctgatttcatacggaggaggatggagagaccttttgggacagcggtg

SEQ ID NO: 371384 - DNA, 140 bp, Artificial Sequence
  Synthetic
caccgctgtcccaaaaggtctctccatcctcctccgtatgaaatcagatcttttttcacgctagcccagtttggttccagtcttttcccattgtgtgtcaacactgcccctcttgtgacgcatatcagcagccagggcct

SEQ ID NO: 371385 - DNA, 140 bp, Artificial Sequence
  Synthetic
aggccctggctgctgatatggcaagaggttcctttttgctcccaccactttcacaagatctttatgaaggatggccgttcactggtcgttccatgtagaaaccaggatgaactaataggagaccttttgggacagcggtg

SEQ ID NO: 371386 - DNA, 140 bp, Artificial Sequence
  Synthetic
caccgctgtcccaaaaggtctcctattagttcatcctggtttctacatggaacgaccagtgaacggccatccttcataaagatcttgtgaaagtggtgggagcaaaaaggaacctcttgccatatcagcagccagggcct

SEQ ID NO: 371387 - DNA, 140 bp, Artificial Sequence
  Synthetic
aggccctggctgctgatatgctaccactgccttggacctcgggagcttcaacatcacaagaaacttggaacagacaagatttgctggtgacatttaagacagctcatgcaaagaagcagggaccttttgggacagcggtg

SEQ ID NO: 371388 - DNA, 140 bp, Artificial Sequence
  Synthetic
caccgctgtcccaaaaggtccctgcttctttgcatgagctgtcttaaatgtcaccagcaaatcttgtctgttccaagtttcttgtgatgttgaagctcccgaggtccaaggcagtggtagcatatcagcagccagggcct

SEQ ID NO: 371389 - DNA, 140 bp, Artificial Sequence
  Synthetic
atacgccatgctgggtctccagagccagaatctcgcaaggggctggatggagtttaagagaaacagcctgtctgggcaaagcttacgcccagatgtggtcgctcatgtactttcatagaacgtacttgggagtcggccat

SEQ ID NO: 371390 - DNA, 140 bp, Artificial Sequence
  Synthetic
atggccgactcccaagtacgttctatgaaagtacatgagcgaccacatctgggcgtaagctttgcccagacaggctgtttctcttaaactccatccagccccttgcgagattctggctctggagacccagcatggcgtat

SEQ ID NO: 371391 - DNA, 140 bp, Artificial Sequence
  Synthetic
atacgccatgctgggtctccaagtagtcgtactaggatcacaagaaggagcaatgcacactgcgttgaccggagcgacagaaatccaaacgtctggaacgacaacaatttttgcaggacacgtacttgggagtcggccat

SEQ ID NO: 371392 - DNA, 140 bp, Artificial Sequence
  Synthetic
atggccgactcccaagtacgtgtcctgcaaaaattgttgtcgttccagacgtttggatttctgtcgctccggtcaacgcagtgtgcattgctccttcttgtgatcctagtacgactacttggagacccagcatggcgtat

SEQ ID NO: 371393 - DNA, 140 bp, Artificial Sequence
  Synthetic
aggccctggctgctgatatgtggtttccaacaagcagaacaacatggtcaatccacgctcatcatcagtggatgactactgaagatatgctcaaagtgtggaacagagtgtggatagaaggaccttttgggacagcggtg

SEQ ID NO: 371394 - DNA, 140 bp, Artificial Sequence
  Synthetic
caccgctgtcccaaaaggtccttctatccacactctgttccacactttgagcatatcttcagtagtcatccactgatgatgagcgtggattgaccatgttgttctgcttgttggaaaccacatatcagcagccagggcct

SEQ ID NO: 371395 - DNA, 140 bp, Artificial Sequence
  Synthetic
aggccctggctgctgatatgatgtgatgtgcacaggctcattcaagctagagaaagaagtggctgagacccagcatggaaccgttctagtgcagattaaatacgaaggaacagatgcaccgaccttttgggacagcggtg

SEQ ID NO: 371396 - DNA, 140 bp, Artificial Sequence
  Synthetic
caccgctgtcccaaaaggtcggtgcatctgttccttcgtatttaatctgcactagaacggttccatgctgggtctcagccacttctttctctagcttgaatgagcctgtgcacatcacatcatatcagcagccagggcct

SEQ ID NO: 371397 - DNA, 140 bp, Artificial Sequence
  Synthetic
atacgccatgctgggtctccatgcaagattcctttttcgacccaagatgaaaaaggagtaactcagaatgggagattgataacagccaaccccatagttactgacaaagaaaagccagtccgtacttgggagtcggccat

SEQ ID NO: 371398 - DNA, 140 bp, Artificial Sequence
  Synthetic
atggccgactcccaagtacggactggcttttctttgtcagtaactatggggttggctgttatcaatctcccattctgagttactcctttttcatcttgggtcgaaaaaggaatcttgcatggagacccagcatggcgtat

SEQ ID NO: 371399 - DNA, 140 bp, Artificial Sequence
  Synthetic
aggccctggctgctgatatgctcttctagggccacctgggctaagaacattcaaacagccataacccaggtcaggaacctgatcgggaaagaagagtatgtggattacatgccagtcatggaccttttgggacagcggtg

SEQ ID NO: 371400 - DNA, 140 bp, Artificial Sequence
  Synthetic
caccgctgtcccaaaaggtccatgactggcatgtaatccacatactcttctttcccgatcaggttcctgacctgggttatggctgtttgaatgttcttagcccaggtggccctagaagagcatatcagcagccagggcct

SEQ ID NO: 371401 - DNA, 140 bp, Artificial Sequence
  Synthetic
aggccctggctgctgatatgctctgcgtgactcaagtactgatgatgaggactacatgggctttgtgtgaggctctaaccttagcgaccgggcccatttccacattgtgggaaggaaatcgaccttttgggacagcggtg

SEQ ID NO: 371402 - DNA, 140 bp, Artificial Sequence
  Synthetic
caccgctgtcccaaaaggtcgatttccttcccacaatgtggaaatgggcccggtcgctaaggttagagcctcacacaaagcccatgtagtcctcatcatcagtacttgagtcacgcagagcatatcagcagccagggcct

SEQ ID NO: 371403 - DNA, 140 bp, Artificial Sequence
  Synthetic
atacgccatgctgggtctccggagacaccgcatgggactttggttctataggaggagtgttcacgtctgttggaaaattagtacaccagatttttggaactgcatatggagttttgttcacgtacttgggagtcggccat

SEQ ID NO: 371404 - DNA, 140 bp, Artificial Sequence
  Synthetic
atggccgactcccaagtacgtgaacaaaactccatatgcagttccaaaaatctggtgtactaattttccaacagacgtgaacactcctcctatagaaccaaagtcccatgcggtgtctccggagacccagcatggcgtat

SEQ ID NO: 371405 - DNA, 140 bp, Artificial Sequence
  Synthetic
atacgccatgctgggtctccgcggtgtttcctggaccatgaaaataggaataggggttctgctgacatggctaggattaaactcaaggagcacgtccctttcgatgacgtgcattgcagtcgtacttgggagtcggccat

SEQ ID NO: 371406 - DNA, 140 bp, Artificial Sequence
  Synthetic
atggccgactcccaagtacgactgcaatgcacgtcatcgaaagggacgtgctccttgagtttaatcctagccatgtcagcagaacccctattcctattttcatggtccaggaaacaccgcggagacccagcatggcgtat

SEQ ID NO: 371407 - DNA, 140 bp, Artificial Sequence
  Synthetic
aggccctggctgctgatatgagaaatggaaaaaccgattgaatgcattagggaagagtgaattccagatttacaagaaaagcggaattcaggaagtggatagaaccttggcaaaagaggggaccttttgggacagcggtg

SEQ ID NO: 371408 - DNA, 140 bp, Artificial Sequence
  Synthetic
caccgctgtcccaaaaggtcccctcttttgccaaggttctatccacttcctgaattccgcttttcttgtaaatctggaattcactcttccctaatgcattcaatcggtttttccatttctcatatcagcagccagggcct

SEQ ID NO: 371409 - DNA, 140 bp, Artificial Sequence
  Synthetic
atacgccatgctgggtctcccggaagcttgcttaacacagttctaacagtttgttttaaatagagagcagatctctggaaaaatgaaccaacgaaaaaaggtggctagaccacctttcaacgtacttgggagtcggccat

SEQ ID NO: 371410 - DNA, 140 bp, Artificial Sequence
  Synthetic
atggccgactcccaagtacgttgaaaggtggtctagccaccttttttcgttggttcatttttccagagatctgctctctatttaaaacaaactgttagaactgtgttaagcaagcttccgggagacccagcatggcgtat

SEQ ID NO: 371411 - DNA, 140 bp, Artificial Sequence
  Synthetic
atacgccatgctgggtctccttccccaaagagactatcagcagccattgggaaggcatgggaggagggtgtgtgtggaattcgatcagcaactcgtctcgagaacatcatgtggaagcaacgtacttgggagtcggccat

SEQ ID NO: 371412 - DNA, 140 bp, Artificial Sequence
  Synthetic
atggccgactcccaagtacgttgcttccacatgatgttctcgagacgagttgctgatcgaattccacacacaccctcctcccatgccttcccaatggctgctgatagtctctttggggaaggagacccagcatggcgtat

SEQ ID NO: 371413 - DNA, 140 bp, Artificial Sequence
  Synthetic
atacgccatgctgggtctccctagcattcatcacgtttttgcgagtcctttccatcccgccaacagcagggattctgaaaagatggggacagttgaaaaagaataaggccatcaagataccgtacttgggagtcggccat

SEQ ID NO: 371414 - DNA, 140 bp, Artificial Sequence
  Synthetic
atggccgactcccaagtacggtatcttgatggccttattctttttcaactgtccccatcttttcagaatccctgctgttggcgggatggaaaggactcgcaaaaacgtgatgaatgctagggagacccagcatggcgtat

SEQ ID NO: 371415 - DNA, 140 bp, Artificial Sequence
  Synthetic
aggccctggctgctgatatgttaggccacaacccatggaatacaaatactcgtggaaaagctggggaaaggctaaaatcataggggcagatgtacagaacaccaccttcatcatcgacgggaccttttgggacagcggtg

SEQ ID NO: 371416 - DNA, 140 bp, Artificial Sequence
  Synthetic
caccgctgtcccaaaaggtcccgtcgatgatgaaggtggtgttctgtacatctgcccctatgattttagcctttccccagcttttccacgagtatttgtattccatgggttgtggcctaacatatcagcagccagggcct

SEQ ID NO: 371417 - DNA, 140 bp, Artificial Sequence
  Synthetic
aggccctggctgctgatatgaggagatctcaaacatgctgagtataatcaacaaacggaaaaagacatcgctctgtctcatgatgatattgccagcagcacttgctttccacttgacctcgaccttttgggacagcggtg

SEQ ID NO: 371418 - DNA, 140 bp, Artificial Sequence
  Synthetic
caccgctgtcccaaaaggtcgaggtcaagtggaaagcaagtgctgctggcaatatcatcatgagacagagcgatgtctttttccgtttgttgattatactcagcatgtttgagatctcctcatatcagcagccagggcct

SEQ ID NO: 371419 - DNA, 140 bp, Artificial Sequence
  Synthetic
aggccctggctgctgatatgggaagcgctgcaaaggaaatacggaggagctttggtgaggaatccactctcaagaaattccacacatgagatgtattgggtatccaatgcttccgggaacgaccttttgggacagcggtg

SEQ ID NO: 371420 - DNA, 140 bp, Artificial Sequence
  Synthetic
caccgctgtcccaaaaggtcgttcccggaagcattggatacccaatacatctcatgtgtggaatttcttgagagtggattcctcaccaaagctcctccgtatttcctttgcagcgcttcccatatcagcagccagggcct

SEQ ID NO: 371421 - DNA, 140 bp, Artificial Sequence
  Synthetic
atacgccatgctgggtctcctgcaccctcattgccatggacctgggtgaaatgtgtgaagacactgtcacgtataaatgccctctactggttaacaccgaacctgaagacatcgattgctcgtacttgggagtcggccat

SEQ ID NO: 371422 - DNA, 140 bp, Artificial Sequence
  Synthetic
atggccgactcccaagtacgagcaatcgatgtcttcaggttcggtgttaaccagtagagggcatttatacgtgacagtgtcttcacacatttcacccaggtccatggcaatgagggtgcaggagacccagcatggcgtat

SEQ ID NO: 371423 - DNA, 140 bp, Artificial Sequence
  Synthetic
aggccctggctgctgatatgtcgacggaaagtgtgaaacatgtgtgtacaacatgatgggaaaaagagagaagaaacttggagaatttggcaaagcaaaaggcagcagagccatatggtagaccttttgggacagcggtg

SEQ ID NO: 371424 - DNA, 140 bp, Artificial Sequence
  Synthetic
caccgctgtcccaaaaggtctaccatatggctctgctgccttttgctttgccaaattctccaagtttcttctctctttttcccatcatgttgtacacacatgtttcacactttccgtcgacatatcagcagccagggcct

SEQ ID NO: 371425 - DNA, 140 bp, Artificial Sequence
  Synthetic
atacgccatgctgggtctccggaaagtgaaatgataattccaaagatctatggaggaccaatatctcagcacaactacagaccaggatatttcacacaaacggcagggccgtggcacctacgtacttgggagtcggccat

SEQ ID NO: 371426 - DNA, 140 bp, Artificial Sequence
  Synthetic
atggccgactcccaagtacgtaggtgccacggccctgccgtttgtgtgaaatatcctggtctgtagttgtgctgagatattggtcctccatagatctttggaattatcatttcactttccggagacccagcatggcgtat

SEQ ID NO: 371427 - DNA, 140 bp, Artificial Sequence
  Synthetic
aggccctggctgctgatatgcaaaacagactggatcagcatcatccatggtgaatggagtggttagactgctgacaaaaccttgggacgtcatccccatggtgacacagatggcaatgacgaccttttgggacagcggtg

SEQ ID NO: 371428 - DNA, 140 bp, Artificial Sequence
  Synthetic
caccgctgtcccaaaaggtcgtcattgccatctgtgtcaccatggggatgacgtcccaaggttttgtcagcagtctaaccactccattcaccatggatgatgctgatccagtctgttttgcatatcagcagccagggcct

SEQ ID NO: 371429 - DNA, 140 bp, Artificial Sequence
  Synthetic
atacgccatgctgggtctccttacgtttcagaggagaagatgggtgctggtacggtatggaaatcagaccagtcaaggaaaaggaagagaatttagtcaaatcaatggtctctgcagggtcgtacttgggagtcggccat

SEQ ID NO: 371430 - DNA, 140 bp, Artificial Sequence
  Synthetic
atggccgactcccaagtacgaccctgcagagaccattgatttgactaaattctcttccttttccttgactggtctgatttccataccgtaccagcacccatcttctcctctgaaacgtaaggagacccagcatggcgtat

SEQ ID NO: 371431 - DNA, 140 bp, Artificial Sequence
  Synthetic
aggccctggctgctgatatgggcccagggaaaaccaaccctggattttgaactgaccaagacaacagctaaggaagtggctctgttgagaacctattgtattgaagcttcgatatcaaacgaccttttgggacagcggtg

SEQ ID NO: 371432 - DNA, 140 bp, Artificial Sequence
  Synthetic
caccgctgtcccaaaaggtcgtttgatatcgaagcttcaatacaataggttctcaacagagccacttccttagctgttgtcttggtcagttcaaaatccagggttggttttccctgggcccatatcagcagccagggcct

SEQ ID NO: 371433 - DNA, 140 bp, Artificial Sequence
  Synthetic
atacgccatgctgggtctccacaaccccaatatgattgacaagactccagtccattcgtgggaagacataccttacctagggaaaagagaggatttgtggtgtggatccctgattggactcgtacttgggagtcggccat

SEQ ID NO: 371434 - DNA, 140 bp, Artificial Sequence
  Synthetic
atggccgactcccaagtacgagtccaatcagggatccacaccacaaatcctctcttttccctaggtaaggtatgtcttcccacgaatggactggagtcttgtcaatcatattggggttgtggagacccagcatggcgtat

SEQ ID NO: 371435 - DNA, 140 bp, Artificial Sequence
  Synthetic
atacgccatgctgggtctccaactaggggaattcggcaaagcaaaaggcagtagagccatatggtacatgtggcttggagcacgcttcttggagtttgaagccctaggattcttgaatgacgtacttgggagtcggccat

SEQ ID NO: 371436 - DNA, 140 bp, Artificial Sequence
  Synthetic
atggccgactcccaagtacgtcattcaagaatcctagggcttcaaactccaagaagcgtgctccaagccacatgtaccatatggctctactgccttttgctttgccgaattcccctagttggagacccagcatggcgtat

SEQ ID NO: 371437 - DNA, 140 bp, Artificial Sequence
  Synthetic
aggccctggctgctgatatgccttgaatacacggtagttgtgacagtccacaatggagacacccatgcagtaggaaatgacacatccaatcatggagtgacagccacgataactcccagggaccttttgggacagcggtg

SEQ ID NO: 371438 - DNA, 140 bp, Artificial Sequence
  Synthetic
caccgctgtcccaaaaggtccctgggagttatcgtggctgtcactccatgattggatgtgtcatttcctactgcatgggtgtctccattgtggactgtcacaactaccgtgtattcaaggcatatcagcagccagggcct

SEQ ID NO: 371439 - DNA, 140 bp, Artificial Sequence
  Synthetic
atacgccatgctgggtctcctgacatttatcaaaacaacgttttccttgcactatgcatggaagacaatggctatggtactgtcaattgtatctctcttccccttatgcctgtccacgaccgtacttgggagtcggccat

SEQ ID NO: 371440 - DNA, 140 bp, Artificial Sequence
  Synthetic
atggccgactcccaagtacggtcgtggacaggcataaggggaagagagatacaattgacagtaccatagccattgtcttccatgcatagtgcaaggaaaacgttgttttgataaatgtcaggagacccagcatggcgtat

SEQ ID NO: 371441 - DNA, 140 bp, Artificial Sequence
  Synthetic
atacgccatgctgggtctccctcccaaaaaacaacatggcttccggtgctattgggatctcttggatgcaaaccactaaccatgtttcttatagcagaaaacaaaatctggggaaggaaacgtacttgggagtcggccat

SEQ ID NO: 371442 - DNA, 140 bp, Artificial Sequence
  Synthetic
atggccgactcccaagtacgtttccttccccagattttgttttctgctataagaaacatggttagtggtttgcatccaagagatcccaatagcaccggaagccatgttgttttttgggagggagacccagcatggcgtat

SEQ ID NO: 371443 - DNA, 140 bp, Artificial Sequence
  Synthetic
atacgccatgctgggtctccagttggcccctcaatgaaggaatcatggctgttggaatagtcagcatcctactaagttcactcctcaaaaatgatgtgccgctagctgggccactaatagcgtacttgggagtcggccat

SEQ ID NO: 371444 - DNA, 140 bp, Artificial Sequence
  Synthetic
atggccgactcccaagtacgctattagtggcccagctagcggcacatcatttttgaggagtgaacttagtaggatgctgactattccaacagccatgattccttcattgaggggccaactggagacccagcatggcgtat

SEQ ID NO: 371445 - DNA, 140 bp, Artificial Sequence
  Synthetic
aggccctggctgctgatatgtcatctcatctaccccttttgctgagaataccaacagcgtaatcaacatagaattagaacccccttttggggacagctacatagtgataggtgttggagagaccttttgggacagcggtg

SEQ ID NO: 371446 - DNA, 140 bp, Artificial Sequence
  Synthetic
caccgctgtcccaaaaggtctctccaacacctatcactatgtagctgtccccaaaagggggttctaattctatgttgattacgctgttggtattctcagcaaaaggggtagatgagatgacatatcagcagccagggcct

SEQ ID NO: 371447 - DNA, 140 bp, Artificial Sequence
  Synthetic
atacgccatgctgggtctcccctttttgtgtggtacttttggcagaaaaagaaacagagatctggagtgttatgggacacacctagccctccagaagtggaaagagcagttcttgatgatcgtacttgggagtcggccat

SEQ ID NO: 371448 - DNA, 140 bp, Artificial Sequence
  Synthetic
atggccgactcccaagtacgatcatcaagaactgctctttccacttctggagggctaggtgtgtcccataacactccagatctctgtttctttttctgccaaaagtaccacacaaaaaggggagacccagcatggcgtat

SEQ ID NO: 371449 - DNA, 140 bp, Artificial Sequence
  Synthetic
aggccctggctgctgatatggaataggagttctcttgacttggatagggttgaactcaaaaaacacatccatgtcattttcatgcattgcgataggaatcattacactctatctgggagcgaccttttgggacagcggtg

SEQ ID NO: 371450 - DNA, 140 bp, Artificial Sequence
  Synthetic
caccgctgtcccaaaaggtcgctcccagatagagtgtaatgattcctatcgcaatgcatgaaaatgacatggatgtgttttttgagttcaaccctatccaagtcaagagaactcctattccatatcagcagccagggcct

SEQ ID NO: 371451 - DNA, 140 bp, Artificial Sequence
  Synthetic
atacgccatgctgggtctccagtgtcaaaaaagacctgatctcatatggaggaggttggaggcttcaaggatcctggaacacgggagaagaagtgcaggtgattgctgttgaaccagggacgtacttgggagtcggccat

SEQ ID NO: 371452 - DNA, 140 bp, Artificial Sequence
  Synthetic
atggccgactcccaagtacgtccctggttcaacagcaatcacctgcacttcttctcccgtgttccaggatccttgaagcctccaacctcctccatatgagatcaggtcttttttgacactggagacccagcatggcgtat

SEQ ID NO: 371453 - DNA, 140 bp, Artificial Sequence
  Synthetic
aggccctggctgctgatatgatcctggaacacgggagaagaagtgcaggtgattgctgttgaaccagggaaaaaccccaaaaatgtacaaacagcgccgggcacctttaagacccctgaagaccttttgggacagcggtg

SEQ ID NO: 371454 - DNA, 140 bp, Artificial Sequence
  Synthetic
caccgctgtcccaaaaggtcttcaggggtcttaaaggtgcccggcgctgtttgtacatttttggggtttttccctggttcaacagcaatcacctgcacttcttctcccgtgttccaggatcatatcagcagccagggcct

SEQ ID NO: 371455 - DNA, 140 bp, Artificial Sequence
  Synthetic
atacgccatgctgggtctcctgtcatggaatgggaaggaactaaaatgtggaagcggaatttttgtggttgacaacgtgcacacttggacagaacagtacaaattccaaccagagtcccccgtacttgggagtcggccat

SEQ ID NO: 371456 - DNA, 140 bp, Artificial Sequence
  Synthetic
atggccgactcccaagtacgggggactctggttggaatttgtactgttctgtccaagtgtgcacgttgtcaaccacaaaaattccgcttccacattttagttccttcccattccatgacaggagacccagcatggcgtat

SEQ ID NO: 371457 - DNA, 140 bp, Artificial Sequence
  Synthetic
aggccctggctgctgatatgaaacttaacaataatggacctacatccaggatcggggaaaacaagaagataccttccagccatagtccgtgaggccataaaaaggaagctgcgcacactagaccttttgggacagcggtg

SEQ ID NO: 371458 - DNA, 140 bp, Artificial Sequence
  Synthetic
caccgctgtcccaaaaggtctagtgtgcgcagcttcctttttatggcctcacggactatggctggaaggtatcttcttgttttccccgatcctggatgtaggtccattattgttaagtttcatatcagcagccagggcct

SEQ ID NO: 371459 - DNA, 140 bp, Artificial Sequence
  Synthetic
atacgccatgctgggtctccctccagtgaatgatctgaaatattcatggaagacgtggggaaaagcaaaaatctctaccccagaagcaagaaatagcacatttttaatagacggaccagacgtacttgggagtcggccat

SEQ ID NO: 371460 - DNA, 140 bp, Artificial Sequence
  Synthetic
atggccgactcccaagtacgtctggtccgtctattaaaaatgtgctatttcttgcttctggggtagagatttttgcttttccccacgtcttccatgaatatttcagatcattcactggagggagacccagcatggcgtat

SEQ ID NO: 371461 - DNA, 140 bp, Artificial Sequence
  Synthetic
atacgccatgctgggtctcccacctccgaatgccccaatgaacgaagagcatggaacttttttgaggtagaagactatggatttggcatgttcacgaccaacatatggatgaaattccgacgtacttgggagtcggccat

SEQ ID NO: 371462 - DNA, 140 bp, Artificial Sequence
  Synthetic
atggccgactcccaagtacgtcggaatttcatccatatgttggtcgtgaacatgccaaatccatagtcttctacctcaaaaaagttccatgctcttcgttcattggggcattcggaggtgggagacccagcatggcgtat

SEQ ID NO: 371463 - DNA, 140 bp, Artificial Sequence
  Synthetic
aggccctggctgctgatatgaagactatggatttggcatgttcacgaccaacatatggatgaaattccgagaaggaagttcagaagtgtgtgaccatagattaatgtcggcggcaatcaagaccttttgggacagcggtg

SEQ ID NO: 371464 - DNA, 140 bp, Artificial Sequence
  Synthetic
caccgctgtcccaaaaggtcttgattgccgccgacattaatctatggtcacacacttctgaacttccttctcggaatttcatccatatgttggtcgtgaacatgccaaatccatagtcttcatatcagcagccagggcct

SEQ ID NO: 371465 - DNA, 140 bp, Artificial Sequence
  Synthetic
aggccctggctgctgatatgtcactggaaggactagaggttagaggagacccccccgaaacaaaaaacagcatattgacgctgggaaagaccagagatcctgctgtctcctcagcatcatgaccttttgggacagcggtg

SEQ ID NO: 371466 - DNA, 140 bp, Artificial Sequence
  Synthetic
caccgctgtcccaaaaggtcatgatgctgaggagacagcaggatctctggtctttcccagcgtcaatatgctgttttttgtttcgggggggtctcctctaacctctagtccttccagtgacatatcagcagccagggcct

SEQ ID NO: 371467 - DNA, 140 bp, Artificial Sequence
  Synthetic
atacgccatgctgggtctcctgtgaaggaacaacggttgtcattacagaaaactgtgggacaagaggcccatcattgagaacaacaacagtgtcagggaagttaatacacgaatggtgttcgtacttgggagtcggccat

SEQ ID NO: 371468 - DNA, 140 bp, Artificial Sequence
  Synthetic
atggccgactcccaagtacgaacaccattcgtgtattaacttccctgacactgttgttgttctcaatgatgggcctcttgtcccacagttttctgtaatgacaaccgttgttccttcacaggagacccagcatggcgtat

SEQ ID NO: 371469 - DNA, 140 bp, Artificial Sequence
  Synthetic
aggccctggctgctgatatgaagagacattcctgagagatcatggaactcaggctatgagtggatcactgacttcccaggcaaaacagtttggtttgttccaagcattaaatcaggaaatgaccttttgggacagcggtg

SEQ ID NO: 371470 - DNA, 140 bp, Artificial Sequence
  Synthetic
caccgctgtcccaaaaggtcatttcctgatttaatgcttggaacaaaccaaactgttttgcctgggaagtcagtgatccactcatagcctgagttccatgatctctcaggaatgtctcttcatatcagcagccagggcct

SEQ ID NO: 371471 - DNA, 140 bp, Artificial Sequence
  Synthetic
aggccctggctgctgatatgactatgtcgtcacaacagacatctccgaaatgggagcaaatttccgggccgacagggtgatagacccaagacggtgtctgaaaccggtaatactaaaagagaccttttgggacagcggtg

SEQ ID NO: 371472 - DNA, 140 bp, Artificial Sequence
  Synthetic
caccgctgtcccaaaaggtctcttttagtattaccggtttcagacaccgtcttgggtctatcaccctgtcggcccggaaatttgctcccatttcggagatgtctgttgtgacgacatagtcatatcagcagccagggcct

SEQ ID NO: 371473 - DNA, 140 bp, Artificial Sequence
  Synthetic
aggccctggctgctgatatgcatcagaaactttttctatggggctgctatgcctgaccttgttcgtggaagaatgcttgaggagaagagtcactaggaaacacatgatattggttgtggtgaccttttgggacagcggtg

SEQ ID NO: 371474 - DNA, 140 bp, Artificial Sequence
  Synthetic
caccgctgtcccaaaaggtcaccacaaccaatatcatgtgtttcctagtgactcttctcctcaagcattcttccacgaacaaggtcaggcatagcagccccatagaaaaagtttctgatgcatatcagcagccagggcct

SEQ ID NO: 371475 - DNA, 140 bp, Artificial Sequence
  Synthetic
atacgccatgctgggtctcctcactggacggaagcaaaaatgctccttgataatataaacacaccagaagggattatcccagccctcttcgagccggagagagaaaagagtgcagcaatacgtacttgggagtcggccat

SEQ ID NO: 371476 - DNA, 140 bp, Artificial Sequence
  Synthetic
atggccgactcccaagtacgtattgctgcactcttttctctctccggctcgaagagggctgggataatcccttctggtgtgtttatattatcaaggagcatttttgcttccgtccagtgaggagacccagcatggcgtat

SEQ ID NO: 371477 - DNA, 140 bp, Artificial Sequence
  Synthetic
atacgccatgctgggtctccaatcaccttctgtgctatcatcttaggaggtctcacatggatggacttactgcgagcccttatcatgttaggggacactatgtctggtagaataggaggacgtacttgggagtcggccat

SEQ ID NO: 371478 - DNA, 140 bp, Artificial Sequence
  Synthetic
atggccgactcccaagtacgtcctcctattctaccagacatagtgtcccctaacatgataagggctcgcagtaagtccatccatgtgagacctcctaagatgatagcacagaaggtgattggagacccagcatggcgtat

SEQ ID NO: 371479 - DNA, 140 bp, Artificial Sequence
  Synthetic
atacgccatgctgggtctcctaataggaatggccatgacaacggtgttttcaattccacatgacctcatggaactcattgatggaatatcattggggctgatattactaaaaatagtaaccgtacttgggagtcggccat

SEQ ID NO: 371480 - DNA, 140 bp, Artificial Sequence
  Synthetic
atggccgactcccaagtacggttactatttttagtaatatcagccccaatgatattccatcaatgagttccatgaggtcatgtggaattgaaaacaccgttgtcatggccattcctattaggagacccagcatggcgtat

SEQ ID NO: 371481 - DNA, 140 bp, Artificial Sequence
  Synthetic
atacgccatgctgggtctccaacaaggaggaagagcctatacacatgcaatggaagaactgccagacaccatagaaacgttgatgctcctagctttgatagctgtgttaactggtggagtcgtacttgggagtcggccat

SEQ ID NO: 371482 - DNA, 140 bp, Artificial Sequence
  Synthetic
atggccgactcccaagtacgactccaccagttaacacagctatcaaagctaggagcatcaacgtttctatggtgtctggcagttcttccattgcatgtgtataggctcttcctccttgttggagacccagcatggcgtat

SEQ ID NO: 371483 - DNA, 140 bp, Artificial Sequence
  Synthetic
atacgccatgctgggtctcccgccctcctaaagaatgatgttcctttagctggcccaatggtagcaggaggcttacttctagcggcttacgtaatgagtggcagctcagcagacctgtcacgtacttgggagtcggccat

SEQ ID NO: 371484 - DNA, 140 bp, Artificial Sequence
  Synthetic
atggccgactcccaagtacgtgacaggtctgctgagctgccactcattacgtaagccgctagaagtaagcctcctgctaccattgggccagctaaaggaacatcattctttaggagggcgggagacccagcatggcgtat

SEQ ID NO: 371485 - DNA, 140 bp, Artificial Sequence
  Synthetic
atacgccatgctgggtctccccccattggatagcggcctctatcatactggagttcttcctgatggtgctgcttattccagagccagacagacaacgcactccgcaggacaaccagctggcgtacttgggagtcggccat

SEQ ID NO: 371486 - DNA, 140 bp, Artificial Sequence
  Synthetic
atggccgactcccaagtacgccagctggttgtcctgcggagtgcgttgtctgtctggctctggaataagcagcaccatcaggaagaactccagtatgatagaggccgctatccaatggggggagacccagcatggcgtat

SEQ ID NO: 371487 - DNA, 140 bp, Artificial Sequence
  Synthetic
aggccctggctgctgatatggcttattccagagccagacagacaacgcactccgcaggacaaccagctggcatatgtggtgataggtttgttattcatgatactgacagtagcagctaatgaccttttgggacagcggtg

SEQ ID NO: 371488 - DNA, 140 bp, Artificial Sequence
  Synthetic
caccgctgtcccaaaaggtcattagctgctactgtcagtatcatgaataacaaacctatcaccacatatgccagctggttgtcctgcggagtgcgttgtctgtctggctctggaataagccatatcagcagccagggcct

SEQ ID NO: 371489 - DNA, 140 bp, Artificial Sequence
  Synthetic
atacgccatgctgggtctccgctgagatggaagaagcattgaaagggctcccaataaggtaccaaacaacagcaacaaaatctgaacacacaggaagagagattgttgatctaatgtgcccgtacttgggagtcggccat

SEQ ID NO: 371490 - DNA, 140 bp, Artificial Sequence
  Synthetic
atggccgactcccaagtacgggcacattagatcaacaatctctcttcctgtgtgttcagattttgttgctgttgtttggtaccttattgggagccctttcaatgcttcttccatctcagcggagacccagcatggcgtat

SEQ ID NO: 371491 - DNA, 140 bp, Artificial Sequence
  Synthetic
atacgccatgctgggtctccctgataacagtatcaggtctttaccccttggcaattccagtcacaatggcactatggtatatttggcaagtgaaaacacaaagatcaggagctctgtgggcgtacttgggagtcggccat

SEQ ID NO: 371492 - DNA, 140 bp, Artificial Sequence
  Synthetic
atggccgactcccaagtacgcccacagagctcctgatctttgtgttttcacttgccaaatataccatagtgccattgtgactggaattgccaaggggtaaagacctgatactgttatcagggagacccagcatggcgtat

SEQ ID NO: 371493 - DNA, 140 bp, Artificial Sequence
  Synthetic
aggccctggctgctgatatgcagcttcagcctggaccctctatgcagtggccacaacaattatcactcccatgatgaggcacacaatcgaaaacacaacggcaaacatttccctgacagcgaccttttgggacagcggtg

SEQ ID NO: 371494 - DNA, 140 bp, Artificial Sequence
  Synthetic
caccgctgtcccaaaaggtcgctgtcagggaaatgtttgccgttgtgttttcgattgtgtgcctcatcatgggagtgataattgttgtggccactgcatagagggtccaggctgaagctgcatatcagcagccagggcct

SEQ ID NO: 371495 - DNA, 140 bp, Artificial Sequence
  Synthetic
aggccctggctgctgatatgcattgcaaaccaggcagctatattgatgggacttgacaaaggatggccaatatcaaagatggacataggagttccacttctcgccttggggtgctattccgaccttttgggacagcggtg

SEQ ID NO: 371496 - DNA, 140 bp, Artificial Sequence
  Synthetic
caccgctgtcccaaaaggtcggaatagcaccccaaggcgagaagtggaactcctatgtccatctttgatattggccatcctttgtcaagtcccatcaatatagctgcctggtttgcaatgcatatcagcagccagggcct

SEQ ID NO: 371497 - DNA, 140 bp, Artificial Sequence
  Synthetic
atacgccatgctgggtctcccagtgatctgccatgagacagggagattagagccatcttgggctgacgtcaggaatgacatgatatcatacggtgggggatggaggctcggagacaaatgcgtacttgggagtcggccat

SEQ ID NO: 371498 - DNA, 140 bp, Artificial Sequence
  Synthetic
atggccgactcccaagtacgcatttgtctccgagcctccatcccccaccgtatgatatcatgtcattcctgacgtcagcccaagatggctctaatctccctgtctcatggcagatcactgggagacccagcatggcgtat

SEQ ID NO: 371499 - DNA, 140 bp, Artificial Sequence
  Synthetic
atacgccatgctgggtctccccaaatcaggtgattacgtcagtgccataacgcaagccgaaagaattggtgagccagattatgaagtagatgaggacatttttcgaaagaaaagattaaccgtacttgggagtcggccat

SEQ ID NO: 371500 - DNA, 140 bp, Artificial Sequence
  Synthetic
atggccgactcccaagtacggttaatcttttctttcgaaaaatgtcctcatctacttcataatctggctcaccaattctttcggcttgcgttatggcactgacgtaatcacctgatttggggagacccagcatggcgtat

SEQ ID NO: 371501 - DNA, 140 bp, Artificial Sequence
  Synthetic
atacgccatgctgggtctcccaatagtcagagaagctttgaaaaggaggctgcgaaccttgattttggctcccacgagagtggtggcggccgagatggaagaggccctacgcggactgcccgtacttgggagtcggccat

SEQ ID NO: 371502 - DNA, 140 bp, Artificial Sequence
  Synthetic
atggccgactcccaagtacgggcagtccgcgtagggcctcttccatctcggccgccaccactctcgtgggagccaaaatcaaggttcgcagcctccttttcaaagcttctctgactattgggagacccagcatggcgtat

SEQ ID NO: 371503 - DNA, 140 bp, Artificial Sequence
  Synthetic
atacgccatgctgggtctccactgagcaagtcagaatttaacacctataaaaggagtgggattatggaagtggacagatccgaagccaaagagggactgaaaagaggagaaacaaccaaacgtacttgggagtcggccat

SEQ ID NO: 371504 - DNA, 140 bp, Artificial Sequence
  Synthetic
atggccgactcccaagtacgtttggttgtttctcctcttttcagtccctctttggcttcggatctgtccacttccataatcccactccttttataggtgttaaattctgacttgctcagtggagacccagcatggcgtat

SEQ ID NO: 371505 - DNA, 140 bp, Artificial Sequence
  Synthetic
atacgccatgctgggtctcccacctgagaaatgtgacacccttttgtgtgatattggtgagtcctctccaaacccaactatagaggaaggaagaacgctacgcgtcctaaagatggtggacgtacttgggagtcggccat

SEQ ID NO: 371506 - DNA, 140 bp, Artificial Sequence
  Synthetic
atggccgactcccaagtacgtccaccatctttaggacgcgtagcgttcttccttcctctatagttgggtttggagaggactcaccaatatcacacaaaagggtgtcacatttctcaggtgggagacccagcatggcgtat

SEQ ID NO: 371507 - DNA, 140 bp, Artificial Sequence
  Synthetic
aggccctggctgctgatatgctttgacacagagtatccaaagacgaaactcacggactgggattttgtggtcaccacagacatatctgaaatgggggccaattttagagctgggagagtggaccttttgggacagcggtg

SEQ ID NO: 371508 - DNA, 140 bp, Artificial Sequence
  Synthetic
caccgctgtcccaaaaggtccactctcccagctctaaaattggcccccatttcagatatgtctgtggtgaccacaaaatcccagtccgtgagtttcgtctttggatactctgtgtcaaagcatatcagcagccagggcct

SEQ ID NO: 371509 - DNA, 140 bp, Artificial Sequence
  Synthetic
aggccctggctgctgatatgatgctagtgcgaaatccactttcaagaaattccactcatgaaatgtattgggtttcatgtggaacaggaaacattgtgtcagcagtaaacatgacatccagaccttttgggacagcggtg

SEQ ID NO: 371510 - DNA, 140 bp, Artificial Sequence
  Synthetic
caccgctgtcccaaaaggtctggatgtcatgtttactgctgacacaatgtttcctgttccacatgaaacccaatacatttcatgagtggaatttcttgaaagtggatttcgcactagcatcatatcagcagccagggcct

SEQ ID NO: 371511 - DNA, 140 bp, Artificial Sequence
  Synthetic
atacgccatgctgggtctccatggaactcaggctatgactggatcactgatttcccaggaaaaacagtctggtttgttccaagcatcaaatcaggaaatgacattgccaactgtttaagacgtacttgggagtcggccat

SEQ ID NO: 371512 - DNA, 140 bp, Artificial Sequence
  Synthetic
atggccgactcccaagtacgtcttaaacagttggcaatgtcatttcctgatttgatgcttggaacaaaccagactgtttttcctgggaaatcagtgatccagtcatagcctgagttccatggagacccagcatggcgtat

SEQ ID NO: 371513 - DNA, 140 bp, Artificial Sequence
  Synthetic
aggccctggctgctgatatgcctaattctggccggagtttcgcttttgccactgtgccagtcttcgagtatgaggaaaacagattggctcccaatgactgtggcagctatgggagtcccagaccttttgggacagcggtg

SEQ ID NO: 371514 - DNA, 140 bp, Artificial Sequence
  Synthetic
caccgctgtcccaaaaggtctgggactcccatagctgccacagtcattgggagccaatctgttttcctcatactcgaagactggcacagtggcaaaagcgaaactccggccagaattaggcatatcagcagccagggcct

SEQ ID NO: 371515 - DNA, 140 bp, Artificial Sequence
  Synthetic
aggccctggctgctgatatgaacacaagtcaacatggcattatgatgaggacaatccatacaaaacatgggcctatcatggatcatatgaggtcaagccatcaggatcagcctcatccatgaccttttgggacagcggtg

SEQ ID NO: 371516 - DNA, 140 bp, Artificial Sequence
  Synthetic
caccgctgtcccaaaaggtcatggatgaggctgatcctgatggcttgacctcatatgatccatgataggcccatgttttgtatggattgtcctcatcataatgccatgttgacttgtgttcatatcagcagccagggcct

SEQ ID NO: 371517 - DNA, 140 bp, Artificial Sequence
  Synthetic
aggccctggctgctgatatggcctatcatggatcatatgaggtcaagccatcaggatcagcctcatccatggtcaatggcgtggtgaaactgctcaccaaaccatgggatgtcatccccagaccttttgggacagcggtg

SEQ ID NO: 371518 - DNA, 140 bp, Artificial Sequence
  Synthetic
caccgctgtcccaaaaggtctggggatgacatcccatggtttggtgagcagtttcaccacgccattgaccatggatgaggctgatcctgatggcttgacctcatatgatccatgataggccatatcagcagccagggcct

SEQ ID NO: 371519 - DNA, 140 bp, Artificial Sequence
  Synthetic
aggccctggctgctgatatgttgcctgaatatggaacccttgggctagaatgctcaccacggacaggtttggatttcaatgaaatgatcttactaacaatgaagaacaaagcatggatgggaccttttgggacagcggtg

SEQ ID NO: 371520 - DNA, 140 bp, Artificial Sequence
  Synthetic
caccgctgtcccaaaaggtcccatccatgctttgttcttcattgttagtaagatcatttcattgaaatccaaacctgtccgtggtgagcattctagcccaagggttccatattcaggcaacatatcagcagccagggcct

SEQ ID NO: 371521 - DNA, 140 bp, Artificial Sequence
  Synthetic
aggccctggctgctgatatgctcagtggagtggaaggagaaggactccacaaacttggatacatactcagagacatatcaaagattccagggggaaacatgtatgcagatgacacagccggaccttttgggacagcggtg

SEQ ID NO: 371522 - DNA, 140 bp, Artificial Sequence
  Synthetic
caccgctgtcccaaaaggtccggctgtgtcatctgcatacatgtttccccctggaatctttgatatgtctctgagtatgtatccaagtttgtggagtccttctccttccactccactgagcatatcagcagccagggcct

SEQ ID NO: 371523 - DNA, 140 bp, Artificial Sequence
  Synthetic
aggccctggctgctgatatgatcaaagttcttaacccctacatgccaacagtcatagaagagctggagaaactgcagagaaaacatggtggaagtcttgtcagatgcccgttatccaggagaccttttgggacagcggtg

SEQ ID NO: 371524 - DNA, 140 bp, Artificial Sequence
  Synthetic
caccgctgtcccaaaaggtctcctggataacgggcatctgacaagacttccaccatgttttctctgcagtttctccagctcttctatgactgttggcatgtaggggttaagaactttgatcatatcagcagccagggcct

SEQ ID NO: 371525 - DNA, 140 bp, Artificial Sequence
  Synthetic
atacgccatgctgggtctccctgattgaaaaaacaaaaacggactttgggttctaccaggtaaaaacagaaaccaccattcttgatgtggatttgagaccagcctcagcatggacactctcgtacttgggagtcggccat

SEQ ID NO: 371526 - DNA, 140 bp, Artificial Sequence
  Synthetic
atggccgactcccaagtacgagagtgtccatgctgaggctggtctcaaatccacatcaagaatggtggtttctgtttttacctggtagaacccaaagtccgtttttgttttttcaatcagggagacccagcatggcgtat

SEQ ID NO: 371527 - DNA, 140 bp, Artificial Sequence
  Synthetic
aggccctggctgctgatatgcgacttggtccatacatgctagtcatgaatggatgacgacggaagacatgctagcagtctggaacagggtgtggatccaggacaacccatggatggaagagaccttttgggacagcggtg

SEQ ID NO: 371528 - DNA, 140 bp, Artificial Sequence
  Synthetic
caccgctgtcccaaaaggtctcttccatccatgggttgtcctggatccacaccctgttccagactgctagcatgtcttccgtcgtcatccattcatgactagcatgtatggaccaagtcgcatatcagcagccagggcct

SEQ ID NO: 371529 - DNA, 140 bp, Artificial Sequence
  Synthetic
aggccctggctgctgatatggtcggaacttatggcttaaacactttcaccaacatggaagcccagttgataagacaaatggagtctgagggaatcttttcacccagtgaattagagacccgaccttttgggacagcggtg

SEQ ID NO: 371530 - DNA, 140 bp, Artificial Sequence
  Synthetic
caccgctgtcccaaaaggtcgggtctctaattcactgggtgaaaagattccctcagactccatttgtcttatcaactgggcttccatgttggtgaaagtgtttaagccataagttccgaccatatcagcagccagggcct

SEQ ID NO: 371531 - DNA, 140 bp, Artificial Sequence
  Synthetic
aggccctggctgctgatatgcaaatttagccgagagagttctagactggctgggaaaatatggcgtcgaaaggctaaaaagaatggcaatcagtggagatgactgcgtagtgaaaccaatgaccttttgggacagcggtg

SEQ ID NO: 371532 - DNA, 140 bp, Artificial Sequence
  Synthetic
caccgctgtcccaaaaggtcattggtttcactacgcagtcatctccactgattgccattctttttagcctttcgacgccatattttcccagccagtctagaactctctcggctaaatttgcatatcagcagccagggcct

SEQ ID NO: 371533 - DNA, 140 bp, Artificial Sequence
  Synthetic
atacgccatgctgggtctcctgccgctgttagccatgggatgttattcccaagtgaacccaacaaccctgacagcatccctagtcatgcttttaatccattatgccataataggtccaggcgtacttgggagtcggccat

SEQ ID NO: 371534 - DNA, 140 bp, Artificial Sequence
  Synthetic
atggccgactcccaagtacgcctggacctattatggcataatggattaaaagcatgactagggatgctgtcagggttgttgggttcacttgggaataacatcccatggctaacagcggcaggagacccagcatggcgtat

SEQ ID NO: 371535 - DNA, 140 bp, Artificial Sequence
  Synthetic
aggccctggctgctgatatgcaacaagtgcctttttgttcacaccacttccaccagctgatcatgaaggatgggagggaaatagtggtgccatgccgcaaccaagatgaacttgtgggtagaccttttgggacagcggtg

SEQ ID NO: 371536 - DNA, 140 bp, Artificial Sequence
  Synthetic
caccgctgtcccaaaaggtctacccacaagttcatcttggttgcggcatggcaccactatttccctcccatccttcatgatcagctggtggaagtggtgtgaacaaaaaggcacttgttgcatatcagcagccagggcct

SEQ ID NO: 371537 - DNA, 140 bp, Artificial Sequence
  Synthetic
aggccctggctgctgatatgatatcctatgacccaaaatttgaaaagcagttagggcaagtcatgctactagtcctgtgtgttggacaattacttttgatgagaacaacctgggctctctgaccttttgggacagcggtg

SEQ ID NO: 371538 - DNA, 140 bp, Artificial Sequence
  Synthetic
caccgctgtcccaaaaggtcagagagcccaggttgttctcatcaaaagtaattgtccaacacacaggactagtagcatgacttgccctaactgcttttcaaattttgggtcataggatatcatatcagcagccagggcct

SEQ ID NO: 371539 - DNA, 140 bp, Artificial Sequence
  Synthetic
atacgccatgctgggtctccgcgaagtattaactttggccacaggaccaatcatgaccttgtgggagggcaacccgggaaggttttggaacacgaccatagctgtatccacagccaacatcgtacttgggagtcggccat

SEQ ID NO: 371540 - DNA, 140 bp, Artificial Sequence
  Synthetic
atggccgactcccaagtacgatgttggctgtggatacagctatggtcgtgttccaaaaccttcccgggttgccctcccacaaggtcatgattggtcctgtggccaaagttaatacttcgcggagacccagcatggcgtat

SEQ ID NO: 371541 - DNA, 140 bp, Artificial Sequence
  Synthetic
aggccctggctgctgatatgaccatgggatgtggtgcccatggtgacacagatggcaatgacagacacaactccatttggccagcagagagtctttaaagagaaagtggacaccaggacagaccttttgggacagcggtg

SEQ ID NO: 371542 - DNA, 140 bp, Artificial Sequence
  Synthetic
caccgctgtcccaaaaggtctgtcctggtgtccactttctctttaaagactctctgctggccaaatggagttgtgtctgtcattgccatctgtgtcaccatgggcaccacatcccatggtcatatcagcagccagggcct

SEQ ID NO: 371543 - DNA, 140 bp, Artificial Sequence
  Synthetic
aggccctggctgctgatatgatgacaacagaagacatgctgtcagtgtggaatagggtttggatagaggaaaacccatggatggaggacaaaacccatatatccaattgggaagatgttcgaccttttgggacagcggtg

SEQ ID NO: 371544 - DNA, 140 bp, Artificial Sequence
  Synthetic
caccgctgtcccaaaaggtcgaacatcttcccaattggatatatgggttttgtcctccatccatgggttttcctctatccaaaccctattccacactgacagcatgtcttctgttgtcatcatatcagcagccagggcct

SEQ ID NO: 371545 - DNA, 140 bp, Artificial Sequence
  Synthetic
atacgccatgctgggtctccagtaagatcagatggattgttgaaagagggatgataaagccaaaaggaaaggtcgtggatcttggttgcgggaggggaggatggtcctattacatggcgacgtacttgggagtcggccat

SEQ ID NO: 371546 - DNA, 140 bp, Artificial Sequence
  Synthetic
atggccgactcccaagtacgtcgccatgtaataggaccatcctcccctcccgcaaccaagatccacgacctttccttttggctttatcatccctctttcaacaatccatctgatcttactggagacccagcatggcgtat

SEQ ID NO: 371547 - DNA, 140 bp, Artificial Sequence
  Synthetic
aggccctggctgctgatatgcatgaagaaccaattcctatggctacttatggctggaatttggtcaaactccattcaggggttgatgtgttctacaaacccactgagcaggtggacacccgaccttttgggacagcggtg

SEQ ID NO: 371548 - DNA, 140 bp, Artificial Sequence
  Synthetic
caccgctgtcccaaaaggtcgggtgtccacctgctcagtgggtttgtagaacacatcaacccctgaatggagtttgaccaaattccagccataagtagccataggaattggttcttcatgcatatcagcagccagggcct

SEQ ID NO: 371549 - DNA, 140 bp, Artificial Sequence
  Synthetic
atacgccatgctgggtctcctgctctgtgacattggggagtcatcctccaatccaacaatagaggaaggaagaacattgagaatcttgaagatggtggagccatggctctcttcaaaacccgtacttgggagtcggccat

SEQ ID NO: 371550 - DNA, 140 bp, Artificial Sequence
  Synthetic
atggccgactcccaagtacgggttttgaagagagccatggctccaccatcttcaagattctcaatgttcttccttcctctattgttggattggaggatgactccccaatgtcacagagcaggagacccagcatggcgtat

SEQ ID NO: 371551 - DNA, 140 bp, Artificial Sequence
  Synthetic
atacgccatgctgggtctccaacatggaagcccagttaatcagacaaatggaaggagaaggtgtgctgtcaaaggcagacctcgagaaccctcatctgccagagaagaaaattacacaatcgtacttgggagtcggccat

SEQ ID NO: 371552 - DNA, 140 bp, Artificial Sequence
  Synthetic
atggccgactcccaagtacgattgtgtaattttcttctctggcagatgagggttctcgaggtctgcctttgacagcacaccttctccttccatttgtctgattaactgggcttccatgttggagacccagcatggcgtat

SEQ ID NO: 371553 - DNA, 140 bp, Artificial Sequence
  Synthetic
aggccctggctgctgatatggataccagaacaccacaaccaaaacttggcacacgaatgattatgaccacgacagccaattggttgtgggccctcctcgggaagaagaaaagtcccagacgaccttttgggacagcggtg

SEQ ID NO: 371554 - DNA, 140 bp, Artificial Sequence
  Synthetic
caccgctgtcccaaaaggtcgtctgggacttttcttcttcccgaggagggcccacaaccaattggctgtcgtggtcataatcattcgtgtgccaagttttggttgtggtgttctggtatccatatcagcagccagggcct

SEQ ID NO: 371555 - DNA, 140 bp, Artificial Sequence
  Synthetic
atacgccatgctgggtctcctgtgcacaagggaagagttcatctcaaaagttaggtcaaatgcagccataggcgcagtctttcaagaagaacagggatggacatcagccagtgaagctgtcgtacttgggagtcggccat

SEQ ID NO: 371556 - DNA, 140 bp, Artificial Sequence
  Synthetic
atggccgactcccaagtacgacagcttcactggctgatgtccatccctgttcttcttgaaagactgcgcctatggctgcatttgacctaacttttgagatgaactcttcccttgtgcacaggagacccagcatggcgtat

SEQ ID NO: 371557 - DNA, 140 bp, Artificial Sequence
  Synthetic
aggccctggctgctgatatgccatggaagctgtacgcatggggtagcagactagtggttagaggagacccctcccgaaacataacgcagcagcggggcccaacaccaggggaagctgtacgaccttttgggacagcggtg

SEQ ID NO: 371558 - DNA, 140 bp, Artificial Sequence
  Synthetic
caccgctgtcccaaaaggtcgtacagcttcccctggtgttgggccccgctgctgcgttatgtttcgggaggggtctcctctaaccactagtctgctaccccatgcgtacagcttccatggcatatcagcagccagggcct

SEQ ID NO: 371559 - DNA, 140 bp, Artificial Sequence
  Synthetic
aggccctggctgctgatatggaggagacccctcccatgacacaacgcagcagcggggcccgagcactgagggaagctgtacctccctgcagacacgcaacaggggataggcaaggcacacgaccttttgggacagcggtg

SEQ ID NO: 371560 - DNA, 140 bp, Artificial Sequence
  Synthetic
caccgctgtcccaaaaggtcgtgtgccttgcctatcccctgttgcgtgtctgcagggaggtacagcttccctcagtgctcgggccccgctgctgcgttgtgtcatgggaggggtctcctccatatcagcagccagggcct

SEQ ID NO: 371561 - DNA, 140 bp, Artificial Sequence
  Synthetic
atacgccatgctgggtctccgtccatgccgatatgggttattggatagaaagtgcactcaatgacacatggaagatggagaaagcctccttcattgaagttaaaagctgccactggccaacgtacttgggagtcggccat

SEQ ID NO: 371562 - DNA, 140 bp, Artificial Sequence
  Synthetic
atggccgactcccaagtacgttggccagtggcagcttttaacttcaatgaaggaggctttctccatcttccatgtgtcattgagtgcactttctatccaataacccatatcggcatggacggagacccagcatggcgtat

SEQ ID NO: 371563 - DNA, 140 bp, Artificial Sequence
  Synthetic
atacgccatgctgggtctccaatacattcactaacatggaagttcaactcatccgccaaatggaagctgaaggagtcatcacacaagacgacatgcagaacccaaaagggttgaaagaaacgtacttgggagtcggccat

SEQ ID NO: 371564 - DNA, 140 bp, Artificial Sequence
  Synthetic
atggccgactcccaagtacgtttctttcaacccttttgggttctgcatgtcgtcttgtgtgatgactccttcagcttccatttggcggatgagttgaacttccatgttagtgaatgtattggagacccagcatggcgtat

SEQ ID NO: 371565 - DNA, 140 bp, Artificial Sequence
  Synthetic
atacgccatgctgggtctcctgctcccaccattttcacaagatcttcatgaaagatggccgctcactggttgttccatgcagaaaccaggatgaactgataggaagagccagaatctcgccgtacttgggagtcggccat

SEQ ID NO: 371566 - DNA, 140 bp, Artificial Sequence
  Synthetic
atggccgactcccaagtacggcgagattctggctcttcctatcagttcatcctggtttctgcatggaacaaccagtgagcggccatctttcatgaagatcttgtgaaaatggtgggagcaggagacccagcatggcgtat

SEQ ID NO: 371567 - DNA, 140 bp, Artificial Sequence
  Synthetic
aggccctggctgctgatatgtgttccatgcagaaaccaggatgaactgataggaagagccagaatctcgcagggggctggatggagcttgagagaaacagcctgtctgggcaaagcttacgaccttttgggacagcggtg

SEQ ID NO: 371568 - DNA, 140 bp, Artificial Sequence
  Synthetic
caccgctgtcccaaaaggtcgtaagctttgcccagacaggctgtttctctcaagctccatccagccccctgcgagattctggctcttcctatcagttcatcctggtttctgcatggaacacatatcagcagccagggcct

SEQ ID NO: 371569 - DNA, 140 bp, Artificial Sequence
  Synthetic
aggccctggctgctgatatgaacattggacattgaacttttgaagacggaagtcacaaaccctgccatcctgcgcaaactgtgcattgaagctaaaatatcaaacaccaccaccgactcagaccttttgggacagcggtg

SEQ ID NO: 371570 - DNA, 140 bp, Artificial Sequence
  Synthetic
caccgctgtcccaaaaggtctgagtcggtggtggtgtttgatattttagcttcaatgcacagtttgcgcaggatggcagggtttgtgacttccgtcttcaaaagttcaatgtccaatgttcatatcagcagccagggcct

SEQ ID NO: 371571 - DNA, 140 bp, Artificial Sequence
  Synthetic
atacgccatgctgggtctcccttccgagagtgaaggagttctgtaattattaacagcaaacaccaaagagacattgaagtcaggccacttgtgccacggcttgagcaaaccgtgctgcctcgtacttgggagtcggccat

SEQ ID NO: 371572 - DNA, 140 bp, Artificial Sequence
  Synthetic
atggccgactcccaagtacgaggcagcacggtttgctcaagccgtggcacaagtggcctgacttcaatgtctctttggtgtttgctgttaataattacagaactccttcactctcggaagggagacccagcatggcgtat

SEQ ID NO: 371573 - DNA, 140 bp, Artificial Sequence
  Synthetic
aggccctggctgctgatatgacattgaagtcaggccacttgtgccacggcttgagcaaaccgtgctgcctgtagctccgccaataatgggaggcgtaaaattcccagggaggccatgcgcgaccttttgggacagcggtg

SEQ ID NO: 371574 - DNA, 140 bp, Artificial Sequence
  Synthetic
caccgctgtcccaaaaggtcgcgcatggcctccctgggaattttacgcctcccattattggcggagctacaggcagcacggtttgctcaagccgtggcacaagtggcctgacttcaatgtcatatcagcagccagggcct

SEQ ID NO: 371575 - DNA, 140 bp, Artificial Sequence
  Synthetic
atacgccatgctgggtctccggctcttcggaaaaggaagcctaataacgtgtgctaagttcaagtgtgtgacaaaactggaaggaaagatagttcaatatgaaaacttgaaatattcagtcgtacttgggagtcggccat

SEQ ID NO: 371576 - DNA, 140 bp, Artificial Sequence
  Synthetic
atggccgactcccaagtacgactgaatatttcaagttttcatattgaactatctttccttccagttttgtcacacacttgaacttagcacacgttattaggcttccttttccgaagagccggagacccagcatggcgtat

SEQ ID NO: 371577 - DNA, 140 bp, Artificial Sequence
  Synthetic
aggccctggctgctgatatgctagaggttagaggagacccccccaacacaaaaacagcatattgacgctgggaaagaccagagatcctgctgtctctgcaacatcaatccaggcacagaggaccttttgggacagcggtg

SEQ ID NO: 371578 - DNA, 140 bp, Artificial Sequence
  Synthetic
caccgctgtcccaaaaggtcctctgtgcctggattgatgttgcagagacagcaggatctctggtctttcccagcgtcaatatgctgtttttgtgttgggggggtctcctctaacctctagcatatcagcagccagggcct

SEQ ID NO: 371579 - DNA, 140 bp, Artificial Sequence
  Synthetic
atacgccatgctgggtctcctatgctgaaacgcgagagaaaccgcgtatcaacccctcaagggttggtgaagagattctcaaccggacttttctctgggaaaggacccttacggatggtgcgtacttgggagtcggccat

SEQ ID NO: 371580 - DNA, 140 bp, Artificial Sequence
  Synthetic
atggccgactcccaagtacgcaccatccgtaagggtcctttcccagagaaaagtccggttgagaatctcttcaccaacccttgaggggttgatacgcggtttctctcgcgtttcagcataggagacccagcatggcgtat

SEQ ID NO: 371581 - DNA, 140 bp, Artificial Sequence
  Synthetic
atacgccatgctgggtctccaagtcttttgtttaaaacagaggatggtgtcaacatgtgcaccctcatggccatagaccttggtgaattgtgtgaagacacaatcacgtacaagtgtccccgtacttgggagtcggccat

SEQ ID NO: 371582 - DNA, 140 bp, Artificial Sequence
  Synthetic
atggccgactcccaagtacggggacacttgtacgtgattgtgtcttcacacaattcaccaaggtctatggccatgagggtgcacatgttgacaccatcctctgttttaaacaaaagacttggagacccagcatggcgtat

SEQ ID NO: 371583 - DNA, 140 bp, Artificial Sequence
  Synthetic
aggccctggctgctgatatggacatttccaagatacccggaggagccatgtatgctgatgacacagccggttgggacacaagaataacagaagatgacctgcacaatgaggaaaagatcagaccttttgggacagcggtg

SEQ ID NO: 371584 - DNA, 140 bp, Artificial Sequence
  Synthetic
caccgctgtcccaaaaggtctgatcttttcctcattgtgcaggtcatcttctgttattcttgtgtcccaaccggctgtgtcatcagcatacatggctcctccgggtatcttggaaatgtccatatcagcagccagggcct

SEQ ID NO: 371585 - DNA, 140 bp, Artificial Sequence
  Synthetic
atacgccatgctgggtctccaggagtcatggttcaggcggattcaggatgtgtaattaattggaaaggtagagaactcaaatgtggaagtggcatttttgtcaccaatgaagttcacactcgtacttgggagtcggccat

SEQ ID NO: 371586 - DNA, 140 bp, Artificial Sequence
  Synthetic
atggccgactcccaagtacgagtgtgaacttcattggtgacaaaaatgccacttccacatttgagttctctacctttccaattaattacacatcctgaatccgcctgaaccatgactcctggagacccagcatggcgtat

SEQ ID NO: 371587 - DNA, 140 bp, Artificial Sequence
  Synthetic
aggccctggctgctgatatgcatggacagaacaatataagttccaaccagaatccccttcaaaactagcttcagctatccaaaaagctcatgaagaaggcatttgtggaatccgctcagtgaccttttgggacagcggtg

SEQ ID NO: 371588 - DNA, 140 bp, Artificial Sequence
  Synthetic
caccgctgtcccaaaaggtcactgagcggattccacaaatgccttcttcatgagctttttggatagctgaagctagttttgaaggggattctggttggaacttatattgttctgtccatgcatatcagcagccagggcct

SEQ ID NO: 371589 - DNA, 140 bp, Artificial Sequence
  Synthetic
atacgccatgctgggtctccgatttgtgtgagggcaccacagttgttgtggatgaacattgtggaaatcgaggaccatctcttaggaccacaacagtcacaggaaagataattcatgaatcgtacttgggagtcggccat

SEQ ID NO: 371590 - DNA, 140 bp, Artificial Sequence
  Synthetic
atggccgactcccaagtacgattcatgaattatctttcctgtgactgttgtggtcctaagagatggtcctcgatttccacaatgttcatccacaacaactgtggtgccctcacacaaatcggagacccagcatggcgtat

SEQ ID NO: 371591 - DNA, 140 bp, Artificial Sequence
  Synthetic
aggccctggctgctgatatgggatagaaagccaaaagaatggaagttggaagctggaaaaagcatccctcatagaggtgaaaacctgcacatggccaaaatcacacaccctttggagtaagaccttttgggacagcggtg

SEQ ID NO: 371592 - DNA, 140 bp, Artificial Sequence
  Synthetic
caccgctgtcccaaaaggtcttactccaaagggtgtgtgattttggccatgtgcaggttttcacctctatgagggatgctttttccagcttccaacttccattcttttggctttctatcccatatcagcagccagggcct

SEQ ID NO: 371593 - DNA, 140 bp, Artificial Sequence
  Synthetic
atacgccatgctgggtctccaggagaccttccggtgtggctgagctacaaggtagcttctgccggtatctcttataaagaccgagaatggtgcttcacaggagaaaggaataaccaaattcgtacttgggagtcggccat

SEQ ID NO: 371594 - DNA, 140 bp, Artificial Sequence
  Synthetic
atggccgactcccaagtacgaatttggttattcctttctcctgtgaagcaccattctcggtctttataagagataccggcagaagctaccttgtagctcagccacaccggaaggtctcctggagacccagcatggcgtat

SEQ ID NO: 371595 - DNA, 140 bp, Artificial Sequence
  Synthetic
atacgccatgctgggtctccattagtggaggtccaagatgatggaaccatgaagataaaggatgaagagagagatgacacgctaaccattctccttaaagcaactctgctagcagtttcacgtacttgggagtcggccat

SEQ ID NO: 371596 - DNA, 140 bp, Artificial Sequence
  Synthetic
atggccgactcccaagtacgtgaaactgctagcagagttgctttaaggagaatggttagcgtgtcatctctctcttcatcctttatcttcatggttccatcatcttggacctccactaatggagacccagcatggcgtat

SEQ ID NO: 371597 - DNA, 140 bp, Artificial Sequence
  Synthetic
atacgccatgctgggtctccagaggactgttgggcaggtcccaagtaggggtaggagttttccaagaaaacgtgttccacacaatgtggcatgtcaccaggggagctgtactcatgtatccgtacttgggagtcggccat

SEQ ID NO: 371598 - DNA, 140 bp, Artificial Sequence
  Synthetic
atggccgactcccaagtacggatacatgagtacagctcccctggtgacatgccacattgtgtggaacacgttttcttggaaaactcctacccctacttgggacctgcccaacagtcctctggagacccagcatggcgtat

SEQ ID NO: 371599 - DNA, 140 bp, Artificial Sequence
  Synthetic
atacgccatgctgggtctccctccatggccatatgctcagcagttccaactgaatggtttccaacaagcagaacaacatggtcaatccatgctcaacaccagtggatgaccactgaagatcgtacttgggagtcggccat

SEQ ID NO: 371600 - DNA, 140 bp, Artificial Sequence
  Synthetic
atggccgactcccaagtacgatcttcagtggtcatccactggtgttgagcatggattgaccatgttgttctgcttgttggaaaccattcagttggaactgctgagcatatggccatggagggagacccagcatggcgtat

SEQ ID NO: 371601 - DNA, 140 bp, Artificial Sequence
  Synthetic
aggccctggctgctgatatgaaaaatagtaggtctttatggaaatggagtagtgacaacaagtggaacctacgtcagtgccatagctcaagccaaagcatcacaagaagggcccctaccagaccttttgggacagcggtg

SEQ ID NO: 371602 - DNA, 140 bp, Artificial Sequence
  Synthetic
caccgctgtcccaaaaggtctggtaggggcccttcttgtgatgctttggcttgagctatggcactgacgtaggttccacttgttgtcactactccatttccataaagacctactatttttcatatcagcagccagggcct

SEQ ID NO: 371603 - DNA, 140 bp, Artificial Sequence
  Synthetic
aggccctggctgctgatatgcaaaggggttggaaagacttcaataggactcatttgtgtagttgcttccagcggcatgttatggatggctgatatcccactccaatggatcgcgtcggccgaccttttgggacagcggtg

SEQ ID NO: 371604 - DNA, 140 bp, Artificial Sequence
  Synthetic
caccgctgtcccaaaaggtcggccgacgcgatccattggagtgggatatcagccatccataacatgccgctggaagcaactacacaaatgagtcctattgaagtctttccaacccctttgcatatcagcagccagggcct

SEQ ID NO: 371605 - DNA, 140 bp, Artificial Sequence
  Synthetic
aggccctggctgctgatatgaaaaacaaaccaacattggattttgaactgataaaaacagaagccaaacaacctgccactctaaggaagtactgtatagaagcaaagctgaccaacacaagaccttttgggacagcggtg

SEQ ID NO: 371606 - DNA, 140 bp, Artificial Sequence
  Synthetic
caccgctgtcccaaaaggtcttgtgttggtcagctttgcttctatacagtacttccttagagtggcaggttgtttggcttctgtttttatcagttcaaaatccaatgttggtttgtttttcatatcagcagccagggcct

SEQ ID NO: 371607 - DNA, 140 bp, Artificial Sequence
  Synthetic
aggccctggctgctgatatgatttcacagatccagccagcatagcggctagagggtacatatcaactcgtgtaggaatgggagaggcagctgcaattttcatgacagcaacaccccctgggaccttttgggacagcggtg

SEQ ID NO: 371608 - DNA, 140 bp, Artificial Sequence
  Synthetic
caccgctgtcccaaaaggtcccagggggtgttgctgtcatgaaaattgcagctgcctctcccattcctacacgagttgatatgtaccctctagccgctatgctggctggatctgtgaaatcatatcagcagccagggcct

SEQ ID NO: 371609 - DNA, 140 bp, Artificial Sequence
  Synthetic
aggccctggctgctgatatgcaggacaaaaggttcatctgcaaacactccatggtagacagaggatggggaaatggatgtggattatttggaaagggaggcattgtgacctgtgctatgtgaccttttgggacagcggtg

SEQ ID NO: 371610 - DNA, 140 bp, Artificial Sequence
  Synthetic
caccgctgtcccaaaaggtcacatagcacaggtcacaatgcctccctttccaaataatccacatccatttccccatcctctgtctaccatggagtgtttgcagatgaaccttttgtcctgcatatcagcagccagggcct

SEQ ID NO: 371611 - DNA, 140 bp, Artificial Sequence
  Synthetic
atacgccatgctgggtctccggtttgttccaagcattaaatcaggaaatgacatagccaactgcttaagaaagaatgggaaacgggtgattcaattgagcaggaaaacctttgatacagacgtacttgggagtcggccat

SEQ ID NO: 371612 - DNA, 140 bp, Artificial Sequence
  Synthetic
atggccgactcccaagtacgtctgtatcaaaggttttcctgctcaattgaatcacccgtttcccattctttcttaagcagttggctatgtcatttcctgatttaatgcttggaacaaaccggagacccagcatggcgtat

SEQ ID NO: 371613 - DNA, 140 bp, Artificial Sequence
  Synthetic
aggccctggctgctgatatgtcggaaaagaggaatacgtggattacatgccagtcatgaaaagatacagcgctccttccgagagtgaaggagttctgtaattattaacagcaaacaccaagaccttttgggacagcggtg

SEQ ID NO: 371614 - DNA, 140 bp, Artificial Sequence
  Synthetic
caccgctgtcccaaaaggtcttggtgtttgctgttaataattacagaactccttcactctcggaaggagcgctgtatcttttcatgactggcatgtaatccacgtattcctcttttccgacatatcagcagccagggcct

SEQ ID NO: 371615 - DNA, 140 bp, Artificial Sequence
  Synthetic
aggccctggctgctgatatgttaaagagtttgcagcagggagaagaagcgtctcaggtgatctaatattggaaatagggaaacttccacaacacttgacgcaaagggcccagaatgccttgaccttttgggacagcggtg

SEQ ID NO: 371616 - DNA, 140 bp, Artificial Sequence
  Synthetic
caccgctgtcccaaaaggtcaaggcattctgggccctttgcgtcaagtgttgtggaagtttccctatttccaatattagatcacctgagacgcttcttctccctgctgcaaactctttaacatatcagcagccagggcct

SEQ ID NO: 371617 - DNA, 140 bp, Artificial Sequence
  Synthetic
aggccctggctgctgatatggctttgatagctgtgttaactggtggagtgacactgttcttcctatcaggaaggggcttagggaaaacatctattggcctactctgcgtaatggcttcaagaccttttgggacagcggtg

SEQ ID NO: 371618 - DNA, 140 bp, Artificial Sequence
  Synthetic
caccgctgtcccaaaaggtcttgaagccattacgcagagtaggccaatagatgttttccctaagccccttcctgataggaagaacagtgtcactccaccagttaacacagctatcaaagccatatcagcagccagggcct

SEQ ID NO: 371619 - DNA, 140 bp, Artificial Sequence
  Synthetic
atacgccatgctgggtctccacaaagaaagacttagggattggccatgtggctgttggaaatcaccaccatgccgcaatgctggacgtagacttacatccagcttcagcctggaccctctcgtacttgggagtcggccat

SEQ ID NO: 371620 - DNA, 140 bp, Artificial Sequence
  Synthetic
atggccgactcccaagtacgagagggtccaggctgaagctggatgtaagtctacgtccagcattgcggcatggtggtgatttccaacagccacatggccaatccctaagtctttctttgtggagacccagcatggcgtat

SEQ ID NO: 371621 - DNA, 140 bp, Artificial Sequence
  Synthetic
atacgccatgctgggtctccagattgtgaccatagaggcccatctttgaggaccaccactgcatctggaaaactggtcacgcaatggtgctgccgctcctgcacgatgcctcccttaaggcgtacttgggagtcggccat

SEQ ID NO: 371622 - DNA, 140 bp, Artificial Sequence
  Synthetic
atggccgactcccaagtacgccttaagggaggcatcgtgcaggagcggcagcaccattgcgtgaccagttttccagatgcagtggtggtcctcaaagatgggcctctatggtcacaatctggagacccagcatggcgtat

SEQ ID NO: 371623 - DNA, 140 bp, Artificial Sequence
  Synthetic
atacgccatgctgggtctccgtggtttatgatgcaaaatttgagaaacaactaggccaaataatgttgttgatactatgcacatcacagatcctcttgatgcggactacatgggccttgtcgtacttgggagtcggccat

SEQ ID NO: 371624 - DNA, 140 bp, Artificial Sequence
  Synthetic
atggccgactcccaagtacgacaaggcccatgtagtccgcatcaagaggatctgtgatgtgcatagtatcaacaacattatttggcctagttgtttctcaaattttgcatcataaaccacggagacccagcatggcgtat

SEQ ID NO: 371625 - DNA, 140 bp, Artificial Sequence
  Synthetic
aggccctggctgctgatatggaggtgaggatggatgctggtacgggatggaaatcagacctttgaaagagaaagaagagaacttggtcaactccttggtcacagccggacatgggcagatgaccttttgggacagcggtg

SEQ ID NO: 371626 - DNA, 140 bp, Artificial Sequence
  Synthetic
caccgctgtcccaaaaggtcatctgcccatgtccggctgtgaccaaggagttgaccaagttctcttctttctctttcaaaggtctgatttccatcccgtaccagcatccatcctcacctccatatcagcagccagggcct

SEQ ID NO: 371627 - DNA, 140 bp, Artificial Sequence
  Synthetic
atacgccatgctgggtctccgacacaacgcagcagcggggcccgagcactgagggaagctgtacctccctgcaaagctgagacacgcaacaggggataggcaaggcacacaggggataggcgtacttgggagtcggccat

SEQ ID NO: 371628 - DNA, 140 bp, Artificial Sequence
  Synthetic
atggccgactcccaagtacgcctatcccctgtgtgccttgcctatcccctgttgcgtgtctcagctttgcagggaggtacagcttccctcagtgctcgggccccgctgctgcgttgtgtcggagacccagcatggcgtat

SEQ ID NO: 371629 - DNA, 140 bp, Artificial Sequence
  Synthetic
aggccctggctgctgatatgaaccaaacatgcagtgtcgagaggaacagccaaactgaggtggtttgtggagaggaacctcgtgaaaccagaagggaaagtcatagacctcggttgtggagaccttttgggacagcggtg

SEQ ID NO: 371630 - DNA, 140 bp, Artificial Sequence
  Synthetic
caccgctgtcccaaaaggtctccacaaccgaggtctatgactttcccttctggtttcacgaggttcctctccacaaaccacctcagtttggctgttcctctcgacactgcatgtttggttcatatcagcagccagggcct

SEQ ID NO: 371631 - DNA, 140 bp, Artificial Sequence
  Synthetic
aggccctggctgctgatatgcagaacatggaacaattgcaaccataacacctcaagctcccacgtcggaaatacagctgactgactacggagccctcacattggactgctcacctagaacgaccttttgggacagcggtg

SEQ ID NO: 371632 - DNA, 140 bp, Artificial Sequence
  Synthetic
caccgctgtcccaaaaggtcgttctaggtgagcagtccaatgtgagggctccgtagtcagtcagctgtatttccgacgtgggagcttgaggtgttatggttgcaattgttccatgttctgcatatcagcagccagggcct

SEQ ID NO: 371633 - DNA, 140 bp, Artificial Sequence
  Synthetic
atacgccatgctgggtctccattttgcataaagattctgaatccctacatgccaagtgtggtggaaactctggagcaaatgcaaagaaaacatggaggaatgctagtgcgaaatccacttcgtacttgggagtcggccat

SEQ ID NO: 371634 - DNA, 140 bp, Artificial Sequence
  Synthetic
atggccgactcccaagtacgaagtggatttcgcactagcattcctccatgttttctttgcatttgctccagagtttccaccacacttggcatgtagggattcagaatctttatgcaaaatggagacccagcatggcgtat

SEQ ID NO: 371635 - DNA, 140 bp, Artificial Sequence
  Synthetic
aggccctggctgctgatatgtggagcaaatgcaaagaaaacatggaggaatgctagtgcgaaatccactttcaagaaattctactcatgaaatgtactgggtttcatgtggaacaggaaagaccttttgggacagcggtg

SEQ ID NO: 371636 - DNA, 140 bp, Artificial Sequence
  Synthetic
caccgctgtcccaaaaggtctttcctgttccacatgaaacccagtacatttcatgagtagaatttcttgaaagtggatttcgcactagcattcctccatgttttctttgcatttgctccacatatcagcagccagggcct

SEQ ID NO: 371637 - DNA, 140 bp, Artificial Sequence
  Synthetic
atacgccatgctgggtctccatggcacttaggcaaactagagatagactttggagaatgccccggaacaacagtcacaattcaggaagattgtgaccataggggcccatctttgaggacccgtacttgggagtcggccat

SEQ ID NO: 371638 - DNA, 140 bp, Artificial Sequence
  Synthetic
atggccgactcccaagtacgggtcctcaaagatgggcccctatggtcacaatcttcctgaattgtgactgttgttccggggcattctccaaagtctatctctagtttgcctaagtgccatggagacccagcatggcgtat

SEQ ID NO: 371639 - DNA, 140 bp, Artificial Sequence
  Synthetic
atacgccatgctgggtctccctgacactacaccctttggacaacagagggtgtttaaagagaaagttgacacacgcacaccaaaagcaaaacgaggcacagcacaaatcatggaggtgaccgtacttgggagtcggccat

SEQ ID NO: 371640 - DNA, 140 bp, Artificial Sequence
  Synthetic
atggccgactcccaagtacggtcacctccatgatttgtgctgtgcctcgttttgcttttggtgtgcgtgtgtcaactttctctttaaacaccctctgttgtccaaagggtgtagtgtcagggagacccagcatggcgtat

SEQ ID NO: 371641 - DNA, 140 bp, Artificial Sequence
  Synthetic
aggccctggctgctgatatgggagcatgggtcgacctggtgctagaacatggaggatgcgtcacaaccatggcccagggaaaaccaaccctggattttgaactgaccaagacaacagctagaccttttgggacagcggtg

SEQ ID NO: 371642 - DNA, 140 bp, Artificial Sequence
  Synthetic
caccgctgtcccaaaaggtctagctgttgtcttggtcagttcaaaatccagggttggttttccctgggccatggttgtgacgcatcctccatgttctagcaccaggtcgacccatgctcccatatcagcagccagggcct

SEQ ID NO: 371643 - DNA, 140 bp, Artificial Sequence
  Synthetic
atacgccatgctgggtctcctatggaacagagtgtggatagaagacaaccctaacatgactgataagactccagttcattcgtgggaagatataccttacctagggaaaagagaggatttcgtacttgggagtcggccat

SEQ ID NO: 371644 - DNA, 140 bp, Artificial Sequence
  Synthetic
atggccgactcccaagtacgaaatcctctcttttccctaggtaaggtatatcttcccacgaatgaactggagtcttatcagtcatgttagggttgtcttctatccacactctgttccataggagacccagcatggcgtat

SEQ ID NO: 371645 - DNA, 140 bp, Artificial Sequence
  Synthetic
atacgccatgctgggtctccactttcaccaacatggaagcccagctgataagacaaatggagtctgagggaatcttttcacccagcgaattagagaccccaaatttagccgagagagttccgtacttgggagtcggccat

SEQ ID NO: 371646 - DNA, 140 bp, Artificial Sequence
  Synthetic
atggccgactcccaagtacggaactctctcggctaaatttggggtctctaattcgctgggtgaaaagattccctcagactccatttgtcttatcagctgggcttccatgttggtgaaagtggagacccagcatggcgtat

SEQ ID NO: 371647 - DNA, 140 bp, Artificial Sequence
  Synthetic
aggccctggctgctgatatgaatcttttcacccagcgaattagagaccccaaatttagccgagagagttctcgcctggctggaaaaatatggcgtcgaaaggctgaaaagaatggcaatcgaccttttgggacagcggtg

SEQ ID NO: 371648 - DNA, 140 bp, Artificial Sequence
  Synthetic
caccgctgtcccaaaaggtcgattgccattcttttcagcctttcgacgccatatttttccagccaggcgagaactctctcggctaaatttggggtctctaattcgctgggtgaaaagattcatatcagcagccagggcct

SEQ ID NO: 371649 - DNA, 140 bp, Artificial Sequence
  Synthetic
aggccctggctgctgatatgacaagggaaagctcacaatggcagactgattacagccaacccagtggtgactaagaaggaggagcctgtcaatattgaggctgaacctccttttggggaagaccttttgggacagcggtg

SEQ ID NO: 371650 - DNA, 140 bp, Artificial Sequence
  Synthetic
caccgctgtcccaaaaggtcttccccaaaaggaggttcagcctcaatattgacaggctcctccttcttagtcaccactgggttggctgtaatcagtctgccattgtgagctttcccttgtcatatcagcagccagggcct

SEQ ID NO: 371651 - DNA, 140 bp, Artificial Sequence
  Synthetic
atacgccatgctgggtctcccactgggactgctatgcatatcaataatgatcgaagaggtgatgagatccagatggagtagaaaaatgctgatgattggaacattggctgtgttcttcctcgtacttgggagtcggccat

SEQ ID NO: 371652 - DNA, 140 bp, Artificial Sequence
  Synthetic
atggccgactcccaagtacgaggaagaacacagccaatgttccaatcatcagcatttttctactccatctggatctcatcacctcttcgatcattattgatatgcatagcagtcccagtgggagacccagcatggcgtat

SEQ ID NO: 371653 - DNA, 140 bp, Artificial Sequence
  Synthetic
atacgccatgctgggtctccaggcgcttgggagaatggagtgtgcggaattaggtcaacaaccagaatggagaatctcctgtggaagcaaatagccaatgaactgaactacatattatggcgtacttgggagtcggccat

SEQ ID NO: 371654 - DNA, 140 bp, Artificial Sequence
  Synthetic
atggccgactcccaagtacgccataatatgtagttcagttcattggctatttgcttccacaggagattctccattctggttgttgacctaattccgcacactccattctcccaagcgcctggagacccagcatggcgtat

SEQ ID NO: 371655 - DNA, 140 bp, Artificial Sequence
  Synthetic
atacgccatgctgggtctcccataatgaacaggaggaaaagatccgtgaccatgcttctcatgctgctgcccacagccctggcgttccatttgaccacacgagggggagagccacacatgcgtacttgggagtcggccat

SEQ ID NO: 371656 - DNA, 140 bp, Artificial Sequence
  Synthetic
atggccgactcccaagtacgcatgtgtggctctccccctcgtgtggtcaaatggaacgccagggctgtgggcagcagcatgagaagcatggtcacggatcttttcctcctgttcattatgggagacccagcatggcgtat

SEQ ID NO: 371657 - DNA, 140 bp, Artificial Sequence
  Synthetic
aggccctggctgctgatatgccacagccctggcgttccatttgaccacacgagggggagagccacacatgatagttagtaagcaggaaagaggaaagtcactcttgtttaagacctctgcgaccttttgggacagcggtg

SEQ ID NO: 371658 - DNA, 140 bp, Artificial Sequence
  Synthetic
caccgctgtcccaaaaggtcgcagaggtcttaaacaagagtgactttcctctttcctgcttactaactatcatgtgtggctctccccctcgtgtggtcaaatggaacgccagggctgtggcatatcagcagccagggcct

SEQ ID NO: 371659 - DNA, 140 bp, Artificial Sequence
  Synthetic
atacgccatgctgggtctccccctcacagcagctcttcttttattggtagcacattatgccattatagggccaggacttcaagcaaaagcaaccagagaagctcagaaaagagcagcagccgtacttgggagtcggccat

SEQ ID NO: 371660 - DNA, 140 bp, Artificial Sequence
  Synthetic
atggccgactcccaagtacggctgctgctcttttctgagcttctctggttgcttttgcttgaagtcctggccctataatggcataatgtgctaccaataaaagaagagctgctgtgagggggagacccagcatggcgtat

SEQ ID NO: 371661 - DNA, 140 bp, Artificial Sequence
  Synthetic
aggccctggctgctgatatgccccacacgtgggacttggtctagaaacaagaaccgaaacatggatgtcctctgaaggcgcctggaaacaaatacaaagagtggagacttgggctttgaggaccttttgggacagcggtg

SEQ ID NO: 371662 - DNA, 140 bp, Artificial Sequence
  Synthetic
caccgctgtcccaaaaggtcctcaaagcccaagtctccactctttgtatttgtttccaggcgccttcagaggacatccatgtttcggttcttgtttctagaccaagtcccacgtgtggggcatatcagcagccagggcct

SEQ ID NO: 371663 - DNA, 140 bp, Artificial Sequence
  Synthetic
aggccctggctgctgatatggtgctattgacaatgaaagaaagatcatggcttgtccacaaacaatggtttctagacttaccactgccttggacttcgggggcttcaacatcccaagagagaccttttgggacagcggtg

SEQ ID NO: 371664 - DNA, 140 bp, Artificial Sequence
  Synthetic
caccgctgtcccaaaaggtctctcttgggatgttgaagcccccgaagtccaaggcagtggtaagtctagaaaccattgtttgtggacaagccatgatctttctttcattgtcaatagcaccatatcagcagccagggcct

SEQ ID NO: 371665 - DNA, 140 bp, Artificial Sequence
  Synthetic
aggccctggctgctgatatgtgcttttcttgatatcaggtaaaggaattggaaagacttcaataggactcatttgtgttattgtttccagcggcatgttatggatggctgatgttccactgaccttttgggacagcggtg

SEQ ID NO: 371666 - DNA, 140 bp, Artificial Sequence
  Synthetic
caccgctgtcccaaaaggtcagtggaacatcagccatccataacatgccgctggaaacaataacacaaatgagtcctattgaagtctttccaattcctttacctgatatcaagaaaagcacatatcagcagccagggcct

SEQ ID NO: 371667 - DNA, 140 bp, Artificial Sequence
  Synthetic
atacgccatgctgggtctccacgtcatatgtgatgtgcacaggctcatttaagctagagaaggaagtggctgagacccagcatggaactgttctagtgcaggtcaaatacgaaggaacagcgtacttgggagtcggccat

SEQ ID NO: 371668 - DNA, 140 bp, Artificial Sequence
  Synthetic
atggccgactcccaagtacgctgttccttcgtatttgacctgcactagaacagttccatgctgggtctcagccacttccttctctagcttaaatgagcctgtgcacatcacatatgacgtggagacccagcatggcgtat

SEQ ID NO: 371669 - DNA, 140 bp, Artificial Sequence
  Synthetic
atacgccatgctgggtctcccatctgtgggaaaattggtacaccaggtttttggaaccgcatatggggttctgttcagcggtgtttcttggaccatgaaaataggaatagggattctgctcgtacttgggagtcggccat

SEQ ID NO: 371670 - DNA, 140 bp, Artificial Sequence
  Synthetic
atggccgactcccaagtacgagcagaatccctattcctattttcatggtccaagaaacaccgctgaacagaaccccatatgcggttccaaaaacctggtgtaccaattttcccacagatgggagacccagcatggcgtat

SEQ ID NO: 371671 - DNA, 140 bp, Artificial Sequence
  Synthetic
aggccctggctgctgatatgctgttcagcggtgtttcttggaccatgaaaataggaatagggattctgctgacatggttgggattaaattcaaggagcacgtcactttcgatgacgtgcagaccttttgggacagcggtg

SEQ ID NO: 371672 - DNA, 140 bp, Artificial Sequence
  Synthetic
caccgctgtcccaaaaggtctgcacgtcatcgaaagtgacgtgctccttgaatttaatcccaaccatgtcagcagaatccctattcctattttcatggtccaagaaacaccgctgaacagcatatcagcagccagggcct

SEQ ID NO: 371673 - DNA, 140 bp, Artificial Sequence
  Synthetic
atacgccatgctgggtctccaaggaaggaggagcaatgtacgccgatgatacagcaggatgggacacaagaatcacactagaagacttaaaaaatgaagaaatggtaacaaaccacatgacgtacttgggagtcggccat

SEQ ID NO: 371674 - DNA, 140 bp, Artificial Sequence
  Synthetic
atggccgactcccaagtacgtcatgtggtttgttaccatttcttcattttttaagtcttctagtgtgattcttgtgtcccatcctgctgtatcatcggcgtacattgctcctccttccttggagacccagcatggcgtat

SEQ ID NO: 371675 - DNA, 140 bp, Artificial Sequence
  Synthetic
aggccctggctgctgatatgggagaaggaatcttcaaaagcattcagcacctgaccgccacagaagaaatcgctgtacagaactggttagcaagagtggggcgtgaaaggctatcaagaagaccttttgggacagcggtg

SEQ ID NO: 371676 - DNA, 140 bp, Artificial Sequence
  Synthetic
caccgctgtcccaaaaggtcttcttgatagcctttcacgccccactcttgctaaccagttctgtacagcgatttcttctgtggcggtcaggtgctgaatgcttttgaagattccttctcccatatcagcagccagggcct

SEQ ID NO: 371677 - DNA, 140 bp, Artificial Sequence
  Synthetic
aggccctggctgctgatatgacagtcacaggaaagataatccatgaatggtgttgcagatcctgcacgttaccccccttacgtttcagaggagaagacggatgttggtatggcatggaaagaccttttgggacagcggtg

SEQ ID NO: 371678 - DNA, 140 bp, Artificial Sequence
  Synthetic
caccgctgtcccaaaaggtctttccatgccataccaacatccgtcttctcctctgaaacgtaaggggggtaacgtgcaggatctgcaacaccattcatggattatctttcctgtgactgtcatatcagcagccagggcct

SEQ ID NO: 371679 - DNA, 140 bp, Artificial Sequence
  Synthetic
atacgccatgctgggtctcctcccagtcacaatgaccttatggtacatgtggcaagtgaaaacacaaagatcaggagccctgtgggacgtgccctcacccgctgccactcaaaaagccgccgtacttgggagtcggccat

SEQ ID NO: 371680 - DNA, 140 bp, Artificial Sequence
  Synthetic
atggccgactcccaagtacggcggctttttgagtggcagcgggtgagggcacgtcccacagggctcctgatctttgtgttttcacttgccacatgtaccataaggtcattgtgactgggaggagacccagcatggcgtat

SEQ ID NO: 371681 - DNA, 140 bp, Artificial Sequence
  Synthetic
aggccctggctgctgatatgtacaaatcgcagcaacaacgggggcccaaggtgagatgaagctgtagtctcactggaaggactagaggttagaggagacccccccaaaacaaaaaacagcgaccttttgggacagcggtg

SEQ ID NO: 371682 - DNA, 140 bp, Artificial Sequence
  Synthetic
caccgctgtcccaaaaggtcgctgttttttgttttgggggggtctcctctaacctctagtccttccagtgagactacagcttcatctcaccttgggcccccgttgttgctgcgatttgtacatatcagcagccagggcct

SEQ ID NO: 371683 - DNA, 140 bp, Artificial Sequence
  Synthetic
aggccctggctgctgatatgctacgacctcccaaaaaacaacatggcttccggtgctgttaggatcttttggatgcaaaccgttaaccatgtttcttataacagaaaacaaaatctgggggaccttttgggacagcggtg

SEQ ID NO: 371684 - DNA, 140 bp, Artificial Sequence
  Synthetic
caccgctgtcccaaaaggtcccccagattttgttttctgttataagaaacatggttaacggtttgcatccaaaagatcctaacagcaccggaagccatgttgttttttgggaggtcgtagcatatcagcagccagggcct

SEQ ID NO: 371685 - DNA, 140 bp, Artificial Sequence
  Synthetic
aggccctggctgctgatatgctaatagctggaggcatgctaatagcatgttatgtcatatccggaagctcagccgatttatcattggagaaagcggctgaggtgtcctgggaacaagagggaccttttgggacagcggtg

SEQ ID NO: 371686 - DNA, 140 bp, Artificial Sequence
  Synthetic
caccgctgtcccaaaaggtccctcttgttcccaggacacctcagccgctttctccaatgataaatcggctgagcttccggatatgacataacatgctattagcatgcctccagctattagcatatcagcagccagggcct

SEQ ID NO: 371687 - DNA, 140 bp, Artificial Sequence
  Synthetic
aggccctggctgctgatatgagccactcgtgaagctcagaaaaggacagctgctggaataatgaagaatccaacggtggatgggataatgacaatagacctagatcctgtaatatatgatgaccttttgggacagcggtg

SEQ ID NO: 371688 - DNA, 140 bp, Artificial Sequence
  Synthetic
caccgctgtcccaaaaggtcatcatatattacaggatctaggtctattgtcattatcccatccaccgttggattcttcattattccagcagctgtccttttctgagcttcacgagtggctcatatcagcagccagggcct

SEQ ID NO: 371689 - DNA, 140 bp, Artificial Sequence
  Synthetic
atacgccatgctgggtctcctgatgatggcatctatagaatcttgcaaagaggactgttgggcaggtcccaagtaggagtgggagttttccaagacggcgtgttccacacaatgtggcaccgtacttgggagtcggccat

SEQ ID NO: 371690 - DNA, 140 bp, Artificial Sequence
  Synthetic
atggccgactcccaagtacggtgccacattgtgtggaacacgccgtcttggaaaactcccactcctacttgggacctgcccaacagtcctctttgcaagattctatagatgccatcatcaggagacccagcatggcgtat

SEQ ID NO: 371691 - DNA, 140 bp, Artificial Sequence
  Synthetic
atacgccatgctgggtctcctgggtatgggactggagacacgaactgaaacatggatgtcatcagaaggggcctggaagcatgttcagagaattgaaacctggatcttgagacatccaggcgtacttgggagtcggccat

SEQ ID NO: 371692 - DNA, 140 bp, Artificial Sequence
  Synthetic
atggccgactcccaagtacgcctggatgtctcaagatccaggtttcaattctctgaacatgcttccaggccccttctgatgacatccatgtttcagttcgtgtctccagtcccatacccaggagacccagcatggcgtat

SEQ ID NO: 371693 - DNA, 140 bp, Artificial Sequence
  Synthetic
aggccctggctgctgatatgagaaaagaaacttaacaataatggacctgcatccaggatcaggaaaaacaagaagatatcttccagccatagtccgtgaggccataaaaaggaaactgcggaccttttgggacagcggtg

SEQ ID NO: 371694 - DNA, 140 bp, Artificial Sequence
  Synthetic
caccgctgtcccaaaaggtccgcagtttcctttttatggcctcacggactatggctggaagatatcttcttgtttttcctgatcctggatgcaggtccattattgttaagtttcttttctcatatcagcagccagggcct

SEQ ID NO: 371695 - DNA, 140 bp, Artificial Sequence
  Synthetic
aggccctggctgctgatatgagaagatatcttccagccatagtccgtgaggccataaaaaggaaactgcgcacgttaatcttggctcccacaagagttgtcgcctctgaaatggcagagggaccttttgggacagcggtg

SEQ ID NO: 371696 - DNA, 140 bp, Artificial Sequence
  Synthetic
caccgctgtcccaaaaggtccctctgccatttcagaggcgacaactcttgtgggagccaagattaacgtgcgcagtttcctttttatggcctcacggactatggctggaagatatcttctcatatcagcagccagggcct

SEQ ID NO: 371697 - DNA, 140 bp, Artificial Sequence
  Synthetic
aggccctggctgctgatatgcgctcaagggaatgccaataagatatcagacaacagcagtgaagagtgaacacacaggaagggagatagttgacctcatgtgccacgccacttttaccatgaccttttgggacagcggtg

SEQ ID NO: 371698 - DNA, 140 bp, Artificial Sequence
  Synthetic
caccgctgtcccaaaaggtcatggtaaaagtggcgtggcacatgaggtcaactatctcccttcctgtgtgttcactcttcactgctgttgtctgatatcttattggcattcccttgagcgcatatcagcagccagggcct

SEQ ID NO: 371699 - DNA, 140 bp, Artificial Sequence
  Synthetic
atacgccatgctgggtctccaattgagcagaaaaacctttgacactgagtaccagaaaacaaaaaacaatgactgggactatgttgtcacaacagacatttccgaaatgggggcaaatttcgtacttgggagtcggccat

SEQ ID NO: 371700 - DNA, 140 bp, Artificial Sequence
  Synthetic
atggccgactcccaagtacgaaatttgcccccatttcggaaatgtctgttgtgacaacatagtcccagtcattgttttttgttttctggtactcagtgtcaaaggtttttctgctcaattggagacccagcatggcgtat

SEQ ID NO: 371701 - DNA, 140 bp, Artificial Sequence
  Synthetic
aggccctggctgctgatatggactgggactatgttgtcacaacagacatttccgaaatgggggcaaatttccgggccgacagggtaatagacccaaggcggtgcttgaaaccggtaatacgaccttttgggacagcggtg

SEQ ID NO: 371702 - DNA, 140 bp, Artificial Sequence
  Synthetic
caccgctgtcccaaaaggtcgtattaccggtttcaagcaccgccttgggtctattaccctgtcggcccggaaatttgcccccatttcggaaatgtctgttgtgacaacatagtcccagtccatatcagcagccagggcct

SEQ ID NO: 371703 - DNA, 140 bp, Artificial Sequence
  Synthetic
atacgccatgctgggtctccaaccaagctgggccagtgtcaaaaaggacttgatctcatatggaggaggttggaggtttcaaggatcatggaacacgggagaagaagtgcaggtgatagccgtacttgggagtcggccat

SEQ ID NO: 371704 - DNA, 140 bp, Artificial Sequence
  Synthetic
atggccgactcccaagtacggctatcacctgcacttcttctcccgtgttccatgatccttgaaacctccaacctcctccatatgagatcaagtcctttttgacactggcccagcttggttggagacccagcatggcgtat

SEQ ID NO: 371705 - DNA, 140 bp, Artificial Sequence
  Synthetic
aggccctggctgctgatatgacagccggttgggacacaagaataacagaggatgatcttcagaatgaggctaaaatcactgacatcatggagcctgaacatgctctattggctacgtcaagaccttttgggacagcggtg

SEQ ID NO: 371706 - DNA, 140 bp, Artificial Sequence
  Synthetic
caccgctgtcccaaaaggtcttgacgtagccaatagagcatgttcaggctccatgatgtcagtgattttagcctcattctgaagatcatcctctgttattcttgtgtcccaaccggctgtcatatcagcagccagggcct

SEQ ID NO: 371707 - DNA, 140 bp, Artificial Sequence
  Synthetic
aggccctggctgctgatatgtacagataacgtacacacatggacagagcaatataagttccaaccagaatccccttcaaaactagcttcagctatccaaaaagctcatgaagaaggcattgaccttttgggacagcggtg

SEQ ID NO: 371708 - DNA, 140 bp, Artificial Sequence
  Synthetic
caccgctgtcccaaaaggtcaatgccttcttcatgagctttttggatagctgaagctagttttgaaggggattctggttggaacttatattgctctgtccatgtgtgtacgttatctgtacatatcagcagccagggcct

SEQ ID NO: 371709 - DNA, 140 bp, Artificial Sequence
  Synthetic
atacgccatgctgggtctcccagctagcatatgtggtgataggtttgttattcatgatactgacagtggcagccaatgagatgggattattggaaaccacaaagaaagacctggggattgcgtacttgggagtcggccat

SEQ ID NO: 371710 - DNA, 140 bp, Artificial Sequence
  Synthetic
atggccgactcccaagtacgcaatccccaggtctttctttgtggtttccaataatcccatctcattggctgccactgtcagtatcatgaataacaaacctatcaccacatatgctagctgggagacccagcatggcgtat

SEQ ID NO: 371711 - DNA, 140 bp, Artificial Sequence
  Synthetic
aggccctggctgctgatatggggcagattgacaacttttcactaggagtcttgggaatggcactgttcctggaagaaatgcttaggacccgagtaggaacgaaacatgcaatactgctaggaccttttgggacagcggtg

SEQ ID NO: 371712 - DNA, 140 bp, Artificial Sequence
  Synthetic
caccgctgtcccaaaaggtcctagcagtattgcatgtttcgttcctactcgggtcctaagcatttcttccaggaacagtgccattcccaagactcctagtgaaaagttgtcaatctgccccatatcagcagccagggcct

SEQ ID NO: 371713 - DNA, 140 bp, Artificial Sequence
  Synthetic
aggccctggctgctgatatgctgggaagagtgatggtcatggtgggcgctaccatgacggatgacataggtatgggagtgacttatcttgccctactagcagctttcaaagttagaccaagaccttttgggacagcggtg

SEQ ID NO: 371714 - DNA, 140 bp, Artificial Sequence
  Synthetic
caccgctgtcccaaaaggtcttggtctaactttgaaagctgctagtagggcaagataagtcactcccatacctatgtcatccgtcatggtagcgcccaccatgaccatcactcttcccagcatatcagcagccagggcct

SEQ ID NO: 371715 - DNA, 140 bp, Artificial Sequence
  Synthetic
aggccctggctgctgatatgggagacccctcccatgacacaacgcagcagcggggcccgagcactgagggaagctgtacctcctctgagacacgcaacagggggataggcaaggcacacagaccttttgggacagcggtg

SEQ ID NO: 371716 - DNA, 140 bp, Artificial Sequence
  Synthetic
caccgctgtcccaaaaggtctgtgtgccttgcctatccccctgttgcgtgtctcagaggaggtacagcttccctcagtgctcgggccccgctgctgcgttgtgtcatgggaggggtctcccatatcagcagccagggcct

SEQ ID NO: 371717 - DNA, 140 bp, Artificial Sequence
  Synthetic
atacgccatgctgggtctcccattctagaactgactgatgcgttagccttgggcatgatggccctcaaaatagtgagaaatatggaaaaataccaattggcagtgactatcatggctattcgtacttgggagtcggccat

SEQ ID NO: 371718 - DNA, 140 bp, Artificial Sequence
  Synthetic
atggccgactcccaagtacgaatagccatgatagtcactgccaattggtatttttccatatttctcactattttgagggccatcatgcccaaggctaacgcatcagtcagttctagaatgggagacccagcatggcgtat

SEQ ID NO: 371719 - DNA, 140 bp, Artificial Sequence
  Synthetic
atacgccatgctgggtctcctggagggatgctagtgcgaaacccactctcaagaaattccacccatgaaatgtactgggtttcatgtggaacaggaaacattgtgtcggcagtgaacatgcgtacttgggagtcggccat

SEQ ID NO: 371720 - DNA, 140 bp, Artificial Sequence
  Synthetic
atggccgactcccaagtacgcatgttcactgccgacacaatgtttcctgttccacatgaaacccagtacatttcatgggtggaatttcttgagagtgggtttcgcactagcatccctccaggagacccagcatggcgtat

SEQ ID NO: 371721 - DNA, 140 bp, Artificial Sequence
  Synthetic
atacgccatgctgggtctccacatccagaatgttactgaatcgattcacaatggctcacaggaagccaacatatgaaagagacgtggacttaggcgctggaacaagacatgtggcagtggcgtacttgggagtcggccat

SEQ ID NO: 371722 - DNA, 140 bp, Artificial Sequence
  Synthetic
atggccgactcccaagtacgccactgccacatgtcttgttccagcgcctaagtccacgtctctttcatatgttggcttcctgtgagccattgtgaatcgattcagtaacattctggatgtggagacccagcatggcgtat

SEQ ID NO: 371723 - DNA, 140 bp, Artificial Sequence
  Synthetic
aggccctggctgctgatatgcagcagcatggtacctgtgggaagtgaagaaacaacgggctggagtattgtgggacgtcccttcacccccaccagtgggaaaagccgaactggaagatgggaccttttgggacagcggtg

SEQ ID NO: 371724 - DNA, 140 bp, Artificial Sequence
  Synthetic
caccgctgtcccaaaaggtcccatcttccagttcggcttttcccactggtgggggtgaagggacgtcccacaatactccagcccgttgtttcttcacttcccacaggtaccatgctgctgcatatcagcagccagggcct

SEQ ID NO: 371725 - DNA, 140 bp, Artificial Sequence
  Synthetic
atacgccatgctgggtctccgaaagtcaatcgcccttgatcttgtgacagaaataggaagagtgccttcacacctagcccatagaacgagaaacgccctggacaatctggtgatgctgcacgtacttgggagtcggccat

SEQ ID NO: 371726 - DNA, 140 bp, Artificial Sequence
  Synthetic
atggccgactcccaagtacgtgcagcatcaccagattgtccagggcgtttctcgttctatgggctaggtgtgaaggcactcttcctatttctgtcacaagatcaagggcgattgactttcggagacccagcatggcgtat

SEQ ID NO: 371727 - DNA, 140 bp, Artificial Sequence
  Synthetic
aggccctggctgctgatatgaatggaactcagcaaaagaagcagtggaagacgaaaggttttgggatctcgtgcacagagagagggagcttcataaacagggaaaatgtgccacgtgtgtgaccttttgggacagcggtg

SEQ ID NO: 371728 - DNA, 140 bp, Artificial Sequence
  Synthetic
caccgctgtcccaaaaggtcacacacgtggcacattttccctgtttatgaagctccctctctctgtgcacgagatcccaaaacctttcgtcttccactgcttcttttgctgagttccattcatatcagcagccagggcct

SEQ ID NO: 371729 - DNA, 140 bp, Artificial Sequence
  Synthetic
aggccctggctgctgatatgccagccatagttagagaagccataaaacgtggcttgagaacattaatcctggctcccactagagtcgtggcagctgaaatggaggaagctcttagaggacgaccttttgggacagcggtg

SEQ ID NO: 371730 - DNA, 140 bp, Artificial Sequence
  Synthetic
caccgctgtcccaaaaggtcgtcctctaagagcttcctccatttcagctgccacgactctagtgggagccaggattaatgttctcaagccacgttttatggcttctctaactatggctggcatatcagcagccagggcct

SEQ ID NO: 371731 - DNA, 140 bp, Artificial Sequence
  Synthetic
aggccctggctgctgatatggagatcgtggacctaatgtgtcatgccacatttactatgaggctgctatcaccagtcagagtgccaaattacaacctgattatcatggacgaagcccactgaccttttgggacagcggtg

SEQ ID NO: 371732 - DNA, 140 bp, Artificial Sequence
  Synthetic
caccgctgtcccaaaaggtcagtgggcttcgtccatgataatcaggttgtaatttggcactctgactggtgatagcagcctcatagtaaatgtggcatgacacattaggtccacgatctccatatcagcagccagggcct

SEQ ID NO: 371733 - DNA, 140 bp, Artificial Sequence
  Synthetic
atacgccatgctgggtctcccgccgaaaggctgaaaagaatggcaatcagcggagatgattgcgtggtgaaaccaattgacgacaggttcgctacagccttaacagctctgaatgacatgcgtacttgggagtcggccat

SEQ ID NO: 371734 - DNA, 140 bp, Artificial Sequence
  Synthetic
atggccgactcccaagtacgcatgtcattcagagctgttaaggctgtagcgaacctgtcgtcaattggtttcaccacgcaatcatctccgctgattgccattcttttcagcctttcggcgggagacccagcatggcgtat

SEQ ID NO: 371735 - DNA, 140 bp, Artificial Sequence
  Synthetic
atacgccatgctgggtctcctctagtcaggtcaatggtctctgcagggtcaggagaagtggatagtttttcattaggaatactatgcgtgtcaataatgattgaagaagtgatgagatcccgtacttgggagtcggccat

SEQ ID NO: 371736 - DNA, 140 bp, Artificial Sequence
  Synthetic
atggccgactcccaagtacgggatctcatcacttcttcaatcattattgacacgcatagtattcctaatgaaaaactatccacttctcctgaccctgcagagaccattgacctgactagaggagacccagcatggcgtat

SEQ ID NO: 371737 - DNA, 140 bp, Artificial Sequence
  Synthetic
aggccctggctgctgatatgtgcttgcctaggcaagtcatatgcacaaatgtggcagctgatgtacttccacaggagagacctgagactggcggctaacgctatctgttcagccgtcccagaccttttgggacagcggtg

SEQ ID NO: 371738 - DNA, 140 bp, Artificial Sequence
  Synthetic
caccgctgtcccaaaaggtctgggacggctgaacagatagcgttagccgccagtctcaggtctctcctgtggaagtacatcagctgccacatttgtgcatatgacttgcctaggcaagcacatatcagcagccagggcct

SEQ ID NO: 371739 - DNA, 140 bp, Artificial Sequence
  Synthetic
aggccctggctgctgatatgggaaagaagctaaaatgctcctagataacatcaacacacccgaaggaatcattcctagtatgttcgaaccagagcgtgaaaaagtggatgccattgatgggaccttttgggacagcggtg

SEQ ID NO: 371740 - DNA, 140 bp, Artificial Sequence
  Synthetic
caccgctgtcccaaaaggtcccatcaatggcatccactttttcacgctctggttcgaacatactaggaatgattccttcgggtgtgttgatgttatctaggagcattttagcttctttcccatatcagcagccagggcct

SEQ ID NO: 371741 - DNA, 140 bp, Artificial Sequence
  Synthetic
atacgccatgctgggtctcctcttataatgggacaactgacatggaatgatctgattaggttatgcatcatggttggagctaatgcttcagacaggatggggatgggaacaacgtacctacgtacttgggagtcggccat

SEQ ID NO: 371742 - DNA, 140 bp, Artificial Sequence
  Synthetic
atggccgactcccaagtacgtaggtacgttgttcccatccccatcctgtctgaagcattagctccaaccatgatgcataacctaatcagatcattccatgtcagttgtcccattataagaggagacccagcatggcgtat

SEQ ID NO: 371743 - DNA, 140 bp, Artificial Sequence
  Synthetic
atacgccatgctgggtctcctgcataatcacagctagcattctcctatggtatgcacagatacaaccacactggatagcagcttcaataatactggagttttttctcatagttttgctcacgtacttgggagtcggccat

SEQ ID NO: 371744 - DNA, 140 bp, Artificial Sequence
  Synthetic
atggccgactcccaagtacgtgagcaaaactatgagaaaaaactccagtattattgaagctgctatccagtgtggttgtatctgtgcataccataggagaatgctagctgtgattatgcaggagacccagcatggcgtat

SEQ ID NO: 371745 - DNA, 140 bp, Artificial Sequence
  Synthetic
atacgccatgctgggtctccttccagaaccagaaaaacagagaacaccccaagacaaccaattgacctacgttgtcatagccatcctcacagtggtggccgcaaccatggcaaacgagatcgtacttgggagtcggccat

SEQ ID NO: 371746 - DNA, 140 bp, Artificial Sequence
  Synthetic
atggccgactcccaagtacgatctcgtttgccatggttgcggccaccactgtgaggatggctatgacaacgtaggtcaattggttgtcttggggtgttctctgtttttctggttctggaaggagacccagcatggcgtat

SEQ ID NO: 371747 - DNA, 140 bp, Artificial Sequence
  Synthetic
aggccctggctgctgatatgctacggggtttcaagaaagaaatctcaaacatgttgaatataatgaatagaaggaaaagatctgtgaccatgctccttatgctgatgcctacagccttgggaccttttgggacagcggtg

SEQ ID NO: 371748 - DNA, 140 bp, Artificial Sequence
  Synthetic
caccgctgtcccaaaaggtcccaaggctgtaggcatcagcataaggagcatggtcacagatcttttccttctattcattatattcaacatgtttgagatttctttcttgaaaccccgtagcatatcagcagccagggcct

SEQ ID NO: 371749 - DNA, 140 bp, Artificial Sequence
  Synthetic
atacgccatgctgggtctccaagtaatgctcctaatcctctgcgtgactcaagtattaatgatgaggactacatgggctttgtgtgaggctctaaccctagcgaccgggcccatctccaccgtacttgggagtcggccat

SEQ ID NO: 371750 - DNA, 140 bp, Artificial Sequence
  Synthetic
atggccgactcccaagtacggtggagatgggcccggtcgctagggttagagcctcacacaaagcccatgtagtcctcatcattaatacttgagtcacgcagaggattaggagcattacttggagacccagcatggcgtat

SEQ ID NO: 371751 - DNA, 140 bp, Artificial Sequence
  Synthetic
atacgccatgctgggtctccaaagtgaatttcagatctacaagaaaagtggaatccaggaagtggatagaaccctagcaaaagaaggcatcaaaagaggagaaacggaccaccatgctgtcgtacttgggagtcggccat

SEQ ID NO: 371752 - DNA, 140 bp, Artificial Sequence
  Synthetic
atggccgactcccaagtacgacagcatggtggtccgtttctcctcttttgatgccttcttttgctagggttctatccacttcctggattccacttttcttgtagatctgaaattcactttggagacccagcatggcgtat

SEQ ID NO: 371753 - DNA, 140 bp, Artificial Sequence
  Synthetic
aggccctggctgctgatatgtggcaaaagacaaaccaacattggacattgaactcttgaagacggaagtcacaaaccctgccatcctgcgcaaactgtgcattgaagctaaaatatcaaagaccttttgggacagcggtg

SEQ ID NO: 371754 - DNA, 140 bp, Artificial Sequence
  Synthetic
caccgctgtcccaaaaggtctttgatattttagcttcaatgcacagtttgcgcaggatggcagggtttgtgacttccgtcttcaagagttcaatgtccaatgttggtttgtcttttgccacatatcagcagccagggcct

SEQ ID NO: 371755 - DNA, 140 bp, Artificial Sequence
  Synthetic
aggccctggctgctgatatgtactattgtgggggactaaagaatgtaagagaagtcaaaggcctaacaaaaggaggaccaggacacgaagaacccatccccatgtcaacatatgggtggagaccttttgggacagcggtg

SEQ ID NO: 371756 - DNA, 140 bp, Artificial Sequence
  Synthetic
caccgctgtcccaaaaggtctccacccatatgttgacatggggatgggttcttcgtgtcctggtcctccttttgttaggcctttgacttctcttacattctttagtcccccacaatagtacatatcagcagccagggcct

SEQ ID NO: 371757 - DNA, 140 bp, Artificial Sequence
  Synthetic
aggccctggctgctgatatgaagaacaagacgcgaactttgtgtgtcgacgaacgtttgtggacagaggctggggcaatggctgtgggctcttcggaaaaggaagcctaataacgtgtgcgaccttttgggacagcggtg

SEQ ID NO: 371758 - DNA, 140 bp, Artificial Sequence
  Synthetic
caccgctgtcccaaaaggtcgcacacgttattaggcttccttttccgaagagcccacagccattgccccagcctctgtccacaaacgttcgtcgacacacaaagttcgcgtcttgttcttcatatcagcagccagggcct

SEQ ID NO: 371759 - DNA, 140 bp, Artificial Sequence
  Synthetic
aggccctggctgctgatatgggacttgcaatgggtatcatgatgttaaaattgttgactgaatttcagccacaccagttatggaccaccttattgtctctgacatttgtcaaaacaactcgaccttttgggacagcggtg

SEQ ID NO: 371760 - DNA, 140 bp, Artificial Sequence
  Synthetic
caccgctgtcccaaaaggtcgagttgttttgacaaatgtcagagacaataaggtggtccataactggtgtggctgaaattcagtcaacaattttaacatcatgatacccattgcaagtcccatatcagcagccagggcct

SEQ ID NO: 371761 - DNA, 140 bp, Artificial Sequence
  Synthetic
atacgccatgctgggtctcctcagtcatagaaaaaatggaaacactacaaaggaaatatggaggagccttagtgaggaatccactctcacgaaactccacgcatgaaatgtactgggtatcgtacttgggagtcggccat

SEQ ID NO: 371762 - DNA, 140 bp, Artificial Sequence
  Synthetic
atggccgactcccaagtacgatacccagtacatttcatgcgtggagtttcgtgagagtggattcctcactaaggctcctccatatttcctttgtagtgtttccattttttctatgactgaggagacccagcatggcgtat

SEQ ID NO: 371763 - DNA, 140 bp, Artificial Sequence
  Synthetic
atacgccatgctgggtctccatgaaagaaaaatcatggctagtccacaaacaatggtttctagatctaccactgccttggacctcgggagcttcaacatcacaagagacttggaacagaccgtacttgggagtcggccat

SEQ ID NO: 371764 - DNA, 140 bp, Artificial Sequence
  Synthetic
atggccgactcccaagtacggtctgttccaagtctcttgtgatgttgaagctcccgaggtccaaggcagtggtagatctagaaaccattgtttgtggactagccatgatttttctttcatggagacccagcatggcgtat

SEQ ID NO: 371765 - DNA, 140 bp, Artificial Sequence
  Synthetic
aggccctggctgctgatatgccatggcagctatgaaacaaaacaaactggatcagcatcatctatggtgaacggagtggtcagactgctgacaaaaccttgggacgtcgttcctatggtggaccttttgggacagcggtg

SEQ ID NO: 371766 - DNA, 140 bp, Artificial Sequence
  Synthetic
caccgctgtcccaaaaggtccaccataggaacgacgtcccaaggttttgtcagcagtctgaccactccgttcaccatagatgatgctgatccagtttgttttgtttcatagctgccatggcatatcagcagccagggcct

SEQ ID NO: 371767 - DNA, 140 bp, Artificial Sequence
  Synthetic
atacgccatgctgggtctccagtcacacaccctctggagcaatggagtattagaaagtgagatgataattccaaaaaattttgccgggccagtgtcacaacacaactacagaccaggctacgtacttgggagtcggccat

SEQ ID NO: 371768 - DNA, 140 bp, Artificial Sequence
  Synthetic
atggccgactcccaagtacgtagcctggtctgtagttgtgttgtgacactggcccggcaaaattttttggaattatcatctcactttctaatactccattgctccagagggtgtgtgactggagacccagcatggcgtat

SEQ ID NO: 371769 - DNA, 140 bp, Artificial Sequence
  Synthetic
aggccctggctgctgatatgttcaggcaatgaatggataaccgacttcgctgggaaaacggtgtggtttgtccccagcattaaagccggaaatgacatagcaaactgcttgcgaaaaaacgaccttttgggacagcggtg

SEQ ID NO: 371770 - DNA, 140 bp, Artificial Sequence
  Synthetic
caccgctgtcccaaaaggtcgttttttcgcaagcagtttgctatgtcatttccggctttaatgctggggacaaaccacaccgttttcccagcgaagtcggttatccattcattgcctgaacatatcagcagccagggcct

SEQ ID NO: 371771 - DNA, 140 bp, Artificial Sequence
  Synthetic
atacgccatgctgggtctccgagacccctccctagacacaacgcagcagcggggcccaacaccaggggaagctgtaccttggtggtaaggactagaggtccacgaggagacccccccgcacgtacttgggagtcggccat

SEQ ID NO: 371772 - DNA, 140 bp, Artificial Sequence
  Synthetic
atggccgactcccaagtacgtgcgggggggtctcctcgtggacctctagtccttaccaccaaggtacagcttcccctggtgttgggccccgctgctgcgttgtgtctagggaggggtctcggagacccagcatggcgtat

SEQ ID NO: 371773 - DNA, 140 bp, Artificial Sequence
  Synthetic
aggccctggctgctgatatgatggtcattcccgaaggaagagtcatagacttgggctgtggaagaggaggctggtcatattactgtgcaggactgaaaaaagtcacagaagtgcgaggatgaccttttgggacagcggtg

SEQ ID NO: 371774 - DNA, 140 bp, Artificial Sequence
  Synthetic
caccgctgtcccaaaaggtcatcctcgcacttctgtgacttttttcagtcctgcacagtaatatgaccagcctcctcttccacagcccaagtctatgactcttccttcgggaatgaccatcatatcagcagccagggcct

SEQ ID NO: 371775 - DNA, 140 bp, Artificial Sequence
  Synthetic
aggccctggctgctgatatggctgtacgcatggcgtagtggactagcggttagaggagacccctcccttacaaatcgcagcaacaacgggggcccaaggtgagatgaagctgtagtctcagaccttttgggacagcggtg

SEQ ID NO: 371776 - DNA, 140 bp, Artificial Sequence
  Synthetic
caccgctgtcccaaaaggtctgagactacagcttcatctcaccttgggcccccgttgttgctgcgatttgtaagggaggggtctcctctaaccgctagtccactacgccatgcgtacagccatatcagcagccagggcct

SEQ ID NO: 371777 - DNA, 140 bp, Artificial Sequence
  Synthetic
atacgccatgctgggtctcctttggggatagctatatagtaataggtgtaggagacagcgcactgacacttcattggttcacgaaaggaagttccatcggcaagatgtttgagtccacatcgtacttgggagtcggccat

SEQ ID NO: 371778 - DNA, 140 bp, Artificial Sequence
  Synthetic
atggccgactcccaagtacgatgtggactcaaacatcttgccgatggaacttcctttcgtgaaccaatgaagtgtcagtgcgctgtctcctacacctattactatatagctatccccaaaggagacccagcatggcgtat

SEQ ID NO: 371779 - DNA, 140 bp, Artificial Sequence
  Synthetic
atacgccatgctgggtctccggcatgctaatagcatgttatgttatatctggaagctcagccgacctatcactagagaaagcggctgaggtctcctgggaagaagaagcagaacactctgcgtacttgggagtcggccat

SEQ ID NO: 371780 - DNA, 140 bp, Artificial Sequence
  Synthetic
atggccgactcccaagtacgcagagtgttctgcttcttcttcccaggagacctcagccgctttctctagtgataggtcggctgagcttccagatataacataacatgctattagcatgccggagacccagcatggcgtat

SEQ ID NO: 371781 - DNA, 140 bp, Artificial Sequence
  Synthetic
atacgccatgctgggtctccagttggagccattgccctagattttaaacccggcacatctggatctcccatcgtgaacagagaaggaaaaatagtaggtctttatggaaatggagtagtgcgtacttgggagtcggccat

SEQ ID NO: 371782 - DNA, 140 bp, Artificial Sequence
  Synthetic
atggccgactcccaagtacgcactactccatttccataaagacctactatttttccttctctgttcacgatgggagatccagatgtgccgggtttaaaatctagggcaatggctccaactggagacccagcatggcgtat

SEQ ID NO: 371783 - DNA, 140 bp, Artificial Sequence
  Synthetic
aggccctggctgctgatatgtgccaataaggtaccaaacaacagcagtgaagagtgaacacacaggaaaagagatagttgacctcatgtgtcacgccactttcaccatgcgcctcctgtcgaccttttgggacagcggtg

SEQ ID NO: 371784 - DNA, 140 bp, Artificial Sequence
  Synthetic
caccgctgtcccaaaaggtcgacaggaggcgcatggtgaaagtggcgtgacacatgaggtcaactatctcttttcctgtgtgttcactcttcactgctgttgtttggtaccttattggcacatatcagcagccagggcct

SEQ ID NO: 371785 - DNA, 140 bp, Artificial Sequence
  Synthetic
aggccctggctgctgatatgccacagagttccaccacagaagcagaactgacaggctatggcactgtcacgatggagtgctctccgagaacgggcctcgacttcaatgagatggtgctgcgaccttttgggacagcggtg

SEQ ID NO: 371786 - DNA, 140 bp, Artificial Sequence
  Synthetic
caccgctgtcccaaaaggtcgcagcaccatctcattgaagtcgaggcccgttctcggagagcactccatcgtgacagtgccatagcctgtcagttctgcttctgtggtggaactctgtggcatatcagcagccagggcct

SEQ ID NO: 371787 - DNA, 140 bp, Artificial Sequence
  Synthetic
aggccctggctgctgatatgagaggactgttggggaggtcccaagtaggagtgggagtcttccaagacggcgtgttccacacaatgtggcacgttaccaggggagctgtccttatgtaccgaccttttgggacagcggtg

SEQ ID NO: 371788 - DNA, 140 bp, Artificial Sequence
  Synthetic
caccgctgtcccaaaaggtcggtacataaggacagctcccctggtaacgtgccacattgtgtggaacacgccgtcttggaagactcccactcctacttgggacctccccaacagtcctctcatatcagcagccagggcct

SEQ ID NO: 371789 - DNA, 140 bp, Artificial Sequence
  Synthetic
atacgccatgctgggtctccactcattaggcaaaatggtgcaccaaatattcggaagtgcttacacagccctattcagtggagtctcttgggtaatgaaaattggaataggagttctcttcgtacttgggagtcggccat

SEQ ID NO: 371790 - DNA, 140 bp, Artificial Sequence
  Synthetic
atggccgactcccaagtacgaagagaactcctattccaattttcattacccaagagactccactgaatagggctgtgtaagcacttccgaatatttggtgcaccattttgcctaatgagtggagacccagcatggcgtat

SEQ ID NO: 371791 - DNA, 140 bp, Artificial Sequence
  Synthetic
aggccctggctgctgatatgaggacagcggccggaataatgaaaaatccaaccgttgatgggattgttgcaatagatttggaccctgtggtttatgatgcaaaatttgagaaacaactaggaccttttgggacagcggtg

SEQ ID NO: 371792 - DNA, 140 bp, Artificial Sequence
  Synthetic
caccgctgtcccaaaaggtcctagttgtttctcaaattttgcatcataaaccacagggtccaaatctattgcaacaatcccatcaacggttggatttttcattattccggccgctgtcctcatatcagcagccagggcct

SEQ ID NO: 371793 - DNA, 140 bp, Artificial Sequence
  Synthetic
aggccctggctgctgatatgaatggagtgtgcggaattaggtcaacaaccagaatggagaatctcctgtggaagcaaatagccaatgaactgaactacatattatgggaaaacaatatcagaccttttgggacagcggtg

SEQ ID NO: 371794 - DNA, 140 bp, Artificial Sequence
  Synthetic
caccgctgtcccaaaaggtctgatattgttttcccataatatgtagttcagttcattggctatttgcttccacaggagattctccattctggttgttgacctaattccgcacactccattcatatcagcagccagggcct

SEQ ID NO: 371795 - DNA, 140 bp, Artificial Sequence
  Synthetic
atacgccatgctgggtctccatcaggaagcagcccaattctgtcaataacaatatcagaagatggcagcatgtcgataaaaaatgaagaggaagaacaaacactgaccatactcattagacgtacttgggagtcggccat

SEQ ID NO: 371796 - DNA, 140 bp, Artificial Sequence
  Synthetic
atggccgactcccaagtacgtctaatgagtatggtcagtgtttgttcttcctcttcattttttatcgacatgctgccatcttctgatattgttattgacagaattgggctgcttcctgatggagacccagcatggcgtat

SEQ ID NO: 371797 - DNA, 140 bp, Artificial Sequence
  Synthetic
aggccctggctgctgatatgggagcctatagaatcaagcaaagagggattcttggatattctcagattggagccggagtttacaaagaaggaacattccatacaatgtggcacgtcacacgaccttttgggacagcggtg

SEQ ID NO: 371798 - DNA, 140 bp, Artificial Sequence
  Synthetic
caccgctgtcccaaaaggtcgtgtgacgtgccacattgtatggaatgttccttctttgtaaactccggctccaatctgagaatatccaagaatccctctttgcttgattctataggctcccatatcagcagccagggcct

SEQ ID NO: 371799 - DNA, 140 bp, Artificial Sequence
  Synthetic
atacgccatgctgggtctcccctaccaaaataaggtggtaagggtacagagaccagcaaaaaatggaaccgtgatggatgtcatatccagacgtgaccagagaggaagtggccaggtcggcgtacttgggagtcggccat

SEQ ID NO: 371800 - DNA, 140 bp, Artificial Sequence
  Synthetic
atggccgactcccaagtacgccgacctggccacttcctctctggtcacgtctggatatgacatccatcacggttccattttttgctggtctctgtacccttaccaccttattttggtaggggagacccagcatggcgtat

SEQ ID NO: 371801 - DNA, 140 bp, Artificial Sequence
  Synthetic
atacgccatgctgggtctccaccctgaacctaatcacagaaatgggtaggcttccaactttcatgactcagaaggcaagaaacgcactggacaacttggctgtgctgcatacggctgaggcgtacttgggagtcggccat

SEQ ID NO: 371802 - DNA, 140 bp, Artificial Sequence
  Synthetic
atggccgactcccaagtacgcctcagccgtatgcagcacagccaagttgtccagtgcgtttcttgccttctgagtcatgaaagttggaagcctacccatttctgtgattaggttcagggtggagacccagcatggcgtat

SEQ ID NO: 371803 - DNA, 140 bp, Artificial Sequence
  Synthetic
atacgccatgctgggtctcctacaaaataaaggaaaataagaaatcaaacaaggcaagaagtcaggccggattaagccatagtacggtaagagctatgctgcctgtgagccccgtctaagcgtacttgggagtcggccat

SEQ ID NO: 371804 - DNA, 140 bp, Artificial Sequence
  Synthetic
atggccgactcccaagtacgcttagacggggctcacaggcagcatagctcttaccgtactatggcttaatccggcctgacttcttgccttgtttgatttcttattttcctttattttgtaggagacccagcatggcgtat

SEQ ID NO: 371805 - DNA, 140 bp, Artificial Sequence
  Synthetic
atacgccatgctgggtctcctggaccgacaagaacagtttcgaattggaagcttgcttaacgtagttctaacagttttttattagagagcagatctctgatgaacaaccaacggaaaaagcgtacttgggagtcggccat

SEQ ID NO: 371806 - DNA, 140 bp, Artificial Sequence
  Synthetic
atggccgactcccaagtacgctttttccgttggttgttcatcagagatctgctctctaataaaaaactgttagaactacgttaagcaagcttccaattcgaaactgttcttgtcggtccaggagacccagcatggcgtat

SEQ ID NO: 371807 - DNA, 140 bp, Artificial Sequence
  Synthetic
aggccctggctgctgatatgacagttttttattagagagcagatctctgatgaacaaccaacggaaaaagacgggtcgaccgtctttcaatatgctgaaacgcgcgagaaaccgcgtgtcgaccttttgggacagcggtg

SEQ ID NO: 371808 - DNA, 140 bp, Artificial Sequence
  Synthetic
caccgctgtcccaaaaggtcgacacgcggtttctcgcgcgtttcagcatattgaaagacggtcgacccgtctttttccgttggttgttcatcagagatctgctctctaataaaaaactgtcatatcagcagccagggcct

SEQ ID NO: 371809 - DNA, 140 bp, Artificial Sequence
  Synthetic
atacgccatgctgggtctccaacccaggaatctgagagcaacatcctggacatagatctacgtcctgcatcagcatggacgctgtatgccgtggctacaacatttgtcacaccaatgttgcgtacttgggagtcggccat

SEQ ID NO: 371810 - DNA, 140 bp, Artificial Sequence
  Synthetic
atggccgactcccaagtacgcaacattggtgtgacaaatgttgtagccacggcatacagcgtccatgctgatgcaggacgtagatctatgtccaggatgttgctctcagattcctgggttggagacccagcatggcgtat

SEQ ID NO: 371811 - DNA, 140 bp, Artificial Sequence
  Synthetic
atacgccatgctgggtctcctagagggagctatttagcaggagctgggcttgctttttccatcatgaaatcagttggaacaggaaagagaggaacagggtctcaaggtgaaactttgggacgtacttgggagtcggccat

SEQ ID NO: 371812 - DNA, 140 bp, Artificial Sequence
  Synthetic
atggccgactcccaagtacgtcccaaagtttcaccttgagaccctgttcctctctttcctgttccaactgatttcatgatggaaaaagcaagcccagctcctgctaaatagctccctctaggagacccagcatggcgtat

SEQ ID NO: 371813 - DNA, 140 bp, Artificial Sequence
  Synthetic
aggccctggctgctgatatgtgcaaagaaacaggaagtagtcgtactgggatcacaggaaggagcaatgcacactgcgttgactggggcgacagaaatccagacgtcaggaacgacaacagaccttttgggacagcggtg

SEQ ID NO: 371814 - DNA, 140 bp, Artificial Sequence
  Synthetic
caccgctgtcccaaaaggtctgttgtcgttcctgacgtctggatttctgtcgccccagtcaacgcagtgtgcattgctccttcctgtgatcccagtacgactacttcctgtttctttgcacatatcagcagccagggcct

SEQ ID NO: 371815 - DNA, 140 bp, Artificial Sequence
  Synthetic
aggccctggctgctgatatggacatgaaattcacagtggttgtaggagatgctaatggaattttggcccaaggaaaaaaaatgattaggccacaacccatggaacacaaatactcatggagaccttttgggacagcggtg

SEQ ID NO: 371816 - DNA, 140 bp, Artificial Sequence
  Synthetic
caccgctgtcccaaaaggtctccatgagtatttgtgttccatgggttgtggcctaatcattttttttccttgggccaaaattccattagcatctcctacaaccactgtgaatttcatgtccatatcagcagccagggcct

SEQ ID NO: 371817 - DNA, 140 bp, Artificial Sequence
  Synthetic
atacgccatgctgggtctcctgacagatttgcaagtgctttaacagctctaaatgacatgggaaaagttaggaaagatatacaacaatgggaaccttcaagaggatggaacgattggacacgtacttgggagtcggccat

SEQ ID NO: 371818 - DNA, 140 bp, Artificial Sequence
  Synthetic
atggccgactcccaagtacgtgtccaatcgttccatcctcttgaaggttcccattgttgtatatctttcctaacttttcccatgtcatttagagctgttaaagcacttgcaaatctgtcaggagacccagcatggcgtat

SEQ ID NO: 371819 - DNA, 140 bp, Artificial Sequence
  Synthetic
aggccctggctgctgatatgagcagggctacctgggcaaagaatatccagacagcaataaatcaagtcagatcccttataggcaatgagggatacacagactacatgccatccatgaagagaccttttgggacagcggtg

SEQ ID NO: 371820 - DNA, 140 bp, Artificial Sequence
  Synthetic
caccgctgtcccaaaaggtctcttcatggatggcatgtagtctgtgtatccctcattgcctataagggatctgacttgatttattgctgtctggatattctttgcccaggtagccctgctcatatcagcagccagggcct

SEQ ID NO: 371821 - DNA, 140 bp, Artificial Sequence
  Synthetic
aggccctggctgctgatatgatcccttataggcaatgagggatacacagactacatgccatccatgaagagattcagaagggaagaggaagaggcaggtgtcctgtggtagaaggcgagagaccttttgggacagcggtg

SEQ ID NO: 371822 - DNA, 140 bp, Artificial Sequence
  Synthetic
caccgctgtcccaaaaggtctctcgccttctaccacaggacacctgcctcttcctcttcccttctgaatctcttcatggatggcatgtagtctgtgtatccctcattgcctataagggatcatatcagcagccagggcct

SEQ ID NO: 371823 - DNA, 140 bp, Artificial Sequence
  Synthetic
aggccctggctgctgatatgcttcagacaggatggggatgggaacaacgtacctagccttgatggctactttcaaaatgagaccaatgttcgctgttgggttattatttcgcagactaacgaccttttgggacagcggtg

SEQ ID NO: 371824 - DNA, 140 bp, Artificial Sequence
  Synthetic
caccgctgtcccaaaaggtcgttagtctgcgaaataataacccaacagcgaacattggtctcattttgaaagtagccatcaaggctaggtacgttgttcccatccccatcctgtctgaagcatatcagcagccagggcct

SEQ ID NO: 371825 - DNA, 140 bp, Artificial Sequence
  Synthetic
aggccctggctgctgatatgtctttatgctgattccaacagtgatggcgttccatttaaccacacgtaacggagaaccacacatgatcgtcagtagacaagagaaagggaaaagtcttctgaccttttgggacagcggtg

SEQ ID NO: 371826 - DNA, 140 bp, Artificial Sequence
  Synthetic
caccgctgtcccaaaaggtcagaagacttttccctttctcttgtctactgacgatcatgtgtggttctccgttacgtgtggttaaatggaacgccatcactgttggaatcagcataaagacatatcagcagccagggcct

SEQ ID NO: 371827 - DNA, 140 bp, Artificial Sequence
  Synthetic
aggccctggctgctgatatggtcttccgctgtcatccattcatgtttggcgtgtatggaccaggttgttctacttgttggaacccaatgtgatgggactgccgagcaaatagcattagccgaccttttgggacagcggtg

SEQ ID NO: 371828 - DNA, 140 bp, Artificial Sequence
  Synthetic
caccgctgtcccaaaaggtcggctaatgctatttgctcggcagtcccatcacattgggttccaacaagtagaacaacctggtccatacacgccaaacatgaatggatgacagcggaagaccatatcagcagccagggcct

SEQ ID NO: 371829 - DNA, 140 bp, Artificial Sequence
  Synthetic
atacgccatgctgggtctccggcacatctggatctcccatcgtgaacagagagggaaaaatagtaggtctttatggaaatggagtggtgacaacaagtggaacctacgtcagtgccattgcgtacttgggagtcggccat

SEQ ID NO: 371830 - DNA, 140 bp, Artificial Sequence
  Synthetic
atggccgactcccaagtacgcaatggcactgacgtaggttccacttgttgtcaccactccatttccataaagacctactatttttccctctctgttcacgatgggagatccagatgtgccggagacccagcatggcgtat

SEQ ID NO: 371831 - DNA, 140 bp, Artificial Sequence
  Synthetic
atacgccatgctgggtctcctggaccgacaagaacagtttcgactcggaaagcttgcttaacgtagtgctaacagttttttattagagagcagatctctgatgaacaaccaacggaagaacgtacttgggagtcggccat

SEQ ID NO: 371832 - DNA, 140 bp, Artificial Sequence
  Synthetic
atggccgactcccaagtacgttcttccgttggttgttcatcagagatctgctctctaataaaaaactgttagcactacgttaagcaagctttccgagtcgaaactgttcttgtcggtccaggagacccagcatggcgtat

SEQ ID NO: 371833 - DNA, 140 bp, Artificial Sequence
  Synthetic
atacgccatgctgggtctcctggaccgacaagaaacagtttcgactcggaagcttgcttaacgtagtgctaacagtttttattagagagcagatctctgatgaacaaccaacggaagaagcgtacttgggagtcggccat

SEQ ID NO: 371834 - DNA, 140 bp, Artificial Sequence
  Synthetic
atggccgactcccaagtacgcttcttccgttggttgttcatcagagatctgctctctaataaaaactgttagcactacgttaagcaagcttccgagtcgaaactgtttcttgtcggtccaggagacccagcatggcgtat

SEQ ID NO: 371835 - DNA, 140 bp, Artificial Sequence
  Synthetic
aggccctggctgctgatatgagagtgcagcaatagacggggagtacagactgcggggagaagcaaggaaaacgttcgtggagctcatgagaagaggagatctaccagtttggctgtcctagaccttttgggacagcggtg

SEQ ID NO: 371836 - DNA, 140 bp, Artificial Sequence
  Synthetic
caccgctgtcccaaaaggtctaggacagccaaactggtagatctcctcttctcatgagctccacgaacgttttccttgcttctccccgcagtctgtactccccgtctattgctgcactctcatatcagcagccagggcct

SEQ ID NO: 371837 - DNA, 140 bp, Artificial Sequence
  Synthetic
aggccctggctgctgatatgatggggaaaggaacaaccaggtgttggaggagaacatggacgtggagatctggacaaaggaaggagaaagaaagaaattgcgaccccgctggttggatgcgaccttttgggacagcggtg

SEQ ID NO: 371838 - DNA, 140 bp, Artificial Sequence
  Synthetic
caccgctgtcccaaaaggtcgcatccaaccagcggggtcgcaatttctttctttctccttcctttgtccagatctccacgtccatgttctcctccaacacctggttgttcctttccccatcatatcagcagccagggcct

SEQ ID NO: 371839 - DNA, 140 bp, Artificial Sequence
  Synthetic
atacgccatgctgggtctccacggtagttgtgggcgacacaatcggggttttagagcaaggaaaaagaacactaacaccacaacccatggagctaaaatactcatggaaaacgtggggaacgtacttgggagtcggccat

SEQ ID NO: 371840 - DNA, 140 bp, Artificial Sequence
  Synthetic
atggccgactcccaagtacgttccccacgttttccatgagtattttagctccatgggttgtggtgttagtgttctttttccttgctctaaaaccccgattgtgtcgcccacaactaccgtggagacccagcatggcgtat

SEQ ID NO: 371841 - DNA, 140 bp, Artificial Sequence
  Synthetic
atacgccatgctgggtctccggatacatactcagagacatatcaaagattccagggggaaatatgtatgcagatgatacagccggatgggacacaagaataacagaggatgatcttcagacgtacttgggagtcggccat

SEQ ID NO: 371842 - DNA, 140 bp, Artificial Sequence
  Synthetic
atggccgactcccaagtacgtctgaagatcatcctctgttattcttgtgtcccatccggctgtatcatctgcatacatatttccccctggaatctttgatatgtctctgagtatgtatccggagacccagcatggcgtat

SEQ ID NO: 371843 - DNA, 140 bp, Artificial Sequence
  Synthetic
atacgccatgctgggtctccagtcacacactctctggagcaatggagtgctagaaagtgagatgataattccaaagaattttgcaggaccagtgtcacaacacaattacagaccaggctacgtacttgggagtcggccat

SEQ ID NO: 371844 - DNA, 140 bp, Artificial Sequence
  Synthetic
atggccgactcccaagtacgtagcctggtctgtaattgtgttgtgacactggtcctgcaaaattctttggaattatcatctcactttctagcactccattgctccagagagtgtgtgactggagacccagcatggcgtat

SEQ ID NO: 371845 - DNA, 140 bp, Artificial Sequence
  Synthetic
aggccctggctgctgatatgcagtggcagccaatgagatgggattattggaaaccacaaagaaagacctggggattggccatgtagccgccgaaaaccaccaacatgctacaatgctggagaccttttgggacagcggtg

SEQ ID NO: 371846 - DNA, 140 bp, Artificial Sequence
  Synthetic
caccgctgtcccaaaaggtctccagcattgtagcatgttggtggttttcggcggctacatggccaatccccaggtctttctttgtggtttccaataatcccatctcattggctgccactgcatatcagcagccagggcct

SEQ ID NO: 371847 - DNA, 140 bp, Artificial Sequence
  Synthetic
atacgccatgctgggtctccatttccctgacagccattgcaaatcaggcagctatattgatgggacttgacaagggatggccaatatcgaagatggacataggagttccacttctcgcctcgtacttgggagtcggccat

SEQ ID NO: 371848 - DNA, 140 bp, Artificial Sequence
  Synthetic
atggccgactcccaagtacgaggcgagaagtggaactcctatgtccatcttcgatattggccatcccttgtcaagtcccatcaatatagctgcctgatttgcaatggctgtcagggaaatggagacccagcatggcgtat

SEQ ID NO: 371849 - DNA, 140 bp, Artificial Sequence
  Synthetic
aggccctggctgctgatatgagcttgagatggactttgatttctgcgaaggaactacagtggtggtgactgaggactgtggaaatagaggaccctctttaagaacgaccactgcctctgggaccttttgggacagcggtg

SEQ ID NO: 371850 - DNA, 140 bp, Artificial Sequence
  Synthetic
caccgctgtcccaaaaggtcccagaggcagtggtcgttcttaaagagggtcctctatttccacagtcctcagtcaccaccactgtagttccttcgcagaaatcaaagtccatctcaagctcatatcagcagccagggcct

SEQ ID NO: 371851 - DNA, 140 bp, Artificial Sequence
  Synthetic
atacgccatgctgggtctcccagagattgaggacgaggtgtttaggaaaagaaacttaacaataatggacctacatccagggtcaggaaaaacaagaagataccttccggccatagtccgcgtacttgggagtcggccat

SEQ ID NO: 371852 - DNA, 140 bp, Artificial Sequence
  Synthetic
atggccgactcccaagtacgcggactatggccggaaggtatcttcttgtttttcctgaccctggatgtaggtccattattgttaagtttcttttcctaaacacctcgtcctcaatctctgggagacccagcatggcgtat

SEQ ID NO: 371853 - DNA, 140 bp, Artificial Sequence
  Synthetic
atacgccatgctgggtctccgtccactgggtccccacaagtagaacgacatggtctattcatgctcaccatcagtggatgactacagaagacatgcttactgtctggaacagggtgtggacgtacttgggagtcggccat

SEQ ID NO: 371854 - DNA, 140 bp, Artificial Sequence
  Synthetic
atggccgactcccaagtacgtccacaccctgttccagacagtaagcatgtcttctgtagtcatccactgatggtgagcatgaatagaccatgtcgttctacttgtggggacccagtggacggagacccagcatggcgtat

SEQ ID NO: 371855 - DNA, 140 bp, Artificial Sequence
  Synthetic
aggccctggctgctgatatgtcagtggatgactacagaagacatgcttactgtctggaacagggtgtggatcgaggacaatccatggatggaagacaaaactccagtcacaacctgggaagaccttttgggacagcggtg

SEQ ID NO: 371856 - DNA, 140 bp, Artificial Sequence
  Synthetic
caccgctgtcccaaaaggtcttcccaggttgtgactggagttttgtcttccatccatggattgtcctcgatccacaccctgttccagacagtaagcatgtcttctgtagtcatccactgacatatcagcagccagggcct

SEQ ID NO: 371857 - DNA, 140 bp, Artificial Sequence
  Synthetic
aggccctggctgctgatatgcccaccaccaatggatgacaacagaagacatgttatcagtgtggaatagggtttggatagaggaaaacccatggatggaggacaaaactcatgtatccaggaccttttgggacagcggtg

SEQ ID NO: 371858 - DNA, 140 bp, Artificial Sequence
  Synthetic
caccgctgtcccaaaaggtcctggatacatgagttttgtcctccatccatgggttttcctctatccaaaccctattccacactgataacatgtcttctgttgtcatccattggtggtgggcatatcagcagccagggcct

SEQ ID NO: 371859 - DNA, 140 bp, Artificial Sequence
  Synthetic
aggccctggctgctgatatggcagactagcggttagaggagacccctcccatgacacaacgcagcagcggggcccgagcactgagggaagctgtacctccctgcaaactggactgccaaggaccttttgggacagcggtg

SEQ ID NO: 371860 - DNA, 140 bp, Artificial Sequence
  Synthetic
caccgctgtcccaaaaggtccttggcagtccagtttgcagggaggtacagcttccctcagtgctcgggccccgctgctgcgttgtgtcatgggaggggtctcctctaaccgctagtctgccatatcagcagccagggcct

SEQ ID NO: 371861 - DNA, 140 bp, Artificial Sequence
  Synthetic
aggccctggctgctgatatgtgctgcctgtgagccccgtccaaggacgtaaaatgaagtcaggccgaaagccacggattgagcaagccgtgctgcctgtggctccatcgtggggatgtaagaccttttgggacagcggtg

SEQ ID NO: 371862 - DNA, 140 bp, Artificial Sequence
  Synthetic
caccgctgtcccaaaaggtcttacatccccacgatggagccacaggcagcacggcttgctcaatccgtggctttcggcctgacttcattttacgtccttggacggggctcacaggcagcacatatcagcagccagggcct

SEQ ID NO: 371863 - DNA, 140 bp, Artificial Sequence
  Synthetic
atacgccatgctgggtctccaagatagttcaatatgaaaacttaaaatattcagtgatagtcactgtccacactggggaccagcaccaggtgggaaacgagactacagaacatggaacaacgtacttgggagtcggccat

SEQ ID NO: 371864 - DNA, 140 bp, Artificial Sequence
  Synthetic
atggccgactcccaagtacgttgttccatgttctgtagtctcgtttcccacctggtgctggtccccagtgtggacagtgactatcactgaatattttaagttttcatattgaactatcttggagacccagcatggcgtat

SEQ ID NO: 371865 - DNA, 140 bp, Artificial Sequence
  Synthetic
aggccctggctgctgatatgatagggccaggacttcaagcaaaagcaaccagagaagctcagaaaagagcagcagcaggcatcatgaaaaacccaacagtcgatggaataacagtgattggaccttttgggacagcggtg

SEQ ID NO: 371866 - DNA, 140 bp, Artificial Sequence
  Synthetic
caccgctgtcccaaaaggtccaatcactgttattccatcgactgttgggtttttcatgatgcctgctgctgctcttttctgagcttctctggttgcttttgcttgaagtcctggccctatcatatcagcagccagggcct

SEQ ID NO: 371867 - DNA, 140 bp, Artificial Sequence
  Synthetic
atacgccatgctgggtctcctaatgaaaaatccaaccgtagacgggattgttgcaatagacttggatcctgtggtttatgatgcaaaatttgaaaaacagctaggccaaataatgttactcgtacttgggagtcggccat

SEQ ID NO: 371868 - DNA, 140 bp, Artificial Sequence
  Synthetic
atggccgactcccaagtacgagtaacattatttggcctagctgtttttcaaattttgcatcataaaccacaggatccaagtctattgcaacaatcccgtctacggttggatttttcattaggagacccagcatggcgtat

SEQ ID NO: 371869 - DNA, 140 bp, Artificial Sequence
  Synthetic
aggccctggctgctgatatggccataaaccaagtgagaaggctcatcgggaatgagaattatctagattacatgacatcaatgaagagattcaagaatgagagtgatcccgaaggggcacgaccttttgggacagcggtg

SEQ ID NO: 371870 - DNA, 140 bp, Artificial Sequence
  Synthetic
caccgctgtcccaaaaggtcgtgccccttcgggatcactctcattcttgaatctcttcattgatgtcatgtaatctagataattctcattcccgatgagccttctcacttggtttatggccatatcagcagccagggcct

SEQ ID NO: 371871 - DNA, 140 bp, Artificial Sequence
  Synthetic
aggccctggctgctgatatggagaattgacacttgactgtgaacctaggtccggaattgactttaatgagatgatcctgatgaaaatgaaaacgaaaacgtggctcgtgcacaagctatggaccttttgggacagcggtg

SEQ ID NO: 371872 - DNA, 140 bp, Artificial Sequence
  Synthetic
caccgctgtcccaaaaggtccatagcttgtgcacgagccacgttttcgttttcattttcatcaggatcatctcattaaagtcaattccggacctaggttcacagtcaagtgtcaattctccatatcagcagccagggcct

SEQ ID NO: 371873 - DNA, 140 bp, Artificial Sequence
  Synthetic
aggccctggctgctgatatgattagagagcagatctctgatgaacaaccaacgaaaaaagacgggtcgaccgtctttcaatatgctgaaacgcgcgagaaaccgcgtgtcaactggttcagaccttttgggacagcggtg

SEQ ID NO: 371874 - DNA, 140 bp, Artificial Sequence
  Synthetic
caccgctgtcccaaaaggtctgaaccagttgacacgcggtttctcgcgcgtttcagcatattgaaagacggtcgacccgtcttttttcgttggttgttcatcagagatctgctctctaatcatatcagcagccagggcct

SEQ ID NO: 371875 - DNA, 140 bp, Artificial Sequence
  Synthetic
aggccctggctgctgatatgaactaccagacaccatagaaacattgatgcttctagctttgatagctgtgttgactggtggagtgacgctgttcttcctatcaggaaaaggtctagggaagaccttttgggacagcggtg

SEQ ID NO: 371876 - DNA, 140 bp, Artificial Sequence
  Synthetic
caccgctgtcccaaaaggtcttccctagaccttttcctgataggaagaacagcgtcactccaccagtcaacacagctatcaaagctagaagcatcaatgtttctatggtgtctggtagttcatatcagcagccagggcct

SEQ ID NO: 371877 - DNA, 140 bp, Artificial Sequence
  Synthetic
atacgccatgctgggtctcccggaagacatgctggcagtctggaacagggtgtggatccaagaaaacccatggatggaagacaaaactccagtggaatcatgggaagaagtcccatacctcgtacttgggagtcggccat

SEQ ID NO: 371878 - DNA, 140 bp, Artificial Sequence
  Synthetic
atggccgactcccaagtacgaggtatgggacttcttcccatgattccactggagttttgtcttccatccatgggttttcttggatccacaccctgttccagactgccagcatgtcttccgggagacccagcatggcgtat

SEQ ID NO: 371879 - DNA, 140 bp, Artificial Sequence
  Synthetic
aggccctggctgctgatatgcgtagacctacgtccagcttcagcctggaccctctatgcagtagccacaacagttatcactcccatgatgagacacacaattgaaaatacaacggcaaacgaccttttgggacagcggtg

SEQ ID NO: 371880 - DNA, 140 bp, Artificial Sequence
  Synthetic
caccgctgtcccaaaaggtcgtttgccgttgtattttcaattgtgtgtctcatcatgggagtgataactgttgtggctactgcatagagggtccaggctgaagctggacgtaggtctacgcatatcagcagccagggcct

SEQ ID NO: 371881 - DNA, 140 bp, Artificial Sequence
  Synthetic
atacgccatgctgggtctccgccaaactgaggtggtttgtggagaggaacctcgtgaaaccagaagggaaagtcatagacctcggttgtggaagaggtggctggtcatattattgtgctgcgtacttgggagtcggccat

SEQ ID NO: 371882 - DNA, 140 bp, Artificial Sequence
  Synthetic
atggccgactcccaagtacgcagcacaataatatgaccagccacctcttccacaaccgaggtctatgactttcccttctggtttcacgaggttcctctccacaaaccacctcagtttggcggagacccagcatggcgtat

SEQ ID NO: 371883 - DNA, 140 bp, Artificial Sequence
  Synthetic
aggccctggctgctgatatgcattcggagacagctacatcattataggagtagaaccgggacaactgaagctcagctggtttaagaaaggaagctcaatcggccaaatgttcgagacaacgaccttttgggacagcggtg

SEQ ID NO: 371884 - DNA, 140 bp, Artificial Sequence
  Synthetic
caccgctgtcccaaaaggtcgttgtctcgaacatttggccgattgagcttcctttcttaaaccagctgagcttcagttgtcccggttctactcctataatgatgtagctgtctccgaatgcatatcagcagccagggcct

SEQ ID NO: 371885 - DNA, 140 bp, Artificial Sequence
  Synthetic
atacgccatgctgggtctccatgaagagcaggacaaaaggttcatctgcaaacactccatggtggacagaggatggggaaatggatgtggattatttggaaagggaggcattgtgacctgcgtacttgggagtcggccat

SEQ ID NO: 371886 - DNA, 140 bp, Artificial Sequence
  Synthetic
atggccgactcccaagtacgcaggtcacaatgcctccctttccaaataatccacatccatttccccatcctctgtccaccatggagtgtttgcagatgaaccttttgtcctgctcttcatggagacccagcatggcgtat

SEQ ID NO: 371887 - DNA, 140 bp, Artificial Sequence
  Synthetic
aggccctggctgctgatatgcataggaacatccatcactcagaaagggatcattttcattttgctgatgctggtgacaccatcaatggccatgcgatgcgtgggaataggcaacagagacgaccttttgggacagcggtg

SEQ ID NO: 371888 - DNA, 140 bp, Artificial Sequence
  Synthetic
caccgctgtcccaaaaggtcgtctctgttgcctattcccacgcatcgcatggccattgatggtgtcaccagcatcagcaaaatgaaaatgatccctttctgagtgatggatgttcctatgcatatcagcagccagggcct

SEQ ID NO: 371889 - DNA, 140 bp, Artificial Sequence
  Synthetic
atacgccatgctgggtctcctaaggaaactgaaccaacaaaacagtttcgactcggaagcttgcttaacgtagtgctaacagttttttattagagagcagatctctgatgaacaaccaaccgtacttgggagtcggccat

SEQ ID NO: 371890 - DNA, 140 bp, Artificial Sequence
  Synthetic
atggccgactcccaagtacggttggttgttcatcagagatctgctctctaataaaaaactgttagcactacgttaagcaagcttccgagtcgaaactgttttgttggttcagtttccttaggagacccagcatggcgtat

SEQ ID NO: 371891 - DNA, 140 bp, Artificial Sequence
  Synthetic
atacgccatgctgggtctccagcaacaacgggggcccaaggtgagatgaagctgtagtctcactggaaggactagaggttagaggagacccccccaaaacaaaaaacagcatattgacgccgtacttgggagtcggccat

SEQ ID NO: 371892 - DNA, 140 bp, Artificial Sequence
  Synthetic
atggccgactcccaagtacggcgtcaatatgctgttttttgttttgggggggtctcctctaacctctagtccttccagtgagactacagcttcatctcaccttgggcccccgttgttgctggagacccagcatggcgtat

SEQ ID NO: 371893 - DNA, 140 bp, Artificial Sequence
  Synthetic
aggccctggctgctgatatgataaccaacgaaaaaaggcgagaaatacgcctttcaatatgctgaaacgcgagagaaaccgcgtgtcaactgtgcaacagctgacaaagagattctcactgaccttttgggacagcggtg

SEQ ID NO: 371894 - DNA, 140 bp, Artificial Sequence
  Synthetic
caccgctgtcccaaaaggtcagtgagaatctctttgtcagctgttgcacagttgacacgcggtttctctcgcgtttcagcatattgaaaggcgtatttctcgccttttttcgttggttatcatatcagcagccagggcct

SEQ ID NO: 371895 - DNA, 140 bp, Artificial Sequence
  Synthetic
aggccctggctgctgatatgttcatcttactgacagctgtcgctccttcaatgacaatgcgctgtattggaatatcaaatagagactttgtggaaggggtttcaggaggaagctgggttggaccttttgggacagcggtg

SEQ ID NO: 371896 - DNA, 140 bp, Artificial Sequence
  Synthetic
caccgctgtcccaaaaggtccaacccagcttcctcctgaaaccccttccacaaagtctctatttgatattccaatacagcgcattgtcattgaaggagcgacagctgtcagtaagatgaacatatcagcagccagggcct

SEQ ID NO: 371897 - DNA, 140 bp, Artificial Sequence
  Synthetic
aggccctggctgctgatatggcaaacccaaagatccggcgttctatgggacgtacccagccccccagagacacagaaagcagaactggaagaaggggtctataggatcaaacagcaaggagaccttttgggacagcggtg

SEQ ID NO: 371898 - DNA, 140 bp, Artificial Sequence
  Synthetic
caccgctgtcccaaaaggtctccttgctgtttgatcctatagaccccttcttccagttctgctttctgtgtctctggggggctgggtacgtcccatagaacgccggatctttgggtttgccatatcagcagccagggcct

SEQ ID NO: 371899 - DNA, 140 bp, Artificial Sequence
  Synthetic
aggccctggctgctgatatgtctaaggaagtactgtatagaggcaaagctgaccaacacaacaacagcatctcgatgcccaacacaaggggaacccagcctaaatgaagaacaggacaaagaccttttgggacagcggtg

SEQ ID NO: 371900 - DNA, 140 bp, Artificial Sequence
  Synthetic
caccgctgtcccaaaaggtctttgtcctgttcttcatttaggctgggttccccttgtgttgggcatcgagatgctgttgttgtgttggtcagctttgcctctatacagtacttccttagacatatcagcagccagggcct

SEQ ID NO: 371901 - DNA, 140 bp, Artificial Sequence
  Synthetic
aggccctggctgctgatatgaggtttgtctgcaaacattccatggtagacagaggatggggaaatggatgtggattatttggaaagggaggcattgtgacctgtgctatgttcacatgcagaccttttgggacagcggtg

SEQ ID NO: 371902 - DNA, 140 bp, Artificial Sequence
  Synthetic
caccgctgtcccaaaaggtctgcatgtgaacatagcacaggtcacaatgcctccctttccaaataatccacatccatttccccatcctctgtctaccatggaatgtttgcagacaaacctcatatcagcagccagggcct

SEQ ID NO: 371903 - DNA, 140 bp, Artificial Sequence
  Synthetic
aggccctggctgctgatatgtagcagactagcggttagaggagacccctccatgacacaacgcagcagcggggcccgagcactgagggaagctgtacctccctgcctgagactaccaagggaccttttgggacagcggtg

SEQ ID NO: 371904 - DNA, 140 bp, Artificial Sequence
  Synthetic
caccgctgtcccaaaaggtcccttggtagtctcaggcagggaggtacagcttccctcagtgctcgggccccgctgctgcgttgtgtcatggaggggtctcctctaaccgctagtctgctacatatcagcagccagggcct

SEQ ID NO: 371905 - DNA, 140 bp, Artificial Sequence
  Synthetic
atacgccatgctgggtctcccaaagaactgaaatgtggcagtgggattttcatcacagacaatgtacacacatggacagaacaatacaaattccaaccagaatccccctcaaagctggctcgtacttgggagtcggccat

SEQ ID NO: 371906 - DNA, 140 bp, Artificial Sequence
  Synthetic
atggccgactcccaagtacgagccagctttgagggggattctggttggaatttgtattgttctgtccatgtgtgtacattgtctgtgatgaaaatcccactgccacatttcagttctttgggagacccagcatggcgtat

SEQ ID NO: 371907 - DNA, 140 bp, Artificial Sequence
  Synthetic
aggccctggctgctgatatgcatggacagaacaatacaaattccaaccagaatccccctcaaagctggcttcagctatccagaaagctcatgaagaaggcatttgtggaatccgctcagtgaccttttgggacagcggtg

SEQ ID NO: 371908 - DNA, 140 bp, Artificial Sequence
  Synthetic
caccgctgtcccaaaaggtcactgagcggattccacaaatgccttcttcatgagctttctggatagctgaagccagctttgagggggattctggttggaatttgtattgttctgtccatgcatatcagcagccagggcct

SEQ ID NO: 371909 - DNA, 140 bp, Artificial Sequence
  Synthetic
atacgccatgctgggtctccgatcttttggatgcaaaccgttaactatgtttcttataacagaaaacaaaatctggggaaggaaaagttggcccctcaatgaaggaattatggctattggcgtacttgggagtcggccat

SEQ ID NO: 371910 - DNA, 140 bp, Artificial Sequence
  Synthetic
atggccgactcccaagtacgccaatagccataattccttcattgaggggccaacttttccttccccagattttgttttctgttataagaaacatagttaacggtttgcatccaaaagatcggagacccagcatggcgtat

SEQ ID NO: 371911 - DNA, 140 bp, Artificial Sequence
  Synthetic
aggccctggctgctgatatggtccatgccgatatgggttattggatagaaagcgcacttaatgacacatggaagatagaaaaagcttcttttatcgaagttaaaagttgccactggccaagaccttttgggacagcggtg

SEQ ID NO: 371912 - DNA, 140 bp, Artificial Sequence
  Synthetic
caccgctgtcccaaaaggtcttggccagtggcaacttttaacttcgataaaagaagctttttctatcttccatgtgtcattaagtgcgctttctatccaataacccatatcggcatggaccatatcagcagccagggcct

SEQ ID NO: 371913 - DNA, 140 bp, Artificial Sequence
  Synthetic
aggccctggctgctgatatggaagatagaaaaagcttcttttatcgaagttaaaagttgccactggccaaaatcacacactctctggagtaacggagtgctagaaagtgagatgataattgaccttttgggacagcggtg

SEQ ID NO: 371914 - DNA, 140 bp, Artificial Sequence
  Synthetic
caccgctgtcccaaaaggtcaattatcatctcactttctagcactccgttactccagagagtgtgtgattttggccagtggcaacttttaacttcgataaaagaagctttttctatcttccatatcagcagccagggcct

SEQ ID NO: 371915 - DNA, 140 bp, Artificial Sequence
  Synthetic
aggccctggctgctgatatgatggtgctgccgatcctgcacattaccaccactaagatacagaggcgaggatggatgctggtacggaatggaaatcagaccattgaaagagaaagaagaggaccttttgggacagcggtg

SEQ ID NO: 371916 - DNA, 140 bp, Artificial Sequence
  Synthetic
caccgctgtcccaaaaggtcctcttctttctctttcaatggtctgatttccattccgtaccagcatccatcctcgcctctgtatcttagtggtggtaatgtgcaggatcggcagcaccatcatatcagcagccagggcct

SEQ ID NO: 371917 - DNA, 140 bp, Artificial Sequence
  Synthetic
aggccctggctgctgatatgcccgagtaggaacaaaacatgcagtattactggttgcagtttctttcatgacattgatcacagggaacatgtctttccgagacctggggagagtgatggtgaccttttgggacagcggtg

SEQ ID NO: 371918 - DNA, 140 bp, Artificial Sequence
  Synthetic
caccgctgtcccaaaaggtcaccatcactctccccaggtctcggaaagacatgttccctgtgatcaatgtcatgaaagaaactgcaaccagtaatactgcatgttttgttcctactcgggcatatcagcagccagggcct

SEQ ID NO: 371919 - DNA, 140 bp, Artificial Sequence
  Synthetic
aggccctggctgctgatatggcagtgttcgttgatgaaaaccaatggaactcagcaaaagaagcagtggaagacgaaaggttttgggatcttgtgcacagagagagggagcttcataaacgaccttttgggacagcggtg

SEQ ID NO: 371920 - DNA, 140 bp, Artificial Sequence
  Synthetic
caccgctgtcccaaaaggtcgtttatgaagctccctctctctgtgcacaagatcccaaaacctttcgtcttccactgcttcttttgctgagttccattggttttcatcaacgaacactgccatatcagcagccagggcct

SEQ ID NO: 371921 - DNA, 140 bp, Artificial Sequence
  Synthetic
aggccctggctgctgatatgaacaaccctttcaagaactaacaagaaaaggagttggccactaaatgaggctatcatggcagtcgggatggtgagcattttagctagttctctcttgaaggaccttttgggacagcggtg

SEQ ID NO: 371922 - DNA, 140 bp, Artificial Sequence
  Synthetic
caccgctgtcccaaaaggtccttcaagagagaactagctaaaatgctcaccatcccgactgccatgatagcctcatttagtggccaactccttttcttgttagttcttgaaagggttgttcatatcagcagccagggcct

SEQ ID NO: 371923 - DNA, 140 bp, Artificial Sequence
  Synthetic
atacgccatgctgggtctcccccacctgtgggaaaggccgaactggaagatggagcctacagaatcaagcagaaagggattcttggatactcccagatcggagctggagtttacaaagaacgtacttgggagtcggccat

SEQ ID NO: 371924 - DNA, 140 bp, Artificial Sequence
  Synthetic
atggccgactcccaagtacgttctttgtaaactccagctccgatctgggagtatccaagaatccctttctgcttgattctgtaggctccatcttccagttcggcctttcccacaggtgggggagacccagcatggcgtat

SEQ ID NO: 371925 - DNA, 140 bp, Artificial Sequence
  Synthetic
atacgccatgctgggtctccatgtgtgatgacacggtcacttacaaatgcccccacatcaccgaagtggaacctgaagacattgactgctggtgcaacctcacatcaacatgggtgacttcgtacttgggagtcggccat

SEQ ID NO: 371926 - DNA, 140 bp, Artificial Sequence
  Synthetic
atggccgactcccaagtacgaagtcacccatgttgatgtgaggttgcaccagcagtcaatgtcttcaggttccacttcggtgatgtgggggcatttgtaagtgaccgtgtcatcacacatggagacccagcatggcgtat

SEQ ID NO: 371927 - DNA, 140 bp, Artificial Sequence
  Synthetic
aggccctggctgctgatatgccctagacttttctcctggaacgtcaggatctccaatcgtcgacaaaaaaggaaaagtcgtgggtctctatggtaatggtgtcgtcacaaggagtggaacgaccttttgggacagcggtg

SEQ ID NO: 371928 - DNA, 140 bp, Artificial Sequence
  Synthetic
caccgctgtcccaaaaggtcgttccactccttgtgacgacaccattaccatagagacccacgacttttccttttttgtcgacgattggagatcctgacgttccaggagaaaagtctagggcatatcagcagccagggcct

SEQ ID NO: 371929 - DNA, 140 bp, Artificial Sequence
  Synthetic
atacgccatgctgggtctccaccccagccatcagagctgagcacactgggcgagaaatcgtggatttaatgtgtcatgccacatttaccatgaggctgttatcaccagttagagtgccaacgtacttgggagtcggccat

SEQ ID NO: 371930 - DNA, 140 bp, Artificial Sequence
  Synthetic
atggccgactcccaagtacgttggcactctaactggtgataacagcctcatggtaaatgtggcatgacacattaaatccacgatttctcgcccagtgtgctcagctctgatggctggggtggagacccagcatggcgtat

SEQ ID NO: 371931 - DNA, 140 bp, Artificial Sequence
  Synthetic
aggccctggctgctgatatggtgtcatgccacatttaccatgaggctgttatcaccagttagagtgccaaattacaacttgatcattatggatgaagcccatttcacagacccagcaagcgaccttttgggacagcggtg

SEQ ID NO: 371932 - DNA, 140 bp, Artificial Sequence
  Synthetic
caccgctgtcccaaaaggtcgcttgctgggtctgtgaaatgggcttcatccataatgatcaagttgtaatttggcactctaactggtgataacagcctcatggtaaatgtggcatgacaccatatcagcagccagggcct

SEQ ID NO: 371933 - DNA, 140 bp, Artificial Sequence
  Synthetic
aggccctggctgctgatatggctgtacgcacagtgtagcagactagcggttagaggagacccctcccatgacacaacgcagcagcggggcccgagcactgagggaagctgtacctccttggaccttttgggacagcggtg

SEQ ID NO: 371934 - DNA, 140 bp, Artificial Sequence
  Synthetic
caccgctgtcccaaaaggtccaaggaggtacagcttccctcagtgctcgggccccgctgctgcgttgtgtcatgggaggggtctcctctaaccgctagtctgctacactgtgcgtacagccatatcagcagccagggcct

SEQ ID NO: 371935 - DNA, 140 bp, Artificial Sequence
  Synthetic
aggccctggctgctgatatgagttttttattagagagcagatctctgatgaacaaccaacggaagaagacgggaaaaccgtctatcaatatgctgaaacgcgtgagaaaccgtgtgtcaagaccttttgggacagcggtg

SEQ ID NO: 371936 - DNA, 140 bp, Artificial Sequence
  Synthetic
caccgctgtcccaaaaggtcttgacacacggtttctcacgcgtttcagcatattgatagacggttttcccgtcttcttccgttggttgttcatcagagatctgctctctaataaaaaactcatatcagcagccagggcct

SEQ ID NO: 371937 - DNA, 140 bp, Artificial Sequence
  Synthetic
atacgccatgctgggtctccagatggctggatgctcggatctactctgacccactggcgctcaaagaattcaaagagtttgcagctggaagaaaatccctgaccctgaatttaatcacagcgtacttgggagtcggccat

SEQ ID NO: 371938 - DNA, 140 bp, Artificial Sequence
  Synthetic
atggccgactcccaagtacgctgtgattaaattcagggtcagggattttcttccagctgcaaactctttgaattctttgagcgccagtgggtcagagtagatccgagcatccagccatctggagacccagcatggcgtat

SEQ ID NO: 371939 - DNA, 140 bp, Artificial Sequence
  Synthetic
aggccctggctgctgatatgggaccaatgaaattggttatggcgttcatagccttcctcagatttctagccattccaccaacagcaggagtcttggctagatggggaaccttcaagaagtgaccttttgggacagcggtg

SEQ ID NO: 371940 - DNA, 140 bp, Artificial Sequence
  Synthetic
caccgctgtcccaaaaggtcacttcttgaaggttccccatctagccaagactcctgctgttggtggaatggctagaaatctgaggaaggctatgaacgccataaccaatttcattggtcccatatcagcagccagggcct

SEQ ID NO: 371941 - DNA, 140 bp, Artificial Sequence
  Synthetic
atacgccatgctgggtctccaaatgggtaggcttccaacttttatgactcagaaagcaaggaacgcactggacaacttagcagtcctgcatacggctgaagcaggcggaagggcgtacaacgtacttgggagtcggccat

SEQ ID NO: 371942 - DNA, 140 bp, Artificial Sequence
  Synthetic
atggccgactcccaagtacgttgtacgcccttccgcctgcttcagccgtatgcaggactgctaagttgtccagtgcgttccttgctttctgagtcataaaagttggaagcctacccatttggagacccagcatggcgtat

SEQ ID NO: 371943 - DNA, 140 bp, Artificial Sequence
  Synthetic
aggccctggctgctgatatgtattctcctatggtacgcacaaatacagccacactggatagcagcttcaataatactggagttttttctcatagtcttgctcattccagagccagaaaaggaccttttgggacagcggtg

SEQ ID NO: 371944 - DNA, 140 bp, Artificial Sequence
  Synthetic
caccgctgtcccaaaaggtccttttctggctctggaatgagcaagactatgagaaaaaactccagtattattgaagctgctatccagtgtggctgtatttgtgcgtaccataggagaatacatatcagcagccagggcct

SEQ ID NO: 371945 - DNA, 140 bp, Artificial Sequence
  Synthetic
atacgccatgctgggtctcccaaagaacaccccaagataaccaattgacttacgttgtcatagccatcctcacagtggtggccgcaaccatggcaaatgagatggggttcctggaaaaaacgtacttgggagtcggccat

SEQ ID NO: 371946 - DNA, 140 bp, Artificial Sequence
  Synthetic
atggccgactcccaagtacgttttttccaggaaccccatctcatttgccatggttgcggccaccactgtgaggatggctatgacaacgtaagtcaattggttatcttggggtgttctttgggagacccagcatggcgtat

SEQ ID NO: 371947 - DNA, 140 bp, Artificial Sequence
  Synthetic
atacgccatgctgggtctcccgaagaaagatttcggactgggaagcattgcaacccagcaacccgagagcaacatcctggacatagatctacgtcctgcatcagcatggaccctgtatgccgtacttgggagtcggccat

SEQ ID NO: 371948 - DNA, 140 bp, Artificial Sequence
  Synthetic
atggccgactcccaagtacggcatacagggtccatgctgatgcaggacgtagatctatgtccaggatgttgctctcgggttgctgggttgcaatgcttcccagtccgaaatctttcttcgggagacccagcatggcgtat

SEQ ID NO: 371949 - DNA, 140 bp, Artificial Sequence
  Synthetic
aggccctggctgctgatatgcaagcgaaagcaaccagagaagcgcagaaaagagcagcagcaggcatcatgaaaaacccaactgtggatggaataacagtgattgacctagatccaatacgaccttttgggacagcggtg

SEQ ID NO: 371950 - DNA, 140 bp, Artificial Sequence
  Synthetic
caccgctgtcccaaaaggtcgtattggatctaggtcaatcactgttattccatccacagttgggtttttcatgatgcctgctgctgctcttttctgcgcttctctggttgctttcgcttgcatatcagcagccagggcct

SEQ ID NO: 371951 - DNA, 140 bp, Artificial Sequence
  Synthetic
atacgccatgctgggtctcccctatgacccaaaatttgagaagcagctgggacaagtaatgctcctagtcctctgcgtgactcaagtactgatgatgaggactacatgggctttgtgtgacgtacttgggagtcggccat

SEQ ID NO: 371952 - DNA, 140 bp, Artificial Sequence
  Synthetic
atggccgactcccaagtacgtcacacaaagcccatgtagtcctcatcatcagtacttgagtcacgcagaggactaggagcattacttgtcccagctgcttctcaaattttgggtcataggggagacccagcatggcgtat

SEQ ID NO: 371953 - DNA, 140 bp, Artificial Sequence
  Synthetic
atacgccatgctgggtctccgtgtgatataggggagtcgtcaccaaatcccacggttgaagctggacgaacactcagagtcctaaacttggtagaaaattggctgaacaacaacacccaacgtacttgggagtcggccat

SEQ ID NO: 371954 - DNA, 140 bp, Artificial Sequence
  Synthetic
atggccgactcccaagtacgttgggtgttgttgttcagccaattttctaccaagtttaggactctgagtgttcgtccagcttcaaccgtgggatttggtgacgactcccctatatcacacggagacccagcatggcgtat

SEQ ID NO: 371955 - DNA, 140 bp, Artificial Sequence
  Synthetic
atacgccatgctgggtctccttttgcataaaggttcttaacccatacatgccctcagtcatagaaaaaatggaaacgctgcaaaggaaatacggaggagctttggtgaggaatcccctctcgtacttgggagtcggccat

SEQ ID NO: 371956 - DNA, 140 bp, Artificial Sequence
  Synthetic
atggccgactcccaagtacgagaggggattcctcaccaaagctcctccgtatttcctttgcagcgtttccattttttctatgactgagggcatgtatgggttaagaacctttatgcaaaaggagacccagcatggcgtat

SEQ ID NO: 371957 - DNA, 140 bp, Artificial Sequence
  Synthetic
atacgccatgctgggtctccatagtgtcatcagtgaacatgatttcaaggatgttgatcaatagatttacaatgagacataagaaggccacatacgagccagatgttgacctcggaagcgcgtacttgggagtcggccat

SEQ ID NO: 371958 - DNA, 140 bp, Artificial Sequence
  Synthetic
atggccgactcccaagtacgcgcttccgaggtcaacatctggctcgtatgtggccttcttatgtctcattgtaaatctattgatcaacatccttgaaatcatgttcactgatgacactatggagacccagcatggcgtat

SEQ ID NO: 371959 - DNA, 140 bp, Artificial Sequence
  Synthetic
aggccctggctgctgatatgaggaaagtgtgagacatgtgtgtacaacatgatgggaaagagagagaagaagataggggaattcggcaaagcaaaaggcagcagagccatatggtacatggaccttttgggacagcggtg

SEQ ID NO: 371960 - DNA, 140 bp, Artificial Sequence
  Synthetic
caccgctgtcccaaaaggtccatgtaccatatggctctgctgccttttgctttgccgaattcccctatcttcttctctctctttcccatcatgttgtacacacatgtctcacactttcctcatatcagcagccagggcct

SEQ ID NO: 371961 - DNA, 140 bp, Artificial Sequence
  Synthetic
aggccctggctgctgatatgggagcaatgtacgccgacgacacagcaggatgggatacaagaatcacactagaggacctaaaaaatgaagagatggtaacaaaccatatggaaggagaacgaccttttgggacagcggtg

SEQ ID NO: 371962 - DNA, 140 bp, Artificial Sequence
  Synthetic
caccgctgtcccaaaaggtcgttctccttccatatggtttgttaccatctcttcattttttaggtcctctagtgtgattcttgtatcccatcctgctgtgtcgtcggcgtacattgctcccatatcagcagccagggcct

SEQ ID NO: 371963 - DNA, 140 bp, Artificial Sequence
  Synthetic
atacgccatgctgggtctcccctttaccaatatgggagcccaactaatcagacagatggagggagagggagtctttaaaggcatccagcatctgacagccacagaagaagttgcagtgcacgtacttgggagtcggccat

SEQ ID NO: 371964 - DNA, 140 bp, Artificial Sequence
  Synthetic
atggccgactcccaagtacgtgcactgcaacttcttctgtggctgtcagatgctggatgcctttaaagactccctctccctccatctgtctgattagttgggctcccatattggtaaaggggagacccagcatggcgtat

SEQ ID NO: 371965 - DNA, 140 bp, Artificial Sequence
  Synthetic
aggccctggctgctgatatgggaaccttcaagaggatggaacgactggacacaagtgcctttctgttcacaccatttccatgagttaatcatgaaagacggtcgtgtgctcgtagttccagaccttttgggacagcggtg

SEQ ID NO: 371966 - DNA, 140 bp, Artificial Sequence
  Synthetic
caccgctgtcccaaaaggtctggaactacgagcacacgaccgtctttcatgattaactcatggaaatggtgtgaacagaaaggcacttgtgtccagtcgttccatcctcttgaaggttcccatatcagcagccagggcct

SEQ ID NO: 371967 - DNA, 140 bp, Artificial Sequence
  Synthetic
atacgccatgctgggtctcctgtagaaaccaagatgaactgattggtagagctcgaatttcccagggagccgggtggtctttgcgggagacggcctgtctggggaagtcttacgcccaaacgtacttgggagtcggccat

SEQ ID NO: 371968 - DNA, 140 bp, Artificial Sequence
  Synthetic
atggccgactcccaagtacgtttgggcgtaagacttccccagacaggccgtctcccgcaaagaccacccggctccctgggaaattcgagctctaccaatcagttcatcttggtttctacaggagacccagcatggcgtat

SEQ ID NO: 371969 - DNA, 140 bp, Artificial Sequence
  Synthetic
atacgccatgctgggtctcctgtggagcctgatgtacttccacagacgtgacctcaggctggcagcaaacgctatttgctcggcagttccatcacattgggttccgacaagtcgaacaaccgtacttgggagtcggccat

SEQ ID NO: 371970 - DNA, 140 bp, Artificial Sequence
  Synthetic
atggccgactcccaagtacggttgttcgacttgtcggaacccaatgtgatggaactgccgagcaaatagcgtttgctgccagcctgaggtcacgtctgtggaagtacatcaggctccacaggagacccagcatggcgtat

SEQ ID NO: 371971 - DNA, 140 bp, Artificial Sequence
  Synthetic
aggccctggctgctgatatgggaacatccaaacagcaataaaccaagttagatccttaataggcagtgaggaatacacagactacatgccatccatgaaaagattcagaagagaagaggagaccttttgggacagcggtg

SEQ ID NO: 371972 - DNA, 140 bp, Artificial Sequence
  Synthetic
caccgctgtcccaaaaggtctcctcttctcttctgaatcttttcatggatggcatgtagtctgtgtattcctcactgcctattaaggatctaacttggtttattgctgtttggatgttcccatatcagcagccagggcct

SEQ ID NO: 371973 - DNA, 140 bp, Artificial Sequence
  Synthetic
atacgccatgctgggtctccgaatacacagactacatgccatccatgaaaagattcagaagagaagaggaagaggcaggggtcttgtggtagaaggcagaattaacatgagacaagattacgtacttgggagtcggccat

SEQ ID NO: 371974 - DNA, 140 bp, Artificial Sequence
  Synthetic
atggccgactcccaagtacgtaatcttgtctcatgttaattctgccttctaccacaagacccctgcctcttcctcttctcttctgaatcttttcatggatggcatgtagtctgtgtattcggagacccagcatggcgtat

SEQ ID NO: 371975 - DNA, 140 bp, Artificial Sequence
  Synthetic
atacgccatgctgggtctccactttcaaaaatccccatgcgaagaaacaggatgttgttgttttaggatcccaagaaggggctatgcatacagcacttacaggggccacggaaatccagacgtacttgggagtcggccat

SEQ ID NO: 371976 - DNA, 140 bp, Artificial Sequence
  Synthetic
atggccgactcccaagtacgtctggatttccgtggcccctgtaagtgctgtatgcatagccccttcttgggatcctaaaacaacaacatcctgtttcttcgcatggggatttttgaaagtggagacccagcatggcgtat

SEQ ID NO: 371977 - DNA, 140 bp, Artificial Sequence
  Synthetic
atacgccatgctgggtctccagagtgaacacacaggaagggagatagttgacctcatgtgccacgccacttttaccatgcgtctcttatccccagtgagagttcccaattacaacatgatcgtacttgggagtcggccat

SEQ ID NO: 371978 - DNA, 140 bp, Artificial Sequence
  Synthetic
atggccgactcccaagtacgatcatgttgtaattgggaactctcactggggataagagacgcatggtaaaagtggcgtggcacatgaggtcaactatctcccttcctgtgtgttcactctggagacccagcatggcgtat

SEQ ID NO: 371979 - DNA, 140 bp, Artificial Sequence
  Synthetic
atacgccatgctgggtctccggtaatactaaaagatggtccagagcgtgtcattttagccggaccgatgccagtgactgtggccagtgctgcccagaggagaggaagaattggaaggaaccgtacttgggagtcggccat

SEQ ID NO: 371980 - DNA, 140 bp, Artificial Sequence
  Synthetic
atggccgactcccaagtacggttccttccaattcttcctctcctctgggcagcactggccacagtcactggcatcggtccggctaaaatgacacgctctggaccatcttttagtattaccggagacccagcatggcgtat

SEQ ID NO: 371981 - DNA, 140 bp, Artificial Sequence
  Synthetic
atacgccatgctgggtctccggccataaaacgaggcttaagaacattaatcctggcccccactagagtcgtggcagctgaaatggaggaagctcttagaggacttccaataagataccaacgtacttgggagtcggccat

SEQ ID NO: 371982 - DNA, 140 bp, Artificial Sequence
  Synthetic
atggccgactcccaagtacgttggtatcttattggaagtcctctaagagcttcctccatttcagctgccacgactctagtgggggccaggattaatgttcttaagcctcgttttatggccggagacccagcatggcgtat

SEQ ID NO: 371983 - DNA, 140 bp, Artificial Sequence
  Synthetic
aggccctggctgctgatatggcaggacccatgccagtgacccactctagtgcagcacaaagaagagggagaataggaagaaatccaaaaaatgaaaatgaccagtacatatacatggggggaccttttgggacagcggtg

SEQ ID NO: 371984 - DNA, 140 bp, Artificial Sequence
  Synthetic
caccgctgtcccaaaaggtccccccatgtatatgtactggtcattttcattttttggatttcttcctattctccctcttctttgtgctgcactagagtgggtcactggcatgggtcctgccatatcagcagccagggcct

SEQ ID NO: 371985 - DNA, 140 bp, Artificial Sequence
  Synthetic
aggccctggctgctgatatgagaggaagtggacaggtcggaacttatggcttaaatactttcaccaatatggaggtccaactaataagacaaatggagtctgaaggaatctttttacccagaccttttgggacagcggtg

SEQ ID NO: 371986 - DNA, 140 bp, Artificial Sequence
  Synthetic
caccgctgtcccaaaaggtctgggtaaaaagattccttcagactccatttgtcttattagttggacctccatattggtgaaagtatttaagccataagttccgacctgtccacttcctctcatatcagcagccagggcct

SEQ ID NO: 371987 - DNA, 140 bp, Artificial Sequence
  Synthetic
aggccctggctgctgatatgttaacagctctaaatgacatgggaaaggttaggaaagacatacaacaatgggaaccttcaagaggatggagcgactggacacaagtgcctttctgttcacgaccttttgggacagcggtg

SEQ ID NO: 371988 - DNA, 140 bp, Artificial Sequence
  Synthetic
caccgctgtcccaaaaggtcgtgaacagaaaggcacttgtgtccagtcgctccatcctcttgaaggttcccattgttgtatgtctttcctaacctttcccatgtcatttagagctgttaacatatcagcagccagggcct

SEQ ID NO: 371989 - DNA, 140 bp, Artificial Sequence
  Synthetic
atacgccatgctgggtctcctatcatatggaggaggctggaagctagaaggagaatggaaggaaggagaagaagtccaggtcttggcattagagcctggaaagaatccaagagccgtccacgtacttgggagtcggccat

SEQ ID NO: 371990 - DNA, 140 bp, Artificial Sequence
  Synthetic
atggccgactcccaagtacgtggacggctcttggattctttccaggctctaatgccaagacctggacttcttctccttccttccattctccttctagcttccagcctcctccatatgataggagacccagcatggcgtat

SEQ ID NO: 371991 - DNA, 140 bp, Artificial Sequence
  Synthetic
atacgccatgctgggtctccggacgtaaaacctgggaggctgcaaactgtggaagctgtacgcacagtgtagcagactagcggttagaggagaccctccatgacacaacgcagcagcgggcgtacttgggagtcggccat

SEQ ID NO: 371992 - DNA, 140 bp, Artificial Sequence
  Synthetic
atggccgactcccaagtacgcccgctgctgcgttgtgtcatggagggtctcctctaaccgctagtctgctacactgtgcgtacagcttccacagtttgcagcctcccaggttttacgtccggagacccagcatggcgtat

SEQ ID NO: 371993 - DNA, 140 bp, Artificial Sequence
  Synthetic
atacgccatgctgggtctccatggatgctggtacggaatggaaatcagaccattgaaagagaaagaagagaacttggtcaattctttggtcacagccggacatggacagattgacaacttcgtacttgggagtcggccat

SEQ ID NO: 371994 - DNA, 140 bp, Artificial Sequence
  Synthetic
atggccgactcccaagtacgaagttgtcaatctgtccatgtccggctgtgaccaaagaattgaccaagttctcttctttctctttcaatggtctgatttccattccgtaccagcatccatggagacccagcatggcgtat

SEQ ID NO: 371995 - DNA, 140 bp, Artificial Sequence
  Synthetic
atacgccatgctgggtctccaagtcttctgttcaaaacagaggatggtgttaacatgtgtaccctcatggccatagaccttggtgaattgtgtgaagatacaatcacgtacaagtgtcctcgtacttgggagtcggccat

SEQ ID NO: 371996 - DNA, 140 bp, Artificial Sequence
  Synthetic
atggccgactcccaagtacgaggacacttgtacgtgattgtatcttcacacaattcaccaaggtctatggccatgagggtacacatgttaacaccatcctctgttttgaacagaagacttggagacccagcatggcgtat

SEQ ID NO: 371997 - DNA, 140 bp, Artificial Sequence
  Synthetic
atacgccatgctgggtctcccatggacagaacaatataagttccaaccagaatccccttcaaaactagcttcagctatccaaaaagctcatgaagagggcatttgtggaatccgctcagtcgtacttgggagtcggccat

SEQ ID NO: 371998 - DNA, 140 bp, Artificial Sequence
  Synthetic
atggccgactcccaagtacgactgagcggattccacaaatgccctcttcatgagctttttggatagctgaagctagttttgaaggggattctggttggaacttatattgttctgtccatgggagacccagcatggcgtat

SEQ ID NO: 371999 - DNA, 140 bp, Artificial Sequence
  Synthetic
aggccctggctgctgatatgcccgaataggaacgaaacatgcaatactgctagttgcagtatcttttgtgacactgataactgggaacatgtcttttagagacctgggaagagtgatggtgaccttttgggacagcggtg

SEQ ID NO: 372000 - DNA, 140 bp, Artificial Sequence
  Synthetic
caccgctgtcccaaaaggtcaccatcactcttcccaggtctctaaaagacatgttcccagttatcagtgtcacaaaagatactgcaactagcagtattgcatgtttcgttcctattcgggcatatcagcagccagggcct

SEQ ID NO: 372001 - DNA, 140 bp, Artificial Sequence
  Synthetic
aggccctggctgctgatatgctcttgagaaaactgacctccaaggaactgatgatggccaccataggaatcgcactcctttcccaaagcaccataccagagaccattcttgaactgactggaccttttgggacagcggtg

SEQ ID NO: 372002 - DNA, 140 bp, Artificial Sequence
  Synthetic
caccgctgtcccaaaaggtccagtcagttcaagaatggtctctggtatggtgctttgggaaaggagtgcgattcctatggtggccatcatcagttccttggaggtcagttttctcaagagcatatcagcagccagggcct

SEQ ID NO: 372003 - DNA, 140 bp, Artificial Sequence
  Synthetic
aggccctggctgctgatatgacacatgatagttagtaagcaggaaagaggaaagtcactcttgtttaagacctctgcaggtgtcaacatgtgcactctcattgcgatggacttgggagaggaccttttgggacagcggtg

SEQ ID NO: 372004 - DNA, 140 bp, Artificial Sequence
  Synthetic
caccgctgtcccaaaaggtcctctcccaagtccatcgcaatgagagtgcacatgttgacacctgcagaggtcttaaacaagagtgactttcctctttcctgcttactaactatcatgtgtcatatcagcagccagggcct

SEQ ID NO: 372005 - DNA, 140 bp, Artificial Sequence
  Synthetic
aggccctggctgctgatatggaagtccaagtcctggcattggaacctggaaaaaatccaagagccgttcaaacgaaacctggaattttcaaaaccaacaccggaaccataggcgccgtatgaccttttgggacagcggtg

SEQ ID NO: 372006 - DNA, 140 bp, Artificial Sequence
  Synthetic
caccgctgtcccaaaaggtcatacggcgcctatggttccggtgttggttttgaaaattccaggtttcgtttgaacggctcttggattttttccaggttccaatgccaggacttggacttccatatcagcagccagggcct

SEQ ID NO: 372007 - DNA, 140 bp, Artificial Sequence
  Synthetic
aggccctggctgctgatatgtggcagctgaaatggaggaagctcttagaggacttccaataagataccaaaccccagccatcaaaaccgagcataccgggcgggagatcgtggacctaatgaccttttgggacagcggtg

SEQ ID NO: 372008 - DNA, 140 bp, Artificial Sequence
  Synthetic
caccgctgtcccaaaaggtcattaggtccacgatctcccgcccggtatgctcggttttgatggctggggtttggtatcttattggaagtcctctaagagcttcctccatttcagctgccacatatcagcagccagggcct

SEQ ID NO: 372009 - DNA, 140 bp, Artificial Sequence
  Synthetic
aggccctggctgctgatatgtggagctaccaaattctttagaggagctaggggatggacttgcaatgggtatcatgatgttaaaattattgactgaatttcagccacaccagttatggacgaccttttgggacagcggtg

SEQ ID NO: 372010 - DNA, 140 bp, Artificial Sequence
  Synthetic
caccgctgtcccaaaaggtcgtccataactggtgtggctgaaattcagtcaataattttaacatcatgatacccattgcaagtccatcccctagctcctctaaagaatttggtagctccacatatcagcagccagggcct

SEQ ID NO: 372011 - DNA, 140 bp, Artificial Sequence
  Synthetic
aggccctggctgctgatatgaataggaagaaatccaaaaaatgaaaatgaccagtacatatacatgggggaacctcttgaaaatgatgaagactgtgcacattggaaagaagctaaaatggaccttttgggacagcggtg

SEQ ID NO: 372012 - DNA, 140 bp, Artificial Sequence
  Synthetic
caccgctgtcccaaaaggtccattttagcttctttccaatgtgcacagtcttcatcattttcaagaggttcccccatgtatatgtactggtcattttcattttttggatttcttcctattcatatcagcagccagggcct

SEQ ID NO: 372013 - DNA, 140 bp, Artificial Sequence
  Synthetic
aggccctggctgctgatatggacaacttggctgtgctgcacacggctgaggcaggtggaagggcgtacaatcatgctctcagtgaactgccggagaccctggagacactgcttctactgagaccttttgggacagcggtg

SEQ ID NO: 372014 - DNA, 140 bp, Artificial Sequence
  Synthetic
caccgctgtcccaaaaggtctcagtagaagcagtgtctccagggtctccggcagttcactgagagcatgattgtacgcccttccacctgcctcagccgtgtgcagcacagccaagttgtccatatcagcagccagggcct

SEQ ID NO: 372015 - DNA, 140 bp, Artificial Sequence
  Synthetic
aggccctggctgctgatatgtatcctcctatggtatgcacagatacaaccacactggatagcagcttcaataatactggagttttttctcatagttttgctcattccagaaccagaaaaagaccttttgggacagcggtg

SEQ ID NO: 372016 - DNA, 140 bp, Artificial Sequence
  Synthetic
caccgctgtcccaaaaggtctttttctggttctggaatgagcaaaactatgagaaaaaactccagtattattgaagctgctatccagtgtggttgtatctgtgcataccataggaggatacatatcagcagccagggcct

SEQ ID NO: 372017 - DNA, 140 bp, Artificial Sequence
  Synthetic
aggccctggctgctgatatgaagaacccatccccatgtcaacatatgggtggaatctagtgcgtctgcaaagtggagttgacgttttcttcaccccgccagaaaagtgtgacacattgttgaccttttgggacagcggtg

SEQ ID NO: 372018 - DNA, 140 bp, Artificial Sequence
  Synthetic
caccgctgtcccaaaaggtcaacaatgtgtcacacttttctggcggggtgaagaaaacgtcaactccactttgcagacgcactagattccacccatatgttgacatggggatgggttcttcatatcagcagccagggcct

SEQ ID NO: 372019 - DNA, 140 bp, Artificial Sequence
  Synthetic
aggccctggctgctgatatggcaaaacgaggcacaacacaaatcatggaggtgacagccaagtggttatggggtttcctttccagaaacaaaaaacccagaatctgcacaagagaggagtgaccttttgggacagcggtg

SEQ ID NO: 372020 - DNA, 140 bp, Artificial Sequence
  Synthetic
caccgctgtcccaaaaggtcactcctctcttgtgcagattctgggttttttgtttctggaaaggaaaccccataaccacttggctgtcacctccatgatttgtgttgtgcctcgttttgccatatcagcagccagggcct

SEQ ID NO: 372021 - DNA, 140 bp, Artificial Sequence
  Synthetic
atacgccatgctgggtctcctctggtgagtcaacacactcatgaagtaaaggaaaatagaagatcaaacaaagtaagaagtcaggccagattaagccatagtacggaaagagctatgctgcgtacttgggagtcggccat

SEQ ID NO: 372022 - DNA, 140 bp, Artificial Sequence
  Synthetic
atggccgactcccaagtacgcagcatagctctttccgtactatggcttaatctggcctgacttcttactttgtttgatcttctattttcctttacttcatgagtgtgttgactcaccagaggagacccagcatggcgtat

SEQ ID NO: 372023 - DNA, 140 bp, Artificial Sequence
  Synthetic
aggccctggctgctgatatggtggaactcatgaggaggggtgaccttccagtctggttagcccacaaagtagcatcagaagggatcaaatatacagatagaaaatggtgctttgatggacgaccttttgggacagcggtg

SEQ ID NO: 372024 - DNA, 140 bp, Artificial Sequence
  Synthetic
caccgctgtcccaaaaggtcgtccatcaaagcaccattttctatctgtatatttgatcccttctgatgctactttgtgggctaaccagactggaaggtcacccctcctcatgagttccaccatatcagcagccagggcct

SEQ ID NO: 372025 - DNA, 140 bp, Artificial Sequence
  Synthetic
atacgccatgctgggtctccgtcgggggccatcaaggtcctgaaaggcttcaagaaggagatctcaaacatgctgagcataatcaacaaacggaaaaagacatcgctctgtctcatgatgcgtacttgggagtcggccat

SEQ ID NO: 372026 - DNA, 140 bp, Artificial Sequence
  Synthetic
atggccgactcccaagtacgcatcatgagacagagcgatgtctttttccgtttgttgattatgctcagcatgtttgagatctccttcttgaagcctttcaggaccttgatggcccccgacggagacccagcatggcgtat

SEQ ID NO: 372027 - DNA, 140 bp, Artificial Sequence
  Synthetic
atacgccatgctgggtctccaccattttcatgagttagtcatgaaagatggtcgcgtgctcgtagtcccatgcagaaaccaagatgaactgattggtagagcccgaatttcccagggagccgtacttgggagtcggccat

SEQ ID NO: 372028 - DNA, 140 bp, Artificial Sequence
  Synthetic
atggccgactcccaagtacggctccctgggaaattcgggctctaccaatcagttcatcttggtttctgcatgggactacgagcacgcgaccatctttcatgactaactcatgaaaatggtggagacccagcatggcgtat

SEQ ID NO: 372029 - DNA, 140 bp, Artificial Sequence
  Synthetic
aggccctggctgctgatatgccacttgtgccacggcttgagcaaaccgtgctgcctgtagctccgccaaaaacgggaggcgtaaaaatcccagggaggccatgcgccacggaagctgtacgaccttttgggacagcggtg

SEQ ID NO: 372030 - DNA, 140 bp, Artificial Sequence
  Synthetic
caccgctgtcccaaaaggtcgtacagcttccgtggcgcatggcctccctgggatttttacgcctcccgtttttggcggagctacaggcagcacggtttgctcaagccgtggcacaagtggcatatcagcagccagggcct

SEQ ID NO: 372031 - DNA, 140 bp, Artificial Sequence
  Synthetic
aggccctggctgctgatatgcaggaagaagaagtgtctcaggtgacctaatattggaaatagggaaacttccacaacatttgacgttaagagcccagaatgctctggataacttggtcatgaccttttgggacagcggtg

SEQ ID NO: 372032 - DNA, 140 bp, Artificial Sequence
  Synthetic
caccgctgtcccaaaaggtcatgaccaagttatccagagcattctgggctcttaacgtcaaatgttgtggaagtttccctatttccaatattaggtcacctgagacacttcttcttcctgcatatcagcagccagggcct

SEQ ID NO: 372033 - DNA, 140 bp, Artificial Sequence
  Synthetic
aggccctggctgctgatatgacccccccaaaacaaaaaacagcatattgacgctgggaaagaccagagatcctgctgtctcctcagcatcattccaggcacagaacgccagaaaatggaagaccttttgggacagcggtg

SEQ ID NO: 372034 - DNA, 140 bp, Artificial Sequence
  Synthetic
caccgctgtcccaaaaggtcttccattttctggcgttctgtgcctggaatgatgctgaggagacagcaggatctctggtctttcccagcgtcaatatgctgttttttgttttgggggggtcatatcagcagccagggcct

SEQ ID NO: 372035 - DNA, 140 bp, Artificial Sequence
  Synthetic
aggccctggctgctgatatgacaaagacagattctttgagggagctaagctcaacgtagttctaacagttttttaattagagagcagatctctgatgaataaccaacgaaaaaaggcgaggaccttttgggacagcggtg

SEQ ID NO: 372036 - DNA, 140 bp, Artificial Sequence
  Synthetic
caccgctgtcccaaaaggtcctcgccttttttcgttggttattcatcagagatctgctctctaattaaaaaactgttagaactacgttgagcttagctccctcaaagaatctgtctttgtcatatcagcagccagggcct

SEQ ID NO: 372037 - DNA, 140 bp, Artificial Sequence
  Synthetic
aggccctggctgctgatatgccattaaaactgttcatggccctggtggcgttccttcgtttcctaacaatcccaccaacagcagggatactgaagagatggggaacaattaaaaaatcaagaccttttgggacagcggtg

SEQ ID NO: 372038 - DNA, 140 bp, Artificial Sequence
  Synthetic
caccgctgtcccaaaaggtcttgattttttaattgttccccatctcttcagtatccctgctgttggtgggattgttaggaaacgaaggaacgccaccagggccatgaacagttttaatggcatatcagcagccagggcct

SEQ ID NO: 372039 - DNA, 140 bp, Artificial Sequence
  Synthetic
aggccctggctgctgatatgtccaacagtgatggcgttccatttaaccacacgtaacggagaaccacacatgatcgtcagtagacaagagaaagggaaaagtcttctgtttaaaacagaggaccttttgggacagcggtg

SEQ ID NO: 372040 - DNA, 140 bp, Artificial Sequence
  Synthetic
caccgctgtcccaaaaggtcctctgttttaaacagaagacttttccctttctcttgtctactgacgatcatgtgtggttctccgttacgtgtggttaaatggaacgccatcactgttggacatatcagcagccagggcct

SEQ ID NO: 372041 - DNA, 140 bp, Artificial Sequence
  Synthetic
atacgccatgctgggtctccaagacatagattgttggtgcaactctacgtccacatgggtaacttatgggacgtgtaccaccacaggagaacacagaagagaaaaaagatcagtggcactcgtacttgggagtcggccat

SEQ ID NO: 372042 - DNA, 140 bp, Artificial Sequence
  Synthetic
atggccgactcccaagtacgagtgccactgatcttttttctcttctgtgttctcctgtggtggtacacgtcccataagttacccatgtggacgtagagttgcaccaacaatctatgtcttggagacccagcatggcgtat

SEQ ID NO: 372043 - DNA, 140 bp, Artificial Sequence
  Synthetic
aggccctggctgctgatatgacgagggggagagccacacatgatagtcagcaagcaggaaagaggaaagtcactcttgtttaagacctctgtaggtgtcaacatgtgcactctcattgcggaccttttgggacagcggtg

SEQ ID NO: 372044 - DNA, 140 bp, Artificial Sequence
  Synthetic
caccgctgtcccaaaaggtccgcaatgagagtgcacatgttgacacctacagaggtcttaaacaagagtgactttcctctttcctgcttgctgactatcatgtgtggctctccccctcgtcatatcagcagccagggcct

SEQ ID NO: 372045 - DNA, 140 bp, Artificial Sequence
  Synthetic
atacgccatgctgggtctccgaaggggtttcaggaggaagctgggttgacatagtcttagaacatggaagctgtgtgacgacgatggcaaaaaacaaaccaacattggattttgaactgacgtacttgggagtcggccat

SEQ ID NO: 372046 - DNA, 140 bp, Artificial Sequence
  Synthetic
atggccgactcccaagtacgtcagttcaaaatccaatgttggtttgttttttgccatcgtcgtcacacagcttccatgttctaagactatgtcaacccagcttcctcctgaaaccccttcggagacccagcatggcgtat

SEQ ID NO: 372047 - DNA, 140 bp, Artificial Sequence
  Synthetic
aggccctggctgctgatatgtggtggacagaggatggggaaatggatgtggactatttggaaaaggaggcattgtgacctgtgctatgttcacatgcaaaaagaacatggaaggaaaagtgaccttttgggacagcggtg

SEQ ID NO: 372048 - DNA, 140 bp, Artificial Sequence
  Synthetic
caccgctgtcccaaaaggtcacttttccttccatgttctttttgcatgtgaacatagcacaggtcacaatgcctccttttccaaatagtccacatccatttccccatcctctgtccaccacatatcagcagccagggcct

SEQ ID NO: 372049 - DNA, 140 bp, Artificial Sequence
  Synthetic
atacgccatgctgggtctcccgtgcaaccagaaaacttggaatacaccattgtgataacacctcactcaggggaagagcatgcagtcggaaatgacacaggaaaacatggcaaggaaatccgtacttgggagtcggccat

SEQ ID NO: 372050 - DNA, 140 bp, Artificial Sequence
  Synthetic
atggccgactcccaagtacggatttccttgccatgttttcctgtgtcatttccgactgcatgctcttcccctgagtgaggtgttatcacaatggtgtattccaagttttctggttgcacgggagacccagcatggcgtat

SEQ ID NO: 372051 - DNA, 140 bp, Artificial Sequence
  Synthetic
aggccctggctgctgatatgtgcacaaagggaaaagacttgagccatcatgggcagacgtgaagaaagacttgatatcatatggaggaggctggaaactggaaggagagtggaaagatgggaccttttgggacagcggtg

SEQ ID NO: 372052 - DNA, 140 bp, Artificial Sequence
  Synthetic
caccgctgtcccaaaaggtcccatctttccactctccttccagtttccagcctcctccatatgatatcaagtctttcttcacgtctgcccatgatggctcaagtcttttccctttgtgcacatatcagcagccagggcct

SEQ ID NO: 372053 - DNA, 140 bp, Artificial Sequence
  Synthetic
aggccctggctgctgatatgttcctagacctgccgttgccatggctgcccggagcggacacacaaggattaaattggatacagaaagagacattggtcactttcaaaaatccccatgcgagaccttttgggacagcggtg

SEQ ID NO: 372054 - DNA, 140 bp, Artificial Sequence
  Synthetic
caccgctgtcccaaaaggtctcgcatggggatttttgaaagtgaccaatgtctctttctgtatccaatttaatccttgtgtgtccgctccgggcagccatggcaacggcaggtctaggaacatatcagcagccagggcct

SEQ ID NO: 372055 - DNA, 140 bp, Artificial Sequence
  Synthetic
aggccctggctgctgatatggcagaaacacaacatggaacaatagttatcagagtacaatatgaaggggacggttctccatgtaagatcccttttgagataatggatttggaaaaaagacgaccttttgggacagcggtg

SEQ ID NO: 372056 - DNA, 140 bp, Artificial Sequence
  Synthetic
caccgctgtcccaaaaggtcgtcttttttccaaatccattatctcaaaagggatcttacatggagaaccgtccccttcatattgtactctgataactattgttccatgttgtgtttctgccatatcagcagccagggcct

SEQ ID NO: 372057 - DNA, 140 bp, Artificial Sequence
  Synthetic
atacgccatgctgggtctccgttctatcggccaaatgattgagacaacaatgaggggagcgaagagaatggccattttaggtgacacagcttgggattttggatccctgggaggagtgttcgtacttgggagtcggccat

SEQ ID NO: 372058 - DNA, 140 bp, Artificial Sequence
  Synthetic
atggccgactcccaagtacgaacactcctcccagggatccaaaatcccaagctgtgtcacctaaaatggccattctcttcgctcccctcattgttgtctcaatcatttggccgatagaacggagacccagcatggcgtat

SEQ ID NO: 372059 - DNA, 140 bp, Artificial Sequence
  Synthetic
aggccctggctgctgatatgtggaaacaaataacaccagaattgaatcacattctatcagaaaatgaggtgaagttgactattatgacaggagacatcaaaggaatcatgcaggcaggaagaccttttgggacagcggtg

SEQ ID NO: 372060 - DNA, 140 bp, Artificial Sequence
  Synthetic
caccgctgtcccaaaaggtcttcctgcctgcatgattcctttgatgtctcctgtcataatagtcaacttcacctcattttctgatagaatgtgattcaattctggtgttatttgtttccacatatcagcagccagggcct

SEQ ID NO: 372061 - DNA, 140 bp, Artificial Sequence
  Synthetic
atacgccatgctgggtctcccattgatggccccgaaacagcagaatgccccaacacaaacagagcttggaattcgctggaagttgaagactatggctttggagtattcaccaccaatatacgtacttgggagtcggccat

SEQ ID NO: 372062 - DNA, 140 bp, Artificial Sequence
  Synthetic
atggccgactcccaagtacgtatattggtggtgaatactccaaagccatagtcttcaacttccagcgaattccaagctctgtttgtgttggggcattctgctgtttcggggccatcaatgggagacccagcatggcgtat

SEQ ID NO: 372063 - DNA, 140 bp, Artificial Sequence
  Synthetic
atacgccatgctgggtctcctggcatctaggtaagcttgagatggactttgatttctgcgaaggaaccacagtggtggtgactgaggactgtggaaatagaggaccctctttaagaacaacgtacttgggagtcggccat

SEQ ID NO: 372064 - DNA, 140 bp, Artificial Sequence
  Synthetic
atggccgactcccaagtacgttgttcttaaagagggtcctctatttccacagtcctcagtcaccaccactgtggttccttcgcagaaatcaaagtccatctcaagcttacctagatgccaggagacccagcatggcgtat

SEQ ID NO: 372065 - DNA, 140 bp, Artificial Sequence
  Synthetic
aggccctggctgctgatatgagtggtggtgactgaggactgtggaaatagaggaccctctttaagaacaactactgcctctggaaaactcataacagaatggtgctgccgatcttgcacagaccttttgggacagcggtg

SEQ ID NO: 372066 - DNA, 140 bp, Artificial Sequence
  Synthetic
caccgctgtcccaaaaggtctgtgcaagatcggcagcaccattctgttatgagttttccagaggcagtagttgttcttaaagagggtcctctatttccacagtcctcagtcaccaccactcatatcagcagccagggcct

SEQ ID NO: 372067 - DNA, 140 bp, Artificial Sequence
  Synthetic
atacgccatgctgggtctccgcattgttcctggaagaaatgctcaggacccgagtaggaacgaaacatgcaatactactagttgcagtttcttttgtgacattgatcacagggaacatgtcgtacttgggagtcggccat

SEQ ID NO: 372068 - DNA, 140 bp, Artificial Sequence
  Synthetic
atggccgactcccaagtacgacatgttccctgtgatcaatgtcacaaaagaaactgcaactagtagtattgcatgtttcgttcctactcgggtcctgagcatttcttccaggaacaatgcggagacccagcatggcgtat

SEQ ID NO: 372069 - DNA, 140 bp, Artificial Sequence
  Synthetic
atacgccatgctgggtctccaggaattgatgatgactaccataggaatcgtactcctctcccagagcaccataccagagaccattcttgaactgactgatgcgttagccttgggcatgatcgtacttgggagtcggccat

SEQ ID NO: 372070 - DNA, 140 bp, Artificial Sequence
  Synthetic
atggccgactcccaagtacgatcatgcccaaggctaacgcatcagtcagttcaagaatggtctctggtatggtgctctgggagaggagtacgattcctatggtagtcatcatcaattcctggagacccagcatggcgtat

SEQ ID NO: 372071 - DNA, 140 bp, Artificial Sequence
  Synthetic
aggccctggctgctgatatgataccagagaccattcttgaactgactgatgcgttagccttgggcatgatggtccttaaaatggtgagaaaaatggaaaagtatcaattggcagtgactagaccttttgggacagcggtg

SEQ ID NO: 372072 - DNA, 140 bp, Artificial Sequence
  Synthetic
caccgctgtcccaaaaggtctagtcactgccaattgatacttttccatttttctcaccattttaaggaccatcatgcccaaggctaacgcatcagtcagttcaagaatggtctctggtatcatatcagcagccagggcct

SEQ ID NO: 372073 - DNA, 140 bp, Artificial Sequence
  Synthetic
atacgccatgctgggtctcccattagtggctggagggctcctcactgtgtgctacgtgctcactggacgatcggccgatttggaactggagagagccgccgatgtcaaatgggaagatcacgtacttgggagtcggccat

SEQ ID NO: 372074 - DNA, 140 bp, Artificial Sequence
  Synthetic
atggccgactcccaagtacgtgatcttcccatttgacatcggcggctctctccagttccaaatcggccgatcgtccagtgagcacgtagcacacagtgaggagccctccagccactaatgggagacccagcatggcgtat

SEQ ID NO: 372075 - DNA, 140 bp, Artificial Sequence
  Synthetic
aggccctggctgctgatatgctcattagaacaggattgctggtgatctcaggactttttcctgtatcaataccaatcacggcagcagcatggtacctgtgggaagtgaagaaacaacggggaccttttgggacagcggtg

SEQ ID NO: 372076 - DNA, 140 bp, Artificial Sequence
  Synthetic
caccgctgtcccaaaaggtccccgttgtttcttcacttcccacaggtaccatgctgctgccgtgattggtattgatacaggaaaaagtcctgagatcaccagcaatcctgttctaatgagcatatcagcagccagggcct

SEQ ID NO: 372077 - DNA, 140 bp, Artificial Sequence
  Synthetic
atacgccatgctgggtctccctggaagatggagcctatagaatcaagcaaaaagggattcttggatattcccagatcggagccggagtttacaaagaaggaacattccatacaatgtggccgtacttgggagtcggccat

SEQ ID NO: 372078 - DNA, 140 bp, Artificial Sequence
  Synthetic
atggccgactcccaagtacggccacattgtatggaatgttccttctttgtaaactccggctccgatctgggaatatccaagaatccctttttgcttgattctataggctccatcttccagggagacccagcatggcgtat

SEQ ID NO: 372079 - DNA, 140 bp, Artificial Sequence
  Synthetic
aggccctggctgctgatatgcttctcaggcagaatgaaccagaagacatagactgctggtgcaactccacgtccacatgggtaacttatgggacatgcactgccacaggagaacacagaagaccttttgggacagcggtg

SEQ ID NO: 372080 - DNA, 140 bp, Artificial Sequence
  Synthetic
caccgctgtcccaaaaggtcttctgtgttctcctgtggcagtgcatgtcccataagttacccatgtggacgtggagttgcaccagcagtctatgtcttctggttcattctgcctgagaagcatatcagcagccagggcct

SEQ ID NO: 372081 - DNA, 140 bp, Artificial Sequence
  Synthetic
atacgccatgctgggtctccagcctggaaaaaatccaagagccgtccaaacaaaacctggtcttttcaaaaccaacgccggaaccataggtgccgtatctctggacttttctcctggaaccgtacttgggagtcggccat

SEQ ID NO: 372082 - DNA, 140 bp, Artificial Sequence
  Synthetic
atggccgactcccaagtacggttccaggagaaaagtccagagatacggcacctatggttccggcgttggttttgaaaagaccaggttttgtttggacggctcttggattttttccaggctggagacccagcatggcgtat

SEQ ID NO: 372083 - DNA, 140 bp, Artificial Sequence
  Synthetic
atacgccatgctgggtctccctcaggatctccaatcatcgacaaaaaaggaaaagttgtgggtctttatggtaatggtgttgttacaaggagtggagcatatgtgagtgctatagcccagcgtacttgggagtcggccat

SEQ ID NO: 372084 - DNA, 140 bp, Artificial Sequence
  Synthetic
atggccgactcccaagtacgctgggctatagcactcacatatgctccactccttgtaacaacaccattaccataaagacccacaacttttccttttttgtcgatgattggagatcctgagggagacccagcatggcgtat

SEQ ID NO: 372085 - DNA, 140 bp, Artificial Sequence
  Synthetic
aggccctggctgctgatatgagagataccttccggccatagtcagagaggctataaaacggggcctgaggacattaatcctggcccccactagagtcgtggcagctgaaatggaggaagcgaccttttgggacagcggtg

SEQ ID NO: 372086 - DNA, 140 bp, Artificial Sequence
  Synthetic
caccgctgtcccaaaaggtcgcttcctccatttcagctgccacgactctagtgggggccaggattaatgtcctcaggccccgttttatagcctctctgactatggccggaaggtatctctcatatcagcagccagggcct

SEQ ID NO: 372087 - DNA, 140 bp, Artificial Sequence
  Synthetic
aggccctggctgctgatatgcagctgaaggcatcaactacgcagacagaaggtggtgttttgatggaattaagaacaaccaaatcttggaagaaaatgtggaggtggaaatctggacaaagaccttttgggacagcggtg

SEQ ID NO: 372088 - DNA, 140 bp, Artificial Sequence
  Synthetic
caccgctgtcccaaaaggtctttgtccagatttccacctccacattttcttccaagatttggttgttcttaattccatcaaaacaccaccttctgtctgcgtagttgatgccttcagctgcatatcagcagccagggcct

SEQ ID NO: 372089 - DNA, 140 bp, Artificial Sequence
  Synthetic
aggccctggctgctgatatgactctgacccactggcgctaaaggaattcaaggagtttgcagctggaagaaagtccctgaccctgaacctaatcacagaaatgggtaggcttccaactttgaccttttgggacagcggtg

SEQ ID NO: 372090 - DNA, 140 bp, Artificial Sequence
  Synthetic
caccgctgtcccaaaaggtcaaagttggaagcctacccatttctgtgattaggttcagggtcagggactttcttccagctgcaaactccttgaattcctttagcgccagtgggtcagagtcatatcagcagccagggcct

SEQ ID NO: 372091 - DNA, 140 bp, Artificial Sequence
  Synthetic
atacgccatgctgggtctcccatgactcagaaggcaagagacgcactggacaacttagcagtgctgcacacggctgaagcaggtggaagggcgtacaatcatgctctcagtgaactgccgcgtacttgggagtcggccat

SEQ ID NO: 372092 - DNA, 140 bp, Artificial Sequence
  Synthetic
atggccgactcccaagtacgcggcagttcactgagagcatgattgtacgcccttccacctgcttcagccgtgtgcagcactgctaagttgtccagtgcgtctcttgccttctgagtcatgggagacccagcatggcgtat

SEQ ID NO: 372093 - DNA, 140 bp, Artificial Sequence
  Synthetic
aggccctggctgctgatatgagctattgccaaccaagccacagtgttaatgggtcttgggaaaggatggccattgtcaaagatggacatcggagttccccttctcgccattggatgctacgaccttttgggacagcggtg

SEQ ID NO: 372094 - DNA, 140 bp, Artificial Sequence
  Synthetic
caccgctgtcccaaaaggtcgtagcatccaatggcgagaaggggaactccgatgtccatctttgacaatggccatcctttcccaagacccattaacactgtggcttggttggcaatagctcatatcagcagccagggcct

SEQ ID NO: 372095 - DNA, 140 bp, Artificial Sequence
  Synthetic
aggccctggctgctgatatgctcagaaaagagcagcagcgggcatcatgaaaaacccaactgtcgatggaataacagtgattgacctagatccaataccctatgatccaaagtttgaaaagaccttttgggacagcggtg

SEQ ID NO: 372096 - DNA, 140 bp, Artificial Sequence
  Synthetic
caccgctgtcccaaaaggtcttttcaaactttggatcatagggtattggatctaggtcaatcactgttattccatcgacagttgggtttttcatgatgcccgctgctgctcttttctgagcatatcagcagccagggcct

SEQ ID NO: 372097 - DNA, 140 bp, Artificial Sequence
  Synthetic
aggccctggctgctgatatgctggacttctcttttccatcatgaagaacacaaccaacacgagaaggggaactggcaacataggagagacgcttggagagaaatggaaaagccgattgaagaccttttgggacagcggtg

SEQ ID NO: 372098 - DNA, 140 bp, Artificial Sequence
  Synthetic
caccgctgtcccaaaaggtcttcaatcggcttttccatttctctccaagcgtctctcctatgttgccagttccccttctcgtgttggttgtgttcttcatgatggaaaagagaagtccagcatatcagcagccagggcct

SEQ ID NO: 372099 - DNA, 140 bp, Artificial Sequence
  Synthetic
aggccctggctgctgatatgactggcaacataggagagacgcttggagagaaatggaaaagccgattgaacgcattggggaaaagtgaattccagatctacaagaaaagtggaatccagggaccttttgggacagcggtg

SEQ ID NO: 372100 - DNA, 140 bp, Artificial Sequence
  Synthetic
caccgctgtcccaaaaggtccctggattccacttttcttgtagatctggaattcacttttccccaatgcgttcaatcggcttttccatttctctccaagcgtctctcctatgttgccagtcatatcagcagccagggcct

SEQ ID NO: 372101 - DNA, 140 bp, Artificial Sequence
  Synthetic
aggccctggctgctgatatgaagtggatagaaccttagcaaaagaaggcattaaaagaggagaaacggaccatcacgctgtgtcgcgaggctcagcaaaactgagatggttcgtcgagaggaccttttgggacagcggtg

SEQ ID NO: 372102 - DNA, 140 bp, Artificial Sequence
  Synthetic
caccgctgtcccaaaaggtcctctcgacgaaccatctcagttttgctgagcctcgcgacacagcgtgatggtccgtttctcctcttttaatgccttcttttgctaaggttctatccacttcatatcagcagccagggcct

SEQ ID NO: 372103 - DNA, 140 bp, Artificial Sequence
  Synthetic
aggccctggctgctgatatgccaaatcccacggtagaagcaggacgaacactcagagtccttaacttagtggaaaattggttgaacaacaacacccaattttgcataaaggttctcaaccgaccttttgggacagcggtg

SEQ ID NO: 372104 - DNA, 140 bp, Artificial Sequence
  Synthetic
caccgctgtcccaaaaggtcggttgagaacctttatgcaaaattgggtgttgttgttcaaccaattttccactaagttaaggactctgagtgttcgtcctgcttctaccgtgggatttggcatatcagcagccagggcct

SEQ ID NO: 372105 - DNA, 140 bp, Artificial Sequence
  Synthetic
atacgccatgctgggtctcctttcaaggatgttgatcaacagattcacaatgagacacaagaaagccacttacgagccagatgtagacctcggaagcggaacccgcaacatcggaattgacgtacttgggagtcggccat

SEQ ID NO: 372106 - DNA, 140 bp, Artificial Sequence
  Synthetic
atggccgactcccaagtacgtcaattccgatgttgcgggttccgcttccgaggtctacatctggctcgtaagtggctttcttgtgtctcattgtgaatctgttgatcaacatccttgaaaggagacccagcatggcgtat

SEQ ID NO: 372107 - DNA, 140 bp, Artificial Sequence
  Synthetic
aggccctggctgctgatatgaacaagagcatgaaacatcatggcactatgaccaagaccacccatacaaaacgtgggcttaccatggcagctatgaaacaaaacaaactggatcagcatcgaccttttgggacagcggtg

SEQ ID NO: 372108 - DNA, 140 bp, Artificial Sequence
  Synthetic
caccgctgtcccaaaaggtcgatgctgatccagtttgttttgtttcatagctgccatggtaagcccacgttttgtatgggtggtcttggtcatagtgccatgatgtttcatgctcttgttcatatcagcagccagggcct

SEQ ID NO: 372109 - DNA, 140 bp, Artificial Sequence
  Synthetic
aggccctggctgctgatatggaaaggttaggaaagacatacaacaatgggaaccttcaagaggatggaacgattggacacaagtgcccttctgttcacaccatttccatgagttaatcatgaccttttgggacagcggtg

SEQ ID NO: 372110 - DNA, 140 bp, Artificial Sequence
  Synthetic
caccgctgtcccaaaaggtcatgattaactcatggaaatggtgtgaacagaagggcacttgtgtccaatcgttccatcctcttgaaggttcccattgttgtatgtctttcctaacctttccatatcagcagccagggcct

SEQ ID NO: 372111 - DNA, 140 bp, Artificial Sequence
  Synthetic
atacgccatgctgggtctccgaaagacggccgcgtacttgtagttccatgcagaaaccaagatgaactgattggtagagcccgaatttcccaaggagctgggtggtctttgcgagagacgcgtacttgggagtcggccat

SEQ ID NO: 372112 - DNA, 140 bp, Artificial Sequence
  Synthetic
atggccgactcccaagtacgcgtctctcgcaaagaccacccagctccttgggaaattcgggctctaccaatcagttcatcttggtttctgcatggaactacaagtacgcggccgtctttcggagacccagcatggcgtat

SEQ ID NO: 372113 - DNA, 140 bp, Artificial Sequence
  Synthetic
atacgccatgctgggtctccgaatggatgacaacggaagacatgctgacagtctggaacagggtgtggattcaagaaaacccatggatggaagacaaaactccagtggaatcatgggaggcgtacttgggagtcggccat

SEQ ID NO: 372114 - DNA, 140 bp, Artificial Sequence
  Synthetic
atggccgactcccaagtacgcctcccatgattccactggagttttgtcttccatccatgggttttcttgaatccacaccctgttccagactgtcagcatgtcttccgttgtcatccattcggagacccagcatggcgtat

SEQ ID NO: 372115 - DNA, 140 bp, Artificial Sequence
  Synthetic
aggccctggctgctgatatgtcaagaaaacccatggatggaagacaaaactccagtggaatcatgggaggaaatcccatacttggggaaaagagaagaccaatggtgcggctcattgattgaccttttgggacagcggtg

SEQ ID NO: 372116 - DNA, 140 bp, Artificial Sequence
  Synthetic
caccgctgtcccaaaaggtcaatcaatgagccgcaccattggtcttctcttttccccaagtatgggatttcctcccatgattccactggagttttgtcttccatccatgggttttcttgacatatcagcagccagggcct

SEQ ID NO: 372117 - DNA, 140 bp, Artificial Sequence
  Synthetic
atacgccatgctgggtctcctagctccacctgagaaggtgtaaaaaatctgggaggccacaaaccatggaagctgtacgcatggcgtagtggactagcggttagaggagacccctcccttcgtacttgggagtcggccat

SEQ ID NO: 372118 - DNA, 140 bp, Artificial Sequence
  Synthetic
atggccgactcccaagtacgaagggaggggtctcctctaaccgctagtccactacgccatgcgtacagcttccatggtttgtggcctcccagattttttacaccttctcaggtggagctaggagacccagcatggcgtat

SEQ ID NO: 372119 - DNA, 140 bp, Artificial Sequence
  Synthetic
aggccctggctgctgatatggaacctatgtgagctccatagcccaaacagagaaaagtgtagaggacaatccagagattgaagatgatatatttcggaagaaaaggttaaccatcatggagaccttttgggacagcggtg

SEQ ID NO: 372120 - DNA, 140 bp, Artificial Sequence
  Synthetic
caccgctgtcccaaaaggtctccatgatggttaaccttttcttccgaaatatatcatcttcaatctctggattgtcctctacacttttctctgtttgggctatggagctcacataggttccatatcagcagccagggcct

SEQ ID NO: 372121 - DNA, 140 bp, Artificial Sequence
  Synthetic
atacgccatgctgggtctccgaagtggcatttttgtcactaatgaagtccacacttggacagagcaatacaaattccaggctgactccccaaaaagactgtcagcagccattggaaaggccgtacttgggagtcggccat

SEQ ID NO: 372122 - DNA, 140 bp, Artificial Sequence
  Synthetic
atggccgactcccaagtacggcctttccaatggctgctgacagtctttttggggagtcagcctggaatttgtattgctctgtccaagtgtggacttcattagtgacaaaaatgccacttcggagacccagcatggcgtat

SEQ ID NO: 372123 - DNA, 140 bp, Artificial Sequence
  Synthetic
atacgccatgctgggtctcctggtgttgctgcaaatggaaaataaagcttggctggtgcacaggcaatggttcctagacctgccgttgccatggctgcccggagcggacacacaaggatccgtacttgggagtcggccat

SEQ ID NO: 372124 - DNA, 140 bp, Artificial Sequence
  Synthetic
atggccgactcccaagtacggatccttgtgtgtccgctccgggcagccatggcaacggcaggtctaggaaccattgcctgtgcaccagccaagctttattttccatttgcagcaacaccaggagacccagcatggcgtat

SEQ ID NO: 372125 - DNA, 140 bp, Artificial Sequence
  Synthetic
atacgccatgctgggtctccgtccacatatggatggaacatagttaagttaatgagtggaaaggatgtgttttatcttccacctgaaaagtgtgacaccctgttgtgtgacattggagaacgtacttgggagtcggccat

SEQ ID NO: 372126 - DNA, 140 bp, Artificial Sequence
  Synthetic
atggccgactcccaagtacgttctccaatgtcacacaacagggtgtcacacttttcaggtggaagataaaacacatcctttccactcattaacttaactatgttccatccatatgtggacggagacccagcatggcgtat

SEQ ID NO: 372127 - DNA, 140 bp, Artificial Sequence
  Synthetic
aggccctggctgctgatatgagcaatggagttttggaaagtgaaatgataatcccaaagatatatggaggaccaatatctcagcacaactacagaccagggtatttcacacaaacagcaggaccttttgggacagcggtg

SEQ ID NO: 372128 - DNA, 140 bp, Artificial Sequence
  Synthetic
caccgctgtcccaaaaggtcctgctgtttgtgtgaaataccctggtctgtagttgtgctgagatattggtcctccatatatctttgggattatcatttcactttccaaaactccattgctcatatcagcagccagggcct

SEQ ID NO: 372129 - DNA, 140 bp, Artificial Sequence
  Synthetic
atacgccatgctgggtctccaaaacgtgggcttaccatggatcttatgaagtcaaagccacaggctcagcctcctccatgataaatggagtcgtgaaactcctcactaaaccatgggatgcgtacttgggagtcggccat

SEQ ID NO: 372130 - DNA, 140 bp, Artificial Sequence
  Synthetic
atggccgactcccaagtacgcatcccatggtttagtgaggagtttcacgactccatttatcatggaggaggctgagcctgtggctttgacttcataagatccatggtaagcccacgttttggagacccagcatggcgtat

SEQ ID NO: 372131 - DNA, 140 bp, Artificial Sequence
  Synthetic
atacgccatgctgggtctcctgggaatgtgctgcataatcacggctagtattctcctatggtacgcacaaatacagccacactggatagcagcttcaataatactggagttttttctcatcgtacttgggagtcggccat

SEQ ID NO: 372132 - DNA, 140 bp, Artificial Sequence
  Synthetic
atggccgactcccaagtacgatgagaaaaaactccagtattattgaagctgctatccagtgtggctgtatttgtgcgtaccataggagaatactagccgtgattatgcagcacattcccaggagacccagcatggcgtat

SEQ ID NO: 372133 - DNA, 140 bp, Artificial Sequence
  Synthetic
atacgccatgctgggtctcccctacgtggaccgacaaagacagattctttgagggagctaagctcaacgtagttctaacagtttttaattagagagcagatctctgatgaataaccaacgcgtacttgggagtcggccat

SEQ ID NO: 372134 - DNA, 140 bp, Artificial Sequence
  Synthetic
atggccgactcccaagtacgcgttggttattcatcagagatctgctctctaattaaaaactgttagaactacgttgagcttagctccctcaaagaatctgtctttgtcggtccacgtaggggagacccagcatggcgtat

SEQ ID NO: 372135 - DNA, 140 bp, Artificial Sequence
  Synthetic
aggccctggctgctgatatgtcgagaaccctcatctgccagagaagaaaattacacaatggttggaaaccaaaggagtggagaggttaaaaagaatggccattagcggggatgattgcgtgaccttttgggacagcggtg

SEQ ID NO: 372136 - DNA, 140 bp, Artificial Sequence
  Synthetic
caccgctgtcccaaaaggtcacgcaatcatccccgctaatggccattctttttaacctctccactcctttggtttccaaccattgtgtaattttcttctctggcagatgagggttctcgacatatcagcagccagggcct

SEQ ID NO: 372137 - DNA, 140 bp, Artificial Sequence
  Synthetic
aggccctggctgctgatatgtttcctaacaatcccaccaacagcagggatactaaaaagatggggaacgatcaaaaaatcaaaagctatcaatgtcttgagagggttcaggaaagagattgaccttttgggacagcggtg

SEQ ID NO: 372138 - DNA, 140 bp, Artificial Sequence
  Synthetic
caccgctgtcccaaaaggtcaatctctttcctgaaccctctcaagacattgatagcttttgattttttgatcgttccccatctttttagtatccctgctgttggtgggattgttaggaaacatatcagcagccagggcct

SEQ ID NO: 372139 - DNA, 140 bp, Artificial Sequence
  Synthetic
aggccctggctgctgatatgggaaggatgctgaacatcttgaacaggagacgcaggacagcaggcgtgattgttatgttgattccaacagcgatggcgttccatttaaccacacgcaatggaccttttgggacagcggtg

SEQ ID NO: 372140 - DNA, 140 bp, Artificial Sequence
  Synthetic
caccgctgtcccaaaaggtccattgcgtgtggttaaatggaacgccatcgctgttggaatcaacataacaatcacgcctgctgtcctgcgtctcctgttcaagatgttcagcatccttcccatatcagcagccagggcct

SEQ ID NO: 372141 - DNA, 140 bp, Artificial Sequence
  Synthetic
atacgccatgctgggtctccgtcaggaaagttgatacatgaatggtgttgccgctcgtgcacacttcctcccctgcgatacatgggagaagacggctgttggtatggcatggaaatcagacgtacttgggagtcggccat

SEQ ID NO: 372142 - DNA, 140 bp, Artificial Sequence
  Synthetic
atggccgactcccaagtacgtctgatttccatgccataccaacagccgtcttctcccatgtatcgcaggggaggaagtgtgcacgagcggcaacaccattcatgtatcaactttcctgacggagacccagcatggcgtat

SEQ ID NO: 372143 - DNA, 140 bp, Artificial Sequence
  Synthetic
atacgccatgctgggtctccggcaaggaaatcaaaataacaccacagagttccatcacagaagcagaactgacaggctatggcactgtcacgatggagtgctctccgagaacgggcctcgcgtacttgggagtcggccat

SEQ ID NO: 372144 - DNA, 140 bp, Artificial Sequence
  Synthetic
atggccgactcccaagtacgcgaggcccgttctcggagagcactccatcgtgacagtgccatagcctgtcagttctgcttctgtgatggaactctgtggtgttattttgatttccttgccggagacccagcatggcgtat

SEQ ID NO: 372145 - DNA, 140 bp, Artificial Sequence
  Synthetic
atacgccatgctgggtctcccagaacatactctgatccactggccctgcgcgagtttaaagagtttgcagcaggaagaagaagtgtctcaggtgacctaatattggaaatagggaaacttcgtacttgggagtcggccat

SEQ ID NO: 372146 - DNA, 140 bp, Artificial Sequence
  Synthetic
atggccgactcccaagtacgaagtttccctatttccaatattaggtcacctgagacacttcttcttcctgctgcaaactctttaaactcgcgcagggccagtggatcagagtatgttctgggagacccagcatggcgtat

SEQ ID NO: 372147 - DNA, 140 bp, Artificial Sequence
  Synthetic
atacgccatgctgggtctcctctttgaagaggtgatgagaggaaaatttgggaagaaacacatgattgcaggggttttcttcacgtttgtgctccttctctcagggcaaataacatggagcgtacttgggagtcggccat

SEQ ID NO: 372148 - DNA, 140 bp, Artificial Sequence
  Synthetic
atggccgactcccaagtacgctccatgttatttgccctgagagaaggagcacaaacgtgaagaaaacccctgcaatcatgtgtttcttcccaaattttcctctcatcacctcttcaaagaggagacccagcatggcgtat

SEQ ID NO: 372149 - DNA, 140 bp, Artificial Sequence
  Synthetic
atacgccatgctgggtctccgagaatctgatgtggaaacaaataacaccagaattgaatcatattctatcagaaaatgaggtaaagttgaccattatgacaggagacattaaaggaatcacgtacttgggagtcggccat

SEQ ID NO: 372150 - DNA, 140 bp, Artificial Sequence
  Synthetic
atggccgactcccaagtacgtgattcctttaatgtctcctgtcataatggtcaactttacctcattttctgatagaatatgattcaattctggtgttatttgtttccacatcagattctcggagacccagcatggcgtat

SEQ ID NO: 372151 - DNA, 140 bp, Artificial Sequence
  Synthetic
aggccctggctgctgatatgctactgacactcctggcagcagtcacaggaggaatcttcttattcttaatgagcggaaaaggtatagggaagatgactctgggaatgtgttgcataatcagaccttttgggacagcggtg

SEQ ID NO: 372152 - DNA, 140 bp, Artificial Sequence
  Synthetic
caccgctgtcccaaaaggtctgattatgcaacacattcccagagtcatcttccctataccttttccgctcattaagaataagaagattcctcctgtgactgctgccaggagtgtcagtagcatatcagcagccagggcct

SEQ ID NO: 372153 - DNA, 140 bp, Artificial Sequence
  Synthetic
aggccctggctgctgatatggcagagagaattcactcagtggagtggaaggagaaggactgcacaaacttggatacatactcagagacatatcaaagattccagggggaaatatgtatgcgaccttttgggacagcggtg

SEQ ID NO: 372154 - DNA, 140 bp, Artificial Sequence
  Synthetic
caccgctgtcccaaaaggtcgcatacatatttccccctggaatctttgatatgtctctgagtatgtatccaagtttgtgcagtccttctccttccactccactgagtgaattctctctgccatatcagcagccagggcct

SEQ ID NO: 372155 - DNA, 140 bp, Artificial Sequence
  Synthetic
aggccctggctgctgatatgcttgggcatgatggtcctcaaaatagtgagaaatatggaaaaataccaattggcagtgactatcatggctatttcgtgtgtcccaaatgcagtgatactggaccttttgggacagcggtg

SEQ ID NO: 372156 - DNA, 140 bp, Artificial Sequence
  Synthetic
caccgctgtcccaaaaggtccagtatcactgcatttgggacacacgaaatagccatgatagtcactgccaattggtatttttccatatttctcactattttgaggaccatcatgcccaagcatatcagcagccagggcct

SEQ ID NO: 372157 - DNA, 140 bp, Artificial Sequence
  Synthetic
aggccctggctgctgatatgtggcagtgactatcatggctatttcgtgtgtcccaaatgcagtgatactgcaaaacgcatggaaggtgagttgcacaatattggcagcggtgtccgtttcgaccttttgggacagcggtg

SEQ ID NO: 372158 - DNA, 140 bp, Artificial Sequence
  Synthetic
caccgctgtcccaaaaggtcgaaacggacaccgctgccaatattgtgcaactcaccttccatgcgttttgcagtatcactgcatttgggacacacgaaatagccatgatagtcactgccacatatcagcagccagggcct

SEQ ID NO: 372159 - DNA, 140 bp, Artificial Sequence
  Synthetic
atacgccatgctgggtctcccaaaacgcatggaaggtgagttgcacaatattggcagcggtgtccgtttcaccactgctcttaacatcctcacagcagaaagcggattggataccactggcgtacttgggagtcggccat

SEQ ID NO: 372160 - DNA, 140 bp, Artificial Sequence
  Synthetic
atggccgactcccaagtacgccagtggtatccaatccgctttctgctgtgaggatgttaagagcagtggtgaaacggacaccgctgccaatattgtgcaactcaccttccatgcgttttgggagacccagcatggcgtat

SEQ ID NO: 372161 - DNA, 140 bp, Artificial Sequence
  Synthetic
aggccctggctgctgatatgctaggcaaatcatatgcacaaatgtggcagctgatgtacttccacaggagagacctgagactagccgctaatgccatctgttcagccgttccagttgattgaccttttgggacagcggtg

SEQ ID NO: 372162 - DNA, 140 bp, Artificial Sequence
  Synthetic
caccgctgtcccaaaaggtcaatcaactggaacggctgaacagatggcattagcggctagtctcaggtctctcctgtggaagtacatcagctgccacatttgtgcatatgatttgcctagcatatcagcagccagggcct

SEQ ID NO: 372163 - DNA, 140 bp, Artificial Sequence
  Synthetic
atacgccatgctgggtctccccatgacaggtccattagtggctggagggctccttaccgtatgttacgtgctcactggacgatcggccgatttggaactggagagagctgccgatgtaaacgtacttgggagtcggccat

SEQ ID NO: 372164 - DNA, 140 bp, Artificial Sequence
  Synthetic
atggccgactcccaagtacgtttacatcggcagctctctccagttccaaatcggccgatcgtccagtgagcacgtaacatacggtaaggagccctccagccactaatggacctgtcatggggagacccagcatggcgtat

SEQ ID NO: 372165 - DNA, 140 bp, Artificial Sequence
  Synthetic
atacgccatgctgggtctccgagggaaaagtggtgcaatatgagaacctcaaatacaccgtcatcattacagtgcacacaggagatcaacaccaggtgggaaatgaaacgcagggagtcacgtacttgggagtcggccat

SEQ ID NO: 372166 - DNA, 140 bp, Artificial Sequence
  Synthetic
atggccgactcccaagtacgtgactccctgcgtttcatttcccacctggtgttgatctcctgtgtgcactgtaatgatgacggtgtatttgaggttctcatattgcaccacttttccctcggagacccagcatggcgtat

SEQ ID NO: 372167 - DNA, 140 bp, Artificial Sequence
  Synthetic
aggccctggctgctgatatgaggaggctggaagctagaaggagaatggaaggaaggagaggaagtccaagtcctggcattggaacctggaaaaaatccaagagccgtccaaacgaaacctgaccttttgggacagcggtg

SEQ ID NO: 372168 - DNA, 140 bp, Artificial Sequence
  Synthetic
caccgctgtcccaaaaggtcaggtttcgtttggacggctcttggattttttccaggttccaatgccaggacttggacttcctctccttccttccattctccttctagcttccagcctcctcatatcagcagccagggcct

SEQ ID NO: 372169 - DNA, 140 bp, Artificial Sequence
  Synthetic
aggccctggctgctgatatgttcccctggaacgtcaggatctccaattgtcgacagaaaaggaaaagttgtgggtctttacggtaatggtgttgtcacaaggagtggagcatatgtaagtgaccttttgggacagcggtg

SEQ ID NO: 372170 - DNA, 140 bp, Artificial Sequence
  Synthetic
caccgctgtcccaaaaggtcacttacatatgctccactccttgtgacaacaccattaccgtaaagacccacaacttttccttttctgtcgacaattggagatcctgacgttccaggggaacatatcagcagccagggcct

SEQ ID NO: 372171 - DNA, 140 bp, Artificial Sequence
  Synthetic
aggccctggctgctgatatgtcacacaaacagcagggccatggcacctaggcaagttggaattggattttgacttgtgtgaaggtaccacagttgttgtggatgaacattgtggatatcggaccttttgggacagcggtg

SEQ ID NO: 372172 - DNA, 140 bp, Artificial Sequence
  Synthetic
caccgctgtcccaaaaggtccgatatccacaatgttcatccacaacaactgtggtaccttcacacaagtcaaaatccaattccaacttgcctaggtgccatggccctgctgtttgtgtgacatatcagcagccagggcct

SEQ ID NO: 372173 - DNA, 140 bp, Artificial Sequence
  Synthetic
atacgccatgctgggtctccgaaggcgcctggaaacaaatacaaagagtggagacttgggctttgagacacccaggattcacggtgatagcccttttcttagcacatgccataggaacatcgtacttgggagtcggccat

SEQ ID NO: 372174 - DNA, 140 bp, Artificial Sequence
  Synthetic
atggccgactcccaagtacgatgttcctatggcatgtgctaagaaaagggctatcaccgtgaatcctgggtgtctcaaagcccaagtctccactctttgtatttgtttccaggcgccttcggagacccagcatggcgtat

SEQ ID NO: 372175 - DNA, 140 bp, Artificial Sequence
  Synthetic
aggccctggctgctgatatgctagagccaatgattgggactttgtggtcacaactgacatttcagaaatgggtgccaacttcaaggctgagagggttatagaccccagacgttgcatgaagaccttttgggacagcggtg

SEQ ID NO: 372176 - DNA, 140 bp, Artificial Sequence
  Synthetic
caccgctgtcccaaaaggtcttcatgcaacgtctggggtctataaccctctcagccttgaagttggcacccatttctgaaatgtcagttgtgaccacaaagtcccaatcattggctctagcatatcagcagccagggcct

SEQ ID NO: 372177 - DNA, 140 bp, Artificial Sequence
  Synthetic
atacgccatgctgggtctcctcaccaccatggcaaaaaataaaccaaccttggacattgaactcttgaagacggaggtcacgaaccctgccgtcttgcgcaaactgtgcattgaagctaacgtacttgggagtcggccat

SEQ ID NO: 372178 - DNA, 140 bp, Artificial Sequence
  Synthetic
atggccgactcccaagtacgttagcttcaatgcacagtttgcgcaagacggcagggttcgtgacctccgtcttcaagagttcaatgtccaaggttggtttattttttgccatggtggtgaggagacccagcatggcgtat

SEQ ID NO: 372179 - DNA, 140 bp, Artificial Sequence
  Synthetic
atacgccatgctgggtctccaagtcgattaaacgcactgggaaaaagtgaatttcaagtctacaagaaaagtggaatccaggaagtggatagaaccctagcaaaagaaggtatcaaaagacgtacttgggagtcggccat

SEQ ID NO: 372180 - DNA, 140 bp, Artificial Sequence
  Synthetic
atggccgactcccaagtacgtcttttgataccttcttttgctagggttctatccacttcctggattccacttttcttgtagacttgaaattcactttttcccagtgcgtttaatcgacttggagacccagcatggcgtat

SEQ ID NO: 372181 - DNA, 140 bp, Artificial Sequence
  Synthetic
atacgccatgctgggtctccaaaacccaagtaggagttggagtacagaaagaaggagtcttccacaccatgtggcacgttacaagaggggcagtgttgacatacaatgggaaaagactggcgtacttgggagtcggccat

SEQ ID NO: 372182 - DNA, 140 bp, Artificial Sequence
  Synthetic
atggccgactcccaagtacgccagtcttttcccattgtatgtcaacactgcccctcttgtaacgtgccacatggtgtggaagactccttctttctgtactccaactcctacttgggttttggagacccagcatggcgtat

SEQ ID NO: 372183 - DNA, 140 bp, Artificial Sequence
  Synthetic
aggccctggctgctgatatggtcacaggaaagataatccatgaatggtgttgcagatcctgcacgttaccccccttacgcttcagaggagaagacggatgttggtatggcatggaaatcagaccttttgggacagcggtg

SEQ ID NO: 372184 - DNA, 140 bp, Artificial Sequence
  Synthetic
caccgctgtcccaaaaggtctgatttccatgccataccaacatccgtcttctcctctgaagcgtaaggggggtaacgtgcaggatctgcaacaccattcatggattatctttcctgtgaccatatcagcagccagggcct

SEQ ID NO: 372185 - DNA, 140 bp, Artificial Sequence
  Synthetic
atacgccatgctgggtctcccagtgaacatgatttcaaggatgttgattaacagattcacaatgaaacacaagaaagccacttacgagccagatgttgacctaggaagtggaacccgcaacgtacttgggagtcggccat

SEQ ID NO: 372186 - DNA, 140 bp, Artificial Sequence
  Synthetic
atggccgactcccaagtacgttgcgggttccacttcctaggtcaacatctggctcgtaagtggctttcttgtgtttcattgtgaatctgttaatcaacatccttgaaatcatgttcactgggagacccagcatggcgtat

SEQ ID NO: 372187 - DNA, 140 bp, Artificial Sequence
  Synthetic
atacgccatgctgggtctcctcagcaaaactgagatggttcgtcgagagaaacatggtcacaccggaagggaaggtggtggatcttggttgcggcagagggggctggtcatactattgtgcgtacttgggagtcggccat

SEQ ID NO: 372188 - DNA, 140 bp, Artificial Sequence
  Synthetic
atggccgactcccaagtacgcacaatagtatgaccagccccctctgccgcaaccaagatccaccaccttcccttccggtgtgaccatgtttctctcgacgaaccatctcagttttgctgaggagacccagcatggcgtat

SEQ ID NO: 372189 - DNA, 140 bp, Artificial Sequence
  Synthetic
aggccctggctgctgatatgacaccagttatggaccaccctattgtctctaacatttatcagaacatctctttcattggattatgcatggaagacaatggccatggcactgtcaatcgtagaccttttgggacagcggtg

SEQ ID NO: 372190 - DNA, 140 bp, Artificial Sequence
  Synthetic
caccgctgtcccaaaaggtctacgattgacagtgccatggccattgtcttccatgcataatccaatgaaagagatgttctgataaatgttagagacaatagggtggtccataactggtgtcatatcagcagccagggcct

SEQ ID NO: 372191 - DNA, 140 bp, Artificial Sequence
  Synthetic
atacgccatgctgggtctcccaaagaggcagtgggcaagtcggcacctatggccttaatactttcaccaatatggaagcccaattaattagacagatggagggagaaggaatcttcaaaacgtacttgggagtcggccat

SEQ ID NO: 372192 - DNA, 140 bp, Artificial Sequence
  Synthetic
atggccgactcccaagtacgttttgaagattccttctccctccatctgtctaattaattgggcttccatattggtgaaagtattaaggccataggtgccgacttgcccactgcctctttgggagacccagcatggcgtat

SEQ ID NO: 372193 - DNA, 140 bp, Artificial Sequence
  Synthetic
atacgccatgctgggtctccctagcgtgaaaaaagatctgatttcatacggaggaggatggagattgagcgcacaatggcaaaagggggaggaggtgcaggttattgccgtagagcctggcgtacttgggagtcggccat

SEQ ID NO: 372194 - DNA, 140 bp, Artificial Sequence
  Synthetic
atggccgactcccaagtacgccaggctctacggcaataacctgcacctcctcccccttttgccattgtgcgctcaatctccatcctcctccgtatgaaatcagatcttttttcacgctagggagacccagcatggcgtat

SEQ ID NO: 372195 - DNA, 140 bp, Artificial Sequence
  Synthetic
aggccctggctgctgatatgcagggtgtggatccaagaaaacccgtggatggaagataaaactccagtggaatcatgggaagaagtcccatacttggggaagagagaagaccaatggtgcgaccttttgggacagcggtg

SEQ ID NO: 372196 - DNA, 140 bp, Artificial Sequence
  Synthetic
caccgctgtcccaaaaggtcgcaccattggtcttctctcttccccaagtatgggacttcttcccatgattccactggagttttatcttccatccacgggttttcttggatccacaccctgcatatcagcagccagggcct

SEQ ID NO: 372197 - DNA, 140 bp, Artificial Sequence
  Synthetic
atacgccatgctgggtctccggctcattgattgggctaacaagcagggctacctgggcaaagaacatccaaacagcaataaatcaagtcagatcccttataggcaatgaggaatacacagcgtacttgggagtcggccat

SEQ ID NO: 372198 - DNA, 140 bp, Artificial Sequence
  Synthetic
atggccgactcccaagtacgctgtgtattcctcattgcctataagggatctgacttgatttattgctgtttggatgttctttgcccaggtagccctgcttgttagcccaatcaatgagccggagacccagcatggcgtat

SEQ ID NO: 372199 - DNA, 140 bp, Artificial Sequence
  Synthetic
aggccctggctgctgatatgcaccactttcatgaattgattatgaaagatggaagaaagttggtggtcccctgcagacctcaggacgaattaatagggagagcaagaatctctcagggaggaccttttgggacagcggtg

SEQ ID NO: 372200 - DNA, 140 bp, Artificial Sequence
  Synthetic
caccgctgtcccaaaaggtcctccctgagagattcttgctctccctattaattcgtcctgaggtctgcaggggaccaccaactttcttccatctttcataatcaattcatgaaagtggtgcatatcagcagccagggcct

SEQ ID NO: 372201 - DNA, 140 bp, Artificial Sequence
  Synthetic
aggccctggctgctgatatgacaaaaatgccacagcttgagtaaactgtgcagcctgtagctccacctgaggaggtgtaaaaaacctgggaggccacaaaccatggaagctgtacgcatggaccttttgggacagcggtg

SEQ ID NO: 372202 - DNA, 140 bp, Artificial Sequence
  Synthetic
caccgctgtcccaaaaggtccatgcgtacagcttccatggtttgtggcctcccaggttttttacacctcctcaggtggagctacaggctgcacagtttactcaagctgtggcatttttgtcatatcagcagccagggcct

SEQ ID NO: 372203 - DNA, 140 bp, Artificial Sequence
  Synthetic
aggccctggctgctgatatgctagcatatgtggtgataggtttgttattcatgatactgacagtggcagccaatgagatgggattattggaaaccacaaagagagacctggggattggccgaccttttgggacagcggtg

SEQ ID NO: 372204 - DNA, 140 bp, Artificial Sequence
  Synthetic
caccgctgtcccaaaaggtcggccaatccccaggtctctctttgtggtttccaataatcccatctcattggctgccactgtcagtatcatgaataacaaacctatcaccacatatgctagcatatcagcagccagggcct

SEQ ID NO: 372205 - DNA, 140 bp, Artificial Sequence
  Synthetic
atacgccatgctgggtctccttaagaagggaagttccatcggccaaatgtttgagacaacaatgagaggagcaaagagaatggccattttaggtgacacagcctgggactttggatccctcgtacttgggagtcggccat

SEQ ID NO: 372206 - DNA, 140 bp, Artificial Sequence
  Synthetic
atggccgactcccaagtacgagggatccaaagtcccaggctgtgtcacctaaaatggccattctctttgctcctctcattgttgtctcaaacatttggccgatggaacttcccttcttaaggagacccagcatggcgtat

SEQ ID NO: 372207 - DNA, 140 bp, Artificial Sequence
  Synthetic
atacgccatgctgggtctccgggaggagtgtttacatctataggaaaggctctccaccaagttttcggagcaatctatggggctgcctttagtggggtctcatggactatgaaaatcctccgtacttgggagtcggccat

SEQ ID NO: 372208 - DNA, 140 bp, Artificial Sequence
  Synthetic
atggccgactcccaagtacggaggattttcatagtccatgagaccccactaaaggcagccccatagattgctccgaaaacttggtggagagcctttcctatagatgtaaacactcctcccggagacccagcatggcgtat

SEQ ID NO: 372209 - DNA, 140 bp, Artificial Sequence
  Synthetic
atacgccatgctgggtctcccgatagcagtgtccatggcaaacatcttcaggggaagttatctagcaggagcaggtctggctttctcattgatgaaatctttaggaggaggtaggagaggcgtacttgggagtcggccat

SEQ ID NO: 372210 - DNA, 140 bp, Artificial Sequence
  Synthetic
atggccgactcccaagtacgcctctcctacctcctcctaaagatttcatcaatgagaaagccagacctgctcctgctagataacttcccctgaagatgtttgccatggacactgctatcgggagacccagcatggcgtat

SEQ ID NO: 372211 - DNA, 140 bp, Artificial Sequence
  Synthetic
atacgccatgctgggtctccaacgaaacatgcaatactgctagtcgcagtatcttttgtgacattgattactgggaacatgtcttttagagacctgggaagagtgatggttatggtgggccgtacttgggagtcggccat

SEQ ID NO: 372212 - DNA, 140 bp, Artificial Sequence
  Synthetic
atggccgactcccaagtacggcccaccataaccatcactcttcccaggtctctaaaagacatgttcccagtaatcaatgtcacaaaagatactgcgactagcagtattgcatgtttcgttggagacccagcatggcgtat

SEQ ID NO: 372213 - DNA, 140 bp, Artificial Sequence
  Synthetic
aggccctggctgctgatatgtggaaccatggctcagaggaaaccaattctgcataaaaatcctaaatccttacatgccaagtgtggtagaaactctggagcaaatgcaaagaaaacatgggaccttttgggacagcggtg

SEQ ID NO: 372214 - DNA, 140 bp, Artificial Sequence
  Synthetic
caccgctgtcccaaaaggtcccatgttttctttgcatttgctccagagtttctaccacacttggcatgtaaggatttaggatttttatgcagaattggtttcctctgagccatggttccacatatcagcagccagggcct

SEQ ID NO: 372215 - DNA, 140 bp, Artificial Sequence
  Synthetic
atacgccatgctgggtctcccccatggtcacacaaatagctatgactgataccacaccctttggacaacagagagtgtttaaagagaaagttgacacgcgcacaccaagagcaaaacgagcgtacttgggagtcggccat

SEQ ID NO: 372216 - DNA, 140 bp, Artificial Sequence
  Synthetic
atggccgactcccaagtacgctcgttttgctcttggtgtgcgcgtgtcaactttctctttaaacactctctgttgtccaaagggtgtggtatcagtcatagctatttgtgtgaccatgggggagacccagcatggcgtat

SEQ ID NO: 372217 - DNA, 140 bp, Artificial Sequence
  Synthetic
atacgccatgctgggtctccaaatgatgaagactgtgcacattggaaagaagctaaaatgctcctagataacatcaacacacccgaaggaatcattcctagtatgttcgaaccagagcgtcgtacttgggagtcggccat

SEQ ID NO: 372218 - DNA, 140 bp, Artificial Sequence
  Synthetic
atggccgactcccaagtacgacgctctggttcgaacatactaggaatgattccttcgggtgtgttgatgttatctaggagcattttagcttctttccaatgtgcacagtcttcatcatttggagacccagcatggcgtat

SEQ ID NO: 372219 - DNA, 140 bp, Artificial Sequence
  Synthetic
atacgccatgctgggtctcccgacttcgccgggaaaacggtgtggtttgtccccagcatcaaagccggaaatgacatagcaaactgcttgcgaaagaacgggaaaaaggtcattcaacttcgtacttgggagtcggccat

SEQ ID NO: 372220 - DNA, 140 bp, Artificial Sequence
  Synthetic
atggccgactcccaagtacgaagttgaatgacctttttcccgttctttcgcaagcagtttgctatgtcatttccggctttgatgctggggacaaaccacaccgttttcccggcgaagtcgggagacccagcatggcgtat

SEQ ID NO: 372221 - DNA, 140 bp, Artificial Sequence
  Synthetic
aggccctggctgctgatatgaaaagcgaaatctaaccataatggatctccatcctgggtcaggaaagacacggaaataccttccagctattgttagagaggcaatcaagagacgtttaaggaccttttgggacagcggtg

SEQ ID NO: 372222 - DNA, 140 bp, Artificial Sequence
  Synthetic
caccgctgtcccaaaaggtccttaaacgtctcttgattgcctctctaacaatagctggaaggtatttccgtgtctttcctgacccaggatggagatccattatggttagatttcgcttttcatatcagcagccagggcct

SEQ ID NO: 372223 - DNA, 140 bp, Artificial Sequence
  Synthetic
atacgccatgctgggtctccggggagtcgtcaccaaatcccacgatagaagcaggacgaacactcagagtcctcaacttagtggaaaattggttgaacaataacacccaattttgcataacgtacttgggagtcggccat

SEQ ID NO: 372224 - DNA, 140 bp, Artificial Sequence
  Synthetic
atggccgactcccaagtacgttatgcaaaattgggtgttattgttcaaccaattttccactaagttgaggactctgagtgttcgtcctgcttctatcgtgggatttggtgacgactccccggagacccagcatggcgtat

SEQ ID NO: 372225 - DNA, 140 bp, Artificial Sequence
  Synthetic
atacgccatgctgggtctccacagctcatgcaaagaaacaggaagtagtcgtactgggatcacaggaaggagcaatgcacactgcgttgactggggcgacagaaatccagacgtcaggaacgtacttgggagtcggccat

SEQ ID NO: 372226 - DNA, 140 bp, Artificial Sequence
  Synthetic
atggccgactcccaagtacgttcctgacgtctggatttctgtcgccccagtcaacgcagtgtgcattgctccttcctgtgatcccagtacgactacttcctgtttctttgcatgagctgtggagacccagcatggcgtat

SEQ ID NO: 372227 - DNA, 140 bp, Artificial Sequence
  Synthetic
atacgccatgctgggtctcctggacgacaagaacagtttcgactcggaagcttgcttaacgtagtgctaactagttttttattagagagcagatctctgatgaacaaccaacggaagaagcgtacttgggagtcggccat

SEQ ID NO: 372228 - DNA, 140 bp, Artificial Sequence
  Synthetic
atggccgactcccaagtacgcttcttccgttggttgttcatcagagatctgctctctaataaaaaactagttagcactacgttaagcaagcttccgagtcgaaactgttcttgtcgtccaggagacccagcatggcgtat

SEQ ID NO: 372229 - DNA, 140 bp, Artificial Sequence
  Synthetic
aggccctggctgctgatatgtttcgatgacgtgcattgcagttggcatggttacactatacctaggagtcatggttcaagcggactcgggatgtgtaatcaactggaagggcagagaactgaccttttgggacagcggtg

SEQ ID NO: 372230 - DNA, 140 bp, Artificial Sequence
  Synthetic
caccgctgtcccaaaaggtcagttctctgcccttccagttgattacacatcccgagtccgcttgaaccatgactcctaggtatagtgtaaccatgccaactgcaatgcacgtcatcgaaacatatcagcagccagggcct

SEQ ID NO: 372231 - DNA, 140 bp, Artificial Sequence
  Synthetic
aggccctggctgctgatatgaatcaattatcccggaaagactttgacctctacaagaaatctggaatcactgaagtggatagaacagaagccaaagaagggttgaaaagaggagaaataagaccttttgggacagcggtg

SEQ ID NO: 372232 - DNA, 140 bp, Artificial Sequence
  Synthetic
caccgctgtcccaaaaggtcttatttctcctcttttcaacccttctttggcttctgttctatccacttcagtgattccagatttcttgtagaggtcaaagtctttccgggataattgattcatatcagcagccagggcct

SEQ ID NO: 372233 - DNA, 140 bp, Artificial Sequence
  Synthetic
atacgccatgctgggtctccgaaggggccatgcacacggcactcacaggggccacagaaatccagatgtcatcagggaacttactgttcacaggacatctcaagtgcaggctgagaatggcgtacttgggagtcggccat

SEQ ID NO: 372234 - DNA, 140 bp, Artificial Sequence
  Synthetic
atggccgactcccaagtacgccattctcagcctgcacttgagatgtcctgtgaacagtaagttccctgatgacatctggatttctgtggcccctgtgagtgccgtgtgcatggccccttcggagacccagcatggcgtat

SEQ ID NO: 372235 - DNA, 140 bp, Artificial Sequence
  Synthetic
aggccctggctgctgatatgtgatattagttgtggtgaccaccctttgtgccatcattttaggaggtcttacatggatggacttactgcgtgcccttatcatgctaggggacaccatgtcgaccttttgggacagcggtg

SEQ ID NO: 372236 - DNA, 140 bp, Artificial Sequence
  Synthetic
caccgctgtcccaaaaggtcgacatggtgtcccctagcatgataagggcacgcagtaagtccatccatgtaagacctcctaaaatgatggcacaaagggtggtcaccacaactaatatcacatatcagcagccagggcct

SEQ ID NO: 372237 - DNA, 140 bp, Artificial Sequence
  Synthetic
atacgccatgctgggtctccgggcccgagcactgagggaagctgtacctccttgcaaaggactagaggttagaggagaccccccgcaaataaaacagcatattgacgctgggagagaccacgtacttgggagtcggccat

SEQ ID NO: 372238 - DNA, 140 bp, Artificial Sequence
  Synthetic
atggccgactcccaagtacgtggtctctcccagcgtcaatatgctgttttatttgcggggggtctcctctaacctctagtcctttgcaaggaggtacagcttccctcagtgctcgggcccggagacccagcatggcgtat

SEQ ID NO: 372239 - DNA, 140 bp, Artificial Sequence
  Synthetic
aggccctggctgctgatatgttggtcatgttgcacaattccgaacaaggaggaaaagcctatagacatgccatggaggaactaccagacaccatagaaacattgatgcttctagctttgagaccttttgggacagcggtg

SEQ ID NO: 372240 - DNA, 140 bp, Artificial Sequence
  Synthetic
caccgctgtcccaaaaggtctcaaagctagaagcatcaatgtttctatggtgtctggtagttcctccatggcatgtctataggcttttcctccttgttcggaattgtgcaacatgaccaacatatcagcagccagggcct

SEQ ID NO: 372241 - DNA, 140 bp, Artificial Sequence
  Synthetic
atacgccatgctgggtctccgggaagaggattgaaccatcatgggcagatgtcaagaaagacctaatatcatatggaggaggctggaagctagaaggagaatggaaggaaggagaggaagcgtacttgggagtcggccat

SEQ ID NO: 372242 - DNA, 140 bp, Artificial Sequence
  Synthetic
atggccgactcccaagtacgcttcctctccttccttccattctccttctagcttccagcctcctccatatgatattaggtctttcttgacatctgcccatgatggttcaatcctcttcccggagacccagcatggcgtat

SEQ ID NO: 372243 - DNA, 140 bp, Artificial Sequence
  Synthetic
atacgccatgctgggtctccaagttgtgggtctttacggcaatggtgttgtcacaaggagtggagcatatgtaagtgctatagcccagaccgaaaaaagcattgaagacaatccagagatcgtacttgggagtcggccat

SEQ ID NO: 372244 - DNA, 140 bp, Artificial Sequence
  Synthetic
atggccgactcccaagtacgatctctggattgtcttcaatgcttttttcggtctgggctatagcacttacatatgctccactccttgtgacaacaccattgccgtaaagacccacaacttggagacccagcatggcgtat

SEQ ID NO: 372245 - DNA, 140 bp, Artificial Sequence
  Synthetic
atacgccatgctgggtctccttataaactggaaaggcaaagaactcaaatgtggaagtggaatcttcgtcaccaacgaggtccatacctggacagaacaatacaaattccaagcagactccgtacttgggagtcggccat

SEQ ID NO: 372246 - DNA, 140 bp, Artificial Sequence
  Synthetic
atggccgactcccaagtacggagtctgcttggaatttgtattgttctgtccaggtatggacctcgttggtgacgaagattccacttccacatttgagttctttgcctttccagtttataaggagacccagcatggcgtat

SEQ ID NO: 372247 - DNA, 140 bp, Artificial Sequence
  Synthetic
atacgccatgctgggtctcctggtgttttgatggaattaagaacaaccaaatactggaagaaaatatggaagtggaaatctggacaaaagaaggggaaaggaaaaaattaaaacccagatcgtacttgggagtcggccat

SEQ ID NO: 372248 - DNA, 140 bp, Artificial Sequence
  Synthetic
atggccgactcccaagtacgatctgggttttaattttttcctttccccttcttttgtccagatttccacttccatattttcttccagtatttggttgttcttaattccatcaaaacaccaggagacccagcatggcgtat

SEQ ID NO: 372249 - DNA, 140 bp, Artificial Sequence
  Synthetic
atacgccatgctgggtctcccgatacatgggagaagacggttgctggtatggcatggaaatcagacccatcagtgagaaagaagagaacatggtaaagtctttagtctcagcgggaagtgcgtacttgggagtcggccat

SEQ ID NO: 372250 - DNA, 140 bp, Artificial Sequence
  Synthetic
atggccgactcccaagtacgcacttcccgctgagactaaagactttaccatgttctcttctttctcactgatgggtctgatttccatgccataccagcaaccgtcttctcccatgtatcgggagacccagcatggcgtat

SEQ ID NO: 372251 - DNA, 140 bp, Artificial Sequence
  Synthetic
atacgccatgctgggtctcctggcgcacacactaataatgattgggtccaacgcatctgacaggatgggaatgggcgtcacctacctagctttaattgcaacatttaaaattcagccattcgtacttgggagtcggccat

SEQ ID NO: 372252 - DNA, 140 bp, Artificial Sequence
  Synthetic
atggccgactcccaagtacgaatggctgaattttaaatgttgcaattaaagctaggtaggtgacgcccattcccatcctgtcagatgcgttggacccaatcattattagtgtgtgcgccaggagacccagcatggcgtat

SEQ ID NO: 372253 - DNA, 140 bp, Artificial Sequence
  Synthetic
aggccctggctgctgatatgctgggacaggtcatgctcctggttttgtgtgcagttcaactgttgttaatgagaacatcatgggccttgtgtgaagctttaactttagctacaggaccaagaccttttgggacagcggtg

SEQ ID NO: 372254 - DNA, 140 bp, Artificial Sequence
  Synthetic
caccgctgtcccaaaaggtcttggtcctgtagctaaagttaaagcttcacacaaggcccatgatgttctcattaacaacagttgaactgcacacaaaaccaggagcatgacctgtcccagcatatcagcagccagggcct

SEQ ID NO: 372255 - DNA, 140 bp, Artificial Sequence
  Synthetic
atacgccatgctgggtctccgtaaaatgaagtcaggccgaaagccacggattgagcaagccgtgctgcctgtggctccatcgtggggatgtaactccatcgtggggatgtagctccatcgcgtacttgggagtcggccat

SEQ ID NO: 372256 - DNA, 140 bp, Artificial Sequence
  Synthetic
atggccgactcccaagtacgcgatggagctacatccccacgatggagttacatccccacgatggagccacaggcagcacggcttgctcaatccgtggctttcggcctgacttcattttacggagacccagcatggcgtat

SEQ ID NO: 372257 - DNA, 140 bp, Artificial Sequence
  Synthetic
aggccctggctgctgatatgttggagcacgcttcttagagtttgaagccctaggattcttgaatgaagatcactggttctccagagggaactccctgagtggagtggaaggagaagggctgaccttttgggacagcggtg

SEQ ID NO: 372258 - DNA, 140 bp, Artificial Sequence
  Synthetic
caccgctgtcccaaaaggtcagcccttctccttccactccactcagggagttccctctggagaaccagtgatcttcattcaagaatcctagggcttcaaactctaagaagcgtgctccaacatatcagcagccagggcct

SEQ ID NO: 372259 - DNA, 140 bp, Artificial Sequence
  Synthetic
aggccctggctgctgatatgtttgctgatgctggtgacaccatcaatggccatgcgatgcgtgggaataggcaacagagacttcgttgaaggactgtcaggagcaacgtgggtggacgtggaccttttgggacagcggtg

SEQ ID NO: 372260 - DNA, 140 bp, Artificial Sequence
  Synthetic
caccgctgtcccaaaaggtccacgtccacccacgttgctcctgacagtccttcaacgaagtctctgttgcctattcccacgcatcgcatggccattgatggtgtcaccagcatcagcaaacatatcagcagccagggcct

SEQ ID NO: 372261 - DNA, 140 bp, Artificial Sequence
  Synthetic
aggccctggctgctgatatgcagctctaaatgacatgggaaaagttagaaaagacatacaacaatgggaaccttcaagaggatggaacgattggacacaagtgcctttctgttcacaccagaccttttgggacagcggtg

SEQ ID NO: 372262 - DNA, 140 bp, Artificial Sequence
  Synthetic
caccgctgtcccaaaaggtctggtgtgaacagaaaggcacttgtgtccaatcgttccatcctcttgaaggttcccattgttgtatgtcttttctaacttttcccatgtcatttagagctgcatatcagcagccagggcct

SEQ ID NO: 372263 - DNA, 140 bp, Artificial Sequence
  Synthetic
aggccctggctgctgatatgtcacaaatgccacggcttgagtaaaccgtgcagcctgtagctccacctgaggaggtgtaaaaaacctgggaggccacaaaccatggaagctgtacgcatggaccttttgggacagcggtg

SEQ ID NO: 372264 - DNA, 140 bp, Artificial Sequence
  Synthetic
caccgctgtcccaaaaggtccatgcgtacagcttccatggtttgtggcctcccaggttttttacacctcctcaggtggagctacaggctgcacggtttactcaagccgtggcatttgtgacatatcagcagccagggcct

SEQ ID NO: 372265 - DNA, 140 bp, Artificial Sequence
  Synthetic
aggccctggctgctgatatgaggtcccaagtaggagtgggagttttccaagacggcgtgttccacacaatgtggcacgtcaccaggggagctgtccttatgtaccaagggaagaggctgggaccttttgggacagcggtg

SEQ ID NO: 372266 - DNA, 140 bp, Artificial Sequence
  Synthetic
caccgctgtcccaaaaggtcccagcctcttcccttggtacataaggacagctcccctggtgacgtgccacattgtgtggaacacgccgtcttggaaaactcccactcctacttgggacctcatatcagcagccagggcct

SEQ ID NO: 372267 - DNA, 140 bp, Artificial Sequence
  Synthetic
atacgccatgctgggtctccaactgtggaagctgtacgcacagtgtagcagactagcggttagaggacgaccccctcccatgacacaacgcagcagcggggcccgagcactgagggaagccgtacttgggagtcggccat

SEQ ID NO: 372268 - DNA, 140 bp, Artificial Sequence
  Synthetic
atggccgactcccaagtacggcttccctcagtgctcgggccccgctgctgcgttgtgtcatgggagggggtcgtcctctaaccgctagtctgctacactgtgcgtacagcttccacagttggagacccagcatggcgtat

SEQ ID NO: 372269 - DNA, 140 bp, Artificial Sequence
  Synthetic
aggccctggctgctgatatgttgaaacctggatcttgagacatccaggttttaccataatggcagcaatcctggcatacaccataggaacgacacatttccaaagggccttgattttcatgaccttttgggacagcggtg

SEQ ID NO: 372270 - DNA, 140 bp, Artificial Sequence
  Synthetic
caccgctgtcccaaaaggtcatgaaaatcaaggccctttggaaatgtgtcgttcctatggtgtatgccaggattgctgccattatggtaaaacctggatgtctcaagatccaggtttcaacatatcagcagccagggcct

SEQ ID NO: 372271 - DNA, 140 bp, Artificial Sequence
  Synthetic
atacgccatgctgggtctcctactgaacaggttcacgatgacacacagaagacctaccattgagaaagatgtggatttaggagcaggaactcgacatgttaatgcggaaccagaaacacccgtacttgggagtcggccat

SEQ ID NO: 372272 - DNA, 140 bp, Artificial Sequence
  Synthetic
atggccgactcccaagtacgggtgtttctggttccgcattaacatgtcgagttcctgctcctaaatccacatctttctcaatggtaggtcttctgtgtgtcatcgtgaacctgttcagtaggagacccagcatggcgtat

SEQ ID NO: 372273 - DNA, 140 bp, Artificial Sequence
  Synthetic
atacgccatgctgggtctccaacatggaaggaaaagtcgtgcagccagaaaatttggaatacaccatcgtgataacacctcactcaggagaagagcacgctgtaggtaatgacacaggaacgtacttgggagtcggccat

SEQ ID NO: 372274 - DNA, 140 bp, Artificial Sequence
  Synthetic
atggccgactcccaagtacgttcctgtgtcattacctacagcgtgctcttctcctgagtgaggtgttatcacgatggtgtattccaaattttctggctgcacgacttttccttccatgttggagacccagcatggcgtat

SEQ ID NO: 372275 - DNA, 140 bp, Artificial Sequence
  Synthetic
atacgccatgctgggtctccaaagagaaagtggacaccaggacacccaggtccatgccaggaacaagaagggtcatggggatcacagcggagtggctctggagaaccctgggaaggaacacgtacttgggagtcggccat

SEQ ID NO: 372276 - DNA, 140 bp, Artificial Sequence
  Synthetic
atggccgactcccaagtacgtgttccttcccagggttctccagagccactccgctgtgatccccatgacccttcttgttcctggcatggacctgggtgtcctggtgtccactttctctttggagacccagcatggcgtat

SEQ ID NO: 372277 - DNA, 140 bp, Artificial Sequence
  Synthetic
atacgccatgctgggtctcccattggattatgcatggaaaacaacggctatggcactgtcaatcgtatctctctttcctttatgcctgtctacgacctcccaaaaaacaacatggcttcccgtacttgggagtcggccat

SEQ ID NO: 372278 - DNA, 140 bp, Artificial Sequence
  Synthetic
atggccgactcccaagtacgggaagccatgttgttttttgggaggtcgtagacaggcataaaggaaagagagatacgattgacagtgccatagccgttgttttccatgcataatccaatgggagacccagcatggcgtat

SEQ ID NO: 372279 - DNA, 140 bp, Artificial Sequence
  Synthetic
aggccctggctgctgatatgttccaagatacccggaggagccatgtatgctgatgacacagctggttgggacacaagaataacagaggatgacctgcacaatgaggaaaagatcacacaggaccttttgggacagcggtg

SEQ ID NO: 372280 - DNA, 140 bp, Artificial Sequence
  Synthetic
caccgctgtcccaaaaggtcctgtgtgatcttttcctcattgtgcaggtcatcctctgttattcttgtgtcccaaccagctgtgtcatcagcatacatggctcctccgggtatcttggaacatatcagcagccagggcct

SEQ ID NO: 372281 - DNA, 140 bp, Artificial Sequence
  Synthetic
aggccctggctgctgatatgaagccttataggcaatgaagagtttctggactacatgccttcaatgaagagatttaggaaggaggaggagtcggagggagccatttggtaaacgtaggaagaccttttgggacagcggtg

SEQ ID NO: 372282 - DNA, 140 bp, Artificial Sequence
  Synthetic
caccgctgtcccaaaaggtcttcctacgtttaccaaatggctccctccgactcctcctccttcctaaatctcttcattgaaggcatgtagtccagaaactcttcattgcctataaggcttcatatcagcagccagggcct

SEQ ID NO: 372283 - DNA, 140 bp, Artificial Sequence
  Synthetic
aggccctggctgctgatatgagcggccagagggtacatctcaacccgagtgggcatgggtgaagcagctgcgatcttcatgacagccactcccccaggatcggtggaggcctttccacaggaccttttgggacagcggtg

SEQ ID NO: 372284 - DNA, 140 bp, Artificial Sequence
  Synthetic
caccgctgtcccaaaaggtcctgtggaaaggcctccaccgatcctgggggagtggctgtcatgaagatcgcagctgcttcacccatgcccactcgggttgagatgtaccctctggccgctcatatcagcagccagggcct

SEQ ID NO: 372285 - DNA, 140 bp, Artificial Sequence
  Synthetic
aggccctggctgctgatatgccaacctatctttggcagccattgccaaccaagcagctgtcctaatgggacttgggaaaggatggccgctccacagaatggacctcggcgtgccgctgctgaccttttgggacagcggtg

SEQ ID NO: 372286 - DNA, 140 bp, Artificial Sequence
  Synthetic
caccgctgtcccaaaaggtcagcagcggcacgccgaggtccattctgtggagcggccatcctttcccaagtcccattaggacagctgcttggttggcaatggctgccaaagataggttggcatatcagcagccagggcct

SEQ ID NO: 372287 - DNA, 140 bp, Artificial Sequence
  Synthetic
atacgccatgctgggtctcccgacaagaacagtttcgactcggaagcttgcttaacgtagtgctaacagtttttattagagagcagatctctgatgaacaaccaacggaagaagacgggacgtacttgggagtcggccat

SEQ ID NO: 372288 - DNA, 140 bp, Artificial Sequence
  Synthetic
atggccgactcccaagtacgtcccgtcttcttccgttggttgttcatcagagatctgctctctaataaaaactgttagcactacgttaagcaagcttccgagtcgaaactgttcttgtcgggagacccagcatggcgtat

SEQ ID NO: 372289 - DNA, 140 bp, Artificial Sequence
  Synthetic
atacgccatgctgggtctcccgctgttgtggatggccagtgtggagccccattggatagcggcctccatcatactagagttctttttgatggtgctgcttattccagagccagacagacacgtacttgggagtcggccat

SEQ ID NO: 372290 - DNA, 140 bp, Artificial Sequence
  Synthetic
atggccgactcccaagtacgtgtctgtctggctctggaataagcagcaccatcaaaaagaactctagtatgatggaggccgctatccaatggggctccacactggccatccacaacagcgggagacccagcatggcgtat

SEQ ID NO: 372291 - DNA, 140 bp, Artificial Sequence
  Synthetic
atacgccatgctgggtctcctgaagaaagtcactgaagtgaagggatacacaaaaggaggacctggacatgaggaacctatcccaatggcgacctatggatggaacctagtaaagctacacgtacttgggagtcggccat

SEQ ID NO: 372292 - DNA, 140 bp, Artificial Sequence
  Synthetic
atggccgactcccaagtacgtgtagctttactaggttccatccataggtcgccattgggataggttcctcatgtccaggtcctccttttgtgtatcccttcacttcagtgactttcttcaggagacccagcatggcgtat

SEQ ID NO: 372293 - DNA, 140 bp, Artificial Sequence
  Synthetic
atacgccatgctgggtctccgactctggccacaggaccaatcatgaccttgtgggagggcaacccgggaagattttggaacacaaccatagcagtatccacagccaatatttttagaggacgtacttgggagtcggccat

SEQ ID NO: 372294 - DNA, 140 bp, Artificial Sequence
  Synthetic
atggccgactcccaagtacgtcctctaaaaatattggctgtggatactgctatggttgtgttccaaaatcttcccgggttgccctcccacaaggtcatgattggtcctgtggccagagtcggagacccagcatggcgtat

SEQ ID NO: 372295 - DNA, 140 bp, Artificial Sequence
  Synthetic
aggccctggctgctgatatgccttacctagggaaaagagaggatttatggtgtggatccttgattggactctcttctagggccacctgggctaagaacattcaaacagccataacccagggaccttttgggacagcggtg

SEQ ID NO: 372296 - DNA, 140 bp, Artificial Sequence
  Synthetic
caccgctgtcccaaaaggtccctgggttatggctgtttgaatgttcttagcccaggtggccctagaagagagtccaatcaaggatccacaccataaatcctctcttttccctaggtaaggcatatcagcagccagggcct

SEQ ID NO: 372297 - DNA, 140 bp, Artificial Sequence
  Synthetic
atacgccatgctgggtctccaatgtctccctaacagccattgctaaccaagctacagtgctaatgggtcttgggaaaggatggccattgtcaaagatggacattggagttcccctccttgcgtacttgggagtcggccat

SEQ ID NO: 372298 - DNA, 140 bp, Artificial Sequence
  Synthetic
atggccgactcccaagtacgcaaggaggggaactccaatgtccatctttgacaatggccatcctttcccaagacccattagcactgtagcttggttagcaatggctgttagggagacattggagacccagcatggcgtat

SEQ ID NO: 372299 - DNA, 140 bp, Artificial Sequence
  Synthetic
atacgccatgctgggtctccggtcaatccatgcccaccaccaatggatgacaacagaagacatgttatcagtgtggaatagggtttggatagaggaaaacccatggatggaggacaaaaccgtacttgggagtcggccat

SEQ ID NO: 372300 - DNA, 140 bp, Artificial Sequence
  Synthetic
atggccgactcccaagtacggttttgtcctccatccatgggttttcctctatccaaaccctattccacactgataacatgtcttctgttgtcatccattggtggtgggcatggattgaccggagacccagcatggcgtat

SEQ ID NO: 372301 - DNA, 140 bp, Artificial Sequence
  Synthetic
atacgccatgctgggtctccggaccgacaagaacagtttcgaatcggaagcttgcttaacgtagttctaacagttttttattagagagcagatctctgatgaacaaccaacggaaaaagacgtacttgggagtcggccat

SEQ ID NO: 372302 - DNA, 140 bp, Artificial Sequence
  Synthetic
atggccgactcccaagtacgtctttttccgttggttgttcatcagagatctgctctctaataaaaaactgttagaactacgttaagcaagcttccgattcgaaactgttcttgtcggtccggagacccagcatggcgtat

SEQ ID NO: 372303 - DNA, 140 bp, Artificial Sequence
  Synthetic
atacgccatgctgggtctcccaagaaccgaaggaaggcacaaagaaactgatgaaaattacggcagagtggctttggaaagaactaggaaagaaaaagacacctaggatgtgtaccagagcgtacttgggagtcggccat

SEQ ID NO: 372304 - DNA, 140 bp, Artificial Sequence
  Synthetic
atggccgactcccaagtacgctctggtacacatcctaggtgtctttttctttcctagttctttccaaagccactctgccgtaattttcatcagtttctttgtgccttccttcggttcttgggagacccagcatggcgtat

SEQ ID NO: 372305 - DNA, 140 bp, Artificial Sequence
  Synthetic
aggccctggctgctgatatggctttggaaagaactaggaaagaaaaagacacctaggatgtgtaccagagaagaattcacaagaaaagtgagaagcaatgcagccttgggggccatattcgaccttttgggacagcggtg

SEQ ID NO: 372306 - DNA, 140 bp, Artificial Sequence
  Synthetic
caccgctgtcccaaaaggtcgaatatggcccccaaggctgcattgcttctcacttttcttgtgaattcttctctggtacacatcctaggtgtctttttctttcctagttctttccaaagccatatcagcagccagggcct

SEQ ID NO: 372307 - DNA, 140 bp, Artificial Sequence
  Synthetic
aggccctggctgctgatatgtgctgcccacagccctggcgttccatttgaccacacgagggggagagccacacatgatagttagtaagcaggaaagaggaaagtcactcttgtttaagacgaccttttgggacagcggtg

SEQ ID NO: 372308 - DNA, 140 bp, Artificial Sequence
  Synthetic
caccgctgtcccaaaaggtcgtcttaaacaagagtgactttcctctttcctgcttactaactatcatgtgtggctctccccctcgtgtggtcaaatggaacgccagggctgtgggcagcacatatcagcagccagggcct

SEQ ID NO: 372309 - DNA, 140 bp, Artificial Sequence
  Synthetic
atacgccatgctgggtctcctgggacgtgttctcaaaccggcgaacaccgacgagacaaacgttccgtggcactggccccacacgtgggacttggtctagaaacaagaaccgaaacatggcgtacttgggagtcggccat

SEQ ID NO: 372310 - DNA, 140 bp, Artificial Sequence
  Synthetic
atggccgactcccaagtacgccatgtttcggttcttgtttctagaccaagtcccacgtgtggggccagtgccacggaacgtttgtctcgtcggtgttcgccggtttgagaacacgtcccaggagacccagcatggcgtat

SEQ ID NO: 372311 - DNA, 140 bp, Artificial Sequence
  Synthetic
atacgccatgctgggtctccacaaaatgccacagcttgagtaaactgtgcagcctgtagctccacctgaggaggtgtaaaaaacctgggaggccacaaaccatggaagctgtacgcatggcgtacttgggagtcggccat

SEQ ID NO: 372312 - DNA, 140 bp, Artificial Sequence
  Synthetic
atggccgactcccaagtacgccatgcgtacagcttccatggtttgtggcctcccaggttttttacacctcctcaggtggagctacaggctgcacagtttactcaagctgtggcattttgtggagacccagcatggcgtat

SEQ ID NO: 372313 - DNA, 140 bp, Artificial Sequence
  Synthetic
atacgccatgctgggtctcctctcacttggaatgctgcaaggacgcggaccattaaaactgttcatggcccttgtggcgttccttcgtttcctaacaatcccaccaacagcagggatactcgtacttgggagtcggccat

SEQ ID NO: 372314 - DNA, 140 bp, Artificial Sequence
  Synthetic
atggccgactcccaagtacgagtatccctgctgttggtgggattgttaggaaacgaaggaacgccacaagggccatgaacagttttaatggtccgcgtccttgcagcattccaagtgagaggagacccagcatggcgtat

SEQ ID NO: 372315 - DNA, 140 bp, Artificial Sequence
  Synthetic
aggccctggctgctgatatggcggactcgggatgtgtaatcaactggaagggcagagaactcaaatgtggaagtggcatttttgtcactaatgaagtccacacttggacagagcaatacagaccttttgggacagcggtg

SEQ ID NO: 372316 - DNA, 140 bp, Artificial Sequence
  Synthetic
caccgctgtcccaaaaggtctgtattgctctgtccaagtgtggacttcattagtgacaaaaatgccacttccacatttgagttctctgcccttccagttgattacacatcccgagtccgccatatcagcagccagggcct

SEQ ID NO: 372317 - DNA, 140 bp, Artificial Sequence
  Synthetic
atacgccatgctgggtctccatggcagcaatcctggcatacaccataggaacgacacatttccaaagggccttgattttcatcttactgacagctgtcgctccttcaatgacaatgcgctcgtacttgggagtcggccat

SEQ ID NO: 372318 - DNA, 140 bp, Artificial Sequence
  Synthetic
atggccgactcccaagtacgagcgcattgtcattgaaggagcgacagctgtcagtaagatgaaaatcaaggccctttggaaatgtgtcgttcctatggtgtatgccaggattgctgccatggagacccagcatggcgtat

SEQ ID NO: 372319 - DNA, 140 bp, Artificial Sequence
  Synthetic
aggccctggctgctgatatgtgaaagggctcccaataaggtaccaaacaacagcaacaaaatctgaacacacaggaagagagattgttgatctaatgtgccacgcaacgttcacaatgcggaccttttgggacagcggtg

SEQ ID NO: 372320 - DNA, 140 bp, Artificial Sequence
  Synthetic
caccgctgtcccaaaaggtccgcattgtgaacgttgcgtggcacattagatcaacaatctctcttcctgtgtgttcagattttgttgctgttgtttggtaccttattgggagccctttcacatatcagcagccagggcct

SEQ ID NO: 372321 - DNA, 140 bp, Artificial Sequence
  Synthetic
aggccctggctgctgatatgtggctacccggagcggacacacaaggatcaaattggatacagaaagagacattggtcactttcaaaaatccccacgcgaagaaacaggatgtcgttgtttgaccttttgggacagcggtg

SEQ ID NO: 372322 - DNA, 140 bp, Artificial Sequence
  Synthetic
caccgctgtcccaaaaggtcaaacaacgacatcctgtttcttcgcgtggggatttttgaaagtgaccaatgtctctttctgtatccaatttgatccttgtgtgtccgctccgggtagccacatatcagcagccagggcct

SEQ ID NO: 372323 - DNA, 140 bp, Artificial Sequence
  Synthetic
aggccctggctgctgatatgtcaaaatgagaccaatgttcgctgttgggctattatttcgcagactaacatccagagaagttcttcttctcacaattggattaagcttggtggcatccgtgaccttttgggacagcggtg

SEQ ID NO: 372324 - DNA, 140 bp, Artificial Sequence
  Synthetic
caccgctgtcccaaaaggtcacggatgccaccaagcttaatccaattgtgagaagaagaacttctctggatgttagtctgcgaaataatagcccaacagcgaacattggtctcattttgacatatcagcagccagggcct

SEQ ID NO: 372325 - DNA, 140 bp, Artificial Sequence
  Synthetic
atacgccatgctgggtctcccaggaaagtttaaaattgtgaaggaaatagcagaaacacaacatggaacaatagttatcagagtacaatatgaaggggacggttctccatgtaagatccccgtacttgggagtcggccat

SEQ ID NO: 372326 - DNA, 140 bp, Artificial Sequence
  Synthetic
atggccgactcccaagtacggggatcttacatggagaaccgtccccttcatattgtactctgataactattgttccatgttgtgtttctgctatttccttcacaattttaaactttcctgggagacccagcatggcgtat

SEQ ID NO: 372327 - DNA, 140 bp, Artificial Sequence
  Synthetic
aggccctggctgctgatatgcagttaacccaatcgtaacagaaaaagatagcccagtcaacatagaagcagaacctccattcggagacagctacatcatcataggagtagagccgggacagaccttttgggacagcggtg

SEQ ID NO: 372328 - DNA, 140 bp, Artificial Sequence
  Synthetic
caccgctgtcccaaaaggtctgtcccggctctactcctatgatgatgtagctgtctccgaatggaggttctgcttctatgttgactgggctatctttttctgttacgattgggttaactgcatatcagcagccagggcct

SEQ ID NO: 372329 - DNA, 140 bp, Artificial Sequence
  Synthetic
atacgccatgctgggtctccaaaccctgggatgtgattccaatggtgactcagttggccatgacagacacaaccccttttgggcaacaaagagtgttcaaggagaaggtggataccagaacgtacttgggagtcggccat

SEQ ID NO: 372330 - DNA, 140 bp, Artificial Sequence
  Synthetic
atggccgactcccaagtacgttctggtatccaccttctccttgaacactctttgttgcccaaaaggggttgtgtctgtcatggccaactgagtcaccattggaatcacatcccagggtttggagacccagcatggcgtat

SEQ ID NO: 372331 - DNA, 140 bp, Artificial Sequence
  Synthetic
aggccctggctgctgatatgtatggaaatggagtggtgacaacaagtggaacctacgtcagtgccattgcccaagctaaagcatcacaggaagggcctctaccagagattgaggacgagggaccttttgggacagcggtg

SEQ ID NO: 372332 - DNA, 140 bp, Artificial Sequence
  Synthetic
caccgctgtcccaaaaggtccctcgtcctcaatctctggtagaggcccttcctgtgatgctttagcttgggcaatggcactgacgtaggttccacttgttgtcaccactccatttccatacatatcagcagccagggcct

SEQ ID NO: 372333 - DNA, 140 bp, Artificial Sequence
  Synthetic
atacgccatgctgggtctccggaagagcaagaatctctcaaggagcgggatggagccttaaagaaaccgcatgtctggggaaagcctacgcccaaatgtggagtctcatgtattttcacacgtacttgggagtcggccat

SEQ ID NO: 372334 - DNA, 140 bp, Artificial Sequence
  Synthetic
atggccgactcccaagtacgtgtgaaaatacatgagactccacatttgggcgtaggctttccccagacatgcggtttctttaaggctccatcccgctccttgagagattcttgctcttccggagacccagcatggcgtat

SEQ ID NO: 372335 - DNA, 140 bp, Artificial Sequence
  Synthetic
atacgccatgctgggtctcctcatggatgaagcacattttaccgatccagccagcatagcggccagagggtacatctcaacccgagtgggtatgggtgaagcagctgcgatcttcatgaccgtacttgggagtcggccat

SEQ ID NO: 372336 - DNA, 140 bp, Artificial Sequence
  Synthetic
atggccgactcccaagtacggtcatgaagatcgcagctgcttcacccatacccactcgggttgagatgtaccctctggccgctatgctggctggatcggtaaaatgtgcttcatccatgaggagacccagcatggcgtat

SEQ ID NO: 372337 - DNA, 140 bp, Artificial Sequence
  Synthetic
aggccctggctgctgatatggaagaatggagcgattaaagtgttacggggtttcaaaaaagaaatctcaaacatgttgaacataatgaacaggaggaaaagatctgtgaccatgctcctcgaccttttgggacagcggtg

SEQ ID NO: 372338 - DNA, 140 bp, Artificial Sequence
  Synthetic
caccgctgtcccaaaaggtcgaggagcatggtcacagatcttttcctcctgttcattatgttcaacatgtttgagatttcttttttgaaaccccgtaacactttaatcgctccattcttccatatcagcagccagggcct

SEQ ID NO: 372339 - DNA, 140 bp, Artificial Sequence
  Synthetic
aggccctggctgctgatatgggattggataccactggcattgacaataaaaggtctcaatccaacagccatttttctaacaactctttcgagaaccagcaagaaaaggagctggccgctagaccttttgggacagcggtg

SEQ ID NO: 372340 - DNA, 140 bp, Artificial Sequence
  Synthetic
caccgctgtcccaaaaggtctagcggccagctccttttcttgctggttctcgaaagagttgttagaaaaatggctgttggattgagaccttttattgtcaatgccagtggtatccaatcccatatcagcagccagggcct

SEQ ID NO: 372341 - DNA, 140 bp, Artificial Sequence
  Synthetic
atacgccatgctgggtctcctttaagctcacataccaaaacaaagtggtcaaagttcaacgaccgaccccaacaggcacggtaatggacatcatatctaggaaagaccaaagaggcagtgcgtacttgggagtcggccat

SEQ ID NO: 372342 - DNA, 140 bp, Artificial Sequence
  Synthetic
atggccgactcccaagtacgcactgcctctttggtctttcctagatatgatgtccattaccgtgcctgttggggtcggtcgttgaactttgaccactttgttttggtatgtgagcttaaaggagacccagcatggcgtat

SEQ ID NO: 372343 - DNA, 140 bp, Artificial Sequence
  Synthetic
atacgccatgctgggtctccgtgatctcaggagtctttccagtatcgataccaattacggcagcagcatggtacctgtgggaagtgaagaaacaacgggctggagtattgtgggacgtcccgtacttgggagtcggccat

SEQ ID NO: 372344 - DNA, 140 bp, Artificial Sequence
  Synthetic
atggccgactcccaagtacgggacgtcccacaatactccagcccgttgtttcttcacttcccacaggtaccatgctgctgccgtaattggtatcgatactggaaagactcctgagatcacggagacccagcatggcgtat

SEQ ID NO: 372345 - DNA, 140 bp, Artificial Sequence
  Synthetic
aggccctggctgctgatatgcagattctcttgatgcggaccacatgggccttgtgtgaatccatcacactggctactggacccctgaccactctctgggagggatctccaggaaaattctgaccttttgggacagcggtg

SEQ ID NO: 372346 - DNA, 140 bp, Artificial Sequence
  Synthetic
caccgctgtcccaaaaggtcagaattttcctggagatccctcccagagagtggtcaggggtccagtagccagtgtgatggattcacacaaggcccatgtggtccgcatcaagagaatctgcatatcagcagccagggcct

SEQ ID NO: 372347 - DNA, 140 bp, Artificial Sequence
  Synthetic
aggccctggctgctgatatgtgacagatggaccagagcgagtgatcctggctggaccaatgccagtcaccgcggcgagtgctgcgcaaaggagagggagagttggcaggaacccacaaaagaccttttgggacagcggtg

SEQ ID NO: 372348 - DNA, 140 bp, Artificial Sequence
  Synthetic
caccgctgtcccaaaaggtcttttgtgggttcctgccaactctccctctcctttgcgcagcactcgccgcggtgactggcattggtccagccaggatcactcgctctggtccatctgtcacatatcagcagccagggcct

SEQ ID NO: 372349 - DNA, 140 bp, Artificial Sequence
  Synthetic
aggccctggctgctgatatgcaaaacgaggcacaacacaaattatggaggtgacagccaagtggttatggggtttcctttccagaaacaaaaaacccagaatctgcacaagagaggagttgaccttttgggacagcggtg

SEQ ID NO: 372350 - DNA, 140 bp, Artificial Sequence
  Synthetic
caccgctgtcccaaaaggtcaactcctctcttgtgcagattctgggttttttgtttctggaaaggaaaccccataaccacttggctgtcacctccataatttgtgttgtgcctcgttttgcatatcagcagccagggcct

SEQ ID NO: 372351 - DNA, 140 bp, Artificial Sequence
  Synthetic
aggccctggctgctgatatggtgtgtctacaacatgatggggaagagagagaaaaaactaggagagtttggaaaggcaaaaggaagtcgtgcaatatggtacatgtggctgggagcacgcgaccttttgggacagcggtg

SEQ ID NO: 372352 - DNA, 140 bp, Artificial Sequence
  Synthetic
caccgctgtcccaaaaggtcgcgtgctcccagccacatgtaccatattgcacgacttccttttgcctttccaaactctcctagttttttctctctcttccccatcatgttgtagacacaccatatcagcagccagggcct

SEQ ID NO: 372353 - DNA, 140 bp, Artificial Sequence
  Synthetic
aggccctggctgctgatatgtttcgactcggaagcttgcttaacgtagtgctaacagtattttattagagagcagatctctgatgaacaaccaacggaagaagacgggaaaaccgtctatgaccttttgggacagcggtg

SEQ ID NO: 372354 - DNA, 140 bp, Artificial Sequence
  Synthetic
caccgctgtcccaaaaggtcatagacggttttcccgtcttcttccgttggttgttcatcagagatctgctctctaataaaatactgttagcactacgttaagcaagcttccgagtcgaaacatatcagcagccagggcct

SEQ ID NO: 372355 - DNA, 140 bp, Artificial Sequence
  Synthetic
aggccctggctgctgatatgtttggatagaggaaaacccatggatggaggacaaaactcatgtatccagttgggaagaagttccatacctagggaaaagggaagatcaatggtgtggatcgaccttttgggacagcggtg

SEQ ID NO: 372356 - DNA, 140 bp, Artificial Sequence
  Synthetic
caccgctgtcccaaaaggtcgatccacaccattgatcttcccttttccctaggtatggaacttcttcccaactggatacatgagttttgtcctccatccatgggttttcctctatccaaacatatcagcagccagggcct

SEQ ID NO: 372357 - DNA, 140 bp, Artificial Sequence
  Synthetic
atacgccatgctgggtctcctggaccgacaagaacagtttcgactcggaagcttgcttaacgtagtgctaacagttttattagagagcagatctctgatgaacaaccaacggaagaagaccgtacttgggagtcggccat

SEQ ID NO: 372358 - DNA, 140 bp, Artificial Sequence
  Synthetic
atggccgactcccaagtacggtcttcttccgttggttgttcatcagagatctgctctctaataaaactgttagcactacgttaagcaagcttccgagtcgaaactgttcttgtcggtccaggagacccagcatggcgtat

SEQ ID NO: 372359 - DNA, 140 bp, Artificial Sequence
  Synthetic
atacgccatgctgggtctccatggctgaaagagtgtggcgtcgacaggttgaagaggatggcaatcagtggagatgattgcgtggtgaagcccatagatgagaggtttagcacctccctccgtacttgggagtcggccat

SEQ ID NO: 372360 - DNA, 140 bp, Artificial Sequence
  Synthetic
atggccgactcccaagtacggagggaggtgctaaacctctcatctatgggcttcaccacgcaatcatctccactgattgccatcctcttcaacctgtcgacgccacactctttcagccatggagacccagcatggcgtat

SEQ ID NO: 372361 - DNA, 140 bp, Artificial Sequence
  Synthetic
aggccctggctgctgatatgtgaactcctgaagacggaggtcacaaaccctgccgtcctgcgcaaactgtgtatagaagctaaaatatcaaatactaccactgactcgagatgtccgacagaccttttgggacagcggtg

SEQ ID NO: 372362 - DNA, 140 bp, Artificial Sequence
  Synthetic
caccgctgtcccaaaaggtctgtcggacatctcgagtcagtggtagtatttgatattttagcttctatacacagtttgcgcaggacggcagggtttgtgacctccgtcttcaggagttcacatatcagcagccagggcct

SEQ ID NO: 372363 - DNA, 140 bp, Artificial Sequence
  Synthetic
atacgccatgctgggtctcctgttgaagatggtaggttttgggagctggttgacagggaaagaaatctccatcttgaaggaaagtgtgaaacatgtgtgtataacatgatgggaaaaagacgtacttgggagtcggccat

SEQ ID NO: 372364 - DNA, 140 bp, Artificial Sequence
  Synthetic
atggccgactcccaagtacgtctttttcccatcatgttatacacacatgtttcacactttccttcaagatggagatttctttccctgtcaaccagctcccaaaacctaccatcttcaacaggagacccagcatggcgtat

SEQ ID NO: 372365 - DNA, 140 bp, Artificial Sequence
  Synthetic
atacgccatgctgggtctcctgtgccatcatcttaggaggtctcacatggatggatttactgcgagcccttatcatgctagggaacaccatgtctagtagaatgggaggacagactcacccgtacttgggagtcggccat

SEQ ID NO: 372366 - DNA, 140 bp, Artificial Sequence
  Synthetic
atggccgactcccaagtacgggtgagtctgtcctcccattctactagacatggtgttccctagcatgataagggctcgcagtaaatccatccatgtgagacctcctaagatgatggcacaggagacccagcatggcgtat

SEQ ID NO: 372367 - DNA, 140 bp, Artificial Sequence
  Synthetic
aggccctggctgctgatatgagtcccatgcagaaaccaagatgaactgattggtagagcccgaatttcccagggagctgggtggtctttgaaggagacggcctgtttggggaagtcttacgaccttttgggacagcggtg

SEQ ID NO: 372368 - DNA, 140 bp, Artificial Sequence
  Synthetic
caccgctgtcccaaaaggtcgtaagacttccccaaacaggccgtctccttcaaagaccacccagctccctgggaaattcgggctctaccaatcagttcatcttggtttctgcatgggactcatatcagcagccagggcct

SEQ ID NO: 372369 - DNA, 140 bp, Artificial Sequence
  Synthetic
aggccctggctgctgatatgaaaccaaccttggacattgaactcttgaagacggaggtcacgaaccctgccgtcttgcgcaaactgtgcattgaagctaaaatatcaaacaccaccaccggaccttttgggacagcggtg

SEQ ID NO: 372370 - DNA, 140 bp, Artificial Sequence
  Synthetic
caccgctgtcccaaaaggtccggtggtggtgtttgatattttagcttcaatgcacagtttgcgcaagacggcagggttcgtgacctccgtcttcaagagttcaatgtccaaggttggtttcatatcagcagccagggcct

SEQ ID NO: 372371 - DNA, 140 bp, Artificial Sequence
  Synthetic
atacgccatgctgggtctccaacgcagaaccagatggaccgacaccagaattggaagaagagatgttcaaaaagcgaaatctaaccataatggatcttcatcctgggtcaggaaagacaccgtacttgggagtcggccat

SEQ ID NO: 372372 - DNA, 140 bp, Artificial Sequence
  Synthetic
atggccgactcccaagtacggtgtctttcctgacccaggatgaagatccattatggttagatttcgctttttgaacatctcttcttccaattctggtgtcggtccatctggttctgcgttggagacccagcatggcgtat

SEQ ID NO: 372373 - DNA, 140 bp, Artificial Sequence
  Synthetic
atacgccatgctgggtctccctacgtggaccgacaaagacagattctttgagggagctaagctcaacgtagttctaacagttttttaattagagagcagatctctgatgaataaccaacgcgtacttgggagtcggccat

SEQ ID NO: 372374 - DNA, 140 bp, Artificial Sequence
  Synthetic
atggccgactcccaagtacgcgttggttattcatcagagatctgctctctaattaaaaaactgttagaactacgttgagcttagctccctcaaagaatctgtctttgtcggtccacgtagggagacccagcatggcgtat

SEQ ID NO: 372375 - DNA, 140 bp, Artificial Sequence
  Synthetic
atacgccatgctgggtctccaaactaagctggttcaagaaaggaagcagcatagggaaaatgttcgaagcaactgcccgaggagcacgaaggatggctatcctgggagacaccgcatgggcgtacttgggagtcggccat

SEQ ID NO: 372376 - DNA, 140 bp, Artificial Sequence
  Synthetic
atggccgactcccaagtacgcccatgcggtgtctcccaggatagccatccttcgtgctcctcgggcagttgcttcgaacattttccctatgctgcttcctttcttgaaccagcttagtttggagacccagcatggcgtat

SEQ ID NO: 372377 - DNA, 140 bp, Artificial Sequence
  Synthetic
aggccctggctgctgatatgtcagcagccattggaaaggcatgggaggagggcgtgtgtggaattcgatcagccacgcgtcttgagaacatcatgtggaagcaaatatcaaatgaattgagaccttttgggacagcggtg

SEQ ID NO: 372378 - DNA, 140 bp, Artificial Sequence
  Synthetic
caccgctgtcccaaaaggtctcaattcatttgatatttgcttccacatgatgttctcaagacgcgtggctgatcgaattccacacacgccctcctcccatgcctttccaatggctgctgacatatcagcagccagggcct

SEQ ID NO: 372379 - DNA, 140 bp, Artificial Sequence
  Synthetic
atacgccatgctgggtctccagccacgcgtcttgagaacatcatgtggaagcaaatatcaaatgaattgaaccacattctacttgaaaatgacatgaaattcacagtggttgtaggagatcgtacttgggagtcggccat

SEQ ID NO: 372380 - DNA, 140 bp, Artificial Sequence
  Synthetic
atggccgactcccaagtacgatctcctacaaccactgtgaatttcatgtcattttcaagtagaatgtggttcaattcatttgatatttgcttccacatgatgttctcaagacgcgtggctggagacccagcatggcgtat

SEQ ID NO: 372381 - DNA, 140 bp, Artificial Sequence
  Synthetic
aggccctggctgctgatatgtggtgcaagctgatagtggttgcgttgtgagctggaaaaataaagaactgaaatgtggcagtgggatcttcattacagataacgtacacacatggacagagaccttttgggacagcggtg

SEQ ID NO: 372382 - DNA, 140 bp, Artificial Sequence
  Synthetic
caccgctgtcccaaaaggtctctgtccatgtgtgtacgttatctgtaatgaagatcccactgccacatttcagttctttatttttccagctcacaacgcaaccactatcagcttgcaccacatatcagcagccagggcct

SEQ ID NO: 372383 - DNA, 140 bp, Artificial Sequence
  Synthetic
atacgccatgctgggtctcctgaaggagttctgtaattattgacaacaaacaccaaagagaccattgaagtcaggccacttgtgccacggcttgagcaaaccgtgctgcctgtagctccgcgtacttgggagtcggccat

SEQ ID NO: 372384 - DNA, 140 bp, Artificial Sequence
  Synthetic
atggccgactcccaagtacgcggagctacaggcagcacggtttgctcaagccgtggcacaagtggcctgacttcaatggtctctttggtgtttgttgtcaataattacagaactccttcaggagacccagcatggcgtat

SEQ ID NO: 372385 - DNA, 140 bp, Artificial Sequence
  Synthetic
atacgccatgctgggtctccccaataatgggaggcgtaaaattcccagggaggccatgcgccacggaagctgtacgcgtggcatattggactagcggttagaggagacccctcccatcaccgtacttgggagtcggccat

SEQ ID NO: 372386 - DNA, 140 bp, Artificial Sequence
  Synthetic
atggccgactcccaagtacggtgatgggaggggtctcctctaaccgctagtccaatatgccacgcgtacagcttccgtggcgcatggcctccctgggaattttacgcctcccattattggggagacccagcatggcgtat

SEQ ID NO: 372387 - DNA, 140 bp, Artificial Sequence
  Synthetic
aggccctggctgctgatatgtctggtggaaggactagaggttagaggagacccccccaacacaaaaacagcatattgacgctgggaaagaccagagatcctgctgtctctgcaacatcaagaccttttgggacagcggtg

SEQ ID NO: 372388 - DNA, 140 bp, Artificial Sequence
  Synthetic
caccgctgtcccaaaaggtcttgatgttgcagagacagcaggatctctggtctttcccagcgtcaatatgctgtttttgtgttgggggggtctcctctaacctctagtccttccaccagacatatcagcagccagggcct

SEQ ID NO: 372389 - DNA, 140 bp, Artificial Sequence
  Synthetic
aggccctggctgctgatatgaccaatcatggatgaggaaagagaaatccctgagcgttcgtggaattcaggacacgaatgggtcacggattttaaggggaagactgtttggtttgttccagaccttttgggacagcggtg

SEQ ID NO: 372390 - DNA, 140 bp, Artificial Sequence
  Synthetic
caccgctgtcccaaaaggtctggaacaaaccaaacagtcttccccttaaaatccgtgacccattcgtgtcctgaattccacgaacgctcagggatttctctttcctcatccatgattggtcatatcagcagccagggcct

SEQ ID NO: 372391 - DNA, 140 bp, Artificial Sequence
  Synthetic
atacgccatgctgggtctccgaaggatggccatcctgggagacaccgcatgggacttcggctccataggaggagtgttcacgtctgtgggaaaactggtacaccagatctttggaactgccgtacttgggagtcggccat

SEQ ID NO: 372392 - DNA, 140 bp, Artificial Sequence
  Synthetic
atggccgactcccaagtacggcagttccaaagatctggtgtaccagttttcccacagacgtgaacactcctcctatggagccgaagtcccatgcggtgtctcccaggatggccatccttcggagacccagcatggcgtat

SEQ ID NO: 372393 - DNA, 140 bp, Artificial Sequence
  Synthetic
aggccctggctgctgatatgcgacagaaggtggtgctttgatggggaaaggaacaaccaggtgttggaggagaacatggacgtggagatctggacaaaggaaggagaaagaaagaaattggaccttttgggacagcggtg

SEQ ID NO: 372394 - DNA, 140 bp, Artificial Sequence
  Synthetic
caccgctgtcccaaaaggtccaatttctttctttctccttcctttgtccagatctccacgtccatgttctcctccaacacctggttgttcctttccccatcaaagcaccaccttctgtcgcatatcagcagccagggcct

SEQ ID NO: 372395 - DNA, 140 bp, Artificial Sequence
  Synthetic
atacgccatgctgggtctcccacgctttctagagtttgaagcccttggcttcatgaatgaagaccactggttcagtagggagaattcactcagtggagtggaaggagaaggactatataacgtacttgggagtcggccat

SEQ ID NO: 372396 - DNA, 140 bp, Artificial Sequence
  Synthetic
atggccgactcccaagtacgttatatagtccttctccttccactccactgagtgaattctccctactgaaccagtggtcttcattcatgaagccaagggcttcaaactctagaaagcgtgggagacccagcatggcgtat

SEQ ID NO: 372397 - DNA, 140 bp, Artificial Sequence
  Synthetic
aggccctggctgctgatatgtcaagggttggtgaagagattctcaaccggacttttctccgggaaaggacctttgcggatggtgctagcattcatcacgtttttgcgggtcctttccatcgaccttttgggacagcggtg

SEQ ID NO: 372398 - DNA, 140 bp, Artificial Sequence
  Synthetic
caccgctgtcccaaaaggtcgatggaaaggacccgcaaaaacgtgatgaatgctagcaccatccgcaaaggtcctttcccggagaaaagtccggttgagaatctcttcaccaacccttgacatatcagcagccagggcct

SEQ ID NO: 372399 - DNA, 140 bp, Artificial Sequence
  Synthetic
atacgccatgctgggtctccgatgtacttccacagacgtgacctcagactggcggcaaatgccatttgctcggcagtcccgtcacattgggttccaacaagtcgaacaacctggtccatacgtacttgggagtcggccat

SEQ ID NO: 372400 - DNA, 140 bp, Artificial Sequence
  Synthetic
atggccgactcccaagtacgtatggaccaggttgttcgacttgttggaacccaatgtgacgggactgccgagcaaatggcatttgccgccagtctgaggtcacgtctgtggaagtacatcggagacccagcatggcgtat

SEQ ID NO: 372401 - DNA, 140 bp, Artificial Sequence
  Synthetic
aggccctggctgctgatatgtaaatactttcaccaatatggaggtccaactaataagacaaatggagtctgaaggaatctttttacccagcgaattggaaacccccaatctagctgagaggaccttttgggacagcggtg

SEQ ID NO: 372402 - DNA, 140 bp, Artificial Sequence
  Synthetic
caccgctgtcccaaaaggtcctctcagctagattgggggtttccaattcgctgggtaaaaagattccttcagactccatttgtcttattagttggacctccatattggtgaaagtatttacatatcagcagccagggcct

SEQ ID NO: 372403 - DNA, 140 bp, Artificial Sequence
  Synthetic
atacgccatgctgggtctccacaatactcattaaggtcgagtacaaaggggaagatgcaccttgcaagattcctttctccacagaggatggacaagggaaagctcacaatggcagactgacgtacttgggagtcggccat

SEQ ID NO: 372404 - DNA, 140 bp, Artificial Sequence
  Synthetic
atggccgactcccaagtacgtcagtctgccattgtgagctttcccttgtccatcctctgtggagaaaggaatcttgcaaggtgcatcttcccctttgtactcgaccttaatgagtattgtggagacccagcatggcgtat

SEQ ID NO: 372405 - DNA, 140 bp, Artificial Sequence
  Synthetic
aggccctggctgctgatatgggaaaagttggggaaaagccaaaatcattggagcagatgttcagaacactaccttcatcatcgacggcccaaacaccccagaatgccccgatgaccaaaggaccttttgggacagcggtg

SEQ ID NO: 372406 - DNA, 140 bp, Artificial Sequence
  Synthetic
caccgctgtcccaaaaggtcctttggtcatcggggcattctggggtgtttgggccgtcgatgatgaaggtagtgttctgaacatctgctccaatgattttggcttttccccaacttttcccatatcagcagccagggcct

SEQ ID NO: 372407 - DNA, 140 bp, Artificial Sequence
  Synthetic
atacgccatgctgggtctcctttgcctgaggagcaggaccaaaactacgtgtgtaagcatacatacgtagacagaggctgggggaacggatgtggtttgtttggcaagggaagcttggtacgtacttgggagtcggccat

SEQ ID NO: 372408 - DNA, 140 bp, Artificial Sequence
  Synthetic
atggccgactcccaagtacgtaccaagcttcccttgccaaacaaaccacatccgttcccccagcctctgtctacgtatgtatgcttacacacgtagttttggtcctgctcctcaggcaaaggagacccagcatggcgtat

SEQ ID NO: 372409 - DNA, 140 bp, Artificial Sequence
  Synthetic
atacgccatgctgggtctccgggccaccaacatacaagtagccataaaccaagtgagaaggctcatcgggaatgagaattatctagattacatgacatcaatgaagagattcaagaatgacgtacttgggagtcggccat

SEQ ID NO: 372410 - DNA, 140 bp, Artificial Sequence
  Synthetic
atggccgactcccaagtacgtcattcttgaatctcttcattgatgtcatgtaatctagataattctcattcccgatgagccttctcacttggtttatggctacttgtatgttggtggcccggagacccagcatggcgtat

SEQ ID NO: 372411 - DNA, 140 bp, Artificial Sequence
  Synthetic
atacgccatgctgggtctcctggaccgacaagaacagtttcgaatcggaagcttgcttaacgtagttctaacagtttttttattagagagcagatctctgatgaacaaccaacggaaaaacgtacttgggagtcggccat

SEQ ID NO: 372412 - DNA, 140 bp, Artificial Sequence
  Synthetic
atggccgactcccaagtacgtttttccgttggttgttcatcagagatctgctctctaataaaaaaactgttagaactacgttaagcaagcttccgattcgaaactgttcttgtcggtccaggagacccagcatggcgtat

SEQ ID NO: 372413 - DNA, 140 bp, Artificial Sequence
  Synthetic
aggccctggctgctgatatgatcgtgataacaccccactcaggagaagagcacgctgttggtaatgacacaggaaaacatggcaaggaaatcaaaataacaccacagagttccatcacaggaccttttgggacagcggtg

SEQ ID NO: 372414 - DNA, 140 bp, Artificial Sequence
  Synthetic
caccgctgtcccaaaaggtcctgtgatggaactctgtggtgttattttgatttccttgccatgttttcctgtgtcattaccaacagcgtgctcttctcctgagtggggtgttatcacgatcatatcagcagccagggcct

SEQ ID NO: 372415 - DNA, 140 bp, Artificial Sequence
  Synthetic
aggccctggctgctgatatgtgtcatcaggaaacttactgttcacaggacatctcaagtgcaggctgagaatggacaaactacagctcaaaggaatgtcatactctatgtgtacaggaaagaccttttgggacagcggtg

SEQ ID NO: 372416 - DNA, 140 bp, Artificial Sequence
  Synthetic
caccgctgtcccaaaaggtctttcctgtacacatagagtatgacattcctttgagctgtagtttgtccattctcagcctgcacttgagatgtcctgtgaacagtaagtttcctgatgacacatatcagcagccagggcct

SEQ ID NO: 372417 - DNA, 140 bp, Artificial Sequence
  Synthetic
aggccctggctgctgatatgataaaaacagcatattgacgctgggagagaccagagatcctgctgtctcctcagcatcattccaggcacagaacgccagaaaatggaaatggtgctgttggaccttttgggacagcggtg

SEQ ID NO: 372418 - DNA, 140 bp, Artificial Sequence
  Synthetic
caccgctgtcccaaaaggtccaacagcaccatttccattttctggcgttctgtgcctggaatgatgctgaggagacagcaggatctctggtctctcccagcgtcaatatgctgtttttatcatatcagcagccagggcct

SEQ ID NO: 372419 - DNA, 140 bp, Artificial Sequence
  Synthetic
atacgccatgctgggtctccgtacctcactgtctgtgtcactggtattggtgggagtcgtgacgctgtacctgggagctatggtgcaggctgatagtggttgcgttgtgagctggaaaaacgtacttgggagtcggccat

SEQ ID NO: 372420 - DNA, 140 bp, Artificial Sequence
  Synthetic
atggccgactcccaagtacgtttttccagctcacaacgcaaccactatcagcctgcaccatagctcccaggtacagcgtcacgactcccaccaataccagtgacacagacagtgaggtacggagacccagcatggcgtat

SEQ ID NO: 372421 - DNA, 140 bp, Artificial Sequence
  Synthetic
aggccctggctgctgatatgcagggccgtggcacttaggcaagttggaactagattttgatttgtgtgaaggtaccacagtggttgtggatgaacattgtggaaatcgcggaccatctctgaccttttgggacagcggtg

SEQ ID NO: 372422 - DNA, 140 bp, Artificial Sequence
  Synthetic
caccgctgtcccaaaaggtcagagatggtccgcgatttccacaatgttcatccacaaccactgtggtaccttcacacaaatcaaaatctagttccaacttgcctaagtgccacggccctgcatatcagcagccagggcct

SEQ ID NO: 372423 - DNA, 140 bp, Artificial Sequence
  Synthetic
atacgccatgctgggtctccttaaggtaaccgtaacaaagaaacaagtttcgactcggaagcttgcttaacgtagtgctaacagtttttattagagagcagatctctgatgaacaaccaacgtacttgggagtcggccat

SEQ ID NO: 372424 - DNA, 140 bp, Artificial Sequence
  Synthetic
atggccgactcccaagtacgttggttgttcatcagagatctgctctctaataaaaactgttagcactacgttaagcaagcttccgagtcgaaacttgtttctttgttacggttaccttaaggagacccagcatggcgtat

SEQ ID NO: 372425 - DNA, 140 bp, Artificial Sequence
  Synthetic
atacgccatgctgggtctccccgtgtgtcaactggatcacagttggcgaagagattctcaaaaggattgctgaacggccagggaccaatgaaattggttatggcgttcatagctttcctccgtacttgggagtcggccat

SEQ ID NO: 372426 - DNA, 140 bp, Artificial Sequence
  Synthetic
atggccgactcccaagtacggaggaaagctatgaacgccataaccaatttcattggtccctggccgttcagcaatccttttgagaatctcttcgccaactgtgatccagttgacacacggggagacccagcatggcgtat

SEQ ID NO: 372427 - DNA, 140 bp, Artificial Sequence
  Synthetic
aggccctggctgctgatatgctcttgagaaaactgacctccaaggaattaatgatggccaccataggaatcacactcctttcccaaagtaccataccagaaaccatttttgaactgactggaccttttgggacagcggtg

SEQ ID NO: 372428 - DNA, 140 bp, Artificial Sequence
  Synthetic
caccgctgtcccaaaaggtccagtcagttcaaaaatggtttctggtatggtactttgggaaaggagtgtgattcctatggtggccatcattaattccttggaggtcagttttctcaagagcatatcagcagccagggcct

SEQ ID NO: 372429 - DNA, 140 bp, Artificial Sequence
  Synthetic
aggccctggctgctgatatgcttgcacgttaccccctctacgtttcaaaggagaagacgggtgctggtacggcatggaaattagaccagtcaaggagaaggaagagaacctagttaagtcgaccttttgggacagcggtg

SEQ ID NO: 372430 - DNA, 140 bp, Artificial Sequence
  Synthetic
caccgctgtcccaaaaggtcgacttaactaggttctcttccttctccttgactggtctaatttccatgccgtaccagcacccgtcttctcctttgaaacgtagagggggtaacgtgcaagcatatcagcagccagggcct

SEQ ID NO: 372431 - DNA, 140 bp, Artificial Sequence
  Synthetic
atacgccatgctgggtctccctgtcagtaacaatatcagaagacggcagcatgtcgataaagaatgaagaggaagaacaaacactgaccatactcatcagaacgggattgctggtgatctcgtacttgggagtcggccat

SEQ ID NO: 372432 - DNA, 140 bp, Artificial Sequence
  Synthetic
atggccgactcccaagtacgagatcaccagcaatcccgttctgatgagtatggtcagtgtttgttcttcctcttcattctttatcgacatgctgccgtcttctgatattgttactgacagggagacccagcatggcgtat

SEQ ID NO: 372433 - DNA, 140 bp, Artificial Sequence
  Synthetic
atacgccatgctgggtctccggatatagagcttcagaagaccgaggccacccaattggcgaccctaaggaagctatgcattgaggggaaaattactaacataacaactgactcaagatgtcgtacttgggagtcggccat

SEQ ID NO: 372434 - DNA, 140 bp, Artificial Sequence
  Synthetic
atggccgactcccaagtacgacatcttgagtcagttgttatgttagtaattttcccctcaatgcatagcttccttagggtcgccaattgggtggcctcggtcttctgaagctctatatccggagacccagcatggcgtat

SEQ ID NO: 372435 - DNA, 140 bp, Artificial Sequence
  Synthetic
aggccctggctgctgatatgatgcttcagacaatatggggatgggaacaacgtacttagctttgatggccactttcagaatgagaccaatgttcgcagtcgggctattatttcgcagattgaccttttgggacagcggtg

SEQ ID NO: 372436 - DNA, 140 bp, Artificial Sequence
  Synthetic
caccgctgtcccaaaaggtcaatctgcgaaataatagcccgactgcgaacattggtctcattctgaaagtggccatcaaagctaagtacgttgttcccatccccatattgtctgaagcatcatatcagcagccagggcct

SEQ ID NO: 372437 - DNA, 140 bp, Artificial Sequence
  Synthetic
atacgccatgctgggtctccgatcctgatgaagatgaaaaagaaaacgtggcttgtgcataagcaatggtttttagacctacctctaccatggacggcaggagcagatacatcagaagttcgtacttgggagtcggccat

SEQ ID NO: 372438 - DNA, 140 bp, Artificial Sequence
  Synthetic
atggccgactcccaagtacgaacttctgatgtatctgctcctgccgtccatggtagaggtaggtctaaaaaccattgcttatgcacaagccacgttttctttttcatcttcatcaggatcggagacccagcatggcgtat

SEQ ID NO: 372439 - DNA, 140 bp, Artificial Sequence
  Synthetic
aggccctggctgctgatatgtcatgctctcagtgaactgccggagaccctggaaacactgcttttactgacactcctagccacagtcacaggaggaatcttcttattcttaatgagcggagaccttttgggacagcggtg

SEQ ID NO: 372440 - DNA, 140 bp, Artificial Sequence
  Synthetic
caccgctgtcccaaaaggtctccgctcattaagaataagaagattcctcctgtgactgtggctaggagtgtcagtaaaagcagtgtttccagggtctccggcagttcactgagagcatgacatatcagcagccagggcct

SEQ ID NO: 372441 - DNA, 140 bp, Artificial Sequence
  Synthetic
atacgccatgctgggtctccgagacaggatgtgacagtgctaggatctcaggagggagctatgcattctgccctcgccggagccacagaagtggattctggtgatggaaatcacatgtttcgtacttgggagtcggccat

SEQ ID NO: 372442 - DNA, 140 bp, Artificial Sequence
  Synthetic
atggccgactcccaagtacgaaacatgtgatttccatcaccagaatccacttctgtggctccggcgagggcagaatgcatagctccctcctgagatcctagcactgtcacatcctgtctcggagacccagcatggcgtat

SEQ ID NO: 372443 - DNA, 140 bp, Artificial Sequence
  Synthetic
atacgccatgctgggtctcccagggaggttttggaacactaccattgcagtgtcaatggctaacatctttagggggagctacttggccggagctggacttctcttttccatcatgaagaacgtacttgggagtcggccat

SEQ ID NO: 372444 - DNA, 140 bp, Artificial Sequence
  Synthetic
atggccgactcccaagtacgttcttcatgatggaaaagagaagtccagctccggccaagtagctccccctaaagatgttagccattgacactgcaatggtagtgttccaaaacctccctgggagacccagcatggcgtat

SEQ ID NO: 372445 - DNA, 140 bp, Artificial Sequence
  Synthetic
aggccctggctgctgatatgatctagcaggagcaggtctggctttctcattaatgaaatctttaggaggaggtaggagaggcacgggagctcaaggggaaacactgggagagaaatggaagaccttttgggacagcggtg

SEQ ID NO: 372446 - DNA, 140 bp, Artificial Sequence
  Synthetic
caccgctgtcccaaaaggtcttccatttctctcccagtgtttccccttgagctcccgtgcctctcctacctcctcctaaagatttcattaatgagaaagccagacctgctcctgctagatcatatcagcagccagggcct

SEQ ID NO: 372447 - DNA, 140 bp, Artificial Sequence
  Synthetic
atacgccatgctgggtctccaatgaaacacaagaaagctacctacgaaccagatgttgacctaggaagcggaacccgcaacattggaattgaaagtgagacaccaaatctagatataatacgtacttgggagtcggccat

SEQ ID NO: 372448 - DNA, 140 bp, Artificial Sequence
  Synthetic
atggccgactcccaagtacgtattatatctagatttggtgtctcactttcaattccaatgttgcgggttccgcttcctaggtcaacatctggttcgtaggtagctttcttgtgtttcattggagacccagcatggcgtat

SEQ ID NO: 372449 - DNA, 140 bp, Artificial Sequence
  Synthetic
aggccctggctgctgatatgaaatttggggaaggaaaagttggcctctcaatgaaggaatcatggctgttggaatagttagcattctactaagctcacttctcaaaaatgatgtgccactgaccttttgggacagcggtg

SEQ ID NO: 372450 - DNA, 140 bp, Artificial Sequence
  Synthetic
caccgctgtcccaaaaggtcagtggcacatcatttttgagaagtgagcttagtagaatgctaactattccaacagccatgattccttcattgagaggccaacttttccttccccaaatttcatatcagcagccagggcct

SEQ ID NO: 372451 - DNA, 140 bp, Artificial Sequence
  Synthetic
aggccctggctgctgatatgatgggagaagacggctgttggtatggcatggaaatcagacccatcagtgagaaagaagagaacatggtaaagtctttagtctcagcgggaagtggaaagggaccttttgggacagcggtg

SEQ ID NO: 372452 - DNA, 140 bp, Artificial Sequence
  Synthetic
caccgctgtcccaaaaggtccctttccacttcccgctgagactaaagactttaccatgttctcttctttctcactgatgggtctgatttccatgccataccaacagccgtcttctcccatcatatcagcagccagggcct

SEQ ID NO: 372453 - DNA, 140 bp, Artificial Sequence
  Synthetic
aggccctggctgctgatatgaatgaggctaaaatcactgacatcatggagcctgaacatgctctattggctacgtcaatttttaagctgacttatcaaaacaaggtggtgagggtgcaaagaccttttgggacagcggtg

SEQ ID NO: 372454 - DNA, 140 bp, Artificial Sequence
  Synthetic
caccgctgtcccaaaaggtctttgcaccctcaccaccttgttttgataagtcagcttaaaaattgacgtagccaatagagcatgttcaggctccatgatgtcagtgattttagcctcattcatatcagcagccagggcct

SEQ ID NO: 372455 - DNA, 140 bp, Artificial Sequence
  Synthetic
aggccctggctgctgatatggaaagaagagaacatggtaaagtctttagtctcagcgggaagtggaaaggtagacaacttcacaatgggtgtcttgtgtttggcaatcctctttgaagaggaccttttgggacagcggtg

SEQ ID NO: 372456 - DNA, 140 bp, Artificial Sequence
  Synthetic
caccgctgtcccaaaaggtcctcttcaaagaggattgccaaacacaagacacccattgtgaagttgtctacctttccacttcccgctgagactaaagactttaccatgttctcttctttccatatcagcagccagggcct

SEQ ID NO: 372457 - DNA, 140 bp, Artificial Sequence
  Synthetic
atacgccatgctgggtctccataacagatttggaaaaaagacacgtcttaggacgcctgattacagttaacccaatcgtaacagaaaaagatagcccagtcaacatagaagcagaacccccgtacttgggagtcggccat

SEQ ID NO: 372458 - DNA, 140 bp, Artificial Sequence
  Synthetic
atggccgactcccaagtacgggggttctgcttctatgttgactgggctatctttttctgttacgattgggttaactgtaatcaggcgtcctaagacgtgtcttttttccaaatctgttatggagacccagcatggcgtat

SEQ ID NO: 372459 - DNA, 140 bp, Artificial Sequence
  Synthetic
atacgccatgctgggtctccagaacatcaaaacagcaataaatcaagtcagatcccttatgggcaatgaggaatacatggactacatgccatccatgaagagattcagaagggaagaggacgtacttgggagtcggccat

SEQ ID NO: 372460 - DNA, 140 bp, Artificial Sequence
  Synthetic
atggccgactcccaagtacgtcctcttcccttctgaatctcttcatggatggcatgtagtccatgtattcctcattgcccataagggatctgacttgatttattgctgttttgatgttctggagacccagcatggcgtat

SEQ ID NO: 372461 - DNA, 140 bp, Artificial Sequence
  Synthetic
atacgccatgctgggtctccaaagtcaggtcggattaagccatagtacgggaaaaactatgctacctgtgagccccgtccaaggacgttaaaagaagtcaggccattacaaatgccacagcgtacttgggagtcggccat

SEQ ID NO: 372462 - DNA, 140 bp, Artificial Sequence
  Synthetic
atggccgactcccaagtacgctgtggcatttgtaatggcctgacttcttttaacgtccttggacggggctcacaggtagcatagtttttcccgtactatggcttaatccgacctgactttggagacccagcatggcgtat

SEQ ID NO: 372463 - DNA, 140 bp, Artificial Sequence
  Synthetic
aggccctggctgctgatatgagccataaaccaagtgagaaggctcatcgggaatgagaattatttagattacatgacatcaatgaagagattcaagaatgagagtgattccgaaggagcagaccttttgggacagcggtg

SEQ ID NO: 372464 - DNA, 140 bp, Artificial Sequence
  Synthetic
caccgctgtcccaaaaggtctgctccttcggaatcactctcattcttgaatctcttcattgatgtcatgtaatctaaataattctcattcccgatgagccttctcacttggtttatggctcatatcagcagccagggcct

SEQ ID NO: 372465 - DNA, 140 bp, Artificial Sequence
  Synthetic
aggccctggctgctgatatgtcaccattctcctcaaagcaaccctgctggcaatttcaggggtgtatccaatgtcaataccggcgactctctttgtgtggcatttttggcagaaaaagaagaccttttgggacagcggtg

SEQ ID NO: 372466 - DNA, 140 bp, Artificial Sequence
  Synthetic
caccgctgtcccaaaaggtcttctttttctgccaaaaatgccacacaaagagagtcgccggtattgacattggatacacccctgaaattgccagcagggttgctttgaggagaatggtgacatatcagcagccagggcct

SEQ ID NO: 372467 - DNA, 140 bp, Artificial Sequence
  Synthetic
atacgccatgctgggtctccttttttatgatggtgttgcttataccagaaccagaaaagcagagaaccccccaagacaaccaactcgcatatgtcgtgataggcatacttacactggctgcgtacttgggagtcggccat

SEQ ID NO: 372468 - DNA, 140 bp, Artificial Sequence
  Synthetic
atggccgactcccaagtacgcagccagtgtaagtatgcctatcacgacatatgcgagttggttgtcttggggggttctctgcttttctggttctggtataagcaacaccatcataaaaaaggagacccagcatggcgtat

SEQ ID NO: 372469 - DNA, 140 bp, Artificial Sequence
  Synthetic
atacgccatgctgggtctccacagagatcaggagtgttatgggacacacccagccctccagaagtggaaaaagcagtccttgatgatggcatttatagaattctccaaagaggattgttgcgtacttgggagtcggccat

SEQ ID NO: 372470 - DNA, 140 bp, Artificial Sequence
  Synthetic
atggccgactcccaagtacgcaacaatcctctttggagaattctataaatgccatcatcaaggactgctttttccacttctggagggctgggtgtgtcccataacactcctgatctctgtggagacccagcatggcgtat

SEQ ID NO: 372471 - DNA, 140 bp, Artificial Sequence
  Synthetic
aggccctggctgctgatatgcaaatggcaaatggaatcgccctggggctcatggctcttaaattgataacacaatttgaaacataccaattatggacagcattaatctccttaacgtgttgaccttttgggacagcggtg

SEQ ID NO: 372472 - DNA, 140 bp, Artificial Sequence
  Synthetic
caccgctgtcccaaaaggtcaacacgttaaggagattaatgctgtccataattggtatgtttcaaattgtgttatcaatttaagagccatgagccccagggcgattccatttgccatttgcatatcagcagccagggcct

SEQ ID NO: 372473 - DNA, 140 bp, Artificial Sequence
  Synthetic
aggccctggctgctgatatgatgggtcttgggaaaggatggccattgtcaaagatggacatcggagttcccctccttgccattggatgctactcacaagtcaaccccataaccctcacaggaccttttgggacagcggtg

SEQ ID NO: 372474 - DNA, 140 bp, Artificial Sequence
  Synthetic
caccgctgtcccaaaaggtcctgtgagggttatggggttgacttgtgagtagcatccaatggcaaggaggggaactccgatgtccatctttgacaatggccatcctttcccaagacccatcatatcagcagccagggcct

SEQ ID NO: 372475 - DNA, 140 bp, Artificial Sequence
  Synthetic
atacgccatgctgggtctccagatggggtctgtggaattagatcaaccacgaggctggaaaatgttatgtggaagcaaataaccaatgagctaaactatgttctctgggaaggaggacatcgtacttgggagtcggccat

SEQ ID NO: 372476 - DNA, 140 bp, Artificial Sequence
  Synthetic
atggccgactcccaagtacgatgtcctccttcccagagaacatagtttagctcattggttatttgcttccacataacattttccagcctcgtggttgatctaattccacagaccccatctggagacccagcatggcgtat

SEQ ID NO: 372477 - DNA, 140 bp, Artificial Sequence
  Synthetic
aggccctggctgctgatatggttgacgtggtgctcgaacacggtgggtgtgtgactaccatggctaagaacaagcccacgctggacatagagctccagaagaccgaggccacccaactgggaccttttgggacagcggtg

SEQ ID NO: 372478 - DNA, 140 bp, Artificial Sequence
  Synthetic
caccgctgtcccaaaaggtcccagttgggtggcctcggtcttctggagctctatgtccagcgtgggcttgttcttagccatggtagtcacacacccaccgtgttcgagcaccacgtcaaccatatcagcagccagggcct

SEQ ID NO: 372479 - DNA, 140 bp, Artificial Sequence
  Synthetic
aggccctggctgctgatatggggaaaaacaagaagataccttccagccatagtccgtgaggccataaaaagaaagctgcggacgttagttctagctcccacaagagttgtcgcctctgaagaccttttgggacagcggtg

SEQ ID NO: 372480 - DNA, 140 bp, Artificial Sequence
  Synthetic
caccgctgtcccaaaaggtcttcagaggcgacaactcttgtgggagctagaactaacgtccgcagctttctttttatggcctcacggactatggctggaaggtatcttcttgtttttccccatatcagcagccagggcct

SEQ ID NO: 372481 - DNA, 140 bp, Artificial Sequence
  Synthetic
aggccctggctgctgatatggatgaagaaagggacataccagaacgctcatggaattcaggcaatgaatggataaccgacttcgctgggaaaacggtgtggtttgtccccagcattaaaggaccttttgggacagcggtg

SEQ ID NO: 372482 - DNA, 140 bp, Artificial Sequence
  Synthetic
caccgctgtcccaaaaggtcctttaatgctggggacaaaccacaccgttttcccagcgaagtcggttatccattcattgcctgaattccatgagcgttctggtatgtccctttcttcatccatatcagcagccagggcct

SEQ ID NO: 372483 - DNA, 140 bp, Artificial Sequence
  Synthetic
atacgccatgctgggtctccttcacagcacaattaccgtcagggctatgccacgcaaaccgtgggcccatggcacctaggcaaattggagatagactttggagaatgccccgggacaacacgtacttgggagtcggccat

SEQ ID NO: 372484 - DNA, 140 bp, Artificial Sequence
  Synthetic
atggccgactcccaagtacgtgttgtcccggggcattctccaaagtctatctccaatttgcctaggtgccatgggcccacggtttgcgtggcatagccctgacggtaattgtgctgtgaaggagacccagcatggcgtat

SEQ ID NO: 372485 - DNA, 140 bp, Artificial Sequence
  Synthetic
aggccctggctgctgatatggacgtaaaacctgggaggctgcaaactgtggaagctgtacgcacagtgtagcagactagcggttagaggagacccctccatgacacaacgcagcagcggggaccttttgggacagcggtg

SEQ ID NO: 372486 - DNA, 140 bp, Artificial Sequence
  Synthetic
caccgctgtcccaaaaggtccccgctgctgcgttgtgtcatggaggggtctcctctaaccgctagtctgctacactgtgcgtacagcttccacagtttgcagcctcccaggttttacgtccatatcagcagccagggcct

SEQ ID NO: 372487 - DNA, 140 bp, Artificial Sequence
  Synthetic
aggccctggctgctgatatggcagactagcggttagaggagacccctccatgacacaacgcagcagcggggcccgagcactgagggaagctgtacctccttgcaaaggactagaggttaggaccttttgggacagcggtg

SEQ ID NO: 372488 - DNA, 140 bp, Artificial Sequence
  Synthetic
caccgctgtcccaaaaggtcctaacctctagtcctttgcaaggaggtacagcttccctcagtgctcgggccccgctgctgcgttgtgtcatggaggggtctcctctaaccgctagtctgccatatcagcagccagggcct

SEQ ID NO: 372489 - DNA, 140 bp, Artificial Sequence
  Synthetic
aggccctggctgctgatatgtgcctcccttaaggttcttgggagaagatggatgttggtatgggatggagatcaggcctctgagtgaaaaagaagagaacatggtcaaatcacaggtaacgaccttttgggacagcggtg

SEQ ID NO: 372490 - DNA, 140 bp, Artificial Sequence
  Synthetic
caccgctgtcccaaaaggtcgttacctgtgatttgaccatgttctcttctttttcactcagaggcctgatctccatcccataccaacatccatcttctcccaagaaccttaagggaggcacatatcagcagccagggcct

SEQ ID NO: 372491 - DNA, 140 bp, Artificial Sequence
  Synthetic
aggccctggctgctgatatggatggaatgattggcagcaagtgcctttttgttcacaccatttccaccagctgatcatgaaggatgggagggaaatagtggtgccatgccgcaaccaagagaccttttgggacagcggtg

SEQ ID NO: 372492 - DNA, 140 bp, Artificial Sequence
  Synthetic
caccgctgtcccaaaaggtctcttggttgcggcatggcaccactatttccctcccatccttcatgatcagctggtggaaatggtgtgaacaaaaaggcacttgctgccaatcattccatccatatcagcagccagggcct

SEQ ID NO: 372493 - DNA, 140 bp, Artificial Sequence
  Synthetic
aggccctggctgctgatatgatattggttgtggtaatcaccttttgcgctatcatcctaggaggtctcacatggatggacttactacgagcccttatcatgttaggggatactatgtctggaccttttgggacagcggtg

SEQ ID NO: 372494 - DNA, 140 bp, Artificial Sequence
  Synthetic
caccgctgtcccaaaaggtccagacatagtatcccctaacatgataagggctcgtagtaagtccatccatgtgagacctcctaggatgatagcgcaaaaggtgattaccacaaccaatatcatatcagcagccagggcct

SEQ ID NO: 372495 - DNA, 140 bp, Artificial Sequence
  Synthetic
atacgccatgctgggtctccttcaatatgctgaaacgcgagagaaaccgcgtgtcaactgtgcaacagctgacaaagagattctcacttggaatgctgcagggacgaggaccgttgaaaccgtacttgggagtcggccat

SEQ ID NO: 372496 - DNA, 140 bp, Artificial Sequence
  Synthetic
atggccgactcccaagtacggtttcaacggtcctcgtccctgcagcattccaagtgagaatctctttgtcagctgttgcacagttgacacgcggtttctctcgcgtttcagcatattgaaggagacccagcatggcgtat

SEQ ID NO: 372497 - DNA, 140 bp, Artificial Sequence
  Synthetic
aggccctggctgctgatatggcagggatactaaaaagatggggaacaatcaaaaagtcaaaggccatcaatgtcttgagagggttcaggaaagagattggaaggatgctgaacatcttgagaccttttgggacagcggtg

SEQ ID NO: 372498 - DNA, 140 bp, Artificial Sequence
  Synthetic
caccgctgtcccaaaaggtctcaagatgttcagcatccttccaatctctttcctgaaccctctcaagacattgatggcctttgactttttgattgttccccatctttttagtatccctgccatatcagcagccagggcct

SEQ ID NO: 372499 - DNA, 140 bp, Artificial Sequence
  Synthetic
atacgccatgctgggtctccatggcgttccatttaaccacacgcaacggagaaccacacatgatcgtcagcaaacaagagaaagggaaaagtctcttgtttaaaacagaggatggtgtgacgtacttgggagtcggccat

SEQ ID NO: 372500 - DNA, 140 bp, Artificial Sequence
  Synthetic
atggccgactcccaagtacgtcacaccatcctctgttttaaacaagagacttttccctttctcttgtttgctgacgatcatgtgtggttctccgttgcgtgtggttaaatggaacgccatggagacccagcatggcgtat

SEQ ID NO: 372501 - DNA, 140 bp, Artificial Sequence
  Synthetic
atacgccatgctgggtctccacatgtgcaccctcatggccatggaccttggtgaactgtgtgaagacacaatcacttataactgtcctcttctcaggcagaatgaaccagaagatatagacgtacttgggagtcggccat

SEQ ID NO: 372502 - DNA, 140 bp, Artificial Sequence
  Synthetic
atggccgactcccaagtacgtctatatcttctggttcattctgcctgagaagaggacagttataagtgattgtgtcttcacacagttcaccaaggtccatggccatgagggtgcacatgtggagacccagcatggcgtat

SEQ ID NO: 372503 - DNA, 140 bp, Artificial Sequence
  Synthetic
aggccctggctgctgatatgggcctggaaacacgcccagagaattgaaacctggatcttgagacatccaggttttaccataatggcagcaatcttggcatacaccataggaacgacatatgaccttttgggacagcggtg

SEQ ID NO: 372504 - DNA, 140 bp, Artificial Sequence
  Synthetic
caccgctgtcccaaaaggtcatatgtcgttcctatggtgtatgccaagattgctgccattatggtaaaacctggatgtctcaagatccaggtttcaattctctgggcgtgtttccaggcccatatcagcagccagggcct

SEQ ID NO: 372505 - DNA, 140 bp, Artificial Sequence
  Synthetic
atacgccatgctgggtctccttccaaagagtcctgatcttcatcttactgacagctgtcgctccttcaatgacaatgcgttgtattggaatatcaaatagagactttgtggaaggggtttcgtacttgggagtcggccat

SEQ ID NO: 372506 - DNA, 140 bp, Artificial Sequence
  Synthetic
atggccgactcccaagtacgaaaccccttccacaaagtctctatttgatattccaatacaacgcattgtcattgaaggagcgacagctgtcagtaagatgaagatcaggactctttggaaggagacccagcatggcgtat

SEQ ID NO: 372507 - DNA, 140 bp, Artificial Sequence
  Synthetic
atacgccatgctgggtctccacgatggcaaaaaacaaaccaacattggactttgaactgataaaaacagaagccaagcaacctgccactctaaggaagtactgtatagaggcaaagctgacgtacttgggagtcggccat

SEQ ID NO: 372508 - DNA, 140 bp, Artificial Sequence
  Synthetic
atggccgactcccaagtacgtcagctttgcctctatacagtacttccttagagtggcaggttgcttggcttctgtttttatcagttcaaagtccaatgttggtttgttttttgccatcgtggagacccagcatggcgtat

SEQ ID NO: 372509 - DNA, 140 bp, Artificial Sequence
  Synthetic
aggccctggctgctgatatgagctgtcttcaaaaacattcccactgggtagaaataacagcactcatcctaggagcccaggctttgccagtgtacctaatgactctcatgaagggagcctgaccttttgggacagcggtg

SEQ ID NO: 372510 - DNA, 140 bp, Artificial Sequence
  Synthetic
caccgctgtcccaaaaggtcaggctcccttcatgagagtcattaggtacactggcaaagcctgggctcctaggatgagtgctgttatttctacccagtgggaatgtttttgaagacagctcatatcagcagccagggcct

SEQ ID NO: 372511 - DNA, 140 bp, Artificial Sequence
  Synthetic
aggccctggctgctgatatggtgctatgttcacatgcaagaaaaacatggaagggaaaattgtgcaaccagaaaacctggaatacaccattgtggtaacacctcattcaggggaagagaagaccttttgggacagcggtg

SEQ ID NO: 372512 - DNA, 140 bp, Artificial Sequence
  Synthetic
caccgctgtcccaaaaggtcttctcttcccctgaatgaggtgttaccacaatggtgtattccaggttttctggttgcacaattttcccttccatgtttttcttgcatgtgaacatagcaccatatcagcagccagggcct

SEQ ID NO: 372513 - DNA, 140 bp, Artificial Sequence
  Synthetic
aggccctggctgctgatatgggcacatctggatctcccatcgtgaacagagagggaaaaatagtgggtctgtatggaaatggagtggtgacaacaagtggaacctacgtcagtgccattggaccttttgggacagcggtg

SEQ ID NO: 372514 - DNA, 140 bp, Artificial Sequence
  Synthetic
caccgctgtcccaaaaggtccaatggcactgacgtaggttccacttgttgtcaccactccatttccatacagacccactatttttccctctctgttcacgatgggagatccagatgtgcccatatcagcagccagggcct

SEQ ID NO: 372515 - DNA, 140 bp, Artificial Sequence
  Synthetic
atacgccatgctgggtctcccaaggagatcttggcctctcaatgagggcataatggctgtaggtttggtgagcctcttaggaagcgccctcttgaagaatgatgttcctttggctggccccgtacttgggagtcggccat

SEQ ID NO: 372516 - DNA, 140 bp, Artificial Sequence
  Synthetic
atggccgactcccaagtacggggccagccaaaggaacatcattcttcaagagggcgcttcctaagaggctcaccaaacctacagccattatgccctcattgagaggccaagatctccttgggagacccagcatggcgtat

SEQ ID NO: 372517 - DNA, 140 bp, Artificial Sequence
  Synthetic
atacgccatgctgggtctccagcctcttaggaagcgccctcttgaagaatgatgttcctttggctggcccaatggtggcaggaggcttgcttctagcggcttacgtaatgagtggtagctcgtacttgggagtcggccat

SEQ ID NO: 372518 - DNA, 140 bp, Artificial Sequence
  Synthetic
atggccgactcccaagtacgagctaccactcattacgtaagccgctagaagcaagcctcctgccaccattgggccagccaaaggaacatcattcttcaagagggcgcttcctaagaggctggagacccagcatggcgtat

SEQ ID NO: 372519 - DNA, 140 bp, Artificial Sequence
  Synthetic
aggccctggctgctgatatgtccccctcaaagctggcttcagctatccagaaagctcatgaagaaggcatttgtggaatccgctcagtaacaagactggagaatctaatgtggaagcaaagaccttttgggacagcggtg

SEQ ID NO: 372520 - DNA, 140 bp, Artificial Sequence
  Synthetic
caccgctgtcccaaaaggtctttgcttccacattagattctccagtcttgttactgagcggattccacaaatgccttcttcatgagctttctggatagctgaagccagctttgagggggacatatcagcagccagggcct

SEQ ID NO: 372521 - DNA, 140 bp, Artificial Sequence
  Synthetic
atacgccatgctgggtctccatcatgacaggggacatcaaaggaatcatgcaggcaggaaaacgatccctgcggcctcagcccactgagctgaaatattcatggaaaacgtggggcaaagcgtacttgggagtcggccat

SEQ ID NO: 372522 - DNA, 140 bp, Artificial Sequence
  Synthetic
atggccgactcccaagtacgctttgccccacgttttccatgaatatttcagctcagtgggctgaggccgcagggatcgttttcctgcctgcatgattcctttgatgtcccctgtcatgatggagacccagcatggcgtat

SEQ ID NO: 372523 - DNA, 140 bp, Artificial Sequence
  Synthetic
atacgccatgctgggtctccaagaattgccagacaccatagagacaataatgctcctagctctgatagctgtgctgactggcggagtgacgctgttcttcctatcaggaagaggcttaggcgtacttgggagtcggccat

SEQ ID NO: 372524 - DNA, 140 bp, Artificial Sequence
  Synthetic
atggccgactcccaagtacgcctaagcctcttcctgataggaagaacagcgtcactccgccagtcagcacagctatcagagctaggagcattattgtctctatggtgtctggcaattcttggagacccagcatggcgtat

SEQ ID NO: 372525 - DNA, 140 bp, Artificial Sequence
  Synthetic
aggccctggctgctgatatggtgctgactggcggagtgacgctgttcttcctatcaggaagaggcttagggaaaacatccataggcctactctgcgtgacgtcctcaagtgcactgttatgaccttttgggacagcggtg

SEQ ID NO: 372526 - DNA, 140 bp, Artificial Sequence
  Synthetic
caccgctgtcccaaaaggtcataacagtgcacttgaggacgtcacgcagagtaggcctatggatgttttccctaagcctcttcctgataggaagaacagcgtcactccgccagtcagcaccatatcagcagccagggcct

SEQ ID NO: 372527 - DNA, 140 bp, Artificial Sequence
  Synthetic
atacgccatgctgggtctccgaaagtgagatgataattccaaagaattttgctggaccagtatcgcaacataattacagaccaggctatcacacacaaacggcaggaccttggcatctagcgtacttgggagtcggccat

SEQ ID NO: 372528 - DNA, 140 bp, Artificial Sequence
  Synthetic
atggccgactcccaagtacgctagatgccaaggtcctgccgtttgtgtgtgatagcctggtctgtaattatgttgcgatactggtccagcaaaattctttggaattatcatctcactttcggagacccagcatggcgtat

SEQ ID NO: 372529 - DNA, 140 bp, Artificial Sequence
  Synthetic
aggccctggctgctgatatgtggaaaactcataacagaatggtgctgccgatcctgcacattaccaccactaagatacagaggcgaggatggatgctggtacggaatggaaatcagaccagaccttttgggacagcggtg

SEQ ID NO: 372530 - DNA, 140 bp, Artificial Sequence
  Synthetic
caccgctgtcccaaaaggtctggtctgatttccattccgtaccagcatccatcctcgcctctgtatcttagtggtggtaatgtgcaggatcggcagcaccattctgttatgagttttccacatatcagcagccagggcct

SEQ ID NO: 372531 - DNA, 140 bp, Artificial Sequence
  Synthetic
aggccctggctgctgatatgttgaaagagaaagaagagaacttggtcaattctttggtcacagccggacatggacagattgacaacttctcactaggagtcttgggaatggcactgttccgaccttttgggacagcggtg

SEQ ID NO: 372532 - DNA, 140 bp, Artificial Sequence
  Synthetic
caccgctgtcccaaaaggtcggaacagtgccattcccaagactcctagtgagaagttgtcaatctgtccatgtccggctgtgaccaaagaattgaccaagttctcttctttctctttcaacatatcagcagccagggcct

SEQ ID NO: 372533 - DNA, 140 bp, Artificial Sequence
  Synthetic
atacgccatgctgggtctccgtatgggcgtgacttatcttgccttactagcagccttcaaagttagaccaacttttgcagctggactgcttttgagaaagctgacctccaaggaattgatcgtacttgggagtcggccat

SEQ ID NO: 372534 - DNA, 140 bp, Artificial Sequence
  Synthetic
atggccgactcccaagtacgatcaattccttggaggtcagctttctcaaaagcagtccagctgcaaaagttggtctaactttgaaggctgctagtaaggcaagataagtcacgcccatacggagacccagcatggcgtat

SEQ ID NO: 372535 - DNA, 140 bp, Artificial Sequence
  Synthetic
aggccctggctgctgatatgatgctgcatacgtcagaacatggcggtagggcctacaggcatgcggtggaggaactaccagagacaatggaaacactcctactcttgggactcatgatctgaccttttgggacagcggtg

SEQ ID NO: 372536 - DNA, 140 bp, Artificial Sequence
  Synthetic
caccgctgtcccaaaaggtcagatcatgagtcccaagagtaggagtgtttccattgtctctggtagttcctccaccgcatgcctgtaggccctaccgccatgttctgacgtatgcagcatcatatcagcagccagggcct

SEQ ID NO: 372537 - DNA, 140 bp, Artificial Sequence
  Synthetic
atacgccatgctgggtctccatagtgagaaacatggaaaagtatcaattggcagtgactatcatggctatcttatgtgttccaaatgcagtgatattacaaaatgcatggaaagtgagctcgtacttgggagtcggccat

SEQ ID NO: 372538 - DNA, 140 bp, Artificial Sequence
  Synthetic
atggccgactcccaagtacgagctcactttccatgcattttgtaatatcactgcatttggaacacataagatagccatgatagtcactgccaattgatacttttccatgtttctcactatggagacccagcatggcgtat

SEQ ID NO: 372539 - DNA, 140 bp, Artificial Sequence
  Synthetic
atacgccatgctgggtctcccagcagaaagcggattggataccattggcattgacgatcaaaggtctcaatccaacagccattttcctaacaaccctttcaagaactaacaagaaaaggacgtacttgggagtcggccat

SEQ ID NO: 372540 - DNA, 140 bp, Artificial Sequence
  Synthetic
atggccgactcccaagtacgtccttttcttgttagttcttgaaagggttgttaggaaaatggctgttggattgagacctttgatcgtcaatgccaatggtatccaatccgctttctgctgggagacccagcatggcgtat

SEQ ID NO: 372541 - DNA, 140 bp, Artificial Sequence
  Synthetic
aggccctggctgctgatatgtcaggaagcagtccaattctgtcaataacaatatcggaagatggcagcatgtcgataaaaaatgaagaggaagaacaaacactgaccatactcattagaagaccttttgggacagcggtg

SEQ ID NO: 372542 - DNA, 140 bp, Artificial Sequence
  Synthetic
caccgctgtcccaaaaggtcttctaatgagtatggtcagtgtttgttcttcctcttcattttttatcgacatgctgccatcttccgatattgttattgacagaattggactgcttcctgacatatcagcagccagggcct

SEQ ID NO: 372543 - DNA, 140 bp, Artificial Sequence
  Synthetic
aggccctggctgctgatatgtgacagtggcagccaatgagatgggattattggaaaccacaaagaaagacctggggattggtcatacagctgctgaaaaccaccaccacgccgcaatgttgaccttttgggacagcggtg

SEQ ID NO: 372544 - DNA, 140 bp, Artificial Sequence
  Synthetic
caccgctgtcccaaaaggtcaacattgcggcgtggtggtggttttcagcagctgtatgaccaatccccaggtctttctttgtggtttccaataatcccatctcattggctgccactgtcacatatcagcagccagggcct

SEQ ID NO: 372545 - DNA, 140 bp, Artificial Sequence
  Synthetic
aggccctggctgctgatatggaatggaaggaaggagaagaagtccaggtcttggcattagagcctggaaagaatccaagagccgtccaaacaaaacccggtctttttaagactaacaccggaccttttgggacagcggtg

SEQ ID NO: 372546 - DNA, 140 bp, Artificial Sequence
  Synthetic
caccgctgtcccaaaaggtccggtgttagtcttaaaaagaccgggttttgtttggacggctcttggattctttccaggctctaatgccaagacctggacttcttctccttccttccattccatatcagcagccagggcct

SEQ ID NO: 372547 - DNA, 140 bp, Artificial Sequence
  Synthetic
atacgccatgctgggtctcctagacttaagatggacaaattggaactcaaggggatgagctatgcaatgtgcacgaatacctttgtgttgaagaaagaagtctcagaaacgcagcatgggcgtacttgggagtcggccat

SEQ ID NO: 372548 - DNA, 140 bp, Artificial Sequence
  Synthetic
atggccgactcccaagtacgcccatgctgcgtttctgagacttctttcttcaacacaaaggtattcgtgcacattgcatagctcatccccttgagttccaatttgtccatcttaagtctaggagacccagcatggcgtat

SEQ ID NO: 372549 - DNA, 140 bp, Artificial Sequence
  Synthetic
aggccctggctgctgatatgttcacagacccagcaagcatagcagctagaggatacatttcaactcgagtagagatgggtgaagcagctgggattttcatgacagccactcctccgggaagaccttttgggacagcggtg

SEQ ID NO: 372550 - DNA, 140 bp, Artificial Sequence
  Synthetic
caccgctgtcccaaaaggtcttcccggaggagtggctgtcatgaaaatcccagctgcttcacccatctctactcgagttgaaatgtatcctctagctgctatgcttgctgggtctgtgaacatatcagcagccagggcct

SEQ ID NO: 372551 - DNA, 140 bp, Artificial Sequence
  Synthetic
aggccctggctgctgatatgagagatgggtgaagcagctgggattttcatgacagccactcctccgggaagcagagacccatttcctcaaagcaatgcaccaatcatggatgaagaaagggaccttttgggacagcggtg

SEQ ID NO: 372552 - DNA, 140 bp, Artificial Sequence
  Synthetic
caccgctgtcccaaaaggtccctttcttcatccatgattggtgcattgctttgaggaaatgggtctctgcttcccggaggagtggctgtcatgaaaatcccagctgcttcacccatctctcatatcagcagccagggcct

SEQ ID NO: 372553 - DNA, 140 bp, Artificial Sequence
  Synthetic
atacgccatgctgggtctccgaagagcgggtgatcctggcaggacccatgccagtgacccactctagtgcagcacaaagaagagggagaataggaagaaatccaaaaaatgaaaatgacccgtacttgggagtcggccat

SEQ ID NO: 372554 - DNA, 140 bp, Artificial Sequence
  Synthetic
atggccgactcccaagtacgggtcattttcattttttggatttcttcctattctccctcttctttgtgctgcactagagtgggtcactggcatgggtcctgccaggatcacccgctcttcggagacccagcatggcgtat

SEQ ID NO: 372555 - DNA, 140 bp, Artificial Sequence
  Synthetic
aggccctggctgctgatatgaggcccatcactgaggacaacaacagtgtcagggaaattgatacacgaatggtgttgccgctcgtgtacacttcctcccctgcgatatatgggagaagacgaccttttgggacagcggtg

SEQ ID NO: 372556 - DNA, 140 bp, Artificial Sequence
  Synthetic
caccgctgtcccaaaaggtcgtcttctcccatatatcgcaggggaggaagtgtacacgagcggcaacaccattcgtgtatcaatttccctgacactgttgttgtcctcagtgatgggcctcatatcagcagccagggcct

SEQ ID NO: 372557 - DNA, 140 bp, Artificial Sequence
  Synthetic
aggccctggctgctgatatgaggcggaagggcgtacaatcatgctctcagtgaactgccagagactctggagacattgcttttgctgacacttttggccacagtcacgggcggaatctttgaccttttgggacagcggtg

SEQ ID NO: 372558 - DNA, 140 bp, Artificial Sequence
  Synthetic
caccgctgtcccaaaaggtcaaagattccgcccgtgactgtggccaaaagtgtcagcaaaagcaatgtctccagagtctctggcagttcactgagagcatgattgtacgcccttccgcctcatatcagcagccagggcct

SEQ ID NO: 372559 - DNA, 140 bp, Artificial Sequence
  Synthetic
aggccctggctgctgatatgctgcataatcacggccagtattctcctatggtacgcacaaatacagccacactggatagcagcttcaataatactggagttttttctcatagtcttgctcgaccttttgggacagcggtg

SEQ ID NO: 372560 - DNA, 140 bp, Artificial Sequence
  Synthetic
caccgctgtcccaaaaggtcgagcaagactatgagaaaaaactccagtattattgaagctgctatccagtgtggctgtatttgtgcgtaccataggagaatactggccgtgattatgcagcatatcagcagccagggcct

SEQ ID NO: 372561 - DNA, 140 bp, Artificial Sequence
  Synthetic
aggccctggctgctgatatgacccagcaacccgagagcaacatcctggacatagatctacgtcctgcatcagcatggaccctgtatgcagtggccacaacatttatcacaccaatgttgagaccttttgggacagcggtg

SEQ ID NO: 372562 - DNA, 140 bp, Artificial Sequence
  Synthetic
caccgctgtcccaaaaggtctcaacattggtgtgataaatgttgtggccactgcatacagggtccatgctgatgcaggacgtagatctatgtccaggatgttgctctcgggttgctgggtcatatcagcagccagggcct

SEQ ID NO: 372563 - DNA, 140 bp, Artificial Sequence
  Synthetic
aggccctggctgctgatatgaagagtgaattccagatttacaagaggagcggaattcaggaagtggatagaaccttggcaaaagaaggcattaaaagaggagaaacggaccatcatgctggaccttttgggacagcggtg

SEQ ID NO: 372564 - DNA, 140 bp, Artificial Sequence
  Synthetic
caccgctgtcccaaaaggtccagcatgatggtccgtttctcctcttttaatgccttcttttgccaaggttctatccacttcctgaattccgctcctcttgtaaatctggaattcactcttcatatcagcagccagggcct

SEQ ID NO: 372565 - DNA, 140 bp, Artificial Sequence
  Synthetic
aggccctggctgctgatatggcatggagaaattgagaatcaagggaatgtcatacacgatgtgttcaggaaagttttcaattgacaaagagatggcagaaacacagcatgggacaacagtgaccttttgggacagcggtg

SEQ ID NO: 372566 - DNA, 140 bp, Artificial Sequence
  Synthetic
caccgctgtcccaaaaggtcactgttgtcccatgctgtgtttctgccatctctttgtcaattgaaaactttcctgaacacatcgtgtatgacattcccttgattctcaatttctccatgccatatcagcagccagggcct

SEQ ID NO: 372567 - DNA, 140 bp, Artificial Sequence
  Synthetic
aggccctggctgctgatatgatctcagattctcttgatgcggaccacatgggccttgtgtgaatccatcacactggccacaggacctctgaccacgctttgggagggatctccaggaaaagaccttttgggacagcggtg

SEQ ID NO: 372568 - DNA, 140 bp, Artificial Sequence
  Synthetic
caccgctgtcccaaaaggtcttttcctggagatccctcccaaagcgtggtcagaggtcctgtggccagtgtgatggattcacacaaggcccatgtggtccgcatcaagagaatctgagatcatatcagcagccagggcct

SEQ ID NO: 372569 - DNA, 140 bp, Artificial Sequence
  Synthetic
aggccctggctgctgatatgcggcgtcctatgggacgtacccagccccccagagacacagaaagcagaactggaagaaggggtttataggatcaaacagcaaggaatttttggaaaaaccgaccttttgggacagcggtg

SEQ ID NO: 372570 - DNA, 140 bp, Artificial Sequence
  Synthetic
caccgctgtcccaaaaggtcggtttttccaaaaattccttgctgtttgatcctataaaccccttcttccagttctgctttctgtgtctctggggggctgggtacgtcccataggacgccgcatatcagcagccagggcct

SEQ ID NO: 372571 - DNA, 140 bp, Artificial Sequence
  Synthetic
aggccctggctgctgatatgccaaacctagacataattgggaaaagaatagaaaaaataaaacaagagcatgagacatcatggcactatgaccaagaccacccatataaaacttgggcctgaccttttgggacagcggtg

SEQ ID NO: 372572 - DNA, 140 bp, Artificial Sequence
  Synthetic
caccgctgtcccaaaaggtcaggcccaagttttatatgggtggtcttggtcatagtgccatgatgtctcatgctcttgttttattttttctattcttttcccaattatgtctaggtttggcatatcagcagccagggcct

SEQ ID NO: 372573 - DNA, 140 bp, Artificial Sequence
  Synthetic
atacgccatgctgggtctccaccatggcagctacgaaacaaaacagactggatcagcatcatccgtggtgaatggagtagttagactgctgacaaaaccttgggacgtcatccctatggtcgtacttgggagtcggccat

SEQ ID NO: 372574 - DNA, 140 bp, Artificial Sequence
  Synthetic
atggccgactcccaagtacgaccatagggatgacgtcccaaggttttgtcagcagtctaactactccattcaccacggatgatgctgatccagtctgttttgtttcgtagctgccatggtggagacccagcatggcgtat

SEQ ID NO: 372575 - DNA, 140 bp, Artificial Sequence
  Synthetic
aggccctggctgctgatatgtcaaagagaaagtggacacgagaacccaagaaccgaaagaaggcacgaagaaactaatgaaaatcacggccgaatggctctggaaagaactagggaagaagaccttttgggacagcggtg

SEQ ID NO: 372576 - DNA, 140 bp, Artificial Sequence
  Synthetic
caccgctgtcccaaaaggtcttcttccctagttctttccagagccattcggccgtgattttcattagtttcttcgtgccttctttcggttcttgggttctcgtgtccactttctctttgacatatcagcagccagggcct

SEQ ID NO: 372577 - DNA, 140 bp, Artificial Sequence
  Synthetic
atacgccatgctgggtctccaaagacacctagaatgtgcactagagaagaattcgcaagaaaggtgagaagcaatgcagccctaggtgccatattcactgatgagaacaagtggaagtcgcgtacttgggagtcggccat

SEQ ID NO: 372578 - DNA, 140 bp, Artificial Sequence
  Synthetic
atggccgactcccaagtacgcgacttccacttgttctcatcagtgaatatggcacctagggctgcattgcttctcacctttcttgcgaattcttctctagtgcacattctaggtgtctttggagacccagcatggcgtat

SEQ ID NO: 372579 - DNA, 140 bp, Artificial Sequence
  Synthetic
aggccctggctgctgatatgcagatggagggagagggagtctttaaaggcatccagcatctgacagccacagaagaagttgcagtgcaagactggttagcaagagtggggcgtgagaggtgaccttttgggacagcggtg

SEQ ID NO: 372580 - DNA, 140 bp, Artificial Sequence
  Synthetic
caccgctgtcccaaaaggtcacctctcacgccccactcttgctaaccagtcttgcactgcaacttcttctgtggctgtcagatgctggatgcctttaaagactccctctccctccatctgcatatcagcagccagggcct

SEQ ID NO: 372581 - DNA, 140 bp, Artificial Sequence
  Synthetic
aggccctggctgctgatatgagaagaagttgcagtgcaagactggttagcaagagtggggcgtgagaggttatcaagaatggccatcagtggagatgattgtgttgtgaaacccttagatgaccttttgggacagcggtg

SEQ ID NO: 372582 - DNA, 140 bp, Artificial Sequence
  Synthetic
caccgctgtcccaaaaggtcatctaagggtttcacaacacaatcatctccactgatggccattcttgataacctctcacgccccactcttgctaaccagtcttgcactgcaacttcttctcatatcagcagccagggcct

SEQ ID NO: 372583 - DNA, 140 bp, Artificial Sequence
  Synthetic
aggccctggctgctgatatgtatcaagaatggccatcagtggagatgattgtgttgtgaaacccttagatgacaggtttgcaagcgctttaacagctctaaatgacatgggaaaggttaggaccttttgggacagcggtg

SEQ ID NO: 372584 - DNA, 140 bp, Artificial Sequence
  Synthetic
caccgctgtcccaaaaggtcctaacctttcccatgtcatttagagctgttaaagcgcttgcaaacctgtcatctaagggtttcacaacacaatcatctccactgatggccattcttgatacatatcagcagccagggcct

SEQ ID NO: 372585 - DNA, 140 bp, Artificial Sequence
  Synthetic
aggccctggctgctgatatgcaacagaagacatgctgacagtctggaacagggtgtggattcaagaaaacccatggatggaagacaaaactccagtggaatcatgggaggaaatcccatagaccttttgggacagcggtg

SEQ ID NO: 372586 - DNA, 140 bp, Artificial Sequence
  Synthetic
caccgctgtcccaaaaggtctatgggatttcctcccatgattccactggagttttgtcttccatccatgggttttcttgaatccacaccctgttccagactgtcagcatgtcttctgttgcatatcagcagccagggcct

SEQ ID NO: 372587 - DNA, 140 bp, Artificial Sequence
  Synthetic
atacgccatgctgggtctcctgtcttgagagggttcaggaaagagattggaaggatgctgaacatcttgaataggagacgcagaaccgcaggcgtgatcatcatgctgattccaacagcgcgtacttgggagtcggccat

SEQ ID NO: 372588 - DNA, 140 bp, Artificial Sequence
  Synthetic
atggccgactcccaagtacgcgctgttggaatcagcatgatgatcacgcctgcggttctgcgtctcctattcaagatgttcagcatccttccaatctctttcctgaaccctctcaagacaggagacccagcatggcgtat

SEQ ID NO: 372589 - DNA, 140 bp, Artificial Sequence
  Synthetic
aggccctggctgctgatatgccaaatgttcgagacaacaatgagaggagcgaagagaatggccattttaggtgacacagcctgggattttggatccctgggaggagtgttcacatctatagaccttttgggacagcggtg

SEQ ID NO: 372590 - DNA, 140 bp, Artificial Sequence
  Synthetic
caccgctgtcccaaaaggtctatagatgtgaacactcctcccagggatccaaaatcccaggctgtgtcacctaaaatggccattctcttcgctcctctcattgttgtctcgaacatttggcatatcagcagccagggcct

SEQ ID NO: 372591 - DNA, 140 bp, Artificial Sequence
  Synthetic
atacgccatgctgggtctccggaaaggccctccaccaagtttttggagcaatctatggggctgccttcagtggggtttcatggactatgaaaatcctcataggagttgtcatcacatggacgtacttgggagtcggccat

SEQ ID NO: 372592 - DNA, 140 bp, Artificial Sequence
  Synthetic
atggccgactcccaagtacgtccatgtgatgacaactcctatgaggattttcatagtccatgaaaccccactgaaggcagccccatagattgctccaaaaacttggtggagggcctttccggagacccagcatggcgtat

SEQ ID NO: 372593 - DNA, 140 bp, Artificial Sequence
  Synthetic
aggccctggctgctgatatggcggcctcagcccactgagctgaaatattcatggaaaacgtggggcaaagcgaaaatgctctccacagagcctcataaccagacctttctcattgatggcgaccttttgggacagcggtg

SEQ ID NO: 372594 - DNA, 140 bp, Artificial Sequence
  Synthetic
caccgctgtcccaaaaggtcgccatcaatgagaaaggtctggttatgaggctctgtggagagcattttcgctttgccccacgttttccatgaatatttcagctcagtgggctgaggccgccatatcagcagccagggcct

SEQ ID NO: 372595 - DNA, 140 bp, Artificial Sequence
  Synthetic
atacgccatgctgggtctcctggaagaaatgctcaggacccgagtaggaacaaaacatgcagtattactggttgcagtttctttcatgacattgatcacagggaacatgtctttccgagacgtacttgggagtcggccat

SEQ ID NO: 372596 - DNA, 140 bp, Artificial Sequence
  Synthetic
atggccgactcccaagtacgtctcggaaagacatgttccctgtgatcaatgtcatgaaagaaactgcaaccagtaatactgcatgttttgttcctactcgggtcctgagcatttcttccaggagacccagcatggcgtat

SEQ ID NO: 372597 - DNA, 140 bp, Artificial Sequence
  Synthetic
aggccctggctgctgatatgctaatgtcagctgccatcaaggacagcaaggcagttcatgctgacatggggtactggatagaaagtgaaaagaacgaaacctggaagctggcgagagcctgaccttttgggacagcggtg

SEQ ID NO: 372598 - DNA, 140 bp, Artificial Sequence
  Synthetic
caccgctgtcccaaaaggtcaggctctcgccagcttccaggtttcgttcttttcactttctatccagtaccccatgtcagcatgaactgccttgctgtccttgatggcagctgacattagcatatcagcagccagggcct

SEQ ID NO: 372599 - DNA, 140 bp, Artificial Sequence
  Synthetic
aggccctggctgctgatatggcagcagcatggtacctgtgggaagtgaagaaacaacgggctggagtattgtgggatgttccttcacccccacctgtgggaaaggccgaactggaagatggaccttttgggacagcggtg

SEQ ID NO: 372600 - DNA, 140 bp, Artificial Sequence
  Synthetic
caccgctgtcccaaaaggtccatcttccagttcggcctttcccacaggtgggggtgaaggaacatcccacaatactccagcccgttgtttcttcacttcccacaggtaccatgctgctgccatatcagcagccagggcct

SEQ ID NO: 372601 - DNA, 140 bp, Artificial Sequence
  Synthetic
atacgccatgctgggtctccgaaccataggcgctgtgtccctagacttttctcctggaacgtcaggatctccaatcgtcgacaaaaaaggaaaagtcgtgggtctctatggtaatggtgtcgtacttgggagtcggccat

SEQ ID NO: 372602 - DNA, 140 bp, Artificial Sequence
  Synthetic
atggccgactcccaagtacgacaccattaccatagagacccacgacttttccttttttgtcgacgattggagatcctgacgttccaggagaaaagtctagggacacagcgcctatggttcggagacccagcatggcgtat

SEQ ID NO: 372603 - DNA, 140 bp, Artificial Sequence
  Synthetic
aggccctggctgctgatatgtggcccccactagagtcgtggcagctgaaatggaggaagctcttagaggacttccaataagataccaaaccccagccatcagagctgagcacactgggcggaccttttgggacagcggtg

SEQ ID NO: 372604 - DNA, 140 bp, Artificial Sequence
  Synthetic
caccgctgtcccaaaaggtccgcccagtgtgctcagctctgatggctggggtttggtatcttattggaagtcctctaagagcttcctccatttcagctgccacgactctagtgggggccacatatcagcagccagggcct

SEQ ID NO: 372605 - DNA, 140 bp, Artificial Sequence
  Synthetic
aggccctggctgctgatatgcgggccactaatagctggaggcatgctaatagcatgttatgtcatatccggaagctcagccgatttatcattggagaaagcggctgaagtatcctgggaagaccttttgggacagcggtg

SEQ ID NO: 372606 - DNA, 140 bp, Artificial Sequence
  Synthetic
caccgctgtcccaaaaggtcttcccaggatacttcagccgctttctccaatgataaatcggctgagcttccggatatgacataacatgctattagcatgcctccagctattagtggcccgcatatcagcagccagggcct

SEQ ID NO: 372607 - DNA, 140 bp, Artificial Sequence
  Synthetic
aggccctggctgctgatatgagagtttgacctttacaagaagtctggaatcactgaagtggatagaacagaagccaaagaagggttgaaaagaggagaaacaacacatcatgccgtgtccgaccttttgggacagcggtg

SEQ ID NO: 372608 - DNA, 140 bp, Artificial Sequence
  Synthetic
caccgctgtcccaaaaggtcggacacggcatgatgtgttgtttctcctcttttcaacccttctttggcttctgttctatccacttcagtgattccagacttcttgtaaaggtcaaactctcatatcagcagccagggcct

SEQ ID NO: 372609 - DNA, 140 bp, Artificial Sequence
  Synthetic
atacgccatgctgggtctcctcaatggctaacatttttagaggaagttacctagctggagctggacttctcttttccatcatgaagaacacaaccaacacaagaaggggaactggcaacacgtacttgggagtcggccat

SEQ ID NO: 372610 - DNA, 140 bp, Artificial Sequence
  Synthetic
atggccgactcccaagtacgtgttgccagttccccttcttgtgttggttgtgttcttcatgatggaaaagagaagtccagctccagctaggtaacttcctctaaaaatgttagccattgaggagacccagcatggcgtat

SEQ ID NO: 372611 - DNA, 140 bp, Artificial Sequence
  Synthetic
atacgccatgctgggtctcctgtcgcgaggctcagcaaagctgagatggttcgtcgagagaaacctggttacaccagaggggaaagtagtggacctcggttgcggtagagggggctggtccgtacttgggagtcggccat

SEQ ID NO: 372612 - DNA, 140 bp, Artificial Sequence
  Synthetic
atggccgactcccaagtacggaccagccccctctaccgcaaccgaggtccactactttcccctctggtgtaaccaggtttctctcgacgaaccatctcagctttgctgagcctcgcgacaggagacccagcatggcgtat

SEQ ID NO: 372613 - DNA, 140 bp, Artificial Sequence
  Synthetic
aggccctggctgctgatatggtaggagaggtacgggagctcaaggggaaacactgggagagaaatggaaaagacagttaaaccaactgagcaagtcagaatttaacacctacaaaaggaggaccttttgggacagcggtg

SEQ ID NO: 372614 - DNA, 140 bp, Artificial Sequence
  Synthetic
caccgctgtcccaaaaggtcctccttttgtaggtgttaaattctgacttgctcagttggtttaactgtcttttccatttctctcccagtgtttccccttgagctcccgtacctctcctaccatatcagcagccagggcct

SEQ ID NO: 372615 - DNA, 140 bp, Artificial Sequence
  Synthetic
atacgccatgctgggtctccaaagcgaaacgaggcacagcacaaatcatggaggtgacggccaagtggttatggggtttcctctctagaaacaaaaaacccagaatctgcacaagagaagcgtacttgggagtcggccat

SEQ ID NO: 372616 - DNA, 140 bp, Artificial Sequence
  Synthetic
atggccgactcccaagtacgcttctcttgtgcagattctgggttttttgtttctagagaggaaaccccataaccacttggccgtcacctccatgatttgtgctgtgcctcgtttcgctttggagacccagcatggcgtat

SEQ ID NO: 372617 - DNA, 140 bp, Artificial Sequence
  Synthetic
atacgccatgctgggtctccagagccatatggtacatgtggcttggagcacgcttcttagagtttgaagccctaggatttctgaatgaagatcactggttttccagagagaactctctgacgtacttgggagtcggccat

SEQ ID NO: 372618 - DNA, 140 bp, Artificial Sequence
  Synthetic
atggccgactcccaagtacgtcagagagttctctctggaaaaccagtgatcttcattcagaaatcctagggcttcaaactctaagaagcgtgctccaagccacatgtaccatatggctctggagacccagcatggcgtat

SEQ ID NO: 372619 - DNA, 140 bp, Artificial Sequence
  Synthetic
aggccctggctgctgatatgatggggtttcctctctagaaacaaaaaacccagaatctgcacaagagaagagtttacaagaaaagtcaggtcaaatgcagctattggagcagtgttcgttgaccttttgggacagcggtg

SEQ ID NO: 372620 - DNA, 140 bp, Artificial Sequence
  Synthetic
caccgctgtcccaaaaggtcaacgaacactgctccaatagctgcatttgacctgacttttcttgtaaactcttctcttgtgcagattctgggttttttgtttctagagaggaaaccccatcatatcagcagccagggcct

SEQ ID NO: 372621 - DNA, 140 bp, Artificial Sequence
  Synthetic
atacgccatgctgggtctcctgttcatggccttggtggcattccttcgtttcctaacaatcccaccaacagcagggatactgaaaagatggggaacaatcaaaaagtcaaaggccatcaacgtacttgggagtcggccat

SEQ ID NO: 372622 - DNA, 140 bp, Artificial Sequence
  Synthetic
atggccgactcccaagtacgttgatggcctttgactttttgattgttccccatcttttcagtatccctgctgttggtgggattgttaggaaacgaaggaatgccaccaaggccatgaacaggagacccagcatggcgtat

SEQ ID NO: 372623 - DNA, 140 bp, Artificial Sequence
  Synthetic
aggccctggctgctgatatgatggagtgctctccaagaacgggcctcgacttcaatgagatggtgttgctgcaaatggaaaacaaggcttggctggtgcacaggcaatggttcttagaccgaccttttgggacagcggtg

SEQ ID NO: 372624 - DNA, 140 bp, Artificial Sequence
  Synthetic
caccgctgtcccaaaaggtcggtctaagaaccattgcctgtgcaccagccaagccttgttttccatttgcagcaacaccatctcattgaagtcgaggcccgttcttggagagcactccatcatatcagcagccagggcct

SEQ ID NO: 372625 - DNA, 140 bp, Artificial Sequence
  Synthetic
atacgccatgctgggtctccttgagcacctagaaagactgcaaaggaaacacggaggaatgcttgtgagaaatccactttcacgaaactccacgcacgaaatgtactggatatctaatggcgtacttgggagtcggccat

SEQ ID NO: 372626 - DNA, 140 bp, Artificial Sequence
  Synthetic
atggccgactcccaagtacgccattagatatccagtacatttcgtgcgtggagtttcgtgaaagtggatttctcacaagcattcctccgtgtttcctttgcagtctttctaggtgctcaaggagacccagcatggcgtat

SEQ ID NO: 372627 - DNA, 140 bp, Artificial Sequence
  Synthetic
aggccctggctgctgatatgctctatgtgtacaggaaagtttaaagttgtaaaggaaatagcagaaacacaacatggaacaatagttgtcagagtacaatatgaaggggatggctctccagaccttttgggacagcggtg

SEQ ID NO: 372628 - DNA, 140 bp, Artificial Sequence
  Synthetic
caccgctgtcccaaaaggtctggagagccatccccttcatattgtactctgacaactattgttccatgttgtgtttctgctatttcctttacaactttaaactttcctgtacacatagagcatatcagcagccagggcct

SEQ ID NO: 372629 - DNA, 140 bp, Artificial Sequence
  Synthetic
aggccctggctgctgatatgtcagcagagagaattcactcagtggagtggagggagaaggactccacaaacttggatacatactcagagatatatcaaagattccagggggaaatatgtagaccttttgggacagcggtg

SEQ ID NO: 372630 - DNA, 140 bp, Artificial Sequence
  Synthetic
caccgctgtcccaaaaggtctacatatttccccctggaatctttgatatatctctgagtatgtatccaagtttgtggagtccttctccctccactccactgagtgaattctctctgctgacatatcagcagccagggcct

SEQ ID NO: 372631 - DNA, 140 bp, Artificial Sequence
  Synthetic
aggccctggctgctgatatgagatgacacagccggatgggacacaagaataacagaggatgatcttcagaatgaggctaaaatcactgacatcatggagcctgaacatgctctattggctgaccttttgggacagcggtg

SEQ ID NO: 372632 - DNA, 140 bp, Artificial Sequence
  Synthetic
caccgctgtcccaaaaggtcagccaatagagcatgttcaggctccatgatgtcagtgattttagcctcattctgaagatcatcctctgttattcttgtgtcccatccggctgtgtcatctcatatcagcagccagggcct

SEQ ID NO: 372633 - DNA, 140 bp, Artificial Sequence
  Synthetic
aggccctggctgctgatatgaaatacagctgaccgactacggagctcttacattggattgttcacctagaacaggattagacttcaatgaaatggtgttgttgacaatgaaagaaaaatcgaccttttgggacagcggtg

SEQ ID NO: 372634 - DNA, 140 bp, Artificial Sequence
  Synthetic
caccgctgtcccaaaaggtcgatttttctttcattgtcaacaacaccatttcattgaagtctaatcctgttctaggtgaacaatccaatgtaagagctccgtagtcggtcagctgtatttcatatcagcagccagggcct

SEQ ID NO: 372635 - DNA, 140 bp, Artificial Sequence
  Synthetic
aggccctggctgctgatatgataaaagacaacagagccgtccatgccgatatgggttattggatagaaagcgcacttaatgacacatggaagatagaaaaagcttctttcatcgaagttagaccttttgggacagcggtg

SEQ ID NO: 372636 - DNA, 140 bp, Artificial Sequence
  Synthetic
caccgctgtcccaaaaggtctaacttcgatgaaagaagctttttctatcttccatgtgtcattaagtgcgctttctatccaataacccatatcggcatggacggctctgttgtcttttatcatatcagcagccagggcct

SEQ ID NO: 372637 - DNA, 140 bp, Artificial Sequence
  Synthetic
atacgccatgctgggtctcctggagacctgatatatgctgacgacacagcaggctgggacacgagaatcactgaggatgaccttttaaatgaagaactgatcacagaacagatggcccctcgtacttgggagtcggccat

SEQ ID NO: 372638 - DNA, 140 bp, Artificial Sequence
  Synthetic
atggccgactcccaagtacgaggggccatctgttctgtgatcagttcttcatttaaaaggtcatcctcagtgattctcgtgtcccagcctgctgtgtcgtcagcatatatcaggtctccaggagacccagcatggcgtat

SEQ ID NO: 372639 - DNA, 140 bp, Artificial Sequence
  Synthetic
aggccctggctgctgatatgagaatgaggccaaaattactgacatcatggaacctgaacatgccctactggccacgtcaatctttaagctaacctaccaaaataaggttgtaagggtacagaccttttgggacagcggtg

SEQ ID NO: 372640 - DNA, 140 bp, Artificial Sequence
  Synthetic
caccgctgtcccaaaaggtctgtacccttacaaccttattttggtaggttagcttaaagattgacgtggccagtagggcatgttcaggttccatgatgtcagtaattttggcctcattctcatatcagcagccagggcct

SEQ ID NO: 372641 - DNA, 140 bp, Artificial Sequence
  Synthetic
atacgccatgctgggtctcctcacaacctgggaaaatgttccatatctagggaagagagaagaccaatggtgcggatcacttattggtctcacttccagagcaacctgggcccagaacatcgtacttgggagtcggccat

SEQ ID NO: 372642 - DNA, 140 bp, Artificial Sequence
  Synthetic
atggccgactcccaagtacgatgttctgggcccaggttgctctggaagtgagaccaataagtgatccgcaccattggtcttctctcttccctagatatggaacattttcccaggttgtgaggagacccagcatggcgtat

SEQ ID NO: 372643 - DNA, 140 bp, Artificial Sequence
  Synthetic
atacgccatgctgggtctccgcattgaagacaatccagagattgaagatgatatctttcgaaaaaaaagattgaccattatggacctccacccaggagcgggaaagacgaaaagatacctcgtacttgggagtcggccat

SEQ ID NO: 372644 - DNA, 140 bp, Artificial Sequence
  Synthetic
atggccgactcccaagtacgaggtatcttttcgtctttcccgctcctgggtggaggtccataatggtcaatcttttttttcgaaagatatcatcttcaatctctggattgtcttcaatgcggagacccagcatggcgtat

SEQ ID NO: 372645 - DNA, 140 bp, Artificial Sequence
  Synthetic
atacgccatgctgggtctccgacatagcattgaaaattcctcagtgaacgtgtctctaacagccattgccaaccaagccacagtgctaatgggtcttgggaaaggatggccattgtcgaacgtacttgggagtcggccat

SEQ ID NO: 372646 - DNA, 140 bp, Artificial Sequence
  Synthetic
atggccgactcccaagtacgttcgacaatggccatcctttcccaagacccattagcactgtggcttggttggcaatggctgttagagacacgttcactgaggaattttcaatgctatgtcggagacccagcatggcgtat

SEQ ID NO: 372647 - DNA, 140 bp, Artificial Sequence
  Synthetic
atacgccatgctgggtctcccaggagagacgcttggagagaaatggaaaaaccgattgaattcattggggaagagtgaattccagatttacaagagaagcggaattcaggaagtggatagcgtacttgggagtcggccat

SEQ ID NO: 372648 - DNA, 140 bp, Artificial Sequence
  Synthetic
atggccgactcccaagtacgctatccacttcctgaattccgcttctcttgtaaatctggaattcactcttccccaatgaattcaatcggtttttccatttctctccaagcgtctctcctgggagacccagcatggcgtat

SEQ ID NO: 372649 - DNA, 140 bp, Artificial Sequence
  Synthetic
aggccctggctgctgatatgaaggaggaccaggacacgaagaacccattcccatgtcaacatatgggtggaatcttgtgcgtctccaaagtggagttgatgttttctttactccaccagagaccttttgggacagcggtg

SEQ ID NO: 372650 - DNA, 140 bp, Artificial Sequence
  Synthetic
caccgctgtcccaaaaggtctctggtggagtaaagaaaacatcaactccactttggagacgcacaagattccacccatatgttgacatgggaatgggttcttcgtgtcctggtcctccttcatatcagcagccagggcct

SEQ ID NO: 372651 - DNA, 140 bp, Artificial Sequence
  Synthetic
aggccctggctgctgatatgcggttgaagctggacgaacactcagagtcctaaacttggtagaaaattggctgaacaacaacacccaattttgcataaaggttcttaacccatacatgccgaccttttgggacagcggtg

SEQ ID NO: 372652 - DNA, 140 bp, Artificial Sequence
  Synthetic
caccgctgtcccaaaaggtcggcatgtatgggttaagaacctttatgcaaaattgggtgttgttgttcagccaattttctaccaagtttaggactctgagtgttcgtccagcttcaaccgcatatcagcagccagggcct

SEQ ID NO: 372653 - DNA, 140 bp, Artificial Sequence
  Synthetic
atacgccatgctgggtctccgacagctgctgggatcatgaagaaccccacggtggacgggataacagtaatagatctagaaccaatatcctatgacccaaaatttgaaaagcaattagggcgtacttgggagtcggccat

SEQ ID NO: 372654 - DNA, 140 bp, Artificial Sequence
  Synthetic
atggccgactcccaagtacgccctaattgcttttcaaattttgggtcataggatattggttctagatctattactgttatcccgtccaccgtggggttcttcatgatcccagcagctgtcggagacccagcatggcgtat

SEQ ID NO: 372655 - DNA, 140 bp, Artificial Sequence
  Synthetic
aggccctggctgctgatatgacgtaccaaaacaaggtggtgcgtgtgcaaagacccacaccaagaggcacagtaatggatattatatcgagaagagaccaaagaggtagtggacaagttggaccttttgggacagcggtg

SEQ ID NO: 372656 - DNA, 140 bp, Artificial Sequence
  Synthetic
caccgctgtcccaaaaggtccaacttgtccactacctctttggtctcttctcgatataatatccattactgtgcctcttggtgtgggtctttgcacacgcaccaccttgttttggtacgtcatatcagcagccagggcct

SEQ ID NO: 372657 - DNA, 140 bp, Artificial Sequence
  Synthetic
aggccctggctgctgatatgacgacaaacatatggctgaaattgcgtgactcctacacccaaatgtgtgaccaccggctaatgtcagctgccatcaaggacagcaaggcagtccatgctggaccttttgggacagcggtg

SEQ ID NO: 372658 - DNA, 140 bp, Artificial Sequence
  Synthetic
caccgctgtcccaaaaggtccagcatggactgccttgctgtccttgatggcagctgacattagccggtggtcacacatttgggtgtaggagtcacgcaatttcagccatatgtttgtcgtcatatcagcagccagggcct

SEQ ID NO: 372659 - DNA, 140 bp, Artificial Sequence
  Synthetic
atacgccatgctgggtctccggaccgacaagaacagtttcgactcggaagcttgcttaacgtagtgcttaacagtttttattagagagcagatctctgatgaacaaccaacggaagaagacgtacttgggagtcggccat

SEQ ID NO: 372660 - DNA, 140 bp, Artificial Sequence
  Synthetic
atggccgactcccaagtacgtcttcttccgttggttgttcatcagagatctgctctctaataaaaactgttaagcactacgttaagcaagcttccgagtcgaaactgttcttgtcggtccggagacccagcatggcgtat

SEQ ID NO: 372661 - DNA, 140 bp, Artificial Sequence
  Synthetic
aggccctggctgctgatatggagagaaaccgcgtgtcaactgtgcagcagctgacaaagagattctcacttggaatgctacagggacgaggaccattgaaactgttcatggccctggtgggaccttttgggacagcggtg

SEQ ID NO: 372662 - DNA, 140 bp, Artificial Sequence
  Synthetic
caccgctgtcccaaaaggtcccaccagggccatgaacagtttcaatggtcctcgtccctgtagcattccaagtgagaatctctttgtcagctgctgcacagttgacacgcggtttctctccatatcagcagccagggcct

SEQ ID NO: 372663 - DNA, 140 bp, Artificial Sequence
  Synthetic
aggccctggctgctgatatgaaggatggaatgattggcaacaagtgcccttctgctcacaccacttccaccagctgattatgaaggatgggagggagatagtggtgccatgccgcaaccagaccttttgggacagcggtg

SEQ ID NO: 372664 - DNA, 140 bp, Artificial Sequence
  Synthetic
caccgctgtcccaaaaggtctggttgcggcatggcaccactatctccctcccatccttcataatcagctggtggaagtggtgtgagcagaagggcacttgttgccaatcattccatccttcatatcagcagccagggcct

SEQ ID NO: 372665 - DNA, 140 bp, Artificial Sequence
  Synthetic
aggccctggctgctgatatgtggggaacaatcaaaaaatcaaaggctatcaatgtcttgagagggttcaggaaagagattggaaggatgctgaacatcttgaacaggagacgcagaactggaccttttgggacagcggtg

SEQ ID NO: 372666 - DNA, 140 bp, Artificial Sequence
  Synthetic
caccgctgtcccaaaaggtccagttctgcgtctcctgttcaagatgttcagcatccttccaatctctttcctgaaccctctcaagacattgatagcctttgattttttgattgttccccacatatcagcagccagggcct

SEQ ID NO: 372667 - DNA, 140 bp, Artificial Sequence
  Synthetic
atacgccatgctgggtctcccaggtataattattatgatgattccaacagtgatggcgttccatttaaccacacgcaacggagaaccacacatgatcgtcagtagacaagagaaagggaacgtacttgggagtcggccat

SEQ ID NO: 372668 - DNA, 140 bp, Artificial Sequence
  Synthetic
atggccgactcccaagtacgttccctttctcttgtctactgacgatcatgtgtggttctccgttgcgtgtggttaaatggaacgccatcactgttggaatcatcataataattatacctgggagacccagcatggcgtat

SEQ ID NO: 372669 - DNA, 140 bp, Artificial Sequence
  Synthetic
aggccctggctgctgatatgccatggaccttggtgaactgtgtgaagacacaatcacttacaattgtcctcttctcaggcagaatgaaccagaagacatagactgttggtgcaactctacgaccttttgggacagcggtg

SEQ ID NO: 372670 - DNA, 140 bp, Artificial Sequence
  Synthetic
caccgctgtcccaaaaggtcgtagagttgcaccaacagtctatgtcttctggttcattctgcctgagaagaggacaattgtaagtgattgtgtcttcacacagttcaccaaggtccatggcatatcagcagccagggcct

SEQ ID NO: 372671 - DNA, 140 bp, Artificial Sequence
  Synthetic
atacgccatgctgggtctccgagaattgaaacttgggtcttgagacatccaggcttcaccataatggcagcaatcctggcatacaccataggaacgacatatttccaaagagtcctgattcgtacttgggagtcggccat

SEQ ID NO: 372672 - DNA, 140 bp, Artificial Sequence
  Synthetic
atggccgactcccaagtacgaatcaggactctttggaaatatgtcgttcctatggtgtatgccaggattgctgccattatggtgaagcctggatgtctcaagacccaagtttcaattctcggagacccagcatggcgtat

SEQ ID NO: 372673 - DNA, 140 bp, Artificial Sequence
  Synthetic
aggccctggctgctgatatgaatatcaaatagagactttgtggaaggggtttcaggaggaagctgggttgacatagtcttggaacatggaagctgtgtgacgacgatggcgaaaaataaagaccttttgggacagcggtg

SEQ ID NO: 372674 - DNA, 140 bp, Artificial Sequence
  Synthetic
caccgctgtcccaaaaggtctttatttttcgccatcgtcgtcacacagcttccatgttccaagactatgtcaacccagcttcctcctgaaaccccttccacaaagtctctatttgatattcatatcagcagccagggcct

SEQ ID NO: 372675 - DNA, 140 bp, Artificial Sequence
  Synthetic
atacgccatgctgggtctccccaacattggattttgaactgataaagacagaagccaaacatcccgccactctaaggaagtattgtatagaggcaaagctgaccaacacaacaacagcatcgtacttgggagtcggccat

SEQ ID NO: 372676 - DNA, 140 bp, Artificial Sequence
  Synthetic
atggccgactcccaagtacgatgctgttgttgtgttggtcagctttgcctctatacaatacttccttagagtggcgggatgtttggcttctgtctttatcagttcaaaatccaatgttggggagacccagcatggcgtat

SEQ ID NO: 372677 - DNA, 140 bp, Artificial Sequence
  Synthetic
aggccctggctgctgatatgtctaaggaagtattgtatagaggcaaagctgaccaacacaacaacagcatctcgctgcccaacacaaggagaacctagcctaaatgaagaacaggacaaagaccttttgggacagcggtg

SEQ ID NO: 372678 - DNA, 140 bp, Artificial Sequence
  Synthetic
caccgctgtcccaaaaggtctttgtcctgttcttcatttaggctaggttctccttgtgttgggcagcgagatgctgttgttgtgttggtcagctttgcctctatacaatacttccttagacatatcagcagccagggcct

SEQ ID NO: 372679 - DNA, 140 bp, Artificial Sequence
  Synthetic
atacgccatgctgggtctccagatttgtctgcaaacactccatggtagacagaggatggggaaatggatgcggattatttggaaagggaggtatcgtgacctgtgcaatgttcacatgcacgtacttgggagtcggccat

SEQ ID NO: 372680 - DNA, 140 bp, Artificial Sequence
  Synthetic
atggccgactcccaagtacgtgcatgtgaacattgcacaggtcacgatacctccctttccaaataatccgcatccatttccccatcctctgtctaccatggagtgtttgcagacaaatctggagacccagcatggcgtat

SEQ ID NO: 372681 - DNA, 140 bp, Artificial Sequence
  Synthetic
aggccctggctgctgatatgcggattatttggaaagggaggtatcgtgacctgtgcaatgttcacatgcaaaaagaacatggaaggaaaaatcgtgcaaccagaaaacttggagtacaccgaccttttgggacagcggtg

SEQ ID NO: 372682 - DNA, 140 bp, Artificial Sequence
  Synthetic
caccgctgtcccaaaaggtcggtgtactccaagttttctggttgcacgatttttccttccatgttctttttgcatgtgaacattgcacaggtcacgatacctccctttccaaataatccgcatatcagcagccagggcct

SEQ ID NO: 372683 - DNA, 140 bp, Artificial Sequence
  Synthetic
atacgccatgctgggtctccattgtgataacacctcactcaggggaagagaatgcagtcggaaatgacacaggaaaacacggcaaggaaattaaagtaacaccacagagttccatcacagcgtacttgggagtcggccat

SEQ ID NO: 372684 - DNA, 140 bp, Artificial Sequence
  Synthetic
atggccgactcccaagtacgctgtgatggaactctgtggtgttactttaatttccttgccgtgttttcctgtgtcatttccgactgcattctcttcccctgagtgaggtgttatcacaatggagacccagcatggcgtat

SEQ ID NO: 372685 - DNA, 140 bp, Artificial Sequence
  Synthetic
aggccctggctgctgatatgactttcaaaaatccccatgcaaagaaacaggatgttgttgttttaggatcccaagaaggggctatgcacacagcactcacaggggccacggaaatccagagaccttttgggacagcggtg

SEQ ID NO: 372686 - DNA, 140 bp, Artificial Sequence
  Synthetic
caccgctgtcccaaaaggtctctggatttccgtggcccctgtgagtgctgtgtgcatagccccttcttgggatcctaaaacaacaacatcctgtttctttgcatggggatttttgaaagtcatatcagcagccagggcct

SEQ ID NO: 372687 - DNA, 140 bp, Artificial Sequence
  Synthetic
aggccctggctgctgatatgccaagaaggggctatgcacacagcactcacaggggccacggaaatccagatgtcatcaggaaacttactattcacaggacatcttaaatgtaggctgagagaccttttgggacagcggtg

SEQ ID NO: 372688 - DNA, 140 bp, Artificial Sequence
  Synthetic
caccgctgtcccaaaaggtctctcagcctacatttaagatgtcctgtgaatagtaagtttcctgatgacatctggatttccgtggcccctgtgagtgctgtgtgcatagccccttcttggcatatcagcagccagggcct

SEQ ID NO: 372689 - DNA, 140 bp, Artificial Sequence
  Synthetic
atacgccatgctgggtctccatggacaaactacagctcaaaggaatgtcatattccatgtgtacaggaaagttcaaagttgtgaaggaaatagcagaaacacaacatggaacaatagttacgtacttgggagtcggccat

SEQ ID NO: 372690 - DNA, 140 bp, Artificial Sequence
  Synthetic
atggccgactcccaagtacgtaactattgttccatgttgtgtttctgctatttccttcacaactttgaactttcctgtacacatggaatatgacattcctttgagctgtagtttgtccatggagacccagcatggcgtat

SEQ ID NO: 372691 - DNA, 140 bp, Artificial Sequence
  Synthetic
atacgccatgctgggtctcccattcggagacagctacatcattataggagtagaaccgggacaactgaagctcagctggtttaagaaaggaagttctattggccaaatgtttgagacaaccgtacttgggagtcggccat

SEQ ID NO: 372692 - DNA, 140 bp, Artificial Sequence
  Synthetic
atggccgactcccaagtacggttgtctcaaacatttggccaatagaacttcctttcttaaaccagctgagcttcagttgtcccggttctactcctataatgatgtagctgtctccgaatgggagacccagcatggcgtat

SEQ ID NO: 372693 - DNA, 140 bp, Artificial Sequence
  Synthetic
aggccctggctgctgatatgctcagctggtttaagaaaggaagttctattggccaaatgtttgagacaacaatgagaggagcgaagagaatggccattttaggtgacacagcttgggattgaccttttgggacagcggtg

SEQ ID NO: 372694 - DNA, 140 bp, Artificial Sequence
  Synthetic
caccgctgtcccaaaaggtcaatcccaagctgtgtcacctaaaatggccattctcttcgctcctctcattgttgtctcaaacatttggccaatagaacttcctttcttaaaccagctgagcatatcagcagccagggcct

SEQ ID NO: 372695 - DNA, 140 bp, Artificial Sequence
  Synthetic
atacgccatgctgggtctccaacaagactggagaatctgatgtggaaacaaataacaccagaactgaatcacattctatcagaaaatgaggtaaagttgactatcatgacaggagacattcgtacttgggagtcggccat

SEQ ID NO: 372696 - DNA, 140 bp, Artificial Sequence
  Synthetic
atggccgactcccaagtacgaatgtctcctgtcatgatagtcaactttacctcattttctgatagaatgtgattcagttctggtgttatttgtttccacatcagattctccagtcttgttggagacccagcatggcgtat

SEQ ID NO: 372697 - DNA, 140 bp, Artificial Sequence
  Synthetic
atacgccatgctgggtctccaaaggaatcatgcaggcaggaaaacgatccctgcggcctcaacccaccgagctgaagtactcttggaaagcatggggcaaagcgaaaatgctctccacagcgtacttgggagtcggccat

SEQ ID NO: 372698 - DNA, 140 bp, Artificial Sequence
  Synthetic
atggccgactcccaagtacgctgtggagagcattttcgctttgccccatgctttccaagagtacttcagctcggtgggttgaggccgcagggatcgttttcctgcctgcatgattcctttggagacccagcatggcgtat

SEQ ID NO: 372699 - DNA, 140 bp, Artificial Sequence
  Synthetic
atacgccatgctgggtctccagcttcataaccacacctttctcattgatggccccgaaacagcagaatgtcccaacacaaacagagcttggaactcactagaggttgaagactatggcttcgtacttgggagtcggccat

SEQ ID NO: 372700 - DNA, 140 bp, Artificial Sequence
  Synthetic
atggccgactcccaagtacgaagccatagtcttcaacctctagtgagttccaagctctgtttgtgttgggacattctgctgtttcggggccatcaatgagaaaggtgtggttatgaagctggagacccagcatggcgtat

SEQ ID NO: 372701 - DNA, 140 bp, Artificial Sequence
  Synthetic
aggccctggctgctgatatgcccaacacaaacagagcttggaactcactagaggttgaagactatggctttggagtattcaccaccaacatatggctgaaattgaaagaaaggcaggatggaccttttgggacagcggtg

SEQ ID NO: 372702 - DNA, 140 bp, Artificial Sequence
  Synthetic
caccgctgtcccaaaaggtccatcctgcctttctttcaatttcagccatatgttggtggtgaatactccaaagccatagtcttcaacctctagtgagttccaagctctgtttgtgttgggcatatcagcagccagggcct

SEQ ID NO: 372703 - DNA, 140 bp, Artificial Sequence
  Synthetic
atacgccatgctgggtctcctattttgtgactcaaaactcatgtcagcagccataaaagacaacagagccgtccacgccgacatgggttattggatagaaagcgcactcaatgacacatgcgtacttgggagtcggccat

SEQ ID NO: 372704 - DNA, 140 bp, Artificial Sequence
  Synthetic
atggccgactcccaagtacgcatgtgtcattgagtgcgctttctatccaataacccatgtcggcgtggacggctctgttgtcttttatggctgctgacatgagttttgagtcacaaaataggagacccagcatggcgtat

SEQ ID NO: 372705 - DNA, 140 bp, Artificial Sequence
  Synthetic
aggccctggctgctgatatggtccacgccgacatgggttattggatagaaagcgcactcaatgacacatggaagattgagaaagcctcttttattgaagttaaaagctgccactggccaagaccttttgggacagcggtg

SEQ ID NO: 372706 - DNA, 140 bp, Artificial Sequence
  Synthetic
caccgctgtcccaaaaggtcttggccagtggcagcttttaacttcaataaaagaggctttctcaatcttccatgtgtcattgagtgcgctttctatccaataacccatgtcggcgtggaccatatcagcagccagggcct

SEQ ID NO: 372707 - DNA, 140 bp, Artificial Sequence
  Synthetic
atacgccatgctgggtctcctagaatgctcaccacggacaggcttggattttaatgaaatgattttgttgacaatgaagaacaaagcctggatggtacataggcaatggttctttgacctcgtacttgggagtcggccat

SEQ ID NO: 372708 - DNA, 140 bp, Artificial Sequence
  Synthetic
atggccgactcccaagtacgaggtcaaagaaccattgcctatgtaccatccaggctttgttcttcattgtcaacaaaatcatttcattaaaatccaagcctgtccgtggtgagcattctaggagacccagcatggcgtat

SEQ ID NO: 372709 - DNA, 140 bp, Artificial Sequence
  Synthetic
aggccctggctgctgatatgaacttggtcaaactccattcaggggttgatgtgttttacaaacccactgagcaggtggacaccttgctctgtgacattggggagtcgtcctctaatccgagaccttttgggacagcggtg

SEQ ID NO: 372710 - DNA, 140 bp, Artificial Sequence
  Synthetic
caccgctgtcccaaaaggtctcggattagaggacgactccccaatgtcacagagcaaggtgtccacctgctcagtgggtttgtaaaacacatcaacccctgaatggagtttgaccaagttcatatcagcagccagggcct

SEQ ID NO: 372711 - DNA, 140 bp, Artificial Sequence
  Synthetic
aggccctggctgctgatatgtgctttgatggggaaaggaacaaccaggtgttggaggagaacatggacgtggagatctggacaaaggaaggagaaagaaagaaattgcgacctcgctggtgaccttttgggacagcggtg

SEQ ID NO: 372712 - DNA, 140 bp, Artificial Sequence
  Synthetic
caccgctgtcccaaaaggtcaccagcgaggtcgcaatttctttctttctccttcctttgtccagatctccacgtccatgttctcctccaacacctggttgttcctttccccatcaaagcacatatcagcagccagggcct

SEQ ID NO: 372713 - DNA, 140 bp, Artificial Sequence
  Synthetic
atacgccatgctgggtctcccccgagtaggaacgaaacatgcaatattactagttgcagtctctttcgtgacattgatcacagggaacatgtcctttcgagatttggggagagtgatggtcgtacttgggagtcggccat

SEQ ID NO: 372714 - DNA, 140 bp, Artificial Sequence
  Synthetic
atggccgactcccaagtacgaccatcactctccccaaatctcgaaaggacatgttccctgtgatcaatgtcacgaaagagactgcaactagtaatattgcatgtttcgttcctactcgggggagacccagcatggcgtat

SEQ ID NO: 372715 - DNA, 140 bp, Artificial Sequence
  Synthetic
atacgccatgctgggtctcccatggtgggcgctactatgacggatgacataggcatgggcgtgacttatcttgccctattagcagccttcaaagtcagaccaacttttgcagctggactacgtacttgggagtcggccat

SEQ ID NO: 372716 - DNA, 140 bp, Artificial Sequence
  Synthetic
atggccgactcccaagtacgtagtccagctgcaaaagttggtctgactttgaaggctgctaatagggcaagataagtcacgcccatgcctatgtcatccgtcatagtagcgcccaccatgggagacccagcatggcgtat

SEQ ID NO: 372717 - DNA, 140 bp, Artificial Sequence
  Synthetic
atacgccatgctgggtctccctcttaagaaagctgacctccaaggaattgatgatgaccaccataggaatcgtactcctctctcagagcaccataccagagactatacttgaactgactgcgtacttgggagtcggccat

SEQ ID NO: 372718 - DNA, 140 bp, Artificial Sequence
  Synthetic
atggccgactcccaagtacgcagtcagttcaagtatagtctctggtatggtgctctgagagaggagtacgattcctatggtggtcatcatcaattccttggaggtcagctttcttaagagggagacccagcatggcgtat

SEQ ID NO: 372719 - DNA, 140 bp, Artificial Sequence
  Synthetic
atacgccatgctgggtctccaagaacccatccccatgtcaacatatgggtggaatctagtgcgtctgcaaagtggggtcgacgttttcttcaccccgccagaaaagtgtgatacattgttcgtacttgggagtcggccat

SEQ ID NO: 372720 - DNA, 140 bp, Artificial Sequence
  Synthetic
atggccgactcccaagtacgaacaatgtatcacacttttctggcggggtgaagaaaacgtcgaccccactttgcagacgcactagattccacccatatgttgacatggggatgggttcttggagacccagcatggcgtat

SEQ ID NO: 372721 - DNA, 140 bp, Artificial Sequence
  Synthetic
atacgccatgctgggtctccacgcgttggctttggggatgatggttctcaaaatagtaagaaacatggaaaagtatcaactagcagtgactatcatggctatcttgtgcgtcccaaatgccgtacttgggagtcggccat

SEQ ID NO: 372722 - DNA, 140 bp, Artificial Sequence
  Synthetic
atggccgactcccaagtacggcatttgggacgcacaagatagccatgatagtcactgctagttgatacttttccatgtttcttactattttgagaaccatcatccccaaagccaacgcgtggagacccagcatggcgtat

SEQ ID NO: 372723 - DNA, 140 bp, Artificial Sequence
  Synthetic
atacgccatgctgggtctcctggtgcacaggcaatggttcctagacctgccgttaccatggctacccggagcggacacacaaggatcaaattggatacagaaagagacattggtcactttcgtacttgggagtcggccat

SEQ ID NO: 372724 - DNA, 140 bp, Artificial Sequence
  Synthetic
atggccgactcccaagtacgaaagtgaccaatgtctctttctgtatccaatttgatccttgtgtgtccgctccgggtagccatggtaacggcaggtctaggaaccattgcctgtgcaccaggagacccagcatggcgtat

SEQ ID NO: 372725 - DNA, 140 bp, Artificial Sequence
  Synthetic
atacgccatgctgggtctccagtgatattacaaaacgcatggaaagtgagctgcacaacactggcagtggtgtccgtttccccactgcttttaacatcctcacagcagaaagcggattggcgtacttgggagtcggccat

SEQ ID NO: 372726 - DNA, 140 bp, Artificial Sequence
  Synthetic
atggccgactcccaagtacgccaatccgctttctgctgtgaggatgttaaaagcagtggggaaacggacaccactgccagtgttgtgcagctcactttccatgcgttttgtaatatcactggagacccagcatggcgtat

SEQ ID NO: 372727 - DNA, 140 bp, Artificial Sequence
  Synthetic
atacgccatgctgggtctccataccactggcgttgacgatcaaaggcctcaatccaacagccattttcttaacaaccctctcaagaactagcaagaaaaggagctggccactaaatgaggcgtacttgggagtcggccat

SEQ ID NO: 372728 - DNA, 140 bp, Artificial Sequence
  Synthetic
atggccgactcccaagtacgcctcatttagtggccagctccttttcttgctagttcttgagagggttgttaagaaaatggctgttggattgaggcctttgatcgtcaacgccagtggtatggagacccagcatggcgtat

SEQ ID NO: 372729 - DNA, 140 bp, Artificial Sequence
  Synthetic
atacgccatgctgggtctcctgctggacgtagacctacacccagcttcagcctggaccctctatgcagtagccacaacagtcatcactcccatgatgagacacacaattgaaaatacaaccgtacttgggagtcggccat

SEQ ID NO: 372730 - DNA, 140 bp, Artificial Sequence
  Synthetic
atggccgactcccaagtacggttgtattttcaattgtgtgtctcatcatgggagtgatgactgttgtggctactgcatagagggtccaggctgaagctgggtgtaggtctacgtccagcaggagacccagcatggcgtat

SEQ ID NO: 372731 - DNA, 140 bp, Artificial Sequence
  Synthetic
atacgccatgctgggtctccgtgttacgtgctcactggaagatcggctgatttggaactggagagagctgctgacgtaagatgggaagaacaggcagagatatcaggaagcagtccaattcgtacttgggagtcggccat

SEQ ID NO: 372732 - DNA, 140 bp, Artificial Sequence
  Synthetic
atggccgactcccaagtacgaattggactgcttcctgatatctctgcctgttcttcccatcttacgtcagcagctctctccagttccaaatcagccgatcttccagtgagcacgtaacacggagacccagcatggcgtat

SEQ ID NO: 372733 - DNA, 140 bp, Artificial Sequence
  Synthetic
atacgccatgctgggtctccctgtcgataacaatatcggaagatggtagcatgtcgataaaaaatgaagaagaagaacaaacactgaccatactcattagaacaggactgctggtgatatcgtacttgggagtcggccat

SEQ ID NO: 372734 - DNA, 140 bp, Artificial Sequence
  Synthetic
atggccgactcccaagtacgatatcaccagcagtcctgttctaatgagtatggtcagtgtttgttcttcttcttcattttttatcgacatgctaccatcttccgatattgttatcgacagggagacccagcatggcgtat

SEQ ID NO: 372735 - DNA, 140 bp, Artificial Sequence
  Synthetic
atacgccatgctgggtctcccaggactttttcccgtgtcaataccaatcacggcagctgcatggtacctgtgggaagtgaaaaaacaacgagccggagtattgtgggatgtcccttcacccgtacttgggagtcggccat

SEQ ID NO: 372736 - DNA, 140 bp, Artificial Sequence
  Synthetic
atggccgactcccaagtacgggtgaagggacatcccacaatactccggctcgttgttttttcacttcccacaggtaccatgcagctgccgtgattggtattgacacgggaaaaagtcctgggagacccagcatggcgtat

SEQ ID NO: 372737 - DNA, 140 bp, Artificial Sequence
  Synthetic
aggccctggctgctgatatgtgggaagtgaaaaaacaacgagccggagtattgtgggatgtcccttcacctccacctgtgggaaaggccgaactggaagatggagcctatagaatcaagcgaccttttgggacagcggtg

SEQ ID NO: 372738 - DNA, 140 bp, Artificial Sequence
  Synthetic
caccgctgtcccaaaaggtcgcttgattctataggctccatcttccagttcggcctttcccacaggtggaggtgaagggacatcccacaatactccggctcgttgttttttcacttcccacatatcagcagccagggcct

SEQ ID NO: 372739 - DNA, 140 bp, Artificial Sequence
  Synthetic
aggccctggctgctgatatgagaaagggattctaggatactcgcagatcggagccggagtttacaaagaaggaacattccacacaatgtggcatgtcacacgtggtgctgttctaatgcagaccttttgggacagcggtg

SEQ ID NO: 372740 - DNA, 140 bp, Artificial Sequence
  Synthetic
caccgctgtcccaaaaggtctgcattagaacagcaccacgtgtgacatgccacattgtgtggaatgttccttctttgtaaactccggctccgatctgcgagtatcctagaatccctttctcatatcagcagccagggcct

SEQ ID NO: 372741 - DNA, 140 bp, Artificial Sequence
  Synthetic
aggccctggctgctgatatgggaacattccacacaatgtggcatgtcacacgtggtgctgttctaatgcataaagggaagagaattgaaccatcatgggcggacgtcaagaaagacctaagaccttttgggacagcggtg

SEQ ID NO: 372742 - DNA, 140 bp, Artificial Sequence
  Synthetic
caccgctgtcccaaaaggtcttaggtctttcttgacgtccgcccatgatggttcaattctcttccctttatgcattagaacagcaccacgtgtgacatgccacattgtgtggaatgttcccatatcagcagccagggcct

SEQ ID NO: 372743 - DNA, 140 bp, Artificial Sequence
  Synthetic
atacgccatgctgggtctccctctggacttttctcctggaacgtcaggatctccaattgtcgacaaaaaaggaaaagttgtgggcctttatggcaacggtgtcgtcacaaggagtggaaccgtacttgggagtcggccat

SEQ ID NO: 372744 - DNA, 140 bp, Artificial Sequence
  Synthetic
atggccgactcccaagtacggttccactccttgtgacgacaccgttgccataaaggcccacaacttttccttttttgtcgacaattggagatcctgacgttccaggagaaaagtccagagggagacccagcatggcgtat

SEQ ID NO: 372745 - DNA, 140 bp, Artificial Sequence
  Synthetic
aggccctggctgctgatatgggaaaagttgtgggcctttatggcaacggtgtcgtcacaaggagtggaacatatgtgagtgccatagcccagactgaaaaaagcatcgaagacaacccaggaccttttgggacagcggtg

SEQ ID NO: 372746 - DNA, 140 bp, Artificial Sequence
  Synthetic
caccgctgtcccaaaaggtcctgggttgtcttcgatgcttttttcagtctgggctatggcactcacatatgttccactccttgtgacgacaccgttgccataaaggcccacaacttttcccatatcagcagccagggcct

SEQ ID NO: 372747 - DNA, 140 bp, Artificial Sequence
  Synthetic
atacgccatgctgggtctccagattgaagatgacatctttcgaaagaaaagattgaccatcatggacctccacccaggagcaggaaaaacaaagagataccttccagcaatagtcagagacgtacttgggagtcggccat

SEQ ID NO: 372748 - DNA, 140 bp, Artificial Sequence
  Synthetic
atggccgactcccaagtacgtctctgactattgctggaaggtatctctttgtttttcctgctcctgggtggaggtccatgatggtcaatcttttctttcgaaagatgtcatcttcaatctggagacccagcatggcgtat

SEQ ID NO: 372749 - DNA, 140 bp, Artificial Sequence
  Synthetic
aggccctggctgctgatatgcacccaggagcaggaaaaacaaagagataccttccagcaatagtcagagaagccataaaacgaggcttgagaacactaatcctggcccccactagagttggaccttttgggacagcggtg

SEQ ID NO: 372750 - DNA, 140 bp, Artificial Sequence
  Synthetic
caccgctgtcccaaaaggtccaactctagtgggggccaggattagtgttctcaagcctcgttttatggcttctctgactattgctggaaggtatctctttgtttttcctgctcctgggtgcatatcagcagccagggcct

SEQ ID NO: 372751 - DNA, 140 bp, Artificial Sequence
  Synthetic
atacgccatgctgggtctcctggcggctgaaatggaagaagctctcagaggacttccaataagataccaaaccccagctatcagagctgagcacactggacgggagattgtggatctaatcgtacttgggagtcggccat

SEQ ID NO: 372752 - DNA, 140 bp, Artificial Sequence
  Synthetic
atggccgactcccaagtacgattagatccacaatctcccgtccagtgtgctcagctctgatagctggggtttggtatcttattggaagtcctctgagagcttcttccatttcagccgccaggagacccagcatggcgtat

SEQ ID NO: 372753 - DNA, 140 bp, Artificial Sequence
  Synthetic
aggccctggctgctgatatgaccccagctatcagagctgagcacactggacgggagattgtggatctaatgtgtcacgccacatttaccatgaggctactatcaccaattagagtgccaagaccttttgggacagcggtg

SEQ ID NO: 372754 - DNA, 140 bp, Artificial Sequence
  Synthetic
caccgctgtcccaaaaggtcttggcactctaattggtgatagtagcctcatggtaaatgtggcgtgacacattagatccacaatctcccgtccagtgtgctcagctctgatagctggggtcatatcagcagccagggcct

SEQ ID NO: 372755 - DNA, 140 bp, Artificial Sequence
  Synthetic
atacgccatgctgggtctccatagttctggagttttttatgatggtgctacttataccagaaccagaaaagcagagaactccccaagacaatcaactcgcatatgtcgtgataggcataccgtacttgggagtcggccat

SEQ ID NO: 372756 - DNA, 140 bp, Artificial Sequence
  Synthetic
atggccgactcccaagtacggtatgcctatcacgacatatgcgagttgattgtcttggggagttctctgcttttctggttctggtataagtagcaccatcataaaaaactccagaactatggagacccagcatggcgtat

SEQ ID NO: 372757 - DNA, 140 bp, Artificial Sequence
  Synthetic
atacgccatgctgggtctcctatatcaagactaggaccaatgattgggactttgtggtcacgacagacatttcagaaatgggtgcaaacttcaaggctgagagggttatagaccccagaccgtacttgggagtcggccat

SEQ ID NO: 372758 - DNA, 140 bp, Artificial Sequence
  Synthetic
atggccgactcccaagtacggtctggggtctataaccctctcagccttgaagtttgcacccatttctgaaatgtctgtcgtgaccacaaagtcccaatcattggtcctagtcttgatataggagacccagcatggcgtat

SEQ ID NO: 372759 - DNA, 140 bp, Artificial Sequence
  Synthetic
aggccctggctgctgatatgcttctagataacatcaacacgcctgaaggaatcattcccagcatgttcgaaccagagcgtgaaaaggtggacgccattgatggtgaataccgcttgagaggaccttttgggacagcggtg

SEQ ID NO: 372760 - DNA, 140 bp, Artificial Sequence
  Synthetic
caccgctgtcccaaaaggtcctctcaagcggtattcaccatcaatggcgtccaccttttcacgctctggttcgaacatgctgggaatgattccttcaggcgtgttgatgttatctagaagcatatcagcagccagggcct

SEQ ID NO: 372761 - DNA, 140 bp, Artificial Sequence
  Synthetic
aggccctggctgctgatatgaccagagcgtgaaaaggtggacgccattgatggtgaataccgcttgagaggagaagcgaggaaaacatttgtggacctaatgagaagaggagacctaccagaccttttgggacagcggtg

SEQ ID NO: 372762 - DNA, 140 bp, Artificial Sequence
  Synthetic
caccgctgtcccaaaaggtctggtaggtctcctcttctcattaggtccacaaatgttttcctcgcttctcctctcaagcggtattcaccatcaatggcgtccaccttttcacgctctggtcatatcagcagccagggcct

SEQ ID NO: 372763 - DNA, 140 bp, Artificial Sequence
  Synthetic
atacgccatgctgggtctccgtctggctagcctacagagtggcagctgaaggtatcaactacgcagacagaagatggtgctttgatggagtcaagaacaaccaaatcttggaagaaaatgcgtacttgggagtcggccat

SEQ ID NO: 372764 - DNA, 140 bp, Artificial Sequence
  Synthetic
atggccgactcccaagtacgcattttcttccaagatttggttgttcttgactccatcaaagcaccatcttctgtctgcgtagttgataccttcagctgccactctgtaggctagccagacggagacccagcatggcgtat

SEQ ID NO: 372765 - DNA, 140 bp, Artificial Sequence
  Synthetic
atacgccatgctgggtctcctggaagtggaaatttggacaaaagaaggagaaaggaagaaattaaaacccagatggttagatgctaggatctactctgacccactggcgctcaaagaattcgtacttgggagtcggccat

SEQ ID NO: 372766 - DNA, 140 bp, Artificial Sequence
  Synthetic
atggccgactcccaagtacgaattctttgagcgccagtgggtcagagtagatcctagcatctaaccatctgggttttaatttcttcctttctccttcttttgtccaaatttccacttccaggagacccagcatggcgtat

SEQ ID NO: 372767 - DNA, 140 bp, Artificial Sequence
  Synthetic
atacgccatgctgggtctcccaaggaattcgcagctggaagaaaatccctgaccttgaatctaatcaccgagatgggtaggctcccaaccttcatgacccagaaagcaaggaatgcattgcgtacttgggagtcggccat

SEQ ID NO: 372768 - DNA, 140 bp, Artificial Sequence
  Synthetic
atggccgactcccaagtacgcaatgcattccttgctttctgggtcatgaaggttgggagcctacccatctcggtgattagattcaaggtcagggattttcttccagctgcgaattccttgggagacccagcatggcgtat

SEQ ID NO: 372769 - DNA, 140 bp, Artificial Sequence
  Synthetic
aggccctggctgctgatatggacaacttagcagtcctgcatacggctgaagcaggcggaagggcgtacaatcatgctcttagtgaactgccggagactctggagacattgcttttactgagaccttttgggacagcggtg

SEQ ID NO: 372770 - DNA, 140 bp, Artificial Sequence
  Synthetic
caccgctgtcccaaaaggtctcagtaaaagcaatgtctccagagtctccggcagttcactaagagcatgattgtacgcccttccgcctgcttcagccgtatgcaggactgctaagttgtccatatcagcagccagggcct

SEQ ID NO: 372771 - DNA, 140 bp, Artificial Sequence
  Synthetic
aggccctggctgctgatatgtcatgctcttagtgaactgccggagactctggagacattgcttttactgacacttttggccacagtcacgggcggaatcttcctgttcttgatgagcggagaccttttgggacagcggtg

SEQ ID NO: 372772 - DNA, 140 bp, Artificial Sequence
  Synthetic
caccgctgtcccaaaaggtctccgctcatcaagaacaggaagattccgcccgtgactgtggccaaaagtgtcagtaaaagcaatgtctccagagtctccggcagttcactaagagcatgacatatcagcagccagggcct

SEQ ID NO: 372773 - DNA, 140 bp, Artificial Sequence
  Synthetic
atacgccatgctgggtctccaacatcctggacatagatctacgtcctgcatcagcttggactctatatgccgtggcaacaactttcatcacaccaatgtttagacatagcattgaaaattcgtacttgggagtcggccat

SEQ ID NO: 372774 - DNA, 140 bp, Artificial Sequence
  Synthetic
atggccgactcccaagtacgaattttcaatgctatgtctaaacattggtgtgatgaaagttgttgccacggcatatagagtccaagctgatgcaggacgtagatctatgtccaggatgttggagacccagcatggcgtat

SEQ ID NO: 372775 - DNA, 140 bp, Artificial Sequence
  Synthetic
aggccctggctgctgatatgcgtggcaacaactttcatcacaccaatgtttagacatagcattgaaaattcctcagtgaatgtgtctctaacagccattgccaaccaagccacagtgttagaccttttgggacagcggtg

SEQ ID NO: 372776 - DNA, 140 bp, Artificial Sequence
  Synthetic
caccgctgtcccaaaaggtctaacactgtggcttggttggcaatggctgttagagacacattcactgaggaattttcaatgctatgtctaaacattggtgtgatgaaagttgttgccacgcatatcagcagccagggcct

SEQ ID NO: 372777 - DNA, 140 bp, Artificial Sequence
  Synthetic
atacgccatgctgggtctccatgggtcttgggaaaggatggccattgtcgaaaatggacatcggagttccccttctcgctatcggatgctattcacaagtcaaccccataactctcacagcgtacttgggagtcggccat

SEQ ID NO: 372778 - DNA, 140 bp, Artificial Sequence
  Synthetic
atggccgactcccaagtacgctgtgagagttatggggttgacttgtgaatagcatccgatagcgagaaggggaactccgatgtccattttcgacaatggccatcctttcccaagacccatggagacccagcatggcgtat

SEQ ID NO: 372779 - DNA, 140 bp, Artificial Sequence
  Synthetic
atacgccatgctgggtctccaagctgtgctgcctgtgagccccgtcaaggacgttaaaagaagaagtcaggccccaaagccacggtttgagcaaaccgtgactgcctgtagctccgtcgtcgtacttgggagtcggccat

SEQ ID NO: 372780 - DNA, 140 bp, Artificial Sequence
  Synthetic
atggccgactcccaagtacgacgacggagctacaggcagtcacggtttgctcaaaccgtggctttggggcctgacttcttcttttaacgtccttgacggggctcacaggcagcacagcttggagacccagcatggcgtat

SEQ ID NO: 372781 - DNA, 140 bp, Artificial Sequence
  Synthetic
atacgccatgctgggtctcccagcccttctcttattggtagcacattatgctatcatagggccaggactccaagcgaaagcaactagagaggctcagaaaagagcagcagcgggcatcatcgtacttgggagtcggccat

SEQ ID NO: 372782 - DNA, 140 bp, Artificial Sequence
  Synthetic
atggccgactcccaagtacgatgatgcccgctgctgctcttttctgagcctctctagttgctttcgcttggagtcctggccctatgatagcataatgtgctaccaataagagaagggctgggagacccagcatggcgtat

SEQ ID NO: 372783 - DNA, 140 bp, Artificial Sequence
  Synthetic
aggccctggctgctgatatgctctgcgtgactcaagtattgatgatgaggactacatgggctttatgtgaagctctaaccttagcgaccgggcccatctctacactgtgggaaggaaatcgaccttttgggacagcggtg

SEQ ID NO: 372784 - DNA, 140 bp, Artificial Sequence
  Synthetic
caccgctgtcccaaaaggtcgatttccttcccacagtgtagagatgggcccggtcgctaaggttagagcttcacataaagcccatgtagtcctcatcatcaatacttgagtcacgcagagcatatcagcagccagggcct

SEQ ID NO: 372785 - DNA, 140 bp, Artificial Sequence
  Synthetic
atacgccatgctgggtctcccagggagattttggaatacaactattgcagtgtcaatggctaacatttttagagggagttacctggccggagccggacttctcttttctatcatgaagaacgtacttgggagtcggccat

SEQ ID NO: 372786 - DNA, 140 bp, Artificial Sequence
  Synthetic
atggccgactcccaagtacgttcttcatgatagaaaagagaagtccggctccggccaggtaactccctctaaaaatgttagccattgacactgcaatagttgtattccaaaatctccctgggagacccagcatggcgtat

SEQ ID NO: 372787 - DNA, 140 bp, Artificial Sequence
  Synthetic
aggccctggctgctgatatgagagggagttacctggccggagccggacttctcttttctatcatgaagaacacggccaacacaagaaggggaactggcaacacaggagagacgcttggaggaccttttgggacagcggtg

SEQ ID NO: 372788 - DNA, 140 bp, Artificial Sequence
  Synthetic
caccgctgtcccaaaaggtcctccaagcgtctctcctgtgttgccagttccccttcttgtgttggccgtgttcttcatgatagaaaagagaagtccggctccggccaggtaactccctctcatatcagcagccagggcct

SEQ ID NO: 372789 - DNA, 140 bp, Artificial Sequence
  Synthetic
atacgccatgctgggtctccagaaatggaaaaaccggttgaatgcattggggaagagtgaattccagatctataagaaaagtggaatccaggaagtggatagaaccttagcaaaagaaggcgtacttgggagtcggccat

SEQ ID NO: 372790 - DNA, 140 bp, Artificial Sequence
  Synthetic
atggccgactcccaagtacgccttcttttgctaaggttctatccacttcctggattccacttttcttatagatctggaattcactcttccccaatgcattcaaccggtttttccatttctggagacccagcatggcgtat

SEQ ID NO: 372791 - DNA, 140 bp, Artificial Sequence
  Synthetic
atacgccatgctgggtctcccatcaagagaggagaaacggaccatcacgctgtgtcgcgaggctcagcgaaactgagatggttcgtcgagagaaacctggtcacaccagaagggaaagtacgtacttgggagtcggccat

SEQ ID NO: 372792 - DNA, 140 bp, Artificial Sequence
  Synthetic
atggccgactcccaagtacgtactttcccttctggtgtgaccaggtttctctcgacgaaccatctcagtttcgctgagcctcgcgacacagcgtgatggtccgtttctcctctcttgatgggagacccagcatggcgtat

SEQ ID NO: 372793 - DNA, 140 bp, Artificial Sequence
  Synthetic
atacgccatgctgggtctccagtggagttgatgtcttttttactccgccagaaaagtgtgacacattgctgtgtgacataggggagtcgtcaccaaaccccacggttgaggcaggacgaacgtacttgggagtcggccat

SEQ ID NO: 372794 - DNA, 140 bp, Artificial Sequence
  Synthetic
atggccgactcccaagtacgttcgtcctgcctcaaccgtggggtttggtgacgactcccctatgtcacacagcaatgtgtcacacttttctggcggagtaaaaaagacatcaactccactggagacccagcatggcgtat

SEQ ID NO: 372795 - DNA, 140 bp, Artificial Sequence
  Synthetic
aggccctggctgctgatatggtgtgacataggggagtcgtcaccaaaccccacggttgaggcaggacgaacactcagagttctaaacttagtggaaaactggctgaacaacaacacccaagaccttttgggacagcggtg

SEQ ID NO: 372796 - DNA, 140 bp, Artificial Sequence
  Synthetic
caccgctgtcccaaaaggtcttgggtgttgttgttcagccagttttccactaagtttagaactctgagtgttcgtcctgcctcaaccgtggggtttggtgacgactcccctatgtcacaccatatcagcagccagggcct

SEQ ID NO: 372797 - DNA, 140 bp, Artificial Sequence
  Synthetic
atacgccatgctgggtctccttttgcataaaggttctcaacccatatatgccttcagttatagaaaaaatggaagcgctacaaaggaaatacggaggagctttggtgaggaatccactctcgtacttgggagtcggccat

SEQ ID NO: 372798 - DNA, 140 bp, Artificial Sequence
  Synthetic
atggccgactcccaagtacgagagtggattcctcaccaaagctcctccgtatttcctttgtagcgcttccattttttctataactgaaggcatatatgggttgagaacctttatgcaaaaggagacccagcatggcgtat

SEQ ID NO: 372799 - DNA, 140 bp, Artificial Sequence
  Synthetic
aggccctggctgctgatatgggaagcgctacaaaggaaatacggaggagctttggtgaggaatccactctcacgaaattccacacacgagatgtactgggtatccaatgcttccgggaacgaccttttgggacagcggtg

SEQ ID NO: 372800 - DNA, 140 bp, Artificial Sequence
  Synthetic
caccgctgtcccaaaaggtcgttcccggaagcattggatacccagtacatctcgtgtgtggaatttcgtgagagtggattcctcaccaaagctcctccgtatttcctttgtagcgcttcccatatcagcagccagggcct

SEQ ID NO: 372801 - DNA, 140 bp, Artificial Sequence
  Synthetic
atacgccatgctgggtctccatagtgtcatcagtgaacatgatttcaagaatgttgattaacagattcacaatgagacacaagaaggccacatacgagccagatgttgatctcggaagtgcgtacttgggagtcggccat

SEQ ID NO: 372802 - DNA, 140 bp, Artificial Sequence
  Synthetic
atggccgactcccaagtacgcacttccgagatcaacatctggctcgtatgtggccttcttgtgtctcattgtgaatctgttaatcaacattcttgaaatcatgttcactgatgacactatggagacccagcatggcgtat

SEQ ID NO: 372803 - DNA, 140 bp, Artificial Sequence
  Synthetic
aggccctggctgctgatatgaatgagacacaagaaggccacatacgagccagatgttgatctcggaagtggaacccgcaacatcggaattgaaagtgagacaccaaatttagacataattgaccttttgggacagcggtg

SEQ ID NO: 372804 - DNA, 140 bp, Artificial Sequence
  Synthetic
caccgctgtcccaaaaggtcaattatgtctaaatttggtgtctcactttcaattccgatgttgcgggttccacttccgagatcaacatctggctcgtatgtggccttcttgtgtctcattcatatcagcagccagggcct

SEQ ID NO: 372805 - DNA, 140 bp, Artificial Sequence
  Synthetic
atacgccatgctgggtctccacggatgttggtatggcatggaaatcagaccagtcaaggagaaggaagagaacctagtcaggtcaatggtctctgcagggtcaggagaagtggacaacttcgtacttgggagtcggccat

SEQ ID NO: 372806 - DNA, 140 bp, Artificial Sequence
  Synthetic
atggccgactcccaagtacgaagttgtccacttctcctgaccctgcagagaccattgacctgactaggttctcttccttctccttgactggtctgatttccatgccataccaacatccgtggagacccagcatggcgtat

SEQ ID NO: 372807 - DNA, 140 bp, Artificial Sequence
  Synthetic
atacgccatgctgggtctccgcagaatggctctggaaagaactaggaaagaaaaagacacctaggatgtgcaccagagaagaattcacaagaaaggtgagaagcaatgcagccttaggtgcgtacttgggagtcggccat

SEQ ID NO: 372808 - DNA, 140 bp, Artificial Sequence
  Synthetic
atggccgactcccaagtacgcacctaaggctgcattgcttctcacctttcttgtgaattcttctctggtgcacatcctaggtgtctttttctttcctagttctttccagagccattctgcggagacccagcatggcgtat

SEQ ID NO: 372809 - DNA, 140 bp, Artificial Sequence
  Synthetic
aggccctggctgctgatatgcaccagagaagaattcacaagaaaggtgagaagcaatgcagccttaggtgccatattcaatgatgagaacaagtggaagtcggcacgtgaggctgttgaagaccttttgggacagcggtg

SEQ ID NO: 372810 - DNA, 140 bp, Artificial Sequence
  Synthetic
caccgctgtcccaaaaggtcttcaacagcctcacgtgccgacttccacttgttctcatcattgaatatggcacctaaggctgcattgcttctcacctttcttgtgaattcttctctggtgcatatcagcagccagggcct

SEQ ID NO: 372811 - DNA, 140 bp, Artificial Sequence
  Synthetic
aggccctggctgctgatatggacagtggattttgggaattggttgacaaggaaaggaatctccatcttgaaggaaagtgtgagacatgtgtgtataacatgatgggaaagagagagaagagaccttttgggacagcggtg

SEQ ID NO: 372812 - DNA, 140 bp, Artificial Sequence
  Synthetic
caccgctgtcccaaaaggtctcttctctctctttcccatcatgttatacacacatgtctcacactttccttcaagatggagattcctttccttgtcaaccaattcccaaaatccactgtccatatcagcagccagggcct

SEQ ID NO: 372813 - DNA, 140 bp, Artificial Sequence
  Synthetic
aggccctggctgctgatatgaacctagtcaggtcaatggtctctgcagggtcaggagaagtggacaacttttcattgggactattatgtgtatcaataatggttgaagaagtgatgagatgaccttttgggacagcggtg

SEQ ID NO: 372814 - DNA, 140 bp, Artificial Sequence
  Synthetic
caccgctgtcccaaaaggtcatctcatcacttcttcaaccattattgatacacataatagtcccaatgaaaagttgtccacttctcctgaccctgcagagaccattgacctgactaggttcatatcagcagccagggcct

SEQ ID NO: 372815 - DNA, 140 bp, Artificial Sequence
  Synthetic
aggccctggctgctgatatgagatcactggttttccagagagaactccctgagtggagtggaaggagaagggctgcacaaactaggctacattttaagagacgtgagtaagaaagaaggagaccttttgggacagcggtg

SEQ ID NO: 372816 - DNA, 140 bp, Artificial Sequence
  Synthetic
caccgctgtcccaaaaggtctccttctttcttactcacgtctcttaaaatgtagcctagtttgtgcagcccttctccttccactccactcagggagttctctctggaaaaccagtgatctcatatcagcagccagggcct

SEQ ID NO: 372817 - DNA, 140 bp, Artificial Sequence
  Synthetic
aggccctggctgctgatatgggagcaatgtacgccgatgacaccgcaggatgggacacaagaatcacactagaggacttaaaaaatgaagaaatggtgacaaaccacatggaaggagaacgaccttttgggacagcggtg

SEQ ID NO: 372818 - DNA, 140 bp, Artificial Sequence
  Synthetic
caccgctgtcccaaaaggtcgttctccttccatgtggtttgtcaccatttcttcattttttaagtcctctagtgtgattcttgtgtcccatcctgcggtgtcatcggcgtacattgctcccatatcagcagccagggcct

SEQ ID NO: 372819 - DNA, 140 bp, Artificial Sequence
  Synthetic
aggccctggctgctgatatgaggagcaatgcacactgcgttgactggggcgacagaaatccagacgtcaggaacgacaacaatcttcgcaggacacctgaaatgcagactaaaaatggatgaccttttgggacagcggtg

SEQ ID NO: 372820 - DNA, 140 bp, Artificial Sequence
  Synthetic
caccgctgtcccaaaaggtcatccatttttagtctgcatttcaggtgtcctgcgaagattgttgtcgttcctgacgtctggatttctgtcgccccagtcaacgcagtgtgcattgctcctcatatcagcagccagggcct

SEQ ID NO: 372821 - DNA, 140 bp, Artificial Sequence
  Synthetic
atacgccatgctgggtctccctttcaccaacatggaagcccaactgatcagacagatggagggagaaggagtcttcaaaagcatccagcacctgacagtcacagaagaaattgcagtgaacgtacttgggagtcggccat

SEQ ID NO: 372822 - DNA, 140 bp, Artificial Sequence
  Synthetic
atggccgactcccaagtacgttcactgcaatttcttctgtgactgtcaggtgctggatgcttttgaagactccttctccctccatctgtctgatcagttgggcttccatgttggtgaaagggagacccagcatggcgtat

SEQ ID NO: 372823 - DNA, 140 bp, Artificial Sequence
  Synthetic
atacgccatgctgggtctccaaactggttagtaagagtggggcgtgagaggttatcaagaatggccatcagtggagatgattgtgttgtgaaacccttagatgacaggtttgcaagcgctcgtacttgggagtcggccat

SEQ ID NO: 372824 - DNA, 140 bp, Artificial Sequence
  Synthetic
atggccgactcccaagtacgagcgcttgcaaacctgtcatctaagggtttcacaacacaatcatctccactgatggccattcttgataacctctcacgccccactcttactaaccagtttggagacccagcatggcgtat

SEQ ID NO: 372825 - DNA, 140 bp, Artificial Sequence
  Synthetic
atacgccatgctgggtctcctgtagaaaccaagatgaactgattggtagggcccgaatttcccagggagccgggtggtccttgcgggaaacagcctgtttggggaagtcttacgcccaaacgtacttgggagtcggccat

SEQ ID NO: 372826 - DNA, 140 bp, Artificial Sequence
  Synthetic
atggccgactcccaagtacgtttgggcgtaagacttccccaaacaggctgtttcccgcaaggaccacccggctccctgggaaattcgggccctaccaatcagttcatcttggtttctacaggagacccagcatggcgtat

SEQ ID NO: 372827 - DNA, 140 bp, Artificial Sequence
  Synthetic
aggccctggctgctgatatgcgggtggtccttgcgggaaacagcctgtttggggaagtcttacgcccaaatgtggagcctgatgtacttccacagacgtgaccttaggctggcggcaaatgaccttttgggacagcggtg

SEQ ID NO: 372828 - DNA, 140 bp, Artificial Sequence
  Synthetic
caccgctgtcccaaaaggtcatttgccgccagcctaaggtcacgtctgtggaagtacatcaggctccacatttgggcgtaagacttccccaaacaggctgtttcccgcaaggaccacccgcatatcagcagccagggcct

SEQ ID NO: 372829 - DNA, 140 bp, Artificial Sequence
  Synthetic
aggccctggctgctgatatgagaacatccaaacagcaataaatcaagttagatccctaataggcaatgaggaatacacagactacatgccatccatgaaaagattcagaagagaagaggagaccttttgggacagcggtg

SEQ ID NO: 372830 - DNA, 140 bp, Artificial Sequence
  Synthetic
caccgctgtcccaaaaggtctcctcttctcttctgaatcttttcatggatggcatgtagtctgtgtattcctcattgcctattagggatctaacttgatttattgctgtttggatgttctcatatcagcagccagggcct

SEQ ID NO: 372831 - DNA, 140 bp, Artificial Sequence
  Synthetic
aggccctggctgctgatatggaatacacagactacatgccatccatgaaaagattcagaagagaagaggaagaggcaggagtcttgtggtagaaagcaggaacatcatgagacaaagtcagaccttttgggacagcggtg

SEQ ID NO: 372832 - DNA, 140 bp, Artificial Sequence
  Synthetic
caccgctgtcccaaaaggtctgactttgtctcatgatgttcctgctttctaccacaagactcctgcctcttcctcttctcttctgaatcttttcatggatggcatgtagtctgtgtattccatatcagcagccagggcct

SEQ ID NO: 372833 - DNA, 140 bp, Artificial Sequence
  Synthetic
atacgccatgctgggtctccgaagtcaggtcggattaagccatagtacggaaaaaactatgctacctgtgagccccgtccaaggacgttaaaagaagtcaggccactacgagtgccatagcgtacttgggagtcggccat

SEQ ID NO: 372834 - DNA, 140 bp, Artificial Sequence
  Synthetic
atggccgactcccaagtacgctatggcactcgtagtggcctgacttcttttaacgtccttggacggggctcacaggtagcatagttttttccgtactatggcttaatccgacctgacttcggagacccagcatggcgtat

SEQ ID NO: 372835 - DNA, 140 bp, Artificial Sequence
  Synthetic
aggccctggctgctgatatgctgggaggccacaaaccatggaagctgtacgcatggcgtagtggactagcggttagaggagacccctcccttacaaatcgcagcaacaatgggggcccaagaccttttgggacagcggtg

SEQ ID NO: 372836 - DNA, 140 bp, Artificial Sequence
  Synthetic
caccgctgtcccaaaaggtcttgggcccccattgttgctgcgatttgtaagggaggggtctcctctaaccgctagtccactacgccatgcgtacagcttccatggtttgtggcctcccagcatatcagcagccagggcct

SEQ ID NO: 372837 - DNA, 140 bp, Artificial Sequence
  Synthetic
atacgccatgctgggtctcctagataccaccgtgtctccgactcagactctcctacgtggaccgacaaaagacagattctttgagggagctaagctcaacgtagttctaacagttttttacgtacttgggagtcggccat

SEQ ID NO: 372838 - DNA, 140 bp, Artificial Sequence
  Synthetic
atggccgactcccaagtacgtaaaaaactgttagaactacgttgagcttagctccctcaaagaatctgtcttttgtcggtccacgtaggagagtctgagtcggagacacggtggtatctaggagacccagcatggcgtat

SEQ ID NO: 372839 - DNA, 140 bp, Artificial Sequence
  Synthetic
atacgccatgctgggtctccacactctatggagcaatggagttttggaaagtgaaatgataatcccaaagatatatggaggaccaatatctcagcacaactacagaccagggtatttcaccgtacttgggagtcggccat

SEQ ID NO: 372840 - DNA, 140 bp, Artificial Sequence
  Synthetic
atggccgactcccaagtacggtgaaataccctggtctgtagttgtgctgagatattggtcctccatatatctttgggattatcatttcactttccaaaactccattgctccatagagtgtggagacccagcatggcgtat

SEQ ID NO: 372841 - DNA, 140 bp, Artificial Sequence
  Synthetic
atacgccatgctgggtctcctgtgtgaaggtaccacagttgttgtggatgaacattgtggaaatcgaggtccatctctcagaaccacaacagtcacaggaaagataatccatgaatggtgcgtacttgggagtcggccat

SEQ ID NO: 372842 - DNA, 140 bp, Artificial Sequence
  Synthetic
atggccgactcccaagtacgcaccattcatggattatctttcctgtgactgttgtggttctgagagatggacctcgatttccacaatgttcatccacaacaactgtggtaccttcacacaggagacccagcatggcgtat

SEQ ID NO: 372843 - DNA, 140 bp, Artificial Sequence
  Synthetic
aggccctggctgctgatatgtagtccaaattgagaatcttgaatacacagtggttgtgacagtccataatggagacacccatgctgtaggaaacgacacatccaaccacggagagacagcgaccttttgggacagcggtg

SEQ ID NO: 372844 - DNA, 140 bp, Artificial Sequence
  Synthetic
caccgctgtcccaaaaggtcgctgtctctccgtggttggatgtgtcgtttcctacagcatgggtgtctccattatggactgtcacaaccactgtgtattcaagattctcaatttggactacatatcagcagccagggcct

SEQ ID NO: 372845 - DNA, 140 bp, Artificial Sequence
  Synthetic
atacgccatgctgggtctccggtggcatccgtggagctaccaaattctttggaggagctaggggatggacttgcaatgggtatcatgatgttaaaattgttgactgaatttcagccacaccgtacttgggagtcggccat

SEQ ID NO: 372846 - DNA, 140 bp, Artificial Sequence
  Synthetic
atggccgactcccaagtacggtgtggctgaaattcagtcaacaattttaacatcatgatacccattgcaagtccatcccctagctcctccaaagaatttggtagctccacggatgccaccggagacccagcatggcgtat

SEQ ID NO: 372847 - DNA, 140 bp, Artificial Sequence
  Synthetic
atacgccatgctgggtctcctacgataacccccaggtcaccatcggttgaagttaaattaccagactatggagaattgacacttgactgtgaacctaggtccggaattgactttaatgagcgtacttgggagtcggccat

SEQ ID NO: 372848 - DNA, 140 bp, Artificial Sequence
  Synthetic
atggccgactcccaagtacgctcattaaagtcaattccggacctaggttcacagtcaagtgtcaattctccatagtctggtaatttaacttcaaccgatggtgacctgggggttatcgtaggagacccagcatggcgtat

SEQ ID NO: 372849 - DNA, 140 bp, Artificial Sequence
  Synthetic
aggccctggctgctgatatgtctttcattggattatgcatggaagacaatggccatggtgttgtcaatagtatctctctttcctttatgtttgtccacgacctctcaaaaaacaacatgggaccttttgggacagcggtg

SEQ ID NO: 372850 - DNA, 140 bp, Artificial Sequence
  Synthetic
caccgctgtcccaaaaggtcccatgttgttttttgagaggtcgtggacaaacataaaggaaagagagatactattgacaacaccatggccattgtcttccatgcataatccaatgaaagacatatcagcagccagggcct

SEQ ID NO: 372851 - DNA, 140 bp, Artificial Sequence
  Synthetic
aggccctggctgctgatatgcaggtgatagctgttgaaccaggaaaaaaccccaaaaatgtacagacaacgccgggcaccttcaagactcctgaaggcgaagttggagccatagctctaggaccttttgggacagcggtg

SEQ ID NO: 372852 - DNA, 140 bp, Artificial Sequence
  Synthetic
caccgctgtcccaaaaggtcctagagctatggctccaacttcgccttcaggagtcttgaaggtgcccggcgttgtctgtacatttttggggttttttcctggttcaacagctatcacctgcatatcagcagccagggcct

SEQ ID NO: 372853 - DNA, 140 bp, Artificial Sequence
  Synthetic
atacgccatgctgggtctcccttccggtgctgttaggatcctttggatgcaaaccattaaccatgttcctcataacagaaaataaaatctggggaaggaagagttggcccctcaacgaagcgtacttgggagtcggccat

SEQ ID NO: 372854 - DNA, 140 bp, Artificial Sequence
  Synthetic
atggccgactcccaagtacgcttcgttgaggggccaactcttccttccccagattttattttctgttatgaggaacatggttaatggtttgcatccaaaggatcctaacagcaccggaagggagacccagcatggcgtat

SEQ ID NO: 372855 - DNA, 140 bp, Artificial Sequence
  Synthetic
atacgccatgctgggtctccaccagagcgcgaaaaggtggatgccattgatggtgaataccgcttgagaggagaagcgaggaaaactttcgtggacctaatgagaagaggagacctaccacgtacttgggagtcggccat

SEQ ID NO: 372856 - DNA, 140 bp, Artificial Sequence
  Synthetic
atggccgactcccaagtacgtggtaggtctcctcttctcattaggtccacgaaagttttcctcgcttctcctctcaagcggtattcaccatcaatggcatccaccttttcgcgctctggtggagacccagcatggcgtat

SEQ ID NO: 372857 - DNA, 140 bp, Artificial Sequence
  Synthetic
aggccctggctgctgatatgttcactggaatcacaaagagagaatggtgacattcaaggttcctcatgccaagagacaggatgtgacagtgctaggatctcaagaaggggccatgcattcgaccttttgggacagcggtg

SEQ ID NO: 372858 - DNA, 140 bp, Artificial Sequence
  Synthetic
caccgctgtcccaaaaggtcgaatgcatggccccttcttgagatcctagcactgtcacatcctgtctcttggcatgaggaaccttgaatgtcaccattctctctttgtgattccagtgaacatatcagcagccagggcct

SEQ ID NO: 372859 - DNA, 140 bp, Artificial Sequence
  Synthetic
atacgccatgctgggtctccttcagtggggtctcatggactatgaaaatcctcataggagtcattatcacatggataggaatgaattcacgcagcacctcactgtctgtgtcactagtatcgtacttgggagtcggccat

SEQ ID NO: 372860 - DNA, 140 bp, Artificial Sequence
  Synthetic
atggccgactcccaagtacgatactagtgacacagacagtgaggtgctgcgtgaattcattcctatccatgtgataatgactcctatgaggattttcatagtccatgagaccccactgaaggagacccagcatggcgtat

SEQ ID NO: 372861 - DNA, 140 bp, Artificial Sequence
  Synthetic
atacgccatgctgggtctccagccctcgccggagccacagaagtggattccggtgatggaaaccatatgtttgcaggacacttaaaatgtaaagttcgtatggaaaagttgaggatcaagcgtacttgggagtcggccat

SEQ ID NO: 372862 - DNA, 140 bp, Artificial Sequence
  Synthetic
atggccgactcccaagtacgcttgatcctcaacttttccatacgaactttacattttaagtgtcctgcaaacatatggtttccatcaccggaatccacttctgtggctccggcgagggctggagacccagcatggcgtat

SEQ ID NO: 372863 - DNA, 140 bp, Artificial Sequence
  Synthetic
aggccctggctgctgatatgactgttatggatggccagtgtggagccccattggatagcggcctccatcatactagagttctttttgatggtgctgctcattccagagccagacagacaggaccttttgggacagcggtg

SEQ ID NO: 372864 - DNA, 140 bp, Artificial Sequence
  Synthetic
caccgctgtcccaaaaggtcctgtctgtctggctctggaatgagcagcaccatcaaaaagaactctagtatgatggaggccgctatccaatggggctccacactggccatccataacagtcatatcagcagccagggcct

SEQ ID NO: 372865 - DNA, 140 bp, Artificial Sequence
  Synthetic
atacgccatgctgggtctccctcaatccaacagctatttttctaacaaccctttcaagaactaacaagaaaaggagctggccactaaatgaggctatcatggcagtcgggatggtgagcacgtacttgggagtcggccat

SEQ ID NO: 372866 - DNA, 140 bp, Artificial Sequence
  Synthetic
atggccgactcccaagtacgtgctcaccatcccgactgccatgatagcctcatttagtggccagctccttttcttgttagttcttgaaagggttgttagaaaaatagctgttggattgagggagacccagcatggcgtat

SEQ ID NO: 372867 - DNA, 140 bp, Artificial Sequence
  Synthetic
aggccctggctgctgatatgtgcagaaaccaagatgaactgattggcagagcccgaatttcccagggagccgggtggtctttgaaggagacggcttgtttggggaagtcttacgcccaaagaccttttgggacagcggtg

SEQ ID NO: 372868 - DNA, 140 bp, Artificial Sequence
  Synthetic
caccgctgtcccaaaaggtctttgggcgtaagacttccccaaacaagccgtctccttcaaagaccacccggctccctgggaaattcgggctctgccaatcagttcatcttggtttctgcacatatcagcagccagggcct

SEQ ID NO: 372869 - DNA, 140 bp, Artificial Sequence
  Synthetic
atacgccatgctgggtctccggtcaactccttggtcacagccggacatgggcagattgacaacttttcactaggagtcttgggaatggcactgctcctggaagaaatgctcaggacccgacgtacttgggagtcggccat

SEQ ID NO: 372870 - DNA, 140 bp, Artificial Sequence
  Synthetic
atggccgactcccaagtacgtcgggtcctgagcatttcttccaggagcagtgccattcccaagactcctagtgaaaagttgtcaatctgcccatgtccggctgtgaccaaggagttgaccggagacccagcatggcgtat

SEQ ID NO: 372871 - DNA, 140 bp, Artificial Sequence
  Synthetic
atacgccatgctgggtctccgatggaacaatgagaataaaagatgatgagactgagaatatcctaacagtgcttttgaaaacagcattactaatagtatcaggaatctttccatactccacgtacttgggagtcggccat

SEQ ID NO: 372872 - DNA, 140 bp, Artificial Sequence
  Synthetic
atggccgactcccaagtacgtggagtatggaaagattcctgatactattagtaatgctgttttcaaaagcactgttaggatattctcagtctcatcatcttttattctcattgttccatcggagacccagcatggcgtat

SEQ ID NO: 372873 - DNA, 140 bp, Artificial Sequence
  Synthetic
aggccctggctgctgatatggcttttgaaaacagcattactaatagtatcaggaatctttccatactccatacccgcaacattgctggtctggcatacttggcaaaagcaaacccaaagagaccttttgggacagcggtg

SEQ ID NO: 372874 - DNA, 140 bp, Artificial Sequence
  Synthetic
caccgctgtcccaaaaggtctctttgggtttgcttttgccaagtatgccagaccagcaatgttgcgggtatggagtatggaaagattcctgatactattagtaatgctgttttcaaaagccatatcagcagccagggcct

SEQ ID NO: 372875 - DNA, 140 bp, Artificial Sequence
  Synthetic
atacgccatgctgggtctccgattttaaagggaagactgtttggttcgttccaagtataaaagcaggaaatgatatagcagcttgcctgagaaaaaatggaaagaaagtgatacaactcacgtacttgggagtcggccat

SEQ ID NO: 372876 - DNA, 140 bp, Artificial Sequence
  Synthetic
atggccgactcccaagtacgtgagttgtatcactttctttccattttttctcaggcaagctgctatatcatttcctgcttttatacttggaacgaaccaaacagtcttccctttaaaatcggagacccagcatggcgtat

SEQ ID NO: 372877 - DNA, 140 bp, Artificial Sequence
  Synthetic
atacgccatgctgggtctccccaagggaagagggtggaaccaagctgggctagtgtcaaaaaagacttgatctcatatggaggaggttggaggttccaaggactatggaacacgggagaacgtacttgggagtcggccat

SEQ ID NO: 372878 - DNA, 140 bp, Artificial Sequence
  Synthetic
atggccgactcccaagtacgttctcccgtgttccatagtccttggaacctccaacctcctccatatgagatcaagtcttttttgacactagcccagcttggttccaccctcttcccttggggagacccagcatggcgtat

SEQ ID NO: 372879 - DNA, 140 bp, Artificial Sequence
  Synthetic
atacgccatgctgggtctccgaagtgcaggtgatagccgttgaaccaggaaaaaaccccagaaatgtacagacaacaccaggcaccttcaagacccctgaaggcgaagtcggagccatagcgtacttgggagtcggccat

SEQ ID NO: 372880 - DNA, 140 bp, Artificial Sequence
  Synthetic
atggccgactcccaagtacgctatggctccgacttcgccttcaggggtcttgaaggtgcctggtgttgtctgtacatttctggggttttttcctggttcaacggctatcacctgcacttcggagacccagcatggcgtat

SEQ ID NO: 372881 - DNA, 140 bp, Artificial Sequence
  Synthetic
aggccctggctgctgatatgcaaaggaaggagaaaagaaaaaattgagacctaggtggcttgatgcccgcacttattcagatcccttagcactcaaggaattcaaggactttgcggctgggaccttttgggacagcggtg

SEQ ID NO: 372882 - DNA, 140 bp, Artificial Sequence
  Synthetic
caccgctgtcccaaaaggtcccagccgcaaagtccttgaattccttgagtgctaagggatctgaataagtgcgggcatcaagccacctaggtctcaattttttcttttctccttcctttgcatatcagcagccagggcct

SEQ ID NO: 372883 - DNA, 140 bp, Artificial Sequence
  Synthetic
atacgccatgctgggtctccttacaacccagcaacccgagagcaacatcctggacatagatctacgtcccgcatcagcatggacgctgtatgctgtggccacaacatttgtcacaccaatcgtacttgggagtcggccat

SEQ ID NO: 372884 - DNA, 140 bp, Artificial Sequence
  Synthetic
atggccgactcccaagtacgattggtgtgacaaatgttgtggccacagcatacagcgtccatgctgatgcgggacgtagatctatgtccaggatgttgctctcgggttgctgggttgtaaggagacccagcatggcgtat

SEQ ID NO: 372885 - DNA, 140 bp, Artificial Sequence
  Synthetic
aggccctggctgctgatatgtcaataggactcatttgtgtaattgcttccagcggcatgttgtggatggccgaaatcccactccaatggatcgcgtcggctatagtcctggagttttttagaccttttgggacagcggtg

SEQ ID NO: 372886 - DNA, 140 bp, Artificial Sequence
  Synthetic
caccgctgtcccaaaaggtctaaaaaactccaggactatagccgacgcgatccattggagtgggatttcggccatccacaacatgccgctggaagcaattacacaaatgagtcctattgacatatcagcagccagggcct

SEQ ID NO: 372887 - DNA, 140 bp, Artificial Sequence
  Synthetic
aggccctggctgctgatatgaaccaactcgcatatgtcgtgataggcatacttacattggctgcaataatagcagccaatgaaatgggattgctggaaactacaaagagagatttaggaagaccttttgggacagcggtg

SEQ ID NO: 372888 - DNA, 140 bp, Artificial Sequence
  Synthetic
caccgctgtcccaaaaggtcttcctaaatctctctttgtagtttccagcaatcccatttcattggctgctattattgcagccaatgtaagtatgcctatcacgacatatgcgagttggttcatatcagcagccagggcct

SEQ ID NO: 372889 - DNA, 140 bp, Artificial Sequence
  Synthetic
atacgccatgctgggtctcccagcggggcccaacaccaggggaagctgtaccctggtggtaaggactagaggttagaggagaccccccgcacaacaacaaacagcatcattccaggcacacgtacttgggagtcggccat

SEQ ID NO: 372890 - DNA, 140 bp, Artificial Sequence
  Synthetic
atggccgactcccaagtacgtgtgcctggaatgatgctgtttgttgttgtgcggggggtctcctctaacctctagtccttaccaccagggtacagcttcccctggtgttgggccccgctgggagacccagcatggcgtat

SEQ ID NO: 372891 - DNA, 140 bp, Artificial Sequence
  Synthetic
aggccctggctgctgatatgtcgtcgcctctgaaatggcagaggcgcttaaaggaatgccaataagatatcagacaacagcagtgaagactgaacacacgggaagggagattgttgacctgaccttttgggacagcggtg

SEQ ID NO: 372892 - DNA, 140 bp, Artificial Sequence
  Synthetic
caccgctgtcccaaaaggtcaggtcaacaatctcccttcccgtgtgttcagtcttcactgctgttgtctgatatcttattggcattcctttaagcgcctctgccatttcagaggcgacgacatatcagcagccagggcct

SEQ ID NO: 372893 - DNA, 140 bp, Artificial Sequence
  Synthetic
aggccctggctgctgatatgtaagctagagaaggaagtggctgagacccagcatggaactgttctagtgcaggtcaaatatgaaggaacagacgcgccatgcaagatccccttttcgaccgaccttttgggacagcggtg

SEQ ID NO: 372894 - DNA, 140 bp, Artificial Sequence
  Synthetic
caccgctgtcccaaaaggtcggtcgaaaaggggatcttgcatggcgcgtctgttccttcatatttgacctgcactagaacagttccatgctgggtctcagccacttccttctctagcttacatatcagcagccagggcct

SEQ ID NO: 372895 - DNA, 140 bp, Artificial Sequence
  Synthetic
atacgccatgctgggtctccgttatcaagaatggccatcagtggagatgattgtgttgtgaaacctttagatgacaggttcgcaagcgctttaacagctctaaatgacatgggaaaggttcgtacttgggagtcggccat

SEQ ID NO: 372896 - DNA, 140 bp, Artificial Sequence
  Synthetic
atggccgactcccaagtacgaacctttcccatgtcatttagagctgttaaagcgcttgcgaacctgtcatctaaaggtttcacaacacaatcatctccactgatggccattcttgataacggagacccagcatggcgtat

SEQ ID NO: 372897 - DNA, 140 bp, Artificial Sequence
  Synthetic
atacgccatgctgggtctccggaattttggcccaagggaaaaaaatgattaggccacaacccatggaacacaaatactcatggaaaagctggggaaaagctaaaatcataggagcagacacgtacttgggagtcggccat

SEQ ID NO: 372898 - DNA, 140 bp, Artificial Sequence
  Synthetic
atggccgactcccaagtacgtgtctgctcctatgattttagcttttccccagcttttccatgagtatttgtgttccatgggttgtggcctaatcatttttttcccttgggccaaaattccggagacccagcatggcgtat

SEQ ID NO: 372899 - DNA, 140 bp, Artificial Sequence
  Synthetic
aggccctggctgctgatatggcttaacgtagttctaacagttttttaattagagagcagatctctgatgaataaccaacggaaaaaggcgagaaatacgcctttcaatatgctgaaacgcgaccttttgggacagcggtg

SEQ ID NO: 372900 - DNA, 140 bp, Artificial Sequence
  Synthetic
caccgctgtcccaaaaggtcgcgtttcagcatattgaaaggcgtatttctcgcctttttccgttggttattcatcagagatctgctctctaattaaaaaactgttagaactacgttaagccatatcagcagccagggcct

SEQ ID NO: 372901 - DNA, 140 bp, Artificial Sequence
  Synthetic
atacgccatgctgggtctccctagttaggtcaatggtctctgcagggtcaggagaagtggacagtttttcattaggaatactatgcgtatcaataatgattgaagaagtgatgagatccacgtacttgggagtcggccat

SEQ ID NO: 372902 - DNA, 140 bp, Artificial Sequence
  Synthetic
atggccgactcccaagtacgtggatctcatcacttcttcaatcattattgatacgcatagtattcctaatgaaaaactgtccacttctcctgaccctgcagagaccattgacctaactagggagacccagcatggcgtat

SEQ ID NO: 372903 - DNA, 140 bp, Artificial Sequence
  Synthetic
aggccctggctgctgatatgatgaacaaccaacgaaaaaagacgggaaaaccgtctatcaatatgctgaaacgcgtgagaaaccgtgtgtcaactggatcacagttggcgaagagattctgaccttttgggacagcggtg

SEQ ID NO: 372904 - DNA, 140 bp, Artificial Sequence
  Synthetic
caccgctgtcccaaaaggtcagaatctcttcgccaactgtgatccagttgacacacggtttctcacgcgtttcagcatattgatagacggttttcccgtcttttttcgttggttgttcatcatatcagcagccagggcct

SEQ ID NO: 372905 - DNA, 140 bp, Artificial Sequence
  Synthetic
aggccctggctgctgatatggaaacatggatgtcatcagaaggggcctggaaacatgcccagagaattgaaacttggatcttgagacatccaggctttaccataatggcagcaatcctgggaccttttgggacagcggtg

SEQ ID NO: 372906 - DNA, 140 bp, Artificial Sequence
  Synthetic
caccgctgtcccaaaaggtcccaggattgctgccattatggtaaagcctggatgtctcaagatccaagtttcaattctctgggcatgtttccaggccccttctgatgacatccatgtttccatatcagcagccagggcct

SEQ ID NO: 372907 - DNA, 140 bp, Artificial Sequence
  Synthetic
atacgccatgctgggtctcccatacaccataggaacgacacatttccaaagagccctgattttcatcttactgacagctgtcgctccttcaatgacaatgcgttgcataggaatatcaaacgtacttgggagtcggccat

SEQ ID NO: 372908 - DNA, 140 bp, Artificial Sequence
  Synthetic
atggccgactcccaagtacgtttgatattcctatgcaacgcattgtcattgaaggagcgacagctgtcagtaagatgaaaatcagggctctttggaaatgtgtcgttcctatggtgtatgggagacccagcatggcgtat

SEQ ID NO: 372909 - DNA, 140 bp, Artificial Sequence
  Synthetic
aggccctggctgctgatatgggaaatccttactttttaagacagcttctggaatcaacatgtgcactctcatagctatggacttgggagagatgtgtgatgacacggtcacttataagtggaccttttgggacagcggtg

SEQ ID NO: 372910 - DNA, 140 bp, Artificial Sequence
  Synthetic
caccgctgtcccaaaaggtccacttataagtgaccgtgtcatcacacatctctcccaagtccatagctatgagagtgcacatgttgattccagaagctgtcttaaaaagtaaggatttcccatatcagcagccagggcct

SEQ ID NO: 372911 - DNA, 140 bp, Artificial Sequence
  Synthetic
aggccctggctgctgatatgaacagaaaacaaaatctggggaaggaaaagttggcccctcaatgaaggaattatggctattggaatagtcagcattctactaagctcactcctcaaaaatgaccttttgggacagcggtg

SEQ ID NO: 372912 - DNA, 140 bp, Artificial Sequence
  Synthetic
caccgctgtcccaaaaggtcatttttgaggagtgagcttagtagaatgctgactattccaatagccataattccttcattgaggggccaacttttccttccccagattttgttttctgttcatatcagcagccagggcct

SEQ ID NO: 372913 - DNA, 140 bp, Artificial Sequence
  Synthetic
atacgccatgctgggtctccagacgtgacaagagatcagtggcgttagctccccatgttggcatgggactggacacacgtacccaaacctggatgtcggctgaaggagcttggagacaagcgtacttgggagtcggccat

SEQ ID NO: 372914 - DNA, 140 bp, Artificial Sequence
  Synthetic
atggccgactcccaagtacgcttgtctccaagctccttcagccgacatccaggtttgggtacgtgtgtccagtcccatgccaacatggggagctaacgccactgatctcttgtcacgtctggagacccagcatggcgtat

SEQ ID NO: 372915 - DNA, 140 bp, Artificial Sequence
  Synthetic
atacgccatgctgggtctccgctctatttcttgcccattacataggcacttccctgacccagaaagtggttatttttatactactaatgctggtcactccatccatgacaatgagatgcgcgtacttgggagtcggccat

SEQ ID NO: 372916 - DNA, 140 bp, Artificial Sequence
  Synthetic
atggccgactcccaagtacgcgcatctcattgtcatggatggagtgaccagcattagtagtataaaaataaccactttctgggtcagggaagtgcctatgtaatgggcaagaaatagagcggagacccagcatggcgtat

SEQ ID NO: 372917 - DNA, 140 bp, Artificial Sequence
  Synthetic
aggccctggctgctgatatgtggggaacgatcaaaaagtcaaaggctatcaatgtcttgagaggctttaggaaagagattggaaggatgctgaatatcttgaataggagacgcagaactggaccttttgggacagcggtg

SEQ ID NO: 372918 - DNA, 140 bp, Artificial Sequence
  Synthetic
caccgctgtcccaaaaggtccagttctgcgtctcctattcaagatattcagcatccttccaatctctttcctaaagcctctcaagacattgatagcctttgactttttgatcgttccccacatatcagcagccagggcct

SEQ ID NO: 372919 - DNA, 140 bp, Artificial Sequence
  Synthetic
aggccctggctgctgatatgcgaccctaaggaagttatgcattgagggaaaaattaccaacataacaactgactcaaggtgtcctacccaaggggaagcgactctacctgaggagcaggagaccttttgggacagcggtg

SEQ ID NO: 372920 - DNA, 140 bp, Artificial Sequence
  Synthetic
caccgctgtcccaaaaggtctcctgctcctcaggtagagtcgcttccccttgggtaggacaccttgagtcagttgttatgttggtaatttttccctcaatgcataacttccttagggtcgcatatcagcagccagggcct

SEQ ID NO: 372921 - DNA, 140 bp, Artificial Sequence
  Synthetic
aggccctggctgctgatatggttgtggtttgtttggaaaaggaagcttggtgacatgcgcgaaatttcagtgtctagaaccaatagagggaaaagtggtgcaatatgagaaccttaaatagaccttttgggacagcggtg

SEQ ID NO: 372922 - DNA, 140 bp, Artificial Sequence
  Synthetic
caccgctgtcccaaaaggtctatttaaggttctcatattgcaccacttttccctctattggttctagacactgaaatttcgcgcatgtcaccaagcttccttttccaaacaaaccacaaccatatcagcagccagggcct

SEQ ID NO: 372923 - DNA, 140 bp, Artificial Sequence
  Synthetic
atacgccatgctgggtctcccactgtcatcatcacagtgcacacaggagaccaacaccaggtgggaaatgacacgcagggagtcacggttgagataacaccccaggcatcaaccgttgaacgtacttgggagtcggccat

SEQ ID NO: 372924 - DNA, 140 bp, Artificial Sequence
  Synthetic
atggccgactcccaagtacgttcaacggttgatgcctggggtgttatctcaaccgtgactccctgcgtgtcatttcccacctggtgttggtctcctgtgtgcactgtgatgatgacagtgggagacccagcatggcgtat

SEQ ID NO: 372925 - DNA, 140 bp, Artificial Sequence
  Synthetic
aggccctggctgctgatatgattcaaaaatgcacatgcaaaaaagcaagaagtggttgtccttggatcgcaagagggagcaatgcacacagcgctgacaggagctacagagattcaaaacgaccttttgggacagcggtg

SEQ ID NO: 372926 - DNA, 140 bp, Artificial Sequence
  Synthetic
caccgctgtcccaaaaggtcgttttgaatctctgtagctcctgtcagcgctgtgtgcattgctccctcttgcgatccaaggacaaccacttcttgcttttttgcatgtgcatttttgaatcatatcagcagccagggcct

SEQ ID NO: 372927 - DNA, 140 bp, Artificial Sequence
  Synthetic
aggccctggctgctgatatgacacgcaatggagaaccacacatgatcgtcagcagacaagagaaagggaaaagtctcttgtttaaaacagaggatggtgtgaacatgtgtaccctcatgggaccttttgggacagcggtg

SEQ ID NO: 372928 - DNA, 140 bp, Artificial Sequence
  Synthetic
caccgctgtcccaaaaggtcccatgagggtacacatgttcacaccatcctctgttttaaacaagagacttttccctttctcttgtctgctgacgatcatgtgtggttctccattgcgtgtcatatcagcagccagggcct

SEQ ID NO: 372929 - DNA, 140 bp, Artificial Sequence
  Synthetic
aggccctggctgctgatatgtgtctgtgtcactagtattggtgggagtcgtgacgctgtatttgggagttatggtgcaggccgatagtggttgcgttgtgagctggaaaaacaaagaactgaccttttgggacagcggtg

SEQ ID NO: 372930 - DNA, 140 bp, Artificial Sequence
  Synthetic
caccgctgtcccaaaaggtcagttctttgtttttccagctcacaacgcaaccactatcggcctgcaccataactcccaaatacagcgtcacgactcccaccaatactagtgacacagacacatatcagcagccagggcct

SEQ ID NO: 372931 - DNA, 140 bp, Artificial Sequence
  Synthetic
atacgccatgctgggtctcccagtggtgaccaagaaggaggagcctgtcaacattgaggctgaacctccttttggggaaagcaacatagtgattggaattggagacaaagccttgaaaatcgtacttgggagtcggccat

SEQ ID NO: 372932 - DNA, 140 bp, Artificial Sequence
  Synthetic
atggccgactcccaagtacgattttcaaggctttgtctccaattccaatcactatgttgctttccccaaaaggaggttcagcctcaatgttgacaggctcctccttcttggtcaccactgggagacccagcatggcgtat

SEQ ID NO: 372933 - DNA, 140 bp, Artificial Sequence
  Synthetic
aggccctggctgctgatatgaaatcaggcccttgaatgaaaaagaagagaacatggtcaaatcacaggtatcagccggacaaggtacatcagagactttttctatggggctgttatgcctgaccttttgggacagcggtg

SEQ ID NO: 372934 - DNA, 140 bp, Artificial Sequence
  Synthetic
caccgctgtcccaaaaggtcaggcataacagccccatagaaaaagtctctgatgtaccttgtccggctgatacctgtgatttgaccatgttctcttctttttcattcaagggcctgatttcatatcagcagccagggcct

SEQ ID NO: 372935 - DNA, 140 bp, Artificial Sequence
  Synthetic
aggccctggctgctgatatgaaattggaataggtgtccttttaacctggatagggttgaattcaaaaaacacttccatgtcattttcatgcattgtgataggaattatcacactctatctgaccttttgggacagcggtg

SEQ ID NO: 372936 - DNA, 140 bp, Artificial Sequence
  Synthetic
caccgctgtcccaaaaggtcagatagagtgtgataattcctatcacaatgcatgaaaatgacatggaagtgttttttgaattcaaccctatccaggttaaaaggacacctattccaatttcatatcagcagccagggcct

SEQ ID NO: 372937 - DNA, 140 bp, Artificial Sequence
  Synthetic
aggccctggctgctgatatgactcaaaactcatgtcagcggccataaaagacaacagagccgtccatgccgatatgggttattggatagaaagtgcactcaatgacacatggaagatagagaccttttgggacagcggtg

SEQ ID NO: 372938 - DNA, 140 bp, Artificial Sequence
  Synthetic
caccgctgtcccaaaaggtctctatcttccatgtgtcattgagtgcactttctatccaataacccatatcggcatggacggctctgttgtcttttatggccgctgacatgagttttgagtcatatcagcagccagggcct

SEQ ID NO: 372939 - DNA, 140 bp, Artificial Sequence
  Synthetic
aggccctggctgctgatatgccagaatggagaatctattgtggaagcaaatagccaatgagctgaactacatattatgggaaaacaacatcaaattaacggtagttgtgggcgacataatgaccttttgggacagcggtg

SEQ ID NO: 372940 - DNA, 140 bp, Artificial Sequence
  Synthetic
caccgctgtcccaaaaggtcattatgtcgcccacaactaccgttaatttgatgttgttttcccataatatgtagttcagctcattggctatttgcttccacaatagattctccattctggcatatcagcagccagggcct

SEQ ID NO: 372941 - DNA, 140 bp, Artificial Sequence
  Synthetic
atacgccatgctgggtctcctggggtcttagagcaagggaaaagaacactaacaccacagcccatggagctaaaatattcatggaaaacatggggaaaggcaaaaatagtgacagctgaacgtacttgggagtcggccat

SEQ ID NO: 372942 - DNA, 140 bp, Artificial Sequence
  Synthetic
atggccgactcccaagtacgttcagctgtcactatttttgcctttccccatgttttccatgaatattttagctccatgggctgtggtgttagtgttcttttcccttgctctaagaccccaggagacccagcatggcgtat

SEQ ID NO: 372943 - DNA, 140 bp, Artificial Sequence
  Synthetic
aggccctggctgctgatatgtaaaatattcatggaaaacatggggaaaggcaaaaatagtgacagctgaaacacaaaattcctctttcataatagatgggccaaacacaccggagtgtccgaccttttgggacagcggtg

SEQ ID NO: 372944 - DNA, 140 bp, Artificial Sequence
  Synthetic
caccgctgtcccaaaaggtcggacactccggtgtgtttggcccatctattatgaaagaggaattttgtgtttcagctgtcactatttttgcctttccccatgttttccatgaatattttacatatcagcagccagggcct

SEQ ID NO: 372945 - DNA, 140 bp, Artificial Sequence
  Synthetic
aggccctggctgctgatatggcgaaggaaccacagtggtggtgactgaggactgtggaaatagaggaccctctttaagaacaactactgcctctggaaaactcataacagaatggtgctggaccttttgggacagcggtg

SEQ ID NO: 372946 - DNA, 140 bp, Artificial Sequence
  Synthetic
caccgctgtcccaaaaggtccagcaccattctgttatgagttttccagaggcagtagttgttcttaaagagggtcctctatttccacagtcctcagtcaccaccactgtggttccttcgccatatcagcagccagggcct

SEQ ID NO: 372947 - DNA, 140 bp, Artificial Sequence
  Synthetic
aggccctggctgctgatatggacaacttggtcatgttgcacaattccgaacaaggaggaaaagcctacagacatgctatggaggaactaccagacaccatagaaacattgatgctactaggaccttttgggacagcggtg

SEQ ID NO: 372948 - DNA, 140 bp, Artificial Sequence
  Synthetic
caccgctgtcccaaaaggtcctagtagcatcaatgtttctatggtgtctggtagttcctccatagcatgtctgtaggcttttcctccttgttcggaattgtgcaacatgaccaagttgtccatatcagcagccagggcct

SEQ ID NO: 372949 - DNA, 140 bp, Artificial Sequence
  Synthetic
aggccctggctgctgatatgggtgttgccgctcgtgcacacttcctcccttgcgatacatgggagaggacggctgctggtatggcatggaaattagacctatcaatgagaaagaagagaagaccttttgggacagcggtg

SEQ ID NO: 372950 - DNA, 140 bp, Artificial Sequence
  Synthetic
caccgctgtcccaaaaggtcttctcttctttctcattgataggtctaatttccatgccataccagcagccgtcctctcccatgtatcgcaagggaggaagtgtgcacgagcggcaacacccatatcagcagccagggcct

SEQ ID NO: 372951 - DNA, 140 bp, Artificial Sequence
  Synthetic
aggccctggctgctgatatgggctgctggtatggcatggaaattagacctatcaatgagaaagaagagaacatggtaaagtctttagtctcagcagggagtggaaaggtggacaacttcagaccttttgggacagcggtg

SEQ ID NO: 372952 - DNA, 140 bp, Artificial Sequence
  Synthetic
caccgctgtcccaaaaggtctgaagttgtccacctttccactccctgctgagactaaagactttaccatgttctcttctttctcattgataggtctaatttccatgccataccagcagcccatatcagcagccagggcct

SEQ ID NO: 372953 - DNA, 140 bp, Artificial Sequence
  Synthetic
atacgccatgctgggtctcccaatgggagtcctgtgtttggcaatcctcttcgaagaggtgatgagaggaaaatttgggaaaaaacacatgattgcaggggttctcttcacgtttgtgctcgtacttgggagtcggccat

SEQ ID NO: 372954 - DNA, 140 bp, Artificial Sequence
  Synthetic
atggccgactcccaagtacgagcacaaacgtgaagagaacccctgcaatcatgtgttttttcccaaattttcctctcatcacctcttcgaagaggattgccaaacacaggactcccattgggagacccagcatggcgtat

SEQ ID NO: 372955 - DNA, 140 bp, Artificial Sequence
  Synthetic
aggccctggctgctgatatgaaatttgggaaaaaacacatgattgcaggggttctcttcacgtttgtgctccttctctcagggcaaataacatggagagatatggcacacacactcataagaccttttgggacagcggtg

SEQ ID NO: 372956 - DNA, 140 bp, Artificial Sequence
  Synthetic
caccgctgtcccaaaaggtcttatgagtgtgtgtgccatatctctccatgttatttgccctgagagaaggagcacaaacgtgaagagaacccctgcaatcatgtgttttttcccaaatttcatatcagcagccagggcct

SEQ ID NO: 372957 - DNA, 140 bp, Artificial Sequence
  Synthetic
aggccctggctgctgatatggctttaattgcaacattcaaaatccagccattcttggctttgggattcttcctgaggaaattgacatctagagaaaatttgctgttgggagttgggttgggaccttttgggacagcggtg

SEQ ID NO: 372958 - DNA, 140 bp, Artificial Sequence
  Synthetic
caccgctgtcccaaaaggtcccaacccaactcccaacagcaaattttctctagatgtcaatttcctcaggaagaatcccaaagccaagaatggctggattttgaatgttgcaattaaagccatatcagcagccagggcct

SEQ ID NO: 372959 - DNA, 140 bp, Artificial Sequence
  Synthetic
atacgccatgctgggtctccccatggcaacaacgttacaactgccagaggacattgaacaaatggcgaatggaattgctctggggctcatgactctaaaactgataacacaatttgagaccgtacttgggagtcggccat

SEQ ID NO: 372960 - DNA, 140 bp, Artificial Sequence
  Synthetic
atggccgactcccaagtacggtctcaaattgtgttatcagttttagagtcatgagccccagagcaattccattcgccatttgttcaatgtcctctggcagttgtaacgttgttgccatggggagacccagcatggcgtat

SEQ ID NO: 372961 - DNA, 140 bp, Artificial Sequence
  Synthetic
aggccctggctgctgatatgggaattgctctggggctcatgactctaaaactgataacacaatttgagacatatcagttgtggacggcattagtctccttaacatgttcaaacacaatttgaccttttgggacagcggtg

SEQ ID NO: 372962 - DNA, 140 bp, Artificial Sequence
  Synthetic
caccgctgtcccaaaaggtcaaattgtgtttgaacatgttaaggagactaatgccgtccacaactgatatgtctcaaattgtgttatcagttttagagtcatgagccccagagcaattcccatatcagcagccagggcct

SEQ ID NO: 372963 - DNA, 140 bp, Artificial Sequence
  Synthetic
aggccctggctgctgatatgaatgggaagatcaggcagagatatcaggaagcagtccaatcctgtcaataacaatatcagaagatggtagcatgtcgataaaaaacgaagaggaagaacagaccttttgggacagcggtg

SEQ ID NO: 372964 - DNA, 140 bp, Artificial Sequence
  Synthetic
caccgctgtcccaaaaggtctgttcttcctcttcgttttttatcgacatgctaccatcttctgatattgttattgacaggattggactgcttcctgatatctctgcctgatcttcccattcatatcagcagccagggcct

SEQ ID NO: 372965 - DNA, 140 bp, Artificial Sequence
  Synthetic
atacgccatgctgggtctcctcacgttgactgttgcctggagaacagccaccttgattctggccggagtttcgcttttgccactgtgccagtcttcgagcatgaggaaaacagattggctcgtacttgggagtcggccat

SEQ ID NO: 372966 - DNA, 140 bp, Artificial Sequence
  Synthetic
atggccgactcccaagtacgagccaatctgttttcctcatgctcgaagactggcacagtggcaaaagcgaaactccggccagaatcaaggtggctgttctccaggcaacagtcaacgtgaggagacccagcatggcgtat

SEQ ID NO: 372967 - DNA, 140 bp, Artificial Sequence
  Synthetic
atacgccatgctgggtctcctcagcttgaaggacacacccaaaaggaggagctggccactgaatgagggagtgatggctgttgggcttgtgagcattctagctagttctctccttaggaacgtacttgggagtcggccat

SEQ ID NO: 372968 - DNA, 140 bp, Artificial Sequence
  Synthetic
atggccgactcccaagtacgttcctaaggagagaactagctagaatgctcacaagcccaacagccatcactccctcattcagtggccagctcctccttttgggtgtgtccttcaagctgaggagacccagcatggcgtat

SEQ ID NO: 372969 - DNA, 140 bp, Artificial Sequence
  Synthetic
atacgccatgctgggtctccgaggattgaaccatcatgggcggacgttaagaaagacctaatatcatatggaggaggctggaagctagaaggagaatggaaggaaggagaagaagtccagcgtacttgggagtcggccat

SEQ ID NO: 372970 - DNA, 140 bp, Artificial Sequence
  Synthetic
atggccgactcccaagtacgctggacttcttctccttccttccattctccttctagcttccagcctcctccatatgatattaggtctttcttaacgtccgcccatgatggttcaatcctcggagacccagcatggcgtat

SEQ ID NO: 372971 - DNA, 140 bp, Artificial Sequence
  Synthetic
atacgccatgctgggtctccgatgatcacagttgatgatgatggaacaatgagaataaaggatgatgagactgagaacatcctaacagtgctcttaaaaacagcattactaatagtatcacgtacttgggagtcggccat

SEQ ID NO: 372972 - DNA, 140 bp, Artificial Sequence
  Synthetic
atggccgactcccaagtacgtgatactattagtaatgctgtttttaagagcactgttaggatgttctcagtctcatcatcctttattctcattgttccatcatcatcaactgtgatcatcggagacccagcatggcgtat

SEQ ID NO: 372973 - DNA, 140 bp, Artificial Sequence
  Synthetic
aggccctggctgctgatatgctgagaacatcctaacagtgctcttaaaaacagcattactaatagtatcaggcatctttccatactccatacccgccacactgttggtctggcatacttggaccttttgggacagcggtg

SEQ ID NO: 372974 - DNA, 140 bp, Artificial Sequence
  Synthetic
caccgctgtcccaaaaggtccaagtatgccagaccaacagtgtggcgggtatggagtatggaaagatgcctgatactattagtaatgctgtttttaagagcactgttaggatgttctcagcatatcagcagccagggcct

SEQ ID NO: 372975 - DNA, 140 bp, Artificial Sequence
  Synthetic
atacgccatgctgggtctccgcaaaagcaaacccaaagatctggcgttctatgggacgtacctagccccccagaaacacagaaagcagaactggaagagggggtctataggatcaaacaacgtacttgggagtcggccat

SEQ ID NO: 372976 - DNA, 140 bp, Artificial Sequence
  Synthetic
atggccgactcccaagtacgttgtttgatcctatagaccccctcttccagttctgctttctgtgtttctggggggctaggtacgtcccatagaacgccagatctttgggtttgcttttgcggagacccagcatggcgtat

SEQ ID NO: 372977 - DNA, 140 bp, Artificial Sequence
  Synthetic
atacgccatgctgggtctccatgacatttttcgaaagagaaaattgaccatcatggacctccacccaggagcgggaaagacgaagagataccttccggccatagtcagagaggctataaacgtacttgggagtcggccat

SEQ ID NO: 372978 - DNA, 140 bp, Artificial Sequence
  Synthetic
atggccgactcccaagtacgtttatagcctctctgactatggccggaaggtatctcttcgtctttcccgctcctgggtggaggtccatgatggtcaattttctctttcgaaaaatgtcatggagacccagcatggcgtat

SEQ ID NO: 372979 - DNA, 140 bp, Artificial Sequence
  Synthetic
atacgccatgctgggtctccactagaaccaatgattgggacttcgtggtcacaactgacatttcagaaatgggtgccaacttcaaggctgagagggttatagaccccagacgctgcatgacgtacttgggagtcggccat

SEQ ID NO: 372980 - DNA, 140 bp, Artificial Sequence
  Synthetic
atggccgactcccaagtacgtcatgcagcgtctggggtctataaccctctcagccttgaagttggcacccatttctgaaatgtcagttgtgaccacgaagtcccaatcattggttctagtggagacccagcatggcgtat

SEQ ID NO: 372981 - DNA, 140 bp, Artificial Sequence
  Synthetic
aggccctggctgctgatatgaattacaatttggtaataatggatgaggcccatttcacagacccagccagtatagcggctagagggtacatatcaactcgtgtaggaatgggagaggcaggaccttttgggacagcggtg

SEQ ID NO: 372982 - DNA, 140 bp, Artificial Sequence
  Synthetic
caccgctgtcccaaaaggtcctgcctctcccattcctacacgagttgatatgtaccctctagccgctatactggctgggtctgtgaaatgggcctcatccattattaccaaattgtaattcatatcagcagccagggcct

SEQ ID NO: 372983 - DNA, 140 bp, Artificial Sequence
  Synthetic
atacgccatgctgggtctcccagagcaacgctccaattcaagatgaagaaagggatattccggaacgctcatggaattcaggcaatgaatggattaccgactttgttgggaagacggtgtcgtacttgggagtcggccat

SEQ ID NO: 372984 - DNA, 140 bp, Artificial Sequence
  Synthetic
atggccgactcccaagtacgacaccgtcttcccaacaaagtcggtaatccattcattgcctgaattccatgagcgttccggaatatccctttcttcatcttgaattggagcgttgctctgggagacccagcatggcgtat

SEQ ID NO: 372985 - DNA, 140 bp, Artificial Sequence
  Synthetic
aggccctggctgctgatatgatggaattcaggcaatgaatggattaccgactttgttgggaagacggtgtggtttgtccctagcatcaaagccggaaatgacatagcaaactgcctgcgggaccttttgggacagcggtg

SEQ ID NO: 372986 - DNA, 140 bp, Artificial Sequence
  Synthetic
caccgctgtcccaaaaggtcccgcaggcagtttgctatgtcatttccggctttgatgctagggacaaaccacaccgtcttcccaacaaagtcggtaatccattcattgcctgaattccatcatatcagcagccagggcct

SEQ ID NO: 372987 - DNA, 140 bp, Artificial Sequence
  Synthetic
atacgccatgctgggtctccaaaaatggaaaaaaggtcatccaacttagtaggaagacttttgatacagaatatcaaaagaccagactgaatgattgggacttcgtggtgacaactgacacgtacttgggagtcggccat

SEQ ID NO: 372988 - DNA, 140 bp, Artificial Sequence
  Synthetic
atggccgactcccaagtacgtgtcagttgtcaccacgaagtcccaatcattcagtctggtcttttgatattctgtatcaaaagtcttcctactaagttggatgaccttttttccatttttggagacccagcatggcgtat

SEQ ID NO: 372989 - DNA, 140 bp, Artificial Sequence
  Synthetic
aggccctggctgctgatatgatatcaaaagaccagactgaatgattgggacttcgtggtgacaactgacatttcagaaatgggagctaactttaaagcagatagagtgattgacccaagagaccttttgggacagcggtg

SEQ ID NO: 372990 - DNA, 140 bp, Artificial Sequence
  Synthetic
caccgctgtcccaaaaggtctcttgggtcaatcactctatctgctttaaagttagctcccatttctgaaatgtcagttgtcaccacgaagtcccaatcattcagtctggtcttttgatatcatatcagcagccagggcct

SEQ ID NO: 372991 - DNA, 140 bp, Artificial Sequence
  Synthetic
atacgccatgctgggtctccagatgtctcaagccagtaatcttgacagatggacccgagcgagtgatcctggctggaccaatgccagttaccgcagcgagcgctgcgcaaaggagagggacgtacttgggagtcggccat

SEQ ID NO: 372992 - DNA, 140 bp, Artificial Sequence
  Synthetic
atggccgactcccaagtacgtccctctcctttgcgcagcgctcgctgcggtaactggcattggtccagccaggatcactcgctcgggtccatctgtcaagattactggcttgagacatctggagacccagcatggcgtat

SEQ ID NO: 372993 - DNA, 140 bp, Artificial Sequence
  Synthetic
aggccctggctgctgatatgggctggaccaatgccagttaccgcagcgagcgctgcgcaaaggagagggagagttggcaggaacccacaaaaggaaaatgaccagtacatattcacgggcgaccttttgggacagcggtg

SEQ ID NO: 372994 - DNA, 140 bp, Artificial Sequence
  Synthetic
caccgctgtcccaaaaggtcgcccgtgaatatgtactggtcattttccttttgtgggttcctgccaactctccctctcctttgcgcagcgctcgctgcggtaactggcattggtccagcccatatcagcagccagggcct

SEQ ID NO: 372995 - DNA, 140 bp, Artificial Sequence
  Synthetic
atacgccatgctgggtctcccagccccttaacaatgacgaagaccatgcccactggacagaagcaaaaatgctgctagacaacattaacacaccagaagggatcataccagctctctttgcgtacttgggagtcggccat

SEQ ID NO: 372996 - DNA, 140 bp, Artificial Sequence
  Synthetic
atggccgactcccaagtacgcaaagagagctggtatgatcccttctggtgtgttaatgttgtctagcagcatttttgcttctgtccagtgggcatggtcttcgtcattgttaaggggctgggagacccagcatggcgtat

SEQ ID NO: 372997 - DNA, 140 bp, Artificial Sequence
  Synthetic
aggccctggctgctgatatgggtgagtccaggaagaccttcgtggaactcatgaggaggggtgacctcccagtttggctagcccataaagtagcctcagaagggatcaaatacacagatagaccttttgggacagcggtg

SEQ ID NO: 372998 - DNA, 140 bp, Artificial Sequence
  Synthetic
caccgctgtcccaaaaggtctatctgtgtatttgatcccttctgaggctactttatgggctagccaaactgggaggtcacccctcctcatgagttccacgaaggtcttcctggactcacccatatcagcagccagggcct

SEQ ID NO: 372999 - DNA, 140 bp, Artificial Sequence
  Synthetic
atacgccatgctgggtctccacgtgtccctaacagctattgccaaccaagccacagtgttaatgggtcttgggaaaggatggccattgtcaaagatggacatcggagttccccttctcgccgtacttgggagtcggccat

SEQ ID NO: 373000 - DNA, 140 bp, Artificial Sequence
  Synthetic
atggccgactcccaagtacggcgagaaggggaactccgatgtccatctttgacaatggccatcctttcccaagacccattaacactgtggcttggttggcaatagctgttagggacacgtggagacccagcatggcgtat

SEQ ID NO: 373001 - DNA, 140 bp, Artificial Sequence
  Synthetic
atacgccatgctgggtctccgtggcatgttatggatggctgatgtcccacttcaatggatcgcgtcagctatagtcctggaatttttcatgatggtgttgctcataccagaaccagaaaacgtacttgggagtcggccat

SEQ ID NO: 373002 - DNA, 140 bp, Artificial Sequence
  Synthetic
atggccgactcccaagtacgttttctggttctggtatgagcaacaccatcatgaaaaattccaggactatagctgacgcgatccattgaagtgggacatcagccatccataacatgccacggagacccagcatggcgtat

SEQ ID NO: 373003 - DNA, 140 bp, Artificial Sequence
  Synthetic
atacgccatgctgggtctccatagtcctggaatttttcatgatggtgttgctcataccagaaccagaaaaacaaagaactccccaagacaaccaactcgcatatgtcgtgataggcataccgtacttgggagtcggccat

SEQ ID NO: 373004 - DNA, 140 bp, Artificial Sequence
  Synthetic
atggccgactcccaagtacggtatgcctatcacgacatatgcgagttggttgtcttggggagttctttgtttttctggttctggtatgagcaacaccatcatgaaaaattccaggactatggagacccagcatggcgtat

SEQ ID NO: 373005 - DNA, 140 bp, Artificial Sequence
  Synthetic
aggccctggctgctgatatgacaaagaactccccaagacaaccaactcgcatatgtcgtgataggcatacttacactggctgcgatagtagcagctaatgaaatgggattattggaaaccgaccttttgggacagcggtg

SEQ ID NO: 373006 - DNA, 140 bp, Artificial Sequence
  Synthetic
caccgctgtcccaaaaggtcggtttccaataatcccatttcattagctgctactatcgcagccagtgtaagtatgcctatcacgacatatgcgagttggttgtcttggggagttctttgtcatatcagcagccagggcct

SEQ ID NO: 373007 - DNA, 140 bp, Artificial Sequence
  Synthetic
atacgccatgctgggtctccacaaagagagatttaggaatgtctaaagaaccaggtgttgtttctccaaccagctatttagatgtagacttgcacccagcatcagcctggacattgtacgcgtacttgggagtcggccat

SEQ ID NO: 373008 - DNA, 140 bp, Artificial Sequence
  Synthetic
atggccgactcccaagtacgcgtacaatgtccaggctgatgctgggtgcaagtctacatctaaatagctggttggagaaacaacacctggttctttagacattcctaaatctctctttgtggagacccagcatggcgtat

SEQ ID NO: 373009 - DNA, 140 bp, Artificial Sequence
  Synthetic
aggccctggctgctgatatgccatcatattagaattctttctgatggtgctgctcattccagagccagacagacagcgcactccgcaggacaaccaactagcgtatgtggtgataggcttgaccttttgggacagcggtg

SEQ ID NO: 373010 - DNA, 140 bp, Artificial Sequence
  Synthetic
caccgctgtcccaaaaggtcaagcctatcaccacatacgctagttggttgtcctgcggagtgcgctgtctgtctggctctggaatgagcagcaccatcagaaagaattctaatatgatggcatatcagcagccagggcct

SEQ ID NO: 373011 - DNA, 140 bp, Artificial Sequence
  Synthetic
aggccctggctgctgatatggggatgtagctccatcgtggggatgtagctccatcgtggggatgtagctccatcgtggggatgtagctccatcgtggggatgtagctccatcgtggggatgaccttttgggacagcggtg

SEQ ID NO: 373012 - DNA, 140 bp, Artificial Sequence
  Synthetic
caccgctgtcccaaaaggtcatccccacgatggagctacatccccacgatggagctacatccccacgatggagctacatccccacgatggagctacatccccacgatggagctacatccccatatcagcagccagggcct

SEQ ID NO: 373013 - DNA, 140 bp, Artificial Sequence
  Synthetic
aggccctggctgctgatatggcggcagtacttctgctagttacacattatgccattataggtccaggattgcaggctaaagccactcgtgaagctcaaaaaagaacagctgctggaataagaccttttgggacagcggtg

SEQ ID NO: 373014 - DNA, 140 bp, Artificial Sequence
  Synthetic
caccgctgtcccaaaaggtcttattccagcagctgttcttttttgagcttcacgagtggctttagcctgcaatcctggacctataatggcataatgtgtaactagcagaagtactgccgccatatcagcagccagggcct

SEQ ID NO: 373015 - DNA, 140 bp, Artificial Sequence
  Synthetic
aggccctggctgctgatatgtgaagaatccaacggtggacgggataatgacaatagacctagatcctgtaatatacgattcaaaattcgaaaagcaactaggacaggtcatgctcttggtgaccttttgggacagcggtg

SEQ ID NO: 373016 - DNA, 140 bp, Artificial Sequence
  Synthetic
caccgctgtcccaaaaggtcaccaagagcatgacctgtcctagttgcttttcgaattttgaatcgtatattacaggatctaggtctattgtcattatcccgtccaccgttggattcttcacatatcagcagccagggcct

SEQ ID NO: 373017 - DNA, 140 bp, Artificial Sequence
  Synthetic
atacgccatgctgggtctcctctgtgtgcagttcaacttttgttaatgagaacatcatgggccttgtgtgaagctctaaccctagccacaggaccaataacaacactctgggaaggatcacgtacttgggagtcggccat

SEQ ID NO: 373018 - DNA, 140 bp, Artificial Sequence
  Synthetic
atggccgactcccaagtacgtgatccttcccagagtgttgttattggtcctgtggctagggttagagcttcacacaaggcccatgatgttctcattaacaaaagttgaactgcacacagaggagacccagcatggcgtat

SEQ ID NO: 373019 - DNA, 140 bp, Artificial Sequence
  Synthetic
aggccctggctgctgatatgtagagggagctacttagcaggagctgggcttgctttttctatcatgaaatcagttggaacaggaaggagaggaacggggtcacaaggcgaaaccttaggagaccttttgggacagcggtg

SEQ ID NO: 373020 - DNA, 140 bp, Artificial Sequence
  Synthetic
caccgctgtcccaaaaggtctcctaaggtttcgccttgtgaccccgttcctctccttcctgttccaactgatttcatgatagaaaaagcaagcccagctcctgctaagtagctccctctacatatcagcagccagggcct

SEQ ID NO: 373021 - DNA, 140 bp, Artificial Sequence
  Synthetic
aggccctggctgctgatatgacaaaggaaatatggaggagccttagtgaggaatccactctcacgaaactccacacatgagatgtactgggtatccaatgcctccgggaacatagtgtcagaccttttgggacagcggtg

SEQ ID NO: 373022 - DNA, 140 bp, Artificial Sequence
  Synthetic
caccgctgtcccaaaaggtctgacactatgttcccggaggcattggatacccagtacatctcatgtgtggagtttcgtgagagtggattcctcactaaggctcctccatatttcctttgtcatatcagcagccagggcct

SEQ ID NO: 373023 - DNA, 140 bp, Artificial Sequence
  Synthetic
aggccctggctgctgatatgcatagacttaggctgtggaagaggaggctggtcatattattgcgcaggactgaaaaaagttacagaagtgcgaggatacacaaaaggcggcccaggacacgaccttttgggacagcggtg

SEQ ID NO: 373024 - DNA, 140 bp, Artificial Sequence
  Synthetic
caccgctgtcccaaaaggtcgtgtcctgggccgccttttgtgtatcctcgcacttctgtaacttttttcagtcctgcgcaataatatgaccagcctcctcttccacagcctaagtctatgcatatcagcagccagggcct

SEQ ID NO: 373025 - DNA, 140 bp, Artificial Sequence
  Synthetic
atacgccatgctgggtctcctgaaaaaagttacagaagtgcgaggatacacaaaaggcggcccaggacacgaggaaccagtacctatgtctacatacggatggaacatagtcaagttaatcgtacttgggagtcggccat

SEQ ID NO: 373026 - DNA, 140 bp, Artificial Sequence
  Synthetic
atggccgactcccaagtacgattaacttgactatgttccatccgtatgtagacataggtactggttcctcgtgtcctgggccgccttttgtgtatcctcgcacttctgtaacttttttcaggagacccagcatggcgtat

SEQ ID NO: 373027 - DNA, 140 bp, Artificial Sequence
  Synthetic
atacgccatgctgggtctccatagaaaaaataaaacaagagcatgaaacatcatggcactatgaccaagaccacccatacaaaacgtgggcttaccatggcagctatgaaacaaaacaaacgtacttgggagtcggccat

SEQ ID NO: 373028 - DNA, 140 bp, Artificial Sequence
  Synthetic
atggccgactcccaagtacgtttgttttgtttcatagctgccatggtaagcccacgttttgtatgggtggtcttggtcatagtgccatgatgtttcatgctcttgttttattttttctatggagacccagcatggcgtat

SEQ ID NO: 373029 - DNA, 140 bp, Artificial Sequence
  Synthetic
atacgccatgctgggtctccttgcattaaagtattaaacccttacatgccaactgtgattgagcacctagaaagactacaaagaaaatatggaggaatgcttgtgagaaacccactctcacgtacttgggagtcggccat

SEQ ID NO: 373030 - DNA, 140 bp, Artificial Sequence
  Synthetic
atggccgactcccaagtacgtgagagtgggtttctcacaagcattcctccatattttctttgtagtctttctaggtgctcaatcacagttggcatgtaagggtttaatactttaatgcaaggagacccagcatggcgtat

SEQ ID NO: 373031 - DNA, 140 bp, Artificial Sequence
  Synthetic
aggccctggctgctgatatgtgacacacaggagacccaccatagagaaagatgtggatttgggagcaggaactcgacatgtcaatgcggaaccagaaacacccaacatggacgtcattgggaccttttgggacagcggtg

SEQ ID NO: 373032 - DNA, 140 bp, Artificial Sequence
  Synthetic
caccgctgtcccaaaaggtcccaatgacgtccatgttgggtgtttctggttccgcattgacatgtcgagttcctgctcccaaatccacatctttctctatggtgggtctcctgtgtgtcacatatcagcagccagggcct

SEQ ID NO: 373033 - DNA, 140 bp, Artificial Sequence
  Synthetic
atacgccatgctgggtctccactcgacatgtcaatgcggaaccagaaacacccaacatggacgtcattggagaaagaataaaaaggatcaaggaggagcatagttcaacatggcactatgcgtacttgggagtcggccat

SEQ ID NO: 373034 - DNA, 140 bp, Artificial Sequence
  Synthetic
atggccgactcccaagtacgcatagtgccatgttgaactatgctcctccttgatcctttttattctttctccaatgacgtccatgttgggtgtttctggttccgcattgacatgtcgagtggagacccagcatggcgtat

SEQ ID NO: 373035 - DNA, 140 bp, Artificial Sequence
  Synthetic
aggccctggctgctgatatgagaaagaataaaaaggatcaaggaggagcatagttcaacatggcactatgatgatgaaaatccttacaaaacgtgggcttaccatggatcctatgaagtcgaccttttgggacagcggtg

SEQ ID NO: 373036 - DNA, 140 bp, Artificial Sequence
  Synthetic
caccgctgtcccaaaaggtcgacttcataggatccatggtaagcccacgttttgtaaggattttcatcatcatagtgccatgttgaactatgctcctccttgatcctttttattctttctcatatcagcagccagggcct

SEQ ID NO: 373037 - DNA, 140 bp, Artificial Sequence
  Synthetic
aggccctggctgctgatatgcacaaaaccatgggatgtggttcccatggtgacacagatggcaatgacagatacaactccatttgggcagcaaagagtcttcaaagagaaagtggacaccgaccttttgggacagcggtg

SEQ ID NO: 373038 - DNA, 140 bp, Artificial Sequence
  Synthetic
caccgctgtcccaaaaggtcggtgtccactttctctttgaagactctttgctgcccaaatggagttgtatctgtcattgccatctgtgtcaccatgggaaccacatcccatggttttgtgcatatcagcagccagggcct

SEQ ID NO: 373039 - DNA, 140 bp, Artificial Sequence
  Synthetic
atacgccatgctgggtctccaggacacccaggcccatgccagggacaagaaaggttatggagattacagcggaatggctttggagaaccctgggaaggaacaaaaaacccagattgtgcacgtacttgggagtcggccat

SEQ ID NO: 373040 - DNA, 140 bp, Artificial Sequence
  Synthetic
atggccgactcccaagtacgtgcacaatctgggttttttgttccttcccagggttctccaaagccattccgctgtaatctccataacctttcttgtccctggcatgggcctgggtgtcctggagacccagcatggcgtat

SEQ ID NO: 373041 - DNA, 140 bp, Artificial Sequence
  Synthetic
aggccctggctgctgatatgggaatggctttggagaaccctgggaaggaacaaaaaacccagattgtgcacaagggaagagttcacaaaaaaggtcagaaccaacgcggctatgggagctgaccttttgggacagcggtg

SEQ ID NO: 373042 - DNA, 140 bp, Artificial Sequence
  Synthetic
caccgctgtcccaaaaggtcagctcccatagccgcgttggttctgaccttttttgtgaactcttcccttgtgcacaatctgggttttttgttccttcccagggttctccaaagccattcccatatcagcagccagggcct

SEQ ID NO: 373043 - DNA, 140 bp, Artificial Sequence
  Synthetic
atacgccatgctgggtctccactaacatgaaacaaggctagaagtcaggtcggattaagccatagtacggaaaaaactatgctacctgtgagccccgtccaaggacgttaaaagaagtcacgtacttgggagtcggccat

SEQ ID NO: 373044 - DNA, 140 bp, Artificial Sequence
  Synthetic
atggccgactcccaagtacgtgacttcttttaacgtccttggacggggctcacaggtagcatagttttttccgtactatggcttaatccgacctgacttctagccttgtttcatgttagtggagacccagcatggcgtat

SEQ ID NO: 373045 - DNA, 140 bp, Artificial Sequence
  Synthetic
atacgccatgctgggtctccaccactggttctcgcgtgaaaactcttacagtggagtagaaggagaaggactgcacaagctgggatacattttaagagacatttctaagatacccggaggcgtacttgggagtcggccat

SEQ ID NO: 373046 - DNA, 140 bp, Artificial Sequence
  Synthetic
atggccgactcccaagtacgcctccgggtatcttagaaatgtctcttaaaatgtatcccagcttgtgcagtccttctccttctactccactgtaagagttttcacgcgagaaccagtggtggagacccagcatggcgtat

SEQ ID NO: 373047 - DNA, 140 bp, Artificial Sequence
  Synthetic
aggccctggctgctgatatgggaaagaccaaagaggcagtggacaggtggggacttatggtctgaacacattcaccaacatggaagcccagttagtcagacagatggaaggagaaggcgtgaccttttgggacagcggtg

SEQ ID NO: 373048 - DNA, 140 bp, Artificial Sequence
  Synthetic
caccgctgtcccaaaaggtcacgccttctccttccatctgtctgactaactgggcttccatgttggtgaatgtgttcagaccataagtccccacctgtccactgcctctttggtctttcccatatcagcagccagggcct

SEQ ID NO: 373049 - DNA, 140 bp, Artificial Sequence
  Synthetic
atacgccatgctgggtctccgttgtcgaaggcagacctcgagaaccctcatctgctagagaagaaaatcatacaatggttggaaaccaaaggagtggagagattaaaaagaatggccatccgtacttgggagtcggccat

SEQ ID NO: 373050 - DNA, 140 bp, Artificial Sequence
  Synthetic
atggccgactcccaagtacggatggccattctttttaatctctccactcctttggtttccaaccattgtatgattttcttctctagcagatgagggttctcgaggtctgccttcgacaacggagacccagcatggcgtat

SEQ ID NO: 373051 - DNA, 140 bp, Artificial Sequence
  Synthetic
aggccctggctgctgatatgaactgtgcagcctgtagctccacctgagaaggtgtaaaaaatctgggaggccacaaaccatggaagctgtacgcatgggtaagatctgatcggagacaccgaccttttgggacagcggtg

SEQ ID NO: 373052 - DNA, 140 bp, Artificial Sequence
  Synthetic
caccgctgtcccaaaaggtcggtgtctccgatcagatcttacccatgcgtacagcttccatggtttgtggcctcccagattttttacaccttctcaggtggagctacaggctgcacagttcatatcagcagccagggcct

SEQ ID NO: 373053 - DNA, 140 bp, Artificial Sequence
  Synthetic
aggccctggctgctgatatgaactccagtcacaacttgggaagatgttccatacctagggaagagagaagatcaatggtgcggatcactcattggtctcacttccagagcaacctgggccgaccttttgggacagcggtg

SEQ ID NO: 373054 - DNA, 140 bp, Artificial Sequence
  Synthetic
caccgctgtcccaaaaggtcggcccaggttgctctggaagtgagaccaatgagtgatccgcaccattgatcttctctcttccctaggtatggaacatcttcccaagttgtgactggagttcatatcagcagccagggcct

SEQ ID NO: 373055 - DNA, 140 bp, Artificial Sequence
  Synthetic
aggccctggctgctgatatggtgacccagaatgggagattgataacagccaatcccatagttactgacaaagaaaaaccagtcaacattgagacagaaccaccttttggtgagagctacagaccttttgggacagcggtg

SEQ ID NO: 373056 - DNA, 140 bp, Artificial Sequence
  Synthetic
caccgctgtcccaaaaggtctgtagctctcaccaaaaggtggttctgtctcaatgttgactggtttttctttgtcagtaactatgggattggctgttatcaatctcccattctgggtcaccatatcagcagccagggcct

SEQ ID NO: 373057 - DNA, 140 bp, Artificial Sequence
  Synthetic
atacgccatgctgggtctcccagaacatactcacagcaatccaacaggtgagaagccttataggcgatgaagaatttctggactacatgccttcgatgaagagattcaggaaggaggaggcgtacttgggagtcggccat

SEQ ID NO: 373058 - DNA, 140 bp, Artificial Sequence
  Synthetic
atggccgactcccaagtacgcctcctccttcctgaatctcttcatcgaaggcatgtagtccagaaattcttcatcgcctataaggcttctcacctgttggattgctgtgagtatgttctgggagacccagcatggcgtat

SEQ ID NO: 373059 - DNA, 140 bp, Artificial Sequence
  Synthetic
aggccctggctgctgatatgggctcggagacaaatgggataaagaagaagatgttcaagttctggctatagaaccaggaaaaaatccgaaacatgtccaaacgaaacccggccttttcaagaccttttgggacagcggtg

SEQ ID NO: 373060 - DNA, 140 bp, Artificial Sequence
  Synthetic
caccgctgtcccaaaaggtcttgaaaaggccgggtttcgtttggacatgtttcggattttttcctggttctatagccagaacttgaacatcttcttctttatcccatttgtctccgagcccatatcagcagccagggcct

SEQ ID NO: 373061 - DNA, 140 bp, Artificial Sequence
  Synthetic
aggccctggctgctgatatgagaacagtttcgactcggaagcttgcttaacgtagtgctgacagttttttattagagagcagatttctgatgaacaaccaacgaaaaaagacgggaaaacgaccttttgggacagcggtg

SEQ ID NO: 373062 - DNA, 140 bp, Artificial Sequence
  Synthetic
caccgctgtcccaaaaggtcgttttcccgtcttttttcgttggttgttcatcagaaatctgctctctaataaaaaactgtcagcactacgttaagcaagcttccgagtcgaaactgttctcatatcagcagccagggcct

SEQ ID NO: 373063 - DNA, 140 bp, Artificial Sequence
  Synthetic
atacgccatgctgggtctccgaggcttcaggaaagagattggaaggatgctgaacatcttgaacaggagacgcagaactgcaggcatgatcattatgctgattccaacagtgatggcgttcgtacttgggagtcggccat

SEQ ID NO: 373064 - DNA, 140 bp, Artificial Sequence
  Synthetic
atggccgactcccaagtacgaacgccatcactgttggaatcagcataatgatcatgcctgcagttctgcgtctcctgttcaagatgttcagcatccttccaatctctttcctgaagcctcggagacccagcatggcgtat

SEQ ID NO: 373065 - DNA, 140 bp, Artificial Sequence
  Synthetic
aggccctggctgctgatatggaacacagaagagaaaaaagatcagtggcactcgttccacatgtgggaatgggactggagacacgaactgaaacatggatgtcatcagaaggggcctggagaccttttgggacagcggtg

SEQ ID NO: 373066 - DNA, 140 bp, Artificial Sequence
  Synthetic
caccgctgtcccaaaaggtctccaggccccttctgatgacatccatgtttcagttcgtgtctccagtcccattcccacatgtggaacgagtgccactgatcttttttctcttctgtgttccatatcagcagccagggcct

SEQ ID NO: 373067 - DNA, 140 bp, Artificial Sequence
  Synthetic
atacgccatgctgggtctcccccaggcttcaccatattagctctattccttgcccattacataggcacttccctgacccagaaagtggttatctttattctactaatgctggtcaccccacgtacttgggagtcggccat

SEQ ID NO: 373068 - DNA, 140 bp, Artificial Sequence
  Synthetic
atggccgactcccaagtacgtggggtgaccagcattagtagaataaagataaccactttctgggtcagggaagtgcctatgtaatgggcaaggaatagagctaatatggtgaagcctgggggagacccagcatggcgtat

SEQ ID NO: 373069 - DNA, 140 bp, Artificial Sequence
  Synthetic
aggccctggctgctgatatgcatccggttctcccatcattaacaggaaaggaaaagtcatcggactctacggaaatggggttgttaccaaatcaggtgattacgttagtgccataacacagaccttttgggacagcggtg

SEQ ID NO: 373070 - DNA, 140 bp, Artificial Sequence
  Synthetic
caccgctgtcccaaaaggtctgtgttatggcactaacgtaatcacctgatttggtaacaaccccatttccgtagagtccgatgacttttcctttcctgttaatgatgggagaaccggatgcatatcagcagccagggcct

SEQ ID NO: 373071 - DNA, 140 bp, Artificial Sequence
  Synthetic
aggccctggctgctgatatgccacagttgttgtggatgaacattgtggaaatcgaggtccatctctcagaaccacaacagtcacaggaaagataatccatgaatggtgttgcagatcctggaccttttgggacagcggtg

SEQ ID NO: 373072 - DNA, 140 bp, Artificial Sequence
  Synthetic
caccgctgtcccaaaaggtccaggatctgcaacaccattcatggattatctttcctgtgactgttgtggttctgagagatggacctcgatttccacaatgttcatccacaacaactgtggcatatcagcagccagggcct

SEQ ID NO: 373073 - DNA, 140 bp, Artificial Sequence
  Synthetic
atacgccatgctgggtctccatcttcagaggaagttatctagcaggagcaggcctggccttttcattaatgaaatctttaggaggaggtaggagaggcacgggggctcaaggggaaacgccgtacttgggagtcggccat

SEQ ID NO: 373074 - DNA, 140 bp, Artificial Sequence
  Synthetic
atggccgactcccaagtacggcgtttccccttgagcccccgtgcctctcctacctcctcctaaagatttcattaatgaaaaggccaggcctgctcctgctagataacttcctctgaagatggagacccagcatggcgtat

SEQ ID NO: 373075 - DNA, 140 bp, Artificial Sequence
  Synthetic
aggccctggctgctgatatgacaatgaagaacaaagcctggatggtacataggcaatggttctttgacctacccttaccatggacatcaggagccacaacagagacaccaacctggaacagaccttttgggacagcggtg

SEQ ID NO: 373076 - DNA, 140 bp, Artificial Sequence
  Synthetic
caccgctgtcccaaaaggtctgttccaggttggtgtctctgttgtggctcctgatgtccatggtaagggtaggtcaaagaaccattgcctatgtaccatccaggctttgttcttcattgtcatatcagcagccagggcct

SEQ ID NO: 373077 - DNA, 140 bp, Artificial Sequence
  Synthetic
atacgccatgctgggtctcctgaaatgtagactcaagatggacaaattggaactcaaggggatgagctatgcaatgtgcttgaatacctttgtgttgaagaaagaagtctctgaaacgcacgtacttgggagtcggccat

SEQ ID NO: 373078 - DNA, 140 bp, Artificial Sequence
  Synthetic
atggccgactcccaagtacgtgcgtttcagagacttctttcttcaacacaaaggtattcaagcacattgcatagctcatccccttgagttccaatttgtccatcttgagtctacatttcaggagacccagcatggcgtat

SEQ ID NO: 373079 - DNA, 140 bp, Artificial Sequence
  Synthetic
atacgccatgctgggtctccgcatgggacaatactcattagggttgagtacaaaggggaagatgcaccttgcaagattcctttctccacagaggatggacaagggaaagcccacaatggtcgtacttgggagtcggccat

SEQ ID NO: 373080 - DNA, 140 bp, Artificial Sequence
  Synthetic
atggccgactcccaagtacgaccattgtgggctttcccttgtccatcctctgtggagaaaggaatcttgcaaggtgcatcttcccctttgtactcaaccctaatgagtattgtcccatgcggagacccagcatggcgtat

SEQ ID NO: 373081 - DNA, 140 bp, Artificial Sequence
  Synthetic
aggccctggctgctgatatgaagatgttcgaggccactgccagaggtgcaaggcgcatggccatcttgggagacacagcctgggactttggttcagtgggtggtgttctaaattcattaggaccttttgggacagcggtg

SEQ ID NO: 373082 - DNA, 140 bp, Artificial Sequence
  Synthetic
caccgctgtcccaaaaggtcctaatgaatttagaacaccacccactgaaccaaagtcccaggctgtgtctcccaagatggccatgcgccttgcacctctggcagtggcctcgaacatcttcatatcagcagccagggcct

SEQ ID NO: 373083 - DNA, 140 bp, Artificial Sequence
  Synthetic
atacgccatgctgggtctccggagtctcatggataatgaaaattggaataggtgtcctcttaacctggatagggttgaattcaaaaaacacttccatgtcattttcatgtattgtgatagcgtacttgggagtcggccat

SEQ ID NO: 373084 - DNA, 140 bp, Artificial Sequence
  Synthetic
atggccgactcccaagtacgctatcacaatacatgaaaatgacatggaagtgttttttgaattcaaccctatccaggttaagaggacacctattccaattttcattatccatgagactccggagacccagcatggcgtat

SEQ ID NO: 373085 - DNA, 140 bp, Artificial Sequence
  Synthetic
atacgccatgctgggtctccgtcataaactggaaaggaaaagaactcaaatgtggaagtggaattttcgtcactaatgaggtccacacctggacagagcaatacaaatttcaagcagactcgtacttgggagtcggccat

SEQ ID NO: 373086 - DNA, 140 bp, Artificial Sequence
  Synthetic
atggccgactcccaagtacgagtctgcttgaaatttgtattgctctgtccaggtgtggacctcattagtgacgaaaattccacttccacatttgagttcttttcctttccagtttatgacggagacccagcatggcgtat

SEQ ID NO: 373087 - DNA, 140 bp, Artificial Sequence
  Synthetic
aggccctggctgctgatatggctggaaaaacaaagaactgaagtgtggcagtgggattttcatcacagacaacgtgcacacatggacagaacaatacaagttccaaccagaatccccttcgaccttttgggacagcggtg

SEQ ID NO: 373088 - DNA, 140 bp, Artificial Sequence
  Synthetic
caccgctgtcccaaaaggtcgaaggggattctggttggaacttgtattgttctgtccatgtgtgcacgttgtctgtgatgaaaatcccactgccacacttcagttctttgtttttccagccatatcagcagccagggcct

SEQ ID NO: 373089 - DNA, 140 bp, Artificial Sequence
  Synthetic
aggccctggctgctgatatgagagggactgaagagaggagaaacaaccaaacatgcagtgtcgagaggagcagccaaactgaggtggttcgtggagagaaacctcgtgaaaccagagggggaccttttgggacagcggtg

SEQ ID NO: 373090 - DNA, 140 bp, Artificial Sequence
  Synthetic
caccgctgtcccaaaaggtccccctctggtttcacgaggtttctctccacgaaccacctcagtttggctgctcctctcgacactgcatgtttggttgtttctcctctcttcagtccctctcatatcagcagccagggcct

SEQ ID NO: 373091 - DNA, 140 bp, Artificial Sequence
  Synthetic
aggccctggctgctgatatgaacctgtacttggccaaaatcacacactctttggagcaatggtgtgctagagagtgacatgatcatcccaaagagtctagctggtcctatttcacaacacgaccttttgggacagcggtg

SEQ ID NO: 373092 - DNA, 140 bp, Artificial Sequence
  Synthetic
caccgctgtcccaaaaggtcgtgttgtgaaataggaccagctagactctttgggatgatcatgtcactctctagcacaccattgctccaaagagtgtgtgattttggccaagtacaggttcatatcagcagccagggcct

SEQ ID NO: 373093 - DNA, 140 bp, Artificial Sequence
  Synthetic
atacgccatgctgggtctcccactggccaaagtcacacaccctctggagtaatgaagtgctagaaagtgagatgataattccaaagaatttcgctggaccagtgtcacaacacaactacacgtacttgggagtcggccat

SEQ ID NO: 373094 - DNA, 140 bp, Artificial Sequence
  Synthetic
atggccgactcccaagtacgtgtagttgtgttgtgacactggtccagcgaaattctttggaattatcatctcactttctagcacttcattactccagagggtgtgtgactttggccagtgggagacccagcatggcgtat

SEQ ID NO: 373095 - DNA, 140 bp, Artificial Sequence
  Synthetic
atacgccatgctgggtctccgggaagctgatacacgaatggtgttgccgctcgtgcacacttcctcccttgcgatacatgggagaggacggctgctggtatggcatggaaattagacctacgtacttgggagtcggccat

SEQ ID NO: 373096 - DNA, 140 bp, Artificial Sequence
  Synthetic
atggccgactcccaagtacgtaggtctaatttccatgccataccagcagccgtcctctcccatgtatcgcaagggaggaagtgtgcacgagcggcaacaccattcgtgtatcagcttcccggagacccagcatggcgtat

SEQ ID NO: 373097 - DNA, 140 bp, Artificial Sequence
  Synthetic
atacgccatgctgggtctccttgatttttgcgaaggaaccacagtagtggtgactgaggattgtggaaatagaggaccctctctaagaacaaccaccgcctccggaaaactcataacagacgtacttgggagtcggccat

SEQ ID NO: 373098 - DNA, 140 bp, Artificial Sequence
  Synthetic
atggccgactcccaagtacgtctgttatgagttttccggaggcggtggttgttcttagagagggtcctctatttccacaatcctcagtcaccactactgtggttccttcgcaaaaatcaaggagacccagcatggcgtat

SEQ ID NO: 373099 - DNA, 140 bp, Artificial Sequence
  Synthetic
atacgccatgctgggtctccaaagtagcctcagaaggtttccagtactccgacagaaggtggtgctttgatggggaaaggaacaaccaggtgttggaggagaacatggacgtggagatctcgtacttgggagtcggccat

SEQ ID NO: 373100 - DNA, 140 bp, Artificial Sequence
  Synthetic
atggccgactcccaagtacgagatctccacgtccatgttctcctccaacacctggttgttcctttccccatcaaagcaccaccttctgtcggagtactggaaaccttctgaggctactttggagacccagcatggcgtat

SEQ ID NO: 373101 - DNA, 140 bp, Artificial Sequence
  Synthetic
atacgccatgctgggtctccgggggcttgttgatagcgtgttatgtcataactggcacgtcagcagacctcactgtagaaaaagcagcagatgtaacatgggaggaagaggctgagcaaacgtacttgggagtcggccat

SEQ ID NO: 373102 - DNA, 140 bp, Artificial Sequence
  Synthetic
atggccgactcccaagtacgtttgctcagcctcttcctcccatgttacatctgctgctttttctacagtgaggtctgctgacgtgccagttatgacataacacgctatcaacaagcccccggagacccagcatggcgtat

SEQ ID NO: 373103 - DNA, 140 bp, Artificial Sequence
  Synthetic
aggccctggctgctgatatgagaataaaggatgatgagactgagaacatcttaacagtgctcttaaaaacagcattgctaatagtatcaggcatctttccatactccatacccgccacacgaccttttgggacagcggtg

SEQ ID NO: 373104 - DNA, 140 bp, Artificial Sequence
  Synthetic
caccgctgtcccaaaaggtcgtgtggcgggtatggagtatggaaagatgcctgatactattagcaatgctgtttttaagagcactgttaagatgttctcagtctcatcatcctttattctcatatcagcagccagggcct

SEQ ID NO: 373105 - DNA, 140 bp, Artificial Sequence
  Synthetic
atacgccatgctgggtctccttggagtgcagaaagaaggagtcttccacaccatgtggcacgtcacaagaggggcagtgttgacgcacaatgggaaaagactggaaccaaactgggccagcgtacttgggagtcggccat

SEQ ID NO: 373106 - DNA, 140 bp, Artificial Sequence
  Synthetic
atggccgactcccaagtacgctggcccagtttggttccagtcttttcccattgtgcgtcaacactgcccctcttgtgacgtgccacatggtgtggaagactccttctttctgcactccaaggagacccagcatggcgtat

SEQ ID NO: 373107 - DNA, 140 bp, Artificial Sequence
  Synthetic
aggccctggctgctgatatgggaaataggagcaattgcactagacttcaagcctggaacttcaggatctcctatcataaacagagagggaaaggtagtgggactgtatggcaatggagtggaccttttgggacagcggtg

SEQ ID NO: 373108 - DNA, 140 bp, Artificial Sequence
  Synthetic
caccgctgtcccaaaaggtccactccattgccatacagtcccactacctttccctctctgtttatgataggagatcctgaagttccaggcttgaagtctagtgcaattgctcctatttcccatatcagcagccagggcct

SEQ ID NO: 373109 - DNA, 140 bp, Artificial Sequence
  Synthetic
atacgccatgctgggtctccaccagacggaccgacaccggaattggaagaggaaatgtttaaaaagcgaaatctaaccataatggatcttcatcctgggtcaggaaagacgcggaaatatcgtacttgggagtcggccat

SEQ ID NO: 373110 - DNA, 140 bp, Artificial Sequence
  Synthetic
atggccgactcccaagtacgatatttccgcgtctttcctgacccaggatgaagatccattatggttagatttcgctttttaaacatttcctcttccaattccggtgtcggtccgtctggtggagacccagcatggcgtat

SEQ ID NO: 373111 - DNA, 140 bp, Artificial Sequence
  Synthetic
aggccctggctgctgatatgatctaaccataatggatcttcatcctgggtcaggaaagacgcggaaatatcttccagccattgtcagagaagcaatcaagagacgcttaagaactctaatgaccttttgggacagcggtg

SEQ ID NO: 373112 - DNA, 140 bp, Artificial Sequence
  Synthetic
caccgctgtcccaaaaggtcattagagttcttaagcgtctcttgattgcttctctgacaatggctggaagatatttccgcgtctttcctgacccaggatgaagatccattatggttagatcatatcagcagccagggcct

SEQ ID NO: 373113 - DNA, 140 bp, Artificial Sequence
  Synthetic
atacgccatgctgggtctcctttggcaccaacaagagtggttgcagctgagatggaagaagcattgaaaggactcccaataaggtaccaaacaactgcaacaaaatctgaacacacaggacgtacttgggagtcggccat

SEQ ID NO: 373114 - DNA, 140 bp, Artificial Sequence
  Synthetic
atggccgactcccaagtacgtcctgtgtgttcagattttgttgcagttgtttggtaccttattgggagtcctttcaatgcttcttccatctcagctgcaaccactcttgttggtgccaaaggagacccagcatggcgtat

SEQ ID NO: 373115 - DNA, 140 bp, Artificial Sequence
  Synthetic
atacgccatgctgggtctccatcaccagtcagggttccaaattacaatttgataataatggatgaggcccatttcacagatccagccagcatagcggctagagggtacatatcaactcgtcgtacttgggagtcggccat

SEQ ID NO: 373116 - DNA, 140 bp, Artificial Sequence
  Synthetic
atggccgactcccaagtacgacgagttgatatgtaccctctagccgctatgctggctggatctgtgaaatgggcctcatccattattatcaaattgtaatttggaaccctgactggtgatggagacccagcatggcgtat

SEQ ID NO: 373117 - DNA, 140 bp, Artificial Sequence
  Synthetic
atacgccatgctgggtctcctggacctaatgtgtcatgccacattcactatgaggctgctatcaccagttagagtgccaaattacaacctgatcatcatggacgaagcccatttcacagacgtacttgggagtcggccat

SEQ ID NO: 373118 - DNA, 140 bp, Artificial Sequence
  Synthetic
atggccgactcccaagtacgtctgtgaaatgggcttcgtccatgatgatcaggttgtaatttggcactctaactggtgatagcagcctcatagtgaatgtggcatgacacattaggtccaggagacccagcatggcgtat

SEQ ID NO: 373119 - DNA, 140 bp, Artificial Sequence
  Synthetic
atacgccatgctgggtctccggaagacttttgatacagaataccaaaagaccagactgaatgattgggacttcgtggtgacgacagatatttcagaaatgggagctaattttaaagcggacgtacttgggagtcggccat

SEQ ID NO: 373120 - DNA, 140 bp, Artificial Sequence
  Synthetic
atggccgactcccaagtacgtccgctttaaaattagctcccatttctgaaatatctgtcgtcaccacgaagtcccaatcattcagtctggtcttttggtattctgtatcaaaagtcttccggagacccagcatggcgtat

SEQ ID NO: 373121 - DNA, 140 bp, Artificial Sequence
  Synthetic
atacgccatgctgggtctcccggtgaataccgcctgaagggtgagtctaggaagaccttcgtggaactcatgaggaggggtgacctcccagtttggctagcccacaaagtagcctcagaacgtacttgggagtcggccat

SEQ ID NO: 373122 - DNA, 140 bp, Artificial Sequence
  Synthetic
atggccgactcccaagtacgttctgaggctactttgtgggctagccaaactgggaggtcacccctcctcatgagttccacgaaggtcttcctagactcacccttcaggcggtattcaccgggagacccagcatggcgtat

SEQ ID NO: 373123 - DNA, 140 bp, Artificial Sequence
  Synthetic
aggccctggctgctgatatggcatgttcgaaccagagcgtgaaaaggtggatgccattgatggtgaataccgcttgagaggagaagcaaggaaaacctttgtggacctaatgagaagagggaccttttgggacagcggtg

SEQ ID NO: 373124 - DNA, 140 bp, Artificial Sequence
  Synthetic
caccgctgtcccaaaaggtccctcttctcattaggtccacaaaggttttccttgcttctcctctcaagcggtattcaccatcaatggcatccaccttttcacgctctggttcgaacatgccatatcagcagccagggcct

SEQ ID NO: 373125 - DNA, 140 bp, Artificial Sequence
  Synthetic
atacgccatgctgggtctcctcaaattttagaggagaacatggatgtggaaatctggacaaaggaaggagaaaggaaaaaattgagacccaggtggcttgatgcccgcacttattcagatcgtacttgggagtcggccat

SEQ ID NO: 373126 - DNA, 140 bp, Artificial Sequence
  Synthetic
atggccgactcccaagtacgatctgaataagtgcgggcatcaagccacctgggtctcaattttttcctttctccttcctttgtccagatttccacatccatgttctcctctaaaatttgaggagacccagcatggcgtat

SEQ ID NO: 373127 - DNA, 140 bp, Artificial Sequence
  Synthetic
atacgccatgctgggtctccgaagaaaatgtggaggtggaaatctggacaaaagaaggggaaaggaagaaattaaaacccagatggttggatgccaggatctactctgacccactggcgccgtacttgggagtcggccat

SEQ ID NO: 373128 - DNA, 140 bp, Artificial Sequence
  Synthetic
atggccgactcccaagtacggcgccagtgggtcagagtagatcctggcatccaaccatctgggttttaatttcttcctttccccttcttttgtccagatttccacctccacattttcttcggagacccagcatggcgtat

SEQ ID NO: 373129 - DNA, 140 bp, Artificial Sequence
  Synthetic
aggccctggctgctgatatggggcgtacaatcatgctctcagtgaactgccggagaccctggagacattgcttttactgacacttctggctacagtcacgggaggaatctttttattcttgaccttttgggacagcggtg

SEQ ID NO: 373130 - DNA, 140 bp, Artificial Sequence
  Synthetic
caccgctgtcccaaaaggtcaagaataaaaagattcctcccgtgactgtagccagaagtgtcagtaaaagcaatgtctccagggtctccggcagttcactgagagcatgattgtacgccccatatcagcagccagggcct

SEQ ID NO: 373131 - DNA, 140 bp, Artificial Sequence
  Synthetic
aggccctggctgctgatatgtagccatcctcacagtggtggccgcaaccatggcaaacgagatgggtttcctggaaaaaacgaagaaagatctcggattgggaagcattacaacccagcagaccttttgggacagcggtg

SEQ ID NO: 373132 - DNA, 140 bp, Artificial Sequence
  Synthetic
caccgctgtcccaaaaggtctgctgggttgtaatgcttcccaatccgagatctttcttcgttttttccaggaaacccatctcgtttgccatggttgcggccaccactgtgaggatggctacatatcagcagccagggcct

SEQ ID NO: 373133 - DNA, 140 bp, Artificial Sequence
  Synthetic
aggccctggctgctgatatgtcagcctggacattgtacgccgtggccacaacagtaataacaccaatgttgagacacaccatagagaattccacagcaaatgtgtccctggcagccataggaccttttgggacagcggtg

SEQ ID NO: 373134 - DNA, 140 bp, Artificial Sequence
  Synthetic
caccgctgtcccaaaaggtcctatggctgccagggacacatttgctgtggaattctctatggtgtgtctcaacattggtgttattactgttgtggccacggcgtacaatgtccaggctgacatatcagcagccagggcct

SEQ ID NO: 373135 - DNA, 140 bp, Artificial Sequence
  Synthetic
atacgccatgctgggtctccgatccaataccctatgatccaaagtttgaaaagcagttgggacaagtaatgctcctagtcctctgcgtgactcaagtgttgatgatgaggactacatgggcgtacttgggagtcggccat

SEQ ID NO: 373136 - DNA, 140 bp, Artificial Sequence
  Synthetic
atggccgactcccaagtacgcccatgtagtcctcatcatcaacacttgagtcacgcagaggactaggagcattacttgtcccaactgcttttcaaactttggatcatagggtattggatcggagacccagcatggcgtat

SEQ ID NO: 373137 - DNA, 140 bp, Artificial Sequence
  Synthetic
atacgccatgctgggtctcctttccatggctaacatctttagagggagctacttagcaggagctgggcttgctttttctatcatgaaatcagttggaacaggaaggagaggaacggggtccgtacttgggagtcggccat

SEQ ID NO: 373138 - DNA, 140 bp, Artificial Sequence
  Synthetic
atggccgactcccaagtacggaccccgttcctctccttcctgttccaactgatttcatgatagaaaaagcaagcccagctcctgctaagtagctccctctaaagatgttagccatggaaaggagacccagcatggcgtat

SEQ ID NO: 373139 - DNA, 140 bp, Artificial Sequence
  Synthetic
aggccctggctgctgatatggctttttctatcatgaaatcagttggaacaggaaggagaggaacggggtcacaaggcgaaaccttaggagaaaaatggaaaaagagattaaatcagctatgaccttttgggacagcggtg

SEQ ID NO: 373140 - DNA, 140 bp, Artificial Sequence
  Synthetic
caccgctgtcccaaaaggtcatagctgatttaatctctttttccatttttctcctaaggtttcgccttgtgaccccgttcctctccttcctgttccaactgatttcatgatagaaaaagccatatcagcagccagggcct

SEQ ID NO: 373141 - DNA, 140 bp, Artificial Sequence
  Synthetic
atacgccatgctgggtctccagagcaacgcaccaatcatggatgaagaaagggaaatccctgagcgttcgtggaactctggacatgagtgggttacggattttaaagggaagactgtttgcgtacttgggagtcggccat

SEQ ID NO: 373142 - DNA, 140 bp, Artificial Sequence
  Synthetic
atggccgactcccaagtacgcaaacagtcttccctttaaaatccgtaacccactcatgtccagagttccacgaacgctcagggatttccctttcttcatccatgattggtgcgttgctctggagacccagcatggcgtat

SEQ ID NO: 373143 - DNA, 140 bp, Artificial Sequence
  Synthetic
aggccctggctgctgatatgtcatattactgcgcaggactgaaaaaagtcacagaagtgcgaggatacacaaaaggcggcccaggacacgaagaaccagtacctatgtctacatatggatgaccttttgggacagcggtg

SEQ ID NO: 373144 - DNA, 140 bp, Artificial Sequence
  Synthetic
caccgctgtcccaaaaggtcatccatatgtagacataggtactggttcttcgtgtcctgggccgccttttgtgtatcctcgcacttctgtgacttttttcagtcctgcgcagtaatatgacatatcagcagccagggcct

SEQ ID NO: 373145 - DNA, 140 bp, Artificial Sequence
  Synthetic
atacgccatgctgggtctccagggaaagtagtggacctcggttgcggcagaggaggctggtcatactattgtgggggactaaagaatgtaagagaagtcaaaggcctaacaaaaggaggacgtacttgggagtcggccat

SEQ ID NO: 373146 - DNA, 140 bp, Artificial Sequence
  Synthetic
atggccgactcccaagtacgtcctccttttgttaggcctttgacttctcttacattctttagtcccccacaatagtatgaccagcctcctctgccgcaaccgaggtccactactttccctggagacccagcatggcgtat

SEQ ID NO: 373147 - DNA, 140 bp, Artificial Sequence
  Synthetic
atacgccatgctgggtctccccaatggtaccggcaacatcgtctcttcagtcaacatggtatccagattgctactgaacagatttacgatgacacacaggagacccaccatggagaaagacgtacttgggagtcggccat

SEQ ID NO: 373148 - DNA, 140 bp, Artificial Sequence
  Synthetic
atggccgactcccaagtacgtctttctccatggtgggtctcctgtgtgtcatcgtaaatctgttcagtagcaatctggataccatgttgactgaagagacgatgttgccggtaccattggggagacccagcatggcgtat

SEQ ID NO: 373149 - DNA, 140 bp, Artificial Sequence
  Synthetic
aggccctggctgctgatatgtccatcttgaaggaaagtgtgaaacatgtgtgtataacatgatgggaaaaagagagaagaagctaggggagttcggcaaggcaaaaggtagcagagccatgaccttttgggacagcggtg

SEQ ID NO: 373150 - DNA, 140 bp, Artificial Sequence
  Synthetic
caccgctgtcccaaaaggtcatggctctgctaccttttgccttgccgaactcccctagcttcttctctctttttcccatcatgttatacacacatgtttcacactttccttcaagatggacatatcagcagccagggcct

SEQ ID NO: 373151 - DNA, 140 bp, Artificial Sequence
  Synthetic
atacgccatgctgggtctccgaaagagggaggagcaatgtatgccgatgacaccgcaggatgggacacaagaatcacactggaagacctaaaaaatgaagaaatggtaacaaaccacatgcgtacttgggagtcggccat

SEQ ID NO: 373152 - DNA, 140 bp, Artificial Sequence
  Synthetic
atggccgactcccaagtacgcatgtggtttgttaccatttcttcattttttaggtcttccagtgtgattcttgtgtcccatcctgcggtgtcatcggcatacattgctcctccctctttcggagacccagcatggcgtat

SEQ ID NO: 373153 - DNA, 140 bp, Artificial Sequence
  Synthetic
aggccctggctgctgatatgcataccaaaacaaagtggtcaaagttcaacgaccaactccaaaaggcacggtaatggacatcatatctaggaaagaccaaagaggcagtggacaggtggggaccttttgggacagcggtg

SEQ ID NO: 373154 - DNA, 140 bp, Artificial Sequence
  Synthetic
caccgctgtcccaaaaggtccccacctgtccactgcctctttggtctttcctagatatgatgtccattaccgtgccttttggagttggtcgttgaactttgaccactttgttttggtatgcatatcagcagccagggcct

SEQ ID NO: 373155 - DNA, 140 bp, Artificial Sequence
  Synthetic
aggccctggctgctgatatgcaaagagtttgcagctggaagaaaatccctgaccctgaatttaatcacagaaatgggtaggcttccaacttttatgactcagaaagcaaggaacgcactggaccttttgggacagcggtg

SEQ ID NO: 373156 - DNA, 140 bp, Artificial Sequence
  Synthetic
caccgctgtcccaaaaggtccagtgcgttccttgctttctgagtcataaaagttggaagcctacccatttctgtgattaaattcagggtcagggattttcttccagctgcaaactctttgcatatcagcagccagggcct

SEQ ID NO: 373157 - DNA, 140 bp, Artificial Sequence
  Synthetic
aggccctggctgctgatatgattaaaaagaatggccatcagcggggatgattgcgtggtgaaaccgatcgatgacaggtttgccaatgccctgcttgccctgaacgacatgggaaaggttgaccttttgggacagcggtg

SEQ ID NO: 373158 - DNA, 140 bp, Artificial Sequence
  Synthetic
caccgctgtcccaaaaggtcaacctttcccatgtcgttcagggcaagcagggcattggcaaacctgtcatcgatcggtttcaccacgcaatcatccccgctgatggccattctttttaatcatatcagcagccagggcct

SEQ ID NO: 373159 - DNA, 140 bp, Artificial Sequence
  Synthetic
aggccctggctgctgatatgacaggtccctttctgctcccaccactttcatgaactgatcatgaaagatggaagaaagttggtggttccctgcagaccccaggacgaactaataggaagggaccttttgggacagcggtg

SEQ ID NO: 373160 - DNA, 140 bp, Artificial Sequence
  Synthetic
caccgctgtcccaaaaggtcccttcctattagttcgtcctggggtctgcagggaaccaccaactttcttccatctttcatgatcagttcatgaaagtggtgggagcagaaagggacctgtcatatcagcagccagggcct

SEQ ID NO: 373161 - DNA, 140 bp, Artificial Sequence
  Synthetic
aggccctggctgctgatatgcacaggagagacactgggagaaaaatggaagagacagctaaactcgcttgataggaaggagtttgaagagtacaaaagaagtggaatactagaagtggacgaccttttgggacagcggtg

SEQ ID NO: 373162 - DNA, 140 bp, Artificial Sequence
  Synthetic
caccgctgtcccaaaaggtcgtccacttctagtattccacttcttttgtactcttcaaactccttcctatcaagcgagtttagctgtctcttccatttttctcccagtgtctctcctgtgcatatcagcagccagggcct

SEQ ID NO: 373163 - DNA, 140 bp, Artificial Sequence
  Synthetic
atacgccatgctgggtctccagtaaaaaagaggctaaatgtcaggccaccttaagccacagtacggaagaagctgtgcagcctgtgagccccgtccaaggacgttaaaagaagaagtcagcgtacttgggagtcggccat

SEQ ID NO: 373164 - DNA, 140 bp, Artificial Sequence
  Synthetic
atggccgactcccaagtacgctgacttcttcttttaacgtccttggacggggctcacaggctgcacagcttcttccgtactgtggcttaaggtggcctgacatttagcctcttttttactggagacccagcatggcgtat

SEQ ID NO: 373165 - DNA, 140 bp, Artificial Sequence
  Synthetic
aggccctggctgctgatatgagctgtgcagcctgtgagccccgtccaaggacgttaaaagaagaagtcaggcccaaaagccacggtttgagcaaaccgtgctgcctgtagctccgtcgtggaccttttgggacagcggtg

SEQ ID NO: 373166 - DNA, 140 bp, Artificial Sequence
  Synthetic
caccgctgtcccaaaaggtccacgacggagctacaggcagcacggtttgctcaaaccgtggcttttgggcctgacttcttcttttaacgtccttggacggggctcacaggctgcacagctcatatcagcagccagggcct

SEQ ID NO: 373167 - DNA, 140 bp, Artificial Sequence
  Synthetic
atacgccatgctgggtctcctacaaatgccatagctcgagtaaactgtgcagcctgtagctccacctgagaaggtgtaaaaaatctgggaggccacaaaccatggaagctgtacgcatggcgtacttgggagtcggccat

SEQ ID NO: 373168 - DNA, 140 bp, Artificial Sequence
  Synthetic
atggccgactcccaagtacgccatgcgtacagcttccatggtttgtggcctcccagattttttacaccttctcaggtggagctacaggctgcacagtttactcgagctatggcatttgtaggagacccagcatggcgtat

SEQ ID NO: 373169 - DNA, 140 bp, Artificial Sequence
  Synthetic
atacgccatgctgggtctccccactccatgggttttcttgaatccacaccctgttccagactgtcagcatgtcttccgctgtcatccattcatgtttggcgtgtatggaccaggttgttccgtacttgggagtcggccat

SEQ ID NO: 373170 - DNA, 140 bp, Artificial Sequence
  Synthetic
atggccgactcccaagtacggaacaacctggtccatacacgccaaacatgaatggatgacagcggaagacatgctgacagtctggaacagggtgtggattcaagaaaacccatggagtggggagacccagcatggcgtat

SEQ ID NO: 373171 - DNA, 140 bp, Artificial Sequence
  Synthetic
atacgccatgctgggtctccccttgcaaaggactagaggttagaggagaccccccgtaaataaaaacagcatattgacgctgggagagaccagagatcctgctgtctcctcagcatcattcgtacttgggagtcggccat

SEQ ID NO: 373172 - DNA, 140 bp, Artificial Sequence
  Synthetic
atggccgactcccaagtacgaatgatgctgaggagacagcaggatctctggtctctcccagcgtcaatatgctgtttttatttacggggggtctcctctaacctctagtcctttgcaaggggagacccagcatggcgtat

SEQ ID NO: 373173 - DNA, 140 bp, Artificial Sequence
  Synthetic
aggccctggctgctgatatgctctgtctcatgatgatattgccagcagcacttgctttccacttgacttcacgagatggagagccgcgcatgatcgtggggaagaatgaaagaggaaaatgaccttttgggacagcggtg

SEQ ID NO: 373174 - DNA, 140 bp, Artificial Sequence
  Synthetic
caccgctgtcccaaaaggtcattttcctctttcattcttccccacgatcatgcgcggctctccatctcgtgaagtcaagtggaaagcaagtgctgctggcaatatcatcatgagacagagcatatcagcagccagggcct

SEQ ID NO: 373175 - DNA, 140 bp, Artificial Sequence
  Synthetic
aggccctggctgctgatatgatgggtttgatagccattgcggtagctagtggcttactctgggtggcagaaatccagccccagtggatagcggcctcaatcatattggaattttttctcagaccttttgggacagcggtg

SEQ ID NO: 373176 - DNA, 140 bp, Artificial Sequence
  Synthetic
caccgctgtcccaaaaggtctgagaaaaaattccaatatgattgaggccgctatccactggggctggatttctgccacccagagtaagccactagctaccgcaatggctatcaaacccatcatatcagcagccagggcct

SEQ ID NO: 373177 - DNA, 140 bp, Artificial Sequence
  Synthetic
aggccctggctgctgatatgatggtgacacagatggcaatgacagacacgactccatttggacaacagcgcgtttttaaagaaaaagtggacacgagaacccaagaaccgaaagaaggcagaccttttgggacagcggtg

SEQ ID NO: 373178 - DNA, 140 bp, Artificial Sequence
  Synthetic
caccgctgtcccaaaaggtctgccttctttcggttcttgggttctcgtgtccactttttctttaaaaacgcgctgttgtccaaatggagtcgtgtctgtcattgccatctgtgtcaccatcatatcagcagccagggcct

SEQ ID NO: 373179 - DNA, 140 bp, Artificial Sequence
  Synthetic
aggccctggctgctgatatgcgtttttaaagaaaaagtggacacgagaacccaagaaccgaaagaaggcacaaagaaactaatgaaaatcacggcagagtggctttggaaagaactaggggaccttttgggacagcggtg

SEQ ID NO: 373180 - DNA, 140 bp, Artificial Sequence
  Synthetic
caccgctgtcccaaaaggtcccctagttctttccaaagccactctgccgtgattttcattagtttctttgtgccttctttcggttcttgggttctcgtgtccactttttctttaaaaacgcatatcagcagccagggcct

SEQ ID NO: 373181 - DNA, 140 bp, Artificial Sequence
  Synthetic
aggccctggctgctgatatgagccaatgagatggggctaattgaaaaaacaaaaacggattttgggttttaccaggcaaaaacagaaaccaccatccttgatgtggacttgagaccagctgaccttttgggacagcggtg

SEQ ID NO: 373182 - DNA, 140 bp, Artificial Sequence
  Synthetic
caccgctgtcccaaaaggtcagctggtctcaagtccacatcaaggatggtggtttctgtttttgcctggtaaaacccaaaatccgtttttgttttttcaattagccccatctcattggctcatatcagcagccagggcct

SEQ ID NO: 373183 - DNA, 140 bp, Artificial Sequence
  Synthetic
atacgccatgctgggtctcctgaaagacacactcaaaaggagaagctggccactgaatgaaggggtgatggctgttgggcttgtgagcattctggccagttctctccttagaaatgacgtcgtacttgggagtcggccat

SEQ ID NO: 373184 - DNA, 140 bp, Artificial Sequence
  Synthetic
atggccgactcccaagtacgacgtcatttctaaggagagaactggccagaatgctcacaagcccaacagccatcaccccttcattcagtggccagcttctccttttgagtgtgtctttcaggagacccagcatggcgtat

SEQ ID NO: 373185 - DNA, 140 bp, Artificial Sequence
  Synthetic
aggccctggctgctgatatgtatagatctagaaccaatatcctatgacccaaaatttgaaaagcagctggggcaagtcatgctgctagttctgtgcgctggacagctactcttgatgagagaccttttgggacagcggtg

SEQ ID NO: 373186 - DNA, 140 bp, Artificial Sequence
  Synthetic
caccgctgtcccaaaaggtctctcatcaagagtagctgtccagcgcacagaactagcagcatgacttgccccagctgcttttcaaattttgggtcataggatattggttctagatctatacatatcagcagccagggcct

SEQ ID NO: 373187 - DNA, 140 bp, Artificial Sequence
  Synthetic
aggccctggctgctgatatgagacaacaatgagaggagcaaagagaatggccattttaggtgacacagcctgggattttggatccctgggaggagtgtttacatctataggaaaggctctgaccttttgggacagcggtg

SEQ ID NO: 373188 - DNA, 140 bp, Artificial Sequence
  Synthetic
caccgctgtcccaaaaggtcagagcctttcctatagatgtaaacactcctcccagggatccaaaatcccaggctgtgtcacctaaaatggccattctctttgctcctctcattgttgtctcatatcagcagccagggcct

SEQ ID NO: 373189 - DNA, 140 bp, Artificial Sequence
  Synthetic
aggccctggctgctgatatgggactatgaaaatcctcataggagtcatcatcacatggataggaatgaattcacgtagcacctcactgtctgtgtcgctagtattggtgggagtcgtgacgaccttttgggacagcggtg

SEQ ID NO: 373190 - DNA, 140 bp, Artificial Sequence
  Synthetic
caccgctgtcccaaaaggtcgtcacgactcccaccaatactagcgacacagacagtgaggtgctacgtgaattcattcctatccatgtgatgatgactcctatgaggattttcatagtcccatatcagcagccagggcct

SEQ ID NO: 373191 - DNA, 140 bp, Artificial Sequence
  Synthetic
aggccctggctgctgatatggaccttgtgggaaggcaacccgggaaggttttggaacacgaccatagccgtgtccactgccaacattttcagaggaagctacttggcgggagctggattggaccttttgggacagcggtg

SEQ ID NO: 373192 - DNA, 140 bp, Artificial Sequence
  Synthetic
caccgctgtcccaaaaggtccaatccagctcccgccaagtagcttcctctgaaaatgttggcagtggacacggctatggtcgtgttccaaaaccttcccgggttgccttcccacaaggtccatatcagcagccagggcct

SEQ ID NO: 373193 - DNA, 140 bp, Artificial Sequence
  Synthetic
aggccctggctgctgatatgcatgttaatgcggaaccagaaacacccaacatggatgtcattggggaaagaataagaaggatcaaggaggagcataattcaacatggcactatgatgacggaccttttgggacagcggtg

SEQ ID NO: 373194 - DNA, 140 bp, Artificial Sequence
  Synthetic
caccgctgtcccaaaaggtccgtcatcatagtgccatgttgaattatgctcctccttgatccttcttattctttccccaatgacatccatgttgggtgtttctggttccgcattaacatgcatatcagcagccagggcct

SEQ ID NO: 373195 - DNA, 140 bp, Artificial Sequence
  Synthetic
aggccctggctgctgatatgaggacaatccatacaaaacatgggcctatcatggatcatatgaggtcaagccatcaggatcagcctcatccatggtgaatggagtggtgagattgctcacgaccttttgggacagcggtg

SEQ ID NO: 373196 - DNA, 140 bp, Artificial Sequence
  Synthetic
caccgctgtcccaaaaggtcgtgagcaatctcaccactccattcaccatggatgaggctgatcctgatggcttgacctcatatgatccatgataggcccatgttttgtatggattgtcctcatatcagcagccagggcct

SEQ ID NO: 373197 - DNA, 140 bp, Artificial Sequence
  Synthetic
aggccctggctgctgatatgacaggctcagcctcctccatgataaatggagtcgtgaaacttctcactaaaccatgggatgtggtgcccatggtgacacagatggcaatgacagatacaagaccttttgggacagcggtg

SEQ ID NO: 373198 - DNA, 140 bp, Artificial Sequence
  Synthetic
caccgctgtcccaaaaggtcttgtatctgtcattgccatctgtgtcaccatgggcaccacatcccatggtttagtgagaagtttcacgactccatttatcatggaggaggctgagcctgtcatatcagcagccagggcct

SEQ ID NO: 373199 - DNA, 140 bp, Artificial Sequence
  Synthetic
aggccctggctgctgatatgaaaactcatgtgtccagttgggaggacgttccatacttagggaaaagagaagatcagtggtgtggatccttgataggcttgacagctagggctacctggggaccttttgggacagcggtg

SEQ ID NO: 373200 - DNA, 140 bp, Artificial Sequence
  Synthetic
caccgctgtcccaaaaggtccccaggtagccctagctgtcaagcctatcaaggatccacaccactgatcttctcttttccctaagtatggaacgtcctcccaactggacacatgagttttcatatcagcagccagggcct

SEQ ID NO: 373201 - DNA, 140 bp, Artificial Sequence
  Synthetic
aggccctggctgctgatatgatagcaacattcaagattcagccattcttggctttgggattctttctaaggaaattgacatccagagaaaatttgctgttgggagttggattggccatgggaccttttgggacagcggtg

SEQ ID NO: 373202 - DNA, 140 bp, Artificial Sequence
  Synthetic
caccgctgtcccaaaaggtcccatggccaatccaactcccaacagcaaattttctctggatgtcaatttccttagaaagaatcccaaagccaagaatggctgaatcttgaatgttgctatcatatcagcagccagggcct

SEQ ID NO: 373203 - DNA, 140 bp, Artificial Sequence
  Synthetic
aggccctggctgctgatatgtatgtatgcagatgatacagccggatgggacacaagagtaacagaggatgatcttcagaatgaggctaaaatcactgacatcatggagcctgaacatgctgaccttttgggacagcggtg

SEQ ID NO: 373204 - DNA, 140 bp, Artificial Sequence
  Synthetic
caccgctgtcccaaaaggtcagcatgttcaggctccatgatgtcagtgattttagcctcattctgaagatcatcctctgttactcttgtgtcccatccggctgtatcatctgcatacatacatatcagcagccagggcct

SEQ ID NO: 373205 - DNA, 140 bp, Artificial Sequence
  Synthetic
aggccctggctgctgatatgctctagacttttctcctggaacgtcaggatctccaatcgtcgacaaaaaaggaaaagtcgtgggtctttatggtaatggtgttgtcactagaagtggaacgaccttttgggacagcggtg

SEQ ID NO: 373206 - DNA, 140 bp, Artificial Sequence
  Synthetic
caccgctgtcccaaaaggtcgttccacttctagtgacaacaccattaccataaagacccacgacttttccttttttgtcgacgattggagatcctgacgttccaggagaaaagtctagagcatatcagcagccagggcct

SEQ ID NO: 373207 - DNA, 140 bp, Artificial Sequence
  Synthetic
aggccctggctgctgatatgacagcatattgacgctgggagagaccagagatcctgctgtctcctcagcatcattccaggcacagaacgccagaaaatggaatggtgctgttgaatcaacgaccttttgggacagcggtg

SEQ ID NO: 373208 - DNA, 140 bp, Artificial Sequence
  Synthetic
caccgctgtcccaaaaggtcgttgattcaacagcaccattccattttctggcgttctgtgcctggaatgatgctgaggagacagcaggatctctggtctctcccagcgtcaatatgctgtcatatcagcagccagggcct

SEQ ID NO: 373209 - DNA, 140 bp, Artificial Sequence
  Synthetic
atacgccatgctgggtctccgggaaccttcaagaagtcaggggctattaaggtcttaaaaggcttcaagaaggagatctcaaacatgctgagcattatcaacaaaaggaaaaagacatcgcgtacttgggagtcggccat

SEQ ID NO: 373210 - DNA, 140 bp, Artificial Sequence
  Synthetic
atggccgactcccaagtacgcgatgtctttttccttttgttgataatgctcagcatgtttgagatctccttcttgaagccttttaagaccttaatagcccctgacttcttgaaggttcccggagacccagcatggcgtat

SEQ ID NO: 373211 - DNA, 140 bp, Artificial Sequence
  Synthetic
aggccctggctgctgatatgtctagccatacccccaacagcaggaattttggctagatggagctcattcaagaagaatggagcaattaaagtgttacggggtttcaaaaaagagatctcagaccttttgggacagcggtg

SEQ ID NO: 373212 - DNA, 140 bp, Artificial Sequence
  Synthetic
caccgctgtcccaaaaggtctgagatctcttttttgaaaccccgtaacactttaattgctccattcttcttgaatgagctccatctagccaaaattcctgctgttgggggtatggctagacatatcagcagccagggcct

SEQ ID NO: 373213 - DNA, 140 bp, Artificial Sequence
  Synthetic
atacgccatgctgggtctccatctgtcttatgatgatgttaccagcaacacttgctttccacttgacttcacgcgatggagagccgcgcatgattgtggggaagaatgaaagagggaaatcgtacttgggagtcggccat

SEQ ID NO: 373214 - DNA, 140 bp, Artificial Sequence
  Synthetic
atggccgactcccaagtacgatttccctctttcattcttccccacaatcatgcgcggctctccatcgcgtgaagtcaagtggaaagcaagtgttgctggtaacatcatcataagacagatggagacccagcatggcgtat

SEQ ID NO: 373215 - DNA, 140 bp, Artificial Sequence
  Synthetic
atacgccatgctgggtctcctaggaaacagagactttgtggaaggtctgtcaggagctacgtgggttgatgtggtgctcgagcacggtgggtgtgtgaccaccatggctaagaacaagcccgtacttgggagtcggccat

SEQ ID NO: 373216 - DNA, 140 bp, Artificial Sequence
  Synthetic
atggccgactcccaagtacgggcttgttcttagccatggtggtcacacacccaccgtgctcgagcaccacatcaacccacgtagctcctgacagaccttccacaaagtctctgtttcctaggagacccagcatggcgtat

SEQ ID NO: 373217 - DNA, 140 bp, Artificial Sequence
  Synthetic
aggccctggctgctgatatggtggtgctcgagcacggtgggtgtgtgaccaccatggctaagaacaagcctacgctggacatagagcttcagaagaccgaggccacccaactggcgacccgaccttttgggacagcggtg

SEQ ID NO: 373218 - DNA, 140 bp, Artificial Sequence
  Synthetic
caccgctgtcccaaaaggtcgggtcgccagttgggtggcctcggtcttctgaagctctatgtccagcgtaggcttgttcttagccatggtggtcacacacccaccgtgctcgagcaccaccatatcagcagccagggcct

SEQ ID NO: 373219 - DNA, 140 bp, Artificial Sequence
  Synthetic
atacgccatgctgggtctcctacgctggacatagagcttcagaagaccgaggccacccaactggcgaccctaaggaagttatgcattgagggaaaaattaccaacataacaaccgactcacgtacttgggagtcggccat

SEQ ID NO: 373220 - DNA, 140 bp, Artificial Sequence
  Synthetic
atggccgactcccaagtacgtgagtcggttgttatgttggtaatttttccctcaatgcataacttccttagggtcgccagttgggtggcctcggtcttctgaagctctatgtccagcgtaggagacccagcatggcgtat

SEQ ID NO: 373221 - DNA, 140 bp, Artificial Sequence
  Synthetic
atacgccatgctgggtctccaggtgtcccacccagggggaagcgattctacctgaggagcaggaccagaactacgtatgtaagcacacatacgtggatagaggttggggaaacggttgtgcgtacttgggagtcggccat

SEQ ID NO: 373222 - DNA, 140 bp, Artificial Sequence
  Synthetic
atggccgactcccaagtacgcacaaccgtttccccaacctctatccacgtatgtgtgcttacatacgtagttctggtcctgctcctcaggtagaatcgcttccccctgggtgggacacctggagacccagcatggcgtat

SEQ ID NO: 373223 - DNA, 140 bp, Artificial Sequence
  Synthetic
aggccctggctgctgatatgctacgtatgtaagcacacatacgtggatagaggttggggaaacggttgtggcttgtttggaaaaggaagcttggtgacatgcgcgaaatttcaatgtctagaccttttgggacagcggtg

SEQ ID NO: 373224 - DNA, 140 bp, Artificial Sequence
  Synthetic
caccgctgtcccaaaaggtctagacattgaaatttcgcgcatgtcaccaagcttccttttccaaacaagccacaaccgtttccccaacctctatccacgtatgtgtgcttacatacgtagcatatcagcagccagggcct

SEQ ID NO: 373225 - DNA, 140 bp, Artificial Sequence
  Synthetic
atacgccatgctgggtctccgtttaaaacaggggatggtgtgaacatgtgtaccctcatggccatggaccttggtgaattgtgtgaagatacaatcacgtacaagtgtcctcttctcaggcgtacttgggagtcggccat

SEQ ID NO: 373226 - DNA, 140 bp, Artificial Sequence
  Synthetic
atggccgactcccaagtacgcctgagaagaggacacttgtacgtgattgtatcttcacacaattcaccaaggtccatggccatgagggtacacatgttcacaccatcccctgttttaaacggagacccagcatggcgtat

SEQ ID NO: 373227 - DNA, 140 bp, Artificial Sequence
  Synthetic
aggccctggctgctgatatggctgcctgtggctccatcgtggggatgtagctccatcgtggggatgtagctccatcgtggggatgtagctccatcgtggggatgtagctccatcgtgggggaccttttgggacagcggtg

SEQ ID NO: 373228 - DNA, 140 bp, Artificial Sequence
  Synthetic
caccgctgtcccaaaaggtcccccacgatggagctacatccccacgatggagctacatccccacgatggagctacatccccacgatggagctacatccccacgatggagccacaggcagccatatcagcagccagggcct

SEQ ID NO: 373229 - DNA, 140 bp, Artificial Sequence
  Synthetic
aggccctggctgctgatatggtgcaaggcgcatggccatcttgggagacacagcctgggactttggttcagtgggtggtgttctaaattcattagggaaaatggtgcaccaaatattcgggaccttttgggacagcggtg

SEQ ID NO: 373230 - DNA, 140 bp, Artificial Sequence
  Synthetic
caccgctgtcccaaaaggtcccgaatatttggtgcaccattttccctaatgaatttagaacaccacccactgaaccaaagtcccaggctgtgtctcccaagatggccatgcgccttgcaccatatcagcagccagggcct

SEQ ID NO: 373231 - DNA, 140 bp, Artificial Sequence
  Synthetic
aggccctggctgctgatatgggaacttggtcaaactccattcaggggttgacgtcttctacaaacccactgagcaagtggacaccctgctctgtgatattggggagtcatcttctaatccgaccttttgggacagcggtg

SEQ ID NO: 373232 - DNA, 140 bp, Artificial Sequence
  Synthetic
caccgctgtcccaaaaggtcggattagaagatgactccccaatatcacagagcagggtgtccacttgctcagtgggtttgtagaagacgtcaacccctgaatggagtttgaccaagttcccatatcagcagccagggcct

SEQ ID NO: 373233 - DNA, 140 bp, Artificial Sequence
  Synthetic
aggccctggctgctgatatgggaagtggaacccgcaacattggaattgaaagtgagataccaaatctagacataataggaaagagaatagagaaaataaaacaagagcatgaaacatcatgaccttttgggacagcggtg

SEQ ID NO: 373234 - DNA, 140 bp, Artificial Sequence
  Synthetic
caccgctgtcccaaaaggtcatgatgtttcatgctcttgttttattttctctattctctttcctattatgtctagatttggtatctcactttcaattccaatgttgcgggttccacttcccatatcagcagccagggcct

SEQ ID NO: 373235 - DNA, 140 bp, Artificial Sequence
  Synthetic
atacgccatgctgggtctccaaaaagcatccttcatagaggtaaaaacctgtacttggccaaaatcacacactctttggagcaatggtgtactagagagtgacatgatcatcccaaagagcgtacttgggagtcggccat

SEQ ID NO: 373236 - DNA, 140 bp, Artificial Sequence
  Synthetic
atggccgactcccaagtacgctctttgggatgatcatgtcactctctagtacaccattgctccaaagagtgtgtgattttggccaagtacaggtttttacctctatgaaggatgctttttggagacccagcatggcgtat

SEQ ID NO: 373237 - DNA, 140 bp, Artificial Sequence
  Synthetic
atacgccatgctgggtctccggtccaacgcttccgacaggatgggaatgggcgttacctacctagctttaattgcaacattcaaaatccagccattcttggctttgggattcttcctgagcgtacttgggagtcggccat

SEQ ID NO: 373238 - DNA, 140 bp, Artificial Sequence
  Synthetic
atggccgactcccaagtacgctcaggaagaatcccaaagccaagaatggctggattttgaatgttgcaattaaagctaggtaggtaacgcccattcccatcctgtcggaagcgttggaccggagacccagcatggcgtat

SEQ ID NO: 373239 - DNA, 140 bp, Artificial Sequence
  Synthetic
aggccctggctgctgatatgtgactgttgcctggagaacagccaccctgattctggccggagtttcgcttttgccactgtgccagtcttcgagtatgaggaaaacagattggctcccaatgaccttttgggacagcggtg

SEQ ID NO: 373240 - DNA, 140 bp, Artificial Sequence
  Synthetic
caccgctgtcccaaaaggtcattgggagccaatctgttttcctcatactcgaagactggcacagtggcaaaagcgaaactccggccagaatcagggtggctgttctccaggcaacagtcacatatcagcagccagggcct

SEQ ID NO: 373241 - DNA, 140 bp, Artificial Sequence
  Synthetic
aggccctggctgctgatatgatgctggcagtctggaacagggtgtggatccaagaaaacccatggatggaagacaaaactccagtggaatcatgggaagaagtcccatacctggggaaaagaccttttgggacagcggtg

SEQ ID NO: 373242 - DNA, 140 bp, Artificial Sequence
  Synthetic
caccgctgtcccaaaaggtcttttccccaggtatgggacttcttcccatgattccactggagttttgtcttccatccatgggttttcttggatccacaccctgttccagactgccagcatcatatcagcagccagggcct

SEQ ID NO: 373243 - DNA, 140 bp, Artificial Sequence
  Synthetic
atacgccatgctgggtctccgttcaaggagaaggttgacaccagaacaccacagccaaaacccggtacacgagtggtcatgaccacgacagccaactggctgtgggctctcctcgggaggcgtacttgggagtcggccat

SEQ ID NO: 373244 - DNA, 140 bp, Artificial Sequence
  Synthetic
atggccgactcccaagtacgcctcccgaggagagcccacagccagttggctgtcgtggtcatgaccactcgtgtaccgggttttggctgtggtgttctggtgtcaaccttctccttgaacggagacccagcatggcgtat

SEQ ID NO: 373245 - DNA, 140 bp, Artificial Sequence
  Synthetic
aggccctggctgctgatatgggaggaggatggagattgagcgcacaatggcaaaagggagaggaggtgcaggttattgccgtagagcctgggaagaacccaaaaaactttcaaaccatgcgaccttttgggacagcggtg

SEQ ID NO: 373246 - DNA, 140 bp, Artificial Sequence
  Synthetic
caccgctgtcccaaaaggtcgcatggtttgaaagttttttgggttcttcccaggctctacggcaataacctgcacctcctctcccttttgccattgtgcgctcaatctccatcctcctcccatatcagcagccagggcct

SEQ ID NO: 373247 - DNA, 140 bp, Artificial Sequence
  Synthetic
aggccctggctgctgatatggctgagatggaagaagcattgaaaggactcccaataaggtatcaaacaactgcaacaaaatctgaacacacaggaagggagattgttgatctaatgtgccgaccttttgggacagcggtg

SEQ ID NO: 373248 - DNA, 140 bp, Artificial Sequence
  Synthetic
caccgctgtcccaaaaggtcggcacattagatcaacaatctcccttcctgtgtgttcagattttgttgcagttgtttgataccttattgggagtcctttcaatgcttcttccatctcagccatatcagcagccagggcct

SEQ ID NO: 373249 - DNA, 140 bp, Artificial Sequence
  Synthetic
aggccctggctgctgatatgatgacagccactcccccaggatcggtggaggcctttccacagagcaatgcagttatccaagatgaggaaagagacattcctgagagatcatggaactcaggaccttttgggacagcggtg

SEQ ID NO: 373250 - DNA, 140 bp, Artificial Sequence
  Synthetic
caccgctgtcccaaaaggtcctgagttccatgatctctcaggaatgtctctttcctcatcttggataactgcattgctctgtggaaaggcctccaccgatcctgggggagtggctgtcatcatatcagcagccagggcct

SEQ ID NO: 373251 - DNA, 140 bp, Artificial Sequence
  Synthetic
aggccctggctgctgatatgctcaacaatgatgaagaccatgctcactggacagaagcaaaaatgctgctagacaacatcaacacaccagaagggatcataccagctctctttgaaccaggaccttttgggacagcggtg

SEQ ID NO: 373252 - DNA, 140 bp, Artificial Sequence
  Synthetic
caccgctgtcccaaaaggtcctggttcaaagagagctggtatgatcccttctggtgtgttgatgttgtctagcagcatttttgcttctgtccagtgagcatggtcttcatcattgttgagcatatcagcagccagggcct

SEQ ID NO: 373253 - DNA, 140 bp, Artificial Sequence
  Synthetic
atacgccatgctgggtctcccagtggaggaactaccagaaacaatggaaacactcctactcttgggactcatgatcttattaacaggtggagcaatgcttttcttgatatcaggtaaaggcgtacttgggagtcggccat

SEQ ID NO: 373254 - DNA, 140 bp, Artificial Sequence
  Synthetic
atggccgactcccaagtacgcctttacctgatatcaagaaaagcattgctccacctgttaataagatcatgagtcccaagagtaggagtgtttccattgtttctggtagttcctccactgggagacccagcatggcgtat

SEQ ID NO: 373255 - DNA, 140 bp, Artificial Sequence
  Synthetic
aggccctggctgctgatatggagaagcgaggaaaacctttgtggacctaatgagaagaggagacctaccagtctggctggcctacagagtggcagccgaaggcattaactatgcagacaggaccttttgggacagcggtg

SEQ ID NO: 373256 - DNA, 140 bp, Artificial Sequence
  Synthetic
caccgctgtcccaaaaggtcctgtctgcatagttaatgccttcggctgccactctgtaggccagccagactggtaggtctcctcttctcattaggtccacaaaggttttcctcgcttctccatatcagcagccagggcct

SEQ ID NO: 373257 - DNA, 140 bp, Artificial Sequence
  Synthetic
atacgccatgctgggtctcctttagacaaaggatggccaatatcgaaaatggacctaggcgtaccgctactggcactgggctgctattcacaagtgaacccactgactctcacagcggcacgtacttgggagtcggccat

SEQ ID NO: 373258 - DNA, 140 bp, Artificial Sequence
  Synthetic
atggccgactcccaagtacgtgccgctgtgagagtcagtgggttcacttgtgaatagcagcccagtgccagtagcggtacgcctaggtccattttcgatattggccatcctttgtctaaaggagacccagcatggcgtat

SEQ ID NO: 373259 - DNA, 140 bp, Artificial Sequence
  Synthetic
aggccctggctgctgatatgttgacaagggatggccaatatcgaagatggacataggagttccacttctcgccttagggtgctattcccaggtgaacccattgacactgacagcggcggtgaccttttgggacagcggtg

SEQ ID NO: 373260 - DNA, 140 bp, Artificial Sequence
  Synthetic
caccgctgtcccaaaaggtcaccgccgctgtcagtgtcaatgggttcacctgggaatagcaccctaaggcgagaagtggaactcctatgtccatcttcgatattggccatcccttgtcaacatatcagcagccagggcct

SEQ ID NO: 373261 - DNA, 140 bp, Artificial Sequence
  Synthetic
aggccctggctgctgatatggccttagggtgctattcccaggtgaacccattgacactgacagcggcggtgttgatgttagtggctcattatgccataattggaccaggactgcaagcaagaccttttgggacagcggtg

SEQ ID NO: 373262 - DNA, 140 bp, Artificial Sequence
  Synthetic
caccgctgtcccaaaaggtcttgcttgcagtcctggtccaattatggcataatgagccactaacatcaacaccgccgctgtcagtgtcaatgggttcacctgggaatagcaccctaaggccatatcagcagccagggcct

SEQ ID NO: 373263 - DNA, 140 bp, Artificial Sequence
  Synthetic
aggccctggctgctgatatggctgagatggaagaagcattgaaaggactcccaataaggtatcaaacaactgcaacaaaatctgaacacacaggaagggagattgttgtgctcatgtgccgaccttttgggacagcggtg

SEQ ID NO: 373264 - DNA, 140 bp, Artificial Sequence
  Synthetic
caccgctgtcccaaaaggtcggcacatgagcacaacaatctcccttcctgtgtgttcagattttgttgcagttgtttgataccttattgggagtcctttcaatgcttcttccatctcagccatatcagcagccagggcct

SEQ ID NO: 373265 - DNA, 140 bp, Artificial Sequence
  Synthetic
aggccctggctgctgatatgtgggacacaagaatcactgaagatgaccttctgaatgaagagctgatcacggaacagatggcccctcatcataaaatccttgctaaagccattttcaaacgaccttttgggacagcggtg

SEQ ID NO: 373266 - DNA, 140 bp, Artificial Sequence
  Synthetic
caccgctgtcccaaaaggtcgtttgaaaatggctttagcaaggattttatgatgaggggccatctgttccgtgatcagctcttcattcagaaggtcatcttcagtgattcttgtgtcccacatatcagcagccagggcct

SEQ ID NO: 373267 - DNA, 140 bp, Artificial Sequence
  Synthetic
aggccctggctgctgatatgttcaaagagaaagtggacacgagaactcaagaaccgaaggaaggcacaaagaaactgatgaaaattacggcagagtggctttggaaagaactaggaaagggaccttttgggacagcggtg

SEQ ID NO: 373268 - DNA, 140 bp, Artificial Sequence
  Synthetic
caccgctgtcccaaaaggtccctttcctagttctttccaaagccactctgccgtaattttcatcagtttctttgtgccttccttcggttcttgagttctcgtgtccactttctctttgaacatatcagcagccagggcct

SEQ ID NO: 373269 - DNA, 140 bp, Artificial Sequence
  Synthetic
aggccctggctgctgatatgaaagaaaacatggaggaatgttagtgcgaaatccactctcaagaaattccactcatgaaatgtactgggtttcatgtggaacaggaaacattgtgtcagcgaccttttgggacagcggtg

SEQ ID NO: 373270 - DNA, 140 bp, Artificial Sequence
  Synthetic
caccgctgtcccaaaaggtcgctgacacaatgtttcctgttccacatgaaacccagtacatttcatgagtggaatttcttgagagtggatttcgcactaacattcctccatgttttctttcatatcagcagccagggcct

SEQ ID NO: 373271 - DNA, 140 bp, Artificial Sequence
  Synthetic
atacgccatgctgggtctcctaacttatcaaaacaaagtggtaaaagtcctcagacccacaccgaaaggagcagtgatggacattatatccaggaaagatcaaagaggtagtggacaggtcgtacttgggagtcggccat

SEQ ID NO: 373272 - DNA, 140 bp, Artificial Sequence
  Synthetic
atggccgactcccaagtacgacctgtccactacctctttgatctttcctggatataatgtccatcactgctcctttcggtgtgggtctgaggacttttaccactttgttttgataagttaggagacccagcatggcgtat

SEQ ID NO: 373273 - DNA, 140 bp, Artificial Sequence
  Synthetic
atacgccatgctgggtctccacagaggagaaccaatgggatagtgcgagagctgctgttgaggacgaggaattctggaaacttgtggacagagaacgtgaactccacaaattgggcaagtcgtacttgggagtcggccat

SEQ ID NO: 373274 - DNA, 140 bp, Artificial Sequence
  Synthetic
atggccgactcccaagtacgacttgcccaatttgtggagttcacgttctctgtccacaagtttccagaattcctcgtcctcaacagcagctctcgcactatcccattggttctcctctgtggagacccagcatggcgtat

SEQ ID NO: 373275 - DNA, 140 bp, Artificial Sequence
  Synthetic
aggccctggctgctgatatgattctggaaacttgtggacagagaacgtgaactccacaaattgggcaagtgtggaagctgtgtctacaacatgatgggcaagagagagaagaaacttggagaccttttgggacagcggtg

SEQ ID NO: 373276 - DNA, 140 bp, Artificial Sequence
  Synthetic
caccgctgtcccaaaaggtctccaagtttcttctctctcttgcccatcatgttgtagacacagcttccacacttgcccaatttgtggagttcacgttctctgtccacaagtttccagaatcatatcagcagccagggcct

SEQ ID NO: 373277 - DNA, 140 bp, Artificial Sequence
  Synthetic
aggccctggctgctgatatgagccaggtaccttgagttcgaagcactcggatttttaaatgaagaccactggttctcgcgtgaaaactcttacagtggagtagaaggagaaggactgcacgaccttttgggacagcggtg

SEQ ID NO: 373278 - DNA, 140 bp, Artificial Sequence
  Synthetic
caccgctgtcccaaaaggtcgtgcagtccttctccttctactccactgtaagagttttcacgcgagaaccagtggtcttcatttaaaaatccgagtgcttcgaactcaaggtacctggctcatatcagcagccagggcct

SEQ ID NO: 373279 - DNA, 140 bp, Artificial Sequence
  Synthetic
aggccctggctgctgatatggtatgctgatgacacagccggttgggacacaagaataacagaagatgacctgcacaatgaggaaaaaatcacacagcaaatggaccctgaacacagacaagaccttttgggacagcggtg

SEQ ID NO: 373280 - DNA, 140 bp, Artificial Sequence
  Synthetic
caccgctgtcccaaaaggtcttgtctgtgttcagggtccatttgctgtgtgattttttcctcattgtgcaggtcatcttctgttattcttgtgtcccaaccggctgtgtcatcagcataccatatcagcagccagggcct

SEQ ID NO: 373281 - DNA, 140 bp, Artificial Sequence
  Synthetic
aggccctggctgctgatatgtgtgctaagttcaagtgtgtgacaaaattggaaggaaaaatagttcaatatgaaaacttgaaatattcagtaattgtcaccgtccacactggagaccagcgaccttttgggacagcggtg

SEQ ID NO: 373282 - DNA, 140 bp, Artificial Sequence
  Synthetic
caccgctgtcccaaaaggtcgctggtctccagtgtggacggtgacaattactgaatatttcaagttttcatattgaactatttttccttccaattttgtcacacacttgaacttagcacacatatcagcagccagggcct

SEQ ID NO: 373283 - DNA, 140 bp, Artificial Sequence
  Synthetic
atacgccatgctgggtctccggagccttaaagaaactgcatgtctagggaaagcctacgctcaaatgtggagtctcatgtattttcacagaagagatcttagactagcatctaacgccatcgtacttgggagtcggccat

SEQ ID NO: 373284 - DNA, 140 bp, Artificial Sequence
  Synthetic
atggccgactcccaagtacgatggcgttagatgctagtctaagatctcttctgtgaaaatacatgagactccacatttgagcgtaggctttccctagacatgcagtttctttaaggctccggagacccagcatggcgtat

SEQ ID NO: 373285 - DNA, 140 bp, Artificial Sequence
  Synthetic
aggccctggctgctgatatgagtctcatgtattttcacagaagagatcttagactagcatctaacgccatttgttcagcagtaccagtccattgggtccccacaagcagaacgacatggtgaccttttgggacagcggtg

SEQ ID NO: 373286 - DNA, 140 bp, Artificial Sequence
  Synthetic
caccgctgtcccaaaaggtcaccatgtcgttctgcttgtggggacccaatggactggtactgctgaacaaatggcgttagatgctagtctaagatctcttctgtgaaaatacatgagactcatatcagcagccagggcct

SEQ ID NO: 373287 - DNA, 140 bp, Artificial Sequence
  Synthetic
atacgccatgctgggtctcctagatggggaactttcaagaagtcgggggctattaaggtcctgagaggcttcaagaaggagatctcaaatatgctgagcattatcaacagacggaaaaggcgtacttgggagtcggccat

SEQ ID NO: 373288 - DNA, 140 bp, Artificial Sequence
  Synthetic
atggccgactcccaagtacgccttttccgtctgttgataatgctcagcatatttgagatctccttcttgaagcctctcaggaccttaatagcccccgacttcttgaaagttccccatctaggagacccagcatggcgtat

SEQ ID NO: 373289 - DNA, 140 bp, Artificial Sequence
  Synthetic
atacgccatgctgggtctcctgaagactatggttttggagtttttaccaccaatatatggctaaaattgagagaaaaacaggatgtattttgtgactcaaaactcatgtcagcggccattcgtacttgggagtcggccat

SEQ ID NO: 373290 - DNA, 140 bp, Artificial Sequence
  Synthetic
atggccgactcccaagtacgaatggccgctgacatgagttttgagtcacaaaatacatcctgtttttctctcaattttagccatatattggtggtaaaaactccaaaaccatagtcttcaggagacccagcatggcgtat

SEQ ID NO: 373291 - DNA, 140 bp, Artificial Sequence
  Synthetic
atacgccatgctgggtctccatagccatggatttgggagaaatgtgtgatgatacgatcacttacaaatgccccctcattactgaagtggagcctgaagacattgactgctggtgcaacccgtacttgggagtcggccat

SEQ ID NO: 373292 - DNA, 140 bp, Artificial Sequence
  Synthetic
atggccgactcccaagtacgggttgcaccagcagtcaatgtcttcaggctccacttcagtaatgagggggcatttgtaagtgatcgtatcatcacacatttctcccaaatccatggctatggagacccagcatggcgtat

SEQ ID NO: 373293 - DNA, 140 bp, Artificial Sequence
  Synthetic
aggccctggctgctgatatgccccctcattactgaagtggagcctgaagacattgactgctggtgcaacctcacatcggcgtgggtgacctacggaacgtgcaaccaagctggagagcatgaccttttgggacagcggtg

SEQ ID NO: 373294 - DNA, 140 bp, Artificial Sequence
  Synthetic
caccgctgtcccaaaaggtcatgctctccagcttggttgcacgttccgtaggtcacccacgccgatgtgaggttgcaccagcagtcaatgtcttcaggctccacttcagtaatgagggggcatatcagcagccagggcct

SEQ ID NO: 373295 - DNA, 140 bp, Artificial Sequence
  Synthetic
aggccctggctgctgatatgtcgagaaggtagagacatgggcctttaggcacccagggttcacaatactagctctatttcttgcccattacataggcacttccttgacccagaaagtggtgaccttttgggacagcggtg

SEQ ID NO: 373296 - DNA, 140 bp, Artificial Sequence
  Synthetic
caccgctgtcccaaaaggtcaccactttctgggtcaaggaagtgcctatgtaatgggcaagaaatagagctagtattgtgaaccctgggtgcctaaaggcccatgtctctaccttctcgacatatcagcagccagggcct

SEQ ID NO: 373297 - DNA, 140 bp, Artificial Sequence
  Synthetic
aggccctggctgctgatatgtggaacatttgggaagttgaggactatgggtttggaattttcacgacaaacatatggttgaaattgcgtgactcctacacccaaatgtgtgaccaccggcgaccttttgggacagcggtg

SEQ ID NO: 373298 - DNA, 140 bp, Artificial Sequence
  Synthetic
caccgctgtcccaaaaggtcgccggtggtcacacatttgggtgtaggagtcacgcaatttcaaccatatgtttgtcgtgaaaattccaaacccatagtcctcaacttcccaaatgttccacatatcagcagccagggcct

SEQ ID NO: 373299 - DNA, 140 bp, Artificial Sequence
  Synthetic
atacgccatgctgggtctcccaaccctaaggaaactatgtattgagggaaaaatcaccaatgtgacaaccgactcaaggtgccccacccaaggggaagcgactctacctgaggagcaggacgtacttgggagtcggccat

SEQ ID NO: 373300 - DNA, 140 bp, Artificial Sequence
  Synthetic
atggccgactcccaagtacgtcctgctcctcaggtagagtcgcttccccttgggtggggcaccttgagtcggttgtcacattggtgatttttccctcaatacatagtttccttagggttgggagacccagcatggcgtat

SEQ ID NO: 373301 - DNA, 140 bp, Artificial Sequence
  Synthetic
aggccctggctgctgatatggactcaaggtgccccacccaaggggaagcgactctacctgaggagcaggaccagaactacgtgtgtaagcacacatacgtggacagaggctggggaaatggaccttttgggacagcggtg

SEQ ID NO: 373302 - DNA, 140 bp, Artificial Sequence
  Synthetic
caccgctgtcccaaaaggtccatttccccagcctctgtccacgtatgtgtgcttacacacgtagttctggtcctgctcctcaggtagagtcgcttccccttgggtggggcaccttgagtccatatcagcagccagggcct

SEQ ID NO: 373303 - DNA, 140 bp, Artificial Sequence
  Synthetic
atacgccatgctgggtctcctttgaaatgtagactaaagatggacaaactgactctaaaagggatgtcatatgtgatgtgcacaggctcattcaagctagagaaagaagtggctgagacccgtacttgggagtcggccat

SEQ ID NO: 373304 - DNA, 140 bp, Artificial Sequence
  Synthetic
atggccgactcccaagtacgggtctcagccacttctttctctagcttgaatgagcctgtgcacatcacatatgacatcccttttagagtcagtttgtccatctttagtctacatttcaaaggagacccagcatggcgtat

SEQ ID NO: 373305 - DNA, 140 bp, Artificial Sequence
  Synthetic
atacgccatgctgggtctccgttgtggtttgtttggcaagggaagcttggtaacatgcgcaaaattccaatgtttggaattaatagagggaaaagtggtgcagcacgagaacctcaaatacgtacttgggagtcggccat

SEQ ID NO: 373306 - DNA, 140 bp, Artificial Sequence
  Synthetic
atggccgactcccaagtacgtatttgaggttctcgtgctgcaccacttttccctctattaattccaaacattggaattttgcgcatgttaccaagcttcccttgccaaacaaaccacaacggagacccagcatggcgtat

SEQ ID NO: 373307 - DNA, 140 bp, Artificial Sequence
  Synthetic
atacgccatgctgggtctcctaccgtcatcatcacagtgcacacaggagaccaacaccaggtgggaaatgaaacgcagggagtcacggctgagataacaccccaggcatcaaccgtcgaacgtacttgggagtcggccat

SEQ ID NO: 373308 - DNA, 140 bp, Artificial Sequence
  Synthetic
atggccgactcccaagtacgttcgacggttgatgcctggggtgttatctcagccgtgactccctgcgtttcatttcccacctggtgttggtctcctgtgtgcactgtgatgatgacggtaggagacccagcatggcgtat

SEQ ID NO: 373309 - DNA, 140 bp, Artificial Sequence
  Synthetic
atacgccatgctgggtctccgccatcttacctgaatatggaacccttgggctagaatgctcaccacggacaggtttggatttcaatgaaatgatcttgttgacaatgaagaacaaagcatcgtacttgggagtcggccat

SEQ ID NO: 373310 - DNA, 140 bp, Artificial Sequence
  Synthetic
atggccgactcccaagtacgatgctttgttcttcattgtcaacaagatcatttcattgaaatccaaacctgtccgtggtgagcattctagcccaagggttccatattcaggtaagatggcggagacccagcatggcgtat

SEQ ID NO: 373311 - DNA, 140 bp, Artificial Sequence
  Synthetic
aggccctggctgctgatatgatgggtcttgggaaaggatggccattgtcaaaaatggacattggagttcctcttctcgccattgggtgctattcacaagtcaaccccataactctcacaggaccttttgggacagcggtg

SEQ ID NO: 373312 - DNA, 140 bp, Artificial Sequence
  Synthetic
caccgctgtcccaaaaggtcctgtgagagttatggggttgacttgtgaatagcacccaatggcgagaagaggaactccaatgtccatttttgacaatggccatcctttcccaagacccatcatatcagcagccagggcct

SEQ ID NO: 373313 - DNA, 140 bp, Artificial Sequence
  Synthetic
atacgccatgctgggtctccggggctacaacagaaacaccaacttggaataagaaagagcttcttgtgacattcaaaaacgcacacgcaaaaaaacaagaagtagttgtccttggatcgccgtacttgggagtcggccat

SEQ ID NO: 373314 - DNA, 140 bp, Artificial Sequence
  Synthetic
atggccgactcccaagtacggcgatccaaggacaactacttcttgtttttttgcgtgtgcgtttttgaatgtcacaagaagctctttcttattccaagttggtgtttctgttgtagccccggagacccagcatggcgtat

SEQ ID NO: 373315 - DNA, 140 bp, Artificial Sequence
  Synthetic
aggccctggctgctgatatgattcaaaaacgcacacgcaaaaaaacaagaagtagttgtccttggatcgcaagagggagcaatgcacacagcactgacaggagctacagagatccaaaccgaccttttgggacagcggtg

SEQ ID NO: 373316 - DNA, 140 bp, Artificial Sequence
  Synthetic
caccgctgtcccaaaaggtcggtttggatctctgtagctcctgtcagtgctgtgtgcattgctccctcttgcgatccaaggacaactacttcttgtttttttgcgtgtgcgtttttgaatcatatcagcagccagggcct

SEQ ID NO: 373317 - DNA, 140 bp, Artificial Sequence
  Synthetic
atacgccatgctgggtctcctcagggggcacaagtatttttgcggggcacttgaaatgcagactcaagatggacaaattggaactcaaggggatgagctatgcaatgtgctcaaatgcctcgtacttgggagtcggccat

SEQ ID NO: 373318 - DNA, 140 bp, Artificial Sequence
  Synthetic
atggccgactcccaagtacgaggcatttgagcacattgcatagctcatccccttgagttccaatttgtccatcttgagtctgcatttcaagtgccccgcaaaaatacttgtgccccctgaggagacccagcatggcgtat

SEQ ID NO: 373319 - DNA, 140 bp, Artificial Sequence
  Synthetic
aggccctggctgctgatatgggaggatggacaagggaaagcccacaatggcagactgatcacagctaacccagtggtgaccaagaaggaggaacctgtcaatattgaggcagaacctcctgaccttttgggacagcggtg

SEQ ID NO: 373320 - DNA, 140 bp, Artificial Sequence
  Synthetic
caccgctgtcccaaaaggtcaggaggttctgcctcaatattgacaggttcctccttcttggtcaccactgggttagctgtgatcagtctgccattgtgggctttcccttgtccatcctcccatatcagcagccagggcct

SEQ ID NO: 373321 - DNA, 140 bp, Artificial Sequence
  Synthetic
aggccctggctgctgatatggtctagtggcatctgtggagttaccaaattccttggaggagctgggggatggacttgcaatgggcattatgattttaaaattattgactgactttcaatcgaccttttgggacagcggtg

SEQ ID NO: 373322 - DNA, 140 bp, Artificial Sequence
  Synthetic
caccgctgtcccaaaaggtcgattgaaagtcagtcaataattttaaaatcataatgcccattgcaagtccatcccccagctcctccaaggaatttggtaactccacagatgccactagaccatatcagcagccagggcct

SEQ ID NO: 373323 - DNA, 140 bp, Artificial Sequence
  Synthetic
  misc_feature (110)..(110): n is a, c, g, or t
atacgccatgctgggtctcctttggggaaagtaacataataattggaattggagacaaagccttgaaaatcaattggtacaagaagggaagctcgattgggaagatgttngaggccactgcgtacttgggagtcggccat

SEQ ID NO: 373324 - DNA, 140 bp, Artificial Sequence
  Synthetic
  misc_feature (31)..(31): n is a, c, g, or t
atggccgactcccaagtacgcagtggcctcnaacatcttcccaatcgagcttcccttcttgtaccaattgattttcaaggctttgtctccaattccaattattatgttactttccccaaaggagacccagcatggcgtat

SEQ ID NO: 373325 - DNA, 140 bp, Artificial Sequence
  Synthetic
atacgccatgctgggtctcccagcccttcttttattggtagcacattatgccatcatagggccaggactccaagcgaaagcaaccagagaagcgcagaaaagagcagcagcaggcatcatcgtacttgggagtcggccat

SEQ ID NO: 373326 - DNA, 140 bp, Artificial Sequence
  Synthetic
atggccgactcccaagtacgatgatgcctgctgctgctcttttctgcgcttctctggttgctttcgcttggagtcctggccctatgatggcataatgtgctaccaataaaagaagggctgggagacccagcatggcgtat

SEQ ID NO: 373327 - DNA, 140 bp, Artificial Sequence
  Synthetic
atacgccatgctgggtctccccagaggggcaaggcgcatggctatcttgggagacacagcctgggactttggatcagtaggtggtgttttaaattcactagggaaaatggtgcaccagatcgtacttgggagtcggccat

SEQ ID NO: 373328 - DNA, 140 bp, Artificial Sequence
  Synthetic
atggccgactcccaagtacgatctggtgcaccattttccctagtgaatttaaaacaccacctactgatccaaagtcccaggctgtgtctcccaagatagccatgcgccttgcccctctggggagacccagcatggcgtat

SEQ ID NO: 373329 - DNA, 140 bp, Artificial Sequence
  Synthetic
aggccctggctgctgatatgggatcagtaggtggtgttttaaattcactagggaaaatggtgcaccagatatttggaagtgcttacacggccctttttagtggagtctcctggataatgagaccttttgggacagcggtg

SEQ ID NO: 373330 - DNA, 140 bp, Artificial Sequence
  Synthetic
caccgctgtcccaaaaggtctcattatccaggagactccactaaaaagggccgtgtaagcacttccaaatatctggtgcaccattttccctagtgaatttaaaacaccacctactgatcccatatcagcagccagggcct

SEQ ID NO: 373331 - DNA, 140 bp, Artificial Sequence
  Synthetic
aggccctggctgctgatatggaggtctcctgggaagaagaagcagaacactctggtgcctcacacaacatactagtggaggtccaagatgatggaaccatgaagataaaggatgaagagagaccttttgggacagcggtg

SEQ ID NO: 373332 - DNA, 140 bp, Artificial Sequence
  Synthetic
caccgctgtcccaaaaggtctctcttcatcctttatcttcatggttccatcatcttggacctccactagtatgttgtgtgaggcaccagagtgttctgcttcttcttcccaggagacctccatatcagcagccagggcct

SEQ ID NO: 373333 - DNA, 140 bp, Artificial Sequence
  Synthetic
atacgccatgctgggtctccagccattgcaggcgcctgggagaatggagtgtgcggaatcaggtcgacaaccagaatggagaacctcttgtggaagcaaatagccaatgaactaaactaccgtacttgggagtcggccat

SEQ ID NO: 373334 - DNA, 140 bp, Artificial Sequence
  Synthetic
atggccgactcccaagtacggtagtttagttcattggctatttgcttccacaagaggttctccattctggttgtcgacctgattccgcacactccattctcccaggcgcctgcaatggctggagacccagcatggcgtat

SEQ ID NO: 373335 - DNA, 140 bp, Artificial Sequence
  Synthetic
aggccctggctgctgatatgccagaatggagaacctcttgtggaagcaaatagccaatgaactaaactacatattatgggaaaacaacatcaaattaacggtagttgtgggtgatataatgaccttttgggacagcggtg

SEQ ID NO: 373336 - DNA, 140 bp, Artificial Sequence
  Synthetic
caccgctgtcccaaaaggtcattatatcacccacaactaccgttaatttgatgttgttttcccataatatgtagtttagttcattggctatttgcttccacaagaggttctccattctggcatatcagcagccagggcct

SEQ ID NO: 373337 - DNA, 140 bp, Artificial Sequence
  Synthetic
atacgccatgctgggtctccaaatgcctcaagagcatggaatgtgtgggaggtggaagattatggcttcggagtcttcacaaccaatatatggctgaaactccgagaaatgtacacccaacgtacttgggagtcggccat

SEQ ID NO: 373338 - DNA, 140 bp, Artificial Sequence
  Synthetic
atggccgactcccaagtacgttgggtgtacatttctcggagtttcagccatatattggttgtgaagactccgaagccataatcttccacctcccacacattccatgctcttgaggcatttggagacccagcatggcgtat

SEQ ID NO: 373339 - DNA, 140 bp, Artificial Sequence
  Synthetic
aggccctggctgctgatatggagtcttcacaaccaatatatggctgaaactccgagaaatgtacacccaactatgtgaccacaggctaatgtcggcagccgttaaggatgagagagccgtgaccttttgggacagcggtg

SEQ ID NO: 373340 - DNA, 140 bp, Artificial Sequence
  Synthetic
caccgctgtcccaaaaggtcacggctctctcatccttaacggctgccgacattagcctgtggtcacatagttgggtgtacatttctcggagtttcagccatatattggttgtgaagactccatatcagcagccagggcct

SEQ ID NO: 373341 - DNA, 140 bp, Artificial Sequence
  Synthetic
atacgccatgctgggtctccacacgccgacatgggctattggatagaaagccaaaagaatggtagttggaagctagaaaaggcatctctcatagaggtaaaaacctgcacatggccaaaacgtacttgggagtcggccat

SEQ ID NO: 373342 - DNA, 140 bp, Artificial Sequence
  Synthetic
atggccgactcccaagtacgttttggccatgtgcaggtttttacctctatgagagatgccttttctagcttccaactaccattcttttggctttctatccaatagcccatgtcggcgtgtggagacccagcatggcgtat

SEQ ID NO: 373343 - DNA, 140 bp, Artificial Sequence
  Synthetic
atacgccatgctgggtctcctcacacactctctggagcaatggtgtgttggagagtgacatgatcatcccaaagagtctggctggacctatctcgcaacacaattacaggcctggatacccgtacttgggagtcggccat

SEQ ID NO: 373344 - DNA, 140 bp, Artificial Sequence
  Synthetic
atggccgactcccaagtacgggtatccaggcctgtaattgtgttgcgagataggtccagccagactctttgggatgatcatgtcactctccaacacaccattgctccagagagtgtgtgaggagacccagcatggcgtat

SEQ ID NO: 373345 - DNA, 140 bp, Artificial Sequence
  Synthetic
aggccctggctgctgatatgggaaaatgtttgaggcaactgccagaggagcacgaaggatggctatactgggagacaccgcatgggactttggttctataggaggagtgttcacgtctgtgaccttttgggacagcggtg

SEQ ID NO: 373346 - DNA, 140 bp, Artificial Sequence
  Synthetic
caccgctgtcccaaaaggtcacagacgtgaacactcctcctatagaaccaaagtcccatgcggtgtctcccagtatagccatccttcgtgctcctctggcagttgcctcaaacattttcccatatcagcagccagggcct

SEQ ID NO: 373347 - DNA, 140 bp, Artificial Sequence
  Synthetic
atacgccatgctgggtctccggctgctggtatggcatggaaattagacccattaatgagaaagaagagaacatggtaaaatctttagtctcagcagggagtggaaaggtggataacttcacgtacttgggagtcggccat

SEQ ID NO: 373348 - DNA, 140 bp, Artificial Sequence
  Synthetic
atggccgactcccaagtacgtgaagttatccacctttccactccctgctgagactaaagattttaccatgttctcttctttctcattaatgggtctaatttccatgccataccagcagccggagacccagcatggcgtat

SEQ ID NO: 373349 - DNA, 140 bp, Artificial Sequence
  Synthetic
aggccctggctgctgatatgcatggtaaaatctttagtctcagcagggagtggaaaggtggataacttcacaatgggtgtcttgtgtcttgcaatcctctttgaagagataatgagaggagaccttttgggacagcggtg

SEQ ID NO: 373350 - DNA, 140 bp, Artificial Sequence
  Synthetic
caccgctgtcccaaaaggtctcctctcattatctcttcaaagaggattgcaagacacaagacacccattgtgaagttatccacctttccactccctgctgagactaaagattttaccatgcatatcagcagccagggcct

SEQ ID NO: 373351 - DNA, 140 bp, Artificial Sequence
  Synthetic
atacgccatgctgggtctccaaattcgggaaaaagcacatgattgcaggggttctcttcacatttgtgctccttctctcagggcaaataacatggagagacatggcgcgcacactcataacgtacttgggagtcggccat

SEQ ID NO: 373352 - DNA, 140 bp, Artificial Sequence
  Synthetic
atggccgactcccaagtacgttatgagtgtgcgcgccatgtctctccatgttatttgccctgagagaaggagcacaaatgtgaagagaacccctgcaatcatgtgctttttcccgaatttggagacccagcatggcgtat

SEQ ID NO: 373353 - DNA, 140 bp, Artificial Sequence
  Synthetic
aggccctggctgctgatatgccttctctcagggcaaataacatggagagacatggcgcgcacactcataatgattggatccaacgcctctgacagaatgggaatgggcgtcacttacctggaccttttgggacagcggtg

SEQ ID NO: 373354 - DNA, 140 bp, Artificial Sequence
  Synthetic
caccgctgtcccaaaaggtccaggtaagtgacgcccattcccattctgtcagaggcgttggatccaatcattatgagtgtgcgcgccatgtctctccatgttatttgccctgagagaaggcatatcagcagccagggcct

SEQ ID NO: 373355 - DNA, 140 bp, Artificial Sequence
  Synthetic
atacgccatgctgggtctccgcattaattgcaacttttaaaattcagccatttttggctttgggattcttcctgaggaaactgacatctagagaaaatttattattaggagttgggttggcgtacttgggagtcggccat

SEQ ID NO: 373356 - DNA, 140 bp, Artificial Sequence
  Synthetic
atggccgactcccaagtacgccaacccaactcctaataataaattttctctagatgtcagtttcctcaggaagaatcccaaagccaaaaatggctgaattttaaaagttgcaattaatgcggagacccagcatggcgtat

SEQ ID NO: 373357 - DNA, 140 bp, Artificial Sequence
  Synthetic
aggccctggctgctgatatgcctgaggaaactgacatctagagaaaatttattattaggagttgggttggccatggcaacaacgttgcaactgccagaggacattgaacaaatggcgaatgaccttttgggacagcggtg

SEQ ID NO: 373358 - DNA, 140 bp, Artificial Sequence
  Synthetic
caccgctgtcccaaaaggtcattcgccatttgttcaatgtcctctggcagttgcaacgttgttgccatggccaacccaactcctaataataaattttctctagatgtcagtttcctcaggcatatcagcagccagggcct

SEQ ID NO: 373359 - DNA, 140 bp, Artificial Sequence
  Synthetic
atacgccatgctgggtctccggaatagccttggggcttatggctctcaaattgataacacaatttgaaacataccaactatgggcggcattagtctccctaatgtgttcaaacacaatttcgtacttgggagtcggccat

SEQ ID NO: 373360 - DNA, 140 bp, Artificial Sequence
  Synthetic
atggccgactcccaagtacgaaattgtgtttgaacacattagggagactaatgccgcccatagttggtatgtttcaaattgtgttatcaatttgagagccataagccccaaggctattccggagacccagcatggcgtat

SEQ ID NO: 373361 - DNA, 140 bp, Artificial Sequence
  Synthetic
aggccctggctgctgatatgataccaactatgggcggcattagtctccctaatgtgttcaaacacaattttcacgttgactgttgcctggagaacagccaccctgatcttggccggaattgaccttttgggacagcggtg

SEQ ID NO: 373362 - DNA, 140 bp, Artificial Sequence
  Synthetic
caccgctgtcccaaaaggtcaattccggccaagatcagggtggctgttctccaggcaacagtcaacgtgaaaattgtgtttgaacacattagggagactaatgccgcccatagttggtatcatatcagcagccagggcct

SEQ ID NO: 373363 - DNA, 140 bp, Artificial Sequence
  Synthetic
atacgccatgctgggtctcctcgcttttgccagtgtgccagtcttcgagcatgaggaaaacagattggctcccaatgactgtggtagctatgggagttccgcctctaccactttttatttcgtacttgggagtcggccat

SEQ ID NO: 373364 - DNA, 140 bp, Artificial Sequence
  Synthetic
atggccgactcccaagtacgaaataaaaagtggtagaggcggaactcccatagctaccacagtcattgggagccaatctgttttcctcatgctcgaagactggcacactggcaaaagcgaggagacccagcatggcgtat

SEQ ID NO: 373365 - DNA, 140 bp, Artificial Sequence
  Synthetic
aggccctggctgctgatatgcccaatgactgtggtagctatgggagttccgcctctaccactttttattttcagtttgaaagacacactcaaaaggagaagctggccactgaatgagggagaccttttgggacagcggtg

SEQ ID NO: 373366 - DNA, 140 bp, Artificial Sequence
  Synthetic
caccgctgtcccaaaaggtctccctcattcagtggccagcttctccttttgagtgtgtctttcaaactgaaaataaaaagtggtagaggcggaactcccatagctaccacagtcattgggcatatcagcagccagggcct

SEQ ID NO: 373367 - DNA, 140 bp, Artificial Sequence
  Synthetic
atacgccatgctgggtctccacagcggcggtattgatgctagtggctcattacgccataattggacctggactgcaagcaaaagctactagagaagctcaaaaaaggacagcggccggaacgtacttgggagtcggccat

SEQ ID NO: 373368 - DNA, 140 bp, Artificial Sequence
  Synthetic
atggccgactcccaagtacgttccggccgctgtccttttttgagcttctctagtagcttttgcttgcagtccaggtccaattatggcgtaatgagccactagcatcaataccgccgctgtggagacccagcatggcgtat

SEQ ID NO: 373369 - DNA, 140 bp, Artificial Sequence
  Synthetic
atacgccatgctgggtctccgtgatggccgttggacttgtgagcattctagcaagttctctccttaggaatgacgtacccatggctggaccattagtggctgggggcttgctgatagcgtcgtacttgggagtcggccat

SEQ ID NO: 373370 - DNA, 140 bp, Artificial Sequence
  Synthetic
atggccgactcccaagtacgacgctatcagcaagcccccagccactaatggtccagccatgggtacgtcattcctaaggagagaacttgctagaatgctcacaagtccaacggccatcacggagacccagcatggcgtat

SEQ ID NO: 373371 - DNA, 140 bp, Artificial Sequence
  Synthetic
aggccctggctgctgatatgagaggaagttacttggctggagctggacttctcttttccatcatgaagaacacaaccaacacaagaaggggaactggcaacacaggagagacgcttggaggaccttttgggacagcggtg

SEQ ID NO: 373372 - DNA, 140 bp, Artificial Sequence
  Synthetic
caccgctgtcccaaaaggtcctccaagcgtctctcctgtgttgccagttccccttcttgtgttggttgtgttcttcatgatggaaaagagaagtccagctccagccaagtaacttcctctcatatcagcagccagggcct

SEQ ID NO: 373373 - DNA, 140 bp, Artificial Sequence
  Synthetic
atacgccatgctgggtctccctgagaacatcttaacagtgcttttgaaaacagcattactaatagtgtcaggcatttttccatactccatacctgcaacacttttggtctggcacacttgcgtacttgggagtcggccat

SEQ ID NO: 373374 - DNA, 140 bp, Artificial Sequence
  Synthetic
atggccgactcccaagtacgcaagtgtgccagaccaaaagtgttgcaggtatggagtatggaaaaatgcctgacactattagtaatgctgttttcaaaagcactgttaagatgttctcagggagacccagcatggcgtat

SEQ ID NO: 373375 - DNA, 140 bp, Artificial Sequence
  Synthetic
atacgccatgctgggtctccagttttccacaccatgtggcatgtcacaagaggagcagtgttgacacacaatggaaaaagactggaaccaaactgggctagcgtgaaaaaagatctgattcgtacttgggagtcggccat

SEQ ID NO: 373376 - DNA, 140 bp, Artificial Sequence
  Synthetic
atggccgactcccaagtacgaatcagatcttttttcacgctagcccagtttggttccagtctttttccattgtgtgtcaacactgctcctcttgtgacatgccacatggtgtggaaaactggagacccagcatggcgtat

SEQ ID NO: 373377 - DNA, 140 bp, Artificial Sequence
  Synthetic
atacgccatgctgggtctccggtgcaggttattgccgtagagcctgggaagaacccaaagaactttcaaaccgtgccaggcattttccagacaacaacaggggagataggagcgattgcacgtacttgggagtcggccat

SEQ ID NO: 373378 - DNA, 140 bp, Artificial Sequence
  Synthetic
atggccgactcccaagtacgtgcaatcgctcctatctcccctgttgttgtctggaaaatgcctggcacggtttgaaagttctttgggttcttcccaggctctacggcaataacctgcaccggagacccagcatggcgtat

SEQ ID NO: 373379 - DNA, 140 bp, Artificial Sequence
  Synthetic
aggccctggctgctgatatgccgtgccaggcattttccagacaacaacaggggagataggagcgattgcactggacttcaagcctggaacttcaggatctcccatcataaacagagaggggaccttttgggacagcggtg

SEQ ID NO: 373380 - DNA, 140 bp, Artificial Sequence
  Synthetic
caccgctgtcccaaaaggtcccctctctgtttatgatgggagatcctgaagttccaggcttgaagtccagtgcaatcgctcctatctcccctgttgttgtctggaaaatgcctggcacggcatatcagcagccagggcct

SEQ ID NO: 373381 - DNA, 140 bp, Artificial Sequence
  Synthetic
atacgccatgctgggtctccaaaggtagtgggactatatggcaatggagtggtcacaaagaatggtggctatgtcagtggaatagctcaaacaaacgcagaaccagacggaccgacaccacgtacttgggagtcggccat

SEQ ID NO: 373382 - DNA, 140 bp, Artificial Sequence
  Synthetic
atggccgactcccaagtacgtggtgtcggtccgtctggttctgcgtttgtttgagctattccactgacatagccaccattctttgtgaccactccattgccatatagtcccactacctttggagacccagcatggcgtat

SEQ ID NO: 373383 - DNA, 140 bp, Artificial Sequence
  Synthetic
aggccctggctgctgatatgaggcaatcaagagacgcttaaggactctaattttagcaccaacaagggtggttgcagctgagatggaagaagcattgaaagggctcccaataaggtatcagaccttttgggacagcggtg

SEQ ID NO: 373384 - DNA, 140 bp, Artificial Sequence
  Synthetic
caccgctgtcccaaaaggtctgataccttattgggagccctttcaatgcttcttccatctcagctgcaaccacccttgttggtgctaaaattagagtccttaagcgtctcttgattgcctcatatcagcagccagggcct

SEQ ID NO: 373385 - DNA, 140 bp, Artificial Sequence
  Synthetic
atacgccatgctgggtctccaacaactgcaacaaaatctgaacacacagggaaagagatcgttgacctaatgtgtcacgcaacgttcacaatgcgtttactgtcaccagtcagagttccacgtacttgggagtcggccat

SEQ ID NO: 373386 - DNA, 140 bp, Artificial Sequence
  Synthetic
atggccgactcccaagtacgtggaactctgactggtgacagtaaacgcattgtgaacgttgcgtgacacattaggtcaacgatctctttccctgtgtgttcagattttgttgcagttgttggagacccagcatggcgtat

SEQ ID NO: 373387 - DNA, 140 bp, Artificial Sequence
  Synthetic
atacgccatgctgggtctccaactacaacttgataataatggatgaggctcatttcacagatccagctagtatagcggctagagggtacatatcaactcgtgtaggaatgggagaggcagcgtacttgggagtcggccat

SEQ ID NO: 373388 - DNA, 140 bp, Artificial Sequence
  Synthetic
atggccgactcccaagtacgctgcctctcccattcctacacgagttgatatgtaccctctagccgctatactagctggatctgtgaaatgagcctcatccattattatcaagttgtagttggagacccagcatggcgtat

SEQ ID NO: 373389 - DNA, 140 bp, Artificial Sequence
  Synthetic
aggccctggctgctgatatgatggaattcaggcaatgattggattaccgactttgccggaaagactgtgtggtttgtccccagcatcaaagctgggaatgacatagcaaactgcttgcgggaccttttgggacagcggtg

SEQ ID NO: 373390 - DNA, 140 bp, Artificial Sequence
  Synthetic
caccgctgtcccaaaaggtcccgcaagcagtttgctatgtcattcccagctttgatgctggggacaaaccacacagtctttccggcaaagtcggtaatccaatcattgcctgaattccatcatatcagcagccagggcct

SEQ ID NO: 373391 - DNA, 140 bp, Artificial Sequence
  Synthetic
atacgccatgctgggtctccaaaaatggaaaaaaggtcattcaacttagtaggaaaacttttgacacagaatatcaaaagaccaaactaaatgattgggactttgtggtgacaacagacacgtacttgggagtcggccat

SEQ ID NO: 373392 - DNA, 140 bp, Artificial Sequence
  Synthetic
atggccgactcccaagtacgtgtctgttgtcaccacaaagtcccaatcatttagtttggtcttttgatattctgtgtcaaaagttttcctactaagttgaatgaccttttttccatttttggagacccagcatggcgtat

SEQ ID NO: 373393 - DNA, 140 bp, Artificial Sequence
  Synthetic
atacgccatgctgggtctcctttcagaaatgggagccaatttcaaagcagacagagtgatcgacccaagaagatgtctcaagccagtcattttgacagacggacccgagcgcgtgatcctcgtacttgggagtcggccat

SEQ ID NO: 373394 - DNA, 140 bp, Artificial Sequence
  Synthetic
atggccgactcccaagtacgaggatcacgcgctcgggtccgtctgtcaaaatgactggcttgagacatcttcttgggtcgatcactctgtctgctttgaaattggctcccatttctgaaaggagacccagcatggcgtat

SEQ ID NO: 373395 - DNA, 140 bp, Artificial Sequence
  Synthetic
atacgccatgctgggtctccctcttaagaaagctgacctccaaggaattgatgatgaccaccataggaatcgtgctcctctcccaggccaccataccagagactatacttgaactgactgcgtacttgggagtcggccat

SEQ ID NO: 373396 - DNA, 140 bp, Artificial Sequence
  Synthetic
atggccgactcccaagtacgcagtcagttcaagtatagtctctggtatggtggcctgggagaggagcacgattcctatggtggtcatcatcaattccttggaggtcagctttcttaagagggagacccagcatggcgtat

SEQ ID NO: 373397 - DNA, 140 bp, Artificial Sequence
  Synthetic
atacgccatgctgggtctccggtgagtccaggaagacctttgtggaactcatgaggaggggtgatctcccagtttggctagctcataaagtagcatcagaaggaatcaaatacacagacacgtacttgggagtcggccat

SEQ ID NO: 373398 - DNA, 140 bp, Artificial Sequence
  Synthetic
atggccgactcccaagtacgtgtctgtgtatttgattccttctgatgctactttatgagctagccaaactgggagatcacccctcctcatgagttccacaaaggtcttcctggactcaccggagacccagcatggcgtat

SEQ ID NO: 373399 - DNA, 140 bp, Artificial Sequence
  Synthetic
atacgccatgctgggtctccgaaataggaagagtgccttcacatttagctcacagaacgagaaacgctctggacaatctggtgatgttgcacacgtcagaacacggtgggagggcctacacgtacttgggagtcggccat

SEQ ID NO: 373400 - DNA, 140 bp, Artificial Sequence
  Synthetic
atggccgactcccaagtacgtgtaggccctcccaccgtgttctgacgtgtgcaacatcaccagattgtccagagcgtttctcgttctgtgagctaaatgtgaaggcactcttcctatttcggagacccagcatggcgtat

SEQ ID NO: 373401 - DNA, 140 bp, Artificial Sequence
  Synthetic
aggccctggctgctgatatgggacaatctggtgatgttgcacacgtcagaacacggtgggagggcctacaggcatgcagtggaggaattaccagaaacaatggaaacactcttactcctggaccttttgggacagcggtg

SEQ ID NO: 373402 - DNA, 140 bp, Artificial Sequence
  Synthetic
caccgctgtcccaaaaggtccaggagtaagagtgtttccattgtttctggtaattcctccactgcatgcctgtaggccctcccaccgtgttctgacgtgtgcaacatcaccagattgtcccatatcagcagccagggcct

SEQ ID NO: 373403 - DNA, 140 bp, Artificial Sequence
  Synthetic
atacgccatgctgggtctccggactcatgatcctgttaacaggtggggtgatgcttttcttgatatcaggcaaaggggttggaaagacttcaataggactcatttgtgtagttgcttccacgtacttgggagtcggccat

SEQ ID NO: 373404 - DNA, 140 bp, Artificial Sequence
  Synthetic
atggccgactcccaagtacgtggaagcaactacacaaatgagtcctattgaagtctttccaacccctttgcctgatatcaagaaaagcatcaccccacctgttaacaggatcatgagtccggagacccagcatggcgtat

SEQ ID NO: 373405 - DNA, 140 bp, Artificial Sequence
  Synthetic
atacgccatgctgggtctccaagaacctattcccatgtcaacatatgggtggaatctagtgcgtcttcaaagtggagttgatgttttctttactccgccagaaaagtgtgatacattgttcgtacttgggagtcggccat

SEQ ID NO: 373406 - DNA, 140 bp, Artificial Sequence
  Synthetic
atggccgactcccaagtacgaacaatgtatcacacttttctggcggagtaaagaaaacatcaactccactttgaagacgcactagattccacccatatgttgacatgggaataggttcttggagacccagcatggcgtat

SEQ ID NO: 373407 - DNA, 140 bp, Artificial Sequence
  Synthetic
atacgccatgctgggtctcccacgagggggagagccgcacatgatagtcagcaagcaggaaagaggaaagtcacttttgtttaagacctcagcaggtgtcaacatgtgcacccttatagccgtacttgggagtcggccat

SEQ ID NO: 373408 - DNA, 140 bp, Artificial Sequence
  Synthetic
atggccgactcccaagtacggctataagggtgcacatgttgacacctgctgaggtcttaaacaaaagtgactttcctctttcctgcttgctgactatcatgtgcggctctccccctcgtgggagacccagcatggcgtat

SEQ ID NO: 373409 - DNA, 140 bp, Artificial Sequence
  Synthetic
aggccctggctgctgatatgtcacttttgtttaagacctcagcaggtgtcaacatgtgcacccttatagcgatggatttgggagagttatgtgaggacacaatgacttacaaatgccctcgaccttttgggacagcggtg

SEQ ID NO: 373410 - DNA, 140 bp, Artificial Sequence
  Synthetic
caccgctgtcccaaaaggtcgagggcatttgtaagtcattgtgtcctcacataactctcccaaatccatcgctataagggtgcacatgttgacacctgctgaggtcttaaacaaaagtgacatatcagcagccagggcct

SEQ ID NO: 373411 - DNA, 140 bp, Artificial Sequence
  Synthetic
atacgccatgctgggtctccttacattggctgcaatagtagcagccaatgaaatgggattgttggaaaccacaaagagagatttggggatgtccaaagaaccaggagttgcttcgccaaccgtacttgggagtcggccat

SEQ ID NO: 373412 - DNA, 140 bp, Artificial Sequence
  Synthetic
atggccgactcccaagtacggttggcgaagcaactcctggttctttggacatccccaaatctctctttgtggtttccaacaatcccatttcattggctgctactattgcagccaatgtaaggagacccagcatggcgtat

SEQ ID NO: 373413 - DNA, 140 bp, Artificial Sequence
  Synthetic
atacgccatgctgggtctccagtggagttgatgttttctttactccgccagaaaagtgtgatacattgttgtgtgacataggggagtcgtcaccaaatcccacggttgaagcaggacgaacgtacttgggagtcggccat

SEQ ID NO: 373414 - DNA, 140 bp, Artificial Sequence
  Synthetic
atggccgactcccaagtacgttcgtcctgcttcaaccgtgggatttggtgacgactcccctatgtcacacaacaatgtatcacacttttctggcggagtaaagaaaacatcaactccactggagacccagcatggcgtat

SEQ ID NO: 373415 - DNA, 140 bp, Artificial Sequence
  Synthetic
atacgccatgctgggtctcccaagaaccgaaacgtggatgtcctccgaaggcgcttggaaacagatacaaagagtggagacttgggccctgagacacccaggattcacggtgatagccctcgtacttgggagtcggccat

SEQ ID NO: 373416 - DNA, 140 bp, Artificial Sequence
  Synthetic
atggccgactcccaagtacgagggctatcaccgtgaatcctgggtgtctcagggcccaagtctccactctttgtatctgtttccaagcgccttcggaggacatccacgtttcggttcttgggagacccagcatggcgtat

SEQ ID NO: 373417 - DNA, 140 bp, Artificial Sequence
  Synthetic
atacgccatgctgggtctccgatgggtctagacaaaggatggccgatatcgaaaatggacttaggcgtgccactattggcgctaggttgctattcacaagtgaacccactgactctcacacgtacttgggagtcggccat

SEQ ID NO: 373418 - DNA, 140 bp, Artificial Sequence
  Synthetic
atggccgactcccaagtacgtgtgagagtcagtgggttcacttgtgaatagcaacctagcgccaatagtggcacgcctaagtccattttcgatatcggccatcctttgtctagacccatcggagacccagcatggcgtat

SEQ ID NO: 373419 - DNA, 140 bp, Artificial Sequence
  Synthetic
atacgccatgctgggtctccgctaaaatcataggggcagatgtacagaacaccaccttcatcatcgacggcccaaacaccccagaatgccctgatgatcaaagagcgtggaacatttgggcgtacttgggagtcggccat

SEQ ID NO: 373420 - DNA, 140 bp, Artificial Sequence
  Synthetic
atggccgactcccaagtacgcccaaatgttccacgctctttgatcatcagggcattctggggtgtttgggccgtcgatgatgaaggtggtgttctgtacatctgcccctatgattttagcggagacccagcatggcgtat

SEQ ID NO: 373421 - DNA, 140 bp, Artificial Sequence
  Synthetic
atacgccatgctgggtctccgtttgttccaagtataaaagcagggaatgacatagcagcttgcctgagaaagaatggaaagaaagtgatacaactcagcaggaagacttttgactctgaacgtacttgggagtcggccat

SEQ ID NO: 373422 - DNA, 140 bp, Artificial Sequence
  Synthetic
atggccgactcccaagtacgttcagagtcaaaagtcttcctgctgagttgtatcactttctttccattctttctcaggcaagctgctatgtcattccctgcttttatacttggaacaaacggagacccagcatggcgtat

SEQ ID NO: 373423 - DNA, 140 bp, Artificial Sequence
  Synthetic
aggccctggctgctgatatgcatagacttgggctgtggaagaggaggctggtcatattattgtgcaggattgaaaaaagttacagaagtgcgaggatacacaaaaggcggcccaggacatgaccttttgggacagcggtg

SEQ ID NO: 373424 - DNA, 140 bp, Artificial Sequence
  Synthetic
caccgctgtcccaaaaggtcatgtcctgggccgccttttgtgtatcctcgcacttctgtaacttttttcaatcctgcacaataatatgaccagcctcctcttccacagcccaagtctatgcatatcagcagccagggcct

SEQ ID NO: 373425 - DNA, 140 bp, Artificial Sequence
  Synthetic
atacgccatgctgggtctccgaagagccagtacctatgtctacatatggatggaacatagtcaagctgatgagtggaaaggatgtgttttatcttccacctgaaaagtgtgacactctaccgtacttgggagtcggccat

SEQ ID NO: 373426 - DNA, 140 bp, Artificial Sequence
  Synthetic
atggccgactcccaagtacggtagagtgtcacacttttcaggtggaagataaaacacatcctttccactcatcagcttgactatgttccatccatatgtagacataggtactggctcttcggagacccagcatggcgtat

SEQ ID NO: 373427 - DNA, 140 bp, Artificial Sequence
  Synthetic
atacgccatgctgggtctcctgtgcgacattggagaatcttcaccaagcccaacagtggaggagagcagaaccataagagtcttgaaaatggttgaaccatggctaaaaaataaccagttcgtacttgggagtcggccat

SEQ ID NO: 373428 - DNA, 140 bp, Artificial Sequence
  Synthetic
atggccgactcccaagtacgaactggttattttttagccatggttcaaccattttcaagactcttatggttctgctctcctccactgttgggcttggtgaagattctccaatgtcgcacaggagacccagcatggcgtat

SEQ ID NO: 373429 - DNA, 140 bp, Artificial Sequence
  Synthetic
atacgccatgctgggtctcccaaggagttcgcagctggaagaaagtccctgaccctgaatctaatcacagagatgggtaggctcccaaccttcatgacccagaaagcaaggaatgcactgcgtacttgggagtcggccat

SEQ ID NO: 373430 - DNA, 140 bp, Artificial Sequence
  Synthetic
atggccgactcccaagtacgcagtgcattccttgctttctgggtcatgaaggttgggagcctacccatctctgtgattagattcagggtcagggactttcttccagctgcgaactccttgggagacccagcatggcgtat

SEQ ID NO: 373431 - DNA, 140 bp, Artificial Sequence
  Synthetic
atacgccatgctgggtctcccgtctcttcagtcaacatgatatccagactgctactgaacagattcacaatgacatataggagacccaccatagagaaagatgtggatttgggagcggggcgtacttgggagtcggccat

SEQ ID NO: 373432 - DNA, 140 bp, Artificial Sequence
  Synthetic
atggccgactcccaagtacgccccgctcccaaatccacatctttctctatggtgggtctcctatatgtcattgtgaatctgttcagtagcagtctggatatcatgttgactgaagagacgggagacccagcatggcgtat

SEQ ID NO: 373433 - DNA, 140 bp, Artificial Sequence
  Synthetic
atacgccatgctgggtctccttttggtgagagttacatcgtgataggagcaggtgaaaaagctttgaaactaagctggttcaagaaaggaagcagcatagggaaaatgtttgaggcaactcgtacttgggagtcggccat

SEQ ID NO: 373434 - DNA, 140 bp, Artificial Sequence
  Synthetic
atggccgactcccaagtacgagttgcctcaaacattttccctatgctgcttcctttcttgaaccagcttagtttcaaagctttttcacctgctcctatcacgatgtaactctcaccaaaaggagacccagcatggcgtat

SEQ ID NO: 373435 - DNA, 140 bp, Artificial Sequence
  Synthetic
aggccctggctgctgatatgcacgaaaccatgggatgtggtgcccacggtgacacagatggcaatgacggacacgaccccttttggccagcaaagggtttttaaagagaaagtggacaccgaccttttgggacagcggtg

SEQ ID NO: 373436 - DNA, 140 bp, Artificial Sequence
  Synthetic
caccgctgtcccaaaaggtcggtgtccactttctctttaaaaaccctttgctggccaaaaggggtcgtgtccgtcattgccatctgtgtcaccgtgggcaccacatcccatggtttcgtgcatatcagcagccagggcct

SEQ ID NO: 373437 - DNA, 140 bp, Artificial Sequence
  Synthetic
atacgccatgctgggtctccaggacacccaaacccatgccaggaacaagaaaggttatggagatcacagcggaatggctttggagaaccctgggaaggaacaaaagacccagattatgcacgtacttgggagtcggccat

SEQ ID NO: 373438 - DNA, 140 bp, Artificial Sequence
  Synthetic
atggccgactcccaagtacgtgcataatctgggtcttttgttccttcccagggttctccaaagccattccgctgtgatctccataacctttcttgttcctggcatgggtttgggtgtcctggagacccagcatggcgtat

SEQ ID NO: 373439 - DNA, 140 bp, Artificial Sequence
  Synthetic
aggccctggctgctgatatgggaatggctttggagaaccctgggaaggaacaaaagacccagattatgcacgagagaggagttcacaaaaaaggtcagaaccaacgcagctatgggcgccgaccttttgggacagcggtg

SEQ ID NO: 373440 - DNA, 140 bp, Artificial Sequence
  Synthetic
caccgctgtcccaaaaggtcggcgcccatagctgcgttggttctgaccttttttgtgaactcctctctcgtgcataatctgggtcttttgttccttcccagggttctccaaagccattcccatatcagcagccagggcct

SEQ ID NO: 373441 - DNA, 140 bp, Artificial Sequence
  Synthetic
atacgccatgctgggtctccgtatttacagaggagaaccaatgggacagtgctagagctgccgttgaagatgaagaattctggaaactcgtggacagagaacgtgaactccataaactggcgtacttgggagtcggccat

SEQ ID NO: 373442 - DNA, 140 bp, Artificial Sequence
  Synthetic
atggccgactcccaagtacgccagtttatggagttcacgttctctgtccacgagtttccagaattcttcatcttcaacggcagctctagcactgtcccattggttctcctctgtaaatacggagacccagcatggcgtat

SEQ ID NO: 373443 - DNA, 140 bp, Artificial Sequence
  Synthetic
aggccctggctgctgatatggttgggagccaggtaccttgagttcgaggcactcggattcttaaatgaagaccattggttctcgcgtgaaaactcttacagtggagtagaaggggaaggagaccttttgggacagcggtg

SEQ ID NO: 373444 - DNA, 140 bp, Artificial Sequence
  Synthetic
caccgctgtcccaaaaggtctccttccccttctactccactgtaagagttttcacgcgagaaccaatggtcttcatttaagaatccgagtgcctcgaactcaaggtacctggctcccaaccatatcagcagccagggcct

SEQ ID NO: 373445 - DNA, 140 bp, Artificial Sequence
  Synthetic
atacgccatgctgggtctccctgcataagctgggatatatcttgagagatatttccaagatacccggaggagctatgtatgctgatgacacagcagggtgggacacaagaataacagaagcgtacttgggagtcggccat

SEQ ID NO: 373446 - DNA, 140 bp, Artificial Sequence
  Synthetic
atggccgactcccaagtacgcttctgttattcttgtgtcccaccctgctgtgtcatcagcatacatagctcctccgggtatcttggaaatatctctcaagatatatcccagcttatgcagggagacccagcatggcgtat

SEQ ID NO: 373447 - DNA, 140 bp, Artificial Sequence
  Synthetic
aggccctggctgctgatatgagctatgtatgctgatgacacagcagggtgggacacaagaataacagaagatgacctgcacaatgaggaaaaaattacacagcaaatggaccctgaacacgaccttttgggacagcggtg

SEQ ID NO: 373448 - DNA, 140 bp, Artificial Sequence
  Synthetic
caccgctgtcccaaaaggtcgtgttcagggtccatttgctgtgtaattttttcctcattgtgcaggtcatcttctgttattcttgtgtcccaccctgctgtgtcatcagcatacatagctcatatcagcagccagggcct

SEQ ID NO: 373449 - DNA, 140 bp, Artificial Sequence
  Synthetic
aggccctggctgctgatatgttcacgctgacatggggtactggatagaaagtgaaaagaacgagacctggaagctggcaagagcctctttcatagaagtcaaaacatgtatctggccaaagaccttttgggacagcggtg

SEQ ID NO: 373450 - DNA, 140 bp, Artificial Sequence
  Synthetic
caccgctgtcccaaaaggtctttggccagatacatgttttgacttctatgaaagaggctcttgccagcttccaggtctcgttcttttcactttctatccagtaccccatgtcagcgtgaacatatcagcagccagggcct

SEQ ID NO: 373451 - DNA, 140 bp, Artificial Sequence
  Synthetic
aggccctggctgctgatatgagtggggatgattgcgtggtgaaaccaatcgacgacaggttcgccaatgccctgcttgccctgaatgacatgggaaaagttaggaaggacataccccaatgaccttttgggacagcggtg

SEQ ID NO: 373452 - DNA, 140 bp, Artificial Sequence
  Synthetic
caccgctgtcccaaaaggtcattggggtatgtccttcctaacttttcccatgtcattcagggcaagcagggcattggcgaacctgtcgtcgattggtttcaccacgcaatcatccccactcatatcagcagccagggcct

SEQ ID NO: 373453 - DNA, 140 bp, Artificial Sequence
  Synthetic
atacgccatgctgggtctccggcagccatcgaaaggatggcatgattggcaacaggtccctttctgctcccaccactttcatgaattgattatgaaagatggaagaaagttggtggtccccgtacttgggagtcggccat

SEQ ID NO: 373454 - DNA, 140 bp, Artificial Sequence
  Synthetic
atggccgactcccaagtacggggaccaccaactttcttccatctttcataatcaattcatgaaagtggtgggagcagaaagggacctgttgccaatcatgccatcctttcgatggctgccggagacccagcatggcgtat

SEQ ID NO: 373455 - DNA, 140 bp, Artificial Sequence
  Synthetic
aggccctggctgctgatatggtgtgacataggggagtcgtcaccaaaccccactgttgaagcaggacgaacactcagagttctaaacctagtggaaaattggctgaacaataacacccaagaccttttgggacagcggtg

SEQ ID NO: 373456 - DNA, 140 bp, Artificial Sequence
  Synthetic
caccgctgtcccaaaaggtcttgggtgttattgttcagccaattttccactaggtttagaactctgagtgttcgtcctgcttcaacagtggggtttggtgacgactcccctatgtcacaccatatcagcagccagggcct

SEQ ID NO: 373457 - DNA, 140 bp, Artificial Sequence
  Synthetic
atacgccatgctgggtctcccaggatggagccttaaagaaactgcatgcttagggaaagcctacgcccaaatgtgggctctcatgtattttcacagaagagatcttagactagcatccaacgtacttgggagtcggccat

SEQ ID NO: 373458 - DNA, 140 bp, Artificial Sequence
  Synthetic
atggccgactcccaagtacgttggatgctagtctaagatctcttctgtgaaaatacatgagagcccacatttgggcgtaggctttccctaagcatgcagtttctttaaggctccatcctgggagacccagcatggcgtat

SEQ ID NO: 373459 - DNA, 140 bp, Artificial Sequence
  Synthetic
atacgccatgctgggtctcctgccatatgttcagcagtaccagtccattgggtccccacaagcagaacgacgtggtccatccatgctcaccatcagtggatgactacagaagacatgcttcgtacttgggagtcggccat

SEQ ID NO: 373460 - DNA, 140 bp, Artificial Sequence
  Synthetic
atggccgactcccaagtacgaagcatgtcttctgtagtcatccactgatggtgagcatggatggaccacgtcgttctgcttgtggggacccaatggactggtactgctgaacatatggcaggagacccagcatggcgtat

SEQ ID NO: 373461 - DNA, 140 bp, Artificial Sequence
  Synthetic
atacgccatgctgggtctcctattccgcagactaacatccagagaagttcttcttctaacaattggattgagtctagtggcatctgtggagttaccaaattccttggaggagctgggggacgtacttgggagtcggccat

SEQ ID NO: 373462 - DNA, 140 bp, Artificial Sequence
  Synthetic
atggccgactcccaagtacgtcccccagctcctccaaggaatttggtaactccacagatgccactagactcaatccaattgttagaagaagaacttctctggatgttagtctgcggaataggagacccagcatggcgtat

SEQ ID NO: 373463 - DNA, 140 bp, Artificial Sequence
  Synthetic
aggccctggctgctgatatgaccaatggtgcggatcactcattggtctcacttccagagcaacctgggcccagaacatacttaccgcaatccaacaggtaagaagccttataggcaatgagaccttttgggacagcggtg

SEQ ID NO: 373464 - DNA, 140 bp, Artificial Sequence
  Synthetic
caccgctgtcccaaaaggtctcattgcctataaggcttcttacctgttggattgcggtaagtatgttctgggcccaggttgctctggaagtgagaccaatgagtgatccgcaccattggtcatatcagcagccagggcct

SEQ ID NO: 373465 - DNA, 140 bp, Artificial Sequence
  Synthetic
atacgccatgctgggtctccagagtttctggattacatgccttcgatgaagagattcaggaaggaggaggagtcagagggagccatttggtaaacgcaggaagtgaaaaaagaggcaaaccgtacttgggagtcggccat

SEQ ID NO: 373466 - DNA, 140 bp, Artificial Sequence
  Synthetic
atggccgactcccaagtacggtttgcctcttttttcacttcctgcgtttaccaaatggctccctctgactcctcctccttcctgaatctcttcatcgaaggcatgtaatccagaaactctggagacccagcatggcgtat

SEQ ID NO: 373467 - DNA, 140 bp, Artificial Sequence
  Synthetic
aggccctggctgctgatatgagtcagagggagccatttggtaaacgcaggaagtgaaaaaagaggcaaactgtcaggccactttaagccacagtacggaagaagctgtgcagcctgtgaggaccttttgggacagcggtg

SEQ ID NO: 373468 - DNA, 140 bp, Artificial Sequence
  Synthetic
caccgctgtcccaaaaggtcctcacaggctgcacagcttcttccgtactgtggcttaaagtggcctgacagtttgcctcttttttcacttcctgcgtttaccaaatggctccctctgactcatatcagcagccagggcct

SEQ ID NO: 373469 - DNA, 140 bp, Artificial Sequence
  Synthetic
atacgccatgctgggtctccagacacgaccccatttggacaacagcgtgtttttaaagagaaagtggacacgagaacccaagaaccaaaagaaggcacgaagaaactaatgaaaatcacgcgtacttgggagtcggccat

SEQ ID NO: 373470 - DNA, 140 bp, Artificial Sequence
  Synthetic
atggccgactcccaagtacgcgtgattttcattagtttcttcgtgccttcttttggttcttgggttctcgtgtccactttctctttaaaaacacgctgttgtccaaatggggtcgtgtctggagacccagcatggcgtat

SEQ ID NO: 373471 - DNA, 140 bp, Artificial Sequence
  Synthetic
atacgccatgctgggtctcccattgccgaagtggaacctgaagacattgactgctggtgcaaccttacatcgacatgggtgacttatggaacgtgcaatcaagctggggagcatagacgccgtacttgggagtcggccat

SEQ ID NO: 373472 - DNA, 140 bp, Artificial Sequence
  Synthetic
atggccgactcccaagtacggcgtctatgctccccagcttgattgcacgttccataagtcacccatgtcgatgtaaggttgcaccagcagtcaatgtcttcaggttccacttcggcaatgggagacccagcatggcgtat

SEQ ID NO: 373473 - DNA, 140 bp, Artificial Sequence
  Synthetic
aggccctggctgctgatatgaggtggagacatgggctcttaggcacccagggttcaccatactagctctatttctagcccattacataggcacttccctgacccagaaagtggttattttgaccttttgggacagcggtg

SEQ ID NO: 373474 - DNA, 140 bp, Artificial Sequence
  Synthetic
caccgctgtcccaaaaggtcaaaataaccactttctgggtcagggaagtgcctatgtaatgggctagaaatagagctagtatggtgaaccctgggtgcctaagagcccatgtctccacctcatatcagcagccagggcct

SEQ ID NO: 373475 - DNA, 140 bp, Artificial Sequence
  Synthetic
atacgccatgctgggtctcccacgctggacatagagcttcagaagaccgaggccactcaactggcgaccctaaggaaattatgcattgaggggaaaataaccaacataacaactgactcacgtacttgggagtcggccat

SEQ ID NO: 373476 - DNA, 140 bp, Artificial Sequence
  Synthetic
atggccgactcccaagtacgtgagtcagttgttatgttggttattttcccctcaatgcataatttccttagggtcgccagttgagtggcctcggtcttctgaagctctatgtccagcgtgggagacccagcatggcgtat

SEQ ID NO: 373477 - DNA, 140 bp, Artificial Sequence
  Synthetic
atacgccatgctgggtctccgtttgtttggaaaaggaagtttggtgacatgcgcaaaatttcaatgtctagaatcaatagagggaaaagtggtgcaacatgagaacctcaaatacactgtcgtacttgggagtcggccat

SEQ ID NO: 373478 - DNA, 140 bp, Artificial Sequence
  Synthetic
atggccgactcccaagtacgacagtgtatttgaggttctcatgttgcaccacttttccctctattgattctagacattgaaattttgcgcatgtcaccaaacttccttttccaaacaaacggagacccagcatggcgtat

SEQ ID NO: 373479 - DNA, 140 bp, Artificial Sequence
  Synthetic
atacgccatgctgggtctccagggagtcacggctgagataacaccccaggcatcaaccgttgaagctatcctgcctgaatatggaacccttgggctagaatgttcaccacgcacaggtttcgtacttgggagtcggccat

SEQ ID NO: 373480 - DNA, 140 bp, Artificial Sequence
  Synthetic
atggccgactcccaagtacgaaacctgtgcgtggtgaacattctagcccaagggttccatattcaggcaggatagcttcaacggttgatgcctggggtgttatctcagccgtgactccctggagacccagcatggcgtat

SEQ ID NO: 373481 - DNA, 140 bp, Artificial Sequence
  Synthetic
atacgccatgctgggtctccggatttcaatgaaatgattctattgacaatgaagaataaagcatggatggtacatagacaatggttttttgacctacccctaccatggacatcaggagctcgtacttgggagtcggccat

SEQ ID NO: 373482 - DNA, 140 bp, Artificial Sequence
  Synthetic
atggccgactcccaagtacgagctcctgatgtccatggtaggggtaggtcaaaaaaccattgtctatgtaccatccatgctttattcttcattgtcaatagaatcatttcattgaaatccggagacccagcatggcgtat

SEQ ID NO: 373483 - DNA, 140 bp, Artificial Sequence
  Synthetic
atacgccatgctgggtctccacaacagagacaccaacttggaacaggaaagagcttcttgtgacattcaaaaatgcacatgcaaaaaagcaagaagtagtcgtccttggatcgcaagaggcgtacttgggagtcggccat

SEQ ID NO: 373484 - DNA, 140 bp, Artificial Sequence
  Synthetic
atggccgactcccaagtacgcctcttgcgatccaaggacgactacttcttgcttttttgcatgtgcatttttgaatgtcacaagaagctctttcctgttccaagttggtgtctctgttgtggagacccagcatggcgtat

SEQ ID NO: 373485 - DNA, 140 bp, Artificial Sequence
  Synthetic
aggccctggctgctgatatgtggggaacgattaaaaagtcaaaggccatcaatgtcttgagagggttcaggaaagagattggaaggatgttgaacatcttgaataggagacgcagaactggaccttttgggacagcggtg

SEQ ID NO: 373486 - DNA, 140 bp, Artificial Sequence
  Synthetic
caccgctgtcccaaaaggtccagttctgcgtctcctattcaagatgttcaacatccttccaatctctttcctgaaccctctcaagacattgatggcctttgactttttaatcgttccccacatatcagcagccagggcct

SEQ ID NO: 373487 - DNA, 140 bp, Artificial Sequence
  Synthetic
atacgccatgctgggtctcctagcaggaccgatgccagtgactgtggccagtgccgcccagaggagaggaagaattggaaggaaccacaataaggaaggtgatcagtacatctatatgggcgtacttgggagtcggccat

SEQ ID NO: 373488 - DNA, 140 bp, Artificial Sequence
  Synthetic
atggccgactcccaagtacgcccatatagatgtactgatcaccttccttattgtggttccttccaattcttcctctcctctgggcggcactggccacagtcactggcatcggtcctgctaggagacccagcatggcgtat

SEQ ID NO: 373489 - DNA, 140 bp, Artificial Sequence
  Synthetic
atacgccatgctgggtctccatctgatcagattatgcatcatggttggagccaacgcttccgacaggatggggatgggaacgacgtacctagctctgatggccacttttaaaatgagacccgtacttgggagtcggccat

SEQ ID NO: 373490 - DNA, 140 bp, Artificial Sequence
  Synthetic
atggccgactcccaagtacgggtctcattttaaaagtggccatcagagctaggtacgtcgttcccatccccatcctgtcggaagcgttggctccaaccatgatgcataatctgatcagatggagacccagcatggcgtat

SEQ ID NO: 373491 - DNA, 140 bp, Artificial Sequence
  Synthetic
aggccctggctgctgatatgagaagatggtgctttgacggggaaaggaacaaccaggtgttggaggagaacatggacgtggagatctggacaaaagaaggagaaagaaagaaactacgacgaccttttgggacagcggtg

SEQ ID NO: 373492 - DNA, 140 bp, Artificial Sequence
  Synthetic
caccgctgtcccaaaaggtcgtcgtagtttctttctttctccttcttttgtccagatctccacgtccatgttctcctccaacacctggttgttcctttccccgtcaaagcaccatcttctcatatcagcagccagggcct

SEQ ID NO: 373493 - DNA, 140 bp, Artificial Sequence
  Synthetic
atacgccatgctgggtctcccccgctggctggatgccagaacatactcagacccactggccctgcgcgagtttaaagagtttgcagcaggaagaagaagcgtctcaggtgatctaatattcgtacttgggagtcggccat

SEQ ID NO: 373494 - DNA, 140 bp, Artificial Sequence
  Synthetic
atggccgactcccaagtacgaatattagatcacctgagacgcttcttcttcctgctgcaaactctttaaactcgcgcagggccagtgggtctgagtatgttctggcatccagccagcgggggagacccagcatggcgtat

SEQ ID NO: 373495 - DNA, 140 bp, Artificial Sequence
  Synthetic
aggccctggctgctgatatgtttaaagagtttgcagcaggaagaagaagcgtctcaggtgatctaatattggaaatagggaaacttccacaacacttgacgcaaagggcccagaatgcctgaccttttgggacagcggtg

SEQ ID NO: 373496 - DNA, 140 bp, Artificial Sequence
  Synthetic
caccgctgtcccaaaaggtcaggcattctgggccctttgcgtcaagtgttgtggaagtttccctatttccaatattagatcacctgagacgcttcttcttcctgctgcaaactctttaaacatatcagcagccagggcct

SEQ ID NO: 373497 - DNA, 140 bp, Artificial Sequence
  Synthetic
aggccctggctgctgatatggagcaatacaaatttcaagcagactcccctaaaagactggcgacggccattgcaggcgcttgggaaaatggagtttgcggaatcaggtcgacaaccagaagaccttttgggacagcggtg

SEQ ID NO: 373498 - DNA, 140 bp, Artificial Sequence
  Synthetic
caccgctgtcccaaaaggtcttctggttgtcgacctgattccgcaaactccattttcccaagcgcctgcaatggccgtcgccagtcttttaggggagtctgcttgaaatttgtattgctccatatcagcagccagggcct

SEQ ID NO: 373499 - DNA, 140 bp, Artificial Sequence
  Synthetic
atacgccatgctgggtctccatctcaagagacttggaacagacaagatctgctggtcacatttaagacagctcatgcgaagaagcaggaagtagtcgtactggggtcacaagaaggagcacgtacttgggagtcggccat

SEQ ID NO: 373500 - DNA, 140 bp, Artificial Sequence
  Synthetic
atggccgactcccaagtacgtgctccttcttgtgaccccagtacgactacttcctgcttcttcgcatgagctgtcttaaatgtgaccagcagatcttgtctgttccaagtctcttgagatggagacccagcatggcgtat

SEQ ID NO: 373501 - DNA, 140 bp, Artificial Sequence
  Synthetic
atacgccatgctgggtctccttggctggtgcacaggcaatggttcttagacctgccgttaccatggctgcccggagcggacacacaaggatcaaattggatacagaaggagacgttggtccgtacttgggagtcggccat

SEQ ID NO: 373502 - DNA, 140 bp, Artificial Sequence
  Synthetic
atggccgactcccaagtacggaccaacgtctccttctgtatccaatttgatccttgtgtgtccgctccgggcagccatggtaacggcaggtctaagaaccattgcctgtgcaccagccaaggagacccagcatggcgtat

SEQ ID NO: 373503 - DNA, 140 bp, Artificial Sequence
  Synthetic
aggccctggctgctgatatgtggcttggagcacgcttcttggagtttgaagccctaggattcttgaatgaagatcactggttttctagagagaactctttgagtggagtggaaggagaaggaccttttgggacagcggtg

SEQ ID NO: 373504 - DNA, 140 bp, Artificial Sequence
  Synthetic
caccgctgtcccaaaaggtccttctccttccactccactcaaagagttctctctagaaaaccagtgatcttcattcaagaatcctagggcttcaaactccaagaagcgtgctccaagccacatatcagcagccagggcct

SEQ ID NO: 373505 - DNA, 140 bp, Artificial Sequence
  Synthetic
aggccctggctgctgatatgataatggatttggaaaaaagacatgtcttaggtcgcctgattacagtcaacccaatcgtcacagaaaaagacagtccagtcaacatagaagcagaacctcgaccttttgggacagcggtg

SEQ ID NO: 373506 - DNA, 140 bp, Artificial Sequence
  Synthetic
caccgctgtcccaaaaggtcgaggttctgcttctatgttgactggactgtctttttctgtgacgattgggttgactgtaatcaggcgacctaagacatgtcttttttccaaatccattatcatatcagcagccagggcct

SEQ ID NO: 373507 - DNA, 140 bp, Artificial Sequence
  Synthetic
aggccctggctgctgatatgaaacggcaggaccctggcacttgggaaaattggagctggacttcaactattgtgaaggaacaacagtagtcatcacagaaaactgtgggacaagaggcccgaccttttgggacagcggtg

SEQ ID NO: 373508 - DNA, 140 bp, Artificial Sequence
  Synthetic
caccgctgtcccaaaaggtcgggcctcttgtcccacagttttctgtgatgactactgttgttccttcacaatagttgaagtccagctccaattttcccaagtgccagggtcctgccgtttcatatcagcagccagggcct

SEQ ID NO: 373509 - DNA, 140 bp, Artificial Sequence
  Synthetic
atacgccatgctgggtctccggtccaacgcttctgacaggatgggaatgggtgttacctacctagctttaatagcaacattcaagattcagccattcttggctttgggattctttctaagcgtacttgggagtcggccat

SEQ ID NO: 373510 - DNA, 140 bp, Artificial Sequence
  Synthetic
atggccgactcccaagtacgcttagaaagaatcccaaagccaagaatggctgaatcttgaatgttgctattaaagctaggtaggtaacacccattcccatcctgtcagaagcgttggaccggagacccagcatggcgtat

SEQ ID NO: 373511 - DNA, 140 bp, Artificial Sequence
  Synthetic
atacgccatgctgggtctcctcagctatccagaaagctcatgaagagggcatttgtggaatccgctcagtaacaagactggagaatctaatgtggaaacaaataacaccagaactgaatccgtacttgggagtcggccat

SEQ ID NO: 373512 - DNA, 140 bp, Artificial Sequence
  Synthetic
atggccgactcccaagtacggattcagttctggtgttatttgtttccacattagattctccagtcttgttactgagcggattccacaaatgccctcttcatgagctttctggatagctgaggagacccagcatggcgtat

SEQ ID NO: 373513 - DNA, 140 bp, Artificial Sequence
  Synthetic
aggccctggctgctgatatggctctggggctcatggctctaaaactgataacacaatttgagacataccagttatggacggcattagtctccctaacgtgttcaaacacaattttcacgtgaccttttgggacagcggtg

SEQ ID NO: 373514 - DNA, 140 bp, Artificial Sequence
  Synthetic
caccgctgtcccaaaaggtcacgtgaaaattgtgtttgaacacgttagggagactaatgccgtccataactggtatgtctcaaattgtgttatcagttttagagccatgagccccagagccatatcagcagccagggcct

SEQ ID NO: 373515 - DNA, 140 bp, Artificial Sequence
  Synthetic
aggccctggctgctgatatgttgccagtgtgccagtcttcgagcatgaggaaaacagattggctcccagtggctgtggcagctatgggagttccacccttaccactttttatcttcagttgaccttttgggacagcggtg

SEQ ID NO: 373516 - DNA, 140 bp, Artificial Sequence
  Synthetic
caccgctgtcccaaaaggtcaactgaagataaaaagtggtaagggtggaactcccatagctgccacagccactgggagccaatctgttttcctcatgctcgaagactggcacactggcaacatatcagcagccagggcct

SEQ ID NO: 373517 - DNA, 140 bp, Artificial Sequence
  Synthetic
atacgccatgctgggtctcctgaaagatacactcaaaaggaggagctggccactgaatgagggggtgatggctgttggccttgtgagcattctagctagttctctccttaggaatgacgtcgtacttgggagtcggccat

SEQ ID NO: 373518 - DNA, 140 bp, Artificial Sequence
  Synthetic
atggccgactcccaagtacgacgtcattcctaaggagagaactagctagaatgctcacaaggccaacagccatcaccccctcattcagtggccagctcctccttttgagtgtatctttcaggagacccagcatggcgtat

SEQ ID NO: 373519 - DNA, 140 bp, Artificial Sequence
  Synthetic
aggccctggctgctgatatggcaaacccaaagatctggtgttctatgggatgtacccagccccccagagacacagaaagcagaactggaagagggggtctataggatcaaacaacaaggagaccttttgggacagcggtg

SEQ ID NO: 373520 - DNA, 140 bp, Artificial Sequence
  Synthetic
caccgctgtcccaaaaggtctccttgttgtttgatcctatagaccccctcttccagttctgctttctgtgtctctggggggctgggtacatcccatagaacaccagatctttgggtttgccatatcagcagccagggcct

SEQ ID NO: 373521 - DNA, 140 bp, Artificial Sequence
  Synthetic
aggccctggctgctgatatgggtcaagccatcaggatcagcctcatccatggtcaatggtgtggtgaaactgctcaccaaaccatgggatgtcatccccatggtcacacaaatagccatggaccttttgggacagcggtg

SEQ ID NO: 373522 - DNA, 140 bp, Artificial Sequence
  Synthetic
caccgctgtcccaaaaggtccatggctatttgtgtgaccatggggatgacatcccatggtttggtgagcagtttcaccacaccattgaccatggatgaggctgatcctgatggcttgacccatatcagcagccagggcct

SEQ ID NO: 373523 - DNA, 140 bp, Artificial Sequence
  Synthetic
atacgccatgctgggtctcctgtactcctctcccagagcaccataccagagaccatacttgaactgactgatgcgttggccttgggcatgatggttctcaagatagtgaggaatatggaacgtacttgggagtcggccat

SEQ ID NO: 373524 - DNA, 140 bp, Artificial Sequence
  Synthetic
atggccgactcccaagtacgttccatattcctcactatcttgagaaccatcatgcccaaggccaacgcatcagtcagttcaagtatggtctctggtatggtgctctgggagaggagtacaggagacccagcatggcgtat

SEQ ID NO: 373525 - DNA, 140 bp, Artificial Sequence
  Synthetic
aggccctggctgctgatatgaatgacattcccatgacaggaccattagtggctggagggcttctcactgtgtgttacgtgctcactggaagatcggccgacttggaactggagagagccggaccttttgggacagcggtg

SEQ ID NO: 373526 - DNA, 140 bp, Artificial Sequence
  Synthetic
caccgctgtcccaaaaggtccggctctctccagttccaagtcggccgatcttccagtgagcacgtaacacacagtgagaagccctccagccactaatggtcctgtcatgggaatgtcattcatatcagcagccagggcct

SEQ ID NO: 373527 - DNA, 140 bp, Artificial Sequence
  Synthetic
atacgccatgctgggtctccgggaaaaaggtcattcaactcagtaggaagacttttgacacagaatatcaaaaaaccaaactgaatgattgggacttcgtggtgacaacagacatttcagcgtacttgggagtcggccat

SEQ ID NO: 373528 - DNA, 140 bp, Artificial Sequence
  Synthetic
atggccgactcccaagtacgctgaaatgtctgttgtcaccacgaagtcccaatcattcagtttggttttttgatattctgtgtcaaaagtcttcctactgagttgaatgacctttttcccggagacccagcatggcgtat

SEQ ID NO: 373529 - DNA, 140 bp, Artificial Sequence
  Synthetic
atacgccatgctgggtctccaaatgggagccaactttaaagcagatagagtgatcgacccaagaagatgtctcaagccagtgattttgacagatggacctgagcgggtgattttggctggcgtacttgggagtcggccat

SEQ ID NO: 373530 - DNA, 140 bp, Artificial Sequence
  Synthetic
atggccgactcccaagtacgccagccaaaatcacccgctcaggtccatctgtcaaaatcactggcttgagacatcttcttgggtcgatcactctatctgctttaaagttggctcccatttggagacccagcatggcgtat

SEQ ID NO: 373531 - DNA, 140 bp, Artificial Sequence
  Synthetic
atacgccatgctgggtctccctctagacttttctcctggaacgtcaggatctccaattgtcgacaaaaaaggaaaggtcgtgggtctctatggcaacggtgtcgtcacaagaagtggaaccgtacttgggagtcggccat

SEQ ID NO: 373532 - DNA, 140 bp, Artificial Sequence
  Synthetic
atggccgactcccaagtacggttccacttcttgtgacgacaccgttgccatagagacccacgacctttccttttttgtcgacaattggagatcctgacgttccaggagaaaagtctagagggagacccagcatggcgtat

SEQ ID NO: 373533 - DNA, 140 bp, Artificial Sequence
  Synthetic
aggccctggctgctgatatgaataagaaatcaaacaaggcaagaagtcaggccggattaagccatagtacggtaagagctatgctgcctgtgagccccgtctaaggacgtaaaatgaagtgaccttttgggacagcggtg

SEQ ID NO: 373534 - DNA, 140 bp, Artificial Sequence
  Synthetic
caccgctgtcccaaaaggtcacttcattttacgtccttagacggggctcacaggcagcatagctcttaccgtactatggcttaatccggcctgacttcttgccttgtttgatttcttattcatatcagcagccagggcct

SEQ ID NO: 373535 - DNA, 140 bp, Artificial Sequence
  Synthetic
aggccctggctgctgatatgatgatcttgttaacaggtggagcaatgcttttcttgatatcaggtaaagggattggaaagacttcaataggactcatttgtgttattgtttccagtggcagaccttttgggacagcggtg

SEQ ID NO: 373536 - DNA, 140 bp, Artificial Sequence
  Synthetic
caccgctgtcccaaaaggtctgccactggaaacaataacacaaatgagtcctattgaagtctttccaatccctttacctgatatcaagaaaagcattgctccacctgttaacaagatcatcatatcagcagccagggcct

SEQ ID NO: 373537 - DNA, 140 bp, Artificial Sequence
  Synthetic
aggccctggctgctgatatggggtagcagactagtggttagaggagacccctcccgaaacacaacgcagcagcggggcccaacaccaggggaagctgtaccctggtggtaaggactagaggaccttttgggacagcggtg

SEQ ID NO: 373538 - DNA, 140 bp, Artificial Sequence
  Synthetic
caccgctgtcccaaaaggtcctctagtccttaccaccagggtacagcttcccctggtgttgggccccgctgctgcgttgtgtttcgggaggggtctcctctaaccactagtctgctaccccatatcagcagccagggcct

SEQ ID NO: 373539 - DNA, 140 bp, Artificial Sequence
  Synthetic
aggccctggctgctgatatggttagaggagaccccccgcataacaataaacagcatattgacgctgggagagaccagagatcctgctgtctctacagcatcattccaggcgagccaacacgaccttttgggacagcggtg

SEQ ID NO: 373540 - DNA, 140 bp, Artificial Sequence
  Synthetic
caccgctgtcccaaaaggtcgtgttggctcgcctggaatgatgctgtagagacagcaggatctctggtctctcccagcgtcaatatgctgtttattgttatgcggggggtctcctctaaccatatcagcagccagggcct

SEQ ID NO: 373541 - DNA, 140 bp, Artificial Sequence
  Synthetic
atacgccatgctgggtctccaactccccaagacaaccaactcgcatatgtcgtgataggcatactcacactggctgcgatagtagcagccaatgaaatgggactactggagactacaaagcgtacttgggagtcggccat

SEQ ID NO: 373542 - DNA, 140 bp, Artificial Sequence
  Synthetic
atggccgactcccaagtacgctttgtagtctccagtagtcccatttcattggctgctactatcgcagccagtgtgagtatgcctatcacgacatatgcgagttggttgtcttggggagttggagacccagcatggcgtat

SEQ ID NO: 373543 - DNA, 140 bp, Artificial Sequence
  Synthetic
atacgccatgctgggtctccaacctctggaaaatgatgaagactgtgcacactggaaagaagccaagatgcttttagacaacatcaacacgcctgaaggaatcattcccagcatgttcgacgtacttgggagtcggccat

SEQ ID NO: 373544 - DNA, 140 bp, Artificial Sequence
  Synthetic
atggccgactcccaagtacgtcgaacatgctgggaatgattccttcaggcgtgttgatgttgtctaaaagcatcttggcttctttccagtgtgcacagtcttcatcattttccagaggttggagacccagcatggcgtat

SEQ ID NO: 373545 - DNA, 140 bp, Artificial Sequence
  Synthetic
atacgccatgctgggtctccaaggtggtgttttgatggaatcaagaacaaccaaatcttggaagaaaatgtggaagtggaaatctggacaaaagaaggggaaaggaagaaactgaaaccccgtacttgggagtcggccat

SEQ ID NO: 373546 - DNA, 140 bp, Artificial Sequence
  Synthetic
atggccgactcccaagtacggggtttcagtttcttcctttccccttcttttgtccagatttccacttccacattttcttccaagatttggttgttcttgattccatcaaaacaccaccttggagacccagcatggcgtat

SEQ ID NO: 373547 - DNA, 140 bp, Artificial Sequence
  Synthetic
aggccctggctgctgatatgatccaacggtggatgggataatgacaatagacctagatcctgtaatatacgattcaaaatttgaaaagcaactaggacaggttatgctcctggtcctgtggaccttttgggacagcggtg

SEQ ID NO: 373548 - DNA, 140 bp, Artificial Sequence
  Synthetic
caccgctgtcccaaaaggtccacaggaccaggagcataacctgtcctagttgcttttcaaattttgaatcgtatattacaggatctaggtctattgtcattatcccatccaccgttggatcatatcagcagccagggcct

SEQ ID NO: 373549 - DNA, 140 bp, Artificial Sequence
  Synthetic
aggccctggctgctgatatgcatattgacgctgggaaagaccagagatcctgctgtctctgcaacatcaatccaggcacagagcgccgcgagatggattggtgttgttgatccaacaggtgaccttttgggacagcggtg

SEQ ID NO: 373550 - DNA, 140 bp, Artificial Sequence
  Synthetic
caccgctgtcccaaaaggtcacctgttggatcaacaacaccaatccatctcgcggcgctctgtgcctggattgatgttgcagagacagcaggatctctggtctttcccagcgtcaatatgcatatcagcagccagggcct

SEQ ID NO: 373551 - DNA, 140 bp, Artificial Sequence
  Synthetic
atacgccatgctgggtctccgaaatctggaatcactgaagtggatagaacagaagccaaagaggggctgaaaagaggagaaacaacacatcatgccgtgtccagaggcagtgcaaaacttcgtacttgggagtcggccat

SEQ ID NO: 373552 - DNA, 140 bp, Artificial Sequence
  Synthetic
atggccgactcccaagtacgaagttttgcactgcctctggacacggcatgatgtgttgtttctcctcttttcagcccctctttggcttctgttctatccacttcagtgattccagatttcggagacccagcatggcgtat

SEQ ID NO: 373553 - DNA, 140 bp, Artificial Sequence
  Synthetic
aggccctggctgctgatatgacaaaactggaaggaaagatagttcaatatgaaaacttgaaatattcagtaatagtcaccgtccacactggagaccagcatcaggtgggaaatgaaagcagaccttttgggacagcggtg

SEQ ID NO: 373554 - DNA, 140 bp, Artificial Sequence
  Synthetic
caccgctgtcccaaaaggtctgctttcatttcccacctgatgctggtctccagtgtggacggtgactattactgaatatttcaagttttcatattgaactatctttccttccagttttgtcatatcagcagccagggcct

SEQ ID NO: 373555 - DNA, 140 bp, Artificial Sequence
  Synthetic
aggccctggctgctgatatgcgggtggtctttgcgggagacggcctgtctgggaaagtcttacgcccaaatgtggagcctgatgtactttcacagacgtgacctcaggctggcggcaaacgaccttttgggacagcggtg

SEQ ID NO: 373556 - DNA, 140 bp, Artificial Sequence
  Synthetic
caccgctgtcccaaaaggtcgtttgccgccagcctgaggtcacgtctgtgaaagtacatcaggctccacatttgggcgtaagactttcccagacaggccgtctcccgcaaagaccacccgcatatcagcagccagggcct

SEQ ID NO: 373557 - DNA, 140 bp, Artificial Sequence
  Synthetic
atacgccatgctgggtctcccagaacatgggacaactgcaactataacacctcaagctcctacgacggaaatacagctgaccgactacggagctcttacattggattgttcacctagaaccgtacttgggagtcggccat

SEQ ID NO: 373558 - DNA, 140 bp, Artificial Sequence
  Synthetic
atggccgactcccaagtacggttctaggtgaacaatccaatgtaagagctccgtagtcggtcagctgtatttccgtcgtaggagcttgaggtgttatagttgcagttgtcccatgttctgggagacccagcatggcgtat

SEQ ID NO: 373559 - DNA, 140 bp, Artificial Sequence
  Synthetic
atacgccatgctgggtctcctccacgcacgagatgtactggatatccaacggtaccggcaacatcgtctcttcagtcaatatggtatccagattgctactgaacagattcacaatgacaccgtacttgggagtcggccat

SEQ ID NO: 373560 - DNA, 140 bp, Artificial Sequence
  Synthetic
atggccgactcccaagtacggtgtcattgtgaatctgttcagtagcaatctggataccatattgactgaagagacgatgttgccggtaccgttggatatccagtacatctcgtgcgtggaggagacccagcatggcgtat

SEQ ID NO: 373561 - DNA, 140 bp, Artificial Sequence
  Synthetic
atacgccatgctgggtctccacaaatactcgtggaaaaattggggaaaggctaaaatcataggggcagatgtacagaactccaccttcatcattgacggcccaaacaccccagaatgctccgtacttgggagtcggccat

SEQ ID NO: 373562 - DNA, 140 bp, Artificial Sequence
  Synthetic
atggccgactcccaagtacggagcattctggggtgtttgggccgtcaatgatgaaggtggagttctgtacatctgcccctatgattttagcctttccccaatttttccacgagtatttgtggagacccagcatggcgtat

SEQ ID NO: 373563 - DNA, 140 bp, Artificial Sequence
  Synthetic
aggccctggctgctgatatgtaacatccagagaggttctccttcttacaattggactaagcctggtggcatccgcggagctaccaaattctttagaggagctaggggatggactcgcaatgaccttttgggacagcggtg

SEQ ID NO: 373564 - DNA, 140 bp, Artificial Sequence
  Synthetic
caccgctgtcccaaaaggtcattgcgagtccatcccctagctcctctaaagaatttggtagctccgcggatgccaccaggcttagtccaattgtaagaaggagaacctctctggatgttacatatcagcagccagggcct

SEQ ID NO: 373565 - DNA, 140 bp, Artificial Sequence
  Synthetic
atacgccatgctgggtctccgatgattgtgtggtgaaaccgatcgatgacaggtttgctaatgccctgcttgccctgaacgatatgggaaaggttaggaaggacatacctcaatggcagccgtacttgggagtcggccat

SEQ ID NO: 373566 - DNA, 140 bp, Artificial Sequence
  Synthetic
atggccgactcccaagtacggctgccattgaggtatgtccttcctaacctttcccatatcgttcagggcaagcagggcattagcaaacctgtcatcgatcggtttcaccacacaatcatcggagacccagcatggcgtat

SEQ ID NO: 373567 - DNA, 140 bp, Artificial Sequence
  Synthetic
atacgccatgctgggtctccggctgcacaagctgggttacattctaagagaagtgagcaagaaagaaggaggagcaatgtacgccgacgacacagcaggatgggacacaagaatcacactcgtacttgggagtcggccat

SEQ ID NO: 373568 - DNA, 140 bp, Artificial Sequence
  Synthetic
atggccgactcccaagtacgagtgtgattcttgtgtcccatcctgctgtgtcgtcggcgtacattgctcctccttctttcttgctcacttctcttagaatgtaacccagcttgtgcagccggagacccagcatggcgtat

SEQ ID NO: 373569 - DNA, 140 bp, Artificial Sequence
  Synthetic
aggccctggctgctgatatgcactaggactgctatgcatatcaataatgatcgaagaggtgatgagatccagatggagtagaaaaatgctgatgactggaacactggctgtgttcttcctgaccttttgggacagcggtg

SEQ ID NO: 373570 - DNA, 140 bp, Artificial Sequence
  Synthetic
caccgctgtcccaaaaggtcaggaagaacacagccagtgttccagtcatcagcatttttctactccatctggatctcatcacctcttcgatcattattgatatgcatagcagtcctagtgcatatcagcagccagggcct

SEQ ID NO: 373571 - DNA, 140 bp, Artificial Sequence
  Synthetic
aggccctggctgctgatatgtggaacagggtgtggatagaggacaatccatggatggaagacaaaactccagtcacaacttgggaggatgttccatacctagggaagagagaagatcaatgaccttttgggacagcggtg

SEQ ID NO: 373572 - DNA, 140 bp, Artificial Sequence
  Synthetic
caccgctgtcccaaaaggtcattgatcttctctcttccctaggtatggaacatcctcccaagttgtgactggagttttgtcttccatccatggattgtcctctatccacaccctgttccacatatcagcagccagggcct

SEQ ID NO: 373573 - DNA, 140 bp, Artificial Sequence
  Synthetic
atacgccatgctgggtctccccaccttaagccacagtacggaagaagctgtgcagcctgtgagccccgtccaaggacgttaaaagaagaagtcaggcccaaaagccacggtttgagcaaacgtacttgggagtcggccat

SEQ ID NO: 373574 - DNA, 140 bp, Artificial Sequence
  Synthetic
atggccgactcccaagtacgtttgctcaaaccgtggcttttgggcctgacttcttcttttaacgtccttggacggggctcacaggctgcacagcttcttccgtactgtggcttaaggtggggagacccagcatggcgtat

SEQ ID NO: 373575 - DNA, 140 bp, Artificial Sequence
  Synthetic
atacgccatgctgggtctccccaatggtgcggctcattgatagggttaacaagcagggccacctgggcaaagaacatccaaacagcaataaaccaagtcagatccttaataggcagtgagcgtacttgggagtcggccat

SEQ ID NO: 373576 - DNA, 140 bp, Artificial Sequence
  Synthetic
atggccgactcccaagtacgctcactgcctattaaggatctgacttggtttattgctgtttggatgttctttgcccaggtggccctgcttgttaaccctatcaatgagccgcaccattggggagacccagcatggcgtat

SEQ ID NO: 373577 - DNA, 140 bp, Artificial Sequence
  Synthetic
aggccctggctgctgatatgagaggggatcaacaaatgcactctcattgccatggacttgggtgaaatgtgtgaggacactgtcacgtataaatgccccctactggtgaataccgaacctgaccttttgggacagcggtg

SEQ ID NO: 373578 - DNA, 140 bp, Artificial Sequence
  Synthetic
caccgctgtcccaaaaggtcaggttcggtattcaccagtagggggcatttatacgtgacagtgtcctcacacatttcacccaagtccatggcaatgagagtgcatttgttgatcccctctcatatcagcagccagggcct

SEQ ID NO: 373579 - DNA, 140 bp, Artificial Sequence
  Synthetic
atacgccatgctgggtctccattctggctcccacaagggttgtcgcttccgaaatggcagaggcgctcaagggaatgccaataaggtaccaaacaacagcagtgaagagtgaacatacagcgtacttgggagtcggccat

SEQ ID NO: 373580 - DNA, 140 bp, Artificial Sequence
  Synthetic
atggccgactcccaagtacgctgtatgttcactcttcactgctgttgtttggtaccttattggcattcccttgagcgcctctgccatttcggaagcgacaacccttgtgggagccagaatggagacccagcatggcgtat

SEQ ID NO: 373581 - DNA, 140 bp, Artificial Sequence
  Synthetic
atacgccatgctgggtctccaattacaacatgattatcatggatgaagcacatttcaccgatccatccagcatagcggccagagggtacatctcaacccgagtgggcatgggtgaagcagcgtacttgggagtcggccat

SEQ ID NO: 373582 - DNA, 140 bp, Artificial Sequence
  Synthetic
atggccgactcccaagtacgctgcttcacccatgcccactcgggttgagatgtaccctctggccgctatgctggatggatcggtgaaatgtgcttcatccatgataatcatgttgtaattggagacccagcatggcgtat

SEQ ID NO: 373583 - DNA, 140 bp, Artificial Sequence
  Synthetic
aggccctggctgctgatatgatggaactcaggctatgagtggatcactgacttcccaggtaaaacagtctggtttgttccaagcattaaagcaggaaatgacattgccaactgcttaagagaccttttgggacagcggtg

SEQ ID NO: 373584 - DNA, 140 bp, Artificial Sequence
  Synthetic
caccgctgtcccaaaaggtctcttaagcagttggcaatgtcatttcctgctttaatgcttggaacaaaccagactgttttacctgggaagtcagtgatccactcatagcctgagttccatcatatcagcagccagggcct

SEQ ID NO: 373585 - DNA, 140 bp, Artificial Sequence
  Synthetic
atacgccatgctgggtctcctctaaggaagtactgtatagaggcaaagttaaccaacacaacaacagaatctcgctgtccaacacaaggggaacccagcctaaatgaagagcaggacaaacgtacttgggagtcggccat

SEQ ID NO: 373586 - DNA, 140 bp, Artificial Sequence
  Synthetic
atggccgactcccaagtacgtttgtcctgctcttcatttaggctgggttccccttgtgttggacagcgagattctgttgttgtgttggttaactttgcctctatacagtacttccttagaggagacccagcatggcgtat

SEQ ID NO: 373587 - DNA, 140 bp, Artificial Sequence
  Synthetic
atacgccatgctgggtctccggtgaagcaaggaaaacgtttgtggagctcatgagaagaggagatctacctgtctggctatcctacaaagttgcctcagaaggcttccagtactctgacacgtacttgggagtcggccat

SEQ ID NO: 373588 - DNA, 140 bp, Artificial Sequence
  Synthetic
atggccgactcccaagtacgtgtcagagtactggaagccttctgaggcaactttgtaggatagccagacaggtagatctcctcttctcatgagctccacaaacgttttccttgcttcaccggagacccagcatggcgtat

SEQ ID NO: 373589 - DNA, 140 bp, Artificial Sequence
  Synthetic
aggccctggctgctgatatgggtgagatgaagctgtagtctcactggaaggactagaggttagaggagacccccccgaaacaaaaaacagcatattgacgctgggaaagaccagagatccgaccttttgggacagcggtg

SEQ ID NO: 373590 - DNA, 140 bp, Artificial Sequence
  Synthetic
caccgctgtcccaaaaggtcggatctctggtctttcccagcgtcaatatgctgttttttgtttcgggggggtctcctctaacctctagtccttccagtgagactacagcttcatctcacccatatcagcagccagggcct

SEQ ID NO: 373591 - DNA, 140 bp, Artificial Sequence
  Synthetic
atacgccatgctgggtctcccccaattgtgacagaaaaggatagcccagtcaacatagaagcagaacctccattcggagacagctacgtcatcataggagtagagccggggcaattgaagcgtacttgggagtcggccat

SEQ ID NO: 373592 - DNA, 140 bp, Artificial Sequence
  Synthetic
atggccgactcccaagtacgcttcaattgccccggctctactcctatgatgacgtagctgtctccgaatggaggttctgcttctatgttgactgggctatccttttctgtcacaattgggggagacccagcatggcgtat

SEQ ID NO: 373593 - DNA, 140 bp, Artificial Sequence
  Synthetic
atacgccatgctgggtctcctggctgcaataatagcggccaatgaaatgggactgttggaaactacaaagagagatctaggaatgtctaaggagccaggtgttgtttctccaactagctacgtacttgggagtcggccat

SEQ ID NO: 373594 - DNA, 140 bp, Artificial Sequence
  Synthetic
atggccgactcccaagtacgtagctagttggagaaacaacacctggctccttagacattcctagatctctctttgtagtttccaacagtcccatttcattggccgctattattgcagccaggagacccagcatggcgtat

SEQ ID NO: 373595 - DNA, 140 bp, Artificial Sequence
  Synthetic
aggccctggctgctgatatgaatgaggggagcgaagagaatggctattctaggtgacacagcttgggattttggatccctgggaggagtgttcacatctataggaaaggctctccaccaggaccttttgggacagcggtg

SEQ ID NO: 373596 - DNA, 140 bp, Artificial Sequence
  Synthetic
caccgctgtcccaaaaggtcctggtggagagcctttcctatagatgtgaacactcctcccagggatccaaaatcccaagctgtgtcacctagaatagccattctcttcgctcccctcattcatatcagcagccagggcct

SEQ ID NO: 373597 - DNA, 140 bp, Artificial Sequence
  Synthetic
aggccctggctgctgatatggagtgggcatgggtgaagcagctgcgatcttcatgacagccactcccccaggatcagtggaggcctttccacagagcaacgcagttatccaagatgaggagaccttttgggacagcggtg

SEQ ID NO: 373598 - DNA, 140 bp, Artificial Sequence
  Synthetic
caccgctgtcccaaaaggtctcctcatcttggataactgcgttgctctgtggaaaggcctccactgatcctgggggagtggctgtcatgaagatcgcagctgcttcacccatgcccactccatatcagcagccagggcct

SEQ ID NO: 373599 - DNA, 140 bp, Artificial Sequence
  Synthetic
aggccctggctgctgatatgtttcagaggaagttatctagcaggagcaggtctggctttctcattaatgaaatctctaggaggaggtaggagaggcacgggagcccaaggggaaacactggaccttttgggacagcggtg

SEQ ID NO: 373600 - DNA, 140 bp, Artificial Sequence
  Synthetic
caccgctgtcccaaaaggtccagtgtttccccttgggctcccgtgcctctcctacctcctcctagagatttcattaatgagaaagccagacctgctcctgctagataacttcctctgaaacatatcagcagccagggcct

SEQ ID NO: 373601 - DNA, 140 bp, Artificial Sequence
  Synthetic
aggccctggctgctgatatgaagtgcctcaagagcatggaatgtgtgggaggtggaagattacgggtttggagtcttcacaaccaacatatggctgaaactccgagaggtgtacacccaagaccttttgggacagcggtg

SEQ ID NO: 373602 - DNA, 140 bp, Artificial Sequence
  Synthetic
caccgctgtcccaaaaggtcttgggtgtacacctctcggagtttcagccatatgttggttgtgaagactccaaacccgtaatcttccacctcccacacattccatgctcttgaggcacttcatatcagcagccagggcct

SEQ ID NO: 373603 - DNA, 140 bp, Artificial Sequence
  Synthetic
aggccctggctgctgatatgcttaacacagttctaacagtttatttgaatagagagcagatctctggaaaaatgaaccaacgaaaaaaggtggttagaccacctttcaatatgctgaaacgaccttttgggacagcggtg

SEQ ID NO: 373604 - DNA, 140 bp, Artificial Sequence
  Synthetic
caccgctgtcccaaaaggtcgtttcagcatattgaaaggtggtctaaccaccttttttcgttggttcatttttccagagatctgctctctattcaaataaactgttagaactgtgttaagcatatcagcagccagggcct

SEQ ID NO: 373605 - DNA, 140 bp, Artificial Sequence
  Synthetic
aggccctggctgctgatatgaatgaaccaacgaaaaaaggtggttagaccacctttcaatatgctgaaacgcgagagaaaccgcgtatcaacccctcaagggttggtgaagagattctcagaccttttgggacagcggtg

SEQ ID NO: 373606 - DNA, 140 bp, Artificial Sequence
  Synthetic
caccgctgtcccaaaaggtctgagaatctcttcaccaacccttgaggggttgatacgcggtttctctcgcgtttcagcatattgaaaggtggtctaaccaccttttttcgttggttcattcatatcagcagccagggcct

SEQ ID NO: 373607 - DNA, 140 bp, Artificial Sequence
  Synthetic
atacgccatgctgggtctcccacgtttttgcgagtcctttccatcccaccaacagcagggattctgaagagatggggacagttgaagaaaaataaggccatcaagatactgattggattccgtacttgggagtcggccat

SEQ ID NO: 373608 - DNA, 140 bp, Artificial Sequence
  Synthetic
atggccgactcccaagtacggaatccaatcagtatcttgatggccttatttttcttcaactgtccccatctcttcagaatccctgctgttggtgggatggaaaggactcgcaaaaacgtgggagacccagcatggcgtat

SEQ ID NO: 373609 - DNA, 140 bp, Artificial Sequence
  Synthetic
aggccctggctgctgatatggatggggacagttgaagaaaaataaggccatcaagatactgattggattcaggaaggagataggccgcatgctgaacatcttgaacgggagaaaaaggtcgaccttttgggacagcggtg

SEQ ID NO: 373610 - DNA, 140 bp, Artificial Sequence
  Synthetic
caccgctgtcccaaaaggtcgacctttttctcccgttcaagatgttcagcatgcggcctatctccttcctgaatccaatcagtatcttgatggccttatttttcttcaactgtccccatccatatcagcagccagggcct

SEQ ID NO: 373611 - DNA, 140 bp, Artificial Sequence
  Synthetic
aggccctggctgctgatatgcgtactcctctcccagagcaccataccagagaccattcttgaactgactgatgcgttagccttgggcatgatggtcctcaaaatagtgagaaaaatggaagaccttttgggacagcggtg

SEQ ID NO: 373612 - DNA, 140 bp, Artificial Sequence
  Synthetic
caccgctgtcccaaaaggtcttccatttttctcactattttgaggaccatcatgcccaaggctaacgcatcagtcagttcaagaatggtctctggtatggtgctctgggagaggagtacgcatatcagcagccagggcct

SEQ ID NO: 373613 - DNA, 140 bp, Artificial Sequence
  Synthetic
aggccctggctgctgatatggtacaagagaggagttcacaagaaaagttaggtcaaacgcagccattggagcagtgttcgttgatgaaaatcaatggaactcagcaaaagaagcagtggagaccttttgggacagcggtg

SEQ ID NO: 373614 - DNA, 140 bp, Artificial Sequence
  Synthetic
caccgctgtcccaaaaggtctccactgcttcttttgctgagttccattgattttcatcaacgaacactgctccaatggctgcgtttgacctaacttttcttgtgaactcctctcttgtaccatatcagcagccagggcct

SEQ ID NO: 373615 - DNA, 140 bp, Artificial Sequence
  Synthetic
atacgccatgctgggtctccagtgatattacaaaacgcatggaaagtgagctgcacaatattggcagtggtgtccgtttccccactgctcttaacatcctcacagcaaaaagcggattggcgtacttgggagtcggccat

SEQ ID NO: 373616 - DNA, 140 bp, Artificial Sequence
  Synthetic
atggccgactcccaagtacgccaatccgctttttgctgtgaggatgttaagagcagtggggaaacggacaccactgccaatattgtgcagctcactttccatgcgttttgtaatatcactggagacccagcatggcgtat

SEQ ID NO: 373617 - DNA, 140 bp, Artificial Sequence
  Synthetic
aggccctggctgctgatatgctatcatggcagtcgggatggtgagcattttagccagttcacttctaaagaatgacattcccatgacaggaccactagtggctggagggctcctcactgtgaccttttgggacagcggtg

SEQ ID NO: 373618 - DNA, 140 bp, Artificial Sequence
  Synthetic
caccgctgtcccaaaaggtcacagtgaggagccctccagccactagtggtcctgtcatgggaatgtcattctttagaagtgaactggctaaaatgctcaccatcccgactgccatgatagcatatcagcagccagggcct

SEQ ID NO: 373619 - DNA, 140 bp, Artificial Sequence
  Synthetic
aggccctggctgctgatatgcgacctggtgctagaacatggaggatgcgtcacaaccatggcccagggaaaaccaaccttggattttgaactgaccaagacaacagccaaggaagtggctgaccttttgggacagcggtg

SEQ ID NO: 373620 - DNA, 140 bp, Artificial Sequence
  Synthetic
caccgctgtcccaaaaggtcagccacttccttggctgttgtcttggtcagttcaaaatccaaggttggttttccctgggccatggttgtgacgcatcctccatgttctagcaccaggtcgcatatcagcagccagggcct

SEQ ID NO: 373621 - DNA, 140 bp, Artificial Sequence
  Synthetic
aggccctggctgctgatatgggtaagggtacagagaccagcaaaaaatggaaccgtgatggatgtcatatccagacgtgaccagagaggaagtggccaggttggaacttatggcttaaacgaccttttgggacagcggtg

SEQ ID NO: 373622 - DNA, 140 bp, Artificial Sequence
  Synthetic
caccgctgtcccaaaaggtcgtttaagccataagttccaacctggccacttcctctctggtcacgtctggatatgacatccatcacggttccattttttgctggtctctgtacccttacccatatcagcagccagggcct

SEQ ID NO: 373623 - DNA, 140 bp, Artificial Sequence
  Synthetic
aggccctggctgctgatatgctgttaagaacctattgcattgaagccttaatatcaaacataaccacggcaacaagatgtccaacgcaaggagagccttatctgaaagaggaacaggaccgaccttttgggacagcggtg

SEQ ID NO: 373624 - DNA, 140 bp, Artificial Sequence
  Synthetic
caccgctgtcccaaaaggtcggtcctgttcctctttcagataaggctctccttgcgttggacatcttgttgccgtggttatgtttgatattaaggcttcaatgcaataggttcttaacagcatatcagcagccagggcct

SEQ ID NO: 373625 - DNA, 140 bp, Artificial Sequence
  Synthetic
atacgccatgctgggtctccaacagtacatttgccgtagagatgtggtagatagaggatggggcaatggctgtggcttgtttggaaaaggaggagttgtgacatgtgcgaagttctcatgcgtacttgggagtcggccat

SEQ ID NO: 373626 - DNA, 140 bp, Artificial Sequence
  Synthetic
atggccgactcccaagtacgcatgagaacttcgcacatgtcacaactcctccttttccaaacaagccacagccattgccccatcctctatctaccacatctctacggcaaatgtactgttggagacccagcatggcgtat

SEQ ID NO: 373627 - DNA, 140 bp, Artificial Sequence
  Synthetic
atacgccatgctgggtctcctgaagtcaaactgccggactatggagaactaacactcgattgtgaacccaggtctggaattgacttcaatgagatgatcctaatgaaaatgaaaaagaaacgtacttgggagtcggccat

SEQ ID NO: 373628 - DNA, 140 bp, Artificial Sequence
  Synthetic
atggccgactcccaagtacgtttctttttcattttcattaggatcatctcattgaagtcaattccagacctgggttcacaatcgagtgttagttctccatagtccggcagtttgacttcaggagacccagcatggcgtat

SEQ ID NO: 373629 - DNA, 140 bp, Artificial Sequence
  Synthetic
atacgccatgctgggtctccacatggctcgtgcataagcaatggtttttggatctgcctcttccatggacgacaggagcagatacatcagaggttcactggaattacaaagagagaatggcgtacttgggagtcggccat

SEQ ID NO: 373630 - DNA, 140 bp, Artificial Sequence
  Synthetic
atggccgactcccaagtacgccattctctctttgtaattccagtgaacctctgatgtatctgctcctgtcgtccatggaagaggcagatccaaaaaccattgcttatgcacgagccatgtggagacccagcatggcgtat

SEQ ID NO: 373631 - DNA, 140 bp, Artificial Sequence
  Synthetic
aggccctggctgctgatatgctctggacttttctcctggaacgtcaggatcaccaatcattgacaaaaaaggaaaggtggtgggtctttatggtaacggcgttgttacaaggaatggagcgaccttttgggacagcggtg

SEQ ID NO: 373632 - DNA, 140 bp, Artificial Sequence
  Synthetic
caccgctgtcccaaaaggtcgctccattccttgtaacaacgccgttaccataaagacccaccacctttccttttttgtcaatgattggtgatcctgacgttccaggagaaaagtccagagcatatcagcagccagggcct

SEQ ID NO: 373633 - DNA, 140 bp, Artificial Sequence
  Synthetic
atacgccatgctgggtctccatcaatggtgtggatctctgataggcttaacagcaagggccacctgggccaccaacatacaagtggccataaaccaagtgagaagactaattgggaatgacgtacttgggagtcggccat

SEQ ID NO: 373634 - DNA, 140 bp, Artificial Sequence
  Synthetic
atggccgactcccaagtacgtcattcccaattagtcttctcacttggtttatggccacttgtatgttggtggcccaggtggcccttgctgttaagcctatcagagatccacaccattgatggagacccagcatggcgtat

SEQ ID NO: 373635 - DNA, 140 bp, Artificial Sequence
  Synthetic
atacgccatgctgggtctccggtgaaagtcaagtatgaaggtgctggagctccgtgtaaagtccccatagagataagagatgtaaacaaggaaaaagtggttgggcgcgttatctcagcccgtacttgggagtcggccat

SEQ ID NO: 373636 - DNA, 140 bp, Artificial Sequence
  Synthetic
atggccgactcccaagtacgggctgagataacgcgcccaaccactttttccttgtttacatctcttatctctatggggactttacacggagctccagcaccttcatacttgactttcaccggagacccagcatggcgtat

SEQ ID NO: 373637 - DNA, 140 bp, Artificial Sequence
  Synthetic
atacgccatgctgggtctccacccctttggctgagaacaccaatagtgtaaccaacatagaattagaacccccctttggggacagctacatagtgataggtgttggaaacagcgcactaacgtacttgggagtcggccat

SEQ ID NO: 373638 - DNA, 140 bp, Artificial Sequence
  Synthetic
atggccgactcccaagtacgttagtgcgctgtttccaacacctatcactatgtagctgtccccaaaggggggttctaattctatgttggttacactattggtgttctcagccaaaggggtggagacccagcatggcgtat

SEQ ID NO: 373639 - DNA, 140 bp, Artificial Sequence
  Synthetic
aggccctggctgctgatatgattacaacctgattatcatggacgaagcccatttcacagacccagcaagtatagcggccagaggatacatttcaactcgagtggaaatgggtgaggcagcgaccttttgggacagcggtg

SEQ ID NO: 373640 - DNA, 140 bp, Artificial Sequence
  Synthetic
caccgctgtcccaaaaggtcgctgcctcacccatttccactcgagttgaaatgtatcctctggccgctatacttgctgggtctgtgaaatgggcttcgtccatgataatcaggttgtaatcatatcagcagccagggcct

SEQ ID NO: 373641 - DNA, 140 bp, Artificial Sequence
  Synthetic
atacgccatgctgggtctccttttggttccgttggtggactgttcacatcattgggaaaggctgtgcaccaggtttttggaagtgtgtatacaaccatgtttggaggagtctcatggatgcgtacttgggagtcggccat

SEQ ID NO: 373642 - DNA, 140 bp, Artificial Sequence
  Synthetic
atggccgactcccaagtacgcatccatgagactcctccaaacatggttgtatacacacttccaaaaacctggtgcacagcctttcccaatgatgtgaacagtccaccaacggaaccaaaaggagacccagcatggcgtat

SEQ ID NO: 373643 - DNA, 140 bp, Artificial Sequence
  Synthetic
aggccctggctgctgatatggaacacttcaatggccatgacgtgcatagctgttgggggaatcactctgtttttgggcttcacggttcaagcggacatgggttgtgtggtgtcatggagtgaccttttgggacagcggtg

SEQ ID NO: 373644 - DNA, 140 bp, Artificial Sequence
  Synthetic
caccgctgtcccaaaaggtcactccatgacaccacacaacccatgtccgcttgaaccgtgaagcccaaaaacagagtgattcccccaacagctatgcacgtcatggccattgaagtgttccatatcagcagccagggcct

SEQ ID NO: 373645 - DNA, 140 bp, Artificial Sequence
  Synthetic
aggccctggctgctgatatgaccacgaggctggaaaatgttatgtggaagcaaataaccaatgagctaaactatgttctctgggaaggaggacatgatctcactgtagtggctggggacggaccttttgggacagcggtg

SEQ ID NO: 373646 - DNA, 140 bp, Artificial Sequence
  Synthetic
caccgctgtcccaaaaggtccgtccccagccactacagtgagatcatgtcctccttcccagagaacatagtttagctcattggttatttgcttccacataacattttccagcctcgtggtcatatcagcagccagggcct

SEQ ID NO: 373647 - DNA, 140 bp, Artificial Sequence
  Synthetic
aggccctggctgctgatatgggattatcccagccctcttcgagccggagagagaaaagagtgcagcaatagacggagaatacagactgcggggtgaagcaaggaaaacgtttgtggagctgaccttttgggacagcggtg

SEQ ID NO: 373648 - DNA, 140 bp, Artificial Sequence
  Synthetic
caccgctgtcccaaaaggtcagctccacaaacgttttccttgcttcaccccgcagtctgtattctccgtctattgctgcactcttttctctctccggctcgaagagggctgggataatcccatatcagcagccagggcct

SEQ ID NO: 373649 - DNA, 140 bp, Artificial Sequence
  Synthetic
aggccctggctgctgatatggatctgaaatattcatggaagacatgggggaaagcaaaaatcttcacccctgaagcaagaaacagcacatttttaatagacggaccagatacctctgaatgaccttttgggacagcggtg

SEQ ID NO: 373650 - DNA, 140 bp, Artificial Sequence
  Synthetic
caccgctgtcccaaaaggtcattcagaggtatctggtccgtctattaaaaatgtgctgtttcttgcttcaggggtgaagatttttgctttcccccatgtcttccatgaatatttcagatccatatcagcagccagggcct

SEQ ID NO: 373651 - DNA, 140 bp, Artificial Sequence
  Synthetic
aggccctggctgctgatatggaattttcacgacaaacatatggctgaaattgcgtgactcctacacccaagtgtgtgaccaccggctaatgtcagctgccatcaaggacagcaaggcagtgaccttttgggacagcggtg

SEQ ID NO: 373652 - DNA, 140 bp, Artificial Sequence
  Synthetic
caccgctgtcccaaaaggtcactgccttgctgtccttgatggcagctgacattagccggtggtcacacacttgggtgtaggagtcacgcaatttcagccatatgtttgtcgtgaaaattccatatcagcagccagggcct

SEQ ID NO: 373653 - DNA, 140 bp, Artificial Sequence
  Synthetic
atacgccatgctgggtctccgccccaatgaacgaagagcatggaattcttttgaggtggaagactatggatttggcatgttcacgaccaacatatggatgaaattccgagaaggaagttccgtacttgggagtcggccat

SEQ ID NO: 373654 - DNA, 140 bp, Artificial Sequence
  Synthetic
atggccgactcccaagtacggaacttccttctcggaatttcatccatatgttggtcgtgaacatgccaaatccatagtcttccacctcaaaagaattccatgctcttcgttcattggggcggagacccagcatggcgtat

SEQ ID NO: 373655 - DNA, 140 bp, Artificial Sequence
  Synthetic
atacgccatgctgggtctccagaagtgtgtgaccacaggctgatgtcagctgcaattaaagaccagaaagctgtgcatgctgacatgggttattggatagagagctcaaaaaaccagacccgtacttgggagtcggccat

SEQ ID NO: 373656 - DNA, 140 bp, Artificial Sequence
  Synthetic
atggccgactcccaagtacgggtctggttttttgagctctctatccaataacccatgtcagcatgcacagctttctggtctttaattgcagctgacatcagcctgtggtcacacacttctggagacccagcatggcgtat

SEQ ID NO: 373657 - DNA, 140 bp, Artificial Sequence
  Synthetic
aggccctggctgctgatatgctgtgcatgctgacatgggttattggatagagagctcaaaaaaccagacctggcagatagagagagcatctctcattgaagtgaaaacatgtctgtggccgaccttttgggacagcggtg

SEQ ID NO: 373658 - DNA, 140 bp, Artificial Sequence
  Synthetic
caccgctgtcccaaaaggtcggccacagacatgttttcacttcaatgagagatgctctctctatctgccaggtctggttttttgagctctctatccaataacccatgtcagcatgcacagcatatcagcagccagggcct

SEQ ID NO: 373659 - DNA, 140 bp, Artificial Sequence
  Synthetic
atacgccatgctgggtctccagatggttggacgccaggatctattctgacccactagcgctaaaagaattcaaggaatttgcagctggaagaaagtccttgaccctgaacctaatcacagcgtacttgggagtcggccat

SEQ ID NO: 373660 - DNA, 140 bp, Artificial Sequence
  Synthetic
atggccgactcccaagtacgctgtgattaggttcagggtcaaggactttcttccagctgcaaattccttgaattcttttagcgctagtgggtcagaatagatcctggcgtccaaccatctggagacccagcatggcgtat

SEQ ID NO: 373661 - DNA, 140 bp, Artificial Sequence
  Synthetic
aggccctggctgctgatatgtatgctacgcaaaccgtgggtccatggcacttgggcaaactagagatagactttggagaatgccccggaacaacagttacaattcaggagaattgtgaccgaccttttgggacagcggtg

SEQ ID NO: 373662 - DNA, 140 bp, Artificial Sequence
  Synthetic
caccgctgtcccaaaaggtcggtcacaattctcctgaattgtaactgttgttccggggcattctccaaagtctatctctagtttgcccaagtgccatggacccacggtttgcgtagcatacatatcagcagccagggcct

SEQ ID NO: 373663 - DNA, 140 bp, Artificial Sequence
  Synthetic
aggccctggctgctgatatgagatgggtgctggtatgggatggagattaggcccttgagtgaaaaagaagagaacatggttaaatcacaggtgacggccggacagggcacatcggaaactgaccttttgggacagcggtg

SEQ ID NO: 373664 - DNA, 140 bp, Artificial Sequence
  Synthetic
caccgctgtcccaaaaggtcagtttccgatgtgccctgtccggccgtcacctgtgatttaaccatgttctcttctttttcactcaagggcctaatctccatcccataccagcacccatctcatatcagcagccagggcct

SEQ ID NO: 373665 - DNA, 140 bp, Artificial Sequence
  Synthetic
aggccctggctgctgatatggtgctatcatcctggggggcctcacatggatggacttgctacgagccctcatcatgttgggggacactatgtctggcagaataggaggacagacccacctgaccttttgggacagcggtg

SEQ ID NO: 373666 - DNA, 140 bp, Artificial Sequence
  Synthetic
caccgctgtcccaaaaggtcaggtgggtctgtcctcctattctgccagacatagtgtcccccaacatgatgagggctcgtagcaagtccatccatgtgaggccccccaggatgatagcaccatatcagcagccagggcct

SEQ ID NO: 373667 - DNA, 140 bp, Artificial Sequence
  Synthetic
aggccctggctgctgatatgagccatcatggcagtgttcaagatgtcaccaggatacgtgctgggtgtgtttttaaggaaactcacttcaagagagacagcactaatggtaataggaatggaccttttgggacagcggtg

SEQ ID NO: 373668 - DNA, 140 bp, Artificial Sequence
  Synthetic
caccgctgtcccaaaaggtccattcctattaccattagtgctgtctctcttgaagtgagtttccttaaaaacacacccagcacgtatcctggtgacatcttgaacactgccatgatggctcatatcagcagccagggcct

SEQ ID NO: 373669 - DNA, 140 bp, Artificial Sequence
  Synthetic
aggccctggctgctgatatgtggaatatcactaggactaatattgctaaaaatagtaacacagtttgacaacacccaagtgggaaccttagctctttccttgactttcataagatcaacagaccttttgggacagcggtg

SEQ ID NO: 373670 - DNA, 140 bp, Artificial Sequence
  Synthetic
caccgctgtcccaaaaggtctgttgatcttatgaaagtcaaggaaagagctaaggttcccacttgggtgttgtcaaactgtgttactatttttagcaatattagtcctagtgatattccacatatcagcagccagggcct

SEQ ID NO: 373671 - DNA, 140 bp, Artificial Sequence
  Synthetic
atacgccatgctgggtctccaaccaggtgttggaggagaacatggatgtggagatctggacaaaagaaggagaaagagagaaactacgaccccgctggctgggtgccagaacatactcagcgtacttgggagtcggccat

SEQ ID NO: 373672 - DNA, 140 bp, Artificial Sequence
  Synthetic
atggccgactcccaagtacgctgagtatgttctggcacccagccagcggggtcgtagtttctctctttctccttcttttgtccagatctccacatccatgttctcctccaacacctggttggagacccagcatggcgtat

SEQ ID NO: 373673 - DNA, 140 bp, Artificial Sequence
  Synthetic
atacgccatgctgggtctccgtgccaaattacaacctgatcatcatggacgaagcccacttcacagacccagcaagtatagcagctagaggatacatctcaactcgagtagagatgggtgcgtacttgggagtcggccat

SEQ ID NO: 373674 - DNA, 140 bp, Artificial Sequence
  Synthetic
atggccgactcccaagtacgcacccatctctactcgagttgagatgtatcctctagctgctatacttgctgggtctgtgaagtgggcttcgtccatgatgatcaggttgtaatttggcacggagacccagcatggcgtat

SEQ ID NO: 373675 - DNA, 140 bp, Artificial Sequence
  Synthetic
atacgccatgctgggtctccgggaaacatgtatgcagatgacacagccggatgggatacaaggataacagaggatgacctccagaatgaggccaaaattactgacatcatggaacccgaacgtacttgggagtcggccat

SEQ ID NO: 373676 - DNA, 140 bp, Artificial Sequence
  Synthetic
atggccgactcccaagtacgttcgggttccatgatgtcagtaattttggcctcattctggaggtcatcctctgttatccttgtatcccatccggctgtgtcatctgcatacatgtttcccggagacccagcatggcgtat

SEQ ID NO: 373677 - DNA, 140 bp, Artificial Sequence
  Synthetic
atacgccatgctgggtctccctaatgactcttatgaaaggagcctcaagaagatcttggcctcttaacgaaggcataatggctgtgggtttggttagtctcttaggaagcgctcttttaacgtacttgggagtcggccat

SEQ ID NO: 373678 - DNA, 140 bp, Artificial Sequence
  Synthetic
atggccgactcccaagtacgttaaaagagcgcttcctaagagactaaccaaacccacagccattatgccttcgttaagaggccaagatcttcttgaggctcctttcataagagtcattagggagacccagcatggcgtat

SEQ ID NO: 373679 - DNA, 140 bp, Artificial Sequence
  Synthetic
atacgccatgctgggtctccagaatgatgtccctttagctggcccaatggtggcaggaggcttacttctggcggcttacgtaatgagtggcagctcagcagatctgtcactagagaaggccgtacttgggagtcggccat

SEQ ID NO: 373680 - DNA, 140 bp, Artificial Sequence
  Synthetic
atggccgactcccaagtacggccttctctagtgacagatctgctgagctgccactcattacgtaagccgccagaagtaagcctcctgccaccattgggccagctaaagggacatcattctggagacccagcatggcgtat

SEQ ID NO: 373681 - DNA, 140 bp, Artificial Sequence
  Synthetic
aggccctggctgctgatatggcggcttacgtaatgagtggcagctcagcagatctgtcactagagaaggccgctaatgtgcagtgggatgaaatggcagacataacaggctcaagtccaagaccttttgggacagcggtg

SEQ ID NO: 373682 - DNA, 140 bp, Artificial Sequence
  Synthetic
caccgctgtcccaaaaggtcttggacttgagcctgttatgtctgccatttcatcccactgcacattagcggccttctctagtgacagatctgctgagctgccactcattacgtaagccgccatatcagcagccagggcct

SEQ ID NO: 373683 - DNA, 140 bp, Artificial Sequence
  Synthetic
atacgccatgctgggtctcctcatagaagtgaagcaagatgaggatggctctttctccatacgggacgtcgaggaaaccaatatgataacccttttggtgaaactggcactgataacggtcgtacttgggagtcggccat

SEQ ID NO: 373684 - DNA, 140 bp, Artificial Sequence
  Synthetic
atggccgactcccaagtacgaccgttatcagtgccagtttcaccaaaagggttatcatattggtttcctcgacgtcccgtatggagaaagagccatcctcatcttgcttcacttctatgaggagacccagcatggcgtat

SEQ ID NO: 373685 - DNA, 140 bp, Artificial Sequence
  Synthetic
aggccctggctgctgatatgtagccggcccactaatagctggaggcatgctgatagcatgttacgtcatatccggaagctcagctgatttatcattggagagagcggctgaggtctcctggaccttttgggacagcggtg

SEQ ID NO: 373686 - DNA, 140 bp, Artificial Sequence
  Synthetic
caccgctgtcccaaaaggtccaggagacctcagccgctctctccaatgataaatcagctgagcttccggatatgacgtaacatgctatcagcatgcctccagctattagtgggccggctacatatcagcagccagggcct

SEQ ID NO: 373687 - DNA, 140 bp, Artificial Sequence
  Synthetic
atacgccatgctgggtctcccacgagactgggagattggagccatcttgggctgacgtcaggaatgacatgatatcatacggtgggggatggaggcttggagataaatgggacaaagaagcgtacttgggagtcggccat

SEQ ID NO: 373688 - DNA, 140 bp, Artificial Sequence
  Synthetic
atggccgactcccaagtacgcttctttgtcccatttatctccaagcctccatcccccaccgtatgatatcatgtcattcctgacgtcagcccaagatggctccaatctcccagtctcgtgggagacccagcatggcgtat

SEQ ID NO: 373689 - DNA, 140 bp, Artificial Sequence
  Synthetic
aggccctggctgctgatatgaacattagatttcaaacccggaacgtctggttctcccattatcaacaggaaaggaaaagtcatcggactctatggaaatggagtggttaccaaatcaggtgaccttttgggacagcggtg

SEQ ID NO: 373690 - DNA, 140 bp, Artificial Sequence
  Synthetic
caccgctgtcccaaaaggtcacctgatttggtaaccactccatttccatagagtccgatgacttttcctttcctgttgataatgggagaaccagacgttccgggtttgaaatctaatgttcatatcagcagccagggcct

SEQ ID NO: 373691 - DNA, 140 bp, Artificial Sequence
  Synthetic
aggccctggctgctgatatgtgaagtggatgaggacatttttcggaagaaaagactaactataatggacttacaccccggagctggaaagacaaaaagaattcttccatcaatagtgagagaccttttgggacagcggtg

SEQ ID NO: 373692 - DNA, 140 bp, Artificial Sequence
  Synthetic
caccgctgtcccaaaaggtctctcactattgatggaagaattctttttgtctttccagctccggggtgtaagtccattatagttagtcttttcttccgaaaaatgtcctcatccacttcacatatcagcagccagggcct

SEQ ID NO: 373693 - DNA, 140 bp, Artificial Sequence
  Synthetic
aggccctggctgctgatatgaaaccccagctgtgaaatcagaacacacaggaagagagattgtggacctcatgtgccatgcaaccttcacaacaagacttttgtcatcaaccagagttccgaccttttgggacagcggtg

SEQ ID NO: 373694 - DNA, 140 bp, Artificial Sequence
  Synthetic
caccgctgtcccaaaaggtcggaactctggttgatgacaaaagtcttgttgtgaaggttgcatggcacatgaggtccacaatctctcttcctgtgtgttctgatttcacagctggggtttcatatcagcagccagggcct

SEQ ID NO: 373695 - DNA, 140 bp, Artificial Sequence
  Synthetic
atacgccatgctgggtctccagttgttagtctacgtggaccgacaagaacagtttcgaatcggaagcttgcttaacgtagttctgacagttttttattagagagcagatctctgatgaaccgtacttgggagtcggccat

SEQ ID NO: 373696 - DNA, 140 bp, Artificial Sequence
  Synthetic
atggccgactcccaagtacggttcatcagagatctgctctctaataaaaaactgtcagaactacgttaagcaagcttccgattcgaaactgttcttgtcggtccacgtagactaacaactggagacccagcatggcgtat

SEQ ID NO: 373697 - DNA, 140 bp, Artificial Sequence
  Synthetic
aggccctggctgctgatatggcagccatcttcatgaccgcaacccctcccggagcgacggatccctttccccagagcaacagcccaatagaagacatcgagagagagattccggaaaggtgaccttttgggacagcggtg

SEQ ID NO: 373698 - DNA, 140 bp, Artificial Sequence
  Synthetic
caccgctgtcccaaaaggtcacctttccggaatctctctctcgatgtcttctattgggctgttgctctggggaaagggatccgtcgctccgggaggggttgcggtcatgaagatggctgccatatcagcagccagggcct

SEQ ID NO: 373699 - DNA, 140 bp, Artificial Sequence
  Synthetic
atacgccatgctgggtctccaatatccaaaaacgaagctcacggactgggactttgtggtcactacagacatatctgaaatgggggctaactttagagctgggagagtgatagaccctagcgtacttgggagtcggccat

SEQ ID NO: 373700 - DNA, 140 bp, Artificial Sequence
  Synthetic
atggccgactcccaagtacgctagggtctatcactctcccagctctaaagttagcccccatttcagatatgtctgtagtgaccacaaagtcccagtccgtgagcttcgtttttggatattggagacccagcatggcgtat

SEQ ID NO: 373701 - DNA, 140 bp, Artificial Sequence
  Synthetic
aggccctggctgctgatatgatatctgaaatgggggctaactttagagctgggagagtgatagaccctagaagatgcctcaagccagttatcctaacagatgggccagagagagtcatccgaccttttgggacagcggtg

SEQ ID NO: 373702 - DNA, 140 bp, Artificial Sequence
  Synthetic
caccgctgtcccaaaaggtcggatgactctctctggcccatctgttaggataactggcttgaggcatcttctagggtctatcactctcccagctctaaagttagcccccatttcagatatcatatcagcagccagggcct

SEQ ID NO: 373703 - DNA, 140 bp, Artificial Sequence
  Synthetic
aggccctggctgctgatatgggtccggaaagggaaaaaacccaagctattgatggagagtttcgcctcagaggggaacaaaggaagacttttgtggaattaatgaggagaggagaccttcgaccttttgggacagcggtg

SEQ ID NO: 373704 - DNA, 140 bp, Artificial Sequence
  Synthetic
caccgctgtcccaaaaggtcgaaggtctcctctcctcattaattccacaaaagtcttcctttgttcccctctgaggcgaaactctccatcaatagcttgggttttttccctttccggacccatatcagcagccagggcct

SEQ ID NO: 373705 - DNA, 140 bp, Artificial Sequence
  Synthetic
atacgccatgctgggtctcccggtgtggctgagttataaggtagcttctgctggcatttcttacaaagatcgggaatggtgcttcactggggaaagaaataaccaaattttagaagaaaacgtacttgggagtcggccat

SEQ ID NO: 373706 - DNA, 140 bp, Artificial Sequence
  Synthetic
atggccgactcccaagtacgttttcttctaaaatttggttatttctttccccagtgaagcaccattcccgatctttgtaagaaatgccagcagaagctaccttataactcagccacaccgggagacccagcatggcgtat

SEQ ID NO: 373707 - DNA, 140 bp, Artificial Sequence
  Synthetic
aggccctggctgctgatatgttgacaacatagttatgctccacacaacagaaagaggagggagggcctatcaacacgccctgaacgaacttccggagtcactggaaacactcatgcttgtgaccttttgggacagcggtg

SEQ ID NO: 373708 - DNA, 140 bp, Artificial Sequence
  Synthetic
caccgctgtcccaaaaggtcacaagcatgagtgtttccagtgactccggaagttcgttcagggcgtgttgataggccctccctcctctttctgttgtgtggagcataactatgttgtcaacatatcagcagccagggcct

SEQ ID NO: 373709 - DNA, 140 bp, Artificial Sequence
  Synthetic
atacgccatgctgggtctcctgtagaaaccaggatgaattaattggtagagcccgaatttcccagggagctggatggtctttgagggagacagcctgtttagggaagtcttatgcccaaacgtacttgggagtcggccat

SEQ ID NO: 373710 - DNA, 140 bp, Artificial Sequence
  Synthetic
atggccgactcccaagtacgtttgggcataagacttccctaaacaggctgtctccctcaaagaccatccagctccctgggaaattcgggctctaccaattaattcatcctggtttctacaggagacccagcatggcgtat

SEQ ID NO: 373711 - DNA, 140 bp, Artificial Sequence
  Synthetic
aggccctggctgctgatatgttcaagcctggaacttcaggatctcctatcataaacagagagggaaaggtagtgggactgtatggtaatggagtggttacaaagaatggtggctacgtcagaccttttgggacagcggtg

SEQ ID NO: 373712 - DNA, 140 bp, Artificial Sequence
  Synthetic
caccgctgtcccaaaaggtctgacgtagccaccattctttgtaaccactccattaccatacagtcccactacctttccctctctgtttatgataggagatcctgaagttccaggcttgaacatatcagcagccagggcct

SEQ ID NO: 373713 - DNA, 140 bp, Artificial Sequence
  Synthetic
atacgccatgctgggtctccaacaaaaacggattttgggttttaccaggtaaaaacagaaaccaccatcctcgatgtggacctgagaccagcttcagcatggacgctctatgcggtagcccgtacttgggagtcggccat

SEQ ID NO: 373714 - DNA, 140 bp, Artificial Sequence
  Synthetic
atggccgactcccaagtacgggctaccgcatagagcgtccatgctgaagctggtctcaggtccacatcgaggatggtggtttctgtttttacctggtaaaacccaaaatccgtttttgttggagacccagcatggcgtat

SEQ ID NO: 373715 - DNA, 140 bp, Artificial Sequence
  Synthetic
atacgccatgctgggtctccaccacaattctgactcccatgctgagacacaccatagaaaatacgtcggccaacctatctttagcagccattgccaaccaggcagccgtcctaatggggccgtacttgggagtcggccat

SEQ ID NO: 373716 - DNA, 140 bp, Artificial Sequence
  Synthetic
atggccgactcccaagtacggccccattaggacggctgcctggttggcaatggctgctaaagataggttggccgacgtattttctatggtgtgtctcagcatgggagtcagaattgtggtggagacccagcatggcgtat

SEQ ID NO: 373717 - DNA, 140 bp, Artificial Sequence
  Synthetic
aggccctggctgctgatatggcaatgggatgctattctcaagtgaacccaacaaccttgacagcatccttagtcatgcttctagtccattatgcaataataggcccaggattgcaggcaagaccttttgggacagcggtg

SEQ ID NO: 373718 - DNA, 140 bp, Artificial Sequence
  Synthetic
caccgctgtcccaaaaggtcttgcctgcaatcctgggcctattattgcataatggactagaagcatgactaaggatgctgtcaaggttgttgggttcacttgagaatagcatcccattgccatatcagcagccagggcct

SEQ ID NO: 373719 - DNA, 140 bp, Artificial Sequence
  Synthetic
atacgccatgctgggtctccctggacaactactcttgatgagaacaacatgggctttctgtgaagtcttgactttggctacaggaccaatcttgaccttgtgggagggcaacccgggaagcgtacttgggagtcggccat

SEQ ID NO: 373720 - DNA, 140 bp, Artificial Sequence
  Synthetic
atggccgactcccaagtacgcttcccgggttgccctcccacaaggtcaagattggtcctgtagccaaagtcaagacttcacagaaagcccatgttgttctcatcaagagtagttgtccagggagacccagcatggcgtat

SEQ ID NO: 373721 - DNA, 140 bp, Artificial Sequence
  Synthetic
aggccctggctgctgatatgactttggctacaggaccaatcttgaccttgtgggagggcaacccgggaaggttttggaacacgaccatagccgtatctaccgccaacattttcaggggaagaccttttgggacagcggtg

SEQ ID NO: 373722 - DNA, 140 bp, Artificial Sequence
  Synthetic
caccgctgtcccaaaaggtcttcccctgaaaatgttggcggtagatacggctatggtcgtgttccaaaaccttcccgggttgccctcccacaaggtcaagattggtcctgtagccaaagtcatatcagcagccagggcct

SEQ ID NO: 373723 - DNA, 140 bp, Artificial Sequence
  Synthetic
aggccctggctgctgatatggaagagacagctaaactcattagacagaaaagagtttgaagagtataaaagaagtggaatactagaagtggacaggactgaagccaagtccgccctgaaagaccttttgggacagcggtg

SEQ ID NO: 373724 - DNA, 140 bp, Artificial Sequence
  Synthetic
caccgctgtcccaaaaggtctttcagggcggacttggcttcagtcctgtccacttctagtattccacttcttttatactcttcaaactcttttctgtctaatgagtttagctgtctcttccatatcagcagccagggcct

SEQ ID NO: 373725 - DNA, 140 bp, Artificial Sequence
  Synthetic
aggccctggctgctgatatgacacgaactgaaacatggatgtcatcagaaggggcctggaaacatgcccagagaattgaaacctggatcttgagacatccaggttttaccataatggcaggaccttttgggacagcggtg

SEQ ID NO: 373726 - DNA, 140 bp, Artificial Sequence
  Synthetic
caccgctgtcccaaaaggtcctgccattatggtaaaacctggatgtctcaagatccaggtttcaattctctgggcatgtttccaggccccttctgatgacatccatgtttcagttcgtgtcatatcagcagccagggcct

SEQ ID NO: 373727 - DNA, 140 bp, Artificial Sequence
  Synthetic
atacgccatgctgggtctccgctgaagtactcatggaaaacatggggaaaggcgaaaatgctctctacagagtctcacaatcagacctttcttattgatggccctgaaacagcagaatgccgtacttgggagtcggccat

SEQ ID NO: 373728 - DNA, 140 bp, Artificial Sequence
  Synthetic
atggccgactcccaagtacggcattctgctgtttcagggccatcaataagaaaggtctgattgtgagactctgtagagagcattttcgcctttccccatgttttccatgagtacttcagcggagacccagcatggcgtat

SEQ ID NO: 373729 - DNA, 140 bp, Artificial Sequence
  Synthetic
atacgccatgctgggtctccgtgactgaagtgaaagggtatacaaaaggaggtccaggacatgaagaaccgattcctatggctacttatggctggaatttggtcaaactccattcaggggcgtacttgggagtcggccat

SEQ ID NO: 373730 - DNA, 140 bp, Artificial Sequence
  Synthetic
atggccgactcccaagtacgcccctgaatggagtttgaccaaattccagccataagtagccataggaatcggttcttcatgtcctggacctccttttgtataccctttcacttcagtcacggagacccagcatggcgtat

SEQ ID NO: 373731 - DNA, 140 bp, Artificial Sequence
  Synthetic
atacgccatgctgggtctccttgacgtgttctacaaacccacagagcaagtggacaccctgctctgtgatattggggagtcatcttctaatccaacaatagaggaaggaagaacattgagcgtacttgggagtcggccat

SEQ ID NO: 373732 - DNA, 140 bp, Artificial Sequence
  Synthetic
atggccgactcccaagtacgctcaatgttcttccttcctctattgttggattagaagatgactccccaatatcacagagcagggtgtccacttgctctgtgggtttgtagaacacgtcaaggagacccagcatggcgtat

SEQ ID NO: 373733 - DNA, 140 bp, Artificial Sequence
  Synthetic
aggccctggctgctgatatgccaacattggactttgaactgataaaaacagaagccaagcaacctgccactctaaggaagtactgtatagaagcaaagctgaccaacacaacaacagcatgaccttttgggacagcggtg

SEQ ID NO: 373734 - DNA, 140 bp, Artificial Sequence
  Synthetic
caccgctgtcccaaaaggtcatgctgttgttgtgttggtcagctttgcttctatacagtacttccttagagtggcaggttgcttggcttctgtttttatcagttcaaagtccaatgttggcatatcagcagccagggcct

SEQ ID NO: 373735 - DNA, 140 bp, Artificial Sequence
  Synthetic
atacgccatgctgggtctccagttttgaagatggtggagccatggctctcttcaaaacctgaattctgcatcaaggtccttaacccctacatgccaacagtcatagaagagctggagaaacgtacttgggagtcggccat

SEQ ID NO: 373736 - DNA, 140 bp, Artificial Sequence
  Synthetic
atggccgactcccaagtacgtttctccagctcttctatgactgttggcatgtaggggttaaggaccttgatgcagaattcaggttttgaagagagccatggctccaccatcttcaaaactggagacccagcatggcgtat

SEQ ID NO: 373737 - DNA, 140 bp, Artificial Sequence
  Synthetic
aggccctggctgctgatatgactatggtatatttggcaagtgaaaacacaaagatcaggagctctgtgggacgtcccctcgcccgctgccactcagaaagccacactgtctgaaggggtggaccttttgggacagcggtg

SEQ ID NO: 373738 - DNA, 140 bp, Artificial Sequence
  Synthetic
caccgctgtcccaaaaggtccaccccttcagacagtgtggctttctgagtggcagcgggcgaggggacgtcccacagagctcctgatctttgtgttttcacttgccaaatataccatagtcatatcagcagccagggcct

SEQ ID NO: 373739 - DNA, 140 bp, Artificial Sequence
  Synthetic
atacgccatgctgggtctcccataggaaacccacttatgagaaggacgtagatcttggggcaggaacgagaagtgtctccactgaaacagaaaaaccagacatgacaatcattgggagaacgtacttgggagtcggccat

SEQ ID NO: 373740 - DNA, 140 bp, Artificial Sequence
  Synthetic
atggccgactcccaagtacgttctcccaatgattgtcatgtctggtttttctgtttcagtggagacacttctcgttcctgccccaagatctacgtccttctcataagtgggtttcctatgggagacccagcatggcgtat

SEQ ID NO: 373741 - DNA, 140 bp, Artificial Sequence
  Synthetic
aggccctggctgctgatatgaagtgtctccactgaaacagaaaaaccagacatgacaatcattgggagaaggcttcagcgattgcaagaagagcacaaagaaacatggcattatgatcaagaccttttgggacagcggtg

SEQ ID NO: 373742 - DNA, 140 bp, Artificial Sequence
  Synthetic
caccgctgtcccaaaaggtcttgatcataatgccatgtttctttgtgctcttcttgcaatcgctgaagccttctcccaatgattgtcatgtctggtttttctgtttcagtggagacacttcatatcagcagccagggcct

SEQ ID NO: 373743 - DNA, 140 bp, Artificial Sequence
  Synthetic
atacgccatgctgggtctccgaaaacccatacagaacctgggcgtatcatggaagctatgaagctccttcgacaggctctgcgtcctccatggtgaacggggtggtgaaactgctaacaacgtacttgggagtcggccat

SEQ ID NO: 373744 - DNA, 140 bp, Artificial Sequence
  Synthetic
atggccgactcccaagtacgttgttagcagtttcaccaccccgttcaccatggaggacgcagagcctgtcgaaggagcttcatagcttccatgatacgcccaggttctgtatgggttttcggagacccagcatggcgtat

SEQ ID NO: 373745 - DNA, 140 bp, Artificial Sequence
  Synthetic
atacgccatgctgggtctccaccccttttgggcaacaaagagtgttcaaagagaaggtggataccagaacaccgcaaccaaaaccaggcacacgaatggttatgaccacgacagccaattcgtacttgggagtcggccat

SEQ ID NO: 373746 - DNA, 140 bp, Artificial Sequence
  Synthetic
atggccgactcccaagtacgaattggctgtcgtggtcataaccattcgtgtgcctggttttggttgcggtgttctggtatccaccttctctttgaacactctttgttgcccaaaaggggtggagacccagcatggcgtat

SEQ ID NO: 373747 - DNA, 140 bp, Artificial Sequence
  Synthetic
aggccctggctgctgatatgaccgcaaccaaaaccaggcacacgaatggttatgaccacgacagccaattggctatgggccctccttggaaagaagaaaaatcccagactgtgcacaagggaccttttgggacagcggtg

SEQ ID NO: 373748 - DNA, 140 bp, Artificial Sequence
  Synthetic
caccgctgtcccaaaaggtcccttgtgcacagtctgggatttttcttctttccaaggagggcccatagccaattggctgtcgtggtcataaccattcgtgtgcctggttttggttgcggtcatatcagcagccagggcct

SEQ ID NO: 373749 - DNA, 140 bp, Artificial Sequence
  Synthetic
aggccctggctgctgatatgccaagaggaacagggatggacatcagccagtgaagctgtgaatgacagccggttttgggaactggttgacaaagaaagggcccttcaccaagaagggaaagaccttttgggacagcggtg

SEQ ID NO: 373750 - DNA, 140 bp, Artificial Sequence
  Synthetic
caccgctgtcccaaaaggtctttcccttcttggtgaagggccctttctttgtcaaccagttcccaaaaccggctgtcattcacagcttcactggctgatgtccatccctgttcctcttggcatatcagcagccagggcct

SEQ ID NO: 373751 - DNA, 140 bp, Artificial Sequence
  Synthetic
atacgccatgctgggtctccgcacctcactgtctgtgtcactagtattagtgggagtcgtgacattgtatttgggagttatggtgcaggctgatagtggttgtgttgtgagttggaaaaacgtacttgggagtcggccat

SEQ ID NO: 373752 - DNA, 140 bp, Artificial Sequence
  Synthetic
atggccgactcccaagtacgtttttccaactcacaacacaaccactatcagcctgcaccataactcccaaatacaatgtcacgactcccactaatactagtgacacagacagtgaggtgcggagacccagcatggcgtat

SEQ ID NO: 373753 - DNA, 140 bp, Artificial Sequence
  Synthetic
aggccctggctgctgatatgtcgtcaccaacgaggtccatacctggacagagcagtacaaattccaagcggattccccaaaaagattggcgacagctattgtaggtgcttgggaaaatgggaccttttgggacagcggtg

SEQ ID NO: 373754 - DNA, 140 bp, Artificial Sequence
  Synthetic
caccgctgtcccaaaaggtcccattttcccaagcacctacaatagctgtcgccaatctttttggggaatccgcttggaatttgtactgctctgtccaggtatggacctcgttggtgacgacatatcagcagccagggcct

SEQ ID NO: 373755 - DNA, 140 bp, Artificial Sequence
  Synthetic
aggccctggctgctgatatggagcgcggtttctggaatttgaagccctgggttttttgaatgaagatcattggtttggcagagaaaactcatggagtggagtggaaggggaaggtctgcagaccttttgggacagcggtg

SEQ ID NO: 373756 - DNA, 140 bp, Artificial Sequence
  Synthetic
caccgctgtcccaaaaggtctgcagaccttccccttccactccactccatgagttttctctgccaaaccaatgatcttcattcaaaaaacccagggcttcaaattccagaaaccgcgctccatatcagcagccagggcct

SEQ ID NO: 373757 - DNA, 140 bp, Artificial Sequence
  Synthetic
atacgccatgctgggtctcccagattgggatacatcctggaggagatagacaagaaggatggagacctaatgtatgctgatgacacagcaggctgggacacaagaatcactgaggatgaccgtacttgggagtcggccat

SEQ ID NO: 373758 - DNA, 140 bp, Artificial Sequence
  Synthetic
atggccgactcccaagtacggtcatcctcagtgattcttgtgtcccagcctgctgtgtcatcagcatacattaggtctccatccttcttgtctatctcctccaggatgtatcccaatctgggagacccagcatggcgtat

SEQ ID NO: 373759 - DNA, 140 bp, Artificial Sequence
  Synthetic
aggccctggctgctgatatgtgtatgctgatgacacagcaggctgggacacaagaatcactgaggatgacctccaaaatgaggaactgatcacggaacagatggctccccaccacaagatgaccttttgggacagcggtg

SEQ ID NO: 373760 - DNA, 140 bp, Artificial Sequence
  Synthetic
caccgctgtcccaaaaggtcatcttgtggtggggagccatctgttccgtgatcagttcctcattttggaggtcatcctcagtgattcttgtgtcccagcctgctgtgtcatcagcatacacatatcagcagccagggcct

SEQ ID NO: 373761 - DNA, 140 bp, Artificial Sequence
  Synthetic
atacgccatgctgggtctcccctagccaaagccattttcaaactaacctaccaaaacaaagtggtgaaagtcctcagacccacaccgagaggagcggtgatggatatcatatccaggaaacgtacttgggagtcggccat

SEQ ID NO: 373762 - DNA, 140 bp, Artificial Sequence
  Synthetic
atggccgactcccaagtacgtttcctggatatgatatccatcaccgctcctctcggtgtgggtctgaggactttcaccactttgttttggtaggttagtttgaaaatggctttggctaggggagacccagcatggcgtat

SEQ ID NO: 373763 - DNA, 140 bp, Artificial Sequence
  Synthetic
aggccctggctgctgatatgtcctcagacccacaccgagaggagcggtgatggatatcatatccaggaaagaccagagaggtagtggacaagttggaacatatggtttgaacacattcacgaccttttgggacagcggtg

SEQ ID NO: 373764 - DNA, 140 bp, Artificial Sequence
  Synthetic
caccgctgtcccaaaaggtcgtgaatgtgttcaaaccatatgttccaacttgtccactacctctctggtctttcctggatatgatatccatcaccgctcctctcggtgtgggtctgaggacatatcagcagccagggcct

SEQ ID NO: 373765 - DNA, 140 bp, Artificial Sequence
  Synthetic
aggccctggctgctgatatgtcacacacaaacggcaggaccctggcatctaggcaagcttgagatggactttgatttttgcgaaggaaccacagtggtggtgactgaagactgtggaaatgaccttttgggacagcggtg

SEQ ID NO: 373766 - DNA, 140 bp, Artificial Sequence
  Synthetic
caccgctgtcccaaaaggtcatttccacagtcttcagtcaccaccactgtggttccttcgcaaaaatcaaagtccatctcaagcttgcctagatgccagggtcctgccgtttgtgtgtgacatatcagcagccagggcct

SEQ ID NO: 373767 - DNA, 140 bp, Artificial Sequence
  Synthetic
atacgccatgctgggtctccagacgattgcgtggtgaaacccctagatgagaggtttggcacctccctcctcttcttgaacgacatgggaaaggtgaggaaagacattccgcagtgggaacgtacttgggagtcggccat

SEQ ID NO: 373768 - DNA, 140 bp, Artificial Sequence
  Synthetic
atggccgactcccaagtacgttcccactgcggaatgtctttcctcacctttcccatgtcgttcaagaagaggagggaggtgccaaacctctcatctaggggtttcaccacgcaatcgtctggagacccagcatggcgtat

SEQ ID NO: 373769 - DNA, 140 bp, Artificial Sequence
  Synthetic
aggccctggctgctgatatggtcgcttatgtacttccacagaagggatctgcgtttagcctccatggccatatgctcagcagttccaacggaatggtttccaacaagcagaacaacatgggaccttttgggacagcggtg

SEQ ID NO: 373770 - DNA, 140 bp, Artificial Sequence
  Synthetic
caccgctgtcccaaaaggtcccatgttgttctgcttgttggaaaccattccgttggaactgctgagcatatggccatggaggctaaacgcagatcccttctgtggaagtacataagcgaccatatcagcagccagggcct

SEQ ID NO: 373771 - DNA, 140 bp, Artificial Sequence
  Synthetic
aggccctggctgctgatatggtggaacagagtgtggatagaagacaaccccaatatgattgacaagactccagtccattcgtgggaagatataccttacctagggaaaagagaggatttggaccttttgggacagcggtg

SEQ ID NO: 373772 - DNA, 140 bp, Artificial Sequence
  Synthetic
caccgctgtcccaaaaggtccaaatcctctcttttccctaggtaaggtatatcttcccacgaatggactggagtcttgtcaatcatattggggttgtcttctatccacactctgttccaccatatcagcagccagggcct

SEQ ID NO: 373773 - DNA, 140 bp, Artificial Sequence
  Synthetic
aggccctggctgctgatatgaagtatcaattagcagtgactatcatggctatcttatgtgttccaaatgcagtgatattacaaaatgcatggaaagtgagctgcacaatactggcagtgggaccttttgggacagcggtg

SEQ ID NO: 373774 - DNA, 140 bp, Artificial Sequence
  Synthetic
caccgctgtcccaaaaggtcccactgccagtattgtgcagctcactttccatgcattttgtaatatcactgcatttggaacacataagatagccatgatagtcactgctaattgatacttcatatcagcagccagggcct

SEQ ID NO: 373775 - DNA, 140 bp, Artificial Sequence
  Synthetic
atacgccatgctgggtctccgaaggagttctgtaatcaccaacaacaaacaccaaaggctattgaagtcaggccacttgtgccacggcttgagcaaaccgtgctgcctgtagctccgccacgtacttgggagtcggccat

SEQ ID NO: 373776 - DNA, 140 bp, Artificial Sequence
  Synthetic
atggccgactcccaagtacgtggcggagctacaggcagcacggtttgctcaagccgtggcacaagtggcctgacttcaatagcctttggtgtttgttgttggtgattacagaactccttcggagacccagcatggcgtat

SEQ ID NO: 373777 - DNA, 140 bp, Artificial Sequence
  Synthetic
aggccctggctgctgatatgggccacttgtgccacggcttgagcaaaccgtgctgcctgtagctccgccaataatgggaggcgtaataatccctagggaggccatgcgccacggaagctggaccttttgggacagcggtg

SEQ ID NO: 373778 - DNA, 140 bp, Artificial Sequence
  Synthetic
caccgctgtcccaaaaggtccagcttccgtggcgcatggcctccctagggattattacgcctcccattattggcggagctacaggcagcacggtttgctcaagccgtggcacaagtggcccatatcagcagccagggcct

SEQ ID NO: 373779 - DNA, 140 bp, Artificial Sequence
  Synthetic
atacgccatgctgggtctccataatgggaggcgtaataatccctagggaggccatgcgccacggaagctgtacgcgtggcatattggactagcggttagaggagacccctcccatcactgcgtacttgggagtcggccat

SEQ ID NO: 373780 - DNA, 140 bp, Artificial Sequence
  Synthetic
atggccgactcccaagtacgcagtgatgggaggggtctcctctaaccgctagtccaatatgccacgcgtacagcttccgtggcgcatggcctccctagggattattacgcctcccattatggagacccagcatggcgtat

SEQ ID NO: 373781 - DNA, 140 bp, Artificial Sequence
  Synthetic
aggccctggctgctgatatgaaccggactcttttccgggaaaggacccttacggatggtgttagcattcatcacgtttctgcgagtcctttccatcccaccaacagcagggattctgaaagaccttttgggacagcggtg

SEQ ID NO: 373782 - DNA, 140 bp, Artificial Sequence
  Synthetic
caccgctgtcccaaaaggtctttcagaatccctgctgttggtgggatggaaaggactcgcagaaacgtgatgaatgctaacaccatccgtaagggtcctttcccggaaaagagtccggttcatatcagcagccagggcct

SEQ ID NO: 373783 - DNA, 140 bp, Artificial Sequence
  Synthetic
atacgccatgctgggtctccgaccataggctaatgtcggcagccgtcaaggatgagagggccgtgcatgccgacatgggctattggatagaaagccaaaagaatggaagttggaagctagcgtacttgggagtcggccat

SEQ ID NO: 373784 - DNA, 140 bp, Artificial Sequence
  Synthetic
atggccgactcccaagtacgctagcttccaacttccattcttttggctttctatccaatagcccatgtcggcatgcacggccctctcatccttgacggctgccgacattagcctatggtcggagacccagcatggcgtat

SEQ ID NO: 373785 - DNA, 140 bp, Artificial Sequence
  Synthetic
aggccctggctgctgatatgcagaaaggagataggccgtatgctgaacatcttgaatggaaggaaaaggtcaacaataacattgttgtgcttgattcccaccgtaatggcgtttcacttggaccttttgggacagcggtg

SEQ ID NO: 373786 - DNA, 140 bp, Artificial Sequence
  Synthetic
caccgctgtcccaaaaggtccaagtgaaacgccattacggtgggaatcaagcacaacaatgttattgttgaccttttccttccattcaagatgttcagcatacggcctatctcctttctgcatatcagcagccagggcct

SEQ ID NO: 373787 - DNA, 140 bp, Artificial Sequence
  Synthetic
atacgccatgctgggtctcctcaacgagagatggcgaaccccttatgatagtggcgaaacacgaaagggggagacctctcttgtttaagacaacagaaggaatcaacaagtgcactctcacgtacttgggagtcggccat

SEQ ID NO: 373788 - DNA, 140 bp, Artificial Sequence
  Synthetic
atggccgactcccaagtacgtgagagtgcacttgttgattccttctgttgtcttaaacaagagaggtctccccctttcgtgtttcgccactatcataaggggttcgccatctctcgttgaggagacccagcatggcgtat

SEQ ID NO: 373789 - DNA, 140 bp, Artificial Sequence
  Synthetic
aggccctggctgctgatatggagacctctcttgtttaagacaacagaaggaatcaacaagtgcactctcattgctatggacctgggtgaaatgtgcgaggacaccgttacgtataaatgcgaccttttgggacagcggtg

SEQ ID NO: 373790 - DNA, 140 bp, Artificial Sequence
  Synthetic
caccgctgtcccaaaaggtcgcatttatacgtaacggtgtcctcgcacatttcacccaggtccatagcaatgagagtgcacttgttgattccttctgttgtcttaaacaagagaggtctccatatcagcagccagggcct

SEQ ID NO: 373791 - DNA, 140 bp, Artificial Sequence
  Synthetic
aggccctggctgctgatatggacgagagaagcgctcagtagctctaacaccacattcaggaatgggactggaaacaagggctgaaacatggatgtcatcggaaggagcttggaaacacgcgaccttttgggacagcggtg

SEQ ID NO: 373792 - DNA, 140 bp, Artificial Sequence
  Synthetic
caccgctgtcccaaaaggtcgcgtgtttccaagctccttccgatgacatccatgtttcagcccttgtttccagtcccattcctgaatgtggtgttagagctactgagcgcttctctcgtccatatcagcagccagggcct

SEQ ID NO: 373793 - DNA, 140 bp, Artificial Sequence
  Synthetic
atacgccatgctgggtctccgaaacaagggctgaaacatggatgtcatcggaaggagcttggaaacacgcccagagggtagagagttggatactcagaaacccaggattcgcgctcttggcgtacttgggagtcggccat

SEQ ID NO: 373794 - DNA, 140 bp, Artificial Sequence
  Synthetic
atggccgactcccaagtacgccaagagcgcgaatcctgggtttctgagtatccaactctctaccctctgggcgtgtttccaagctccttccgatgacatccatgtttcagcccttgtttcggagacccagcatggcgtat

SEQ ID NO: 373795 - DNA, 140 bp, Artificial Sequence
  Synthetic
atacgccatgctgggtctcccaggatttatggcctatatgattgggcaaacaggaatccagcggacagtcttctttattttaatgatgctggtcgctccatcctacggaatgcgatgtgtcgtacttgggagtcggccat

SEQ ID NO: 373796 - DNA, 140 bp, Artificial Sequence
  Synthetic
atggccgactcccaagtacgacacatcgcattccgtaggatggagcgaccagcatcattaaaataaagaagactgtccgctggattcctgtttgcccaatcatataggccataaatcctgggagacccagcatggcgtat

SEQ ID NO: 373797 - DNA, 140 bp, Artificial Sequence
  Synthetic
atacgccatgctgggtctccaggagtggggaacagagactttgtggaaggagtctcaggtggagcatgggtcgatctggtgctagaacatggaggatgtgtcacaaccatggcccagggacgtacttgggagtcggccat

SEQ ID NO: 373798 - DNA, 140 bp, Artificial Sequence
  Synthetic
atggccgactcccaagtacgtccctgggccatggttgtgacacatcctccatgttctagcaccagatcgacccatgctccacctgagactccttccacaaagtctctgttccccactcctggagacccagcatggcgtat

SEQ ID NO: 373799 - DNA, 140 bp, Artificial Sequence
  Synthetic
atacgccatgctgggtctccaccagagcgtgaaaaagtggatgccattgatggtgaataccgcttaagaggagaagcgaggaaaacctttgtggagctaatgagaagaggagacctaccacgtacttgggagtcggccat

SEQ ID NO: 373800 - DNA, 140 bp, Artificial Sequence
  Synthetic
atggccgactcccaagtacgtggtaggtctcctcttctcattagctccacaaaggttttcctcgcttctcctcttaagcggtattcaccatcaatggcatccactttttcacgctctggtggagacccagcatggcgtat

SEQ ID NO: 373801 - DNA, 140 bp, Artificial Sequence
  Synthetic
aggccctggctgctgatatgcaacaagatgtccaacgcaaggagagccctacctcaaagaggaacaagatcaacagtacatctgccggagagacgtggtagacagagggtggggcaatgggaccttttgggacagcggtg

SEQ ID NO: 373802 - DNA, 140 bp, Artificial Sequence
  Synthetic
caccgctgtcccaaaaggtcccattgccccaccctctgtctaccacgtctctccggcagatgtactgttgatcttgttcctctttgaggtagggctctccttgcgttggacatcttgttgcatatcagcagccagggcct

SEQ ID NO: 373803 - DNA, 140 bp, Artificial Sequence
  Synthetic
atacgccatgctgggtctccctgtggcctgtttgggaaaggaggagttgtgacatgtgcgaagttttcatgctcggggaagataacaggcaacttaatccaaattgagaacctagaataccgtacttgggagtcggccat

SEQ ID NO: 373804 - DNA, 140 bp, Artificial Sequence
  Synthetic
atggccgactcccaagtacggtattctaggttctcaatttggattaagttgcctgttatcttccccgagcatgaaaacttcgcacatgtcacaactcctcctttcccaaacaggccacagggagacccagcatggcgtat

SEQ ID NO: 373805 - DNA, 140 bp, Artificial Sequence
  Synthetic
aggccctggctgctgatatggctcggggaagataacaggcaacttaatccaaattgagaacctagaatacacagtggttgtaacagtccacaatggagacacccatgcagtaggaaatgagaccttttgggacagcggtg

SEQ ID NO: 373806 - DNA, 140 bp, Artificial Sequence
  Synthetic
caccgctgtcccaaaaggtctcatttcctactgcatgggtgtctccattgtggactgttacaaccactgtgtattctaggttctcaatttggattaagttgcctgttatcttccccgagccatatcagcagccagggcct

SEQ ID NO: 373807 - DNA, 140 bp, Artificial Sequence
  Synthetic
atacgccatgctgggtctcccacatccaaccacggagtgacagccacggtaacccccaggtcaccatcggtagaagttgaattgccggactatggagaattgacactcgattgtgagccccgtacttgggagtcggccat

SEQ ID NO: 373808 - DNA, 140 bp, Artificial Sequence
  Synthetic
atggccgactcccaagtacggggctcacaatcgagtgtcaattctccatagtccggcaattcaacttctaccgatggtgacctgggggttaccgtggctgtcactccgtggttggatgtgggagacccagcatggcgtat

SEQ ID NO: 373809 - DNA, 140 bp, Artificial Sequence
  Synthetic
aggccctggctgctgatatgtagaagttgaattgccggactatggagaattgacactcgattgtgagcccaggtccggaattgactttaatgagatgattctgatgaaaatgaataagaagaccttttgggacagcggtg

SEQ ID NO: 373810 - DNA, 140 bp, Artificial Sequence
  Synthetic
caccgctgtcccaaaaggtcttcttattcattttcatcagaatcatctcattaaagtcaattccggacctgggctcacaatcgagtgtcaattctccatagtccggcaattcaacttctacatatcagcagccagggcct

SEQ ID NO: 373811 - DNA, 140 bp, Artificial Sequence
  Synthetic
atacgccatgctgggtctcctcatgctctcagtgaactgccagagaccctggagacattgcttttgctcacgctcttggccacagtcacgggcggaatctttttattcttgatgagtggacgtacttgggagtcggccat

SEQ ID NO: 373812 - DNA, 140 bp, Artificial Sequence
  Synthetic
atggccgactcccaagtacgtccactcatcaagaataaaaagattccgcccgtgactgtggccaagagcgtgagcaaaagcaatgtctccagggtctctggcagttcactgagagcatgaggagacccagcatggcgtat

SEQ ID NO: 373813 - DNA, 140 bp, Artificial Sequence
  Synthetic
atacgccatgctgggtctccaacgtggcttgtgcacaagcaatggtttttggatctacctctaccatggacagcaggagcagacacgtcagaagttcattggaatcacaaagaaagaatgcgtacttgggagtcggccat

SEQ ID NO: 373814 - DNA, 140 bp, Artificial Sequence
  Synthetic
atggccgactcccaagtacgcattctttctttgtgattccaatgaacttctgacgtgtctgctcctgctgtccatggtagaggtagatccaaaaaccattgcttgtgcacaagccacgttggagacccagcatggcgtat

SEQ ID NO: 373815 - DNA, 140 bp, Artificial Sequence
  Synthetic
aggccctggctgctgatatgcagcaggagcagacacgtcagaagttcattggaatcacaaagaaagaatggtgacgtttaaggtccctcatgccaagagacaggatgtgacagtgctagggaccttttgggacagcggtg

SEQ ID NO: 373816 - DNA, 140 bp, Artificial Sequence
  Synthetic
caccgctgtcccaaaaggtccctagcactgtcacatcctgtctcttggcatgagggaccttaaacgtcaccattctttctttgtgattccaatgaacttctgacgtgtctgctcctgctgcatatcagcagccagggcct

SEQ ID NO: 373817 - DNA, 140 bp, Artificial Sequence
  Synthetic
atacgccatgctgggtctccatctcaggaaggagccatgcattcagccctcaccggagccacagaagtagattccggtgatggaaaccacatgtttgcaggacatttgaaatgcaaagttcgtacttgggagtcggccat

SEQ ID NO: 373818 - DNA, 140 bp, Artificial Sequence
  Synthetic
atggccgactcccaagtacgaactttgcatttcaaatgtcctgcaaacatgtggtttccatcaccggaatctacttctgtggctccggtgagggctgaatgcatggctccttcctgagatggagacccagcatggcgtat

SEQ ID NO: 373819 - DNA, 140 bp, Artificial Sequence
  Synthetic
aggccctggctgctgatatgaaagttctcaattgataaagagatggcagaaacacagcatgggacaacagtggtaaaagtcaagtatgagggtgctggagctccatgcaaagttcccatagaccttttgggacagcggtg

SEQ ID NO: 373820 - DNA, 140 bp, Artificial Sequence
  Synthetic
caccgctgtcccaaaaggtctatgggaactttgcatggagctccagcaccctcatacttgacttttaccactgttgtcccatgctgtgtttctgccatctctttatcaattgagaactttcatatcagcagccagggcct

SEQ ID NO: 373821 - DNA, 140 bp, Artificial Sequence
  Synthetic
atacgccatgctgggtctccgagataagagatgtgaacaaggaaaaagtggttgggcgtatcatctcatctactccttttgctgagaataccaacagtgtgaccaatatagaattggaaccgtacttgggagtcggccat

SEQ ID NO: 373822 - DNA, 140 bp, Artificial Sequence
  Synthetic
atggccgactcccaagtacggttccaattctatattggtcacactgttggtattctcagcaaaaggagtagatgagatgatacgcccaaccactttttccttgttcacatctcttatctcggagacccagcatggcgtat

SEQ ID NO: 373823 - DNA, 140 bp, Artificial Sequence
  Synthetic
atacgccatgctgggtctcccctcagtgaatgtgtctctaacagccattgccaatcaagccacagtgctaatgggtcttgggaagggatggccattgtcaaaaatggacattggagttcccgtacttgggagtcggccat

SEQ ID NO: 373824 - DNA, 140 bp, Artificial Sequence
  Synthetic
atggccgactcccaagtacgggaactccaatgtccatttttgacaatggccatcccttcccaagacccattagcactgtggcttgattggcaatggctgttagagacacattcactgaggggagacccagcatggcgtat

SEQ ID NO: 373825 - DNA, 140 bp, Artificial Sequence
  Synthetic
atacgccatgctgggtctccccccctttggggatagctacatagtaataggtgtaggagacagcgcactgacacttcattggttcaggaaagggagttccatcggtaagatgtttgagtccgtacttgggagtcggccat

SEQ ID NO: 373826 - DNA, 140 bp, Artificial Sequence
  Synthetic
atggccgactcccaagtacggactcaaacatcttaccgatggaactccctttcctgaaccaatgaagtgtcagtgcgctgtctcctacacctattactatgtagctatccccaaagggggggagacccagcatggcgtat

SEQ ID NO: 373827 - DNA, 140 bp, Artificial Sequence
  Synthetic
atacgccatgctgggtctcccacatacagaggcgcaaagcgcatggccattctaggtgaaacagcttgggattttggttctgttggtggactgctcacatcattgggaaaggctgtacaccgtacttgggagtcggccat

SEQ ID NO: 373828 - DNA, 140 bp, Artificial Sequence
  Synthetic
atggccgactcccaagtacggtgtacagcctttcccaatgatgtgagcagtccaccaacagaaccaaaatcccaagctgtttcacctagaatggccatgcgctttgcgcctctgtatgtgggagacccagcatggcgtat

SEQ ID NO: 373829 - DNA, 140 bp, Artificial Sequence
  Synthetic
aggccctggctgctgatatgattttggttctgttggtggactgctcacatcattgggaaaggctgtacaccaagtttttggtagtgtgtatacaactatgttcggaggagtctcatggatgaccttttgggacagcggtg

SEQ ID NO: 373830 - DNA, 140 bp, Artificial Sequence
  Synthetic
caccgctgtcccaaaaggtcatccatgagactcctccgaacatagttgtatacacactaccaaaaacttggtgtacagcctttcccaatgatgtgagcagtccaccaacagaaccaaaatcatatcagcagccagggcct

SEQ ID NO: 373831 - DNA, 140 bp, Artificial Sequence
  Synthetic
atacgccatgctgggtctccggttagaattctaattgggttcttagtgttgtggattggcacgaattcaagaaacacctcaatggcaatgtcatgcatagctgttggagggattactttgcgtacttgggagtcggccat

SEQ ID NO: 373832 - DNA, 140 bp, Artificial Sequence
  Synthetic
atggccgactcccaagtacgcaaagtaatccctccaacagctatgcatgacattgccattgaggtgtttcttgaattcgtgccaatccacaacactaagaacccaattagaattctaaccggagacccagcatggcgtat

SEQ ID NO: 373833 - DNA, 140 bp, Artificial Sequence
  Synthetic
aggccctggctgctgatatgtgggaaagaattgaagtgtggaagcggaatctttataattgacaacgtgcacacttggacagaacagtacaagttccaaccagagtcaccagcgagactagaccttttgggacagcggtg

SEQ ID NO: 373834 - DNA, 140 bp, Artificial Sequence
  Synthetic
caccgctgtcccaaaaggtctagtctcgctggtgactctggttggaacttgtactgttctgtccaagtgtgcacgttgtcaattataaagattccgcttccacacttcaattctttcccacatatcagcagccagggcct

SEQ ID NO: 373835 - DNA, 140 bp, Artificial Sequence
  Synthetic
atacgccatgctgggtctccgcgtctgcaatactgaatgcccacaaagatggggtctgtggaattagatcaaccacgaggttggaaaatgtcatgtggaagcaaataaccaatgagttaacgtacttgggagtcggccat

SEQ ID NO: 373836 - DNA, 140 bp, Artificial Sequence
  Synthetic
atggccgactcccaagtacgttaactcattggttatttgcttccacatgacattttccaacctcgtggttgatctaattccacagaccccatctttgtgggcattcagtattgcagacgcggagacccagcatggcgtat

SEQ ID NO: 373837 - DNA, 140 bp, Artificial Sequence
  Synthetic
aggccctggctgctgatatgaaccacgaggttggaaaatgtcatgtggaagcaaataaccaatgagttaaactatgtgctctgggaaggaggacatgacctcactgtagtggccggggacgaccttttgggacagcggtg

SEQ ID NO: 373838 - DNA, 140 bp, Artificial Sequence
  Synthetic
caccgctgtcccaaaaggtcgtccccggccactacagtgaggtcatgtcctccttcccagagcacatagtttaactcattggttatttgcttccacatgacattttccaacctcgtggttcatatcagcagccagggcct

SEQ ID NO: 373839 - DNA, 140 bp, Artificial Sequence
  Synthetic
atacgccatgctgggtctccgtgaaaggggtgttatccaaaggcaagagagcattagcacctccagtgaatgatttgaaatattcatggaagacatggggaaaagcaaagatcttcactccgtacttgggagtcggccat

SEQ ID NO: 373840 - DNA, 140 bp, Artificial Sequence
  Synthetic
atggccgactcccaagtacggagtgaagatctttgcttttccccatgtcttccatgaatatttcaaatcattcactggaggtgctaatgctctcttgcctttggataacacccctttcacggagacccagcatggcgtat

SEQ ID NO: 373841 - DNA, 140 bp, Artificial Sequence
  Synthetic
aggccctggctgctgatatgtgatttgaaatattcatggaagacatggggaaaagcaaagatcttcactccagagacaagaaacagcacatttttaatagacggaccagacacttccgaagaccttttgggacagcggtg

SEQ ID NO: 373842 - DNA, 140 bp, Artificial Sequence
  Synthetic
caccgctgtcccaaaaggtcttcggaagtgtctggtccgtctattaaaaatgtgctgtttcttgtctctggagtgaagatctttgcttttccccatgtcttccatgaatatttcaaatcacatatcagcagccagggcct

SEQ ID NO: 373843 - DNA, 140 bp, Artificial Sequence
  Synthetic
atacgccatgctgggtctccgaacccgcaacatcggaattgaaagtgagataccaaacctagacataattgggaaaagaatagaaaaaataaaacaagagcatgagacatcatggcactacgtacttgggagtcggccat

SEQ ID NO: 373844 - DNA, 140 bp, Artificial Sequence
  Synthetic
atggccgactcccaagtacgtagtgccatgatgtctcatgctcttgttttattttttctattcttttcccaattatgtctaggtttggtatctcactttcaattccgatgttgcgggttcggagacccagcatggcgtat

SEQ ID NO: 373845 - DNA, 140 bp, Artificial Sequence
  Synthetic
atacgccatgctgggtctccaagaatggaaaacgggtgattcaattgagcaggaaaacctttgacacagagtaccaaaaaacaaaaaataacgactgggactacgtcgtcacaacagacacgtacttgggagtcggccat

SEQ ID NO: 373846 - DNA, 140 bp, Artificial Sequence
  Synthetic
atggccgactcccaagtacgtgtctgttgtgacgacgtagtcccagtcgttattttttgttttttggtactctgtgtcaaaggttttcctgctcaattgaatcacccgttttccattcttggagacccagcatggcgtat

SEQ ID NO: 373847 - DNA, 140 bp, Artificial Sequence
  Synthetic
atacgccatgctgggtctccgacagtagattttgggaactggttgacaaggaaaggaatctccatcttgaaggaaagtgtgagacatgtgtgtacaacatgatgggaaagagagagaagacgtacttgggagtcggccat

SEQ ID NO: 373848 - DNA, 140 bp, Artificial Sequence
  Synthetic
atggccgactcccaagtacgtcttctctctctttcccatcatgttgtacacacatgtctcacactttccttcaagatggagattcctttccttgtcaaccagttcccaaaatctactgtcggagacccagcatggcgtat

SEQ ID NO: 373849 - DNA, 140 bp, Artificial Sequence
  Synthetic
atacgccatgctgggtctccccaagacccacacattgtggagtaatggagtgctggaaagtcagatgctcatcccgaaagcatatgcaggccctttttcacagcacaattaccgtcagggcgtacttgggagtcggccat

SEQ ID NO: 373850 - DNA, 140 bp, Artificial Sequence
  Synthetic
atggccgactcccaagtacgccctgacggtaattgtgctgtgaaaaagggcctgcatatgctttcgggatgagcatctgactttccagcactccattactccacaatgtgtgggtcttggggagacccagcatggcgtat

SEQ ID NO: 373851 - DNA, 140 bp, Artificial Sequence
  Synthetic
atacgccatgctgggtctccctacgccacgcagaccatgggcccatggcacttgggaaaattggagatagactttggagaatgccccggaacaacagtcaccattcaagaggattgtgaccgtacttgggagtcggccat

SEQ ID NO: 373852 - DNA, 140 bp, Artificial Sequence
  Synthetic
atggccgactcccaagtacggtcacaatcctcttgaatggtgactgttgttccggggcattctccaaagtctatctccaattttcccaagtgccatgggcccatggtctgcgtggcgtagggagacccagcatggcgtat

SEQ ID NO: 373853 - DNA, 140 bp, Artificial Sequence
  Synthetic
aggccctggctgctgatatgactttggagaatgccccggaacaacagtcaccattcaagaggattgtgaccatagaggcccgtctttgaggaccaccactgcatctgggaaactggtcacgaccttttgggacagcggtg

SEQ ID NO: 373854 - DNA, 140 bp, Artificial Sequence
  Synthetic
caccgctgtcccaaaaggtcgtgaccagtttcccagatgcagtggtggtcctcaaagacgggcctctatggtcacaatcctcttgaatggtgactgttgttccggggcattctccaaagtcatatcagcagccagggcct

SEQ ID NO: 373855 - DNA, 140 bp, Artificial Sequence
  Synthetic
atacgccatgctgggtctccgcagtggtgctgccgctcctgcacgatgcctcccttaaggtttttaggagaggatggatgttggtatgggatggaaattaggcccttgagtgaaaaagaacgtacttgggagtcggccat

SEQ ID NO: 373856 - DNA, 140 bp, Artificial Sequence
  Synthetic
atggccgactcccaagtacgttctttttcactcaagggcctaatttccatcccataccaacatccatcctctcctaaaaaccttaagggaggcatcgtgcaggagcggcagcaccactgcggagacccagcatggcgtat

SEQ ID NO: 373857 - DNA, 140 bp, Artificial Sequence
  Synthetic
atacgccatgctgggtctccgagaacatggttaaatcacaggtgtcggccggacagggcacatcagaaactttctccatggggctgttgtgcctgactctatttgtggaagaatgcttgacgtacttgggagtcggccat

SEQ ID NO: 373858 - DNA, 140 bp, Artificial Sequence
  Synthetic
atggccgactcccaagtacgtcaagcattcttccacaaatagagtcaggcacaacagccccatggagaaagtttctgatgtgccctgtccggccgacacctgtgatttaaccatgttctcggagacccagcatggcgtat

SEQ ID NO: 373859 - DNA, 140 bp, Artificial Sequence
  Synthetic
aggccctggctgctgatatgtttctccatggggctgttgtgcctgactctatttgtggaagaatgcttgaggagaagagtcaccaggaaacacatgatattggttgtggtgaccacccttgaccttttgggacagcggtg

SEQ ID NO: 373860 - DNA, 140 bp, Artificial Sequence
  Synthetic
caccgctgtcccaaaaggtcaagggtggtcaccacaaccaatatcatgtgtttcctggtgactcttctcctcaagcattcttccacaaatagagtcaggcacaacagccccatggagaaacatatcagcagccagggcct

SEQ ID NO: 373861 - DNA, 140 bp, Artificial Sequence
  Synthetic
aggccctggctgctgatatggatgccccccttaaggttcttaggagaagatgggtgctggtatgggatggagattaggcccttgagtgaaaaagaagagaacatggtcaaatcacaggtggaccttttgggacagcggtg

SEQ ID NO: 373862 - DNA, 140 bp, Artificial Sequence
  Synthetic
caccgctgtcccaaaaggtccacctgtgatttgaccatgttctcttctttttcactcaagggcctaatctccatcccataccagcacccatcttctcctaagaaccttaaggggggcatccatatcagcagccagggcct

SEQ ID NO: 373863 - DNA, 140 bp, Artificial Sequence
  Synthetic
aggccctggctgctgatatgtatcatgctagggaacaccatgtctagtagaatgggaggacagactcacctagccatcatggcagtgtttaaaatgtcaccaggatacgtgctgggtatagaccttttgggacagcggtg

SEQ ID NO: 373864 - DNA, 140 bp, Artificial Sequence
  Synthetic
caccgctgtcccaaaaggtctatacccagcacgtatcctggtgacattttaaacactgccatgatggctaggtgagtctgtcctcccattctactagacatggtgttccctagcatgatacatatcagcagccagggcct

SEQ ID NO: 373865 - DNA, 140 bp, Artificial Sequence
  Synthetic
atacgccatgctgggtctcctttttgaggaaactcacctcaagagagacagcactaatggtgataggaatggccatgacaacggtgctttcaattccacatgaccttatggaattcattgcgtacttgggagtcggccat

SEQ ID NO: 373866 - DNA, 140 bp, Artificial Sequence
  Synthetic
atggccgactcccaagtacgcaatgaattccataaggtcatgtggaattgaaagcaccgttgtcatggccattcctatcaccattagtgctgtctctcttgaggtgagtttcctcaaaaaggagacccagcatggcgtat

SEQ ID NO: 373867 - DNA, 140 bp, Artificial Sequence
  Synthetic
aggccctggctgctgatatgggccatgacaacggtgctttcaattccacatgaccttatggaattcattgatggaatatcactagggttgatcttgttaaagatggtaacacattttgacgaccttttgggacagcggtg

SEQ ID NO: 373868 - DNA, 140 bp, Artificial Sequence
  Synthetic
caccgctgtcccaaaaggtcgtcaaaatgtgttaccatctttaacaagatcaaccctagtgatattccatcaatgaattccataaggtcatgtggaattgaaagcaccgttgtcatggcccatatcagcagccagggcct

SEQ ID NO: 373869 - DNA, 140 bp, Artificial Sequence
  Synthetic
aggccctggctgctgatatggctttgatagctgtgttaactggtggagtgacgctgttcttcctatcaggaaggggcctagggaaaacatctatcggcctactctgcgtgatggcttcaagaccttttgggacagcggtg

SEQ ID NO: 373870 - DNA, 140 bp, Artificial Sequence
  Synthetic
caccgctgtcccaaaaggtcttgaagccatcacgcagagtaggccgatagatgttttccctaggccccttcctgataggaagaacagcgtcactccaccagttaacacagctatcaaagccatatcagcagccagggcct

SEQ ID NO: 373871 - DNA, 140 bp, Artificial Sequence
  Synthetic
atacgccatgctgggtctccaacactcaagtaggaaccttagccctttccttgaccttcataaaatcaacaatgccattggtcatggcttggaggaccataatggcggtgttgtttgtggcgtacttgggagtcggccat

SEQ ID NO: 373872 - DNA, 140 bp, Artificial Sequence
  Synthetic
atggccgactcccaagtacgccacaaacaacaccgccattatggtcctccaagccatgaccaatggcattgttgattttatgaaggtcaaggaaagggctaaggttcctacttgagtgttggagacccagcatggcgtat

SEQ ID NO: 373873 - DNA, 140 bp, Artificial Sequence
  Synthetic
aggccctggctgctgatatgaatgccattggtcatggcttggaggaccataatggcggtgttgtttgtggtcacactcattcctctatgcaggacaagctgtcttcagaagcagtcccatgaccttttgggacagcggtg

SEQ ID NO: 373874 - DNA, 140 bp, Artificial Sequence
  Synthetic
caccgctgtcccaaaaggtcatgggactgcttctgaagacagcttgtcctgcatagaggaatgagtgtgaccacaaacaacaccgccattatggtcctccaagccatgaccaatggcattcatatcagcagccagggcct

SEQ ID NO: 373875 - DNA, 140 bp, Artificial Sequence
  Synthetic
atacgccatgctgggtctcctgggtggaaataacagcactcatcctgggagcccaggctctgccagtatacctaatgactctcatgaaaggagcctcaaagagatcttggccccttaacgcgtacttgggagtcggccat

SEQ ID NO: 373876 - DNA, 140 bp, Artificial Sequence
  Synthetic
atggccgactcccaagtacgcgttaaggggccaagatctctttgaggctcctttcatgagagtcattaggtatactggcagagcctgggctcccaggatgagtgctgttatttccacccaggagacccagcatggcgtat

SEQ ID NO: 373877 - DNA, 140 bp, Artificial Sequence
  Synthetic
atacgccatgctgggtctccaaggtataatggctgtgggcttggtcagtctcttaggaagcgcccttctaaagaatgatgtccctctagctggcccaatggtggcaggaggcttgcttctcgtacttgggagtcggccat

SEQ ID NO: 373878 - DNA, 140 bp, Artificial Sequence
  Synthetic
atggccgactcccaagtacgagaagcaagcctcctgccaccattgggccagctagagggacatcattctttagaagggcgcttcctaagagactgaccaagcccacagccattataccttggagacccagcatggcgtat

SEQ ID NO: 373879 - DNA, 140 bp, Artificial Sequence
  Synthetic
aggccctggctgctgatatgatcatagaagtgaagcaggatgaagatggctctttctccatacgggacgtcgaggaaaccaacatgataaccctcctggtgaaactggcactgataacaggaccttttgggacagcggtg

SEQ ID NO: 373880 - DNA, 140 bp, Artificial Sequence
  Synthetic
caccgctgtcccaaaaggtcctgttatcagtgccagtttcaccaggagggttatcatgttggtttcctcgacgtcccgtatggagaaagagccatcttcatcctgcttcacttctatgatcatatcagcagccagggcct

SEQ ID NO: 373881 - DNA, 140 bp, Artificial Sequence
  Synthetic
atacgccatgctgggtctcctgcaaagagggttatttgggaaaactcaggttggagtagggatacacatggaaggtgtgtttcacacaatgtggcatgtaacaagaggatcagtgatttgcgtacttgggagtcggccat

SEQ ID NO: 373882 - DNA, 140 bp, Artificial Sequence
  Synthetic
atggccgactcccaagtacgcaaatcactgatcctcttgttacatgccacattgtgtgaaacacaccttccatgtgtatccctactccaacctgagttttcccaaataaccctctttgcaggagacccagcatggcgtat

SEQ ID NO: 373883 - DNA, 140 bp, Artificial Sequence
  Synthetic
aggccctggctgctgatatgtgatatcatacggtgggggatggaggctcggagacaaatgggataaagaagaagacgttcaagttctggctgtagaaccagggaaaaatccaaaacatgtgaccttttgggacagcggtg

SEQ ID NO: 373884 - DNA, 140 bp, Artificial Sequence
  Synthetic
caccgctgtcccaaaaggtcacatgttttggatttttccctggttctacagccagaacttgaacgtcttcttctttatcccatttgtctccgagcctccatcccccaccgtatgatatcacatatcagcagccagggcct

SEQ ID NO: 373885 - DNA, 140 bp, Artificial Sequence
  Synthetic
atacgccatgctgggtctccccaaacgaaacccggccttttcaaaaccctaactggagaaattggagcggtgacattggacttcaaacccggaacatccggttctcccatcatcaataggcgtacttgggagtcggccat

SEQ ID NO: 373886 - DNA, 140 bp, Artificial Sequence
  Synthetic
atggccgactcccaagtacgcctattgatgatgggagaaccggatgttccgggtttgaagtccaatgtcaccgctccaatttctccagttagggttttgaaaaggccgggtttcgtttggggagacccagcatggcgtat

SEQ ID NO: 373887 - DNA, 140 bp, Artificial Sequence
  Synthetic
atacgccatgctgggtctccaaaggaaaagtcattggactttacggaaatggggtagttaccaaatcaggtgattacgtcagtgccataacacaagctgaaagaattggcgaaccagattcgtacttgggagtcggccat

SEQ ID NO: 373888 - DNA, 140 bp, Artificial Sequence
  Synthetic
atggccgactcccaagtacgaatctggttcgccaattctttcagcttgtgttatggcactgacgtaatcacctgatttggtaactaccccatttccgtaaagtccaatgacttttcctttggagacccagcatggcgtat

SEQ ID NO: 373889 - DNA, 140 bp, Artificial Sequence
  Synthetic
aggccctggctgctgatatgtgattacgtcagtgccataacacaagctgaaagaattggcgaaccagattatgaagtggatgaggacatctttcgaaagaaaagattgaccataatggacgaccttttgggacagcggtg

SEQ ID NO: 373890 - DNA, 140 bp, Artificial Sequence
  Synthetic
caccgctgtcccaaaaggtcgtccattatggtcaatcttttctttcgaaagatgtcctcatccacttcataatctggttcgccaattctttcagcttgtgttatggcactgacgtaatcacatatcagcagccagggcct

SEQ ID NO: 373891 - DNA, 140 bp, Artificial Sequence
  Synthetic
atacgccatgctgggtctccatgaagtggatgaggacatctttcgaaagaaaagattgaccataatggacttacaccccggagccggaaagacaaaaagaattcttccatcaatcgttagcgtacttgggagtcggccat

SEQ ID NO: 373892 - DNA, 140 bp, Artificial Sequence
  Synthetic
atggccgactcccaagtacgctaacgattgatggaagaattctttttgtctttccggctccggggtgtaagtccattatggtcaatcttttctttcgaaagatgtcctcatccacttcatggagacccagcatggcgtat

SEQ ID NO: 373893 - DNA, 140 bp, Artificial Sequence
  Synthetic
atacgccatgctgggtctccaggaaaacatggcaaggaaatcaaagtaacaccacagagttccattacagaagcagaactgacaggctatggcactgtcacgatggagtgctctccaagacgtacttgggagtcggccat

SEQ ID NO: 373894 - DNA, 140 bp, Artificial Sequence
  Synthetic
atggccgactcccaagtacgtcttggagagcactccatcgtgacagtgccatagcctgtcagttctgcttctgtaatggaactctgtggtgttactttgatttccttgccatgttttcctggagacccagcatggcgtat

SEQ ID NO: 373895 - DNA, 140 bp, Artificial Sequence
  Synthetic
atacgccatgctgggtctccagaagctttaaaaaggaggctacgaaccctgattctggcacccacgagagtggtagcggccgaaatggaagaagccctacgcggactgccaatccgttaccgtacttgggagtcggccat

SEQ ID NO: 373896 - DNA, 140 bp, Artificial Sequence
  Synthetic
atggccgactcccaagtacggtaacggattggcagtccgcgtagggcttcttccatttcggccgctaccactctcgtgggtgccagaatcagggttcgtagcctcctttttaaagcttctggagacccagcatggcgtat

SEQ ID NO: 373897 - DNA, 140 bp, Artificial Sequence
  Synthetic
aggccctggctgctgatatgcatgtgccatgcaaccttcacaacaagacttttatcatcaaccagggttccaaattacaaccttatagtgatggatgaagcgcatttcacagacccttctgaccttttgggacagcggtg

SEQ ID NO: 373898 - DNA, 140 bp, Artificial Sequence
  Synthetic
caccgctgtcccaaaaggtcagaagggtctgtgaaatgcgcttcatccatcactataaggttgtaatttggaaccctggttgatgataaaagtcttgttgtgaaggttgcatggcacatgcatatcagcagccagggcct

SEQ ID NO: 373899 - DNA, 140 bp, Artificial Sequence
  Synthetic
atacgccatgctgggtctccagtgtcgcagctagaggatacatctcaaccagggtggaaatgggagaggccgcagctatcttcatgactgcaacccctcctggaacaacagatcccttcccgtacttgggagtcggccat

SEQ ID NO: 373900 - DNA, 140 bp, Artificial Sequence
  Synthetic
atggccgactcccaagtacgggaagggatctgttgttccaggaggggttgcagtcatgaagatagctgcggcctctcccatttccaccctggttgagatgtatcctctagctgcgacactggagacccagcatggcgtat

SEQ ID NO: 373901 - DNA, 140 bp, Artificial Sequence
  Synthetic
aggccctggctgctgatatgcgcagctatcttcatgactgcaacccctcctggaacaacagatcccttcccccagagcaacagcccaatagaagatatcgagagggaaattccagaaagggaccttttgggacagcggtg

SEQ ID NO: 373902 - DNA, 140 bp, Artificial Sequence
  Synthetic
caccgctgtcccaaaaggtccctttctggaatttccctctcgatatcttctattgggctgttgctctgggggaagggatctgttgttccaggaggggttgcagtcatgaagatagctgcgcatatcagcagccagggcct

SEQ ID NO: 373903 - DNA, 140 bp, Artificial Sequence
  Synthetic
atacgccatgctgggtctcctcatggaacacagggtttgactggataacagactaccaagggaaaactgtgtggtttgttcccagcataaaagctggaaatgacattgcaaactgcttgacgtacttgggagtcggccat

SEQ ID NO: 373904 - DNA, 140 bp, Artificial Sequence
  Synthetic
atggccgactcccaagtacgtcaagcagtttgcaatgtcatttccagcttttatgctgggaacaaaccacacagttttcccttggtagtctgttatccagtcaaaccctgtgttccatgaggagacccagcatggcgtat

SEQ ID NO: 373905 - DNA, 140 bp, Artificial Sequence
  Synthetic
aggccctggctgctgatatggtggtttgttcccagcataaaagctggaaatgacattgcaaactgcttgagaaaatcgggaaagaaggtggtccaattgagtaggaaaacttttgacacagaccttttgggacagcggtg

SEQ ID NO: 373906 - DNA, 140 bp, Artificial Sequence
  Synthetic
caccgctgtcccaaaaggtctgtgtcaaaagttttcctactcaattggaccaccttctttcccgattttctcaagcagtttgcaatgtcatttccagcttttatgctgggaacaaaccaccatatcagcagccagggcct

SEQ ID NO: 373907 - DNA, 140 bp, Artificial Sequence
  Synthetic
atacgccatgctgggtctccttagcgggtcccattccagtgactccagcaagcgctgctcagagaagagggcgaataggtaggaacccagcacaagaagatgaccaatatgtcttctctgcgtacttgggagtcggccat

SEQ ID NO: 373908 - DNA, 140 bp, Artificial Sequence
  Synthetic
atggccgactcccaagtacgcagagaagacatattggtcatcttcttgtgctgggttcctacctattcgccctcttctctgagcagcgcttgctggagtcactggaatgggacccgctaaggagacccagcatggcgtat

SEQ ID NO: 373909 - DNA, 140 bp, Artificial Sequence
  Synthetic
atacgccatgctgggtctccgcagtgttcgttgacgaaaatcaatggaactcagcaaaagaagcagtggaagatgagcggttctgggaccttgtgcatagagagagggagcttcacaaaccgtacttgggagtcggccat

SEQ ID NO: 373910 - DNA, 140 bp, Artificial Sequence
  Synthetic
atggccgactcccaagtacggtttgtgaagctccctctctctatgcacaaggtcccagaaccgctcatcttccactgcttcttttgctgagttccattgattttcgtcaacgaacactgcggagacccagcatggcgtat

SEQ ID NO: 373911 - DNA, 140 bp, Artificial Sequence
  Synthetic
aggccctggctgctgatatgagggaaaatgtgccacgtgtgtttacaacatgatggggaagagagagaaaaagctaggagagtttggaaaggcaaaaggaagtcgtgcaatatggtacatgaccttttgggacagcggtg

SEQ ID NO: 373912 - DNA, 140 bp, Artificial Sequence
  Synthetic
caccgctgtcccaaaaggtcatgtaccatattgcacgacttccttttgcctttccaaactctcctagctttttctctctcttccccatcatgttgtaaacacacgtggcacattttccctcatatcagcagccagggcct

SEQ ID NO: 373913 - DNA, 140 bp, Artificial Sequence
  Synthetic
atacgccatgctgggtctccgaggggaacaaaggaagacttttgtagaattaatgaggagaggagaccttccggtgtggctgagttacaaggtagcttctgctggtatctcttacaaagacgtacttgggagtcggccat

SEQ ID NO: 373914 - DNA, 140 bp, Artificial Sequence
  Synthetic
atggccgactcccaagtacgtctttgtaagagataccagcagaagctaccttgtaactcagccacaccggaaggtctcctctcctcattaattctacaaaagtcttcctttgttcccctcggagacccagcatggcgtat

SEQ ID NO: 373915 - DNA, 140 bp, Artificial Sequence
  Synthetic
atacgccatgctgggtctccccgggaatggtgcttcacgggggaaaggaataaccaaattctagaagaaaacatggaggtagaaatttggactagagagggagagaagaaaaaactcaggcgtacttgggagtcggccat

SEQ ID NO: 373916 - DNA, 140 bp, Artificial Sequence
  Synthetic
atggccgactcccaagtacgcctgagttttttcttctctccctctctagtccaaatttctacctccatgttttcttctagaatttggttattcctttcccccgtgaagcaccattcccggggagacccagcatggcgtat

SEQ ID NO: 373917 - DNA, 140 bp, Artificial Sequence
  Synthetic
atacgccatgctgggtctccgatctggacaaaagaaggagaaagaaagaaattgcgacctcgctggttagatgccagaacctactctgacccactggccctgcgtgagtttaaagaattccgtacttgggagtcggccat

SEQ ID NO: 373918 - DNA, 140 bp, Artificial Sequence
  Synthetic
atggccgactcccaagtacggaattctttaaactcacgcagggccagtgggtcagagtaggttctggcatctaaccagcgaggtcgcaatttctttctttctccttcttttgtccagatcggagacccagcatggcgtat

SEQ ID NO: 373919 - DNA, 140 bp, Artificial Sequence
  Synthetic
aggccctggctgctgatatgaaaggaatcatgcaggcaggaaaacgatccctgcggccccagcccactgagctgaagtattcatggaaaacgtggggcaaagcgaaaatgctctccacaggaccttttgggacagcggtg

SEQ ID NO: 373920 - DNA, 140 bp, Artificial Sequence
  Synthetic
caccgctgtcccaaaaggtcctgtggagagcattttcgctttgccccacgttttccatgaatacttcagctcagtgggctggggccgcagggatcgttttcctgcctgcatgattcctttcatatcagcagccagggcct

SEQ ID NO: 373921 - DNA, 140 bp, Artificial Sequence
  Synthetic
atacgccatgctgggtctcccagaaattgccagtttgccaacgtacctttcctctagagctaagcttgcccttgacaacatagtcatgctccacacaacagaaagaggagggaaggcctacgtacttgggagtcggccat

SEQ ID NO: 373922 - DNA, 140 bp, Artificial Sequence
  Synthetic
atggccgactcccaagtacgtaggccttccctcctctttctgttgtgtggagcatgactatgttgtcaagggcaagcttagctctagaggaaaggtacgttggcaaactggcaatttctgggagacccagcatggcgtat

SEQ ID NO: 373923 - DNA, 140 bp, Artificial Sequence
  Synthetic
aggccctggctgctgatatgcttgacaacatagtcatgctccacacaacagaaagaggagggaaggcctaccaacacgccctgaacgaactcccagagtcactagaaacactcatgcttggaccttttgggacagcggtg

SEQ ID NO: 373924 - DNA, 140 bp, Artificial Sequence
  Synthetic
caccgctgtcccaaaaggtccaagcatgagtgtttctagtgactctgggagttcgttcagggcgtgttggtaggccttccctcctctttctgttgtgtggagcatgactatgttgtcaagcatatcagcagccagggcct

SEQ ID NO: 373925 - DNA, 140 bp, Artificial Sequence
  Synthetic
atacgccatgctgggtctcctagctttactaggagctatgacagcaggcatctttttgttcttcatgcaaggaaaaggaatggggaaattgtcaatgggtttgatagccatcgcggtagccgtacttgggagtcggccat

SEQ ID NO: 373926 - DNA, 140 bp, Artificial Sequence
  Synthetic
atggccgactcccaagtacggctaccgcgatggctatcaaacccattgacaatttccccattccttttccttgcatgaagaacaaaaagatgcctgctgtcatagctcctagtaaagctaggagacccagcatggcgtat

SEQ ID NO: 373927 - DNA, 140 bp, Artificial Sequence
  Synthetic
atacgccatgctgggtctcctagtggcttgctctgggtagcagaaatccagccccagtggatagcagcctcaattatattggagttttttctcatggcgctgttgataccagaaccagaacgtacttgggagtcggccat

SEQ ID NO: 373928 - DNA, 140 bp, Artificial Sequence
  Synthetic
atggccgactcccaagtacgttctggttctggtatcaacagcgccatgagaaaaaactccaatataattgaggctgctatccactggggctggatttctgctacccagagcaagccactaggagacccagcatggcgtat

SEQ ID NO: 373929 - DNA, 140 bp, Artificial Sequence
  Synthetic
aggccctggctgctgatatgaaacaaaaacggactttgggttttaccaggtaaaaacagaaactaccatccttgatgtggatttaagacccgcctcagcatggacgctctatgcagtagcgaccttttgggacagcggtg

SEQ ID NO: 373930 - DNA, 140 bp, Artificial Sequence
  Synthetic
caccgctgtcccaaaaggtcgctactgcatagagcgtccatgctgaggcgggtcttaaatccacatcaaggatggtagtttctgtttttacctggtaaaacccaaagtccgtttttgtttcatatcagcagccagggcct

SEQ ID NO: 373931 - DNA, 140 bp, Artificial Sequence
  Synthetic
aggccctggctgctgatatgatgtggcagctgatgtacttccacaggagagacttgagactagccgctaatgctatctgttcagccgttccagttgattgggtcccaaccagccgcaccagaccttttgggacagcggtg

SEQ ID NO: 373932 - DNA, 140 bp, Artificial Sequence
  Synthetic
caccgctgtcccaaaaggtctggtgcggctggttgggacccaatcaactggaacggctgaacagatagcattagcggctagtctcaagtctctcctgtggaagtacatcagctgccacatcatatcagcagccagggcct

SEQ ID NO: 373933 - DNA, 140 bp, Artificial Sequence
  Synthetic
atacgccatgctgggtctcccaccactatcttgactcccatgctgagacacaccatagaaaacacgtctgcaaacctatctttagcggccattgccaaccaagcagccgtcttaatggggcgtacttgggagtcggccat

SEQ ID NO: 373934 - DNA, 140 bp, Artificial Sequence
  Synthetic
atggccgactcccaagtacgccccattaagacggctgcttggttggcaatggccgctaaagataggtttgcagacgtgttttctatggtgtgtctcagcatgggagtcaagatagtggtgggagacccagcatggcgtat

SEQ ID NO: 373935 - DNA, 140 bp, Artificial Sequence
  Synthetic
aggccctggctgctgatatgggcaatgggatgctattcccaggtgaacccaacgactttaacagcatccttagtcatgcttttagttcattatgcaataataggtccaggattgcaggctgaccttttgggacagcggtg

SEQ ID NO: 373936 - DNA, 140 bp, Artificial Sequence
  Synthetic
caccgctgtcccaaaaggtcagcctgcaatcctggacctattattgcataatgaactaaaagcatgactaaggatgctgttaaagtcgttgggttcacctgggaatagcatcccattgcccatatcagcagccagggcct

SEQ ID NO: 373937 - DNA, 140 bp, Artificial Sequence
  Synthetic
aggccctggctgctgatatgaccaacatacaagtggccataaaccaagtgagaagactaattgggaatgagaattatctagattacatgacatcaatgaagagattcaagaacgagagtggaccttttgggacagcggtg

SEQ ID NO: 373938 - DNA, 140 bp, Artificial Sequence
  Synthetic
caccgctgtcccaaaaggtccactctcgttcttgaatctcttcattgatgtcatgtaatctagataattctcattcccaattagtcttctcacttggtttatggccacttgtatgttggtcatatcagcagccagggcct

SEQ ID NO: 373939 - DNA, 140 bp, Artificial Sequence
  Synthetic
aggccctggctgctgatatgcttttgagaaagctgacctccaaggaattgatgatgaccaccataggaatcgtactcctctcccagagcaccataccagagactatacttgaactgactggaccttttgggacagcggtg

SEQ ID NO: 373940 - DNA, 140 bp, Artificial Sequence
  Synthetic
caccgctgtcccaaaaggtccagtcagttcaagtatagtctctggtatggtgctctgggagaggagtacgattcctatggtggtcatcatcaattccttggaggtcagctttctcaaaagcatatcagcagccagggcct

SEQ ID NO: 373941 - DNA, 140 bp, Artificial Sequence
  Synthetic
aggccctggctgctgatatggattttggaacacgactatagccgtgtccacagccaacattttcaggggaagctacctggcgggagctggattggccttctcgctcataaagaatacacagaccttttgggacagcggtg

SEQ ID NO: 373942 - DNA, 140 bp, Artificial Sequence
  Synthetic
caccgctgtcccaaaaggtctgtgtattctttatgagcgagaaggccaatccagctcccgccaggtagcttcccctgaaaatgttggctgtggacacggctatagtcgtgttccaaaatccatatcagcagccagggcct

SEQ ID NO: 373943 - DNA, 140 bp, Artificial Sequence
  Synthetic
atacgccatgctgggtctccaacccccaggaggggaaccgggaccacaggagagacactgggagaaaagtggaagagacaactgaactcactagataggaaggagtttgaagagtacaaacgtacttgggagtcggccat

SEQ ID NO: 373944 - DNA, 140 bp, Artificial Sequence
  Synthetic
atggccgactcccaagtacgtttgtactcttcaaactccttcctatctagtgagttcagttgtctcttccacttttctcccagtgtctctcctgtggtcccggttcccctcctgggggttggagacccagcatggcgtat

SEQ ID NO: 373945 - DNA, 140 bp, Artificial Sequence
  Synthetic
aggccctggctgctgatatgggaagagacaactgaactcactagataggaaggagtttgaagagtacaaaagaagtggaatactagaagtagacaggactgaagccaaatccgccctgaagaccttttgggacagcggtg

SEQ ID NO: 373946 - DNA, 140 bp, Artificial Sequence
  Synthetic
caccgctgtcccaaaaggtcttcagggcggatttggcttcagtcctgtctacttctagtattccacttcttttgtactcttcaaactccttcctatctagtgagttcagttgtctcttcccatatcagcagccagggcct

SEQ ID NO: 373947 - DNA, 140 bp, Artificial Sequence
  Synthetic
aggccctggctgctgatatgcccccgcttaacaataaacagcatattgacgctgggagagaccagagatcctgctgtctctacagcatcattccaggcacagaacgccagaaaatggaatgaccttttgggacagcggtg

SEQ ID NO: 373948 - DNA, 140 bp, Artificial Sequence
  Synthetic
caccgctgtcccaaaaggtcattccattttctggcgttctgtgcctggaatgatgctgtagagacagcaggatctctggtctctcccagcgtcaatatgctgtttattgttaagcgggggcatatcagcagccagggcct

SEQ ID NO: 373949 - DNA, 140 bp, Artificial Sequence
  Synthetic
atacgccatgctgggtctccagatggatctaaaatcaagtatgcagtgtccagagggaccagcaagattagatggattgttgaaagagggatggtaaagccaaaagggaaagttgtggaccgtacttgggagtcggccat

SEQ ID NO: 373950 - DNA, 140 bp, Artificial Sequence
  Synthetic
atggccgactcccaagtacggtccacaactttcccttttggctttaccatccctctttcaacaatccatctaatcttgctggtccctctggacactgcatacttgattttagatccatctggagacccagcatggcgtat

SEQ ID NO: 373951 - DNA, 140 bp, Artificial Sequence
  Synthetic
atacgccatgctgggtctccctatcatggcagtcgggatggtgagcattttagccagttctctcttgaagaatgacattcccatgacaggaccattagtggctggagggcttctcactgtcgtacttgggagtcggccat

SEQ ID NO: 373952 - DNA, 140 bp, Artificial Sequence
  Synthetic
atggccgactcccaagtacgacagtgagaagccctccagccactaatggtcctgtcatgggaatgtcattcttcaagagagaactggctaaaatgctcaccatcccgactgccatgatagggagacccagcatggcgtat

SEQ ID NO: 373953 - DNA, 140 bp, Artificial Sequence
  Synthetic
aggccctggctgctgatatgaatgacattcccatgacaggaccattagtggctggagggcttctcactgtgtgttacgtgctcactggaagatcggctgacttggaactggagagagccggaccttttgggacagcggtg

SEQ ID NO: 373954 - DNA, 140 bp, Artificial Sequence
  Synthetic
caccgctgtcccaaaaggtccggctctctccagttccaagtcagccgatcttccagtgagcacgtaacacacagtgagaagccctccagccactaatggtcctgtcatgggaatgtcattcatatcagcagccagggcct

SEQ ID NO: 373955 - DNA, 140 bp, Artificial Sequence
  Synthetic
aggccctggctgctgatatgcaggactttttcccgtatcaataccaatcacggcagcagcatggtacctgtgggaagtgaagaaacaacgggctggagtattgtgggatgtcccttcaccgaccttttgggacagcggtg

SEQ ID NO: 373956 - DNA, 140 bp, Artificial Sequence
  Synthetic
caccgctgtcccaaaaggtcggtgaagggacatcccacaatactccagcccgttgtttcttcacttcccacaggtaccatgctgctgccgtgattggtattgatacgggaaaaagtcctgcatatcagcagccagggcct

SEQ ID NO: 373957 - DNA, 140 bp, Artificial Sequence
  Synthetic
aggccctggctgctgatatgagaaagggattcttggatactcccagatcggagctggagtttacaaagaaggaacattccacacaatgtggcatgtcacacgtggtgctgttctaatgcagaccttttgggacagcggtg

SEQ ID NO: 373958 - DNA, 140 bp, Artificial Sequence
  Synthetic
caccgctgtcccaaaaggtctgcattagaacagcaccacgtgtgacatgccacattgtgtggaatgttccttctttgtaaactccagctccgatctgggagtatccaagaatccctttctcatatcagcagccagggcct

SEQ ID NO: 373959 - DNA, 140 bp, Artificial Sequence
  Synthetic
atacgccatgctgggtctccattccactcatgagatgtattgggtgtcaggtgtgtcaggaaacattgtgagctctgtgaacacaacatcaaagatgttgttgaacagatttaccacaagcgtacttgggagtcggccat

SEQ ID NO: 373960 - DNA, 140 bp, Artificial Sequence
  Synthetic
atggccgactcccaagtacgcttgtggtaaatctgttcaacaacatctttgatgttgtgttcacagagctcacaatgtttcctgacacacctgacacccaatacatctcatgagtggaatggagacccagcatggcgtat

SEQ ID NO: 373961 - DNA, 140 bp, Artificial Sequence
  Synthetic
atacgccatgctgggtctccgaagcgtctccactgaaacagaaaaaccagacatggcaatcatcgggagaagactccagcgattgcaagaagagcacaaagaaacttggcactatgatcacgtacttgggagtcggccat

SEQ ID NO: 373962 - DNA, 140 bp, Artificial Sequence
  Synthetic
atggccgactcccaagtacgtgatcatagtgccaagtttctttgtgctcttcttgcaatcgctggagtcttctcccgatgattgccatgtctggtttttctgtttcagtggagacgcttcggagacccagcatggcgtat

SEQ ID NO: 373963 - DNA, 140 bp, Artificial Sequence
  Synthetic
aggccctggctgctgatatgagactccagcgattgcaagaagagcacaaagaaacttggcactatgatcaagaaaatccatacagaacctgggcatatcatggaagctatgaggctccttgaccttttgggacagcggtg

SEQ ID NO: 373964 - DNA, 140 bp, Artificial Sequence
  Synthetic
caccgctgtcccaaaaggtcaaggagcctcatagcttccatgatatgcccaggttctgtatggattttcttgatcatagtgccaagtttctttgtgctcttcttgcaatcgctggagtctcatatcagcagccagggcct

SEQ ID NO: 373965 - DNA, 140 bp, Artificial Sequence
  Synthetic
aggccctggctgctgatatgaaaccctgggacgtgattccaatggtgacccagttggctatgacagacacaaccccttttgggcaacagagagtgttcaaagagaaggttgacaccaggagaccttttgggacagcggtg

SEQ ID NO: 373966 - DNA, 140 bp, Artificial Sequence
  Synthetic
caccgctgtcccaaaaggtctcctggtgtcaaccttctctttgaacactctctgttgcccaaaaggggttgtgtctgtcatagccaactgggtcaccattggaatcacgtcccagggtttcatatcagcagccagggcct

SEQ ID NO: 373967 - DNA, 140 bp, Artificial Sequence
  Synthetic
aggccctggctgctgatatgctttgaaggatttcaaggagttcgccagtggaagaaagagcacaactcttgacatcctaacagagatcgccactttgccaacctacctttcctctaaggcgaccttttgggacagcggtg

SEQ ID NO: 373968 - DNA, 140 bp, Artificial Sequence
  Synthetic
caccgctgtcccaaaaggtcgccttagaggaaaggtaggttggcaaagtggcgatctctgttaggatgtcaagagttgtgctctttcttccactggcgaactccttgaaatccttcaaagcatatcagcagccagggcct

SEQ ID NO: 373969 - DNA, 140 bp, Artificial Sequence
  Synthetic
atacgccatgctgggtctcccaccacagccaaaacccggcacacgaatgatcatgaccacgacagccaactggctatgggctctcctcggaaagaagaaaaatcccagactgtgcacaagcgtacttgggagtcggccat

SEQ ID NO: 373970 - DNA, 140 bp, Artificial Sequence
  Synthetic
atggccgactcccaagtacgcttgtgcacagtctgggatttttcttctttccgaggagagcccatagccagttggctgtcgtggtcatgatcattcgtgtgccgggttttggctgtggtgggagacccagcatggcgtat

SEQ ID NO: 373971 - DNA, 140 bp, Artificial Sequence
  Synthetic
atacgccatgctgggtctcctgggattttcatgacagccactcctccgggaagcagagacccatttccccagagcaatgcaccaatcatggatgaagaaagggaaatccctgaacgttcgcgtacttgggagtcggccat

SEQ ID NO: 373972 - DNA, 140 bp, Artificial Sequence
  Synthetic
atggccgactcccaagtacgcgaacgttcagggatttccctttcttcatccatgattggtgcattgctctggggaaatgggtctctgcttcccggaggagtggctgtcatgaaaatcccaggagacccagcatggcgtat

SEQ ID NO: 373973 - DNA, 140 bp, Artificial Sequence
  Synthetic
aggccctggctgctgatatgggagcgcggtttctggaatttgaagccctgggttttctgaatgaagatcattggtttggcagggaaaactcatggagtggagtggaaggggaaggtctgcgaccttttgggacagcggtg

SEQ ID NO: 373974 - DNA, 140 bp, Artificial Sequence
  Synthetic
caccgctgtcccaaaaggtcgcagaccttccccttccactccactccatgagttttccctgccaaaccaatgatcttcattcagaaaacccagggcttcaaattccagaaaccgcgctcccatatcagcagccagggcct

SEQ ID NO: 373975 - DNA, 140 bp, Artificial Sequence
  Synthetic
aggccctggctgctgatatgatatatgctgatgacacagcaggctgggacacaagaatcactgaagatgaccttctgaatgaagagctgatcacagaacagatggcccctcaccacaagagaccttttgggacagcggtg

SEQ ID NO: 373976 - DNA, 140 bp, Artificial Sequence
  Synthetic
caccgctgtcccaaaaggtctcttgtggtgaggggccatctgttctgtgatcagctcttcattcagaaggtcatcttcagtgattcttgtgtcccagcctgctgtgtcatcagcatatatcatatcagcagccagggcct

SEQ ID NO: 373977 - DNA, 140 bp, Artificial Sequence
  Synthetic
atacgccatgctgggtctccccaacatggaagtacaacttatccgccaaatggaagctgaaggagtcatcacacgagatgacatgcataacccaaaagggttgaaagaaagagttgagaacgtacttgggagtcggccat

SEQ ID NO: 373978 - DNA, 140 bp, Artificial Sequence
  Synthetic
atggccgactcccaagtacgttctcaactctttctttcaacccttttgggttatgcatgtcatctcgtgtgatgactccttcagcttccatttggcggataagttgtacttccatgttggggagacccagcatggcgtat

SEQ ID NO: 373979 - DNA, 140 bp, Artificial Sequence
  Synthetic
aggccctggctgctgatatggagacgattgtgtggtgaagcccctggatgagaggttcagcacttccctcctcttcttaaacgacatgggaaaggtgaggaaagacatcccgcaatgggagaccttttgggacagcggtg

SEQ ID NO: 373980 - DNA, 140 bp, Artificial Sequence
  Synthetic
caccgctgtcccaaaaggtctcccattgcgggatgtctttcctcacctttcccatgtcgtttaagaagaggagggaagtgctgaacctctcatccaggggcttcaccacacaatcgtctccatatcagcagccagggcct

SEQ ID NO: 373981 - DNA, 140 bp, Artificial Sequence
  Synthetic
aggccctggctgctgatatgatggagtttaagagagacagcctgtctaggcaaagcttacgcccagatgtggtcgctcatgtattttcatagaagggacctgcgcttagcctccatggccgaccttttgggacagcggtg

SEQ ID NO: 373982 - DNA, 140 bp, Artificial Sequence
  Synthetic
caccgctgtcccaaaaggtcggccatggaggctaagcgcaggtcccttctatgaaaatacatgagcgaccacatctgggcgtaagctttgcctagacaggctgtctctcttaaactccatcatatcagcagccagggcct

SEQ ID NO: 373983 - DNA, 140 bp, Artificial Sequence
  Synthetic
atacgccatgctgggtctccatatgctcagcagtcccaacggagtggtttccaacaagcagaacaacatggtcaatccacgctcatcatcaatggatgaccactgaagatatgctcaaagcgtacttgggagtcggccat

SEQ ID NO: 373984 - DNA, 140 bp, Artificial Sequence
  Synthetic
atggccgactcccaagtacgctttgagcatatcttcagtggtcatccattgatgatgagcgtggattgaccatgttgttctgcttgttggaaaccactccgttgggactgctgagcatatggagacccagcatggcgtat

SEQ ID NO: 373985 - DNA, 140 bp, Artificial Sequence
  Synthetic
aggccctggctgctgatatgaacatcctggacatagatctacgtcctgcatcagcatggaccctgtatgcagtggccacaacatttatcacaccaatgctgagacatagcattgaaaattgaccttttgggacagcggtg

SEQ ID NO: 373986 - DNA, 140 bp, Artificial Sequence
  Synthetic
caccgctgtcccaaaaggtcaattttcaatgctatgtctcagcattggtgtgataaatgttgtggccactgcatacagggtccatgctgatgcaggacgtagatctatgtccaggatgttcatatcagcagccagggcct

SEQ ID NO: 373987 - DNA, 140 bp, Artificial Sequence
  Synthetic
atacgccatgctgggtctccgtggtgtggatccttgattggactctcttctagggccacctgggcgaagaacattcacacagccataacccaggtcaggaacctgatcggaaaagaagagcgtacttgggagtcggccat

SEQ ID NO: 373988 - DNA, 140 bp, Artificial Sequence
  Synthetic
atggccgactcccaagtacgctcttcttttccgatcaggttcctgacctgggttatggctgtgtgaatgttcttcgcccaggtggccctagaagagagtccaatcaaggatccacaccacggagacccagcatggcgtat

SEQ ID NO: 373989 - DNA, 140 bp, Artificial Sequence
  Synthetic
aggccctggctgctgatatgatgggtcttgggaagggatggccattgtcaaaaatggacattggagttccccttctcgccatcgggtgctattcacaagtcaaccccataaccctcacaggaccttttgggacagcggtg

SEQ ID NO: 373990 - DNA, 140 bp, Artificial Sequence
  Synthetic
caccgctgtcccaaaaggtcctgtgagggttatggggttgacttgtgaatagcacccgatggcgagaaggggaactccaatgtccatttttgacaatggccatcccttcccaagacccatcatatcagcagccagggcct

SEQ ID NO: 373991 - DNA, 140 bp, Artificial Sequence
  Synthetic
atacgccatgctgggtctcctatgtagattacatgccagtcatgaaaagatacagcgctcctttcgagagtgaaggagttctgtaattaccaacaacaaacaccaaagaggctattgaagcgtacttgggagtcggccat

SEQ ID NO: 373992 - DNA, 140 bp, Artificial Sequence
  Synthetic
atggccgactcccaagtacgcttcaatagcctctttggtgtttgttgttggtaattacagaactccttcactctcgaaaggagcgctgtatcttttcatgactggcatgtaatctacataggagacccagcatggcgtat

SEQ ID NO: 373993 - DNA, 140 bp, Artificial Sequence
  Synthetic
aggccctggctgctgatatgaaaggaatcatgcatgcaggaaaacgatctctgcggcctcagcccactgagctgaggtattcatggaagacatggggcaaagcgaaaatcctctctacaggaccttttgggacagcggtg

SEQ ID NO: 373994 - DNA, 140 bp, Artificial Sequence
  Synthetic
caccgctgtcccaaaaggtcctgtagagaggattttcgctttgccccatgtcttccatgaatacctcagctcagtgggctgaggccgcagagatcgttttcctgcatgcatgattcctttcatatcagcagccagggcct

SEQ ID NO: 373995 - DNA, 140 bp, Artificial Sequence
  Synthetic
aggccctggctgctgatatgttagtctgtgtggaccgacaaggacagttccaaatcggaagcttgcttaacacagttctaacagtttatttagatagagagcagatctctggaaaaaatggaccttttgggacagcggtg

SEQ ID NO: 373996 - DNA, 140 bp, Artificial Sequence
  Synthetic
caccgctgtcccaaaaggtccattttttccagagatctgctctctatctaaataaactgttagaactgtgttaagcaagcttccgatttggaactgtccttgtcggtccacacagactaacatatcagcagccagggcct

SEQ ID NO: 373997 - DNA, 140 bp, Artificial Sequence
  Synthetic
atacgccatgctgggtctccgctggtcaacaccgaacctgaagacattgattgctggtgtaatctcacgtctgcctgggtcatgtatgggacatgcacccaaagtggggaacggagacgacgtacttgggagtcggccat

SEQ ID NO: 373998 - DNA, 140 bp, Artificial Sequence
  Synthetic
atggccgactcccaagtacgtcgtctccgttccccactttgggtgcatgtcccatacatgacccaggcagacgtgagattacaccagcaatcaatgtcttcaggttcggtgttgaccagcggagacccagcatggcgtat

SEQ ID NO: 373999 - DNA, 140 bp, Artificial Sequence
  Synthetic
aggccctggctgctgatatgcactagagaagaattcacaagaaaggtgagaagcaatgcagccttgggtgccatattcactgatgagaacaagtggaagtcggcacgtgaggctgttgaagaccttttgggacagcggtg

SEQ ID NO: 374000 - DNA, 140 bp, Artificial Sequence
  Synthetic
caccgctgtcccaaaaggtcttcaacagcctcacgtgccgacttccacttgttctcatcagtgaatatggcacccaaggctgcattgcttctcacctttcttgtgaattcttctctagtgcatatcagcagccagggcct

SEQ ID NO: 374001 - DNA, 140 bp, Artificial Sequence
  Synthetic
atacgccatgctgggtctcctaagaacctattgcatcgaagcctccatatcaaacataaccacggcaacaagatgtccaacgcaaggagagccttaccttaaagaggaacaagatcaacacgtacttgggagtcggccat

SEQ ID NO: 374002 - DNA, 140 bp, Artificial Sequence
  Synthetic
atggccgactcccaagtacgtgttgatcttgttcctctttaaggtaaggctctccttgcgttggacatcttgttgccgtggttatgtttgatatggaggcttcgatgcaataggttcttaggagacccagcatggcgtat

SEQ ID NO: 374003 - DNA, 140 bp, Artificial Sequence
  Synthetic
aggccctggctgctgatatggagaagagaccaaagaggtagtggacaagttggcacctatggcctcaacaccttcaccaatatgggagcccaactaatcagacagatggagggagaaggagaccttttgggacagcggtg

SEQ ID NO: 374004 - DNA, 140 bp, Artificial Sequence
  Synthetic
caccgctgtcccaaaaggtctccttctccctccatctgtctgattagttgggctcccatattggtgaaggtgttgaggccataggtgccaacttgtccactacctctttggtctcttctccatatcagcagccagggcct

SEQ ID NO: 374005 - DNA, 140 bp, Artificial Sequence
  Synthetic
atacgccatgctgggtctccccttcaccaatatgggagcccaactaatcagacagatggagggagaaggagtctttaagggcatccagcacctgacagccacagaagaaaccgcagtgcacgtacttgggagtcggccat

SEQ ID NO: 374006 - DNA, 140 bp, Artificial Sequence
  Synthetic
atggccgactcccaagtacgtgcactgcggtttcttctgtggctgtcaggtgctggatgcccttaaagactccttctccctccatctgtctgattagttgggctcccatattggtgaaggggagacccagcatggcgtat

SEQ ID NO: 374007 - DNA, 140 bp, Artificial Sequence
  Synthetic
atacgccatgctgggtctccggagaaattgaggatcaagggaatgtcatacacgatgtgctcaggaaagttttcaattgataaagaaatggcagaaacacagcatgggacaacagtggtacgtacttgggagtcggccat

SEQ ID NO: 374008 - DNA, 140 bp, Artificial Sequence
  Synthetic
atggccgactcccaagtacgtaccactgttgtcccatgctgtgtttctgccatttctttatcaattgaaaactttcctgagcacatcgtgtatgacattcccttgatcctcaatttctccggagacccagcatggcgtat

SEQ ID NO: 374009 - DNA, 140 bp, Artificial Sequence
  Synthetic
aggccctggctgctgatatgcttttgctgagaataccaacagtgtgaccaatatagaactggaacccccctttggggatagctatatagtaataggtgtaggagacagcgcactgacactgaccttttgggacagcggtg

SEQ ID NO: 374010 - DNA, 140 bp, Artificial Sequence
  Synthetic
caccgctgtcccaaaaggtcagtgtcagtgcgctgtctcctacacctattactatatagctatccccaaaggggggttccagttctatattggtcacactgttggtattctcagcaaaagcatatcagcagccagggcct

SEQ ID NO: 374011 - DNA, 140 bp, Artificial Sequence
  Synthetic
aggccctggctgctgatatggctatttgctcggcagtcccatcacattgggttccaacaagtcgaacaacctggtccatacacgccagacatgaatggatgacaacagaagacatgctgagaccttttgggacagcggtg

SEQ ID NO: 374012 - DNA, 140 bp, Artificial Sequence
  Synthetic
caccgctgtcccaaaaggtctcagcatgtcttctgttgtcatccattcatgtctggcgtgtatggaccaggttgttcgacttgttggaacccaatgtgatgggactgccgagcaaatagccatatcagcagccagggcct

SEQ ID NO: 374013 - DNA, 140 bp, Artificial Sequence
  Synthetic
atacgccatgctgggtctccgggtttcacagtccatgcagacatgggttgtgcggtgtcatggagtgggaaagaattgaagtgtggaagcggaatctttataattgacaacgtgcacactcgtacttgggagtcggccat

SEQ ID NO: 374014 - DNA, 140 bp, Artificial Sequence
  Synthetic
atggccgactcccaagtacgagtgtgcacgttgtcaattataaagattccgcttccacacttcaattctttcccactccatgacaccgcacaacccatgtctgcatggactgtgaaacccggagacccagcatggcgtat

SEQ ID NO: 374015 - DNA, 140 bp, Artificial Sequence
  Synthetic
atacgccatgctgggtctccagttgttagtctgtgtggaccgacaaggacagttccaaatcggaagcttgcttaacacagttctaacagtttatttgaatagagagcagatctctggaaacgtacttgggagtcggccat

SEQ ID NO: 374016 - DNA, 140 bp, Artificial Sequence
  Synthetic
atggccgactcccaagtacgtttccagagatctgctctctattcaaataaactgttagaactgtgttaagcaagcttccgatttggaactgtccttgtcggtccacacagactaacaactggagacccagcatggcgtat

SEQ ID NO: 374017 - DNA, 140 bp, Artificial Sequence
  Synthetic
aggccctggctgctgatatgagatagagaaggcatccctcattgaagtgaaaacatgtctatggcccaagacccacacattgtggagcaatggagtgctggaaagccagatgctcatcccgaccttttgggacagcggtg

SEQ ID NO: 374018 - DNA, 140 bp, Artificial Sequence
  Synthetic
caccgctgtcccaaaaggtcgggatgagcatctggctttccagcactccattgctccacaatgtgtgggtcttgggccatagacatgttttcacttcaatgagggatgccttctctatctcatatcagcagccagggcct

SEQ ID NO: 374019 - DNA, 140 bp, Artificial Sequence
  Synthetic
aggccctggctgctgatatgggctgaagaaagtcacagaagtgaagggatatacaaaaggaggacctggacatgaagaaccaatcccaatggcgacctatggatggaacctagtaaagctgaccttttgggacagcggtg

SEQ ID NO: 374020 - DNA, 140 bp, Artificial Sequence
  Synthetic
caccgctgtcccaaaaggtcagctttactaggttccatccataggtcgccattgggattggttcttcatgtccaggtcctccttttgtatatcccttcacttctgtgactttcttcagcccatatcagcagccagggcct

SEQ ID NO: 374021 - DNA, 140 bp, Artificial Sequence
  Synthetic
aggccctggctgctgatatgcaatggctcacaggaaaccaacatatgaaagagacgtggacctaggcgccggaacaagacatgtggcagtggaaccagaggtagccaacctagatatcatgaccttttgggacagcggtg

SEQ ID NO: 374022 - DNA, 140 bp, Artificial Sequence
  Synthetic
caccgctgtcccaaaaggtcatgatatctaggttggctacctctggttccactgccacatgtcttgttccggcgcctaggtccacgtctctttcatatgttggtttcctgtgagccattgcatatcagcagccagggcct

SEQ ID NO: 374023 - DNA, 140 bp, Artificial Sequence
  Synthetic
atacgccatgctgggtctcccctacgtgatgagcggtagctcagcggacctgtcactagagaaggctgccactgtgcagtgggatgagatggcagacataacaggctcaagcccaatcatcgtacttgggagtcggccat

SEQ ID NO: 374024 - DNA, 140 bp, Artificial Sequence
  Synthetic
atggccgactcccaagtacgatgattgggcttgagcctgttatgtctgccatctcatcccactgcacagtggcagccttctctagtgacaggtccgctgagctaccgctcatcacgtaggggagacccagcatggcgtat

SEQ ID NO: 374025 - DNA, 140 bp, Artificial Sequence
  Synthetic
atacgccatgctgggtctccagagtgggagactggagccatcttgggctgacgtcaggaatgacatgatatcatacggtgggggatggaggctcggagacaaatgggataaagaagaagacgtacttgggagtcggccat

SEQ ID NO: 374026 - DNA, 140 bp, Artificial Sequence
  Synthetic
atggccgactcccaagtacgtcttcttctttatcccatttgtctccgagcctccatcccccaccgtatgatatcatgtcattcctgacgtcagcccaagatggctccagtctcccactctggagacccagcatggcgtat

SEQ ID NO: 374027 - DNA, 140 bp, Artificial Sequence
  Synthetic
atacgccatgctgggtctcccccagctgtgaaatcagaacacacaggaagggagatcgtagacctcatgtgccatgcaaccttcacaacaagacttttatcatcaaccagagttccaaatcgtacttgggagtcggccat

SEQ ID NO: 374028 - DNA, 140 bp, Artificial Sequence
  Synthetic
atggccgactcccaagtacgatttggaactctggttgatgataaaagtcttgttgtgaaggttgcatggcacatgaggtctacgatctcccttcctgtgtgttctgatttcacagctgggggagacccagcatggcgtat

SEQ ID NO: 374029 - DNA, 140 bp, Artificial Sequence
  Synthetic
aggccctggctgctgatatgggaaaagttgtgggtctttatggcaacggtgtcgtcacaaggagtggaacatatgtgagtgccatagctcagactgaaaaaagcattgaagacaacctaggaccttttgggacagcggtg

SEQ ID NO: 374030 - DNA, 140 bp, Artificial Sequence
  Synthetic
caccgctgtcccaaaaggtcctaggttgtcttcaatgcttttttcagtctgagctatggcactcacatatgttccactccttgtgacgacaccgttgccataaagacccacaacttttcccatatcagcagccagggcct

SEQ ID NO: 374031 - DNA, 140 bp, Artificial Sequence
  Synthetic
aggccctggctgctgatatgtccaaaaacgaaactcacggactgggattttgtggttaccacagacatatctgaaatgggggccaactttagagctgggagagtgatagaccccaggagagaccttttgggacagcggtg

SEQ ID NO: 374032 - DNA, 140 bp, Artificial Sequence
  Synthetic
caccgctgtcccaaaaggtctctcctggggtctatcactctcccagctctaaagttggcccccatttcagatatgtctgtggtaaccacaaaatcccagtccgtgagtttcgtttttggacatatcagcagccagggcct

SEQ ID NO: 374033 - DNA, 140 bp, Artificial Sequence
  Synthetic
atacgccatgctgggtctccccactaaggaatgatgaagatcatgcccactggactgaagcaaagatgcttcttgacaatatctacaccccagaagggatcattccaacactgtttggtccgtacttgggagtcggccat

SEQ ID NO: 374034 - DNA, 140 bp, Artificial Sequence
  Synthetic
atggccgactcccaagtacggaccaaacagtgttggaatgatcccttctggggtgtagatattgtcaagaagcatctttgcttcagtccagtgggcatgatcttcatcattccttagtggggagacccagcatggcgtat

SEQ ID NO: 374035 - DNA, 140 bp, Artificial Sequence
  Synthetic
aggccctggctgctgatatggagaagactaattgggaatgagaattatctagattacatgacatcaatgaagagattcaagaacgagagtgatcccgaaggggcactctggtgagtcaacgaccttttgggacagcggtg

SEQ ID NO: 374036 - DNA, 140 bp, Artificial Sequence
  Synthetic
caccgctgtcccaaaaggtcgttgactcaccagagtgccccttcgggatcactctcgttcttgaatctcttcattgatgtcatgtaatctagataattctcattcccaattagtcttctccatatcagcagccagggcct

SEQ ID NO: 374037 - DNA, 140 bp, Artificial Sequence
  Synthetic
atacgccatgctgggtctccacgtctacctgggtcatgtatgggacatgcacccagagcggagaacggagacgagagaagcgctcagtagctttaacaccacattcaggaatgggattggcgtacttgggagtcggccat

SEQ ID NO: 374038 - DNA, 140 bp, Artificial Sequence
  Synthetic
atggccgactcccaagtacgccaatcccattcctgaatgtggtgttaaagctactgagcgcttctctcgtctccgttctccgctctgggtgcatgtcccatacatgacccaggtagacgtggagacccagcatggcgtat

SEQ ID NO: 374039 - DNA, 140 bp, Artificial Sequence
  Synthetic
atacgccatgctgggtctccaaggaccccacaagacaatcaattgatctacgtcatattgaccattctcaccattattggtctcgtggcagccaatgagatggggctaattgaaaaaacacgtacttgggagtcggccat

SEQ ID NO: 374040 - DNA, 140 bp, Artificial Sequence
  Synthetic
atggccgactcccaagtacgtgttttttcaattagccccatctcattggctgccacgagaccaataatggtgagaatggtcaatatgacgtagatcaattgattgtcttgtggggtccttggagacccagcatggcgtat

SEQ ID NO: 374041 - DNA, 140 bp, Artificial Sequence
  Synthetic
atacgccatgctgggtctccaaaaggatggccgctccacagaatggaccttggtgtgccgctattagcaatgggatgctattcccaagtgaacccaacgactttaacagcatccttagtccgtacttgggagtcggccat

SEQ ID NO: 374042 - DNA, 140 bp, Artificial Sequence
  Synthetic
atggccgactcccaagtacggactaaggatgctgttaaagtcgttgggttcacttgggaatagcatcccattgctaatagcggcacaccaaggtccattctgtggagcggccatccttttggagacccagcatggcgtat

SEQ ID NO: 374043 - DNA, 140 bp, Artificial Sequence
  Synthetic
atacgccatgctgggtctccaaacaagagctgagacatggatgtcatcggaaggagcttggaagcatgctcagagagtagagagctggatactcagaaacccaggatttgcactcttggccgtacttgggagtcggccat

SEQ ID NO: 374044 - DNA, 140 bp, Artificial Sequence
  Synthetic
atggccgactcccaagtacggccaagagtgcaaatcctgggtttctgagtatccagctctctactctctgagcatgcttccaagctccttccgatgacatccatgtctcagctcttgtttggagacccagcatggcgtat

SEQ ID NO: 374045 - DNA, 140 bp, Artificial Sequence
  Synthetic
aggccctggctgctgatatgtgatgaccaaagagcatggaacatttgggaagttgaggactatggatttggaattttcacgacaaacatatggctgaaattgcgtgactcctacacccaagaccttttgggacagcggtg

SEQ ID NO: 374046 - DNA, 140 bp, Artificial Sequence
  Synthetic
caccgctgtcccaaaaggtcttgggtgtaggagtcacgcaatttcagccatatgtttgtcgtgaaaattccaaatccatagtcctcaacttcccaaatgttccatgctctttggtcatcacatatcagcagccagggcct

SEQ ID NO: 374047 - DNA, 140 bp, Artificial Sequence
  Synthetic
aggccctggctgctgatatggatgactactgaagatatgctcaaagtgtggaacagagtgtggatagaagacaaccctaatatgattgacaaaactccagttcactcgtgggaagacatagaccttttgggacagcggtg

SEQ ID NO: 374048 - DNA, 140 bp, Artificial Sequence
  Synthetic
caccgctgtcccaaaaggtctatgtcttcccacgagtgaactggagttttgtcaatcatattagggttgtcttctatccacactctgttccacactttgagcatatcttcagtagtcatccatatcagcagccagggcct

SEQ ID NO: 374049 - DNA, 140 bp, Artificial Sequence
  Synthetic
aggccctggctgctgatatggcaactactcttgatgagaacaacatgggccttctgtgaagtcttgactttggccacaggaccaatcttgaccctgtgggagggcaacccgggaaggtttgaccttttgggacagcggtg

SEQ ID NO: 374050 - DNA, 140 bp, Artificial Sequence
  Synthetic
caccgctgtcccaaaaggtcaaaccttcccgggttgccctcccacagggtcaagattggtcctgtggccaaagtcaagacttcacagaaggcccatgttgttctcatcaagagtagttgccatatcagcagccagggcct

SEQ ID NO: 374051 - DNA, 140 bp, Artificial Sequence
  Synthetic
atacgccatgctgggtctcctaacagatgggccagagagagtcatcttagcaggtcctattccagtgactccagcaagcgctgctcagagaagagggcgaataggaaggaacccagcacacgtacttgggagtcggccat

SEQ ID NO: 374052 - DNA, 140 bp, Artificial Sequence
  Synthetic
atggccgactcccaagtacgtgtgctgggttccttcctattcgccctcttctctgagcagcgcttgctggagtcactggaataggacctgctaagatgactctctctggcccatctgttaggagacccagcatggcgtat

SEQ ID NO: 374053 - DNA, 140 bp, Artificial Sequence
  Synthetic
atacgccatgctgggtctccctgtgggagaggaggatggtcgtactacatggccacactcaagaacgtgactgaggtgaaagggtacacaaaagggggtccaggacatgaagaaccgattcgtacttgggagtcggccat

SEQ ID NO: 374054 - DNA, 140 bp, Artificial Sequence
  Synthetic
atggccgactcccaagtacgaatcggttcttcatgtcctggacccccttttgtgtaccctttcacctcagtcacgttcttgagtgtggccatgtagtacgaccatcctcctctcccacagggagacccagcatggcgtat

SEQ ID NO: 374055 - DNA, 140 bp, Artificial Sequence
  Synthetic
aggccctggctgctgatatgtgtgaacacaacatcaaagatgttgttgaacagatttaccacaagatatagaaaacccacttatgagaaggacgcagaccttggagcaggaacgagaagtgaccttttgggacagcggtg

SEQ ID NO: 374056 - DNA, 140 bp, Artificial Sequence
  Synthetic
caccgctgtcccaaaaggtcacttctcgttcctgctccaaggtctgcgtccttctcataagtgggttttctatatcttgtggtaaatctgttcaacaacatctttgatgttgtgttcacacatatcagcagccagggcct

SEQ ID NO: 374057 - DNA, 140 bp, Artificial Sequence
  Synthetic
aggccctggctgctgatatggcggacataactggctcaagcccaatcatagaagtgaagcaggatgaagatggctctttttccatacgggacgtcgaggaaaccaatatgatgactctctgaccttttgggacagcggtg

SEQ ID NO: 374058 - DNA, 140 bp, Artificial Sequence
  Synthetic
caccgctgtcccaaaaggtcagagagtcatcatattggtttcctcgacgtcccgtatggaaaaagagccatcttcatcctgcttcacttctatgattgggcttgagccagttatgtccgccatatcagcagccagggcct

SEQ ID NO: 374059 - DNA, 140 bp, Artificial Sequence
  Synthetic
atacgccatgctgggtctccggctcggcatcctccatggtgaacggggtagttaaactgctgacaaaaccttgggacgtggttccaatggtgacccagttggctatgacagacacaaccccgtacttgggagtcggccat

SEQ ID NO: 374060 - DNA, 140 bp, Artificial Sequence
  Synthetic
atggccgactcccaagtacggggttgtgtctgtcatagccaactgggtcaccattggaaccacgtcccaaggttttgtcagcagtttaactaccccgttcaccatggaggatgccgagccggagacccagcatggcgtat

SEQ ID NO: 374061 - DNA, 140 bp, Artificial Sequence
  Synthetic
atacgccatgctgggtctccaatgacattcccatgacaggaccactagtggctggagggctcctcactgtatgctacgtgctcactggacgatcggccgatttggaattggagaaagctgcgtacttgggagtcggccat

SEQ ID NO: 374062 - DNA, 140 bp, Artificial Sequence
  Synthetic
atggccgactcccaagtacgcagctttctccaattccaaatcggccgatcgtccagtgagcacgtagcatacagtgaggagccctccagccactagtggtcctgtcatgggaatgtcattggagacccagcatggcgtat

SEQ ID NO: 374063 - DNA, 140 bp, Artificial Sequence
  Synthetic
aggccctggctgctgatatggtgggctctcctcgggaagaagaaaaatcccagactgtgcacaagggaggagttcatctcaaaagtcaggtcgaatgcagccataggcgcagtctcccaggaccttttgggacagcggtg

SEQ ID NO: 374064 - DNA, 140 bp, Artificial Sequence
  Synthetic
caccgctgtcccaaaaggtcctgggagactgcgcctatggctgcattcgacctgacttttgagatgaactcctcccttgtgcacagtctgggatttttcttcttcccgaggagagcccaccatatcagcagccagggcct

SEQ ID NO: 374065 - DNA, 140 bp, Artificial Sequence
  Synthetic
aggccctggctgctgatatggaagaacagggatggacatcagccagtgaagctgtgaatgacagccgattttgggaactggttgacaaagaaagggctctgcaccaggaagggaaatgtggaccttttgggacagcggtg

SEQ ID NO: 374066 - DNA, 140 bp, Artificial Sequence
  Synthetic
caccgctgtcccaaaaggtccacatttcccttcctggtgcagagccctttctttgtcaaccagttcccaaaatcggctgtcattcacagcttcactggctgatgtccatccctgttcttccatatcagcagccagggcct

SEQ ID NO: 374067 - DNA, 140 bp, Artificial Sequence
  Synthetic
aggccctggctgctgatatgttttattagagagcagatctctgatgaacaaccaacggaagaagacgggaaaaccgtctatcaatatgctgaaacgcgtgagaaaccgtgtgtcaactgggaccttttgggacagcggtg

SEQ ID NO: 374068 - DNA, 140 bp, Artificial Sequence
  Synthetic
caccgctgtcccaaaaggtcccagttgacacacggtttctcacgcgtttcagcatattgatagacggttttcccgtcttcttccgttggttgttcatcagagatctgctctctaataaaacatatcagcagccagggcct

SEQ ID NO: 374069 - DNA, 140 bp, Artificial Sequence
  Synthetic
atacgccatgctgggtctcctgaaagagtgtggtgtcgacaggttaaagaggatggcaatcagcggagacgattgtgtggtgaagcctctggatgagaggttcagcacttccctcctcttcgtacttgggagtcggccat

SEQ ID NO: 374070 - DNA, 140 bp, Artificial Sequence
  Synthetic
atggccgactcccaagtacgaagaggagggaagtgctgaacctctcatccagaggcttcaccacacaatcgtctccgctgattgccatcctctttaacctgtcgacaccacactctttcaggagacccagcatggcgtat

SEQ ID NO: 374071 - DNA, 140 bp, Artificial Sequence
  Synthetic
aggccctggctgctgatatgcaatgaaattggtcatggcgttcatagccttccttagatttctggccattccaccaacagcaggagttttggccagatggggaaccttcaagaagtcggggaccttttgggacagcggtg

SEQ ID NO: 374072 - DNA, 140 bp, Artificial Sequence
  Synthetic
caccgctgtcccaaaaggtccccgacttcttgaaggttccccatctggccaaaactcctgctgttggtggaatggccagaaatctaaggaaggctatgaacgccatgaccaatttcattgcatatcagcagccagggcct

SEQ ID NO: 374073 - DNA, 140 bp, Artificial Sequence
  Synthetic
atacgccatgctgggtctccccagcagcacttgctttccacttgacttcacgagatggagagccgcgcatgattgtggggaagaatgaaagaggaaaatccctactttttaagacagcctcgtacttgggagtcggccat

SEQ ID NO: 374074 - DNA, 140 bp, Artificial Sequence
  Synthetic
atggccgactcccaagtacgaggctgtcttaaaaagtagggattttcctctttcattcttccccacaatcatgcgcggctctccatctcgtgaagtcaagtggaaagcaagtgctgctggggagacccagcatggcgtat

SEQ ID NO: 374075 - DNA, 140 bp, Artificial Sequence
  Synthetic
atacgccatgctgggtctccggcatccagggttcaccatactagccctatttcttgcccattacataggcacctccttgacccagaaggtggttatttttatactactaatgctggtcaccgtacttgggagtcggccat

SEQ ID NO: 374076 - DNA, 140 bp, Artificial Sequence
  Synthetic
atggccgactcccaagtacggtgaccagcattagtagtataaaaataaccaccttctgggtcaaggaggtgcctatgtaatgggcaagaaatagggctagtatggtgaaccctggatgccggagacccagcatggcgtat

SEQ ID NO: 374077 - DNA, 140 bp, Artificial Sequence
  Synthetic
aggccctggctgctgatatgcccatccatgacaatgagatgtgtgggagtgggaaacagagattttgtggaaggtctgtcaggagctacgtgggttgacgtggtgctagagcacgggggggaccttttgggacagcggtg

SEQ ID NO: 374078 - DNA, 140 bp, Artificial Sequence
  Synthetic
caccgctgtcccaaaaggtcccccccgtgctctagcaccacgtcaacccacgtagctcctgacagaccttccacaaaatctctgtttcccactcccacacatctcattgtcatggatgggcatatcagcagccagggcct

SEQ ID NO: 374079 - DNA, 140 bp, Artificial Sequence
  Synthetic
aggccctggctgctgatatgaacgggaggcgtaaaaatcccagggaggccatgcgccacggaagctgtacgcgtggcatattggactagcggttagaggagacccctcccatcactaacggaccttttgggacagcggtg

SEQ ID NO: 374080 - DNA, 140 bp, Artificial Sequence
  Synthetic
caccgctgtcccaaaaggtccgttagtgatgggaggggtctcctctaaccgctagtccaatatgccacgcgtacagcttccgtggcgcatggcctccctgggatttttacgcctcccgttcatatcagcagccagggcct

SEQ ID NO: 374081 - DNA, 140 bp, Artificial Sequence
  Synthetic
atacgccatgctgggtctccgcggttttgcctgaggagcaggaccagaactacgtgtgtaagcacacatacgtagatagaggctgggggaacggctgtggtttgttcggcaagggaagctcgtacttgggagtcggccat

SEQ ID NO: 374082 - DNA, 140 bp, Artificial Sequence
  Synthetic
atggccgactcccaagtacgagcttcccttgccgaacaaaccacagccgttcccccagcctctatctacgtatgtgtgcttacacacgtagttctggtcctgctcctcaggcaaaaccgcggagacccagcatggcgtat

SEQ ID NO: 374083 - DNA, 140 bp, Artificial Sequence
  Synthetic
atacgccatgctgggtctcccaggatcttctggtctttcccagcgtcaatatgctgtttttgtgttgggggggtctcctctaacctctagtccttccaccaggagtacagcttcctcgtgcgtacttgggagtcggccat

SEQ ID NO: 374084 - DNA, 140 bp, Artificial Sequence
  Synthetic
atggccgactcccaagtacgcacgaggaagctgtactcctggtggaaggactagaggttagaggagacccccccaacacaaaaacagcatattgacgctgggaaagaccagaagatcctgggagacccagcatggcgtat

SEQ ID NO: 374085 - DNA, 140 bp, Artificial Sequence
  Synthetic
atacgccatgctgggtctccagttgttagtctgtgtggaccgacaaggacagttccaaatcggaagcttgcttaacacagttctaacagtttgttttaaatagagagcagatctctggaacgtacttgggagtcggccat

SEQ ID NO: 374086 - DNA, 140 bp, Artificial Sequence
  Synthetic
atggccgactcccaagtacgttccagagatctgctctctatttaaaacaaactgttagaactgtgttaagcaagcttccgatttggaactgtccttgtcggtccacacagactaacaactggagacccagcatggcgtat

SEQ ID NO: 374087 - DNA, 140 bp, Artificial Sequence
  Synthetic
atacgccatgctgggtctccacctacctctaccatggacatcaggagccacaacagaaacaccaacttggaacaggaaggagctccttgtgacattcaaaaatgcacatgcgaaaaaacacgtacttgggagtcggccat

SEQ ID NO: 374088 - DNA, 140 bp, Artificial Sequence
  Synthetic
atggccgactcccaagtacgtgttttttcgcatgtgcatttttgaatgtcacaaggagctccttcctgttccaagttggtgtttctgttgtggctcctgatgtccatggtagaggtaggtggagacccagcatggcgtat

SEQ ID NO: 374089 - DNA, 140 bp, Artificial Sequence
  Synthetic
aggccctggctgctgatatgagatggggacagttgaaaaagaataaggccatcaagatactgattggattcaggaaggagataggtcgcatgttaaacatcttgaataggagaagaaggtgaccttttgggacagcggtg

SEQ ID NO: 374090 - DNA, 140 bp, Artificial Sequence
  Synthetic
caccgctgtcccaaaaggtcaccttcttctcctattcaagatgtttaacatgcgacctatctccttcctgaatccaatcagtatcttgatggccttattctttttcaactgtccccatctcatatcagcagccagggcct

SEQ ID NO: 374091 - DNA, 140 bp, Artificial Sequence
  Synthetic
aggccctggctgctgatatgcgcagcatgggacaatactcattaaggtcgagtacaaaggggaagatgcaccttgcaagattcctttctccacagaggatggacaagggaaagctcacaagaccttttgggacagcggtg

SEQ ID NO: 374092 - DNA, 140 bp, Artificial Sequence
  Synthetic
caccgctgtcccaaaaggtcttgtgagctttcccttgtccatcctctgtggagaaaggaatcttgcaaggtgcatcttcccctttgtactcgaccttaatgagtattgtcccatgctgcgcatatcagcagccagggcct

SEQ ID NO: 374093 - DNA, 140 bp, Artificial Sequence
  Synthetic
atacgccatgctgggtctcccaggatttatggcttacatgattgggcaaacaggaatccagcgaactgttttctttgtcctaatgatgctagtcgccccatcttacggaatgcgatgcgtcgtacttgggagtcggccat

SEQ ID NO: 374094 - DNA, 140 bp, Artificial Sequence
  Synthetic
atggccgactcccaagtacgacgcatcgcattccgtaagatggggcgactagcatcattaggacaaagaaaacagttcgctggattcctgtttgcccaatcatgtaagccataaatcctgggagacccagcatggcgtat

SEQ ID NO: 374095 - DNA, 140 bp, Artificial Sequence
  Synthetic
atacgccatgctgggtctccggatagggttgaattcaaaaaacacatccatgtcattttcatgcattgcaataggaatcatcacactctatttgggagctgtggtacaagctgacatgggcgtacttgggagtcggccat

SEQ ID NO: 374096 - DNA, 140 bp, Artificial Sequence
  Synthetic
atggccgactcccaagtacgcccatgtcagcttgtaccacagctcccaaatagagtgtgatgattcctattgcaatgcatgaaaatgacatggatgtgttttttgaattcaaccctatccggagacccagcatggcgtat

SEQ ID NO: 374097 - DNA, 140 bp, Artificial Sequence
  Synthetic
aggccctggctgctgatatgtctggactacatgccttcaatgaagagatttaggaaggaggaggagtcggagggagccatttggtgaacgtaggaagctaactgtcaggccacattaagcgaccttttgggacagcggtg

SEQ ID NO: 374098 - DNA, 140 bp, Artificial Sequence
  Synthetic
caccgctgtcccaaaaggtcgcttaatgtggcctgacagttagcttcctacgttcaccaaatggctccctccgactcctcctccttcctaaatctcttcattgaaggcatgtagtccagacatatcagcagccagggcct

SEQ ID NO: 374099 - DNA, 140 bp, Artificial Sequence
  Synthetic
atacgccatgctgggtctccgtgtgtcataaactggaaaggcaaagaacttaaatgcggaagtggaattttcgtcaccaacgaggtccatacctggacagagcagtacaaattccaagcgcgtacttgggagtcggccat

SEQ ID NO: 374100 - DNA, 140 bp, Artificial Sequence
  Synthetic
atggccgactcccaagtacgcgcttggaatttgtactgctctgtccaggtatggacctcgttggtgacgaaaattccacttccgcatttaagttctttgcctttccagtttatgacacacggagacccagcatggcgtat

SEQ ID NO: 374101 - DNA, 140 bp, Artificial Sequence
  Synthetic
aggccctggctgctgatatgcaacaagatgtccaacgcaaggagagccttatctcaaagaggaacaagaccaacagtacatttgccggagagatgtggtagatagagggtggggcaatgggaccttttgggacagcggtg

SEQ ID NO: 374102 - DNA, 140 bp, Artificial Sequence
  Synthetic
caccgctgtcccaaaaggtcccattgccccaccctctatctaccacatctctccggcaaatgtactgttggtcttgttcctctttgagataaggctctccttgcgttggacatcttgttgcatatcagcagccagggcct

SEQ ID NO: 374103 - DNA, 140 bp, Artificial Sequence
  Synthetic
atacgccatgctgggtctccctgtggcttgtttggaaaaggaggagttgtgacatgtgcgaagtttttatgctcggggaagataacaggcaatctggtccaaattgaaaaccttgaatatcgtacttgggagtcggccat

SEQ ID NO: 374104 - DNA, 140 bp, Artificial Sequence
  Synthetic
atggccgactcccaagtacgatattcaaggttttcaatttggaccagattgcctgttatcttccccgagcataaaaacttcgcacatgtcacaactcctccttttccaaacaagccacagggagacccagcatggcgtat

SEQ ID NO: 374105 - DNA, 140 bp, Artificial Sequence
  Synthetic
atacgccatgctgggtctccagccaggtggttatggggttttctttctagaaacaagaaaccaagaatttgtacaagagaggagttcacaagaaaagttaggtcaaacgcagccattggacgtacttgggagtcggccat

SEQ ID NO: 374106 - DNA, 140 bp, Artificial Sequence
  Synthetic
atggccgactcccaagtacgtccaatggctgcgtttgacctaacttttcttgtgaactcctctcttgtacaaattcttggtttcttgtttctagaaagaaaaccccataaccacctggctggagacccagcatggcgtat

SEQ ID NO: 374107 - DNA, 140 bp, Artificial Sequence
  Synthetic
atacgccatgctgggtctcctagaagtcaaattgccggactatggagaactaacactcgattgtgaacccaggtctggaattgatttcaatgagatgatcctgatgaaaatgaaaaagaacgtacttgggagtcggccat

SEQ ID NO: 374108 - DNA, 140 bp, Artificial Sequence
  Synthetic
atggccgactcccaagtacgttctttttcattttcatcaggatcatctcattgaaatcaattccagacctgggttcacaatcgagtgttagttctccatagtccggcaatttgacttctaggagacccagcatggcgtat

SEQ ID NO: 374109 - DNA, 140 bp, Artificial Sequence
  Synthetic
atacgccatgctgggtctccgggccaaacacaccggagtgtccaagtgcctcaagagcatggaatgtgtgggaggtggaagattacgggttcggagtcttcacaaccaacatatggctgacgtacttgggagtcggccat

SEQ ID NO: 374110 - DNA, 140 bp, Artificial Sequence
  Synthetic
atggccgactcccaagtacgtcagccatatgttggttgtgaagactccgaacccgtaatcttccacctcccacacattccatgctcttgaggcacttggacactccggtgtgtttggcccggagacccagcatggcgtat

SEQ ID NO: 374111 - DNA, 140 bp, Artificial Sequence
  Synthetic
atacgccatgctgggtctccaacgtggcttgtgcacaagcaatggtttttggacctacctctaccatggtcagcaggagcagacacatcagaagttcattggaattacaaagagagaatgcgtacttgggagtcggccat

SEQ ID NO: 374112 - DNA, 140 bp, Artificial Sequence
  Synthetic
atggccgactcccaagtacgcattctctctttgtaattccaatgaacttctgatgtgtctgctcctgctgaccatggtagaggtaggtccaaaaaccattgcttgtgcacaagccacgttggagacccagcatggcgtat

SEQ ID NO: 374113 - DNA, 140 bp, Artificial Sequence
  Synthetic
atacgccatgctgggtctccgtgacattcaaagttcctcatgccaagagacaggatgtgacagtactaggatctcaggagggagctatgcattctgccctcgccggagccacagaagtggcgtacttgggagtcggccat

SEQ ID NO: 374114 - DNA, 140 bp, Artificial Sequence
  Synthetic
atggccgactcccaagtacgccacttctgtggctccggcgagggcagaatgcatagctccctcctgagatcctagtactgtcacatcctgtctcttggcatgaggaactttgaatgtcacggagacccagcatggcgtat

SEQ ID NO: 374115 - DNA, 140 bp, Artificial Sequence
  Synthetic
atacgccatgctgggtctcctgaaaacctgcacatggccaaaatcacacactctttggagcaacggtgtgctagagagtgacatgatcattccaaagagtctagctggtcctatttcgcacgtacttgggagtcggccat

SEQ ID NO: 374116 - DNA, 140 bp, Artificial Sequence
  Synthetic
atggccgactcccaagtacgtgcgaaataggaccagctagactctttggaatgatcatgtcactctctagcacaccgttgctccaaagagtgtgtgattttggccatgtgcaggttttcaggagacccagcatggcgtat

SEQ ID NO: 374117 - DNA, 140 bp, Artificial Sequence
  Synthetic
atacgccatgctgggtctccacacaactacaggcccgggtaccacacccaaacggcaggaccctggcacttaggaaaattggagctggacttcaactattgtgaaggaacaacagttgtccgtacttgggagtcggccat

SEQ ID NO: 374118 - DNA, 140 bp, Artificial Sequence
  Synthetic
atggccgactcccaagtacggacaactgttgttccttcacaatagttgaagtccagctccaattttcctaagtgccagggtcctgccgtttgggtgtggtacccgggcctgtagttgtgtggagacccagcatggcgtat

SEQ ID NO: 374119 - DNA, 140 bp, Artificial Sequence
  Synthetic
aggccctggctgctgatatgtaggaaaattggagctggacttcaactattgtgaaggaacaacagttgtcatcacagaaaattgtgggacaagaggcccatcattgagaacgacaacagtgaccttttgggacagcggtg

SEQ ID NO: 374120 - DNA, 140 bp, Artificial Sequence
  Synthetic
caccgctgtcccaaaaggtcactgttgtcgttctcaatgatgggcctcttgtcccacaattttctgtgatgacaactgttgttccttcacaatagttgaagtccagctccaattttcctacatatcagcagccagggcct

SEQ ID NO: 374121 - DNA, 140 bp, Artificial Sequence
  Synthetic
atacgccatgctgggtctccgagataagagatgtgaacaaggaaaaagtagttgggcgcatcatctcatccaccccttttgctgagaataccaacagcgtaaccaacatagaattagaaccgtacttgggagtcggccat

SEQ ID NO: 374122 - DNA, 140 bp, Artificial Sequence
  Synthetic
atggccgactcccaagtacggttctaattctatgttggttacgctgttggtattctcagcaaaaggggtggatgagatgatgcgcccaactactttttccttgttcacatctcttatctcggagacccagcatggcgtat

SEQ ID NO: 374123 - DNA, 140 bp, Artificial Sequence
  Synthetic
atacgccatgctgggtctcctcgactggctggaaaaatatggcgtcgaaaggctgaaaagaatggcaatcagcggagatgactgcgtagtgaaaccaattgatgataggtttgcaacagccgtacttgggagtcggccat

SEQ ID NO: 374124 - DNA, 140 bp, Artificial Sequence
  Synthetic
atggccgactcccaagtacggctgttgcaaacctatcatcaattggtttcactacgcagtcatctccgctgattgccattcttttcagcctttcgacgccatatttttccagccagtcgaggagacccagcatggcgtat

SEQ ID NO: 374125 - DNA, 140 bp, Artificial Sequence
  Synthetic
atacgccatgctgggtctccacactccattggttcaggaaagggagctccattggcaagatgtttgagtccacatacagaggtgcaaaacgaatggccattctaggtgaaacagcttgggcgtacttgggagtcggccat

SEQ ID NO: 374126 - DNA, 140 bp, Artificial Sequence
  Synthetic
atggccgactcccaagtacgcccaagctgtttcacctagaatggccattcgttttgcacctctgtatgtggactcaaacatcttgccaatggagctccctttcctgaaccaatggagtgtggagacccagcatggcgtat

SEQ ID NO: 374127 - DNA, 140 bp, Artificial Sequence
  Synthetic
atacgccatgctgggtctccattttggttctgttggtggactgttcacatcactgggaaaggctgtacaccaagtttttgggagtgtgtatacaaccatgtttggaggggtctcatggatcgtacttgggagtcggccat

SEQ ID NO: 374128 - DNA, 140 bp, Artificial Sequence
  Synthetic
atggccgactcccaagtacgatccatgagacccctccaaacatggttgtatacacactcccaaaaacttggtgtacagcctttcccagtgatgtgaacagtccaccaacagaaccaaaatggagacccagcatggcgtat

SEQ ID NO: 374129 - DNA, 140 bp, Artificial Sequence
  Synthetic
atacgccatgctgggtctccgattagaatcctaattgggttcttagtattgtggattggcacgaattcaagaaatacttcaatggcaatgacgtgcatagctgttggaggaatcactctgcgtacttgggagtcggccat

SEQ ID NO: 374130 - DNA, 140 bp, Artificial Sequence
  Synthetic
atggccgactcccaagtacgcagagtgattcctccaacagctatgcacgtcattgccattgaagtatttcttgaattcgtgccaatccacaatactaagaacccaattaggattctaatcggagacccagcatggcgtat

SEQ ID NO: 374131 - DNA, 140 bp, Artificial Sequence
  Synthetic
atacgccatgctgggtctcccctggtcaatccatgcccatcaccaatggatgacaacagaagacatgctgtcagtgtggaatagggtttggatagaggaaaacccatggatggaggacaacgtacttgggagtcggccat

SEQ ID NO: 374132 - DNA, 140 bp, Artificial Sequence
  Synthetic
atggccgactcccaagtacgttgtcctccatccatgggttttcctctatccaaaccctattccacactgacagcatgtcttctgttgtcatccattggtgatgggcatggattgaccaggggagacccagcatggcgtat

SEQ ID NO: 374133 - DNA, 140 bp, Artificial Sequence
  Synthetic
aggccctggctgctgatatgaggacattgaacaaatggcaaatggaatcgccctggggctcatggctcttaaattgataacacaatttgaaacataccaattatggacagcattaatctcgaccttttgggacagcggtg

SEQ ID NO: 374134 - DNA, 140 bp, Artificial Sequence
  Synthetic
caccgctgtcccaaaaggtcgagattaatgctgtccataattggtatgtttcaaattgtgttatcaatttaagagccatgagccccagggcgattccatttgccatttgttcaatgtcctcatatcagcagccagggcct

SEQ ID NO: 374135 - DNA, 140 bp, Artificial Sequence
  Synthetic
aggccctggctgctgatatgagaacagggctggactttaatgagatggtgctattgacaatgaaagaaaaatcatggcttgtccacaaacaatggtttctagacttaccactgccttggagaccttttgggacagcggtg

SEQ ID NO: 374136 - DNA, 140 bp, Artificial Sequence
  Synthetic
caccgctgtcccaaaaggtctccaaggcagtggtaagtctagaaaccattgtttgtggacaagccatgatttttctttcattgtcaatagcaccatctcattaaagtccagccctgttctcatatcagcagccagggcct

SEQ ID NO: 374137 - DNA, 140 bp, Artificial Sequence
  Synthetic
atacgccatgctgggtctccgtgaaaggggtgttgaccaaaggcaagagagcactcacacctccagtgaatgatttgaaatattcatggaagacatggggaaaagcaaaaatctttaccccgtacttgggagtcggccat

SEQ ID NO: 374138 - DNA, 140 bp, Artificial Sequence
  Synthetic
atggccgactcccaagtacggggtaaagatttttgcttttccccatgtcttccatgaatatttcaaatcattcactggaggtgtgagtgctctcttgcctttggtcaacacccctttcacggagacccagcatggcgtat

SEQ ID NO: 374139 - DNA, 140 bp, Artificial Sequence
  Synthetic
atacgccatgctgggtctccatatgtgagtgctatagcccagacggaaaaaagcattgaagacaatccagagattgaagatgacatttttcgaaagaaaagattgaccattatggacctccgtacttgggagtcggccat

SEQ ID NO: 374140 - DNA, 140 bp, Artificial Sequence
  Synthetic
atggccgactcccaagtacggaggtccataatggtcaatcttttctttcgaaaaatgtcatcttcaatctctggattgtcttcaatgcttttttccgtctgggctatagcactcacatatggagacccagcatggcgtat

SEQ ID NO: 374141 - DNA, 140 bp, Artificial Sequence
  Synthetic
aggccctggctgctgatatgctggcaaatagagaaagcatctcttattgaagtgaaaacatgcctgtggcccaaaacccacacgctgtggagcaatggagtgctggaaagtcagatgctcgaccttttgggacagcggtg

SEQ ID NO: 374142 - DNA, 140 bp, Artificial Sequence
  Synthetic
caccgctgtcccaaaaggtcgagcatctgactttccagcactccattgctccacagcgtgtgggttttgggccacaggcatgttttcacttcaataagagatgctttctctatttgccagcatatcagcagccagggcct

SEQ ID NO: 374143 - DNA, 140 bp, Artificial Sequence
  Synthetic
atacgccatgctgggtctccattccaagatcatatgcaggccctttttcacagcacaattaccgccagggctatgccacgcaaaccgcgggcccatggcacttaggcaaattggagatagcgtacttgggagtcggccat

SEQ ID NO: 374144 - DNA, 140 bp, Artificial Sequence
  Synthetic
atggccgactcccaagtacgctatctccaatttgcctaagtgccatgggcccgcggtttgcgtggcatagccctggcggtaattgtgctgtgaaaaagggcctgcatatgatcttggaatggagacccagcatggcgtat

SEQ ID NO: 374145 - DNA, 140 bp, Artificial Sequence
  Synthetic
atacgccatgctgggtctccggggttggagtacaaaaagacggagtcttccacaccatgtggcacgtcacaagaggggcagtgttgacacataatgggaaaagactggaaccaaactgggcgtacttgggagtcggccat

SEQ ID NO: 374146 - DNA, 140 bp, Artificial Sequence
  Synthetic
atggccgactcccaagtacgcccagtttggttccagtcttttcccattatgtgtcaacactgcccctcttgtgacgtgccacatggtgtggaagactccgtctttttgtactccaaccccggagacccagcatggcgtat

SEQ ID NO: 374147 - DNA, 140 bp, Artificial Sequence
  Synthetic
atacgccatgctgggtctccgaattattcggattacatgacatcaatgaagagattcaagaacgagagtgaacccgaaggggcactctggtgagtcaacacacttacaaaataaatgaaacgtacttgggagtcggccat

SEQ ID NO: 374148 - DNA, 140 bp, Artificial Sequence
  Synthetic
atggccgactcccaagtacgtttcatttattttgtaagtgtgttgactcaccagagtgccccttcgggttcactctcgttcttgaatctcttcattgatgtcatgtaatccgaataattcggagacccagcatggcgtat

SEQ ID NO: 374149 - DNA, 140 bp, Artificial Sequence
  Synthetic
atacgccatgctgggtctccaagatggatgttggtacgggatggagattaggcccttgagtgaaaaagaagagaacatggtcaaatcacaggtaacagccggacagggcacatcagaaaccgtacttgggagtcggccat

SEQ ID NO: 374150 - DNA, 140 bp, Artificial Sequence
  Synthetic
atggccgactcccaagtacggtttctgatgtgccctgtccggctgttacctgtgatttgaccatgttctcttctttttcactcaagggcctaatctccatcccgtaccaacatccatcttggagacccagcatggcgtat

SEQ ID NO: 374151 - DNA, 140 bp, Artificial Sequence
  Synthetic
aggccctggctgctgatatgtctcctatcataaacagagagggaaaggtagtgggactatatggcaatggagtggttacaaagaatggcggctacgtcagcggaatagcgcaaacaaatggaccttttgggacagcggtg

SEQ ID NO: 374152 - DNA, 140 bp, Artificial Sequence
  Synthetic
caccgctgtcccaaaaggtccatttgtttgcgctattccgctgacgtagccgccattctttgtaaccactccattgccatatagtcccactacctttccctctctgtttatgataggagacatatcagcagccagggcct

SEQ ID NO: 374153 - DNA, 140 bp, Artificial Sequence
  Synthetic
aggccctggctgctgatatgtatcatgttaggggacactatgtctggcagaataggaggacagattcacctagccatcatggcagtgttcaagatgtcaccaggatatgtgttgggtgtggaccttttgggacagcggtg

SEQ ID NO: 374154 - DNA, 140 bp, Artificial Sequence
  Synthetic
caccgctgtcccaaaaggtccacacccaacacatatcctggtgacatcttgaacactgccatgatggctaggtgaatctgtcctcctattctgccagacatagtgtcccctaacatgatacatatcagcagccagggcct

SEQ ID NO: 374155 - DNA, 140 bp, Artificial Sequence
  Synthetic
atacgccatgctgggtctccaacacccaagtgggaaccttagccctttccctgactttcataagatcaacaacaccattggtcatggcttggaggaccatcatggctgtgttctttgtggcgtacttgggagtcggccat

SEQ ID NO: 374156 - DNA, 140 bp, Artificial Sequence
  Synthetic
atggccgactcccaagtacgccacaaagaacacagccatgatggtcctccaagccatgaccaatggtgttgttgatcttatgaaagtcagggaaagggctaaggttcccacttgggtgttggagacccagcatggcgtat

SEQ ID NO: 374157 - DNA, 140 bp, Artificial Sequence
  Synthetic
atacgccatgctgggtctcctgggtagaaataacagcacttatcttaggggcccaggctttgccagtgtacctaatgaccctcatgaaaggagcctcaagaagatcttggcctcttaatgcgtacttgggagtcggccat

SEQ ID NO: 374158 - DNA, 140 bp, Artificial Sequence
  Synthetic
atggccgactcccaagtacgcattaagaggccaagatcttcttgaggctcctttcatgagggtcattaggtacactggcaaagcctgggcccctaagataagtgctgttatttctacccaggagacccagcatggcgtat

SEQ ID NO: 374159 - DNA, 140 bp, Artificial Sequence
  Synthetic
atacgccatgctgggtctccctggaacagctgatgcctttcctcagagcaacgctccaattcaagatgaagaaagggacataccagaacgctcatggaattcaggcaatgaatggatcaccgtacttgggagtcggccat

SEQ ID NO: 374160 - DNA, 140 bp, Artificial Sequence
  Synthetic
atggccgactcccaagtacggtgatccattcattgcctgaattccatgagcgttctggtatgtccctttcttcatcttgaattggagcgttgctctgaggaaaggcatcagctgttccagggagacccagcatggcgtat

SEQ ID NO: 374161 - DNA, 140 bp, Artificial Sequence
  Synthetic
aggccctggctgctgatatgagcggcttacgtaatgagtggcagctcagcagacctgtcactagagaaggctgctaatgtgcaatgggatgaaatggcggacataactggctcaagcccagaccttttgggacagcggtg

SEQ ID NO: 374162 - DNA, 140 bp, Artificial Sequence
  Synthetic
caccgctgtcccaaaaggtctgggcttgagccagttatgtccgccatttcatcccattgcacattagcagccttctctagtgacaggtctgctgagctgccactcattacgtaagccgctcatatcagcagccagggcct

SEQ ID NO: 374163 - DNA, 140 bp, Artificial Sequence
  Synthetic
atacgccatgctgggtctccacccgctgccactcagaaagccacactgtctgaaggggtgtataggatcatgcaaagagggttgttcgggaaaactcaggttggagtagggatacacatgcgtacttgggagtcggccat

SEQ ID NO: 374164 - DNA, 140 bp, Artificial Sequence
  Synthetic
atggccgactcccaagtacgcatgtgtatccctactccaacctgagttttcccgaacaaccctctttgcatgatcctatacaccccttcagacagtgtggctttctgagtggcagcgggtggagacccagcatggcgtat

SEQ ID NO: 374165 - DNA, 140 bp, Artificial Sequence
  Synthetic
aggccctggctgctgatatggctcactggacagaagcaaaaatgctgctggacaacatcaacactccagaaggaatcataccagctctctttgaaccagaaagggagaagtcagccgccagaccttttgggacagcggtg

SEQ ID NO: 374166 - DNA, 140 bp, Artificial Sequence
  Synthetic
caccgctgtcccaaaaggtctggcggctgacttctccctttctggttcaaagagagctggtatgattccttctggagtgttgatgttgtccagcagcatttttgcttctgtccagtgagccatatcagcagccagggcct

SEQ ID NO: 374167 - DNA, 140 bp, Artificial Sequence
  Synthetic
atacgccatgctgggtctccaggaatcataccagctctctttgaaccagaaagggagaagtcagccgccatagacggtgaatatcgcctgaagggtgaatccaggaagactttcgtggaacgtacttgggagtcggccat

SEQ ID NO: 374168 - DNA, 140 bp, Artificial Sequence
  Synthetic
atggccgactcccaagtacgttccacgaaagtcttcctggattcacccttcaggcgatattcaccgtctatggcggctgacttctccctttctggttcaaagagagctggtatgattcctggagacccagcatggcgtat

SEQ ID NO: 374169 - DNA, 140 bp, Artificial Sequence
  Synthetic
aggccctggctgctgatatgtgattacgttagtgccataacgcaagccgaaagaattggtgagccagattatgaagtggatgaggacatttttcgaaagaaaagattaactataatggacgaccttttgggacagcggtg

SEQ ID NO: 374170 - DNA, 140 bp, Artificial Sequence
  Synthetic
caccgctgtcccaaaaggtcgtccattatagttaatcttttctttcgaaaaatgtcctcatccacttcataatctggctcaccaattctttcggcttgcgttatggcactaacgtaatcacatatcagcagccagggcct

SEQ ID NO: 374171 - DNA, 140 bp, Artificial Sequence
  Synthetic
aggccctggctgctgatatgcatgtgtcatgcaaccttcacaacgagacttttgtcatcaaccagggttccaaattataacctcatagtgatggatgaagcacattttactgacccttgtgaccttttgggacagcggtg

SEQ ID NO: 374172 - DNA, 140 bp, Artificial Sequence
  Synthetic
caccgctgtcccaaaaggtcacaagggtcagtaaaatgtgcttcatccatcactatgaggttataatttggaaccctggttgatgacaaaagtctcgttgtgaaggttgcatgacacatgcatatcagcagccagggcct

SEQ ID NO: 374173 - DNA, 140 bp, Artificial Sequence
  Synthetic
atacgccatgctgggtctcctcatggaacacagggttcgactggataacagactaccaaggaaaaactgtgtggtttgttcccagcataaaagctggaaatgacattgcaaattgtttgacgtacttgggagtcggccat

SEQ ID NO: 374174 - DNA, 140 bp, Artificial Sequence
  Synthetic
atggccgactcccaagtacgtcaaacaatttgcaatgtcatttccagcttttatgctgggaacaaaccacacagtttttccttggtagtctgttatccagtcgaaccctgtgttccatgaggagacccagcatggcgtat

SEQ ID NO: 374175 - DNA, 140 bp, Artificial Sequence
  Synthetic
atacgccatgctgggtctccgaaagtcgggaaagagagtgatccagttgagcagaaaaacctttgacacagagtatccaaagacgaaactcacggattgggattttgtggttaccacagacgtacttgggagtcggccat

SEQ ID NO: 374176 - DNA, 140 bp, Artificial Sequence
  Synthetic
atggccgactcccaagtacgtctgtggtaaccacaaaatcccaatccgtgagtttcgtctttggatactctgtgtcaaaggtttttctgctcaactggatcactctctttcccgactttcggagacccagcatggcgtat

SEQ ID NO: 374177 - DNA, 140 bp, Artificial Sequence
  Synthetic
aggccctggctgctgatatgatcaaaaatggacttaggcgtaccactactggcattgggttgctattcacaagtgaacccactgactctaacagcggcagtacttttgctagttacacatgaccttttgggacagcggtg

SEQ ID NO: 374178 - DNA, 140 bp, Artificial Sequence
  Synthetic
caccgctgtcccaaaaggtcatgtgtaactagcaaaagtactgccgctgttagagtcagtgggttcacttgtgaatagcaacccaatgccagtagtggtacgcctaagtccatttttgatcatatcagcagccagggcct

SEQ ID NO: 374179 - DNA, 140 bp, Artificial Sequence
  Synthetic
atacgccatgctgggtctccgcgaataggtaggaatccagcacaagaagatgaccaatatgttttctccggagacccactaaagaatgatgaagatcatgcccactggacagaagcaaagcgtacttgggagtcggccat

SEQ ID NO: 374180 - DNA, 140 bp, Artificial Sequence
  Synthetic
atggccgactcccaagtacgctttgcttctgtccagtgggcatgatcttcatcattctttagtgggtctccggagaaaacatattggtcatcttcttgtgctggattcctacctattcgcggagacccagcatggcgtat

SEQ ID NO: 374181 - DNA, 140 bp, Artificial Sequence
  Synthetic
atacgccatgctgggtctccatgttgcttgacaatatctacactcctgaagggataattccaacattgtttggtccggaaagggaaaaaacccaagccattgatggagagtttcgcctcacgtacttgggagtcggccat

SEQ ID NO: 374182 - DNA, 140 bp, Artificial Sequence
  Synthetic
atggccgactcccaagtacgtgaggcgaaactctccatcaatggcttgggttttttccctttccggaccaaacaatgttggaattatcccttcaggagtgtagatattgtcaagcaacatggagacccagcatggcgtat

SEQ ID NO: 374183 - DNA, 140 bp, Artificial Sequence
  Synthetic
atacgccatgctgggtctccgcttgccttttctattatgaaatcagttggaacaggaaaaagaggaacaggctctcaaggtgaaactttaggagaaaaatggaaaaagaaattgaatcaacgtacttgggagtcggccat

SEQ ID NO: 374184 - DNA, 140 bp, Artificial Sequence
  Synthetic
atggccgactcccaagtacgttgattcaatttctttttccatttttctcctaaagtttcaccttgagagcctgttcctctttttcctgttccaactgatttcataatagaaaaggcaagcggagacccagcatggcgtat

SEQ ID NO: 374185 - DNA, 140 bp, Artificial Sequence
  Synthetic
atacgccatgctgggtctccccaaaatggttagatgcacgtgtgtacgctgaccccatggctttgaaggatttcaaggagtttgccagtggaagaaagagcataactcttgacatcctaacgtacttgggagtcggccat

SEQ ID NO: 374186 - DNA, 140 bp, Artificial Sequence
  Synthetic
atggccgactcccaagtacgttaggatgtcaagagttatgctctttcttccactggcaaactccttgaaatccttcaaagccatggggtcagcgtacacacgtgcatctaaccattttggggagacccagcatggcgtat

SEQ ID NO: 374187 - DNA, 140 bp, Artificial Sequence
  Synthetic
aggccctggctgctgatatgcttgacaacatagtcatgctccacacaacagaaaaaggagggagggcctaccaacacgccctgaatgaactcccggagtcactggaaacactcatgcttggaccttttgggacagcggtg

SEQ ID NO: 374188 - DNA, 140 bp, Artificial Sequence
  Synthetic
caccgctgtcccaaaaggtccaagcatgagtgtttccagtgactccgggagttcattcagggcgtgttggtaggccctccctcctttttctgttgtgtggagcatgactatgttgtcaagcatatcagcagccagggcct

SEQ ID NO: 374189 - DNA, 140 bp, Artificial Sequence
  Synthetic
atacgccatgctgggtctccgggaaaggaatagggaaattgtcaatgggtctgatagccatagctgtggccagtggcttgctctgggtagcagaaattcagccccagtggatagcagcttcgtacttgggagtcggccat

SEQ ID NO: 374190 - DNA, 140 bp, Artificial Sequence
  Synthetic
atggccgactcccaagtacgaagctgctatccactggggctgaatttctgctacccagagcaagccactggccacagctatggctatcagacccattgacaatttccctattcctttcccggagacccagcatggcgtat

SEQ ID NO: 374191 - DNA, 140 bp, Artificial Sequence
  Synthetic
aggccctggctgctgatatgtgcttgtgagaaatccactttcacgaaactccacgcacgaaatgtactggatatctaatggtacaggtaacattgtctcttcagttaacatggtatccaggaccttttgggacagcggtg

SEQ ID NO: 374192 - DNA, 140 bp, Artificial Sequence
  Synthetic
caccgctgtcccaaaaggtcctggataccatgttaactgaagagacaatgttacctgtaccattagatatccagtacatttcgtgcgtggagtttcgtgaaagtggatttctcacaagcacatatcagcagccagggcct

SEQ ID NO: 374193 - DNA, 140 bp, Artificial Sequence
  Synthetic
aggccctggctgctgatatgaagatgtggatttaggagcaggaactcgacatgtcaatgcggaaccagaaacacccaacatggatgtcattggggaaagaataaaaaggatcaaggaggagaccttttgggacagcggtg

SEQ ID NO: 374194 - DNA, 140 bp, Artificial Sequence
  Synthetic
caccgctgtcccaaaaggtctcctccttgatcctttttattctttccccaatgacatccatgttgggtgtttctggttccgcattgacatgtcgagttcctgctcctaaatccacatcttcatatcagcagccagggcct

SEQ ID NO: 374195 - DNA, 140 bp, Artificial Sequence
  Synthetic
aggccctggctgctgatatgacacccaacatggatgtcattggggaaagaataaaaaggatcaaggaggagcataattcaacatggcactatgatgacgaaaacccctacaaaacgtggggaccttttgggacagcggtg

SEQ ID NO: 374196 - DNA, 140 bp, Artificial Sequence
  Synthetic
caccgctgtcccaaaaggtccccacgttttgtaggggttttcgtcatcatagtgccatgttgaattatgctcctccttgatcctttttattctttccccaatgacatccatgttgggtgtcatatcagcagccagggcct

SEQ ID NO: 374197 - DNA, 140 bp, Artificial Sequence
  Synthetic
atacgccatgctgggtctccagcaatgggatgttattctcaagtgaacccaacaaccctgacagcatccctagtcatgcttttagtccattatgccataataggtccaggattacaggcacgtacttgggagtcggccat

SEQ ID NO: 374198 - DNA, 140 bp, Artificial Sequence
  Synthetic
atggccgactcccaagtacgtgcctgtaatcctggacctattatggcataatggactaaaagcatgactagggatgctgtcagggttgttgggttcacttgagaataacatcccattgctggagacccagcatggcgtat

SEQ ID NO: 374199 - DNA, 140 bp, Artificial Sequence
  Synthetic
atacgccatgctgggtctccagaaaggttatggagatcacagcggagtggctctggagaaccctgggaaggaacaaaagacccaggttatgcacaagggaagagttcacaaaaaaggtcacgtacttgggagtcggccat

SEQ ID NO: 374200 - DNA, 140 bp, Artificial Sequence
  Synthetic
atggccgactcccaagtacgtgaccttttttgtgaactcttcccttgtgcataacctgggtcttttgttccttcccagggttctccagagccactccgctgtgatctccataacctttctggagacccagcatggcgtat

SEQ ID NO: 374201 - DNA, 140 bp, Artificial Sequence
  Synthetic
aggccctggctgctgatatggaacaaaagacccaggttatgcacaagggaagagttcacaaaaaaggtcagaaccaacgcagccatgggcgccgttttcacagaggagaaccaatgggacgaccttttgggacagcggtg

SEQ ID NO: 374202 - DNA, 140 bp, Artificial Sequence
  Synthetic
caccgctgtcccaaaaggtcgtcccattggttctcctctgtgaaaacggcgcccatggctgcgttggttctgaccttttttgtgaactcttcccttgtgcataacctgggtcttttgttccatatcagcagccagggcct

SEQ ID NO: 374203 - DNA, 140 bp, Artificial Sequence
  Synthetic
atacgccatgctgggtctccagaacgtgaactccacaaattgggcaagtgtggaagctgtgtttacaacatgatgggcaagagagagaagaaacttggagagtttggcaaagcaaaaggccgtacttgggagtcggccat

SEQ ID NO: 374204 - DNA, 140 bp, Artificial Sequence
  Synthetic
atggccgactcccaagtacggccttttgctttgccaaactctccaagtttcttctctctcttgcccatcatgttgtaaacacagcttccacacttgcccaatttgtggagttcacgttctggagacccagcatggcgtat

SEQ ID NO: 374205 - DNA, 140 bp, Artificial Sequence
  Synthetic
aggccctggctgctgatatgtgatgggcaagagagagaagaaacttggagagtttggcaaagcaaaaggcagtagagctatatggtacatgtggttgggagccaggtaccttgagttcgagaccttttgggacagcggtg

SEQ ID NO: 374206 - DNA, 140 bp, Artificial Sequence
  Synthetic
caccgctgtcccaaaaggtctcgaactcaaggtacctggctcccaaccacatgtaccatatagctctactgccttttgctttgccaaactctccaagtttcttctctctcttgcccatcacatatcagcagccagggcct

SEQ ID NO: 374207 - DNA, 140 bp, Artificial Sequence
  Synthetic
aggccctggctgctgatatggatggattgttgaaagaggaatgataaaaccaaaaggaaaggtcgtagatcttggttgcgggaggggaggatggtcctattacatggcgacactcaagaagaccttttgggacagcggtg

SEQ ID NO: 374208 - DNA, 140 bp, Artificial Sequence
  Synthetic
caccgctgtcccaaaaggtcttcttgagtgtcgccatgtaataggaccatcctcccctcccgcaaccaagatctacgacctttccttttggttttatcattcctctttcaacaatccatccatatcagcagccagggcct

SEQ ID NO: 374209 - DNA, 140 bp, Artificial Sequence
  Synthetic
atacgccatgctgggtctcccgtgactgaagtgaaaggatatactaaaggaggtccaggacatgaagaaccaatccccatggctacttatggctggaatttggtcaaactccattcagggcgtacttgggagtcggccat

SEQ ID NO: 374210 - DNA, 140 bp, Artificial Sequence
  Synthetic
atggccgactcccaagtacgccctgaatggagtttgaccaaattccagccataagtagccatggggattggttcttcatgtcctggacctcctttagtatatcctttcacttcagtcacgggagacccagcatggcgtat

SEQ ID NO: 374211 - DNA, 140 bp, Artificial Sequence
  Synthetic
atacgccatgctgggtctccctggatggagcctgagagaaaccgcatgcctaggcaaatcatatgcacaaatgtggcagctgatgtacttccacaggagagacctgagactagccgctaacgtacttgggagtcggccat

SEQ ID NO: 374212 - DNA, 140 bp, Artificial Sequence
  Synthetic
atggccgactcccaagtacgttagcggctagtctcaggtctctcctgtggaagtacatcagctgccacatttgtgcatatgatttgcctaggcatgcggtttctctcaggctccatccagggagacccagcatggcgtat

SEQ ID NO: 374213 - DNA, 140 bp, Artificial Sequence
  Synthetic
atacgccatgctgggtctcccattggagagtcatcctctaatccgacaatagaggaaggaagaacattgagagtcttaaagatggtggagccatggctctcttcaaaacctgagttctgccgtacttgggagtcggccat

SEQ ID NO: 374214 - DNA, 140 bp, Artificial Sequence
  Synthetic
atggccgactcccaagtacggcagaactcaggttttgaagagagccatggctccaccatctttaagactctcaatgttcttccttcctctattgtcggattagaggatgactctccaatgggagacccagcatggcgtat

SEQ ID NO: 374215 - DNA, 140 bp, Artificial Sequence
  Synthetic
aggccctggctgctgatatggagtcttaaagatggtggagccatggctctcttcaaaacctgagttctgcatcaaagtcctcaacccctacatgccgacagttatagaagagctggagaagaccttttgggacagcggtg

SEQ ID NO: 374216 - DNA, 140 bp, Artificial Sequence
  Synthetic
caccgctgtcccaaaaggtcttctccagctcttctataactgtcggcatgtaggggttgaggactttgatgcagaactcaggttttgaagagagccatggctccaccatctttaagactccatatcagcagccagggcct

SEQ ID NO: 374217 - DNA, 140 bp, Artificial Sequence
  Synthetic
atacgccatgctgggtctccatcaaagtcctcaacccctacatgccgacagttatagaagagctggagaaactgcagagaagacatggtggaagcctcgtcagatgcccgctatccaggacgtacttgggagtcggccat

SEQ ID NO: 374218 - DNA, 140 bp, Artificial Sequence
  Synthetic
atggccgactcccaagtacgtcctggatagcgggcatctgacgaggcttccaccatgtcttctctgcagtttctccagctcttctataactgtcggcatgtaggggttgaggactttgatggagacccagcatggcgtat

SEQ ID NO: 374219 - DNA, 140 bp, Artificial Sequence
  Synthetic
aggccctggctgctgatatggtttggggaaagcctacgcccaaatgtggagtctcatgtattttcacagaagagatctcagactagcgtccaatgccatatgttcagcaataccagtccagaccttttgggacagcggtg

SEQ ID NO: 374220 - DNA, 140 bp, Artificial Sequence
  Synthetic
caccgctgtcccaaaaggtctggactggtattgctgaacatatggcattggacgctagtctgagatctcttctgtgaaaatacatgagactccacatttgggcgtaggctttccccaaaccatatcagcagccagggcct

SEQ ID NO: 374221 - DNA, 140 bp, Artificial Sequence
  Synthetic
aggccctggctgctgatatgtaacgtaccaaaacaaggtggtgcgtgtgcaaagaccaacaccaagaggcacagtaatggatatcatatcgagaagagaccaaagaggtagtggacaagtgaccttttgggacagcggtg

SEQ ID NO: 374222 - DNA, 140 bp, Artificial Sequence
  Synthetic
caccgctgtcccaaaaggtcacttgtccactacctctttggtctcttctcgatatgatatccattactgtgcctcttggtgttggtctttgcacacgcaccaccttgttttggtacgttacatatcagcagccagggcct

SEQ ID NO: 374223 - DNA, 140 bp, Artificial Sequence
  Synthetic
aggccctggctgctgatatgaaccccttttgggcaacaaagagtgttcaaggagaaggtggataccagaacaccacaaccaaaacccggcacacgaatgattatgaccatgacagccaatgaccttttgggacagcggtg

SEQ ID NO: 374224 - DNA, 140 bp, Artificial Sequence
  Synthetic
caccgctgtcccaaaaggtcattggctgtcatggtcataatcattcgtgtgccgggttttggttgtggtgttctggtatccaccttctccttgaacactctttgttgcccaaaaggggttcatatcagcagccagggcct

SEQ ID NO: 374225 - DNA, 140 bp, Artificial Sequence
  Synthetic
aggccctggctgctgatatgtcacttccagagcaacctgggcccagaacatacccacagcaattcaacaggtgagaagccttataggcaatgaagagtttctggactacatgccttcaatgaccttttgggacagcggtg

SEQ ID NO: 374226 - DNA, 140 bp, Artificial Sequence
  Synthetic
caccgctgtcccaaaaggtcattgaaggcatgtagtccagaaactcttcattgcctataaggcttctcacctgttgaattgctgtgggtatgttctgggcccaggttgctctggaagtgacatatcagcagccagggcct

SEQ ID NO: 374227 - DNA, 140 bp, Artificial Sequence
  Synthetic
atacgccatgctgggtctccgtgagaagccttataggcaatgaagagtttctggactacatgccttcaatgaagagattcaggaaggaggaggagtcggagggagccatttggtaaacgtcgtacttgggagtcggccat

SEQ ID NO: 374228 - DNA, 140 bp, Artificial Sequence
  Synthetic
atggccgactcccaagtacgacgtttaccaaatggctccctccgactcctcctccttcctgaatctcttcattgaaggcatgtagtccagaaactcttcattgcctataaggcttctcacggagacccagcatggcgtat

SEQ ID NO: 374229 - DNA, 140 bp, Artificial Sequence
  Synthetic
atacgccatgctgggtctccatgctgctgcccacagtcctgacgttccatttgaccacccgagggggagagcctcacatgatagttagcaaacaggaaagaggaaagtcacttttgttcacgtacttgggagtcggccat

SEQ ID NO: 374230 - DNA, 140 bp, Artificial Sequence
  Synthetic
atggccgactcccaagtacgtgaacaaaagtgactttcctctttcctgtttgctaactatcatgtgaggctctccccctcgggtggtcaaatggaacgtcaggactgtgggcagcagcatggagacccagcatggcgtat

SEQ ID NO: 374231 - DNA, 140 bp, Artificial Sequence
  Synthetic
aggccctggctgctgatatggcctcacatgatagttagcaaacaggaaagaggaaagtcacttttgttcaagacctctgcaggtgtcaacatgtgcacccttattgcaatggacctgggagaccttttgggacagcggtg

SEQ ID NO: 374232 - DNA, 140 bp, Artificial Sequence
  Synthetic
caccgctgtcccaaaaggtctcccaggtccattgcaataagggtgcacatgttgacacctgcagaggtcttgaacaaaagtgactttcctctttcctgtttgctaactatcatgtgaggccatatcagcagccagggcct

SEQ ID NO: 374233 - DNA, 140 bp, Artificial Sequence
  Synthetic
atacgccatgctgggtctccgagttatgtgatgacacgatgacctacaaatgtccccggatcactgagacggaaccagatgacgttgactgttggtgcaatgccacggagacgtgggtgacgtacttgggagtcggccat

SEQ ID NO: 374234 - DNA, 140 bp, Artificial Sequence
  Synthetic
atggccgactcccaagtacgtcacccacgtctccgtggcattgcaccaacagtcaacgtcatctggttccgtctcagtgatccggggacatttgtaggtcatcgtgtcatcacataactcggagacccagcatggcgtat

SEQ ID NO: 374235 - DNA, 140 bp, Artificial Sequence
  Synthetic
aggccctggctgctgatatgggaaccagatgacgttgactgttggtgcaatgccacggagacgtgggtgacctatggaacatgttctcaaactggtgaacaccgacgagacaaacgttccgaccttttgggacagcggtg

SEQ ID NO: 374236 - DNA, 140 bp, Artificial Sequence
  Synthetic
caccgctgtcccaaaaggtcggaacgtttgtctcgtcggtgttcaccagtttgagaacatgttccataggtcacccacgtctccgtggcattgcaccaacagtcaacgtcatctggttcccatatcagcagccagggcct

SEQ ID NO: 374237 - DNA, 140 bp, Artificial Sequence
  Synthetic
atacgccatgctgggtctccgttgcactggcaccacacgtagggcttggtctagaaacaagaaccgaaacgtggatgtcctctgaaggcgcttggagacaaatacaaaaagtggagacatcgtacttgggagtcggccat

SEQ ID NO: 374238 - DNA, 140 bp, Artificial Sequence
  Synthetic
atggccgactcccaagtacgatgtctccactttttgtatttgtctccaagcgccttcagaggacatccacgtttcggttcttgtttctagaccaagccctacgtgtggtgccagtgcaacggagacccagcatggcgtat

SEQ ID NO: 374239 - DNA, 140 bp, Artificial Sequence
  Synthetic
aggccctggctgctgatatggtggatgtcctctgaaggcgcttggagacaaatacaaaaagtggagacatgggctctgagacacccaggatttacggtgatagccctttttctagcacatgaccttttgggacagcggtg

SEQ ID NO: 374240 - DNA, 140 bp, Artificial Sequence
  Synthetic
caccgctgtcccaaaaggtcatgtgctagaaaaagggctatcaccgtaaatcctgggtgtctcagagcccatgtctccactttttgtatttgtctccaagcgccttcagaggacatccaccatatcagcagccagggcct

SEQ ID NO: 374241 - DNA, 140 bp, Artificial Sequence
  Synthetic
atacgccatgctgggtctccgccatagggacatccatcacccagaaaggaattattttcattttgctgatgctggtgactccatccatggccatgcggtgcgtgggaataggaaacagagcgtacttgggagtcggccat

SEQ ID NO: 374242 - DNA, 140 bp, Artificial Sequence
  Synthetic
atggccgactcccaagtacgctctgtttcctattcccacgcaccgcatggccatggatggagtcaccagcatcagcaaaatgaaaataattcctttctgggtgatggatgtccctatggcggagacccagcatggcgtat

SEQ ID NO: 374243 - DNA, 140 bp, Artificial Sequence
  Synthetic
aggccctggctgctgatatggctggtgactccatccatggccatgcggtgcgtgggaataggaaacagagacttcgtggaaggactgtcaggagctacgtgggtggatgtagttctggaagaccttttgggacagcggtg

SEQ ID NO: 374244 - DNA, 140 bp, Artificial Sequence
  Synthetic
caccgctgtcccaaaaggtcttccagaactacatccacccacgtagctcctgacagtccttccacgaagtctctgtttcctattcccacgcaccgcatggccatggatggagtcaccagccatatcagcagccagggcct

SEQ ID NO: 374245 - DNA, 140 bp, Artificial Sequence
  Synthetic
atacgccatgctgggtctcccatggaagttgcgtcactaccatggcaaaagacaaaccaacactggacattgaactcctgaagacggaggtcacaaaccctgccgtcctgcgcaaactgtcgtacttgggagtcggccat

SEQ ID NO: 374246 - DNA, 140 bp, Artificial Sequence
  Synthetic
atggccgactcccaagtacgacagtttgcgcaggacggcagggtttgtgacctccgtcttcaggagttcaatgtccagtgttggtttgtcttttgccatggtagtgacgcaacttccatgggagacccagcatggcgtat

SEQ ID NO: 374247 - DNA, 140 bp, Artificial Sequence
  Synthetic
aggccctggctgctgatatggagatgattgcgtggtgaagcccatagatgagaggtttagcacctccctcctcttcttgaatgacatgggaaaggtgaggaaagacatcccgcaatgggagaccttttgggacagcggtg

SEQ ID NO: 374248 - DNA, 140 bp, Artificial Sequence
  Synthetic
caccgctgtcccaaaaggtctcccattgcgggatgtctttcctcacctttcccatgtcattcaagaagaggagggaggtgctaaacctctcatctatgggcttcaccacgcaatcatctccatatcagcagccagggcct

SEQ ID NO: 374249 - DNA, 140 bp, Artificial Sequence
  Synthetic
atacgccatgctgggtctcccaaggagaagccacgctggtggaagaacaagacacgaactttgtgtgtcgacgaacattcgttgacagaggctggggcaatggttgtggactattcggaacgtacttgggagtcggccat

SEQ ID NO: 374250 - DNA, 140 bp, Artificial Sequence
  Synthetic
atggccgactcccaagtacgttccgaatagtccacaaccattgccccagcctctgtcaacgaatgttcgtcgacacacaaagttcgtgtcttgttcttccaccagcgtggcttctccttgggagacccagcatggcgtat

SEQ ID NO: 374251 - DNA, 140 bp, Artificial Sequence
  Synthetic
aggccctggctgctgatatgacgaacattcgttgacagaggctggggcaatggttgtggactattcggaaagggtagcttaataacgtgtgctaagtttaagtgtgtgacaaaattggaagaccttttgggacagcggtg

SEQ ID NO: 374252 - DNA, 140 bp, Artificial Sequence
  Synthetic
caccgctgtcccaaaaggtcttccaattttgtcacacacttaaacttagcacacgttattaagctaccctttccgaatagtccacaaccattgccccagcctctgtcaacgaatgttcgtcatatcagcagccagggcct

SEQ ID NO: 374253 - DNA, 140 bp, Artificial Sequence
  Synthetic
aggccctggctgctgatatgagaaaccaggatgaactgataggaagagccagaatctcgcagggggctggatggagcttgagagaaacagcctgtctgggcaaagcttatgcccagatgtgaccttttgggacagcggtg

SEQ ID NO: 374254 - DNA, 140 bp, Artificial Sequence
  Synthetic
caccgctgtcccaaaaggtcacatctgggcataagctttgcccagacaggctgtttctctcaagctccatccagccccctgcgagattctggctcttcctatcagttcatcctggtttctcatatcagcagccagggcct

SEQ ID NO: 374255 - DNA, 140 bp, Artificial Sequence
  Synthetic
atacgccatgctgggtctccggaaagatagtccaatatgaaaacttaaaatattctgtgatcgttactgtccacactggagaccagcaccaagttggaaatgagaccacagaacatggaacgtacttgggagtcggccat

SEQ ID NO: 374256 - DNA, 140 bp, Artificial Sequence
  Synthetic
atggccgactcccaagtacgttccatgttctgtggtctcatttccaacttggtgctggtctccagtgtggacagtaacgatcacagaatattttaagttttcatattggactatctttccggagacccagcatggcgtat

SEQ ID NO: 374257 - DNA, 140 bp, Artificial Sequence
  Synthetic
aggccctggctgctgatatgccacactggagaccagcaccaagttggaaatgagaccacagaacatggaacaattgcaaccataacaccccaagctcccacgtcggaaatacaactgacagaccttttgggacagcggtg

SEQ ID NO: 374258 - DNA, 140 bp, Artificial Sequence
  Synthetic
caccgctgtcccaaaaggtctgtcagttgtatttccgacgtgggagcttggggtgttatggttgcaattgttccatgttctgtggtctcatttccaacttggtgctggtctccagtgtggcatatcagcagccagggcct

SEQ ID NO: 374259 - DNA, 140 bp, Artificial Sequence
  Synthetic
atacgccatgctgggtctccgactacggagctctaacactggattgttcacctagaacagggctagactttaatgagatggtgttgctgacaatgaaagaaaaatcatggctcgtccacacgtacttgggagtcggccat

SEQ ID NO: 374260 - DNA, 140 bp, Artificial Sequence
  Synthetic
atggccgactcccaagtacgtgtggacgagccatgatttttctttcattgtcagcaacaccatctcattaaagtctagccctgttctaggtgaacaatccagtgttagagctccgtagtcggagacccagcatggcgtat

SEQ ID NO: 374261 - DNA, 140 bp, Artificial Sequence
  Synthetic
atacgccatgctgggtctccaacaatggtttctagacttaccactgccttggaccacaggggcctcaacgtcccaagagacttggaacagacaagacttgctggtcacgtttaagacagccgtacttgggagtcggccat

SEQ ID NO: 374262 - DNA, 140 bp, Artificial Sequence
  Synthetic
atggccgactcccaagtacggctgtcttaaacgtgaccagcaagtcttgtctgttccaagtctcttgggacgttgaggcccctgtggtccaaggcagtggtaagtctagaaaccattgttggagacccagcatggcgtat

SEQ ID NO: 374263 - DNA, 140 bp, Artificial Sequence
  Synthetic
aggccctggctgctgatatgacattcacacggccataacccaggtcaggaatctgatcggaaaagaggaatacgtggattacatgccagccatgaaaagatacagcgctcctttcgagaggaccttttgggacagcggtg

SEQ ID NO: 374264 - DNA, 140 bp, Artificial Sequence
  Synthetic
caccgctgtcccaaaaggtcctctcgaaaggagcgctgtatcttttcatggctggcatgtaatccacgtattcctcttttccgatcagattcctgacctgggttatggccgtgtgaatgtcatatcagcagccagggcct

SEQ ID NO: 374265 - DNA, 140 bp, Artificial Sequence
  Synthetic
aggccctggctgctgatatgacaatttttgcaggccacctgaaatgcagattaaaaatggacaaactaactctaaaaggaatatcatatgtaatgtgcacaggctcattcaagttagagagaccttttgggacagcggtg

SEQ ID NO: 374266 - DNA, 140 bp, Artificial Sequence
  Synthetic
caccgctgtcccaaaaggtctctctaacttgaatgagcctgtgcacattacatatgatattccttttagagttagtttgtccatttttaatctgcatttcaggtggcctgcaaaaattgtcatatcagcagccagggcct

SEQ ID NO: 374267 - DNA, 140 bp, Artificial Sequence
  Synthetic
atacgccatgctgggtctccaggaagtggctgagacccagcatggaactgttctagtacaggtcaaatacgaaggaacagatgcaccatgcaagatccccttctcgtcccaagatgagaacgtacttgggagtcggccat

SEQ ID NO: 374268 - DNA, 140 bp, Artificial Sequence
  Synthetic
atggccgactcccaagtacgttctcatcttgggacgagaaggggatcttgcatggtgcatctgttccttcgtatttgacctgtactagaacagttccatgctgggtctcagccacttcctggagacccagcatggcgtat

SEQ ID NO: 374269 - DNA, 140 bp, Artificial Sequence
  Synthetic
aggccctggctgctgatatggaaggaacagatgcaccatgcaagatccccttctcgtcccaagatgagaagggagtaacccagaatgggagattggtaacagccaaccccatagtcactggaccttttgggacagcggtg

SEQ ID NO: 374270 - DNA, 140 bp, Artificial Sequence
  Synthetic
caccgctgtcccaaaaggtccagtgactatggggttggctgttaccaatctcccattctgggttactcccttctcatcttgggacgagaaggggatcttgcatggtgcatctgttccttccatatcagcagccagggcct

SEQ ID NO: 374271 - DNA, 140 bp, Artificial Sequence
  Synthetic
atacgccatgctgggtctccacaaagaaagaccagtcaacattgaagcggagccaccctttggtgagagctacatcgtggtaggagcaggtgaaaaagctttgaaactaagttggttcaacgtacttgggagtcggccat

SEQ ID NO: 374272 - DNA, 140 bp, Artificial Sequence
  Synthetic
atggccgactcccaagtacgttgaaccaacttagtttcaaagctttttcacctgctcctaccacgatgtagctctcaccaaagggtggctccgcttcaatgttgactggtctttctttgtggagacccagcatggcgtat

SEQ ID NO: 374273 - DNA, 140 bp, Artificial Sequence
  Synthetic
aggccctggctgctgatatgtacatcgtggtaggagcaggtgaaaaagctttgaaactaagttggttcaagaagggaagcagtatagggaaaatgtttgaagcaactgcccgtggagcacgaccttttgggacagcggtg

SEQ ID NO: 374274 - DNA, 140 bp, Artificial Sequence
  Synthetic
caccgctgtcccaaaaggtcgtgctccacgggcagttgcttcaaacattttccctatactgcttcccttcttgaaccaacttagtttcaaagctttttcacctgctcctaccacgatgtacatatcagcagccagggcct

SEQ ID NO: 374275 - DNA, 140 bp, Artificial Sequence
  Synthetic
atacgccatgctgggtctccccctagccaaagccattttcaaactaacctatcaaaacaaagtggtgaaagtcctcagacccacaccgaaaggagcggtaatggacatcatatccaggaacgtacttgggagtcggccat

SEQ ID NO: 374276 - DNA, 140 bp, Artificial Sequence
  Synthetic
atggccgactcccaagtacgttcctggatatgatgtccattaccgctcctttcggtgtgggtctgaggactttcaccactttgttttgataggttagtttgaaaatggctttggctagggggagacccagcatggcgtat

SEQ ID NO: 374277 - DNA, 140 bp, Artificial Sequence
  Synthetic
aggccctggctgctgatatgggagtgttcacgtctgtgggaaaactggtacaccagatctttggaactgcgtatggagttttgttcagcggtgtttcttggaccatgaaaataggaataggaccttttgggacagcggtg

SEQ ID NO: 374278 - DNA, 140 bp, Artificial Sequence
  Synthetic
caccgctgtcccaaaaggtcctattcctattttcatggtccaagaaacaccgctgaacaaaactccatacgcagttccaaagatctggtgtaccagttttcccacagacgtgaacactcccatatcagcagccagggcct

SEQ ID NO: 374279 - DNA, 140 bp, Artificial Sequence
  Synthetic
atacgccatgctgggtctccggattctgctgacatggctgggattaaactcaaggagtacgtctctttcaatgacgtgtatcgcagttggcatggtcacactgtacctaggagtcatggtcgtacttgggagtcggccat

SEQ ID NO: 374280 - DNA, 140 bp, Artificial Sequence
  Synthetic
atggccgactcccaagtacgaccatgactcctaggtacagtgtgaccatgccaactgcgatacacgtcattgaaagagacgtactccttgagtttaatcccagccatgtcagcagaatccggagacccagcatggcgtat

SEQ ID NO: 374281 - DNA, 140 bp, Artificial Sequence
  Synthetic
atacgccatgctgggtctccccaggcggactcgggatgtgtaatcaactggaaaggcagagaactcaaatgtggaagtggcatttttgtcactaatgaagttcacacctggacagagcaacgtacttgggagtcggccat

SEQ ID NO: 374282 - DNA, 140 bp, Artificial Sequence
  Synthetic
atggccgactcccaagtacgttgctctgtccaggtgtgaacttcattagtgacaaaaatgccacttccacatttgagttctctgcctttccagttgattacacatcccgagtccgcctggggagacccagcatggcgtat

SEQ ID NO: 374283 - DNA, 140 bp, Artificial Sequence
  Synthetic
aggccctggctgctgatatgacatcatgtggaagcaaatatcaaatgaattaaaccacatcttacttgaaaatgacatgaaatttacagtggtagtaggagacgttagtggaatcttggcgaccttttgggacagcggtg

SEQ ID NO: 374284 - DNA, 140 bp, Artificial Sequence
  Synthetic
caccgctgtcccaaaaggtcgccaagattccactaacgtctcctactaccactgtaaatttcatgtcattttcaagtaagatgtggtttaattcatttgatatttgcttccacatgatgtcatatcagcagccagggcct

SEQ ID NO: 374285 - DNA, 140 bp, Artificial Sequence
  Synthetic
atacgccatgctgggtctcccccaccgtaatggcgtttcacctgtcaacaagagatggcgaacccctcatgatagtggcaaaacacgaaagggggagacctctcttgtttaagacaacagcgtacttgggagtcggccat

SEQ ID NO: 374286 - DNA, 140 bp, Artificial Sequence
  Synthetic
atggccgactcccaagtacgctgttgtcttaaacaagagaggtctccccctttcgtgttttgccactatcatgaggggttcgccatctcttgttgacaggtgaaacgccattacggtgggggagacccagcatggcgtat

SEQ ID NO: 374287 - DNA, 140 bp, Artificial Sequence
  Synthetic
atacgccatgctgggtctccccaaggaaagaaaacgattaggccacaacccatggaacacaaatactcgtggaaaagttggggaaaagccaaaatcattggagcagatgttcagaacactcgtacttgggagtcggccat

SEQ ID NO: 374288 - DNA, 140 bp, Artificial Sequence
  Synthetic
atggccgactcccaagtacgagtgttctgaacatctgctccaatgattttggcttttccccaacttttccacgagtatttgtgttccatgggttgtggcctaatcgttttctttccttggggagacccagcatggcgtat

SEQ ID NO: 374289 - DNA, 140 bp, Artificial Sequence
  Synthetic
atacgccatgctgggtctccaagggatcaacaaatgtacccttattgctatggacctgggtgaaatgtgcgaagacactgtcacgtataagtgtcctctactggttaacaccgaacctgacgtacttgggagtcggccat

SEQ ID NO: 374290 - DNA, 140 bp, Artificial Sequence
  Synthetic
atggccgactcccaagtacgtcaggttcggtgttaaccagtagaggacacttatacgtgacagtgtcttcgcacatttcacccaggtccatagcaataagggtacatttgttgatcccttggagacccagcatggcgtat

SEQ ID NO: 374291 - DNA, 140 bp, Artificial Sequence
  Synthetic
atacgccatgctgggtctccagcgtggaacatctgggaagttgaagactatggatttggaattttcacgacaaacatatggttgaaattgcgcgattcctacacccaagtgtgtgaccatcgtacttgggagtcggccat

SEQ ID NO: 374292 - DNA, 140 bp, Artificial Sequence
  Synthetic
atggccgactcccaagtacgatggtcacacacttgggtgtaggaatcgcgcaatttcaaccatatgtttgtcgtgaaaattccaaatccatagtcttcaacttcccagatgttccacgctggagacccagcatggcgtat

SEQ ID NO: 374293 - DNA, 140 bp, Artificial Sequence
  Synthetic
aggccctggctgctgatatgcaaacatatggttgaaattgcgcgattcctacacccaagtgtgtgaccatcgactaatgtcggctgccatcaaggatagcaaagcagttcatgctgacatgaccttttgggacagcggtg

SEQ ID NO: 374294 - DNA, 140 bp, Artificial Sequence
  Synthetic
caccgctgtcccaaaaggtcatgtcagcatgaactgctttgctatccttgatggcagccgacattagtcgatggtcacacacttgggtgtaggaatcgcgcaatttcaaccatatgtttgcatatcagcagccagggcct

SEQ ID NO: 374295 - DNA, 140 bp, Artificial Sequence
  Synthetic
aggccctggctgctgatatgacaccacattcaggaatgggattggaaacaagagctgagacatggatgtcatcggaaggggcttggaaacatgctcagagagtagaaagctggatactcagaccttttgggacagcggtg

SEQ ID NO: 374296 - DNA, 140 bp, Artificial Sequence
  Synthetic
caccgctgtcccaaaaggtctgagtatccagctttctactctctgagcatgtttccaagccccttccgatgacatccatgtctcagctcttgtttccaatcccattcctgaatgtggtgtcatatcagcagccagggcct

SEQ ID NO: 374297 - DNA, 140 bp, Artificial Sequence
  Synthetic
atacgccatgctgggtctccggggtactggatagaaagtgaaaagaacgagacttggaagttggcaagagcctccttcatagaagtcaagacatgcgtctggccaaaatctcacactctacgtacttgggagtcggccat

SEQ ID NO: 374298 - DNA, 140 bp, Artificial Sequence
  Synthetic
atggccgactcccaagtacgtagagtgtgagattttggccagacgcatgtcttgacttctatgaaggaggctcttgccaacttccaagtctcgttcttttcactttctatccagtaccccggagacccagcatggcgtat

SEQ ID NO: 374299 - DNA, 140 bp, Artificial Sequence
  Synthetic
aggccctggctgctgatatgcctccttcatagaagtcaagacatgcgtctggccaaaatctcacactctatggagcaatggagtcctggaaagtgagatggtaatcccaaagatatatgggaccttttgggacagcggtg

SEQ ID NO: 374300 - DNA, 140 bp, Artificial Sequence
  Synthetic
caccgctgtcccaaaaggtcccatatatctttgggattaccatctcactttccaggactccattgctccatagagtgtgagattttggccagacgcatgtcttgacttctatgaaggaggcatatcagcagccagggcct

SEQ ID NO: 374301 - DNA, 140 bp, Artificial Sequence
  Synthetic
atacgccatgctgggtctccaggaccaatatctcagcacaattacagaccaggatatttcacacaaacagcagggccgtggcacttaggcaagttggaactagattttgatttgtgtgaacgtacttgggagtcggccat

SEQ ID NO: 374302 - DNA, 140 bp, Artificial Sequence
  Synthetic
atggccgactcccaagtacgttcacacaaatcaaaatctagttccaacttgcctaagtgccacggccctgctgtttgtgtgaaatatcctggtctgtaattgtgctgagatattggtcctggagacccagcatggcgtat

SEQ ID NO: 374303 - DNA, 140 bp, Artificial Sequence
  Synthetic
aggccctggctgctgatatgaaggagtctcgggtggagcatgggtcgacttggtgctagaacatggaggatgcgtcacaaccatggcccagggaaagccaaccttggattttgaattgacgaccttttgggacagcggtg

SEQ ID NO: 374304 - DNA, 140 bp, Artificial Sequence
  Synthetic
caccgctgtcccaaaaggtcgtcaattcaaaatccaaggttggctttccctgggccatggttgtgacgcatcctccatgttctagcaccaagtcgacccatgctccacccgagactccttcatatcagcagccagggcct

SEQ ID NO: 374305 - DNA, 140 bp, Artificial Sequence
  Synthetic
atacgccatgctgggtctcctagaaccacaacagtcacaggaaagataatccatgaatggtgctgcagatcttgcacgttaccccctctacgtttcaaaggagaagacgggtgctggtaccgtacttgggagtcggccat

SEQ ID NO: 374306 - DNA, 140 bp, Artificial Sequence
  Synthetic
atggccgactcccaagtacggtaccagcacccgtcttctcctttgaaacgtagagggggtaacgtgcaagatctgcagcaccattcatggattatctttcctgtgactgttgtggttctaggagacccagcatggcgtat

SEQ ID NO: 374307 - DNA, 140 bp, Artificial Sequence
  Synthetic
atacgccatgctgggtctcccctcgatatcaaacataaccacggcaacaagatgtccaacgcaaggagagccttatctcaaagaggagcaagaccaacagtacatttgccggagagacgtcgtacttgggagtcggccat

SEQ ID NO: 374308 - DNA, 140 bp, Artificial Sequence
  Synthetic
atggccgactcccaagtacgacgtctctccggcaaatgtactgttggtcttgctcctctttgagataaggctctccttgcgttggacatcttgttgccgtggttatgtttgatatcgaggggagacccagcatggcgtat

SEQ ID NO: 374309 - DNA, 140 bp, Artificial Sequence
  Synthetic
atacgccatgctgggtctccaatggtctctgcagggtcaggagaagtggacagtttttcactaggactgttatgcatatcaataatgatcgaagaggtaatgagatccagatggagcaggcgtacttgggagtcggccat

SEQ ID NO: 374310 - DNA, 140 bp, Artificial Sequence
  Synthetic
atggccgactcccaagtacgcctgctccatctggatctcattacctcttcgatcattattgatatgcataacagtcctagtgaaaaactgtccacttctcctgaccctgcagagaccattggagacccagcatggcgtat

SEQ ID NO: 374311 - DNA, 140 bp, Artificial Sequence
  Synthetic
aggccctggctgctgatatgtatgcatatcaataatgatcgaagaggtaatgagatccagatggagcaggaaaatgctgatgactggaacattggttgtgttcctccttctcacattggggaccttttgggacagcggtg

SEQ ID NO: 374312 - DNA, 140 bp, Artificial Sequence
  Synthetic
caccgctgtcccaaaaggtccccaatgtgagaaggaggaacacaaccaatgttccagtcatcagcattttcctgctccatctggatctcattacctcttcgatcattattgatatgcatacatatcagcagccagggcct

SEQ ID NO: 374313 - DNA, 140 bp, Artificial Sequence
  Synthetic
aggccctggctgctgatatggtccaaattgaaaaccttgaatacacagtagtagtaacagtccacaatggagacacccatgcagtaggaaatgacacatccaaccatggagtgacagccagaccttttgggacagcggtg

SEQ ID NO: 374314 - DNA, 140 bp, Artificial Sequence
  Synthetic
caccgctgtcccaaaaggtctggctgtcactccatggttggatgtgtcatttcctactgcatgggtgtctccattgtggactgttactactactgtgtattcaaggttttcaatttggaccatatcagcagccagggcct

SEQ ID NO: 374315 - DNA, 140 bp, Artificial Sequence
  Synthetic
atacgccatgctgggtctccacaattgacatggaacgatctgatcaggctatgcatcatggttggagccaatgcttcagacaatatggggatgggaacaacgtacttagctttgatggcccgtacttgggagtcggccat

SEQ ID NO: 374316 - DNA, 140 bp, Artificial Sequence
  Synthetic
atggccgactcccaagtacgggccatcaaagctaagtacgttgttcccatccccatattgtctgaagcattggctccaaccatgatgcatagcctgatcagatcgttccatgtcaattgtggagacccagcatggcgtat

SEQ ID NO: 374317 - DNA, 140 bp, Artificial Sequence
  Synthetic
atacgccatgctgggtctcccaataactcctaggtcaccatcggttgaagttaaattgccggactatggagaactaacactcgattgcgagcccaggtccggaattgattttaatgagatcgtacttgggagtcggccat

SEQ ID NO: 374318 - DNA, 140 bp, Artificial Sequence
  Synthetic
atggccgactcccaagtacgatctcattaaaatcaattccggacctgggctcgcaatcgagtgttagttctccatagtccggcaatttaacttcaaccgatggtgacctaggagttattgggagacccagcatggcgtat

SEQ ID NO: 374319 - DNA, 140 bp, Artificial Sequence
  Synthetic
atacgccatgctgggtctccaacatctagagaagttctccttctcacggttggattgagtctggtggcatctgtagaactaccaaattccttagacgagctaggggatggacttgcaatgcgtacttgggagtcggccat

SEQ ID NO: 374320 - DNA, 140 bp, Artificial Sequence
  Synthetic
atggccgactcccaagtacgcattgcaagtccatcccctagctcgtctaaggaatttggtagttctacagatgccaccagactcaatccaaccgtgagaaggagaacttctctagatgttggagacccagcatggcgtat

SEQ ID NO: 374321 - DNA, 140 bp, Artificial Sequence
  Synthetic
aggccctggctgctgatatgctgtagaactaccaaattccttagacgagctaggggatggacttgcaatgggcatcatgatattgaaattactgactgattttcaatcacatcagctatggaccttttgggacagcggtg

SEQ ID NO: 374322 - DNA, 140 bp, Artificial Sequence
  Synthetic
caccgctgtcccaaaaggtccatagctgatgtgattgaaaatcagtcagtaatttcaatatcatgatgcccattgcaagtccatcccctagctcgtctaaggaatttggtagttctacagcatatcagcagccagggcct

SEQ ID NO: 374323 - DNA, 140 bp, Artificial Sequence
  Synthetic
atacgccatgctgggtctccagaggtatagggaggatgcccttaggaatgtgctgcataatcacggccagtattcttctatggtacgcacaaatacagccacactggatagcagcttcaacgtacttgggagtcggccat

SEQ ID NO: 374324 - DNA, 140 bp, Artificial Sequence
  Synthetic
atggccgactcccaagtacgttgaagctgctatccagtgtggctgtatttgtgcgtaccatagaagaatactggccgtgattatgcagcacattcctaagggcatcctccctatacctctggagacccagcatggcgtat

SEQ ID NO: 374325 - DNA, 140 bp, Artificial Sequence
  Synthetic
atacgccatgctgggtctccggctactttgctgtctttaacatttgtcaaaacaactctttcactgcactatgcatggaagacaatggccatgatactgtcaattgtatccctcctccctcgtacttgggagtcggccat

SEQ ID NO: 374326 - DNA, 140 bp, Artificial Sequence
  Synthetic
atggccgactcccaagtacgagggaggagggatacaattgacagtatcatggccattgtcttccatgcatagtgcagtgaaagagttgttttgacaaatgttaaagacagcaaagtagccggagacccagcatggcgtat

SEQ ID NO: 374327 - DNA, 140 bp, Artificial Sequence
  Synthetic
aggccctggctgctgatatgatgcatggaagacaatggccatgatactgtcaattgtatccctcctccctttatgcctgtccacgacttctcaaaaaacgacatggcttccagtgcttctgaccttttgggacagcggtg

SEQ ID NO: 374328 - DNA, 140 bp, Artificial Sequence
  Synthetic
caccgctgtcccaaaaggtcagaagcactggaagccatgtcgttttttgagaagtcgtggacaggcataaagggaggagggatacaattgacagtatcatggccattgtcttccatgcatcatatcagcagccagggcct

SEQ ID NO: 374329 - DNA, 140 bp, Artificial Sequence
  Synthetic
atacgccatgctgggtctccgggatctcttggatgcaaaccactaaccatgtttctcataacagaaaacaaaatttggggaaggaaaagttggcctctcaatgaaggaatcatggctgttcgtacttgggagtcggccat

SEQ ID NO: 374330 - DNA, 140 bp, Artificial Sequence
  Synthetic
atggccgactcccaagtacgaacagccatgattccttcattgagaggccaacttttccttccccaaattttgttttctgttatgagaaacatggttagtggtttgcatccaagagatcccggagacccagcatggcgtat

SEQ ID NO: 374331 - DNA, 140 bp, Artificial Sequence
  Synthetic
atacgccatgctgggtctcccagaaacacagcatggaaccacagtggtgaaagtcaagtatgaaggcgctggagctccgtgtaaagttcccatagagataagagatgtgaacaaggaaaacgtacttgggagtcggccat

SEQ ID NO: 374332 - DNA, 140 bp, Artificial Sequence
  Synthetic
atggccgactcccaagtacgttttccttgttcacatctcttatctctatgggaactttacacggagctccagcgccttcatacttgactttcaccactgtggttccatgctgtgtttctgggagacccagcatggcgtat

SEQ ID NO: 374333 - DNA, 140 bp, Artificial Sequence
  Synthetic
atacgccatgctgggtctccagctggcccattaatagctggaggcatgctaatagcatgttatgtcatatccggaagctcggccgatttatcactggagaaagcagctaaggtctcctggcgtacttgggagtcggccat

SEQ ID NO: 374334 - DNA, 140 bp, Artificial Sequence
  Synthetic
atggccgactcccaagtacgccaggagaccttagctgctttctccagtgataaatcggccgagcttccggatatgacataacatgctattagcatgcctccagctattaatgggccagctggagacccagcatggcgtat

SEQ ID NO: 374335 - DNA, 140 bp, Artificial Sequence
  Synthetic
aggccctggctgctgatatgccggaagctcggccgatttatcactggagaaagcagctaaggtctcctgggaagaagaagcagaacactctggcgcctcacacaatatactagtcgagatgaccttttgggacagcggtg

SEQ ID NO: 374336 - DNA, 140 bp, Artificial Sequence
  Synthetic
caccgctgtcccaaaaggtcatctcgactagtatattgtgtgaggcgccagagtgttctgcttcttcttcccaggagaccttagctgctttctccagtgataaatcggccgagcttccggcatatcagcagccagggcct

SEQ ID NO: 374337 - DNA, 140 bp, Artificial Sequence
  Synthetic
atacgccatgctgggtctccccaagatgatggaaccatgaagataaaggatgaagagagagatgacacgatcaccattctcctcaaagcaaccctgctggcaatttcaggggtgtatccacgtacttgggagtcggccat

SEQ ID NO: 374338 - DNA, 140 bp, Artificial Sequence
  Synthetic
atggccgactcccaagtacgtggatacacccctgaaattgccagcagggttgctttgaggagaatggtgatcgtgtcatctctctcttcatcctttatcttcatggttccatcatcttggggagacccagcatggcgtat

SEQ ID NO: 374339 - DNA, 140 bp, Artificial Sequence
  Synthetic
aggccctggctgctgatatgccattctaggtgaaacagcttgggattttggctctgttggtggactgttcacatcattgggaaaggccgtacaccaggtttttggaagtgtgtatacaacgaccttttgggacagcggtg

SEQ ID NO: 374340 - DNA, 140 bp, Artificial Sequence
  Synthetic
caccgctgtcccaaaaggtcgttgtatacacacttccaaaaacctggtgtacggcctttcccaatgatgtgaacagtccaccaacagagccaaaatcccaagctgtttcacctagaatggcatatcagcagccagggcct

SEQ ID NO: 374341 - DNA, 140 bp, Artificial Sequence
  Synthetic
aggccctggctgctgatatggtcacctatctagctttaattgcaacatttaaaatccagccattcctggctttgggatttttcctaagaaaactgacatctagagaaaatttactgttaggaccttttgggacagcggtg

SEQ ID NO: 374342 - DNA, 140 bp, Artificial Sequence
  Synthetic
caccgctgtcccaaaaggtcctaacagtaaattttctctagatgtcagttttcttaggaaaaatcccaaagccaggaatggctggattttaaatgttgcaattaaagctagataggtgaccatatcagcagccagggcct

SEQ ID NO: 374343 - DNA, 140 bp, Artificial Sequence
  Synthetic
aggccctggctgctgatatgaagcagtccttgatgatggcatttatagaattctccaaagaggattgttgggcaggtctcaggtaggagtaggagttttccaagaaggcgtattccacacgaccttttgggacagcggtg

SEQ ID NO: 374344 - DNA, 140 bp, Artificial Sequence
  Synthetic
caccgctgtcccaaaaggtcgtgtggaatacgccttcttggaaaactcctactcctacctgagacctgcccaacaatcctctttggagaattctataaatgccatcatcaaggactgcttcatatcagcagccagggcct

SEQ ID NO: 374345 - DNA, 140 bp, Artificial Sequence
  Synthetic
atacgccatgctgggtctccaatgtggcacgtcaccaggggagctgttctcatgtaccaagggaagagattggaaccaagttgggccagtgtcaaaaaagacttgatctcatatggaggacgtacttgggagtcggccat

SEQ ID NO: 374346 - DNA, 140 bp, Artificial Sequence
  Synthetic
atggccgactcccaagtacgtcctccatatgagatcaagtcttttttgacactggcccaacttggttccaatctcttcccttggtacatgagaacagctcccctggtgacgtgccacattggagacccagcatggcgtat

SEQ ID NO: 374347 - DNA, 140 bp, Artificial Sequence
  Synthetic
aggccctggctgctgatatgtggaaccaagttgggccagtgtcaaaaaagacttgatctcatatggaggaggttggaggttccaaggatcctggaacatgggagaagaagtgcaggtgatgaccttttgggacagcggtg

SEQ ID NO: 374348 - DNA, 140 bp, Artificial Sequence
  Synthetic
caccgctgtcccaaaaggtcatcacctgcacttcttctcccatgttccaggatccttggaacctccaacctcctccatatgagatcaagtcttttttgacactggcccaacttggttccacatatcagcagccagggcct

SEQ ID NO: 374349 - DNA, 140 bp, Artificial Sequence
  Synthetic
atacgccatgctgggtctcctgctgttgaaccggggaagaacccaaaaaatgtacagacagcgccaggtaccttcaagacttctgaaggcgaagttggagccatagctctagacttcaaacgtacttgggagtcggccat

SEQ ID NO: 374350 - DNA, 140 bp, Artificial Sequence
  Synthetic
atggccgactcccaagtacgtttgaagtctagagctatggctccaacttcgccttcagaagtcttgaaggtacctggcgctgtctgtacattttttgggttcttccccggttcaacagcaggagacccagcatggcgtat

SEQ ID NO: 374351 - DNA, 140 bp, Artificial Sequence
  Synthetic
aggccctggctgctgatatgggaagcaaataaccaatgagctaaactatgttctctgggaaggaggacatgacctcactgtagtggctggggatgtgaagggggtgttgaccaaaggcaagaccttttgggacagcggtg

SEQ ID NO: 374352 - DNA, 140 bp, Artificial Sequence
  Synthetic
caccgctgtcccaaaaggtcttgcctttggtcaacacccccttcacatccccagccactacagtgaggtcatgtcctccttcccagagaacatagtttagctcattggttatttgcttcccatatcagcagccagggcct

SEQ ID NO: 374353 - DNA, 140 bp, Artificial Sequence
  Synthetic
atacgccatgctgggtctcccccggcacatctggatctcctatcgtgaacagagagggaaaaatagtaggtctttacggaaatggagtggtgacaacaagtggaacctatgtcagtgccacgtacttgggagtcggccat

SEQ ID NO: 374354 - DNA, 140 bp, Artificial Sequence
  Synthetic
atggccgactcccaagtacgtggcactgacataggttccacttgttgtcaccactccatttccgtaaagacctactatttttccctctctgttcacgataggagatccagatgtgccgggggagacccagcatggcgtat

SEQ ID NO: 374355 - DNA, 140 bp, Artificial Sequence
  Synthetic
aggccctggctgctgatatgtctttacggaaatggagtggtgacaacaagtggaacctatgtcagtgccatagctcaagctaaagcatcacaagaagggcctttgccagagattgaggacgaccttttgggacagcggtg

SEQ ID NO: 374356 - DNA, 140 bp, Artificial Sequence
  Synthetic
caccgctgtcccaaaaggtcgtcctcaatctctggcaaaggcccttcttgtgatgctttagcttgagctatggcactgacataggttccacttgttgtcaccactccatttccgtaaagacatatcagcagccagggcct

SEQ ID NO: 374357 - DNA, 140 bp, Artificial Sequence
  Synthetic
atacgccatgctgggtctccgaggtgtttaggaaaagaaacttaacaataatggacctacacccaggatcgggaaaaacaagaagataccttccagccatagtccgtgaggccataaaaacgtacttgggagtcggccat

SEQ ID NO: 374358 - DNA, 140 bp, Artificial Sequence
  Synthetic
atggccgactcccaagtacgtttttatggcctcacggactatggctggaaggtatcttcttgtttttcccgatcctgggtgtaggtccattattgttaagtttcttttcctaaacacctcggagacccagcatggcgtat

SEQ ID NO: 374359 - DNA, 140 bp, Artificial Sequence
  Synthetic
aggccctggctgctgatatggaaaaagcagcagatgtaacatgggaggaagaggctgagcaaacaggagtgtcccacaacttaatgatcacagttgatgatgatggaacaatgagaataagaccttttgggacagcggtg

SEQ ID NO: 374360 - DNA, 140 bp, Artificial Sequence
  Synthetic
caccgctgtcccaaaaggtcttattctcattgttccatcatcatcaactgtgatcattaagttgtgggacactcctgtttgctcagcctcttcctcccatgttacatctgctgctttttccatatcagcagccagggcct

SEQ ID NO: 374361 - DNA, 140 bp, Artificial Sequence
  Synthetic
atacgccatgctgggtctccatggcagaggcgctcaagggaatgccaataaggtatcagacaacagcagtgaagagtgaacacacgggaaaggagatagttgaccttatgtgtcacgccacgtacttgggagtcggccat

SEQ ID NO: 374362 - DNA, 140 bp, Artificial Sequence
  Synthetic
atggccgactcccaagtacgtggcgtgacacataaggtcaactatctcctttcccgtgtgttcactcttcactgctgttgtctgataccttattggcattcccttgagcgcctctgccatggagacccagcatggcgtat

SEQ ID NO: 374363 - DNA, 140 bp, Artificial Sequence
  Synthetic
aggccctggctgctgatatggatagagagctcaaaaaaccagacctggcagatagagaaagcatcccttattgaagtgaaaacatgtctgtggcccaaaacccacacgctgtggagcaatgaccttttgggacagcggtg

SEQ ID NO: 374364 - DNA, 140 bp, Artificial Sequence
  Synthetic
caccgctgtcccaaaaggtcattgctccacagcgtgtgggttttgggccacagacatgttttcacttcaataagggatgctttctctatctgccaggtctggttttttgagctctctatccatatcagcagccagggcct

SEQ ID NO: 374365 - DNA, 140 bp, Artificial Sequence
  Synthetic
atacgccatgctgggtctccctggcatacttggcaaaagcaaacccaaagatccggtgttctatgggacgtacccagccccccagagacacagaaagcagaactggaagaaggggtctatcgtacttgggagtcggccat

SEQ ID NO: 374366 - DNA, 140 bp, Artificial Sequence
  Synthetic
atggccgactcccaagtacgatagaccccttcttccagttctgctttctgtgtctctggggggctgggtacgtcccatagaacaccggatctttgggtttgcttttgccaagtatgccagggagacccagcatggcgtat

SEQ ID NO: 374367 - DNA, 140 bp, Artificial Sequence
  Synthetic
aggccctggctgctgatatgagggtacatctcaacccgagtgggtatgggtgaagcagctgcgattttcatgacagccaccccccccggatcggtggaggcttttccacagagcaatgcagaccttttgggacagcggtg

SEQ ID NO: 374368 - DNA, 140 bp, Artificial Sequence
  Synthetic
caccgctgtcccaaaaggtctgcattgctctgtggaaaagcctccaccgatccggggggggtggctgtcatgaaaatcgcagctgcttcacccatacccactcgggttgagatgtaccctcatatcagcagccagggcct

SEQ ID NO: 374369 - DNA, 140 bp, Artificial Sequence
  Synthetic
aggccctggctgctgatatggcatcaaatcaggaaatgacattgccaactgtttaagaaagaatggtaaacgggtgatccaattaagcaggaaaacttttgacactgagtatcagaaaacgaccttttgggacagcggtg

SEQ ID NO: 374370 - DNA, 140 bp, Artificial Sequence
  Synthetic
caccgctgtcccaaaaggtcgttttctgatactcagtgtcaaaagttttcctgcttaattggatcacccgtttaccattctttcttaaacagttggcaatgtcatttcctgatttgatgccatatcagcagccagggcct

SEQ ID NO: 374371 - DNA, 140 bp, Artificial Sequence
  Synthetic
atacgccatgctgggtctccaaaaaataacgactgggactatgttgtcacaacagacatatccgaaatgggagcaaactttcgagctgacagggtaatagacccaaggcggtgcctgaaacgtacttgggagtcggccat

SEQ ID NO: 374372 - DNA, 140 bp, Artificial Sequence
  Synthetic
atggccgactcccaagtacgtttcaggcaccgccttgggtctattaccctgtcagctcgaaagtttgctcccatttcggatatgtctgttgtgacaacatagtcccagtcgttattttttggagacccagcatggcgtat

SEQ ID NO: 374373 - DNA, 140 bp, Artificial Sequence
  Synthetic
atacgccatgctgggtctccccggttatactgaaagatggtccagagcgtgtcattctagccggaccgatgccagtgactgtggctagtgccgcccagaggagaggaagaattggaaggacgtacttgggagtcggccat

SEQ ID NO: 374374 - DNA, 140 bp, Artificial Sequence
  Synthetic
atggccgactcccaagtacgtccttccaattcttcctctcctctgggcggcactagccacagtcactggcatcggtccggctagaatgacacgctctggaccatctttcagtataaccggggagacccagcatggcgtat

SEQ ID NO: 374375 - DNA, 140 bp, Artificial Sequence
  Synthetic
atacgccatgctgggtctccaccaaaataaggaaggtgatcagtatatttacatgggacagcctctaaataatgatgaggaccacgcccattggacagaagcaaaaatgctccttgacaacgtacttgggagtcggccat

SEQ ID NO: 374376 - DNA, 140 bp, Artificial Sequence
  Synthetic
atggccgactcccaagtacgttgtcaaggagcatttttgcttctgtccaatgggcgtggtcctcatcattatttagaggctgtcccatgtaaatatactgatcaccttccttattttggtggagacccagcatggcgtat

SEQ ID NO: 374377 - DNA, 140 bp, Artificial Sequence
  Synthetic
aggccctggctgctgatatgaatgatgaggaccacgcccattggacagaagcaaaaatgctccttgacaacataaacacaccagaagggatcatcccagccctctttgagccggaaagaggaccttttgggacagcggtg

SEQ ID NO: 374378 - DNA, 140 bp, Artificial Sequence
  Synthetic
caccgctgtcccaaaaggtcctctttccggctcaaagagggctgggatgatcccttctggtgtgtttatgttgtcaaggagcatttttgcttctgtccaatgggcgtggtcctcatcattcatatcagcagccagggcct

SEQ ID NO: 374379 - DNA, 140 bp, Artificial Sequence
  Synthetic
atacgccatgctgggtctccaaaagagtgctgcaatagacggggagtacagactacggggtgaagcgaggaaaacgtttgtggagctcatgagaagaggagatctacctgtctggctatccgtacttgggagtcggccat

SEQ ID NO: 374380 - DNA, 140 bp, Artificial Sequence
  Synthetic
atggccgactcccaagtacggatagccagacaggtagatctcctcttctcatgagctccacaaacgttttcctcgcttcaccccgtagtctgtactccccgtctattgcagcactcttttggagacccagcatggcgtat

SEQ ID NO: 374381 - DNA, 140 bp, Artificial Sequence
  Synthetic
aggccctggctgctgatatgctaaaaatagtaacacattttgacaacactcaagtgggaaccctagccctttccttgacttttttaagatcaacaataccattagtcatggcttggaggagaccttttgggacagcggtg

SEQ ID NO: 374382 - DNA, 140 bp, Artificial Sequence
  Synthetic
caccgctgtcccaaaaggtctcctccaagccatgactaatggtattgttgatcttaaaaaagtcaaggaaagggctagggttcccacttgagtgttgtcaaaatgtgttactatttttagcatatcagcagccagggcct

SEQ ID NO: 374383 - DNA, 140 bp, Artificial Sequence
  Synthetic
atacgccatgctgggtctccgttagggttccaaattacaacttgataataatggatgaggcccatttcacagacccagccagtatagcggccagagggtacatatcaactcgtgttggaacgtacttgggagtcggccat

SEQ ID NO: 374384 - DNA, 140 bp, Artificial Sequence
  Synthetic
atggccgactcccaagtacgttccaacacgagttgatatgtaccctctggccgctatactggctgggtctgtgaaatgggcctcatccattattatcaagttgtaatttggaaccctaacggagacccagcatggcgtat

SEQ ID NO: 374385 - DNA, 140 bp, Artificial Sequence
  Synthetic
atacgccatgctgggtctccccattatggctgtgttctttgtggtcacactcattcctttgtgcaggacaagctgtcttcaaaaacattcccactgggtagaaataacagcactcatcctcgtacttgggagtcggccat

SEQ ID NO: 374386 - DNA, 140 bp, Artificial Sequence
  Synthetic
atggccgactcccaagtacgaggatgagtgctgttatttctacccagtgggaatgtttttgaagacagcttgtcctgcacaaaggaatgagtgtgaccacaaagaacacagccataatggggagacccagcatggcgtat

SEQ ID NO: 374387 - DNA, 140 bp, Artificial Sequence
  Synthetic
aggccctggctgctgatatgatctggacaaaggaaggagaaagaaagaaactgcgaccccgctggctggatgccagaacatactctgacccactggctctgcgcgaattcaaagagttcggaccttttgggacagcggtg

SEQ ID NO: 374388 - DNA, 140 bp, Artificial Sequence
  Synthetic
caccgctgtcccaaaaggtccgaactctttgaattcgcgcagagccagtgggtcagagtatgttctggcatccagccagcggggtcgcagtttctttctttctccttcctttgtccagatcatatcagcagccagggcct

SEQ ID NO: 374389 - DNA, 140 bp, Artificial Sequence
  Synthetic
atacgccatgctgggtctcccagcaggaagaagaagcgtctcaggtgacctaatattggaaatagggaaacttccacaacatctaacgcaaagggcccagaatgctttggataatctggtcgtacttgggagtcggccat

SEQ ID NO: 374390 - DNA, 140 bp, Artificial Sequence
  Synthetic
atggccgactcccaagtacgaccagattatccaaagcattctgggccctttgcgttagatgttgtggaagtttccctatttccaatattaggtcacctgagacgcttcttcttcctgctgggagacccagcatggcgtat

SEQ ID NO: 374391 - DNA, 140 bp, Artificial Sequence
  Synthetic
aggccctggctgctgatatgcttccacaacatctaacgcaaagggcccagaatgctttggataatctggttatgctgcacaactctgaacaaggaggaaaagcttatagacacgccatgggaccttttgggacagcggtg

SEQ ID NO: 374392 - DNA, 140 bp, Artificial Sequence
  Synthetic
caccgctgtcccaaaaggtcccatggcgtgtctataagcttttcctccttgttcagagttgtgcagcataaccagattatccaaagcattctgggccctttgcgttagatgttgtggaagcatatcagcagccagggcct

SEQ ID NO: 374393 - DNA, 140 bp, Artificial Sequence
  Synthetic
atacgccatgctgggtctcccagcagacctgttactagagaaagctgccaacgtgcagtgggatgaaatggcggacataactggctcaagcccaatcatagaagtgaagcaggatgaagacgtacttgggagtcggccat

SEQ ID NO: 374394 - DNA, 140 bp, Artificial Sequence
  Synthetic
atggccgactcccaagtacgtcttcatcctgcttcacttctatgattgggcttgagccagttatgtccgccatttcatcccactgcacgttggcagctttctctagtaacaggtctgctgggagacccagcatggcgtat

SEQ ID NO: 374395 - DNA, 140 bp, Artificial Sequence
  Synthetic
atacgccatgctgggtctcctgacaactgacatttcagaaatgggggccaatttcaaagcagatagagtgatcgacccaagaagatgtctaaaaccagtgatcctgacagatggaccagacgtacttgggagtcggccat

SEQ ID NO: 374396 - DNA, 140 bp, Artificial Sequence
  Synthetic
atggccgactcccaagtacgtctggtccatctgtcaggatcactggttttagacatcttcttgggtcgatcactctatctgctttgaaattggcccccatttctgaaatgtcagttgtcaggagacccagcatggcgtat

SEQ ID NO: 374397 - DNA, 140 bp, Artificial Sequence
  Synthetic
atacgccatgctgggtctccggatggccagtgtggagccccattggatagcggcctctattatactagagttctttctgatggtgttgctcattccagagccagatagacagcgcactcccgtacttgggagtcggccat

SEQ ID NO: 374398 - DNA, 140 bp, Artificial Sequence
  Synthetic
atggccgactcccaagtacgggagtgcgctgtctatctggctctggaatgagcaacaccatcagaaagaactctagtataatagaggccgctatccaatggggctccacactggccatccggagacccagcatggcgtat

SEQ ID NO: 374399 - DNA, 140 bp, Artificial Sequence
  Synthetic
atacgccatgctgggtctccaaaggagagggagagttggcaggaacccacaaaaagaaaatgaccagtacatattcacgggccagcctctcaacaatgacgaagaccatgctcactggaccgtacttgggagtcggccat

SEQ ID NO: 374400 - DNA, 140 bp, Artificial Sequence
  Synthetic
atggccgactcccaagtacggtccagtgagcatggtcttcgtcattgttgagaggctggcccgtgaatatgtactggtcattttctttttgtgggttcctgccaactctccctctcctttggagacccagcatggcgtat

SEQ ID NO: 374401 - DNA, 140 bp, Artificial Sequence
  Synthetic
atacgccatgctgggtctccacaagacaaccagttagcatatgtggtgataggtttgctattcatgatattgacagtggcagccaatgagatgggattattggaaaccacaaagaaagaccgtacttgggagtcggccat

SEQ ID NO: 374402 - DNA, 140 bp, Artificial Sequence
  Synthetic
atggccgactcccaagtacggtctttctttgtggtttccaataatcccatctcattggctgccactgtcaatatcatgaatagcaaacctatcaccacatatgctaactggttgtcttgtggagacccagcatggcgtat

SEQ ID NO: 374403 - DNA, 140 bp, Artificial Sequence
  Synthetic
atacgccatgctgggtctcctgtctgaaggagtgtataggattatgcaaagagggctgtttgggaaaactcaagttggagtaggaatacacatggaaggcgtatttcacacaatgtggcacgtacttgggagtcggccat

SEQ ID NO: 374404 - DNA, 140 bp, Artificial Sequence
  Synthetic
atggccgactcccaagtacgtgccacattgtgtgaaatacgccttccatgtgtattcctactccaacttgagttttcccaaacagccctctttgcataatcctatacactccttcagacaggagacccagcatggcgtat

SEQ ID NO: 374405 - DNA, 140 bp, Artificial Sequence
  Synthetic
atacgccatgctgggtctccggacgtggacctccatccagcttcagcctggaccctctacgcagtagccacaacgattatcactcccatgatgagacacacaattgaaaacacaacggcacgtacttgggagtcggccat

SEQ ID NO: 374406 - DNA, 140 bp, Artificial Sequence
  Synthetic
atggccgactcccaagtacgtgccgttgtgttttcaattgtgtgtctcatcatgggagtgataatcgttgtggctactgcgtagagggtccaggctgaagctggatggaggtccacgtccggagacccagcatggcgtat

SEQ ID NO: 374407 - DNA, 140 bp, Artificial Sequence
  Synthetic
aggccctggctgctgatatgcaacgattatcactcccatgatgagacacacaattgaaaacacaacggcaaatatttccctgacagctattgcaaaccaggcagccatattgatgggactgaccttttgggacagcggtg

SEQ ID NO: 374408 - DNA, 140 bp, Artificial Sequence
  Synthetic
caccgctgtcccaaaaggtcagtcccatcaatatggctgcctggtttgcaatagctgtcagggaaatatttgccgttgtgttttcaattgtgtgtctcatcatgggagtgataatcgttgcatatcagcagccagggcct

SEQ ID NO: 374409 - DNA, 140 bp, Artificial Sequence
  Synthetic
atacgccatgctgggtctcctgataagggatggccaatatcaaagatggacataggagttccacttctcgccttggggtgctattctcaagtgaacccgctgacgctgacagcagcggtacgtacttgggagtcggccat

SEQ ID NO: 374410 - DNA, 140 bp, Artificial Sequence
  Synthetic
atggccgactcccaagtacgtaccgctgctgtcagcgtcagcgggttcacttgagaatagcaccccaaggcgagaagtggaactcctatgtccatctttgatattggccatcccttatcaggagacccagcatggcgtat

SEQ ID NO: 374411 - DNA, 140 bp, Artificial Sequence
  Synthetic
aggccctggctgctgatatgccctaactggagaaattggagcagtaactctggatttcaaacccggaacgtctggctctcccattattaacaagaaagggaaagttattggactctatgggaccttttgggacagcggtg

SEQ ID NO: 374412 - DNA, 140 bp, Artificial Sequence
  Synthetic
caccgctgtcccaaaaggtcccatagagtccaataactttccctttcttgttaataatgggagagccagacgttccgggtttgaaatccagagttactgctccaatttctccagttagggcatatcagcagccagggcct

SEQ ID NO: 374413 - DNA, 140 bp, Artificial Sequence
  Synthetic
atacgccatgctgggtctccctgatgctagtagcccattatgccataattggaccaggactgcaagcaaaagccactagagaagcgcaaaaaaggacggcagccggaataatgaaaaacccgtacttgggagtcggccat

SEQ ID NO: 374414 - DNA, 140 bp, Artificial Sequence
  Synthetic
atggccgactcccaagtacgggtttttcattattccggctgccgtccttttttgcgcttctctagtggcttttgcttgcagtcctggtccaattatggcataatgggctactagcatcagggagacccagcatggcgtat

SEQ ID NO: 374415 - DNA, 140 bp, Artificial Sequence
  Synthetic
atacgccatgctgggtctccaagaatcctcccatcaatagtcagagaggccttaaaaaggaggctgcgaaccctgattttagctcccacgagagtggtggcggccgagatggaagaggcccgtacttgggagtcggccat

SEQ ID NO: 374416 - DNA, 140 bp, Artificial Sequence
  Synthetic
atggccgactcccaagtacgggcctcttccatctcggccgccaccactctcgtgggagctaaaatcagggttcgcagcctcctttttaaggcctctctgactattgatgggaggattcttggagacccagcatggcgtat

SEQ ID NO: 374417 - DNA, 140 bp, Artificial Sequence
  Synthetic
atacgccatgctgggtctccttctggaacaccacgatagcggtgtccatggcaaacatttttaggggtagttatctagcaggagcgggtctggccttttcattaatgaaatctctgggagcgtacttgggagtcggccat

SEQ ID NO: 374418 - DNA, 140 bp, Artificial Sequence
  Synthetic
atggccgactcccaagtacgctcccagagatttcattaatgaaaaggccagacccgctcctgctagataactacccctaaaaatgtttgccatggacaccgctatcgtggtgttccagaaggagacccagcatggcgtat

SEQ ID NO: 374419 - DNA, 140 bp, Artificial Sequence
  Synthetic
aggccctggctgctgatatgttatctagcaggagcgggtctggccttttcattaatgaaatctctgggaggaggtaggagagggacgggagcccaaggggaaacattgggagaaaagtgggaccttttgggacagcggtg

SEQ ID NO: 374420 - DNA, 140 bp, Artificial Sequence
  Synthetic
caccgctgtcccaaaaggtcccacttttctcccaatgtttccccttgggctcccgtccctctcctacctcctcccagagatttcattaatgaaaaggccagacccgctcctgctagataacatatcagcagccagggcct

SEQ ID NO: 374421 - DNA, 140 bp, Artificial Sequence
  Synthetic
aggccctggctgctgatatggacttttgtcatcaaccagggttcctaattataacctcatagtgatggatgaagcacatttcactgacccttgcagtgtcgcggctagagggtacatttcgaccttttgggacagcggtg

SEQ ID NO: 374422 - DNA, 140 bp, Artificial Sequence
  Synthetic
caccgctgtcccaaaaggtcgaaatgtaccctctagccgcgacactgcaagggtcagtgaaatgtgcttcatccatcactatgaggttataattaggaaccctggttgatgacaaaagtccatatcagcagccagggcct

SEQ ID NO: 374423 - DNA, 140 bp, Artificial Sequence
  Synthetic
atacgccatgctgggtctccaaaagacagctgaaccaattgagcaagtcacaatttaacacctacaagaggagtgggattatagaagtagatagatctgaagccaaggaggggttgaaaacgtacttgggagtcggccat

SEQ ID NO: 374424 - DNA, 140 bp, Artificial Sequence
  Synthetic
atggccgactcccaagtacgttttcaacccctccttggcttcagatctatctacttctataatcccactcctcttgtaggtgttaaattgtgacttgctcaattggttcagctgtcttttggagacccagcatggcgtat

SEQ ID NO: 374425 - DNA, 140 bp, Artificial Sequence
  Synthetic
atacgccatgctgggtctccaaccagggtggaaatgggagaggcagcagctatcttcatgactgcaacccctcctggagcgacagatcccttcccccagagcaacagcccaatagaagaccgtacttgggagtcggccat

SEQ ID NO: 374426 - DNA, 140 bp, Artificial Sequence
  Synthetic
atggccgactcccaagtacggtcttctattgggctgttgctctgggggaagggatctgtcgctccaggaggggttgcagtcatgaagatagctgctgcctctcccatttccaccctggttggagacccagcatggcgtat

SEQ ID NO: 374427 - DNA, 140 bp, Artificial Sequence
  Synthetic
aggccctggctgctgatatgtggtttgtggagaggaaccttgtgaaaccagaagggaaagtcatagacctcggttgtggaagaggtggctggtcatattattgcgctgggctgaagaaaggaccttttgggacagcggtg

SEQ ID NO: 374428 - DNA, 140 bp, Artificial Sequence
  Synthetic
caccgctgtcccaaaaggtcctttcttcagcccagcgcaataatatgaccagccacctcttccacaaccgaggtctatgactttcccttctggtttcacaaggttcctctccacaaaccacatatcagcagccagggcct

SEQ ID NO: 374429 - DNA, 140 bp, Artificial Sequence
  Synthetic
atacgccatgctgggtctcctcacagaagtgaaaggatacacaaaaggaggacctggacatgaggaaccgatcccaatggcaacctatggatggaatctagtaaagctacactccgggaacgtacttgggagtcggccat

SEQ ID NO: 374430 - DNA, 140 bp, Artificial Sequence
  Synthetic
atggccgactcccaagtacgttcccggagtgtagctttactagattccatccataggttgccattgggatcggttcctcatgtccaggtcctccttttgtgtatcctttcacttctgtgaggagacccagcatggcgtat

SEQ ID NO: 374431 - DNA, 140 bp, Artificial Sequence
  Synthetic
atacgccatgctgggtctccgagctgggagagtgatagaccccaggagatgcctcaagccagttatcctaacagatgggccagagagagttattctagcaggtccaatcccagtaactcccgtacttgggagtcggccat

SEQ ID NO: 374432 - DNA, 140 bp, Artificial Sequence
  Synthetic
atggccgactcccaagtacgggagttactgggattggacctgctagaataactctctctggcccatctgttaggataactggcttgaggcatctcctggggtctatcactctcccagctcggagacccagcatggcgtat

SEQ ID NO: 374433 - DNA, 140 bp, Artificial Sequence
  Synthetic
aggccctggctgctgatatggttctaaagatggtagaaccatggctcagaggaaaccaattttgcataaaaattctaaatccctatatgccgagtgtggtagaaactctggagcaaatgcgaccttttgggacagcggtg

SEQ ID NO: 374434 - DNA, 140 bp, Artificial Sequence
  Synthetic
caccgctgtcccaaaaggtcgcatttgctccagagtttctaccacactcggcatatagggatttagaatttttatgcaaaattggtttcctctgagccatggttctaccatctttagaaccatatcagcagccagggcct

SEQ ID NO: 374435 - DNA, 140 bp, Artificial Sequence
  Synthetic
aggccctggctgctgatatgaagatgaccaatatgttttctccggagacccactaaaaaatgatgaagatcatgctcactggacagaagcaaagatgctgcttgacaatatctacaccccgaccttttgggacagcggtg

SEQ ID NO: 374436 - DNA, 140 bp, Artificial Sequence
  Synthetic
caccgctgtcccaaaaggtcggggtgtagatattgtcaagcagcatctttgcttctgtccagtgagcatgatcttcatcattttttagtgggtctccggagaaaacatattggtcatcttcatatcagcagccagggcct

SEQ ID NO: 374437 - DNA, 140 bp, Artificial Sequence
  Synthetic
atacgccatgctgggtctccagtaaatatgacatctagaatgctgctaaaccgattcacaatggctcacaggaagccaacatatgaaagagatgtggacttgggcgctggaacgagacatcgtacttgggagtcggccat

SEQ ID NO: 374438 - DNA, 140 bp, Artificial Sequence
  Synthetic
atggccgactcccaagtacgatgtctcgttccagcgcccaagtccacatctctttcatatgttggcttcctgtgagccattgtgaatcggtttagcagcattctagatgtcatatttactggagacccagcatggcgtat

SEQ ID NO: 374439 - DNA, 140 bp, Artificial Sequence
  Synthetic
aggccctggctgctgatatgggaagccaacatatgaaagagatgtggacttgggcgctggaacgagacatgtggcagtagaaccagaggtggccaacctagacatcattggccagaggatgaccttttgggacagcggtg

SEQ ID NO: 374440 - DNA, 140 bp, Artificial Sequence
  Synthetic
caccgctgtcccaaaaggtcatcctctggccaatgatgtctaggttggccacctctggttctactgccacatgtctcgttccagcgcccaagtccacatctctttcatatgttggcttcccatatcagcagccagggcct

SEQ ID NO: 374441 - DNA, 140 bp, Artificial Sequence
  Synthetic
aggccctggctgctgatatgggaataaccaaattttagaagaaaacatggaggttgaaatttggactaaagagggagaaaagaaaaagctaaggccaaaatggttggatgcacgtgtgtagaccttttgggacagcggtg

SEQ ID NO: 374442 - DNA, 140 bp, Artificial Sequence
  Synthetic
caccgctgtcccaaaaggtctacacacgtgcatccaaccattttggccttagctttttcttttctccctctttagtccaaatttcaacctccatgttttcttctaaaatttggttattcccatatcagcagccagggcct

SEQ ID NO: 374443 - DNA, 140 bp, Artificial Sequence
  Synthetic
atacgccatgctgggtctccatgggatgtcattcccatggtcacacaaatagccatgactgacaccacaccctttggacaacaaagggtgtttaaagagaaagttgatacgcgcacaccacgtacttgggagtcggccat

SEQ ID NO: 374444 - DNA, 140 bp, Artificial Sequence
  Synthetic
atggccgactcccaagtacgtggtgtgcgcgtatcaactttctctttaaacaccctttgttgtccaaagggtgtggtgtcagtcatggctatttgtgtgaccatgggaatgacatcccatggagacccagcatggcgtat

SEQ ID NO: 374445 - DNA, 140 bp, Artificial Sequence
  Synthetic
atacgccatgctgggtctccggctttaaccttagcgaccgggcccatttccacattgtgggaaggaaatccagggaggttttggaacactaccattgcagtgtcaatggctaacatttttcgtacttgggagtcggccat

SEQ ID NO: 374446 - DNA, 140 bp, Artificial Sequence
  Synthetic
atggccgactcccaagtacgaaaaatgttagccattgacactgcaatggtagtgttccaaaacctccctggatttccttcccacaatgtggaaatgggcccggtcgctaaggttaaagccggagacccagcatggcgtat

SEQ ID NO: 374447 - DNA, 140 bp, Artificial Sequence
  Synthetic
aggccctggctgctgatatgaacagaaaaaggagggagggcctaccaacacgccctgaacgaactcccagaatcactggaaacgctcatgcttgtagctctactaggtgctatgacagcagaccttttgggacagcggtg

SEQ ID NO: 374448 - DNA, 140 bp, Artificial Sequence
  Synthetic
caccgctgtcccaaaaggtctgctgtcatagcacctagtagagctacaagcatgagcgtttccagtgattctgggagttcgttcagggcgtgttggtaggccctccctcctttttctgttcatatcagcagccagggcct

SEQ ID NO: 374449 - DNA, 140 bp, Artificial Sequence
  Synthetic
atacgccatgctgggtctccgatgaaaatcaatggaactcagcaaaagaagcagtggaagatgaaaggttctgggaccttgtgcgcagagagagggagcttcataaacaaggaaaatgtgcgtacttgggagtcggccat

SEQ ID NO: 374450 - DNA, 140 bp, Artificial Sequence
  Synthetic
atggccgactcccaagtacgcacattttccttgtttatgaagctccctctctctgcgcacaaggtcccagaacctttcatcttccactgcttcttttgctgagttccattgattttcatcggagacccagcatggcgtat

SEQ ID NO: 374451 - DNA, 140 bp, Artificial Sequence
  Synthetic
aggccctggctgctgatatgctgggaccttgtgcgcagagagagggagcttcataaacaaggaaaatgtgctacatgtgtctacaacatgatgggaaagagagaaaaaaaattaggagaggaccttttgggacagcggtg

SEQ ID NO: 374452 - DNA, 140 bp, Artificial Sequence
  Synthetic
caccgctgtcccaaaaggtcctctcctaattttttttctctctttcccatcatgttgtagacacatgtagcacattttccttgtttatgaagctccctctctctgcgcacaaggtcccagcatatcagcagccagggcct

SEQ ID NO: 374453 - DNA, 140 bp, Artificial Sequence
  Synthetic
atacgccatgctgggtctccttcggaaaggcaaaaggaagtcgcgcaatatggtacatgtggttgggagcgcgcttcttagagtttgaagcccttggcttcatgaatgaagatcactggtcgtacttgggagtcggccat

SEQ ID NO: 374454 - DNA, 140 bp, Artificial Sequence
  Synthetic
atggccgactcccaagtacgaccagtgatcttcattcatgaagccaagggcttcaaactctaagaagcgcgctcccaaccacatgtaccatattgcgcgacttccttttgcctttccgaaggagacccagcatggcgtat

SEQ ID NO: 374455 - DNA, 140 bp, Artificial Sequence
  Synthetic
atacgccatgctgggtctccccaatgagatggggctgattgaaaaaacaaaaactgactttgggttttaccaggtaaaaacagaaacaactattcttgatgtggatttgagaccagcctccgtacttgggagtcggccat

SEQ ID NO: 374456 - DNA, 140 bp, Artificial Sequence
  Synthetic
atggccgactcccaagtacggaggctggtctcaaatccacatcaagaatagttgtttctgtttttacctggtaaaacccaaagtcagtttttgttttttcaatcagccccatctcattggggagacccagcatggcgtat

SEQ ID NO: 374457 - DNA, 140 bp, Artificial Sequence
  Synthetic
atacgccatgctgggtctcctgcagatgacacagccggatgggacacaagaataacagaggaagatcttcagaatgaggccaaaattactgacatcatggaacctgaacatgccctactgcgtacttgggagtcggccat

SEQ ID NO: 374458 - DNA, 140 bp, Artificial Sequence
  Synthetic
atggccgactcccaagtacgcagtagggcatgttcaggttccatgatgtcagtaattttggcctcattctgaagatcttcctctgttattcttgtgtcccatccggctgtgtcatctgcaggagacccagcatggcgtat

SEQ ID NO: 374459 - DNA, 140 bp, Artificial Sequence
  Synthetic
aggccctggctgctgatatggacacaccatagaaaacacgtctgccaacctatctctagcagccattgccaaccaagcagctgttctaatgggacttggaaaaggatggccgctccacaggaccttttgggacagcggtg

SEQ ID NO: 374460 - DNA, 140 bp, Artificial Sequence
  Synthetic
caccgctgtcccaaaaggtcctgtggagcggccatccttttccaagtcccattagaacagctgcttggttggcaatggctgctagagataggttggcagacgtgttttctatggtgtgtccatatcagcagccagggcct

SEQ ID NO: 374461 - DNA, 140 bp, Artificial Sequence
  Synthetic
aggccctggctgctgatatggagaccagcaaaaaatggaaccgtgatggatgtcatatccaggcgtgaccagagaggaagtggacaggttggaacttatggcttaaacaccttcaccaacgaccttttgggacagcggtg

SEQ ID NO: 374462 - DNA, 140 bp, Artificial Sequence
  Synthetic
caccgctgtcccaaaaggtcgttggtgaaggtgtttaagccataagttccaacctgtccacttcctctctggtcacgcctggatatgacatccatcacggttccattttttgctggtctccatatcagcagccagggcct

SEQ ID NO: 374463 - DNA, 140 bp, Artificial Sequence
  Synthetic
aggccctggctgctgatatgagagaggaagtggacaggttggaacttatggcttaaacaccttcaccaacatggaggcccaactaataagacaaatggagtctgaaggaatcttttcaccgaccttttgggacagcggtg

SEQ ID NO: 374464 - DNA, 140 bp, Artificial Sequence
  Synthetic
caccgctgtcccaaaaggtcggtgaaaagattccttcagactccatttgtcttattagttgggcctccatgttggtgaaggtgtttaagccataagttccaacctgtccacttcctctctcatatcagcagccagggcct

SEQ ID NO: 374465 - DNA, 140 bp, Artificial Sequence
  Synthetic
atacgccatgctgggtctcctagcgaattggaaaccccaaatttagccggaagagtccttgactggttggaaaaacatggcatcgagaggctgagaagaatggcaatcagtggagatgaccgtacttgggagtcggccat

SEQ ID NO: 374466 - DNA, 140 bp, Artificial Sequence
  Synthetic
atggccgactcccaagtacggtcatctccactgattgccattcttctcagcctctcgatgccatgtttttccaaccagtcaaggactcttccggctaaatttggggtttccaattcgctaggagacccagcatggcgtat

SEQ ID NO: 374467 - DNA, 140 bp, Artificial Sequence
  Synthetic
aggccctggctgctgatatgaaaaacatggcatcgagaggctgagaagaatggcaatcagtggagatgactgtgtggtgaaaccaattgatgacagatttgcaacagccttaacagccttgaccttttgggacagcggtg

SEQ ID NO: 374468 - DNA, 140 bp, Artificial Sequence
  Synthetic
caccgctgtcccaaaaggtcaaggctgttaaggctgttgcaaatctgtcatcaattggtttcaccacacagtcatctccactgattgccattcttctcagcctctcgatgccatgtttttcatatcagcagccagggcct

SEQ ID NO: 374469 - DNA, 140 bp, Artificial Sequence
  Synthetic
atacgccatgctgggtctccgaatgacatgggaaaggtaagaaaagacataccgcaatgggaaccttcaaaaggatggaatgattggcaacaagtgcccttctgctcacaccacttccaccgtacttgggagtcggccat

SEQ ID NO: 374470 - DNA, 140 bp, Artificial Sequence
  Synthetic
atggccgactcccaagtacggtggaagtggtgtgagcagaagggcacttgttgccaatcattccatccttttgaaggttcccattgcggtatgtcttttcttacctttcccatgtcattcggagacccagcatggcgtat

SEQ ID NO: 374471 - DNA, 140 bp, Artificial Sequence
  Synthetic
atacgccatgctgggtctccccttgtgggagggcaacccaggaaggttttggaacacgaccatagctgtatccacagccaacattttcagaggaagctatttggcaggagctggactagccgtacttgggagtcggccat

SEQ ID NO: 374472 - DNA, 140 bp, Artificial Sequence
  Synthetic
atggccgactcccaagtacggctagtccagctcctgccaaatagcttcctctgaaaatgttggctgtggatacagctatggtcgtgttccaaaaccttcctgggttgccctcccacaaggggagacccagcatggcgtat

SEQ ID NO: 374473 - DNA, 140 bp, Artificial Sequence
  Synthetic
atacgccatgctgggtctccagatgaattggtaggtagggccagagtgtcacaaggcgccggatggagcttgagagaaactgcatgtctaggcaagtcgtatgcacaaatgtggcagctgcgtacttgggagtcggccat

SEQ ID NO: 374474 - DNA, 140 bp, Artificial Sequence
  Synthetic
atggccgactcccaagtacgcagctgccacatttgtgcatacgacttgcctagacatgcagtttctctcaagctccatccggcgccttgtgacactctggccctacctaccaattcatctggagacccagcatggcgtat

SEQ ID NO: 374475 - DNA, 140 bp, Artificial Sequence
  Synthetic
atacgccatgctgggtctccatggtacatgtggttgggagccaggtaccttgagttcgaagcccttggattcttaaatgaagaccactggttctcgcgtgaaaactcttacagtggagtacgtacttgggagtcggccat

SEQ ID NO: 374476 - DNA, 140 bp, Artificial Sequence
  Synthetic
atggccgactcccaagtacgtactccactgtaagagttttcacgcgagaaccagtggtcttcatttaagaatccaagggcttcgaactcaaggtacctggctcccaaccacatgtaccatggagacccagcatggcgtat

SEQ ID NO: 374477 - DNA, 140 bp, Artificial Sequence
  Synthetic
atacgccatgctgggtctcctgtccagagggtctagtaagatcagatggattgttgaaagagggatggttaagccgaaagggaaggtcgtggatcttggttgcgggaggggaggatggtccgtacttgggagtcggccat

SEQ ID NO: 374478 - DNA, 140 bp, Artificial Sequence
  Synthetic
atggccgactcccaagtacggaccatcctcccctcccgcaaccaagatccacgaccttccctttcggcttaaccatccctctttcaacaatccatctgatcttactagaccctctggacaggagacccagcatggcgtat

SEQ ID NO: 374479 - DNA, 140 bp, Artificial Sequence
  Synthetic
atacgccatgctgggtctccagggtctggatagaggaaaacccatggatggaggataaaactcatgtgtccagttgggaagacgttccatacctagggaagagggaagatcaatggtgtgcgtacttgggagtcggccat

SEQ ID NO: 374480 - DNA, 140 bp, Artificial Sequence
  Synthetic
atggccgactcccaagtacgcacaccattgatcttccctcttccctaggtatggaacgtcttcccaactggacacatgagttttatcctccatccatgggttttcctctatccagaccctggagacccagcatggcgtat

SEQ ID NO: 374481 - DNA, 140 bp, Artificial Sequence
  Synthetic
aggccctggctgctgatatgcagttgggaagacgttccatacctagggaagagggaagatcaatggtgtggatccctaataggcttaacagcacgagccacctgggccaccaacatacaggaccttttgggacagcggtg

SEQ ID NO: 374482 - DNA, 140 bp, Artificial Sequence
  Synthetic
caccgctgtcccaaaaggtcctgtatgttggtggcccaggtggctcgtgctgttaagcctattagggatccacaccattgatcttccctcttccctaggtatggaacgtcttcccaactgcatatcagcagccagggcct

SEQ ID NO: 374483 - DNA, 140 bp, Artificial Sequence
  Synthetic
atacgccatgctgggtctccgtggccataaaccaagtgagaaggctcattgggaatgagaattatctagactacatgacatcaatgaagagattcaaaaacgagagtgatcctgaaggggcgtacttgggagtcggccat

SEQ ID NO: 374484 - DNA, 140 bp, Artificial Sequence
  Synthetic
atggccgactcccaagtacgccccttcaggatcactctcgtttttgaatctcttcattgatgtcatgtagtctagataattctcattcccaatgagccttctcacttggtttatggccacggagacccagcatggcgtat

SEQ ID NO: 374485 - DNA, 140 bp, Artificial Sequence
  Synthetic
aggccctggctgctgatatgcaatagaggaaggaaggacattgagagtcttgaagatggtagagccatggctctcttcaaaacctgagttctgcatcaaagtcctcaacccctacatgccgaccttttgggacagcggtg

SEQ ID NO: 374486 - DNA, 140 bp, Artificial Sequence
  Synthetic
caccgctgtcccaaaaggtcggcatgtaggggttgaggactttgatgcagaactcaggttttgaagagagccatggctctaccatcttcaagactctcaatgtccttccttcctctattgcatatcagcagccagggcct

SEQ ID NO: 374487 - DNA, 140 bp, Artificial Sequence
  Synthetic
aggccctggctgctgatatgtcgtcagatgccctttatccaggaattccacccatgagatgtattgggtgtcaggtgcgtcgggaaacatcgtgagttctgtgaacacaatatcaaagatgaccttttgggacagcggtg

SEQ ID NO: 374488 - DNA, 140 bp, Artificial Sequence
  Synthetic
caccgctgtcccaaaaggtcatctttgatattgtgttcacagaactcacgatgtttcccgacgcacctgacacccaatacatctcatgggtggaattcctggataaagggcatctgacgacatatcagcagccagggcct

SEQ ID NO: 374489 - DNA, 140 bp, Artificial Sequence
  Synthetic
atacgccatgctgggtctcccaaagaaacctggcactatgaccaggaaaacccatacagaacctgggcgtatcatggaagctatgaagctccttcgacaggctcagcatcctccatggtgcgtacttgggagtcggccat

SEQ ID NO: 374490 - DNA, 140 bp, Artificial Sequence
  Synthetic
atggccgactcccaagtacgcaccatggaggatgctgagcctgtcgaaggagcttcatagcttccatgatacgcccaggttctgtatgggttttcctggtcatagtgccaggtttctttgggagacccagcatggcgtat

SEQ ID NO: 374491 - DNA, 140 bp, Artificial Sequence
  Synthetic
atacgccatgctgggtctccaagggctctgcaccaggaaggaaaatgtgaatcgtgtgtctataacatgatgggaaagcgtgagaaaaaattaggagagtttggtagggccaagggaagccgtacttgggagtcggccat

SEQ ID NO: 374492 - DNA, 140 bp, Artificial Sequence
  Synthetic
atggccgactcccaagtacggcttcccttggccctaccaaactctcctaattttttctcacgctttcccatcatgttatagacacacgattcacattttccttcctggtgcagagcccttggagacccagcatggcgtat

SEQ ID NO: 374493 - DNA, 140 bp, Artificial Sequence
  Synthetic
aggccctggctgctgatatgctgcctgtgagccccgtccaaggacgttaaaagaagaagtcaggccccaaagccacggtttgagcaaaccgtgctgcctgtagctccgtcgtggggacgtgaccttttgggacagcggtg

SEQ ID NO: 374494 - DNA, 140 bp, Artificial Sequence
  Synthetic
caccgctgtcccaaaaggtcacgtccccacgacggagctacaggcagcacggtttgctcaaaccgtggctttggggcctgacttcttcttttaacgtccttggacggggctcacaggcagcatatcagcagccagggcct

SEQ ID NO: 374495 - DNA, 140 bp, Artificial Sequence
  Synthetic
atacgccatgctgggtctccatagacaagcaggaaggagatctaatatatgctgacgacacagcaggctgggacacgagaatcactgaggatgaccttttaaatgaagaactgatcacagcgtacttgggagtcggccat

SEQ ID NO: 374496 - DNA, 140 bp, Artificial Sequence
  Synthetic
atggccgactcccaagtacgctgtgatcagttcttcatttaaaaggtcatcctcagtgattctcgtgtcccagcctgctgtgtcgtcagcatatattagatctccttcctgcttgtctatggagacccagcatggcgtat

SEQ ID NO: 374497 - DNA, 140 bp, Artificial Sequence
  Synthetic
aggccctggctgctgatatggaccccccgcaaacaaaaacagcatattgacgctgggagagaccagagatcctgctgtctcctcagcatcattccaggcacagaacgccagaaaatggaagaccttttgggacagcggtg

SEQ ID NO: 374498 - DNA, 140 bp, Artificial Sequence
  Synthetic
caccgctgtcccaaaaggtcttccattttctggcgttctgtgcctggaatgatgctgaggagacagcaggatctctggtctctcccagcgtcaatatgctgtttttgtttgcggggggtccatatcagcagccagggcct

SEQ ID NO: 374499 - DNA, 140 bp, Artificial Sequence
  Synthetic
atacgccatgctgggtctccatcttacttgaaaatgacatgaaattcacagtggttgtaggagatgttgctgggatcttggctcaaggaaagaaaatgattaggccacaacccatggaatcgtacttgggagtcggccat

SEQ ID NO: 374500 - DNA, 140 bp, Artificial Sequence
  Synthetic
atggccgactcccaagtacgattccatgggttgtggcctaatcattttctttccttgagccaagatcccagcaacatctcctacaaccactgtgaatttcatgtcattttcaagtaagatggagacccagcatggcgtat

SEQ ID NO: 374501 - DNA, 140 bp, Artificial Sequence
  Synthetic
atacgccatgctgggtctccaagaacccatccctatgtcaacatatggatggaatctagtgcgtcttcaaagtggagttgatgttttctttactccgccagaaaagtgcgacacattgctcgtacttgggagtcggccat

SEQ ID NO: 374502 - DNA, 140 bp, Artificial Sequence
  Synthetic
atggccgactcccaagtacgagcaatgtgtcgcacttttctggcggagtaaagaaaacatcaactccactttgaagacgcactagattccatccatatgttgacatagggatgggttcttggagacccagcatggcgtat

SEQ ID NO: 374503 - DNA, 140 bp, Artificial Sequence
  Synthetic
aggccctggctgctgatatggatgagaggttcagcacctccctcctcttcttgaacgatatgggaaaggtgaggaaagacatccctcagtgggaaccatccaagggatggaaaaactggcgaccttttgggacagcggtg

SEQ ID NO: 374504 - DNA, 140 bp, Artificial Sequence
  Synthetic
caccgctgtcccaaaaggtcgccagtttttccatcccttggatggttcccactgagggatgtctttcctcacctttcccatatcgttcaagaagaggagggaggtgctgaacctctcatccatatcagcagccagggcct

SEQ ID NO: 374505 - DNA, 140 bp, Artificial Sequence
  Synthetic
aggccctggctgctgatatgagcctctggaatcaacatgtgcacactcatagccatggacttgggagaaatgtgtgatgacacggtcacttacaaatgcccccacattaccgaagtggaagaccttttgggacagcggtg

SEQ ID NO: 374506 - DNA, 140 bp, Artificial Sequence
  Synthetic
caccgctgtcccaaaaggtcttccacttcggtaatgtgggggcatttgtaagtgaccgtgtcatcacacatttctcccaagtccatggctatgagtgtgcacatgttgattccagaggctcatatcagcagccagggcct

SEQ ID NO: 374507 - DNA, 140 bp, Artificial Sequence
  Synthetic
atacgccatgctgggtctccgacctacgtttagcctccatggccatatgttcagcagttccaacggaatggtttccaacaagcaggacaacatggtcaatccacgctcatcaccagtggacgtacttgggagtcggccat

SEQ ID NO: 374508 - DNA, 140 bp, Artificial Sequence
  Synthetic
atggccgactcccaagtacgtccactggtgatgagcgtggattgaccatgttgtcctgcttgttggaaaccattccgttggaactgctgaacatatggccatggaggctaaacgtaggtcggagacccagcatggcgtat

SEQ ID NO: 374509 - DNA, 140 bp, Artificial Sequence
  Synthetic
aggccctggctgctgatatgcgttagctccccatgtcggcatgggactggacacacgcacccaaacctggatgtcggctgaaggagcttggagacaagtcgagaaggtagagacatgggcgaccttttgggacagcggtg

SEQ ID NO: 374510 - DNA, 140 bp, Artificial Sequence
  Synthetic
caccgctgtcccaaaaggtcgcccatgtctctaccttctcgacttgtctccaagctccttcagccgacatccaggtttgggtgcgtgtgtccagtcccatgccgacatggggagctaacgcatatcagcagccagggcct

SEQ ID NO: 374511 - DNA, 140 bp, Artificial Sequence
  Synthetic
atacgccatgctgggtctccaggaatctgatcggaaaagaggactacgtggattacatgccagtcatgaaaagatacagcgctccttccgaaagtgaaggagttctgtaattactaataacgtacttgggagtcggccat

SEQ ID NO: 374512 - DNA, 140 bp, Artificial Sequence
  Synthetic
atggccgactcccaagtacgttattagtaattacagaactccttcactttcggaaggagcgctgtatcttttcatgactggcatgtaatccacgtagtcctcttttccgatcagattcctggagacccagcatggcgtat

SEQ ID NO: 374513 - DNA, 140 bp, Artificial Sequence
  Synthetic
atacgccatgctgggtctccccgaagccaggaggaagctgtacttctggtggaaggactagaggttagaggagacccccccaacacaaaaacagcatattgacgctgggaaagaccagagcgtacttgggagtcggccat

SEQ ID NO: 374514 - DNA, 140 bp, Artificial Sequence
  Synthetic
atggccgactcccaagtacgctctggtctttcccagcgtcaatatgctgtttttgtgttgggggggtctcctctaacctctagtccttccaccagaagtacagcttcctcctggcttcggggagacccagcatggcgtat

SEQ ID NO: 374515 - DNA, 140 bp, Artificial Sequence
  Synthetic
aggccctggctgctgatatgcaggatttatggcttatatgattgggcaaacaggaatccagcgaactgtcttctttgtcctaatgatgctagtcgccccatcctacggaatgcgatgcgtgaccttttgggacagcggtg

SEQ ID NO: 374516 - DNA, 140 bp, Artificial Sequence
  Synthetic
caccgctgtcccaaaaggtcacgcatcgcattccgtaggatggggcgactagcatcattaggacaaagaagacagttcgctggattcctgtttgcccaatcatataagccataaatcctgcatatcagcagccagggcct

SEQ ID NO: 374517 - DNA, 140 bp, Artificial Sequence
  Synthetic
atacgccatgctgggtctcctctgttaagaacctattgcattgaagcttcgatatcgaacataaccacggcaacaagatgtccaacgcaaggagagccttatctcaaagaggaacaagaccgtacttgggagtcggccat

SEQ ID NO: 374518 - DNA, 140 bp, Artificial Sequence
  Synthetic
atggccgactcccaagtacggtcttgttcctctttgagataaggctctccttgcgttggacatcttgttgccgtggttatgttcgatatcgaagcttcaatgcaataggttcttaacagaggagacccagcatggcgtat

SEQ ID NO: 374519 - DNA, 140 bp, Artificial Sequence
  Synthetic
aggccctggctgctgatatggggaaaggcaaaaatagtgacagctgaaacacaaaattcctctttcataatagacgggccaaacacaccggagtgtccaagtgcctcaagagcatggaatgaccttttgggacagcggtg

SEQ ID NO: 374520 - DNA, 140 bp, Artificial Sequence
  Synthetic
caccgctgtcccaaaaggtcattccatgctcttgaggcacttggacactccggtgtgtttggcccgtctattatgaaagaggaattttgtgtttcagctgtcactatttttgcctttccccatatcagcagccagggcct

SEQ ID NO: 374521 - DNA, 140 bp, Artificial Sequence
  Synthetic
aggccctggctgctgatatgaacaccattagtcatggcttggaggaccatcatggctgtgttctttgtggtcacactcattcctttgtgcaggacaagctgtcttcaaaaacagtcccatgaccttttgggacagcggtg

SEQ ID NO: 374522 - DNA, 140 bp, Artificial Sequence
  Synthetic
caccgctgtcccaaaaggtcatgggactgtttttgaagacagcttgtcctgcacaaaggaatgagtgtgaccacaaagaacacagccatgatggtcctccaagccatgactaatggtgttcatatcagcagccagggcct

SEQ ID NO: 374523 - DNA, 140 bp, Artificial Sequence
  Synthetic
atacgccatgctgggtctccgaagatgttcaggtcctagccatagaaccaggaaaaaatcctaaacatgtccaaacgaaaccaggccttttcaagaccttaactggagaaattggagcagcgtacttgggagtcggccat

SEQ ID NO: 374524 - DNA, 140 bp, Artificial Sequence
  Synthetic
atggccgactcccaagtacgctgctccaatttctccagttaaggtcttgaaaaggcctggtttcgtttggacatgtttaggattttttcctggttctatggctaggacctgaacatcttcggagacccagcatggcgtat

SEQ ID NO: 374525 - DNA, 140 bp, Artificial Sequence
  Synthetic
aggccctggctgctgatatgccaaacgaaaccaggccttttcaagaccttaactggagaaattggagcagtaactctggatttcaaacccggaacgtctggctctcctatcataaacaaggaccttttgggacagcggtg

SEQ ID NO: 374526 - DNA, 140 bp, Artificial Sequence
  Synthetic
caccgctgtcccaaaaggtccttgtttatgataggagagccagacgttccgggtttgaaatccagagttactgctccaatttctccagttaaggtcttgaaaaggcctggtttcgtttggcatatcagcagccagggcct

SEQ ID NO: 374527 - DNA, 140 bp, Artificial Sequence
  Synthetic
aggccctggctgctgatatgtgattacgtcagtgccataacgcaagccgaaagaattggtgagccagattatgaagtggatgaggacatcttccgaaagaaaagattaaccataatggacgaccttttgggacagcggtg

SEQ ID NO: 374528 - DNA, 140 bp, Artificial Sequence
  Synthetic
caccgctgtcccaaaaggtcgtccattatggttaatcttttctttcggaagatgtcctcatccacttcataatctggctcaccaattctttcggcttgcgttatggcactgacgtaatcacatatcagcagccagggcct

SEQ ID NO: 374529 - DNA, 140 bp, Artificial Sequence
  Synthetic
atacgccatgctgggtctcccagaccccagctgtgaaatcagagcacacaggaagagagattgtagacctcatgtgtcatgcaaccttcacaacgagacttttgtcatcaaccagggttccgtacttgggagtcggccat

SEQ ID NO: 374530 - DNA, 140 bp, Artificial Sequence
  Synthetic
atggccgactcccaagtacggaaccctggttgatgacaaaagtctcgttgtgaaggttgcatgacacatgaggtctacaatctctcttcctgtgtgctctgatttcacagctggggtctgggagacccagcatggcgtat

SEQ ID NO: 374531 - DNA, 140 bp, Artificial Sequence
  Synthetic
atacgccatgctgggtctcctggcttggagcacgcttcttagagtttgaagccctaggattcttgaatgaagatcactggttctccagagggaactccctgagtggagtggaaggagaagcgtacttgggagtcggccat

SEQ ID NO: 374532 - DNA, 140 bp, Artificial Sequence
  Synthetic
atggccgactcccaagtacgcttctccttccactccactcagggagttccctctggagaaccagtgatcttcattcaagaatcctagggcttcaaactctaagaagcgtgctccaagccaggagacccagcatggcgtat

SEQ ID NO: 374533 - DNA, 140 bp, Artificial Sequence
  Synthetic
aggccctggctgctgatatgccaagaaggggccatgcacacagcactcacaggggccacggaaatccagatgtcatcaggaaacttgctgttcacaggacatcttaagtgtaggctgagagaccttttgggacagcggtg

SEQ ID NO: 374534 - DNA, 140 bp, Artificial Sequence
  Synthetic
caccgctgtcccaaaaggtctctcagcctacacttaagatgtcctgtgaacagcaagtttcctgatgacatctggatttccgtggcccctgtgagtgctgtgtgcatggccccttcttggcatatcagcagccagggcct

SEQ ID NO: 374535 - DNA, 140 bp, Artificial Sequence
  Synthetic
atacgccatgctgggtctccagatcatggaactcaggctacgactggatcactgattttccaggtaaaacagtctggtttgtcccaagcattaaatcaggaaatgacattgccaactgttcgtacttgggagtcggccat

SEQ ID NO: 374536 - DNA, 140 bp, Artificial Sequence
  Synthetic
atggccgactcccaagtacgaacagttggcaatgtcatttcctgatttaatgcttgggacaaaccagactgttttacctggaaaatcagtgatccagtcgtagcctgagttccatgatctggagacccagcatggcgtat

SEQ ID NO: 374537 - DNA, 140 bp, Artificial Sequence
  Synthetic
atacgccatgctgggtctcccagagattgccactttgccaacttacctttcctctaaggccaagctagcccttgacaacatagtcatgctccacacaacagaaaaaggagggagggcctacgtacttgggagtcggccat

SEQ ID NO: 374538 - DNA, 140 bp, Artificial Sequence
  Synthetic
atggccgactcccaagtacgtaggccctccctcctttttctgttgtgtggagcatgactatgttgtcaagggctagcttggccttagaggaaaggtaagttggcaaagtggcaatctctgggagacccagcatggcgtat

SEQ ID NO: 374539 - DNA, 140 bp, Artificial Sequence
  Synthetic
atacgccatgctgggtctccccaacatgccctgaacgaactcccggagtcactggaaacactcatgcttgtagccctactaggtgctatgacagccggtatcttcctgtttttcatgcagcgtacttgggagtcggccat

SEQ ID NO: 374540 - DNA, 140 bp, Artificial Sequence
  Synthetic
atggccgactcccaagtacgctgcatgaaaaacaggaagataccggctgtcatagcacctagtagggctacaagcatgagtgtttccagtgactccgggagttcgttcagggcatgttggggagacccagcatggcgtat

SEQ ID NO: 374541 - DNA, 140 bp, Artificial Sequence
  Synthetic
atacgccatgctgggtctcccaatcatactggagttttttcttatggtgctgttgataccagaaccagaaaaacaaaggaccccacaagacaatcaattgatctacgttatattgaccatcgtacttgggagtcggccat

SEQ ID NO: 374542 - DNA, 140 bp, Artificial Sequence
  Synthetic
atggccgactcccaagtacgatggtcaatataacgtagatcaattgattgtcttgtggggtcctttgtttttctggttctggtatcaacagcaccataagaaaaaactccagtatgattgggagacccagcatggcgtat

SEQ ID NO: 374543 - DNA, 140 bp, Artificial Sequence
  Synthetic
atacgccatgctgggtctccaaaagacagctgaaccaattgagcaagtcagaatttaacatttacaagaggagtgggattatagaagtggatagatctgaagccaaggaggggttgaaaacgtacttgggagtcggccat

SEQ ID NO: 374544 - DNA, 140 bp, Artificial Sequence
  Synthetic
atggccgactcccaagtacgttttcaacccctccttggcttcagatctatccacttctataatcccactcctcttgtaaatgttaaattctgacttgctcaattggttcagctgtcttttggagacccagcatggcgtat

SEQ ID NO: 374545 - DNA, 140 bp, Artificial Sequence
  Synthetic
atacgccatgctgggtctcccaccactattctgactcccatgctgagacacaccatagagaacacgtctgccaacctatctctagcagccattgccaaccaagcagctgtcctaatgggacgtacttgggagtcggccat

SEQ ID NO: 374546 - DNA, 140 bp, Artificial Sequence
  Synthetic
atggccgactcccaagtacgtcccattaggacagctgcttggttggcaatggctgctagagataggttggcagacgtgttctctatggtgtgtctcagcatgggagtcagaatagtggtgggagacccagcatggcgtat

SEQ ID NO: 374547 - DNA, 140 bp, Artificial Sequence
  Synthetic
atacgccatgctgggtctccagcaatgggatgctattctcaagtgaacccaacaaccttgacagcatccctagttatgctcttagttcattatgccataataggtccaggattgcaggcacgtacttgggagtcggccat

SEQ ID NO: 374548 - DNA, 140 bp, Artificial Sequence
  Synthetic
atggccgactcccaagtacgtgcctgcaatcctggacctattatggcataatgaactaagagcataactagggatgctgtcaaggttgttgggttcacttgagaatagcatcccattgctggagacccagcatggcgtat

SEQ ID NO: 374549 - DNA, 140 bp, Artificial Sequence
  Synthetic
atacgccatgctgggtctccgactctggccacaggaccagtcatgaccttgtgggagggcaacccgggaaggttttggaacacaaccatagctgtatccacagctaacatttttagaggacgtacttgggagtcggccat

SEQ ID NO: 374550 - DNA, 140 bp, Artificial Sequence
  Synthetic
atggccgactcccaagtacgtcctctaaaaatgttagctgtggatacagctatggttgtgttccaaaaccttcccgggttgccctcccacaaggtcatgactggtcctgtggccagagtcggagacccagcatggcgtat

SEQ ID NO: 374551 - DNA, 140 bp, Artificial Sequence
  Synthetic
aggccctggctgctgatatgaacccctaggaggggaactgggaccacaggagagacactgggagagaagtggaagagacagctaaactcattagacagaaaagagtttgaagagtacaaagaccttttgggacagcggtg

SEQ ID NO: 374552 - DNA, 140 bp, Artificial Sequence
  Synthetic
caccgctgtcccaaaaggtctttgtactcttcaaactcttttctgtctaatgagtttagctgtctcttccacttctctcccagtgtctctcctgtggtcccagttcccctcctaggggttcatatcagcagccagggcct

SEQ ID NO: 374553 - DNA, 140 bp, Artificial Sequence
  Synthetic
aggccctggctgctgatatgggaagagacagctaaactcattagacagaaaagagtttgaagagtacaaaagaagtggaatactagaagtggataggactgaagccaagtctgccctaaggaccttttgggacagcggtg

SEQ ID NO: 374554 - DNA, 140 bp, Artificial Sequence
  Synthetic
caccgctgtcccaaaaggtccttagggcagacttggcttcagtcctatccacttctagtattccacttcttttgtactcttcaaactcttttctgtctaatgagtttagctgtctcttcccatatcagcagccagggcct

SEQ ID NO: 374555 - DNA, 140 bp, Artificial Sequence
  Synthetic
aggccctggctgctgatatgcaatccccatggctacctatggctggaatttggtcaaactccattcaggagttgatgtgttctacaaacccacagagcaggtggacaccctgctttgtgagaccttttgggacagcggtg

SEQ ID NO: 374556 - DNA, 140 bp, Artificial Sequence
  Synthetic
caccgctgtcccaaaaggtctcacaaagcagggtgtccacctgctctgtgggtttgtagaacacatcaactcctgaatggagtttgaccaaattccagccataggtagccatggggattgcatatcagcagccagggcct

SEQ ID NO: 374557 - DNA, 140 bp, Artificial Sequence
  Synthetic
atacgccatgctgggtctccagagttatgtgaggatacaatgacctacaaatgcccccggatcactgaagcagaaccagatgatgttgattgctggtgcaatgccacagacacatgggtgcgtacttgggagtcggccat

SEQ ID NO: 374558 - DNA, 140 bp, Artificial Sequence
  Synthetic
atggccgactcccaagtacgcacccatgtgtctgtggcattgcaccagcaatcaacatcatctggttctgcttcagtgatccgggggcatttgtaggtcattgtatcctcacataactctggagacccagcatggcgtat

SEQ ID NO: 374559 - DNA, 140 bp, Artificial Sequence
  Synthetic
aggccctggctgctgatatgcagaaccagatgatgttgattgctggtgcaatgccacagacacatgggtgacctatgggacgtgttctcaaactggcgaacaccgacgggataaacgttcgaccttttgggacagcggtg

SEQ ID NO: 374560 - DNA, 140 bp, Artificial Sequence
  Synthetic
caccgctgtcccaaaaggtcgaacgtttatcccgtcggtgttcgccagtttgagaacacgtcccataggtcacccatgtgtctgtggcattgcaccagcaatcaacatcatctggttctgcatatcagcagccagggcct

SEQ ID NO: 374561 - DNA, 140 bp, Artificial Sequence
  Synthetic
atacgccatgctgggtctccggggcgcggttcctggaatttgaagccctgggttttttgaatgaagatcactggtttagcagagaaaactcatggagtggagtggaaggggaaggtctgccgtacttgggagtcggccat

SEQ ID NO: 374562 - DNA, 140 bp, Artificial Sequence
  Synthetic
atggccgactcccaagtacggcagaccttccccttccactccactccatgagttttctctgctaaaccagtgatcttcattcaaaaaacccagggcttcaaattccaggaaccgcgccccggagacccagcatggcgtat

SEQ ID NO: 374563 - DNA, 140 bp, Artificial Sequence
  Synthetic
atacgccatgctgggtctccagtcgcattggccccacatgtggggcttggtctcgaaacaagaaccgaaacatggatgtcctctgaaggcgcctggagacagatacaaaaagtggagactcgtacttgggagtcggccat

SEQ ID NO: 374564 - DNA, 140 bp, Artificial Sequence
  Synthetic
atggccgactcccaagtacgagtctccactttttgtatctgtctccaggcgccttcagaggacatccatgtttcggttcttgtttcgagaccaagccccacatgtggggccaatgcgactggagacccagcatggcgtat

SEQ ID NO: 374565 - DNA, 140 bp, Artificial Sequence
  Synthetic
atacgccatgctgggtctcctgggccttgagacacccaggattcacggtgatagccctttttctagcacatgccataggaacatccatcacccagaaagggatcatcttcattttgctgacgtacttgggagtcggccat

SEQ ID NO: 374566 - DNA, 140 bp, Artificial Sequence
  Synthetic
atggccgactcccaagtacgtcagcaaaatgaagatgatccctttctgggtgatggatgttcctatggcatgtgctagaaaaagggctatcaccgtgaatcctgggtgtctcaaggcccaggagacccagcatggcgtat

SEQ ID NO: 374567 - DNA, 140 bp, Artificial Sequence
  Synthetic
atacgccatgctgggtctccgacgaacattcgtggacagaggctggggtaatggctgtggactattcgggaagggaagcttactgacgtgtgctaagtttaagtgtgtgacaaaacttgacgtacttgggagtcggccat

SEQ ID NO: 374568 - DNA, 140 bp, Artificial Sequence
  Synthetic
atggccgactcccaagtacgtcaagttttgtcacacacttaaacttagcacacgtcagtaagcttcccttcccgaatagtccacagccattaccccagcctctgtccacgaatgttcgtcggagacccagcatggcgtat

SEQ ID NO: 374569 - DNA, 140 bp, Artificial Sequence
  Synthetic
atacgccatgctgggtctccatggtgcaggccgatagtggttgcgttgtgagctggaaaaacaaagaactgaagtgtggcagtgggattttcatcacagacaacgtgcacacatggacagcgtacttgggagtcggccat

SEQ ID NO: 374570 - DNA, 140 bp, Artificial Sequence
  Synthetic
atggccgactcccaagtacgctgtccatgtgtgcacgttgtctgtgatgaaaatcccactgccacacttcagttctttgtttttccagctcacaacgcaaccactatcggcctgcaccatggagacccagcatggcgtat

SEQ ID NO: 374571 - DNA, 140 bp, Artificial Sequence
  Synthetic
aggccctggctgctgatatgccagtccattcgtgggaagacataccttacctagggaaaagagaggatctgtggtgcggatccctgattggactttcttccagagccacctgggcgaagagaccttttgggacagcggtg

SEQ ID NO: 374572 - DNA, 140 bp, Artificial Sequence
  Synthetic
caccgctgtcccaaaaggtctcttcgcccaggtggctctggaagaaagtccaatcagggatccgcaccacagatcctctcttttccctaggtaaggtatgtcttcccacgaatggactggcatatcagcagccagggcct

SEQ ID NO: 374573 - DNA, 140 bp, Artificial Sequence
  Synthetic
atacgccatgctgggtctccggaaccttcaagagggtggagcgactggacacaagtgcccttctgttcacatcatttccatgagttaatcatgaaagacggtcgcgtacttgtagttccacgtacttgggagtcggccat

SEQ ID NO: 374574 - DNA, 140 bp, Artificial Sequence
  Synthetic
atggccgactcccaagtacgtggaactacaagtacgcgaccgtctttcatgattaactcatggaaatgatgtgaacagaagggcacttgtgtccagtcgctccaccctcttgaaggttccggagacccagcatggcgtat

SEQ ID NO: 374575 - DNA, 140 bp, Artificial Sequence
  Synthetic
aggccctggctgctgatatgaaggaagtggctgagacccagcatggaactgtcctagtgcaggttaaatatgaaggaacagatgcaccatgcaagattccattttcaacccaagatgagagaccttttgggacagcggtg

SEQ ID NO: 374576 - DNA, 140 bp, Artificial Sequence
  Synthetic
caccgctgtcccaaaaggtctctcatcttgggttgaaaatggaatcttgcatggtgcatctgttccttcatatttaacctgcactaggacagttccatgctgggtctcagccacttccttcatatcagcagccagggcct

SEQ ID NO: 374577 - DNA, 140 bp, Artificial Sequence
  Synthetic
atacgccatgctgggtctccctgccaatgtgcaatgggatgaaatggcggacataactggctcaagcccgatcatagaagtgaagcaggatgaagatggctctttctccatacgggacgtcgtacttgggagtcggccat

SEQ ID NO: 374578 - DNA, 140 bp, Artificial Sequence
  Synthetic
atggccgactcccaagtacgacgtcccgtatggagaaagagccatcttcatcctgcttcacttctatgatcgggcttgagccagttatgtccgccatttcatcccattgcacattggcagggagacccagcatggcgtat

SEQ ID NO: 374579 - DNA, 140 bp, Artificial Sequence
  Synthetic
aggccctggctgctgatatggatgacgtgcattgcagttggcatggtcacactgtacctaggagtcatggttcaagcggacacggggtgtgtgatcaactggaagggcagagaacttaaagaccttttgggacagcggtg

SEQ ID NO: 374580 - DNA, 140 bp, Artificial Sequence
  Synthetic
caccgctgtcccaaaaggtctttaagttctctgcccttccagttgatcacacaccccgtgtccgcttgaaccatgactcctaggtacagtgtgaccatgccaactgcaatgcacgtcatccatatcagcagccagggcct

SEQ ID NO: 374581 - DNA, 140 bp, Artificial Sequence
  Synthetic
atacgccatgctgggtctcccaaggacagcgccagttcggaagcttgcttaacacagttctaacagtttgtttgaatagagagcagatctctggaaaaatgaaccaacgaaaaaaggtggcgtacttgggagtcggccat

SEQ ID NO: 374582 - DNA, 140 bp, Artificial Sequence
  Synthetic
atggccgactcccaagtacgccaccttttttcgttggttcatttttccagagatctgctctctattcaaacaaactgttagaactgtgttaagcaagcttccgaactggcgctgtccttgggagacccagcatggcgtat

SEQ ID NO: 374583 - DNA, 140 bp, Artificial Sequence
  Synthetic
atacgccatgctgggtctccaacatcatgtggaagcaaatatcaaatgaattgaaccatattctacttgaaaatgatatgaaattcacagtggttgtaggagacgctaatggaatcttgacgtacttgggagtcggccat

SEQ ID NO: 374584 - DNA, 140 bp, Artificial Sequence
  Synthetic
atggccgactcccaagtacgtcaagattccattagcgtctcctacaaccactgtgaatttcatatcattttcaagtagaatatggttcaattcatttgatatttgcttccacatgatgttggagacccagcatggcgtat

SEQ ID NO: 374585 - DNA, 140 bp, Artificial Sequence
  Synthetic
aggccctggctgctgatatggtaaaggaatagggaaattgtcaatgggtttgataaccattgcggtggctagtggcttgctctgggtagcagaaattcaaccccagtggatagcggcctcgaccttttgggacagcggtg

SEQ ID NO: 374586 - DNA, 140 bp, Artificial Sequence
  Synthetic
caccgctgtcccaaaaggtcgaggccgctatccactggggttgaatttctgctacccagagcaagccactagccaccgcaatggttatcaaacccattgacaatttccctattcctttaccatatcagcagccagggcct

SEQ ID NO: 374587 - DNA, 140 bp, Artificial Sequence
  Synthetic
atacgccatgctgggtctcccccaaggaaaaaagatgattaggccacaacccatggaacacaaatactcatggaaaagctggggaaaagccaaaatcataggagcagatacacagaataccgtacttgggagtcggccat

SEQ ID NO: 374588 - DNA, 140 bp, Artificial Sequence
  Synthetic
atggccgactcccaagtacggtattctgtgtatctgctcctatgattttggcttttccccagcttttccatgagtatttgtgttccatgggttgtggcctaatcatcttttttccttgggggagacccagcatggcgtat

SEQ ID NO: 374589 - DNA, 140 bp, Artificial Sequence
  Synthetic
atacgccatgctgggtctccccggctaatgtcagctgccatcaaggacagcaaggcagtccatgctgacatggggtactggatagaaagtgaaaagaacgagacctggaagctagcgagacgtacttgggagtcggccat

SEQ ID NO: 374590 - DNA, 140 bp, Artificial Sequence
  Synthetic
atggccgactcccaagtacgtctcgctagcttccaggtctcgttcttttcactttctatccagtaccccatgtcagcatggactgccttgctgtccttgatggcagctgacattagccggggagacccagcatggcgtat

SEQ ID NO: 374591 - DNA, 140 bp, Artificial Sequence
  Synthetic
atacgccatgctgggtctccgacaactgacatggaatgatctgatcagattatgcatcatggttggagccaatgtctcagacagaatggggatgggaacaacgtacctagccttgatggccgtacttgggagtcggccat

SEQ ID NO: 374592 - DNA, 140 bp, Artificial Sequence
  Synthetic
atggccgactcccaagtacggccatcaaggctaggtacgttgttcccatccccattctgtctgagacattggctccaaccatgatgcataatctgatcagatcattccatgtcagttgtcggagacccagcatggcgtat

SEQ ID NO: 374593 - DNA, 140 bp, Artificial Sequence
  Synthetic
atacgccatgctgggtctcccactttcaaaatgagaccgatgttcgctgttgggctattatttcgcagactaacatccagagaggttctccttcttacaattggactaagcctggtggcacgtacttgggagtcggccat

SEQ ID NO: 374594 - DNA, 140 bp, Artificial Sequence
  Synthetic
atggccgactcccaagtacgtgccaccaggcttagtccaattgtaagaaggagaacctctctggatgttagtctgcgaaataatagcccaacagcgaacatcggtctcattttgaaagtgggagacccagcatggcgtat

SEQ ID NO: 374595 - DNA, 140 bp, Artificial Sequence
  Synthetic
atacgccatgctgggtctcctggtccaaattgagaaccttgaatacacagtggttgtgacagtccacaatggagacacccatgcagtaggaaatgacacatccaatcatggggttacagccgtacttgggagtcggccat

SEQ ID NO: 374596 - DNA, 140 bp, Artificial Sequence
  Synthetic
atggccgactcccaagtacggctgtaaccccatgattggatgtgtcatttcctactgcatgggtgtctccattgtggactgtcacaaccactgtgtattcaaggttctcaatttggaccaggagacccagcatggcgtat

SEQ ID NO: 374597 - DNA, 140 bp, Artificial Sequence
  Synthetic
atacgccatgctgggtctccgggcatcatgatgttaaaattattgactgattttcagtcacaccagttatggactaccttactgtctctgacattcatcaaaacaactctttcactggatcgtacttgggagtcggccat

SEQ ID NO: 374598 - DNA, 140 bp, Artificial Sequence
  Synthetic
atggccgactcccaagtacgatccagtgaaagagttgttttgatgaatgtcagagacagtaaggtagtccataactggtgtgactgaaaatcagtcaataattttaacatcatgatgcccggagacccagcatggcgtat

SEQ ID NO: 374599 - DNA, 140 bp, Artificial Sequence
  Synthetic
aggccctggctgctgatatgtaggatcctttggatgcaaaccactaaccatgtttcttataacagaaaacaaaatttggggaaggaaaagttggcccctcaatgaaggaattatggctgtgaccttttgggacagcggtg

SEQ ID NO: 374600 - DNA, 140 bp, Artificial Sequence
  Synthetic
caccgctgtcccaaaaggtcacagccataattccttcattgaggggccaacttttccttccccaaattttgttttctgttataagaaacatggttagtggtttgcatccaaaggatcctacatatcagcagccagggcct

SEQ ID NO: 374601 - DNA, 140 bp, Artificial Sequence
  Synthetic
atacgccatgctgggtctccaagagacaggatgtgacagtgctgggatctcaggaaggagccatgcattctgccctcgctggagccacagaagtggactccggtgatggaaatcacatgtcgtacttgggagtcggccat

SEQ ID NO: 374602 - DNA, 140 bp, Artificial Sequence
  Synthetic
atggccgactcccaagtacgacatgtgatttccatcaccggagtccacttctgtggctccagcgagggcagaatgcatggctccttcctgagatcccagcactgtcacatcctgtctcttggagacccagcatggcgtat

SEQ ID NO: 374603 - DNA, 140 bp, Artificial Sequence
  Synthetic
atacgccatgctgggtctcctggaatagtcagcattttactaagctcactcctcaaaaatgacgtgccactagccggcccactaatagctggaggcatgctgatagcatgttacgtcatacgtacttgggagtcggccat

SEQ ID NO: 374604 - DNA, 140 bp, Artificial Sequence
  Synthetic
atggccgactcccaagtacgtatgacgtaacatgctatcagcatgcctccagctattagtgggccggctagtggcacgtcatttttgaggagtgagcttagtaaaatgctgactattccaggagacccagcatggcgtat

SEQ ID NO: 374605 - DNA, 140 bp, Artificial Sequence
  Synthetic
atacgccatgctgggtctccttgcaggacatctcaagtgcaaagtccgcatggagaaattgagaatcaagggaatgtcatacacgatgtgttcaggaaagttttcaattgacaaagagatcgtacttgggagtcggccat

SEQ ID NO: 374606 - DNA, 140 bp, Artificial Sequence
  Synthetic
atggccgactcccaagtacgatctctttgtcaattgaaaactttcctgaacacatcgtgtatgacattcccttgattctcaatttctccatgcggactttgcacttgagatgtcctgcaaggagacccagcatggcgtat

SEQ ID NO: 374607 - DNA, 140 bp, Artificial Sequence
  Synthetic
aggccctggctgctgatatgggaatgtcatacacgatgtgttcaggaaagttttcaattgacaaagagatggcagaaacacagcatgggacaacagtggtgaaagtcaagtatgaaggtggaccttttgggacagcggtg

SEQ ID NO: 374608 - DNA, 140 bp, Artificial Sequence
  Synthetic
caccgctgtcccaaaaggtccaccttcatacttgactttcaccactgttgtcccatgctgtgtttctgccatctctttgtcaattgaaaactttcctgaacacatcgtgtatgacattcccatatcagcagccagggcct

SEQ ID NO: 374609 - DNA, 140 bp, Artificial Sequence
  Synthetic
aggccctggctgctgatatgggaagaggaagcagaacactctggtgcctcacacaacatactagtggaggtccaagatgatggaactatgaaaataaaagatgaagagagagatgacacggaccttttgggacagcggtg

SEQ ID NO: 374610 - DNA, 140 bp, Artificial Sequence
  Synthetic
caccgctgtcccaaaaggtccgtgtcatctctctcttcatcttttattttcatagttccatcatcttggacctccactagtatgttgtgtgaggcaccagagtgttctgcttcctcttcccatatcagcagccagggcct

SEQ ID NO: 374611 - DNA, 140 bp, Artificial Sequence
  Synthetic
atacgccatgctgggtctccgtacaagaagggaagctctattgggaagatgttcgaggccactgccagaggtgcaaggcgcatggccatcttgggagacacagcttgggactttggatcacgtacttgggagtcggccat

SEQ ID NO: 374612 - DNA, 140 bp, Artificial Sequence
  Synthetic
atggccgactcccaagtacgtgatccaaagtcccaagctgtgtctcccaagatggccatgcgccttgcacctctggcagtggcctcgaacatcttcccaatagagcttcccttcttgtacggagacccagcatggcgtat

SEQ ID NO: 374613 - DNA, 140 bp, Artificial Sequence
  Synthetic
aggccctggctgctgatatgaatgtcaataccagcaaccctttttgtgtggtatttttggcagaaaaagaaacagagatcaggagtcttgtgggacacacccagccctccagaagtggaagaccttttgggacagcggtg

SEQ ID NO: 374614 - DNA, 140 bp, Artificial Sequence
  Synthetic
caccgctgtcccaaaaggtcttccacttctggagggctgggtgtgtcccacaagactcctgatctctgtttctttttctgccaaaaataccacacaaaaagggttgctggtattgacattcatatcagcagccagggcct

SEQ ID NO: 374615 - DNA, 140 bp, Artificial Sequence
  Synthetic
atacgccatgctgggtctccagccatcgcaggcgcttgggaaaatggagtctgtggaatcaggtcaacaaccagaatggagaatctattgtggaagcaaatagccaatgagctgaactaccgtacttgggagtcggccat

SEQ ID NO: 374616 - DNA, 140 bp, Artificial Sequence
  Synthetic
atggccgactcccaagtacggtagttcagctcattggctatttgcttccacaatagattctccattctggttgttgacctgattccacagactccattttcccaagcgcctgcgatggctggagacccagcatggcgtat

SEQ ID NO: 374617 - DNA, 140 bp, Artificial Sequence
  Synthetic
aggccctggctgctgatatgtagctgttgaaccagggaaaaacccaaagaatgtacagacaacgccgggcaccttcaagacccctgaaggcgaagttggagccatagccctagatttcaagaccttttgggacagcggtg

SEQ ID NO: 374618 - DNA, 140 bp, Artificial Sequence
  Synthetic
caccgctgtcccaaaaggtcttgaaatctagggctatggctccaacttcgccttcaggggtcttgaaggtgcccggcgttgtctgtacattctttgggtttttccctggttcaacagctacatatcagcagccagggcct

SEQ ID NO: 374619 - DNA, 140 bp, Artificial Sequence
  Synthetic
atacgccatgctgggtctcccggaatttttgtggttgacaacgtgcacacttggacagaacagtacaaattccaaccagagtccccagcgagactagcgtctgcaatattaaatgcccaccgtacttgggagtcggccat

SEQ ID NO: 374620 - DNA, 140 bp, Artificial Sequence
  Synthetic
atggccgactcccaagtacggtgggcatttaatattgcagacgctagtctcgctggggactctggttggaatttgtactgttctgtccaagtgtgcacgttgtcaaccacaaaaattccgggagacccagcatggcgtat

SEQ ID NO: 374621 - DNA, 140 bp, Artificial Sequence
  Synthetic
atacgccatgctgggtctcccttagagcaaggaaaaagaacactaacaccacaacccatggagctaaaatactcatggaaaacgtggggaaaggcaaaaatagtgacagctgaaacacaacgtacttgggagtcggccat

SEQ ID NO: 374622 - DNA, 140 bp, Artificial Sequence
  Synthetic
atggccgactcccaagtacgttgtgtttcagctgtcactatttttgcctttccccacgttttccatgagtattttagctccatgggttgtggtgttagtgttctttttccttgctctaagggagacccagcatggcgtat

SEQ ID NO: 374623 - DNA, 140 bp, Artificial Sequence
  Synthetic
atacgccatgctgggtctcctaaagagtgaacacacaggaagggagatagtcgacctcatgtgccacgccactttcaccatgcgtctcctatctccagtgagagttcccaattacaacatcgtacttgggagtcggccat

SEQ ID NO: 374624 - DNA, 140 bp, Artificial Sequence
  Synthetic
atggccgactcccaagtacgatgttgtaattgggaactctcactggagataggagacgcatggtgaaagtggcgtggcacatgaggtcgactatctcccttcctgtgtgttcactctttaggagacccagcatggcgtat

SEQ ID NO: 374625 - DNA, 140 bp, Artificial Sequence
  Synthetic
aggccctggctgctgatatgagcatcaaatcaggaaatgacattgccaactgtttaagaaagaacgggaaacgggtgatccaattgagcagaaaaacctttgacactgaataccagaaaagaccttttgggacagcggtg

SEQ ID NO: 374626 - DNA, 140 bp, Artificial Sequence
  Synthetic
caccgctgtcccaaaaggtcttttctggtattcagtgtcaaaggtttttctgctcaattggatcacccgtttcccgttctttcttaaacagttggcaatgtcatttcctgatttgatgctcatatcagcagccagggcct

SEQ ID NO: 374627 - DNA, 140 bp, Artificial Sequence
  Synthetic
atacgccatgctgggtctcccagtcacaattcaggagaattgtgaccatagaggcccatctttgaggaccaccactgcatctggaaaactagtcacgcaatggtgttgccgctcctgcaccgtacttgggagtcggccat

SEQ ID NO: 374628 - DNA, 140 bp, Artificial Sequence
  Synthetic
atggccgactcccaagtacggtgcaggagcggcaacaccattgcgtgactagttttccagatgcagtggtggtcctcaaagatgggcctctatggtcacaattctcctgaattgtgactgggagacccagcatggcgtat

SEQ ID NO: 374629 - DNA, 140 bp, Artificial Sequence
  Synthetic
atacgccatgctgggtctccgccggtaatactaaaagatggtccagagcgcgtcattctagccggaccaatgccagtgaccgcggccagtgctgcccagaggagaggaagaattggaaggcgtacttgggagtcggccat

SEQ ID NO: 374630 - DNA, 140 bp, Artificial Sequence
  Synthetic
atggccgactcccaagtacgccttccaattcttcctctcctctgggcagcactggccgcggtcactggcattggtccggctagaatgacgcgctctggaccatcttttagtattaccggcggagacccagcatggcgtat

SEQ ID NO: 374631 - DNA, 140 bp, Artificial Sequence
  Synthetic
aggccctggctgctgatatgaaccaaaacaaggaaggtgaccagtatatttacatgggacagcctttaaataatgatgaggatcacgcccattggacagaagcaaaaatgctccttgacagaccttttgggacagcggtg

SEQ ID NO: 374632 - DNA, 140 bp, Artificial Sequence
  Synthetic
caccgctgtcccaaaaggtctgtcaaggagcatttttgcttctgtccaatgggcgtgatcctcatcattatttaaaggctgtcccatgtaaatatactggtcaccttccttgttttggttcatatcagcagccagggcct

SEQ ID NO: 374633 - DNA, 140 bp, Artificial Sequence
  Synthetic
atacgccatgctgggtctcctccacatgacctcatggaactcattgatggaatatcactaggactaattttgctaaaaatagtaacacagtttgacaacacccaagtgggaaccttagctcgtacttgggagtcggccat

SEQ ID NO: 374634 - DNA, 140 bp, Artificial Sequence
  Synthetic
atggccgactcccaagtacgagctaaggttcccacttgggtgttgtcaaactgtgttactatttttagcaaaattagtcctagtgatattccatcaatgagttccatgaggtcatgtggaggagacccagcatggcgtat

SEQ ID NO: 374635 - DNA, 140 bp, Artificial Sequence
  Synthetic
aggccctggctgctgatatggcagcaggaagaagaagtgtctcaggtgacctaatattagaaatagggaaacttccacagcatttgacgctaagggcccaaaatgctttggacaacttgggaccttttgggacagcggtg

SEQ ID NO: 374636 - DNA, 140 bp, Artificial Sequence
  Synthetic
caccgctgtcccaaaaggtcccaagttgtccaaagcattttgggcccttagcgtcaaatgctgtggaagtttccctatttctaatattaggtcacctgagacacttcttcttcctgctgccatatcagcagccagggcct

SEQ ID NO: 374637 - DNA, 140 bp, Artificial Sequence
  Synthetic
aggccctggctgctgatatgtcatgttgcacaattccgaacaagggggaaaagcctatagacatgctatggaagaattaccagacaccatagaaacattgatgctactagctttgatagcgaccttttgggacagcggtg

SEQ ID NO: 374638 - DNA, 140 bp, Artificial Sequence
  Synthetic
caccgctgtcccaaaaggtcgctatcaaagctagtagcatcaatgtttctatggtgtctggtaattcttccatagcatgtctataggcttttcccccttgttcggaattgtgcaacatgacatatcagcagccagggcct

SEQ ID NO: 374639 - DNA, 140 bp, Artificial Sequence
  Synthetic
atacgccatgctgggtctcctgtgctgactggtggagttacgttgtttttcctatcaggaaaaggtctagggaaaacatccattggcttactttgtgtaatggcctcaagtgtactgttacgtacttgggagtcggccat

SEQ ID NO: 374640 - DNA, 140 bp, Artificial Sequence
  Synthetic
atggccgactcccaagtacgtaacagtacacttgaggccattacacaaagtaagccaatggatgttttccctagaccttttcctgataggaaaaacaacgtaactccaccagtcagcacaggagacccagcatggcgtat

SEQ ID NO: 374641 - DNA, 140 bp, Artificial Sequence
  Synthetic
atacgccatgctgggtctcctagacatagacttacatccagcttcagcctggaccctctatgcagtagccacaacaattatcactcccatgatgagacacacaattgaaaacacaacggccgtacttgggagtcggccat

SEQ ID NO: 374642 - DNA, 140 bp, Artificial Sequence
  Synthetic
atggccgactcccaagtacggccgttgtgttttcaattgtgtgtctcatcatgggagtgataattgttgtggctactgcatagagggtccaggctgaagctggatgtaagtctatgtctaggagacccagcatggcgtat

SEQ ID NO: 374643 - DNA, 140 bp, Artificial Sequence
  Synthetic
atacgccatgctgggtctccactgtctgaaggagtgtacaggatcatgcaaagagggttattcgggaaaactcaggttggagtagggatacacatggaaggtgtatttcacacaatgtggcgtacttgggagtcggccat

SEQ ID NO: 374644 - DNA, 140 bp, Artificial Sequence
  Synthetic
atggccgactcccaagtacgccacattgtgtgaaatacaccttccatgtgtatccctactccaacctgagttttcccgaataaccctctttgcatgatcctgtacactccttcagacagtggagacccagcatggcgtat

SEQ ID NO: 374645 - DNA, 140 bp, Artificial Sequence
  Synthetic
aggccctggctgctgatatgggttatcgccgtagagcctgggaagaacccaaagaactttcaaaccatgccaggcacatttcagactacaacaggggaaataggagcaattgcactggatgaccttttgggacagcggtg

SEQ ID NO: 374646 - DNA, 140 bp, Artificial Sequence
  Synthetic
caccgctgtcccaaaaggtcatccagtgcaattgctcctatttcccctgttgtagtctgaaatgtgcctggcatggtttgaaagttctttgggttcttcccaggctctacggcgataacccatatcagcagccagggcct

SEQ ID NO: 374647 - DNA, 140 bp, Artificial Sequence
  Synthetic
atacgccatgctgggtctcccaggcacatttcagactacaacaggggaaataggagcaattgcactggatttcaagcctggaacttcagggtctcctatcataaacagagagggaaaggtcgtacttgggagtcggccat

SEQ ID NO: 374648 - DNA, 140 bp, Artificial Sequence
  Synthetic
atggccgactcccaagtacgacctttccctctctgtttatgataggagaccctgaagttccaggcttgaaatccagtgcaattgctcctatttcccctgttgtagtctgaaatgtgcctgggagacccagcatggcgtat

SEQ ID NO: 374649 - DNA, 140 bp, Artificial Sequence
  Synthetic
atacgccatgctgggtctcccatcacagattcttttgatgcggactacatgggccttatgtgaatccatcacactggctactggacccttgaccactctctgggagggatctcctggaaacgtacttgggagtcggccat

SEQ ID NO: 374650 - DNA, 140 bp, Artificial Sequence
  Synthetic
atggccgactcccaagtacgtttccaggagatccctcccagagagtggtcaagggtccagtagccagtgtgatggattcacataaggcccatgtagtccgcatcaaaagaatctgtgatgggagacccagcatggcgtat

SEQ ID NO: 374651 - DNA, 140 bp, Artificial Sequence
  Synthetic
atacgccatgctgggtctccgaaaagacaactaaaccaactgagcaagccagaatttaatacttacaaaaggagtggaattatggaggtggacagatctgaagccaaggagggactgaaacgtacttgggagtcggccat

SEQ ID NO: 374652 - DNA, 140 bp, Artificial Sequence
  Synthetic
atggccgactcccaagtacgtttcagtccctccttggcttcagatctgtccacctccataattccactccttttgtaagtattaaattctggcttgctcagttggtttagttgtcttttcggagacccagcatggcgtat

SEQ ID NO: 374653 - DNA, 140 bp, Artificial Sequence
  Synthetic
aggccctggctgctgatatgagaggagaaacaaccaaacatgcagtgtcgagaggaacagccaaacttaggtggtttgtggagaggaaccttgtgaaaccagaagggaaagtgatagaccgaccttttgggacagcggtg

SEQ ID NO: 374654 - DNA, 140 bp, Artificial Sequence
  Synthetic
caccgctgtcccaaaaggtcggtctatcactttcccttctggtttcacaaggttcctctccacaaaccacctaagtttggctgttcctctcgacactgcatgtttggttgtttctcctctcatatcagcagccagggcct

SEQ ID NO: 374655 - DNA, 140 bp, Artificial Sequence
  Synthetic
atacgccatgctgggtctccatgaagcacatttcaccgatccttccagtgtcgcggctagaggatacatttcgaccagggtggaaatgggagaggcagcagccatcttcatgaccgcaaccgtacttgggagtcggccat

SEQ ID NO: 374656 - DNA, 140 bp, Artificial Sequence
  Synthetic
atggccgactcccaagtacggttgcggtcatgaagatggctgctgcctctcccatttccaccctggtcgaaatgtatcctctagccgcgacactggaaggatcggtgaaatgtgcttcatggagacccagcatggcgtat

SEQ ID NO: 374657 - DNA, 140 bp, Artificial Sequence
  Synthetic
atacgccatgctgggtctccaggatgtattctttacaccacctgagaaatgtgacacccttttgtgtgacattggtgagtcctctccgaatccaactatagaagaaggaagaacgttacgcgtacttgggagtcggccat

SEQ ID NO: 374658 - DNA, 140 bp, Artificial Sequence
  Synthetic
atggccgactcccaagtacgcgtaacgttcttccttcttctatagttggattcggagaggactcaccaatgtcacacaaaagggtgtcacatttctcaggtggtgtaaagaatacatcctggagacccagcatggcgtat

SEQ ID NO: 374659 - DNA, 140 bp, Artificial Sequence
  Synthetic
aggccctggctgctgatatgcagtgaacatgacatccagaatgttgctgaatcggttcacaatggctcacaggaagccaacgtatgaaagagacgtggacttaggcgctggaacaagacagaccttttgggacagcggtg

SEQ ID NO: 374660 - DNA, 140 bp, Artificial Sequence
  Synthetic
caccgctgtcccaaaaggtctgtcttgttccagcgcctaagtccacgtctctttcatacgttggcttcctgtgagccattgtgaaccgattcagcaacattctggatgtcatgttcactgcatatcagcagccagggcct

SEQ ID NO: 374661 - DNA, 140 bp, Artificial Sequence
  Synthetic
aggccctggctgctgatatgccagcaagcgctgctcagagaagagggcgaataggaaggaacccagcacaagaagacgaccaatacgtcttctccggagacccactaaaaaatgatgaaggaccttttgggacagcggtg

SEQ ID NO: 374662 - DNA, 140 bp, Artificial Sequence
  Synthetic
caccgctgtcccaaaaggtccttcatcattttttagtgggtctccggagaagacgtattggtcgtcttcttgtgctgggttccttcctattcgccctcttctctgagcagcgcttgctggcatatcagcagccagggcct

SEQ ID NO: 374663 - DNA, 140 bp, Artificial Sequence
  Synthetic
aggccctggctgctgatatgaatccatacaaaacatgggcctatcatggatcatatgaggtcaagccatcagggtcagcctcatccatggtgaacggcgtggtgagattgctcaccaagcgaccttttgggacagcggtg

SEQ ID NO: 374664 - DNA, 140 bp, Artificial Sequence
  Synthetic
caccgctgtcccaaaaggtcgcttggtgagcaatctcaccacgccgttcaccatggatgaggctgaccctgatggcttgacctcatatgatccatgataggcccatgttttgtatggattcatatcagcagccagggcct

SEQ ID NO: 374665 - DNA, 140 bp, Artificial Sequence
  Synthetic
aggccctggctgctgatatggagagggagaaaagaaaaaactgaggccaaaatggttagatgcacgtgtatacgctgaccccatggctttgaaggatttcaaggagtttgccagtggaaggaccttttgggacagcggtg

SEQ ID NO: 374666 - DNA, 140 bp, Artificial Sequence
  Synthetic
caccgctgtcccaaaaggtccttccactggcaaactccttgaaatccttcaaagccatggggtcagcgtatacacgtgcatctaaccattttggcctcagttttttcttttctccctctccatatcagcagccagggcct

SEQ ID NO: 374667 - DNA, 140 bp, Artificial Sequence
  Synthetic
atacgccatgctgggtctcccaggtatcttcctgtttttcatgcaagggaaaggaatagggaaattgtcaatgggtttgataaccattgcggtcgctagtggcttgctctgggtagcagacgtacttgggagtcggccat

SEQ ID NO: 374668 - DNA, 140 bp, Artificial Sequence
  Synthetic
atggccgactcccaagtacgtctgctacccagagcaagccactagcgaccgcaatggttatcaaacccattgacaatttccctattcctttcccttgcatgaaaaacaggaagatacctgggagacccagcatggcgtat

SEQ ID NO: 374669 - DNA, 140 bp, Artificial Sequence
  Synthetic
aggccctggctgctgatatgtggtactgttgataccagaaccagaaaaacaaaggaccccacaagacaatcaattgatctacgtcatattgaccattctcaccattattggtctaatagcgaccttttgggacagcggtg

SEQ ID NO: 374670 - DNA, 140 bp, Artificial Sequence
  Synthetic
caccgctgtcccaaaaggtcgctattagaccaataatggtgagaatggtcaatatgacgtagatcaattgattgtcttgtggggtcctttgtttttctggttctggtatcaacagtaccacatatcagcagccagggcct

SEQ ID NO: 374671 - DNA, 140 bp, Artificial Sequence
  Synthetic
aggccctggctgctgatatgcagaatgaggccaaaatcactgacatcatggagcccgaacatgctctactggctacgtcaatcttcaagctgacctatcaaaataaggtggtaagggtgcgaccttttgggacagcggtg

SEQ ID NO: 374672 - DNA, 140 bp, Artificial Sequence
  Synthetic
caccgctgtcccaaaaggtcgcacccttaccaccttattttgataggtcagcttgaagattgacgtagccagtagagcatgttcgggctccatgatgtcagtgattttggcctcattctgcatatcagcagccagggcct

SEQ ID NO: 374673 - DNA, 140 bp, Artificial Sequence
  Synthetic
aggccctggctgctgatatgcagagaggaagtggacaggtcggaacttatggcttaaacactttcaccaacatggaggtccaactaataagacagatggaatctgaaggaatcttttcacgaccttttgggacagcggtg

SEQ ID NO: 374674 - DNA, 140 bp, Artificial Sequence
  Synthetic
caccgctgtcccaaaaggtcgtgaaaagattccttcagattccatctgtcttattagttggacctccatgttggtgaaagtgtttaagccataagttccgacctgtccacttcctctctgcatatcagcagccagggcct

SEQ ID NO: 374675 - DNA, 140 bp, Artificial Sequence
  Synthetic
atacgccatgctgggtctccagaatggacctcggtgtgccgctgttagcaatgggatgctattctcaagtgaacccaacaaccttgacagcatccttagtcatgcttttagtccattatgcgtacttgggagtcggccat

SEQ ID NO: 374676 - DNA, 140 bp, Artificial Sequence
  Synthetic
atggccgactcccaagtacgcataatggactaaaagcatgactaaggatgctgtcaaggttgttgggttcacttgagaatagcatcccattgctaacagcggcacaccgaggtccattctggagacccagcatggcgtat

SEQ ID NO: 374677 - DNA, 140 bp, Artificial Sequence
  Synthetic
aggccctggctgctgatatgtgaatgacatgggaaaagtgagaaaagacataccgcaatgggaaccttcaaaaggatggaatgactggcagcaagtgcctttctgttcacaccatttccagaccttttgggacagcggtg

SEQ ID NO: 374678 - DNA, 140 bp, Artificial Sequence
  Synthetic
caccgctgtcccaaaaggtctggaaatggtgtgaacagaaaggcacttgctgccagtcattccatccttttgaaggttcccattgcggtatgtcttttctcacttttcccatgtcattcacatatcagcagccagggcct

SEQ ID NO: 374679 - DNA, 140 bp, Artificial Sequence
  Synthetic
atacgccatgctgggtctccaaaggatggaatgactggcagcaagtgcctttctgttcacaccatttccaccaactgatcatgaaggatgggagggagatagtggtgccatgccgcaacccgtacttgggagtcggccat

SEQ ID NO: 374680 - DNA, 140 bp, Artificial Sequence
  Synthetic
atggccgactcccaagtacgggttgcggcatggcaccactatctccctcccatccttcatgatcagttggtggaaatggtgtgaacagaaaggcacttgctgccagtcattccatcctttggagacccagcatggcgtat

SEQ ID NO: 374681 - DNA, 140 bp, Artificial Sequence
  Synthetic
atacgccatgctgggtctccagtatctagagggtccagtaagatcagatggattgttgagagagggatggtaaagccaaaagggaaagttgtagatcttggctgtgggagaggaggatggcgtacttgggagtcggccat

SEQ ID NO: 374682 - DNA, 140 bp, Artificial Sequence
  Synthetic
atggccgactcccaagtacgccatcctcctctcccacagccaagatctacaactttcccttttggctttaccatccctctctcaacaatccatctgatcttactggaccctctagatactggagacccagcatggcgtat

SEQ ID NO: 374683 - DNA, 140 bp, Artificial Sequence
  Synthetic
atacgccatgctgggtctccactacatgacatcaatgaagagattcaagaatgagagtgatcccgaaggagccctctggtaagccaacacactcatgaaataaaaacaagaagtcaggcccgtacttgggagtcggccat

SEQ ID NO: 374684 - DNA, 140 bp, Artificial Sequence
  Synthetic
atggccgactcccaagtacgggcctgacttcttgtttttatttcatgagtgtgttggcttaccagagggctccttcgggatcactctcattcttgaatctcttcattgatgtcatgtagtggagacccagcatggcgtat

SEQ ID NO: 374685 - DNA, 140 bp, Artificial Sequence
  Synthetic
aggccctggctgctgatatgtgcctgtggctccatcgtggggatgtaaaaacccgggaggctgcaacccatggaagctgtacgcatggggtagcagactagtggttagaggagacccctcgaccttttgggacagcggtg

SEQ ID NO: 374686 - DNA, 140 bp, Artificial Sequence
  Synthetic
caccgctgtcccaaaaggtcgaggggtctcctctaaccactagtctgctaccccatgcgtacagcttccatgggttgcagcctcccgggtttttacatccccacgatggagccacaggcacatatcagcagccagggcct

SEQ ID NO: 374687 - DNA, 140 bp, Artificial Sequence
  Synthetic
atacgccatgctgggtctccccttgtcagatgcccgctgtccaggaactccacccatgagatgtattgggtgtcaggagcgtcgggaaacattgtgagctctgtgaacacaacatcaaagcgtacttgggagtcggccat

SEQ ID NO: 374688 - DNA, 140 bp, Artificial Sequence
  Synthetic
atggccgactcccaagtacgctttgatgttgtgttcacagagctcacaatgtttcccgacgctcctgacacccaatacatctcatgggtggagttcctggacagcgggcatctgacaaggggagacccagcatggcgtat

SEQ ID NO: 374689 - DNA, 140 bp, Artificial Sequence
  Synthetic
aggccctggctgctgatatggtatcatggaagctatgaagctccttcgacaggctctgcgtcctccatggtgaacggggtggtgaaactgctaacaaaaccctgggatgtgattccaatggaccttttgggacagcggtg

SEQ ID NO: 374690 - DNA, 140 bp, Artificial Sequence
  Synthetic
caccgctgtcccaaaaggtccattggaatcacatcccagggttttgttagcagtttcaccaccccgttcaccatggaggacgcagagcctgtcgaaggagcttcatagcttccatgataccatatcagcagccagggcct

SEQ ID NO: 374691 - DNA, 140 bp, Artificial Sequence
  Synthetic
aggccctggctgctgatatgatcaaacgcagccataggcgcagtctttcaagaggaacagggatggacatcagccagtgaagctgtgaatgacagccggttttgggaactggtggacaaagaccttttgggacagcggtg

SEQ ID NO: 374692 - DNA, 140 bp, Artificial Sequence
  Synthetic
caccgctgtcccaaaaggtctttgtccaccagttcccaaaaccggctgtcattcacagcttcactggctgatgtccatccctgttcctcttgaaagactgcgcctatggctgcgtttgatcatatcagcagccagggcct

SEQ ID NO: 374693 - DNA, 140 bp, Artificial Sequence
  Synthetic
atacgccatgctgggtctccgatgggaaaacgtgagaaaaagttaggagagtttggcagagccaagggaagccgagcaatctggtatatgtggctgggagcgcggtttctggaatttgaacgtacttgggagtcggccat

SEQ ID NO: 374694 - DNA, 140 bp, Artificial Sequence
  Synthetic
atggccgactcccaagtacgttcaaattccagaaaccgcgctcccagccacatataccagattgctcggcttcccttggctctgccaaactctcctaactttttctcacgttttcccatcggagacccagcatggcgtat

SEQ ID NO: 374695 - DNA, 140 bp, Artificial Sequence
  Synthetic
aggccctggctgctgatatgaccaaagaggcagtggacaggtgggaacttatggtctgaatacatttaccaatatggaagcccagttagtcagacaaatggaaggagaaggtgtgctgtcgaccttttgggacagcggtg

SEQ ID NO: 374696 - DNA, 140 bp, Artificial Sequence
  Synthetic
caccgctgtcccaaaaggtcgacagcacaccttctccttccatttgtctgactaactgggcttccatattggtaaatgtattcagaccataagttcccacctgtccactgcctctttggtcatatcagcagccagggcct

SEQ ID NO: 374697 - DNA, 140 bp, Artificial Sequence
  Synthetic
atacgccatgctgggtctccgcaagaggttcctttttgctcccaccactttcacaagatctttatgaaggatggccgctcactagttgttccatgtagaaaccaggatgaactgatagggcgtacttgggagtcggccat

SEQ ID NO: 374698 - DNA, 140 bp, Artificial Sequence
  Synthetic
atggccgactcccaagtacgccctatcagttcatcctggtttctacatggaacaactagtgagcggccatccttcataaagatcttgtgaaagtggtgggagcaaaaaggaacctcttgcggagacccagcatggcgtat

SEQ ID NO: 374699 - DNA, 140 bp, Artificial Sequence
  Synthetic
atacgccatgctgggtctccccgtgctgcctgtagctccgtcgtggggacgtaaaacctgggaggctgcaaactgtggaagctgtacgcacggtgtagcagactagcggttagaggagaccgtacttgggagtcggccat

SEQ ID NO: 374700 - DNA, 140 bp, Artificial Sequence
  Synthetic
atggccgactcccaagtacggtctcctctaaccgctagtctgctacaccgtgcgtacagcttccacagtttgcagcctcccaggttttacgtccccacgacggagctacaggcagcacggggagacccagcatggcgtat

SEQ ID NO: 374701 - DNA, 140 bp, Artificial Sequence
  Synthetic
aggccctggctgctgatatgaactgtggaagctgtacgcacggtgtagcagactagcggttagaggagacccctcccatgacacaacgcagcagcggggcccgagcactgagggaagctggaccttttgggacagcggtg

SEQ ID NO: 374702 - DNA, 140 bp, Artificial Sequence
  Synthetic
caccgctgtcccaaaaggtccagcttccctcagtgctcgggccccgctgctgcgttgtgtcatgggaggggtctcctctaaccgctagtctgctacaccgtgcgtacagcttccacagttcatatcagcagccagggcct

SEQ ID NO: 374703 - DNA, 140 bp, Artificial Sequence
  Synthetic
atacgccatgctgggtctccgacaagagatcagtggcgttggctccccatgtcggcatgggactagacacacgcacccaaacctggatgtcggctgaaggagcctggaggcaagtcgagacgtacttgggagtcggccat

SEQ ID NO: 374704 - DNA, 140 bp, Artificial Sequence
  Synthetic
atggccgactcccaagtacgtctcgacttgcctccaggctccttcagccgacatccaggtttgggtgcgtgtgtctagtcccatgccgacatggggagccaacgccactgatctcttgtcggagacccagcatggcgtat

SEQ ID NO: 374705 - DNA, 140 bp, Artificial Sequence
  Synthetic
atacgccatgctgggtctccggataaactgactttaaaaggggtgtcatatgtgatgtgcacaggctcatttaagctagagaaggaagtggctgagacccagcatggaactgttttagtgcgtacttgggagtcggccat

SEQ ID NO: 374706 - DNA, 140 bp, Artificial Sequence
  Synthetic
atggccgactcccaagtacgcactaaaacagttccatgctgggtctcagccacttccttctctagcttaaatgagcctgtgcacatcacatatgacaccccttttaaagtcagtttatccggagacccagcatggcgtat

SEQ ID NO: 374707 - DNA, 140 bp, Artificial Sequence
  Synthetic
aggccctggctgctgatatgagggagtcacggctgagataacacctcaggcatcaaccactgaagccatcttgcctgaatatggaacccttgggctagaatgctcaccacggacaggtttgaccttttgggacagcggtg

SEQ ID NO: 374708 - DNA, 140 bp, Artificial Sequence
  Synthetic
caccgctgtcccaaaaggtcaaacctgtccgtggtgagcattctagcccaagggttccatattcaggcaagatggcttcagtggttgatgcctgaggtgttatctcagccgtgactccctcatatcagcagccagggcct

SEQ ID NO: 374709 - DNA, 140 bp, Artificial Sequence
  Synthetic
aggccctggctgctgatatgggatttcaatgaaatgatcttgctaacaatgaagaacaaagcatggatggtacatagacaatggttttttgacctacctctaccatggacatcaggagctgaccttttgggacagcggtg

SEQ ID NO: 374710 - DNA, 140 bp, Artificial Sequence
  Synthetic
caccgctgtcccaaaaggtcagctcctgatgtccatggtagaggtaggtcaaaaaaccattgtctatgtaccatccatgctttgttcttcattgttagcaagatcatttcattgaaatcccatatcagcagccagggcct

SEQ ID NO: 374711 - DNA, 140 bp, Artificial Sequence
  Synthetic
aggccctggctgctgatatgtttgaatagagagcagatctctggaaaaatgaaccaacgaaaaaaggtggttagaccacctttcaatatgctgaaacgcgagagaaaccgcgtatcaaccgaccttttgggacagcggtg

SEQ ID NO: 374712 - DNA, 140 bp, Artificial Sequence
  Synthetic
caccgctgtcccaaaaggtcggttgatacgcggtttctctcgcgtttcagcatattgaaaggtggtctaaccaccttttttcgttggttcatttttccagagatctgctctctattcaaacatatcagcagccagggcct

SEQ ID NO: 374713 - DNA, 140 bp, Artificial Sequence
  Synthetic
aggccctggctgctgatatggacatgcacccagagcggagaacggagacgagagaagcgctcagtagctttaacaccacattcaggaatgggattggaaacaagagctgagacatggatggaccttttgggacagcggtg

SEQ ID NO: 374714 - DNA, 140 bp, Artificial Sequence
  Synthetic
caccgctgtcccaaaaggtccatccatgtctcagctcttgtttccaatcccattcctgaatgtggtgttaaagctactgagcgcttctctcgtctccgttctccgctctgggtgcatgtccatatcagcagccagggcct

SEQ ID NO: 374715 - DNA, 140 bp, Artificial Sequence
  Synthetic
atacgccatgctgggtctccggaaggagtctcaggtggagcatgggtcgacctggtgctagaacatggaggatgcgtcacaaccatggcccagggaaaaccaaccttggattttgaactgcgtacttgggagtcggccat

SEQ ID NO: 374716 - DNA, 140 bp, Artificial Sequence
  Synthetic
atggccgactcccaagtacgcagttcaaaatccaaggttggttttccctgggccatggttgtgacgcatcctccatgttctagcaccaggtcgacccatgctccacctgagactccttccggagacccagcatggcgtat

SEQ ID NO: 374717 - DNA, 140 bp, Artificial Sequence
  Synthetic
aggccctggctgctgatatgaaagtggttgggcgcgttatctcagccacccctttggctgagaacaccaacagtgtaaccaacatagaattagaacccccctttggggacagctacataggaccttttgggacagcggtg

SEQ ID NO: 374718 - DNA, 140 bp, Artificial Sequence
  Synthetic
caccgctgtcccaaaaggtcctatgtagctgtccccaaaggggggttctaattctatgttggttacactgttggtgttctcagccaaaggggtggctgagataacgcgcccaaccactttcatatcagcagccagggcct

SEQ ID NO: 374719 - DNA, 140 bp, Artificial Sequence
  Synthetic
aggccctggctgctgatatgtgataggtgttggaaacagcgcactaacactccattggttcaggaaagggagttccattggcaagatgtttgagtccacatacagaggtgcaaaacgcatgaccttttgggacagcggtg

SEQ ID NO: 374720 - DNA, 140 bp, Artificial Sequence
  Synthetic
caccgctgtcccaaaaggtcatgcgttttgcacctctgtatgtggactcaaacatcttgccaatggaactccctttcctgaaccaatggagtgttagtgcgctgtttccaacacctatcacatatcagcagccagggcct

SEQ ID NO: 374721 - DNA, 140 bp, Artificial Sequence
  Synthetic
atacgccatgctgggtctccaccctttggagtaatggtgtgctagagagtgatatgatcatcccaaagagtctagctggtcctatttcgcaacacaaccacaggcccgggtaccacaccccgtacttgggagtcggccat

SEQ ID NO: 374722 - DNA, 140 bp, Artificial Sequence
  Synthetic
atggccgactcccaagtacggggtgtggtacccgggcctgtggttgtgttgcgaaataggaccagctagactctttgggatgatcatatcactctctagcacaccattactccaaagggtggagacccagcatggcgtat

SEQ ID NO: 374723 - DNA, 140 bp, Artificial Sequence
  Synthetic
aggccctggctgctgatatgtctagctggtcctatttcgcaacacaaccacaggcccgggtaccacacccagacggcgggaccctggcatttaggaaaattagagctggacttcaactatgaccttttgggacagcggtg

SEQ ID NO: 374724 - DNA, 140 bp, Artificial Sequence
  Synthetic
caccgctgtcccaaaaggtcatagttgaagtccagctctaattttcctaaatgccagggtcccgccgtctgggtgtggtacccgggcctgtggttgtgttgcgaaataggaccagctagacatatcagcagccagggcct

SEQ ID NO: 374725 - DNA, 140 bp, Artificial Sequence
  Synthetic
aggccctggctgctgatatgatttcgcagactaacatccagagaggtgctccttctcacaattggactaagcctggtggcatccgtggagctaccaaattctttagaggagctaggggacgaccttttgggacagcggtg

SEQ ID NO: 374726 - DNA, 140 bp, Artificial Sequence
  Synthetic
caccgctgtcccaaaaggtcgtcccctagctcctctaaagaatttggtagctccacggatgccaccaggcttagtccaattgtgagaaggagcacctctctggatgttagtctgcgaaatcatatcagcagccagggcct

SEQ ID NO: 374727 - DNA, 140 bp, Artificial Sequence
  Synthetic
aggccctggctgctgatatggaatacacagactacatgccatccatgaagagattcagaagggaagaggaagaggcaggtgtcctgtggtagaaggcaaaactaacatgaaacaaggctggaccttttgggacagcggtg

SEQ ID NO: 374728 - DNA, 140 bp, Artificial Sequence
  Synthetic
caccgctgtcccaaaaggtccagccttgtttcatgttagttttgccttctaccacaggacacctgcctcttcctcttcccttctgaatctcttcatggatggcatgtagtctgtgtattccatatcagcagccagggcct

SEQ ID NO: 374729 - DNA, 140 bp, Artificial Sequence
  Synthetic
atacgccatgctgggtctcctctctctttcctctatgtctatccacgacctctcaaaaaacaacatggcttccggtgctgctaggatcctttggatgtaaaccactaaccatgtttcttacgtacttgggagtcggccat

SEQ ID NO: 374730 - DNA, 140 bp, Artificial Sequence
  Synthetic
atggccgactcccaagtacgtaagaaacatggttagtggtttacatccaaaggatcctagcagcaccggaagccatgttgttttttgagaggtcgtggatagacatagaggaaagagagaggagacccagcatggcgtat

SEQ ID NO: 374731 - DNA, 140 bp, Artificial Sequence
  Synthetic
atacgccatgctgggtctcccggacacacaaaaagaatgaaggattttgaatctttattgtgtgcgagtaactacgaggaagattaaagattttcctctcattgaaattgaaattgagatcgtacttgggagtcggccat

SEQ ID NO: 374732 - DNA, 140 bp, Artificial Sequence
  Synthetic
atggccgactcccaagtacgatctcaatttcaatttcaatgagaggaaaatctttaatcttcctcgtagttactcgcacacaataaagattcaaaatccttcattctttttgtgtgtccgggagacccagcatggcgtat

SEQ ID NO: 374733 - DNA, 140 bp, Artificial Sequence
  Synthetic
aggccctggctgctgatatgactacgaggaagattaaagattttcctctcattgaaattgaaattgagattctaatctcgacggatcgatccccaataccaacactgagaattggcctgagaccttttgggacagcggtg

SEQ ID NO: 374734 - DNA, 140 bp, Artificial Sequence
  Synthetic
caccgctgtcccaaaaggtctcaggccaattctcagtgttggtattggggatcgatccgtcgagattagaatctcaatttcaatttcaatgagaggaaaatctttaatcttcctcgtagtcatatcagcagccagggcct

SEQ ID NO: 374735 - DNA, 140 bp, Artificial Sequence
  Synthetic
atacgccatgctgggtctcctctaatctcgacggatcgatccccaataccaacactgagaattggcctgaagaagtcatctgctccttggcaaaaccaagagcaggcccaaagggccattcgtacttgggagtcggccat

SEQ ID NO: 374736 - DNA, 140 bp, Artificial Sequence
  Synthetic
atggccgactcccaagtacgaatggccctttgggcctgctcttggttttgccaaggagcagatgacttcttcaggccaattctcagtgttggtattggggatcgatccgtcgagattagaggagacccagcatggcgtat

SEQ ID NO: 374737 - DNA, 140 bp, Artificial Sequence
  Synthetic
atacgccatgctgggtctccagagcgcgtgccgaagccagccaacaaattgacacagctgctcactctgaccctgaattcataaacaatattaagttgacaacagagatactaatccaatcgtacttgggagtcggccat

SEQ ID NO: 374738 - DNA, 140 bp, Artificial Sequence
  Synthetic
atggccgactcccaagtacgattggattagtatctctgttgtcaacttaatattgtttatgaattcagggtcagagtgagcagctgtgtcaatttgttggctggcttcggcacgcgctctggagacccagcatggcgtat

SEQ ID NO: 374739 - DNA, 140 bp, Artificial Sequence
  Synthetic
aggccctggctgctgatatgccctgaattcataaacaatattaagttgacaacagagatactaatccaatatttggatcaagaatcaaaatagtgaaacgactgactatccctccttagagaccttttgggacagcggtg

SEQ ID NO: 374740 - DNA, 140 bp, Artificial Sequence
  Synthetic
caccgctgtcccaaaaggtctctaaggagggatagtcagtcgtttcactattttgattcttgatccaaatattggattagtatctctgttgtcaacttaatattgtttatgaattcagggcatatcagcagccagggcct

SEQ ID NO: 374741 - DNA, 140 bp, Artificial Sequence
  Synthetic
atacgccatgctgggtctcccctcaaaatggatcctcgtccaatcagaacctggatgatgcataacacatctgaagttgaagcagactaccataagattttaactgccggattgtccgtccgtacttgggagtcggccat

SEQ ID NO: 374742 - DNA, 140 bp, Artificial Sequence
  Synthetic
atggccgactcccaagtacggacggacaatccggcagttaaaatcttatggtagtctgcttcaacttcagatgtgttatgcatcatccaggttctgattggacgaggatccattttgaggggagacccagcatggcgtat

SEQ ID NO: 374743 - DNA, 140 bp, Artificial Sequence
  Synthetic
aggccctggctgctgatatgctgaagttgaagcagactaccataagattttaactgccggattgtccgtccagcaaggcattgtgagacaaagaatcattcctgtttaccaaatctcaaagaccttttgggacagcggtg

SEQ ID NO: 374744 - DNA, 140 bp, Artificial Sequence
  Synthetic
caccgctgtcccaaaaggtctttgagatttggtaaacaggaatgattctttgtctcacaatgccttgctggacggacaatccggcagttaaaatcttatggtagtctgcttcaacttcagcatatcagcagccagggcct

SEQ ID NO: 374745 - DNA, 140 bp, Artificial Sequence
  Synthetic
atacgccatgctgggtctccacttccaggatagtgcagatagctttttgttaatgctatgtctgcatcatgcctatcaaggggattataaacaatttttggaaagtaatgcggtaaaatacgtacttgggagtcggccat

SEQ ID NO: 374746 - DNA, 140 bp, Artificial Sequence
  Synthetic
atggccgactcccaagtacgtattttaccgcattactttccaaaaattgtttataatccccttgataggcatgatgcagacatagcattaacaaaaagctatctgcactatcctggaagtggagacccagcatggcgtat

SEQ ID NO: 374747 - DNA, 140 bp, Artificial Sequence
  Synthetic
aggccctggctgctgatatggcctatcaaggggattataaacaatttttggaaagtaatgcggtaaaataccttgaaggtcatggattccgttttgagatgaagaaaaaggaaggtgtcagaccttttgggacagcggtg

SEQ ID NO: 374748 - DNA, 140 bp, Artificial Sequence
  Synthetic
caccgctgtcccaaaaggtctgacaccttcctttttcttcatctcaaaacggaatccatgaccttcaaggtattttaccgcattactttccaaaaattgtttataatccccttgataggccatatcagcagccagggcct

SEQ ID NO: 374749 - DNA, 140 bp, Artificial Sequence
  Synthetic
atacgccatgctgggtctccagaacattggctgcaatgcccgaggaggaaacaacagaagcaaatgctggacaatttctttcatttgctagtctgtttctcccaaaattggttgtcggagcgtacttgggagtcggccat

SEQ ID NO: 374750 - DNA, 140 bp, Artificial Sequence
  Synthetic
atggccgactcccaagtacgctccgacaaccaattttgggagaaacagactagcaaatgaaagaaattgtccagcatttgcttctgttgtttcctcctcgggcattgcagccaatgttctggagacccagcatggcgtat

SEQ ID NO: 374751 - DNA, 140 bp, Artificial Sequence
  Synthetic
aggccctggctgctgatatgacaatttctttcatttgctagtctgtttctcccaaaattggttgtcggagaaaaggcctgtctggagaaggttcaacgacaaatccaagtgcacgcagaagaccttttgggacagcggtg

SEQ ID NO: 374752 - DNA, 140 bp, Artificial Sequence
  Synthetic
caccgctgtcccaaaaggtcttctgcgtgcacttggatttgtcgttgaaccttctccagacaggccttttctccgacaaccaattttgggagaaacagactagcaaatgaaagaaattgtcatatcagcagccagggcct

SEQ ID NO: 374753 - DNA, 140 bp, Artificial Sequence
  Synthetic
atacgccatgctgggtctccggtcatcttcagactaatgcgaaccaacttcctgattaagttcctcctaatacatcagggaatgcatatggttgcagggcatgatgctaatgatgccgtccgtacttgggagtcggccat

SEQ ID NO: 374754 - DNA, 140 bp, Artificial Sequence
  Synthetic
atggccgactcccaagtacggacggcatcattagcatcatgccctgcaaccatatgcattccctgatgtattaggaggaacttaatcaggaagttggttcgcattagtctgaagatgaccggagacccagcatggcgtat

SEQ ID NO: 374755 - DNA, 140 bp, Artificial Sequence
  Synthetic
atacgccatgctgggtctccaacagtgcttgatcatatcctccaaaaaacagagcacggagttcgcctgcatcccttggcgcgaacagccaaagtcaaaaatgaggtaagctcttttaagcgtacttgggagtcggccat

SEQ ID NO: 374756 - DNA, 140 bp, Artificial Sequence
  Synthetic
atggccgactcccaagtacgcttaaaagagcttacctcatttttgactttggctgttcgcgccaagggatgcaggcgaactccgtgctctgttttttggaggatatgatcaagcactgttggagacccagcatggcgtat

SEQ ID NO: 374757 - DNA, 140 bp, Artificial Sequence
  Synthetic
atacgccatgctgggtctcctctgctgaatctatctggggttaacaatcttgagcatgggcttttccctcaactttctgcaattgctttgggagtagcaactgcacatgggagcactctgcgtacttgggagtcggccat

SEQ ID NO: 374758 - DNA, 140 bp, Artificial Sequence
  Synthetic
atggccgactcccaagtacgcagagtgctcccatgtgcagttgctactcccaaagcaattgcagaaagttgagggaaaagcccatgctcaagattgttaaccccagatagattcagcagaggagacccagcatggcgtat

SEQ ID NO: 374759 - DNA, 140 bp, Artificial Sequence
  Synthetic
aggccctggctgctgatatgaactttctgcaattgctttgggagtagcaactgcacatgggagcactctggcaggagtcaatgtaggagagcaataccaacaactgcgagaagcagccacgaccttttgggacagcggtg

SEQ ID NO: 374760 - DNA, 140 bp, Artificial Sequence
  Synthetic
caccgctgtcccaaaaggtcgtggctgcttctcgcagttgttggtattgctctcctacattgactcctgccagagtgctcccatgtgcagttgctactcccaaagcaattgcagaaagttcatatcagcagccagggcct

SEQ ID NO: 374761 - DNA, 140 bp, Artificial Sequence
  Synthetic
atacgccatgctgggtctccacctaggtcttgatgatcaggaaaagaaaatcctaaaagacttccatcagaaaaagaatgagatcagcttccagcagacgacagccatggtcacactgcgcgtacttgggagtcggccat

SEQ ID NO: 374762 - DNA, 140 bp, Artificial Sequence
  Synthetic
atggccgactcccaagtacgcgcagtgtgaccatggctgtcgtctgctggaagctgatctcattctttttctgatggaagtcttttaggattttcttttcctgatcatcaagacctaggtggagacccagcatggcgtat

SEQ ID NO: 374763 - DNA, 140 bp, Artificial Sequence
  Synthetic
atacgccatgctgggtctcctcaaaacaggaaggcggtatgatgatgacaatgacataccctttccagggccaatcaatgataacgagaactctggtcagaacgatgacgatccaacagacgtacttgggagtcggccat

SEQ ID NO: 374764 - DNA, 140 bp, Artificial Sequence
  Synthetic
atggccgactcccaagtacgtctgttggatcgtcatcgttctgaccagagttctcgttatcattgattggccctggaaagggtatgtcattgtcatcatcataccgccttcctgttttgaggagacccagcatggcgtat

SEQ ID NO: 374765 - DNA, 140 bp, Artificial Sequence
  Synthetic
aggccctggctgctgatatgccaatcaatgataacgagaactctggtcagaacgatgacgatccaacagactcccaggataccacaatcccggatgtaataatcgatccaaacgatggtggaccttttgggacagcggtg

SEQ ID NO: 374766 - DNA, 140 bp, Artificial Sequence
  Synthetic
caccgctgtcccaaaaggtccaccatcgtttggatcgattattacatccgggattgtggtatcctgggagtctgttggatcgtcatcgttctgaccagagttctcgttatcattgattggcatatcagcagccagggcct

SEQ ID NO: 374767 - DNA, 140 bp, Artificial Sequence
  Synthetic
atacgccatgctgggtctccgacctagttctttttgaccttgaggacgaggatgatgctgataacccggctcagaacacgccagaaaaaaatgatagaccagcaacaacaaagctgagaacgtacttgggagtcggccat

SEQ ID NO: 374768 - DNA, 140 bp, Artificial Sequence
  Synthetic
atggccgactcccaagtacgttctcagctttgttgttgctggtctatcatttttttctggcgtgttctgagccgggttatcagcatcatcctcgtcctcaaggtcaaaaagaactaggtcggagacccagcatggcgtat

SEQ ID NO: 374769 - DNA, 140 bp, Artificial Sequence
  Synthetic
atacgccatgctgggtctccatggacgggaccaggatggaaaccaaagcgaaactgcatccccacgggcagcccccaaccaatacagagacaagccaatgccacaagtacagagcagatccgtacttgggagtcggccat

SEQ ID NO: 374770 - DNA, 140 bp, Artificial Sequence
  Synthetic
atggccgactcccaagtacggatctgctctgtacttgtggcattggcttgtctctgtattggttgggggctgcccgtggggatgcagtttcgctttggtttccatcctggtcccgtccatggagacccagcatggcgtat

SEQ ID NO: 374771 - DNA, 140 bp, Artificial Sequence
  Synthetic
atacgccatgctgggtctcctcagcgaggaagcagaccccagcgaccacaacgatggcgacaatgaaagcattcctcccctggaatcagacgacgagggtagcactgatactactgcagccgtacttgggagtcggccat

SEQ ID NO: 374772 - DNA, 140 bp, Artificial Sequence
  Synthetic
atggccgactcccaagtacggctgcagtagtatcagtgctaccctcgtcgtctgattccaggggaggaatgctttcattgtcgccatcgttgtggtcgctggggtctgcttcctcgctgaggagacccagcatggcgtat

SEQ ID NO: 374773 - DNA, 140 bp, Artificial Sequence
  Synthetic
aggccctggctgctgatatgattcctcccctggaatcagacgacgagggtagcactgatactactgcagcagaaacaaagcctgccactgcacctcccgctcccgtctaccgaagtatctgaccttttgggacagcggtg

SEQ ID NO: 374774 - DNA, 140 bp, Artificial Sequence
  Synthetic
caccgctgtcccaaaaggtcagatacttcggtagacgggagcgggaggtgcagtggcaggctttgtttctgctgcagtagtatcagtgctaccctcgtcgtctgattccaggggaggaatcatatcagcagccagggcct

SEQ ID NO: 374775 - DNA, 140 bp, Artificial Sequence
  Synthetic
atacgccatgctgggtctccacgaacaatgaggacaatgtcaggaacaatgcccagtcggagcaatccattgcagaaatgtatcaacatatcttgaaaacacaaggaccttttgatgccacgtacttgggagtcggccat

SEQ ID NO: 374776 - DNA, 140 bp, Artificial Sequence
  Synthetic
atggccgactcccaagtacgtggcatcaaaaggtccttgtgttttcaagatatgttgatacatttctgcaatggattgctccgactgggcattgttcctgacattgtcctcattgttcgtggagacccagcatggcgtat

SEQ ID NO: 374777 - DNA, 140 bp, Artificial Sequence
  Synthetic
aggccctggctgctgatatgtgcagaaatgtatcaacatatcttgaaaacacaaggaccttttgatgccatcctttactaccatatgatgaaagaagagcccatcattttcagcactagtgaccttttgggacagcggtg

SEQ ID NO: 374778 - DNA, 140 bp, Artificial Sequence
  Synthetic
caccgctgtcccaaaaggtcactagtgctgaaaatgatgggctcttctttcatcatatggtagtaaaggatggcatcaaaaggtccttgtgttttcaagatatgttgatacatttctgcacatatcagcagccagggcct

SEQ ID NO: 374779 - DNA, 140 bp, Artificial Sequence
  Synthetic
atacgccatgctgggtctccctggctcagcgagaaggaagccatgaatgaagacaatagattcataaccatggatggtcagcagttttactggcctgtgatgaatcatagaaataaattccgtacttgggagtcggccat

SEQ ID NO: 374780 - DNA, 140 bp, Artificial Sequence
  Synthetic
atggccgactcccaagtacggaatttatttctatgattcatcacaggccagtaaaactgctgaccatccatggttatgaatctattgtcttcattcatggcttccttctcgctgagccagggagacccagcatggcgtat

SEQ ID NO: 374781 - DNA, 140 bp, Artificial Sequence
  Synthetic
atacgccatgctgggtctcctaactacaagctaccccatcactctgccggaatgccagaacctccctccaaaacagctccacatcgagaacctccgacgtggtacacaggcaagacaggccgtacttgggagtcggccat

SEQ ID NO: 374782 - DNA, 140 bp, Artificial Sequence
  Synthetic
atggccgactcccaagtacggcctgtcttgcctgtgtaccacgtcggaggttctcgatgtggagctgttttggagggaggttctggcattccggcagagtgatggggtagcttgtagttaggagacccagcatggcgtat

SEQ ID NO: 374783 - DNA, 140 bp, Artificial Sequence
  Synthetic
atacgccatgctgggtctcccttccaagacaactacaacccccttagccaactccaccacagaagcactaccccataacaacaaccccaaatcaacgacactgcatgtaagtattgtctccgtacttgggagtcggccat

SEQ ID NO: 374784 - DNA, 140 bp, Artificial Sequence
  Synthetic
atggccgactcccaagtacggagacaatacttacatgcagtgtcgttgatttggggttgttgttatggggtagtgcttctgtggtggagttggctaagggggttgtagttgtcttggaagggagacccagcatggcgtat

SEQ ID NO: 374785 - DNA, 140 bp, Artificial Sequence
  Synthetic
atacgccatgctgggtctcctcattaagaaaaaatatatgatgaagattaaaaccttcatcggagctatttcttctacgcttggttaggaccagtattcacaaactattttacaatccctcgtacttgggagtcggccat

SEQ ID NO: 374786 - DNA, 140 bp, Artificial Sequence
  Synthetic
atggccgactcccaagtacgagggattgtaaaatagtttgtgaatactggtcctaaccaagcgtagaagaaatagctccgatgaaggttttaatcttcatcatatattttttcttaatgaggagacccagcatggcgtat

SEQ ID NO: 374787 - DNA, 140 bp, Artificial Sequence
  Synthetic
aggccctggctgctgatatgtcttctacgcttggttaggaccagtattcacaaactattttacaatccctacccaatatgacctctaacagagcaagggtgacttacaacccaccaccaagaccttttgggacagcggtg

SEQ ID NO: 374788 - DNA, 140 bp, Artificial Sequence
  Synthetic
caccgctgtcccaaaaggtcttggtggtgggttgtaagtcacccttgctctgttagaggtcatattgggtagggattgtaaaatagtttgtgaatactggtcctaaccaagcgtagaagacatatcagcagccagggcct

SEQ ID NO: 374789 - DNA, 140 bp, Artificial Sequence
  Synthetic
atacgccatgctgggtctccgagcaattgatgacaggcaagattccgattaccgatatcttcaatgaaattgaaaccttacctagtataagtccctcgatccactccaaaatcaaaaccccgtacttgggagtcggccat

SEQ ID NO: 374790 - DNA, 140 bp, Artificial Sequence
  Synthetic
atggccgactcccaagtacggggttttgattttggagtggatcgagggacttatactaggtaaggtttcaatttcattgaagatatcggtaatcggaatcttgcctgtcatcaattgctcggagacccagcatggcgtat

SEQ ID NO: 374791 - DNA, 140 bp, Artificial Sequence
  Synthetic
aggccctggctgctgatatgtgaaaccttacctagtataagtccctcgatccactccaaaatcaaaaccccaagtgttcaaacacgcagtgtccagacccaaactgacccaaattgtaatgaccttttgggacagcggtg

SEQ ID NO: 374792 - DNA, 140 bp, Artificial Sequence
  Synthetic
caccgctgtcccaaaaggtcattacaatttgggtcagtttgggtctggacactgcgtgtttgaacacttggggttttgattttggagtggatcgagggacttatactaggtaaggtttcacatatcagcagccagggcct

SEQ ID NO: 374793 - DNA, 140 bp, Artificial Sequence
  Synthetic
atacgccatgctgggtctccacaaaaacaaacccttgcaactgaatcacttgagcaacgcattaccgacctggaaggtagcctgaaaccagtgtctgagatcaccaagattgtttctgcacgtacttgggagtcggccat

SEQ ID NO: 374794 - DNA, 140 bp, Artificial Sequence
  Synthetic
atggccgactcccaagtacgtgcagaaacaatcttggtgatctcagacactggtttcaggctaccttccaggtcggtaatgcgttgctcaagtgattcagttgcaagggtttgtttttgtggagacccagcatggcgtat

SEQ ID NO: 374795 - DNA, 140 bp, Artificial Sequence
  Synthetic
atacgccatgctgggtctccctaaatagatcctgtgcagagatggtggccaaatatgatcttctagtaatgacaactggtcgtgcaactgccactgctgcagctactgaagcatactgggcgtacttgggagtcggccat

SEQ ID NO: 374796 - DNA, 140 bp, Artificial Sequence
  Synthetic
atggccgactcccaagtacgcccagtatgcttcagtagctgcagcagtggcagttgcacgaccagttgtcattactagaagatcatatttggccaccatctctgcacaggatctatttagggagacccagcatggcgtat

SEQ ID NO: 374797 - DNA, 140 bp, Artificial Sequence
  Synthetic
aggccctggctgctgatatggacaactggtcgtgcaactgccactgctgcagctactgaagcatactgggcagaacatggacgtcctccaccggggccctcattgtacgaagaggatgcagaccttttgggacagcggtg

SEQ ID NO: 374798 - DNA, 140 bp, Artificial Sequence
  Synthetic
caccgctgtcccaaaaggtctgcatcctcttcgtacaatgagggccccggtggaggacgtccatgttctgcccagtatgcttcagtagctgcagcagtggcagttgcacgaccagttgtccatatcagcagccagggcct

SEQ ID NO: 374799 - DNA, 140 bp, Artificial Sequence
  Synthetic
atacgccatgctgggtctccagaggccttccgtaatctggatagtactgcccttctaacggaagagaattttgggaaaccagacatatccgcaaaagacttgcgcaatatcatgtatgatcgtacttgggagtcggccat

SEQ ID NO: 374800 - DNA, 140 bp, Artificial Sequence
  Synthetic
atggccgactcccaagtacgatcatacatgatattgcgcaagtcttttgcggatatgtctggtttcccaaaattctcttccgttagaagggcagtactatccagattacggaaggcctctggagacccagcatggcgtat

SEQ ID NO: 374801 - DNA, 140 bp, Artificial Sequence
  Synthetic
aggccctggctgctgatatgttgggaaaccagacatatccgcaaaagacttgcgcaatatcatgtatgatcacctcccaggttttggcacagcatttcatcaactagtgcaagttatctggaccttttgggacagcggtg

SEQ ID NO: 374802 - DNA, 140 bp, Artificial Sequence
  Synthetic
caccgctgtcccaaaaggtccagataacttgcactagttgatgaaatgctgtgccaaaacctgggaggtgatcatacatgatattgcgcaagtcttttgcggatatgtctggtttcccaacatatcagcagccagggcct

SEQ ID NO: 374803 - DNA, 140 bp, Artificial Sequence
  Synthetic
atacgccatgctgggtctccaggccagccttgctgaaggagactctcctcagtgtgccctgattcagataaccaaacggattcctattttccaagatgcagcaccacccgtaatccatatcgtacttgggagtcggccat

SEQ ID NO: 374804 - DNA, 140 bp, Artificial Sequence
  Synthetic
atggccgactcccaagtacgatatggattacgggtggtgctgcatcttggaaaataggaatccgtttggttatctgaatcagggcacactgaggagagtctccttcagcaaggctggcctggagacccagcatggcgtat

SEQ ID NO: 374805 - DNA, 140 bp, Artificial Sequence
  Synthetic
atacgccatgctgggtctccttccaccatcaccaaagattgataggggttgggtatgcatattccagctacaagacggaaaaacactcggactcaaaatctaaggtgaacaattgcacaacgtacttgggagtcggccat

SEQ ID NO: 374806 - DNA, 140 bp, Artificial Sequence
  Synthetic
atggccgactcccaagtacgttgtgcaattgttcaccttagattttgagtccgagtgtttttccgtcttgtagctggaatatgcatacccaacccctatcaatctttggtgatggtggaaggagacccagcatggcgtat

SEQ ID NO: 374807 - DNA, 140 bp, Artificial Sequence
  Synthetic
aggccctggctgctgatatgcaagacggaaaaacactcggactcaaaatctaaggtgaacaattgcacaacctccacagtcgcctatattgcttccttccggaattagggtatgatcgcggaccttttgggacagcggtg

SEQ ID NO: 374808 - DNA, 140 bp, Artificial Sequence
  Synthetic
caccgctgtcccaaaaggtccgcgatcataccctaattccggaaggaagcaatataggcgactgtggaggttgtgcaattgttcaccttagattttgagtccgagtgtttttccgtcttgcatatcagcagccagggcct

SEQ ID NO: 374809 - DNA, 140 bp, Artificial Sequence
  Synthetic
atacgccatgctgggtctccatctccaggaatatgagaacgcaaggccatatcaggacccgatctcaattccaatgcaacctactgttaagaataaaataaccaatgtcctctagcctcacgtacttgggagtcggccat

SEQ ID NO: 374810 - DNA, 140 bp, Artificial Sequence
  Synthetic
atggccgactcccaagtacgtgaggctagaggacattggttattttattcttaacagtaggttgcattggaattgagatcgggtcctgatatggccttgcgttctcatattcctggagatggagacccagcatggcgtat

SEQ ID NO: 374811 - DNA, 140 bp, Artificial Sequence
  Synthetic
atacgccatgctgggtctccttgagaggagctaattctttatacttcatctaatctttaagtaagttgatcattaccaccatgaggagggcaattctacctactgcaccgccagaatacacgtacttgggagtcggccat

SEQ ID NO: 374812 - DNA, 140 bp, Artificial Sequence
  Synthetic
atggccgactcccaagtacgtgtattctggcggtgcagtaggtagaattgccctcctcatggtggtaatgatcaacttacttaaagattagatgaagtataaagaattagctcctctcaaggagacccagcatggcgtat

SEQ ID NO: 374813 - DNA, 140 bp, Artificial Sequence
  Synthetic
atacgccatgctgggtctcctggaggctgtctacccaatgagaacggttagtactaatatcagcagtacctccagtggtccgaactttccagcaccggatgtaatgatgagtgatacacccgtacttgggagtcggccat

SEQ ID NO: 374814 - DNA, 140 bp, Artificial Sequence
  Synthetic
atggccgactcccaagtacgggtgtatcactcatcattacatccggtgctggaaagttcggaccactggaggtactgctgatattagtactaaccgttctcattgggtagacagcctccaggagacccagcatggcgtat

SEQ ID NO: 374815 - DNA, 140 bp, Artificial Sequence
  Synthetic
atacgccatgctgggtctccatacaccaaccagtgtttcatcagcctttatactcgaggcaatggtgaatgtgatatcggggccgaaggtactaatgaagcaaattcctatatggctccccgtacttgggagtcggccat

SEQ ID NO: 374816 - DNA, 140 bp, Artificial Sequence
  Synthetic
atggccgactcccaagtacggggagccatataggaatttgcttcattagtaccttcggccccgatatcacattcaccattgcctcgagtataaaggctgatgaaacactggttggtgtatggagacccagcatggcgtat

SEQ ID NO: 374817 - DNA, 140 bp, Artificial Sequence
  Synthetic
aggccctggctgctgatatggtgatatcggggccgaaggtactaatgaagcaaattcctatatggctccccttgggtgttgctgatcaaaaaacatatagttttgactcaactacagctggaccttttgggacagcggtg

SEQ ID NO: 374818 - DNA, 140 bp, Artificial Sequence
  Synthetic
caccgctgtcccaaaaggtccagctgtagttgagtcaaaactatatgttttttgatcagcaacacccaaggggagccatataggaatttgcttcattagtaccttcggccccgatatcaccatatcagcagccagggcct

SEQ ID NO: 374819 - DNA, 140 bp, Artificial Sequence
  Synthetic
atacgccatgctgggtctccccgcttgtgagaatcaatcgacttggtcctgggatccctgatcacccgttgcggcttctaagaataggaaatcaagccttcttgcaagagtttgtgctgccgtacttgggagtcggccat

SEQ ID NO: 374820 - DNA, 140 bp, Artificial Sequence
  Synthetic
atggccgactcccaagtacggcagcacaaactcttgcaagaaggcttgatttcctattcttagaagccgcaacgggtgatcagggatcccaggaccaagtcgattgattctcacaagcggggagacccagcatggcgtat

SEQ ID NO: 374821 - DNA, 140 bp, Artificial Sequence
  Synthetic
aggccctggctgctgatatggcggcttctaagaataggaaatcaagccttcttgcaagagtttgtgctgcctccagtgcaattgccgcagtatttcacttttgacctgacggctctaaaggaccttttgggacagcggtg

SEQ ID NO: 374822 - DNA, 140 bp, Artificial Sequence
  Synthetic
caccgctgtcccaaaaggtcctttagagccgtcaggtcaaaagtgaaatactgcggcaattgcactggaggcagcacaaactcttgcaagaaggcttgatttcctattcttagaagccgccatatcagcagccagggcct

SEQ ID NO: 374823 - DNA, 140 bp, Artificial Sequence
  Synthetic
atacgccatgctgggtctcccggtcctacaggaatacttcgtcctggaatttcctttcatcccaaactgagacctatcctattgccagggaagaccgggaaaagaggatccagctccgatcgtacttgggagtcggccat

SEQ ID NO: 374824 - DNA, 140 bp, Artificial Sequence
  Synthetic
atggccgactcccaagtacgatcggagctggatcctcttttcccggtcttccctggcaataggataggtctcagtttgggatgaaaggaaattccaggacgaagtattcctgtaggaccgggagacccagcatggcgtat

SEQ ID NO: 374825 - DNA, 140 bp, Artificial Sequence
  Synthetic
aggccctggctgctgatatggacctatcctattgccagggaagaccgggaaaagaggatccagctccgatcttacttctcctgataaaatacaagcaataatgaactttctccaagacctgaccttttgggacagcggtg

SEQ ID NO: 374826 - DNA, 140 bp, Artificial Sequence
  Synthetic
caccgctgtcccaaaaggtcaggtcttggagaaagttcattattgcttgtattttatcaggagaagtaagatcggagctggatcctcttttcccggtcttccctggcaataggataggtccatatcagcagccagggcct

SEQ ID NO: 374827 - DNA, 140 bp, Artificial Sequence
  Synthetic
atacgccatgctgggtctcccggaactcttggtccacagactaactggaaagaaaatcacaacaaaaaatggtcaaccaataattcctattcttctaccaaagtatattggcatggatcccgtacttgggagtcggccat

SEQ ID NO: 374828 - DNA, 140 bp, Artificial Sequence
  Synthetic
atggccgactcccaagtacgggatccatgccaatatactttggtagaagaataggaattattggttgaccattttttgttgtgattttctttccagttagtctgtggaccaagagttccgggagacccagcatggcgtat

SEQ ID NO: 374829 - DNA, 140 bp, Artificial Sequence
  Synthetic
atacgccatgctgggtctcccatttctcagggagacctcacaatggtcatcactcaagactgtgacacttgccattctcctgctagtcttcctccagtcagcgagaaataagcatgaagtcgtacttgggagtcggccat

SEQ ID NO: 374830 - DNA, 140 bp, Artificial Sequence
  Synthetic
atggccgactcccaagtacgacttcatgcttatttctcgctgactggaggaagactagcaggagaatggcaagtgtcacagtcttgagtgatgaccattgtgaggtctccctgagaaatgggagacccagcatggcgtat

SEQ ID NO: 374831 - DNA, 140 bp, Artificial Sequence
  Synthetic
aggccctggctgctgatatggccattctcctgctagtcttcctccagtcagcgagaaataagcatgaagtccgaggctgcctggcccacacggcccccagggccttcgtccgaccaccgagaccttttgggacagcggtg

SEQ ID NO: 374832 - DNA, 140 bp, Artificial Sequence
  Synthetic
caccgctgtcccaaaaggtctcggtggtcggacgaaggccctgggggccgtgtgggccaggcagcctcggacttcatgcttatttctcgctgactggaggaagactagcaggagaatggccatatcagcagccagggcct

SEQ ID NO: 374833 - DNA, 140 bp, Artificial Sequence
  Synthetic
atacgccatgctgggtctcctaaaatgcaggaccacaatccaaccagcaacaccatccatacacaggcatcaattgggctaccgcagcatatagacccaatagcaagctgctgtccagaacgtacttgggagtcggccat

SEQ ID NO: 374834 - DNA, 140 bp, Artificial Sequence
  Synthetic
atggccgactcccaagtacgttctggacagcagcttgctattgggtctatatgctgcggtagcccaattgatgcctgtgtatggatggtgttgctggttggattgtggtcctgcattttaggagacccagcatggcgtat

SEQ ID NO: 374835 - DNA, 140 bp, Artificial Sequence
  Synthetic
aggccctggctgctgatatgcaattgggctaccgcagcatatagacccaatagcaagctgctgtccagaaaacagttccagaaagtaactcaaccatcgcaagcccaatgcagctttcaggaccttttgggacagcggtg

SEQ ID NO: 374836 - DNA, 140 bp, Artificial Sequence
  Synthetic
caccgctgtcccaaaaggtcctgaaagctgcattgggcttgcgatggttgagttactttctggaactgttttctggacagcagcttgctattgggtctatatgctgcggtagcccaattgcatatcagcagccagggcct

SEQ ID NO: 374837 - DNA, 140 bp, Artificial Sequence
  Synthetic
atacgccatgctgggtctccgactaaccgcactttaatttgaagcacatttgttcaatgggttcattattaacagtgttgcttttagattgtacctttgctcacagatagtaaattgttacgtacttgggagtcggccat

SEQ ID NO: 374838 - DNA, 140 bp, Artificial Sequence
  Synthetic
atggccgactcccaagtacgtaacaatttactatctgtgagcaaaggtacaatctaaaagcaacactgttaataatgaacccattgaacaaatgtgcttcaaattaaagtgcggttagtcggagacccagcatggcgtat

SEQ ID NO: 374839 - DNA, 140 bp, Artificial Sequence
  Synthetic
atacgccatgctgggtctcctggtatctaatcttattaagaaaaagaacacgatgaagattaacgcgacctagagcgctgccttcatctcatcaatttaacttgtcaatagcgcaacctacgtacttgggagtcggccat

SEQ ID NO: 374840 - DNA, 140 bp, Artificial Sequence
  Synthetic
atggccgactcccaagtacgtaggttgcgctattgacaagttaaattgatgagatgaaggcagcgctctaggtcgcgttaatcttcatcgtgttctttttcttaataagattagataccaggagacccagcatggcgtat

SEQ ID NO: 374841 - DNA, 140 bp, Artificial Sequence
  Synthetic
atacgccatgctgggtctccgtagatataccacagtcatcatggttacatcaggaattctacaattgccccgtgaacgcttcagaaaaacatcattttttgtttgggtaataatcctattcgtacttgggagtcggccat

SEQ ID NO: 374842 - DNA, 140 bp, Artificial Sequence
  Synthetic
atggccgactcccaagtacgaataggattattacccaaacaaaaaatgatgtttttctgaagcgttcacggggcaattgtagaattcctgatgtaaccatgatgactgtggtatatctacggagacccagcatggcgtat

SEQ ID NO: 374843 - DNA, 140 bp, Artificial Sequence
  Synthetic
aggccctggctgctgatatgcgtgaacgcttcagaaaaacatcattttttgtttgggtaataatcctatttcacaaagttttccctatcccattgggcgtagttcacaacaacactctccgaccttttgggacagcggtg

SEQ ID NO: 374844 - DNA, 140 bp, Artificial Sequence
  Synthetic
caccgctgtcccaaaaggtcggagagtgttgttgtgaactacgcccaatgggatagggaaaactttgtgaaataggattattacccaaacaaaaaatgatgtttttctgaagcgttcacgcatatcagcagccagggcct

SEQ ID NO: 374845 - DNA, 140 bp, Artificial Sequence
  Synthetic
atacgccatgctgggtctccagtcagctgaaatcggtcgggcttaatctagaaggtaatggagttgccacagatgtaccaacagcaacgaagagatggggattccgagccggtgttccaccgtacttgggagtcggccat

SEQ ID NO: 374846 - DNA, 140 bp, Artificial Sequence
  Synthetic
atggccgactcccaagtacggtggaacaccggctcggaatccccatctcttcgttgctgttggtacatctgtggcaactccattaccttctagattaagcccgaccgatttcagctgactggagacccagcatggcgtat

SEQ ID NO: 374847 - DNA, 140 bp, Artificial Sequence
  Synthetic
atacgccatgctgggtctccctggacatcaagaaagcagatggtagcgaatgcctacctgaagcccctgagggtgtaagaggcttccctcgctgccgttatgtgcacaaggtttctggaacgtacttgggagtcggccat

SEQ ID NO: 374848 - DNA, 140 bp, Artificial Sequence
  Synthetic
atggccgactcccaagtacgttccagaaaccttgtgcacataacggcagcgagggaagcctcttacaccctcaggggcttcaggtaggcattcgctaccatctgctttcttgatgtccagggagacccagcatggcgtat

SEQ ID NO: 374849 - DNA, 140 bp, Artificial Sequence
  Synthetic
atacgccatgctgggtctcccagggccgtgtcctgaaggtttcgctttccacaaagaaggcgctttcttcctgtatgatcgactggcatcaacaatcatctatcgaagcaccacgttttccgtacttgggagtcggccat

SEQ ID NO: 374850 - DNA, 140 bp, Artificial Sequence
  Synthetic
atggccgactcccaagtacggaaaacgtggtgcttcgatagatgattgttgatgccagtcgatcatacaggaagaaagcgccttctttgtggaaagcgaaaccttcaggacacggccctgggagacccagcatggcgtat

SEQ ID NO: 374851 - DNA, 140 bp, Artificial Sequence
  Synthetic
atacgccatgctgggtctcctccaatcaccaccactacatgaaccggccaatatgacaacagacccatccagctactaccacacagtcacacttaattatgtggctgacaattttgggaccgtacttgggagtcggccat

SEQ ID NO: 374852 - DNA, 140 bp, Artificial Sequence
  Synthetic
atggccgactcccaagtacggtcccaaaattgtcagccacataattaagtgtgactgtgtggtagtagctggatgggtctgttgtcatattggccggttcatgtagtggtggtgattggaggagacccagcatggcgtat

SEQ ID NO: 374853 - DNA, 140 bp, Artificial Sequence
  Synthetic
aggccctggctgctgatatgagctactaccacacagtcacacttaattatgtggctgacaattttgggaccaatatgactaactttctgtttcaagtggatcatccaacttatgtgcaacgaccttttgggacagcggtg

SEQ ID NO: 374854 - DNA, 140 bp, Artificial Sequence
  Synthetic
caccgctgtcccaaaaggtcgttgcacataagttggatgatccacttgaaacagaaagttagtcatattggtcccaaaattgtcagccacataattaagtgtgactgtgtggtagtagctcatatcagcagccagggcct

SEQ ID NO: 374855 - DNA, 140 bp, Artificial Sequence
  Synthetic
atacgccatgctgggtctcctatactaatgggcgtcgcagcaacaccacaggaacactaatttggaaagtaaatcctactgttgacaccggcgtaggtgaatgggccttctgggaaaatacgtacttgggagtcggccat

SEQ ID NO: 374856 - DNA, 140 bp, Artificial Sequence
  Synthetic
atggccgactcccaagtacgtattttcccagaaggcccattcacctacgccggtgtcaacagtaggatttactttccaaattagtgttcctgtggtgttgctgcgacgcccattagtataggagacccagcatggcgtat

SEQ ID NO: 374857 - DNA, 140 bp, Artificial Sequence
  Synthetic
aggccctggctgctgatatgaaatcctactgttgacaccggcgtaggtgaatgggccttctgggaaaataaaaaaacttcacaaaaaccctttcaagtgaagagctgtctgtcatacttggaccttttgggacagcggtg

SEQ ID NO: 374858 - DNA, 140 bp, Artificial Sequence
  Synthetic
caccgctgtcccaaaaggtccaagtatgacagacagctcttcacttgaaagggtttttgtgaagtttttttattttcccagaaggcccattcacctacgccggtgtcaacagtaggatttcatatcagcagccagggcct

SEQ ID NO: 374859 - DNA, 140 bp, Artificial Sequence
  Synthetic
atacgccatgctgggtctccaccagcttcgccaacaaccaaacctccaagaaccacgaagacttggttccaaaggatcccgcttcagtggttcaagtgcgagacctccagagggaaaacacgtacttgggagtcggccat

SEQ ID NO: 374860 - DNA, 140 bp, Artificial Sequence
  Synthetic
atggccgactcccaagtacgtgttttccctctggaggtctcgcacttgaaccactgaagcgggatcctttggaaccaagtcttcgtggttcttggaggtttggttgttggcgaagctggtggagacccagcatggcgtat

SEQ ID NO: 374861 - DNA, 140 bp, Artificial Sequence
  Synthetic
aggccctggctgctgatatgaaaggatcccgcttcagtggttcaagtgcgagacctccagagggaaaacacagtgccgacctcacccttgaacacagtccccacaactctgatccccgacgaccttttgggacagcggtg

SEQ ID NO: 374862 - DNA, 140 bp, Artificial Sequence
  Synthetic
caccgctgtcccaaaaggtcgtcggggatcagagttgtggggactgtgttcaagggtgaggtcggcactgtgttttccctctggaggtctcgcacttgaaccactgaagcgggatcctttcatatcagcagccagggcct

SEQ ID NO: 374863 - DNA, 140 bp, Artificial Sequence
  Synthetic
atacgccatgctgggtctccaaaccatcaagagaggaacaacaccgcacaccccgaaactctcgccaacaatcctccagacaacacaaccccgtcgacaccacctcaagacggtgagcggcgtacttgggagtcggccat

SEQ ID NO: 374864 - DNA, 140 bp, Artificial Sequence
  Synthetic
atggccgactcccaagtacgccgctcaccgtcttgaggtggtgtcgacggggttgtgttgtctggaggattgttggcgagagtttcggggtgtgcggtgttgttcctctcttgatggtttggagacccagcatggcgtat

SEQ ID NO: 374865 - DNA, 140 bp, Artificial Sequence
  Synthetic
aggccctggctgctgatatgatcctccagacaacacaaccccgtcgacaccacctcaagacggtgagcggacaagttcccacacaacaccctccccccgcccagtcccaaccagcacaatgaccttttgggacagcggtg

SEQ ID NO: 374866 - DNA, 140 bp, Artificial Sequence
  Synthetic
caccgctgtcccaaaaggtcattgtgctggttgggactgggcggggggagggtgttgtgtgggaacttgtccgctcaccgtcttgaggtggtgtcgacggggttgtgttgtctggaggatcatatcagcagccagggcct

SEQ ID NO: 374867 - DNA, 140 bp, Artificial Sequence
  Synthetic
atacgccatgctgggtctccatgatactgacagtaatcgacccaacccaattgacatcagcgagtctacagagccaggactactcaccaacaccataagaggggttgcaaatttgctgaccgtacttgggagtcggccat

SEQ ID NO: 374868 - DNA, 140 bp, Artificial Sequence
  Synthetic
atggccgactcccaagtacggtcagcaaatttgcaacccctcttatggtgttggtgagtagtcctggctctgtagactcgctgatgtcaattgggttgggtcgattactgtcagtatcatggagacccagcatggcgtat

SEQ ID NO: 374869 - DNA, 140 bp, Artificial Sequence
  Synthetic
atacgccatgctgggtctccaggttcaagaagaacccggagggaaatcaccttgagaacacaagccaaatgtaatccgaacctacactattggacaacccaagatgaaggggctgccattcgtacttgggagtcggccat

SEQ ID NO: 374870 - DNA, 140 bp, Artificial Sequence
  Synthetic
atggccgactcccaagtacgaatggcagccccttcatcttgggttgtccaatagtgtaggttcggattacatttggcttgtgttctcaaggtgatttccctccgggttcttcttgaacctggagacccagcatggcgtat

SEQ ID NO: 374871 - DNA, 140 bp, Artificial Sequence
  Synthetic
atacgccatgctgggtctccggaaggaataatgcacaatcaaaatgggctaatttgcgggttgaggcagctagcaaatgagacgactcaagccctacagttattcttgcgtgctaccacgcgtacttgggagtcggccat

SEQ ID NO: 374872 - DNA, 140 bp, Artificial Sequence
  Synthetic
atggccgactcccaagtacgcgtggtagcacgcaagaataactgtagggcttgagtcgtctcatttgctagctgcctcaacccgcaaattagcccattttgattgtgcattattccttccggagacccagcatggcgtat

SEQ ID NO: 374873 - DNA, 140 bp, Artificial Sequence
  Synthetic
aggccctggctgctgatatgtagcaaatgagacgactcaagccctacagttattcttgcgtgctaccacggaattgcgcactttctccatattgaatcgaaaagccatcgactttttactgaccttttgggacagcggtg

SEQ ID NO: 374874 - DNA, 140 bp, Artificial Sequence
  Synthetic
caccgctgtcccaaaaggtcagtaaaaagtcgatggcttttcgattcaatatggagaaagtgcgcaattccgtggtagcacgcaagaataactgtagggcttgagtcgtctcatttgctacatatcagcagccagggcct

SEQ ID NO: 374875 - DNA, 140 bp, Artificial Sequence
  Synthetic
atacgccatgctgggtctccagccccatgattggactaagaacattactgacaaaatagatcaaatcattcatgatttcattgataaacctctaccagatcaaacagataatgacaattgcgtacttgggagtcggccat

SEQ ID NO: 374876 - DNA, 140 bp, Artificial Sequence
  Synthetic
atggccgactcccaagtacgcaattgtcattatctgtttgatctggtagaggtttatcaatgaaatcatgaatgatttgatctattttgtcagtaatgttcttagtccaatcatggggctggagacccagcatggcgtat

SEQ ID NO: 374877 - DNA, 140 bp, Artificial Sequence
  Synthetic
atacgccatgctgggtctcctaataatcgcagttatagcactgctgtgtatttgcaaatttctactctaatctagtccgactctgtaccagcataatggcctctaaaataagcttttgctcgtacttgggagtcggccat

SEQ ID NO: 374878 - DNA, 140 bp, Artificial Sequence
  Synthetic
atggccgactcccaagtacgagcaaaagcttattttagaggccattatgctggtacagagtcggactagattagagtagaaatttgcaaatacacagcagtgctataactgcgattattaggagacccagcatggcgtat

SEQ ID NO: 374879 - DNA, 140 bp, Artificial Sequence
  Synthetic
atacgccatgctgggtctccaagaagatccctctaataatcctaattaccttcaaaaatctagaactttattaattctcagggtatttagaacagccagatgacttgactaagtttgtaccgtacttgggagtcggccat

SEQ ID NO: 374880 - DNA, 140 bp, Artificial Sequence
  Synthetic
atggccgactcccaagtacggtacaaacttagtcaagtcatctggctgttctaaataccctgagaattaataaagttctagatttttgaaggtaattaggattattagagggatcttcttggagacccagcatggcgtat

SEQ ID NO: 374881 - DNA, 140 bp, Artificial Sequence
  Synthetic
aggccctggctgctgatatgttaattctcagggtatttagaacagccagatgacttgactaagtttgtactgtaataaaaagatacttgatgaagattaagaaaaagacagtcttgtgatgaccttttgggacagcggtg

SEQ ID NO: 374882 - DNA, 140 bp, Artificial Sequence
  Synthetic
caccgctgtcccaaaaggtcatcacaagactgtctttttcttaatcttcatcaagtatctttttattacagtacaaacttagtcaagtcatctggctgttctaaataccctgagaattaacatatcagcagccagggcct

SEQ ID NO: 374883 - DNA, 140 bp, Artificial Sequence
  Synthetic
atacgccatgctgggtctccgcctacctccttgacacatagcaaaccttactcatgttgataattgtttgcctgctatttacatatttactaacttacaaaattatcttggggatttctccgtacttgggagtcggccat

SEQ ID NO: 374884 - DNA, 140 bp, Artificial Sequence
  Synthetic
atggccgactcccaagtacggagaaatccccaagataattttgtaagttagtaaatatgtaaatagcaggcaaacaattatcaacatgagtaaggtttgctatgtgtcaaggaggtaggcggagacccagcatggcgtat

SEQ ID NO: 374885 - DNA, 140 bp, Artificial Sequence
  Synthetic
aggccctggctgctgatatgcctgctatttacatatttactaacttacaaaattatcttggggatttctctgaacatataatcaggattggcatttaaaacacaagttagtcctaatggagaccttttgggacagcggtg

SEQ ID NO: 374886 - DNA, 140 bp, Artificial Sequence
  Synthetic
caccgctgtcccaaaaggtctccattaggactaacttgtgttttaaatgccaatcctgattatatgttcagagaaatccccaagataattttgtaagttagtaaatatgtaaatagcaggcatatcagcagccagggcct

SEQ ID NO: 374887 - DNA, 140 bp, Artificial Sequence
  Synthetic
atacgccatgctgggtctccatgggccgagtcatcaagtaagaacaagatcatcctccagagacagccaccgcagcgaatatcatacacctaggagctcttcccaagttcgagtcccgaccgtacttgggagtcggccat

SEQ ID NO: 374888 - DNA, 140 bp, Artificial Sequence
  Synthetic
atggccgactcccaagtacggtcgggactcgaacttgggaagagctcctaggtgtatgatattcgctgcggtggctgtctctggaggatgatcttgttcttacttgatgactcggcccatggagacccagcatggcgtat

SEQ ID NO: 374889 - DNA, 140 bp, Artificial Sequence
  Synthetic
aggccctggctgctgatatgcgcagcgaatatcatacacctaggagctcttcccaagttcgagtcccgactgtgtttcatcggaagcgtactgattttttgacagttccaccagcaccaagaccttttgggacagcggtg

SEQ ID NO: 374890 - DNA, 140 bp, Artificial Sequence
  Synthetic
caccgctgtcccaaaaggtcttggtgctggtggaactgtcaaaaaatcagtacgcttccgatgaaacacagtcgggactcgaacttgggaagagctcctaggtgtatgatattcgctgcgcatatcagcagccagggcct

SEQ ID NO: 374891 - DNA, 140 bp, Artificial Sequence
  Synthetic
atacgccatgctgggtctcctgtaaaaaagaccatcaactagaaagtttaacagatagggagctgcttttgctgattgcacggaaaacctgcggctcccttgaacaacaattgaacatcacgtacttgggagtcggccat

SEQ ID NO: 374892 - DNA, 140 bp, Artificial Sequence
  Synthetic
atggccgactcccaagtacgtgatgttcaattgttgttcaagggagccgcaggttttccgtgcaatcagcaaaagcagctccctatctgttaaactttctagttgatggtcttttttacaggagacccagcatggcgtat

SEQ ID NO: 374893 - DNA, 140 bp, Artificial Sequence
  Synthetic
aggccctggctgctgatatggctgattgcacggaaaacctgcggctcccttgaacaacaattgaacatcactgctcctaaagatacacgattagcaaatccaattgcagatgatttccaagaccttttgggacagcggtg

SEQ ID NO: 374894 - DNA, 140 bp, Artificial Sequence
  Synthetic
caccgctgtcccaaaaggtcttggaaatcatctgcaattggatttgctaatcgtgtatctttaggagcagtgatgttcaattgttgttcaagggagccgcaggttttccgtgcaatcagccatatcagcagccagggcct

SEQ ID NO: 374895 - DNA, 140 bp, Artificial Sequence
  Synthetic
atacgccatgctgggtctccgtattggtcaaaacaagatatcaagggcattgatgattcaagactaagagcattactaaccctttgtgccgtcatgacgaggaaattctcaaaatcccagcgtacttgggagtcggccat

SEQ ID NO: 374896 - DNA, 140 bp, Artificial Sequence
  Synthetic
atggccgactcccaagtacgctgggattttgagaatttcctcgtcatgacggcacaaagggttagtaatgctcttagtcttgaatcatcaatgcccttgatatcttgttttgaccaatacggagacccagcatggcgtat

SEQ ID NO: 374897 - DNA, 140 bp, Artificial Sequence
  Synthetic
aggccctggctgctgatatgcattactaaccctttgtgccgtcatgacgaggaaattctcaaaatcccagctgagtctattgtgtgagagtcatctacgacgagaagggctaggacaggagaccttttgggacagcggtg

SEQ ID NO: 374898 - DNA, 140 bp, Artificial Sequence
  Synthetic
caccgctgtcccaaaaggtctcctgtcctagcccttctcgtcgtagatgactctcacacaatagactcagctgggattttgagaatttcctcgtcatgacggcacaaagggttagtaatgcatatcagcagccagggcct

SEQ ID NO: 374899 - DNA, 140 bp, Artificial Sequence
  Synthetic
atacgccatgctgggtctccgcggaaattttgaggcagccctatggcaacaatgggaccgacagtccttgatcatgtttataacagcatttcttaatattgctttacaattaccctgtgacgtacttgggagtcggccat

SEQ ID NO: 374900 - DNA, 140 bp, Artificial Sequence
  Synthetic
atggccgactcccaagtacgtcacagggtaattgtaaagcaatattaagaaatgctgttataaacatgatcaaggactgtcggtcccattgttgccatagggctgcctcaaaatttccgcggagacccagcatggcgtat

SEQ ID NO: 374901 - DNA, 140 bp, Artificial Sequence
  Synthetic
atacgccatgctgggtctccaagttcatctgttgttatttcaggattaaggctgctagtgcctcaatcagaagataccgagacctcaacctacaccgagacacgtgcatggtcagaggaacgtacttgggagtcggccat

SEQ ID NO: 374902 - DNA, 140 bp, Artificial Sequence
  Synthetic
atggccgactcccaagtacgttcctctgaccatgcacgtgtctcggtgtaggttgaggtctcggtatcttctgattgaggcactagcagccttaatcctgaaataacaacagatgaacttggagacccagcatggcgtat

SEQ ID NO: 374903 - DNA, 140 bp, Artificial Sequence
  Synthetic
atacgccatgctgggtctccttcaacgcaggtaagaatcagtactaaaccacaagtgcaaaaattaacaaaacaccagcataagtgaaatcttgtctgtgattagcaagacgaatgatctcgtacttgggagtcggccat

SEQ ID NO: 374904 - DNA, 140 bp, Artificial Sequence
  Synthetic
atggccgactcccaagtacgagatcattcgtcttgctaatcacagacaagatttcacttatgctggtgttttgttaatttttgcacttgtggtttagtactgattcttacctgcgttgaaggagacccagcatggcgtat

SEQ ID NO: 374905 - DNA, 140 bp, Artificial Sequence
  Synthetic
aggccctggctgctgatatgaacaccagcataagtgaaatcttgtctgtgattagcaagacgaatgatcttcaatcctgttgcaattcgccagtgataattgtattcacattgtggccacgaccttttgggacagcggtg

SEQ ID NO: 374906 - DNA, 140 bp, Artificial Sequence
  Synthetic
caccgctgtcccaaaaggtcgtggccacaatgtgaatacaattatcactggcgaattgcaacaggattgaagatcattcgtcttgctaatcacagacaagatttcacttatgctggtgttcatatcagcagccagggcct

SEQ ID NO: 374907 - DNA, 140 bp, Artificial Sequence
  Synthetic
atacgccatgctgggtctcccaaacttacaggattagcaccacgacggctcaatactatacctattggtcacggctcgatgtgttaatcacttatattgtattcatttgaaattattcatcgtacttgggagtcggccat

SEQ ID NO: 374908 - DNA, 140 bp, Artificial Sequence
  Synthetic
atggccgactcccaagtacgatgaataatttcaaatgaatacaatataagtgattaacacatcgagccgtgaccaataggtatagtattgagccgtcgtggtgctaatcctgtaagtttgggagacccagcatggcgtat

SEQ ID NO: 374909 - DNA, 140 bp, Artificial Sequence
  Synthetic
atacgccatgctgggtctcctaggcaaatattttgattaagaaaaaataattggaaaaccagaaaatccctaggtatttaaattcctatctccggagatccgagataattaatcaagcaacgtacttgggagtcggccat

SEQ ID NO: 374910 - DNA, 140 bp, Artificial Sequence
  Synthetic
atggccgactcccaagtacgttgcttgattaattatctcggatctccggagataggaatttaaatacctagggattttctggttttccaattattttttcttaatcaaaatatttgcctaggagacccagcatggcgtat

SEQ ID NO: 374911 - DNA, 140 bp, Artificial Sequence
  Synthetic
atacgccatgctgggtctcctgaaggaacaatggtgaacaacaacatattgttgccccctttagattggtcagttccaaaaacaagtgatgaagattaatgcagatgtccaaggaacacacgtacttgggagtcggccat

SEQ ID NO: 374912 - DNA, 140 bp, Artificial Sequence
  Synthetic
atggccgactcccaagtacgtgtgttccttggacatctgcattaatcttcatcacttgtttttggaactgaccaatctaaagggggcaacaatatgttgttgttcaccattgttccttcaggagacccagcatggcgtat

SEQ ID NO: 374913 - DNA, 140 bp, Artificial Sequence
  Synthetic
aggccctggctgctgatatgcagttccaaaaacaagtgatgaagattaatgcagatgtccaaggaacacatatttgtgatttaaacgttccagttagactctgttcaaggatcttcatctgaccttttgggacagcggtg

SEQ ID NO: 374914 - DNA, 140 bp, Artificial Sequence
  Synthetic
caccgctgtcccaaaaggtcagatgaagatccttgaacagagtctaactggaacgtttaaatcacaaatatgtgttccttggacatctgcattaatcttcatcacttgtttttggaactgcatatcagcagccagggcct

SEQ ID NO: 374915 - DNA, 140 bp, Artificial Sequence
  Synthetic
atacgccatgctgggtctccgttatcaggattaaattctctcaaataactgaaactactagcatcactctcaatttcattacttacgacaatcattatcttaataatatttccctaaattcgtacttgggagtcggccat

SEQ ID NO: 374916 - DNA, 140 bp, Artificial Sequence
  Synthetic
atggccgactcccaagtacgaatttagggaaatattattaagataatgattgtcgtaagtaatgaaattgagagtgatgctagtagtttcagttatttgagagaatttaatcctgataacggagacccagcatggcgtat

SEQ ID NO: 374917 - DNA, 140 bp, Artificial Sequence
  Synthetic
aggccctggctgctgatatgcaatttcattacttacgacaatcattatcttaataatatttccctaaattactgacttaatcagcttgtaatcagataatatcgaaaccaatttatcatagaccttttgggacagcggtg

SEQ ID NO: 374918 - DNA, 140 bp, Artificial Sequence
  Synthetic
caccgctgtcccaaaaggtctatgataaattggtttcgatattatctgattacaagctgattaagtcagtaatttagggaaatattattaagataatgattgtcgtaagtaatgaaattgcatatcagcagccagggcct

SEQ ID NO: 374919 - DNA, 140 bp, Artificial Sequence
  Synthetic
atacgccatgctgggtctcctcttagaataaaagaccgactagaatatccttaaggctgtctgacgtgccacacagctagggttagcctgacatctggaacaagatcgatactaatatagcgtacttgggagtcggccat

SEQ ID NO: 374920 - DNA, 140 bp, Artificial Sequence
  Synthetic
atggccgactcccaagtacgctatattagtatcgatcttgttccagatgtcaggctaaccctagctgtgtggcacgtcagacagccttaaggatattctagtcggtcttttattctaagaggagacccagcatggcgtat

SEQ ID NO: 374921 - DNA, 140 bp, Artificial Sequence
  Synthetic
atacgccatgctgggtctccggatttgtttcatactaactctctgcaaacacaatggctaaggcaacaggtaggtacaacttggtttcacctaaaaaggacctcgagagggggctagtttcgtacttgggagtcggccat

SEQ ID NO: 374922 - DNA, 140 bp, Artificial Sequence
  Synthetic
atggccgactcccaagtacgaaactagccccctctcgaggtcctttttaggtgaaaccaagttgtacctacctgttgccttagccattgtgtttgcagagagttagtatgaaacaaatccggagacccagcatggcgtat

SEQ ID NO: 374923 - DNA, 140 bp, Artificial Sequence
  Synthetic
atacgccatgctgggtctccgtgacttgggttgggattgaatttgatatcgcccagaaagggatggctctactgcatcggttaaaaactgctgacttcgctcctgcatggtcgatgacaacgtacttgggagtcggccat

SEQ ID NO: 374924 - DNA, 140 bp, Artificial Sequence
  Synthetic
atggccgactcccaagtacgttgtcatcgaccatgcaggagcgaagtcagcagtttttaaccgatgcagtagagccatccctttctgggcgatatcaaattcaatcccaacccaagtcacggagacccagcatggcgtat

SEQ ID NO: 374925 - DNA, 140 bp, Artificial Sequence
  Synthetic
atacgccatgctgggtctcccccctctgggcattacgagtgattctggcagctggtattcaagaccagttaattgaccaatccttggtagaaccgttggccggagccctgagtttagtctcgtacttgggagtcggccat

SEQ ID NO: 374926 - DNA, 140 bp, Artificial Sequence
  Synthetic
atggccgactcccaagtacgagactaaactcagggctccggccaacggttctaccaaggattggtcaattaactggtcttgaataccagctgccagaatcactcgtaatgcccagaggggggagacccagcatggcgtat

SEQ ID NO: 374927 - DNA, 140 bp, Artificial Sequence
  Synthetic
atacgccatgctgggtctcctatcctgaaattcatcagtcaattggacgcactacatgtcgtgaactacaatggactcttgagcagtatcgaaattggcactagaaatcataccattatccgtacttgggagtcggccat

SEQ ID NO: 374928 - DNA, 140 bp, Artificial Sequence
  Synthetic
atggccgactcccaagtacggataatggtatgatttctagtgccaatttcgatactgctcaagagtccattgtagttcacgacatgtagtgcgtccaattgactgatgaatttcaggataggagacccagcatggcgtat

SEQ ID NO: 374929 - DNA, 140 bp, Artificial Sequence
  Synthetic
aggccctggctgctgatatgatggactcttgagcagtatcgaaattggcactagaaatcataccattatcatcacaagaaccaacatgggtttcctggtagaattacaggagcctgataagaccttttgggacagcggtg

SEQ ID NO: 374930 - DNA, 140 bp, Artificial Sequence
  Synthetic
caccgctgtcccaaaaggtcttatcaggctcctgtaattctaccaggaaacccatgttggttcttgtgatgataatggtatgatttctagtgccaatttcgatactgctcaagagtccatcatatcagcagccagggcct

SEQ ID NO: 374931 - DNA, 140 bp, Artificial Sequence
  Synthetic
atacgccatgctgggtctccatgaatcaaccttcaaggctctaatcaaaaaacccgcaactaagatgcaggccttgattctggaatttaacagctccctggcaatatagtccaacgataccgtacttgggagtcggccat

SEQ ID NO: 374932 - DNA, 140 bp, Artificial Sequence
  Synthetic
atggccgactcccaagtacggtatcgttggactatattgccagggagctgttaaattccagaatcaaggcctgcatcttagttgcgggttttttgattagagccttgaaggttgattcatggagacccagcatggcgtat

SEQ ID NO: 374933 - DNA, 140 bp, Artificial Sequence
  Synthetic
atacgccatgctgggtctcctacaattataatcaagatccctaatcccttttgacgaagtgggctaatttttgctcattctaataataaatcataacctgaataaaagacaccacaatatcgtacttgggagtcggccat

SEQ ID NO: 374934 - DNA, 140 bp, Artificial Sequence
  Synthetic
atggccgactcccaagtacgatattgtggtgtcttttattcaggttatgatttattattagaatgagcaaaaattagcccacttcgtcaaaagggattagggatcttgattataattgtaggagacccagcatggcgtat

SEQ ID NO: 374935 - DNA, 140 bp, Artificial Sequence
  Synthetic
aggccctggctgctgatatgttgctcattctaataataaatcataacctgaataaaagacaccacaatattataacccaataacacctagagaattgctaaattgctaaagattatatacgaccttttgggacagcggtg

SEQ ID NO: 374936 - DNA, 140 bp, Artificial Sequence
  Synthetic
caccgctgtcccaaaaggtcgtatataatctttagcaatttagcaattctctaggtgttattgggttataatattgtggtgtcttttattcaggttatgatttattattagaatgagcaacatatcagcagccagggcct

SEQ ID NO: 374937 - DNA, 140 bp, Artificial Sequence
  Synthetic
atacgccatgctgggtctccctagatagctctggctaattaacctgagttgtggattactccttttaaaagtctatcaatttaagcttatcactaatattaaggaggactttttaaataacgtacttgggagtcggccat

SEQ ID NO: 374938 - DNA, 140 bp, Artificial Sequence
  Synthetic
atggccgactcccaagtacgttatttaaaaagtcctccttaatattagtgataagcttaaattgatagacttttaaaaggagtaatccacaactcaggttaattagccagagctatctagggagacccagcatggcgtat

SEQ ID NO: 374939 - DNA, 140 bp, Artificial Sequence
  Synthetic
aggccctggctgctgatatggtctatcaatttaagcttatcactaatattaaggaggactttttaaataagagcaagtgttatgtagtcttactaagaatgatttgaggaagattaagaagaccttttgggacagcggtg

SEQ ID NO: 374940 - DNA, 140 bp, Artificial Sequence
  Synthetic
caccgctgtcccaaaaggtcttcttaatcttcctcaaatcattcttagtaagactacataacacttgctcttatttaaaaagtcctccttaatattagtgataagcttaaattgatagaccatatcagcagccagggcct

SEQ ID NO: 374941 - DNA, 140 bp, Artificial Sequence
  Synthetic
atacgccatgctgggtctcctcctctaattttaatatggcaactcaacatacacaatatccagatgcaagattatcttcacccattgtcttagatcaatgtgatcttgtcactcgtgcttcgtacttgggagtcggccat

SEQ ID NO: 374942 - DNA, 140 bp, Artificial Sequence
  Synthetic
atggccgactcccaagtacgaagcacgagtgacaagatcacattgatctaagacaatgggtgaagataatcttgcatctggatattgtgtatgttgagttgccatattaaaattagaggaggagacccagcatggcgtat

SEQ ID NO: 374943 - DNA, 140 bp, Artificial Sequence
  Synthetic
atacgccatgctgggtctccgcggtctgtattcttcatattcattaaatcctcagttgaaaaattgtagactaccaaaacatatttaccgcctcaaatttgatgctacggttacaaaattcgtacttgggagtcggccat

SEQ ID NO: 374944 - DNA, 140 bp, Artificial Sequence
  Synthetic
atggccgactcccaagtacgaattttgtaaccgtagcatcaaatttgaggcggtaaatatgttttggtagtctacaatttttcaactgaggatttaatgaatatgaagaatacagaccgcggagacccagcatggcgtat

SEQ ID NO: 374945 - DNA, 140 bp, Artificial Sequence
  Synthetic
atacgccatgctgggtctcctttaagcgatgttccaatagttacattgccaatagattacttgacccctttacttttacgaactttatccggggagggcttatgccctgtcgaaccaaagcgtacttgggagtcggccat

SEQ ID NO: 374946 - DNA, 140 bp, Artificial Sequence
  Synthetic
atggccgactcccaagtacgctttggttcgacagggcataagccctccccggataaagttcgtaaaagtaaaggggtcaagtaatctattggcaatgtaactattggaacatcgcttaaaggagacccagcatggcgtat

SEQ ID NO: 374947 - DNA, 140 bp, Artificial Sequence
  Synthetic
aggccctggctgctgatatgtacttttacgaactttatccggggagggcttatgccctgtcgaaccaaagtgcagccaattcttagatgaaatagtaagttatgttttgcaggatgcacggaccttttgggacagcggtg

SEQ ID NO: 374948 - DNA, 140 bp, Artificial Sequence
  Synthetic
caccgctgtcccaaaaggtccgtgcatcctgcaaaacataacttactatttcatctaagaattggctgcactttggttcgacagggcataagccctccccggataaagttcgtaaaagtacatatcagcagccagggcct

SEQ ID NO: 374949 - DNA, 140 bp, Artificial Sequence
  Synthetic
atacgccatgctgggtctccggaaaaattttgagccaaagattaaggctttgatttatgataatgaatttctgcaacaattgttttattggtacgatttagcaatcctaacgcgtagaggcgtacttgggagtcggccat

SEQ ID NO: 374950 - DNA, 140 bp, Artificial Sequence
  Synthetic
atggccgactcccaagtacgcctctacgcgttaggattgctaaatcgtaccaataaaacaattgttgcagaaattcattatcataaatcaaagccttaatctttggctcaaaatttttccggagacccagcatggcgtat

SEQ ID NO: 374951 - DNA, 140 bp, Artificial Sequence
  Synthetic
aggccctggctgctgatatgctgcaacaattgttttattggtacgatttagcaatcctaacgcgtagagggcgcctgaatcgagggaataaccgttcaacatggtttgcaaatgacgattgaccttttgggacagcggtg

SEQ ID NO: 374952 - DNA, 140 bp, Artificial Sequence
  Synthetic
caccgctgtcccaaaaggtcaatcgtcatttgcaaaccatgttgaacggttattccctcgattcaggcgccctctacgcgttaggattgctaaatcgtaccaataaaacaattgttgcagcatatcagcagccagggcct

SEQ ID NO: 374953 - DNA, 140 bp, Artificial Sequence
  Synthetic
atacgccatgctgggtctcctcattgttgtcactcaacacagaggggattcctcatgcagctaaggactggtatcacgcatcaatcttcaaagaagcggttcaaggtcacacacatatcgcgtacttgggagtcggccat

SEQ ID NO: 374954 - DNA, 140 bp, Artificial Sequence
  Synthetic
atggccgactcccaagtacgcgatatgtgtgtgaccttgaaccgcttctttgaagattgatgcgtgataccagtccttagctgcatgaggaatcccctctgtgttgagtgacaacaatgaggagacccagcatggcgtat

SEQ ID NO: 374955 - DNA, 140 bp, Artificial Sequence
  Synthetic
atacgccatgctgggtctcctgtcgtttcaataccacactcattgcagcattggcaaatttagaagattctatctgttctgactatccacaacctgaaacaatctctaatctgtataaagcgtacttgggagtcggccat

SEQ ID NO: 374956 - DNA, 140 bp, Artificial Sequence
  Synthetic
atggccgactcccaagtacgctttatacagattagagattgtttcaggttgtggatagtcagaacagatagaatcttctaaatttgccaatgctgcaatgagtgtggtattgaaacgacaggagacccagcatggcgtat

SEQ ID NO: 374957 - DNA, 140 bp, Artificial Sequence
  Synthetic
atacgccatgctgggtctccaagtttttagaaccactatgtttagctaagatccaattgtgctcaaattacactgagaggaaagggagattccttactcaaatgcatttggccgttaatccgtacttgggagtcggccat

SEQ ID NO: 374958 - DNA, 140 bp, Artificial Sequence
  Synthetic
atggccgactcccaagtacggattaacggccaaatgcatttgagtaaggaatctccctttcctctcagtgtaatttgagcacaattggatcttagctaaacatagtggttctaaaaacttggagacccagcatggcgtat

SEQ ID NO: 374959 - DNA, 140 bp, Artificial Sequence
  Synthetic
atacgccatgctgggtctcctggaagatgagggaatttcaccgaatcttagtaaatttaaagtcaacaccacaacaactctgtgaattgttttcagtgcaaaagcattgggggcatcctgcgtacttgggagtcggccat

SEQ ID NO: 374960 - DNA, 140 bp, Artificial Sequence
  Synthetic
atggccgactcccaagtacgcaggatgcccccaatgcttttgcactgaaaacaattcacagagttgttgtggtgttgactttaaatttactaagattcggtgaaattccctcatcttccaggagacccagcatggcgtat

SEQ ID NO: 374961 - DNA, 140 bp, Artificial Sequence
  Synthetic
aggccctggctgctgatatgacaacaactctgtgaattgttttcagtgcaaaagcattgggggcatcctgtgctacatagtgagaaggctattcagaaagtaaagaaacatgcaaccatagaccttttgggacagcggtg

SEQ ID NO: 374962 - DNA, 140 bp, Artificial Sequence
  Synthetic
caccgctgtcccaaaaggtctatggttgcatgtttctttactttctgaatagccttctcactatgtagcacaggatgcccccaatgcttttgcactgaaaacaattcacagagttgttgtcatatcagcagccagggcct

SEQ ID NO: 374963 - DNA, 140 bp, Artificial Sequence
  Synthetic
atacgccatgctgggtctccgtacagcattgccaaacattattttgatagccaagggtcatggtatagtgtaatctcagataaacatctaacaccaggtttacattcttacattaagaggcgtacttgggagtcggccat

SEQ ID NO: 374964 - DNA, 140 bp, Artificial Sequence
  Synthetic
atggccgactcccaagtacgcctcttaatgtaagaatgtaaacctggtgttagatgtttatctgagattacactataccatgacccttggctatcaaaataatgtttggcaatgctgtacggagacccagcatggcgtat

SEQ ID NO: 374965 - DNA, 140 bp, Artificial Sequence
  Synthetic
aggccctggctgctgatatgtaatctcagataaacatctaacaccaggtttacattcttacattaagaggaaccaatttccgccactgcctatgattaaagacttattgtgggaattctagaccttttgggacagcggtg

SEQ ID NO: 374966 - DNA, 140 bp, Artificial Sequence
  Synthetic
caccgctgtcccaaaaggtctagaattcccacaataagtctttaatcataggcagtggcggaaattggttcctcttaatgtaagaatgtaaacctggtgttagatgtttatctgagattacatatcagcagccagggcct

SEQ ID NO: 374967 - DNA, 140 bp, Artificial Sequence
  Synthetic
atacgccatgctgggtctccgtattttcattaaggatcgcgctaccgcagtggaaaaaacatgttgggatgcagttttcgaacctaatgttcttggatatagtcctccaaacaagttctccgtacttgggagtcggccat

SEQ ID NO: 374968 - DNA, 140 bp, Artificial Sequence
  Synthetic
atggccgactcccaagtacggagaacttgtttggaggactatatccaagaacattaggttcgaaaactgcatcccaacatgttttttccactgcggtagcgcgatccttaatgaaaatacggagacccagcatggcgtat

SEQ ID NO: 374969 - DNA, 140 bp, Artificial Sequence
  Synthetic
aggccctggctgctgatatggcagttttcgaacctaatgttcttggatatagtcctccaaacaagttctcaactaagagggttcctgaacagtttcttgaacaagaaaatttctcgattggaccttttgggacagcggtg

SEQ ID NO: 374970 - DNA, 140 bp, Artificial Sequence
  Synthetic
caccgctgtcccaaaaggtccaatcgagaaattttcttgttcaagaaactgttcaggaaccctcttagttgagaacttgtttggaggactatatccaagaacattaggttcgaaaactgccatatcagcagccagggcct

SEQ ID NO: 374971 - DNA, 140 bp, Artificial Sequence
  Synthetic
atacgccatgctgggtctcccggaatttttctttctcacttaaggaaaaggaattaaatgtaggacgagcttttggtaagctaccttatcctacacgtaatgttcaaactttatgtgaagcgtacttgggagtcggccat

SEQ ID NO: 374972 - DNA, 140 bp, Artificial Sequence
  Synthetic
atggccgactcccaagtacgcttcacataaagtttgaacattacgtgtaggataaggtagcttaccaaaagctcgtcctacatttaattccttttccttaagtgagaaagaaaaattccgggagacccagcatggcgtat

SEQ ID NO: 374973 - DNA, 140 bp, Artificial Sequence
  Synthetic
aggccctggctgctgatatgttttggtaagctaccttatcctacacgtaatgttcaaactttatgtgaagccttattggcagatggattagctaaagcctttcctagtaacatgatggttgaccttttgggacagcggtg

SEQ ID NO: 374974 - DNA, 140 bp, Artificial Sequence
  Synthetic
caccgctgtcccaaaaggtcaaccatcatgttactaggaaaggctttagctaatccatctgccaataaggcttcacataaagtttgaacattacgtgtaggataaggtagcttaccaaaacatatcagcagccagggcct

SEQ ID NO: 374975 - DNA, 140 bp, Artificial Sequence
  Synthetic
atacgccatgctgggtctccccacacaagtgacgatttcggtgagaatgccactgttagaggcagcagttttgttaccgacctagaaaaatacaacttggcatttagatatgagtttacacgtacttgggagtcggccat

SEQ ID NO: 374976 - DNA, 140 bp, Artificial Sequence
  Synthetic
atggccgactcccaagtacgtgtaaactcatatctaaatgccaagttgtatttttctaggtcggtaacaaaactgctgcctctaacagtggcattctcaccgaaatcgtcacttgtgtggggagacccagcatggcgtat

SEQ ID NO: 374977 - DNA, 140 bp, Artificial Sequence
  Synthetic
atacgccatgctgggtctcccaattggatgcattatacgataccgcaatgttatatacatgtaagtgattattataatccccctcatggagtttcgctagaaaatcgggaagatcctccgcgtacttgggagtcggccat

SEQ ID NO: 374978 - DNA, 140 bp, Artificial Sequence
  Synthetic
atggccgactcccaagtacgcggaggatcttcccgattttctagcgaaactccatgagggggattataataatcacttacatgtatataacattgcggtatcgtataatgcatccaattgggagacccagcatggcgtat

SEQ ID NO: 374979 - DNA, 140 bp, Artificial Sequence
  Synthetic
atacgccatgctgggtctccgaaggccctagctcttaccggggtcatcttgggggaattgagggactccaacagaaactctggaccagcatttcatgtgcgcaaatctcattagttgagacgtacttgggagtcggccat

SEQ ID NO: 374980 - DNA, 140 bp, Artificial Sequence
  Synthetic
atggccgactcccaagtacgtctcaactaatgagatttgcgcacatgaaatgctggtccagagtttctgttggagtccctcaattcccccaagatgaccccggtaagagctagggccttcggagacccagcatggcgtat

SEQ ID NO: 374981 - DNA, 140 bp, Artificial Sequence
  Synthetic
atacgccatgctgggtctccatcacagttctttccgtattccctctagagacagattccaatgagcaagagcatagctccgaggacaatgctgctcgcgtagcagccagtttagccaaagcgtacttgggagtcggccat

SEQ ID NO: 374982 - DNA, 140 bp, Artificial Sequence
  Synthetic
atggccgactcccaagtacgctttggctaaactggctgctacgcgagcagcattgtcctcggagctatgctcttgctcattggaatctgtctctagagggaatacggaaagaactgtgatggagacccagcatggcgtat

SEQ ID NO: 374983 - DNA, 140 bp, Artificial Sequence
  Synthetic
aggccctggctgctgatatggcatagctccgaggacaatgctgctcgcgtagcagccagtttagccaaagtcacgagtgcctgtggcatcttcctaaaaccagatgagacttttgtgcatgaccttttgggacagcggtg

SEQ ID NO: 374984 - DNA, 140 bp, Artificial Sequence
  Synthetic
caccgctgtcccaaaaggtcatgcacaaaagtctcatctggttttaggaagatgccacaggcactcgtgactttggctaaactggctgctacgcgagcagcattgtcctcggagctatgccatatcagcagccagggcct

SEQ ID NO: 374985 - DNA, 140 bp, Artificial Sequence
  Synthetic
atacgccatgctgggtctccgccacaatcactcaagactgctaccaggattgctcccttgtcagatgcaatctttgatgaccttcagggaactctggctagtataggaacggcatttgagcgtacttgggagtcggccat

SEQ ID NO: 374986 - DNA, 140 bp, Artificial Sequence
  Synthetic
atggccgactcccaagtacgctcaaatgccgttcctatactagccagagttccctgaaggtcatcaaagattgcatctgacaagggagcaatcctggtagcagtcttgagtgattgtggcggagacccagcatggcgtat

SEQ ID NO: 374987 - DNA, 140 bp, Artificial Sequence
  Synthetic
aggccctggctgctgatatgtctttgatgaccttcagggaactctggctagtataggaacggcatttgagagatctatatccgagactagacatgtatacccttgccgggtggttgccgcgaccttttgggacagcggtg

SEQ ID NO: 374988 - DNA, 140 bp, Artificial Sequence
  Synthetic
caccgctgtcccaaaaggtcgcggcaaccacccggcaagggtatacatgtctagtctcggatatagatctctcaaatgccgttcctatactagccagagttccctgaaggtcatcaaagacatatcagcagccagggcct

SEQ ID NO: 374989 - DNA, 140 bp, Artificial Sequence
  Synthetic
atacgccatgctgggtctcctcaacaaaggaactgatctaggtcaactatcactaagcaaaccgttggatttcggaactatcactcttgctttagcggtacctcaagttctaggaggtttcgtacttgggagtcggccat

SEQ ID NO: 374990 - DNA, 140 bp, Artificial Sequence
  Synthetic
atggccgactcccaagtacgaaacctcctagaacttgaggtaccgctaaagcaagagtgatagttccgaaatccaacggtttgcttagtgatagttgacctagatcagttcctttgttgaggagacccagcatggcgtat

SEQ ID NO: 374991 - DNA, 140 bp, Artificial Sequence
  Synthetic
atacgccatgctgggtctcctgacctctggcctattccaacttaggacttacctgcaaatgatcaacatggacgacttatttctacctttaattgccaagaaccccgggaactgtagtgccgtacttgggagtcggccat

SEQ ID NO: 374992 - DNA, 140 bp, Artificial Sequence
  Synthetic
atggccgactcccaagtacggcactacagttcccggggttcttggcaattaaaggtagaaataagtcgtccatgttgatcatttgcaggtaagtcctaagttggaataggccagaggtcaggagacccagcatggcgtat

SEQ ID NO: 374993 - DNA, 140 bp, Artificial Sequence
  Synthetic
aggccctggctgctgatatggacgacttatttctacctttaattgccaagaaccccgggaactgtagtgcaattgactttgtactcaacccaagcggattgaatgtccctgggtcacaaggaccttttgggacagcggtg

SEQ ID NO: 374994 - DNA, 140 bp, Artificial Sequence
  Synthetic
caccgctgtcccaaaaggtccttgtgacccagggacattcaatccgcttgggttgagtacaaagtcaattgcactacagttcccggggttcttggcaattaaaggtagaaataagtcgtccatatcagcagccagggcct

SEQ ID NO: 374995 - DNA, 140 bp, Artificial Sequence
  Synthetic
atacgccatgctgggtctccaattgactttgtactcaacccaagcggattgaatgtccctgggtcacaagacctaacatcttttttacgtcagatagtgcgtagaacaatcacattgagtcgtacttgggagtcggccat

SEQ ID NO: 374996 - DNA, 140 bp, Artificial Sequence
  Synthetic
atggccgactcccaagtacgactcaatgtgattgttctacgcactatctgacgtaaaaaagatgttaggtcttgtgacccagggacattcaatccgcttgggttgagtacaaagtcaattggagacccagcatggcgtat

SEQ ID NO: 374997 - DNA, 140 bp, Artificial Sequence
  Synthetic
atacgccatgctgggtctccagatgagatggtatgtaaatggctactttcttcaacacctgtaatgagtcggtttgctgctgatatattctctcgtactccgagtgggaagcgcctgcagcgtacttgggagtcggccat

SEQ ID NO: 374998 - DNA, 140 bp, Artificial Sequence
  Synthetic
atggccgactcccaagtacgctgcaggcgcttcccactcggagtacgagagaatatatcagcagcaaaccgactcattacaggtgttgaagaaagtagccatttacataccatctcatctggagacccagcatggcgtat

SEQ ID NO: 374999 - DNA, 140 bp, Artificial Sequence
  Synthetic
aggccctggctgctgatatgggtttgctgctgatatattctctcgtactccgagtgggaagcgcctgcagatcctaggttatttagaagggactagaaccttgctagcctccaaagtcatgaccttttgggacagcggtg

SEQ ID NO: 375000 - DNA, 140 bp, Artificial Sequence
  Synthetic
caccgctgtcccaaaaggtcatgactttggaggctagcaaggttctagtcccttctaaataacctaggatctgcaggcgcttcccactcggagtacgagagaatatatcagcagcaaacccatatcagcagccagggcct

SEQ ID NO: 375001 - DNA, 140 bp, Artificial Sequence
  Synthetic
atacgccatgctgggtctcctgcagagatggagtttatggtttagctacctagaccactgtgatcaggttctagcagatgctttaataaaagtttcttgtacagttgatttggcgcaaatcgtacttgggagtcggccat

SEQ ID NO: 375002 - DNA, 140 bp, Artificial Sequence
  Synthetic
atggccgactcccaagtacgatttgcgccaaatcaactgtacaagaaacttttattaaagcatctgctagaacctgatcacagtggtctaggtagctaaaccataaactccatctctgcaggagacccagcatggcgtat

SEQ ID NO: 375003 - DNA, 140 bp, Artificial Sequence
  Synthetic
aggccctggctgctgatatgctagcagatgctttaataaaagtttcttgtacagttgatttggcgcaaattttacgtgaatatacctgggcacacatactagagggaagacagctcattggaccttttgggacagcggtg

SEQ ID NO: 375004 - DNA, 140 bp, Artificial Sequence
  Synthetic
caccgctgtcccaaaaggtccaatgagctgtcttccctctagtatgtgtgcccaggtatattcacgtaaaatttgcgccaaatcaactgtacaagaaacttttattaaagcatctgctagcatatcagcagccagggcct

SEQ ID NO: 375005 - DNA, 140 bp, Artificial Sequence
  Synthetic
atacgccatgctgggtctcctcgtacgaacaatgccctaaatgtgcaagatctagaaatccaaaaggagagccatttgtgtcaattgcaattaagaaacaagttgtgagtgcatggccgacgtacttgggagtcggccat

SEQ ID NO: 375006 - DNA, 140 bp, Artificial Sequence
  Synthetic
atggccgactcccaagtacgtcggccatgcactcacaacttgtttcttaattgcaattgacacaaatggctctccttttggatttctagatcttgcacatttagggcattgttcgtacgaggagacccagcatggcgtat

SEQ ID NO: 375007 - DNA, 140 bp, Artificial Sequence
  Synthetic
atacgccatgctgggtctcctctcgaacagaggacaagattgggcagccagcaatcaagcctaagtgtccctctgctgccttacgtgaagcaatagagttgacatctagactaacatgggcgtacttgggagtcggccat

SEQ ID NO: 375008 - DNA, 140 bp, Artificial Sequence
  Synthetic
atggccgactcccaagtacgcccatgttagtctagatgtcaactctattgcttcacgtaaggcagcagagggacacttaggcttgattgctggctgcccaatcttgtcctctgttcgagaggagacccagcatggcgtat

SEQ ID NO: 375009 - DNA, 140 bp, Artificial Sequence
  Synthetic
atacgccatgctgggtctccgcacgagtaaacctgagtgtgcaggagatccttcaaatgacgccttctcattattcagggaacatcgtacatcggtataatgaccaatacagccctcattcgtacttgggagtcggccat

SEQ ID NO: 375010 - DNA, 140 bp, Artificial Sequence
  Synthetic
atggccgactcccaagtacgaatgagggctgtattggtcattataccgatgtacgatgttccctgaataatgagaaggcgtcatttgaaggatctcctgcacactcaggtttactcgtgcggagacccagcatggcgtat

SEQ ID NO: 375011 - DNA, 140 bp, Artificial Sequence
  Synthetic
atacgccatgctgggtctccctttcatggcaaatagaatgagtaattccgcgacgagattggtggtgtcgacaaatactctcggggagttctcaggtggggggcaatcagcaagggacagcgtacttgggagtcggccat

SEQ ID NO: 375012 - DNA, 140 bp, Artificial Sequence
  Synthetic
atggccgactcccaagtacgctgtcccttgctgattgccccccacctgagaactccccgagagtatttgtcgacaccaccaatctcgtcgcggaattactcattctatttgccatgaaagggagacccagcatggcgtat

SEQ ID NO: 375013 - DNA, 140 bp, Artificial Sequence
  Synthetic
atacgccatgctgggtctcctacgatttcggaacaccgaaacatcctccattcagcataaccgtgcccatctccatctttcacagtgttgcacacgggaagtcccagctcaatacctaaccgtacttgggagtcggccat

SEQ ID NO: 375014 - DNA, 140 bp, Artificial Sequence
  Synthetic
atggccgactcccaagtacggttaggtattgagctgggacttcccgtgtgcaacactgtgaaagatggagatgggcacggttatgctgaatggaggatgtttcggtgttccgaaatcgtaggagacccagcatggcgtat

SEQ ID NO: 375015 - DNA, 140 bp, Artificial Sequence
  Synthetic
atacgccatgctgggtctcctaatttatgataacaatccattaaaaggtggacttaattgcaacctatcctttgataatccacttttcaagggccaaaggctcaatatcatagaggaggacgtacttgggagtcggccat

SEQ ID NO: 375016 - DNA, 140 bp, Artificial Sequence
  Synthetic
atggccgactcccaagtacgtcctcctctatgatattgagcctttggcccttgaaaagtggattatcaaaggataggttgcaattaagtccaccttttaatggattgttatcataaattaggagacccagcatggcgtat

SEQ ID NO: 375017 - DNA, 140 bp, Artificial Sequence
  Synthetic
atacgccatgctgggtctccttcagtccattatctcagacagcaataactcatccacagaccccattagcagtggagaaacacgatcattcacaactcactttctcacatatcctaaggtcgtacttgggagtcggccat

SEQ ID NO: 375018 - DNA, 140 bp, Artificial Sequence
  Synthetic
atggccgactcccaagtacgaccttaggatatgtgagaaagtgagttgtgaatgatcgtgtttctccactgctaatggggtctgtggatgagttattgctgtctgagataatggactgaaggagacccagcatggcgtat

SEQ ID NO: 375019 - DNA, 140 bp, Artificial Sequence
  Synthetic
aggccctggctgctgatatgagtggagaaacacgatcattcacaactcactttctcacatatcctaaggttgggctcctctatagtttcggcgccatcgtgagttattacttagggaatagaccttttgggacagcggtg

SEQ ID NO: 375020 - DNA, 140 bp, Artificial Sequence
  Synthetic
caccgctgtcccaaaaggtctattccctaagtaataactcacgatggcgccgaaactatagaggagcccaaccttaggatatgtgagaaagtgagttgtgaatgatcgtgtttctccactcatatcagcagccagggcct

SEQ ID NO: 375021 - DNA, 140 bp, Artificial Sequence
  Synthetic
atacgccatgctgggtctccacaactcaaatccataatttgccacatcgctcgttgaggatacttaagcccacttttaaacatgttagtgtgatatcaagactaatgagtattgatcctccgtacttgggagtcggccat

SEQ ID NO: 375022 - DNA, 140 bp, Artificial Sequence
  Synthetic
atggccgactcccaagtacggaggatcaatactcattagtcttgatatcacactaacatgtttaaaagtgggcttaagtatcctcaacgagcgatgtggcaaattatggatttgagttgtggagacccagcatggcgtat

SEQ ID NO: 375023 - DNA, 140 bp, Artificial Sequence
  Synthetic
atacgccatgctgggtctccatttttcaatctacatcgggggtacagcaggtgatcgagggctttcggatgctaccagactattccttcgagtggccatttcttccttccttcaatttgtcgtacttgggagtcggccat

SEQ ID NO: 375024 - DNA, 140 bp, Artificial Sequence
  Synthetic
atggccgactcccaagtacgacaaattgaaggaaggaagaaatggccactcgaaggaatagtctggtagcatccgaaagccctcgatcacctgctgtacccccgatgtagattgaaaaatggagacccagcatggcgtat

SEQ ID NO: 375025 - DNA, 140 bp, Artificial Sequence
  Synthetic
atacgccatgctgggtctccaccctttggagggacaaaatccagatccaattaatagctttctacatcagattatagccttactgcaaaatgaatcccctcaaaacaacatccaattccacgtacttgggagtcggccat

SEQ ID NO: 375026 - DNA, 140 bp, Artificial Sequence
  Synthetic
atggccgactcccaagtacgtggaattggatgttgttttgaggggattcattttgcagtaaggctataatctgatgtagaaagctattaattggatctggattttgtccctccaaagggtggagacccagcatggcgtat

SEQ ID NO: 375027 - DNA, 140 bp, Artificial Sequence
  Synthetic
atacgccatgctgggtctccagagcactgccagtaatttcttccatgcatcacttgcctattggaggagccggcacaaaggacggcccaaaaatcgatcgaccgaagaacagacagttaacgtacttgggagtcggccat

SEQ ID NO: 375028 - DNA, 140 bp, Artificial Sequence
  Synthetic
atggccgactcccaagtacgttaactgtctgttcttcggtcgatcgatttttgggccgtcctttgtgccggctcctccaataggcaagtgatgcatggaagaaattactggcagtgctctggagacccagcatggcgtat

SEQ ID NO: 375029 - DNA, 140 bp, Artificial Sequence
  Synthetic
atacgccatgctgggtctcccaagcatccccaaatctaagtcaggaactcaaggctcaagcgcattttttgagaaacttgaatatgataaagaaatagaattgccaacagcttccacacccgtacttgggagtcggccat

SEQ ID NO: 375030 - DNA, 140 bp, Artificial Sequence
  Synthetic
atggccgactcccaagtacgggtgtggaagctgttggcaattctatttctttatcatattcaagtttctcaaaaaatgcgcttgagccttgagttcctgacttagatttggggatgcttgggagacccagcatggcgtat

SEQ ID NO: 375031 - DNA, 140 bp, Artificial Sequence
  Synthetic
atacgccatgctgggtctccatggtaaaacaccatccaatgccgcaaaagatgattcaacaacctccaagggctgcgattccaaagaagaaaatgccgttcaagcttcacaccgaattgtcgtacttgggagtcggccat

SEQ ID NO: 375032 - DNA, 140 bp, Artificial Sequence
  Synthetic
atggccgactcccaagtacgacaattcggtgtgaagcttgaacggcattttcttctttggaatcgcagcccttggaggttgttgaatcatcttttgcggcattggatggtgttttaccatggagacccagcatggcgtat

SEQ ID NO: 375033 - DNA, 140 bp, Artificial Sequence
  Synthetic
aggccctggctgctgatatgggctgcgattccaaagaagaaaatgccgttcaagcttcacaccgaattgtcctaccattttttacattgtcacagaacggctacagaactccctcagttagaccttttgggacagcggtg

SEQ ID NO: 375034 - DNA, 140 bp, Artificial Sequence
  Synthetic
caccgctgtcccaaaaggtctaactgagggagttctgtagccgttctgtgacaatgtaaaaaatggtaggacaattcggtgtgaagcttgaacggcattttcttctttggaatcgcagcccatatcagcagccagggcct

SEQ ID NO: 375035 - DNA, 140 bp, Artificial Sequence
  Synthetic
atacgccatgctgggtctccgcaattccagataccactgtatactgtcgctttacaggggttgtgtcttcaatgcattataagcttgatgaggttctctgggaattcgatagtttcaaaacgtacttgggagtcggccat

SEQ ID NO: 375036 - DNA, 140 bp, Artificial Sequence
  Synthetic
atggccgactcccaagtacgttttgaaactatcgaattcccagagaacctcatcaagcttataatgcattgaagacacaacccctgtaaagcgacagtatacagtggtatctggaattgcggagacccagcatggcgtat

SEQ ID NO: 375037 - DNA, 140 bp, Artificial Sequence
  Synthetic
aggccctggctgctgatatgaatgcattataagcttgatgaggttctctgggaattcgatagtttcaaaactgctgtgactctagctgaaggagaagggtcaggtgccttattactactagaccttttgggacagcggtg

SEQ ID NO: 375038 - DNA, 140 bp, Artificial Sequence
  Synthetic
caccgctgtcccaaaaggtctagtagtaataaggcacctgacccttctccttcagctagagtcacagcagttttgaaactatcgaattcccagagaacctcatcaagcttataatgcattcatatcagcagccagggcct

SEQ ID NO: 375039 - DNA, 140 bp, Artificial Sequence
  Synthetic
atacgccatgctgggtctcctagcatcgaggcagaaatagtttctgggacaaccacacctcgaatgctccttcctgtaatggccaaacttcatgatgatcaaataaatgtaatattaaaccgtacttgggagtcggccat

SEQ ID NO: 375040 - DNA, 140 bp, Artificial Sequence
  Synthetic
atggccgactcccaagtacggtttaatattacatttatttgatcatcatgaagtttggccattacaggaaggagcattcgaggtgtggttgtcccagaaactatttctgcctcgatgctaggagacccagcatggcgtat

SEQ ID NO: 375041 - DNA, 140 bp, Artificial Sequence
  Synthetic
atacgccatgctgggtctccaattctgctagccaggttactgatatcactaaccctgcatggttcactgaccagaaatctagaatccccacacaagttgagattatgactatggatgctgcgtacttgggagtcggccat

SEQ ID NO: 375042 - DNA, 140 bp, Artificial Sequence
  Synthetic
atggccgactcccaagtacgcagcatccatagtcataatctcaacttgtgtggggattctagatttctggtcagtgaaccatgcagggttagtgatatcagtaacctggctagcagaattggagacccagcatggcgtat

SEQ ID NO: 375043 - DNA, 140 bp, Artificial Sequence
  Synthetic
atacgccatgctgggtctccttaattgtttcacacattgatacaagggtgctaaagattgttattataaaggtttttttaagtgatattgatggtctactgtggcttaatgaccatcttgcgtacttgggagtcggccat

SEQ ID NO: 375044 - DNA, 140 bp, Artificial Sequence
  Synthetic
atggccgactcccaagtacgcaagatggtcattaagccacagtagaccatcaatatcacttaaaaaaacctttataataacaatctttagcacccttgtatcaatgtgtgaaacaattaaggagacccagcatggcgtat

SEQ ID NO: 375045 - DNA, 140 bp, Artificial Sequence
  Synthetic
atacgccatgctgggtctccaagtcaagcgaatggtacttatgtctttcaaatttcctttcagcttctcgacgacggcctcatcagggtcatgctacctgtatgcaagtcatccaaacagcgtacttgggagtcggccat

SEQ ID NO: 375046 - DNA, 140 bp, Artificial Sequence
  Synthetic
atggccgactcccaagtacgctgtttggatgacttgcatacaggtagcatgaccctgatgaggccgtcgtcgagaagctgaaaggaaatttgaaagacataagtaccattcgcttgacttggagacccagcatggcgtat

SEQ ID NO: 375047 - DNA, 140 bp, Artificial Sequence
  Synthetic
aggccctggctgctgatatgacgacggcctcatcagggtcatgctacctgtatgcaagtcatccaaacagcgctacgactccaagttcaaaggagttcatactggcttagccatttagtggaccttttgggacagcggtg

SEQ ID NO: 375048 - DNA, 140 bp, Artificial Sequence
  Synthetic
caccgctgtcccaaaaggtccactaaatggctaagccagtatgaactcctttgaacttggagtcgtagcgctgtttggatgacttgcatacaggtagcatgaccctgatgaggccgtcgtcatatcagcagccagggcct

SEQ ID NO: 375049 - DNA, 140 bp, Artificial Sequence
  Synthetic
atacgccatgctgggtctccttcattggaaaaggttctttaccatcgatataacctagttgattcacggaagggtccactggtctcgatcctttaccatttaacacacttgcaagcagaacgtacttgggagtcggccat

SEQ ID NO: 375050 - DNA, 140 bp, Artificial Sequence
  Synthetic
atggccgactcccaagtacgttctgcttgcaagtgtgttaaatggtaaaggatcgagaccagtggacccttccgtgaatcaactaggttatatcgatggtaaagaaccttttccaatgaaggagacccagcatggcgtat

SEQ ID NO: 375051 - DNA, 140 bp, Artificial Sequence
  Synthetic
atacgccatgctgggtctccattagagaattggtgtgtgactataatcagcaacgacaaagtcgaacccaaacataccacttcatcaaaacgacaaagggccggattacaaaattagtcacgtacttgggagtcggccat

SEQ ID NO: 375052 - DNA, 140 bp, Artificial Sequence
  Synthetic
atggccgactcccaagtacgtgactaattttgtaatccggccctttgtcgttttgatgaagtggtatgtttgggttcgactttgtcgttgctgattatagtcacacaccaattctctaatggagacccagcatggcgtat

SEQ ID NO: 375053 - DNA, 140 bp, Artificial Sequence
  Synthetic
atacgccatgctgggtctccatgactaccttaaattttatctcgtagtgcaagcactgaagcataattgtctttggcaggaagaactcagaacacttcctgacttaatcaatgtttgcaacgtacttgggagtcggccat

SEQ ID NO: 375054 - DNA, 140 bp, Artificial Sequence
  Synthetic
atggccgactcccaagtacgttgcaaacattgattaagtcaggaagtgttctgagttcttcctgccaaagacaattatgcttcagtgcttgcactacgagataaaatttaaggtagtcatggagacccagcatggcgtat

SEQ ID NO: 375055 - DNA, 140 bp, Artificial Sequence
  Synthetic
aggccctggctgctgatatgctttggcaggaagaactcagaacacttcctgacttaatcaatgtttgcaatcgattttaccatataagggactgctcatgtgaagatcgatttttaattcgaccttttgggacagcggtg

SEQ ID NO: 375056 - DNA, 140 bp, Artificial Sequence
  Synthetic
caccgctgtcccaaaaggtcgaattaaaaatcgatcttcacatgagcagtcccttatatggtaaaatcgattgcaaacattgattaagtcaggaagtgttctgagttcttcctgccaaagcatatcagcagccagggcct

SEQ ID NO: 375057 - DNA, 140 bp, Artificial Sequence
  Synthetic
atacgccatgctgggtctccagattaaccgggtttctaggattgtatcctaatggtattaacacttaagatccccttagaggcatcgcaatatgactccaaacattaaatgatattgctgcgtacttgggagtcggccat

SEQ ID NO: 375058 - DNA, 140 bp, Artificial Sequence
  Synthetic
atggccgactcccaagtacgcagcaatatcatttaatgtttggagtcatattgcgatgcctctaaggggatcttaagtgttaataccattaggatacaatcctagaaacccggttaatctggagacccagcatggcgtat

SEQ ID NO: 375059 - DNA, 140 bp, Artificial Sequence
  Synthetic
atacgccatgctgggtctccacatgactgcaatgcgtgatttataccgaaacacagtgagggctgcacatgcaggttcctgttgagcttaaaaagatcatgcaatacaaaatgatatttgcgtacttgggagtcggccat

SEQ ID NO: 375060 - DNA, 140 bp, Artificial Sequence
  Synthetic
atggccgactcccaagtacgcaaatatcattttgtattgcatgatctttttaagctcaacaggaacctgcatgtgcagccctcactgtgtttcggtataaatcacgcattgcagtcatgtggagacccagcatggcgtat

SEQ ID NO: 375061 - DNA, 140 bp, Artificial Sequence
  Synthetic
atacgccatgctgggtctcctcaattaagaaaaattactgtggtttatgcatttaaatgacatcacggatggatataatatagttaattcttacctaaatgttgagttatagtaatttgacgtacttgggagtcggccat

SEQ ID NO: 375062 - DNA, 140 bp, Artificial Sequence
  Synthetic
atggccgactcccaagtacgtcaaattactataactcaacatttaggtaagaattaactatattatatccatccgtgatgtcatttaaatgcataaaccacagtaatttttcttaattgaggagacccagcatggcgtat

SEQ ID NO: 375063 - DNA, 140 bp, Artificial Sequence
  Synthetic
aggccctggctgctgatatgggatataatatagttaattcttacctaaatgttgagttatagtaatttgaagttgtaattatgattagtgcttatactataaataatagctataccaagtgaccttttgggacagcggtg

SEQ ID NO: 375064 - DNA, 140 bp, Artificial Sequence
  Synthetic
caccgctgtcccaaaaggtcacttggtatagctattatttatagtataagcactaatcataattacaacttcaaattactataactcaacatttaggtaagaattaactatattatatcccatatcagcagccagggcct

SEQ ID NO: 375065 - DNA, 140 bp, Artificial Sequence
  Synthetic
atacgccatgctgggtctcctgattaataacaaaagtctcagttgttggttgttgagttgcaaaacccccgttaaaaatttattttccacttataactaataataatcatagatcagtatcgtacttgggagtcggccat

SEQ ID NO: 375066 - DNA, 140 bp, Artificial Sequence
  Synthetic
atggccgactcccaagtacgatactgatctatgattattattagttataagtggaaaataaatttttaacgggggttttgcaactcaacaaccaacaactgagacttttgttattaatcaggagacccagcatggcgtat

SEQ ID NO: 375067 - DNA, 140 bp, Artificial Sequence
  Synthetic
atacgccatgctgggtctccatcaatcttgatttcaatgatattggagggcttgtcgataaatttagtaattaacattaagtcagtgtggaacctcattggatatttgatcgtacacaaacgtacttgggagtcggccat

SEQ ID NO: 375068 - DNA, 140 bp, Artificial Sequence
  Synthetic
atggccgactcccaagtacgtttgtgtacgatcaaatatccaatgaggttccacactgacttaatgttaattactaaatttatcgacaagccctccaatatcattgaaatcaagattgatggagacccagcatggcgtat

SEQ ID NO: 375069 - DNA, 140 bp, Artificial Sequence
  Synthetic
aggccctggctgctgatatgaaatttagtaattaacattaagtcagtgtggaacctcattggatatttgatcgtacacaaaaatatctttacaaaattgttttctcttttttgtgtgtccgaccttttgggacagcggtg

SEQ ID NO: 375070 - DNA, 140 bp, Artificial Sequence
  Synthetic
caccgctgtcccaaaaggtcggacacacaaaaaagagaaaacaattttgtaaagatatttttgtgtacgatcaaatatccaatgaggttccacactgacttaatgttaattactaaatttcatatcagcagccagggcct

SEQ ID NO: 375071 - DNA, 140 bp, Artificial Sequence
  Synthetic
atacgccatgctgggtctccccgattggcttctcacaacaaacacaaaccattttcaaatgcgcacgcagcacgctaaagagcaactgagcttgaagatgctatcattagtgcgctctaacgtacttgggagtcggccat

SEQ ID NO: 375072 - DNA, 140 bp, Artificial Sequence
  Synthetic
atggccgactcccaagtacgttagagcgcactaatgatagcatcttcaagctcagttgctctttagcgtgctgcgtgcgcatttgaaaatggtttgtgtttgttgtgagaagccaatcggggagacccagcatggcgtat

SEQ ID NO: 375073 - DNA, 140 bp, Artificial Sequence
  Synthetic
atacgccatgctgggtctccatggacaggaccaggatggaaaccaaggcgaaactgcatccccacgggtagcccccaaccaatacagagacaagccaatgccacaagtacaggacagatccgtacttgggagtcggccat

SEQ ID NO: 375074 - DNA, 140 bp, Artificial Sequence
  Synthetic
atggccgactcccaagtacggatctgtcctgtacttgtggcattggcttgtctctgtattggttgggggctacccgtggggatgcagtttcgccttggtttccatcctggtcctgtccatggagacccagcatggcgtat

SEQ ID NO: 375075 - DNA, 140 bp, Artificial Sequence
  Synthetic
atacgccatgctgggtctcccttccaagacaactacaacccccttagccaactccaccacagaagcaccaccccataacaacaaccccaaaccaacaacactgcatgtaagtattgtctccgtacttgggagtcggccat

SEQ ID NO: 375076 - DNA, 140 bp, Artificial Sequence
  Synthetic
atggccgactcccaagtacggagacaatacttacatgcagtgttgttggtttggggttgttgttatggggtggtgcttctgtggtggagttggctaagggggttgtagttgtcttggaagggagacccagcatggcgtat

SEQ ID NO: 375077 - DNA, 140 bp, Artificial Sequence
  Synthetic
aggccctggctgctgatatggacgactggtcgtgcaactgccactgctgcagctactgaagcatactgggcagaacatggacgtcctccaccggggccctcattgtacgaggaggatgcagaccttttgggacagcggtg

SEQ ID NO: 375078 - DNA, 140 bp, Artificial Sequence
  Synthetic
caccgctgtcccaaaaggtctgcatcctcctcgtacaatgagggccccggtggaggacgtccatgttctgcccagtatgcttcagtagctgcagcagtggcagttgcacgaccagtcgtccatatcagcagccagggcct

SEQ ID NO: 375079 - DNA, 140 bp, Artificial Sequence
  Synthetic
aggccctggctgctgatatgcaagacggaaaaacactcggactcaaaatctaaggtgaacaattgcgcaacctccacagtcgcctatattgcttccttccggaatcagggtatgatcgcggaccttttgggacagcggtg

SEQ ID NO: 375080 - DNA, 140 bp, Artificial Sequence
  Synthetic
caccgctgtcccaaaaggtccgcgatcataccctgattccggaaggaagcaatataggcgactgtggaggttgcgcaattgttcaccttagattttgagtccgagtgtttttccgtcttgcatatcagcagccagggcct

SEQ ID NO: 375081 - DNA, 140 bp, Artificial Sequence
  Synthetic
atacgccatgctgggtctcctagaggctgtctacccaatgagaacggttagtactagtatcaacagtactgccagtggtccgaactttccagcaccggatgtaatgatgagtgatacacccgtacttgggagtcggccat

SEQ ID NO: 375082 - DNA, 140 bp, Artificial Sequence
  Synthetic
atggccgactcccaagtacgggtgtatcactcatcattacatccggtgctggaaagttcggaccactggcagtactgttgatactagtactaaccgttctcattgggtagacagcctctaggagacccagcatggcgtat

SEQ ID NO: 375083 - DNA, 140 bp, Artificial Sequence
  Synthetic
aggccctggctgctgatatggccattctcctgctagtcttcctccagtcagcgagaaatgagcatgaagtccgaggctgcccggcccacacgacccccagggccttcgtccggctaccgagaccttttgggacagcggtg

SEQ ID NO: 375084 - DNA, 140 bp, Artificial Sequence
  Synthetic
caccgctgtcccaaaaggtctcggtagccggacgaaggccctgggggtcgtgtgggccgggcagcctcggacttcatgctcatttctcgctgactggaggaagactagcaggagaatggccatatcagcagccagggcct

SEQ ID NO: 375085 - DNA, 140 bp, Artificial Sequence
  Synthetic
atacgccatgctgggtctcctaaaatgcaggaccacaatccaaccagcaacaccatccatacacaggtatcaattgggctgccgcagcatatagacccaatagcaagctgctgtccagaacgtacttgggagtcggccat

SEQ ID NO: 375086 - DNA, 140 bp, Artificial Sequence
  Synthetic
atggccgactcccaagtacgttctggacagcagcttgctattgggtctatatgctgcggcagcccaattgatacctgtgtatggatggtgttgctggttggattgtggtcctgcattttaggagacccagcatggcgtat

SEQ ID NO: 375087 - DNA, 140 bp, Artificial Sequence
  Synthetic
aggccctggctgctgatatgcaattgggctgccgcagcatatagacccaatagcaagctgctgtccagaaaatagttccggaaagtaactcaaccatcgcaagcccaatgcagctttcaggaccttttgggacagcggtg

SEQ ID NO: 375088 - DNA, 140 bp, Artificial Sequence
  Synthetic
caccgctgtcccaaaaggtcctgaaagctgcattgggcttgcgatggttgagttactttccggaactattttctggacagcagcttgctattgggtctatatgctgcggcagcccaattgcatatcagcagccagggcct

SEQ ID NO: 375089 - DNA, 140 bp, Artificial Sequence
  Synthetic
atacgccatgctgggtctcctggtatcaaatcttattaagaaaaagaacacgatgaagattaacgcgacctagagcgctgccttcatctcatcaatttaacttgtcaatagagcaacctacgtacttgggagtcggccat

SEQ ID NO: 375090 - DNA, 140 bp, Artificial Sequence
  Synthetic
atggccgactcccaagtacgtaggttgctctattgacaagttaaattgatgagatgaaggcagcgctctaggtcgcgttaatcttcatcgtgttctttttcttaataagatttgataccaggagacccagcatggcgtat

SEQ ID NO: 375091 - DNA, 140 bp, Artificial Sequence
  Synthetic
atacgccatgctgggtctcccagggccgtgccctgaaggttacgctttccacaaagaaggcgctttcttcctgtatgatcgactggcatcaacaatcatctatcgaagcaccacgttttccgtacttgggagtcggccat

SEQ ID NO: 375092 - DNA, 140 bp, Artificial Sequence
  Synthetic
atggccgactcccaagtacggaaaacgtggtgcttcgatagatgattgttgatgccagtcgatcatacaggaagaaagcgccttctttgtggaaagcgtaaccttcagggcacggccctgggagacccagcatggcgtat

SEQ ID NO: 375093 - DNA, 140 bp, Artificial Sequence
  Synthetic
aggccctggctgctgatatgagaggatcccgcttcagtggttcaagtgcgagacctccagagggaaaacacagtgccgaccccacccccagacacagtccccacaactctgatccccgacgaccttttgggacagcggtg

SEQ ID NO: 375094 - DNA, 140 bp, Artificial Sequence
  Synthetic
caccgctgtcccaaaaggtcgtcggggatcagagttgtggggactgtgtctgggggtggggtcggcactgtgttttccctctggaggtctcgcacttgaaccactgaagcgggatcctctcatatcagcagccagggcct

SEQ ID NO: 375095 - DNA, 140 bp, Artificial Sequence
  Synthetic
atacgccatgctgggtctccatgacaccgacagcaatcgacccaacccaattgacatcagcgagtctacagagccaggaccactcaccaacaccacaagaggggctgcaaatctgctgaccgtacttgggagtcggccat

SEQ ID NO: 375096 - DNA, 140 bp, Artificial Sequence
  Synthetic
atggccgactcccaagtacggtcagcagatttgcagcccctcttgtggtgttggtgagtggtcctggctctgtagactcgctgatgtcaattgggttgggtcgattgctgtcggtgtcatggagacccagcatggcgtat

SEQ ID NO: 375097 - DNA, 140 bp, Artificial Sequence
  Synthetic
atacgccatgctgggtctccaggctcaagaagaacccgaagggaaatcaccctgagaacacaagccaaatgcaacccaaacctacactattggacaacccaagatgaaggggctgccattcgtacttgggagtcggccat

SEQ ID NO: 375098 - DNA, 140 bp, Artificial Sequence
  Synthetic
atggccgactcccaagtacgaatggcagccccttcatcttgggttgtccaatagtgtaggtttgggttgcatttggcttgtgttctcagggtgatttcccttcgggttcttcttgagcctggagacccagcatggcgtat

SEQ ID NO: 375099 - DNA, 140 bp, Artificial Sequence
  Synthetic
aggccctggctgctgatatgaagataccgagacctcaacctacaccgagacacgtgcatggtcagaggaaggtggcccccattaacatcttccacagtcgaatctaccataatttccctagaccttttgggacagcggtg

SEQ ID NO: 375100 - DNA, 140 bp, Artificial Sequence
  Synthetic
caccgctgtcccaaaaggtctagggaaattatggtagattcgactgtggaagatgttaatgggggccaccttcctctgaccatgcacgtgtctcggtgtaggttgaggtctcggtatcttcatatcagcagccagggcct

SEQ ID NO: 375101 - DNA, 140 bp, Artificial Sequence
  Synthetic
atacgccatgctgggtctccaacaccagcataagtgaaatcctgtctgtgattagcaacacgaatgatcttcaatcctgttgcaattcgccagtgataattgtattcacattgtggccaccgtacttgggagtcggccat

SEQ ID NO: 375102 - DNA, 140 bp, Artificial Sequence
  Synthetic
atggccgactcccaagtacggtggccacaatgtgaatacaattatcactggcgaattgcaacaggattgaagatcattcgtgttgctaatcacagacaggatttcacttatgctggtgttggagacccagcatggcgtat

SEQ ID NO: 375103 - DNA, 140 bp, Artificial Sequence
  Synthetic
aggccctggctgctgatatgtcaatttcattacttacgacaatcattatcttaataatatttctctaaattactgacttaattagcttgtaatcagataatatcgaaaccaatttatcatgaccttttgggacagcggtg

SEQ ID NO: 375104 - DNA, 140 bp, Artificial Sequence
  Synthetic
caccgctgtcccaaaaggtcatgataaattggtttcgatattatctgattacaagctaattaagtcagtaatttagagaaatattattaagataatgattgtcgtaagtaatgaaattgacatatcagcagccagggcct

SEQ ID NO: 375105 - DNA, 140 bp, Artificial Sequence
  Synthetic
aggccctggctgctgatatggggatttgtttcatactagctctctgcaaacacaatggctaaggcaacaggtaggtacaacttggtttcacctaaaaaggacctcgagagggggcttgttgaccttttgggacagcggtg

SEQ ID NO: 375106 - DNA, 140 bp, Artificial Sequence
  Synthetic
caccgctgtcccaaaaggtcaacaagccccctctcgaggtcctttttaggtgaaaccaagttgtacctacctgttgccttagccattgtgtttgcagagagctagtatgaaacaaatccccatatcagcagccagggcct

SEQ ID NO: 375107 - DNA, 140 bp, Artificial Sequence
  Synthetic
aggccctggctgctgatatgtttgctcattctaataataaatcataacctgaataaaagacaccacaatattataacccaataacacctagagaatttctgaattgctaaagattatatagaccttttgggacagcggtg

SEQ ID NO: 375108 - DNA, 140 bp, Artificial Sequence
  Synthetic
caccgctgtcccaaaaggtctatataatctttagcaattcagaaattctctaggtgttattgggttataatattgtggtgtcttttattcaggttatgatttattattagaatgagcaaacatatcagcagccagggcct

SEQ ID NO: 375109 - DNA, 140 bp, Artificial Sequence
  Synthetic
aggccctggctgctgatatgcacaacaactctgtgaattgttttcagtgcaaaagcattgggggcatcctgtgctacatagcgagaaggctattcagaaagtaaagaaacatgcaaccgtgaccttttgggacagcggtg

SEQ ID NO: 375110 - DNA, 140 bp, Artificial Sequence
  Synthetic
caccgctgtcccaaaaggtcacggttgcatgtttctttactttctgaatagccttctcgctatgtagcacaggatgcccccaatgcttttgcactgaaaacaattcacagagttgttgtgcatatcagcagccagggcct

SEQ ID NO: 375111 - DNA, 140 bp, Artificial Sequence
  Synthetic
aggccctggctgctgatatgggaaggccctagctcttaccgtggtcatcttgggggaattgagggactccaacagaaactctggaccagcatttcatgtgcacaaatctcattagttgaggaccttttgggacagcggtg

SEQ ID NO: 375112 - DNA, 140 bp, Artificial Sequence
  Synthetic
caccgctgtcccaaaaggtcctcaactaatgagatttgtgcacatgaaatgctggtccagagtttctgttggagtccctcaattcccccaagatgaccacggtaagagctagggccttcccatatcagcagccagggcct

SEQ ID NO: 375113 - DNA, 140 bp, Artificial Sequence
  Synthetic
aggccctggctgctgatatgcatttttcaatctacatcgggggtacggcaggtgatcgagggctttcggatgctaccagactattccttcgagtggccatttcttccttccttcaatttagaccttttgggacagcggtg

SEQ ID NO: 375114 - DNA, 140 bp, Artificial Sequence
  Synthetic
caccgctgtcccaaaaggtctaaattgaaggaaggaagaaatggccactcgaaggaatagtctggtagcatccgaaagccctcgatcacctgccgtacccccgatgtagattgaaaaatgcatatcagcagccagggcct

SEQ ID NO: 375115 - DNA, 140 bp, Artificial Sequence
  Synthetic
atacgccatgctgggtctccccaagcatccccaaatctaagtcaggaactcaaggttcaagcgcattttttgagaaacttgaatatgataaagaaagagaattgccaacagcttccacaccgtacttgggagtcggccat

SEQ ID NO: 375116 - DNA, 140 bp, Artificial Sequence
  Synthetic
atggccgactcccaagtacggtgtggaagctgttggcaattctctttctttatcatattcaagtttctcaaaaaatgcgcttgaaccttgagttcctgacttagatttggggatgcttggggagacccagcatggcgtat

SEQ ID NO: 375117 - DNA, 140 bp, Artificial Sequence
  Synthetic
aggccctggctgctgatatggggctgcgattccaaagaagaaaatgccgttcaagcttcacaccgaattgtcctaccattttttacattgtcacagaacgactacagaactccctcagctgaccttttgggacagcggtg

SEQ ID NO: 375118 - DNA, 140 bp, Artificial Sequence
  Synthetic
caccgctgtcccaaaaggtcagctgagggagttctgtagtcgttctgtgacaatgtaaaaaatggtaggacaattcggtgtgaagcttgaacggcattttcttctttggaatcgcagccccatatcagcagccagggcct

SEQ ID NO: 375119 - DNA, 140 bp, Artificial Sequence
  Synthetic
atacgccatgctgggtctccattaattgtttcacacattgatacaagggtgctaaagattgttattataaaggtttttttaagtgatattgaaggtctcctgtggcttaatgaccatcttcgtacttgggagtcggccat

SEQ ID NO: 375120 - DNA, 140 bp, Artificial Sequence
  Synthetic
atggccgactcccaagtacgaagatggtcattaagccacaggagaccttcaatatcacttaaaaaaacctttataataacaatctttagcacccttgtatcaatgtgtgaaacaattaatggagacccagcatggcgtat

SEQ ID NO: 375121 - DNA, 140 bp, Artificial Sequence
  Synthetic
atacgccatgctgggtctcccacatgactgcaatgcgtaatttataccgaaacacagtgagggctgcacatgcaggttcctgttgagctttaaaagatcatgcaatataaaatgatatttcgtacttgggagtcggccat

SEQ ID NO: 375122 - DNA, 140 bp, Artificial Sequence
  Synthetic
atggccgactcccaagtacgaaatatcattttatattgcatgatcttttaaagctcaacaggaacctgcatgtgcagccctcactgtgtttcggtataaattacgcattgcagtcatgtgggagacccagcatggcgtat

SEQ ID NO: 375123 - DNA, 140 bp, Artificial Sequence
  Synthetic
atacgccatgctgggtctccgtgattaataataaaagtctcagttgttggttgttgagttgtaaaactcccgttaaaaatttattttccacttataactaataataatcatagatcagtacgtacttgggagtcggccat

SEQ ID NO: 375124 - DNA, 140 bp, Artificial Sequence
  Synthetic
atggccgactcccaagtacgtactgatctatgattattattagttataagtggaaaataaatttttaacgggagttttacaactcaacaaccaacaactgagacttttattattaatcacggagacccagcatggcgtat

SEQ ID NO: 375125 - DNA, 140 bp, Artificial Sequence
  Synthetic
atacgccatgctgggtctcctgtcaatcttgatttcaatgatattggagggcttgtcgataaattcagtaattaacattaagtcagtgtggaacctcattggatatttgatcgtacacaacgtacttgggagtcggccat

SEQ ID NO: 375126 - DNA, 140 bp, Artificial Sequence
  Synthetic
atggccgactcccaagtacgttgtgtacgatcaaatatccaatgaggttccacactgacttaatgttaattactgaatttatcgacaagccctccaatatcattgaaatcaagattgacaggagacccagcatggcgtat

SEQ ID NO: 375127 - DNA, 140 bp, Artificial Sequence
  Synthetic
aggccctggctgctgatatgaaattcagtaattaacattaagtcagtgtggaacctcattggatatttgatcgtacacaaaatatctttacaaaattgttttctcttttttgtgtgtccagaccttttgggacagcggtg

SEQ ID NO: 375128 - DNA, 140 bp, Artificial Sequence
  Synthetic
caccgctgtcccaaaaggtctggacacacaaaaaagagaaaacaattttgtaaagatattttgtgtacgatcaaatatccaatgaggttccacactgacttaatgttaattactgaatttcatatcagcagccagggcct

SEQ ID NO: 375129 - DNA, 140 bp, Artificial Sequence
  Synthetic
atacgccatgctgggtctcctggatatataaaaagaaagaaaagttttttatattttttgtgtgtgaataattatgaggaagattaattattttttttaaatttaaattaatattaatatcgtacttgggagtcggccat

SEQ ID NO: 375130 - DNA, 140 bp, Artificial Sequence
  Synthetic
atggccgactcccaagtacgatattaatattaatttaaatttaaaaaaaataattaatcttcctcataattattcacacacaaaaaatataaaaaacttttctttctttttatatatccaggagacccagcatggcgtat

SEQ ID NO: 375131 - DNA, 140 bp, Artificial Sequence
  Synthetic
aggccctggctgctgatatgattatgaggaagattaattattttttttaaatttaaattaatattaatattgagattgattttattatttattaattggagataatttaattagttaattgaccttttgggacagcggtg

SEQ ID NO: 375132 - DNA, 140 bp, Artificial Sequence
  Synthetic
caccgctgtcccaaaaggtcaattaactaattaaattatctccaattaataaataataaaatcaatctcaatattaatattaatttaaatttaaaaaaaataattaatcttcctcataatcatatcagcagccagggcct

SEQ ID NO: 375133 - DNA, 140 bp, Artificial Sequence
  Synthetic
atacgccatgctgggtctcctgagattgattttattatttattaattggagataatttaattagttaattttttatttgggggtatttttaaagtgttgtaaaggtatgtgggttgtattcgtacttgggagtcggccat

SEQ ID NO: 375134 - DNA, 140 bp, Artificial Sequence
  Synthetic
atggccgactcccaagtacgaatacaacccacatacctttacaacactttaaaaatacccccaaataaaaaattaactaattaaattatctccaattaataaataataaaatcaatctcaggagacccagcatggcgtat

SEQ ID NO: 375135 - DNA, 140 bp, Artificial Sequence
  Synthetic
atacgccatgctgggtctccaagtgtgattatttgagtaatagattaattttgttttggtaattagtattttttagtaaaattaatattattttaagttttaagagaaggtgagaagaggcgtacttgggagtcggccat

SEQ ID NO: 375136 - DNA, 140 bp, Artificial Sequence
  Synthetic
atggccgactcccaagtacgcctcttctcaccttctcttaaaacttaaaataatattaattttactaaaaaatactaattaccaaaacaaaattaatctattactcaaataatcacacttggagacccagcatggcgtat

SEQ ID NO: 375137 - DNA, 140 bp, Artificial Sequence
  Synthetic
aggccctggctgctgatatgttttagtaaaattaatattattttaagttttaagagaaggtgagaagagggttttgaggtatttttttagtttataaaatttagttaattttagttgagtgaccttttgggacagcggtg

SEQ ID NO: 375138 - DNA, 140 bp, Artificial Sequence
  Synthetic
caccgctgtcccaaaaggtcactcaactaaaattaactaaattttataaactaaaaaaatacctcaaaaccctcttctcaccttctcttaaaacttaaaataatattaattttactaaaacatatcagcagccagggcct

SEQ ID NO: 375139 - DNA, 140 bp, Artificial Sequence
  Synthetic
atacgccatgctgggtctccttataatatggataaatgggtgagaggtttatgggttttgggaggataatttgaagttgattttgattattataaaatattaatagttgggtttttggttcgtacttgggagtcggccat

SEQ ID NO: 375140 - DNA, 140 bp, Artificial Sequence
  Synthetic
atggccgactcccaagtacgaaccaaaaacccaactattaatattttataataatcaaaatcaacttcaaattatcctcccaaaacccataaacctctcacccatttatccatattataaggagacccagcatggcgtat

SEQ ID NO: 375141 - DNA, 140 bp, Artificial Sequence
  Synthetic
aggccctggctgctgatatgttgaagttgattttgattattataaaatattaatagttgggtttttggtttaataagggattgtgtgataaagagttattttggtatatgttgtgagtgagaccttttgggacagcggtg

SEQ ID NO: 375142 - DNA, 140 bp, Artificial Sequence
  Synthetic
caccgctgtcccaaaaggtctcactcacaacatataccaaaataactctttatcacacaatcccttattaaaccaaaaacccaactattaatattttataataatcaaaatcaacttcaacatatcagcagccagggcct

SEQ ID NO: 375143 - DNA, 140 bp, Artificial Sequence
  Synthetic
atacgccatgctgggtctccatttttaagataatgttgatagtttttttttatttttatgtttatattatgtttattaaggagattataggtttttttttaaaagtgatgtagtttaatacgtacttgggagtcggccat

SEQ ID NO: 375144 - DNA, 140 bp, Artificial Sequence
  Synthetic
atggccgactcccaagtacgtattaaactacatcacttttaaaaaaaaacctataatctccttaataaacataatataaacataaaaataaaaaaaaactatcaacattatcttaaaaatggagacccagcatggcgtat

SEQ ID NO: 375145 - DNA, 140 bp, Artificial Sequence
  Synthetic
aggccctggctgctgatatggtttattaaggagattataggtttttttttaaaagtgatgtagtttaatatttagagggttatggttttaggtttgaggtttgagaaaaggagaatgtgtgaccttttgggacagcggtg

SEQ ID NO: 375146 - DNA, 140 bp, Artificial Sequence
  Synthetic
caccgctgtcccaaaaggtcacacattctccttttctcaaacctcaaacctaaaaccataaccctctaaatattaaactacatcacttttaaaaaaaaacctataatctccttaataaaccatatcagcagccagggcct

SEQ ID NO: 375147 - DNA, 140 bp, Artificial Sequence
  Synthetic
atacgccatgctgggtctccagaatattggttgtaatgtttgaagaggagataatagaagttaatgttggttagtttttattttttgttagtttgtttttatttaaatttgttgttggggcgtacttgggagtcggccat

SEQ ID NO: 375148 - DNA, 140 bp, Artificial Sequence
  Synthetic
atggccgactcccaagtacgccccaacaacaaatttaaataaaaacaaactaacaaaaaataaaaactaaccaacattaacttctattatctcctcttcaaacattacaaccaatattctggagacccagcatggcgtat

SEQ ID NO: 375149 - DNA, 140 bp, Artificial Sequence
  Synthetic
aggccctggctgctgatatgttagtttttattttttgttagtttgtttttatttaaatttgttgttggggagaaagtgtgtttggaaaaagtataaaggtagatttaggtttatgtagaagaccttttgggacagcggtg

SEQ ID NO: 375150 - DNA, 140 bp, Artificial Sequence
  Synthetic
caccgctgtcccaaaaggtcttctacataaacctaaatctacctttatactttttccaaacacactttctccccaacaacaaatttaaataaaaacaaactaacaaaaaataaaaactaacatatcagcagccagggcct

SEQ ID NO: 375151 - DNA, 140 bp, Artificial Sequence
  Synthetic
atacgccatgctgggtctccggtgattttttgtttgatgagaataaattttttaattaagtttttattaatatattaggggatgtatatggttgtaggttatgatgtgaatgatatagtacgtacttgggagtcggccat

SEQ ID NO: 375152 - DNA, 140 bp, Artificial Sequence
  Synthetic
atggccgactcccaagtacgtactatatcattcacatcataacctacaaccatatacatcccctaatatattaataaaaacttaattaaaaaatttattctcatcaaacaaaaaatcaccggagacccagcatggcgtat

SEQ ID NO: 375153 - DNA, 140 bp, Artificial Sequence
  Synthetic
aggccctggctgctgatatgtatattaggggatgtatatggttgtaggttatgatgtgaatgatatagtaatatttaattttgttgtttaagtaaggttttttggttttttgattgtaaagaccttttgggacagcggtg

SEQ ID NO: 375154 - DNA, 140 bp, Artificial Sequence
  Synthetic
caccgctgtcccaaaaggtctttacaatcaaaaaaccaaaaaaccttacttaaacaacaaaattaaatattactatatcattcacatcataacctacaaccatatacatcccctaatatacatatcagcagccagggcct

SEQ ID NO: 375155 - DNA, 140 bp, Artificial Sequence
  Synthetic
atacgccatgctgggtctccatttattggttaggatagtaaaagttaagaatgaggttagtttatttaaggtagtttttggtttatttgttaagtatggagaatatgttttatttgtatgcgtacttgggagtcggccat

SEQ ID NO: 375156 - DNA, 140 bp, Artificial Sequence
  Synthetic
atggccgactcccaagtacgcatacaaataaaacatattctccatacttaacaaataaaccaaaaactaccttaaataaactaacctcattcttaacttttactatcctaaccaataaatggagacccagcatggcgtat

SEQ ID NO: 375157 - DNA, 140 bp, Artificial Sequence
  Synthetic
aggccctggctgctgatatggtagtttttggtttatttgttaagtatggagaatatgttttatttgtatgtttttttaatttttttggagttaataatttggaatatgggttttatttatgaccttttgggacagcggtg

SEQ ID NO: 375158 - DNA, 140 bp, Artificial Sequence
  Synthetic
caccgctgtcccaaaaggtcataaataaaacccatattccaaattattaactccaaaaaaattaaaaaaacatacaaataaaacatattctccatacttaacaaataaaccaaaaactaccatatcagcagccagggcct

SEQ ID NO: 375159 - DNA, 140 bp, Artificial Sequence
  Synthetic
atacgccatgctgggtctccgttggtgttaatgtaggggagtaatattagtaattgtgtgaggttgttattgaagttgaaaagtaattttaataatatgttgaaatatgtgagttggatacgtacttgggagtcggccat

SEQ ID NO: 375160 - DNA, 140 bp, Artificial Sequence
  Synthetic
atggccgactcccaagtacgtatccaactcacatatttcaacatattattaaaattacttttcaacttcaataacaacctcacacaattactaatattactcccctacattaacaccaacggagacccagcatggcgtat

SEQ ID NO: 375161 - DNA, 140 bp, Artificial Sequence
  Synthetic
aggccctggctgctgatatgtgaagttgaaaagtaattttaataatatgttgaaatatgtgagttggataattttgggtttgatgaataggaaaagaagatttttatgagtttttattaggaccttttgggacagcggtg

SEQ ID NO: 375162 - DNA, 140 bp, Artificial Sequence
  Synthetic
caccgctgtcccaaaaggtcctaataaaaactcataaaaatcttcttttcctattcatcaaacccaaaattatccaactcacatatttcaacatattattaaaattacttttcaacttcacatatcagcagccagggcct

SEQ ID NO: 375163 - DNA, 140 bp, Artificial Sequence
  Synthetic
atacgccatgctgggtctccgaaagagtggttggttaaattgattgaagttattatgattgtattaaagattaaggttggagattgttattttgatgataatgatattttattttttgggcgtacttgggagtcggccat

SEQ ID NO: 375164 - DNA, 140 bp, Artificial Sequence
  Synthetic
atggccgactcccaagtacgcccaaaaaataaaatatcattatcatcaaaataacaatctccaaccttaatctttaatacaatcataataacttcaatcaatttaaccaaccactctttcggagacccagcatggcgtat

SEQ ID NO: 375165 - DNA, 140 bp, Artificial Sequence
  Synthetic
aggccctggctgctgatatgttaaggttggagattgttattttgatgataatgatattttattttttgggttgatttatgatgaaatttattttaatttttttgatgataattttgatgagaccttttgggacagcggtg

SEQ ID NO: 375166 - DNA, 140 bp, Artificial Sequence
  Synthetic
caccgctgtcccaaaaggtctcatcaaaattatcatcaaaaaaattaaaataaatttcatcataaatcaacccaaaaaataaaatatcattatcatcaaaataacaatctccaaccttaacatatcagcagccagggcct

SEQ ID NO: 375167 - DNA, 140 bp, Artificial Sequence
  Synthetic
atacgccatgctgggtctccagagtaataattattttgattatgaggatttggttgaaggtattataggagattttgatttttttaatttggatgatgatgatgatgatagttaattaggcgtacttgggagtcggccat

SEQ ID NO: 375168 - DNA, 140 bp, Artificial Sequence
  Synthetic
atggccgactcccaagtacgcctaattaactatcatcatcatcatcatccaaattaaaaaaatcaaaatctcctataataccttcaaccaaatcctcataatcaaaataattattactctggagacccagcatggcgtat

SEQ ID NO: 375169 - DNA, 140 bp, Artificial Sequence
  Synthetic
aggccctggctgctgatatggattttgatttttttaatttggatgatgatgatgatgatagttaattaggattattagatagggggtagagtaaggaaagagtggtttggatatatggttgaccttttgggacagcggtg

SEQ ID NO: 375170 - DNA, 140 bp, Artificial Sequence
  Synthetic
caccgctgtcccaaaaggtcaaccatatatccaaaccactctttccttactctaccccctatctaataatcctaattaactatcatcatcatcatcatccaaattaaaaaaatcaaaatccatatcagcagccagggcct

SEQ ID NO: 375171 - DNA, 140 bp, Artificial Sequence
  Synthetic
atacgccatgctgggtctccggtttttattaattaggtaatttttatattattaagttgggtttaaatattaattaattataaggtaatatgttatttattttttagagtatgatttttacgtacttgggagtcggccat

SEQ ID NO: 375172 - DNA, 140 bp, Artificial Sequence
  Synthetic
atggccgactcccaagtacgtaaaaatcatactctaaaaaataaataacatattaccttataattaattaatatttaaacccaacttaataatataaaaattacctaattaataaaaaccggagacccagcatggcgtat

SEQ ID NO: 375173 - DNA, 140 bp, Artificial Sequence
  Synthetic
aggccctggctgctgatatgtaattaattataaggtaatatgttatttattttttagagtatgatttttatataggaagaattagagtttgatgattagaaagatgatgatgatgagagtgaccttttgggacagcggtg

SEQ ID NO: 375174 - DNA, 140 bp, Artificial Sequence
  Synthetic
caccgctgtcccaaaaggtcactctcatcatcatcatctttctaatcatcaaactctaattcttcctatataaaaatcatactctaaaaaataaataacatattaccttataattaattacatatcagcagccagggcct

SEQ ID NO: 375175 - DNA, 140 bp, Artificial Sequence
  Synthetic
atacgccatgctgggtctccggagaataatttaattgtagttttattagtattagtttataaagatattggagtagatattaattagtaaaatggattaagtaatgttgtagatggttaacgtacttgggagtcggccat

SEQ ID NO: 375176 - DNA, 140 bp, Artificial Sequence
  Synthetic
atggccgactcccaagtacgttaaccatctacaacattacttaatccattttactaattaatatctactccaatatctttataaactaatactaataaaactacaattaaattattctccggagacccagcatggcgtat

SEQ ID NO: 375177 - DNA, 140 bp, Artificial Sequence
  Synthetic
aggccctggctgctgatatggagtagatattaattagtaaaatggattaagtaatgttgtagatggttaaggttttgaaagtgaagtttttttaattaattttgaaaagggatttgtattgaccttttgggacagcggtg

SEQ ID NO: 375178 - DNA, 140 bp, Artificial Sequence
  Synthetic
caccgctgtcccaaaaggtcaatacaaatcccttttcaaaattaattaaaaaaacttcactttcaaaaccttaaccatctacaacattacttaatccattttactaattaatatctactccatatcagcagccagggcct

SEQ ID NO: 375179 - DNA, 140 bp, Artificial Sequence
  Synthetic
atacgccatgctgggtctccttaattattattatttaatgagtgatgagtttattgtttttagtattgaaagtggtaaggaatatatttttttagatttttttgaagaagtttatttgttcgtacttgggagtcggccat

SEQ ID NO: 375180 - DNA, 140 bp, Artificial Sequence
  Synthetic
atggccgactcccaagtacgaacaaataaacttcttcaaaaaaatctaaaaaaatatattccttaccactttcaatactaaaaacaataaactcatcactcattaaataataataattaaggagacccagcatggcgtat

SEQ ID NO: 375181 - DNA, 140 bp, Artificial Sequence
  Synthetic
aggccctggctgctgatatgagtggtaaggaatatatttttttagatttttttgaagaagtttatttgttttggttgagtgagaaggaggttttagagaaagaaaattgttatttggttagaccttttgggacagcggtg

SEQ ID NO: 375182 - DNA, 140 bp, Artificial Sequence
  Synthetic
caccgctgtcccaaaaggtctaaccaaataacaattttctttctctaaaacctccttctcactcaaccaaaacaaataaacttcttcaaaaaaatctaaaaaaatatattccttaccactcatatcagcagccagggcct

SEQ ID NO: 375183 - DNA, 140 bp, Artificial Sequence
  Synthetic
atacgccatgctgggtctcctttgttgttttttaatatgattgaggatttatgattagtagattttgtttattttgagtttgattataattgttttgataatttaagtatgagtaattaacgtacttgggagtcggccat

SEQ ID NO: 375184 - DNA, 140 bp, Artificial Sequence
  Synthetic
atggccgactcccaagtacgttaattactcatacttaaattatcaaaacaattataatcaaactcaaaataaacaaaatctactaatcataaatcctcaatcatattaaaaaacaacaaaggagacccagcatggcgtat

SEQ ID NO: 375185 - DNA, 140 bp, Artificial Sequence
  Synthetic
aggccctggctgctgatatgattttgagtttgattataattgttttgataatttaagtatgagtaattaatttgaaatataaattttattttagttatgaggaaattaaataaataatttgaccttttgggacagcggtg

SEQ ID NO: 375186 - DNA, 140 bp, Artificial Sequence
  Synthetic
caccgctgtcccaaaaggtcaaattatttatttaatttcctcataactaaaataaaatttatatttcaaattaattactcatacttaaattatcaaaacaattataatcaaactcaaaatcatatcagcagccagggcct

SEQ ID NO: 375187 - DNA, 140 bp, Artificial Sequence
  Synthetic
atacgccatgctgggtctccatatttatattgtaagaataattatttagtaattttgattagtttatgatatgtattaataggaaaatattatagtattaaaatataaagtattttttgacgtacttgggagtcggccat

SEQ ID NO: 375188 - DNA, 140 bp, Artificial Sequence
  Synthetic
atggccgactcccaagtacgtcaaaaaatactttatattttaatactataatattttcctattaatacatatcataaactaatcaaaattactaaataattattcttacaatataaatatggagacccagcatggcgtat

SEQ ID NO: 375189 - DNA, 140 bp, Artificial Sequence
  Synthetic
aggccctggctgctgatatgatgtattaataggaaaatattatagtattaaaatataaagtattttttgatgagtttaggaggataatattttgatgaattttatagaatttaggattaagaccttttgggacagcggtg

SEQ ID NO: 375190 - DNA, 140 bp, Artificial Sequence
  Synthetic
caccgctgtcccaaaaggtcttaatcctaaattctataaaattcatcaaaatattatcctcctaaactcatcaaaaaatactttatattttaatactataatattttcctattaatacatcatatcagcagccagggcct

SEQ ID NO: 375191 - DNA, 140 bp, Artificial Sequence
  Synthetic
atacgccatgctgggtctccgttattttttatttgaatgtttttattaatgtttaagagttattattttgtatttttttagtttagatattgtttagtatataagttatgtagtaggatacgtacttgggagtcggccat

SEQ ID NO: 375192 - DNA, 140 bp, Artificial Sequence
  Synthetic
atggccgactcccaagtacgtatcctactacataacttatatactaaacaatatctaaactaaaaaaatacaaaataataactcttaaacattaataaaaacattcaaataaaaaataacggagacccagcatggcgtat

SEQ ID NO: 375193 - DNA, 140 bp, Artificial Sequence
  Synthetic
aggccctggctgctgatatgtatttttttagtttagatattgtttagtatataagttatgtagtaggataggatttatagatattatggatttgaagtgtttggttggttttttgagtaagaccttttgggacagcggtg

SEQ ID NO: 375194 - DNA, 140 bp, Artificial Sequence
  Synthetic
caccgctgtcccaaaaggtcttactcaaaaaaccaaccaaacacttcaaatccataatatctataaatcctatcctactacataacttatatactaaacaatatctaaactaaaaaaatacatatcagcagccagggcct

SEQ ID NO: 375195 - DNA, 140 bp, Artificial Sequence
  Synthetic
atacgccatgctgggtctcctaaattaagttttgttttgataattattattagtaagaattttaagataatatgtaaaagtgataagtaagtttaaatagatgatgttagtagtttattgcgtacttgggagtcggccat

SEQ ID NO: 375196 - DNA, 140 bp, Artificial Sequence
  Synthetic
atggccgactcccaagtacgcaataaactactaacatcatctatttaaacttacttatcacttttacatattatcttaaaattcttactaataataattatcaaaacaaaacttaatttaggagacccagcatggcgtat

SEQ ID NO: 375197 - DNA, 140 bp, Artificial Sequence
  Synthetic
aggccctggctgctgatatgtatgtaaaagtgataagtaagtttaaatagatgatgttagtagtttattgatagaagaagttaaggttgttataaatttggtgatattagttgtgtgttggaccttttgggacagcggtg

SEQ ID NO: 375198 - DNA, 140 bp, Artificial Sequence
  Synthetic
caccgctgtcccaaaaggtccaacacacaactaatatcaccaaatttataacaaccttaacttcttctatcaataaactactaacatcatctatttaaacttacttatcacttttacatacatatcagcagccagggcct

SEQ ID NO: 375199 - DNA, 140 bp, Artificial Sequence
  Synthetic
atacgccatgctgggtctccttagtttaaaatttgtttaagatatggtaaagattatattatttttgaattgtagttgtgttgaaatggttgtaaaatatgatttattggtgatgattatcgtacttgggagtcggccat

SEQ ID NO: 375200 - DNA, 140 bp, Artificial Sequence
  Synthetic
atggccgactcccaagtacgataatcatcaccaataaatcatattttacaaccatttcaacacaactacaattcaaaaataatataatctttaccatatcttaaacaaattttaaactaaggagacccagcatggcgtat

SEQ ID NO: 375201 - DNA, 140 bp, Artificial Sequence
  Synthetic
aggccctggctgctgatatgtgtagttgtgttgaaatggttgtaaaatatgatttattggtgatgattattgggtgagtaattgttattgttgtagtaatagaagtatattggaatgaatgaccttttgggacagcggtg

SEQ ID NO: 375202 - DNA, 140 bp, Artificial Sequence
  Synthetic
caccgctgtcccaaaaggtcattcattccaatatacttctattactacaacaataacaattactcacccaataatcatcaccaataaatcatattttacaaccatttcaacacaactacacatatcagcagccagggcct

SEQ ID NO: 375203 - DNA, 140 bp, Artificial Sequence
  Synthetic
atacgccatgctgggtctccgttaaattgaaagatttgaatgggaaggttttagaaagtgttaaataggtttatataaatttagatagtataagtgtttttaatgaggaaaattttgggtcgtacttgggagtcggccat

SEQ ID NO: 375204 - DNA, 140 bp, Artificial Sequence
  Synthetic
atggccgactcccaagtacgacccaaaattttcctcattaaaaacacttatactatctaaatttatataaacctatttaacactttctaaaaccttcccattcaaatctttcaatttaacggagacccagcatggcgtat

SEQ ID NO: 375205 - DNA, 140 bp, Artificial Sequence
  Synthetic
aggccctggctgctgatatgttatataaatttagatagtataagtgtttttaatgaggaaaattttgggtgattttatattttagtaaaagattttaaggaaattatttatgattattttgaccttttgggacagcggtg

SEQ ID NO: 375206 - DNA, 140 bp, Artificial Sequence
  Synthetic
caccgctgtcccaaaaggtcaaaataatcataaataatttccttaaaatcttttactaaaatataaaatcacccaaaattttcctcattaaaaacacttatactatctaaatttatataacatatcagcagccagggcct

SEQ ID NO: 375207 - DNA, 140 bp, Artificial Sequence
  Synthetic
atacgccatgctgggtctcctggtaaggataataatattttagatataatttatgtagaattttaagtaagtttggttgagggagattttttttagtgtgtattaatttagataataaaacgtacttgggagtcggccat

SEQ ID NO: 375208 - DNA, 140 bp, Artificial Sequence
  Synthetic
atggccgactcccaagtacgttttattatctaaattaatacacactaaaaaaaatctccctcaaccaaacttacttaaaattctacataaattatatctaaaatattattatccttaccaggagacccagcatggcgtat

SEQ ID NO: 375209 - DNA, 140 bp, Artificial Sequence
  Synthetic
aggccctggctgctgatatggtttggttgagggagattttttttagtgtgtattaatttagataataaaatggatttttgttttttaagatgttttttttttaattgtgtatattaagttgaccttttgggacagcggtg

SEQ ID NO: 375210 - DNA, 140 bp, Artificial Sequence
  Synthetic
caccgctgtcccaaaaggtcaacttaatatacacaattaaaaaaaaaacatcttaaaaaacaaaaatccattttattatctaaattaatacacactaaaaaaaatctccctcaaccaaaccatatcagcagccagggcct

SEQ ID NO: 375211 - DNA, 140 bp, Artificial Sequence
  Synthetic
atacgccatgctgggtctcctgttattaaagattgatagaggttgggtttgtattttttaattttaagatgggaaggtttttgggttaaaaatatgatatagaagtaaggtaagtttattcgtacttgggagtcggccat

SEQ ID NO: 375212 - DNA, 140 bp, Artificial Sequence
  Synthetic
atggccgactcccaagtacgaataaacttaccttacttctatatcatatttttaacccaaaaaccttcccatcttaaaattaaaaaatacaaacccaacctctatcaatctttaataacaggagacccagcatggcgtat

SEQ ID NO: 375213 - DNA, 140 bp, Artificial Sequence
  Synthetic
aggccctggctgctgatatggggaaggtttttgggttaaaaatatgatatagaagtaaggtaagtttattttgtgatggttaaatgatatttatgattgtttaaaattaagttagattaagaccttttgggacagcggtg

SEQ ID NO: 375214 - DNA, 140 bp, Artificial Sequence
  Synthetic
caccgctgtcccaaaaggtcttaatctaacttaattttaaacaatcataaatatcatttaaccatcacaaaataaacttaccttacttctatatcatatttttaacccaaaaaccttccccatatcagcagccagggcct

SEQ ID NO: 375215 - DNA, 140 bp, Artificial Sequence
  Synthetic
atacgccatgctgggtctcctttaattaattgataatgttgttaatagggaaatttttttgtattgtaataagattttattaatatattttttttgtttagtattatgtagaaatttttgcgtacttgggagtcggccat

SEQ ID NO: 375216 - DNA, 140 bp, Artificial Sequence
  Synthetic
atggccgactcccaagtacgcaaaaatttctacataatactaaacaaaaaaaatatattaataaaatcttattacaatacaaaaaaatttccctattaacaacattatcaattaattaaaggagacccagcatggcgtat

SEQ ID NO: 375217 - DNA, 140 bp, Artificial Sequence
  Synthetic
aggccctggctgctgatatgaagattttattaatatattttttttgtttagtattatgtagaaatttttgagtaaattaaaattgatgaagattaagaaaaagagggatttttttaggaagaccttttgggacagcggtg

SEQ ID NO: 375218 - DNA, 140 bp, Artificial Sequence
  Synthetic
caccgctgtcccaaaaggtcttcctaaaaaaatccctctttttcttaatcttcatcaattttaatttactcaaaaatttctacataatactaaacaaaaaaaatatattaataaaatcttcatatcagcagccagggcct

SEQ ID NO: 375219 - DNA, 140 bp, Artificial Sequence
  Synthetic
atacgccatgctgggtctccaaaatgagaagggttattgtgttgattgtattatttgtttatgttgatattggttattttatgagtatgttttttattaagttaagtagggttgtgagtgcgtacttgggagtcggccat

SEQ ID NO: 375220 - DNA, 140 bp, Artificial Sequence
  Synthetic
atggccgactcccaagtacgcactcacaaccctacttaacttaataaaaaacatactcataaaataaccaatatcaacataaacaaataatacaatcaacacaataacccttctcattttggagacccagcatggcgtat

SEQ ID NO: 375221 - DNA, 140 bp, Artificial Sequence
  Synthetic
aggccctggctgctgatatgtggttattttatgagtatgttttttattaagttaagtagggttgtgagtggaatttaatagaaataagaggttttttttggaatggatatattattaaatgaccttttgggacagcggtg

SEQ ID NO: 375222 - DNA, 140 bp, Artificial Sequence
  Synthetic
caccgctgtcccaaaaggtcatttaataatatatccattccaaaaaaaacctcttatttctattaaattccactcacaaccctacttaacttaataaaaaacatactcataaaataaccacatatcagcagccagggcct

SEQ ID NO: 375223 - DNA, 140 bp, Artificial Sequence
  Synthetic
atacgccatgctgggtctccgaatggagtggttttagtatttattttggaggtaattgttaatgtgattttggggtttaaagtttttatgaaataaatttttatttggttgttatttggacgtacttgggagtcggccat

SEQ ID NO: 375224 - DNA, 140 bp, Artificial Sequence
  Synthetic
atggccgactcccaagtacgtccaaataacaaccaaataaaaatttatttcataaaaactttaaaccccaaaatcacattaacaattacctccaaaataaatactaaaaccactccattcggagacccagcatggcgtat

SEQ ID NO: 375225 - DNA, 140 bp, Artificial Sequence
  Synthetic
aggccctggctgctgatatgtggggtttaaagtttttatgaaataaatttttatttggttgttatttggaattgttgattaaaaaatgtatagttttgatttaataatagtagtaattatgaccttttgggacagcggtg

SEQ ID NO: 375226 - DNA, 140 bp, Artificial Sequence
  Synthetic
caccgctgtcccaaaaggtcataattactactattattaaatcaaaactatacattttttaatcaacaattccaaataacaaccaaataaaaatttatttcataaaaactttaaaccccacatatcagcagccagggcct

SEQ ID NO: 375227 - DNA, 140 bp, Artificial Sequence
  Synthetic
atacgccatgctgggtctccttagagtgaattgatttggttagggaatattggattatttatttagattgtttaggatggggaattaggtttttttttaagagtttgtgttattattagtcgtacttgggagtcggccat

SEQ ID NO: 375228 - DNA, 140 bp, Artificial Sequence
  Synthetic
atggccgactcccaagtacgactaataataacacaaactcttaaaaaaaaacctaattccccatcctaaacaatctaaataaataatccaatattccctaaccaaatcaattcactctaaggagacccagcatggcgtat

SEQ ID NO: 375229 - DNA, 140 bp, Artificial Sequence
  Synthetic
aggccctggctgctgatatgtttaggatggggaattaggtttttttttaagagtttgtgttattattagtttaattgttgtaatattttatttttgatttgattgtatttaaattagtgagaccttttgggacagcggtg

SEQ ID NO: 375230 - DNA, 140 bp, Artificial Sequence
  Synthetic
caccgctgtcccaaaaggtctcactaatttaaatacaatcaaatcaaaaataaaatattacaacaattaaactaataataacacaaactcttaaaaaaaaacctaattccccatcctaaacatatcagcagccagggcct

SEQ ID NO: 375231 - DNA, 140 bp, Artificial Sequence
  Synthetic
atacgccatgctgggtctccttaggagttttttgttttgggtttttattttatttaaagttgagatttgttttatttttaggtaagatgggaaagaaagggtatgtttttgatttgattgcgtacttgggagtcggccat

SEQ ID NO: 375232 - DNA, 140 bp, Artificial Sequence
  Synthetic
atggccgactcccaagtacgcaatcaaatcaaaaacataccctttctttcccatcttacctaaaaataaaacaaatctcaactttaaataaaataaaaacccaaaacaaaaaactcctaaggagacccagcatggcgtat

SEQ ID NO: 375233 - DNA, 140 bp, Artificial Sequence
  Synthetic
aggccctggctgctgatatgtttatttttaggtaagatgggaaagaaagggtatgtttttgatttgattgttttagataaaatttagataattgtgaatttgatgtaagattttaaaattgaccttttgggacagcggtg

SEQ ID NO: 375234 - DNA, 140 bp, Artificial Sequence
  Synthetic
caccgctgtcccaaaaggtcaattttaaaatcttacatcaaattcacaattatctaaattttatctaaaacaatcaaatcaaaaacataccctttctttcccatcttacctaaaaataaacatatcagcagccagggcct

SEQ ID NO: 375235 - DNA, 140 bp, Artificial Sequence
  Synthetic
atacgccatgctgggtctccgttggtttataagtttattgggaagaaaatgagttagaagaatggatagtttataatttttgttttatttttaaaatatattgggttagatttaattttacgtacttgggagtcggccat

SEQ ID NO: 375236 - DNA, 140 bp, Artificial Sequence
  Synthetic
atggccgactcccaagtacgtaaaattaaatctaacccaatatattttaaaaataaaacaaaaattataaactatccattcttctaactcattttcttcccaataaacttataaaccaacggagacccagcatggcgtat

SEQ ID NO: 375237 - DNA, 140 bp, Artificial Sequence
  Synthetic
aggccctggctgctgatatgttataatttttgttttatttttaaaatatattgggttagatttaattttatttggagatttgattatggttataatattagattatgatgattgttatttgaccttttgggacagcggtg

SEQ ID NO: 375238 - DNA, 140 bp, Artificial Sequence
  Synthetic
caccgctgtcccaaaaggtcaaataacaatcatcataatctaatattataaccataatcaaatctccaaataaaattaaatctaacccaatatattttaaaaataaaacaaaaattataacatatcagcagccagggcct

SEQ ID NO: 375239 - DNA, 140 bp, Artificial Sequence
  Synthetic
atacgccatgctgggtctccgaaatatttttagtaaagaaattaaattttatttatagtaatttaattgatttttaggaagttagtagtttatatattatgggataatttaatttttttgcgtacttgggagtcggccat

SEQ ID NO: 375240 - DNA, 140 bp, Artificial Sequence
  Synthetic
atggccgactcccaagtacgcaaaaaaattaaattatcccataatatataaactactaacttcctaaaaatcaattaaattactataaataaaatttaatttctttactaaaaatatttcggagacccagcatggcgtat

SEQ ID NO: 375241 - DNA, 140 bp, Artificial Sequence
  Synthetic
aggccctggctgctgatatgtttttaggaagttagtagtttatatattatgggataatttaatttttttgttaaaatgtattaattgggttaaggaatttttattgattaagtttgaattgaccttttgggacagcggtg

SEQ ID NO: 375242 - DNA, 140 bp, Artificial Sequence
  Synthetic
caccgctgtcccaaaaggtcaattcaaacttaatcaataaaaattccttaacccaattaatacattttaacaaaaaaattaaattatcccataatatataaactactaacttcctaaaaacatatcagcagccagggcct

SEQ ID NO: 375243 - DNA, 140 bp, Artificial Sequence
  Synthetic
atacgccatgctgggtctccttaattaattaatatgtataagtgatttatattttgtttaattagtgtttgatgtttatttttttaagttttttttttagtaaattgatttagttgtattcgtacttgggagtcggccat

SEQ ID NO: 375244 - DNA, 140 bp, Artificial Sequence
  Synthetic
atggccgactcccaagtacgaatacaactaaatcaatttactaaaaaaaaaacttaaaaaaataaacatcaaacactaattaaacaaaatataaatcacttatacatattaattaattaaggagacccagcatggcgtat

SEQ ID NO: 375245 - DNA, 140 bp, Artificial Sequence
  Synthetic
aggccctggctgctgatatggatgtttatttttttaagttttttttttagtaaattgatttagttgtattaagagatttttttagttttttttttaaataatttgatttttgagggttatgaccttttgggacagcggtg

SEQ ID NO: 375246 - DNA, 140 bp, Artificial Sequence
  Synthetic
caccgctgtcccaaaaggtcataaccctcaaaaatcaaattatttaaaaaaaaaactaaaaaaatctcttaatacaactaaatcaatttactaaaaaaaaaacttaaaaaaataaacatccatatcagcagccagggcct

SEQ ID NO: 375247 - DNA, 140 bp, Artificial Sequence
  Synthetic
atacgccatgctgggtctccaatatgattgtattattaagaaaaataaatttgatgaagattaagtttgatgaaggtttaatttttatttttttattataattttgtttttagtattattcgtacttgggagtcggccat

SEQ ID NO: 375248 - DNA, 140 bp, Artificial Sequence
  Synthetic
atggccgactcccaagtacgaataatactaaaaacaaaattataataaaaaaataaaaattaaaccttcatcaaacttaatcttcatcaaatttatttttcttaataatacaatcatattggagacccagcatggcgtat

SEQ ID NO: 375249 - DNA, 140 bp, Artificial Sequence
  Synthetic
aggccctggctgctgatatgtgaaggtttaatttttatttttttattataattttgtttttagtattatttgataagggtatatttgttaatatgtttttattttaagggttttgtaatggaccttttgggacagcggtg

SEQ ID NO: 375250 - DNA, 140 bp, Artificial Sequence
  Synthetic
caccgctgtcccaaaaggtccattacaaaacccttaaaataaaaacatattaacaaatatacccttatcaaataatactaaaaacaaaattataataaaaaaataaaaattaaaccttcacatatcagcagccagggcct

SEQ ID NO: 375251 - DNA, 140 bp, Artificial Sequence
  Synthetic
atacgccatgctgggtctcctttttttgtttgggttattattttattttaaaaggttttttttatgtttttgggtgttgtgattaatagtattttagaagtaatagagattgattagttacgtacttgggagtcggccat

SEQ ID NO: 375252 - DNA, 140 bp, Artificial Sequence
  Synthetic
atggccgactcccaagtacgtaactaatcaatctctattacttctaaaatactattaatcacaacacccaaaaacataaaaaaaaccttttaaaataaaataataacccaaacaaaaaaaggagacccagcatggcgtat

SEQ ID NO: 375253 - DNA, 140 bp, Artificial Sequence
  Synthetic
aggccctggctgctgatatgtgggtgttgtgattaatagtattttagaagtaatagagattgattagttagtttgtaaggattattttgtatttattgattagttgaaattagttggtttgaccttttgggacagcggtg

SEQ ID NO: 375254 - DNA, 140 bp, Artificial Sequence
  Synthetic
caccgctgtcccaaaaggtcaaaccaactaatttcaactaatcaataaatacaaaataatccttacaaactaactaatcaatctctattacttctaaaatactattaatcacaacacccacatatcagcagccagggcct

SEQ ID NO: 375255 - DNA, 140 bp, Artificial Sequence
  Synthetic
atacgccatgctgggtctccgttggggttttagatttggtgttttttttaaggtggttagttatgaagtgggagaatgggttgaaaattgttataattttgaaataaagaagttggatggcgtacttgggagtcggccat

SEQ ID NO: 375256 - DNA, 140 bp, Artificial Sequence
  Synthetic
atggccgactcccaagtacgccatccaacttctttatttcaaaattataacaattttcaacccattctcccacttcataactaaccaccttaaaaaaaacaccaaatctaaaaccccaacggagacccagcatggcgtat

SEQ ID NO: 375257 - DNA, 140 bp, Artificial Sequence
  Synthetic
aggccctggctgctgatatgggagaatgggttgaaaattgttataattttgaaataaagaagttggatgggagtgaatgtttatttttattgttagatggtgttagaggttttttaaggtgaccttttgggacagcggtg

SEQ ID NO: 375258 - DNA, 140 bp, Artificial Sequence
  Synthetic
caccgctgtcccaaaaggtcaccttaaaaaacctctaacaccatctaacaataaaaataaacattcactcccatccaacttctttatttcaaaattataacaattttcaacccattctcccatatcagcagccagggcct

SEQ ID NO: 375259 - DNA, 140 bp, Artificial Sequence
  Synthetic
atacgccatgctgggtctccgttttttataaggatggagttttttttttttatgataggttggttttaattgtaatttatagaggagttaattttgttgagggggtaattgtatttttgacgtacttgggagtcggccat

SEQ ID NO: 375260 - DNA, 140 bp, Artificial Sequence
  Synthetic
atggccgactcccaagtacgtcaaaaatacaattaccccctcaacaaaattaactcctctataaattacaattaaaaccaacctatcataaaaaaaaaaaactccatccttataaaaaacggagacccagcatggcgtat

SEQ ID NO: 375261 - DNA, 140 bp, Artificial Sequence
  Synthetic
aggccctggctgctgatatgtgtaatttatagaggagttaattttgttgagggggtaattgtatttttgatattggttaaattaaaagaaatgtttttttagttattttttatttgagaggaccttttgggacagcggtg

SEQ ID NO: 375262 - DNA, 140 bp, Artificial Sequence
  Synthetic
caccgctgtcccaaaaggtcctctcaaataaaaaataactaaaaaaacatttcttttaatttaaccaatatcaaaaatacaattaccccctcaacaaaattaactcctctataaattacacatatcagcagccagggcct

SEQ ID NO: 375263 - DNA, 140 bp, Artificial Sequence
  Synthetic
atacgccatgctgggtctccggagtatgaaattgaaaattttggtgtttaatattttatgattttttttaaaattgataataatatttttgtttgtttggataggttttatatgttttagcgtacttgggagtcggccat

SEQ ID NO: 375264 - DNA, 140 bp, Artificial Sequence
  Synthetic
atggccgactcccaagtacgctaaaacatataaaacctatccaaacaaacaaaaatattattatcaattttaaaaaaaatcataaaatattaaacaccaaaattttcaatttcatactccggagacccagcatggcgtat

SEQ ID NO: 375265 - DNA, 140 bp, Artificial Sequence
  Synthetic
aggccctggctgctgatatgaaattgataataatatttttgtttgtttggataggttttatatgttttagttttttttttagttgaatgatattatttatttttattaatagttgagtaagaccttttgggacagcggtg

SEQ ID NO: 375266 - DNA, 140 bp, Artificial Sequence
  Synthetic
caccgctgtcccaaaaggtcttactcaactattaataaaaataaataatatcattcaactaaaaaaaaaactaaaacatataaaacctatccaaacaaacaaaaatattattatcaatttcatatcagcagccagggcct

SEQ ID NO: 375267 - DNA, 140 bp, Artificial Sequence
  Synthetic
atacgccatgctgggtctccttggtgaatgggttttttgggaaaataaaaaaatttttttgaataattatgtggagaagagttgttttttgaagttttattgtttaatgagatagaagatcgtacttgggagtcggccat

SEQ ID NO: 375268 - DNA, 140 bp, Artificial Sequence
  Synthetic
atggccgactcccaagtacgatcttctatctcattaaacaataaaacttcaaaaaacaactcttctccacataattattcaaaaaaatttttttattttcccaaaaaacccattcaccaaggagacccagcatggcgtat

SEQ ID NO: 375269 - DNA, 140 bp, Artificial Sequence
  Synthetic
aggccctggctgctgatatggtggagaagagttgttttttgaagttttattgtttaatgagatagaagatgatgatgtggtattgttgagaattataaagggaagaatttttgattgggtgaccttttgggacagcggtg

SEQ ID NO: 375270 - DNA, 140 bp, Artificial Sequence
  Synthetic
caccgctgtcccaaaaggtcacccaatcaaaaattcttccctttataattctcaacaataccacatcatcatcttctatctcattaaacaataaaacttcaaaaaacaactcttctccaccatatcagcagccagggcct

SEQ ID NO: 375271 - DNA, 140 bp, Artificial Sequence
  Synthetic
atacgccatgctgggtctcctattgtatatattagaaggggaaataatattgttgttttagaatttgatagaaggttgaagagtaggtgtgaatatttaggagattattatagagatagtcgtacttgggagtcggccat

SEQ ID NO: 375272 - DNA, 140 bp, Artificial Sequence
  Synthetic
atggccgactcccaagtacgactatctctataataatctcctaaatattcacacctactcttcaaccttctatcaaattctaaaacaacaatattatttccccttctaatatatacaataggagacccagcatggcgtat

SEQ ID NO: 375273 - DNA, 140 bp, Artificial Sequence
  Synthetic
aggccctggctgctgatatggaaggttgaagagtaggtgtgaatatttaggagattattatagagatagttgtaataattataggtattaatggtaattatatgtagatttttattattggaccttttgggacagcggtg

SEQ ID NO: 375274 - DNA, 140 bp, Artificial Sequence
  Synthetic
caccgctgtcccaaaaggtccaataataaaaatctacatataattaccattaatacctataattattacaactatctctataataatctcctaaatattcacacctactcttcaaccttccatatcagcagccagggcct

SEQ ID NO: 375275 - DNA, 140 bp, Artificial Sequence
  Synthetic
atacgccatgctgggtctccttaagttttgaggtttagatttttataatttatatattaggtttattagtgatggttattgaggaattaataatattattgggaagtttttttggtttaacgtacttgggagtcggccat

SEQ ID NO: 375276 - DNA, 140 bp, Artificial Sequence
  Synthetic
atggccgactcccaagtacgttaaaccaaaaaaacttcccaataatattattaattcctcaataaccatcactaataaacctaatatataaattataaaaatctaaacctcaaaacttaaggagacccagcatggcgtat

SEQ ID NO: 375277 - DNA, 140 bp, Artificial Sequence
  Synthetic
aggccctggctgctgatatggatggttattgaggaattaataatattattgggaagtttttttggtttaataatagaagtatttatttttattattttagaaaatataataatagtggttgaccttttgggacagcggtg

SEQ ID NO: 375278 - DNA, 140 bp, Artificial Sequence
  Synthetic
caccgctgtcccaaaaggtcaaccactattattatattttctaaaataataaaaataaatacttctattattaaaccaaaaaaacttcccaataatattattaattcctcaataaccatccatatcagcagccagggcct

SEQ ID NO: 375279 - DNA, 140 bp, Artificial Sequence
  Synthetic
atacgccatgctgggtctccagtaatagggatttttgggagttttgggttttgaaaatgtagtagaagataaattaatattaaagttatgggtaagtgtaattttaatttatattattggcgtacttgggagtcggccat

SEQ ID NO: 375280 - DNA, 140 bp, Artificial Sequence
  Synthetic
atggccgactcccaagtacgccaataatataaattaaaattacacttacccataactttaatattaatttatcttctactacattttcaaaacccaaaactcccaaaaatccctattactggagacccagcatggcgtat

SEQ ID NO: 375281 - DNA, 140 bp, Artificial Sequence
  Synthetic
aggccctggctgctgatatgaaattaatattaaagttatgggtaagtgtaattttaatttatattattggattgtataagaataatataatgttgttgggattgtttggattttgtatttgaccttttgggacagcggtg

SEQ ID NO: 375282 - DNA, 140 bp, Artificial Sequence
  Synthetic
caccgctgtcccaaaaggtcaaatacaaaatccaaacaatcccaacaacattatattattcttatacaatccaataatataaattaaaattacacttacccataactttaatattaatttcatatcagcagccagggcct

SEQ ID NO: 375283 - DNA, 140 bp, Artificial Sequence
  Synthetic
atacgccatgctgggtctccatgttttagtttgtggatttaggtaatttgtaaatgaaataatttaagttttgtagttttttttaagagttataatggagttgtggatatatattatattcgtacttgggagtcggccat

SEQ ID NO: 375284 - DNA, 140 bp, Artificial Sequence
  Synthetic
atggccgactcccaagtacgaatataatatatatccacaactccattataactcttaaaaaaaactacaaaacttaaattatttcatttacaaattacctaaatccacaaactaaaacatggagacccagcatggcgtat

SEQ ID NO: 375285 - DNA, 140 bp, Artificial Sequence
  Synthetic
aggccctggctgctgatatgttgtagttttttttaagagttataatggagttgtggatatatattatatttaataggaaggttatagatttttttttgtgatgatggggtgggatatgtagaccttttgggacagcggtg

SEQ ID NO: 375286 - DNA, 140 bp, Artificial Sequence
  Synthetic
caccgctgtcccaaaaggtctacatatcccaccccatcatcacaaaaaaaaatctataaccttcctattaaatataatatatatccacaactccattataactcttaaaaaaaactacaacatatcagcagccagggcct

SEQ ID NO: 375287 - DNA, 140 bp, Artificial Sequence
  Synthetic
atacgccatgctgggtctccattattgataaaattaattaaattatttatgattttattgataattttttatttaattaggataatgatgataattggtggatgggttggagatagtggacgtacttgggagtcggccat

SEQ ID NO: 375288 - DNA, 140 bp, Artificial Sequence
  Synthetic
atggccgactcccaagtacgtccactatctccaacccatccaccaattatcatcattatcctaattaaataaaaaattatcaataaaatcataaataatttaattaattttatcaataatggagacccagcatggcgtat

SEQ ID NO: 375289 - DNA, 140 bp, Artificial Sequence
  Synthetic
aggccctggctgctgatatgatttaattaggataatgatgataattggtggatgggttggagatagtggatttttgtaggaataggtattattggaattattattgtaattattgtttttgaccttttgggacagcggtg

SEQ ID NO: 375290 - DNA, 140 bp, Artificial Sequence
  Synthetic
caccgctgtcccaaaaggtcaaaaacaataattacaataataattccaataatacctattcctacaaaaatccactatctccaacccatccaccaattatcatcattatcctaattaaatcatatcagcagccagggcct

SEQ ID NO: 375291 - DNA, 140 bp, Artificial Sequence
  Synthetic
atacgccatgctgggtctccaagtttgatatatttttagtattttaaattataaattgatattgatatttgaaaattaggttaatgttaagttttgtgtaaaatttgaaagtaggtttatcgtacttgggagtcggccat

SEQ ID NO: 375292 - DNA, 140 bp, Artificial Sequence
  Synthetic
atggccgactcccaagtacgataaacctactttcaaattttacacaaaacttaacattaacctaattttcaaatatcaatatcaatttataatttaaaatactaaaaatatatcaaacttggagacccagcatggcgtat

SEQ ID NO: 375293 - DNA, 140 bp, Artificial Sequence
  Synthetic
aggccctggctgctgatatggaaaattaggttaatgttaagttttgtgtaaaatttgaaagtaggtttataaaaattttttggattggaatgttttgatatttttttttaatattatatagaccttttgggacagcggtg

SEQ ID NO: 375294 - DNA, 140 bp, Artificial Sequence
  Synthetic
caccgctgtcccaaaaggtctatataatattaaaaaaaaatatcaaaacattccaatccaaaaaatttttataaacctactttcaaattttacacaaaacttaacattaacctaattttccatatcagcagccagggcct

SEQ ID NO: 375295 - DNA, 140 bp, Artificial Sequence
  Synthetic
atacgccatgctgggtctcctgtttatttttgtaatttttatttatttatatatttatatttaggaatttttgaattaatttttatatttgtttaggaaagagtttattttttataagaacgtacttgggagtcggccat

SEQ ID NO: 375296 - DNA, 140 bp, Artificial Sequence
  Synthetic
atggccgactcccaagtacgttcttataaaaaataaactctttcctaaacaaatataaaaattaattcaaaaattcctaaatataaatatataaataaataaaaattacaaaaataaacaggagacccagcatggcgtat

SEQ ID NO: 375297 - DNA, 140 bp, Artificial Sequence
  Synthetic
aggccctggctgctgatatgttgaattaatttttatatttgtttaggaaagagtttattttttataagaattttgaggtggtaatttagttaattttatattaagataatatttatttttgaccttttgggacagcggtg

SEQ ID NO: 375298 - DNA, 140 bp, Artificial Sequence
  Synthetic
caccgctgtcccaaaaggtcaaaaataaatattatcttaatataaaattaactaaattaccacctcaaaattcttataaaaaataaactctttcctaaacaaatataaaaattaattcaacatatcagcagccagggcct

SEQ ID NO: 375299 - DNA, 140 bp, Artificial Sequence
  Synthetic
atacgccatgctgggtctccgttgtgagtgtgggagattaaggaatttatgtgttgattagtaaaatttaataggtttttaatttaggataagatttattttttgggataagataataatcgtacttgggagtcggccat

SEQ ID NO: 375300 - DNA, 140 bp, Artificial Sequence
  Synthetic
atggccgactcccaagtacgattattatcttatcccaaaaaataaatcttatcctaaattaaaaacctattaaattttactaatcaacacataaattccttaatctcccacactcacaacggagacccagcatggcgtat

SEQ ID NO: 375301 - DNA, 140 bp, Artificial Sequence
  Synthetic
aggccctggctgctgatatgataggtttttaatttaggataagatttattttttgggataagataataatagattattgtagtagttgaagtattttgtaagttagagtttttatggtttgaccttttgggacagcggtg

SEQ ID NO: 375302 - DNA, 140 bp, Artificial Sequence
  Synthetic
caccgctgtcccaaaaggtcaaaccataaaaactctaacttacaaaatacttcaactactacaataatctattattatcttatcccaaaaaataaatcttatcctaaattaaaaacctatcatatcagcagccagggcct

SEQ ID NO: 375303 - DNA, 140 bp, Artificial Sequence
  Synthetic
atacgccatgctgggtctccgtttgttttatttttagaaaaggatttttatgtgatagtaatttttgtaaaaaggattattaatttgaaagtttaattgattgggagtttttattttttacgtacttgggagtcggccat

SEQ ID NO: 375304 - DNA, 140 bp, Artificial Sequence
  Synthetic
atggccgactcccaagtacgtaaaaaataaaaactcccaatcaattaaactttcaaattaataatcctttttacaaaaattactatcacataaaaatccttttctaaaaataaaacaaacggagacccagcatggcgtat

SEQ ID NO: 375305 - DNA, 140 bp, Artificial Sequence
  Synthetic
aggccctggctgctgatatgaaaggattattaatttgaaagtttaattgattgggagtttttattttttatagtatggaagatttgtggattaattgatttattgtttaatatagttgttgaccttttgggacagcggtg

SEQ ID NO: 375306 - DNA, 140 bp, Artificial Sequence
  Synthetic
caccgctgtcccaaaaggtcaacaactatattaaacaataaatcaattaatccacaaatcttccatactataaaaaataaaaactcccaatcaattaaactttcaaattaataatcctttcatatcagcagccagggcct

SEQ ID NO: 375307 - DNA, 140 bp, Artificial Sequence
  Synthetic
atacgccatgctgggtctcctggtagtttaaaattaattttaaaattattagttgagattgttgagttttgggttaattagaatattaatgaagtagatgatgtaaaattttgtgtttttcgtacttgggagtcggccat

SEQ ID NO: 375308 - DNA, 140 bp, Artificial Sequence
  Synthetic
atggccgactcccaagtacgaaaaacacaaaattttacatcatctacttcattaatattctaattaacccaaaactcaacaatctcaactaataattttaaaattaattttaaactaccaggagacccagcatggcgtat

SEQ ID NO: 375309 - DNA, 140 bp, Artificial Sequence
  Synthetic
aggccctggctgctgatatggggttaattagaatattaatgaagtagatgatgtaaaattttgtgtttttttgatgttgagtgttgttttagtgtggaaattttttaagttatagtttaggaccttttgggacagcggtg

SEQ ID NO: 375310 - DNA, 140 bp, Artificial Sequence
  Synthetic
caccgctgtcccaaaaggtcctaaactataacttaaaaaatttccacactaaaacaacactcaacatcaaaaaaacacaaaattttacatcatctacttcattaatattctaattaaccccatatcagcagccagggcct

SEQ ID NO: 375311 - DNA, 140 bp, Artificial Sequence
  Synthetic
atacgccatgctgggtctccttgaattagtttttgaggtttattaatgtttatatagtgataaaggaggtgtttttgaggtagtattatggtaatagtgggatagataattattaattatcgtacttgggagtcggccat

SEQ ID NO: 375312 - DNA, 140 bp, Artificial Sequence
  Synthetic
atggccgactcccaagtacgataattaataattatctatcccactattaccataatactacctcaaaaacacctcctttatcactatataaacattaataaacctcaaaaactaattcaaggagacccagcatggcgtat

SEQ ID NO: 375313 - DNA, 140 bp, Artificial Sequence
  Synthetic
aggccctggctgctgatatggtttttgaggtagtattatggtaatagtgggatagataattattaattatgtttatatttgtttttttttatgtagtattgtaatttttttgtgagagttgaccttttgggacagcggtg

SEQ ID NO: 375314 - DNA, 140 bp, Artificial Sequence
  Synthetic
caccgctgtcccaaaaggtcaactctcacaaaaaaattacaatactacataaaaaaaaacaaatataaacataattaataattatctatcccactattaccataatactacctcaaaaaccatatcagcagccagggcct

SEQ ID NO: 375315 - DNA, 140 bp, Artificial Sequence
  Synthetic
atacgccatgctgggtctccgaagggtttttttttgtattaggggaatatatttggttagaagatagtataatttagtttgtagggaggataagtaaaataagatgtttttattttttatcgtacttgggagtcggccat

SEQ ID NO: 375316 - DNA, 140 bp, Artificial Sequence
  Synthetic
atggccgactcccaagtacgataaaaaataaaaacatcttattttacttatcctccctacaaactaaattatactatcttctaaccaaatatattcccctaatacaaaaaaaaacccttcggagacccagcatggcgtat

SEQ ID NO: 375317 - DNA, 140 bp, Artificial Sequence
  Synthetic
aggccctggctgctgatatgaatttagtttgtagggaggataagtaaaataagatgtttttattttttatagatggtatttttagagagggggataggataggaataaagataatgattagaccttttgggacagcggtg

SEQ ID NO: 375318 - DNA, 140 bp, Artificial Sequence
  Synthetic
caccgctgtcccaaaaggtctaatcattatctttattcctatcctatccccctctctaaaaataccatctataaaaaataaaaacatcttattttacttatcctccctacaaactaaattcatatcagcagccagggcct

SEQ ID NO: 375319 - DNA, 140 bp, Artificial Sequence
  Synthetic
atacgccatgctgggtctccataatttttttttatttaatatgaaatataatagtgagtatttgttttatgatgttaattatttattgttaaaaataaataaagttagtaagagtgttagcgtacttgggagtcggccat

SEQ ID NO: 375320 - DNA, 140 bp, Artificial Sequence
  Synthetic
atggccgactcccaagtacgctaacactcttactaactttatttatttttaacaataaataattaacatcataaaacaaatactcactattatatttcatattaaataaaaaaaaattatggagacccagcatggcgtat

SEQ ID NO: 375321 - DNA, 140 bp, Artificial Sequence
  Synthetic
aggccctggctgctgatatggatgttaattatttattgttaaaaataaataaagttagtaagagtgttaggattgttatattgtaaggattttttttagaagtgttgaattattttaagtgaccttttgggacagcggtg

SEQ ID NO: 375322 - DNA, 140 bp, Artificial Sequence
  Synthetic
caccgctgtcccaaaaggtcacttaaaataattcaacacttctaaaaaaaatccttacaatataacaatcctaacactcttactaactttatttatttttaacaataaataattaacatccatatcagcagccagggcct

SEQ ID NO: 375323 - DNA, 140 bp, Artificial Sequence
  Synthetic
atacgccatgctgggtctccattgtttgtttttaagatagttttaggaagtttaaaattaagaaaaagaatttatggatatattttagtattgaggatggggtttttttgatgatagtatcgtacttgggagtcggccat

SEQ ID NO: 375324 - DNA, 140 bp, Artificial Sequence
  Synthetic
atggccgactcccaagtacgatactatcatcaaaaaaaccccatcctcaatactaaaatatatccataaattctttttcttaattttaaacttcctaaaactatcttaaaaacaaacaatggagacccagcatggcgtat

SEQ ID NO: 375325 - DNA, 140 bp, Artificial Sequence
  Synthetic
aggccctggctgctgatatgtttatggatatattttagtattgaggatggggtttttttgatgatagtatagttttaggtatagggtagttttatatgtattatattatatagtttaaatgaccttttgggacagcggtg

SEQ ID NO: 375326 - DNA, 140 bp, Artificial Sequence
  Synthetic
caccgctgtcccaaaaggtcatttaaactatataatataatacatataaaactaccctatacctaaaactatactatcatcaaaaaaaccccatcctcaatactaaaatatatccataaacatatcagcagccagggcct

SEQ ID NO: 375327 - DNA, 140 bp, Artificial Sequence
  Synthetic
atacgccatgctgggtctccagattgattttaatttaaatattttgttttgttaatttttatttttttaagatatatgattttgtttttgtgagataaggttattaaatagggtgtgtatcgtacttgggagtcggccat

SEQ ID NO: 375328 - DNA, 140 bp, Artificial Sequence
  Synthetic
atggccgactcccaagtacgatacacaccctatttaataaccttatctcacaaaaacaaaatcatatatcttaaaaaaataaaaattaacaaaacaaaatatttaaattaaaatcaatctggagacccagcatggcgtat

SEQ ID NO: 375329 - DNA, 140 bp, Artificial Sequence
  Synthetic
aggccctggctgctgatatggatatatgattttgtttttgtgagataaggttattaaatagggtgtgtattttttttatatatttgggtttttattaggttagggtttatagttaaggaagaccttttgggacagcggtg

SEQ ID NO: 375330 - DNA, 140 bp, Artificial Sequence
  Synthetic
caccgctgtcccaaaaggtcttccttaactataaaccctaacctaataaaaacccaaatatataaaaaaaatacacaccctatttaataaccttatctcacaaaaacaaaatcatatatccatatcagcagccagggcct

SEQ ID NO: 375331 - DNA, 140 bp, Artificial Sequence
  Synthetic
atacgccatgctgggtctccaatagaaattagaatatttgtgatattttgattataggaaataatttttaatattatttgagattaggttatttttttaatttattttgtaagtaattgtcgtacttgggagtcggccat

SEQ ID NO: 375332 - DNA, 140 bp, Artificial Sequence
  Synthetic
atggccgactcccaagtacgacaattacttacaaaataaattaaaaaaataacctaatctcaaataatattaaaaattatttcctataatcaaaatatcacaaatattctaatttctattggagacccagcatggcgtat

SEQ ID NO: 375333 - DNA, 140 bp, Artificial Sequence
  Synthetic
aggccctggctgctgatatgatattatttgagattaggttatttttttaatttattttgtaagtaattgtttagtattataataataatgttataatttaagaattaagttttgtaataggaccttttgggacagcggtg

SEQ ID NO: 375334 - DNA, 140 bp, Artificial Sequence
  Synthetic
caccgctgtcccaaaaggtcctattacaaaacttaattcttaaattataacattattattataatactaaacaattacttacaaaataaattaaaaaaataacctaatctcaaataatatcatatcagcagccagggcct

SEQ ID NO: 375335 - DNA, 140 bp, Artificial Sequence
  Synthetic
atacgccatgctgggtctccaggagaagttttttttataagtttaagattttattagagataattagaatggttaaagttataggttggtataatttggtaatattaaaatgggagttagcgtacttgggagtcggccat

SEQ ID NO: 375336 - DNA, 140 bp, Artificial Sequence
  Synthetic
atggccgactcccaagtacgctaactcccattttaatattaccaaattataccaacctataactttaaccattctaattatctctaataaaatcttaaacttataaaaaaaacttctcctggagacccagcatggcgtat

SEQ ID NO: 375337 - DNA, 140 bp, Artificial Sequence
  Synthetic
aggccctggctgctgatatgggttaaagttataggttggtataatttggtaatattaaaatgggagttagagtaaggagttgtgtttagtgatttatgtaattttttagtgattttaattgaccttttgggacagcggtg

SEQ ID NO: 375338 - DNA, 140 bp, Artificial Sequence
  Synthetic
caccgctgtcccaaaaggtcaattaaaatcactaaaaaattacataaatcactaaacacaactccttactctaactcccattttaatattaccaaattataccaacctataactttaacccatatcagcagccagggcct

SEQ ID NO: 375339 - DNA, 140 bp, Artificial Sequence
  Synthetic
atacgccatgctgggtctccaaagggtattattttgttaaattgttttaaagtgaatgattttgtttttgtatgggtgatgatttggaatttttttttatatttgtttaaaaattaatagcgtacttgggagtcggccat

SEQ ID NO: 375340 - DNA, 140 bp, Artificial Sequence
  Synthetic
atggccgactcccaagtacgctattaatttttaaacaaatataaaaaaaaattccaaatcatcacccatacaaaaacaaaatcattcactttaaaacaatttaacaaaataataccctttggagacccagcatggcgtat

SEQ ID NO: 375341 - DNA, 140 bp, Artificial Sequence
  Synthetic
aggccctggctgctgatatgtatgggtgatgatttggaatttttttttatatttgtttaaaaattaatagtttgaagtttaaatttttatttgggttttgagggtaatttttgttgttgggaccttttgggacagcggtg

SEQ ID NO: 375342 - DNA, 140 bp, Artificial Sequence
  Synthetic
caccgctgtcccaaaaggtcccaacaacaaaaattaccctcaaaacccaaataaaaatttaaacttcaaactattaatttttaaacaaatataaaaaaaaattccaaatcatcacccatacatatcagcagccagggcct

SEQ ID NO: 375343 - DNA, 140 bp, Artificial Sequence
  Synthetic
atacgccatgctgggtctccttttgaatttaattgttgattggttattaataatatttattaattattttaatatgagaatttaatgagtaaaggattaattgagtatgaggatgttattcgtacttgggagtcggccat

SEQ ID NO: 375344 - DNA, 140 bp, Artificial Sequence
  Synthetic
atggccgactcccaagtacgaataacatcctcatactcaattaatcctttactcattaaattctcatattaaaataattaataaatattattaataaccaatcaacaattaaattcaaaaggagacccagcatggcgtat

SEQ ID NO: 375345 - DNA, 140 bp, Artificial Sequence
  Synthetic
aggccctggctgctgatatgaatatgagaatttaatgagtaaaggattaattgagtatgaggatgttattttttataaggttaaatattattaattttataaataagtttgagattttttgaccttttgggacagcggtg

SEQ ID NO: 375346 - DNA, 140 bp, Artificial Sequence
  Synthetic
caccgctgtcccaaaaggtcaaaaaatctcaaacttatttataaaattaataatatttaaccttataaaaaataacatcctcatactcaattaatcctttactcattaaattctcatattcatatcagcagccagggcct

SEQ ID NO: 375347 - DNA, 140 bp, Artificial Sequence
  Synthetic
atacgccatgctgggtctccagttatgtaattattattattaggattaatatgggttattttgttgaggtttaggaattagataaatttgtgatggatatatgatattttggttttgttacgtacttgggagtcggccat

SEQ ID NO: 375348 - DNA, 140 bp, Artificial Sequence
  Synthetic
atggccgactcccaagtacgtaacaaaaccaaaatatcatatatccatcacaaatttatctaattcctaaacctcaacaaaataacccatattaatcctaataataataattacataactggagacccagcatggcgtat

SEQ ID NO: 375349 - DNA, 140 bp, Artificial Sequence
  Synthetic
aggccctggctgctgatatgttaggaattagataaatttgtgatggatatatgatattttggttttgttaaattttttttattatatgaattgatatttaaatttgttgttatttttaaagaccttttgggacagcggtg

SEQ ID NO: 375350 - DNA, 140 bp, Artificial Sequence
  Synthetic
caccgctgtcccaaaaggtctttaaaaataacaacaaatttaaatatcaattcatataataaaaaaaatttaacaaaaccaaaatatcatatatccatcacaaatttatctaattcctaacatatcagcagccagggcct

SEQ ID NO: 375351 - DNA, 140 bp, Artificial Sequence
  Synthetic
atacgccatgctgggtctccttaattgttgtaataaaaattgtatgatagggttaatattgattttataatttattgtaggatagaattatttttttgtatgattttagtttaattttttcgtacttgggagtcggccat

SEQ ID NO: 375352 - DNA, 140 bp, Artificial Sequence
  Synthetic
atggccgactcccaagtacgaaaaaattaaactaaaatcatacaaaaaaataattctatcctacaataaattataaaatcaatattaaccctatcatacaatttttattacaacaattaaggagacccagcatggcgtat

SEQ ID NO: 375353 - DNA, 140 bp, Artificial Sequence
  Synthetic
aggccctggctgctgatatgtttattgtaggatagaattatttttttgtatgattttagtttaatttttttttatataatgattaataaggagtttgtttaaaatgttataaaagtatatgaccttttgggacagcggtg

SEQ ID NO: 375354 - DNA, 140 bp, Artificial Sequence
  Synthetic
caccgctgtcccaaaaggtcatatacttttataacattttaaacaaactccttattaatcattatataaaaaaaaattaaactaaaatcatacaaaaaaataattctatcctacaataaacatatcagcagccagggcct

SEQ ID NO: 375355 - DNA, 140 bp, Artificial Sequence
  Synthetic
atacgccatgctgggtctccttatatgtgtagttatttgtatagtatgattttagttatgtttttaattaatatttaatttaatagttaatataatgtataattttttatgtttaaagagcgtacttgggagtcggccat

SEQ ID NO: 375356 - DNA, 140 bp, Artificial Sequence
  Synthetic
atggccgactcccaagtacgctctttaaacataaaaaattatacattatattaactattaaattaaatattaattaaaaacataactaaaatcatactatacaaataactacacatataaggagacccagcatggcgtat

SEQ ID NO: 375357 - DNA, 140 bp, Artificial Sequence
  Synthetic
aggccctggctgctgatatgatatttaatttaatagttaatataatgtataattttttatgtttaaagagtagttaaaataatgtgagatttagttttatttatagtatttatttattatgaccttttgggacagcggtg

SEQ ID NO: 375358 - DNA, 140 bp, Artificial Sequence
  Synthetic
caccgctgtcccaaaaggtcataataaataaatactataaataaaactaaatctcacattattttaactactctttaaacataaaaaattatacattatattaactattaaattaaatatcatatcagcagccagggcct

SEQ ID NO: 375359 - DNA, 140 bp, Artificial Sequence
  Synthetic
atacgccatgctgggtctcctagaatgaggaagattaagaaaaagtttataatgttggggaggtaatttttgttattataggatttttttaatttttttattttatgatggttatttaatcgtacttgggagtcggccat

SEQ ID NO: 375360 - DNA, 140 bp, Artificial Sequence
  Synthetic
atggccgactcccaagtacgattaaataaccatcataaaataaaaaaattaaaaaaatcctataataacaaaaattacctccccaacattataaactttttcttaatcttcctcattctaggagacccagcatggcgtat

SEQ ID NO: 375361 - DNA, 140 bp, Artificial Sequence
  Synthetic
aggccctggctgctgatatgtgttattataggatttttttaatttttttattttatgatggttatttaatatatataatattttgatgtaagattgttttttttaattgttttagattaagaccttttgggacagcggtg

SEQ ID NO: 375362 - DNA, 140 bp, Artificial Sequence
  Synthetic
caccgctgtcccaaaaggtcttaatctaaaacaattaaaaaaaacaatcttacatcaaaatattatatatattaaataaccatcataaaataaaaaaattaaaaaaatcctataataacacatatcagcagccagggcct

SEQ ID NO: 375363 - DNA, 140 bp, Artificial Sequence
  Synthetic
atacgccatgctgggtctccttttaaattaaagatatgttgtttattgaaatatatttatagattaaaatatgatattattgttttatgatttattagtgatgtttttgtagttataattcgtacttgggagtcggccat

SEQ ID NO: 375364 - DNA, 140 bp, Artificial Sequence
  Synthetic
atggccgactcccaagtacgaattataactacaaaaacatcactaataaatcataaaacaataatatcatattttaatctataaatatatttcaataaacaacatatctttaatttaaaaggagacccagcatggcgtat

SEQ ID NO: 375365 - DNA, 140 bp, Artificial Sequence
  Synthetic
aggccctggctgctgatatgatgatattattgttttatgatttattagtgatgtttttgtagttataattttaatagattatattgttttgatgttaataaatgttttggtagatagtaagaccttttgggacagcggtg

SEQ ID NO: 375366 - DNA, 140 bp, Artificial Sequence
  Synthetic
caccgctgtcccaaaaggtcttactatctaccaaaacatttattaacatcaaaacaatataatctattaaaattataactacaaaaacatcactaataaatcataaaacaataatatcatcatatcagcagccagggcct

SEQ ID NO: 375367 - DNA, 140 bp, Artificial Sequence
  Synthetic
atacgccatgctgggtctccattatattgtgtaggatgtagttttttttaattattatatgaattagattaaaatataggaaggagtaattatagattaattaaaatagaatatttgtagcgtacttgggagtcggccat

SEQ ID NO: 375368 - DNA, 140 bp, Artificial Sequence
  Synthetic
atggccgactcccaagtacgctacaaatattctattttaattaatctataattactccttcctatattttaatctaattcatataataattaaaaaaaactacatcctacacaatataatggagacccagcatggcgtat

SEQ ID NO: 375369 - DNA, 140 bp, Artificial Sequence
  Synthetic
aggccctggctgctgatatgaaaatataggaaggagtaattatagattaattaaaatagaatatttgtagggttatttataaaaatagatatttatttgttttatttttttggtatgattgaccttttgggacagcggtg

SEQ ID NO: 375370 - DNA, 140 bp, Artificial Sequence
  Synthetic
caccgctgtcccaaaaggtcaatcataccaaaaaaataaaacaaataaatatctatttttataaataaccctacaaatattctattttaattaatctataattactccttcctatattttcatatcagcagccagggcct

SEQ ID NO: 375371 - DNA, 140 bp, Artificial Sequence
  Synthetic
atacgccatgctgggtctccatttggtttgtaatgaatgaggttgttgatattttaggatatggtgattatattttttggaagatttttattgttttattattaatgaatatagttaatgcgtacttgggagtcggccat

SEQ ID NO: 375372 - DNA, 140 bp, Artificial Sequence
  Synthetic
atggccgactcccaagtacgcattaactatattcattaataataaaacaataaaaatcttccaaaaaatataatcaccatatcctaaaatatcaacaacctcattcattacaaaccaaatggagacccagcatggcgtat

SEQ ID NO: 375373 - DNA, 140 bp, Artificial Sequence
  Synthetic
aggccctggctgctgatatgtattttttggaagatttttattgttttattattaatgaatatagttaatgttttatatgtattaattgattggtattaatttaatatttttaaggaggttgaccttttgggacagcggtg

SEQ ID NO: 375374 - DNA, 140 bp, Artificial Sequence
  Synthetic
caccgctgtcccaaaaggtcaacctccttaaaaatattaaattaataccaatcaattaatacatataaaacattaactatattcattaataataaaacaataaaaatcttccaaaaaatacatatcagcagccagggcct

SEQ ID NO: 375375 - DNA, 140 bp, Artificial Sequence
  Synthetic
atacgccatgctgggtctcctatgtgtaaggattttgttataagttgttttaatatttttttgattgttgagttagttaggttggaagatttagtgtttgttgattatttattagtagatcgtacttgggagtcggccat

SEQ ID NO: 375376 - DNA, 140 bp, Artificial Sequence
  Synthetic
atggccgactcccaagtacgatctactaataaataatcaacaaacactaaatcttccaacctaactaactcaacaatcaaaaaaatattaaaacaacttataacaaaatccttacacataggagacccagcatggcgtat

SEQ ID NO: 375377 - DNA, 140 bp, Artificial Sequence
  Synthetic
aggccctggctgctgatatgagttagttaggttggaagatttagtgtttgttgattatttattagtagataatatttaatttttgtataatgtaggagattatttgttgtttatattggggaccttttgggacagcggtg

SEQ ID NO: 375378 - DNA, 140 bp, Artificial Sequence
  Synthetic
caccgctgtcccaaaaggtccccaatataaacaacaaataatctcctacattatacaaaaattaaatattatctactaataaataatcaacaaacactaaatcttccaacctaactaactcatatcagcagccagggcct

SEQ ID NO: 375379 - DNA, 140 bp, Artificial Sequence
  Synthetic
atacgccatgctgggtctccagatttaattatgtttttaatatatagaatgaaaagggtggtttttaatttagatgtattttgtagttatttagatattgtgtgaatttttttttaatagcgtacttgggagtcggccat

SEQ ID NO: 375380 - DNA, 140 bp, Artificial Sequence
  Synthetic
atggccgactcccaagtacgctattaaaaaaaaattcacacaatatctaaataactacaaaatacatctaaattaaaaaccacccttttcattctatatattaaaaacataattaaatctggagacccagcatggcgtat

SEQ ID NO: 375381 - DNA, 140 bp, Artificial Sequence
  Synthetic
aggccctggctgctgatatgtagatgtattttgtagttatttagatattgtgtgaatttttttttaatagagggttgaaaaaattataattgtttaaaatttgtgagttttattaattgtgaccttttgggacagcggtg

SEQ ID NO: 375382 - DNA, 140 bp, Artificial Sequence
  Synthetic
caccgctgtcccaaaaggtcacaattaataaaactcacaaattttaaacaattataattttttcaaccctctattaaaaaaaaattcacacaatatctaaataactacaaaatacatctacatatcagcagccagggcct

SEQ ID NO: 375383 - DNA, 140 bp, Artificial Sequence
  Synthetic
atacgccatgctgggtctcctaaaaatattggggttatttagttttgtatagtgaaaaggttatttaaaaggttaaaaattatgtaatagttttaaaggtattgtggttgattattatttcgtacttgggagtcggccat

SEQ ID NO: 375384 - DNA, 140 bp, Artificial Sequence
  Synthetic
atggccgactcccaagtacgaaataataatcaaccacaatacctttaaaactattacataatttttaaccttttaaataaccttttcactatacaaaactaaataaccccaatatttttaggagacccagcatggcgtat

SEQ ID NO: 375385 - DNA, 140 bp, Artificial Sequence
  Synthetic
aggccctggctgctgatatgggttaaaaattatgtaatagttttaaaggtattgtggttgattattatttttgaaatgtattgtgtatttaagtatagtgttgtaaaatatttttttgatgaccttttgggacagcggtg

SEQ ID NO: 375386 - DNA, 140 bp, Artificial Sequence
  Synthetic
caccgctgtcccaaaaggtcatcaaaaaaatattttacaacactatacttaaatacacaatacatttcaaaaataataatcaaccacaatacctttaaaactattacataatttttaacccatatcagcagccagggcct

SEQ ID NO: 375387 - DNA, 140 bp, Artificial Sequence
  Synthetic
atacgccatgctgggtctccattgaatttttatattaggtgaaattaattttttttatttttaatgattaaagattttttatgggaattttattatttggattattttttattattttttcgtacttgggagtcggccat

SEQ ID NO: 375388 - DNA, 140 bp, Artificial Sequence
  Synthetic
atggccgactcccaagtacgaaaaaataataaaaaataatccaaataataaaattcccataaaaaatctttaatcattaaaaataaaaaaaattaatttcacctaatataaaaattcaatggagacccagcatggcgtat

SEQ ID NO: 375389 - DNA, 140 bp, Artificial Sequence
  Synthetic
aggccctggctgctgatatgaagattttttatgggaattttattatttggattattttttattattttttatgaagattattagtgattttagtatttttattaaagattgtgtaatagtgaccttttgggacagcggtg

SEQ ID NO: 375390 - DNA, 140 bp, Artificial Sequence
  Synthetic
caccgctgtcccaaaaggtcactattacacaatctttaataaaaatactaaaatcactaataatcttcataaaaaataataaaaaataatccaaataataaaattcccataaaaaatcttcatatcagcagccagggcct

SEQ ID NO: 375391 - DNA, 140 bp, Artificial Sequence
  Synthetic
atacgccatgctgggtctccatagtttattttattgatttaatattaaatgtgtatttgaataatttttggagtaagaggatttttttattgagagtgttttataatatgtttaagaattcgtacttgggagtcggccat

SEQ ID NO: 375392 - DNA, 140 bp, Artificial Sequence
  Synthetic
atggccgactcccaagtacgaattcttaaacatattataaaacactctcaataaaaaaatcctcttactccaaaaattattcaaatacacatttaatattaaatcaataaaataaactatggagacccagcatggcgtat

SEQ ID NO: 375393 - DNA, 140 bp, Artificial Sequence
  Synthetic
aggccctggctgctgatatggagtaagaggatttttttattgagagtgttttataatatgtttaagaatttaggtatttattgttttagaattgaaattttttttttttattgaaggaaagaccttttgggacagcggtg

SEQ ID NO: 375394 - DNA, 140 bp, Artificial Sequence
  Synthetic
caccgctgtcccaaaaggtctttccttcaataaaaaaaaaaaatttcaattctaaaacaataaatacctaaattcttaaacatattataaaacactctcaataaaaaaatcctcttactccatatcagcagccagggcct

SEQ ID NO: 375395 - DNA, 140 bp, Artificial Sequence
  Synthetic
atacgccatgctgggtctccaatgtttaaattttttgtgaagtattatttgtagatggtttggttaaagtttttttaagtaatatgatggttgttatagagagggaataaaaggagagttcgtacttgggagtcggccat

SEQ ID NO: 375396 - DNA, 140 bp, Artificial Sequence
  Synthetic
atggccgactcccaagtacgaactctccttttattccctctctataacaaccatcatattacttaaaaaaactttaaccaaaccatctacaaataatacttcacaaaaaatttaaacattggagacccagcatggcgtat

SEQ ID NO: 375397 - DNA, 140 bp, Artificial Sequence
  Synthetic
aggccctggctgctgatatgttttttaagtaatatgatggttgttatagagagggaataaaaggagagttttttttattaagtattttggtattatataagtgatgattttggagagtatgaccttttgggacagcggtg

SEQ ID NO: 375398 - DNA, 140 bp, Artificial Sequence
  Synthetic
caccgctgtcccaaaaggtcatactctccaaaatcatcacttatataataccaaaatacttaataaaaaaaactctccttttattccctctctataacaaccatcatattacttaaaaaacatatcagcagccagggcct

SEQ ID NO: 375399 - DNA, 140 bp, Artificial Sequence
  Synthetic
atacgccatgctgggtctccggtttttaggtatgaatttatagttttttttattaaatattgtaattaatgttatggggtttgtaatgtttttgattggatgtattttttaattttgtaacgtacttgggagtcggccat

SEQ ID NO: 375400 - DNA, 140 bp, Artificial Sequence
  Synthetic
atggccgactcccaagtacgttacaaaattaaaaaatacatccaatcaaaaacattacaaaccccataacattaattacaatatttaataaaaaaaactataaattcatacctaaaaaccggagacccagcatggcgtat

SEQ ID NO: 375401 - DNA, 140 bp, Artificial Sequence
  Synthetic
aggccctggctgctgatatggttatggggtttgtaatgtttttgattggatgtattttttaattttgtaatgttatatgtatgttagtgattattataatttattatataatgtaattttgaccttttgggacagcggtg

SEQ ID NO: 375402 - DNA, 140 bp, Artificial Sequence
  Synthetic
caccgctgtcccaaaaggtcaaaattacattatataataaattataataatcactaacatacatataacattacaaaattaaaaaatacatccaatcaaaaacattacaaaccccataaccatatcagcagccagggcct

SEQ ID NO: 375403 - DNA, 140 bp, Artificial Sequence
  Synthetic
atacgccatgctgggtctccttggtggtattgaggggttttaataaaagttatggattagtattttatgtgtttaaattttattggtagagattaagattgggtttaaattgtgattagtcgtacttgggagtcggccat

SEQ ID NO: 375404 - DNA, 140 bp, Artificial Sequence
  Synthetic
atggccgactcccaagtacgactaatcacaatttaaacccaatcttaatctctaccaataaaatttaaacacataaaatactaatccataacttttattaaaacccctcaataccaccaaggagacccagcatggcgtat

SEQ ID NO: 375405 - DNA, 140 bp, Artificial Sequence
  Synthetic
aggccctggctgctgatatggtttaaattttattggtagagattaagattgggtttaaattgtgattagtagttatgggggataattaatgtattatagtattattagtttttttattaggaccttttgggacagcggtg

SEQ ID NO: 375406 - DNA, 140 bp, Artificial Sequence
  Synthetic
caccgctgtcccaaaaggtcctaataaaaaaactaataatactataatacattaattatcccccataactactaatcacaatttaaacccaatcttaatctctaccaataaaatttaaaccatatcagcagccagggcct

SEQ ID NO: 375407 - DNA, 140 bp, Artificial Sequence
  Synthetic
atacgccatgctgggtctccgtggttgttagtttggttaaagttataagtgtttgtgggatattttttaagtttgatgagatttttgtatatttaggttttatttattttggtaaaaagtcgtacttgggagtcggccat

SEQ ID NO: 375408 - DNA, 140 bp, Artificial Sequence
  Synthetic
atggccgactcccaagtacgactttttaccaaaataaataaaacctaaatatacaaaaatctcatcaaacttaaaaaatatcccacaaacacttataactttaaccaaactaacaaccacggagacccagcatggcgtat

SEQ ID NO: 375409 - DNA, 140 bp, Artificial Sequence
  Synthetic
aggccctggctgctgatatggtttgatgagatttttgtatatttaggttttatttattttggtaaaaagtaatatttgaatggaatttaattattttaattatttaagatagtagttagggaccttttgggacagcggtg

SEQ ID NO: 375410 - DNA, 140 bp, Artificial Sequence
  Synthetic
caccgctgtcccaaaaggtccctaactactatcttaaataattaaaataattaaattccattcaaatattactttttaccaaaataaataaaacctaaatatacaaaaatctcatcaaaccatatcagcagccagggcct

SEQ ID NO: 375411 - DNA, 140 bp, Artificial Sequence
  Synthetic
atacgccatgctgggtctcctagtataggaattgtttttgagtgattaatttttgaaattagatatattttattatgttgtgttgtagttgttttttatatatatttttttgtttggattcgtacttgggagtcggccat

SEQ ID NO: 375412 - DNA, 140 bp, Artificial Sequence
  Synthetic
atggccgactcccaagtacgaatccaaacaaaaaaatatatataaaaaacaactacaacacaacataataaaatatatctaatttcaaaaattaatcactcaaaaacaattcctatactaggagacccagcatggcgtat

SEQ ID NO: 375413 - DNA, 140 bp, Artificial Sequence
  Synthetic
aggccctggctgctgatatgtattatgttgtgttgtagttgttttttatatatatttttttgtttggattttataatattattattttggtttttataagggtttagattttggataattgaccttttgggacagcggtg

SEQ ID NO: 375414 - DNA, 140 bp, Artificial Sequence
  Synthetic
caccgctgtcccaaaaggtcaattatccaaaatctaaacccttataaaaaccaaaataataatattataaaatccaaacaaaaaaatatatataaaaaacaactacaacacaacataatacatatcagcagccagggcct

SEQ ID NO: 375415 - DNA, 140 bp, Artificial Sequence
  Synthetic
atacgccatgctgggtctccttttttaggtattgggtggattattttttttaaatttagaaaagtgtttttattgtaatttgggtgattttgtaattttaggtttattttagttgaagtacgtacttgggagtcggccat

SEQ ID NO: 375416 - DNA, 140 bp, Artificial Sequence
  Synthetic
atggccgactcccaagtacgtacttcaactaaaataaacctaaaattacaaaatcacccaaattacaataaaaacacttttctaaatttaaaaaaaataatccacccaatacctaaaaaaggagacccagcatggcgtat

SEQ ID NO: 375417 - DNA, 140 bp, Artificial Sequence
  Synthetic
aggccctggctgctgatatgtattgtaatttgggtgattttgtaattttaggtttattttagttgaagtattatttgttaatggtgggtatgagtgatattttttatgtatttattgtaagaccttttgggacagcggtg

SEQ ID NO: 375418 - DNA, 140 bp, Artificial Sequence
  Synthetic
caccgctgtcccaaaaggtcttacaataaatacataaaaaatatcactcatacccaccattaacaaataatacttcaactaaaataaacctaaaattacaaaatcacccaaattacaatacatatcagcagccagggcct

SEQ ID NO: 375419 - DNA, 140 bp, Artificial Sequence
  Synthetic
atacgccatgctgggtctccttaaatgtttttggattataggatttaatattttttttttgttagattgttagaaggagtattatatttttggtaaggaataagttaattaatatgttatcgtacttgggagtcggccat

SEQ ID NO: 375420 - DNA, 140 bp, Artificial Sequence
  Synthetic
atggccgactcccaagtacgataacatattaattaacttattccttaccaaaaatataatactccttctaacaatctaacaaaaaaaaaatattaaatcctataatccaaaaacatttaaggagacccagcatggcgtat

SEQ ID NO: 375421 - DNA, 140 bp, Artificial Sequence
  Synthetic
aggccctggctgctgatatgtagaaggagtattatatttttggtaaggaataagttaattaatatgttattttatgtttttgtagattttgaagatgaattagtatgtaaatggttatttgaccttttgggacagcggtg

SEQ ID NO: 375422 - DNA, 140 bp, Artificial Sequence
  Synthetic
caccgctgtcccaaaaggtcaaataaccatttacatactaattcatcttcaaaatctacaaaaacataaaataacatattaattaacttattccttaccaaaaatataatactccttctacatatcagcagccagggcct

SEQ ID NO: 375423 - DNA, 140 bp, Artificial Sequence
  Synthetic
atacgccatgctgggtctccattaagtgggaaaagattataaattttgggatattttgagggaattagaattttattagtatttaaaatgataagtaataatgtagagatattaattttgcgtacttgggagtcggccat

SEQ ID NO: 375424 - DNA, 140 bp, Artificial Sequence
  Synthetic
atggccgactcccaagtacgcaaaattaatatctctacattattacttatcattttaaatactaataaaattctaattccctcaaaatatcccaaaatttataatcttttcccacttaatggagacccagcatggcgtat

SEQ ID NO: 375425 - DNA, 140 bp, Artificial Sequence
  Synthetic
aggccctggctgctgatatgttttattagtatttaaaatgataagtaataatgtagagatattaattttggagaggtttagaaaaataatattttaaagatggaatttatggtttagttagaccttttgggacagcggtg

SEQ ID NO: 375426 - DNA, 140 bp, Artificial Sequence
  Synthetic
caccgctgtcccaaaaggtctaactaaaccataaattccatctttaaaatattatttttctaaacctctccaaaattaatatctctacattattacttatcattttaaatactaataaaacatatcagcagccagggcct

SEQ ID NO: 375427 - DNA, 140 bp, Artificial Sequence
  Synthetic
atacgccatgctgggtctccgtattgttgatattgtttaaatttttagagaatatttttgggtttatatttttgatggtagatagttaataggggtaatattgttatgtatatttgagtacgtacttgggagtcggccat

SEQ ID NO: 375428 - DNA, 140 bp, Artificial Sequence
  Synthetic
atggccgactcccaagtacgtactcaaatatacataacaatattacccctattaactatctaccatcaaaaatataaacccaaaaatattctctaaaaatttaaacaatatcaacaatacggagacccagcatggcgtat

SEQ ID NO: 375429 - DNA, 140 bp, Artificial Sequence
  Synthetic
aggccctggctgctgatatgtttgatggtagatagttaataggggtaatattgttatgtatatttgagtagttttaaattatatggttaaaattttatgagtaatgtgtggaatgtttatgaccttttgggacagcggtg

SEQ ID NO: 375430 - DNA, 140 bp, Artificial Sequence
  Synthetic
caccgctgtcccaaaaggtcataaacattccacacattactcataaaattttaaccatataatttaaaactactcaaatatacataacaatattacccctattaactatctaccatcaaacatatcagcagccagggcct

SEQ ID NO: 375431 - DNA, 140 bp, Artificial Sequence
  Synthetic
atacgccatgctgggtctccgttagtgtttggtttgatgtatttagattggggtggatgattggtgatgggattttttatataggtttaagaattgaggataaaataggttagtttgttacgtacttgggagtcggccat

SEQ ID NO: 375432 - DNA, 140 bp, Artificial Sequence
  Synthetic
atggccgactcccaagtacgtaacaaactaacctattttatcctcaattcttaaacctatataaaaaatcccatcaccaatcatccaccccaatctaaatacatcaaaccaaacactaacggagacccagcatggcgtat

SEQ ID NO: 375433 - DNA, 140 bp, Artificial Sequence
  Synthetic
aggccctggctgctgatatggattttttatataggtttaagaattgaggataaaataggttagtttgttattaagttgaggtgtttattagttgtattaagagaagttattgaattgattgaccttttgggacagcggtg

SEQ ID NO: 375434 - DNA, 140 bp, Artificial Sequence
  Synthetic
caccgctgtcccaaaaggtcaatcaattcaataacttctcttaatacaactaataaacacctcaacttaataacaaactaacctattttatcctcaattcttaaacctatataaaaaatccatatcagcagccagggcct

SEQ ID NO: 375435 - DNA, 140 bp, Artificial Sequence
  Synthetic
atacgccatgctgggtctccttgttttttttttgaggtaagagtaaatttgagtgtataagagattttttaaatgatttttttatattattttggtaatattgtgtattggtataatgatcgtacttgggagtcggccat

SEQ ID NO: 375436 - DNA, 140 bp, Artificial Sequence
  Synthetic
atggccgactcccaagtacgatcattataccaatacacaatattaccaaaataatataaaaaaatcatttaaaaaatctcttatacactcaaatttactcttacctcaaaaaaaaaacaaggagacccagcatggcgtat

SEQ ID NO: 375437 - DNA, 140 bp, Artificial Sequence
  Synthetic
aggccctggctgctgatatgaaatgatttttttatattattttggtaatattgtgtattggtataatgattagtatagtttttatttttttatggttaattgtatgagtaatatagtaatgaccttttgggacagcggtg

SEQ ID NO: 375438 - DNA, 140 bp, Artificial Sequence
  Synthetic
caccgctgtcccaaaaggtcattactatattactcatacaattaaccataaaaaaataaaaactatactaatcattataccaatacacaatattaccaaaataatataaaaaaatcatttcatatcagcagccagggcct

SEQ ID NO: 375439 - DNA, 140 bp, Artificial Sequence
  Synthetic
atacgccatgctgggtctccaggttgtatgtgatagtaatattatattttaaaatgtgattaattttgtagtggttttgtatgatattaggttttggaatatttgtatattttttatttacgtacttgggagtcggccat

SEQ ID NO: 375440 - DNA, 140 bp, Artificial Sequence
  Synthetic
atggccgactcccaagtacgtaaataaaaaatatacaaatattccaaaacctaatatcatacaaaaccactacaaaattaatcacattttaaaatataatattactatcacatacaacctggagacccagcatggcgtat

SEQ ID NO: 375441 - DNA, 140 bp, Artificial Sequence
  Synthetic
aggccctggctgctgatatggtggttttgtatgatattaggttttggaatatttgtatattttttatttaatattatagggtttatatttatttgatgaattgttgtatgagggaagtatgaccttttgggacagcggtg

SEQ ID NO: 375442 - DNA, 140 bp, Artificial Sequence
  Synthetic
caccgctgtcccaaaaggtcatacttccctcatacaacaattcatcaaataaatataaaccctataatattaaataaaaaatatacaaatattccaaaacctaatatcatacaaaaccaccatatcagcagccagggcct

SEQ ID NO: 375443 - DNA, 140 bp, Artificial Sequence
  Synthetic
atacgccatgctgggtctcctattgtaataatgaattgatttatgatttagatttattaagaggaggttttaattgtaatttattgattgatagttttttgatgaagggtttatgtttaacgtacttgggagtcggccat

SEQ ID NO: 375444 - DNA, 140 bp, Artificial Sequence
  Synthetic
atggccgactcccaagtacgttaaacataaacccttcatcaaaaaactatcaatcaataaattacaattaaaacctcctcttaataaatctaaatcataaatcaattcattattacaataggagacccagcatggcgtat

SEQ ID NO: 375445 - DNA, 140 bp, Artificial Sequence
  Synthetic
aggccctggctgctgatatgtaattgtaatttattgattgatagttttttgatgaagggtttatgtttaaatattattgaggatgatttaatatggttgttatatttatttggttgggaagaccttttgggacagcggtg

SEQ ID NO: 375446 - DNA, 140 bp, Artificial Sequence
  Synthetic
caccgctgtcccaaaaggtcttcccaaccaaataaatataacaaccatattaaatcatcctcaataatatttaaacataaacccttcatcaaaaaactatcaatcaataaattacaattacatatcagcagccagggcct

SEQ ID NO: 375447 - DNA, 140 bp, Artificial Sequence
  Synthetic
atacgccatgctgggtctccaatagattttattagtagtggtgaaataagattttttataatttattttttaatgtattttaaaatagggtttttatatagttttggagtttttataagtcgtacttgggagtcggccat

SEQ ID NO: 375448 - DNA, 140 bp, Artificial Sequence
  Synthetic
atggccgactcccaagtacgacttataaaaactccaaaactatataaaaaccctattttaaaatacattaaaaaataaattataaaaaatcttatttcaccactactaataaaatctattggagacccagcatggcgtat

SEQ ID NO: 375449 - DNA, 140 bp, Artificial Sequence
  Synthetic
aggccctggctgctgatatgtaatgtattttaaaatagggtttttatatagttttggagtttttataagtttttatttgggtaatattattttatgtatgaaaaagattggatttatagagaccttttgggacagcggtg

SEQ ID NO: 375450 - DNA, 140 bp, Artificial Sequence
  Synthetic
caccgctgtcccaaaaggtctctataaatccaatctttttcatacataaaataatattacccaaataaaaacttataaaaactccaaaactatataaaaaccctattttaaaatacattacatatcagcagccagggcct

SEQ ID NO: 375451 - DNA, 140 bp, Artificial Sequence
  Synthetic
atacgccatgctgggtctcctttgaatttttaaattgatatttagatatttaagtgttatgtttaggttgatggatatagattttaattttttaatatatattggtgggattgtaggtgacgtacttgggagtcggccat

SEQ ID NO: 375452 - DNA, 140 bp, Artificial Sequence
  Synthetic
atggccgactcccaagtacgtcacctacaatcccaccaatatatattaaaaaattaaaatctatatccatcaacctaaacataacacttaaatatctaaatatcaatttaaaaattcaaaggagacccagcatggcgtat

SEQ ID NO: 375453 - DNA, 140 bp, Artificial Sequence
  Synthetic
aggccctggctgctgatatgatggatatagattttaattttttaatatatattggtgggattgtaggtgattgtggattattggatgttgtaagattatttttttgaattgtaattttaagaccttttgggacagcggtg

SEQ ID NO: 375454 - DNA, 140 bp, Artificial Sequence
  Synthetic
caccgctgtcccaaaaggtcttaaaattacaattcaaaaaaataatcttacaacatccaataatccacaatcacctacaatcccaccaatatatattaaaaaattaaaatctatatccatcatatcagcagccagggcct

SEQ ID NO: 375455 - DNA, 140 bp, Artificial Sequence
  Synthetic
atacgccatgctgggtctccttattatgggttatttatttttttgaaggttaatgttttgatttttttggtgaatttttgaattgagtaaaatttttaattgttgggattgaagatgatacgtacttgggagtcggccat

SEQ ID NO: 375456 - DNA, 140 bp, Artificial Sequence
  Synthetic
atggccgactcccaagtacgtatcatcttcaatcccaacaattaaaaattttactcaattcaaaaattcaccaaaaaaatcaaaacattaaccttcaaaaaaataaataacccataataaggagacccagcatggcgtat

SEQ ID NO: 375457 - DNA, 140 bp, Artificial Sequence
  Synthetic
aggccctggctgctgatatgtgaatttttgaattgagtaaaatttttaattgttgggattgaagatgataaaaataaaggttttatatttttaagatttggagagaaatgttttttaaatgaccttttgggacagcggtg

SEQ ID NO: 375458 - DNA, 140 bp, Artificial Sequence
  Synthetic
caccgctgtcccaaaaggtcatttaaaaaacatttctctccaaatcttaaaaatataaaacctttatttttatcatcttcaatcccaacaattaaaaattttactcaattcaaaaattcacatatcagcagccagggcct

SEQ ID NO: 375459 - DNA, 140 bp, Artificial Sequence
  Synthetic
atacgccatgctgggtctccggtttattggagaggttgatatagatttaagaagattataggtgtaattaatgtgataatagttttatatattattttgttattgggaaattttgattgacgtacttgggagtcggccat

SEQ ID NO: 375460 - DNA, 140 bp, Artificial Sequence
  Synthetic
atggccgactcccaagtacgtcaatcaaaatttcccaataacaaaataatatataaaactattatcacattaattacacctataatcttcttaaatctatatcaacctctccaataaaccggagacccagcatggcgtat

SEQ ID NO: 375461 - DNA, 140 bp, Artificial Sequence
  Synthetic
aggccctggctgctgatatgatgtgataatagttttatatattattttgttattgggaaattttgattgattgtttggtttagattttaataggaataatgatatttttatttttattaggaccttttgggacagcggtg

SEQ ID NO: 375462 - DNA, 140 bp, Artificial Sequence
  Synthetic
caccgctgtcccaaaaggtcctaataaaaataaaaatatcattattcctattaaaatctaaaccaaacaatcaatcaaaatttcccaataacaaaataatatataaaactattatcacatcatatcagcagccagggcct

SEQ ID NO: 375463 - DNA, 140 bp, Artificial Sequence
  Synthetic
atacgccatgctgggtctcctgagatttttatttaaaagtaggtttattttaatattagtaattgagttttttataaaaatgtatgagggtttgataatttattaagggaaattaatagacgtacttgggagtcggccat

SEQ ID NO: 375464 - DNA, 140 bp, Artificial Sequence
  Synthetic
atggccgactcccaagtacgtctattaatttcccttaataaattatcaaaccctcatacatttttataaaaaactcaattactaatattaaaataaacctacttttaaataaaaatctcaggagacccagcatggcgtat

SEQ ID NO: 375465 - DNA, 140 bp, Artificial Sequence
  Synthetic
aggccctggctgctgatatgtttataaaaatgtatgagggtttgataatttattaagggaaattaatagatatatatttggatgaggattataatgttaaagagtttttatttaatttgtgaccttttgggacagcggtg

SEQ ID NO: 375466 - DNA, 140 bp, Artificial Sequence
  Synthetic
caccgctgtcccaaaaggtcacaaattaaataaaaactctttaacattataatcctcatccaaatatatatctattaatttcccttaataaattatcaaaccctcatacatttttataaacatatcagcagccagggcct

SEQ ID NO: 375467 - DNA, 140 bp, Artificial Sequence
  Synthetic
atacgccatgctgggtctccattgaatttttttttgaagaaagttgtagtaatataaaagggttattttaatatttaagaattatggttgatattattatatattgttgttttattggaacgtacttgggagtcggccat

SEQ ID NO: 375468 - DNA, 140 bp, Artificial Sequence
  Synthetic
atggccgactcccaagtacgttccaataaaacaacaatatataataatatcaaccataattcttaaatattaaaataacccttttatattactacaactttcttcaaaaaaaaattcaatggagacccagcatggcgtat

SEQ ID NO: 375469 - DNA, 140 bp, Artificial Sequence
  Synthetic
aggccctggctgctgatatgatatttaagaattatggttgatattattatatattgttgttttattggaattgttttattaatgtattataagttagatgaagtattatgggaatataatgaccttttgggacagcggtg

SEQ ID NO: 375470 - DNA, 140 bp, Artificial Sequence
  Synthetic
caccgctgtcccaaaaggtcattatattcccataatacttcatctaacttataatacattaataaaacaattccaataaaacaacaatatataataatatcaaccataattcttaaatatcatatcagcagccagggcct

SEQ ID NO: 375471 - DNA, 140 bp, Artificial Sequence
  Synthetic
atacgccatgctgggtctccattattgatttaaaaatatggtgttaagaagttatttttgaatatatttgttattgaatatagtattgagagtgaagtgatattaggttatattattttacgtacttgggagtcggccat

SEQ ID NO: 375472 - DNA, 140 bp, Artificial Sequence
  Synthetic
atggccgactcccaagtacgtaaaataatataacctaatatcacttcactctcaatactatattcaataacaaatatattcaaaaataacttcttaacaccatatttttaaatcaataatggagacccagcatggcgtat

SEQ ID NO: 375473 - DNA, 140 bp, Artificial Sequence
  Synthetic
aggccctggctgctgatatgttattgaatatagtattgagagtgaagtgatattaggttatattattttaaggatgttatttttaattatgtttaaaatatattgtggtgagttagaggtgaccttttgggacagcggtg

SEQ ID NO: 375474 - DNA, 140 bp, Artificial Sequence
  Synthetic
caccgctgtcccaaaaggtcacctctaactcaccacaatatattttaaacataattaaaaataacatccttaaaataatataacctaatatcacttcactctcaatactatattcaataacatatcagcagccagggcct

SEQ ID NO: 375475 - DNA, 140 bp, Artificial Sequence
  Synthetic
atacgccatgctgggtctccggtttttaaattaaaaaaataggattttaaatgatgttgatattattattatggatgttgaaattatagaaaatttagattgttttagattatatgaagtcgtacttgggagtcggccat

SEQ ID NO: 375476 - DNA, 140 bp, Artificial Sequence
  Synthetic
atggccgactcccaagtacgacttcatataatctaaaacaatctaaattttctataatttcaacatccataataataatatcaacatcatttaaaatcctatttttttaatttaaaaaccggagacccagcatggcgtat

SEQ ID NO: 375477 - DNA, 140 bp, Artificial Sequence
  Synthetic
aggccctggctgctgatatgatggatgttgaaattatagaaaatttagattgttttagattatatgaagtagtatatatgattatttgtaattatattaattttaaaattttgaaagtgggaccttttgggacagcggtg

SEQ ID NO: 375478 - DNA, 140 bp, Artificial Sequence
  Synthetic
caccgctgtcccaaaaggtcccactttcaaaattttaaaattaatataattacaaataatcatatatactacttcatataatctaaaacaatctaaattttctataatttcaacatccatcatatcagcagccagggcct

SEQ ID NO: 375479 - DNA, 140 bp, Artificial Sequence
  Synthetic
atacgccatgctgggtctccaattattttgtttttatgtttggattaggatatttaattaaatttataatattaagtgtaaagttaagtgagtggtatttatgtttatttaatttattttcgtacttgggagtcggccat

SEQ ID NO: 375480 - DNA, 140 bp, Artificial Sequence
  Synthetic
atggccgactcccaagtacgaaaataaattaaataaacataaataccactcacttaactttacacttaatattataaatttaattaaatatcctaatccaaacataaaaacaaaataattggagacccagcatggcgtat

SEQ ID NO: 375481 - DNA, 140 bp, Artificial Sequence
  Synthetic
aggccctggctgctgatatgattaagtgtaaagttaagtgagtggtatttatgtttatttaatttatttttaattttgagaattatttagtattaaatttaggtaaattgtttttatgttgaccttttgggacagcggtg

SEQ ID NO: 375482 - DNA, 140 bp, Artificial Sequence
  Synthetic
caccgctgtcccaaaaggtcaacataaaaacaatttacctaaatttaatactaaataattctcaaaattaaaaataaattaaataaacataaataccactcacttaactttacacttaatcatatcagcagccagggcct

SEQ ID NO: 375483 - DNA, 140 bp, Artificial Sequence
  Synthetic
atacgccatgctgggtctccttattttattaaatatattataagtagattgtataatagttatattgtatttggtttttttttattagagaaggttttatattataggtataattttgttcgtacttgggagtcggccat

SEQ ID NO: 375484 - DNA, 140 bp, Artificial Sequence
  Synthetic
atggccgactcccaagtacgaacaaaattatacctataatataaaaccttctctaataaaaaaaaaccaaatacaatataactattatacaatctacttataatatatttaataaaataaggagacccagcatggcgtat

SEQ ID NO: 375485 - DNA, 140 bp, Artificial Sequence
  Synthetic
aggccctggctgctgatatgttggtttttttttattagagaaggttttatattataggtataattttgttgatttgagaaatggattattagtttttataatgagatattttgtttttttgaccttttgggacagcggtg

SEQ ID NO: 375486 - DNA, 140 bp, Artificial Sequence
  Synthetic
caccgctgtcccaaaaggtcaaaaaaacaaaatatctcattataaaaactaataatccatttctcaaatcaacaaaattatacctataatataaaaccttctctaataaaaaaaaaccaacatatcagcagccagggcct

SEQ ID NO: 375487 - DNA, 140 bp, Artificial Sequence
  Synthetic
atacgccatgctgggtctccgttgaatttagatttattattttataaaaatatttaagggatggataattaaattagtgaatgattatttaagatttgagttggttatatgggtttttaacgtacttgggagtcggccat

SEQ ID NO: 375488 - DNA, 140 bp, Artificial Sequence
  Synthetic
atggccgactcccaagtacgttaaaaacccatataaccaactcaaatcttaaataatcattcactaatttaattatccatcccttaaatatttttataaaataataaatctaaattcaacggagacccagcatggcgtat

SEQ ID NO: 375489 - DNA, 140 bp, Artificial Sequence
  Synthetic
aggccctggctgctgatatgaaattagtgaatgattatttaagatttgagttggttatatgggtttttaaaaataattttatatggtattatgagttatatttgttattagaatttataggaccttttgggacagcggtg

SEQ ID NO: 375490 - DNA, 140 bp, Artificial Sequence
  Synthetic
caccgctgtcccaaaaggtcctataaattctaataacaaatataactcataataccatataaaattatttttaaaaacccatataaccaactcaaatcttaaataatcattcactaatttcatatcagcagccagggcct

SEQ ID NO: 375491 - DNA, 140 bp, Artificial Sequence
  Synthetic
atacgccatgctgggtctcctttttggtttaaattttatatttatattgaatgagtgatgttgagataaaatttatggattggtttattagtttagttaatatgttttttgaaggttttacgtacttgggagtcggccat

SEQ ID NO: 375492 - DNA, 140 bp, Artificial Sequence
  Synthetic
atggccgactcccaagtacgtaaaaccttcaaaaaacatattaactaaactaataaaccaatccataaattttatctcaacatcactcattcaatataaatataaaatttaaaccaaaaaggagacccagcatggcgtat

SEQ ID NO: 375493 - DNA, 140 bp, Artificial Sequence
  Synthetic
aggccctggctgctgatatgatttatggattggtttattagtttagttaatatgttttttgaaggttttaggtttagtttagtttaattttaattgtattaaaggttttaaaaatattttgaccttttgggacagcggtg

SEQ ID NO: 375494 - DNA, 140 bp, Artificial Sequence
  Synthetic
caccgctgtcccaaaaggtcaaaatatttttaaaacctttaatacaattaaaattaaactaaactaaacctaaaaccttcaaaaaacatattaactaaactaataaaccaatccataaatcatatcagcagccagggcct

SEQ ID NO: 375495 - DNA, 140 bp, Artificial Sequence
  Synthetic
atacgccatgctgggtctccagggattatatttaggattagtttattgatttttttaatatatagagttggaagtattgatttaaggtttttaagatgttttattgattatgttgataatcgtacttgggagtcggccat

SEQ ID NO: 375496 - DNA, 140 bp, Artificial Sequence
  Synthetic
atggccgactcccaagtacgattatcaacataatcaataaaacatcttaaaaaccttaaatcaatacttccaactctatatattaaaaaaatcaataaactaatcctaaatataatccctggagacccagcatggcgtat

SEQ ID NO: 375497 - DNA, 140 bp, Artificial Sequence
  Synthetic
aggccctggctgctgatatggaagtattgatttaaggtttttaagatgttttattgattatgttgataatgtaaataatagttttttttgtttattatgatttaaataattatatttatagaccttttgggacagcggtg

SEQ ID NO: 375498 - DNA, 140 bp, Artificial Sequence
  Synthetic
caccgctgtcccaaaaggtctataaatataattatttaaatcataataaacaaaaaaaactattatttacattatcaacataatcaataaaacatcttaaaaaccttaaatcaatacttccatatcagcagccagggcct

SEQ ID NO: 375499 - DNA, 140 bp, Artificial Sequence
  Synthetic
atacgccatgctgggtctccttagaagttaggttgattttaattatataagtattaagaaaaaattattaagattaatatttttatgttaagaattagtaatgtgttttatatgatagatcgtacttgggagtcggccat

SEQ ID NO: 375500 - DNA, 140 bp, Artificial Sequence
  Synthetic
atggccgactcccaagtacgatctatcatataaaacacattactaattcttaacataaaaatattaatcttaataattttttcttaatacttatataattaaaatcaacctaacttctaaggagacccagcatggcgtat

SEQ ID NO: 375501 - DNA, 140 bp, Artificial Sequence
  Synthetic
aggccctggctgctgatatgagattaatatttttatgttaagaattagtaatgtgttttatatgatagattatttttaatattaaattgtaattttaattttaaagttaagtttaatattgaccttttgggacagcggtg

SEQ ID NO: 375502 - DNA, 140 bp, Artificial Sequence
  Synthetic
caccgctgtcccaaaaggtcaatattaaacttaactttaaaattaaaattacaatttaatattaaaaataatctatcatataaaacacattactaattcttaacataaaaatattaatctcatatcagcagccagggcct

SEQ ID NO: 375503 - DNA, 140 bp, Artificial Sequence
  Synthetic
atacgccatgctgggtctccatgattaatgaattttttattttaattaggtagttgattgataatttataaattttataagatgtttttatgatatttttttgtttttaattttaatgttcgtacttgggagtcggccat

SEQ ID NO: 375504 - DNA, 140 bp, Artificial Sequence
  Synthetic
atggccgactcccaagtacgaacattaaaattaaaaacaaaaaaatatcataaaaacatcttataaaatttataaattatcaatcaactacctaattaaaataaaaaattcattaatcatggagacccagcatggcgtat

SEQ ID NO: 375505 - DNA, 140 bp, Artificial Sequence
  Synthetic
atacgccatgctgggtctccaatgatttaataagtaataataaaaaaattatattaaagatgtaggaagattttgattttgttaggaaaattaagtgtatataaataaattaaaaaatttcgtacttgggagtcggccat

SEQ ID NO: 375506 - DNA, 140 bp, Artificial Sequence
  Synthetic
atggccgactcccaagtacgaaattttttaatttatttatatacacttaattttcctaacaaaatcaaaatcttcctacatctttaatataatttttttattattacttattaaatcattggagacccagcatggcgtat

SEQ ID NO: 375507 - DNA, 140 bp, Artificial Sequence
  Synthetic
atacgccatgctgggtctcctggatatataaaaaagagaaaatatagattttttaatttatttgtgtgtgtttaatttttttggtgaggttaagatttttttgtatttttaatgtgatttcgtacttgggagtcggccat

SEQ ID NO: 375508 - DNA, 140 bp, Artificial Sequence
  Synthetic
atggccgactcccaagtacgaaatcacattaaaaatacaaaaaaatcttaacctcaccaaaaaaattaaacacacacaaataaattaaaaaatctatattttctcttttttatatatccaggagacccagcatggcgtat

SEQ ID NO: 375509 - DNA, 140 bp, Artificial Sequence
  Synthetic
aggccctggctgctgatatgtttaatttttttggtgaggttaagatttttttgtatttttaatgtgatttttttattattatttattaaattattgatattgagattaaaaataaaagaagaccttttgggacagcggtg

SEQ ID NO: 375510 - DNA, 140 bp, Artificial Sequence
  Synthetic
caccgctgtcccaaaaggtcttcttttatttttaatctcaatatcaataatttaataaataataataaaaaaatcacattaaaaatacaaaaaaatcttaacctcaccaaaaaaattaaacatatcagcagccagggcct

SEQ ID NO: 375511 - DNA, 140 bp, Artificial Sequence
  Synthetic
atacgccatgctgggtctccttttattattatttattaaattattgatattgagattaaaaataaaagaatattgtaagaatattttatggaatttgtagattattaattaattgtttagcgtacttgggagtcggccat

SEQ ID NO: 375512 - DNA, 140 bp, Artificial Sequence
  Synthetic
atggccgactcccaagtacgctaaacaattaattaataatctacaaattccataaaatattcttacaatattcttttatttttaatctcaatatcaataatttaataaataataataaaaggagacccagcatggcgtat

SEQ ID NO: 375513 - DNA, 140 bp, Artificial Sequence
  Synthetic
atacgccatgctgggtctccttttatgaaatattttggttgtataggtgttaaatttagttttaaaattgaaattgtaatttagtgttagaaataatttgttatgtgaaatatattattacgtacttgggagtcggccat

SEQ ID NO: 375514 - DNA, 140 bp, Artificial Sequence
  Synthetic
atggccgactcccaagtacgtaataatatatttcacataacaaattatttctaacactaaattacaatttcaattttaaaactaaatttaacacctatacaaccaaaatatttcataaaaggagacccagcatggcgtat

SEQ ID NO: 375515 - DNA, 140 bp, Artificial Sequence
  Synthetic
aggccctggctgctgatatgaaattgtaatttagtgttagaaataatttgttatgtgaaatatattattagtttttggtatgagagtattagttttagtaatttttttttaatatttatggaccttttgggacagcggtg

SEQ ID NO: 375516 - DNA, 140 bp, Artificial Sequence
  Synthetic
caccgctgtcccaaaaggtccataaatattaaaaaaaaattactaaaactaatactctcataccaaaaactaataatatatttcacataacaaattatttctaacactaaattacaatttcatatcagcagccagggcct

SEQ ID NO: 375517 - DNA, 140 bp, Artificial Sequence
  Synthetic
atacgccatgctgggtctccgtaatgatttagttgtgatggttgttatagatatgattatttaagttataatagataggaaaagttattatttatattattaatataattgatagggtgtcgtacttgggagtcggccat

SEQ ID NO: 375518 - DNA, 140 bp, Artificial Sequence
  Synthetic
atggccgactcccaagtacgacaccctatcaattatattaataatataaataataacttttcctatctattataacttaaataatcatatctataacaaccatcacaactaaatcattacggagacccagcatggcgtat

SEQ ID NO: 375519 - DNA, 140 bp, Artificial Sequence
  Synthetic
aggccctggctgctgatatgatagataggaaaagttattatttatattattaatataattgatagggtgttttagaaattttgaattggtgtttttaattttgtgtattggaagagttaagaccttttgggacagcggtg

SEQ ID NO: 375520 - DNA, 140 bp, Artificial Sequence
  Synthetic
caccgctgtcccaaaaggtcttaactcttccaatacacaaaattaaaaacaccaattcaaaatttctaaaacaccctatcaattatattaataatataaataataacttttcctatctatcatatcagcagccagggcct

SEQ ID NO: 375521 - DNA, 140 bp, Artificial Sequence
  Synthetic
atacgccatgctgggtctccgattttgatatatatttggttatttaaaatatttttagagtttttggtgtagttagaattagattgaattagatttgaaatttttaggaaatatattgatcgtacttgggagtcggccat

SEQ ID NO: 375522 - DNA, 140 bp, Artificial Sequence
  Synthetic
atggccgactcccaagtacgatcaatatatttcctaaaaatttcaaatctaattcaatctaattctaactacaccaaaaactctaaaaatattttaaataaccaaatatatatcaaaatcggagacccagcatggcgtat

SEQ ID NO: 375523 - DNA, 140 bp, Artificial Sequence
  Synthetic
aggccctggctgctgatatgagttagaattagattgaattagatttgaaatttttaggaaatatattgattaggttggtgagttggtttataagttttattttagtattatttatttggtgaccttttgggacagcggtg

SEQ ID NO: 375524 - DNA, 140 bp, Artificial Sequence
  Synthetic
caccgctgtcccaaaaggtcaccaaataaataatactaaaataaaacttataaaccaactcaccaacctaatcaatatatttcctaaaaatttcaaatctaattcaatctaattctaactcatatcagcagccagggcct

SEQ ID NO: 375525 - DNA, 140 bp, Artificial Sequence
  Synthetic
atacgccatgctgggtctccgtatgattaaattgatggtaaatatttataagttttggtagtaagtataatttatggtgttatgtagaattatttttaagagtttgtataattaatttaacgtacttgggagtcggccat

SEQ ID NO: 375526 - DNA, 140 bp, Artificial Sequence
  Synthetic
atggccgactcccaagtacgttaaattaattatacaaactcttaaaaataattctacataacaccataaattatacttactaccaaaacttataaatatttaccatcaatttaatcatacggagacccagcatggcgtat

SEQ ID NO: 375527 - DNA, 140 bp, Artificial Sequence
  Synthetic
aggccctggctgctgatatgtttatggtgttatgtagaattatttttaagagtttgtataattaatttaaattttagataattatttattagtttagttatttgttttttggatgtttttgaccttttgggacagcggtg

SEQ ID NO: 375528 - DNA, 140 bp, Artificial Sequence
  Synthetic
caccgctgtcccaaaaggtcaaaaacatccaaaaaacaaataactaaactaataaataattatctaaaatttaaattaattatacaaactcttaaaaataattctacataacaccataaacatatcagcagccagggcct

SEQ ID NO: 375529 - DNA, 140 bp, Artificial Sequence
  Synthetic
atacgccatgctgggtctcctattaatttttggattttagtttggaggagggtaaggtgttttgttatagaaattaatggtttattttttgaattaataaggttatatttatgatataggcgtacttgggagtcggccat

SEQ ID NO: 375530 - DNA, 140 bp, Artificial Sequence
  Synthetic
atggccgactcccaagtacgcctatatcataaatataaccttattaattcaaaaaataaaccattaatttctataacaaaacaccttaccctcctccaaactaaaatccaaaaattaataggagacccagcatggcgtat

SEQ ID NO: 375531 - DNA, 140 bp, Artificial Sequence
  Synthetic
aggccctggctgctgatatgaaattaatggtttattttttgaattaataaggttatatttatgatataggattttttttaatgaaggaaaattaaatgtaatataattattgtgtaatttgaccttttgggacagcggtg

SEQ ID NO: 375532 - DNA, 140 bp, Artificial Sequence
  Synthetic
caccgctgtcccaaaaggtcaaattacacaataattatattacatttaattttccttcattaaaaaaaatcctatatcataaatataaccttattaattcaaaaaataaaccattaatttcatatcagcagccagggcct

SEQ ID NO: 375533 - DNA, 140 bp, Artificial Sequence
  Synthetic
atacgccatgctgggtctcctttgttgttgaagagtatattgtatgatatggagatagtttgtttgggtttgatgttgagtagtttttaaggttgaaagtagattagataagtataaatacgtacttgggagtcggccat

SEQ ID NO: 375534 - DNA, 140 bp, Artificial Sequence
  Synthetic
atggccgactcccaagtacgtatttatacttatctaatctactttcaaccttaaaaactactcaacatcaaacccaaacaaactatctccatatcatacaatatactcttcaacaacaaaggagacccagcatggcgtat

SEQ ID NO: 375535 - DNA, 140 bp, Artificial Sequence
  Synthetic
aggccctggctgctgatatgtgatgttgagtagtttttaaggttgaaagtagattagataagtataaatattatttatttgattttgtatttgatgttataggtttgattaaatattttggaccttttgggacagcggtg

SEQ ID NO: 375536 - DNA, 140 bp, Artificial Sequence
  Synthetic
caccgctgtcccaaaaggtccaaaatatttaatcaaacctataacatcaaatacaaaatcaaataaataatatttatacttatctaatctactttcaaccttaaaaactactcaacatcacatatcagcagccagggcct

SEQ ID NO: 375537 - DNA, 140 bp, Artificial Sequence
  Synthetic
atacgccatgctgggtctccttgttgaggaagatttttaagatgattatttttaaagttttaggattgatatgattataaataattgtatatattgttttatataatttggaatgatttacgtacttgggagtcggccat

SEQ ID NO: 375538 - DNA, 140 bp, Artificial Sequence
  Synthetic
atggccgactcccaagtacgtaaatcattccaaattatataaaacaatatatacaattatttataatcatatcaatcctaaaactttaaaaataatcatcttaaaaatcttcctcaacaaggagacccagcatggcgtat

SEQ ID NO: 375539 - DNA, 140 bp, Artificial Sequence
  Synthetic
aggccctggctgctgatatgatgattataaataattgtatatattgttttatataatttggaatgatttaagttttttgtagttttagtatttatggtaataatattagtattatttggagaccttttgggacagcggtg

SEQ ID NO: 375540 - DNA, 140 bp, Artificial Sequence
  Synthetic
caccgctgtcccaaaaggtctccaaataatactaatattattaccataaatactaaaactacaaaaaacttaaatcattccaaattatataaaacaatatatacaattatttataatcatcatatcagcagccagggcct

SEQ ID NO: 375541 - DNA, 140 bp, Artificial Sequence
  Synthetic
atacgccatgctgggtctccttgattagttgagttatttaatatgatttttagtttattatgatgtgttttaggtataattgggagtagtatttttggagtggtgtaatttgatattattcgtacttgggagtcggccat

SEQ ID NO: 375542 - DNA, 140 bp, Artificial Sequence
  Synthetic
atggccgactcccaagtacgaataatatcaaattacaccactccaaaaatactactcccaattatacctaaaacacatcataataaactaaaaatcatattaaataactcaactaatcaaggagacccagcatggcgtat

SEQ ID NO: 375543 - DNA, 140 bp, Artificial Sequence
  Synthetic
aggccctggctgctgatatgtaggtataattgggagtagtatttttggagtggtgtaatttgatattattttatttttaatattatgtttagtagtaagtgtatttaaaaataattttttgaccttttgggacagcggtg

SEQ ID NO: 375544 - DNA, 140 bp, Artificial Sequence
  Synthetic
caccgctgtcccaaaaggtcaaaaaattatttttaaatacacttactactaaacataatattaaaaataaaataatatcaaattacaccactccaaaaatactactcccaattatacctacatatcagcagccagggcct

SEQ ID NO: 375545 - DNA, 140 bp, Artificial Sequence
  Synthetic
atacgccatgctgggtctccttagggttatagttgatttaaatttattatatttttatagtattttatttaatttataatgtattgatgaaataattttagtgaagtgataatatatggtcgtacttgggagtcggccat

SEQ ID NO: 375546 - DNA, 140 bp, Artificial Sequence
  Synthetic
atggccgactcccaagtacgaccatatattatcacttcactaaaattatttcatcaatacattataaattaaataaaatactataaaaatataataaatttaaatcaactataaccctaaggagacccagcatggcgtat

SEQ ID NO: 375547 - DNA, 140 bp, Artificial Sequence
  Synthetic
aggccctggctgctgatatgaatttataatgtattgatgaaataattttagtgaagtgataatatatggtagtattaattatggtttttaaatgttgaagtaatttttttatattattgtgaccttttgggacagcggtg

SEQ ID NO: 375548 - DNA, 140 bp, Artificial Sequence
  Synthetic
caccgctgtcccaaaaggtcacaataatataaaaaaattacttcaacatttaaaaaccataattaatactaccatatattatcacttcactaaaattatttcatcaatacattataaattcatatcagcagccagggcct

SEQ ID NO: 375549 - DNA, 140 bp, Artificial Sequence
  Synthetic
atacgccatgctgggtctccttaaagaatggtattattaaatgatgtggattggatgggaattttttggtattgtgatttttatttaaatgtgtatttgttaattttttttggtgggttgcgtacttgggagtcggccat

SEQ ID NO: 375550 - DNA, 140 bp, Artificial Sequence
  Synthetic
atggccgactcccaagtacgcaacccaccaaaaaaaattaacaaatacacatttaaataaaaatcacaataccaaaaaattcccatccaatccacatcatttaataataccattctttaaggagacccagcatggcgtat

SEQ ID NO: 375551 - DNA, 140 bp, Artificial Sequence
  Synthetic
aggccctggctgctgatatgattgtgatttttatttaaatgtgtatttgttaattttttttggtgggttgttgaatttttatatatttttgtaggaggtttggttgttgatgttggagtggaccttttgggacagcggtg

SEQ ID NO: 375552 - DNA, 140 bp, Artificial Sequence
  Synthetic
caccgctgtcccaaaaggtccactccaacatcaacaaccaaacctcctacaaaaatatataaaaattcaacaacccaccaaaaaaaattaacaaatacacatttaaataaaaatcacaatcatatcagcagccagggcct

SEQ ID NO: 375553 - DNA, 140 bp, Artificial Sequence
  Synthetic
atacgccatgctgggtctccgtttttttggattatttgtttaattttggtaggaatgaaagtattattgtttttattaaggtttaggttaggtggttgattagaattttttagtggtaaacgtacttgggagtcggccat

SEQ ID NO: 375554 - DNA, 140 bp, Artificial Sequence
  Synthetic
atggccgactcccaagtacgtttaccactaaaaaattctaatcaaccacctaacctaaaccttaataaaaacaataatactttcattcctaccaaaattaaacaaataatccaaaaaaacggagacccagcatggcgtat

SEQ ID NO: 375555 - DNA, 140 bp, Artificial Sequence
  Synthetic
aggccctggctgctgatatgttttattaaggtttaggttaggtggttgattagaattttttagtggtaaaatgatatgtggagttgttgttgtgttagttgtatttatagtttttttagggaccttttgggacagcggtg

SEQ ID NO: 375556 - DNA, 140 bp, Artificial Sequence
  Synthetic
caccgctgtcccaaaaggtccctaaaaaaactataaatacaactaacacaacaacaactccacatatcattttaccactaaaaaattctaatcaaccacctaacctaaaccttaataaaacatatcagcagccagggcct

SEQ ID NO: 375557 - DNA, 140 bp, Artificial Sequence
  Synthetic
atacgccatgctgggtctccttgtatttttgtaattataaattagatttgaagagtatttttttttagattttgaaagtatagagtttttatttttattatttttagttttaataattagcgtacttgggagtcggccat

SEQ ID NO: 375558 - DNA, 140 bp, Artificial Sequence
  Synthetic
atggccgactcccaagtacgctaattattaaaactaaaaataataaaaataaaaactctatactttcaaaatctaaaaaaaaatactcttcaaatctaatttataattacaaaaatacaaggagacccagcatggcgtat

SEQ ID NO: 375559 - DNA, 140 bp, Artificial Sequence
  Synthetic
aggccctggctgctgatatgtttgaaagtatagagtttttatttttattatttttagttttaataattagagattttatttggtttaaaaatttgttaggaggattagagtgttggttttgaccttttgggacagcggtg

SEQ ID NO: 375560 - DNA, 140 bp, Artificial Sequence
  Synthetic
caccgctgtcccaaaaggtcaaaaccaacactctaatcctcctaacaaatttttaaaccaaataaaatctctaattattaaaactaaaaataataaaaataaaaactctatactttcaaacatatcagcagccagggcct

SEQ ID NO: 375561 - DNA, 140 bp, Artificial Sequence
  Synthetic
atacgccatgctgggtctcctattttttaataaagtttaagaaagttgaaattgtaatttggagaaataattttgtagtgtttgataatttatggttatttgtagttttattaatatatacgtacttgggagtcggccat

SEQ ID NO: 375562 - DNA, 140 bp, Artificial Sequence
  Synthetic
atggccgactcccaagtacgtatatattaataaaactacaaataaccataaattatcaaacactacaaaattatttctccaaattacaatttcaactttcttaaactttattaaaaaataggagacccagcatggcgtat

SEQ ID NO: 375563 - DNA, 140 bp, Artificial Sequence
  Synthetic
aggccctggctgctgatatgttttgtagtgtttgataatttatggttatttgtagttttattaatatatattgagaagttggggtttatatttattaatttggatatgatatttgagtgtgaccttttgggacagcggtg

SEQ ID NO: 375564 - DNA, 140 bp, Artificial Sequence
  Synthetic
caccgctgtcccaaaaggtcacactcaaatatcatatccaaattaataaatataaaccccaacttctcaatatatattaataaaactacaaataaccataaattatcaaacactacaaaacatatcagcagccagggcct

SEQ ID NO: 375565 - DNA, 140 bp, Artificial Sequence
  Synthetic
atacgccatgctgggtctccttgattttggagatagtatagaaattttgtgagtttgattttttttgtgtatagaatagtattatttaaataaaaatttatgagggttttaaaattgtatcgtacttgggagtcggccat

SEQ ID NO: 375566 - DNA, 140 bp, Artificial Sequence
  Synthetic
atggccgactcccaagtacgatacaattttaaaaccctcataaatttttatttaaataatactattctatacacaaaaaaaatcaaactcacaaaatttctatactatctccaaaatcaaggagacccagcatggcgtat

SEQ ID NO: 375567 - DNA, 140 bp, Artificial Sequence
  Synthetic
aggccctggctgctgatatgatagaatagtattatttaaataaaaatttatgagggttttaaaattgtatagaagttttattttgggatatgttaagaagtgggttgtgaaggattttgtgaccttttgggacagcggtg

SEQ ID NO: 375568 - DNA, 140 bp, Artificial Sequence
  Synthetic
caccgctgtcccaaaaggtcacaaaatccttcacaacccacttcttaacatatcccaaaataaaacttctatacaattttaaaaccctcataaatttttatttaaataatactattctatcatatcagcagccagggcct

SEQ ID NO: 375569 - DNA, 140 bp, Artificial Sequence
  Synthetic
atacgccatgctgggtctccttgattgtaagattgtttttgttaatttttagttggataaatgtggtaattgtattaagttatttttaataatatttaaatgtgggttttttattaaaggcgtacttgggagtcggccat

SEQ ID NO: 375570 - DNA, 140 bp, Artificial Sequence
  Synthetic
atggccgactcccaagtacgcctttaataaaaaacccacatttaaatattattaaaaataacttaatacaattaccacatttatccaactaaaaattaacaaaaacaatcttacaatcaaggagacccagcatggcgtat

SEQ ID NO: 375571 - DNA, 140 bp, Artificial Sequence
  Synthetic
aggccctggctgctgatatgtgtattaagttatttttaataatatttaaatgtgggttttttattaaaggattgttaattgataagttgtagttgagatttttttttagtggatttgaatgaccttttgggacagcggtg

SEQ ID NO: 375572 - DNA, 140 bp, Artificial Sequence
  Synthetic
caccgctgtcccaaaaggtcattcaaatccactaaaaaaaaatctcaactacaacttatcaattaacaatcctttaataaaaaacccacatttaaatattattaaaaataacttaatacacatatcagcagccagggcct

SEQ ID NO: 375573 - DNA, 140 bp, Artificial Sequence
  Synthetic
atacgccatgctgggtctccgttgtgtatgttaagtattgggttggtattttttttgtataataatttgttaggtgaatatgggttttgtgatattgaatagaagatgtataagtgttttcgtacttgggagtcggccat

SEQ ID NO: 375574 - DNA, 140 bp, Artificial Sequence
  Synthetic
atggccgactcccaagtacgaaaacacttatacatcttctattcaatatcacaaaacccatattcacctaacaaattattatacaaaaaaaataccaacccaatacttaacatacacaacggagacccagcatggcgtat

SEQ ID NO: 375575 - DNA, 140 bp, Artificial Sequence
  Synthetic
aggccctggctgctgatatgtaggtgaatatgggttttgtgatattgaatagaagatgtataagtgttttgaaatttaatgttatataaggttattgtaaagttaattatattttgaaatgaccttttgggacagcggtg

SEQ ID NO: 375576 - DNA, 140 bp, Artificial Sequence
  Synthetic
caccgctgtcccaaaaggtcatttcaaaatataattaactttacaataaccttatataacattaaatttcaaaacacttatacatcttctattcaatatcacaaaacccatattcacctacatatcagcagccagggcct

SEQ ID NO: 375577 - DNA, 140 bp, Artificial Sequence
  Synthetic
atacgccatgctgggtctcctgtgttggtagatattattaagtgtgttgttgtgttatttatgtggttagttataaaggagtgagggttatattgattattatattgatgtataatattacgtacttgggagtcggccat

SEQ ID NO: 375578 - DNA, 140 bp, Artificial Sequence
  Synthetic
atggccgactcccaagtacgtaatattatacatcaatataataatcaatataaccctcactcctttataactaaccacataaataacacaacaacacacttaataatatctaccaacacaggagacccagcatggcgtat

SEQ ID NO: 375579 - DNA, 140 bp, Artificial Sequence
  Synthetic
aggccctggctgctgatatgttataaaggagtgagggttatattgattattatattgatgtataatattattggagtaatgtgagggggttatttgaagaattttttgtatatttaagttgaccttttgggacagcggtg

SEQ ID NO: 375580 - DNA, 140 bp, Artificial Sequence
  Synthetic
caccgctgtcccaaaaggtcaacttaaatatacaaaaaattcttcaaataaccccctcacattactccaataatattatacatcaatataataatcaatataaccctcactcctttataacatatcagcagccagggcct

SEQ ID NO: 375581 - DNA, 140 bp, Artificial Sequence
  Synthetic
atacgccatgctgggtctcctttgagtgatttaggttaatttagaggttaatttaatagttttttttaatgtagttgatgggtattttggtttaatagtgggttgatttattttgtttttcgtacttgggagtcggccat

SEQ ID NO: 375582 - DNA, 140 bp, Artificial Sequence
  Synthetic
atggccgactcccaagtacgaaaaacaaaataaatcaacccactattaaaccaaaatacccatcaactacattaaaaaaaactattaaattaacctctaaattaacctaaatcactcaaaggagacccagcatggcgtat

SEQ ID NO: 375583 - DNA, 140 bp, Artificial Sequence
  Synthetic
aggccctggctgctgatatggtagttgatgggtattttggtttaatagtgggttgatttattttgtttttagtttttgagtttatgtagggaattttattattaattgtttattttaattgaccttttgggacagcggtg

SEQ ID NO: 375584 - DNA, 140 bp, Artificial Sequence
  Synthetic
caccgctgtcccaaaaggtcaattaaaataaacaattaataataaaattccctacataaactcaaaaactaaaaacaaaataaatcaacccactattaaaccaaaatacccatcaactaccatatcagcagccagggcct

SEQ ID NO: 375585 - DNA, 140 bp, Artificial Sequence
  Synthetic
atacgccatgctgggtctccatatatggattagaattgtttgtggatgaatattttatatattgtttgtaaggttttaattatgtggtttggaattgtttaggtatatatggtagtgttgcgtacttgggagtcggccat

SEQ ID NO: 375586 - DNA, 140 bp, Artificial Sequence
  Synthetic
atggccgactcccaagtacgcaacactaccatatatacctaaacaattccaaaccacataattaaaaccttacaaacaatatataaaatattcatccacaaacaattctaatccatatatggagacccagcatggcgtat

SEQ ID NO: 375587 - DNA, 140 bp, Artificial Sequence
  Synthetic
aggccctggctgctgatatgaggttttaattatgtggtttggaattgtttaggtatatatggtagtgttgtttttattaattgtttattattaaggatatgagtttaggagtattttttagaccttttgggacagcggtg

SEQ ID NO: 375588 - DNA, 140 bp, Artificial Sequence
  Synthetic
caccgctgtcccaaaaggtctaaaaaatactcctaaactcatatccttaataataaacaattaataaaaacaacactaccatatatacctaaacaattccaaaccacataattaaaacctcatatcagcagccagggcct

SEQ ID NO: 375589 - DNA, 140 bp, Artificial Sequence
  Synthetic
atacgccatgctgggtctcctaaagttgggttataatggtttaggtaattaaattatagattttatttttgaagtgttatttttttgagtttttttaagattggtgtttttgtattattgcgtacttgggagtcggccat

SEQ ID NO: 375590 - DNA, 140 bp, Artificial Sequence
  Synthetic
atggccgactcccaagtacgcaataatacaaaaacaccaatcttaaaaaaactcaaaaaaataacacttcaaaaataaaatctataatttaattacctaaaccattataacccaactttaggagacccagcatggcgtat

SEQ ID NO: 375591 - DNA, 140 bp, Artificial Sequence
  Synthetic
aggccctggctgctgatatggaagtgttatttttttgagtttttttaagattggtgtttttgtattattgtttattattttggatgttaataaagttttggtttttttgaggtattttaagaccttttgggacagcggtg

SEQ ID NO: 375592 - DNA, 140 bp, Artificial Sequence
  Synthetic
caccgctgtcccaaaaggtcttaaaatacctcaaaaaaaccaaaactttattaacatccaaaataataaacaataatacaaaaacaccaatcttaaaaaaactcaaaaaaataacacttccatatcagcagccagggcct

SEQ ID NO: 375593 - DNA, 140 bp, Artificial Sequence
  Synthetic
atacgccatgctgggtctccaatggtttattatgggtgttgaagaaagtaattatttatatattaatttgtttttaagatttgtagaagtgtgaaataatgtgttgattaatttgtttttcgtacttgggagtcggccat

SEQ ID NO: 375594 - DNA, 140 bp, Artificial Sequence
  Synthetic
atggccgactcccaagtacgaaaaacaaattaatcaacacattatttcacacttctacaaatcttaaaaacaaattaatatataaataattactttcttcaacacccataataaaccattggagacccagcatggcgtat

SEQ ID NO: 375595 - DNA, 140 bp, Artificial Sequence
  Synthetic
aggccctggctgctgatatgtttttaagatttgtagaagtgtgaaataatgtgttgattaatttgttttttgttgaaagtgtgatattttttttgataatttgatgaaggaaagatgttagaccttttgggacagcggtg

SEQ ID NO: 375596 - DNA, 140 bp, Artificial Sequence
  Synthetic
caccgctgtcccaaaaggtctaacatctttccttcatcaaattatcaaaaaaaatatcacactttcaacaaaaaacaaattaatcaacacattatttcacacttctacaaatcttaaaaacatatcagcagccagggcct

SEQ ID NO: 375597 - DNA, 140 bp, Artificial Sequence
  Synthetic
atacgccatgctgggtctccattgtgttataattttttgggttttttgtaataagtgtatgaaagatattatttatatttattattgatagataatgttttaattgaaataggtttgaagcgtacttgggagtcggccat

SEQ ID NO: 375598 - DNA, 140 bp, Artificial Sequence
  Synthetic
atggccgactcccaagtacgcttcaaacctatttcaattaaaacattatctatcaataataaatataaataatatctttcatacacttattacaaaaaacccaaaaaattataacacaatggagacccagcatggcgtat

SEQ ID NO: 375599 - DNA, 140 bp, Artificial Sequence
  Synthetic
aggccctggctgctgatatgatttatatttattattgatagataatgttttaattgaaataggtttgaagttataggattatttaagttgtgataaaggtatttttttggatttaggaaggaccttttgggacagcggtg

SEQ ID NO: 375600 - DNA, 140 bp, Artificial Sequence
  Synthetic
caccgctgtcccaaaaggtccttcctaaatccaaaaaaatacctttatcacaacttaaataatcctataacttcaaacctatttcaattaaaacattatctatcaataataaatataaatcatatcagcagccagggcct

SEQ ID NO: 375601 - DNA, 140 bp, Artificial Sequence
  Synthetic
atacgccatgctgggtctccgaaattaagaggtttattgattgttaattgtttaaggtttgaatttttatggaaattaaggtgatgatgttgtaagatttgaatagagaaatatgtatgacgtacttgggagtcggccat

SEQ ID NO: 375602 - DNA, 140 bp, Artificial Sequence
  Synthetic
atggccgactcccaagtacgtcatacatatttctctattcaaatcttacaacatcatcaccttaatttccataaaaattcaaaccttaaacaattaacaatcaataaacctcttaatttcggagacccagcatggcgtat

SEQ ID NO: 375603 - DNA, 140 bp, Artificial Sequence
  Synthetic
aggccctggctgctgatatgggaaattaaggtgatgatgttgtaagatttgaatagagaaatatgtatgaaaggtagttgtaatatggtatggtaaaatatgtttagttttggagattgagaccttttgggacagcggtg

SEQ ID NO: 375604 - DNA, 140 bp, Artificial Sequence
  Synthetic
caccgctgtcccaaaaggtctcaatctccaaaactaaacatattttaccataccatattacaactacctttcatacatatttctctattcaaatcttacaacatcatcaccttaatttcccatatcagcagccagggcct

SEQ ID NO: 375605 - DNA, 140 bp, Artificial Sequence
  Synthetic
atacgccatgctgggtctccaaattgtatttgagagaggggttattttagttgttgttttgagtgattgaggtaattgaattttgtttaagtattgttttttgttaaaatagataaagttcgtacttgggagtcggccat

SEQ ID NO: 375606 - DNA, 140 bp, Artificial Sequence
  Synthetic
atggccgactcccaagtacgaactttatctattttaacaaaaaacaatacttaaacaaaattcaattacctcaatcactcaaaacaacaactaaaataacccctctctcaaatacaatttggagacccagcatggcgtat

SEQ ID NO: 375607 - DNA, 140 bp, Artificial Sequence
  Synthetic
aggccctggctgctgatatgggtaattgaattttgtttaagtattgttttttgttaaaatagataaagtttgagtgtatgaaagttttattaggtttgaggaatattttataggtatttggaccttttgggacagcggtg

SEQ ID NO: 375608 - DNA, 140 bp, Artificial Sequence
  Synthetic
caccgctgtcccaaaaggtccaaatacctataaaatattcctcaaacctaataaaactttcatacactcaaactttatctattttaacaaaaaacaatacttaaacaaaattcaattacccatatcagcagccagggcct

SEQ ID NO: 375609 - DNA, 140 bp, Artificial Sequence
  Synthetic
atacgccatgctgggtctcctttttttgtttatttggattagattttagtggaaagattgataatattgtaatatattgattattttttatgattgttgattgtaatttgaatttggtttcgtacttgggagtcggccat

SEQ ID NO: 375610 - DNA, 140 bp, Artificial Sequence
  Synthetic
atggccgactcccaagtacgaaaccaaattcaaattacaatcaacaatcataaaaaataatcaatatattacaatattatcaatctttccactaaaatctaatccaaataaacaaaaaaaggagacccagcatggcgtat

SEQ ID NO: 375611 - DNA, 140 bp, Artificial Sequence
  Synthetic
aggccctggctgctgatatgaatatattgattattttttatgattgttgattgtaatttgaatttggttttgatttttattaatgagatttgagtatatgagatattagtttataattttgaccttttgggacagcggtg

SEQ ID NO: 375612 - DNA, 140 bp, Artificial Sequence
  Synthetic
caccgctgtcccaaaaggtcaaaattataaactaatatctcatatactcaaatctcattaataaaaatcaaaaccaaattcaaattacaatcaacaatcataaaaaataatcaatatattcatatcagcagccagggcct

SEQ ID NO: 375613 - DNA, 140 bp, Artificial Sequence
  Synthetic
atacgccatgctgggtctcctttggggggatattttttattttttaaggttatattatgtggtgggttataataattattaatatgtatgtaatattgtggaattaggaagtgtatttaacgtacttgggagtcggccat

SEQ ID NO: 375614 - DNA, 140 bp, Artificial Sequence
  Synthetic
atggccgactcccaagtacgttaaatacacttcctaattccacaatattacatacatattaataattattataacccaccacataatataaccttaaaaaataaaaaatatccccccaaaggagacccagcatggcgtat

SEQ ID NO: 375615 - DNA, 140 bp, Artificial Sequence
  Synthetic
aggccctggctgctgatatgaataattattaatatgtatgtaatattgtggaattaggaagtgtatttaattaaagatattgtgaattttatagtattggttgtaatatttgatgaaggggaccttttgggacagcggtg

SEQ ID NO: 375616 - DNA, 140 bp, Artificial Sequence
  Synthetic
caccgctgtcccaaaaggtccccttcatcaaatattacaaccaatactataaaattcacaatatctttaattaaatacacttcctaattccacaatattacatacatattaataattattcatatcagcagccagggcct

SEQ ID NO: 375617 - DNA, 140 bp, Artificial Sequence
  Synthetic
atacgccatgctgggtctcctaaaattatttttatgaattgtggtatgttttttgaaattattatttgtatggtgttaggatgtttggtgaaggaggttttttttttgttttttttttgtcgtacttgggagtcggccat

SEQ ID NO: 375618 - DNA, 140 bp, Artificial Sequence
  Synthetic
atggccgactcccaagtacgacaaaaaaaaaacaaaaaaaaaacctccttcaccaaacatcctaacaccatacaaataataatttcaaaaaacataccacaattcataaaaataattttaggagacccagcatggcgtat

SEQ ID NO: 375619 - DNA, 140 bp, Artificial Sequence
  Synthetic
aggccctggctgctgatatgtggtgttaggatgtttggtgaaggaggttttttttttgttttttttttgtgataattattatattgtttggaaaggttttagttaaattatttgtaagtagaccttttgggacagcggtg

SEQ ID NO: 375620 - DNA, 140 bp, Artificial Sequence
  Synthetic
caccgctgtcccaaaaggtctacttacaaataatttaactaaaacctttccaaacaatataataattatcacaaaaaaaaaacaaaaaaaaaacctccttcaccaaacatcctaacaccacatatcagcagccagggcct

SEQ ID NO: 375621 - DNA, 140 bp, Artificial Sequence
  Synthetic
atacgccatgctgggtctccaatgttttattaatatttaatttttttttttttaatgaaaaagaaaaattttgattttggggtaataagtatttaagtttttgggtgtattgtaagatatcgtacttgggagtcggccat

SEQ ID NO: 375622 - DNA, 140 bp, Artificial Sequence
  Synthetic
atggccgactcccaagtacgatatcttacaatacacccaaaaacttaaatacttattaccccaaaatcaaaatttttctttttcattaaaaaaaaaaaaattaaatattaataaaacattggagacccagcatggcgtat

SEQ ID NO: 375623 - DNA, 140 bp, Artificial Sequence
  Synthetic
aggccctggctgctgatatgttgattttggggtaataagtatttaagtttttgggtgtattgtaagatatttttaatagaaaaatttttttgttttaggaattgtttaggtatatgtttggaccttttgggacagcggtg

SEQ ID NO: 375624 - DNA, 140 bp, Artificial Sequence
  Synthetic
caccgctgtcccaaaaggtccaaacatatacctaaacaattcctaaaacaaaaaaatttttctattaaaaatatcttacaatacacccaaaaacttaaatacttattaccccaaaatcaacatatcagcagccagggcct

SEQ ID NO: 375625 - DNA, 140 bp, Artificial Sequence
  Synthetic
atacgccatgctgggtctcctgtattttaataggtttgtttaattgttgttgtgtggtttttaatgaaaatgttgaggttattaatgatttttgtggagaataatggaggatgatttaaacgtacttgggagtcggccat

SEQ ID NO: 375626 - DNA, 140 bp, Artificial Sequence
  Synthetic
atggccgactcccaagtacgtttaaatcatcctccattattctccacaaaaatcattaataacctcaacattttcattaaaaaccacacaacaacaattaaacaaacctattaaaatacaggagacccagcatggcgtat

SEQ ID NO: 375627 - DNA, 140 bp, Artificial Sequence
  Synthetic
aggccctggctgctgatatgtgttgaggttattaatgatttttgtggagaataatggaggatgatttaaatggtaaaatttttataaaagatttttgattattggaagtggagggaattggaccttttgggacagcggtg

SEQ ID NO: 375628 - DNA, 140 bp, Artificial Sequence
  Synthetic
caccgctgtcccaaaaggtccaattccctccacttccaataatcaaaaatcttttataaaaattttaccatttaaatcatcctccattattctccacaaaaatcattaataacctcaacacatatcagcagccagggcct

SEQ ID NO: 375629 - DNA, 140 bp, Artificial Sequence
  Synthetic
atacgccatgctgggtctccttatattgtattaagtgttttgattattaaagaaatgttttgtaatattatatttgaatatataatatgttttaaagatgataattggttgtaatgttttcgtacttgggagtcggccat

SEQ ID NO: 375630 - DNA, 140 bp, Artificial Sequence
  Synthetic
atggccgactcccaagtacgaaaacattacaaccaattatcatctttaaaacatattatatattcaaatataatattacaaaacatttctttaataatcaaaacacttaatacaatataaggagacccagcatggcgtat

SEQ ID NO: 375631 - DNA, 140 bp, Artificial Sequence
  Synthetic
aggccctggctgctgatatgtatttgaatatataatatgttttaaagatgataattggttgtaatgtttttagaattgttgtatgatttttaattttttggatggtttttttattatgtagaccttttgggacagcggtg

SEQ ID NO: 375632 - DNA, 140 bp, Artificial Sequence
  Synthetic
caccgctgtcccaaaaggtctacataataaaaaaaccatccaaaaaattaaaaatcatacaacaattctaaaaacattacaaccaattatcatctttaaaacatattatatattcaaatacatatcagcagccagggcct

SEQ ID NO: 375633 - DNA, 140 bp, Artificial Sequence
  Synthetic
atacgccatgctgggtctcctgtggtgtagattggagtttgagtaatagttggtgaaatttgtggattttagataattgtgatttttttaattttttattaaggaggagtttatgtaatgcgtacttgggagtcggccat

SEQ ID NO: 375634 - DNA, 140 bp, Artificial Sequence
  Synthetic
atggccgactcccaagtacgcattacataaactcctccttaataaaaaattaaaaaaatcacaattatctaaaatccacaaatttcaccaactattactcaaactccaatctacaccacaggagacccagcatggcgtat

SEQ ID NO: 375635 - DNA, 140 bp, Artificial Sequence
  Synthetic
aggccctggctgctgatatgagataattgtgatttttttaattttttattaaggaggagtttatgtaatgtttgaataattgtaagatgtatttgggttaaaaattgttttttttgttttgaccttttgggacagcggtg

SEQ ID NO: 375636 - DNA, 140 bp, Artificial Sequence
  Synthetic
caccgctgtcccaaaaggtcaaaacaaaaaaaacaatttttaacccaaatacatcttacaattattcaaacattacataaactcctccttaataaaaaattaaaaaaatcacaattatctcatatcagcagccagggcct

SEQ ID NO: 375637 - DNA, 140 bp, Artificial Sequence
  Synthetic
atacgccatgctgggtctcctttgattattttgtatttttttgattttaatatggataataggtagttttttgtgttatatagagattgaatattatttattagtggataattagtagatcgtacttgggagtcggccat

SEQ ID NO: 375638 - DNA, 140 bp, Artificial Sequence
  Synthetic
atggccgactcccaagtacgatctactaattatccactaataaataatattcaatctctatataacacaaaaaactacctattatccatattaaaatcaaaaaaatacaaaataatcaaaggagacccagcatggcgtat

SEQ ID NO: 375639 - DNA, 140 bp, Artificial Sequence
  Synthetic
aggccctggctgctgatatgttgtgttatatagagattgaatattatttattagtggataattagtagatattggattttttaatttggttaatttagtaattagaagggtattaaaatggaccttttgggacagcggtg

SEQ ID NO: 375640 - DNA, 140 bp, Artificial Sequence
  Synthetic
caccgctgtcccaaaaggtccattttaatacccttctaattactaaattaaccaaattaaaaaatccaatatctactaattatccactaataaataatattcaatctctatataacacaacatatcagcagccagggcct

SEQ ID NO: 375641 - DNA, 140 bp, Artificial Sequence
  Synthetic
atacgccatgctgggtctccaaataatatgtgtgtgtttttgaatagtttttttgaagatattaggttggtattagttagttgatgtatgtggaatattagttgtgtttattggtaatagcgtacttgggagtcggccat

SEQ ID NO: 375642 - DNA, 140 bp, Artificial Sequence
  Synthetic
atggccgactcccaagtacgctattaccaataaacacaactaatattccacatacatcaactaactaataccaacctaatatcttcaaaaaaactattcaaaaacacacacatattatttggagacccagcatggcgtat

SEQ ID NO: 375643 - DNA, 140 bp, Artificial Sequence
  Synthetic
aggccctggctgctgatatgtattagttagttgatgtatgtggaatattagttgtgtttattggtaatagagtaatagggattttttagaagatataattattatattttagaatgttaagaccttttgggacagcggtg

SEQ ID NO: 375644 - DNA, 140 bp, Artificial Sequence
  Synthetic
caccgctgtcccaaaaggtcttaacattctaaaatataataattatatcttctaaaaaatccctattactctattaccaataaacacaactaatattccacatacatcaactaactaatacatatcagcagccagggcct

SEQ ID NO: 375645 - DNA, 140 bp, Artificial Sequence
  Synthetic
atacgccatgctgggtctcctttttttgatgggtgaggatggtaagattatgttagaagaatagagtagatagatatttgtttttgtgaatgattttatgaatgttttgttttaattgatcgtacttgggagtcggccat

SEQ ID NO: 375646 - DNA, 140 bp, Artificial Sequence
  Synthetic
atggccgactcccaagtacgatcaattaaaacaaaacattcataaaatcattcacaaaaacaaatatctatctactctattcttctaacataatcttaccatcctcacccatcaaaaaaaggagacccagcatggcgtat

SEQ ID NO: 375647 - DNA, 140 bp, Artificial Sequence
  Synthetic
aggccctggctgctgatatgtagatatttgtttttgtgaatgattttatgaatgttttgttttaattgatttgtaattatttttttttgtgttttaatttgatttatgtaataattaagggaccttttgggacagcggtg

SEQ ID NO: 375648 - DNA, 140 bp, Artificial Sequence
  Synthetic
caccgctgtcccaaaaggtcccttaattattacataaatcaaattaaaacacaaaaaaaaataattacaaatcaattaaaacaaaacattcataaaatcattcacaaaaacaaatatctacatatcagcagccagggcct

SEQ ID NO: 375649 - DNA, 140 bp, Artificial Sequence
  Synthetic
atacgccatgctgggtctccgtagggaggttttaatggtatatttttattatttgttagaatatttattaatattggagtaatgtagtttattgggattgtagttatagggatattattacgtacttgggagtcggccat

SEQ ID NO: 375650 - DNA, 140 bp, Artificial Sequence
  Synthetic
atggccgactcccaagtacgtaataatatccctataactacaatcccaataaactacattactccaatattaataaatattctaacaaataataaaaatataccattaaaacctccctacggagacccagcatggcgtat

SEQ ID NO: 375651 - DNA, 140 bp, Artificial Sequence
  Synthetic
aggccctggctgctgatatgatattggagtaatgtagtttattgggattgtagttatagggatattattaataaattgtaaaataatagtgttatattttaatttatagatatgttttgggaccttttgggacagcggtg

SEQ ID NO: 375652 - DNA, 140 bp, Artificial Sequence
  Synthetic
caccgctgtcccaaaaggtcccaaaacatatctataaattaaaatataacactattattttacaatttattaataatatccctataactacaatcccaataaactacattactccaatatcatatcagcagccagggcct

SEQ ID NO: 375653 - DNA, 140 bp, Artificial Sequence
  Synthetic
atacgccatgctgggtctcctatatgtttttgttattaggttatattggtttaagataattggggaagataattttgtattaggatattgtgtatgttgggtagttattataaaatagagcgtacttgggagtcggccat

SEQ ID NO: 375654 - DNA, 140 bp, Artificial Sequence
  Synthetic
atggccgactcccaagtacgctctattttataataactacccaacatacacaatatcctaatacaaaattatcttccccaattatcttaaaccaatataacctaataacaaaaacatataggagacccagcatggcgtat

SEQ ID NO: 375655 - DNA, 140 bp, Artificial Sequence
  Synthetic
aggccctggctgctgatatgaattttgtattaggatattgtgtatgttgggtagttattataaaatagaggaattgaaaaagttttatggtggtaaggattgtttttttagtattatggagaccttttgggacagcggtg

SEQ ID NO: 375656 - DNA, 140 bp, Artificial Sequence
  Synthetic
caccgctgtcccaaaaggtctccataatactaaaaaaacaatccttaccaccataaaactttttcaattcctctattttataataactacccaacatacacaatatcctaatacaaaattcatatcagcagccagggcct

SEQ ID NO: 375657 - DNA, 140 bp, Artificial Sequence
  Synthetic
atacgccatgctgggtctccttaatttgggtttattatattgtaaatagtgaatagatgttgtgagtgaaattggattttatattgttttgattattttttgaatatggaaagttatatacgtacttgggagtcggccat

SEQ ID NO: 375658 - DNA, 140 bp, Artificial Sequence
  Synthetic
atggccgactcccaagtacgtatataactttccatattcaaaaaataatcaaaacaatataaaatccaatttcactcacaacatctattcactatttacaatataataaacccaaattaaggagacccagcatggcgtat

SEQ ID NO: 375659 - DNA, 140 bp, Artificial Sequence
  Synthetic
aggccctggctgctgatatgattggattttatattgttttgattattttttgaatatggaaagttatatattatattaattgttagattaagtattaattaaaggtatgattagggttatgaccttttgggacagcggtg

SEQ ID NO: 375660 - DNA, 140 bp, Artificial Sequence
  Synthetic
caccgctgtcccaaaaggtcataaccctaatcatacctttaattaatacttaatctaacaattaatataatatataactttccatattcaaaaaataatcaaaacaatataaaatccaatcatatcagcagccagggcct

SEQ ID NO: 375661 - DNA, 140 bp, Artificial Sequence
  Synthetic
atacgccatgctgggtctcctatagggatattaggggtttaaatagtatatttttgtaatattttaaataggttttttattaattattgtataaagagagattaaattaagattatatagcgtacttgggagtcggccat

SEQ ID NO: 375662 - DNA, 140 bp, Artificial Sequence
  Synthetic
atggccgactcccaagtacgctatataatcttaatttaatctctctttatacaataattaataaaaaacctatttaaaatattacaaaaatatactatttaaacccctaatatccctataggagacccagcatggcgtat

SEQ ID NO: 375663 - DNA, 140 bp, Artificial Sequence
  Synthetic
aggccctggctgctgatatgggttttttattaattattgtataaagagagattaaattaagattatataggaaaatgattttgttttatgatggattatggaattaatgttagttttattgaccttttgggacagcggtg

SEQ ID NO: 375664 - DNA, 140 bp, Artificial Sequence
  Synthetic
caccgctgtcccaaaaggtcaataaaactaacattaattccataatccatcataaaacaaaatcattttcctatataatcttaatttaatctctctttatacaataattaataaaaaacccatatcagcagccagggcct

SEQ ID NO: 375665 - DNA, 140 bp, Artificial Sequence
  Synthetic
atacgccatgctgggtctcctgattaatgaagtaatgtttgatggtttaggagtggtaataggtttaagtgttgatttatgtagtaaggagaatttgataggattagggtgttgtatattcgtacttgggagtcggccat

SEQ ID NO: 375666 - DNA, 140 bp, Artificial Sequence
  Synthetic
atggccgactcccaagtacgaatatacaacaccctaatcctatcaaattctccttactacataaatcaacacttaaacctattaccactcctaaaccatcaaacattacttcattaatcaggagacccagcatggcgtat

SEQ ID NO: 375667 - DNA, 140 bp, Artificial Sequence
  Synthetic
aggccctggctgctgatatggttgatttatgtagtaaggagaatttgataggattagggtgttgtatatttattgtagatttatttggtttttgaattttgataagataatttatattaggaccttttgggacagcggtg

SEQ ID NO: 375668 - DNA, 140 bp, Artificial Sequence
  Synthetic
caccgctgtcccaaaaggtcctaatataaattatcttatcaaaattcaaaaaccaaataaatctacaataaatatacaacaccctaatcctatcaaattctccttactacataaatcaaccatatcagcagccagggcct

SEQ ID NO: 375669 - DNA, 140 bp, Artificial Sequence
  Synthetic
atacgccatgctgggtctccagaagttttttgtaattaatgatatgaagagttttgagtttatttataaagttaataatatttgattttataagagataatatttttatgtttagttggtcgtacttgggagtcggccat

SEQ ID NO: 375670 - DNA, 140 bp, Artificial Sequence
  Synthetic
atggccgactcccaagtacgaccaactaaacataaaaatattatctcttataaaatcaaatattattaactttataaataaactcaaaactcttcatatcattaattacaaaaaacttctggagacccagcatggcgtat

SEQ ID NO: 375671 - DNA, 140 bp, Artificial Sequence
  Synthetic
aggccctggctgctgatatggttaataatatttgattttataagagataatatttttatgtttagttggttttttatttgttgagtttttatgttgaagtgattagtagatgttgttagtgaccttttgggacagcggtg

SEQ ID NO: 375672 - DNA, 140 bp, Artificial Sequence
  Synthetic
caccgctgtcccaaaaggtcactaacaacatctactaatcacttcaacataaaaactcaacaaataaaaaaccaactaaacataaaaatattatctcttataaaatcaaatattattaaccatatcagcagccagggcct

SEQ ID NO: 375673 - DNA, 140 bp, Artificial Sequence
  Synthetic
atacgccatgctgggtctccatgatttattaattggttaagaattttggtggtaagaattatttttaaggtttaaatgggagtttggattttagattgttggtttttgaataagtgtgggcgtacttgggagtcggccat

SEQ ID NO: 375674 - DNA, 140 bp, Artificial Sequence
  Synthetic
atggccgactcccaagtacgcccacacttattcaaaaaccaacaatctaaaatccaaactcccatttaaaccttaaaaataattcttaccaccaaaattcttaaccaattaataaatcatggagacccagcatggcgtat

SEQ ID NO: 375675 - DNA, 140 bp, Artificial Sequence
  Synthetic
aggccctggctgctgatatgtttaaatgggagtttggattttagattgttggtttttgaataagtgtgggaagaggttttgggttattgtttatgtaggagtaaaattatttattttaaggaccttttgggacagcggtg

SEQ ID NO: 375676 - DNA, 140 bp, Artificial Sequence
  Synthetic
caccgctgtcccaaaaggtccttaaaataaataattttactcctacataaacaataacccaaaacctcttcccacacttattcaaaaaccaacaatctaaaatccaaactcccatttaaacatatcagcagccagggcct

SEQ ID NO: 375677 - DNA, 140 bp, Artificial Sequence
  Synthetic
atacgccatgctgggtctcctttagtaaattttttatttttgtatagttggagttattaggaagttgtataggttgttaaatataattttttgttttagtttttgttttggtgttattaacgtacttgggagtcggccat

SEQ ID NO: 375678 - DNA, 140 bp, Artificial Sequence
  Synthetic
atggccgactcccaagtacgttaataacaccaaaacaaaaactaaaacaaaaaattatatttaacaacctatacaacttcctaataactccaactatacaaaaataaaaaatttactaaaggagacccagcatggcgtat

SEQ ID NO: 375679 - DNA, 140 bp, Artificial Sequence
  Synthetic
aggccctggctgctgatatgaggttgttaaatataattttttgttttagtttttgttttggtgttattaagttgtattggtttgtggttttagttattttggttatttttaatggaatttgaccttttgggacagcggtg

SEQ ID NO: 375680 - DNA, 140 bp, Artificial Sequence
  Synthetic
caccgctgtcccaaaaggtcaaattccattaaaaataaccaaaataactaaaaccacaaaccaatacaacttaataacaccaaaacaaaaactaaaacaaaaaattatatttaacaacctcatatcagcagccagggcct

SEQ ID NO: 375681 - DNA, 140 bp, Artificial Sequence
  Synthetic
atacgccatgctgggtctccaaggttttttttgttatttttatttttgttataagatttgatttttaaattataatgttgttgttatgatgttaaataattatttgtagaataagttggacgtacttgggagtcggccat

SEQ ID NO: 375682 - DNA, 140 bp, Artificial Sequence
  Synthetic
atggccgactcccaagtacgtccaacttattctacaaataattatttaacatcataacaacaacattataatttaaaaatcaaatcttataacaaaaataaaaataacaaaaaaaaccttggagacccagcatggcgtat

SEQ ID NO: 375683 - DNA, 140 bp, Artificial Sequence
  Synthetic
aggccctggctgctgatatgtataatgttgttgttatgatgttaaataattatttgtagaataagttggaagaataatttgattttaggtagtgttgaaaattattttttatagttaaaggaccttttgggacagcggtg

SEQ ID NO: 375684 - DNA, 140 bp, Artificial Sequence
  Synthetic
caccgctgtcccaaaaggtcctttaactataaaaaataattttcaacactacctaaaatcaaattattcttccaacttattctacaaataattatttaacatcataacaacaacattatacatatcagcagccagggcct

SEQ ID NO: 375685 - DNA, 140 bp, Artificial Sequence
  Synthetic
atacgccatgctgggtctccagtttaataaaaaatgtgatgagttttttttaattataaattttagtttagtgggagtttaaatatgtaaaagagatatatattttatttgataattttacgtacttgggagtcggccat

SEQ ID NO: 375686 - DNA, 140 bp, Artificial Sequence
  Synthetic
atggccgactcccaagtacgtaaaattatcaaataaaatatatatctcttttacatatttaaactcccactaaactaaaatttataattaaaaaaaactcatcacattttttattaaactggagacccagcatggcgtat

SEQ ID NO: 375687 - DNA, 140 bp, Artificial Sequence
  Synthetic
aggccctggctgctgatatggtgggagtttaaatatgtaaaagagatatatattttatttgataattttattttgtaggaataaaattatatattttaaggagatgaaaattggtagagtgaccttttgggacagcggtg

SEQ ID NO: 375688 - DNA, 140 bp, Artificial Sequence
  Synthetic
caccgctgtcccaaaaggtcactctaccaattttcatctccttaaaatatataattttattcctacaaaataaaattatcaaataaaatatatatctcttttacatatttaaactcccaccatatcagcagccagggcct

SEQ ID NO: 375689 - DNA, 140 bp, Artificial Sequence
  Synthetic
atacgccatgctgggtctccatgtttttgtagtttaattttataagtttagattgtataatatagtatgtgtaggattattttatatttaagattatattattattaagggaattttattcgtacttgggagtcggccat

SEQ ID NO: 375690 - DNA, 140 bp, Artificial Sequence
  Synthetic
atggccgactcccaagtacgaataaaattcccttaataataatataatcttaaatataaaataatcctacacatactatattatacaatctaaacttataaaattaaactacaaaaacatggagacccagcatggcgtat

SEQ ID NO: 375691 - DNA, 140 bp, Artificial Sequence
  Synthetic
aggccctggctgctgatatggtaggattattttatatttaagattatattattattaagggaattttatttttaatgttagagtgtgtttatgggtttttttttttaattttaaatttttgaccttttgggacagcggtg

SEQ ID NO: 375692 - DNA, 140 bp, Artificial Sequence
  Synthetic
caccgctgtcccaaaaggtcaaaaatttaaaattaaaaaaaaaaacccataaacacactctaacattaaaaataaaattcccttaataataatataatcttaaatataaaataatcctaccatatcagcagccagggcct

SEQ ID NO: 375693 - DNA, 140 bp, Artificial Sequence
  Synthetic
atacgccatgctgggtctcctgttttgttgtttttgttttaggttatttgagatgatttaatgtttttagggaggatttttgtaatataatgattttaatatttttattgattttgtttacgtacttgggagtcggccat

SEQ ID NO: 375694 - DNA, 140 bp, Artificial Sequence
  Synthetic
atggccgactcccaagtacgtaaacaaaatcaataaaaatattaaaatcattatattacaaaaatcctccctaaaaacattaaatcatctcaaataacctaaaacaaaaacaacaaaacaggagacccagcatggcgtat

SEQ ID NO: 375695 - DNA, 140 bp, Artificial Sequence
  Synthetic
aggccctggctgctgatatgggaggatttttgtaatataatgattttaatatttttattgattttgtttatttttaataataaatgattgatattatgaaataaatatttattattatatgaccttttgggacagcggtg

SEQ ID NO: 375696 - DNA, 140 bp, Artificial Sequence
  Synthetic
caccgctgtcccaaaaggtcatataataataaatatttatttcataatatcaatcatttattattaaaaataaacaaaatcaataaaaatattaaaatcattatattacaaaaatcctcccatatcagcagccagggcct

SEQ ID NO: 375697 - DNA, 140 bp, Artificial Sequence
  Synthetic
atacgccatgctgggtctcctgtgtttgtatttttatattggttttagttattatttttatttttattttgtttttttttttaaaaatattatttatagaggataagggtattttgttttcgtacttgggagtcggccat

SEQ ID NO: 375698 - DNA, 140 bp, Artificial Sequence
  Synthetic
atggccgactcccaagtacgaaaacaaaatacccttatcctctataaataatatttttaaaaaaaaaaacaaaataaaaataaaaataataactaaaaccaatataaaaatacaaacacaggagacccagcatggcgtat

SEQ ID NO: 375699 - DNA, 140 bp, Artificial Sequence
  Synthetic
aggccctggctgctgatatggtttttttttttaaaaatattatttatagaggataagggtattttgttttatttgttttttttataggttaagttgtattattttttgattaagtatattgaccttttgggacagcggtg

SEQ ID NO: 375700 - DNA, 140 bp, Artificial Sequence
  Synthetic
caccgctgtcccaaaaggtcaatatacttaatcaaaaaataatacaacttaacctataaaaaaaacaaataaaacaaaatacccttatcctctataaataatatttttaaaaaaaaaaaccatatcagcagccagggcct

SEQ ID NO: 375701 - DNA, 140 bp, Artificial Sequence
  Synthetic
atacgccatgctgggtctcctgtaggtttgatattattatagtggagtttttataggaaagttgtaatgttatatggaggaaagtagatataaatatagttaatgattgtttattttattcgtacttgggagtcggccat

SEQ ID NO: 375702 - DNA, 140 bp, Artificial Sequence
  Synthetic
atggccgactcccaagtacgaataaaataaacaatcattaactatatttatatctactttcctccatataacattacaactttcctataaaaactccactataataatatcaaacctacaggagacccagcatggcgtat

SEQ ID NO: 375703 - DNA, 140 bp, Artificial Sequence
  Synthetic
aggccctggctgctgatatgtatatggaggaaagtagatataaatatagttaatgattgtttattttattgttgttatagtgttgttttaaaagtattttttttgttattatgtaaatgtgaccttttgggacagcggtg

SEQ ID NO: 375704 - DNA, 140 bp, Artificial Sequence
  Synthetic
caccgctgtcccaaaaggtcacatttacataataacaaaaaaaatacttttaaaacaacactataacaacaataaaataaacaatcattaactatatttatatctactttcctccatatacatatcagcagccagggcct

SEQ ID NO: 375705 - DNA, 140 bp, Artificial Sequence
  Synthetic
atacgccatgctgggtctcctttaagatgatttttatataattgattaagttgtgatttagagaatttttgtattaagatagtatttaatgttaagagagtatggagttttgtattatttcgtacttgggagtcggccat

SEQ ID NO: 375706 - DNA, 140 bp, Artificial Sequence
  Synthetic
atggccgactcccaagtacgaaataatacaaaactccatactctcttaacattaaatactatcttaatacaaaaattctctaaatcacaacttaatcaattatataaaaatcatcttaaaggagacccagcatggcgtat

SEQ ID NO: 375707 - DNA, 140 bp, Artificial Sequence
  Synthetic
aggccctggctgctgatatggtattaagatagtatttaatgttaagagagtatggagttttgtattatttattttattaatattttgattggtttaaaatttagtagttttgattagtaagaccttttgggacagcggtg

SEQ ID NO: 375708 - DNA, 140 bp, Artificial Sequence
  Synthetic
caccgctgtcccaaaaggtcttactaatcaaaactactaaattttaaaccaatcaaaatattaataaaataaataatacaaaactccatactctcttaacattaaatactatcttaataccatatcagcagccagggcct

SEQ ID NO: 375709 - DNA, 140 bp, Artificial Sequence
  Synthetic
atacgccatgctgggtctccgatttgttagttttaggtttttaggagtagttatattaagtgatgaattagttgatttataggttttttgtgttataagaagtaggagtttttggttggtcgtacttgggagtcggccat

SEQ ID NO: 375710 - DNA, 140 bp, Artificial Sequence
  Synthetic
atggccgactcccaagtacgaccaaccaaaaactcctacttcttataacacaaaaaacctataaatcaactaattcatcacttaatataactactcctaaaaacctaaaactaacaaatcggagacccagcatggcgtat

SEQ ID NO: 375711 - DNA, 140 bp, Artificial Sequence
  Synthetic
aggccctggctgctgatatggttgatttataggttttttgtgttataagaagtaggagtttttggttggttaggtttttaagttgatggttttttttatagaaattattattatatagaagaccttttgggacagcggtg

SEQ ID NO: 375712 - DNA, 140 bp, Artificial Sequence
  Synthetic
caccgctgtcccaaaaggtcttctatataataataatttctataaaaaaaaccatcaacttaaaaacctaaccaaccaaaaactcctacttcttataacacaaaaaacctataaatcaaccatatcagcagccagggcct

SEQ ID NO: 375713 - DNA, 140 bp, Artificial Sequence
  Synthetic
atacgccatgctgggtctccagggttttagtattttttttatggaaaattgtagggattttaatttgtgaagtattttgattattatggtagtttgttgttgttttattttgggaaatggcgtacttgggagtcggccat

SEQ ID NO: 375714 - DNA, 140 bp, Artificial Sequence
  Synthetic
atggccgactcccaagtacgccatttcccaaaataaaacaacaacaaactaccataataatcaaaatacttcacaaattaaaatccctacaattttccataaaaaaaatactaaaaccctggagacccagcatggcgtat

SEQ ID NO: 375715 - DNA, 140 bp, Artificial Sequence
  Synthetic
aggccctggctgctgatatgagtattttgattattatggtagtttgttgttgttttattttgggaaatggattttgttttaaattgaggatttgttgaattttgttggttggtatgtgaagaccttttgggacagcggtg

SEQ ID NO: 375716 - DNA, 140 bp, Artificial Sequence
  Synthetic
caccgctgtcccaaaaggtcttcacataccaaccaacaaaattcaacaaatcctcaatttaaaacaaaatccatttcccaaaataaaacaacaacaaactaccataataatcaaaatactcatatcagcagccagggcct

SEQ ID NO: 375717 - DNA, 140 bp, Artificial Sequence
  Synthetic
atacgccatgctgggtctcctaataatatagttatttgtggttttggaaatggatgttattttgatatgaaattaattgaattgttgttttgggatttttgtagaggataggttttttttcgtacttgggagtcggccat

SEQ ID NO: 375718 - DNA, 140 bp, Artificial Sequence
  Synthetic
atggccgactcccaagtacgaaaaaaaacctatcctctacaaaaatcccaaaacaacaattcaattaatttcatatcaaaataacatccatttccaaaaccacaaataactatattattaggagacccagcatggcgtat

SEQ ID NO: 375719 - DNA, 140 bp, Artificial Sequence
  Synthetic
aggccctggctgctgatatgaattaattgaattgttgttttgggatttttgtagaggataggtttttttttaagtaagtgtgagggttaatttaaagatttttgaatatgaatgtgtagggaccttttgggacagcggtg

SEQ ID NO: 375720 - DNA, 140 bp, Artificial Sequence
  Synthetic
caccgctgtcccaaaaggtccctacacattcatattcaaaaatctttaaattaaccctcacacttacttaaaaaaaaacctatcctctacaaaaatcccaaaacaacaattcaattaattcatatcagcagccagggcct

SEQ ID NO: 375721 - DNA, 140 bp, Artificial Sequence
  Synthetic
atacgccatgctgggtctccttaatattatttttgggaaggaatttatatagtattgagaaagagtattaaagtattttagtttaaaggatttttgtaaatttatttttaagttttgtatcgtacttgggagtcggccat

SEQ ID NO: 375722 - DNA, 140 bp, Artificial Sequence
  Synthetic
atggccgactcccaagtacgatacaaaacttaaaaataaatttacaaaaatcctttaaactaaaatactttaatactctttctcaatactatataaattccttcccaaaaataatattaaggagacccagcatggcgtat

SEQ ID NO: 375723 - DNA, 140 bp, Artificial Sequence
  Synthetic
aggccctggctgctgatatgaagtattttagtttaaaggatttttgtaaatttatttttaagttttgtatagaatttggtattagtttgatttttaagtattagtattggtttataatttgaccttttgggacagcggtg

SEQ ID NO: 375724 - DNA, 140 bp, Artificial Sequence
  Synthetic
caccgctgtcccaaaaggtcaaattataaaccaatactaatacttaaaaatcaaactaataccaaattctatacaaaacttaaaaataaatttacaaaaatcctttaaactaaaatacttcatatcagcagccagggcct

SEQ ID NO: 375725 - DNA, 140 bp, Artificial Sequence
  Synthetic
atacgccatgctgggtctccagtaaagtagtttgtaaatgtaaagaagagtaataattgtaataataattttagtaatgtttatttttgtagggatttattgtttttagtttgtttattacgtacttgggagtcggccat

SEQ ID NO: 375726 - DNA, 140 bp, Artificial Sequence
  Synthetic
atggccgactcccaagtacgtaataaacaaactaaaaacaataaatccctacaaaaataaacattactaaaattattattacaattattactcttctttacatttacaaactactttactggagacccagcatggcgtat

SEQ ID NO: 375727 - DNA, 140 bp, Artificial Sequence
  Synthetic
aggccctggctgctgatatgttagtaatgtttatttttgtagggatttattgtttttagtttgtttattaattattattattattttgattaggtaaggggttgttgatgaaattatggagaccttttgggacagcggtg

SEQ ID NO: 375728 - DNA, 140 bp, Artificial Sequence
  Synthetic
caccgctgtcccaaaaggtctccataatttcatcaacaaccccttacctaatcaaaataataataataattaataaacaaactaaaaacaataaatccctacaaaaataaacattactaacatatcagcagccagggcct

SEQ ID NO: 375729 - DNA, 140 bp, Artificial Sequence
  Synthetic
atacgccatgctgggtctccatgtaataatttggttttaggattttgtatgttttgttttattgttgtagaaggaaatttatggtttttttattgagtatggtatatgtttgtagttttgcgtacttgggagtcggccat

SEQ ID NO: 375730 - DNA, 140 bp, Artificial Sequence
  Synthetic
atggccgactcccaagtacgcaaaactacaaacatataccatactcaataaaaaaaccataaatttccttctacaacaataaaacaaaacatacaaaatcctaaaaccaaattattacatggagacccagcatggcgtat

SEQ ID NO: 375731 - DNA, 140 bp, Artificial Sequence
  Synthetic
aggccctggctgctgatatgaaggaaatttatggtttttttattgagtatggtatatgtttgtagttttgttgtggtttttaagaaaagttgtagagtttgagttgttttatttgtaagtgaccttttgggacagcggtg

SEQ ID NO: 375732 - DNA, 140 bp, Artificial Sequence
  Synthetic
caccgctgtcccaaaaggtcacttacaaataaaacaactcaaactctacaacttttcttaaaaaccacaacaaaactacaaacatataccatactcaataaaaaaaccataaatttccttcatatcagcagccagggcct

SEQ ID NO: 375733 - DNA, 140 bp, Artificial Sequence
  Synthetic
atacgccatgctgggtctccgtatatgttttttgtatttggtttaaagtatgggatttaggtaattttagtagtattatgttgtttttgtgtagtttagtagtgtaagttgggattgtatcgtacttgggagtcggccat

SEQ ID NO: 375734 - DNA, 140 bp, Artificial Sequence
  Synthetic
atggccgactcccaagtacgatacaatcccaacttacactactaaactacacaaaaacaacataatactactaaaattacctaaatcccatactttaaaccaaatacaaaaaacatatacggagacccagcatggcgtat

SEQ ID NO: 375735 - DNA, 140 bp, Artificial Sequence
  Synthetic
aggccctggctgctgatatgtagtattatgttgtttttgtgtagtttagtagtgtaagttgggattgtatttatttgtggttttggtgttagtttgttttttgttgtgtttttgaagtttgaccttttgggacagcggtg

SEQ ID NO: 375736 - DNA, 140 bp, Artificial Sequence
  Synthetic
caccgctgtcccaaaaggtcaaacttcaaaaacacaacaaaaaacaaactaacaccaaaaccacaaataaatacaatcccaacttacactactaaactacacaaaaacaacataatactacatatcagcagccagggcct

SEQ ID NO: 375737 - DNA, 140 bp, Artificial Sequence
  Synthetic
atacgccatgctgggtctcctggatttttgtggtaggatagttttaattgttgttgttatattttttggggtggtgagagtgggtgtttttgttgttgggttgggggagttttttggtggcgtacttgggagtcggccat

SEQ ID NO: 375738 - DNA, 140 bp, Artificial Sequence
  Synthetic
atggccgactcccaagtacgccaccaaaaaactcccccaacccaacaacaaaaacacccactctcaccaccccaaaaaatataacaacaacaattaaaactatcctaccacaaaaatccaggagacccagcatggcgtat

SEQ ID NO: 375739 - DNA, 140 bp, Artificial Sequence
  Synthetic
aggccctggctgctgatatggtggtgagagtgggtgtttttgttgttgggttgggggagttttttggtggtgttgttggttttttggtggttattattgatggatttgatgtgtgggttggaccttttgggacagcggtg

SEQ ID NO: 375740 - DNA, 140 bp, Artificial Sequence
  Synthetic
caccgctgtcccaaaaggtccaacccacacatcaaatccatcaataataaccaccaaaaaaccaacaacaccaccaaaaaactcccccaacccaacaacaaaaacacccactctcaccaccatatcagcagccagggcct

SEQ ID NO: 375741 - DNA, 140 bp, Artificial Sequence
  Synthetic
atacgccatgctgggtctccatttggttggagtttggttttattttgatggtggagatttgtatatggttgttgttagtgtttataattgttgtagttgtttttgtaatggttttttgagcgtacttgggagtcggccat

SEQ ID NO: 375742 - DNA, 140 bp, Artificial Sequence
  Synthetic
atggccgactcccaagtacgctcaaaaaaccattacaaaaacaactacaacaattataaacactaacaacaaccatatacaaatctccaccatcaaaataaaaccaaactccaaccaaatggagacccagcatggcgtat

SEQ ID NO: 375743 - DNA, 140 bp, Artificial Sequence
  Synthetic
aggccctggctgctgatatggttgttagtgtttataattgttgtagttgtttttgtaatggttttttgagtgtttatatttattttttgattttttgttgaattttgagatggtaatgttgaccttttgggacagcggtg

SEQ ID NO: 375744 - DNA, 140 bp, Artificial Sequence
  Synthetic
caccgctgtcccaaaaggtcaacattaccatctcaaaattcaacaaaaaatcaaaaaataaatataaacactcaaaaaaccattacaaaaacaactacaacaattataaacactaacaaccatatcagcagccagggcct

SEQ ID NO: 375745 - DNA, 140 bp, Artificial Sequence
  Synthetic
atacgccatgctgggtctccaattaggtttgaatattttttggtggtttggttggagatttttttttttgtaatttttgatgatgttgtattattgttttttgttttgttgagtgataaacgtacttgggagtcggccat

SEQ ID NO: 375746 - DNA, 140 bp, Artificial Sequence
  Synthetic
atggccgactcccaagtacgtttatcactcaacaaaacaaaaaacaataatacaacatcatcaaaaattacaaaaaaaaaaatctccaaccaaaccaccaaaaaatattcaaacctaattggagacccagcatggcgtat

SEQ ID NO: 375747 - DNA, 140 bp, Artificial Sequence
  Synthetic
aggccctggctgctgatatgtaatttttgatgatgttgtattattgttttttgttttgttgagtgataaagttttgaaagatagtttttttttatgtagttgtttggagagatttttttagaccttttgggacagcggtg

SEQ ID NO: 375748 - DNA, 140 bp, Artificial Sequence
  Synthetic
caccgctgtcccaaaaggtctaaaaaaatctctccaaacaactacataaaaaaaaactatctttcaaaactttatcactcaacaaaacaaaaaacaataatacaacatcatcaaaaattacatatcagcagccagggcct

SEQ ID NO: 375749 - DNA, 140 bp, Artificial Sequence
  Synthetic
atacgccatgctgggtctcctgtttaaattagttttttagttgtattatttaattgttggtgaaggtgaatggtattatttagttggaaaaggaattgaggtgtgtggggtttgtttagacgtacttgggagtcggccat

SEQ ID NO: 375750 - DNA, 140 bp, Artificial Sequence
  Synthetic
atggccgactcccaagtacgtctaaacaaaccccacacacctcaattccttttccaactaaataataccattcaccttcaccaacaattaaataatacaactaaaaaactaatttaaacaggagacccagcatggcgtat

SEQ ID NO: 375751 - DNA, 140 bp, Artificial Sequence
  Synthetic
aggccctggctgctgatatgtggtattatttagttggaaaaggaattgaggtgtgtggggtttgtttagatgaataaaagtattattgttaattttgaaaagggttgtggagtgttgagtgaccttttgggacagcggtg

SEQ ID NO: 375752 - DNA, 140 bp, Artificial Sequence
  Synthetic
caccgctgtcccaaaaggtcactcaacactccacaacccttttcaaaattaacaataatacttttattcatctaaacaaaccccacacacctcaattccttttccaactaaataataccacatatcagcagccagggcct

SEQ ID NO: 375753 - DNA, 140 bp, Artificial Sequence
  Synthetic
atacgccatgctgggtctccatgtatttttagtgtagtttattgttttttgaatggggggtgattgaaggaatgttttttttggtttagttaatattaagaatgtaattatttttttagtcgtacttgggagtcggccat

SEQ ID NO: 375754 - DNA, 140 bp, Artificial Sequence
  Synthetic
atggccgactcccaagtacgactaaaaaaataattacattcttaatattaactaaaccaaaaaaaacattccttcaatcaccccccattcaaaaaacaataaactacactaaaaatacatggagacccagcatggcgtat

SEQ ID NO: 375755 - DNA, 140 bp, Artificial Sequence
  Synthetic
aggccctggctgctgatatgaatgttttttttggtttagttaatattaagaatgtaattatttttttagtaaaattgatttttttgtaaattatagttgaagttagtttgttatagaggagaccttttgggacagcggtg

SEQ ID NO: 375756 - DNA, 140 bp, Artificial Sequence
  Synthetic
caccgctgtcccaaaaggtctcctctataacaaactaacttcaactataatttacaaaaaaatcaattttactaaaaaaataattacattcttaatattaactaaaccaaaaaaaacattcatatcagcagccagggcct

SEQ ID NO: 375757 - DNA, 140 bp, Artificial Sequence
  Synthetic
atacgccatgctgggtctccttttgggttttgtgaatatagtggtattttggaaagtttttgatattatttggtggtgggggtaagtatttgtttttgtttggtttttttattttaagatcgtacttgggagtcggccat

SEQ ID NO: 375758 - DNA, 140 bp, Artificial Sequence
  Synthetic
atggccgactcccaagtacgatcttaaaataaaaaaaccaaacaaaaacaaatacttacccccaccaccaaataatatcaaaaactttccaaaataccactatattcacaaaacccaaaaggagacccagcatggcgtat

SEQ ID NO: 375759 - DNA, 140 bp, Artificial Sequence
  Synthetic
aggccctggctgctgatatgtggtggtgggggtaagtatttgtttttgtttggtttttttattttaagattgtagtaatttttagtttatttttttgttttatagttgattattttgggagaccttttgggacagcggtg

SEQ ID NO: 375760 - DNA, 140 bp, Artificial Sequence
  Synthetic
caccgctgtcccaaaaggtctcccaaaataatcaactataaaacaaaaaaataaactaaaaattactacaatcttaaaataaaaaaaccaaacaaaaacaaatacttacccccaccaccacatatcagcagccagggcct

SEQ ID NO: 375761 - DNA, 140 bp, Artificial Sequence
  Synthetic
atacgccatgctgggtctccagatattttgttttttttgaggttgagattaattgattttagttggttagtagatgtaagatgatttttgtagattagttggttaatttttgttatttttcgtacttgggagtcggccat

SEQ ID NO: 375762 - DNA, 140 bp, Artificial Sequence
  Synthetic
atggccgactcccaagtacgaaaaataacaaaaattaaccaactaatctacaaaaatcatcttacatctactaaccaactaaaatcaattaatctcaacctcaaaaaaaacaaaatatctggagacccagcatggcgtat

SEQ ID NO: 375763 - DNA, 140 bp, Artificial Sequence
  Synthetic
aggccctggctgctgatatgtagatgtaagatgatttttgtagattagttggttaatttttgttatttttaaagtgttgttagttataatatttaaaggtatggaaaaggttttttggaagaccttttgggacagcggtg

SEQ ID NO: 375764 - DNA, 140 bp, Artificial Sequence
  Synthetic
caccgctgtcccaaaaggtcttccaaaaaaccttttccatacctttaaatattataactaacaacactttaaaaataacaaaaattaaccaactaatctacaaaaatcatcttacatctacatatcagcagccagggcct

SEQ ID NO: 375765 - DNA, 140 bp, Artificial Sequence
  Synthetic
atacgccatgctgggtctccgtaattggagtaggttaagattttttattgtgagatttttaggatgggggtgtattggtaagtgtatttttattaaatggtattgagaataagattatggcgtacttgggagtcggccat

SEQ ID NO: 375766 - DNA, 140 bp, Artificial Sequence
  Synthetic
atggccgactcccaagtacgccataatcttattctcaataccatttaataaaaatacacttaccaatacacccccatcctaaaaatctcacaataaaaaatcttaacctactccaattacggagacccagcatggcgtat

SEQ ID NO: 375767 - DNA, 140 bp, Artificial Sequence
  Synthetic
aggccctggctgctgatatgtgtattggtaagtgtatttttattaaatggtattgagaataagattatggtaaaaagatgaaggttgggtttttattaggtttaatttttattagatttggaccttttgggacagcggtg

SEQ ID NO: 375768 - DNA, 140 bp, Artificial Sequence
  Synthetic
caccgctgtcccaaaaggtccaaatctaataaaaattaaacctaataaaaacccaaccttcatctttttaccataatcttattctcaataccatttaataaaaatacacttaccaatacacatatcagcagccagggcct

SEQ ID NO: 375769 - DNA, 140 bp, Artificial Sequence
  Synthetic
atacgccatgctgggtctccgaaatgagtatagagtggtgaaggtgtaatttttgaggattaggttatttgagaaggaggttgagggaattttttggtatagttaggttaatttgttaggcgtacttgggagtcggccat

SEQ ID NO: 375770 - DNA, 140 bp, Artificial Sequence
  Synthetic
atggccgactcccaagtacgcctaacaaattaacctaactataccaaaaaattccctcaacctccttctcaaataacctaatcctcaaaaattacaccttcaccactctatactcatttcggagacccagcatggcgtat

SEQ ID NO: 375771 - DNA, 140 bp, Artificial Sequence
  Synthetic
aggccctggctgctgatatggagaaggaggttgagggaattttttggtatagttaggttaatttgttaggaaggaggtttgaaggggtgaatattggatattgattgggtgaagtatggagaccttttgggacagcggtg

SEQ ID NO: 375772 - DNA, 140 bp, Artificial Sequence
  Synthetic
caccgctgtcccaaaaggtctccatacttcacccaatcaatatccaatattcaccccttcaaacctccttcctaacaaattaacctaactataccaaaaaattccctcaacctccttctccatatcagcagccagggcct

SEQ ID NO: 375773 - DNA, 140 bp, Artificial Sequence
  Synthetic
atacgccatgctgggtctccggttttttgggttggttttattttggatttaggtttgattagtgagagttttttgatttgattagtatattttaataagagggttgagttgttttatagtcgtacttgggagtcggccat

SEQ ID NO: 375774 - DNA, 140 bp, Artificial Sequence
  Synthetic
atggccgactcccaagtacgactataaaacaactcaaccctcttattaaaatatactaatcaaatcaaaaaactctcactaatcaaacctaaatccaaaataaaaccaacccaaaaaaccggagacccagcatggcgtat

SEQ ID NO: 375775 - DNA, 140 bp, Artificial Sequence
  Synthetic
aggccctggctgctgatatgttttgatttgattagtatattttaataagagggttgagttgttttatagtatatggattgttagttttttaaaagttgattgagttgttatagataagatgaccttttgggacagcggtg

SEQ ID NO: 375776 - DNA, 140 bp, Artificial Sequence
  Synthetic
caccgctgtcccaaaaggtcatcttatctataacaactcaatcaacttttaaaaaactaacaatccatatactataaaacaactcaaccctcttattaaaatatactaatcaaatcaaaacatatcagcagccagggcct

SEQ ID NO: 375777 - DNA, 140 bp, Artificial Sequence
  Synthetic
atacgccatgctgggtctccattgagataagagtaattggtaggtgaatgataattattataatttggtgttatgattatagttaggtttttaggtgagattggatttagtttaatgtatcgtacttgggagtcggccat

SEQ ID NO: 375778 - DNA, 140 bp, Artificial Sequence
  Synthetic
atggccgactcccaagtacgatacattaaactaaatccaatctcacctaaaaacctaactataatcataacaccaaattataataattatcattcacctaccaattactcttatctcaatggagacccagcatggcgtat

SEQ ID NO: 375779 - DNA, 140 bp, Artificial Sequence
  Synthetic
aggccctggctgctgatatgttatgattatagttaggtttttaggtgagattggatttagtttaatgtattttgggagtaagataggaattataggttgtttatttttttgatttattttgaccttttgggacagcggtg

SEQ ID NO: 375780 - DNA, 140 bp, Artificial Sequence
  Synthetic
caccgctgtcccaaaaggtcaaaataaatcaaaaaaataaacaacctataattcctatcttactcccaaaatacattaaactaaatccaatctcacctaaaaacctaactataatcataacatatcagcagccagggcct

SEQ ID NO: 375781 - DNA, 140 bp, Artificial Sequence
  Synthetic
atacgccatgctgggtctcctatttttagttggattaattggtatgattttgaaattttgtattaggtttataattgtttgaattttgtttggggtagttagattagaaatatgttttttcgtacttgggagtcggccat

SEQ ID NO: 375782 - DNA, 140 bp, Artificial Sequence
  Synthetic
atggccgactcccaagtacgaaaaaacatatttctaatctaactaccccaaacaaaattcaaacaattataaacctaatacaaaatttcaaaatcataccaattaatccaactaaaaataggagacccagcatggcgtat

SEQ ID NO: 375783 - DNA, 140 bp, Artificial Sequence
  Synthetic
aggccctggctgctgatatgataattgtttgaattttgtttggggtagttagattagaaatatgtttttttttttttgttttgtttggaagtagaatgggttttagttttgggtgaaatggaccttttgggacagcggtg

SEQ ID NO: 375784 - DNA, 140 bp, Artificial Sequence
  Synthetic
caccgctgtcccaaaaggtccatttcacccaaaactaaaacccattctacttccaaacaaaacaaaaaaaaaaaaacatatttctaatctaactaccccaaacaaaattcaaacaattatcatatcagcagccagggcct

SEQ ID NO: 375785 - DNA, 140 bp, Artificial Sequence
  Synthetic
atacgccatgctgggtctcctatgttgtagtagggagaggttgtgttattagtttgagtgtagttagattaaaagtgaaatattgtggtagttgaattggtggtagtataaatttttgaacgtacttgggagtcggccat

SEQ ID NO: 375786 - DNA, 140 bp, Artificial Sequence
  Synthetic
atggccgactcccaagtacgttcaaaaatttatactaccaccaattcaactaccacaatatttcacttttaatctaactacactcaaactaataacacaacctctccctactacaacataggagacccagcatggcgtat

SEQ ID NO: 375787 - DNA, 140 bp, Artificial Sequence
  Synthetic
aggccctggctgctgatatgaaaagtgaaatattgtggtagttgaattggtggtagtataaatttttgaaggaaagtttggttttttattttgagtaatttgagtgggtgatttggtattgaccttttgggacagcggtg

SEQ ID NO: 375788 - DNA, 140 bp, Artificial Sequence
  Synthetic
caccgctgtcccaaaaggtcaataccaaatcacccactcaaattactcaaaataaaaaaccaaactttccttcaaaaatttatactaccaccaattcaactaccacaatatttcacttttcatatcagcagccagggcct

SEQ ID NO: 375789 - DNA, 140 bp, Artificial Sequence
  Synthetic
atacgccatgctgggtctccatgggtgattgtataagatgtgagtataattgttgttgttgttgagttaaaattgtatgttttttggttagtaattttgagtggtaattaaatagggattcgtacttgggagtcggccat

SEQ ID NO: 375790 - DNA, 140 bp, Artificial Sequence
  Synthetic
atggccgactcccaagtacgaatccctatttaattaccactcaaaattactaaccaaaaaacatacaattttaactcaacaacaacaacaattatactcacatcttatacaatcacccatggagacccagcatggcgtat

SEQ ID NO: 375791 - DNA, 140 bp, Artificial Sequence
  Synthetic
aggccctggctgctgatatgaattgtatgttttttggttagtaattttgagtggtaattaaatagggatttgttttatgaggattttgggttttgagattatattgatagttgtttttaagaccttttgggacagcggtg

SEQ ID NO: 375792 - DNA, 140 bp, Artificial Sequence
  Synthetic
caccgctgtcccaaaaggtcttaaaaacaactatcaatataatctcaaaacccaaaatcctcataaaacaaatccctatttaattaccactcaaaattactaaccaaaaaacatacaattcatatcagcagccagggcct

SEQ ID NO: 375793 - DNA, 140 bp, Artificial Sequence
  Synthetic
atacgccatgctgggtctcctattattagtaataggttttatagaatttgatggtgtatttattttaggaaggattttttgtttttgttgaattttatttatagttttgtttgatttgatcgtacttgggagtcggccat

SEQ ID NO: 375794 - DNA, 140 bp, Artificial Sequence
  Synthetic
atggccgactcccaagtacgatcaaatcaaacaaaactataaataaaattcaacaaaaacaaaaaatccttcctaaaataaatacaccatcaaattctataaaacctattactaataataggagacccagcatggcgtat

SEQ ID NO: 375795 - DNA, 140 bp, Artificial Sequence
  Synthetic
aggccctggctgctgatatgaggattttttgtttttgttgaattttatttatagttttgtttgatttgatgggaagtatgtttataggatagttaatgttagtataggtaggtggtgtaggaccttttgggacagcggtg

SEQ ID NO: 375796 - DNA, 140 bp, Artificial Sequence
  Synthetic
caccgctgtcccaaaaggtcctacaccacctacctatactaacattaactatcctataaacatacttcccatcaaatcaaacaaaactataaataaaattcaacaaaaacaaaaaatcctcatatcagcagccagggcct

SEQ ID NO: 375797 - DNA, 140 bp, Artificial Sequence
  Synthetic
atacgccatgctgggtctccgagatgaaggtaagaaaaaagattttttttgagaaaattttttttttttttaatttttattaattttaatttgtttgggggtttttgtatagtattaagtcgtacttgggagtcggccat

SEQ ID NO: 375798 - DNA, 140 bp, Artificial Sequence
  Synthetic
atggccgactcccaagtacgacttaatactatacaaaaacccccaaacaaattaaaattaataaaaattaaaaaaaaaaaaaattttctcaaaaaaaatcttttttcttaccttcatctcggagacccagcatggcgtat

SEQ ID NO: 375799 - DNA, 140 bp, Artificial Sequence
  Synthetic
aggccctggctgctgatatgtaatttttattaattttaatttgtttgggggtttttgtatagtattaagtaggggaaatatgttaatgaggttttattataatataggggaatttttttagaccttttgggacagcggtg

SEQ ID NO: 375800 - DNA, 140 bp, Artificial Sequence
  Synthetic
caccgctgtcccaaaaggtctaaaaaaattcccctatattataataaaacctcattaacatatttcccctacttaatactatacaaaaacccccaaacaaattaaaattaataaaaattacatatcagcagccagggcct

SEQ ID NO: 375801 - DNA, 140 bp, Artificial Sequence
  Synthetic
atacgccatgctgggtctcctataagtttatgatataatagattattagtttaatttgattttaaatagttataagtattatttggttattgtaaaatgagtttattttgtttttgtattcgtacttgggagtcggccat

SEQ ID NO: 375802 - DNA, 140 bp, Artificial Sequence
  Synthetic
atggccgactcccaagtacgaatacaaaaacaaaataaactcattttacaataaccaaataatacttataactatttaaaatcaaattaaactaataatctattatatcataaacttataggagacccagcatggcgtat

SEQ ID NO: 375803 - DNA, 140 bp, Artificial Sequence
  Synthetic
aggccctggctgctgatatgtataagtattatttggttattgtaaaatgagtttattttgtttttgtattatatttttagtttaagggtttttttgttttggaattgaaaaatatagattgaccttttgggacagcggtg

SEQ ID NO: 375804 - DNA, 140 bp, Artificial Sequence
  Synthetic
caccgctgtcccaaaaggtcaatctatatttttcaattccaaaacaaaaaaacccttaaactaaaaatataatacaaaaacaaaataaactcattttacaataaccaaataatacttatacatatcagcagccagggcct

SEQ ID NO: 375805 - DNA, 140 bp, Artificial Sequence
  Synthetic
atacgccatgctgggtctccataggttttgggtatatttttttgagatttgatatgtataattggaggagaggtattttggaaagtagggatttgttttgttatttggattaatgtatatcgtacttgggagtcggccat

SEQ ID NO: 375806 - DNA, 140 bp, Artificial Sequence
  Synthetic
atggccgactcccaagtacgatatacattaatccaaataacaaaacaaatccctactttccaaaatacctctcctccaattatacatatcaaatctcaaaaaaatatacccaaaacctatggagacccagcatggcgtat

SEQ ID NO: 375807 - DNA, 140 bp, Artificial Sequence
  Synthetic
aggccctggctgctgatatgaggtattttggaaagtagggatttgttttgttatttggattaatgtatattggggggagttttttttagttaagtttgtttggaattttgtatgaattatgaccttttgggacagcggtg

SEQ ID NO: 375808 - DNA, 140 bp, Artificial Sequence
  Synthetic
caccgctgtcccaaaaggtcataattcatacaaaattccaaacaaacttaactaaaaaaaactccccccaatatacattaatccaaataacaaaacaaatccctactttccaaaatacctcatatcagcagccagggcct

SEQ ID NO: 375809 - DNA, 140 bp, Artificial Sequence
  Synthetic
atacgccatgctgggtctccgatgaaaagttgttttaaattttgggagatggttatagatgatttttttgagattttttgttgaaatgtaaggttgtttgaaattttttttattgagggtcgtacttgggagtcggccat

SEQ ID NO: 375810 - DNA, 140 bp, Artificial Sequence
  Synthetic
atggccgactcccaagtacgaccctcaataaaaaaaatttcaaacaaccttacatttcaacaaaaaatctcaaaaaaatcatctataaccatctcccaaaatttaaaacaacttttcatcggagacccagcatggcgtat

SEQ ID NO: 375811 - DNA, 140 bp, Artificial Sequence
  Synthetic
aggccctggctgctgatatgagattttttgttgaaatgtaaggttgtttgaaattttttttattgagggtatttgtgttatttagatttatgtaggtttgtttgatattttttggaatttgaccttttgggacagcggtg

SEQ ID NO: 375812 - DNA, 140 bp, Artificial Sequence
  Synthetic
caccgctgtcccaaaaggtcaaattccaaaaaatatcaaacaaacctacataaatctaaataacacaaataccctcaataaaaaaaatttcaaacaaccttacatttcaacaaaaaatctcatatcagcagccagggcct

SEQ ID NO: 375813 - DNA, 140 bp, Artificial Sequence
  Synthetic
atacgccatgctgggtctccgatgggtttggaggtgtttgtttatgtttattttaatatgtttttgttgttgtagtagtggtagttgtttgtttagtggttattattagtaggttgtattcgtacttgggagtcggccat

SEQ ID NO: 375814 - DNA, 140 bp, Artificial Sequence
  Synthetic
atggccgactcccaagtacgaatacaacctactaataataaccactaaacaaacaactaccactactacaacaacaaaaacatattaaaataaacataaacaaacacctccaaacccatcggagacccagcatggcgtat

SEQ ID NO: 375815 - DNA, 140 bp, Artificial Sequence
  Synthetic
aggccctggctgctgatatgtgtagtagtggtagttgtttgtttagtggttattattagtaggttgtattttgtaattattttggtatagttgtgatttagggatgatatggtttttgttgaccttttgggacagcggtg

SEQ ID NO: 375816 - DNA, 140 bp, Artificial Sequence
  Synthetic
caccgctgtcccaaaaggtcaacaaaaaccatatcatccctaaatcacaactataccaaaataattacaaaatacaacctactaataataaccactaaacaaacaactaccactactacacatatcagcagccagggcct

SEQ ID NO: 375817 - DNA, 140 bp, Artificial Sequence
  Synthetic
atacgccatgctgggtctcctagtgatttaatagtattggtttgttgatgtatagttgatattattgaatttatggtagttttgattttttttgttaataagttattggtattatttgttcgtacttgggagtcggccat

SEQ ID NO: 375818 - DNA, 140 bp, Artificial Sequence
  Synthetic
atggccgactcccaagtacgaacaaataataccaataacttattaacaaaaaaaatcaaaactaccataaattcaataatatcaactatacatcaacaaaccaatactattaaatcactaggagacccagcatggcgtat

SEQ ID NO: 375819 - DNA, 140 bp, Artificial Sequence
  Synthetic
aggccctggctgctgatatgttatggtagttttgattttttttgttaataagttattggtattatttgtttggatttgtttattatttttatgtgttgttttgggatttttattaataatgaccttttgggacagcggtg

SEQ ID NO: 375820 - DNA, 140 bp, Artificial Sequence
  Synthetic
caccgctgtcccaaaaggtcattattaataaaaatcccaaaacaacacataaaaataataaacaaatccaaacaaataataccaataacttattaacaaaaaaaatcaaaactaccataacatatcagcagccagggcct

SEQ ID NO: 375821 - DNA, 140 bp, Artificial Sequence
  Synthetic
atacgccatgctgggtctccttagtggtattttgttggttattaattgtttagaaaattagttagatattttgggtttatgatgtttataagttttattttgttgtatggtttatatgttcgtacttgggagtcggccat

SEQ ID NO: 375822 - DNA, 140 bp, Artificial Sequence
  Synthetic
atggccgactcccaagtacgaacatataaaccatacaacaaaataaaacttataaacatcataaacccaaaatatctaactaattttctaaacaattaataaccaacaaaataccactaaggagacccagcatggcgtat

SEQ ID NO: 375823 - DNA, 140 bp, Artificial Sequence
  Synthetic
aggccctggctgctgatatgttgggtttatgatgtttataagttttattttgttgtatggtttatatgttgggtagtgtttaggttaagagggtataaaataatagtttttagatattaagaccttttgggacagcggtg

SEQ ID NO: 375824 - DNA, 140 bp, Artificial Sequence
  Synthetic
caccgctgtcccaaaaggtcttaatatctaaaaactattattttataccctcttaacctaaacactacccaacatataaaccatacaacaaaataaaacttataaacatcataaacccaacatatcagcagccagggcct

SEQ ID NO: 375825 - DNA, 140 bp, Artificial Sequence
  Synthetic
atacgccatgctgggtctcctttaatttttattatgaatttttttttaattttaagttttatagaatttattaggatattatttttttaagtttattgaaggatattttatgttttaatgcgtacttgggagtcggccat

SEQ ID NO: 375826 - DNA, 140 bp, Artificial Sequence
  Synthetic
atggccgactcccaagtacgcattaaaacataaaatatccttcaataaacttaaaaaaataatatcctaataaattctataaaacttaaaattaaaaaaaaattcataataaaaattaaaggagacccagcatggcgtat

SEQ ID NO: 375827 - DNA, 140 bp, Artificial Sequence
  Synthetic
aggccctggctgctgatatgttaggatattatttttttaagtttattgaaggatattttatgttttaatgttataatgtttttttattggtatatattataagttgattaaaattattaagaccttttgggacagcggtg

SEQ ID NO: 375828 - DNA, 140 bp, Artificial Sequence
  Synthetic
caccgctgtcccaaaaggtcttaataattttaatcaacttataatatataccaataaaaaaacattataacattaaaacataaaatatccttcaataaacttaaaaaaataatatcctaacatatcagcagccagggcct

SEQ ID NO: 375829 - DNA, 140 bp, Artificial Sequence
  Synthetic
atacgccatgctgggtctccagttttttatagttttataatttatagattatttatttaatttttttataattaaaatagggtttatattttgggttggttgtttatatttgaattattacgtacttgggagtcggccat

SEQ ID NO: 375830 - DNA, 140 bp, Artificial Sequence
  Synthetic
atggccgactcccaagtacgtaataattcaaatataaacaaccaacccaaaatataaaccctattttaattataaaaaaattaaataaataatctataaattataaaactataaaaaactggagacccagcatggcgtat

SEQ ID NO: 375831 - DNA, 140 bp, Artificial Sequence
  Synthetic
aggccctggctgctgatatgattaaaatagggtttatattttgggttggttgtttatatttgaattattaaaataattataattaagtttagaataaataaaatttattaattatgggttgaccttttgggacagcggtg

SEQ ID NO: 375832 - DNA, 140 bp, Artificial Sequence
  Synthetic
caccgctgtcccaaaaggtcaacccataattaataaattttatttattctaaacttaattataattattttaataattcaaatataaacaaccaacccaaaatataaaccctattttaatcatatcagcagccagggcct

SEQ ID NO: 375833 - DNA, 140 bp, Artificial Sequence
  Synthetic
atacgccatgctgggtctccggttagaggaattgttggttattaatgattagataatgattttttttttttaaggttttttttttatttaattaaggtgggtaggtttttttaagagaatcgtacttgggagtcggccat

SEQ ID NO: 375834 - DNA, 140 bp, Artificial Sequence
  Synthetic
atggccgactcccaagtacgattctcttaaaaaaacctacccaccttaattaaataaaaaaaaaaccttaaaaaaaaaaaatcattatctaatcattaataaccaacaattcctctaaccggagacccagcatggcgtat

SEQ ID NO: 375835 - DNA, 140 bp, Artificial Sequence
  Synthetic
aggccctggctgctgatatgtaaggttttttttttatttaattaaggtgggtaggtttttttaagagaatttgggaagatatattttttgttatttttagtgttaaaagtaatgggtttagaccttttgggacagcggtg

SEQ ID NO: 375836 - DNA, 140 bp, Artificial Sequence
  Synthetic
caccgctgtcccaaaaggtctaaacccattacttttaacactaaaaataacaaaaaatatatcttcccaaattctcttaaaaaaacctacccaccttaattaaataaaaaaaaaaccttacatatcagcagccagggcct

SEQ ID NO: 375837 - DNA, 140 bp, Artificial Sequence
  Synthetic
atacgccatgctgggtctcctaggagatgataatatgttttttttagtgtagatttttttttggggttgattgggagagttttatttttagaattttgattatttatagtattgtttggtcgtacttgggagtcggccat

SEQ ID NO: 375838 - DNA, 140 bp, Artificial Sequence
  Synthetic
atggccgactcccaagtacgaccaaacaatactataaataatcaaaattctaaaaataaaactctcccaatcaaccccaaaaaaaaatctacactaaaaaaaacatattatcatctcctaggagacccagcatggcgtat

SEQ ID NO: 375839 - DNA, 140 bp, Artificial Sequence
  Synthetic
aggccctggctgctgatatgttgggagagttttatttttagaattttgattatttatagtattgtttggtttattttgttgattagtgtttattttagtatttttgtagattggtgttgggaccttttgggacagcggtg

SEQ ID NO: 375840 - DNA, 140 bp, Artificial Sequence
  Synthetic
caccgctgtcccaaaaggtcccaacaccaatctacaaaaatactaaaataaacactaatcaacaaaataaaccaaacaatactataaataatcaaaattctaaaaataaaactctcccaacatatcagcagccagggcct

SEQ ID NO: 375841 - DNA, 140 bp, Artificial Sequence
  Synthetic
atacgccatgctgggtctcctatttttagagttaagggatgtgagatttttgttattattatttttttgattattgggttttgattttttttgtataggggttatattttggagagtagacgtacttgggagtcggccat

SEQ ID NO: 375842 - DNA, 140 bp, Artificial Sequence
  Synthetic
atggccgactcccaagtacgtctactctccaaaatataacccctatacaaaaaaaatcaaaacccaataatcaaaaaaataataataacaaaaatctcacatcccttaactctaaaaataggagacccagcatggcgtat

SEQ ID NO: 375843 - DNA, 140 bp, Artificial Sequence
  Synthetic
aggccctggctgctgatatgttattgggttttgattttttttgtataggggttatattttggagagtagatgatatattgttttgtggttggttggtgtttgaatttggtttggtgatgtgaccttttgggacagcggtg

SEQ ID NO: 375844 - DNA, 140 bp, Artificial Sequence
  Synthetic
caccgctgtcccaaaaggtcacatcaccaaaccaaattcaaacaccaaccaaccacaaaacaatatatcatctactctccaaaatataacccctatacaaaaaaaatcaaaacccaataacatatcagcagccagggcct

SEQ ID NO: 375845 - DNA, 140 bp, Artificial Sequence
  Synthetic
atacgccatgctgggtctccgttttgtttaaggttggattttggaggttatgtgtttgagttgttttttttttgttttgttttttgtttggtggttttggttggttgttgttattgttgtcgtacttgggagtcggccat

SEQ ID NO: 375846 - DNA, 140 bp, Artificial Sequence
  Synthetic
atggccgactcccaagtacgacaacaataacaacaaccaaccaaaaccaccaaacaaaaaacaaaacaaaaaaaaaacaactcaaacacataacctccaaaatccaaccttaaacaaaacggagacccagcatggcgtat

SEQ ID NO: 375847 - DNA, 140 bp, Artificial Sequence
  Synthetic
aggccctggctgctgatatgtttgttttgttttttgtttggtggttttggttggttgttgttattgttgttgtttaaattgaagagattaagattttttgtggtgtttttagttgaatttgaccttttgggacagcggtg

SEQ ID NO: 375848 - DNA, 140 bp, Artificial Sequence
  Synthetic
caccgctgtcccaaaaggtcaaattcaactaaaaacaccacaaaaaatcttaatctcttcaatttaaacaacaacaataacaacaaccaaccaaaaccaccaaacaaaaaacaaaacaaacatatcagcagccagggcct

SEQ ID NO: 375849 - DNA, 140 bp, Artificial Sequence
  Synthetic
atacgccatgctgggtctccatttgggatagttgtattatgtgaattattaggattattattagaagggttggggtgggttttattatagattggtttgggaaatggaatattattgttacgtacttgggagtcggccat

SEQ ID NO: 375850 - DNA, 140 bp, Artificial Sequence
  Synthetic
atggccgactcccaagtacgtaacaataatattccatttcccaaaccaatctataataaaacccaccccaacccttctaataataatcctaataattcacataatacaactatcccaaatggagacccagcatggcgtat

SEQ ID NO: 375851 - DNA, 140 bp, Artificial Sequence
  Synthetic
aggccctggctgctgatatgtggggtgggttttattatagattggtttgggaaatggaatattattgttattaggataatgatttttaattttgatttttgatgtagttgtgatggttttgaccttttgggacagcggtg

SEQ ID NO: 375852 - DNA, 140 bp, Artificial Sequence
  Synthetic
caccgctgtcccaaaaggtcaaaaccatcacaactacatcaaaaatcaaaattaaaaatcattatcctaataacaataatattccatttcccaaaccaatctataataaaacccaccccacatatcagcagccagggcct

SEQ ID NO: 375853 - DNA, 140 bp, Artificial Sequence
  Synthetic
atacgccatgctgggtctccgttggaagttgattttattttttttttggtggaagtttatgagaattttttttttttgtttattaagtttaaggttgtttaatttatgtgttttagtatacgtacttgggagtcggccat

SEQ ID NO: 375854 - DNA, 140 bp, Artificial Sequence
  Synthetic
atggccgactcccaagtacgtatactaaaacacataaattaaacaaccttaaacttaataaacaaaaaaaaaaaattctcataaacttccaccaaaaaaaaaataaaatcaacttccaacggagacccagcatggcgtat

SEQ ID NO: 375855 - DNA, 140 bp, Artificial Sequence
  Synthetic
aggccctggctgctgatatgtttttttgtttattaagtttaaggttgtttaatttatgtgttttagtatattgttggagttgttttttagttttagtagtagttttatgtagttgttgatgaccttttgggacagcggtg

SEQ ID NO: 375856 - DNA, 140 bp, Artificial Sequence
  Synthetic
caccgctgtcccaaaaggtcatcaacaactacataaaactactactaaaactaaaaaacaactccaacaatatactaaaacacataaattaaacaaccttaaacttaataaacaaaaaaacatatcagcagccagggcct

SEQ ID NO: 375857 - DNA, 140 bp, Artificial Sequence
  Synthetic
atacgccatgctgggtctccatatttaaagtaatggttgagagttgtggataaagtttatgttttaagttgttgattttagaaagattgaggagatgtgtaaatggagtatattttttatcgtacttgggagtcggccat

SEQ ID NO: 375858 - DNA, 140 bp, Artificial Sequence
  Synthetic
atggccgactcccaagtacgataaaaaatatactccatttacacatctcctcaatctttctaaaatcaacaacttaaaacataaactttatccacaactctcaaccattactttaaatatggagacccagcatggcgtat

SEQ ID NO: 375859 - DNA, 140 bp, Artificial Sequence
  Synthetic
aggccctggctgctgatatggttgattttagaaagattgaggagatgtgtaaatggagtatattttttatgtttggtaagtgagttaagagttgttttgaatgaattgattttatttttggaccttttgggacagcggtg

SEQ ID NO: 375860 - DNA, 140 bp, Artificial Sequence
  Synthetic
caccgctgtcccaaaaggtccaaaaataaaatcaattcattcaaaacaactcttaactcacttaccaaacataaaaaatatactccatttacacatctcctcaatctttctaaaatcaaccatatcagcagccagggcct

SEQ ID NO: 375861 - DNA, 140 bp, Artificial Sequence
  Synthetic
atacgccatgctgggtctccttgtaggatgtggtttagaatagtttttataattagaagattagagaattttgtttgggtaatagaattagatattattgtgttatttgtattatggtttcgtacttgggagtcggccat

SEQ ID NO: 375862 - DNA, 140 bp, Artificial Sequence
  Synthetic
atggccgactcccaagtacgaaaccataatacaaataacacaataatatctaattctattacccaaacaaaattctctaatcttctaattataaaaactattctaaaccacatcctacaaggagacccagcatggcgtat

SEQ ID NO: 375863 - DNA, 140 bp, Artificial Sequence
  Synthetic
aggccctggctgctgatatgttgtttgggtaatagaattagatattattgtgttatttgtattatggtttgtgattatgtgtattttttgatgtattagtaggaatttgattaaaaagttgaccttttgggacagcggtg

SEQ ID NO: 375864 - DNA, 140 bp, Artificial Sequence
  Synthetic
caccgctgtcccaaaaggtcaactttttaatcaaattcctactaatacatcaaaaaatacacataatcacaaaccataatacaaataacacaataatatctaattctattacccaaacaacatatcagcagccagggcct

SEQ ID NO: 375865 - DNA, 140 bp, Artificial Sequence
  Synthetic
atacgccatgctgggtctccaagttggatattgaatgagtttttgttttgtatggatttgaatttgtttttgtattttttttagatatgttttttttttaatgataagtttgggtagaaacgtacttgggagtcggccat

SEQ ID NO: 375866 - DNA, 140 bp, Artificial Sequence
  Synthetic
atggccgactcccaagtacgtttctacccaaacttatcattaaaaaaaaaacatatctaaaaaaaatacaaaaacaaattcaaatccatacaaaacaaaaactcattcaatatccaacttggagacccagcatggcgtat

SEQ ID NO: 375867 - DNA, 140 bp, Artificial Sequence
  Synthetic
aggccctggctgctgatatgtgtattttttttagatatgttttttttttaatgataagtttgggtagaaataaattggtaaaggataaaaattgattagtattagtttttgttgttttttgaccttttgggacagcggtg

SEQ ID NO: 375868 - DNA, 140 bp, Artificial Sequence
  Synthetic
caccgctgtcccaaaaggtcaaaaaacaacaaaaactaatactaatcaatttttatcctttaccaatttatttctacccaaacttatcattaaaaaaaaaacatatctaaaaaaaatacacatatcagcagccagggcct

SEQ ID NO: 375869 - DNA, 140 bp, Artificial Sequence
  Synthetic
atacgccatgctgggtctccttgggtaataatttatttagatggtgtatatttttttttttttggattttaaatttgaaattatggttttttaagtattgaattgtattatttttgaggacgtacttgggagtcggccat

SEQ ID NO: 375870 - DNA, 140 bp, Artificial Sequence
  Synthetic
atggccgactcccaagtacgtcctcaaaaataatacaattcaatacttaaaaaaccataatttcaaatttaaaatccaaaaaaaaaaaaatatacaccatctaaataaattattacccaaggagacccagcatggcgtat

SEQ ID NO: 375871 - DNA, 140 bp, Artificial Sequence
  Synthetic
aggccctggctgctgatatgaaatttgaaattatggttttttaagtattgaattgtattatttttgaggaagagtttatgatttttttggtaagtatgatgtaaatataaaagtaaaagggaccttttgggacagcggtg

SEQ ID NO: 375872 - DNA, 140 bp, Artificial Sequence
  Synthetic
caccgctgtcccaaaaggtcccttttacttttatatttacatcatacttaccaaaaaaatcataaactcttcctcaaaaataatacaattcaatacttaaaaaaccataatttcaaatttcatatcagcagccagggcct

SEQ ID NO: 375873 - DNA, 140 bp, Artificial Sequence
  Synthetic
atacgccatgctgggtctccgatatgttgataaatatttttaagattatttataatatatattgggatgattttttgttgtataattttttgttggattgaaagtttggttgttaatattcgtacttgggagtcggccat

SEQ ID NO: 375874 - DNA, 140 bp, Artificial Sequence
  Synthetic
atggccgactcccaagtacgaatattaacaaccaaactttcaatccaacaaaaaattatacaacaaaaaatcatcccaatatatattataaataatcttaaaaatatttatcaacatatcggagacccagcatggcgtat

SEQ ID NO: 375875 - DNA, 140 bp, Artificial Sequence
  Synthetic
aggccctggctgctgatatgttttttgttgtataattttttgttggattgaaagtttggttgttaatattttgtggtagttaagattaattttagattgtttttttagggtttatgaattgaccttttgggacagcggtg

SEQ ID NO: 375876 - DNA, 140 bp, Artificial Sequence
  Synthetic
caccgctgtcccaaaaggtcaattcataaaccctaaaaaaacaatctaaaattaatcttaactaccacaaaatattaacaaccaaactttcaatccaacaaaaaattatacaacaaaaaacatatcagcagccagggcct

SEQ ID NO: 375877 - DNA, 140 bp, Artificial Sequence
  Synthetic
atacgccatgctgggtctccagtgtgtgatgagagtaattagtttatttagttaaaattagttagattttgtggattggagggatattttgggattttttttttatttttttttaggattcgtacttgggagtcggccat

SEQ ID NO: 375878 - DNA, 140 bp, Artificial Sequence
  Synthetic
atggccgactcccaagtacgaatcctaaaaaaaaataaaaaaaaaatcccaaaatatccctccaatccacaaaatctaactaattttaactaaataaactaattactctcatcacacactggagacccagcatggcgtat

SEQ ID NO: 375879 - DNA, 140 bp, Artificial Sequence
  Synthetic
aggccctggctgctgatatggtggattggagggatattttgggattttttttttatttttttttaggatttgagatagtattggttttattagaaaatgttaattattaggatgaaattagaccttttgggacagcggtg

SEQ ID NO: 375880 - DNA, 140 bp, Artificial Sequence
  Synthetic
caccgctgtcccaaaaggtctaatttcatcctaataattaacattttctaataaaaccaatactatctcaaatcctaaaaaaaaataaaaaaaaaatcccaaaatatccctccaatccaccatatcagcagccagggcct

SEQ ID NO: 375881 - DNA, 140 bp, Artificial Sequence
  Synthetic
atacgccatgctgggtctccgagttaggttaggaaaaggtaaagtaatatgatttatatatttttgtaatattttaggaatgtttttaaatgggggattgattagttaaattgtttttaacgtacttgggagtcggccat

SEQ ID NO: 375882 - DNA, 140 bp, Artificial Sequence
  Synthetic
atggccgactcccaagtacgttaaaaacaatttaactaatcaatcccccatttaaaaacattcctaaaatattacaaaaatatataaatcatattactttaccttttcctaacctaactcggagacccagcatggcgtat

SEQ ID NO: 375883 - DNA, 140 bp, Artificial Sequence
  Synthetic
atacgccatgctgggtctccttggtaaatgatgagattaattttaatgttaatattagtttgagtttgaggaaaatgattaattttttttatagttatttgtatataaaaagtataaaaacgtacttgggagtcggccat

SEQ ID NO: 375884 - DNA, 140 bp, Artificial Sequence
  Synthetic
atggccgactcccaagtacgtttttatactttttatatacaaataactataaaaaaaattaatcattttcctcaaactcaaactaatattaacattaaaattaatctcatcatttaccaaggagacccagcatggcgtat

SEQ ID NO: 375885 - DNA, 140 bp, Artificial Sequence
  Synthetic
atacgccatgctgggtctcctggatatataaaaagaaaaaaggttttttaagattttttgtgtgtgagtaattatgaggaagattaatagttttttttagtttaagatatatattgaaatcgtacttgggagtcggccat

SEQ ID NO: 375886 - DNA, 140 bp, Artificial Sequence
  Synthetic
atggccgactcccaagtacgatttcaatatatatcttaaactaaaaaaaactattaatcttcctcataattactcacacacaaaaaatcttaaaaaaccttttttctttttatatatccaggagacccagcatggcgtat

SEQ ID NO: 375887 - DNA, 140 bp, Artificial Sequence
  Synthetic
aggccctggctgctgatatgattatgaggaagattaatagttttttttagtttaagatatatattgaaattgagattgagatttttttttttgttattttgtaattttttttggttgtgagaccttttgggacagcggtg

SEQ ID NO: 375888 - DNA, 140 bp, Artificial Sequence
  Synthetic
caccgctgtcccaaaaggtctcacaaccaaaaaaaattacaaaataacaaaaaaaaaaatctcaatctcaatttcaatatatatcttaaactaaaaaaaactattaatcttcctcataatcatatcagcagccagggcct

SEQ ID NO: 375889 - DNA, 140 bp, Artificial Sequence
  Synthetic
atacgccatgctgggtctcctgagattgagatttttttttttgttattttgtaattttttttggttgtgataattgaattagttttatttattattaattattattaatatggtatgtttcgtacttgggagtcggccat

SEQ ID NO: 375890 - DNA, 140 bp, Artificial Sequence
  Synthetic
atggccgactcccaagtacgaaacataccatattaataataattaataataaataaaactaattcaattatcacaaccaaaaaaaattacaaaataacaaaaaaaaaaatctcaatctcaggagacccagcatggcgtat

SEQ ID NO: 375891 - DNA, 140 bp, Artificial Sequence
  Synthetic
atacgccatgctgggtctccattttgtgagaagtttatttaaatgatttagtgtttgaaaatataaaaggtttttttttttgttaagtttaaggggttgttttgattgtgtgtagattttcgtacttgggagtcggccat

SEQ ID NO: 375892 - DNA, 140 bp, Artificial Sequence
  Synthetic
atggccgactcccaagtacgaaaatctacacacaatcaaaacaaccccttaaacttaacaaaaaaaaaaaccttttatattttcaaacactaaatcatttaaataaacttctcacaaaatggagacccagcatggcgtat

SEQ ID NO: 375893 - DNA, 140 bp, Artificial Sequence
  Synthetic
aggccctggctgctgatatgtttttttttttgttaagtttaaggggttgttttgattgtgtgtagattttataattttagagtgttaaggagttgtgtgttattattgattgggaagattgaccttttgggacagcggtg

SEQ ID NO: 375894 - DNA, 140 bp, Artificial Sequence
  Synthetic
caccgctgtcccaaaaggtcaatcttcccaatcaataataacacacaactccttaacactctaaaattataaaatctacacacaatcaaaacaaccccttaaacttaacaaaaaaaaaaacatatcagcagccagggcct

SEQ ID NO: 375895 - DNA, 140 bp, Artificial Sequence
  Synthetic
atacgccatgctgggtctccaggggaagttgatatggattgtgggattagaagaatttgggtgttgtaaaattaaggtgatattgatttagattattataaaattttgatagttggttttcgtacttgggagtcggccat

SEQ ID NO: 375896 - DNA, 140 bp, Artificial Sequence
  Synthetic
atggccgactcccaagtacgaaaaccaactatcaaaattttataataatctaaatcaatatcaccttaattttacaacacccaaattcttctaatcccacaatccatatcaacttcccctggagacccagcatggcgtat

SEQ ID NO: 375897 - DNA, 140 bp, Artificial Sequence
  Synthetic
aggccctggctgctgatatgattaaggtgatattgatttagattattataaaattttgatagttggttttattgtttaatagggaattgttaggtagaaaataatttttgtatattttgtgaccttttgggacagcggtg

SEQ ID NO: 375898 - DNA, 140 bp, Artificial Sequence
  Synthetic
caccgctgtcccaaaaggtcacaaaatatacaaaaattattttctacctaacaattccctattaaacaataaaaccaactatcaaaattttataataatctaaatcaatatcaccttaatcatatcagcagccagggcct

SEQ ID NO: 375899 - DNA, 140 bp, Artificial Sequence
  Synthetic
atacgccatgctgggtctccgaattgatttttaagaaaatgttgatagtttttttttgatgttttgtttatattatgtttattaaggtgattataaattgtttttggagagtaatgttgtcgtacttgggagtcggccat

SEQ ID NO: 375900 - DNA, 140 bp, Artificial Sequence
  Synthetic
atggccgactcccaagtacgacaacattactctccaaaaacaatttataatcaccttaataaacataatataaacaaaacatcaaaaaaaaactatcaacattttcttaaaaatcaattcggagacccagcatggcgtat

SEQ ID NO: 375901 - DNA, 140 bp, Artificial Sequence
  Synthetic
aggccctggctgctgatatgtattatgtttattaaggtgattataaattgtttttggagagtaatgttgtatagtatttggaaggttatggatttaaatttgagttttggaagaaggatggaccttttgggacagcggtg

SEQ ID NO: 375902 - DNA, 140 bp, Artificial Sequence
  Synthetic
caccgctgtcccaaaaggtccatccttcttccaaaactcaaatttaaatccataaccttccaaatactatacaacattactctccaaaaacaatttataatcaccttaataaacataatacatatcagcagccagggcct

SEQ ID NO: 375903 - DNA, 140 bp, Artificial Sequence
  Synthetic
atacgccatgctgggtctccattaggtgtatgttggttgtattgtttgaagaggagattatagaagtaaatgtagggtaattttttttatttgtgagtttgtttttttttaaattggttgcgtacttgggagtcggccat

SEQ ID NO: 375904 - DNA, 140 bp, Artificial Sequence
  Synthetic
atggccgactcccaagtacgcaaccaatttaaaaaaaaacaaactcacaaataaaaaaaattaccctacatttacttctataatctcctcttcaaacaatacaaccaacatacacctaatggagacccagcatggcgtat

SEQ ID NO: 375905 - DNA, 140 bp, Artificial Sequence
  Synthetic
aggccctggctgctgatatgtgtagggtaattttttttatttgtgagtttgtttttttttaaattggttgtgggagagaaggtttgtttggaaaaagtttagtgataaatttaggtttatgaccttttgggacagcggtg

SEQ ID NO: 375906 - DNA, 140 bp, Artificial Sequence
  Synthetic
caccgctgtcccaaaaggtcataaacctaaatttatcactaaactttttccaaacaaaccttctctcccacaaccaatttaaaaaaaaacaaactcacaaataaaaaaaattaccctacacatatcagcagccagggcct

SEQ ID NO: 375907 - DNA, 140 bp, Artificial Sequence
  Synthetic
atacgccatgctgggtctcctatgatggtaatttttagattgatgaggattaattttttgattaaatatttattgatttattagggtatgtatatggtagttggttatgatgttaatgatcgtacttgggagtcggccat

SEQ ID NO: 375908 - DNA, 140 bp, Artificial Sequence
  Synthetic
atggccgactcccaagtacgatcattaacatcataaccaactaccatatacataccctaataaatcaataaatatttaatcaaaaaattaatcctcatcaatctaaaaattaccatcataggagacccagcatggcgtat

SEQ ID NO: 375909 - DNA, 140 bp, Artificial Sequence
  Synthetic
aggccctggctgctgatatgtattgatttattagggtatgtatatggtagttggttatgatgttaatgatgttgttattgttaatttagttgtttaggtttgttttttaggatttttaatgaccttttgggacagcggtg

SEQ ID NO: 375910 - DNA, 140 bp, Artificial Sequence
  Synthetic
caccgctgtcccaaaaggtcattaaaaatcctaaaaaacaaacctaaacaactaaattaacaataacaacatcattaacatcataaccaactaccatatacataccctaataaatcaatacatatcagcagccagggcct

SEQ ID NO: 375911 - DNA, 140 bp, Artificial Sequence
  Synthetic
atacgccatgctgggtctccgattttattttttggtttgaatagttaaagtgtgtaatgaggttaatgtatttaaggttgttttaagtttatttgttaagtatggggaatatgtttttttcgtacttgggagtcggccat

SEQ ID NO: 375912 - DNA, 140 bp, Artificial Sequence
  Synthetic
atggccgactcccaagtacgaaaaaaacatattccccatacttaacaaataaacttaaaacaaccttaaatacattaacctcattacacactttaactattcaaaccaaaaaataaaatcggagacccagcatggcgtat

SEQ ID NO: 375913 - DNA, 140 bp, Artificial Sequence
  Synthetic
aggccctggctgctgatatgtttaaggttgttttaagtttatttgttaagtatggggaatatgttttttttgtttgtttttttaattttttgggagttaataatttagaatatggtttttgaccttttgggacagcggtg

SEQ ID NO: 375914 - DNA, 140 bp, Artificial Sequence
  Synthetic
caccgctgtcccaaaaggtcaaaaaccatattctaaattattaactcccaaaaaattaaaaaaacaaacaaaaaaaacatattccccatacttaacaaataaacttaaaacaaccttaaacatatcagcagccagggcct

SEQ ID NO: 375915 - DNA, 140 bp, Artificial Sequence
  Synthetic
atacgccatgctgggtctccatttttgtaggagttaatgttggtgagtagtattagtagtttagagaggttgttattgaagttgagaagtaattttaataatatgttgagtttagagaatcgtacttgggagtcggccat

SEQ ID NO: 375916 - DNA, 140 bp, Artificial Sequence
  Synthetic
atggccgactcccaagtacgattctctaaactcaacatattattaaaattacttctcaacttcaataacaacctctctaaactactaatactactcaccaacattaactcctacaaaaatggagacccagcatggcgtat

SEQ ID NO: 375917 - DNA, 140 bp, Artificial Sequence
  Synthetic
aggccctggctgctgatatgtgttattgaagttgagaagtaattttaataatatgttgagtttagagaatttgatagtttaggtttggatgattaggaaagaagaatattaatgaattttgaccttttgggacagcggtg

SEQ ID NO: 375918 - DNA, 140 bp, Artificial Sequence
  Synthetic
caccgctgtcccaaaaggtcaaaattcattaatattcttctttcctaatcatccaaacctaaactatcaaattctctaaactcaacatattattaaaattacttctcaacttcaataacacatatcagcagccagggcct

SEQ ID NO: 375919 - DNA, 140 bp, Artificial Sequence
  Synthetic
atacgccatgctgggtctccttttaggaaagagtgattggttaaattaatagaagttataatgttggttttaagatttaattttgggtttagataagatgatggtaatgaaatattgtttcgtacttgggagtcggccat

SEQ ID NO: 375920 - DNA, 140 bp, Artificial Sequence
  Synthetic
atggccgactcccaagtacgaaacaatatttcattaccatcatcttatctaaacccaaaattaaatcttaaaaccaacattataacttctattaatttaaccaatcactctttcctaaaaggagacccagcatggcgtat

SEQ ID NO: 375921 - DNA, 140 bp, Artificial Sequence
  Synthetic
aggccctggctgctgatatgtaagatttaattttgggtttagataagatgatggtaatgaaatattgttttttgggtttataagtaataatttagattaagattatttggaggatgatttgaccttttgggacagcggtg

SEQ ID NO: 375922 - DNA, 140 bp, Artificial Sequence
  Synthetic
caccgctgtcccaaaaggtcaaatcatcctccaaataatcttaatctaaattattacttataaacccaaaaaacaatatttcattaccatcatcttatctaaacccaaaattaaatcttacatatcagcagccagggcct

SEQ ID NO: 375923 - DNA, 140 bp, Artificial Sequence
  Synthetic
atacgccatgctgggtctccatggtgattttgaaaattataatggttattatgatgatgaagttgggatggtaggtgatttggttttgtttgattttgatgattatgaggatgataataacgtacttgggagtcggccat

SEQ ID NO: 375924 - DNA, 140 bp, Artificial Sequence
  Synthetic
atggccgactcccaagtacgttattatcatcctcataatcatcaaaatcaaacaaaaccaaatcacctaccatcccaacttcatcatcataataaccattataattttcaaaatcaccatggagacccagcatggcgtat

SEQ ID NO: 375925 - DNA, 140 bp, Artificial Sequence
  Synthetic
aggccctggctgctgatatggtaggtgatttggttttgtttgattttgatgattatgaggatgataataaagtttttgagttataggatagtttgttataattttaaagggaaatagagagaccttttgggacagcggtg

SEQ ID NO: 375926 - DNA, 140 bp, Artificial Sequence
  Synthetic
caccgctgtcccaaaaggtctctctatttccctttaaaattataacaaactatcctataactcaaaaactttattatcatcctcataatcatcaaaatcaaacaaaaccaaatcacctaccatatcagcagccagggcct

SEQ ID NO: 375927 - DNA, 140 bp, Artificial Sequence
  Synthetic
atacgccatgctgggtctccgttttagataataattaataattagtagattttgaggaataaggaggttaatataattggtattgaggtttagaatgtatgattgttaattgaagattttcgtacttgggagtcggccat

SEQ ID NO: 375928 - DNA, 140 bp, Artificial Sequence
  Synthetic
atggccgactcccaagtacgaaaatcttcaattaacaatcatacattctaaacctcaataccaattatattaacctccttattcctcaaaatctactaattattaattattatctaaaacggagacccagcatggcgtat

SEQ ID NO: 375929 - DNA, 140 bp, Artificial Sequence
  Synthetic
aggccctggctgctgatatgatataattggtattgaggtttagaatgtatgattgttaattgaagatttttattagtgtatgaagaggatatttttatggattaaggtgatgatgattttgaccttttgggacagcggtg

SEQ ID NO: 375930 - DNA, 140 bp, Artificial Sequence
  Synthetic
caccgctgtcccaaaaggtcaaaatcatcatcaccttaatccataaaaatatcctcttcatacactaataaaaatcttcaattaacaatcatacattctaaacctcaataccaattatatcatatcagcagccagggcct

SEQ ID NO: 375931 - DNA, 140 bp, Artificial Sequence
  Synthetic
atacgccatgctgggtctccataagattttgattatatagttgttgttttttttgtttttgtatattgtagtgtagaagtttatgagtttttttataaatttttgaatgagttagttgaacgtacttgggagtcggccat

SEQ ID NO: 375932 - DNA, 140 bp, Artificial Sequence
  Synthetic
atggccgactcccaagtacgttcaactaactcattcaaaaatttataaaaaaactcataaacttctacactacaatatacaaaaacaaaaaaaacaacaactatataatcaaaatcttatggagacccagcatggcgtat

SEQ ID NO: 375933 - DNA, 140 bp, Artificial Sequence
  Synthetic
aggccctggctgctgatatggtgtagaagtttatgagtttttttataaatttttgaatgagttagttgaaatattataattgaatgaagattttgatattggttaattaaagtttatgtagaccttttgggacagcggtg

SEQ ID NO: 375934 - DNA, 140 bp, Artificial Sequence
  Synthetic
caccgctgtcccaaaaggtctacataaactttaattaaccaatatcaaaatcttcattcaattataatatttcaactaactcattcaaaaatttataaaaaaactcataaacttctacaccatatcagcagccagggcct

SEQ ID NO: 375935 - DNA, 140 bp, Artificial Sequence
  Synthetic
atacgccatgctgggtctccaagttattaattattattatatgatgaaggatgagttggtaatatttagtattgatgatgggaaggaatatatttatttggatttatttgaggaagtttacgtacttgggagtcggccat

SEQ ID NO: 375936 - DNA, 140 bp, Artificial Sequence
  Synthetic
atggccgactcccaagtacgtaaacttcctcaaataaatccaaataaatatattccttcccatcatcaatactaaatattaccaactcatccttcatcatataataataattaataacttggagacccagcatggcgtat

SEQ ID NO: 375937 - DNA, 140 bp, Artificial Sequence
  Synthetic
aggccctggctgctgatatgattgatgatgggaaggaatatatttatttggatttatttgaggaagtttattttttatggtttattgagaaagaatgattggataaagagaattgttatagaccttttgggacagcggtg

SEQ ID NO: 375938 - DNA, 140 bp, Artificial Sequence
  Synthetic
caccgctgtcccaaaaggtctataacaattctctttatccaatcattctttctcaataaaccataaaaaataaacttcctcaaataaatccaaataaatatattccttcccatcatcaatcatatcagcagccagggcct

SEQ ID NO: 375939 - DNA, 140 bp, Artificial Sequence
  Synthetic
atacgccatgctgggtctccaaattttttgtaattttgtagtattattagtaattatagtataaagtgtggtttattttgtaaagttaaatatatttaagatttgattgatttatttatacgtacttgggagtcggccat

SEQ ID NO: 375940 - DNA, 140 bp, Artificial Sequence
  Synthetic
atggccgactcccaagtacgtataaataaatcaatcaaatcttaaatatatttaactttacaaaataaaccacactttatactataattactaataatactacaaaattacaaaaaatttggagacccagcatggcgtat

SEQ ID NO: 375941 - DNA, 140 bp, Artificial Sequence
  Synthetic
aggccctggctgctgatatggtttattttgtaaagttaaatatatttaagatttgattgatttatttataaaaattaatttattataatttattagtgttatttttttataagtgattttgaccttttgggacagcggtg

SEQ ID NO: 375942 - DNA, 140 bp, Artificial Sequence
  Synthetic
caccgctgtcccaaaaggtcaaaatcacttataaaaaaataacactaataaattataataaattaatttttataaataaatcaatcaaatcttaaatatatttaactttacaaaataaaccatatcagcagccagggcct

SEQ ID NO: 375943 - DNA, 140 bp, Artificial Sequence
  Synthetic
atacgccatgctgggtctccgtttatttaagatgtggtttaatgtttttgatttgaatatagttataaggggataaataatattttatatttttgattgtggattgatttattttgtttacgtacttgggagtcggccat

SEQ ID NO: 375944 - DNA, 140 bp, Artificial Sequence
  Synthetic
atggccgactcccaagtacgtaaacaaaataaatcaatccacaatcaaaaatataaaatattatttatccccttataactatattcaaatcaaaaacattaaaccacatcttaaataaacggagacccagcatggcgtat

SEQ ID NO: 375945 - DNA, 140 bp, Artificial Sequence
  Synthetic
aggccctggctgctgatatgggataaataatattttatatttttgattgtggattgatttattttgtttaaaatgttttgtttattgaaaatgtgatttaatagatagttttgattagatgaccttttgggacagcggtg

SEQ ID NO: 375946 - DNA, 140 bp, Artificial Sequence
  Synthetic
caccgctgtcccaaaaggtcatctaatcaaaactatctattaaatcacattttcaataaacaaaacattttaaacaaaataaatcaatccacaatcaaaaatataaaatattatttatcccatatcagcagccagggcct

SEQ ID NO: 375947 - DNA, 140 bp, Artificial Sequence
  Synthetic
atacgccatgctgggtctccgattatattgtttgtaggtaggtgtttattttattttaaatttggaaatattttattttaggattattgttaagaggtgtataggtattattatttttgacgtacttgggagtcggccat

SEQ ID NO: 375948 - DNA, 140 bp, Artificial Sequence
  Synthetic
atggccgactcccaagtacgtcaaaaataataatacctatacacctcttaacaataatcctaaaataaaatatttccaaatttaaaataaaataaacacctacctacaaacaatataatcggagacccagcatggcgtat

SEQ ID NO: 375949 - DNA, 140 bp, Artificial Sequence
  Synthetic
aggccctggctgctgatatgttttattttaggattattgttaagaggtgtataggtattattatttttgagaatatgtataataataaattgaaggtatgtttaggtttagaaatgattggaccttttgggacagcggtg

SEQ ID NO: 375950 - DNA, 140 bp, Artificial Sequence
  Synthetic
caccgctgtcccaaaaggtccaatcatttctaaacctaaacataccttcaatttattattatacatattctcaaaaataataatacctatacacctcttaacaataatcctaaaataaaacatatcagcagccagggcct

SEQ ID NO: 375951 - DNA, 140 bp, Artificial Sequence
  Synthetic
atacgccatgctgggtctcctttattgatattgataataagttagattaaatggaagtttgatttaaattattattaaggagtttaataagaatttgtataagtagtagttagatggaggcgtacttgggagtcggccat

SEQ ID NO: 375952 - DNA, 140 bp, Artificial Sequence
  Synthetic
atggccgactcccaagtacgcctccatctaactactacttatacaaattcttattaaactccttaataataatttaaatcaaacttccatttaatctaacttattatcaatatcaataaaggagacccagcatggcgtat

SEQ ID NO: 375953 - DNA, 140 bp, Artificial Sequence
  Synthetic
aggccctggctgctgatatgattattaaggagtttaataagaatttgtataagtagtagttagatggaggttaattatgtatttttttttaaaaaggttgaggatatattaattatgttagaccttttgggacagcggtg

SEQ ID NO: 375954 - DNA, 140 bp, Artificial Sequence
  Synthetic
caccgctgtcccaaaaggtctaacataattaatatatcctcaacctttttaaaaaaaaatacataattaacctccatctaactactacttatacaaattcttattaaactccttaataatcatatcagcagccagggcct

SEQ ID NO: 375955 - DNA, 140 bp, Artificial Sequence
  Synthetic
atacgccatgctgggtctccttttagtatatttgagagtagtttaaagttaatttaagatatgggtaaagtgattttattattgaattgtagttgtgttgaaatggttgtaaaatatgatcgtacttgggagtcggccat

SEQ ID NO: 375956 - DNA, 140 bp, Artificial Sequence
  Synthetic
atggccgactcccaagtacgatcatattttacaaccatttcaacacaactacaattcaataataaaatcactttacccatatcttaaattaactttaaactactctcaaatatactaaaaggagacccagcatggcgtat

SEQ ID NO: 375957 - DNA, 140 bp, Artificial Sequence
  Synthetic
aggccctggctgctgatatgtgattttattattgaattgtagttgtgttgaaatggttgtaaaatatgattttttagttatgataattggatgggttattttaattgtagttgtagtagagaccttttgggacagcggtg

SEQ ID NO: 375958 - DNA, 140 bp, Artificial Sequence
  Synthetic
caccgctgtcccaaaaggtctctactacaactacaattaaaataacccatccaattatcataactaaaaaatcatattttacaaccatttcaacacaactacaattcaataataaaatcacatatcagcagccagggcct

SEQ ID NO: 375959 - DNA, 140 bp, Artificial Sequence
  Synthetic
atacgccatgctgggtctccaagagaatgtgtttaaaggaaaaattgatgatttaaatagttatgtattagatgttgtgtaagaggtttataagaattttgatagtatattgattttgatcgtacttgggagtcggccat

SEQ ID NO: 375960 - DNA, 140 bp, Artificial Sequence
  Synthetic
atggccgactcccaagtacgatcaaaatcaatatactatcaaaattcttataaacctcttacacaacatctaatacataactatttaaatcatcaatttttcctttaaacacattctcttggagacccagcatggcgtat

SEQ ID NO: 375961 - DNA, 140 bp, Artificial Sequence
  Synthetic
aggccctggctgctgatatggatgttgtgtaagaggtttataagaattttgatagtatattgattttgattgaggaaaattttgggaaattttatatatttgttaaagatttgaaggagagaccttttgggacagcggtg

SEQ ID NO: 375962 - DNA, 140 bp, Artificial Sequence
  Synthetic
caccgctgtcccaaaaggtctctccttcaaatctttaacaaatatataaaatttcccaaaattttcctcaatcaaaatcaatatactatcaaaattcttataaacctcttacacaacatccatatcagcagccagggcct

SEQ ID NO: 375963 - DNA, 140 bp, Artificial Sequence
  Synthetic
atacgccatgctgggtctcctaagtgatttgtaaaataggaaaggataataattttttggatataatttatgttgagttttaggtaagtttagtagatggtgattttttttaatgtgtatcgtacttgggagtcggccat

SEQ ID NO: 375964 - DNA, 140 bp, Artificial Sequence
  Synthetic
atggccgactcccaagtacgatacacattaaaaaaaatcaccatctactaaacttacctaaaactcaacataaattatatccaaaaaattattatcctttcctattttacaaatcacttaggagacccagcatggcgtat

SEQ ID NO: 375965 - DNA, 140 bp, Artificial Sequence
  Synthetic
aggccctggctgctgatatgtgttgagttttaggtaagtttagtagatggtgattttttttaatgtgtatttatatagataattaaaagggttttaattttttaggatgtgttgtttttggaccttttgggacagcggtg

SEQ ID NO: 375966 - DNA, 140 bp, Artificial Sequence
  Synthetic
caccgctgtcccaaaaggtccaaaaacaacacatcctaaaaaattaaaacccttttaattatctatataaatacacattaaaaaaaatcaccatctactaaacttacctaaaactcaacacatatcagcagccagggcct

SEQ ID NO: 375967 - DNA, 140 bp, Artificial Sequence
  Synthetic
atacgccatgctgggtctcctttttgattagtattattattatttaaaattgattgtggttgggtttgtttgtttaagatgtaagatggtaaaatgtttggatttaagatttaagaattacgtacttgggagtcggccat

SEQ ID NO: 375968 - DNA, 140 bp, Artificial Sequence
  Synthetic
atggccgactcccaagtacgtaattcttaaatcttaaatccaaacattttaccatcttacatcttaaacaaacaaacccaaccacaatcaattttaaataataataatactaatcaaaaaggagacccagcatggcgtat

SEQ ID NO: 375969 - DNA, 140 bp, Artificial Sequence
  Synthetic
aggccctggctgctgatatgtgtttaagatgtaagatggtaaaatgtttggatttaagatttaagaattaagatttatttaataaggtaagttataattttagatggaattttagttagagaccttttgggacagcggtg

SEQ ID NO: 375970 - DNA, 140 bp, Artificial Sequence
  Synthetic
caccgctgtcccaaaaggtctctaactaaaattccatctaaaattataacttaccttattaaataaatcttaattcttaaatcttaaatccaaacattttaccatcttacatcttaaacacatatcagcagccagggcct

SEQ ID NO: 375971 - DNA, 140 bp, Artificial Sequence
  Synthetic
atacgccatgctgggtctccttgaatatgataatattttgttttttgttttgttttgtagttttttgaattggaagattattttaaatttataaatatgtataagatgttatggtttagtcgtacttgggagtcggccat

SEQ ID NO: 375972 - DNA, 140 bp, Artificial Sequence
  Synthetic
atggccgactcccaagtacgactaaaccataacatcttatacatatttataaatttaaaataatcttccaattcaaaaaactacaaaacaaaacaaaaaacaaaatattatcatattcaaggagacccagcatggcgtat

SEQ ID NO: 375973 - DNA, 140 bp, Artificial Sequence
  Synthetic
aggccctggctgctgatatgtggaagattattttaaatttataaatatgtataagatgttatggtttagtaaagaattgataggagtattggtatataatgtaaatataataagtgatgagaccttttgggacagcggtg

SEQ ID NO: 375974 - DNA, 140 bp, Artificial Sequence
  Synthetic
caccgctgtcccaaaaggtctcatcacttattatatttacattatataccaatactcctatcaattctttactaaaccataacatcttatacatatttataaatttaaaataatcttccacatatcagcagccagggcct

SEQ ID NO: 375975 - DNA, 140 bp, Artificial Sequence
  Synthetic
atacgccatgctgggtctcctattttttaaagtgagatattttattattaaaaaatgaggtgtggagtgttattaatggtttttttagtatataatgatattgtatattttatgagtatacgtacttgggagtcggccat

SEQ ID NO: 375976 - DNA, 140 bp, Artificial Sequence
  Synthetic
atggccgactcccaagtacgtatactcataaaatatacaatatcattatatactaaaaaaaccattaataacactccacacctcattttttaataataaaatatctcactttaaaaaataggagacccagcatggcgtat

SEQ ID NO: 375977 - DNA, 140 bp, Artificial Sequence
  Synthetic
aggccctggctgctgatatgtattaatggtttttttagtatataatgatattgtatattttatgagtatatttttaatttgattaagtgttatagttaatgagattaaattagatgtattgaccttttgggacagcggtg

SEQ ID NO: 375978 - DNA, 140 bp, Artificial Sequence
  Synthetic
caccgctgtcccaaaaggtcaatacatctaatttaatctcattaactataacacttaatcaaattaaaaatatactcataaaatatacaatatcattatatactaaaaaaaccattaatacatatcagcagccagggcct

SEQ ID NO: 375979 - DNA, 140 bp, Artificial Sequence
  Synthetic
atacgccatgctgggtctccatgataatattgattatttaagttatattttaagtggagtagtttttgtttttatattggaagttatagtgaatgtaattttgggaataaaagttttgatcgtacttgggagtcggccat

SEQ ID NO: 375980 - DNA, 140 bp, Artificial Sequence
  Synthetic
atggccgactcccaagtacgatcaaaacttttattcccaaaattacattcactataacttccaatataaaaacaaaaactactccacttaaaatataacttaaataatcaatattatcatggagacccagcatggcgtat

SEQ ID NO: 375981 - DNA, 140 bp, Artificial Sequence
  Synthetic
aggccctggctgctgatatgtttatattggaagttatagtgaatgtaattttgggaataaaagttttgatgaagtaaatatttatttggtttttattgggtgtagttgattagaagatatgaccttttgggacagcggtg

SEQ ID NO: 375982 - DNA, 140 bp, Artificial Sequence
  Synthetic
caccgctgtcccaaaaggtcatatcttctaatcaactacacccaataaaaaccaaataaatatttacttcatcaaaacttttattcccaaaattacattcactataacttccaatataaacatatcagcagccagggcct

SEQ ID NO: 375983 - DNA, 140 bp, Artificial Sequence
  Synthetic
atacgccatgctgggtctccatatattttgggaagatatttaatttgttggtatgtgttaataggttaggtttaggaatatttgattatttgttatgatttttaaggttgggtaattaggcgtacttgggagtcggccat

SEQ ID NO: 375984 - DNA, 140 bp, Artificial Sequence
  Synthetic
atggccgactcccaagtacgcctaattacccaaccttaaaaatcataacaaataatcaaatattcctaaacctaacctattaacacataccaacaaattaaatatcttcccaaaatatatggagacccagcatggcgtat

SEQ ID NO: 375985 - DNA, 140 bp, Artificial Sequence
  Synthetic
aggccctggctgctgatatgtttaggaatatttgattatttgttatgatttttaaggttgggtaattaggtatttttttaagagtttgtttttttattagtttagtttttttagtattttgaccttttgggacagcggtg

SEQ ID NO: 375986 - DNA, 140 bp, Artificial Sequence
  Synthetic
caccgctgtcccaaaaggtcaaaatactaaaaaaactaaactaataaaaaaacaaactcttaaaaaaatacctaattacccaaccttaaaaatcataacaaataatcaaatattcctaaacatatcagcagccagggcct

SEQ ID NO: 375987 - DNA, 140 bp, Artificial Sequence
  Synthetic
atacgccatgctgggtctccaatttggatagatgaaattttagtaggagtagttaatgttttttgttttgggtttttattttattttaagttttgtttaatttttttgttggggaagatacgtacttgggagtcggccat

SEQ ID NO: 375988 - DNA, 140 bp, Artificial Sequence
  Synthetic
atggccgactcccaagtacgtatcttccccaacaaaaaaattaaacaaaacttaaaataaaataaaaacccaaaacaaaaaacattaactactcctactaaaatttcatctatccaaattggagacccagcatggcgtat

SEQ ID NO: 375989 - DNA, 140 bp, Artificial Sequence
  Synthetic
aggccctggctgctgatatgggtttttattttattttaagttttgtttaatttttttgttggggaagataggaaagaaaggatatgttttagatttaatattatttgataagatttaaatgaccttttgggacagcggtg

SEQ ID NO: 375990 - DNA, 140 bp, Artificial Sequence
  Synthetic
caccgctgtcccaaaaggtcatttaaatcttatcaaataatattaaatctaaaacatatcctttctttcctatcttccccaacaaaaaaattaaacaaaacttaaaataaaataaaaacccatatcagcagccagggcct

SEQ ID NO: 375991 - DNA, 140 bp, Artificial Sequence
  Synthetic
atacgccatgctgggtctccagaatatagttggaattgaggttttagaattattagtttaaaggttgattggtaaaaaattataatttaaaaatggttaattaattattttagtttttttcgtacttgggagtcggccat

SEQ ID NO: 375992 - DNA, 140 bp, Artificial Sequence
  Synthetic
atggccgactcccaagtacgaaaaaaactaaaataattaattaaccatttttaaattataattttttaccaatcaacctttaaactaataattctaaaacctcaattccaactatattctggagacccagcatggcgtat

SEQ ID NO: 375993 - DNA, 140 bp, Artificial Sequence
  Synthetic
aggccctggctgctgatatgggtaaaaaattataatttaaaaatggttaattaattattttagttttttttttgaaatatgttggatttgattttatattgttaggggatttaattatgggaccttttgggacagcggtg

SEQ ID NO: 375994 - DNA, 140 bp, Artificial Sequence
  Synthetic
caccgctgtcccaaaaggtcccataattaaatcccctaacaatataaaatcaaatccaacatatttcaaaaaaaaaactaaaataattaattaaccatttttaaattataattttttacccatatcagcagccagggcct

SEQ ID NO: 375995 - DNA, 140 bp, Artificial Sequence
  Synthetic
atacgccatgctgggtctcctatatggataagtagaatagttattaataatttaaattttatttgagttattattttgttagtaattttgatgggattaatagattaaaaatttgattgtcgtacttgggagtcggccat

SEQ ID NO: 375996 - DNA, 140 bp, Artificial Sequence
  Synthetic
atggccgactcccaagtacgacaatcaaatttttaatctattaatcccatcaaaattactaacaaaataataactcaaataaaatttaaattattaataactattctacttatccatataggagacccagcatggcgtat

SEQ ID NO: 375997 - DNA, 140 bp, Artificial Sequence
  Synthetic
aggccctggctgctgatatgttattttgttagtaattttgatgggattaatagattaaaaatttgattgtatagaattataaaagaattaagtagaggtaatagatttatagtttatgttgaccttttgggacagcggtg

SEQ ID NO: 375998 - DNA, 140 bp, Artificial Sequence
  Synthetic
caccgctgtcccaaaaggtcaacataaactataaatctattacctctacttaattcttttataattctatacaatcaaatttttaatctattaatcccatcaaaattactaacaaaataacatatcagcagccagggcct

SEQ ID NO: 375999 - DNA, 140 bp, Artificial Sequence
  Synthetic
atacgccatgctgggtctccaataattattttttttgtaattaattatgtatttgttaatttattggtgtgagatttttttgagaatttggtggagtttttattatttgtagtaattagacgtacttgggagtcggccat

SEQ ID NO: 376000 - DNA, 140 bp, Artificial Sequence
  Synthetic
atggccgactcccaagtacgtctaattactacaaataataaaaactccaccaaattctcaaaaaaatctcacaccaataaattaacaaatacataattaattacaaaaaaaataattattggagacccagcatggcgtat

SEQ ID NO: 376001 - DNA, 140 bp, Artificial Sequence
  Synthetic
aggccctggctgctgatatggagatttttttgagaatttggtggagtttttattatttgtagtaattagaagagaagtttaatttagttaaaattaaattaagtaatattttgaatgtttgaccttttgggacagcggtg

SEQ ID NO: 376002 - DNA, 140 bp, Artificial Sequence
  Synthetic
caccgctgtcccaaaaggtcaaacattcaaaatattacttaatttaattttaactaaattaaacttctcttctaattactacaaataataaaaactccaccaaattctcaaaaaaatctccatatcagcagccagggcct

SEQ ID NO: 376003 - DNA, 140 bp, Artificial Sequence
  Synthetic
atacgccatgctgggtctcctgttaataattgttagtaattttaatttttagattaagaaaaagatatatgatgaagattaaggtgataatgagttgaaattttattttttttaaagattcgtacttgggagtcggccat

SEQ ID NO: 376004 - DNA, 140 bp, Artificial Sequence
  Synthetic
atggccgactcccaagtacgaatctttaaaaaaaataaaatttcaactcattatcaccttaatcttcatcatatatctttttcttaatctaaaaattaaaattactaacaattattaacaggagacccagcatggcgtat

SEQ ID NO: 376005 - DNA, 140 bp, Artificial Sequence
  Synthetic
aggccctggctgctgatatggatgaagattaaggtgataatgagttgaaattttattttttttaaagatttaatattatttgttttaaagttatataaggatatatttaaattagggattgaccttttgggacagcggtg

SEQ ID NO: 376006 - DNA, 140 bp, Artificial Sequence
  Synthetic
caccgctgtcccaaaaggtcaatccctaatttaaatatatccttatataactttaaaacaaataatattaaatctttaaaaaaaataaaatttcaactcattatcaccttaatcttcatccatatcagcagccagggcct

SEQ ID NO: 376007 - DNA, 140 bp, Artificial Sequence
  Synthetic
atacgccatgctgggtctccggatattaatttttttaattgttttgggaatgtttttgtaaaattttgtttttagtatgggtaattatttttttttagtgagtaatttttatgttgtttgcgtacttgggagtcggccat

SEQ ID NO: 376008 - DNA, 140 bp, Artificial Sequence
  Synthetic
atggccgactcccaagtacgcaaacaacataaaaattactcactaaaaaaaaataattacccatactaaaaacaaaattttacaaaaacattcccaaaacaattaaaaaaattaatatccggagacccagcatggcgtat

SEQ ID NO: 376009 - DNA, 140 bp, Artificial Sequence
  Synthetic
aggccctggctgctgatatgtttagtatgggtaattatttttttttagtgagtaatttttatgttgtttggtatagtgataaatagtatttttaaagtaatagaaattgattaattggttgaccttttgggacagcggtg

SEQ ID NO: 376010 - DNA, 140 bp, Artificial Sequence
  Synthetic
caccgctgtcccaaaaggtcaaccaattaatcaatttctattactttaaaaatactatttatcactataccaaacaacataaaaattactcactaaaaaaaaataattacccatactaaacatatcagcagccagggcct

SEQ ID NO: 376011 - DNA, 140 bp, Artificial Sequence
  Synthetic
atacgccatgctgggtctcctttggaaggaaatggaattgtaattgatgttttattagtaataaaatgttggggattttgtttaggtgtgttttttaaggtggttagttatgaagttggacgtacttgggagtcggccat

SEQ ID NO: 376012 - DNA, 140 bp, Artificial Sequence
  Synthetic
atggccgactcccaagtacgtccaacttcataactaaccaccttaaaaaacacacctaaacaaaatccccaacattttattactaataaaacatcaattacaattccatttccttccaaaggagacccagcatggcgtat

SEQ ID NO: 376013 - DNA, 140 bp, Artificial Sequence
  Synthetic
aggccctggctgctgatatgggggattttgtttaggtgtgttttttaaggtggttagttatgaagttggagaatgggtagaaaattgttataatttggagattaaaaagttagatggaaggaccttttgggacagcggtg

SEQ ID NO: 376014 - DNA, 140 bp, Artificial Sequence
  Synthetic
caccgctgtcccaaaaggtccttccatctaactttttaatctccaaattataacaattttctacccattctccaacttcataactaaccaccttaaaaaacacacctaaacaaaatcccccatatcagcagccagggcct

SEQ ID NO: 376015 - DNA, 140 bp, Artificial Sequence
  Synthetic
atacgccatgctgggtctccgttatgtttataaagtttaaggaataggtttttgttttggtgatttagttttttataaaaatggggttttttttttgtatgatagattggttttaattgtcgtacttgggagtcggccat

SEQ ID NO: 376016 - DNA, 140 bp, Artificial Sequence
  Synthetic
atggccgactcccaagtacgacaattaaaaccaatctatcatacaaaaaaaaaaccccatttttataaaaaactaaatcaccaaaacaaaaacctattccttaaactttataaacataacggagacccagcatggcgtat

SEQ ID NO: 376017 - DNA, 140 bp, Artificial Sequence
  Synthetic
aggccctggctgctgatatgttttataaaaatggggttttttttttgtatgatagattggttttaattgttatttattgagggataatttttgttgaaggtgttgtagtttttttaatttgaccttttgggacagcggtg

SEQ ID NO: 376018 - DNA, 140 bp, Artificial Sequence
  Synthetic
caccgctgtcccaaaaggtcaaattaaaaaaactacaacaccttcaacaaaaattatccctcaataaataacaattaaaaccaatctatcatacaaaaaaaaaaccccatttttataaaacatatcagcagccagggcct

SEQ ID NO: 376019 - DNA, 140 bp, Artificial Sequence
  Synthetic
atacgccatgctgggtctccgtgaatataatagatgattttataagttattatatgattttgatatttagttatgagatgttaaattttgggggtaatgaaagtaatattttttttaaggcgtacttgggagtcggccat

SEQ ID NO: 376020 - DNA, 140 bp, Artificial Sequence
  Synthetic
atggccgactcccaagtacgccttaaaaaaaatattactttcattacccccaaaatttaacatctcataactaaatatcaaaatcatataataacttataaaatcatctattatattcacggagacccagcatggcgtat

SEQ ID NO: 376021 - DNA, 140 bp, Artificial Sequence
  Synthetic
aggccctggctgctgatatgttatgagatgttaaattttgggggtaatgaaagtaatattttttttaaggtagataattatatatatgtgtaattagattgtttatatattttgtagtttgaccttttgggacagcggtg

SEQ ID NO: 376022 - DNA, 140 bp, Artificial Sequence
  Synthetic
caccgctgtcccaaaaggtcaaactacaaaatatataaacaatctaattacacatatatataattatctaccttaaaaaaaatattactttcattacccccaaaatttaacatctcataacatatcagcagccagggcct

SEQ ID NO: 376023 - DNA, 140 bp, Artificial Sequence
  Synthetic
atacgccatgctgggtctcctatagggagattgatttggatattggattttaaaattgaattagatgttggtgagtgggttttttgggaaattaaaaaaattttttttaataattttatgcgtacttgggagtcggccat

SEQ ID NO: 376024 - DNA, 140 bp, Artificial Sequence
  Synthetic
atggccgactcccaagtacgcataaaattattaaaaaaaatttttttaatttcccaaaaaacccactcaccaacatctaattcaattttaaaatccaatatccaaatcaatctccctataggagacccagcatggcgtat

SEQ ID NO: 376025 - DNA, 140 bp, Artificial Sequence
  Synthetic
aggccctggctgctgatatggtgagtgggttttttgggaaattaaaaaaattttttttaataattttatggagaaaatttgtatttttaaattttattaatttatattaataattttttagaccttttgggacagcggtg

SEQ ID NO: 376026 - DNA, 140 bp, Artificial Sequence
  Synthetic
caccgctgtcccaaaaggtctaaaaaattattaatataaattaataaaatttaaaaatacaaattttctccataaaattattaaaaaaaatttttttaatttcccaaaaaacccactcaccatatcagcagccagggcct

SEQ ID NO: 376027 - DNA, 140 bp, Artificial Sequence
  Synthetic
atacgccatgctgggtctcctgttaataattttgagttggttttaatggatttttttttagtggttttagtgtttattgtaggatggatagaggaaatgttgatttaaggtttaattaatcgtacttgggagtcggccat

SEQ ID NO: 376028 - DNA, 140 bp, Artificial Sequence
  Synthetic
atggccgactcccaagtacgattaattaaaccttaaatcaacatttcctctatccatcctacaataaacactaaaaccactaaaaaaaaatccattaaaaccaactcaaaattattaacaggagacccagcatggcgtat

SEQ ID NO: 376029 - DNA, 140 bp, Artificial Sequence
  Synthetic
aggccctggctgctgatatgtgtttattgtaggatggatagaggaaatgttgatttaaggtttaattaatggagagataattataggttttattgtgaatttaatgataattattattgtgaccttttgggacagcggtg

SEQ ID NO: 376030 - DNA, 140 bp, Artificial Sequence
  Synthetic
caccgctgtcccaaaaggtcacaataataattatcattaaattcacaataaaacctataattatctctccattaattaaaccttaaatcaacatttcctctatccatcctacaataaacacatatcagcagccagggcct

SEQ ID NO: 376031 - DNA, 140 bp, Artificial Sequence
  Synthetic
atacgccatgctgggtctccagttgaataatatagtatttattgaagatttttttttattggtaagtaatgagataatttattattttgagatggatttgatttaaggtttgaataatttcgtacttgggagtcggccat

SEQ ID NO: 376032 - DNA, 140 bp, Artificial Sequence
  Synthetic
atggccgactcccaagtacgaaattattcaaaccttaaatcaaatccatctcaaaataataaattatctcattacttaccaataaaaaaaaatcttcaataaatactatattattcaactggagacccagcatggcgtat

SEQ ID NO: 376033 - DNA, 140 bp, Artificial Sequence
  Synthetic
aggccctggctgctgatatggagataatttattattttgagatggatttgatttaaggtttgaataattttgtttagagtttatagattaagattatgttagtatttataatatttttgagaccttttgggacagcggtg

SEQ ID NO: 376034 - DNA, 140 bp, Artificial Sequence
  Synthetic
caccgctgtcccaaaaggtctcaaaaatattataaatactaacataatcttaatctataaactctaaacaaaattattcaaaccttaaatcaaatccatctcaaaataataaattatctccatatcagcagccagggcct

SEQ ID NO: 376035 - DNA, 140 bp, Artificial Sequence
  Synthetic
atacgccatgctgggtctccttaggaagtgtagttggattaagttagtttggatttattataaatatagtaagtaaggtagttgatttattgagttttattaggaaataaaagtgattggcgtacttgggagtcggccat

SEQ ID NO: 376036 - DNA, 140 bp, Artificial Sequence
  Synthetic
atggccgactcccaagtacgccaatcacttttatttcctaataaaactcaataaatcaactaccttacttactatatttataataaatccaaactaacttaatccaactacacttcctaaggagacccagcatggcgtat

SEQ ID NO: 376037 - DNA, 140 bp, Artificial Sequence
  Synthetic
aggccctggctgctgatatgaagtaaggtagttgatttattgagttttattaggaaataaaagtgattggtttgataaaatattgttaataaatgtaatttagatttttattattggatagaccttttgggacagcggtg

SEQ ID NO: 376038 - DNA, 140 bp, Artificial Sequence
  Synthetic
caccgctgtcccaaaaggtctatccaataataaaaatctaaattacatttattaacaatattttatcaaaccaatcacttttatttcctaataaaactcaataaatcaactaccttacttcatatcagcagccagggcct

SEQ ID NO: 376039 - DNA, 140 bp, Artificial Sequence
  Synthetic
atacgccatgctgggtctccatttgtagtagaaggtatttatattgagggtgtaatgtataattagaatgggtttatttgtgggttatgttagttagttaatgaaattatttaggtttttcgtacttgggagtcggccat

SEQ ID NO: 376040 - DNA, 140 bp, Artificial Sequence
  Synthetic
atggccgactcccaagtacgaaaaacctaaataatttcattaactaactaacataacccacaaataaacccattctaattatacattacaccctcaatataaataccttctactacaaatggagacccagcatggcgtat

SEQ ID NO: 376041 - DNA, 140 bp, Artificial Sequence
  Synthetic
aggccctggctgctgatatgggtttatttgtgggttatgttagttagttaatgaaattatttaggttttttaattatttttgtgggttataatagaattgaggatttatttattttttaagaccttttgggacagcggtg

SEQ ID NO: 376042 - DNA, 140 bp, Artificial Sequence
  Synthetic
caccgctgtcccaaaaggtcttaaaaaataaataaatcctcaattctattataacccacaaaaataattaaaaaacctaaataatttcattaactaactaacataacccacaaataaacccatatcagcagccagggcct

SEQ ID NO: 376043 - DNA, 140 bp, Artificial Sequence
  Synthetic
atacgccatgctgggtctccttttaggattattttgttgtattgagttatatgattggataaaaaatattattgatgaaattaattaaattaaatatgattttattgataattttttattcgtacttgggagtcggccat

SEQ ID NO: 376044 - DNA, 140 bp, Artificial Sequence
  Synthetic
atggccgactcccaagtacgaataaaaaattatcaataaaatcatatttaatttaattaatttcatcaataatattttttatccaatcatataactcaatacaacaaaataatcctaaaaggagacccagcatggcgtat

SEQ ID NO: 376045 - DNA, 140 bp, Artificial Sequence
  Synthetic
aggccctggctgctgatatgattgatgaaattaattaaattaaatatgattttattgataattttttattagattatggagatgattttaatttatggataggttggagataatggatttgaccttttgggacagcggtg

SEQ ID NO: 376046 - DNA, 140 bp, Artificial Sequence
  Synthetic
caccgctgtcccaaaaggtcaaatccattatctccaacctatccataaattaaaatcatctccataatctaataaaaaattatcaataaaatcatatttaatttaattaatttcatcaatcatatcagcagccagggcct

SEQ ID NO: 376047 - DNA, 140 bp, Artificial Sequence
  Synthetic
atacgccatgctgggtctcctgtatatgtaagattttgtgttgatttattttgagatttgagagagaaaaattttagggttattttaaggagaaatattatttttaaaatttatttgaatcgtacttgggagtcggccat

SEQ ID NO: 376048 - DNA, 140 bp, Artificial Sequence
  Synthetic
atggccgactcccaagtacgattcaaataaattttaaaaataatatttctccttaaaataaccctaaaatttttctctctcaaatctcaaaataaatcaacacaaaatcttacatatacaggagacccagcatggcgtat

SEQ ID NO: 376049 - DNA, 140 bp, Artificial Sequence
  Synthetic
aggccctggctgctgatatgattttagggttattttaaggagaaatattatttttaaaatttatttgaatgttgattatttattttaaatgagtaattaataatatgtttttttgtttttgaccttttgggacagcggtg

SEQ ID NO: 376050 - DNA, 140 bp, Artificial Sequence
  Synthetic
caccgctgtcccaaaaggtcaaaaacaaaaaaacatattattaattactcatttaaaataaataatcaacattcaaataaattttaaaaataatatttctccttaaaataaccctaaaatcatatcagcagccagggcct

SEQ ID NO: 376051 - DNA, 140 bp, Artificial Sequence
  Synthetic
atacgccatgctgggtctccgaaaaatttatgatgaagattaaaggagaggattgttaatgggaaaattttttattttgtttgttgaagttatgttggtggtgtttgtagttgagaataacgtacttgggagtcggccat

SEQ ID NO: 376052 - DNA, 140 bp, Artificial Sequence
  Synthetic
atggccgactcccaagtacgttattctcaactacaaacaccaccaacataacttcaacaaacaaaataaaaaattttcccattaacaatcctctcctttaatcttcatcataaatttttcggagacccagcatggcgtat

SEQ ID NO: 376053 - DNA, 140 bp, Artificial Sequence
  Synthetic
aggccctggctgctgatatgtttattttgtttgttgaagttatgttggtggtgtttgtagttgagaataattttagagattgtaggtagaaaggattaatatttataggtaggggttagagaccttttgggacagcggtg

SEQ ID NO: 376054 - DNA, 140 bp, Artificial Sequence
  Synthetic
caccgctgtcccaaaaggtctctaacccctacctataaatattaatcctttctacctacaatctctaaaattattctcaactacaaacaccaccaacataacttcaacaaacaaaataaacatatcagcagccagggcct

SEQ ID NO: 376055 - DNA, 140 bp, Artificial Sequence
  Synthetic
atacgccatgctgggtctccagaatttgatttttaggttttagttttaaaatttggatgatggagtatttaagagaatggggtagatttagtaatatgtgatataatagttgggaattatcgtacttgggagtcggccat

SEQ ID NO: 376056 - DNA, 140 bp, Artificial Sequence
  Synthetic
atggccgactcccaagtacgataattcccaactattatatcacatattactaaatctaccccattctcttaaatactccatcatccaaattttaaaactaaaacctaaaaatcaaattctggagacccagcatggcgtat

SEQ ID NO: 376057 - DNA, 140 bp, Artificial Sequence
  Synthetic
aggccctggctgctgatatgaagagaatggggtagatttagtaatatgtgatataatagttgggaattatatgaaaatttattaaggttttgtttattattttgggattttaattaggttgaccttttgggacagcggtg

SEQ ID NO: 376058 - DNA, 140 bp, Artificial Sequence
  Synthetic
caccgctgtcccaaaaggtcaacctaattaaaatcccaaaataataaacaaaaccttaataaattttcatataattcccaactattatatcacatattactaaatctaccccattctcttcatatcagcagccagggcct

SEQ ID NO: 376059 - DNA, 140 bp, Artificial Sequence
  Synthetic
atacgccatgctgggtctccttattggaaaaagattgatgtatttatagtttttttggtttttaaagatatatgtttaatatttaaaaaaggatttttttgtgatagtaaattttgtaaacgtacttgggagtcggccat

SEQ ID NO: 376060 - DNA, 140 bp, Artificial Sequence
  Synthetic
atggccgactcccaagtacgtttacaaaatttactatcacaaaaaaatccttttttaaatattaaacatatatctttaaaaaccaaaaaaactataaatacatcaatctttttccaataaggagacccagcatggcgtat

SEQ ID NO: 376061 - DNA, 140 bp, Artificial Sequence
  Synthetic
aggccctggctgctgatatgtatgtttaatatttaaaaaaggatttttttgtgatagtaaattttgtaaaaaagattattaattggatagtttaaatgattatgaattattattgttaatgaccttttgggacagcggtg

SEQ ID NO: 376062 - DNA, 140 bp, Artificial Sequence
  Synthetic
caccgctgtcccaaaaggtcattaacaataataattcataatcatttaaactatccaattaataatcttttttacaaaatttactatcacaaaaaaatccttttttaaatattaaacatacatatcagcagccagggcct

SEQ ID NO: 376063 - DNA, 140 bp, Artificial Sequence
  Synthetic
atacgccatgctgggtctcctaaaagatatgtggttagtgaatttaatagttgaagattttttataaggtaatagttttaaattaatatttgtagtttttttttaaattgttgaatattgcgtacttgggagtcggccat

SEQ ID NO: 376064 - DNA, 140 bp, Artificial Sequence
  Synthetic
atggccgactcccaagtacgcaatattcaacaatttaaaaaaaaactacaaatattaatttaaaactattaccttataaaaaatcttcaactattaaattcactaaccacatatcttttaggagacccagcatggcgtat

SEQ ID NO: 376065 - DNA, 140 bp, Artificial Sequence
  Synthetic
aggccctggctgctgatatgaatagttttaaattaatatttgtagtttttttttaaattgttgaatattgggtaattagagatttaaggtaaattgaggattttaaatttagagttttttgaccttttgggacagcggtg

SEQ ID NO: 376066 - DNA, 140 bp, Artificial Sequence
  Synthetic
caccgctgtcccaaaaggtcaaaaaactctaaatttaaaatcctcaatttaccttaaatctctaattacccaatattcaacaatttaaaaaaaaactacaaatattaatttaaaactattcatatcagcagccagggcct

SEQ ID NO: 376067 - DNA, 140 bp, Artificial Sequence
  Synthetic
atacgccatgctgggtctcctttttatgtgagatttatttatggtatgagggttttggataggattaagttgattttgtattagaggtttattaaagattttatagtgataaaggagggacgtacttgggagtcggccat

SEQ ID NO: 376068 - DNA, 140 bp, Artificial Sequence
  Synthetic
atggccgactcccaagtacgtccctcctttatcactataaaatctttaataaacctctaatacaaaatcaacttaatcctatccaaaaccctcataccataaataaatctcacataaaaaggagacccagcatggcgtat

SEQ ID NO: 376069 - DNA, 140 bp, Artificial Sequence
  Synthetic
aggccctggctgctgatatgtgattttgtattagaggtttattaaagattttatagtgataaaggagggaattttgaggttgttttgtggtaataatgggattgatagttattaataatggaccttttgggacagcggtg

SEQ ID NO: 376070 - DNA, 140 bp, Artificial Sequence
  Synthetic
caccgctgtcccaaaaggtccattattaataactatcaatcccattattaccacaaaacaacctcaaaattccctcctttatcactataaaatctttaataaacctctaatacaaaatcacatatcagcagccagggcct

SEQ ID NO: 376071 - DNA, 140 bp, Artificial Sequence
  Synthetic
atacgccatgctgggtctcctagtgttgtagttttaggttttgttatattgtatttagtataagataattttatattatttgaggtaattaatgatattatttggttaagtatagttgaacgtacttgggagtcggccat

SEQ ID NO: 376072 - DNA, 140 bp, Artificial Sequence
  Synthetic
atggccgactcccaagtacgttcaactatacttaaccaaataatatcattaattacctcaaataatataaaattatcttatactaaatacaatataacaaaacctaaaactacaacactaggagacccagcatggcgtat

SEQ ID NO: 376073 - DNA, 140 bp, Artificial Sequence
  Synthetic
aggccctggctgctgatatgttatattatttgaggtaattaatgatattatttggttaagtatagttgaatagaaaattattggagttatttttttatgattgtttttagttaataaattgaccttttgggacagcggtg

SEQ ID NO: 376074 - DNA, 140 bp, Artificial Sequence
  Synthetic
caccgctgtcccaaaaggtcaatttattaactaaaaacaatcataaaaaaataactccaataattttctattcaactatacttaaccaaataatatcattaattacctcaaataatataacatatcagcagccagggcct

SEQ ID NO: 376075 - DNA, 140 bp, Artificial Sequence
  Synthetic
atacgccatgctgggtctccgtaataatgatttttaaaataatttattattgtaattattgatggatttattttatttgatggtatatgatttgaatgtaataaggtaagttggtatttgcgtacttgggagtcggccat

SEQ ID NO: 376076 - DNA, 140 bp, Artificial Sequence
  Synthetic
atggccgactcccaagtacgcaaataccaacttaccttattacattcaaatcatataccatcaaataaaataaatccatcaataattacaataataaattattttaaaaatcattattacggagacccagcatggcgtat

SEQ ID NO: 376077 - DNA, 140 bp, Artificial Sequence
  Synthetic
aggccctggctgctgatatgttttatttgatggtatatgatttgaatgtaataaggtaagttggtatttgaggtattttgtttagagtatatttaaaattgtatgtttagtaaattattagaccttttgggacagcggtg

SEQ ID NO: 376078 - DNA, 140 bp, Artificial Sequence
  Synthetic
caccgctgtcccaaaaggtctaataatttactaaacatacaattttaaatatactctaaacaaaatacctcaaataccaacttaccttattacattcaaatcatataccatcaaataaaacatatcagcagccagggcct

SEQ ID NO: 376079 - DNA, 140 bp, Artificial Sequence
  Synthetic
atacgccatgctgggtctccttttatgataattttttttagattattggtttaatttttattaagaaaaaattatgattgtagataatttattggtagtttttgggtatttaagtttatgcgtacttgggagtcggccat

SEQ ID NO: 376080 - DNA, 140 bp, Artificial Sequence
  Synthetic
atggccgactcccaagtacgcataaacttaaatacccaaaaactaccaataaattatctacaatcataattttttcttaataaaaattaaaccaataatctaaaaaaaattatcataaaaggagacccagcatggcgtat

SEQ ID NO: 376081 - DNA, 140 bp, Artificial Sequence
  Synthetic
aggccctggctgctgatatgattatgattgtagataatttattggtagtttttgggtatttaagtttatgaatagagttagagagaatttgttatttttgaggtataattttattatttggaccttttgggacagcggtg

SEQ ID NO: 376082 - DNA, 140 bp, Artificial Sequence
  Synthetic
caccgctgtcccaaaaggtccaaataataaaattatacctcaaaaataacaaattctctctaactctattcataaacttaaatacccaaaaactaccaataaattatctacaatcataatcatatcagcagccagggcct

SEQ ID NO: 376083 - DNA, 140 bp, Artificial Sequence
  Synthetic
atacgccatgctgggtctccggaattaggaatttaattttagttttttaaggttttgtttgaatttttattagtttgtaagtttttttatagaagttattagtttttaaggtgattatatcgtacttgggagtcggccat

SEQ ID NO: 376084 - DNA, 140 bp, Artificial Sequence
  Synthetic
atggccgactcccaagtacgatataatcaccttaaaaactaataacttctataaaaaaacttacaaactaataaaaattcaaacaaaaccttaaaaaactaaaattaaattcctaattccggagacccagcatggcgtat

SEQ ID NO: 376085 - DNA, 140 bp, Artificial Sequence
  Synthetic
aggccctggctgctgatatgtagtttgtaagtttttttatagaagttattagtttttaaggtgattatattttagtattaaattttgttaattgtttgttataaagttgaaatgtttaatgaccttttgggacagcggtg

SEQ ID NO: 376086 - DNA, 140 bp, Artificial Sequence
  Synthetic
caccgctgtcccaaaaggtcattaaacatttcaactttataacaaacaattaacaaaatttaatactaaaatataatcaccttaaaaactaataacttctataaaaaaacttacaaactacatatcagcagccagggcct

SEQ ID NO: 376087 - DNA, 140 bp, Artificial Sequence
  Synthetic
atacgccatgctgggtctcctgaaaatattgtaattagagtgtttttgaagtttggtattgatagttattaggttgtttttagtagtttgtttttggaagtttttggggagataaaaagacgtacttgggagtcggccat

SEQ ID NO: 376088 - DNA, 140 bp, Artificial Sequence
  Synthetic
atggccgactcccaagtacgtctttttatctccccaaaaacttccaaaaacaaactactaaaaacaacctaataactatcaataccaaacttcaaaaacactctaattacaatattttcaggagacccagcatggcgtat

SEQ ID NO: 376089 - DNA, 140 bp, Artificial Sequence
  Synthetic
aggccctggctgctgatatgaggttgtttttagtagtttgtttttggaagtttttggggagataaaaagaggttttagagagttttaataggttggtataaggttattaatattagtatagaccttttgggacagcggtg

SEQ ID NO: 376090 - DNA, 140 bp, Artificial Sequence
  Synthetic
caccgctgtcccaaaaggtctatactaatattaataaccttataccaacctattaaaactctctaaaacctctttttatctccccaaaaacttccaaaaacaaactactaaaaacaacctcatatcagcagccagggcct

SEQ ID NO: 376091 - DNA, 140 bp, Artificial Sequence
  Synthetic
atacgccatgctgggtctcctttttgttgtttaaataaattttttttgtgtgagatatttttaaggtataagatggttaaagttataggttgatataattttgtgtttttaaagaaagatcgtacttgggagtcggccat

SEQ ID NO: 376092 - DNA, 140 bp, Artificial Sequence
  Synthetic
atggccgactcccaagtacgatctttctttaaaaacacaaaattatatcaacctataactttaaccatcttataccttaaaaatatctcacacaaaaaaaatttatttaaacaacaaaaaggagacccagcatggcgtat

SEQ ID NO: 376093 - DNA, 140 bp, Artificial Sequence
  Synthetic
aggccctggctgctgatatgagatggttaaagttataggttgatataattttgtgtttttaaagaaagatatggaaaagggagtgatttttagtgatttttgtaattttttgattatttagaccttttgggacagcggtg

SEQ ID NO: 376094 - DNA, 140 bp, Artificial Sequence
  Synthetic
caccgctgtcccaaaaggtctaaataatcaaaaaattacaaaaatcactaaaaatcactcccttttccatatctttctttaaaaacacaaaattatatcaacctataactttaaccatctcatatcagcagccagggcct

SEQ ID NO: 376095 - DNA, 140 bp, Artificial Sequence
  Synthetic
atacgccatgctgggtctccgttaaaaaggtatggtttttttgataagatttaaaataaatgattttgtttttgtttgggtgatgataagaaatttttttttatatttgttttagaatttcgtacttgggagtcggccat

SEQ ID NO: 376096 - DNA, 140 bp, Artificial Sequence
  Synthetic
atggccgactcccaagtacgaaattctaaaacaaatataaaaaaaaatttcttatcatcacccaaacaaaaacaaaatcatttattttaaatcttatcaaaaaaaccatacctttttaacggagacccagcatggcgtat

SEQ ID NO: 376097 - DNA, 140 bp, Artificial Sequence
  Synthetic
aggccctggctgctgatatgtttgtttgggtgatgataagaaatttttttttatatttgttttagaatttaaatttggttatttaattttttatttgggttttgagggtaattttggtaggaccttttgggacagcggtg

SEQ ID NO: 376098 - DNA, 140 bp, Artificial Sequence
  Synthetic
caccgctgtcccaaaaggtcctaccaaaattaccctcaaaacccaaataaaaaattaaataaccaaatttaaattctaaaacaaatataaaaaaaaatttcttatcatcacccaaacaaacatatcagcagccagggcct

SEQ ID NO: 376099 - DNA, 140 bp, Artificial Sequence
  Synthetic
atacgccatgctgggtctccggggtttttggtttaatttttgattggtttttaattataatgttaatatattttaatttttgtattagaagtgtaaaggattagtttagtttttgtatgtcgtacttgggagtcggccat

SEQ ID NO: 376100 - DNA, 140 bp, Artificial Sequence
  Synthetic
atggccgactcccaagtacgacatacaaaaactaaactaatcctttacacttctaatacaaaaattaaaatatattaacattataattaaaaaccaatcaaaaattaaaccaaaaaccccggagacccagcatggcgtat

SEQ ID NO: 376101 - DNA, 140 bp, Artificial Sequence
  Synthetic
aggccctggctgctgatatgttttaatttttgtattagaagtgtaaaggattagtttagtttttgtatgttatttttgattaggttaaatattttgtagtttattaataagtttgatgttgaccttttgggacagcggtg

SEQ ID NO: 376102 - DNA, 140 bp, Artificial Sequence
  Synthetic
caccgctgtcccaaaaggtcaacatcaaacttattaataaactacaaaatatttaacctaatcaaaaataacatacaaaaactaaactaatcctttacacttctaatacaaaaattaaaacatatcagcagccagggcct

SEQ ID NO: 376103 - DNA, 140 bp, Artificial Sequence
  Synthetic
atacgccatgctgggtctccttttatatatataattattataatttgtataaatatgggtttttttgtggaagtttaagagtttgataaattagttatgaattttaagtgtttaggattacgtacttgggagtcggccat

SEQ ID NO: 376104 - DNA, 140 bp, Artificial Sequence
  Synthetic
atggccgactcccaagtacgtaatcctaaacacttaaaattcataactaatttatcaaactcttaaacttccacaaaaaaacccatatttatacaaattataataattatatatataaaaggagacccagcatggcgtat

SEQ ID NO: 376105 - DNA, 140 bp, Artificial Sequence
  Synthetic
aggccctggctgctgatatgaagtttaagagtttgataaattagttatgaattttaagtgtttaggattagttaagtttttattattttatgagtttgtttttaaattttttatttgtgtgaccttttgggacagcggtg

SEQ ID NO: 376106 - DNA, 140 bp, Artificial Sequence
  Synthetic
caccgctgtcccaaaaggtcacacaaataaaaaatttaaaaacaaactcataaaataataaaaacttaactaatcctaaacacttaaaattcataactaatttatcaaactcttaaacttcatatcagcagccagggcct

SEQ ID NO: 376107 - DNA, 140 bp, Artificial Sequence
  Synthetic
atacgccatgctgggtctcctaatttaataaggtaattttaaaataagtatatgaatgagaattagttgtgggttttatttagtattgttgagttaattatttaatttatttttgttaatcgtacttgggagtcggccat

SEQ ID NO: 376108 - DNA, 140 bp, Artificial Sequence
  Synthetic
atggccgactcccaagtacgattaacaaaaataaattaaataattaactcaacaatactaaataaaacccacaactaattctcattcatatacttattttaaaattaccttattaaattaggagacccagcatggcgtat

SEQ ID NO: 376109 - DNA, 140 bp, Artificial Sequence
  Synthetic
aggccctggctgctgatatggggttttatttagtattgttgagttaattatttaatttatttttgttaattgtattgagtattgttaataggtttgtattatgttaaagatttagagtgtgaccttttgggacagcggtg

SEQ ID NO: 376110 - DNA, 140 bp, Artificial Sequence
  Synthetic
caccgctgtcccaaaaggtcacactctaaatctttaacataatacaaacctattaacaatactcaatacaattaacaaaaataaattaaataattaactcaacaatactaaataaaaccccatatcagcagccagggcct

SEQ ID NO: 376111 - DNA, 140 bp, Artificial Sequence
  Synthetic
atacgccatgctgggtctcctttttttgaaatggagattattagtattttttaaatgggaggagttagtaattagaaattggagataaatggatattgggatagaataatgtttaattatcgtacttgggagtcggccat

SEQ ID NO: 376112 - DNA, 140 bp, Artificial Sequence
  Synthetic
atggccgactcccaagtacgataattaaacattattctatcccaatatccatttatctccaatttctaattactaactcctcccatttaaaaaatactaataatctccatttcaaaaaaaggagacccagcatggcgtat

SEQ ID NO: 376113 - DNA, 140 bp, Artificial Sequence
  Synthetic
aggccctggctgctgatatgattagaaattggagataaatggatattgggatagaataatgtttaattattgggtggtttttatttttatatgtgtatataattaatttttttttattttgaccttttgggacagcggtg

SEQ ID NO: 376114 - DNA, 140 bp, Artificial Sequence
  Synthetic
caccgctgtcccaaaaggtcaaaataaaaaaaaattaattatatacacatataaaaataaaaaccacccaataattaaacattattctatcccaatatccatttatctccaatttctaatcatatcagcagccagggcct

SEQ ID NO: 376115 - DNA, 140 bp, Artificial Sequence
  Synthetic
atacgccatgctgggtctcctaagagaaggtttgaggaagattaagaaaaaggttttgtgtttatttggttgttgttaagtattttgtggtttttttttatttaatttttttatgttatacgtacttgggagtcggccat

SEQ ID NO: 376116 - DNA, 140 bp, Artificial Sequence
  Synthetic
atggccgactcccaagtacgtataacataaaaaaattaaataaaaaaaaaccacaaaatacttaacaacaaccaaataaacacaaaacctttttcttaatcttcctcaaaccttctcttaggagacccagcatggcgtat

SEQ ID NO: 376117 - DNA, 140 bp, Artificial Sequence
  Synthetic
aggccctggctgctgatatgtgttgttaagtattttgtggtttttttttatttaatttttttatgttatatggttatttagtatatttagtatttggatgtatgtttatttttatttatagaccttttgggacagcggtg

SEQ ID NO: 376118 - DNA, 140 bp, Artificial Sequence
  Synthetic
caccgctgtcccaaaaggtctataaataaaaataaacatacatccaaatactaaatatactaaataaccatataacataaaaaaattaaataaaaaaaaaccacaaaatacttaacaacacatatcagcagccagggcct

SEQ ID NO: 376119 - DNA, 140 bp, Artificial Sequence
  Synthetic
atacgccatgctgggtctccttattttttaaatttttaattaaggtaatgtaaattattaaaatatatatattgatttaagtttgatataatagtatttaaatttttaagtgatatatttcgtacttgggagtcggccat

SEQ ID NO: 376120 - DNA, 140 bp, Artificial Sequence
  Synthetic
atggccgactcccaagtacgaaatatatcacttaaaaatttaaatactattatatcaaacttaaatcaatatatatattttaataatttacattaccttaattaaaaatttaaaaaataaggagacccagcatggcgtat

SEQ ID NO: 376121 - DNA, 140 bp, Artificial Sequence
  Synthetic
aggccctggctgctgatatgattgatttaagtttgatataatagtatttaaatttttaagtgatatatttgtagtaatattgttgatagattatttagtattaatttttttgtgttttttgaccttttgggacagcggtg

SEQ ID NO: 376122 - DNA, 140 bp, Artificial Sequence
  Synthetic
caccgctgtcccaaaaggtcaaaaaacacaaaaaaattaatactaaataatctatcaacaatattactacaaatatatcacttaaaaatttaaatactattatatcaaacttaaatcaatcatatcagcagccagggcct

SEQ ID NO: 376123 - DNA, 140 bp, Artificial Sequence
  Synthetic
atacgccatgctgggtctccatgaaattattaattatattttttatgatgtagttttttttgattattattttaaggtaataggtgtataggattatttgataaatattgtaattagagacgtacttgggagtcggccat

SEQ ID NO: 376124 - DNA, 140 bp, Artificial Sequence
  Synthetic
atggccgactcccaagtacgtctctaattacaatatttatcaaataatcctatacacctattaccttaaaataataatcaaaaaaaactacatcataaaaaatataattaataatttcatggagacccagcatggcgtat

SEQ ID NO: 376125 - DNA, 140 bp, Artificial Sequence
  Synthetic
aggccctggctgctgatatgtttaaggtaataggtgtataggattatttgataaatattgtaattagagagaagtttaaaaatgaaattttaaataatgattatgtttattaattgttttgaccttttgggacagcggtg

SEQ ID NO: 376126 - DNA, 140 bp, Artificial Sequence
  Synthetic
caccgctgtcccaaaaggtcaaaacaattaataaacataatcattatttaaaatttcatttttaaacttctctctaattacaatatttatcaaataatcctatacacctattaccttaaacatatcagcagccagggcct

SEQ ID NO: 376127 - DNA, 140 bp, Artificial Sequence
  Synthetic
atacgccatgctgggtctccaataattgtttaatttggtttgtttatgatgaatttattgatattttaggatatggtgattatattttttggaaaatatttttattattattattagttacgtacttgggagtcggccat

SEQ ID NO: 376128 - DNA, 140 bp, Artificial Sequence
  Synthetic
atggccgactcccaagtacgtaactaataataataataaaaatattttccaaaaaatataatcaccatatcctaaaatatcaataaattcatcataaacaaaccaaattaaacaattattggagacccagcatggcgtat

SEQ ID NO: 376129 - DNA, 140 bp, Artificial Sequence
  Synthetic
aggccctggctgctgatatgatatggtgattatattttttggaaaatatttttattattattattagttattatagatggggttttatatgtagtaattgattggtattaattgatttttgaccttttgggacagcggtg

SEQ ID NO: 376130 - DNA, 140 bp, Artificial Sequence
  Synthetic
caccgctgtcccaaaaggtcaaaaatcaattaataccaatcaattactacatataaaaccccatctataataactaataataataataaaaatattttccaaaaaatataatcaccatatcatatcagcagccagggcct

SEQ ID NO: 376131 - DNA, 140 bp, Artificial Sequence
  Synthetic
atacgccatgctgggtctcctgaaatattaattatgtgtaaagatattattatttgtaggtttaatatattattgattgtatttattgtaaaattagaggatgtagatgtgtttgattatcgtacttgggagtcggccat

SEQ ID NO: 376132 - DNA, 140 bp, Artificial Sequence
  Synthetic
atggccgactcccaagtacgataatcaaacacatctacatcctctaattttacaataaatacaatcaataatatattaaacctacaaataataatatctttacacataattaatatttcaggagacccagcatggcgtat

SEQ ID NO: 376133 - DNA, 140 bp, Artificial Sequence
  Synthetic
aggccctggctgctgatatgtattgattgtatttattgtaaaattagaggatgtagatgtgtttgattattttgatttgagtgatatttttaagatatataatgttggagattatgtaatgaccttttgggacagcggtg

SEQ ID NO: 376134 - DNA, 140 bp, Artificial Sequence
  Synthetic
caccgctgtcccaaaaggtcattacataatctccaacattatatatcttaaaaatatcactcaaatcaaaataatcaaacacatctacatcctctaattttacaataaatacaatcaatacatatcagcagccagggcct

SEQ ID NO: 376135 - DNA, 140 bp, Artificial Sequence
  Synthetic
atacgccatgctgggtctcctttgtttggttaaaatttaattttgttttaaatttatagaaagaaaaggttgtttttttatatagatgtatttattagtaataaatgatttttgggagttcgtacttgggagtcggccat

SEQ ID NO: 376136 - DNA, 140 bp, Artificial Sequence
  Synthetic
atggccgactcccaagtacgaactcccaaaaatcatttattactaataaatacatctatataaaaaaacaaccttttctttctataaatttaaaacaaaattaaattttaaccaaacaaaggagacccagcatggcgtat

SEQ ID NO: 376137 - DNA, 140 bp, Artificial Sequence
  Synthetic
aggccctggctgctgatatgtgtttttttatatagatgtatttattagtaataaatgatttttgggagttgatttttaattgtaggttaaaggattattagtaagagaagattagagattgaccttttgggacagcggtg

SEQ ID NO: 376138 - DNA, 140 bp, Artificial Sequence
  Synthetic
caccgctgtcccaaaaggtcaatctctaatcttctcttactaataatcctttaacctacaattaaaaatcaactcccaaaaatcatttattactaataaatacatctatataaaaaaacacatatcagcagccagggcct

SEQ ID NO: 376139 - DNA, 140 bp, Artificial Sequence
  Synthetic
atacgccatgctgggtctccttattttttgtttaaaaatattgggggtatttaattttatatagtgagaaagttatataaaaagtaaaatggtatgtaattatttttaaggtttttagatcgtacttgggagtcggccat

SEQ ID NO: 376140 - DNA, 140 bp, Artificial Sequence
  Synthetic
atggccgactcccaagtacgatctaaaaaccttaaaaataattacataccattttactttttatataactttctcactatataaaattaaatacccccaatatttttaaacaaaaaataaggagacccagcatggcgtat

SEQ ID NO: 376141 - DNA, 140 bp, Artificial Sequence
  Synthetic
aggccctggctgctgatatgagttatataaaaagtaaaatggtatgtaattatttttaaggtttttagatttaatgttatttttgagatatattgtgtatttaagtataatattgttaaggaccttttgggacagcggtg

SEQ ID NO: 376142 - DNA, 140 bp, Artificial Sequence
  Synthetic
caccgctgtcccaaaaggtccttaacaatattatacttaaatacacaatatatctcaaaaataacattaaatctaaaaaccttaaaaataattacataccattttactttttatataactcatatcagcagccagggcct

SEQ ID NO: 376143 - DNA, 140 bp, Artificial Sequence
  Synthetic
atacgccatgctgggtctcctttaattttaggatttaatttttttataaaatgtaattatttttttttattatttatgattaaggattttttatgggaattttattattttaattattttcgtacttgggagtcggccat

SEQ ID NO: 376144 - DNA, 140 bp, Artificial Sequence
  Synthetic
atggccgactcccaagtacgaaaataattaaaataataaaattcccataaaaaatccttaatcataaataataaaaaaaaataattacattttataaaaaaattaaatcctaaaattaaaggagacccagcatggcgtat

SEQ ID NO: 376145 - DNA, 140 bp, Artificial Sequence
  Synthetic
aggccctggctgctgatatgtatttatgattaaggattttttatgggaattttattattttaattattttttgttattttttataaaggtgattagtgatttaagtatttttattaaagagaccttttgggacagcggtg

SEQ ID NO: 376146 - DNA, 140 bp, Artificial Sequence
  Synthetic
caccgctgtcccaaaaggtctctttaataaaaatacttaaatcactaatcacctttataaaaaataacaaaaaataattaaaataataaaattcccataaaaaatccttaatcataaatacatatcagcagccagggcct

SEQ ID NO: 376147 - DNA, 140 bp, Artificial Sequence
  Synthetic
atacgccatgctgggtctccatgtgttaggttataattttttaaataaattttttattaaaagggtgttggaataatttttagaataagaggattttttaattgaaagtgttttgaattacgtacttgggagtcggccat

SEQ ID NO: 376148 - DNA, 140 bp, Artificial Sequence
  Synthetic
atggccgactcccaagtacgtaattcaaaacactttcaattaaaaaatcctcttattctaaaaattattccaacacccttttaataaaaaatttatttaaaaaattataacctaacacatggagacccagcatggcgtat

SEQ ID NO: 376149 - DNA, 140 bp, Artificial Sequence
  Synthetic
aggccctggctgctgatatggaataatttttagaataagaggattttttaattgaaagtgttttgaattatgtataggaattatattatttattattatagaataggaatttttttttttgaccttttgggacagcggtg

SEQ ID NO: 376150 - DNA, 140 bp, Artificial Sequence
  Synthetic
caccgctgtcccaaaaggtcaaaaaaaaaaattcctattctataataataaataatataattcctatacataattcaaaacactttcaattaaaaaatcctcttattctaaaaattattccatatcagcagccagggcct

SEQ ID NO: 376151 - DNA, 140 bp, Artificial Sequence
  Synthetic
atacgccatgctgggtctcctattttatatggaatgtttaaattttatgtgaggttttgttagtagatggattggttaaggttttttttagtaatatgatggtagtaattgaatgtgaatcgtacttgggagtcggccat

SEQ ID NO: 376152 - DNA, 140 bp, Artificial Sequence
  Synthetic
atggccgactcccaagtacgattcacattcaattactaccatcatattactaaaaaaaaccttaaccaatccatctactaacaaaacctcacataaaatttaaacattccatataaaataggagacccagcatggcgtat

SEQ ID NO: 376153 - DNA, 140 bp, Artificial Sequence
  Synthetic
aggccctggctgctgatatgattggttaaggttttttttagtaatatgatggtagtaattgaatgtgaataaaaagagagttttttttattaggtattatggtattatattagtgatgatgaccttttgggacagcggtg

SEQ ID NO: 376154 - DNA, 140 bp, Artificial Sequence
  Synthetic
caccgctgtcccaaaaggtcatcatcactaatataataccataatacctaataaaaaaaactctctttttattcacattcaattactaccatcatattactaaaaaaaaccttaaccaatcatatcagcagccagggcct

SEQ ID NO: 376155 - DNA, 140 bp, Artificial Sequence
  Synthetic
atacgccatgctgggtctccgaagtataattttgtattttgttatgagtttattgtattatttattgagtattgtaattattgttatggtgtgtgtaatgtttttaattggatgtattatcgtacttgggagtcggccat

SEQ ID NO: 376156 - DNA, 140 bp, Artificial Sequence
  Synthetic
atggccgactcccaagtacgataatacatccaattaaaaacattacacacaccataacaataattacaatactcaataaataatacaataaactcataacaaaatacaaaattatacttcggagacccagcatggcgtat

SEQ ID NO: 376157 - DNA, 140 bp, Artificial Sequence
  Synthetic
aggccctggctgctgatatgattgtaattattgttatggtgtgtgtaatgtttttaattggatgtattatttaattttgtagtgttatatgtatgtaagtgattattataatttgttttagaccttttgggacagcggtg

SEQ ID NO: 376158 - DNA, 140 bp, Artificial Sequence
  Synthetic
caccgctgtcccaaaaggtctaaaacaaattataataatcacttacatacatataacactacaaaattaaataatacatccaattaaaaacattacacacaccataacaataattacaatcatatcagcagccagggcct

SEQ ID NO: 376159 - DNA, 140 bp, Artificial Sequence
  Synthetic
atacgccatgctgggtctccattgagggtatttaggaggtatagagggattataataaaaattgtggatgagtatattttgtgtataaatttttttagtggaaattaaaattggttttaacgtacttgggagtcggccat

SEQ ID NO: 376160 - DNA, 140 bp, Artificial Sequence
  Synthetic
atggccgactcccaagtacgttaaaaccaattttaatttccactaaaaaaatttatacacaaaatatactcatccacaatttttattataatccctctatacctcctaaataccctcaatggagacccagcatggcgtat

SEQ ID NO: 376161 - DNA, 140 bp, Artificial Sequence
  Synthetic
aggccctggctgctgatatgagtatattttgtgtataaatttttttagtggaaattaaaattggttttaagttatgattagtggttatgggagataattagtgtataattgtattgtttggaccttttgggacagcggtg

SEQ ID NO: 376162 - DNA, 140 bp, Artificial Sequence
  Synthetic
caccgctgtcccaaaaggtccaaacaatacaattatacactaattatctcccataaccactaatcataacttaaaaccaattttaatttccactaaaaaaatttatacacaaaatatactcatatcagcagccagggcct

SEQ ID NO: 376163 - DNA, 140 bp, Artificial Sequence
  Synthetic
atacgccatgctgggtctccaatgttgtaagagtagtagtaagttttgtaaaagtaattagtgtatgtgggattttttttaaattagatgagatatttgtatatttaggttttatttattcgtacttgggagtcggccat

SEQ ID NO: 376164 - DNA, 140 bp, Artificial Sequence
  Synthetic
atggccgactcccaagtacgaataaataaaacctaaatatacaaatatctcatctaatttaaaaaaaatcccacatacactaattacttttacaaaacttactactactcttacaacattggagacccagcatggcgtat

SEQ ID NO: 376165 - DNA, 140 bp, Artificial Sequence
  Synthetic
aggccctggctgctgatatggattttttttaaattagatgagatatttgtatatttaggttttatttattttggaaaaaaataatattttaatggtgtataattattgtaattatttaaagaccttttgggacagcggtg

SEQ ID NO: 376166 - DNA, 140 bp, Artificial Sequence
  Synthetic
caccgctgtcccaaaaggtctttaaataattacaataattatacaccattaaaatattatttttttccaaaataaataaaacctaaatatacaaatatctcatctaatttaaaaaaaatccatatcagcagccagggcct

SEQ ID NO: 376167 - DNA, 140 bp, Artificial Sequence
  Synthetic
atacgccatgctgggtctccaggaatatttgttagtattggaattgtttttgaatgtgttatattggaaatgtgatatatttttttatgttgtattgtagtagttttttatatgtattttcgtacttgggagtcggccat

SEQ ID NO: 376168 - DNA, 140 bp, Artificial Sequence
  Synthetic
atggccgactcccaagtacgaaaatacatataaaaaactactacaatacaacataaaaaaatatatcacatttccaatataacacattcaaaaacaattccaatactaacaaatattcctggagacccagcatggcgtat

SEQ ID NO: 376169 - DNA, 140 bp, Artificial Sequence
  Synthetic
aggccctggctgctgatatgtgtgatatatttttttatgttgtattgtagtagttttttatatgtattttgttgtttggattttataatattattattttggatttaataaaggtattgagaccttttgggacagcggtg

SEQ ID NO: 376170 - DNA, 140 bp, Artificial Sequence
  Synthetic
caccgctgtcccaaaaggtctcaatacctttattaaatccaaaataataatattataaaatccaaacaacaaaatacatataaaaaactactacaatacaacataaaaaaatatatcacacatatcagcagccagggcct

SEQ ID NO: 376171 - DNA, 140 bp, Artificial Sequence
  Synthetic
atacgccatgctgggtctcctaatattggtggttttataagtttttgggggattgttttttttaaatttagaaaagtgtttttattgaaattttggagattttgtgatttttggatttttcgtacttgggagtcggccat

SEQ ID NO: 376172 - DNA, 140 bp, Artificial Sequence
  Synthetic
atggccgactcccaagtacgaaaaatccaaaaatcacaaaatctccaaaatttcaataaaaacacttttctaaatttaaaaaaaacaatcccccaaaaacttataaaaccaccaatattaggagacccagcatggcgtat

SEQ ID NO: 376173 - DNA, 140 bp, Artificial Sequence
  Synthetic
aggccctggctgctgatatggaaaagtgtttttattgaaattttggagattttgtgatttttggatttttttagttatgggtgtatttagaaatggttaatatgaaagatttattttgttgaccttttgggacagcggtg

SEQ ID NO: 376174 - DNA, 140 bp, Artificial Sequence
  Synthetic
caccgctgtcccaaaaggtcaacaaaataaatctttcatattaaccatttctaaatacacccataactaaaaaaatccaaaaatcacaaaatctccaaaatttcaataaaaacacttttccatatcagcagccagggcct

SEQ ID NO: 376175 - DNA, 140 bp, Artificial Sequence
  Synthetic
atacgccatgctgggtctccaatttatttggattaaatgttttaggattataagatttgatattttttttgtgataaattgttaggtgtagtattattttaattgttagaaataagttaacgtacttgggagtcggccat

SEQ ID NO: 376176 - DNA, 140 bp, Artificial Sequence
  Synthetic
atggccgactcccaagtacgttaacttatttctaacaattaaaataatactacacctaacaatttatcacaaaaaaaatatcaaatcttataatcctaaaacatttaatccaaataaattggagacccagcatggcgtat

SEQ ID NO: 376177 - DNA, 140 bp, Artificial Sequence
  Synthetic
aggccctggctgctgatatggtgataaattgttaggtgtagtattattttaattgttagaaataagttaattaatatttttttttatgtttttgttgatttggaagatgagatggtttgtgaccttttgggacagcggtg

SEQ ID NO: 376178 - DNA, 140 bp, Artificial Sequence
  Synthetic
caccgctgtcccaaaaggtcacaaaccatctcatcttccaaatcaacaaaaacataaaaaaaaatattaattaacttatttctaacaattaaaataatactacacctaacaatttatcaccatatcagcagccagggcct

SEQ ID NO: 376179 - DNA, 140 bp, Artificial Sequence
  Synthetic
atacgccatgctgggtctcctttttttaggatattgagtggtaaatgtttttaaatattaggttattttgaagggattaggattttattggtttttaaaattataaataataatagtgagcgtacttgggagtcggccat

SEQ ID NO: 376180 - DNA, 140 bp, Artificial Sequence
  Synthetic
atggccgactcccaagtacgctcactattattatttataattttaaaaaccaataaaatcctaatcccttcaaaataacctaatatttaaaaacatttaccactcaatatcctaaaaaaaggagacccagcatggcgtat

SEQ ID NO: 376181 - DNA, 140 bp, Artificial Sequence
  Synthetic
aggccctggctgctgatatgaagggattaggattttattggtttttaaaattataaataataatagtgagatatttgtatttgataagttgaggaagattattttataaagatggaatttgaccttttgggacagcggtg

SEQ ID NO: 376182 - DNA, 140 bp, Artificial Sequence
  Synthetic
caccgctgtcccaaaaggtcaaattccatctttataaaataatcttcctcaacttatcaaatacaaatatctcactattattatttataattttaaaaaccaataaaatcctaatcccttcatatcagcagccagggcct

SEQ ID NO: 376183 - DNA, 140 bp, Artificial Sequence
  Synthetic
atacgccatgctgggtctccagaaaattagttgtatggtggatttggtttagattttgtgtgagtatatatggttatatattttagagggtagattattgattggagtgatattattatgcgtacttgggagtcggccat

SEQ ID NO: 376184 - DNA, 140 bp, Artificial Sequence
  Synthetic
atggccgactcccaagtacgcataataatatcactccaatcaataatctaccctctaaaatatataaccatatatactcacacaaaatctaaaccaaatccaccatacaactaattttctggagacccagcatggcgtat

SEQ ID NO: 376185 - DNA, 140 bp, Artificial Sequence
  Synthetic
aggccctggctgctgatatgtggttatatattttagagggtagattattgattggagtgatattattatgtatggtggagtaatttaaagttaagtggttaggataatatgaattttgttgaccttttgggacagcggtg

SEQ ID NO: 376186 - DNA, 140 bp, Artificial Sequence
  Synthetic
caccgctgtcccaaaaggtcaacaaaattcatattatcctaaccacttaactttaaattactccaccatacataataatatcactccaatcaataatctaccctctaaaatatataaccacatatcagcagccagggcct

SEQ ID NO: 376187 - DNA, 140 bp, Artificial Sequence
  Synthetic
atacgccatgctgggtctccaaagattaagtggttagtgtttggtttaatattttttgaataagttggataatagggagtggtgttttttatatagggttaagaattgaggataaaattgcgtacttgggagtcggccat

SEQ ID NO: 376188 - DNA, 140 bp, Artificial Sequence
  Synthetic
atggccgactcccaagtacgcaattttatcctcaattcttaaccctatataaaaaacaccactccctattatccaacttattcaaaaaatattaaaccaaacactaaccacttaatctttggagacccagcatggcgtat

SEQ ID NO: 376189 - DNA, 140 bp, Artificial Sequence
  Synthetic
aggccctggctgctgatatgaatagggagtggtgttttttatatagggttaagaattgaggataaaattggatagtttgttattaagttgtgatgttttttatttgtttttaaggaggttgaccttttgggacagcggtg

SEQ ID NO: 376190 - DNA, 140 bp, Artificial Sequence
  Synthetic
caccgctgtcccaaaaggtcaacctccttaaaaacaaataaaaaacatcacaacttaataacaaactatccaattttatcctcaattcttaaccctatataaaaaacaccactccctattcatatcagcagccagggcct

SEQ ID NO: 376191 - DNA, 140 bp, Artificial Sequence
  Synthetic
atacgccatgctgggtctcctgaataattaatttggttttttttggaagtgagagttaattttagtgttagtgaagttttgtaaatgatattattatattatttaggaaatattgtttatcgtacttgggagtcggccat

SEQ ID NO: 376192 - DNA, 140 bp, Artificial Sequence
  Synthetic
atggccgactcccaagtacgataaacaatatttcctaaataatataataatatcatttacaaaacttcactaacactaaaattaactctcacttccaaaaaaaaccaaattaattattcaggagacccagcatggcgtat

SEQ ID NO: 376193 - DNA, 140 bp, Artificial Sequence
  Synthetic
aggccctggctgctgatatggtgaagttttgtaaatgatattattatattatttaggaaatattgtttattgatataatgattaatatagtttgtatttatttatggtgaattgtatgaggaccttttgggacagcggtg

SEQ ID NO: 376194 - DNA, 140 bp, Artificial Sequence
  Synthetic
caccgctgtcccaaaaggtcctcatacaattcaccataaataaatacaaactatattaatcattatatcaataaacaatatttcctaaataatataataatatcatttacaaaacttcaccatatcagcagccagggcct

SEQ ID NO: 376195 - DNA, 140 bp, Artificial Sequence
  Synthetic
atacgccatgctgggtctcctaggtggagggtaggttgttagggatagtaatataattttttagaatgttataaatttagtagttgttttttatgatattagattttggaatataaatatcgtacttgggagtcggccat

SEQ ID NO: 376196 - DNA, 140 bp, Artificial Sequence
  Synthetic
atggccgactcccaagtacgatatttatattccaaaatctaatatcataaaaaacaactactaaatttataacattctaaaaaattatattactatccctaacaacctaccctccacctaggagacccagcatggcgtat

SEQ ID NO: 376197 - DNA, 140 bp, Artificial Sequence
  Synthetic
aggccctggctgctgatatgataaatttagtagttgttttttatgatattagattttggaatataaatatttttgatataaggtataatagggtttatttttatttgatagagtgttgtagaccttttgggacagcggtg

SEQ ID NO: 376198 - DNA, 140 bp, Artificial Sequence
  Synthetic
caccgctgtcccaaaaggtctacaacactctatcaaataaaaataaaccctattataccttatatcaaaaatatttatattccaaaatctaatatcataaaaaacaactactaaatttatcatatcagcagccagggcct

SEQ ID NO: 376199 - DNA, 140 bp, Artificial Sequence
  Synthetic
atacgccatgctgggtctccgatttaagttgttattgtgataatgaattaatatatgatttaaatttattgaagggaggattgaattgtaatttaataatagatagttttttagtgaaggcgtacttgggagtcggccat

SEQ ID NO: 376200 - DNA, 140 bp, Artificial Sequence
  Synthetic
atggccgactcccaagtacgccttcactaaaaaactatctattattaaattacaattcaatcctcccttcaataaatttaaatcatatattaattcattatcacaataacaacttaaatcggagacccagcatggcgtat

SEQ ID NO: 376201 - DNA, 140 bp, Artificial Sequence
  Synthetic
aggccctggctgctgatatggaagggaggattgaattgtaatttaataatagatagttttttagtgaagggttttaggtttaatatgattgaagatgattttttttgttttttatattttgaccttttgggacagcggtg

SEQ ID NO: 376202 - DNA, 140 bp, Artificial Sequence
  Synthetic
caccgctgtcccaaaaggtcaaaatataaaaaacaaaaaaaatcatcttcaatcatattaaacctaaaacccttcactaaaaaactatctattattaaattacaattcaatcctcccttccatatcagcagccagggcct

SEQ ID NO: 376203 - DNA, 140 bp, Artificial Sequence
  Synthetic
atacgccatgctgggtctcctagtaatttattaatagatttaattagtagtggagaaatatgtttttttataatttatttttttatttatttttagattggttttttttatagttttggacgtacttgggagtcggccat

SEQ ID NO: 376204 - DNA, 140 bp, Artificial Sequence
  Synthetic
atggccgactcccaagtacgtccaaaactataaaaaaaaccaatctaaaaataaataaaaaaataaattataaaaaaacatatttctccactactaattaaatctattaataaattactaggagacccagcatggcgtat

SEQ ID NO: 376205 - DNA, 140 bp, Artificial Sequence
  Synthetic
aggccctggctgctgatatgtaatttatttttttatttatttttagattggttttttttatagttttggagtagtattatgtttttatttaggtaatattattttatggattaaaaaattgaccttttgggacagcggtg

SEQ ID NO: 376206 - DNA, 140 bp, Artificial Sequence
  Synthetic
caccgctgtcccaaaaggtcaattttttaatccataaaataatattacctaaataaaaacataatactactccaaaactataaaaaaaaccaatctaaaaataaataaaaaaataaattacatatcagcagccagggcct

SEQ ID NO: 376207 - DNA, 140 bp, Artificial Sequence
  Synthetic
atacgccatgctgggtctcctttattgagtattttgtgtttttaaattaatatttaagtatgttagtgtgatgttttgattaatggaaattgattttaattttttaatttatattggtggcgtacttgggagtcggccat

SEQ ID NO: 376208 - DNA, 140 bp, Artificial Sequence
  Synthetic
atggccgactcccaagtacgccaccaatataaattaaaaaattaaaatcaatttccattaatcaaaacatcacactaacatacttaaatattaatttaaaaacacaaaatactcaataaaggagacccagcatggcgtat

SEQ ID NO: 376209 - DNA, 140 bp, Artificial Sequence
  Synthetic
aggccctggctgctgatatgatgttttgattaatggaaattgattttaattttttaatttatattggtgggatatttggagattgagggttgtttgatgttgtttgattgtttttttggagaccttttgggacagcggtg

SEQ ID NO: 376210 - DNA, 140 bp, Artificial Sequence
  Synthetic
caccgctgtcccaaaaggtctccaaaaaaacaatcaaacaacatcaaacaaccctcaatctccaaatatcccaccaatataaattaaaaaattaaaatcaatttccattaatcaaaacatcatatcagcagccagggcct

SEQ ID NO: 376211 - DNA, 140 bp, Artificial Sequence
  Synthetic
atacgccatgctgggtctcctaaaagataatttttttatggatagtatatttgtttgaaggttaatagttggaatttattaatgaatttttatataaaattttgggtttgtttaaataagcgtacttgggagtcggccat

SEQ ID NO: 376212 - DNA, 140 bp, Artificial Sequence
  Synthetic
atggccgactcccaagtacgcttatttaaacaaacccaaaattttatataaaaattcattaataaattccaactattaaccttcaaacaaatatactatccataaaaaaattatcttttaggagacccagcatggcgtat

SEQ ID NO: 376213 - DNA, 140 bp, Artificial Sequence
  Synthetic
aggccctggctgctgatatgggaatttattaatgaatttttatataaaattttgggtttgtttaaataaggttttaaaagtattttaaaggaggttagtatttaaaatgatggatatttggaccttttgggacagcggtg

SEQ ID NO: 376214 - DNA, 140 bp, Artificial Sequence
  Synthetic
caccgctgtcccaaaaggtccaaatatccatcattttaaatactaacctcctttaaaatacttttaaaaccttatttaaacaaacccaaaattttatataaaaattcattaataaattcccatatcagcagccagggcct

SEQ ID NO: 376215 - DNA, 140 bp, Artificial Sequence
  Synthetic
atacgccatgctgggtctccttttttttatgtatttttagtttattggagaagtaggaaattttggaaaatttaagattataatgattttttaagaggggatggaatatttatagaatttcgtacttgggagtcggccat

SEQ ID NO: 376216 - DNA, 140 bp, Artificial Sequence
  Synthetic
atggccgactcccaagtacgaaattctataaatattccatcccctcttaaaaaatcattataatcttaaattttccaaaatttcctacttctccaataaactaaaaatacataaaaaaaaggagacccagcatggcgtat

SEQ ID NO: 376217 - DNA, 140 bp, Artificial Sequence
  Synthetic
aggccctggctgctgatatgtttaagattataatgattttttaagaggggatggaatatttatagaatttgtgtgtaagtttttaagtaattattagttagatgaaaagtattataatgtgaccttttgggacagcggtg

SEQ ID NO: 376218 - DNA, 140 bp, Artificial Sequence
  Synthetic
caccgctgtcccaaaaggtcacattataatacttttcatctaactaataattacttaaaaacttacacacaaattctataaatattccatcccctcttaaaaaatcattataatcttaaacatatcagcagccagggcct

SEQ ID NO: 376219 - DNA, 140 bp, Artificial Sequence
  Synthetic
atacgccatgctgggtctccatagatttagtaataatgggtaaataatgagtaattattgtaagaaagggaagttttataagtggaatttttgtaaaatgttaatggagagttaaaggggcgtacttgggagtcggccat

SEQ ID NO: 376220 - DNA, 140 bp, Artificial Sequence
  Synthetic
atggccgactcccaagtacgcccctttaactctccattaacattttacaaaaattccacttataaaacttccctttcttacaataattactcattatttacccattattactaaatctatggagacccagcatggcgtat

SEQ ID NO: 376221 - DNA, 140 bp, Artificial Sequence
  Synthetic
aggccctggctgctgatatgaagttttataagtggaatttttgtaaaatgttaatggagagttaaaggggaattgttttaatagagggtgattatttttaaaataatattttattaataggaccttttgggacagcggtg

SEQ ID NO: 376222 - DNA, 140 bp, Artificial Sequence
  Synthetic
caccgctgtcccaaaaggtcctattaataaaatattattttaaaaataatcaccctctattaaaacaattcccctttaactctccattaacattttacaaaaattccacttataaaacttcatatcagcagccagggcct

SEQ ID NO: 376223 - DNA, 140 bp, Artificial Sequence
  Synthetic
atacgccatgctgggtctccaattataattatgtatatgattaagatgtttaagaattgatgaattaaaatattaaatagtatttatattagttaaggtttatgttggatattattatatcgtacttgggagtcggccat

SEQ ID NO: 376224 - DNA, 140 bp, Artificial Sequence
  Synthetic
atggccgactcccaagtacgatataataatatccaacataaaccttaactaatataaatactatttaatattttaattcatcaattcttaaacatcttaatcatatacataattataattggagacccagcatggcgtat

SEQ ID NO: 376225 - DNA, 140 bp, Artificial Sequence
  Synthetic
aggccctggctgctgatatgtattaaatagtatttatattagttaaggtttatgttggatattattatatattgtagatttatagggattgttttatttatgtattataaattggatgaagaccttttgggacagcggtg

SEQ ID NO: 376226 - DNA, 140 bp, Artificial Sequence
  Synthetic
caccgctgtcccaaaaggtcttcatccaatttataatacataaataaaacaatccctataaatctacaatatataataatatccaacataaaccttaactaatataaatactatttaatacatatcagcagccagggcct

SEQ ID NO: 376227 - DNA, 140 bp, Artificial Sequence
  Synthetic
atacgccatgctgggtctcctgaggggttaggggttttattatttttgtaaaaatatagtataaggttattatttttgaatatattggtaatagaatatagtatagaattagaagttgtacgtacttgggagtcggccat

SEQ ID NO: 376228 - DNA, 140 bp, Artificial Sequence
  Synthetic
atggccgactcccaagtacgtacaacttctaattctatactatattctattaccaatatattcaaaaataataaccttatactatatttttacaaaaataataaaacccctaacccctcaggagacccagcatggcgtat

SEQ ID NO: 376229 - DNA, 140 bp, Artificial Sequence
  Synthetic
aggccctggctgctgatatgtatttttgaatatattggtaatagaatatagtatagaattagaagttgtattaggtttttttattttgagaatgttgttattaataatgtaaaaggtttagaccttttgggacagcggtg

SEQ ID NO: 376230 - DNA, 140 bp, Artificial Sequence
  Synthetic
caccgctgtcccaaaaggtctaaaccttttacattattaataacaacattctcaaaataaaaaaacctaatacaacttctaattctatactatattctattaccaatatattcaaaaatacatatcagcagccagggcct

SEQ ID NO: 376231 - DNA, 140 bp, Artificial Sequence
  Synthetic
atacgccatgctgggtctccatataattagtttaatgtggttaagtaattaaaaatataatttattttgttaagttgaaattattatgatggatgttgaaataatagagaatttaaatagcgtacttgggagtcggccat

SEQ ID NO: 376232 - DNA, 140 bp, Artificial Sequence
  Synthetic
atggccgactcccaagtacgctatttaaattctctattatttcaacatccatcataataatttcaacttaacaaaataaattatatttttaattacttaaccacattaaactaattatatggagacccagcatggcgtat

SEQ ID NO: 376233 - DNA, 140 bp, Artificial Sequence
  Synthetic
aggccctggctgctgatatgtaagttgaaattattatgatggatgttgaaataatagagaatttaaataggttttaattttattgagtagtatataatttaatatttgattatattgattgaccttttgggacagcggtg

SEQ ID NO: 376234 - DNA, 140 bp, Artificial Sequence
  Synthetic
caccgctgtcccaaaaggtcaatcaatataatcaaatattaaattatatactactcaataaaattaaaacctatttaaattctctattatttcaacatccatcataataatttcaacttacatatcagcagccagggcct

SEQ ID NO: 376235 - DNA, 140 bp, Artificial Sequence
  Synthetic
atacgccatgctgggtctccggaatattatggattaatgattatttggttttattatttggggttggttatttgattaaattgattatattaagtgtttggttaagtgaatggtatttttcgtacttgggagtcggccat

SEQ ID NO: 376236 - DNA, 140 bp, Artificial Sequence
  Synthetic
atggccgactcccaagtacgaaaaataccattcacttaaccaaacacttaatataatcaatttaatcaaataaccaaccccaaataataaaaccaaataatcattaatccataatattccggagacccagcatggcgtat

SEQ ID NO: 376237 - DNA, 140 bp, Artificial Sequence
  Synthetic
aggccctggctgctgatatgtttgattaaattgattatattaagtgtttggttaagtgaatggtatttttgtttattaaatttgatatttattaataggagattggtttattagatttatgaccttttgggacagcggtg

SEQ ID NO: 376238 - DNA, 140 bp, Artificial Sequence
  Synthetic
caccgctgtcccaaaaggtcataaatctaataaaccaatctcctattaataaatatcaaatttaataaacaaaaataccattcacttaaccaaacacttaatataatcaatttaatcaaacatatcagcagccagggcct

SEQ ID NO: 376239 - DNA, 140 bp, Artificial Sequence
  Synthetic
atacgccatgctgggtctccaggtgtgtattggttgagttatattgtatagtatgttataaagaatttttattgtgaatatataggttttggttttttatttttagaaaaggttttatatcgtacttgggagtcggccat

SEQ ID NO: 376240 - DNA, 140 bp, Artificial Sequence
  Synthetic
atggccgactcccaagtacgatataaaaccttttctaaaaataaaaaaccaaaacctatatattcacaataaaaattctttataacatactatacaatataactcaaccaatacacacctggagacccagcatggcgtat

SEQ ID NO: 376241 - DNA, 140 bp, Artificial Sequence
  Synthetic
aggccctggctgctgatatgattgtgaatatataggttttggttttttatttttagaaaaggttttatattataggtataatttagttgatattggatttggtttattgttgttagttatgaccttttgggacagcggtg

SEQ ID NO: 376242 - DNA, 140 bp, Artificial Sequence
  Synthetic
caccgctgtcccaaaaggtcataactaacaacaataaaccaaatccaatatcaactaaattatacctataatataaaaccttttctaaaaataaaaaaccaaaacctatatattcacaatcatatcagcagccagggcct

SEQ ID NO: 376243 - DNA, 140 bp, Artificial Sequence
  Synthetic
atacgccatgctgggtctccataatttgatgagggagagttgtatttaaatgtattattttattaagattgtaaaaggtagaattataaagttagttaatgattttttgaagttttttttcgtacttgggagtcggccat

SEQ ID NO: 376244 - DNA, 140 bp, Artificial Sequence
  Synthetic
atggccgactcccaagtacgaaaaaaaacttcaaaaaatcattaactaactttataattctaccttttacaatcttaataaaataatacatttaaatacaactctccctcatcaaattatggagacccagcatggcgtat

SEQ ID NO: 376245 - DNA, 140 bp, Artificial Sequence
  Synthetic
aggccctggctgctgatatggtaaaaggtagaattataaagttagttaatgattttttgaagttttttttaattgtttaggtatttaaaaataattttttttggtatattgagtttaaaagaccttttgggacagcggtg

SEQ ID NO: 376246 - DNA, 140 bp, Artificial Sequence
  Synthetic
caccgctgtcccaaaaggtcttttaaactcaatataccaaaaaaaattatttttaaatacctaaacaattaaaaaaaacttcaaaaaatcattaactaactttataattctaccttttaccatatcagcagccagggcct

SEQ ID NO: 376247 - DNA, 140 bp, Artificial Sequence
  Synthetic
atacgccatgctgggtctcctgtgaatgttaggaaaaattttttgtttagatgttttatttataatgtttatgtgatgtagaaattaagttaattgaatgttttattgggttaatgtgatcgtacttgggagtcggccat

SEQ ID NO: 376248 - DNA, 140 bp, Artificial Sequence
  Synthetic
atggccgactcccaagtacgatcacattaacccaataaaacattcaattaacttaatttctacatcacataaacattataaataaaacatctaaacaaaaaatttttcctaacattcacaggagacccagcatggcgtat

SEQ ID NO: 376249 - DNA, 140 bp, Artificial Sequence
  Synthetic
aggccctggctgctgatatgatgtgatgtagaaattaagttaattgaatgttttattgggttaatgtgattttatttagaagggttaatatattttaattatatataggtattaaattatgaccttttgggacagcggtg

SEQ ID NO: 376250 - DNA, 140 bp, Artificial Sequence
  Synthetic
caccgctgtcccaaaaggtcataatttaatacctatatataattaaaatatattaacccttctaaataaaatcacattaacccaataaaacattcaattaacttaatttctacatcacatcatatcagcagccagggcct

SEQ ID NO: 376251 - DNA, 140 bp, Artificial Sequence
  Synthetic
atacgccatgctgggtctcctgattttaagtatattggaagagagtatgttaattttaattgttagaggtaataagttattagttattatttattgataagaatatattttattatagtgcgtacttgggagtcggccat

SEQ ID NO: 376252 - DNA, 140 bp, Artificial Sequence
  Synthetic
atggccgactcccaagtacgcactataataaaatatattcttatcaataaataataactaataacttattacctctaacaattaaaattaacatactctcttccaatatacttaaaatcaggagacccagcatggcgtat

SEQ ID NO: 376253 - DNA, 140 bp, Artificial Sequence
  Synthetic
aggccctggctgctgatatgaataagttattagttattatttattgataagaatatattttattatagtgtaatatattataattttataatgattttgtatttttaattttagtatttagaccttttgggacagcggtg

SEQ ID NO: 376254 - DNA, 140 bp, Artificial Sequence
  Synthetic
caccgctgtcccaaaaggtctaaatactaaaattaaaaatacaaaatcattataaaattataatatattacactataataaaatatattcttatcaataaataataactaataacttattcatatcagcagccagggcct

SEQ ID NO: 376255 - DNA, 140 bp, Artificial Sequence
  Synthetic
atacgccatgctgggtctccattgtgtgtattaaattattagtttattaggtttatgagttggttatatagtgagtattagtaattgaggattatgtagataggtaatttaatattgaatcgtacttgggagtcggccat

SEQ ID NO: 376256 - DNA, 140 bp, Artificial Sequence
  Synthetic
atggccgactcccaagtacgattcaatattaaattacctatctacataatcctcaattactaatactcactatataaccaactcataaacctaataaactaataatttaatacacacaatggagacccagcatggcgtat

SEQ ID NO: 376257 - DNA, 140 bp, Artificial Sequence
  Synthetic
aggccctggctgctgatatggtgagtattagtaattgaggattatgtagataggtaatttaatattgaattatttatttgatgttattatatttaaatgttgtgttagttgtatttaaatgaccttttgggacagcggtg

SEQ ID NO: 376258 - DNA, 140 bp, Artificial Sequence
  Synthetic
caccgctgtcccaaaaggtcatttaaatacaactaacacaacatttaaatataataacatcaaataaataattcaatattaaattacctatctacataatcctcaattactaatactcaccatatcagcagccagggcct

SEQ ID NO: 376259 - DNA, 140 bp, Artificial Sequence
  Synthetic
atacgccatgctgggtctccgagtaaaagtataaaataaatttaattaaattttaaagtgattaaatgataatgattttgggaatttgatatgattttaagttaaaaataatgttaatatcgtacttgggagtcggccat

SEQ ID NO: 376260 - DNA, 140 bp, Artificial Sequence
  Synthetic
atggccgactcccaagtacgatattaacattatttttaacttaaaatcatatcaaattcccaaaatcattatcatttaatcactttaaaatttaattaaatttattttatacttttactcggagacccagcatggcgtat

SEQ ID NO: 376261 - DNA, 140 bp, Artificial Sequence
  Synthetic
atacgccatgctgggtctcctaattagttttagtagttaagattaaatgtaaatattataagaatgttaagtgtatataaaaatattataaaaaattaatttttttttttttgtgtgtttcgtacttgggagtcggccat

SEQ ID NO: 376262 - DNA, 140 bp, Artificial Sequence
  Synthetic
atggccgactcccaagtacgaaacacacaaaaaaaaaaaaattaattttttataatatttttatatacacttaacattcttataatatttacatttaatcttaactactaaaactaattaggagacccagcatggcgtat

SEQ ID NO: 376263 - DNA, 140 bp, Artificial Sequence
  Synthetic
atacgccatgctgggtctccggatatataaaaaggaaaaaattggttttttataatgtttttgtgtgtgtttaatatttttataatgtttgtatttgattttaattattaaagttagttacgtacttgggagtcggccat

SEQ ID NO: 376264 - DNA, 140 bp, Artificial Sequence
  Synthetic
atggccgactcccaagtacgtaactaactttaataattaaaatcaaatacaaacattataaaaatattaaacacacacaaaaacattataaaaaaccaattttttcctttttatatatccggagacccagcatggcgtat

SEQ ID NO: 376265 - DNA, 140 bp, Artificial Sequence
  Synthetic
aggccctggctgctgatatgttaatatttttataatgtttgtatttgattttaattattaaagttagttagttattaaaatttatattattatttatattattaaataattatattgatagaccttttgggacagcggtg

SEQ ID NO: 376266 - DNA, 140 bp, Artificial Sequence
  Synthetic
caccgctgtcccaaaaggtctatcaatataattatttaataatataaataataatataaattttaataactaactaactttaataattaaaatcaaatacaaacattataaaaatattaacatatcagcagccagggcct

SEQ ID NO: 376267 - DNA, 140 bp, Artificial Sequence
  Synthetic
atacgccatgctgggtctccgttattaaaatttatattattatttatattattaaataattatattgatattatttttgatttgaggttatattgagtttttaagattattattatttaacgtacttgggagtcggccat

SEQ ID NO: 376268 - DNA, 140 bp, Artificial Sequence
  Synthetic
atggccgactcccaagtacgttaaataataataatcttaaaaactcaatataacctcaaatcaaaaataatatcaatataattatttaataatataaataataatataaattttaataacggagacccagcatggcgtat

SEQ ID NO: 376269 - DNA, 140 bp, Artificial Sequence
  Synthetic
atacgccatgctgggtctcctttagtatttttagtttatgttatttaattgaagatagtatgtttaaatgtgattagtataatatttggatatggtgatattagatgggtgatttagtgtcgtacttgggagtcggccat

SEQ ID NO: 376270 - DNA, 140 bp, Artificial Sequence
  Synthetic
atggccgactcccaagtacgacactaaatcacccatctaatatcaccatatccaaatattatactaatcacatttaaacatactatcttcaattaaataacataaactaaaaatactaaaggagacccagcatggcgtat

SEQ ID NO: 376271 - DNA, 140 bp, Artificial Sequence
  Synthetic
aggccctggctgctgatatgtgattagtataatatttggatatggtgatattagatgggtgatttagtgttagattatttatttatataatttttaattattaatatttattgtgtaattgaccttttgggacagcggtg

SEQ ID NO: 376272 - DNA, 140 bp, Artificial Sequence
  Synthetic
caccgctgtcccaaaaggtcaattacacaataaatattaataattaaaaattatataaataaataatctaacactaaatcacccatctaatatcaccatatccaaatattatactaatcacatatcagcagccagggcct

SEQ ID NO: 376273 - DNA, 140 bp, Artificial Sequence
  Synthetic
atacgccatgctgggtctccaagataggaattggggttatttttttggtagtatattttaataaatattaggattagaaatgtaaaattgttataaagttatgatgtgttatgttatgatcgtacttgggagtcggccat

SEQ ID NO: 376274 - DNA, 140 bp, Artificial Sequence
  Synthetic
atggccgactcccaagtacgatcataacataacacatcataactttataacaattttacatttctaatcctaatatttattaaaatatactaccaaaaaaataaccccaattcctatcttggagacccagcatggcgtat

SEQ ID NO: 376275 - DNA, 140 bp, Artificial Sequence
  Synthetic
aggccctggctgctgatatgggattagaaatgtaaaattgttataaagttatgatgtgttatgttatgataaagtgtatttttattaataagtaataattaatagtttgttatttttaatgaccttttgggacagcggtg

SEQ ID NO: 376276 - DNA, 140 bp, Artificial Sequence
  Synthetic
caccgctgtcccaaaaggtcattaaaaataacaaactattaattattacttattaataaaaatacactttatcataacataacacatcataactttataacaattttacatttctaatcccatatcagcagccagggcct

SEQ ID NO: 376277 - DNA, 140 bp, Artificial Sequence
  Synthetic
atacgccatgctgggtctccttgttgttaggaattattattattttattttttatattatgatgatttagtatttatgtgtgattggaatatattaatttttttggataaaattgtattacgtacttgggagtcggccat

SEQ ID NO: 376278 - DNA, 140 bp, Artificial Sequence
  Synthetic
atggccgactcccaagtacgtaatacaattttatccaaaaaaattaatatattccaatcacacataaatactaaatcatcataatataaaaaataaaataataataattcctaacaacaaggagacccagcatggcgtat

SEQ ID NO: 376279 - DNA, 140 bp, Artificial Sequence
  Synthetic
aggccctggctgctgatatgtatttatgtgtgattggaatatattaatttttttggataaaattgtattaatttggtaaggtgtttaattagtttgatttttgtattgtgtaggtgttgtgaccttttgggacagcggtg

SEQ ID NO: 376280 - DNA, 140 bp, Artificial Sequence
  Synthetic
caccgctgtcccaaaaggtcacaacacctacacaatacaaaaatcaaactaattaaacaccttaccaaattaatacaattttatccaaaaaaattaatatattccaatcacacataaatacatatcagcagccagggcct

SEQ ID NO: 376281 - DNA, 140 bp, Artificial Sequence
  Synthetic
atacgccatgctgggtctccatgataaaattgattatatatattaataattttaggtaattttttaagtttagtatattaagaagaattatttttgagtgtttggataattaaagaaaatcgtacttgggagtcggccat

SEQ ID NO: 376282 - DNA, 140 bp, Artificial Sequence
  Synthetic
atggccgactcccaagtacgattttctttaattatccaaacactcaaaaataattcttcttaatatactaaacttaaaaaattacctaaaattattaatatatataatcaattttatcatggagacccagcatggcgtat

SEQ ID NO: 376283 - DNA, 140 bp, Artificial Sequence
  Synthetic
aggccctggctgctgatatgtagtatattaagaagaattatttttgagtgtttggataattaaagaaaattttagaaagttattgattaattttgtgattttgttttttgtagttttaatgaccttttgggacagcggtg

SEQ ID NO: 376284 - DNA, 140 bp, Artificial Sequence
  Synthetic
caccgctgtcccaaaaggtcattaaaactacaaaaaacaaaatcacaaaattaatcaataactttctaaaattttctttaattatccaaacactcaaaaataattcttcttaatatactacatatcagcagccagggcct

SEQ ID NO: 376285 - DNA, 140 bp, Artificial Sequence
  Synthetic
atacgccatgctgggtctccttaagttttgtatttttgtttggaggttagttaaatgtttaataattgatgataatggattgagtttagtattaattagattatatttgtgatataggatcgtacttgggagtcggccat

SEQ ID NO: 376286 - DNA, 140 bp, Artificial Sequence
  Synthetic
atggccgactcccaagtacgatcctatatcacaaatataatctaattaatactaaactcaatccattatcatcaattattaaacatttaactaacctccaaacaaaaatacaaaacttaaggagacccagcatggcgtat

SEQ ID NO: 376287 - DNA, 140 bp, Artificial Sequence
  Synthetic
aggccctggctgctgatatggataatggattgagtttagtattaattagattatatttgtgatataggattttttttagagatgggaaattaaggtttatgtatttataatggagattttgaccttttgggacagcggtg

SEQ ID NO: 376288 - DNA, 140 bp, Artificial Sequence
  Synthetic
caccgctgtcccaaaaggtcaaaatctccattataaatacataaaccttaatttcccatctctaaaaaaaatcctatatcacaaatataatctaattaatactaaactcaatccattatccatatcagcagccagggcct

SEQ ID NO: 376289 - DNA, 140 bp, Artificial Sequence
  Synthetic
atacgccatgctgggtctcctgtgtttgtaaagtatttttgataatattaagatatgttttgtgagtttgatgggttgattttttgttagtagatattaaatttgataagtaaaggtattcgtacttgggagtcggccat

SEQ ID NO: 376290 - DNA, 140 bp, Artificial Sequence
  Synthetic
atggccgactcccaagtacgaatacctttacttatcaaatttaatatctactaacaaaaaatcaacccatcaaactcacaaaacatatcttaatattatcaaaaatactttacaaacacaggagacccagcatggcgtat

SEQ ID NO: 376291 - DNA, 140 bp, Artificial Sequence
  Synthetic
aggccctggctgctgatatgatgggttgattttttgttagtagatattaaatttgataagtaaaggtattatttatttgattgggtatttgatgtaattggtttaattaagtaattagttgaccttttgggacagcggtg

SEQ ID NO: 376292 - DNA, 140 bp, Artificial Sequence
  Synthetic
caccgctgtcccaaaaggtcaactaattacttaattaaaccaattacatcaaatacccaatcaaataaataatacctttacttatcaaatttaatatctactaacaaaaaatcaacccatcatatcagcagccagggcct

SEQ ID NO: 376293 - DNA, 140 bp, Artificial Sequence
  Synthetic
atacgccatgctgggtctccatttagaaatattttgagtattattattttgagatattgtggattaatgtgattaagtattaagttatatattgtttggtagagttgggatttgtttaagcgtacttgggagtcggccat

SEQ ID NO: 376294 - DNA, 140 bp, Artificial Sequence
  Synthetic
atggccgactcccaagtacgcttaaacaaatcccaactctaccaaacaatatataacttaatacttaatcacattaatccacaatatctcaaaataataatactcaaaatatttctaaatggagacccagcatggcgtat

SEQ ID NO: 376295 - DNA, 140 bp, Artificial Sequence
  Synthetic
aggccctggctgctgatatggattaagtattaagttatatattgtttggtagagttgggatttgtttaagttttttgttgttttagtatttattataatgattttaatttgataaggtaggaccttttgggacagcggtg

SEQ ID NO: 376296 - DNA, 140 bp, Artificial Sequence
  Synthetic
caccgctgtcccaaaaggtcctaccttatcaaattaaaatcattataataaatactaaaacaacaaaaaacttaaacaaatcccaactctaccaaacaatatataacttaatacttaatccatatcagcagccagggcct

SEQ ID NO: 376297 - DNA, 140 bp, Artificial Sequence
  Synthetic
atacgccatgctgggtctccgatttgttgaattatttaagataatagtgatttgttttttatgaattttttgtattattggtaataatatttttggagtagaaaaatttgatataattttcgtacttgggagtcggccat

SEQ ID NO: 376298 - DNA, 140 bp, Artificial Sequence
  Synthetic
atggccgactcccaagtacgaaaattatatcaaatttttctactccaaaaatattattaccaataatacaaaaaattcataaaaaacaaatcactattatcttaaataattcaacaaatcggagacccagcatggcgtat

SEQ ID NO: 376299 - DNA, 140 bp, Artificial Sequence
  Synthetic
aggccctggctgctgatatgtgtattattggtaataatatttttggagtagaaaaatttgatataatttttgattttatattgtgttttgttgttaatgtgtttaaaaataataattttggaccttttgggacagcggtg

SEQ ID NO: 376300 - DNA, 140 bp, Artificial Sequence
  Synthetic
caccgctgtcccaaaaggtccaaaattattatttttaaacacattaacaacaaaacacaatataaaatcaaaaattatatcaaatttttctactccaaaaatattattaccaataatacacatatcagcagccagggcct

SEQ ID NO: 376301 - DNA, 140 bp, Artificial Sequence
  Synthetic
atacgccatgctgggtctccaatgtgatagttgaattgaaattattgtattttagaagaattttgtttaatttgtaatgtatggatgagataatttttgtgaatttataatatatagtggcgtacttgggagtcggccat

SEQ ID NO: 376302 - DNA, 140 bp, Artificial Sequence
  Synthetic
atggccgactcccaagtacgccactatatattataaattcacaaaaattatctcatccatacattacaaattaaacaaaattcttctaaaatacaataatttcaattcaactatcacattggagacccagcatggcgtat

SEQ ID NO: 376303 - DNA, 140 bp, Artificial Sequence
  Synthetic
aggccctggctgctgatatgtttgtaatgtatggatgagataatttttgtgaatttataatatatagtggtgtttaatatagattttagttgatgtaggtattgtttaatattttgatttgaccttttgggacagcggtg

SEQ ID NO: 376304 - DNA, 140 bp, Artificial Sequence
  Synthetic
caccgctgtcccaaaaggtcaaatcaaaatattaaacaatacctacatcaactaaaatctatattaaacaccactatatattataaattcacaaaaattatctcatccatacattacaaacatatcagcagccagggcct

SEQ ID NO: 376305 - DNA, 140 bp, Artificial Sequence
  Synthetic
atacgccatgctgggtctccaaaaaatggtagaatgagttggtgaggatttgatatattatttgttggtggagtattgttttgaaagtagttattttttgttagaatagtttttttttgacgtacttgggagtcggccat

SEQ ID NO: 376306 - DNA, 140 bp, Artificial Sequence
  Synthetic
atggccgactcccaagtacgtcaaaaaaaaactattctaacaaaaaataactactttcaaaacaatactccaccaacaaataatatatcaaatcctcaccaactcattctaccattttttggagacccagcatggcgtat

SEQ ID NO: 376307 - DNA, 140 bp, Artificial Sequence
  Synthetic
aggccctggctgctgatatggagtattgttttgaaagtagttattttttgttagaatagtttttttttgattttttattaatattttgtagggattttatttgtggaattttttttttttgaccttttgggacagcggtg

SEQ ID NO: 376308 - DNA, 140 bp, Artificial Sequence
  Synthetic
caccgctgtcccaaaaggtcaaaaaaaaaaaattccacaaataaaatccctacaaaatattaataaaaaatcaaaaaaaaactattctaacaaaaaataactactttcaaaacaatactccatatcagcagccagggcct

SEQ ID NO: 376309 - DNA, 140 bp, Artificial Sequence
  Synthetic
atacgccatgctgggtctccagtttttgtgtttttgtggttttggtgattttttatatgttatattgtagtattttttatttgattgatgattgtttgaaaatttatgtatgggttttgtcgtacttgggagtcggccat

SEQ ID NO: 376310 - DNA, 140 bp, Artificial Sequence
  Synthetic
atggccgactcccaagtacgacaaaacccatacataaattttcaaacaatcatcaatcaaataaaaaatactacaatataacatataaaaaatcaccaaaaccacaaaaacacaaaaactggagacccagcatggcgtat

SEQ ID NO: 376311 - DNA, 140 bp, Artificial Sequence
  Synthetic
aggccctggctgctgatatgtattttttatttgattgatgattgtttgaaaatttatgtatgggttttgtaagtgttttatttttttttgagaaattattatggttttgagttttttgaggaccttttgggacagcggtg

SEQ ID NO: 376312 - DNA, 140 bp, Artificial Sequence
  Synthetic
caccgctgtcccaaaaggtcctcaaaaaactcaaaaccataataatttctcaaaaaaaaataaaacacttacaaaacccatacataaattttcaaacaatcatcaatcaaataaaaaatacatatcagcagccagggcct

SEQ ID NO: 376313 - DNA, 140 bp, Artificial Sequence
  Synthetic
atacgccatgctgggtctccgtgtttttattattgtaaatataattattttttgttaaatttaaatgtttattattttggatgttgattttttttggaatatttttggggttttgtttgacgtacttgggagtcggccat

SEQ ID NO: 376314 - DNA, 140 bp, Artificial Sequence
  Synthetic
atggccgactcccaagtacgtcaaacaaaaccccaaaaatattccaaaaaaaatcaacatccaaaataataaacatttaaatttaacaaaaaataattatatttacaataataaaaacacggagacccagcatggcgtat

SEQ ID NO: 376315 - DNA, 140 bp, Artificial Sequence
  Synthetic
aggccctggctgctgatatgattattttggatgttgattttttttggaatatttttggggttttgtttgagtagatttaaaattttatgtagaaatttattgatggattttggttgttgagaccttttgggacagcggtg

SEQ ID NO: 376316 - DNA, 140 bp, Artificial Sequence
  Synthetic
caccgctgtcccaaaaggtctcaacaaccaaaatccatcaataaatttctacataaaattttaaatctactcaaacaaaaccccaaaaatattccaaaaaaaatcaacatccaaaataatcatatcagcagccagggcct

SEQ ID NO: 376317 - DNA, 140 bp, Artificial Sequence
  Synthetic
atacgccatgctgggtctccgatttagtttttaagaaattgtaaaaaatttgtgattgttgtttgaagaaatagttgagtagtattagatagtttttgatttttagatgttttgttaatacgtacttgggagtcggccat

SEQ ID NO: 376318 - DNA, 140 bp, Artificial Sequence
  Synthetic
atggccgactcccaagtacgtattaacaaaacatctaaaaatcaaaaactatctaatactactcaactatttcttcaaacaacaatcacaaattttttacaatttcttaaaaactaaatcggagacccagcatggcgtat

SEQ ID NO: 376319 - DNA, 140 bp, Artificial Sequence
  Synthetic
aggccctggctgctgatatgatagttgagtagtattagatagtttttgatttttagatgttttgttaatataaattgagaagttagaattaatttttattaattgggatattatattggtgaccttttgggacagcggtg

SEQ ID NO: 376320 - DNA, 140 bp, Artificial Sequence
  Synthetic
caccgctgtcccaaaaggtcaccaatataatatcccaattaataaaaattaattctaacttctcaatttatattaacaaaacatctaaaaatcaaaaactatctaatactactcaactatcatatcagcagccagggcct

SEQ ID NO: 376321 - DNA, 140 bp, Artificial Sequence
  Synthetic
atacgccatgctgggtctccgtagttggttatgtaaataatatagaaattgtttgtaattaagttttttagtttataggatagtattgtttagataaaagtataatattgttttgaaattcgtacttgggagtcggccat

SEQ ID NO: 376322 - DNA, 140 bp, Artificial Sequence
  Synthetic
atggccgactcccaagtacgaatttcaaaacaatattatacttttatctaaacaatactatcctataaactaaaaaacttaattacaaacaatttctatattatttacataaccaactacggagacccagcatggcgtat

SEQ ID NO: 376323 - DNA, 140 bp, Artificial Sequence
  Synthetic
aggccctggctgctgatatggtttataggatagtattgtttagataaaagtataatattgttttgaaattgtaaagaaggttaatttgagggtaagtgagaaaatgagttgtgaaagagtgaccttttgggacagcggtg

SEQ ID NO: 376324 - DNA, 140 bp, Artificial Sequence
  Synthetic
caccgctgtcccaaaaggtcactctttcacaactcattttctcacttaccctcaaattaaccttctttacaatttcaaaacaatattatacttttatctaaacaatactatcctataaaccatatcagcagccagggcct

SEQ ID NO: 376325 - DNA, 140 bp, Artificial Sequence
  Synthetic
atacgccatgctgggtctccatgatggattgtattattgtttttgttaatttttatttagaaaggtgtggaaagtggagaagattatttttaattatgttaagtttaggattttttattacgtacttgggagtcggccat

SEQ ID NO: 376326 - DNA, 140 bp, Artificial Sequence
  Synthetic
atggccgactcccaagtacgtaataaaaaatcctaaacttaacataattaaaaataatcttctccactttccacacctttctaaataaaaattaacaaaaacaataatacaatccatcatggagacccagcatggcgtat

SEQ ID NO: 376327 - DNA, 140 bp, Artificial Sequence
  Synthetic
aggccctggctgctgatatgaaagtggagaagattatttttaattatgttaagtttaggattttttattaaaggattatttattgttaaattgtagtttaattttttttttagtggatttgaccttttgggacagcggtg

SEQ ID NO: 376328 - DNA, 140 bp, Artificial Sequence
  Synthetic
caccgctgtcccaaaaggtcaaatccactaaaaaaaaaattaaactacaatttaacaataaataatcctttaataaaaaatcctaaacttaacataattaaaaataatcttctccactttcatatcagcagccagggcct

SEQ ID NO: 376329 - DNA, 140 bp, Artificial Sequence
  Synthetic
atacgccatgctgggtctcctgtatttgtatatgttaaatattgggttgggatttttttagtatagtattttgttaggtgaagatgagttttattatgttttatattagaggtgtttgtacgtacttgggagtcggccat

SEQ ID NO: 376330 - DNA, 140 bp, Artificial Sequence
  Synthetic
atggccgactcccaagtacgtacaaacacctctaatataaaacataataaaactcatcttcacctaacaaaatactatactaaaaaaatcccaacccaatatttaacatatacaaatacaggagacccagcatggcgtat

SEQ ID NO: 376331 - DNA, 140 bp, Artificial Sequence
  Synthetic
aggccctggctgctgatatgttgttaggtgaagatgagttttattatgttttatattagaggtgtttgtattttggaatttaatattataaagggtaattgttaaatttataatattttggaccttttgggacagcggtg

SEQ ID NO: 376332 - DNA, 140 bp, Artificial Sequence
  Synthetic
caccgctgtcccaaaaggtccaaaatattataaatttaacaattaccctttataatattaaattccaaaatacaaacacctctaatataaaacataataaaactcatcttcacctaacaacatatcagcagccagggcct

SEQ ID NO: 376333 - DNA, 140 bp, Artificial Sequence
  Synthetic
atacgccatgctgggtctcctaagtgtattagttgatattatgagatgggttgtagtattgtttatgtgatttgttataaatgagtgtgggttgtattggttgttatattgatggataatcgtacttgggagtcggccat

SEQ ID NO: 376334 - DNA, 140 bp, Artificial Sequence
  Synthetic
atggccgactcccaagtacgattatccatcaatataacaaccaatacaacccacactcatttataacaaatcacataaacaatactacaacccatctcataatatcaactaatacacttaggagacccagcatggcgtat

SEQ ID NO: 376335 - DNA, 140 bp, Artificial Sequence
  Synthetic
aggccctggctgctgatatgtttgttataaatgagtgtgggttgtattggttgttatattgatggataatattttttgaataatgtgatggtgttatttgtaggattttattgatattaagaccttttgggacagcggtg

SEQ ID NO: 376336 - DNA, 140 bp, Artificial Sequence
  Synthetic
caccgctgtcccaaaaggtcttaatatcaataaaatcctacaaataacaccatcacattattcaaaaaatattatccatcaatataacaaccaatacaacccacactcatttataacaaacatatcagcagccagggcct

SEQ ID NO: 376337 - DNA, 140 bp, Artificial Sequence
  Synthetic
atacgccatgctgggtctcctttttttgtgtaatttaagtgagttttgatgttaattttatagtttttttgagggtagatgaagggtattgtggtttgatagtaggttgtttgattttatcgtacttgggagtcggccat

SEQ ID NO: 376338 - DNA, 140 bp, Artificial Sequence
  Synthetic
atggccgactcccaagtacgataaaatcaaacaacctactatcaaaccacaatacccttcatctaccctcaaaaaaactataaaattaacatcaaaactcacttaaattacacaaaaaaaggagacccagcatggcgtat

SEQ ID NO: 376339 - DNA, 140 bp, Artificial Sequence
  Synthetic
aggccctggctgctgatatggagggtagatgaagggtattgtggtttgatagtaggttgtttgattttatttttggtttttgattttatataggggatattattttttattgtttaatttgaccttttgggacagcggtg

SEQ ID NO: 376340 - DNA, 140 bp, Artificial Sequence
  Synthetic
caccgctgtcccaaaaggtcaaattaaacaataaaaaataatatcccctatataaaatcaaaaaccaaaaataaaatcaaacaacctactatcaaaccacaatacccttcatctaccctccatatcagcagccagggcct

SEQ ID NO: 376341 - DNA, 140 bp, Artificial Sequence
  Synthetic
atacgccatgctgggtctcctgagatataagtatttgagttttttttgttgagatattttggataaggtttatattgttttagttatttaattttgaattgttttattatatatggtaatcgtacttgggagtcggccat

SEQ ID NO: 376342 - DNA, 140 bp, Artificial Sequence
  Synthetic
atggccgactcccaagtacgattaccatatataataaaacaattcaaaattaaataactaaaacaatataaaccttatccaaaatatctcaacaaaaaaaactcaaatacttatatctcaggagacccagcatggcgtat

SEQ ID NO: 376343 - DNA, 140 bp, Artificial Sequence
  Synthetic
aggccctggctgctgatatgtatattgttttagttatttaattttgaattgttttattatatatggtaatgttgttttgattaatgatttattttttaagatgtgtgattatgtatatttgaccttttgggacagcggtg

SEQ ID NO: 376344 - DNA, 140 bp, Artificial Sequence
  Synthetic
caccgctgtcccaaaaggtcaaatatacataatcacacatcttaaaaaataaatcattaatcaaaacaacattaccatatataataaaacaattcaaaattaaataactaaaacaatatacatatcagcagccagggcct

SEQ ID NO: 376345 - DNA, 140 bp, Artificial Sequence
  Synthetic
atacgccatgctgggtctccttgttagtaattggttataatggtttaaataattgaattatagattttatttttgtagggtgattttttttagtttattaagtataggtgttttattgttcgtacttgggagtcggccat

SEQ ID NO: 376346 - DNA, 140 bp, Artificial Sequence
  Synthetic
atggccgactcccaagtacgaacaataaaacacctatacttaataaactaaaaaaaatcaccctacaaaaataaaatctataattcaattatttaaaccattataaccaattactaacaaggagacccagcatggcgtat

SEQ ID NO: 376347 - DNA, 140 bp, Artificial Sequence
  Synthetic
aggccctggctgctgatatgttttgtagggtgattttttttagtttattaagtataggtgttttattgttgttgtttatgattttggaggttaatagagttttggtttttttaagataatgaccttttgggacagcggtg

SEQ ID NO: 376348 - DNA, 140 bp, Artificial Sequence
  Synthetic
caccgctgtcccaaaaggtcattatcttaaaaaaaccaaaactctattaacctccaaaatcataaacaacaacaataaaacacctatacttaataaactaaaaaaaatcaccctacaaaacatatcagcagccagggcct

SEQ ID NO: 376349 - DNA, 140 bp, Artificial Sequence
  Synthetic
atacgccatgctgggtctccgtaaagtgatttatgatagggtttgatgaaaggagttatttataaattattttattttttaaattagtagaggtatggaagagagtgttaattaatttatcgtacttgggagtcggccat

SEQ ID NO: 376350 - DNA, 140 bp, Artificial Sequence
  Synthetic
atggccgactcccaagtacgataaattaattaacactctcttccatacctctactaatttaaaaaataaaataatttataaataactcctttcatcaaaccctatcataaatcactttacggagacccagcatggcgtat

SEQ ID NO: 376351 - DNA, 140 bp, Artificial Sequence
  Synthetic
aggccctggctgctgatatgtttattttttaaattagtagaggtatggaagagagtgttaattaatttatttttagtagttagggtaatattatgtttaatgatttgttgtaaaaaggatgaccttttgggacagcggtg

SEQ ID NO: 376352 - DNA, 140 bp, Artificial Sequence
  Synthetic
caccgctgtcccaaaaggtcatcctttttacaacaaatcattaaacataatattaccctaactactaaaaataaattaattaacactctcttccatacctctactaatttaaaaaataaacatatcagcagccagggcct

SEQ ID NO: 376353 - DNA, 140 bp, Artificial Sequence
  Synthetic
atacgccatgctgggtctccattaatggtattataattttttggattttttgatattaatggataaaataggttttttatgttaattatttttaggtatatttgtagttggaaaagtttacgtacttgggagtcggccat

SEQ ID NO: 376354 - DNA, 140 bp, Artificial Sequence
  Synthetic
atggccgactcccaagtacgtaaacttttccaactacaaatatacctaaaaataattaacataaaaaacctattttatccattaatatcaaaaaatccaaaaaattataataccattaatggagacccagcatggcgtat

SEQ ID NO: 376355 - DNA, 140 bp, Artificial Sequence
  Synthetic
aggccctggctgctgatatgggttttttatgttaattatttttaggtatatttgtagttggaaaagtttagaagttataggatttttgaagttttgataaaaatatttttttggatttaggaccttttgggacagcggtg

SEQ ID NO: 376356 - DNA, 140 bp, Artificial Sequence
  Synthetic
caccgctgtcccaaaaggtcctaaatccaaaaaaatatttttatcaaaacttcaaaaatcctataacttctaaacttttccaactacaaatatacctaaaaataattaacataaaaaacccatatcagcagccagggcct

SEQ ID NO: 376357 - DNA, 140 bp, Artificial Sequence
  Synthetic
atacgccatgctgggtctccttttatagtttaatggtttattaagtgataattgttttaaattgatgtttttattaaatttaagatggtgatattgtaaaatttgaatggtgaaatatgtcgtacttgggagtcggccat

SEQ ID NO: 376358 - DNA, 140 bp, Artificial Sequence
  Synthetic
atggccgactcccaagtacgacatatttcaccattcaaattttacaatatcaccatcttaaatttaataaaaacatcaatttaaaacaattatcacttaataaaccattaaactataaaaggagacccagcatggcgtat

SEQ ID NO: 376359 - DNA, 140 bp, Artificial Sequence
  Synthetic
aggccctggctgctgatatgttattaaatttaagatggtgatattgtaaaatttgaatggtgaaatatgtatggaaagttgttataatatgatatgggaggatatgttgtgtttttgatagaccttttgggacagcggtg

SEQ ID NO: 376360 - DNA, 140 bp, Artificial Sequence
  Synthetic
caccgctgtcccaaaaggtctatcaaaaacacaacatatcctcccatatcatattataacaactttccatacatatttcaccattcaaattttacaatatcaccatcttaaatttaataacatatcagcagccagggcct

SEQ ID NO: 376361 - DNA, 140 bp, Artificial Sequence
  Synthetic
atacgccatgctgggtctccttgaatatagtattagagagtggtgttatttttgttgttgttttgagtgattgtggtaattgtatattattgagatattgtttttttttgaaataaatgacgtacttgggagtcggccat

SEQ ID NO: 376362 - DNA, 140 bp, Artificial Sequence
  Synthetic
atggccgactcccaagtacgtcatttatttcaaaaaaaaacaatatctcaataatatacaattaccacaatcactcaaaacaacaacaaaaataacaccactctctaatactatattcaaggagacccagcatggcgtat

SEQ ID NO: 376363 - DNA, 140 bp, Artificial Sequence
  Synthetic
aggccctggctgctgatatgttgtggtaattgtatattattgagatattgtttttttttgaaataaatgaaatttgagtgtataaatgttttatttggtttaagaaagattttatatgtagaccttttgggacagcggtg

SEQ ID NO: 376364 - DNA, 140 bp, Artificial Sequence
  Synthetic
caccgctgtcccaaaaggtctacatataaaatctttcttaaaccaaataaaacatttatacactcaaatttcatttatttcaaaaaaaaacaatatctcaataatatacaattaccacaacatatcagcagccagggcct

SEQ ID NO: 376365 - DNA, 140 bp, Artificial Sequence
  Synthetic
atacgccatgctgggtctccgttttgtttttgttttttagggtttgttttaagtggaaaaatagataatatggttatatattgattgttttttatgattgttgattgtaatttaaaattacgtacttgggagtcggccat

SEQ ID NO: 376366 - DNA, 140 bp, Artificial Sequence
  Synthetic
atggccgactcccaagtacgtaattttaaattacaatcaacaatcataaaaaacaatcaatatataaccatattatctatttttccacttaaaacaaaccctaaaaaacaaaaacaaaacggagacccagcatggcgtat

SEQ ID NO: 376367 - DNA, 140 bp, Artificial Sequence
  Synthetic
aggccctggctgctgatatgtggttatatattgattgttttttatgattgttgattgtaatttaaaattagttttaatttttattaaggagatttgtgtataggatatatttgtttataggaccttttgggacagcggtg

SEQ ID NO: 376368 - DNA, 140 bp, Artificial Sequence
  Synthetic
caccgctgtcccaaaaggtcctataaacaaatatatcctatacacaaatctccttaataaaaattaaaactaattttaaattacaatcaacaatcataaaaaacaatcaatatataaccacatatcagcagccagggcct

SEQ ID NO: 376369 - DNA, 140 bp, Artificial Sequence
  Synthetic
atacgccatgctgggtctccggtttttaggaggatatttttgattgttaagattaatattgtgaggtggattataataattatttatatgtatgtaatattgtgggattaaataatgtatcgtacttgggagtcggccat

SEQ ID NO: 376370 - DNA, 140 bp, Artificial Sequence
  Synthetic
atggccgactcccaagtacgatacattatttaatcccacaatattacatacatataaataattattataatccacctcacaatattaatcttaacaatcaaaaatatcctcctaaaaaccggagacccagcatggcgtat

SEQ ID NO: 376371 - DNA, 140 bp, Artificial Sequence
  Synthetic
aggccctggctgctgatatgttataataattatttatatgtatgtaatattgtgggattaaataatgtatttaattaaagatattatgtatattatagtaatggttgtagtatttaataagaccttttgggacagcggtg

SEQ ID NO: 376372 - DNA, 140 bp, Artificial Sequence
  Synthetic
caccgctgtcccaaaaggtcttattaaatactacaaccattactataatatacataatatctttaattaaatacattatttaatcccacaatattacatacatataaataattattataacatatcagcagccagggcct

SEQ ID NO: 376373 - DNA, 140 bp, Artificial Sequence
  Synthetic
atacgccatgctgggtctccgttataaaattatttttttgaatggtagtattttttttaaaattattattggtgtggtgttatgatgtttgatgaagaaggttttttttttgtttatgttcgtacttgggagtcggccat

SEQ ID NO: 376374 - DNA, 140 bp, Artificial Sequence
  Synthetic
atggccgactcccaagtacgaacataaacaaaaaaaaaaccttcttcatcaaacatcataacaccacaccaataataattttaaaaaaaatactaccattcaaaaaaataattttataacggagacccagcatggcgtat

SEQ ID NO: 376375 - DNA, 140 bp, Artificial Sequence
  Synthetic
aggccctggctgctgatatgggtgtggtgttatgatgtttgatgaagaaggttttttttttgtttatgtttagttattattattatgttattggggaaggttttggttagtttatttgttgaccttttgggacagcggtg

SEQ ID NO: 376376 - DNA, 140 bp, Artificial Sequence
  Synthetic
caccgctgtcccaaaaggtcaacaaataaactaaccaaaaccttccccaataacataataataataactaaacataaacaaaaaaaaaaccttcttcatcaaacatcataacaccacacccatatcagcagccagggcct

SEQ ID NO: 376377 - DNA, 140 bp, Artificial Sequence
  Synthetic
atacgccatgctgggtctcctttaaatgtttgtttaatatttaattttttttttttgagagaaaaggaaaaatttttattttgtggtaataaataatgtaatttttgtgtataatttaggcgtacttgggagtcggccat

SEQ ID NO: 376378 - DNA, 140 bp, Artificial Sequence
  Synthetic
atggccgactcccaagtacgcctaaattatacacaaaaattacattatttattaccacaaaataaaaatttttccttttctctcaaaaaaaaaaaattaaatattaaacaaacatttaaaggagacccagcatggcgtat

SEQ ID NO: 376379 - DNA, 140 bp, Artificial Sequence
  Synthetic
aggccctggctgctgatatgaatttttattttgtggtaataaataatgtaatttttgtgtataatttaggatatttttgattgaaaaatttttttgttttagaaattgttttggtattttgaccttttgggacagcggtg

SEQ ID NO: 376380 - DNA, 140 bp, Artificial Sequence
  Synthetic
caccgctgtcccaaaaggtcaaaataccaaaacaatttctaaaacaaaaaaatttttcaatcaaaaatatcctaaattatacacaaaaattacattatttattaccacaaaataaaaattcatatcagcagccagggcct

SEQ ID NO: 376381 - DNA, 140 bp, Artificial Sequence
  Synthetic
atacgccatgctgggtctccagattgtattttaatatgtttgtttaatagttgtggttttatttttgatgaaaatatttaagttattaattatttttgtagagaataatggagggtgattcgtacttgggagtcggccat

SEQ ID NO: 376382 - DNA, 140 bp, Artificial Sequence
  Synthetic
atggccgactcccaagtacgaatcaccctccattattctctacaaaaataattaataacttaaatattttcatcaaaaataaaaccacaactattaaacaaacatattaaaatacaatctggagacccagcatggcgtat

SEQ ID NO: 376383 - DNA, 140 bp, Artificial Sequence
  Synthetic
aggccctggctgctgatatgaaaatatttaagttattaattatttttgtagagaataatggagggtgattaagatgatagaatttttatagaagatttttaattatgggtagtgaaggaagaccttttgggacagcggtg

SEQ ID NO: 376384 - DNA, 140 bp, Artificial Sequence
  Synthetic
caccgctgtcccaaaaggtcttccttcactacccataattaaaaatcttctataaaaattctatcatcttaatcaccctccattattctctacaaaaataattaataacttaaatattttcatatcagcagccagggcct

SEQ ID NO: 376385 - DNA, 140 bp, Artificial Sequence
  Synthetic
atacgccatgctgggtctccgagattatattgtattaagttttttggttgttgaaatagtgtttggtaatattgtatttgaatatataatatgttttaaagatgatattaggtttgagagcgtacttgggagtcggccat

SEQ ID NO: 376386 - DNA, 140 bp, Artificial Sequence
  Synthetic
atggccgactcccaagtacgctctcaaacctaatatcatctttaaaacatattatatattcaaatacaatattaccaaacactatttcaacaaccaaaaaacttaatacaatataatctcggagacccagcatggcgtat

SEQ ID NO: 376387 - DNA, 140 bp, Artificial Sequence
  Synthetic
aggccctggctgctgatatgattgtatttgaatatataatatgttttaaagatgatattaggtttgagagttttaaggatggttgtatgttgttttattttttgtatagtttttttattagaccttttgggacagcggtg

SEQ ID NO: 376388 - DNA, 140 bp, Artificial Sequence
  Synthetic
caccgctgtcccaaaaggtctaataaaaaaactatacaaaaaataaaacaacatacaaccatccttaaaactctcaaacctaatatcatctttaaaacatattatatattcaaatacaatcatatcagcagccagggcct

SEQ ID NO: 376389 - DNA, 140 bp, Artificial Sequence
  Synthetic
atacgccatgctgggtctccttgttgaggagataattgtaattgtaataatattttgtgaaaatttttaatttttttttgttgatagttttttaatttgtggttagaaattaatttttgacgtacttgggagtcggccat

SEQ ID NO: 376390 - DNA, 140 bp, Artificial Sequence
  Synthetic
atggccgactcccaagtacgtcaaaaattaatttctaaccacaaattaaaaaactatcaacaaaaaaaaattaaaaattttcacaaaatattattacaattacaattatctcctcaacaaggagacccagcatggcgtat

SEQ ID NO: 376391 - DNA, 140 bp, Artificial Sequence
  Synthetic
aggccctggctgctgatatgtttttttttgttgatagttttttaatttgtggttagaaattaatttttgaagattatttattattgataaatgtatttgtgtgaggaaatgattttttttgaccttttgggacagcggtg

SEQ ID NO: 376392 - DNA, 140 bp, Artificial Sequence
  Synthetic
caccgctgtcccaaaaggtcaaaaaaaatcatttcctcacacaaatacatttatcaataataaataatcttcaaaaattaatttctaaccacaaattaaaaaactatcaacaaaaaaaaacatatcagcagccagggcct

SEQ ID NO: 376393 - DNA, 140 bp, Artificial Sequence
  Synthetic
atacgccatgctgggtctccggtattttattattttataattttttgagttaagaatagatattatatagtttttagtattgtatattttaagaatattatttgggttaggataattagacgtacttgggagtcggccat

SEQ ID NO: 376394 - DNA, 140 bp, Artificial Sequence
  Synthetic
atggccgactcccaagtacgtctaattatcctaacccaaataatattcttaaaatatacaatactaaaaactatataatatctattcttaactcaaaaaattataaaataataaaataccggagacccagcatggcgtat

SEQ ID NO: 376395 - DNA, 140 bp, Artificial Sequence
  Synthetic
aggccctggctgctgatatgtttttagtattgtatattttaagaatattatttgggttaggataattagatatatttatattttttaattttgtaatggatgtaattagtgatgtattaagaccttttgggacagcggtg

SEQ ID NO: 376396 - DNA, 140 bp, Artificial Sequence
  Synthetic
caccgctgtcccaaaaggtcttaatacatcactaattacatccattacaaaattaaaaaatataaatatatctaattatcctaacccaaataatattcttaaaatatacaatactaaaaacatatcagcagccagggcct

SEQ ID NO: 376397 - DNA, 140 bp, Artificial Sequence
  Synthetic
atacgccatgctgggtctccatagataggatttggttatgttttaggatggattttttaaaaagagttggttgatattagttagttgttgtgtgtgggattttgtttatagtaattggtacgtacttgggagtcggccat

SEQ ID NO: 376398 - DNA, 140 bp, Artificial Sequence
  Synthetic
atggccgactcccaagtacgtaccaattactataaacaaaatcccacacacaacaactaactaatatcaaccaactctttttaaaaaatccatcctaaaacataaccaaatcctatctatggagacccagcatggcgtat

SEQ ID NO: 376399 - DNA, 140 bp, Artificial Sequence
  Synthetic
aggccctggctgctgatatgttgatattagttagttgttgtgtgtgggattttgtttatagtaattggtaataatgataaaggtattttttaaaaaatataattgttatattttaaaatagaccttttgggacagcggtg

SEQ ID NO: 376400 - DNA, 140 bp, Artificial Sequence
  Synthetic
caccgctgtcccaaaaggtctattttaaaatataacaattatattttttaaaaaatacctttatcattattaccaattactataaacaaaatcccacacacaacaactaactaatatcaacatatcagcagccagggcct

SEQ ID NO: 376401 - DNA, 140 bp, Artificial Sequence
  Synthetic
atacgccatgctgggtctcctagatgtttatgttgagttaaaatagaaaggttatgttagaagaataattgatggatataattattgtttagaattttgtttttaagtttttttttagttcgtacttgggagtcggccat

SEQ ID NO: 376402 - DNA, 140 bp, Artificial Sequence
  Synthetic
atggccgactcccaagtacgaactaaaaaaaaacttaaaaacaaaattctaaacaataattatatccatcaattattcttctaacataacctttctattttaactcaacataaacatctaggagacccagcatggcgtat

SEQ ID NO: 376403 - DNA, 140 bp, Artificial Sequence
  Synthetic
aggccctggctgctgatatggatggatataattattgtttagaattttgtttttaagtttttttttagttgtaatgtttgttaaatggttttgtgtatttgttgttttgagatagtaattgaccttttgggacagcggtg

SEQ ID NO: 376404 - DNA, 140 bp, Artificial Sequence
  Synthetic
caccgctgtcccaaaaggtcaattactatctcaaaacaacaaatacacaaaaccatttaacaaacattacaactaaaaaaaaacttaaaaacaaaattctaaacaataattatatccatccatatcagcagccagggcct

SEQ ID NO: 376405 - DNA, 140 bp, Artificial Sequence
  Synthetic
atacgccatgctgggtctccgattgtaagttggggttaatggtttattattgtgttttgttagggaatgtaggagaattggtattaaatagtttattggtagtgttgttataggtgtattcgtacttgggagtcggccat

SEQ ID NO: 376406 - DNA, 140 bp, Artificial Sequence
  Synthetic
atggccgactcccaagtacgaatacacctataacaacactaccaataaactatttaataccaattctcctacattccctaacaaaacacaataataaaccattaaccccaacttacaatcggagacccagcatggcgtat

SEQ ID NO: 376407 - DNA, 140 bp, Artificial Sequence
  Synthetic
aggccctggctgctgatatgaggagaattggtattaaatagtttattggtagtgttgttataggtgtattatttaggaatttggatattattgtgttgaatttaagttgatatatatgttgaccttttgggacagcggtg

SEQ ID NO: 376408 - DNA, 140 bp, Artificial Sequence
  Synthetic
caccgctgtcccaaaaggtcaacatatatatcaacttaaattcaacacaataatatccaaattcctaaataatacacctataacaacactaccaataaactatttaataccaattctcctcatatcagcagccagggcct

SEQ ID NO: 376409 - DNA, 140 bp, Artificial Sequence
  Synthetic
atacgccatgctgggtctccaatttatatgtttgagttattaaattatattgatttaggattataggtgaggataaatgtgtatttgggtattgggtatgttgggtagttatatggtatgcgtacttgggagtcggccat

SEQ ID NO: 376410 - DNA, 140 bp, Artificial Sequence
  Synthetic
atggccgactcccaagtacgcataccatataactacccaacatacccaatacccaaatacacatttatcctcacctataatcctaaatcaatataatttaataactcaaacatataaattggagacccagcatggcgtat

SEQ ID NO: 376411 - DNA, 140 bp, Artificial Sequence
  Synthetic
aggccctggctgctgatatgggataaatgtgtatttgggtattgggtatgttgggtagttatatggtatgaggaagttaggtagaaaaaaattataggatatttgatggtaattaagtgagaccttttgggacagcggtg

SEQ ID NO: 376412 - DNA, 140 bp, Artificial Sequence
  Synthetic
caccgctgtcccaaaaggtctcacttaattaccatcaaatatcctataatttttttctacctaacttcctcataccatataactacccaacatacccaatacccaaatacacatttatcccatatcagcagccagggcct

SEQ ID NO: 376413 - DNA, 140 bp, Artificial Sequence
  Synthetic
atacgccatgctgggtctcctattgatatgttattaaaataaagttatattaatataagtaaagataggaaaagattggttatatatatatgtaaaaatggaagttgtttaatagttaggcgtacttgggagtcggccat

SEQ ID NO: 376414 - DNA, 140 bp, Artificial Sequence
  Synthetic
atggccgactcccaagtacgcctaactattaaacaacttccatttttacatatatatataaccaatcttttcctatctttacttatattaatataactttattttaataacatatcaataggagacccagcatggcgtat

SEQ ID NO: 376415 - DNA, 140 bp, Artificial Sequence
  Synthetic
aggccctggctgctgatatgaaagattggttatatatatatgtaaaaatggaagttgtttaatagttaggtattgttttattttgatgtttatttatttttaatttttgattgttaatttgaccttttgggacagcggtg

SEQ ID NO: 376416 - DNA, 140 bp, Artificial Sequence
  Synthetic
caccgctgtcccaaaaggtcaaattaacaatcaaaaattaaaaataaataaacatcaaaataaaacaatacctaactattaaacaacttccatttttacatatatatataaccaatctttcatatcagcagccagggcct

SEQ ID NO: 376417 - DNA, 140 bp, Artificial Sequence
  Synthetic
atacgccatgctgggtctccaagtataaggtaaaatttaagtttaaatttgtataatttatatattttaaatttttaatgtgatataaatttattagtagtgtttaatgtaattagtgaacgtacttgggagtcggccat

SEQ ID NO: 376418 - DNA, 140 bp, Artificial Sequence
  Synthetic
atggccgactcccaagtacgttcactaattacattaaacactactaataaatttatatcacattaaaaatttaaaatatataaattatacaaatttaaacttaaattttaccttatacttggagacccagcatggcgtat

SEQ ID NO: 376419 - DNA, 140 bp, Artificial Sequence
  Synthetic
aggccctggctgctgatatgatttttaatgtgatataaatttattagtagtgtttaatgtaattagtgaaaatagattagatagttaatttaataatgttagataagatttataattaatgaccttttgggacagcggtg

SEQ ID NO: 376420 - DNA, 140 bp, Artificial Sequence
  Synthetic
caccgctgtcccaaaaggtcattaattataaatcttatctaacattattaaattaactatctaatctattttcactaattacattaaacactactaataaatttatatcacattaaaaatcatatcagcagccagggcct

SEQ ID NO: 376421 - DNA, 140 bp, Artificial Sequence
  Synthetic
atacgccatgctgggtctcctgttgaattttattattaatgattgtattttagattgtggaatatgagtgaaaggtttgaaggtagatttatgaagtaatgagaatttgattggttttggcgtacttgggagtcggccat

SEQ ID NO: 376422 - DNA, 140 bp, Artificial Sequence
  Synthetic
atggccgactcccaagtacgccaaaaccaatcaaattctcattacttcataaatctaccttcaaacctttcactcatattccacaatctaaaatacaatcattaataataaaattcaacaggagacccagcatggcgtat

SEQ ID NO: 376423 - DNA, 140 bp, Artificial Sequence
  Synthetic
aggccctggctgctgatatgaaaggtttgaaggtagatttatgaagtaatgagaatttgattggttttgggtgtttagaatttatagttgatttgttaggtttttgaatttttatgagaagaccttttgggacagcggtg

SEQ ID NO: 376424 - DNA, 140 bp, Artificial Sequence
  Synthetic
caccgctgtcccaaaaggtcttctcataaaaattcaaaaacctaacaaatcaactataaattctaaacacccaaaaccaatcaaattctcattacttcataaatctaccttcaaacctttcatatcagcagccagggcct

SEQ ID NO: 376425 - DNA, 140 bp, Artificial Sequence
  Synthetic
atacgccatgctgggtctccttaatattattgagtaaattattgtaattgataatatgtagggtgttaagtttgttgatgaattgtaagatgtttgatttgattaaagataatatatgaacgtacttgggagtcggccat

SEQ ID NO: 376426 - DNA, 140 bp, Artificial Sequence
  Synthetic
atggccgactcccaagtacgttcatatattatctttaatcaaatcaaacatcttacaattcatcaacaaacttaacaccctacatattatcaattacaataatttactcaataatattaaggagacccagcatggcgtat

SEQ ID NO: 376427 - DNA, 140 bp, Artificial Sequence
  Synthetic
aggccctggctgctgatatgtttgttgatgaattgtaagatgtttgatttgattaaagataatatatgaagattaagttggttttttatgtttttagtatgaagattgaaatgtgttgatgaccttttgggacagcggtg

SEQ ID NO: 376428 - DNA, 140 bp, Artificial Sequence
  Synthetic
caccgctgtcccaaaaggtcatcaacacatttcaatcttcatactaaaaacataaaaaaccaacttaatcttcatatattatctttaatcaaatcaaacatcttacaattcatcaacaaacatatcagcagccagggcct

SEQ ID NO: 376429 - DNA, 140 bp, Artificial Sequence
  Synthetic
atacgccatgctgggtctcctttaattaatgaatggtttaataattgattttgtaatttggttgttaaaattatttttaaagtttagatgggagattgaataattgaatttgggttttggcgtacttgggagtcggccat

SEQ ID NO: 376430 - DNA, 140 bp, Artificial Sequence
  Synthetic
atggccgactcccaagtacgccaaaacccaaattcaattattcaatctcccatctaaactttaaaaataattttaacaaccaaattacaaaatcaattattaaaccattcattaattaaaggagacccagcatggcgtat

SEQ ID NO: 376431 - DNA, 140 bp, Artificial Sequence
  Synthetic
aggccctggctgctgatatgttatttttaaagtttagatgggagattgaataattgaatttgggttttggaatagatgtgggaaaagattttttgttattgtttaggtaggagtaaagttgaccttttgggacagcggtg

SEQ ID NO: 376432 - DNA, 140 bp, Artificial Sequence
  Synthetic
caccgctgtcccaaaaggtcaactttactcctacctaaacaataacaaaaaatcttttcccacatctattccaaaacccaaattcaattattcaatctcccatctaaactttaaaaataacatatcagcagccagggcct

SEQ ID NO: 376433 - DNA, 140 bp, Artificial Sequence
  Synthetic
atacgccatgctgggtctccatttaatttttgtttaataaattttttaattttgtagggtttgagtaattaagaaattataaagattattaaaaattatttttttttttatattttttttcgtacttgggagtcggccat

SEQ ID NO: 376434 - DNA, 140 bp, Artificial Sequence
  Synthetic
atggccgactcccaagtacgaaaaaaaatataaaaaaaaaaataatttttaataatctttataatttcttaattactcaaaccctacaaaattaaaaaatttattaaacaaaaattaaatggagacccagcatggcgtat

SEQ ID NO: 376435 - DNA, 140 bp, Artificial Sequence
  Synthetic
aggccctggctgctgatatgaagaaattataaagattattaaaaattatttttttttttatatttttttttgggggtatgagattgtattggtttgtggttttagttattttgtgttttggaccttttgggacagcggtg

SEQ ID NO: 376436 - DNA, 140 bp, Artificial Sequence
  Synthetic
caccgctgtcccaaaaggtccaaaacacaaaataactaaaaccacaaaccaatacaatctcatacccccaaaaaaaaatataaaaaaaaaaataatttttaataatctttataatttcttcatatcagcagccagggcct

SEQ ID NO: 376437 - DNA, 140 bp, Artificial Sequence
  Synthetic
atacgccatgctgggtctccttagttgaaattgatttgtttatagttttggttgagttgattatgttggtgttaatgattttatgttaatttgttgggattttttgggatttttttttgtcgtacttgggagtcggccat

SEQ ID NO: 376438 - DNA, 140 bp, Artificial Sequence
  Synthetic
atggccgactcccaagtacgacaaaaaaaaatcccaaaaaatcccaacaaattaacataaaatcattaacaccaacataatcaactcaaccaaaactataaacaaatcaatttcaactaaggagacccagcatggcgtat

SEQ ID NO: 376439 - DNA, 140 bp, Artificial Sequence
  Synthetic
aggccctggctgctgatatggttaatgattttatgttaatttgttgggattttttgggatttttttttgtttttttaagagtttttaaggatagattattgagaatagtttggtgattgtgaccttttgggacagcggtg

SEQ ID NO: 376440 - DNA, 140 bp, Artificial Sequence
  Synthetic
caccgctgtcccaaaaggtcacaatcaccaaactattctcaataatctatccttaaaaactcttaaaaaaacaaaaaaaaatcccaaaaaatcccaacaaattaacataaaatcattaaccatatcagcagccagggcct

SEQ ID NO: 376441 - DNA, 140 bp, Artificial Sequence
  Synthetic
atacgccatgctgggtctccatgtatttgtatgttagttttaaaaaagtgtttatttaagtattagatattttaattttatagtaagtaattagtaaaatttaatattaaaatataattacgtacttgggagtcggccat

SEQ ID NO: 376442 - DNA, 140 bp, Artificial Sequence
  Synthetic
atggccgactcccaagtacgtaattatattttaatattaaattttactaattacttactataaaattaaaatatctaatacttaaataaacacttttttaaaactaacatacaaatacatggagacccagcatggcgtat

SEQ ID NO: 376443 - DNA, 140 bp, Artificial Sequence
  Synthetic
aggccctggctgctgatatgtttaattttatagtaagtaattagtaaaatttaatattaaaatataattattttagaagttaatgatttttataaaagaatttatgaattgatgaagattgaccttttgggacagcggtg

SEQ ID NO: 376444 - DNA, 140 bp, Artificial Sequence
  Synthetic
caccgctgtcccaaaaggtcaatcttcatcaattcataaattcttttataaaaatcattaacttctaaaataattatattttaatattaaattttactaattacttactataaaattaaacatatcagcagccagggcct

SEQ ID NO: 376445 - DNA, 140 bp, Artificial Sequence
  Synthetic
atacgccatgctgggtctccaatttttattttgtattattggttttaggtatttgaagtagtaaataataaagttatattttggaagtagtaaattttttttagttttatttataaatttcgtacttgggagtcggccat

SEQ ID NO: 376446 - DNA, 140 bp, Artificial Sequence
  Synthetic
atggccgactcccaagtacgaaatttataaataaaactaaaaaaaatttactacttccaaaatataactttattatttactacttcaaatacctaaaaccaataatacaaaataaaaattggagacccagcatggcgtat

SEQ ID NO: 376447 - DNA, 140 bp, Artificial Sequence
  Synthetic
aggccctggctgctgatatgaagttatattttggaagtagtaaattttttttagttttatttataaatttggatatttaaggattattagtaaattgtttataattatgatttttttttagaccttttgggacagcggtg

SEQ ID NO: 376448 - DNA, 140 bp, Artificial Sequence
  Synthetic
caccgctgtcccaaaaggtctaaaaaaaaatcataattataaacaatttactaataatccttaaatatccaaatttataaataaaactaaaaaaaatttactacttccaaaatataacttcatatcagcagccagggcct

SEQ ID NO: 376449 - DNA, 140 bp, Artificial Sequence
  Synthetic
atacgccatgctgggtctcctttgattaaaatatgaggttaggagaatttaattttgttattgataatttgttagatatatgattttgagtatattttagataaaatattttagatattacgtacttgggagtcggccat

SEQ ID NO: 376450 - DNA, 140 bp, Artificial Sequence
  Synthetic
atggccgactcccaagtacgtaatatctaaaatattttatctaaaatatactcaaaatcatatatctaacaaattatcaataacaaaattaaattctcctaacctcatattttaatcaaaggagacccagcatggcgtat

SEQ ID NO: 376451 - DNA, 140 bp, Artificial Sequence
  Synthetic
aggccctggctgctgatatggttagatatatgattttgagtatattttagataaaatattttagatattaatttattttattatatttaagttatgtattgttaaatagggtagatttatgaccttttgggacagcggtg

SEQ ID NO: 376452 - DNA, 140 bp, Artificial Sequence
  Synthetic
caccgctgtcccaaaaggtcataaatctaccctatttaacaatacataacttaaatataataaaataaattaatatctaaaatattttatctaaaatatactcaaaatcatatatctaaccatatcagcagccagggcct

SEQ ID NO: 376453 - DNA, 140 bp, Artificial Sequence
  Synthetic
atacgccatgctgggtctcctttttgataattgtatattgaagttgtattatatttatattaatttattgattgagagtaattgtggaaaaatagttttagtggttttttatttaattgtcgtacttgggagtcggccat

SEQ ID NO: 376454 - DNA, 140 bp, Artificial Sequence
  Synthetic
atggccgactcccaagtacgacaattaaataaaaaaccactaaaactatttttccacaattactctcaatcaataaattaatataaatataatacaacttcaatatacaattatcaaaaaggagacccagcatggcgtat

SEQ ID NO: 376455 - DNA, 140 bp, Artificial Sequence
  Synthetic
aggccctggctgctgatatgattgagagtaattgtggaaaaatagttttagtggttttttatttaattgtatttgattaggtggtattattagttgttttggatggtgtagaattgttttgaccttttgggacagcggtg

SEQ ID NO: 376456 - DNA, 140 bp, Artificial Sequence
  Synthetic
caccgctgtcccaaaaggtcaaaacaattctacaccatccaaaacaactaataataccacctaatcaaatacaattaaataaaaaaccactaaaactatttttccacaattactctcaatcatatcagcagccagggcct

SEQ ID NO: 376457 - DNA, 140 bp, Artificial Sequence
  Synthetic
atacgccatgctgggtctcctaaggtatttggagagtaatgttgagaaaagtagagatgaatattattaatgattgttggttttattgttgttatagggtagttttaaaattttttttttcgtacttgggagtcggccat

SEQ ID NO: 376458 - DNA, 140 bp, Artificial Sequence
  Synthetic
atggccgactcccaagtacgaaaaaaaaaattttaaaactaccctataacaacaataaaaccaacaatcattaataatattcatctctacttttctcaacattactctccaaataccttaggagacccagcatggcgtat

SEQ ID NO: 376459 - DNA, 140 bp, Artificial Sequence
  Synthetic
aggccctggctgctgatatgtgattgttggttttattgttgttatagggtagttttaaaatttttttttttattattgtggagtttttggtagatttttaatatagaattagtttggtttgaccttttgggacagcggtg

SEQ ID NO: 376460 - DNA, 140 bp, Artificial Sequence
  Synthetic
caccgctgtcccaaaaggtcaaaccaaactaattctatattaaaaatctaccaaaaactccacaataataaaaaaaaaaattttaaaactaccctataacaacaataaaaccaacaatcacatatcagcagccagggcct

SEQ ID NO: 376461 - DNA, 140 bp, Artificial Sequence
  Synthetic
atacgccatgctgggtctccggatttagaaaatttttttgttaatatggtataaagggttaaaagagttttaagtttagagtttttaatttgttttaggtttttggttgtttaatgtttacgtacttgggagtcggccat

SEQ ID NO: 376462 - DNA, 140 bp, Artificial Sequence
  Synthetic
atggccgactcccaagtacgtaaacattaaacaaccaaaaacctaaaacaaattaaaaactctaaacttaaaactcttttaaccctttataccatattaacaaaaaaattttctaaatccggagacccagcatggcgtat

SEQ ID NO: 376463 - DNA, 140 bp, Artificial Sequence
  Synthetic
aggccctggctgctgatatgtaagtttagagtttttaatttgttttaggtttttggttgtttaatgtttagtaatttgaagaaggattgtaagtgttaatttaggattattattttgtgagaccttttgggacagcggtg

SEQ ID NO: 376464 - DNA, 140 bp, Artificial Sequence
  Synthetic
caccgctgtcccaaaaggtctcacaaaataataatcctaaattaacacttacaatccttcttcaaattactaaacattaaacaaccaaaaacctaaaacaaattaaaaactctaaacttacatatcagcagccagggcct

SEQ ID NO: 376465 - DNA, 140 bp, Artificial Sequence
  Synthetic
atacgccatgctgggtctcctttgtgaattgtttttgataattttatatgttttttttgtaattagtagtagtaatttatgattatttaagttatttaattggtgattttttttgtaaaacgtacttgggagtcggccat

SEQ ID NO: 376466 - DNA, 140 bp, Artificial Sequence
  Synthetic
atggccgactcccaagtacgttttacaaaaaaaatcaccaattaaataacttaaataatcataaattactactactaattacaaaaaaaacatataaaattatcaaaaacaattcacaaaggagacccagcatggcgtat

SEQ ID NO: 376467 - DNA, 140 bp, Artificial Sequence
  Synthetic
aggccctggctgctgatatgagtaatttatgattatttaagttatttaattggtgattttttttgtaaaatttgttattgtagaggaatttttttttgagtgttgggtatatatttttaggaccttttgggacagcggtg

SEQ ID NO: 376468 - DNA, 140 bp, Artificial Sequence
  Synthetic
caccgctgtcccaaaaggtcctaaaaatatatacccaacactcaaaaaaaaattcctctacaataacaaattttacaaaaaaaatcaccaattaaataacttaaataatcataaattactcatatcagcagccagggcct

SEQ ID NO: 376469 - DNA, 140 bp, Artificial Sequence
  Synthetic
atacgccatgctgggtctccggaatatgaatttgggatgtattttgaggttgtttatgattaatttgattagggttttgagataatgagtgagattttgatggatttttgtatggtttttcgtacttgggagtcggccat

SEQ ID NO: 376470 - DNA, 140 bp, Artificial Sequence
  Synthetic
atggccgactcccaagtacgaaaaaccatacaaaaatccatcaaaatctcactcattatctcaaaaccctaatcaaattaatcataaacaacctcaaaatacatcccaaattcatattccggagacccagcatggcgtat

SEQ ID NO: 376471 - DNA, 140 bp, Artificial Sequence
  Synthetic
aggccctggctgctgatatgagggttttgagataatgagtgagattttgatggatttttgtatggtttttggttattatgttgtatgttgttagatttattttgtttttttgaatgttttgaccttttgggacagcggtg

SEQ ID NO: 376472 - DNA, 140 bp, Artificial Sequence
  Synthetic
caccgctgtcccaaaaggtcaaaacattcaaaaaaacaaaataaatctaacaacatacaacataataaccaaaaaccatacaaaaatccatcaaaatctcactcattatctcaaaaccctcatatcagcagccagggcct

SEQ ID NO: 376473 - DNA, 140 bp, Artificial Sequence
  Synthetic
atacgccatgctgggtctccaatagtaatgttaggttttttttttatggttattgttgttttttgatttttatttataaatgttggttttttttatttataatttttggagttgtttttacgtacttgggagtcggccat

SEQ ID NO: 376474 - DNA, 140 bp, Artificial Sequence
  Synthetic
atggccgactcccaagtacgtaaaaacaactccaaaaattataaataaaaaaaaccaacatttataaataaaaatcaaaaaacaacaataaccataaaaaaaaaacctaacattactattggagacccagcatggcgtat

SEQ ID NO: 376475 - DNA, 140 bp, Artificial Sequence
  Synthetic
aggccctggctgctgatatgtatttataaatgttggttttttttatttataatttttggagttgtttttagttgtaagtattattaatgtggttttgatgaatgagatgggaggttttttgaccttttgggacagcggtg

SEQ ID NO: 376476 - DNA, 140 bp, Artificial Sequence
  Synthetic
caccgctgtcccaaaaggtcaaaaaacctcccatctcattcatcaaaaccacattaataatacttacaactaaaaacaactccaaaaattataaataaaaaaaaccaacatttataaatacatatcagcagccagggcct

SEQ ID NO: 376477 - DNA, 140 bp, Artificial Sequence
  Synthetic
atacgccatgctgggtctcctaattattattaagagaaatattatattgtaaattaagtaaagaagtagaaaaatatattattaattgtttatttaagataagtggttagtatttaagtacgtacttgggagtcggccat

SEQ ID NO: 376478 - DNA, 140 bp, Artificial Sequence
  Synthetic
atggccgactcccaagtacgtacttaaatactaaccacttatcttaaataaacaattaataatatatttttctacttctttacttaatttacaatataatatttctcttaataataattaggagacccagcatggcgtat

SEQ ID NO: 376479 - DNA, 140 bp, Artificial Sequence
  Synthetic
aggccctggctgctgatatgaaaatatattattaattgtttatttaagataagtggttagtatttaagtaaattttaaaaataatatttttttttagagtaattttgagattttttttttgaccttttgggacagcggtg

SEQ ID NO: 376480 - DNA, 140 bp, Artificial Sequence
  Synthetic
caccgctgtcccaaaaggtcaaaaaaaaaatctcaaaattactctaaaaaaaaatattatttttaaaatttacttaaatactaaccacttatcttaaataaacaattaataatatattttcatatcagcagccagggcct

SEQ ID NO: 376481 - DNA, 140 bp, Artificial Sequence
  Synthetic
atacgccatgctgggtctcctattatagtaattataattttaataattttaattttagttgggatttattgtttttaatttgtttatagattaagattatttttgtggtttggtaggggacgtacttgggagtcggccat

SEQ ID NO: 376482 - DNA, 140 bp, Artificial Sequence
  Synthetic
atggccgactcccaagtacgtcccctaccaaaccacaaaaataatcttaatctataaacaaattaaaaacaataaatcccaactaaaattaaaattattaaaattataattactataataggagacccagcatggcgtat

SEQ ID NO: 376483 - DNA, 140 bp, Artificial Sequence
  Synthetic
aggccctggctgctgatatggtttttaatttgtttatagattaagattatttttgtggtttggtaggggattgttaataaagttatgtttaatttggttaattttattagtaatatttttgaccttttgggacagcggtg

SEQ ID NO: 376484 - DNA, 140 bp, Artificial Sequence
  Synthetic
caccgctgtcccaaaaggtcaaaaatattactaataaaattaaccaaattaaacataactttattaacaatcccctaccaaaccacaaaaataatcttaatctataaacaaattaaaaaccatatcagcagccagggcct

SEQ ID NO: 376485 - DNA, 140 bp, Artificial Sequence
  Synthetic
atacgccatgctgggtctcctatttttttattgttgaagaagaaaattaatagtttttttgttaagaagtgagtaagtttttagttttgttgtggtttgtagaaataattgaagagtttgcgtacttgggagtcggccat

SEQ ID NO: 376486 - DNA, 140 bp, Artificial Sequence
  Synthetic
atggccgactcccaagtacgcaaactcttcaattatttctacaaaccacaacaaaactaaaaacttactcacttcttaacaaaaaaactattaattttcttcttcaacaataaaaaaataggagacccagcatggcgtat

SEQ ID NO: 376487 - DNA, 140 bp, Artificial Sequence
  Synthetic
aggccctggctgctgatatggagtaagtttttagttttgttgtggtttgtagaaataattgaagagtttgggtagttttattggttagttgatgtagtttgtaaataagtttattttgatgaccttttgggacagcggtg

SEQ ID NO: 376488 - DNA, 140 bp, Artificial Sequence
  Synthetic
caccgctgtcccaaaaggtcatcaaaataaacttatttacaaactacatcaactaaccaataaaactacccaaactcttcaattatttctacaaaccacaacaaaactaaaaacttactccatatcagcagccagggcct

SEQ ID NO: 376489 - DNA, 140 bp, Artificial Sequence
  Synthetic
atacgccatgctgggtctccggaatttatgttaattttattgttgtttttttattaatagttgtttaatagtaaagatttgggttatatttattagtggtgttttgttgaattgattgttcgtacttgggagtcggccat

SEQ ID NO: 376490 - DNA, 140 bp, Artificial Sequence
  Synthetic
atggccgactcccaagtacgaacaatcaattcaacaaaacaccactaataaatataacccaaatctttactattaaacaactattaataaaaaaacaacaataaaattaacataaattccggagacccagcatggcgtat

SEQ ID NO: 376491 - DNA, 140 bp, Artificial Sequence
  Synthetic
aggccctggctgctgatatggtaaagatttgggttatatttattagtggtgttttgttgaattgattgtttttgttttttggtgggatttagtgaattagttattttatttattgtatttgaccttttgggacagcggtg

SEQ ID NO: 376492 - DNA, 140 bp, Artificial Sequence
  Synthetic
caccgctgtcccaaaaggtcaaatacaataaataaaataactaattcactaaatcccaccaaaaaacaaaaacaatcaattcaacaaaacaccactaataaatataacccaaatctttaccatatcagcagccagggcct

SEQ ID NO: 376493 - DNA, 140 bp, Artificial Sequence
  Synthetic
atacgccatgctgggtctcctggtttgttgttgttggttgttttttgtgggttttgggttattggggatgttgtgggtgttggtgtggttttggtttgtgggttttgggtggagttgtttcgtacttgggagtcggccat

SEQ ID NO: 376494 - DNA, 140 bp, Artificial Sequence
  Synthetic
atggccgactcccaagtacgaaacaactccacccaaaacccacaaaccaaaaccacaccaacacccacaacatccccaataacccaaaacccacaaaaaacaaccaacaacaacaaaccaggagacccagcatggcgtat

SEQ ID NO: 376495 - DNA, 140 bp, Artificial Sequence
  Synthetic
aggccctggctgctgatatgttgtgggtgttggtgtggttttggtttgtgggttttgggtggagttgtttgagttttggattggatttattttggagtggtaaattgttttgttgtttgtgaccttttgggacagcggtg

SEQ ID NO: 376496 - DNA, 140 bp, Artificial Sequence
  Synthetic
caccgctgtcccaaaaggtcacaaacaacaaaacaatttaccactccaaaataaatccaatccaaaactcaaacaactccacccaaaacccacaaaccaaaaccacaccaacacccacaacatatcagcagccagggcct

SEQ ID NO: 376497 - DNA, 140 bp, Artificial Sequence
  Synthetic
atacgccatgctgggtctccgtatattgttattaattttgtttgttatggttggatttggggtaatggtggttgttattgggtttgtggtgaaatttgtgattgtttttttgttggttagcgtacttgggagtcggccat

SEQ ID NO: 376498 - DNA, 140 bp, Artificial Sequence
  Synthetic
atggccgactcccaagtacgctaaccaacaaaaaaacaatcacaaatttcaccacaaacccaataacaaccaccattaccccaaatccaaccataacaaacaaaattaataacaatatacggagacccagcatggcgtat

SEQ ID NO: 376499 - DNA, 140 bp, Artificial Sequence
  Synthetic
aggccctggctgctgatatggttgttattgggtttgtggtgaaatttgtgattgtttttttgttggttagattttgggttgatattttttttgtttgttttgtagtgagtattgaaattagaccttttgggacagcggtg

SEQ ID NO: 376500 - DNA, 140 bp, Artificial Sequence
  Synthetic
caccgctgtcccaaaaggtctaatttcaatactcactacaaaacaaacaaaaaaaatatcaacccaaaatctaaccaacaaaaaaacaatcacaaatttcaccacaaacccaataacaaccatatcagcagccagggcct

SEQ ID NO: 376501 - DNA, 140 bp, Artificial Sequence
  Synthetic
atacgccatgctgggtctcctagttaatttttttttggatagtttttgttgggttttgatttgaggagttgttggtgtgggttgatggaatttggaaatgtaagttttttttatgaagttcgtacttgggagtcggccat

SEQ ID NO: 376502 - DNA, 140 bp, Artificial Sequence
  Synthetic
atggccgactcccaagtacgaacttcataaaaaaaacttacatttccaaattccatcaacccacaccaacaactcctcaaatcaaaacccaacaaaaactatccaaaaaaaaattaactaggagacccagcatggcgtat

SEQ ID NO: 376503 - DNA, 140 bp, Artificial Sequence
  Synthetic
aggccctggctgctgatatggttggtgtgggttgatggaatttggaaatgtaagttttttttatgaagttgttgggaaaagtttttttagttttttagaaggtttatttattaatatttggaccttttgggacagcggtg

SEQ ID NO: 376504 - DNA, 140 bp, Artificial Sequence
  Synthetic
caccgctgtcccaaaaggtccaaatattaataaataaaccttctaaaaaactaaaaaaacttttcccaacaacttcataaaaaaaacttacatttccaaattccatcaacccacaccaaccatatcagcagccagggcct

SEQ ID NO: 376505 - DNA, 140 bp, Artificial Sequence
  Synthetic
atacgccatgctgggtctccaggtgattatttttttgaagtgttttattgagttgaataaggaattgtggagtgtgtggatgatttagttgtatatatgtgtggttgtttattttaaaaacgtacttgggagtcggccat

SEQ ID NO: 376506 - DNA, 140 bp, Artificial Sequence
  Synthetic
atggccgactcccaagtacgtttttaaaataaacaaccacacatatatacaactaaatcatccacacactccacaattccttattcaactcaataaaacacttcaaaaaaataatcacctggagacccagcatggcgtat

SEQ ID NO: 376507 - DNA, 140 bp, Artificial Sequence
  Synthetic
aggccctggctgctgatatgagtgtgtggatgatttagttgtatatatgtgtggttgtttattttaaaaagggtgttgtttttattgtttttaaaatttgatattttgtagttgagtgttgaccttttgggacagcggtg

SEQ ID NO: 376508 - DNA, 140 bp, Artificial Sequence
  Synthetic
caccgctgtcccaaaaggtcaacactcaactacaaaatatcaaattttaaaaacaataaaaacaacaccctttttaaaataaacaaccacacatatatacaactaaatcatccacacactcatatcagcagccagggcct

SEQ ID NO: 376509 - DNA, 140 bp, Artificial Sequence
  Synthetic
atacgccatgctgggtctccagttggtgtagttttttaaaaatgttttttgggttttgatagaattaaaaaagttatgatatttttagtaaaagttgttttttggtagatgatagttgagcgtacttgggagtcggccat

SEQ ID NO: 376510 - DNA, 140 bp, Artificial Sequence
  Synthetic
atggccgactcccaagtacgctcaactatcatctaccaaaaaacaacttttactaaaaatatcataacttttttaattctatcaaaacccaaaaaacatttttaaaaaactacaccaactggagacccagcatggcgtat

SEQ ID NO: 376511 - DNA, 140 bp, Artificial Sequence
  Synthetic
aggccctggctgctgatatgaagttatgatatttttagtaaaagttgttttttggtagatgatagttgaggttaatttattatataagaaaaaagttttatttttatggaaagttaagttgaccttttgggacagcggtg

SEQ ID NO: 376512 - DNA, 140 bp, Artificial Sequence
  Synthetic
caccgctgtcccaaaaggtcaacttaactttccataaaaataaaacttttttcttatataataaattaacctcaactatcatctaccaaaaaacaacttttactaaaaatatcataacttcatatcagcagccagggcct

SEQ ID NO: 376513 - DNA, 140 bp, Artificial Sequence
  Synthetic
atacgccatgctgggtctccggaatttttgtatattgttgggagggagagggaggtatttatttttgtttgattttttgatttttagattgtagtaattttttgtttattttttggttttcgtacttgggagtcggccat

SEQ ID NO: 376514 - DNA, 140 bp, Artificial Sequence
  Synthetic
atggccgactcccaagtacgaaaaccaaaaaataaacaaaaaattactacaatctaaaaatcaaaaaatcaaacaaaaataaatacctccctctccctcccaacaatatacaaaaattccggagacccagcatggcgtat

SEQ ID NO: 376515 - DNA, 140 bp, Artificial Sequence
  Synthetic
aggccctggctgctgatatggattttttgatttttagattgtagtaattttttgtttattttttggttttatagttgattattttgggaggtatatttgaatgaaatttttagtgttttggaccttttgggacagcggtg

SEQ ID NO: 376516 - DNA, 140 bp, Artificial Sequence
  Synthetic
caccgctgtcccaaaaggtccaaaacactaaaaatttcattcaaatatacctcccaaaataatcaactataaaaccaaaaaataaacaaaaaattactacaatctaaaaatcaaaaaatccatatcagcagccagggcct

SEQ ID NO: 376517 - DNA, 140 bp, Artificial Sequence
  Synthetic
atacgccatgctgggtctccatagatttgagttgattggttgatgatagtttgttttgataaattaattgattaatttttgttgttttgagagtgttatttgttattatattaagtggtacgtacttgggagtcggccat

SEQ ID NO: 376518 - DNA, 140 bp, Artificial Sequence
  Synthetic
atggccgactcccaagtacgtaccacttaatataataacaaataacactctcaaaacaacaaaaattaatcaattaatttatcaaaacaaactatcatcaaccaatcaactcaaatctatggagacccagcatggcgtat

SEQ ID NO: 376519 - DNA, 140 bp, Artificial Sequence
  Synthetic
aggccctggctgctgatatgattaatttttgttgttttgagagtgttatttgttattatattaagtggtatggagattgtttgttggaagaggatgattatttatattaagaatgaagttgaccttttgggacagcggtg

SEQ ID NO: 376520 - DNA, 140 bp, Artificial Sequence
  Synthetic
caccgctgtcccaaaaggtcaacttcattcttaatataaataatcatcctcttccaacaaacaatctccataccacttaatataataacaaataacactctcaaaacaacaaaaattaatcatatcagcagccagggcct

SEQ ID NO: 376521 - DNA, 140 bp, Artificial Sequence
  Synthetic
atacgccatgctgggtctccgttgtataggtaatttggggaggtaagaaatagtagtttataatttttgatttgaatgtgtttttgtatgattttggaatagataatgttagatttttaacgtacttgggagtcggccat

SEQ ID NO: 376522 - DNA, 140 bp, Artificial Sequence
  Synthetic
atggccgactcccaagtacgttaaaaatctaacattatctattccaaaatcatacaaaaacacattcaaatcaaaaattataaactactatttcttacctccccaaattacctatacaacggagacccagcatggcgtat

SEQ ID NO: 376523 - DNA, 140 bp, Artificial Sequence
  Synthetic
aggccctggctgctgatatgtttgaatgtgtttttgtatgattttggaatagataatgttagatttttaaaagagatgaagttttggtttgttgttgttttaatttttattgtatattttgaccttttgggacagcggtg

SEQ ID NO: 376524 - DNA, 140 bp, Artificial Sequence
  Synthetic
caccgctgtcccaaaaggtcaaaatatacaataaaaattaaaacaacaacaaaccaaaacttcatctcttttaaaaatctaacattatctattccaaaatcatacaaaaacacattcaaacatatcagcagccagggcct

SEQ ID NO: 376525 - DNA, 140 bp, Artificial Sequence
  Synthetic
atacgccatgctgggtctccaattttagttattgttatatttttgattagaatagattatagagtatttagaatattgtttggtttagttttgattgggttgaattttttttttggttatcgtacttgggagtcggccat

SEQ ID NO: 376526 - DNA, 140 bp, Artificial Sequence
  Synthetic
atggccgactcccaagtacgataaccaaaaaaaaaattcaacccaatcaaaactaaaccaaacaatattctaaatactctataatctattctaatcaaaaatataacaataactaaaattggagacccagcatggcgtat

SEQ ID NO: 376527 - DNA, 140 bp, Artificial Sequence
  Synthetic
aggccctggctgctgatatggaatattgtttggtttagttttgattgggttgaattttttttttggttattgtagatagtagaagttttgttgggtttttaaggaaattttgtattgatagaccttttgggacagcggtg

SEQ ID NO: 376528 - DNA, 140 bp, Artificial Sequence
  Synthetic
caccgctgtcccaaaaggtctatcaatacaaaatttccttaaaaacccaacaaaacttctactatctacaataaccaaaaaaaaaattcaacccaatcaaaactaaaccaaacaatattccatatcagcagccagggcct

SEQ ID NO: 376529 - DNA, 140 bp, Artificial Sequence
  Synthetic
atacgccatgctgggtctcctggaaaattagattaaaaaattttttaatattagttatttaggtgtaagttgtgagtttgttgtttttgtttgatttttttataattttatataattagacgtacttgggagtcggccat

SEQ ID NO: 376530 - DNA, 140 bp, Artificial Sequence
  Synthetic
atggccgactcccaagtacgtctaattatataaaattataaaaaaatcaaacaaaaacaacaaactcacaacttacacctaaataactaatattaaaaaattttttaatctaattttccaggagacccagcatggcgtat

SEQ ID NO: 376531 - DNA, 140 bp, Artificial Sequence
  Synthetic
aggccctggctgctgatatgtgtgagtttgttgtttttgtttgatttttttataattttatataattagatttttagtttattgattttgttggaattattagtagaataatagtttgaagaccttttgggacagcggtg

SEQ ID NO: 376532 - DNA, 140 bp, Artificial Sequence
  Synthetic
caccgctgtcccaaaaggtcttcaaactattattctactaataattccaacaaaatcaataaactaaaaatctaattatataaaattataaaaaaatcaaacaaaaacaacaaactcacacatatcagcagccagggcct

SEQ ID NO: 376533 - DNA, 140 bp, Artificial Sequence
  Synthetic
atacgccatgctgggtctccgttggttggagagtggtatgaattataattttgggtgataattatagttaagttttttggtgatataggattaagtttaatatattttggaagaagaattcgtacttgggagtcggccat

SEQ ID NO: 376534 - DNA, 140 bp, Artificial Sequence
  Synthetic
atggccgactcccaagtacgaattcttcttccaaaatatattaaacttaatcctatatcaccaaaaaacttaactataattatcacccaaaattataattcataccactctccaaccaacggagacccagcatggcgtat

SEQ ID NO: 376535 - DNA, 140 bp, Artificial Sequence
  Synthetic
aggccctggctgctgatatgagttttttggtgatataggattaagtttaatatattttggaagaagaattggaataattggttggttatttttgggttgtggttttttgttggttagtttgaccttttgggacagcggtg

SEQ ID NO: 376536 - DNA, 140 bp, Artificial Sequence
  Synthetic
caccgctgtcccaaaaggtcaaactaaccaacaaaaaaccacaacccaaaaataaccaaccaattattccaattcttcttccaaaatatattaaacttaatcctatatcaccaaaaaactcatatcagcagccagggcct

SEQ ID NO: 376537 - DNA, 140 bp, Artificial Sequence
  Synthetic
atacgccatgctgggtctcctaattgggataattttgaggtttggtattgtatttatgattgtttgaattttgttaggtgatgttaagtttgaagtatgtttttttttttttgtttttttcgtacttgggagtcggccat

SEQ ID NO: 376538 - DNA, 140 bp, Artificial Sequence
  Synthetic
atggccgactcccaagtacgaaaaaaacaaaaaaaaaaaaacatacttcaaacttaacatcacctaacaaaattcaaacaatcataaatacaataccaaacctcaaaattatcccaattaggagacccagcatggcgtat

SEQ ID NO: 376539 - DNA, 140 bp, Artificial Sequence
  Synthetic
aggccctggctgctgatatgttgttaggtgatgttaagtttgaagtatgtttttttttttttgttttttttggtaggagaattggatgaagtttgggatggagtgagagtttaggatgaagaccttttgggacagcggtg

SEQ ID NO: 376540 - DNA, 140 bp, Artificial Sequence
  Synthetic
caccgctgtcccaaaaggtcttcatcctaaactctcactccatcccaaacttcatccaattctcctaccaaaaaaaacaaaaaaaaaaaaacatacttcaaacttaacatcacctaacaacatatcagcagccagggcct

SEQ ID NO: 376541 - DNA, 140 bp, Artificial Sequence
  Synthetic
atacgccatgctgggtctccaatggttgagtgatgagttttagagttgttagattaaatgtgaaatattggggaagttggattggtggaagaataaatttttgaaggaatgtttgattgtcgtacttgggagtcggccat

SEQ ID NO: 376542 - DNA, 140 bp, Artificial Sequence
  Synthetic
atggccgactcccaagtacgacaatcaaacattccttcaaaaatttattcttccaccaatccaacttccccaatatttcacatttaatctaacaactctaaaactcatcactcaaccattggagacccagcatggcgtat

SEQ ID NO: 376543 - DNA, 140 bp, Artificial Sequence
  Synthetic
aggccctggctgctgatatggggaagttggattggtggaagaataaatttttgaaggaatgtttgattgtttaattttaggagttgtagtggatgattgggtatttttgggtttagtttggaccttttgggacagcggtg

SEQ ID NO: 376544 - DNA, 140 bp, Artificial Sequence
  Synthetic
caccgctgtcccaaaaggtccaaactaaacccaaaaatacccaatcatccactacaactcctaaaattaaacaatcaaacattccttcaaaaatttattcttccaccaatccaacttccccatatcagcagccagggcct

SEQ ID NO: 376545 - DNA, 140 bp, Artificial Sequence
  Synthetic
atacgccatgctgggtctccggaagttaatataattgtggttgttgttgaattaaagttgtatattttttgattagttatatttagtggaagttaaataggtatttgttttattaggattcgtacttgggagtcggccat

SEQ ID NO: 376546 - DNA, 140 bp, Artificial Sequence
  Synthetic
atggccgactcccaagtacgaatcctaataaaacaaatacctatttaacttccactaaatataactaatcaaaaaatatacaactttaattcaacaacaaccacaattatattaacttccggagacccagcatggcgtat

SEQ ID NO: 376547 - DNA, 140 bp, Artificial Sequence
  Synthetic
aggccctggctgctgatatggattagttatatttagtggaagttaaataggtatttgttttattaggatttttgtttttgaaattatatttattgtagtttttaatataaaggtagaagtgaccttttgggacagcggtg

SEQ ID NO: 376548 - DNA, 140 bp, Artificial Sequence
  Synthetic
caccgctgtcccaaaaggtcacttctacctttatattaaaaactacaataaatataatttcaaaaacaaaaatcctaataaaacaaatacctatttaacttccactaaatataactaatccatatcagcagccagggcct

SEQ ID NO: 376549 - DNA, 140 bp, Artificial Sequence
  Synthetic
atacgccatgctgggtctccgttttatggagtttgatggaatatttgtttttggtattgttagtatatttgatttggttttattgattatgatatttggttgggttgggagtatgtttatcgtacttgggagtcggccat

SEQ ID NO: 376550 - DNA, 140 bp, Artificial Sequence
  Synthetic
atggccgactcccaagtacgataaacatactcccaacccaaccaaatatcataatcaataaaaccaaatcaaatatactaacaataccaaaaacaaatattccatcaaactccataaaacggagacccagcatggcgtat

SEQ ID NO: 376551 - DNA, 140 bp, Artificial Sequence
  Synthetic
aggccctggctgctgatatggatttggttttattgattatgatatttggttgggttgggagtatgtttatagggtatgtaatattattatatgttggaggagttgttggtaatattttgtgaccttttgggacagcggtg

SEQ ID NO: 376552 - DNA, 140 bp, Artificial Sequence
  Synthetic
caccgctgtcccaaaaggtcacaaaatattaccaacaactcctccaacatataataatattacataccctataaacatactcccaacccaaccaaatatcataatcaataaaaccaaatccatatcagcagccagggcct

SEQ ID NO: 376553 - DNA, 140 bp, Artificial Sequence
  Synthetic
atacgccatgctgggtctccaatgttaagtttggaaaatattgattggttttttttaatttttattatttgttatatttatattatatattagtatttttattaattttttgttaaattacgtacttgggagtcggccat

SEQ ID NO: 376554 - DNA, 140 bp, Artificial Sequence
  Synthetic
atggccgactcccaagtacgtaatttaacaaaaaattaataaaaatactaatatataatataaatataacaaataataaaaattaaaaaaaaccaatcaatattttccaaacttaacattggagacccagcatggcgtat

SEQ ID NO: 376555 - DNA, 140 bp, Artificial Sequence
  Synthetic
aggccctggctgctgatatggttatatttatattatatattagtatttttattaattttttgttaaattataatattttgtgtatgtttgtaagtttggaatgattttttaatttaaagagaccttttgggacagcggtg

SEQ ID NO: 376556 - DNA, 140 bp, Artificial Sequence
  Synthetic
caccgctgtcccaaaaggtctctttaaattaaaaaatcattccaaacttacaaacatacacaaaatattataatttaacaaaaaattaataaaaatactaatatataatataaatataaccatatcagcagccagggcct

SEQ ID NO: 376557 - DNA, 140 bp, Artificial Sequence
  Synthetic
atacgccatgctgggtctccttaattatatattattattaatagtgttaatagtttaatagtttggttgaggttttatttaaggttgtggtttgttttgttaaataaattttgatttttacgtacttgggagtcggccat

SEQ ID NO: 376558 - DNA, 140 bp, Artificial Sequence
  Synthetic
atggccgactcccaagtacgtaaaaatcaaaatttatttaacaaaacaaaccacaaccttaaataaaacctcaaccaaactattaaactattaacactattaataataatatataattaaggagacccagcatggcgtat

SEQ ID NO: 376559 - DNA, 140 bp, Artificial Sequence
  Synthetic
aggccctggctgctgatatgggttttatttaaggttgtggtttgttttgttaaataaattttgatttttagattttaagtttaagtgttttattattttgtattttaaataaataaatttgaccttttgggacagcggtg

SEQ ID NO: 376560 - DNA, 140 bp, Artificial Sequence
  Synthetic
caccgctgtcccaaaaggtcaaatttatttatttaaaatacaaaataataaaacacttaaacttaaaatctaaaaatcaaaatttatttaacaaaacaaaccacaaccttaaataaaacccatatcagcagccagggcct

SEQ ID NO: 376561 - DNA, 140 bp, Artificial Sequence
  Synthetic
atacgccatgctgggtctcctatgtttgtgggatgttattatgggatttaatatggattattgggggtggtatattttgaaagattgggatttttttggttatttgtatgagtgtatattcgtacttgggagtcggccat

SEQ ID NO: 376562 - DNA, 140 bp, Artificial Sequence
  Synthetic
atggccgactcccaagtacgaatatacactcatacaaataaccaaaaaaatcccaatctttcaaaatataccacccccaataatccatattaaatcccataataacatcccacaaacataggagacccagcatggcgtat

SEQ ID NO: 376563 - DNA, 140 bp, Artificial Sequence
  Synthetic
aggccctggctgctgatatgtatattttgaaagattgggatttttttggttatttgtatgagtgtatattggggagagttattatttgttagatttgtttggaatttagtatggattgtggaccttttgggacagcggtg

SEQ ID NO: 376564 - DNA, 140 bp, Artificial Sequence
  Synthetic
caccgctgtcccaaaaggtccacaatccatactaaattccaaacaaatctaacaaataataactctccccaatatacactcatacaaataaccaaaaaaatcccaatctttcaaaatatacatatcagcagccagggcct

SEQ ID NO: 376565 - DNA, 140 bp, Artificial Sequence
  Synthetic
atacgccatgctgggtctccgtgaaaggtagttttaaaattaggtagatgattatatatgattttttttaggtttttagtagatatataaggttttttaaaattttttttggttagggttcgtacttgggagtcggccat

SEQ ID NO: 376566 - DNA, 140 bp, Artificial Sequence
  Synthetic
atggccgactcccaagtacgaaccctaaccaaaaaaaattttaaaaaaccttatatatctactaaaaacctaaaaaaaatcatatataatcatctacctaattttaaaactacctttcacggagacccagcatggcgtat

SEQ ID NO: 376567 - DNA, 140 bp, Artificial Sequence
  Synthetic
aggccctggctgctgatatgggtttttagtagatatataaggttttttaaaattttttttggttagggttgatgtattgttaaggtttttgtaagttttttgtatagtatttggtatatagaccttttgggacagcggtg

SEQ ID NO: 376568 - DNA, 140 bp, Artificial Sequence
  Synthetic
caccgctgtcccaaaaggtctatataccaaatactatacaaaaaacttacaaaaaccttaacaatacatcaaccctaaccaaaaaaaattttaaaaaaccttatatatctactaaaaacccatatcagcagccagggcct

SEQ ID NO: 376569 - DNA, 140 bp, Artificial Sequence
  Synthetic
atacgccatgctgggtctccttggttttggtggtggttgtttgtgttttttttaatatgtatttattgtagttgtagttgaagtagtttgtttagttgttataattagaagattatatttcgtacttgggagtcggccat

SEQ ID NO: 376570 - DNA, 140 bp, Artificial Sequence
  Synthetic
atggccgactcccaagtacgaaatataatcttctaattataacaactaaacaaactacttcaactacaactacaataaatacatattaaaaaaaacacaaacaaccaccaccaaaaccaaggagacccagcatggcgtat

SEQ ID NO: 376571 - DNA, 140 bp, Artificial Sequence
  Synthetic
aggccctggctgctgatatggttgtagttgaagtagtttgtttagttgttataattagaagattatattttgtaattattttggtataattgtgatttaatgatgaaattattttatttagaccttttgggacagcggtg

SEQ ID NO: 376572 - DNA, 140 bp, Artificial Sequence
  Synthetic
caccgctgtcccaaaaggtctaaataaaataatttcatcattaaatcacaattataccaaaataattacaaaatataatcttctaattataacaactaaacaaactacttcaactacaaccatatcagcagccagggcct

SEQ ID NO: 376573 - DNA, 140 bp, Artificial Sequence
  Synthetic
atacgccatgctgggtctccagggttttgattgtagtattttgatgattggtggtatttattagtatagttaatgtatttttaatttttttaaggagaggtatatagttgatttttgtttcgtacttgggagtcggccat

SEQ ID NO: 376574 - DNA, 140 bp, Artificial Sequence
  Synthetic
atggccgactcccaagtacgaaacaaaaatcaactatatacctctccttaaaaaaattaaaaatacattaactatactaataaataccaccaatcatcaaaatactacaatcaaaaccctggagacccagcatggcgtat

SEQ ID NO: 376575 - DNA, 140 bp, Artificial Sequence
  Synthetic
aggccctggctgctgatatgtaatgtatttttaatttttttaaggagaggtatatagttgatttttgtttgattgttatttgtataagtttttgttgagttttttgatgatggtttgagtgaccttttgggacagcggtg

SEQ ID NO: 376576 - DNA, 140 bp, Artificial Sequence
  Synthetic
caccgctgtcccaaaaggtcactcaaaccatcatcaaaaaactcaacaaaaacttatacaaataacaatcaaacaaaaatcaactatatacctctccttaaaaaaattaaaaatacattacatatcagcagccagggcct

SEQ ID NO: 376577 - DNA, 140 bp, Artificial Sequence
  Synthetic
atacgccatgctgggtctcctattggaattttatttgttataagttgtttagaaatttatttagttgtttttgggtttgaatatatttttaatttattattgtatatgtttttaagggtgcgtacttgggagtcggccat

SEQ ID NO: 376578 - DNA, 140 bp, Artificial Sequence
  Synthetic
atggccgactcccaagtacgcacccttaaaaacatatacaataataaattaaaaatatattcaaacccaaaaacaactaaataaatttctaaacaacttataacaaataaaattccaataggagacccagcatggcgtat

SEQ ID NO: 376579 - DNA, 140 bp, Artificial Sequence
  Synthetic
aggccctggctgctgatatgttgggtttgaatatatttttaatttattattgtatatgtttttaagggtggtaatgtttatgtattttttgataatggttttaaggtaggatatttttaagaccttttgggacagcggtg

SEQ ID NO: 376580 - DNA, 140 bp, Artificial Sequence
  Synthetic
caccgctgtcccaaaaggtcttaaaaatatcctaccttaaaaccattatcaaaaaatacataaacattaccacccttaaaaacatatacaataataaattaaaaatatattcaaacccaacatatcagcagccagggcct

SEQ ID NO: 376581 - DNA, 140 bp, Artificial Sequence
  Synthetic
atacgccatgctgggtctcctgatgaaggttttaatttttattaaatgttttttttaatttgtttagttagggttatttattagattatatttttaatgggtgaagtattttaagtagaacgtacttgggagtcggccat

SEQ ID NO: 376582 - DNA, 140 bp, Artificial Sequence
  Synthetic
atggccgactcccaagtacgttctacttaaaatacttcacccattaaaaatataatctaataaataaccctaactaaacaaattaaaaaaaacatttaataaaaattaaaaccttcatcaggagacccagcatggcgtat

SEQ ID NO: 376583 - DNA, 140 bp, Artificial Sequence
  Synthetic
aggccctggctgctgatatggggttatttattagattatatttttaatgggtgaagtattttaagtagaatgggttaatttataattagaaatataaagtattatttatttttttatgatgaccttttgggacagcggtg

SEQ ID NO: 376584 - DNA, 140 bp, Artificial Sequence
  Synthetic
caccgctgtcccaaaaggtcatcataaaaaaataaataatactttatatttctaattataaattaacccattctacttaaaatacttcacccattaaaaatataatctaataaataaccccatatcagcagccagggcct

SEQ ID NO: 376585 - DNA, 140 bp, Artificial Sequence
  Synthetic
atacgccatgctgggtctcctgtatatgtatattatttaaatttttaatggttttagattaagaattatttatagaaaagtagtattaataagttataatggattagtttttgtagatgacgtacttgggagtcggccat

SEQ ID NO: 376586 - DNA, 140 bp, Artificial Sequence
  Synthetic
atggccgactcccaagtacgtcatctacaaaaactaatccattataacttattaatactacttttctataaataattcttaatctaaaaccattaaaaatttaaataatatacatatacaggagacccagcatggcgtat

SEQ ID NO: 376587 - DNA, 140 bp, Artificial Sequence
  Synthetic
aggccctggctgctgatatgtatagaaaagtagtattaataagttataatggattagtttttgtagatgaattggttaagttttaagtgtatttagttttatgaagtggattgtgttttggaccttttgggacagcggtg

SEQ ID NO: 376588 - DNA, 140 bp, Artificial Sequence
  Synthetic
caccgctgtcccaaaaggtccaaaacacaatccacttcataaaactaaatacacttaaaacttaaccaattcatctacaaaaactaatccattataacttattaatactacttttctatacatatcagcagccagggcct

SEQ ID NO: 376589 - DNA, 140 bp, Artificial Sequence
  Synthetic
atacgccatgctgggtctccatttatgataggttagaagaattgttgattatttatgtaaatgtagtgattttttttgtttagttgtttttttttggtgagttatggaggataggtttttcgtacttgggagtcggccat

SEQ ID NO: 376590 - DNA, 140 bp, Artificial Sequence
  Synthetic
atggccgactcccaagtacgaaaaacctatcctccataactcaccaaaaaaaaacaactaaacaaaaaaaatcactacatttacataaataatcaacaattcttctaacctatcataaatggagacccagcatggcgtat

SEQ ID NO: 376591 - DNA, 140 bp, Artificial Sequence
  Synthetic
aggccctggctgctgatatgtttttttgtttagttgtttttttttggtgagttatggaggataggtttttttaagtgaatttgggtaggtgtatttttttttattattagtgttaaatatgaccttttgggacagcggtg

SEQ ID NO: 376592 - DNA, 140 bp, Artificial Sequence
  Synthetic
caccgctgtcccaaaaggtcatatttaacactaataataaaaaaaaatacacctacccaaattcacttaaaaaaacctatcctccataactcaccaaaaaaaaacaactaaacaaaaaaacatatcagcagccagggcct

SEQ ID NO: 376593 - DNA, 140 bp, Artificial Sequence
  Synthetic
atacgccatgctgggtctcctttgagtttttagtagatggtgatatgttttttttaatttttgtatagattttgattgattgatattagggtttttatttaattgtgatgttttagttggcgtacttgggagtcggccat

SEQ ID NO: 376594 - DNA, 140 bp, Artificial Sequence
  Synthetic
atggccgactcccaagtacgccaactaaaacatcacaattaaataaaaaccctaatatcaatcaatcaaaatctatacaaaaattaaaaaaaacatatcaccatctactaaaaactcaaaggagacccagcatggcgtat

SEQ ID NO: 376595 - DNA, 140 bp, Artificial Sequence
  Synthetic
aggccctggctgctgatatgtttgattgattgatattagggtttttatttaattgtgatgttttagttggtttgtttgaggatttgtggggaggtttgtgggtttttgtattgtggtatagaccttttgggacagcggtg

SEQ ID NO: 376596 - DNA, 140 bp, Artificial Sequence
  Synthetic
caccgctgtcccaaaaggtctataccacaatacaaaaacccacaaacctccccacaaatcctcaaacaaaccaactaaaacatcacaattaaataaaaaccctaatatcaatcaatcaaacatatcagcagccagggcct

SEQ ID NO: 376597 - DNA, 140 bp, Artificial Sequence
  Synthetic
atacgccatgctgggtctccgatgtattgttattattagattttagtggaggtaagtttgagggattattattattttgatttataagggtgttttttttgtgtattggtgagagtttttcgtacttgggagtcggccat

SEQ ID NO: 376598 - DNA, 140 bp, Artificial Sequence
  Synthetic
atggccgactcccaagtacgaaaaactctcaccaatacacaaaaaaaacacccttataaatcaaaataataataatccctcaaacttacctccactaaaatctaataataacaatacatcggagacccagcatggcgtat

SEQ ID NO: 376599 - DNA, 140 bp, Artificial Sequence
  Synthetic
aggccctggctgctgatatgattattttgatttataagggtgttttttttgtgtattggtgagagtttttgattggtggttgtatgttttgggttttggtgttagttgtattgattttttgaccttttgggacagcggtg

SEQ ID NO: 376600 - DNA, 140 bp, Artificial Sequence
  Synthetic
caccgctgtcccaaaaggtcaaaaaatcaatacaactaacaccaaaacccaaaacatacaaccaccaatcaaaaactctcaccaatacacaaaaaaaacacccttataaatcaaaataatcatatcagcagccagggcct

SEQ ID NO: 376601 - DNA, 140 bp, Artificial Sequence
  Synthetic
atacgccatgctgggtctccgtttttgttgttgtttgggggtggatgaattaatttttttttttttatttttttttgggattgtggtgagttgttttgtggtttaaaagttttattgttacgtacttgggagtcggccat

SEQ ID NO: 376602 - DNA, 140 bp, Artificial Sequence
  Synthetic
atggccgactcccaagtacgtaacaataaaacttttaaaccacaaaacaactcaccacaatcccaaaaaaaaataaaaaaaaaaaaattaattcatccacccccaaacaacaacaaaaacggagacccagcatggcgtat

SEQ ID NO: 376603 - DNA, 140 bp, Artificial Sequence
  Synthetic
aggccctggctgctgatatgttttttgggattgtggtgagttgttttgtggtttaaaagttttattgttatttttatgattgttaagattgaataggattaagttatttgttgttttaatgaccttttgggacagcggtg

SEQ ID NO: 376604 - DNA, 140 bp, Artificial Sequence
  Synthetic
caccgctgtcccaaaaggtcattaaaacaacaaataacttaatcctattcaatcttaacaatcataaaaataacaataaaacttttaaaccacaaaacaactcaccacaatcccaaaaaacatatcagcagccagggcct

SEQ ID NO: 376605 - DNA, 140 bp, Artificial Sequence
  Synthetic
atacgccatgctgggtctcctaattgtattattaggaatgatggtgtttttggagtttttaggattattttttagatgattttggtttgggttgttgtttataggtttagggaatggtatcgtacttgggagtcggccat

SEQ ID NO: 376606 - DNA, 140 bp, Artificial Sequence
  Synthetic
atggccgactcccaagtacgataccattccctaaacctataaacaacaacccaaaccaaaatcatctaaaaaataatcctaaaaactccaaaaacaccatcattcctaataatacaattaggagacccagcatggcgtat

SEQ ID NO: 376607 - DNA, 140 bp, Artificial Sequence
  Synthetic
aggccctggctgctgatatgtttagatgattttggtttgggttgttgtttataggtttagggaatggtattttattgttgttgttttgtttagatttgaggttaggttttgaggttagtggaccttttgggacagcggtg

SEQ ID NO: 376608 - DNA, 140 bp, Artificial Sequence
  Synthetic
caccgctgtcccaaaaggtccactaacctcaaaacctaacctcaaatctaaacaaaacaacaacaataaaataccattccctaaacctataaacaacaacccaaaccaaaatcatctaaacatatcagcagccagggcct

SEQ ID NO: 376609 - DNA, 140 bp, Artificial Sequence
  Synthetic
atacgccatgctgggtctccgtattggtttgttggaaattaattttgttttttttttgatggaagtttattagtattttttttttttgattgtttaggtttaggttgttgagttttttggcgtacttgggagtcggccat

SEQ ID NO: 376610 - DNA, 140 bp, Artificial Sequence
  Synthetic
atggccgactcccaagtacgccaaaaaactcaacaacctaaacctaaacaatcaaaaaaaaaaaatactaataaacttccatcaaaaaaaaaacaaaattaatttccaacaaaccaatacggagacccagcatggcgtat

SEQ ID NO: 376611 - DNA, 140 bp, Artificial Sequence
  Synthetic
aggccctggctgctgatatgtagtattttttttttttgattgtttaggtttaggttgttgagttttttggatttagtatattgttggagttgttttttagttttagtggtagtttttttagaccttttgggacagcggtg

SEQ ID NO: 376612 - DNA, 140 bp, Artificial Sequence
  Synthetic
caccgctgtcccaaaaggtctaaaaaaactaccactaaaactaaaaaacaactccaacaatatactaaatccaaaaaactcaacaacctaaacctaaacaatcaaaaaaaaaaaatactacatatcagcagccagggcct

SEQ ID NO: 376613 - DNA, 140 bp, Artificial Sequence
  Synthetic
atacgccatgctgggtctcctgttgtggtaattttaagagtaattgttgataattgtgggtagagattatgttttaggttgttaatttttgagagattgagaaggtgagtaaaaggggtacgtacttgggagtcggccat

SEQ ID NO: 376614 - DNA, 140 bp, Artificial Sequence
  Synthetic
atggccgactcccaagtacgtaccccttttactcaccttctcaatctctcaaaaattaacaacctaaaacataatctctacccacaattatcaacaattactcttaaaattaccacaacaggagacccagcatggcgtat

SEQ ID NO: 376615 - DNA, 140 bp, Artificial Sequence
  Synthetic
aggccctggctgctgatatggttttaggttgttaatttttgagagattgagaaggtgagtaaaaggggtatattttttatgtttagtaagtgagtttagggtggttttaaatgtattaatgaccttttgggacagcggtg

SEQ ID NO: 376616 - DNA, 140 bp, Artificial Sequence
  Synthetic
caccgctgtcccaaaaggtcattaatacatttaaaaccaccctaaactcacttactaaacataaaaaatataccccttttactcaccttctcaatctctcaaaaattaacaacctaaaaccatatcagcagccagggcct

SEQ ID NO: 376617 - DNA, 140 bp, Artificial Sequence
  Synthetic
atacgccatgctgggtctccggttggttttttgtagaatatgattaagaatggttttgataattaggagttttgaaaagtgagtttgagtaattgaattagtaatgatagtattattggtcgtacttgggagtcggccat

SEQ ID NO: 376618 - DNA, 140 bp, Artificial Sequence
  Synthetic
atggccgactcccaagtacgaccaataatactatcattactaattcaattactcaaactcacttttcaaaactcctaattatcaaaaccattcttaatcatattctacaaaaaaccaaccggagacccagcatggcgtat

SEQ ID NO: 376619 - DNA, 140 bp, Artificial Sequence
  Synthetic
aggccctggctgctgatatgtttgaaaagtgagtttgagtaattgaattagtaatgatagtattattggtattgtggttagttattatatgtatattttggtggattagtaaatatttaagaccttttgggacagcggtg

SEQ ID NO: 376620 - DNA, 140 bp, Artificial Sequence
  Synthetic
caccgctgtcccaaaaggtcttaaatatttactaatccaccaaaatatacatataataactaaccacaataccaataatactatcattactaattcaattactcaaactcacttttcaaacatatcagcagccagggcct

SEQ ID NO: 376621 - DNA, 140 bp, Artificial Sequence
  Synthetic
atacgccatgctgggtctccgattgttatgtagtgggatattgaattaaattttgttttgtatgaatttgaatttgttgttggattttttttaagtaagtttttttttttataattagttcgtacttgggagtcggccat

SEQ ID NO: 376622 - DNA, 140 bp, Artificial Sequence
  Synthetic
atggccgactcccaagtacgaactaattataaaaaaaaaaacttacttaaaaaaaatccaacaacaaattcaaattcatacaaaacaaaatttaattcaatatcccactacataacaatcggagacccagcatggcgtat

SEQ ID NO: 376623 - DNA, 140 bp, Artificial Sequence
  Synthetic
aggccctggctgctgatatgaatttgttgttggattttttttaagtaagtttttttttttataattagtttgggaagaaataaatttgtaaatgagagaaattgttttgtatttgtttttgaccttttgggacagcggtg

SEQ ID NO: 376624 - DNA, 140 bp, Artificial Sequence
  Synthetic
caccgctgtcccaaaaggtcaaaaacaaatacaaaacaatttctctcatttacaaatttatttcttcccaaactaattataaaaaaaaaaacttacttaaaaaaaatccaacaacaaattcatatcagcagccagggcct

SEQ ID NO: 376625 - DNA, 140 bp, Artificial Sequence
  Synthetic
atacgccatgctgggtctccatttgttgtagtaggaagtaattttttgagttgattgatattgttttttttttggagtttaaatttgaatttatgattttttaaatattgtatagtattgcgtacttgggagtcggccat

SEQ ID NO: 376626 - DNA, 140 bp, Artificial Sequence
  Synthetic
atggccgactcccaagtacgcaatactatacaatatttaaaaaatcataaattcaaatttaaactccaaaaaaaaaacaatatcaatcaactcaaaaaattacttcctactacaacaaatggagacccagcatggcgtat

SEQ ID NO: 376627 - DNA, 140 bp, Artificial Sequence
  Synthetic
aggccctggctgctgatatgtttggagtttaaatttgaatttatgattttttaaatattgtatagtattgttttttaagaataatttatagttattttggtaagtatgatgtaggtaaaggaccttttgggacagcggtg

SEQ ID NO: 376628 - DNA, 140 bp, Artificial Sequence
  Synthetic
caccgctgtcccaaaaggtcctttacctacatcatacttaccaaaataactataaattattcttaaaaaacaatactatacaatatttaaaaaatcataaattcaaatttaaactccaaacatatcagcagccagggcct

SEQ ID NO: 376629 - DNA, 140 bp, Artificial Sequence
  Synthetic
atacgccatgctgggtctccaggtttgtattattaattgatatatagtttttaagttattaataagatatatagaaattattttttgtttgataattttttgttgaatagtaaggttagtcgtacttgggagtcggccat

SEQ ID NO: 376630 - DNA, 140 bp, Artificial Sequence
  Synthetic
atggccgactcccaagtacgactaaccttactattcaacaaaaaattatcaaacaaaaaataatttctatatatcttattaataacttaaaaactatatatcaattaataatacaaacctggagacccagcatggcgtat

SEQ ID NO: 376631 - DNA, 140 bp, Artificial Sequence
  Synthetic
aggccctggctgctgatatgatagaaattattttttgtttgataattttttgttgaatagtaaggttagttgttaaaattttatgataatttaaattagtattattttgattttgtgatagaccttttgggacagcggtg

SEQ ID NO: 376632 - DNA, 140 bp, Artificial Sequence
  Synthetic
caccgctgtcccaaaaggtctatcacaaaatcaaaataatactaatttaaattatcataaaattttaacaactaaccttactattcaacaaaaaattatcaaacaaaaaataatttctatcatatcagcagccagggcct

SEQ ID NO: 376633 - DNA, 140 bp, Artificial Sequence
  Synthetic
atacgccatgctgggtctcctagttaagatgtatgatattattggaataaattgtttttttgatttttttaattaatgatgatatgtaattttttggtattttaggattataaaatttatcgtacttgggagtcggccat

SEQ ID NO: 376634 - DNA, 140 bp, Artificial Sequence
  Synthetic
atggccgactcccaagtacgataaattttataatcctaaaataccaaaaaattacatatcatcattaattaaaaaaatcaaaaaaacaatttattccaataatatcatacatcttaactaggagacccagcatggcgtat

SEQ ID NO: 376635 - DNA, 140 bp, Artificial Sequence
  Synthetic
aggccctggctgctgatatgaattaatgatgatatgtaattttttggtattttaggattataaaatttatatataattaaaataattttttaaatttgatggaaaggggaattttttgtagaccttttgggacagcggtg

SEQ ID NO: 376636 - DNA, 140 bp, Artificial Sequence
  Synthetic
caccgctgtcccaaaaggtctacaaaaaattcccctttccatcaaatttaaaaaattattttaattatatataaattttataatcctaaaataccaaaaaattacatatcatcattaattcatatcagcagccagggcct

SEQ ID NO: 376637 - DNA, 140 bp, Artificial Sequence
  Synthetic
atacgccatgctgggtctccgttttaggaaaaattagatgaagaagagttttaagattattagatatattatgttgatggtaattggtaatagataaaattgatttaattgttataattacgtacttgggagtcggccat

SEQ ID NO: 376638 - DNA, 140 bp, Artificial Sequence
  Synthetic
atggccgactcccaagtacgtaattataacaattaaatcaattttatctattaccaattaccatcaacataatatatctaataatcttaaaactcttcttcatctaatttttcctaaaacggagacccagcatggcgtat

SEQ ID NO: 376639 - DNA, 140 bp, Artificial Sequence
  Synthetic
atacgccatgctgggtctccattttagtgtatattttaaattgaggaaaattgttaattttttttatagttatttgtatataaaaagttttaaaaaattttttttttttttgtgtgtttgcgtacttgggagtcggccat

SEQ ID NO: 376640 - DNA, 140 bp, Artificial Sequence
  Synthetic
atggccgactcccaagtacgcaaacacacaaaaaaaaaaaaaattttttaaaactttttatatacaaataactataaaaaaaattaacaattttcctcaatttaaaatatacactaaaatggagacccagcatggcgtat

SEQ ID NO: 376641 - DNA, 140 bp, Artificial Sequence
  Synthetic
atacgccatgctgggtctcctggatatataaaaagaaagaagaatttttaggattttttgtgtgtgaataattatgaggaagattaataattttttttttattgaaatttatattggaatcgtacttgggagtcggccat

SEQ ID NO: 376642 - DNA, 140 bp, Artificial Sequence
  Synthetic
atggccgactcccaagtacgattccaatataaatttcaataaaaaaaaaattattaatcttcctcataattattcacacacaaaaaatcctaaaaattcttctttctttttatatatccaggagacccagcatggcgtat

SEQ ID NO: 376643 - DNA, 140 bp, Artificial Sequence
  Synthetic
aggccctggctgctgatatgattatgaggaagattaataattttttttttattgaaatttatattggaatttaaattgaaattgttattgtaattatatttggtttgttttagagttatagaccttttgggacagcggtg

SEQ ID NO: 376644 - DNA, 140 bp, Artificial Sequence
  Synthetic
caccgctgtcccaaaaggtctataactctaaaacaaaccaaatataattacaataacaatttcaatttaaattccaatataaatttcaataaaaaaaaaattattaatcttcctcataatcatatcagcagccagggcct

SEQ ID NO: 376645 - DNA, 140 bp, Artificial Sequence
  Synthetic
atacgccatgctgggtctccttaaattgaaattgttattgtaattatatttggtttgttttagagttatattataaagatagagaataatttaggtttttgaagggagtaagggtattagcgtacttgggagtcggccat

SEQ ID NO: 376646 - DNA, 140 bp, Artificial Sequence
  Synthetic
atggccgactcccaagtacgctaatacccttactcccttcaaaaacctaaattattctctatctttataatataactctaaaacaaaccaaatataattacaataacaatttcaatttaaggagacccagcatggcgtat

SEQ ID NO: 376647 - DNA, 140 bp, Artificial Sequence
  Synthetic
atacgccatgctgggtctccagttttattttagattttgtagggtgatttaataattttaatagaaatattattgttaaaggatagtattagtttatagttaaataagtaagattgagaacgtacttgggagtcggccat

SEQ ID NO: 376648 - DNA, 140 bp, Artificial Sequence
  Synthetic
atggccgactcccaagtacgttctcaatcttacttatttaactataaactaatactatcctttaacaataatatttctattaaaattattaaatcaccctacaaaatctaaaataaaactggagacccagcatggcgtat

SEQ ID NO: 376649 - DNA, 140 bp, Artificial Sequence
  Synthetic
aggccctggctgctgatatgtattgttaaaggatagtattagtttatagttaaataagtaagattgagaattaattttggttttgaatttgaatatttaggggattgaagatttaataatgaccttttgggacagcggtg

SEQ ID NO: 376650 - DNA, 140 bp, Artificial Sequence
  Synthetic
caccgctgtcccaaaaggtcattattaaatcttcaatcccctaaatattcaaattcaaaaccaaaattaattctcaatcttacttatttaactataaactaatactatcctttaacaatacatatcagcagccagggcct

SEQ ID NO: 376651 - DNA, 140 bp, Artificial Sequence
  Synthetic
atacgccatgctgggtctccgaattataaaattttgagtatggatttttgtttttagaaaatttggatggtgttgagttttattgaatttgatatggattattataagattttgatagtacgtacttgggagtcggccat

SEQ ID NO: 376652 - DNA, 140 bp, Artificial Sequence
  Synthetic
atggccgactcccaagtacgtactatcaaaatcttataataatccatatcaaattcaataaaactcaacaccatccaaattttctaaaaacaaaaatccatactcaaaattttataattcggagacccagcatggcgtat

SEQ ID NO: 376653 - DNA, 140 bp, Artificial Sequence
  Synthetic
aggccctggctgctgatatgtgttgagttttattgaatttgatatggattattataagattttgatagtaggtttgtttgtttaataggggattgtttggtaaagagttattttagtgtagaccttttgggacagcggtg

SEQ ID NO: 376654 - DNA, 140 bp, Artificial Sequence
  Synthetic
caccgctgtcccaaaaggtctacactaaaataactctttaccaaacaatcccctattaaacaaacaaacctactatcaaaatcttataataatccatatcaaattcaataaaactcaacacatatcagcagccagggcct

SEQ ID NO: 376655 - DNA, 140 bp, Artificial Sequence
  Synthetic
atacgccatgctgggtctccaagtaggtgttgatttttaagagagtgtggatagttttttttttatgttttgtttttattatgtgtattagggagattataaattttttttggaaagtggcgtacttgggagtcggccat

SEQ ID NO: 376656 - DNA, 140 bp, Artificial Sequence
  Synthetic
atggccgactcccaagtacgccactttccaaaaaaaatttataatctccctaatacacataataaaaacaaaacataaaaaaaaaactatccacactctcttaaaaatcaacacctacttggagacccagcatggcgtat

SEQ ID NO: 376657 - DNA, 140 bp, Artificial Sequence
  Synthetic
aggccctggctgctgatatgtgtttttattatgtgtattagggagattataaattttttttggaaagtggtgtagttaagtatttggaagggtatgggttttgttttgaagttaagaagtgaccttttgggacagcggtg

SEQ ID NO: 376658 - DNA, 140 bp, Artificial Sequence
  Synthetic
caccgctgtcccaaaaggtcacttcttaacttcaaaacaaaacccatacccttccaaatacttaactacaccactttccaaaaaaaatttataatctccctaatacacataataaaaacacatatcagcagccagggcct

SEQ ID NO: 376659 - DNA, 140 bp, Artificial Sequence
  Synthetic
atacgccatgctgggtctccaaaaatattaagagaatatttgttgttatgttggaagaggagataattgaagttaatgttggttagttttttttttttgtaagtttattttttttgaaatcgtacttgggagtcggccat

SEQ ID NO: 376660 - DNA, 140 bp, Artificial Sequence
  Synthetic
atggccgactcccaagtacgatttcaaaaaaaataaacttacaaaaaaaaaaaactaaccaacattaacttcaattatctcctcttccaacataacaacaaatattctcttaatatttttggagacccagcatggcgtat

SEQ ID NO: 376661 - DNA, 140 bp, Artificial Sequence
  Synthetic
aggccctggctgctgatatgagttaatgttggttagttttttttttttgtaagtttattttttttgaaattggtagtaggagaaaaggtttgttttgagaaggtttaaaggtaaatttaagaccttttgggacagcggtg

SEQ ID NO: 376662 - DNA, 140 bp, Artificial Sequence
  Synthetic
caccgctgtcccaaaaggtcttaaatttacctttaaaccttctcaaaacaaaccttttctcctactaccaatttcaaaaaaaataaacttacaaaaaaaaaaaactaaccaacattaactcatatcagcagccagggcct

SEQ ID NO: 376663 - DNA, 140 bp, Artificial Sequence
  Synthetic
atacgccatgctgggtctccaggatatatgatggtgattttttgtttgatgtgaataaattttttgattaaattttttttaatatattaagggatgtatatggttgttgggtatgatgttcgtacttgggagtcggccat

SEQ ID NO: 376664 - DNA, 140 bp, Artificial Sequence
  Synthetic
atggccgactcccaagtacgaacatcatacccaacaaccatatacatcccttaatatattaaaaaaaatttaatcaaaaaatttattcacatcaaacaaaaaatcaccatcatatatcctggagacccagcatggcgtat

SEQ ID NO: 376665 - DNA, 140 bp, Artificial Sequence
  Synthetic
aggccctggctgctgatatgaattttttttaatatattaagggatgtatatggttgttgggtatgatgttaatgatgttgtgattttaaatttagtggtttaagtttgttttttaggtttgaccttttgggacagcggtg

SEQ ID NO: 376666 - DNA, 140 bp, Artificial Sequence
  Synthetic
caccgctgtcccaaaaggtcaaacctaaaaaacaaacttaaaccactaaatttaaaatcacaacatcattaacatcatacccaacaaccatatacatcccttaatatattaaaaaaaattcatatcagcagccagggcct

SEQ ID NO: 376667 - DNA, 140 bp, Artificial Sequence
  Synthetic
atacgccatgctgggtctccgagtttgtttttatttttttgtaaggattgttaaggtaaaaaatgaggtgaatttttttaaggttgtatttagttttttggttaagtatggagagtatgtcgtacttgggagtcggccat

SEQ ID NO: 376668 - DNA, 140 bp, Artificial Sequence
  Synthetic
atggccgactcccaagtacgacatactctccatacttaaccaaaaaactaaatacaaccttaaaaaaattcacctcattttttaccttaacaatccttacaaaaaaataaaaacaaactcggagacccagcatggcgtat

SEQ ID NO: 376669 - DNA, 140 bp, Artificial Sequence
  Synthetic
aggccctggctgctgatatgaatttttttaaggttgtatttagttttttggttaagtatggagagtatgttttttttgtttgatttttgaatttttttggagtaaataattttgagtatggaccttttgggacagcggtg

SEQ ID NO: 376670 - DNA, 140 bp, Artificial Sequence
  Synthetic
caccgctgtcccaaaaggtccatactcaaaattatttactccaaaaaaattcaaaaatcaaacaaaaaaaacatactctccatacttaaccaaaaaactaaatacaaccttaaaaaaattcatatcagcagccagggcct

SEQ ID NO: 376671 - DNA, 140 bp, Artificial Sequence
  Synthetic
atacgccatgctgggtctccgggagtatttttgtaggagtaaatgttggagaatagtattaataatttagagaggttgttattgaggttgagaagtaattttaataatatgtagagttttcgtacttgggagtcggccat

SEQ ID NO: 376672 - DNA, 140 bp, Artificial Sequence
  Synthetic
atggccgactcccaagtacgaaaactctacatattattaaaattacttctcaacctcaataacaacctctctaaattattaatactattctccaacatttactcctacaaaaatactcccggagacccagcatggcgtat

SEQ ID NO: 376673 - DNA, 140 bp, Artificial Sequence
  Synthetic
aggccctggctgctgatatgagaggttgttattgaggttgagaagtaattttaataatatgtagagttttgtgaatttgattattttggatttgatgattaggaaaagaaaatttttatggaccttttgggacagcggtg

SEQ ID NO: 376674 - DNA, 140 bp, Artificial Sequence
  Synthetic
caccgctgtcccaaaaggtccataaaaattttcttttcctaatcatcaaatccaaaataatcaaattcacaaaactctacatattattaaaattacttctcaacctcaataacaacctctcatatcagcagccagggcct

SEQ ID NO: 376675 - DNA, 140 bp, Artificial Sequence
  Synthetic
atacgccatgctgggtctccggtaattttaagaaaagagtgtttggttaagttgatagaagttattattgttgtgttattgtttaaaataagtggatattatgatgatgatgatgatattcgtacttgggagtcggccat

SEQ ID NO: 376676 - DNA, 140 bp, Artificial Sequence
  Synthetic
atggccgactcccaagtacgaatatcatcatcatcatcataatatccacttattttaaacaataacacaacaataataacttctatcaacttaaccaaacactcttttcttaaaattaccggagacccagcatggcgtat

SEQ ID NO: 376677 - DNA, 140 bp, Artificial Sequence
  Synthetic
aggccctggctgctgatatgttgtgttattgtttaaaataagtggatattatgatgatgatgatgatattttttttttaggatttattaatgatgatgataattttggttattaagatgagaccttttgggacagcggtg

SEQ ID NO: 376678 - DNA, 140 bp, Artificial Sequence
  Synthetic
caccgctgtcccaaaaggtctcatcttaataaccaaaattatcatcatcattaataaatcctaaaaaaaaaatatcatcatcatcatcataatatccacttattttaaacaataacacaacatatcagcagccagggcct

SEQ ID NO: 376679 - DNA, 140 bp, Artificial Sequence
  Synthetic
atacgccatgctgggtctccttgatgatggaagttatggtgaatattagagttatttggaaaatggtatgaatgtattagatgatttggttttatttgatttagatgaggatgatgaggacgtacttgggagtcggccat

SEQ ID NO: 376680 - DNA, 140 bp, Artificial Sequence
  Synthetic
atggccgactcccaagtacgtcctcatcatcctcatctaaatcaaataaaaccaaatcatctaatacattcataccattttccaaataactctaatattcaccataacttccatcatcaaggagacccagcatggcgtat

SEQ ID NO: 376681 - DNA, 140 bp, Artificial Sequence
  Synthetic
aggccctggctgctgatatgaatgtattagatgatttggttttatttgatttagatgaggatgatgaggatattaagttagtgtttaatagattgattaagggtggataatagaagaatagaccttttgggacagcggtg

SEQ ID NO: 376682 - DNA, 140 bp, Artificial Sequence
  Synthetic
caccgctgtcccaaaaggtctattcttctattatccacccttaatcaatctattaaacactaacttaatatcctcatcatcctcatctaaatcaaataaaaccaaatcatctaatacattcatatcagcagccagggcct

SEQ ID NO: 376683 - DNA, 140 bp, Artificial Sequence
  Synthetic
atacgccatgctgggtctcctaaaatgttttaggtttttatagaataatttattatgttagtgtgttatttatggataatgatagaagaaatgaattttttggtttaattagtttttgtacgtacttgggagtcggccat

SEQ ID NO: 376684 - DNA, 140 bp, Artificial Sequence
  Synthetic
atggccgactcccaagtacgtacaaaaactaattaaaccaaaaaattcatttcttctatcattatccataaataacacactaacataataaattattctataaaaacctaaaacattttaggagacccagcatggcgtat

SEQ ID NO: 376685 - DNA, 140 bp, Artificial Sequence
  Synthetic
aggccctggctgctgatatgtatggataatgatagaagaaatgaattttttggtttaattagtttttgtatgttgatattaattaatgaagaggtagatttattggatgatgttgatgatgaccttttgggacagcggtg

SEQ ID NO: 376686 - DNA, 140 bp, Artificial Sequence
  Synthetic
caccgctgtcccaaaaggtcatcatcaacatcatccaataaatctacctcttcattaattaatatcaacatacaaaaactaattaaaccaaaaaattcatttcttctatcattatccatacatatcagcagccagggcct

SEQ ID NO: 376687 - DNA, 140 bp, Artificial Sequence
  Synthetic
atacgccatgctgggtctccggatggaatttttaattgtatatttattgttgttttattggtttttgtatatagagattattttgaaaagaaagaatttttgtaagatgagtaataagatcgtacttgggagtcggccat

SEQ ID NO: 376688 - DNA, 140 bp, Artificial Sequence
  Synthetic
atggccgactcccaagtacgatcttattactcatcttacaaaaattctttcttttcaaaataatctctatatacaaaaaccaataaaacaacaataaatatacaattaaaaattccatccggagacccagcatggcgtat

SEQ ID NO: 376689 - DNA, 140 bp, Artificial Sequence
  Synthetic
aggccctggctgctgatatgatagagattattttgaaaagaaagaatttttgtaagatgagtaataagattaggattatatttaagaggttaggaattaggatagtgataatatttagttgaccttttgggacagcggtg

SEQ ID NO: 376690 - DNA, 140 bp, Artificial Sequence
  Synthetic
caccgctgtcccaaaaggtcaactaaatattatcactatcctaattcctaacctcttaaatataatcctaatcttattactcatcttacaaaaattctttcttttcaaaataatctctatcatatcagcagccagggcct

SEQ ID NO: 376691 - DNA, 140 bp, Artificial Sequence
  Synthetic
atacgccatgctgggtctcctatttgatgttgttttgtattattatatgatgaaggatgagtttgtagtttttagtattagtgatggtaaagagtatatgtatttagatttttttgaagacgtacttgggagtcggccat

SEQ ID NO: 376692 - DNA, 140 bp, Artificial Sequence
  Synthetic
atggccgactcccaagtacgtcttcaaaaaaatctaaatacatatactctttaccatcactaatactaaaaactacaaactcatccttcatcatataataatacaaaacaacatcaaataggagacccagcatggcgtat

SEQ ID NO: 376693 - DNA, 140 bp, Artificial Sequence
  Synthetic
aggccctggctgctgatatgtttagtattagtgatggtaaagagtatatgtatttagatttttttgaagaggaatatttattatggtttattgaaaaagaggttatgaatgaagagaatagaccttttgggacagcggtg

SEQ ID NO: 376694 - DNA, 140 bp, Artificial Sequence
  Synthetic
caccgctgtcccaaaaggtctattctcttcattcataacctctttttcaataaaccataataaatattcctcttcaaaaaaatctaaatacatatactctttaccatcactaatactaaacatatcagcagccagggcct

SEQ ID NO: 376695 - DNA, 140 bp, Artificial Sequence
  Synthetic
atacgccatgctgggtctccaagaataaatttatggtaattttgtaatattattagtgaatgagtatggaataatgggatgatttaattgataaatagttaatattaagtagttaaggaacgtacttgggagtcggccat

SEQ ID NO: 376696 - DNA, 140 bp, Artificial Sequence
  Synthetic
atggccgactcccaagtacgttccttaactacttaatattaactatttatcaattaaatcatcccattattccatactcattcactaataatattacaaaattaccataaatttattcttggagacccagcatggcgtat

SEQ ID NO: 376697 - DNA, 140 bp, Artificial Sequence
  Synthetic
aggccctggctgctgatatgataatgggatgatttaattgataaatagttaatattaagtagttaaggaatgaaaataggaagaatttttgatgtttaaggtgtgaattattattataatgaccttttgggacagcggtg

SEQ ID NO: 376698 - DNA, 140 bp, Artificial Sequence
  Synthetic
caccgctgtcccaaaaggtcattataataataattcacaccttaaacatcaaaaattcttcctattttcattccttaactacttaatattaactatttatcaattaaatcatcccattatcatatcagcagccagggcct

SEQ ID NO: 376699 - DNA, 140 bp, Artificial Sequence
  Synthetic
atacgccatgctgggtctccttttttaaagtttaatttgagttttaatgtaaataggtgttaagttatagttatagttataattgtaatttaatattttaattagtgatttatttaaattcgtacttgggagtcggccat

SEQ ID NO: 376700 - DNA, 140 bp, Artificial Sequence
  Synthetic
atggccgactcccaagtacgaatttaaataaatcactaattaaaatattaaattacaattataactataactataacttaacacctatttacattaaaactcaaattaaactttaaaaaaggagacccagcatggcgtat

SEQ ID NO: 376701 - DNA, 140 bp, Artificial Sequence
  Synthetic
aggccctggctgctgatatgttatagttataattgtaatttaatattttaattagtgatttatttaaattaaattatattatgtttttataatttatttattagtttgtttaatatttatgaccttttgggacagcggtg

SEQ ID NO: 376702 - DNA, 140 bp, Artificial Sequence
  Synthetic
caccgctgtcccaaaaggtcataaatattaaacaaactaataaataaattataaaaacataatataatttaatttaaataaatcactaattaaaatattaaattacaattataactataacatatcagcagccagggcct

SEQ ID NO: 376703 - DNA, 140 bp, Artificial Sequence
  Synthetic
atacgccatgctgggtctccattatttttatgttaattgaattttttagtatttgaagtttattgtttttaatgtaaaagaaaagttggtttaataagatgataattagaataaagggtacgtacttgggagtcggccat

SEQ ID NO: 376704 - DNA, 140 bp, Artificial Sequence
  Synthetic
atggccgactcccaagtacgtaccctttattctaattatcatcttattaaaccaacttttcttttacattaaaaacaataaacttcaaatactaaaaaattcaattaacataaaaataatggagacccagcatggcgtat

SEQ ID NO: 376705 - DNA, 140 bp, Artificial Sequence
  Synthetic
aggccctggctgctgatatgaatgtaaaagaaaagttggtttaataagatgataattagaataaagggtaggggttatattgtggttatgatttaaaatgatagaatgttaggttttgaggaccttttgggacagcggtg

SEQ ID NO: 376706 - DNA, 140 bp, Artificial Sequence
  Synthetic
caccgctgtcccaaaaggtcctcaaaacctaacattctatcattttaaatcataaccacaatataacccctaccctttattctaattatcatcttattaaaccaacttttcttttacattcatatcagcagccagggcct

SEQ ID NO: 376707 - DNA, 140 bp, Artificial Sequence
  Synthetic
atacgccatgctgggtctcctgatattttttgtgatattgagaataatttaggattatgttatgtattttaaatgtaataaatgaagttaaatttgaagatgtgtaatagttaaatttaacgtacttgggagtcggccat

SEQ ID NO: 376708 - DNA, 140 bp, Artificial Sequence
  Synthetic
atggccgactcccaagtacgttaaatttaactattacacatcttcaaatttaacttcatttattacatttaaaatacataacataatcctaaattattctcaatatcacaaaaaatatcaggagacccagcatggcgtat

SEQ ID NO: 376709 - DNA, 140 bp, Artificial Sequence
  Synthetic
aggccctggctgctgatatgaaatgtaataaatgaagttaaatttgaagatgtgtaatagttaaatttaaatggatttaatttgtaattatagttttgaggaggtagtataaatattggtgaccttttgggacagcggtg

SEQ ID NO: 376710 - DNA, 140 bp, Artificial Sequence
  Synthetic
caccgctgtcccaaaaggtcaccaatatttatactacctcctcaaaactataattacaaattaaatccatttaaatttaactattacacatcttcaaatttaacttcatttattacatttcatatcagcagccagggcct

SEQ ID NO: 376711 - DNA, 140 bp, Artificial Sequence
  Synthetic
atacgccatgctgggtctccaataatgtattatgagttttgagaatggtttaaagttagtttatgatatggtaaaaataatttttttattgaatagggtttgtgttgagatggttgtaaacgtacttgggagtcggccat

SEQ ID NO: 376712 - DNA, 140 bp, Artificial Sequence
  Synthetic
atggccgactcccaagtacgtttacaaccatctcaacacaaaccctattcaataaaaaaattatttttaccatatcataaactaactttaaaccattctcaaaactcataatacattattggagacccagcatggcgtat

SEQ ID NO: 376713 - DNA, 140 bp, Artificial Sequence
  Synthetic
aggccctggctgctgatatggtaaaaataatttttttattgaatagggtttgtgttgagatggttgtaaaatatgattttttggtgatgataattggttgggtaatagtaattgttgtgggaccttttgggacagcggtg

SEQ ID NO: 376714 - DNA, 140 bp, Artificial Sequence
  Synthetic
caccgctgtcccaaaaggtcccacaacaattactattacccaaccaattatcatcaccaaaaaatcatattttacaaccatctcaacacaaaccctattcaataaaaaaattatttttaccatatcagcagccagggcct

SEQ ID NO: 376715 - DNA, 140 bp, Artificial Sequence
  Synthetic
atacgccatgctgggtctccttttatgaagaaagtgtgatttggggtaagattgaatttagagatgagattgttttttaaagtgttagggaggtatttaataatttaaatagtattatttcgtacttgggagtcggccat

SEQ ID NO: 376716 - DNA, 140 bp, Artificial Sequence
  Synthetic
atggccgactcccaagtacgaaataatactatttaaattattaaatacctccctaacactttaaaaaacaatctcatctctaaattcaatcttaccccaaatcacactttcttcataaaaggagacccagcatggcgtat

SEQ ID NO: 376717 - DNA, 140 bp, Artificial Sequence
  Synthetic
aggccctggctgctgatatgtgttttttaaagtgttagggaggtatttaataatttaaatagtattattttattaattgaggaaaattttgggaaatttgatattttggtaaaggatttggaccttttgggacagcggtg

SEQ ID NO: 376718 - DNA, 140 bp, Artificial Sequence
  Synthetic
caccgctgtcccaaaaggtccaaatcctttaccaaaatatcaaatttcccaaaattttcctcaattaataaaataatactatttaaattattaaatacctccctaacactttaaaaaacacatatcagcagccagggcct

SEQ ID NO: 376719 - DNA, 140 bp, Artificial Sequence
  Synthetic
atacgccatgctgggtctccattagtataagtgatttgtaaattgggaaaagatagtaatttattggatattatttatgttgagttttaggttagtttggttgaaggagattttttttaacgtacttgggagtcggccat

SEQ ID NO: 376720 - DNA, 140 bp, Artificial Sequence
  Synthetic
atggccgactcccaagtacgttaaaaaaaatctccttcaaccaaactaacctaaaactcaacataaataatatccaataaattactatcttttcccaatttacaaatcacttatactaatggagacccagcatggcgtat

SEQ ID NO: 376721 - DNA, 140 bp, Artificial Sequence
  Synthetic
aggccctggctgctgatatgttatttatgttgagttttaggttagtttggttgaaggagattttttttaatgtgttttaatttaaattataaaaagagttttaattttttaagatgttgtgaccttttgggacagcggtg

SEQ ID NO: 376722 - DNA, 140 bp, Artificial Sequence
  Synthetic
caccgctgtcccaaaaggtcacaacatcttaaaaaattaaaactctttttataatttaaattaaaacacattaaaaaaaatctccttcaaccaaactaacctaaaactcaacataaataacatatcagcagccagggcct

SEQ ID NO: 376723 - DNA, 140 bp, Artificial Sequence
  Synthetic
atacgccatgctgggtctccagaaaagtttgtgtttagttttattattgtttaagattgattgaggttgggtatgtgttttttagttttaagatggtaaaatatttggatttaaaatttgcgtacttgggagtcggccat

SEQ ID NO: 376724 - DNA, 140 bp, Artificial Sequence
  Synthetic
atggccgactcccaagtacgcaaattttaaatccaaatattttaccatcttaaaactaaaaaacacatacccaacctcaatcaatcttaaacaataataaaactaaacacaaacttttctggagacccagcatggcgtat

SEQ ID NO: 376725 - DNA, 140 bp, Artificial Sequence
  Synthetic
aggccctggctgctgatatggtatgtgttttttagttttaagatggtaaaatatttggatttaaaatttgagttaattttttttttttttgaaagaggtgaataatagtagaggttttaagaccttttgggacagcggtg

SEQ ID NO: 376726 - DNA, 140 bp, Artificial Sequence
  Synthetic
caccgctgtcccaaaaggtcttaaaacctctactattattcacctctttcaaaaaaaaaaaaaattaactcaaattttaaatccaaatattttaccatcttaaaactaaaaaacacataccatatcagcagccagggcct

SEQ ID NO: 376727 - DNA, 140 bp, Artificial Sequence
  Synthetic
atacgccatgctgggtctccttttggataatataagttaattaaatgattaagataaaattgtttatattttgttagtagtttaaaatataaatgtaataggagttatatttttgatagtcgtacttgggagtcggccat

SEQ ID NO: 376728 - DNA, 140 bp, Artificial Sequence
  Synthetic
atggccgactcccaagtacgactatcaaaaatataactcctattacatttatattttaaactactaacaaaatataaacaattttatcttaatcatttaattaacttatattatccaaaaggagacccagcatggcgtat

SEQ ID NO: 376729 - DNA, 140 bp, Artificial Sequence
  Synthetic
aggccctggctgctgatatgttgttagtagtttaaaatataaatgtaataggagttatatttttgatagtattataattaattgttattaagtaatttaaattaaaagtgatgaagattagaccttttgggacagcggtg

SEQ ID NO: 376730 - DNA, 140 bp, Artificial Sequence
  Synthetic
caccgctgtcccaaaaggtctaatcttcatcacttttaatttaaattacttaataacaattaattataatactatcaaaaatataactcctattacatttatattttaaactactaacaacatatcagcagccagggcct

SEQ ID NO: 376731 - DNA, 140 bp, Artificial Sequence
  Synthetic
atacgccatgctgggtctccgtaaatgttgagtaaaattgttaaaaatatgaggtgggttatattgtttattgttttttttgaatatatggaggttatatattttgttaggttaaatttacgtacttgggagtcggccat

SEQ ID NO: 376732 - DNA, 140 bp, Artificial Sequence
  Synthetic
atggccgactcccaagtacgtaaatttaacctaacaaaatatataacctccatatattcaaaaaaaacaataaacaatataacccacctcatatttttaacaattttactcaacatttacggagacccagcatggcgtat

SEQ ID NO: 376733 - DNA, 140 bp, Artificial Sequence
  Synthetic
aggccctggctgctgatatgttgttttttttgaatatatggaggttatatattttgttaggttaaatttaataattgttagaggtggtaatagtaatataggttttttgatattggagttgaccttttgggacagcggtg

SEQ ID NO: 376734 - DNA, 140 bp, Artificial Sequence
  Synthetic
caccgctgtcccaaaaggtcaactccaatatcaaaaaacctatattactattaccacctctaacaattattaaatttaacctaacaaaatatataacctccatatattcaaaaaaaacaacatatcagcagccagggcct

SEQ ID NO: 376735 - DNA, 140 bp, Artificial Sequence
  Synthetic
atacgccatgctgggtctccttattgattatgttagttatatattaggtagtgtgttattagtatttatttttgaagttatggtgaatgttatattgggttttaaagtgttaatgaagtacgtacttgggagtcggccat

SEQ ID NO: 376736 - DNA, 140 bp, Artificial Sequence
  Synthetic
atggccgactcccaagtacgtacttcattaacactttaaaacccaatataacattcaccataacttcaaaaataaatactaataacacactacctaatatataactaacataatcaataaggagacccagcatggcgtat

SEQ ID NO: 376737 - DNA, 140 bp, Artificial Sequence
  Synthetic
aggccctggctgctgatatgtttgaagttatggtgaatgttatattgggttttaaagtgttaatgaagtaaattttaatttggttttttttaggtgttgttgattaaaagatttatagttgaccttttgggacagcggtg

SEQ ID NO: 376738 - DNA, 140 bp, Artificial Sequence
  Synthetic
caccgctgtcccaaaaggtcaactataaatcttttaatcaacaacacctaaaaaaaaccaaattaaaatttacttcattaacactttaaaacccaatataacattcaccataacttcaaacatatcagcagccagggcct

SEQ ID NO: 376739 - DNA, 140 bp, Artificial Sequence
  Synthetic
atacgccatgctgggtctcctttggtaaggtaattaatttatttgttagagttaattggttgggttttggaattttggattatttttttaggtttttgtgaattggaaattaggttttttcgtacttgggagtcggccat

SEQ ID NO: 376740 - DNA, 140 bp, Artificial Sequence
  Synthetic
atggccgactcccaagtacgaaaaaacctaatttccaattcacaaaaacctaaaaaaataatccaaaattccaaaacccaaccaattaactctaacaaataaattaattaccttaccaaaggagacccagcatggcgtat

SEQ ID NO: 376741 - DNA, 140 bp, Artificial Sequence
  Synthetic
aggccctggctgctgatatgaattttggattatttttttaggtttttgtgaattggaaattaggtttttttttaggagtttgtttttttgttagtttaattattttagtattttatttttgaccttttgggacagcggtg

SEQ ID NO: 376742 - DNA, 140 bp, Artificial Sequence
  Synthetic
caccgctgtcccaaaaggtcaaaaataaaatactaaaataattaaactaacaaaaaaacaaactcctaaaaaaaaacctaatttccaattcacaaaaacctaaaaaaataatccaaaattcatatcagcagccagggcct

SEQ ID NO: 376743 - DNA, 140 bp, Artificial Sequence
  Synthetic
atacgccatgctgggtctccgattgatgatattttaataggattaaatggagtgttgtgtttaggaattttattttatttaaaattttgttttatttttttatttaataaaagtgggaagcgtacttgggagtcggccat

SEQ ID NO: 376744 - DNA, 140 bp, Artificial Sequence
  Synthetic
atggccgactcccaagtacgcttcccacttttattaaataaaaaaataaaacaaaattttaaataaaataaaattcctaaacacaacactccatttaatcctattaaaatatcatcaatcggagacccagcatggcgtat

SEQ ID NO: 376745 - DNA, 140 bp, Artificial Sequence
  Synthetic
aggccctggctgctgatatgtattttatttaaaattttgttttatttttttatttaataaaagtgggaagaaggggaatagtgttgatttaatatttttggagaaaatttaagtaataatgaccttttgggacagcggtg

SEQ ID NO: 376746 - DNA, 140 bp, Artificial Sequence
  Synthetic
caccgctgtcccaaaaggtcattattacttaaattttctccaaaaatattaaatcaacactattccccttcttcccacttttattaaataaaaaaataaaacaaaattttaaataaaatacatatcagcagccagggcct

SEQ ID NO: 376747 - DNA, 140 bp, Artificial Sequence
  Synthetic
atacgccatgctgggtctccttatgggaattgaagtgttagaaattttggtttataagttgattggtaagaaggtgatttttaaaaatggataattaattatttttgtttttttgttaaacgtacttgggagtcggccat

SEQ ID NO: 376748 - DNA, 140 bp, Artificial Sequence
  Synthetic
atggccgactcccaagtacgtttaacaaaaaaacaaaaataattaattatccatttttaaaaatcaccttcttaccaatcaacttataaaccaaaatttctaacacttcaattcccataaggagacccagcatggcgtat

SEQ ID NO: 376749 - DNA, 140 bp, Artificial Sequence
  Synthetic
aggccctggctgctgatatgaaggtgatttttaaaaatggataattaattatttttgtttttttgttaaagtatattgggttggatttggtggttttaggagattttattatggtaattagaccttttgggacagcggtg

SEQ ID NO: 376750 - DNA, 140 bp, Artificial Sequence
  Synthetic
caccgctgtcccaaaaggtctaattaccataataaaatctcctaaaaccaccaaatccaacccaatatactttaacaaaaaaacaaaaataattaattatccatttttaaaaatcaccttcatatcagcagccagggcct

SEQ ID NO: 376751 - DNA, 140 bp, Artificial Sequence
  Synthetic
atacgccatgctgggtctccgagaagtaattgtaataattgatttagatttagttttatagaatttttttagggatagtgataatatttatttagtaatttgtttattagaggagatattcgtacttgggagtcggccat

SEQ ID NO: 376752 - DNA, 140 bp, Artificial Sequence
  Synthetic
atggccgactcccaagtacgaatatctcctctaataaacaaattactaaataaatattatcactatccctaaaaaaattctataaaactaaatctaaatcaattattacaattacttctcggagacccagcatggcgtat

SEQ ID NO: 376753 - DNA, 140 bp, Artificial Sequence
  Synthetic
aggccctggctgctgatatgagggatagtgataatatttatttagtaatttgtttattagaggagatatttttaattgattaatatattaaaggtgttttatattattgtttttttttttgaccttttgggacagcggtg

SEQ ID NO: 376754 - DNA, 140 bp, Artificial Sequence
  Synthetic
caccgctgtcccaaaaggtcaaaaaaaaaaacaataatataaaacacctttaatatattaatcaattaaaaatatctcctctaataaacaaattactaaataaatattatcactatccctcatatcagcagccagggcct

SEQ ID NO: 376755 - DNA, 140 bp, Artificial Sequence
  Synthetic
atacgccatgctgggtctccgattgattgatgaaagattataattaataatattataaataattttattataattaatatggtgatttaaatgttaattttttttattgtatatatttttcgtacttgggagtcggccat

SEQ ID NO: 376756 - DNA, 140 bp, Artificial Sequence
  Synthetic
atggccgactcccaagtacgaaaaatatatacaataaaaaaaattaacatttaaatcaccatattaattataataaaattatttataatattattaattataatctttcatcaatcaatcggagacccagcatggcgtat

SEQ ID NO: 376757 - DNA, 140 bp, Artificial Sequence
  Synthetic
aggccctggctgctgatatgtaattaatatggtgatttaaatgttaattttttttattgtatatattttttgtttttatttttaaattgtttgtatgtttatatttgaggatagttagtggaccttttgggacagcggtg

SEQ ID NO: 376758 - DNA, 140 bp, Artificial Sequence
  Synthetic
caccgctgtcccaaaaggtccactaactatcctcaaatataaacatacaaacaatttaaaaataaaaacaaaaaatatatacaataaaaaaaattaacatttaaatcaccatattaattacatatcagcagccagggcct

SEQ ID NO: 376759 - DNA, 140 bp, Artificial Sequence
  Synthetic
atacgccatgctgggtctcctttataatttaagtatagatattgtttttttaattaagaaaaaattggtgatgaagattaagttgatagtgagtgtaatttttattttttttagattattcgtacttgggagtcggccat

SEQ ID NO: 376760 - DNA, 140 bp, Artificial Sequence
  Synthetic
atggccgactcccaagtacgaataatctaaaaaaaataaaaattacactcactatcaacttaatcttcatcaccaattttttcttaattaaaaaaacaatatctatacttaaattataaaggagacccagcatggcgtat

SEQ ID NO: 376761 - DNA, 140 bp, Artificial Sequence
  Synthetic
aggccctggctgctgatatgatgaagattaagttgatagtgagtgtaatttttattttttttagattatttgttttttagagtaggggttgttaggttttttttaattgtgtaattaaaagaccttttgggacagcggtg

SEQ ID NO: 376762 - DNA, 140 bp, Artificial Sequence
  Synthetic
caccgctgtcccaaaaggtcttttaattacacaattaaaaaaaacctaacaacccctactctaaaaaacaaataatctaaaaaaaataaaaattacactcactatcaacttaatcttcatcatatcagcagccagggcct

SEQ ID NO: 376763 - DNA, 140 bp, Artificial Sequence
  Synthetic
atacgccatgctgggtctccggaatattgtagttattttgtgattgatttaagaggatattattttttttttgggtaattatttttttttaaagaatattttttattttatttggagttacgtacttgggagtcggccat

SEQ ID NO: 376764 - DNA, 140 bp, Artificial Sequence
  Synthetic
atggccgactcccaagtacgtaactccaaataaaataaaaaatattctttaaaaaaaaataattacccaaaaaaaaaataatatcctcttaaatcaatcacaaaataactacaatattccggagacccagcatggcgtat

SEQ ID NO: 376765 - DNA, 140 bp, Artificial Sequence
  Synthetic
aggccctggctgctgatatgttgggtaattatttttttttaaagaatattttttattttatttggagttatttataatagtatattataggttagtgatgttgataaattagtttgttgtgaccttttgggacagcggtg

SEQ ID NO: 376766 - DNA, 140 bp, Artificial Sequence
  Synthetic
caccgctgtcccaaaaggtcacaacaaactaatttatcaacatcactaacctataatatactattataaataactccaaataaaataaaaaatattctttaaaaaaaaataattacccaacatatcagcagccagggcct

SEQ ID NO: 376767 - DNA, 140 bp, Artificial Sequence
  Synthetic
atacgccatgctgggtctccagggaatggagtggtaattgatgtgttatttgtaattaaaagatggggttttaggtttggtgttttattaaaggtggttaattatgaagttggtgaatggcgtacttgggagtcggccat

SEQ ID NO: 376768 - DNA, 140 bp, Artificial Sequence
  Synthetic
atggccgactcccaagtacgccattcaccaacttcataattaaccacctttaataaaacaccaaacctaaaaccccatcttttaattacaaataacacatcaattaccactccattccctggagacccagcatggcgtat

SEQ ID NO: 376769 - DNA, 140 bp, Artificial Sequence
  Synthetic
aggccctggctgctgatatgttaggtttggtgttttattaaaggtggttaattatgaagttggtgaatgggttgaaaattgttataattttgaaattaaaaaatttgatgggagtgagtggaccttttgggacagcggtg

SEQ ID NO: 376770 - DNA, 140 bp, Artificial Sequence
  Synthetic
caccgctgtcccaaaaggtccactcactcccatcaaattttttaatttcaaaattataacaattttcaacccattcaccaacttcataattaaccacctttaataaaacaccaaacctaacatatcagcagccagggcct

SEQ ID NO: 376771 - DNA, 140 bp, Artificial Sequence
  Synthetic
atacgccatgctgggtctcctgtataaagtattaggaatgggattgtgtgttggagattttgttttttataaagagggtgttttttttttgtatgattgatttgtttttatagttatttacgtacttgggagtcggccat

SEQ ID NO: 376772 - DNA, 140 bp, Artificial Sequence
  Synthetic
atggccgactcccaagtacgtaaataactataaaaacaaatcaatcatacaaaaaaaaaacaccctctttataaaaaacaaaatctccaacacacaatcccattcctaatactttatacaggagacccagcatggcgtat

SEQ ID NO: 376773 - DNA, 140 bp, Artificial Sequence
  Synthetic
aggccctggctgctgatatgaaagagggtgttttttttttgtatgattgatttgtttttatagttatttattgaggaatgatttttgttgaaggtgttgttgtatttttgatattgttttgaccttttgggacagcggtg

SEQ ID NO: 376774 - DNA, 140 bp, Artificial Sequence
  Synthetic
caccgctgtcccaaaaggtcaaaacaatatcaaaaatacaacaacaccttcaacaaaaatcattcctcaataaataactataaaaacaaatcaatcatacaaaaaaaaaacaccctctttcatatcagcagccagggcct

SEQ ID NO: 376775 - DNA, 140 bp, Artificial Sequence
  Synthetic
atacgccatgctgggtctccgtaatggaggatttgtttagtggttattattttattataattagatattaggttattggttttggaattaatgagatagagtatttgtttgaggttgatacgtacttgggagtcggccat

SEQ ID NO: 376776 - DNA, 140 bp, Artificial Sequence
  Synthetic
atggccgactcccaagtacgtatcaacctcaaacaaatactctatctcattaattccaaaaccaataacctaatatctaattataataaaataataaccactaaacaaatcctccattacggagacccagcatggcgtat

SEQ ID NO: 376777 - DNA, 140 bp, Artificial Sequence
  Synthetic
aggccctggctgctgatatgggttattggttttggaattaatgagatagagtatttgtttgaggttgataatttgatttatgtttaatttgaattaagatttatattatagtttttgtttgaccttttgggacagcggtg

SEQ ID NO: 376778 - DNA, 140 bp, Artificial Sequence
  Synthetic
caccgctgtcccaaaaggtcaaacaaaaactataatataaatcttaattcaaattaaacataaatcaaattatcaacctcaaacaaatactctatctcattaattccaaaaccaataacccatatcagcagccagggcct

SEQ ID NO: 376779 - DNA, 140 bp, Artificial Sequence
  Synthetic
atacgccatgctgggtctccaaaattaatttggaaggttaattttgaaattgatataataattggggagtgggttttttgggaaattaaaaaaattttattagaaaaatttgtagtgaagcgtacttgggagtcggccat

SEQ ID NO: 376780 - DNA, 140 bp, Artificial Sequence
  Synthetic
atggccgactcccaagtacgcttcactacaaatttttctaataaaatttttttaatttcccaaaaaacccactccccaattattatatcaatttcaaaattaaccttccaaattaattttggagacccagcatggcgtat

SEQ ID NO: 376781 - DNA, 140 bp, Artificial Sequence
  Synthetic
aggccctggctgctgatatggggttttttgggaaattaaaaaaattttattagaaaaatttgtagtgaagagttgttttttatagttgtattaaatggagttaaaaatattagtggttaggaccttttgggacagcggtg

SEQ ID NO: 376782 - DNA, 140 bp, Artificial Sequence
  Synthetic
caccgctgtcccaaaaggtcctaaccactaatatttttaactccatttaatacaactataaaaaacaactcttcactacaaatttttctaataaaatttttttaatttcccaaaaaaccccatatcagcagccagggcct

SEQ ID NO: 376783 - DNA, 140 bp, Artificial Sequence
  Synthetic
atacgccatgctgggtctccttataaaattatggttttagaaaatttttttgtaatggtttaagtgtatagttaaggaagggaagttgtagtgttgtatttaataatttttgttataattcgtacttgggagtcggccat

SEQ ID NO: 376784 - DNA, 140 bp, Artificial Sequence
  Synthetic
atggccgactcccaagtacgaattataacaaaaattattaaatacaacactacaacttcccttccttaactatacacttaaaccattacaaaaaaattttctaaaaccataattttataaggagacccagcatggcgtat

SEQ ID NO: 376785 - DNA, 140 bp, Artificial Sequence
  Synthetic
aggccctggctgctgatatggttaaggaagggaagttgtagtgttgtatttaataatttttgttataatttttatgagtttttaattttttataattaaattaggtttggataatagtatgaccttttgggacagcggtg

SEQ ID NO: 376786 - DNA, 140 bp, Artificial Sequence
  Synthetic
caccgctgtcccaaaaggtcatactattatccaaacctaatttaattataaaaaattaaaaactcataaaaattataacaaaaattattaaatacaacactacaacttcccttccttaaccatatcagcagccagggcct

SEQ ID NO: 376787 - DNA, 140 bp, Artificial Sequence
  Synthetic
atacgccatgctgggtctccaataatattattgtagaatagataatgatagtatagtttttgatattttttttgttatgattgtagttggatttttaaaagtagagaatattaatatgagcgtacttgggagtcggccat

SEQ ID NO: 376788 - DNA, 140 bp, Artificial Sequence
  Synthetic
atggccgactcccaagtacgctcatattaatattctctacttttaaaaatccaactacaatcataacaaaaaaaatatcaaaaactatactatcattatctattctacaataatattattggagacccagcatggcgtat

SEQ ID NO: 376789 - DNA, 140 bp, Artificial Sequence
  Synthetic
aggccctggctgctgatatgtttgttatgattgtagttggatttttaaaagtagagaatattaatatgagtaagagtattgattttttggattttgttattataataagtttttaaaattgaccttttgggacagcggtg

SEQ ID NO: 376790 - DNA, 140 bp, Artificial Sequence
  Synthetic
caccgctgtcccaaaaggtcaattttaaaaacttattataataacaaaatccaaaaaatcaatactcttactcatattaatattctctacttttaaaaatccaactacaatcataacaaacatatcagcagccagggcct

SEQ ID NO: 376791 - DNA, 140 bp, Artificial Sequence
  Synthetic
atacgccatgctgggtctccgagagtgttagtagtgggaagttaggtttaattattaatattattgttggagttgtaggattgattataggtgggagaagaatttgaagagaagtaattgcgtacttgggagtcggccat

SEQ ID NO: 376792 - DNA, 140 bp, Artificial Sequence
  Synthetic
atggccgactcccaagtacgcaattacttctcttcaaattcttctcccacctataatcaatcctacaactccaacaataatattaataattaaacctaacttcccactactaacactctcggagacccagcatggcgtat

SEQ ID NO: 376793 - DNA, 140 bp, Artificial Sequence
  Synthetic
aggccctggctgctgatatgagttgtaggattgattataggtgggagaagaatttgaagagaagtaattgttaatgtttaatttaaatgtaattttaatttatattattggattatttaggaccttttgggacagcggtg

SEQ ID NO: 376794 - DNA, 140 bp, Artificial Sequence
  Synthetic
caccgctgtcccaaaaggtcctaaataatccaataatataaattaaaattacatttaaattaaacattaacaattacttctcttcaaattcttctcccacctataatcaatcctacaactcatatcagcagccagggcct

SEQ ID NO: 376795 - DNA, 140 bp, Artificial Sequence
  Synthetic
atacgccatgctgggtctccagttgagggaatttatatagaggggttaatgtataattaagatggtttaatttgtgggttgagatagttggttaatgagatgatttaagttttttaattgcgtacttgggagtcggccat

SEQ ID NO: 376796 - DNA, 140 bp, Artificial Sequence
  Synthetic
atggccgactcccaagtacgcaattaaaaaacttaaatcatctcattaaccaactatctcaacccacaaattaaaccatcttaattatacattaacccctctatataaattccctcaactggagacccagcatggcgtat

SEQ ID NO: 376797 - DNA, 140 bp, Artificial Sequence
  Synthetic
aggccctggctgctgatatgtttgtgggttgagatagttggttaatgagatgatttaagttttttaattgtttttgagagttataattgagttatgtatttttttaatttttaattgtaagaccttttgggacagcggtg

SEQ ID NO: 376798 - DNA, 140 bp, Artificial Sequence
  Synthetic
caccgctgtcccaaaaggtcttacaattaaaaattaaaaaaatacataactcaattataactctcaaaaacaattaaaaaacttaaatcatctcattaaccaactatctcaacccacaaacatatcagcagccagggcct

SEQ ID NO: 376799 - DNA, 140 bp, Artificial Sequence
  Synthetic
atacgccatgctgggtctccgattggattgttgtattgaattatatgattggattaagaatataatagataaaattgattagattatttatgattttgttgataaaatttttttggattacgtacttgggagtcggccat

SEQ ID NO: 376800 - DNA, 140 bp, Artificial Sequence
  Synthetic
atggccgactcccaagtacgtaatccaaaaaaattttatcaacaaaatcataaataatctaatcaattttatctattatattcttaatccaatcatataattcaatacaacaatccaatcggagacccagcatggcgtat

SEQ ID NO: 376801 - DNA, 140 bp, Artificial Sequence
  Synthetic
aggccctggctgctgatatgaaaattgattagattatttatgattttgttgataaaatttttttggattagggggataatgataattggtggataggatggagataatggatattggtaggaccttttgggacagcggtg

SEQ ID NO: 376802 - DNA, 140 bp, Artificial Sequence
  Synthetic
caccgctgtcccaaaaggtcctaccaatatccattatctccatcctatccaccaattatcattatccccctaatccaaaaaaattttatcaacaaaatcataaataatctaatcaattttcatatcagcagccagggcct

SEQ ID NO: 376803 - DNA, 140 bp, Artificial Sequence
  Synthetic
atacgccatgctgggtctcctgtaaatttgttttttagtttttttttagattgttttatggaaaagtttagttttaaattaatgaaattaggatttaattatatggattatttgaatttacgtacttgggagtcggccat

SEQ ID NO: 376804 - DNA, 140 bp, Artificial Sequence
  Synthetic
atggccgactcccaagtacgtaaattcaaataatccatataattaaatcctaatttcattaatttaaaactaaacttttccataaaacaatctaaaaaaaaactaaaaaacaaatttacaggagacccagcatggcgtat

SEQ ID NO: 376805 - DNA, 140 bp, Artificial Sequence
  Synthetic
aggccctggctgctgatatggttttaaattaatgaaattaggatttaattatatggattatttgaatttaagattatttgataaatgataatataatatattggagttttaaatatagttgaccttttgggacagcggtg

SEQ ID NO: 376806 - DNA, 140 bp, Artificial Sequence
  Synthetic
caccgctgtcccaaaaggtcaactatatttaaaactccaatatattatattatcatttatcaaataatcttaaattcaaataatccatataattaaatcctaatttcattaatttaaaaccatatcagcagccagggcct

SEQ ID NO: 376807 - DNA, 140 bp, Artificial Sequence
  Synthetic
atacgccatgctgggtctccatattaatttagttatttttttgagaatgataaatttgatgaagattaagaaaaaggtaattttttgattatttttaatttttatttttgattttataatcgtacttgggagtcggccat

SEQ ID NO: 376808 - DNA, 140 bp, Artificial Sequence
  Synthetic
atggccgactcccaagtacgattataaaatcaaaaataaaaattaaaaataatcaaaaaattacctttttcttaatcttcatcaaatttatcattctcaaaaaaataactaaattaatatggagacccagcatggcgtat

SEQ ID NO: 376809 - DNA, 140 bp, Artificial Sequence
  Synthetic
aggccctggctgctgatatgaaaaaggtaattttttgattatttttaatttttatttttgattttataattatgatagttgtttttagtgataagggaaagaagtttttttattaagttggaccttttgggacagcggtg

SEQ ID NO: 376810 - DNA, 140 bp, Artificial Sequence
  Synthetic
caccgctgtcccaaaaggtccaacttaataaaaaaacttctttcccttatcactaaaaacaactatcataattataaaatcaaaaataaaaattaaaaataatcaaaaaattacctttttcatatcagcagccagggcct

SEQ ID NO: 376811 - DNA, 140 bp, Artificial Sequence
  Synthetic
atacgccatgctgggtctcctaaagtattggttaaaaagttaatagaaatttaaatagtgagtggagataatttttaaatggaagttttatatgagagaggatgtttatgagttgttagacgtacttgggagtcggccat

SEQ ID NO: 376812 - DNA, 140 bp, Artificial Sequence
  Synthetic
atggccgactcccaagtacgtctaacaactcataaacatcctctctcatataaaacttccatttaaaaattatctccactcactatttaaatttctattaactttttaaccaatactttaggagacccagcatggcgtat

SEQ ID NO: 376813 - DNA, 140 bp, Artificial Sequence
  Synthetic
aggccctggctgctgatatgatttttaaatggaagttttatatgagagaggatgtttatgagttgttagatagtatttaagggatggatatgattattatgtttgagtatgattattattgaccttttgggacagcggtg

SEQ ID NO: 376814 - DNA, 140 bp, Artificial Sequence
  Synthetic
caccgctgtcccaaaaggtcaataataatcatactcaaacataataatcatatccatcccttaaatactatctaacaactcataaacatcctctctcatataaaacttccatttaaaaatcatatcagcagccagggcct

SEQ ID NO: 376815 - DNA, 140 bp, Artificial Sequence
  Synthetic
atacgccatgctgggtctcctgtgtgtttttattgtattttataagaagagagttgaattattaatagtttttttagtatttaaagatatatgtttgattttgaaaaaaggatttttgtgcgtacttgggagtcggccat

SEQ ID NO: 376816 - DNA, 140 bp, Artificial Sequence
  Synthetic
atggccgactcccaagtacgcacaaaaatccttttttcaaaatcaaacatatatctttaaatactaaaaaaactattaataattcaactctcttcttataaaatacaataaaaacacacaggagacccagcatggcgtat

SEQ ID NO: 376817 - DNA, 140 bp, Artificial Sequence
  Synthetic
aggccctggctgctgatatgtttttagtatttaaagatatatgtttgattttgaaaaaaggatttttgtgtgatagtagtttttgtaaaaaagattattagttggagagtttaattgatagaccttttgggacagcggtg

SEQ ID NO: 376818 - DNA, 140 bp, Artificial Sequence
  Synthetic
caccgctgtcccaaaaggtctatcaattaaactctccaactaataatcttttttacaaaaactactatcacacaaaaatccttttttcaaaatcaaacatatatctttaaatactaaaaacatatcagcagccagggcct

SEQ ID NO: 376819 - DNA, 140 bp, Artificial Sequence
  Synthetic
atacgccatgctgggtctcctaattaaatataattgtatttaaggatttgtgtttagtaaatttaatggttgatgatttttagtaagaggaaggtttaaaaattattttgttgatattgacgtacttgggagtcggccat

SEQ ID NO: 376820 - DNA, 140 bp, Artificial Sequence
  Synthetic
atggccgactcccaagtacgtcaatatcaacaaaataatttttaaaccttcctcttactaaaaatcatcaaccattaaatttactaaacacaaatccttaaatacaattatatttaattaggagacccagcatggcgtat

SEQ ID NO: 376821 - DNA, 140 bp, Artificial Sequence
  Synthetic
aggccctggctgctgatatgtgatgatttttagtaagaggaaggtttaaaaattattttgttgatattgattaagatggtagaatattgggtgagataagatattagaattatagaggatgaccttttgggacagcggtg

SEQ ID NO: 376822 - DNA, 140 bp, Artificial Sequence
  Synthetic
caccgctgtcccaaaaggtcatcctctataattctaatatcttatctcacccaatattctaccatcttaatcaatatcaacaaaataatttttaaaccttcctcttactaaaaatcatcacatatcagcagccagggcct

SEQ ID NO: 376823 - DNA, 140 bp, Artificial Sequence
  Synthetic
atacgccatgctgggtctcctttaaaattttagttgagttttttatgtgagatatatttaaggtgtgaggggtttgggtaagattaggtagaatttgtttttgaagtatattaatgattacgtacttgggagtcggccat

SEQ ID NO: 376824 - DNA, 140 bp, Artificial Sequence
  Synthetic
atggccgactcccaagtacgtaatcattaatatacttcaaaaacaaattctacctaatcttacccaaacccctcacaccttaaatatatctcacataaaaaactcaactaaaattttaaaggagacccagcatggcgtat

SEQ ID NO: 376825 - DNA, 140 bp, Artificial Sequence
  Synthetic
aggccctggctgctgatatgggtttgggtaagattaggtagaatttgtttttgaagtatattaatgattatatagtgataaaggaggtagttttgaagttgtattatggtaataatgggagaccttttgggacagcggtg

SEQ ID NO: 376826 - DNA, 140 bp, Artificial Sequence
  Synthetic
caccgctgtcccaaaaggtctcccattattaccataatacaacttcaaaactacctcctttatcactatataatcattaatatacttcaaaaacaaattctacctaatcttacccaaacccatatcagcagccagggcct

SEQ ID NO: 376827 - DNA, 140 bp, Artificial Sequence
  Synthetic
atacgccatgctgggtctccagttattgtgtgaaagttttgttgttgttgttttagggttaagaatattggttttttaattagataatgaggaagttttaattaatttggggatatgtttcgtacttgggagtcggccat

SEQ ID NO: 376828 - DNA, 140 bp, Artificial Sequence
  Synthetic
atggccgactcccaagtacgaaacatatccccaaattaattaaaacttcctcattatctaattaaaaaaccaatattcttaaccctaaaacaacaacaacaaaactttcacacaataactggagacccagcatggcgtat

SEQ ID NO: 376829 - DNA, 140 bp, Artificial Sequence
  Synthetic
aggccctggctgctgatatggttttttaattagataatgaggaagttttaattaatttggggatatgtttatggtttgatgagggtattttttaataaggttgattaaaatattatataagaccttttgggacagcggtg

SEQ ID NO: 376830 - DNA, 140 bp, Artificial Sequence
  Synthetic
caccgctgtcccaaaaggtcttatataatattttaatcaaccttattaaaaaataccctcatcaaaccataaacatatccccaaattaattaaaacttcctcattatctaattaaaaaaccatatcagcagccagggcct

SEQ ID NO: 376831 - DNA, 140 bp, Artificial Sequence
  Synthetic
atacgccatgctgggtctccaagatgatattttttaaaatttatttagtattataattatttttgttttaaattaataagatgtgtatgattgttttaatatatgaagaggtatgatatacgtacttgggagtcggccat

SEQ ID NO: 376832 - DNA, 140 bp, Artificial Sequence
  Synthetic
atggccgactcccaagtacgtatatcatacctcttcatatattaaaacaatcatacacatcttattaatttaaaacaaaaataattataatactaaataaattttaaaaaatatcatcttggagacccagcatggcgtat

SEQ ID NO: 376833 - DNA, 140 bp, Artificial Sequence
  Synthetic
aggccctggctgctgatatgaattaataagatgtgtatgattgttttaatatatgaagaggtatgatataattttaatagtgattaaagaaaattataattttgtattgtttgtaatatagaccttttgggacagcggtg

SEQ ID NO: 376834 - DNA, 140 bp, Artificial Sequence
  Synthetic
caccgctgtcccaaaaggtctatattacaaacaatacaaaattataattttctttaatcactattaaaattatatcatacctcttcatatattaaaacaatcatacacatcttattaattcatatcagcagccagggcct

SEQ ID NO: 376835 - DNA, 140 bp, Artificial Sequence
  Synthetic
atacgccatgctgggtctccttttattttataggaggtagtaatgatttattttattaaaaaataagtattttatgatttattaatgattttttaaaatattaagaaaaattgatggaatcgtacttgggagtcggccat

SEQ ID NO: 376836 - DNA, 140 bp, Artificial Sequence
  Synthetic
atggccgactcccaagtacgattccatcaatttttcttaatattttaaaaaatcattaataaatcataaaatacttattttttaataaaataaatcattactacctcctataaaataaaaggagacccagcatggcgtat

SEQ ID NO: 376837 - DNA, 140 bp, Artificial Sequence
  Synthetic
aggccctggctgctgatatgtttatgatttattaatgattttttaaaatattaagaaaaattgatggaatataaattttttatgttttaagttgtggaggaggtgtttggtattggttatgaccttttgggacagcggtg

SEQ ID NO: 376838 - DNA, 140 bp, Artificial Sequence
  Synthetic
caccgctgtcccaaaaggtcataaccaataccaaacacctcctccacaacttaaaacataaaaaatttatattccatcaatttttcttaatattttaaaaaatcattaataaatcataaacatatcagcagccagggcct

SEQ ID NO: 376839 - DNA, 140 bp, Artificial Sequence
  Synthetic
atacgccatgctgggtctccagaggtagattgtgattggaaatgttaaattaatgatgaagattaatgtggaggtttgataagaataaattttattatttagattaggttttaagaggtacgtacttgggagtcggccat

SEQ ID NO: 376840 - DNA, 140 bp, Artificial Sequence
  Synthetic
atggccgactcccaagtacgtacctcttaaaacctaatctaaataataaaatttattcttatcaaacctccacattaatcttcatcattaatttaacatttccaatcacaatctacctctggagacccagcatggcgtat

SEQ ID NO: 376841 - DNA, 140 bp, Artificial Sequence
  Synthetic
aggccctggctgctgatatggaggtttgataagaataaattttattatttagattaggttttaagaggtattttttatttttttttagtaaagtattattttagggtagtttaattagtggaccttttgggacagcggtg

SEQ ID NO: 376842 - DNA, 140 bp, Artificial Sequence
  Synthetic
caccgctgtcccaaaaggtccactaattaaactaccctaaaataatactttactaaaaaaaaataaaaaatacctcttaaaacctaatctaaataataaaatttattcttatcaaacctccatatcagcagccagggcct

SEQ ID NO: 376843 - DNA, 140 bp, Artificial Sequence
  Synthetic
atacgccatgctgggtctccgtttttaagttaaattggtttgtatatattttatatattgtattaggggtaataatatttaattgaatttagttgtttaaaatttagtgtataaatttggcgtacttgggagtcggccat

SEQ ID NO: 376844 - DNA, 140 bp, Artificial Sequence
  Synthetic
atggccgactcccaagtacgccaaatttatacactaaattttaaacaactaaattcaattaaatattattacccctaatacaatatataaaatatatacaaaccaatttaacttaaaaacggagacccagcatggcgtat

SEQ ID NO: 376845 - DNA, 140 bp, Artificial Sequence
  Synthetic
aggccctggctgctgatatgaataatatttaattgaatttagttgtttaaaatttagtgtataaatttgggttaatattattaggttaattttattggttgaaaagaagtttatttataagaccttttgggacagcggtg

SEQ ID NO: 376846 - DNA, 140 bp, Artificial Sequence
  Synthetic
caccgctgtcccaaaaggtcttataaataaacttcttttcaaccaataaaattaacctaataatattaacccaaatttatacactaaattttaaacaactaaattcaattaaatattattcatatcagcagccagggcct

SEQ ID NO: 376847 - DNA, 140 bp, Artificial Sequence
  Synthetic
atacgccatgctgggtctccaataattgagtgtaaggttttaaggttgaattgagagtgtttagataataaaatattgatattttagatattaagtaagatttgagaaaaaattatggttcgtacttgggagtcggccat

SEQ ID NO: 376848 - DNA, 140 bp, Artificial Sequence
  Synthetic
atggccgactcccaagtacgaaccataattttttctcaaatcttacttaatatctaaaatatcaatattttattatctaaacactctcaattcaaccttaaaaccttacactcaattattggagacccagcatggcgtat

SEQ ID NO: 376849 - DNA, 140 bp, Artificial Sequence
  Synthetic
aggccctggctgctgatatgaaatattgatattttagatattaagtaagatttgagaaaaaattatggttaaagttatgggatgatataatttaatattgtttaaaaaggatttggagaagaccttttgggacagcggtg

SEQ ID NO: 376850 - DNA, 140 bp, Artificial Sequence
  Synthetic
caccgctgtcccaaaaggtcttctccaaatcctttttaaacaatattaaattatatcatcccataactttaaccataattttttctcaaatcttacttaatatctaaaatatcaatatttcatatcagcagccagggcct

SEQ ID NO: 376851 - DNA, 140 bp, Artificial Sequence
  Synthetic
atacgccatgctgggtctccaggggtggaaggtttattgggttggtattgagtttgatgtgatttataaaggaatggttttattgtatagattgaaaattaatgattttgtttttgtatgcgtacttgggagtcggccat

SEQ ID NO: 376852 - DNA, 140 bp, Artificial Sequence
  Synthetic
atggccgactcccaagtacgcatacaaaaacaaaatcattaattttcaatctatacaataaaaccattcctttataaatcacatcaaactcaataccaacccaataaaccttccacccctggagacccagcatggcgtat

SEQ ID NO: 376853 - DNA, 140 bp, Artificial Sequence
  Synthetic
aggccctggctgctgatatgggaatggttttattgtatagattgaaaattaatgattttgtttttgtatggttaatgataaggaatttttttttttatttattttaaaatttgaattttagaccttttgggacagcggtg

SEQ ID NO: 376854 - DNA, 140 bp, Artificial Sequence
  Synthetic
caccgctgtcccaaaaggtctaaaattcaaattttaaaataaataaaaaaaaaaattccttatcattaaccatacaaaaacaaaatcattaattttcaatctatacaataaaaccattcccatatcagcagccagggcct

SEQ ID NO: 376855 - DNA, 140 bp, Artificial Sequence
  Synthetic
atacgccatgctgggtctcctaggattagttgattgattagtttttgattgaatttttagtaggagtttttggtttgatttttgattggttgttaataattaatattaattattttaatacgtacttgggagtcggccat

SEQ ID NO: 376856 - DNA, 140 bp, Artificial Sequence
  Synthetic
atggccgactcccaagtacgtattaaaataattaatattaattattaacaaccaatcaaaaatcaaaccaaaaactcctactaaaaattcaatcaaaaactaatcaatcaactaatcctaggagacccagcatggcgtat

SEQ ID NO: 376857 - DNA, 140 bp, Artificial Sequence
  Synthetic
aggccctggctgctgatatgtggtttgatttttgattggttgttaataattaatattaattattttaatatgtgaatataatgtgttaaggaataattgagtttaaaaatgttgttgttggaccttttgggacagcggtg

SEQ ID NO: 376858 - DNA, 140 bp, Artificial Sequence
  Synthetic
caccgctgtcccaaaaggtccaacaacaacatttttaaactcaattattccttaacacattatattcacatattaaaataattaatattaattattaacaaccaatcaaaaatcaaaccacatatcagcagccagggcct

SEQ ID NO: 376859 - DNA, 140 bp, Artificial Sequence
  Synthetic
atacgccatgctgggtctcctgtgaattataatggattgttgagtagtattgaaattggaatttaaaattatataattattataatttgaattaatatgggttttttggtggagttttaacgtacttgggagtcggccat

SEQ ID NO: 376860 - DNA, 140 bp, Artificial Sequence
  Synthetic
atggccgactcccaagtacgttaaaactccaccaaaaaacccatattaattcaaattataataattatataattttaaattccaatttcaatactactcaacaatccattataattcacaggagacccagcatggcgtat

SEQ ID NO: 376861 - DNA, 140 bp, Artificial Sequence
  Synthetic
aggccctggctgctgatatgatataattattataatttgaattaatatgggttttttggtggagttttaagaatttgataaattggtaatgaattgtatgaagtttgggttggtgaaattgaccttttgggacagcggtg

SEQ ID NO: 376862 - DNA, 140 bp, Artificial Sequence
  Synthetic
caccgctgtcccaaaaggtcaatttcaccaacccaaacttcatacaattcattaccaatttatcaaattcttaaaactccaccaaaaaacccatattaattcaaattataataattatatcatatcagcagccagggcct

SEQ ID NO: 376863 - DNA, 140 bp, Artificial Sequence
  Synthetic
atacgccatgctgggtctcctatgaatgtaaagtttgatttttgaatttaatagtttttttgttatttaattaaggtagaatattttatattgagttaatttatatatgttgatttaatacgtacttgggagtcggccat

SEQ ID NO: 376864 - DNA, 140 bp, Artificial Sequence
  Synthetic
atggccgactcccaagtacgtattaaatcaacatatataaattaactcaatataaaatattctaccttaattaaataacaaaaaaactattaaattcaaaaatcaaactttacattcataggagacccagcatggcgtat

SEQ ID NO: 376865 - DNA, 140 bp, Artificial Sequence
  Synthetic
aggccctggctgctgatatgttaaggtagaatattttatattgagttaatttatatatgttgatttaatagttattttgatatttttgtttttataattagatatataagtataataaatgaccttttgggacagcggtg

SEQ ID NO: 376866 - DNA, 140 bp, Artificial Sequence
  Synthetic
caccgctgtcccaaaaggtcatttattatacttatatatctaattataaaaacaaaaatatcaaaataactattaaatcaacatatataaattaactcaatataaaatattctaccttaacatatcagcagccagggcct

SEQ ID NO: 376867 - DNA, 140 bp, Artificial Sequence
  Synthetic
atacgccatgctgggtctccgtaagttagtttttaagttgatatttttataaaaattaggatttagaattttttaaataagagattttaagataatattatagaattgttttattatatgcgtacttgggagtcggccat

SEQ ID NO: 376868 - DNA, 140 bp, Artificial Sequence
  Synthetic
atggccgactcccaagtacgcatataataaaacaattctataatattatcttaaaatctcttatttaaaaaattctaaatcctaatttttataaaaatatcaacttaaaaactaacttacggagacccagcatggcgtat

SEQ ID NO: 376869 - DNA, 140 bp, Artificial Sequence
  Synthetic
aggccctggctgctgatatgttttaaataagagattttaagataatattatagaattgttttattatatgaataagtattttattattagaaattttatatattaaatggttaattgtaagaccttttgggacagcggtg

SEQ ID NO: 376870 - DNA, 140 bp, Artificial Sequence
  Synthetic
caccgctgtcccaaaaggtcttacaattaaccatttaatatataaaatttctaataataaaatacttattcatataataaaacaattctataatattatcttaaaatctcttatttaaaacatatcagcagccagggcct

SEQ ID NO: 376871 - DNA, 140 bp, Artificial Sequence
  Synthetic
atacgccatgctgggtctccaattttatatttgtaattaatattagataagtagattaagaaaaaagtttgaggaagattaagaaaaattgtttattgggtttttttgtgttttagatgacgtacttgggagtcggccat

SEQ ID NO: 376872 - DNA, 140 bp, Artificial Sequence
  Synthetic
atggccgactcccaagtacgtcatctaaaacacaaaaaaacccaataaacaatttttcttaatcttcctcaaacttttttcttaatctacttatctaatattaattacaaatataaaattggagacccagcatggcgtat

SEQ ID NO: 376873 - DNA, 140 bp, Artificial Sequence
  Synthetic
aggccctggctgctgatatggaggaagattaagaaaaattgtttattgggtttttttgtgttttagatgaagtagttgaaatttttttttttgatattaaatggttatataatatatttagaccttttgggacagcggtg

SEQ ID NO: 376874 - DNA, 140 bp, Artificial Sequence
  Synthetic
caccgctgtcccaaaaggtctaaatatattatataaccatttaatatcaaaaaaaaaaatttcaactacttcatctaaaacacaaaaaaacccaataaacaatttttcttaatcttcctccatatcagcagccagggcct

SEQ ID NO: 376875 - DNA, 140 bp, Artificial Sequence
  Synthetic
atacgccatgctgggtctcctagttattagagtttgtgggttatatttattatatttttttaatttgtaattatgtaattgtaaatttttgaaatatatttattgtttgaaatatgatgtcgtacttgggagtcggccat

SEQ ID NO: 376876 - DNA, 140 bp, Artificial Sequence
  Synthetic
atggccgactcccaagtacgacatcatatttcaaacaataaatatatttcaaaaatttacaattacataattacaaattaaaaaaatataataaatataacccacaaactctaataactaggagacccagcatggcgtat

SEQ ID NO: 376877 - DNA, 140 bp, Artificial Sequence
  Synthetic
aggccctggctgctgatatgttatgtaattgtaaatttttgaaatatatttattgtttgaaatatgatgtaattgttattaagtttttgagtgatgtattagtggtgatattgtttataggaccttttgggacagcggtg

SEQ ID NO: 376878 - DNA, 140 bp, Artificial Sequence
  Synthetic
caccgctgtcccaaaaggtcctataaacaatatcaccactaatacatcactcaaaaacttaataacaattacatcatatttcaaacaataaatatatttcaaaaatttacaattacataacatatcagcagccagggcct

SEQ ID NO: 376879 - DNA, 140 bp, Artificial Sequence
  Synthetic
atacgccatgctgggtctcctttgttgagttgtggtgttaatagtttttagatgaaattattaagtatataatgtaagatgttttttttttgaaatattattttaaaaatgtgggtgtttcgtacttgggagtcggccat

SEQ ID NO: 376880 - DNA, 140 bp, Artificial Sequence
  Synthetic
atggccgactcccaagtacgaaacacccacatttttaaaataatatttcaaaaaaaaaacatcttacattatatacttaataatttcatctaaaaactattaacaccacaactcaacaaaggagacccagcatggcgtat

SEQ ID NO: 376881 - DNA, 140 bp, Artificial Sequence
  Synthetic
aggccctggctgctgatatgaatgtaagatgttttttttttgaaatattattttaaaaatgtgggtgtttaagaagattgtgttgatgaatatttttaagagaaaattttatttttaattgaccttttgggacagcggtg

SEQ ID NO: 376882 - DNA, 140 bp, Artificial Sequence
  Synthetic
caccgctgtcccaaaaggtcaattaaaaataaaattttctcttaaaaatattcatcaacacaatcttcttaaacacccacatttttaaaataatatttcaaaaaaaaaacatcttacattcatatcagcagccagggcct

SEQ ID NO: 376883 - DNA, 140 bp, Artificial Sequence
  Synthetic
atacgccatgctgggtctcctttaatttgaaggggtagattaaattgaggaaattttagattaatatggtttgtttatgatgatttaatagatattttaggttatggggattatgtttttcgtacttgggagtcggccat

SEQ ID NO: 376884 - DNA, 140 bp, Artificial Sequence
  Synthetic
atggccgactcccaagtacgaaaaacataatccccataacctaaaatatctattaaatcatcataaacaaaccatattaatctaaaatttcctcaatttaatctaccccttcaaattaaaggagacccagcatggcgtat

SEQ ID NO: 376885 - DNA, 140 bp, Artificial Sequence
  Synthetic
aggccctggctgctgatatgttgtttatgatgatttaatagatattttaggttatggggattatgttttttggaagattttaattttaatgttattattgaatatataaggaattttttagaccttttgggacagcggtg

SEQ ID NO: 376886 - DNA, 140 bp, Artificial Sequence
  Synthetic
caccgctgtcccaaaaggtctaaaaaattccttatatattcaataataacattaaaattaaaatcttccaaaaaacataatccccataacctaaaatatctattaaatcatcataaacaacatatcagcagccagggcct

SEQ ID NO: 376887 - DNA, 140 bp, Artificial Sequence
  Synthetic
atacgccatgctgggtctccggtatatatatattgtttttgtttttattgttgatgttttgataatgtgtaaagatttaattatatgttgatttaatataattttaattttaaaaatagtcgtacttgggagtcggccat

SEQ ID NO: 376888 - DNA, 140 bp, Artificial Sequence
  Synthetic
atggccgactcccaagtacgactatttttaaaattaaaattatattaaatcaacatataattaaatctttacacattatcaaaacatcaacaataaaaacaaaaacaatatatatataccggagacccagcatggcgtat

SEQ ID NO: 376889 - DNA, 140 bp, Artificial Sequence
  Synthetic
aggccctggctgctgatatgaaagatttaattatatgttgatttaatataattttaattttaaaaatagtagagattgaggatttagtttgttttgattattttaattttaagattgtgtgaccttttgggacagcggtg

SEQ ID NO: 376890 - DNA, 140 bp, Artificial Sequence
  Synthetic
caccgctgtcccaaaaggtcacacaatcttaaaattaaaataatcaaaacaaactaaatcctcaatctctactatttttaaaattaaaattatattaaatcaacatataattaaatctttcatatcagcagccagggcct

SEQ ID NO: 376891 - DNA, 140 bp, Artificial Sequence
  Synthetic
atacgccatgctgggtctccgggtataaaattattaagttttttgaattattgtgtttggttaaaatttaattatgtttaaagtatattgagaggaagggttgatttttaatataaatgtcgtacttgggagtcggccat

SEQ ID NO: 376892 - DNA, 140 bp, Artificial Sequence
  Synthetic
atggccgactcccaagtacgacatttatattaaaaatcaacccttcctctcaatatactttaaacataattaaattttaaccaaacacaataattcaaaaaacttaataattttatacccggagacccagcatggcgtat

SEQ ID NO: 376893 - DNA, 140 bp, Artificial Sequence
  Synthetic
aggccctggctgctgatatgattatgtttaaagtatattgagaggaagggttgatttttaatataaatgtatttagttgtaaattatattttagaagaaattatagaaatgtgtgtattagaccttttgggacagcggtg

SEQ ID NO: 376894 - DNA, 140 bp, Artificial Sequence
  Synthetic
caccgctgtcccaaaaggtctaatacacacatttctataatttcttctaaaatataatttacaactaaatacatttatattaaaaatcaacccttcctctcaatatactttaaacataatcatatcagcagccagggcct

SEQ ID NO: 376895 - DNA, 140 bp, Artificial Sequence
  Synthetic
atacgccatgctgggtctccgttggagatgatgttataataattttgtgagttattttttatttaaaaatattgggggtattttgtgttatatagtgaaatagtaatttaaaaagttaaacgtacttgggagtcggccat

SEQ ID NO: 376896 - DNA, 140 bp, Artificial Sequence
  Synthetic
atggccgactcccaagtacgtttaactttttaaattactatttcactatataacacaaaatacccccaatatttttaaataaaaaataactcacaaaattattataacatcatctccaacggagacccagcatggcgtat

SEQ ID NO: 376897 - DNA, 140 bp, Artificial Sequence
  Synthetic
aggccctggctgctgatatgattgggggtattttgtgttatatagtgaaatagtaatttaaaaagttaaaaaatatgttatggtgttaaaagtattatgttttatagtgatttttgagatgaccttttgggacagcggtg

SEQ ID NO: 376898 - DNA, 140 bp, Artificial Sequence
  Synthetic
caccgctgtcccaaaaggtcatctcaaaaatcactataaaacataatacttttaacaccataacatattttttaactttttaaattactatttcactatataacacaaaatacccccaatcatatcagcagccagggcct

SEQ ID NO: 376899 - DNA, 140 bp, Artificial Sequence
  Synthetic
atacgccatgctgggtctccgattttggtatagtgttattttagataggaatttaatattgggttttaatttttatattaaaagaaattaattttttttgttgttaatgattaaagaattcgtacttgggagtcggccat

SEQ ID NO: 376900 - DNA, 140 bp, Artificial Sequence
  Synthetic
atggccgactcccaagtacgaattctttaatcattaacaacaaaaaaaattaatttcttttaatataaaaattaaaacccaatattaaattcctatctaaaataacactataccaaaatcggagacccagcatggcgtat

SEQ ID NO: 376901 - DNA, 140 bp, Artificial Sequence
  Synthetic
aggccctggctgctgatatgttttatattaaaagaaattaattttttttgttgttaatgattaaagaattattatgggaattttattattttgattattttttattttttttaattaaaagaccttttgggacagcggtg

SEQ ID NO: 376902 - DNA, 140 bp, Artificial Sequence
  Synthetic
caccgctgtcccaaaaggtcttttaattaaaaaaaataaaaaataatcaaaataataaaattcccataataattctttaatcattaacaacaaaaaaaattaatttcttttaatataaaacatatcagcagccagggcct

SEQ ID NO: 376903 - DNA, 140 bp, Artificial Sequence
  Synthetic
atacgccatgctgggtctccaggatatgttgggatgtagtatttgagtttaatgttttaggatataatttattttataaatttagtattaaatgtgtattggaataatttttagagtaagcgtacttgggagtcggccat

SEQ ID NO: 376904 - DNA, 140 bp, Artificial Sequence
  Synthetic
atggccgactcccaagtacgcttactctaaaaattattccaatacacatttaatactaaatttataaaataaattatatcctaaaacattaaactcaaatactacatcccaacatatcctggagacccagcatggcgtat

SEQ ID NO: 376905 - DNA, 140 bp, Artificial Sequence
  Synthetic
aggccctggctgctgatatgattttataaatttagtattaaatgtgtattggaataatttttagagtaagaaaatttttttattgagaatgtttttttttatgtataaaaatttgagtatgaccttttgggacagcggtg

SEQ ID NO: 376906 - DNA, 140 bp, Artificial Sequence
  Synthetic
caccgctgtcccaaaaggtcatactcaaatttttatacataaaaaaaaacattctcaataaaaaaattttcttactctaaaaattattccaatacacatttaatactaaatttataaaatcatatcagcagccagggcct

SEQ ID NO: 376907 - DNA, 140 bp, Artificial Sequence
  Synthetic
atacgccatgctgggtctccgaatgtaggtagaatttttggaaaattgttttatttgatttgtaatgtttaaatattttgtgaagttttgttagttgatggttttgttaaagtattttttcgtacttgggagtcggccat

SEQ ID NO: 376908 - DNA, 140 bp, Artificial Sequence
  Synthetic
atggccgactcccaagtacgaaaaaatactttaacaaaaccatcaactaacaaaacttcacaaaatatttaaacattacaaatcaaataaaacaattttccaaaaattctacctacattcggagacccagcatggcgtat

SEQ ID NO: 376909 - DNA, 140 bp, Artificial Sequence
  Synthetic
aggccctggctgctgatatgaaatattttgtgaagttttgttagttgatggttttgttaaagtattttttagtaatatgatggtagttatggaatgtgagtaaaaagaaagtttattgtagaccttttgggacagcggtg

SEQ ID NO: 376910 - DNA, 140 bp, Artificial Sequence
  Synthetic
caccgctgtcccaaaaggtctacaataaactttctttttactcacattccataactaccatcatattactaaaaaatactttaacaaaaccatcaactaacaaaacttcacaaaatatttcatatcagcagccagggcct

SEQ ID NO: 376911 - DNA, 140 bp, Artificial Sequence
  Synthetic
atacgccatgctgggtctccttagagggagtagttttgtaattgatttagagaaatataattttgtatttagatatgagtttatagtattttttatagaatattgtaattgttgttatggcgtacttgggagtcggccat

SEQ ID NO: 376912 - DNA, 140 bp, Artificial Sequence
  Synthetic
atggccgactcccaagtacgccataacaacaattacaatattctataaaaaatactataaactcatatctaaatacaaaattatatttctctaaatcaattacaaaactactccctctaaggagacccagcatggcgtat

SEQ ID NO: 376913 - DNA, 140 bp, Artificial Sequence
  Synthetic
aggccctggctgctgatatgagatatgagtttatagtattttttatagaatattgtaattgttgttatggtgttaagaatgtttttaattggatgtattatataattttatagtgttatagaccttttgggacagcggtg

SEQ ID NO: 376914 - DNA, 140 bp, Artificial Sequence
  Synthetic
caccgctgtcccaaaaggtctataacactataaaattatataatacatccaattaaaaacattcttaacaccataacaacaattacaatattctataaaaaatactataaactcatatctcatatcagcagccagggcct

SEQ ID NO: 376915 - DNA, 140 bp, Artificial Sequence
  Synthetic
atacgccatgctgggtctcctgagataatttttttgaagggtttagtttatataggggttatatgggagggattgaaggattgtaataaaaattttggataagtattttatgtgtttaaacgtacttgggagtcggccat

SEQ ID NO: 376916 - DNA, 140 bp, Artificial Sequence
  Synthetic
atggccgactcccaagtacgtttaaacacataaaatacttatccaaaatttttattacaatccttcaatccctcccatataacccctatataaactaaacccttcaaaaaaattatctcaggagacccagcatggcgtat

SEQ ID NO: 376917 - DNA, 140 bp, Artificial Sequence
  Synthetic
aggccctggctgctgatatggattgaaggattgtaataaaaattttggataagtattttatgtgtttaaatttttttagttgaaattaagattggttttaagttatgtttagttgtgatggaccttttgggacagcggtg

SEQ ID NO: 376918 - DNA, 140 bp, Artificial Sequence
  Synthetic
caccgctgtcccaaaaggtccatcacaactaaacataacttaaaaccaatcttaatttcaactaaaaaaatttaaacacataaaatacttatccaaaatttttattacaatccttcaatccatatcagcagccagggcct

SEQ ID NO: 376919 - DNA, 140 bp, Artificial Sequence
  Synthetic
atacgccatgctgggtctcctgtagatgagtaggaatagagtgttgaagataatgtagtgagggtggttgttagtttagtaaaagttataagtgtttgtggaatttttttaaaatttgatcgtacttgggagtcggccat

SEQ ID NO: 376920 - DNA, 140 bp, Artificial Sequence
  Synthetic
atggccgactcccaagtacgatcaaattttaaaaaaattccacaaacacttataacttttactaaactaacaaccaccctcactacattatcttcaacactctattcctactcatctacaggagacccagcatggcgtat

SEQ ID NO: 376921 - DNA, 140 bp, Artificial Sequence
  Synthetic
aggccctggctgctgatatgttagtttagtaaaagttataagtgtttgtggaatttttttaaaatttgatgaaatatttgtatatttaggttttatttattttggaaaaaaataatatttgaccttttgggacagcggtg

SEQ ID NO: 376922 - DNA, 140 bp, Artificial Sequence
  Synthetic
caccgctgtcccaaaaggtcaaatattatttttttccaaaataaataaaacctaaatatacaaatatttcatcaaattttaaaaaaattccacaaacacttataacttttactaaactaacatatcagcagccagggcct

SEQ ID NO: 376923 - DNA, 140 bp, Artificial Sequence
  Synthetic
atacgccatgctgggtctcctattgtttgatgtaatttttgatgatttttaagggattttggttagtataggtattgtttttgagtgatttatttttgagatatgatatatttttttttgcgtacttgggagtcggccat

SEQ ID NO: 376924 - DNA, 140 bp, Artificial Sequence
  Synthetic
atggccgactcccaagtacgcaaaaaaaaatatatcatatctcaaaaataaatcactcaaaaacaatacctatactaaccaaaatcccttaaaaatcatcaaaaattacatcaaacaataggagacccagcatggcgtat

SEQ ID NO: 376925 - DNA, 140 bp, Artificial Sequence
  Synthetic
aggccctggctgctgatatgggtattgtttttgagtgatttatttttgagatatgatatatttttttttgtaggataattgtagttttttatatgttttttttggtgagaattttgtaatgaccttttgggacagcggtg

SEQ ID NO: 376926 - DNA, 140 bp, Artificial Sequence
  Synthetic
caccgctgtcccaaaaggtcattacaaaattctcaccaaaaaaaacatataaaaaactacaattatcctacaaaaaaaaatatatcatatctcaaaaataaatcactcaaaaacaatacccatatcagcagccagggcct

SEQ ID NO: 376927 - DNA, 140 bp, Artificial Sequence
  Synthetic
atacgccatgctgggtctccggtaaatttttggattttggaataatattattggtattagtggtattgtaggtgtttggagggttattttttttgaattttgagaaatgtttttattggacgtacttgggagtcggccat

SEQ ID NO: 376928 - DNA, 140 bp, Artificial Sequence
  Synthetic
atggccgactcccaagtacgtccaataaaaacatttctcaaaattcaaaaaaaataaccctccaaacacctacaataccactaataccaataatattattccaaaatccaaaaatttaccggagacccagcatggcgtat

SEQ ID NO: 376929 - DNA, 140 bp, Artificial Sequence
  Synthetic
aggccctggctgctgatatgggtgtttggagggttattttttttgaattttgagaaatgtttttattggaatttaggagatttagttattttaggtttattttagttaaaaatttattttgaccttttgggacagcggtg

SEQ ID NO: 376930 - DNA, 140 bp, Artificial Sequence
  Synthetic
caccgctgtcccaaaaggtcaaaataaatttttaactaaaataaacctaaaataactaaatctcctaaattccaataaaaacatttctcaaaattcaaaaaaaataaccctccaaacacccatatcagcagccagggcct

SEQ ID NO: 376931 - DNA, 140 bp, Artificial Sequence
  Synthetic
atacgccatgctgggtctcctgggaattgtattgttattgattttgtgttaaattttagtggattaaatgtttttgggttgtaagatttaattttatttttgtgttagattgtatgtaggcgtacttgggagtcggccat

SEQ ID NO: 376932 - DNA, 140 bp, Artificial Sequence
  Synthetic
atggccgactcccaagtacgcctacatacaatctaacacaaaaataaaattaaatcttacaacccaaaaacatttaatccactaaaatttaacacaaaatcaataacaatacaattcccaggagacccagcatggcgtat

SEQ ID NO: 376933 - DNA, 140 bp, Artificial Sequence
  Synthetic
aggccctggctgctgatatgtttttgggttgtaagatttaattttatttttgtgttagattgtatgtaggattattattttaagtgtgaaaaataaatttattaatattttattttatgtgaccttttgggacagcggtg

SEQ ID NO: 376934 - DNA, 140 bp, Artificial Sequence
  Synthetic
caccgctgtcccaaaaggtcacataaaataaaatattaataaatttatttttcacacttaaaataataatcctacatacaatctaacacaaaaataaaattaaatcttacaacccaaaaacatatcagcagccagggcct

SEQ ID NO: 376935 - DNA, 140 bp, Artificial Sequence
  Synthetic
atacgccatgctgggtctcctttttgttatgagttgttttgtggttgatatttttttatgtatgttgagtgggaagtgattgtaaattttaggatatttggaaggaatatgtatattattcgtacttgggagtcggccat

SEQ ID NO: 376936 - DNA, 140 bp, Artificial Sequence
  Synthetic
atggccgactcccaagtacgaataatatacatattccttccaaatatcctaaaatttacaatcacttcccactcaacatacataaaaaaatatcaaccacaaaacaactcataacaaaaaggagacccagcatggcgtat

SEQ ID NO: 376937 - DNA, 140 bp, Artificial Sequence
  Synthetic
aggccctggctgctgatatggggaagtgattgtaaattttaggatatttggaaggaatatgtatattattagtttttaagattattaataataatatagagatattggttttggatagatgaccttttgggacagcggtg

SEQ ID NO: 376938 - DNA, 140 bp, Artificial Sequence
  Synthetic
caccgctgtcccaaaaggtcatctatccaaaaccaatatctctatattattattaataatcttaaaaactaataatatacatattccttccaaatatcctaaaatttacaatcacttccccatatcagcagccagggcct

SEQ ID NO: 376939 - DNA, 140 bp, Artificial Sequence
  Synthetic
atacgccatgctgggtctcctattgtgataatattttggtggaggttttaatttaaataatttgtatagttgatttagtatagattttgagggaatatttatgggtttatattttagaggcgtacttgggagtcggccat

SEQ ID NO: 376940 - DNA, 140 bp, Artificial Sequence
  Synthetic
atggccgactcccaagtacgcctctaaaatataaacccataaatattccctcaaaatctatactaaatcaactatacaaattatttaaattaaaacctccaccaaaatattatcacaataggagacccagcatggcgtat

SEQ ID NO: 376941 - DNA, 140 bp, Artificial Sequence
  Synthetic
aggccctggctgctgatatgtgatttagtatagattttgagggaatatttatgggtttatattttagagggaagattttttattggagttatatttttatgtatgattgagtaatttaaagaccttttgggacagcggtg

SEQ ID NO: 376942 - DNA, 140 bp, Artificial Sequence
  Synthetic
caccgctgtcccaaaaggtctttaaattactcaatcatacataaaaatataactccaataaaaaatcttccctctaaaatataaacccataaatattccctcaaaatctatactaaatcacatatcagcagccagggcct

SEQ ID NO: 376943 - DNA, 140 bp, Artificial Sequence
  Synthetic
atacgccatgctgggtctccgtaattaggtgggaaattatttgtgttagtggtagttaagaaatatattgttagtgtatggttgaatgtattttgaataagttggattattggggatggacgtacttgggagtcggccat

SEQ ID NO: 376944 - DNA, 140 bp, Artificial Sequence
  Synthetic
atggccgactcccaagtacgtccatccccaataatccaacttattcaaaatacattcaaccatacactaacaatatatttcttaactaccactaacacaaataatttcccacctaattacggagacccagcatggcgtat

SEQ ID NO: 376945 - DNA, 140 bp, Artificial Sequence
  Synthetic
aggccctggctgctgatatgttagtgtatggttgaatgtattttgaataagttggattattggggatggaattttatatattggattaaggatagaagataagataggataatttgttatgaccttttgggacagcggtg

SEQ ID NO: 376946 - DNA, 140 bp, Artificial Sequence
  Synthetic
caccgctgtcccaaaaggtcataacaaattatcctatcttatcttctatccttaatccaatatataaaattccatccccaataatccaacttattcaaaatacattcaaccatacactaacatatcagcagccagggcct

SEQ ID NO: 376947 - DNA, 140 bp, Artificial Sequence
  Synthetic
atacgccatgctgggtctcctttgtttaatatgggtaatttaaggtagtttgaatagtgatttgttaataaaattatttttggaagtatgagtaaatttaagtgtttaagaaatattttacgtacttgggagtcggccat

SEQ ID NO: 376948 - DNA, 140 bp, Artificial Sequence
  Synthetic
atggccgactcccaagtacgtaaaatatttcttaaacacttaaatttactcatacttccaaaaataattttattaacaaatcactattcaaactaccttaaattacccatattaaacaaaggagacccagcatggcgtat

SEQ ID NO: 376949 - DNA, 140 bp, Artificial Sequence
  Synthetic
aggccctggctgctgatatgaaattatttttggaagtatgagtaaatttaagtgtttaagaaatattttaaatgatttttttatattatttaggaaatattgtttataggtataatgattgaccttttgggacagcggtg

SEQ ID NO: 376950 - DNA, 140 bp, Artificial Sequence
  Synthetic
caccgctgtcccaaaaggtcaatcattatacctataaacaatatttcctaaataatataaaaaaatcatttaaaatatttcttaaacacttaaatttactcatacttccaaaaataatttcatatcagcagccagggcct

SEQ ID NO: 376951 - DNA, 140 bp, Artificial Sequence
  Synthetic
atacgccatgctgggtctcctgattgattgtttttataaatattttaggtgagtttttaggaggtggttagtttgtatgtgatagtaatattattttttagaatgttataaattatgtagcgtacttgggagtcggccat

SEQ ID NO: 376952 - DNA, 140 bp, Artificial Sequence
  Synthetic
atggccgactcccaagtacgctacataatttataacattctaaaaaataatattactatcacatacaaactaaccacctcctaaaaactcacctaaaatatttataaaaacaatcaatcaggagacccagcatggcgtat

SEQ ID NO: 376953 - DNA, 140 bp, Artificial Sequence
  Synthetic
aggccctggctgctgatatggtttgtatgtgatagtaatattattttttagaatgttataaattatgtagttgtattgtttgatattaaatttagaaatattgaggttatagatatttaagaccttttgggacagcggtg

SEQ ID NO: 376954 - DNA, 140 bp, Artificial Sequence
  Synthetic
caccgctgtcccaaaaggtcttaaatatctataacctcaatatttctaaatttaatatcaaacaatacaactacataatttataacattctaaaaaataatattactatcacatacaaaccatatcagcagccagggcct

SEQ ID NO: 376955 - DNA, 140 bp, Artificial Sequence
  Synthetic
atacgccatgctgggtctccagtttagtatttaatatatatatttatattggatttagatttaataagatattgagaaaatgaattgatttatgatagtaattttttaaaaggaggatttcgtacttgggagtcggccat

SEQ ID NO: 376956 - DNA, 140 bp, Artificial Sequence
  Synthetic
atggccgactcccaagtacgaaatcctccttttaaaaaattactatcataaatcaattcattttctcaatatcttattaaatctaaatccaatataaatatatatattaaatactaaactggagacccagcatggcgtat

SEQ ID NO: 376957 - DNA, 140 bp, Artificial Sequence
  Synthetic
aggccctggctgctgatatgattgagaaaatgaattgatttatgatagtaattttttaaaaggaggatttaattgtaatattttatttgataatttatttttttaaggtaaatggttgaagaccttttgggacagcggtg

SEQ ID NO: 376958 - DNA, 140 bp, Artificial Sequence
  Synthetic
caccgctgtcccaaaaggtcttcaaccatttaccttaaaaaaataaattatcaaataaaatattacaattaaatcctccttttaaaaaattactatcataaatcaattcattttctcaatcatatcagcagccagggcct

SEQ ID NO: 376959 - DNA, 140 bp, Artificial Sequence
  Synthetic
atacgccatgctgggtctcctagttaagattattatgtaattaattattttagatagtaataatttatttatagatttaattagtagtggagaaataagattatttattatttattttttcgtacttgggagtcggccat

SEQ ID NO: 376960 - DNA, 140 bp, Artificial Sequence
  Synthetic
atggccgactcccaagtacgaaaaaataaataataaataatcttatttctccactactaattaaatctataaataaattattactatctaaaataattaattacataataatcttaactaggagacccagcatggcgtat

SEQ ID NO: 376961 - DNA, 140 bp, Artificial Sequence
  Synthetic
aggccctggctgctgatatgatagatttaattagtagtggagaaataagattatttattatttattttttaatttattttaagataggatttttgtatagttttggggtttttgtaagttgaccttttgggacagcggtg

SEQ ID NO: 376962 - DNA, 140 bp, Artificial Sequence
  Synthetic
caccgctgtcccaaaaggtcaacttacaaaaaccccaaaactatacaaaaatcctatcttaaaataaattaaaaaataaataataaataatcttatttctccactactaattaaatctatcatatcagcagccagggcct

SEQ ID NO: 376963 - DNA, 140 bp, Artificial Sequence
  Synthetic
atacgccatgctgggtctcctttttatattatttaattatttaaatttataatttattatattgtttattgtgaatatttaagttaatatttaaatatgtaagtgttatgttatggttaacgtacttgggagtcggccat

SEQ ID NO: 376964 - DNA, 140 bp, Artificial Sequence
  Synthetic
atggccgactcccaagtacgttaaccataacataacacttacatatttaaatattaacttaaatattcacaataaacaatataataaattataaatttaaataattaaataatataaaaaggagacccagcatggcgtat

SEQ ID NO: 376965 - DNA, 140 bp, Artificial Sequence
  Synthetic
aggccctggctgctgatatggtgaatatttaagttaatatttaaatatgtaagtgttatgttatggttaatgagtattgatttttatttttttatttatataggtggtgttgtaggtgatgaccttttgggacagcggtg

SEQ ID NO: 376966 - DNA, 140 bp, Artificial Sequence
  Synthetic
caccgctgtcccaaaaggtcatcacctacaacaccacctatataaataaaaaaataaaaatcaatactcattaaccataacataacacttacatatttaaatattaacttaaatattcaccatatcagcagccagggcct

SEQ ID NO: 376967 - DNA, 140 bp, Artificial Sequence
  Synthetic
atacgccatgctgggtctcctttttttatatttgtaaaagaatggataattaattgtggaataattgtttttttatggatagtatatttgttagagggttaaaatttaatatttgtgaatcgtacttgggagtcggccat

SEQ ID NO: 376968 - DNA, 140 bp, Artificial Sequence
  Synthetic
atggccgactcccaagtacgattcacaaatattaaattttaaccctctaacaaatatactatccataaaaaaacaattattccacaattaattatccattcttttacaaatataaaaaaaggagacccagcatggcgtat

SEQ ID NO: 376969 - DNA, 140 bp, Artificial Sequence
  Synthetic
aggccctggctgctgatatgttttatggatagtatatttgttagagggttaaaatttaatatttgtgaataattttttttattagattgtagaattgttggtgtatgatttattaagatagaccttttgggacagcggtg

SEQ ID NO: 376970 - DNA, 140 bp, Artificial Sequence
  Synthetic
caccgctgtcccaaaaggtctatcttaataaatcatacaccaacaattctacaatctaataaaaaaaattattcacaaatattaaattttaaccctctaacaaatatactatccataaaacatatcagcagccagggcct

SEQ ID NO: 376971 - DNA, 140 bp, Artificial Sequence
  Synthetic
atacgccatgctgggtctccttgtttatatatgtaagagtatagttagtaattttttttatgtattattggtgtattggaggagtagatatagaaatagtaattgaaaatatttggtaagcgtacttgggagtcggccat

SEQ ID NO: 376972 - DNA, 140 bp, Artificial Sequence
  Synthetic
atggccgactcccaagtacgcttaccaaatattttcaattactatttctatatctactcctccaatacaccaataatacataaaaaaaattactaactatactcttacatatataaacaaggagacccagcatggcgtat

SEQ ID NO: 376973 - DNA, 140 bp, Artificial Sequence
  Synthetic
aggccctggctgctgatatggtgtattggaggagtagatatagaaatagtaattgaaaatatttggtaagagattttttaattggattaagtataaataatagtgatggttatattgagagaccttttgggacagcggtg

SEQ ID NO: 376974 - DNA, 140 bp, Artificial Sequence
  Synthetic
caccgctgtcccaaaaggtctctcaatataaccatcactattatttatacttaatccaattaaaaaatctcttaccaaatattttcaattactatttctatatctactcctccaatacaccatatcagcagccagggcct

SEQ ID NO: 376975 - DNA, 140 bp, Artificial Sequence
  Synthetic
atacgccatgctgggtctccttagttttataaatgagttatgaaataaaaagaatgataattttataagaaaatatgtattagggtttgttgttttagttttttttaagtgattttgtttcgtacttgggagtcggccat

SEQ ID NO: 376976 - DNA, 140 bp, Artificial Sequence
  Synthetic
atggccgactcccaagtacgaaacaaaatcacttaaaaaaaactaaaacaacaaaccctaatacatattttcttataaaattatcattctttttatttcataactcatttataaaactaaggagacccagcatggcgtat

SEQ ID NO: 376977 - DNA, 140 bp, Artificial Sequence
  Synthetic
aggccctggctgctgatatgaaatatgtattagggtttgttgttttagttttttttaagtgattttgtttgtggtatagtaaatttaaaattaaattttgattgattgagatataatgtggaccttttgggacagcggtg

SEQ ID NO: 376978 - DNA, 140 bp, Artificial Sequence
  Synthetic
caccgctgtcccaaaaggtccacattatatctcaatcaatcaaaatttaattttaaatttactataccacaaacaaaatcacttaaaaaaaactaaaacaacaaaccctaatacatatttcatatcagcagccagggcct

SEQ ID NO: 376979 - DNA, 140 bp, Artificial Sequence
  Synthetic
atacgccatgctgggtctcctttatattgtttagttttatttttttttatattattttaagggatatgttaattaatgttatttaatgagttataaatttaagatgagatattaaagtatcgtacttgggagtcggccat

SEQ ID NO: 376980 - DNA, 140 bp, Artificial Sequence
  Synthetic
atggccgactcccaagtacgatactttaatatctcatcttaaatttataactcattaaataacattaattaacatatcccttaaaataatataaaaaaaaataaaactaaacaatataaaggagacccagcatggcgtat

SEQ ID NO: 376981 - DNA, 140 bp, Artificial Sequence
  Synthetic
aggccctggctgctgatatgaattaatgttatttaatgagttataaatttaagatgagatattaaagtatttatggtaattgagatttgttattgatattatagtttattgtagatttatgaccttttgggacagcggtg

SEQ ID NO: 376982 - DNA, 140 bp, Artificial Sequence
  Synthetic
caccgctgtcccaaaaggtcataaatctacaataaactataatatcaataacaaatctcaattaccataaatactttaatatctcatcttaaatttataactcattaaataacattaattcatatcagcagccagggcct

SEQ ID NO: 376983 - DNA, 140 bp, Artificial Sequence
  Synthetic
atacgccatgctgggtctcctagagagttttaagttggttgtgatgttagtagagggagaaggtgttggtgttttattattgatttagaaatattaagttaagattttattttttaatatcgtacttgggagtcggccat

SEQ ID NO: 376984 - DNA, 140 bp, Artificial Sequence
  Synthetic
atggccgactcccaagtacgatattaaaaaataaaatcttaacttaatatttctaaatcaataataaaacaccaacaccttctccctctactaacatcacaaccaacttaaaactctctaggagacccagcatggcgtat

SEQ ID NO: 376985 - DNA, 140 bp, Artificial Sequence
  Synthetic
aggccctggctgctgatatggttttattattgatttagaaatattaagttaagattttattttttaatatgttagttattgagtttagtatagagttagaaatagtattaggaatgattagaccttttgggacagcggtg

SEQ ID NO: 376986 - DNA, 140 bp, Artificial Sequence
  Synthetic
caccgctgtcccaaaaggtctaatcattcctaatactatttctaactctatactaaactcaataactaacatattaaaaaataaaatcttaacttaatatttctaaatcaataataaaaccatatcagcagccagggcct

SEQ ID NO: 376987 - DNA, 140 bp, Artificial Sequence
  Synthetic
atacgccatgctgggtctccgagattatttttaataatttagtaagttaaataatagatataataaattttatttggtttaaagattaaagagtaaggttatttaagtaagttgaggttacgtacttgggagtcggccat

SEQ ID NO: 376988 - DNA, 140 bp, Artificial Sequence
  Synthetic
atggccgactcccaagtacgtaacctcaacttacttaaataaccttactctttaatctttaaaccaaataaaatttattatatctattatttaacttactaaattattaaaaataatctcggagacccagcatggcgtat

SEQ ID NO: 376989 - DNA, 140 bp, Artificial Sequence
  Synthetic
aggccctggctgctgatatgtatttggtttaaagattaaagagtaaggttatttaagtaagttgaggttataattatggatgtagagataatagagaatataaatagattgaaattgtatgaccttttgggacagcggtg

SEQ ID NO: 376990 - DNA, 140 bp, Artificial Sequence
  Synthetic
caccgctgtcccaaaaggtcatacaatttcaatctatttatattctctattatctctacatccataattataacctcaacttacttaaataaccttactctttaatctttaaaccaaatacatatcagcagccagggcct

SEQ ID NO: 376991 - DNA, 140 bp, Artificial Sequence
  Synthetic
atacgccatgctgggtctccagtagtggtttttaaagtttttttaagtgatattgagggtatgttatggttaaatgataatttagttttgttttttgttattggttatttaattaagttacgtacttgggagtcggccat

SEQ ID NO: 376992 - DNA, 140 bp, Artificial Sequence
  Synthetic
atggccgactcccaagtacgtaacttaattaaataaccaataacaaaaaacaaaactaaattatcatttaaccataacataccctcaatatcacttaaaaaaactttaaaaaccactactggagacccagcatggcgtat

SEQ ID NO: 376993 - DNA, 140 bp, Artificial Sequence
  Synthetic
aggccctggctgctgatatgtaaatgataatttagttttgttttttgttattggttatttaattaagttaataatgttaagtgttagatttagtgagtggtatttttgtttgatgaatttgaccttttgggacagcggtg

SEQ ID NO: 376994 - DNA, 140 bp, Artificial Sequence
  Synthetic
caccgctgtcccaaaaggtcaaattcatcaaacaaaaataccactcactaaatctaacacttaacattattaacttaattaaataaccaataacaaaaaacaaaactaaattatcatttacatatcagcagccagggcct

SEQ ID NO: 376995 - DNA, 140 bp, Artificial Sequence
  Synthetic
atacgccatgctgggtctccaggtaatatttatggtattgtaattgtaaatttaatgaagtttatattggttaagttatttaatttagtatgttgattgtgagttatatttaagttatatcgtacttgggagtcggccat

SEQ ID NO: 376996 - DNA, 140 bp, Artificial Sequence
  Synthetic
atggccgactcccaagtacgatataacttaaatataactcacaatcaacatactaaattaaataacttaaccaatataaacttcattaaatttacaattacaataccataaatattacctggagacccagcatggcgtat

SEQ ID NO: 376997 - DNA, 140 bp, Artificial Sequence
  Synthetic
aggccctggctgctgatatgttaagttatttaatttagtatgttgattgtgagttatatttaagttatatttgttttggttttttattattagagaaagtattatattataggtataattgaccttttgggacagcggtg

SEQ ID NO: 376998 - DNA, 140 bp, Artificial Sequence
  Synthetic
caccgctgtcccaaaaggtcaattatacctataatataatactttctctaataataaaaaaccaaaacaaatataacttaaatataactcacaatcaacatactaaattaaataacttaacatatcagcagccagggcct

SEQ ID NO: 376999 - DNA, 140 bp, Artificial Sequence
  Synthetic
atacgccatgctgggtctcctattttagagtagagatttgagaattaattaatgattataattaatagtgataaagttggatttaaatatattattttatttgtattgtaaaaggatgaacgtacttgggagtcggccat

SEQ ID NO: 377000 - DNA, 140 bp, Artificial Sequence
  Synthetic
atggccgactcccaagtacgttcatccttttacaatacaaataaaataatatatttaaatccaactttatcactattaattataatcattaattaattctcaaatctctactctaaaataggagacccagcatggcgtat

SEQ ID NO: 377001 - DNA, 140 bp, Artificial Sequence
  Synthetic
aggccctggctgctgatatgataaagttggatttaaatatattattttatttgtattgtaaaaggatgaattataaaattagttaatgattatttaaaatttttttttattgtgtaagtagaccttttgggacagcggtg

SEQ ID NO: 377002 - DNA, 140 bp, Artificial Sequence
  Synthetic
caccgctgtcccaaaaggtctacttacacaataaaaaaaaattttaaataatcattaactaattttataattcatccttttacaatacaaataaaataatatatttaaatccaactttatcatatcagcagccagggcct

SEQ ID NO: 377003 - DNA, 140 bp, Artificial Sequence
  Synthetic
atacgccatgctgggtctccgattagtgtgtgtaataggttttattatattagagattgtaattgtgaagaatgttttttagtttaaattttatatttatatagaatgtaggattttgaacgtacttgggagtcggccat

SEQ ID NO: 377004 - DNA, 140 bp, Artificial Sequence
  Synthetic
atggccgactcccaagtacgttcaaaatcctacattctatataaatataaaatttaaactaaaaaacattcttcacaattacaatctctaatataataaaacctattacacacactaatcggagacccagcatggcgtat

SEQ ID NO: 377005 - DNA, 140 bp, Artificial Sequence
  Synthetic
aggccctggctgctgatatgaatgttttttagtttaaattttatatttatatagaatgtaggattttgaagttaagtttattgaaaggttgatagggtttttgagtttatttttggatgggaccttttgggacagcggtg

SEQ ID NO: 377006 - DNA, 140 bp, Artificial Sequence
  Synthetic
caccgctgtcccaaaaggtcccatccaaaaataaactcaaaaaccctatcaacctttcaataaacttaacttcaaaatcctacattctatataaatataaaatttaaactaaaaaacattcatatcagcagccagggcct

SEQ ID NO: 377007 - DNA, 140 bp, Artificial Sequence
  Synthetic
atacgccatgctgggtctccaggttggttattaatatatagattataaaaaatttataaattgtttttatatattatattgatttaattttaataaataattatttaaataatgaaaggacgtacttgggagtcggccat

SEQ ID NO: 377008 - DNA, 140 bp, Artificial Sequence
  Synthetic
atggccgactcccaagtacgtcctttcattatttaaataattatttattaaaattaaatcaatataatatataaaaacaatttataaattttttataatctatatattaataaccaacctggagacccagcatggcgtat

SEQ ID NO: 377009 - DNA, 140 bp, Artificial Sequence
  Synthetic
aggccctggctgctgatatgatattatattgatttaattttaataaataattatttaaataatgaaaggagtttttatattatatattatatttagtttttttttttgtgtgataattaagaccttttgggacagcggtg

SEQ ID NO: 377010 - DNA, 140 bp, Artificial Sequence
  Synthetic
caccgctgtcccaaaaggtcttaattatcacacaaaaaaaaaaactaaatataatatataatataaaaactcctttcattatttaaataattatttattaaaattaaatcaatataatatcatatcagcagccagggcct

SEQ ID NO: 377011 - DNA, 140 bp, Artificial Sequence
  Synthetic
atacgccatgctgggtctcctgtaatataataaattttgtattttttataattaagttttaatgaaaggtttgggtttatattgttattgatataataatgttgtattaatattttgttacgtacttgggagtcggccat

SEQ ID NO: 377012 - DNA, 140 bp, Artificial Sequence
  Synthetic
atggccgactcccaagtacgtaacaaaatattaatacaacattattatatcaataacaatataaacccaaacctttcattaaaacttaattataaaaaatacaaaatttattatattacaggagacccagcatggcgtat

SEQ ID NO: 377013 - DNA, 140 bp, Artificial Sequence
  Synthetic
aggccctggctgctgatatgttgggtttatattgttattgatataataatgttgtattaatattttgttagatggaatagtgttttggttgataatataattttttaaaataaaattgatgaccttttgggacagcggtg

SEQ ID NO: 377014 - DNA, 140 bp, Artificial Sequence
  Synthetic
caccgctgtcccaaaaggtcatcaattttattttaaaaaattatattatcaaccaaaacactattccatctaacaaaatattaatacaacattattatatcaataacaatataaacccaacatatcagcagccagggcct

SEQ ID NO: 377015 - DNA, 140 bp, Artificial Sequence
  Synthetic
atacgccatgctgggtctccaaaatggtgatagttttaatttttgtgtaaaataagagattaggtgtaataattttaatatttttgtttagtaagttattattttatatagaatgataaacgtacttgggagtcggccat

SEQ ID NO: 377016 - DNA, 140 bp, Artificial Sequence
  Synthetic
atggccgactcccaagtacgtttatcattctatataaaataataacttactaaacaaaaatattaaaattattacacctaatctcttattttacacaaaaattaaaactatcaccattttggagacccagcatggcgtat

SEQ ID NO: 377017 - DNA, 140 bp, Artificial Sequence
  Synthetic
atacgccatgctgggtctcctagtagattagataataatttttgtgttaatgataattaagatattgattatgtttattagaaggtttgttagaataaatgttgtaaaaaggatttttggcgtacttgggagtcggccat

SEQ ID NO: 377018 - DNA, 140 bp, Artificial Sequence
  Synthetic
atggccgactcccaagtacgccaaaaatcctttttacaacatttattctaacaaaccttctaataaacataatcaatatcttaattatcattaacacaaaaattattatctaatctactaggagacccagcatggcgtat

SEQ ID NO: 377019 - DNA, 140 bp, Artificial Sequence
  Synthetic
aggccctggctgctgatatgatgtttattagaaggtttgttagaataaatgttgtaaaaaggatttttggaaaaatggttgtatataaaaatttaaaaataaatttatttttttttttttgaccttttgggacagcggtg

SEQ ID NO: 377020 - DNA, 140 bp, Artificial Sequence
  Synthetic
caccgctgtcccaaaaggtcaaaaaaaaaaaaataaatttatttttaaatttttatatacaaccatttttccaaaaatcctttttacaacatttattctaacaaaccttctaataaacatcatatcagcagccagggcct

SEQ ID NO: 377021 - DNA, 140 bp, Artificial Sequence
  Synthetic
atacgccatgctgggtctcctggatatataaaaaagaagaaatagatttatttttaaatttttgtgtgtgattatttttttaggaattttttttgtaatgtttattttggtgagttttttcgtacttgggagtcggccat

SEQ ID NO: 377022 - DNA, 140 bp, Artificial Sequence
  Synthetic
atggccgactcccaagtacgaaaaaactcaccaaaataaacattacaaaaaaaattcctaaaaaaataatcacacacaaaaatttaaaaataaatctatttcttcttttttatatatccaggagacccagcatggcgtat

SEQ ID NO: 377023 - DNA, 140 bp, Artificial Sequence
  Synthetic
aggccctggctgctgatatgattatttttttaggaattttttttgtaatgtttattttggtgagttttttgatgagtgtggttaatgttttaattattattaatatgaagattattatttgaccttttgggacagcggtg

SEQ ID NO: 377024 - DNA, 140 bp, Artificial Sequence
  Synthetic
caccgctgtcccaaaaggtcaaataataatcttcatattaataataattaaaacattaaccacactcatcaaaaaactcaccaaaataaacattacaaaaaaaattcctaaaaaaataatcatatcagcagccagggcct

SEQ ID NO: 377025 - DNA, 140 bp, Artificial Sequence
  Synthetic
atacgccatgctgggtctccgatgagtgtggttaatgttttaattattattaatatgaagattattatttagtttgttatattgtaaagaaggtatttttgattttatagttttgtttttcgtacttgggagtcggccat

SEQ ID NO: 377026 - DNA, 140 bp, Artificial Sequence
  Synthetic
atggccgactcccaagtacgaaaaacaaaactataaaatcaaaaataccttctttacaatataacaaactaaataataatcttcatattaataataattaaaacattaaccacactcatcggagacccagcatggcgtat

SEQ ID NO: 377027 - DNA, 140 bp, Artificial Sequence
  Synthetic
atacgccatgctgggtctccgttaaggttattatatttaattttttattttatataaagattaaggttattattgtttttaaaatgataaattaaagtaatgataattataaaaaatttacgtacttgggagtcggccat

SEQ ID NO: 377028 - DNA, 140 bp, Artificial Sequence
  Synthetic
atggccgactcccaagtacgtaaattttttataattatcattactttaatttatcattttaaaaacaataataaccttaatctttatataaaataaaaaattaaatataataaccttaacggagacccagcatggcgtat

SEQ ID NO: 377029 - DNA, 140 bp, Artificial Sequence
  Synthetic
aggccctggctgctgatatgtattgtttttaaaatgataaattaaagtaatgataattataaaaaatttaattttaaagattaattttgttttaagaagttgtgttattaattaaaatatgaccttttgggacagcggtg

SEQ ID NO: 377030 - DNA, 140 bp, Artificial Sequence
  Synthetic
caccgctgtcccaaaaggtcatattttaattaataacacaacttcttaaaacaaaattaatctttaaaattaaattttttataattatcattactttaatttatcattttaaaaacaatacatatcagcagccagggcct

SEQ ID NO: 377031 - DNA, 140 bp, Artificial Sequence
  Synthetic
atacgccatgctgggtctcctgagtttagattttttgttaaagtttaattataaagagtgtagagtttattatgttgtgttaaatttattgtggtagtaatatgttatatatgttgtattcgtacttgggagtcggccat

SEQ ID NO: 377032 - DNA, 140 bp, Artificial Sequence
  Synthetic
atggccgactcccaagtacgaatacaacatatataacatattactaccacaataaatttaacacaacataataaactctacactctttataattaaactttaacaaaaaatctaaactcaggagacccagcatggcgtat

SEQ ID NO: 377033 - DNA, 140 bp, Artificial Sequence
  Synthetic
aggccctggctgctgatatgtatgttgtgttaaatttattgtggtagtaatatgttatatatgttgtattgtgaattttttgattattatgtagggagagaggttaaatatagtatataagaccttttgggacagcggtg

SEQ ID NO: 377034 - DNA, 140 bp, Artificial Sequence
  Synthetic
caccgctgtcccaaaaggtcttatatactatatttaacctctctccctacataataatcaaaaaattcacaatacaacatatataacatattactaccacaataaatttaacacaacatacatatcagcagccagggcct

SEQ ID NO: 377035 - DNA, 140 bp, Artificial Sequence
  Synthetic
atacgccatgctgggtctccatatgatgtatgagagtaatttatgagttttttataatttgtatgttaataattaatttttgtaagtattaggatattatgtatggtaatttaattaaatcgtacttgggagtcggccat

SEQ ID NO: 377036 - DNA, 140 bp, Artificial Sequence
  Synthetic
atggccgactcccaagtacgatttaattaaattaccatacataatatcctaatacttacaaaaattaattattaacatacaaattataaaaaactcataaattactctcatacatcatatggagacccagcatggcgtat

SEQ ID NO: 377037 - DNA, 140 bp, Artificial Sequence
  Synthetic
aggccctggctgctgatatgaattaatttttgtaagtattaggatattatgtatggtaatttaattaaatttgtagagattatttggaaataaatttagaagttttgttagttttttgatgaccttttgggacagcggtg

SEQ ID NO: 377038 - DNA, 140 bp, Artificial Sequence
  Synthetic
caccgctgtcccaaaaggtcatcaaaaaactaacaaaacttctaaatttatttccaaataatctctacaaatttaattaaattaccatacataatatcctaatacttacaaaaattaattcatatcagcagccagggcct

SEQ ID NO: 377039 - DNA, 140 bp, Artificial Sequence
  Synthetic
atacgccatgctgggtctccagaaatgttttttataattgtaatttttaatatggtagaatttattgtatatattaattaattttggtaattttttaaatttagtttgttatgttttattcgtacttgggagtcggccat

SEQ ID NO: 377040 - DNA, 140 bp, Artificial Sequence
  Synthetic
atggccgactcccaagtacgaataaaacataacaaactaaatttaaaaaattaccaaaattaattaatatatacaataaattctaccatattaaaaattacaattataaaaaacatttctggagacccagcatggcgtat

SEQ ID NO: 377041 - DNA, 140 bp, Artificial Sequence
  Synthetic
aggccctggctgctgatatgatattaattaattttggtaattttttaaatttagtttgttatgttttattatgttttaatgtttgtataataagaaagaattttaaataattattgattagaccttttgggacagcggtg

SEQ ID NO: 377042 - DNA, 140 bp, Artificial Sequence
  Synthetic
caccgctgtcccaaaaggtctaatcaataattatttaaaattctttcttattatacaaacattaaaacataataaaacataacaaactaaatttaaaaaattaccaaaattaattaatatcatatcagcagccagggcct

SEQ ID NO: 377043 - DNA, 140 bp, Artificial Sequence
  Synthetic
atacgccatgctgggtctcctgattttgttgttgttgattataattattagttaatttttgaatttttgttttaagatgtgttaagtgttgagtgatagagattagtggatttttttttgcgtacttgggagtcggccat

SEQ ID NO: 377044 - DNA, 140 bp, Artificial Sequence
  Synthetic
atggccgactcccaagtacgcaaaaaaaaatccactaatctctatcactcaacacttaacacatcttaaaacaaaaattcaaaaattaactaataattataatcaacaacaacaaaatcaggagacccagcatggcgtat

SEQ ID NO: 377045 - DNA, 140 bp, Artificial Sequence
  Synthetic
aggccctggctgctgatatgtttaagatgtgttaagtgttgagtgatagagattagtggatttttttttgaattgatgaggttatatttgtggtatagtattttttttaatgatggaaaagaccttttgggacagcggtg

SEQ ID NO: 377046 - DNA, 140 bp, Artificial Sequence
  Synthetic
caccgctgtcccaaaaggtcttttccatcattaaaaaaaatactataccacaaatataacctcatcaattcaaaaaaaaatccactaatctctatcactcaacacttaacacatcttaaacatatcagcagccagggcct

SEQ ID NO: 377047 - DNA, 140 bp, Artificial Sequence
  Synthetic
atacgccatgctgggtctccatgatttagttagtatgggttttgttgaatttgtagttgtaatgttgtaagtattatttgtttataattgagatggttttggtgtggtattttatgtgtacgtacttgggagtcggccat

SEQ ID NO: 377048 - DNA, 140 bp, Artificial Sequence
  Synthetic
atggccgactcccaagtacgtacacataaaataccacaccaaaaccatctcaattataaacaaataatacttacaacattacaactacaaattcaacaaaacccatactaactaaatcatggagacccagcatggcgtat

SEQ ID NO: 377049 - DNA, 140 bp, Artificial Sequence
  Synthetic
aggccctggctgctgatatggtattatttgtttataattgagatggttttggtgtggtattttatgtgtagttgataagaagtttgttagataaagatattatttattagatttagtattgaccttttgggacagcggtg

SEQ ID NO: 377050 - DNA, 140 bp, Artificial Sequence
  Synthetic
caccgctgtcccaaaaggtcaatactaaatctaataaataatatctttatctaacaaacttcttatcaactacacataaaataccacaccaaaaccatctcaattataaacaaataataccatatcagcagccagggcct

SEQ ID NO: 377051 - DNA, 140 bp, Artificial Sequence
  Synthetic
atacgccatgctgggtctcctattatttagttataatatatttttagtattatttagaaagattttaaggattattgtttttaatatgttaggattaatatggtgtaagattaatttatacgtacttgggagtcggccat

SEQ ID NO: 377052 - DNA, 140 bp, Artificial Sequence
  Synthetic
atggccgactcccaagtacgtataaattaatcttacaccatattaatcctaacatattaaaaacaataatccttaaaatctttctaaataatactaaaaatatattataactaaataataggagacccagcatggcgtat

SEQ ID NO: 377053 - DNA, 140 bp, Artificial Sequence
  Synthetic
aggccctggctgctgatatgattattgtttttaatatgttaggattaatatggtgtaagattaatttatatatagttttgtataattttgatttgtttatattttttgttgtttttgtatgaccttttgggacagcggtg

SEQ ID NO: 377054 - DNA, 140 bp, Artificial Sequence
  Synthetic
caccgctgtcccaaaaggtcatacaaaaacaacaaaaaatataaacaaatcaaaattatacaaaactatatataaattaatcttacaccatattaatcctaacatattaaaaacaataatcatatcagcagccagggcct

SEQ ID NO: 377055 - DNA, 140 bp, Artificial Sequence
  Synthetic
atacgccatgctgggtctccaattaagtaggatttgttatgtttgttatttggtttgttgagttgttaagaataattttaatttggttattatggaattttgatataataggtagaagtacgtacttgggagtcggccat

SEQ ID NO: 377056 - DNA, 140 bp, Artificial Sequence
  Synthetic
atggccgactcccaagtacgtacttctacctattatatcaaaattccataataaccaaattaaaattattcttaacaactcaacaaaccaaataacaaacataacaaatcctacttaattggagacccagcatggcgtat

SEQ ID NO: 377057 - DNA, 140 bp, Artificial Sequence
  Synthetic
aggccctggctgctgatatgaataattttaatttggttattatggaattttgatataataggtagaagtattttaggagtagttatttttgatattatttttgattttatattggatttagaccttttgggacagcggtg

SEQ ID NO: 377058 - DNA, 140 bp, Artificial Sequence
  Synthetic
caccgctgtcccaaaaggtctaaatccaatataaaatcaaaaataatatcaaaaataactactcctaaaatacttctacctattatatcaaaattccataataaccaaattaaaattattcatatcagcagccagggcct

SEQ ID NO: 377059 - DNA, 140 bp, Artificial Sequence
  Synthetic
atacgccatgctgggtctcctagtaaggtattagtattttttttttttgttagtgttatagttgatttgaaattttttattttttaaaggattttattaagtttgtaatgtatggatgagcgtacttgggagtcggccat

SEQ ID NO: 377060 - DNA, 140 bp, Artificial Sequence
  Synthetic
atggccgactcccaagtacgctcatccatacattacaaacttaataaaatcctttaaaaaataaaaaatttcaaatcaactataacactaacaaaaaaaaaaaatactaataccttactaggagacccagcatggcgtat

SEQ ID NO: 377061 - DNA, 140 bp, Artificial Sequence
  Synthetic
aggccctggctgctgatatgaattttttattttttaaaggattttattaagtttgtaatgtatggatgagattatattggtaaatttataataaattgtggtattaatgatggattttaagaccttttgggacagcggtg

SEQ ID NO: 377062 - DNA, 140 bp, Artificial Sequence
  Synthetic
caccgctgtcccaaaaggtcttaaaatccatcattaataccacaatttattataaatttaccaatataatctcatccatacattacaaacttaataaaatcctttaaaaaataaaaaattcatatcagcagccagggcct

SEQ ID NO: 377063 - DNA, 140 bp, Artificial Sequence
  Synthetic
atacgccatgctgggtctccatgttaattggtgtgttttttgagataatgtaaagaaaggtaggattagatggtgtgagattatttgatgatttttttttttggatgttgagttatgattcgtacttgggagtcggccat

SEQ ID NO: 377064 - DNA, 140 bp, Artificial Sequence
  Synthetic
atggccgactcccaagtacgaatcataactcaacatccaaaaaaaaaaatcatcaaataatctcacaccatctaatcctacctttctttacattatctcaaaaaacacaccaattaacatggagacccagcatggcgtat

SEQ ID NO: 377065 - DNA, 140 bp, Artificial Sequence
  Synthetic
aggccctggctgctgatatgtggtgtgagattatttgatgatttttttttttggatgttgagttatgattttgaaattttatattgtgttttgattgattgaaatttagttttggatttggaccttttgggacagcggtg

SEQ ID NO: 377066 - DNA, 140 bp, Artificial Sequence
  Synthetic
caccgctgtcccaaaaggtccaaatccaaaactaaatttcaatcaatcaaaacacaatataaaatttcaaaatcataactcaacatccaaaaaaaaaaatcatcaaataatctcacaccacatatcagcagccagggcct

SEQ ID NO: 377067 - DNA, 140 bp, Artificial Sequence
  Synthetic
atacgccatgctgggtctcctgtgtgtttttttgtggaattgttgttttttttattttatggtttatttgtaggattagattttgtttagtgttattatgtggatttttggtggtttgttcgtacttgggagtcggccat

SEQ ID NO: 377068 - DNA, 140 bp, Artificial Sequence
  Synthetic
atggccgactcccaagtacgaacaaaccaccaaaaatccacataataacactaaacaaaatctaatcctacaaataaaccataaaataaaaaaaacaacaattccacaaaaaaacacacaggagacccagcatggcgtat

SEQ ID NO: 377069 - DNA, 140 bp, Artificial Sequence
  Synthetic
aggccctggctgctgatatgtaggattagattttgtttagtgttattatgtggatttttggtggtttgtttttgattttttttaatatgattattattgttgtttgtgtttgatttagttgaccttttgggacagcggtg

SEQ ID NO: 377070 - DNA, 140 bp, Artificial Sequence
  Synthetic
caccgctgtcccaaaaggtcaactaaatcaaacacaaacaacaataataatcatattaaaaaaaatcaaaaacaaaccaccaaaaatccacataataacactaaacaaaatctaatcctacatatcagcagccagggcct

SEQ ID NO: 377071 - DNA, 140 bp, Artificial Sequence
  Synthetic
atacgccatgctgggtctccttagtatgttaatgatgtatggaagaaattgttggttgtatttttatatgtgtaaataagattgttgtgaggatgtatatgattatttatggtagttttacgtacttgggagtcggccat

SEQ ID NO: 377072 - DNA, 140 bp, Artificial Sequence
  Synthetic
atggccgactcccaagtacgtaaaactaccataaataatcatatacatcctcacaacaatcttatttacacatataaaaatacaaccaacaatttcttccatacatcattaacatactaaggagacccagcatggcgtat

SEQ ID NO: 377073 - DNA, 140 bp, Artificial Sequence
  Synthetic
aggccctggctgctgatatgtgtaaataagattgttgtgaggatgtatatgattatttatggtagttttaaaagtttgttgttttgatgaattatgtattagtagttttatgatttgatagaccttttgggacagcggtg

SEQ ID NO: 377074 - DNA, 140 bp, Artificial Sequence
  Synthetic
caccgctgtcccaaaaggtctatcaaatcataaaactactaatacataattcatcaaaacaacaaacttttaaaactaccataaataatcatatacatcctcacaacaatcttatttacacatatcagcagccagggcct

SEQ ID NO: 377075 - DNA, 140 bp, Artificial Sequence
  Synthetic
atacgccatgctgggtctcctttataaagggataattgttttgtgattaattatttatttttttataaatgtaagaaaagatgaaatggatgtttttaaaaataatttggttgtatttgacgtacttgggagtcggccat

SEQ ID NO: 377076 - DNA, 140 bp, Artificial Sequence
  Synthetic
atggccgactcccaagtacgtcaaatacaaccaaattatttttaaaaacatccatttcatcttttcttacatttataaaaaaataaataattaatcacaaaacaattatccctttataaaggagacccagcatggcgtat

SEQ ID NO: 377077 - DNA, 140 bp, Artificial Sequence
  Synthetic
aggccctggctgctgatatggtaagaaaagatgaaatggatgtttttaaaaataatttggttgtatttgagagttttttgttatttgtagtattgtttatgtaaatagaaaaatgaggatgaccttttgggacagcggtg

SEQ ID NO: 377078 - DNA, 140 bp, Artificial Sequence
  Synthetic
caccgctgtcccaaaaggtcatcctcatttttctatttacataaacaatactacaaataacaaaaaactctcaaatacaaccaaattatttttaaaaacatccatttcatcttttcttaccatatcagcagccagggcct

SEQ ID NO: 377079 - DNA, 140 bp, Artificial Sequence
  Synthetic
atacgccatgctgggtctccagtatttgtaatgagtgatgtggtagattatgaatttgagtagttaagtaatataaaaaattgttaagtgttaattttttagtttgaagaattgtattgtcgtacttgggagtcggccat

SEQ ID NO: 377080 - DNA, 140 bp, Artificial Sequence
  Synthetic
atggccgactcccaagtacgacaatacaattcttcaaactaaaaaattaacacttaacaattttttatattacttaactactcaaattcataatctaccacatcactcattacaaatactggagacccagcatggcgtat

SEQ ID NO: 377081 - DNA, 140 bp, Artificial Sequence
  Synthetic
aggccctggctgctgatatgatataaaaaattgttaagtgttaattttttagtttgaagaattgtattgttaagataataatttataaaggttttaaaattgtatagaagttttattttggaccttttgggacagcggtg

SEQ ID NO: 377082 - DNA, 140 bp, Artificial Sequence
  Synthetic
caccgctgtcccaaaaggtccaaaataaaacttctatacaattttaaaacctttataaattattatcttaacaatacaattcttcaaactaaaaaattaacacttaacaattttttatatcatatcagcagccagggcct

SEQ ID NO: 377083 - DNA, 140 bp, Artificial Sequence
  Synthetic
atacgccatgctgggtctcctgggtttgtagatgaattgttgttatttgaaataattgattgtatgatggttttggttagtttttatttagataagtgaggtagttgaataagattatttcgtacttgggagtcggccat

SEQ ID NO: 377084 - DNA, 140 bp, Artificial Sequence
  Synthetic
atggccgactcccaagtacgaaataatcttattcaactacctcacttatctaaataaaaactaaccaaaaccatcatacaatcaattatttcaaataacaacaattcatctacaaacccaggagacccagcatggcgtat

SEQ ID NO: 377085 - DNA, 140 bp, Artificial Sequence
  Synthetic
aggccctggctgctgatatgttttggttagtttttatttagataagtgaggtagttgaataagattattttttataatgtttagttgtttattttggaaaaatggattattgaatgagatgaccttttgggacagcggtg

SEQ ID NO: 377086 - DNA, 140 bp, Artificial Sequence
  Synthetic
caccgctgtcccaaaaggtcatctcattcaataatccatttttccaaaataaacaactaaacattataaaaaataatcttattcaactacctcacttatctaaataaaaactaaccaaaacatatcagcagccagggcct

SEQ ID NO: 377087 - DNA, 140 bp, Artificial Sequence
  Synthetic
atacgccatgctgggtctccttttttggtattttgttaaatttaaatttaatgtagatgtgtatgttaaatattgagttggtattttttgggtgtaatatttagttagatgaaggtgagtcgtacttgggagtcggccat

SEQ ID NO: 377088 - DNA, 140 bp, Artificial Sequence
  Synthetic
atggccgactcccaagtacgactcaccttcatctaactaaatattacacccaaaaaataccaactcaatatttaacatacacatctacattaaatttaaatttaacaaaataccaaaaaaggagacccagcatggcgtat

SEQ ID NO: 377089 - DNA, 140 bp, Artificial Sequence
  Synthetic
aggccctggctgctgatatgtattgagttggtattttttgggtgtaatatttagttagatgaaggtgagtatgattatattggatatttgtagttttagtgtttttaaatttaatattgagaccttttgggacagcggtg

SEQ ID NO: 377090 - DNA, 140 bp, Artificial Sequence
  Synthetic
caccgctgtcccaaaaggtctcaatattaaatttaaaaacactaaaactacaaatatccaatataatcatactcaccttcatctaactaaatattacacccaaaaaataccaactcaatacatatcagcagccagggcct

SEQ ID NO: 377091 - DNA, 140 bp, Artificial Sequence
  Synthetic
atacgccatgctgggtctcctgtgtagattggttattttttgaaaatttatttaaagtgtttgtagaaataattaattgtgttgttgaattatttatatgattggttatgaaagaatgagcgtacttgggagtcggccat

SEQ ID NO: 377092 - DNA, 140 bp, Artificial Sequence
  Synthetic
atggccgactcccaagtacgctcattctttcataaccaatcatataaataattcaacaacacaattaattatttctacaaacactttaaataaattttcaaaaaataaccaatctacacaggagacccagcatggcgtat

SEQ ID NO: 377093 - DNA, 140 bp, Artificial Sequence
  Synthetic
aggccctggctgctgatatgaattaattgtgttgttgaattatttatatgattggttatgaaagaatgaggattgtattgattgttgtatttgtgaataatattttttgagtaatgtgaagaccttttgggacagcggtg

SEQ ID NO: 377094 - DNA, 140 bp, Artificial Sequence
  Synthetic
caccgctgtcccaaaaggtcttcacattactcaaaaaatattattcacaaatacaacaatcaatacaatcctcattctttcataaccaatcatataaataattcaacaacacaattaattcatatcagcagccagggcct

SEQ ID NO: 377095 - DNA, 140 bp, Artificial Sequence
  Synthetic
atacgccatgctgggtctccaaatggttttattagtaagttattgtttgaattgttttgagttatttatgttaaatgggatgttaatttaatggttttttttaaggttgtggaaggatatcgtacttgggagtcggccat

SEQ ID NO: 377096 - DNA, 140 bp, Artificial Sequence
  Synthetic
atggccgactcccaagtacgatatccttccacaaccttaaaaaaaaccattaaattaacatcccatttaacataaataactcaaaacaattcaaacaataacttactaataaaaccatttggagacccagcatggcgtat

SEQ ID NO: 377097 - DNA, 140 bp, Artificial Sequence
  Synthetic
aggccctggctgctgatatgttaaatgggatgttaatttaatggttttttttaaggttgtggaaggatattttggtttaatagtaggttgttttattttattttttgtttttgatttaatgaccttttgggacagcggtg

SEQ ID NO: 377098 - DNA, 140 bp, Artificial Sequence
  Synthetic
caccgctgtcccaaaaggtcattaaatcaaaaacaaaaaataaaataaaacaacctactattaaaccaaaatatccttccacaaccttaaaaaaaaccattaaattaacatcccatttaacatatcagcagccagggcct

SEQ ID NO: 377099 - DNA, 140 bp, Artificial Sequence
  Synthetic
atacgccatgctgggtctccatgtattaataatatgttttttgattgttattgatatgaatggttttttatttggttgttttgtatttgaatattgtggatattgtttgtagggttttagcgtacttgggagtcggccat

SEQ ID NO: 377100 - DNA, 140 bp, Artificial Sequence
  Synthetic
atggccgactcccaagtacgctaaaaccctacaaacaatatccacaatattcaaatacaaaacaaccaaataaaaaaccattcatatcaataacaatcaaaaaacatattattaatacatggagacccagcatggcgtat

SEQ ID NO: 377101 - DNA, 140 bp, Artificial Sequence
  Synthetic
aggccctggctgctgatatgtttggttgttttgtatttgaatattgtggatattgtttgtagggttttagttaaaatattttgaattgtttaattatatatgggagtgtggttttaataagaccttttgggacagcggtg

SEQ ID NO: 377102 - DNA, 140 bp, Artificial Sequence
  Synthetic
caccgctgtcccaaaaggtcttattaaaaccacactcccatatataattaaacaattcaaaatattttaactaaaaccctacaaacaatatccacaatattcaaatacaaaacaaccaaacatatcagcagccagggcct

SEQ ID NO: 377103 - DNA, 140 bp, Artificial Sequence
  Synthetic
atacgccatgctgggtctccgttaaattaattgtgtaagttatttgggttaaagtttttgttaggatattattataatgattaagataattaaattataggttttatttttgtaatgttacgtacttgggagtcggccat

SEQ ID NO: 377104 - DNA, 140 bp, Artificial Sequence
  Synthetic
atggccgactcccaagtacgtaacattacaaaaataaaacctataatttaattatcttaatcattataataatatcctaacaaaaactttaacccaaataacttacacaattaatttaacggagacccagcatggcgtat

SEQ ID NO: 377105 - DNA, 140 bp, Artificial Sequence
  Synthetic
aggccctggctgctgatatgattataatgattaagataattaaattataggttttatttttgtaatgttattttttttagtttgtttaaaattggtgtttttgtattattgttgatgattgaccttttgggacagcggtg

SEQ ID NO: 377106 - DNA, 140 bp, Artificial Sequence
  Synthetic
caccgctgtcccaaaaggtcaatcatcaacaataatacaaaaacaccaattttaaacaaactaaaaaaaataacattacaaaaataaaacctataatttaattatcttaatcattataatcatatcagcagccagggcct

SEQ ID NO: 377107 - DNA, 140 bp, Artificial Sequence
  Synthetic
atacgccatgctgggtctccttgttttttgtttggtgtgtgtgaaaagatattggttgtaaaatgatttataataggagttgatgataatagttatttataaattattttgtttttgaagcgtacttgggagtcggccat

SEQ ID NO: 377108 - DNA, 140 bp, Artificial Sequence
  Synthetic
atggccgactcccaagtacgcttcaaaaacaaaataatttataaataactattatcatcaactcctattataaatcattttacaaccaatatcttttcacacacaccaaacaaaaaacaaggagacccagcatggcgtat

SEQ ID NO: 377109 - DNA, 140 bp, Artificial Sequence
  Synthetic
aggccctggctgctgatatgtaataggagttgatgataatagttatttataaattattttgtttttgaagttagttgatgtatgaaataaggtattaataagtttgttttttgtatttaggaccttttgggacagcggtg

SEQ ID NO: 377110 - DNA, 140 bp, Artificial Sequence
  Synthetic
caccgctgtcccaaaaggtcctaaatacaaaaaacaaacttattaataccttatttcatacatcaactaacttcaaaaacaaaataatttataaataactattatcatcaactcctattacatatcagcagccagggcct

SEQ ID NO: 377111 - DNA, 140 bp, Artificial Sequence
  Synthetic
atacgccatgctgggtctccatttagggatatttaatttgttaggatttagtataaagttaatggtagtgtagtttttagggttttttgtaattaaaggtaagaataaattatttattttcgtacttgggagtcggccat

SEQ ID NO: 377112 - DNA, 140 bp, Artificial Sequence
  Synthetic
atggccgactcccaagtacgaaaataaataatttattcttacctttaattacaaaaaaccctaaaaactacactaccattaactttatactaaatcctaacaaattaaatatccctaaatggagacccagcatggcgtat

SEQ ID NO: 377113 - DNA, 140 bp, Artificial Sequence
  Synthetic
aggccctggctgctgatatgtagtttttagggttttttgtaattaaaggtaagaataaattatttattttaattatttggagataagtttttaattggaataagtttgaggtaattggatgaccttttgggacagcggtg

SEQ ID NO: 377114 - DNA, 140 bp, Artificial Sequence
  Synthetic
caccgctgtcccaaaaggtcatccaattacctcaaacttattccaattaaaaacttatctccaaataattaaaataaataatttattcttacctttaattacaaaaaaccctaaaaactacatatcagcagccagggcct

SEQ ID NO: 377115 - DNA, 140 bp, Artificial Sequence
  Synthetic
atacgccatgctgggtctccttaagtatttgtggtattgttagtgttaatgatattgttttgaaatttagaggtttgttgagtgttaattgtttaaggttaaaatttttattgaatttgacgtacttgggagtcggccat

SEQ ID NO: 377116 - DNA, 140 bp, Artificial Sequence
  Synthetic
atggccgactcccaagtacgtcaaattcaataaaaattttaaccttaaacaattaacactcaacaaacctctaaatttcaaaacaatatcattaacactaacaataccacaaatacttaaggagacccagcatggcgtat

SEQ ID NO: 377117 - DNA, 140 bp, Artificial Sequence
  Synthetic
aggccctggctgctgatatgaggtttgttgagtgttaattgtttaaggttaaaatttttattgaatttgagatgatgatattgtaagatttttattgaaaaaaatgtatggaaagttgtggaccttttgggacagcggtg

SEQ ID NO: 377118 - DNA, 140 bp, Artificial Sequence
  Synthetic
caccgctgtcccaaaaggtccacaactttccatacatttttttcaataaaaatcttacaatatcatcatctcaaattcaataaaaattttaaccttaaacaattaacactcaacaaacctcatatcagcagccagggcct

SEQ ID NO: 377119 - DNA, 140 bp, Artificial Sequence
  Synthetic
atacgccatgctgggtctccagtagtgtttatattagttagggttttttgaagattattaaaaattgtattagataatggtgttatttttgtagttgttttaagggattgaggtaattggcgtacttgggagtcggccat

SEQ ID NO: 377120 - DNA, 140 bp, Artificial Sequence
  Synthetic
atggccgactcccaagtacgccaattacctcaatcccttaaaacaactacaaaaataacaccattatctaatacaatttttaataatcttcaaaaaaccctaactaatataaacactactggagacccagcatggcgtat

SEQ ID NO: 377121 - DNA, 140 bp, Artificial Sequence
  Synthetic
aggccctggctgctgatatgtagataatggtgttatttttgtagttgttttaagggattgaggtaattggattttatttaaatattgtttttttttaaaatagataaaatttgaatgtatgaccttttgggacagcggtg

SEQ ID NO: 377122 - DNA, 140 bp, Artificial Sequence
  Synthetic
caccgctgtcccaaaaggtcatacattcaaattttatctattttaaaaaaaaacaatatttaaataaaatccaattacctcaatcccttaaaacaactacaaaaataacaccattatctacatatcagcagccagggcct

SEQ ID NO: 377123 - DNA, 140 bp, Artificial Sequence
  Synthetic
atacgccatgctgggtctccttaggttggtggttatttttgttgtattgtttttggtgttttgtttttgtttgtttgtgttagtttttaaggggaagattgataaaatagtaatgtattgcgtacttgggagtcggccat

SEQ ID NO: 377124 - DNA, 140 bp, Artificial Sequence
  Synthetic
atggccgactcccaagtacgcaatacattactattttatcaatcttccccttaaaaactaacacaaacaaacaaaaacaaaacaccaaaaacaatacaacaaaaataaccaccaacctaaggagacccagcatggcgtat

SEQ ID NO: 377125 - DNA, 140 bp, Artificial Sequence
  Synthetic
aggccctggctgctgatatgttgtttgtgttagtttttaaggggaagattgataaaatagtaatgtattgattgttatttattatagttgagtgtaatttaaaattagttttaattttaagaccttttgggacagcggtg

SEQ ID NO: 377126 - DNA, 140 bp, Artificial Sequence
  Synthetic
caccgctgtcccaaaaggtcttaaaattaaaactaattttaaattacactcaactataataaataacaatcaatacattactattttatcaatcttccccttaaaaactaacacaaacaacatatcagcagccagggcct

SEQ ID NO: 377127 - DNA, 140 bp, Artificial Sequence
  Synthetic
atacgccatgctgggtctcctttttaattttttttatatgatttttgtatgaattaggttttttgggggggttgttttgattttttagtgtgaggttatgtggtggattataataattatcgtacttgggagtcggccat

SEQ ID NO: 377128 - DNA, 140 bp, Artificial Sequence
  Synthetic
atggccgactcccaagtacgataattattataatccaccacataacctcacactaaaaaatcaaaacaacccccccaaaaaacctaattcatacaaaaatcatataaaaaaaattaaaaaggagacccagcatggcgtat

SEQ ID NO: 377129 - DNA, 140 bp, Artificial Sequence
  Synthetic
aggccctggctgctgatatggttgttttgattttttagtgtgaggttatgtggtggattataataattattgatatgtatataatattgtgggattgtataatgtatttaattaaaaatagaccttttgggacagcggtg

SEQ ID NO: 377130 - DNA, 140 bp, Artificial Sequence
  Synthetic
caccgctgtcccaaaaggtctatttttaattaaatacattatacaatcccacaatattatatacatatcaataattattataatccaccacataacctcacactaaaaaatcaaaacaaccatatcagcagccagggcct

SEQ ID NO: 377131 - DNA, 140 bp, Artificial Sequence
  Synthetic
atacgccatgctgggtctcctttatatttaaatgtaagattgtatttttttaaattagttataaagttattttttttaattgtggtatgtttattaaaattattatttgtgtggtgttatcgtacttgggagtcggccat

SEQ ID NO: 377132 - DNA, 140 bp, Artificial Sequence
  Synthetic
atggccgactcccaagtacgataacaccacacaaataataattttaataaacataccacaattaaaaaaaataactttataactaatttaaaaaaatacaatcttacatttaaatataaaggagacccagcatggcgtat

SEQ ID NO: 377133 - DNA, 140 bp, Artificial Sequence
  Synthetic
aggccctggctgctgatatgtttttttaattgtggtatgtttattaaaattattatttgtgtggtgttatgatgtttgatgtaataagttttttttttgtttatgttttgtaattattatgaccttttgggacagcggtg

SEQ ID NO: 377134 - DNA, 140 bp, Artificial Sequence
  Synthetic
caccgctgtcccaaaaggtcataataattacaaaacataaacaaaaaaaaaacttattacatcaaacatcataacaccacacaaataataattttaataaacataccacaattaaaaaaacatatcagcagccagggcct

SEQ ID NO: 377135 - DNA, 140 bp, Artificial Sequence
  Synthetic
atacgccatgctgggtctccaaagtgtttgaatattgtgagttggataaggtaattttttgaaggttttatttatatttaatttttttttttttaatgagaaagaaaagttttgatattgcgtacttgggagtcggccat

SEQ ID NO: 377136 - DNA, 140 bp, Artificial Sequence
  Synthetic
atggccgactcccaagtacgcaatatcaaaacttttctttctcattaaaaaaaaaaaaattaaatataaataaaaccttcaaaaaattaccttatccaactcacaatattcaaacactttggagacccagcatggcgtat

SEQ ID NO: 377137 - DNA, 140 bp, Artificial Sequence
  Synthetic
aggccctggctgctgatatgtttatatttaatttttttttttttaatgagaaagaaaagttttgatattgtggtagtagatatttgagtttttgtgtgtaggaaagaatatttttaataggaccttttgggacagcggtg

SEQ ID NO: 377138 - DNA, 140 bp, Artificial Sequence
  Synthetic
caccgctgtcccaaaaggtcctattaaaaatattctttcctacacacaaaaactcaaatatctactaccacaatatcaaaacttttctttctcattaaaaaaaaaaaaattaaatataaacatatcagcagccagggcct

SEQ ID NO: 377139 - DNA, 140 bp, Artificial Sequence
  Synthetic
atacgccatgctgggtctccttgtgaggtggattatattttagaatattaggtttgaatattgtattttagtatgttttttttattgtggtagttttgttttttataaaaatatttaagtcgtacttgggagtcggccat

SEQ ID NO: 377140 - DNA, 140 bp, Artificial Sequence
  Synthetic
atggccgactcccaagtacgacttaaatatttttataaaaaacaaaactaccacaataaaaaaaacatactaaaatacaatattcaaacctaatattctaaaatataatccacctcacaaggagacccagcatggcgtat

SEQ ID NO: 377141 - DNA, 140 bp, Artificial Sequence
  Synthetic
aggccctggctgctgatatggtatgttttttttattgtggtagttttgttttttataaaaatatttaagttattaataattttggttgagaaaagtggagggtggttaaggtggtaaaatgaccttttgggacagcggtg

SEQ ID NO: 377142 - DNA, 140 bp, Artificial Sequence
  Synthetic
caccgctgtcccaaaaggtcattttaccaccttaaccaccctccacttttctcaaccaaaattattaataacttaaatatttttataaaaaacaaaactaccacaataaaaaaaacataccatatcagcagccagggcct

SEQ ID NO: 377143 - DNA, 140 bp, Artificial Sequence
  Synthetic
atacgccatgctgggtctccgatataagaattaagatttggtgttagatttttatttgaagtaatattgtattaagatttttgattattaaaataatgtttggtaatattatatttaaaacgtacttgggagtcggccat

SEQ ID NO: 377144 - DNA, 140 bp, Artificial Sequence
  Synthetic
atggccgactcccaagtacgttttaaatataatattaccaaacattattttaataatcaaaaatcttaatacaatattacttcaaataaaaatctaacaccaaatcttaattcttatatcggagacccagcatggcgtat

SEQ ID NO: 377145 - DNA, 140 bp, Artificial Sequence
  Synthetic
aggccctggctgctgatatgattaagatttttgattattaaaataatgtttggtaatattatatttaaaaatatagtatgttttgaaaattattatagggtgtaatgtttttagtattgtgaccttttgggacagcggtg

SEQ ID NO: 377146 - DNA, 140 bp, Artificial Sequence
  Synthetic
caccgctgtcccaaaaggtcacaatactaaaaacattacaccctataataattttcaaaacatactatatttttaaatataatattaccaaacattattttaataatcaaaaatcttaatcatatcagcagccagggcct

SEQ ID NO: 377147 - DNA, 140 bp, Artificial Sequence
  Synthetic
atacgccatgctgggtctccgtttttagtgtttttgaatggaaaatagtttataaagttgttgtggtgttatttttagttttattaatgttttatggaatttatggattttttgagtttgcgtacttgggagtcggccat

SEQ ID NO: 377148 - DNA, 140 bp, Artificial Sequence
  Synthetic
atggccgactcccaagtacgcaaactcaaaaaatccataaattccataaaacattaataaaactaaaaataacaccacaacaactttataaactattttccattcaaaaacactaaaaacggagacccagcatggcgtat

SEQ ID NO: 377149 - DNA, 140 bp, Artificial Sequence
  Synthetic
aggccctggctgctgatatgatttttagttttattaatgttttatggaatttatggattttttgagtttgtgaaggttttagtgtatgtatttttgtaattttttttagggtgtgatttagaccttttgggacagcggtg

SEQ ID NO: 377150 - DNA, 140 bp, Artificial Sequence
  Synthetic
caccgctgtcccaaaaggtctaaatcacaccctaaaaaaaattacaaaaatacatacactaaaaccttcacaaactcaaaaaatccataaattccataaaacattaataaaactaaaaatcatatcagcagccagggcct

SEQ ID NO: 377151 - DNA, 140 bp, Artificial Sequence
  Synthetic
atacgccatgctgggtctccgagtataattgaattttggttaagtataatggtttgaggaatttaataattttatatttattagattttaatatggagagtaagtaatttttgttttggtcgtacttgggagtcggccat

SEQ ID NO: 377152 - DNA, 140 bp, Artificial Sequence
  Synthetic
atggccgactcccaagtacgaccaaaacaaaaattacttactctccatattaaaatctaataaatataaaattattaaattcctcaaaccattatacttaaccaaaattcaattatactcggagacccagcatggcgtat

SEQ ID NO: 377153 - DNA, 140 bp, Artificial Sequence
  Synthetic
aggccctggctgctgatatgtttatatttattagattttaatatggagagtaagtaatttttgttttggtaaagtatagatataattttaaaattgggataattagaataaattggatttgaccttttgggacagcggtg

SEQ ID NO: 377154 - DNA, 140 bp, Artificial Sequence
  Synthetic
caccgctgtcccaaaaggtcaaatccaatttattctaattatcccaattttaaaattatatctatactttaccaaaacaaaaattacttactctccatattaaaatctaataaatataaacatatcagcagccagggcct

SEQ ID NO: 377155 - DNA, 140 bp, Artificial Sequence
  Synthetic
atacgccatgctgggtctcctaaatttttgtatattattaagatgttggtagtagaaatagaaataatgtgtgtatgtttttgaattgtttttttgaatattgatgtttgatattagtttcgtacttgggagtcggccat

SEQ ID NO: 377156 - DNA, 140 bp, Artificial Sequence
  Synthetic
atggccgactcccaagtacgaaactaatatcaaacatcaatattcaaaaaaacaattcaaaaacatacacacattatttctatttctactaccaacatcttaataatatacaaaaatttaggagacccagcatggcgtat

SEQ ID NO: 377157 - DNA, 140 bp, Artificial Sequence
  Synthetic
aggccctggctgctgatatggtgtatgtttttgaattgtttttttgaatattgatgtttgatattagtttatagtagtatgggggattttttgtgtgtttagtggtaatattgaaattgggaccttttgggacagcggtg

SEQ ID NO: 377158 - DNA, 140 bp, Artificial Sequence
  Synthetic
caccgctgtcccaaaaggtcccaatttcaatattaccactaaacacacaaaaaatcccccatactactataaactaatatcaaacatcaatattcaaaaaaacaattcaaaaacatacaccatatcagcagccagggcct

SEQ ID NO: 377159 - DNA, 140 bp, Artificial Sequence
  Synthetic
atacgccatgctgggtctcctatgaataaattatgttgatttagagtttttttgatttaatttatttttttgagttaaaatagttagattatattagaaaaatatttgatgtaaaaatttcgtacttgggagtcggccat

SEQ ID NO: 377160 - DNA, 140 bp, Artificial Sequence
  Synthetic
atggccgactcccaagtacgaaatttttacatcaaatatttttctaatataatctaactattttaactcaaaaaaataaattaaatcaaaaaaactctaaatcaacataatttattcataggagacccagcatggcgtat

SEQ ID NO: 377161 - DNA, 140 bp, Artificial Sequence
  Synthetic
aggccctggctgctgatatgtgagttaaaatagttagattatattagaaaaatatttgatgtaaaaatttattgttttgaattgaagataagatttttttttgaaagtgtttattaatatgaccttttgggacagcggtg

SEQ ID NO: 377162 - DNA, 140 bp, Artificial Sequence
  Synthetic
caccgctgtcccaaaaggtcatattaataaacactttcaaaaaaaaatcttatcttcaattcaaaacaataaatttttacatcaaatatttttctaatataatctaactattttaactcacatatcagcagccagggcct

SEQ ID NO: 377163 - DNA, 140 bp, Artificial Sequence
  Synthetic
atacgccatgctgggtctccttttgtattgtgtatttaatgattttatttaagaattgttggtattgtggtttaataggatagaatttattgtttgatagtgttttgagaagaattgggacgtacttgggagtcggccat

SEQ ID NO: 377164 - DNA, 140 bp, Artificial Sequence
  Synthetic
atggccgactcccaagtacgtcccaattcttctcaaaacactatcaaacaataaattctatcctattaaaccacaataccaacaattcttaaataaaatcattaaatacacaatacaaaaggagacccagcatggcgtat

SEQ ID NO: 377165 - DNA, 140 bp, Artificial Sequence
  Synthetic
aggccctggctgctgatatgtttaataggatagaatttattgtttgatagtgttttgagaagaattgggattatgaaatttatgggtaatgttgttattggtatattatttaagaatttggaccttttgggacagcggtg

SEQ ID NO: 377166 - DNA, 140 bp, Artificial Sequence
  Synthetic
caccgctgtcccaaaaggtccaaattcttaaataatataccaataacaacattacccataaatttcataatcccaattcttctcaaaacactatcaaacaataaattctatcctattaaacatatcagcagccagggcct

SEQ ID NO: 377167 - DNA, 140 bp, Artificial Sequence
  Synthetic
atacgccatgctgggtctccgttgtgtagttgtggattaagggagtatgatgaatataatttgtaagttttagtgattaggttatattggtttaatataattggtgatgataatttagtgcgtacttgggagtcggccat

SEQ ID NO: 377168 - DNA, 140 bp, Artificial Sequence
  Synthetic
atggccgactcccaagtacgcactaaattatcatcaccaattatattaaaccaatataacctaatcactaaaacttacaaattatattcatcatactcccttaatccacaactacacaacggagacccagcatggcgtat

SEQ ID NO: 377169 - DNA, 140 bp, Artificial Sequence
  Synthetic
aggccctggctgctgatatgtagtgattaggttatattggtttaatataattggtgatgataatttagtgtttgggtattgggtatgttgtgtagttatttaatattaagaggaagaattgaccttttgggacagcggtg

SEQ ID NO: 377170 - DNA, 140 bp, Artificial Sequence
  Synthetic
caccgctgtcccaaaaggtcaattcttcctcttaatattaaataactacacaacatacccaatacccaaacactaaattatcatcaccaattatattaaaccaatataacctaatcactacatatcagcagccagggcct

SEQ ID NO: 377171 - DNA, 140 bp, Artificial Sequence
  Synthetic
atacgccatgctgggtctccattttttttaggttttttttttaatttatttatttaatgttaattatgagtatagagttagtaatatatagaatttgtgaaatttaatatatgtgatttgcgtacttgggagtcggccat

SEQ ID NO: 377172 - DNA, 140 bp, Artificial Sequence
  Synthetic
atggccgactcccaagtacgcaaatcacatatattaaatttcacaaattctatatattactaactctatactcataattaacattaaataaataaattaaaaaaaaaacctaaaaaaaatggagacccagcatggcgtat

SEQ ID NO: 377173 - DNA, 140 bp, Artificial Sequence
  Synthetic
aggccctggctgctgatatgtatagagttagtaatatatagaatttgtgaaatttaatatatgtgatttgtgggtttagttataattaattatttagtatataggatttttggtgataaagaccttttgggacagcggtg

SEQ ID NO: 377174 - DNA, 140 bp, Artificial Sequence
  Synthetic
caccgctgtcccaaaaggtctttatcaccaaaaatcctatatactaaataattaattataactaaacccacaaatcacatatattaaatttcacaaattctatatattactaactctatacatatcagcagccagggcct

SEQ ID NO: 377175 - DNA, 140 bp, Artificial Sequence
  Synthetic
atacgccatgctgggtctcctgtttgagggattttgagttttggtttttgtaagggtgttaatttggaagttggtttatagtgaggatttatttgtggttaaataaattattaagaaatacgtacttgggagtcggccat

SEQ ID NO: 377176 - DNA, 140 bp, Artificial Sequence
  Synthetic
atggccgactcccaagtacgtatttcttaataatttatttaaccacaaataaatcctcactataaaccaacttccaaattaacacccttacaaaaaccaaaactcaaaatccctcaaacaggagacccagcatggcgtat

SEQ ID NO: 377177 - DNA, 140 bp, Artificial Sequence
  Synthetic
aggccctggctgctgatatgttggtttatagtgaggatttatttgtggttaaataaattattaagaaatatgagtatttatttattatgtttatatatttgattatgaaagtagagatgtgaccttttgggacagcggtg

SEQ ID NO: 377178 - DNA, 140 bp, Artificial Sequence
  Synthetic
caccgctgtcccaaaaggtcacatctctactttcataatcaaatatataaacataataaataaatactcatatttcttaataatttatttaaccacaaataaatcctcactataaaccaacatatcagcagccagggcct

SEQ ID NO: 377179 - DNA, 140 bp, Artificial Sequence
  Synthetic
atacgccatgctgggtctccttattttagttagatagtaagagagttattaaatttaagaattaaattttgtatttgtgttgaggatttttgtgtaaatgtttttagtgtggatttatgacgtacttgggagtcggccat

SEQ ID NO: 377180 - DNA, 140 bp, Artificial Sequence
  Synthetic
atggccgactcccaagtacgtcataaatccacactaaaaacatttacacaaaaatcctcaacacaaatacaaaatttaattcttaaatttaataactctcttactatctaactaaaataaggagacccagcatggcgtat

SEQ ID NO: 377181 - DNA, 140 bp, Artificial Sequence
  Synthetic
aggccctggctgctgatatggtatttgtgttgaggatttttgtgtaaatgtttttagtgtggatttatgaaggagggaaaattttgttggtttaggttttatgtggtttattgttgatttgaccttttgggacagcggtg

SEQ ID NO: 377182 - DNA, 140 bp, Artificial Sequence
  Synthetic
caccgctgtcccaaaaggtcaaatcaacaataaaccacataaaacctaaaccaacaaaattttccctccttcataaatccacactaaaaacatttacacaaaaatcctcaacacaaataccatatcagcagccagggcct

SEQ ID NO: 377183 - DNA, 140 bp, Artificial Sequence
  Synthetic
atacgccatgctgggtctcctgattgtatgattttgagttttaattttaatattgtttaataatttgttgtagtttatgatatgtagagtatttaatttgttaataaatttgagaatattcgtacttgggagtcggccat

SEQ ID NO: 377184 - DNA, 140 bp, Artificial Sequence
  Synthetic
atggccgactcccaagtacgaatattctcaaatttattaacaaattaaatactctacatatcataaactacaacaaattattaaacaatattaaaattaaaactcaaaatcatacaatcaggagacccagcatggcgtat

SEQ ID NO: 377185 - DNA, 140 bp, Artificial Sequence
  Synthetic
aggccctggctgctgatatgtagtttatgatatgtagagtatttaatttgttaataaatttgagaatattggattgaattaatgatagtatttttaggtttaattgttttttgatatgttgaccttttgggacagcggtg

SEQ ID NO: 377186 - DNA, 140 bp, Artificial Sequence
  Synthetic
caccgctgtcccaaaaggtcaacatatcaaaaaacaattaaacctaaaaatactatcattaattcaatccaatattctcaaatttattaacaaattaaatactctacatatcataaactacatatcagcagccagggcct

SEQ ID NO: 377187 - DNA, 140 bp, Artificial Sequence
  Synthetic
atacgccatgctgggtctccattagattaagggtttttgttaagggtttaattaaagattggttaattagttggttttgtatttttgttgtaaggatgatttttaatgtttatagtggtgcgtacttgggagtcggccat

SEQ ID NO: 377188 - DNA, 140 bp, Artificial Sequence
  Synthetic
atggccgactcccaagtacgcaccactataaacattaaaaatcatccttacaacaaaaatacaaaaccaactaattaaccaatctttaattaaacccttaacaaaaacccttaatctaatggagacccagcatggcgtat

SEQ ID NO: 377189 - DNA, 140 bp, Artificial Sequence
  Synthetic
aggccctggctgctgatatgttggttttgtatttttgttgtaaggatgatttttaatgtttatagtggtgatttaattgtggaatttggattttgaaataaatgaggaaagagattttttgaccttttgggacagcggtg

SEQ ID NO: 377190 - DNA, 140 bp, Artificial Sequence
  Synthetic
caccgctgtcccaaaaggtcaaaaaatctctttcctcatttatttcaaaatccaaattccacaattaaatcaccactataaacattaaaaatcatccttacaacaaaaatacaaaaccaacatatcagcagccagggcct

SEQ ID NO: 377191 - DNA, 140 bp, Artificial Sequence
  Synthetic
atacgccatgctgggtctccggttatttttttgtgagttatattaaatttaatattagtttaataaattttttatttttgaatagtttggttaattaagaagttatagaggttgtttaagcgtacttgggagtcggccat

SEQ ID NO: 377192 - DNA, 140 bp, Artificial Sequence
  Synthetic
atggccgactcccaagtacgcttaaacaacctctataacttcttaattaaccaaactattcaaaaataaaaaatttattaaactaatattaaatttaatataactcacaaaaaaataaccggagacccagcatggcgtat

SEQ ID NO: 377193 - DNA, 140 bp, Artificial Sequence
  Synthetic
aggccctggctgctgatatgtttatttttgaatagtttggttaattaagaagttatagaggttgtttaagataatttttttttttaggttttttttgggtgatattagattgtattgtttgaccttttgggacagcggtg

SEQ ID NO: 377194 - DNA, 140 bp, Artificial Sequence
  Synthetic
caccgctgtcccaaaaggtcaaacaatacaatctaatatcacccaaaaaaaacctaaaaaaaaaaattatcttaaacaacctctataacttcttaattaaccaaactattcaaaaataaacatatcagcagccagggcct

SEQ ID NO: 377195 - DNA, 140 bp, Artificial Sequence
  Synthetic
atacgccatgctgggtctccttaatattttgttgtttagatatttttagtttaattttgaaattttgtgtttgattgttggaatgatgtttttattttttaattgtgagggtgtttaaagcgtacttgggagtcggccat

SEQ ID NO: 377196 - DNA, 140 bp, Artificial Sequence
  Synthetic
atggccgactcccaagtacgctttaaacaccctcacaattaaaaaataaaaacatcattccaacaatcaaacacaaaatttcaaaattaaactaaaaatatctaaacaacaaaatattaaggagacccagcatggcgtat

SEQ ID NO: 377197 - DNA, 140 bp, Artificial Sequence
  Synthetic
aggccctggctgctgatatgttgattgttggaatgatgtttttattttttaattgtgagggtgtttaaagtgatgtttgttgtaggtaagtttttttttagttaatggagttgatttggtgaccttttgggacagcggtg

SEQ ID NO: 377198 - DNA, 140 bp, Artificial Sequence
  Synthetic
caccgctgtcccaaaaggtcaccaaatcaactccattaactaaaaaaaaacttacctacaacaaacatcactttaaacaccctcacaattaaaaaataaaaacatcattccaacaatcaacatatcagcagccagggcct

SEQ ID NO: 377199 - DNA, 140 bp, Artificial Sequence
  Synthetic
atacgccatgctgggtctccgatattattgtttttaatataatgtatgggatgtgtatagattaatttagtttagagatatttttgtggtgtattttaggggtgattgatatatagttaacgtacttgggagtcggccat

SEQ ID NO: 377200 - DNA, 140 bp, Artificial Sequence
  Synthetic
atggccgactcccaagtacgttaactatatatcaatcacccctaaaatacaccacaaaaatatctctaaactaaattaatctatacacatcccatacattatattaaaaacaataatatcggagacccagcatggcgtat

SEQ ID NO: 377201 - DNA, 140 bp, Artificial Sequence
  Synthetic
aggccctggctgctgatatgtttagagatatttttgtggtgtattttaggggtgattgatatatagttaaaagatgtgttattaattggattattttgaaatagtattttgttaaaaggagaccttttgggacagcggtg

SEQ ID NO: 377202 - DNA, 140 bp, Artificial Sequence
  Synthetic
caccgctgtcccaaaaggtctccttttaacaaaatactatttcaaaataatccaattaataacacatcttttaactatatatcaatcacccctaaaatacaccacaaaaatatctctaaacatatcagcagccagggcct

SEQ ID NO: 377203 - DNA, 140 bp, Artificial Sequence
  Synthetic
atacgccatgctgggtctccttagatttttgtattaatttttattattagtttagtatttttggttataatttattttttgaaataagaataatatttttataagtttgttattgattgtcgtacttgggagtcggccat

SEQ ID NO: 377204 - DNA, 140 bp, Artificial Sequence
  Synthetic
atggccgactcccaagtacgacaatcaataacaaacttataaaaatattattcttatttcaaaaaataaattataaccaaaaatactaaactaataataaaaattaatacaaaaatctaaggagacccagcatggcgtat

SEQ ID NO: 377205 - DNA, 140 bp, Artificial Sequence
  Synthetic
aggccctggctgctgatatgtttattttttgaaataagaataatatttttataagtttgttattgattgtaatataataatagttaatattaaatattttttttatagtttgaagtataagaccttttgggacagcggtg

SEQ ID NO: 377206 - DNA, 140 bp, Artificial Sequence
  Synthetic
caccgctgtcccaaaaggtcttatacttcaaactataaaaaaaatatttaatattaactattattatattacaatcaataacaaacttataaaaatattattcttatttcaaaaaataaacatatcagcagccagggcct

SEQ ID NO: 377207 - DNA, 140 bp, Artificial Sequence
  Synthetic
atacgccatgctgggtctccagttatgaaatatttattttttgatgggatggattgttgttattttttgtagagtaaaatattatttgtgtataagaattattttgtgtaagaggtatgtcgtacttgggagtcggccat

SEQ ID NO: 377208 - DNA, 140 bp, Artificial Sequence
  Synthetic
atggccgactcccaagtacgacatacctcttacacaaaataattcttatacacaaataatattttactctacaaaaaataacaacaatccatcccatcaaaaaataaatatttcataactggagacccagcatggcgtat

SEQ ID NO: 377209 - DNA, 140 bp, Artificial Sequence
  Synthetic
aggccctggctgctgatatgagagtaaaatattatttgtgtataagaattattttgtgtaagaggtatgtttggtaggttatattatgagtgatatgagattatgattttttttgattatgaccttttgggacagcggtg

SEQ ID NO: 377210 - DNA, 140 bp, Artificial Sequence
  Synthetic
caccgctgtcccaaaaggtcataatcaaaaaaaatcataatctcatatcactcataatataacctaccaaacatacctcttacacaaaataattcttatacacaaataatattttactctcatatcagcagccagggcct

SEQ ID NO: 377211 - DNA, 140 bp, Artificial Sequence
  Synthetic
atacgccatgctgggtctccttattaatttgaaatgagagtgattatagtattgaataagttttaaaggatattgttttgattaaatatatgatgataggtatatggagtattgtgattacgtacttgggagtcggccat

SEQ ID NO: 377212 - DNA, 140 bp, Artificial Sequence
  Synthetic
atggccgactcccaagtacgtaatcacaatactccatatacctatcatcatatatttaatcaaaacaatatcctttaaaacttattcaatactataatcactctcatttcaaattaataaggagacccagcatggcgtat

SEQ ID NO: 377213 - DNA, 140 bp, Artificial Sequence
  Synthetic
aggccctggctgctgatatgtattgttttgattaaatatatgatgataggtatatggagtattgtgattaagtagaaggttatatagtgttttagttagttttattaaggggtatttttagaccttttgggacagcggtg

SEQ ID NO: 377214 - DNA, 140 bp, Artificial Sequence
  Synthetic
caccgctgtcccaaaaggtctaaaaataccccttaataaaactaactaaaacactatataaccttctacttaatcacaatactccatatacctatcatcatatatttaatcaaaacaatacatatcagcagccagggcct

SEQ ID NO: 377215 - DNA, 140 bp, Artificial Sequence
  Synthetic
atacgccatgctgggtctccttgaggaattaatgtttttaattttgaaataatgatagtagaatttttatatggtaattggagagtaatatttaagaatgtagtgataaatataattaggcgtacttgggagtcggccat

SEQ ID NO: 377216 - DNA, 140 bp, Artificial Sequence
  Synthetic
atggccgactcccaagtacgcctaattatatttatcactacattcttaaatattactctccaattaccatataaaaattctactatcattatttcaaaattaaaaacattaattcctcaaggagacccagcatggcgtat

SEQ ID NO: 377217 - DNA, 140 bp, Artificial Sequence
  Synthetic
aggccctggctgctgatatgatggtaattggagagtaatatttaagaatgtagtgataaatataattagggattgttggttttattgttgttatagtgtagttttaaaattgttttttttgaccttttgggacagcggtg

SEQ ID NO: 377218 - DNA, 140 bp, Artificial Sequence
  Synthetic
caccgctgtcccaaaaggtcaaaaaaaacaattttaaaactacactataacaacaataaaaccaacaatccctaattatatttatcactacattcttaaatattactctccaattaccatcatatcagcagccagggcct

SEQ ID NO: 377219 - DNA, 140 bp, Artificial Sequence
  Synthetic
atacgccatgctgggtctccgtttaagttttttgtgttttaggtgtgttttatataaaagatttagttgggattttgagaatttttttgttattatagtatatagagttaataatgttttcgtacttgggagtcggccat

SEQ ID NO: 377220 - DNA, 140 bp, Artificial Sequence
  Synthetic
atggccgactcccaagtacgaaaacattattaactctatatactataataacaaaaaaattctcaaaatcccaactaaatcttttatataaaacacacctaaaacacaaaaaacttaaacggagacccagcatggcgtat

SEQ ID NO: 377221 - DNA, 140 bp, Artificial Sequence
  Synthetic
aggccctggctgctgatatggattttgagaatttttttgttattatagtatatagagttaataatgtttttaattttgaattttttatggttttgatgttttgttttgtttagtgttttggaccttttgggacagcggtg

SEQ ID NO: 377222 - DNA, 140 bp, Artificial Sequence
  Synthetic
caccgctgtcccaaaaggtccaaaacactaaacaaaacaaaacatcaaaaccataaaaaattcaaaattaaaaacattattaactctatatactataataacaaaaaaattctcaaaatccatatcagcagccagggcct

SEQ ID NO: 377223 - DNA, 140 bp, Artificial Sequence
  Synthetic
atacgccatgctgggtctccaaattattagttgttggatttgttaagtgtgagtttttgggtgtagttatatttaattgttgttttattgatttataagttttatgggtgattagtaggacgtacttgggagtcggccat

SEQ ID NO: 377224 - DNA, 140 bp, Artificial Sequence
  Synthetic
atggccgactcccaagtacgtcctactaatcacccataaaacttataaatcaataaaacaacaattaaatataactacacccaaaaactcacacttaacaaatccaacaactaataatttggagacccagcatggcgtat

SEQ ID NO: 377225 - DNA, 140 bp, Artificial Sequence
  Synthetic
aggccctggctgctgatatgatttaattgttgttttattgatttataagttttatgggtgattagtaggagtaattttttattagttaaattttttaattggtgattttttttgtaaaaagaccttttgggacagcggtg

SEQ ID NO: 377226 - DNA, 140 bp, Artificial Sequence
  Synthetic
caccgctgtcccaaaaggtctttttacaaaaaaaatcaccaattaaaaaatttaactaataaaaaattactcctactaatcacccataaaacttataaatcaataaaacaacaattaaatcatatcagcagccagggcct

SEQ ID NO: 377227 - DNA, 140 bp, Artificial Sequence
  Synthetic
atacgccatgctgggtctcctgttggaggaattgttaatggtttaattttttttttatgaaatatagtaggaatgtgtatttgtgaggtgttttttgattgatggtatttattttgataacgtacttgggagtcggccat

SEQ ID NO: 377228 - DNA, 140 bp, Artificial Sequence
  Synthetic
atggccgactcccaagtacgttatcaaaataaataccatcaatcaaaaaacacctcacaaatacacattcctactatatttcataaaaaaaaaattaaaccattaacaattcctccaacaggagacccagcatggcgtat

SEQ ID NO: 377229 - DNA, 140 bp, Artificial Sequence
  Synthetic
aggccctggctgctgatatggaatgtgtatttgtgaggtgttttttgattgatggtatttattttgataattttttttggatgatgattgtgtttgaatatggtggttgtgtttatttttgaccttttgggacagcggtg

SEQ ID NO: 377230 - DNA, 140 bp, Artificial Sequence
  Synthetic
caccgctgtcccaaaaggtcaaaaataaacacaaccaccatattcaaacacaatcatcatccaaaaaaaattatcaaaataaataccatcaatcaaaaaacacctcacaaatacacattccatatcagcagccagggcct

SEQ ID NO: 377231 - DNA, 140 bp, Artificial Sequence
  Synthetic
atacgccatgctgggtctcctttaaaagttgtttttatttattgtttaaatttttattgattttttgattaatgttttatgtgtgttaggttgtaattaaattttattggtttgtagattcgtacttgggagtcggccat

SEQ ID NO: 377232 - DNA, 140 bp, Artificial Sequence
  Synthetic
atggccgactcccaagtacgaatctacaaaccaataaaatttaattacaacctaacacacataaaacattaatcaaaaaatcaataaaaatttaaacaataaataaaaacaacttttaaaggagacccagcatggcgtat

SEQ ID NO: 377233 - DNA, 140 bp, Artificial Sequence
  Synthetic
aggccctggctgctgatatgaatgttttatgtgtgttaggttgtaattaaattttattggtttgtagatttgattattataatttaataaaaaggttttttttttttgttattaaagatagaccttttgggacagcggtg

SEQ ID NO: 377234 - DNA, 140 bp, Artificial Sequence
  Synthetic
caccgctgtcccaaaaggtctatctttaataacaaaaaaaaaaaacctttttattaaattataataatcaaatctacaaaccaataaaatttaattacaacctaacacacataaaacattcatatcagcagccagggcct

SEQ ID NO: 377235 - DNA, 140 bp, Artificial Sequence
  Synthetic
atacgccatgctgggtctcctattttttttttaatttttattaagtttattatttttaaagagataattagattgatgttaaattttgtttatgattaattgtgagtttaaaggagttagcgtacttgggagtcggccat

SEQ ID NO: 377236 - DNA, 140 bp, Artificial Sequence
  Synthetic
atggccgactcccaagtacgctaactcctttaaactcacaattaatcataaacaaaatttaacatcaatctaattatctctttaaaaataataaacttaataaaaattaaaaaaaaaataggagacccagcatggcgtat

SEQ ID NO: 377237 - DNA, 140 bp, Artificial Sequence
  Synthetic
aggccctggctgctgatatggattgatgttaaattttgtttatgattaattgtgagtttaaaggagttagaattatattggttatgtttaaagttttagtgtattatattattatttgttgaccttttgggacagcggtg

SEQ ID NO: 377238 - DNA, 140 bp, Artificial Sequence
  Synthetic
caccgctgtcccaaaaggtcaacaaataataatataatacactaaaactttaaacataaccaatataattctaactcctttaaactcacaattaatcataaacaaaatttaacatcaatccatatcagcagccagggcct

SEQ ID NO: 377239 - DNA, 140 bp, Artificial Sequence
  Synthetic
atacgccatgctgggtctccatttgaggttgagtttttttatgaagtaatttgaagaaaaattaaaagataaatttgtatatatagaataaagtgataattgtaattataatgtttgtaacgtacttgggagtcggccat

SEQ ID NO: 377240 - DNA, 140 bp, Artificial Sequence
  Synthetic
atggccgactcccaagtacgttacaaacattataattacaattatcactttattctatatatacaaatttatcttttaatttttcttcaaattacttcataaaaaaactcaacctcaaatggagacccagcatggcgtat

SEQ ID NO: 377241 - DNA, 140 bp, Artificial Sequence
  Synthetic
aggccctggctgctgatatgaaatttgtatatatagaataaagtgataattgtaattataatgtttgtaattttaatatttgttggtatttattgtttttattttgtttattaattgttagaccttttgggacagcggtg

SEQ ID NO: 377242 - DNA, 140 bp, Artificial Sequence
  Synthetic
caccgctgtcccaaaaggtctaacaattaataaacaaaataaaaacaataaataccaacaaatattaaaattacaaacattataattacaattatcactttattctatatatacaaatttcatatcagcagccagggcct

SEQ ID NO: 377243 - DNA, 140 bp, Artificial Sequence
  Synthetic
atacgccatgctgggtctccattaattttgtttgttatgtttttggtttaattatgtggtttgatatagtagtttggttttagaatgtggtatgtgttgttttattgttgtagtaagaaacgtacttgggagtcggccat

SEQ ID NO: 377244 - DNA, 140 bp, Artificial Sequence
  Synthetic
atggccgactcccaagtacgtttcttactacaacaataaaacaacacataccacattctaaaaccaaactactatatcaaaccacataattaaaccaaaaacataacaaacaaaattaatggagacccagcatggcgtat

SEQ ID NO: 377245 - DNA, 140 bp, Artificial Sequence
  Synthetic
aggccctggctgctgatatgagtttggttttagaatgtggtatgtgttgttttattgttgtagtaagaaattaattgttttatggttgaggattgaaaaggtgtgtagtttagttgtggtgaccttttgggacagcggtg

SEQ ID NO: 377246 - DNA, 140 bp, Artificial Sequence
  Synthetic
caccgctgtcccaaaaggtcaccacaactaaactacacaccttttcaatcctcaaccataaaacaattaatttcttactacaacaataaaacaacacataccacattctaaaaccaaactcatatcagcagccagggcct

SEQ ID NO: 377247 - DNA, 140 bp, Artificial Sequence
  Synthetic
atacgccatgctgggtctccatttatagattaaattattttgattgtgtattagtttttttatgtaaatttttttggttgttggtttgaaatatggtatttaggttagtttgattgtagtcgtacttgggagtcggccat

SEQ ID NO: 377248 - DNA, 140 bp, Artificial Sequence
  Synthetic
atggccgactcccaagtacgactacaatcaaactaacctaaataccatatttcaaaccaacaaccaaaaaaatttacataaaaaaactaatacacaatcaaaataatttaatctataaatggagacccagcatggcgtat

SEQ ID NO: 377249 - DNA, 140 bp, Artificial Sequence
  Synthetic
aggccctggctgctgatatgtttttggttgttggtttgaaatatggtatttaggttagtttgattgtagtatttttattttgagtagtttagtaatgtaaattagggttgtatttgggttgaccttttgggacagcggtg

SEQ ID NO: 377250 - DNA, 140 bp, Artificial Sequence
  Synthetic
caccgctgtcccaaaaggtcaacccaaatacaaccctaatttacattactaaactactcaaaataaaaatactacaatcaaactaacctaaataccatatttcaaaccaacaaccaaaaacatatcagcagccagggcct

SEQ ID NO: 377251 - DNA, 140 bp, Artificial Sequence
  Synthetic
atacgccatgctgggtctcctttgtgattttagtaatagtattggtaattaagtttagttttttgttgttggtatttttttttttggtattttggtgatgagtgttgttgttgttagtggcgtacttgggagtcggccat

SEQ ID NO: 377252 - DNA, 140 bp, Artificial Sequence
  Synthetic
atggccgactcccaagtacgccactaacaacaacaacactcatcaccaaaataccaaaaaaaaaaataccaacaacaaaaaactaaacttaattaccaatactattactaaaatcacaaaggagacccagcatggcgtat

SEQ ID NO: 377253 - DNA, 140 bp, Artificial Sequence
  Synthetic
aggccctggctgctgatatgggtatttttttttttggtattttggtgatgagtgttgttgttgttagtggttttgttgtggttttggggatttgttgtggtggtggggtttaggaagttagaccttttgggacagcggtg

SEQ ID NO: 377254 - DNA, 140 bp, Artificial Sequence
  Synthetic
caccgctgtcccaaaaggtctaacttcctaaaccccaccaccacaacaaatccccaaaaccacaacaaaaccactaacaacaacaacactcatcaccaaaataccaaaaaaaaaaatacccatatcagcagccagggcct

SEQ ID NO: 377255 - DNA, 140 bp, Artificial Sequence
  Synthetic
atacgccatgctgggtctcctgtggtagagggagtgttggaggttgtgttgttgttgtttgttttgtggtgatgttgtttaatttgagttgttttagagatgttaagtttatatatgggtcgtacttgggagtcggccat

SEQ ID NO: 377256 - DNA, 140 bp, Artificial Sequence
  Synthetic
atggccgactcccaagtacgacccatatataaacttaacatctctaaaacaactcaaattaaacaacatcaccacaaaacaaacaacaacaacacaacctccaacactccctctaccacaggagacccagcatggcgtat

SEQ ID NO: 377257 - DNA, 140 bp, Artificial Sequence
  Synthetic
aggccctggctgctgatatggatgttgtttaatttgagttgttttagagatgttaagtttatatatgggtgtattatgggtgttgttgtttggatttggtttggttgtgagggattgggggaccttttgggacagcggtg

SEQ ID NO: 377258 - DNA, 140 bp, Artificial Sequence
  Synthetic
caccgctgtcccaaaaggtcccccaatccctcacaaccaaaccaaatccaaacaacaacacccataatacacccatatataaacttaacatctctaaaacaactcaaattaaacaacatccatatcagcagccagggcct

SEQ ID NO: 377259 - DNA, 140 bp, Artificial Sequence
  Synthetic
atacgccatgctgggtctccttttttgattgtgtatttgaattattgtagaggaattttttgaagttatgattttgtggtttttagttgttgtgttggtttttgggttggaagaagtttgcgtacttgggagtcggccat

SEQ ID NO: 377260 - DNA, 140 bp, Artificial Sequence
  Synthetic
atggccgactcccaagtacgcaaacttcttccaacccaaaaaccaacacaacaactaaaaaccacaaaatcataacttcaaaaaattcctctacaataattcaaatacacaatcaaaaaaggagacccagcatggcgtat

SEQ ID NO: 377261 - DNA, 140 bp, Artificial Sequence
  Synthetic
aggccctggctgctgatatgattttgtggtttttagttgttgtgttggtttttgggttggaagaagtttgtgttggattttgattattgatgtttttggttttgtttgatataattgtgagaccttttgggacagcggtg

SEQ ID NO: 377262 - DNA, 140 bp, Artificial Sequence
  Synthetic
caccgctgtcccaaaaggtctcacaattatatcaaacaaaaccaaaaacatcaataatcaaaatccaacacaaacttcttccaacccaaaaaccaacacaacaactaaaaaccacaaaatcatatcagcagccagggcct

SEQ ID NO: 377263 - DNA, 140 bp, Artificial Sequence
  Synthetic
atacgccatgctgggtctccagaaggtttattttttgattgttgtattaattttggggttgattttttaaattagtttttttgtggtattgtttttttttttatttgtatatattgttttcgtacttgggagtcggccat

SEQ ID NO: 377264 - DNA, 140 bp, Artificial Sequence
  Synthetic
atggccgactcccaagtacgaaaacaatatatacaaataaaaaaaaaaacaataccacaaaaaaactaatttaaaaaatcaaccccaaaattaatacaacaatcaaaaaataaaccttctggagacccagcatggcgtat

SEQ ID NO: 377265 - DNA, 140 bp, Artificial Sequence
  Synthetic
aggccctggctgctgatatgattagtttttttgtggtattgtttttttttttatttgtatatattgttttatttagttggagtagaaattgtggtgtgaattttgatttaagttggatgtgaccttttgggacagcggtg

SEQ ID NO: 377266 - DNA, 140 bp, Artificial Sequence
  Synthetic
caccgctgtcccaaaaggtcacatccaacttaaatcaaaattcacaccacaatttctactccaactaaataaaacaatatatacaaataaaaaaaaaaacaataccacaaaaaaactaatcatatcagcagccagggcct

SEQ ID NO: 377267 - DNA, 140 bp, Artificial Sequence
  Synthetic
atacgccatgctgggtctccttggtagtttgatatttaattgtggtagaatagtagttattagatgggttttttgttgtattgattggtttttttaaggggtgtgagttgaagaagttttcgtacttgggagtcggccat

SEQ ID NO: 377268 - DNA, 140 bp, Artificial Sequence
  Synthetic
atggccgactcccaagtacgaaaacttcttcaactcacaccccttaaaaaaaccaatcaatacaacaaaaaacccatctaataactactattctaccacaattaaatatcaaactaccaaggagacccagcatggcgtat

SEQ ID NO: 377269 - DNA, 140 bp, Artificial Sequence
  Synthetic
aggccctggctgctgatatgttttgttgtattgattggtttttttaaggggtgtgagttgaagaagttttttttagtttggggtagtattagaaatgtaatgatatttttagtgaaagttgaccttttgggacagcggtg

SEQ ID NO: 377270 - DNA, 140 bp, Artificial Sequence
  Synthetic
caccgctgtcccaaaaggtcaactttcactaaaaatatcattacatttctaatactaccccaaactaaaaaaaacttcttcaactcacaccccttaaaaaaaccaatcaatacaacaaaacatatcagcagccagggcct

SEQ ID NO: 377271 - DNA, 140 bp, Artificial Sequence
  Synthetic
atacgccatgctgggtctccattttttttatggaaggtaaagtttttggtatatggttttgtttttgatattttgtgtatatattggtattgggggaagttttgaattttgtttggtgttcgtacttgggagtcggccat

SEQ ID NO: 377272 - DNA, 140 bp, Artificial Sequence
  Synthetic
atggccgactcccaagtacgaacaccaaacaaaattcaaaacttcccccaataccaatatatacacaaaatatcaaaaacaaaaccatataccaaaaactttaccttccataaaaaaaatggagacccagcatggcgtat

SEQ ID NO: 377273 - DNA, 140 bp, Artificial Sequence
  Synthetic
aggccctggctgctgatatgttttgtgtatatattggtattgggggaagttttgaattttgtttggtgttgttggtagatatttatttttgttaggttttttgattttaagattgtagtagaccttttgggacagcggtg

SEQ ID NO: 377274 - DNA, 140 bp, Artificial Sequence
  Synthetic
caccgctgtcccaaaaggtctactacaatcttaaaatcaaaaaacctaacaaaaataaatatctaccaacaacaccaaacaaaattcaaaacttcccccaataccaatatatacacaaaacatatcagcagccagggcct

SEQ ID NO: 377275 - DNA, 140 bp, Artificial Sequence
  Synthetic
atacgccatgctgggtctcctggatttgaagttttattttttagttgtagatggtatgttagttgttattttattttttttgagatttagtttaattgattttaattgatttgtggatgacgtacttgggagtcggccat

SEQ ID NO: 377276 - DNA, 140 bp, Artificial Sequence
  Synthetic
atggccgactcccaagtacgtcatccacaaatcaattaaaatcaattaaactaaatctcaaaaaaaataaaataacaactaacataccatctacaactaaaaaataaaacttcaaatccaggagacccagcatggcgtat

SEQ ID NO: 377277 - DNA, 140 bp, Artificial Sequence
  Synthetic
aggccctggctgctgatatgttattttttttgagatttagtttaattgattttaattgatttgtggatgatagtttgttatgataaattagtttgttgatattattaatttgtaatgtgtgaccttttgggacagcggtg

SEQ ID NO: 377278 - DNA, 140 bp, Artificial Sequence
  Synthetic
caccgctgtcccaaaaggtcacacattacaaattaataatatcaacaaactaatttatcataacaaactatcatccacaaatcaattaaaatcaattaaactaaatctcaaaaaaaataacatatcagcagccagggcct

SEQ ID NO: 377279 - DNA, 140 bp, Artificial Sequence
  Synthetic
atacgccatgctgggtctccattatttaaagaaagaatgatgtttttttgaattgattatgaggtaattgtaatatttttgtaatgtttattgtgttgttgttttataatatttttttagcgtacttgggagtcggccat

SEQ ID NO: 377280 - DNA, 140 bp, Artificial Sequence
  Synthetic
atggccgactcccaagtacgctaaaaaaatattataaaacaacaacacaataaacattacaaaaatattacaattacctcataatcaattcaaaaaaacatcattctttctttaaataatggagacccagcatggcgtat

SEQ ID NO: 377281 - DNA, 140 bp, Artificial Sequence
  Synthetic
aggccctggctgctgatatgtaatatttttgtaatgtttattgtgttgttgttttataatatttttttagtggagtttattttggttatatgattgaaaaggatttgatgatttttatttgaccttttgggacagcggtg

SEQ ID NO: 377282 - DNA, 140 bp, Artificial Sequence
  Synthetic
caccgctgtcccaaaaggtcaaataaaaatcatcaaatccttttcaatcatataaccaaaataaactccactaaaaaaatattataaaacaacaacacaataaacattacaaaaatattacatatcagcagccagggcct

SEQ ID NO: 377283 - DNA, 140 bp, Artificial Sequence
  Synthetic
atacgccatgctgggtctccaatttttattgttgatttttttttaattagaagggtaatgtttgtatttggattgtgaataatttagaaatgggttttgattttttttttatatttttaacgtacttgggagtcggccat

SEQ ID NO: 377284 - DNA, 140 bp, Artificial Sequence
  Synthetic
atggccgactcccaagtacgttaaaaatataaaaaaaaaatcaaaacccatttctaaattattcacaatccaaatacaaacattacccttctaattaaaaaaaaatcaacaataaaaattggagacccagcatggcgtat

SEQ ID NO: 377285 - DNA, 140 bp, Artificial Sequence
  Synthetic
aggccctggctgctgatatggattgtgaataatttagaaatgggttttgattttttttttatatttttaatttaagttatattggttatttttagatgtaagtatgtaggtaatttgagggaccttttgggacagcggtg

SEQ ID NO: 377286 - DNA, 140 bp, Artificial Sequence
  Synthetic
caccgctgtcccaaaaggtccctcaaattacctacatacttacatctaaaaataaccaatataacttaaattaaaaatataaaaaaaaaatcaaaacccatttctaaattattcacaatccatatcagcagccagggcct

SEQ ID NO: 377287 - DNA, 140 bp, Artificial Sequence
  Synthetic
atacgccatgctgggtctcctattgattatagtaggattatttgtaatgttattagttatgattttttattaattaattttttaaaaataagtatattatgagttttttgttaagttttacgtacttgggagtcggccat

SEQ ID NO: 377288 - DNA, 140 bp, Artificial Sequence
  Synthetic
atggccgactcccaagtacgtaaaacttaacaaaaaactcataatatacttatttttaaaaaattaattaataaaaaatcataactaataacattacaaataatcctactataatcaataggagacccagcatggcgtat

SEQ ID NO: 377289 - DNA, 140 bp, Artificial Sequence
  Synthetic
aggccctggctgctgatatgtaattaattttttaaaaataagtatattatgagttttttgttaagttttatatttaggagagaaaaaagataatggtgtaaagtatttttagtatattgagaccttttgggacagcggtg

SEQ ID NO: 377290 - DNA, 140 bp, Artificial Sequence
  Synthetic
caccgctgtcccaaaaggtctcaatatactaaaaatactttacaccattatcttttttctctcctaaatataaaacttaacaaaaaactcataatatacttatttttaaaaaattaattacatatcagcagccagggcct

SEQ ID NO: 377291 - DNA, 140 bp, Artificial Sequence
  Synthetic
atacgccatgctgggtctccattatttttgagaagattttataaaattggatttgagttaattattgtaattattttttaattatagttggaagatttgtaggagaatgatatgtgttatcgtacttgggagtcggccat

SEQ ID NO: 377292 - DNA, 140 bp, Artificial Sequence
  Synthetic
atggccgactcccaagtacgataacacatatcattctcctacaaatcttccaactataattaaaaaataattacaataattaactcaaatccaattttataaaatcttctcaaaaataatggagacccagcatggcgtat

SEQ ID NO: 377293 - DNA, 140 bp, Artificial Sequence
  Synthetic
aggccctggctgctgatatgttattttttaattatagttggaagatttgtaggagaatgatatgtgttataattttgtgtgattattatggtgaggttttttggagttattgggtttaatgaccttttgggacagcggtg

SEQ ID NO: 377294 - DNA, 140 bp, Artificial Sequence
  Synthetic
caccgctgtcccaaaaggtcattaaacccaataactccaaaaaacctcaccataataatcacacaaaattataacacatatcattctcctacaaatcttccaactataattaaaaaataacatatcagcagccagggcct

SEQ ID NO: 377295 - DNA, 140 bp, Artificial Sequence
  Synthetic
atacgccatgctgggtctccagttatttttttattggttagtttgtggattagagtttttggtattttgatttttatgatatttttggttggattaattggaatgattttaaagttttggcgtacttgggagtcggccat

SEQ ID NO: 377296 - DNA, 140 bp, Artificial Sequence
  Synthetic
atggccgactcccaagtacgccaaaactttaaaatcattccaattaatccaaccaaaaatatcataaaaatcaaaataccaaaaactctaatccacaaactaaccaataaaaaaataactggagacccagcatggcgtat

SEQ ID NO: 377297 - DNA, 140 bp, Artificial Sequence
  Synthetic
aggccctggctgctgatatgtttttatgatatttttggttggattaattggaatgattttaaagttttggagtgaagttattattgtttggattttttttggagatgttagattggtattgaccttttgggacagcggtg

SEQ ID NO: 377298 - DNA, 140 bp, Artificial Sequence
  Synthetic
caccgctgtcccaaaaggtcaataccaatctaacatctccaaaaaaaatccaaacaataataacttcactccaaaactttaaaatcattccaattaatccaaccaaaaatatcataaaaacatatcagcagccagggcct

SEQ ID NO: 377299 - DNA, 140 bp, Artificial Sequence
  Synthetic
atacgccatgctgggtctccgatgaaatgaaatttttggatgtaatgttttatttgattttgttggagtgttattggtttatgttgtagtaggtagtggttgggtgattagtttgagtgtcgtacttgggagtcggccat

SEQ ID NO: 377300 - DNA, 140 bp, Artificial Sequence
  Synthetic
atggccgactcccaagtacgacactcaaactaatcacccaaccactacctactacaacataaaccaataacactccaacaaaatcaaataaaacattacatccaaaaatttcatttcatcggagacccagcatggcgtat

SEQ ID NO: 377301 - DNA, 140 bp, Artificial Sequence
  Synthetic
aggccctggctgctgatatgttattggtttatgttgtagtaggtagtggttgggtgattagtttgagtgttgttaaattaaaggtgaaatattggggtagttggattggtggaagaatgagaccttttgggacagcggtg

SEQ ID NO: 377302 - DNA, 140 bp, Artificial Sequence
  Synthetic
caccgctgtcccaaaaggtctcattcttccaccaatccaactaccccaatatttcacctttaatttaacaacactcaaactaatcacccaaccactacctactacaacataaaccaataacatatcagcagccagggcct

SEQ ID NO: 377303 - DNA, 140 bp, Artificial Sequence
  Synthetic
atacgccatgctgggtctcctttgggattttaggatttagttgattgattttgataagtggattggttgttttgttgaaatgggtgatagtgtatgaagtaagtatgatggtggttgtagcgtacttgggagtcggccat

SEQ ID NO: 377304 - DNA, 140 bp, Artificial Sequence
  Synthetic
atggccgactcccaagtacgctacaaccaccatcatacttacttcatacactatcacccatttcaacaaaacaaccaatccacttatcaaaatcaatcaactaaatcctaaaatcccaaaggagacccagcatggcgtat

SEQ ID NO: 377305 - DNA, 140 bp, Artificial Sequence
  Synthetic
aggccctggctgctgatatgtttgttgaaatgggtgatagtgtatgaagtaagtatgatggtggttgtagttgagttaaagttgtaggttttttgattagtgatatttagaggaagttaagaccttttgggacagcggtg

SEQ ID NO: 377306 - DNA, 140 bp, Artificial Sequence
  Synthetic
caccgctgtcccaaaaggtcttaacttcctctaaatatcactaatcaaaaaacctacaactttaactcaactacaaccaccatcatacttacttcatacactatcacccatttcaacaaacatatcagcagccagggcct

SEQ ID NO: 377307 - DNA, 140 bp, Artificial Sequence
  Synthetic
atacgccatgctgggtctccagttttaaggatgaatgttgatgatatattgtttggtgtgtggttggtatggttgatggtgttattggtaattggtttgagtggatttgatggagtgtttcgtacttgggagtcggccat

SEQ ID NO: 377308 - DNA, 140 bp, Artificial Sequence
  Synthetic
atggccgactcccaagtacgaaacactccatcaaatccactcaaaccaattaccaataacaccatcaaccataccaaccacacaccaaacaatatatcatcaacattcatccttaaaactggagacccagcatggcgtat

SEQ ID NO: 377309 - DNA, 140 bp, Artificial Sequence
  Synthetic
aggccctggctgctgatatgggttgatggtgttattggtaattggtttgagtggatttgatggagtgtttttattgattgattttggtgttaggaagtttgtattgttgttgttatttttgaccttttgggacagcggtg

SEQ ID NO: 377310 - DNA, 140 bp, Artificial Sequence
  Synthetic
caccgctgtcccaaaaggtcaaaaataacaacaacaatacaaacttcctaacaccaaaatcaatcaataaaaacactccatcaaatccactcaaaccaattaccaataacaccatcaacccatatcagcagccagggcct

SEQ ID NO: 377311 - DNA, 140 bp, Artificial Sequence
  Synthetic
atacgccatgctgggtctccgaggagtagtaggtaatataatttgttttatatttttaataattttgtttaatgtttataagatgaaggttaatgaaaaaatatttttttagttgaggtacgtacttgggagtcggccat

SEQ ID NO: 377312 - DNA, 140 bp, Artificial Sequence
  Synthetic
atggccgactcccaagtacgtacctcaactaaaaaaatattttttcattaaccttcatcttataaacattaaacaaaattattaaaaatataaaacaaattatattacctactactcctcggagacccagcatggcgtat

SEQ ID NO: 377313 - DNA, 140 bp, Artificial Sequence
  Synthetic
aggccctggctgctgatatgaatgtttataagatgaaggttaatgaaaaaatatttttttagttgaggtaggttttttttaatttttattatttttggtttgggttatttaataataattgaccttttgggacagcggtg

SEQ ID NO: 377314 - DNA, 140 bp, Artificial Sequence
  Synthetic
caccgctgtcccaaaaggtcaattattattaaataacccaaaccaaaaataataaaaattaaaaaaaacctacctcaactaaaaaaatattttttcattaaccttcatcttataaacattcatatcagcagccagggcct

SEQ ID NO: 377315 - DNA, 140 bp, Artificial Sequence
  Synthetic
atacgccatgctgggtctcctgttagtgagatatgaataattttattttggttgtttaattgatttatattatttagggttgatatttataagtgtattattaatgtaatgtattttatacgtacttgggagtcggccat

SEQ ID NO: 377316 - DNA, 140 bp, Artificial Sequence
  Synthetic
atggccgactcccaagtacgtataaaatacattacattaataatacacttataaatatcaaccctaaataatataaatcaattaaacaaccaaaataaaattattcatatctcactaacaggagacccagcatggcgtat

SEQ ID NO: 377317 - DNA, 140 bp, Artificial Sequence
  Synthetic
aggccctggctgctgatatgtatttagggttgatatttataagtgtattattaatgtaatgtattttatagtttagtagttgaagtttttgttattatttgttttttttggagggaaggggaccttttgggacagcggtg

SEQ ID NO: 377318 - DNA, 140 bp, Artificial Sequence
  Synthetic
caccgctgtcccaaaaggtccccttccctccaaaaaaaacaaataataacaaaaacttcaactactaaactataaaatacattacattaataatacacttataaatatcaaccctaaatacatatcagcagccagggcct

SEQ ID NO: 377319 - DNA, 140 bp, Artificial Sequence
  Synthetic
atacgccatgctgggtctccaatatatatttaattttgattaattttgggtgatggtgggattggatgtaagtttttttggtaagtttggggaatgttattttgagagtggatgtggatgcgtacttgggagtcggccat

SEQ ID NO: 377320 - DNA, 140 bp, Artificial Sequence
  Synthetic
atggccgactcccaagtacgcatccacatccactctcaaaataacattccccaaacttaccaaaaaaacttacatccaatcccaccatcacccaaaattaatcaaaattaaatatatattggagacccagcatggcgtat

SEQ ID NO: 377321 - DNA, 140 bp, Artificial Sequence
  Synthetic
aggccctggctgctgatatgagtttttttggtaagtttggggaatgttattttgagagtggatgtggatgataggtggagtagtattttggaagattggaattttttttgtaatttgaatgaccttttgggacagcggtg

SEQ ID NO: 377322 - DNA, 140 bp, Artificial Sequence
  Synthetic
caccgctgtcccaaaaggtcattcaaattacaaaaaaaattccaatcttccaaaatactactccacctatcatccacatccactctcaaaataacattccccaaacttaccaaaaaaactcatatcagcagccagggcct

SEQ ID NO: 377323 - DNA, 140 bp, Artificial Sequence
  Synthetic
atacgccatgctgggtctcctatgaatgatgtttaatgagttgttatttttttttaatttataaattatttgtattaattggtggaaagtagttttaaaattaggtaagtgattatatatcgtacttgggagtcggccat

SEQ ID NO: 377324 - DNA, 140 bp, Artificial Sequence
  Synthetic
atggccgactcccaagtacgatatataatcacttacctaattttaaaactactttccaccaattaatacaaataatttataaattaaaaaaaaataacaactcattaaacatcattcataggagacccagcatggcgtat

SEQ ID NO: 377325 - DNA, 140 bp, Artificial Sequence
  Synthetic
aggccctggctgctgatatgtgtattaattggtggaaagtagttttaaaattaggtaagtgattatatataatgttttttaaattttttgttgaaatgttaggttttttaaaatttttttgaccttttgggacagcggtg

SEQ ID NO: 377326 - DNA, 140 bp, Artificial Sequence
  Synthetic
caccgctgtcccaaaaggtcaaaaaaattttaaaaaacctaacatttcaacaaaaaatttaaaaaacattatatataatcacttacctaattttaaaactactttccaccaattaatacacatatcagcagccagggcct

SEQ ID NO: 377327 - DNA, 140 bp, Artificial Sequence
  Synthetic
atacgccatgctgggtctcctgagggatggttttatttttagatttaattttattttgaattgtattttttttataaagtgatggtttaggtggtggttgattatgtttggtttaataagcgtacttgggagtcggccat

SEQ ID NO: 377328 - DNA, 140 bp, Artificial Sequence
  Synthetic
atggccgactcccaagtacgcttattaaaccaaacataatcaaccaccacctaaaccatcactttataaaaaaaatacaattcaaaataaaattaaatctaaaaataaaaccatccctcaggagacccagcatggcgtat

SEQ ID NO: 377329 - DNA, 140 bp, Artificial Sequence
  Synthetic
aggccctggctgctgatatgtttataaagtgatggtttaggtggtggttgattatgtttggtttaataagttttagttgttgtagtggttgttgttgtttgattggttgttattattagagaccttttgggacagcggtg

SEQ ID NO: 377330 - DNA, 140 bp, Artificial Sequence
  Synthetic
caccgctgtcccaaaaggtctctaataataacaaccaatcaaacaacaacaaccactacaacaactaaaacttattaaaccaaacataatcaaccaccacctaaaccatcactttataaacatatcagcagccagggcct

SEQ ID NO: 377331 - DNA, 140 bp, Artificial Sequence
  Synthetic
atacgccatgctgggtctcctgtttttgttatattataaattggttttagattatttttaagatttgtaatgtgttgttttaatgattttgatgtgatggtttgttgttgtataatagtacgtacttgggagtcggccat

SEQ ID NO: 377332 - DNA, 140 bp, Artificial Sequence
  Synthetic
atggccgactcccaagtacgtactattatacaacaacaaaccatcacatcaaaatcattaaaacaacacattacaaatcttaaaaataatctaaaaccaatttataatataacaaaaacaggagacccagcatggcgtat

SEQ ID NO: 377333 - DNA, 140 bp, Artificial Sequence
  Synthetic
aggccctggctgctgatatgtgtgttgttttaatgattttgatgtgatggtttgttgttgtataatagtagttaatgaagttaatgtttgtattatttttttaaaattatgattgtaaatgaccttttgggacagcggtg

SEQ ID NO: 377334 - DNA, 140 bp, Artificial Sequence
  Synthetic
caccgctgtcccaaaaggtcatttacaatcataattttaaaaaaataatacaaacattaacttcattaactactattatacaacaacaaaccatcacatcaaaatcattaaaacaacacacatatcagcagccagggcct

SEQ ID NO: 377335 - DNA, 140 bp, Artificial Sequence
  Synthetic
atacgccatgctgggtctccgttgtatttgggatgtgtagtataattttggattgtttttaatattatagaagatgttgtttataggaatttttttggttattagttgtttagagatttacgtacttgggagtcggccat

SEQ ID NO: 377336 - DNA, 140 bp, Artificial Sequence
  Synthetic
atggccgactcccaagtacgtaaatctctaaacaactaataaccaaaaaaattcctataaacaacatcttctataatattaaaaacaatccaaaattatactacacatcccaaatacaacggagacccagcatggcgtat

SEQ ID NO: 377337 - DNA, 140 bp, Artificial Sequence
  Synthetic
aggccctggctgctgatatgaagatgttgtttataggaatttttttggttattagttgtttagagatttagtttgaaagtttagggtttggtattttgttgttttgagttgtggttgtaggaccttttgggacagcggtg

SEQ ID NO: 377338 - DNA, 140 bp, Artificial Sequence
  Synthetic
caccgctgtcccaaaaggtcctacaaccacaactcaaaacaacaaaataccaaaccctaaactttcaaactaaatctctaaacaactaataaccaaaaaaattcctataaacaacatcttcatatcagcagccagggcct

SEQ ID NO: 377339 - DNA, 140 bp, Artificial Sequence
  Synthetic
atacgccatgctgggtctccttttatattgaagataataagttttgagtgttagagaatttaattgatgtaaggatgatgaaggttttaatttttattattagtttttttttaattataacgtacttgggagtcggccat

SEQ ID NO: 377340 - DNA, 140 bp, Artificial Sequence
  Synthetic
atggccgactcccaagtacgttataattaaaaaaaaactaataataaaaattaaaaccttcatcatccttacatcaattaaattctctaacactcaaaacttattatcttcaatataaaaggagacccagcatggcgtat

SEQ ID NO: 377341 - DNA, 140 bp, Artificial Sequence
  Synthetic
aggccctggctgctgatatgaaggatgatgaaggttttaatttttattattagtttttttttaattataaaatgattgtgtaaatgttgggtaggttagtaggtaagttataaaagtatagaccttttgggacagcggtg

SEQ ID NO: 377342 - DNA, 140 bp, Artificial Sequence
  Synthetic
caccgctgtcccaaaaggtctatacttttataacttacctactaacctacccaacatttacacaatcattttataattaaaaaaaaactaataataaaaattaaaaccttcatcatccttcatatcagcagccagggcct

SEQ ID NO: 377343 - DNA, 140 bp, Artificial Sequence
  Synthetic
atacgccatgctgggtctcctggttataattgtggtttaatgtttatttgtattaagatttaaattgaattttgaaaaatggttagtaataataagttagttttaaatttaaaaataagacgtacttgggagtcggccat

SEQ ID NO: 377344 - DNA, 140 bp, Artificial Sequence
  Synthetic
atggccgactcccaagtacgtcttatttttaaatttaaaactaacttattattactaaccatttttcaaaattcaatttaaatcttaatacaaataaacattaaaccacaattataaccaggagacccagcatggcgtat

SEQ ID NO: 377345 - DNA, 140 bp, Artificial Sequence
  Synthetic
aggccctggctgctgatatgtttgaaaaatggttagtaataataagttagttttaaatttaaaaataagaattatttttattgtgataataatttatattttagatattaaaaattttttgaccttttgggacagcggtg

SEQ ID NO: 377346 - DNA, 140 bp, Artificial Sequence
  Synthetic
caccgctgtcccaaaaggtcaaaaaatttttaatatctaaaatataaattattatcacaataaaaataattcttatttttaaatttaaaactaacttattattactaaccatttttcaaacatatcagcagccagggcct

SEQ ID NO: 377347 - DNA, 140 bp, Artificial Sequence
  Synthetic
atacgccatgctgggtctccttttattgttttatgtttatttattgatgatgttgtaggattgttatgaatttatttttgtgatttattattggttaataaaattgttgattatttaatgcgtacttgggagtcggccat

SEQ ID NO: 377348 - DNA, 140 bp, Artificial Sequence
  Synthetic
atggccgactcccaagtacgcattaaataatcaacaattttattaaccaataataaatcacaaaaataaattcataacaatcctacaacatcatcaataaataaacataaaacaataaaaggagacccagcatggcgtat

SEQ ID NO: 377349 - DNA, 140 bp, Artificial Sequence
  Synthetic
aggccctggctgctgatatgtttatttttgtgatttattattggttaataaaattgttgattatttaatgtaataaatttattttttttatttatagttttttttttagtgagttatggtgaccttttgggacagcggtg

SEQ ID NO: 377350 - DNA, 140 bp, Artificial Sequence
  Synthetic
caccgctgtcccaaaaggtcaccataactcactaaaaaaaaaactataaataaaaaaaataaatttattacattaaataatcaacaattttattaaccaataataaatcacaaaaataaacatatcagcagccagggcct

SEQ ID NO: 377351 - DNA, 140 bp, Artificial Sequence
  Synthetic
atacgccatgctgggtctccggtattgaaaattataggtttattttttattatatgataatataaaatagtattaaatggtttttgtgattttagaatgtggtgatatatttttttaaaacgtacttgggagtcggccat

SEQ ID NO: 377352 - DNA, 140 bp, Artificial Sequence
  Synthetic
atggccgactcccaagtacgttttaaaaaaatatatcaccacattctaaaatcacaaaaaccatttaatactattttatattatcatataataaaaaataaacctataattttcaataccggagacccagcatggcgtat

SEQ ID NO: 377353 - DNA, 140 bp, Artificial Sequence
  Synthetic
aggccctggctgctgatatgtattaaatggtttttgtgattttagaatgtggtgatatatttttttaaaagagtgttttgattgggtgttgttattgttttggtttttggttttttgagtgaccttttgggacagcggtg

SEQ ID NO: 377354 - DNA, 140 bp, Artificial Sequence
  Synthetic
caccgctgtcccaaaaggtcactcaaaaaaccaaaaaccaaaacaataacaacacccaatcaaaacactcttttaaaaaaatatatcaccacattctaaaatcacaaaaaccatttaatacatatcagcagccagggcct

SEQ ID NO: 377355 - DNA, 140 bp, Artificial Sequence
  Synthetic
atacgccatgctgggtctccgatttttgtatatgggagttggtggggtgatagtgggtgtgtggttggaagttttgtttttgttttgttttttattatttgattttaagggtggaaggttcgtacttgggagtcggccat

SEQ ID NO: 377356 - DNA, 140 bp, Artificial Sequence
  Synthetic
atggccgactcccaagtacgaaccttccacccttaaaatcaaataataaaaaacaaaacaaaaacaaaacttccaaccacacacccactatcaccccaccaactcccatatacaaaaatcggagacccagcatggcgtat

SEQ ID NO: 377357 - DNA, 140 bp, Artificial Sequence
  Synthetic
aggccctggctgctgatatggttttgtttttgttttgttttttattatttgattttaagggtggaaggttagatgttttgttgttggtattgtttagtgggtttgtttttttgttaattggaccttttgggacagcggtg

SEQ ID NO: 377358 - DNA, 140 bp, Artificial Sequence
  Synthetic
caccgctgtcccaaaaggtccaattaacaaaaaaacaaacccactaaacaataccaacaacaaaacatctaaccttccacccttaaaatcaaataataaaaaacaaaacaaaaacaaaaccatatcagcagccagggcct

SEQ ID NO: 377359 - DNA, 140 bp, Artificial Sequence
  Synthetic
atacgccatgctgggtctccttgtttgtgagtggtgtattggtgtggtggattgttttgtgagggtttgggatattttgaattggtttggattgtgtttgtttgttttttatatgttggtcgtacttgggagtcggccat

SEQ ID NO: 377360 - DNA, 140 bp, Artificial Sequence
  Synthetic
atggccgactcccaagtacgaccaacatataaaaaacaaacaaacacaatccaaaccaattcaaaatatcccaaaccctcacaaaacaatccaccacaccaatacaccactcacaaacaaggagacccagcatggcgtat

SEQ ID NO: 377361 - DNA, 140 bp, Artificial Sequence
  Synthetic
aggccctggctgctgatatggatattttgaattggtttggattgtgtttgtttgttttttatatgttggtttttttgattgtttttttgttgtttatttttggttgatttattaggtattgaccttttgggacagcggtg

SEQ ID NO: 377362 - DNA, 140 bp, Artificial Sequence
  Synthetic
caccgctgtcccaaaaggtcaatacctaataaatcaaccaaaaataaacaacaaaaaaacaatcaaaaaaaccaacatataaaaaacaaacaaacacaatccaaaccaattcaaaatatccatatcagcagccagggcct

SEQ ID NO: 377363 - DNA, 140 bp, Artificial Sequence
  Synthetic
atacgccatgctgggtctcctggtgtatttatgttgttttttgagtaattttggtatttgttgtagtttttattattgggattaattattatattgggaatggttgtattttgtgagttacgtacttgggagtcggccat

SEQ ID NO: 377364 - DNA, 140 bp, Artificial Sequence
  Synthetic
atggccgactcccaagtacgtaactcacaaaatacaaccattcccaatataataattaatcccaataataaaaactacaacaaataccaaaattactcaaaaaacaacataaatacaccaggagacccagcatggcgtat

SEQ ID NO: 377365 - DNA, 140 bp, Artificial Sequence
  Synthetic
aggccctggctgctgatatgtattattgggattaattattatattgggaatggttgtattttgtgagttagttggattattattttgatggttaggattgttgttattattgatgggtttgaccttttgggacagcggtg

SEQ ID NO: 377366 - DNA, 140 bp, Artificial Sequence
  Synthetic
caccgctgtcccaaaaggtcaaacccatcaataataacaacaatcctaaccatcaaaataataatccaactaactcacaaaatacaaccattcccaatataataattaatcccaataatacatatcagcagccagggcct

SEQ ID NO: 377367 - DNA, 140 bp, Artificial Sequence
  Synthetic
atacgccatgctgggtctccgtgatgtagtagtgatagtttttgttagtttggttaggtgttttttttttagagttattatagtgtttgtttgttggaagttgattttgttttttttttgcgtacttgggagtcggccat

SEQ ID NO: 377368 - DNA, 140 bp, Artificial Sequence
  Synthetic
atggccgactcccaagtacgcaaaaaaaaaacaaaatcaacttccaacaaacaaacactataataactctaaaaaaaaaacacctaaccaaactaacaaaaactatcactactacatcacggagacccagcatggcgtat

SEQ ID NO: 377369 - DNA, 140 bp, Artificial Sequence
  Synthetic
aggccctggctgctgatatgagagttattatagtgtttgtttgttggaagttgattttgttttttttttgatggaagtttataagaattttttttttttgattattaagtttaagatggtgaccttttgggacagcggtg

SEQ ID NO: 377370 - DNA, 140 bp, Artificial Sequence
  Synthetic
caccgctgtcccaaaaggtcaccatcttaaacttaataatcaaaaaaaaaaaattcttataaacttccatcaaaaaaaaaacaaaatcaacttccaacaaacaaacactataataactctcatatcagcagccagggcct

SEQ ID NO: 377371 - DNA, 140 bp, Artificial Sequence
  Synthetic
atacgccatgctgggtctccgtagtttttttgagttgttgatattgttttttaatatttatttttgtgagggtatttttgtgtgttgtggtgattttgagtgtaattgttgatagttgagcgtacttgggagtcggccat

SEQ ID NO: 377372 - DNA, 140 bp, Artificial Sequence
  Synthetic
atggccgactcccaagtacgctcaactatcaacaattacactcaaaatcaccacaacacacaaaaataccctcacaaaaataaatattaaaaaacaatatcaacaactcaaaaaaactacggagacccagcatggcgtat

SEQ ID NO: 377373 - DNA, 140 bp, Artificial Sequence
  Synthetic
aggccctggctgctgatatgggtatttttgtgtgttgtggtgattttgagtgtaattgttgatagttgagggaaaagattatgtttaagattatttattttagaaaggtttaaaagttgggaccttttgggacagcggtg

SEQ ID NO: 377374 - DNA, 140 bp, Artificial Sequence
  Synthetic
caccgctgtcccaaaaggtcccaacttttaaacctttctaaaataaataatcttaaacataatcttttccctcaactatcaacaattacactcaaaatcaccacaacacacaaaaatacccatatcagcagccagggcct

SEQ ID NO: 377375 - DNA, 140 bp, Artificial Sequence
  Synthetic
atacgccatgctgggtctccaaaggagtttattttattttttattttggtggtttttgtaagaggatggagatgaattttttgttttgttttttgtaggatatgattaagtattgttttgcgtacttgggagtcggccat

SEQ ID NO: 377376 - DNA, 140 bp, Artificial Sequence
  Synthetic
atggccgactcccaagtacgcaaaacaatacttaatcatatcctacaaaaaacaaaacaaaaaattcatctccatcctcttacaaaaaccaccaaaataaaaaataaaataaactcctttggagacccagcatggcgtat

SEQ ID NO: 377377 - DNA, 140 bp, Artificial Sequence
  Synthetic
aggccctggctgctgatatggatgaattttttgttttgttttttgtaggatatgattaagtattgttttgataattaataagtttgaaaaatgagtttgagttattgaatttgaaattatgaccttttgggacagcggtg

SEQ ID NO: 377378 - DNA, 140 bp, Artificial Sequence
  Synthetic
caccgctgtcccaaaaggtcataatttcaaattcaataactcaaactcatttttcaaacttattaattatcaaaacaatacttaatcatatcctacaaaaaacaaaacaaaaaattcatccatatcagcagccagggcct

SEQ ID NO: 377379 - DNA, 140 bp, Artificial Sequence
  Synthetic
atacgccatgctgggtctccggagaaatttgattagaaaatttgtttgtattaaatggaaaattattattatgtgttttattgattgttaagttgttggatattgtattagtttttgtttcgtacttgggagtcggccat

SEQ ID NO: 377380 - DNA, 140 bp, Artificial Sequence
  Synthetic
atggccgactcccaagtacgaaacaaaaactaatacaatatccaacaacttaacaatcaataaaacacataataataattttccatttaatacaaacaaattttctaatcaaatttctccggagacccagcatggcgtat

SEQ ID NO: 377381 - DNA, 140 bp, Artificial Sequence
  Synthetic
aggccctggctgctgatatgatgtgttttattgattgttaagttgttggatattgtattagtttttgttttgtatgtatttgaatttgtttttgaatttttttaaggtaagtttttttttgaccttttgggacagcggtg

SEQ ID NO: 377382 - DNA, 140 bp, Artificial Sequence
  Synthetic
caccgctgtcccaaaaggtcaaaaaaaaacttaccttaaaaaaattcaaaaacaaattcaaatacatacaaaacaaaaactaatacaatatccaacaacttaacaatcaataaaacacatcatatcagcagccagggcct

SEQ ID NO: 377383 - DNA, 140 bp, Artificial Sequence
  Synthetic
atacgccatgctgggtctccgtattagttttagttgtttttttttttggtatggtagtaagtgtttttttaatgttttttttattagatattgttggtagtaattttttaaggtgttttacgtacttgggagtcggccat

SEQ ID NO: 377384 - DNA, 140 bp, Artificial Sequence
  Synthetic
atggccgactcccaagtacgtaaaacaccttaaaaaattactaccaacaatatctaataaaaaaaacattaaaaaaacacttactaccataccaaaaaaaaaaacaactaaaactaatacggagacccagcatggcgtat

SEQ ID NO: 377385 - DNA, 140 bp, Artificial Sequence
  Synthetic
aggccctggctgctgatatgaatgttttttttattagatattgttggtagtaattttttaaggtgttttattttattatgttttttgattttaaaatggaatttgtgtttttttaaatatgaccttttgggacagcggtg

SEQ ID NO: 377386 - DNA, 140 bp, Artificial Sequence
  Synthetic
caccgctgtcccaaaaggtcatatttaaaaaaacacaaattccattttaaaatcaaaaaacataataaaataaaacaccttaaaaaattactaccaacaatatctaataaaaaaaacattcatatcagcagccagggcct

SEQ ID NO: 377387 - DNA, 140 bp, Artificial Sequence
  Synthetic
atacgccatgctgggtctccatgaagataaagtatgagaaggaaattgtttgtatttttttgaaaattaatatttgttttaaaggtttgtatgataagttggtaaatttttttaagattgcgtacttgggagtcggccat

SEQ ID NO: 377388 - DNA, 140 bp, Artificial Sequence
  Synthetic
atggccgactcccaagtacgcaatcttaaaaaaatttaccaacttatcatacaaacctttaaaacaaatattaattttcaaaaaaatacaaacaatttccttctcatactttatcttcatggagacccagcatggcgtat

SEQ ID NO: 377389 - DNA, 140 bp, Artificial Sequence
  Synthetic
aggccctggctgctgatatgtatttgttttaaaggtttgtatgataagttggtaaatttttttaagattgtttatttgatatattgggatgattttttgttgaataattttttgttgaatgaccttttgggacagcggtg

SEQ ID NO: 377390 - DNA, 140 bp, Artificial Sequence
  Synthetic
caccgctgtcccaaaaggtcattcaacaaaaaattattcaacaaaaaatcatcccaatatatcaaataaacaatcttaaaaaaatttaccaacttatcatacaaacctttaaaacaaatacatatcagcagccagggcct

SEQ ID NO: 377391 - DNA, 140 bp, Artificial Sequence
  Synthetic
atacgccatgctgggtctccgatttggtgttatttagattttttgaggatgagaatttatatttggaattttgtgattttgagtaatttgttttttaattatttttaatgttttattttacgtacttgggagtcggccat

SEQ ID NO: 377392 - DNA, 140 bp, Artificial Sequence
  Synthetic
atggccgactcccaagtacgtaaaataaaacattaaaaataattaaaaaacaaattactcaaaatcacaaaattccaaatataaattctcatcctcaaaaaatctaaataacaccaaatcggagacccagcatggcgtat

SEQ ID NO: 377393 - DNA, 140 bp, Artificial Sequence
  Synthetic
aggccctggctgctgatatgttgtgattttgagtaatttgttttttaattatttttaatgttttattttaagttttagggttgttgaatttttaattttttaagtgtttaagtttaaaatgaccttttgggacagcggtg

SEQ ID NO: 377394 - DNA, 140 bp, Artificial Sequence
  Synthetic
caccgctgtcccaaaaggtcattttaaacttaaacacttaaaaaattaaaaattcaacaaccctaaaacttaaaataaaacattaaaaataattaaaaaacaaattactcaaaatcacaacatatcagcagccagggcct

SEQ ID NO: 377395 - DNA, 140 bp, Artificial Sequence
  Synthetic
atacgccatgctgggtctccttaataataatgtttttattaaggttgttggattattttgtagagtttgaggtggaatttgtgatgtgataagatttaggtgttgataagggatttttaacgtacttgggagtcggccat

SEQ ID NO: 377396 - DNA, 140 bp, Artificial Sequence
  Synthetic
atggccgactcccaagtacgttaaaaatcccttatcaacacctaaatcttatcacatcacaaattccacctcaaactctacaaaataatccaacaaccttaataaaaacattattattaaggagacccagcatggcgtat

SEQ ID NO: 377397 - DNA, 140 bp, Artificial Sequence
  Synthetic
atacgccatgctgggtctcctttttgtgatgtggttttgaaataaattaggtgtgattatagtaataattttaatttaaattttgatataaattttaatgagaggaaaattattaattttcgtacttgggagtcggccat

SEQ ID NO: 377398 - DNA, 140 bp, Artificial Sequence
  Synthetic
atggccgactcccaagtacgaaaattaataattttcctctcattaaaatttatatcaaaatttaaattaaaattattactataatcacacctaatttatttcaaaaccacatcacaaaaaggagacccagcatggcgtat

SEQ ID NO: 377399 - DNA, 140 bp, Artificial Sequence
  Synthetic
aggccctggctgctgatatgttaatttaaattttgatataaattttaatgagaggaaaattattaattttttttatagttatttgtatataaaagattttaaaaatttttttttttttttgaccttttgggacagcggtg

SEQ ID NO: 377400 - DNA, 140 bp, Artificial Sequence
  Synthetic
caccgctgtcccaaaaggtcaaaaaaaaaaaaaaatttttaaaatcttttatatacaaataactataaaaaaaattaataattttcctctcattaaaatttatatcaaaatttaaattaacatatcagcagccagggcct

SEQ ID NO: 377401 - DNA, 140 bp, Artificial Sequence
  Synthetic
atacgccatgctgggtctccagacacacaaaaacaagagatgatgattttgtgtatcatataaataaagaagaatattaacattgacattgagacttgtcagtctgttaatattcttgaacgtacttgggagtcggccat

SEQ ID NO: 377402 - DNA, 140 bp, Artificial Sequence
  Synthetic
atggccgactcccaagtacgttcaagaatattaacagactgacaagtctcaatgtcaatgttaatattcttctttatttatatgatacacaaaatcatcatctcttgtttttgtgtgtctggagacccagcatggcgtat

SEQ ID NO: 377403 - DNA, 140 bp, Artificial Sequence
  Synthetic
aggccctggctgctgatatgagaatattaacattgacattgagacttgtcagtctgttaatattcttgaagagatggatttacacagtttgttggagttgggtacaaaacccactgccccgaccttttgggacagcggtg

SEQ ID NO: 377404 - DNA, 140 bp, Artificial Sequence
  Synthetic
caccgctgtcccaaaaggtcggggcagtgggttttgtacccaactccaacaaactgtgtaaatccatctcttcaagaatattaacagactgacaagtctcaatgtcaatgttaatattctcatatcagcagccagggcct

SEQ ID NO: 377405 - DNA, 140 bp, Artificial Sequence
  Synthetic
atacgccatgctgggtctccgagatggatttacacagtttgttggagttgggtacaaaacccactgcccctcatgttcgtaataagaaagtgatattatttgacacaaatcatcaggttacgtacttgggagtcggccat

SEQ ID NO: 377406 - DNA, 140 bp, Artificial Sequence
  Synthetic
atggccgactcccaagtacgtaacctgatgatttgtgtcaaataatatcactttcttattacgaacatgaggggcagtgggttttgtacccaactccaacaaactgtgtaaatccatctcggagacccagcatggcgtat

SEQ ID NO: 377407 - DNA, 140 bp, Artificial Sequence
  Synthetic
atacgccatgctgggtctccgatctcctagaagggggtttgctgacgttgtgtgttgagcattactataattctgataaggataaattcaacacaagtcctatcgcgaagtacttacgtgcgtacttgggagtcggccat

SEQ ID NO: 377408 - DNA, 140 bp, Artificial Sequence
  Synthetic
atggccgactcccaagtacgcacgtaagtacttcgcgataggacttgtgttgaatttatccttatcagaattatagtaatgctcaacacacaacgtcagcaaacccccttctaggagatcggagacccagcatggcgtat

SEQ ID NO: 377409 - DNA, 140 bp, Artificial Sequence
  Synthetic
aggccctggctgctgatatgttctgataaggataaattcaacacaagtcctatcgcgaagtacttacgtgatgcgggctatgaatttgatgtcatcaagaatgcagatgcaacccgctttgaccttttgggacagcggtg

SEQ ID NO: 377410 - DNA, 140 bp, Artificial Sequence
  Synthetic
caccgctgtcccaaaaggtcaaagcgggttgcatctgcattcttgatgacatcaaattcatagcccgcatcacgtaagtacttcgcgataggacttgtgttgaatttatccttatcagaacatatcagcagccagggcct

SEQ ID NO: 377411 - DNA, 140 bp, Artificial Sequence
  Synthetic
atacgccatgctgggtctcctaagacattggaaagtactgaatctcagagggggagaattgggctctttttatcattttgcagtcttttcctcccaaaacttgtcgtcggagaccgagctcgtacttgggagtcggccat

SEQ ID NO: 377412 - DNA, 140 bp, Artificial Sequence
  Synthetic
atggccgactcccaagtacgagctcggtctccgacgacaagttttgggaggaaaagactgcaaaatgataaaaagagcccaattctccccctctgagattcagtactttccaatgtcttaggagacccagcatggcgtat

SEQ ID NO: 377413 - DNA, 140 bp, Artificial Sequence
  Synthetic
aggccctggctgctgatatgtatcattttgcagtcttttcctcccaaaacttgtcgtcggagaccgagctagtatcgaaaaggctttaagacaagtaacagtgcatcaagaacaggggatgaccttttgggacagcggtg

SEQ ID NO: 377414 - DNA, 140 bp, Artificial Sequence
  Synthetic
caccgctgtcccaaaaggtcatcccctgttcttgatgcactgttacttgtcttaaagccttttcgatactagctcggtctccgacgacaagttttgggaggaaaagactgcaaaatgatacatatcagcagccagggcct

SEQ ID NO: 377415 - DNA, 140 bp, Artificial Sequence
  Synthetic
atacgccatgctgggtctcctcgggattttgaggtccagcttcattttaaagtttgtgttgattcatcaaggagtaaatttggtgacaggtcatgatgcctatgacagtatcattagtaacgtacttgggagtcggccat

SEQ ID NO: 377416 - DNA, 140 bp, Artificial Sequence
  Synthetic
atggccgactcccaagtacgttactaatgatactgtcataggcatcatgacctgtcaccaaatttactccttgatgaatcaacacaaactttaaaatgaagctggacctcaaaatcccgaggagacccagcatggcgtat

SEQ ID NO: 377417 - DNA, 140 bp, Artificial Sequence
  Synthetic
aggccctggctgctgatatgggagtaaatttggtgacaggtcatgatgcctatgacagtatcattagtaattcagtaggtcaaactagattctcaggacttcttatcgtgaaaacagttcgaccttttgggacagcggtg

SEQ ID NO: 377418 - DNA, 140 bp, Artificial Sequence
  Synthetic
caccgctgtcccaaaaggtcgaactgttttcacgataagaagtcctgagaatctagtttgacctactgaattactaatgatactgtcataggcatcatgacctgtcaccaaatttactcccatatcagcagccagggcct

SEQ ID NO: 377419 - DNA, 140 bp, Artificial Sequence
  Synthetic
atacgccatgctgggtctccgtgcggacctccaaagtaaaaaatgaagttgctagtttcaagcaggcgttgagcaacctagcccgacatggggaatacgcaccatttgcacgggttctgacgtacttgggagtcggccat

SEQ ID NO: 377420 - DNA, 140 bp, Artificial Sequence
  Synthetic
atggccgactcccaagtacgtcagaacccgtgcaaatggtgcgtattccccatgtcgggctaggttgctcaacgcctgcttgaaactagcaacttcattttttactttggaggtccgcacggagacccagcatggcgtat

SEQ ID NO: 377421 - DNA, 140 bp, Artificial Sequence
  Synthetic
aggccctggctgctgatatggagcaacctagcccgacatggggaatacgcaccatttgcacgggttctgaatttatcagggattaacaacctcgaacatggactctatcctcagctttcagaccttttgggacagcggtg

SEQ ID NO: 377422 - DNA, 140 bp, Artificial Sequence
  Synthetic
caccgctgtcccaaaaggtctgaaagctgaggatagagtccatgttcgaggttgttaatccctgataaattcagaacccgtgcaaatggtgcgtattccccatgtcgggctaggttgctccatatcagcagccagggcct

SEQ ID NO: 377423 - DNA, 140 bp, Artificial Sequence
  Synthetic
atacgccatgctgggtctcccaatgttggcgaacaatatcaacaactacgagaggcggcacatgatgcggaagtaaaactacaaaggcgacatgaacatcaggaaattcaagctattgcccgtacttgggagtcggccat

SEQ ID NO: 377424 - DNA, 140 bp, Artificial Sequence
  Synthetic
atggccgactcccaagtacgggcaatagcttgaatttcctgatgttcatgtcgcctttgtagttttacttccgcatcatgtgccgcctctcgtagttgttgatattgttcgccaacattgggagacccagcatggcgtat

SEQ ID NO: 377425 - DNA, 140 bp, Artificial Sequence
  Synthetic
aggccctggctgctgatatgaagtaaaactacaaaggcgacatgaacatcaggaaattcaagctattgccgaggatgacgaggaaaggaagatattagaacaattccaccttcagaaaacgaccttttgggacagcggtg

SEQ ID NO: 377426 - DNA, 140 bp, Artificial Sequence
  Synthetic
caccgctgtcccaaaaggtcgttttctgaaggtggaattgttctaatatcttcctttcctcgtcatcctcggcaatagcttgaatttcctgatgttcatgtcgcctttgtagttttacttcatatcagcagccagggcct

SEQ ID NO: 377427 - DNA, 140 bp, Artificial Sequence
  Synthetic
atacgccatgctgggtctccaattagctcgtctcgctgcagaaattgaaaacaatattgtggaagatcagggatttaagcaatcacagaatcgggtgtcacagtcgtttttgaatgaccccgtacttgggagtcggccat

SEQ ID NO: 377428 - DNA, 140 bp, Artificial Sequence
  Synthetic
atggccgactcccaagtacggggtcattcaaaaacgactgtgacacccgattctgtgattgcttaaatccctgatcttccacaatattgttttcaatttctgcagcgagacgagctaattggagacccagcatggcgtat

SEQ ID NO: 377429 - DNA, 140 bp, Artificial Sequence
  Synthetic
aggccctggctgctgatatgggatttaagcaatcacagaatcgggtgtcacagtcgtttttgaatgaccctacacctgtggaagtaacggttcaagccaggcccatgaatcgaccaactggaccttttgggacagcggtg

SEQ ID NO: 377430 - DNA, 140 bp, Artificial Sequence
  Synthetic
caccgctgtcccaaaaggtccagttggtcgattcatgggcctggcttgaaccgttacttccacaggtgtagggtcattcaaaaacgactgtgacacccgattctgtgattgcttaaatcccatatcagcagccagggcct

SEQ ID NO: 377431 - DNA, 140 bp, Artificial Sequence
  Synthetic
atacgccatgctgggtctccagctcttcttcaagtagctttgttgacttgaatgatccatttgcactgctgaatgaggacgaggatactcttgatgacagtgtcatgatcccgggcacaacgtacttgggagtcggccat

SEQ ID NO: 377432 - DNA, 140 bp, Artificial Sequence
  Synthetic
atggccgactcccaagtacgttgtgcccgggatcatgacactgtcatcaagagtatcctcgtcctcattcagcagtgcaaatggatcattcaagtcaacaaagctacttgaagaagagctggagacccagcatggcgtat

SEQ ID NO: 377433 - DNA, 140 bp, Artificial Sequence
  Synthetic
aggccctggctgctgatatggaatgaggacgaggatactcttgatgacagtgtcatgatcccgggcacaacatcgagagaatttcaagggattcctgaaccgccaagacaatcccaagacgaccttttgggacagcggtg

SEQ ID NO: 377434 - DNA, 140 bp, Artificial Sequence
  Synthetic
caccgctgtcccaaaaggtcgtcttgggattgtcttggcggttcaggaatcccttgaaattctctcgatgttgtgcccgggatcatgacactgtcatcaagagtatcctcgtcctcattccatatcagcagccagggcct

SEQ ID NO: 377435 - DNA, 140 bp, Artificial Sequence
  Synthetic
atacgccatgctgggtctccgaaacagtttctgagatatcaagaattgcctcctgttcaagaggatgatgaatcggaatacacaactgactctcaagaaagcatcgaccaaccaggatcccgtacttgggagtcggccat

SEQ ID NO: 377436 - DNA, 140 bp, Artificial Sequence
  Synthetic
atggccgactcccaagtacgggatcctggttggtcgatgctttcttgagagtcagttgtgtattccgattcatcatcctcttgaacaggaggcaattcttgatatctcagaaactgtttcggagacccagcatggcgtat

SEQ ID NO: 377437 - DNA, 140 bp, Artificial Sequence
  Synthetic
aggccctggctgctgatatgaatcggaatacacaactgactctcaagaaagcatcgaccaaccaggatccgacaatgaacaaggagttgatcttccacctcctccgttgtacgctcaggagaccttttgggacagcggtg

SEQ ID NO: 377438 - DNA, 140 bp, Artificial Sequence
  Synthetic
caccgctgtcccaaaaggtctcctgagcgtacaacggaggaggtggaagatcaactccttgttcattgtcggatcctggttggtcgatgctttcttgagagtcagttgtgtattccgattcatatcagcagccagggcct

SEQ ID NO: 377439 - DNA, 140 bp, Artificial Sequence
  Synthetic
atacgccatgctgggtctcctcggcagtattggtgatgtaaatggtgatatcttagaacctataagatcaccttcttcaccatctgctcctcaggaagacacaaggatgagggaagcctacgtacttgggagtcggccat

SEQ ID NO: 377440 - DNA, 140 bp, Artificial Sequence
  Synthetic
atggccgactcccaagtacgtaggcttccctcatccttgtgtcttcctgaggagcagatggtgaagaaggtgatcttataggttctaagatatcaccatttacatcaccaatactgccgaggagacccagcatggcgtat

SEQ ID NO: 377441 - DNA, 140 bp, Artificial Sequence
  Synthetic
aggccctggctgctgatatgccttcttcaccatctgctcctcaggaagacacaaggatgagggaagcctatgaattgtcgcctgatttcacaaatgatgaggataatcagcagaattggcgaccttttgggacagcggtg

SEQ ID NO: 377442 - DNA, 140 bp, Artificial Sequence
  Synthetic
caccgctgtcccaaaaggtcgccaattctgctgattatcctcatcatttgtgaaatcaggcgacaattcataggcttccctcatccttgtgtcttcctgaggagcagatggtgaagaaggcatatcagcagccagggcct

SEQ ID NO: 377443 - DNA, 140 bp, Artificial Sequence
  Synthetic
atacgccatgctgggtctcccttctgcaaacaaatcctccagagtcacttataacagccctcgttgaggaataccaaaatcctgtctcagctaaggagcttcaagcagattggcccgacacgtacttgggagtcggccat

SEQ ID NO: 377444 - DNA, 140 bp, Artificial Sequence
  Synthetic
atggccgactcccaagtacgtgtcgggccaatctgcttgaagctccttagctgagacaggattttggtattcctcaacgagggctgttataagtgactctggaggatttgtttgcagaagggagacccagcatggcgtat

SEQ ID NO: 377445 - DNA, 140 bp, Artificial Sequence
  Synthetic
aggccctggctgctgatatgataccaaaatcctgtctcagctaaggagcttcaagcagattggcccgacatgtcatttgatgaaaggagacatgttgcgatgaacttgtagtccagataagaccttttgggacagcggtg

SEQ ID NO: 377446 - DNA, 140 bp, Artificial Sequence
  Synthetic
caccgctgtcccaaaaggtcttatctggactacaagttcatcgcaacatgtctcctttcatcaaatgacatgtcgggccaatctgcttgaagctccttagctgagacaggattttggtatcatatcagcagccagggcct

SEQ ID NO: 377447 - DNA, 140 bp, Artificial Sequence
  Synthetic
atacgccatgctgggtctccacagcaatcaaatttatttgaatatttgaaccaccttttagtatcctattacttgttactattgtgtgagacaacataagccatcaaataacaatcacggcgtacttgggagtcggccat

SEQ ID NO: 377448 - DNA, 140 bp, Artificial Sequence
  Synthetic
atggccgactcccaagtacgccgtgattgttatttgatggcttatgttgtctcacacaatagtaacaagtaataggatactaaaaggtggttcaaatattcaaataaatttgattgctgtggagacccagcatggcgtat

SEQ ID NO: 377449 - DNA, 140 bp, Artificial Sequence
  Synthetic
aggccctggctgctgatatgacttgttactattgtgtgagacaacataagccatcaaataacaatcacgggcaaggactgggcatactatggtggtcttagagcattgtccagtgctacagaccttttgggacagcggtg

SEQ ID NO: 377450 - DNA, 140 bp, Artificial Sequence
  Synthetic
caccgctgtcccaaaaggtctgtagcactggacaatgctctaagaccaccatagtatgcccagtccttgcccgtgattgttatttgatggcttatgttgtctcacacaatagtaacaagtcatatcagcagccagggcct

SEQ ID NO: 377451 - DNA, 140 bp, Artificial Sequence
  Synthetic
atacgccatgctgggtctcctgccgcaacactgtaatcaacactgctgtatctcttcttcaagccatctgatttaacttaataaacatgacttgattcaaagaatatactgacaatgttacgtacttgggagtcggccat

SEQ ID NO: 377452 - DNA, 140 bp, Artificial Sequence
  Synthetic
atggccgactcccaagtacgtaacattgtcagtatattctttgaatcaagtcatgtttattaagttaaatcagatggcttgaagaagagatacagcagtgttgattacagtgttgcggcaggagacccagcatggcgtat

SEQ ID NO: 377453 - DNA, 140 bp, Artificial Sequence
  Synthetic
aggccctggctgctgatatgatttaacttaataaacatgacttgattcaaagaatatactgacaatgttactgtttgaatttctcaagtggtgcactatcctactgttttgctcagcttagaccttttgggacagcggtg

SEQ ID NO: 377454 - DNA, 140 bp, Artificial Sequence
  Synthetic
caccgctgtcccaaaaggtctaagctgagcaaaacagtaggatagtgcaccacttgagaaattcaaacagtaacattgtcagtatattctttgaatcaagtcatgtttattaagttaaatcatatcagcagccagggcct

SEQ ID NO: 377455 - DNA, 140 bp, Artificial Sequence
  Synthetic
atacgccatgctgggtctccttataaatcacttacttgatagaatgtcgagtctactggtttggagtttccttactctaatggatgtaataattaactgttggcctagatgataacagatcgtacttgggagtcggccat

SEQ ID NO: 377456 - DNA, 140 bp, Artificial Sequence
  Synthetic
atggccgactcccaagtacgatctgttatcatctaggccaacagttaattattacatccattagagtaaggaaactccaaaccagtagactcgacattctatcaagtaagtgatttataaggagacccagcatggcgtat

SEQ ID NO: 377457 - DNA, 140 bp, Artificial Sequence
  Synthetic
aggccctggctgctgatatgcttactctaatggatgtaataattaactgttggcctagatgataacagatatgaggttatataattactcatagtgtaaagtataattcttacctctgttgaccttttgggacagcggtg

SEQ ID NO: 377458 - DNA, 140 bp, Artificial Sequence
  Synthetic
caccgctgtcccaaaaggtcaacagaggtaagaattatactttacactatgagtaattatataacctcatatctgttatcatctaggccaacagttaattattacatccattagagtaagcatatcagcagccagggcct

SEQ ID NO: 377459 - DNA, 140 bp, Artificial Sequence
  Synthetic
atacgccatgctgggtctccatcgaagaatattaaagattttctttaatattcagaaaaggctttttattctattctttctttttacaaacgtattgaaatagtaattctcacaatgtggcgtacttgggagtcggccat

SEQ ID NO: 377460 - DNA, 140 bp, Artificial Sequence
  Synthetic
atggccgactcccaagtacgccacattgtgagaattactatttcaatacgtttgtaaaaagaaagaatagaataaaaagccttttctgaatattaaagaaaatctttaatattcttcgatggagacccagcatggcgtat

SEQ ID NO: 377461 - DNA, 140 bp, Artificial Sequence
  Synthetic
aggccctggctgctgatatgctattctttctttttacaaacgtattgaaatagtaattctcacaatgtgggactcatcatacatgcagcaagtcagcgaagggttgatgactggaaaagtgaccttttgggacagcggtg

SEQ ID NO: 377462 - DNA, 140 bp, Artificial Sequence
  Synthetic
caccgctgtcccaaaaggtcacttttccagtcatcaacccttcgctgacttgctgcatgtatgatgagtcccacattgtgagaattactatttcaatacgtttgtaaaaagaaagaatagcatatcagcagccagggcct

SEQ ID NO: 377463 - DNA, 140 bp, Artificial Sequence
  Synthetic
atacgccatgctgggtctccgaagaaaaccaaaaggcacagttggactacaatgtagcccttgtctaatgtcaaaggcgacaagtactgatgatattatttgggaccaactgatcgtgaacgtacttgggagtcggccat

SEQ ID NO: 377464 - DNA, 140 bp, Artificial Sequence
  Synthetic
atggccgactcccaagtacgttcacgatcagttggtcccaaataatatcatcagtacttgtcgcctttgacattagacaagggctacattgtagtccaactgtgccttttggttttcttcggagacccagcatggcgtat

SEQ ID NO: 377465 - DNA, 140 bp, Artificial Sequence
  Synthetic
aggccctggctgctgatatgtcaaaggcgacaagtactgatgatattatttgggaccaactgatcgtgaagagaacactagctgatctacttataccgataaataggcagatatcagacagaccttttgggacagcggtg

SEQ ID NO: 377466 - DNA, 140 bp, Artificial Sequence
  Synthetic
caccgctgtcccaaaaggtctgtctgatatctgcctatttatcggtataagtagatcagctagtgttctcttcacgatcagttggtcccaaataatatcatcagtacttgtcgcctttgacatatcagcagccagggcct

SEQ ID NO: 377467 - DNA, 140 bp, Artificial Sequence
  Synthetic
atacgccatgctgggtctcccaattacatgagattaccccagttttaaaaatgggaaggacactggaagcaatttccaaggggatgtcagaaatgttagccaaatacgaccaccttgtaacgtacttgggagtcggccat

SEQ ID NO: 377468 - DNA, 140 bp, Artificial Sequence
  Synthetic
atggccgactcccaagtacgttacaaggtggtcgtatttggctaacatttctgacatccccttggaaattgcttccagtgtccttcccatttttaaaactggggtaatctcatgtaattgggagacccagcatggcgtat

SEQ ID NO: 377469 - DNA, 140 bp, Artificial Sequence
  Synthetic
aggccctggctgctgatatgaatttccaaggggatgtcagaaatgttagccaaatacgaccaccttgtaatttcaactggaagaaccactgcaccagctgctgcctttgatgcctacttagaccttttgggacagcggtg

SEQ ID NO: 377470 - DNA, 140 bp, Artificial Sequence
  Synthetic
caccgctgtcccaaaaggtctaagtaggcatcaaaggcagcagctggtgcagtggttcttccagttgaaattacaaggtggtcgtatttggctaacatttctgacatccccttggaaattcatatcagcagccagggcct

SEQ ID NO: 377471 - DNA, 140 bp, Artificial Sequence
  Synthetic
atacgccatgctgggtctccggttgcccaacaagcttgtagtaaggggaccatggttaaaaatgcaacaacagatgcagccgacaagatgtcgaaggttcttgaactcagtgaggaaacgcgtacttgggagtcggccat

SEQ ID NO: 377472 - DNA, 140 bp, Artificial Sequence
  Synthetic
atggccgactcccaagtacgcgtttcctcactgagttcaagaaccttcgacatcttgtcggctgcatctgttgttgcatttttaaccatggtccccttactacaagcttgttgggcaaccggagacccagcatggcgtat

SEQ ID NO: 377473 - DNA, 140 bp, Artificial Sequence
  Synthetic
aggccctggctgctgatatgcagatgcagccgacaagatgtcgaaggttcttgaactcagtgaggaaacgttctccaagccaaacctttcagctaaggatttagcccttttattgtttacgaccttttgggacagcggtg

SEQ ID NO: 377474 - DNA, 140 bp, Artificial Sequence
  Synthetic
caccgctgtcccaaaaggtcgtaaacaataaaagggctaaatccttagctgaaaggtttggcttggagaacgtttcctcactgagttcaagaaccttcgacatcttgtcggctgcatctgcatatcagcagccagggcct

SEQ ID NO: 377475 - DNA, 140 bp, Artificial Sequence
  Synthetic
atacgccatgctgggtctcccaaaaattgcttacaagtcaggaaaatccggagcattcttggatgcatttcaccagattctaagtgaaggagagaatgctcaggcggcattaactcgactcgtacttgggagtcggccat

SEQ ID NO: 377476 - DNA, 140 bp, Artificial Sequence
  Synthetic
atggccgactcccaagtacgagtcgagttaatgccgcctgagcattctctccttcacttagaatctggtgaaatgcatccaagaatgctccggattttcctgacttgtaagcaatttttgggagacccagcatggcgtat

SEQ ID NO: 377477 - DNA, 140 bp, Artificial Sequence
  Synthetic
aggccctggctgctgatatgcaccagattctaagtgaaggagagaatgctcaggcggcattaactcgactaagcagaacatttgacgctttccttggagtggttcctccagtgataagaggaccttttgggacagcggtg

SEQ ID NO: 377478 - DNA, 140 bp, Artificial Sequence
  Synthetic
caccgctgtcccaaaaggtcctcttatcactggaggaaccactccaaggaaagcgtcaaatgttctgcttagtcgagttaatgccgcctgagcattctctccttcacttagaatctggtgcatatcagcagccagggcct

SEQ ID NO: 377479 - DNA, 140 bp, Artificial Sequence
  Synthetic
atacgccatgctgggtctccgtccctccaaatccaacaattgacaaaggatgggtctgtgtttattcatctgagcaaggtgaaacacgggcccttaaaatctaattctcattgttcatagcgtacttgggagtcggccat

SEQ ID NO: 377480 - DNA, 140 bp, Artificial Sequence
  Synthetic
atggccgactcccaagtacgctatgaacaatgagaattagattttaagggcccgtgtttcaccttgctcagatgaataaacacagacccatcctttgtcaattgttggatttggagggacggagacccagcatggcgtat

SEQ ID NO: 377481 - DNA, 140 bp, Artificial Sequence
  Synthetic
aggccctggctgctgatatgtgagcaaggtgaaacacgggcccttaaaatctaattctcattgttcatagttgcaagggaagtgatctttccgagttgatacaaagacactaaacatttcgaccttttgggacagcggtg

SEQ ID NO: 377482 - DNA, 140 bp, Artificial Sequence
  Synthetic
caccgctgtcccaaaaggtcgaaatgtttagtgtctttgtatcaactcggaaagatcacttcccttgcaactatgaacaatgagaattagattttaagggcccgtgtttcaccttgctcacatatcagcagccagggcct

SEQ ID NO: 377483 - DNA, 140 bp, Artificial Sequence
  Synthetic
atacgccatgctgggtctcctaatttatttctgtcttaaatgtgattttcactttaaaagcgttaaatggtgatagattaatccttgaagttactcttctatatattatagagaaaccaacgtacttgggagtcggccat

SEQ ID NO: 377484 - DNA, 140 bp, Artificial Sequence
  Synthetic
atggccgactcccaagtacgttggtttctctataatatatagaagagtaacttcaaggattaatctatcaccatttaacgcttttaaagtgaaaatcacatttaagacagaaataaattaggagacccagcatggcgtat

SEQ ID NO: 377485 - DNA, 140 bp, Artificial Sequence
  Synthetic
aggccctggctgctgatatgtgatagattaatccttgaagttactcttctatatattatagagaaaccaatgttactaacaaaaggggtctacctaacgcatatgattgagtaatccgtagaccttttgggacagcggtg

SEQ ID NO: 377486 - DNA, 140 bp, Artificial Sequence
  Synthetic
caccgctgtcccaaaaggtctacggattactcaatcatatgcgttaggtagaccccttttgttagtaacattggtttctctataatatatagaagagtaacttcaaggattaatctatcacatatcagcagccagggcct

SEQ ID NO: 377487 - DNA, 140 bp, Artificial Sequence
  Synthetic
atacgccatgctgggtctccaacatagaaaagacatttatccttatgtaatcctcggcttagttgaaattaacttttgttggacctcaagacgcttattcatagtatattatatgattttcgtacttgggagtcggccat

SEQ ID NO: 377488 - DNA, 140 bp, Artificial Sequence
  Synthetic
atggccgactcccaagtacgaaaatcatataatatactatgaataagcgtcttgaggtccaacaaaagttaatttcaactaagccgaggattacataaggataaatgtcttttctatgttggagacccagcatggcgtat

SEQ ID NO: 377489 - DNA, 140 bp, Artificial Sequence
  Synthetic
aggccctggctgctgatatgaacttttgttggacctcaagacgcttattcatagtatattatatgattttttataagtttaagatatcttaaattatacccacaaaagatactgttttaagaccttttgggacagcggtg

SEQ ID NO: 377490 - DNA, 140 bp, Artificial Sequence
  Synthetic
caccgctgtcccaaaaggtcttaaaacagtatcttttgtgggtataatttaagatatcttaaacttataaaaaatcatataatatactatgaataagcgtcttgaggtccaacaaaagttcatatcagcagccagggcct

SEQ ID NO: 377491 - DNA, 140 bp, Artificial Sequence
  Synthetic
atacgccatgctgggtctccttttactggaaggagtattccaatttcagcttgttggattaattgttacttaaattgtcctttttgaaattaattcacacaaggtagtttaaatttatatcgtacttgggagtcggccat

SEQ ID NO: 377492 - DNA, 140 bp, Artificial Sequence
  Synthetic
atggccgactcccaagtacgatataaatttaaactaccttgtgtgaattaatttcaaaaaggacaatttaagtaacaattaatccaacaagctgaaattggaatactccttccagtaaaaggagacccagcatggcgtat

SEQ ID NO: 377493 - DNA, 140 bp, Artificial Sequence
  Synthetic
aggccctggctgctgatatgtaaattgtcctttttgaaattaattcacacaaggtagtttaaatttatatccaaaataaattttgatatggccagttccagcaattacaacacatacatggaccttttgggacagcggtg

SEQ ID NO: 377494 - DNA, 140 bp, Artificial Sequence
  Synthetic
caccgctgtcccaaaaggtccatgtatgtgttgtaattgctggaactggccatatcaaaatttattttggatataaatttaaactaccttgtgtgaattaatttcaaaaaggacaatttacatatcagcagccagggcct

SEQ ID NO: 377495 - DNA, 140 bp, Artificial Sequence
  Synthetic
atacgccatgctgggtctcccccggcggatcagctatcaaatcagcagggtataactccaaattacgtgggtgatttaaacctagatgatcagttcaaagggaatgtctgccatgctttccgtacttgggagtcggccat

SEQ ID NO: 377496 - DNA, 140 bp, Artificial Sequence
  Synthetic
atggccgactcccaagtacggaaagcatggcagacattccctttgaactgatcatctaggtttaaatcacccacgtaatttggagttataccctgctgatttgatagctgatccgccgggggagacccagcatggcgtat

SEQ ID NO: 377497 - DNA, 140 bp, Artificial Sequence
  Synthetic
aggccctggctgctgatatggtgatttaaacctagatgatcagttcaaagggaatgtctgccatgctttcactttagaggcaataattgacatatctgcatataacgagcgaacagtcaagaccttttgggacagcggtg

SEQ ID NO: 377498 - DNA, 140 bp, Artificial Sequence
  Synthetic
caccgctgtcccaaaaggtcttgactgttcgctcgttatatgcagatatgtcaattattgcctctaaagtgaaagcatggcagacattccctttgaactgatcatctaggtttaaatcaccatatcagcagccagggcct

SEQ ID NO: 377499 - DNA, 140 bp, Artificial Sequence
  Synthetic
atacgccatgctgggtctccctttagctcatactgtggccgcgttgctcacaggcagctatacaatcacccaatttactcacaacgggcaaaaattcgtccgtgttaatcgacttggtaccgtacttgggagtcggccat

SEQ ID NO: 377500 - DNA, 140 bp, Artificial Sequence
  Synthetic
atggccgactcccaagtacggtaccaagtcgattaacacggacgaatttttgcccgttgtgagtaaattgggtgattgtatagctgcctgtgagcaacgcggccacagtatgagctaaagggagacccagcatggcgtat

SEQ ID NO: 377501 - DNA, 140 bp, Artificial Sequence
  Synthetic
aggccctggctgctgatatgcaatttactcacaacgggcaaaaattcgtccgtgttaatcgacttggtacaggaatcccagcacacccactcagaatgttgcgtgaaggaaatcaagcttgaccttttgggacagcggtg

SEQ ID NO: 377502 - DNA, 140 bp, Artificial Sequence
  Synthetic
caccgctgtcccaaaaggtcaagcttgatttccttcacgcaacattctgagtgggtgtgctgggattcctgtaccaagtcgattaacacggacgaatttttgcccgttgtgagtaaattgcatatcagcagccagggcct

SEQ ID NO: 377503 - DNA, 140 bp, Artificial Sequence
  Synthetic
atacgccatgctgggtctcctacaatctcactaatttagtattgagtgtgcaaaaacttcctgatgatgcctggcgcccatccaaggacaaattaattgggaacactatgcatcccgcagcgtacttgggagtcggccat

SEQ ID NO: 377504 - DNA, 140 bp, Artificial Sequence
  Synthetic
atggccgactcccaagtacgctgcgggatgcatagtgttcccaattaatttgtccttggatgggcgccaggcatcatcaggaagtttttgcacactcaatactaaattagtgagattgtaggagacccagcatggcgtat

SEQ ID NO: 377505 - DNA, 140 bp, Artificial Sequence
  Synthetic
aggccctggctgctgatatgctggcgcccatccaaggacaaattaattgggaacactatgcatcccgcagtctccatccacccgaatctgccgcctattgttctaccaacagtcaagaaggaccttttgggacagcggtg

SEQ ID NO: 377506 - DNA, 140 bp, Artificial Sequence
  Synthetic
caccgctgtcccaaaaggtccttcttgactgttggtagaacaataggcggcagattcgggtggatggagactgcgggatgcatagtgttcccaattaatttgtccttggatgggcgccagcatatcagcagccagggcct

SEQ ID NO: 377507 - DNA, 140 bp, Artificial Sequence
  Synthetic
atacgccatgctgggtctccatctggcatcctccatcaactgagggtcgaaaaagtcccagagaagacgagcctgtttaggatctcgcttcctgccgacatgttctcagtaaaagagggtcgtacttgggagtcggccat

SEQ ID NO: 377508 - DNA, 140 bp, Artificial Sequence
  Synthetic
atggccgactcccaagtacgaccctcttttactgagaacatgtcggcaggaagcgagatcctaaacaggctcgtcttctctgggactttttcgaccctcagttgatggaggatgccagatggagacccagcatggcgtat

SEQ ID NO: 377509 - DNA, 140 bp, Artificial Sequence
  Synthetic
aggccctggctgctgatatggcctgtttaggatctcgcttcctgccgacatgttctcagtaaaagagggtatgatgaagaaaaggggagaaaattcccccgtggtttattttcaagcaccgaccttttgggacagcggtg

SEQ ID NO: 377510 - DNA, 140 bp, Artificial Sequence
  Synthetic
caccgctgtcccaaaaggtcggtgcttgaaaataaaccacgggggaattttctccccttttcttcatcataccctcttttactgagaacatgtcggcaggaagcgagatcctaaacaggccatatcagcagccagggcct

SEQ ID NO: 377511 - DNA, 140 bp, Artificial Sequence
  Synthetic
atacgccatgctgggtctccatgcgaatccaacgctcagtgccgtttgaaatgatgctcaaatgagacaggagtccatctgtataagaagtatggcttaaatggatatttgtcaaattctcgtacttgggagtcggccat

SEQ ID NO: 377512 - DNA, 140 bp, Artificial Sequence
  Synthetic
atggccgactcccaagtacgagaatttgacaaatatccatttaagccatacttcttatacagatggactcctgtctcatttgagcatcatttcaaacggcactgagcgttggattcgcatggagacccagcatggcgtat

SEQ ID NO: 377513 - DNA, 140 bp, Artificial Sequence
  Synthetic
aggccctggctgctgatatggagtccatctgtataagaagtatggcttaaatggatatttgtcaaattcttacaagattagtttgtattgatttcaacaatgctttaaccttacattgctgaccttttgggacagcggtg

SEQ ID NO: 377514 - DNA, 140 bp, Artificial Sequence
  Synthetic
caccgctgtcccaaaaggtcagcaatgtaaggttaaagcattgttgaaatcaatacaaactaatcttgtaagaatttgacaaatatccatttaagccatacttcttatacagatggactccatatcagcagccagggcct

SEQ ID NO: 377515 - DNA, 140 bp, Artificial Sequence
  Synthetic
atacgccatgctgggtctccgggccatcagatccataatgggtttactagactatataagagaaatagtaatattttataaacaattcttgctcagttttactgtgatttaataacatatcgtacttgggagtcggccat

SEQ ID NO: 377516 - DNA, 140 bp, Artificial Sequence
  Synthetic
atggccgactcccaagtacgatatgttattaaatcacagtaaaactgagcaagaattgtttataaaatattactatttctcttatatagtctagtaaacccattatggatctgatggcccggagacccagcatggcgtat

SEQ ID NO: 377517 - DNA, 140 bp, Artificial Sequence
  Synthetic
aggccctggctgctgatatgatattttataaacaattcttgctcagttttactgtgatttaataacatatgtcattgtgccctccattgctaagtcaactcaactgacgataatactcctgaccttttgggacagcggtg

SEQ ID NO: 377518 - DNA, 140 bp, Artificial Sequence
  Synthetic
caccgctgtcccaaaaggtcaggagtattatcgtcagttgagttgacttagcaatggagggcacaatgacatatgttattaaatcacagtaaaactgagcaagaattgtttataaaatatcatatcagcagccagggcct

SEQ ID NO: 377519 - DNA, 140 bp, Artificial Sequence
  Synthetic
atacgccatgctgggtctcctgattaatttctttaaatttgaccagaataatattttgtcagtgaatatattctcatatcacttgattaaaaacagaaaattaccctaacatgaagaccacgtacttgggagtcggccat

SEQ ID NO: 377520 - DNA, 140 bp, Artificial Sequence
  Synthetic
atggccgactcccaagtacgtggtcttcatgttagggtaattttctgtttttaatcaagtgatatgagaatatattcactgacaaaatattattctggtcaaatttaaagaaattaatcaggagacccagcatggcgtat

SEQ ID NO: 377521 - DNA, 140 bp, Artificial Sequence
  Synthetic
aggccctggctgctgatatgttctcatatcacttgattaaaaacagaaaattaccctaacatgaagaccacatgtttccttatcagtcttatcttaattcaagggacaaaaaatctccccgaccttttgggacagcggtg

SEQ ID NO: 377522 - DNA, 140 bp, Artificial Sequence
  Synthetic
caccgctgtcccaaaaggtcggggagattttttgtcccttgaattaagataagactgataaggaaacatgtggtcttcatgttagggtaattttctgtttttaatcaagtgatatgagaacatatcagcagccagggcct

SEQ ID NO: 377523 - DNA, 140 bp, Artificial Sequence
  Synthetic
atacgccatgctgggtctccctccggaactctccagaagacagaagacgtccatctgatgggattcacactgagtgggcaaaaagttgctgattcccctttggaggcatccaagcgatggcgtacttgggagtcggccat

SEQ ID NO: 377524 - DNA, 140 bp, Artificial Sequence
  Synthetic
atggccgactcccaagtacgccatcgcttggatgcctccaaaggggaatcagcaactttttgcccactcagtgtgaatcccatcagatggacgtcttctgtcttctggagagttccggagggagacccagcatggcgtat

SEQ ID NO: 377525 - DNA, 140 bp, Artificial Sequence
  Synthetic
aggccctggctgctgatatgtgagtgggcaaaaagttgctgattcccctttggaggcatccaagcgatgggctttcaggacaggtgtacctcccaagaatgttgagtacacagagggggagaccttttgggacagcggtg

SEQ ID NO: 377526 - DNA, 140 bp, Artificial Sequence
  Synthetic
caccgctgtcccaaaaggtctccccctctgtgtactcaacattcttgggaggtacacctgtcctgaaagcccatcgcttggatgcctccaaaggggaatcagcaactttttgcccactcacatatcagcagccagggcct

SEQ ID NO: 377527 - DNA, 140 bp, Artificial Sequence
  Synthetic
atacgccatgctgggtctccccttgctgttagatcctcctaccaacatccgtgactatcctaaatgcaaaactatccatcatattcaaggtcaaaaccctcatgcacaggggatcgccctcgtacttgggagtcggccat

SEQ ID NO: 377528 - DNA, 140 bp, Artificial Sequence
  Synthetic
atggccgactcccaagtacgagggcgatcccctgtgcatgagggttttgaccttgaatatgatggatagttttgcatttaggatagtcacggatgttggtaggaggatctaacagcaaggggagacccagcatggcgtat

SEQ ID NO: 377529 - DNA, 140 bp, Artificial Sequence
  Synthetic
aggccctggctgctgatatgactatccatcatattcaaggtcaaaaccctcatgcacaggggatcgcccttcatttatggggagcattttttctgtatgatcgcattgcctccacaacaagaccttttgggacagcggtg

SEQ ID NO: 377530 - DNA, 140 bp, Artificial Sequence
  Synthetic
caccgctgtcccaaaaggtcttgttgtggaggcaatgcgatcatacagaaaaaatgctccccataaatgaagggcgatcccctgtgcatgagggttttgaccttgaatatgatggatagtcatatcagcagccagggcct

SEQ ID NO: 377531 - DNA, 140 bp, Artificial Sequence
  Synthetic
atacgccatgctgggtctccaataagacagtgcacaaaatgattttctcgcggcaaggacaagggtaccgtcatatgaatctgacttctactaataaatattggacaagtagtaacggaacgtacttgggagtcggccat

SEQ ID NO: 377532 - DNA, 140 bp, Artificial Sequence
  Synthetic
atggccgactcccaagtacgttccgttactacttgtccaatatttattagtagaagtcagattcatatgacggtacccttgtccttgccgcgagaaaatcattttgtgcactgtcttattggagacccagcatggcgtat

SEQ ID NO: 377533 - DNA, 140 bp, Artificial Sequence
  Synthetic
aggccctggctgctgatatgtcatatgaatctgacttctactaataaatattggacaagtagtaacggaacgcaaacgaatgacactggatgtttcggcgctcttcaagaatacaattctgaccttttgggacagcggtg

SEQ ID NO: 377534 - DNA, 140 bp, Artificial Sequence
  Synthetic
caccgctgtcccaaaaggtcagaattgtattcttgaagagcgccgaaacatccagtgtcattcgtttgcgttccgttactacttgtccaatatttattagtagaagtcagattcatatgacatatcagcagccagggcct

SEQ ID NO: 377535 - DNA, 140 bp, Artificial Sequence
  Synthetic
atacgccatgctgggtctccagcccgtccggagatcaaactcacaagcaccccaactgatgccaccaaactcaataccacggacccaagcagtgatgatgaggacctcgcaacatccggccgtacttgggagtcggccat

SEQ ID NO: 377536 - DNA, 140 bp, Artificial Sequence
  Synthetic
atggccgactcccaagtacggccggatgttgcgaggtcctcatcatcactgcttgggtccgtggtattgagtttggtggcatcagttggggtgcttgtgagtttgatctccggacgggctggagacccagcatggcgtat

SEQ ID NO: 377537 - DNA, 140 bp, Artificial Sequence
  Synthetic
aggccctggctgctgatatgtcaataccacggacccaagcagtgatgatgaggacctcgcaacatccggctcagggtccggagaacgagaaccccacacaacttctgatgcggtcaccaagaccttttgggacagcggtg

SEQ ID NO: 377538 - DNA, 140 bp, Artificial Sequence
  Synthetic
caccgctgtcccaaaaggtcttggtgaccgcatcagaagttgtgtggggttctcgttctccggaccctgagccggatgttgcgaggtcctcatcatcactgcttgggtccgtggtattgacatatcagcagccagggcct

SEQ ID NO: 377539 - DNA, 140 bp, Artificial Sequence
  Synthetic
atacgccatgctgggtctcccgccacagcaaggaggaaacaacacaaaccattcccaagatgctgtgactgaactagacaaaaataacacaactgcacaaccgtccatgccccctcataacgtacttgggagtcggccat

SEQ ID NO: 377540 - DNA, 140 bp, Artificial Sequence
  Synthetic
atggccgactcccaagtacgttatgagggggcatggacggttgtgcagttgtgttatttttgtctagttcagtcacagcatcttgggaatggtttgtgttgtttcctccttgctgtggcgggagacccagcatggcgtat

SEQ ID NO: 377541 - DNA, 140 bp, Artificial Sequence
  Synthetic
aggccctggctgctgatatggaactagacaaaaataacacaactgcacaaccgtccatgccccctcataacactaccacaatctctactaacaacacctccaaacacaacttcagcactcgaccttttgggacagcggtg

SEQ ID NO: 377542 - DNA, 140 bp, Artificial Sequence
  Synthetic
caccgctgtcccaaaaggtcgagtgctgaagttgtgtttggaggtgttgttagtagagattgtggtagtgttatgagggggcatggacggttgtgcagttgtgttatttttgtctagttccatatcagcagccagggcct

SEQ ID NO: 377543 - DNA, 140 bp, Artificial Sequence
  Synthetic
atacgccatgctgggtctccactgaaaatgagcaaaccagtgccccctcgataacaaccctgcctccaacgggaaatcccaccacagcaaagagcaccagcagcaaaaaaggccccgccacgtacttgggagtcggccat

SEQ ID NO: 377544 - DNA, 140 bp, Artificial Sequence
  Synthetic
atggccgactcccaagtacgtggcggggccttttttgctgctggtgctctttgctgtggtgggatttcccgttggaggcagggttgttatcgagggggcactggtttgctcattttcagtggagacccagcatggcgtat

SEQ ID NO: 377545 - DNA, 140 bp, Artificial Sequence
  Synthetic
aggccctggctgctgatatggggaaatcccaccacagcaaagagcaccagcagcaaaaaaggccccgccacaacggcaccaaacacgacaaatgagcatttcaccagtcctccccccaccgaccttttgggacagcggtg

SEQ ID NO: 377546 - DNA, 140 bp, Artificial Sequence
  Synthetic
caccgctgtcccaaaaggtcggtggggggaggactggtgaaatgctcatttgtcgtgtttggtgccgttgtggcggggccttttttgctgctggtgctctttgctgtggtgggatttccccatatcagcagccagggcct

SEQ ID NO: 377547 - DNA, 140 bp, Artificial Sequence
  Synthetic
atacgccatgctgggtctcccctctggagggaaggcgacatgttcccttttctggatgggttaataaatgctccaattgattttgacccagttccaaatacaaaaacaatctttgatgaacgtacttgggagtcggccat

SEQ ID NO: 377548 - DNA, 140 bp, Artificial Sequence
  Synthetic
atggccgactcccaagtacgttcatcaaagattgtttttgtatttggaactgggtcaaaatcaattggagcatttattaacccatccagaaaagggaacatgtcgccttccctccagaggggagacccagcatggcgtat

SEQ ID NO: 377549 - DNA, 140 bp, Artificial Sequence
  Synthetic
aggccctggctgctgatatgctccaattgattttgacccagttccaaatacaaaaacaatctttgatgaatcctctagttctggtgcctcggctgaggaagatcaacatgcctcccccaagaccttttgggacagcggtg

SEQ ID NO: 377550 - DNA, 140 bp, Artificial Sequence
  Synthetic
caccgctgtcccaaaaggtcttgggggaggcatgttgatcttcctcagccgaggcaccagaactagaggattcatcaaagattgtttttgtatttggaactgggtcaaaatcaattggagcatatcagcagccagggcct

SEQ ID NO: 377551 - DNA, 140 bp, Artificial Sequence
  Synthetic
atacgccatgctgggtctccactctggagaaaatgagaatgattgtgatgcagagttaagaatttggagcgttcaggaggatgacctggccgcagggctcagttggataccgttttttggcgtacttgggagtcggccat

SEQ ID NO: 377552 - DNA, 140 bp, Artificial Sequence
  Synthetic
atggccgactcccaagtacgccaaaaaacggtatccaactgagccctgcggccaggtcatcctcctgaacgctccaaattcttaactctgcatcacaatcattctcattttctccagagtggagacccagcatggcgtat

SEQ ID NO: 377553 - DNA, 140 bp, Artificial Sequence
  Synthetic
aggccctggctgctgatatggttcaggaggatgacctggccgcagggctcagttggataccgttttttggccctggaattgaaggactttacactgctgttttaattaaaaatcaaaacagaccttttgggacagcggtg

SEQ ID NO: 377554 - DNA, 140 bp, Artificial Sequence
  Synthetic
caccgctgtcccaaaaggtctgttttgatttttaattaaaacagcagtgtaaagtccttcaattccagggccaaaaaacggtatccaactgagccctgcggccaggtcatcctcctgaaccatatcagcagccagggcct

SEQ ID NO: 377555 - DNA, 140 bp, Artificial Sequence
  Synthetic
atacgccatgctgggtctccgaactcttattgagagtcacaactgaggaaagaacattctccttaatcaatagacatgctattgactttctactcacaagatggggaggaacatgcaaagcgtacttgggagtcggccat

SEQ ID NO: 377556 - DNA, 140 bp, Artificial Sequence
  Synthetic
atggccgactcccaagtacgctttgcatgttcctccccatcttgtgagtagaaagtcaatagcatgtctattgattaaggagaatgttctttcctcagttgtgactctcaataagagttcggagacccagcatggcgtat

SEQ ID NO: 377557 - DNA, 140 bp, Artificial Sequence
  Synthetic
aggccctggctgctgatatgtagacatgctattgactttctactcacaagatggggaggaacatgcaaagtgcttggacctgattgttgcatcgggatagaagacttgtccaaaaatattgaccttttgggacagcggtg

SEQ ID NO: 377558 - DNA, 140 bp, Artificial Sequence
  Synthetic
caccgctgtcccaaaaggtcaatatttttggacaagtcttctatcccgatgcaacaatcaggtccaagcactttgcatgttcctccccatcttgtgagtagaaagtcaatagcatgtctacatatcagcagccagggcct

SEQ ID NO: 377559 - DNA, 140 bp, Artificial Sequence
  Synthetic
atacgccatgctgggtctccttggggtctgggtggtaaatggtggacatccgactggggtgttcttactaacttgggcattttgctactattatccatagctgtcttgattgctctatcccgtacttgggagtcggccat

SEQ ID NO: 377560 - DNA, 140 bp, Artificial Sequence
  Synthetic
atggccgactcccaagtacgggatagagcaatcaagacagctatggataatagtagcaaaatgcccaagttagtaagaacaccccagtcggatgtccaccatttaccacccagaccccaaggagacccagcatggcgtat

SEQ ID NO: 377561 - DNA, 140 bp, Artificial Sequence
  Synthetic
aggccctggctgctgatatgacttgggcattttgctactattatccatagctgtcttgattgctctatcctgtatttgtcgtatctttactaaatatatcggataacgttaaatgtgtaagaccttttgggacagcggtg

SEQ ID NO: 377562 - DNA, 140 bp, Artificial Sequence
  Synthetic
caccgctgtcccaaaaggtcttacacatttaacgttatccgatatatttagtaaagatacgacaaatacaggatagagcaatcaagacagctatggataatagtagcaaaatgcccaagtcatatcagcagccagggcct

SEQ ID NO: 377563 - DNA, 140 bp, Artificial Sequence
  Synthetic
atacgccatgctgggtctccaaatcaacttgggagatttttaagaagctgataacttaatgtgaatcaatagtttatgtattatcgattattatggtttgatattcaattgttattattgcgtacttgggagtcggccat

SEQ ID NO: 377564 - DNA, 140 bp, Artificial Sequence
  Synthetic
atggccgactcccaagtacgcaataataacaattgaatatcaaaccataataatcgataatacataaactattgattcacattaagttatcagcttcttaaaaatctcccaagttgatttggagacccagcatggcgtat

SEQ ID NO: 377565 - DNA, 140 bp, Artificial Sequence
  Synthetic
aggccctggctgctgatatgagtttatgtattatcgattattatggtttgatattcaattgttattattgtcaggagtgaccttttctatttgatgcattaatgttttaaactacctcttgaccttttgggacagcggtg

SEQ ID NO: 377566 - DNA, 140 bp, Artificial Sequence
  Synthetic
caccgctgtcccaaaaggtcaagaggtagtttaaaacattaatgcatcaaatagaaaaggtcactcctgacaataataacaattgaatatcaaaccataataatcgataatacataaactcatatcagcagccagggcct

SEQ ID NO: 377567 - DNA, 140 bp, Artificial Sequence
  Synthetic
atacgccatgctgggtctcctttcttattgtacagttttctgtattacttatttgggcttgaagacatagttaagatttgccgaaaatgctctccagtcaattccatcccctctcagaaacgtacttgggagtcggccat

SEQ ID NO: 377568 - DNA, 140 bp, Artificial Sequence
  Synthetic
atggccgactcccaagtacgtttctgagaggggatggaattgactggagagcattttcggcaaatcttaactatgtcttcaagcccaaataagtaatacagaaaactgtacaataagaaaggagacccagcatggcgtat

SEQ ID NO: 377569 - DNA, 140 bp, Artificial Sequence
  Synthetic
aggccctggctgctgatatgttaagatttgccgaaaatgctctccagtcaattccatcccctctcagaaaagacgtgctgttcaaagagtcttaatttataaccaactattgcaagaattgaccttttgggacagcggtg

SEQ ID NO: 377570 - DNA, 140 bp, Artificial Sequence
  Synthetic
caccgctgtcccaaaaggtcaattcttgcaatagttggttataaattaagactctttgaacagcacgtcttttctgagaggggatggaattgactggagagcattttcggcaaatcttaacatatcagcagccagggcct

SEQ ID NO: 377571 - DNA, 140 bp, Artificial Sequence
  Synthetic
atacgccatgctgggtctcccattattaacgacttgtcttaattcaatcgttcggatgaaattcataaggaaaaatgagcctccttccccctattctgggctgagaaaatttctcttatccgtacttgggagtcggccat

SEQ ID NO: 377572 - DNA, 140 bp, Artificial Sequence
  Synthetic
atggccgactcccaagtacggataagagaaattttctcagcccagaatagggggaaggaggctcatttttccttatgaatttcatccgaacgattgaattaagacaagtcgttaataatgggagacccagcatggcgtat

SEQ ID NO: 377573 - DNA, 140 bp, Artificial Sequence
  Synthetic
aggccctggctgctgatatgaaaaatgagcctccttccccctattctgggctgagaaaatttctcttatccgcctaaaatctgatctgttaggtcatgggtccttcataatctgtttgaggaccttttgggacagcggtg

SEQ ID NO: 377574 - DNA, 140 bp, Artificial Sequence
  Synthetic
caccgctgtcccaaaaggtcctcaaacagattatgaaggacccatgacctaacagatcagattttaggcggataagagaaattttctcagcccagaatagggggaaggaggctcatttttcatatcagcagccagggcct

SEQ ID NO: 377575 - DNA, 140 bp, Artificial Sequence
  Synthetic
atacgccatgctgggtctccttatcctttattaagaaaaagataaatagaacacaaagaattgacaaaattttactttgattgattttgcaaggagttataaaaatcttgaaggataaatcgtacttgggagtcggccat

SEQ ID NO: 377576 - DNA, 140 bp, Artificial Sequence
  Synthetic
atggccgactcccaagtacgatttatccttcaagatttttataactccttgcaaaatcaatcaaagtaaaattttgtcaattctttgtgttctatttatctttttcttaataaaggataaggagacccagcatggcgtat

SEQ ID NO: 377577 - DNA, 140 bp, Artificial Sequence
  Synthetic
aggccctggctgctgatatgtttactttgattgattttgcaaggagttataaaaatcttgaaggataaattgttataaagtagagtcgaagaacattaaatgttctttgttagaattattgaccttttgggacagcggtg

SEQ ID NO: 377578 - DNA, 140 bp, Artificial Sequence
  Synthetic
caccgctgtcccaaaaggtcaataattctaacaaagaacatttaatgttcttcgactctactttataacaatttatccttcaagatttttataactccttgcaaaatcaatcaaagtaaacatatcagcagccagggcct

SEQ ID NO: 377579 - DNA, 140 bp, Artificial Sequence
  Synthetic
atacgccatgctgggtctcctttgatttaagttttaaaatgcaacaacctcgcggaagaagtcgaacccgcaaccaccaagtcacaccgactatatatcatgaaactcaattgccctccacgtacttgggagtcggccat

SEQ ID NO: 377580 - DNA, 140 bp, Artificial Sequence
  Synthetic
atggccgactcccaagtacgtggagggcaattgagtttcatgatatatagtcggtgtgacttggtggttgcgggttcgacttcttccgcgaggttgttgcattttaaaacttaaatcaaaggagacccagcatggcgtat

SEQ ID NO: 377581 - DNA, 140 bp, Artificial Sequence
  Synthetic
aggccctggctgctgatatgcaaccaccaagtcacaccgactatatatcatgaaactcaattgccctccaaacctcattataccaattatcatccacgtgcaagatcgatgagctcaaccgaccttttgggacagcggtg

SEQ ID NO: 377582 - DNA, 140 bp, Artificial Sequence
  Synthetic
caccgctgtcccaaaaggtcggttgagctcatcgatcttgcacgtggatgataattggtataatgaggtttggagggcaattgagtttcatgatatatagtcggtgtgacttggtggttgcatatcagcagccagggcct

SEQ ID NO: 377583 - DNA, 140 bp, Artificial Sequence
  Synthetic
atacgccatgctgggtctccaccctcaacattcaacttatcgaaaccccctcctcctccaaaagacatgtgcaggaacatgaaaattggattgccgtgcgctgatcccacttgtaatagacgtacttgggagtcggccat

SEQ ID NO: 377584 - DNA, 140 bp, Artificial Sequence
  Synthetic
atggccgactcccaagtacgtctattacaagtgggatcagcgcacggcaatccaattttcatgttcctgcacatgtcttttggaggaggagggggtttcgataagttgaatgttgagggtggagacccagcatggcgtat

SEQ ID NO: 377585 - DNA, 140 bp, Artificial Sequence
  Synthetic
aggccctggctgctgatatggcaggaacatgaaaattggattgccgtgcgctgatcccacttgtaatagagatcatgaccttgataatctaacaaatcgtgaacttttgctattgatggcgaccttttgggacagcggtg

SEQ ID NO: 377586 - DNA, 140 bp, Artificial Sequence
  Synthetic
caccgctgtcccaaaaggtcgccatcaatagcaaaagttcacgatttgttagattatcaaggtcatgatctctattacaagtgggatcagcgcacggcaatccaattttcatgttcctgccatatcagcagccagggcct

SEQ ID NO: 377587 - DNA, 140 bp, Artificial Sequence
  Synthetic
atacgccatgctgggtctccgtggatcaccgtctctttctaaaggtctctcaaaagataaacaggagcaaacgaaagatgtgttgaccttggaaaatctaggacacattctgagctatctcgtacttgggagtcggccat

SEQ ID NO: 377588 - DNA, 140 bp, Artificial Sequence
  Synthetic
atggccgactcccaagtacgagatagctcagaatgtgtcctagattttccaaggtcaacacatctttcgtttgctcctgtttatcttttgagagacctttagaaagagacggtgatccacggagacccagcatggcgtat

SEQ ID NO: 377589 - DNA, 140 bp, Artificial Sequence
  Synthetic
aggccctggctgctgatatgacgaaagatgtgttgaccttggaaaatctaggacacattctgagctatctccacagatcagaaattgggaaattggatgagacatcacttcgtgcagcatgaccttttgggacagcggtg

SEQ ID NO: 377590 - DNA, 140 bp, Artificial Sequence
  Synthetic
caccgctgtcccaaaaggtcatgctgcacgaagtgatgtctcatccaatttcccaatttctgatctgtggagatagctcagaatgtgtcctagattttccaaggtcaacacatctttcgtcatatcagcagccagggcct

SEQ ID NO: 377591 - DNA, 140 bp, Artificial Sequence
  Synthetic
atacgccatgctgggtctccaccatgacagaattacacatgaaccatgaaaatctcccgcaagaccaaaacggtgttatcaagcagacctatacaggtattcaccttgacaaaggaggtccgtacttgggagtcggccat

SEQ ID NO: 377592 - DNA, 140 bp, Artificial Sequence
  Synthetic
atggccgactcccaagtacggacctcctttgtcaaggtgaatacctgtataggtctgcttgataacaccgttttggtcttgcgggagattttcatggttcatgtgtaattctgtcatggtggagacccagcatggcgtat

SEQ ID NO: 377593 - DNA, 140 bp, Artificial Sequence
  Synthetic
aggccctggctgctgatatgcggtgttatcaagcagacctatacaggtattcaccttgacaaaggaggtcaattcgaagccgccttatggcaaggttgggataagagatcgatatctctagaccttttgggacagcggtg

SEQ ID NO: 377594 - DNA, 140 bp, Artificial Sequence
  Synthetic
caccgctgtcccaaaaggtctagagatatcgatctcttatcccaaccttgccataaggcggcttcgaattgacctcctttgtcaaggtgaatacctgtataggtctgcttgataacaccgcatatcagcagccagggcct

SEQ ID NO: 377595 - DNA, 140 bp, Artificial Sequence
  Synthetic
atacgccatgctgggtctccaatcagtgtgcaagcctcatacgatcattttattcttcctcaaagtcaaggtaaaggacagtgattattgttcgaaagttgacaatttgatcactttcagcgtacttgggagtcggccat

SEQ ID NO: 377596 - DNA, 140 bp, Artificial Sequence
  Synthetic
atggccgactcccaagtacgctgaaagtgatcaaattgtcaactttcgaacaataatcactgtcctttaccttgactttgaggaagaataaaatgatcgtatgaggcttgcacactgattggagacccagcatggcgtat

SEQ ID NO: 377597 - DNA, 140 bp, Artificial Sequence
  Synthetic
aggccctggctgctgatatggtaaaggacagtgattattgttcgaaagttgacaatttgatcactttcagttttcagtttcaacccttatcgcgagacttgaatacaatcctactaacttgaccttttgggacagcggtg

SEQ ID NO: 377598 - DNA, 140 bp, Artificial Sequence
  Synthetic
caccgctgtcccaaaaggtcaagttagtaggattgtattcaagtctcgcgataagggttgaaactgaaaactgaaagtgatcaaattgtcaactttcgaacaataatcactgtcctttaccatatcagcagccagggcct

SEQ ID NO: 377599 - DNA, 140 bp, Artificial Sequence
  Synthetic
atacgccatgctgggtctcccactagttcattgtaaattactcgatcaaaatgttcttaagctatcttaagcttactgatgcggctctgcttcacttttcttttgattttaaagccatagcgtacttgggagtcggccat

SEQ ID NO: 377600 - DNA, 140 bp, Artificial Sequence
  Synthetic
atggccgactcccaagtacgctatggctttaaaatcaaaagaaaagtgaagcagagccgcatcagtaagcttaagatagcttaagaacattttgatcgagtaatttacaatgaactagtgggagacccagcatggcgtat

SEQ ID NO: 377601 - DNA, 140 bp, Artificial Sequence
  Synthetic
aggccctggctgctgatatggcttactgatgcggctctgcttcacttttcttttgattttaaagccatagctatatctaagtgtctaattaacaacttgtacctctaaggaaaaacatgagaccttttgggacagcggtg

SEQ ID NO: 377602 - DNA, 140 bp, Artificial Sequence
  Synthetic
caccgctgtcccaaaaggtctcatgtttttccttagaggtacaagttgttaattagacacttagatatagctatggctttaaaatcaaaagaaaagtgaagcagagccgcatcagtaagccatatcagcagccagggcct

SEQ ID NO: 377603 - DNA, 140 bp, Artificial Sequence
  Synthetic
atacgccatgctgggtctccctttgttgataccctcgagagacaacttttgacaccagatcacggatcaagcacacttcaatcaagcaccctaaattttcaatcatacacataataaccacgtacttgggagtcggccat

SEQ ID NO: 377604 - DNA, 140 bp, Artificial Sequence
  Synthetic
atggccgactcccaagtacgtggttattatgtgtatgattgaaaatttagggtgcttgattgaagtgtgcttgatccgtgatctggtgtcaaaagttgtctctcgagggtatcaacaaagggagacccagcatggcgtat

SEQ ID NO: 377605 - DNA, 140 bp, Artificial Sequence
  Synthetic
aggccctggctgctgatatggcacacttcaatcaagcaccctaaattttcaatcatacacataataaccattttagtagcgttgcctttcagtacagtctaggtgattgttgaaagacttgaccttttgggacagcggtg

SEQ ID NO: 377606 - DNA, 140 bp, Artificial Sequence
  Synthetic
caccgctgtcccaaaaggtcaagtctttcaacaatcacctagactgtactgaaaggcaacgctactaaaatggttattatgtgtatgattgaaaatttagggtgcttgattgaagtgtgccatatcagcagccagggcct

SEQ ID NO: 377607 - DNA, 140 bp, Artificial Sequence
  Synthetic
atacgccatgctgggtctccggaaaatagtataaatcttgaccttaattccacagcacgatggataaaagaacccagtgttgggggctggacagtgaagtggggaaactttgttttccatcgtacttgggagtcggccat

SEQ ID NO: 377608 - DNA, 140 bp, Artificial Sequence
  Synthetic
atggccgactcccaagtacgatggaaaacaaagtttccccacttcactgtccagcccccaacactgggttcttttatccatcgtgctgtggaattaaggtcaagatttatactattttccggagacccagcatggcgtat

SEQ ID NO: 377609 - DNA, 140 bp, Artificial Sequence
  Synthetic
aggccctggctgctgatatgaacccagtgttgggggctggacagtgaagtggggaaactttgttttccatataccaaatactggaatgacattgttgcatcatttaaagtctaacttcgtgaccttttgggacagcggtg

SEQ ID NO: 377610 - DNA, 140 bp, Artificial Sequence
  Synthetic
caccgctgtcccaaaaggtcacgaagttagactttaaatgatgcaacaatgtcattccagtatttggtatatggaaaacaaagtttccccacttcactgtccagcccccaacactgggttcatatcagcagccagggcct

SEQ ID NO: 377611 - DNA, 140 bp, Artificial Sequence
  Synthetic
atacgccatgctgggtctccacccaaaatcaacaattatagaaccgtttttggccctgaggattttgcttggagttgctttgaaggatcaagaattacagcaatcattgattcctggattcgtacttgggagtcggccat

SEQ ID NO: 377612 - DNA, 140 bp, Artificial Sequence
  Synthetic
atggccgactcccaagtacgaatccaggaatcaatgattgctgtaattcttgatccttcaaagcaactccaagcaaaatcctcagggccaaaaacggttctataattgttgattttgggtggagacccagcatggcgtat

SEQ ID NO: 377613 - DNA, 140 bp, Artificial Sequence
  Synthetic
aggccctggctgctgatatgggagttgctttgaaggatcaagaattacagcaatcattgattcctggatttagatctattgttcatatgctatcagaatggctgctcctggaggtcacgtgaccttttgggacagcggtg

SEQ ID NO: 377614 - DNA, 140 bp, Artificial Sequence
  Synthetic
caccgctgtcccaaaaggtcacgtgacctccaggagcagccattctgatagcatatgaacaatagatctaaatccaggaatcaatgattgctgtaattcttgatccttcaaagcaactcccatatcagcagccagggcct

SEQ ID NO: 377615 - DNA, 140 bp, Artificial Sequence
  Synthetic
atacgccatgctgggtctccatgtttaaaattctgatggcaggtgtgaaaaatttcttcaataagatgttcactcttcatgttgtaaatgaccacggaaaacccagcagtattgaaataacgtacttgggagtcggccat

SEQ ID NO: 377616 - DNA, 140 bp, Artificial Sequence
  Synthetic
atggccgactcccaagtacgttatttcaatactgctgggttttccgtggtcatttacaacatgaagagtgaacatcttattgaagaaatttttcacacctgccatcagaattttaaacatggagacccagcatggcgtat

SEQ ID NO: 377617 - DNA, 140 bp, Artificial Sequence
  Synthetic
aggccctggctgctgatatgcactcttcatgttgtaaatgaccacggaaaacccagcagtattgaaataaagttaactggacaacagatcattatcactcgtgttaatatggggtttctagaccttttgggacagcggtg

SEQ ID NO: 377618 - DNA, 140 bp, Artificial Sequence
  Synthetic
caccgctgtcccaaaaggtctagaaaccccatattaacacgagtgataatgatctgttgtccagttaactttatttcaatactgctgggttttccgtggtcatttacaacatgaagagtgcatatcagcagccagggcct

SEQ ID NO: 377619 - DNA, 140 bp, Artificial Sequence
  Synthetic
atacgccatgctgggtctccctcagaatcagttgtttttggactagtggctgaggcagttctaagagaacacagtcaaatggagaagggccaacctctcaatctgacacaatacatgaaccgtacttgggagtcggccat

SEQ ID NO: 377620 - DNA, 140 bp, Artificial Sequence
  Synthetic
atggccgactcccaagtacggttcatgtattgtgtcagattgagaggttggcccttctccatttgactgtgttctcttagaactgcctcagccactagtccaaaaacaactgattctgagggagacccagcatggcgtat

SEQ ID NO: 377621 - DNA, 140 bp, Artificial Sequence
  Synthetic
aggccctggctgctgatatgacagtcaaatggagaagggccaacctctcaatctgacacaatacatgaacagcaaaattgctatataagtggcttaaattagcatgggtattcctagttcgaccttttgggacagcggtg

SEQ ID NO: 377622 - DNA, 140 bp, Artificial Sequence
  Synthetic
caccgctgtcccaaaaggtcgaactaggaatacccatgctaatttaagccacttatatagcaattttgctgttcatgtattgtgtcagattgagaggttggcccttctccatttgactgtcatatcagcagccagggcct

SEQ ID NO: 377623 - DNA, 140 bp, Artificial Sequence
  Synthetic
atacgccatgctgggtctccatactaagggatatacctaacctgatttatatttactggtataaaatagtagcatcatcttattgaatagttatcatacaataggctgttcctataatctcgtacttgggagtcggccat

SEQ ID NO: 377624 - DNA, 140 bp, Artificial Sequence
  Synthetic
atggccgactcccaagtacgagattataggaacagcctattgtatgataactattcaataagatgatgctactattttataccagtaaatataaatcaggttaggtatatcccttagtatggagacccagcatggcgtat

SEQ ID NO: 377625 - DNA, 140 bp, Artificial Sequence
  Synthetic
aggccctggctgctgatatgagcatcatcttattgaatagttatcatacaataggctgttcctataatctgattgtgagattataaacttgtagaattaccgtgggtcacaactgttgcagaccttttgggacagcggtg

SEQ ID NO: 377626 - DNA, 140 bp, Artificial Sequence
  Synthetic
caccgctgtcccaaaaggtctgcaacagttgtgacccacggtaattctacaagtttataatctcacaatcagattataggaacagcctattgtatgataactattcaataagatgatgctcatatcagcagccagggcct

SEQ ID NO: 377627 - DNA, 140 bp, Artificial Sequence
  Synthetic
atacgccatgctgggtctcctataatacatactaataacgattgattaagaaaaatcaatgatggatattaaatgtccatcaagcaagtgttgtagaataccaggggtttcacaggctgccgtacttgggagtcggccat

SEQ ID NO: 377628 - DNA, 140 bp, Artificial Sequence
  Synthetic
atggccgactcccaagtacggcagcctgtgaaacccctggtattctacaacacttgcttgatggacatttaatatccatcattgatttttcttaatcaatcgttattagtatgtattataggagacccagcatggcgtat

SEQ ID NO: 377629 - DNA, 140 bp, Artificial Sequence
  Synthetic
aggccctggctgctgatatgaaatgtccatcaagcaagtgttgtagaataccaggggtttcacaggctgctaaacttactaaattttacataggattatataattcttttcgatacacgtgaccttttgggacagcggtg

SEQ ID NO: 377630 - DNA, 140 bp, Artificial Sequence
  Synthetic
caccgctgtcccaaaaggtcacgtgtatcgaaaagaattatataatcctatgtaaaatttagtaagtttagcagcctgtgaaacccctggtattctacaacacttgcttgatggacatttcatatcagcagccagggcct

SEQ ID NO: 377631 - DNA, 140 bp, Artificial Sequence
  Synthetic
atacgccatgctgggtctcctatccattttaagtgaatcctttcctcaacatgcagcatccaactcaatatcctgatgcaaggttgtcctctcctataatcctagaccagtgtgacttatcgtacttgggagtcggccat

SEQ ID NO: 377632 - DNA, 140 bp, Artificial Sequence
  Synthetic
atggccgactcccaagtacgataagtcacactggtctaggattataggagaggacaaccttgcatcaggatattgagttggatgctgcatgttgaggaaaggattcacttaaaatggataggagacccagcatggcgtat

SEQ ID NO: 377633 - DNA, 140 bp, Artificial Sequence
  Synthetic
aggccctggctgctgatatgtcctgatgcaaggttgtcctctcctataatcctagaccagtgtgacttattagccagaagtttagggttgtatagtcattattcacataatccgaaattggaccttttgggacagcggtg

SEQ ID NO: 377634 - DNA, 140 bp, Artificial Sequence
  Synthetic
caccgctgtcccaaaaggtccaatttcggattatgtgaataatgactatacaaccctaaacttctggctaataagtcacactggtctaggattataggagaggacaaccttgcatcaggacatatcagcagccagggcct

SEQ ID NO: 377635 - DNA, 140 bp, Artificial Sequence
  Synthetic
atacgccatgctgggtctccattaaagacatttcttcagaattgttcgatactcaccgttccttttcattcaatttgggatcatattttaacttccattcaatatgatgcaattaatcatcgtacttgggagtcggccat

SEQ ID NO: 377636 - DNA, 140 bp, Artificial Sequence
  Synthetic
atggccgactcccaagtacgatgattaattgcatcatattgaatggaagttaaaatatgatcccaaattgaatgaaaaggaacggtgagtatcgaacaattctgaagaaatgtctttaatggagacccagcatggcgtat

SEQ ID NO: 377637 - DNA, 140 bp, Artificial Sequence
  Synthetic
aggccctggctgctgatatgcaatttgggatcatattttaacttccattcaatatgatgcaattaatcatgttgatgattttaaatacctattgccatctgagctagtcaagtatgcgaagaccttttgggacagcggtg

SEQ ID NO: 377638 - DNA, 140 bp, Artificial Sequence
  Synthetic
caccgctgtcccaaaaggtcttcgcatacttgactagctcagatggcaataggtatttaaaatcatcaacatgattaattgcatcatattgaatggaagttaaaatatgatcccaaattgcatatcagcagccagggcct

SEQ ID NO: 377639 - DNA, 140 bp, Artificial Sequence
  Synthetic
atacgccatgctgggtctccaccatgttttttcagcttctgcaaggtcacagtgtgaggatttttctcctaaggaaaatccttattattgggggatgttattactcgtgcatctatctcacgtacttgggagtcggccat

SEQ ID NO: 377640 - DNA, 140 bp, Artificial Sequence
  Synthetic
atggccgactcccaagtacgtgagatagatgcacgagtaataacatcccccaataataaggattttccttaggagaaaaatcctcacactgtgaccttgcagaagctgaaaaaacatggtggagacccagcatggcgtat

SEQ ID NO: 377641 - DNA, 140 bp, Artificial Sequence
  Synthetic
aggccctggctgctgatatgaaggaaaatccttattattgggggatgttattactcgtgcatctatctcaacttgccaggaggataaaaggacaaagagggtcattaagaagtaactggagaccttttgggacagcggtg

SEQ ID NO: 377642 - DNA, 140 bp, Artificial Sequence
  Synthetic
caccgctgtcccaaaaggtctccagttacttcttaatgaccctctttgtccttttatcctcctggcaagttgagatagatgcacgagtaataacatcccccaataataaggattttccttcatatcagcagccagggcct

SEQ ID NO: 377643 - DNA, 140 bp, Artificial Sequence
  Synthetic
atacgccatgctgggtctcctttaaggttccagtaaaaacaataatccgaaatgctgtaagcttacaagcttcaaaaccgggattaagaatatggtaccgtgaccaaaacttgaccccttcgtacttgggagtcggccat

SEQ ID NO: 377644 - DNA, 140 bp, Artificial Sequence
  Synthetic
atggccgactcccaagtacgaaggggtcaagttttggtcacggtaccatattcttaatcccggttttgaagcttgtaagcttacagcatttcggattattgtttttactggaaccttaaaggagacccagcatggcgtat

SEQ ID NO: 377645 - DNA, 140 bp, Artificial Sequence
  Synthetic
aggccctggctgctgatatgttcaaaaccgggattaagaatatggtaccgtgaccaaaacttgaccccttatctatgcgacgatgagtttattgtaagcgtcgctagttatgaatgttttgaccttttgggacagcggtg

SEQ ID NO: 377646 - DNA, 140 bp, Artificial Sequence
  Synthetic
caccgctgtcccaaaaggtcaaaacattcataactagcgacgcttacaataaactcatcgtcgcatagataaggggtcaagttttggtcacggtaccatattcttaatcccggttttgaacatatcagcagccagggcct

SEQ ID NO: 377647 - DNA, 140 bp, Artificial Sequence
  Synthetic
atacgccatgctgggtctcctgcccgcgcttggctcgaagacagtgatggagctgattatcctcctcttgatgtgttaggtgaattatacaaccagggagaccaaattattgccatgtaccgtacttgggagtcggccat

SEQ ID NO: 377648 - DNA, 140 bp, Artificial Sequence
  Synthetic
atggccgactcccaagtacggtacatggcaataatttggtctccctggttgtataattcacctaacacatcaagaggaggataatcagctccatcactgtcttcgagccaagcgcgggcaggagacccagcatggcgtat

SEQ ID NO: 377649 - DNA, 140 bp, Artificial Sequence
  Synthetic
aggccctggctgctgatatgatgtgttaggtgaattatacaaccagggagaccaaattattgccatgtacctggaggacggtttcaaattgattaaacacttagaacccttgtgtgtcaggaccttttgggacagcggtg

SEQ ID NO: 377650 - DNA, 140 bp, Artificial Sequence
  Synthetic
caccgctgtcccaaaaggtcctgacacacaagggttctaagtgtttaatcaatttgaaaccgtcctccaggtacatggcaataatttggtctccctggttgtataattcacctaacacatcatatcagcagccagggcct

SEQ ID NO: 377651 - DNA, 140 bp, Artificial Sequence
  Synthetic
atacgccatgctgggtctcccacagatgattaagtcatattatgatgaactccatgatctcaatttgaaacttcaaatttcagacaataaggctgagtgtgcccaaaactttattaaaaccgtacttgggagtcggccat

SEQ ID NO: 377652 - DNA, 140 bp, Artificial Sequence
  Synthetic
atggccgactcccaagtacggttttaataaagttttgggcacactcagccttattgtctgaaatttgaagtttcaaattgagatcatggagttcatcataatatgacttaatcatctgtgggagacccagcatggcgtat

SEQ ID NO: 377653 - DNA, 140 bp, Artificial Sequence
  Synthetic
aggccctggctgctgatatgcttcaaatttcagacaataaggctgagtgtgcccaaaactttattaaaactatagttcaggcgaaattgactcctcaacaatactgtgaattattctcccgaccttttgggacagcggtg

SEQ ID NO: 377654 - DNA, 140 bp, Artificial Sequence
  Synthetic
caccgctgtcccaaaaggtcgggagaataattcacagtattgttgaggagtcaatttcgcctgaactatagttttaataaagttttgggcacactcagccttattgtctgaaatttgaagcatatcagcagccagggcct

SEQ ID NO: 377655 - DNA, 140 bp, Artificial Sequence
  Synthetic
atacgccatgctgggtctccaaggttaaaaaacatgcgcaatcgacaaaaatcttaaaacctaaagtcatgtttgaaactttttgtgttttcaaatttatagtagcaaagaatcattatccgtacttgggagtcggccat

SEQ ID NO: 377656 - DNA, 140 bp, Artificial Sequence
  Synthetic
atggccgactcccaagtacggataatgattctttgctactataaatttgaaaacacaaaaagtttcaaacatgactttaggttttaagatttttgtcgattgcgcatgttttttaaccttggagacccagcatggcgtat

SEQ ID NO: 377657 - DNA, 140 bp, Artificial Sequence
  Synthetic
aggccctggctgctgatatggtttgaaactttttgtgttttcaaatttatagtagcaaagaatcattatcattctcaaggatcatggtataaaaccacacatgatttgcatttgactccagaccttttgggacagcggtg

SEQ ID NO: 377658 - DNA, 140 bp, Artificial Sequence
  Synthetic
caccgctgtcccaaaaggtctggagtcaaatgcaaatcatgtgtggttttataccatgatccttgagaatgataatgattctttgctactataaatttgaaaacacaaaaagtttcaaaccatatcagcagccagggcct

SEQ ID NO: 377659 - DNA, 140 bp, Artificial Sequence
  Synthetic
atacgccatgctgggtctccttatcagcatctttgggagtggtatttcgtggagcatgaacctcttttctcaactaaaataataagtgatttaagtatctttataaaagacagggctacccgtacttgggagtcggccat

SEQ ID NO: 377660 - DNA, 140 bp, Artificial Sequence
  Synthetic
atggccgactcccaagtacgggtagccctgtcttttataaagatacttaaatcacttattattttagttgagaaaagaggttcatgctccacgaaataccactcccaaagatgctgataaggagacccagcatggcgtat

SEQ ID NO: 377661 - DNA, 140 bp, Artificial Sequence
  Synthetic
aggccctggctgctgatatgcaactaaaataataagtgatttaagtatctttataaaagacagggctaccgctgtgaaccaggagtgttgggacagtgtcttcgatagaagtgtattagggaccttttgggacagcggtg

SEQ ID NO: 377662 - DNA, 140 bp, Artificial Sequence
  Synthetic
caccgctgtcccaaaaggtccctaatacacttctatcgaagacactgtcccaacactcctggttcacagcggtagccctgtcttttataaagatacttaaatcacttattattttagttgcatatcagcagccagggcct

SEQ ID NO: 377663 - DNA, 140 bp, Artificial Sequence
  Synthetic
atacgccatgctgggtctcctgggtcaagcagacttttccttgaatcaaatattagagtttgctgaaaagttagagtatttggctccttcttataggaatttttccttctcattaaaagacgtacttgggagtcggccat

SEQ ID NO: 377664 - DNA, 140 bp, Artificial Sequence
  Synthetic
atggccgactcccaagtacgtcttttaatgagaaggaaaaattcctataagaaggagccaaatactctaacttttcagcaaactctaatatttgattcaaggaaaagtctgcttgacccaggagacccagcatggcgtat

SEQ ID NO: 377665 - DNA, 140 bp, Artificial Sequence
  Synthetic
aggccctggctgctgatatgttagagtatttggctccttcttataggaatttttccttctcattaaaagaaaaagagttgaatataggaagaacttttgggaagttaccgtatcgtgtcagaccttttgggacagcggtg

SEQ ID NO: 377666 - DNA, 140 bp, Artificial Sequence
  Synthetic
caccgctgtcccaaaaggtctgacacgatacggtaacttcccaaaagttcttcctatattcaactctttttcttttaatgagaaggaaaaattcctataagaaggagccaaatactctaacatatcagcagccagggcct

SEQ ID NO: 377667 - DNA, 140 bp, Artificial Sequence
  Synthetic
atacgccatgctgggtctccgcattccctagtaacatgatggttgtcactgagagggaacagaaagaagcattattacatcaggcttcttggcaccacaattcagcaagcataggggagacgtacttgggagtcggccat

SEQ ID NO: 377668 - DNA, 140 bp, Artificial Sequence
  Synthetic
atggccgactcccaagtacgtctcccctatgcttgctgaattgtggtgccaagaagcctgatgtaataatgcttctttctgttccctctcagtgacaaccatcatgttactagggaatgcggagacccagcatggcgtat

SEQ ID NO: 377669 - DNA, 140 bp, Artificial Sequence
  Synthetic
aggccctggctgctgatatgattattacatcaggcttcttggcaccacaattcagcaagcataggggagaacgctatagtgaggggtgcaagttttgttactgatcttgagaaatacaacgaccttttgggacagcggtg

SEQ ID NO: 377670 - DNA, 140 bp, Artificial Sequence
  Synthetic
caccgctgtcccaaaaggtcgttgtatttctcaagatcagtaacaaaacttgcacccctcactatagcgttctcccctatgcttgctgaattgtggtgccaagaagcctgatgtaataatcatatcagcagccagggcct

SEQ ID NO: 377671 - DNA, 140 bp, Artificial Sequence
  Synthetic
atacgccatgctgggtctccatgttatggtgtgaagaatttatttgattggatgcattttttaataccactatgttatatgcatgtcagtgacttttatagcccaccacattgtgtgacacgtacttgggagtcggccat

SEQ ID NO: 377672 - DNA, 140 bp, Artificial Sequence
  Synthetic
atggccgactcccaagtacgtgtcacacaatgtggtgggctataaaagtcactgacatgcatataacatagtggtattaaaaaatgcatccaatcaaataaattcttcacaccataacatggagacccagcatggcgtat

SEQ ID NO: 377673 - DNA, 140 bp, Artificial Sequence
  Synthetic
aggccctggctgctgatatgtatgttatatgcatgtcagtgacttttatagcccaccacattgtgtgacagaagataatcgaaataacccacctgattgtgctaatgcttatcattatcagaccttttgggacagcggtg

SEQ ID NO: 377674 - DNA, 140 bp, Artificial Sequence
  Synthetic
caccgctgtcccaaaaggtctgataatgataagcattagcacaatcaggtgggttatttcgattatcttctgtcacacaatgtggtgggctataaaagtcactgacatgcatataacatacatatcagcagccagggcct

SEQ ID NO: 377675 - DNA, 140 bp, Artificial Sequence
  Synthetic
atacgccatgctgggtctccgtgcccaaatcacccttgtggagttaaaaactaaattaaaattgaagtccagcgtcatgggtgataatcaatgtataacaactctaagtctttttccaatcgtacttgggagtcggccat

SEQ ID NO: 377676 - DNA, 140 bp, Artificial Sequence
  Synthetic
atggccgactcccaagtacgattggaaaaagacttagagttgttatacattgattatcacccatgacgctggacttcaattttaatttagtttttaactccacaagggtgatttgggcacggagacccagcatggcgtat

SEQ ID NO: 377677 - DNA, 140 bp, Artificial Sequence
  Synthetic
aggccctggctgctgatatgagcgtcatgggtgataatcaatgtataacaactctaagtctttttccaattgatgctcccaacgattatcaagagaacgaggctgaattgaatgcggcacgaccttttgggacagcggtg

SEQ ID NO: 377678 - DNA, 140 bp, Artificial Sequence
  Synthetic
caccgctgtcccaaaaggtcgtgccgcattcaattcagcctcgttctcttgataatcgttgggagcatcaattggaaaaagacttagagttgttatacattgattatcacccatgacgctcatatcagcagccagggcct

SEQ ID NO: 377679 - DNA, 140 bp, Artificial Sequence
  Synthetic
atacgccatgctgggtctccaagcctgaggaaacatttgtccattcagggttcatttattttggtaaaaagcaatatctcaacggtgttcaactgccgcaatcattgaaaacaatggcaacgtacttgggagtcggccat

SEQ ID NO: 377680 - DNA, 140 bp, Artificial Sequence
  Synthetic
atggccgactcccaagtacgttgccattgttttcaatgattgcggcagttgaacaccgttgagatattgctttttaccaaaataaatgaaccctgaatggacaaatgtttcctcaggcttggagacccagcatggcgtat

SEQ ID NO: 377681 - DNA, 140 bp, Artificial Sequence
  Synthetic
aggccctggctgctgatatggcaatatctcaacggtgttcaactgccgcaatcattgaaaacaatggcaaggtgtggacccttatctgactctattttcgatgatcttcaaggttctctggaccttttgggacagcggtg

SEQ ID NO: 377682 - DNA, 140 bp, Artificial Sequence
  Synthetic
caccgctgtcccaaaaggtccagagaaccttgaagatcatcgaaaatagagtcagataagggtccacaccttgccattgttttcaatgattgcggcagttgaacaccgttgagatattgccatatcagcagccagggcct

SEQ ID NO: 377683 - DNA, 140 bp, Artificial Sequence
  Synthetic
atacgccatgctgggtctccttttccgagccgttggatagcttcattccattcaatgttagcaataaatttattaaatcagaatcaccttgggtttcctctagggttcaatattgatattcgtacttgggagtcggccat

SEQ ID NO: 377684 - DNA, 140 bp, Artificial Sequence
  Synthetic
atggccgactcccaagtacgaatatcaatattgaaccctagaggaaacccaaggtgattctgatttaataaatttattgctaacattgaatggaatgaagctatccaacggctcggaaaaggagacccagcatggcgtat

SEQ ID NO: 377685 - DNA, 140 bp, Artificial Sequence
  Synthetic
aggccctggctgctgatatgtattaaatcagaatcaccttgggtttcctctagggttcaatattgatatttcttgtttcaaaaagcctcttaccttctcggaaaaattaattgctctcatgaccttttgggacagcggtg

SEQ ID NO: 377686 - DNA, 140 bp, Artificial Sequence
  Synthetic
caccgctgtcccaaaaggtcatgagagcaattaatttttccgagaaggtaagaggctttttgaaacaagaaatatcaatattgaaccctagaggaaacccaaggtgattctgatttaatacatatcagcagccagggcct

SEQ ID NO: 377687 - DNA, 140 bp, Artificial Sequence
  Synthetic
atacgccatgctgggtctcctctaccggaacataagtgatcctctcacttcaggtctatttcaactcaagaatgcattggaatttcttgaaaaggaagaattattctatatcttgatttccgtacttgggagtcggccat

SEQ ID NO: 377688 - DNA, 140 bp, Artificial Sequence
  Synthetic
atggccgactcccaagtacggaaatcaagatatagaataattcttccttttcaagaaattccaatgcattcttgagttgaaatagacctgaagtgagaggatcacttatgttccggtagaggagacccagcatggcgtat

SEQ ID NO: 377689 - DNA, 140 bp, Artificial Sequence
  Synthetic
aggccctggctgctgatatgaatgcattggaatttcttgaaaaggaagaattattctatatcttgatttctaaaaaacctggtttagcagatgcctcagattttgtcatgaatccattaggaccttttgggacagcggtg

SEQ ID NO: 377690 - DNA, 140 bp, Artificial Sequence
  Synthetic
caccgctgtcccaaaaggtcctaatggattcatgacaaaatctgaggcatctgctaaaccaggttttttagaaatcaagatatagaataattcttccttttcaagaaattccaatgcattcatatcagcagccagggcct

SEQ ID NO: 377691 - DNA, 140 bp, Artificial Sequence
  Synthetic
atacgccatgctgggtctccgttcgcgaaaatatcacgatcacgtcacaaaatagaataataaattctcttttccacataggttctgatttagaggaccaaagagtgtgtgagtggctttcgtacttgggagtcggccat

SEQ ID NO: 377692 - DNA, 140 bp, Artificial Sequence
  Synthetic
atggccgactcccaagtacgaaagccactcacacactctttggtcctctaaatcagaacctatgtggaaaagagaatttattattctattttgtgacgtgatcgtgatattttcgcgaacggagacccagcatggcgtat

SEQ ID NO: 377693 - DNA, 140 bp, Artificial Sequence
  Synthetic
aggccctggctgctgatatgtttccacataggttctgatttagaggaccaaagagtgtgtgagtggcttttatcatcaaaccctgtaatgagccgatttgctgctgacatcttttcaagagaccttttgggacagcggtg

SEQ ID NO: 377694 - DNA, 140 bp, Artificial Sequence
  Synthetic
caccgctgtcccaaaaggtctcttgaaaagatgtcagcagcaaatcggctcattacagggtttgatgataaaagccactcacacactctttggtcctctaaatcagaacctatgtggaaacatatcagcagccagggcct

SEQ ID NO: 377695 - DNA, 140 bp, Artificial Sequence
  Synthetic
atacgccatgctgggtctccaacattactagcttctcggacaatcagtttaactacagaaggaacaatgttgatgaaattaagagaattaacgagaaaccgatggaaaagttggttttctcgtacttgggagtcggccat

SEQ ID NO: 377696 - DNA, 140 bp, Artificial Sequence
  Synthetic
atggccgactcccaagtacgagaaaaccaacttttccatcggtttctcgttaattctcttaatttcatcaacattgttccttctgtagttaaactgattgtccgagaagctagtaatgttggagacccagcatggcgtat

SEQ ID NO: 377697 - DNA, 140 bp, Artificial Sequence
  Synthetic
aggccctggctgctgatatgtgatgaaattaagagaattaacgagaaaccgatggaaaagttggttttcttatattgatgcactggacgatgatttatctgagtccttggaaaagttcacgaccttttgggacagcggtg

SEQ ID NO: 377698 - DNA, 140 bp, Artificial Sequence
  Synthetic
caccgctgtcccaaaaggtcgtgaacttttccaaggactcagataaatcatcgtccagtgcatcaatataagaaaaccaacttttccatcggtttctcgttaattctcttaatttcatcacatatcagcagccagggcct

SEQ ID NO: 377699 - DNA, 140 bp, Artificial Sequence
  Synthetic
atacgccatgctgggtctcctcttaaaagggaaaaggctaattggtgccacactgccatgtttactagagcaatttgaggtaaagtggattaatttatctgaggatttaagggaacaattcgtacttgggagtcggccat

SEQ ID NO: 377700 - DNA, 140 bp, Artificial Sequence
  Synthetic
atggccgactcccaagtacgaattgttcccttaaatcctcagataaattaatccactttacctcaaattgctctagtaaacatggcagtgtggcaccaattagccttttcccttttaagaggagacccagcatggcgtat

SEQ ID NO: 377701 - DNA, 140 bp, Artificial Sequence
  Synthetic
aggccctggctgctgatatgcaatttgaggtaaagtggattaatttatctgaggatttaagggaacaatttaatctatcttcagactcaaaatcaactataaacttgttgccgtatgactgaccttttgggacagcggtg

SEQ ID NO: 377702 - DNA, 140 bp, Artificial Sequence
  Synthetic
caccgctgtcccaaaaggtcagtcatacggcaacaagtttatagttgattttgagtctgaagatagattaaattgttcccttaaatcctcagataaattaatccactttacctcaaattgcatatcagcagccagggcct

SEQ ID NO: 377703 - DNA, 140 bp, Artificial Sequence
  Synthetic
atacgccatgctgggtctccagttgtgctcttgaccggaaagttgtccagaaacatccctctgttaatcgtctagcttggacgataggaaatcgagcaccgtatattggctcacggacagcgtacttgggagtcggccat

SEQ ID NO: 377704 - DNA, 140 bp, Artificial Sequence
  Synthetic
atggccgactcccaagtacgctgtccgtgagccaatatacggtgctcgatttcctatcgtccaagctagacgattaacagagggatgtttctggacaactttccggtcaagagcacaactggagacccagcatggcgtat

SEQ ID NO: 377705 - DNA, 140 bp, Artificial Sequence
  Synthetic
aggccctggctgctgatatgtctagcttggacgataggaaatcgagcaccgtatattggctcacggacagaagataagatcggttatcctcccttaagagtaaattgcccatcagcagcagaccttttgggacagcggtg

SEQ ID NO: 377706 - DNA, 140 bp, Artificial Sequence
  Synthetic
caccgctgtcccaaaaggtctgctgctgatgggcaatttactcttaagggaggataaccgatcttatcttctgtccgtgagccaatatacggtgctcgatttcctatcgtccaagctagacatatcagcagccagggcct

SEQ ID NO: 377707 - DNA, 140 bp, Artificial Sequence
  Synthetic
atacgccatgctgggtctcccactgcagaccgagaaaaattgcttattcctcttctcaattcaagagtaaatctggactatcagacggtgcttaactttttacctacacactactcaggccgtacttgggagtcggccat

SEQ ID NO: 377708 - DNA, 140 bp, Artificial Sequence
  Synthetic
atggccgactcccaagtacggcctgagtagtgtgtaggtaaaaagttaagcaccgtctgatagtccagatttactcttgaattgagaagaggaataagcaatttttctcggtctgcagtgggagacccagcatggcgtat

SEQ ID NO: 377709 - DNA, 140 bp, Artificial Sequence
  Synthetic
aggccctggctgctgatatgatctggactatcagacggtgcttaactttttacctacacactactcaggcaacatagttcatagatataatgatcaatatggacaacattcctttatggcgaccttttgggacagcggtg

SEQ ID NO: 377710 - DNA, 140 bp, Artificial Sequence
  Synthetic
caccgctgtcccaaaaggtcgccataaaggaatgttgtccatattgatcattatatctatgaactatgttgcctgagtagtgtgtaggtaaaaagttaagcaccgtctgatagtccagatcatatcagcagccagggcct

SEQ ID NO: 377711 - DNA, 140 bp, Artificial Sequence
  Synthetic
atacgccatgctgggtctcctgggtaaatatgctgggggaggtcaagctgctattgatagtaatataatctttcaaaatactattaatttaggagttgcagttttagatattgcattgtccgtacttgggagtcggccat

SEQ ID NO: 377712 - DNA, 140 bp, Artificial Sequence
  Synthetic
atggccgactcccaagtacggacaatgcaatatctaaaactgcaactcctaaattaatagtattttgaaagattatattactatcaatagcagcttgacctcccccagcatatttacccaggagacccagcatggcgtat

SEQ ID NO: 377713 - DNA, 140 bp, Artificial Sequence
  Synthetic
aggccctggctgctgatatgtttcaaaatactattaatttaggagttgcagttttagatattgcattgtctcttgctaaattgtcgtcagcatcaaatgtcactttccgtttaatgttaagaccttttgggacagcggtg

SEQ ID NO: 377714 - DNA, 140 bp, Artificial Sequence
  Synthetic
caccgctgtcccaaaaggtcttaacattaaacggaaagtgacatttgatgctgacgacaatttagcaagagacaatgcaatatctaaaactgcaactcctaaattaatagtattttgaaacatatcagcagccagggcct

SEQ ID NO: 377715 - DNA, 140 bp, Artificial Sequence
  Synthetic
atacgccatgctgggtctcccctttagatgtggatttgaacaagtatatggacaatgagttggtttatgacaatgaccctctttgcagtgggattaaagggagattaggcagagtatctccgtacttgggagtcggccat

SEQ ID NO: 377716 - DNA, 140 bp, Artificial Sequence
  Synthetic
atggccgactcccaagtacggagatactctgcctaatctccctttaatcccactgcaaagagggtcattgtcataaaccaactcattgtccatatacttgttcaaatccacatctaaaggggagacccagcatggcgtat

SEQ ID NO: 377717 - DNA, 140 bp, Artificial Sequence
  Synthetic
aggccctggctgctgatatgcaatgaccctctttgcagtgggattaaagggagattaggcagagtatctcgatcaacactcacattgagtttgaatgtcagtgacattggttcttatgacgaccttttgggacagcggtg

SEQ ID NO: 377718 - DNA, 140 bp, Artificial Sequence
  Synthetic
caccgctgtcccaaaaggtcgtcataagaaccaatgtcactgacattcaaactcaatgtgagtgttgatcgagatactctgcctaatctccctttaatcccactgcaaagagggtcattgcatatcagcagccagggcct

SEQ ID NO: 377719 - DNA, 140 bp, Artificial Sequence
  Synthetic
atacgccatgctgggtctcctttttctgatgaatcttctcaaagtacggatccaataagctcaggttgcacaaaaactttcgtcacacatttccttgtgtatccagttgagagtatatttcgtacttgggagtcggccat

SEQ ID NO: 377720 - DNA, 140 bp, Artificial Sequence
  Synthetic
atggccgactcccaagtacgaaatatactctcaactggatacacaaggaaatgtgtgacgaaagtttttgtgcaacctgagcttattggatccgtactttgagaagattcatcagaaaaaggagacccagcatggcgtat

SEQ ID NO: 377721 - DNA, 140 bp, Artificial Sequence
  Synthetic
aggccctggctgctgatatgcaaaaactttcgtcacacatttccttgtgtatccagttgagagtatattttatgcattcggagctaacttaatagttgaaagtttaagtctaagtaggatgaccttttgggacagcggtg

SEQ ID NO: 377722 - DNA, 140 bp, Artificial Sequence
  Synthetic
caccgctgtcccaaaaggtcatcctacttagacttaaactttcaactattaagttagctccgaatgcataaaatatactctcaactggatacacaaggaaatgtgtgacgaaagtttttgcatatcagcagccagggcct

SEQ ID NO: 377723 - DNA, 140 bp, Artificial Sequence
  Synthetic
atacgccatgctgggtctcctcaggaatttatcacatagatcacttcggattcttcaatctactttccgacatgaattggtgctcacccgactagcccaccacataccgttaatttctttcgtacttgggagtcggccat

SEQ ID NO: 377724 - DNA, 140 bp, Artificial Sequence
  Synthetic
atggccgactcccaagtacgaaagaaattaacggtatgtggtgggctagtcgggtgagcaccaattcatgtcggaaagtagattgaagaatccgaagtgatctatgtgataaattcctgaggagacccagcatggcgtat

SEQ ID NO: 377725 - DNA, 140 bp, Artificial Sequence
  Synthetic
aggccctggctgctgatatgcatgaattggtgctcacccgactagcccaccacataccgttaatttctttaatgttagggggctctgcaggagagaagagttcatcagatgctgttcggcgaccttttgggacagcggtg

SEQ ID NO: 377726 - DNA, 140 bp, Artificial Sequence
  Synthetic
caccgctgtcccaaaaggtcgccgaacagcatctgatgaactcttctctcctgcagagccccctaacattaaagaaattaacggtatgtggtgggctagtcgggtgagcaccaattcatgcatatcagcagccagggcct

SEQ ID NO: 377727 - DNA, 140 bp, Artificial Sequence
  Synthetic
atacgccatgctgggtctccatgaagaagggtcagtcatcgctaccggtttggctttactttcctagtgaagggcaacaattaaagcctatattaaaaatcttacagagattatcagactcgtacttgggagtcggccat

SEQ ID NO: 377728 - DNA, 140 bp, Artificial Sequence
  Synthetic
atggccgactcccaagtacgagtctgataatctctgtaagatttttaatataggctttaattgttgcccttcactaggaaagtaaagccaaaccggtagcgatgactgacccttcttcatggagacccagcatggcgtat

SEQ ID NO: 377729 - DNA, 140 bp, Artificial Sequence
  Synthetic
aggccctggctgctgatatgagggcaacaattaaagcctatattaaaaatcttacagagattatcagacttgttatcacctgacaaaattcaaaagcgtaaaattttggctgacacctgtgaccttttgggacagcggtg

SEQ ID NO: 377730 - DNA, 140 bp, Artificial Sequence
  Synthetic
caccgctgtcccaaaaggtcacaggtgtcagccaaaattttacgcttttgaattttgtcaggtgataacaagtctgataatctctgtaagatttttaatataggctttaattgttgccctcatatcagcagccagggcct

SEQ ID NO: 377731 - DNA, 140 bp, Artificial Sequence
  Synthetic
atacgccatgctgggtctccccattattatgcaagccttaattattggagagacaaagctaataaggttaagaatactcctttttcacacttgataaattgttcatttcctgaattttctcgtacttgggagtcggccat

SEQ ID NO: 377732 - DNA, 140 bp, Artificial Sequence
  Synthetic
atggccgactcccaagtacgagaaaattcaggaaatgaacaatttatcaagtgtgaaaaaggagtattcttaaccttattagctttgtctctccaataattaaggcttgcataataatggggagacccagcatggcgtat

SEQ ID NO: 377733 - DNA, 140 bp, Artificial Sequence
  Synthetic
aggccctggctgctgatatgagaatactcctttttcacacttgataaattgttcatttcctgaattttcttcacataccagttcagtctcctctaatcaacaagtgaccaattcgaagtagaccttttgggacagcggtg

SEQ ID NO: 377734 - DNA, 140 bp, Artificial Sequence
  Synthetic
caccgctgtcccaaaaggtctacttcgaattggtcacttgttgattagaggagactgaactggtatgtgaagaaaattcaggaaatgaacaatttatcaagtgtgaaaaaggagtattctcatatcagcagccagggcct

SEQ ID NO: 377735 - DNA, 140 bp, Artificial Sequence
  Synthetic
atacgccatgctgggtctcctaaattatggatcaacagctctacaggggatggacaccaagatgccactctcagagcaaaatctagtcgaaaattgtcgaccatcagagggcatcagattcgtacttgggagtcggccat

SEQ ID NO: 377736 - DNA, 140 bp, Artificial Sequence
  Synthetic
atggccgactcccaagtacgaatctgatgccctctgatggtcgacaattttcgactagattttgctctgagagtggcatcttggtgtccatcccctgtagagctgttgatccataatttaggagacccagcatggcgtat

SEQ ID NO: 377737 - DNA, 140 bp, Artificial Sequence
  Synthetic
aggccctggctgctgatatgtcagagcaaaatctagtcgaaaattgtcgaccatcagagggcatcagattcaaggacaatcaaaaaataacaaaacatgaccagagatgtgagagggagggaccttttgggacagcggtg

SEQ ID NO: 377738 - DNA, 140 bp, Artificial Sequence
  Synthetic
caccgctgtcccaaaaggtccctccctctcacatctctggtcatgttttgttattttttgattgtccttgaatctgatgccctctgatggtcgacaattttcgactagattttgctctgacatatcagcagccagggcct

SEQ ID NO: 377739 - DNA, 140 bp, Artificial Sequence
  Synthetic
atacgccatgctgggtctcccacatacatagttcctccccatttcaaatccttataaaatcactagatgcacatgaggactttgatgcctcgaagataatcttaaattctgaaataaatacgtacttgggagtcggccat

SEQ ID NO: 377740 - DNA, 140 bp, Artificial Sequence
  Synthetic
atggccgactcccaagtacgtatttatttcagaatttaagattatcttcgaggcatcaaagtcctcatgtgcatctagtgattttataaggatttgaaatggggaggaactatgtatgtgggagacccagcatggcgtat

SEQ ID NO: 377741 - DNA, 140 bp, Artificial Sequence
  Synthetic
aggccctggctgctgatatgacatgaggactttgatgcctcgaagataatcttaaattctgaaataaataatcttaaccttacggagtatactcttaatacaaagttattgacaactcctgaccttttgggacagcggtg

SEQ ID NO: 377742 - DNA, 140 bp, Artificial Sequence
  Synthetic
caccgctgtcccaaaaggtcaggagttgtcaataactttgtattaagagtatactccgtaaggttaagattatttatttcagaatttaagattatcttcgaggcatcaaagtcctcatgtcatatcagcagccagggcct

SEQ ID NO: 377743 - DNA, 140 bp, Artificial Sequence
  Synthetic
atacgccatgctgggtctccatcaacttccagggaacggtctctactatccagagaacaagcttcatatttgtacgttgattgcagtaatattccttctatctctctagacccaggttttcgtacttgggagtcggccat

SEQ ID NO: 377744 - DNA, 140 bp, Artificial Sequence
  Synthetic
atggccgactcccaagtacgaaaacctgggtctagagagatagaaggaatattactgcaatcaacgtacaaatatgaagcttgttctctggatagtagagaccgttccctggaagttgatggagacccagcatggcgtat

SEQ ID NO: 377745 - DNA, 140 bp, Artificial Sequence
  Synthetic
aggccctggctgctgatatgtgtacgttgattgcagtaatattccttctatctctctagacccaggttttcggagtatgtctgatcagaatcaagttcaaatgttaatcaatacctacaagaccttttgggacagcggtg

SEQ ID NO: 377746 - DNA, 140 bp, Artificial Sequence
  Synthetic
caccgctgtcccaaaaggtcttgtaggtattgattaacatttgaacttgattctgatcagacatactccgaaaacctgggtctagagagatagaaggaatattactgcaatcaacgtacacatatcagcagccagggcct

SEQ ID NO: 377747 - DNA, 140 bp, Artificial Sequence
  Synthetic
atacgccatgctgggtctccgggtagtctcatcaatgcattacaagctttatgatcttttgcctccaggtaaattgaaaaaggcaatttgtttggccgaaggggaaggaagtggtgctcgcgtacttgggagtcggccat

SEQ ID NO: 377748 - DNA, 140 bp, Artificial Sequence
  Synthetic
atggccgactcccaagtacgcgagcaccacttccttccccttcggccaaacaaattgcctttttcaatttacctggaggcaaaagatcataaagcttgtaatgcattgatgagactacccggagacccagcatggcgtat

SEQ ID NO: 377749 - DNA, 140 bp, Artificial Sequence
  Synthetic
aggccctggctgctgatatgaaattgaaaaaggcaatttgtttggccgaaggggaaggaagtggtgctcggttacttttgaagtggaaggaaacggattatttattcttcaacactttgggaccttttgggacagcggtg

SEQ ID NO: 377750 - DNA, 140 bp, Artificial Sequence
  Synthetic
caccgctgtcccaaaaggtcccaaagtgttgaagaataaataatccgtttccttccacttcaaaagtaaccgagcaccacttccttccccttcggccaaacaaattgcctttttcaatttcatatcagcagccagggcct

SEQ ID NO: 377751 - DNA, 140 bp, Artificial Sequence
  Synthetic
atacgccatgctgggtctccagaatgttgtataacatagacagattaagtgctttgcttgaatcaaggagactaatattgaacaacctaactatccaaattacagatattacaaatccatcgtacttgggagtcggccat

SEQ ID NO: 377752 - DNA, 140 bp, Artificial Sequence
  Synthetic
atggccgactcccaagtacgatggatttgtaatatctgtaatttggatagttaggttgttcaatattagtctccttgattcaagcaaagcacttaatctgtctatgttatacaacattctggagacccagcatggcgtat

SEQ ID NO: 377753 - DNA, 140 bp, Artificial Sequence
  Synthetic
aggccctggctgctgatatgactaatattgaacaacctaactatccaaattacagatattacaaatccattatggctagattctgtaatacaatatttacctgaagatagtgacattcttgaccttttgggacagcggtg

SEQ ID NO: 377754 - DNA, 140 bp, Artificial Sequence
  Synthetic
caccgctgtcccaaaaggtcaagaatgtcactatcttcaggtaaatattgtattacagaatctagccataatggatttgtaatatctgtaatttggatagttaggttgttcaatattagtcatatcagcagccagggcct

SEQ ID NO: 377755 - DNA, 140 bp, Artificial Sequence
  Synthetic
atacgccatgctgggtctccaactattgtgaatatttggacacgtacttctcctaatatcccaaaaattagcatcatcaaggtatttttattagactatgaagggactttattcttaatgcgtacttgggagtcggccat

SEQ ID NO: 377756 - DNA, 140 bp, Artificial Sequence
  Synthetic
atggccgactcccaagtacgcattaagaataaagtcccttcatagtctaataaaaataccttgatgatgctaatttttgggatattaggagaagtacgtgtccaaatattcacaatagttggagacccagcatggcgtat

SEQ ID NO: 377757 - DNA, 140 bp, Artificial Sequence
  Synthetic
aggccctggctgctgatatggcatcatcaaggtatttttattagactatgaagggactttattcttaatgaagaatgctattcagtattatgggcaagttcaactcaagaaaccatataggaccttttgggacagcggtg

SEQ ID NO: 377758 - DNA, 140 bp, Artificial Sequence
  Synthetic
caccgctgtcccaaaaggtcctatatggtttcttgagttgaacttgcccataatactgaatagcattcttcattaagaataaagtcccttcatagtctaataaaaataccttgatgatgccatatcagcagccagggcct

SEQ ID NO: 377759 - DNA, 140 bp, Artificial Sequence
  Synthetic
atacgccatgctgggtctccttcaacggctccaaattgatttctcagaccaggtgggaatttttctgatttgtaaagcaatgtcacgccaaagacaagcaattccttactggttaaaacacgtacttgggagtcggccat

SEQ ID NO: 377760 - DNA, 140 bp, Artificial Sequence
  Synthetic
atggccgactcccaagtacgtgttttaaccagtaaggaattgcttgtctttggcgtgacattgctttacaaatcagaaaaattcccacctggtctgagaaatcaatttggagccgttgaaggagacccagcatggcgtat

SEQ ID NO: 377761 - DNA, 140 bp, Artificial Sequence
  Synthetic
aggccctggctgctgatatgtgtaaagcaatgtcacgccaaagacaagcaattccttactggttaaaacatatagaaaagaattatcctgcttcattacacgagtttttcctaactttgggaccttttgggacagcggtg

SEQ ID NO: 377762 - DNA, 140 bp, Artificial Sequence
  Synthetic
caccgctgtcccaaaaggtcccaaagttaggaaaaactcgtgtaatgaagcaggataattcttttctatatgttttaaccagtaaggaattgcttgtctttggcgtgacattgctttacacatatcagcagccagggcct

SEQ ID NO: 377763 - DNA, 140 bp, Artificial Sequence
  Synthetic
atacgccatgctgggtctccagtgaaggaaaggctctttttcacaaggtccagtcttatgttcgtcaaggcaaacaacatttacattctcttatgttggattatgaaaacaattcacctccgtacttgggagtcggccat

SEQ ID NO: 377764 - DNA, 140 bp, Artificial Sequence
  Synthetic
atggccgactcccaagtacggaggtgaattgttttcataatccaacataagagaatgtaaatgttgtttgccttgacgaacataagactggaccttgtgaaaaagagcctttccttcactggagacccagcatggcgtat

SEQ ID NO: 377765 - DNA, 140 bp, Artificial Sequence
  Synthetic
aggccctggctgctgatatgcaaacaacatttacattctcttatgttggattatgaaaacaattcacctctactagacttgagaaatcactttatttgctcattaaggggaaagataactgaccttttgggacagcggtg

SEQ ID NO: 377766 - DNA, 140 bp, Artificial Sequence
  Synthetic
caccgctgtcccaaaaggtcagttatctttccccttaatgagcaaataaagtgatttctcaagtctagtagaggtgaattgttttcataatccaacataagagaatgtaaatgttgtttgcatatcagcagccagggcct

SEQ ID NO: 377767 - DNA, 140 bp, Artificial Sequence
  Synthetic
atacgccatgctgggtctccaaaaggtaaaaattggtcacaacttgttgagatccttcctaatatgcattcagtatgcatagtgcacgtggatcatgagtgttctggatgcgagaaacggcgtacttgggagtcggccat

SEQ ID NO: 377768 - DNA, 140 bp, Artificial Sequence
  Synthetic
atggccgactcccaagtacgccgtttctcgcatccagaacactcatgatccacgtgcactatgcatactgaatgcatattaggaaggatctcaacaagttgtgaccaatttttaccttttggagacccagcatggcgtat

SEQ ID NO: 377769 - DNA, 140 bp, Artificial Sequence
  Synthetic
aggccctggctgctgatatgcagtatgcatagtgcacgtggatcatgagtgttctggatgcgagaaacggttattacttaaattggattttatcagaaatacaaagatcgcagaacaaaagaccttttgggacagcggtg

SEQ ID NO: 377770 - DNA, 140 bp, Artificial Sequence
  Synthetic
caccgctgtcccaaaaggtcttttgttctgcgatctttgtatttctgataaaatccaatttaagtaataaccgtttctcgcatccagaacactcatgatccacgtgcactatgcatactgcatatcagcagccagggcct

SEQ ID NO: 377771 - DNA, 140 bp, Artificial Sequence
  Synthetic
atacgccatgctgggtctccttaaatctggatcattaagggcataatttcaacagagagaacttcatttaattcacaaaaacaatctatttaagagtgagggttacattgtctaagatatcgtacttgggagtcggccat

SEQ ID NO: 377772 - DNA, 140 bp, Artificial Sequence
  Synthetic
atggccgactcccaagtacgatatcttagacaatgtaaccctcactcttaaatagattgtttttgtgaattaaatgaagttctctctgttgaaattatgcccttaatgatccagatttaaggagacccagcatggcgtat

SEQ ID NO: 377773 - DNA, 140 bp, Artificial Sequence
  Synthetic
aggccctggctgctgatatgattcacaaaaacaatctatttaagagtgagggttacattgtctaagatattgtatgagaagtaataaaataaataagaaaacgaaaagactattagacaggaccttttgggacagcggtg

SEQ ID NO: 377774 - DNA, 140 bp, Artificial Sequence
  Synthetic
caccgctgtcccaaaaggtcctgtctaatagtcttttcgttttcttatttattttattacttctcatacaatatcttagacaatgtaaccctcactcttaaatagattgtttttgtgaatcatatcagcagccagggcct

SEQ ID NO: 377775 - DNA, 140 bp, Artificial Sequence
  Synthetic
atacgccatgctgggtctccgaaaattacgcgcacagattaactagtgattagtgtttggtcacaccagaggtaactttttaacgttaattactcagatgttattgctcataattagcatcgtacttgggagtcggccat

SEQ ID NO: 377776 - DNA, 140 bp, Artificial Sequence
  Synthetic
atggccgactcccaagtacgatgctaattatgagcaataacatctgagtaattaacgttaaaaagttacctctggtgtgaccaaacactaatcactagttaatctgtgcgcgtaattttcggagacccagcatggcgtat

SEQ ID NO: 377777 - DNA, 140 bp, Artificial Sequence
  Synthetic
aggccctggctgctgatatgggtaactttttaacgttaattactcagatgttattgctcataattagcattaatattggcacattgggtgaatccttgagctttatccctaatatggtgtgaccttttgggacagcggtg

SEQ ID NO: 377778 - DNA, 140 bp, Artificial Sequence
  Synthetic
caccgctgtcccaaaaggtcacaccatattagggataaagctcaaggattcacccaatgtgccaatattaatgctaattatgagcaataacatctgagtaattaacgttaaaaagttacccatatcagcagccagggcct

SEQ ID NO: 377779 - DNA, 140 bp, Artificial Sequence
  Synthetic
atacgccatgctgggtctccaccatatatcataaatataaaaaagtgtctgctgtaatctacaagcacctcttttaaatacattaggaaaagaattaagttaccgttgagatcaaaaaaacgtacttgggagtcggccat

SEQ ID NO: 377780 - DNA, 140 bp, Artificial Sequence
  Synthetic
atggccgactcccaagtacgtttttttgatctcaacggtaacttaattcttttcctaatgtatttaaaagaggtgcttgtagattacagcagacacttttttatatttatgatatatggtggagacccagcatggcgtat

SEQ ID NO: 377781 - DNA, 140 bp, Artificial Sequence
  Synthetic
atacgccatgctgggtctcctctagaatgtcgatgtgaatgtaaattaagaaaaaccaatatataaaattaaaaaattaaaaagctttgatataagtaacacaaaacattcttcatctttcgtacttgggagtcggccat

SEQ ID NO: 377782 - DNA, 140 bp, Artificial Sequence
  Synthetic
atggccgactcccaagtacgaaagatgaagaatgttttgtgttacttatatcaaagctttttaattttttaattttatatattggtttttcttaatttacattcacatcgacattctagaggagacccagcatggcgtat

SEQ ID NO: 377783 - DNA, 140 bp, Artificial Sequence
  Synthetic
atacgccatgctgggtctcccggacacacaaaaagaaaaaaggttttttaagattttttgtgtgcgagtaactatgaggaagattaacagttttcctcagtttaaggtatacactgaaatcgtacttgggagtcggccat

SEQ ID NO: 377784 - DNA, 140 bp, Artificial Sequence
  Synthetic
atggccgactcccaagtacgatttcagtgtataccttaaactgaggaaaactgttaatcttcctcatagttactcgcacacaaaaaatcttaaaaaaccttttttctttttgtgtgtccgggagacccagcatggcgtat

SEQ ID NO: 377785 - DNA, 140 bp, Artificial Sequence
  Synthetic
atacgccatgctgggtctcccaattgaatcagttttatctattaccaattaccatcaacatggtatgtctagtgatcttgggactcttcttcatctggtttttcctagagctctgaatctcgtacttgggagtcggccat

SEQ ID NO: 377786 - DNA, 140 bp, Artificial Sequence
  Synthetic
atggccgactcccaagtacgagattcagagctctaggaaaaaccagatgaagaagagtcccaagatcactagacataccatgttgatggtaattggtaatagataaaactgattcaattgggagacccagcatggcgtat

SEQ ID NO: 377787 - DNA, 140 bp, Artificial Sequence
  Synthetic
aggccctggctgctgatatgactgttcaacagggaattgtcaggcagaaaataatttctgtatatcttgttgataacttggaggctatgtgtcaattggtaatacaagcctttgaggccggaccttttgggacagcggtg

SEQ ID NO: 377788 - DNA, 140 bp, Artificial Sequence
  Synthetic
caccgctgtcccaaaaggtccggcctcaaaggcttgtattaccaattgacacatagcctccaagttatcaacaagatatacagaaattattttctgcctgacaattccctgttgaacagtcatatcagcagccagggcct

SEQ ID NO: 377789 - DNA, 140 bp, Artificial Sequence
  Synthetic
atacgccatgctgggtctcctgataacttggaggctatgtgtcaattggtaatacaagcctttgaggccggaattgatttccaagaaaatgccgacagcttccttctgatgctttgcctacgtacttgggagtcggccat

SEQ ID NO: 377790 - DNA, 140 bp, Artificial Sequence
  Synthetic
atggccgactcccaagtacgtaggcaaagcatcagaaggaagctgtcggcattttcttggaaatcaattccggcctcaaaggcttgtattaccaattgacacatagcctccaagttatcaggagacccagcatggcgtat

SEQ ID NO: 377791 - DNA, 140 bp, Artificial Sequence
  Synthetic
atacgccatgctgggtctccacagtatttggaaggtcatggattcaaatttgagctccggaagaaggacggtgtcaatcggctcgaggaattgcttcctgctgcaacgagtggaaaaaaccgtacttgggagtcggccat

SEQ ID NO: 377792 - DNA, 140 bp, Artificial Sequence
  Synthetic
atggccgactcccaagtacggttttttccactcgttgcagcaggaagcaattcctcgagccgattgacaccgtccttcttccggagctcaaatttgaatccatgaccttccaaatactgtggagacccagcatggcgtat

SEQ ID NO: 377793 - DNA, 140 bp, Artificial Sequence
  Synthetic
aggccctggctgctgatatgtgggagagaaggcttgcttggaaaaagtccagcgacaaattcaggttcatgcagaacagggtttaattcaatatcccactgcatggcaatcagttggacagaccttttgggacagcggtg

SEQ ID NO: 377794 - DNA, 140 bp, Artificial Sequence
  Synthetic
caccgctgtcccaaaaggtctgtccaactgattgccatgcagtgggatattgaattaaaccctgttctgcatgaacctgaatttgtcgctggactttttccaagcaagccttctctcccacatatcagcagccagggcct

SEQ ID NO: 377795 - DNA, 140 bp, Artificial Sequence
  Synthetic
atacgccatgctgggtctcccatgatggtaatcttcagattgatgaggactaatttcttgattaaatatttactgatccaccagggtatgcatatggtagctggccacgatgccaatgatcgtacttgggagtcggccat

SEQ ID NO: 377796 - DNA, 140 bp, Artificial Sequence
  Synthetic
atggccgactcccaagtacgatcattggcatcgtggccagctaccatatgcataccctggtggatcagtaaatatttaatcaagaaattagtcctcatcaatctgaagattaccatcatgggagacccagcatggcgtat

SEQ ID NO: 377797 - DNA, 140 bp, Artificial Sequence
  Synthetic
aggccctggctgctgatatgtactgatccaccagggtatgcatatggtagctggccacgatgccaatgatgctgtcattgctaattcagttgctcaggctcgcttttcaggactcctaatgaccttttgggacagcggtg

SEQ ID NO: 377798 - DNA, 140 bp, Artificial Sequence
  Synthetic
caccgctgtcccaaaaggtcattaggagtcctgaaaagcgagcctgagcaactgaattagcaatgacagcatcattggcatcgtggccagctaccatatgcataccctggtggatcagtacatatcagcagccagggcct

SEQ ID NO: 377799 - DNA, 140 bp, Artificial Sequence
  Synthetic
atacgccatgctgggtctcctgctcgccttctcaatctctcgggagttaacaacctagaacatggtctctacccacagttatcagcaattgctcttggagttgccacagcacatggtagccgtacttgggagtcggccat

SEQ ID NO: 377800 - DNA, 140 bp, Artificial Sequence
  Synthetic
atggccgactcccaagtacggctaccatgtgctgtggcaactccaagagcaattgctgataactgtgggtagagaccatgttctaggttgttaactcccgagagattgagaaggcgagcaggagacccagcatggcgtat

SEQ ID NO: 377801 - DNA, 140 bp, Artificial Sequence
  Synthetic
atacgccatgctgggtctccacccttgcaggagttaatgttggtgagcagtatcagcagcttagagaggctgccactgaagctgagaagcaactccaacaatatgctgagtccagagaaccgtacttgggagtcggccat

SEQ ID NO: 377802 - DNA, 140 bp, Artificial Sequence
  Synthetic
atggccgactcccaagtacggttctctggactcagcatattgttggagttgcttctcagcttcagtggcagcctctctaagctgctgatactgctcaccaacattaactcctgcaagggtggagacccagcatggcgtat

SEQ ID NO: 377803 - DNA, 140 bp, Artificial Sequence
  Synthetic
atacgccatgctgggtctcccaagacctaacctcgggtctagacaagacgacgacaatgaaataccgttccctgggcctataagcaacaacccagaccaagatcatctggaggatgatcccgtacttgggagtcggccat

SEQ ID NO: 377804 - DNA, 140 bp, Artificial Sequence
  Synthetic
atggccgactcccaagtacgggatcatcctccagatgatcttggtctgggttgttgcttataggcccagggaacggtatttcattgtcgtcgtcttgtctagacccgaggttaggtcttgggagacccagcatggcgtat

SEQ ID NO: 377805 - DNA, 140 bp, Artificial Sequence
  Synthetic
aggccctggctgctgatatgcctgggcctataagcaacaacccagaccaagatcatctggaggatgatcctagagactccagagacactatcattcctaatagtgcaattgaccccgagggaccttttgggacagcggtg

SEQ ID NO: 377806 - DNA, 140 bp, Artificial Sequence
  Synthetic
caccgctgtcccaaaaggtccctcggggtcaattgcactattaggaatgatagtgtctctggagtctctaggatcatcctccagatgatcttggtctgggttgttgcttataggcccaggcatatcagcagccagggcct

SEQ ID NO: 377807 - DNA, 140 bp, Artificial Sequence
  Synthetic
aggccctggctgctgatatggcaggtgacttggtcttgttcgatcttgacgatcatgaggatgacaataaagcttttgagctacaggacagctcaccacaatcccaaagggaaatagagagaccttttgggacagcggtg

SEQ ID NO: 377808 - DNA, 140 bp, Artificial Sequence
  Synthetic
caccgctgtcccaaaaggtctctctatttccctttgggattgtggtgagctgtcctgtagctcaaaagctttattgtcatcctcatgatcgtcaagatcgaacaagaccaagtcacctgccatatcagcagccagggcct

SEQ ID NO: 377809 - DNA, 140 bp, Artificial Sequence
  Synthetic
atacgccatgctgggtctccgcctcagacaacaatcaacaatcagcagattctgaggaacaagaaggtcaatacaacaggcaccgaggcccagaacgtacgaccgccaatcgaagactctcgtacttgggagtcggccat

SEQ ID NO: 377810 - DNA, 140 bp, Artificial Sequence
  Synthetic
atggccgactcccaagtacgagagtcttcgattggcggtcgtacgttctgggcctcggtgcctgttgtattgaccttcttgttcctcagaatctgctgattgttgattgttgtctgaggcggagacccagcatggcgtat

SEQ ID NO: 377811 - DNA, 140 bp, Artificial Sequence
  Synthetic
atacgccatgctgggtctcctcaagcccacctccgctggaatctgatgatgacgatgcatcaagtagccaacaagatcccgattatacagctgttgcccctcctgctcctgtataccgcacgtacttgggagtcggccat

SEQ ID NO: 377812 - DNA, 140 bp, Artificial Sequence
  Synthetic
atggccgactcccaagtacgtgcggtatacaggagcaggaggggcaacagctgtataatcgggatcttgttggctacttgatgcatcgtcatcatcagattccagcggaggtgggcttgaggagacccagcatggcgtat

SEQ ID NO: 377813 - DNA, 140 bp, Artificial Sequence
  Synthetic
aggccctggctgctgatatgacaagatcccgattatacagctgttgcccctcctgctcctgtataccgcagtgcagaagcccacgagcctccccacaaatcctcgaacgagccagctgaagaccttttgggacagcggtg

SEQ ID NO: 377814 - DNA, 140 bp, Artificial Sequence
  Synthetic
caccgctgtcccaaaaggtcttcagctggctcgttcgaggatttgtggggaggctcgtgggcttctgcactgcggtatacaggagcaggaggggcaacagctgtataatcgggatcttgtcatatcagcagccagggcct

SEQ ID NO: 377815 - DNA, 140 bp, Artificial Sequence
  Synthetic
atacgccatgctgggtctccgtgcagaagcccacgagcctccccacaaatcctcgaacgagccagctgaaacatcacaattgaatgaagaccctgatatcggtcaatcaaagtctatgcacgtacttgggagtcggccat

SEQ ID NO: 377816 - DNA, 140 bp, Artificial Sequence
  Synthetic
atggccgactcccaagtacgtgcatagactttgattgaccgatatcagggtcttcattcaattgtgatgtttcagctggctcgttcgaggatttgtggggaggctcgtgggcttctgcacggagacccagcatggcgtat

SEQ ID NO: 377817 - DNA, 140 bp, Artificial Sequence
  Synthetic
aggccctggctgctgatatgactgatgatgggaaggaatacacctacccggattcacttgaggaagcctatcctccatggctcaccgagaaagaacgactggacaatgaaaatcgatacagaccttttgggacagcggtg

SEQ ID NO: 377818 - DNA, 140 bp, Artificial Sequence
  Synthetic
caccgctgtcccaaaaggtctgtatcgattttcattgtccagtcgttctttctcggtgagccatggaggataggcttcctcaagtgaatccgggtaggtgtattccttcccatcatcagtcatatcagcagccagggcct

SEQ ID NO: 377819 - DNA, 140 bp, Artificial Sequence
  Synthetic
atacgccatgctgggtctccgtctatccaagatgtggctcaatgttcttaatttgaacatagtcataaggggataaataatactttatatttctgattgtggattgacccattctgcttacgtacttgggagtcggccat

SEQ ID NO: 377820 - DNA, 140 bp, Artificial Sequence
  Synthetic
atggccgactcccaagtacgtaagcagaatgggtcaatccacaatcagaaatataaagtattatttatccccttatgactatgttcaaattaagaacattgagccacatcttggatagacggagacccagcatggcgtat

SEQ ID NO: 377821 - DNA, 140 bp, Artificial Sequence
  Synthetic
aggccctggctgctgatatggattatattgtctgtaggcaggtgtttactccaccttaaagtcggaaatatcctaccttaggaccattgttaagaggtgcataggcattaccatccttgagaccttttgggacagcggtg

SEQ ID NO: 377822 - DNA, 140 bp, Artificial Sequence
  Synthetic
caccgctgtcccaaaaggtctcaaggatggtaatgcctatgcacctcttaacaatggtcctaaggtaggatatttccgactttaaggtggagtaaacacctgcctacagacaatataatccatatcagcagccagggcct

SEQ ID NO: 377823 - DNA, 140 bp, Artificial Sequence
  Synthetic
atacgccatgctgggtctcctcctaccttaggaccattgttaagaggtgcataggcattaccatccttgagaacatgtataataataaattgaagatatgttcaggcccagaaacaactgcgtacttgggagtcggccat

SEQ ID NO: 377824 - DNA, 140 bp, Artificial Sequence
  Synthetic
atggccgactcccaagtacgcagttgtttctgggcctgaacatatcttcaatttattattatacatgttctcaaggatggtaatgcctatgcacctcttaacaatggtcctaaggtaggaggagacccagcatggcgtat

SEQ ID NO: 377825 - DNA, 140 bp, Artificial Sequence
  Synthetic
atacgccatgctgggtctccgatggatttctgagcaactaatgacaggtaagattccagtaactgatatattcattgatattgataacaagccagatcaaatggaagtccggctcaaacccgtacttgggagtcggccat

SEQ ID NO: 377826 - DNA, 140 bp, Artificial Sequence
  Synthetic
atggccgactcccaagtacgggtttgagccggacttccatttgatctggcttgttatcaatatcaatgaatatatcagttactggaatcttacctgtcattagttgctcagaaatccatcggagacccagcatggcgtat

SEQ ID NO: 377827 - DNA, 140 bp, Artificial Sequence
  Synthetic
atacgccatgctgggtctcctgctgagttccaggcaagtctagcagatggtgactctccccaatgtgcactcatacagataaccaaaagagtcccaatctttcaggatgtgccgcccccgcgtacttgggagtcggccat

SEQ ID NO: 377828 - DNA, 140 bp, Artificial Sequence
  Synthetic
atggccgactcccaagtacgcgggggcggcacatcctgaaagattgggactcttttggttatctgtatgagtgcacattggggagagtcaccatctgctagacttgcctggaactcagcaggagacccagcatggcgtat

SEQ ID NO: 377829 - DNA, 140 bp, Artificial Sequence
  Synthetic
atacgccatgctgggtctccagatttatttaacaaggcaagccacaaccttagatagaacctcagccagactattgaactattgacgctgttgatgataatatataattaatggtcatatcgtacttgggagtcggccat

SEQ ID NO: 377830 - DNA, 140 bp, Artificial Sequence
  Synthetic
atggccgactcccaagtacgatatgaccattaattatatattatcatcaacagcgtcaatagttcaatagtctggctgaggttctatctaaggttgtggcttgccttgttaaataaatctggagacccagcatggcgtat

SEQ ID NO: 377831 - DNA, 140 bp, Artificial Sequence
  Synthetic
aggccctggctgctgatatgcatcttctaaagtgagatattttatcatcaaaaaatgagacgcggagtgttaccaacggctcctccagcatataatgatattgcatactctatgagcatagaccttttgggacagcggtg

SEQ ID NO: 377832 - DNA, 140 bp, Artificial Sequence
  Synthetic
caccgctgtcccaaaaggtctatgctcatagagtatgcaatatcattatatgctggaggagccgttggtaacactccgcgtctcattttttgatgataaaatatctcactttagaagatgcatatcagcagccagggcct

SEQ ID NO: 377833 - DNA, 140 bp, Artificial Sequence
  Synthetic
aggccctggctgctgatatgacatttgatctaacagctctaaagctcatcactcaaccattgccagctgcaacctggacagacgaaactccagcaggagcagtcaatgctcttcgtcctggaccttttgggacagcggtg

SEQ ID NO: 377834 - DNA, 140 bp, Artificial Sequence
  Synthetic
caccgctgtcccaaaaggtccaggacgaagagcattgactgctcctgctggagtttcgtctgtccaggttgcagctggcaatggttgagtgatgagctttagagctgttagatcaaatgtcatatcagcagccagggcct

SEQ ID NO: 377835 - DNA, 140 bp, Artificial Sequence
  Synthetic
atacgccatgctgggtctccaacctggacagacgaaactccagcaggagcagtcaatgctcttcgtcctgggctctcactccatcccaagcttcgtccaattcttctaccggggaagatacgtacttgggagtcggccat

SEQ ID NO: 377836 - DNA, 140 bp, Artificial Sequence
  Synthetic
atggccgactcccaagtacgtatcttccccggtagaagaattggacgaagcttgggatggagtgagagcccaggacgaagagcattgactgctcctgctggagtttcgtctgtccaggttggagacccagcatggcgtat

SEQ ID NO: 377837 - DNA, 140 bp, Artificial Sequence
  Synthetic
aggccctggctgctgatatgagaacatagttggaattgaggttccagaattactagttcaaaggctgaccggcaaaaaaccacaacccaaaaatggccaaccaattattccagttcttctgaccttttgggacagcggtg

SEQ ID NO: 377838 - DNA, 140 bp, Artificial Sequence
  Synthetic
caccgctgtcccaaaaggtcagaagaactggaataattggttggccatttttgggttgtggttttttgccggtcagcctttgaactagtaattctggaacctcaattccaactatgttctcatatcagcagccagggcct

SEQ ID NO: 377839 - DNA, 140 bp, Artificial Sequence
  Synthetic
atacgccatgctgggtctccggcaaaaaaccacaacccaaaaatggccaaccaattattccagttcttcttccgaaatatgttggacttgatcctatatcgccaggggacttaactatggcgtacttgggagtcggccat

SEQ ID NO: 377840 - DNA, 140 bp, Artificial Sequence
  Synthetic
atggccgactcccaagtacgccatagttaagtcccctggcgatataggatcaagtccaacatatttcggaagaagaactggaataattggttggccatttttgggttgtggttttttgccggagacccagcatggcgtat

SEQ ID NO: 377841 - DNA, 140 bp, Artificial Sequence
  Synthetic
atacgccatgctgggtctcccacatggacaagcaggatagttaccaataatttaaattccattcgagctattattctgctagtaattccgacgggatcaatagactaaaaatctgattgtcgtacttgggagtcggccat

SEQ ID NO: 377842 - DNA, 140 bp, Artificial Sequence
  Synthetic
atggccgactcccaagtacgacaatcagatttttagtctattgatcccgtcggaattactagcagaataatagctcgaatggaatttaaattattggtaactatcctgcttgtccatgtgggagacccagcatggcgtat

SEQ ID NO: 377843 - DNA, 140 bp, Artificial Sequence
  Synthetic
atacgccatgctgggtctcctagatgactaatattaaggagttttttaatctaattttccagtcttaagtaataatcatttcttttgtaattaattatgcatttgttaacttatcggtgccgtacttgggagtcggccat

SEQ ID NO: 377844 - DNA, 140 bp, Artificial Sequence
  Synthetic
atggccgactcccaagtacggcaccgataagttaacaaatgcataattaattacaaaagaaatgattattacttaagactggaaaattagattaaaaaactccttaatattagtcatctaggagacccagcatggcgtat

SEQ ID NO: 377845 - DNA, 140 bp, Artificial Sequence
  Synthetic
atacgccatgctgggtctccagagaagttcaacccagtcaaaactaaaccaagcaatattctgaatgctctatagtctattctaatcagaggtataacaatggctaagatttcaatgactcgtacttgggagtcggccat

SEQ ID NO: 377846 - DNA, 140 bp, Artificial Sequence
  Synthetic
atggccgactcccaagtacgagtcattgaaatcttagccattgttatacctctgattagaatagactatagagcattcagaatattgcttggtttagttttgactgggttgaacttctctggagacccagcatggcgtat

SEQ ID NO: 377847 - DNA, 140 bp, Artificial Sequence
  Synthetic
aggccctggctgctgatatgtaacattatctgttccaaagtcatacaaggacacattcaaatcagggattgtaagctgctatttcttacctccccaaatcacctatacaacatggggtcagaccttttgggacagcggtg

SEQ ID NO: 377848 - DNA, 140 bp, Artificial Sequence
  Synthetic
caccgctgtcccaaaaggtctgaccccatgttgtataggtgatttggggaggtaagaaatagcagcttacaatccctgatttgaatgtgtccttgtatgactttggaacagataatgttacatatcagcagccagggcct

SEQ ID NO: 377849 - DNA, 140 bp, Artificial Sequence
  Synthetic
atacgccatgctgggtctcccttagtatgggtaatcatcctcttccagcgagcaatctccatgccgcttggtatagtgacaaatagcactctcaaagcaacagaaattgatcaattggttcgtacttgggagtcggccat

SEQ ID NO: 377850 - DNA, 140 bp, Artificial Sequence
  Synthetic
atggccgactcccaagtacgaaccaattgatcaatttctgttgctttgagagtgctatttgtcactataccaagcggcatggagattgctcgctggaagaggatgattacccatactaagggagacccagcatggcgtat

SEQ ID NO: 377851 - DNA, 140 bp, Artificial Sequence
  Synthetic
aggccctggctgctgatatggtatagtgacaaatagcactctcaaagcaacagaaattgatcaattggtttgtcgggacaaactgtcatcaaccagtcagctcaagtctgtggggctgaagaccttttgggacagcggtg

SEQ ID NO: 377852 - DNA, 140 bp, Artificial Sequence
  Synthetic
caccgctgtcccaaaaggtcttcagccccacagacttgagctgactggttgatgacagtttgtcccgacaaaccaattgatcaatttctgttgctttgagagtgctatttgtcactataccatatcagcagccagggcct

SEQ ID NO: 377853 - DNA, 140 bp, Artificial Sequence
  Synthetic
atacgccatgctgggtctccggggattccgttcaggtgtgcctcccaaggtggtcagctatgaagccggagaatgggcagaaaattgctacaatctggagatcaaaaagtcagacggaagcgtacttgggagtcggccat

SEQ ID NO: 377854 - DNA, 140 bp, Artificial Sequence
  Synthetic
atggccgactcccaagtacgcttccgtctgactttttgatctccagattgtagcaattttctgcccattctccggcttcatagctgaccaccttgggaggcacacctgaacggaatccccggagacccagcatggcgtat

SEQ ID NO: 377855 - DNA, 140 bp, Artificial Sequence
  Synthetic
atacgccatgctgggtctccgctatgtccacaaagttcaaggaacaggtccttgtcccggtgacttagctttccataaaaatggggcttttttcttgtatgatagattggcctcaactgtcgtacttgggagtcggccat

SEQ ID NO: 377856 - DNA, 140 bp, Artificial Sequence
  Synthetic
atggccgactcccaagtacgacagttgaggccaatctatcatacaagaaaaaagccccatttttatggaaagctaagtcaccgggacaaggacctgttccttgaactttgtggacatagcggagacccagcatggcgtat

SEQ ID NO: 377857 - DNA, 140 bp, Artificial Sequence
  Synthetic
atacgccatgctgggtctcctgtcagagcccaagaagcatttttggaaggctacaccagctcatgaaccggtgaacacaacagatgattccacaagctactacatgaccctgacactcagcgtacttgggagtcggccat

SEQ ID NO: 377858 - DNA, 140 bp, Artificial Sequence
  Synthetic
atggccgactcccaagtacgctgagtgtcagggtcatgtagtagcttgtggaatcatctgttgtgttcaccggttcatgagctggtgtagccttccaaaaatgcttcttgggctctgacaggagacccagcatggcgtat

SEQ ID NO: 377859 - DNA, 140 bp, Artificial Sequence
  Synthetic
aggccctggctgctgatatggtgaacacaacagatgattccacaagctactacatgaccctgacactcagctacgagatgtcaaattttggaggcgaggaaagtaacaccctttttaagggaccttttgggacagcggtg

SEQ ID NO: 377860 - DNA, 140 bp, Artificial Sequence
  Synthetic
caccgctgtcccaaaaggtcccttaaaaagggtgttactttcctcgcctccaaaatttgacatctcgtagctgagtgtcagggtcatgtagtagcttgtggaatcatctgttgtgttcaccatatcagcagccagggcct

SEQ ID NO: 377861 - DNA, 140 bp, Artificial Sequence
  Synthetic
aggccctggctgctgatatggagaaaacttgcatttccaaattctatcaacccacaccaacaactcctcagatcagagcccggcgggaactgtccaaggaaaaattagctaccacccaccgaccttttgggacagcggtg

SEQ ID NO: 377862 - DNA, 140 bp, Artificial Sequence
  Synthetic
caccgctgtcccaaaaggtcggtgggtggtagctaatttttccttggacagttcccgccgggctctgatctgaggagttgttggtgtgggttgatagaatttggaaatgcaagttttctccatatcagcagccagggcct

SEQ ID NO: 377863 - DNA, 140 bp, Artificial Sequence
  Synthetic
aggccctggctgctgatatgggagagacaatcacaggtttcaccgcgaacccaatgacaaccaccattgccccaagtccaaccatgacaagcgaggttgataacaatgtaccaagtgaacgaccttttgggacagcggtg

SEQ ID NO: 377864 - DNA, 140 bp, Artificial Sequence
  Synthetic
caccgctgtcccaaaaggtcgttcacttggtacattgttatcaacctcgcttgtcatggttggacttggggcaatggtggttgtcattgggttcgcggtgaaacctgtgattgtctctcccatatcagcagccagggcct

SEQ ID NO: 377865 - DNA, 140 bp, Artificial Sequence
  Synthetic
aggccctggctgctgatatggagacaattgaccactccgaaatgaattcgatccaaggctcgaacaactccgcccagagcccacagaccaaggccacgccagcgcccacagcatccccgagaccttttgggacagcggtg

SEQ ID NO: 377866 - DNA, 140 bp, Artificial Sequence
  Synthetic
caccgctgtcccaaaaggtctcggggatgctgtgggcgctggcgtggccttggtctgtgggctctgggcggagttgttcgagccttggatcgaattcatttcggagtggtcaattgtctccatatcagcagccagggcct

SEQ ID NO: 377867 - DNA, 140 bp, Artificial Sequence
  Synthetic
aggccctggctgctgatatggctgttgatgagggggcagcagtaggattggcatggattccatattttggacctgcagcagaaggcatctacattgagggtgtaatgcataatcagaatggaccttttgggacagcggtg

SEQ ID NO: 377868 - DNA, 140 bp, Artificial Sequence
  Synthetic
caccgctgtcccaaaaggtccattctgattatgcattacaccctcaatgtagatgccttctgctgcaggtccaaaatatggaatccatgccaatcctactgctgccccctcatcaacagccatatcagcagccagggcct

SEQ ID NO: 377869 - DNA, 140 bp, Artificial Sequence
  Synthetic
atacgccatgctgggtctccggcttatttgcgggctacgtcagctagccaatgaaactacccaggctcttcaattatttctgcgggccacaacagaactgaggacttactcacttcttaacgtacttgggagtcggccat

SEQ ID NO: 377870 - DNA, 140 bp, Artificial Sequence
  Synthetic
atggccgactcccaagtacgttaagaagtgagtaagtcctcagttctgttgtggcccgcagaaataattgaagagcctgggtagtttcattggctagctgacgtagcccgcaaataagccggagacccagcatggcgtat

SEQ ID NO: 377871 - DNA, 140 bp, Artificial Sequence
  Synthetic
aggccctggctgctgatatgcaattatttctgcgggccacaacagaactgaggacttactcacttcttaacagaaaagctattgattttcttcttcaacgatggggaggtacctgtcgaagaccttttgggacagcggtg

SEQ ID NO: 377872 - DNA, 140 bp, Artificial Sequence
  Synthetic
caccgctgtcccaaaaggtcttcgacaggtacctccccatcgttgaagaagaaaatcaatagcttttctgttaagaagtgagtaagtcctcagttctgttgtggcccgcagaaataattgcatatcagcagccagggcct

SEQ ID NO: 377873 - DNA, 140 bp, Artificial Sequence
  Synthetic
atacgccatgctgggtctccactgatgaaattaaccaaattaaacatgactttattgacaatcccctaccagaccacggagatgatcttaatctatggacaggttggagacaatggatcccgtacttgggagtcggccat

SEQ ID NO: 377874 - DNA, 140 bp, Artificial Sequence
  Synthetic
atggccgactcccaagtacgggatccattgtctccaacctgtccatagattaagatcatctccgtggtctggtaggggattgtcaataaagtcatgtttaatttggttaatttcatcagtggagacccagcatggcgtat

SEQ ID NO: 377875 - DNA, 140 bp, Artificial Sequence
  Synthetic
aggccctggctgctgatatgtgtatatgtaagattttgtgttgatttattctgagatctgagagaaaaaaatctcagggttactctaaggagaaatattatttttaaaatttacttaaatgaccttttgggacagcggtg

SEQ ID NO: 377876 - DNA, 140 bp, Artificial Sequence
  Synthetic
caccgctgtcccaaaaggtcatttaagtaaattttaaaaataatatttctccttagagtaaccctgagatttttttctctcagatctcagaataaatcaacacaaaatcttacatatacacatatcagcagccagggcct

SEQ ID NO: 377877 - DNA, 140 bp, Artificial Sequence
  Synthetic
atacgccatgctgggtctccaagagaacggggtagatctagcaacatgcgacataatagccgggaaccatacgaaaatccatcaaggtctcgctcattatctcgggaccctaatcaggttcgtacttgggagtcggccat

SEQ ID NO: 377878 - DNA, 140 bp, Artificial Sequence
  Synthetic
atggccgactcccaagtacgaacctgattagggtcccgagataatgagcgagaccttgatggattttcgtatggttcccggctattatgtcgcatgttgctagatctaccccgttctcttggagacccagcatggcgtat

SEQ ID NO: 377879 - DNA, 140 bp, Artificial Sequence
  Synthetic
aggccctggctgctgatatgacgaaaatccatcaaggtctcgctcattatctcgggaccctaatcaggttgatcgtaggcagcctcgaagtgcatcccaaattcgtgttccgaatctgttgaccttttgggacagcggtg

SEQ ID NO: 377880 - DNA, 140 bp, Artificial Sequence
  Synthetic
caccgctgtcccaaaaggtcaacagattcggaacacgaatttgggatgcacttcgaggctgcctacgatcaacctgattagggtcccgagataatgagcgagaccttgatggattttcgtcatatcagcagccagggcct

SEQ ID NO: 377881 - DNA, 140 bp, Artificial Sequence
  Synthetic
atacgccatgctgggtctcctatgcccaacactcaaaaaaggattcctctgcgatagtaaattttgcaaaaaagatcaccaattggatagcttaaatgatcatgaattactactgctaatcgtacttgggagtcggccat

SEQ ID NO: 377882 - DNA, 140 bp, Artificial Sequence
  Synthetic
atggccgactcccaagtacgattagcagtagtaattcatgatcatttaagctatccaattggtgatcttttttgcaaaatttactatcgcagaggaatccttttttgagtgttgggcataggagacccagcatggcgtat

SEQ ID NO: 377883 - DNA, 140 bp, Artificial Sequence
  Synthetic
aggccctggctgctgatatgaaagatcaccaattggatagcttaaatgatcatgaattactactgctaattgcaagaagaacatgtggaattatcgagagcaattcgcagattacatcccgaccttttgggacagcggtg

SEQ ID NO: 377884 - DNA, 140 bp, Artificial Sequence
  Synthetic
caccgctgtcccaaaaggtcgggatgtaatctgcgaattgctctcgataattccacatgttcttcttgcaattagcagtagtaattcatgatcatttaagctatccaattggtgatctttcatatcagcagccagggcct

SEQ ID NO: 377885 - DNA, 140 bp, Artificial Sequence
  Synthetic
atacgccatgctgggtctcctgcaagaagaacatgtggaattatcgagagcaattcgcagattacatccccaaaagatatgcggttagcgaatccaacagctgaagacttctcacaaggtcgtacttgggagtcggccat

SEQ ID NO: 377886 - DNA, 140 bp, Artificial Sequence
  Synthetic
atggccgactcccaagtacgaccttgtgagaagtcttcagctgttggattcgctaaccgcatatcttttggggatgtaatctgcgaattgctctcgataattccacatgttcttcttgcaggagacccagcatggcgtat

SEQ ID NO: 377887 - DNA, 140 bp, Artificial Sequence
  Synthetic
atacgccatgctgggtctccaatagtcctaaattaacacttgcagtccttcttcaaattgctgaacattgggcaaccagagacctaaggcaaattgaggactctaaacttagagctctttcgtacttgggagtcggccat

SEQ ID NO: 377888 - DNA, 140 bp, Artificial Sequence
  Synthetic
atggccgactcccaagtacgaaagagctctaagtttagagtcctcaatttgccttaggtctctggttgcccaatgttcagcaatttgaagaaggactgcaagtgttaatttaggactattggagacccagcatggcgtat

SEQ ID NO: 377889 - DNA, 140 bp, Artificial Sequence
  Synthetic
aggccctggctgctgatatgattttgaggctgccctgtggcaacaatgggaccgacagtcgttaataatgttcatctctgcttttctcaacattgctctccagacaccttgtgaaagttcgaccttttgggacagcggtg

SEQ ID NO: 377890 - DNA, 140 bp, Artificial Sequence
  Synthetic
caccgctgtcccaaaaggtcgaactttcacaaggtgtctggagagcaatgttgagaaaagcagagatgaacattattaacgactgtcggtcccattgttgccacagggcagcctcaaaatcatatcagcagccagggcct

SEQ ID NO: 377891 - DNA, 140 bp, Artificial Sequence
  Synthetic
atacgccatgctgggtctccctacaccatccgaggcaactaatgataccacctggtcaagtacagttgaatagaaaaccactggagctatttttccacgattgctctcagtcaataaattcgtacttgggagtcggccat

SEQ ID NO: 377892 - DNA, 140 bp, Artificial Sequence
  Synthetic
atggccgactcccaagtacgaatttattgactgagagcaatcgtggaaaaatagctccagtggttttctattcaactgtacttgaccaggtggtatcattagttgcctcggatggtgtagggagacccagcatggcgtat

SEQ ID NO: 377893 - DNA, 140 bp, Artificial Sequence
  Synthetic
aggccctggctgctgatatgccctatttgacggtacatgacttgaatgtaataaggtaagttggtatctgaggtattttgtctagagtatactcaaaatcgtatgtctagcaaattatcagaccttttgggacagcggtg

SEQ ID NO: 377894 - DNA, 140 bp, Artificial Sequence
  Synthetic
caccgctgtcccaaaaggtctgataatttgctagacatacgattttgagtatactctagacaaaatacctcagataccaacttaccttattacattcaagtcatgtaccgtcaaatagggcatatcagcagccagggcct

SEQ ID NO: 377895 - DNA, 140 bp, Artificial Sequence
  Synthetic
atacgccatgctgggtctccatagcaaagttaaattctcctaacctcatattttgatcaagtaatcatgattttatggtaattctttgcagattatcggtttaatctttattaagaaaaacgtacttgggagtcggccat

SEQ ID NO: 377896 - DNA, 140 bp, Artificial Sequence
  Synthetic
atggccgactcccaagtacgtttttcttaataaagattaaaccgataatctgcaaagaattaccataaaatcatgattacttgatcaaaatatgaggttaggagaatttaactttgctatggagacccagcatggcgtat

SEQ ID NO: 377897 - DNA, 140 bp, Artificial Sequence
  Synthetic
atacgccatgctgggtctccatcatgattgtagacaatttactggtagtccctgggtatccaagtttatgaacagagctagagagaatttgctacttccgaggtataactttattatttgcgtacttgggagtcggccat

SEQ ID NO: 377898 - DNA, 140 bp, Artificial Sequence
  Synthetic
atggccgactcccaagtacgcaaataataaagttatacctcggaagtagcaaattctctctagctctgttcataaacttggatacccagggactaccagtaaattgtctacaatcatgatggagacccagcatggcgtat

SEQ ID NO: 377899 - DNA, 140 bp, Artificial Sequence
  Synthetic
atacgccatgctgggtctccaacagagctagagagaatttgctacttccgaggtataactttattatttgctacttcgaatgcctaaaaccagtaatgcaggatgaagattaattgcggacgtacttgggagtcggccat

SEQ ID NO: 377900 - DNA, 140 bp, Artificial Sequence
  Synthetic
atggccgactcccaagtacgtccgcaattaatcttcatcctgcattactggttttaggcattcgaagtagcaaataataaagttatacctcggaagtagcaaattctctctagctctgttggagacccagcatggcgtat

SEQ ID NO: 377901 - DNA, 140 bp, Artificial Sequence
  Synthetic
aggccctggctgctgatatggcttaaatgaacatttctttgaagctgacatacgaatacatcatatcatatgaaaacatcgcaattagagcgtccttgaagtctggcattgacagtcaccgaccttttgggacagcggtg

SEQ ID NO: 377902 - DNA, 140 bp, Artificial Sequence
  Synthetic
caccgctgtcccaaaaggtcggtgactgtcaatgccagacttcaaggacgctctaattgcgatgttttcatatgatatgatgtattcgtatgtcagcttcaaagaaatgttcatttaagccatatcagcagccagggcct

SEQ ID NO: 377903 - DNA, 140 bp, Artificial Sequence
  Synthetic
atacgccatgctgggtctcctgaaaacatcgcaattagagcgtccttgaagtctggcattgacagtcaccaggctgttctcagtagtctgtccttggaagctcttggggagacaagaagacgtacttgggagtcggccat

SEQ ID NO: 377904 - DNA, 140 bp, Artificial Sequence
  Synthetic
atggccgactcccaagtacgtcttcttgtctccccaagagcttccaaggacagactactgagaacagcctggtgactgtcaatgccagacttcaaggacgctctaattgcgatgttttcaggagacccagcatggcgtat

SEQ ID NO: 377905 - DNA, 140 bp, Artificial Sequence
  Synthetic
atacgccatgctgggtctccggtcccagagagtcccaacaggttggcataaggtcattaacaccagcatagtcagctcgatcaagactgtaagcgagtcgattgcaactaaaaagattatcgtacttgggagtcggccat

SEQ ID NO: 377906 - DNA, 140 bp, Artificial Sequence
  Synthetic
atggccgactcccaagtacgataatctttttagttgcaatcgactcgcttacagtcttgatcgagctgactatgctggtgttaatgaccttatgccaacctgttgggactctctgggaccggagacccagcatggcgtat

SEQ ID NO: 377907 - DNA, 140 bp, Artificial Sequence
  Synthetic
atacgccatgctgggtctccagatggctaaagccacaggccgatacaatctcgtgcccccaaagaaagatatggaaaagggagtgatttttagtgatctttgtaatttcttgattactcacgtacttgggagtcggccat

SEQ ID NO: 377908 - DNA, 140 bp, Artificial Sequence
  Synthetic
atggccgactcccaagtacgtgagtaatcaagaaattacaaagatcactaaaaatcactcccttttccatatctttctttgggggcacgagattgtatcggcctgtggctttagccatctggagacccagcatggcgtat

SEQ ID NO: 377909 - DNA, 140 bp, Artificial Sequence
  Synthetic
atacgccatgctgggtctccccggattgcaggatcagttgttagaccattcattggttgagccattgacaggggctctcggtctaatttctgattggctcctaactacaacgtcaacacacgtacttgggagtcggccat

SEQ ID NO: 377910 - DNA, 140 bp, Artificial Sequence
  Synthetic
atggccgactcccaagtacgtgtgttgacgttgtagttaggagccaatcagaaattagaccgagagcccctgtcaatggctcaaccaatgaatggtctaacaactgatcctgcaatccggggagacccagcatggcgtat

SEQ ID NO: 377911 - DNA, 140 bp, Artificial Sequence
  Synthetic
atacgccatgctgggtctcctatctttgatcaggtcaaacatcttgcagttcatcaacaagcttgacgccctgcatgttgtcaattacaatggtttactcagtagtattgagatcgggaccgtacttgggagtcggccat

SEQ ID NO: 377912 - DNA, 140 bp, Artificial Sequence
  Synthetic
atggccgactcccaagtacggtcccgatctcaatactactgagtaaaccattgtaattgacaacatgcagggcgtcaagcttgttgatgaactgcaagatgtttgacctgatcaaagataggagacccagcatggcgtat

SEQ ID NO: 377913 - DNA, 140 bp, Artificial Sequence
  Synthetic
aggccctggctgctgatatgaagttcaggagcctgacaaatcagctatgaattctaagcgcccaggaccagtcaagttctcattacttcatgagtctgccttcaaacctttcactcgtgtgaccttttgggacagcggtg

SEQ ID NO: 377914 - DNA, 140 bp, Artificial Sequence
  Synthetic
caccgctgtcccaaaaggtcacacgagtgaaaggtttgaaggcagactcatgaagtaatgagaacttgactggtcctgggcgcttagaattcatagctgatttgtcaggctcctgaacttcatatcagcagccagggcct

SEQ ID NO: 377915 - DNA, 140 bp, Artificial Sequence
  Synthetic
atacgccatgctgggtctcctgcattgagcactgctagtaggtttgcaccacgttaaagattcagagtgtatgaattgtgcagatttaaacttgggttttgccttatgcttcataggtggcgtacttgggagtcggccat

SEQ ID NO: 377916 - DNA, 140 bp, Artificial Sequence
  Synthetic
atggccgactcccaagtacgccacctatgaagcataaggcaaaacccaagtttaaatctgcacaattcatacactctgaatctttaacgtggtgcaaacctactagcagtgctcaatgcaggagacccagcatggcgtat

SEQ ID NO: 377917 - DNA, 140 bp, Artificial Sequence
  Synthetic
atacgccatgctgggtctccatcagaaattggagataaatggacatcgggatagaacaatgcctaactattgggcggctttcatttttaaatgtgtatataaccaatcttttcctatcttcgtacttgggagtcggccat

SEQ ID NO: 377918 - DNA, 140 bp, Artificial Sequence
  Synthetic
atggccgactcccaagtacgaagataggaaaagattggttatatacacatttaaaaatgaaagccgcccaatagttaggcattgttctatcccgatgtccatttatctccaatttctgatggagacccagcatggcgtat

SEQ ID NO: 377919 - DNA, 140 bp, Artificial Sequence
  Synthetic
aggccctggctgctgatatgtaagagaaggtctgaggaagattaagaaaaaggtctcgtgttcacttggttgccgtcaagtatcctgtggtttttttctacctaacttcctcatgccatagaccttttgggacagcggtg

SEQ ID NO: 377920 - DNA, 140 bp, Artificial Sequence
  Synthetic
caccgctgtcccaaaaggtctatggcatgaggaagttaggtagaaaaaaaccacaggatacttgacggcaaccaagtgaacacgagacctttttcttaatcttcctcagaccttctcttacatatcagcagccagggcct

SEQ ID NO: 377921 - DNA, 140 bp, Artificial Sequence
  Synthetic
atacgccatgctgggtctcctggctacccagcatacccagtacccggatgcacgtttatcttcacctatagtcctggatcaatgtgatttggtaactcgagcatgtgggttatattcatccgtacttgggagtcggccat

SEQ ID NO: 377922 - DNA, 140 bp, Artificial Sequence
  Synthetic
atggccgactcccaagtacggatgaatataacccacatgctcgagttaccaaatcacattgatccaggactataggtgaagataaacgtgcatccgggtactgggtatgctgggtagccaggagacccagcatggcgtat

SEQ ID NO: 377923 - DNA, 140 bp, Artificial Sequence
  Synthetic
atacgccatgctgggtctccatcgacttaagttcgacacaatagtatccaaattcctaagtgatacacctgtagcaacactgccgatagactatttagtaccaattctcctgcgttccctcgtacttgggagtcggccat

SEQ ID NO: 377924 - DNA, 140 bp, Artificial Sequence
  Synthetic
atggccgactcccaagtacgagggaacgcaggagaattggtactaaatagtctatcggcagtgttgctacaggtgtatcacttaggaatttggatactattgtgtcgaacttaagtcgatggagacccagcatggcgtat

SEQ ID NO: 377925 - DNA, 140 bp, Artificial Sequence
  Synthetic
atacgccatgctgggtctccatggaattattaattacactcttcatgatgcagcctttcttgattactatctcaaggcaacaggtgcacaggaccatttgacaaacattacaactagagacgtacttgggagtcggccat

SEQ ID NO: 377926 - DNA, 140 bp, Artificial Sequence
  Synthetic
atggccgactcccaagtacgtctctagttgtaatgtttgtcaaatggtcctgtgcacctgttgccttgagatagtaatcaagaaaggctgcatcatgaagagtgtaattaataattccatggagacccagcatggcgtat

SEQ ID NO: 377927 - DNA, 140 bp, Artificial Sequence
  Synthetic
atacgccatgctgggtctccctcaaggcaacaggtgcacaggaccatttgacaaacattacaactagagagaagcttaaaaacgaaattctaaacaatgattatgtccatcaattgttctcgtacttgggagtcggccat

SEQ ID NO: 377928 - DNA, 140 bp, Artificial Sequence
  Synthetic
atggccgactcccaagtacgagaacaattgatggacataatcattgtttagaatttcgtttttaagcttctctctagttgtaatgtttgtcaaatggtcctgtgcacctgttgccttgagggagacccagcatggcgtat

SEQ ID NO: 377929 - DNA, 140 bp, Artificial Sequence
  Synthetic
atacgccatgctgggtctccaacaaccgttcaacctggtttgttcatgatgaattcattgatattttaggatatggcgattatattttttggaaaatacctttatcattattaccagttacgtacttgggagtcggccat

SEQ ID NO: 377930 - DNA, 140 bp, Artificial Sequence
  Synthetic
atggccgactcccaagtacgtaactggtaataatgataaaggtattttccaaaaaatataatcgccatatcctaaaatatcaatgaattcatcatgaacaaaccaggttgaacggttgttggagacccagcatggcgtat

SEQ ID NO: 377931 - DNA, 140 bp, Artificial Sequence
  Synthetic
atacgccatgctgggtctcccactgattgcatccattgcaaaattagaggatgtagatgtgtctgattatcctgacccgagtgatattcttaagatatacaatgctggagactatgtaatcgtacttgggagtcggccat

SEQ ID NO: 377932 - DNA, 140 bp, Artificial Sequence
  Synthetic
atggccgactcccaagtacgattacatagtctccagcattgtatatcttaagaatatcactcgggtcaggataatcagacacatctacatcctctaattttgcaatggatgcaatcagtgggagacccagcatggcgtat

SEQ ID NO: 377933 - DNA, 140 bp, Artificial Sequence
  Synthetic
aggccctggctgctgatatgcgtttcctcacacagatgcatttatcagtaataaatgatcttcgggagttgatttctaaccgcaggttaaaggactatcagcaagagaagattagggattgaccttttgggacagcggtg

SEQ ID NO: 377934 - DNA, 140 bp, Artificial Sequence
  Synthetic
caccgctgtcccaaaaggtcaatccctaatcttctcttgctgatagtcctttaacctgcggttagaaatcaactcccgaagatcatttattactgataaatgcatctgtgtgaggaaacgcatatcagcagccagggcct

SEQ ID NO: 377935 - DNA, 140 bp, Artificial Sequence
  Synthetic
aggccctggctgctgatatggatttctaaccgcaggttaaaggactatcagcaagagaagattagggattttcacaaaatattattacaattgcaattatctcctcaacagttttgtgaagaccttttgggacagcggtg

SEQ ID NO: 377936 - DNA, 140 bp, Artificial Sequence
  Synthetic
caccgctgtcccaaaaggtcttcacaaaactgttgaggagataattgcaattgtaataatattttgtgaaaatccctaatcttctcttgctgatagtcctttaacctgcggttagaaatccatatcagcagccagggcct

SEQ ID NO: 377937 - DNA, 140 bp, Artificial Sequence
  Synthetic
atacgccatgctgggtctccttattctctgttcaaaaacattgggggcatccaattttacatagtgagaaagctatacaaaaagtaaaacggcatgcaaccatccttaaggctctcagaccgtacttgggagtcggccat

SEQ ID NO: 377938 - DNA, 140 bp, Artificial Sequence
  Synthetic
atggccgactcccaagtacggtctgagagccttaaggatggttgcatgccgttttactttttgtatagctttctcactatgtaaaattggatgcccccaatgtttttgaacagagaataaggagacccagcatggcgtat

SEQ ID NO: 377939 - DNA, 140 bp, Artificial Sequence
  Synthetic
atacgccatgctgggtctcccactatttcgacagccaaggaacttggtacagtgtaatctcagacaggaatttaactccaggactcaactccttcataaaacgtaatcactttccttcaccgtacttgggagtcggccat

SEQ ID NO: 377940 - DNA, 140 bp, Artificial Sequence
  Synthetic
atggccgactcccaagtacggtgaaggaaagtgattacgttttatgaaggagttgagtcctggagttaaattcctgtctgagattacactgtaccaagttccttggctgtcgaaatagtgggagacccagcatggcgtat

SEQ ID NO: 377941 - DNA, 140 bp, Artificial Sequence
  Synthetic
atacgccatgctgggtctcctacccatgattaaggatcttctatgggaattctatcatcttaatcaccctccgttattctctacaaaggtgattagtgacttaagtattttcatcaaggacgtacttgggagtcggccat

SEQ ID NO: 377942 - DNA, 140 bp, Artificial Sequence
  Synthetic
atggccgactcccaagtacgtccttgatgaaaatacttaagtcactaatcacctttgtagagaataacggagggtgattaagatgatagaattcccatagaagatccttaatcatgggtaggagacccagcatggcgtat

SEQ ID NO: 377943 - DNA, 140 bp, Artificial Sequence
  Synthetic
aggccctggctgctgatatgtatctcacacggaatgtccaaactttatgtgaggctctgttagcagatggactggctaaggccttccccagtaacatgatggtagtaactgaacgtgaacgaccttttgggacagcggtg

SEQ ID NO: 377944 - DNA, 140 bp, Artificial Sequence
  Synthetic
caccgctgtcccaaaaggtcgttcacgttcagttactaccatcatgttactggggaaggccttagccagtccatctgctaacagagcctcacataaagtttggacattccgtgtgagatacatatcagcagccagggcct

SEQ ID NO: 377945 - DNA, 140 bp, Artificial Sequence
  Synthetic
atacgccatgctgggtctccaaaaagagagccttcttcatcaggcatcatggcaccacaccagtgatgattttggagagaatgctaccgttcgagggagtagttttgtaactgatttagacgtacttgggagtcggccat

SEQ ID NO: 377946 - DNA, 140 bp, Artificial Sequence
  Synthetic
atggccgactcccaagtacgtctaaatcagttacaaaactactccctcgaacggtagcattctctccaaaatcatcactggtgtggtgccatgatgcctgatgaagaaggctctctttttggagacccagcatggcgtat

SEQ ID NO: 377947 - DNA, 140 bp, Artificial Sequence
  Synthetic
aggccctggctgctgatatgtttggagagaatgctaccgttcgagggagtagttttgtaactgatttagagaagtacaatcttgcatttcgctatgagttcactgcaccatttattgagtgaccttttgggacagcggtg

SEQ ID NO: 377948 - DNA, 140 bp, Artificial Sequence
  Synthetic
caccgctgtcccaaaaggtcactcaataaatggtgcagtgaactcatagcgaaatgcaagattgtacttctctaaatcagttacaaaactactccctcgaacggtagcattctctccaaacatatcagcagccagggcct

SEQ ID NO: 377949 - DNA, 140 bp, Artificial Sequence
  Synthetic
atacgccatgctgggtctcctttttccacttgaaacagaccctgaagagcaggagcaaagcgccgaagacaatgctgcaagagtagcagcaagtcttgcaaaagtaaccagtgcatgtggcgtacttgggagtcggccat

SEQ ID NO: 377950 - DNA, 140 bp, Artificial Sequence
  Synthetic
atggccgactcccaagtacgccacatgcactggttacttttgcaagacttgctgctactcttgcagcattgtcttcggcgctttgctcctgctcttcagggtctgtttcaagtggaaaaaggagacccagcatggcgtat

SEQ ID NO: 377951 - DNA, 140 bp, Artificial Sequence
  Synthetic
atacgccatgctgggtctcctcggaaaaaaacaatatctcaatggtgtacaattaccgcaatcactcaaaacagcagcaagaatggcgccactctctgatgctatattcgatgatctacacgtacttgggagtcggccat

SEQ ID NO: 377952 - DNA, 140 bp, Artificial Sequence
  Synthetic
atggccgactcccaagtacgtgtagatcatcgaatatagcatcagagagtggcgccattcttgctgctgttttgagtgattgcggtaattgtacaccattgagatattgtttttttccgaggagacccagcatggcgtat

SEQ ID NO: 377953 - DNA, 140 bp, Artificial Sequence
  Synthetic
atacgccatgctgggtctcccgcgacatatcctcccatgtcgtattgtagcagctttccatacgtatttcgccgttcggattttacaatatcaccatcttggatttaataaaggcatcgacgtacttgggagtcggccat

SEQ ID NO: 377954 - DNA, 140 bp, Artificial Sequence
  Synthetic
atggccgactcccaagtacgtcgatgcctttattaaatccaagatggtgatattgtaaaatccgaacggcgaaatacgtatggaaagctgctacaatacgacatgggaggatatgtcgcgggagacccagcatggcgtat

SEQ ID NO: 377955 - DNA, 140 bp, Artificial Sequence
  Synthetic
atacgccatgctgggtctcctaacattggcggttccacaagtccttgggggattgtcttttctaaatccagaaaagtgtttttatcgaaacttcggagatcctgtgacttctggacttttcgtacttgggagtcggccat

SEQ ID NO: 377956 - DNA, 140 bp, Artificial Sequence
  Synthetic
atggccgactcccaagtacgaaaagtccagaagtcacaggatctccgaagtttcgataaaaacacttttctggatttagaaaagacaatcccccaaggacttgtggaaccgccaatgttaggagacccagcatggcgtat

SEQ ID NO: 377957 - DNA, 140 bp, Artificial Sequence
  Synthetic
atacgccatgctgggtctcccattaatatcgaaaaatccaggaaattgtagtgccattgattttgtcttaaatccatccggattaaatgttccaggatcacaagacttgacatcctttttcgtacttgggagtcggccat

SEQ ID NO: 377958 - DNA, 140 bp, Artificial Sequence
  Synthetic
atggccgactcccaagtacgaaaaaggatgtcaagtcttgtgatcctggaacatttaatccggatggatttaagacaaaatcaatggcactacaatttcctggatttttcgatattaatgggagacccagcatggcgtat

SEQ ID NO: 377959 - DNA, 140 bp, Artificial Sequence
  Synthetic
atacgccatgctgggtctccgcgacagatcgttaggcgtagtattacactaactgcaagaaataagttaattaacactctcttccatgcctctgctgatttggaagatgagatggtttgtcgtacttgggagtcggccat

SEQ ID NO: 377960 - DNA, 140 bp, Artificial Sequence
  Synthetic
atggccgactcccaagtacgacaaaccatctcatcttccaaatcagcagaggcatggaagagagtgttaattaacttatttcttgcagttagtgtaatactacgcctaacgatctgtcgcggagacccagcatggcgtat

SEQ ID NO: 377961 - DNA, 140 bp, Artificial Sequence
  Synthetic
aggccctggctgctgatatgtttttccaggacacctagtggtaaacgtctccaaatattaggttatcttgaagggaccaggactctattggcctccaaaatcataaacaacaacagtgaggaccttttgggacagcggtg

SEQ ID NO: 377962 - DNA, 140 bp, Artificial Sequence
  Synthetic
caccgctgtcccaaaaggtcctcactgttgttgtttatgattttggaggccaatagagtcctggtcccttcaagataacctaatatttggagacgtttaccactaggtgtcctggaaaaacatatcagcagccagggcct

SEQ ID NO: 377963 - DNA, 140 bp, Artificial Sequence
  Synthetic
atacgccatgctgggtctccaagggaccaggactctattggcctccaaaatcataaacaacaacagtgagacacctgtacttgataagctgaggaagatcaccctacaaagatggaatctcgtacttgggagtcggccat

SEQ ID NO: 377964 - DNA, 140 bp, Artificial Sequence
  Synthetic
atggccgactcccaagtacgagattccatctttgtagggtgatcttcctcagcttatcaagtacaggtgtctcactgttgttgtttatgattttggaggccaatagagtcctggtcccttggagacccagcatggcgtat

SEQ ID NO: 377965 - DNA, 140 bp, Artificial Sequence
  Synthetic
aggccctggctgctgatatgacacctgtacttgataagctgaggaagatcaccctacaaagatggaatctgtggttcagttatttggaccattgtgaccaattactagcagatgctctacgaccttttgggacagcggtg

SEQ ID NO: 377966 - DNA, 140 bp, Artificial Sequence
  Synthetic
caccgctgtcccaaaaggtcgtagagcatctgctagtaattggtcacaatggtccaaataactgaaccacagattccatctttgtagggtgatcttcctcagcttatcaagtacaggtgtcatatcagcagccagggcct

SEQ ID NO: 377967 - DNA, 140 bp, Artificial Sequence
  Synthetic
atacgccatgctgggtctcccagaatgcctcaacaaaaaaggctcaaatgcttatgtctcagttgcagtcaaagatcaagtggtcagtgcttggcctaatacttctcgaataagttggaccgtacttgggagtcggccat

SEQ ID NO: 377968 - DNA, 140 bp, Artificial Sequence
  Synthetic
atggccgactcccaagtacggtccaacttattcgagaagtattaggccaagcactgaccacttgatctttgactgcaactgagacataagcatttgagccttttttgttgaggcattctgggagacccagcatggcgtat

SEQ ID NO: 377969 - DNA, 140 bp, Artificial Sequence
  Synthetic
aggccctggctgctgatatgaaagatcaagtggtcagtgcttggcctaatacttctcgaataagttggacaatagggagtggtgtcccctatatagggtcaagaaccgaggataaaatcggaccttttgggacagcggtg

SEQ ID NO: 377970 - DNA, 140 bp, Artificial Sequence
  Synthetic
caccgctgtcccaaaaggtccgattttatcctcggttcttgaccctatataggggacaccactccctattgtccaacttattcgagaagtattaggccaagcactgaccacttgatctttcatatcagcagccagggcct

SEQ ID NO: 377971 - DNA, 140 bp, Artificial Sequence
  Synthetic
atacgccatgctgggtctcccaatactgcgacccgtctcatagtgtcaactaatacacttggagaattttcaggtggagggcaggccgccagggatagcaatataattttccagaatgttcgtacttgggagtcggccat

SEQ ID NO: 377972 - DNA, 140 bp, Artificial Sequence
  Synthetic
atggccgactcccaagtacgaacattctggaaaattatattgctatccctggcggcctgccctccacctgaaaattctccaagtgtattagttgacactatgagacgggtcgcagtattgggagacccagcatggcgtat

SEQ ID NO: 377973 - DNA, 140 bp, Artificial Sequence
  Synthetic
aggccctggctgctgatatgcaggtggagggcaggccgccagggatagcaatataattttccagaatgttataaatttagcagttgccctttatgatattagattccggaatacgaacacgaccttttgggacagcggtg

SEQ ID NO: 377974 - DNA, 140 bp, Artificial Sequence
  Synthetic
caccgctgtcccaaaaggtcgtgttcgtattccggaatctaatatcataaagggcaactgctaaatttataacattctggaaaattatattgctatccctggcggcctgccctccacctgcatatcagcagccagggcct

SEQ ID NO: 377975 - DNA, 140 bp, Artificial Sequence
  Synthetic
atacgccatgctgggtctccataaatttagcagttgccctttatgatattagattccggaatacgaacacctctgatataaggcataatagggctcatcttcacctgacagagtgctgtacgtacttgggagtcggccat

SEQ ID NO: 377976 - DNA, 140 bp, Artificial Sequence
  Synthetic
atggccgactcccaagtacgtacagcactctgtcaggtgaagatgagccctattatgccttatatcagaggtgttcgtattccggaatctaatatcataaagggcaactgctaaatttatggagacccagcatggcgtat

SEQ ID NO: 377977 - DNA, 140 bp, Artificial Sequence
  Synthetic
aggccctggctgctgatatgctctgatataaggcataatagggctcatcttcacctgacagagtgctgtactaaagaggtcccggcccagtatttgacatatacaagtgcactcaatctggaccttttgggacagcggtg

SEQ ID NO: 377978 - DNA, 140 bp, Artificial Sequence
  Synthetic
caccgctgtcccaaaaggtccagattgagtgcacttgtatatgtcaaatactgggccgggacctctttagtacagcactctgtcaggtgaagatgagccctattatgccttatatcagagcatatcagcagccagggcct

SEQ ID NO: 377979 - DNA, 140 bp, Artificial Sequence
  Synthetic
aggccctggctgctgatatggatttaagccgttatcgtgataatgaactaatatatgactcaaatccactgaggggaggattgaactgcaatttaacaatggatagtcctttagtgaagggaccttttgggacagcggtg

SEQ ID NO: 377980 - DNA, 140 bp, Artificial Sequence
  Synthetic
caccgctgtcccaaaaggtcccttcactaaaggactatccattgttaaattgcagttcaatcctcccctcagtggatttgagtcatatattagttcattatcacgataacggcttaaatccatatcagcagccagggcct

SEQ ID NO: 377981 - DNA, 140 bp, Artificial Sequence
  Synthetic
aggccctggctgctgatatggtcctaggcttaacatgattgaagatgatcttctccgctttccacacctttctggatgggagttagcgaaaacggtggtacaatccatcatctcagacaagaccttttgggacagcggtg

SEQ ID NO: 377982 - DNA, 140 bp, Artificial Sequence
  Synthetic
caccgctgtcccaaaaggtcttgtctgagatgatggattgtaccaccgttttcgctaactcccatccagaaaggtgtggaaagcggagaagatcatcttcaatcatgttaagcctaggaccatatcagcagccagggcct

SEQ ID NO: 377983 - DNA, 140 bp, Artificial Sequence
  Synthetic
aggccctggctgctgatatgtctggatgggagttagcgaaaacggtggtacaatccatcatctcagacaatagcaactcatcaacagatccaatcagtagcggagaaacacgctctttcagaccttttgggacagcggtg

SEQ ID NO: 377984 - DNA, 140 bp, Artificial Sequence
  Synthetic
caccgctgtcccaaaaggtctgaaagagcgtgtttctccgctactgattggatctgttgatgagttgctattgtctgagatgatggattgtaccaccgttttcgctaactcccatccagacatatcagcagccagggcct

SEQ ID NO: 377985 - DNA, 140 bp, Artificial Sequence
  Synthetic
aggccctggctgctgatatgtgattatgaacagtttctatattatttgcataaccagctgcacaacttacctcatcgagcactccgtgtttttaaaccaacatttaagcatgccagtgtggaccttttgggacagcggtg

SEQ ID NO: 377986 - DNA, 140 bp, Artificial Sequence
  Synthetic
caccgctgtcccaaaaggtccacactggcatgcttaaatgttggtttaaaaacacggagtgctcgatgaggtaagttgtgcagctggttatgcaaataatatagaaactgttcataatcacatatcagcagccagggcct

SEQ ID NO: 377987 - DNA, 140 bp, Artificial Sequence
  Synthetic
atacgccatgctgggtctcccaaaagacaattcctttatggatagtatatccgcttgaaggtcaacagccggaatccatcaatgaatttctacataaaatttttggtctgctcaaacaagcgtacttgggagtcggccat

SEQ ID NO: 377988 - DNA, 140 bp, Artificial Sequence
  Synthetic
atggccgactcccaagtacgcttgtttgagcagaccaaaaattttatgtagaaattcattgatggattccggctgttgaccttcaagcggatatactatccataaaggaattgtcttttgggagacccagcatggcgtat

SEQ ID NO: 377989 - DNA, 140 bp, Artificial Sequence
  Synthetic
atacgccatgctgggtctccgatttggcagaaaataattatgtttacaatagtaagagcactgctagtaatttcttccatgcatccttagcttactggagaagtaggaaatctcggaaaacgtacttgggagtcggccat

SEQ ID NO: 377990 - DNA, 140 bp, Artificial Sequence
  Synthetic
atggccgactcccaagtacgttttccgagatttcctacttctccagtaagctaaggatgcatggaagaaattactagcagtgctcttactattgtaaacataattattttctgccaaatcggagacccagcatggcgtat

SEQ ID NO: 377991 - DNA, 140 bp, Artificial Sequence
  Synthetic
atacgccatgctgggtctccctcaagaccataatgatttctcaagaggggatggaacacttacagaacccgtgtgtaagttctcaagcaatcatcagtcagatgaaaagtactacaatgtcgtacttgggagtcggccat

SEQ ID NO: 377992 - DNA, 140 bp, Artificial Sequence
  Synthetic
atggccgactcccaagtacgacattgtagtacttttcatctgactgatgattgcttgagaacttacacacgggttctgtaagtgttccatcccctcttgagaaatcattatggtcttgagggagacccagcatggcgtat

SEQ ID NO: 377993 - DNA, 140 bp, Artificial Sequence
  Synthetic
atacgccatgctgggtctccacagactcagcaataacgggcaaacaatgagtaatcatcgtaagaaagggaagttccacaagtggaatccctgcaaagtgttaatggagagtcaaaggggcgtacttgggagtcggccat

SEQ ID NO: 377994 - DNA, 140 bp, Artificial Sequence
  Synthetic
atggccgactcccaagtacgcccctttgactctccattaacactttgcagggattccacttgtggaacttccctttcttacgatgattactcattgtttgcccgttattgctgagtctgtggagacccagcatggcgtat

SEQ ID NO: 377995 - DNA, 140 bp, Artificial Sequence
  Synthetic
aggccctggctgctgatatgatgatgtatcaagtcctcaccgactcattctaccattttttaaattgggaaatcacaaccatgcacatgatcaagatgcccaagaattgataaatcaaaagaccttttgggacagcggtg

SEQ ID NO: 377996 - DNA, 140 bp, Artificial Sequence
  Synthetic
caccgctgtcccaaaaggtcttttgatttatcaattcttgggcatcttgatcatgtgcatggttgtgatttcccaatttaaaaaatggtagaatgagtcggtgaggacttgatacatcatcatatcagcagccagggcct

SEQ ID NO: 377997 - DNA, 140 bp, Artificial Sequence
  Synthetic
atacgccatgctgggtctcctattaaacagtacctacatcagctaaggtctatgttggacaccactatatattgtagattcacagggattgtctcatccatgcattacaaattggacgaacgtacttgggagtcggccat

SEQ ID NO: 377998 - DNA, 140 bp, Artificial Sequence
  Synthetic
atggccgactcccaagtacgttcgtccaatttgtaatgcatggatgagacaatccctgtgaatctacaatatatagtggtgtccaacatagaccttagctgatgtaggtactgtttaataggagacccagcatggcgtat

SEQ ID NO: 377999 - DNA, 140 bp, Artificial Sequence
  Synthetic
aggccctggctgctgatatgcaagttgaaatcattacgatggatgctgaaacaacagagaacttaaacaggtcccaactctaccgagcagtatataacttaatacttgatcacattgatcgaccttttgggacagcggtg

SEQ ID NO: 378000 - DNA, 140 bp, Artificial Sequence
  Synthetic
caccgctgtcccaaaaggtcgatcaatgtgatcaagtattaagttatatactgctcggtagagttgggacctgtttaagttctctgttgtttcagcatccatcgtaatgatttcaacttgcatatcagcagccagggcct

SEQ ID NO: 378001 - DNA, 140 bp, Artificial Sequence
  Synthetic
aggccctggctgctgatatggtcccaactctaccgagcagtatataacttaatacttgatcacattgatccgcagtatctcaaggtggtggtactcaaagtatttctgagtgatatagaagaccttttgggacagcggtg

SEQ ID NO: 378002 - DNA, 140 bp, Artificial Sequence
  Synthetic
caccgctgtcccaaaaggtcttctatatcactcagaaatactttgagtaccaccaccttgagatactgcggatcaatgtgatcaagtattaagttatatactgctcggtagagttgggaccatatcagcagccagggcct

SEQ ID NO: 378003 - DNA, 140 bp, Artificial Sequence
  Synthetic
atacgccatgctgggtctcccttgattaaaccgattacatcaagtgcccggtcaagtgaatggtacctttgcttatcaaatttgatatctactaacaggagatcggcccatcagactcaccgtacttgggagtcggccat

SEQ ID NO: 378004 - DNA, 140 bp, Artificial Sequence
  Synthetic
atggccgactcccaagtacggtgagtctgatgggccgatctcctgttagtagatatcaaatttgataagcaaaggtaccattcacttgaccgggcacttgatgtaatcggtttaatcaagggagacccagcatggcgtat

SEQ ID NO: 378005 - DNA, 140 bp, Artificial Sequence
  Synthetic
aggccctggctgctgatatggcttatcaaatttgatatctactaacaggagatcggcccatcagactcacaaggcatgtcttggtgttatcagagatgctttgcaagcacaagtccagcggaccttttgggacagcggtg

SEQ ID NO: 378006 - DNA, 140 bp, Artificial Sequence
  Synthetic
caccgctgtcccaaaaggtccgctggacttgtgcttgcaaagcatctctgataacaccaagacatgccttgtgagtctgatgggccgatctcctgttagtagatatcaaatttgataagccatatcagcagccagggcct

SEQ ID NO: 378007 - DNA, 140 bp, Artificial Sequence
  Synthetic
atacgccatgctgggtctccaaggcatgtcttggtgttatcagagatgctttgcaagcacaagtccagcgaggcgtgtactggttgagtcacatcgcacagtatgctacaaagaatctcccgtacttgggagtcggccat

SEQ ID NO: 378008 - DNA, 140 bp, Artificial Sequence
  Synthetic
atggccgactcccaagtacgggagattctttgtagcatactgtgcgatgtgactcaaccagtacacgcctcgctggacttgtgcttgcaaagcatctctgataacaccaagacatgccttggagacccagcatggcgtat

SEQ ID NO: 378009 - DNA, 140 bp, Artificial Sequence
  Synthetic
aggccctggctgctgatatgtagacatttaactaacctccaggcagagatacgagacttagtattagattataccctgatgagagagagtcgcactcaaacgtaccattttattaagactgaccttttgggacagcggtg

SEQ ID NO: 378010 - DNA, 140 bp, Artificial Sequence
  Synthetic
caccgctgtcccaaaaggtcagtcttaataaaatggtacgtttgagtgcgactctctctcatcagggtataatctaatactaagtctcgtatctctgcctggaggttagttaaatgtctacatatcagcagccagggcct

SEQ ID NO: 378011 - DNA, 140 bp, Artificial Sequence
  Synthetic
atacgccatgctgggtctccaattacctgaggtgattaatgtgtgtaatcgattttatcatactcacagttgcgaatgtcaggaaaaattctttgtccagacgctttatttacaacgcctcgtacttgggagtcggccat

SEQ ID NO: 378012 - DNA, 140 bp, Artificial Sequence
  Synthetic
atggccgactcccaagtacgaggcgttgtaaataaagcgtctggacaaagaatttttcctgacattcgcaactgtgagtatgataaaatcgattacacacattaatcacctcaggtaattggagacccagcatggcgtat

SEQ ID NO: 378013 - DNA, 140 bp, Artificial Sequence
  Synthetic
atacgccatgctgggtctcctgcgaatgtcaggaaaaattctttgtccagacgctttatttacaacgcctacgcgatgcagaaatcaagctaattgaacgccttaccgggttaatgcgatcgtacttgggagtcggccat

SEQ ID NO: 378014 - DNA, 140 bp, Artificial Sequence
  Synthetic
atggccgactcccaagtacgatcgcattaacccggtaaggcgttcaattagcttgatttctgcatcgcgtaggcgttgtaaataaagcgtctggacaaagaatttttcctgacattcgcaggagacccagcatggcgtat

SEQ ID NO: 378015 - DNA, 140 bp, Artificial Sequence
  Synthetic
atacgccatgctgggtctccaacaagctattagttattacttattgataagaataaactttatcatagcgtaacacatcataactttatagcgattttgcatttctaatcctagtatttacgtacttgggagtcggccat

SEQ ID NO: 378016 - DNA, 140 bp, Artificial Sequence
  Synthetic
atggccgactcccaagtacgtaaatactaggattagaaatgcaaaatcgctataaagttatgatgtgttacgctatgataaagtttattcttatcaataagtaataactaatagcttgttggagacccagcatggcgtat

SEQ ID NO: 378017 - DNA, 140 bp, Artificial Sequence
  Synthetic
atacgccatgctgggtctccttagaatgtactatcagagaaatgaccccagttcctatctttaaataatgattgtgtgtattaaattattagtttattaggtttatgagttggttacacacgtacttgggagtcggccat

SEQ ID NO: 378018 - DNA, 140 bp, Artificial Sequence
  Synthetic
atggccgactcccaagtacgtgtgtaaccaactcataaacctaataaactaataatttaatacacacaatcattatttaaagataggaactggggtcatttctctgatagtacattctaaggagacccagcatggcgtat

SEQ ID NO: 378019 - DNA, 140 bp, Artificial Sequence
  Synthetic
aggccctggctgctgatatgattgtgtgtattaaattattagtttattaggtttatgagttggttacacagtgagtattagtaattgaggattatgtagataggtaatctaacactgaatgaccttttgggacagcggtg

SEQ ID NO: 378020 - DNA, 140 bp, Artificial Sequence
  Synthetic
caccgctgtcccaaaaggtcattcagtgttagattacctatctacataatcctcaattactaatactcactgtgtaaccaactcataaacctaataaactaataatttaatacacacaatcatatcagcagccagggcct

SEQ ID NO: 378021 - DNA, 140 bp, Artificial Sequence
  Synthetic
atacgccatgctgggtctccatgctatcttcagttaagtaacatagactgaaaatgctaagaagagattggagtaaaagtataaaataaatttaattaaacttcaaagtgattaaatgatcgtacttgggagtcggccat

SEQ ID NO: 378022 - DNA, 140 bp, Artificial Sequence
  Synthetic
atggccgactcccaagtacgatcatttaatcactttgaagtttaattaaatttattttatacttttactccaatctcttcttagcattttcagtctatgttacttaactgaagatagcatggagacccagcatggcgtat

SEQ ID NO: 378023 - DNA, 140 bp, Artificial Sequence
  Synthetic
aggccctggctgctgatatggagtaaaagtataaaataaatttaattaaacttcaaagtgattaaatgataatgatcttgggaactcgatatgacctcaagtcaaaaataatgtcaatatgaccttttgggacagcggtg

SEQ ID NO: 378024 - DNA, 140 bp, Artificial Sequence
  Synthetic
caccgctgtcccaaaaggtcatattgacattatttttgacttgaggtcatatcgagttcccaagatcattatcatttaatcactttgaagtttaattaaatttattttatacttttactccatatcagcagccagggcct

SEQ ID NO: 378025 - DNA, 140 bp, Artificial Sequence
  Synthetic
aggccctggctgctgatatgactatgaggaagattaacagttttcctcagtttaagatatacactgaaattgagattgagattctcctctttgctattctgtaactttccctggttgtgagaccttttgggacagcggtg

SEQ ID NO: 378026 - DNA, 140 bp, Artificial Sequence
  Synthetic
caccgctgtcccaaaaggtctcacaaccagggaaagttacagaatagcaaagaggagaatctcaatctcaatttcagtgtatatcttaaactgaggaaaactgttaatcttcctcatagtcatatcagcagccagggcct

SEQ ID NO: 378027 - DNA, 140 bp, Artificial Sequence
  Synthetic
atacgccatgctgggtctccttcccctttccgtcaagtttaaggggttgttttgattgtgtgtagattttataatcctagagtgccaaggagttgcgtgtcatcattgattgggaagatccgtacttgggagtcggccat

SEQ ID NO: 378028 - DNA, 140 bp, Artificial Sequence
  Synthetic
atggccgactcccaagtacggatcttcccaatcaatgatgacacgcaactccttggcactctaggattataaaatctacacacaatcaaaacaaccccttaaacttgacggaaaggggaaggagacccagcatggcgtat

SEQ ID NO: 378029 - DNA, 140 bp, Artificial Sequence
  Synthetic
atacgccatgctgggtctcctgtcaaaaccgttcttgatcatattctgcaaaaaaccgaccaaggagtaagacttcaccctttggcccgaacagccaaagtgcgtaatgaggttaatgcacgtacttgggagtcggccat

SEQ ID NO: 378030 - DNA, 140 bp, Artificial Sequence
  Synthetic
atggccgactcccaagtacgtgcattaacctcattacgcactttggctgttcgggccaaagggtgaagtcttactccttggtcggttttttgcagaatatgatcaagaacggttttgacaggagacccagcatggcgtat

SEQ ID NO: 378031 - DNA, 140 bp, Artificial Sequence
  Synthetic
atacgccatgctgggtctccatggtgattttgaaaattacaatggctatcatgatgatgaagttgggacggcaggtgacttggtcctgttcgatcttgacgatcatgaggatgacaataacgtacttgggagtcggccat

SEQ ID NO: 378032 - DNA, 140 bp, Artificial Sequence
  Synthetic
atggccgactcccaagtacgttattgtcatcctcatgatcgtcaagatcgaacaggaccaagtcacctgccgtcccaacttcatcatcatgatagccattgtaattttcaaaatcaccatggagacccagcatggcgtat

SEQ ID NO: 378033 - DNA, 140 bp, Artificial Sequence
  Synthetic
aggccctggctgctgatatggcaggtgacttggtcctgttcgatcttgacgatcatgaggatgacaataaagcttttgagccacaggacagctcgccacaatcccaaagggaaatagagagaccttttgggacagcggtg

SEQ ID NO: 378034 - DNA, 140 bp, Artificial Sequence
  Synthetic
caccgctgtcccaaaaggtctctctatttccctttgggattgtggcgagctgtcctgtggctcaaaagctttattgtcatcctcatgatcgtcaagatcgaacaggaccaagtcacctgccatatcagcagccagggcct

SEQ ID NO: 378035 - DNA, 140 bp, Artificial Sequence
  Synthetic
atacgccatgctgggtctccgcctcagacaacaatcaacaatcagcagattctgaggaacaaggaggtcaatacaactggcaccgaggcccagaacgtacgaccgccaatcgaagactctcgtacttgggagtcggccat

SEQ ID NO: 378036 - DNA, 140 bp, Artificial Sequence
  Synthetic
atggccgactcccaagtacgagagtcttcgattggcggtcgtacgttctgggcctcggtgccagttgtattgacctccttgttcctcagaatctgctgattgttgattgttgtctgaggcggagacccagcatggcgtat

SEQ ID NO: 378037 - DNA, 140 bp, Artificial Sequence
  Synthetic
atacgccatgctgggtctcctcaagcttacctccgctggaatctgatgatgacgatgcatcaagtagccaacaagatcccgattatacagctgttgcccctcctgctcctgtataccgcacgtacttgggagtcggccat

SEQ ID NO: 378038 - DNA, 140 bp, Artificial Sequence
  Synthetic
atggccgactcccaagtacgtgcggtatacaggagcaggaggggcaacagctgtataatcgggatcttgttggctacttgatgcatcgtcatcatcagattccagcggaggtaagcttgaggagacccagcatggcgtat

SEQ ID NO: 378039 - DNA, 140 bp, Artificial Sequence
  Synthetic
aggccctggctgctgatatggtccacttcgtaaagctaaatacacttaagacttgaccgattcatctacaaaaactaatccattataacttattagtgctacttttctataagtgattctgaccttttgggacagcggtg

SEQ ID NO: 378040 - DNA, 140 bp, Artificial Sequence
  Synthetic
caccgctgtcccaaaaggtcagaatcacttatagaaaagtagcactaataagttataatggattagtttttgtagatgaatcggtcaagtcttaagtgtatttagctttacgaagtggaccatatcagcagccagggcct

SEQ ID NO: 378041 - DNA, 140 bp, Artificial Sequence
  Synthetic
aggccctggctgctgatatgaaattaagaaaaacatttgatgaagattaaaaccttcatcgccagtaaatgattatattgtctgtaggcaggtgtttactccaccttaaatttggaaatagaccttttgggacagcggtg

SEQ ID NO: 378042 - DNA, 140 bp, Artificial Sequence
  Synthetic
caccgctgtcccaaaaggtctatttccaaatttaaggtggagtaaacacctgcctacagacaatataatcatttactggcgatgaaggttttaatcttcatcaaatgtttttcttaatttcatatcagcagccagggcct

SEQ ID NO: 378043 - DNA, 140 bp, Artificial Sequence
  Synthetic
atacgccatgctgggtctccgaacatgtacaataataaattgaaggtatgttcaggcccagaaacgactggatggatttctgagcaacttatgacaggtaagattccagtaactgatatacgtacttgggagtcggccat

SEQ ID NO: 378044 - DNA, 140 bp, Artificial Sequence
  Synthetic
atggccgactcccaagtacgtatatcagttactggaatcttacctgtcataagttgctcagaaatccatccagtcgtttctgggcctgaacataccttcaatttattattgtacatgttcggagacccagcatggcgtat

SEQ ID NO: 378045 - DNA, 140 bp, Artificial Sequence
  Synthetic
aggccctggctgctgatatgcctcagcacacttgagagtagcttaaagccaatccaagacatgggtaaagtgatttcatcattgaatcgcagttgtgccgaaatggttgcaaaatatgatgaccttttgggacagcggtg

SEQ ID NO: 378046 - DNA, 140 bp, Artificial Sequence
  Synthetic
caccgctgtcccaaaaggtcatcatattttgcaaccatttcggcacaactgcgattcaatgatgaaatcactttacccatgtcttggattggctttaagctactctcaagtgtgctgaggcatatcagcagccagggcct

SEQ ID NO: 378047 - DNA, 140 bp, Artificial Sequence
  Synthetic
atacgccatgctgggtctcctcatgtatgatcatctacctggttttgggactgcctttcaccaacttgttcaagtgatttgtaaaataggaaaggataacaaccttttggacacaatccacgtacttgggagtcggccat

SEQ ID NO: 378048 - DNA, 140 bp, Artificial Sequence
  Synthetic
atggccgactcccaagtacgtggattgtgtccaaaaggttgttatcctttcctattttacaaatcacttgaacaagttggtgaaaggcagtcccaaaaccaggtagatgatcatacatgaggagacccagcatggcgtat

SEQ ID NO: 378049 - DNA, 140 bp, Artificial Sequence
  Synthetic
atacgccatgctgggtctcctctccgaccagcaccaccatcacccaaaattgatcgtggttgggtttgtttgtttaagatgcaagatggtaaaacgcttggacttaagatctaagaatcacgtacttgggagtcggccat

SEQ ID NO: 378050 - DNA, 140 bp, Artificial Sequence
  Synthetic
atggccgactcccaagtacgtgattcttagatcttaagtccaagcgttttaccatcttgcatcttaaacaaacaaacccaaccacgatcaattttgggtgatggtggtgctggtcggagaggagacccagcatggcgtat

SEQ ID NO: 378051 - DNA, 140 bp, Artificial Sequence
  Synthetic
atacgccatgctgggtctccagatttatttaacaaggcaagccacaaccttagatggaacctcagccagactattgaactattgacgctgttgatgataatatataattaatggtcttatcgtacttgggagtcggccat

SEQ ID NO: 378052 - DNA, 140 bp, Artificial Sequence
  Synthetic
atggccgactcccaagtacgataagaccattaattatatattatcatcaacagcgtcaatagttcaatagtctggctgaggttccatctaaggttgtggcttgccttgttaaataaatctggagacccagcatggcgtat

SEQ ID NO: 378053 - DNA, 140 bp, Artificial Sequence
  Synthetic
atacgccatgctgggtctccttgaatatgacaacatcttgcttcttgttctgccttgtagctctttgaattggaagatcattccaaacttacaaacatgcacaagatgttatggtttagccgtacttgggagtcggccat

SEQ ID NO: 378054 - DNA, 140 bp, Artificial Sequence
  Synthetic
atggccgactcccaagtacggctaaaccataacatcttgtgcatgtttgtaagtttggaatgatcttccaattcaaagagctacaaggcagaacaagaagcaagatgttgtcatattcaaggagacccagcatggcgtat

SEQ ID NO: 378055 - DNA, 140 bp, Artificial Sequence
  Synthetic
atacgccatgctgggtctccctcccaacccgaccaagtgtcatagtcaatgagaccaaatcagatgtactggcagtgccaggggcagatgttccatcaaactccatgagaccagtggctgcgtacttgggagtcggccat

SEQ ID NO: 378056 - DNA, 140 bp, Artificial Sequence
  Synthetic
atggccgactcccaagtacgcagccactggtctcatggagtttgatggaacatctgcccctggcactgccagtacatctgatttggtctcattgactatgacacttggtcgggttgggagggagacccagcatggcgtat

SEQ ID NO: 378057 - DNA, 140 bp, Artificial Sequence
  Synthetic
aggccctggctgctgatatgggcagtgccaggggcagatgttccatcaaactccatgagaccagtggctgatgataacattgatcactcaagccatactccaagcggagtagcttctgccgaccttttgggacagcggtg

SEQ ID NO: 378058 - DNA, 140 bp, Artificial Sequence
  Synthetic
caccgctgtcccaaaaggtcggcagaagctactccgcttggagtatggcttgagtgatcaatgttatcatcagccactggtctcatggagtttgatggaacatctgcccctggcactgcccatatcagcagccagggcct

SEQ ID NO: 378059 - DNA, 140 bp, Artificial Sequence
  Synthetic
atacgccatgctgggtctcctttatattggaagctacagtgaatgtaatttcgggaacaaaagtcctgatgaagcaaatacctatttggcttccactgggtgtagctgatcagaagatatcgtacttgggagtcggccat

SEQ ID NO: 378060 - DNA, 140 bp, Artificial Sequence
  Synthetic
atggccgactcccaagtacgatatcttctgatcagctacacccagtggaagccaaataggtatttgcttcatcaggacttttgttcccgaaattacattcactgtagcttccaatataaaggagacccagcatggcgtat

SEQ ID NO: 378061 - DNA, 140 bp, Artificial Sequence
  Synthetic
atacgccatgctgggtctccaacctggacagacgaaactccagcaggagcagtcaatgctcttcgtcctgggctctcactccatcccaagcttcgtccaattctcctgccggggaagacacgtacttgggagtcggccat

SEQ ID NO: 378062 - DNA, 140 bp, Artificial Sequence
  Synthetic
atggccgactcccaagtacgtgtcttccccggcaggagaattggacgaagcttgggatggagtgagagcccaggacgaagagcattgactgctcctgctggagtttcgtctgtccaggttggagacccagcatggcgtat

SEQ ID NO: 378063 - DNA, 140 bp, Artificial Sequence
  Synthetic
atacgccatgctgggtctccaatcatgaatgcaataccggacctcaaaattgtcccgattgatccaaccaagaacatagttggaattgaggttccagaattactagttcaaaggctgacccgtacttgggagtcggccat

SEQ ID NO: 378064 - DNA, 140 bp, Artificial Sequence
  Synthetic
atggccgactcccaagtacgggtcagcctttgaactagtaattctggaacctcaattccaactatgttcttggttggatcaatcgggacaattttgaggtccggtattgcattcatgattggagacccagcatggcgtat

SEQ ID NO: 378065 - DNA, 140 bp, Artificial Sequence
  Synthetic
atacgccatgctgggtctcctagataactaatattaaggagttttttaatctaattttccagtcttgagtaataatcatttcttttgtaattaattatgcatttgttaacttatcggtgccgtacttgggagtcggccat

SEQ ID NO: 378066 - DNA, 140 bp, Artificial Sequence
  Synthetic
atggccgactcccaagtacggcaccgataagttaacaaatgcataattaattacaaaagaaatgattattactcaagactggaaaattagattaaaaaactccttaatattagttatctaggagacccagcatggcgtat

SEQ ID NO: 378067 - DNA, 140 bp, Artificial Sequence
  Synthetic
aggccctggctgctgatatgggggatttcgttcaggtgtgcctcccaaggtggtcagctatgaagccggagaatgggcagaaaattgctacaatctggagatcaaaaagtcagacggaaggaccttttgggacagcggtg

SEQ ID NO: 378068 - DNA, 140 bp, Artificial Sequence
  Synthetic
caccgctgtcccaaaaggtccttccgtctgactttttgatctccagattgtagcaattttctgcccattctccggcttcatagctgaccaccttgggaggcacacctgaacgaaatcccccatatcagcagccagggcct

SEQ ID NO: 378069 - DNA, 140 bp, Artificial Sequence
  Synthetic
aggccctggctgctgatatgttccataaaaatggggcttttttcttgtatgatagattggcctcaactgtcatctaccgagggacaacttttgctgaaggtgtcgtagcttttttaattcgaccttttgggacagcggtg

SEQ ID NO: 378070 - DNA, 140 bp, Artificial Sequence
  Synthetic
caccgctgtcccaaaaggtcgaattaaaaaagctacgacaccttcagcaaaagttgtccctcggtagatgacagttgaggccaatctatcatacaagaaaaaagccccatttttatggaacatatcagcagccagggcct

SEQ ID NO: 378071 - DNA, 140 bp, Artificial Sequence
  Synthetic
atacgccatgctgggtctcctgctcactgcaggacggacagaggaaatgtcgacccaaggtctaaccaacggagagacaatcacaggtttcaccgcgaacccaatgacaaccaccattgccgtacttgggagtcggccat

SEQ ID NO: 378072 - DNA, 140 bp, Artificial Sequence
  Synthetic
atggccgactcccaagtacggcaatggtggttgtcattgggttcgcggtgaaacctgtgattgtctctccgttggttagaccttgggtcgacatttcctctgtccgtcctgcagtgagcaggagacccagcatggcgtat

SEQ ID NO: 378073 - DNA, 140 bp, Artificial Sequence
  Synthetic
aggccctggctgctgatatggagacaatttaccactccgagatggatccgatccaaggctcgaacaactccgcccagagcccacagaccaagaccacgccagcacccacaacatccccgagaccttttgggacagcggtg

SEQ ID NO: 378074 - DNA, 140 bp, Artificial Sequence
  Synthetic
caccgctgtcccaaaaggtctcggggatgttgtgggtgctggcgtggtcttggtctgtgggctctgggcggagttgttcgagccttggatcggatccatctcggagtggtaaattgtctccatatcagcagccagggcct

SEQ ID NO: 378075 - DNA, 140 bp, Artificial Sequence
  Synthetic
aggccctggctgctgatatgtgtatatgtaagattttgtgttgatttattctgagatctgagagagaaaaatctcagggttactctaaggagaaatattatttttaaaatttacttgaatgaccttttgggacagcggtg

SEQ ID NO: 378076 - DNA, 140 bp, Artificial Sequence
  Synthetic
caccgctgtcccaaaaggtcattcaagtaaattttaaaaataatatttctccttagagtaaccctgagatttttctctctcagatctcagaataaatcaacacaaaatcttacatatacacatatcagcagccagggcct

SEQ ID NO: 378077 - DNA, 140 bp, Artificial Sequence
  Synthetic
aggccctggctgctgatatgctccagagattgtaggtagaaaggaccaacatttataggtaggggtcagaaagcaacaataaccataaaaggagagcctgacattgctatttaatatcctgaccttttgggacagcggtg

SEQ ID NO: 378078 - DNA, 140 bp, Artificial Sequence
  Synthetic
caccgctgtcccaaaaggtcaggatattaaatagcaatgtcaggctctccttttatggttattgttgctttctgacccctacctataaatgttggtcctttctacctacaatctctggagcatatcagcagccagggcct

SEQ ID NO: 378079 - DNA, 140 bp, Artificial Sequence
  Synthetic
atacgccatgctgggtctcctgattctgtattagaggtctaccaaagactccacagtgataaaggagggaattttgaggctgccctgtggcaacaatgggaccgacagtcattaataatgcgtacttgggagtcggccat

SEQ ID NO: 378080 - DNA, 140 bp, Artificial Sequence
  Synthetic
atggccgactcccaagtacgcattattaatgactgtcggtcccattgttgccacagggcagcctcaaaattccctcctttatcactgtggagtctttggtagacctctaatacagaatcaggagacccagcatggcgtat

SEQ ID NO: 378081 - DNA, 140 bp, Artificial Sequence
  Synthetic
atacgccatgctgggtctccttcatctctgcttttctcaacattgctctccagataccttgtgaaagttctagtgtcgtagtctcaggtcttgccacattgtacccagcacaagacaattcgtacttgggagtcggccat

SEQ ID NO: 378082 - DNA, 140 bp, Artificial Sequence
  Synthetic
atggccgactcccaagtacgaattgtcttgtgctgggtacaatgtggcaagacctgagactacgacactagaactttcacaaggtatctggagagcaatgttgagaaaagcagagatgaaggagacccagcatggcgtat

SEQ ID NO: 378083 - DNA, 140 bp, Artificial Sequence
  Synthetic
atacgccatgctgggtctccgtaataatgattcttaaaacaatctactatcgcaattatcgatggatctaccctatttgacggtacatgacttgaatgtaataaggtaagttggtatctgcgtacttgggagtcggccat

SEQ ID NO: 378084 - DNA, 140 bp, Artificial Sequence
  Synthetic
atggccgactcccaagtacgcagataccaacttaccttattacattcaagtcatgtaccgtcaaatagggtagatccatcgataattgcgatagtagattgttttaagaatcattattacggagacccagcatggcgtat

SEQ ID NO: 378085 - DNA, 140 bp, Artificial Sequence
  Synthetic
atacgccatgctgggtctccatagcaaagttaaattctcctaacctcatattttgatcaagtaatcatgattttatgataattcttttcagattatcggtttaatctttattaagaaaaacgtacttgggagtcggccat

SEQ ID NO: 378086 - DNA, 140 bp, Artificial Sequence
  Synthetic
atggccgactcccaagtacgtttttcttaataaagattaaaccgataatctgaaaagaattatcataaaatcatgattacttgatcaaaatatgaggttaggagaatttaactttgctatggagacccagcatggcgtat

SEQ ID NO: 378087 - DNA, 140 bp, Artificial Sequence
  Synthetic
atacgccatgctgggtctcccagttcgtaagttcttttatagaagtcattagcttctaaggtgattatattttagtattaaattttgctaattgcttgctataaagttgaaatgtctaatcgtacttgggagtcggccat

SEQ ID NO: 378088 - DNA, 140 bp, Artificial Sequence
  Synthetic
atggccgactcccaagtacgattagacatttcaactttatagcaagcaattagcaaaatttaatactaaaatataatcaccttagaagctaatgacttctataaaagaacttacgaactgggagacccagcatggcgtat

SEQ ID NO: 378089 - DNA, 140 bp, Artificial Sequence
  Synthetic
atacgccatgctgggtctccggtcccagagagtcccaacaggttggcataaggtcattaacaccagcatagtcggctcgaccaagactgtaagcgagtcgatttcaactaaaaagattatcgtacttgggagtcggccat

SEQ ID NO: 378090 - DNA, 140 bp, Artificial Sequence
  Synthetic
atggccgactcccaagtacgataatctttttagttgaaatcgactcgcttacagtcttggtcgagccgactatgctggtgttaatgaccttatgccaacctgttgggactctctgggaccggagacccagcatggcgtat

SEQ ID NO: 378091 - DNA, 140 bp, Artificial Sequence
  Synthetic
aggccctggctgctgatatgcaatttaacaaggtaatcttaaaataagtacatgaatgagaattagttgtgggtcttatctagcattgttgagttaactatctaatctattttcgctaatgaccttttgggacagcggtg

SEQ ID NO: 378092 - DNA, 140 bp, Artificial Sequence
  Synthetic
caccgctgtcccaaaaggtcattagcgaaaatagattagatagttaactcaacaatgctagataagacccacaactaattctcattcatgtacttattttaagattaccttgttaaattgcatatcagcagccagggcct

SEQ ID NO: 378093 - DNA, 140 bp, Artificial Sequence
  Synthetic
atacgccatgctgggtctccatgaattgtgcagatttaaacttgggttttgccttatgcttcataggtggtctttttgaaatggagattatcagcatttcttaaatgggaggagttagcacgtacttgggagtcggccat

SEQ ID NO: 378094 - DNA, 140 bp, Artificial Sequence
  Synthetic
atggccgactcccaagtacgtgctaactcctcccatttaagaaatgctgataatctccatttcaaaaagaccacctatgaagcataaggcaaaacccaagtttaaatctgcacaattcatggagacccagcatggcgtat

SEQ ID NO: 378095 - DNA, 140 bp, Artificial Sequence
  Synthetic
aggccctggctgctgatatgtctttttgaaatggagattatcagcatttcttaaatgggaggagttagcaatcagaaattggagataaatggacatcgggatagaacaatgcctaactatgaccttttgggacagcggtg

SEQ ID NO: 378096 - DNA, 140 bp, Artificial Sequence
  Synthetic
caccgctgtcccaaaaggtcatagttaggcattgttctatcccgatgtccatttatctccaatttctgattgctaactcctcccatttaagaaatgctgataatctccatttcaaaaagacatatcagcagccagggcct

SEQ ID NO: 378097 - DNA, 140 bp, Artificial Sequence
  Synthetic
atacgccatgctgggtctcctgcttatattggtgtaactttattttaataacatgtcaatgctatactgttaagagaaggtctgaggaagattaagaaaaaggcctcgtgttcacttggtcgtacttgggagtcggccat

SEQ ID NO: 378098 - DNA, 140 bp, Artificial Sequence
  Synthetic
atggccgactcccaagtacgaccaagtgaacacgaggcctttttcttaatcttcctcagaccttctcttaacagtatagcattgacatgttattaaaataaagttacaccaatataagcaggagacccagcatggcgtat

SEQ ID NO: 378099 - DNA, 140 bp, Artificial Sequence
  Synthetic
aggccctggctgctgatatggtagcaacactgccgatagactatttagtaccaattctcctgcgttccctaacggggcacggtgataggccattgaccccgacttgcaatcaattccttggaccttttgggacagcggtg

SEQ ID NO: 378100 - DNA, 140 bp, Artificial Sequence
  Synthetic
caccgctgtcccaaaaggtccaaggaattgattgcaagtcggggtcaatggcctatcaccgtgccccgttagggaacgcaggagaattggtactaaatagtctatcggcagtgttgctaccatatcagcagccagggcct

SEQ ID NO: 378101 - DNA, 140 bp, Artificial Sequence
  Synthetic
atacgccatgctgggtctccctatagacggggtcccacacgcagcaactgactggtatcaaccgactctttttaaagaatccatcctagggcatagccaaatcctatctgtgtcaacagccgtacttgggagtcggccat

SEQ ID NO: 378102 - DNA, 140 bp, Artificial Sequence
  Synthetic
atggccgactcccaagtacggctgttgacacagataggatttggctatgccctaggatggattctttaaaaagagtcggttgataccagtcagttgctgcgtgtgggaccccgtctatagggagacccagcatggcgtat

SEQ ID NO: 378103 - DNA, 140 bp, Artificial Sequence
  Synthetic
aggccctggctgctgatatggaacaatttctagaacaagaggatttttcaatcgaaagtgtcctgaattatgcacaggaattacattatttattaccacagaataggaatttttccttttgaccttttgggacagcggtg

SEQ ID NO: 378104 - DNA, 140 bp, Artificial Sequence
  Synthetic
caccgctgtcccaaaaggtcaaaaggaaaaattcctattctgtggtaataaataatgtaattcctgtgcataattcaggacactttcgattgaaaaatcctcttgttctagaaattgttccatatcagcagccagggcct

SEQ ID NO: 378105 - DNA, 140 bp, Artificial Sequence
  Synthetic
aggccctggctgctgatatgtatctcacacggaatgtccaaactttatgtgaggctctgttagcagatggactggccaaggccttccccagtaacatgatggtagtaactgaacgtgaacgaccttttgggacagcggtg

SEQ ID NO: 378106 - DNA, 140 bp, Artificial Sequence
  Synthetic
caccgctgtcccaaaaggtcgttcacgttcagttactaccatcatgttactggggaaggccttggccagtccatctgctaacagagcctcacataaagtttggacattccgtgtgagatacatatcagcagccagggcct

SEQ ID NO: 378107 - DNA, 140 bp, Artificial Sequence
  Synthetic
aggccctggctgctgatatgtcggaaaaaaacaatatctcaatggtgtacaattaccgcaatcactcaaaacagcagcaagaatggcaccactctctgatgctatattcgatgatctacagaccttttgggacagcggtg

SEQ ID NO: 378108 - DNA, 140 bp, Artificial Sequence
  Synthetic
caccgctgtcccaaaaggtctgtagatcatcgaatatagcatcagagagtggtgccattcttgctgctgttttgagtgattgcggtaattgtacaccattgagatattgtttttttccgacatatcagcagccagggcct

SEQ ID NO: 378109 - DNA, 140 bp, Artificial Sequence
  Synthetic
atacgccatgctgggtctcctggtcacacatcttagagggtagatcattgatcggagcgacattaccatgtatggtggagcaattcaaagttaagtggctaggacaatatgaaccttgtccgtacttgggagtcggccat

SEQ ID NO: 378110 - DNA, 140 bp, Artificial Sequence
  Synthetic
atggccgactcccaagtacggacaaggttcatattgtcctagccacttaactttgaattgctccaccatacatggtaatgtcgctccgatcaatgatctaccctctaagatgtgtgaccaggagacccagcatggcgtat

SEQ ID NO: 378111 - DNA, 140 bp, Artificial Sequence
  Synthetic
atacgccatgctgggtctccctaaagaggtcccggcccagtatttgacatatacaagtgcacttaatctggatttaagccgttatcgtgataatgaactaatatatgactcaaatccactcgtacttgggagtcggccat

SEQ ID NO: 378112 - DNA, 140 bp, Artificial Sequence
  Synthetic
atggccgactcccaagtacgagtggatttgagtcatatattagttcattatcacgataacggcttaaatccagattaagtgcacttgtatatgtcaaatactgggccgggacctctttagggagacccagcatggcgtat

SEQ ID NO: 378113 - DNA, 140 bp, Artificial Sequence
  Synthetic
atacgccatgctgggtctccgcagtattatgcttttatctaggcaatactatcctatggactaaaaaacttgattacgaacagtttctatattatttgcataaccagctgcacaacttaccgtacttgggagtcggccat

SEQ ID NO: 378114 - DNA, 140 bp, Artificial Sequence
  Synthetic
atggccgactcccaagtacggtaagttgtgcagctggttatgcaaataatatagaaactgttcgtaatcaagttttttagtccataggatagtattgcctagataaaagcataatactgcggagacccagcatggcgtat

SEQ ID NO: 378115 - DNA, 140 bp, Artificial Sequence
  Synthetic
atacgccatgctgggtctccctcaagaccataatgatttctcaagaggggatggaacacttacagaacccgtgcgtaagttttcaagcaatcatcagtcagatgaaaagtactacaatgtcgtacttgggagtcggccat

SEQ ID NO: 378116 - DNA, 140 bp, Artificial Sequence
  Synthetic
atggccgactcccaagtacgacattgtagtacttttcatctgactgatgattgcttgaaaacttacgcacgggttctgtaagtgttccatcccctcttgagaaatcattatggtcttgagggagacccagcatggcgtat

SEQ ID NO: 378117 - DNA, 140 bp, Artificial Sequence
  Synthetic
aggccctggctgctgatatgattgtagattcacagggattgtctcatccatgcattacaaattggacgaagttcttctagaatacaatagtttcgattcagctatcacattagctgaagggaccttttgggacagcggtg

SEQ ID NO: 378118 - DNA, 140 bp, Artificial Sequence
  Synthetic
caccgctgtcccaaaaggtcccttcagctaatgtgatagctgaatcgaaactattgtattctagaagaacttcgtccaatttgtaatgcatggatgagacaatccctgtgaatctacaatcatatcagcagccagggcct

SEQ ID NO: 378119 - DNA, 140 bp, Artificial Sequence
  Synthetic
aggccctggctgctgatatgcgattctaagtatatcggaagagagtatgccaatcttaattgttagaggtaacaagctattagttattacttattgataagaatacactttatcatagcggaccttttgggacagcggtg

SEQ ID NO: 378120 - DNA, 140 bp, Artificial Sequence
  Synthetic
caccgctgtcccaaaaggtccgctatgataaagtgtattcttatcaataagtaataactaatagcttgttacctctaacaattaagattggcatactctcttccgatatacttagaatcgcatatcagcagccagggcct

SEQ ID NO: 378121 - DNA, 140 bp, Artificial Sequence
  Synthetic
atacgccatgctgggtctcctaactagctttagtagttaagatcaaatgcaaacattataagaatgttaagcgcacacaaaaacattataaaaaaccaattttttcctttttgtgtgtcccgtacttgggagtcggccat

SEQ ID NO: 378122 - DNA, 140 bp, Artificial Sequence
  Synthetic
atggccgactcccaagtacgggacacacaaaaaggaaaaaattggttttttataatgtttttgtgtgcgcttaacattcttataatgtttgcatttgatcttaactactaaagctagttaggagacccagcatggcgtat

SEQ ID NO: 378123 - DNA, 140 bp, Artificial Sequence
  Synthetic
atacgccatgctgggtctccacacacttcgggaagatatctaacccgctggtacgtgtcaacaggctaggcccaggaatacccgatcatccgttccggctcctgaggttgggcaaaaaagcgtacttgggagtcggccat

SEQ ID NO: 378124 - DNA, 140 bp, Artificial Sequence
  Synthetic
atggccgactcccaagtacgcttttttgcccaacctcaggagccggaacggatgatcgggtattcctgggcctagcctgttgacacgtaccagcgggttagatatcttcccgaagtgtgtggagacccagcatggcgtat

SEQ ID NO: 378125 - DNA, 140 bp, Artificial Sequence
  Synthetic
aggccctggctgctgatatgtcaggtttttctactccgagaatgttgttaccaataatgcaaaaggttcatgaaggacaagtcactgttatcttaaataattcatcaagtcacataactggaccttttgggacagcggtg

SEQ ID NO: 378126 - DNA, 140 bp, Artificial Sequence
  Synthetic
caccgctgtcccaaaaggtccagttatgtgacttgatgaattatttaagataacagtgacttgtccttcatgaaccttttgcattattggtaacaacattctcggagtagaaaaacctgacatatcagcagccagggcct

SEQ ID NO: 378127 - DNA, 140 bp, Artificial Sequence
  Synthetic
atacgccatgctgggtctcccggacacacaaaaagaaaaaagattttttaagactttttgtgtgcgagtaactatgaggaagattaacagttttcctcagtttaagatatacactgaaatcgtacttgggagtcggccat

SEQ ID NO: 378128 - DNA, 140 bp, Artificial Sequence
  Synthetic
atggccgactcccaagtacgatttcagtgtatatcttaaactgaggaaaactgttaatcttcctcatagttactcgcacacaaaaagtcttaaaaaatcttttttctttttgtgtgtccgggagacccagcatggcgtat

SEQ ID NO: 378129 - DNA, 140 bp, Artificial Sequence
  Synthetic
atacgccatgctgggtctcccaattgaatcagttttatctattaccaattaccatcaacaaggtatatctagtgatcttgggactcttcttcatctggtttttcctagagctctgaatcccgtacttgggagtcggccat

SEQ ID NO: 378130 - DNA, 140 bp, Artificial Sequence
  Synthetic
atggccgactcccaagtacgggattcagagctctaggaaaaaccagatgaagaagagtcccaagatcactagatataccttgttgatggtaattggtaatagataaaactgattcaattgggagacccagcatggcgtat

SEQ ID NO: 378131 - DNA, 140 bp, Artificial Sequence
  Synthetic
aggccctggctgctgatatggcaggtgacttggtcctgttcgatcttgacgatcatgaggatgacaataaagcttttgagccacaggacagctcaccacaatcccaaaggggaatagagagaccttttgggacagcggtg

SEQ ID NO: 378132 - DNA, 140 bp, Artificial Sequence
  Synthetic
caccgctgtcccaaaaggtctctctattcccctttgggattgtggtgagctgtcctgtggctcaaaagctttattgtcatcctcatgatcgtcaagatcgaacaggaccaagtcacctgccatatcagcagccagggcct

SEQ ID NO: 378133 - DNA, 140 bp, Artificial Sequence
  Synthetic
atacgccatgctgggtctccgcttcagacaacaatcaacaatcagcagattctgaggaacaagaagatcgatacaacaggcaccgaggcccagaacgtacgaccgccaatcgaagactctcgtacttgggagtcggccat

SEQ ID NO: 378134 - DNA, 140 bp, Artificial Sequence
  Synthetic
atggccgactcccaagtacgagagtcttcgattggcggtcgtacgttctgggcctcggtgcctgttgtatcgatcttcttgttcctcagaatctgctgattgttgattgttgtctgaagcggagacccagcatggcgtat

SEQ ID NO: 378135 - DNA, 140 bp, Artificial Sequence
  Synthetic
aggccctggctgctgatatgatacaacaggcaccgaggcccagaacgtacgaccgccaatcgaagactctcaccagtgtacgaggaggacacccttatagatcaaggcgatgatgatcccgaccttttgggacagcggtg

SEQ ID NO: 378136 - DNA, 140 bp, Artificial Sequence
  Synthetic
caccgctgtcccaaaaggtcgggatcatcatcgccttgatctataagggtgtcctcctcgtacactggtgagagtcttcgattggcggtcgtacgttctgggcctcggtgcctgttgtatcatatcagcagccagggcct

SEQ ID NO: 378137 - DNA, 140 bp, Artificial Sequence
  Synthetic
atacgccatgctgggtctccaagtttcttgcaatcttgcagcaccatcagtaaccacagcacaaagcgcggtccacttcgtaaagctaaatacacttaagacttgaccaattcatctacacgtacttgggagtcggccat

SEQ ID NO: 378138 - DNA, 140 bp, Artificial Sequence
  Synthetic
atggccgactcccaagtacgtgtagatgaattggtcaagtcttaagtgtatttagctttacgaagtggaccgcgctttgtgctgtggttactgatggtgctgcaagattgcaagaaacttggagacccagcatggcgtat

SEQ ID NO: 378139 - DNA, 140 bp, Artificial Sequence
  Synthetic
aggccctggctgctgatatggtccacttcgtaaagctaaatacacttaagacttgaccaattcatctacaaaaactaatccattataactgattagtgctacttttctataagtgattctgaccttttgggacagcggtg

SEQ ID NO: 378140 - DNA, 140 bp, Artificial Sequence
  Synthetic
caccgctgtcccaaaaggtcagaatcacttatagaaaagtagcactaatcagttataatggattagtttttgtagatgaattggtcaagtcttaagtgtatttagctttacgaagtggaccatatcagcagccagggcct

SEQ ID NO: 378141 - DNA, 140 bp, Artificial Sequence
  Synthetic
atacgccatgctgggtctccgtttatccaagatgtggctcaatgttcttaatttgaacatagttataaggggataaataatactttatatttctgattgtggattgacccattctgcttacgtacttgggagtcggccat

SEQ ID NO: 378142 - DNA, 140 bp, Artificial Sequence
  Synthetic
atggccgactcccaagtacgtaagcagaatgggtcaatccacaatcagaaatataaagtattatttatccccttataactatgttcaaattaagaacattgagccacatcttggataaacggagacccagcatggcgtat

SEQ ID NO: 378143 - DNA, 140 bp, Artificial Sequence
  Synthetic
aggccctggctgctgatatgggataaataatactttatatttctgattgtggattgacccattctgcttaaaatgctttgcccgttaaaaatgtgatctaatagatagccctgactagcagaccttttgggacagcggtg

SEQ ID NO: 378144 - DNA, 140 bp, Artificial Sequence
  Synthetic
caccgctgtcccaaaaggtctgctagtcagggctatctattagatcacatttttaacgggcaaagcattttaagcagaatgggtcaatccacaatcagaaatataaagtattatttatcccatatcagcagccagggcct

SEQ ID NO: 378145 - DNA, 140 bp, Artificial Sequence
  Synthetic
atacgccatgctgggtctccgatcatattgtctgtagacaggtgtttactccacctcaaagtcggaaatatcctaccttaggaccattgtcaagaggtgcataggcattaccatccttgacgtacttgggagtcggccat

SEQ ID NO: 378146 - DNA, 140 bp, Artificial Sequence
  Synthetic
atggccgactcccaagtacgtcaaggatggtaatgcctatgcacctcttgacaatggtcctaaggtaggatatttccgactttgaggtggagtaaacacctgtctacagacaatatgatcggagacccagcatggcgtat

SEQ ID NO: 378147 - DNA, 140 bp, Artificial Sequence
  Synthetic
atacgccatgctgggtctccagatttatttaacaaggcaagccacaaccttagacggaacctcagccagaccattgaactattaacgctgttgatgataatatataattaatggtcatatcgtacttgggagtcggccat

SEQ ID NO: 378148 - DNA, 140 bp, Artificial Sequence
  Synthetic
atggccgactcccaagtacgatatgaccattaattatatattatcatcaacagcgttaatagttcaatggtctggctgaggttccgtctaaggttgtggcttgccttgttaaataaatctggagacccagcatggcgtat

SEQ ID NO: 378149 - DNA, 140 bp, Artificial Sequence
  Synthetic
atacgccatgctgggtctcccatcttctaaagtgagatactttatcatcaaaaaatgaggcgcggagtgttaccaacggctcccccagcatataatgatattacataccctatgagcatacgtacttgggagtcggccat

SEQ ID NO: 378150 - DNA, 140 bp, Artificial Sequence
  Synthetic
atggccgactcccaagtacgtatgctcatagggtatgtaatatcattatatgctgggggagccgttggtaacactccgcgcctcattttttgatgataaagtatctcactttagaagatgggagacccagcatggcgtat

SEQ ID NO: 378151 - DNA, 140 bp, Artificial Sequence
  Synthetic
atacgccatgctgggtctccaacctggacagacgaaactccagcaggagcagtcaatgttcttcgtcctgggctttcactccatcccaagcttcgtccaattcttctgccggggaagacacgtacttgggagtcggccat

SEQ ID NO: 378152 - DNA, 140 bp, Artificial Sequence
  Synthetic
atggccgactcccaagtacgtgtcttccccggcagaagaattggacgaagcttgggatggagtgaaagcccaggacgaagaacattgactgctcctgctggagtttcgtctgtccaggttggagacccagcatggcgtat

SEQ ID NO: 378153 - DNA, 140 bp, Artificial Sequence
  Synthetic
atacgccatgctgggtctccggcaaaaaaccacaacccaaaagtggccaaccaattattccagttcttcttccgaaatatgttggacttgatcctatatcgccaggggacttaaccatggcgtacttgggagtcggccat

SEQ ID NO: 378154 - DNA, 140 bp, Artificial Sequence
  Synthetic
atggccgactcccaagtacgccatggttaagtcccctggcgatataggatcaagtccaacatatttcggaagaagaactggaataattggttggccacttttgggttgtggttttttgccggagacccagcatggcgtat

SEQ ID NO: 378155 - DNA, 140 bp, Artificial Sequence
  Synthetic
aggccctggctgctgatatgttattctgctagtaattccgacgggatcaatagactaaaaatctgattgtgtaaaattataaaagaatcaagcagaggcaacagacccacagcttaagccgaccttttgggacagcggtg

SEQ ID NO: 378156 - DNA, 140 bp, Artificial Sequence
  Synthetic
caccgctgtcccaaaaggtcggcttaagctgtgggtctgttgcctctgcttgattcttttataattttacacaatcagatttttagtctattgatcccgtcggaattactagcagaataacatatcagcagccagggcct

SEQ ID NO: 378157 - DNA, 140 bp, Artificial Sequence
  Synthetic
atacgccatgctgggtctccaataatcatttcttttgtaattaattatgaatttgttagcttatcggtgcgagattcccttgagaacccggcggagcttctactatctgcagtaaccagacgtacttgggagtcggccat

SEQ ID NO: 378158 - DNA, 140 bp, Artificial Sequence
  Synthetic
atggccgactcccaagtacgtctggttactgcagatagtagaagctccgccgggttctcaagggaatctcgcaccgataagctaacaaattcataattaattacaaaagaaatgattattggagacccagcatggcgtat

SEQ ID NO: 378159 - DNA, 140 bp, Artificial Sequence
  Synthetic
aggccctggctgctgatatggagattcccttgagaacccggcggagcttctactatctgcagtaaccagaggagaagttcaacctagtcaaaactaaaccaagcaatattctggatgctcgaccttttgggacagcggtg

SEQ ID NO: 378160 - DNA, 140 bp, Artificial Sequence
  Synthetic
caccgctgtcccaaaaggtcgagcatccagaatattgcttggtttagttttgactaggttgaacttctcctctggttactgcagatagtagaagctccgccgggttctcaagggaatctccatatcagcagccagggcct

SEQ ID NO: 378161 - DNA, 140 bp, Artificial Sequence
  Synthetic
atacgccatgctgggtctcccgttaacaatcgctagtgattttaatcttcagattaagaaaaagatatacgatgaagattaaggcgacaacgagccgaaacttcatctcttttaaatatccgtacttgggagtcggccat

SEQ ID NO: 378162 - DNA, 140 bp, Artificial Sequence
  Synthetic
atggccgactcccaagtacggatatttaaaagagatgaagtttcggctcgttgtcgccttaatcttcatcgtatatctttttcttaatctgaagattaaaatcactagcgattgttaacgggagacccagcatggcgtat

SEQ ID NO: 378163 - DNA, 140 bp, Artificial Sequence
  Synthetic
atacgccatgctgggtctcctaacattacccgttccaaagtcatacaaggacacattcaaatcagggattgtaagctgctatttcttacctccccaaattacctatacaacatggggtcacgtacttgggagtcggccat

SEQ ID NO: 378164 - DNA, 140 bp, Artificial Sequence
  Synthetic
atggccgactcccaagtacgtgaccccatgttgtataggtaatttggggaggtaagaaatagcagcttacaatccctgatttgaatgtgtccttgtatgactttggaacgggtaatgttaggagacccagcatggcgtat

SEQ ID NO: 378165 - DNA, 140 bp, Artificial Sequence
  Synthetic
aggccctggctgctgatatggagaaaaattgcatttccaaattctatcaacccacaccaacaactcctcagatcagagcccagcgggaactgtccaaggaaaaattggcttccacccaccgaccttttgggacagcggtg

SEQ ID NO: 378166 - DNA, 140 bp, Artificial Sequence
  Synthetic
caccgctgtcccaaaaggtcggtgggtggaagccaatttttccttggacagttcccgctgggctctgatctgaggagttgttggtgtgggttgatagaatttggaaatgcaatttttctccatatcagcagccagggcct

SEQ ID NO: 378167 - DNA, 140 bp, Artificial Sequence
  Synthetic
atacgccatgctgggtctccgggacaatcaaccgccccgagatgaatccgacccaaggaccgaacaactccgcccagagcccacagaccaagaccacgccagcacccacagcatccccgacgtacttgggagtcggccat

SEQ ID NO: 378168 - DNA, 140 bp, Artificial Sequence
  Synthetic
atggccgactcccaagtacgtcggggatgctgtgggtgctggcgtggtcttggtctgtgggctctgggcggagttgttcggtccttgggtcggattcatctcggggcggttgattgtcccggagacccagcatggcgtat

SEQ ID NO: 378169 - DNA, 140 bp, Artificial Sequence
  Synthetic
atacgccatgctgggtctccccaggaagcacagccgaaccaagtcagcccggattcaccacaaatacagtaagtaaggtagctgattcagtgagtaccaccaggaaacaaaagcgatcgacgtacttgggagtcggccat

SEQ ID NO: 378170 - DNA, 140 bp, Artificial Sequence
  Synthetic
atggccgactcccaagtacgtcgatcgcttttgtttcctggtggtactcactgaatcagctaccttacttactgtatttgtggtgaatccgggctgacttggttcggctgtgcttcctggggagacccagcatggcgtat

SEQ ID NO: 378171 - DNA, 140 bp, Artificial Sequence
  Synthetic
atacgccatgctgggtctcccaattgtttctgcgggccacaacagaactgaggacttactcacttcttaatagaaaagctattgattttcttcttcaacgatggggaggtacctgtcgaacgtacttgggagtcggccat

SEQ ID NO: 378172 - DNA, 140 bp, Artificial Sequence
  Synthetic
atggccgactcccaagtacgttcgacaggtacctccccatcgttgaagaagaaaatcaatagcttttctattaagaagtgagtaagtcctcagttctgttgtggcccgcagaaacaattgggagacccagcatggcgtat

SEQ ID NO: 378173 - DNA, 140 bp, Artificial Sequence
  Synthetic
aggccctggctgctgatatgtgtatatgtaagattttgtgttgatttattctgagatctgagagagaaaaatctcagggttactccaaggagaaatattatctctaaggtttacttgaatgaccttttgggacagcggtg

SEQ ID NO: 378174 - DNA, 140 bp, Artificial Sequence
  Synthetic
caccgctgtcccaaaaggtcattcaagtaaaccttagagataatatttctccttggagtaaccctgagatttttctctctcagatctcagaataaatcaacacaaaatcttacatatacacatatcagcagccagggcct

SEQ ID NO: 378175 - DNA, 140 bp, Artificial Sequence
  Synthetic
atacgccatgctgggtctcctagcttgattcacaatataatatttctcttaataatgattaatatattaagaaaaacttatgatgaagattaaaggggaggatcgctaacgtgaaaatctcgtacttgggagtcggccat

SEQ ID NO: 378176 - DNA, 140 bp, Artificial Sequence
  Synthetic
atggccgactcccaagtacgagattttcacgttagcgatcctcccctttaatcttcatcataagtttttcttaatatattaatcattattaagagaaatattatattgtgaatcaagctaggagacccagcatggcgtat

SEQ ID NO: 378177 - DNA, 140 bp, Artificial Sequence
  Synthetic
atacgccatgctgggtctcccccatctcgcttgtcgaagccacgttggtggtgcttgcagctgagaacaactccagagattgtaggtagaaaggaccagcatttataggtaggggtcagacgtacttgggagtcggccat

SEQ ID NO: 378178 - DNA, 140 bp, Artificial Sequence
  Synthetic
atggccgactcccaagtacgtctgacccctacctataaatgctggtcctttctacctacaatctctggagttgttctcagctgcaagcaccaccaacgtggcttcgacaagcgagatgggggagacccagcatggcgtat

SEQ ID NO: 378179 - DNA, 140 bp, Artificial Sequence
  Synthetic
aggccctggctgctgatatgtagtgtcgtagtctcaggtcttgccacattgtacccagcacaagacaattctacaccatccgaggcaactaatgataccacttagtcaagtacagttgaagaccttttgggacagcggtg

SEQ ID NO: 378180 - DNA, 140 bp, Artificial Sequence
  Synthetic
caccgctgtcccaaaaggtcttcaactgtacttgactaagtggtatcattagttgcctcggatggtgtagaattgtcttgtgctgggtacaatgtggcaagacctgagactacgacactacatatcagcagccagggcct

SEQ ID NO: 378181 - DNA, 140 bp, Artificial Sequence
  Synthetic
atacgccatgctgggtctccaatatagatataatacgacttcggtgtgcaattgtcaagggttccatttagtaataatgatccttaaaacagtctactatcgcaattatcgatggatttacgtacttgggagtcggccat

SEQ ID NO: 378182 - DNA, 140 bp, Artificial Sequence
  Synthetic
atggccgactcccaagtacgtaaatccatcgataattgcgatagtagactgttttaaggatcattattactaaatggaacccttgacaattgcacaccgaagtcgtattatatctatattggagacccagcatggcgtat

SEQ ID NO: 378183 - DNA, 140 bp, Artificial Sequence
  Synthetic
atacgccatgctgggtctccaggtattttgtctagggtatactcaaagtcgtatgtctagcaaattatcaatagcaaagttaaattctcataacctcatattttgattaagtaatcatgacgtacttgggagtcggccat

SEQ ID NO: 378184 - DNA, 140 bp, Artificial Sequence
  Synthetic
atggccgactcccaagtacgtcatgattacttaatcaaaatatgaggttatgagaatttaactttgctattgataatttgctagacatacgactttgagtataccctagacaaaatacctggagacccagcatggcgtat

SEQ ID NO: 378185 - DNA, 140 bp, Artificial Sequence
  Synthetic
aggccctggctgctgatatggcttaaatgaacatttttgaagctgacatacgactacatcatatcatatgaaaacatcgtaattagagcgtccttgaagtctggcattgacagttaccaggaccttttgggacagcggtg

SEQ ID NO: 378186 - DNA, 140 bp, Artificial Sequence
  Synthetic
caccgctgtcccaaaaggtcctggtaactgtcaatgccagacttcaaggacgctctaattacgatgttttcatatgatatgatgtagtcgtatgtcagcttcaaaaatgttcatttaagccatatcagcagccagggcct

SEQ ID NO: 378187 - DNA, 140 bp, Artificial Sequence
  Synthetic
atacgccatgctgggtctccaaaaggcatggctcttctgacaagactcaaaacaaatgactttgctcctgcctgggcgatgacaagaaatcttttcccacatctgttccaaaacccaaatcgtacttgggagtcggccat

SEQ ID NO: 378188 - DNA, 140 bp, Artificial Sequence
  Synthetic
atggccgactcccaagtacgatttgggttttggaacagatgtgggaaaagatttcttgtcatcgcccaggcaggagcaaagtcatttgttttgagtcttgtcagaagagccatgccttttggagacccagcatggcgtat

SEQ ID NO: 378189 - DNA, 140 bp, Artificial Sequence
  Synthetic
atacgccatgctgggtctccttaacaaggtgatcttaaaataagtacatgaatgagaattagttgtgggtcttgcctagcattgttgagttagctatctaatctattttcgctaattacacgtacttgggagtcggccat

SEQ ID NO: 378190 - DNA, 140 bp, Artificial Sequence
  Synthetic
atggccgactcccaagtacgtgtaattagcgaaaatagattagatagctaactcaacaatgctaggcaagacccacaactaattctcattcatgtacttattttaagatcaccttgttaaggagacccagcatggcgtat

SEQ ID NO: 378191 - DNA, 140 bp, Artificial Sequence
  Synthetic
atacgccatgctgggtctccattgtgcagatttaaacctgggttttgccttatgcttcataggtggcctttttgaaatggggattatcagcatttcttcaataggaggagttagcaatcacgtacttgggagtcggccat

SEQ ID NO: 378192 - DNA, 140 bp, Artificial Sequence
  Synthetic
atggccgactcccaagtacgtgattgctaactcctcctattgaagaaatgctgataatccccatttcaaaaaggccacctatgaagcataaggcaaaacccaggtttaaatctgcacaatggagacccagcatggcgtat

SEQ ID NO: 378193 - DNA, 140 bp, Artificial Sequence
  Synthetic
aggccctggctgctgatatgtttgaaatggggattatcagcatttcttcaataggaggagttagcaatcaggaattgaagagaaatggacatcgggatagaacgatgcttaactattggggaccttttgggacagcggtg

SEQ ID NO: 378194 - DNA, 140 bp, Artificial Sequence
  Synthetic
caccgctgtcccaaaaggtccccaatagttaagcatcgttctatcccgatgtccatttctcttcaattcctgattgctaactcctcctattgaagaaatgctgataatccccatttcaaacatatcagcagccagggcct

SEQ ID NO: 378195 - DNA, 140 bp, Artificial Sequence
  Synthetic
atacgccatgctgggtctccaggcaacaggcgcacaggaccgtttgacaaacattacaactagagagaagcttaaaaacgagattttaaacaatgattatgtccatcaattgttcttctgcgtacttgggagtcggccat

SEQ ID NO: 378196 - DNA, 140 bp, Artificial Sequence
  Synthetic
atggccgactcccaagtacgcagaagaacaattgatggacataatcattgtttaaaatctcgtttttaagcttctctctagttgtaatgtttgtcaaacggtcctgtgcgcctgttgcctggagacccagcatggcgtat

SEQ ID NO: 378197 - DNA, 140 bp, Artificial Sequence
  Synthetic
atacgccatgctgggtctcctttggccaaaatccaactttgctctaaattcacagaaagaaaaggtcgtttcctcacacagatgcatttatcagtaataaatgatcttcgggagttgattcgtacttgggagtcggccat

SEQ ID NO: 378198 - DNA, 140 bp, Artificial Sequence
  Synthetic
atggccgactcccaagtacgaatcaactcccgaagatcatttattactgataaatgcatctgtgtgaggaaacgaccttttctttctgtgaatttagagcaaagttggattttggccaaaggagacccagcatggcgtat

SEQ ID NO: 378199 - DNA, 140 bp, Artificial Sequence
  Synthetic
atacgccatgctgggtctcctgtcatctttgaaacatactgtgtattcaagtacaatattgccaagcactatttcgacagccaaggaacttggtacagtgtgatctcagacaggaatttacgtacttgggagtcggccat

SEQ ID NO: 378200 - DNA, 140 bp, Artificial Sequence
  Synthetic
atggccgactcccaagtacgtaaattcctgtctgagatcacactgtaccaagttccttggctgtcgaaatagtgcttggcaatattgtacttgaatacacagtatgtttcaaagatgacaggagacccagcatggcgtat

SEQ ID NO: 378201 - DNA, 140 bp, Artificial Sequence
  Synthetic
atacgccatgctgggtctcccactctcttccatgcctctgctgatttggaagatgagatggtttgtaaatggctcctttcatcaaaccctgtcatgagtcgctttgcagcggatatttttcgtacttgggagtcggccat

SEQ ID NO: 378202 - DNA, 140 bp, Artificial Sequence
  Synthetic
atggccgactcccaagtacgaaaaatatccgctgcaaagcgactcatgacagggtttgatgaaaggagccatttacaaaccatctcatcttccaaatcagcagaggcatggaagagagtgggagacccagcatggcgtat

SEQ ID NO: 378203 - DNA, 140 bp, Artificial Sequence
  Synthetic
aggccctggctgctgatatgcacacatcttagagggtagaccattgatcggagcgacattaccatgtatggtggagcaattcaaagttaagtggctaggacaatatgaaccttgtccagagaccttttgggacagcggtg

SEQ ID NO: 378204 - DNA, 140 bp, Artificial Sequence
  Synthetic
caccgctgtcccaaaaggtctctggacaaggttcatattgtcctagccacttaactttgaattgctccaccatacatggtaatgtcgctccgatcaatggtctaccctctaagatgtgtgcatatcagcagccagggcct

SEQ ID NO: 378205 - DNA, 140 bp, Artificial Sequence
  Synthetic
atacgccatgctgggtctccgcctgctatcaagccgcgatgcccttcatctgccctcaaggaggctatagaattagcatcaaggctcacttgggttacacaagggagttctaatagtgaacgtacttgggagtcggccat

SEQ ID NO: 378206 - DNA, 140 bp, Artificial Sequence
  Synthetic
atggccgactcccaagtacgttcactattagaactcccttgtgtaacccaagtgagccttgatgctaattctatagcctccttgagggcagatgaagggcatcgcggcttgatagcaggcggagacccagcatggcgtat

SEQ ID NO: 378207 - DNA, 140 bp, Artificial Sequence
  Synthetic
aggccctggctgctgatatgataatgaccaatatagcccgcactcatttatggcgaatcgcatgagcaatactgcaacccgtctcatagtgtcaactaatacacttggagaattttcagggaccttttgggacagcggtg

SEQ ID NO: 378208 - DNA, 140 bp, Artificial Sequence
  Synthetic
caccgctgtcccaaaaggtccctgaaaattctccaagtgtattagttgacactatgagacgggttgcagtattgctcatgcgattcgccataaatgagtgcgggctatattggtcattatcatatcagcagccagggcct

SEQ ID NO: 378209 - DNA, 140 bp, Artificial Sequence
  Synthetic
atacgccatgctgggtctccggaggattgaactgcaatttaacaatggatagtcctttagtgaagggtcctaggcttaacatgattgaagatgatcttctccgctttccacacctttctgcgtacttgggagtcggccat

SEQ ID NO: 378210 - DNA, 140 bp, Artificial Sequence
  Synthetic
atggccgactcccaagtacgcagaaaggtgtggaaagcggagaagatcatcttcaatcatgttaagcctaggacccttcactaaaggactatccattgttaaattgcagttcaatcctccggagacccagcatggcgtat

SEQ ID NO: 378211 - DNA, 140 bp, Artificial Sequence
  Synthetic
aggccctggctgctgatatggatgggagttagcgaaaacggtggtgcaatccatcatctcggacaatagcaactcatcaacagatccaatcagtagtggagaaacacgctctttcacaacgaccttttgggacagcggtg

SEQ ID NO: 378212 - DNA, 140 bp, Artificial Sequence
  Synthetic
caccgctgtcccaaaaggtcgttgtgaaagagcgtgtttctccactactgattggatctgttgatgagttgctattgtccgagatgatggattgcaccaccgttttcgctaactcccatccatatcagcagccagggcct

SEQ ID NO: 378213 - DNA, 140 bp, Artificial Sequence
  Synthetic
atacgccatgctgggtctcctctggagatcgagggttgtctgatgctgctcgattgtttcttcggacagcaatcgcgggttttttacaatttcttaagagctggatcatcgatcgccaaacgtacttgggagtcggccat

SEQ ID NO: 378214 - DNA, 140 bp, Artificial Sequence
  Synthetic
atggccgactcccaagtacgtttggcgatcgatgatccagctcttaagaaattgtaaaaaacccgcgattgctgtccgaagaaacaatcgagcagcatcagacaaccctcgatctccagaggagacccagcatggcgtat

SEQ ID NO: 378215 - DNA, 140 bp, Artificial Sequence
  Synthetic
atacgccatgctgggtctccaaacaatccctttatggatagtatatccgcttgaaggtcaacagccggaacccatcaatgaatttctacataaaattttaggtctgctcaaacaaggccccgtacttgggagtcggccat

SEQ ID NO: 378216 - DNA, 140 bp, Artificial Sequence
  Synthetic
atggccgactcccaagtacggggccttgtttgagcagacctaaaattttatgtagaaattcattgatgggttccggctgttgaccttcaagcggatatactatccataaagggattgtttggagacccagcatggcgtat

SEQ ID NO: 378217 - DNA, 140 bp, Artificial Sequence
  Synthetic
atacgccatgctgggtctccagaccataatgatttctcaagagggaatggaacacttacagaacccgtgcgtaagttatcaagcaatcaacagtcagatgaaaagtactacagtgtaacacgtacttgggagtcggccat

SEQ ID NO: 378218 - DNA, 140 bp, Artificial Sequence
  Synthetic
atggccgactcccaagtacgtgttacactgtagtacttttcatctgactgttgattgcttgataacttacgcacgggttctgtaagtgttccattccctcttgagaaatcattatggtctggagacccagcatggcgtat

SEQ ID NO: 378219 - DNA, 140 bp, Artificial Sequence
  Synthetic
atacgccatgctgggtctcctgtatcaagtcctcatcgactcattctaccatttttcaaattgggaaatcacaaccatgcaaatgatcaagatgcccaagaattgataaatcaaaatattcgtacttgggagtcggccat

SEQ ID NO: 378220 - DNA, 140 bp, Artificial Sequence
  Synthetic
atggccgactcccaagtacgaatattttgatttatcaattcttgggcatcttgatcatttgcatggttgtgatttcccaatttgaaaaatggtagaatgagtcgatgaggacttgatacaggagacccagcatggcgtat

SEQ ID NO: 378221 - DNA, 140 bp, Artificial Sequence
  Synthetic
atacgccatgctgggtctcccctgatgagagagagtcgcactcaaacgtaccattttattaagactgcaaaaggcagaatcacaaagttggtcaatgactttctgaagttttctttaattcgtacttgggagtcggccat

SEQ ID NO: 378222 - DNA, 140 bp, Artificial Sequence
  Synthetic
atggccgactcccaagtacgaattaaagaaaacttcagaaagtcattgaccaactttgtgattctgccttttgcagtcttaataaaatggtacgtttgagtgcgactctctctcatcaggggagacccagcatggcgtat

SEQ ID NO: 378223 - DNA, 140 bp, Artificial Sequence
  Synthetic
aggccctggctgctgatatggatgcagaaatcaagctaattgaacgccttaccgggttaatgcgattttatccagaagggttaatatgttccaaccatacataggtactagatcatcatagaccttttgggacagcggtg

SEQ ID NO: 378224 - DNA, 140 bp, Artificial Sequence
  Synthetic
caccgctgtcccaaaaggtctatgatgatctagtacctatgtatggttggaacatattaacccttctggataaaatcgcattaacccggtaaggcgttcaattagcttgatttctgcatccatatcagcagccagggcct

SEQ ID NO: 378225 - DNA, 140 bp, Artificial Sequence
  Synthetic
atacgccatgctgggtctcctctaagtatatcggaagagagtatgccaatttaaattattaaaggtaacaagctattagttattacttattgataagaataaactttatcatagtgtaaccgtacttgggagtcggccat

SEQ ID NO: 378226 - DNA, 140 bp, Artificial Sequence
  Synthetic
atggccgactcccaagtacggttacactatgataaagtttattcttatcaataagtaataactaatagcttgttacctttaataatttaaattggcatactctcttccgatatacttagaggagacccagcatggcgtat

SEQ ID NO: 378227 - DNA, 140 bp, Artificial Sequence
  Synthetic
aggccctggctgctgatatgagctattagttattacttattgataagaataaactttatcatagtgtaacacatcataactttatgacgattttgcatttctaatcctagtatttattaggaccttttgggacagcggtg

SEQ ID NO: 378228 - DNA, 140 bp, Artificial Sequence
  Synthetic
caccgctgtcccaaaaggtcctaataaatactaggattagaaatgcaaaatcgtcataaagttatgatgtgttacactatgataaagtttattcttatcaataagtaataactaatagctcatatcagcagccagggcct

SEQ ID NO: 378229 - DNA, 140 bp, Artificial Sequence
  Synthetic
atacgccatgctgggtctcctgtgtattaagttgttagtttattaagtttatgagttggttacacagtgagtattagtaattgaggattaggtagataggtaatctaacactgaatcacccgtacttgggagtcggccat

SEQ ID NO: 378230 - DNA, 140 bp, Artificial Sequence
  Synthetic
atggccgactcccaagtacgggtgattcagtgttagattacctatctacctaatcctcaattactaatactcactgtgtaaccaactcataaacttaataaactaacaacttaatacacaggagacccagcatggcgtat

SEQ ID NO: 378231 - DNA, 140 bp, Artificial Sequence
  Synthetic
atacgccatgctgggtctcctatcttcagttaagtaacatagactgaaaatgctgagaagagtttggagtaaaagtataaaataaatttaattaaacttcaaagtgcttaaatgataaagcgtacttgggagtcggccat

SEQ ID NO: 378232 - DNA, 140 bp, Artificial Sequence
  Synthetic
atggccgactcccaagtacgctttatcatttaagcactttgaagtttaattaaatttattttatacttttactccaaactcttctcagcattttcagtctatgttacttaactgaagataggagacccagcatggcgtat

SEQ ID NO: 378233 - DNA, 140 bp, Artificial Sequence
  Synthetic
aggccctggctgctgatatgaaaagtataaaataaatttaattaaacttcaaagtgcttaaatgataaagatcttgggaactcgatataacctcaaatcaaaaataatgtcaatataattgaccttttgggacagcggtg

SEQ ID NO: 378234 - DNA, 140 bp, Artificial Sequence
  Synthetic
caccgctgtcccaaaaggtcaattatattgacattatttttgatttgaggttatatcgagttcccaagatctttatcatttaagcactttgaagtttaattaaatttattttatacttttcatatcagcagccagggcct

SEQ ID NO: 378235 - DNA, 140 bp, Artificial Sequence
  Synthetic
atacgccatgctgggtctccgggacacacaaaagaaaaaggttttttaagattttttgtgtgcgagtaactatgaggaagattaacagttttcctcagtttaaggtatacactgaaattgcgtacttgggagtcggccat

SEQ ID NO: 378236 - DNA, 140 bp, Artificial Sequence
  Synthetic
atggccgactcccaagtacgcaatttcagtgtataccttaaactgaggaaaactgttaatcttcctcatagttactcgcacacaaaaaatcttaaaaaacctttttcttttgtgtgtcccggagacccagcatggcgtat

SEQ ID NO: 378237 - DNA, 140 bp, Artificial Sequence
  Synthetic
atacgccatgctgggtctccgggaagtcgatatggatcgtgggaccagaagaatctgggtgtcgcaaaatcaaggtgatactgatttagattatcataaaattttgacagctggccttaccgtacttgggagtcggccat

SEQ ID NO: 378238 - DNA, 140 bp, Artificial Sequence
  Synthetic
atggccgactcccaagtacggtaaggccagctgtcaaaattttatgataatctaaatcagtatcaccttgattttgcgacacccagattcttctggtcccacgatccatatcgacttcccggagacccagcatggcgtat

SEQ ID NO: 378239 - DNA, 140 bp, Artificial Sequence
  Synthetic
atacgccatgctgggtctcccagggcaatttctctcatttgcgagtttgtttcttcccaaactggttgtgggagagaaggcttgcttggaaaaagtccagcgacaaattcaggttcatgccgtacttgggagtcggccat

SEQ ID NO: 378240 - DNA, 140 bp, Artificial Sequence
  Synthetic
atggccgactcccaagtacggcatgaacctgaatttgtcgctggactttttccaagcaagccttctctcccacaaccagtttgggaagaaacaaactcgcaaatgagagaaattgccctgggagacccagcatggcgtat

SEQ ID NO: 378241 - DNA, 140 bp, Artificial Sequence
  Synthetic
atacgccatgctgggtctccgctatcaattattatcacatgatgaaggatgagccggtaatatttagcactgatgatgggaaggaatacacctacccggattcacttgaggaagcctatccgtacttgggagtcggccat

SEQ ID NO: 378242 - DNA, 140 bp, Artificial Sequence
  Synthetic
atggccgactcccaagtacggataggcttcctcaagtgaatccgggtaggtgtattccttcccatcatcagtgctaaatattaccggctcatccttcatcatgtgataataattgatagcggagacccagcatggcgtat

SEQ ID NO: 378243 - DNA, 140 bp, Artificial Sequence
  Synthetic
atacgccatgctgggtctcctacataaataatcaacagttcttctggcctgtcatgagtcccagagacaaatttcttgcaatcttgcagcaccatcagtaaccacagcacaaagcgcggtcgtacttgggagtcggccat

SEQ ID NO: 378244 - DNA, 140 bp, Artificial Sequence
  Synthetic
atggccgactcccaagtacgaccgcgctttgtgctgtggttactgatggtgctgcaagattgcaagaaatttgtctctgggactcatgacaggccagaagaactgttgattatttatgtaggagacccagcatggcgtat

SEQ ID NO: 378245 - DNA, 140 bp, Artificial Sequence
  Synthetic
atacgccatgctgggtctccaactaatccattataacttattagtgctacttttctataagtgattctcaatctaaggccattaagagtttaagcaatatacatatacacttacaccggtcgtacttgggagtcggccat

SEQ ID NO: 378246 - DNA, 140 bp, Artificial Sequence
  Synthetic
atggccgactcccaagtacgaccggtgtaagtgtatatgtatattgcttaaactcttaatggccttagattgagaatcacttatagaaaagtagcactaataagttataatggattagttggagacccagcatggcgtat

SEQ ID NO: 378247 - DNA, 140 bp, Artificial Sequence
  Synthetic
aggccctggctgctgatatgagcaaatacctatttggcttccactgggtgtagctgatcagaagatatacagctttgattcaacaacagccgcaattatgttggcttcctacacagtgacgaccttttgggacagcggtg

SEQ ID NO: 378248 - DNA, 140 bp, Artificial Sequence
  Synthetic
caccgctgtcccaaaaggtcgtcactgtgtaggaagccaacataattgcggctgttgttgaatcaaagctgtatatcttctgatcagctacacccagtggaagccaaataggtatttgctcatatcagcagccagggcct

SEQ ID NO: 378249 - DNA, 140 bp, Artificial Sequence
  Synthetic
atacgccatgctgggtctcccaggaatacccgatcatccgctacgactcctaaggttgggcaatcaggcattccttcaagagtttgttcttccaccagtccagcttccccagtatttcaccgtacttgggagtcggccat

SEQ ID NO: 378250 - DNA, 140 bp, Artificial Sequence
  Synthetic
atggccgactcccaagtacggtgaaatactggggaagctggactggtggaagaacaaactcttgaaggaatgcctgattgcccaaccttaggagtcgtagcggatgatcgggtattcctgggagacccagcatggcgtat

SEQ ID NO: 378251 - DNA, 140 bp, Artificial Sequence
  Synthetic
atacgccatgctgggtctccttaacaatcgctagtaattttaatctccagattaagaaaaagatatacgatgaagattaaggcgacaacgagccgaaacttcatctcttttaaagatctacgtacttgggagtcggccat

SEQ ID NO: 378252 - DNA, 140 bp, Artificial Sequence
  Synthetic
atggccgactcccaagtacgtagatctttaaaagagatgaagtttcggctcgttgtcgccttaatcttcatcgtatatctttttcttaatctggagattaaaattactagcgattgttaaggagacccagcatggcgtat

SEQ ID NO: 378253 - DNA, 140 bp, Artificial Sequence
  Synthetic
atacgccatgctgggtctccgacaaccacacatatgtgcaactagatcgtccacacactccgcagttccttgttcagctcaatgaaacacttcgaagaaataatcgccttagcaacagtacgtacttgggagtcggccat

SEQ ID NO: 378254 - DNA, 140 bp, Artificial Sequence
  Synthetic
atggccgactcccaagtacgtactgttgctaaggcgattatttcttcgaagtgtttcattgagctgaacaaggaactgcggagtgtgtggacgatctagttgcacatatgtgtggttgtcggagacccagcatggcgtat

SEQ ID NO: 378255 - DNA, 140 bp, Artificial Sequence
  Synthetic
atacgccatgctgggtctccgagtgggccttctgggaaactaaaaaaacttttcccaacaacttcatggagaaaacttgcatttccaaattctatcaacccacaccaacaactcctcagacgtacttgggagtcggccat

SEQ ID NO: 378256 - DNA, 140 bp, Artificial Sequence
  Synthetic
atggccgactcccaagtacgtctgaggagttgttggtgtgggttgatagaatttggaaatgcaagttttctccatgaagttgttgggaaaagtttttttagtttcccagaaggcccactcggagacccagcatggcgtat

SEQ ID NO: 378257 - DNA, 140 bp, Artificial Sequence
  Synthetic
atacgccatgctgggtctcccaagtccaaccatgacaagcgaggttgataacaatgtaccaagtgaacaaccgaacaacacagcatccattgaagactcccccccatcggcaagcaacgacgtacttgggagtcggccat

SEQ ID NO: 378258 - DNA, 140 bp, Artificial Sequence
  Synthetic
atggccgactcccaagtacgtcgttgcttgccgatgggggggagtcttcaatggatgctgtgttgttcggttgttcacttggtacattgttatcaacctcgcttgtcatggttggacttgggagacccagcatggcgtat

SEQ ID NO: 378259 - DNA, 140 bp, Artificial Sequence
  Synthetic
atacgccatgctgggtctccaggaagcgcagccggaccaagtcagcccggactcactataaatacaataagtaaggtagctgattcactgagtcccaccaggaaacaaaagcgatcggttcgtacttgggagtcggccat

SEQ ID NO: 378260 - DNA, 140 bp, Artificial Sequence
  Synthetic
atggccgactcccaagtacgaaccgatcgcttttgtttcctggtgggactcagtgaatcagctaccttacttattgtatttatagtgagtccgggctgacttggtccggctgcgcttcctggagacccagcatggcgtat

SEQ ID NO: 378261 - DNA, 140 bp, Artificial Sequence
  Synthetic
atacgccatgctgggtctccgctggaattgggattattggagttataattgctataatagccctactttgtatatgtaagattttgtgttgatttattctgagatctgagagaaaaaaatcgtacttgggagtcggccat

SEQ ID NO: 378262 - DNA, 140 bp, Artificial Sequence
  Synthetic
atggccgactcccaagtacgatttttttctctcagatctcagaataaatcaacacaaaatcttacatatacaaagtagggctattatagcaattataactccaataatcccaattccagcggagacccagcatggcgtat

SEQ ID NO: 378263 - DNA, 140 bp, Artificial Sequence
  Synthetic
atacgccatgctgggtctcccatctcgttcgtcgaagccacgttggtggtgcttgcagctgagaacaactccagagattgtaggtagaaaggaccagcatttataggtaggggtcagaaacgtacttgggagtcggccat

SEQ ID NO: 378264 - DNA, 140 bp, Artificial Sequence
  Synthetic
atggccgactcccaagtacgtttctgacccctacctataaatgctggtcctttctacctacaatctctggagttgttctcagctgcaagcaccaccaacgtggcttcgacgaacgagatgggagacccagcatggcgtat

SEQ ID NO: 378265 - DNA, 140 bp, Artificial Sequence
  Synthetic
aggccctggctgctgatatgcaaccagagacctaaggcaaattgaggactctaaacttagagctcttttaaccctttgtgccgtattaacaaggaaattttctaaatcccaactgggtctgaccttttgggacagcggtg
